United States Patent 7,341,835 (METHODS OF ANALYSIS OF ALTERNATIVE SPLICING IN MOUSE) - sequence listing, part 15

SEQ ID NO: 558853 - DNA, 25 bp, Mus musculus
cacccttcatctgctggtgcgggat

SEQ ID NO: 558854 - DNA, 25 bp, Mus musculus
cacccttctaaccagcatacaggta

SEQ ID NO: 558855 - DNA, 25 bp, Mus musculus
cacccttctaacgagcatacaggta

SEQ ID NO: 558856 - DNA, 25 bp, Mus musculus
cacccttcttgcatggatatgacca

SEQ ID NO: 558857 - DNA, 25 bp, Mus musculus
cacccttcttgcttggatatgacca

SEQ ID NO: 558858 - DNA, 25 bp, Mus musculus
cacccttgaactaaacatgtaggag

SEQ ID NO: 558859 - DNA, 25 bp, Mus musculus
cacccttgaacttaacatgtaggag

SEQ ID NO: 558860 - DNA, 25 bp, Mus musculus
cacccttgggaaaggagagtctaga

SEQ ID NO: 558861 - DNA, 25 bp, Mus musculus
cacccttgggaatggagagtctaga

SEQ ID NO: 558862 - DNA, 25 bp, Mus musculus
cacccttgtactaggctgagtggca

SEQ ID NO: 558863 - DNA, 25 bp, Mus musculus
cacccttgtacttggctgagtggca

SEQ ID NO: 558864 - DNA, 25 bp, Mus musculus
cacccttgtggcctgtctttcaggc

SEQ ID NO: 558865 - DNA, 25 bp, Mus musculus
cacccttgtggcgtgtctttcaggc

SEQ ID NO: 558866 - DNA, 25 bp, Mus musculus
caccgaacgctcagggctttttcca

SEQ ID NO: 558867 - DNA, 25 bp, Mus musculus
caccgaacgctctgggctttttcca

SEQ ID NO: 558868 - DNA, 25 bp, Mus musculus
caccgaactggtcttagcggcgagc

SEQ ID NO: 558869 - DNA, 25 bp, Mus musculus
caccgaactggtgttagcggcgagc

SEQ ID NO: 558870 - DNA, 25 bp, Mus musculus
caccgaaggctacaatgggaccatt

SEQ ID NO: 558871 - DNA, 25 bp, Mus musculus
caccgaaggctagaatgggaccatt

SEQ ID NO: 558872 - DNA, 25 bp, Mus musculus
caccgaagggctattatacggctcg

SEQ ID NO: 558873 - DNA, 25 bp, Mus musculus
caccgaagggcttttatacggctcg

SEQ ID NO: 558874 - DNA, 25 bp, Mus musculus
caccgaagtagcagccaacgtctga

SEQ ID NO: 558875 - DNA, 25 bp, Mus musculus
caccgaagtagcctctcttcagtgg

SEQ ID NO: 558876 - DNA, 25 bp, Mus musculus
caccgaagtagcgtctcttcagtgg

SEQ ID NO: 558877 - DNA, 25 bp, Mus musculus
caccgaagtagctgccaacgtctga

SEQ ID NO: 558878 - DNA, 25 bp, Mus musculus
caccgaagttcaccctaaaggctgg

SEQ ID NO: 558879 - DNA, 25 bp, Mus musculus
caccgaagttcagcctaaaggctgg

SEQ ID NO: 558880 - DNA, 25 bp, Mus musculus
caccgaattccgagaagccgggagg

SEQ ID NO: 558881 - DNA, 25 bp, Mus musculus
caccgaattccgtgaagccgggagg

SEQ ID NO: 558882 - DNA, 25 bp, Mus musculus
caccgacagcatcaagtacgtgttg

SEQ ID NO: 558883 - DNA, 25 bp, Mus musculus
caccgacagcatgaagtacgtgttg

SEQ ID NO: 558884 - DNA, 25 bp, Mus musculus
caccgacagtcactaggcatctggc

SEQ ID NO: 558885 - DNA, 25 bp, Mus musculus
caccgacagtcagtaggcatctggc

SEQ ID NO: 558886 - DNA, 25 bp, Mus musculus
caccgacattgaactcaagtgcaag

SEQ ID NO: 558887 - DNA, 25 bp, Mus musculus
caccgacattgatctcaagtgcaag

SEQ ID NO: 558888 - DNA, 25 bp, Mus musculus
caccgaccgggcactcaagttgagt

SEQ ID NO: 558889 - DNA, 25 bp, Mus musculus
caccgaccgggctctcaagttgagt

SEQ ID NO: 558890 - DNA, 25 bp, Mus musculus
caccgacggctgctcaatgaatggc

SEQ ID NO: 558891 - DNA, 25 bp, Mus musculus
caccgacggctggtcaatgaatggc

SEQ ID NO: 558892 - DNA, 25 bp, Mus musculus
caccgactatgcctcctattaggtc

SEQ ID NO: 558893 - DNA, 25 bp, Mus musculus
caccgactatgcgtcctattaggtc

SEQ ID NO: 558894 - DNA, 25 bp, Mus musculus
caccgactcttgctgtctctgcagg

SEQ ID NO: 558895 - DNA, 25 bp, Mus musculus
caccgactcttggtgtctctgcagg

SEQ ID NO: 558896 - DNA, 25 bp, Mus musculus
caccgactctttaggcagccaaggg

SEQ ID NO: 558897 - DNA, 25 bp, Mus musculus
caccgactcttttggcagccaaggg

SEQ ID NO: 558898 - DNA, 25 bp, Mus musculus
caccgagaaaatcgctacttttgag

SEQ ID NO: 558899 - DNA, 25 bp, Mus musculus
caccgagaaaatggctacttttgag

SEQ ID NO: 558900 - DNA, 25 bp, Mus musculus
caccgagaaaggatggagctgaaat

SEQ ID NO: 558901 - DNA, 25 bp, Mus musculus
caccgagaaaggttggagctgaaat

SEQ ID NO: 558902 - DNA, 25 bp, Mus musculus
caccgagaaagtatgcgcaacatga

SEQ ID NO: 558903 - DNA, 25 bp, Mus musculus
caccgagaaagtttgcgcaacatga

SEQ ID NO: 558904 - DNA, 25 bp, Mus musculus
caccgagagtttcccatggaagctg

SEQ ID NO: 558905 - DNA, 25 bp, Mus musculus
caccgagagtttgccatggaagctg

SEQ ID NO: 558906 - DNA, 25 bp, Mus musculus
caccgagataagagctttcacgttt

SEQ ID NO: 558907 - DNA, 25 bp, Mus musculus
caccgagataagtgctttcacgttt

SEQ ID NO: 558908 - DNA, 25 bp, Mus musculus
caccgagatgttccagggcatgaga

SEQ ID NO: 558909 - DNA, 25 bp, Mus musculus
caccgagatgttgcagggcatgaga

SEQ ID NO: 558910 - DNA, 25 bp, Mus musculus
caccgagcgagtcacaccgtggtat

SEQ ID NO: 558911 - DNA, 25 bp, Mus musculus
caccgagcgagtgacaccgtggtat

SEQ ID NO: 558912 - DNA, 25 bp, Mus musculus
caccgagctgttcatcaagtgatta

SEQ ID NO: 558913 - DNA, 25 bp, Mus musculus
caccgagctgttgatcaagtgatta

SEQ ID NO: 558914 - DNA, 25 bp, Mus musculus
caccgaggaaataaatacttggcca

SEQ ID NO: 558915 - DNA, 25 bp, Mus musculus
caccgaggaaattaatacttggcca

SEQ ID NO: 558916 - DNA, 25 bp, Mus musculus
caccgaggatggcttcagtctgaag

SEQ ID NO: 558917 - DNA, 25 bp, Mus musculus
caccgaggatgggttcagtctgaag

SEQ ID NO: 558918 - DNA, 25 bp, Mus musculus
caccgaggtgtccaaggtgcccagt

SEQ ID NO: 558919 - DNA, 25 bp, Mus musculus
caccgaggtgtcgaaggtgcccagt

SEQ ID NO: 558920 - DNA, 25 bp, Mus musculus
caccgagtagaaacgaaaatgaaag

SEQ ID NO: 558921 - DNA, 25 bp, Mus musculus
caccgagtagaatcgaaaatgaaag

SEQ ID NO: 558922 - DNA, 25 bp, Mus musculus
caccgagtggcaatcgtcagcgaaa

SEQ ID NO: 558923 - DNA, 25 bp, Mus musculus
caccgagtggcattcgtcagcgaaa

SEQ ID NO: 558924 - DNA, 25 bp, Mus musculus
caccgagtttcgctgcaagctgctc

SEQ ID NO: 558925 - DNA, 25 bp, Mus musculus
caccgagtttcggtgcaagctgctc

SEQ ID NO: 558926 - DNA, 25 bp, Mus musculus
caccgagtttggcaagatgtccctg

SEQ ID NO: 558927 - DNA, 25 bp, Mus musculus
caccgagtttgggaagatgtccctg

SEQ ID NO: 558928 - DNA, 25 bp, Mus musculus
caccgatcggagcagttctttttag

SEQ ID NO: 558929 - DNA, 25 bp, Mus musculus
caccgatcggaggagttctttttag

SEQ ID NO: 558930 - DNA, 25 bp, Mus musculus
caccgatgacttctaaagggaagac

SEQ ID NO: 558931 - DNA, 25 bp, Mus musculus
caccgatgacttgtaaagggaagac

SEQ ID NO: 558932 - DNA, 25 bp, Mus musculus
caccgatgatatagtcctaatggca

SEQ ID NO: 558933 - DNA, 25 bp, Mus musculus
caccgatgatattgtcctaatggca

SEQ ID NO: 558934 - DNA, 25 bp, Mus musculus
caccgatgcaagcagatgtctgagt

SEQ ID NO: 558935 - DNA, 25 bp, Mus musculus
caccgatgcaaggagatgtctgagt

SEQ ID NO: 558936 - DNA, 25 bp, Mus musculus
caccgatgcctaaaccctgagcgga

SEQ ID NO: 558937 - DNA, 25 bp, Mus musculus
caccgatgcctataccctgagcgga

SEQ ID NO: 558938 - DNA, 25 bp, Mus musculus
caccgatgtggaaagcttcgattta

SEQ ID NO: 558939 - DNA, 25 bp, Mus musculus
caccgatgtggatagcttcgattta

SEQ ID NO: 558940 - DNA, 25 bp, Mus musculus
caccgattatggattggcaacctgg

SEQ ID NO: 558941 - DNA, 25 bp, Mus musculus
caccgattatggtttggcaacctgg

SEQ ID NO: 558942 - DNA, 25 bp, Mus musculus
caccgattctgaacatcaaacaggg

SEQ ID NO: 558943 - DNA, 25 bp, Mus musculus
caccgattctgatcatcaaacaggg

SEQ ID NO: 558944 - DNA, 25 bp, Mus musculus
caccgcaacaagatgtacaaggaca

SEQ ID NO: 558945 - DNA, 25 bp, Mus musculus
caccgcaacaagttgtacaaggaca

SEQ ID NO: 558946 - DNA, 25 bp, Mus musculus
caccgcaatgtgaaaaaccaagaac

SEQ ID NO: 558947 - DNA, 25 bp, Mus musculus
caccgcaatgtgtaaaaccaagaac

SEQ ID NO: 558948 - DNA, 25 bp, Mus musculus
caccgcacaggcactctggagttca

SEQ ID NO: 558949 - DNA, 25 bp, Mus musculus
caccgcacaggctctctggagttca

SEQ ID NO: 558950 - DNA, 25 bp, Mus musculus
caccgcagagggagaccctaacgct

SEQ ID NO: 558951 - DNA, 25 bp, Mus musculus
caccgcagagggtgaccctaacgct

SEQ ID NO: 558952 - DNA, 25 bp, Mus musculus
caccgcagattgaggaggcctgtga

SEQ ID NO: 558953 - DNA, 25 bp, Mus musculus
caccgcagattgtggaggcctgtga

SEQ ID NO: 558954 - DNA, 25 bp, Mus musculus
caccgcagcctccagtagtggtcag

SEQ ID NO: 558955 - DNA, 25 bp, Mus musculus
caccgcagcctcgagtagtggtcag

SEQ ID NO: 558956 - DNA, 25 bp, Mus musculus
caccgcaggatcacggacccggatg

SEQ ID NO: 558957 - DNA, 25 bp, Mus musculus
caccgcaggatctcggacccggatg

SEQ ID NO: 558958 - DNA, 25 bp, Mus musculus
caccgcagggctccgctgtagctgt

SEQ ID NO: 558959 - DNA, 25 bp, Mus musculus
caccgcagggctgcgctgtagctgt

SEQ ID NO: 558960 - DNA, 25 bp, Mus musculus
caccgcagtggtacgggaaatgacc

SEQ ID NO: 558961 - DNA, 25 bp, Mus musculus
caccgcagtggttcgggaaatgacc

SEQ ID NO: 558962 - DNA, 25 bp, Mus musculus
caccgcatggtaaggtccacgtcac

SEQ ID NO: 558963 - DNA, 25 bp, Mus musculus
caccgcatggtatggtccacgtcac

SEQ ID NO: 558964 - DNA, 25 bp, Mus musculus
caccgccacctgcattgaggctgag

SEQ ID NO: 558965 - DNA, 25 bp, Mus musculus
caccgccacctggattgaggctgag

SEQ ID NO: 558966 - DNA, 25 bp, Mus musculus
caccgccagatgagagcctactagg

SEQ ID NO: 558967 - DNA, 25 bp, Mus musculus
caccgccagatgtgagcctactagg

SEQ ID NO: 558968 - DNA, 25 bp, Mus musculus
caccgccatatacaggaaggtctgg

SEQ ID NO: 558969 - DNA, 25 bp, Mus musculus
caccgccatatagaggaaggtctgg

SEQ ID NO: 558970 - DNA, 25 bp, Mus musculus
caccgccatgggatagagaggcaga

SEQ ID NO: 558971 - DNA, 25 bp, Mus musculus
caccgccatgggttagagaggcaga

SEQ ID NO: 558972 - DNA, 25 bp, Mus musculus
caccgcccagttacaaggcctggaa

SEQ ID NO: 558973 - DNA, 25 bp, Mus musculus
caccgcccagtttcaaggcctggaa

SEQ ID NO: 558974 - DNA, 25 bp, Mus musculus
caccgcccgtggattcatctgtagg

SEQ ID NO: 558975 - DNA, 25 bp, Mus musculus
caccgcccgtggtttcatctgtagg

SEQ ID NO: 558976 - DNA, 25 bp, Mus musculus
caccgccgccagactgaggcaggtg

SEQ ID NO: 558977 - DNA, 25 bp, Mus musculus
caccgccgccagtctgaggcaggtg

SEQ ID NO: 558978 - DNA, 25 bp, Mus musculus
caccgcctcataaagggagagaaat

SEQ ID NO: 558979 - DNA, 25 bp, Mus musculus
caccgcctcatatagggagagaaat

SEQ ID NO: 558980 - DNA, 25 bp, Mus musculus
caccgcctcatgacagatgccagga

SEQ ID NO: 558981 - DNA, 25 bp, Mus musculus
caccgcctcatgtcagatgccagga

SEQ ID NO: 558982 - DNA, 25 bp, Mus musculus
caccgccttgtgagatggaatcaat

SEQ ID NO: 558983 - DNA, 25 bp, Mus musculus
caccgccttgtgtgatggaatcaat

SEQ ID NO: 558984 - DNA, 25 bp, Mus musculus
caccgcctttaaatgcagggagcga

SEQ ID NO: 558985 - DNA, 25 bp, Mus musculus
caccgcctttaattgcagggagcga

SEQ ID NO: 558986 - DNA, 25 bp, Mus musculus
caccgcgtggagaaacgatgattcc

SEQ ID NO: 558987 - DNA, 25 bp, Mus musculus
caccgcgtggagtaacgatgattcc

SEQ ID NO: 558988 - DNA, 25 bp, Mus musculus
caccgctccatacctgtgaaagatg

SEQ ID NO: 558989 - DNA, 25 bp, Mus musculus
caccgctccatagctgtgaaagatg

SEQ ID NO: 558990 - DNA, 25 bp, Mus musculus
caccgctctcaaagtccgagcagga

SEQ ID NO: 558991 - DNA, 25 bp, Mus musculus
caccgctctcaatgtccgagcagga

SEQ ID NO: 558992 - DNA, 25 bp, Mus musculus
caccgctctgaaagggatctgcaga

SEQ ID NO: 558993 - DNA, 25 bp, Mus musculus
caccgctctgaatgggatctgcaga

SEQ ID NO: 558994 - DNA, 25 bp, Mus musculus
caccgctgaatcacctggctgactt

SEQ ID NO: 558995 - DNA, 25 bp, Mus musculus
caccgctgaatctcctggctgactt

SEQ ID NO: 558996 - DNA, 25 bp, Mus musculus
caccgctggtgaactggcatgggat

SEQ ID NO: 558997 - DNA, 25 bp, Mus musculus
caccgctggtgatctggcatgggat

SEQ ID NO: 558998 - DNA, 25 bp, Mus musculus
caccgctgtgtgcatggagtgcttc

SEQ ID NO: 558999 - DNA, 25 bp, Mus musculus
caccgctgtgtggatggagtgcttc

SEQ ID NO: 559000 - DNA, 25 bp, Mus musculus
caccgcttcactatgctgctggagg

SEQ ID NO: 559001 - DNA, 25 bp, Mus musculus
caccgcttcactttgctgctggagg

SEQ ID NO: 559002 - DNA, 25 bp, Mus musculus
caccgcttgggcagtttgtgtccct

SEQ ID NO: 559003 - DNA, 25 bp, Mus musculus
caccgcttgggctgtttgtgtccct

SEQ ID NO: 559004 - DNA, 25 bp, Mus musculus
caccgcttttggaccaggagcttaa

SEQ ID NO: 559005 - DNA, 25 bp, Mus musculus
caccgcttttggtccaggagcttaa

SEQ ID NO: 559006 - DNA, 25 bp, Mus musculus
caccggaaagccctgtgcaggaact

SEQ ID NO: 559007 - DNA, 25 bp, Mus musculus
caccggaaagccgtgtgcaggaact

SEQ ID NO: 559008 - DNA, 25 bp, Mus musculus
caccggaaccagagtcagtactgtc

SEQ ID NO: 559009 - DNA, 25 bp, Mus musculus
caccggaaccagtgtcagtactgtc

SEQ ID NO: 559010 - DNA, 25 bp, Mus musculus
caccggacatagagggcaagacctc

SEQ ID NO: 559011 - DNA, 25 bp, Mus musculus
caccggacatagtgggcaagacctc

SEQ ID NO: 559012 - DNA, 25 bp, Mus musculus
caccggaccgctcacttatctggaa

SEQ ID NO: 559013 - DNA, 25 bp, Mus musculus
caccggaccgctgacttatctggaa

SEQ ID NO: 559014 - DNA, 25 bp, Mus musculus
caccggagagtccatctagagagaa

SEQ ID NO: 559015 - DNA, 25 bp, Mus musculus
caccggagagtcgatctagagagaa

SEQ ID NO: 559016 - DNA, 25 bp, Mus musculus
caccggagctagaccgtttgtgtgc

SEQ ID NO: 559017 - DNA, 25 bp, Mus musculus
caccggagctagtccgtttgtgtgc

SEQ ID NO: 559018 - DNA, 25 bp, Mus musculus
caccggagtcctctttggagacttt

SEQ ID NO: 559019 - DNA, 25 bp, Mus musculus
caccggagtcctgtttggagacttt

SEQ ID NO: 559020 - DNA, 25 bp, Mus musculus
caccggatagtcaggaatttgattc

SEQ ID NO: 559021 - DNA, 25 bp, Mus musculus
caccggatagtctggaatttgattc

SEQ ID NO: 559022 - DNA, 25 bp, Mus musculus
caccggatgaagaagcttaagtcaa

SEQ ID NO: 559023 - DNA, 25 bp, Mus musculus
caccggatgaagtagcttaagtcaa

SEQ ID NO: 559024 - DNA, 25 bp, Mus musculus
caccggatgctcagcgttactgagg

SEQ ID NO: 559025 - DNA, 25 bp, Mus musculus
caccggatgctctgcgttactgagg

SEQ ID NO: 559026 - DNA, 25 bp, Mus musculus
caccggcagataattgatgaatatg

SEQ ID NO: 559027 - DNA, 25 bp, Mus musculus
caccggcagatatttgatgaatatg

SEQ ID NO: 559028 - DNA, 25 bp, Mus musculus
caccggcccagccattttagctgag

SEQ ID NO: 559029 - DNA, 25 bp, Mus musculus
caccggcccagcgattttagctgag

SEQ ID NO: 559030 - DNA, 25 bp, Mus musculus
caccggcgcctgcatcgtgggaatc

SEQ ID NO: 559031 - DNA, 25 bp, Mus musculus
caccggcgcctggatcgtgggaatc

SEQ ID NO: 559032 - DNA, 25 bp, Mus musculus
caccggcgtgttcactcagacgaga

SEQ ID NO: 559033 - DNA, 25 bp, Mus musculus
caccggcgtgttgactcagacgaga

SEQ ID NO: 559034 - DNA, 25 bp, Mus musculus
caccggctacgtacccgaggatggg

SEQ ID NO: 559035 - DNA, 25 bp, Mus musculus
caccggctacgttcccgaggatggg

SEQ ID NO: 559036 - DNA, 25 bp, Mus musculus
caccggctcactcggcgtgtgctgt

SEQ ID NO: 559037 - DNA, 25 bp, Mus musculus
caccggctcactgggcgtgtgctgt

SEQ ID NO: 559038 - DNA, 25 bp, Mus musculus
caccggcttcttcactactgtggca

SEQ ID NO: 559039 - DNA, 25 bp, Mus musculus
caccggcttcttgactactgtggca

SEQ ID NO: 559040 - DNA, 25 bp, Mus musculus
caccgggaagcacctctttgatcag

SEQ ID NO: 559041 - DNA, 25 bp, Mus musculus
caccgggaagcagctctttgatcag

SEQ ID NO: 559042 - DNA, 25 bp, Mus musculus
caccgggacatacaggaaattatcc

SEQ ID NO: 559043 - DNA, 25 bp, Mus musculus
caccgggacatagaggaaattatcc

SEQ ID NO: 559044 - DNA, 25 bp, Mus musculus
caccgggagatgcaggtttctgatc

SEQ ID NO: 559045 - DNA, 25 bp, Mus musculus
caccgggagatggaggtttctgatc

SEQ ID NO: 559046 - DNA, 25 bp, Mus musculus
caccgggagctgactgtggaatcat

SEQ ID NO: 559047 - DNA, 25 bp, Mus musculus
caccgggagctgtctgtggaatcat

SEQ ID NO: 559048 - DNA, 25 bp, Mus musculus
caccgggccttgattacttctgcag

SEQ ID NO: 559049 - DNA, 25 bp, Mus musculus
caccgggccttgtttacttctgcag

SEQ ID NO: 559050 - DNA, 25 bp, Mus musculus
caccgggtcaggagttgcaagttta

SEQ ID NO: 559051 - DNA, 25 bp, Mus musculus
caccgggtcaggtgttgcaagttta

SEQ ID NO: 559052 - DNA, 25 bp, Mus musculus
caccggtacaatacctgtgatgtat

SEQ ID NO: 559053 - DNA, 25 bp, Mus musculus
caccggtacaattcctgtgatgtat

SEQ ID NO: 559054 - DNA, 25 bp, Mus musculus
caccggtcacgaacggcatcgcgga

SEQ ID NO: 559055 - DNA, 25 bp, Mus musculus
caccggtcacgatcggcatcgcgga

SEQ ID NO: 559056 - DNA, 25 bp, Mus musculus
caccggtgcaacactgcctgtgtat

SEQ ID NO: 559057 - DNA, 25 bp, Mus musculus
caccggtgcaactctgcctgtgtat

SEQ ID NO: 559058 - DNA, 25 bp, Mus musculus
caccggtggtcaacgattacacacc

SEQ ID NO: 559059 - DNA, 25 bp, Mus musculus
caccggtggtcatcgattacacacc

SEQ ID NO: 559060 - DNA, 25 bp, Mus musculus
caccggttagaaactggaggctgtg

SEQ ID NO: 559061 - DNA, 25 bp, Mus musculus
caccggttagaatctggaggctgtg

SEQ ID NO: 559062 - DNA, 25 bp, Mus musculus
caccgtaatgctagtgccctgagaa

SEQ ID NO: 559063 - DNA, 25 bp, Mus musculus
caccgtaatgcttgtgccctgagaa

SEQ ID NO: 559064 - DNA, 25 bp, Mus musculus
caccgtacgcaacctacacgttgga

SEQ ID NO: 559065 - DNA, 25 bp, Mus musculus
caccgtacgcaagctacacgttgga

SEQ ID NO: 559066 - DNA, 25 bp, Mus musculus
caccgtcaccggatagaaactggag

SEQ ID NO: 559067 - DNA, 25 bp, Mus musculus
caccgtcaccggttagaaactggag

SEQ ID NO: 559068 - DNA, 25 bp, Mus musculus
caccgtcagactcgcatcggagaca

SEQ ID NO: 559069 - DNA, 25 bp, Mus musculus
caccgtcagactggcatcggagaca

SEQ ID NO: 559070 - DNA, 25 bp, Mus musculus
caccgtcagatcatcataaagcttt

SEQ ID NO: 559071 - DNA, 25 bp, Mus musculus
caccgtcagatcttcataaagcttt

SEQ ID NO: 559072 - DNA, 25 bp, Mus musculus
caccgtcagcgacgaaggcattttc

SEQ ID NO: 559073 - DNA, 25 bp, Mus musculus
caccgtcagcgaggaaggcattttc

SEQ ID NO: 559074 - DNA, 25 bp, Mus musculus
caccgtcatgtcacggatatgggta

SEQ ID NO: 559075 - DNA, 25 bp, Mus musculus
caccgtcatgtctcggatatgggta

SEQ ID NO: 559076 - DNA, 25 bp, Mus musculus
caccgtcttggaccagaaagattaa

SEQ ID NO: 559077 - DNA, 25 bp, Mus musculus
caccgtcttggagcagaaagattaa

SEQ ID NO: 559078 - DNA, 25 bp, Mus musculus
caccgtctttcaacacttggcctgg

SEQ ID NO: 559079 - DNA, 25 bp, Mus musculus
caccgtctttcatcacttggcctgg

SEQ ID NO: 559080 - DNA, 25 bp, Mus musculus
caccgtcttttacccaagcgatgga

SEQ ID NO: 559081 - DNA, 25 bp, Mus musculus
caccgtcttttagccaagcgatgga

SEQ ID NO: 559082 - DNA, 25 bp, Mus musculus
caccgtgaaagcagccggcgtggta

SEQ ID NO: 559083 - DNA, 25 bp, Mus musculus
caccgtgaaagctgccggcgtggta

SEQ ID NO: 559084 - DNA, 25 bp, Mus musculus
caccgtgaagctcgaaaatggcagt

SEQ ID NO: 559085 - DNA, 25 bp, Mus musculus
caccgtgaagctggaaaatggcagt

SEQ ID NO: 559086 - DNA, 25 bp, Mus musculus
caccgtgaaggtcatgaaggcccaa

SEQ ID NO: 559087 - DNA, 25 bp, Mus musculus
caccgtgaaggtgatgaaggcccaa

SEQ ID NO: 559088 - DNA, 25 bp, Mus musculus
caccgtgaggttcagggctttgagt

SEQ ID NO: 559089 - DNA, 25 bp, Mus musculus
caccgtgaggttgagggctttgagt

SEQ ID NO: 559090 - DNA, 25 bp, Mus musculus
caccgtgatcaaagccatgctctgg

SEQ ID NO: 559091 - DNA, 25 bp, Mus musculus
caccgtgatcaatgccatgctctgg

SEQ ID NO: 559092 - DNA, 25 bp, Mus musculus
caccgtgcattaagcctgccggagc

SEQ ID NO: 559093 - DNA, 25 bp, Mus musculus
caccgtgcattatgcctgccggagc

SEQ ID NO: 559094 - DNA, 25 bp, Mus musculus
caccgtgccaatagttctgctgagc

SEQ ID NO: 559095 - DNA, 25 bp, Mus musculus
caccgtgccaattgttctgctgagc

SEQ ID NO: 559096 - DNA, 25 bp, Mus musculus
caccgtgctcaactactatgtatgg

SEQ ID NO: 559097 - DNA, 25 bp, Mus musculus
caccgtgctcaagtactatgtatgg

SEQ ID NO: 559098 - DNA, 25 bp, Mus musculus
caccgtgcttacaggtgctatgcca

SEQ ID NO: 559099 - DNA, 25 bp, Mus musculus
caccgtgcttactggtgctatgcca

SEQ ID NO: 559100 - DNA, 25 bp, Mus musculus
caccgtggaaggatcttctgggact

SEQ ID NO: 559101 - DNA, 25 bp, Mus musculus
caccgtggaaggttcttctgggact

SEQ ID NO: 559102 - DNA, 25 bp, Mus musculus
caccgtggaccgcaacaagttcaga

SEQ ID NO: 559103 - DNA, 25 bp, Mus musculus
caccgtggaccggaacaagttcaga

SEQ ID NO: 559104 - DNA, 25 bp, Mus musculus
caccgtggacgtcctcagattgagt

SEQ ID NO: 559105 - DNA, 25 bp, Mus musculus
caccgtggacgtgctcagattgagt

SEQ ID NO: 559106 - DNA, 25 bp, Mus musculus
caccgtggatatcggagttctttta

SEQ ID NO: 559107 - DNA, 25 bp, Mus musculus
caccgtggatatgggagttctttta

SEQ ID NO: 559108 - DNA, 25 bp, Mus musculus
caccgtgggcaaattgaagttgctt

SEQ ID NO: 559109 - DNA, 25 bp, Mus musculus
caccgtgggcaatttgaagttgctt

SEQ ID NO: 559110 - DNA, 25 bp, Mus musculus
caccgtggtgatacttctaggaatc

SEQ ID NO: 559111 - DNA, 25 bp, Mus musculus
caccgtggtgattcttctaggaatc

SEQ ID NO: 559112 - DNA, 25 bp, Mus musculus
caccgtggttatcgctgacgtgtcc

SEQ ID NO: 559113 - DNA, 25 bp, Mus musculus
caccgtggttatggctgacgtgtcc

SEQ ID NO: 559114 - DNA, 25 bp, Mus musculus
caccgtgtcttacgtgatcactaag

SEQ ID NO: 559115 - DNA, 25 bp, Mus musculus
caccgtgtcttaggtgatcactaag

SEQ ID NO: 559116 - DNA, 25 bp, Mus musculus
caccgtgtggtcagataaaagcatc

SEQ ID NO: 559117 - DNA, 25 bp, Mus musculus
caccgtgtggtctgataaaagcatc

SEQ ID NO: 559118 - DNA, 25 bp, Mus musculus
caccgttccccactataaatatgct

SEQ ID NO: 559119 - DNA, 25 bp, Mus musculus
caccgttccccagtataaatatgct

SEQ ID NO: 559120 - DNA, 25 bp, Mus musculus
caccgttgcctgataagttcttcca

SEQ ID NO: 559121 - DNA, 25 bp, Mus musculus
caccgttgcctgttaagttcttcca

SEQ ID NO: 559122 - DNA, 25 bp, Mus musculus
caccgtttacctagagctggagaag

SEQ ID NO: 559123 - DNA, 25 bp, Mus musculus
caccgtttaccttgagctggagaag

SEQ ID NO: 559124 - DNA, 25 bp, Mus musculus
caccgtttctgcaggcaccatgagc

SEQ ID NO: 559125 - DNA, 25 bp, Mus musculus
caccgtttctgctggcaccatgagc

SEQ ID NO: 559126 - DNA, 25 bp, Mus musculus
caccgtttttgtaggaggaattgat

SEQ ID NO: 559127 - DNA, 25 bp, Mus musculus
caccgtttttgttggaggaattgat

SEQ ID NO: 559128 - DNA, 25 bp, Mus musculus
cacctaaagcagagaaaatggccag

SEQ ID NO: 559129 - DNA, 25 bp, Mus musculus
cacctaaagcagtgaaaatggccag

SEQ ID NO: 559130 - DNA, 25 bp, Mus musculus
cacctaacaccaacgatgaggtgga

SEQ ID NO: 559131 - DNA, 25 bp, Mus musculus
cacctaacaccatcgatgaggtgga

SEQ ID NO: 559132 - DNA, 25 bp, Mus musculus
cacctaacgtttcctctgaggtacc

SEQ ID NO: 559133 - DNA, 25 bp, Mus musculus
cacctaacgtttgctctgaggtacc

SEQ ID NO: 559134 - DNA, 25 bp, Mus musculus
cacctaagaatgagtggagacctgg

SEQ ID NO: 559135 - DNA, 25 bp, Mus musculus
cacctaagaatgtgtggagacctgg

SEQ ID NO: 559136 - DNA, 25 bp, Mus musculus
cacctaattgatcttgccatgtctg

SEQ ID NO: 559137 - DNA, 25 bp, Mus musculus
cacctaattgatgttgccatgtctg

SEQ ID NO: 559138 - DNA, 25 bp, Mus musculus
cacctacaacaaagaagaatttcct

SEQ ID NO: 559139 - DNA, 25 bp, Mus musculus
cacctacaacaatgaagaatttcct

SEQ ID NO: 559140 - DNA, 25 bp, Mus musculus
cacctacaacgaacgggagaacctg

SEQ ID NO: 559141 - DNA, 25 bp, Mus musculus
cacctacaacgatcgggagaacctg

SEQ ID NO: 559142 - DNA, 25 bp, Mus musculus
cacctacataatcatctctgggagg

SEQ ID NO: 559143 - DNA, 25 bp, Mus musculus
cacctacataatgatctctgggagg

SEQ ID NO: 559144 - DNA, 25 bp, Mus musculus
cacctacataccaggagcctgggat

SEQ ID NO: 559145 - DNA, 25 bp, Mus musculus
cacctacatacctggagcctgggat

SEQ ID NO: 559146 - DNA, 25 bp, Mus musculus
cacctaccgagactctgagtcctgg

SEQ ID NO: 559147 - DNA, 25 bp, Mus musculus
cacctaccgagagtctgagtcctgg

SEQ ID NO: 559148 - DNA, 25 bp, Mus musculus
cacctaccgctaagtagtcagtgag

SEQ ID NO: 559149 - DNA, 25 bp, Mus musculus
cacctaccgctatgtagtcagtgag

SEQ ID NO: 559150 - DNA, 25 bp, Mus musculus
cacctacctacacgagaagcttggg

SEQ ID NO: 559151 - DNA, 25 bp, Mus musculus
cacctacctacaggagaagcttggg

SEQ ID NO: 559152 - DNA, 25 bp, Mus musculus
cacctacctggacggattcgaccag

SEQ ID NO: 559153 - DNA, 25 bp, Mus musculus
cacctacctggagggattcgaccag

SEQ ID NO: 559154 - DNA, 25 bp, Mus musculus
cacctacgattcaagattcgaatgg

SEQ ID NO: 559155 - DNA, 25 bp, Mus musculus
cacctacgattctagattcgaatgg

SEQ ID NO: 559156 - DNA, 25 bp, Mus musculus
cacctacggcggattggaaggttca

SEQ ID NO: 559157 - DNA, 25 bp, Mus musculus
cacctacggcggtttggaaggttca

SEQ ID NO: 559158 - DNA, 25 bp, Mus musculus
cacctactacacaggtgtctctggg

SEQ ID NO: 559159 - DNA, 25 bp, Mus musculus
cacctactacactggtgtctctggg

SEQ ID NO: 559160 - DNA, 25 bp, Mus musculus
cacctactgtctatgctccttatga

SEQ ID NO: 559161 - DNA, 25 bp, Mus musculus
cacctactgtctttgctccttatga

SEQ ID NO: 559162 - DNA, 25 bp, Mus musculus
cacctagacatgcaaaacgaaacgc

SEQ ID NO: 559163 - DNA, 25 bp, Mus musculus
cacctagacatggaaaacgaaacgc

SEQ ID NO: 559164 - DNA, 25 bp, Mus musculus
cacctagccgggaatatgtcgactt

SEQ ID NO: 559165 - DNA, 25 bp, Mus musculus
cacctagccgggtatatgtcgactt

SEQ ID NO: 559166 - DNA, 25 bp, Mus musculus
cacctagccttgaagagtattttga

SEQ ID NO: 559167 - DNA, 25 bp, Mus musculus
cacctagccttgtagagtattttga

SEQ ID NO: 559168 - DNA, 25 bp, Mus musculus
cacctagcggccacctgggtttggg

SEQ ID NO: 559169 - DNA, 25 bp, Mus musculus
cacctagcggcctcctgggtttggg

SEQ ID NO: 559170 - DNA, 25 bp, Mus musculus
cacctaggaagtacgtgatttccag

SEQ ID NO: 559171 - DNA, 25 bp, Mus musculus
cacctaggaagttcgtgatttccag

SEQ ID NO: 559172 - DNA, 25 bp, Mus musculus
cacctagggtctatgtggctgcaga

SEQ ID NO: 559173 - DNA, 25 bp, Mus musculus
cacctagggtctttgtggctgcaga

SEQ ID NO: 559174 - DNA, 25 bp, Mus musculus
cacctagttccgaggctacgaggag

SEQ ID NO: 559175 - DNA, 25 bp, Mus musculus
cacctagttccgtggctacgaggag

SEQ ID NO: 559176 - DNA, 25 bp, Mus musculus
cacctataagcgacttgccattaaa

SEQ ID NO: 559177 - DNA, 25 bp, Mus musculus
cacctataagcgtcttgccattaaa

SEQ ID NO: 559178 - DNA, 25 bp, Mus musculus
cacctatacagaatgctgctgccaa

SEQ ID NO: 559179 - DNA, 25 bp, Mus musculus
cacctatacagattgctgctgccaa

SEQ ID NO: 559180 - DNA, 25 bp, Mus musculus
cacctatcgagcagtgccaggcaag

SEQ ID NO: 559181 - DNA, 25 bp, Mus musculus
cacctatcgagctgtgccaggcaag

SEQ ID NO: 559182 - DNA, 25 bp, Mus musculus
cacctatctgtaagtctacaagaga

SEQ ID NO: 559183 - DNA, 25 bp, Mus musculus
cacctatctgtatgtctacaagaga

SEQ ID NO: 559184 - DNA, 25 bp, Mus musculus
cacctatgaattcgctatcattgta

SEQ ID NO: 559185 - DNA, 25 bp, Mus musculus
cacctatgaattggctatcattgta

SEQ ID NO: 559186 - DNA, 25 bp, Mus musculus
cacctatgacaacatgaacaagctg

SEQ ID NO: 559187 - DNA, 25 bp, Mus musculus
cacctatgacaagatgaacaagctg

SEQ ID NO: 559188 - DNA, 25 bp, Mus musculus
cacctatgacctcgtagctcttggg

SEQ ID NO: 559189 - DNA, 25 bp, Mus musculus
cacctatgacctggtagctcttggg

SEQ ID NO: 559190 - DNA, 25 bp, Mus musculus
cacctatgacttcgtgtatgatcag

SEQ ID NO: 559191 - DNA, 25 bp, Mus musculus
cacctatgacttggtgtatgatcag

SEQ ID NO: 559192 - DNA, 25 bp, Mus musculus
cacctatgaggaagtgaagcaggct

SEQ ID NO: 559193 - DNA, 25 bp, Mus musculus
cacctatgaggatgtgaagcaggct

SEQ ID NO: 559194 - DNA, 25 bp, Mus musculus
cacctatggcttatatactggctat

SEQ ID NO: 559195 - DNA, 25 bp, Mus musculus
cacctatggcttttatactggctat

SEQ ID NO: 559196 - DNA, 25 bp, Mus musculus
cacctatgtcttctgatgaaataaa

SEQ ID NO: 559197 - DNA, 25 bp, Mus musculus
cacctatgtcttgtgatgaaataaa

SEQ ID NO: 559198 - DNA, 25 bp, Mus musculus
cacctatgtgaacaacggcacgtcc

SEQ ID NO: 559199 - DNA, 25 bp, Mus musculus
cacctatgtgaagaacggcacgtcc

SEQ ID NO: 559200 - DNA, 25 bp, Mus musculus
cacctcaaagctcttgtgtacgtga

SEQ ID NO: 559201 - DNA, 25 bp, Mus musculus
cacctcaaagctgttgtgtacgtga

SEQ ID NO: 559202 - DNA, 25 bp, Mus musculus
cacctcaccgtgcacaacaaggaag

SEQ ID NO: 559203 - DNA, 25 bp, Mus musculus
cacctcaccgtggacaacaaggaag

SEQ ID NO: 559204 - DNA, 25 bp, Mus musculus
cacctcactaaccagtatatgcaga

SEQ ID NO: 559205 - DNA, 25 bp, Mus musculus
cacctcactaacgagtatatgcaga

SEQ ID NO: 559206 - DNA, 25 bp, Mus musculus
cacctcagaatactgctgcctaagg

SEQ ID NO: 559207 - DNA, 25 bp, Mus musculus
cacctcagaatagtgctgcctaagg

SEQ ID NO: 559208 - DNA, 25 bp, Mus musculus
cacctcagactcattgtgacaagga

SEQ ID NO: 559209 - DNA, 25 bp, Mus musculus
cacctcagactctttgtgacaagga

SEQ ID NO: 559210 - DNA, 25 bp, Mus musculus
cacctcagagtccgcggctgcgaga

SEQ ID NO: 559211 - DNA, 25 bp, Mus musculus
cacctcagagtcggcggctgcgaga

SEQ ID NO: 559212 - DNA, 25 bp, Mus musculus
cacctcagcccaagaaatctaagaa

SEQ ID NO: 559213 - DNA, 25 bp, Mus musculus
cacctcagcccatgaaatctaagaa

SEQ ID NO: 559214 - DNA, 25 bp, Mus musculus
cacctcaggttacagcaagactcga

SEQ ID NO: 559215 - DNA, 25 bp, Mus musculus
cacctcaggttagagcaagactcga

SEQ ID NO: 559216 - DNA, 25 bp, Mus musculus
cacctcagtgcacggaaactatggc

SEQ ID NO: 559217 - DNA, 25 bp, Mus musculus
cacctcagtgcagggaaactatggc

SEQ ID NO: 559218 - DNA, 25 bp, Mus musculus
cacctcatggtgaaggactggcagc

SEQ ID NO: 559219 - DNA, 25 bp, Mus musculus
cacctcatggtgtaggactggcagc

SEQ ID NO: 559220 - DNA, 25 bp, Mus musculus
cacctccaaggaaatgatgtgtttc

SEQ ID NO: 559221 - DNA, 25 bp, Mus musculus
cacctccaaggatatgatgtgtttc

SEQ ID NO: 559222 - DNA, 25 bp, Mus musculus
cacctccaggtcaaagaaactgtgg

SEQ ID NO: 559223 - DNA, 25 bp, Mus musculus
cacctccaggtctaagaaactgtgg

SEQ ID NO: 559224 - DNA, 25 bp, Mus musculus
cacctccagtgtctgcggtctttgt

SEQ ID NO: 559225 - DNA, 25 bp, Mus musculus
cacctccagtgtgtgcggtctttgt

SEQ ID NO: 559226 - DNA, 25 bp, Mus musculus
cacctccagttaccatggcagaaac

SEQ ID NO: 559227 - DNA, 25 bp, Mus musculus
cacctccagttagcatggcagaaac

SEQ ID NO: 559228 - DNA, 25 bp, Mus musculus
cacctccatgccaaagtcttttcat

SEQ ID NO: 559229 - DNA, 25 bp, Mus musculus
cacctccatgcctaagtcttttcat

SEQ ID NO: 559230 - DNA, 25 bp, Mus musculus
cacctcccgtgaaggtgggcagaca

SEQ ID NO: 559231 - DNA, 25 bp, Mus musculus
cacctcccgtgatggtgggcagaca

SEQ ID NO: 559232 - DNA, 25 bp, Mus musculus
cacctccgagctccagttctgtatg

SEQ ID NO: 559233 - DNA, 25 bp, Mus musculus
cacctccgagctgcagttctgtatg

SEQ ID NO: 559234 - DNA, 25 bp, Mus musculus
cacctccgggagcaaagatcaatcg

SEQ ID NO: 559235 - DNA, 25 bp, Mus musculus
cacctccgggaggaaagatcaatcg

SEQ ID NO: 559236 - DNA, 25 bp, Mus musculus
cacctccgtccgagggagaggcaaa

SEQ ID NO: 559237 - DNA, 25 bp, Mus musculus
cacctccgtccgtgggagaggcaaa

SEQ ID NO: 559238 - DNA, 25 bp, Mus musculus
cacctcctctgaagctgctgtggga

SEQ ID NO: 559239 - DNA, 25 bp, Mus musculus
cacctcctctgatgctgctgtggga

SEQ ID NO: 559240 - DNA, 25 bp, Mus musculus
cacctcctctggcattcctgggtgg

SEQ ID NO: 559241 - DNA, 25 bp, Mus musculus
cacctcctctgggattcctgggtgg

SEQ ID NO: 559242 - DNA, 25 bp, Mus musculus
cacctcctgcagacattgagttaaa

SEQ ID NO: 559243 - DNA, 25 bp, Mus musculus
cacctcctgcagtcattgagttaaa

SEQ ID NO: 559244 - DNA, 25 bp, Mus musculus
cacctcctgccgagacaagcgagtt

SEQ ID NO: 559245 - DNA, 25 bp, Mus musculus
cacctcctgccgtgacaagcgagtt

SEQ ID NO: 559246 - DNA, 25 bp, Mus musculus
cacctcctggaaaggacagatcatc

SEQ ID NO: 559247 - DNA, 25 bp, Mus musculus
cacctcctggaatggacagatcatc

SEQ ID NO: 559248 - DNA, 25 bp, Mus musculus
cacctcgaattcctactctaagaag

SEQ ID NO: 559249 - DNA, 25 bp, Mus musculus
cacctcgaattcgtactctaagaag

SEQ ID NO: 559250 - DNA, 25 bp, Mus musculus
cacctcgaggacaacaacagcatgt

SEQ ID NO: 559251 - DNA, 25 bp, Mus musculus
cacctcgaggactacaacagcatgt

SEQ ID NO: 559252 - DNA, 25 bp, Mus musculus
cacctcgaggtgaaaaggttcgcat

SEQ ID NO: 559253 - DNA, 25 bp, Mus musculus
cacctcgaggtgtaaaggttcgcat

SEQ ID NO: 559254 - DNA, 25 bp, Mus musculus
cacctcggatggcttaccagtcgga

SEQ ID NO: 559255 - DNA, 25 bp, Mus musculus
cacctcggatgggttaccagtcgga

SEQ ID NO: 559256 - DNA, 25 bp, Mus musculus
cacctcgggtagactgtgctgtccc

SEQ ID NO: 559257 - DNA, 25 bp, Mus musculus
cacctcgggtagtctgtgctgtccc

SEQ ID NO: 559258 - DNA, 25 bp, Mus musculus
cacctcggtttgagtctatcatgga

SEQ ID NO: 559259 - DNA, 25 bp, Mus musculus
cacctcggtttgtgtctatcatgga

SEQ ID NO: 559260 - DNA, 25 bp, Mus musculus
cacctcgtggcgataggctttacca

SEQ ID NO: 559261 - DNA, 25 bp, Mus musculus
cacctcgtggcgttaggctttacca

SEQ ID NO: 559262 - DNA, 25 bp, Mus musculus
cacctctaatataggaaaacattga

SEQ ID NO: 559263 - DNA, 25 bp, Mus musculus
cacctctaatattggaaaacattga

SEQ ID NO: 559264 - DNA, 25 bp, Mus musculus
cacctctagtatccggggcgttggc

SEQ ID NO: 559265 - DNA, 25 bp, Mus musculus
cacctctagtatgcggggcgttggc

SEQ ID NO: 559266 - DNA, 25 bp, Mus musculus
cacctctcagctcaaggctggcaag

SEQ ID NO: 559267 - DNA, 25 bp, Mus musculus
cacctctcagctgaaggctggcaag

SEQ ID NO: 559268 - DNA, 25 bp, Mus musculus
cacctctcagggagggaacagagca

SEQ ID NO: 559269 - DNA, 25 bp, Mus musculus
cacctctcagggtgggaacagagca

SEQ ID NO: 559270 - DNA, 25 bp, Mus musculus
cacctctccctgcattgacaaaaga

SEQ ID NO: 559271 - DNA, 25 bp, Mus musculus
cacctctccctggattgacaaaaga

SEQ ID NO: 559272 - DNA, 25 bp, Mus musculus
cacctctggacgaggctaagacaag

SEQ ID NO: 559273 - DNA, 25 bp, Mus musculus
cacctctggacgtggctaagacaag

SEQ ID NO: 559274 - DNA, 25 bp, Mus musculus
cacctctggagtactatggcattga

SEQ ID NO: 559275 - DNA, 25 bp, Mus musculus
cacctctggagttctatggcattga

SEQ ID NO: 559276 - DNA, 25 bp, Mus musculus
cacctctggtttacagtgttgttgg

SEQ ID NO: 559277 - DNA, 25 bp, Mus musculus
cacctctggttttcagtgttgttgg

SEQ ID NO: 559278 - DNA, 25 bp, Mus musculus
cacctctgtcgccaaagaagttttc

SEQ ID NO: 559279 - DNA, 25 bp, Mus musculus
cacctctgtcgcgaaagaagttttc

SEQ ID NO: 559280 - DNA, 25 bp, Mus musculus
cacctcttacaaataggtggctgac

SEQ ID NO: 559281 - DNA, 25 bp, Mus musculus
cacctcttacaattaggtggctgac

SEQ ID NO: 559282 - DNA, 25 bp, Mus musculus
cacctcttatgtcagcatttcgcaa

SEQ ID NO: 559283 - DNA, 25 bp, Mus musculus
cacctcttatgtgagcatttcgcaa

SEQ ID NO: 559284 - DNA, 25 bp, Mus musculus
cacctcttccacaatgagtcgtctt

SEQ ID NO: 559285 - DNA, 25 bp, Mus musculus
cacctcttccactatgagtcgtctt

SEQ ID NO: 559286 - DNA, 25 bp, Mus musculus
cacctcttgaagagaagcatcagcg

SEQ ID NO: 559287 - DNA, 25 bp, Mus musculus
cacctcttgaagtgaagcatcagcg

SEQ ID NO: 559288 - DNA, 25 bp, Mus musculus
cacctcttggtcaggaaacattaaa

SEQ ID NO: 559289 - DNA, 25 bp, Mus musculus
cacctcttggtctggaaacattaaa

SEQ ID NO: 559290 - DNA, 25 bp, Mus musculus
cacctcttgtaactgcgtgccaaag

SEQ ID NO: 559291 - DNA, 25 bp, Mus musculus
cacctcttgtaagtgcgtgccaaag

SEQ ID NO: 559292 - DNA, 25 bp, Mus musculus
cacctgaaagacctgcttcaggtag

SEQ ID NO: 559293 - DNA, 25 bp, Mus musculus
cacctgaaagacgtgcttcaggtag

SEQ ID NO: 559294 - DNA, 25 bp, Mus musculus
cacctgaagaacctaaaggaggtat

SEQ ID NO: 559295 - DNA, 25 bp, Mus musculus
cacctgaagaacgtaaaggaggtat

SEQ ID NO: 559296 - DNA, 25 bp, Mus musculus
cacctgaagctcatcctgtcacgga

SEQ ID NO: 559297 - DNA, 25 bp, Mus musculus
cacctgaagctcttcctgtcacgga

SEQ ID NO: 559298 - DNA, 25 bp, Mus musculus
cacctgaaggctagtatctcgctac

SEQ ID NO: 559299 - DNA, 25 bp, Mus musculus
cacctgaaggcttgtatctcgctac

SEQ ID NO: 559300 - DNA, 25 bp, Mus musculus
cacctgaagtgtccaagaagcttga

SEQ ID NO: 559301 - DNA, 25 bp, Mus musculus
cacctgaagtgtgcaagaagcttga

SEQ ID NO: 559302 - DNA, 25 bp, Mus musculus
cacctgaattgcattgcctaaggaa

SEQ ID NO: 559303 - DNA, 25 bp, Mus musculus
cacctgaattgctttgcctaaggaa

SEQ ID NO: 559304 - DNA, 25 bp, Mus musculus
cacctgactgggatactccagctga

SEQ ID NO: 559305 - DNA, 25 bp, Mus musculus
cacctgactgggttactccagctga

SEQ ID NO: 559306 - DNA, 25 bp, Mus musculus
cacctgactggtattgaaagccgag

SEQ ID NO: 559307 - DNA, 25 bp, Mus musculus
cacctgactggttttgaaagccgag

SEQ ID NO: 559308 - DNA, 25 bp, Mus musculus
cacctgactgtgcagtgtgtagacc

SEQ ID NO: 559309 - DNA, 25 bp, Mus musculus
cacctgactgtggagtgtgtagacc

SEQ ID NO: 559310 - DNA, 25 bp, Mus musculus
cacctgagacctcaggacgccttat

SEQ ID NO: 559311 - DNA, 25 bp, Mus musculus
cacctgagacctgaggacgccttat

SEQ ID NO: 559312 - DNA, 25 bp, Mus musculus
cacctgagcaagaccaggactcttc

SEQ ID NO: 559313 - DNA, 25 bp, Mus musculus
cacctgagcaagtccaggactcttc

SEQ ID NO: 559314 - DNA, 25 bp, Mus musculus
cacctgagccacattcagatgagga

SEQ ID NO: 559315 - DNA, 25 bp, Mus musculus
cacctgagccactttcagatgagga

SEQ ID NO: 559316 - DNA, 25 bp, Mus musculus
cacctgatatgaaaaaggagcaaga

SEQ ID NO: 559317 - DNA, 25 bp, Mus musculus
cacctgatatgataaaggagcaaga

SEQ ID NO: 559318 - DNA, 25 bp, Mus musculus
cacctgatgagtacattgagaaact

SEQ ID NO: 559319 - DNA, 25 bp, Mus musculus
cacctgatgagtctctggacgactt

SEQ ID NO: 559320 - DNA, 25 bp, Mus musculus
cacctgatgagtgtctggacgactt

SEQ ID NO: 559321 - DNA, 25 bp, Mus musculus
cacctgatgagttcattgagaaact

SEQ ID NO: 559322 - DNA, 25 bp, Mus musculus
cacctgatggaacactatgaacgcc

SEQ ID NO: 559323 - DNA, 25 bp, Mus musculus
cacctgatggaagactatgaacgcc

SEQ ID NO: 559324 - DNA, 25 bp, Mus musculus
cacctgatgtgtactgcgagactgc

SEQ ID NO: 559325 - DNA, 25 bp, Mus musculus
cacctgatgtgttctgcgagactgc

SEQ ID NO: 559326 - DNA, 25 bp, Mus musculus
cacctgattgaaatggcaaccaagc

SEQ ID NO: 559327 - DNA, 25 bp, Mus musculus
cacctgattgaattggcaaccaagc

SEQ ID NO: 559328 - DNA, 25 bp, Mus musculus
cacctgcaaagaagaagtctggttc

SEQ ID NO: 559329 - DNA, 25 bp, Mus musculus
cacctgcaaagatgaagtctggttc

SEQ ID NO: 559330 - DNA, 25 bp, Mus musculus
cacctgcaatgtcgagcagtccttc

SEQ ID NO: 559331 - DNA, 25 bp, Mus musculus
cacctgcaatgtggagcagtccttc

SEQ ID NO: 559332 - DNA, 25 bp, Mus musculus
cacctgcagagcaaccatccagatg

SEQ ID NO: 559333 - DNA, 25 bp, Mus musculus
cacctgcagagctaccatccagatg

SEQ ID NO: 559334 - DNA, 25 bp, Mus musculus
cacctgcaggcaagatgttaatgag

SEQ ID NO: 559335 - DNA, 25 bp, Mus musculus
cacctgcaggcatgatgttaatgag

SEQ ID NO: 559336 - DNA, 25 bp, Mus musculus
cacctgcaggctccatgagcgaagt

SEQ ID NO: 559337 - DNA, 25 bp, Mus musculus
cacctgcaggctgcatgagcgaagt

SEQ ID NO: 559338 - DNA, 25 bp, Mus musculus
cacctgcagtaccagccaaaaaggc

SEQ ID NO: 559339 - DNA, 25 bp, Mus musculus
cacctgcagtacgagccaaaaaggc

SEQ ID NO: 559340 - DNA, 25 bp, Mus musculus
cacctgccaaaacttatgctccaga

SEQ ID NO: 559341 - DNA, 25 bp, Mus musculus
cacctgccaaaagttatgctccaga

SEQ ID NO: 559342 - DNA, 25 bp, Mus musculus
cacctgccactgagtgaagcaagga

SEQ ID NO: 559343 - DNA, 25 bp, Mus musculus
cacctgccactgtgtgaagcaagga

SEQ ID NO: 559344 - DNA, 25 bp, Mus musculus
cacctgccaggacatggagaagcgt

SEQ ID NO: 559345 - DNA, 25 bp, Mus musculus
cacctgccaggagatggagaagcgt

SEQ ID NO: 559346 - DNA, 25 bp, Mus musculus
cacctgccccttagtggagaagttc

SEQ ID NO: 559347 - DNA, 25 bp, Mus musculus
cacctgcccctttgtggagaagttc

SEQ ID NO: 559348 - DNA, 25 bp, Mus musculus
cacctgcccgttcggctatgctggg

SEQ ID NO: 559349 - DNA, 25 bp, Mus musculus
cacctgcccgttgggctatgctggg

SEQ ID NO: 559350 - DNA, 25 bp, Mus musculus
cacctgccgagacaacaaggactgc

SEQ ID NO: 559351 - DNA, 25 bp, Mus musculus
cacctgccgagagaacaaggactgc

SEQ ID NO: 559352 - DNA, 25 bp, Mus musculus
cacctgccgtttcctgttgttggca

SEQ ID NO: 559353 - DNA, 25 bp, Mus musculus
cacctgccgtttgctgttgttggca

SEQ ID NO: 559354 - DNA, 25 bp, Mus musculus
cacctgcctcagaacagcagacaaa

SEQ ID NO: 559355 - DNA, 25 bp, Mus musculus
cacctgcctcagtacagcagacaaa

SEQ ID NO: 559356 - DNA, 25 bp, Mus musculus
cacctgcctggtcgagaatgaatac

SEQ ID NO: 559357 - DNA, 25 bp, Mus musculus
cacctgcctggtggagaatgaatac

SEQ ID NO: 559358 - DNA, 25 bp, Mus musculus
cacctgcgtctgaaacctgggatat

SEQ ID NO: 559359 - DNA, 25 bp, Mus musculus
cacctgcgtctgtaacctgggatat

SEQ ID NO: 559360 - DNA, 25 bp, Mus musculus
cacctgctaaggacggcaaagagcc

SEQ ID NO: 559361 - DNA, 25 bp, Mus musculus
cacctgctaaggtcggcaaagagcc

SEQ ID NO: 559362 - DNA, 25 bp, Mus musculus
cacctgctagcaagtcgatgcctgc

SEQ ID NO: 559363 - DNA, 25 bp, Mus musculus
cacctgctagcatgtcgatgcctgc

SEQ ID NO: 559364 - DNA, 25 bp, Mus musculus
cacctgctccatctgtctggaaagg

SEQ ID NO: 559365 - DNA, 25 bp, Mus musculus
cacctgctccatgtgtctggaaagg

SEQ ID NO: 559366 - DNA, 25 bp, Mus musculus
cacctgctgccacttacactggtgt

SEQ ID NO: 559367 - DNA, 25 bp, Mus musculus
cacctgctgccagttacactggtgt

SEQ ID NO: 559368 - DNA, 25 bp, Mus musculus
cacctgctggaacttacagaagacc

SEQ ID NO: 559369 - DNA, 25 bp, Mus musculus
cacctgctggaagttacagaagacc

SEQ ID NO: 559370 - DNA, 25 bp, Mus musculus
cacctgctggagaatctcaaaggca

SEQ ID NO: 559371 - DNA, 25 bp, Mus musculus
cacctgctggagtatctcaaaggca

SEQ ID NO: 559372 - DNA, 25 bp, Mus musculus
cacctgctgtctaccgtgcaggctt

SEQ ID NO: 559373 - DNA, 25 bp, Mus musculus
cacctgctgtcttccgtgcaggctt

SEQ ID NO: 559374 - DNA, 25 bp, Mus musculus
cacctgctgttacaccagtgaaagg

SEQ ID NO: 559375 - DNA, 25 bp, Mus musculus
cacctgctgttagaccagtgaaagg

SEQ ID NO: 559376 - DNA, 25 bp, Mus musculus
cacctgctgttcaatatgttgcctg

SEQ ID NO: 559377 - DNA, 25 bp, Mus musculus
cacctgctgttctatatgttgcctg

SEQ ID NO: 559378 - DNA, 25 bp, Mus musculus
cacctggaacgtcgcgtgctactgc

SEQ ID NO: 559379 - DNA, 25 bp, Mus musculus
cacctggaacgtggcgtgctactgc

SEQ ID NO: 559380 - DNA, 25 bp, Mus musculus
cacctggaatacatgaggacctggg

SEQ ID NO: 559381 - DNA, 25 bp, Mus musculus
cacctggaatacttgaggacctggg

SEQ ID NO: 559382 - DNA, 25 bp, Mus musculus
cacctggaatttcggaagtttctgt

SEQ ID NO: 559383 - DNA, 25 bp, Mus musculus
cacctggaatttgggaagtttctgt

SEQ ID NO: 559384 - DNA, 25 bp, Mus musculus
cacctggacaggcactgtcctgtca

SEQ ID NO: 559385 - DNA, 25 bp, Mus musculus
cacctggacagggactgtcctgtca

SEQ ID NO: 559386 - DNA, 25 bp, Mus musculus
cacctggaccaaagacggacaggcc

SEQ ID NO: 559387 - DNA, 25 bp, Mus musculus
cacctggaccaatgacggacaggcc

SEQ ID NO: 559388 - DNA, 25 bp, Mus musculus
cacctggaccacatcaagaaggtgg

SEQ ID NO: 559389 - DNA, 25 bp, Mus musculus
cacctggaccacttcaagaaggtgg

SEQ ID NO: 559390 - DNA, 25 bp, Mus musculus
cacctggagcatcataatggattct

SEQ ID NO: 559391 - DNA, 25 bp, Mus musculus
cacctggagcatgataatggattct

SEQ ID NO: 559392 - DNA, 25 bp, Mus musculus
cacctggatctcaaggaagtggcgc

SEQ ID NO: 559393 - DNA, 25 bp, Mus musculus
cacctggatctctaggaagtggcgc

SEQ ID NO: 559394 - DNA, 25 bp, Mus musculus
cacctggcaataacagtgactgatc

SEQ ID NO: 559395 - DNA, 25 bp, Mus musculus
cacctggcaatatcagtgactgatc

SEQ ID NO: 559396 - DNA, 25 bp, Mus musculus
cacctggcagtccttgatagaagca

SEQ ID NO: 559397 - DNA, 25 bp, Mus musculus
cacctggcagtcgttgatagaagca

SEQ ID NO: 559398 - DNA, 25 bp, Mus musculus
cacctggcagtgattcacgaagccc

SEQ ID NO: 559399 - DNA, 25 bp, Mus musculus
cacctggcagtgtttcacgaagccc

SEQ ID NO: 559400 - DNA, 25 bp, Mus musculus
cacctggcgcctctggactcaaagg

SEQ ID NO: 559401 - DNA, 25 bp, Mus musculus
cacctggcgcctgtggactcaaagg

SEQ ID NO: 559402 - DNA, 25 bp, Mus musculus
cacctggcgtcccagctgtggagct

SEQ ID NO: 559403 - DNA, 25 bp, Mus musculus
cacctggcgtccgagctgtggagct

SEQ ID NO: 559404 - DNA, 25 bp, Mus musculus
cacctggctacgacgaaaatgtggc

SEQ ID NO: 559405 - DNA, 25 bp, Mus musculus
cacctggctacgtcgaaaatgtggc

SEQ ID NO: 559406 - DNA, 25 bp, Mus musculus
cacctggctaggagttcctttttca

SEQ ID NO: 559407 - DNA, 25 bp, Mus musculus
cacctggctaggtgttcctttttca

SEQ ID NO: 559408 - DNA, 25 bp, Mus musculus
cacctggctggtatgtgtccgagga

SEQ ID NO: 559409 - DNA, 25 bp, Mus musculus
cacctggctggtttgtgtccgagga

SEQ ID NO: 559410 - DNA, 25 bp, Mus musculus
cacctggcttccattatgatgtgct

SEQ ID NO: 559411 - DNA, 25 bp, Mus musculus
cacctggcttcctttatgatgtgct

SEQ ID NO: 559412 - DNA, 25 bp, Mus musculus
cacctgggaaaaaatgctacatttt

SEQ ID NO: 559413 - DNA, 25 bp, Mus musculus
cacctgggaaaatatgctacatttt

SEQ ID NO: 559414 - DNA, 25 bp, Mus musculus
cacctgggacttcgagctacaaaca

SEQ ID NO: 559415 - DNA, 25 bp, Mus musculus
cacctgggacttggagctacaaaca

SEQ ID NO: 559416 - DNA, 25 bp, Mus musculus
cacctgggagtaacctagtcatggc

SEQ ID NO: 559417 - DNA, 25 bp, Mus musculus
cacctgggagtatcctagtcatggc

SEQ ID NO: 559418 - DNA, 25 bp, Mus musculus
cacctgggctctatggtacctcttc

SEQ ID NO: 559419 - DNA, 25 bp, Mus musculus
cacctgggctctttggtacctcttc

SEQ ID NO: 559420 - DNA, 25 bp, Mus musculus
cacctggtcatccacagggcaggga

SEQ ID NO: 559421 - DNA, 25 bp, Mus musculus
cacctggtcatcgacagggcaggga

SEQ ID NO: 559422 - DNA, 25 bp, Mus musculus
cacctggtcggacttttgcacgatc

SEQ ID NO: 559423 - DNA, 25 bp, Mus musculus
cacctggtcggagttttgcacgatc

SEQ ID NO: 559424 - DNA, 25 bp, Mus musculus
cacctggtgcatcataggaggcaaa

SEQ ID NO: 559425 - DNA, 25 bp, Mus musculus
cacctggtgcatgataggaggcaaa

SEQ ID NO: 559426 - DNA, 25 bp, Mus musculus
cacctggttacaaccctggcaaagg

SEQ ID NO: 559427 - DNA, 25 bp, Mus musculus
cacctggttacatccctggcaaagg

SEQ ID NO: 559428 - DNA, 25 bp, Mus musculus
cacctgtacggtagatggaaaggtc

SEQ ID NO: 559429 - DNA, 25 bp, Mus musculus
cacctgtacggttgatggaaaggtc

SEQ ID NO: 559430 - DNA, 25 bp, Mus musculus
cacctgtactaacgagctgctgggc

SEQ ID NO: 559431 - DNA, 25 bp, Mus musculus
cacctgtactaaggagctgctgggc

SEQ ID NO: 559432 - DNA, 25 bp, Mus musculus
cacctgtactgtctggaggaatcag

SEQ ID NO: 559433 - DNA, 25 bp, Mus musculus
cacctgtactgtgtggaggaatcag

SEQ ID NO: 559434 - DNA, 25 bp, Mus musculus
cacctgtacttcctgcactacgagt

SEQ ID NO: 559435 - DNA, 25 bp, Mus musculus
cacctgtacttcgtgcactacgagt

SEQ ID NO: 559436 - DNA, 25 bp, Mus musculus
cacctgtagctcatagaagctgaag

SEQ ID NO: 559437 - DNA, 25 bp, Mus musculus
cacctgtagctcttagaagctgaag

SEQ ID NO: 559438 - DNA, 25 bp, Mus musculus
cacctgtatcccactggctctaaag

SEQ ID NO: 559439 - DNA, 25 bp, Mus musculus
cacctgtatccctctggctctaaag

SEQ ID NO: 559440 - DNA, 25 bp, Mus musculus
cacctgtcaccaagatctggatgag

SEQ ID NO: 559441 - DNA, 25 bp, Mus musculus
cacctgtcaccatgatctggatgag

SEQ ID NO: 559442 - DNA, 25 bp, Mus musculus
cacctgtgaaagaagaggagctgcc

SEQ ID NO: 559443 - DNA, 25 bp, Mus musculus
cacctgtgaaagtagaggagctgcc

SEQ ID NO: 559444 - DNA, 25 bp, Mus musculus
cacctgtgacagctaacgatgctgg

SEQ ID NO: 559445 - DNA, 25 bp, Mus musculus
cacctgtgacaggtaacgatgctgg

SEQ ID NO: 559446 - DNA, 25 bp, Mus musculus
cacctgtgagtaccctaatgaagac

SEQ ID NO: 559447 - DNA, 25 bp, Mus musculus
cacctgtgagtagcctaatgaagac

SEQ ID NO: 559448 - DNA, 25 bp, Mus musculus
cacctgtgcaatcaggtggctggca

SEQ ID NO: 559449 - DNA, 25 bp, Mus musculus
cacctgtgcaatgaggtggctggca

SEQ ID NO: 559450 - DNA, 25 bp, Mus musculus
cacctgtgcgagacccatcttggga

SEQ ID NO: 559451 - DNA, 25 bp, Mus musculus
cacctgtgcgagtcccatcttggga

SEQ ID NO: 559452 - DNA, 25 bp, Mus musculus
cacctgtgctgaacgtgttgacaga

SEQ ID NO: 559453 - DNA, 25 bp, Mus musculus
cacctgtgctgatcgtgttgacaga

SEQ ID NO: 559454 - DNA, 25 bp, Mus musculus
cacctgtgggctagcagtgtcactg

SEQ ID NO: 559455 - DNA, 25 bp, Mus musculus
cacctgtgggcttgcagtgtcactg

SEQ ID NO: 559456 - DNA, 25 bp, Mus musculus
cacctgtggtagacactgctcatgg

SEQ ID NO: 559457 - DNA, 25 bp, Mus musculus
cacctgtggtagtcactgctcatgg

SEQ ID NO: 559458 - DNA, 25 bp, Mus musculus
cacctgtggtggacaccacacaagg

SEQ ID NO: 559459 - DNA, 25 bp, Mus musculus
cacctgtggtggtcaccacacaagg

SEQ ID NO: 559460 - DNA, 25 bp, Mus musculus
cacctgtggttcaaatggcagctga

SEQ ID NO: 559461 - DNA, 25 bp, Mus musculus
cacctgtggttctaatggcagctga

SEQ ID NO: 559462 - DNA, 25 bp, Mus musculus
cacctgtgtcgtcttcctggttgtc

SEQ ID NO: 559463 - DNA, 25 bp, Mus musculus
cacctgtgtcgtgttcctggttgtc

SEQ ID NO: 559464 - DNA, 25 bp, Mus musculus
cacctgtgttggaaactcgtggacc

SEQ ID NO: 559465 - DNA, 25 bp, Mus musculus
cacctgtgttggtaactcgtggacc

SEQ ID NO: 559466 - DNA, 25 bp, Mus musculus
cacctgttcttcctgatggagtttc

SEQ ID NO: 559467 - DNA, 25 bp, Mus musculus
cacctgttcttcgtgatggagtttc

SEQ ID NO: 559468 - DNA, 25 bp, Mus musculus
cacctgttgcttctgcatctgtaag

SEQ ID NO: 559469 - DNA, 25 bp, Mus musculus
cacctgttgcttgtgcatctgtaag

SEQ ID NO: 559470 - DNA, 25 bp, Mus musculus
cacctgtttatacgcattgcagctc

SEQ ID NO: 559471 - DNA, 25 bp, Mus musculus
cacctgtttataggcattgcagctc

SEQ ID NO: 559472 - DNA, 25 bp, Mus musculus
caccttaagatccaagaaggtactt

SEQ ID NO: 559473 - DNA, 25 bp, Mus musculus
caccttaagatcgaagaaggtactt

SEQ ID NO: 559474 - DNA, 25 bp, Mus musculus
caccttacaggtcgcatctaaccaa

SEQ ID NO: 559475 - DNA, 25 bp, Mus musculus
caccttacaggtggcatctaaccaa

SEQ ID NO: 559476 - DNA, 25 bp, Mus musculus
caccttaccaggatgagtgggaggc

SEQ ID NO: 559477 - DNA, 25 bp, Mus musculus
caccttaccaggttgagtgggaggc

SEQ ID NO: 559478 - DNA, 25 bp, Mus musculus
caccttataccacgaatcagatagc

SEQ ID NO: 559479 - DNA, 25 bp, Mus musculus
caccttataccaggaatcagatagc

SEQ ID NO: 559480 - DNA, 25 bp, Mus musculus
caccttatgctcagggcttggcctc

SEQ ID NO: 559481 - DNA, 25 bp, Mus musculus
caccttatgctctgggcttggcctc

SEQ ID NO: 559482 - DNA, 25 bp, Mus musculus
caccttattaggacacagcagagtg

SEQ ID NO: 559483 - DNA, 25 bp, Mus musculus
caccttattaggtcacagcagagtg

SEQ ID NO: 559484 - DNA, 25 bp, Mus musculus
caccttcaaactcgagacagcctga

SEQ ID NO: 559485 - DNA, 25 bp, Mus musculus
caccttcaaactggagacagcctga

SEQ ID NO: 559486 - DNA, 25 bp, Mus musculus
caccttcacagtaagagcttgggag

SEQ ID NO: 559487 - DNA, 25 bp, Mus musculus
caccttcacagttagagcttgggag

SEQ ID NO: 559488 - DNA, 25 bp, Mus musculus
caccttcagacactgcagttatcaa

SEQ ID NO: 559489 - DNA, 25 bp, Mus musculus
caccttcagacagtgcagttatcaa

SEQ ID NO: 559490 - DNA, 25 bp, Mus musculus
caccttcatgagaggattgatctga

SEQ ID NO: 559491 - DNA, 25 bp, Mus musculus
caccttcatgagtggattgatctga

SEQ ID NO: 559492 - DNA, 25 bp, Mus musculus
caccttcattcacacttagtggcaa

SEQ ID NO: 559493 - DNA, 25 bp, Mus musculus
caccttcattcagacttagtggcaa

SEQ ID NO: 559494 - DNA, 25 bp, Mus musculus
caccttccgtggaacaggcgtccgt

SEQ ID NO: 559495 - DNA, 25 bp, Mus musculus
caccttccgtggtacaggcgtccgt

SEQ ID NO: 559496 - DNA, 25 bp, Mus musculus
caccttcctgaacaatacggtgatg

SEQ ID NO: 559497 - DNA, 25 bp, Mus musculus
caccttcctgaagaatacggtgatg

SEQ ID NO: 559498 - DNA, 25 bp, Mus musculus
caccttcctggaatatatcatgggt

SEQ ID NO: 559499 - DNA, 25 bp, Mus musculus
caccttcctggattatatcatgggt

SEQ ID NO: 559500 - DNA, 25 bp, Mus musculus
caccttccttcgctgggcatcagaa

SEQ ID NO: 559501 - DNA, 25 bp, Mus musculus
caccttccttcggtgggcatcagaa

SEQ ID NO: 559502 - DNA, 25 bp, Mus musculus
caccttcgatgaagcccagcaggag

SEQ ID NO: 559503 - DNA, 25 bp, Mus musculus
caccttcgatgatgcccagcaggag

SEQ ID NO: 559504 - DNA, 25 bp, Mus musculus
caccttcggagacgccgttatccag

SEQ ID NO: 559505 - DNA, 25 bp, Mus musculus
caccttcggagaggccgttatccag

SEQ ID NO: 559506 - DNA, 25 bp, Mus musculus
caccttcgggccagtagcctacgtg

SEQ ID NO: 559507 - DNA, 25 bp, Mus musculus
caccttcgggcctgtagcctacgtg

SEQ ID NO: 559508 - DNA, 25 bp, Mus musculus
caccttcgtgctagaactgctttca

SEQ ID NO: 559509 - DNA, 25 bp, Mus musculus
caccttcgtgcttgaactgctttca

SEQ ID NO: 559510 - DNA, 25 bp, Mus musculus
caccttctccgcaggtcgtgacggt

SEQ ID NO: 559511 - DNA, 25 bp, Mus musculus
caccttctccgctggtcgtgacggt

SEQ ID NO: 559512 - DNA, 25 bp, Mus musculus
caccttctgaccatgaagaaagacg

SEQ ID NO: 559513 - DNA, 25 bp, Mus musculus
caccttctgaccttgaagaaagacg

SEQ ID NO: 559514 - DNA, 25 bp, Mus musculus
caccttctgagaccagagaggtgat

SEQ ID NO: 559515 - DNA, 25 bp, Mus musculus
caccttctgagagcagagaggtgat

SEQ ID NO: 559516 - DNA, 25 bp, Mus musculus
caccttctgtcaagtcaagggaaca

SEQ ID NO: 559517 - DNA, 25 bp, Mus musculus
caccttctgtcatgtcaagggaaca

SEQ ID NO: 559518 - DNA, 25 bp, Mus musculus
caccttctttgaacaccaggatcag

SEQ ID NO: 559519 - DNA, 25 bp, Mus musculus
caccttctttgatcaccaggatcag

SEQ ID NO: 559520 - DNA, 25 bp, Mus musculus
caccttgaagatccagtttttgaga

SEQ ID NO: 559521 - DNA, 25 bp, Mus musculus
caccttgaagatgcagtttttgaga

SEQ ID NO: 559522 - DNA, 25 bp, Mus musculus
caccttgacaacctggaggacgaag

SEQ ID NO: 559523 - DNA, 25 bp, Mus musculus
caccttgacaacgtggaggacgaag

SEQ ID NO: 559524 - DNA, 25 bp, Mus musculus
caccttgagggccttcgcttgagct

SEQ ID NO: 559525 - DNA, 25 bp, Mus musculus
caccttgagggcgttcgcttgagct

SEQ ID NO: 559526 - DNA, 25 bp, Mus musculus
caccttgcaaggacagaactgaatc

SEQ ID NO: 559527 - DNA, 25 bp, Mus musculus
caccttgcaaggtcagaactgaatc

SEQ ID NO: 559528 - DNA, 25 bp, Mus musculus
caccttgcgagactggtatccttag

SEQ ID NO: 559529 - DNA, 25 bp, Mus musculus
caccttgcgagagtggtatccttag

SEQ ID NO: 559530 - DNA, 25 bp, Mus musculus
caccttgcttttagactatttccgc

SEQ ID NO: 559531 - DNA, 25 bp, Mus musculus
caccttgctttttgactatttccgc

SEQ ID NO: 559532 - DNA, 25 bp, Mus musculus
caccttggagctcatggtgtttatc

SEQ ID NO: 559533 - DNA, 25 bp, Mus musculus
caccttggagctgatggtgtttatc

SEQ ID NO: 559534 - DNA, 25 bp, Mus musculus
caccttggaggaagtagcaagaatg

SEQ ID NO: 559535 - DNA, 25 bp, Mus musculus
caccttggaggatgtagcaagaatg

SEQ ID NO: 559536 - DNA, 25 bp, Mus musculus
caccttggatctagggctgccagga

SEQ ID NO: 559537 - DNA, 25 bp, Mus musculus
caccttggatcttgggctgccagga

SEQ ID NO: 559538 - DNA, 25 bp, Mus musculus
caccttggcagacgaatctacactg

SEQ ID NO: 559539 - DNA, 25 bp, Mus musculus
caccttggcagaggaatctacactg

SEQ ID NO: 559540 - DNA, 25 bp, Mus musculus
caccttggcagcagggagcttgctt

SEQ ID NO: 559541 - DNA, 25 bp, Mus musculus
caccttggcagctgggagcttgctt

SEQ ID NO: 559542 - DNA, 25 bp, Mus musculus
caccttggctaaagggatgagcctc

SEQ ID NO: 559543 - DNA, 25 bp, Mus musculus
caccttggctaatgggatgagcctc

SEQ ID NO: 559544 - DNA, 25 bp, Mus musculus
caccttggctgtcacaacgatgctc

SEQ ID NO: 559545 - DNA, 25 bp, Mus musculus
caccttggctgtgacaacgatgctc

SEQ ID NO: 559546 - DNA, 25 bp, Mus musculus
caccttgggactcagtgtgggactt

SEQ ID NO: 559547 - DNA, 25 bp, Mus musculus
caccttgggactgagtgtgggactt

SEQ ID NO: 559548 - DNA, 25 bp, Mus musculus
caccttgggcatctagctgagggca

SEQ ID NO: 559549 - DNA, 25 bp, Mus musculus
caccttgggcatgtagctgagggca

SEQ ID NO: 559550 - DNA, 25 bp, Mus musculus
caccttggtatcaggtgttattgca

SEQ ID NO: 559551 - DNA, 25 bp, Mus musculus
caccttggtatctggtgttattgca

SEQ ID NO: 559552 - DNA, 25 bp, Mus musculus
caccttggtgtgctagggctgtacc

SEQ ID NO: 559553 - DNA, 25 bp, Mus musculus
caccttggtgtggtagggctgtacc

SEQ ID NO: 559554 - DNA, 25 bp, Mus musculus
caccttgtacgacagagatgagggc

SEQ ID NO: 559555 - DNA, 25 bp, Mus musculus
caccttgtacgagagagatgagggc

SEQ ID NO: 559556 - DNA, 25 bp, Mus musculus
caccttgtactcagttcaggaggct

SEQ ID NO: 559557 - DNA, 25 bp, Mus musculus
caccttgtactctgttcaggaggct

SEQ ID NO: 559558 - DNA, 25 bp, Mus musculus
caccttgtcactagaggatgccacc

SEQ ID NO: 559559 - DNA, 25 bp, Mus musculus
caccttgtcacttgaggatgccacc

SEQ ID NO: 559560 - DNA, 25 bp, Mus musculus
caccttgtcatgcagattgatcttg

SEQ ID NO: 559561 - DNA, 25 bp, Mus musculus
caccttgtcatggagattgatcttg

SEQ ID NO: 559562 - DNA, 25 bp, Mus musculus
caccttgtgaagagcggaattcaca

SEQ ID NO: 559563 - DNA, 25 bp, Mus musculus
caccttgtgaagtgcggaattcaca

SEQ ID NO: 559564 - DNA, 25 bp, Mus musculus
caccttgtggatactcactactgca

SEQ ID NO: 559565 - DNA, 25 bp, Mus musculus
caccttgtggattctcactactgca

SEQ ID NO: 559566 - DNA, 25 bp, Mus musculus
caccttgtgttaagccaggcccgag

SEQ ID NO: 559567 - DNA, 25 bp, Mus musculus
caccttgtgttatgccaggcccgag

SEQ ID NO: 559568 - DNA, 25 bp, Mus musculus
caccttgtttgccttgggattggct

SEQ ID NO: 559569 - DNA, 25 bp, Mus musculus
caccttgtttgcgttgggattggct

SEQ ID NO: 559570 - DNA, 25 bp, Mus musculus
cacctttaatgccaacccagaggag

SEQ ID NO: 559571 - DNA, 25 bp, Mus musculus
cacctttaatgcgaacccagaggag

SEQ ID NO: 559572 - DNA, 25 bp, Mus musculus
cacctttatagtaccagaaacgtgg

SEQ ID NO: 559573 - DNA, 25 bp, Mus musculus
cacctttatagttccagaaacgtgg

SEQ ID NO: 559574 - DNA, 25 bp, Mus musculus
cacctttccgtacatatgccgatgg

SEQ ID NO: 559575 - DNA, 25 bp, Mus musculus
cacctttccgtagatatgccgatgg

SEQ ID NO: 559576 - DNA, 25 bp, Mus musculus
cacctttcttggaaataggaggcag

SEQ ID NO: 559577 - DNA, 25 bp, Mus musculus
cacctttcttggtaataggaggcag

SEQ ID NO: 559578 - DNA, 25 bp, Mus musculus
cacctttgacaaacacggagagcac

SEQ ID NO: 559579 - DNA, 25 bp, Mus musculus
cacctttgacaatcacggagagcac

SEQ ID NO: 559580 - DNA, 25 bp, Mus musculus
cacctttgacacagttctttcttga

SEQ ID NO: 559581 - DNA, 25 bp, Mus musculus
cacctttgacactgttctttcttga

SEQ ID NO: 559582 - DNA, 25 bp, Mus musculus
cacctttgacagataatgagacagc

SEQ ID NO: 559583 - DNA, 25 bp, Mus musculus
cacctttgacagttaatgagacagc

SEQ ID NO: 559584 - DNA, 25 bp, Mus musculus
cacctttgagaaaacagaaactgtc

SEQ ID NO: 559585 - DNA, 25 bp, Mus musculus
cacctttgagaatacagaaactgtc

SEQ ID NO: 559586 - DNA, 25 bp, Mus musculus
cacctttgaggacattcagttcttc

SEQ ID NO: 559587 - DNA, 25 bp, Mus musculus
cacctttgaggagattcagttcttc

SEQ ID NO: 559588 - DNA, 25 bp, Mus musculus
cacctttgcgttaaccttttggctg

SEQ ID NO: 559589 - DNA, 25 bp, Mus musculus
cacctttgcgtttaccttttggctg

SEQ ID NO: 559590 - DNA, 25 bp, Mus musculus
cacctttgctggcctctattcactg

SEQ ID NO: 559591 - DNA, 25 bp, Mus musculus
cacctttgctgggctctattcactg

SEQ ID NO: 559592 - DNA, 25 bp, Mus musculus
cacctttggaagcatggagtggttc

SEQ ID NO: 559593 - DNA, 25 bp, Mus musculus
cacctttggaaggatggagtggttc

SEQ ID NO: 559594 - DNA, 25 bp, Mus musculus
cacctttggatgatcatgtacagac

SEQ ID NO: 559595 - DNA, 25 bp, Mus musculus
cacctttggatgttcatgtacagac

SEQ ID NO: 559596 - DNA, 25 bp, Mus musculus
caccttttctgtatgagtctggaac

SEQ ID NO: 559597 - DNA, 25 bp, Mus musculus
caccttttctgtttgagtctggaac

SEQ ID NO: 559598 - DNA, 25 bp, Mus musculus
caccttttggagagagccactgcca

SEQ ID NO: 559599 - DNA, 25 bp, Mus musculus
caccttttggagtgagccactgcca

SEQ ID NO: 559600 - DNA, 25 bp, Mus musculus
cacgaaaagcgacttatattgaaga

SEQ ID NO: 559601 - DNA, 25 bp, Mus musculus
cacgaaaagcgagttatattgaaga

SEQ ID NO: 559602 - DNA, 25 bp, Mus musculus
cacgaaacaatgaatcagaaaagcc

SEQ ID NO: 559603 - DNA, 25 bp, Mus musculus
cacgaaacaatgtatcagaaaagcc

SEQ ID NO: 559604 - DNA, 25 bp, Mus musculus
cacgaaagaggactattgcttgacc

SEQ ID NO: 559605 - DNA, 25 bp, Mus musculus
cacgaaagaggagtattgcttgacc

SEQ ID NO: 559606 - DNA, 25 bp, Mus musculus
cacgaaagccgcacgaagttggagc

SEQ ID NO: 559607 - DNA, 25 bp, Mus musculus
cacgaaagccgctcgaagttggagc

SEQ ID NO: 559608 - DNA, 25 bp, Mus musculus
cacgaaaggattacggatccaaagt

SEQ ID NO: 559609 - DNA, 25 bp, Mus musculus
cacgaaaggatttcggatccaaagt

SEQ ID NO: 559610 - DNA, 25 bp, Mus musculus
cacgaaagggttagcaggtggatct

SEQ ID NO: 559611 - DNA, 25 bp, Mus musculus
cacgaaagggtttgcaggtggatct

SEQ ID NO: 559612 - DNA, 25 bp, Mus musculus
cacgaaatggttatttatgaagctg

SEQ ID NO: 559613 - DNA, 25 bp, Mus musculus
cacgaaatggttttttatgaagctg

SEQ ID NO: 559614 - DNA, 25 bp, Mus musculus
cacgaacaagtcaagagagctaaga

SEQ ID NO: 559615 - DNA, 25 bp, Mus musculus
cacgaacaagtctagagagctaaga

SEQ ID NO: 559616 - DNA, 25 bp, Mus musculus
cacgaacaccatagcaccattgtct

SEQ ID NO: 559617 - DNA, 25 bp, Mus musculus
cacgaacaccattgcaccattgtct

SEQ ID NO: 559618 - DNA, 25 bp, Mus musculus
cacgaacagggcaccattgagatgt

SEQ ID NO: 559619 - DNA, 25 bp, Mus musculus
cacgaacagggctccattgagatgt

SEQ ID NO: 559620 - DNA, 25 bp, Mus musculus
cacgaacagtatcacggcagtgagg

SEQ ID NO: 559621 - DNA, 25 bp, Mus musculus
cacgaacagtatgacggcagtgagg

SEQ ID NO: 559622 - DNA, 25 bp, Mus musculus
cacgaacctctcacaggatacgagg

SEQ ID NO: 559623 - DNA, 25 bp, Mus musculus
cacgaacctctctcaggatacgagg

SEQ ID NO: 559624 - DNA, 25 bp, Mus musculus
cacgaacgaaatcggaagcagtacc

SEQ ID NO: 559625 - DNA, 25 bp, Mus musculus
cacgaacgaaatgggaagcagtacc

SEQ ID NO: 559626 - DNA, 25 bp, Mus musculus
cacgaactgacccatggctatgacg

SEQ ID NO: 559627 - DNA, 25 bp, Mus musculus
cacgaactgaccgatggctatgacg

SEQ ID NO: 559628 - DNA, 25 bp, Mus musculus
cacgaagactccctcacagttgttt

SEQ ID NO: 559629 - DNA, 25 bp, Mus musculus
cacgaagactccgtcacagttgttt

SEQ ID NO: 559630 - DNA, 25 bp, Mus musculus
cacgaagactggattattaacaaga

SEQ ID NO: 559631 - DNA, 25 bp, Mus musculus
cacgaagactggtttattaacaaga

SEQ ID NO: 559632 - DNA, 25 bp, Mus musculus
cacgaagacttaaccaagtgcatga

SEQ ID NO: 559633 - DNA, 25 bp, Mus musculus
cacgaagacttatccaagtgcatga

SEQ ID NO: 559634 - DNA, 25 bp, Mus musculus
cacgaagagcttcctttacgagata

SEQ ID NO: 559635 - DNA, 25 bp, Mus musculus
cacgaagagcttgctttacgagata

SEQ ID NO: 559636 - DNA, 25 bp, Mus musculus
cacgaagagttcatcaggctacatg

SEQ ID NO: 559637 - DNA, 25 bp, Mus musculus
cacgaagagttcttcaggctacatg

SEQ ID NO: 559638 - DNA, 25 bp, Mus musculus
cacgaagattatcggcgcctatggg

SEQ ID NO: 559639 - DNA, 25 bp, Mus musculus
cacgaagattatgggcgcctatggg

SEQ ID NO: 559640 - DNA, 25 bp, Mus musculus
cacgaagccccgacggtgctattct

SEQ ID NO: 559641 - DNA, 25 bp, Mus musculus
cacgaagccccgtcggtgctattct

SEQ ID NO: 559642 - DNA, 25 bp, Mus musculus
cacgaagccgagaccccgtgctggg

SEQ ID NO: 559643 - DNA, 25 bp, Mus musculus
cacgaagccgagtccccgtgctggg

SEQ ID NO: 559644 - DNA, 25 bp, Mus musculus
cacgaagctctgattgatgctggca

SEQ ID NO: 559645 - DNA, 25 bp, Mus musculus
cacgaagctctgtttgatgctggca

SEQ ID NO: 559646 - DNA, 25 bp, Mus musculus
cacgaaggacttatatcattttcta

SEQ ID NO: 559647 - DNA, 25 bp, Mus musculus
cacgaaggacttttatcattttcta

SEQ ID NO: 559648 - DNA, 25 bp, Mus musculus
cacgaaggatgcagataacgacaac

SEQ ID NO: 559649 - DNA, 25 bp, Mus musculus
cacgaaggatgctgataacgacaac

SEQ ID NO: 559650 - DNA, 25 bp, Mus musculus
cacgaaggccgcaactctgaggcgg

SEQ ID NO: 559651 - DNA, 25 bp, Mus musculus
cacgaaggccgctactctgaggcgg

SEQ ID NO: 559652 - DNA, 25 bp, Mus musculus
cacgaagggcttaccacgtgtcgcc

SEQ ID NO: 559653 - DNA, 25 bp, Mus musculus
cacgaagggctttccacgtgtcgcc

SEQ ID NO: 559654 - DNA, 25 bp, Mus musculus
cacgaagtaagcattcacgagtaag

SEQ ID NO: 559655 - DNA, 25 bp, Mus musculus
cacgaagtaagctttcacgagtaag

SEQ ID NO: 559656 - DNA, 25 bp, Mus musculus
cacgaagtacctcaattttgctaca

SEQ ID NO: 559657 - DNA, 25 bp, Mus musculus
cacgaagtacctgaattttgctaca

SEQ ID NO: 559658 - DNA, 25 bp, Mus musculus
cacgaatcctttctatcagaggtgc

SEQ ID NO: 559659 - DNA, 25 bp, Mus musculus
cacgaatcctttgtatcagaggtgc

SEQ ID NO: 559660 - DNA, 25 bp, Mus musculus
cacgaatgacgtcgtgcagaatttt

SEQ ID NO: 559661 - DNA, 25 bp, Mus musculus
cacgaatgacgtggtgcagaatttt

SEQ ID NO: 559662 - DNA, 25 bp, Mus musculus
cacgaatgtctcagatcaagaggct

SEQ ID NO: 559663 - DNA, 25 bp, Mus musculus
cacgaatgtctctgatcaagaggct

SEQ ID NO: 559664 - DNA, 25 bp, Mus musculus
cacgacactcaaagtgaacttttaa

SEQ ID NO: 559665 - DNA, 25 bp, Mus musculus
cacgacactcaatgtgaacttttaa

SEQ ID NO: 559666 - DNA, 25 bp, Mus musculus
cacgacattccgattgggatcgaca

SEQ ID NO: 559667 - DNA, 25 bp, Mus musculus
cacgacattccgtttgggatcgaca

SEQ ID NO: 559668 - DNA, 25 bp, Mus musculus
cacgaccattagcaacttgttgcct

SEQ ID NO: 559669 - DNA, 25 bp, Mus musculus
cacgaccattaggaacttgttgcct

SEQ ID NO: 559670 - DNA, 25 bp, Mus musculus
cacgaccgcctcagctttgtcatgg

SEQ ID NO: 559671 - DNA, 25 bp, Mus musculus
cacgaccgcctctgctttgtcatgg

SEQ ID NO: 559672 - DNA, 25 bp, Mus musculus
cacgacctgaagctggcgagttgca

SEQ ID NO: 559673 - DNA, 25 bp, Mus musculus
cacgacctgaaggtggcgagttgca

SEQ ID NO: 559674 - DNA, 25 bp, Mus musculus
cacgacctgctacctgatgggagaa

SEQ ID NO: 559675 - DNA, 25 bp, Mus musculus
cacgacctgctagctgatgggagaa

SEQ ID NO: 559676 - DNA, 25 bp, Mus musculus
cacgacctggagacgttggcgttcc

SEQ ID NO: 559677 - DNA, 25 bp, Mus musculus
cacgacctggagtcgttggcgttcc

SEQ ID NO: 559678 - DNA, 25 bp, Mus musculus
cacgactcgagcagtaatggcaacc

SEQ ID NO: 559679 - DNA, 25 bp, Mus musculus
cacgactcgagctgtaatggcaacc

SEQ ID NO: 559680 - DNA, 25 bp, Mus musculus
cacgactgatctctggcagaactgt

SEQ ID NO: 559681 - DNA, 25 bp, Mus musculus
cacgactgatctgtggcagaactgt

SEQ ID NO: 559682 - DNA, 25 bp, Mus musculus
cacgacttgcggaggctttgagaag

SEQ ID NO: 559683 - DNA, 25 bp, Mus musculus
cacgacttgcggtggctttgagaag

SEQ ID NO: 559684 - DNA, 25 bp, Mus musculus
cacgacttgtttaagccctgcaggc

SEQ ID NO: 559685 - DNA, 25 bp, Mus musculus
cacgacttgttttagccctgcaggc

SEQ ID NO: 559686 - DNA, 25 bp, Mus musculus
cacgactttaatcagagggcagggc

SEQ ID NO: 559687 - DNA, 25 bp, Mus musculus
cacgactttaatgagagggcagggc

SEQ ID NO: 559688 - DNA, 25 bp, Mus musculus
cacgactttctgagacccaaggttt

SEQ ID NO: 559689 - DNA, 25 bp, Mus musculus
cacgactttctgtgacccaaggttt

SEQ ID NO: 559690 - DNA, 25 bp, Mus musculus
cacgagaaggagaggaagtgtacca

SEQ ID NO: 559691 - DNA, 25 bp, Mus musculus
cacgagaaggagtggaagtgtacca

SEQ ID NO: 559692 - DNA, 25 bp, Mus musculus
cacgagaatgagaacgctgaatgca

SEQ ID NO: 559693 - DNA, 25 bp, Mus musculus
cacgagaatgagtacgctgaatgca

SEQ ID NO: 559694 - DNA, 25 bp, Mus musculus
cacgagacatccagcaatgggagta

SEQ ID NO: 559695 - DNA, 25 bp, Mus musculus
cacgagacatcctgcaatgggagta

SEQ ID NO: 559696 - DNA, 25 bp, Mus musculus
cacgagacccaaaccacttgttggg

SEQ ID NO: 559697 - DNA, 25 bp, Mus musculus
cacgagacccaatccacttgttggg

SEQ ID NO: 559698 - DNA, 25 bp, Mus musculus
cacgagatgaacaagtggaagtatg

SEQ ID NO: 559699 - DNA, 25 bp, Mus musculus
cacgagatgaactagtggaagtatg

SEQ ID NO: 559700 - DNA, 25 bp, Mus musculus
cacgagcacatgcaggagctgattc

SEQ ID NO: 559701 - DNA, 25 bp, Mus musculus
cacgagcacatggaggagctgattc

SEQ ID NO: 559702 - DNA, 25 bp, Mus musculus
cacgagcagacgcacgccatgtatg

SEQ ID NO: 559703 - DNA, 25 bp, Mus musculus
cacgagcagacggacgccatgtatg

SEQ ID NO: 559704 - DNA, 25 bp, Mus musculus
cacgagcagcggcaacatggctcta

SEQ ID NO: 559705 - DNA, 25 bp, Mus musculus
cacgagcagcgggaacatggctcta

SEQ ID NO: 559706 - DNA, 25 bp, Mus musculus
cacgagccctacctcaagaactggg

SEQ ID NO: 559707 - DNA, 25 bp, Mus musculus
cacgagccctacgtcaagaactggg

SEQ ID NO: 559708 - DNA, 25 bp, Mus musculus
cacgagcgccggagctatgaagatg

SEQ ID NO: 559709 - DNA, 25 bp, Mus musculus
cacgagcgccggtgctatgaagatg

SEQ ID NO: 559710 - DNA, 25 bp, Mus musculus
cacgagctccagagattatttataa

SEQ ID NO: 559711 - DNA, 25 bp, Mus musculus
cacgagctccagtgattatttataa

SEQ ID NO: 559712 - DNA, 25 bp, Mus musculus
cacgagctgcggctctcttgcatac

SEQ ID NO: 559713 - DNA, 25 bp, Mus musculus
cacgagctgcgggtctcttgcatac

SEQ ID NO: 559714 - DNA, 25 bp, Mus musculus
cacgagctttctcaaataagaaggc

SEQ ID NO: 559715 - DNA, 25 bp, Mus musculus
cacgagctttctgaaataagaaggc

SEQ ID NO: 559716 - DNA, 25 bp, Mus musculus
cacgaggaacctctcagagtcggga

SEQ ID NO: 559717 - DNA, 25 bp, Mus musculus
cacgaggaacctgtcagagtcggga

SEQ ID NO: 559718 - DNA, 25 bp, Mus musculus
cacgaggacgacagtggtgtctaca

SEQ ID NO: 559719 - DNA, 25 bp, Mus musculus
cacgaggacgactgtggtgtctaca

SEQ ID NO: 559720 - DNA, 25 bp, Mus musculus
cacgaggacggcaacgctgctgtgt

SEQ ID NO: 559721 - DNA, 25 bp, Mus musculus
cacgaggacggctacgctgctgtgt

SEQ ID NO: 559722 - DNA, 25 bp, Mus musculus
cacgaggagctgagaactacctgca

SEQ ID NO: 559723 - DNA, 25 bp, Mus musculus
cacgaggagctgtgaactacctgca

SEQ ID NO: 559724 - DNA, 25 bp, Mus musculus
cacgaggatgagacccgagatgtgc

SEQ ID NO: 559725 - DNA, 25 bp, Mus musculus
cacgaggatgagtcccgagatgtgc

SEQ ID NO: 559726 - DNA, 25 bp, Mus musculus
cacgaggcatggacccagccaggat

SEQ ID NO: 559727 - DNA, 25 bp, Mus musculus
cacgaggcatggtcccagccaggat

SEQ ID NO: 559728 - DNA, 25 bp, Mus musculus
cacgaggcgaggaccagatgtgcaa

SEQ ID NO: 559729 - DNA, 25 bp, Mus musculus
cacgaggcgaggtccagatgtgcaa

SEQ ID NO: 559730 - DNA, 25 bp, Mus musculus
cacgaggctgctctaagttgggaca

SEQ ID NO: 559731 - DNA, 25 bp, Mus musculus
cacgaggctgctgtaagttgggaca

SEQ ID NO: 559732 - DNA, 25 bp, Mus musculus
cacgagggcggaaactgaatcctga

SEQ ID NO: 559733 - DNA, 25 bp, Mus musculus
cacgagggcggatactgaatcctga

SEQ ID NO: 559734 - DNA, 25 bp, Mus musculus
cacgagggtatgctgacagggagga

SEQ ID NO: 559735 - DNA, 25 bp, Mus musculus
cacgagggtatggtgacagggagga

SEQ ID NO: 559736 - DNA, 25 bp, Mus musculus
cacgagggtgtgatcaagtttcttc

SEQ ID NO: 559737 - DNA, 25 bp, Mus musculus
cacgagggtgtgttcaagtttcttc

SEQ ID NO: 559738 - DNA, 25 bp, Mus musculus
cacgaggtatttagtggttctcact

SEQ ID NO: 559739 - DNA, 25 bp, Mus musculus
cacgaggtattttgtggttctcact

SEQ ID NO: 559740 - DNA, 25 bp, Mus musculus
cacgaggtccggaagatgaccctgg

SEQ ID NO: 559741 - DNA, 25 bp, Mus musculus
cacgaggtccggtagatgaccctgg

SEQ ID NO: 559742 - DNA, 25 bp, Mus musculus
cacgaggttttgaagttctacgtca

SEQ ID NO: 559743 - DNA, 25 bp, Mus musculus
cacgaggttttgtagttctacgtca

SEQ ID NO: 559744 - DNA, 25 bp, Mus musculus
cacgagtacggcattgtgagcagca

SEQ ID NO: 559745 - DNA, 25 bp, Mus musculus
cacgagtacggctttgtgagcagca

SEQ ID NO: 559746 - DNA, 25 bp, Mus musculus
cacgagtgctgtattccttatatgg

SEQ ID NO: 559747 - DNA, 25 bp, Mus musculus
cacgagtgctgttttccttatatgg

SEQ ID NO: 559748 - DNA, 25 bp, Mus musculus
cacgagtgtgaccaatgtgggcccc

SEQ ID NO: 559749 - DNA, 25 bp, Mus musculus
cacgagtgtgacgaatgtgggcccc

SEQ ID NO: 559750 - DNA, 25 bp, Mus musculus
cacgagttccatcccaagtgtgttg

SEQ ID NO: 559751 - DNA, 25 bp, Mus musculus
cacgagttccatgccaagtgtgttg

SEQ ID NO: 559752 - DNA, 25 bp, Mus musculus
cacgagttctttcaagccattggct

SEQ ID NO: 559753 - DNA, 25 bp, Mus musculus
cacgagttctttgaagccattggct

SEQ ID NO: 559754 - DNA, 25 bp, Mus musculus
cacgagttgcctagcgtcacatgga

SEQ ID NO: 559755 - DNA, 25 bp, Mus musculus
cacgagttgccttgcgtcacatgga

SEQ ID NO: 559756 - DNA, 25 bp, Mus musculus
cacgagttgctcacagctcgggatt

SEQ ID NO: 559757 - DNA, 25 bp, Mus musculus
cacgagttgctctcagctcgggatt

SEQ ID NO: 559758 - DNA, 25 bp, Mus musculus
cacgagtttgtgatggcgcagtatg

SEQ ID NO: 559759 - DNA, 25 bp, Mus musculus
cacgagtttgtgttggcgcagtatg

SEQ ID NO: 559760 - DNA, 25 bp, Mus musculus
cacgatagttacagatggaatccag

SEQ ID NO: 559761 - DNA, 25 bp, Mus musculus
cacgatagttactgatggaatccag

SEQ ID NO: 559762 - DNA, 25 bp, Mus musculus
cacgatcagactctcattcgcaaag

SEQ ID NO: 559763 - DNA, 25 bp, Mus musculus
cacgatcagactgtcattcgcaaag

SEQ ID NO: 559764 - DNA, 25 bp, Mus musculus
cacgatccaaatctcggtctcggac

SEQ ID NO: 559765 - DNA, 25 bp, Mus musculus
cacgatccaaatgtcggtctcggac

SEQ ID NO: 559766 - DNA, 25 bp, Mus musculus
cacgatcgaaacctacaggcagcag

SEQ ID NO: 559767 - DNA, 25 bp, Mus musculus
cacgatcgaaacgtacaggcagcag

SEQ ID NO: 559768 - DNA, 25 bp, Mus musculus
cacgatcgaggtcgtttgctcttcc

SEQ ID NO: 559769 - DNA, 25 bp, Mus musculus
cacgatcgaggtggtttgctcttcc

SEQ ID NO: 559770 - DNA, 25 bp, Mus musculus
cacgatcgatgcaatgagacaggct

SEQ ID NO: 559771 - DNA, 25 bp, Mus musculus
cacgatcgatgctatgagacaggct

SEQ ID NO: 559772 - DNA, 25 bp, Mus musculus
cacgatcgccgacaacattcgctat

SEQ ID NO: 559773 - DNA, 25 bp, Mus musculus
cacgatcgccgagaacattcgctat

SEQ ID NO: 559774 - DNA, 25 bp, Mus musculus
cacgatcttgtcactgcactggaag

SEQ ID NO: 559775 - DNA, 25 bp, Mus musculus
cacgatcttgtctctgcactggaag

SEQ ID NO: 559776 - DNA, 25 bp, Mus musculus
cacgatgaacaacaactcatccagg

SEQ ID NO: 559777 - DNA, 25 bp, Mus musculus
cacgatgaacaagaactcatccagg

SEQ ID NO: 559778 - DNA, 25 bp, Mus musculus
cacgatgacttgaacctcaatgcca

SEQ ID NO: 559779 - DNA, 25 bp, Mus musculus
cacgatgacttgtacctcaatgcca

SEQ ID NO: 559780 - DNA, 25 bp, Mus musculus
cacgatgaggccatctccactgaac

SEQ ID NO: 559781 - DNA, 25 bp, Mus musculus
cacgatgaggccttctccactgaac

SEQ ID NO: 559782 - DNA, 25 bp, Mus musculus
cacgatgatcttcgtgctccaggca

SEQ ID NO: 559783 - DNA, 25 bp, Mus musculus
cacgatgatcttggtgctccaggca

SEQ ID NO: 559784 - DNA, 25 bp, Mus musculus
cacgatgcagggaccgacagtggtt

SEQ ID NO: 559785 - DNA, 25 bp, Mus musculus
cacgatgcagggtccgacagtggtt

SEQ ID NO: 559786 - DNA, 25 bp, Mus musculus
cacgatgcagtaatgaatccagcag

SEQ ID NO: 559787 - DNA, 25 bp, Mus musculus
cacgatgcagtattgaatccagcag

SEQ ID NO: 559788 - DNA, 25 bp, Mus musculus
cacgatgctgctctgtcaggctgga

SEQ ID NO: 559789 - DNA, 25 bp, Mus musculus
cacgatgctgctgtgtcaggctgga

SEQ ID NO: 559790 - DNA, 25 bp, Mus musculus
cacgatgctgtcagccagccagaag

SEQ ID NO: 559791 - DNA, 25 bp, Mus musculus
cacgatgctgtctgccagccagaag

SEQ ID NO: 559792 - DNA, 25 bp, Mus musculus
cacgatggagctacgagagtatcac

SEQ ID NO: 559793 - DNA, 25 bp, Mus musculus
cacgatggagcttcgagagtatcac

SEQ ID NO: 559794 - DNA, 25 bp, Mus musculus
cacgatggagtcacagcttacaact

SEQ ID NO: 559795 - DNA, 25 bp, Mus musculus
cacgatggagtctcagcttacaact

SEQ ID NO: 559796 - DNA, 25 bp, Mus musculus
cacgatggttcgagctgccggtgat

SEQ ID NO: 559797 - DNA, 25 bp, Mus musculus
cacgatggttcgtgctgccggtgat

SEQ ID NO: 559798 - DNA, 25 bp, Mus musculus
cacgatgtgcctctctccggttaaa

SEQ ID NO: 559799 - DNA, 25 bp, Mus musculus
cacgatgtgcctgtctccggttaaa

SEQ ID NO: 559800 - DNA, 25 bp, Mus musculus
cacgatgtgcttctggaataccagc

SEQ ID NO: 559801 - DNA, 25 bp, Mus musculus
cacgatgtgcttgtggaataccagc

SEQ ID NO: 559802 - DNA, 25 bp, Mus musculus
cacgatgtggaaagtcggtatacgc

SEQ ID NO: 559803 - DNA, 25 bp, Mus musculus
cacgatgtggaatgtcggtatacgc

SEQ ID NO: 559804 - DNA, 25 bp, Mus musculus
cacgattaatccagaagatggtttt

SEQ ID NO: 559805 - DNA, 25 bp, Mus musculus
cacgattaatcctgaagatggtttt

SEQ ID NO: 559806 - DNA, 25 bp, Mus musculus
cacgattacaggagcacatgggaga

SEQ ID NO: 559807 - DNA, 25 bp, Mus musculus
cacgattacaggtgcacatgggaga

SEQ ID NO: 559808 - DNA, 25 bp, Mus musculus
cacgattatctgaacctgtttcact

SEQ ID NO: 559809 - DNA, 25 bp, Mus musculus
cacgattatctgtacctgtttcact

SEQ ID NO: 559810 - DNA, 25 bp, Mus musculus
cacgattgacgacagaacgatcaac

SEQ ID NO: 559811 - DNA, 25 bp, Mus musculus
cacgattgacgagagaacgatcaac

SEQ ID NO: 559812 - DNA, 25 bp, Mus musculus
cacgattggagcaggcgtggtcaat

SEQ ID NO: 559813 - DNA, 25 bp, Mus musculus
cacgattggagctggcgtggtcaat

SEQ ID NO: 559814 - DNA, 25 bp, Mus musculus
cacgatttcatcactgggttccctc

SEQ ID NO: 559815 - DNA, 25 bp, Mus musculus
cacgatttcatctctgggttccctc

SEQ ID NO: 559816 - DNA, 25 bp, Mus musculus
cacgatttccctcctatgtttggag

SEQ ID NO: 559817 - DNA, 25 bp, Mus musculus
cacgatttccctgctatgtttggag

SEQ ID NO: 559818 - DNA, 25 bp, Mus musculus
cacgatttcctcaaatatgagttcg

SEQ ID NO: 559819 - DNA, 25 bp, Mus musculus
cacgatttcctctaatatgagttcg

SEQ ID NO: 559820 - DNA, 25 bp, Mus musculus
cacgatttctgcagcgggagactgt

SEQ ID NO: 559821 - DNA, 25 bp, Mus musculus
cacgatttctgctgcgggagactgt

SEQ ID NO: 559822 - DNA, 25 bp, Mus musculus
cacgcaaaccatcacggaaacacat

SEQ ID NO: 559823 - DNA, 25 bp, Mus musculus
cacgcaaaccatgacggaaacacat

SEQ ID NO: 559824 - DNA, 25 bp, Mus musculus
cacgcaacgggaagaggtcaacaag

SEQ ID NO: 559825 - DNA, 25 bp, Mus musculus
cacgcaacgggatgaggtcaacaag

SEQ ID NO: 559826 - DNA, 25 bp, Mus musculus
cacgcaagctgccaaagcgaaaaat

SEQ ID NO: 559827 - DNA, 25 bp, Mus musculus
cacgcaagctgcgaaagcgaaaaat

SEQ ID NO: 559828 - DNA, 25 bp, Mus musculus
cacgcaaggactatcatcgggaagc

SEQ ID NO: 559829 - DNA, 25 bp, Mus musculus
cacgcaaggactttcatcgggaagc

SEQ ID NO: 559830 - DNA, 25 bp, Mus musculus
cacgcaaggccaagattgagaagct

SEQ ID NO: 559831 - DNA, 25 bp, Mus musculus
cacgcaaggccatgattgagaagct

SEQ ID NO: 559832 - DNA, 25 bp, Mus musculus
cacgcaagggagcaacagttaaacc

SEQ ID NO: 559833 - DNA, 25 bp, Mus musculus
cacgcaagggaggaacagttaaacc

SEQ ID NO: 559834 - DNA, 25 bp, Mus musculus
cacgcacatgcaattcccgttcatg

SEQ ID NO: 559835 - DNA, 25 bp, Mus musculus
cacgcacatgcatttcccgttcatg

SEQ ID NO: 559836 - DNA, 25 bp, Mus musculus
cacgcacatgggagagaaacattac

SEQ ID NO: 559837 - DNA, 25 bp, Mus musculus
cacgcacatgggtgagaaacattac

SEQ ID NO: 559838 - DNA, 25 bp, Mus musculus
cacgcaccgttcctcctgatgttat

SEQ ID NO: 559839 - DNA, 25 bp, Mus musculus
cacgcaccgttcgtcctgatgttat

SEQ ID NO: 559840 - DNA, 25 bp, Mus musculus
cacgcaccttggacttggagagaac

SEQ ID NO: 559841 - DNA, 25 bp, Mus musculus
cacgcaccttggtcttggagagaac

SEQ ID NO: 559842 - DNA, 25 bp, Mus musculus
cacgcacgcgcacacattgagaagc

SEQ ID NO: 559843 - DNA, 25 bp, Mus musculus
cacgcacgcgcagacattgagaagc

SEQ ID NO: 559844 - DNA, 25 bp, Mus musculus
cacgcacgggtcatgtgaacaccga

SEQ ID NO: 559845 - DNA, 25 bp, Mus musculus
cacgcacgggtcttgtgaacaccga

SEQ ID NO: 559846 - DNA, 25 bp, Mus musculus
cacgcactacgtcggacttcagttc

SEQ ID NO: 559847 - DNA, 25 bp, Mus musculus
cacgcactacgtgggacttcagttc

SEQ ID NO: 559848 - DNA, 25 bp, Mus musculus
cacgcactctgcacctcgaaggttg

SEQ ID NO: 559849 - DNA, 25 bp, Mus musculus
cacgcactctgctcctcgaaggttg

SEQ ID NO: 559850 - DNA, 25 bp, Mus musculus
cacgcactggtgcttagcagcacgg

SEQ ID NO: 559851 - DNA, 25 bp, Mus musculus
cacgcactggtggttagcagcacgg

SEQ ID NO: 559852 - DNA, 25 bp, Mus musculus
cacgcacttcgtccatgtggcagag

SEQ ID NO: 559853 - DNA, 25 bp, Mus musculus
cacgcacttcgtgcatgtggcagag

SEQ ID NO: 559854 - DNA, 25 bp, Mus musculus
cacgcagaatgcaagtggataaaaa

SEQ ID NO: 559855 - DNA, 25 bp, Mus musculus
cacgcagaatgctagtggataaaaa

SEQ ID NO: 559856 - DNA, 25 bp, Mus musculus
cacgcagagcatcagcagcgcgcgt

SEQ ID NO: 559857 - DNA, 25 bp, Mus musculus
cacgcagagcatgagcagcgcgcgt

SEQ ID NO: 559858 - DNA, 25 bp, Mus musculus
cacgcagatcttcttctcactgggc

SEQ ID NO: 559859 - DNA, 25 bp, Mus musculus
cacgcagatcttgttctcactgggc

SEQ ID NO: 559860 - DNA, 25 bp, Mus musculus
cacgcagcagccagagcactattac

SEQ ID NO: 559861 - DNA, 25 bp, Mus musculus
cacgcagcagcctgagcactattac

SEQ ID NO: 559862 - DNA, 25 bp, Mus musculus
cacgcagcaggcagtgaatgagtgc

SEQ ID NO: 559863 - DNA, 25 bp, Mus musculus
cacgcagcaggctgtgaatgagtgc

SEQ ID NO: 559864 - DNA, 25 bp, Mus musculus
cacgcagcggaacagctgtgagtcc

SEQ ID NO: 559865 - DNA, 25 bp, Mus musculus
cacgcagcggaagagctgtgagtcc

SEQ ID NO: 559866 - DNA, 25 bp, Mus musculus
cacgcagcgtttagataaattattg

SEQ ID NO: 559867 - DNA, 25 bp, Mus musculus
cacgcagcgttttgataaattattg

SEQ ID NO: 559868 - DNA, 25 bp, Mus musculus
cacgcagctcggctgatcttagcca

SEQ ID NO: 559869 - DNA, 25 bp, Mus musculus
cacgcagctcgggtgatcttagcca

SEQ ID NO: 559870 - DNA, 25 bp, Mus musculus
cacgcagctggtaggtgaacagaac

SEQ ID NO: 559871 - DNA, 25 bp, Mus musculus
cacgcagctggttggtgaacagaac

SEQ ID NO: 559872 - DNA, 25 bp, Mus musculus
cacgcagggtttacaggcagctgtt

SEQ ID NO: 559873 - DNA, 25 bp, Mus musculus
cacgcagggttttcaggcagctgtt

SEQ ID NO: 559874 - DNA, 25 bp, Mus musculus
cacgcagtaagtcccagtcagggct

SEQ ID NO: 559875 - DNA, 25 bp, Mus musculus
cacgcagtaagtgccagtcagggct

SEQ ID NO: 559876 - DNA, 25 bp, Mus musculus
cacgcagtgactcaacagtgtagtc

SEQ ID NO: 559877 - DNA, 25 bp, Mus musculus
cacgcagtgactgaacagtgtagtc

SEQ ID NO: 559878 - DNA, 25 bp, Mus musculus
cacgcagttggcaggcttcagtgga

SEQ ID NO: 559879 - DNA, 25 bp, Mus musculus
cacgcagttggctggcttcagtgga

SEQ ID NO: 559880 - DNA, 25 bp, Mus musculus
cacgcatacacgcacaatctggaat

SEQ ID NO: 559881 - DNA, 25 bp, Mus musculus
cacgcatacacggacaatctggaat

SEQ ID NO: 559882 - DNA, 25 bp, Mus musculus
cacgcatcagacatctgtagggcta

SEQ ID NO: 559883 - DNA, 25 bp, Mus musculus
cacgcatcagacttctgtagggcta

SEQ ID NO: 559884 - DNA, 25 bp, Mus musculus
cacgcatcccggcatgagctggcag

SEQ ID NO: 559885 - DNA, 25 bp, Mus musculus
cacgcatcccgggatgagctggcag

SEQ ID NO: 559886 - DNA, 25 bp, Mus musculus
cacgcatgcatgatgcttagatatt

SEQ ID NO: 559887 - DNA, 25 bp, Mus musculus
cacgcatgcatgttgcttagatatt

SEQ ID NO: 559888 - DNA, 25 bp, Mus musculus
cacgcatgtgttccgtctgaaaagg

SEQ ID NO: 559889 - DNA, 25 bp, Mus musculus
cacgcatgtgttgcgtctgaaaagg

SEQ ID NO: 559890 - DNA, 25 bp, Mus musculus
cacgcattgaacattatgctagcag

SEQ ID NO: 559891 - DNA, 25 bp, Mus musculus
cacgcattgaactttatgctagcag

SEQ ID NO: 559892 - DNA, 25 bp, Mus musculus
cacgcattggtaccttggataacag

SEQ ID NO: 559893 - DNA, 25 bp, Mus musculus
cacgcattggtagcttggataacag

SEQ ID NO: 559894 - DNA, 25 bp, Mus musculus
cacgcattttgtctcacagaaccag

SEQ ID NO: 559895 - DNA, 25 bp, Mus musculus
cacgcattttgtgtcacagaaccag

SEQ ID NO: 559896 - DNA, 25 bp, Mus musculus
cacgccaatgtgattaaactaaaag

SEQ ID NO: 559897 - DNA, 25 bp, Mus musculus
cacgccaatgtgtttaaactaaaag

SEQ ID NO: 559898 - DNA, 25 bp, Mus musculus
cacgccacagatcgttattaactat

SEQ ID NO: 559899 - DNA, 25 bp, Mus musculus
cacgccacagatggttattaactat

SEQ ID NO: 559900 - DNA, 25 bp, Mus musculus
cacgccacgggcatttataatgtcg

SEQ ID NO: 559901 - DNA, 25 bp, Mus musculus
cacgccacgggcttttataatgtcg

SEQ ID NO: 559902 - DNA, 25 bp, Mus musculus
cacgccactgagcagaaactgctcg

SEQ ID NO: 559903 - DNA, 25 bp, Mus musculus
cacgccactgaggagaaactgctcg

SEQ ID NO: 559904 - DNA, 25 bp, Mus musculus
cacgccagaggaagacgattgttta

SEQ ID NO: 559905 - DNA, 25 bp, Mus musculus
cacgccagaggatgacgattgttta

SEQ ID NO: 559906 - DNA, 25 bp, Mus musculus
cacgccagagttagtagcacctgag

SEQ ID NO: 559907 - DNA, 25 bp, Mus musculus
cacgccagagtttgtagcacctgag

SEQ ID NO: 559908 - DNA, 25 bp, Mus musculus
cacgccaggaaactgcagccaaaaa

SEQ ID NO: 559909 - DNA, 25 bp, Mus musculus
cacgccaggaaagtgcagccaaaaa

SEQ ID NO: 559910 - DNA, 25 bp, Mus musculus
cacgccatcattcgagggattgtgg

SEQ ID NO: 559911 - DNA, 25 bp, Mus musculus
cacgccatcattggagggattgtgg

SEQ ID NO: 559912 - DNA, 25 bp, Mus musculus
cacgccattaaaaagcagtaggcct

SEQ ID NO: 559913 - DNA, 25 bp, Mus musculus
cacgccattaaatagcagtaggcct

SEQ ID NO: 559914 - DNA, 25 bp, Mus musculus
cacgccattgtcactgtgaacggca

SEQ ID NO: 559915 - DNA, 25 bp, Mus musculus
cacgccattgtctctgtgaacggca

SEQ ID NO: 559916 - DNA, 25 bp, Mus musculus
cacgcccatgatagctggccttggg

SEQ ID NO: 559917 - DNA, 25 bp, Mus musculus
cacgcccatgattgctggccttggg

SEQ ID NO: 559918 - DNA, 25 bp, Mus musculus
cacgcccggcacaatgaattgtacc

SEQ ID NO: 559919 - DNA, 25 bp, Mus musculus
cacgcccggcactatgaattgtacc

SEQ ID NO: 559920 - DNA, 25 bp, Mus musculus
cacgcccggcgacacaatatttttt

SEQ ID NO: 559921 - DNA, 25 bp, Mus musculus
cacgcccggcgagacaatatttttt

SEQ ID NO: 559922 - DNA, 25 bp, Mus musculus
cacgccgagcgactgagaagcccag

SEQ ID NO: 559923 - DNA, 25 bp, Mus musculus
cacgccgagcgagtgagaagcccag

SEQ ID NO: 559924 - DNA, 25 bp, Mus musculus
cacgccgcacctagagcatagacaa

SEQ ID NO: 559925 - DNA, 25 bp, Mus musculus
cacgccgcaccttgagcatagacaa

SEQ ID NO: 559926 - DNA, 25 bp, Mus musculus
cacgccggtgagcatctgctgcttg

SEQ ID NO: 559927 - DNA, 25 bp, Mus musculus
cacgccggtgaggatctgctgcttg

SEQ ID NO: 559928 - DNA, 25 bp, Mus musculus
cacgcctacggcaaggccgggaaga

SEQ ID NO: 559929 - DNA, 25 bp, Mus musculus
cacgcctacggctaggccgggaaga

SEQ ID NO: 559930 - DNA, 25 bp, Mus musculus
cacgcctctgccatatagcactatg

SEQ ID NO: 559931 - DNA, 25 bp, Mus musculus
cacgcctctgccttatagcactatg

SEQ ID NO: 559932 - DNA, 25 bp, Mus musculus
cacgcctggagcaggcccttggaga

SEQ ID NO: 559933 - DNA, 25 bp, Mus musculus
cacgcctggagctggcccttggaga

SEQ ID NO: 559934 - DNA, 25 bp, Mus musculus
cacgcctggtgtatcatactctgac

SEQ ID NO: 559935 - DNA, 25 bp, Mus musculus
cacgcctggtgtttcatactctgac

SEQ ID NO: 559936 - DNA, 25 bp, Mus musculus
cacgcctgtggtaagactactgcca

SEQ ID NO: 559937 - DNA, 25 bp, Mus musculus
cacgcctgtggttagactactgcca

SEQ ID NO: 559938 - DNA, 25 bp, Mus musculus
cacgccttttatcttgggcaaggag

SEQ ID NO: 559939 - DNA, 25 bp, Mus musculus
cacgccttttatgttgggcaaggag

SEQ ID NO: 559940 - DNA, 25 bp, Mus musculus
cacgcgccagaaccagtgcgggata

SEQ ID NO: 559941 - DNA, 25 bp, Mus musculus
cacgcgccagaagcagtgcgggata

SEQ ID NO: 559942 - DNA, 25 bp, Mus musculus
cacgcgcgagccacatcgtctgtgg

SEQ ID NO: 559943 - DNA, 25 bp, Mus musculus
cacgcgcgagcctcatcgtctgtgg

SEQ ID NO: 559944 - DNA, 25 bp, Mus musculus
cacgcgcgctttcgacctttgggtg

SEQ ID NO: 559945 - DNA, 25 bp, Mus musculus
cacgcgcgctttggacctttgggtg

SEQ ID NO: 559946 - DNA, 25 bp, Mus musculus
cacgcgctgtctcagaatgagagag

SEQ ID NO: 559947 - DNA, 25 bp, Mus musculus
cacgcgctgtctgagaatgagagag

SEQ ID NO: 559948 - DNA, 25 bp, Mus musculus
cacgcgcttggcaaagtacaggctc

SEQ ID NO: 559949 - DNA, 25 bp, Mus musculus
cacgcgcttggctaagtacaggctc

SEQ ID NO: 559950 - DNA, 25 bp, Mus musculus
cacgcggagccaaatgctgcctgtg

SEQ ID NO: 559951 - DNA, 25 bp, Mus musculus
cacgcggagccatatgctgcctgtg

SEQ ID NO: 559952 - DNA, 25 bp, Mus musculus
cacgcgggaggcactagagcgtctc

SEQ ID NO: 559953 - DNA, 25 bp, Mus musculus
cacgcgggaggctctagagcgtctc

SEQ ID NO: 559954 - DNA, 25 bp, Mus musculus
cacgcggtctccatgattgccttca

SEQ ID NO: 559955 - DNA, 25 bp, Mus musculus
cacgcggtctccttgattgccttca

SEQ ID NO: 559956 - DNA, 25 bp, Mus musculus
cacgcgtgatttcgccactgcggct

SEQ ID NO: 559957 - DNA, 25 bp, Mus musculus
cacgcgtgatttggccactgcggct

SEQ ID NO: 559958 - DNA, 25 bp, Mus musculus
cacgcgtgcatccactgggtcaaat

SEQ ID NO: 559959 - DNA, 25 bp, Mus musculus
cacgcgtgcatcgactgggtcaaat

SEQ ID NO: 559960 - DNA, 25 bp, Mus musculus
cacgcgtggcttataaccgaactca

SEQ ID NO: 559961 - DNA, 25 bp, Mus musculus
cacgcgtggcttttaaccgaactca

SEQ ID NO: 559962 - DNA, 25 bp, Mus musculus
cacgcgtggtccaggttacctgttc

SEQ ID NO: 559963 - DNA, 25 bp, Mus musculus
cacgcgtggtcctggttacctgttc

SEQ ID NO: 559964 - DNA, 25 bp, Mus musculus
cacgctaacaccctgcactgggtgg

SEQ ID NO: 559965 - DNA, 25 bp, Mus musculus
cacgctaacaccgtgcactgggtgg

SEQ ID NO: 559966 - DNA, 25 bp, Mus musculus
cacgctacggacagcgctcttcaga

SEQ ID NO: 559967 - DNA, 25 bp, Mus musculus
cacgctacggactgcgctcttcaga

SEQ ID NO: 559968 - DNA, 25 bp, Mus musculus
cacgctacttcccaagcatttttga

SEQ ID NO: 559969 - DNA, 25 bp, Mus musculus
cacgctacttccgaagcatttttga

SEQ ID NO: 559970 - DNA, 25 bp, Mus musculus
cacgctcacggtcgaatatccatgg

SEQ ID NO: 559971 - DNA, 25 bp, Mus musculus
cacgctcacggtggaatatccatgg

SEQ ID NO: 559972 - DNA, 25 bp, Mus musculus
cacgctcatggaaaccctgtttaac

SEQ ID NO: 559973 - DNA, 25 bp, Mus musculus
cacgctcatggataccctgtttaac

SEQ ID NO: 559974 - DNA, 25 bp, Mus musculus
cacgctcattggaaactggtaatca

SEQ ID NO: 559975 - DNA, 25 bp, Mus musculus
cacgctcattggtaactggtaatca

SEQ ID NO: 559976 - DNA, 25 bp, Mus musculus
cacgctcgccggcaactgagcattg

SEQ ID NO: 559977 - DNA, 25 bp, Mus musculus
cacgctcgccgggaactgagcattg

SEQ ID NO: 559978 - DNA, 25 bp, Mus musculus
cacgctcggaagcaaacagagtttc

SEQ ID NO: 559979 - DNA, 25 bp, Mus musculus
cacgctcggaaggaaacagagtttc

SEQ ID NO: 559980 - DNA, 25 bp, Mus musculus
cacgctcgtgtgcagacctgtgtca

SEQ ID NO: 559981 - DNA, 25 bp, Mus musculus
cacgctcgtgtggagacctgtgtca

SEQ ID NO: 559982 - DNA, 25 bp, Mus musculus
cacgctcgttttcttcttggcagcg

SEQ ID NO: 559983 - DNA, 25 bp, Mus musculus
cacgctcgttttgttcttggcagcg

SEQ ID NO: 559984 - DNA, 25 bp, Mus musculus
cacgctctctatctacattcttaca

SEQ ID NO: 559985 - DNA, 25 bp, Mus musculus
cacgctctctatgtacattcttaca

SEQ ID NO: 559986 - DNA, 25 bp, Mus musculus
cacgctctggcccagggcaggtcat

SEQ ID NO: 559987 - DNA, 25 bp, Mus musculus
cacgctctggccgagggcaggtcat

SEQ ID NO: 559988 - DNA, 25 bp, Mus musculus
cacgctcttctgagggctctgcttt

SEQ ID NO: 559989 - DNA, 25 bp, Mus musculus
cacgctcttctgtgggctctgcttt

SEQ ID NO: 559990 - DNA, 25 bp, Mus musculus
cacgctgaacgaaagggacacggag

SEQ ID NO: 559991 - DNA, 25 bp, Mus musculus
cacgctgaacgatagggacacggag

SEQ ID NO: 559992 - DNA, 25 bp, Mus musculus
cacgctgaatgacatctactttgga

SEQ ID NO: 559993 - DNA, 25 bp, Mus musculus
cacgctgaatgagatctactttgga

SEQ ID NO: 559994 - DNA, 25 bp, Mus musculus
cacgctgacagtcgttgctgaagaa

SEQ ID NO: 559995 - DNA, 25 bp, Mus musculus
cacgctgacagtggttgctgaagaa

SEQ ID NO: 559996 - DNA, 25 bp, Mus musculus
cacgctgagatgctgatgtcttgga

SEQ ID NO: 559997 - DNA, 25 bp, Mus musculus
cacgctgagatggtgatgtcttgga

SEQ ID NO: 559998 - DNA, 25 bp, Mus musculus
cacgctgagcccaagatgagggcgt

SEQ ID NO: 559999 - DNA, 25 bp, Mus musculus
cacgctgagccctagatgagggcgt

SEQ ID NO: 560000 - DNA, 25 bp, Mus musculus
cacgctgagcctccttgaagttgaa

SEQ ID NO: 560001 - DNA, 25 bp, Mus musculus
cacgctgagcctgcttgaagttgaa

SEQ ID NO: 560002 - DNA, 25 bp, Mus musculus
cacgctgaggcccagtagaagaaag

SEQ ID NO: 560003 - DNA, 25 bp, Mus musculus
cacgctgaggccgagtagaagaaag

SEQ ID NO: 560004 - DNA, 25 bp, Mus musculus
cacgctgatcagacagctaatgagg

SEQ ID NO: 560005 - DNA, 25 bp, Mus musculus
cacgctgatcagtcagctaatgagg

SEQ ID NO: 560006 - DNA, 25 bp, Mus musculus
cacgctgcagtgcatgtacggctgc

SEQ ID NO: 560007 - DNA, 25 bp, Mus musculus
cacgctgcagtggatgtacggctgc

SEQ ID NO: 560008 - DNA, 25 bp, Mus musculus
cacgctgcggttcgtccattcctag

SEQ ID NO: 560009 - DNA, 25 bp, Mus musculus
cacgctgcggttggtccattcctag

SEQ ID NO: 560010 - DNA, 25 bp, Mus musculus
cacgctgctattcgatcgttgctgg

SEQ ID NO: 560011 - DNA, 25 bp, Mus musculus
cacgctgctattggatcgttgctgg

SEQ ID NO: 560012 - DNA, 25 bp, Mus musculus
cacgctgcttaccaatacaggcaag

SEQ ID NO: 560013 - DNA, 25 bp, Mus musculus
cacgctgcttacgaatacaggcaag

SEQ ID NO: 560014 - DNA, 25 bp, Mus musculus
cacgctggattaagtctcggatcga

SEQ ID NO: 560015 - DNA, 25 bp, Mus musculus
cacgctggattatgtctcggatcga

SEQ ID NO: 560016 - DNA, 25 bp, Mus musculus
cacgctggcagtagcagtgcctctg

SEQ ID NO: 560017 - DNA, 25 bp, Mus musculus
cacgctggcagttgcagtgcctctg

SEQ ID NO: 560018 - DNA, 25 bp, Mus musculus
cacgctggccttctcttcgagtacg

SEQ ID NO: 560019 - DNA, 25 bp, Mus musculus
cacgctggccttgtcttcgagtacg

SEQ ID NO: 560020 - DNA, 25 bp, Mus musculus
cacgctgggaggatcatgggagaga

SEQ ID NO: 560021 - DNA, 25 bp, Mus musculus
cacgctgggaggttcatgggagaga

SEQ ID NO: 560022 - DNA, 25 bp, Mus musculus
cacgctgggtggacagcagtctcca

SEQ ID NO: 560023 - DNA, 25 bp, Mus musculus
cacgctgggtggtcagcagtctcca

SEQ ID NO: 560024 - DNA, 25 bp, Mus musculus
cacgctgtaacacaagcagtggtag

SEQ ID NO: 560025 - DNA, 25 bp, Mus musculus
cacgctgtaacagaagcagtggtag

SEQ ID NO: 560026 - DNA, 25 bp, Mus musculus
cacgctgtacatcctagtgagtggt

SEQ ID NO: 560027 - DNA, 25 bp, Mus musculus
cacgctgtacatgctagtgagtggt

SEQ ID NO: 560028 - DNA, 25 bp, Mus musculus
cacgctgtcgggatgcatcgacatc

SEQ ID NO: 560029 - DNA, 25 bp, Mus musculus
cacgctgtcgggttgcatcgacatc

SEQ ID NO: 560030 - DNA, 25 bp, Mus musculus
cacgctgtggcgacgtaatgccgag

SEQ ID NO: 560031 - DNA, 25 bp, Mus musculus
cacgctgtggcgtcgtaatgccgag

SEQ ID NO: 560032 - DNA, 25 bp, Mus musculus
cacgctgttattactgccctgtcca

SEQ ID NO: 560033 - DNA, 25 bp, Mus musculus
cacgctgttatttctgccctgtcca

SEQ ID NO: 560034 - DNA, 25 bp, Mus musculus
cacgctgttgcgctgacacgagatt

SEQ ID NO: 560035 - DNA, 25 bp, Mus musculus
cacgctgttgcggtgacacgagatt

SEQ ID NO: 560036 - DNA, 25 bp, Mus musculus
cacgcttagattcgaacaccgatgc

SEQ ID NO: 560037 - DNA, 25 bp, Mus musculus
cacgcttagattggaacaccgatgc

SEQ ID NO: 560038 - DNA, 25 bp, Mus musculus
cacgcttcatgacttctgaatacaa

SEQ ID NO: 560039 - DNA, 25 bp, Mus musculus
cacgcttcatgagttctgaatacaa

SEQ ID NO: 560040 - DNA, 25 bp, Mus musculus
cacgctttcagtccctgctggtgcg

SEQ ID NO: 560041 - DNA, 25 bp, Mus musculus
cacgctttcagtgcctgctggtgcg

SEQ ID NO: 560042 - DNA, 25 bp, Mus musculus
cacggaaacataatggacatgggcc

SEQ ID NO: 560043 - DNA, 25 bp, Mus musculus
cacggaaacatattggacatgggcc

SEQ ID NO: 560044 - DNA, 25 bp, Mus musculus
cacggaaataaccagcctgcaagaa

SEQ ID NO: 560045 - DNA, 25 bp, Mus musculus
cacggaaataacgagcctgcaagaa

SEQ ID NO: 560046 - DNA, 25 bp, Mus musculus
cacggaaatccccagccagggtggc

SEQ ID NO: 560047 - DNA, 25 bp, Mus musculus
cacggaaatcccgagccagggtggc

SEQ ID NO: 560048 - DNA, 25 bp, Mus musculus
cacggaaatccgatctctttcaccg

SEQ ID NO: 560049 - DNA, 25 bp, Mus musculus
cacggaaatccgttctctttcaccg

SEQ ID NO: 560050 - DNA, 25 bp, Mus musculus
cacggaacgcaacgctcccaagaag

SEQ ID NO: 560051 - DNA, 25 bp, Mus musculus
cacggaacgcaaggctcccaagaag

SEQ ID NO: 560052 - DNA, 25 bp, Mus musculus
cacggaactcacacatgaggactac

SEQ ID NO: 560053 - DNA, 25 bp, Mus musculus
cacggaactcactcatgaggactac

SEQ ID NO: 560054 - DNA, 25 bp, Mus musculus
cacggaagaaaaagggcgggccaat

SEQ ID NO: 560055 - DNA, 25 bp, Mus musculus
cacggaagaaaatgggcgggccaat

SEQ ID NO: 560056 - DNA, 25 bp, Mus musculus
cacggaagagatagtccagcgcaca

SEQ ID NO: 560057 - DNA, 25 bp, Mus musculus
cacggaagagattgtccagcgcaca

SEQ ID NO: 560058 - DNA, 25 bp, Mus musculus
cacggaagagcacgtcctggacgtc

SEQ ID NO: 560059 - DNA, 25 bp, Mus musculus
cacggaagagcaggtcctggacgtc

SEQ ID NO: 560060 - DNA, 25 bp, Mus musculus
cacggaagcctgaaaaagctcgcct

SEQ ID NO: 560061 - DNA, 25 bp, Mus musculus
cacggaagcctgagtgggatcctgt

SEQ ID NO: 560062 - DNA, 25 bp, Mus musculus
cacggaagcctgtaaaagctcgcct

SEQ ID NO: 560063 - DNA, 25 bp, Mus musculus
cacggaagcctgtgtgggatcctgt

SEQ ID NO: 560064 - DNA, 25 bp, Mus musculus
cacggaagcgcaagtcagagccagg

SEQ ID NO: 560065 - DNA, 25 bp, Mus musculus
cacggaagcgcatgtcagagccagg

SEQ ID NO: 560066 - DNA, 25 bp, Mus musculus
cacggaaggccacaagccggttgat

SEQ ID NO: 560067 - DNA, 25 bp, Mus musculus
cacggaaggccagaagccggttgat

SEQ ID NO: 560068 - DNA, 25 bp, Mus musculus
cacggaagtcaaagaagtctacatc

SEQ ID NO: 560069 - DNA, 25 bp, Mus musculus
cacggaagtcaatgaagtctacatc

SEQ ID NO: 560070 - DNA, 25 bp, Mus musculus
cacggacacacactgcaagcgtgta

SEQ ID NO: 560071 - DNA, 25 bp, Mus musculus
cacggacacacagtgcaagcgtgta

SEQ ID NO: 560072 - DNA, 25 bp, Mus musculus
cacggacagcttagtgagaagggtt

SEQ ID NO: 560073 - DNA, 25 bp, Mus musculus
cacggacagctttgtgagaagggtt

SEQ ID NO: 560074 - DNA, 25 bp, Mus musculus
cacggacatcatcagggtaaggcca

SEQ ID NO: 560075 - DNA, 25 bp, Mus musculus
cacggacatcatgagggtaaggcca

SEQ ID NO: 560076 - DNA, 25 bp, Mus musculus
cacggacatggaccctgaagtggca

SEQ ID NO: 560077 - DNA, 25 bp, Mus musculus
cacggacatggagcctgaagtggca

SEQ ID NO: 560078 - DNA, 25 bp, Mus musculus
cacggaccaagtcctgcattgggtg

SEQ ID NO: 560079 - DNA, 25 bp, Mus musculus
cacggaccaagtgctgcattgggtg

SEQ ID NO: 560080 - DNA, 25 bp, Mus musculus
cacggaccaggtcatcaaaccggtg

SEQ ID NO: 560081 - DNA, 25 bp, Mus musculus
cacggaccaggtgatcaaaccggtg

SEQ ID NO: 560082 - DNA, 25 bp, Mus musculus
cacggacgaggacggcaatgcttat

SEQ ID NO: 560083 - DNA, 25 bp, Mus musculus
cacggacgaggagggcaatgcttat

SEQ ID NO: 560084 - DNA, 25 bp, Mus musculus
cacggacgcccaagaggtaccggtg

SEQ ID NO: 560085 - DNA, 25 bp, Mus musculus
cacggacgcccatgaggtaccggtg

SEQ ID NO: 560086 - DNA, 25 bp, Mus musculus
cacggacggaagatgacctgagttt

SEQ ID NO: 560087 - DNA, 25 bp, Mus musculus
cacggacggaagttgacctgagttt

SEQ ID NO: 560088 - DNA, 25 bp, Mus musculus
cacggactatttcaaatggctcttc

SEQ ID NO: 560089 - DNA, 25 bp, Mus musculus
cacggactatttgaaatggctcttc

SEQ ID NO: 560090 - DNA, 25 bp, Mus musculus
cacggactcgagctcgtcatcaaga

SEQ ID NO: 560091 - DNA, 25 bp, Mus musculus
cacggactcgaggtcgtcatcaaga

SEQ ID NO: 560092 - DNA, 25 bp, Mus musculus
cacggactctacatcacacttcaaa

SEQ ID NO: 560093 - DNA, 25 bp, Mus musculus
cacggactctacttcacacttcaaa

SEQ ID NO: 560094 - DNA, 25 bp, Mus musculus
cacggactgtgtcaaagaaggtgca

SEQ ID NO: 560095 - DNA, 25 bp, Mus musculus
cacggactgtgtgaaagaaggtgca

SEQ ID NO: 560096 - DNA, 25 bp, Mus musculus
cacggacttctactcttctcggcag

SEQ ID NO: 560097 - DNA, 25 bp, Mus musculus
cacggacttctagtcttctcggcag

SEQ ID NO: 560098 - DNA, 25 bp, Mus musculus
cacggactttaacggcaatccccat

SEQ ID NO: 560099 - DNA, 25 bp, Mus musculus
cacggactttaagggcaatccccat

SEQ ID NO: 560100 - DNA, 25 bp, Mus musculus
cacggagaaaaaagatgagcccagc

SEQ ID NO: 560101 - DNA, 25 bp, Mus musculus
cacggagaaaaatgatgagcccagc

SEQ ID NO: 560102 - DNA, 25 bp, Mus musculus
cacggagagaggatgctgttttgat

SEQ ID NO: 560103 - DNA, 25 bp, Mus musculus
cacggagagaggttgctgttttgat

SEQ ID NO: 560104 - DNA, 25 bp, Mus musculus
cacggagagcttatgacgtcagggc

SEQ ID NO: 560105 - DNA, 25 bp, Mus musculus
cacggagagcttttgacgtcagggc

SEQ ID NO: 560106 - DNA, 25 bp, Mus musculus
cacggagaggacacagcagttccag

SEQ ID NO: 560107 - DNA, 25 bp, Mus musculus
cacggagaggactcagcagttccag

SEQ ID NO: 560108 - DNA, 25 bp, Mus musculus
cacggagaggtacatctgctagtcc

SEQ ID NO: 560109 - DNA, 25 bp, Mus musculus
cacggagaggtagatctgctagtcc

SEQ ID NO: 560110 - DNA, 25 bp, Mus musculus
cacggagatcccagaaggaattaca

SEQ ID NO: 560111 - DNA, 25 bp, Mus musculus
cacggagatccctgaaggaattaca

SEQ ID NO: 560112 - DNA, 25 bp, Mus musculus
cacggagcaatacagtgacatcggg

SEQ ID NO: 560113 - DNA, 25 bp, Mus musculus
cacggagcaatagagtgacatcggg

SEQ ID NO: 560114 - DNA, 25 bp, Mus musculus
cacggagcagaacccagacgtgttt

SEQ ID NO: 560115 - DNA, 25 bp, Mus musculus
cacggagcagaagccagacgtgttt

SEQ ID NO: 560116 - DNA, 25 bp, Mus musculus
cacggagccacacaacgaagatgcc

SEQ ID NO: 560117 - DNA, 25 bp, Mus musculus
cacggagccacagaacgaagatgcc

SEQ ID NO: 560118 - DNA, 25 bp, Mus musculus
cacggagcggaaagagatgtcagca

SEQ ID NO: 560119 - DNA, 25 bp, Mus musculus
cacggagcggaatgagatgtcagca

SEQ ID NO: 560120 - DNA, 25 bp, Mus musculus
cacggaggaaacaatcctgtactca

SEQ ID NO: 560121 - DNA, 25 bp, Mus musculus
cacggaggaaactatcctgtactca

SEQ ID NO: 560122 - DNA, 25 bp, Mus musculus
cacggaggagaaatcgcctaggcag

SEQ ID NO: 560123 - DNA, 25 bp, Mus musculus
cacggaggagaattcgcctaggcag

SEQ ID NO: 560124 - DNA, 25 bp, Mus musculus
cacggaggcattatgtacagaggtt

SEQ ID NO: 560125 - DNA, 25 bp, Mus musculus
cacggaggcattttgtacagaggtt

SEQ ID NO: 560126 - DNA, 25 bp, Mus musculus
cacggaggcgccaggtgaatacttc

SEQ ID NO: 560127 - DNA, 25 bp, Mus musculus
cacggaggcgcctggtgaatacttc

SEQ ID NO: 560128 - DNA, 25 bp, Mus musculus
cacggagggagtagaaacgcttgaa

SEQ ID NO: 560129 - DNA, 25 bp, Mus musculus
cacggagggagttgaaacgcttgaa

SEQ ID NO: 560130 - DNA, 25 bp, Mus musculus
cacggagggatcagtgaccacacgt

SEQ ID NO: 560131 - DNA, 25 bp, Mus musculus
cacggagggatctgtgaccacacgt

SEQ ID NO: 560132 - DNA, 25 bp, Mus musculus
cacggagtaacaacacctggaatga

SEQ ID NO: 560133 - DNA, 25 bp, Mus musculus
cacggagtaacatcacctggaatga

SEQ ID NO: 560134 - DNA, 25 bp, Mus musculus
cacggagtagcacggcatggcattt

SEQ ID NO: 560135 - DNA, 25 bp, Mus musculus
cacggagtagcagggcatggcattt

SEQ ID NO: 560136 - DNA, 25 bp, Mus musculus
cacggagttcctaccaagaactgca

SEQ ID NO: 560137 - DNA, 25 bp, Mus musculus
cacggagttccttccaagaactgca

SEQ ID NO: 560138 - DNA, 25 bp, Mus musculus
cacggataccatcaacgacgtagcc

SEQ ID NO: 560139 - DNA, 25 bp, Mus musculus
cacggataccatgaacgacgtagcc

SEQ ID NO: 560140 - DNA, 25 bp, Mus musculus
cacggatagacacccagctggtaga

SEQ ID NO: 560141 - DNA, 25 bp, Mus musculus
cacggatagacagccagctggtaga

SEQ ID NO: 560142 - DNA, 25 bp, Mus musculus
cacggatatgggaaaccaaactcca

SEQ ID NO: 560143 - DNA, 25 bp, Mus musculus
cacggatatgggtaaccaaactcca

SEQ ID NO: 560144 - DNA, 25 bp, Mus musculus
cacggatattaaagagtgtgagacc

SEQ ID NO: 560145 - DNA, 25 bp, Mus musculus
cacggatattaatgagtgtgagacc

SEQ ID NO: 560146 - DNA, 25 bp, Mus musculus
cacggatcagctcgatggagagaca

SEQ ID NO: 560147 - DNA, 25 bp, Mus musculus
cacggatcagctggatggagagaca

SEQ ID NO: 560148 - DNA, 25 bp, Mus musculus
cacggatcaggaaggctggattcag

SEQ ID NO: 560149 - DNA, 25 bp, Mus musculus
cacggatcaggatggctggattcag

SEQ ID NO: 560150 - DNA, 25 bp, Mus musculus
cacggatgccatccagaactacaat

SEQ ID NO: 560151 - DNA, 25 bp, Mus musculus
cacggatgccatgcagaactacaat

SEQ ID NO: 560152 - DNA, 25 bp, Mus musculus
cacggattgacgactatgacattgt

SEQ ID NO: 560153 - DNA, 25 bp, Mus musculus
cacggattgacgtctatgacattgt

SEQ ID NO: 560154 - DNA, 25 bp, Mus musculus
cacggattggaacccaagtgaagac

SEQ ID NO: 560155 - DNA, 25 bp, Mus musculus
cacggattggaagccaagtgaagac

SEQ ID NO: 560156 - DNA, 25 bp, Mus musculus
cacggcaacagtcatggtcattggc

SEQ ID NO: 560157 - DNA, 25 bp, Mus musculus
cacggcaacagtgatggtcattggc

SEQ ID NO: 560158 - DNA, 25 bp, Mus musculus
cacggcaacttcaacgagggagact

SEQ ID NO: 560159 - DNA, 25 bp, Mus musculus
cacggcaacttctacgagggagact

SEQ ID NO: 560160 - DNA, 25 bp, Mus musculus
cacggcaccctgactaacgatgaat

SEQ ID NO: 560161 - DNA, 25 bp, Mus musculus
cacggcaccctgtctaacgatgaat

SEQ ID NO: 560162 - DNA, 25 bp, Mus musculus
cacggcagcaggcaatgcaatggca

SEQ ID NO: 560163 - DNA, 25 bp, Mus musculus
cacggcagcagggaatgcaatggca

SEQ ID NO: 560164 - DNA, 25 bp, Mus musculus
cacggcagctcaacattgtccacgg

SEQ ID NO: 560165 - DNA, 25 bp, Mus musculus
cacggcagctcatcattgtccacgg

SEQ ID NO: 560166 - DNA, 25 bp, Mus musculus
cacggcagtgagaaccagtctgtga

SEQ ID NO: 560167 - DNA, 25 bp, Mus musculus
cacggcagtgagtaccagtctgtga

SEQ ID NO: 560168 - DNA, 25 bp, Mus musculus
cacggcataacaaggctggaagcga

SEQ ID NO: 560169 - DNA, 25 bp, Mus musculus
cacggcataacatggctggaagcga

SEQ ID NO: 560170 - DNA, 25 bp, Mus musculus
cacggcatcaccaacctgtgtgtca

SEQ ID NO: 560171 - DNA, 25 bp, Mus musculus
cacggcatcacctacctgtgtgtca

SEQ ID NO: 560172 - DNA, 25 bp, Mus musculus
cacggcatccctaccgatatgggat

SEQ ID NO: 560173 - DNA, 25 bp, Mus musculus
cacggcatcccttccgatatgggat

SEQ ID NO: 560174 - DNA, 25 bp, Mus musculus
cacggcatggatcacctcattggag

SEQ ID NO: 560175 - DNA, 25 bp, Mus musculus
cacggcatggatgacctcattggag

SEQ ID NO: 560176 - DNA, 25 bp, Mus musculus
cacggcattttcacggcgggttggt

SEQ ID NO: 560177 - DNA, 25 bp, Mus musculus
cacggcattttctcggcgggttggt

SEQ ID NO: 560178 - DNA, 25 bp, Mus musculus
cacggccagtggactttcctggatc

SEQ ID NO: 560179 - DNA, 25 bp, Mus musculus
cacggccagtggtctttcctggatc

SEQ ID NO: 560180 - DNA, 25 bp, Mus musculus
cacggcctattgctactcatgatgg

SEQ ID NO: 560181 - DNA, 25 bp, Mus musculus
cacggcctattggtactcatgatgg

SEQ ID NO: 560182 - DNA, 25 bp, Mus musculus
cacggcctcataccggtggttctgg

SEQ ID NO: 560183 - DNA, 25 bp, Mus musculus
cacggcctcatagcggtggttctgg

SEQ ID NO: 560184 - DNA, 25 bp, Mus musculus
cacggcctgatgattgtccctctca

SEQ ID NO: 560185 - DNA, 25 bp, Mus musculus
cacggcctgatgtttgtccctctca

SEQ ID NO: 560186 - DNA, 25 bp, Mus musculus
cacggcctttttctgcgctacggag

SEQ ID NO: 560187 - DNA, 25 bp, Mus musculus
cacggcctttttgtgcgctacggag

SEQ ID NO: 560188 - DNA, 25 bp, Mus musculus
cacggcgcctggaatggacttgtgt

SEQ ID NO: 560189 - DNA, 25 bp, Mus musculus
cacggcgcctggtatggacttgtgt

SEQ ID NO: 560190 - DNA, 25 bp, Mus musculus
cacggcgcggtgacattaagctgac

SEQ ID NO: 560191 - DNA, 25 bp, Mus musculus
cacggcgcggtgtcattaagctgac

SEQ ID NO: 560192 - DNA, 25 bp, Mus musculus
cacggcggctatacacgaagccgag

SEQ ID NO: 560193 - DNA, 25 bp, Mus musculus
cacggcggctattcacgaagccgag

SEQ ID NO: 560194 - DNA, 25 bp, Mus musculus
cacggcgtgagcatctggagcagat

SEQ ID NO: 560195 - DNA, 25 bp, Mus musculus
cacggcgtgagcttctggagcagat

SEQ ID NO: 560196 - DNA, 25 bp, Mus musculus
cacggctaggcaagtgcaagcagct

SEQ ID NO: 560197 - DNA, 25 bp, Mus musculus
cacggctaggcatgtgcaagcagct

SEQ ID NO: 560198 - DNA, 25 bp, Mus musculus
cacggctatcttcaggagctctctg

SEQ ID NO: 560199 - DNA, 25 bp, Mus musculus
cacggctatcttgaggagctctctg

SEQ ID NO: 560200 - DNA, 25 bp, Mus musculus
cacggctcagtcaggcctgggtgcc

SEQ ID NO: 560201 - DNA, 25 bp, Mus musculus
cacggctcagtctggcctgggtgcc

SEQ ID NO: 560202 - DNA, 25 bp, Mus musculus
cacggctcagtgctattctctttaa

SEQ ID NO: 560203 - DNA, 25 bp, Mus musculus
cacggctcagtggtattctctttaa

SEQ ID NO: 560204 - DNA, 25 bp, Mus musculus
cacggctcatctctgggcgttcagg

SEQ ID NO: 560205 - DNA, 25 bp, Mus musculus
cacggctcatctgtgggcgttcagg

SEQ ID NO: 560206 - DNA, 25 bp, Mus musculus
cacggctccaggatcactacgttga

SEQ ID NO: 560207 - DNA, 25 bp, Mus musculus
cacggctccaggttcactacgttga

SEQ ID NO: 560208 - DNA, 25 bp, Mus musculus
cacggctcgtggagaagctcatgcc

SEQ ID NO: 560209 - DNA, 25 bp, Mus musculus
cacggctcgtggtgaagctcatgcc

SEQ ID NO: 560210 - DNA, 25 bp, Mus musculus
cacggctctgagcttattctctcca

SEQ ID NO: 560211 - DNA, 25 bp, Mus musculus
cacggctctgaggttattctctcca

SEQ ID NO: 560212 - DNA, 25 bp, Mus musculus
cacggctgatggagccagctggcaa

SEQ ID NO: 560213 - DNA, 25 bp, Mus musculus
cacggctgatggtgccagctggcaa

SEQ ID NO: 560214 - DNA, 25 bp, Mus musculus
cacggctgccatcggaaactttcta

SEQ ID NO: 560215 - DNA, 25 bp, Mus musculus
cacggctgccatgggaaactttcta

SEQ ID NO: 560216 - DNA, 25 bp, Mus musculus
cacggctggagcaaaacgctacaag

SEQ ID NO: 560217 - DNA, 25 bp, Mus musculus
cacggctggagctaaacgctacaag

SEQ ID NO: 560218 - DNA, 25 bp, Mus musculus
cacggctgtagaccgagtgttgcca

SEQ ID NO: 560219 - DNA, 25 bp, Mus musculus
cacggctgtagagcgagtgttgcca

SEQ ID NO: 560220 - DNA, 25 bp, Mus musculus
cacggctgtcaacgctgcaatggag

SEQ ID NO: 560221 - DNA, 25 bp, Mus musculus
cacggctgtcaaggctgcaatggag

SEQ ID NO: 560222 - DNA, 25 bp, Mus musculus
cacggctgttagacagcgagatcaa

SEQ ID NO: 560223 - DNA, 25 bp, Mus musculus
cacggctgttagtcagcgagatcaa

SEQ ID NO: 560224 - DNA, 25 bp, Mus musculus
cacggcttccccagattatctggag

SEQ ID NO: 560225 - DNA, 25 bp, Mus musculus
cacggcttcccctgattatctggag

SEQ ID NO: 560226 - DNA, 25 bp, Mus musculus
cacggcttgctactttggaacaatt

SEQ ID NO: 560227 - DNA, 25 bp, Mus musculus
cacggcttgctagtttggaacaatt

SEQ ID NO: 560228 - DNA, 25 bp, Mus musculus
cacgggaaaccaactgtctgagctt

SEQ ID NO: 560229 - DNA, 25 bp, Mus musculus
cacgggaaaccatctgtctgagctt

SEQ ID NO: 560230 - DNA, 25 bp, Mus musculus
cacgggaagagaaccaggactcgct

SEQ ID NO: 560231 - DNA, 25 bp, Mus musculus
cacgggaagagatccaggactcgct

SEQ ID NO: 560232 - DNA, 25 bp, Mus musculus
cacgggaagccaaatttctacaacc

SEQ ID NO: 560233 - DNA, 25 bp, Mus musculus
cacgggaagccatatttctacaacc

SEQ ID NO: 560234 - DNA, 25 bp, Mus musculus
cacgggacagcacgctcattggaaa

SEQ ID NO: 560235 - DNA, 25 bp, Mus musculus
cacgggacagcaggctcattggaaa

SEQ ID NO: 560236 - DNA, 25 bp, Mus musculus
cacgggaccccgctgtgagattgat

SEQ ID NO: 560237 - DNA, 25 bp, Mus musculus
cacgggaccccggtgtgagattgat

SEQ ID NO: 560238 - DNA, 25 bp, Mus musculus
cacgggacctatctgatcatgtctc

SEQ ID NO: 560239 - DNA, 25 bp, Mus musculus
cacgggacctatgtgatcatgtctc

SEQ ID NO: 560240 - DNA, 25 bp, Mus musculus
cacgggacgaaaccatgactgtaat

SEQ ID NO: 560241 - DNA, 25 bp, Mus musculus
cacgggacgaaagcatgactgtaat

SEQ ID NO: 560242 - DNA, 25 bp, Mus musculus
cacgggagagatagtggtccgcctt

SEQ ID NO: 560243 - DNA, 25 bp, Mus musculus
cacgggagagattgtggtccgcctt

SEQ ID NO: 560244 - DNA, 25 bp, Mus musculus
cacgggagatttagctctggtgaaa

SEQ ID NO: 560245 - DNA, 25 bp, Mus musculus
cacgggagattttgctctggtgaaa

SEQ ID NO: 560246 - DNA, 25 bp, Mus musculus
cacgggagctttctcaataagccca

SEQ ID NO: 560247 - DNA, 25 bp, Mus musculus
cacgggagctttgtcaataagccca

SEQ ID NO: 560248 - DNA, 25 bp, Mus musculus
cacgggatactgaaaggacacagtt

SEQ ID NO: 560249 - DNA, 25 bp, Mus musculus
cacgggatactgtaaggacacagtt

SEQ ID NO: 560250 - DNA, 25 bp, Mus musculus
cacgggatcagcactttcatcgaca

SEQ ID NO: 560251 - DNA, 25 bp, Mus musculus
cacgggatcagctctttcatcgaca

SEQ ID NO: 560252 - DNA, 25 bp, Mus musculus
cacgggatcgcgaccaagtctgaat

SEQ ID NO: 560253 - DNA, 25 bp, Mus musculus
cacgggatcgcgtccaagtctgaat

SEQ ID NO: 560254 - DNA, 25 bp, Mus musculus
cacgggatgaccagttcaacaccaa

SEQ ID NO: 560255 - DNA, 25 bp, Mus musculus
cacgggatgacctgttcaacaccaa

SEQ ID NO: 560256 - DNA, 25 bp, Mus musculus
cacgggatgagtatccatactgcct

SEQ ID NO: 560257 - DNA, 25 bp, Mus musculus
cacgggatgagtttccatactgcct

SEQ ID NO: 560258 - DNA, 25 bp, Mus musculus
cacgggatgtacacagtgagacaga

SEQ ID NO: 560259 - DNA, 25 bp, Mus musculus
cacgggatgtactcagtgagacaga

SEQ ID NO: 560260 - DNA, 25 bp, Mus musculus
cacgggattgttcctggcttaccag

SEQ ID NO: 560261 - DNA, 25 bp, Mus musculus
cacgggattgttgctggcttaccag

SEQ ID NO: 560262 - DNA, 25 bp, Mus musculus
cacgggcagaggagtcaggtcattt

SEQ ID NO: 560263 - DNA, 25 bp, Mus musculus
cacgggcagaggtgtcaggtcattt

SEQ ID NO: 560264 - DNA, 25 bp, Mus musculus
cacgggcatcgtcgaaacacacttc

SEQ ID NO: 560265 - DNA, 25 bp, Mus musculus
cacgggcatcgtggaaacacacttc

SEQ ID NO: 560266 - DNA, 25 bp, Mus musculus
cacgggccccttcatttatatccag

SEQ ID NO: 560267 - DNA, 25 bp, Mus musculus
cacgggccccttgatttatatccag

SEQ ID NO: 560268 - DNA, 25 bp, Mus musculus
cacgggccgcatcactgactggatt

SEQ ID NO: 560269 - DNA, 25 bp, Mus musculus
cacgggccgcatgactgactggatt

SEQ ID NO: 560270 - DNA, 25 bp, Mus musculus
cacgggcgaagtcaataccatgggc

SEQ ID NO: 560271 - DNA, 25 bp, Mus musculus
cacgggcgaagtgaataccatgggc

SEQ ID NO: 560272 - DNA, 25 bp, Mus musculus
cacgggcgcagccttctatcacaag

SEQ ID NO: 560273 - DNA, 25 bp, Mus musculus
cacgggcgcagcgttctatcacaag

SEQ ID NO: 560274 - DNA, 25 bp, Mus musculus
cacgggctgcacagaagggacatga

SEQ ID NO: 560275 - DNA, 25 bp, Mus musculus
cacgggctgcactgaagggacatga

SEQ ID NO: 560276 - DNA, 25 bp, Mus musculus
cacgggctgctgatatttctagact

SEQ ID NO: 560277 - DNA, 25 bp, Mus musculus
cacgggctgctgttatttctagact

SEQ ID NO: 560278 - DNA, 25 bp, Mus musculus
cacgggctggacatacggcttgtca

SEQ ID NO: 560279 - DNA, 25 bp, Mus musculus
cacgggctggacttacggcttgtca

SEQ ID NO: 560280 - DNA, 25 bp, Mus musculus
cacgggcttggcaagcaaggatcac

SEQ ID NO: 560281 - DNA, 25 bp, Mus musculus
cacgggcttggctagcaaggatcac

SEQ ID NO: 560282 - DNA, 25 bp, Mus musculus
cacgggctttgtccctatgtacatt

SEQ ID NO: 560283 - DNA, 25 bp, Mus musculus
cacgggctttgtgcctatgtacatt

SEQ ID NO: 560284 - DNA, 25 bp, Mus musculus
cacgggtatctaagaagcactggaa

SEQ ID NO: 560285 - DNA, 25 bp, Mus musculus
cacgggtatctatgaagcactggaa

SEQ ID NO: 560286 - DNA, 25 bp, Mus musculus
cacgggtatctgactacaagcatca

SEQ ID NO: 560287 - DNA, 25 bp, Mus musculus
cacgggtatctgtctacaagcatca

SEQ ID NO: 560288 - DNA, 25 bp, Mus musculus
cacgggtcacgtcctggccttggta

SEQ ID NO: 560289 - DNA, 25 bp, Mus musculus
cacgggtcacgtgctggccttggta

SEQ ID NO: 560290 - DNA, 25 bp, Mus musculus
cacgggtccgagatgctgataccaa

SEQ ID NO: 560291 - DNA, 25 bp, Mus musculus
cacgggtccgagttgctgataccaa

SEQ ID NO: 560292 - DNA, 25 bp, Mus musculus
cacgggtcgtgacggactccagcca

SEQ ID NO: 560293 - DNA, 25 bp, Mus musculus
cacgggtcgtgagggactccagcca

SEQ ID NO: 560294 - DNA, 25 bp, Mus musculus
cacgggtttcagacgcatgagtgag

SEQ ID NO: 560295 - DNA, 25 bp, Mus musculus
cacgggtttcagtcgcatgagtgag

SEQ ID NO: 560296 - DNA, 25 bp, Mus musculus
cacggtacacccatgctgctggatg

SEQ ID NO: 560297 - DNA, 25 bp, Mus musculus
cacggtacacccttgctgctggatg

SEQ ID NO: 560298 - DNA, 25 bp, Mus musculus
cacggtagaagccatgcaggtcccc

SEQ ID NO: 560299 - DNA, 25 bp, Mus musculus
cacggtagaagcgatgcaggtcccc

SEQ ID NO: 560300 - DNA, 25 bp, Mus musculus
cacggtagaattctctctgctatgg

SEQ ID NO: 560301 - DNA, 25 bp, Mus musculus
cacggtagaattgtctctgctatgg

SEQ ID NO: 560302 - DNA, 25 bp, Mus musculus
cacggtagtgtcaggacagagtgta

SEQ ID NO: 560303 - DNA, 25 bp, Mus musculus
cacggtagtgtctggacagagtgta

SEQ ID NO: 560304 - DNA, 25 bp, Mus musculus
cacggtatactcatcttctggaatg

SEQ ID NO: 560305 - DNA, 25 bp, Mus musculus
cacggtatactcttcttctggaatg

SEQ ID NO: 560306 - DNA, 25 bp, Mus musculus
cacggtcaagtgattggctccagac

SEQ ID NO: 560307 - DNA, 25 bp, Mus musculus
cacggtcaagtgtttggctccagac

SEQ ID NO: 560308 - DNA, 25 bp, Mus musculus
cacggtcaccaccaaggttcggagg

SEQ ID NO: 560309 - DNA, 25 bp, Mus musculus
cacggtcaccacgaaggttcggagg

SEQ ID NO: 560310 - DNA, 25 bp, Mus musculus
cacggtcatacacagtagtctttca

SEQ ID NO: 560311 - DNA, 25 bp, Mus musculus
cacggtcatacagagtagtctttca

SEQ ID NO: 560312 - DNA, 25 bp, Mus musculus
cacggtcatgttcacagttgtggcc

SEQ ID NO: 560313 - DNA, 25 bp, Mus musculus
cacggtcatgttgacagttgtggcc

SEQ ID NO: 560314 - DNA, 25 bp, Mus musculus
cacggtccgcttctccaaagagaag

SEQ ID NO: 560315 - DNA, 25 bp, Mus musculus
cacggtccgcttgtccaaagagaag

SEQ ID NO: 560316 - DNA, 25 bp, Mus musculus
cacggtcctggaatcgcaaggctga

SEQ ID NO: 560317 - DNA, 25 bp, Mus musculus
cacggtcctggattcgcaaggctga

SEQ ID NO: 560318 - DNA, 25 bp, Mus musculus
cacggtccttgcacagtgccggaca

SEQ ID NO: 560319 - DNA, 25 bp, Mus musculus
cacggtccttgctcagtgccggaca

SEQ ID NO: 560320 - DNA, 25 bp, Mus musculus
cacggtcgagaacgacaaggtgacc

SEQ ID NO: 560321 - DNA, 25 bp, Mus musculus
cacggtcgagaaggacaaggtgacc

SEQ ID NO: 560322 - DNA, 25 bp, Mus musculus
cacggtcgcctcagtgtacaaaggg

SEQ ID NO: 560323 - DNA, 25 bp, Mus musculus
cacggtcgcctctgtgtacaaaggg

SEQ ID NO: 560324 - DNA, 25 bp, Mus musculus
cacggtcggaacagctacaagcgct

SEQ ID NO: 560325 - DNA, 25 bp, Mus musculus
cacggtcggaactgctacaagcgct

SEQ ID NO: 560326 - DNA, 25 bp, Mus musculus
cacggtctacctcaagctaggaggc

SEQ ID NO: 560327 - DNA, 25 bp, Mus musculus
cacggtctacctgaagctaggaggc

SEQ ID NO: 560328 - DNA, 25 bp, Mus musculus
cacggtctgggcaaaggatggtaca

SEQ ID NO: 560329 - DNA, 25 bp, Mus musculus
cacggtctgggctaaggatggtaca

SEQ ID NO: 560330 - DNA, 25 bp, Mus musculus
cacggtctttcccagtggccaggct

SEQ ID NO: 560331 - DNA, 25 bp, Mus musculus
cacggtctttccgagtggccaggct

SEQ ID NO: 560332 - DNA, 25 bp, Mus musculus
cacggtctttctcacttggctcgag

SEQ ID NO: 560333 - DNA, 25 bp, Mus musculus
cacggtctttctgacttggctcgag

SEQ ID NO: 560334 - DNA, 25 bp, Mus musculus
cacggtgaaaacaaaaacactggct

SEQ ID NO: 560335 - DNA, 25 bp, Mus musculus
cacggtgaaaactaaaacactggct

SEQ ID NO: 560336 - DNA, 25 bp, Mus musculus
cacggtgagagccaacaggtgctac

SEQ ID NO: 560337 - DNA, 25 bp, Mus musculus
cacggtgagagcgaacaggtgctac

SEQ ID NO: 560338 - DNA, 25 bp, Mus musculus
cacggtgaggccaagaaaatggctc

SEQ ID NO: 560339 - DNA, 25 bp, Mus musculus
cacggtgaggcctagaaaatggctc

SEQ ID NO: 560340 - DNA, 25 bp, Mus musculus
cacggtgatcgtcattttattcaca

SEQ ID NO: 560341 - DNA, 25 bp, Mus musculus
cacggtgatcgtgattttattcaca

SEQ ID NO: 560342 - DNA, 25 bp, Mus musculus
cacggtgatgcgcatgacagcgttt

SEQ ID NO: 560343 - DNA, 25 bp, Mus musculus
cacggtgatgcggatgacagcgttt

SEQ ID NO: 560344 - DNA, 25 bp, Mus musculus
cacggtgcgcttatggcaggctcac

SEQ ID NO: 560345 - DNA, 25 bp, Mus musculus
cacggtgcgcttttggcaggctcac

SEQ ID NO: 560346 - DNA, 25 bp, Mus musculus
cacggtgctgtgcaagggaccatct

SEQ ID NO: 560347 - DNA, 25 bp, Mus musculus
cacggtgctgtggaagggaccatct

SEQ ID NO: 560348 - DNA, 25 bp, Mus musculus
cacggtggaataaccatggaggtac

SEQ ID NO: 560349 - DNA, 25 bp, Mus musculus
cacggtggaatatccatggaggtac

SEQ ID NO: 560350 - DNA, 25 bp, Mus musculus
cacggtggacacagggacctgcagt

SEQ ID NO: 560351 - DNA, 25 bp, Mus musculus
cacggtggacactgggacctgcagt

SEQ ID NO: 560352 - DNA, 25 bp, Mus musculus
cacggtggaggtcgacctgcacaca

SEQ ID NO: 560353 - DNA, 25 bp, Mus musculus
cacggtggaggtggacctgcacaca

SEQ ID NO: 560354 - DNA, 25 bp, Mus musculus
cacggtggcttcagtcccaaggaag

SEQ ID NO: 560355 - DNA, 25 bp, Mus musculus
cacggtggcttctgtcccaaggaag

SEQ ID NO: 560356 - DNA, 25 bp, Mus musculus
cacggtggtcataagtcagggcaga

SEQ ID NO: 560357 - DNA, 25 bp, Mus musculus
cacggtggtcatcttctccatgcag

SEQ ID NO: 560358 - DNA, 25 bp, Mus musculus
cacggtggtcatgttctccatgcag

SEQ ID NO: 560359 - DNA, 25 bp, Mus musculus
cacggtggtcattagtcagggcaga

SEQ ID NO: 560360 - DNA, 25 bp, Mus musculus
cacggtggttctcggaggcatactt

SEQ ID NO: 560361 - DNA, 25 bp, Mus musculus
cacggtggttctgggaggcatactt

SEQ ID NO: 560362 - DNA, 25 bp, Mus musculus
cacggtgtatgcagtgagaagcttc

SEQ ID NO: 560363 - DNA, 25 bp, Mus musculus
cacggtgtatgctgtgagaagcttc

SEQ ID NO: 560364 - DNA, 25 bp, Mus musculus
cacggtgtcgaacgtttggatctac

SEQ ID NO: 560365 - DNA, 25 bp, Mus musculus
cacggtgtcgaaggtttggatctac

SEQ ID NO: 560366 - DNA, 25 bp, Mus musculus
cacggtgtcttcatgctaaacagca

SEQ ID NO: 560367 - DNA, 25 bp, Mus musculus
cacggtgtcttcttgctaaacagca

SEQ ID NO: 560368 - DNA, 25 bp, Mus musculus
cacggtgtgccaccctacagtactg

SEQ ID NO: 560369 - DNA, 25 bp, Mus musculus
cacggtgtgccagcctacagtactg

SEQ ID NO: 560370 - DNA, 25 bp, Mus musculus
cacggtgtggaaagagatgcactcc

SEQ ID NO: 560371 - DNA, 25 bp, Mus musculus
cacggtgtggaatgagatgcactcc

SEQ ID NO: 560372 - DNA, 25 bp, Mus musculus
cacggtgtggctctggtttgtacaa

SEQ ID NO: 560373 - DNA, 25 bp, Mus musculus
cacggtgtggctgtggtttgtacaa

SEQ ID NO: 560374 - DNA, 25 bp, Mus musculus
cacggtgtggtgaacgacacaatag

SEQ ID NO: 560375 - DNA, 25 bp, Mus musculus
cacggtgtggtgtacgacacaatag

SEQ ID NO: 560376 - DNA, 25 bp, Mus musculus
cacggtgtgtcaacttcaggagatc

SEQ ID NO: 560377 - DNA, 25 bp, Mus musculus
cacggtgtgtcatcttcaggagatc

SEQ ID NO: 560378 - DNA, 25 bp, Mus musculus
cacggttatgagaagccactgggct

SEQ ID NO: 560379 - DNA, 25 bp, Mus musculus
cacggttatgagtagccactgggct

SEQ ID NO: 560380 - DNA, 25 bp, Mus musculus
cacggttgatacatctctggagaga

SEQ ID NO: 560381 - DNA, 25 bp, Mus musculus
cacggttgatacttctctggagaga

SEQ ID NO: 560382 - DNA, 25 bp, Mus musculus
cacgtaatatgcaccagtgtgtcca

SEQ ID NO: 560383 - DNA, 25 bp, Mus musculus
cacgtaatatgctccagtgtgtcca

SEQ ID NO: 560384 - DNA, 25 bp, Mus musculus
cacgtacataaaagatgtgactttc

SEQ ID NO: 560385 - DNA, 25 bp, Mus musculus
cacgtacataaatgatgtgactttc

SEQ ID NO: 560386 - DNA, 25 bp, Mus musculus
cacgtacatgcgcaacaccagtaag

SEQ ID NO: 560387 - DNA, 25 bp, Mus musculus
cacgtacatgcggaacaccagtaag

SEQ ID NO: 560388 - DNA, 25 bp, Mus musculus
cacgtacccggcaagaaattgtcac

SEQ ID NO: 560389 - DNA, 25 bp, Mus musculus
cacgtacccggctagaaattgtcac

SEQ ID NO: 560390 - DNA, 25 bp, Mus musculus
cacgtactctttatacattgcaatg

SEQ ID NO: 560391 - DNA, 25 bp, Mus musculus
cacgtactctttttacattgcaatg

SEQ ID NO: 560392 - DNA, 25 bp, Mus musculus
cacgtactggaaatctaggaatggg

SEQ ID NO: 560393 - DNA, 25 bp, Mus musculus
cacgtactggaattctaggaatggg

SEQ ID NO: 560394 - DNA, 25 bp, Mus musculus
cacgtacttggaagtttctaaaaat

SEQ ID NO: 560395 - DNA, 25 bp, Mus musculus
cacgtacttggatgtttctaaaaat

SEQ ID NO: 560396 - DNA, 25 bp, Mus musculus
cacgtagaagcaattgttgagcatc

SEQ ID NO: 560397 - DNA, 25 bp, Mus musculus
cacgtagaagcatttgttgagcatc

SEQ ID NO: 560398 - DNA, 25 bp, Mus musculus
cacgtagagaagaccttccggaatt

SEQ ID NO: 560399 - DNA, 25 bp, Mus musculus
cacgtagagaagtccttccggaatt

SEQ ID NO: 560400 - DNA, 25 bp, Mus musculus
cacgtagaggcacgctctgaacttg

SEQ ID NO: 560401 - DNA, 25 bp, Mus musculus
cacgtagaggcaggctctgaacttg

SEQ ID NO: 560402 - DNA, 25 bp, Mus musculus
cacgtaggggttatcctgcaaaggg

SEQ ID NO: 560403 - DNA, 25 bp, Mus musculus
cacgtaggggttttcctgcaaaggg

SEQ ID NO: 560404 - DNA, 25 bp, Mus musculus
cacgtagtgaggatccacgagtgcg

SEQ ID NO: 560405 - DNA, 25 bp, Mus musculus
cacgtagtgaggttccacgagtgcg

SEQ ID NO: 560406 - DNA, 25 bp, Mus musculus
cacgtatatgcccagaccttagcca

SEQ ID NO: 560407 - DNA, 25 bp, Mus musculus
cacgtatatgccgagaccttagcca

SEQ ID NO: 560408 - DNA, 25 bp, Mus musculus
cacgtatgctgaaccccaattctac

SEQ ID NO: 560409 - DNA, 25 bp, Mus musculus
cacgtatgctgatccccaattctac

SEQ ID NO: 560410 - DNA, 25 bp, Mus musculus
cacgtattgttactagaattttcca

SEQ ID NO: 560411 - DNA, 25 bp, Mus musculus
cacgtattgttagtagaattttcca

SEQ ID NO: 560412 - DNA, 25 bp, Mus musculus
cacgtcaccataagaggcttaccaa

SEQ ID NO: 560413 - DNA, 25 bp, Mus musculus
cacgtcaccatatgaggcttaccaa

SEQ ID NO: 560414 - DNA, 25 bp, Mus musculus
cacgtcagattgagctggagaaaga

SEQ ID NO: 560415 - DNA, 25 bp, Mus musculus
cacgtcagattgtgctggagaaaga

SEQ ID NO: 560416 - DNA, 25 bp, Mus musculus
cacgtcagccgaacagagacttcag

SEQ ID NO: 560417 - DNA, 25 bp, Mus musculus
cacgtcagccgatcagagacttcag

SEQ ID NO: 560418 - DNA, 25 bp, Mus musculus
cacgtcaggcgacacaaaggtgtga

SEQ ID NO: 560419 - DNA, 25 bp, Mus musculus
cacgtcaggcgagacaaaggtgtga

SEQ ID NO: 560420 - DNA, 25 bp, Mus musculus
cacgtcatcatgaaggagctttgcg

SEQ ID NO: 560421 - DNA, 25 bp, Mus musculus
cacgtcatcatgtaggagctttgcg

SEQ ID NO: 560422 - DNA, 25 bp, Mus musculus
cacgtcatgacaaacttaggagaaa

SEQ ID NO: 560423 - DNA, 25 bp, Mus musculus
cacgtcatgacatacttaggagaaa

SEQ ID NO: 560424 - DNA, 25 bp, Mus musculus
cacgtccactttcatgaaaagctgc

SEQ ID NO: 560425 - DNA, 25 bp, Mus musculus
cacgtccactttgatgaaaagctgc

SEQ ID NO: 560426 - DNA, 25 bp, Mus musculus
cacgtccatggtccttcgtctggag

SEQ ID NO: 560427 - DNA, 25 bp, Mus musculus
cacgtccatggtgcttcgtctggag

SEQ ID NO: 560428 - DNA, 25 bp, Mus musculus
cacgtccattggacaaaaaggttga

SEQ ID NO: 560429 - DNA, 25 bp, Mus musculus
cacgtccattggtcaaaaaggttga

SEQ ID NO: 560430 - DNA, 25 bp, Mus musculus
cacgtcctgcaacccgagcaggtgt

SEQ ID NO: 560431 - DNA, 25 bp, Mus musculus
cacgtcctgcaagccgagcaggtgt

SEQ ID NO: 560432 - DNA, 25 bp, Mus musculus
cacgtccttgggattcggaagcagc

SEQ ID NO: 560433 - DNA, 25 bp, Mus musculus
cacgtccttgggtttcggaagcagc

SEQ ID NO: 560434 - DNA, 25 bp, Mus musculus
cacgtcgggtgaacctcactgaggc

SEQ ID NO: 560435 - DNA, 25 bp, Mus musculus
cacgtcgggtgatcctcactgaggc

SEQ ID NO: 560436 - DNA, 25 bp, Mus musculus
cacgtcggtttcaggacggcgatga

SEQ ID NO: 560437 - DNA, 25 bp, Mus musculus
cacgtcggtttctggacggcgatga

SEQ ID NO: 560438 - DNA, 25 bp, Mus musculus
cacgtcgtcatcaacggcagcagct

SEQ ID NO: 560439 - DNA, 25 bp, Mus musculus
cacgtcgtcatctacggcagcagct

SEQ ID NO: 560440 - DNA, 25 bp, Mus musculus
cacgtcgtgtggctgaactgtaaag

SEQ ID NO: 560441 - DNA, 25 bp, Mus musculus
cacgtcgtgtgggtgaactgtaaag

SEQ ID NO: 560442 - DNA, 25 bp, Mus musculus
cacgtctacgtgcaagaggtcccct

SEQ ID NO: 560443 - DNA, 25 bp, Mus musculus
cacgtctacgtggaagaggtcccct

SEQ ID NO: 560444 - DNA, 25 bp, Mus musculus
cacgtctccagtctgagtcactggt

SEQ ID NO: 560445 - DNA, 25 bp, Mus musculus
cacgtctccagtgtgagtcactggt

SEQ ID NO: 560446 - DNA, 25 bp, Mus musculus
cacgtctggctgactggatccacag

SEQ ID NO: 560447 - DNA, 25 bp, Mus musculus
cacgtctggctgtctggatccacag

SEQ ID NO: 560448 - DNA, 25 bp, Mus musculus
cacgtctgtgaactgttgctcacca

SEQ ID NO: 560449 - DNA, 25 bp, Mus musculus
cacgtctgtgaagtgttgctcacca

SEQ ID NO: 560450 - DNA, 25 bp, Mus musculus
cacgtgaaacctcggaaagcgcggc

SEQ ID NO: 560451 - DNA, 25 bp, Mus musculus
cacgtgaaacctgggaaagcgcggc

SEQ ID NO: 560452 - DNA, 25 bp, Mus musculus
cacgtgaaagatcaagtcaactggt

SEQ ID NO: 560453 - DNA, 25 bp, Mus musculus
cacgtgaaagatgaagtcaactggt

SEQ ID NO: 560454 - DNA, 25 bp, Mus musculus
cacgtgaagcgccttcgagaaatga

SEQ ID NO: 560455 - DNA, 25 bp, Mus musculus
cacgtgaagcgcgttcgagaaatga

SEQ ID NO: 560456 - DNA, 25 bp, Mus musculus
cacgtgaagtcacttcctggataca

SEQ ID NO: 560457 - DNA, 25 bp, Mus musculus
cacgtgaagtcagttcctggataca

SEQ ID NO: 560458 - DNA, 25 bp, Mus musculus
cacgtgactcgtagtttctggagaa

SEQ ID NO: 560459 - DNA, 25 bp, Mus musculus
cacgtgactcgttgtttctggagaa

SEQ ID NO: 560460 - DNA, 25 bp, Mus musculus
cacgtgactgagagctttttccgaa

SEQ ID NO: 560461 - DNA, 25 bp, Mus musculus
cacgtgactgagtgctttttccgaa

SEQ ID NO: 560462 - DNA, 25 bp, Mus musculus
cacgtgagagaacgttctgcgcaga

SEQ ID NO: 560463 - DNA, 25 bp, Mus musculus
cacgtgagagaaggttctgcgcaga

SEQ ID NO: 560464 - DNA, 25 bp, Mus musculus
cacgtgagagcacgaaatctggcct

SEQ ID NO: 560465 - DNA, 25 bp, Mus musculus
cacgtgagagcaggaaatctggcct

SEQ ID NO: 560466 - DNA, 25 bp, Mus musculus
cacgtgaggtcaatgaggccctgct

SEQ ID NO: 560467 - DNA, 25 bp, Mus musculus
cacgtgaggtcattgaggccctgct

SEQ ID NO: 560468 - DNA, 25 bp, Mus musculus
cacgtgcaagctcataagaaatgcc

SEQ ID NO: 560469 - DNA, 25 bp, Mus musculus
cacgtgcaagctgataagaaatgcc

SEQ ID NO: 560470 - DNA, 25 bp, Mus musculus
cacgtgcacagccaagaacgcacat

SEQ ID NO: 560471 - DNA, 25 bp, Mus musculus
cacgtgcacagcgaagaacgcacat

SEQ ID NO: 560472 - DNA, 25 bp, Mus musculus
cacgtgcagacaaaggcaaggtctc

SEQ ID NO: 560473 - DNA, 25 bp, Mus musculus
cacgtgcagacataggcaaggtctc

SEQ ID NO: 560474 - DNA, 25 bp, Mus musculus
cacgtgcagttgctgcgaaagccag

SEQ ID NO: 560475 - DNA, 25 bp, Mus musculus
cacgtgcagttggtgcgaaagccag

SEQ ID NO: 560476 - DNA, 25 bp, Mus musculus
cacgtgccacagctcatgtgtagag

SEQ ID NO: 560477 - DNA, 25 bp, Mus musculus
cacgtgccacaggtcatgtgtagag

SEQ ID NO: 560478 - DNA, 25 bp, Mus musculus
cacgtgcccaacattgccacaggag

SEQ ID NO: 560479 - DNA, 25 bp, Mus musculus
cacgtgcccaactttgccacaggag

SEQ ID NO: 560480 - DNA, 25 bp, Mus musculus
cacgtgcgggaacagttttagacaa

SEQ ID NO: 560481 - DNA, 25 bp, Mus musculus
cacgtgcgggaagagttttagacaa

SEQ ID NO: 560482 - DNA, 25 bp, Mus musculus
cacgtgctaacaccagcataggaca

SEQ ID NO: 560483 - DNA, 25 bp, Mus musculus
cacgtgctaacagcagcataggaca

SEQ ID NO: 560484 - DNA, 25 bp, Mus musculus
cacgtgctactaactgtcaggagga

SEQ ID NO: 560485 - DNA, 25 bp, Mus musculus
cacgtgctactatctgtcaggagga

SEQ ID NO: 560486 - DNA, 25 bp, Mus musculus
cacgtgctccctcacctaaaggagg

SEQ ID NO: 560487 - DNA, 25 bp, Mus musculus
cacgtgctccctgacctaaaggagg

SEQ ID NO: 560488 - DNA, 25 bp, Mus musculus
cacgtgctgctcataggaaggcgct

SEQ ID NO: 560489 - DNA, 25 bp, Mus musculus
cacgtgctgctcttaggaaggcgct

SEQ ID NO: 560490 - DNA, 25 bp, Mus musculus
cacgtgctgttaaaatgttgttaag

SEQ ID NO: 560491 - DNA, 25 bp, Mus musculus
cacgtgctgttataatgttgttaag

SEQ ID NO: 560492 - DNA, 25 bp, Mus musculus
cacgtgcttcttatttcgcctgcct

SEQ ID NO: 560493 - DNA, 25 bp, Mus musculus
cacgtgcttcttttttcgcctgcct

SEQ ID NO: 560494 - DNA, 25 bp, Mus musculus
cacgtggacctgatttattacctca

SEQ ID NO: 560495 - DNA, 25 bp, Mus musculus
cacgtggacctgttttattacctca

SEQ ID NO: 560496 - DNA, 25 bp, Mus musculus
cacgtggacttcctacaggaggtgc

SEQ ID NO: 560497 - DNA, 25 bp, Mus musculus
cacgtggacttcgtacaggaggtgc

SEQ ID NO: 560498 - DNA, 25 bp, Mus musculus
cacgtggagcccatggtgattagct

SEQ ID NO: 560499 - DNA, 25 bp, Mus musculus
cacgtggagcccttggtgattagct

SEQ ID NO: 560500 - DNA, 25 bp, Mus musculus
cacgtggaggcaatgtattaattac

SEQ ID NO: 560501 - DNA, 25 bp, Mus musculus
cacgtggaggcattgtattaattac

SEQ ID NO: 560502 - DNA, 25 bp, Mus musculus
cacgtggccatgaggtgtgtcatca

SEQ ID NO: 560503 - DNA, 25 bp, Mus musculus
cacgtggccatgtggtgtgtcatca

SEQ ID NO: 560504 - DNA, 25 bp, Mus musculus
cacgtggccattccagtagagggac

SEQ ID NO: 560505 - DNA, 25 bp, Mus musculus
cacgtggccattgcagtagagggac

SEQ ID NO: 560506 - DNA, 25 bp, Mus musculus
cacgtggccttgaactttatcctca

SEQ ID NO: 560507 - DNA, 25 bp, Mus musculus
cacgtggccttgacgctgtcttgca

SEQ ID NO: 560508 - DNA, 25 bp, Mus musculus
cacgtggccttgtactttatcctca

SEQ ID NO: 560509 - DNA, 25 bp, Mus musculus
cacgtggccttgtcgctgtcttgca

SEQ ID NO: 560510 - DNA, 25 bp, Mus musculus
cacgtggcggaccaaatgattggca

SEQ ID NO: 560511 - DNA, 25 bp, Mus musculus
cacgtggcggacgaaatgattggca

SEQ ID NO: 560512 - DNA, 25 bp, Mus musculus
cacgtggctgacagcagctggattc

SEQ ID NO: 560513 - DNA, 25 bp, Mus musculus
cacgtggctgactgcagctggattc

SEQ ID NO: 560514 - DNA, 25 bp, Mus musculus
cacgtggctgtgctctggactctga

SEQ ID NO: 560515 - DNA, 25 bp, Mus musculus
cacgtggctgtggtctggactctga

SEQ ID NO: 560516 - DNA, 25 bp, Mus musculus
cacgtggcttaaagtaaagacagca

SEQ ID NO: 560517 - DNA, 25 bp, Mus musculus
cacgtggcttaatgtaaagacagca

SEQ ID NO: 560518 - DNA, 25 bp, Mus musculus
cacgtgggcatgcatgaatcagaaa

SEQ ID NO: 560519 - DNA, 25 bp, Mus musculus
cacgtgggcatggatgaatcagaaa

SEQ ID NO: 560520 - DNA, 25 bp, Mus musculus
cacgtggtaaccatttgtcctgaag

SEQ ID NO: 560521 - DNA, 25 bp, Mus musculus
cacgtggtaaccttttgtcctgaag

SEQ ID NO: 560522 - DNA, 25 bp, Mus musculus
cacgtggtacgtcggcaagatcaac

SEQ ID NO: 560523 - DNA, 25 bp, Mus musculus
cacgtggtacgtgggcaagatcaac

SEQ ID NO: 560524 - DNA, 25 bp, Mus musculus
cacgtggtactgaccgatttcggcc

SEQ ID NO: 560525 - DNA, 25 bp, Mus musculus
cacgtggtactgtccgatttcggcc

SEQ ID NO: 560526 - DNA, 25 bp, Mus musculus
cacgtggtgtgtcttcatggtcaac

SEQ ID NO: 560527 - DNA, 25 bp, Mus musculus
cacgtggtgtgtgttcatggtcaac

SEQ ID NO: 560528 - DNA, 25 bp, Mus musculus
cacgtgtatttcctgcagcagtggc

SEQ ID NO: 560529 - DNA, 25 bp, Mus musculus
cacgtgtatttcgtgcagcagtggc

SEQ ID NO: 560530 - DNA, 25 bp, Mus musculus
cacgtgtcagcaatagattatctac

SEQ ID NO: 560531 - DNA, 25 bp, Mus musculus
cacgtgtcagcattagattatctac

SEQ ID NO: 560532 - DNA, 25 bp, Mus musculus
cacgtgtcatgcaggagtgtccgca

SEQ ID NO: 560533 - DNA, 25 bp, Mus musculus
cacgtgtcatgctggagtgtccgca

SEQ ID NO: 560534 - DNA, 25 bp, Mus musculus
cacgtgtccctgaccatagtaatcc

SEQ ID NO: 560535 - DNA, 25 bp, Mus musculus
cacgtgtccctgtccatagtaatcc

SEQ ID NO: 560536 - DNA, 25 bp, Mus musculus
cacgtgtgaggtatgtgaaagataa

SEQ ID NO: 560537 - DNA, 25 bp, Mus musculus
cacgtgtgaggtttgtgaaagataa

SEQ ID NO: 560538 - DNA, 25 bp, Mus musculus
cacgtgtgtcagagcacatgcctaa

SEQ ID NO: 560539 - DNA, 25 bp, Mus musculus
cacgtgtgtcagtgcacatgcctaa

SEQ ID NO: 560540 - DNA, 25 bp, Mus musculus
cacgtgtgtccaatgcagggatagc

SEQ ID NO: 560541 - DNA, 25 bp, Mus musculus
cacgtgtgtccattgcagggatagc

SEQ ID NO: 560542 - DNA, 25 bp, Mus musculus
cacgtgtgtggcagctgtacatcgg

SEQ ID NO: 560543 - DNA, 25 bp, Mus musculus
cacgtgtgtggctgctgtacatcgg

SEQ ID NO: 560544 - DNA, 25 bp, Mus musculus
cacgtgttagccaccatggtagccc

SEQ ID NO: 560545 - DNA, 25 bp, Mus musculus
cacgtgttagcctccatggtagccc

SEQ ID NO: 560546 - DNA, 25 bp, Mus musculus
cacgtgtttgggatcacgttctcct

SEQ ID NO: 560547 - DNA, 25 bp, Mus musculus
cacgtgtttgggttcacgttctcct

SEQ ID NO: 560548 - DNA, 25 bp, Mus musculus
cacgttaagaaaccccagagcctgg

SEQ ID NO: 560549 - DNA, 25 bp, Mus musculus
cacgttaagaaagcccagagcctgg

SEQ ID NO: 560550 - DNA, 25 bp, Mus musculus
cacgttagatgaagcggatgaccca

SEQ ID NO: 560551 - DNA, 25 bp, Mus musculus
cacgttagatgatgcggatgaccca

SEQ ID NO: 560552 - DNA, 25 bp, Mus musculus
cacgttagtgctcgctgtggcatca

SEQ ID NO: 560553 - DNA, 25 bp, Mus musculus
cacgttagtgctggctgtggcatca

SEQ ID NO: 560554 - DNA, 25 bp, Mus musculus
cacgttatggccatcgacagagttg

SEQ ID NO: 560555 - DNA, 25 bp, Mus musculus
cacgttatggccttcgacagagttg

SEQ ID NO: 560556 - DNA, 25 bp, Mus musculus
cacgttcaagaacagttgccccgag

SEQ ID NO: 560557 - DNA, 25 bp, Mus musculus
cacgttcaagaagagttgccccgag

SEQ ID NO: 560558 - DNA, 25 bp, Mus musculus
cacgttcaccttcttaaatgtgctt

SEQ ID NO: 560559 - DNA, 25 bp, Mus musculus
cacgttcaccttgttaaatgtgctt

SEQ ID NO: 560560 - DNA, 25 bp, Mus musculus
cacgttcagacaagatgtaccattg

SEQ ID NO: 560561 - DNA, 25 bp, Mus musculus
cacgttcagacatgatgtaccattg

SEQ ID NO: 560562 - DNA, 25 bp, Mus musculus
cacgttcagtttctcatctaccaga

SEQ ID NO: 560563 - DNA, 25 bp, Mus musculus
cacgttcagtttgtcatctaccaga

SEQ ID NO: 560564 - DNA, 25 bp, Mus musculus
cacgttcatcatcgagaagcagcct

SEQ ID NO: 560565 - DNA, 25 bp, Mus musculus
cacgttcatcatggagaagcagcct

SEQ ID NO: 560566 - DNA, 25 bp, Mus musculus
cacgttcatcgtcctgattagaaga

SEQ ID NO: 560567 - DNA, 25 bp, Mus musculus
cacgttcatcgtgctgattagaaga

SEQ ID NO: 560568 - DNA, 25 bp, Mus musculus
cacgttccacaacttgggaagccca

SEQ ID NO: 560569 - DNA, 25 bp, Mus musculus
cacgttccacaagttgggaagccca

SEQ ID NO: 560570 - DNA, 25 bp, Mus musculus
cacgttcctgtgactgtacggcatg

SEQ ID NO: 560571 - DNA, 25 bp, Mus musculus
cacgttcctgtgtctgtacggcatg

SEQ ID NO: 560572 - DNA, 25 bp, Mus musculus
cacgttccttgcagtggttatcctg

SEQ ID NO: 560573 - DNA, 25 bp, Mus musculus
cacgttccttgctgtggttatcctg

SEQ ID NO: 560574 - DNA, 25 bp, Mus musculus
cacgttctacatcaagggagcagac

SEQ ID NO: 560575 - DNA, 25 bp, Mus musculus
cacgttctacatgaagggagcagac

SEQ ID NO: 560576 - DNA, 25 bp, Mus musculus
cacgttctcaatctcctgaataaga

SEQ ID NO: 560577 - DNA, 25 bp, Mus musculus
cacgttctcaatgtcctgaataaga

SEQ ID NO: 560578 - DNA, 25 bp, Mus musculus
cacgttctcacactattgtccagat

SEQ ID NO: 560579 - DNA, 25 bp, Mus musculus
cacgttctcacagtattgtccagat

SEQ ID NO: 560580 - DNA, 25 bp, Mus musculus
cacgttctgctgcagtggcttccgg

SEQ ID NO: 560581 - DNA, 25 bp, Mus musculus
cacgttctgctggagtggcttccgg

SEQ ID NO: 560582 - DNA, 25 bp, Mus musculus
cacgttgaagtcacacctcctgttc

SEQ ID NO: 560583 - DNA, 25 bp, Mus musculus
cacgttgaagtctcacctcctgttc

SEQ ID NO: 560584 - DNA, 25 bp, Mus musculus
cacgttgccttgaggaggaacttag

SEQ ID NO: 560585 - DNA, 25 bp, Mus musculus
cacgttgccttgtggaggaacttag

SEQ ID NO: 560586 - DNA, 25 bp, Mus musculus
cacgttggcagaactggatgttaac

SEQ ID NO: 560587 - DNA, 25 bp, Mus musculus
cacgttggcagatctggatgttaac

SEQ ID NO: 560588 - DNA, 25 bp, Mus musculus
cacgttgtcacaaccagcgtcggaa

SEQ ID NO: 560589 - DNA, 25 bp, Mus musculus
cacgttgtcacatccagcgtcggaa

SEQ ID NO: 560590 - DNA, 25 bp, Mus musculus
cacgttgtgcagaactgtttcgggc

SEQ ID NO: 560591 - DNA, 25 bp, Mus musculus
cacgttgtgcagtactgtttcgggc

SEQ ID NO: 560592 - DNA, 25 bp, Mus musculus
cacgtttaccccagcaatccatgag

SEQ ID NO: 560593 - DNA, 25 bp, Mus musculus
cacgtttacccctgcaatccatgag

SEQ ID NO: 560594 - DNA, 25 bp, Mus musculus
cacgtttccaagaggaactttgaga

SEQ ID NO: 560595 - DNA, 25 bp, Mus musculus
cacgtttccaagtggaactttgaga

SEQ ID NO: 560596 - DNA, 25 bp, Mus musculus
cacgtttccgaacatgatgggctca

SEQ ID NO: 560597 - DNA, 25 bp, Mus musculus
cacgtttccgaagatgatgggctca

SEQ ID NO: 560598 - DNA, 25 bp, Mus musculus
cacgtttcctgtcaagatggcggat

SEQ ID NO: 560599 - DNA, 25 bp, Mus musculus
cacgtttcctgtgaagatggcggat

SEQ ID NO: 560600 - DNA, 25 bp, Mus musculus
cacgtttcggcccaagtggctgcag

SEQ ID NO: 560601 - DNA, 25 bp, Mus musculus
cacgtttcggccgaagtggctgcag

SEQ ID NO: 560602 - DNA, 25 bp, Mus musculus
cacgtttgctggctatcaataaaga

SEQ ID NO: 560603 - DNA, 25 bp, Mus musculus
cacgtttgctgggtatcaataaaga

SEQ ID NO: 560604 - DNA, 25 bp, Mus musculus
cacgttttcacaatcggtggataca

SEQ ID NO: 560605 - DNA, 25 bp, Mus musculus
cacgttttcacattcggtggataca

SEQ ID NO: 560606 - DNA, 25 bp, Mus musculus
cacgtttttgcaccttcgggaacag

SEQ ID NO: 560607 - DNA, 25 bp, Mus musculus
cacgtttttgcagcttcgggaacag

SEQ ID NO: 560608 - DNA, 25 bp, Mus musculus
cactaaacagtcaagactccgtgtg

SEQ ID NO: 560609 - DNA, 25 bp, Mus musculus
cactaaacagtcagaggtgggtgcc

SEQ ID NO: 560610 - DNA, 25 bp, Mus musculus
cactaaacagtctagactccgtgtg

SEQ ID NO: 560611 - DNA, 25 bp, Mus musculus
cactaaacagtctgaggtgggtgcc

SEQ ID NO: 560612 - DNA, 25 bp, Mus musculus
cactaaacgcgaaggtgaggacgga

SEQ ID NO: 560613 - DNA, 25 bp, Mus musculus
cactaaacgcgatggtgaggacgga

SEQ ID NO: 560614 - DNA, 25 bp, Mus musculus
cactaaagagagagaaggtggcttt

SEQ ID NO: 560615 - DNA, 25 bp, Mus musculus
cactaaagagagtgaaggtggcttt

SEQ ID NO: 560616 - DNA, 25 bp, Mus musculus
cactaaagcaacattgttgtggcga

SEQ ID NO: 560617 - DNA, 25 bp, Mus musculus
cactaaagcaactttgttgtggcga

SEQ ID NO: 560618 - DNA, 25 bp, Mus musculus
cactaaagctctcgatgtaccggag

SEQ ID NO: 560619 - DNA, 25 bp, Mus musculus
cactaaagctctggatgtaccggag

SEQ ID NO: 560620 - DNA, 25 bp, Mus musculus
cactaaagctgacgcggagaaggat

SEQ ID NO: 560621 - DNA, 25 bp, Mus musculus
cactaaagctgaggcggagaaggat

SEQ ID NO: 560622 - DNA, 25 bp, Mus musculus
cactaaaggataaaactcctgttgc

SEQ ID NO: 560623 - DNA, 25 bp, Mus musculus
cactaaaggatataactcctgttgc

SEQ ID NO: 560624 - DNA, 25 bp, Mus musculus
cactaaaggatgaaggcaaactcct

SEQ ID NO: 560625 - DNA, 25 bp, Mus musculus
cactaaaggatgtaggcaaactcct

SEQ ID NO: 560626 - DNA, 25 bp, Mus musculus
cactaaagtccacccgggagagtga

SEQ ID NO: 560627 - DNA, 25 bp, Mus musculus
cactaaagtccagccgggagagtga

SEQ ID NO: 560628 - DNA, 25 bp, Mus musculus
cactaaatgggaactatttggtaat

SEQ ID NO: 560629 - DNA, 25 bp, Mus musculus
cactaaatgggatctatttggtaat

SEQ ID NO: 560630 - DNA, 25 bp, Mus musculus
cactaaattcgaccttggtgatcac

SEQ ID NO: 560631 - DNA, 25 bp, Mus musculus
cactaaattcgagcttggtgatcac

SEQ ID NO: 560632 - DNA, 25 bp, Mus musculus
cactaacaaagtaacagattggtgc

SEQ ID NO: 560633 - DNA, 25 bp, Mus musculus
cactaacaaagttacagattggtgc

SEQ ID NO: 560634 - DNA, 25 bp, Mus musculus
cactaacaatgtagtacgctgtgac

SEQ ID NO: 560635 - DNA, 25 bp, Mus musculus
cactaacaatgttgtacgctgtgac

SEQ ID NO: 560636 - DNA, 25 bp, Mus musculus
cactaacagggcaggcaagccgaag

SEQ ID NO: 560637 - DNA, 25 bp, Mus musculus
cactaacagggctggcaagccgaag

SEQ ID NO: 560638 - DNA, 25 bp, Mus musculus
cactaacatgacaatgactgtccag

SEQ ID NO: 560639 - DNA, 25 bp, Mus musculus
cactaacatgactatgactgtccag

SEQ ID NO: 560640 - DNA, 25 bp, Mus musculus
cactaacattttacaccagccaatg

SEQ ID NO: 560641 - DNA, 25 bp, Mus musculus
cactaacatttttcaccagccaatg

SEQ ID NO: 560642 - DNA, 25 bp, Mus musculus
cactaaccagatatgtacctccaag

SEQ ID NO: 560643 - DNA, 25 bp, Mus musculus
cactaaccagatttgtacctccaag

SEQ ID NO: 560644 - DNA, 25 bp, Mus musculus
cactaaccagtgcaagttggtaaat

SEQ ID NO: 560645 - DNA, 25 bp, Mus musculus
cactaaccagtggaagttggtaaat

SEQ ID NO: 560646 - DNA, 25 bp, Mus musculus
cactaacgccccatttctgctattg

SEQ ID NO: 560647 - DNA, 25 bp, Mus musculus
cactaacgccccttttctgctattg

SEQ ID NO: 560648 - DNA, 25 bp, Mus musculus
cactaacggtgcagaacatggcatg

SEQ ID NO: 560649 - DNA, 25 bp, Mus musculus
cactaacggtgctgaacatggcatg

SEQ ID NO: 560650 - DNA, 25 bp, Mus musculus
cactaactacgacagccggaaggga

SEQ ID NO: 560651 - DNA, 25 bp, Mus musculus
cactaactacgagagccggaaggga

SEQ ID NO: 560652 - DNA, 25 bp, Mus musculus
cactaagaaaagactcaggcactgt

SEQ ID NO: 560653 - DNA, 25 bp, Mus musculus
cactaagaaaagtctcaggcactgt

SEQ ID NO: 560654 - DNA, 25 bp, Mus musculus
cactaagagcaaaaccaagaggaag

SEQ ID NO: 560655 - DNA, 25 bp, Mus musculus
cactaagagcaataccaagaggaag

SEQ ID NO: 560656 - DNA, 25 bp, Mus musculus
cactaagagccaacttagaagcttc

SEQ ID NO: 560657 - DNA, 25 bp, Mus musculus
cactaagagccatcttagaagcttc

SEQ ID NO: 560658 - DNA, 25 bp, Mus musculus
cactaagagtgacctgctggaggaa

SEQ ID NO: 560659 - DNA, 25 bp, Mus musculus
cactaagagtgagctgctggaggaa

SEQ ID NO: 560660 - DNA, 25 bp, Mus musculus
cactaagccgggacatggagctcaa

SEQ ID NO: 560661 - DNA, 25 bp, Mus musculus
cactaagccgggagtccgagcagtc

SEQ ID NO: 560662 - DNA, 25 bp, Mus musculus
cactaagccgggtcatggagctcaa

SEQ ID NO: 560663 - DNA, 25 bp, Mus musculus
cactaagccgggtgtccgagcagtc

SEQ ID NO: 560664 - DNA, 25 bp, Mus musculus
cactaagctcatagaatggctgcct

SEQ ID NO: 560665 - DNA, 25 bp, Mus musculus
cactaagctcattgaatggctgcct

SEQ ID NO: 560666 - DNA, 25 bp, Mus musculus
cactaaggagctcttgttaactagc

SEQ ID NO: 560667 - DNA, 25 bp, Mus musculus
cactaaggagctgttgttaactagc

SEQ ID NO: 560668 - DNA, 25 bp, Mus musculus
cactaaggctgcatttaatggcggc

SEQ ID NO: 560669 - DNA, 25 bp, Mus musculus
cactaaggctgcttttaatggcggc

SEQ ID NO: 560670 - DNA, 25 bp, Mus musculus
cactaaggtcagatgtgctgccgtc

SEQ ID NO: 560671 - DNA, 25 bp, Mus musculus
cactaaggtcagttgtgctgccgtc

SEQ ID NO: 560672 - DNA, 25 bp, Mus musculus
cactaaggttgcaagggcattgtgg

SEQ ID NO: 560673 - DNA, 25 bp, Mus musculus
cactaaggttgctagggcattgtgg

SEQ ID NO: 560674 - DNA, 25 bp, Mus musculus
cactaagtccttcgtgaaacattcc

SEQ ID NO: 560675 - DNA, 25 bp, Mus musculus
cactaagtccttggtgaaacattcc

SEQ ID NO: 560676 - DNA, 25 bp, Mus musculus
cactaagtgtctaggattaagtctc

SEQ ID NO: 560677 - DNA, 25 bp, Mus musculus
cactaagtgtcttggattaagtctc

SEQ ID NO: 560678 - DNA, 25 bp, Mus musculus
cactaagtgttaactgagaacctgc

SEQ ID NO: 560679 - DNA, 25 bp, Mus musculus
cactaagtgttatctgagaacctgc

SEQ ID NO: 560680 - DNA, 25 bp, Mus musculus
cactaatagcagagcgggcatccgg

SEQ ID NO: 560681 - DNA, 25 bp, Mus musculus
cactaatagcagtgcgggcatccgg

SEQ ID NO: 560682 - DNA, 25 bp, Mus musculus
cactaatccaggaggcttgttttgt

SEQ ID NO: 560683 - DNA, 25 bp, Mus musculus
cactaatccaggtggcttgttttgt

SEQ ID NO: 560684 - DNA, 25 bp, Mus musculus
cactaatcgaagagacatcaggaag

SEQ ID NO: 560685 - DNA, 25 bp, Mus musculus
cactaatcgaagtgacatcaggaag

SEQ ID NO: 560686 - DNA, 25 bp, Mus musculus
cactaatgagctatgaagttccgga

SEQ ID NO: 560687 - DNA, 25 bp, Mus musculus
cactaatgagctttgaagttccgga

SEQ ID NO: 560688 - DNA, 25 bp, Mus musculus
cactaatgtccaccgcttggctgaa

SEQ ID NO: 560689 - DNA, 25 bp, Mus musculus
cactaatgtccagcgcttggctgaa

SEQ ID NO: 560690 - DNA, 25 bp, Mus musculus
cactaattgcaaaccagccctggtt

SEQ ID NO: 560691 - DNA, 25 bp, Mus musculus
cactaattgcaatccagccctggtt

SEQ ID NO: 560692 - DNA, 25 bp, Mus musculus
cactaatttagaagggccctgtacc

SEQ ID NO: 560693 - DNA, 25 bp, Mus musculus
cactaatttagatgggccctgtacc

SEQ ID NO: 560694 - DNA, 25 bp, Mus musculus
cactaatttccaaagggtctgggag

SEQ ID NO: 560695 - DNA, 25 bp, Mus musculus
cactaatttccatagggtctgggag

SEQ ID NO: 560696 - DNA, 25 bp, Mus musculus
cactaatttggaccttaatcactgt

SEQ ID NO: 560697 - DNA, 25 bp, Mus musculus
cactaatttggagcttaatcactgt

SEQ ID NO: 560698 - DNA, 25 bp, Mus musculus
cactacaagggcacccagggatggg

SEQ ID NO: 560699 - DNA, 25 bp, Mus musculus
cactacaagggctcccagggatggg

SEQ ID NO: 560700 - DNA, 25 bp, Mus musculus
cactacaccacgatttcagaccttg

SEQ ID NO: 560701 - DNA, 25 bp, Mus musculus
cactacaccacgttttcagaccttg

SEQ ID NO: 560702 - DNA, 25 bp, Mus musculus
cactacacctggaaaaatatctttt

SEQ ID NO: 560703 - DNA, 25 bp, Mus musculus
cactacacctggtaaaatatctttt

SEQ ID NO: 560704 - DNA, 25 bp, Mus musculus
cactacacgggtcctgggcatggag

SEQ ID NO: 560705 - DNA, 25 bp, Mus musculus
cactacacgggtgctgggcatggag

SEQ ID NO: 560706 - DNA, 25 bp, Mus musculus
cactacagaggaccgcggagtcctt

SEQ ID NO: 560707 - DNA, 25 bp, Mus musculus
cactacagaggagcgcggagtcctt

SEQ ID NO: 560708 - DNA, 25 bp, Mus musculus
cactacagcgaacacggaagcatat

SEQ ID NO: 560709 - DNA, 25 bp, Mus musculus
cactacagcgaagacggaagcatat

SEQ ID NO: 560710 - DNA, 25 bp, Mus musculus
cactacagtgttactttaagacggt

SEQ ID NO: 560711 - DNA, 25 bp, Mus musculus
cactacagtgtttctttaagacggt

SEQ ID NO: 560712 - DNA, 25 bp, Mus musculus
cactaccaacacagttatagcaaag

SEQ ID NO: 560713 - DNA, 25 bp, Mus musculus
cactaccaacactgttatagcaaag

SEQ ID NO: 560714 - DNA, 25 bp, Mus musculus
cactaccaagtgaagccagagtcaa

SEQ ID NO: 560715 - DNA, 25 bp, Mus musculus
cactaccaagtgtagccagagtcaa

SEQ ID NO: 560716 - DNA, 25 bp, Mus musculus
cactaccagagcactatgaatgtca

SEQ ID NO: 560717 - DNA, 25 bp, Mus musculus
cactaccagagctctatgaatgtca

SEQ ID NO: 560718 - DNA, 25 bp, Mus musculus
cactaccccatgctagagtattgca

SEQ ID NO: 560719 - DNA, 25 bp, Mus musculus
cactaccccatggtagagtattgca

SEQ ID NO: 560720 - DNA, 25 bp, Mus musculus
cactacccggttagatgaggtcttc

SEQ ID NO: 560721 - DNA, 25 bp, Mus musculus
cactacccggtttgatgaggtcttc

SEQ ID NO: 560722 - DNA, 25 bp, Mus musculus
cactaccgctgcagatgtccagagg

SEQ ID NO: 560723 - DNA, 25 bp, Mus musculus
cactaccgctgctgatgtccagagg

SEQ ID NO: 560724 - DNA, 25 bp, Mus musculus
cactaccgggacctacagaggaagc

SEQ ID NO: 560725 - DNA, 25 bp, Mus musculus
cactaccgggacgtacagaggaagc

SEQ ID NO: 560726 - DNA, 25 bp, Mus musculus
cactacctcaccaagcaggatgtgg

SEQ ID NO: 560727 - DNA, 25 bp, Mus musculus
cactacctcacctagcaggatgtgg

SEQ ID NO: 560728 - DNA, 25 bp, Mus musculus
cactacctgagtcttcagtttcaga

SEQ ID NO: 560729 - DNA, 25 bp, Mus musculus
cactacctgagtgttcagtttcaga

SEQ ID NO: 560730 - DNA, 25 bp, Mus musculus
cactacgaagaaagacagaggagta

SEQ ID NO: 560731 - DNA, 25 bp, Mus musculus
cactacgaagaatgacagaggagta

SEQ ID NO: 560732 - DNA, 25 bp, Mus musculus
cactacgaaggtatcctctggatgc

SEQ ID NO: 560733 - DNA, 25 bp, Mus musculus
cactacgaaggtttcctctggatgc

SEQ ID NO: 560734 - DNA, 25 bp, Mus musculus
cactacggagtaagtgtagcctcag

SEQ ID NO: 560735 - DNA, 25 bp, Mus musculus
cactacggagtatgtgtagcctcag

SEQ ID NO: 560736 - DNA, 25 bp, Mus musculus
cactacgtgtgaagacacctactgt

SEQ ID NO: 560737 - DNA, 25 bp, Mus musculus
cactacgtgtgatgacacctactgt

SEQ ID NO: 560738 - DNA, 25 bp, Mus musculus
cactacgttctgacttcaaacagag

SEQ ID NO: 560739 - DNA, 25 bp, Mus musculus
cactacgttctgtcttcaaacagag

SEQ ID NO: 560740 - DNA, 25 bp, Mus musculus
cactacgttgagcttcaggtcttca

SEQ ID NO: 560741 - DNA, 25 bp, Mus musculus
cactacgttgaggttcaggtcttca

SEQ ID NO: 560742 - DNA, 25 bp, Mus musculus
cactactacctcatgaagccatgag

SEQ ID NO: 560743 - DNA, 25 bp, Mus musculus
cactactacctcttgaagccatgag

SEQ ID NO: 560744 - DNA, 25 bp, Mus musculus
cactactgaacaaagtcattctgaa

SEQ ID NO: 560745 - DNA, 25 bp, Mus musculus
cactactgaacatagtcattctgaa

SEQ ID NO: 560746 - DNA, 25 bp, Mus musculus
cactactggcgccaaggatgctatc

SEQ ID NO: 560747 - DNA, 25 bp, Mus musculus
cactactggcgcgaaggatgctatc

SEQ ID NO: 560748 - DNA, 25 bp, Mus musculus
cactactggtcgactccaaaggaga

SEQ ID NO: 560749 - DNA, 25 bp, Mus musculus
cactactggtcgtctccaaaggaga

SEQ ID NO: 560750 - DNA, 25 bp, Mus musculus
cactactggtgcatggcttggccct

SEQ ID NO: 560751 - DNA, 25 bp, Mus musculus
cactactggtgcttggcttggccct

SEQ ID NO: 560752 - DNA, 25 bp, Mus musculus
cactacttgtggatgttgaacctaa

SEQ ID NO: 560753 - DNA, 25 bp, Mus musculus
cactacttgtggttgttgaacctaa

SEQ ID NO: 560754 - DNA, 25 bp, Mus musculus
cactactttaacatcgacatgtcca

SEQ ID NO: 560755 - DNA, 25 bp, Mus musculus
cactactttaacttcgacatgtcca

SEQ ID NO: 560756 - DNA, 25 bp, Mus musculus
cactagaagcgtactgcaaacacaa

SEQ ID NO: 560757 - DNA, 25 bp, Mus musculus
cactagaagcgttctgcaaacacaa

SEQ ID NO: 560758 - DNA, 25 bp, Mus musculus
cactagaattaaccaactggtccag

SEQ ID NO: 560759 - DNA, 25 bp, Mus musculus
cactagaattaagcaactggtccag

SEQ ID NO: 560760 - DNA, 25 bp, Mus musculus
cactagacacccaagaagtcaggag

SEQ ID NO: 560761 - DNA, 25 bp, Mus musculus
cactagacaccctagaagtcaggag

SEQ ID NO: 560762 - DNA, 25 bp, Mus musculus
cactagactaggaatttggaaagcc

SEQ ID NO: 560763 - DNA, 25 bp, Mus musculus
cactagactaggtatttggaaagcc

SEQ ID NO: 560764 - DNA, 25 bp, Mus musculus
cactagagaaaaaatgtgaggtgga

SEQ ID NO: 560765 - DNA, 25 bp, Mus musculus
cactagagaaaatatgtgaggtgga

SEQ ID NO: 560766 - DNA, 25 bp, Mus musculus
cactagagaaagacatcgagatcca

SEQ ID NO: 560767 - DNA, 25 bp, Mus musculus
cactagagaaagtcatcgagatcca

SEQ ID NO: 560768 - DNA, 25 bp, Mus musculus
cactagagcgtcactcctcgtggaa

SEQ ID NO: 560769 - DNA, 25 bp, Mus musculus
cactagagcgtctctcctcgtggaa

SEQ ID NO: 560770 - DNA, 25 bp, Mus musculus
cactagagtatgattttggaagcca

SEQ ID NO: 560771 - DNA, 25 bp, Mus musculus
cactagagtatgtttttggaagcca

SEQ ID NO: 560772 - DNA, 25 bp, Mus musculus
cactagagtgtaatgaccctgccaa

SEQ ID NO: 560773 - DNA, 25 bp, Mus musculus
cactagagtgtattgaccctgccaa

SEQ ID NO: 560774 - DNA, 25 bp, Mus musculus
cactagatagtgatggagactcaga

SEQ ID NO: 560775 - DNA, 25 bp, Mus musculus
cactagatagtgttggagactcaga

SEQ ID NO: 560776 - DNA, 25 bp, Mus musculus
cactagatcccgcagagccttggtg

SEQ ID NO: 560777 - DNA, 25 bp, Mus musculus
cactagatcccggagagccttggtg

SEQ ID NO: 560778 - DNA, 25 bp, Mus musculus
cactagcagagtaatcccccatgta

SEQ ID NO: 560779 - DNA, 25 bp, Mus musculus
cactagcagagttatcccccatgta

SEQ ID NO: 560780 - DNA, 25 bp, Mus musculus
cactagcagtatccccggagtgcca

SEQ ID NO: 560781 - DNA, 25 bp, Mus musculus
cactagcagtatgcccggagtgcca

SEQ ID NO: 560782 - DNA, 25 bp, Mus musculus
cactagcgatggatggtcagagaca

SEQ ID NO: 560783 - DNA, 25 bp, Mus musculus
cactagcgatggttggtcagagaca

SEQ ID NO: 560784 - DNA, 25 bp, Mus musculus
cactagcggcggcattttgcaggca

SEQ ID NO: 560785 - DNA, 25 bp, Mus musculus
cactagcggcgggattttgcaggca

SEQ ID NO: 560786 - DNA, 25 bp, Mus musculus
cactagctaagtctgtcctggcaga

SEQ ID NO: 560787 - DNA, 25 bp, Mus musculus
cactagctaagtgtgtcctggcaga

SEQ ID NO: 560788 - DNA, 25 bp, Mus musculus
cactagctgactatttaaagagtac

SEQ ID NO: 560789 - DNA, 25 bp, Mus musculus
cactagctgactctactgcatttca

SEQ ID NO: 560790 - DNA, 25 bp, Mus musculus
cactagctgactgtactgcatttca

SEQ ID NO: 560791 - DNA, 25 bp, Mus musculus
cactagctgactttttaaagagtac

SEQ ID NO: 560792 - DNA, 25 bp, Mus musculus
cactagctttgcctactacgggctg

SEQ ID NO: 560793 - DNA, 25 bp, Mus musculus
cactagctttgcgtactacgggctg

SEQ ID NO: 560794 - DNA, 25 bp, Mus musculus
cactaggagacgctgctgggtcaaa

SEQ ID NO: 560795 - DNA, 25 bp, Mus musculus
cactaggagacggtgctgggtcaaa

SEQ ID NO: 560796 - DNA, 25 bp, Mus musculus
cactaggagaggagccaaaggatca

SEQ ID NO: 560797 - DNA, 25 bp, Mus musculus
cactaggagaggtgccaaaggatca

SEQ ID NO: 560798 - DNA, 25 bp, Mus musculus
cactaggcctcaatggcgtcctcaa

SEQ ID NO: 560799 - DNA, 25 bp, Mus musculus
cactaggcctcattggcgtcctcaa

SEQ ID NO: 560800 - DNA, 25 bp, Mus musculus
cactaggcgagtaagatagggaacc

SEQ ID NO: 560801 - DNA, 25 bp, Mus musculus
cactaggcgagttagatagggaacc

SEQ ID NO: 560802 - DNA, 25 bp, Mus musculus
cactaggcttggagctgagccgtcg

SEQ ID NO: 560803 - DNA, 25 bp, Mus musculus
cactaggcttggtgctgagccgtcg

SEQ ID NO: 560804 - DNA, 25 bp, Mus musculus
cactagggagctcgcttttcagatc

SEQ ID NO: 560805 - DNA, 25 bp, Mus musculus
cactagggagctggcttttcagatc

SEQ ID NO: 560806 - DNA, 25 bp, Mus musculus
cactaggtcattctctactacaggg

SEQ ID NO: 560807 - DNA, 25 bp, Mus musculus
cactaggtcattgtctactacaggg

SEQ ID NO: 560808 - DNA, 25 bp, Mus musculus
cactaggtgcgcacagcgtcctcgt

SEQ ID NO: 560809 - DNA, 25 bp, Mus musculus
cactaggtgcgctcagcgtcctcgt

SEQ ID NO: 560810 - DNA, 25 bp, Mus musculus
cactagtacatgacagcacaggagg

SEQ ID NO: 560811 - DNA, 25 bp, Mus musculus
cactagtacatgtcagcacaggagg

SEQ ID NO: 560812 - DNA, 25 bp, Mus musculus
cactagtacctcacctcagcagata

SEQ ID NO: 560813 - DNA, 25 bp, Mus musculus
cactagtacctctcctcagcagata

SEQ ID NO: 560814 - DNA, 25 bp, Mus musculus
cactagtattcgcattgaggaagcc

SEQ ID NO: 560815 - DNA, 25 bp, Mus musculus
cactagtattcggattgaggaagcc

SEQ ID NO: 560816 - DNA, 25 bp, Mus musculus
cactagtcagggagttgcatgcagg

SEQ ID NO: 560817 - DNA, 25 bp, Mus musculus
cactagtcagggtgttgcatgcagg

SEQ ID NO: 560818 - DNA, 25 bp, Mus musculus
cactagtctttgcaaactggcccct

SEQ ID NO: 560819 - DNA, 25 bp, Mus musculus
cactagtctttggaaactggcccct

SEQ ID NO: 560820 - DNA, 25 bp, Mus musculus
cactagtgatagcacagtatttcct

SEQ ID NO: 560821 - DNA, 25 bp, Mus musculus
cactagtgataggacagtatttcct

SEQ ID NO: 560822 - DNA, 25 bp, Mus musculus
cactagtgcgctaccttctgtccag

SEQ ID NO: 560823 - DNA, 25 bp, Mus musculus
cactagtgcgcttccttctgtccag

SEQ ID NO: 560824 - DNA, 25 bp, Mus musculus
cactagtggagcaactgagtccaac

SEQ ID NO: 560825 - DNA, 25 bp, Mus musculus
cactagtggagctactgagtccaac

SEQ ID NO: 560826 - DNA, 25 bp, Mus musculus
cactagtgtcaaccgcctcgtgcag

SEQ ID NO: 560827 - DNA, 25 bp, Mus musculus
cactagtgtcaagcgcctcgtgcag

SEQ ID NO: 560828 - DNA, 25 bp, Mus musculus
cactagttaagaattgagatggata

SEQ ID NO: 560829 - DNA, 25 bp, Mus musculus
cactagttaagatttgagatggata

SEQ ID NO: 560830 - DNA, 25 bp, Mus musculus
cactagttccacaagtcgcattacc

SEQ ID NO: 560831 - DNA, 25 bp, Mus musculus
cactagttccactagtcgcattacc

SEQ ID NO: 560832 - DNA, 25 bp, Mus musculus
cactagttctggcaagaagatgaag

SEQ ID NO: 560833 - DNA, 25 bp, Mus musculus
cactagttctgggaagaagatgaag

SEQ ID NO: 560834 - DNA, 25 bp, Mus musculus
cactagtttgagacagcacttttcc

SEQ ID NO: 560835 - DNA, 25 bp, Mus musculus
cactagtttgagtcagcacttttcc

SEQ ID NO: 560836 - DNA, 25 bp, Mus musculus
cactataagagactggagagtccag

SEQ ID NO: 560837 - DNA, 25 bp, Mus musculus
cactataagagagtggagagtccag

SEQ ID NO: 560838 - DNA, 25 bp, Mus musculus
cactatagctctctcaccttcaagg

SEQ ID NO: 560839 - DNA, 25 bp, Mus musculus
cactatagctctgtcaccttcaagg

SEQ ID NO: 560840 - DNA, 25 bp, Mus musculus
cactatagtcccaacaagagggagg

SEQ ID NO: 560841 - DNA, 25 bp, Mus musculus
cactatagtccctacaagagggagg

SEQ ID NO: 560842 - DNA, 25 bp, Mus musculus
cactatcaagttatcaggagagacg

SEQ ID NO: 560843 - DNA, 25 bp, Mus musculus
cactatcaagttttcaggagagacg

SEQ ID NO: 560844 - DNA, 25 bp, Mus musculus
cactatcagagactagagacgccag

SEQ ID NO: 560845 - DNA, 25 bp, Mus musculus
cactatcagagagtagagacgccag

SEQ ID NO: 560846 - DNA, 25 bp, Mus musculus
cactatcctggtctccccatttgat

SEQ ID NO: 560847 - DNA, 25 bp, Mus musculus
cactatcctggtgtccccatttgat

SEQ ID NO: 560848 - DNA, 25 bp, Mus musculus
cactatcgtgataactttggaggag

SEQ ID NO: 560849 - DNA, 25 bp, Mus musculus
cactatcgtgattactttggaggag

SEQ ID NO: 560850 - DNA, 25 bp, Mus musculus
cactatctgaggagtaaggattcca

SEQ ID NO: 560851 - DNA, 25 bp, Mus musculus
cactatctgaggtgtaaggattcca

SEQ ID NO: 560852 - DNA, 25 bp, Mus musculus
cactatctgtgactgacagccactg

SEQ ID NO: 560853 - DNA, 25 bp, Mus musculus
cactatctgtgagtgacagccactg

SEQ ID NO: 560854 - DNA, 25 bp, Mus musculus
cactatgaggtgcttgaaggacaac

SEQ ID NO: 560855 - DNA, 25 bp, Mus musculus
cactatgaggtggttgaaggacaac

SEQ ID NO: 560856 - DNA, 25 bp, Mus musculus
cactatgcaagtctcattatattga

SEQ ID NO: 560857 - DNA, 25 bp, Mus musculus
cactatgcaagtgtcattatattga

SEQ ID NO: 560858 - DNA, 25 bp, Mus musculus
cactatgccagacgatgattattgg

SEQ ID NO: 560859 - DNA, 25 bp, Mus musculus
cactatgccagaggatgattattgg

SEQ ID NO: 560860 - DNA, 25 bp, Mus musculus
cactatgctttgaggtgctctcatc

SEQ ID NO: 560861 - DNA, 25 bp, Mus musculus
cactatgctttgtggtgctctcatc

SEQ ID NO: 560862 - DNA, 25 bp, Mus musculus
cactatggacgtatggtgcaatggt

SEQ ID NO: 560863 - DNA, 25 bp, Mus musculus
cactatggacgtttggtgcaatggt

SEQ ID NO: 560864 - DNA, 25 bp, Mus musculus
cactatggatggagtgagcacagcc

SEQ ID NO: 560865 - DNA, 25 bp, Mus musculus
cactatggatggtgtgagcacagcc

SEQ ID NO: 560866 - DNA, 25 bp, Mus musculus
cactatggttccagtaaggatggtg

SEQ ID NO: 560867 - DNA, 25 bp, Mus musculus
cactatggttcctgtaaggatggtg

SEQ ID NO: 560868 - DNA, 25 bp, Mus musculus
cactatgtctggaaccgcactgaac

SEQ ID NO: 560869 - DNA, 25 bp, Mus musculus
cactatgtctggtaccgcactgaac

SEQ ID NO: 560870 - DNA, 25 bp, Mus musculus
cactatgtgcaaaaggaccagattc

SEQ ID NO: 560871 - DNA, 25 bp, Mus musculus
cactatgtgcaataggaccagattc

SEQ ID NO: 560872 - DNA, 25 bp, Mus musculus
cactatgttaatagcctggatctgg

SEQ ID NO: 560873 - DNA, 25 bp, Mus musculus
cactatgttaattgcctggatctgg

SEQ ID NO: 560874 - DNA, 25 bp, Mus musculus
cactatgttgggattgcccgggatc

SEQ ID NO: 560875 - DNA, 25 bp, Mus musculus
cactatgttgggtttgcccgggatc

SEQ ID NO: 560876 - DNA, 25 bp, Mus musculus
cactattaaactactcaatgagaca

SEQ ID NO: 560877 - DNA, 25 bp, Mus musculus
cactattaaacttctcaatgagaca

SEQ ID NO: 560878 - DNA, 25 bp, Mus musculus
cactattaaatgcatggtagatgcc

SEQ ID NO: 560879 - DNA, 25 bp, Mus musculus
cactattaaatggatggtagatgcc

SEQ ID NO: 560880 - DNA, 25 bp, Mus musculus
cactattacgtaatcctggaaacca

SEQ ID NO: 560881 - DNA, 25 bp, Mus musculus
cactattacgtattcctggaaacca

SEQ ID NO: 560882 - DNA, 25 bp, Mus musculus
cactattattgacgatgttgggaca

SEQ ID NO: 560883 - DNA, 25 bp, Mus musculus
cactattattgaggatgttgggaca

SEQ ID NO: 560884 - DNA, 25 bp, Mus musculus
cactattgacaacgaggcctatcca

SEQ ID NO: 560885 - DNA, 25 bp, Mus musculus
cactattgacaaggaggcctatcca

SEQ ID NO: 560886 - DNA, 25 bp, Mus musculus
cactattgctcgagtgttttgcgga

SEQ ID NO: 560887 - DNA, 25 bp, Mus musculus
cactattgctcgtgtgttttgcgga

SEQ ID NO: 560888 - DNA, 25 bp, Mus musculus
cactattggtctatgacatttggga

SEQ ID NO: 560889 - DNA, 25 bp, Mus musculus
cactattggtctttgacatttggga

SEQ ID NO: 560890 - DNA, 25 bp, Mus musculus
cactatttcctaaggcagtggcctt

SEQ ID NO: 560891 - DNA, 25 bp, Mus musculus
cactatttcctatggcagtggcctt

SEQ ID NO: 560892 - DNA, 25 bp, Mus musculus
cactatttgtagagtcctgcaggtc

SEQ ID NO: 560893 - DNA, 25 bp, Mus musculus
cactatttgtagtgtcctgcaggtc

SEQ ID NO: 560894 - DNA, 25 bp, Mus musculus
cactattttacacgagcagcggatg

SEQ ID NO: 560895 - DNA, 25 bp, Mus musculus
cactattttacaggagcagcggatg

SEQ ID NO: 560896 - DNA, 25 bp, Mus musculus
cactcaaaagtcaggcagggctggt

SEQ ID NO: 560897 - DNA, 25 bp, Mus musculus
cactcaaaagtctggcagggctggt

SEQ ID NO: 560898 - DNA, 25 bp, Mus musculus
cactcaaaagtgacctaatgtcaac

SEQ ID NO: 560899 - DNA, 25 bp, Mus musculus
cactcaaaagtgtcctaatgtcaac

SEQ ID NO: 560900 - DNA, 25 bp, Mus musculus
cactcaaagggtagaggtcctggac

SEQ ID NO: 560901 - DNA, 25 bp, Mus musculus
cactcaaagggttgaggtcctggac

SEQ ID NO: 560902 - DNA, 25 bp, Mus musculus
cactcaaagtggagaacggatttgc

SEQ ID NO: 560903 - DNA, 25 bp, Mus musculus
cactcaaagtggtgaacggatttgc

SEQ ID NO: 560904 - DNA, 25 bp, Mus musculus
cactcaaccttgaccgaagaccaag

SEQ ID NO: 560905 - DNA, 25 bp, Mus musculus
cactcaaccttgtccgaagaccaag

SEQ ID NO: 560906 - DNA, 25 bp, Mus musculus
cactcaacgagtatgcatatgcagc

SEQ ID NO: 560907 - DNA, 25 bp, Mus musculus
cactcaacgagtttgcatatgcagc

SEQ ID NO: 560908 - DNA, 25 bp, Mus musculus
cactcaactgcaattgggctttcag

SEQ ID NO: 560909 - DNA, 25 bp, Mus musculus
cactcaactgcatttgggctttcag

SEQ ID NO: 560910 - DNA, 25 bp, Mus musculus
cactcaagacagctaagggcaaggt

SEQ ID NO: 560911 - DNA, 25 bp, Mus musculus
cactcaagacaggtaagggcaaggt

SEQ ID NO: 560912 - DNA, 25 bp, Mus musculus
cactcaagcgtgctgctgtgctgaa

SEQ ID NO: 560913 - DNA, 25 bp, Mus musculus
cactcaagcgtggtgctgtgctgaa

SEQ ID NO: 560914 - DNA, 25 bp, Mus musculus
cactcaaggagtcagcagctatgct

SEQ ID NO: 560915 - DNA, 25 bp, Mus musculus
cactcaaggagtgagcagctatgct

SEQ ID NO: 560916 - DNA, 25 bp, Mus musculus
cactcaaggctgctttattggactg

SEQ ID NO: 560917 - DNA, 25 bp, Mus musculus
cactcaaggctggtttattggactg

SEQ ID NO: 560918 - DNA, 25 bp, Mus musculus
cactcaagggaacacgctggtgctg

SEQ ID NO: 560919 - DNA, 25 bp, Mus musculus
cactcaagggaagacgctggtgctg

SEQ ID NO: 560920 - DNA, 25 bp, Mus musculus
cactcaagttctagctccgtcctgg

SEQ ID NO: 560921 - DNA, 25 bp, Mus musculus
cactcaagttcttgctccgtcctgg

SEQ ID NO: 560922 - DNA, 25 bp, Mus musculus
cactcaagtttgaaataaaagcaac

SEQ ID NO: 560923 - DNA, 25 bp, Mus musculus
cactcaagtttgtaataaaagcaac

SEQ ID NO: 560924 - DNA, 25 bp, Mus musculus
cactcaatcaagatctactttcggc

SEQ ID NO: 560925 - DNA, 25 bp, Mus musculus
cactcaatcaagttctactttcggc

SEQ ID NO: 560926 - DNA, 25 bp, Mus musculus
cactcaatgaggcaaccatctcacg

SEQ ID NO: 560927 - DNA, 25 bp, Mus musculus
cactcaatgagggaaccatctcacg

SEQ ID NO: 560928 - DNA, 25 bp, Mus musculus
cactcaatttgtaatggctgaaaga

SEQ ID NO: 560929 - DNA, 25 bp, Mus musculus
cactcaatttgttatggctgaaaga

SEQ ID NO: 560930 - DNA, 25 bp, Mus musculus
cactcacagggaaagcagatccttc

SEQ ID NO: 560931 - DNA, 25 bp, Mus musculus
cactcacagggatagcagatccttc

SEQ ID NO: 560932 - DNA, 25 bp, Mus musculus
cactcacaggtaattctatgtcggc

SEQ ID NO: 560933 - DNA, 25 bp, Mus musculus
cactcacaggtatttctatgtcggc

SEQ ID NO: 560934 - DNA, 25 bp, Mus musculus
cactcacatttccaaccgcagagag

SEQ ID NO: 560935 - DNA, 25 bp, Mus musculus
cactcacatttcgaaccgcagagag

SEQ ID NO: 560936 - DNA, 25 bp, Mus musculus
cactcacccaggaccagcatgggtg

SEQ ID NO: 560937 - DNA, 25 bp, Mus musculus
cactcacccaggtccagcatgggtg

SEQ ID NO: 560938 - DNA, 25 bp, Mus musculus
cactcacccggacgagacagaagag

SEQ ID NO: 560939 - DNA, 25 bp, Mus musculus
cactcacccggaggagacagaagag

SEQ ID NO: 560940 - DNA, 25 bp, Mus musculus
cactcaccgggacgatccaggaggc

SEQ ID NO: 560941 - DNA, 25 bp, Mus musculus
cactcaccgggaggatccaggaggc

SEQ ID NO: 560942 - DNA, 25 bp, Mus musculus
cactcaccgtgtcgttctaccgaga

SEQ ID NO: 560943 - DNA, 25 bp, Mus musculus
cactcaccgtgtggttctaccgaga

SEQ ID NO: 560944 - DNA, 25 bp, Mus musculus
cactcacgattgaagctggaaacag

SEQ ID NO: 560945 - DNA, 25 bp, Mus musculus
cactcacgattgtagctggaaacag

SEQ ID NO: 560946 - DNA, 25 bp, Mus musculus
cactcacggtgcaggtgatggccac

SEQ ID NO: 560947 - DNA, 25 bp, Mus musculus
cactcacggtgctggtgatggccac

SEQ ID NO: 560948 - DNA, 25 bp, Mus musculus
cactcactcttaccacctgtggtgg

SEQ ID NO: 560949 - DNA, 25 bp, Mus musculus
cactcactcttagcacctgtggtgg

SEQ ID NO: 560950 - DNA, 25 bp, Mus musculus
cactcactggtgaccgaaaacatcc

SEQ ID NO: 560951 - DNA, 25 bp, Mus musculus
cactcactggtgtccgaaaacatcc

SEQ ID NO: 560952 - DNA, 25 bp, Mus musculus
cactcactgtacatggaagcaagca

SEQ ID NO: 560953 - DNA, 25 bp, Mus musculus
cactcactgtacttggaagcaagca

SEQ ID NO: 560954 - DNA, 25 bp, Mus musculus
cactcacttcaacgacaaccagtgg

SEQ ID NO: 560955 - DNA, 25 bp, Mus musculus
cactcacttcaaggacaaccagtgg

SEQ ID NO: 560956 - DNA, 25 bp, Mus musculus
cactcactttttcctgcgtgtggac

SEQ ID NO: 560957 - DNA, 25 bp, Mus musculus
cactcactttttgctgcgtgtggac

SEQ ID NO: 560958 - DNA, 25 bp, Mus musculus
cactcagaactcaggatgaactggg

SEQ ID NO: 560959 - DNA, 25 bp, Mus musculus
cactcagaactctggatgaactggg

SEQ ID NO: 560960 - DNA, 25 bp, Mus musculus
cactcagaatctattgcgcacacaa

SEQ ID NO: 560961 - DNA, 25 bp, Mus musculus
cactcagaatcttttgcgcacacaa

SEQ ID NO: 560962 - DNA, 25 bp, Mus musculus
cactcagaccgcaccactgtggtag

SEQ ID NO: 560963 - DNA, 25 bp, Mus musculus
cactcagaccgctccactgtggtag

SEQ ID NO: 560964 - DNA, 25 bp, Mus musculus
cactcagagagcctatgagcatcac

SEQ ID NO: 560965 - DNA, 25 bp, Mus musculus
cactcagagagcgtatgagcatcac

SEQ ID NO: 560966 - DNA, 25 bp, Mus musculus
cactcagccgtgctttaccgttcag

SEQ ID NO: 560967 - DNA, 25 bp, Mus musculus
cactcagccgtggtttaccgttcag

SEQ ID NO: 560968 - DNA, 25 bp, Mus musculus
cactcagcgagaagaaagggatgcg

SEQ ID NO: 560969 - DNA, 25 bp, Mus musculus
cactcagcgagatgaaagggatgcg

SEQ ID NO: 560970 - DNA, 25 bp, Mus musculus
cactcagcggctatgaccaggtgct

SEQ ID NO: 560971 - DNA, 25 bp, Mus musculus
cactcagcggctttgaccaggtgct

SEQ ID NO: 560972 - DNA, 25 bp, Mus musculus
cactcagctgtaatatgaaatggca

SEQ ID NO: 560973 - DNA, 25 bp, Mus musculus
cactcagctgtattatgaaatggca

SEQ ID NO: 560974 - DNA, 25 bp, Mus musculus
cactcaggaccaaagccatgcggga

SEQ ID NO: 560975 - DNA, 25 bp, Mus musculus
cactcaggaccatagccatgcggga

SEQ ID NO: 560976 - DNA, 25 bp, Mus musculus
cactcaggagtcatctgcaggcata

SEQ ID NO: 560977 - DNA, 25 bp, Mus musculus
cactcaggagtcttctgcaggcata

SEQ ID NO: 560978 - DNA, 25 bp, Mus musculus
cactcaggagtgcaagcctttgtaa

SEQ ID NO: 560979 - DNA, 25 bp, Mus musculus
cactcaggagtggaagcctttgtaa

SEQ ID NO: 560980 - DNA, 25 bp, Mus musculus
cactcaggccggagctgacgtcata

SEQ ID NO: 560981 - DNA, 25 bp, Mus musculus
cactcaggccggtgctgacgtcata

SEQ ID NO: 560982 - DNA, 25 bp, Mus musculus
cactcaggccttcgaggctgtctga

SEQ ID NO: 560983 - DNA, 25 bp, Mus musculus
cactcaggccttggaggctgtctga

SEQ ID NO: 560984 - DNA, 25 bp, Mus musculus
cactcagggtagatgtattggaccc

SEQ ID NO: 560985 - DNA, 25 bp, Mus musculus
cactcagggtagttgtattggaccc

SEQ ID NO: 560986 - DNA, 25 bp, Mus musculus
cactcaggtgtgactgtagcagaga

SEQ ID NO: 560987 - DNA, 25 bp, Mus musculus
cactcaggtgtgtctgtagcagaga

SEQ ID NO: 560988 - DNA, 25 bp, Mus musculus
cactcagtgaaacaaatgggtgcct

SEQ ID NO: 560989 - DNA, 25 bp, Mus musculus
cactcagtgaaagaaatgggtgcct

SEQ ID NO: 560990 - DNA, 25 bp, Mus musculus
cactcagtgacgctgccgcttgttg

SEQ ID NO: 560991 - DNA, 25 bp, Mus musculus
cactcagtgacggtgccgcttgttg

SEQ ID NO: 560992 - DNA, 25 bp, Mus musculus
cactcagtgctaaggtttcaatggt

SEQ ID NO: 560993 - DNA, 25 bp, Mus musculus
cactcagtgctatggtttcaatggt

SEQ ID NO: 560994 - DNA, 25 bp, Mus musculus
cactcagtgctcaggcagatctacg

SEQ ID NO: 560995 - DNA, 25 bp, Mus musculus
cactcagtgctctggcagatctacg

SEQ ID NO: 560996 - DNA, 25 bp, Mus musculus
cactcagtgcttcgaggtccgtgta

SEQ ID NO: 560997 - DNA, 25 bp, Mus musculus
cactcagtgcttggaggtccgtgta

SEQ ID NO: 560998 - DNA, 25 bp, Mus musculus
cactcagttacacgtggcagcatga

SEQ ID NO: 560999 - DNA, 25 bp, Mus musculus
cactcagttacaggtggcagcatga

SEQ ID NO: 561000 - DNA, 25 bp, Mus musculus
cactcagttagaaagaggaagcatg

SEQ ID NO: 561001 - DNA, 25 bp, Mus musculus
cactcagttagatagaggaagcatg

SEQ ID NO: 561002 - DNA, 25 bp, Mus musculus
cactcagttattatcaactaatgca

SEQ ID NO: 561003 - DNA, 25 bp, Mus musculus
cactcagttattttcaactaatgca

SEQ ID NO: 561004 - DNA, 25 bp, Mus musculus
cactcataacacctctgaaatggaa

SEQ ID NO: 561005 - DNA, 25 bp, Mus musculus
cactcataacacgtctgaaatggaa

SEQ ID NO: 561006 - DNA, 25 bp, Mus musculus
cactcatactctatctagtcactgg

SEQ ID NO: 561007 - DNA, 25 bp, Mus musculus
cactcatactctttctagtcactgg

SEQ ID NO: 561008 - DNA, 25 bp, Mus musculus
cactcatatggcatggaaggtggga

SEQ ID NO: 561009 - DNA, 25 bp, Mus musculus
cactcatatggcttggaaggtggga

SEQ ID NO: 561010 - DNA, 25 bp, Mus musculus
cactcatcctcaatctagtgtgtgc

SEQ ID NO: 561011 - DNA, 25 bp, Mus musculus
cactcatcctcattctagtgtgtgc

SEQ ID NO: 561012 - DNA, 25 bp, Mus musculus
cactcatctaggaatccagagagag

SEQ ID NO: 561013 - DNA, 25 bp, Mus musculus
cactcatctaggtatccagagagag

SEQ ID NO: 561014 - DNA, 25 bp, Mus musculus
cactcatctttgagggcggcgtgcc

SEQ ID NO: 561015 - DNA, 25 bp, Mus musculus
cactcatctttgtgggcggcgtgcc

SEQ ID NO: 561016 - DNA, 25 bp, Mus musculus
cactcatgacttatgcccagtatgg

SEQ ID NO: 561017 - DNA, 25 bp, Mus musculus
cactcatgacttttgcccagtatgg

SEQ ID NO: 561018 - DNA, 25 bp, Mus musculus
cactcatgcatcaacagtgaggaca

SEQ ID NO: 561019 - DNA, 25 bp, Mus musculus
cactcatgcatctacagtgaggaca

SEQ ID NO: 561020 - DNA, 25 bp, Mus musculus
cactcatgccgtcgaatgagtccag

SEQ ID NO: 561021 - DNA, 25 bp, Mus musculus
cactcatgccgtggaatgagtccag

SEQ ID NO: 561022 - DNA, 25 bp, Mus musculus
cactcatgcctaagcggttttggat

SEQ ID NO: 561023 - DNA, 25 bp, Mus musculus
cactcatgcctatgcggttttggat

SEQ ID NO: 561024 - DNA, 25 bp, Mus musculus
cactcatgcctgattttctcagcct

SEQ ID NO: 561025 - DNA, 25 bp, Mus musculus
cactcatgcctgtttttctcagcct

SEQ ID NO: 561026 - DNA, 25 bp, Mus musculus
cactcatggcggaggtggtctttgt

SEQ ID NO: 561027 - DNA, 25 bp, Mus musculus
cactcatggcggtggtggtctttgt

SEQ ID NO: 561028 - DNA, 25 bp, Mus musculus
cactcatgtatacgctgggcatggc

SEQ ID NO: 561029 - DNA, 25 bp, Mus musculus
cactcatgtataggctgggcatggc

SEQ ID NO: 561030 - DNA, 25 bp, Mus musculus
cactcattgactcccctgtgcagga

SEQ ID NO: 561031 - DNA, 25 bp, Mus musculus
cactcattgactgccctgtgcagga

SEQ ID NO: 561032 - DNA, 25 bp, Mus musculus
cactcatttgagctcccaggtgaac

SEQ ID NO: 561033 - DNA, 25 bp, Mus musculus
cactcatttgaggtcccaggtgaac

SEQ ID NO: 561034 - DNA, 25 bp, Mus musculus
cactcatttgctatctgcctctgga

SEQ ID NO: 561035 - DNA, 25 bp, Mus musculus
cactcatttgctttctgcctctgga

SEQ ID NO: 561036 - DNA, 25 bp, Mus musculus
cactccaacgtgaggctaccttcaa

SEQ ID NO: 561037 - DNA, 25 bp, Mus musculus
cactccaacgtgtggctaccttcaa

SEQ ID NO: 561038 - DNA, 25 bp, Mus musculus
cactccaagaaaagacggctccaaa

SEQ ID NO: 561039 - DNA, 25 bp, Mus musculus
cactccaagaaatgacggctccaaa

SEQ ID NO: 561040 - DNA, 25 bp, Mus musculus
cactccacagcacagggcgttttat

SEQ ID NO: 561041 - DNA, 25 bp, Mus musculus
cactccacagcagagggcgttttat

SEQ ID NO: 561042 - DNA, 25 bp, Mus musculus
cactccacaggcaagagatgtcgat

SEQ ID NO: 561043 - DNA, 25 bp, Mus musculus
cactccacaggctagagatgtcgat

SEQ ID NO: 561044 - DNA, 25 bp, Mus musculus
cactccacgaggctgcgctgtatgg

SEQ ID NO: 561045 - DNA, 25 bp, Mus musculus
cactccacgagggtgcgctgtatgg

SEQ ID NO: 561046 - DNA, 25 bp, Mus musculus
cactccactcaaagttccaaggaag

SEQ ID NO: 561047 - DNA, 25 bp, Mus musculus
cactccactcaatgttccaaggaag

SEQ ID NO: 561048 - DNA, 25 bp, Mus musculus
cactccagacctaagacatgcacta

SEQ ID NO: 561049 - DNA, 25 bp, Mus musculus
cactccagaccttagacatgcacta

SEQ ID NO: 561050 - DNA, 25 bp, Mus musculus
cactccagcatgattgcagatgcag

SEQ ID NO: 561051 - DNA, 25 bp, Mus musculus
cactccagcatgtttgcagatgcag

SEQ ID NO: 561052 - DNA, 25 bp, Mus musculus
cactccagccggaagaaatgcattc

SEQ ID NO: 561053 - DNA, 25 bp, Mus musculus
cactccagccggtagaaatgcattc

SEQ ID NO: 561054 - DNA, 25 bp, Mus musculus
cactccagctaacacttatgcaaag

SEQ ID NO: 561055 - DNA, 25 bp, Mus musculus
cactccagctaagacttatgcaaag

SEQ ID NO: 561056 - DNA, 25 bp, Mus musculus
cactccagggagcactgatgatata

SEQ ID NO: 561057 - DNA, 25 bp, Mus musculus
cactccagggaggactgatgatata

SEQ ID NO: 561058 - DNA, 25 bp, Mus musculus
cactccagtctgacggttccgggcg

SEQ ID NO: 561059 - DNA, 25 bp, Mus musculus
cactccagtctgtcggttccgggcg

SEQ ID NO: 561060 - DNA, 25 bp, Mus musculus
cactccatatgcaggtcagaacgta

SEQ ID NO: 561061 - DNA, 25 bp, Mus musculus
cactccatatgctggtcagaacgta

SEQ ID NO: 561062 - DNA, 25 bp, Mus musculus
cactccatctgtagggcctggccgg

SEQ ID NO: 561063 - DNA, 25 bp, Mus musculus
cactccatctgttgggcctggccgg

SEQ ID NO: 561064 - DNA, 25 bp, Mus musculus
cactccatggagctttagtggtaaa

SEQ ID NO: 561065 - DNA, 25 bp, Mus musculus
cactccatggaggtttagtggtaaa

SEQ ID NO: 561066 - DNA, 25 bp, Mus musculus
cactccatgtggatgcttgtctggg

SEQ ID NO: 561067 - DNA, 25 bp, Mus musculus
cactccatgtggttgcttgtctggg

SEQ ID NO: 561068 - DNA, 25 bp, Mus musculus
cactccattatgcagcttcgaagaa

SEQ ID NO: 561069 - DNA, 25 bp, Mus musculus
cactccattatggagcttcgaagaa

SEQ ID NO: 561070 - DNA, 25 bp, Mus musculus
cactccatttgcatcgatactaaac

SEQ ID NO: 561071 - DNA, 25 bp, Mus musculus
cactccatttgcttcgatactaaac

SEQ ID NO: 561072 - DNA, 25 bp, Mus musculus
cactcccaaggtattcggaggagca

SEQ ID NO: 561073 - DNA, 25 bp, Mus musculus
cactcccaaggttttcggaggagca

SEQ ID NO: 561074 - DNA, 25 bp, Mus musculus
cactcccatgttcatgctccaaaag

SEQ ID NO: 561075 - DNA, 25 bp, Mus musculus
cactcccatgttgatgctccaaaag

SEQ ID NO: 561076 - DNA, 25 bp, Mus musculus
cactcccatttcatcagcttgggca

SEQ ID NO: 561077 - DNA, 25 bp, Mus musculus
cactcccatttcttcagcttgggca

SEQ ID NO: 561078 - DNA, 25 bp, Mus musculus
cactccccatacataacggtttgca

SEQ ID NO: 561079 - DNA, 25 bp, Mus musculus
cactccccatacttaacggtttgca

SEQ ID NO: 561080 - DNA, 25 bp, Mus musculus
cactcccctgttcaaaataaattgg

SEQ ID NO: 561081 - DNA, 25 bp, Mus musculus
cactcccctgttgaaaataaattgg

SEQ ID NO: 561082 - DNA, 25 bp, Mus musculus
cactccccttacaaagagggtcgcg

SEQ ID NO: 561083 - DNA, 25 bp, Mus musculus
cactccccttactaagagggtcgcg

SEQ ID NO: 561084 - DNA, 25 bp, Mus musculus
cactcccgaaatctgctaccagaga

SEQ ID NO: 561085 - DNA, 25 bp, Mus musculus
cactcccgaaatgtgctaccagaga

SEQ ID NO: 561086 - DNA, 25 bp, Mus musculus
cactcccgaattctggacatcagca

SEQ ID NO: 561087 - DNA, 25 bp, Mus musculus
cactcccgaattgtggacatcagca

SEQ ID NO: 561088 - DNA, 25 bp, Mus musculus
cactccctaggcaggagtagtggga

SEQ ID NO: 561089 - DNA, 25 bp, Mus musculus
cactccctaggctggagtagtggga

SEQ ID NO: 561090 - DNA, 25 bp, Mus musculus
cactccctaggtctagtttagcaaa

SEQ ID NO: 561091 - DNA, 25 bp, Mus musculus
cactccctaggtgtagtttagcaaa

SEQ ID NO: 561092 - DNA, 25 bp, Mus musculus
cactccgacaagcagcaccatagag

SEQ ID NO: 561093 - DNA, 25 bp, Mus musculus
cactccgacaaggagcaccatagag

SEQ ID NO: 561094 - DNA, 25 bp, Mus musculus
cactccgagtatcattgaccagtca

SEQ ID NO: 561095 - DNA, 25 bp, Mus musculus
cactccgagtatgattgaccagtca

SEQ ID NO: 561096 - DNA, 25 bp, Mus musculus
cactccggatgcaggtcaaggagca

SEQ ID NO: 561097 - DNA, 25 bp, Mus musculus
cactccggatgctggtcaaggagca

SEQ ID NO: 561098 - DNA, 25 bp, Mus musculus
cactccgtgcatcatgacagtcatt

SEQ ID NO: 561099 - DNA, 25 bp, Mus musculus
cactccgtgcatgatgacagtcatt

SEQ ID NO: 561100 - DNA, 25 bp, Mus musculus
cactccgtgtgtcgacgtaaaactt

SEQ ID NO: 561101 - DNA, 25 bp, Mus musculus
cactccgtgtgtggacgtaaaactt

SEQ ID NO: 561102 - DNA, 25 bp, Mus musculus
cactccgttgtgatactttaatcct

SEQ ID NO: 561103 - DNA, 25 bp, Mus musculus
cactccgttgtgttactttaatcct

SEQ ID NO: 561104 - DNA, 25 bp, Mus musculus
cactccgtttggaaagcagttgtga

SEQ ID NO: 561105 - DNA, 25 bp, Mus musculus
cactccgtttggtaagcagttgtga

SEQ ID NO: 561106 - DNA, 25 bp, Mus musculus
cactcctaagcgctttctggtgcga

SEQ ID NO: 561107 - DNA, 25 bp, Mus musculus
cactcctaagcggtttctggtgcga

SEQ ID NO: 561108 - DNA, 25 bp, Mus musculus
cactcctaccatcgcttggatagaa

SEQ ID NO: 561109 - DNA, 25 bp, Mus musculus
cactcctaccatggcttggatagaa

SEQ ID NO: 561110 - DNA, 25 bp, Mus musculus
cactcctagatgcagtcctggccaa

SEQ ID NO: 561111 - DNA, 25 bp, Mus musculus
cactcctagatggagtcctggccaa

SEQ ID NO: 561112 - DNA, 25 bp, Mus musculus
cactcctcaagtcccgtgcgaatgg

SEQ ID NO: 561113 - DNA, 25 bp, Mus musculus
cactcctcaagtgccgtgcgaatgg

SEQ ID NO: 561114 - DNA, 25 bp, Mus musculus
cactcctcaatgacaaatcgactgg

SEQ ID NO: 561115 - DNA, 25 bp, Mus musculus
cactcctcaatgtcaaatcgactgg

SEQ ID NO: 561116 - DNA, 25 bp, Mus musculus
cactcctcggctacattcaaggcgg

SEQ ID NO: 561117 - DNA, 25 bp, Mus musculus
cactcctcggcttcattcaaggcgg

SEQ ID NO: 561118 - DNA, 25 bp, Mus musculus
cactcctgaccgcacaggttttgga

SEQ ID NO: 561119 - DNA, 25 bp, Mus musculus
cactcctgaccggacaggttttgga

SEQ ID NO: 561120 - DNA, 25 bp, Mus musculus
cactcctgactcacatgatggatcg

SEQ ID NO: 561121 - DNA, 25 bp, Mus musculus
cactcctgactctcatgatggatcg

SEQ ID NO: 561122 - DNA, 25 bp, Mus musculus
cactcctgcaaacagtatggcatca

SEQ ID NO: 561123 - DNA, 25 bp, Mus musculus
cactcctgcaaagagtatggcatca

SEQ ID NO: 561124 - DNA, 25 bp, Mus musculus
cactcctggaaaccacagggaggca

SEQ ID NO: 561125 - DNA, 25 bp, Mus musculus
cactcctggaaagcacagggaggca

SEQ ID NO: 561126 - DNA, 25 bp, Mus musculus
cactcctggagtaaaatattgcctg

SEQ ID NO: 561127 - DNA, 25 bp, Mus musculus
cactcctggagttaaatattgcctg

SEQ ID NO: 561128 - DNA, 25 bp, Mus musculus
cactcctggctgaggaacggaaaga

SEQ ID NO: 561129 - DNA, 25 bp, Mus musculus
cactcctggctgtggaacggaaaga

SEQ ID NO: 561130 - DNA, 25 bp, Mus musculus
cactccttcctgaatgggaccaatg

SEQ ID NO: 561131 - DNA, 25 bp, Mus musculus
cactccttcctgtatgggaccaatg

SEQ ID NO: 561132 - DNA, 25 bp, Mus musculus
cactccttgaggctgcgatgggaac

SEQ ID NO: 561133 - DNA, 25 bp, Mus musculus
cactccttgagggtgcgatgggaac

SEQ ID NO: 561134 - DNA, 25 bp, Mus musculus
cactccttgcatctggaagtcagta

SEQ ID NO: 561135 - DNA, 25 bp, Mus musculus
cactccttgcatgtggaagtcagta

SEQ ID NO: 561136 - DNA, 25 bp, Mus musculus
cactccttgggtccacgtggtagcc

SEQ ID NO: 561137 - DNA, 25 bp, Mus musculus
cactccttgggtgcacgtggtagcc

SEQ ID NO: 561138 - DNA, 25 bp, Mus musculus
cactcgaaaggcctactggcaggtg

SEQ ID NO: 561139 - DNA, 25 bp, Mus musculus
cactcgaaaggcgtactggcaggtg

SEQ ID NO: 561140 - DNA, 25 bp, Mus musculus
cactcgaagtcacatggaagagcta

SEQ ID NO: 561141 - DNA, 25 bp, Mus musculus
cactcgaagtcagatggaagagcta

SEQ ID NO: 561142 - DNA, 25 bp, Mus musculus
cactcgaatcacacagacatcatat

SEQ ID NO: 561143 - DNA, 25 bp, Mus musculus
cactcgaatcactcagacatcatat

SEQ ID NO: 561144 - DNA, 25 bp, Mus musculus
cactcgaattcacatgggcatgctt

SEQ ID NO: 561145 - DNA, 25 bp, Mus musculus
cactcgaattcagatgggcatgctt

SEQ ID NO: 561146 - DNA, 25 bp, Mus musculus
cactcgacagaacgagccgaaagct

SEQ ID NO: 561147 - DNA, 25 bp, Mus musculus
cactcgacagaaggagccgaaagct

SEQ ID NO: 561148 - DNA, 25 bp, Mus musculus
cactcgactgcacgcagagaaagcc

SEQ ID NO: 561149 - DNA, 25 bp, Mus musculus
cactcgactgcaggcagagaaagcc

SEQ ID NO: 561150 - DNA, 25 bp, Mus musculus
cactcgagaagaaatccaggaagta

SEQ ID NO: 561151 - DNA, 25 bp, Mus musculus
cactcgagaagatatccaggaagta

SEQ ID NO: 561152 - DNA, 25 bp, Mus musculus
cactcgagtcctagagtggattggt

SEQ ID NO: 561153 - DNA, 25 bp, Mus musculus
cactcgagtccttgagtggattggt

SEQ ID NO: 561154 - DNA, 25 bp, Mus musculus
cactcgagtgggctgtttgcaaaga

SEQ ID NO: 561155 - DNA, 25 bp, Mus musculus
cactcgagtggggtgtttgcaaaga

SEQ ID NO: 561156 - DNA, 25 bp, Mus musculus
cactcgagtggtagctcccatttac

SEQ ID NO: 561157 - DNA, 25 bp, Mus musculus
cactcgagtggttgctcccatttac

SEQ ID NO: 561158 - DNA, 25 bp, Mus musculus
cactcgataagtatgcctgtcatga

SEQ ID NO: 561159 - DNA, 25 bp, Mus musculus
cactcgataagtttgcctgtcatga

SEQ ID NO: 561160 - DNA, 25 bp, Mus musculus
cactcgatcactccttctcagggat

SEQ ID NO: 561161 - DNA, 25 bp, Mus musculus
cactcgatcactgcttctcagggat

SEQ ID NO: 561162 - DNA, 25 bp, Mus musculus
cactcgatcagtactggaaaacacc

SEQ ID NO: 561163 - DNA, 25 bp, Mus musculus
cactcgatcagttctggaaaacacc

SEQ ID NO: 561164 - DNA, 25 bp, Mus musculus
cactcgcaagctctacgaaaagaaa

SEQ ID NO: 561165 - DNA, 25 bp, Mus musculus
cactcgcaagctgtacgaaaagaaa

SEQ ID NO: 561166 - DNA, 25 bp, Mus musculus
cactcgcaccaactctcagaggatt

SEQ ID NO: 561167 - DNA, 25 bp, Mus musculus
cactcgcaccaagtctcagaggatt

SEQ ID NO: 561168 - DNA, 25 bp, Mus musculus
cactcgcatattattagagaaagga

SEQ ID NO: 561169 - DNA, 25 bp, Mus musculus
cactcgcatatttttagagaaagga

SEQ ID NO: 561170 - DNA, 25 bp, Mus musculus
cactcgccgaggagatatcaacttg

SEQ ID NO: 561171 - DNA, 25 bp, Mus musculus
cactcgccgaggtgatatcaacttg

SEQ ID NO: 561172 - DNA, 25 bp, Mus musculus
cactcgccgcgacctttgttggatt

SEQ ID NO: 561173 - DNA, 25 bp, Mus musculus
cactcgccgcgagctttgttggatt

SEQ ID NO: 561174 - DNA, 25 bp, Mus musculus
cactcgcgactgaaatttgaagttg

SEQ ID NO: 561175 - DNA, 25 bp, Mus musculus
cactcgcgactgtaatttgaagttg

SEQ ID NO: 561176 - DNA, 25 bp, Mus musculus
cactcgcgcaacctgctactgatag

SEQ ID NO: 561177 - DNA, 25 bp, Mus musculus
cactcgcgcaacgtgctactgatag

SEQ ID NO: 561178 - DNA, 25 bp, Mus musculus
cactcgctgcctacgttgggcttgg

SEQ ID NO: 561179 - DNA, 25 bp, Mus musculus
cactcgctgccttcgttgggcttgg

SEQ ID NO: 561180 - DNA, 25 bp, Mus musculus
cactcgctggaaattcaacgttcaa

SEQ ID NO: 561181 - DNA, 25 bp, Mus musculus
cactcgctggaatttcaacgttcaa

SEQ ID NO: 561182 - DNA, 25 bp, Mus musculus
cactcgctgtttcacatggctttgt

SEQ ID NO: 561183 - DNA, 25 bp, Mus musculus
cactcgctgtttgacatggctttgt

SEQ ID NO: 561184 - DNA, 25 bp, Mus musculus
cactcgcttagtcttgctggaccct

SEQ ID NO: 561185 - DNA, 25 bp, Mus musculus
cactcgcttagtgttgctggaccct

SEQ ID NO: 561186 - DNA, 25 bp, Mus musculus
cactcggaccggctggtcttcttca

SEQ ID NO: 561187 - DNA, 25 bp, Mus musculus
cactcggaccgggtggtcttcttca

SEQ ID NO: 561188 - DNA, 25 bp, Mus musculus
cactcggacgtgaccagtacaagga

SEQ ID NO: 561189 - DNA, 25 bp, Mus musculus
cactcggacgtgtccagtacaagga

SEQ ID NO: 561190 - DNA, 25 bp, Mus musculus
cactcggagaacatcaataattgct

SEQ ID NO: 561191 - DNA, 25 bp, Mus musculus
cactcggagaacttcaataattgct

SEQ ID NO: 561192 - DNA, 25 bp, Mus musculus
cactcggatctcacggcagagtcac

SEQ ID NO: 561193 - DNA, 25 bp, Mus musculus
cactcggatctctcggcagagtcac

SEQ ID NO: 561194 - DNA, 25 bp, Mus musculus
cactcggcacctatgctggtacctg

SEQ ID NO: 561195 - DNA, 25 bp, Mus musculus
cactcggcacctttgctggtacctg

SEQ ID NO: 561196 - DNA, 25 bp, Mus musculus
cactcggcacgcaggctttaggcca

SEQ ID NO: 561197 - DNA, 25 bp, Mus musculus
cactcggcacgctggctttaggcca

SEQ ID NO: 561198 - DNA, 25 bp, Mus musculus
cactcggctcttcaaggtcgttggc

SEQ ID NO: 561199 - DNA, 25 bp, Mus musculus
cactcggctcttgaaggtcgttggc

SEQ ID NO: 561200 - DNA, 25 bp, Mus musculus
cactcgggaaagaatgtgaactcac

SEQ ID NO: 561201 - DNA, 25 bp, Mus musculus
cactcgggaaagtatgtgaactcac

SEQ ID NO: 561202 - DNA, 25 bp, Mus musculus
cactcgggcttcagcaggcagaggt

SEQ ID NO: 561203 - DNA, 25 bp, Mus musculus
cactcgggcttctgcaggcagaggt

SEQ ID NO: 561204 - DNA, 25 bp, Mus musculus
cactcggtgcttccctggagttggt

SEQ ID NO: 561205 - DNA, 25 bp, Mus musculus
cactcggtgcttgcctggagttggt

SEQ ID NO: 561206 - DNA, 25 bp, Mus musculus
cactcggtggcgacctcagcggctt

SEQ ID NO: 561207 - DNA, 25 bp, Mus musculus
cactcggtggcgtcctcagcggctt

SEQ ID NO: 561208 - DNA, 25 bp, Mus musculus
cactcgtggtttatggtctgctggg

SEQ ID NO: 561209 - DNA, 25 bp, Mus musculus
cactcgtggtttttggtctgctggg

SEQ ID NO: 561210 - DNA, 25 bp, Mus musculus
cactcgttagccctgtccaggcagg

SEQ ID NO: 561211 - DNA, 25 bp, Mus musculus
cactcgttagccgtgtccaggcagg

SEQ ID NO: 561212 - DNA, 25 bp, Mus musculus
cactctacatcccacagtgtggaga

SEQ ID NO: 561213 - DNA, 25 bp, Mus musculus
cactctacatccgacagtgtggaga

SEQ ID NO: 561214 - DNA, 25 bp, Mus musculus
cactctacatcgaagcacggatcat

SEQ ID NO: 561215 - DNA, 25 bp, Mus musculus
cactctacatcgtagcacggatcat

SEQ ID NO: 561216 - DNA, 25 bp, Mus musculus
cactctacctgcaccatatgggctt

SEQ ID NO: 561217 - DNA, 25 bp, Mus musculus
cactctacctgcctatgcaaaacgg

SEQ ID NO: 561218 - DNA, 25 bp, Mus musculus
cactctacctgcgtatgcaaaacgg

SEQ ID NO: 561219 - DNA, 25 bp, Mus musculus
cactctacctgctccatatgggctt

SEQ ID NO: 561220 - DNA, 25 bp, Mus musculus
cactctacgaacatttcagcagtcc

SEQ ID NO: 561221 - DNA, 25 bp, Mus musculus
cactctacgaacttttcagcagtcc

SEQ ID NO: 561222 - DNA, 25 bp, Mus musculus
cactctacttggctgacttggtact

SEQ ID NO: 561223 - DNA, 25 bp, Mus musculus
cactctacttgggtgacttggtact

SEQ ID NO: 561224 - DNA, 25 bp, Mus musculus
cactctagagggacagatgtatcct

SEQ ID NO: 561225 - DNA, 25 bp, Mus musculus
cactctagagggtcagatgtatcct

SEQ ID NO: 561226 - DNA, 25 bp, Mus musculus
cactctaggttgaaatgaccaaagc

SEQ ID NO: 561227 - DNA, 25 bp, Mus musculus
cactctaggttgtaatgaccaaagc

SEQ ID NO: 561228 - DNA, 25 bp, Mus musculus
cactctatcatgatgagtgctgcaa

SEQ ID NO: 561229 - DNA, 25 bp, Mus musculus
cactctatcatgttgagtgctgcaa

SEQ ID NO: 561230 - DNA, 25 bp, Mus musculus
cactctcaaagaagactggattgct

SEQ ID NO: 561231 - DNA, 25 bp, Mus musculus
cactctcaaagatgactggattgct

SEQ ID NO: 561232 - DNA, 25 bp, Mus musculus
cactctcaacatcggtgaggccttg

SEQ ID NO: 561233 - DNA, 25 bp, Mus musculus
cactctcaacatgggtgaggccttg

SEQ ID NO: 561234 - DNA, 25 bp, Mus musculus
cactctcagacgacgctgcatctgt

SEQ ID NO: 561235 - DNA, 25 bp, Mus musculus
cactctcagacgtcgctgcatctgt

SEQ ID NO: 561236 - DNA, 25 bp, Mus musculus
cactctcagagacggtgtacctgtc

SEQ ID NO: 561237 - DNA, 25 bp, Mus musculus
cactctcagagagggtgtacctgtc

SEQ ID NO: 561238 - DNA, 25 bp, Mus musculus
cactctcaggttatggtaattcact

SEQ ID NO: 561239 - DNA, 25 bp, Mus musculus
cactctcaggttttggtaattcact

SEQ ID NO: 561240 - DNA, 25 bp, Mus musculus
cactctccaagaaggttttctgacg

SEQ ID NO: 561241 - DNA, 25 bp, Mus musculus
cactctccaagatggttttctgacg

SEQ ID NO: 561242 - DNA, 25 bp, Mus musculus
cactctccaagcattatctcatgtt

SEQ ID NO: 561243 - DNA, 25 bp, Mus musculus
cactctccaagctttatctcatgtt

SEQ ID NO: 561244 - DNA, 25 bp, Mus musculus
cactctccattacgaagttttgtaa

SEQ ID NO: 561245 - DNA, 25 bp, Mus musculus
cactctccattaggaagttttgtaa

SEQ ID NO: 561246 - DNA, 25 bp, Mus musculus
cactctccctgtcgctatagatagc

SEQ ID NO: 561247 - DNA, 25 bp, Mus musculus
cactctccctgtggctatagatagc

SEQ ID NO: 561248 - DNA, 25 bp, Mus musculus
cactctccctttcaacatggcgttg

SEQ ID NO: 561249 - DNA, 25 bp, Mus musculus
cactctccctttgaacatggcgttg

SEQ ID NO: 561250 - DNA, 25 bp, Mus musculus
cactctccggtaaaagcacagattc

SEQ ID NO: 561251 - DNA, 25 bp, Mus musculus
cactctccggtataagcacagattc

SEQ ID NO: 561252 - DNA, 25 bp, Mus musculus
cactctcctggtaaatgatcccagt

SEQ ID NO: 561253 - DNA, 25 bp, Mus musculus
cactctcctggttaatgatcccagt

SEQ ID NO: 561254 - DNA, 25 bp, Mus musculus
cactctcggaacctagcctgctttg

SEQ ID NO: 561255 - DNA, 25 bp, Mus musculus
cactctcggaacgtagcctgctttg

SEQ ID NO: 561256 - DNA, 25 bp, Mus musculus
cactctcggaccatatcagatgaaa

SEQ ID NO: 561257 - DNA, 25 bp, Mus musculus
cactctcggaccttatcagatgaaa

SEQ ID NO: 561258 - DNA, 25 bp, Mus musculus
cactctcggatgatgccggttacac

SEQ ID NO: 561259 - DNA, 25 bp, Mus musculus
cactctcggatgttgccggttacac

SEQ ID NO: 561260 - DNA, 25 bp, Mus musculus
cactctcggcagatcaatgacatcc

SEQ ID NO: 561261 - DNA, 25 bp, Mus musculus
cactctcggcagttcaatgacatcc

SEQ ID NO: 561262 - DNA, 25 bp, Mus musculus
cactctctagcgcaaggcgcggagc

SEQ ID NO: 561263 - DNA, 25 bp, Mus musculus
cactctctagcggaaggcgcggagc

SEQ ID NO: 561264 - DNA, 25 bp, Mus musculus
cactctctcctgctctagttgtctt

SEQ ID NO: 561265 - DNA, 25 bp, Mus musculus
cactctctcctggtctagttgtctt

SEQ ID NO: 561266 - DNA, 25 bp, Mus musculus
cactctctcttaagggattgccagg

SEQ ID NO: 561267 - DNA, 25 bp, Mus musculus
cactctctcttatgggattgccagg

SEQ ID NO: 561268 - DNA, 25 bp, Mus musculus
cactctctgcagacacaaaattatc

SEQ ID NO: 561269 - DNA, 25 bp, Mus musculus
cactctctgcagtcacaaaattatc

SEQ ID NO: 561270 - DNA, 25 bp, Mus musculus
cactctctgtccaaatctctctgca

SEQ ID NO: 561271 - DNA, 25 bp, Mus musculus
cactctctgtcctaatctctctgca

SEQ ID NO: 561272 - DNA, 25 bp, Mus musculus
cactctctgttacgttctgagctca

SEQ ID NO: 561273 - DNA, 25 bp, Mus musculus
cactctctgttaggttctgagctca

SEQ ID NO: 561274 - DNA, 25 bp, Mus musculus
cactctgacgagcaggcaggacatc

SEQ ID NO: 561275 - DNA, 25 bp, Mus musculus
cactctgacgaggaggcaggacatc

SEQ ID NO: 561276 - DNA, 25 bp, Mus musculus
cactctgagagcagggtgggagcca

SEQ ID NO: 561277 - DNA, 25 bp, Mus musculus
cactctgagagctgggtgggagcca

SEQ ID NO: 561278 - DNA, 25 bp, Mus musculus
cactctgaggccagatgagaaggcc

SEQ ID NO: 561279 - DNA, 25 bp, Mus musculus
cactctgaggcctgatgagaaggcc

SEQ ID NO: 561280 - DNA, 25 bp, Mus musculus
cactctgagtgtactgtccttgcat

SEQ ID NO: 561281 - DNA, 25 bp, Mus musculus
cactctgagtgttctgtccttgcat

SEQ ID NO: 561282 - DNA, 25 bp, Mus musculus
cactctgatgagagctcagacgtga

SEQ ID NO: 561283 - DNA, 25 bp, Mus musculus
cactctgatgagtgctcagacgtga

SEQ ID NO: 561284 - DNA, 25 bp, Mus musculus
cactctgatgctcgcagcgaacttg

SEQ ID NO: 561285 - DNA, 25 bp, Mus musculus
cactctgatgctggcagcgaacttg

SEQ ID NO: 561286 - DNA, 25 bp, Mus musculus
cactctgattctcatgctgatcagt

SEQ ID NO: 561287 - DNA, 25 bp, Mus musculus
cactctgattctgatgctgatcagt

SEQ ID NO: 561288 - DNA, 25 bp, Mus musculus
cactctgcaagcaagcgctagagga

SEQ ID NO: 561289 - DNA, 25 bp, Mus musculus
cactctgcaagctagcgctagagga

SEQ ID NO: 561290 - DNA, 25 bp, Mus musculus
cactctgcaccacaatacaaggatg

SEQ ID NO: 561291 - DNA, 25 bp, Mus musculus
cactctgcaccagaatacaaggatg

SEQ ID NO: 561292 - DNA, 25 bp, Mus musculus
cactctgcaggtatgtgggccctca

SEQ ID NO: 561293 - DNA, 25 bp, Mus musculus
cactctgcaggtttgtgggccctca

SEQ ID NO: 561294 - DNA, 25 bp, Mus musculus
cactctgcatttaaagcgattccag

SEQ ID NO: 561295 - DNA, 25 bp, Mus musculus
cactctgcattttaagcgattccag

SEQ ID NO: 561296 - DNA, 25 bp, Mus musculus
cactctgcgctgcttgaaaaatggc

SEQ ID NO: 561297 - DNA, 25 bp, Mus musculus
cactctgcgctggttgaaaaatggc

SEQ ID NO: 561298 - DNA, 25 bp, Mus musculus
cactctgctcgacaacctgtggcga

SEQ ID NO: 561299 - DNA, 25 bp, Mus musculus
cactctgctcgagaacctgtggcga

SEQ ID NO: 561300 - DNA, 25 bp, Mus musculus
cactctgctgggagacgcatgctct

SEQ ID NO: 561301 - DNA, 25 bp, Mus musculus
cactctgctgggtgacgcatgctct

SEQ ID NO: 561302 - DNA, 25 bp, Mus musculus
cactctgctgtgctctatgggagca

SEQ ID NO: 561303 - DNA, 25 bp, Mus musculus
cactctgctgtggtctatgggagca

SEQ ID NO: 561304 - DNA, 25 bp, Mus musculus
cactctggaagtctgtatttacata

SEQ ID NO: 561305 - DNA, 25 bp, Mus musculus
cactctggaagtgtgtatttacata

SEQ ID NO: 561306 - DNA, 25 bp, Mus musculus
cactctggaccgagcaagttaagag

SEQ ID NO: 561307 - DNA, 25 bp, Mus musculus
cactctggaccgtgcaagttaagag

SEQ ID NO: 561308 - DNA, 25 bp, Mus musculus
cactctggacctctttttgggtgga

SEQ ID NO: 561309 - DNA, 25 bp, Mus musculus
cactctggacctgtttttgggtgga

SEQ ID NO: 561310 - DNA, 25 bp, Mus musculus
cactctggaggtaggcaccatggac

SEQ ID NO: 561311 - DNA, 25 bp, Mus musculus
cactctggaggttggcaccatggac

SEQ ID NO: 561312 - DNA, 25 bp, Mus musculus
cactctggagttatcacgggataga

SEQ ID NO: 561313 - DNA, 25 bp, Mus musculus
cactctggagttttcacgggataga

SEQ ID NO: 561314 - DNA, 25 bp, Mus musculus
cactctgggagaacatagtggcttt

SEQ ID NO: 561315 - DNA, 25 bp, Mus musculus
cactctgggagatcatagtggcttt

SEQ ID NO: 561316 - DNA, 25 bp, Mus musculus
cactctggtcatcaaggaagtgtcg

SEQ ID NO: 561317 - DNA, 25 bp, Mus musculus
cactctggtcatctacctgatgccg

SEQ ID NO: 561318 - DNA, 25 bp, Mus musculus
cactctggtcatgaaggaagtgtcg

SEQ ID NO: 561319 - DNA, 25 bp, Mus musculus
cactctggtcatgtacctgatgccg

SEQ ID NO: 561320 - DNA, 25 bp, Mus musculus
cactctggtgaccatggccaaaaaa

SEQ ID NO: 561321 - DNA, 25 bp, Mus musculus
cactctggtgacgatggccaaaaaa

SEQ ID NO: 561322 - DNA, 25 bp, Mus musculus
cactctggtggactttctgcttgat

SEQ ID NO: 561323 - DNA, 25 bp, Mus musculus
cactctggtggagtttctgcttgat

SEQ ID NO: 561324 - DNA, 25 bp, Mus musculus
cactctggtgtaacacgtggttggc

SEQ ID NO: 561325 - DNA, 25 bp, Mus musculus
cactctggtgtatcacgtggttggc

SEQ ID NO: 561326 - DNA, 25 bp, Mus musculus
cactctgtaaagaggaattgcaaag

SEQ ID NO: 561327 - DNA, 25 bp, Mus musculus
cactctgtaaagtggaattgcaaag

SEQ ID NO: 561328 - DNA, 25 bp, Mus musculus
cactctgtcgttctggtcttttcca

SEQ ID NO: 561329 - DNA, 25 bp, Mus musculus
cactctgtcgttgtggtcttttcca

SEQ ID NO: 561330 - DNA, 25 bp, Mus musculus
cactctgtgacaagaacgccattca

SEQ ID NO: 561331 - DNA, 25 bp, Mus musculus
cactctgtgacatgaacgccattca

SEQ ID NO: 561332 - DNA, 25 bp, Mus musculus
cactctgtggttaagaaggaagcca

SEQ ID NO: 561333 - DNA, 25 bp, Mus musculus
cactctgtggtttagaaggaagcca

SEQ ID NO: 561334 - DNA, 25 bp, Mus musculus
cactctgtgtgacgccggtgccgac

SEQ ID NO: 561335 - DNA, 25 bp, Mus musculus
cactctgtgtgaggccggtgccgac

SEQ ID NO: 561336 - DNA, 25 bp, Mus musculus
cactctgttaatcgatgcaacctga

SEQ ID NO: 561337 - DNA, 25 bp, Mus musculus
cactctgttaatggatgcaacctga

SEQ ID NO: 561338 - DNA, 25 bp, Mus musculus
cactctgttcctcgtgtctctagca

SEQ ID NO: 561339 - DNA, 25 bp, Mus musculus
cactctgttcctggtgtctctagca

SEQ ID NO: 561340 - DNA, 25 bp, Mus musculus
cactctgttggtaccagagtgggtc

SEQ ID NO: 561341 - DNA, 25 bp, Mus musculus
cactctgttggtctccttgtggcca

SEQ ID NO: 561342 - DNA, 25 bp, Mus musculus
cactctgttggtgtccttgtggcca

SEQ ID NO: 561343 - DNA, 25 bp, Mus musculus
cactctgttggttccagagtgggtc

SEQ ID NO: 561344 - DNA, 25 bp, Mus musculus
cactcttaagagcttcagggaacca

SEQ ID NO: 561345 - DNA, 25 bp, Mus musculus
cactcttaagaggttcagggaacca

SEQ ID NO: 561346 - DNA, 25 bp, Mus musculus
cactcttaatataacatatgcgtcc

SEQ ID NO: 561347 - DNA, 25 bp, Mus musculus
cactcttaatattacatatgcgtcc

SEQ ID NO: 561348 - DNA, 25 bp, Mus musculus
cactcttcacttatctaggctggaa

SEQ ID NO: 561349 - DNA, 25 bp, Mus musculus
cactcttcacttttctaggctggaa

SEQ ID NO: 561350 - DNA, 25 bp, Mus musculus
cactcttcgggtagcctggtacatc

SEQ ID NO: 561351 - DNA, 25 bp, Mus musculus
cactcttcgggttgcctggtacatc

SEQ ID NO: 561352 - DNA, 25 bp, Mus musculus
cactcttcttgtagtgggccatgca

SEQ ID NO: 561353 - DNA, 25 bp, Mus musculus
cactcttcttgttgtgggccatgca

SEQ ID NO: 561354 - DNA, 25 bp, Mus musculus
cactcttgaagcctgtccttggaga

SEQ ID NO: 561355 - DNA, 25 bp, Mus musculus
cactcttgaagcgtgtccttggaga

SEQ ID NO: 561356 - DNA, 25 bp, Mus musculus
cactcttgaggaccgccgaaaactt

SEQ ID NO: 561357 - DNA, 25 bp, Mus musculus
cactcttgaggagcgccgaaaactt

SEQ ID NO: 561358 - DNA, 25 bp, Mus musculus
cactcttgaggcctactatagttct

SEQ ID NO: 561359 - DNA, 25 bp, Mus musculus
cactcttgaggcgtactatagttct

SEQ ID NO: 561360 - DNA, 25 bp, Mus musculus
cactcttgagttaaccattgaaagc

SEQ ID NO: 561361 - DNA, 25 bp, Mus musculus
cactcttgagtttaccattgaaagc

SEQ ID NO: 561362 - DNA, 25 bp, Mus musculus
cactcttgcctgacctgctgatcag

SEQ ID NO: 561363 - DNA, 25 bp, Mus musculus
cactcttgcctgtcctgctgatcag

SEQ ID NO: 561364 - DNA, 25 bp, Mus musculus
cactcttgctttaggtctacatggt

SEQ ID NO: 561365 - DNA, 25 bp, Mus musculus
cactcttgcttttggtctacatggt

SEQ ID NO: 561366 - DNA, 25 bp, Mus musculus
cactcttggaagaagatctggattc

SEQ ID NO: 561367 - DNA, 25 bp, Mus musculus
cactcttggaagtagatctggattc

SEQ ID NO: 561368 - DNA, 25 bp, Mus musculus
cactcttggaataatcagctatttc

SEQ ID NO: 561369 - DNA, 25 bp, Mus musculus
cactcttggaattatcagctatttc

SEQ ID NO: 561370 - DNA, 25 bp, Mus musculus
cactcttggcaccagctgttgccag

SEQ ID NO: 561371 - DNA, 25 bp, Mus musculus
cactcttggcacgagctgttgccag

SEQ ID NO: 561372 - DNA, 25 bp, Mus musculus
cactcttggtctacgtttctgatca

SEQ ID NO: 561373 - DNA, 25 bp, Mus musculus
cactcttggtcttcgtttctgatca

SEQ ID NO: 561374 - DNA, 25 bp, Mus musculus
cactctttgacgacccctggatcag

SEQ ID NO: 561375 - DNA, 25 bp, Mus musculus
cactctttgacgtcccctggatcag

SEQ ID NO: 561376 - DNA, 25 bp, Mus musculus
cactgaaaaagaatcgagtggtgct

SEQ ID NO: 561377 - DNA, 25 bp, Mus musculus
cactgaaaaagattcgagtggtgct

SEQ ID NO: 561378 - DNA, 25 bp, Mus musculus
cactgaaaattcataagcatggcca

SEQ ID NO: 561379 - DNA, 25 bp, Mus musculus
cactgaaaattcttaagcatggcca

SEQ ID NO: 561380 - DNA, 25 bp, Mus musculus
cactgaaacgcacgctgacctggaa

SEQ ID NO: 561381 - DNA, 25 bp, Mus musculus
cactgaaacgcaggctgacctggaa

SEQ ID NO: 561382 - DNA, 25 bp, Mus musculus
cactgaaacgctacgaaggccctct

SEQ ID NO: 561383 - DNA, 25 bp, Mus musculus
cactgaaacgcttcgaaggccctct

SEQ ID NO: 561384 - DNA, 25 bp, Mus musculus
cactgaaactagaggccctcatcta

SEQ ID NO: 561385 - DNA, 25 bp, Mus musculus
cactgaaactagtggccctcatcta

SEQ ID NO: 561386 - DNA, 25 bp, Mus musculus
cactgaaactttaccagacatggat

SEQ ID NO: 561387 - DNA, 25 bp, Mus musculus
cactgaaacttttccagacatggat

SEQ ID NO: 561388 - DNA, 25 bp, Mus musculus
cactgaaagacgaagctgatgcgga

SEQ ID NO: 561389 - DNA, 25 bp, Mus musculus
cactgaaagacgtagctgatgcgga

SEQ ID NO: 561390 - DNA, 25 bp, Mus musculus
cactgaaagccacagttgtctatcc

SEQ ID NO: 561391 - DNA, 25 bp, Mus musculus
cactgaaagccagagttgtctatcc

SEQ ID NO: 561392 - DNA, 25 bp, Mus musculus
cactgaaaggagaaatcgattccag

SEQ ID NO: 561393 - DNA, 25 bp, Mus musculus
cactgaaaggagtaatcgattccag

SEQ ID NO: 561394 - DNA, 25 bp, Mus musculus
cactgaaagggaagcggctccaagt

SEQ ID NO: 561395 - DNA, 25 bp, Mus musculus
cactgaaagggatgcggctccaagt

SEQ ID NO: 561396 - DNA, 25 bp, Mus musculus
cactgaaatgatcacagggactgac

SEQ ID NO: 561397 - DNA, 25 bp, Mus musculus
cactgaaatgatgacagggactgac

SEQ ID NO: 561398 - DNA, 25 bp, Mus musculus
cactgaacagcaaccacacaggcta

SEQ ID NO: 561399 - DNA, 25 bp, Mus musculus
cactgaacagcatccacacaggcta

SEQ ID NO: 561400 - DNA, 25 bp, Mus musculus
cactgaacccctcagcatgagttga

SEQ ID NO: 561401 - DNA, 25 bp, Mus musculus
cactgaacccctgagcatgagttga

SEQ ID NO: 561402 - DNA, 25 bp, Mus musculus
cactgaaccgcaagctcaggactca

SEQ ID NO: 561403 - DNA, 25 bp, Mus musculus
cactgaaccgcatgctcaggactca

SEQ ID NO: 561404 - DNA, 25 bp, Mus musculus
cactgaacggctagaatgaattgca

SEQ ID NO: 561405 - DNA, 25 bp, Mus musculus
cactgaacggcttgaatgaattgca

SEQ ID NO: 561406 - DNA, 25 bp, Mus musculus
cactgaacgtggacggtgcctgtgc

SEQ ID NO: 561407 - DNA, 25 bp, Mus musculus
cactgaacgtggtcggtgcctgtgc

SEQ ID NO: 561408 - DNA, 25 bp, Mus musculus
cactgaactcctcctgaaggaaggt

SEQ ID NO: 561409 - DNA, 25 bp, Mus musculus
cactgaactcctgctgaaggaaggt

SEQ ID NO: 561410 - DNA, 25 bp, Mus musculus
cactgaactcggcatcttgggaatg

SEQ ID NO: 561411 - DNA, 25 bp, Mus musculus
cactgaactcgggatcttgggaatg

SEQ ID NO: 561412 - DNA, 25 bp, Mus musculus
cactgaactgggaggacttaagagt

SEQ ID NO: 561413 - DNA, 25 bp, Mus musculus
cactgaactgggtggacttaagagt

SEQ ID NO: 561414 - DNA, 25 bp, Mus musculus
cactgaagacccagggaagctccat

SEQ ID NO: 561415 - DNA, 25 bp, Mus musculus
cactgaagaccctgggaagctccat

SEQ ID NO: 561416 - DNA, 25 bp, Mus musculus
cactgaagatccacattccggagcc

SEQ ID NO: 561417 - DNA, 25 bp, Mus musculus
cactgaagatcctcattccggagcc

SEQ ID NO: 561418 - DNA, 25 bp, Mus musculus
cactgaagccagagacagtagcccg

SEQ ID NO: 561419 - DNA, 25 bp, Mus musculus
cactgaagccagtgacagtagcccg

SEQ ID NO: 561420 - DNA, 25 bp, Mus musculus
cactgaagccatctttctaccaaga

SEQ ID NO: 561421 - DNA, 25 bp, Mus musculus
cactgaagccatgtttctaccaaga

SEQ ID NO: 561422 - DNA, 25 bp, Mus musculus
cactgaaggacaaatgcaaggctca

SEQ ID NO: 561423 - DNA, 25 bp, Mus musculus
cactgaaggacatatgcaaggctca

SEQ ID NO: 561424 - DNA, 25 bp, Mus musculus
cactgaaggagcctgcagcgctcac

SEQ ID NO: 561425 - DNA, 25 bp, Mus musculus
cactgaaggagcctgtatccctgcc

SEQ ID NO: 561426 - DNA, 25 bp, Mus musculus
cactgaaggagcgtgcagcgctcac

SEQ ID NO: 561427 - DNA, 25 bp, Mus musculus
cactgaaggagcgtgtatccctgcc

SEQ ID NO: 561428 - DNA, 25 bp, Mus musculus
cactgaaggtgaaacatgaacaggt

SEQ ID NO: 561429 - DNA, 25 bp, Mus musculus
cactgaaggtgatacatgaacaggt

SEQ ID NO: 561430 - DNA, 25 bp, Mus musculus
cactgaagtcatccagggtatcaga

SEQ ID NO: 561431 - DNA, 25 bp, Mus musculus
cactgaagtcatgcagggtatcaga

SEQ ID NO: 561432 - DNA, 25 bp, Mus musculus
cactgaagtggcactcctgtttgga

SEQ ID NO: 561433 - DNA, 25 bp, Mus musculus
cactgaagtggctctcctgtttgga

SEQ ID NO: 561434 - DNA, 25 bp, Mus musculus
cactgaagttcgaggatctgaagcg

SEQ ID NO: 561435 - DNA, 25 bp, Mus musculus
cactgaagttcgtggatctgaagcg

SEQ ID NO: 561436 - DNA, 25 bp, Mus musculus
cactgaatacttagaacacaatgac

SEQ ID NO: 561437 - DNA, 25 bp, Mus musculus
cactgaatactttgaacacaatgac

SEQ ID NO: 561438 - DNA, 25 bp, Mus musculus
cactgaatagtaatcacacaggcta

SEQ ID NO: 561439 - DNA, 25 bp, Mus musculus
cactgaatagtattcacacaggcta

SEQ ID NO: 561440 - DNA, 25 bp, Mus musculus
cactgaatagttcccatgatcttgg

SEQ ID NO: 561441 - DNA, 25 bp, Mus musculus
cactgaatagttgccatgatcttgg

SEQ ID NO: 561442 - DNA, 25 bp, Mus musculus
cactgaatcccgatgcagttgaatt

SEQ ID NO: 561443 - DNA, 25 bp, Mus musculus
cactgaatcccgttgcagttgaatt

SEQ ID NO: 561444 - DNA, 25 bp, Mus musculus
cactgaatgagacaggagaccacaa

SEQ ID NO: 561445 - DNA, 25 bp, Mus musculus
cactgaatgagagaggagaccacaa

SEQ ID NO: 561446 - DNA, 25 bp, Mus musculus
cactgaatgcatccaaacaagacgg

SEQ ID NO: 561447 - DNA, 25 bp, Mus musculus
cactgaatgcatgcaaacaagacgg

SEQ ID NO: 561448 - DNA, 25 bp, Mus musculus
cactgaatgggacggttacctgccc

SEQ ID NO: 561449 - DNA, 25 bp, Mus musculus
cactgaatgggagggttacctgccc

SEQ ID NO: 561450 - DNA, 25 bp, Mus musculus
cactgacaacaaaggagagactgcc

SEQ ID NO: 561451 - DNA, 25 bp, Mus musculus
cactgacaacaatggagagactgcc

SEQ ID NO: 561452 - DNA, 25 bp, Mus musculus
cactgacaacgtcaagacaggcatc

SEQ ID NO: 561453 - DNA, 25 bp, Mus musculus
cactgacaacgtgaagacaggcatc

SEQ ID NO: 561454 - DNA, 25 bp, Mus musculus
cactgacacagacacaggctgtgga

SEQ ID NO: 561455 - DNA, 25 bp, Mus musculus
cactgacacagagacaggctgtgga

SEQ ID NO: 561456 - DNA, 25 bp, Mus musculus
cactgacagcagaaaaggtgcagcc

SEQ ID NO: 561457 - DNA, 25 bp, Mus musculus
cactgacagcagtaaaggtgcagcc

SEQ ID NO: 561458 - DNA, 25 bp, Mus musculus
cactgacaggtcaggctgttggcac

SEQ ID NO: 561459 - DNA, 25 bp, Mus musculus
cactgacaggtctggctgttggcac

SEQ ID NO: 561460 - DNA, 25 bp, Mus musculus
cactgacataccagttccggaggag

SEQ ID NO: 561461 - DNA, 25 bp, Mus musculus
cactgacatacctgttccggaggag

SEQ ID NO: 561462 - DNA, 25 bp, Mus musculus
cactgacatagtcgatggaaatcat

SEQ ID NO: 561463 - DNA, 25 bp, Mus musculus
cactgacatagtggatggaaatcat

SEQ ID NO: 561464 - DNA, 25 bp, Mus musculus
cactgacatcaacatgctttactgg

SEQ ID NO: 561465 - DNA, 25 bp, Mus musculus
cactgacatcaagatgctttactgg

SEQ ID NO: 561466 - DNA, 25 bp, Mus musculus
cactgacatggaataagcccagcct

SEQ ID NO: 561467 - DNA, 25 bp, Mus musculus
cactgacatggattaagcccagcct

SEQ ID NO: 561468 - DNA, 25 bp, Mus musculus
cactgaccaccgcagatatttcttt

SEQ ID NO: 561469 - DNA, 25 bp, Mus musculus
cactgaccaccggagatatttcttt

SEQ ID NO: 561470 - DNA, 25 bp, Mus musculus
cactgaccattgaggaaagtcctct

SEQ ID NO: 561471 - DNA, 25 bp, Mus musculus
cactgaccattgtggaaagtcctct

SEQ ID NO: 561472 - DNA, 25 bp, Mus musculus
cactgacccacaacaatgaggtctg

SEQ ID NO: 561473 - DNA, 25 bp, Mus musculus
cactgacccacatcaatgaggtctg

SEQ ID NO: 561474 - DNA, 25 bp, Mus musculus
cactgaccctcaatgtcaagagtga

SEQ ID NO: 561475 - DNA, 25 bp, Mus musculus
cactgaccctcattgtcaagagtga

SEQ ID NO: 561476 - DNA, 25 bp, Mus musculus
cactgaccctgcctatttcatggag

SEQ ID NO: 561477 - DNA, 25 bp, Mus musculus
cactgaccctgcgtatttcatggag

SEQ ID NO: 561478 - DNA, 25 bp, Mus musculus
cactgaccgttgaagacttttgtac

SEQ ID NO: 561479 - DNA, 25 bp, Mus musculus
cactgaccgttgtagacttttgtac

SEQ ID NO: 561480 - DNA, 25 bp, Mus musculus
cactgacctatgagccactctttgg

SEQ ID NO: 561481 - DNA, 25 bp, Mus musculus
cactgacctatgtgccactctttgg

SEQ ID NO: 561482 - DNA, 25 bp, Mus musculus
cactgacctctgcagtcggcaagac

SEQ ID NO: 561483 - DNA, 25 bp, Mus musculus
cactgacctctggagtcggcaagac

SEQ ID NO: 561484 - DNA, 25 bp, Mus musculus
cactgacgtcatcctcatgtgtttc

SEQ ID NO: 561485 - DNA, 25 bp, Mus musculus
cactgacgtcatgctcatgtgtttc

SEQ ID NO: 561486 - DNA, 25 bp, Mus musculus
cactgacgtccaccctgactatggg

SEQ ID NO: 561487 - DNA, 25 bp, Mus musculus
cactgacgtccagcctgactatggg

SEQ ID NO: 561488 - DNA, 25 bp, Mus musculus
cactgactacctcattgaggaagtg

SEQ ID NO: 561489 - DNA, 25 bp, Mus musculus
cactgactacctgattgaggaagtg

SEQ ID NO: 561490 - DNA, 25 bp, Mus musculus
cactgactacttatgggccatgccg

SEQ ID NO: 561491 - DNA, 25 bp, Mus musculus
cactgactacttttgggccatgccg

SEQ ID NO: 561492 - DNA, 25 bp, Mus musculus
cactgactgacgcacagaagaataa

SEQ ID NO: 561493 - DNA, 25 bp, Mus musculus
cactgactgacggacagaagaataa

SEQ ID NO: 561494 - DNA, 25 bp, Mus musculus
cactgactgccccagctttgcaaat

SEQ ID NO: 561495 - DNA, 25 bp, Mus musculus
cactgactgcccgagctttgcaaat

SEQ ID NO: 561496 - DNA, 25 bp, Mus musculus
cactgactggcgagaacgtcgaaga

SEQ ID NO: 561497 - DNA, 25 bp, Mus musculus
cactgactggcgtgaacgtcgaaga

SEQ ID NO: 561498 - DNA, 25 bp, Mus musculus
cactgactgggcacacccatttggc

SEQ ID NO: 561499 - DNA, 25 bp, Mus musculus
cactgactgggctcacccatttggc

SEQ ID NO: 561500 - DNA, 25 bp, Mus musculus
cactgactgggtcgataccagaaag

SEQ ID NO: 561501 - DNA, 25 bp, Mus musculus
cactgactgggtggataccagaaag

SEQ ID NO: 561502 - DNA, 25 bp, Mus musculus
cactgactgtggaccgtgggttagc

SEQ ID NO: 561503 - DNA, 25 bp, Mus musculus
cactgactgtggtccgtgggttagc

SEQ ID NO: 561504 - DNA, 25 bp, Mus musculus
cactgactgtgtataaagcgtccaa

SEQ ID NO: 561505 - DNA, 25 bp, Mus musculus
cactgactgtgtttaaagcgtccaa

SEQ ID NO: 561506 - DNA, 25 bp, Mus musculus
cactgacttggaaacagtagcactg

SEQ ID NO: 561507 - DNA, 25 bp, Mus musculus
cactgacttggatacagtagcactg

SEQ ID NO: 561508 - DNA, 25 bp, Mus musculus
cactgacttgggatattttattcac

SEQ ID NO: 561509 - DNA, 25 bp, Mus musculus
cactgacttgggttattttattcac

SEQ ID NO: 561510 - DNA, 25 bp, Mus musculus
cactgagaaggaatagtgcctgtaa

SEQ ID NO: 561511 - DNA, 25 bp, Mus musculus
cactgagaaggattagtgcctgtaa

SEQ ID NO: 561512 - DNA, 25 bp, Mus musculus
cactgagacgtgaagatgagtgaac

SEQ ID NO: 561513 - DNA, 25 bp, Mus musculus
cactgagacgtgtagatgagtgaac

SEQ ID NO: 561514 - DNA, 25 bp, Mus musculus
cactgagactgaagtctactgccag

SEQ ID NO: 561515 - DNA, 25 bp, Mus musculus
cactgagactgatgtctactgccag

SEQ ID NO: 561516 - DNA, 25 bp, Mus musculus
cactgagagaggcttcacagctacc

SEQ ID NO: 561517 - DNA, 25 bp, Mus musculus
cactgagagagggttcacagctacc

SEQ ID NO: 561518 - DNA, 25 bp, Mus musculus
cactgagagcacagggaaccaggag

SEQ ID NO: 561519 - DNA, 25 bp, Mus musculus
cactgagagcactgggaaccaggag

SEQ ID NO: 561520 - DNA, 25 bp, Mus musculus
cactgagagtgaccttgtagactgc

SEQ ID NO: 561521 - DNA, 25 bp, Mus musculus
cactgagagtgagcttgtagactgc

SEQ ID NO: 561522 - DNA, 25 bp, Mus musculus
cactgagatcttcacgctggttgga

SEQ ID NO: 561523 - DNA, 25 bp, Mus musculus
cactgagatcttgacgctggttgga

SEQ ID NO: 561524 - DNA, 25 bp, Mus musculus
cactgagatgcgctagttggctgct

SEQ ID NO: 561525 - DNA, 25 bp, Mus musculus
cactgagatgcggtagttggctgct

SEQ ID NO: 561526 - DNA, 25 bp, Mus musculus
cactgagattccaggacccttttcc

SEQ ID NO: 561527 - DNA, 25 bp, Mus musculus
cactgagattcctggacccttttcc

SEQ ID NO: 561528 - DNA, 25 bp, Mus musculus
cactgagcagaaagcaacacttgtg

SEQ ID NO: 561529 - DNA, 25 bp, Mus musculus
cactgagcagaatgcaacacttgtg

SEQ ID NO: 561530 - DNA, 25 bp, Mus musculus
cactgagcatcaaggaacagcttca

SEQ ID NO: 561531 - DNA, 25 bp, Mus musculus
cactgagcatcatggaacagcttca

SEQ ID NO: 561532 - DNA, 25 bp, Mus musculus
cactgagccgtaagagccgtttgaa

SEQ ID NO: 561533 - DNA, 25 bp, Mus musculus
cactgagccgtatgagccgtttgaa

SEQ ID NO: 561534 - DNA, 25 bp, Mus musculus
cactgagcgacacggccctgaagag

SEQ ID NO: 561535 - DNA, 25 bp, Mus musculus
cactgagcgacagggccctgaagag

SEQ ID NO: 561536 - DNA, 25 bp, Mus musculus
cactgagcgtacactctaagtgtgt

SEQ ID NO: 561537 - DNA, 25 bp, Mus musculus
cactgagcgtactctctaagtgtgt

SEQ ID NO: 561538 - DNA, 25 bp, Mus musculus
cactgagcgtgccaaagggtaagac

SEQ ID NO: 561539 - DNA, 25 bp, Mus musculus
cactgagcgtgcgaaagggtaagac

SEQ ID NO: 561540 - DNA, 25 bp, Mus musculus
cactgagcttgcagggtttattaag

SEQ ID NO: 561541 - DNA, 25 bp, Mus musculus
cactgagcttgctgggtttattaag

SEQ ID NO: 561542 - DNA, 25 bp, Mus musculus
cactgaggagcaacaaggagagacc

SEQ ID NO: 561543 - DNA, 25 bp, Mus musculus
cactgaggagcatcaaggagagacc

SEQ ID NO: 561544 - DNA, 25 bp, Mus musculus
cactgaggagccacggatccggctg

SEQ ID NO: 561545 - DNA, 25 bp, Mus musculus
cactgaggagcctcggatccggctg

SEQ ID NO: 561546 - DNA, 25 bp, Mus musculus
cactgaggagtcatggttgggactt

SEQ ID NO: 561547 - DNA, 25 bp, Mus musculus
cactgaggagtcttggttgggactt

SEQ ID NO: 561548 - DNA, 25 bp, Mus musculus
cactgaggcagaatatgcaaacagc

SEQ ID NO: 561549 - DNA, 25 bp, Mus musculus
cactgaggcagattatgcaaacagc

SEQ ID NO: 561550 - DNA, 25 bp, Mus musculus
cactgaggcaggaatggccccgaga

SEQ ID NO: 561551 - DNA, 25 bp, Mus musculus
cactgaggcaggtatggccccgaga

SEQ ID NO: 561552 - DNA, 25 bp, Mus musculus
cactgaggccataaaaaacatggaa

SEQ ID NO: 561553 - DNA, 25 bp, Mus musculus
cactgaggccattaaaaacatggaa

SEQ ID NO: 561554 - DNA, 25 bp, Mus musculus
cactgaggccgtaggtgtggccatt

SEQ ID NO: 561555 - DNA, 25 bp, Mus musculus
cactgaggccgttggtgtggccatt

SEQ ID NO: 561556 - DNA, 25 bp, Mus musculus
cactgaggctctcagacactcctgt

SEQ ID NO: 561557 - DNA, 25 bp, Mus musculus
cactgaggctctgagacactcctgt

SEQ ID NO: 561558 - DNA, 25 bp, Mus musculus
cactgaggctgaagtagaggaggca

SEQ ID NO: 561559 - DNA, 25 bp, Mus musculus
cactgaggctgacgatgaagataat

SEQ ID NO: 561560 - DNA, 25 bp, Mus musculus
cactgaggctgactacaccgacgtg

SEQ ID NO: 561561 - DNA, 25 bp, Mus musculus
cactgaggctgaggatgaagataat

SEQ ID NO: 561562 - DNA, 25 bp, Mus musculus
cactgaggctgagtacaccgacgtg

SEQ ID NO: 561563 - DNA, 25 bp, Mus musculus
cactgaggctgatgtagaggaggca

SEQ ID NO: 561564 - DNA, 25 bp, Mus musculus
cactgagggagcattgccgtatagt

SEQ ID NO: 561565 - DNA, 25 bp, Mus musculus
cactgagggagctttgccgtatagt

SEQ ID NO: 561566 - DNA, 25 bp, Mus musculus
cactgagggtggaccaatcaggaga

SEQ ID NO: 561567 - DNA, 25 bp, Mus musculus
cactgagggtggtccaatcaggaga

SEQ ID NO: 561568 - DNA, 25 bp, Mus musculus
cactgagtaaacagctgaaactgtc

SEQ ID NO: 561569 - DNA, 25 bp, Mus musculus
cactgagtaaactgctgaaactgtc

SEQ ID NO: 561570 - DNA, 25 bp, Mus musculus
cactgagtaagaccaggcagattga

SEQ ID NO: 561571 - DNA, 25 bp, Mus musculus
cactgagtaagagcaggcagattga

SEQ ID NO: 561572 - DNA, 25 bp, Mus musculus
cactgagtcctccagagctttggca

SEQ ID NO: 561573 - DNA, 25 bp, Mus musculus
cactgagtcctcgagagctttggca

SEQ ID NO: 561574 - DNA, 25 bp, Mus musculus
cactgagtggccatgcgtcctgggt

SEQ ID NO: 561575 - DNA, 25 bp, Mus musculus
cactgagtggccttgcgtcctgggt

SEQ ID NO: 561576 - DNA, 25 bp, Mus musculus
cactgagttgcaagttgagcactgc

SEQ ID NO: 561577 - DNA, 25 bp, Mus musculus
cactgagttgcatgttgagcactgc

SEQ ID NO: 561578 - DNA, 25 bp, Mus musculus
cactgagtttggagggagctgaccc

SEQ ID NO: 561579 - DNA, 25 bp, Mus musculus
cactgagtttggtgggagctgaccc

SEQ ID NO: 561580 - DNA, 25 bp, Mus musculus
cactgataaagcagtttgtgtctga

SEQ ID NO: 561581 - DNA, 25 bp, Mus musculus
cactgataaagctgtttgtgtctga

SEQ ID NO: 561582 - DNA, 25 bp, Mus musculus
cactgatactgtactcaggaagccg

SEQ ID NO: 561583 - DNA, 25 bp, Mus musculus
cactgatactgttctcaggaagccg

SEQ ID NO: 561584 - DNA, 25 bp, Mus musculus
cactgatccatcatctggccatttc

SEQ ID NO: 561585 - DNA, 25 bp, Mus musculus
cactgatccatcttctggccatttc

SEQ ID NO: 561586 - DNA, 25 bp, Mus musculus
cactgatccctgcaggctcagagtc

SEQ ID NO: 561587 - DNA, 25 bp, Mus musculus
cactgatccctggaggctcagagtc

SEQ ID NO: 561588 - DNA, 25 bp, Mus musculus
cactgatcgaacaggtgtgtcgaag

SEQ ID NO: 561589 - DNA, 25 bp, Mus musculus
cactgatcgaactggtgtgtcgaag

SEQ ID NO: 561590 - DNA, 25 bp, Mus musculus
cactgatcgctcctttcggtcctga

SEQ ID NO: 561591 - DNA, 25 bp, Mus musculus
cactgatcgctcgtttcggtcctga

SEQ ID NO: 561592 - DNA, 25 bp, Mus musculus
cactgatgacttcatgggatccaga

SEQ ID NO: 561593 - DNA, 25 bp, Mus musculus
cactgatgacttgatgggatccaga

SEQ ID NO: 561594 - DNA, 25 bp, Mus musculus
cactgatgatgacatgacaggctac

SEQ ID NO: 561595 - DNA, 25 bp, Mus musculus
cactgatgatgagatgacaggctac

SEQ ID NO: 561596 - DNA, 25 bp, Mus musculus
cactgatgattacgttctgggagaa

SEQ ID NO: 561597 - DNA, 25 bp, Mus musculus
cactgatgattaggttctgggagaa

SEQ ID NO: 561598 - DNA, 25 bp, Mus musculus
cactgatgccctacgctttggactc

SEQ ID NO: 561599 - DNA, 25 bp, Mus musculus
cactgatgcccttcgctttggactc

SEQ ID NO: 561600 - DNA, 25 bp, Mus musculus
cactgatgctaaacagcagtgtgtt

SEQ ID NO: 561601 - DNA, 25 bp, Mus musculus
cactgatgctaatcagcagtgtgtt

SEQ ID NO: 561602 - DNA, 25 bp, Mus musculus
cactgatggaataggaaaagcatat

SEQ ID NO: 561603 - DNA, 25 bp, Mus musculus
cactgatggaattggaaaagcatat

SEQ ID NO: 561604 - DNA, 25 bp, Mus musculus
cactgatggaggacactatgacgga

SEQ ID NO: 561605 - DNA, 25 bp, Mus musculus
cactgatggaggtcactatgacgga

SEQ ID NO: 561606 - DNA, 25 bp, Mus musculus
cactgatggatgacgctggtttcca

SEQ ID NO: 561607 - DNA, 25 bp, Mus musculus
cactgatggatgtcgctggtttcca

SEQ ID NO: 561608 - DNA, 25 bp, Mus musculus
cactgatggctcacactactggagc

SEQ ID NO: 561609 - DNA, 25 bp, Mus musculus
cactgatggctctcactactggagc

SEQ ID NO: 561610 - DNA, 25 bp, Mus musculus
cactgatgggacacttcgggagcag

SEQ ID NO: 561611 - DNA, 25 bp, Mus musculus
cactgatgggacatgacgatgctgt

SEQ ID NO: 561612 - DNA, 25 bp, Mus musculus
cactgatgggactcttcgggagcag

SEQ ID NO: 561613 - DNA, 25 bp, Mus musculus
cactgatgggacttgacgatgctgt

SEQ ID NO: 561614 - DNA, 25 bp, Mus musculus
cactgatggtcacaagagcatatga

SEQ ID NO: 561615 - DNA, 25 bp, Mus musculus
cactgatggtcagaagagcatatga

SEQ ID NO: 561616 - DNA, 25 bp, Mus musculus
cactgatggtgaagaagacgcagaa

SEQ ID NO: 561617 - DNA, 25 bp, Mus musculus
cactgatggtgatgaagacgcagaa

SEQ ID NO: 561618 - DNA, 25 bp, Mus musculus
cactgatggtgcatgcagtgaagta

SEQ ID NO: 561619 - DNA, 25 bp, Mus musculus
cactgatggtgcttgcagtgaagta

SEQ ID NO: 561620 - DNA, 25 bp, Mus musculus
cactgatgtacacagacactgtgca

SEQ ID NO: 561621 - DNA, 25 bp, Mus musculus
cactgatgtacagagacactgtgca

SEQ ID NO: 561622 - DNA, 25 bp, Mus musculus
cactgatgtggtaccatatccaata

SEQ ID NO: 561623 - DNA, 25 bp, Mus musculus
cactgatgtggttccatatccaata

SEQ ID NO: 561624 - DNA, 25 bp, Mus musculus
cactgatgttttaaaccctttgagc

SEQ ID NO: 561625 - DNA, 25 bp, Mus musculus
cactgatgtttttaaccctttgagc

SEQ ID NO: 561626 - DNA, 25 bp, Mus musculus
cactgattgatactgtgttagcaaa

SEQ ID NO: 561627 - DNA, 25 bp, Mus musculus
cactgattgatagtgtgttagcaaa

SEQ ID NO: 561628 - DNA, 25 bp, Mus musculus
cactgatttatcaaggcaagagggc

SEQ ID NO: 561629 - DNA, 25 bp, Mus musculus
cactgatttatctaggcaagagggc

SEQ ID NO: 561630 - DNA, 25 bp, Mus musculus
cactgatttatgacagtacatggac

SEQ ID NO: 561631 - DNA, 25 bp, Mus musculus
cactgatttatgtcagtacatggac

SEQ ID NO: 561632 - DNA, 25 bp, Mus musculus
cactgcaaggcgaactgaggactga

SEQ ID NO: 561633 - DNA, 25 bp, Mus musculus
cactgcaaggcgtactgaggactga

SEQ ID NO: 561634 - DNA, 25 bp, Mus musculus
cactgcacaccccagtatcgtttga

SEQ ID NO: 561635 - DNA, 25 bp, Mus musculus
cactgcacacccgagtatcgtttga

SEQ ID NO: 561636 - DNA, 25 bp, Mus musculus
cactgcaccaggcttagctcttgga

SEQ ID NO: 561637 - DNA, 25 bp, Mus musculus
cactgcaccagggttagctcttgga

SEQ ID NO: 561638 - DNA, 25 bp, Mus musculus
cactgcacgaagattatgggcgcct

SEQ ID NO: 561639 - DNA, 25 bp, Mus musculus
cactgcacgaagtttatgggcgcct

SEQ ID NO: 561640 - DNA, 25 bp, Mus musculus
cactgcacgaggcagaattccatgc

SEQ ID NO: 561641 - DNA, 25 bp, Mus musculus
cactgcacgagggagaattccatgc

SEQ ID NO: 561642 - DNA, 25 bp, Mus musculus
cactgcacgttcaggagcgcttcgt

SEQ ID NO: 561643 - DNA, 25 bp, Mus musculus
cactgcacgttctggagcgcttcgt

SEQ ID NO: 561644 - DNA, 25 bp, Mus musculus
cactgcactcaacggcaagtcagag

SEQ ID NO: 561645 - DNA, 25 bp, Mus musculus
cactgcactcaagggcaagtcagag

SEQ ID NO: 561646 - DNA, 25 bp, Mus musculus
cactgcactgagaataaggctgaca

SEQ ID NO: 561647 - DNA, 25 bp, Mus musculus
cactgcactgagtataaggctgaca

SEQ ID NO: 561648 - DNA, 25 bp, Mus musculus
cactgcactggtagggaacaagggc

SEQ ID NO: 561649 - DNA, 25 bp, Mus musculus
cactgcactggttgggaacaagggc

SEQ ID NO: 561650 - DNA, 25 bp, Mus musculus
cactgcagacatatccttaacattg

SEQ ID NO: 561651 - DNA, 25 bp, Mus musculus
cactgcagacatttccttaacattg

SEQ ID NO: 561652 - DNA, 25 bp, Mus musculus
cactgcagagaaccggaagaaaact

SEQ ID NO: 561653 - DNA, 25 bp, Mus musculus
cactgcagagaagcggaagaaaact

SEQ ID NO: 561654 - DNA, 25 bp, Mus musculus
cactgcagagcaccggcgcacggaa

SEQ ID NO: 561655 - DNA, 25 bp, Mus musculus
cactgcagagcagcggcgcacggaa

SEQ ID NO: 561656 - DNA, 25 bp, Mus musculus
cactgcagaggtcgcgagcgccatt

SEQ ID NO: 561657 - DNA, 25 bp, Mus musculus
cactgcagaggtggcgagcgccatt

SEQ ID NO: 561658 - DNA, 25 bp, Mus musculus
cactgcagatgtacggctgccgagt

SEQ ID NO: 561659 - DNA, 25 bp, Mus musculus
cactgcagatgttcggctgccgagt

SEQ ID NO: 561660 - DNA, 25 bp, Mus musculus
cactgcagcgacagtaccgccagtt

SEQ ID NO: 561661 - DNA, 25 bp, Mus musculus
cactgcagcgactgtaccgccagtt

SEQ ID NO: 561662 - DNA, 25 bp, Mus musculus
cactgcagctcaaggcggagttcct

SEQ ID NO: 561663 - DNA, 25 bp, Mus musculus
cactgcagctcatggcggagttcct

SEQ ID NO: 561664 - DNA, 25 bp, Mus musculus
cactgcaggagtccaaaactgtgcg

SEQ ID NO: 561665 - DNA, 25 bp, Mus musculus
cactgcaggagtgcaaaactgtgcg

SEQ ID NO: 561666 - DNA, 25 bp, Mus musculus
cactgcaggctgagttcacgctgcc

SEQ ID NO: 561667 - DNA, 25 bp, Mus musculus
cactgcaggctgtgttcacgctgcc

SEQ ID NO: 561668 - DNA, 25 bp, Mus musculus
cactgcaggtatcggtttcttccgc

SEQ ID NO: 561669 - DNA, 25 bp, Mus musculus
cactgcaggtatgggtttcttccgc

SEQ ID NO: 561670 - DNA, 25 bp, Mus musculus
cactgcaggttcaggagaattccct

SEQ ID NO: 561671 - DNA, 25 bp, Mus musculus
cactgcaggttctggagaattccct

SEQ ID NO: 561672 - DNA, 25 bp, Mus musculus
cactgcagtacgctctggcctgtgt

SEQ ID NO: 561673 - DNA, 25 bp, Mus musculus
cactgcagtacggtctggcctgtgt

SEQ ID NO: 561674 - DNA, 25 bp, Mus musculus
cactgcagtctgcaggctactggtt

SEQ ID NO: 561675 - DNA, 25 bp, Mus musculus
cactgcagtctggaggctactggtt

SEQ ID NO: 561676 - DNA, 25 bp, Mus musculus
cactgcatacggactctgcctatag

SEQ ID NO: 561677 - DNA, 25 bp, Mus musculus
cactgcatacggtctctgcctatag

SEQ ID NO: 561678 - DNA, 25 bp, Mus musculus
cactgcatcaggaagtgaacctggt

SEQ ID NO: 561679 - DNA, 25 bp, Mus musculus
cactgcatcaggtagtgaacctggt

SEQ ID NO: 561680 - DNA, 25 bp, Mus musculus
cactgcatctctcgatggctcaaaa

SEQ ID NO: 561681 - DNA, 25 bp, Mus musculus
cactgcatctctggatggctcaaaa

SEQ ID NO: 561682 - DNA, 25 bp, Mus musculus
cactgcatgacgagttcgagaacaa

SEQ ID NO: 561683 - DNA, 25 bp, Mus musculus
cactgcatgacgtgttcgagaacaa

SEQ ID NO: 561684 - DNA, 25 bp, Mus musculus
cactgcatggacaagatcaatgagt

SEQ ID NO: 561685 - DNA, 25 bp, Mus musculus
cactgcatggactagatcaatgagt

SEQ ID NO: 561686 - DNA, 25 bp, Mus musculus
cactgcatggctctgtcgctttcag

SEQ ID NO: 561687 - DNA, 25 bp, Mus musculus
cactgcatggctgtgtcgctttcag

SEQ ID NO: 561688 - DNA, 25 bp, Mus musculus
cactgcatgggccttggtaagaccc

SEQ ID NO: 561689 - DNA, 25 bp, Mus musculus
cactgcatgggcgttggtaagaccc

SEQ ID NO: 561690 - DNA, 25 bp, Mus musculus
cactgcattgcccaagctcttgaaa

SEQ ID NO: 561691 - DNA, 25 bp, Mus musculus
cactgcattgccgaagctcttgaaa

SEQ ID NO: 561692 - DNA, 25 bp, Mus musculus
cactgcattggcacttctgcactgt

SEQ ID NO: 561693 - DNA, 25 bp, Mus musculus
cactgcattggctcttctgcactgt

SEQ ID NO: 561694 - DNA, 25 bp, Mus musculus
cactgcattgtgatgctacagattg

SEQ ID NO: 561695 - DNA, 25 bp, Mus musculus
cactgcattgtgttgctacagattg

SEQ ID NO: 561696 - DNA, 25 bp, Mus musculus
cactgccacttcatttgctggtgga

SEQ ID NO: 561697 - DNA, 25 bp, Mus musculus
cactgccacttcttttgctggtgga

SEQ ID NO: 561698 - DNA, 25 bp, Mus musculus
cactgccagctgagttacaggagaa

SEQ ID NO: 561699 - DNA, 25 bp, Mus musculus
cactgccagctgtgttacaggagaa

SEQ ID NO: 561700 - DNA, 25 bp, Mus musculus
cactgccaggagattctgcaccacg

SEQ ID NO: 561701 - DNA, 25 bp, Mus musculus
cactgccaggagtttctgcaccacg

SEQ ID NO: 561702 - DNA, 25 bp, Mus musculus
cactgccatggacactacaaagctg

SEQ ID NO: 561703 - DNA, 25 bp, Mus musculus
cactgccatggagactacaaagctg

SEQ ID NO: 561704 - DNA, 25 bp, Mus musculus
cactgccattgaagcggatgatcca

SEQ ID NO: 561705 - DNA, 25 bp, Mus musculus
cactgccattgatgcggatgatcca

SEQ ID NO: 561706 - DNA, 25 bp, Mus musculus
cactgccattgccagttcactgcag

SEQ ID NO: 561707 - DNA, 25 bp, Mus musculus
cactgccattgcgagttcactgcag

SEQ ID NO: 561708 - DNA, 25 bp, Mus musculus
cactgcccaaggattgtttcagaga

SEQ ID NO: 561709 - DNA, 25 bp, Mus musculus
cactgcccaaggtttgtttcagaga

SEQ ID NO: 561710 - DNA, 25 bp, Mus musculus
cactgcccaccgactactggaaggt

SEQ ID NO: 561711 - DNA, 25 bp, Mus musculus
cactgcccaccgtctactggaaggt

SEQ ID NO: 561712 - DNA, 25 bp, Mus musculus
cactgccctgtccttggtgaaagag

SEQ ID NO: 561713 - DNA, 25 bp, Mus musculus
cactgccctgtcgttggtgaaagag

SEQ ID NO: 561714 - DNA, 25 bp, Mus musculus
cactgccgagtacgaatttgccaac

SEQ ID NO: 561715 - DNA, 25 bp, Mus musculus
cactgccgagtaggaatttgccaac

SEQ ID NO: 561716 - DNA, 25 bp, Mus musculus
cactgccgctccacattaaaataga

SEQ ID NO: 561717 - DNA, 25 bp, Mus musculus
cactgccgctcctcattaaaataga

SEQ ID NO: 561718 - DNA, 25 bp, Mus musculus
cactgccgtgcaccccaatgagagt

SEQ ID NO: 561719 - DNA, 25 bp, Mus musculus
cactgccgtgcagcccaatgagagt

SEQ ID NO: 561720 - DNA, 25 bp, Mus musculus
cactgccgttgaagctgcctttgag

SEQ ID NO: 561721 - DNA, 25 bp, Mus musculus
cactgccgttgatgctgcctttgag

SEQ ID NO: 561722 - DNA, 25 bp, Mus musculus
cactgcctaagaatagtggaccttc

SEQ ID NO: 561723 - DNA, 25 bp, Mus musculus
cactgcctaagattagtggaccttc

SEQ ID NO: 561724 - DNA, 25 bp, Mus musculus
cactgcctacttcggagcctgtatg

SEQ ID NO: 561725 - DNA, 25 bp, Mus musculus
cactgcctacttctgtggcgtgaag

SEQ ID NO: 561726 - DNA, 25 bp, Mus musculus
cactgcctacttgggagcctgtatg

SEQ ID NO: 561727 - DNA, 25 bp, Mus musculus
cactgcctacttgtgtggcgtgaag

SEQ ID NO: 561728 - DNA, 25 bp, Mus musculus
cactgcctgggtcaacctggctgtg

SEQ ID NO: 561729 - DNA, 25 bp, Mus musculus
cactgcctgggtgaacctggctgtg

SEQ ID NO: 561730 - DNA, 25 bp, Mus musculus
cactgccttggacgactttgtccag

SEQ ID NO: 561731 - DNA, 25 bp, Mus musculus
cactgccttggaggactttgtccag

SEQ ID NO: 561732 - DNA, 25 bp, Mus musculus
cactgccttgttactgccacaggga

SEQ ID NO: 561733 - DNA, 25 bp, Mus musculus
cactgccttgtttctgccacaggga

SEQ ID NO: 561734 - DNA, 25 bp, Mus musculus
cactgcctttttcggtcacaacggg

SEQ ID NO: 561735 - DNA, 25 bp, Mus musculus
cactgcctttttgggtcacaacggg

SEQ ID NO: 561736 - DNA, 25 bp, Mus musculus
cactgcgaactgcaatccactcggg

SEQ ID NO: 561737 - DNA, 25 bp, Mus musculus
cactgcgaactggaatccactcggg

SEQ ID NO: 561738 - DNA, 25 bp, Mus musculus
cactgcgatcacaatccaaagggac

SEQ ID NO: 561739 - DNA, 25 bp, Mus musculus
cactgcgatcactatccaaagggac

SEQ ID NO: 561740 - DNA, 25 bp, Mus musculus
cactgcgcaggtagctcagcggaac

SEQ ID NO: 561741 - DNA, 25 bp, Mus musculus
cactgcgcaggttgctcagcggaac

SEQ ID NO: 561742 - DNA, 25 bp, Mus musculus
cactgcgcattgcaaccgttgtggt

SEQ ID NO: 561743 - DNA, 25 bp, Mus musculus
cactgcgcattggaaccgttgtggt

SEQ ID NO: 561744 - DNA, 25 bp, Mus musculus
cactgcggagagctacatgctgcag

SEQ ID NO: 561745 - DNA, 25 bp, Mus musculus
cactgcggagaggtacatgctgcag

SEQ ID NO: 561746 - DNA, 25 bp, Mus musculus
cactgcggcacgaccttagggattt

SEQ ID NO: 561747 - DNA, 25 bp, Mus musculus
cactgcggcacgtccttagggattt

SEQ ID NO: 561748 - DNA, 25 bp, Mus musculus
cactgcggcggccaacttggtgact

SEQ ID NO: 561749 - DNA, 25 bp, Mus musculus
cactgcggcggcgaacttggtgact

SEQ ID NO: 561750 - DNA, 25 bp, Mus musculus
cactgcgggactccgagggcctctg

SEQ ID NO: 561751 - DNA, 25 bp, Mus musculus
cactgcgggactgcgagggcctctg

SEQ ID NO: 561752 - DNA, 25 bp, Mus musculus
cactgcgggtgcatgccacttctgt

SEQ ID NO: 561753 - DNA, 25 bp, Mus musculus
cactgcgggtgcttgccacttctgt

SEQ ID NO: 561754 - DNA, 25 bp, Mus musculus
cactgctaaggactactgggcatat

SEQ ID NO: 561755 - DNA, 25 bp, Mus musculus
cactgctaaggagtactgggcatat

SEQ ID NO: 561756 - DNA, 25 bp, Mus musculus
cactgctactcaaggtgctgcggca

SEQ ID NO: 561757 - DNA, 25 bp, Mus musculus
cactgctactcatggtgctgcggca

SEQ ID NO: 561758 - DNA, 25 bp, Mus musculus
cactgctagaccagcagaacaatga

SEQ ID NO: 561759 - DNA, 25 bp, Mus musculus
cactgctagacctgcagaacaatga

SEQ ID NO: 561760 - DNA, 25 bp, Mus musculus
cactgctagattcgagctgggctcc

SEQ ID NO: 561761 - DNA, 25 bp, Mus musculus
cactgctagattggagctgggctcc

SEQ ID NO: 561762 - DNA, 25 bp, Mus musculus
cactgctatctcatgtaggcggtga

SEQ ID NO: 561763 - DNA, 25 bp, Mus musculus
cactgctatctcttgtaggcggtga

SEQ ID NO: 561764 - DNA, 25 bp, Mus musculus
cactgctcagctcctaagatggtac

SEQ ID NO: 561765 - DNA, 25 bp, Mus musculus
cactgctcagctgctaagatggtac

SEQ ID NO: 561766 - DNA, 25 bp, Mus musculus
cactgctcccagagtgataacagtg

SEQ ID NO: 561767 - DNA, 25 bp, Mus musculus
cactgctcccagtgtgataacagtg

SEQ ID NO: 561768 - DNA, 25 bp, Mus musculus
cactgctctacgctgtgcgtgggaa

SEQ ID NO: 561769 - DNA, 25 bp, Mus musculus
cactgctctacggtgtgcgtgggaa

SEQ ID NO: 561770 - DNA, 25 bp, Mus musculus
cactgctctcagagagaagcgcaca

SEQ ID NO: 561771 - DNA, 25 bp, Mus musculus
cactgctctcagtgagaagcgcaca

SEQ ID NO: 561772 - DNA, 25 bp, Mus musculus
cactgctgagatctggccaaggtta

SEQ ID NO: 561773 - DNA, 25 bp, Mus musculus
cactgctgagatgtggccaaggtta

SEQ ID NO: 561774 - DNA, 25 bp, Mus musculus
cactgctgagtacaggtgggacatc

SEQ ID NO: 561775 - DNA, 25 bp, Mus musculus
cactgctgagtagaggtgggacatc

SEQ ID NO: 561776 - DNA, 25 bp, Mus musculus
cactgctgatggcagagctgtttca

SEQ ID NO: 561777 - DNA, 25 bp, Mus musculus
cactgctgatgggagagctgtttca

SEQ ID NO: 561778 - DNA, 25 bp, Mus musculus
cactgctgcgtgaggaaacctatga

SEQ ID NO: 561779 - DNA, 25 bp, Mus musculus
cactgctgcgtgtggaaacctatga

SEQ ID NO: 561780 - DNA, 25 bp, Mus musculus
cactgctgctaaaccccctgtttgg

SEQ ID NO: 561781 - DNA, 25 bp, Mus musculus
cactgctgctaatccccctgtttgg

SEQ ID NO: 561782 - DNA, 25 bp, Mus musculus
cactgctgcttaccgagacgtggaa

SEQ ID NO: 561783 - DNA, 25 bp, Mus musculus
cactgctgcttagcgagacgtggaa

SEQ ID NO: 561784 - DNA, 25 bp, Mus musculus
cactgctgctttccttttgtggctt

SEQ ID NO: 561785 - DNA, 25 bp, Mus musculus
cactgctgctttgcttttgtggctt

SEQ ID NO: 561786 - DNA, 25 bp, Mus musculus
cactgctggaacagatcgggtgtct

SEQ ID NO: 561787 - DNA, 25 bp, Mus musculus
cactgctggaactgatcgggtgtct

SEQ ID NO: 561788 - DNA, 25 bp, Mus musculus
cactgctggagcaactagcccttga

SEQ ID NO: 561789 - DNA, 25 bp, Mus musculus
cactgctggagctactagcccttga

SEQ ID NO: 561790 - DNA, 25 bp, Mus musculus
cactgctggctgctggcggcttttc

SEQ ID NO: 561791 - DNA, 25 bp, Mus musculus
cactgctggctggtggcggcttttc

SEQ ID NO: 561792 - DNA, 25 bp, Mus musculus
cactgctggtaccaaaaagagagct

SEQ ID NO: 561793 - DNA, 25 bp, Mus musculus
cactgctggtacgaaaaagagagct

SEQ ID NO: 561794 - DNA, 25 bp, Mus musculus
cactgctgtcctctggttatgacac

SEQ ID NO: 561795 - DNA, 25 bp, Mus musculus
cactgctgtcctgtggttatgacac

SEQ ID NO: 561796 - DNA, 25 bp, Mus musculus
cactgctgtcgccaaatactcagat

SEQ ID NO: 561797 - DNA, 25 bp, Mus musculus
cactgctgtcgcgaaatactcagat

SEQ ID NO: 561798 - DNA, 25 bp, Mus musculus
cactgctgttagaggcccagaagga

SEQ ID NO: 561799 - DNA, 25 bp, Mus musculus
cactgctgttagtggcccagaagga

SEQ ID NO: 561800 - DNA, 25 bp, Mus musculus
cactgcttaagcatctgtagttgga

SEQ ID NO: 561801 - DNA, 25 bp, Mus musculus
cactgcttaagcttctgtagttgga

SEQ ID NO: 561802 - DNA, 25 bp, Mus musculus
cactgcttaaggagcccagaataaa

SEQ ID NO: 561803 - DNA, 25 bp, Mus musculus
cactgcttaaggtgcccagaataaa

SEQ ID NO: 561804 - DNA, 25 bp, Mus musculus
cactgcttgggaagggtgctaaatc

SEQ ID NO: 561805 - DNA, 25 bp, Mus musculus
cactgcttgggatgggtgctaaatc

SEQ ID NO: 561806 - DNA, 25 bp, Mus musculus
cactgctttaagatctagatgattg

SEQ ID NO: 561807 - DNA, 25 bp, Mus musculus
cactgctttaagttctagatgattg

SEQ ID NO: 561808 - DNA, 25 bp, Mus musculus
cactgctttttgacatcggcttggc

SEQ ID NO: 561809 - DNA, 25 bp, Mus musculus
cactgctttttgtcatcggcttggc

SEQ ID NO: 561810 - DNA, 25 bp, Mus musculus
cactggaaaagcacgcagacaagga

SEQ ID NO: 561811 - DNA, 25 bp, Mus musculus
cactggaaaagctcgcagacaagga

SEQ ID NO: 561812 - DNA, 25 bp, Mus musculus
cactggaaactgaagactgccgtca

SEQ ID NO: 561813 - DNA, 25 bp, Mus musculus
cactggaaactgtagactgccgtca

SEQ ID NO: 561814 - DNA, 25 bp, Mus musculus
cactggaacaagagatttcaaaatt

SEQ ID NO: 561815 - DNA, 25 bp, Mus musculus
cactggaacaagtgatttcaaaatt

SEQ ID NO: 561816 - DNA, 25 bp, Mus musculus
cactggaactccactatcaaaagga

SEQ ID NO: 561817 - DNA, 25 bp, Mus musculus
cactggaactcctctatcaaaagga

SEQ ID NO: 561818 - DNA, 25 bp, Mus musculus
cactggaactgcacttatctcgctt

SEQ ID NO: 561819 - DNA, 25 bp, Mus musculus
cactggaactgctcttatctcgctt

SEQ ID NO: 561820 - DNA, 25 bp, Mus musculus
cactggaagaaaccggagcattgtt

SEQ ID NO: 561821 - DNA, 25 bp, Mus musculus
cactggaagaaagcggagcattgtt

SEQ ID NO: 561822 - DNA, 25 bp, Mus musculus
cactggaatgcgaagtgtgggtcat

SEQ ID NO: 561823 - DNA, 25 bp, Mus musculus
cactggaatgcgtagtgtgggtcat

SEQ ID NO: 561824 - DNA, 25 bp, Mus musculus
cactggaatgtgcagcagcttgtga

SEQ ID NO: 561825 - DNA, 25 bp, Mus musculus
cactggaatgtggagcagcttgtga

SEQ ID NO: 561826 - DNA, 25 bp, Mus musculus
cactggaattgcattatttgcggag

SEQ ID NO: 561827 - DNA, 25 bp, Mus musculus
cactggaattgctttatttgcggag

SEQ ID NO: 561828 - DNA, 25 bp, Mus musculus
cactggacacagatgaggtccctta

SEQ ID NO: 561829 - DNA, 25 bp, Mus musculus
cactggacacagttgaggtccctta

SEQ ID NO: 561830 - DNA, 25 bp, Mus musculus
cactggacatagaggctgggaaaac

SEQ ID NO: 561831 - DNA, 25 bp, Mus musculus
cactggacatagtggctgggaaaac

SEQ ID NO: 561832 - DNA, 25 bp, Mus musculus
cactggacatgaacttctcagctgc

SEQ ID NO: 561833 - DNA, 25 bp, Mus musculus
cactggacatgatcttctcagctgc

SEQ ID NO: 561834 - DNA, 25 bp, Mus musculus
cactggacatggagctccgagcagc

SEQ ID NO: 561835 - DNA, 25 bp, Mus musculus
cactggacatggtgctccgagcagc

SEQ ID NO: 561836 - DNA, 25 bp, Mus musculus
cactggacatgtagcagagggctgc

SEQ ID NO: 561837 - DNA, 25 bp, Mus musculus
cactggacatgttgcagagggctgc

SEQ ID NO: 561838 - DNA, 25 bp, Mus musculus
cactggaccagtctgcagagatact

SEQ ID NO: 561839 - DNA, 25 bp, Mus musculus
cactggaccagtgtgcagagatact

SEQ ID NO: 561840 - DNA, 25 bp, Mus musculus
cactggacggagaaagcaggcttgc

SEQ ID NO: 561841 - DNA, 25 bp, Mus musculus
cactggacggagtaagcaggcttgc

SEQ ID NO: 561842 - DNA, 25 bp, Mus musculus
cactggagaaacacgggagtgtgtc

SEQ ID NO: 561843 - DNA, 25 bp, Mus musculus
cactggagaaactcgggagtgtgtc

SEQ ID NO: 561844 - DNA, 25 bp, Mus musculus
cactggagaagactatcctatggat

SEQ ID NO: 561845 - DNA, 25 bp, Mus musculus
cactggagaagagtatcctatggat

SEQ ID NO: 561846 - DNA, 25 bp, Mus musculus
cactggagaccacttgccatgcttt

SEQ ID NO: 561847 - DNA, 25 bp, Mus musculus
cactggagaccagttgccatgcttt

SEQ ID NO: 561848 - DNA, 25 bp, Mus musculus
cactggagatgtcatgagcctgtct

SEQ ID NO: 561849 - DNA, 25 bp, Mus musculus
cactggagatgtgatgagcctgtct

SEQ ID NO: 561850 - DNA, 25 bp, Mus musculus
cactggagattgcagctgctgagca

SEQ ID NO: 561851 - DNA, 25 bp, Mus musculus
cactggagattggagctgctgagca

SEQ ID NO: 561852 - DNA, 25 bp, Mus musculus
cactggagcccaaacagatgttctg

SEQ ID NO: 561853 - DNA, 25 bp, Mus musculus
cactggagcccatacagatgttctg

SEQ ID NO: 561854 - DNA, 25 bp, Mus musculus
cactggagctaacgcctagcgagta

SEQ ID NO: 561855 - DNA, 25 bp, Mus musculus
cactggagctaaggcctagcgagta

SEQ ID NO: 561856 - DNA, 25 bp, Mus musculus
cactggaggactccggtatctatca

SEQ ID NO: 561857 - DNA, 25 bp, Mus musculus
cactggaggactgcggtatctatca

SEQ ID NO: 561858 - DNA, 25 bp, Mus musculus
cactggaggccaatacagatgctat

SEQ ID NO: 561859 - DNA, 25 bp, Mus musculus
cactggaggccattacagatgctat

SEQ ID NO: 561860 - DNA, 25 bp, Mus musculus
cactggaggctgaaattcagcaggg

SEQ ID NO: 561861 - DNA, 25 bp, Mus musculus
cactggaggctgtaattcagcaggg

SEQ ID NO: 561862 - DNA, 25 bp, Mus musculus
cactggagtcatctctacattgcag

SEQ ID NO: 561863 - DNA, 25 bp, Mus musculus
cactggagtcatgtctacattgcag

SEQ ID NO: 561864 - DNA, 25 bp, Mus musculus
cactggagtgacctcacagttggac

SEQ ID NO: 561865 - DNA, 25 bp, Mus musculus
cactggagtgacgtcacagttggac

SEQ ID NO: 561866 - DNA, 25 bp, Mus musculus
cactggagttccagaggtgaccacc

SEQ ID NO: 561867 - DNA, 25 bp, Mus musculus
cactggagttcctgaggtgaccacc

SEQ ID NO: 561868 - DNA, 25 bp, Mus musculus
cactggatatcacctgcctgtttat

SEQ ID NO: 561869 - DNA, 25 bp, Mus musculus
cactggatatcagctgcctgtttat

SEQ ID NO: 561870 - DNA, 25 bp, Mus musculus
cactggatcactccatgtggtttca

SEQ ID NO: 561871 - DNA, 25 bp, Mus musculus
cactggatcactgcatgtggtttca

SEQ ID NO: 561872 - DNA, 25 bp, Mus musculus
cactggatcctaagctcagaagtat

SEQ ID NO: 561873 - DNA, 25 bp, Mus musculus
cactggatcctatgctcagaagtat

SEQ ID NO: 561874 - DNA, 25 bp, Mus musculus
cactggatctggagtcggaggctca

SEQ ID NO: 561875 - DNA, 25 bp, Mus musculus
cactggatctggtgtcggaggctca

SEQ ID NO: 561876 - DNA, 25 bp, Mus musculus
cactggatgagaaagaacctgtacc

SEQ ID NO: 561877 - DNA, 25 bp, Mus musculus
cactggatgagatagaacctgtacc

SEQ ID NO: 561878 - DNA, 25 bp, Mus musculus
cactggatgctgaacgagtgtgaga

SEQ ID NO: 561879 - DNA, 25 bp, Mus musculus
cactggatgctgtacgagtgtgaga

SEQ ID NO: 561880 - DNA, 25 bp, Mus musculus
cactggatggacaggtccctgatag

SEQ ID NO: 561881 - DNA, 25 bp, Mus musculus
cactggatggactggtccctgatag

SEQ ID NO: 561882 - DNA, 25 bp, Mus musculus
cactggatgtgtaccgactgtcctc

SEQ ID NO: 561883 - DNA, 25 bp, Mus musculus
cactggatgtgttccgactgtcctc

SEQ ID NO: 561884 - DNA, 25 bp, Mus musculus
cactggattcttattcaggcattct

SEQ ID NO: 561885 - DNA, 25 bp, Mus musculus
cactggattctttttcaggcattct

SEQ ID NO: 561886 - DNA, 25 bp, Mus musculus
cactggatttacacaaggcaagatc

SEQ ID NO: 561887 - DNA, 25 bp, Mus musculus
cactggatttactcaaggcaagatc

SEQ ID NO: 561888 - DNA, 25 bp, Mus musculus
cactggcaattacgcttctcatcga

SEQ ID NO: 561889 - DNA, 25 bp, Mus musculus
cactggcaattaggcttctcatcga

SEQ ID NO: 561890 - DNA, 25 bp, Mus musculus
cactggcacgaaagtgagttcaccc

SEQ ID NO: 561891 - DNA, 25 bp, Mus musculus
cactggcacgaatgtgagttcaccc

SEQ ID NO: 561892 - DNA, 25 bp, Mus musculus
cactggcagagaaggctctcctggc

SEQ ID NO: 561893 - DNA, 25 bp, Mus musculus
cactggcagagatggctctcctggc

SEQ ID NO: 561894 - DNA, 25 bp, Mus musculus
cactggcagagcagcagctacatgc

SEQ ID NO: 561895 - DNA, 25 bp, Mus musculus
cactggcagagctgcagctacatgc

SEQ ID NO: 561896 - DNA, 25 bp, Mus musculus
cactggcatagtaggagacaaagga

SEQ ID NO: 561897 - DNA, 25 bp, Mus musculus
cactggcatagttggagacaaagga

SEQ ID NO: 561898 - DNA, 25 bp, Mus musculus
cactggcatgaacgctgcttccatt

SEQ ID NO: 561899 - DNA, 25 bp, Mus musculus
cactggcatgaaggctgcttccatt

SEQ ID NO: 561900 - DNA, 25 bp, Mus musculus
cactggccagtgcaagagcatcacg

SEQ ID NO: 561901 - DNA, 25 bp, Mus musculus
cactggccagtggaagagcatcacg

SEQ ID NO: 561902 - DNA, 25 bp, Mus musculus
cactggccccagcatcaagatctgg

SEQ ID NO: 561903 - DNA, 25 bp, Mus musculus
cactggccccaggatcaagatctgg

SEQ ID NO: 561904 - DNA, 25 bp, Mus musculus
cactggccgaggaaaggccccagag

SEQ ID NO: 561905 - DNA, 25 bp, Mus musculus
cactggccgaggtaaggccccagag

SEQ ID NO: 561906 - DNA, 25 bp, Mus musculus
cactggcctctcagggaattaacac

SEQ ID NO: 561907 - DNA, 25 bp, Mus musculus
cactggcctctctgggaattaacac

SEQ ID NO: 561908 - DNA, 25 bp, Mus musculus
cactggcctgcacaactctgtattt

SEQ ID NO: 561909 - DNA, 25 bp, Mus musculus
cactggcctgcagaactctgtattt

SEQ ID NO: 561910 - DNA, 25 bp, Mus musculus
cactggcctggaaagggtacagcgc

SEQ ID NO: 561911 - DNA, 25 bp, Mus musculus
cactggcctggatagggtacagcgc

SEQ ID NO: 561912 - DNA, 25 bp, Mus musculus
cactggcctggcactacccagagat

SEQ ID NO: 561913 - DNA, 25 bp, Mus musculus
cactggcctggctctacccagagat

SEQ ID NO: 561914 - DNA, 25 bp, Mus musculus
cactggccttagagcttccattcgg

SEQ ID NO: 561915 - DNA, 25 bp, Mus musculus
cactggccttagtgcttccattcgg

SEQ ID NO: 561916 - DNA, 25 bp, Mus musculus
cactggcgactcaggctacgtttcc

SEQ ID NO: 561917 - DNA, 25 bp, Mus musculus
cactggcgactctggctacgtttcc

SEQ ID NO: 561918 - DNA, 25 bp, Mus musculus
cactggcgagtcactacaaggctta

SEQ ID NO: 561919 - DNA, 25 bp, Mus musculus
cactggcgagtctctacaaggctta

SEQ ID NO: 561920 - DNA, 25 bp, Mus musculus
cactggcgccagagtatggcagagc

SEQ ID NO: 561921 - DNA, 25 bp, Mus musculus
cactggcgccagtgtatggcagagc

SEQ ID NO: 561922 - DNA, 25 bp, Mus musculus
cactggcggagtacagctggccttc

SEQ ID NO: 561923 - DNA, 25 bp, Mus musculus
cactggcggagttcagctggccttc

SEQ ID NO: 561924 - DNA, 25 bp, Mus musculus
cactggcgggcaacattgagtccat

SEQ ID NO: 561925 - DNA, 25 bp, Mus musculus
cactggcgggcatcattgagtccat

SEQ ID NO: 561926 - DNA, 25 bp, Mus musculus
cactggctaatcaagagtgaaaaac

SEQ ID NO: 561927 - DNA, 25 bp, Mus musculus
cactggctaatctagagtgaaaaac

SEQ ID NO: 561928 - DNA, 25 bp, Mus musculus
cactggctagaaaataaatgggatt

SEQ ID NO: 561929 - DNA, 25 bp, Mus musculus
cactggctagaatataaatgggatt

SEQ ID NO: 561930 - DNA, 25 bp, Mus musculus
cactggctagcaccgaacagaacgg

SEQ ID NO: 561931 - DNA, 25 bp, Mus musculus
cactggctagcagcgaacagaacgg

SEQ ID NO: 561932 - DNA, 25 bp, Mus musculus
cactggctatcaagtgccgggtcta

SEQ ID NO: 561933 - DNA, 25 bp, Mus musculus
cactggctatcatgtgccgggtcta

SEQ ID NO: 561934 - DNA, 25 bp, Mus musculus
cactggctctaaagcagatcgggcc

SEQ ID NO: 561935 - DNA, 25 bp, Mus musculus
cactggctctaatgcagatcgggcc

SEQ ID NO: 561936 - DNA, 25 bp, Mus musculus
cactggctctgaatcttgccgtctg

SEQ ID NO: 561937 - DNA, 25 bp, Mus musculus
cactggctctgattcttgccgtctg

SEQ ID NO: 561938 - DNA, 25 bp, Mus musculus
cactggctgtatccagtatttctgc

SEQ ID NO: 561939 - DNA, 25 bp, Mus musculus
cactggctgtatgcagtatttctgc

SEQ ID NO: 561940 - DNA, 25 bp, Mus musculus
cactggcttcagacatcatgggcct

SEQ ID NO: 561941 - DNA, 25 bp, Mus musculus
cactggcttcagtcatcatgggcct

SEQ ID NO: 561942 - DNA, 25 bp, Mus musculus
cactgggaaaacactcttggcacga

SEQ ID NO: 561943 - DNA, 25 bp, Mus musculus
cactgggaaaactctcttggcacga

SEQ ID NO: 561944 - DNA, 25 bp, Mus musculus
cactgggaacaactgctggaggcat

SEQ ID NO: 561945 - DNA, 25 bp, Mus musculus
cactgggaacaagtgctggaggcat

SEQ ID NO: 561946 - DNA, 25 bp, Mus musculus
cactgggacagacgagaccctggaa

SEQ ID NO: 561947 - DNA, 25 bp, Mus musculus
cactgggacagaggagaccctggaa

SEQ ID NO: 561948 - DNA, 25 bp, Mus musculus
cactgggacagtccagactttgtat

SEQ ID NO: 561949 - DNA, 25 bp, Mus musculus
cactgggacagtgcagactttgtat

SEQ ID NO: 561950 - DNA, 25 bp, Mus musculus
cactgggaccagaatgagcgttacc

SEQ ID NO: 561951 - DNA, 25 bp, Mus musculus
cactgggaccagtatgagcgttacc

SEQ ID NO: 561952 - DNA, 25 bp, Mus musculus
cactgggacctacctctgcaatgtt

SEQ ID NO: 561953 - DNA, 25 bp, Mus musculus
cactgggacctagctctgcaatgtt

SEQ ID NO: 561954 - DNA, 25 bp, Mus musculus
cactgggagaagcacggaaagacat

SEQ ID NO: 561955 - DNA, 25 bp, Mus musculus
cactgggagaaggacggaaagacat

SEQ ID NO: 561956 - DNA, 25 bp, Mus musculus
cactgggagtctccaaaaagctaca

SEQ ID NO: 561957 - DNA, 25 bp, Mus musculus
cactgggagtctgcaaaaagctaca

SEQ ID NO: 561958 - DNA, 25 bp, Mus musculus
cactgggataggacacttgtggaag

SEQ ID NO: 561959 - DNA, 25 bp, Mus musculus
cactgggataggtcacttgtggaag

SEQ ID NO: 561960 - DNA, 25 bp, Mus musculus
cactgggatgctcatcgggctcagc

SEQ ID NO: 561961 - DNA, 25 bp, Mus musculus
cactgggatgctgatcgggctcagc

SEQ ID NO: 561962 - DNA, 25 bp, Mus musculus
cactgggcaggaagcaccaatgcag

SEQ ID NO: 561963 - DNA, 25 bp, Mus musculus
cactgggcaggatgcaccaatgcag

SEQ ID NO: 561964 - DNA, 25 bp, Mus musculus
cactgggcccaacactaagcaaaac

SEQ ID NO: 561965 - DNA, 25 bp, Mus musculus
cactgggcccaacgcataggctgat

SEQ ID NO: 561966 - DNA, 25 bp, Mus musculus
cactgggcccaagactaagcaaaac

SEQ ID NO: 561967 - DNA, 25 bp, Mus musculus
cactgggcccaaggcataggctgat

SEQ ID NO: 561968 - DNA, 25 bp, Mus musculus
cactgggccctcagtatgtactgct

SEQ ID NO: 561969 - DNA, 25 bp, Mus musculus
cactgggccctctgtatgtactgct

SEQ ID NO: 561970 - DNA, 25 bp, Mus musculus
cactgggccgacagggccccttagg

SEQ ID NO: 561971 - DNA, 25 bp, Mus musculus
cactgggccgactgggccccttagg

SEQ ID NO: 561972 - DNA, 25 bp, Mus musculus
cactgggcgagacaaaaccacctgt

SEQ ID NO: 561973 - DNA, 25 bp, Mus musculus
cactgggcgagagaaaaccacctgt

SEQ ID NO: 561974 - DNA, 25 bp, Mus musculus
cactgggcgaggacaacattggtct

SEQ ID NO: 561975 - DNA, 25 bp, Mus musculus
cactgggcgaggtcaacattggtct

SEQ ID NO: 561976 - DNA, 25 bp, Mus musculus
cactgggctcctccactaaaggtga

SEQ ID NO: 561977 - DNA, 25 bp, Mus musculus
cactgggctcctgcactaaaggtga

SEQ ID NO: 561978 - DNA, 25 bp, Mus musculus
cactgggcttggcttttggcagcct

SEQ ID NO: 561979 - DNA, 25 bp, Mus musculus
cactgggcttgggttttggcagcct

SEQ ID NO: 561980 - DNA, 25 bp, Mus musculus
cactgggtaatcagcacctgttgtg

SEQ ID NO: 561981 - DNA, 25 bp, Mus musculus
cactgggtaatctgcacctgttgtg

SEQ ID NO: 561982 - DNA, 25 bp, Mus musculus
cactgggtcaccagagagtcgagca

SEQ ID NO: 561983 - DNA, 25 bp, Mus musculus
cactgggtcacctgagagtcgagca

SEQ ID NO: 561984 - DNA, 25 bp, Mus musculus
cactgggtctaccatgatagaacac

SEQ ID NO: 561985 - DNA, 25 bp, Mus musculus
cactgggtctacgatgatagaacac

SEQ ID NO: 561986 - DNA, 25 bp, Mus musculus
cactgggtctgcagatgttaggact

SEQ ID NO: 561987 - DNA, 25 bp, Mus musculus
cactgggtctgctgatgttaggact

SEQ ID NO: 561988 - DNA, 25 bp, Mus musculus
cactgggtggctattctgtcaccgc

SEQ ID NO: 561989 - DNA, 25 bp, Mus musculus
cactgggtggcttttctgtcaccgc

SEQ ID NO: 561990 - DNA, 25 bp, Mus musculus
cactgggtgggacacctggaatcac

SEQ ID NO: 561991 - DNA, 25 bp, Mus musculus
cactgggtgggagacctggaatcac

SEQ ID NO: 561992 - DNA, 25 bp, Mus musculus
cactgggtgtgcactccgagcgatc

SEQ ID NO: 561993 - DNA, 25 bp, Mus musculus
cactgggtgtgctctccgagcgatc

SEQ ID NO: 561994 - DNA, 25 bp, Mus musculus
cactggtaagttcgaggtgtgaact

SEQ ID NO: 561995 - DNA, 25 bp, Mus musculus
cactggtaagttggaggtgtgaact

SEQ ID NO: 561996 - DNA, 25 bp, Mus musculus
cactggtaatgtccttgtaataaaa

SEQ ID NO: 561997 - DNA, 25 bp, Mus musculus
cactggtaatgtgcttgtaataaaa

SEQ ID NO: 561998 - DNA, 25 bp, Mus musculus
cactggtactgaagatcttgcccga

SEQ ID NO: 561999 - DNA, 25 bp, Mus musculus
cactggtactgatgatcttgcccga

SEQ ID NO: 562000 - DNA, 25 bp, Mus musculus
cactggtactgtcgtcgagtgaccg

SEQ ID NO: 562001 - DNA, 25 bp, Mus musculus
cactggtactgtggtcgagtgaccg

SEQ ID NO: 562002 - DNA, 25 bp, Mus musculus
cactggtagtaacccagccctgact

SEQ ID NO: 562003 - DNA, 25 bp, Mus musculus
cactggtagtaagccagccctgact

SEQ ID NO: 562004 - DNA, 25 bp, Mus musculus
cactggtataccaggtcacaggtgg

SEQ ID NO: 562005 - DNA, 25 bp, Mus musculus
cactggtatacctggtcacaggtgg

SEQ ID NO: 562006 - DNA, 25 bp, Mus musculus
cactggtcaagcctcgctggagaaa

SEQ ID NO: 562007 - DNA, 25 bp, Mus musculus
cactggtcaagcgtcgctggagaaa

SEQ ID NO: 562008 - DNA, 25 bp, Mus musculus
cactggtcacaaccgggcagtggac

SEQ ID NO: 562009 - DNA, 25 bp, Mus musculus
cactggtcacaagcgggcagtggac

SEQ ID NO: 562010 - DNA, 25 bp, Mus musculus
cactggtcctgacggccatgtgctc

SEQ ID NO: 562011 - DNA, 25 bp, Mus musculus
cactggtcctgagggccatgtgctc

SEQ ID NO: 562012 - DNA, 25 bp, Mus musculus
cactggtcgggaaactcaatggaat

SEQ ID NO: 562013 - DNA, 25 bp, Mus musculus
cactggtcgggatactcaatggaat

SEQ ID NO: 562014 - DNA, 25 bp, Mus musculus
cactggtcgtgtagatcgtgagcag

SEQ ID NO: 562015 - DNA, 25 bp, Mus musculus
cactggtcgtgttgatcgtgagcag

SEQ ID NO: 562016 - DNA, 25 bp, Mus musculus
cactggtctagcactctatggtgga

SEQ ID NO: 562017 - DNA, 25 bp, Mus musculus
cactggtctagctctctatggtgga

SEQ ID NO: 562018 - DNA, 25 bp, Mus musculus
cactggtctgcgctcgcggttacca

SEQ ID NO: 562019 - DNA, 25 bp, Mus musculus
cactggtctgcggtcgcggttacca

SEQ ID NO: 562020 - DNA, 25 bp, Mus musculus
cactggtctggaaggcagctggtac

SEQ ID NO: 562021 - DNA, 25 bp, Mus musculus
cactggtctggatggcagctggtac

SEQ ID NO: 562022 - DNA, 25 bp, Mus musculus
cactggtgaaaaaatttcccgtagg

SEQ ID NO: 562023 - DNA, 25 bp, Mus musculus
cactggtgaaaatatttcccgtagg

SEQ ID NO: 562024 - DNA, 25 bp, Mus musculus
cactggtgaagtctctctgcgccaa

SEQ ID NO: 562025 - DNA, 25 bp, Mus musculus
cactggtgaagtgtctctgcgccaa

SEQ ID NO: 562026 - DNA, 25 bp, Mus musculus
cactggtgaccgcatatgccgccta

SEQ ID NO: 562027 - DNA, 25 bp, Mus musculus
cactggtgaccggatatgccgccta

SEQ ID NO: 562028 - DNA, 25 bp, Mus musculus
cactggtgagtgctactgggcttca

SEQ ID NO: 562029 - DNA, 25 bp, Mus musculus
cactggtgagtggtactgggcttca

SEQ ID NO: 562030 - DNA, 25 bp, Mus musculus
cactggtgcaaaagtcatagtaaca

SEQ ID NO: 562031 - DNA, 25 bp, Mus musculus
cactggtgcaaatgtcatagtaaca

SEQ ID NO: 562032 - DNA, 25 bp, Mus musculus
cactggtgctgaagtccctatgcct

SEQ ID NO: 562033 - DNA, 25 bp, Mus musculus
cactggtgctgatgtccctatgcct

SEQ ID NO: 562034 - DNA, 25 bp, Mus musculus
cactggtggacaaatgacaatggaa

SEQ ID NO: 562035 - DNA, 25 bp, Mus musculus
cactggtggacatatgacaatggaa

SEQ ID NO: 562036 - DNA, 25 bp, Mus musculus
cactggtggttcagaatgtgtccgt

SEQ ID NO: 562037 - DNA, 25 bp, Mus musculus
cactggtggttctgaatgtgtccgt

SEQ ID NO: 562038 - DNA, 25 bp, Mus musculus
cactggtgtctaactaagcgcctcg

SEQ ID NO: 562039 - DNA, 25 bp, Mus musculus
cactggtgtctatctaagcgcctcg

SEQ ID NO: 562040 - DNA, 25 bp, Mus musculus
cactggtgtttactatcctggcatg

SEQ ID NO: 562041 - DNA, 25 bp, Mus musculus
cactggtgtttagtatcctggcatg

SEQ ID NO: 562042 - DNA, 25 bp, Mus musculus
cactggttataactcatcattgcgg

SEQ ID NO: 562043 - DNA, 25 bp, Mus musculus
cactggttataagtcatcattgcgg

SEQ ID NO: 562044 - DNA, 25 bp, Mus musculus
cactggttgcccaccttgtccttgg

SEQ ID NO: 562045 - DNA, 25 bp, Mus musculus
cactggttgccctccttgtccttgg

SEQ ID NO: 562046 - DNA, 25 bp, Mus musculus
cactggttgtcaatggccagtctac

SEQ ID NO: 562047 - DNA, 25 bp, Mus musculus
cactggttgtcattggccagtctac

SEQ ID NO: 562048 - DNA, 25 bp, Mus musculus
cactggtttcctaaccctggtcagg

SEQ ID NO: 562049 - DNA, 25 bp, Mus musculus
cactggtttccttaccctggtcagg

SEQ ID NO: 562050 - DNA, 25 bp, Mus musculus
cactgtaaagaacgagccgcatgaa

SEQ ID NO: 562051 - DNA, 25 bp, Mus musculus
cactgtaaagaaggagccgcatgaa

SEQ ID NO: 562052 - DNA, 25 bp, Mus musculus
cactgtaatactcagctctatggaa

SEQ ID NO: 562053 - DNA, 25 bp, Mus musculus
cactgtaatactgagctctatggaa

SEQ ID NO: 562054 - DNA, 25 bp, Mus musculus
cactgtaattctagctgtcgaaagc

SEQ ID NO: 562055 - DNA, 25 bp, Mus musculus
cactgtaattcttgctgtcgaaagc

SEQ ID NO: 562056 - DNA, 25 bp, Mus musculus
cactgtacagaaagccgaggcctac

SEQ ID NO: 562057 - DNA, 25 bp, Mus musculus
cactgtacagaatgccgaggcctac

SEQ ID NO: 562058 - DNA, 25 bp, Mus musculus
cactgtacagtccacataacttaaa

SEQ ID NO: 562059 - DNA, 25 bp, Mus musculus
cactgtacagtcgacataacttaaa

SEQ ID NO: 562060 - DNA, 25 bp, Mus musculus
cactgtacatggaggaacaccagga

SEQ ID NO: 562061 - DNA, 25 bp, Mus musculus
cactgtacatggtggaacaccagga

SEQ ID NO: 562062 - DNA, 25 bp, Mus musculus
cactgtacgctaatcctgtttgcta

SEQ ID NO: 562063 - DNA, 25 bp, Mus musculus
cactgtacgctattcctgtttgcta

SEQ ID NO: 562064 - DNA, 25 bp, Mus musculus
cactgtactgacacggccagaggtc

SEQ ID NO: 562065 - DNA, 25 bp, Mus musculus
cactgtactgactcggccagaggtc

SEQ ID NO: 562066 - DNA, 25 bp, Mus musculus
cactgtacttggctgatggctacgt

SEQ ID NO: 562067 - DNA, 25 bp, Mus musculus
cactgtacttgggtgatggctacgt

SEQ ID NO: 562068 - DNA, 25 bp, Mus musculus
cactgtaggcatcccattctgatga

SEQ ID NO: 562069 - DNA, 25 bp, Mus musculus
cactgtaggcatgccattctgatga

SEQ ID NO: 562070 - DNA, 25 bp, Mus musculus
cactgtagttgaatgcagggaaacc

SEQ ID NO: 562071 - DNA, 25 bp, Mus musculus
cactgtagttgattgcagggaaacc

SEQ ID NO: 562072 - DNA, 25 bp, Mus musculus
cactgtatgatcaggtgcacccaga

SEQ ID NO: 562073 - DNA, 25 bp, Mus musculus
cactgtatgatctggtgcacccaga

SEQ ID NO: 562074 - DNA, 25 bp, Mus musculus
cactgtatgcctcgtagatgctgac

SEQ ID NO: 562075 - DNA, 25 bp, Mus musculus
cactgtatgcctggtagatgctgac

SEQ ID NO: 562076 - DNA, 25 bp, Mus musculus
cactgtatggctaccatgctcagga

SEQ ID NO: 562077 - DNA, 25 bp, Mus musculus
cactgtatggcttccatgctcagga

SEQ ID NO: 562078 - DNA, 25 bp, Mus musculus
cactgtattcctcgagtggtctcca

SEQ ID NO: 562079 - DNA, 25 bp, Mus musculus
cactgtattcctggagtggtctcca

SEQ ID NO: 562080 - DNA, 25 bp, Mus musculus
cactgtcaagaaagtcccggtgtga

SEQ ID NO: 562081 - DNA, 25 bp, Mus musculus
cactgtcaagaatgtcccggtgtga

SEQ ID NO: 562082 - DNA, 25 bp, Mus musculus
cactgtcaatgtcccctggaatggg

SEQ ID NO: 562083 - DNA, 25 bp, Mus musculus
cactgtcaatgtgccctggaatggg

SEQ ID NO: 562084 - DNA, 25 bp, Mus musculus
cactgtcaccagacctgtggcaaaa

SEQ ID NO: 562085 - DNA, 25 bp, Mus musculus
cactgtcaccagtcctgtggcaaaa

SEQ ID NO: 562086 - DNA, 25 bp, Mus musculus
cactgtcaccgtctgtcgtcagcag

SEQ ID NO: 562087 - DNA, 25 bp, Mus musculus
cactgtcaccgtgtgtcgtcagcag

SEQ ID NO: 562088 - DNA, 25 bp, Mus musculus
cactgtcactggaggtgcctggtac

SEQ ID NO: 562089 - DNA, 25 bp, Mus musculus
cactgtcactggtggtgcctggtac

SEQ ID NO: 562090 - DNA, 25 bp, Mus musculus
cactgtcaggcaagtggatccactt

SEQ ID NO: 562091 - DNA, 25 bp, Mus musculus
cactgtcaggcatgtggatccactt

SEQ ID NO: 562092 - DNA, 25 bp, Mus musculus
cactgtcagtagcactgtggtggac

SEQ ID NO: 562093 - DNA, 25 bp, Mus musculus
cactgtcagtaggactgtggtggac

SEQ ID NO: 562094 - DNA, 25 bp, Mus musculus
cactgtcagtatatagcaaacatct

SEQ ID NO: 562095 - DNA, 25 bp, Mus musculus
cactgtcagtatttagcaaacatct

SEQ ID NO: 562096 - DNA, 25 bp, Mus musculus
cactgtcattaaacaagctgtacaa

SEQ ID NO: 562097 - DNA, 25 bp, Mus musculus
cactgtcattaatcaagctgtacaa

SEQ ID NO: 562098 - DNA, 25 bp, Mus musculus
cactgtccaaggaagccggtgaaga

SEQ ID NO: 562099 - DNA, 25 bp, Mus musculus
cactgtccaaggtagccggtgaaga

SEQ ID NO: 562100 - DNA, 25 bp, Mus musculus
cactgtccagccagcaggttgcaga

SEQ ID NO: 562101 - DNA, 25 bp, Mus musculus
cactgtccagcctgcaggttgcaga

SEQ ID NO: 562102 - DNA, 25 bp, Mus musculus
cactgtcccaatcagtcctttctga

SEQ ID NO: 562103 - DNA, 25 bp, Mus musculus
cactgtcccaatgagtcctttctga

SEQ ID NO: 562104 - DNA, 25 bp, Mus musculus
cactgtcccattagactttggagaa

SEQ ID NO: 562105 - DNA, 25 bp, Mus musculus
cactgtcccatttgactttggagaa

SEQ ID NO: 562106 - DNA, 25 bp, Mus musculus
cactgtccccggacactgagggaca

SEQ ID NO: 562107 - DNA, 25 bp, Mus musculus
cactgtccccggtcactgagggaca

SEQ ID NO: 562108 - DNA, 25 bp, Mus musculus
cactgtccgaaaagttgcccggtgt

SEQ ID NO: 562109 - DNA, 25 bp, Mus musculus
cactgtccgaaatgttgcccggtgt

SEQ ID NO: 562110 - DNA, 25 bp, Mus musculus
cactgtccgccacccggtggatgtg

SEQ ID NO: 562111 - DNA, 25 bp, Mus musculus
cactgtccgccagccggtggatgtg

SEQ ID NO: 562112 - DNA, 25 bp, Mus musculus
cactgtcctacaagacgttcttaat

SEQ ID NO: 562113 - DNA, 25 bp, Mus musculus
cactgtcctacatgacgttcttaat

SEQ ID NO: 562114 - DNA, 25 bp, Mus musculus
cactgtcctactagatgctgggtac

SEQ ID NO: 562115 - DNA, 25 bp, Mus musculus
cactgtcctacttgatgctgggtac

SEQ ID NO: 562116 - DNA, 25 bp, Mus musculus
cactgtcctctcagattatgtgggc

SEQ ID NO: 562117 - DNA, 25 bp, Mus musculus
cactgtcctctctgattatgtgggc

SEQ ID NO: 562118 - DNA, 25 bp, Mus musculus
cactgtccttggacaggtacatcct

SEQ ID NO: 562119 - DNA, 25 bp, Mus musculus
cactgtccttggtcaggtacatcct

SEQ ID NO: 562120 - DNA, 25 bp, Mus musculus
cactgtcgctcaaccagggcctggt

SEQ ID NO: 562121 - DNA, 25 bp, Mus musculus
cactgtcgctcatccagggcctggt

SEQ ID NO: 562122 - DNA, 25 bp, Mus musculus
cactgtcgctgtcgaccaggtggat

SEQ ID NO: 562123 - DNA, 25 bp, Mus musculus
cactgtcgctgtggaccaggtggat

SEQ ID NO: 562124 - DNA, 25 bp, Mus musculus
cactgtcgtgggagtattgccgcct

SEQ ID NO: 562125 - DNA, 25 bp, Mus musculus
cactgtcgtgggtgtattgccgcct

SEQ ID NO: 562126 - DNA, 25 bp, Mus musculus
cactgtctaagcctgtggtggtagt

SEQ ID NO: 562127 - DNA, 25 bp, Mus musculus
cactgtctaagcgtgtggtggtagt

SEQ ID NO: 562128 - DNA, 25 bp, Mus musculus
cactgtctatatcatcttccgattc

SEQ ID NO: 562129 - DNA, 25 bp, Mus musculus
cactgtctatatgatcttccgattc

SEQ ID NO: 562130 - DNA, 25 bp, Mus musculus
cactgtctatgtatgggaacattcg

SEQ ID NO: 562131 - DNA, 25 bp, Mus musculus
cactgtctatgtttgggaacattcg

SEQ ID NO: 562132 - DNA, 25 bp, Mus musculus
cactgtctgtccatgtgatggtgcc

SEQ ID NO: 562133 - DNA, 25 bp, Mus musculus
cactgtctgtccttgtgatggtgcc

SEQ ID NO: 562134 - DNA, 25 bp, Mus musculus
cactgtcttctgctatcaggaagcc

SEQ ID NO: 562135 - DNA, 25 bp, Mus musculus
cactgtcttctggtatcaggaagcc

SEQ ID NO: 562136 - DNA, 25 bp, Mus musculus
cactgtcttttgagcgggaagcttc

SEQ ID NO: 562137 - DNA, 25 bp, Mus musculus
cactgtcttttgtgcgggaagcttc

SEQ ID NO: 562138 - DNA, 25 bp, Mus musculus
cactgtgaagttccgctgtccggct

SEQ ID NO: 562139 - DNA, 25 bp, Mus musculus
cactgtgaagttgcgctgtccggct

SEQ ID NO: 562140 - DNA, 25 bp, Mus musculus
cactgtgacaacagtactggcccgt

SEQ ID NO: 562141 - DNA, 25 bp, Mus musculus
cactgtgacaactgtactggcccgt

SEQ ID NO: 562142 - DNA, 25 bp, Mus musculus
cactgtgacctcaggcgccattgct

SEQ ID NO: 562143 - DNA, 25 bp, Mus musculus
cactgtgacctctggcgccattgct

SEQ ID NO: 562144 - DNA, 25 bp, Mus musculus
cactgtgacgttcaggagacctgcg

SEQ ID NO: 562145 - DNA, 25 bp, Mus musculus
cactgtgacgttgaggagacctgcg

SEQ ID NO: 562146 - DNA, 25 bp, Mus musculus
cactgtgactcaaggatccgaatta

SEQ ID NO: 562147 - DNA, 25 bp, Mus musculus
cactgtgactcatggatccgaatta

SEQ ID NO: 562148 - DNA, 25 bp, Mus musculus
cactgtgactctagagcactctcca

SEQ ID NO: 562149 - DNA, 25 bp, Mus musculus
cactgtgactcttgagcactctcca

SEQ ID NO: 562150 - DNA, 25 bp, Mus musculus
cactgtgagcgaaaacaaccctgag

SEQ ID NO: 562151 - DNA, 25 bp, Mus musculus
cactgtgagcgataacaaccctgag

SEQ ID NO: 562152 - DNA, 25 bp, Mus musculus
cactgtgaggagattccatcacgaa

SEQ ID NO: 562153 - DNA, 25 bp, Mus musculus
cactgtgaggagtttccatcacgaa

SEQ ID NO: 562154 - DNA, 25 bp, Mus musculus
cactgtgagggacgcccatggcctc

SEQ ID NO: 562155 - DNA, 25 bp, Mus musculus
cactgtgagggaggcccatggcctc

SEQ ID NO: 562156 - DNA, 25 bp, Mus musculus
cactgtgagtctaccatcgtgatcg

SEQ ID NO: 562157 - DNA, 25 bp, Mus musculus
cactgtgagtcttccatcgtgatcg

SEQ ID NO: 562158 - DNA, 25 bp, Mus musculus
cactgtgatccccaattagccgtga

SEQ ID NO: 562159 - DNA, 25 bp, Mus musculus
cactgtgatcccgaattagccgtga

SEQ ID NO: 562160 - DNA, 25 bp, Mus musculus
cactgtgcagaaaacgagatcctca

SEQ ID NO: 562161 - DNA, 25 bp, Mus musculus
cactgtgcagaatacgagatcctca

SEQ ID NO: 562162 - DNA, 25 bp, Mus musculus
cactgtgcatctagacattctctgc

SEQ ID NO: 562163 - DNA, 25 bp, Mus musculus
cactgtgcatcttgacattctctgc

SEQ ID NO: 562164 - DNA, 25 bp, Mus musculus
cactgtgcatggcagagttccccag

SEQ ID NO: 562165 - DNA, 25 bp, Mus musculus
cactgtgcatgggagagttccccag

SEQ ID NO: 562166 - DNA, 25 bp, Mus musculus
cactgtgcccgtccagatgccaaag

SEQ ID NO: 562167 - DNA, 25 bp, Mus musculus
cactgtgcccgtgcagatgccaaag

SEQ ID NO: 562168 - DNA, 25 bp, Mus musculus
cactgtgcgcgacacgttgcgatac

SEQ ID NO: 562169 - DNA, 25 bp, Mus musculus
cactgtgcgcgagacgttgcgatac

SEQ ID NO: 562170 - DNA, 25 bp, Mus musculus
cactgtgctcacagacatgtggttt

SEQ ID NO: 562171 - DNA, 25 bp, Mus musculus
cactgtgctcactgacatgtggttt

SEQ ID NO: 562172 - DNA, 25 bp, Mus musculus
cactgtgctgccatgaaagttttca

SEQ ID NO: 562173 - DNA, 25 bp, Mus musculus
cactgtgctgccttgaaagttttca

SEQ ID NO: 562174 - DNA, 25 bp, Mus musculus
cactgtgctggacgccccagtttgt

SEQ ID NO: 562175 - DNA, 25 bp, Mus musculus
cactgtgctggaggccccagtttgt

SEQ ID NO: 562176 - DNA, 25 bp, Mus musculus
cactgtgctgttcaagaatttcccc

SEQ ID NO: 562177 - DNA, 25 bp, Mus musculus
cactgtgctgttgaagaatttcccc

SEQ ID NO: 562178 - DNA, 25 bp, Mus musculus
cactgtggaatgagatagaaaggct

SEQ ID NO: 562179 - DNA, 25 bp, Mus musculus
cactgtggaatgtgatagaaaggct

SEQ ID NO: 562180 - DNA, 25 bp, Mus musculus
cactgtggactacagaacgtcctta

SEQ ID NO: 562181 - DNA, 25 bp, Mus musculus
cactgtggactagagaacgtcctta

SEQ ID NO: 562182 - DNA, 25 bp, Mus musculus
cactgtggagaactggtaccagccc

SEQ ID NO: 562183 - DNA, 25 bp, Mus musculus
cactgtggagaagtggtaccagccc

SEQ ID NO: 562184 - DNA, 25 bp, Mus musculus
cactgtggagtacaaggagctaccc

SEQ ID NO: 562185 - DNA, 25 bp, Mus musculus
cactgtggagtagaaggagctaccc

SEQ ID NO: 562186 - DNA, 25 bp, Mus musculus
cactgtggatgacaaaatactgaat

SEQ ID NO: 562187 - DNA, 25 bp, Mus musculus
cactgtggatgagaaaatactgaat

SEQ ID NO: 562188 - DNA, 25 bp, Mus musculus
cactgtggcagcaccaatagccagg

SEQ ID NO: 562189 - DNA, 25 bp, Mus musculus
cactgtggcagcaggtctggatcga

SEQ ID NO: 562190 - DNA, 25 bp, Mus musculus
cactgtggcagctccaatagccagg

SEQ ID NO: 562191 - DNA, 25 bp, Mus musculus
cactgtggcagctggtctggatcga

SEQ ID NO: 562192 - DNA, 25 bp, Mus musculus
cactgtggcagtagttgtttatgat

SEQ ID NO: 562193 - DNA, 25 bp, Mus musculus
cactgtggcagttgttgtttatgat

SEQ ID NO: 562194 - DNA, 25 bp, Mus musculus
cactgtggccacaaaagagactgag

SEQ ID NO: 562195 - DNA, 25 bp, Mus musculus
cactgtggccactaaagagactgag

SEQ ID NO: 562196 - DNA, 25 bp, Mus musculus
cactgtggcccacagtgaggctttt

SEQ ID NO: 562197 - DNA, 25 bp, Mus musculus
cactgtggcccacgtggatgataac

SEQ ID NO: 562198 - DNA, 25 bp, Mus musculus
cactgtggcccagagtgaggctttt

SEQ ID NO: 562199 - DNA, 25 bp, Mus musculus
cactgtggcccaggtggatgataac

SEQ ID NO: 562200 - DNA, 25 bp, Mus musculus
cactgtggctagaaacccaaagggc

SEQ ID NO: 562201 - DNA, 25 bp, Mus musculus
cactgtggctagtaacccaaagggc

SEQ ID NO: 562202 - DNA, 25 bp, Mus musculus
cactgtgggcccagcgtatgggcaa

SEQ ID NO: 562203 - DNA, 25 bp, Mus musculus
cactgtgggccctgcgtatgggcaa

SEQ ID NO: 562204 - DNA, 25 bp, Mus musculus
cactgtgggttgcattcgccaagtt

SEQ ID NO: 562205 - DNA, 25 bp, Mus musculus
cactgtgggttggattcgccaagtt

SEQ ID NO: 562206 - DNA, 25 bp, Mus musculus
cactgtggtgaaccgatggatgtac

SEQ ID NO: 562207 - DNA, 25 bp, Mus musculus
cactgtggtgaagcgatggatgtac

SEQ ID NO: 562208 - DNA, 25 bp, Mus musculus
cactgtggtgttccatggatatgag

SEQ ID NO: 562209 - DNA, 25 bp, Mus musculus
cactgtggtgttgcatggatatgag

SEQ ID NO: 562210 - DNA, 25 bp, Mus musculus
cactgtgtacaacggcaagtggcat

SEQ ID NO: 562211 - DNA, 25 bp, Mus musculus
cactgtgtacaagggcaagtggcat

SEQ ID NO: 562212 - DNA, 25 bp, Mus musculus
cactgtgtcatccatgagcggactg

SEQ ID NO: 562213 - DNA, 25 bp, Mus musculus
cactgtgtcatcgatgagcggactg

SEQ ID NO: 562214 - DNA, 25 bp, Mus musculus
cactgtgtccagatttagcataaag

SEQ ID NO: 562215 - DNA, 25 bp, Mus musculus
cactgtgtccagttttagcataaag

SEQ ID NO: 562216 - DNA, 25 bp, Mus musculus
cactgtgtgaacacgccaggttcct

SEQ ID NO: 562217 - DNA, 25 bp, Mus musculus
cactgtgtgaactcgccaggttcct

SEQ ID NO: 562218 - DNA, 25 bp, Mus musculus
cactgtgtgactatgcccaggtccc

SEQ ID NO: 562219 - DNA, 25 bp, Mus musculus
cactgtgtgactttgcccaggtccc

SEQ ID NO: 562220 - DNA, 25 bp, Mus musculus
cactgtgtgcagatcatctgtttca

SEQ ID NO: 562221 - DNA, 25 bp, Mus musculus
cactgtgtgcagttcatctgtttca

SEQ ID NO: 562222 - DNA, 25 bp, Mus musculus
cactgtgtgcatagacttgctcatc

SEQ ID NO: 562223 - DNA, 25 bp, Mus musculus
cactgtgtgcattgacttgctcatc

SEQ ID NO: 562224 - DNA, 25 bp, Mus musculus
cactgtgtgctgactgaacattcgt

SEQ ID NO: 562225 - DNA, 25 bp, Mus musculus
cactgtgtgctgtctgaacattcgt

SEQ ID NO: 562226 - DNA, 25 bp, Mus musculus
cactgtgtggccactagatgccagc

SEQ ID NO: 562227 - DNA, 25 bp, Mus musculus
cactgtgtggcctctagatgccagc

SEQ ID NO: 562228 - DNA, 25 bp, Mus musculus
cactgtgtggtaagagctgctcctc

SEQ ID NO: 562229 - DNA, 25 bp, Mus musculus
cactgtgtggtatgagctgctcctc

SEQ ID NO: 562230 - DNA, 25 bp, Mus musculus
cactgtgtgtccaccagaagcggct

SEQ ID NO: 562231 - DNA, 25 bp, Mus musculus
cactgtgtgtcctccagaagcggct

SEQ ID NO: 562232 - DNA, 25 bp, Mus musculus
cactgtgtgtcgactgctactcaac

SEQ ID NO: 562233 - DNA, 25 bp, Mus musculus
cactgtgtgtcgtctgctactcaac

SEQ ID NO: 562234 - DNA, 25 bp, Mus musculus
cactgtgtgtctcctcccggggaac

SEQ ID NO: 562235 - DNA, 25 bp, Mus musculus
cactgtgtgtctcgagcggatggac

SEQ ID NO: 562236 - DNA, 25 bp, Mus musculus
cactgtgtgtctgctcccggggaac

SEQ ID NO: 562237 - DNA, 25 bp, Mus musculus
cactgtgtgtctggagcggatggac

SEQ ID NO: 562238 - DNA, 25 bp, Mus musculus
cactgtgtgtgaatgggagattcga

SEQ ID NO: 562239 - DNA, 25 bp, Mus musculus
cactgtgtgtgattgggagattcga

SEQ ID NO: 562240 - DNA, 25 bp, Mus musculus
cactgtgtgtggcaaccatggcttc

SEQ ID NO: 562241 - DNA, 25 bp, Mus musculus
cactgtgtgtgggaaccatggcttc

SEQ ID NO: 562242 - DNA, 25 bp, Mus musculus
cactgtgtgtgtctccaagccctga

SEQ ID NO: 562243 - DNA, 25 bp, Mus musculus
cactgtgtgtgtgtccaagccctga

SEQ ID NO: 562244 - DNA, 25 bp, Mus musculus
cactgtgtttcgcatgggttccgag

SEQ ID NO: 562245 - DNA, 25 bp, Mus musculus
cactgtgtttcggatgggttccgag

SEQ ID NO: 562246 - DNA, 25 bp, Mus musculus
cactgttaatgaagattcaggatcg

SEQ ID NO: 562247 - DNA, 25 bp, Mus musculus
cactgttaatgatgattcaggatcg

SEQ ID NO: 562248 - DNA, 25 bp, Mus musculus
cactgttaattcactgccctttgga

SEQ ID NO: 562249 - DNA, 25 bp, Mus musculus
cactgttaattctctgccctttgga

SEQ ID NO: 562250 - DNA, 25 bp, Mus musculus
cactgttaccatcttggcactctgg

SEQ ID NO: 562251 - DNA, 25 bp, Mus musculus
cactgttaccatgttggcactctgg

SEQ ID NO: 562252 - DNA, 25 bp, Mus musculus
cactgttaccgactctacacgaaac

SEQ ID NO: 562253 - DNA, 25 bp, Mus musculus
cactgttaccgagtctacacgaaac

SEQ ID NO: 562254 - DNA, 25 bp, Mus musculus
cactgttagaaccattgagtaggac

SEQ ID NO: 562255 - DNA, 25 bp, Mus musculus
cactgttagaacgattgagtaggac

SEQ ID NO: 562256 - DNA, 25 bp, Mus musculus
cactgttaggaacgcaagccctcct

SEQ ID NO: 562257 - DNA, 25 bp, Mus musculus
cactgttaggaaggcaagccctcct

SEQ ID NO: 562258 - DNA, 25 bp, Mus musculus
cactgttagtgtaggtcactgccac

SEQ ID NO: 562259 - DNA, 25 bp, Mus musculus
cactgttagtgttggtcactgccac

SEQ ID NO: 562260 - DNA, 25 bp, Mus musculus
cactgttagtttctggcaccaaaga

SEQ ID NO: 562261 - DNA, 25 bp, Mus musculus
cactgttagtttgtggcaccaaaga

SEQ ID NO: 562262 - DNA, 25 bp, Mus musculus
cactgttcactgcttcagggttcct

SEQ ID NO: 562263 - DNA, 25 bp, Mus musculus
cactgttcactggttcagggttcct

SEQ ID NO: 562264 - DNA, 25 bp, Mus musculus
cactgttcagttcttcttggtggcc

SEQ ID NO: 562265 - DNA, 25 bp, Mus musculus
cactgttcagttgttcttggtggcc

SEQ ID NO: 562266 - DNA, 25 bp, Mus musculus
cactgttcatggcaggaggtcaacg

SEQ ID NO: 562267 - DNA, 25 bp, Mus musculus
cactgttcatgggaggaggtcaacg

SEQ ID NO: 562268 - DNA, 25 bp, Mus musculus
cactgttgagagagggtttggcacc

SEQ ID NO: 562269 - DNA, 25 bp, Mus musculus
cactgttgagagtgggtttggcacc

SEQ ID NO: 562270 - DNA, 25 bp, Mus musculus
cactgttgagctcggagagtagccc

SEQ ID NO: 562271 - DNA, 25 bp, Mus musculus
cactgttgagctgggagagtagccc

SEQ ID NO: 562272 - DNA, 25 bp, Mus musculus
cactgttgccagaattatcttctgt

SEQ ID NO: 562273 - DNA, 25 bp, Mus musculus
cactgttgccagtattatcttctgt

SEQ ID NO: 562274 - DNA, 25 bp, Mus musculus
cactgttggaggacacaactgtgtc

SEQ ID NO: 562275 - DNA, 25 bp, Mus musculus
cactgttggaggtcacaactgtgtc

SEQ ID NO: 562276 - DNA, 25 bp, Mus musculus
cactgttgtcccattgtctctcaaa

SEQ ID NO: 562277 - DNA, 25 bp, Mus musculus
cactgttgtccctttgtctctcaaa

SEQ ID NO: 562278 - DNA, 25 bp, Mus musculus
cactgttgtgatacaaaccttgggt

SEQ ID NO: 562279 - DNA, 25 bp, Mus musculus
cactgttgtgattcaaaccttgggt

SEQ ID NO: 562280 - DNA, 25 bp, Mus musculus
cactgttgtgctcctggaacgggac

SEQ ID NO: 562281 - DNA, 25 bp, Mus musculus
cactgttgtgctgctggaacgggac

SEQ ID NO: 562282 - DNA, 25 bp, Mus musculus
cactgttgttctaagtgctctgcag

SEQ ID NO: 562283 - DNA, 25 bp, Mus musculus
cactgttgttcttagtgctctgcag

SEQ ID NO: 562284 - DNA, 25 bp, Mus musculus
cactgtttatggactgggattctcc

SEQ ID NO: 562285 - DNA, 25 bp, Mus musculus
cactgtttatggtctgggattctcc

SEQ ID NO: 562286 - DNA, 25 bp, Mus musculus
cactgtttgagcctgtgcctcttga

SEQ ID NO: 562287 - DNA, 25 bp, Mus musculus
cactgtttgagcgtgtgcctcttga

SEQ ID NO: 562288 - DNA, 25 bp, Mus musculus
cactgtttgagtcgccgtggctaag

SEQ ID NO: 562289 - DNA, 25 bp, Mus musculus
cactgtttgagtggccgtggctaag

SEQ ID NO: 562290 - DNA, 25 bp, Mus musculus
cactgtttgcaaaggttgccgccac

SEQ ID NO: 562291 - DNA, 25 bp, Mus musculus
cactgtttgcaatggttgccgccac

SEQ ID NO: 562292 - DNA, 25 bp, Mus musculus
cactgtttgcctagaaagccagaag

SEQ ID NO: 562293 - DNA, 25 bp, Mus musculus
cactgtttgccttgaaagccagaag

SEQ ID NO: 562294 - DNA, 25 bp, Mus musculus
cactgtttgcttacttgagaagtcg

SEQ ID NO: 562295 - DNA, 25 bp, Mus musculus
cactgtttgctttcttgagaagtcg

SEQ ID NO: 562296 - DNA, 25 bp, Mus musculus
cactgtttttcacattggatcagag

SEQ ID NO: 562297 - DNA, 25 bp, Mus musculus
cactgtttttcagattggatcagag

SEQ ID NO: 562298 - DNA, 25 bp, Mus musculus
cacttaacaggtcccgctctggtga

SEQ ID NO: 562299 - DNA, 25 bp, Mus musculus
cacttaacaggtgccgctctggtga

SEQ ID NO: 562300 - DNA, 25 bp, Mus musculus
cacttaaccccacagtgaaaactcg

SEQ ID NO: 562301 - DNA, 25 bp, Mus musculus
cacttaaccccagagtgaaaactcg

SEQ ID NO: 562302 - DNA, 25 bp, Mus musculus
cacttaacccctactacaatgagtc

SEQ ID NO: 562303 - DNA, 25 bp, Mus musculus
cacttaaccccttctacaatgagtc

SEQ ID NO: 562304 - DNA, 25 bp, Mus musculus
cacttaagaatcatgtctctgcatc

SEQ ID NO: 562305 - DNA, 25 bp, Mus musculus
cacttaagaatcttgtctctgcatc

SEQ ID NO: 562306 - DNA, 25 bp, Mus musculus
cacttaaggatgacacaattggcac

SEQ ID NO: 562307 - DNA, 25 bp, Mus musculus
cacttaaggatgtcacaattggcac

SEQ ID NO: 562308 - DNA, 25 bp, Mus musculus
cacttaatgccgctgcttactccaa

SEQ ID NO: 562309 - DNA, 25 bp, Mus musculus
cacttaatgccggtgcttactccaa

SEQ ID NO: 562310 - DNA, 25 bp, Mus musculus
cacttacactggagtctgcccagat

SEQ ID NO: 562311 - DNA, 25 bp, Mus musculus
cacttacactggtgtctgcccagat

SEQ ID NO: 562312 - DNA, 25 bp, Mus musculus
cacttaccagcaccgtttggaagcc

SEQ ID NO: 562313 - DNA, 25 bp, Mus musculus
cacttaccagcagcgtttggaagcc

SEQ ID NO: 562314 - DNA, 25 bp, Mus musculus
cacttaccttagctctgccttcagg

SEQ ID NO: 562315 - DNA, 25 bp, Mus musculus
cacttaccttaggtctgccttcagg

SEQ ID NO: 562316 - DNA, 25 bp, Mus musculus
cacttacgaaagcatggaggccatg

SEQ ID NO: 562317 - DNA, 25 bp, Mus musculus
cacttacgaaaggatggaggccatg

SEQ ID NO: 562318 - DNA, 25 bp, Mus musculus
cacttacgtagtcatggagcaggct

SEQ ID NO: 562319 - DNA, 25 bp, Mus musculus
cacttacgtagtgatggagcaggct

SEQ ID NO: 562320 - DNA, 25 bp, Mus musculus
cacttacgtttgcagcgagagatgt

SEQ ID NO: 562321 - DNA, 25 bp, Mus musculus
cacttacgtttggagcgagagatgt

SEQ ID NO: 562322 - DNA, 25 bp, Mus musculus
cacttactccaaagggaagactcca

SEQ ID NO: 562323 - DNA, 25 bp, Mus musculus
cacttactccaatgggaagactcca

SEQ ID NO: 562324 - DNA, 25 bp, Mus musculus
cacttactgccacaacatcaaggag

SEQ ID NO: 562325 - DNA, 25 bp, Mus musculus
cacttactgccagaacatcaaggag

SEQ ID NO: 562326 - DNA, 25 bp, Mus musculus
cacttactggtgaacacaatagcat

SEQ ID NO: 562327 - DNA, 25 bp, Mus musculus
cacttactggtgtacacaatagcat

SEQ ID NO: 562328 - DNA, 25 bp, Mus musculus
cacttacttgatccaaaccagtggg

SEQ ID NO: 562329 - DNA, 25 bp, Mus musculus
cacttacttgatgcaaaccagtggg

SEQ ID NO: 562330 - DNA, 25 bp, Mus musculus
cacttactttggctggtgtggatcc

SEQ ID NO: 562331 - DNA, 25 bp, Mus musculus
cacttactttgggtggtgtggatcc

SEQ ID NO: 562332 - DNA, 25 bp, Mus musculus
cacttactttttacttgctgaaagg

SEQ ID NO: 562333 - DNA, 25 bp, Mus musculus
cacttacttttttcttgctgaaagg

SEQ ID NO: 562334 - DNA, 25 bp, Mus musculus
cacttaggcttgactcctgggttaa

SEQ ID NO: 562335 - DNA, 25 bp, Mus musculus
cacttaggcttgtctcctgggttaa

SEQ ID NO: 562336 - DNA, 25 bp, Mus musculus
cacttaggtagtcccagaactgggc

SEQ ID NO: 562337 - DNA, 25 bp, Mus musculus
cacttaggtagtgccagaactgggc

SEQ ID NO: 562338 - DNA, 25 bp, Mus musculus
cacttagtaattatcgtcggagcac

SEQ ID NO: 562339 - DNA, 25 bp, Mus musculus
cacttagtaattttcgtcggagcac

SEQ ID NO: 562340 - DNA, 25 bp, Mus musculus
cacttagtggcaaatggctgtcacc

SEQ ID NO: 562341 - DNA, 25 bp, Mus musculus
cacttagtggcatatggctgtcacc

SEQ ID NO: 562342 - DNA, 25 bp, Mus musculus
cacttagttggtcgactgattggca

SEQ ID NO: 562343 - DNA, 25 bp, Mus musculus
cacttagttggtggactgattggca

SEQ ID NO: 562344 - DNA, 25 bp, Mus musculus
cacttatccagacaagaagtccatc

SEQ ID NO: 562345 - DNA, 25 bp, Mus musculus
cacttatccagagaagaagtccatc

SEQ ID NO: 562346 - DNA, 25 bp, Mus musculus
cacttatcgtgtcggcaacgcccag

SEQ ID NO: 562347 - DNA, 25 bp, Mus musculus
cacttatcgtgtgggcaacgcccag

SEQ ID NO: 562348 - DNA, 25 bp, Mus musculus
cacttatctacacagagacataccc

SEQ ID NO: 562349 - DNA, 25 bp, Mus musculus
cacttatctacagagagacataccc

SEQ ID NO: 562350 - DNA, 25 bp, Mus musculus
cacttatgggagatcatccgagaca

SEQ ID NO: 562351 - DNA, 25 bp, Mus musculus
cacttatgggagttcatccgagaca

SEQ ID NO: 562352 - DNA, 25 bp, Mus musculus
cacttatgtactctgtgttggcaga

SEQ ID NO: 562353 - DNA, 25 bp, Mus musculus
cacttatgtactgtgtgttggcaga

SEQ ID NO: 562354 - DNA, 25 bp, Mus musculus
cacttattatggagaggcagcccag

SEQ ID NO: 562355 - DNA, 25 bp, Mus musculus
cacttattatggtgaggcagcccag

SEQ ID NO: 562356 - DNA, 25 bp, Mus musculus
cacttattattgagtggcctcagga

SEQ ID NO: 562357 - DNA, 25 bp, Mus musculus
cacttattattgtgtggcctcagga

SEQ ID NO: 562358 - DNA, 25 bp, Mus musculus
cacttattcatacgcctttcagaga

SEQ ID NO: 562359 - DNA, 25 bp, Mus musculus
cacttattcataggcctttcagaga

SEQ ID NO: 562360 - DNA, 25 bp, Mus musculus
cacttattttgccaacctgtggaag

SEQ ID NO: 562361 - DNA, 25 bp, Mus musculus
cacttattttgcgaacctgtggaag

SEQ ID NO: 562362 - DNA, 25 bp, Mus musculus
cacttcaaaaggcaagattgcctac

SEQ ID NO: 562363 - DNA, 25 bp, Mus musculus
cacttcaaaagggaagattgcctac

SEQ ID NO: 562364 - DNA, 25 bp, Mus musculus
cacttcaaatatctaggcaccaagc

SEQ ID NO: 562365 - DNA, 25 bp, Mus musculus
cacttcaaatatgtaggcaccaagc

SEQ ID NO: 562366 - DNA, 25 bp, Mus musculus
cacttcaagatacaaaagtgagaag

SEQ ID NO: 562367 - DNA, 25 bp, Mus musculus
cacttcaagatagaaaagtgagaag

SEQ ID NO: 562368 - DNA, 25 bp, Mus musculus
cacttcaagcggatgagggtcatac

SEQ ID NO: 562369 - DNA, 25 bp, Mus musculus
cacttcaagcggttgagggtcatac

SEQ ID NO: 562370 - DNA, 25 bp, Mus musculus
cacttcaaggaaacccagtttgagc

SEQ ID NO: 562371 - DNA, 25 bp, Mus musculus
cacttcaaggaatcccagtttgagc

SEQ ID NO: 562372 - DNA, 25 bp, Mus musculus
cacttcagagatcagatagcagcct

SEQ ID NO: 562373 - DNA, 25 bp, Mus musculus
cacttcagagatgagatagcagcct

SEQ ID NO: 562374 - DNA, 25 bp, Mus musculus
cacttcagggctcaacagtttcaac

SEQ ID NO: 562375 - DNA, 25 bp, Mus musculus
cacttcagggctgaacagtttcaac

SEQ ID NO: 562376 - DNA, 25 bp, Mus musculus
cacttcagtgccaactgggtcgtgg

SEQ ID NO: 562377 - DNA, 25 bp, Mus musculus
cacttcagtgcctactgggtcgtgg

SEQ ID NO: 562378 - DNA, 25 bp, Mus musculus
cacttccaagagacgtggctcgcag

SEQ ID NO: 562379 - DNA, 25 bp, Mus musculus
cacttccaagagtcgtggctcgcag

SEQ ID NO: 562380 - DNA, 25 bp, Mus musculus
cacttccactccaaatcgggcaaat

SEQ ID NO: 562381 - DNA, 25 bp, Mus musculus
cacttccactcctaatcgggcaaat

SEQ ID NO: 562382 - DNA, 25 bp, Mus musculus
cacttccaggccataaaggctggct

SEQ ID NO: 562383 - DNA, 25 bp, Mus musculus
cacttccaggccttaaaggctggct

SEQ ID NO: 562384 - DNA, 25 bp, Mus musculus
cacttccagttaatacagaggagcc

SEQ ID NO: 562385 - DNA, 25 bp, Mus musculus
cacttccagttattacagaggagcc

SEQ ID NO: 562386 - DNA, 25 bp, Mus musculus
cacttccatgggagtgcctacagca

SEQ ID NO: 562387 - DNA, 25 bp, Mus musculus
cacttccatgggtgtgcctacagca

SEQ ID NO: 562388 - DNA, 25 bp, Mus musculus
cacttccatgtcacaactgaagaat

SEQ ID NO: 562389 - DNA, 25 bp, Mus musculus
cacttccatgtctcaactgaagaat

SEQ ID NO: 562390 - DNA, 25 bp, Mus musculus
cacttcccagaccatttatgtgtca

SEQ ID NO: 562391 - DNA, 25 bp, Mus musculus
cacttcccagacgatttatgtgtca

SEQ ID NO: 562392 - DNA, 25 bp, Mus musculus
cacttccccaagagctgatggctga

SEQ ID NO: 562393 - DNA, 25 bp, Mus musculus
cacttccccaagtgctgatggctga

SEQ ID NO: 562394 - DNA, 25 bp, Mus musculus
cacttcccgagtcgacgaagagcct

SEQ ID NO: 562395 - DNA, 25 bp, Mus musculus
cacttcccgagtggacgaagagcct

SEQ ID NO: 562396 - DNA, 25 bp, Mus musculus
cacttcccgggtaatgctgggcccg

SEQ ID NO: 562397 - DNA, 25 bp, Mus musculus
cacttcccgggttatgctgggcccg

SEQ ID NO: 562398 - DNA, 25 bp, Mus musculus
cacttccggacaagagactcattgg

SEQ ID NO: 562399 - DNA, 25 bp, Mus musculus
cacttccggacatgagactcattgg

SEQ ID NO: 562400 - DNA, 25 bp, Mus musculus
cacttccggccacgctatgagtatg

SEQ ID NO: 562401 - DNA, 25 bp, Mus musculus
cacttccggccaggctatgagtatg

SEQ ID NO: 562402 - DNA, 25 bp, Mus musculus
cacttccggtacatgggctttggct

SEQ ID NO: 562403 - DNA, 25 bp, Mus musculus
cacttccggtacttgggctttggct

SEQ ID NO: 562404 - DNA, 25 bp, Mus musculus
cacttcctacaactgctcttgcaag

SEQ ID NO: 562405 - DNA, 25 bp, Mus musculus
cacttcctacaagtgctcttgcaag

SEQ ID NO: 562406 - DNA, 25 bp, Mus musculus
cacttcctctgccaggaatactcgg

SEQ ID NO: 562407 - DNA, 25 bp, Mus musculus
cacttcctctgcgaggaatactcgg

SEQ ID NO: 562408 - DNA, 25 bp, Mus musculus
cacttcctgaatacatttaccagca

SEQ ID NO: 562409 - DNA, 25 bp, Mus musculus
cacttcctgaattcatttaccagca

SEQ ID NO: 562410 - DNA, 25 bp, Mus musculus
cacttcctggtgctcaacatgaagg

SEQ ID NO: 562411 - DNA, 25 bp, Mus musculus
cacttcctggtggtcaacatgaagg

SEQ ID NO: 562412 - DNA, 25 bp, Mus musculus
cacttcctgtgaagccagggagcat

SEQ ID NO: 562413 - DNA, 25 bp, Mus musculus
cacttcctgtgatgccagggagcat

SEQ ID NO: 562414 - DNA, 25 bp, Mus musculus
cacttcctgtggaggtacctgcaga

SEQ ID NO: 562415 - DNA, 25 bp, Mus musculus
cacttcctgtggtggtacctgcaga

SEQ ID NO: 562416 - DNA, 25 bp, Mus musculus
cacttcgaagcgacttggagcaatc

SEQ ID NO: 562417 - DNA, 25 bp, Mus musculus
cacttcgaagcgtcttggagcaatc

SEQ ID NO: 562418 - DNA, 25 bp, Mus musculus
cacttcgaagctctgcagcacgtgc

SEQ ID NO: 562419 - DNA, 25 bp, Mus musculus
cacttcgaagctgtgcagcacgtgc

SEQ ID NO: 562420 - DNA, 25 bp, Mus musculus
cacttcgacaaaattgccatcctga

SEQ ID NO: 562421 - DNA, 25 bp, Mus musculus
cacttcgacaaatttgccatcctga

SEQ ID NO: 562422 - DNA, 25 bp, Mus musculus
cacttcgagatgatctccttgtcct

SEQ ID NO: 562423 - DNA, 25 bp, Mus musculus
cacttcgagatgttctccttgtcct

SEQ ID NO: 562424 - DNA, 25 bp, Mus musculus
cacttcgaggagacaagcaagctgg

SEQ ID NO: 562425 - DNA, 25 bp, Mus musculus
cacttcgaggagtcaagcaagctgg

SEQ ID NO: 562426 - DNA, 25 bp, Mus musculus
cacttcgatgagaacttgacagggc

SEQ ID NO: 562427 - DNA, 25 bp, Mus musculus
cacttcgatgagtacttgacagggc

SEQ ID NO: 562428 - DNA, 25 bp, Mus musculus
cacttcgattgtccttacttatacc

SEQ ID NO: 562429 - DNA, 25 bp, Mus musculus
cacttcgattgtgcttacttatacc

SEQ ID NO: 562430 - DNA, 25 bp, Mus musculus
cacttcggaactatggaagctacag

SEQ ID NO: 562431 - DNA, 25 bp, Mus musculus
cacttcggaactttggaagctacag

SEQ ID NO: 562432 - DNA, 25 bp, Mus musculus
cacttcgggagcaaacatgggaagc

SEQ ID NO: 562433 - DNA, 25 bp, Mus musculus
cacttcgggagctaacatgggaagc

SEQ ID NO: 562434 - DNA, 25 bp, Mus musculus
cacttcgggtgtagtgggagcggac

SEQ ID NO: 562435 - DNA, 25 bp, Mus musculus
cacttcgggtgttgtgggagcggac

SEQ ID NO: 562436 - DNA, 25 bp, Mus musculus
cacttcgtaggccagactggacttg

SEQ ID NO: 562437 - DNA, 25 bp, Mus musculus
cacttcgtaggcgagactggacttg

SEQ ID NO: 562438 - DNA, 25 bp, Mus musculus
cacttctaagcaaggagggcggaga

SEQ ID NO: 562439 - DNA, 25 bp, Mus musculus
cacttctaagcatggagggcggaga

SEQ ID NO: 562440 - DNA, 25 bp, Mus musculus
cacttctacagtcatcatcaacgag

SEQ ID NO: 562441 - DNA, 25 bp, Mus musculus
cacttctacagtgatcatcaacgag

SEQ ID NO: 562442 - DNA, 25 bp, Mus musculus
cacttctatcttcgctgtctcggca

SEQ ID NO: 562443 - DNA, 25 bp, Mus musculus
cacttctatcttggctgtctcggca

SEQ ID NO: 562444 - DNA, 25 bp, Mus musculus
cacttctatgctcgtggactatggg

SEQ ID NO: 562445 - DNA, 25 bp, Mus musculus
cacttctatgctggtggactatggg

SEQ ID NO: 562446 - DNA, 25 bp, Mus musculus
cacttctcctgcacggtgctggcaa

SEQ ID NO: 562447 - DNA, 25 bp, Mus musculus
cacttctcctgctcggtgctggcaa

SEQ ID NO: 562448 - DNA, 25 bp, Mus musculus
cacttctcggacaatgaggcagacc

SEQ ID NO: 562449 - DNA, 25 bp, Mus musculus
cacttctcggactatgaggcagacc

SEQ ID NO: 562450 - DNA, 25 bp, Mus musculus
cacttctcggtgctaccgatgctgt

SEQ ID NO: 562451 - DNA, 25 bp, Mus musculus
cacttctcggtggtaccgatgctgt

SEQ ID NO: 562452 - DNA, 25 bp, Mus musculus
cacttctctccccaactgtttgatt

SEQ ID NO: 562453 - DNA, 25 bp, Mus musculus
cacttctctcccgaactgtttgatt

SEQ ID NO: 562454 - DNA, 25 bp, Mus musculus
cacttctctgcactctgctacagga

SEQ ID NO: 562455 - DNA, 25 bp, Mus musculus
cacttctctgcagtctgctacagga

SEQ ID NO: 562456 - DNA, 25 bp, Mus musculus
cacttctgacagaacagaacgatga

SEQ ID NO: 562457 - DNA, 25 bp, Mus musculus
cacttctgacagtacagaacgatga

SEQ ID NO: 562458 - DNA, 25 bp, Mus musculus
cacttctgaggacgctccttagaaa

SEQ ID NO: 562459 - DNA, 25 bp, Mus musculus
cacttctgaggaggctccttagaaa

SEQ ID NO: 562460 - DNA, 25 bp, Mus musculus
cacttctgcatgaaaagaaacctca

SEQ ID NO: 562461 - DNA, 25 bp, Mus musculus
cacttctgcatgtaaagaaacctca

SEQ ID NO: 562462 - DNA, 25 bp, Mus musculus
cacttctgcattcacatgctcaacg

SEQ ID NO: 562463 - DNA, 25 bp, Mus musculus
cacttctgcattgacatgctcaacg

SEQ ID NO: 562464 - DNA, 25 bp, Mus musculus
cacttctgccgaaacaccgtgggca

SEQ ID NO: 562465 - DNA, 25 bp, Mus musculus
cacttctgccgatacaccgtgggca

SEQ ID NO: 562466 - DNA, 25 bp, Mus musculus
cacttctgccttcaaggagcttcag

SEQ ID NO: 562467 - DNA, 25 bp, Mus musculus
cacttctgccttgaaggagcttcag

SEQ ID NO: 562468 - DNA, 25 bp, Mus musculus
cacttctgctgcaccgatgacgtgt

SEQ ID NO: 562469 - DNA, 25 bp, Mus musculus
cacttctgctgctccgatgacgtgt

SEQ ID NO: 562470 - DNA, 25 bp, Mus musculus
cacttctggccgactctgctgacag

SEQ ID NO: 562471 - DNA, 25 bp, Mus musculus
cacttctggccgtctctgctgacag

SEQ ID NO: 562472 - DNA, 25 bp, Mus musculus
cacttctgggaaatcaagatgacct

SEQ ID NO: 562473 - DNA, 25 bp, Mus musculus
cacttctgggaattcaagatgacct

SEQ ID NO: 562474 - DNA, 25 bp, Mus musculus
cacttctgggttcaaagtggcctga

SEQ ID NO: 562475 - DNA, 25 bp, Mus musculus
cacttctgggttgaaagtggcctga

SEQ ID NO: 562476 - DNA, 25 bp, Mus musculus
cacttcttcgacatcttctggtgga

SEQ ID NO: 562477 - DNA, 25 bp, Mus musculus
cacttcttcgacttcttctggtgga

SEQ ID NO: 562478 - DNA, 25 bp, Mus musculus
cacttcttcttcaacctggctggca

SEQ ID NO: 562479 - DNA, 25 bp, Mus musculus
cacttcttcttctacctggctggca

SEQ ID NO: 562480 - DNA, 25 bp, Mus musculus
cacttcttgatcctctacgtggaac

SEQ ID NO: 562481 - DNA, 25 bp, Mus musculus
cacttcttgatcgtctacgtggaac

SEQ ID NO: 562482 - DNA, 25 bp, Mus musculus
cacttcttggacagctgagaaatcc

SEQ ID NO: 562483 - DNA, 25 bp, Mus musculus
cacttcttggactgctgagaaatcc

SEQ ID NO: 562484 - DNA, 25 bp, Mus musculus
cacttctttaccctgctgcaagaag

SEQ ID NO: 562485 - DNA, 25 bp, Mus musculus
cacttctttaccgtgctgcaagaag

SEQ ID NO: 562486 - DNA, 25 bp, Mus musculus
cacttgaacattcaggaccctgaaa

SEQ ID NO: 562487 - DNA, 25 bp, Mus musculus
cacttgaacattgaggaccctgaaa

SEQ ID NO: 562488 - DNA, 25 bp, Mus musculus
cacttgaagaatcatcccagggaac

SEQ ID NO: 562489 - DNA, 25 bp, Mus musculus
cacttgaagaatgatcccagggaac

SEQ ID NO: 562490 - DNA, 25 bp, Mus musculus
cacttgacaaagctgaggcattggc

SEQ ID NO: 562491 - DNA, 25 bp, Mus musculus
cacttgacaaaggtgaggcattggc

SEQ ID NO: 562492 - DNA, 25 bp, Mus musculus
cacttgacagttcattgatggagac

SEQ ID NO: 562493 - DNA, 25 bp, Mus musculus
cacttgacagttgattgatggagac

SEQ ID NO: 562494 - DNA, 25 bp, Mus musculus
cacttgagacgcctgagggaaacca

SEQ ID NO: 562495 - DNA, 25 bp, Mus musculus
cacttgagacgcgtgagggaaacca

SEQ ID NO: 562496 - DNA, 25 bp, Mus musculus
cacttgagccaaagccagatactga

SEQ ID NO: 562497 - DNA, 25 bp, Mus musculus
cacttgagccaatgccagatactga

SEQ ID NO: 562498 - DNA, 25 bp, Mus musculus
cacttgaggaaacgaaacttcttgg

SEQ ID NO: 562499 - DNA, 25 bp, Mus musculus
cacttgaggaaaggaaacttcttgg

SEQ ID NO: 562500 - DNA, 25 bp, Mus musculus
cacttgataggaaaagcattcggaa

SEQ ID NO: 562501 - DNA, 25 bp, Mus musculus
cacttgataggataagcattcggaa

SEQ ID NO: 562502 - DNA, 25 bp, Mus musculus
cacttgatggatcatactgtcattc

SEQ ID NO: 562503 - DNA, 25 bp, Mus musculus
cacttgatggatgatactgtcattc

SEQ ID NO: 562504 - DNA, 25 bp, Mus musculus
cacttgcaatgaactggacgcgtct

SEQ ID NO: 562505 - DNA, 25 bp, Mus musculus
cacttgcaatgatctggacgcgtct

SEQ ID NO: 562506 - DNA, 25 bp, Mus musculus
cacttgcacaaacaagagggtcctg

SEQ ID NO: 562507 - DNA, 25 bp, Mus musculus
cacttgcacaaagaagagggtcctg

SEQ ID NO: 562508 - DNA, 25 bp, Mus musculus
cacttgcacatgcattcacataaac

SEQ ID NO: 562509 - DNA, 25 bp, Mus musculus
cacttgcacatggattcacataaac

SEQ ID NO: 562510 - DNA, 25 bp, Mus musculus
cacttgcagcatcgtaactttctac

SEQ ID NO: 562511 - DNA, 25 bp, Mus musculus
cacttgcagcatggtaactttctac

SEQ ID NO: 562512 - DNA, 25 bp, Mus musculus
cacttgcagtcgctgtcagaagcaa

SEQ ID NO: 562513 - DNA, 25 bp, Mus musculus
cacttgcagtcggtgtcagaagcaa

SEQ ID NO: 562514 - DNA, 25 bp, Mus musculus
cacttgccagtaagggtggctacac

SEQ ID NO: 562515 - DNA, 25 bp, Mus musculus
cacttgccagtatgggtggctacac

SEQ ID NO: 562516 - DNA, 25 bp, Mus musculus
cacttgcccctcactgatcgaagga

SEQ ID NO: 562517 - DNA, 25 bp, Mus musculus
cacttgcccctctctgatcgaagga

SEQ ID NO: 562518 - DNA, 25 bp, Mus musculus
cacttgcccttcatcattgtcaaca

SEQ ID NO: 562519 - DNA, 25 bp, Mus musculus
cacttgcccttcttcattgtcaaca

SEQ ID NO: 562520 - DNA, 25 bp, Mus musculus
cacttgccgggcatgtttgaagagg

SEQ ID NO: 562521 - DNA, 25 bp, Mus musculus
cacttgccgggcttgtttgaagagg

SEQ ID NO: 562522 - DNA, 25 bp, Mus musculus
cacttgcctttgcagactcagttca

SEQ ID NO: 562523 - DNA, 25 bp, Mus musculus
cacttgcctttggagactcagttca

SEQ ID NO: 562524 - DNA, 25 bp, Mus musculus
cacttgcgactgctttgagggcttc

SEQ ID NO: 562525 - DNA, 25 bp, Mus musculus
cacttgcgactggtttgagggcttc

SEQ ID NO: 562526 - DNA, 25 bp, Mus musculus
cacttgcggtggcttgggcttcaca

SEQ ID NO: 562527 - DNA, 25 bp, Mus musculus
cacttgcggtgggttgggcttcaca

SEQ ID NO: 562528 - DNA, 25 bp, Mus musculus
cacttgcgtggactccctggactgg

SEQ ID NO: 562529 - DNA, 25 bp, Mus musculus
cacttgcgtggagtccctggactgg

SEQ ID NO: 562530 - DNA, 25 bp, Mus musculus
cacttgctaagtaggctctgggccc

SEQ ID NO: 562531 - DNA, 25 bp, Mus musculus
cacttgctaagttggctctgggccc

SEQ ID NO: 562532 - DNA, 25 bp, Mus musculus
cacttgctagcacacataggcagca

SEQ ID NO: 562533 - DNA, 25 bp, Mus musculus
cacttgctagcagacataggcagca

SEQ ID NO: 562534 - DNA, 25 bp, Mus musculus
cacttgctaggacatgcagggagcc

SEQ ID NO: 562535 - DNA, 25 bp, Mus musculus
cacttgctaggagatgcagggagcc

SEQ ID NO: 562536 - DNA, 25 bp, Mus musculus
cacttgctatggagaggatcaaaga

SEQ ID NO: 562537 - DNA, 25 bp, Mus musculus
cacttgctatggtgaggatcaaaga

SEQ ID NO: 562538 - DNA, 25 bp, Mus musculus
cacttgctcctacacgatcagactg

SEQ ID NO: 562539 - DNA, 25 bp, Mus musculus
cacttgctcctagacgatcagactg

SEQ ID NO: 562540 - DNA, 25 bp, Mus musculus
cacttgctcggtcgtaaatggagac

SEQ ID NO: 562541 - DNA, 25 bp, Mus musculus
cacttgctcggtggtaaatggagac

SEQ ID NO: 562542 - DNA, 25 bp, Mus musculus
cacttgctgcagagggaatcctgaa

SEQ ID NO: 562543 - DNA, 25 bp, Mus musculus
cacttgctgcagtgggaatcctgaa

SEQ ID NO: 562544 - DNA, 25 bp, Mus musculus
cacttgctgcttcaggcaggcgtga

SEQ ID NO: 562545 - DNA, 25 bp, Mus musculus
cacttgctgcttgaggcaggcgtga

SEQ ID NO: 562546 - DNA, 25 bp, Mus musculus
cacttgctttttaccagtcttctgg

SEQ ID NO: 562547 - DNA, 25 bp, Mus musculus
cacttgcttttttccagtcttctgg

SEQ ID NO: 562548 - DNA, 25 bp, Mus musculus
cacttggaaccacaaggagacgtac

SEQ ID NO: 562549 - DNA, 25 bp, Mus musculus
cacttggaaccagaaggagacgtac

SEQ ID NO: 562550 - DNA, 25 bp, Mus musculus
cacttggaagcacagccatgtgtaa

SEQ ID NO: 562551 - DNA, 25 bp, Mus musculus
cacttggaagcagagccatgtgtaa

SEQ ID NO: 562552 - DNA, 25 bp, Mus musculus
cacttggaatctcagctcagaaact

SEQ ID NO: 562553 - DNA, 25 bp, Mus musculus
cacttggaatctgagctcagaaact

SEQ ID NO: 562554 - DNA, 25 bp, Mus musculus
cacttggaatgacccttcggtgcag

SEQ ID NO: 562555 - DNA, 25 bp, Mus musculus
cacttggaatgagccttcggtgcag

SEQ ID NO: 562556 - DNA, 25 bp, Mus musculus
cacttggaatgcaaaatggttgccg

SEQ ID NO: 562557 - DNA, 25 bp, Mus musculus
cacttggaatgctaaatggttgccg

SEQ ID NO: 562558 - DNA, 25 bp, Mus musculus
cacttggacgaaagcccacacagtc

SEQ ID NO: 562559 - DNA, 25 bp, Mus musculus
cacttggacgaatgcccacacagtc

SEQ ID NO: 562560 - DNA, 25 bp, Mus musculus
cacttggacgccacttcatggtctt

SEQ ID NO: 562561 - DNA, 25 bp, Mus musculus
cacttggacgcctcttcatggtctt

SEQ ID NO: 562562 - DNA, 25 bp, Mus musculus
cacttggagacacacatgatacaag

SEQ ID NO: 562563 - DNA, 25 bp, Mus musculus
cacttggagacagacatgatacaag

SEQ ID NO: 562564 - DNA, 25 bp, Mus musculus
cacttggagatgagcagcagctaaa

SEQ ID NO: 562565 - DNA, 25 bp, Mus musculus
cacttggagatgtgcagcagctaaa

SEQ ID NO: 562566 - DNA, 25 bp, Mus musculus
cacttggaggttccacttaccttag

SEQ ID NO: 562567 - DNA, 25 bp, Mus musculus
cacttggaggttgcacttaccttag

SEQ ID NO: 562568 - DNA, 25 bp, Mus musculus
cacttggagtgccattacaccttaa

SEQ ID NO: 562569 - DNA, 25 bp, Mus musculus
cacttggagtgcgattacaccttaa

SEQ ID NO: 562570 - DNA, 25 bp, Mus musculus
cacttggagtggacctggagaagac

SEQ ID NO: 562571 - DNA, 25 bp, Mus musculus
cacttggagtggtcctggagaagac

SEQ ID NO: 562572 - DNA, 25 bp, Mus musculus
cacttggagttaatgtccaactggg

SEQ ID NO: 562573 - DNA, 25 bp, Mus musculus
cacttggagttattgtccaactggg

SEQ ID NO: 562574 - DNA, 25 bp, Mus musculus
cacttggagtttactgtcctgttca

SEQ ID NO: 562575 - DNA, 25 bp, Mus musculus
cacttggagttttctgtcctgttca

SEQ ID NO: 562576 - DNA, 25 bp, Mus musculus
cacttggatgcaatcttggaccttc

SEQ ID NO: 562577 - DNA, 25 bp, Mus musculus
cacttggatgcattcttggaccttc

SEQ ID NO: 562578 - DNA, 25 bp, Mus musculus
cacttggcaagaatggtggagttcc

SEQ ID NO: 562579 - DNA, 25 bp, Mus musculus
cacttggcaagattggtggagttcc

SEQ ID NO: 562580 - DNA, 25 bp, Mus musculus
cacttggcagcgcaagaagcaaatc

SEQ ID NO: 562581 - DNA, 25 bp, Mus musculus
cacttggcagcggaagaagcaaatc

SEQ ID NO: 562582 - DNA, 25 bp, Mus musculus
cacttggcccggcaggtcagtttca

SEQ ID NO: 562583 - DNA, 25 bp, Mus musculus
cacttggcccgggaggtcagtttca

SEQ ID NO: 562584 - DNA, 25 bp, Mus musculus
cacttggcgattccatgtgaaagat

SEQ ID NO: 562585 - DNA, 25 bp, Mus musculus
cacttggcgattgcatgtgaaagat

SEQ ID NO: 562586 - DNA, 25 bp, Mus musculus
cacttggcttcaatgtcccaggaga

SEQ ID NO: 562587 - DNA, 25 bp, Mus musculus
cacttggcttcattgtcccaggaga

SEQ ID NO: 562588 - DNA, 25 bp, Mus musculus
cacttgggccagcttgttctaggga

SEQ ID NO: 562589 - DNA, 25 bp, Mus musculus
cacttgggccaggttgttctaggga

SEQ ID NO: 562590 - DNA, 25 bp, Mus musculus
cacttgggcctgagaagcttgaagc

SEQ ID NO: 562591 - DNA, 25 bp, Mus musculus
cacttgggcctgtgaagcttgaagc

SEQ ID NO: 562592 - DNA, 25 bp, Mus musculus
cacttgggtcggaagtggcagttac

SEQ ID NO: 562593 - DNA, 25 bp, Mus musculus
cacttgggtcggtagtggcagttac

SEQ ID NO: 562594 - DNA, 25 bp, Mus musculus
cacttggtatctctatacatggatg

SEQ ID NO: 562595 - DNA, 25 bp, Mus musculus
cacttggtatctgtatacatggatg

SEQ ID NO: 562596 - DNA, 25 bp, Mus musculus
cacttggtctgtcctccctaagaga

SEQ ID NO: 562597 - DNA, 25 bp, Mus musculus
cacttggtctgtgctccctaagaga

SEQ ID NO: 562598 - DNA, 25 bp, Mus musculus
cacttggtggacaatactatgactg

SEQ ID NO: 562599 - DNA, 25 bp, Mus musculus
cacttggtggactatactatgactg

SEQ ID NO: 562600 - DNA, 25 bp, Mus musculus
cacttggtggatagctgtgcgtcca

SEQ ID NO: 562601 - DNA, 25 bp, Mus musculus
cacttggtggattgctgtgcgtcca

SEQ ID NO: 562602 - DNA, 25 bp, Mus musculus
cacttggtgggacgcctgctgtccc

SEQ ID NO: 562603 - DNA, 25 bp, Mus musculus
cacttggtgggaggcctgctgtccc

SEQ ID NO: 562604 - DNA, 25 bp, Mus musculus
cacttggttgttatggccatggaga

SEQ ID NO: 562605 - DNA, 25 bp, Mus musculus
cacttggttgttttggccatggaga

SEQ ID NO: 562606 - DNA, 25 bp, Mus musculus
cacttgtacgtgaggtgtattctca

SEQ ID NO: 562607 - DNA, 25 bp, Mus musculus
cacttgtacgtgtggtgtattctca

SEQ ID NO: 562608 - DNA, 25 bp, Mus musculus
cacttgtagagaacttgtagagtat

SEQ ID NO: 562609 - DNA, 25 bp, Mus musculus
cacttgtagagatcttgtagagtat

SEQ ID NO: 562610 - DNA, 25 bp, Mus musculus
cacttgtagatgctgataccttcca

SEQ ID NO: 562611 - DNA, 25 bp, Mus musculus
cacttgtagatggtgataccttcca

SEQ ID NO: 562612 - DNA, 25 bp, Mus musculus
cacttgtagcaaaggtttgaactcc

SEQ ID NO: 562613 - DNA, 25 bp, Mus musculus
cacttgtagcaatggtttgaactcc

SEQ ID NO: 562614 - DNA, 25 bp, Mus musculus
cacttgtagtccaggattttggcaa

SEQ ID NO: 562615 - DNA, 25 bp, Mus musculus
cacttgtagtcctggattttggcaa

SEQ ID NO: 562616 - DNA, 25 bp, Mus musculus
cacttgtatcagcaccacatgcagt

SEQ ID NO: 562617 - DNA, 25 bp, Mus musculus
cacttgtatcaggaccacatgcagt

SEQ ID NO: 562618 - DNA, 25 bp, Mus musculus
cacttgtatgtgatgtaatctctta

SEQ ID NO: 562619 - DNA, 25 bp, Mus musculus
cacttgtatgtgttgtaatctctta

SEQ ID NO: 562620 - DNA, 25 bp, Mus musculus
cacttgtcaggaaacaacctgatca

SEQ ID NO: 562621 - DNA, 25 bp, Mus musculus
cacttgtcaggatacaacctgatca

SEQ ID NO: 562622 - DNA, 25 bp, Mus musculus
cacttgtgactcctaagccagagaa

SEQ ID NO: 562623 - DNA, 25 bp, Mus musculus
cacttgtgactcgtaagccagagaa

SEQ ID NO: 562624 - DNA, 25 bp, Mus musculus
cacttgtgatgaagactcggtggcc

SEQ ID NO: 562625 - DNA, 25 bp, Mus musculus
cacttgtgatgatgactcggtggcc

SEQ ID NO: 562626 - DNA, 25 bp, Mus musculus
cacttgtgccacctagtgggttgcc

SEQ ID NO: 562627 - DNA, 25 bp, Mus musculus
cacttgtgccacgtagtgggttgcc

SEQ ID NO: 562628 - DNA, 25 bp, Mus musculus
cacttgtgctctatctgcagtgcgg

SEQ ID NO: 562629 - DNA, 25 bp, Mus musculus
cacttgtgctctttctgcagtgcgg

SEQ ID NO: 562630 - DNA, 25 bp, Mus musculus
cacttgtgctgcatggtatagtcca

SEQ ID NO: 562631 - DNA, 25 bp, Mus musculus
cacttgtgctgcttggtatagtcca

SEQ ID NO: 562632 - DNA, 25 bp, Mus musculus
cacttgtggaaaagtgcccgaaaca

SEQ ID NO: 562633 - DNA, 25 bp, Mus musculus
cacttgtggaaatgtgcccgaaaca

SEQ ID NO: 562634 - DNA, 25 bp, Mus musculus
cacttgtggcttcgaagggaactgc

SEQ ID NO: 562635 - DNA, 25 bp, Mus musculus
cacttgtggcttggaagggaactgc

SEQ ID NO: 562636 - DNA, 25 bp, Mus musculus
cacttgtggtttctcatggtgacct

SEQ ID NO: 562637 - DNA, 25 bp, Mus musculus
cacttgtggtttgtcatggtgacct

SEQ ID NO: 562638 - DNA, 25 bp, Mus musculus
cacttgttccctaaatgagttcagc

SEQ ID NO: 562639 - DNA, 25 bp, Mus musculus
cacttgttcccttaatgagttcagc

SEQ ID NO: 562640 - DNA, 25 bp, Mus musculus
cacttgttcgatagccagatgaaga

SEQ ID NO: 562641 - DNA, 25 bp, Mus musculus
cacttgttcgattgccagatgaaga

SEQ ID NO: 562642 - DNA, 25 bp, Mus musculus
cacttgttgggaccaccccaaaatg

SEQ ID NO: 562643 - DNA, 25 bp, Mus musculus
cacttgttgggagcaccccaaaatg

SEQ ID NO: 562644 - DNA, 25 bp, Mus musculus
cacttgttgtcccaggactgcgggt

SEQ ID NO: 562645 - DNA, 25 bp, Mus musculus
cacttgttgtccgaggactgcgggt

SEQ ID NO: 562646 - DNA, 25 bp, Mus musculus
cacttgttgtgacccatggagacag

SEQ ID NO: 562647 - DNA, 25 bp, Mus musculus
cacttgttgtgagccatggagacag

SEQ ID NO: 562648 - DNA, 25 bp, Mus musculus
cacttgttgtgcagaaagaggccca

SEQ ID NO: 562649 - DNA, 25 bp, Mus musculus
cacttgttgtgctgaaagaggccca

SEQ ID NO: 562650 - DNA, 25 bp, Mus musculus
cactttaaagtactaggagactgga

SEQ ID NO: 562651 - DNA, 25 bp, Mus musculus
cactttaaagtagtaggagactgga

SEQ ID NO: 562652 - DNA, 25 bp, Mus musculus
cactttaaatggaagccagcctgag

SEQ ID NO: 562653 - DNA, 25 bp, Mus musculus
cactttaaatggtagccagcctgag

SEQ ID NO: 562654 - DNA, 25 bp, Mus musculus
cactttaactgtcctgttcatcctc

SEQ ID NO: 562655 - DNA, 25 bp, Mus musculus
cactttaactgtgctgttcatcctc

SEQ ID NO: 562656 - DNA, 25 bp, Mus musculus
cactttaagaacctaggctatgcca

SEQ ID NO: 562657 - DNA, 25 bp, Mus musculus
cactttaagaacgtaggctatgcca

SEQ ID NO: 562658 - DNA, 25 bp, Mus musculus
cactttaagaggatacaaagtctgc

SEQ ID NO: 562659 - DNA, 25 bp, Mus musculus
cactttaagaggttacaaagtctgc

SEQ ID NO: 562660 - DNA, 25 bp, Mus musculus
cactttaagcgtcctgcttatgcat

SEQ ID NO: 562661 - DNA, 25 bp, Mus musculus
cactttaagcgtgctgcttatgcat

SEQ ID NO: 562662 - DNA, 25 bp, Mus musculus
cactttacacttaaatgtggagcta

SEQ ID NO: 562663 - DNA, 25 bp, Mus musculus
cactttacactttaatgtggagcta

SEQ ID NO: 562664 - DNA, 25 bp, Mus musculus
cactttacgggaaggtacactgact

SEQ ID NO: 562665 - DNA, 25 bp, Mus musculus
cactttacgggatggtacactgact

SEQ ID NO: 562666 - DNA, 25 bp, Mus musculus
cactttactgagcaattggcaactc

SEQ ID NO: 562667 - DNA, 25 bp, Mus musculus
cactttactgaggaattggcaactc

SEQ ID NO: 562668 - DNA, 25 bp, Mus musculus
cactttacttggcagaagaagtatg

SEQ ID NO: 562669 - DNA, 25 bp, Mus musculus
cactttacttgggagaagaagtatg

SEQ ID NO: 562670 - DNA, 25 bp, Mus musculus
cactttagccacaatgagtgttaga

SEQ ID NO: 562671 - DNA, 25 bp, Mus musculus
cactttagccactatgagtgttaga

SEQ ID NO: 562672 - DNA, 25 bp, Mus musculus
cactttaggccacctgaaggaatta

SEQ ID NO: 562673 - DNA, 25 bp, Mus musculus
cactttaggccagctgaaggaatta

SEQ ID NO: 562674 - DNA, 25 bp, Mus musculus
cactttatctggaggaattggcatc

SEQ ID NO: 562675 - DNA, 25 bp, Mus musculus
cactttatctggtggaattggcatc

SEQ ID NO: 562676 - DNA, 25 bp, Mus musculus
cactttattgcaacgtgggctccga

SEQ ID NO: 562677 - DNA, 25 bp, Mus musculus
cactttattgcatcgtgggctccga

SEQ ID NO: 562678 - DNA, 25 bp, Mus musculus
cactttattttgcacgagtgtgaca

SEQ ID NO: 562679 - DNA, 25 bp, Mus musculus
cactttattttggacgagtgtgaca

SEQ ID NO: 562680 - DNA, 25 bp, Mus musculus
cactttcaagggaacctgtctctcc

SEQ ID NO: 562681 - DNA, 25 bp, Mus musculus
cactttcaagggtacctgtctctcc

SEQ ID NO: 562682 - DNA, 25 bp, Mus musculus
cactttcaagtgagctgttgcgtac

SEQ ID NO: 562683 - DNA, 25 bp, Mus musculus
cactttcaagtgtgctgttgcgtac

SEQ ID NO: 562684 - DNA, 25 bp, Mus musculus
cactttcaatttaaaaatcagagac

SEQ ID NO: 562685 - DNA, 25 bp, Mus musculus
cactttcaattttaaaatcagagac

SEQ ID NO: 562686 - DNA, 25 bp, Mus musculus
cactttcaggttcgaaagaagagtc

SEQ ID NO: 562687 - DNA, 25 bp, Mus musculus
cactttcaggttggaaagaagagtc

SEQ ID NO: 562688 - DNA, 25 bp, Mus musculus
cactttccacataactgaggcaggg

SEQ ID NO: 562689 - DNA, 25 bp, Mus musculus
cactttccacattactgaggcaggg

SEQ ID NO: 562690 - DNA, 25 bp, Mus musculus
cactttccatgcagggaatgtcaac

SEQ ID NO: 562691 - DNA, 25 bp, Mus musculus
cactttccatgctgggaatgtcaac

SEQ ID NO: 562692 - DNA, 25 bp, Mus musculus
cactttccgagaaggatgggtctcc

SEQ ID NO: 562693 - DNA, 25 bp, Mus musculus
cactttccgagatggatgggtctcc

SEQ ID NO: 562694 - DNA, 25 bp, Mus musculus
cactttcctgttactttccagcggg

SEQ ID NO: 562695 - DNA, 25 bp, Mus musculus
cactttcctgtttctttccagcggg

SEQ ID NO: 562696 - DNA, 25 bp, Mus musculus
cactttcctttgcttctacgttctg

SEQ ID NO: 562697 - DNA, 25 bp, Mus musculus
cactttcctttggttctacgttctg

SEQ ID NO: 562698 - DNA, 25 bp, Mus musculus
cactttctagggagcagttatggcc

SEQ ID NO: 562699 - DNA, 25 bp, Mus musculus
cactttctagggtgcagttatggcc

SEQ ID NO: 562700 - DNA, 25 bp, Mus musculus
cactttctccacagaacccttggag

SEQ ID NO: 562701 - DNA, 25 bp, Mus musculus
cactttctccactgaacccttggag

SEQ ID NO: 562702 - DNA, 25 bp, Mus musculus
cactttctgacacgtgtgtgcgcca

SEQ ID NO: 562703 - DNA, 25 bp, Mus musculus
cactttctgacaggtgtgtgcgcca

SEQ ID NO: 562704 - DNA, 25 bp, Mus musculus
cactttctgcttcgaggatggacca

SEQ ID NO: 562705 - DNA, 25 bp, Mus musculus
cactttctgcttggaggatggacca

SEQ ID NO: 562706 - DNA, 25 bp, Mus musculus
cactttctgttgcactctctggaga

SEQ ID NO: 562707 - DNA, 25 bp, Mus musculus
cactttctgttggactctctggaga

SEQ ID NO: 562708 - DNA, 25 bp, Mus musculus
cactttcttgcaaaggtggagacct

SEQ ID NO: 562709 - DNA, 25 bp, Mus musculus
cactttcttgcataggtggagacct

SEQ ID NO: 562710 - DNA, 25 bp, Mus musculus
cactttgaaaaacgtatctatggag

SEQ ID NO: 562711 - DNA, 25 bp, Mus musculus
cactttgaaaaaggtatctatggag

SEQ ID NO: 562712 - DNA, 25 bp, Mus musculus
cactttgacagacagcggattcctg

SEQ ID NO: 562713 - DNA, 25 bp, Mus musculus
cactttgacagagagcggattcctg

SEQ ID NO: 562714 - DNA, 25 bp, Mus musculus
cactttgaccaacagggagtgtgta

SEQ ID NO: 562715 - DNA, 25 bp, Mus musculus
cactttgaccaagagggagtgtgta

SEQ ID NO: 562716 - DNA, 25 bp, Mus musculus
cactttgagttacctgacctgggac

SEQ ID NO: 562717 - DNA, 25 bp, Mus musculus
cactttgagttagctgacctgggac

SEQ ID NO: 562718 - DNA, 25 bp, Mus musculus
cactttgcaaagacaaagagcccta

SEQ ID NO: 562719 - DNA, 25 bp, Mus musculus
cactttgcaaagtcaaagagcccta

SEQ ID NO: 562720 - DNA, 25 bp, Mus musculus
cactttgcagacagctgcagcacga

SEQ ID NO: 562721 - DNA, 25 bp, Mus musculus
cactttgcagactgctgcagcacga

SEQ ID NO: 562722 - DNA, 25 bp, Mus musculus
cactttgcagtcaacgtactgtgac

SEQ ID NO: 562723 - DNA, 25 bp, Mus musculus
cactttgcagtctacgtactgtgac

SEQ ID NO: 562724 - DNA, 25 bp, Mus musculus
cactttgccagcagaataaaaggtg

SEQ ID NO: 562725 - DNA, 25 bp, Mus musculus
cactttgccagctgaataaaaggtg

SEQ ID NO: 562726 - DNA, 25 bp, Mus musculus
cactttgcctctcgcggcatggata

SEQ ID NO: 562727 - DNA, 25 bp, Mus musculus
cactttgcctctggcggcatggata

SEQ ID NO: 562728 - DNA, 25 bp, Mus musculus
cactttgctgtcagtcacgtggacg

SEQ ID NO: 562729 - DNA, 25 bp, Mus musculus
cactttgctgtctgtcacgtggacg

SEQ ID NO: 562730 - DNA, 25 bp, Mus musculus
cactttggagaccactttactgtga

SEQ ID NO: 562731 - DNA, 25 bp, Mus musculus
cactttggagacgactttactgtga

SEQ ID NO: 562732 - DNA, 25 bp, Mus musculus
cactttggagctaagcagagaagca

SEQ ID NO: 562733 - DNA, 25 bp, Mus musculus
cactttggagcttagcagagaagca

SEQ ID NO: 562734 - DNA, 25 bp, Mus musculus
cactttggccttacttgggaattct

SEQ ID NO: 562735 - DNA, 25 bp, Mus musculus
cactttggcctttcttgggaattct

SEQ ID NO: 562736 - DNA, 25 bp, Mus musculus
cactttggcgccacgtgagacttga

SEQ ID NO: 562737 - DNA, 25 bp, Mus musculus
cactttggcgcctcgtgagacttga

SEQ ID NO: 562738 - DNA, 25 bp, Mus musculus
cactttgtgctgaagccccagagag

SEQ ID NO: 562739 - DNA, 25 bp, Mus musculus
cactttgtgctgtagccccagagag

SEQ ID NO: 562740 - DNA, 25 bp, Mus musculus
cactttgtggtactccactgcacag

SEQ ID NO: 562741 - DNA, 25 bp, Mus musculus
cactttgtggtagtccactgcacag

SEQ ID NO: 562742 - DNA, 25 bp, Mus musculus
cactttgtgtctcactgcaggaagc

SEQ ID NO: 562743 - DNA, 25 bp, Mus musculus
cactttgtgtctgactgcaggaagc

SEQ ID NO: 562744 - DNA, 25 bp, Mus musculus
cactttgttcagaggtgtgcgctca

SEQ ID NO: 562745 - DNA, 25 bp, Mus musculus
cactttgttcagtggtgtgcgctca

SEQ ID NO: 562746 - DNA, 25 bp, Mus musculus
cacttttaaccaagtggaggcccag

SEQ ID NO: 562747 - DNA, 25 bp, Mus musculus
cacttttaaccatgtggaggcccag

SEQ ID NO: 562748 - DNA, 25 bp, Mus musculus
cacttttaccccagaatatagcttt

SEQ ID NO: 562749 - DNA, 25 bp, Mus musculus
cacttttacccctgaatatagcttt

SEQ ID NO: 562750 - DNA, 25 bp, Mus musculus
cacttttatcagaatctgtagcacc

SEQ ID NO: 562751 - DNA, 25 bp, Mus musculus
cacttttatcagtatctgtagcacc

SEQ ID NO: 562752 - DNA, 25 bp, Mus musculus
cacttttatgtgaaaccccgcgttg

SEQ ID NO: 562753 - DNA, 25 bp, Mus musculus
cacttttatgtgtaaccccgcgttg

SEQ ID NO: 562754 - DNA, 25 bp, Mus musculus
cacttttcaggcacatgtggcccct

SEQ ID NO: 562755 - DNA, 25 bp, Mus musculus
cacttttcaggcactgaactaggag

SEQ ID NO: 562756 - DNA, 25 bp, Mus musculus
cacttttcaggctcatgtggcccct

SEQ ID NO: 562757 - DNA, 25 bp, Mus musculus
cacttttcaggctctgaactaggag

SEQ ID NO: 562758 - DNA, 25 bp, Mus musculus
cacttttgagacagaagtctggacc

SEQ ID NO: 562759 - DNA, 25 bp, Mus musculus
cacttttgagactgaagtctggacc

SEQ ID NO: 562760 - DNA, 25 bp, Mus musculus
cacttttgccttcgccgagggctca

SEQ ID NO: 562761 - DNA, 25 bp, Mus musculus
cacttttgccttggccgagggctca

SEQ ID NO: 562762 - DNA, 25 bp, Mus musculus
cacttttgctagagagcaaggcttt

SEQ ID NO: 562763 - DNA, 25 bp, Mus musculus
cacttttgctagtgagcaaggcttt

SEQ ID NO: 562764 - DNA, 25 bp, Mus musculus
cacttttggcggacgcagcttggct

SEQ ID NO: 562765 - DNA, 25 bp, Mus musculus
cacttttggcggtcgcagcttggct

SEQ ID NO: 562766 - DNA, 25 bp, Mus musculus
cacttttggtcaccctgtggttgaa

SEQ ID NO: 562767 - DNA, 25 bp, Mus musculus
cacttttggtcagcctgtggttgaa

SEQ ID NO: 562768 - DNA, 25 bp, Mus musculus
cacttttgtagaccatcgttgtgtg

SEQ ID NO: 562769 - DNA, 25 bp, Mus musculus
cacttttgtagagcatcgttgtgtg

SEQ ID NO: 562770 - DNA, 25 bp, Mus musculus
cacttttgtattcagttgcagccag

SEQ ID NO: 562771 - DNA, 25 bp, Mus musculus
cacttttgtattgagttgcagccag

SEQ ID NO: 562772 - DNA, 25 bp, Mus musculus
cacttttgtgatagccatggcattc

SEQ ID NO: 562773 - DNA, 25 bp, Mus musculus
cacttttgtgattgccatggcattc

SEQ ID NO: 562774 - DNA, 25 bp, Mus musculus
cactttttcaatcttttagcgagcc

SEQ ID NO: 562775 - DNA, 25 bp, Mus musculus
cactttttcaatgttttagcgagcc

SEQ ID NO: 562776 - DNA, 25 bp, Mus musculus
cactttttcttcatccgcacagcgg

SEQ ID NO: 562777 - DNA, 25 bp, Mus musculus
cactttttcttcttccgcacagcgg

SEQ ID NO: 562778 - DNA, 25 bp, Mus musculus
cagaaaaacattcccagcgtcagag

SEQ ID NO: 562779 - DNA, 25 bp, Mus musculus
cagaaaaacattgccagcgtcagag

SEQ ID NO: 562780 - DNA, 25 bp, Mus musculus
cagaaaaaccctatgatatgaagtc

SEQ ID NO: 562781 - DNA, 25 bp, Mus musculus
cagaaaaaccctttgatatgaagtc

SEQ ID NO: 562782 - DNA, 25 bp, Mus musculus
cagaaaaacttcacataccaagtag

SEQ ID NO: 562783 - DNA, 25 bp, Mus musculus
cagaaaaacttctcataccaagtag

SEQ ID NO: 562784 - DNA, 25 bp, Mus musculus
cagaaaaagcggcagcgagaccgta

SEQ ID NO: 562785 - DNA, 25 bp, Mus musculus
cagaaaaagcgggagcgagaccgta

SEQ ID NO: 562786 - DNA, 25 bp, Mus musculus
cagaaaaagcttcaggagcggagac

SEQ ID NO: 562787 - DNA, 25 bp, Mus musculus
cagaaaaagcttgaggagcggagac

SEQ ID NO: 562788 - DNA, 25 bp, Mus musculus
cagaaaaatctgatgtcattgagca

SEQ ID NO: 562789 - DNA, 25 bp, Mus musculus
cagaaaaatctgttgtcattgagca

SEQ ID NO: 562790 - DNA, 25 bp, Mus musculus
cagaaaacaacaaatacagcacatc

SEQ ID NO: 562791 - DNA, 25 bp, Mus musculus
cagaaaacaacatatacagcacatc

SEQ ID NO: 562792 - DNA, 25 bp, Mus musculus
cagaaaacaagaattccctttggtg

SEQ ID NO: 562793 - DNA, 25 bp, Mus musculus
cagaaaacaagatttccctttggtg

SEQ ID NO: 562794 - DNA, 25 bp, Mus musculus
cagaaaacagacacgccaacttaga

SEQ ID NO: 562795 - DNA, 25 bp, Mus musculus
cagaaaacagactcgccaacttaga

SEQ ID NO: 562796 - DNA, 25 bp, Mus musculus
cagaaaacagatagatgacttaaag

SEQ ID NO: 562797 - DNA, 25 bp, Mus musculus
cagaaaacagattgatgacttaaag

SEQ ID NO: 562798 - DNA, 25 bp, Mus musculus
cagaaaacagctcaaaccgaagagg

SEQ ID NO: 562799 - DNA, 25 bp, Mus musculus
cagaaaacagctgaaaccgaagagg

SEQ ID NO: 562800 - DNA, 25 bp, Mus musculus
cagaaaacagttccgcagcagcacc

SEQ ID NO: 562801 - DNA, 25 bp, Mus musculus
cagaaaacagttgcgcagcagcacc

SEQ ID NO: 562802 - DNA, 25 bp, Mus musculus
cagaaaacattcacttggactgcca

SEQ ID NO: 562803 - DNA, 25 bp, Mus musculus
cagaaaacattctcttggactgcca

SEQ ID NO: 562804 - DNA, 25 bp, Mus musculus
cagaaaacctaccagtgggtgccct

SEQ ID NO: 562805 - DNA, 25 bp, Mus musculus
cagaaaacctacgagtgggtgccct

SEQ ID NO: 562806 - DNA, 25 bp, Mus musculus
cagaaaacctggcaattggccaaca

SEQ ID NO: 562807 - DNA, 25 bp, Mus musculus
cagaaaacctgggaattggccaaca

SEQ ID NO: 562808 - DNA, 25 bp, Mus musculus
cagaaaacgaccataacctgtatgt

SEQ ID NO: 562809 - DNA, 25 bp, Mus musculus
cagaaaacgaccttaacctgtatgt

SEQ ID NO: 562810 - DNA, 25 bp, Mus musculus
cagaaaacgattaggtgttgtaggg

SEQ ID NO: 562811 - DNA, 25 bp, Mus musculus
cagaaaacgatttggtgttgtaggg

SEQ ID NO: 562812 - DNA, 25 bp, Mus musculus
cagaaaacggaaccccaagaacctg

SEQ ID NO: 562813 - DNA, 25 bp, Mus musculus
cagaaaacggaagcccaagaacctg

SEQ ID NO: 562814 - DNA, 25 bp, Mus musculus
cagaaaacggagacgcgcttggctc

SEQ ID NO: 562815 - DNA, 25 bp, Mus musculus
cagaaaacggagtcgcgcttggctc

SEQ ID NO: 562816 - DNA, 25 bp, Mus musculus
cagaaaacgtgtatacttgtagcag

SEQ ID NO: 562817 - DNA, 25 bp, Mus musculus
cagaaaacgtgtttacttgtagcag

SEQ ID NO: 562818 - DNA, 25 bp, Mus musculus
cagaaaactctcagactttgggcag

SEQ ID NO: 562819 - DNA, 25 bp, Mus musculus
cagaaaactctctgactttgggcag

SEQ ID NO: 562820 - DNA, 25 bp, Mus musculus
cagaaaagccgaccagagcgaacag

SEQ ID NO: 562821 - DNA, 25 bp, Mus musculus
cagaaaagccgagcagagcgaacag

SEQ ID NO: 562822 - DNA, 25 bp, Mus musculus
cagaaaagctaaaggagtcacctct

SEQ ID NO: 562823 - DNA, 25 bp, Mus musculus
cagaaaagctaatggagtcacctct

SEQ ID NO: 562824 - DNA, 25 bp, Mus musculus
cagaaaaggctacaaatcatcaatg

SEQ ID NO: 562825 - DNA, 25 bp, Mus musculus
cagaaaaggctagaaatcatcaatg

SEQ ID NO: 562826 - DNA, 25 bp, Mus musculus
cagaaaaggtaaaaggattctgcca

SEQ ID NO: 562827 - DNA, 25 bp, Mus musculus
cagaaaaggtaataggattctgcca

SEQ ID NO: 562828 - DNA, 25 bp, Mus musculus
cagaaaagtcctacgggctctgagt

SEQ ID NO: 562829 - DNA, 25 bp, Mus musculus
cagaaaagtccttcgggctctgagt

SEQ ID NO: 562830 - DNA, 25 bp, Mus musculus
cagaaaagttcaaagtccagtgttt

SEQ ID NO: 562831 - DNA, 25 bp, Mus musculus
cagaaaagttcatagtccagtgttt

SEQ ID NO: 562832 - DNA, 25 bp, Mus musculus
cagaaaagttctcggcctgcctcac

SEQ ID NO: 562833 - DNA, 25 bp, Mus musculus
cagaaaagttctgggcctgcctcac

SEQ ID NO: 562834 - DNA, 25 bp, Mus musculus
cagaaaataattacttggaatgcca

SEQ ID NO: 562835 - DNA, 25 bp, Mus musculus
cagaaaataatttcttggaatgcca

SEQ ID NO: 562836 - DNA, 25 bp, Mus musculus
cagaaaatacaaaccagtctgcaag

SEQ ID NO: 562837 - DNA, 25 bp, Mus musculus
cagaaaatacaatccagtctgcaag

SEQ ID NO: 562838 - DNA, 25 bp, Mus musculus
cagaaaatagggatccgctccccaa

SEQ ID NO: 562839 - DNA, 25 bp, Mus musculus
cagaaaatagggttccgctccccaa

SEQ ID NO: 562840 - DNA, 25 bp, Mus musculus
cagaaaatcaaaaacgccttcagtc

SEQ ID NO: 562841 - DNA, 25 bp, Mus musculus
cagaaaatcaaatacgccttcagtc

SEQ ID NO: 562842 - DNA, 25 bp, Mus musculus
cagaaaatcgcccatgagtgctatc

SEQ ID NO: 562843 - DNA, 25 bp, Mus musculus
cagaaaatcgccgatgagtgctatc

SEQ ID NO: 562844 - DNA, 25 bp, Mus musculus
cagaaaatctcacacctggtgctac

SEQ ID NO: 562845 - DNA, 25 bp, Mus musculus
cagaaaatctcagacctggtgctac

SEQ ID NO: 562846 - DNA, 25 bp, Mus musculus
cagaaaatgaaacccacccaagggc

SEQ ID NO: 562847 - DNA, 25 bp, Mus musculus
cagaaaatgaaagccacccaagggc

SEQ ID NO: 562848 - DNA, 25 bp, Mus musculus
cagaaaatgccgaggttcaagacta

SEQ ID NO: 562849 - DNA, 25 bp, Mus musculus
cagaaaatgccgtggttcaagacta

SEQ ID NO: 562850 - DNA, 25 bp, Mus musculus
cagaaaatgcttcaactagctggtg

SEQ ID NO: 562851 - DNA, 25 bp, Mus musculus
cagaaaatgcttgaactagctggtg

SEQ ID NO: 562852 - DNA, 25 bp, Mus musculus
cagaaaatggttcctttgctcaaca

SEQ ID NO: 562853 - DNA, 25 bp, Mus musculus
cagaaaatggttgctttgctcaaca

SEQ ID NO: 562854 - DNA, 25 bp, Mus musculus
cagaaaatgttaatcagtacctcac

SEQ ID NO: 562855 - DNA, 25 bp, Mus musculus
cagaaaatgttattcagtacctcac

SEQ ID NO: 562856 - DNA, 25 bp, Mus musculus
cagaaaattgccatgaaagtggaac

SEQ ID NO: 562857 - DNA, 25 bp, Mus musculus
cagaaaattgccttgaaagtggaac

SEQ ID NO: 562858 - DNA, 25 bp, Mus musculus
cagaaacaaaaactgccgccacagc

SEQ ID NO: 562859 - DNA, 25 bp, Mus musculus
cagaaacaaaaagtgccgccacagc

SEQ ID NO: 562860 - DNA, 25 bp, Mus musculus
cagaaacaaaagaatgtcctttcag

SEQ ID NO: 562861 - DNA, 25 bp, Mus musculus
cagaaacaaaagtatgtcctttcag

SEQ ID NO: 562862 - DNA, 25 bp, Mus musculus
cagaaacaaagccatgagcttgccc

SEQ ID NO: 562863 - DNA, 25 bp, Mus musculus
cagaaacaaagcgatgagcttgccc

SEQ ID NO: 562864 - DNA, 25 bp, Mus musculus
cagaaacaaatgagcaaagatcaac

SEQ ID NO: 562865 - DNA, 25 bp, Mus musculus
cagaaacaaatgtgcaaagatcaac

SEQ ID NO: 562866 - DNA, 25 bp, Mus musculus
cagaaacaactgcaatgacggagac

SEQ ID NO: 562867 - DNA, 25 bp, Mus musculus
cagaaacaactggaatgacggagac

SEQ ID NO: 562868 - DNA, 25 bp, Mus musculus
cagaaacaagccctagtgagcctat

SEQ ID NO: 562869 - DNA, 25 bp, Mus musculus
cagaaacaagccgtagtgagcctat

SEQ ID NO: 562870 - DNA, 25 bp, Mus musculus
cagaaacaatgtacccacaaccaca

SEQ ID NO: 562871 - DNA, 25 bp, Mus musculus
cagaaacaatgttcccacaaccaca

SEQ ID NO: 562872 - DNA, 25 bp, Mus musculus
cagaaacaccctcgaggccgtaaag

SEQ ID NO: 562873 - DNA, 25 bp, Mus musculus
cagaaacaccctggaggccgtaaag

SEQ ID NO: 562874 - DNA, 25 bp, Mus musculus
cagaaacacctcagcacaaacctag

SEQ ID NO: 562875 - DNA, 25 bp, Mus musculus
cagaaacacctctgcacaaacctag

SEQ ID NO: 562876 - DNA, 25 bp, Mus musculus
cagaaacagaagcacctccaggaga

SEQ ID NO: 562877 - DNA, 25 bp, Mus musculus
cagaaacagaaggacctccaggaga

SEQ ID NO: 562878 - DNA, 25 bp, Mus musculus
cagaaacaggtaattgcaaccacag

SEQ ID NO: 562879 - DNA, 25 bp, Mus musculus
cagaaacaggtatttgcaaccacag

SEQ ID NO: 562880 - DNA, 25 bp, Mus musculus
cagaaacagtatagttccgagcacc

SEQ ID NO: 562881 - DNA, 25 bp, Mus musculus
cagaaacagtattgttccgagcacc

SEQ ID NO: 562882 - DNA, 25 bp, Mus musculus
cagaaacagtttatctttggacgga

SEQ ID NO: 562883 - DNA, 25 bp, Mus musculus
cagaaacagtttttctttggacgga

SEQ ID NO: 562884 - DNA, 25 bp, Mus musculus
cagaaacatctgctgatgggtgaca

SEQ ID NO: 562885 - DNA, 25 bp, Mus musculus
cagaaacatctggtgatgggtgaca

SEQ ID NO: 562886 - DNA, 25 bp, Mus musculus
cagaaacatgcaaggccgagaagct

SEQ ID NO: 562887 - DNA, 25 bp, Mus musculus
cagaaacatgcatggccgagaagct

SEQ ID NO: 562888 - DNA, 25 bp, Mus musculus
cagaaacattggcatccagtggaag

SEQ ID NO: 562889 - DNA, 25 bp, Mus musculus
cagaaacattgggatccagtggaag

SEQ ID NO: 562890 - DNA, 25 bp, Mus musculus
cagaaaccagtaacgccatgaaatc

SEQ ID NO: 562891 - DNA, 25 bp, Mus musculus
cagaaaccagtatcgccatgaaatc

SEQ ID NO: 562892 - DNA, 25 bp, Mus musculus
cagaaaccagtcaatcaaagccata

SEQ ID NO: 562893 - DNA, 25 bp, Mus musculus
cagaaaccagtctatcaaagccata

SEQ ID NO: 562894 - DNA, 25 bp, Mus musculus
cagaaacccagcagaatctttgcag

SEQ ID NO: 562895 - DNA, 25 bp, Mus musculus
cagaaacccagctgaatctttgcag

SEQ ID NO: 562896 - DNA, 25 bp, Mus musculus
cagaaacccctgacggagtctgagc

SEQ ID NO: 562897 - DNA, 25 bp, Mus musculus
cagaaacccctgtcggagtctgagc

SEQ ID NO: 562898 - DNA, 25 bp, Mus musculus
cagaaaccctacaccttcctggagg

SEQ ID NO: 562899 - DNA, 25 bp, Mus musculus
cagaaaccctactccttcctggagg

SEQ ID NO: 562900 - DNA, 25 bp, Mus musculus
cagaaaccggctcttcctactgtta

SEQ ID NO: 562901 - DNA, 25 bp, Mus musculus
cagaaaccggctgttcctactgtta

SEQ ID NO: 562902 - DNA, 25 bp, Mus musculus
cagaaacctagaagcggctgggcag

SEQ ID NO: 562903 - DNA, 25 bp, Mus musculus
cagaaacctagatgcggctgggcag

SEQ ID NO: 562904 - DNA, 25 bp, Mus musculus
cagaaaccttgacatctcaggaccc

SEQ ID NO: 562905 - DNA, 25 bp, Mus musculus
cagaaaccttgagatctcaggaccc

SEQ ID NO: 562906 - DNA, 25 bp, Mus musculus
cagaaacgatttcagcatctggagc

SEQ ID NO: 562907 - DNA, 25 bp, Mus musculus
cagaaacgatttgagcatctggagc

SEQ ID NO: 562908 - DNA, 25 bp, Mus musculus
cagaaacgcaaaataaagaggtggc

SEQ ID NO: 562909 - DNA, 25 bp, Mus musculus
cagaaacgcaaattaaagaggtggc

SEQ ID NO: 562910 - DNA, 25 bp, Mus musculus
cagaaacggactcctcgggcaccgt

SEQ ID NO: 562911 - DNA, 25 bp, Mus musculus
cagaaacggactgctcgggcaccgt

SEQ ID NO: 562912 - DNA, 25 bp, Mus musculus
cagaaacgggaactgcttgtagaag

SEQ ID NO: 562913 - DNA, 25 bp, Mus musculus
cagaaacgggaagtgcttgtagaag

SEQ ID NO: 562914 - DNA, 25 bp, Mus musculus
cagaaactacgtcgagaatcggccc

SEQ ID NO: 562915 - DNA, 25 bp, Mus musculus
cagaaactacgtggagaatcggccc

SEQ ID NO: 562916 - DNA, 25 bp, Mus musculus
cagaaactcgaaatgattggcttta

SEQ ID NO: 562917 - DNA, 25 bp, Mus musculus
cagaaactcgaattgattggcttta

SEQ ID NO: 562918 - DNA, 25 bp, Mus musculus
cagaaactctgtcttgaccaaccgg

SEQ ID NO: 562919 - DNA, 25 bp, Mus musculus
cagaaactctgtgttgaccaaccgg

SEQ ID NO: 562920 - DNA, 25 bp, Mus musculus
cagaaactgaaaccttggcggcagg

SEQ ID NO: 562921 - DNA, 25 bp, Mus musculus
cagaaactgaaagcttggcggcagg

SEQ ID NO: 562922 - DNA, 25 bp, Mus musculus
cagaaactgcagcagaaggcacgcc

SEQ ID NO: 562923 - DNA, 25 bp, Mus musculus
cagaaactgcaggagaaggcacgcc

SEQ ID NO: 562924 - DNA, 25 bp, Mus musculus
cagaaactggctcttcctactgatg

SEQ ID NO: 562925 - DNA, 25 bp, Mus musculus
cagaaactggctgttcctactgatg

SEQ ID NO: 562926 - DNA, 25 bp, Mus musculus
cagaaactgtctcctgaccttcctt

SEQ ID NO: 562927 - DNA, 25 bp, Mus musculus
cagaaactgtctgctgaccttcctt

SEQ ID NO: 562928 - DNA, 25 bp, Mus musculus
cagaaactgtgacaactggagggac

SEQ ID NO: 562929 - DNA, 25 bp, Mus musculus
cagaaactgtgagaactggagggac

SEQ ID NO: 562930 - DNA, 25 bp, Mus musculus
cagaaactgtgcctaccagtgaagc

SEQ ID NO: 562931 - DNA, 25 bp, Mus musculus
cagaaactgtgcgtaccagtgaagc

SEQ ID NO: 562932 - DNA, 25 bp, Mus musculus
cagaaactgttaagttctcagtata

SEQ ID NO: 562933 - DNA, 25 bp, Mus musculus
cagaaactgttatgttctcagtata

SEQ ID NO: 562934 - DNA, 25 bp, Mus musculus
cagaaacttcaaagtgccagggcgg

SEQ ID NO: 562935 - DNA, 25 bp, Mus musculus
cagaaacttcaatgtgccagggcgg

SEQ ID NO: 562936 - DNA, 25 bp, Mus musculus
cagaaacttctgcaccacctccagt

SEQ ID NO: 562937 - DNA, 25 bp, Mus musculus
cagaaacttctggaccacctccagt

SEQ ID NO: 562938 - DNA, 25 bp, Mus musculus
cagaaagaaccaattgtggagttaa

SEQ ID NO: 562939 - DNA, 25 bp, Mus musculus
cagaaagaaccatttgtggagttaa

SEQ ID NO: 562940 - DNA, 25 bp, Mus musculus
cagaaagaacctaaagaagcaacca

SEQ ID NO: 562941 - DNA, 25 bp, Mus musculus
cagaaagaaccttaagaagcaacca

SEQ ID NO: 562942 - DNA, 25 bp, Mus musculus
cagaaagaataccattttgccaaag

SEQ ID NO: 562943 - DNA, 25 bp, Mus musculus
cagaaagaatacgattttgccaaag

SEQ ID NO: 562944 - DNA, 25 bp, Mus musculus
cagaaagacaccatgactgtggtta

SEQ ID NO: 562945 - DNA, 25 bp, Mus musculus
cagaaagacaccttgactgtggtta

SEQ ID NO: 562946 - DNA, 25 bp, Mus musculus
cagaaagacaggacctttgcagtcc

SEQ ID NO: 562947 - DNA, 25 bp, Mus musculus
cagaaagacaggtcctttgcagtcc

SEQ ID NO: 562948 - DNA, 25 bp, Mus musculus
cagaaagagaagaattcccctgctg

SEQ ID NO: 562949 - DNA, 25 bp, Mus musculus
cagaaagagaagtattcccctgctg

SEQ ID NO: 562950 - DNA, 25 bp, Mus musculus
cagaaagagagcctgccagggataa

SEQ ID NO: 562951 - DNA, 25 bp, Mus musculus
cagaaagagagcgtgccagggataa

SEQ ID NO: 562952 - DNA, 25 bp, Mus musculus
cagaaagagctgagtgcaaaggaga

SEQ ID NO: 562953 - DNA, 25 bp, Mus musculus
cagaaagagctgtgtgcaaaggaga

SEQ ID NO: 562954 - DNA, 25 bp, Mus musculus
cagaaagaggtccttgcaatgtttc

SEQ ID NO: 562955 - DNA, 25 bp, Mus musculus
cagaaagaggtcgttgcaatgtttc

SEQ ID NO: 562956 - DNA, 25 bp, Mus musculus
cagaaagataacacagacccaggac

SEQ ID NO: 562957 - DNA, 25 bp, Mus musculus
cagaaagataactcagacccaggac

SEQ ID NO: 562958 - DNA, 25 bp, Mus musculus
cagaaagatacacacctggatggcc

SEQ ID NO: 562959 - DNA, 25 bp, Mus musculus
cagaaagatacagacctggatggcc

SEQ ID NO: 562960 - DNA, 25 bp, Mus musculus
cagaaagatgaacgatacagacagc

SEQ ID NO: 562961 - DNA, 25 bp, Mus musculus
cagaaagatgaaggatacagacagc

SEQ ID NO: 562962 - DNA, 25 bp, Mus musculus
cagaaagatggaaagaagaaatgac

SEQ ID NO: 562963 - DNA, 25 bp, Mus musculus
cagaaagatggaacttgggaccggc

SEQ ID NO: 562964 - DNA, 25 bp, Mus musculus
cagaaagatggatagaagaaatgac

SEQ ID NO: 562965 - DNA, 25 bp, Mus musculus
cagaaagatggatcttgggaccggc

SEQ ID NO: 562966 - DNA, 25 bp, Mus musculus
cagaaagattccagtgcaggaaaag

SEQ ID NO: 562967 - DNA, 25 bp, Mus musculus
cagaaagattcctgtgcaggaaaag

SEQ ID NO: 562968 - DNA, 25 bp, Mus musculus
cagaaagcagatcagtacctgcggg

SEQ ID NO: 562969 - DNA, 25 bp, Mus musculus
cagaaagcagatgagtacctgcggg

SEQ ID NO: 562970 - DNA, 25 bp, Mus musculus
cagaaagcatccatgctgagcacta

SEQ ID NO: 562971 - DNA, 25 bp, Mus musculus
cagaaagcatccttgctgagcacta

SEQ ID NO: 562972 - DNA, 25 bp, Mus musculus
cagaaagcccgacagctctgggaca

SEQ ID NO: 562973 - DNA, 25 bp, Mus musculus
cagaaagcccgagagctctgggaca

SEQ ID NO: 562974 - DNA, 25 bp, Mus musculus
cagaaagcctgacagacaaggctgc

SEQ ID NO: 562975 - DNA, 25 bp, Mus musculus
cagaaagcctgagagacaaggctgc

SEQ ID NO: 562976 - DNA, 25 bp, Mus musculus
cagaaagctacgagagctggacctg

SEQ ID NO: 562977 - DNA, 25 bp, Mus musculus
cagaaagctacgtgagctggacctg

SEQ ID NO: 562978 - DNA, 25 bp, Mus musculus
cagaaagctatgcaatattgatgca

SEQ ID NO: 562979 - DNA, 25 bp, Mus musculus
cagaaagctatggaatattgatgca

SEQ ID NO: 562980 - DNA, 25 bp, Mus musculus
cagaaagctcagaagtaatgctgtg

SEQ ID NO: 562981 - DNA, 25 bp, Mus musculus
cagaaagctcagtagtaatgctgtg

SEQ ID NO: 562982 - DNA, 25 bp, Mus musculus
cagaaagctgatattgtctccgaag

SEQ ID NO: 562983 - DNA, 25 bp, Mus musculus
cagaaagctgattttgtctccgaag

SEQ ID NO: 562984 - DNA, 25 bp, Mus musculus
cagaaagctgtcaccgccctgaagg

SEQ ID NO: 562985 - DNA, 25 bp, Mus musculus
cagaaagctgtctccgccctgaagg

SEQ ID NO: 562986 - DNA, 25 bp, Mus musculus
cagaaaggaagtcctgtggataccc

SEQ ID NO: 562987 - DNA, 25 bp, Mus musculus
cagaaaggaagtgctgtggataccc

SEQ ID NO: 562988 - DNA, 25 bp, Mus musculus
cagaaaggagtgcaaagcactagct

SEQ ID NO: 562989 - DNA, 25 bp, Mus musculus
cagaaaggagtggaaagcactagct

SEQ ID NO: 562990 - DNA, 25 bp, Mus musculus
cagaaaggatcaattgaccacaaac

SEQ ID NO: 562991 - DNA, 25 bp, Mus musculus
cagaaaggatcatttgaccacaaac

SEQ ID NO: 562992 - DNA, 25 bp, Mus musculus
cagaaaggccaaagagggtaaattc

SEQ ID NO: 562993 - DNA, 25 bp, Mus musculus
cagaaaggccaatgagggtaaattc

SEQ ID NO: 562994 - DNA, 25 bp, Mus musculus
cagaaaggtgaacagtatgccccaa

SEQ ID NO: 562995 - DNA, 25 bp, Mus musculus
cagaaaggtgaagagtatgccccaa

SEQ ID NO: 562996 - DNA, 25 bp, Mus musculus
cagaaagtagagactgtgacaagct

SEQ ID NO: 562997 - DNA, 25 bp, Mus musculus
cagaaagtagagtctgtgacaagct

SEQ ID NO: 562998 - DNA, 25 bp, Mus musculus
cagaaagtaggaactgcacttagag

SEQ ID NO: 562999 - DNA, 25 bp, Mus musculus
cagaaagtaggatctgcacttagag

SEQ ID NO: 563000 - DNA, 25 bp, Mus musculus
cagaaagtccttacggacccggcag

SEQ ID NO: 563001 - DNA, 25 bp, Mus musculus
cagaaagtccttcaagcactgcatt

SEQ ID NO: 563002 - DNA, 25 bp, Mus musculus
cagaaagtccttgaagcactgcatt

SEQ ID NO: 563003 - DNA, 25 bp, Mus musculus
cagaaagtcctttcggacccggcag

SEQ ID NO: 563004 - DNA, 25 bp, Mus musculus
cagaaagtctgtcctgagtccaata

SEQ ID NO: 563005 - DNA, 25 bp, Mus musculus
cagaaagtctgtgctgagtccaata

SEQ ID NO: 563006 - DNA, 25 bp, Mus musculus
cagaaagtgacgacatagacagaac

SEQ ID NO: 563007 - DNA, 25 bp, Mus musculus
cagaaagtgacgtcatagacagaac

SEQ ID NO: 563008 - DNA, 25 bp, Mus musculus
cagaaagtggctcaggattacgtca

SEQ ID NO: 563009 - DNA, 25 bp, Mus musculus
cagaaagtggctgaggattacgtca

SEQ ID NO: 563010 - DNA, 25 bp, Mus musculus
cagaaagttaagagacccaagaggg

SEQ ID NO: 563011 - DNA, 25 bp, Mus musculus
cagaaagttaagtgacccaagaggg

SEQ ID NO: 563012 - DNA, 25 bp, Mus musculus
cagaaagttgcaagtaatccaggct

SEQ ID NO: 563013 - DNA, 25 bp, Mus musculus
cagaaagttgcatgtaatccaggct

SEQ ID NO: 563014 - DNA, 25 bp, Mus musculus
cagaaataaataaggctcgagagga

SEQ ID NO: 563015 - DNA, 25 bp, Mus musculus
cagaaataaatatggctcgagagga

SEQ ID NO: 563016 - DNA, 25 bp, Mus musculus
cagaaataagtcaccttttaaggca

SEQ ID NO: 563017 - DNA, 25 bp, Mus musculus
cagaaataagtctccttttaaggca

SEQ ID NO: 563018 - DNA, 25 bp, Mus musculus
cagaaatagaccagcccgtgggagg

SEQ ID NO: 563019 - DNA, 25 bp, Mus musculus
cagaaatagacctgcccgtgggagg

SEQ ID NO: 563020 - DNA, 25 bp, Mus musculus
cagaaatagttccaggcctagagga

SEQ ID NO: 563021 - DNA, 25 bp, Mus musculus
cagaaatagttcgaggcctagagga

SEQ ID NO: 563022 - DNA, 25 bp, Mus musculus
cagaaatatgacattcctgccacag

SEQ ID NO: 563023 - DNA, 25 bp, Mus musculus
cagaaatatgactttcctgccacag

SEQ ID NO: 563024 - DNA, 25 bp, Mus musculus
cagaaatatgtacgcctcctgtagc

SEQ ID NO: 563025 - DNA, 25 bp, Mus musculus
cagaaatatgtaggcctcctgtagc

SEQ ID NO: 563026 - DNA, 25 bp, Mus musculus
cagaaatcatatatgtcgactggaa

SEQ ID NO: 563027 - DNA, 25 bp, Mus musculus
cagaaatcatatttgtcgactggaa

SEQ ID NO: 563028 - DNA, 25 bp, Mus musculus
cagaaatcctgaccgtcctcagtca

SEQ ID NO: 563029 - DNA, 25 bp, Mus musculus
cagaaatcctgagcgtcctcagtca

SEQ ID NO: 563030 - DNA, 25 bp, Mus musculus
cagaaatcctgcatggcgatgagta

SEQ ID NO: 563031 - DNA, 25 bp, Mus musculus
cagaaatcctgcttggcgatgagta

SEQ ID NO: 563032 - DNA, 25 bp, Mus musculus
cagaaatccttaacaagtatgtggg

SEQ ID NO: 563033 - DNA, 25 bp, Mus musculus
cagaaatccttatcaagtatgtggg

SEQ ID NO: 563034 - DNA, 25 bp, Mus musculus
cagaaatcgggacaagtgctaagtc

SEQ ID NO: 563035 - DNA, 25 bp, Mus musculus
cagaaatcgggagaagtgctaagtc

SEQ ID NO: 563036 - DNA, 25 bp, Mus musculus
cagaaatctcagataaccgagccag

SEQ ID NO: 563037 - DNA, 25 bp, Mus musculus
cagaaatctcagttaaccgagccag

SEQ ID NO: 563038 - DNA, 25 bp, Mus musculus
cagaaatctgggatcgcctggagag

SEQ ID NO: 563039 - DNA, 25 bp, Mus musculus
cagaaatctgggttcgcctggagag

SEQ ID NO: 563040 - DNA, 25 bp, Mus musculus
cagaaatgactgcaaaaatggtccc

SEQ ID NO: 563041 - DNA, 25 bp, Mus musculus
cagaaatgactggaaaaatggtccc

SEQ ID NO: 563042 - DNA, 25 bp, Mus musculus
cagaaatgagaccaaggagcgccaa

SEQ ID NO: 563043 - DNA, 25 bp, Mus musculus
cagaaatgagacgaaggagcgccaa

SEQ ID NO: 563044 - DNA, 25 bp, Mus musculus
cagaaatgaggtcatccgggcaaca

SEQ ID NO: 563045 - DNA, 25 bp, Mus musculus
cagaaatgaggtgatccgggcaaca

SEQ ID NO: 563046 - DNA, 25 bp, Mus musculus
cagaaatgatctagttgggagagat

SEQ ID NO: 563047 - DNA, 25 bp, Mus musculus
cagaaatgatcttgttgggagagat

SEQ ID NO: 563048 - DNA, 25 bp, Mus musculus
cagaaatgcaaacacagaaaacgat

SEQ ID NO: 563049 - DNA, 25 bp, Mus musculus
cagaaatgcaaagacagaaaacgat

SEQ ID NO: 563050 - DNA, 25 bp, Mus musculus
cagaaatgcagaccaaagtcaaggt

SEQ ID NO: 563051 - DNA, 25 bp, Mus musculus
cagaaatgcagagcaaagtcaaggt

SEQ ID NO: 563052 - DNA, 25 bp, Mus musculus
cagaaatgcccacgctattgctgac

SEQ ID NO: 563053 - DNA, 25 bp, Mus musculus
cagaaatgcccaggctattgctgac

SEQ ID NO: 563054 - DNA, 25 bp, Mus musculus
cagaaatgctgacgaacttcatcca

SEQ ID NO: 563055 - DNA, 25 bp, Mus musculus
cagaaatgctgacgtaggtttccca

SEQ ID NO: 563056 - DNA, 25 bp, Mus musculus
cagaaatgctgaggaacttcatcca

SEQ ID NO: 563057 - DNA, 25 bp, Mus musculus
cagaaatgctgaggtaggtttccca

SEQ ID NO: 563058 - DNA, 25 bp, Mus musculus
cagaaatgctggcaagaaaagtttg

SEQ ID NO: 563059 - DNA, 25 bp, Mus musculus
cagaaatgctgggaagaaaagtttg

SEQ ID NO: 563060 - DNA, 25 bp, Mus musculus
cagaaatggcccagtgcacgctgta

SEQ ID NO: 563061 - DNA, 25 bp, Mus musculus
cagaaatggccctgtgcacgctgta

SEQ ID NO: 563062 - DNA, 25 bp, Mus musculus
cagaaatggctaccgcgatgacagt

SEQ ID NO: 563063 - DNA, 25 bp, Mus musculus
cagaaatggctagcgcgatgacagt

SEQ ID NO: 563064 - DNA, 25 bp, Mus musculus
cagaaatgggtcatatgacattggc

SEQ ID NO: 563065 - DNA, 25 bp, Mus musculus
cagaaatgggtcttatgacattggc

SEQ ID NO: 563066 - DNA, 25 bp, Mus musculus
cagaaatgtcatctgctgtgaaaag

SEQ ID NO: 563067 - DNA, 25 bp, Mus musculus
cagaaatgtcatgtgctgtgaaaag

SEQ ID NO: 563068 - DNA, 25 bp, Mus musculus
cagaaatgtgttctggtactcccat

SEQ ID NO: 563069 - DNA, 25 bp, Mus musculus
cagaaatgtgttgtggtactcccat

SEQ ID NO: 563070 - DNA, 25 bp, Mus musculus
cagaaattacaacagaagatatcaa

SEQ ID NO: 563071 - DNA, 25 bp, Mus musculus
cagaaattacaagagaagatatcaa

SEQ ID NO: 563072 - DNA, 25 bp, Mus musculus
cagaaattagccctggctactcgta

SEQ ID NO: 563073 - DNA, 25 bp, Mus musculus
cagaaattagccgtggctactcgta

SEQ ID NO: 563074 - DNA, 25 bp, Mus musculus
cagaaattcacgaccattggtcaaa

SEQ ID NO: 563075 - DNA, 25 bp, Mus musculus
cagaaattcacgtccattggtcaaa

SEQ ID NO: 563076 - DNA, 25 bp, Mus musculus
cagaaattctggaaatcaagggaca

SEQ ID NO: 563077 - DNA, 25 bp, Mus musculus
cagaaattctggtaatcaagggaca

SEQ ID NO: 563078 - DNA, 25 bp, Mus musculus
cagaaattcttcacccgagagtgag

SEQ ID NO: 563079 - DNA, 25 bp, Mus musculus
cagaaattcttctcccgagagtgag

SEQ ID NO: 563080 - DNA, 25 bp, Mus musculus
cagaaattgggcctatgtcttgctt

SEQ ID NO: 563081 - DNA, 25 bp, Mus musculus
cagaaattgggcgtatgtcttgctt

SEQ ID NO: 563082 - DNA, 25 bp, Mus musculus
cagaaattgtttactccatatacag

SEQ ID NO: 563083 - DNA, 25 bp, Mus musculus
cagaaattgttttctccatatacag

SEQ ID NO: 563084 - DNA, 25 bp, Mus musculus
cagaaatttctgcagactcaggatg

SEQ ID NO: 563085 - DNA, 25 bp, Mus musculus
cagaaatttctggagactcaggatg

SEQ ID NO: 563086 - DNA, 25 bp, Mus musculus
cagaaatttgggaaggccacaatgt

SEQ ID NO: 563087 - DNA, 25 bp, Mus musculus
cagaaatttgggtaggccacaatgt

SEQ ID NO: 563088 - DNA, 25 bp, Mus musculus
cagaacaactagaagcattgaaagc

SEQ ID NO: 563089 - DNA, 25 bp, Mus musculus
cagaacaactagtagcattgaaagc

SEQ ID NO: 563090 - DNA, 25 bp, Mus musculus
cagaacaactgaacagccggtggac

SEQ ID NO: 563091 - DNA, 25 bp, Mus musculus
cagaacaactgatcagccggtggac

SEQ ID NO: 563092 - DNA, 25 bp, Mus musculus
cagaacaactgcaacaatacagcag

SEQ ID NO: 563093 - DNA, 25 bp, Mus musculus
cagaacaactgctacaatacagcag

SEQ ID NO: 563094 - DNA, 25 bp, Mus musculus
cagaacaactttaccctggaggtca

SEQ ID NO: 563095 - DNA, 25 bp, Mus musculus
cagaacaacttttccctggaggtca

SEQ ID NO: 563096 - DNA, 25 bp, Mus musculus
cagaacaagaacaacaattgtggaa

SEQ ID NO: 563097 - DNA, 25 bp, Mus musculus
cagaacaagaactacaattgtggaa

SEQ ID NO: 563098 - DNA, 25 bp, Mus musculus
cagaacaagctacaagaaatgatta

SEQ ID NO: 563099 - DNA, 25 bp, Mus musculus
cagaacaagctagaagaaatgatta

SEQ ID NO: 563100 - DNA, 25 bp, Mus musculus
cagaacaatggaatcaacgaaggag

SEQ ID NO: 563101 - DNA, 25 bp, Mus musculus
cagaacaatggattcaacgaaggag

SEQ ID NO: 563102 - DNA, 25 bp, Mus musculus
cagaacaattacaaccccgaggaga

SEQ ID NO: 563103 - DNA, 25 bp, Mus musculus
cagaacaattaccagccctactaaa

SEQ ID NO: 563104 - DNA, 25 bp, Mus musculus
cagaacaattacgagccctactaaa

SEQ ID NO: 563105 - DNA, 25 bp, Mus musculus
cagaacaattactaccccgaggaga

SEQ ID NO: 563106 - DNA, 25 bp, Mus musculus
cagaacacattgacgatgagcaaaa

SEQ ID NO: 563107 - DNA, 25 bp, Mus musculus
cagaacacattgtcgatgagcaaaa

SEQ ID NO: 563108 - DNA, 25 bp, Mus musculus
cagaacaccgtgagtaactgccatg

SEQ ID NO: 563109 - DNA, 25 bp, Mus musculus
cagaacaccgtgtgtaactgccatg

SEQ ID NO: 563110 - DNA, 25 bp, Mus musculus
cagaacactgaaagggaagcggctc

SEQ ID NO: 563111 - DNA, 25 bp, Mus musculus
cagaacactgaatgggaagcggctc

SEQ ID NO: 563112 - DNA, 25 bp, Mus musculus
cagaacactggtagtaagccagccc

SEQ ID NO: 563113 - DNA, 25 bp, Mus musculus
cagaacactggttgtaagccagccc

SEQ ID NO: 563114 - DNA, 25 bp, Mus musculus
cagaacagactgatggagcggacac

SEQ ID NO: 563115 - DNA, 25 bp, Mus musculus
cagaacagactgttggagcggacac

SEQ ID NO: 563116 - DNA, 25 bp, Mus musculus
cagaacagagccacgagggcacaaa

SEQ ID NO: 563117 - DNA, 25 bp, Mus musculus
cagaacagagcctcgagggcacaaa

SEQ ID NO: 563118 - DNA, 25 bp, Mus musculus
cagaacagtctaattactccaaagg

SEQ ID NO: 563119 - DNA, 25 bp, Mus musculus
cagaacagtctatttactccaaagg

SEQ ID NO: 563120 - DNA, 25 bp, Mus musculus
cagaacagtgggaaaaaccaatggc

SEQ ID NO: 563121 - DNA, 25 bp, Mus musculus
cagaacagtgggtaaaaccaatggc

SEQ ID NO: 563122 - DNA, 25 bp, Mus musculus
cagaacagttttatgacttcttcag

SEQ ID NO: 563123 - DNA, 25 bp, Mus musculus
cagaacagttttttgacttcttcag

SEQ ID NO: 563124 - DNA, 25 bp, Mus musculus
cagaacataacaacccggttgtcat

SEQ ID NO: 563125 - DNA, 25 bp, Mus musculus
cagaacataacatcccggttgtcat

SEQ ID NO: 563126 - DNA, 25 bp, Mus musculus
cagaacataatgaagaatcttccag

SEQ ID NO: 563127 - DNA, 25 bp, Mus musculus
cagaacataatgcagtcctttgaaa

SEQ ID NO: 563128 - DNA, 25 bp, Mus musculus
cagaacataatggagtcctttgaaa

SEQ ID NO: 563129 - DNA, 25 bp, Mus musculus
cagaacataatgtagaatcttccag

SEQ ID NO: 563130 - DNA, 25 bp, Mus musculus
cagaacataggccatgtgtatggtg

SEQ ID NO: 563131 - DNA, 25 bp, Mus musculus
cagaacataggcgatgtgtatggtg

SEQ ID NO: 563132 - DNA, 25 bp, Mus musculus
cagaacatcaggcagtgaggagact

SEQ ID NO: 563133 - DNA, 25 bp, Mus musculus
cagaacatcagggagtgaggagact

SEQ ID NO: 563134 - DNA, 25 bp, Mus musculus
cagaacatcagtagcaatcaccatg

SEQ ID NO: 563135 - DNA, 25 bp, Mus musculus
cagaacatcagttgcaatcaccatg

SEQ ID NO: 563136 - DNA, 25 bp, Mus musculus
cagaacatccataagtctctacaag

SEQ ID NO: 563137 - DNA, 25 bp, Mus musculus
cagaacatccattagtctctacaag

SEQ ID NO: 563138 - DNA, 25 bp, Mus musculus
cagaacatcgccagtctccgaagta

SEQ ID NO: 563139 - DNA, 25 bp, Mus musculus
cagaacatcgcctgtctccgaagta

SEQ ID NO: 563140 - DNA, 25 bp, Mus musculus
cagaacatctcccaacaggctcagt

SEQ ID NO: 563141 - DNA, 25 bp, Mus musculus
cagaacatctccgaacaggctcagt

SEQ ID NO: 563142 - DNA, 25 bp, Mus musculus
cagaacatttggcataacctctata

SEQ ID NO: 563143 - DNA, 25 bp, Mus musculus
cagaacatttgggataacctctata

SEQ ID NO: 563144 - DNA, 25 bp, Mus musculus
cagaacattttcatggatctttgcc

SEQ ID NO: 563145 - DNA, 25 bp, Mus musculus
cagaacattttcttggatctttgcc

SEQ ID NO: 563146 - DNA, 25 bp, Mus musculus
cagaaccaaatgacagaggcacaca

SEQ ID NO: 563147 - DNA, 25 bp, Mus musculus
cagaaccaaatgtcagaggcacaca

SEQ ID NO: 563148 - DNA, 25 bp, Mus musculus
cagaaccaatagaggcacagttggt

SEQ ID NO: 563149 - DNA, 25 bp, Mus musculus
cagaaccaatagtggcacagttggt

SEQ ID NO: 563150 - DNA, 25 bp, Mus musculus
cagaaccaattactgatcaacttga

SEQ ID NO: 563151 - DNA, 25 bp, Mus musculus
cagaaccaattagtgatcaacttga

SEQ ID NO: 563152 - DNA, 25 bp, Mus musculus
cagaaccacatcatggcagagcgca

SEQ ID NO: 563153 - DNA, 25 bp, Mus musculus
cagaaccacatcttggcagagcgca

SEQ ID NO: 563154 - DNA, 25 bp, Mus musculus
cagaaccaccgacgagctagatcga

SEQ ID NO: 563155 - DNA, 25 bp, Mus musculus
cagaaccaccgaggagctagatcga

SEQ ID NO: 563156 - DNA, 25 bp, Mus musculus
cagaaccagcaccaggagctgcaga

SEQ ID NO: 563157 - DNA, 25 bp, Mus musculus
cagaaccagcacgaggagctgcaga

SEQ ID NO: 563158 - DNA, 25 bp, Mus musculus
cagaaccagggtcggcctcaggaaa

SEQ ID NO: 563159 - DNA, 25 bp, Mus musculus
cagaaccagggtctctgtgtccgct

SEQ ID NO: 563160 - DNA, 25 bp, Mus musculus
cagaaccagggtgggcctcaggaaa

SEQ ID NO: 563161 - DNA, 25 bp, Mus musculus
cagaaccagggtgtctgtgtccgct

SEQ ID NO: 563162 - DNA, 25 bp, Mus musculus
cagaaccattaacagccagagtgcc

SEQ ID NO: 563163 - DNA, 25 bp, Mus musculus
cagaaccattaagagccagagtgcc

SEQ ID NO: 563164 - DNA, 25 bp, Mus musculus
cagaacccctgaaatcagcaaagcc

SEQ ID NO: 563165 - DNA, 25 bp, Mus musculus
cagaacccctgaccaagagagctgt

SEQ ID NO: 563166 - DNA, 25 bp, Mus musculus
cagaacccctgagcaagagagctgt

SEQ ID NO: 563167 - DNA, 25 bp, Mus musculus
cagaacccctgatatcagcaaagcc

SEQ ID NO: 563168 - DNA, 25 bp, Mus musculus
cagaacccgaagatcttgcgataat

SEQ ID NO: 563169 - DNA, 25 bp, Mus musculus
cagaacccgaagttcttgcgataat

SEQ ID NO: 563170 - DNA, 25 bp, Mus musculus
cagaacccgtctcagcagtgtctct

SEQ ID NO: 563171 - DNA, 25 bp, Mus musculus
cagaacccgtctgagcagtgtctct

SEQ ID NO: 563172 - DNA, 25 bp, Mus musculus
cagaacccgtgactacgcgggcaga

SEQ ID NO: 563173 - DNA, 25 bp, Mus musculus
cagaacccgtgagtacgcgggcaga

SEQ ID NO: 563174 - DNA, 25 bp, Mus musculus
cagaacccttctatgctgcttttgg

SEQ ID NO: 563175 - DNA, 25 bp, Mus musculus
cagaacccttctttgctgcttttgg

SEQ ID NO: 563176 - DNA, 25 bp, Mus musculus
cagaaccgcactcggctggtctatg

SEQ ID NO: 563177 - DNA, 25 bp, Mus musculus
cagaaccgcactgggctggtctatg

SEQ ID NO: 563178 - DNA, 25 bp, Mus musculus
cagaaccgttacactaaggagcaca

SEQ ID NO: 563179 - DNA, 25 bp, Mus musculus
cagaaccgttactctaaggagcaca

SEQ ID NO: 563180 - DNA, 25 bp, Mus musculus
cagaacctatagcagagtggcagaa

SEQ ID NO: 563181 - DNA, 25 bp, Mus musculus
cagaacctataggagagtggcagaa

SEQ ID NO: 563182 - DNA, 25 bp, Mus musculus
cagaacctatgccttgatgaagaag

SEQ ID NO: 563183 - DNA, 25 bp, Mus musculus
cagaacctatgcgttgatgaagaag

SEQ ID NO: 563184 - DNA, 25 bp, Mus musculus
cagaacctggtgatgggcataggca

SEQ ID NO: 563185 - DNA, 25 bp, Mus musculus
cagaacctggtgttgggcataggca

SEQ ID NO: 563186 - DNA, 25 bp, Mus musculus
cagaacctgtatagcctgatgccta

SEQ ID NO: 563187 - DNA, 25 bp, Mus musculus
cagaacctgtattgcctgatgccta

SEQ ID NO: 563188 - DNA, 25 bp, Mus musculus
cagaacctgtcaactccttctatga

SEQ ID NO: 563189 - DNA, 25 bp, Mus musculus
cagaacctgtcatctccttctatga

SEQ ID NO: 563190 - DNA, 25 bp, Mus musculus
cagaaccttggcctgaaaatgcgac

SEQ ID NO: 563191 - DNA, 25 bp, Mus musculus
cagaaccttggcgtgaaaatgcgac

SEQ ID NO: 563192 - DNA, 25 bp, Mus musculus
cagaaccttgggagctaagctgtgc

SEQ ID NO: 563193 - DNA, 25 bp, Mus musculus
cagaaccttgggtgctaagctgtgc

SEQ ID NO: 563194 - DNA, 25 bp, Mus musculus
cagaaccttggtaacctttggcctg

SEQ ID NO: 563195 - DNA, 25 bp, Mus musculus
cagaaccttggttacctttggcctg

SEQ ID NO: 563196 - DNA, 25 bp, Mus musculus
cagaacgagaatctgagctggcatt

SEQ ID NO: 563197 - DNA, 25 bp, Mus musculus
cagaacgagaatgtgagctggcatt

SEQ ID NO: 563198 - DNA, 25 bp, Mus musculus
cagaacgccctgatacaccttgtgc

SEQ ID NO: 563199 - DNA, 25 bp, Mus musculus
cagaacgccctgttacaccttgtgc

SEQ ID NO: 563200 - DNA, 25 bp, Mus musculus
cagaacgcggacatgatcgtggtga

SEQ ID NO: 563201 - DNA, 25 bp, Mus musculus
cagaacgcggacttgatcgtggtga

SEQ ID NO: 563202 - DNA, 25 bp, Mus musculus
cagaacgcttttccccttggctggg

SEQ ID NO: 563203 - DNA, 25 bp, Mus musculus
cagaacgcttttgcccttggctggg

SEQ ID NO: 563204 - DNA, 25 bp, Mus musculus
cagaacggaacacaaacctggatca

SEQ ID NO: 563205 - DNA, 25 bp, Mus musculus
cagaacggaacagaaacctggatca

SEQ ID NO: 563206 - DNA, 25 bp, Mus musculus
cagaacggaggaccgatcataaccg

SEQ ID NO: 563207 - DNA, 25 bp, Mus musculus
cagaacggaggagcgatcataaccg

SEQ ID NO: 563208 - DNA, 25 bp, Mus musculus
cagaacggcggtcagtgatggatgc

SEQ ID NO: 563209 - DNA, 25 bp, Mus musculus
cagaacggcggtgagtgatggatgc

SEQ ID NO: 563210 - DNA, 25 bp, Mus musculus
cagaacggtcttactctacccatgg

SEQ ID NO: 563211 - DNA, 25 bp, Mus musculus
cagaacggtctttctctacccatgg

SEQ ID NO: 563212 - DNA, 25 bp, Mus musculus
cagaacgtattcactagctgactat

SEQ ID NO: 563213 - DNA, 25 bp, Mus musculus
cagaacgtattctctagctgactat

SEQ ID NO: 563214 - DNA, 25 bp, Mus musculus
cagaacgtgcagattctgctcgagg

SEQ ID NO: 563215 - DNA, 25 bp, Mus musculus
cagaacgtgcagtttctgctcgagg

SEQ ID NO: 563216 - DNA, 25 bp, Mus musculus
cagaacgtggagcatgttggtgacc

SEQ ID NO: 563217 - DNA, 25 bp, Mus musculus
cagaacgtggaggatgttggtgacc

SEQ ID NO: 563218 - DNA, 25 bp, Mus musculus
cagaacgtggatcccctcaagttgc

SEQ ID NO: 563219 - DNA, 25 bp, Mus musculus
cagaacgtggatgccctcaagttgc

SEQ ID NO: 563220 - DNA, 25 bp, Mus musculus
cagaacgtggtgagaagtcgaagca

SEQ ID NO: 563221 - DNA, 25 bp, Mus musculus
cagaacgtggtgtgaagtcgaagca

SEQ ID NO: 563222 - DNA, 25 bp, Mus musculus
cagaactacaatcgcaatgatgaga

SEQ ID NO: 563223 - DNA, 25 bp, Mus musculus
cagaactacaatggcaatgatgaga

SEQ ID NO: 563224 - DNA, 25 bp, Mus musculus
cagaactagcttcttggtatcaact

SEQ ID NO: 563225 - DNA, 25 bp, Mus musculus
cagaactagcttgttggtatcaact

SEQ ID NO: 563226 - DNA, 25 bp, Mus musculus
cagaactaggacaggcctggtgttg

SEQ ID NO: 563227 - DNA, 25 bp, Mus musculus
cagaactaggactggcctggtgttg

SEQ ID NO: 563228 - DNA, 25 bp, Mus musculus
cagaactcaggtcctcgagagatcc

SEQ ID NO: 563229 - DNA, 25 bp, Mus musculus
cagaactcaggtgctcgagagatcc

SEQ ID NO: 563230 - DNA, 25 bp, Mus musculus
cagaactccactatggagctccagt

SEQ ID NO: 563231 - DNA, 25 bp, Mus musculus
cagaactccactttggagctccagt

SEQ ID NO: 563232 - DNA, 25 bp, Mus musculus
cagaactccgaacctggatagaggg

SEQ ID NO: 563233 - DNA, 25 bp, Mus musculus
cagaactccgaagctggatagaggg

SEQ ID NO: 563234 - DNA, 25 bp, Mus musculus
cagaactccgggaccagctgcggcg

SEQ ID NO: 563235 - DNA, 25 bp, Mus musculus
cagaactccgggtccagctgcggcg

SEQ ID NO: 563236 - DNA, 25 bp, Mus musculus
cagaactcctgtcgaatgaccagtg

SEQ ID NO: 563237 - DNA, 25 bp, Mus musculus
cagaactcctgtggaatgaccagtg

SEQ ID NO: 563238 - DNA, 25 bp, Mus musculus
cagaactcggttcctttgctgtttg

SEQ ID NO: 563239 - DNA, 25 bp, Mus musculus
cagaactcggttgctttgctgtttg

SEQ ID NO: 563240 - DNA, 25 bp, Mus musculus
cagaactgagtaaaaggatggcccc

SEQ ID NO: 563241 - DNA, 25 bp, Mus musculus
cagaactgagtataaggatggcccc

SEQ ID NO: 563242 - DNA, 25 bp, Mus musculus
cagaactgagtcatcctttggagta

SEQ ID NO: 563243 - DNA, 25 bp, Mus musculus
cagaactgagtcttcctttggagta

SEQ ID NO: 563244 - DNA, 25 bp, Mus musculus
cagaactgatccaggtacgtgtgaa

SEQ ID NO: 563245 - DNA, 25 bp, Mus musculus
cagaactgatcctggtacgtgtgaa

SEQ ID NO: 563246 - DNA, 25 bp, Mus musculus
cagaactgcaccatggtgtttagtt

SEQ ID NO: 563247 - DNA, 25 bp, Mus musculus
cagaactgcaccttggtgtttagtt

SEQ ID NO: 563248 - DNA, 25 bp, Mus musculus
cagaactgcagaaggtgatggagaa

SEQ ID NO: 563249 - DNA, 25 bp, Mus musculus
cagaactgcagatggtgatggagaa

SEQ ID NO: 563250 - DNA, 25 bp, Mus musculus
cagaactgcctgcatgagggactca

SEQ ID NO: 563251 - DNA, 25 bp, Mus musculus
cagaactgcctggatgagggactca

SEQ ID NO: 563252 - DNA, 25 bp, Mus musculus
cagaactgctcaaaagtacttgacg

SEQ ID NO: 563253 - DNA, 25 bp, Mus musculus
cagaactgctcataagtacttgacg

SEQ ID NO: 563254 - DNA, 25 bp, Mus musculus
cagaactggataaggtaccaggaag

SEQ ID NO: 563255 - DNA, 25 bp, Mus musculus
cagaactggatatggtaccaggaag

SEQ ID NO: 563256 - DNA, 25 bp, Mus musculus
cagaactggccgcactatgctcatt

SEQ ID NO: 563257 - DNA, 25 bp, Mus musculus
cagaactggccggactatgctcatt

SEQ ID NO: 563258 - DNA, 25 bp, Mus musculus
cagaactggctgagtgcataggctc

SEQ ID NO: 563259 - DNA, 25 bp, Mus musculus
cagaactggctgtgtgcataggctc

SEQ ID NO: 563260 - DNA, 25 bp, Mus musculus
cagaactggtacagaaggagactgc

SEQ ID NO: 563261 - DNA, 25 bp, Mus musculus
cagaactggtactgaaggagactgc

SEQ ID NO: 563262 - DNA, 25 bp, Mus musculus
cagaactgtgctagggacctgagtc

SEQ ID NO: 563263 - DNA, 25 bp, Mus musculus
cagaactgtgcttgggacctgagtc

SEQ ID NO: 563264 - DNA, 25 bp, Mus musculus
cagaacttagagaagccctcgaccg

SEQ ID NO: 563265 - DNA, 25 bp, Mus musculus
cagaacttagagtagccctcgaccg

SEQ ID NO: 563266 - DNA, 25 bp, Mus musculus
cagaacttcaggaggtgcagatcac

SEQ ID NO: 563267 - DNA, 25 bp, Mus musculus
cagaacttcaggctactgaagaaga

SEQ ID NO: 563268 - DNA, 25 bp, Mus musculus
cagaacttcagggtactgaagaaga

SEQ ID NO: 563269 - DNA, 25 bp, Mus musculus
cagaacttcaggtggtgcagatcac

SEQ ID NO: 563270 - DNA, 25 bp, Mus musculus
cagaacttctacagggacttaaggc

SEQ ID NO: 563271 - DNA, 25 bp, Mus musculus
cagaacttctactgggacttaaggc

SEQ ID NO: 563272 - DNA, 25 bp, Mus musculus
cagaacttctctacattacatggag

SEQ ID NO: 563273 - DNA, 25 bp, Mus musculus
cagaacttctcttcattacatggag

SEQ ID NO: 563274 - DNA, 25 bp, Mus musculus
cagaacttgaatacttagggccaga

SEQ ID NO: 563275 - DNA, 25 bp, Mus musculus
cagaacttgaattcttagggccaga

SEQ ID NO: 563276 - DNA, 25 bp, Mus musculus
cagaacttgcccctgagaagaaggg

SEQ ID NO: 563277 - DNA, 25 bp, Mus musculus
cagaacttgcccgtgagaagaaggg

SEQ ID NO: 563278 - DNA, 25 bp, Mus musculus
cagaacttgctgaattggctagact

SEQ ID NO: 563279 - DNA, 25 bp, Mus musculus
cagaacttgctgtattggctagact

SEQ ID NO: 563280 - DNA, 25 bp, Mus musculus
cagaactttctgagctggcaaaggc

SEQ ID NO: 563281 - DNA, 25 bp, Mus musculus
cagaactttctgtgctggcaaaggc

SEQ ID NO: 563282 - DNA, 25 bp, Mus musculus
cagaagaaacttcgtccactgagtt

SEQ ID NO: 563283 - DNA, 25 bp, Mus musculus
cagaagaaacttggtccactgagtt

SEQ ID NO: 563284 - DNA, 25 bp, Mus musculus
cagaagaaatccagtgcaatgggag

SEQ ID NO: 563285 - DNA, 25 bp, Mus musculus
cagaagaaatcctgtgcaatgggag

SEQ ID NO: 563286 - DNA, 25 bp, Mus musculus
cagaagaactagattccccacctgg

SEQ ID NO: 563287 - DNA, 25 bp, Mus musculus
cagaagaactagtttccccacctgg

SEQ ID NO: 563288 - DNA, 25 bp, Mus musculus
cagaagaagacgataagcagatcac

SEQ ID NO: 563289 - DNA, 25 bp, Mus musculus
cagaagaagacgttaagcagatcac

SEQ ID NO: 563290 - DNA, 25 bp, Mus musculus
cagaagaaggaaccgtggaatgccc

SEQ ID NO: 563291 - DNA, 25 bp, Mus musculus
cagaagaaggaagcgtggaatgccc

SEQ ID NO: 563292 - DNA, 25 bp, Mus musculus
cagaagaagggaaactcgacggtgt

SEQ ID NO: 563293 - DNA, 25 bp, Mus musculus
cagaagaagggatactcgacggtgt

SEQ ID NO: 563294 - DNA, 25 bp, Mus musculus
cagaagaagtcacggacctttggca

SEQ ID NO: 563295 - DNA, 25 bp, Mus musculus
cagaagaagtcagggacctttggca

SEQ ID NO: 563296 - DNA, 25 bp, Mus musculus
cagaagaagtgcatcagcatcgaca

SEQ ID NO: 563297 - DNA, 25 bp, Mus musculus
cagaagaagtgcttcagcatcgaca

SEQ ID NO: 563298 - DNA, 25 bp, Mus musculus
cagaagaattaaagcccttaacagt

SEQ ID NO: 563299 - DNA, 25 bp, Mus musculus
cagaagaattaatgcccttaacagt

SEQ ID NO: 563300 - DNA, 25 bp, Mus musculus
cagaagacaccaagtagagaagagg

SEQ ID NO: 563301 - DNA, 25 bp, Mus musculus
cagaagacaccatgtagagaagagg

SEQ ID NO: 563302 - DNA, 25 bp, Mus musculus
cagaagacacccatcgaaagcttgt

SEQ ID NO: 563303 - DNA, 25 bp, Mus musculus
cagaagacacccttcgaaagcttgt

SEQ ID NO: 563304 - DNA, 25 bp, Mus musculus
cagaagacacggctcagtgagcacc

SEQ ID NO: 563305 - DNA, 25 bp, Mus musculus
cagaagacacgggtcagtgagcacc

SEQ ID NO: 563306 - DNA, 25 bp, Mus musculus
cagaagacaggcctcctagctgctg

SEQ ID NO: 563307 - DNA, 25 bp, Mus musculus
cagaagacaggcgtcctagctgctg

SEQ ID NO: 563308 - DNA, 25 bp, Mus musculus
cagaagaccaagagggcggagaaag

SEQ ID NO: 563309 - DNA, 25 bp, Mus musculus
cagaagaccaagtgggcggagaaag

SEQ ID NO: 563310 - DNA, 25 bp, Mus musculus
cagaagaccacgactccatgggagg

SEQ ID NO: 563311 - DNA, 25 bp, Mus musculus
cagaagaccacgtctccatgggagg

SEQ ID NO: 563312 - DNA, 25 bp, Mus musculus
cagaagaccagaaagccctgtcaga

SEQ ID NO: 563313 - DNA, 25 bp, Mus musculus
cagaagaccagatagccctgtcaga

SEQ ID NO: 563314 - DNA, 25 bp, Mus musculus
cagaagaccgctccggaacacctga

SEQ ID NO: 563315 - DNA, 25 bp, Mus musculus
cagaagaccgctgcggaacacctga

SEQ ID NO: 563316 - DNA, 25 bp, Mus musculus
cagaagacctcactgtgttctaccc

SEQ ID NO: 563317 - DNA, 25 bp, Mus musculus
cagaagacctcagtgtgttctaccc

SEQ ID NO: 563318 - DNA, 25 bp, Mus musculus
cagaagacctgcaggatcacgaggc

SEQ ID NO: 563319 - DNA, 25 bp, Mus musculus
cagaagacctgctggatcacgaggc

SEQ ID NO: 563320 - DNA, 25 bp, Mus musculus
cagaagacctggatgaagtgaaccc

SEQ ID NO: 563321 - DNA, 25 bp, Mus musculus
cagaagacctggttgaagtgaaccc

SEQ ID NO: 563322 - DNA, 25 bp, Mus musculus
cagaagaccttcactgtcattgaga

SEQ ID NO: 563323 - DNA, 25 bp, Mus musculus
cagaagaccttctctgtcattgaga

SEQ ID NO: 563324 - DNA, 25 bp, Mus musculus
cagaagacctttcactggaagaggg

SEQ ID NO: 563325 - DNA, 25 bp, Mus musculus
cagaagacctttgactggaagaggg

SEQ ID NO: 563326 - DNA, 25 bp, Mus musculus
cagaagacgaagacgatcaagaggg

SEQ ID NO: 563327 - DNA, 25 bp, Mus musculus
cagaagacgaagtcgatcaagaggg

SEQ ID NO: 563328 - DNA, 25 bp, Mus musculus
cagaagacgactcgcctcgagaggt

SEQ ID NO: 563329 - DNA, 25 bp, Mus musculus
cagaagacgactggcctcgagaggt

SEQ ID NO: 563330 - DNA, 25 bp, Mus musculus
cagaagacgcagactaacacgtggt

SEQ ID NO: 563331 - DNA, 25 bp, Mus musculus
cagaagacgcagtctaacacgtggt

SEQ ID NO: 563332 - DNA, 25 bp, Mus musculus
cagaagacggacatcgatggaaagt

SEQ ID NO: 563333 - DNA, 25 bp, Mus musculus
cagaagacggacttcgatggaaagt

SEQ ID NO: 563334 - DNA, 25 bp, Mus musculus
cagaagacgtggaccagactggagc

SEQ ID NO: 563335 - DNA, 25 bp, Mus musculus
cagaagacgtggtccagactggagc

SEQ ID NO: 563336 - DNA, 25 bp, Mus musculus
cagaagacgttgcaaatgacccttt

SEQ ID NO: 563337 - DNA, 25 bp, Mus musculus
cagaagacgttggaaatgacccttt

SEQ ID NO: 563338 - DNA, 25 bp, Mus musculus
cagaagactaaaatagggcacagtg

SEQ ID NO: 563339 - DNA, 25 bp, Mus musculus
cagaagactaaattagggcacagtg

SEQ ID NO: 563340 - DNA, 25 bp, Mus musculus
cagaagactggtatcagagcatggg

SEQ ID NO: 563341 - DNA, 25 bp, Mus musculus
cagaagactggtttcagagcatggg

SEQ ID NO: 563342 - DNA, 25 bp, Mus musculus
cagaagagaaagaggtgtttgccca

SEQ ID NO: 563343 - DNA, 25 bp, Mus musculus
cagaagagaaagtggtgtttgccca

SEQ ID NO: 563344 - DNA, 25 bp, Mus musculus
cagaagagaacacccgaacttcagg

SEQ ID NO: 563345 - DNA, 25 bp, Mus musculus
cagaagagaacagccgaacttcagg

SEQ ID NO: 563346 - DNA, 25 bp, Mus musculus
cagaagagaacccagggcactgaga

SEQ ID NO: 563347 - DNA, 25 bp, Mus musculus
cagaagagaaccgagggcactgaga

SEQ ID NO: 563348 - DNA, 25 bp, Mus musculus
cagaagagaagactaagaatggcgt

SEQ ID NO: 563349 - DNA, 25 bp, Mus musculus
cagaagagaagagtaagaatggcgt

SEQ ID NO: 563350 - DNA, 25 bp, Mus musculus
cagaagagacataggaacatccttg

SEQ ID NO: 563351 - DNA, 25 bp, Mus musculus
cagaagagacattggaacatccttg

SEQ ID NO: 563352 - DNA, 25 bp, Mus musculus
cagaagagagctagcggatggccat

SEQ ID NO: 563353 - DNA, 25 bp, Mus musculus
cagaagagagcttgcggatggccat

SEQ ID NO: 563354 - DNA, 25 bp, Mus musculus
cagaagagattgatttagggatggt

SEQ ID NO: 563355 - DNA, 25 bp, Mus musculus
cagaagagattgttttagggatggt

SEQ ID NO: 563356 - DNA, 25 bp, Mus musculus
cagaagagcaaaccggaagaagcct

SEQ ID NO: 563357 - DNA, 25 bp, Mus musculus
cagaagagcaaagcggaagaagcct

SEQ ID NO: 563358 - DNA, 25 bp, Mus musculus
cagaagagcagtcatggtttccaat

SEQ ID NO: 563359 - DNA, 25 bp, Mus musculus
cagaagagcagtgatggtttccaat

SEQ ID NO: 563360 - DNA, 25 bp, Mus musculus
cagaagagcataccactggccctag

SEQ ID NO: 563361 - DNA, 25 bp, Mus musculus
cagaagagcatagcactggccctag

SEQ ID NO: 563362 - DNA, 25 bp, Mus musculus
cagaagagcgtcaagaactggagaa

SEQ ID NO: 563363 - DNA, 25 bp, Mus musculus
cagaagagcgtctagaactggagaa

SEQ ID NO: 563364 - DNA, 25 bp, Mus musculus
cagaagagcttcaagagcgcatggc

SEQ ID NO: 563365 - DNA, 25 bp, Mus musculus
cagaagagcttctagagcgcatggc

SEQ ID NO: 563366 - DNA, 25 bp, Mus musculus
cagaagagggttcctaatgtctgtt

SEQ ID NO: 563367 - DNA, 25 bp, Mus musculus
cagaagagggttgctaatgtctgtt

SEQ ID NO: 563368 - DNA, 25 bp, Mus musculus
cagaagataaacaatggctccagcc

SEQ ID NO: 563369 - DNA, 25 bp, Mus musculus
cagaagataaactatggctccagcc

SEQ ID NO: 563370 - DNA, 25 bp, Mus musculus
cagaagataacaatccacggtgaag

SEQ ID NO: 563371 - DNA, 25 bp, Mus musculus
cagaagataacattccacggtgaag

SEQ ID NO: 563372 - DNA, 25 bp, Mus musculus
cagaagatacttagagaagctctgg

SEQ ID NO: 563373 - DNA, 25 bp, Mus musculus
cagaagatactttgagaagctctgg

SEQ ID NO: 563374 - DNA, 25 bp, Mus musculus
cagaagatagtcagcggccttcgag

SEQ ID NO: 563375 - DNA, 25 bp, Mus musculus
cagaagatagtctgcggccttcgag

SEQ ID NO: 563376 - DNA, 25 bp, Mus musculus
cagaagatatccacattccaaagat

SEQ ID NO: 563377 - DNA, 25 bp, Mus musculus
cagaagatatcctcattccaaagat

SEQ ID NO: 563378 - DNA, 25 bp, Mus musculus
cagaagatcaagcaacagcagtatt

SEQ ID NO: 563379 - DNA, 25 bp, Mus musculus
cagaagatcaaggaacagcagtatt

SEQ ID NO: 563380 - DNA, 25 bp, Mus musculus
cagaagatcaccaagatgacacttg

SEQ ID NO: 563381 - DNA, 25 bp, Mus musculus
cagaagatcacctagatgacacttg

SEQ ID NO: 563382 - DNA, 25 bp, Mus musculus
cagaagatcatccagtttgcttctg

SEQ ID NO: 563383 - DNA, 25 bp, Mus musculus
cagaagatcatcgagtttgcttctg

SEQ ID NO: 563384 - DNA, 25 bp, Mus musculus
cagaagatcattacctgggaaacgg

SEQ ID NO: 563385 - DNA, 25 bp, Mus musculus
cagaagatcatttcctgggaaacgg

SEQ ID NO: 563386 - DNA, 25 bp, Mus musculus
cagaagatcgtacagctagctcaca

SEQ ID NO: 563387 - DNA, 25 bp, Mus musculus
cagaagatcgtagagctagctcaca

SEQ ID NO: 563388 - DNA, 25 bp, Mus musculus
cagaagatgaaaaagctacaatatt

SEQ ID NO: 563389 - DNA, 25 bp, Mus musculus
cagaagatgaaatagctacaatatt

SEQ ID NO: 563390 - DNA, 25 bp, Mus musculus
cagaagatgagtaacggccagatgt

SEQ ID NO: 563391 - DNA, 25 bp, Mus musculus
cagaagatgagttacggccagatgt

SEQ ID NO: 563392 - DNA, 25 bp, Mus musculus
cagaagatgatgaagcacctgtgga

SEQ ID NO: 563393 - DNA, 25 bp, Mus musculus
cagaagatgatgtagcacctgtgga

SEQ ID NO: 563394 - DNA, 25 bp, Mus musculus
cagaagatgcagacctacaagatcc

SEQ ID NO: 563395 - DNA, 25 bp, Mus musculus
cagaagatgcagtcctacaagatcc

SEQ ID NO: 563396 - DNA, 25 bp, Mus musculus
cagaagatgcctccaacatcatgag

SEQ ID NO: 563397 - DNA, 25 bp, Mus musculus
cagaagatgcctgcaacatcatgag

SEQ ID NO: 563398 - DNA, 25 bp, Mus musculus
cagaagatggccatggccccaagct

SEQ ID NO: 563399 - DNA, 25 bp, Mus musculus
cagaagatggccttggccccaagct

SEQ ID NO: 563400 - DNA, 25 bp, Mus musculus
cagaagatggtcaacagcactgaga

SEQ ID NO: 563401 - DNA, 25 bp, Mus musculus
cagaagatggtctacagcactgaga

SEQ ID NO: 563402 - DNA, 25 bp, Mus musculus
cagaagatgtctatatcttgtgtga

SEQ ID NO: 563403 - DNA, 25 bp, Mus musculus
cagaagatgtctttatcttgtgtga

SEQ ID NO: 563404 - DNA, 25 bp, Mus musculus
cagaagattctaaaggaggacatcc

SEQ ID NO: 563405 - DNA, 25 bp, Mus musculus
cagaagattctataggaggacatcc

SEQ ID NO: 563406 - DNA, 25 bp, Mus musculus
cagaagattgcacaaaatcaacgta

SEQ ID NO: 563407 - DNA, 25 bp, Mus musculus
cagaagattgcagaaaatcaacgta

SEQ ID NO: 563408 - DNA, 25 bp, Mus musculus
cagaagcaactcactcaaccagaaa

SEQ ID NO: 563409 - DNA, 25 bp, Mus musculus
cagaagcaactctctcaaccagaaa

SEQ ID NO: 563410 - DNA, 25 bp, Mus musculus
cagaagcaactgaggacctgggtgc

SEQ ID NO: 563411 - DNA, 25 bp, Mus musculus
cagaagcaactgtggacctgggtgc

SEQ ID NO: 563412 - DNA, 25 bp, Mus musculus
cagaagcaatctagtggataacacc

SEQ ID NO: 563413 - DNA, 25 bp, Mus musculus
cagaagcaatcttgtggataacacc

SEQ ID NO: 563414 - DNA, 25 bp, Mus musculus
cagaagcaccttcagatcaaccaaa

SEQ ID NO: 563415 - DNA, 25 bp, Mus musculus
cagaagcaccttgagatcaaccaaa

SEQ ID NO: 563416 - DNA, 25 bp, Mus musculus
cagaagcacggaccaaatgggcaca

SEQ ID NO: 563417 - DNA, 25 bp, Mus musculus
cagaagcacggagcaaatgggcaca

SEQ ID NO: 563418 - DNA, 25 bp, Mus musculus
cagaagcacggtacacttccgtgga

SEQ ID NO: 563419 - DNA, 25 bp, Mus musculus
cagaagcacggttcacttccgtgga

SEQ ID NO: 563420 - DNA, 25 bp, Mus musculus
cagaagcagagacggtacagtgacc

SEQ ID NO: 563421 - DNA, 25 bp, Mus musculus
cagaagcagagagggtacagtgacc

SEQ ID NO: 563422 - DNA, 25 bp, Mus musculus
cagaagcagaggcaccagctcccgg

SEQ ID NO: 563423 - DNA, 25 bp, Mus musculus
cagaagcagagggaccagctcccgg

SEQ ID NO: 563424 - DNA, 25 bp, Mus musculus
cagaagcagatgataccactccagg

SEQ ID NO: 563425 - DNA, 25 bp, Mus musculus
cagaagcagatgttaccactccagg

SEQ ID NO: 563426 - DNA, 25 bp, Mus musculus
cagaagccagacctgttttcaacag

SEQ ID NO: 563427 - DNA, 25 bp, Mus musculus
cagaagccagacgtgttttcaacag

SEQ ID NO: 563428 - DNA, 25 bp, Mus musculus
cagaagccaggcagcgaaggttaaa

SEQ ID NO: 563429 - DNA, 25 bp, Mus musculus
cagaagccaggctgcgaaggttaaa

SEQ ID NO: 563430 - DNA, 25 bp, Mus musculus
cagaagccatgtataccaaccttcg

SEQ ID NO: 563431 - DNA, 25 bp, Mus musculus
cagaagccatgtttaccaaccttcg

SEQ ID NO: 563432 - DNA, 25 bp, Mus musculus
cagaagcccatgctcaggcaatggc

SEQ ID NO: 563433 - DNA, 25 bp, Mus musculus
cagaagcccatggtcaggcaatggc

SEQ ID NO: 563434 - DNA, 25 bp, Mus musculus
cagaagccggagaggtagcagtaaa

SEQ ID NO: 563435 - DNA, 25 bp, Mus musculus
cagaagccggagtggtagcagtaaa

SEQ ID NO: 563436 - DNA, 25 bp, Mus musculus
cagaagcctttgcaggtatcaaaag

SEQ ID NO: 563437 - DNA, 25 bp, Mus musculus
cagaagcctttggaggtatcaaaag

SEQ ID NO: 563438 - DNA, 25 bp, Mus musculus
cagaagcgaataaggctgccgtgac

SEQ ID NO: 563439 - DNA, 25 bp, Mus musculus
cagaagcgaatatggctgccgtgac

SEQ ID NO: 563440 - DNA, 25 bp, Mus musculus
cagaagcgcatcacgttgaagaagc

SEQ ID NO: 563441 - DNA, 25 bp, Mus musculus
cagaagcgcatctcgttgaagaagc

SEQ ID NO: 563442 - DNA, 25 bp, Mus musculus
cagaagcgccatcatgcagagacca

SEQ ID NO: 563443 - DNA, 25 bp, Mus musculus
cagaagcgccatgatgcagagacca

SEQ ID NO: 563444 - DNA, 25 bp, Mus musculus
cagaagcgcttgcaggaggtcaccc

SEQ ID NO: 563445 - DNA, 25 bp, Mus musculus
cagaagcgcttggaggaggtcaccc

SEQ ID NO: 563446 - DNA, 25 bp, Mus musculus
cagaagcggatcaatgtcttgccac

SEQ ID NO: 563447 - DNA, 25 bp, Mus musculus
cagaagcggatctatgtcttgccac

SEQ ID NO: 563448 - DNA, 25 bp, Mus musculus
cagaagcgtcgacgtcaggatgcaa

SEQ ID NO: 563449 - DNA, 25 bp, Mus musculus
cagaagcgtcgaggtcaggatgcaa

SEQ ID NO: 563450 - DNA, 25 bp, Mus musculus
cagaagctacgtccagaaggacctc

SEQ ID NO: 563451 - DNA, 25 bp, Mus musculus
cagaagctacgtgcagaaggacctc

SEQ ID NO: 563452 - DNA, 25 bp, Mus musculus
cagaagctcaacaagttcttggaac

SEQ ID NO: 563453 - DNA, 25 bp, Mus musculus
cagaagctcaactagttcttggaac

SEQ ID NO: 563454 - DNA, 25 bp, Mus musculus
cagaagctcacacctgagtttgagg

SEQ ID NO: 563455 - DNA, 25 bp, Mus musculus
cagaagctcacagctgagtttgagg

SEQ ID NO: 563456 - DNA, 25 bp, Mus musculus
cagaagctcactaccagtgacattg

SEQ ID NO: 563457 - DNA, 25 bp, Mus musculus
cagaagctcacttccagtgacattg

SEQ ID NO: 563458 - DNA, 25 bp, Mus musculus
cagaagctcagtcaaaagatttcct

SEQ ID NO: 563459 - DNA, 25 bp, Mus musculus
cagaagctcagtgaaaagatttcct

SEQ ID NO: 563460 - DNA, 25 bp, Mus musculus
cagaagctccctcagctagaaagga

SEQ ID NO: 563461 - DNA, 25 bp, Mus musculus
cagaagctccctgagctagaaagga

SEQ ID NO: 563462 - DNA, 25 bp, Mus musculus
cagaagctcctgatgacttgagcac

SEQ ID NO: 563463 - DNA, 25 bp, Mus musculus
cagaagctcctgttgacttgagcac

SEQ ID NO: 563464 - DNA, 25 bp, Mus musculus
cagaagctctcgctgcagctgagcg

SEQ ID NO: 563465 - DNA, 25 bp, Mus musculus
cagaagctctcggtgcagctgagcg

SEQ ID NO: 563466 - DNA, 25 bp, Mus musculus
cagaagctctggattgagtgctgca

SEQ ID NO: 563467 - DNA, 25 bp, Mus musculus
cagaagctctggtttgagtgctgca

SEQ ID NO: 563468 - DNA, 25 bp, Mus musculus
cagaagctcttgataactacaagca

SEQ ID NO: 563469 - DNA, 25 bp, Mus musculus
cagaagctcttgttaactacaagca

SEQ ID NO: 563470 - DNA, 25 bp, Mus musculus
cagaagctgaatatcgtaatgacag

SEQ ID NO: 563471 - DNA, 25 bp, Mus musculus
cagaagctgaatttcgtaatgacag

SEQ ID NO: 563472 - DNA, 25 bp, Mus musculus
cagaagctgagcatgtcaacttaga

SEQ ID NO: 563473 - DNA, 25 bp, Mus musculus
cagaagctgagcttgtcaacttaga

SEQ ID NO: 563474 - DNA, 25 bp, Mus musculus
cagaagctgcgaccccaagtgcggc

SEQ ID NO: 563475 - DNA, 25 bp, Mus musculus
cagaagctgcgagcccaagtgcggc

SEQ ID NO: 563476 - DNA, 25 bp, Mus musculus
cagaagctgcgcagctcgctttgga

SEQ ID NO: 563477 - DNA, 25 bp, Mus musculus
cagaagctgcgctgctcgctttgga

SEQ ID NO: 563478 - DNA, 25 bp, Mus musculus
cagaagctgcttataaactggggcc

SEQ ID NO: 563479 - DNA, 25 bp, Mus musculus
cagaagctgcttttaaactggggcc

SEQ ID NO: 563480 - DNA, 25 bp, Mus musculus
cagaagctggccagggctttggaca

SEQ ID NO: 563481 - DNA, 25 bp, Mus musculus
cagaagctggcctgggctttggaca

SEQ ID NO: 563482 - DNA, 25 bp, Mus musculus
cagaagctgtccagcacatgccagg

SEQ ID NO: 563483 - DNA, 25 bp, Mus musculus
cagaagctgtcctgcacatgccagg

SEQ ID NO: 563484 - DNA, 25 bp, Mus musculus
cagaagctgttactgagattctcaa

SEQ ID NO: 563485 - DNA, 25 bp, Mus musculus
cagaagctgttagtgagattctcaa

SEQ ID NO: 563486 - DNA, 25 bp, Mus musculus
cagaagctgtttagggctgatctca

SEQ ID NO: 563487 - DNA, 25 bp, Mus musculus
cagaagctgttttgggctgatctca

SEQ ID NO: 563488 - DNA, 25 bp, Mus musculus
cagaagcttcctaggactcacctgc

SEQ ID NO: 563489 - DNA, 25 bp, Mus musculus
cagaagcttccttggactcacctgc

SEQ ID NO: 563490 - DNA, 25 bp, Mus musculus
cagaagcttgctaagcgggcagcgc

SEQ ID NO: 563491 - DNA, 25 bp, Mus musculus
cagaagcttgctatatgagtcacag

SEQ ID NO: 563492 - DNA, 25 bp, Mus musculus
cagaagcttgcttagcgggcagcgc

SEQ ID NO: 563493 - DNA, 25 bp, Mus musculus
cagaagcttgctttatgagtcacag

SEQ ID NO: 563494 - DNA, 25 bp, Mus musculus
cagaagctttaaacatgagcaggtg

SEQ ID NO: 563495 - DNA, 25 bp, Mus musculus
cagaagctttaatcatgagcaggtg

SEQ ID NO: 563496 - DNA, 25 bp, Mus musculus
cagaagctttccacaactacatgaa

SEQ ID NO: 563497 - DNA, 25 bp, Mus musculus
cagaagctttcctcaactacatgaa

SEQ ID NO: 563498 - DNA, 25 bp, Mus musculus
cagaagctttgcagaactgctacac

SEQ ID NO: 563499 - DNA, 25 bp, Mus musculus
cagaagctttgctgaactgctacac

SEQ ID NO: 563500 - DNA, 25 bp, Mus musculus
cagaaggaaaagctcgaacgagatc

SEQ ID NO: 563501 - DNA, 25 bp, Mus musculus
cagaaggaaaaggtcgaacgagatc

SEQ ID NO: 563502 - DNA, 25 bp, Mus musculus
cagaaggaagttcgcaaagacgtgt

SEQ ID NO: 563503 - DNA, 25 bp, Mus musculus
cagaaggaagttggcaaagacgtgt

SEQ ID NO: 563504 - DNA, 25 bp, Mus musculus
cagaaggacacaaggaaccctggca

SEQ ID NO: 563505 - DNA, 25 bp, Mus musculus
cagaaggacacatggaaccctggca

SEQ ID NO: 563506 - DNA, 25 bp, Mus musculus
cagaaggaccaccacatctggagct

SEQ ID NO: 563507 - DNA, 25 bp, Mus musculus
cagaaggaccacgacatctggagct

SEQ ID NO: 563508 - DNA, 25 bp, Mus musculus
cagaaggactgcaaaccgaggatgt

SEQ ID NO: 563509 - DNA, 25 bp, Mus musculus
cagaaggactgctaaccgaggatgt

SEQ ID NO: 563510 - DNA, 25 bp, Mus musculus
cagaaggaggtgaatttcatgggcc

SEQ ID NO: 563511 - DNA, 25 bp, Mus musculus
cagaaggaggtgtatttcatgggcc

SEQ ID NO: 563512 - DNA, 25 bp, Mus musculus
cagaaggagtgaaagctcgaaggaa

SEQ ID NO: 563513 - DNA, 25 bp, Mus musculus
cagaaggagtgatagctcgaaggaa

SEQ ID NO: 563514 - DNA, 25 bp, Mus musculus
cagaaggattgacataagcagagac

SEQ ID NO: 563515 - DNA, 25 bp, Mus musculus
cagaaggattgagataagcagagac

SEQ ID NO: 563516 - DNA, 25 bp, Mus musculus
cagaaggcaatgcatgaaagaagat

SEQ ID NO: 563517 - DNA, 25 bp, Mus musculus
cagaaggcaatggatgaaagaagat

SEQ ID NO: 563518 - DNA, 25 bp, Mus musculus
cagaaggcactgacgtatcaccgta

SEQ ID NO: 563519 - DNA, 25 bp, Mus musculus
cagaaggcactgtcgtatcaccgta

SEQ ID NO: 563520 - DNA, 25 bp, Mus musculus
cagaaggcagataggaaagaacagc

SEQ ID NO: 563521 - DNA, 25 bp, Mus musculus
cagaaggcagattggaaagaacagc

SEQ ID NO: 563522 - DNA, 25 bp, Mus musculus
cagaaggcagccatggtgaacggcc

SEQ ID NO: 563523 - DNA, 25 bp, Mus musculus
cagaaggcagccttggtgaacggcc

SEQ ID NO: 563524 - DNA, 25 bp, Mus musculus
cagaaggcccctccctagggatgca

SEQ ID NO: 563525 - DNA, 25 bp, Mus musculus
cagaaggcccctgcctagggatgca

SEQ ID NO: 563526 - DNA, 25 bp, Mus musculus
cagaaggccctgagtgtagttgcca

SEQ ID NO: 563527 - DNA, 25 bp, Mus musculus
cagaaggccctgtgtgtagttgcca

SEQ ID NO: 563528 - DNA, 25 bp, Mus musculus
cagaaggcgaagctctccttctcca

SEQ ID NO: 563529 - DNA, 25 bp, Mus musculus
cagaaggcgaaggtctccttctcca

SEQ ID NO: 563530 - DNA, 25 bp, Mus musculus
cagaaggctcttacgatttcggcag

SEQ ID NO: 563531 - DNA, 25 bp, Mus musculus
cagaaggctctttcgatttcggcag

SEQ ID NO: 563532 - DNA, 25 bp, Mus musculus
cagaaggctgctcctagtaagatgc

SEQ ID NO: 563533 - DNA, 25 bp, Mus musculus
cagaaggctgctgctagtaagatgc

SEQ ID NO: 563534 - DNA, 25 bp, Mus musculus
cagaaggctgtcacacacgtgggca

SEQ ID NO: 563535 - DNA, 25 bp, Mus musculus
cagaaggctgtccaacccttgtata

SEQ ID NO: 563536 - DNA, 25 bp, Mus musculus
cagaaggctgtcgaacccttgtata

SEQ ID NO: 563537 - DNA, 25 bp, Mus musculus
cagaaggctgtctcacacgtgggca

SEQ ID NO: 563538 - DNA, 25 bp, Mus musculus
cagaaggcttcaatctccgcaggga

SEQ ID NO: 563539 - DNA, 25 bp, Mus musculus
cagaaggcttcattctccgcaggga

SEQ ID NO: 563540 - DNA, 25 bp, Mus musculus
cagaaggcttggagagctactacac

SEQ ID NO: 563541 - DNA, 25 bp, Mus musculus
cagaaggcttggtgagctactacac

SEQ ID NO: 563542 - DNA, 25 bp, Mus musculus
cagaaggcttgtaggccatgaagga

SEQ ID NO: 563543 - DNA, 25 bp, Mus musculus
cagaaggcttgttggccatgaagga

SEQ ID NO: 563544 - DNA, 25 bp, Mus musculus
cagaagggaagaatctaaccacggg

SEQ ID NO: 563545 - DNA, 25 bp, Mus musculus
cagaagggaagattctaaccacggg

SEQ ID NO: 563546 - DNA, 25 bp, Mus musculus
cagaagggaaggcttcctctaccac

SEQ ID NO: 563547 - DNA, 25 bp, Mus musculus
cagaagggaagggttcctctaccac

SEQ ID NO: 563548 - DNA, 25 bp, Mus musculus
cagaagggacagatgacaggtcaat

SEQ ID NO: 563549 - DNA, 25 bp, Mus musculus
cagaagggacagttgacaggtcaat

SEQ ID NO: 563550 - DNA, 25 bp, Mus musculus
cagaagggagttacttattcacacc

SEQ ID NO: 563551 - DNA, 25 bp, Mus musculus
cagaagggagtttcttattcacacc

SEQ ID NO: 563552 - DNA, 25 bp, Mus musculus
cagaagggcccaaagaggtcctaga

SEQ ID NO: 563553 - DNA, 25 bp, Mus musculus
cagaagggcccatagaggtcctaga

SEQ ID NO: 563554 - DNA, 25 bp, Mus musculus
cagaagggcgccattactgccgtga

SEQ ID NO: 563555 - DNA, 25 bp, Mus musculus
cagaagggcgcctttactgccgtga

SEQ ID NO: 563556 - DNA, 25 bp, Mus musculus
cagaagggtattcatgtagaaaaca

SEQ ID NO: 563557 - DNA, 25 bp, Mus musculus
cagaagggtattgatgtagaaaaca

SEQ ID NO: 563558 - DNA, 25 bp, Mus musculus
cagaagggtcaaaggactaacgaca

SEQ ID NO: 563559 - DNA, 25 bp, Mus musculus
cagaagggtcaatggactaacgaca

SEQ ID NO: 563560 - DNA, 25 bp, Mus musculus
cagaagggttccactgaccagcgga

SEQ ID NO: 563561 - DNA, 25 bp, Mus musculus
cagaagggttcctctgaccagcgga

SEQ ID NO: 563562 - DNA, 25 bp, Mus musculus
cagaaggtacttcactttagttatg

SEQ ID NO: 563563 - DNA, 25 bp, Mus musculus
cagaaggtacttgactttagttatg

SEQ ID NO: 563564 - DNA, 25 bp, Mus musculus
cagaaggtccagcagctagctcacg

SEQ ID NO: 563565 - DNA, 25 bp, Mus musculus
cagaaggtccaggagctagctcacg

SEQ ID NO: 563566 - DNA, 25 bp, Mus musculus
cagaaggtcctgatgccctcttcca

SEQ ID NO: 563567 - DNA, 25 bp, Mus musculus
cagaaggtcctgttgccctcttcca

SEQ ID NO: 563568 - DNA, 25 bp, Mus musculus
cagaaggtcttcatcgccaagatgg

SEQ ID NO: 563569 - DNA, 25 bp, Mus musculus
cagaaggtcttcttcgccaagatgg

SEQ ID NO: 563570 - DNA, 25 bp, Mus musculus
cagaaggtgaatagagcaggcctgc

SEQ ID NO: 563571 - DNA, 25 bp, Mus musculus
cagaaggtgaattgagcaggcctgc

SEQ ID NO: 563572 - DNA, 25 bp, Mus musculus
cagaaggttatgagacaagaagatg

SEQ ID NO: 563573 - DNA, 25 bp, Mus musculus
cagaaggttatgtgacaagaagatg

SEQ ID NO: 563574 - DNA, 25 bp, Mus musculus
cagaaggttctacccgatggtttgc

SEQ ID NO: 563575 - DNA, 25 bp, Mus musculus
cagaaggttctagccgatggtttgc

SEQ ID NO: 563576 - DNA, 25 bp, Mus musculus
cagaaggttcttaccaaacaagagc

SEQ ID NO: 563577 - DNA, 25 bp, Mus musculus
cagaaggttctttccaaacaagagc

SEQ ID NO: 563578 - DNA, 25 bp, Mus musculus
cagaaggttttcaagtgaggatgtt

SEQ ID NO: 563579 - DNA, 25 bp, Mus musculus
cagaaggttttctagtgaggatgtt

SEQ ID NO: 563580 - DNA, 25 bp, Mus musculus
cagaagtacaatatcttcacatttc

SEQ ID NO: 563581 - DNA, 25 bp, Mus musculus
cagaagtacaatttcttcacatttc

SEQ ID NO: 563582 - DNA, 25 bp, Mus musculus
cagaagtactcccagatcagaagta

SEQ ID NO: 563583 - DNA, 25 bp, Mus musculus
cagaagtactccgagatcagaagta

SEQ ID NO: 563584 - DNA, 25 bp, Mus musculus
cagaagtacttacagcagcgtccag

SEQ ID NO: 563585 - DNA, 25 bp, Mus musculus
cagaagtacttagagcagcgtccag

SEQ ID NO: 563586 - DNA, 25 bp, Mus musculus
cagaagtactttagcattagtctag

SEQ ID NO: 563587 - DNA, 25 bp, Mus musculus
cagaagtacttttgcattagtctag

SEQ ID NO: 563588 - DNA, 25 bp, Mus musculus
cagaagtagaggaggcagatgaaac

SEQ ID NO: 563589 - DNA, 25 bp, Mus musculus
cagaagtagaggtggcagatgaaac

SEQ ID NO: 563590 - DNA, 25 bp, Mus musculus
cagaagtatggtcttgcccgttaaa

SEQ ID NO: 563591 - DNA, 25 bp, Mus musculus
cagaagtatggtgttgcccgttaaa

SEQ ID NO: 563592 - DNA, 25 bp, Mus musculus
cagaagtattctcgttgtcgccaga

SEQ ID NO: 563593 - DNA, 25 bp, Mus musculus
cagaagtattctggttgtcgccaga

SEQ ID NO: 563594 - DNA, 25 bp, Mus musculus
cagaagtcagttagtcagatgaaga

SEQ ID NO: 563595 - DNA, 25 bp, Mus musculus
cagaagtcagtttgtcagatgaaga

SEQ ID NO: 563596 - DNA, 25 bp, Mus musculus
cagaagtcatttcatcccggctcga

SEQ ID NO: 563597 - DNA, 25 bp, Mus musculus
cagaagtcatttgatcccggctcga

SEQ ID NO: 563598 - DNA, 25 bp, Mus musculus
cagaagtccaagatacactgaagct

SEQ ID NO: 563599 - DNA, 25 bp, Mus musculus
cagaagtccaagttacactgaagct

SEQ ID NO: 563600 - DNA, 25 bp, Mus musculus
cagaagtccagtactctgcaggtag

SEQ ID NO: 563601 - DNA, 25 bp, Mus musculus
cagaagtccagttctctgcaggtag

SEQ ID NO: 563602 - DNA, 25 bp, Mus musculus
cagaagtccttcaggacagtgtggt

SEQ ID NO: 563603 - DNA, 25 bp, Mus musculus
cagaagtccttctggacagtgtggt

SEQ ID NO: 563604 - DNA, 25 bp, Mus musculus
cagaagtcggcgcagaccttcctgt

SEQ ID NO: 563605 - DNA, 25 bp, Mus musculus
cagaagtcggcggagaccttcctgt

SEQ ID NO: 563606 - DNA, 25 bp, Mus musculus
cagaagtctaacattttcctcgaga

SEQ ID NO: 563607 - DNA, 25 bp, Mus musculus
cagaagtctaactttttcctcgaga

SEQ ID NO: 563608 - DNA, 25 bp, Mus musculus
cagaagtctattcccattgggacca

SEQ ID NO: 563609 - DNA, 25 bp, Mus musculus
cagaagtctattgccattgggacca

SEQ ID NO: 563610 - DNA, 25 bp, Mus musculus
cagaagtctggtcccctgtcactga

SEQ ID NO: 563611 - DNA, 25 bp, Mus musculus
cagaagtctggtgccctgtcactga

SEQ ID NO: 563612 - DNA, 25 bp, Mus musculus
cagaagtgaagtcactccggacgga

SEQ ID NO: 563613 - DNA, 25 bp, Mus musculus
cagaagtgaagtgactccggacgga

SEQ ID NO: 563614 - DNA, 25 bp, Mus musculus
cagaagtgagacagtcgggctgcac

SEQ ID NO: 563615 - DNA, 25 bp, Mus musculus
cagaagtgagactgtcgggctgcac

SEQ ID NO: 563616 - DNA, 25 bp, Mus musculus
cagaagtgattccagtattacagaa

SEQ ID NO: 563617 - DNA, 25 bp, Mus musculus
cagaagtgattcgagtattacagaa

SEQ ID NO: 563618 - DNA, 25 bp, Mus musculus
cagaagtgcctgatcgcagaagtct

SEQ ID NO: 563619 - DNA, 25 bp, Mus musculus
cagaagtgcctgttcgcagaagtct

SEQ ID NO: 563620 - DNA, 25 bp, Mus musculus
cagaagtgctgcctgttcaggccat

SEQ ID NO: 563621 - DNA, 25 bp, Mus musculus
cagaagtgctgcgtgttcaggccat

SEQ ID NO: 563622 - DNA, 25 bp, Mus musculus
cagaagtgcttcctaaagagcctta

SEQ ID NO: 563623 - DNA, 25 bp, Mus musculus
cagaagtgcttcgtaaagagcctta

SEQ ID NO: 563624 - DNA, 25 bp, Mus musculus
cagaagtggacaccccaaacgactt

SEQ ID NO: 563625 - DNA, 25 bp, Mus musculus
cagaagtggacagcccaaacgactt

SEQ ID NO: 563626 - DNA, 25 bp, Mus musculus
cagaagtggctacacgactataaca

SEQ ID NO: 563627 - DNA, 25 bp, Mus musculus
cagaagtggctagacgactataaca

SEQ ID NO: 563628 - DNA, 25 bp, Mus musculus
cagaagtggtccagggcctgttccc

SEQ ID NO: 563629 - DNA, 25 bp, Mus musculus
cagaagtggtcctgggcctgttccc

SEQ ID NO: 563630 - DNA, 25 bp, Mus musculus
cagaagtgtaggactgacgtggcac

SEQ ID NO: 563631 - DNA, 25 bp, Mus musculus
cagaagtgtaggtctgacgtggcac

SEQ ID NO: 563632 - DNA, 25 bp, Mus musculus
cagaagtgtctaaatgttggcatga

SEQ ID NO: 563633 - DNA, 25 bp, Mus musculus
cagaagtgtctatatgttggcatga

SEQ ID NO: 563634 - DNA, 25 bp, Mus musculus
cagaagttaagaatgggccacgtca

SEQ ID NO: 563635 - DNA, 25 bp, Mus musculus
cagaagttaagattgggccacgtca

SEQ ID NO: 563636 - DNA, 25 bp, Mus musculus
cagaagttcactctggtccgggccg

SEQ ID NO: 563637 - DNA, 25 bp, Mus musculus
cagaagttcactgtggtccgggccg

SEQ ID NO: 563638 - DNA, 25 bp, Mus musculus
cagaagttcagaaccagtggttggt

SEQ ID NO: 563639 - DNA, 25 bp, Mus musculus
cagaagttcagatccagtggttggt

SEQ ID NO: 563640 - DNA, 25 bp, Mus musculus
cagaagttcagtcagcaaaagatga

SEQ ID NO: 563641 - DNA, 25 bp, Mus musculus
cagaagttcagtgagcaaaagatga

SEQ ID NO: 563642 - DNA, 25 bp, Mus musculus
cagaagttcattcttcatagagatc

SEQ ID NO: 563643 - DNA, 25 bp, Mus musculus
cagaagttcattgttcatagagatc

SEQ ID NO: 563644 - DNA, 25 bp, Mus musculus
cagaagttctggcattgaatgacga

SEQ ID NO: 563645 - DNA, 25 bp, Mus musculus
cagaagttctgggattgaatgacga

SEQ ID NO: 563646 - DNA, 25 bp, Mus musculus
cagaagttgaccatcctgacatgtg

SEQ ID NO: 563647 - DNA, 25 bp, Mus musculus
cagaagttgaccttcctgacatgtg

SEQ ID NO: 563648 - DNA, 25 bp, Mus musculus
cagaagttgctgacgtactgtcaga

SEQ ID NO: 563649 - DNA, 25 bp, Mus musculus
cagaagttgctgtcgtactgtcaga

SEQ ID NO: 563650 - DNA, 25 bp, Mus musculus
cagaagttggagcatgggttctaca

SEQ ID NO: 563651 - DNA, 25 bp, Mus musculus
cagaagttggaggatgggttctaca

SEQ ID NO: 563652 - DNA, 25 bp, Mus musculus
cagaagttgggcatcccagctaagt

SEQ ID NO: 563653 - DNA, 25 bp, Mus musculus
cagaagttgggcttcccagctaagt

SEQ ID NO: 563654 - DNA, 25 bp, Mus musculus
cagaagtttcccctaggagacggct

SEQ ID NO: 563655 - DNA, 25 bp, Mus musculus
cagaagtttcccgtaggagacggct

SEQ ID NO: 563656 - DNA, 25 bp, Mus musculus
cagaagtttctaaacaagttggtga

SEQ ID NO: 563657 - DNA, 25 bp, Mus musculus
cagaagtttctatacaagttggtga

SEQ ID NO: 563658 - DNA, 25 bp, Mus musculus
cagaagtttgaaaccatgtatgccc

SEQ ID NO: 563659 - DNA, 25 bp, Mus musculus
cagaagtttgaactggaaatcagtc

SEQ ID NO: 563660 - DNA, 25 bp, Mus musculus
cagaagtttgaagtggaaatcagtc

SEQ ID NO: 563661 - DNA, 25 bp, Mus musculus
cagaagtttgaatccatgtatgccc

SEQ ID NO: 563662 - DNA, 25 bp, Mus musculus
cagaagtttgcactttttaagcgga

SEQ ID NO: 563663 - DNA, 25 bp, Mus musculus
cagaagtttgcagtttttaagcgga

SEQ ID NO: 563664 - DNA, 25 bp, Mus musculus
cagaagtttgtcacacagtgctgtc

SEQ ID NO: 563665 - DNA, 25 bp, Mus musculus
cagaagtttgtctcacagtgctgtc

SEQ ID NO: 563666 - DNA, 25 bp, Mus musculus
cagaagttttccatgattactccca

SEQ ID NO: 563667 - DNA, 25 bp, Mus musculus
cagaagttttccttgattactccca

SEQ ID NO: 563668 - DNA, 25 bp, Mus musculus
cagaagtttttgcacattgcaagac

SEQ ID NO: 563669 - DNA, 25 bp, Mus musculus
cagaagtttttggacattgcaagac

SEQ ID NO: 563670 - DNA, 25 bp, Mus musculus
cagaataaagctagcggaaccccag

SEQ ID NO: 563671 - DNA, 25 bp, Mus musculus
cagaataaagcttgcggaaccccag

SEQ ID NO: 563672 - DNA, 25 bp, Mus musculus
cagaataagatgacagagcacagca

SEQ ID NO: 563673 - DNA, 25 bp, Mus musculus
cagaataagatgtcagagcacagca

SEQ ID NO: 563674 - DNA, 25 bp, Mus musculus
cagaataagcatctgagtatgctca

SEQ ID NO: 563675 - DNA, 25 bp, Mus musculus
cagaataagcatgtgagtatgctca

SEQ ID NO: 563676 - DNA, 25 bp, Mus musculus
cagaataatccacagctgtggcaca

SEQ ID NO: 563677 - DNA, 25 bp, Mus musculus
cagaataatccagagctgtggcaca

SEQ ID NO: 563678 - DNA, 25 bp, Mus musculus
cagaataccagactccttccgtggg

SEQ ID NO: 563679 - DNA, 25 bp, Mus musculus
cagaataccagagtccttccgtggg

SEQ ID NO: 563680 - DNA, 25 bp, Mus musculus
cagaataccttacacgaaagactgg

SEQ ID NO: 563681 - DNA, 25 bp, Mus musculus
cagaataccttagacgaaagactgg

SEQ ID NO: 563682 - DNA, 25 bp, Mus musculus
cagaatactcctatcccttttgaat

SEQ ID NO: 563683 - DNA, 25 bp, Mus musculus
cagaatactcctttcccttttgaat

SEQ ID NO: 563684 - DNA, 25 bp, Mus musculus
cagaatagctggctcaaggttaagc

SEQ ID NO: 563685 - DNA, 25 bp, Mus musculus
cagaatagctgggtcaaggttaagc

SEQ ID NO: 563686 - DNA, 25 bp, Mus musculus
cagaataggaaaaaccacaacacaa

SEQ ID NO: 563687 - DNA, 25 bp, Mus musculus
cagaataggaaataccacaacacaa

SEQ ID NO: 563688 - DNA, 25 bp, Mus musculus
cagaatagtgctccctaaggacctg

SEQ ID NO: 563689 - DNA, 25 bp, Mus musculus
cagaatagtgctgcctaaggacctg

SEQ ID NO: 563690 - DNA, 25 bp, Mus musculus
cagaatatatctcagggtgatgtaa

SEQ ID NO: 563691 - DNA, 25 bp, Mus musculus
cagaatatatctgagggtgatgtaa

SEQ ID NO: 563692 - DNA, 25 bp, Mus musculus
cagaatatcaccaagaacttaagtg

SEQ ID NO: 563693 - DNA, 25 bp, Mus musculus
cagaatatcacctagaacttaagtg

SEQ ID NO: 563694 - DNA, 25 bp, Mus musculus
cagaatatcgtgcttcagatcacag

SEQ ID NO: 563695 - DNA, 25 bp, Mus musculus
cagaatatcgtggttcagatcacag

SEQ ID NO: 563696 - DNA, 25 bp, Mus musculus
cagaatatgaaaagagtattgctgc

SEQ ID NO: 563697 - DNA, 25 bp, Mus musculus
cagaatatgaaatgagtattgctgc

SEQ ID NO: 563698 - DNA, 25 bp, Mus musculus
cagaatatgatgagctggcagagcc

SEQ ID NO: 563699 - DNA, 25 bp, Mus musculus
cagaatatgatgtgctggcagagcc

SEQ ID NO: 563700 - DNA, 25 bp, Mus musculus
cagaatcaagaacaaggctcctccc

SEQ ID NO: 563701 - DNA, 25 bp, Mus musculus
cagaatcaagaagaaggctcctccc

SEQ ID NO: 563702 - DNA, 25 bp, Mus musculus
cagaatcaagagaacaaatggcttc

SEQ ID NO: 563703 - DNA, 25 bp, Mus musculus
cagaatcaagagtacaaatggcttc

SEQ ID NO: 563704 - DNA, 25 bp, Mus musculus
cagaatcacgctccaatgcaggtca

SEQ ID NO: 563705 - DNA, 25 bp, Mus musculus
cagaatcacgctgcaatgcaggtca

SEQ ID NO: 563706 - DNA, 25 bp, Mus musculus
cagaatccactaagggcagctgtct

SEQ ID NO: 563707 - DNA, 25 bp, Mus musculus
cagaatccactatgggcagctgtct

SEQ ID NO: 563708 - DNA, 25 bp, Mus musculus
cagaatccatttatggagctcccaa

SEQ ID NO: 563709 - DNA, 25 bp, Mus musculus
cagaatccatttttggagctcccaa

SEQ ID NO: 563710 - DNA, 25 bp, Mus musculus
cagaatccctttctacatgtccaca

SEQ ID NO: 563711 - DNA, 25 bp, Mus musculus
cagaatccctttgtacatgtccaca

SEQ ID NO: 563712 - DNA, 25 bp, Mus musculus
cagaatccgagtctccgaacagagc

SEQ ID NO: 563713 - DNA, 25 bp, Mus musculus
cagaatccgagtgtccgaacagagc

SEQ ID NO: 563714 - DNA, 25 bp, Mus musculus
cagaatccttgcctggacttactca

SEQ ID NO: 563715 - DNA, 25 bp, Mus musculus
cagaatccttgcgtggacttactca

SEQ ID NO: 563716 - DNA, 25 bp, Mus musculus
cagaatcgtcccactctatggagct

SEQ ID NO: 563717 - DNA, 25 bp, Mus musculus
cagaatcgtccctctctatggagct

SEQ ID NO: 563718 - DNA, 25 bp, Mus musculus
cagaatctagacaaggcccggcagg

SEQ ID NO: 563719 - DNA, 25 bp, Mus musculus
cagaatctagactaggcccggcagg

SEQ ID NO: 563720 - DNA, 25 bp, Mus musculus
cagaatctagttccgagtcccgctc

SEQ ID NO: 563721 - DNA, 25 bp, Mus musculus
cagaatctagttgcgagtcccgctc

SEQ ID NO: 563722 - DNA, 25 bp, Mus musculus
cagaatctctctcactggcctgcac

SEQ ID NO: 563723 - DNA, 25 bp, Mus musculus
cagaatctctctgactggcctgcac

SEQ ID NO: 563724 - DNA, 25 bp, Mus musculus
cagaatctgataatagcttcatgtg

SEQ ID NO: 563725 - DNA, 25 bp, Mus musculus
cagaatctgatattagcttcatgtg

SEQ ID NO: 563726 - DNA, 25 bp, Mus musculus
cagaatctgatcatgggcctcttcc

SEQ ID NO: 563727 - DNA, 25 bp, Mus musculus
cagaatctgatcttgggcctcttcc

SEQ ID NO: 563728 - DNA, 25 bp, Mus musculus
cagaatgaaggacaagcagacaggc

SEQ ID NO: 563729 - DNA, 25 bp, Mus musculus
cagaatgaaggagaagcagacaggc

SEQ ID NO: 563730 - DNA, 25 bp, Mus musculus
cagaatgaatgcatacagccaagtt

SEQ ID NO: 563731 - DNA, 25 bp, Mus musculus
cagaatgaatgcttacagccaagtt

SEQ ID NO: 563732 - DNA, 25 bp, Mus musculus
cagaatgaattcagttaatttcaag

SEQ ID NO: 563733 - DNA, 25 bp, Mus musculus
cagaatgaattctgttaatttcaag

SEQ ID NO: 563734 - DNA, 25 bp, Mus musculus
cagaatgacgtaaccaggtggtgtc

SEQ ID NO: 563735 - DNA, 25 bp, Mus musculus
cagaatgacgtatccaggtggtgtc

SEQ ID NO: 563736 - DNA, 25 bp, Mus musculus
cagaatgagagaagtgttgcagaag

SEQ ID NO: 563737 - DNA, 25 bp, Mus musculus
cagaatgagagatgtgttgcagaag

SEQ ID NO: 563738 - DNA, 25 bp, Mus musculus
cagaatgagtcacagccagggtagc

SEQ ID NO: 563739 - DNA, 25 bp, Mus musculus
cagaatgagtcagagccagggtagc

SEQ ID NO: 563740 - DNA, 25 bp, Mus musculus
cagaatgagtcgctcttgcacgagt

SEQ ID NO: 563741 - DNA, 25 bp, Mus musculus
cagaatgagtcggtcttgcacgagt

SEQ ID NO: 563742 - DNA, 25 bp, Mus musculus
cagaatgatcaaacccagaattgtt

SEQ ID NO: 563743 - DNA, 25 bp, Mus musculus
cagaatgatcaatcccagaattgtt

SEQ ID NO: 563744 - DNA, 25 bp, Mus musculus
cagaatgatcttccttgggaattca

SEQ ID NO: 563745 - DNA, 25 bp, Mus musculus
cagaatgatcttgcttgggaattca

SEQ ID NO: 563746 - DNA, 25 bp, Mus musculus
cagaatgcagctcctcaagcggttg

SEQ ID NO: 563747 - DNA, 25 bp, Mus musculus
cagaatgcagctgctcaagcggttg

SEQ ID NO: 563748 - DNA, 25 bp, Mus musculus
cagaatgcccagatccggaatcagg

SEQ ID NO: 563749 - DNA, 25 bp, Mus musculus
cagaatgcccagttccggaatcagg

SEQ ID NO: 563750 - DNA, 25 bp, Mus musculus
cagaatgcctgaagacgcttgagac

SEQ ID NO: 563751 - DNA, 25 bp, Mus musculus
cagaatgcctgatgacgcttgagac

SEQ ID NO: 563752 - DNA, 25 bp, Mus musculus
cagaatgcgaggaacaagcaaaggc

SEQ ID NO: 563753 - DNA, 25 bp, Mus musculus
cagaatgcgaggtacaagcaaaggc

SEQ ID NO: 563754 - DNA, 25 bp, Mus musculus
cagaatgctgatcttcataccatgg

SEQ ID NO: 563755 - DNA, 25 bp, Mus musculus
cagaatgctgatgttcataccatgg

SEQ ID NO: 563756 - DNA, 25 bp, Mus musculus
cagaatgctggtagggcaagcctgt

SEQ ID NO: 563757 - DNA, 25 bp, Mus musculus
cagaatgctggttgggcaagcctgt

SEQ ID NO: 563758 - DNA, 25 bp, Mus musculus
cagaatggactgcaaccctgtatcg

SEQ ID NO: 563759 - DNA, 25 bp, Mus musculus
cagaatggactggaaccctgtatcg

SEQ ID NO: 563760 - DNA, 25 bp, Mus musculus
cagaatggagctcacattgatgtac

SEQ ID NO: 563761 - DNA, 25 bp, Mus musculus
cagaatggagctgacattgatgtac

SEQ ID NO: 563762 - DNA, 25 bp, Mus musculus
cagaatggcggaacctgccacaaca

SEQ ID NO: 563763 - DNA, 25 bp, Mus musculus
cagaatggcggatcctgccacaaca

SEQ ID NO: 563764 - DNA, 25 bp, Mus musculus
cagaatggcgggaatttgtgcatcc

SEQ ID NO: 563765 - DNA, 25 bp, Mus musculus
cagaatggcgggtatttgtgcatcc

SEQ ID NO: 563766 - DNA, 25 bp, Mus musculus
cagaatggctccagtgagggctgca

SEQ ID NO: 563767 - DNA, 25 bp, Mus musculus
cagaatggctcctgtgagggctgca

SEQ ID NO: 563768 - DNA, 25 bp, Mus musculus
cagaatgggattcatgcagacgtca

SEQ ID NO: 563769 - DNA, 25 bp, Mus musculus
cagaatgggattgatgcagacgtca

SEQ ID NO: 563770 - DNA, 25 bp, Mus musculus
cagaatgggccacgactggagtaca

SEQ ID NO: 563771 - DNA, 25 bp, Mus musculus
cagaatgggccaggactggagtaca

SEQ ID NO: 563772 - DNA, 25 bp, Mus musculus
cagaatgggcccatttatgccaggg

SEQ ID NO: 563773 - DNA, 25 bp, Mus musculus
cagaatgggcccttttatgccaggg

SEQ ID NO: 563774 - DNA, 25 bp, Mus musculus
cagaatgggtgtcttgtgtccgctt

SEQ ID NO: 563775 - DNA, 25 bp, Mus musculus
cagaatgggtgtgttgtgtccgctt

SEQ ID NO: 563776 - DNA, 25 bp, Mus musculus
cagaatgtaaggaaaatgctcagcc

SEQ ID NO: 563777 - DNA, 25 bp, Mus musculus
cagaatgtaaggtaaatgctcagcc

SEQ ID NO: 563778 - DNA, 25 bp, Mus musculus
cagaatgtaccacggacacatgcag

SEQ ID NO: 563779 - DNA, 25 bp, Mus musculus
cagaatgtaccagggacacatgcag

SEQ ID NO: 563780 - DNA, 25 bp, Mus musculus
cagaatgtatccaggcctgcaagtg

SEQ ID NO: 563781 - DNA, 25 bp, Mus musculus
cagaatgtatcctggcctgcaagtg

SEQ ID NO: 563782 - DNA, 25 bp, Mus musculus
cagaatgtcatcatggctgccttga

SEQ ID NO: 563783 - DNA, 25 bp, Mus musculus
cagaatgtcatcttggctgccttga

SEQ ID NO: 563784 - DNA, 25 bp, Mus musculus
cagaatgtccccagtcacctatggg

SEQ ID NO: 563785 - DNA, 25 bp, Mus musculus
cagaatgtcccctgtcacctatggg

SEQ ID NO: 563786 - DNA, 25 bp, Mus musculus
cagaatgtcttaatgttcatgacgc

SEQ ID NO: 563787 - DNA, 25 bp, Mus musculus
cagaatgtcttattgttcatgacgc

SEQ ID NO: 563788 - DNA, 25 bp, Mus musculus
cagaatgtgctcaccagcggctgat

SEQ ID NO: 563789 - DNA, 25 bp, Mus musculus
cagaatgtgctctccagcggctgat

SEQ ID NO: 563790 - DNA, 25 bp, Mus musculus
cagaatgttctgcttgtgtgtgaga

SEQ ID NO: 563791 - DNA, 25 bp, Mus musculus
cagaatgttctggttgtgtgtgaga

SEQ ID NO: 563792 - DNA, 25 bp, Mus musculus
cagaatgtttctagcaccttgcagc

SEQ ID NO: 563793 - DNA, 25 bp, Mus musculus
cagaatgtttcttgcaccttgcagc

SEQ ID NO: 563794 - DNA, 25 bp, Mus musculus
cagaattaagagcagaaatagcagg

SEQ ID NO: 563795 - DNA, 25 bp, Mus musculus
cagaattaagaggagaaatagcagg

SEQ ID NO: 563796 - DNA, 25 bp, Mus musculus
cagaattacgacagagacgacatgg

SEQ ID NO: 563797 - DNA, 25 bp, Mus musculus
cagaattacgactgagacgacatgg

SEQ ID NO: 563798 - DNA, 25 bp, Mus musculus
cagaattcagacatcatcgaaagta

SEQ ID NO: 563799 - DNA, 25 bp, Mus musculus
cagaattcagacttcatcgaaagta

SEQ ID NO: 563800 - DNA, 25 bp, Mus musculus
cagaattctgcccagacttgaagct

SEQ ID NO: 563801 - DNA, 25 bp, Mus musculus
cagaattctgccgagacttgaagct

SEQ ID NO: 563802 - DNA, 25 bp, Mus musculus
cagaattctggtaatgacctgcagg

SEQ ID NO: 563803 - DNA, 25 bp, Mus musculus
cagaattctggttatgacctgcagg

SEQ ID NO: 563804 - DNA, 25 bp, Mus musculus
cagaattgaaggagagggcaaagat

SEQ ID NO: 563805 - DNA, 25 bp, Mus musculus
cagaattgaaggtgagggcaaagat

SEQ ID NO: 563806 - DNA, 25 bp, Mus musculus
cagaattgctgtcgcttttcctgtg

SEQ ID NO: 563807 - DNA, 25 bp, Mus musculus
cagaattgctgtggcttttcctgtg

SEQ ID NO: 563808 - DNA, 25 bp, Mus musculus
cagaattggaggagctgcgccaacg

SEQ ID NO: 563809 - DNA, 25 bp, Mus musculus
cagaattggaggtgctgcgccaacg

SEQ ID NO: 563810 - DNA, 25 bp, Mus musculus
cagaattggcaaactctgtgccaga

SEQ ID NO: 563811 - DNA, 25 bp, Mus musculus
cagaattggcaatctctgtgccaga

SEQ ID NO: 563812 - DNA, 25 bp, Mus musculus
cagaattgggctcgatgtaaccgga

SEQ ID NO: 563813 - DNA, 25 bp, Mus musculus
cagaattgggctggatgtaaccgga

SEQ ID NO: 563814 - DNA, 25 bp, Mus musculus
cagaattggttcacctatgccggag

SEQ ID NO: 563815 - DNA, 25 bp, Mus musculus
cagaattggttctcctatgccggag

SEQ ID NO: 563816 - DNA, 25 bp, Mus musculus
cagaattgtagacccaactgcgcac

SEQ ID NO: 563817 - DNA, 25 bp, Mus musculus
cagaattgtagagccaactgcgcac

SEQ ID NO: 563818 - DNA, 25 bp, Mus musculus
cagaattgttttctatttggccaga

SEQ ID NO: 563819 - DNA, 25 bp, Mus musculus
cagaattgttttgtatttggccaga

SEQ ID NO: 563820 - DNA, 25 bp, Mus musculus
cagaatttaacacaccaacatgcat

SEQ ID NO: 563821 - DNA, 25 bp, Mus musculus
cagaatttaacagaccaacatgcat

SEQ ID NO: 563822 - DNA, 25 bp, Mus musculus
cagaatttagtgactccatgatgca

SEQ ID NO: 563823 - DNA, 25 bp, Mus musculus
cagaatttagtgtctccatgatgca

SEQ ID NO: 563824 - DNA, 25 bp, Mus musculus
cagaatttgccaaggctatcccagg

SEQ ID NO: 563825 - DNA, 25 bp, Mus musculus
cagaatttgccatggctatcccagg

SEQ ID NO: 563826 - DNA, 25 bp, Mus musculus
cagaattttaagatattcgtgagcg

SEQ ID NO: 563827 - DNA, 25 bp, Mus musculus
cagaattttaagttattcgtgagcg

SEQ ID NO: 563828 - DNA, 25 bp, Mus musculus
cagaattttatacgaacctgaacca

SEQ ID NO: 563829 - DNA, 25 bp, Mus musculus
cagaattttataggaacctgaacca

SEQ ID NO: 563830 - DNA, 25 bp, Mus musculus
cagaattttccacgttagtatcaga

SEQ ID NO: 563831 - DNA, 25 bp, Mus musculus
cagaattttccaggttagtatcaga

SEQ ID NO: 563832 - DNA, 25 bp, Mus musculus
cagacaaagatgctattcttcgagc

SEQ ID NO: 563833 - DNA, 25 bp, Mus musculus
cagacaaagatggtattcttcgagc

SEQ ID NO: 563834 - DNA, 25 bp, Mus musculus
cagacaaatgttcccctgcttggca

SEQ ID NO: 563835 - DNA, 25 bp, Mus musculus
cagacaaatgttgccctgcttggca

SEQ ID NO: 563836 - DNA, 25 bp, Mus musculus
cagacaaccgttcgatctgccaaaa

SEQ ID NO: 563837 - DNA, 25 bp, Mus musculus
cagacaaccgttggatctgccaaaa

SEQ ID NO: 563838 - DNA, 25 bp, Mus musculus
cagacaacctgcacttcggtggcac

SEQ ID NO: 563839 - DNA, 25 bp, Mus musculus
cagacaacctgctcttcggtggcac

SEQ ID NO: 563840 - DNA, 25 bp, Mus musculus
cagacaacctttcacttagatgatg

SEQ ID NO: 563841 - DNA, 25 bp, Mus musculus
cagacaacctttgacttagatgatg

SEQ ID NO: 563842 - DNA, 25 bp, Mus musculus
cagacaagaaggagtctgagacccg

SEQ ID NO: 563843 - DNA, 25 bp, Mus musculus
cagacaagaaggtgtctgagacccg

SEQ ID NO: 563844 - DNA, 25 bp, Mus musculus
cagacaagacatcccatcagaggat

SEQ ID NO: 563845 - DNA, 25 bp, Mus musculus
cagacaagacatgccatcagaggat

SEQ ID NO: 563846 - DNA, 25 bp, Mus musculus
cagacaagctgaaggtgcacctggt

SEQ ID NO: 563847 - DNA, 25 bp, Mus musculus
cagacaagctgatggtgcacctggt

SEQ ID NO: 563848 - DNA, 25 bp, Mus musculus
cagacaagtggcattaaagatcaaa

SEQ ID NO: 563849 - DNA, 25 bp, Mus musculus
cagacaagtggctttaaagatcaaa

SEQ ID NO: 563850 - DNA, 25 bp, Mus musculus
cagacaagtggtcatcagagtcccc

SEQ ID NO: 563851 - DNA, 25 bp, Mus musculus
cagacaagtggtgatcagagtcccc

SEQ ID NO: 563852 - DNA, 25 bp, Mus musculus
cagacaagtgtgcattgacccgaaa

SEQ ID NO: 563853 - DNA, 25 bp, Mus musculus
cagacaagtgtggattgacccgaaa

SEQ ID NO: 563854 - DNA, 25 bp, Mus musculus
cagacaataatgagtgggacctaca

SEQ ID NO: 563855 - DNA, 25 bp, Mus musculus
cagacaataatgtgtgggacctaca

SEQ ID NO: 563856 - DNA, 25 bp, Mus musculus
cagacaatccgcagtcgtggccggg

SEQ ID NO: 563857 - DNA, 25 bp, Mus musculus
cagacaatccgctgtcgtggccggg

SEQ ID NO: 563858 - DNA, 25 bp, Mus musculus
cagacaatctgaaggatgacataga

SEQ ID NO: 563859 - DNA, 25 bp, Mus musculus
cagacaatctgatggatgacataga

SEQ ID NO: 563860 - DNA, 25 bp, Mus musculus
cagacaatgagcatcagcaagcatt

SEQ ID NO: 563861 - DNA, 25 bp, Mus musculus
cagacaatgagcttcagcaagcatt

SEQ ID NO: 563862 - DNA, 25 bp, Mus musculus
cagacaatgatccaacaggggaagc

SEQ ID NO: 563863 - DNA, 25 bp, Mus musculus
cagacaatgatcgaacaggggaagc

SEQ ID NO: 563864 - DNA, 25 bp, Mus musculus
cagacaatggatcggatgatggcaa

SEQ ID NO: 563865 - DNA, 25 bp, Mus musculus
cagacaatggatgggatgatggcaa

SEQ ID NO: 563866 - DNA, 25 bp, Mus musculus
cagacaattgaaatacatggtacaa

SEQ ID NO: 563867 - DNA, 25 bp, Mus musculus
cagacaattgaattacatggtacaa

SEQ ID NO: 563868 - DNA, 25 bp, Mus musculus
cagacaatttttcctccaccaaaca

SEQ ID NO: 563869 - DNA, 25 bp, Mus musculus
cagacaatttttgctccaccaaaca

SEQ ID NO: 563870 - DNA, 25 bp, Mus musculus
cagacacaatctcaagtactatgta

SEQ ID NO: 563871 - DNA, 25 bp, Mus musculus
cagacacaatctgaagtactatgta

SEQ ID NO: 563872 - DNA, 25 bp, Mus musculus
cagacacactttctggaacggcgag

SEQ ID NO: 563873 - DNA, 25 bp, Mus musculus
cagacacactttgtggaacggcgag

SEQ ID NO: 563874 - DNA, 25 bp, Mus musculus
cagacacagggcagcgagtcttcgg

SEQ ID NO: 563875 - DNA, 25 bp, Mus musculus
cagacacagggctgcgagtcttcgg

SEQ ID NO: 563876 - DNA, 25 bp, Mus musculus
cagacacatgacatggaagcagtgg

SEQ ID NO: 563877 - DNA, 25 bp, Mus musculus
cagacacatgacttggaagcagtgg

SEQ ID NO: 563878 - DNA, 25 bp, Mus musculus
cagacaccactgcagagcagcggcg

SEQ ID NO: 563879 - DNA, 25 bp, Mus musculus
cagacaccactggagagcagcggcg

SEQ ID NO: 563880 - DNA, 25 bp, Mus musculus
cagacaccagaactgtctggagacc

SEQ ID NO: 563881 - DNA, 25 bp, Mus musculus
cagacaccagaagtgtctggagacc

SEQ ID NO: 563882 - DNA, 25 bp, Mus musculus
cagacaccagacatgcttgcaagtc

SEQ ID NO: 563883 - DNA, 25 bp, Mus musculus
cagacaccagacttgcttgcaagtc

SEQ ID NO: 563884 - DNA, 25 bp, Mus musculus
cagacaccagcacaaaacaaggcgg

SEQ ID NO: 563885 - DNA, 25 bp, Mus musculus
cagacaccagcagaaaacaaggcgg

SEQ ID NO: 563886 - DNA, 25 bp, Mus musculus
cagacacccagaagaaatgttttgg

SEQ ID NO: 563887 - DNA, 25 bp, Mus musculus
cagacacccagatgaaatgttttgg

SEQ ID NO: 563888 - DNA, 25 bp, Mus musculus
cagacacccgatcgacagtcctgat

SEQ ID NO: 563889 - DNA, 25 bp, Mus musculus
cagacacccgatggacagtcctgat

SEQ ID NO: 563890 - DNA, 25 bp, Mus musculus
cagacaccttagcacagtacctggc

SEQ ID NO: 563891 - DNA, 25 bp, Mus musculus
cagacaccttaggacagtacctggc

SEQ ID NO: 563892 - DNA, 25 bp, Mus musculus
cagacaccttctcagagcagagagg

SEQ ID NO: 563893 - DNA, 25 bp, Mus musculus
cagacaccttctgagagcagagagg

SEQ ID NO: 563894 - DNA, 25 bp, Mus musculus
cagacacgaaggagggccatcatct

SEQ ID NO: 563895 - DNA, 25 bp, Mus musculus
cagacacgaaggtgggccatcatct

SEQ ID NO: 563896 - DNA, 25 bp, Mus musculus
cagacacgattgacgagagaacgat

SEQ ID NO: 563897 - DNA, 25 bp, Mus musculus
cagacacgattgtcgagagaacgat

SEQ ID NO: 563898 - DNA, 25 bp, Mus musculus
cagacacggcggcagaagctcacag

SEQ ID NO: 563899 - DNA, 25 bp, Mus musculus
cagacacggcgggagaagctcacag

SEQ ID NO: 563900 - DNA, 25 bp, Mus musculus
cagacactacgacattggttcccaa

SEQ ID NO: 563901 - DNA, 25 bp, Mus musculus
cagacactacgagattggttcccaa

SEQ ID NO: 563902 - DNA, 25 bp, Mus musculus
cagacactcccaaaagacattttca

SEQ ID NO: 563903 - DNA, 25 bp, Mus musculus
cagacactcccataagacattttca

SEQ ID NO: 563904 - DNA, 25 bp, Mus musculus
cagacactctttaagaccagctgga

SEQ ID NO: 563905 - DNA, 25 bp, Mus musculus
cagacactcttttagaccagctgga

SEQ ID NO: 563906 - DNA, 25 bp, Mus musculus
cagacactgctactcatggtgctgc

SEQ ID NO: 563907 - DNA, 25 bp, Mus musculus
cagacactgctagtcatggtgctgc

SEQ ID NO: 563908 - DNA, 25 bp, Mus musculus
cagacactgggcaagaaccactgtt

SEQ ID NO: 563909 - DNA, 25 bp, Mus musculus
cagacactgggctagaaccactgtt

SEQ ID NO: 563910 - DNA, 25 bp, Mus musculus
cagacactgtcgacctcagcctgtt

SEQ ID NO: 563911 - DNA, 25 bp, Mus musculus
cagacactgtcgtcctcagcctgtt

SEQ ID NO: 563912 - DNA, 25 bp, Mus musculus
cagacacttaccagcagcgtttgga

SEQ ID NO: 563913 - DNA, 25 bp, Mus musculus
cagacacttacctgcagcgtttgga

SEQ ID NO: 563914 - DNA, 25 bp, Mus musculus
cagacacttctactgcaaacatggt

SEQ ID NO: 563915 - DNA, 25 bp, Mus musculus
cagacacttctagtgcaaacatggt

SEQ ID NO: 563916 - DNA, 25 bp, Mus musculus
cagacacttttgagctcggacacca

SEQ ID NO: 563917 - DNA, 25 bp, Mus musculus
cagacacttttgtgctcggacacca

SEQ ID NO: 563918 - DNA, 25 bp, Mus musculus
cagacagaaccaagtaaaatttgga

SEQ ID NO: 563919 - DNA, 25 bp, Mus musculus
cagacagaaccatgtaaaatttgga

SEQ ID NO: 563920 - DNA, 25 bp, Mus musculus
cagacagaagaaacccagccctcag

SEQ ID NO: 563921 - DNA, 25 bp, Mus musculus
cagacagaagaatcccagccctcag

SEQ ID NO: 563922 - DNA, 25 bp, Mus musculus
cagacagaagttcagctgcttgatg

SEQ ID NO: 563923 - DNA, 25 bp, Mus musculus
cagacagaagttgagctgcttgatg

SEQ ID NO: 563924 - DNA, 25 bp, Mus musculus
cagacagacttaatcgggagctttc

SEQ ID NO: 563925 - DNA, 25 bp, Mus musculus
cagacagacttattcgggagctttc

SEQ ID NO: 563926 - DNA, 25 bp, Mus musculus
cagacagagggcactggcgccatca

SEQ ID NO: 563927 - DNA, 25 bp, Mus musculus
cagacagagggctctggcgccatca

SEQ ID NO: 563928 - DNA, 25 bp, Mus musculus
cagacagagttacgacagcaaatcc

SEQ ID NO: 563929 - DNA, 25 bp, Mus musculus
cagacagagttaggacagcaaatcc

SEQ ID NO: 563930 - DNA, 25 bp, Mus musculus
cagacagatctgaccaaactcatca

SEQ ID NO: 563931 - DNA, 25 bp, Mus musculus
cagacagatctgtccaaactcatca

SEQ ID NO: 563932 - DNA, 25 bp, Mus musculus
cagacagatgcgctcagctgatgaa

SEQ ID NO: 563933 - DNA, 25 bp, Mus musculus
cagacagatgcggtcagctgatgaa

SEQ ID NO: 563934 - DNA, 25 bp, Mus musculus
cagacagcaaagctaccagaacaga

SEQ ID NO: 563935 - DNA, 25 bp, Mus musculus
cagacagcaaaggtaccagaacaga

SEQ ID NO: 563936 - DNA, 25 bp, Mus musculus
cagacagcagtaacatgaggaagct

SEQ ID NO: 563937 - DNA, 25 bp, Mus musculus
cagacagcagtatcatgaggaagct

SEQ ID NO: 563938 - DNA, 25 bp, Mus musculus
cagacagcatgaccgtaaccactgg

SEQ ID NO: 563939 - DNA, 25 bp, Mus musculus
cagacagcatgagcgtaaccactgg

SEQ ID NO: 563940 - DNA, 25 bp, Mus musculus
cagacagccattctaggcagtgacg

SEQ ID NO: 563941 - DNA, 25 bp, Mus musculus
cagacagccattgtaggcagtgacg

SEQ ID NO: 563942 - DNA, 25 bp, Mus musculus
cagacagccttgaatgggaagatgg

SEQ ID NO: 563943 - DNA, 25 bp, Mus musculus
cagacagccttgagaggaatggcac

SEQ ID NO: 563944 - DNA, 25 bp, Mus musculus
cagacagccttgtatgggaagatgg

SEQ ID NO: 563945 - DNA, 25 bp, Mus musculus
cagacagccttgtgaggaatggcac

SEQ ID NO: 563946 - DNA, 25 bp, Mus musculus
cagacagctccgattcagacgtgga

SEQ ID NO: 563947 - DNA, 25 bp, Mus musculus
cagacagctccgtttcagacgtgga

SEQ ID NO: 563948 - DNA, 25 bp, Mus musculus
cagacagcttggatatggaaaagag

SEQ ID NO: 563949 - DNA, 25 bp, Mus musculus
cagacagcttggttatggaaaagag

SEQ ID NO: 563950 - DNA, 25 bp, Mus musculus
cagacaggacctctcatgtgtgcct

SEQ ID NO: 563951 - DNA, 25 bp, Mus musculus
cagacaggacctgtcatgtgtgcct

SEQ ID NO: 563952 - DNA, 25 bp, Mus musculus
cagacaggagccacgagaaggcaga

SEQ ID NO: 563953 - DNA, 25 bp, Mus musculus
cagacaggagcctcgagaaggcaga

SEQ ID NO: 563954 - DNA, 25 bp, Mus musculus
cagacaggtggaagttgatgattga

SEQ ID NO: 563955 - DNA, 25 bp, Mus musculus
cagacaggtggatgttgatgattga

SEQ ID NO: 563956 - DNA, 25 bp, Mus musculus
cagacaggtggcaaactctacctca

SEQ ID NO: 563957 - DNA, 25 bp, Mus musculus
cagacaggtggctaactctacctca

SEQ ID NO: 563958 - DNA, 25 bp, Mus musculus
cagacagtaggacgattcggattaa

SEQ ID NO: 563959 - DNA, 25 bp, Mus musculus
cagacagtaggaggattcggattaa

SEQ ID NO: 563960 - DNA, 25 bp, Mus musculus
cagacagtagtgagcaccttgaatg

SEQ ID NO: 563961 - DNA, 25 bp, Mus musculus
cagacagtagtgtgcaccttgaatg

SEQ ID NO: 563962 - DNA, 25 bp, Mus musculus
cagacagtatggagaagttgctaat

SEQ ID NO: 563963 - DNA, 25 bp, Mus musculus
cagacagtatggtgaagttgctaat

SEQ ID NO: 563964 - DNA, 25 bp, Mus musculus
cagacagtccacatcaaatcctgct

SEQ ID NO: 563965 - DNA, 25 bp, Mus musculus
cagacagtccacttcaaatcctgct

SEQ ID NO: 563966 - DNA, 25 bp, Mus musculus
cagacagtccatcatgaagtggcca

SEQ ID NO: 563967 - DNA, 25 bp, Mus musculus
cagacagtccatgatgaagtggcca

SEQ ID NO: 563968 - DNA, 25 bp, Mus musculus
cagacagtctagaagtctacctgcc

SEQ ID NO: 563969 - DNA, 25 bp, Mus musculus
cagacagtctagtagtctacctgcc

SEQ ID NO: 563970 - DNA, 25 bp, Mus musculus
cagacagtgacgaggtgcctccaag

SEQ ID NO: 563971 - DNA, 25 bp, Mus musculus
cagacagtgacgtggtgcctccaag

SEQ ID NO: 563972 - DNA, 25 bp, Mus musculus
cagacagtgagaagacaggatatgt

SEQ ID NO: 563973 - DNA, 25 bp, Mus musculus
cagacagtgagatgacaggatatgt

SEQ ID NO: 563974 - DNA, 25 bp, Mus musculus
cagacagtgatgaaaacgacaaagg

SEQ ID NO: 563975 - DNA, 25 bp, Mus musculus
cagacagtgatgtaaacgacaaagg

SEQ ID NO: 563976 - DNA, 25 bp, Mus musculus
cagacagtgcagatatcaaagctgg

SEQ ID NO: 563977 - DNA, 25 bp, Mus musculus
cagacagtgcagttatcaaagctgg

SEQ ID NO: 563978 - DNA, 25 bp, Mus musculus
cagacagtgccgaggtttcaattcc

SEQ ID NO: 563979 - DNA, 25 bp, Mus musculus
cagacagtgccgtggtttcaattcc

SEQ ID NO: 563980 - DNA, 25 bp, Mus musculus
cagacagtgctgatccagggagctg

SEQ ID NO: 563981 - DNA, 25 bp, Mus musculus
cagacagtgctgttccagggagctg

SEQ ID NO: 563982 - DNA, 25 bp, Mus musculus
cagacagtgtcgctttctgtgtgaa

SEQ ID NO: 563983 - DNA, 25 bp, Mus musculus
cagacagtgtcggtttctgtgtgaa

SEQ ID NO: 563984 - DNA, 25 bp, Mus musculus
cagacagtgttcatcgggactgcag

SEQ ID NO: 563985 - DNA, 25 bp, Mus musculus
cagacagtgttcttcgggactgcag

SEQ ID NO: 563986 - DNA, 25 bp, Mus musculus
cagacagtttctacatggcgtgcaa

SEQ ID NO: 563987 - DNA, 25 bp, Mus musculus
cagacagtttcttcatggcgtgcaa

SEQ ID NO: 563988 - DNA, 25 bp, Mus musculus
cagacataagggaaaatgctgttaa

SEQ ID NO: 563989 - DNA, 25 bp, Mus musculus
cagacataagggtaaatgctgttaa

SEQ ID NO: 563990 - DNA, 25 bp, Mus musculus
cagacatacacactggatgtgctgg

SEQ ID NO: 563991 - DNA, 25 bp, Mus musculus
cagacatacacagtggatgtgctgg

SEQ ID NO: 563992 - DNA, 25 bp, Mus musculus
cagacatagaaacagaagaaataga

SEQ ID NO: 563993 - DNA, 25 bp, Mus musculus
cagacatagaaagagaagaaataga

SEQ ID NO: 563994 - DNA, 25 bp, Mus musculus
cagacatcaagtcacactatgcctt

SEQ ID NO: 563995 - DNA, 25 bp, Mus musculus
cagacatcaagtgacactatgcctt

SEQ ID NO: 563996 - DNA, 25 bp, Mus musculus
cagacatcagtaacggttgtgatac

SEQ ID NO: 563997 - DNA, 25 bp, Mus musculus
cagacatcagtatcggttgtgatac

SEQ ID NO: 563998 - DNA, 25 bp, Mus musculus
cagacatcagtcatcctgcgaaagc

SEQ ID NO: 563999 - DNA, 25 bp, Mus musculus
cagacatcagtcttcctgcgaaagc

SEQ ID NO: 564000 - DNA, 25 bp, Mus musculus
cagacatcatagctatttgctgcca

SEQ ID NO: 564001 - DNA, 25 bp, Mus musculus
cagacatcataggtatttgctgcca

SEQ ID NO: 564002 - DNA, 25 bp, Mus musculus
cagacatcatggagcacctgactga

SEQ ID NO: 564003 - DNA, 25 bp, Mus musculus
cagacatcatggtgcacctgactga

SEQ ID NO: 564004 - DNA, 25 bp, Mus musculus
cagacatccttaccactagttctca

SEQ ID NO: 564005 - DNA, 25 bp, Mus musculus
cagacatccttagcactagttctca

SEQ ID NO: 564006 - DNA, 25 bp, Mus musculus
cagacatcgaacaactgccgtcgta

SEQ ID NO: 564007 - DNA, 25 bp, Mus musculus
cagacatcgaactactgccgtcgta

SEQ ID NO: 564008 - DNA, 25 bp, Mus musculus
cagacatcgacaataacatgtcgga

SEQ ID NO: 564009 - DNA, 25 bp, Mus musculus
cagacatcgacattaacatgtcgga

SEQ ID NO: 564010 - DNA, 25 bp, Mus musculus
cagacatcgactccagtgacgagag

SEQ ID NO: 564011 - DNA, 25 bp, Mus musculus
cagacatcgactgcagtgacgagag

SEQ ID NO: 564012 - DNA, 25 bp, Mus musculus
cagacatcgtggagggaaagaaagt

SEQ ID NO: 564013 - DNA, 25 bp, Mus musculus
cagacatcgtggtgggaaagaaagt

SEQ ID NO: 564014 - DNA, 25 bp, Mus musculus
cagacatctggtcccaagatctaca

SEQ ID NO: 564015 - DNA, 25 bp, Mus musculus
cagacatctggtgccaagatctaca

SEQ ID NO: 564016 - DNA, 25 bp, Mus musculus
cagacatgaagcaaatttgctgccg

SEQ ID NO: 564017 - DNA, 25 bp, Mus musculus
cagacatgaagctaatttgctgccg

SEQ ID NO: 564018 - DNA, 25 bp, Mus musculus
cagacatgaagtcatcctggcagac

SEQ ID NO: 564019 - DNA, 25 bp, Mus musculus
cagacatgaagtgatcctggcagac

SEQ ID NO: 564020 - DNA, 25 bp, Mus musculus
cagacatgagtaacatttgtcagcc

SEQ ID NO: 564021 - DNA, 25 bp, Mus musculus
cagacatgagtatcatttgtcagcc

SEQ ID NO: 564022 - DNA, 25 bp, Mus musculus
cagacatgagtgatcggagagctgc

SEQ ID NO: 564023 - DNA, 25 bp, Mus musculus
cagacatgagtgttcggagagctgc

SEQ ID NO: 564024 - DNA, 25 bp, Mus musculus
cagacatgatacaaggaggtgtgta

SEQ ID NO: 564025 - DNA, 25 bp, Mus musculus
cagacatgatactaggaggtgtgta

SEQ ID NO: 564026 - DNA, 25 bp, Mus musculus
cagacatgctccctgaagccagttc

SEQ ID NO: 564027 - DNA, 25 bp, Mus musculus
cagacatgctccgtgaagccagttc

SEQ ID NO: 564028 - DNA, 25 bp, Mus musculus
cagacatgctggaaaccaaagctgt

SEQ ID NO: 564029 - DNA, 25 bp, Mus musculus
cagacatgctggtaaccaaagctgt

SEQ ID NO: 564030 - DNA, 25 bp, Mus musculus
cagacatgctgtcacttggtatggt

SEQ ID NO: 564031 - DNA, 25 bp, Mus musculus
cagacatgctgtgacttggtatggt

SEQ ID NO: 564032 - DNA, 25 bp, Mus musculus
cagacatgcttcaagatgtgtatca

SEQ ID NO: 564033 - DNA, 25 bp, Mus musculus
cagacatgcttctagatgtgtatca

SEQ ID NO: 564034 - DNA, 25 bp, Mus musculus
cagacatggagtcgaggtgctgtca

SEQ ID NO: 564035 - DNA, 25 bp, Mus musculus
cagacatggagtggaggtgctgtca

SEQ ID NO: 564036 - DNA, 25 bp, Mus musculus
cagacatggcagcaaaaatatttgc

SEQ ID NO: 564037 - DNA, 25 bp, Mus musculus
cagacatggcaggaaaaatatttgc

SEQ ID NO: 564038 - DNA, 25 bp, Mus musculus
cagacatgggaaaactgctgtggag

SEQ ID NO: 564039 - DNA, 25 bp, Mus musculus
cagacatgggaatactgctgtggag

SEQ ID NO: 564040 - DNA, 25 bp, Mus musculus
cagacattaacacaactgtcagtga

SEQ ID NO: 564041 - DNA, 25 bp, Mus musculus
cagacattaacagaactgtcagtga

SEQ ID NO: 564042 - DNA, 25 bp, Mus musculus
cagacattaggcagaaaacggagtt

SEQ ID NO: 564043 - DNA, 25 bp, Mus musculus
cagacattaggctgaaaacggagtt

SEQ ID NO: 564044 - DNA, 25 bp, Mus musculus
cagacattcccgcaagagcagaagc

SEQ ID NO: 564045 - DNA, 25 bp, Mus musculus
cagacattcccggaagagcagaagc

SEQ ID NO: 564046 - DNA, 25 bp, Mus musculus
cagacattcctgctctgaccataag

SEQ ID NO: 564047 - DNA, 25 bp, Mus musculus
cagacattcctggtctgaccataag

SEQ ID NO: 564048 - DNA, 25 bp, Mus musculus
cagacattctgtcattcagaacggc

SEQ ID NO: 564049 - DNA, 25 bp, Mus musculus
cagacattctgtgattcagaacggc

SEQ ID NO: 564050 - DNA, 25 bp, Mus musculus
cagacattggccaacagggaccgtt

SEQ ID NO: 564051 - DNA, 25 bp, Mus musculus
cagacattggcctacagggaccgtt

SEQ ID NO: 564052 - DNA, 25 bp, Mus musculus
cagacattgtgaaagccatcgctcg

SEQ ID NO: 564053 - DNA, 25 bp, Mus musculus
cagacattgtgatagccatcgctcg

SEQ ID NO: 564054 - DNA, 25 bp, Mus musculus
cagaccaacacgcagtaccactgtg

SEQ ID NO: 564055 - DNA, 25 bp, Mus musculus
cagaccaacacggagtaccactgtg

SEQ ID NO: 564056 - DNA, 25 bp, Mus musculus
cagaccaagaaaatggctctgctgt

SEQ ID NO: 564057 - DNA, 25 bp, Mus musculus
cagaccaagaaattggctctgctgt

SEQ ID NO: 564058 - DNA, 25 bp, Mus musculus
cagaccaagaagatggaactctata

SEQ ID NO: 564059 - DNA, 25 bp, Mus musculus
cagaccaagaagttggaactctata

SEQ ID NO: 564060 - DNA, 25 bp, Mus musculus
cagaccaagaatacactgcaacaag

SEQ ID NO: 564061 - DNA, 25 bp, Mus musculus
cagaccaagaatagatgagatgact

SEQ ID NO: 564062 - DNA, 25 bp, Mus musculus
cagaccaagaattcactgcaacaag

SEQ ID NO: 564063 - DNA, 25 bp, Mus musculus
cagaccaagaattgatgagatgact

SEQ ID NO: 564064 - DNA, 25 bp, Mus musculus
cagaccaagacaccggccaagtgtg

SEQ ID NO: 564065 - DNA, 25 bp, Mus musculus
cagaccaagacagcggccaagtgtg

SEQ ID NO: 564066 - DNA, 25 bp, Mus musculus
cagaccaagatgactgagcgagcgc

SEQ ID NO: 564067 - DNA, 25 bp, Mus musculus
cagaccaagatgagcctctaagggc

SEQ ID NO: 564068 - DNA, 25 bp, Mus musculus
cagaccaagatgagtgccagtgacc

SEQ ID NO: 564069 - DNA, 25 bp, Mus musculus
cagaccaagatgtctgagcgagcgc

SEQ ID NO: 564070 - DNA, 25 bp, Mus musculus
cagaccaagatgtgcctctaagggc

SEQ ID NO: 564071 - DNA, 25 bp, Mus musculus
cagaccaagatgtgtgccagtgacc

SEQ ID NO: 564072 - DNA, 25 bp, Mus musculus
cagaccacagaacctgtgcttagag

SEQ ID NO: 564073 - DNA, 25 bp, Mus musculus
cagaccacagaagctgtgcttagag

SEQ ID NO: 564074 - DNA, 25 bp, Mus musculus
cagaccacatatcctttacagagtc

SEQ ID NO: 564075 - DNA, 25 bp, Mus musculus
cagaccacatatgctttacagagtc

SEQ ID NO: 564076 - DNA, 25 bp, Mus musculus
cagaccaccatgactttgacaacgt

SEQ ID NO: 564077 - DNA, 25 bp, Mus musculus
cagaccaccatgtctttgacaacgt

SEQ ID NO: 564078 - DNA, 25 bp, Mus musculus
cagaccagagagcacacgcgcgacg

SEQ ID NO: 564079 - DNA, 25 bp, Mus musculus
cagaccagagaggacacgcgcgacg

SEQ ID NO: 564080 - DNA, 25 bp, Mus musculus
cagaccagcaaactcaacatttccg

SEQ ID NO: 564081 - DNA, 25 bp, Mus musculus
cagaccagcaaagtcaacatttccg

SEQ ID NO: 564082 - DNA, 25 bp, Mus musculus
cagaccagcggccctttgcagagga

SEQ ID NO: 564083 - DNA, 25 bp, Mus musculus
cagaccagcggcgctttgcagagga

SEQ ID NO: 564084 - DNA, 25 bp, Mus musculus
cagaccagctcacaggagtttctgg

SEQ ID NO: 564085 - DNA, 25 bp, Mus musculus
cagaccagctcagaggagtttctgg

SEQ ID NO: 564086 - DNA, 25 bp, Mus musculus
cagaccaggagaacagagaaatgca

SEQ ID NO: 564087 - DNA, 25 bp, Mus musculus
cagaccaggagatcagagaaatgca

SEQ ID NO: 564088 - DNA, 25 bp, Mus musculus
cagaccaggcctccgagtccatgtt

SEQ ID NO: 564089 - DNA, 25 bp, Mus musculus
cagaccaggcctgcgagtccatgtt

SEQ ID NO: 564090 - DNA, 25 bp, Mus musculus
cagaccatgaacagtgaccctggcc

SEQ ID NO: 564091 - DNA, 25 bp, Mus musculus
cagaccatgaactgtgaccctggcc

SEQ ID NO: 564092 - DNA, 25 bp, Mus musculus
cagaccatgaagcttgttgagaaca

SEQ ID NO: 564093 - DNA, 25 bp, Mus musculus
cagaccatgaaggttgttgagaaca

SEQ ID NO: 564094 - DNA, 25 bp, Mus musculus
cagaccatgtgtacgcgggatgccc

SEQ ID NO: 564095 - DNA, 25 bp, Mus musculus
cagaccatgtgttcgcgggatgccc

SEQ ID NO: 564096 - DNA, 25 bp, Mus musculus
cagaccatttccattacatcgggta

SEQ ID NO: 564097 - DNA, 25 bp, Mus musculus
cagaccatttcctttacatcgggta

SEQ ID NO: 564098 - DNA, 25 bp, Mus musculus
cagacccagcggagtgccttgctgc

SEQ ID NO: 564099 - DNA, 25 bp, Mus musculus
cagacccagcggtgtgccttgctgc

SEQ ID NO: 564100 - DNA, 25 bp, Mus musculus
cagacccagctgctcgtcgtgggct

SEQ ID NO: 564101 - DNA, 25 bp, Mus musculus
cagacccagctggtcgtcgtgggct

SEQ ID NO: 564102 - DNA, 25 bp, Mus musculus
cagacccaggaaaaatcaagcggat

SEQ ID NO: 564103 - DNA, 25 bp, Mus musculus
cagacccaggaataatcaagcggat

SEQ ID NO: 564104 - DNA, 25 bp, Mus musculus
cagacccattgtcaagtcagcgtgg

SEQ ID NO: 564105 - DNA, 25 bp, Mus musculus
cagacccattgtgaagtcagcgtgg

SEQ ID NO: 564106 - DNA, 25 bp, Mus musculus
cagacccgacagatttgtctcgtga

SEQ ID NO: 564107 - DNA, 25 bp, Mus musculus
cagacccgacagttttgtctcgtga

SEQ ID NO: 564108 - DNA, 25 bp, Mus musculus
cagacccgcacactggtaatgccgt

SEQ ID NO: 564109 - DNA, 25 bp, Mus musculus
cagacccgcacagtggtaatgccgt

SEQ ID NO: 564110 - DNA, 25 bp, Mus musculus
cagacccgcagccttgaacttcagt

SEQ ID NO: 564111 - DNA, 25 bp, Mus musculus
cagacccgcagcgttgaacttcagt

SEQ ID NO: 564112 - DNA, 25 bp, Mus musculus
cagaccctaccgagaactctgacgg

SEQ ID NO: 564113 - DNA, 25 bp, Mus musculus
cagaccctaccgtgaactctgacgg

SEQ ID NO: 564114 - DNA, 25 bp, Mus musculus
cagaccctagtgatgctgacaaggc

SEQ ID NO: 564115 - DNA, 25 bp, Mus musculus
cagaccctagtgttgctgacaaggc

SEQ ID NO: 564116 - DNA, 25 bp, Mus musculus
cagaccctcgagcagatctggacag

SEQ ID NO: 564117 - DNA, 25 bp, Mus musculus
cagaccctcgaggagatctggacag

SEQ ID NO: 564118 - DNA, 25 bp, Mus musculus
cagaccctcggcctgtgtaaacaca

SEQ ID NO: 564119 - DNA, 25 bp, Mus musculus
cagaccctcggcgtgtgtaaacaca

SEQ ID NO: 564120 - DNA, 25 bp, Mus musculus
cagaccctgaaacccggacagtggc

SEQ ID NO: 564121 - DNA, 25 bp, Mus musculus
cagaccctgaaagccggacagtggc

SEQ ID NO: 564122 - DNA, 25 bp, Mus musculus
cagaccctgagaaattggaccaaat

SEQ ID NO: 564123 - DNA, 25 bp, Mus musculus
cagaccctgagatattggaccaaat

SEQ ID NO: 564124 - DNA, 25 bp, Mus musculus
cagaccctgaggaaggccatgaaag

SEQ ID NO: 564125 - DNA, 25 bp, Mus musculus
cagaccctgaggtaggccatgaaag

SEQ ID NO: 564126 - DNA, 25 bp, Mus musculus
cagaccctgagtcgtatgtcggcct

SEQ ID NO: 564127 - DNA, 25 bp, Mus musculus
cagaccctgagtggtatgtcggcct

SEQ ID NO: 564128 - DNA, 25 bp, Mus musculus
cagaccctgatccacttggttgagg

SEQ ID NO: 564129 - DNA, 25 bp, Mus musculus
cagaccctgatcgacttggttgagg

SEQ ID NO: 564130 - DNA, 25 bp, Mus musculus
cagaccctgtgaacttccgagcaaa

SEQ ID NO: 564131 - DNA, 25 bp, Mus musculus
cagaccctgtgatcttccgagcaaa

SEQ ID NO: 564132 - DNA, 25 bp, Mus musculus
cagacccttgatcgtcattcatcac

SEQ ID NO: 564133 - DNA, 25 bp, Mus musculus
cagacccttgatggtcattcatcac

SEQ ID NO: 564134 - DNA, 25 bp, Mus musculus
cagaccgaacgcctattgaggcaag

SEQ ID NO: 564135 - DNA, 25 bp, Mus musculus
cagaccgaacgcgtattgaggcaag

SEQ ID NO: 564136 - DNA, 25 bp, Mus musculus
cagaccgaagctagtttgatcaagg

SEQ ID NO: 564137 - DNA, 25 bp, Mus musculus
cagaccgaagcttgtttgatcaagg

SEQ ID NO: 564138 - DNA, 25 bp, Mus musculus
cagaccgccatgaccgagacttacg

SEQ ID NO: 564139 - DNA, 25 bp, Mus musculus
cagaccgccatgtccgagacttacg

SEQ ID NO: 564140 - DNA, 25 bp, Mus musculus
cagaccgcttttagccgcgagccga

SEQ ID NO: 564141 - DNA, 25 bp, Mus musculus
cagaccgctttttgccgcgagccga

SEQ ID NO: 564142 - DNA, 25 bp, Mus musculus
cagaccggacgtaccctatgacagt

SEQ ID NO: 564143 - DNA, 25 bp, Mus musculus
cagaccggacgtctttagtcagagc

SEQ ID NO: 564144 - DNA, 25 bp, Mus musculus
cagaccggacgtgtttagtcagagc

SEQ ID NO: 564145 - DNA, 25 bp, Mus musculus
cagaccggacgttccctatgacagt

SEQ ID NO: 564146 - DNA, 25 bp, Mus musculus
cagaccggcacgcatgaaaacccag

SEQ ID NO: 564147 - DNA, 25 bp, Mus musculus
cagaccggcacggatgaaaacccag

SEQ ID NO: 564148 - DNA, 25 bp, Mus musculus
cagaccgtctttattcgcgatccaa

SEQ ID NO: 564149 - DNA, 25 bp, Mus musculus
cagaccgtcttttttcgcgatccaa

SEQ ID NO: 564150 - DNA, 25 bp, Mus musculus
cagaccgtgcacactgagtaccaca

SEQ ID NO: 564151 - DNA, 25 bp, Mus musculus
cagaccgtgcactctgagtaccaca

SEQ ID NO: 564152 - DNA, 25 bp, Mus musculus
cagacctaagtgcagtgtccttgct

SEQ ID NO: 564153 - DNA, 25 bp, Mus musculus
cagacctaagtggagtgtccttgct

SEQ ID NO: 564154 - DNA, 25 bp, Mus musculus
cagacctaggctagcaggatcggct

SEQ ID NO: 564155 - DNA, 25 bp, Mus musculus
cagacctaggcttgcaggatcggct

SEQ ID NO: 564156 - DNA, 25 bp, Mus musculus
cagacctagttacgcctctgcagat

SEQ ID NO: 564157 - DNA, 25 bp, Mus musculus
cagacctagttaggcctctgcagat

SEQ ID NO: 564158 - DNA, 25 bp, Mus musculus
cagacctccagaagttcttctgggc

SEQ ID NO: 564159 - DNA, 25 bp, Mus musculus
cagacctccagatgttcttctgggc

SEQ ID NO: 564160 - DNA, 25 bp, Mus musculus
cagacctcccttagagcattgagtg

SEQ ID NO: 564161 - DNA, 25 bp, Mus musculus
cagacctccctttgagcattgagtg

SEQ ID NO: 564162 - DNA, 25 bp, Mus musculus
cagacctcctggagacggtcaagca

SEQ ID NO: 564163 - DNA, 25 bp, Mus musculus
cagacctcctggtgacggtcaagca

SEQ ID NO: 564164 - DNA, 25 bp, Mus musculus
cagacctcgggcagcctttgtttga

SEQ ID NO: 564165 - DNA, 25 bp, Mus musculus
cagacctcgggctgcctttgtttga

SEQ ID NO: 564166 - DNA, 25 bp, Mus musculus
cagacctcgtggctcgcatgctgct

SEQ ID NO: 564167 - DNA, 25 bp, Mus musculus
cagacctcgtgggtcgcatgctgct

SEQ ID NO: 564168 - DNA, 25 bp, Mus musculus
cagacctctgtgcacgggtccgaga

SEQ ID NO: 564169 - DNA, 25 bp, Mus musculus
cagacctctgtggacgggtccgaga

SEQ ID NO: 564170 - DNA, 25 bp, Mus musculus
cagacctgacttagtgaacatccag

SEQ ID NO: 564171 - DNA, 25 bp, Mus musculus
cagacctgactttgtgaacatccag

SEQ ID NO: 564172 - DNA, 25 bp, Mus musculus
cagacctgatagctgagcttctcag

SEQ ID NO: 564173 - DNA, 25 bp, Mus musculus
cagacctgataggtgagcttctcag

SEQ ID NO: 564174 - DNA, 25 bp, Mus musculus
cagacctgatatcgttcttcttggg

SEQ ID NO: 564175 - DNA, 25 bp, Mus musculus
cagacctgatatggttcttcttggg

SEQ ID NO: 564176 - DNA, 25 bp, Mus musculus
cagacctgatctactgcctgatgca

SEQ ID NO: 564177 - DNA, 25 bp, Mus musculus
cagacctgatcttctgcctgatgca

SEQ ID NO: 564178 - DNA, 25 bp, Mus musculus
cagacctgccacaacttccatgaag

SEQ ID NO: 564179 - DNA, 25 bp, Mus musculus
cagacctgccactacttccatgaag

SEQ ID NO: 564180 - DNA, 25 bp, Mus musculus
cagacctgctgacctgaaagcaaaa

SEQ ID NO: 564181 - DNA, 25 bp, Mus musculus
cagacctgctgagctgaaagcaaaa

SEQ ID NO: 564182 - DNA, 25 bp, Mus musculus
cagacctggcttcaatgtgctcaag

SEQ ID NO: 564183 - DNA, 25 bp, Mus musculus
cagacctggcttgaatgtgctcaag

SEQ ID NO: 564184 - DNA, 25 bp, Mus musculus
cagacctgggaaacacagtgctcct

SEQ ID NO: 564185 - DNA, 25 bp, Mus musculus
cagacctgggaatcacagtgctcct

SEQ ID NO: 564186 - DNA, 25 bp, Mus musculus
cagacctgggagcttgtccagccca

SEQ ID NO: 564187 - DNA, 25 bp, Mus musculus
cagacctgggaggttgtccagccca

SEQ ID NO: 564188 - DNA, 25 bp, Mus musculus
cagacctgggcaaagtgatagaaag

SEQ ID NO: 564189 - DNA, 25 bp, Mus musculus
cagacctgggcatagtgatagaaag

SEQ ID NO: 564190 - DNA, 25 bp, Mus musculus
cagacctgggccaattactttgtca

SEQ ID NO: 564191 - DNA, 25 bp, Mus musculus
cagacctgggcctattactttgtca

SEQ ID NO: 564192 - DNA, 25 bp, Mus musculus
cagacctggtgtattagtagtgcca

SEQ ID NO: 564193 - DNA, 25 bp, Mus musculus
cagacctggtgttttagtagtgcca

SEQ ID NO: 564194 - DNA, 25 bp, Mus musculus
cagacctgtggaaacctggatgtga

SEQ ID NO: 564195 - DNA, 25 bp, Mus musculus
cagacctgtggatacctggatgtga

SEQ ID NO: 564196 - DNA, 25 bp, Mus musculus
cagaccttatttccctaaagatgag

SEQ ID NO: 564197 - DNA, 25 bp, Mus musculus
cagaccttatttgcctaaagatgag

SEQ ID NO: 564198 - DNA, 25 bp, Mus musculus
cagaccttcaagatccgcatggaac

SEQ ID NO: 564199 - DNA, 25 bp, Mus musculus
cagaccttcaagttccgcatggaac

SEQ ID NO: 564200 - DNA, 25 bp, Mus musculus
cagaccttttaaagcgttgaagaca

SEQ ID NO: 564201 - DNA, 25 bp, Mus musculus
cagaccttttaatgcgttgaagaca

SEQ ID NO: 564202 - DNA, 25 bp, Mus musculus
cagacgaaagccattaaagaccaac

SEQ ID NO: 564203 - DNA, 25 bp, Mus musculus
cagacgaaagcctttaaagaccaac

SEQ ID NO: 564204 - DNA, 25 bp, Mus musculus
cagacgacaaaactcaactcacaga

SEQ ID NO: 564205 - DNA, 25 bp, Mus musculus
cagacgacaaaagtcaactcacaga

SEQ ID NO: 564206 - DNA, 25 bp, Mus musculus
cagacgacgactaccaaaacaccga

SEQ ID NO: 564207 - DNA, 25 bp, Mus musculus
cagacgacgacttccaaaacaccga

SEQ ID NO: 564208 - DNA, 25 bp, Mus musculus
cagacgacgagaactatgacggaat

SEQ ID NO: 564209 - DNA, 25 bp, Mus musculus
cagacgacgagatctatgacggaat

SEQ ID NO: 564210 - DNA, 25 bp, Mus musculus
cagacgacggccattgcaatagaat

SEQ ID NO: 564211 - DNA, 25 bp, Mus musculus
cagacgacggcctttgcaatagaat

SEQ ID NO: 564212 - DNA, 25 bp, Mus musculus
cagacgactgccacatagatgccat

SEQ ID NO: 564213 - DNA, 25 bp, Mus musculus
cagacgactgcctcatagatgccat

SEQ ID NO: 564214 - DNA, 25 bp, Mus musculus
cagacgagccacctttgttgagtga

SEQ ID NO: 564215 - DNA, 25 bp, Mus musculus
cagacgagccacgtttgttgagtga

SEQ ID NO: 564216 - DNA, 25 bp, Mus musculus
cagacgagccccaaagactgcagtt

SEQ ID NO: 564217 - DNA, 25 bp, Mus musculus
cagacgagcccctaagactgcagtt

SEQ ID NO: 564218 - DNA, 25 bp, Mus musculus
cagacgagcgagagaagtggatcca

SEQ ID NO: 564219 - DNA, 25 bp, Mus musculus
cagacgagcgagtgaagtggatcca

SEQ ID NO: 564220 - DNA, 25 bp, Mus musculus
cagacgagcgtcatggctgcttgga

SEQ ID NO: 564221 - DNA, 25 bp, Mus musculus
cagacgagcgtcttggctgcttgga

SEQ ID NO: 564222 - DNA, 25 bp, Mus musculus
cagacgagctccagagctggaagag

SEQ ID NO: 564223 - DNA, 25 bp, Mus musculus
cagacgagctcctgagctggaagag

SEQ ID NO: 564224 - DNA, 25 bp, Mus musculus
cagacgatatgtatgcggttggata

SEQ ID NO: 564225 - DNA, 25 bp, Mus musculus
cagacgatatgtttgcggttggata

SEQ ID NO: 564226 - DNA, 25 bp, Mus musculus
cagacgatctctcgacccgttttgt

SEQ ID NO: 564227 - DNA, 25 bp, Mus musculus
cagacgatctctggacccgttttgt

SEQ ID NO: 564228 - DNA, 25 bp, Mus musculus
cagacgatgtctataccaaagagga

SEQ ID NO: 564229 - DNA, 25 bp, Mus musculus
cagacgatgtctttaccaaagagga

SEQ ID NO: 564230 - DNA, 25 bp, Mus musculus
cagacgattgtgatctgcctgagtt

SEQ ID NO: 564231 - DNA, 25 bp, Mus musculus
cagacgattgtgttctgcctgagtt

SEQ ID NO: 564232 - DNA, 25 bp, Mus musculus
cagacgccatctatgatgagtggct

SEQ ID NO: 564233 - DNA, 25 bp, Mus musculus
cagacgccatctttgatgagtggct

SEQ ID NO: 564234 - DNA, 25 bp, Mus musculus
cagacgccatgacggctctgttgtt

SEQ ID NO: 564235 - DNA, 25 bp, Mus musculus
cagacgccatgagggctctgttgtt

SEQ ID NO: 564236 - DNA, 25 bp, Mus musculus
cagacgcgctcaagaaagagcagct

SEQ ID NO: 564237 - DNA, 25 bp, Mus musculus
cagacgcgctcatgaaagagcagct

SEQ ID NO: 564238 - DNA, 25 bp, Mus musculus
cagacgctagctctagctggcaggc

SEQ ID NO: 564239 - DNA, 25 bp, Mus musculus
cagacgctagctgtagctggcaggc

SEQ ID NO: 564240 - DNA, 25 bp, Mus musculus
cagacgctgaggagagctagctgca

SEQ ID NO: 564241 - DNA, 25 bp, Mus musculus
cagacgctgaggtgagctagctgca

SEQ ID NO: 564242 - DNA, 25 bp, Mus musculus
cagacgctgcgaccgcaatggcagc

SEQ ID NO: 564243 - DNA, 25 bp, Mus musculus
cagacgctgcgagcgcaatggcagc

SEQ ID NO: 564244 - DNA, 25 bp, Mus musculus
cagacggaccaactggatttggctt

SEQ ID NO: 564245 - DNA, 25 bp, Mus musculus
cagacggaccaagtggatttggctt

SEQ ID NO: 564246 - DNA, 25 bp, Mus musculus
cagacggcatgtcacctaagaagga

SEQ ID NO: 564247 - DNA, 25 bp, Mus musculus
cagacggcatgtgacctaagaagga

SEQ ID NO: 564248 - DNA, 25 bp, Mus musculus
cagacggccacaagatgtttgcaat

SEQ ID NO: 564249 - DNA, 25 bp, Mus musculus
cagacggccacatgatgtttgcaat

SEQ ID NO: 564250 - DNA, 25 bp, Mus musculus
cagacggcgaagacatggccttgag

SEQ ID NO: 564251 - DNA, 25 bp, Mus musculus
cagacggcgaagtcatggccttgag

SEQ ID NO: 564252 - DNA, 25 bp, Mus musculus
cagacggcgctgcacatagtcaatc

SEQ ID NO: 564253 - DNA, 25 bp, Mus musculus
cagacggcgctggacatagtcaatc

SEQ ID NO: 564254 - DNA, 25 bp, Mus musculus
cagacgggacaacagaagttgctga

SEQ ID NO: 564255 - DNA, 25 bp, Mus musculus
cagacgggacaagagaagttgctga

SEQ ID NO: 564256 - DNA, 25 bp, Mus musculus
cagacgggatacatgccttcctttc

SEQ ID NO: 564257 - DNA, 25 bp, Mus musculus
cagacgggatacttgccttcctttc

SEQ ID NO: 564258 - DNA, 25 bp, Mus musculus
cagacggtcagcagttgagaggttc

SEQ ID NO: 564259 - DNA, 25 bp, Mus musculus
cagacggtcagctgttgagaggttc

SEQ ID NO: 564260 - DNA, 25 bp, Mus musculus
cagacggtggccacggaaatccgtt

SEQ ID NO: 564261 - DNA, 25 bp, Mus musculus
cagacggtggcctcggaaatccgtt

SEQ ID NO: 564262 - DNA, 25 bp, Mus musculus
cagacggttctaacctgagcggcgt

SEQ ID NO: 564263 - DNA, 25 bp, Mus musculus
cagacggttctatcctgagcggcgt

SEQ ID NO: 564264 - DNA, 25 bp, Mus musculus
cagacgtcatagatgcggatcctca

SEQ ID NO: 564265 - DNA, 25 bp, Mus musculus
cagacgtcatagttgcggatcctca

SEQ ID NO: 564266 - DNA, 25 bp, Mus musculus
cagacgtcctctcggctcacgaggg

SEQ ID NO: 564267 - DNA, 25 bp, Mus musculus
cagacgtcctctgggctcacgaggg

SEQ ID NO: 564268 - DNA, 25 bp, Mus musculus
cagacgtcttttcggtccatgtacc

SEQ ID NO: 564269 - DNA, 25 bp, Mus musculus
cagacgtcttttgggtccatgtacc

SEQ ID NO: 564270 - DNA, 25 bp, Mus musculus
cagacgtgactgagcgcttgctctc

SEQ ID NO: 564271 - DNA, 25 bp, Mus musculus
cagacgtgactgtgcgcttgctctc

SEQ ID NO: 564272 - DNA, 25 bp, Mus musculus
cagacgtgagcactaatgaaagtaa

SEQ ID NO: 564273 - DNA, 25 bp, Mus musculus
cagacgtgagcagtaatgaaagtaa

SEQ ID NO: 564274 - DNA, 25 bp, Mus musculus
cagacgtggcacaggctcatgacag

SEQ ID NO: 564275 - DNA, 25 bp, Mus musculus
cagacgtggcactggctcatgacag

SEQ ID NO: 564276 - DNA, 25 bp, Mus musculus
cagacgtggcctactctcatgatgg

SEQ ID NO: 564277 - DNA, 25 bp, Mus musculus
cagacgtggccttctctcatgatgg

SEQ ID NO: 564278 - DNA, 25 bp, Mus musculus
cagacgtggcggacactggtgatcc

SEQ ID NO: 564279 - DNA, 25 bp, Mus musculus
cagacgtggcggtcactggtgatcc

SEQ ID NO: 564280 - DNA, 25 bp, Mus musculus
cagacgtgttttcaacagagagcag

SEQ ID NO: 564281 - DNA, 25 bp, Mus musculus
cagacgtgttttgaacagagagcag

SEQ ID NO: 564282 - DNA, 25 bp, Mus musculus
cagacgttacccatgttgctcagct

SEQ ID NO: 564283 - DNA, 25 bp, Mus musculus
cagacgttacccttgttgctcagct

SEQ ID NO: 564284 - DNA, 25 bp, Mus musculus
cagacgttctgcaaggagatctcac

SEQ ID NO: 564285 - DNA, 25 bp, Mus musculus
cagacgttctgctaggagatctcac

SEQ ID NO: 564286 - DNA, 25 bp, Mus musculus
cagacgtttgttcccgtgcgaccag

SEQ ID NO: 564287 - DNA, 25 bp, Mus musculus
cagacgtttgttgccgtgcgaccag

SEQ ID NO: 564288 - DNA, 25 bp, Mus musculus
cagactaaagctccccaagaataca

SEQ ID NO: 564289 - DNA, 25 bp, Mus musculus
cagactaaagctgcccaagaataca

SEQ ID NO: 564290 - DNA, 25 bp, Mus musculus
cagactaatgcgaaacaagttcaca

SEQ ID NO: 564291 - DNA, 25 bp, Mus musculus
cagactaatgcgtaacaagttcaca

SEQ ID NO: 564292 - DNA, 25 bp, Mus musculus
cagactacaccaaataaagatgctg

SEQ ID NO: 564293 - DNA, 25 bp, Mus musculus
cagactacaccatataaagatgctg

SEQ ID NO: 564294 - DNA, 25 bp, Mus musculus
cagactacagaaacctgctcaagga

SEQ ID NO: 564295 - DNA, 25 bp, Mus musculus
cagactacagaatcctgctcaagga

SEQ ID NO: 564296 - DNA, 25 bp, Mus musculus
cagactacagcgctaagaacactta

SEQ ID NO: 564297 - DNA, 25 bp, Mus musculus
cagactacagcggtaagaacactta

SEQ ID NO: 564298 - DNA, 25 bp, Mus musculus
cagactacctctatgaaagtggaga

SEQ ID NO: 564299 - DNA, 25 bp, Mus musculus
cagactacctctttgaaagtggaga

SEQ ID NO: 564300 - DNA, 25 bp, Mus musculus
cagactactccaattgcacttcagg

SEQ ID NO: 564301 - DNA, 25 bp, Mus musculus
cagactactccatttgcacttcagg

SEQ ID NO: 564302 - DNA, 25 bp, Mus musculus
cagactagagacagaatgtgtgagt

SEQ ID NO: 564303 - DNA, 25 bp, Mus musculus
cagactagagactgaatgtgtgagt

SEQ ID NO: 564304 - DNA, 25 bp, Mus musculus
cagactagcatcactcagtgggttc

SEQ ID NO: 564305 - DNA, 25 bp, Mus musculus
cagactagcatctctcagtgggttc

SEQ ID NO: 564306 - DNA, 25 bp, Mus musculus
cagactagggtgctggctgtgtgcg

SEQ ID NO: 564307 - DNA, 25 bp, Mus musculus
cagactagggtggtggctgtgtgcg

SEQ ID NO: 564308 - DNA, 25 bp, Mus musculus
cagactagttttcgatacattcaca

SEQ ID NO: 564309 - DNA, 25 bp, Mus musculus
cagactagttttggatacattcaca

SEQ ID NO: 564310 - DNA, 25 bp, Mus musculus
cagactatagtacgattggatacca

SEQ ID NO: 564311 - DNA, 25 bp, Mus musculus
cagactatagtaggattggatacca

SEQ ID NO: 564312 - DNA, 25 bp, Mus musculus
cagactatcaagaatgagaactcac

SEQ ID NO: 564313 - DNA, 25 bp, Mus musculus
cagactatcaagtatgagaactcac

SEQ ID NO: 564314 - DNA, 25 bp, Mus musculus
cagactatcacacgtacagtgcggg

SEQ ID NO: 564315 - DNA, 25 bp, Mus musculus
cagactatcacaggtacagtgcggg

SEQ ID NO: 564316 - DNA, 25 bp, Mus musculus
cagactcaagaacccagtgcccgga

SEQ ID NO: 564317 - DNA, 25 bp, Mus musculus
cagactcaagaagccagtgcccgga

SEQ ID NO: 564318 - DNA, 25 bp, Mus musculus
cagactcagactcgtggacccaaac

SEQ ID NO: 564319 - DNA, 25 bp, Mus musculus
cagactcagactggtggacccaaac

SEQ ID NO: 564320 - DNA, 25 bp, Mus musculus
cagactcagcctctgtgatcggcct

SEQ ID NO: 564321 - DNA, 25 bp, Mus musculus
cagactcagcctgtgtgatcggcct

SEQ ID NO: 564322 - DNA, 25 bp, Mus musculus
cagactcaggacaggagatccggga

SEQ ID NO: 564323 - DNA, 25 bp, Mus musculus
cagactcaggactggagatccggga

SEQ ID NO: 564324 - DNA, 25 bp, Mus musculus
cagactcagtacagcctttgaccct

SEQ ID NO: 564325 - DNA, 25 bp, Mus musculus
cagactcagtaccagacactgcagc

SEQ ID NO: 564326 - DNA, 25 bp, Mus musculus
cagactcagtacgagacactgcagc

SEQ ID NO: 564327 - DNA, 25 bp, Mus musculus
cagactcagtactgcctttgaccct

SEQ ID NO: 564328 - DNA, 25 bp, Mus musculus
cagactcatcttagtaaagaggaaa

SEQ ID NO: 564329 - DNA, 25 bp, Mus musculus
cagactcatctttgtaaagaggaaa

SEQ ID NO: 564330 - DNA, 25 bp, Mus musculus
cagactcatgatcccgaagagccag

SEQ ID NO: 564331 - DNA, 25 bp, Mus musculus
cagactcatgatgccgaagagccag

SEQ ID NO: 564332 - DNA, 25 bp, Mus musculus
cagactccaacaccaaatagtacag

SEQ ID NO: 564333 - DNA, 25 bp, Mus musculus
cagactccaacagcaaatagtacag

SEQ ID NO: 564334 - DNA, 25 bp, Mus musculus
cagactccggtgaagtaccagcaga

SEQ ID NO: 564335 - DNA, 25 bp, Mus musculus
cagactccggtgtagtaccagcaga

SEQ ID NO: 564336 - DNA, 25 bp, Mus musculus
cagactcctgcgaagtggcactcct

SEQ ID NO: 564337 - DNA, 25 bp, Mus musculus
cagactcctgcgtagtggcactcct

SEQ ID NO: 564338 - DNA, 25 bp, Mus musculus
cagactcctttgattgtagtcatcc

SEQ ID NO: 564339 - DNA, 25 bp, Mus musculus
cagactcctttgtttgtagtcatcc

SEQ ID NO: 564340 - DNA, 25 bp, Mus musculus
cagactcgagagatgagcgcttcaa

SEQ ID NO: 564341 - DNA, 25 bp, Mus musculus
cagactcgagagttgagcgcttcaa

SEQ ID NO: 564342 - DNA, 25 bp, Mus musculus
cagactcgccaacttagaaatctat

SEQ ID NO: 564343 - DNA, 25 bp, Mus musculus
cagactcgccaagttagaaatctat

SEQ ID NO: 564344 - DNA, 25 bp, Mus musculus
cagactcggctaccaactcagctga

SEQ ID NO: 564345 - DNA, 25 bp, Mus musculus
cagactcggctagcaactcagctga

SEQ ID NO: 564346 - DNA, 25 bp, Mus musculus
cagactcgtggcaccaaatttgtta

SEQ ID NO: 564347 - DNA, 25 bp, Mus musculus
cagactcgtggctccaaatttgtta

SEQ ID NO: 564348 - DNA, 25 bp, Mus musculus
cagactctctccatcgggctggtgt

SEQ ID NO: 564349 - DNA, 25 bp, Mus musculus
cagactctctccttcgggctggtgt

SEQ ID NO: 564350 - DNA, 25 bp, Mus musculus
cagactctgctgatgaccttgtcat

SEQ ID NO: 564351 - DNA, 25 bp, Mus musculus
cagactctgctgttgaccttgtcat

SEQ ID NO: 564352 - DNA, 25 bp, Mus musculus
cagactctggcactatggtcatggc

SEQ ID NO: 564353 - DNA, 25 bp, Mus musculus
cagactctggcagtatggtcatggc

SEQ ID NO: 564354 - DNA, 25 bp, Mus musculus
cagactctgggcatatgacatattc

SEQ ID NO: 564355 - DNA, 25 bp, Mus musculus
cagactctgggcatgggcaagagaa

SEQ ID NO: 564356 - DNA, 25 bp, Mus musculus
cagactctgggcttatgacatattc

SEQ ID NO: 564357 - DNA, 25 bp, Mus musculus
cagactctgggcttgggcaagagaa

SEQ ID NO: 564358 - DNA, 25 bp, Mus musculus
cagactcttagacatggagttggaa

SEQ ID NO: 564359 - DNA, 25 bp, Mus musculus
cagactcttagagatggagttggaa

SEQ ID NO: 564360 - DNA, 25 bp, Mus musculus
cagactcttgatcgtggctggatcc

SEQ ID NO: 564361 - DNA, 25 bp, Mus musculus
cagactcttgatggtggctggatcc

SEQ ID NO: 564362 - DNA, 25 bp, Mus musculus
cagactgactccaaaactgatggaa

SEQ ID NO: 564363 - DNA, 25 bp, Mus musculus
cagactgactcctaaactgatggaa

SEQ ID NO: 564364 - DNA, 25 bp, Mus musculus
cagactgagaaaacccatagttaaa

SEQ ID NO: 564365 - DNA, 25 bp, Mus musculus
cagactgagaaatcccatagttaaa

SEQ ID NO: 564366 - DNA, 25 bp, Mus musculus
cagactgagccactgcattgcagaa

SEQ ID NO: 564367 - DNA, 25 bp, Mus musculus
cagactgagccagtgcattgcagaa

SEQ ID NO: 564368 - DNA, 25 bp, Mus musculus
cagactgagctgaggccaaccgttt

SEQ ID NO: 564369 - DNA, 25 bp, Mus musculus
cagactgagctgtggccaaccgttt

SEQ ID NO: 564370 - DNA, 25 bp, Mus musculus
cagactgaggcaactagcagacaga

SEQ ID NO: 564371 - DNA, 25 bp, Mus musculus
cagactgaggcatctagcagacaga

SEQ ID NO: 564372 - DNA, 25 bp, Mus musculus
cagactgagtgcacaagaacgacct

SEQ ID NO: 564373 - DNA, 25 bp, Mus musculus
cagactgagtgctcaagaacgacct

SEQ ID NO: 564374 - DNA, 25 bp, Mus musculus
cagactgatgtgcttgtgcgagtca

SEQ ID NO: 564375 - DNA, 25 bp, Mus musculus
cagactgatgtggttgtgcgagtca

SEQ ID NO: 564376 - DNA, 25 bp, Mus musculus
cagactgcacttagaagattcttga

SEQ ID NO: 564377 - DNA, 25 bp, Mus musculus
cagactgcactttgaagattcttga

SEQ ID NO: 564378 - DNA, 25 bp, Mus musculus
cagactgccggccatattgggagaa

SEQ ID NO: 564379 - DNA, 25 bp, Mus musculus
cagactgccggcgatattgggagaa

SEQ ID NO: 564380 - DNA, 25 bp, Mus musculus
cagactgctcagcacactttgtgca

SEQ ID NO: 564381 - DNA, 25 bp, Mus musculus
cagactgctcaggacactttgtgca

SEQ ID NO: 564382 - DNA, 25 bp, Mus musculus
cagactgctggcacagacaacaaga

SEQ ID NO: 564383 - DNA, 25 bp, Mus musculus
cagactgctggcagatagctgtgct

SEQ ID NO: 564384 - DNA, 25 bp, Mus musculus
cagactgctggctcagacaacaaga

SEQ ID NO: 564385 - DNA, 25 bp, Mus musculus
cagactgctggctgatagctgtgct

SEQ ID NO: 564386 - DNA, 25 bp, Mus musculus
cagactgcttcacggacggtgtccg

SEQ ID NO: 564387 - DNA, 25 bp, Mus musculus
cagactgcttcagggacggtgtccg

SEQ ID NO: 564388 - DNA, 25 bp, Mus musculus
cagactggaagtccgtgtacacgta

SEQ ID NO: 564389 - DNA, 25 bp, Mus musculus
cagactggaagtgcgtgtacacgta

SEQ ID NO: 564390 - DNA, 25 bp, Mus musculus
cagactggagaacgtccccctagga

SEQ ID NO: 564391 - DNA, 25 bp, Mus musculus
cagactggagaaggtccccctagga

SEQ ID NO: 564392 - DNA, 25 bp, Mus musculus
cagactggagcgagaggactaaatt

SEQ ID NO: 564393 - DNA, 25 bp, Mus musculus
cagactggagcgtgaggactaaatt

SEQ ID NO: 564394 - DNA, 25 bp, Mus musculus
cagactggcaaaaggagaagcttcc

SEQ ID NO: 564395 - DNA, 25 bp, Mus musculus
cagactggcaaatggagaagcttcc

SEQ ID NO: 564396 - DNA, 25 bp, Mus musculus
cagactggcagaatgtcttccggac

SEQ ID NO: 564397 - DNA, 25 bp, Mus musculus
cagactggcagattgtcttccggac

SEQ ID NO: 564398 - DNA, 25 bp, Mus musculus
cagactggcatcatatttaccctgc

SEQ ID NO: 564399 - DNA, 25 bp, Mus musculus
cagactggcatcttatttaccctgc

SEQ ID NO: 564400 - DNA, 25 bp, Mus musculus
cagactggccttcattacgactaca

SEQ ID NO: 564401 - DNA, 25 bp, Mus musculus
cagactggccttgattacgactaca

SEQ ID NO: 564402 - DNA, 25 bp, Mus musculus
cagactggctctccatgtctggcca

SEQ ID NO: 564403 - DNA, 25 bp, Mus musculus
cagactggctctgcatgtctggcca

SEQ ID NO: 564404 - DNA, 25 bp, Mus musculus
cagactgggctcaaacttagagaag

SEQ ID NO: 564405 - DNA, 25 bp, Mus musculus
cagactgggctctaacttagagaag

SEQ ID NO: 564406 - DNA, 25 bp, Mus musculus
cagactggtacactgtgggcaccaa

SEQ ID NO: 564407 - DNA, 25 bp, Mus musculus
cagactggtacagtgtgggcaccaa

SEQ ID NO: 564408 - DNA, 25 bp, Mus musculus
cagactggtcaaaaatcaactgcag

SEQ ID NO: 564409 - DNA, 25 bp, Mus musculus
cagactggtcaataatcaactgcag

SEQ ID NO: 564410 - DNA, 25 bp, Mus musculus
cagactggtgccatagtggttggcc

SEQ ID NO: 564411 - DNA, 25 bp, Mus musculus
cagactggtgccttagtggttggcc

SEQ ID NO: 564412 - DNA, 25 bp, Mus musculus
cagactggtggacccaaacgcactc

SEQ ID NO: 564413 - DNA, 25 bp, Mus musculus
cagactggtggagccaaacgcactc

SEQ ID NO: 564414 - DNA, 25 bp, Mus musculus
cagactggtttcctatctcccagga

SEQ ID NO: 564415 - DNA, 25 bp, Mus musculus
cagactggtttcgtatctcccagga

SEQ ID NO: 564416 - DNA, 25 bp, Mus musculus
cagactgtaaacagtgaccctggac

SEQ ID NO: 564417 - DNA, 25 bp, Mus musculus
cagactgtaaactgtgaccctggac

SEQ ID NO: 564418 - DNA, 25 bp, Mus musculus
cagactgtcacacattctgtcggat

SEQ ID NO: 564419 - DNA, 25 bp, Mus musculus
cagactgtcacagattctgtcggat

SEQ ID NO: 564420 - DNA, 25 bp, Mus musculus
cagactgtgcctacatggtggacaa

SEQ ID NO: 564421 - DNA, 25 bp, Mus musculus
cagactgtgccttcatggtggacaa

SEQ ID NO: 564422 - DNA, 25 bp, Mus musculus
cagactgtgctactccgggtggtcc

SEQ ID NO: 564423 - DNA, 25 bp, Mus musculus
cagactgtgctagtccgggtggtcc

SEQ ID NO: 564424 - DNA, 25 bp, Mus musculus
cagactgtggagagcacggtcacct

SEQ ID NO: 564425 - DNA, 25 bp, Mus musculus
cagactgtggagtgcacggtcacct

SEQ ID NO: 564426 - DNA, 25 bp, Mus musculus
cagactgtggcactgtcatagcaca

SEQ ID NO: 564427 - DNA, 25 bp, Mus musculus
cagactgtggcagtgtcatagcaca

SEQ ID NO: 564428 - DNA, 25 bp, Mus musculus
cagactgtgggactgccctgctagc

SEQ ID NO: 564429 - DNA, 25 bp, Mus musculus
cagactgtgggagtgccctgctagc

SEQ ID NO: 564430 - DNA, 25 bp, Mus musculus
cagactgttgctctgtgtcaggaga

SEQ ID NO: 564431 - DNA, 25 bp, Mus musculus
cagactgttgctgtgtgtcaggaga

SEQ ID NO: 564432 - DNA, 25 bp, Mus musculus
cagactgttggaccggacacagcgc

SEQ ID NO: 564433 - DNA, 25 bp, Mus musculus
cagactgttggagcggacacagcgc

SEQ ID NO: 564434 - DNA, 25 bp, Mus musculus
cagacttaagggacttcatggaaat

SEQ ID NO: 564435 - DNA, 25 bp, Mus musculus
cagacttaagggtcttcatggaaat

SEQ ID NO: 564436 - DNA, 25 bp, Mus musculus
cagacttaatgaagccctgaagagg

SEQ ID NO: 564437 - DNA, 25 bp, Mus musculus
cagacttaatgatgccctgaagagg

SEQ ID NO: 564438 - DNA, 25 bp, Mus musculus
cagacttaccgcaaccatggacaca

SEQ ID NO: 564439 - DNA, 25 bp, Mus musculus
cagacttaccgctaccatggacaca

SEQ ID NO: 564440 - DNA, 25 bp, Mus musculus
cagacttacgtcatgatcttcatcc

SEQ ID NO: 564441 - DNA, 25 bp, Mus musculus
cagacttacgtcttgatcttcatcc

SEQ ID NO: 564442 - DNA, 25 bp, Mus musculus
cagacttactgcagaactcagacag

SEQ ID NO: 564443 - DNA, 25 bp, Mus musculus
cagacttactgctgaactcagacag

SEQ ID NO: 564444 - DNA, 25 bp, Mus musculus
cagacttccatcaactgcactctag

SEQ ID NO: 564445 - DNA, 25 bp, Mus musculus
cagacttccatctactgcactctag

SEQ ID NO: 564446 - DNA, 25 bp, Mus musculus
cagacttcctggctgtcaggcagtg

SEQ ID NO: 564447 - DNA, 25 bp, Mus musculus
cagacttcctgggtgtcaggcagtg

SEQ ID NO: 564448 - DNA, 25 bp, Mus musculus
cagacttcgggcagtttgggatctc

SEQ ID NO: 564449 - DNA, 25 bp, Mus musculus
cagacttcgggctgtttgggatctc

SEQ ID NO: 564450 - DNA, 25 bp, Mus musculus
cagacttcgttgaggtacagtttaa

SEQ ID NO: 564451 - DNA, 25 bp, Mus musculus
cagacttcgttgtggtacagtttaa

SEQ ID NO: 564452 - DNA, 25 bp, Mus musculus
cagacttctacacaactccataata

SEQ ID NO: 564453 - DNA, 25 bp, Mus musculus
cagacttctacagaactccataata

SEQ ID NO: 564454 - DNA, 25 bp, Mus musculus
cagacttctgaacatgacaatttgt

SEQ ID NO: 564455 - DNA, 25 bp, Mus musculus
cagacttctgaagatgacaatttgt

SEQ ID NO: 564456 - DNA, 25 bp, Mus musculus
cagacttctgcgactactcgtgaca

SEQ ID NO: 564457 - DNA, 25 bp, Mus musculus
cagacttctgcgtctactcgtgaca

SEQ ID NO: 564458 - DNA, 25 bp, Mus musculus
cagacttctgtacggctattggata

SEQ ID NO: 564459 - DNA, 25 bp, Mus musculus
cagacttctgtagggctattggata

SEQ ID NO: 564460 - DNA, 25 bp, Mus musculus
cagacttcttcaagtatgcttgtgg

SEQ ID NO: 564461 - DNA, 25 bp, Mus musculus
cagacttcttcatgtatgcttgtgg

SEQ ID NO: 564462 - DNA, 25 bp, Mus musculus
cagacttcttgtatgtgatgggatc

SEQ ID NO: 564463 - DNA, 25 bp, Mus musculus
cagacttcttgtccgcagctagccg

SEQ ID NO: 564464 - DNA, 25 bp, Mus musculus
cagacttcttgtgcgcagctagccg

SEQ ID NO: 564465 - DNA, 25 bp, Mus musculus
cagacttcttgtttgtgatgggatc

SEQ ID NO: 564466 - DNA, 25 bp, Mus musculus
cagacttctttcaatcatcacagta

SEQ ID NO: 564467 - DNA, 25 bp, Mus musculus
cagacttctttctatcatcacagta

SEQ ID NO: 564468 - DNA, 25 bp, Mus musculus
cagacttgactgactacctcaacag

SEQ ID NO: 564469 - DNA, 25 bp, Mus musculus
cagacttgactgtctacctcaacag

SEQ ID NO: 564470 - DNA, 25 bp, Mus musculus
cagacttggcatcagacaactttac

SEQ ID NO: 564471 - DNA, 25 bp, Mus musculus
cagacttggcatgagacaactttac

SEQ ID NO: 564472 - DNA, 25 bp, Mus musculus
cagacttggctgaggcaggaatcta

SEQ ID NO: 564473 - DNA, 25 bp, Mus musculus
cagacttggctgtggcaggaatcta

SEQ ID NO: 564474 - DNA, 25 bp, Mus musculus
cagacttgggcccaagaggacctga

SEQ ID NO: 564475 - DNA, 25 bp, Mus musculus
cagacttgggccgaagaggacctga

SEQ ID NO: 564476 - DNA, 25 bp, Mus musculus
cagacttggtctctcctcagtaacc

SEQ ID NO: 564477 - DNA, 25 bp, Mus musculus
cagacttggtctgtcctcagtaacc

SEQ ID NO: 564478 - DNA, 25 bp, Mus musculus
cagacttggtgcaatggactcgaca

SEQ ID NO: 564479 - DNA, 25 bp, Mus musculus
cagacttggtgctatggactcgaca

SEQ ID NO: 564480 - DNA, 25 bp, Mus musculus
cagacttgtgccaagtggtcggaga

SEQ ID NO: 564481 - DNA, 25 bp, Mus musculus
cagacttgtgcctagtggtcggaga

SEQ ID NO: 564482 - DNA, 25 bp, Mus musculus
cagacttgtttgctcgctatgaccg

SEQ ID NO: 564483 - DNA, 25 bp, Mus musculus
cagacttgtttggtcgctatgaccg

SEQ ID NO: 564484 - DNA, 25 bp, Mus musculus
cagactttaatgaaattgtgcaagc

SEQ ID NO: 564485 - DNA, 25 bp, Mus musculus
cagactttaatgtaattgtgcaagc

SEQ ID NO: 564486 - DNA, 25 bp, Mus musculus
cagactttccgacacctggtctggt

SEQ ID NO: 564487 - DNA, 25 bp, Mus musculus
cagactttccgagacctggtctggt

SEQ ID NO: 564488 - DNA, 25 bp, Mus musculus
cagactttctgtagtatatcggacg

SEQ ID NO: 564489 - DNA, 25 bp, Mus musculus
cagactttctgttgtatatcggacg

SEQ ID NO: 564490 - DNA, 25 bp, Mus musculus
cagactttgaatccttttcttagag

SEQ ID NO: 564491 - DNA, 25 bp, Mus musculus
cagactttgaatgcttttcttagag

SEQ ID NO: 564492 - DNA, 25 bp, Mus musculus
cagactttgacaagactctaagtag

SEQ ID NO: 564493 - DNA, 25 bp, Mus musculus
cagactttgacatgactctaagtag

SEQ ID NO: 564494 - DNA, 25 bp, Mus musculus
cagactttggatcaccttacttgga

SEQ ID NO: 564495 - DNA, 25 bp, Mus musculus
cagactttggatgaccttacttgga

SEQ ID NO: 564496 - DNA, 25 bp, Mus musculus
cagacttttcctagttatagtagca

SEQ ID NO: 564497 - DNA, 25 bp, Mus musculus
cagacttttccttgttatagtagca

SEQ ID NO: 564498 - DNA, 25 bp, Mus musculus
cagagaaaaaagaatgccagttgct

SEQ ID NO: 564499 - DNA, 25 bp, Mus musculus
cagagaaaaaagtatgccagttgct

SEQ ID NO: 564500 - DNA, 25 bp, Mus musculus
cagagaaaaagaagactaagccttt

SEQ ID NO: 564501 - DNA, 25 bp, Mus musculus
cagagaaaaagatgactaagccttt

SEQ ID NO: 564502 - DNA, 25 bp, Mus musculus
cagagaaaacgtaactccaccgtgg

SEQ ID NO: 564503 - DNA, 25 bp, Mus musculus
cagagaaaacgttactccaccgtgg

SEQ ID NO: 564504 - DNA, 25 bp, Mus musculus
cagagaaaagatacagcgggcacgt

SEQ ID NO: 564505 - DNA, 25 bp, Mus musculus
cagagaaaagattcagcgggcacgt

SEQ ID NO: 564506 - DNA, 25 bp, Mus musculus
cagagaaaagcaagtggcacagttg

SEQ ID NO: 564507 - DNA, 25 bp, Mus musculus
cagagaaaagcatgtggcacagttg

SEQ ID NO: 564508 - DNA, 25 bp, Mus musculus
cagagaaaatcgaggtgtctagaca

SEQ ID NO: 564509 - DNA, 25 bp, Mus musculus
cagagaaaatcgtggtgtctagaca

SEQ ID NO: 564510 - DNA, 25 bp, Mus musculus
cagagaaacaataatgtgtcttcca

SEQ ID NO: 564511 - DNA, 25 bp, Mus musculus
cagagaaacaattatgtgtcttcca

SEQ ID NO: 564512 - DNA, 25 bp, Mus musculus
cagagaaactgaaacgctgcattcg

SEQ ID NO: 564513 - DNA, 25 bp, Mus musculus
cagagaaactgacgtgaaaaggcca

SEQ ID NO: 564514 - DNA, 25 bp, Mus musculus
cagagaaactgaggtgaaaaggcca

SEQ ID NO: 564515 - DNA, 25 bp, Mus musculus
cagagaaactgatacgctgcattcg

SEQ ID NO: 564516 - DNA, 25 bp, Mus musculus
cagagaaagagccacttgaacgcca

SEQ ID NO: 564517 - DNA, 25 bp, Mus musculus
cagagaaagagcgacttgaacgcca

SEQ ID NO: 564518 - DNA, 25 bp, Mus musculus
cagagaaataatcaggacgtttcta

SEQ ID NO: 564519 - DNA, 25 bp, Mus musculus
cagagaaataatccacatggctatt

SEQ ID NO: 564520 - DNA, 25 bp, Mus musculus
cagagaaataatgaggacgtttcta

SEQ ID NO: 564521 - DNA, 25 bp, Mus musculus
cagagaaataatgcacatggctatt

SEQ ID NO: 564522 - DNA, 25 bp, Mus musculus
cagagaaattatattgttcagcctg

SEQ ID NO: 564523 - DNA, 25 bp, Mus musculus
cagagaaattattttgttcagcctg

SEQ ID NO: 564524 - DNA, 25 bp, Mus musculus
cagagaacaggaacctttggtgatc

SEQ ID NO: 564525 - DNA, 25 bp, Mus musculus
cagagaacaggatcctttggtgatc

SEQ ID NO: 564526 - DNA, 25 bp, Mus musculus
cagagaacaggtagaacggaacgag

SEQ ID NO: 564527 - DNA, 25 bp, Mus musculus
cagagaacaggtcaagagacgagcc

SEQ ID NO: 564528 - DNA, 25 bp, Mus musculus
cagagaacaggtgaagagacgagcc

SEQ ID NO: 564529 - DNA, 25 bp, Mus musculus
cagagaacaggttgaacggaacgag

SEQ ID NO: 564530 - DNA, 25 bp, Mus musculus
cagagaacagtaaaagtgaccagac

SEQ ID NO: 564531 - DNA, 25 bp, Mus musculus
cagagaacagtaaagcatccgacat

SEQ ID NO: 564532 - DNA, 25 bp, Mus musculus
cagagaacagtataagtgaccagac

SEQ ID NO: 564533 - DNA, 25 bp, Mus musculus
cagagaacagtatagcatccgacat

SEQ ID NO: 564534 - DNA, 25 bp, Mus musculus
cagagaacatcactgaagggaaaaa

SEQ ID NO: 564535 - DNA, 25 bp, Mus musculus
cagagaacatcagtgaagggaaaaa

SEQ ID NO: 564536 - DNA, 25 bp, Mus musculus
cagagaacatccaatgtgagcaccc

SEQ ID NO: 564537 - DNA, 25 bp, Mus musculus
cagagaacatcctatgtgagcaccc

SEQ ID NO: 564538 - DNA, 25 bp, Mus musculus
cagagaaccggaagaaaactatgga

SEQ ID NO: 564539 - DNA, 25 bp, Mus musculus
cagagaaccggatgaaaactatgga

SEQ ID NO: 564540 - DNA, 25 bp, Mus musculus
cagagaacctgtacagttggaaaca

SEQ ID NO: 564541 - DNA, 25 bp, Mus musculus
cagagaacctgttcagttggaaaca

SEQ ID NO: 564542 - DNA, 25 bp, Mus musculus
cagagaacgatcaccgaattttgga

SEQ ID NO: 564543 - DNA, 25 bp, Mus musculus
cagagaacgatctccgaattttgga

SEQ ID NO: 564544 - DNA, 25 bp, Mus musculus
cagagaacgctgagctccaggctat

SEQ ID NO: 564545 - DNA, 25 bp, Mus musculus
cagagaacgctgtgctccaggctat

SEQ ID NO: 564546 - DNA, 25 bp, Mus musculus
cagagaacgtcaccaagagggaaag

SEQ ID NO: 564547 - DNA, 25 bp, Mus musculus
cagagaacgtcagcaagagggaaag

SEQ ID NO: 564548 - DNA, 25 bp, Mus musculus
cagagaactctacggtcacgtgaat

SEQ ID NO: 564549 - DNA, 25 bp, Mus musculus
cagagaactctagggtcacgtgaat

SEQ ID NO: 564550 - DNA, 25 bp, Mus musculus
cagagaactgccagtccaagtctcc

SEQ ID NO: 564551 - DNA, 25 bp, Mus musculus
cagagaactgcctgtccaagtctcc

SEQ ID NO: 564552 - DNA, 25 bp, Mus musculus
cagagaactgcgcagtgtcatgaat

SEQ ID NO: 564553 - DNA, 25 bp, Mus musculus
cagagaactgcggagtgtcatgaat

SEQ ID NO: 564554 - DNA, 25 bp, Mus musculus
cagagaacttccactcagagattgt

SEQ ID NO: 564555 - DNA, 25 bp, Mus musculus
cagagaacttcctctcagagattgt

SEQ ID NO: 564556 - DNA, 25 bp, Mus musculus
cagagaacttgactttattagaaaa

SEQ ID NO: 564557 - DNA, 25 bp, Mus musculus
cagagaacttgagtttattagaaaa

SEQ ID NO: 564558 - DNA, 25 bp, Mus musculus
cagagaagaacccagttctgagagt

SEQ ID NO: 564559 - DNA, 25 bp, Mus musculus
cagagaagaaccgagttctgagagt

SEQ ID NO: 564560 - DNA, 25 bp, Mus musculus
cagagaagacagctttgtatggtac

SEQ ID NO: 564561 - DNA, 25 bp, Mus musculus
cagagaagacaggtttgtatggtac

SEQ ID NO: 564562 - DNA, 25 bp, Mus musculus
cagagaagacgaagggcttctgcca

SEQ ID NO: 564563 - DNA, 25 bp, Mus musculus
cagagaagacgatgggcttctgcca

SEQ ID NO: 564564 - DNA, 25 bp, Mus musculus
cagagaagagacagcggaaagctct

SEQ ID NO: 564565 - DNA, 25 bp, Mus musculus
cagagaagagactgcggaaagctct

SEQ ID NO: 564566 - DNA, 25 bp, Mus musculus
cagagaagcaagaccggaaactcac

SEQ ID NO: 564567 - DNA, 25 bp, Mus musculus
cagagaagcaagtccggaaactcac

SEQ ID NO: 564568 - DNA, 25 bp, Mus musculus
cagagaagcacacggctcagaacct

SEQ ID NO: 564569 - DNA, 25 bp, Mus musculus
cagagaagcacagggctcagaacct

SEQ ID NO: 564570 - DNA, 25 bp, Mus musculus
cagagaagcagaaattgatggcgac

SEQ ID NO: 564571 - DNA, 25 bp, Mus musculus
cagagaagcagatattgatggcgac

SEQ ID NO: 564572 - DNA, 25 bp, Mus musculus
cagagaagccctccagaactggatg

SEQ ID NO: 564573 - DNA, 25 bp, Mus musculus
cagagaagccctgcagaactggatg

SEQ ID NO: 564574 - DNA, 25 bp, Mus musculus
cagagaagctgcctttcgaagcatg

SEQ ID NO: 564575 - DNA, 25 bp, Mus musculus
cagagaagctgcgtttcgaagcatg

SEQ ID NO: 564576 - DNA, 25 bp, Mus musculus
cagagaaggagtataactttctgga

SEQ ID NO: 564577 - DNA, 25 bp, Mus musculus
cagagaaggagtttaactttctgga

SEQ ID NO: 564578 - DNA, 25 bp, Mus musculus
cagagaaggcgtattgggacagatc

SEQ ID NO: 564579 - DNA, 25 bp, Mus musculus
cagagaaggcgttttgggacagatc

SEQ ID NO: 564580 - DNA, 25 bp, Mus musculus
cagagaagggctattcgtttgtcag

SEQ ID NO: 564581 - DNA, 25 bp, Mus musculus
cagagaagggcttttcgtttgtcag

SEQ ID NO: 564582 - DNA, 25 bp, Mus musculus
cagagaagtaacctgaaaactcacc

SEQ ID NO: 564583 - DNA, 25 bp, Mus musculus
cagagaagtaacgtgaaaactcacc

SEQ ID NO: 564584 - DNA, 25 bp, Mus musculus
cagagaagtagacaacagagtgagt

SEQ ID NO: 564585 - DNA, 25 bp, Mus musculus
cagagaagtagagaacagagtgagt

SEQ ID NO: 564586 - DNA, 25 bp, Mus musculus
cagagaagtatgacgtcagttccca

SEQ ID NO: 564587 - DNA, 25 bp, Mus musculus
cagagaagtatgtcgtcagttccca

SEQ ID NO: 564588 - DNA, 25 bp, Mus musculus
cagagaagtctgagcgggtctttga

SEQ ID NO: 564589 - DNA, 25 bp, Mus musculus
cagagaagtctgtgcgggtctttga

SEQ ID NO: 564590 - DNA, 25 bp, Mus musculus
cagagaagtgatagtgtgtccaggt

SEQ ID NO: 564591 - DNA, 25 bp, Mus musculus
cagagaagtgattgtgtgtccaggt

SEQ ID NO: 564592 - DNA, 25 bp, Mus musculus
cagagaagtgcccacgatgtggaaa

SEQ ID NO: 564593 - DNA, 25 bp, Mus musculus
cagagaagtgccgacgatgtggaaa

SEQ ID NO: 564594 - DNA, 25 bp, Mus musculus
cagagaagttgaactaatgtgaggc

SEQ ID NO: 564595 - DNA, 25 bp, Mus musculus
cagagaagttgatctaatgtgaggc

SEQ ID NO: 564596 - DNA, 25 bp, Mus musculus
cagagaagttggctccttccaggca

SEQ ID NO: 564597 - DNA, 25 bp, Mus musculus
cagagaagttgggtccttccaggca

SEQ ID NO: 564598 - DNA, 25 bp, Mus musculus
cagagaatactaagaccatcagcgc

SEQ ID NO: 564599 - DNA, 25 bp, Mus musculus
cagagaatactatgaccatcagcgc

SEQ ID NO: 564600 - DNA, 25 bp, Mus musculus
cagagaatattcagcttaaaatcag

SEQ ID NO: 564601 - DNA, 25 bp, Mus musculus
cagagaatattctgcttaaaatcag

SEQ ID NO: 564602 - DNA, 25 bp, Mus musculus
cagagaatccacagccggagtgaaa

SEQ ID NO: 564603 - DNA, 25 bp, Mus musculus
cagagaatccactgccggagtgaaa

SEQ ID NO: 564604 - DNA, 25 bp, Mus musculus
cagagaatcgacaaggccaagtagc

SEQ ID NO: 564605 - DNA, 25 bp, Mus musculus
cagagaatcgactaggccaagtagc

SEQ ID NO: 564606 - DNA, 25 bp, Mus musculus
cagagaatgcaaatgtgcatatggg

SEQ ID NO: 564607 - DNA, 25 bp, Mus musculus
cagagaatgcaattgtgcatatggg

SEQ ID NO: 564608 - DNA, 25 bp, Mus musculus
cagagaatgctaccaggcctgagca

SEQ ID NO: 564609 - DNA, 25 bp, Mus musculus
cagagaatgctagcaggcctgagca

SEQ ID NO: 564610 - DNA, 25 bp, Mus musculus
cagagaatgctcatgttgcttggta

SEQ ID NO: 564611 - DNA, 25 bp, Mus musculus
cagagaatgctcttgttgcttggta

SEQ ID NO: 564612 - DNA, 25 bp, Mus musculus
cagagaattctgacttcgccactca

SEQ ID NO: 564613 - DNA, 25 bp, Mus musculus
cagagaattctgtcttcgccactca

SEQ ID NO: 564614 - DNA, 25 bp, Mus musculus
cagagacaaaggcaacgaggtgaac

SEQ ID NO: 564615 - DNA, 25 bp, Mus musculus
cagagacaaagggaacgaggtgaac

SEQ ID NO: 564616 - DNA, 25 bp, Mus musculus
cagagacaccacattgaaattagag

SEQ ID NO: 564617 - DNA, 25 bp, Mus musculus
cagagacaccactttgaaattagag

SEQ ID NO: 564618 - DNA, 25 bp, Mus musculus
cagagacagcctcagctttgaggac

SEQ ID NO: 564619 - DNA, 25 bp, Mus musculus
cagagacagcctgagctttgaggac

SEQ ID NO: 564620 - DNA, 25 bp, Mus musculus
cagagacaggccagactgaaggaga

SEQ ID NO: 564621 - DNA, 25 bp, Mus musculus
cagagacaggcctgactgaaggaga

SEQ ID NO: 564622 - DNA, 25 bp, Mus musculus
cagagacaggtaaggagaacaaagc

SEQ ID NO: 564623 - DNA, 25 bp, Mus musculus
cagagacaggtatggagaacaaagc

SEQ ID NO: 564624 - DNA, 25 bp, Mus musculus
cagagacagtttaagtacaaccaac

SEQ ID NO: 564625 - DNA, 25 bp, Mus musculus
cagagacagttttagtacaaccaac

SEQ ID NO: 564626 - DNA, 25 bp, Mus musculus
cagagacataaacgtacacatacag

SEQ ID NO: 564627 - DNA, 25 bp, Mus musculus
cagagacataaaggtacacatacag

SEQ ID NO: 564628 - DNA, 25 bp, Mus musculus
cagagacatggacctcacttgttgc

SEQ ID NO: 564629 - DNA, 25 bp, Mus musculus
cagagacatggagctcacttgttgc

SEQ ID NO: 564630 - DNA, 25 bp, Mus musculus
cagagacattgaagcagcaacggaa

SEQ ID NO: 564631 - DNA, 25 bp, Mus musculus
cagagacattgatgcagcaacggaa

SEQ ID NO: 564632 - DNA, 25 bp, Mus musculus
cagagacatttgaggtggccacatg

SEQ ID NO: 564633 - DNA, 25 bp, Mus musculus
cagagacatttgtggtggccacatg

SEQ ID NO: 564634 - DNA, 25 bp, Mus musculus
cagagaccaagcatcgcatcagcat

SEQ ID NO: 564635 - DNA, 25 bp, Mus musculus
cagagaccaagcttcgcatcagcat

SEQ ID NO: 564636 - DNA, 25 bp, Mus musculus
cagagaccactgcagctaaggccta

SEQ ID NO: 564637 - DNA, 25 bp, Mus musculus
cagagaccactggagctaaggccta

SEQ ID NO: 564638 - DNA, 25 bp, Mus musculus
cagagaccagcacttattggagatg

SEQ ID NO: 564639 - DNA, 25 bp, Mus musculus
cagagaccagcagttattggagatg

SEQ ID NO: 564640 - DNA, 25 bp, Mus musculus
cagagaccattgacagagtgactgc

SEQ ID NO: 564641 - DNA, 25 bp, Mus musculus
cagagaccattgtcagagtgactgc

SEQ ID NO: 564642 - DNA, 25 bp, Mus musculus
cagagacccgaaaggaatgactgtg

SEQ ID NO: 564643 - DNA, 25 bp, Mus musculus
cagagacccgaatggaatgactgtg

SEQ ID NO: 564644 - DNA, 25 bp, Mus musculus
cagagacctggactttcgtagcccc

SEQ ID NO: 564645 - DNA, 25 bp, Mus musculus
cagagacctggagtttcgtagcccc

SEQ ID NO: 564646 - DNA, 25 bp, Mus musculus
cagagacctgttcatgctacaggag

SEQ ID NO: 564647 - DNA, 25 bp, Mus musculus
cagagacctgttgatgctacaggag

SEQ ID NO: 564648 - DNA, 25 bp, Mus musculus
cagagacgaaaaatgtggagttggt

SEQ ID NO: 564649 - DNA, 25 bp, Mus musculus
cagagacgaaaattgtggagttggt

SEQ ID NO: 564650 - DNA, 25 bp, Mus musculus
cagagacgcgccactctggtctgag

SEQ ID NO: 564651 - DNA, 25 bp, Mus musculus
cagagacgcgcctctctggtctgag

SEQ ID NO: 564652 - DNA, 25 bp, Mus musculus
cagagacggataactgtgacactgt

SEQ ID NO: 564653 - DNA, 25 bp, Mus musculus
cagagacggatatctgtgacactgt

SEQ ID NO: 564654 - DNA, 25 bp, Mus musculus
cagagacggctaccatgacaatggg

SEQ ID NO: 564655 - DNA, 25 bp, Mus musculus
cagagacggctagcatgacaatggg

SEQ ID NO: 564656 - DNA, 25 bp, Mus musculus
cagagactacagctgagtcatgatc

SEQ ID NO: 564657 - DNA, 25 bp, Mus musculus
cagagactacaggtgagtcatgatc

SEQ ID NO: 564658 - DNA, 25 bp, Mus musculus
cagagactactaagagtgcactgga

SEQ ID NO: 564659 - DNA, 25 bp, Mus musculus
cagagactactatgagtgcactgga

SEQ ID NO: 564660 - DNA, 25 bp, Mus musculus
cagagactagcaaggataaggtgcc

SEQ ID NO: 564661 - DNA, 25 bp, Mus musculus
cagagactagcatggataaggtgcc

SEQ ID NO: 564662 - DNA, 25 bp, Mus musculus
cagagactcaatcctggaacctggt

SEQ ID NO: 564663 - DNA, 25 bp, Mus musculus
cagagactcaatgctggaacctggt

SEQ ID NO: 564664 - DNA, 25 bp, Mus musculus
cagagactcagaaaatggtgcttac

SEQ ID NO: 564665 - DNA, 25 bp, Mus musculus
cagagactcagataatggtgcttac

SEQ ID NO: 564666 - DNA, 25 bp, Mus musculus
cagagactcagtaaggtggtaaaag

SEQ ID NO: 564667 - DNA, 25 bp, Mus musculus
cagagactcagttaggtggtaaaag

SEQ ID NO: 564668 - DNA, 25 bp, Mus musculus
cagagactcctacttcagtgatagc

SEQ ID NO: 564669 - DNA, 25 bp, Mus musculus
cagagactcctagttcagtgatagc

SEQ ID NO: 564670 - DNA, 25 bp, Mus musculus
cagagactccttcagacccagagag

SEQ ID NO: 564671 - DNA, 25 bp, Mus musculus
cagagactccttgagacccagagag

SEQ ID NO: 564672 - DNA, 25 bp, Mus musculus
cagagactgaagacgacagtgatag

SEQ ID NO: 564673 - DNA, 25 bp, Mus musculus
cagagactgaagtcgacagtgatag

SEQ ID NO: 564674 - DNA, 25 bp, Mus musculus
cagagactggaacgatgaacagccc

SEQ ID NO: 564675 - DNA, 25 bp, Mus musculus
cagagactggaaggatgaacagccc

SEQ ID NO: 564676 - DNA, 25 bp, Mus musculus
cagagactggagagacgagcccctg

SEQ ID NO: 564677 - DNA, 25 bp, Mus musculus
cagagactggagtgacgagcccctg

SEQ ID NO: 564678 - DNA, 25 bp, Mus musculus
cagagactgtcaccaaggaacgaga

SEQ ID NO: 564679 - DNA, 25 bp, Mus musculus
cagagactgtcagcaaggaacgaga

SEQ ID NO: 564680 - DNA, 25 bp, Mus musculus
cagagactgtgaacatgtgtgatca

SEQ ID NO: 564681 - DNA, 25 bp, Mus musculus
cagagactgtgactgccccacctgg

SEQ ID NO: 564682 - DNA, 25 bp, Mus musculus
cagagactgtgagtgccccacctgg

SEQ ID NO: 564683 - DNA, 25 bp, Mus musculus
cagagactgtgatcatgtgtgatca

SEQ ID NO: 564684 - DNA, 25 bp, Mus musculus
cagagacttttgcaataacaatgaa

SEQ ID NO: 564685 - DNA, 25 bp, Mus musculus
cagagacttttggaataacaatgaa

SEQ ID NO: 564686 - DNA, 25 bp, Mus musculus
cagagactttttcccataactatta

SEQ ID NO: 564687 - DNA, 25 bp, Mus musculus
cagagactttttgccataactatta

SEQ ID NO: 564688 - DNA, 25 bp, Mus musculus
cagagagaaaccaatccgtgatcta

SEQ ID NO: 564689 - DNA, 25 bp, Mus musculus
cagagagaaacctatccgtgatcta

SEQ ID NO: 564690 - DNA, 25 bp, Mus musculus
cagagagaacccagtacctagctca

SEQ ID NO: 564691 - DNA, 25 bp, Mus musculus
cagagagaaccctgtacctagctca

SEQ ID NO: 564692 - DNA, 25 bp, Mus musculus
cagagagaaggcaacgttacaagac

SEQ ID NO: 564693 - DNA, 25 bp, Mus musculus
cagagagaaggctacgttacaagac

SEQ ID NO: 564694 - DNA, 25 bp, Mus musculus
cagagagaatgaccatctttatttt

SEQ ID NO: 564695 - DNA, 25 bp, Mus musculus
cagagagaatgagcatctttatttt

SEQ ID NO: 564696 - DNA, 25 bp, Mus musculus
cagagagacaaaagaagatgacact

SEQ ID NO: 564697 - DNA, 25 bp, Mus musculus
cagagagacaaatgaagatgacact

SEQ ID NO: 564698 - DNA, 25 bp, Mus musculus
cagagagaccataccctatagcagt

SEQ ID NO: 564699 - DNA, 25 bp, Mus musculus
cagagagaccattccctatagcagt

SEQ ID NO: 564700 - DNA, 25 bp, Mus musculus
cagagagacgggatctcaaggagtt

SEQ ID NO: 564701 - DNA, 25 bp, Mus musculus
cagagagacgggttctcaaggagtt

SEQ ID NO: 564702 - DNA, 25 bp, Mus musculus
cagagagacgtgctgattatgcttc

SEQ ID NO: 564703 - DNA, 25 bp, Mus musculus
cagagagacgtggtgattatgcttc

SEQ ID NO: 564704 - DNA, 25 bp, Mus musculus
cagagagagaaacaattagccagct

SEQ ID NO: 564705 - DNA, 25 bp, Mus musculus
cagagagagaaagaattagccagct

SEQ ID NO: 564706 - DNA, 25 bp, Mus musculus
cagagagagaccatgctgtggactt

SEQ ID NO: 564707 - DNA, 25 bp, Mus musculus
cagagagagaccttgctgtggactt

SEQ ID NO: 564708 - DNA, 25 bp, Mus musculus
cagagagcagcgagaacctgggtcc

SEQ ID NO: 564709 - DNA, 25 bp, Mus musculus
cagagagcagcgtgaacctgggtcc

SEQ ID NO: 564710 - DNA, 25 bp, Mus musculus
cagagagcatctagccatgatggaa

SEQ ID NO: 564711 - DNA, 25 bp, Mus musculus
cagagagcatcttgccatgatggaa

SEQ ID NO: 564712 - DNA, 25 bp, Mus musculus
cagagagcccttcccatgactgact

SEQ ID NO: 564713 - DNA, 25 bp, Mus musculus
cagagagcccttgccatgactgact

SEQ ID NO: 564714 - DNA, 25 bp, Mus musculus
cagagagcctaaccccagttttgga

SEQ ID NO: 564715 - DNA, 25 bp, Mus musculus
cagagagcctaagcccagttttgga

SEQ ID NO: 564716 - DNA, 25 bp, Mus musculus
cagagagcctggagatccaggccta

SEQ ID NO: 564717 - DNA, 25 bp, Mus musculus
cagagagcctggtgatccaggccta

SEQ ID NO: 564718 - DNA, 25 bp, Mus musculus
cagagagcgagccttatatatttca

SEQ ID NO: 564719 - DNA, 25 bp, Mus musculus
cagagagcgagcgttatatatttca

SEQ ID NO: 564720 - DNA, 25 bp, Mus musculus
cagagagcgtggagtccgtcaccag

SEQ ID NO: 564721 - DNA, 25 bp, Mus musculus
cagagagcgtggtgtccgtcaccag

SEQ ID NO: 564722 - DNA, 25 bp, Mus musculus
cagagagctccaaggtgcatctcaa

SEQ ID NO: 564723 - DNA, 25 bp, Mus musculus
cagagagctccatggtgcatctcaa

SEQ ID NO: 564724 - DNA, 25 bp, Mus musculus
cagagaggaagaagttaccattttt

SEQ ID NO: 564725 - DNA, 25 bp, Mus musculus
cagagaggaagatgttaccattttt

SEQ ID NO: 564726 - DNA, 25 bp, Mus musculus
cagagaggaatgcagtgtccctgtc

SEQ ID NO: 564727 - DNA, 25 bp, Mus musculus
cagagaggaatgctcaagtcaattc

SEQ ID NO: 564728 - DNA, 25 bp, Mus musculus
cagagaggaatggagtgtccctgtc

SEQ ID NO: 564729 - DNA, 25 bp, Mus musculus
cagagaggaatggtcaagtcaattc

SEQ ID NO: 564730 - DNA, 25 bp, Mus musculus
cagagaggacgcagagtggatccat

SEQ ID NO: 564731 - DNA, 25 bp, Mus musculus
cagagaggacgctgagtggatccat

SEQ ID NO: 564732 - DNA, 25 bp, Mus musculus
cagagaggagggaaaagccaacacc

SEQ ID NO: 564733 - DNA, 25 bp, Mus musculus
cagagaggagggtaaagccaacacc

SEQ ID NO: 564734 - DNA, 25 bp, Mus musculus
cagagaggatagctgacggcaccat

SEQ ID NO: 564735 - DNA, 25 bp, Mus musculus
cagagaggataggtgacggcaccat

SEQ ID NO: 564736 - DNA, 25 bp, Mus musculus
cagagaggctggagggtcctttcaa

SEQ ID NO: 564737 - DNA, 25 bp, Mus musculus
cagagaggctggtgggtcctttcaa

SEQ ID NO: 564738 - DNA, 25 bp, Mus musculus
cagagaggctgtacagaagttcacg

SEQ ID NO: 564739 - DNA, 25 bp, Mus musculus
cagagaggctgttcagaagttcacg

SEQ ID NO: 564740 - DNA, 25 bp, Mus musculus
cagagaggcttaattgacttcatgc

SEQ ID NO: 564741 - DNA, 25 bp, Mus musculus
cagagaggcttatttgacttcatgc

SEQ ID NO: 564742 - DNA, 25 bp, Mus musculus
cagagagggaaccatgggaatattt

SEQ ID NO: 564743 - DNA, 25 bp, Mus musculus
cagagagggaacgatgggaatattt

SEQ ID NO: 564744 - DNA, 25 bp, Mus musculus
cagagagggcagaggtctgcattcc

SEQ ID NO: 564745 - DNA, 25 bp, Mus musculus
cagagagggcagtggtctgcattcc

SEQ ID NO: 564746 - DNA, 25 bp, Mus musculus
cagagagggccacttgctaagtctt

SEQ ID NO: 564747 - DNA, 25 bp, Mus musculus
cagagagggccagttgctaagtctt

SEQ ID NO: 564748 - DNA, 25 bp, Mus musculus
cagagaggtcacatggcttgctcga

SEQ ID NO: 564749 - DNA, 25 bp, Mus musculus
cagagaggtcacatgggccaaaact

SEQ ID NO: 564750 - DNA, 25 bp, Mus musculus
cagagaggtcacttggcttgctcga

SEQ ID NO: 564751 - DNA, 25 bp, Mus musculus
cagagaggtcacttgggccaaaact

SEQ ID NO: 564752 - DNA, 25 bp, Mus musculus
cagagaggtgaacgctgtcgattca

SEQ ID NO: 564753 - DNA, 25 bp, Mus musculus
cagagaggtgaaggctgtcgattca

SEQ ID NO: 564754 - DNA, 25 bp, Mus musculus
cagagaggtgttacgggccgtcctt

SEQ ID NO: 564755 - DNA, 25 bp, Mus musculus
cagagaggtgtttcgggccgtcctt

SEQ ID NO: 564756 - DNA, 25 bp, Mus musculus
cagagagtaacacgtgtctgaaagc

SEQ ID NO: 564757 - DNA, 25 bp, Mus musculus
cagagagtaacaggtgtctgaaagc

SEQ ID NO: 564758 - DNA, 25 bp, Mus musculus
cagagagtccccaaaggttcaggga

SEQ ID NO: 564759 - DNA, 25 bp, Mus musculus
cagagagtcccctaaggttcaggga

SEQ ID NO: 564760 - DNA, 25 bp, Mus musculus
cagagagtcgagctactcgccaaga

SEQ ID NO: 564761 - DNA, 25 bp, Mus musculus
cagagagtcgaggtactcgccaaga

SEQ ID NO: 564762 - DNA, 25 bp, Mus musculus
cagagagtcgtgatccttgagaggc

SEQ ID NO: 564763 - DNA, 25 bp, Mus musculus
cagagagtcgtgttccttgagaggc

SEQ ID NO: 564764 - DNA, 25 bp, Mus musculus
cagagagtctctcactgaaatacag

SEQ ID NO: 564765 - DNA, 25 bp, Mus musculus
cagagagtctctgactgaaatacag

SEQ ID NO: 564766 - DNA, 25 bp, Mus musculus
cagagagtgaccatatgagagccca

SEQ ID NO: 564767 - DNA, 25 bp, Mus musculus
cagagagtgaccttatgagagccca

SEQ ID NO: 564768 - DNA, 25 bp, Mus musculus
cagagagtgactattgacctgtacc

SEQ ID NO: 564769 - DNA, 25 bp, Mus musculus
cagagagtgacttttgacctgtacc

SEQ ID NO: 564770 - DNA, 25 bp, Mus musculus
cagagagtgagcacaagttccacta

SEQ ID NO: 564771 - DNA, 25 bp, Mus musculus
cagagagtgagctcaagttccacta

SEQ ID NO: 564772 - DNA, 25 bp, Mus musculus
cagagagtgagtccccaggtatgaa

SEQ ID NO: 564773 - DNA, 25 bp, Mus musculus
cagagagtgagtgcccaggtatgaa

SEQ ID NO: 564774 - DNA, 25 bp, Mus musculus
cagagagttgtgaggaagttcaaga

SEQ ID NO: 564775 - DNA, 25 bp, Mus musculus
cagagagttgtgtggaagttcaaga

SEQ ID NO: 564776 - DNA, 25 bp, Mus musculus
cagagataagacagagacaaaggtc

SEQ ID NO: 564777 - DNA, 25 bp, Mus musculus
cagagataagactgagacaaaggtc

SEQ ID NO: 564778 - DNA, 25 bp, Mus musculus
cagagataatctctatttgagaacc

SEQ ID NO: 564779 - DNA, 25 bp, Mus musculus
cagagataatctgtatttgagaacc

SEQ ID NO: 564780 - DNA, 25 bp, Mus musculus
cagagatagtatcgacttacagagg

SEQ ID NO: 564781 - DNA, 25 bp, Mus musculus
cagagatagtatggacttacagagg

SEQ ID NO: 564782 - DNA, 25 bp, Mus musculus
cagagatcaccgagctggagacagg

SEQ ID NO: 564783 - DNA, 25 bp, Mus musculus
cagagatcaccgtgctggagacagg

SEQ ID NO: 564784 - DNA, 25 bp, Mus musculus
cagagatcagctccattgatgaatt

SEQ ID NO: 564785 - DNA, 25 bp, Mus musculus
cagagatcagctgcattgatgaatt

SEQ ID NO: 564786 - DNA, 25 bp, Mus musculus
cagagatcaggacatggacaatgat

SEQ ID NO: 564787 - DNA, 25 bp, Mus musculus
cagagatcaggagatggacaatgat

SEQ ID NO: 564788 - DNA, 25 bp, Mus musculus
cagagatccaagatggcagattcaa

SEQ ID NO: 564789 - DNA, 25 bp, Mus musculus
cagagatccaagctttccagaaatc

SEQ ID NO: 564790 - DNA, 25 bp, Mus musculus
cagagatccaaggtttccagaaatc

SEQ ID NO: 564791 - DNA, 25 bp, Mus musculus
cagagatccaagttggcagattcaa

SEQ ID NO: 564792 - DNA, 25 bp, Mus musculus
cagagatccggcctgtttttataca

SEQ ID NO: 564793 - DNA, 25 bp, Mus musculus
cagagatccggcgtgtttttataca

SEQ ID NO: 564794 - DNA, 25 bp, Mus musculus
cagagatcgaggagctgacggactc

SEQ ID NO: 564795 - DNA, 25 bp, Mus musculus
cagagatcgaggtgctgacggactc

SEQ ID NO: 564796 - DNA, 25 bp, Mus musculus
cagagatcgagtactacagaaatcc

SEQ ID NO: 564797 - DNA, 25 bp, Mus musculus
cagagatcgagttctacagaaatcc

SEQ ID NO: 564798 - DNA, 25 bp, Mus musculus
cagagatcgatacgtacttcaccgg

SEQ ID NO: 564799 - DNA, 25 bp, Mus musculus
cagagatcgataggtacttcaccgg

SEQ ID NO: 564800 - DNA, 25 bp, Mus musculus
cagagatcggccatgcagtttgcaa

SEQ ID NO: 564801 - DNA, 25 bp, Mus musculus
cagagatcggccttgcagtttgcaa

SEQ ID NO: 564802 - DNA, 25 bp, Mus musculus
cagagatctcctcgcatcatgggaa

SEQ ID NO: 564803 - DNA, 25 bp, Mus musculus
cagagatctcctggcatcatgggaa

SEQ ID NO: 564804 - DNA, 25 bp, Mus musculus
cagagatctggactcaacgacccaa

SEQ ID NO: 564805 - DNA, 25 bp, Mus musculus
cagagatctggagtcaacgacccaa

SEQ ID NO: 564806 - DNA, 25 bp, Mus musculus
cagagatgaccacagacctgcttcc

SEQ ID NO: 564807 - DNA, 25 bp, Mus musculus
cagagatgaccagagacctgcttcc

SEQ ID NO: 564808 - DNA, 25 bp, Mus musculus
cagagatgacggctggaatgacacc

SEQ ID NO: 564809 - DNA, 25 bp, Mus musculus
cagagatgacgggtggaatgacacc

SEQ ID NO: 564810 - DNA, 25 bp, Mus musculus
cagagatgaggcatggcgccctgta

SEQ ID NO: 564811 - DNA, 25 bp, Mus musculus
cagagatgaggcttggcgccctgta

SEQ ID NO: 564812 - DNA, 25 bp, Mus musculus
cagagatgatcccagtgggcttcgt

SEQ ID NO: 564813 - DNA, 25 bp, Mus musculus
cagagatgatccgagtgggcttcgt

SEQ ID NO: 564814 - DNA, 25 bp, Mus musculus
cagagatgcgctcctctgactgcta

SEQ ID NO: 564815 - DNA, 25 bp, Mus musculus
cagagatgcgctgctctgactgcta

SEQ ID NO: 564816 - DNA, 25 bp, Mus musculus
cagagatgctgaactgggatccaaa

SEQ ID NO: 564817 - DNA, 25 bp, Mus musculus
cagagatgctgatctgggatccaaa

SEQ ID NO: 564818 - DNA, 25 bp, Mus musculus
cagagatggaaactccaaaggaaac

SEQ ID NO: 564819 - DNA, 25 bp, Mus musculus
cagagatggaaagtccaaaggaaac

SEQ ID NO: 564820 - DNA, 25 bp, Mus musculus
cagagatggagtatgatccaaattc

SEQ ID NO: 564821 - DNA, 25 bp, Mus musculus
cagagatggagtttgatccaaattc

SEQ ID NO: 564822 - DNA, 25 bp, Mus musculus
cagagatggcacacctggagagaag

SEQ ID NO: 564823 - DNA, 25 bp, Mus musculus
cagagatggcactcctggagagaag

SEQ ID NO: 564824 - DNA, 25 bp, Mus musculus
cagagatggcttccagctctaatag

SEQ ID NO: 564825 - DNA, 25 bp, Mus musculus
cagagatggcttgcagctctaatag

SEQ ID NO: 564826 - DNA, 25 bp, Mus musculus
cagagatgggaaaatctttgtttgg

SEQ ID NO: 564827 - DNA, 25 bp, Mus musculus
cagagatgggaatatctttgtttgg

SEQ ID NO: 564828 - DNA, 25 bp, Mus musculus
cagagatgggacacgacttctttcc

SEQ ID NO: 564829 - DNA, 25 bp, Mus musculus
cagagatgggactcgacttctttcc

SEQ ID NO: 564830 - DNA, 25 bp, Mus musculus
cagagatgggcactctataccacgg

SEQ ID NO: 564831 - DNA, 25 bp, Mus musculus
cagagatgggcagtctataccacgg

SEQ ID NO: 564832 - DNA, 25 bp, Mus musculus
cagagatggtccaggtagacaggac

SEQ ID NO: 564833 - DNA, 25 bp, Mus musculus
cagagatggtcctggtagacaggac

SEQ ID NO: 564834 - DNA, 25 bp, Mus musculus
cagagatgtccgagtgctttccttc

SEQ ID NO: 564835 - DNA, 25 bp, Mus musculus
cagagatgtccgtgtgctttccttc

SEQ ID NO: 564836 - DNA, 25 bp, Mus musculus
cagagatgtgggaccccaccgaact

SEQ ID NO: 564837 - DNA, 25 bp, Mus musculus
cagagatgtgggtccccaccgaact

SEQ ID NO: 564838 - DNA, 25 bp, Mus musculus
cagagatgttaaatgcattcgagaa

SEQ ID NO: 564839 - DNA, 25 bp, Mus musculus
cagagatgttaattgcattcgagaa

SEQ ID NO: 564840 - DNA, 25 bp, Mus musculus
cagagattcagtctctggtataccc

SEQ ID NO: 564841 - DNA, 25 bp, Mus musculus
cagagattcagtgtctggtataccc

SEQ ID NO: 564842 - DNA, 25 bp, Mus musculus
cagagattcatgagtatgcccagag

SEQ ID NO: 564843 - DNA, 25 bp, Mus musculus
cagagattcatgtgtatgcccagag

SEQ ID NO: 564844 - DNA, 25 bp, Mus musculus
cagagattccaaacgcttccagatc

SEQ ID NO: 564845 - DNA, 25 bp, Mus musculus
cagagattccaaagaagctccagga

SEQ ID NO: 564846 - DNA, 25 bp, Mus musculus
cagagattccaatcgcttccagatc

SEQ ID NO: 564847 - DNA, 25 bp, Mus musculus
cagagattccaatgaagctccagga

SEQ ID NO: 564848 - DNA, 25 bp, Mus musculus
cagagattcccaagagcgtttcagg

SEQ ID NO: 564849 - DNA, 25 bp, Mus musculus
cagagattcccatgagcgtttcagg

SEQ ID NO: 564850 - DNA, 25 bp, Mus musculus
cagagattcgagctctgagaggaca

SEQ ID NO: 564851 - DNA, 25 bp, Mus musculus
cagagattcgaggtctgagaggaca

SEQ ID NO: 564852 - DNA, 25 bp, Mus musculus
cagagattgacaccttgaagaacca

SEQ ID NO: 564853 - DNA, 25 bp, Mus musculus
cagagattgacagcttgaagaacca

SEQ ID NO: 564854 - DNA, 25 bp, Mus musculus
cagagattgactagggggtgccacc

SEQ ID NO: 564855 - DNA, 25 bp, Mus musculus
cagagattgacttgggggtgccacc

SEQ ID NO: 564856 - DNA, 25 bp, Mus musculus
cagagattgagaccaagcggagaca

SEQ ID NO: 564857 - DNA, 25 bp, Mus musculus
cagagattgagagcaagcggagaca

SEQ ID NO: 564858 - DNA, 25 bp, Mus musculus
cagagattgggcatagtactagagg

SEQ ID NO: 564859 - DNA, 25 bp, Mus musculus
cagagattgggcttagtactagagg

SEQ ID NO: 564860 - DNA, 25 bp, Mus musculus
cagagattgttaaaatgatttaccg

SEQ ID NO: 564861 - DNA, 25 bp, Mus musculus
cagagattgttataatgatttaccg

SEQ ID NO: 564862 - DNA, 25 bp, Mus musculus
cagagatttacaaccaccgaagtgg

SEQ ID NO: 564863 - DNA, 25 bp, Mus musculus
cagagatttacatccaccgaagtgg

SEQ ID NO: 564864 - DNA, 25 bp, Mus musculus
cagagattttctcttggacgaggcc

SEQ ID NO: 564865 - DNA, 25 bp, Mus musculus
cagagattttctgttggacgaggcc

SEQ ID NO: 564866 - DNA, 25 bp, Mus musculus
cagagcaaaagtcactagggcgttc

SEQ ID NO: 564867 - DNA, 25 bp, Mus musculus
cagagcaaaagtgactagggcgttc

SEQ ID NO: 564868 - DNA, 25 bp, Mus musculus
cagagcaaagggaagggaagtctca

SEQ ID NO: 564869 - DNA, 25 bp, Mus musculus
cagagcaaagggtagggaagtctca

SEQ ID NO: 564870 - DNA, 25 bp, Mus musculus
cagagcaacctgagtacatcagtca

SEQ ID NO: 564871 - DNA, 25 bp, Mus musculus
cagagcaacctgctgagtgtggcct

SEQ ID NO: 564872 - DNA, 25 bp, Mus musculus
cagagcaacctggtgagtgtggcct

SEQ ID NO: 564873 - DNA, 25 bp, Mus musculus
cagagcaacctgtgtacatcagtca

SEQ ID NO: 564874 - DNA, 25 bp, Mus musculus
cagagcaacgttccccttgggcaga

SEQ ID NO: 564875 - DNA, 25 bp, Mus musculus
cagagcaacgttgcccttgggcaga

SEQ ID NO: 564876 - DNA, 25 bp, Mus musculus
cagagcaagacaaattgtaagcggc

SEQ ID NO: 564877 - DNA, 25 bp, Mus musculus
cagagcaagacatattgtaagcggc

SEQ ID NO: 564878 - DNA, 25 bp, Mus musculus
cagagcaagcagcaatccaatgagc

SEQ ID NO: 564879 - DNA, 25 bp, Mus musculus
cagagcaagcaggaatccaatgagc

SEQ ID NO: 564880 - DNA, 25 bp, Mus musculus
cagagcaaggacactgggcttagca

SEQ ID NO: 564881 - DNA, 25 bp, Mus musculus
cagagcaaggactctgggcttagca

SEQ ID NO: 564882 - DNA, 25 bp, Mus musculus
cagagcaaggctcccaagaattgca

SEQ ID NO: 564883 - DNA, 25 bp, Mus musculus
cagagcaaggctgccaagaattgca

SEQ ID NO: 564884 - DNA, 25 bp, Mus musculus
cagagcaagggcatgccccttttgg

SEQ ID NO: 564885 - DNA, 25 bp, Mus musculus
cagagcaagggcttgccccttttgg

SEQ ID NO: 564886 - DNA, 25 bp, Mus musculus
cagagcaaggtacagagggtctcac

SEQ ID NO: 564887 - DNA, 25 bp, Mus musculus
cagagcaaggtagagagggtctcac

SEQ ID NO: 564888 - DNA, 25 bp, Mus musculus
cagagcaatgcccttggacaaggtg

SEQ ID NO: 564889 - DNA, 25 bp, Mus musculus
cagagcaatgccgttggacaaggtg

SEQ ID NO: 564890 - DNA, 25 bp, Mus musculus
cagagcaattggaaccgatgaggat

SEQ ID NO: 564891 - DNA, 25 bp, Mus musculus
cagagcaattggtaccgatgaggat

SEQ ID NO: 564892 - DNA, 25 bp, Mus musculus
cagagcacagctcctatgggagaaa

SEQ ID NO: 564893 - DNA, 25 bp, Mus musculus
cagagcacagctgctatgggagaaa

SEQ ID NO: 564894 - DNA, 25 bp, Mus musculus
cagagcaccatcagggaggaaggaa

SEQ ID NO: 564895 - DNA, 25 bp, Mus musculus
cagagcaccatctgggaggaaggaa

SEQ ID NO: 564896 - DNA, 25 bp, Mus musculus
cagagcactatgctcaccgggaaaa

SEQ ID NO: 564897 - DNA, 25 bp, Mus musculus
cagagcactatggtcaccgggaaaa

SEQ ID NO: 564898 - DNA, 25 bp, Mus musculus
cagagcactgacacacacaggagac

SEQ ID NO: 564899 - DNA, 25 bp, Mus musculus
cagagcactgactcacacaggagac

SEQ ID NO: 564900 - DNA, 25 bp, Mus musculus
cagagcacttttaggtaatgtgagg

SEQ ID NO: 564901 - DNA, 25 bp, Mus musculus
cagagcactttttggtaatgtgagg

SEQ ID NO: 564902 - DNA, 25 bp, Mus musculus
cagagcagacatctttgggcccaga

SEQ ID NO: 564903 - DNA, 25 bp, Mus musculus
cagagcagacatgtttgggcccaga

SEQ ID NO: 564904 - DNA, 25 bp, Mus musculus
cagagcagagcaatcacagaggact

SEQ ID NO: 564905 - DNA, 25 bp, Mus musculus
cagagcagagcattcacagaggact

SEQ ID NO: 564906 - DNA, 25 bp, Mus musculus
cagagcagattgagaagtatgataa

SEQ ID NO: 564907 - DNA, 25 bp, Mus musculus
cagagcagattgtgaagtatgataa

SEQ ID NO: 564908 - DNA, 25 bp, Mus musculus
cagagcagcagacgagctaagccag

SEQ ID NO: 564909 - DNA, 25 bp, Mus musculus
cagagcagcagaggagctaagccag

SEQ ID NO: 564910 - DNA, 25 bp, Mus musculus
cagagcagccatacatatgatgata

SEQ ID NO: 564911 - DNA, 25 bp, Mus musculus
cagagcagccattcatatgatgata

SEQ ID NO: 564912 - DNA, 25 bp, Mus musculus
cagagcaggagactggcttcaagca

SEQ ID NO: 564913 - DNA, 25 bp, Mus musculus
cagagcaggagagtggcttcaagca

SEQ ID NO: 564914 - DNA, 25 bp, Mus musculus
cagagcaggcgcacaccattaggga

SEQ ID NO: 564915 - DNA, 25 bp, Mus musculus
cagagcaggcgctcaccattaggga

SEQ ID NO: 564916 - DNA, 25 bp, Mus musculus
cagagcagggacaatgacgtggagt

SEQ ID NO: 564917 - DNA, 25 bp, Mus musculus
cagagcagggactatgacgtggagt

SEQ ID NO: 564918 - DNA, 25 bp, Mus musculus
cagagcaggtcaaaacctcttctac

SEQ ID NO: 564919 - DNA, 25 bp, Mus musculus
cagagcaggtcataacctcttctac

SEQ ID NO: 564920 - DNA, 25 bp, Mus musculus
cagagcagtactcccgggaacaaga

SEQ ID NO: 564921 - DNA, 25 bp, Mus musculus
cagagcagtactgccgggaacaaga

SEQ ID NO: 564922 - DNA, 25 bp, Mus musculus
cagagcagtcgcacagcgtggtgtt

SEQ ID NO: 564923 - DNA, 25 bp, Mus musculus
cagagcagtcgctcagcgtggtgtt

SEQ ID NO: 564924 - DNA, 25 bp, Mus musculus
cagagcagtgctacaaggtgaccaa

SEQ ID NO: 564925 - DNA, 25 bp, Mus musculus
cagagcagtgcttcaaggtgaccaa

SEQ ID NO: 564926 - DNA, 25 bp, Mus musculus
cagagcatcaacaggctgcgggatg

SEQ ID NO: 564927 - DNA, 25 bp, Mus musculus
cagagcatcaactggctgcgggatg

SEQ ID NO: 564928 - DNA, 25 bp, Mus musculus
cagagcatcaagagtgtgctggtga

SEQ ID NO: 564929 - DNA, 25 bp, Mus musculus
cagagcatcaagtgtgtgctggtga

SEQ ID NO: 564930 - DNA, 25 bp, Mus musculus
cagagcatcagactctcccattgat

SEQ ID NO: 564931 - DNA, 25 bp, Mus musculus
cagagcatcagagtctcccattgat

SEQ ID NO: 564932 - DNA, 25 bp, Mus musculus
cagagcatccccagcagtacaacta

SEQ ID NO: 564933 - DNA, 25 bp, Mus musculus
cagagcatcccctgcagtacaacta

SEQ ID NO: 564934 - DNA, 25 bp, Mus musculus
cagagcatctctcggatgacagtcc

SEQ ID NO: 564935 - DNA, 25 bp, Mus musculus
cagagcatctctgggatgacagtcc

SEQ ID NO: 564936 - DNA, 25 bp, Mus musculus
cagagcatcttccagtttacttgtg

SEQ ID NO: 564937 - DNA, 25 bp, Mus musculus
cagagcatcttcgagtttacttgtg

SEQ ID NO: 564938 - DNA, 25 bp, Mus musculus
cagagcatgggacagaatcagctgt

SEQ ID NO: 564939 - DNA, 25 bp, Mus musculus
cagagcatgggagagaatcagctgt

SEQ ID NO: 564940 - DNA, 25 bp, Mus musculus
cagagcattaagactgagacatctg

SEQ ID NO: 564941 - DNA, 25 bp, Mus musculus
cagagcattaagtctgagacatctg

SEQ ID NO: 564942 - DNA, 25 bp, Mus musculus
cagagcattaccaggacctgctggc

SEQ ID NO: 564943 - DNA, 25 bp, Mus musculus
cagagcattacctggacctgctggc

SEQ ID NO: 564944 - DNA, 25 bp, Mus musculus
cagagcattgaactgaacaaccgtc

SEQ ID NO: 564945 - DNA, 25 bp, Mus musculus
cagagcattgaagtgaacaaccgtc

SEQ ID NO: 564946 - DNA, 25 bp, Mus musculus
cagagccaagggatcctccctgtta

SEQ ID NO: 564947 - DNA, 25 bp, Mus musculus
cagagccaagggttcctccctgtta

SEQ ID NO: 564948 - DNA, 25 bp, Mus musculus
cagagccaaggtatgctgaagacca

SEQ ID NO: 564949 - DNA, 25 bp, Mus musculus
cagagccaaggtttgctgaagacca

SEQ ID NO: 564950 - DNA, 25 bp, Mus musculus
cagagccacacccaaaagttattga

SEQ ID NO: 564951 - DNA, 25 bp, Mus musculus
cagagccacaccgaaaagttattga

SEQ ID NO: 564952 - DNA, 25 bp, Mus musculus
cagagccacctacggagactctgct

SEQ ID NO: 564953 - DNA, 25 bp, Mus musculus
cagagccacctagggagactctgct

SEQ ID NO: 564954 - DNA, 25 bp, Mus musculus
cagagccacgtccactttgatgaaa

SEQ ID NO: 564955 - DNA, 25 bp, Mus musculus
cagagccacgtcgactttgatgaaa

SEQ ID NO: 564956 - DNA, 25 bp, Mus musculus
cagagccactggctgaagacaagaa

SEQ ID NO: 564957 - DNA, 25 bp, Mus musculus
cagagccactgggtgaagacaagaa

SEQ ID NO: 564958 - DNA, 25 bp, Mus musculus
cagagccagacaagtgcggtggcaa

SEQ ID NO: 564959 - DNA, 25 bp, Mus musculus
cagagccagacatgtgcggtggcaa

SEQ ID NO: 564960 - DNA, 25 bp, Mus musculus
cagagccagcaaaggaggacttatc

SEQ ID NO: 564961 - DNA, 25 bp, Mus musculus
cagagccagcaatggaggacttatc

SEQ ID NO: 564962 - DNA, 25 bp, Mus musculus
cagagccagctaagccgctgaagag

SEQ ID NO: 564963 - DNA, 25 bp, Mus musculus
cagagccagctatgccgctgaagag

SEQ ID NO: 564964 - DNA, 25 bp, Mus musculus
cagagccagggacataccccttgct

SEQ ID NO: 564965 - DNA, 25 bp, Mus musculus
cagagccagggagataccccttgct

SEQ ID NO: 564966 - DNA, 25 bp, Mus musculus
cagagccatgagctcctgcgggact

SEQ ID NO: 564967 - DNA, 25 bp, Mus musculus
cagagccatgaggtcctgcgggact

SEQ ID NO: 564968 - DNA, 25 bp, Mus musculus
cagagcccaatgaggatcgaccgtc

SEQ ID NO: 564969 - DNA, 25 bp, Mus musculus
cagagcccaatgtggatcgaccgtc

SEQ ID NO: 564970 - DNA, 25 bp, Mus musculus
cagagcccacaacctggataacaag

SEQ ID NO: 564971 - DNA, 25 bp, Mus musculus
cagagcccacaagctggataacaag

SEQ ID NO: 564972 - DNA, 25 bp, Mus musculus
cagagcccagcgagggctgccttgc

SEQ ID NO: 564973 - DNA, 25 bp, Mus musculus
cagagcccagcgtgggctgccttgc

SEQ ID NO: 564974 - DNA, 25 bp, Mus musculus
cagagcccaggaaggtattcacacc

SEQ ID NO: 564975 - DNA, 25 bp, Mus musculus
cagagcccaggatggtattcacacc

SEQ ID NO: 564976 - DNA, 25 bp, Mus musculus
cagagccccacgagcactgatgttt

SEQ ID NO: 564977 - DNA, 25 bp, Mus musculus
cagagccccacgtgcactgatgttt

SEQ ID NO: 564978 - DNA, 25 bp, Mus musculus
cagagcccgttaaatgccagtgata

SEQ ID NO: 564979 - DNA, 25 bp, Mus musculus
cagagcccgttatatgccagtgata

SEQ ID NO: 564980 - DNA, 25 bp, Mus musculus
cagagccctgccatgtctcaaagag

SEQ ID NO: 564981 - DNA, 25 bp, Mus musculus
cagagccctgccttgtctcaaagag

SEQ ID NO: 564982 - DNA, 25 bp, Mus musculus
cagagccgaaccacggtcttcggaa

SEQ ID NO: 564983 - DNA, 25 bp, Mus musculus
cagagccgaacctcggtcttcggaa

SEQ ID NO: 564984 - DNA, 25 bp, Mus musculus
cagagccgcatgaatcaggcatgaa

SEQ ID NO: 564985 - DNA, 25 bp, Mus musculus
cagagccgcatgtatcaggcatgaa

SEQ ID NO: 564986 - DNA, 25 bp, Mus musculus
cagagccggcttagtactaagagtc

SEQ ID NO: 564987 - DNA, 25 bp, Mus musculus
cagagccggctttgtactaagagtc

SEQ ID NO: 564988 - DNA, 25 bp, Mus musculus
cagagccggtgtcacatgacagaac

SEQ ID NO: 564989 - DNA, 25 bp, Mus musculus
cagagccggtgtgacatgacagaac

SEQ ID NO: 564990 - DNA, 25 bp, Mus musculus
cagagcctaagtcagactggagccc

SEQ ID NO: 564991 - DNA, 25 bp, Mus musculus
cagagcctaagtgagactggagccc

SEQ ID NO: 564992 - DNA, 25 bp, Mus musculus
cagagcctcgagcaattgggcaccc

SEQ ID NO: 564993 - DNA, 25 bp, Mus musculus
cagagcctcgaggaattgggcaccc

SEQ ID NO: 564994 - DNA, 25 bp, Mus musculus
cagagcctctcgctagtggtctgcc

SEQ ID NO: 564995 - DNA, 25 bp, Mus musculus
cagagcctctcggtagtggtctgcc

SEQ ID NO: 564996 - DNA, 25 bp, Mus musculus
cagagcctgaaacggtgggactaca

SEQ ID NO: 564997 - DNA, 25 bp, Mus musculus
cagagcctgaaagggtgggactaca

SEQ ID NO: 564998 - DNA, 25 bp, Mus musculus
cagagcctgacaagatcaccatctt

SEQ ID NO: 564999 - DNA, 25 bp, Mus musculus
cagagcctgacatgatcaccatctt

SEQ ID NO: 565000 - DNA, 25 bp, Mus musculus
cagagcctgactacctttagcaagg

SEQ ID NO: 565001 - DNA, 25 bp, Mus musculus
cagagcctgacttcctttagcaagg

SEQ ID NO: 565002 - DNA, 25 bp, Mus musculus
cagagcctgagcagtttgcagttcc

SEQ ID NO: 565003 - DNA, 25 bp, Mus musculus
cagagcctgagctgtttgcagttcc

SEQ ID NO: 565004 - DNA, 25 bp, Mus musculus
cagagcctgaggcacaactggagca

SEQ ID NO: 565005 - DNA, 25 bp, Mus musculus
cagagcctgagggacaactggagca

SEQ ID NO: 565006 - DNA, 25 bp, Mus musculus
cagagcctgcaacatggagcatagg

SEQ ID NO: 565007 - DNA, 25 bp, Mus musculus
cagagcctgcaagatggagcatagg

SEQ ID NO: 565008 - DNA, 25 bp, Mus musculus
cagagcctgctgagactttgtgtac

SEQ ID NO: 565009 - DNA, 25 bp, Mus musculus
cagagcctgctgtgactttgtgtac

SEQ ID NO: 565010 - DNA, 25 bp, Mus musculus
cagagcctggagcacacggacttga

SEQ ID NO: 565011 - DNA, 25 bp, Mus musculus
cagagcctggaggacacggacttga

SEQ ID NO: 565012 - DNA, 25 bp, Mus musculus
cagagcctgtttaccccaaaacagg

SEQ ID NO: 565013 - DNA, 25 bp, Mus musculus
cagagcctgttttccccaaaacagg

SEQ ID NO: 565014 - DNA, 25 bp, Mus musculus
cagagccttctcctggtgatgaacc

SEQ ID NO: 565015 - DNA, 25 bp, Mus musculus
cagagccttctcgtggtgatgaacc

SEQ ID NO: 565016 - DNA, 25 bp, Mus musculus
cagagccttggaatgtgaagacaca

SEQ ID NO: 565017 - DNA, 25 bp, Mus musculus
cagagccttggattgtgaagacaca

SEQ ID NO: 565018 - DNA, 25 bp, Mus musculus
cagagcctttgacagcgacccggga

SEQ ID NO: 565019 - DNA, 25 bp, Mus musculus
cagagcctttgagagcgacccggga

SEQ ID NO: 565020 - DNA, 25 bp, Mus musculus
cagagcgaatctcagcccacagcag

SEQ ID NO: 565021 - DNA, 25 bp, Mus musculus
cagagcgaatctgagcccacagcag

SEQ ID NO: 565022 - DNA, 25 bp, Mus musculus
cagagcgagcgacaacccgaacgct

SEQ ID NO: 565023 - DNA, 25 bp, Mus musculus
cagagcgagcgagaacccgaacgct

SEQ ID NO: 565024 - DNA, 25 bp, Mus musculus
cagagcgaggacagggccctcaaca

SEQ ID NO: 565025 - DNA, 25 bp, Mus musculus
cagagcgaggactgggccctcaaca

SEQ ID NO: 565026 - DNA, 25 bp, Mus musculus
cagagcgatatgatgacatggcagc

SEQ ID NO: 565027 - DNA, 25 bp, Mus musculus
cagagcgatatgttgacatggcagc

SEQ ID NO: 565028 - DNA, 25 bp, Mus musculus
cagagcgcaacgagctgttgaagaa

SEQ ID NO: 565029 - DNA, 25 bp, Mus musculus
cagagcgcaacgtgctgttgaagaa

SEQ ID NO: 565030 - DNA, 25 bp, Mus musculus
cagagcgcaagaaccaccgagatat

SEQ ID NO: 565031 - DNA, 25 bp, Mus musculus
cagagcgcaagatccaccgagatat

SEQ ID NO: 565032 - DNA, 25 bp, Mus musculus
cagagcgcaaggcatacaccagaaa

SEQ ID NO: 565033 - DNA, 25 bp, Mus musculus
cagagcgcaagggatacaccagaaa

SEQ ID NO: 565034 - DNA, 25 bp, Mus musculus
cagagcggagccatcatctgcatcc

SEQ ID NO: 565035 - DNA, 25 bp, Mus musculus
cagagcggagccttcatctgcatcc

SEQ ID NO: 565036 - DNA, 25 bp, Mus musculus
cagagcggaggcacagcgcagcaca

SEQ ID NO: 565037 - DNA, 25 bp, Mus musculus
cagagcggaggctcagcgcagcaca

SEQ ID NO: 565038 - DNA, 25 bp, Mus musculus
cagagcggctacaggactacagcag

SEQ ID NO: 565039 - DNA, 25 bp, Mus musculus
cagagcggctactggactacagcag

SEQ ID NO: 565040 - DNA, 25 bp, Mus musculus
cagagcgggatgaatccagtggaat

SEQ ID NO: 565041 - DNA, 25 bp, Mus musculus
cagagcgggatgtatccagtggaat

SEQ ID NO: 565042 - DNA, 25 bp, Mus musculus
cagagcgtctggcaaaatacaacca

SEQ ID NO: 565043 - DNA, 25 bp, Mus musculus
cagagcgtctgggaaaatacaacca

SEQ ID NO: 565044 - DNA, 25 bp, Mus musculus
cagagcgtctttccttggctagaga

SEQ ID NO: 565045 - DNA, 25 bp, Mus musculus
cagagcgtctttgcttggctagaga

SEQ ID NO: 565046 - DNA, 25 bp, Mus musculus
cagagcgtgctgagctcattgatga

SEQ ID NO: 565047 - DNA, 25 bp, Mus musculus
cagagcgtgctgtgctcattgatga

SEQ ID NO: 565048 - DNA, 25 bp, Mus musculus
cagagcgttacaagggtctcccaat

SEQ ID NO: 565049 - DNA, 25 bp, Mus musculus
cagagcgttacatgggtctcccaat

SEQ ID NO: 565050 - DNA, 25 bp, Mus musculus
cagagcgttcatagggaatgaagtg

SEQ ID NO: 565051 - DNA, 25 bp, Mus musculus
cagagcgttcattgggaatgaagtg

SEQ ID NO: 565052 - DNA, 25 bp, Mus musculus
cagagctaatagcatcggctccacc

SEQ ID NO: 565053 - DNA, 25 bp, Mus musculus
cagagctaataggatcggctccacc

SEQ ID NO: 565054 - DNA, 25 bp, Mus musculus
cagagctaatgacatatgtgtggga

SEQ ID NO: 565055 - DNA, 25 bp, Mus musculus
cagagctaatgagatatgtgtggga

SEQ ID NO: 565056 - DNA, 25 bp, Mus musculus
cagagctactttcatctcctgggag

SEQ ID NO: 565057 - DNA, 25 bp, Mus musculus
cagagctactttgatctcctgggag

SEQ ID NO: 565058 - DNA, 25 bp, Mus musculus
cagagctagcttctaaacaccttgc

SEQ ID NO: 565059 - DNA, 25 bp, Mus musculus
cagagctagcttgtaaacaccttgc

SEQ ID NO: 565060 - DNA, 25 bp, Mus musculus
cagagctatcgaatcaggaggagac

SEQ ID NO: 565061 - DNA, 25 bp, Mus musculus
cagagctatcgattcaggaggagac

SEQ ID NO: 565062 - DNA, 25 bp, Mus musculus
cagagctattgcacctacactggaa

SEQ ID NO: 565063 - DNA, 25 bp, Mus musculus
cagagctattgctcctacactggaa

SEQ ID NO: 565064 - DNA, 25 bp, Mus musculus
cagagctcaaacaggtgtaaacaga

SEQ ID NO: 565065 - DNA, 25 bp, Mus musculus
cagagctcaaactggtgtaaacaga

SEQ ID NO: 565066 - DNA, 25 bp, Mus musculus
cagagctcaaatcaagcagtctggg

SEQ ID NO: 565067 - DNA, 25 bp, Mus musculus
cagagctcaaatgaagcagtctggg

SEQ ID NO: 565068 - DNA, 25 bp, Mus musculus
cagagctcacggcacaccctgagtt

SEQ ID NO: 565069 - DNA, 25 bp, Mus musculus
cagagctcacgggacaccctgagtt

SEQ ID NO: 565070 - DNA, 25 bp, Mus musculus
cagagctcagaactccaagatacac

SEQ ID NO: 565071 - DNA, 25 bp, Mus musculus
cagagctcagaagtccaagatacac

SEQ ID NO: 565072 - DNA, 25 bp, Mus musculus
cagagctcagggaacgggtcttttg

SEQ ID NO: 565073 - DNA, 25 bp, Mus musculus
cagagctcagggtacgggtcttttg

SEQ ID NO: 565074 - DNA, 25 bp, Mus musculus
cagagctcaggtattctgggcatgc

SEQ ID NO: 565075 - DNA, 25 bp, Mus musculus
cagagctcaggttttctgggcatgc

SEQ ID NO: 565076 - DNA, 25 bp, Mus musculus
cagagctcatcccacggttaaaggg

SEQ ID NO: 565077 - DNA, 25 bp, Mus musculus
cagagctcatccgacggttaaaggg

SEQ ID NO: 565078 - DNA, 25 bp, Mus musculus
cagagctcatgcatgctgtcaagga

SEQ ID NO: 565079 - DNA, 25 bp, Mus musculus
cagagctcatgcttgctgtcaagga

SEQ ID NO: 565080 - DNA, 25 bp, Mus musculus
cagagctcccggcactagatagtga

SEQ ID NO: 565081 - DNA, 25 bp, Mus musculus
cagagctcccgggactagatagtga

SEQ ID NO: 565082 - DNA, 25 bp, Mus musculus
cagagctccgagcaatgggacccag

SEQ ID NO: 565083 - DNA, 25 bp, Mus musculus
cagagctccgaggaatgggacccag

SEQ ID NO: 565084 - DNA, 25 bp, Mus musculus
cagagctccggacgatctgtaggaa

SEQ ID NO: 565085 - DNA, 25 bp, Mus musculus
cagagctccggaggatctgtaggaa

SEQ ID NO: 565086 - DNA, 25 bp, Mus musculus
cagagctcgaacacccgtcgttcat

SEQ ID NO: 565087 - DNA, 25 bp, Mus musculus
cagagctcgaactcccgtcgttcat

SEQ ID NO: 565088 - DNA, 25 bp, Mus musculus
cagagctcgacacaactcggttgct

SEQ ID NO: 565089 - DNA, 25 bp, Mus musculus
cagagctcgacagaactcggttgct

SEQ ID NO: 565090 - DNA, 25 bp, Mus musculus
cagagctctgcgcataaagagagac

SEQ ID NO: 565091 - DNA, 25 bp, Mus musculus
cagagctctgcggataaagagagac

SEQ ID NO: 565092 - DNA, 25 bp, Mus musculus
cagagctctgggaaccgctatggca

SEQ ID NO: 565093 - DNA, 25 bp, Mus musculus
cagagctctgggacacgcttctagc

SEQ ID NO: 565094 - DNA, 25 bp, Mus musculus
cagagctctgggtaccgctatggca

SEQ ID NO: 565095 - DNA, 25 bp, Mus musculus
cagagctctgggtcacgcttctagc

SEQ ID NO: 565096 - DNA, 25 bp, Mus musculus
cagagctcttgcaggtgtctgtctg

SEQ ID NO: 565097 - DNA, 25 bp, Mus musculus
cagagctcttgctggtgtctgtctg

SEQ ID NO: 565098 - DNA, 25 bp, Mus musculus
cagagctgaagaaaagagagcagga

SEQ ID NO: 565099 - DNA, 25 bp, Mus musculus
cagagctgaagataagagagcagga

SEQ ID NO: 565100 - DNA, 25 bp, Mus musculus
cagagctgaccaaggcaacatccct

SEQ ID NO: 565101 - DNA, 25 bp, Mus musculus
cagagctgaccatggcaacatccct

SEQ ID NO: 565102 - DNA, 25 bp, Mus musculus
cagagctgacgcagtcgcagatgct

SEQ ID NO: 565103 - DNA, 25 bp, Mus musculus
cagagctgacgctgtcgcagatgct

SEQ ID NO: 565104 - DNA, 25 bp, Mus musculus
cagagctgacggacaaggagttgaa

SEQ ID NO: 565105 - DNA, 25 bp, Mus musculus
cagagctgacggtcaaggagttgaa

SEQ ID NO: 565106 - DNA, 25 bp, Mus musculus
cagagctgagccacgttttgtccca

SEQ ID NO: 565107 - DNA, 25 bp, Mus musculus
cagagctgagcctcgttttgtccca

SEQ ID NO: 565108 - DNA, 25 bp, Mus musculus
cagagctgattgacattcggcagta

SEQ ID NO: 565109 - DNA, 25 bp, Mus musculus
cagagctgattgtcattcggcagta

SEQ ID NO: 565110 - DNA, 25 bp, Mus musculus
cagagctgccagaattccagcttaa

SEQ ID NO: 565111 - DNA, 25 bp, Mus musculus
cagagctgccagtattccagcttaa

SEQ ID NO: 565112 - DNA, 25 bp, Mus musculus
cagagctgcccaagaacgaccagtt

SEQ ID NO: 565113 - DNA, 25 bp, Mus musculus
cagagctgcccatgaacgaccagtt

SEQ ID NO: 565114 - DNA, 25 bp, Mus musculus
cagagctgctcaatggtttagaccc

SEQ ID NO: 565115 - DNA, 25 bp, Mus musculus
cagagctgctcattggtttagaccc

SEQ ID NO: 565116 - DNA, 25 bp, Mus musculus
cagagctggaaacaactcccatggg

SEQ ID NO: 565117 - DNA, 25 bp, Mus musculus
cagagctggaaagaactcccatggg

SEQ ID NO: 565118 - DNA, 25 bp, Mus musculus
cagagctggagaactttgcaataat

SEQ ID NO: 565119 - DNA, 25 bp, Mus musculus
cagagctggagatctttgcaataat

SEQ ID NO: 565120 - DNA, 25 bp, Mus musculus
cagagctggcagagtacacggccaa

SEQ ID NO: 565121 - DNA, 25 bp, Mus musculus
cagagctggcagtgtacacggccaa

SEQ ID NO: 565122 - DNA, 25 bp, Mus musculus
cagagctggccactctagtgaataa

SEQ ID NO: 565123 - DNA, 25 bp, Mus musculus
cagagctggccagtctagtgaataa

SEQ ID NO: 565124 - DNA, 25 bp, Mus musculus
cagagctggtgacgatgaagctacc

SEQ ID NO: 565125 - DNA, 25 bp, Mus musculus
cagagctggtgaggatgaagctacc

SEQ ID NO: 565126 - DNA, 25 bp, Mus musculus
cagagctggtgtagactgcattatc

SEQ ID NO: 565127 - DNA, 25 bp, Mus musculus
cagagctggtgttgactgcattatc

SEQ ID NO: 565128 - DNA, 25 bp, Mus musculus
cagagctgtcaaagcaggatgagga

SEQ ID NO: 565129 - DNA, 25 bp, Mus musculus
cagagctgtcaatgcaggatgagga

SEQ ID NO: 565130 - DNA, 25 bp, Mus musculus
cagagctgtgcacaaactccggcgt

SEQ ID NO: 565131 - DNA, 25 bp, Mus musculus
cagagctgtgcagaaactccggcgt

SEQ ID NO: 565132 - DNA, 25 bp, Mus musculus
cagagcttcaaactttctagtgccc

SEQ ID NO: 565133 - DNA, 25 bp, Mus musculus
cagagcttcaaagtttctagtgccc

SEQ ID NO: 565134 - DNA, 25 bp, Mus musculus
cagagcttcagaatcttggagaaac

SEQ ID NO: 565135 - DNA, 25 bp, Mus musculus
cagagcttcagattcttggagaaac

SEQ ID NO: 565136 - DNA, 25 bp, Mus musculus
cagagcttccctcaaggtcagccta

SEQ ID NO: 565137 - DNA, 25 bp, Mus musculus
cagagcttccctgaaggtcagccta

SEQ ID NO: 565138 - DNA, 25 bp, Mus musculus
cagagcttccgaccactaggtatct

SEQ ID NO: 565139 - DNA, 25 bp, Mus musculus
cagagcttccgagcactaggtatct

SEQ ID NO: 565140 - DNA, 25 bp, Mus musculus
cagagcttctcaacgtggtgaagta

SEQ ID NO: 565141 - DNA, 25 bp, Mus musculus
cagagcttctcatcgtggtgaagta

SEQ ID NO: 565142 - DNA, 25 bp, Mus musculus
cagagcttctgaatggtgatttctc

SEQ ID NO: 565143 - DNA, 25 bp, Mus musculus
cagagcttctgattggtgatttctc

SEQ ID NO: 565144 - DNA, 25 bp, Mus musculus
cagagcttctggagacaggtgcaga

SEQ ID NO: 565145 - DNA, 25 bp, Mus musculus
cagagcttctggtgacaggtgcaga

SEQ ID NO: 565146 - DNA, 25 bp, Mus musculus
cagagcttcttcagagccagtcaga

SEQ ID NO: 565147 - DNA, 25 bp, Mus musculus
cagagcttcttctgagccagtcaga

SEQ ID NO: 565148 - DNA, 25 bp, Mus musculus
cagagcttgcttctcttttcactcc

SEQ ID NO: 565149 - DNA, 25 bp, Mus musculus
cagagcttgcttgtcttttcactcc

SEQ ID NO: 565150 - DNA, 25 bp, Mus musculus
cagagcttggagaatctggaacaag

SEQ ID NO: 565151 - DNA, 25 bp, Mus musculus
cagagcttggagtatctggaacaag

SEQ ID NO: 565152 - DNA, 25 bp, Mus musculus
cagagcttgggccttgaagagtctc

SEQ ID NO: 565153 - DNA, 25 bp, Mus musculus
cagagcttgggcgttgaagagtctc

SEQ ID NO: 565154 - DNA, 25 bp, Mus musculus
cagagcttgtcaacgactatggcaa

SEQ ID NO: 565155 - DNA, 25 bp, Mus musculus
cagagcttgtcatcgactatggcaa

SEQ ID NO: 565156 - DNA, 25 bp, Mus musculus
cagagctttgggatgccgggatcaa

SEQ ID NO: 565157 - DNA, 25 bp, Mus musculus
cagagctttgggttgccgggatcaa

SEQ ID NO: 565158 - DNA, 25 bp, Mus musculus
cagaggaaacgaaggctctagtggt

SEQ ID NO: 565159 - DNA, 25 bp, Mus musculus
cagaggaaacgatggctctagtggt

SEQ ID NO: 565160 - DNA, 25 bp, Mus musculus
cagaggaaatcgcaatcgagggaac

SEQ ID NO: 565161 - DNA, 25 bp, Mus musculus
cagaggaaatcggaatcgagggaac

SEQ ID NO: 565162 - DNA, 25 bp, Mus musculus
cagaggaaatctagtggtgactata

SEQ ID NO: 565163 - DNA, 25 bp, Mus musculus
cagaggaaatcttgtggtgactata

SEQ ID NO: 565164 - DNA, 25 bp, Mus musculus
cagaggaaatgcagaaagttcttct

SEQ ID NO: 565165 - DNA, 25 bp, Mus musculus
cagaggaaatgctgaaagttcttct

SEQ ID NO: 565166 - DNA, 25 bp, Mus musculus
cagaggaaatggctgatatgcaaaa

SEQ ID NO: 565167 - DNA, 25 bp, Mus musculus
cagaggaaatgggtgatatgcaaaa

SEQ ID NO: 565168 - DNA, 25 bp, Mus musculus
cagaggaaattgatcaagtattgga

SEQ ID NO: 565169 - DNA, 25 bp, Mus musculus
cagaggaaattgttcaagtattgga

SEQ ID NO: 565170 - DNA, 25 bp, Mus musculus
cagaggaaccacagactgcagagac

SEQ ID NO: 565171 - DNA, 25 bp, Mus musculus
cagaggaaccactgactgcagagac

SEQ ID NO: 565172 - DNA, 25 bp, Mus musculus
cagaggaaccctccgaagactatga

SEQ ID NO: 565173 - DNA, 25 bp, Mus musculus
cagaggaaccctgcgaagactatga

SEQ ID NO: 565174 - DNA, 25 bp, Mus musculus
cagaggaagactcctgttaggcaag

SEQ ID NO: 565175 - DNA, 25 bp, Mus musculus
cagaggaagactgctgttaggcaag

SEQ ID NO: 565176 - DNA, 25 bp, Mus musculus
cagaggaagatcaacgaatggctgg

SEQ ID NO: 565177 - DNA, 25 bp, Mus musculus
cagaggaagatctacgaatggctgg

SEQ ID NO: 565178 - DNA, 25 bp, Mus musculus
cagaggaagattattacctttgcag

SEQ ID NO: 565179 - DNA, 25 bp, Mus musculus
cagaggaagatttttacctttgcag

SEQ ID NO: 565180 - DNA, 25 bp, Mus musculus
cagaggaagcctattgatgacgcaa

SEQ ID NO: 565181 - DNA, 25 bp, Mus musculus
cagaggaagccttttgatgacgcaa

SEQ ID NO: 565182 - DNA, 25 bp, Mus musculus
cagaggaagggtacagatgcactgt

SEQ ID NO: 565183 - DNA, 25 bp, Mus musculus
cagaggaagggttcagatgcactgt

SEQ ID NO: 565184 - DNA, 25 bp, Mus musculus
cagaggaagtttccctacggtggca

SEQ ID NO: 565185 - DNA, 25 bp, Mus musculus
cagaggaagtttgcctacggtggca

SEQ ID NO: 565186 - DNA, 25 bp, Mus musculus
cagaggaataggcttgatgaagaat

SEQ ID NO: 565187 - DNA, 25 bp, Mus musculus
cagaggaatagggttgatgaagaat

SEQ ID NO: 565188 - DNA, 25 bp, Mus musculus
cagaggaattggatcagaaatatag

SEQ ID NO: 565189 - DNA, 25 bp, Mus musculus
cagaggaattggttcagaaatatag

SEQ ID NO: 565190 - DNA, 25 bp, Mus musculus
cagaggacaatgatacctgcggcgt

SEQ ID NO: 565191 - DNA, 25 bp, Mus musculus
cagaggacaatgttacctgcggcgt

SEQ ID NO: 565192 - DNA, 25 bp, Mus musculus
cagaggacacatatactgtggccag

SEQ ID NO: 565193 - DNA, 25 bp, Mus musculus
cagaggacacatttactgtggccag

SEQ ID NO: 565194 - DNA, 25 bp, Mus musculus
cagaggacagcccataagacaggtg

SEQ ID NO: 565195 - DNA, 25 bp, Mus musculus
cagaggacagccgataagacaggtg

SEQ ID NO: 565196 - DNA, 25 bp, Mus musculus
cagaggacatgaatgaggcagcccg

SEQ ID NO: 565197 - DNA, 25 bp, Mus musculus
cagaggacatgattgaggcagcccg

SEQ ID NO: 565198 - DNA, 25 bp, Mus musculus
cagaggacatttaagctcgactaca

SEQ ID NO: 565199 - DNA, 25 bp, Mus musculus
cagaggacattttagctcgactaca

SEQ ID NO: 565200 - DNA, 25 bp, Mus musculus
cagaggaccaagaggcagaatgccg

SEQ ID NO: 565201 - DNA, 25 bp, Mus musculus
cagaggaccaagtggcagaatgccg

SEQ ID NO: 565202 - DNA, 25 bp, Mus musculus
cagaggaccttcctcctggaggtga

SEQ ID NO: 565203 - DNA, 25 bp, Mus musculus
cagaggaccttcgtcctggaggtga

SEQ ID NO: 565204 - DNA, 25 bp, Mus musculus
cagaggacgagcacaaggagttcca

SEQ ID NO: 565205 - DNA, 25 bp, Mus musculus
cagaggacgagcaccacatttgccg

SEQ ID NO: 565206 - DNA, 25 bp, Mus musculus
cagaggacgagctcaaggagttcca

SEQ ID NO: 565207 - DNA, 25 bp, Mus musculus
cagaggacgagctccacatttgccg

SEQ ID NO: 565208 - DNA, 25 bp, Mus musculus
cagaggactacgaggacattgtgca

SEQ ID NO: 565209 - DNA, 25 bp, Mus musculus
cagaggactacgtggacattgtgca

SEQ ID NO: 565210 - DNA, 25 bp, Mus musculus
cagaggagaactatgatatggaggc

SEQ ID NO: 565211 - DNA, 25 bp, Mus musculus
cagaggagaactttgatatggaggc

SEQ ID NO: 565212 - DNA, 25 bp, Mus musculus
cagaggagacctcgagtccttttca

SEQ ID NO: 565213 - DNA, 25 bp, Mus musculus
cagaggagacctggagtccttttca

SEQ ID NO: 565214 - DNA, 25 bp, Mus musculus
cagaggagagccatatagacggccc

SEQ ID NO: 565215 - DNA, 25 bp, Mus musculus
cagaggagagccttatagacggccc

SEQ ID NO: 565216 - DNA, 25 bp, Mus musculus
cagaggagcccaaggcatcatagtt

SEQ ID NO: 565217 - DNA, 25 bp, Mus musculus
cagaggagcccactgtatatgctac

SEQ ID NO: 565218 - DNA, 25 bp, Mus musculus
cagaggagcccagtgtatatgctac

SEQ ID NO: 565219 - DNA, 25 bp, Mus musculus
cagaggagcccatggcatcatagtt

SEQ ID NO: 565220 - DNA, 25 bp, Mus musculus
cagaggagcccgaatggatttcaca

SEQ ID NO: 565221 - DNA, 25 bp, Mus musculus
cagaggagcccgtatggatttcaca

SEQ ID NO: 565222 - DNA, 25 bp, Mus musculus
cagaggagctaacccagcatgtccg

SEQ ID NO: 565223 - DNA, 25 bp, Mus musculus
cagaggagctaagccagcatgtccg

SEQ ID NO: 565224 - DNA, 25 bp, Mus musculus
cagaggagctacattccagagccgg

SEQ ID NO: 565225 - DNA, 25 bp, Mus musculus
cagaggagctactttccagagccgg

SEQ ID NO: 565226 - DNA, 25 bp, Mus musculus
cagaggagctggatgtccccttgga

SEQ ID NO: 565227 - DNA, 25 bp, Mus musculus
cagaggagctggttgtccccttgga

SEQ ID NO: 565228 - DNA, 25 bp, Mus musculus
cagaggagcttaaacagggatgtca

SEQ ID NO: 565229 - DNA, 25 bp, Mus musculus
cagaggagcttatacagggatgtca

SEQ ID NO: 565230 - DNA, 25 bp, Mus musculus
cagaggaggatgctgaaattattca

SEQ ID NO: 565231 - DNA, 25 bp, Mus musculus
cagaggaggatggtgaaattattca

SEQ ID NO: 565232 - DNA, 25 bp, Mus musculus
cagaggaggcgtaccaaaaacacat

SEQ ID NO: 565233 - DNA, 25 bp, Mus musculus
cagaggaggcgttccaaaaacacat

SEQ ID NO: 565234 - DNA, 25 bp, Mus musculus
cagaggaggtctatcgaagctacgt

SEQ ID NO: 565235 - DNA, 25 bp, Mus musculus
cagaggaggtctttcgaagctacgt

SEQ ID NO: 565236 - DNA, 25 bp, Mus musculus
cagaggaggttccagaactgtcgct

SEQ ID NO: 565237 - DNA, 25 bp, Mus musculus
cagaggaggttcgagaactgtcgct

SEQ ID NO: 565238 - DNA, 25 bp, Mus musculus
cagaggagtcaaacagtgcagagat

SEQ ID NO: 565239 - DNA, 25 bp, Mus musculus
cagaggagtcaatcagtgcagagat

SEQ ID NO: 565240 - DNA, 25 bp, Mus musculus
cagaggagtcgaaggcagtttttta

SEQ ID NO: 565241 - DNA, 25 bp, Mus musculus
cagaggagtcgatggcagtttttta

SEQ ID NO: 565242 - DNA, 25 bp, Mus musculus
cagaggagttcacttactcagagtg

SEQ ID NO: 565243 - DNA, 25 bp, Mus musculus
cagaggagttcagttactcagagtg

SEQ ID NO: 565244 - DNA, 25 bp, Mus musculus
cagaggatccagcaaatgatacagt

SEQ ID NO: 565245 - DNA, 25 bp, Mus musculus
cagaggatccaggaaatgatacagt

SEQ ID NO: 565246 - DNA, 25 bp, Mus musculus
cagaggatccgtctctgacgaagaa

SEQ ID NO: 565247 - DNA, 25 bp, Mus musculus
cagaggatccgtgtctgacgaagaa

SEQ ID NO: 565248 - DNA, 25 bp, Mus musculus
cagaggatcctacagcactgtctcc

SEQ ID NO: 565249 - DNA, 25 bp, Mus musculus
cagaggatcctagagcactgtctcc

SEQ ID NO: 565250 - DNA, 25 bp, Mus musculus
cagaggatctctcaccttgtatcac

SEQ ID NO: 565251 - DNA, 25 bp, Mus musculus
cagaggatctctgaccttgtatcac

SEQ ID NO: 565252 - DNA, 25 bp, Mus musculus
cagaggatgagaagatgccgcccta

SEQ ID NO: 565253 - DNA, 25 bp, Mus musculus
cagaggatgagatgatgccgcccta

SEQ ID NO: 565254 - DNA, 25 bp, Mus musculus
cagaggatgagcagtaccagctctc

SEQ ID NO: 565255 - DNA, 25 bp, Mus musculus
cagaggatgagctgtaccagctctc

SEQ ID NO: 565256 - DNA, 25 bp, Mus musculus
cagaggatgctgaccgtatttcaca

SEQ ID NO: 565257 - DNA, 25 bp, Mus musculus
cagaggatgctgtccgtatttcaca

SEQ ID NO: 565258 - DNA, 25 bp, Mus musculus
cagaggcacaacatcacactactgt

SEQ ID NO: 565259 - DNA, 25 bp, Mus musculus
cagaggcacaacttcacactactgt

SEQ ID NO: 565260 - DNA, 25 bp, Mus musculus
cagaggcactaaccttgggcacaca

SEQ ID NO: 565261 - DNA, 25 bp, Mus musculus
cagaggcactaagcttgggcacaca

SEQ ID NO: 565262 - DNA, 25 bp, Mus musculus
cagaggcactttccataaagtgaag

SEQ ID NO: 565263 - DNA, 25 bp, Mus musculus
cagaggcactttgcataaagtgaag

SEQ ID NO: 565264 - DNA, 25 bp, Mus musculus
cagaggcagaaacgaaccatacagt

SEQ ID NO: 565265 - DNA, 25 bp, Mus musculus
cagaggcagaaaggaaccatacagt

SEQ ID NO: 565266 - DNA, 25 bp, Mus musculus
cagaggcagaagatttatacagata

SEQ ID NO: 565267 - DNA, 25 bp, Mus musculus
cagaggcagaagttttatacagata

SEQ ID NO: 565268 - DNA, 25 bp, Mus musculus
cagaggcagaggcaaatcctcaacc

SEQ ID NO: 565269 - DNA, 25 bp, Mus musculus
cagaggcagagggaaatcctcaacc

SEQ ID NO: 565270 - DNA, 25 bp, Mus musculus
cagaggcagattcaagagatgcaga

SEQ ID NO: 565271 - DNA, 25 bp, Mus musculus
cagaggcagattgaagagatgcaga

SEQ ID NO: 565272 - DNA, 25 bp, Mus musculus
cagaggcagcgtacgacaaacttga

SEQ ID NO: 565273 - DNA, 25 bp, Mus musculus
cagaggcagcgttcgacaaacttga

SEQ ID NO: 565274 - DNA, 25 bp, Mus musculus
cagaggcaggacattgtaccttgtg

SEQ ID NO: 565275 - DNA, 25 bp, Mus musculus
cagaggcaggactttgtaccttgtg

SEQ ID NO: 565276 - DNA, 25 bp, Mus musculus
cagaggcagtgcagcgacctctcta

SEQ ID NO: 565277 - DNA, 25 bp, Mus musculus
cagaggcagtgctgcgacctctcta

SEQ ID NO: 565278 - DNA, 25 bp, Mus musculus
cagaggcagtggctttcgatcagaa

SEQ ID NO: 565279 - DNA, 25 bp, Mus musculus
cagaggcagtgggtttcgatcagaa

SEQ ID NO: 565280 - DNA, 25 bp, Mus musculus
cagaggcattgtacgaccgcgtgta

SEQ ID NO: 565281 - DNA, 25 bp, Mus musculus
cagaggcattgttcgaccgcgtgta

SEQ ID NO: 565282 - DNA, 25 bp, Mus musculus
cagaggccaagacagatgccgggat

SEQ ID NO: 565283 - DNA, 25 bp, Mus musculus
cagaggccaagagagatgccgggat

SEQ ID NO: 565284 - DNA, 25 bp, Mus musculus
cagaggccaccaagttgaatgaatg

SEQ ID NO: 565285 - DNA, 25 bp, Mus musculus
cagaggccaccatgttgaatgaatg

SEQ ID NO: 565286 - DNA, 25 bp, Mus musculus
cagaggccagcgaatcaggaaagtg

SEQ ID NO: 565287 - DNA, 25 bp, Mus musculus
cagaggccagcgtatcaggaaagtg

SEQ ID NO: 565288 - DNA, 25 bp, Mus musculus
cagaggccagttcctgcatcagctg

SEQ ID NO: 565289 - DNA, 25 bp, Mus musculus
cagaggccagttgctgcatcagctg

SEQ ID NO: 565290 - DNA, 25 bp, Mus musculus
cagaggccatcaaccagaagatcaa

SEQ ID NO: 565291 - DNA, 25 bp, Mus musculus
cagaggccatcatccagaagatcaa

SEQ ID NO: 565292 - DNA, 25 bp, Mus musculus
cagaggcccgtaactatgaggaaac

SEQ ID NO: 565293 - DNA, 25 bp, Mus musculus
cagaggcccgtatctatgaggaaac

SEQ ID NO: 565294 - DNA, 25 bp, Mus musculus
cagaggccctttatgaccgagtcta

SEQ ID NO: 565295 - DNA, 25 bp, Mus musculus
cagaggccctttttgaccgagtcta

SEQ ID NO: 565296 - DNA, 25 bp, Mus musculus
cagaggccggacctttgaccagatc

SEQ ID NO: 565297 - DNA, 25 bp, Mus musculus
cagaggccggacgtttgaccagatc

SEQ ID NO: 565298 - DNA, 25 bp, Mus musculus
cagaggccgtggatcgccaaactga

SEQ ID NO: 565299 - DNA, 25 bp, Mus musculus
cagaggccgtggttcgccaaactga

SEQ ID NO: 565300 - DNA, 25 bp, Mus musculus
cagaggcctgaacatagaaccagaa

SEQ ID NO: 565301 - DNA, 25 bp, Mus musculus
cagaggcctgaagatagaaccagaa

SEQ ID NO: 565302 - DNA, 25 bp, Mus musculus
cagaggcctggtccagaacgacttc

SEQ ID NO: 565303 - DNA, 25 bp, Mus musculus
cagaggcctggtgcagaacgacttc

SEQ ID NO: 565304 - DNA, 25 bp, Mus musculus
cagaggccttcactgactgattgtc

SEQ ID NO: 565305 - DNA, 25 bp, Mus musculus
cagaggccttcagtgactgattgtc

SEQ ID NO: 565306 - DNA, 25 bp, Mus musculus
cagaggcgaagcactatcacgccaa

SEQ ID NO: 565307 - DNA, 25 bp, Mus musculus
cagaggcgaagctctatcacgccaa

SEQ ID NO: 565308 - DNA, 25 bp, Mus musculus
cagaggcgatcgagtgctggttcgt

SEQ ID NO: 565309 - DNA, 25 bp, Mus musculus
cagaggcgatcgtgtgctggttcgt

SEQ ID NO: 565310 - DNA, 25 bp, Mus musculus
cagaggcgattcaaggagttcctga

SEQ ID NO: 565311 - DNA, 25 bp, Mus musculus
cagaggcgattctaggagttcctga

SEQ ID NO: 565312 - DNA, 25 bp, Mus musculus
cagaggcgcaagcactggaaatcag

SEQ ID NO: 565313 - DNA, 25 bp, Mus musculus
cagaggcgcaaggactggaaatcag

SEQ ID NO: 565314 - DNA, 25 bp, Mus musculus
cagaggcgccccagaggacactgag

SEQ ID NO: 565315 - DNA, 25 bp, Mus musculus
cagaggcgcccctgaggacactgag

SEQ ID NO: 565316 - DNA, 25 bp, Mus musculus
cagaggcgcctgacggatttcaagt

SEQ ID NO: 565317 - DNA, 25 bp, Mus musculus
cagaggcgcctgtcggatttcaagt

SEQ ID NO: 565318 - DNA, 25 bp, Mus musculus
cagaggcgtggcatctacagaagag

SEQ ID NO: 565319 - DNA, 25 bp, Mus musculus
cagaggcgtggcttctacagaagag

SEQ ID NO: 565320 - DNA, 25 bp, Mus musculus
cagaggctcaagacaagcatgggca

SEQ ID NO: 565321 - DNA, 25 bp, Mus musculus
cagaggctcaagtcaagcatgggca

SEQ ID NO: 565322 - DNA, 25 bp, Mus musculus
cagaggctcgtccatatagaacggc

SEQ ID NO: 565323 - DNA, 25 bp, Mus musculus
cagaggctcgtcgatatagaacggc

SEQ ID NO: 565324 - DNA, 25 bp, Mus musculus
cagaggctctcccttcgactgaggg

SEQ ID NO: 565325 - DNA, 25 bp, Mus musculus
cagaggctctccgttcgactgaggg

SEQ ID NO: 565326 - DNA, 25 bp, Mus musculus
cagaggctctgaacgggacactgga

SEQ ID NO: 565327 - DNA, 25 bp, Mus musculus
cagaggctctgatcgggacactgga

SEQ ID NO: 565328 - DNA, 25 bp, Mus musculus
cagaggctctgcctggccaggtatc

SEQ ID NO: 565329 - DNA, 25 bp, Mus musculus
cagaggctctgcgtggccaggtatc

SEQ ID NO: 565330 - DNA, 25 bp, Mus musculus
cagaggctctggagatcctcccaga

SEQ ID NO: 565331 - DNA, 25 bp, Mus musculus
cagaggctctggtgatcctcccaga

SEQ ID NO: 565332 - DNA, 25 bp, Mus musculus
cagaggctcttcatgatcctttggc

SEQ ID NO: 565333 - DNA, 25 bp, Mus musculus
cagaggctcttcttgatcctttggc

SEQ ID NO: 565334 - DNA, 25 bp, Mus musculus
cagaggctgcttctgcacgtggacc

SEQ ID NO: 565335 - DNA, 25 bp, Mus musculus
cagaggctgcttgtgcacgtggacc

SEQ ID NO: 565336 - DNA, 25 bp, Mus musculus
cagaggctggagcaagtcgttccta

SEQ ID NO: 565337 - DNA, 25 bp, Mus musculus
cagaggctggaggaagtcgttccta

SEQ ID NO: 565338 - DNA, 25 bp, Mus musculus
cagaggctgggcatcgatacacgag

SEQ ID NO: 565339 - DNA, 25 bp, Mus musculus
cagaggctgggcttcgatacacgag

SEQ ID NO: 565340 - DNA, 25 bp, Mus musculus
cagaggctggttcgcgaagccaaca

SEQ ID NO: 565341 - DNA, 25 bp, Mus musculus
cagaggctggttggcgaagccaaca

SEQ ID NO: 565342 - DNA, 25 bp, Mus musculus
cagaggcttcacaaggaatatccag

SEQ ID NO: 565343 - DNA, 25 bp, Mus musculus
cagaggcttcactaggaatatccag

SEQ ID NO: 565344 - DNA, 25 bp, Mus musculus
cagaggcttccaatgccttgcttct

SEQ ID NO: 565345 - DNA, 25 bp, Mus musculus
cagaggcttccattgccttgcttct

SEQ ID NO: 565346 - DNA, 25 bp, Mus musculus
cagaggcttccgagtatgaaacctg

SEQ ID NO: 565347 - DNA, 25 bp, Mus musculus
cagaggcttccgtgtatgaaacctg

SEQ ID NO: 565348 - DNA, 25 bp, Mus musculus
cagaggcttcgtctcagcagttcca

SEQ ID NO: 565349 - DNA, 25 bp, Mus musculus
cagaggcttcgtgtcagcagttcca

SEQ ID NO: 565350 - DNA, 25 bp, Mus musculus
cagaggcttctccaacactaagaga

SEQ ID NO: 565351 - DNA, 25 bp, Mus musculus
cagaggcttctcgaacactaagaga

SEQ ID NO: 565352 - DNA, 25 bp, Mus musculus
cagaggcttttgaaagaactgtcaa

SEQ ID NO: 565353 - DNA, 25 bp, Mus musculus
cagaggcttttgtaagaactgtcaa

SEQ ID NO: 565354 - DNA, 25 bp, Mus musculus
cagagggaacgtcccttctcagagg

SEQ ID NO: 565355 - DNA, 25 bp, Mus musculus
cagagggaacgtgccttctcagagg

SEQ ID NO: 565356 - DNA, 25 bp, Mus musculus
cagagggaagagcatgcccgtatct

SEQ ID NO: 565357 - DNA, 25 bp, Mus musculus
cagagggaagaggatgcccgtatct

SEQ ID NO: 565358 - DNA, 25 bp, Mus musculus
cagagggaagcaatctacatgcatg

SEQ ID NO: 565359 - DNA, 25 bp, Mus musculus
cagagggaagcattctacatgcatg

SEQ ID NO: 565360 - DNA, 25 bp, Mus musculus
cagagggaaggcaaatcctcccggc

SEQ ID NO: 565361 - DNA, 25 bp, Mus musculus
cagagggaaggctaatcctcccggc

SEQ ID NO: 565362 - DNA, 25 bp, Mus musculus
cagagggaatgaaccgagctaagta

SEQ ID NO: 565363 - DNA, 25 bp, Mus musculus
cagagggaatgacgagcagccacat

SEQ ID NO: 565364 - DNA, 25 bp, Mus musculus
cagagggaatgaggagcagccacat

SEQ ID NO: 565365 - DNA, 25 bp, Mus musculus
cagagggaatgatccgagctaagta

SEQ ID NO: 565366 - DNA, 25 bp, Mus musculus
cagagggactctatgactcagaaac

SEQ ID NO: 565367 - DNA, 25 bp, Mus musculus
cagagggactctttgactcagaaac

SEQ ID NO: 565368 - DNA, 25 bp, Mus musculus
cagagggatagaagttacctaagca

SEQ ID NO: 565369 - DNA, 25 bp, Mus musculus
cagagggatagatgttacctaagca

SEQ ID NO: 565370 - DNA, 25 bp, Mus musculus
cagagggatcccattacttaagtcc

SEQ ID NO: 565371 - DNA, 25 bp, Mus musculus
cagagggatccctttacttaagtcc

SEQ ID NO: 565372 - DNA, 25 bp, Mus musculus
cagagggcaaccctggcagcagatc

SEQ ID NO: 565373 - DNA, 25 bp, Mus musculus
cagagggcaaccgtggcagcagatc

SEQ ID NO: 565374 - DNA, 25 bp, Mus musculus
cagagggcactaaaacttcccagca

SEQ ID NO: 565375 - DNA, 25 bp, Mus musculus
cagagggcactataacttcccagca

SEQ ID NO: 565376 - DNA, 25 bp, Mus musculus
cagagggccaaccacctgatgggcc

SEQ ID NO: 565377 - DNA, 25 bp, Mus musculus
cagagggccaacgacctgatgggcc

SEQ ID NO: 565378 - DNA, 25 bp, Mus musculus
cagagggccagcatgaggtacagac

SEQ ID NO: 565379 - DNA, 25 bp, Mus musculus
cagagggccagcttgaggtacagac

SEQ ID NO: 565380 - DNA, 25 bp, Mus musculus
cagagggccggacctttgtcccttg

SEQ ID NO: 565381 - DNA, 25 bp, Mus musculus
cagagggccggagctttgtcccttg

SEQ ID NO: 565382 - DNA, 25 bp, Mus musculus
cagagggcctcacatcaacagaggg

SEQ ID NO: 565383 - DNA, 25 bp, Mus musculus
cagagggcctcagatcaacagaggg

SEQ ID NO: 565384 - DNA, 25 bp, Mus musculus
cagagggcctgaactacctgtttac

SEQ ID NO: 565385 - DNA, 25 bp, Mus musculus
cagagggcctgatctacctgtttac

SEQ ID NO: 565386 - DNA, 25 bp, Mus musculus
cagagggctattaagcgacggtcag

SEQ ID NO: 565387 - DNA, 25 bp, Mus musculus
cagagggctatttagcgacggtcag

SEQ ID NO: 565388 - DNA, 25 bp, Mus musculus
cagagggctcccagggcttggcatt

SEQ ID NO: 565389 - DNA, 25 bp, Mus musculus
cagagggctccctgggcttggcatt

SEQ ID NO: 565390 - DNA, 25 bp, Mus musculus
cagagggctcgaaggattcgtcccc

SEQ ID NO: 565391 - DNA, 25 bp, Mus musculus
cagagggctcgatggattcgtcccc

SEQ ID NO: 565392 - DNA, 25 bp, Mus musculus
cagagggctgggatatcgtaccaga

SEQ ID NO: 565393 - DNA, 25 bp, Mus musculus
cagagggctgggttatcgtaccaga

SEQ ID NO: 565394 - DNA, 25 bp, Mus musculus
cagagggctgttcatcaaacccacg

SEQ ID NO: 565395 - DNA, 25 bp, Mus musculus
cagagggctgttgatcaaacccacg

SEQ ID NO: 565396 - DNA, 25 bp, Mus musculus
cagagggcttcgctgatgccgcact

SEQ ID NO: 565397 - DNA, 25 bp, Mus musculus
cagagggcttcggtgatgccgcact

SEQ ID NO: 565398 - DNA, 25 bp, Mus musculus
cagaggggtctgcaccaacaggaaa

SEQ ID NO: 565399 - DNA, 25 bp, Mus musculus
cagaggggtctggaccaacaggaaa

SEQ ID NO: 565400 - DNA, 25 bp, Mus musculus
cagagggtagccactgtttgtcaca

SEQ ID NO: 565401 - DNA, 25 bp, Mus musculus
cagagggtagcctctgtttgtcaca

SEQ ID NO: 565402 - DNA, 25 bp, Mus musculus
cagagggtatgacaaatagagaact

SEQ ID NO: 565403 - DNA, 25 bp, Mus musculus
cagagggtatgagaaatagagaact

SEQ ID NO: 565404 - DNA, 25 bp, Mus musculus
cagagggtcaggaaactcccaatct

SEQ ID NO: 565405 - DNA, 25 bp, Mus musculus
cagagggtcaggtaactcccaatct

SEQ ID NO: 565406 - DNA, 25 bp, Mus musculus
cagagggtccagctgttcacacaag

SEQ ID NO: 565407 - DNA, 25 bp, Mus musculus
cagagggtccaggtgttcacacaag

SEQ ID NO: 565408 - DNA, 25 bp, Mus musculus
cagaggtaagtcattgctggagtta

SEQ ID NO: 565409 - DNA, 25 bp, Mus musculus
cagaggtaagtctttgctggagtta

SEQ ID NO: 565410 - DNA, 25 bp, Mus musculus
cagaggtaccagattggcgccgact

SEQ ID NO: 565411 - DNA, 25 bp, Mus musculus
cagaggtaccagtttggcgccgact

SEQ ID NO: 565412 - DNA, 25 bp, Mus musculus
cagaggtaggaaatggaacgctgtc

SEQ ID NO: 565413 - DNA, 25 bp, Mus musculus
cagaggtaggaattggaacgctgtc

SEQ ID NO: 565414 - DNA, 25 bp, Mus musculus
cagaggtagtgtctggcctgaaaca

SEQ ID NO: 565415 - DNA, 25 bp, Mus musculus
cagaggtagtgtgtggcctgaaaca

SEQ ID NO: 565416 - DNA, 25 bp, Mus musculus
cagaggtataagaggataaggcttg

SEQ ID NO: 565417 - DNA, 25 bp, Mus musculus
cagaggtataagtggataaggcttg

SEQ ID NO: 565418 - DNA, 25 bp, Mus musculus
cagaggtcaataacacactatgcag

SEQ ID NO: 565419 - DNA, 25 bp, Mus musculus
cagaggtcaatatcacactatgcag

SEQ ID NO: 565420 - DNA, 25 bp, Mus musculus
cagaggtcacagatgctgaaacaga

SEQ ID NO: 565421 - DNA, 25 bp, Mus musculus
cagaggtcacagttgctgaaacaga

SEQ ID NO: 565422 - DNA, 25 bp, Mus musculus
cagaggtcattacacatggaaagta

SEQ ID NO: 565423 - DNA, 25 bp, Mus musculus
cagaggtcattagacatggaaagta

SEQ ID NO: 565424 - DNA, 25 bp, Mus musculus
cagaggtcattcacggcatgggcta

SEQ ID NO: 565425 - DNA, 25 bp, Mus musculus
cagaggtcattctcggcatgggcta

SEQ ID NO: 565426 - DNA, 25 bp, Mus musculus
cagaggtctagtcgactttatgaac

SEQ ID NO: 565427 - DNA, 25 bp, Mus musculus
cagaggtctagtggactttatgaac

SEQ ID NO: 565428 - DNA, 25 bp, Mus musculus
cagaggtctccaatactacattgga

SEQ ID NO: 565429 - DNA, 25 bp, Mus musculus
cagaggtctccattactacattgga

SEQ ID NO: 565430 - DNA, 25 bp, Mus musculus
cagaggtctgggatgtcacagtcca

SEQ ID NO: 565431 - DNA, 25 bp, Mus musculus
cagaggtctgggttgtcacagtcca

SEQ ID NO: 565432 - DNA, 25 bp, Mus musculus
cagaggtcttccagcatatctggga

SEQ ID NO: 565433 - DNA, 25 bp, Mus musculus
cagaggtcttcctgcatatctggga

SEQ ID NO: 565434 - DNA, 25 bp, Mus musculus
cagaggtgacggagaatgtcacaga

SEQ ID NO: 565435 - DNA, 25 bp, Mus musculus
cagaggtgacggtgaatgtcacaga

SEQ ID NO: 565436 - DNA, 25 bp, Mus musculus
cagaggtgacttaccaatctaagaa

SEQ ID NO: 565437 - DNA, 25 bp, Mus musculus
cagaggtgactttccaatctaagaa

SEQ ID NO: 565438 - DNA, 25 bp, Mus musculus
cagaggtgagcacagatcacctgaa

SEQ ID NO: 565439 - DNA, 25 bp, Mus musculus
cagaggtgagcagagatcacctgaa

SEQ ID NO: 565440 - DNA, 25 bp, Mus musculus
cagaggtgccctaccctcgggacat

SEQ ID NO: 565441 - DNA, 25 bp, Mus musculus
cagaggtgcccttccctcgggacat

SEQ ID NO: 565442 - DNA, 25 bp, Mus musculus
cagaggtgctaaagccagctttgat

SEQ ID NO: 565443 - DNA, 25 bp, Mus musculus
cagaggtgctaatgccagctttgat

SEQ ID NO: 565444 - DNA, 25 bp, Mus musculus
cagaggtgctgtatggagttagcta

SEQ ID NO: 565445 - DNA, 25 bp, Mus musculus
cagaggtgctgtttggagttagcta

SEQ ID NO: 565446 - DNA, 25 bp, Mus musculus
cagaggtggagtcccgctatgccac

SEQ ID NO: 565447 - DNA, 25 bp, Mus musculus
cagaggtggagtgccgctatgccac

SEQ ID NO: 565448 - DNA, 25 bp, Mus musculus
cagaggtggcacaggcctatgccaa

SEQ ID NO: 565449 - DNA, 25 bp, Mus musculus
cagaggtggcactggcctatgccaa

SEQ ID NO: 565450 - DNA, 25 bp, Mus musculus
cagaggtggctaatgagcaccggaa

SEQ ID NO: 565451 - DNA, 25 bp, Mus musculus
cagaggtggctattgagcaccggaa

SEQ ID NO: 565452 - DNA, 25 bp, Mus musculus
cagaggtgggctaaaggctgtccaa

SEQ ID NO: 565453 - DNA, 25 bp, Mus musculus
cagaggtgggcttaaggctgtccaa

SEQ ID NO: 565454 - DNA, 25 bp, Mus musculus
cagaggtggtctactagctctccct

SEQ ID NO: 565455 - DNA, 25 bp, Mus musculus
cagaggtggtcttctagctctccct

SEQ ID NO: 565456 - DNA, 25 bp, Mus musculus
cagaggttaattaattctgggaagc

SEQ ID NO: 565457 - DNA, 25 bp, Mus musculus
cagaggttaatttattctgggaagc

SEQ ID NO: 565458 - DNA, 25 bp, Mus musculus
cagaggttatgtcatgtgctctcac

SEQ ID NO: 565459 - DNA, 25 bp, Mus musculus
cagaggttatgtgatgtgctctcac

SEQ ID NO: 565460 - DNA, 25 bp, Mus musculus
cagaggttcacaaaacgagtgtagt

SEQ ID NO: 565461 - DNA, 25 bp, Mus musculus
cagaggttcacataacgagtgtagt

SEQ ID NO: 565462 - DNA, 25 bp, Mus musculus
cagaggttccgcaagggactgtcct

SEQ ID NO: 565463 - DNA, 25 bp, Mus musculus
cagaggttccgctagggactgtcct

SEQ ID NO: 565464 - DNA, 25 bp, Mus musculus
cagaggttcgagcataagtgctatg

SEQ ID NO: 565465 - DNA, 25 bp, Mus musculus
cagaggttcgaggataagtgctatg

SEQ ID NO: 565466 - DNA, 25 bp, Mus musculus
cagaggttggaacagttctccttga

SEQ ID NO: 565467 - DNA, 25 bp, Mus musculus
cagaggttggaagagttctccttga

SEQ ID NO: 565468 - DNA, 25 bp, Mus musculus
cagaggttggtgaattctggcagac

SEQ ID NO: 565469 - DNA, 25 bp, Mus musculus
cagaggttggtgtattctggcagac

SEQ ID NO: 565470 - DNA, 25 bp, Mus musculus
cagaggttggttcctgctgtgacat

SEQ ID NO: 565471 - DNA, 25 bp, Mus musculus
cagaggttggttgctgctgtgacat

SEQ ID NO: 565472 - DNA, 25 bp, Mus musculus
cagaggttgtgactcccgcggtccc

SEQ ID NO: 565473 - DNA, 25 bp, Mus musculus
cagaggttgtgagtcccgcggtccc

SEQ ID NO: 565474 - DNA, 25 bp, Mus musculus
cagaggttttctcatgcttgctact

SEQ ID NO: 565475 - DNA, 25 bp, Mus musculus
cagaggttttctgatgcttgctact

SEQ ID NO: 565476 - DNA, 25 bp, Mus musculus
cagaggtttttaaagcggcgactgg

SEQ ID NO: 565477 - DNA, 25 bp, Mus musculus
cagaggtttttatagcggcgactgg

SEQ ID NO: 565478 - DNA, 25 bp, Mus musculus
cagagtaaattgcaggccgagattc

SEQ ID NO: 565479 - DNA, 25 bp, Mus musculus
cagagtaaattggaggccgagattc

SEQ ID NO: 565480 - DNA, 25 bp, Mus musculus
cagagtaagaacctgggctgagcct

SEQ ID NO: 565481 - DNA, 25 bp, Mus musculus
cagagtaagaacgtgggctgagcct

SEQ ID NO: 565482 - DNA, 25 bp, Mus musculus
cagagtaaggaaatagtggcaggcc

SEQ ID NO: 565483 - DNA, 25 bp, Mus musculus
cagagtaaggaattagtggcaggcc

SEQ ID NO: 565484 - DNA, 25 bp, Mus musculus
cagagtaaggcccagacggaaatgc

SEQ ID NO: 565485 - DNA, 25 bp, Mus musculus
cagagtaaggccgagacggaaatgc

SEQ ID NO: 565486 - DNA, 25 bp, Mus musculus
cagagtaatgcgcagcagcacgcag

SEQ ID NO: 565487 - DNA, 25 bp, Mus musculus
cagagtaatgcggagcagcacgcag

SEQ ID NO: 565488 - DNA, 25 bp, Mus musculus
cagagtacaaaacagcacttgggaa

SEQ ID NO: 565489 - DNA, 25 bp, Mus musculus
cagagtacaaaagagcacttgggaa

SEQ ID NO: 565490 - DNA, 25 bp, Mus musculus
cagagtacccagcacagtcctagtg

SEQ ID NO: 565491 - DNA, 25 bp, Mus musculus
cagagtacccaggacagtcctagtg

SEQ ID NO: 565492 - DNA, 25 bp, Mus musculus
cagagtaccgtgctagcggcgctct

SEQ ID NO: 565493 - DNA, 25 bp, Mus musculus
cagagtaccgtggtagcggcgctct

SEQ ID NO: 565494 - DNA, 25 bp, Mus musculus
cagagtactcagaaagtcgaagcca

SEQ ID NO: 565495 - DNA, 25 bp, Mus musculus
cagagtactcagtaagtcgaagcca

SEQ ID NO: 565496 - DNA, 25 bp, Mus musculus
cagagtagaagaatggctaaatctt

SEQ ID NO: 565497 - DNA, 25 bp, Mus musculus
cagagtagaagattggctaaatctt

SEQ ID NO: 565498 - DNA, 25 bp, Mus musculus
cagagtagctcaaagcagcaatgcc

SEQ ID NO: 565499 - DNA, 25 bp, Mus musculus
cagagtagctcatagcagcaatgcc

SEQ ID NO: 565500 - DNA, 25 bp, Mus musculus
cagagtaggtgacccgacgacgcat

SEQ ID NO: 565501 - DNA, 25 bp, Mus musculus
cagagtaggtgagccgacgacgcat

SEQ ID NO: 565502 - DNA, 25 bp, Mus musculus
cagagtagtattctgacaaagccac

SEQ ID NO: 565503 - DNA, 25 bp, Mus musculus
cagagtagtattgtgacaaagccac

SEQ ID NO: 565504 - DNA, 25 bp, Mus musculus
cagagtatacagagtcccttatgga

SEQ ID NO: 565505 - DNA, 25 bp, Mus musculus
cagagtatacagtgtcccttatgga

SEQ ID NO: 565506 - DNA, 25 bp, Mus musculus
cagagtatatgcagtgtctacaaaa

SEQ ID NO: 565507 - DNA, 25 bp, Mus musculus
cagagtatatgctgtgtctacaaaa

SEQ ID NO: 565508 - DNA, 25 bp, Mus musculus
cagagtatcagcaagatctggacag

SEQ ID NO: 565509 - DNA, 25 bp, Mus musculus
cagagtatcagctagatctggacag

SEQ ID NO: 565510 - DNA, 25 bp, Mus musculus
cagagtatccaaaggaatatccggg

SEQ ID NO: 565511 - DNA, 25 bp, Mus musculus
cagagtatccaatggaatatccggg

SEQ ID NO: 565512 - DNA, 25 bp, Mus musculus
cagagtatgatgacctctactgcaa

SEQ ID NO: 565513 - DNA, 25 bp, Mus musculus
cagagtatgatgtcctctactgcaa

SEQ ID NO: 565514 - DNA, 25 bp, Mus musculus
cagagtatgcctacgccttcatcca

SEQ ID NO: 565515 - DNA, 25 bp, Mus musculus
cagagtatgccttcgccttcatcca

SEQ ID NO: 565516 - DNA, 25 bp, Mus musculus
cagagtatggaacacttgcaatgga

SEQ ID NO: 565517 - DNA, 25 bp, Mus musculus
cagagtatggaagacttgcaatgga

SEQ ID NO: 565518 - DNA, 25 bp, Mus musculus
cagagtattcccatcgttcctgtac

SEQ ID NO: 565519 - DNA, 25 bp, Mus musculus
cagagtattcccttcgttcctgtac

SEQ ID NO: 565520 - DNA, 25 bp, Mus musculus
cagagtcaactcaccatatgaaatc

SEQ ID NO: 565521 - DNA, 25 bp, Mus musculus
cagagtcaactctccatatgaaatc

SEQ ID NO: 565522 - DNA, 25 bp, Mus musculus
cagagtcacattctccactgttctc

SEQ ID NO: 565523 - DNA, 25 bp, Mus musculus
cagagtcacattgtccactgttctc

SEQ ID NO: 565524 - DNA, 25 bp, Mus musculus
cagagtcacccacgcatccgtgaaa

SEQ ID NO: 565525 - DNA, 25 bp, Mus musculus
cagagtcacccaggcatccgtgaaa

SEQ ID NO: 565526 - DNA, 25 bp, Mus musculus
cagagtcacgtgagagccaaagatg

SEQ ID NO: 565527 - DNA, 25 bp, Mus musculus
cagagtcacgtgtgagccaaagatg

SEQ ID NO: 565528 - DNA, 25 bp, Mus musculus
cagagtcacttcagtgagtcctgaa

SEQ ID NO: 565529 - DNA, 25 bp, Mus musculus
cagagtcacttctgtgagtcctgaa

SEQ ID NO: 565530 - DNA, 25 bp, Mus musculus
cagagtcagcctctattatgagtcc

SEQ ID NO: 565531 - DNA, 25 bp, Mus musculus
cagagtcagcctgtattatgagtcc

SEQ ID NO: 565532 - DNA, 25 bp, Mus musculus
cagagtcaggtgacatctagcctag

SEQ ID NO: 565533 - DNA, 25 bp, Mus musculus
cagagtcaggtgtcatctagcctag

SEQ ID NO: 565534 - DNA, 25 bp, Mus musculus
cagagtcatccgagtgtggtttcaa

SEQ ID NO: 565535 - DNA, 25 bp, Mus musculus
cagagtcatccgtgtgtggtttcaa

SEQ ID NO: 565536 - DNA, 25 bp, Mus musculus
cagagtccagagagcctgagactga

SEQ ID NO: 565537 - DNA, 25 bp, Mus musculus
cagagtccagagtgcctgagactga

SEQ ID NO: 565538 - DNA, 25 bp, Mus musculus
cagagtccagcgattgtccaagaat

SEQ ID NO: 565539 - DNA, 25 bp, Mus musculus
cagagtccagcgtttgtccaagaat

SEQ ID NO: 565540 - DNA, 25 bp, Mus musculus
cagagtccaggactgctgaaggctc

SEQ ID NO: 565541 - DNA, 25 bp, Mus musculus
cagagtccaggagtgctgaaggctc

SEQ ID NO: 565542 - DNA, 25 bp, Mus musculus
cagagtccagtccaagattggctcc

SEQ ID NO: 565543 - DNA, 25 bp, Mus musculus
cagagtccagtcgaagattggctcc

SEQ ID NO: 565544 - DNA, 25 bp, Mus musculus
cagagtcccagtcctagaaaggtag

SEQ ID NO: 565545 - DNA, 25 bp, Mus musculus
cagagtcccagtgctagaaaggtag

SEQ ID NO: 565546 - DNA, 25 bp, Mus musculus
cagagtccctgcatttctcccagtg

SEQ ID NO: 565547 - DNA, 25 bp, Mus musculus
cagagtccctgcttttctcccagtg

SEQ ID NO: 565548 - DNA, 25 bp, Mus musculus
cagagtccgagcaggctcgccagcg

SEQ ID NO: 565549 - DNA, 25 bp, Mus musculus
cagagtccgagctggctcgccagcg

SEQ ID NO: 565550 - DNA, 25 bp, Mus musculus
cagagtccggctcattccagcaaga

SEQ ID NO: 565551 - DNA, 25 bp, Mus musculus
cagagtccggctgattccagcaaga

SEQ ID NO: 565552 - DNA, 25 bp, Mus musculus
cagagtcctccgagcactggcctgg

SEQ ID NO: 565553 - DNA, 25 bp, Mus musculus
cagagtcctccgtgcactggcctgg

SEQ ID NO: 565554 - DNA, 25 bp, Mus musculus
cagagtcctctaatgtctccccgga

SEQ ID NO: 565555 - DNA, 25 bp, Mus musculus
cagagtcctctattgtctccccgga

SEQ ID NO: 565556 - DNA, 25 bp, Mus musculus
cagagtcctctgagggtgtctggaa

SEQ ID NO: 565557 - DNA, 25 bp, Mus musculus
cagagtcctctgtgggtgtctggaa

SEQ ID NO: 565558 - DNA, 25 bp, Mus musculus
cagagtcctcttcttggagctacaa

SEQ ID NO: 565559 - DNA, 25 bp, Mus musculus
cagagtcctcttgttggagctacaa

SEQ ID NO: 565560 - DNA, 25 bp, Mus musculus
cagagtccttccctgggtcaaagta

SEQ ID NO: 565561 - DNA, 25 bp, Mus musculus
cagagtccttccgtgggtcaaagta

SEQ ID NO: 565562 - DNA, 25 bp, Mus musculus
cagagtccttggagtctagccgagc

SEQ ID NO: 565563 - DNA, 25 bp, Mus musculus
cagagtccttggtgtctagccgagc

SEQ ID NO: 565564 - DNA, 25 bp, Mus musculus
cagagtcgctagatgcagaaggctt

SEQ ID NO: 565565 - DNA, 25 bp, Mus musculus
cagagtcgctagttgcagaaggctt

SEQ ID NO: 565566 - DNA, 25 bp, Mus musculus
cagagtctacctcggcaaaatcagt

SEQ ID NO: 565567 - DNA, 25 bp, Mus musculus
cagagtctacctgggcaaaatcagt

SEQ ID NO: 565568 - DNA, 25 bp, Mus musculus
cagagtctcaggaagaagatggttc

SEQ ID NO: 565569 - DNA, 25 bp, Mus musculus
cagagtctcaggtagaagatggttc

SEQ ID NO: 565570 - DNA, 25 bp, Mus musculus
cagagtctccctctgtctgaaacct

SEQ ID NO: 565571 - DNA, 25 bp, Mus musculus
cagagtctccctgtgtctgaaacct

SEQ ID NO: 565572 - DNA, 25 bp, Mus musculus
cagagtctgaaaaattggaggccca

SEQ ID NO: 565573 - DNA, 25 bp, Mus musculus
cagagtctgaaatattggaggccca

SEQ ID NO: 565574 - DNA, 25 bp, Mus musculus
cagagtctgaagcaagagcattggc

SEQ ID NO: 565575 - DNA, 25 bp, Mus musculus
cagagtctgaaggaagagcattggc

SEQ ID NO: 565576 - DNA, 25 bp, Mus musculus
cagagtctgacgatctttaacgggc

SEQ ID NO: 565577 - DNA, 25 bp, Mus musculus
cagagtctgacgttctttaacgggc

SEQ ID NO: 565578 - DNA, 25 bp, Mus musculus
cagagtctgcacaggcctaggctta

SEQ ID NO: 565579 - DNA, 25 bp, Mus musculus
cagagtctgcactggcctaggctta

SEQ ID NO: 565580 - DNA, 25 bp, Mus musculus
cagagtctggcaccagtgtcacgtc

SEQ ID NO: 565581 - DNA, 25 bp, Mus musculus
cagagtctggcagcagtgtcacgtc

SEQ ID NO: 565582 - DNA, 25 bp, Mus musculus
cagagtctggctataccttccatag

SEQ ID NO: 565583 - DNA, 25 bp, Mus musculus
cagagtctggctttaccttccatag

SEQ ID NO: 565584 - DNA, 25 bp, Mus musculus
cagagtctgtcgcaatataccaggg

SEQ ID NO: 565585 - DNA, 25 bp, Mus musculus
cagagtctgtcggaatataccaggg

SEQ ID NO: 565586 - DNA, 25 bp, Mus musculus
cagagtctgtttcacgacctttaac

SEQ ID NO: 565587 - DNA, 25 bp, Mus musculus
cagagtctgtttgacgacctttaac

SEQ ID NO: 565588 - DNA, 25 bp, Mus musculus
cagagtcttcaacccagagctcttc

SEQ ID NO: 565589 - DNA, 25 bp, Mus musculus
cagagtcttcaagccagagctcttc

SEQ ID NO: 565590 - DNA, 25 bp, Mus musculus
cagagtcttgttcttaatgtgcagt

SEQ ID NO: 565591 - DNA, 25 bp, Mus musculus
cagagtcttgttgttaatgtgcagt

SEQ ID NO: 565592 - DNA, 25 bp, Mus musculus
cagagtgaacttcatcgggacagga

SEQ ID NO: 565593 - DNA, 25 bp, Mus musculus
cagagtgaacttgatcgggacagga

SEQ ID NO: 565594 - DNA, 25 bp, Mus musculus
cagagtgaagatcaatatagagccc

SEQ ID NO: 565595 - DNA, 25 bp, Mus musculus
cagagtgaagatgaatatagagccc

SEQ ID NO: 565596 - DNA, 25 bp, Mus musculus
cagagtgactggaatcttggaaatc

SEQ ID NO: 565597 - DNA, 25 bp, Mus musculus
cagagtgactggtatcttggaaatc

SEQ ID NO: 565598 - DNA, 25 bp, Mus musculus
cagagtgagagcaattcattctggg

SEQ ID NO: 565599 - DNA, 25 bp, Mus musculus
cagagtgagagctattcattctggg

SEQ ID NO: 565600 - DNA, 25 bp, Mus musculus
cagagtgagcatacggtggatttac

SEQ ID NO: 565601 - DNA, 25 bp, Mus musculus
cagagtgagcattcggtggatttac

SEQ ID NO: 565602 - DNA, 25 bp, Mus musculus
cagagtgaggcaaggacaggccact

SEQ ID NO: 565603 - DNA, 25 bp, Mus musculus
cagagtgaggcatggacaggccact

SEQ ID NO: 565604 - DNA, 25 bp, Mus musculus
cagagtgagggcagcacaaactact

SEQ ID NO: 565605 - DNA, 25 bp, Mus musculus
cagagtgagggctgcacaaactact

SEQ ID NO: 565606 - DNA, 25 bp, Mus musculus
cagagtgagtgcattccaagaggat

SEQ ID NO: 565607 - DNA, 25 bp, Mus musculus
cagagtgagtgctttccaagaggat

SEQ ID NO: 565608 - DNA, 25 bp, Mus musculus
cagagtgagtgtcccaatgtcgctc

SEQ ID NO: 565609 - DNA, 25 bp, Mus musculus
cagagtgagtgtgccaatgtcgctc

SEQ ID NO: 565610 - DNA, 25 bp, Mus musculus
cagagtgatatacctgggccttcag

SEQ ID NO: 565611 - DNA, 25 bp, Mus musculus
cagagtgatatagctgggccttcag

SEQ ID NO: 565612 - DNA, 25 bp, Mus musculus
cagagtgatcaacatgaaagaatcc

SEQ ID NO: 565613 - DNA, 25 bp, Mus musculus
cagagtgatcaagatgaaagaatcc

SEQ ID NO: 565614 - DNA, 25 bp, Mus musculus
cagagtgatccaaagcaaatatgaa

SEQ ID NO: 565615 - DNA, 25 bp, Mus musculus
cagagtgatccatagcaaatatgaa

SEQ ID NO: 565616 - DNA, 25 bp, Mus musculus
cagagtgatttgctatgctgtttgc

SEQ ID NO: 565617 - DNA, 25 bp, Mus musculus
cagagtgatttggtatgctgtttgc

SEQ ID NO: 565618 - DNA, 25 bp, Mus musculus
cagagtgcatgaagttcgggagcac

SEQ ID NO: 565619 - DNA, 25 bp, Mus musculus
cagagtgcatgatgttcgggagcac

SEQ ID NO: 565620 - DNA, 25 bp, Mus musculus
cagagtgcatgcagcaacaggcgga

SEQ ID NO: 565621 - DNA, 25 bp, Mus musculus
cagagtgcatgctgcaacaggcgga

SEQ ID NO: 565622 - DNA, 25 bp, Mus musculus
cagagtgccgtgagatatcagagtt

SEQ ID NO: 565623 - DNA, 25 bp, Mus musculus
cagagtgccgtgtgatatcagagtt

SEQ ID NO: 565624 - DNA, 25 bp, Mus musculus
cagagtgcctaaactacaacttgaa

SEQ ID NO: 565625 - DNA, 25 bp, Mus musculus
cagagtgcctaatctacaacttgaa

SEQ ID NO: 565626 - DNA, 25 bp, Mus musculus
cagagtgcctagacccgagaggaaa

SEQ ID NO: 565627 - DNA, 25 bp, Mus musculus
cagagtgcctagtcccgagaggaaa

SEQ ID NO: 565628 - DNA, 25 bp, Mus musculus
cagagtgcttgaagccatgctccca

SEQ ID NO: 565629 - DNA, 25 bp, Mus musculus
cagagtgcttgatgccatgctccca

SEQ ID NO: 565630 - DNA, 25 bp, Mus musculus
cagagtggaagtcctgaaggctggc

SEQ ID NO: 565631 - DNA, 25 bp, Mus musculus
cagagtggaagtgctgaaggctggc

SEQ ID NO: 565632 - DNA, 25 bp, Mus musculus
cagagtggagagctttacacctgcc

SEQ ID NO: 565633 - DNA, 25 bp, Mus musculus
cagagtggagaggtttacacctgcc

SEQ ID NO: 565634 - DNA, 25 bp, Mus musculus
cagagtggagccaagataactaaca

SEQ ID NO: 565635 - DNA, 25 bp, Mus musculus
cagagtggagcctagataactaaca

SEQ ID NO: 565636 - DNA, 25 bp, Mus musculus
cagagtggcaccagtggaagtccac

SEQ ID NO: 565637 - DNA, 25 bp, Mus musculus
cagagtggcacctgtggaagtccac

SEQ ID NO: 565638 - DNA, 25 bp, Mus musculus
cagagtggcatgcatgacatgaagc

SEQ ID NO: 565639 - DNA, 25 bp, Mus musculus
cagagtggcatggatgacatgaagc

SEQ ID NO: 565640 - DNA, 25 bp, Mus musculus
cagagtggcgggaagaagtaaaact

SEQ ID NO: 565641 - DNA, 25 bp, Mus musculus
cagagtggcgggtagaagtaaaact

SEQ ID NO: 565642 - DNA, 25 bp, Mus musculus
cagagtggcttccttccttcgggag

SEQ ID NO: 565643 - DNA, 25 bp, Mus musculus
cagagtggcttcgttccttcgggag

SEQ ID NO: 565644 - DNA, 25 bp, Mus musculus
cagagtggctttagccggactccgg

SEQ ID NO: 565645 - DNA, 25 bp, Mus musculus
cagagtggcttttgccggactccgg

SEQ ID NO: 565646 - DNA, 25 bp, Mus musculus
cagagtgggacccatagcctccaag

SEQ ID NO: 565647 - DNA, 25 bp, Mus musculus
cagagtgggaccgatagcctccaag

SEQ ID NO: 565648 - DNA, 25 bp, Mus musculus
cagagtgggtccctaatcgtcccat

SEQ ID NO: 565649 - DNA, 25 bp, Mus musculus
cagagtgggtccgtaatcgtcccat

SEQ ID NO: 565650 - DNA, 25 bp, Mus musculus
cagagtggtccacagtgtttgtatt

SEQ ID NO: 565651 - DNA, 25 bp, Mus musculus
cagagtggtccagagtgtttgtatt

SEQ ID NO: 565652 - DNA, 25 bp, Mus musculus
cagagtgtcaaaagtgtttgcatgc

SEQ ID NO: 565653 - DNA, 25 bp, Mus musculus
cagagtgtcaaatgtgtttgcatgc

SEQ ID NO: 565654 - DNA, 25 bp, Mus musculus
cagagtgtcaggacagcatgaagag

SEQ ID NO: 565655 - DNA, 25 bp, Mus musculus
cagagtgtcaggtcagcatgaagag

SEQ ID NO: 565656 - DNA, 25 bp, Mus musculus
cagagtgtccacatggtgacctctc

SEQ ID NO: 565657 - DNA, 25 bp, Mus musculus
cagagtgtccacttggtgacctctc

SEQ ID NO: 565658 - DNA, 25 bp, Mus musculus
cagagtgtccctcagagattagaag

SEQ ID NO: 565659 - DNA, 25 bp, Mus musculus
cagagtgtccctgagagattagaag

SEQ ID NO: 565660 - DNA, 25 bp, Mus musculus
cagagtgtcgacatcgcagctttca

SEQ ID NO: 565661 - DNA, 25 bp, Mus musculus
cagagtgtcgacttcgcagctttca

SEQ ID NO: 565662 - DNA, 25 bp, Mus musculus
cagagtgtggagagagttcctgccc

SEQ ID NO: 565663 - DNA, 25 bp, Mus musculus
cagagtgtggagtgagttcctgccc

SEQ ID NO: 565664 - DNA, 25 bp, Mus musculus
cagagttaagaaactgattgaaacc

SEQ ID NO: 565665 - DNA, 25 bp, Mus musculus
cagagttaagaatctgattgaaacc

SEQ ID NO: 565666 - DNA, 25 bp, Mus musculus
cagagttactcaaaaactacctgga

SEQ ID NO: 565667 - DNA, 25 bp, Mus musculus
cagagttactcataaactacctgga

SEQ ID NO: 565668 - DNA, 25 bp, Mus musculus
cagagttaggaaaggtacaggaaga

SEQ ID NO: 565669 - DNA, 25 bp, Mus musculus
cagagttaggaatggtacaggaaga

SEQ ID NO: 565670 - DNA, 25 bp, Mus musculus
cagagttaggacagcaaatcctggc

SEQ ID NO: 565671 - DNA, 25 bp, Mus musculus
cagagttaggactgcaaatcctggc

SEQ ID NO: 565672 - DNA, 25 bp, Mus musculus
cagagttaggctatgtgttccaagc

SEQ ID NO: 565673 - DNA, 25 bp, Mus musculus
cagagttaggctttgtgttccaagc

SEQ ID NO: 565674 - DNA, 25 bp, Mus musculus
cagagttattgcaggtggactgtga

SEQ ID NO: 565675 - DNA, 25 bp, Mus musculus
cagagttattgctggtggactgtga

SEQ ID NO: 565676 - DNA, 25 bp, Mus musculus
cagagttccagcacaatgactcggc

SEQ ID NO: 565677 - DNA, 25 bp, Mus musculus
cagagttccagctcaatgactcggc

SEQ ID NO: 565678 - DNA, 25 bp, Mus musculus
cagagttcctgaatgagaaacctca

SEQ ID NO: 565679 - DNA, 25 bp, Mus musculus
cagagttcctgattgagaaacctca

SEQ ID NO: 565680 - DNA, 25 bp, Mus musculus
cagagttcgctaatgggcaggaagt

SEQ ID NO: 565681 - DNA, 25 bp, Mus musculus
cagagttcgctattgggcaggaagt

SEQ ID NO: 565682 - DNA, 25 bp, Mus musculus
cagagttcgtctatgaacatggcta

SEQ ID NO: 565683 - DNA, 25 bp, Mus musculus
cagagttcgtctttgaacatggcta

SEQ ID NO: 565684 - DNA, 25 bp, Mus musculus
cagagttctgagatgtgacacaagt

SEQ ID NO: 565685 - DNA, 25 bp, Mus musculus
cagagttctgagttgtgacacaagt

SEQ ID NO: 565686 - DNA, 25 bp, Mus musculus
cagagttctgggataagatgcaggc

SEQ ID NO: 565687 - DNA, 25 bp, Mus musculus
cagagttctgggttaagatgcaggc

SEQ ID NO: 565688 - DNA, 25 bp, Mus musculus
cagagttctggtagccagaccggca

SEQ ID NO: 565689 - DNA, 25 bp, Mus musculus
cagagttctggttgccagaccggca

SEQ ID NO: 565690 - DNA, 25 bp, Mus musculus
cagagttctttgctccgcttattca

SEQ ID NO: 565691 - DNA, 25 bp, Mus musculus
cagagttctttggtccgcttattca

SEQ ID NO: 565692 - DNA, 25 bp, Mus musculus
cagagttgctggcacttcgacaaga

SEQ ID NO: 565693 - DNA, 25 bp, Mus musculus
cagagttgctgggacttcgacaaga

SEQ ID NO: 565694 - DNA, 25 bp, Mus musculus
cagagttggagtctagcatgttctt

SEQ ID NO: 565695 - DNA, 25 bp, Mus musculus
cagagttggagtgtagcatgttctt

SEQ ID NO: 565696 - DNA, 25 bp, Mus musculus
cagagttggtcactgtcattaaaca

SEQ ID NO: 565697 - DNA, 25 bp, Mus musculus
cagagttggtcagtgtcattaaaca

SEQ ID NO: 565698 - DNA, 25 bp, Mus musculus
cagagttgtcaaagccactgggctg

SEQ ID NO: 565699 - DNA, 25 bp, Mus musculus
cagagttgtcaatgccactgggctg

SEQ ID NO: 565700 - DNA, 25 bp, Mus musculus
cagagtttcacaagctgcagcgatg

SEQ ID NO: 565701 - DNA, 25 bp, Mus musculus
cagagtttcacatgctgcagcgatg

SEQ ID NO: 565702 - DNA, 25 bp, Mus musculus
cagagtttccaaaagtatggcccca

SEQ ID NO: 565703 - DNA, 25 bp, Mus musculus
cagagtttccaatagtatggcccca

SEQ ID NO: 565704 - DNA, 25 bp, Mus musculus
cagagtttctccaaagaatcctcga

SEQ ID NO: 565705 - DNA, 25 bp, Mus musculus
cagagtttctcctaagaatcctcga

SEQ ID NO: 565706 - DNA, 25 bp, Mus musculus
cagagttttaacctcttctttggtg

SEQ ID NO: 565707 - DNA, 25 bp, Mus musculus
cagagttttaacgtcttctttggtg

SEQ ID NO: 565708 - DNA, 25 bp, Mus musculus
cagagttttgggacgcctcctcctt

SEQ ID NO: 565709 - DNA, 25 bp, Mus musculus
cagagttttgggtcgcctcctcctt

SEQ ID NO: 565710 - DNA, 25 bp, Mus musculus
cagataaagagtaccatgcaccgct

SEQ ID NO: 565711 - DNA, 25 bp, Mus musculus
cagataaagagttccatgcaccgct

SEQ ID NO: 565712 - DNA, 25 bp, Mus musculus
cagataaagccaaatggattgctgg

SEQ ID NO: 565713 - DNA, 25 bp, Mus musculus
cagataaagccatatggattgctgg

SEQ ID NO: 565714 - DNA, 25 bp, Mus musculus
cagataaagtccaggtggtagcaga

SEQ ID NO: 565715 - DNA, 25 bp, Mus musculus
cagataaagtcctggtggtagcaga

SEQ ID NO: 565716 - DNA, 25 bp, Mus musculus
cagataaatggaaccactggctatg

SEQ ID NO: 565717 - DNA, 25 bp, Mus musculus
cagataaatggatccactggctatg

SEQ ID NO: 565718 - DNA, 25 bp, Mus musculus
cagataaattgcctggatctctggg

SEQ ID NO: 565719 - DNA, 25 bp, Mus musculus
cagataaattgcgtggatctctggg

SEQ ID NO: 565720 - DNA, 25 bp, Mus musculus
cagataaatttccatggtaaaaagc

SEQ ID NO: 565721 - DNA, 25 bp, Mus musculus
cagataaatttcgatggtaaaaagc

SEQ ID NO: 565722 - DNA, 25 bp, Mus musculus
cagataacactgcaggatgtccggc

SEQ ID NO: 565723 - DNA, 25 bp, Mus musculus
cagataacactggaggatgtccggc

SEQ ID NO: 565724 - DNA, 25 bp, Mus musculus
cagataaccttacccgggcttgtag

SEQ ID NO: 565725 - DNA, 25 bp, Mus musculus
cagataaccttagccgggcttgtag

SEQ ID NO: 565726 - DNA, 25 bp, Mus musculus
cagataactaccagaacacctcaac

SEQ ID NO: 565727 - DNA, 25 bp, Mus musculus
cagataactacctgaacacctcaac

SEQ ID NO: 565728 - DNA, 25 bp, Mus musculus
cagataactgtgaaaggactcagta

SEQ ID NO: 565729 - DNA, 25 bp, Mus musculus
cagataactgtgtaaggactcagta

SEQ ID NO: 565730 - DNA, 25 bp, Mus musculus
cagataagctcccagaagagatggc

SEQ ID NO: 565731 - DNA, 25 bp, Mus musculus
cagataagctccgagaagagatggc

SEQ ID NO: 565732 - DNA, 25 bp, Mus musculus
cagataagctctcaggaagggacag

SEQ ID NO: 565733 - DNA, 25 bp, Mus musculus
cagataagctctgaggaagggacag

SEQ ID NO: 565734 - DNA, 25 bp, Mus musculus
cagataaggacacaggatgaaagac

SEQ ID NO: 565735 - DNA, 25 bp, Mus musculus
cagataaggacagaggatgaaagac

SEQ ID NO: 565736 - DNA, 25 bp, Mus musculus
cagataagtgacctgagactggatg

SEQ ID NO: 565737 - DNA, 25 bp, Mus musculus
cagataagtgacgtgagactggatg

SEQ ID NO: 565738 - DNA, 25 bp, Mus musculus
cagataagtgctagatcatgcaata

SEQ ID NO: 565739 - DNA, 25 bp, Mus musculus
cagataagtgctctagcctgaacaa

SEQ ID NO: 565740 - DNA, 25 bp, Mus musculus
cagataagtgctgtagcctgaacaa

SEQ ID NO: 565741 - DNA, 25 bp, Mus musculus
cagataagtgcttgatcatgcaata

SEQ ID NO: 565742 - DNA, 25 bp, Mus musculus
cagataatgaaacttttaatcctgc

SEQ ID NO: 565743 - DNA, 25 bp, Mus musculus
cagataatgaaagttttaatcctgc

SEQ ID NO: 565744 - DNA, 25 bp, Mus musculus
cagataatgacactgggactcagag

SEQ ID NO: 565745 - DNA, 25 bp, Mus musculus
cagataatgacagtgggactcagag

SEQ ID NO: 565746 - DNA, 25 bp, Mus musculus
cagataattaataagaagctggatc

SEQ ID NO: 565747 - DNA, 25 bp, Mus musculus
cagataattaattagaagctggatc

SEQ ID NO: 565748 - DNA, 25 bp, Mus musculus
cagatacaacggaagtgcatgatag

SEQ ID NO: 565749 - DNA, 25 bp, Mus musculus
cagatacaacggtagtgcatgatag

SEQ ID NO: 565750 - DNA, 25 bp, Mus musculus
cagatacaagctccagctcctgggt

SEQ ID NO: 565751 - DNA, 25 bp, Mus musculus
cagatacaagctgcagctcctgggt

SEQ ID NO: 565752 - DNA, 25 bp, Mus musculus
cagatacagaatagacgaagagatc

SEQ ID NO: 565753 - DNA, 25 bp, Mus musculus
cagatacagaattgacgaagagatc

SEQ ID NO: 565754 - DNA, 25 bp, Mus musculus
cagatacagagaacaacgctcttca

SEQ ID NO: 565755 - DNA, 25 bp, Mus musculus
cagatacagagatcaacgctcttca

SEQ ID NO: 565756 - DNA, 25 bp, Mus musculus
cagatacagggactatgcagagaga

SEQ ID NO: 565757 - DNA, 25 bp, Mus musculus
cagatacagggagtatgcagagaga

SEQ ID NO: 565758 - DNA, 25 bp, Mus musculus
cagataccaaagatgaatcggagga

SEQ ID NO: 565759 - DNA, 25 bp, Mus musculus
cagataccaaagttgaatcggagga

SEQ ID NO: 565760 - DNA, 25 bp, Mus musculus
cagatacccacaaaacgtcaaaacg

SEQ ID NO: 565761 - DNA, 25 bp, Mus musculus
cagatacccacataacgtcaaaacg

SEQ ID NO: 565762 - DNA, 25 bp, Mus musculus
cagataccccacacagtctggcagg

SEQ ID NO: 565763 - DNA, 25 bp, Mus musculus
cagataccccactcagtctggcagg

SEQ ID NO: 565764 - DNA, 25 bp, Mus musculus
cagatacctaggcaattgagctcag

SEQ ID NO: 565765 - DNA, 25 bp, Mus musculus
cagatacctagggaattgagctcag

SEQ ID NO: 565766 - DNA, 25 bp, Mus musculus
cagatacctgtcctttgcctgttgg

SEQ ID NO: 565767 - DNA, 25 bp, Mus musculus
cagatacctgtcgtttgcctgttgg

SEQ ID NO: 565768 - DNA, 25 bp, Mus musculus
cagatacgcatacagcagcagctta

SEQ ID NO: 565769 - DNA, 25 bp, Mus musculus
cagatacgcatagagcagcagctta

SEQ ID NO: 565770 - DNA, 25 bp, Mus musculus
cagatactcagtcaccagttaaaac

SEQ ID NO: 565771 - DNA, 25 bp, Mus musculus
cagatactcagtgaccagttaaaac

SEQ ID NO: 565772 - DNA, 25 bp, Mus musculus
cagatactctatctgatgctttggc

SEQ ID NO: 565773 - DNA, 25 bp, Mus musculus
cagatactctatgtgatgctttggc

SEQ ID NO: 565774 - DNA, 25 bp, Mus musculus
cagatactgatcaccaacttcctag

SEQ ID NO: 565775 - DNA, 25 bp, Mus musculus
cagatactgatctccaacttcctag

SEQ ID NO: 565776 - DNA, 25 bp, Mus musculus
cagatactggaaagtgttctgacca

SEQ ID NO: 565777 - DNA, 25 bp, Mus musculus
cagatactggaatgtgttctgacca

SEQ ID NO: 565778 - DNA, 25 bp, Mus musculus
cagatacttgaaaacgaagaagcta

SEQ ID NO: 565779 - DNA, 25 bp, Mus musculus
cagatacttgaatacgaagaagcta

SEQ ID NO: 565780 - DNA, 25 bp, Mus musculus
cagatactttgtcacggcagacacc

SEQ ID NO: 565781 - DNA, 25 bp, Mus musculus
cagatactttgtgacggcagacacc

SEQ ID NO: 565782 - DNA, 25 bp, Mus musculus
cagatagaagctatgcccagttttc

SEQ ID NO: 565783 - DNA, 25 bp, Mus musculus
cagatagaagctttgcccagttttc

SEQ ID NO: 565784 - DNA, 25 bp, Mus musculus
cagatagaaggccacaccatttgtg

SEQ ID NO: 565785 - DNA, 25 bp, Mus musculus
cagatagaaggcgacaccatttgtg

SEQ ID NO: 565786 - DNA, 25 bp, Mus musculus
cagatagaccctagcaccgaatata

SEQ ID NO: 565787 - DNA, 25 bp, Mus musculus
cagatagacccttgcaccgaatata

SEQ ID NO: 565788 - DNA, 25 bp, Mus musculus
cagatagagccaagccctctggaga

SEQ ID NO: 565789 - DNA, 25 bp, Mus musculus
cagatagagccatgccctctggaga

SEQ ID NO: 565790 - DNA, 25 bp, Mus musculus
cagatagcgaagaagagatccgcga

SEQ ID NO: 565791 - DNA, 25 bp, Mus musculus
cagatagcgaagtagagatccgcga

SEQ ID NO: 565792 - DNA, 25 bp, Mus musculus
cagatagctccgaagacgttgtcag

SEQ ID NO: 565793 - DNA, 25 bp, Mus musculus
cagatagctccgtagacgttgtcag

SEQ ID NO: 565794 - DNA, 25 bp, Mus musculus
cagatagggcagaaggtgttgcctt

SEQ ID NO: 565795 - DNA, 25 bp, Mus musculus
cagatagggcagtaggtgttgcctt

SEQ ID NO: 565796 - DNA, 25 bp, Mus musculus
cagatagggttcaaccagtagggct

SEQ ID NO: 565797 - DNA, 25 bp, Mus musculus
cagatagggttctaccagtagggct

SEQ ID NO: 565798 - DNA, 25 bp, Mus musculus
cagataggttggctagtttcgaagt

SEQ ID NO: 565799 - DNA, 25 bp, Mus musculus
cagataggttgggtagtttcgaagt

SEQ ID NO: 565800 - DNA, 25 bp, Mus musculus
cagatataagagactgaccagtctt

SEQ ID NO: 565801 - DNA, 25 bp, Mus musculus
cagatataagagtctgaccagtctt

SEQ ID NO: 565802 - DNA, 25 bp, Mus musculus
cagatatatgataagcagctggatg

SEQ ID NO: 565803 - DNA, 25 bp, Mus musculus
cagatatatgattagcagctggatg

SEQ ID NO: 565804 - DNA, 25 bp, Mus musculus
cagatatcaacaacccagtggacag

SEQ ID NO: 565805 - DNA, 25 bp, Mus musculus
cagatatcaacacgtttatggtgca

SEQ ID NO: 565806 - DNA, 25 bp, Mus musculus
cagatatcaacaggtttatggtgca

SEQ ID NO: 565807 - DNA, 25 bp, Mus musculus
cagatatcaacatcccagtggacag

SEQ ID NO: 565808 - DNA, 25 bp, Mus musculus
cagatatcctgtaccctcgggcagc

SEQ ID NO: 565809 - DNA, 25 bp, Mus musculus
cagatatcctgttccctcgggcagc

SEQ ID NO: 565810 - DNA, 25 bp, Mus musculus
cagatatcttccctggattgcggaa

SEQ ID NO: 565811 - DNA, 25 bp, Mus musculus
cagatatcttccgtggattgcggaa

SEQ ID NO: 565812 - DNA, 25 bp, Mus musculus
cagatatgaagtcaaacatgcctcc

SEQ ID NO: 565813 - DNA, 25 bp, Mus musculus
cagatatgaagtgaaacatgcctcc

SEQ ID NO: 565814 - DNA, 25 bp, Mus musculus
cagatatgaatgaaattatggcttc

SEQ ID NO: 565815 - DNA, 25 bp, Mus musculus
cagatatgaatgtaattatggcttc

SEQ ID NO: 565816 - DNA, 25 bp, Mus musculus
cagatatgagaactagcatgagata

SEQ ID NO: 565817 - DNA, 25 bp, Mus musculus
cagatatgagaagtagcatgagata

SEQ ID NO: 565818 - DNA, 25 bp, Mus musculus
cagatatgattgctgtaaaggagct

SEQ ID NO: 565819 - DNA, 25 bp, Mus musculus
cagatatgattggtgtaaaggagct

SEQ ID NO: 565820 - DNA, 25 bp, Mus musculus
cagatatggcctattcccggcagca

SEQ ID NO: 565821 - DNA, 25 bp, Mus musculus
cagatatggccttttcccggcagca

SEQ ID NO: 565822 - DNA, 25 bp, Mus musculus
cagatatggcttcggtctgatgcag

SEQ ID NO: 565823 - DNA, 25 bp, Mus musculus
cagatatggcttgggtctgatgcag

SEQ ID NO: 565824 - DNA, 25 bp, Mus musculus
cagatatgggagacatgggcgatcc

SEQ ID NO: 565825 - DNA, 25 bp, Mus musculus
cagatatgggagtcatgggcgatcc

SEQ ID NO: 565826 - DNA, 25 bp, Mus musculus
cagatatgggtgcttatgccacatg

SEQ ID NO: 565827 - DNA, 25 bp, Mus musculus
cagatatgggtggttatgccacatg

SEQ ID NO: 565828 - DNA, 25 bp, Mus musculus
cagatatgtaccaccaagaaaagct

SEQ ID NO: 565829 - DNA, 25 bp, Mus musculus
cagatatgtacctccaagaaaagct

SEQ ID NO: 565830 - DNA, 25 bp, Mus musculus
cagatattaataatctcttcaagga

SEQ ID NO: 565831 - DNA, 25 bp, Mus musculus
cagatattaatattctcttcaagga

SEQ ID NO: 565832 - DNA, 25 bp, Mus musculus
cagatattagtgacgcccttagccc

SEQ ID NO: 565833 - DNA, 25 bp, Mus musculus
cagatattagtgtcgcccttagccc

SEQ ID NO: 565834 - DNA, 25 bp, Mus musculus
cagatcaaagcaatctgcttagaaa

SEQ ID NO: 565835 - DNA, 25 bp, Mus musculus
cagatcaaagcattctgcttagaaa

SEQ ID NO: 565836 - DNA, 25 bp, Mus musculus
cagatcaacagcattggcaagaatg

SEQ ID NO: 565837 - DNA, 25 bp, Mus musculus
cagatcaacagctttggcaagaatg

SEQ ID NO: 565838 - DNA, 25 bp, Mus musculus
cagatcaacatcaccatcctgaaag

SEQ ID NO: 565839 - DNA, 25 bp, Mus musculus
cagatcaacatctccatcctgaaag

SEQ ID NO: 565840 - DNA, 25 bp, Mus musculus
cagatcaatgacacactacaacttc

SEQ ID NO: 565841 - DNA, 25 bp, Mus musculus
cagatcaatgactcactacaacttc

SEQ ID NO: 565842 - DNA, 25 bp, Mus musculus
cagatcaatggcacgtttgcactca

SEQ ID NO: 565843 - DNA, 25 bp, Mus musculus
cagatcaatggctcgtttgcactca

SEQ ID NO: 565844 - DNA, 25 bp, Mus musculus
cagatcaatgtgagcagattctaac

SEQ ID NO: 565845 - DNA, 25 bp, Mus musculus
cagatcaatgtgtgcagattctaac

SEQ ID NO: 565846 - DNA, 25 bp, Mus musculus
cagatcaattccacaatgactagaa

SEQ ID NO: 565847 - DNA, 25 bp, Mus musculus
cagatcaattcctcaatgactagaa

SEQ ID NO: 565848 - DNA, 25 bp, Mus musculus
cagatcacatttatcggtggcttaa

SEQ ID NO: 565849 - DNA, 25 bp, Mus musculus
cagatcacatttttcggtggcttaa

SEQ ID NO: 565850 - DNA, 25 bp, Mus musculus
cagatcaccttccagcgggagtggc

SEQ ID NO: 565851 - DNA, 25 bp, Mus musculus
cagatcaccttcgagcgggagtggc

SEQ ID NO: 565852 - DNA, 25 bp, Mus musculus
cagatcactactattgccgttttgg

SEQ ID NO: 565853 - DNA, 25 bp, Mus musculus
cagatcactacttttgccgttttgg

SEQ ID NO: 565854 - DNA, 25 bp, Mus musculus
cagatcagatgaccgcccgctggct

SEQ ID NO: 565855 - DNA, 25 bp, Mus musculus
cagatcagatgagcgcccgctggct

SEQ ID NO: 565856 - DNA, 25 bp, Mus musculus
cagatcagcaacacacagcttggag

SEQ ID NO: 565857 - DNA, 25 bp, Mus musculus
cagatcagcaactcacagcttggag

SEQ ID NO: 565858 - DNA, 25 bp, Mus musculus
cagatcagctcacgccctggtggaa

SEQ ID NO: 565859 - DNA, 25 bp, Mus musculus
cagatcagctcaggccctggtggaa

SEQ ID NO: 565860 - DNA, 25 bp, Mus musculus
cagatcagctgaaactctactcgga

SEQ ID NO: 565861 - DNA, 25 bp, Mus musculus
cagatcagctgatactctactcgga

SEQ ID NO: 565862 - DNA, 25 bp, Mus musculus
cagatcaggccactgacagggtaga

SEQ ID NO: 565863 - DNA, 25 bp, Mus musculus
cagatcaggccagtgacagggtaga

SEQ ID NO: 565864 - DNA, 25 bp, Mus musculus
cagatcagggtaatcagctgctgca

SEQ ID NO: 565865 - DNA, 25 bp, Mus musculus
cagatcagggtattcagctgctgca

SEQ ID NO: 565866 - DNA, 25 bp, Mus musculus
cagatcagtgacagattttggtgta

SEQ ID NO: 565867 - DNA, 25 bp, Mus musculus
cagatcagtgactgattttggtgta

SEQ ID NO: 565868 - DNA, 25 bp, Mus musculus
cagatcagttgaaaaatggcgacac

SEQ ID NO: 565869 - DNA, 25 bp, Mus musculus
cagatcagttgataaatggcgacac

SEQ ID NO: 565870 - DNA, 25 bp, Mus musculus
cagatcatacgacgaggcgttcctc

SEQ ID NO: 565871 - DNA, 25 bp, Mus musculus
cagatcatacgaggaggcgttcctc

SEQ ID NO: 565872 - DNA, 25 bp, Mus musculus
cagatcatcaacctcctcaacaagg

SEQ ID NO: 565873 - DNA, 25 bp, Mus musculus
cagatcatcaacgtcctcaacaagg

SEQ ID NO: 565874 - DNA, 25 bp, Mus musculus
cagatcatggtaatggagaggcgca

SEQ ID NO: 565875 - DNA, 25 bp, Mus musculus
cagatcatggtattggagaggcgca

SEQ ID NO: 565876 - DNA, 25 bp, Mus musculus
cagatcatgttcacggttcccggga

SEQ ID NO: 565877 - DNA, 25 bp, Mus musculus
cagatcatgttctcggttcccggga

SEQ ID NO: 565878 - DNA, 25 bp, Mus musculus
cagatcattaccctaactacatgca

SEQ ID NO: 565879 - DNA, 25 bp, Mus musculus
cagatcattaccgtaactacatgca

SEQ ID NO: 565880 - DNA, 25 bp, Mus musculus
cagatccacagccatatccagacat

SEQ ID NO: 565881 - DNA, 25 bp, Mus musculus
cagatccacagcgatatccagacat

SEQ ID NO: 565882 - DNA, 25 bp, Mus musculus
cagatccacgggaacgacaaatcca

SEQ ID NO: 565883 - DNA, 25 bp, Mus musculus
cagatccacgggtacgacaaatcca

SEQ ID NO: 565884 - DNA, 25 bp, Mus musculus
cagatccagcaaatcgggacaggcg

SEQ ID NO: 565885 - DNA, 25 bp, Mus musculus
cagatccagcaattcgggacaggcg

SEQ ID NO: 565886 - DNA, 25 bp, Mus musculus
cagatccagctcaatggtcctacca

SEQ ID NO: 565887 - DNA, 25 bp, Mus musculus
cagatccagctctatggtcctacca

SEQ ID NO: 565888 - DNA, 25 bp, Mus musculus
cagatccagctgcacaagctcaaga

SEQ ID NO: 565889 - DNA, 25 bp, Mus musculus
cagatccagctggacaagctcaaga

SEQ ID NO: 565890 - DNA, 25 bp, Mus musculus
cagatccaggataccgcagggagag

SEQ ID NO: 565891 - DNA, 25 bp, Mus musculus
cagatccaggattccgcagggagag

SEQ ID NO: 565892 - DNA, 25 bp, Mus musculus
cagatccatcatctgggtcaggatg

SEQ ID NO: 565893 - DNA, 25 bp, Mus musculus
cagatccatcatgtgggtcaggatg

SEQ ID NO: 565894 - DNA, 25 bp, Mus musculus
cagatcccactgcagttcatctgca

SEQ ID NO: 565895 - DNA, 25 bp, Mus musculus
cagatcccactggagttcatctgca

SEQ ID NO: 565896 - DNA, 25 bp, Mus musculus
cagatcccatccacgcagtttgacg

SEQ ID NO: 565897 - DNA, 25 bp, Mus musculus
cagatcccatcctcgcagtttgacg

SEQ ID NO: 565898 - DNA, 25 bp, Mus musculus
cagatccccagcatctaggaaaagg

SEQ ID NO: 565899 - DNA, 25 bp, Mus musculus
cagatccccagcttctaggaaaagg

SEQ ID NO: 565900 - DNA, 25 bp, Mus musculus
cagatccctcaaagatccccattaa

SEQ ID NO: 565901 - DNA, 25 bp, Mus musculus
cagatccctcaatgatccccattaa

SEQ ID NO: 565902 - DNA, 25 bp, Mus musculus
cagatccctctcacaggcttcgtgg

SEQ ID NO: 565903 - DNA, 25 bp, Mus musculus
cagatccctctctcaggcttcgtgg

SEQ ID NO: 565904 - DNA, 25 bp, Mus musculus
cagatccgacttccccagaaagaaa

SEQ ID NO: 565905 - DNA, 25 bp, Mus musculus
cagatccgacttgcccagaaagaaa

SEQ ID NO: 565906 - DNA, 25 bp, Mus musculus
cagatccgggacatctgggtgtgct

SEQ ID NO: 565907 - DNA, 25 bp, Mus musculus
cagatccgggacttctgggtgtgct

SEQ ID NO: 565908 - DNA, 25 bp, Mus musculus
cagatcctcagccaccgatttaaag

SEQ ID NO: 565909 - DNA, 25 bp, Mus musculus
cagatcctcagcgaccgatttaaag

SEQ ID NO: 565910 - DNA, 25 bp, Mus musculus
cagatcctcctcaagctggacaggc

SEQ ID NO: 565911 - DNA, 25 bp, Mus musculus
cagatcctcctctagctggacaggc

SEQ ID NO: 565912 - DNA, 25 bp, Mus musculus
cagatcctgctcaacaacggagatg

SEQ ID NO: 565913 - DNA, 25 bp, Mus musculus
cagatcctgctctacaacggagatg

SEQ ID NO: 565914 - DNA, 25 bp, Mus musculus
cagatcctgggacattgtgcctgcc

SEQ ID NO: 565915 - DNA, 25 bp, Mus musculus
cagatcctgggagattgtgcctgcc

SEQ ID NO: 565916 - DNA, 25 bp, Mus musculus
cagatcctggtgcagaggcccatgc

SEQ ID NO: 565917 - DNA, 25 bp, Mus musculus
cagatcctggtggagaggcccatgc

SEQ ID NO: 565918 - DNA, 25 bp, Mus musculus
cagatccttcgaccatccgtggagc

SEQ ID NO: 565919 - DNA, 25 bp, Mus musculus
cagatccttcgagcatccgtggagc

SEQ ID NO: 565920 - DNA, 25 bp, Mus musculus
cagatccttcggagcctggtttcgg

SEQ ID NO: 565921 - DNA, 25 bp, Mus musculus
cagatccttcggtgcctggtttcgg

SEQ ID NO: 565922 - DNA, 25 bp, Mus musculus
cagatcctttcaaggaccttcggta

SEQ ID NO: 565923 - DNA, 25 bp, Mus musculus
cagatcctttcatggaccttcggta

SEQ ID NO: 565924 - DNA, 25 bp, Mus musculus
cagatcgagtcgaagctccagaaag

SEQ ID NO: 565925 - DNA, 25 bp, Mus musculus
cagatcgagtcgtagctccagaaag

SEQ ID NO: 565926 - DNA, 25 bp, Mus musculus
cagatcgcatttcatgacttcatcc

SEQ ID NO: 565927 - DNA, 25 bp, Mus musculus
cagatcgcatttgatgacttcatcc

SEQ ID NO: 565928 - DNA, 25 bp, Mus musculus
cagatcggccttcctgtagcacggg

SEQ ID NO: 565929 - DNA, 25 bp, Mus musculus
cagatcggccttgctgtagcacggg

SEQ ID NO: 565930 - DNA, 25 bp, Mus musculus
cagatcggcgagatctacggcgcta

SEQ ID NO: 565931 - DNA, 25 bp, Mus musculus
cagatcggcgagttctacggcgcta

SEQ ID NO: 565932 - DNA, 25 bp, Mus musculus
cagatcggctctctgcacgatcgat

SEQ ID NO: 565933 - DNA, 25 bp, Mus musculus
cagatcggctctgtgcacgatcgat

SEQ ID NO: 565934 - DNA, 25 bp, Mus musculus
cagatcgtagtcatgagaagccaga

SEQ ID NO: 565935 - DNA, 25 bp, Mus musculus
cagatcgtagtcttgagaagccaga

SEQ ID NO: 565936 - DNA, 25 bp, Mus musculus
cagatcgttacgaccagaggagatt

SEQ ID NO: 565937 - DNA, 25 bp, Mus musculus
cagatcgttacgtccagaggagatt

SEQ ID NO: 565938 - DNA, 25 bp, Mus musculus
cagatctacattcatgagctgtacg

SEQ ID NO: 565939 - DNA, 25 bp, Mus musculus
cagatctacattgatgagctgtacg

SEQ ID NO: 565940 - DNA, 25 bp, Mus musculus
cagatctacgatcccaagtattgcc

SEQ ID NO: 565941 - DNA, 25 bp, Mus musculus
cagatctacgatgccaagtattgcc

SEQ ID NO: 565942 - DNA, 25 bp, Mus musculus
cagatctagcacacttggccatcaa

SEQ ID NO: 565943 - DNA, 25 bp, Mus musculus
cagatctagcactcttggccatcaa

SEQ ID NO: 565944 - DNA, 25 bp, Mus musculus
cagatctagttgcttacagacatgc

SEQ ID NO: 565945 - DNA, 25 bp, Mus musculus
cagatctagttggttacagacatgc

SEQ ID NO: 565946 - DNA, 25 bp, Mus musculus
cagatctatgcaaggcagtactaca

SEQ ID NO: 565947 - DNA, 25 bp, Mus musculus
cagatctatgcatggcagtactaca

SEQ ID NO: 565948 - DNA, 25 bp, Mus musculus
cagatctctaaaacaattcgaaaag

SEQ ID NO: 565949 - DNA, 25 bp, Mus musculus
cagatctctaaatcaattcgaaaag

SEQ ID NO: 565950 - DNA, 25 bp, Mus musculus
cagatctgaaacacaacggacccca

SEQ ID NO: 565951 - DNA, 25 bp, Mus musculus
cagatctgaaactcaacggacccca

SEQ ID NO: 565952 - DNA, 25 bp, Mus musculus
cagatctgaaggcactggcacgaaa

SEQ ID NO: 565953 - DNA, 25 bp, Mus musculus
cagatctgaagggactggcacgaaa

SEQ ID NO: 565954 - DNA, 25 bp, Mus musculus
cagatctgccctcaggctttgatgg

SEQ ID NO: 565955 - DNA, 25 bp, Mus musculus
cagatctgccctgaggctttgatgg

SEQ ID NO: 565956 - DNA, 25 bp, Mus musculus
cagatctgcgtcaatgccatgggca

SEQ ID NO: 565957 - DNA, 25 bp, Mus musculus
cagatctgcgtctatgccatgggca

SEQ ID NO: 565958 - DNA, 25 bp, Mus musculus
cagatctgctgaagcacagacttta

SEQ ID NO: 565959 - DNA, 25 bp, Mus musculus
cagatctgctgatgcacagacttta

SEQ ID NO: 565960 - DNA, 25 bp, Mus musculus
cagatctggacccatgagagaacct

SEQ ID NO: 565961 - DNA, 25 bp, Mus musculus
cagatctggaccgatgagagaacct

SEQ ID NO: 565962 - DNA, 25 bp, Mus musculus
cagatctggagcagtagttgcagat

SEQ ID NO: 565963 - DNA, 25 bp, Mus musculus
cagatctggagctgtagttgcagat

SEQ ID NO: 565964 - DNA, 25 bp, Mus musculus
cagatctgggccacaaggtgtttcc

SEQ ID NO: 565965 - DNA, 25 bp, Mus musculus
cagatctgggcctcaaggtgtttcc

SEQ ID NO: 565966 - DNA, 25 bp, Mus musculus
cagatctgtatcaacactgaaggag

SEQ ID NO: 565967 - DNA, 25 bp, Mus musculus
cagatctgtatctacactgaaggag

SEQ ID NO: 565968 - DNA, 25 bp, Mus musculus
cagatcttcaggatcatcaaggtca

SEQ ID NO: 565969 - DNA, 25 bp, Mus musculus
cagatcttcaggttcatcaaggtca

SEQ ID NO: 565970 - DNA, 25 bp, Mus musculus
cagatcttctccacggcttccgata

SEQ ID NO: 565971 - DNA, 25 bp, Mus musculus
cagatcttctcctcggcttccgata

SEQ ID NO: 565972 - DNA, 25 bp, Mus musculus
cagatcttggacaggacattggtgc

SEQ ID NO: 565973 - DNA, 25 bp, Mus musculus
cagatcttggactggacattggtgc

SEQ ID NO: 565974 - DNA, 25 bp, Mus musculus
cagatcttgtaccaccacttccggt

SEQ ID NO: 565975 - DNA, 25 bp, Mus musculus
cagatcttgtacgaccacttccggt

SEQ ID NO: 565976 - DNA, 25 bp, Mus musculus
cagatctttgcgcacgaggtgcttg

SEQ ID NO: 565977 - DNA, 25 bp, Mus musculus
cagatctttgcggacgaggtgcttg

SEQ ID NO: 565978 - DNA, 25 bp, Mus musculus
cagatctttgggagaaatgacgaaa

SEQ ID NO: 565979 - DNA, 25 bp, Mus musculus
cagatctttgggtgaaatgacgaaa

SEQ ID NO: 565980 - DNA, 25 bp, Mus musculus
cagatcttttctacgacagtggaac

SEQ ID NO: 565981 - DNA, 25 bp, Mus musculus
cagatcttttctctggcctgatgtg

SEQ ID NO: 565982 - DNA, 25 bp, Mus musculus
cagatcttttctgtggcctgatgtg

SEQ ID NO: 565983 - DNA, 25 bp, Mus musculus
cagatcttttcttcgacagtggaac

SEQ ID NO: 565984 - DNA, 25 bp, Mus musculus
cagatgaaagtgcaaaatccaaagg

SEQ ID NO: 565985 - DNA, 25 bp, Mus musculus
cagatgaaagtggaaaatccaaagg

SEQ ID NO: 565986 - DNA, 25 bp, Mus musculus
cagatgaacagtatcagctgctcag

SEQ ID NO: 565987 - DNA, 25 bp, Mus musculus
cagatgaacagtttcagctgctcag

SEQ ID NO: 565988 - DNA, 25 bp, Mus musculus
cagatgaaccaccttgtcatggaga

SEQ ID NO: 565989 - DNA, 25 bp, Mus musculus
cagatgaaccacgttgtcatggaga

SEQ ID NO: 565990 - DNA, 25 bp, Mus musculus
cagatgaagaaacgccacaacccaa

SEQ ID NO: 565991 - DNA, 25 bp, Mus musculus
cagatgaagaaaggccacaacccaa

SEQ ID NO: 565992 - DNA, 25 bp, Mus musculus
cagatgaagcaacataggatcacca

SEQ ID NO: 565993 - DNA, 25 bp, Mus musculus
cagatgaagcaagataggatcacca

SEQ ID NO: 565994 - DNA, 25 bp, Mus musculus
cagatgaagcatcctgccttgacca

SEQ ID NO: 565995 - DNA, 25 bp, Mus musculus
cagatgaagcatgctgccttgacca

SEQ ID NO: 565996 - DNA, 25 bp, Mus musculus
cagatgaagcttcctgacagcgtaa

SEQ ID NO: 565997 - DNA, 25 bp, Mus musculus
cagatgaagcttgctgacagcgtaa

SEQ ID NO: 565998 - DNA, 25 bp, Mus musculus
cagatgaatgaacaccccattcggg

SEQ ID NO: 565999 - DNA, 25 bp, Mus musculus
cagatgaatgaagaccccattcggg

SEQ ID NO: 566000 - DNA, 25 bp, Mus musculus
cagatgacagcaactgaacaatgga

SEQ ID NO: 566001 - DNA, 25 bp, Mus musculus
cagatgacagcatctgaacaatgga

SEQ ID NO: 566002 - DNA, 25 bp, Mus musculus
cagatgacagggaccggtttaagca

SEQ ID NO: 566003 - DNA, 25 bp, Mus musculus
cagatgacagggtccggtttaagca

SEQ ID NO: 566004 - DNA, 25 bp, Mus musculus
cagatgacaggtcaatcagaagtgt

SEQ ID NO: 566005 - DNA, 25 bp, Mus musculus
cagatgacaggtgaatcagaagtgt

SEQ ID NO: 566006 - DNA, 25 bp, Mus musculus
cagatgacccttcggatgataacac

SEQ ID NO: 566007 - DNA, 25 bp, Mus musculus
cagatgacccttgggatgataacac

SEQ ID NO: 566008 - DNA, 25 bp, Mus musculus
cagatgacctaaaaacctggatcaa

SEQ ID NO: 566009 - DNA, 25 bp, Mus musculus
cagatgacctaataacctggatcaa

SEQ ID NO: 566010 - DNA, 25 bp, Mus musculus
cagatgacctacctgaccatgtgca

SEQ ID NO: 566011 - DNA, 25 bp, Mus musculus
cagatgacctacgtgaccatgtgca

SEQ ID NO: 566012 - DNA, 25 bp, Mus musculus
cagatgacctggcactaggcttgga

SEQ ID NO: 566013 - DNA, 25 bp, Mus musculus
cagatgacctgggactaggcttgga

SEQ ID NO: 566014 - DNA, 25 bp, Mus musculus
cagatgacgaccagtgttccgacat

SEQ ID NO: 566015 - DNA, 25 bp, Mus musculus
cagatgacgacctgtgttccgacat

SEQ ID NO: 566016 - DNA, 25 bp, Mus musculus
cagatgacggcacggagcctgcaca

SEQ ID NO: 566017 - DNA, 25 bp, Mus musculus
cagatgacggcagggagcctgcaca

SEQ ID NO: 566018 - DNA, 25 bp, Mus musculus
cagatgacggccaggaagccattat

SEQ ID NO: 566019 - DNA, 25 bp, Mus musculus
cagatgacggcctggaagccattat

SEQ ID NO: 566020 - DNA, 25 bp, Mus musculus
cagatgacggttacaggtgccagga

SEQ ID NO: 566021 - DNA, 25 bp, Mus musculus
cagatgacggtttcaggtgccagga

SEQ ID NO: 566022 - DNA, 25 bp, Mus musculus
cagatgactgtgacaggcaccagtg

SEQ ID NO: 566023 - DNA, 25 bp, Mus musculus
cagatgactgtgtcaggcaccagtg

SEQ ID NO: 566024 - DNA, 25 bp, Mus musculus
cagatgacttcacggccctgcttat

SEQ ID NO: 566025 - DNA, 25 bp, Mus musculus
cagatgacttcagggccctgcttat

SEQ ID NO: 566026 - DNA, 25 bp, Mus musculus
cagatgagatccaactacttgcgaa

SEQ ID NO: 566027 - DNA, 25 bp, Mus musculus
cagatgagatcctactacttgcgaa

SEQ ID NO: 566028 - DNA, 25 bp, Mus musculus
cagatgagctcaccagattggccag

SEQ ID NO: 566029 - DNA, 25 bp, Mus musculus
cagatgagctcagcagattggccag

SEQ ID NO: 566030 - DNA, 25 bp, Mus musculus
cagatgagctgcaccttgggatctt

SEQ ID NO: 566031 - DNA, 25 bp, Mus musculus
cagatgagctgctccttgggatctt

SEQ ID NO: 566032 - DNA, 25 bp, Mus musculus
cagatgaggaagaacaagatgaaga

SEQ ID NO: 566033 - DNA, 25 bp, Mus musculus
cagatgaggaagtacaagatgaaga

SEQ ID NO: 566034 - DNA, 25 bp, Mus musculus
cagatgaggacacgcacctggtgaa

SEQ ID NO: 566035 - DNA, 25 bp, Mus musculus
cagatgaggacaggcacctggtgaa

SEQ ID NO: 566036 - DNA, 25 bp, Mus musculus
cagatgaggagcacaagcccaagaa

SEQ ID NO: 566037 - DNA, 25 bp, Mus musculus
cagatgaggagctcaagcccaagaa

SEQ ID NO: 566038 - DNA, 25 bp, Mus musculus
cagatgaggaggacaatacgagccg

SEQ ID NO: 566039 - DNA, 25 bp, Mus musculus
cagatgaggaggtcaatacgagccg

SEQ ID NO: 566040 - DNA, 25 bp, Mus musculus
cagatgaggcgtacctggaagacct

SEQ ID NO: 566041 - DNA, 25 bp, Mus musculus
cagatgaggcgttcctggaagacct

SEQ ID NO: 566042 - DNA, 25 bp, Mus musculus
cagatgagggcaacattcagggacc

SEQ ID NO: 566043 - DNA, 25 bp, Mus musculus
cagatgagggcatcattcagggacc

SEQ ID NO: 566044 - DNA, 25 bp, Mus musculus
cagatgaggtcacctaccgcatcaa

SEQ ID NO: 566045 - DNA, 25 bp, Mus musculus
cagatgaggtcagctaccgcatcaa

SEQ ID NO: 566046 - DNA, 25 bp, Mus musculus
cagatgataacgcaaggacgcatga

SEQ ID NO: 566047 - DNA, 25 bp, Mus musculus
cagatgataacggaaggacgcatga

SEQ ID NO: 566048 - DNA, 25 bp, Mus musculus
cagatgatcactaccctgggctgtg

SEQ ID NO: 566049 - DNA, 25 bp, Mus musculus
cagatgatcacttccctgggctgtg

SEQ ID NO: 566050 - DNA, 25 bp, Mus musculus
cagatgatcctgatgacgggccagc

SEQ ID NO: 566051 - DNA, 25 bp, Mus musculus
cagatgatcctgttgacgggccagc

SEQ ID NO: 566052 - DNA, 25 bp, Mus musculus
cagatgatctggagtgcacccctgg

SEQ ID NO: 566053 - DNA, 25 bp, Mus musculus
cagatgatctggtgtgcacccctgg

SEQ ID NO: 566054 - DNA, 25 bp, Mus musculus
cagatgatgaagatcaacaagttct

SEQ ID NO: 566055 - DNA, 25 bp, Mus musculus
cagatgatgaagttcaacaagttct

SEQ ID NO: 566056 - DNA, 25 bp, Mus musculus
cagatgatgacccagaggctggcca

SEQ ID NO: 566057 - DNA, 25 bp, Mus musculus
cagatgatgaccgagaggctggcca

SEQ ID NO: 566058 - DNA, 25 bp, Mus musculus
cagatgatgacgaccaacgtgtggg

SEQ ID NO: 566059 - DNA, 25 bp, Mus musculus
cagatgatgacgtccaacgtgtggg

SEQ ID NO: 566060 - DNA, 25 bp, Mus musculus
cagatgatgactccgaagtgaaggc

SEQ ID NO: 566061 - DNA, 25 bp, Mus musculus
cagatgatgactgcgaagtgaaggc

SEQ ID NO: 566062 - DNA, 25 bp, Mus musculus
cagatgatgagcagctgtacctacc

SEQ ID NO: 566063 - DNA, 25 bp, Mus musculus
cagatgatgagctgctgtacctacc

SEQ ID NO: 566064 - DNA, 25 bp, Mus musculus
cagatgatgcaaagctcattgatat

SEQ ID NO: 566065 - DNA, 25 bp, Mus musculus
cagatgatgcaatgctcattgatat

SEQ ID NO: 566066 - DNA, 25 bp, Mus musculus
cagatgatggtactgatcatttaac

SEQ ID NO: 566067 - DNA, 25 bp, Mus musculus
cagatgatggtagtgatcatttaac

SEQ ID NO: 566068 - DNA, 25 bp, Mus musculus
cagatgattcctccaaaccactcta

SEQ ID NO: 566069 - DNA, 25 bp, Mus musculus
cagatgattcctgcaaaccactcta

SEQ ID NO: 566070 - DNA, 25 bp, Mus musculus
cagatgcaaatgacgtggttgtcac

SEQ ID NO: 566071 - DNA, 25 bp, Mus musculus
cagatgcaaatgtcgtggttgtcac

SEQ ID NO: 566072 - DNA, 25 bp, Mus musculus
cagatgcactgaatccagggctgcc

SEQ ID NO: 566073 - DNA, 25 bp, Mus musculus
cagatgcactgattccagggctgcc

SEQ ID NO: 566074 - DNA, 25 bp, Mus musculus
cagatgcactgtcgatggccacctt

SEQ ID NO: 566075 - DNA, 25 bp, Mus musculus
cagatgcactgtggatggccacctt

SEQ ID NO: 566076 - DNA, 25 bp, Mus musculus
cagatgcagaccaccgggctgaagt

SEQ ID NO: 566077 - DNA, 25 bp, Mus musculus
cagatgcagacctccgggctgaagt

SEQ ID NO: 566078 - DNA, 25 bp, Mus musculus
cagatgcagcttcttcatatccggg

SEQ ID NO: 566079 - DNA, 25 bp, Mus musculus
cagatgcagcttgttcatatccggg

SEQ ID NO: 566080 - DNA, 25 bp, Mus musculus
cagatgcaggagcttcccctgggca

SEQ ID NO: 566081 - DNA, 25 bp, Mus musculus
cagatgcaggaggttcccctgggca

SEQ ID NO: 566082 - DNA, 25 bp, Mus musculus
cagatgcagggtcttctacagaaat

SEQ ID NO: 566083 - DNA, 25 bp, Mus musculus
cagatgcagggtgttctacagaaat

SEQ ID NO: 566084 - DNA, 25 bp, Mus musculus
cagatgcagttgacaaagaatgagc

SEQ ID NO: 566085 - DNA, 25 bp, Mus musculus
cagatgcagttgtcaaagaatgagc

SEQ ID NO: 566086 - DNA, 25 bp, Mus musculus
cagatgcatgggacctctgcctgca

SEQ ID NO: 566087 - DNA, 25 bp, Mus musculus
cagatgcatgggtcctctgcctgca

SEQ ID NO: 566088 - DNA, 25 bp, Mus musculus
cagatgccaagaagagaggccggaa

SEQ ID NO: 566089 - DNA, 25 bp, Mus musculus
cagatgccaagatgagaggccggaa

SEQ ID NO: 566090 - DNA, 25 bp, Mus musculus
cagatgccactgaggacctacagaa

SEQ ID NO: 566091 - DNA, 25 bp, Mus musculus
cagatgccactgtggacctacagaa

SEQ ID NO: 566092 - DNA, 25 bp, Mus musculus
cagatgcccactcctgatagggtga

SEQ ID NO: 566093 - DNA, 25 bp, Mus musculus
cagatgcccactgctgatagggtga

SEQ ID NO: 566094 - DNA, 25 bp, Mus musculus
cagatgcccgatactggaggaacca

SEQ ID NO: 566095 - DNA, 25 bp, Mus musculus
cagatgcccgattctggaggaacca

SEQ ID NO: 566096 - DNA, 25 bp, Mus musculus
cagatgccgaagatgaacttcgcaa

SEQ ID NO: 566097 - DNA, 25 bp, Mus musculus
cagatgccgaagttgaacttcgcaa

SEQ ID NO: 566098 - DNA, 25 bp, Mus musculus
cagatgccttccctgtctagcgtgt

SEQ ID NO: 566099 - DNA, 25 bp, Mus musculus
cagatgccttccgtgtctagcgtgt

SEQ ID NO: 566100 - DNA, 25 bp, Mus musculus
cagatgcgaaggaccattacgatgc

SEQ ID NO: 566101 - DNA, 25 bp, Mus musculus
cagatgcgaaggtccattacgatgc

SEQ ID NO: 566102 - DNA, 25 bp, Mus musculus
cagatgcgtctgcagcaacagaagc

SEQ ID NO: 566103 - DNA, 25 bp, Mus musculus
cagatgcgtctggagcaacagaagc

SEQ ID NO: 566104 - DNA, 25 bp, Mus musculus
cagatgcgtgttcctgtacagcccc

SEQ ID NO: 566105 - DNA, 25 bp, Mus musculus
cagatgcgtgttgctgtacagcccc

SEQ ID NO: 566106 - DNA, 25 bp, Mus musculus
cagatgcgtttgcttcactggctaa

SEQ ID NO: 566107 - DNA, 25 bp, Mus musculus
cagatgcgtttggttcactggctaa

SEQ ID NO: 566108 - DNA, 25 bp, Mus musculus
cagatgctagtgactggaggcataa

SEQ ID NO: 566109 - DNA, 25 bp, Mus musculus
cagatgctagtgtctggaggcataa

SEQ ID NO: 566110 - DNA, 25 bp, Mus musculus
cagatgctcacaagggacgcaaaaa

SEQ ID NO: 566111 - DNA, 25 bp, Mus musculus
cagatgctcacatgggacgcaaaaa

SEQ ID NO: 566112 - DNA, 25 bp, Mus musculus
cagatgctcattctggaatgtgtgg

SEQ ID NO: 566113 - DNA, 25 bp, Mus musculus
cagatgctcattgtggaatgtgtgg

SEQ ID NO: 566114 - DNA, 25 bp, Mus musculus
cagatgctcgagacagtagcttggg

SEQ ID NO: 566115 - DNA, 25 bp, Mus musculus
cagatgctcgagtcagtagcttggg

SEQ ID NO: 566116 - DNA, 25 bp, Mus musculus
cagatgctgaatccaaagaaatggc

SEQ ID NO: 566117 - DNA, 25 bp, Mus musculus
cagatgctgaatgcaaagaaatggc

SEQ ID NO: 566118 - DNA, 25 bp, Mus musculus
cagatgctgccacaattggtgctga

SEQ ID NO: 566119 - DNA, 25 bp, Mus musculus
cagatgctgccagaattggtgctga

SEQ ID NO: 566120 - DNA, 25 bp, Mus musculus
cagatgctgcgacaacttcaggaga

SEQ ID NO: 566121 - DNA, 25 bp, Mus musculus
cagatgctgcgagaacttcaggaga

SEQ ID NO: 566122 - DNA, 25 bp, Mus musculus
cagatgctgcgtcacatttgctcca

SEQ ID NO: 566123 - DNA, 25 bp, Mus musculus
cagatgctgcgtgacatttgctcca

SEQ ID NO: 566124 - DNA, 25 bp, Mus musculus
cagatgctgctcatggcctcaaagg

SEQ ID NO: 566125 - DNA, 25 bp, Mus musculus
cagatgctgctcttggcctcaaagg

SEQ ID NO: 566126 - DNA, 25 bp, Mus musculus
cagatgctgcttatctcggccacct

SEQ ID NO: 566127 - DNA, 25 bp, Mus musculus
cagatgctgcttttctcggccacct

SEQ ID NO: 566128 - DNA, 25 bp, Mus musculus
cagatgctggacatgtggatcaagg

SEQ ID NO: 566129 - DNA, 25 bp, Mus musculus
cagatgctggacttgtggatcaagg

SEQ ID NO: 566130 - DNA, 25 bp, Mus musculus
cagatgctgggacgccgacagtacc

SEQ ID NO: 566131 - DNA, 25 bp, Mus musculus
cagatgctgggaggccgacagtacc

SEQ ID NO: 566132 - DNA, 25 bp, Mus musculus
cagatgctgggtattcacacggtgc

SEQ ID NO: 566133 - DNA, 25 bp, Mus musculus
cagatgctgggttttcacacggtgc

SEQ ID NO: 566134 - DNA, 25 bp, Mus musculus
cagatgctgtatacaccagcagcct

SEQ ID NO: 566135 - DNA, 25 bp, Mus musculus
cagatgctgtattcaccagcagcct

SEQ ID NO: 566136 - DNA, 25 bp, Mus musculus
cagatggaaatgattgttcgagcaa

SEQ ID NO: 566137 - DNA, 25 bp, Mus musculus
cagatggaaatgtttgttcgagcaa

SEQ ID NO: 566138 - DNA, 25 bp, Mus musculus
cagatggaacatcggaagagcaaat

SEQ ID NO: 566139 - DNA, 25 bp, Mus musculus
cagatggaacatgggaagagcaaat

SEQ ID NO: 566140 - DNA, 25 bp, Mus musculus
cagatggaagacagcgtccttcagc

SEQ ID NO: 566141 - DNA, 25 bp, Mus musculus
cagatggaagactgcgtccttcagc

SEQ ID NO: 566142 - DNA, 25 bp, Mus musculus
cagatggaagtacaatttatgcaga

SEQ ID NO: 566143 - DNA, 25 bp, Mus musculus
cagatggaagtagaatttatgcaga

SEQ ID NO: 566144 - DNA, 25 bp, Mus musculus
cagatggaatggatgaacaatgtag

SEQ ID NO: 566145 - DNA, 25 bp, Mus musculus
cagatggaatggttgaacaatgtag

SEQ ID NO: 566146 - DNA, 25 bp, Mus musculus
cagatggacctgagaaaggagatca

SEQ ID NO: 566147 - DNA, 25 bp, Mus musculus
cagatggacctgtgaaaggagatca

SEQ ID NO: 566148 - DNA, 25 bp, Mus musculus
cagatggactcactcgccgaggtga

SEQ ID NO: 566149 - DNA, 25 bp, Mus musculus
cagatggactcagtcgccgaggtga

SEQ ID NO: 566150 - DNA, 25 bp, Mus musculus
cagatggacttcaacatactggtgg

SEQ ID NO: 566151 - DNA, 25 bp, Mus musculus
cagatggacttctacatactggtgg

SEQ ID NO: 566152 - DNA, 25 bp, Mus musculus
cagatggagatccaaggctttgtga

SEQ ID NO: 566153 - DNA, 25 bp, Mus musculus
cagatggagatcgaaggctttgtga

SEQ ID NO: 566154 - DNA, 25 bp, Mus musculus
cagatggagatgatgcgcagccttc

SEQ ID NO: 566155 - DNA, 25 bp, Mus musculus
cagatggagatgttgcgcagccttc

SEQ ID NO: 566156 - DNA, 25 bp, Mus musculus
cagatggaggagacatggatgaact

SEQ ID NO: 566157 - DNA, 25 bp, Mus musculus
cagatggaggagtcatggatgaact

SEQ ID NO: 566158 - DNA, 25 bp, Mus musculus
cagatggaggctccctttggatgcc

SEQ ID NO: 566159 - DNA, 25 bp, Mus musculus
cagatggaggctgcctttggatgcc

SEQ ID NO: 566160 - DNA, 25 bp, Mus musculus
cagatggatcagaactaaaacccga

SEQ ID NO: 566161 - DNA, 25 bp, Mus musculus
cagatggatcagtactaaaacccga

SEQ ID NO: 566162 - DNA, 25 bp, Mus musculus
cagatggatctcatgttggcagaga

SEQ ID NO: 566163 - DNA, 25 bp, Mus musculus
cagatggatctcttgttggcagaga

SEQ ID NO: 566164 - DNA, 25 bp, Mus musculus
cagatggatcttcaatggtttctcc

SEQ ID NO: 566165 - DNA, 25 bp, Mus musculus
cagatggatcttgaatggtttctcc

SEQ ID NO: 566166 - DNA, 25 bp, Mus musculus
cagatggcacacagttgatccacaa

SEQ ID NO: 566167 - DNA, 25 bp, Mus musculus
cagatggcacactgttgatccacaa

SEQ ID NO: 566168 - DNA, 25 bp, Mus musculus
cagatggcacctatagtaagactat

SEQ ID NO: 566169 - DNA, 25 bp, Mus musculus
cagatggcacctttagtaagactat

SEQ ID NO: 566170 - DNA, 25 bp, Mus musculus
cagatggcccctcctggctattggg

SEQ ID NO: 566171 - DNA, 25 bp, Mus musculus
cagatggcccctgctggctattggg

SEQ ID NO: 566172 - DNA, 25 bp, Mus musculus
cagatggccgccacagagtgtgaac

SEQ ID NO: 566173 - DNA, 25 bp, Mus musculus
cagatggccgcctcagagtgtgaac

SEQ ID NO: 566174 - DNA, 25 bp, Mus musculus
cagatggcgcggaatggacagctaa

SEQ ID NO: 566175 - DNA, 25 bp, Mus musculus
cagatggcgcggtatggacagctaa

SEQ ID NO: 566176 - DNA, 25 bp, Mus musculus
cagatggctattactgcgggttctc

SEQ ID NO: 566177 - DNA, 25 bp, Mus musculus
cagatggctatttctgcgggttctc

SEQ ID NO: 566178 - DNA, 25 bp, Mus musculus
cagatggctcctccattcacggtag

SEQ ID NO: 566179 - DNA, 25 bp, Mus musculus
cagatggctcctgcattcacggtag

SEQ ID NO: 566180 - DNA, 25 bp, Mus musculus
cagatgggaacacatacagagaccc

SEQ ID NO: 566181 - DNA, 25 bp, Mus musculus
cagatgggaacagatacagagaccc

SEQ ID NO: 566182 - DNA, 25 bp, Mus musculus
cagatgggaaggacaccccggatga

SEQ ID NO: 566183 - DNA, 25 bp, Mus musculus
cagatgggaaggtcaccccggatga

SEQ ID NO: 566184 - DNA, 25 bp, Mus musculus
cagatgggacgtcgaaacattaagt

SEQ ID NO: 566185 - DNA, 25 bp, Mus musculus
cagatgggacgtggaaacattaagt

SEQ ID NO: 566186 - DNA, 25 bp, Mus musculus
cagatgggactgaacagcttagtgt

SEQ ID NO: 566187 - DNA, 25 bp, Mus musculus
cagatgggactgtacagcttagtgt

SEQ ID NO: 566188 - DNA, 25 bp, Mus musculus
cagatgggagtgctcctttgcagcc

SEQ ID NO: 566189 - DNA, 25 bp, Mus musculus
cagatgggagtggtcctttgcagcc

SEQ ID NO: 566190 - DNA, 25 bp, Mus musculus
cagatgggcaagatttaccctgaac

SEQ ID NO: 566191 - DNA, 25 bp, Mus musculus
cagatgggcaagttttaccctgaac

SEQ ID NO: 566192 - DNA, 25 bp, Mus musculus
cagatgggcagtccctcctgtgagc

SEQ ID NO: 566193 - DNA, 25 bp, Mus musculus
cagatgggcagtgcctcctgtgagc

SEQ ID NO: 566194 - DNA, 25 bp, Mus musculus
cagatgggcctgagcttagcacagc

SEQ ID NO: 566195 - DNA, 25 bp, Mus musculus
cagatgggcctgtgcttagcacagc

SEQ ID NO: 566196 - DNA, 25 bp, Mus musculus
cagatgggctacacgcagggcgcca

SEQ ID NO: 566197 - DNA, 25 bp, Mus musculus
cagatgggctactcgcagggcgcca

SEQ ID NO: 566198 - DNA, 25 bp, Mus musculus
cagatgggtccaccttcaacatgac

SEQ ID NO: 566199 - DNA, 25 bp, Mus musculus
cagatgggtccagcttcaacatgac

SEQ ID NO: 566200 - DNA, 25 bp, Mus musculus
cagatgggtcctaacagagatcaga

SEQ ID NO: 566201 - DNA, 25 bp, Mus musculus
cagatgggtccttacagagatcaga

SEQ ID NO: 566202 - DNA, 25 bp, Mus musculus
cagatgggttggactgatctcttca

SEQ ID NO: 566203 - DNA, 25 bp, Mus musculus
cagatgggttggtctgatctcttca

SEQ ID NO: 566204 - DNA, 25 bp, Mus musculus
cagatggtcaccagctctcagagct

SEQ ID NO: 566205 - DNA, 25 bp, Mus musculus
cagatggtcacctgctctcagagct

SEQ ID NO: 566206 - DNA, 25 bp, Mus musculus
cagatggtccctatgtaagcccagt

SEQ ID NO: 566207 - DNA, 25 bp, Mus musculus
cagatggtccctttgtaagcccagt

SEQ ID NO: 566208 - DNA, 25 bp, Mus musculus
cagatggtgttaccaggactggcct

SEQ ID NO: 566209 - DNA, 25 bp, Mus musculus
cagatggtgttagcaggactggcct

SEQ ID NO: 566210 - DNA, 25 bp, Mus musculus
cagatggttgtgagggagaaaatcc

SEQ ID NO: 566211 - DNA, 25 bp, Mus musculus
cagatggttgtgtgggagaaaatcc

SEQ ID NO: 566212 - DNA, 25 bp, Mus musculus
cagatgtaaataccaaaaagacgtt

SEQ ID NO: 566213 - DNA, 25 bp, Mus musculus
cagatgtaaatagcaaaaagacgtt

SEQ ID NO: 566214 - DNA, 25 bp, Mus musculus
cagatgtacaacctggaaactacat

SEQ ID NO: 566215 - DNA, 25 bp, Mus musculus
cagatgtacaacgtggaaactacat

SEQ ID NO: 566216 - DNA, 25 bp, Mus musculus
cagatgtactatcagctgggtgtag

SEQ ID NO: 566217 - DNA, 25 bp, Mus musculus
cagatgtactatgagctgggtgtag

SEQ ID NO: 566218 - DNA, 25 bp, Mus musculus
cagatgtagtgaaaggaaggcccag

SEQ ID NO: 566219 - DNA, 25 bp, Mus musculus
cagatgtagtgataggaaggcccag

SEQ ID NO: 566220 - DNA, 25 bp, Mus musculus
cagatgtatatcaagctggttttaa

SEQ ID NO: 566221 - DNA, 25 bp, Mus musculus
cagatgtatatctagctggttttaa

SEQ ID NO: 566222 - DNA, 25 bp, Mus musculus
cagatgtatcccatgcccgctttta

SEQ ID NO: 566223 - DNA, 25 bp, Mus musculus
cagatgtatcccttgcccgctttta

SEQ ID NO: 566224 - DNA, 25 bp, Mus musculus
cagatgtcactgacactcatcccga

SEQ ID NO: 566225 - DNA, 25 bp, Mus musculus
cagatgtcactgtcactcatcccga

SEQ ID NO: 566226 - DNA, 25 bp, Mus musculus
cagatgtcagcacccgcatcgagaa

SEQ ID NO: 566227 - DNA, 25 bp, Mus musculus
cagatgtcagcagccgcatcgagaa

SEQ ID NO: 566228 - DNA, 25 bp, Mus musculus
cagatgtcagccagggaagcctggc

SEQ ID NO: 566229 - DNA, 25 bp, Mus musculus
cagatgtcagcctgggaagcctggc

SEQ ID NO: 566230 - DNA, 25 bp, Mus musculus
cagatgtccactctccaagctttat

SEQ ID NO: 566231 - DNA, 25 bp, Mus musculus
cagatgtccactgtccaagctttat

SEQ ID NO: 566232 - DNA, 25 bp, Mus musculus
cagatgtctgtcactatggtcagca

SEQ ID NO: 566233 - DNA, 25 bp, Mus musculus
cagatgtctgtctctatggtcagca

SEQ ID NO: 566234 - DNA, 25 bp, Mus musculus
cagatgtgaagccaggaaactacat

SEQ ID NO: 566235 - DNA, 25 bp, Mus musculus
cagatgtgaagcgaggaaactacat

SEQ ID NO: 566236 - DNA, 25 bp, Mus musculus
cagatgtgaatgaggcaacatgtaa

SEQ ID NO: 566237 - DNA, 25 bp, Mus musculus
cagatgtgaatgatttccagaggaa

SEQ ID NO: 566238 - DNA, 25 bp, Mus musculus
cagatgtgaatgtggcaacatgtaa

SEQ ID NO: 566239 - DNA, 25 bp, Mus musculus
cagatgtgaatgttttccagaggaa

SEQ ID NO: 566240 - DNA, 25 bp, Mus musculus
cagatgtgatgtccaaccccttcta

SEQ ID NO: 566241 - DNA, 25 bp, Mus musculus
cagatgtgatgtgcaaccccttcta

SEQ ID NO: 566242 - DNA, 25 bp, Mus musculus
cagatgtgccgacttcggaatggct

SEQ ID NO: 566243 - DNA, 25 bp, Mus musculus
cagatgtgccgagttcggaatggct

SEQ ID NO: 566244 - DNA, 25 bp, Mus musculus
cagatgtgctagctgttcacgaagc

SEQ ID NO: 566245 - DNA, 25 bp, Mus musculus
cagatgtgctaggtgttcacgaagc

SEQ ID NO: 566246 - DNA, 25 bp, Mus musculus
cagatgtgctcacctataggacagc

SEQ ID NO: 566247 - DNA, 25 bp, Mus musculus
cagatgtgctcagctataggacagc

SEQ ID NO: 566248 - DNA, 25 bp, Mus musculus
cagatgtgctcgagtttctccagga

SEQ ID NO: 566249 - DNA, 25 bp, Mus musculus
cagatgtgctcgtgtttctccagga

SEQ ID NO: 566250 - DNA, 25 bp, Mus musculus
cagatgtggcaaaacagctgaacaa

SEQ ID NO: 566251 - DNA, 25 bp, Mus musculus
cagatgtggcaatacagctgaacaa

SEQ ID NO: 566252 - DNA, 25 bp, Mus musculus
cagatgtggtgtattgtccccgtcc

SEQ ID NO: 566253 - DNA, 25 bp, Mus musculus
cagatgtggtgttttgtccccgtcc

SEQ ID NO: 566254 - DNA, 25 bp, Mus musculus
cagatgtgtaatcacaaagagcggt

SEQ ID NO: 566255 - DNA, 25 bp, Mus musculus
cagatgtgtaatctgcctgtcaaag

SEQ ID NO: 566256 - DNA, 25 bp, Mus musculus
cagatgtgtaatgacaaagagcggt

SEQ ID NO: 566257 - DNA, 25 bp, Mus musculus
cagatgtgtaatgtgcctgtcaaag

SEQ ID NO: 566258 - DNA, 25 bp, Mus musculus
cagatgtgtcagaagtctcttggac

SEQ ID NO: 566259 - DNA, 25 bp, Mus musculus
cagatgtgtcagtagtctcttggac

SEQ ID NO: 566260 - DNA, 25 bp, Mus musculus
cagatgtgtgagaggccccgaccca

SEQ ID NO: 566261 - DNA, 25 bp, Mus musculus
cagatgtgtgagtggccccgaccca

SEQ ID NO: 566262 - DNA, 25 bp, Mus musculus
cagatgttcagcactaacagcttca

SEQ ID NO: 566263 - DNA, 25 bp, Mus musculus
cagatgttcagctctaacagcttca

SEQ ID NO: 566264 - DNA, 25 bp, Mus musculus
cagatgttgcagatgttctacttca

SEQ ID NO: 566265 - DNA, 25 bp, Mus musculus
cagatgttgcagttgttctacttca

SEQ ID NO: 566266 - DNA, 25 bp, Mus musculus
cagatgtttattcgagatggcgcca

SEQ ID NO: 566267 - DNA, 25 bp, Mus musculus
cagatgtttattggagatggcgcca

SEQ ID NO: 566268 - DNA, 25 bp, Mus musculus
cagatgtttggaccacaagtgctta

SEQ ID NO: 566269 - DNA, 25 bp, Mus musculus
cagatgtttggagcacaagtgctta

SEQ ID NO: 566270 - DNA, 25 bp, Mus musculus
cagatgtttgtccagagagtcaaag

SEQ ID NO: 566271 - DNA, 25 bp, Mus musculus
cagatgtttgtcgagagagtcaaag

SEQ ID NO: 566272 - DNA, 25 bp, Mus musculus
cagattaaaaagaagaccctgaatc

SEQ ID NO: 566273 - DNA, 25 bp, Mus musculus
cagattaaaaagtagaccctgaatc

SEQ ID NO: 566274 - DNA, 25 bp, Mus musculus
cagattaaacaaagtccctgagtac

SEQ ID NO: 566275 - DNA, 25 bp, Mus musculus
cagattaaacaatgtccctgagtac

SEQ ID NO: 566276 - DNA, 25 bp, Mus musculus
cagattaacgttccttagttaccac

SEQ ID NO: 566277 - DNA, 25 bp, Mus musculus
cagattaacgttgcttagttaccac

SEQ ID NO: 566278 - DNA, 25 bp, Mus musculus
cagattaaggtcctgatgaagaacg

SEQ ID NO: 566279 - DNA, 25 bp, Mus musculus
cagattaaggtcgtgatgaagaacg

SEQ ID NO: 566280 - DNA, 25 bp, Mus musculus
cagattacaacactgccctggatgt

SEQ ID NO: 566281 - DNA, 25 bp, Mus musculus
cagattacaacagtgccctggatgt

SEQ ID NO: 566282 - DNA, 25 bp, Mus musculus
cagattacaagtcgctaaactgcac

SEQ ID NO: 566283 - DNA, 25 bp, Mus musculus
cagattacaagtggctaaactgcac

SEQ ID NO: 566284 - DNA, 25 bp, Mus musculus
cagattaccctgcagatgacgggtc

SEQ ID NO: 566285 - DNA, 25 bp, Mus musculus
cagattaccctggagatgacgggtc

SEQ ID NO: 566286 - DNA, 25 bp, Mus musculus
cagattatggacagtgtgaaatcca

SEQ ID NO: 566287 - DNA, 25 bp, Mus musculus
cagattatggactgtgtgaaatcca

SEQ ID NO: 566288 - DNA, 25 bp, Mus musculus
cagattatgtgtatgatggcacaaa

SEQ ID NO: 566289 - DNA, 25 bp, Mus musculus
cagattatgtgtttgatggcacaaa

SEQ ID NO: 566290 - DNA, 25 bp, Mus musculus
cagattcaacagatgaaattggatc

SEQ ID NO: 566291 - DNA, 25 bp, Mus musculus
cagattcaacagttgaaattggatc

SEQ ID NO: 566292 - DNA, 25 bp, Mus musculus
cagattcaggacacagagatggtcc

SEQ ID NO: 566293 - DNA, 25 bp, Mus musculus
cagattcaggactcagagatggtcc

SEQ ID NO: 566294 - DNA, 25 bp, Mus musculus
cagattcaggagctattcaaccagt

SEQ ID NO: 566295 - DNA, 25 bp, Mus musculus
cagattcaggaggtattcaaccagt

SEQ ID NO: 566296 - DNA, 25 bp, Mus musculus
cagattcatgatctcccggcagacc

SEQ ID NO: 566297 - DNA, 25 bp, Mus musculus
cagattcatgatgtcccggcagacc

SEQ ID NO: 566298 - DNA, 25 bp, Mus musculus
cagattcatgcacactgatcccaac

SEQ ID NO: 566299 - DNA, 25 bp, Mus musculus
cagattcatgcagactgatcccaac

SEQ ID NO: 566300 - DNA, 25 bp, Mus musculus
cagattccagaaaatgggctgacct

SEQ ID NO: 566301 - DNA, 25 bp, Mus musculus
cagattccagaatatgggctgacct

SEQ ID NO: 566302 - DNA, 25 bp, Mus musculus
cagattcccgctaggctcaggctgg

SEQ ID NO: 566303 - DNA, 25 bp, Mus musculus
cagattcccgcttggctcaggctgg

SEQ ID NO: 566304 - DNA, 25 bp, Mus musculus
cagattcctcttaatctatcagcag

SEQ ID NO: 566305 - DNA, 25 bp, Mus musculus
cagattcctctttatctatcagcag

SEQ ID NO: 566306 - DNA, 25 bp, Mus musculus
cagattcggagacccaatccccatt

SEQ ID NO: 566307 - DNA, 25 bp, Mus musculus
cagattcggagagccaatccccatt

SEQ ID NO: 566308 - DNA, 25 bp, Mus musculus
cagattctaacacagttgctgggac

SEQ ID NO: 566309 - DNA, 25 bp, Mus musculus
cagattctaacagagttgctgggac

SEQ ID NO: 566310 - DNA, 25 bp, Mus musculus
cagattctagaacttagagaaaacc

SEQ ID NO: 566311 - DNA, 25 bp, Mus musculus
cagattctagaagttagagaaaacc

SEQ ID NO: 566312 - DNA, 25 bp, Mus musculus
cagattctctgtctttgtcagtgag

SEQ ID NO: 566313 - DNA, 25 bp, Mus musculus
cagattctctgtgtttgtcagtgag

SEQ ID NO: 566314 - DNA, 25 bp, Mus musculus
cagattctgagcaacaagttcctca

SEQ ID NO: 566315 - DNA, 25 bp, Mus musculus
cagattctgagctacaagttcctca

SEQ ID NO: 566316 - DNA, 25 bp, Mus musculus
cagattctgagtccaccgtggagcc

SEQ ID NO: 566317 - DNA, 25 bp, Mus musculus
cagattctgagtgcaccgtggagcc

SEQ ID NO: 566318 - DNA, 25 bp, Mus musculus
cagattctgcatcacagcctagtga

SEQ ID NO: 566319 - DNA, 25 bp, Mus musculus
cagattctgcatgacagcctagtga

SEQ ID NO: 566320 - DNA, 25 bp, Mus musculus
cagattctgtcacagacgagggaga

SEQ ID NO: 566321 - DNA, 25 bp, Mus musculus
cagattctgtcagagacgagggaga

SEQ ID NO: 566322 - DNA, 25 bp, Mus musculus
cagattcttcgaacgccagctcaga

SEQ ID NO: 566323 - DNA, 25 bp, Mus musculus
cagattcttcgatcgccagctcaga

SEQ ID NO: 566324 - DNA, 25 bp, Mus musculus
cagattcttgaccaaaatgtggcac

SEQ ID NO: 566325 - DNA, 25 bp, Mus musculus
cagattcttgacgaaaatgtggcac

SEQ ID NO: 566326 - DNA, 25 bp, Mus musculus
cagattgaaaaacctgaataccgga

SEQ ID NO: 566327 - DNA, 25 bp, Mus musculus
cagattgaaaaagctgaataccgga

SEQ ID NO: 566328 - DNA, 25 bp, Mus musculus
cagattgacagcctggttcgagcct

SEQ ID NO: 566329 - DNA, 25 bp, Mus musculus
cagattgacagcgtggttcgagcct

SEQ ID NO: 566330 - DNA, 25 bp, Mus musculus
cagattgacgtcataacagagttag

SEQ ID NO: 566331 - DNA, 25 bp, Mus musculus
cagattgacgtcttaacagagttag

SEQ ID NO: 566332 - DNA, 25 bp, Mus musculus
cagattgacttactagagcgtctta

SEQ ID NO: 566333 - DNA, 25 bp, Mus musculus
cagattgacttagtagagcgtctta

SEQ ID NO: 566334 - DNA, 25 bp, Mus musculus
cagattgcatcaaagattgcacttc

SEQ ID NO: 566335 - DNA, 25 bp, Mus musculus
cagattgcatcatagattgcacttc

SEQ ID NO: 566336 - DNA, 25 bp, Mus musculus
cagattgcgattcctggacatgagc

SEQ ID NO: 566337 - DNA, 25 bp, Mus musculus
cagattgcgattgctggacatgagc

SEQ ID NO: 566338 - DNA, 25 bp, Mus musculus
cagattgcgtctaccctgtctaaag

SEQ ID NO: 566339 - DNA, 25 bp, Mus musculus
cagattgcgtcttccctgtctaaag

SEQ ID NO: 566340 - DNA, 25 bp, Mus musculus
cagattgctgatcaaaagctactcc

SEQ ID NO: 566341 - DNA, 25 bp, Mus musculus
cagattgctgatgaaaagctactcc

SEQ ID NO: 566342 - DNA, 25 bp, Mus musculus
cagattggcttaagtttgccagaat

SEQ ID NO: 566343 - DNA, 25 bp, Mus musculus
cagattggcttatgtttgccagaat

SEQ ID NO: 566344 - DNA, 25 bp, Mus musculus
cagattggctttcaggtaagtacag

SEQ ID NO: 566345 - DNA, 25 bp, Mus musculus
cagattggctttgaggtaagtacag

SEQ ID NO: 566346 - DNA, 25 bp, Mus musculus
cagattgggagcagtgtaactcgtc

SEQ ID NO: 566347 - DNA, 25 bp, Mus musculus
cagattgggagctgtgtaactcgtc

SEQ ID NO: 566348 - DNA, 25 bp, Mus musculus
cagattgtactacctccatgagagc

SEQ ID NO: 566349 - DNA, 25 bp, Mus musculus
cagattgtactagctccatgagagc

SEQ ID NO: 566350 - DNA, 25 bp, Mus musculus
cagattgtcagcacttcagcctcaa

SEQ ID NO: 566351 - DNA, 25 bp, Mus musculus
cagattgtcagctcttcagcctcaa

SEQ ID NO: 566352 - DNA, 25 bp, Mus musculus
cagattgtggaaacctacaccgagg

SEQ ID NO: 566353 - DNA, 25 bp, Mus musculus
cagattgtggaatcctacaccgagg

SEQ ID NO: 566354 - DNA, 25 bp, Mus musculus
cagattgttcggctgctccaggaac

SEQ ID NO: 566355 - DNA, 25 bp, Mus musculus
cagattgttcgggtgctccaggaac

SEQ ID NO: 566356 - DNA, 25 bp, Mus musculus
cagattgtttatagcattggcggag

SEQ ID NO: 566357 - DNA, 25 bp, Mus musculus
cagattgtttattgcattggcggag

SEQ ID NO: 566358 - DNA, 25 bp, Mus musculus
cagatttactctctgtgttgcataa

SEQ ID NO: 566359 - DNA, 25 bp, Mus musculus
cagatttactctgtgtgttgcataa

SEQ ID NO: 566360 - DNA, 25 bp, Mus musculus
cagatttacttaactgatccagact

SEQ ID NO: 566361 - DNA, 25 bp, Mus musculus
cagatttacttatctgatccagact

SEQ ID NO: 566362 - DNA, 25 bp, Mus musculus
cagatttatcagcaccgagaccagt

SEQ ID NO: 566363 - DNA, 25 bp, Mus musculus
cagatttatcaggaccgagaccagt

SEQ ID NO: 566364 - DNA, 25 bp, Mus musculus
cagatttcatccatcagcagcgaac

SEQ ID NO: 566365 - DNA, 25 bp, Mus musculus
cagatttcatccttcagcagcgaac

SEQ ID NO: 566366 - DNA, 25 bp, Mus musculus
cagatttcatggatagtcagccctg

SEQ ID NO: 566367 - DNA, 25 bp, Mus musculus
cagatttcatggttagtcagccctg

SEQ ID NO: 566368 - DNA, 25 bp, Mus musculus
cagatttctacaccaacgggttggg

SEQ ID NO: 566369 - DNA, 25 bp, Mus musculus
cagatttctacagcaacgggttggg

SEQ ID NO: 566370 - DNA, 25 bp, Mus musculus
cagatttctgttacgaatgtgttgg

SEQ ID NO: 566371 - DNA, 25 bp, Mus musculus
cagatttctgtttcgaatgtgttgg

SEQ ID NO: 566372 - DNA, 25 bp, Mus musculus
cagatttcttcgacccaatctcaca

SEQ ID NO: 566373 - DNA, 25 bp, Mus musculus
cagatttcttcgtcccaatctcaca

SEQ ID NO: 566374 - DNA, 25 bp, Mus musculus
cagatttgaatactcgacatggttg

SEQ ID NO: 566375 - DNA, 25 bp, Mus musculus
cagatttgaatagtcgacatggttg

SEQ ID NO: 566376 - DNA, 25 bp, Mus musculus
cagatttgacaactcatgagataag

SEQ ID NO: 566377 - DNA, 25 bp, Mus musculus
cagatttgacaagtcatgagataag

SEQ ID NO: 566378 - DNA, 25 bp, Mus musculus
cagatttgctgtcaatacaatcaac

SEQ ID NO: 566379 - DNA, 25 bp, Mus musculus
cagatttgctgtgaatacaatcaac

SEQ ID NO: 566380 - DNA, 25 bp, Mus musculus
cagatttggagaagaactattgtac

SEQ ID NO: 566381 - DNA, 25 bp, Mus musculus
cagatttggagatgaactattgtac

SEQ ID NO: 566382 - DNA, 25 bp, Mus musculus
cagatttggtatctaagcctgtccc

SEQ ID NO: 566383 - DNA, 25 bp, Mus musculus
cagatttggtatgtaagcctgtccc

SEQ ID NO: 566384 - DNA, 25 bp, Mus musculus
cagattttaagtcggcaggtgtcac

SEQ ID NO: 566385 - DNA, 25 bp, Mus musculus
cagattttaagtgggcaggtgtcac

SEQ ID NO: 566386 - DNA, 25 bp, Mus musculus
cagattttgaaaacccgtacttaca

SEQ ID NO: 566387 - DNA, 25 bp, Mus musculus
cagattttgaaaacgttgatggaag

SEQ ID NO: 566388 - DNA, 25 bp, Mus musculus
cagattttgaaatcccgtacttaca

SEQ ID NO: 566389 - DNA, 25 bp, Mus musculus
cagattttgaaatcgttgatggaag

SEQ ID NO: 566390 - DNA, 25 bp, Mus musculus
cagattttgccacagtgtgtgttgc

SEQ ID NO: 566391 - DNA, 25 bp, Mus musculus
cagattttgccagagtgtgtgttgc

SEQ ID NO: 566392 - DNA, 25 bp, Mus musculus
cagattttggagctagactgtgtca

SEQ ID NO: 566393 - DNA, 25 bp, Mus musculus
cagattttggaggtagactgtgtca

SEQ ID NO: 566394 - DNA, 25 bp, Mus musculus
cagatttttatgagagggcacaagc

SEQ ID NO: 566395 - DNA, 25 bp, Mus musculus
cagatttttatgtgagggcacaagc

SEQ ID NO: 566396 - DNA, 25 bp, Mus musculus
cagcaaaaactcaagccgtttcagg

SEQ ID NO: 566397 - DNA, 25 bp, Mus musculus
cagcaaaaactctagccgtttcagg

SEQ ID NO: 566398 - DNA, 25 bp, Mus musculus
cagcaaaaatcaaatgactctgcct

SEQ ID NO: 566399 - DNA, 25 bp, Mus musculus
cagcaaaaatcacctgtgcgagatt

SEQ ID NO: 566400 - DNA, 25 bp, Mus musculus
cagcaaaaatcagctgtgcgagatt

SEQ ID NO: 566401 - DNA, 25 bp, Mus musculus
cagcaaaaatcatatgactctgcct

SEQ ID NO: 566402 - DNA, 25 bp, Mus musculus
cagcaaaagatacgaggcaacagcc

SEQ ID NO: 566403 - DNA, 25 bp, Mus musculus
cagcaaaagataggaggcaacagcc

SEQ ID NO: 566404 - DNA, 25 bp, Mus musculus
cagcaaaagtaacgagtctatttgg

SEQ ID NO: 566405 - DNA, 25 bp, Mus musculus
cagcaaaagtaaggagtctatttgg

SEQ ID NO: 566406 - DNA, 25 bp, Mus musculus
cagcaaaagtatctactggcggaga

SEQ ID NO: 566407 - DNA, 25 bp, Mus musculus
cagcaaaagtatgtactggcggaga

SEQ ID NO: 566408 - DNA, 25 bp, Mus musculus
cagcaaaattccacctctaccttgg

SEQ ID NO: 566409 - DNA, 25 bp, Mus musculus
cagcaaaattcctcctctaccttgg

SEQ ID NO: 566410 - DNA, 25 bp, Mus musculus
cagcaaacaagaccctaaggaaggc

SEQ ID NO: 566411 - DNA, 25 bp, Mus musculus
cagcaaacaagagcctaaggaaggc

SEQ ID NO: 566412 - DNA, 25 bp, Mus musculus
cagcaaaccatcaaaggaacaaagc

SEQ ID NO: 566413 - DNA, 25 bp, Mus musculus
cagcaaaccatctaaggaacaaagc

SEQ ID NO: 566414 - DNA, 25 bp, Mus musculus
cagcaaacgtctcgcaacctgagtt

SEQ ID NO: 566415 - DNA, 25 bp, Mus musculus
cagcaaacgtctggcaacctgagtt

SEQ ID NO: 566416 - DNA, 25 bp, Mus musculus
cagcaaactacaaaatggattgatg

SEQ ID NO: 566417 - DNA, 25 bp, Mus musculus
cagcaaactacataatggattgatg

SEQ ID NO: 566418 - DNA, 25 bp, Mus musculus
cagcaaactccaccttatggaaaag

SEQ ID NO: 566419 - DNA, 25 bp, Mus musculus
cagcaaactccagcttatggaaaag

SEQ ID NO: 566420 - DNA, 25 bp, Mus musculus
cagcaaactcccaagcagagtgaat

SEQ ID NO: 566421 - DNA, 25 bp, Mus musculus
cagcaaactccctagcagagtgaat

SEQ ID NO: 566422 - DNA, 25 bp, Mus musculus
cagcaaagagccctacatgaagatc

SEQ ID NO: 566423 - DNA, 25 bp, Mus musculus
cagcaaagagccgtacatgaagatc

SEQ ID NO: 566424 - DNA, 25 bp, Mus musculus
cagcaaagatcactttccagaggtc

SEQ ID NO: 566425 - DNA, 25 bp, Mus musculus
cagcaaagatcagtttccagaggtc

SEQ ID NO: 566426 - DNA, 25 bp, Mus musculus
cagcaaagcacactgggtaacacgg

SEQ ID NO: 566427 - DNA, 25 bp, Mus musculus
cagcaaagcacagtgggtaacacgg

SEQ ID NO: 566428 - DNA, 25 bp, Mus musculus
cagcaaagccagcagagttggagcc

SEQ ID NO: 566429 - DNA, 25 bp, Mus musculus
cagcaaagccaggagagttggagcc

SEQ ID NO: 566430 - DNA, 25 bp, Mus musculus
cagcaaagccatcgttctacagaag

SEQ ID NO: 566431 - DNA, 25 bp, Mus musculus
cagcaaagccatggttctacagaag

SEQ ID NO: 566432 - DNA, 25 bp, Mus musculus
cagcaaagggcacgatgtattatac

SEQ ID NO: 566433 - DNA, 25 bp, Mus musculus
cagcaaagggcaggatgtattatac

SEQ ID NO: 566434 - DNA, 25 bp, Mus musculus
cagcaaagtttgatccttcttcgaa

SEQ ID NO: 566435 - DNA, 25 bp, Mus musculus
cagcaaagtttgttccttcttcgaa

SEQ ID NO: 566436 - DNA, 25 bp, Mus musculus
cagcaaatacttcggtgttatcaca

SEQ ID NO: 566437 - DNA, 25 bp, Mus musculus
cagcaaatacttgggtgttatcaca

SEQ ID NO: 566438 - DNA, 25 bp, Mus musculus
cagcaaatgctgcacttcgcaggcc

SEQ ID NO: 566439 - DNA, 25 bp, Mus musculus
cagcaaatgctggacttcgcaggcc

SEQ ID NO: 566440 - DNA, 25 bp, Mus musculus
cagcaaatggtgagtttaaatcccg

SEQ ID NO: 566441 - DNA, 25 bp, Mus musculus
cagcaaatggtgtgtttaaatcccg

SEQ ID NO: 566442 - DNA, 25 bp, Mus musculus
cagcaaattctgcacattcacaaga

SEQ ID NO: 566443 - DNA, 25 bp, Mus musculus
cagcaaattctggacattcacaaga

SEQ ID NO: 566444 - DNA, 25 bp, Mus musculus
cagcaacaaattacagcctggaaag

SEQ ID NO: 566445 - DNA, 25 bp, Mus musculus
cagcaacaaatttcagcctggaaag

SEQ ID NO: 566446 - DNA, 25 bp, Mus musculus
cagcaacaagaaactcagagacagg

SEQ ID NO: 566447 - DNA, 25 bp, Mus musculus
cagcaacaagaatctcagagacagg

SEQ ID NO: 566448 - DNA, 25 bp, Mus musculus
cagcaacacagcacgttatgccgct

SEQ ID NO: 566449 - DNA, 25 bp, Mus musculus
cagcaacacagctcgttatgccgct

SEQ ID NO: 566450 - DNA, 25 bp, Mus musculus
cagcaacaggagagaagagatggac

SEQ ID NO: 566451 - DNA, 25 bp, Mus musculus
cagcaacaggagtgaagagatggac

SEQ ID NO: 566452 - DNA, 25 bp, Mus musculus
cagcaacagtacagtcaactcctct

SEQ ID NO: 566453 - DNA, 25 bp, Mus musculus
cagcaacagtactgtcaactcctct

SEQ ID NO: 566454 - DNA, 25 bp, Mus musculus
cagcaacagttactgctacagcagg

SEQ ID NO: 566455 - DNA, 25 bp, Mus musculus
cagcaacagttactggaggatacgg

SEQ ID NO: 566456 - DNA, 25 bp, Mus musculus
cagcaacagttagtgctacagcagg

SEQ ID NO: 566457 - DNA, 25 bp, Mus musculus
cagcaacagttagtggaggatacgg

SEQ ID NO: 566458 - DNA, 25 bp, Mus musculus
cagcaacatagacgagttcgcagag

SEQ ID NO: 566459 - DNA, 25 bp, Mus musculus
cagcaacatagaggagttcgcagag

SEQ ID NO: 566460 - DNA, 25 bp, Mus musculus
cagcaacatcaaagaccgaagtaaa

SEQ ID NO: 566461 - DNA, 25 bp, Mus musculus
cagcaacatcaatgaccgaagtaaa

SEQ ID NO: 566462 - DNA, 25 bp, Mus musculus
cagcaacatcggcagcggtcatttt

SEQ ID NO: 566463 - DNA, 25 bp, Mus musculus
cagcaacatcgggagcggtcatttt

SEQ ID NO: 566464 - DNA, 25 bp, Mus musculus
cagcaaccagatccacagcaaggat

SEQ ID NO: 566465 - DNA, 25 bp, Mus musculus
cagcaaccagatgcacagcaaggat

SEQ ID NO: 566466 - DNA, 25 bp, Mus musculus
cagcaacctagcagtgaacgaagac

SEQ ID NO: 566467 - DNA, 25 bp, Mus musculus
cagcaacctagctgtgaacgaagac

SEQ ID NO: 566468 - DNA, 25 bp, Mus musculus
cagcaacctcggcatgctgggagct

SEQ ID NO: 566469 - DNA, 25 bp, Mus musculus
cagcaacctcgggatgctgggagct

SEQ ID NO: 566470 - DNA, 25 bp, Mus musculus
cagcaacgacctctatgaactccag

SEQ ID NO: 566471 - DNA, 25 bp, Mus musculus
cagcaacgacctgtatgaactccag

SEQ ID NO: 566472 - DNA, 25 bp, Mus musculus
cagcaacggtggacatccaggtgga

SEQ ID NO: 566473 - DNA, 25 bp, Mus musculus
cagcaacggtggtcatccaggtgga

SEQ ID NO: 566474 - DNA, 25 bp, Mus musculus
cagcaactccacagagtgagtacta

SEQ ID NO: 566475 - DNA, 25 bp, Mus musculus
cagcaactccactgagtgagtacta

SEQ ID NO: 566476 - DNA, 25 bp, Mus musculus
cagcaactctgaaaatagaacataa

SEQ ID NO: 566477 - DNA, 25 bp, Mus musculus
cagcaactctgataatagaacataa

SEQ ID NO: 566478 - DNA, 25 bp, Mus musculus
cagcaactgaacaatggatttttct

SEQ ID NO: 566479 - DNA, 25 bp, Mus musculus
cagcaactgaactatggatttttct

SEQ ID NO: 566480 - DNA, 25 bp, Mus musculus
cagcaactggtacagcattactcag

SEQ ID NO: 566481 - DNA, 25 bp, Mus musculus
cagcaactggtagagcattactcag

SEQ ID NO: 566482 - DNA, 25 bp, Mus musculus
cagcaactggtgaaagagttcttca

SEQ ID NO: 566483 - DNA, 25 bp, Mus musculus
cagcaactggtgtaagagttcttca

SEQ ID NO: 566484 - DNA, 25 bp, Mus musculus
cagcaactgtgacagaggcctttgt

SEQ ID NO: 566485 - DNA, 25 bp, Mus musculus
cagcaactgtgagagaggcctttgt

SEQ ID NO: 566486 - DNA, 25 bp, Mus musculus
cagcaactgttaatattgagatcac

SEQ ID NO: 566487 - DNA, 25 bp, Mus musculus
cagcaactgttattattgagatcac

SEQ ID NO: 566488 - DNA, 25 bp, Mus musculus
cagcaacttaaaccgggagcgcatg

SEQ ID NO: 566489 - DNA, 25 bp, Mus musculus
cagcaacttaaagcgggagcgcatg

SEQ ID NO: 566490 - DNA, 25 bp, Mus musculus
cagcaactttcgagaagtgcgagga

SEQ ID NO: 566491 - DNA, 25 bp, Mus musculus
cagcaactttcgtgaagtgcgagga

SEQ ID NO: 566492 - DNA, 25 bp, Mus musculus
cagcaactttgtctcctgttcagac

SEQ ID NO: 566493 - DNA, 25 bp, Mus musculus
cagcaactttgtgtcctgttcagac

SEQ ID NO: 566494 - DNA, 25 bp, Mus musculus
cagcaagaaaggaaggtgccagtag

SEQ ID NO: 566495 - DNA, 25 bp, Mus musculus
cagcaagaaaggtaggtgccagtag

SEQ ID NO: 566496 - DNA, 25 bp, Mus musculus
cagcaagaaataccccggcttcctg

SEQ ID NO: 566497 - DNA, 25 bp, Mus musculus
cagcaagaaatagcccggcttcctg

SEQ ID NO: 566498 - DNA, 25 bp, Mus musculus
cagcaagacgacattcaggaaggga

SEQ ID NO: 566499 - DNA, 25 bp, Mus musculus
cagcaagacgactttcaggaaggga

SEQ ID NO: 566500 - DNA, 25 bp, Mus musculus
cagcaagacgtcagccaagtacctg

SEQ ID NO: 566501 - DNA, 25 bp, Mus musculus
cagcaagacgtctgccaagtacctg

SEQ ID NO: 566502 - DNA, 25 bp, Mus musculus
cagcaagactatctgatttcaaatc

SEQ ID NO: 566503 - DNA, 25 bp, Mus musculus
cagcaagactatgtgatttcaaatc

SEQ ID NO: 566504 - DNA, 25 bp, Mus musculus
cagcaagagatacacggaggaagcc

SEQ ID NO: 566505 - DNA, 25 bp, Mus musculus
cagcaagagatagacggaggaagcc

SEQ ID NO: 566506 - DNA, 25 bp, Mus musculus
cagcaagagcgccaagcaggctttg

SEQ ID NO: 566507 - DNA, 25 bp, Mus musculus
cagcaagagcgcgaagcaggctttg

SEQ ID NO: 566508 - DNA, 25 bp, Mus musculus
cagcaagagtgacgtgaagtcactg

SEQ ID NO: 566509 - DNA, 25 bp, Mus musculus
cagcaagagtgaggtgaagtcactg

SEQ ID NO: 566510 - DNA, 25 bp, Mus musculus
cagcaagatccgctcagtgggcaga

SEQ ID NO: 566511 - DNA, 25 bp, Mus musculus
cagcaagatccggtcagtgggcaga

SEQ ID NO: 566512 - DNA, 25 bp, Mus musculus
cagcaagatgacagttgctaacgag

SEQ ID NO: 566513 - DNA, 25 bp, Mus musculus
cagcaagatgactgttgctaacgag

SEQ ID NO: 566514 - DNA, 25 bp, Mus musculus
cagcaagatgtccagatggcaattt

SEQ ID NO: 566515 - DNA, 25 bp, Mus musculus
cagcaagatgtcgagatggcaattt

SEQ ID NO: 566516 - DNA, 25 bp, Mus musculus
cagcaagatttgcttatagactacc

SEQ ID NO: 566517 - DNA, 25 bp, Mus musculus
cagcaagatttggttatagactacc

SEQ ID NO: 566518 - DNA, 25 bp, Mus musculus
cagcaagcacagcatgaatatcctc

SEQ ID NO: 566519 - DNA, 25 bp, Mus musculus
cagcaagcacaggatgaatatcctc

SEQ ID NO: 566520 - DNA, 25 bp, Mus musculus
cagcaagcagggacgccatgatcct

SEQ ID NO: 566521 - DNA, 25 bp, Mus musculus
cagcaagcagggtcgccatgatcct

SEQ ID NO: 566522 - DNA, 25 bp, Mus musculus
cagcaagcattcaacaacgatccct

SEQ ID NO: 566523 - DNA, 25 bp, Mus musculus
cagcaagcattctacaacgatccct

SEQ ID NO: 566524 - DNA, 25 bp, Mus musculus
cagcaagcattgatggccaagaagg

SEQ ID NO: 566525 - DNA, 25 bp, Mus musculus
cagcaagcattgttggccaagaagg

SEQ ID NO: 566526 - DNA, 25 bp, Mus musculus
cagcaagccatgaccttagggtgag

SEQ ID NO: 566527 - DNA, 25 bp, Mus musculus
cagcaagccatgtccttagggtgag

SEQ ID NO: 566528 - DNA, 25 bp, Mus musculus
cagcaagcccctagagaagtcagaa

SEQ ID NO: 566529 - DNA, 25 bp, Mus musculus
cagcaagccccttgagaagtcagaa

SEQ ID NO: 566530 - DNA, 25 bp, Mus musculus
cagcaagcccgaaaagatgctgaag

SEQ ID NO: 566531 - DNA, 25 bp, Mus musculus
cagcaagcccgataagatgctgaag

SEQ ID NO: 566532 - DNA, 25 bp, Mus musculus
cagcaagccttccttacgttgagcg

SEQ ID NO: 566533 - DNA, 25 bp, Mus musculus
cagcaagccttcgttacgttgagcg

SEQ ID NO: 566534 - DNA, 25 bp, Mus musculus
cagcaagctcagaggcaccaggtaa

SEQ ID NO: 566535 - DNA, 25 bp, Mus musculus
cagcaagctcagtggcaccaggtaa

SEQ ID NO: 566536 - DNA, 25 bp, Mus musculus
cagcaagctgatcccagcttttgag

SEQ ID NO: 566537 - DNA, 25 bp, Mus musculus
cagcaagctgatgccagcttttgag

SEQ ID NO: 566538 - DNA, 25 bp, Mus musculus
cagcaagctgggagtgacgtaatcc

SEQ ID NO: 566539 - DNA, 25 bp, Mus musculus
cagcaagctgggtgtgacgtaatcc

SEQ ID NO: 566540 - DNA, 25 bp, Mus musculus
cagcaaggcccaagcagaggtactg

SEQ ID NO: 566541 - DNA, 25 bp, Mus musculus
cagcaaggcccatgcagaggtactg

SEQ ID NO: 566542 - DNA, 25 bp, Mus musculus
cagcaagggtccagaggcggctctc

SEQ ID NO: 566543 - DNA, 25 bp, Mus musculus
cagcaagggtcctgaggcggctctc

SEQ ID NO: 566544 - DNA, 25 bp, Mus musculus
cagcaaggtccccaagtactgaggt

SEQ ID NO: 566545 - DNA, 25 bp, Mus musculus
cagcaaggtcccgaagtactgaggt

SEQ ID NO: 566546 - DNA, 25 bp, Mus musculus
cagcaaggtcttcgctgactgagtc

SEQ ID NO: 566547 - DNA, 25 bp, Mus musculus
cagcaaggtcttggctgactgagtc

SEQ ID NO: 566548 - DNA, 25 bp, Mus musculus
cagcaagtatcgcacagcgcaaaga

SEQ ID NO: 566549 - DNA, 25 bp, Mus musculus
cagcaagtatcggacagcgcaaaga

SEQ ID NO: 566550 - DNA, 25 bp, Mus musculus
cagcaagtcatcagagataatctct

SEQ ID NO: 566551 - DNA, 25 bp, Mus musculus
cagcaagtcatctgagataatctct

SEQ ID NO: 566552 - DNA, 25 bp, Mus musculus
cagcaagtctgaccccttcatggag

SEQ ID NO: 566553 - DNA, 25 bp, Mus musculus
cagcaagtctgagcccttcatggag

SEQ ID NO: 566554 - DNA, 25 bp, Mus musculus
cagcaagtctttctaggtgcagggc

SEQ ID NO: 566555 - DNA, 25 bp, Mus musculus
cagcaagtctttgtaggtgcagggc

SEQ ID NO: 566556 - DNA, 25 bp, Mus musculus
cagcaagtgacgagaatcggacaga

SEQ ID NO: 566557 - DNA, 25 bp, Mus musculus
cagcaagtgacgtgaatcggacaga

SEQ ID NO: 566558 - DNA, 25 bp, Mus musculus
cagcaagtgccacgcgtgatggtcc

SEQ ID NO: 566559 - DNA, 25 bp, Mus musculus
cagcaagtgccaggcgtgatggtcc

SEQ ID NO: 566560 - DNA, 25 bp, Mus musculus
cagcaagtgcttctttgcagagaag

SEQ ID NO: 566561 - DNA, 25 bp, Mus musculus
cagcaagtgcttgtttgcagagaag

SEQ ID NO: 566562 - DNA, 25 bp, Mus musculus
cagcaagtgttcattgaagaaattc

SEQ ID NO: 566563 - DNA, 25 bp, Mus musculus
cagcaagtgttctttgaagaaattc

SEQ ID NO: 566564 - DNA, 25 bp, Mus musculus
cagcaatactgtctggatacatggg

SEQ ID NO: 566565 - DNA, 25 bp, Mus musculus
cagcaatactgtgtggatacatggg

SEQ ID NO: 566566 - DNA, 25 bp, Mus musculus
cagcaatattaacgagcagctcttg

SEQ ID NO: 566567 - DNA, 25 bp, Mus musculus
cagcaatattaaggagcagctcttg

SEQ ID NO: 566568 - DNA, 25 bp, Mus musculus
cagcaatcaaaaattaccagactga

SEQ ID NO: 566569 - DNA, 25 bp, Mus musculus
cagcaatcaaaatttaccagactga

SEQ ID NO: 566570 - DNA, 25 bp, Mus musculus
cagcaatcaaccagaggcagccagc

SEQ ID NO: 566571 - DNA, 25 bp, Mus musculus
cagcaatcaacctgaggcagccagc

SEQ ID NO: 566572 - DNA, 25 bp, Mus musculus
cagcaatccatacagcttacttgat

SEQ ID NO: 566573 - DNA, 25 bp, Mus musculus
cagcaatccatagagcttacttgat

SEQ ID NO: 566574 - DNA, 25 bp, Mus musculus
cagcaatcctgcaaagtcagcctgg

SEQ ID NO: 566575 - DNA, 25 bp, Mus musculus
cagcaatcctgctaagtcagcctgg

SEQ ID NO: 566576 - DNA, 25 bp, Mus musculus
cagcaatcggcccaagacacactgg

SEQ ID NO: 566577 - DNA, 25 bp, Mus musculus
cagcaatcggccgaagacacactgg

SEQ ID NO: 566578 - DNA, 25 bp, Mus musculus
cagcaatctcagaacctcatcatga

SEQ ID NO: 566579 - DNA, 25 bp, Mus musculus
cagcaatctcagtacctcatcatga

SEQ ID NO: 566580 - DNA, 25 bp, Mus musculus
cagcaatctgctagggtgccgctct

SEQ ID NO: 566581 - DNA, 25 bp, Mus musculus
cagcaatctgcttgggtgccgctct

SEQ ID NO: 566582 - DNA, 25 bp, Mus musculus
cagcaatgaacaaagtcaacttccc

SEQ ID NO: 566583 - DNA, 25 bp, Mus musculus
cagcaatgaacatagtcaacttccc

SEQ ID NO: 566584 - DNA, 25 bp, Mus musculus
cagcaatgacatccgtgtggctggc

SEQ ID NO: 566585 - DNA, 25 bp, Mus musculus
cagcaatgacatgcgtgtggctggc

SEQ ID NO: 566586 - DNA, 25 bp, Mus musculus
cagcaatgactcagcgcacggtatt

SEQ ID NO: 566587 - DNA, 25 bp, Mus musculus
cagcaatgactctgcgcacggtatt

SEQ ID NO: 566588 - DNA, 25 bp, Mus musculus
cagcaatgatgaccgcccagagggt

SEQ ID NO: 566589 - DNA, 25 bp, Mus musculus
cagcaatgatgacgatctgccgtcc

SEQ ID NO: 566590 - DNA, 25 bp, Mus musculus
cagcaatgatgagcgcccagagggt

SEQ ID NO: 566591 - DNA, 25 bp, Mus musculus
cagcaatgatgaggatctgccgtcc

SEQ ID NO: 566592 - DNA, 25 bp, Mus musculus
cagcaatgatggaccacagcaagtc

SEQ ID NO: 566593 - DNA, 25 bp, Mus musculus
cagcaatgatggtccacagcaagtc

SEQ ID NO: 566594 - DNA, 25 bp, Mus musculus
cagcaatgattacttcagagttacc

SEQ ID NO: 566595 - DNA, 25 bp, Mus musculus
cagcaatgattagttcagagttacc

SEQ ID NO: 566596 - DNA, 25 bp, Mus musculus
cagcaatgccaacgtcaggaacaca

SEQ ID NO: 566597 - DNA, 25 bp, Mus musculus
cagcaatgccaaggtcaggaacaca

SEQ ID NO: 566598 - DNA, 25 bp, Mus musculus
cagcaatggacaccggcgcacgctg

SEQ ID NO: 566599 - DNA, 25 bp, Mus musculus
cagcaatggacagcggcgcacgctg

SEQ ID NO: 566600 - DNA, 25 bp, Mus musculus
cagcaatgtcccagtgccctattct

SEQ ID NO: 566601 - DNA, 25 bp, Mus musculus
cagcaatgtccctgtgccctattct

SEQ ID NO: 566602 - DNA, 25 bp, Mus musculus
cagcaatgtcttatctatggcccag

SEQ ID NO: 566603 - DNA, 25 bp, Mus musculus
cagcaatgtcttttctatggcccag

SEQ ID NO: 566604 - DNA, 25 bp, Mus musculus
cagcaattgattcactgagaatctg

SEQ ID NO: 566605 - DNA, 25 bp, Mus musculus
cagcaattgattgactgagaatctg

SEQ ID NO: 566606 - DNA, 25 bp, Mus musculus
cagcaatttccaaatcagtgtggag

SEQ ID NO: 566607 - DNA, 25 bp, Mus musculus
cagcaatttccatatcagtgtggag

SEQ ID NO: 566608 - DNA, 25 bp, Mus musculus
cagcacaaaccgaagcaggaactcc

SEQ ID NO: 566609 - DNA, 25 bp, Mus musculus
cagcacaaaccgtagcaggaactcc

SEQ ID NO: 566610 - DNA, 25 bp, Mus musculus
cagcacaaacgcagccaaaatcttt

SEQ ID NO: 566611 - DNA, 25 bp, Mus musculus
cagcacaaacgctgccaaaatcttt

SEQ ID NO: 566612 - DNA, 25 bp, Mus musculus
cagcacaaatggactgtttcggcca

SEQ ID NO: 566613 - DNA, 25 bp, Mus musculus
cagcacaaatggtctgtttcggcca

SEQ ID NO: 566614 - DNA, 25 bp, Mus musculus
cagcacaacggcaccgacttgatga

SEQ ID NO: 566615 - DNA, 25 bp, Mus musculus
cagcacaacggctccgacttgatga

SEQ ID NO: 566616 - DNA, 25 bp, Mus musculus
cagcacaagaggccttaaaaaagga

SEQ ID NO: 566617 - DNA, 25 bp, Mus musculus
cagcacaagagggcttaaaaaagga

SEQ ID NO: 566618 - DNA, 25 bp, Mus musculus
cagcacaagattcagaagacctgcc

SEQ ID NO: 566619 - DNA, 25 bp, Mus musculus
cagcacaagattgagaagacctgcc

SEQ ID NO: 566620 - DNA, 25 bp, Mus musculus
cagcacacacaacaacttcagaaca

SEQ ID NO: 566621 - DNA, 25 bp, Mus musculus
cagcacacacaagaacttcagaaca

SEQ ID NO: 566622 - DNA, 25 bp, Mus musculus
cagcacacactgaggcaggaatggc

SEQ ID NO: 566623 - DNA, 25 bp, Mus musculus
cagcacacactgtggcaggaatggc

SEQ ID NO: 566624 - DNA, 25 bp, Mus musculus
cagcacacagaaagatggtgagaag

SEQ ID NO: 566625 - DNA, 25 bp, Mus musculus
cagcacacagaactggatatggtac

SEQ ID NO: 566626 - DNA, 25 bp, Mus musculus
cagcacacagaagtggatatggtac

SEQ ID NO: 566627 - DNA, 25 bp, Mus musculus
cagcacacagaatgatggtgagaag

SEQ ID NO: 566628 - DNA, 25 bp, Mus musculus
cagcacaccaggaaggaaggaggac

SEQ ID NO: 566629 - DNA, 25 bp, Mus musculus
cagcacaccaggtaggaaggaggac

SEQ ID NO: 566630 - DNA, 25 bp, Mus musculus
cagcacacggagcatgatgctgact

SEQ ID NO: 566631 - DNA, 25 bp, Mus musculus
cagcacacggaggatgatgctgact

SEQ ID NO: 566632 - DNA, 25 bp, Mus musculus
cagcacagaagaagtgaagataggc

SEQ ID NO: 566633 - DNA, 25 bp, Mus musculus
cagcacagaagatgtgaagataggc

SEQ ID NO: 566634 - DNA, 25 bp, Mus musculus
cagcacagcacgagtacatatttca

SEQ ID NO: 566635 - DNA, 25 bp, Mus musculus
cagcacagcacgtgtacatatttca

SEQ ID NO: 566636 - DNA, 25 bp, Mus musculus
cagcacaggactaacaactctggtc

SEQ ID NO: 566637 - DNA, 25 bp, Mus musculus
cagcacaggacttacaactctggtc

SEQ ID NO: 566638 - DNA, 25 bp, Mus musculus
cagcacaggcaacgtcaaactggag

SEQ ID NO: 566639 - DNA, 25 bp, Mus musculus
cagcacaggcaaggtcaaactggag

SEQ ID NO: 566640 - DNA, 25 bp, Mus musculus
cagcacagtggcctcagtgacagtg

SEQ ID NO: 566641 - DNA, 25 bp, Mus musculus
cagcacagtggcgtcagtgacagtg

SEQ ID NO: 566642 - DNA, 25 bp, Mus musculus
cagcacagtgtcagttgctgatgcc

SEQ ID NO: 566643 - DNA, 25 bp, Mus musculus
cagcacagtgtctgttgctgatgcc

SEQ ID NO: 566644 - DNA, 25 bp, Mus musculus
cagcacagttctaaattggagacca

SEQ ID NO: 566645 - DNA, 25 bp, Mus musculus
cagcacagttcttaattggagacca

SEQ ID NO: 566646 - DNA, 25 bp, Mus musculus
cagcacatggatatcagaactacct

SEQ ID NO: 566647 - DNA, 25 bp, Mus musculus
cagcacatggatttcagaactacct

SEQ ID NO: 566648 - DNA, 25 bp, Mus musculus
cagcacatgggcatcttacaggtgc

SEQ ID NO: 566649 - DNA, 25 bp, Mus musculus
cagcacatgggcttcttacaggtgc

SEQ ID NO: 566650 - DNA, 25 bp, Mus musculus
cagcaccaaagtagaagtagacatg

SEQ ID NO: 566651 - DNA, 25 bp, Mus musculus
cagcaccaaagttgaagtagacatg

SEQ ID NO: 566652 - DNA, 25 bp, Mus musculus
cagcaccaagttagatgaggaggac

SEQ ID NO: 566653 - DNA, 25 bp, Mus musculus
cagcaccaagtttgatgaggaggac

SEQ ID NO: 566654 - DNA, 25 bp, Mus musculus
cagcaccacaccaggcggtggcaga

SEQ ID NO: 566655 - DNA, 25 bp, Mus musculus
cagcaccacacctggcggtggcaga

SEQ ID NO: 566656 - DNA, 25 bp, Mus musculus
cagcaccagaaaaccatgtctgcct

SEQ ID NO: 566657 - DNA, 25 bp, Mus musculus
cagcaccagaaatccatgtctgcct

SEQ ID NO: 566658 - DNA, 25 bp, Mus musculus
cagcaccagcagcatcatcgcagat

SEQ ID NO: 566659 - DNA, 25 bp, Mus musculus
cagcaccagcaggatcatcgcagat

SEQ ID NO: 566660 - DNA, 25 bp, Mus musculus
cagcaccaggacaggatgagtggca

SEQ ID NO: 566661 - DNA, 25 bp, Mus musculus
cagcaccaggactggatgagtggca

SEQ ID NO: 566662 - DNA, 25 bp, Mus musculus
cagcaccagtaaatcttaatatcaa

SEQ ID NO: 566663 - DNA, 25 bp, Mus musculus
cagcaccagtaattcttaatatcaa

SEQ ID NO: 566664 - DNA, 25 bp, Mus musculus
cagcaccatggaacgcaagttcagc

SEQ ID NO: 566665 - DNA, 25 bp, Mus musculus
cagcaccatggacgacgatgacagc

SEQ ID NO: 566666 - DNA, 25 bp, Mus musculus
cagcaccatggaggacgatgacagc

SEQ ID NO: 566667 - DNA, 25 bp, Mus musculus
cagcaccatggatcgcaagttcagc

SEQ ID NO: 566668 - DNA, 25 bp, Mus musculus
cagcaccatggccaacttcctgaag

SEQ ID NO: 566669 - DNA, 25 bp, Mus musculus
cagcaccatggcgaacttcctgaag

SEQ ID NO: 566670 - DNA, 25 bp, Mus musculus
cagcacccagacaattacagccttg

SEQ ID NO: 566671 - DNA, 25 bp, Mus musculus
cagcacccagactattacagccttg

SEQ ID NO: 566672 - DNA, 25 bp, Mus musculus
cagcacccagttataggtccaaaca

SEQ ID NO: 566673 - DNA, 25 bp, Mus musculus
cagcacccagttttaggtccaaaca

SEQ ID NO: 566674 - DNA, 25 bp, Mus musculus
cagcacccatacatcaacgtctggt

SEQ ID NO: 566675 - DNA, 25 bp, Mus musculus
cagcacccatacttcaacgtctggt

SEQ ID NO: 566676 - DNA, 25 bp, Mus musculus
cagcaccccagaaggatctcgatag

SEQ ID NO: 566677 - DNA, 25 bp, Mus musculus
cagcaccccagatggatctcgatag

SEQ ID NO: 566678 - DNA, 25 bp, Mus musculus
cagcacccctggatgaatgggcttt

SEQ ID NO: 566679 - DNA, 25 bp, Mus musculus
cagcacccctggttgaatgggcttt

SEQ ID NO: 566680 - DNA, 25 bp, Mus musculus
cagcaccctgtcacacgtttgagta

SEQ ID NO: 566681 - DNA, 25 bp, Mus musculus
cagcaccctgtctcacgtttgagta

SEQ ID NO: 566682 - DNA, 25 bp, Mus musculus
cagcacccttggcaaaggagagtct

SEQ ID NO: 566683 - DNA, 25 bp, Mus musculus
cagcacccttgggaaaggagagtct

SEQ ID NO: 566684 - DNA, 25 bp, Mus musculus
cagcaccgaaaacgagatcctgcct

SEQ ID NO: 566685 - DNA, 25 bp, Mus musculus
cagcaccgaaaaggagatcctgcct

SEQ ID NO: 566686 - DNA, 25 bp, Mus musculus
cagcaccgatgactttttcttcaag

SEQ ID NO: 566687 - DNA, 25 bp, Mus musculus
cagcaccgatgagtttttcttcaag

SEQ ID NO: 566688 - DNA, 25 bp, Mus musculus
cagcaccgccctcgtgtttttgtgt

SEQ ID NO: 566689 - DNA, 25 bp, Mus musculus
cagcaccgccctggtgtttttgtgt

SEQ ID NO: 566690 - DNA, 25 bp, Mus musculus
cagcaccgctttctgccagagaaat

SEQ ID NO: 566691 - DNA, 25 bp, Mus musculus
cagcaccgctttgtgccagagaaat

SEQ ID NO: 566692 - DNA, 25 bp, Mus musculus
cagcaccggttgcttcaccatgatt

SEQ ID NO: 566693 - DNA, 25 bp, Mus musculus
cagcaccggttggttcaccatgatt

SEQ ID NO: 566694 - DNA, 25 bp, Mus musculus
cagcaccgtgagcaagtagaaggac

SEQ ID NO: 566695 - DNA, 25 bp, Mus musculus
cagcaccgtgaggaagtagaaggac

SEQ ID NO: 566696 - DNA, 25 bp, Mus musculus
cagcacctccttatgcactgtggga

SEQ ID NO: 566697 - DNA, 25 bp, Mus musculus
cagcacctccttttgcactgtggga

SEQ ID NO: 566698 - DNA, 25 bp, Mus musculus
cagcacctcgagagaaggacacccg

SEQ ID NO: 566699 - DNA, 25 bp, Mus musculus
cagcacctcgagtgaaggacacccg

SEQ ID NO: 566700 - DNA, 25 bp, Mus musculus
cagcacctctggctgaggacatcga

SEQ ID NO: 566701 - DNA, 25 bp, Mus musculus
cagcacctctgggtgaggacatcga

SEQ ID NO: 566702 - DNA, 25 bp, Mus musculus
cagcacctgcatacttctggctatg

SEQ ID NO: 566703 - DNA, 25 bp, Mus musculus
cagcacctgcattcttctggctatg

SEQ ID NO: 566704 - DNA, 25 bp, Mus musculus
cagcacctgcttatgcccagcttgt

SEQ ID NO: 566705 - DNA, 25 bp, Mus musculus
cagcacctgcttttgcccagcttgt

SEQ ID NO: 566706 - DNA, 25 bp, Mus musculus
cagcacctggaaaacggaagaagga

SEQ ID NO: 566707 - DNA, 25 bp, Mus musculus
cagcacctggaatacggaagaagga

SEQ ID NO: 566708 - DNA, 25 bp, Mus musculus
cagcacctgggtcctgcgcctggat

SEQ ID NO: 566709 - DNA, 25 bp, Mus musculus
cagcacctgggtgctgcgcctggat

SEQ ID NO: 566710 - DNA, 25 bp, Mus musculus
cagcacctggtcagtggaccgccag

SEQ ID NO: 566711 - DNA, 25 bp, Mus musculus
cagcacctggtctgtggaccgccag

SEQ ID NO: 566712 - DNA, 25 bp, Mus musculus
cagcacctgtgaagggctttgagag

SEQ ID NO: 566713 - DNA, 25 bp, Mus musculus
cagcacctgtgatgggctttgagag

SEQ ID NO: 566714 - DNA, 25 bp, Mus musculus
cagcacctgttaagaccatgaccat

SEQ ID NO: 566715 - DNA, 25 bp, Mus musculus
cagcacctgttatgaccatgaccat

SEQ ID NO: 566716 - DNA, 25 bp, Mus musculus
cagcaccttcacaatcactgtcgat

SEQ ID NO: 566717 - DNA, 25 bp, Mus musculus
cagcaccttcactatcactgtcgat

SEQ ID NO: 566718 - DNA, 25 bp, Mus musculus
cagcacctttgacgagattcagttc

SEQ ID NO: 566719 - DNA, 25 bp, Mus musculus
cagcacctttgaggagattcagttc

SEQ ID NO: 566720 - DNA, 25 bp, Mus musculus
cagcacgcctgacgaccttgagcag

SEQ ID NO: 566721 - DNA, 25 bp, Mus musculus
cagcacgcctgaggaccttgagcag

SEQ ID NO: 566722 - DNA, 25 bp, Mus musculus
cagcacggagccacagaacgaagat

SEQ ID NO: 566723 - DNA, 25 bp, Mus musculus
cagcacggagcctcagaacgaagat

SEQ ID NO: 566724 - DNA, 25 bp, Mus musculus
cagcacggaggactgcagccgccta

SEQ ID NO: 566725 - DNA, 25 bp, Mus musculus
cagcacggaggagtgcagccgccta

SEQ ID NO: 566726 - DNA, 25 bp, Mus musculus
cagcacggtccactttgtggcagag

SEQ ID NO: 566727 - DNA, 25 bp, Mus musculus
cagcacggtccagtttgtggcagag

SEQ ID NO: 566728 - DNA, 25 bp, Mus musculus
cagcacgtactaagcaaatgtctca

SEQ ID NO: 566729 - DNA, 25 bp, Mus musculus
cagcacgtactatgcaaatgtctca

SEQ ID NO: 566730 - DNA, 25 bp, Mus musculus
cagcacgtatgtcggctctcatgca

SEQ ID NO: 566731 - DNA, 25 bp, Mus musculus
cagcacgtatgtgggctctcatgca

SEQ ID NO: 566732 - DNA, 25 bp, Mus musculus
cagcacgtggctcactgcagctgga

SEQ ID NO: 566733 - DNA, 25 bp, Mus musculus
cagcacgtggctgactgcagctgga

SEQ ID NO: 566734 - DNA, 25 bp, Mus musculus
cagcactaagttatggattaagcag

SEQ ID NO: 566735 - DNA, 25 bp, Mus musculus
cagcactaagttttggattaagcag

SEQ ID NO: 566736 - DNA, 25 bp, Mus musculus
cagcactacctgcacaaggataagg

SEQ ID NO: 566737 - DNA, 25 bp, Mus musculus
cagcactacctggacaaggataagg

SEQ ID NO: 566738 - DNA, 25 bp, Mus musculus
cagcactagtgtcaaccgcctcgtg

SEQ ID NO: 566739 - DNA, 25 bp, Mus musculus
cagcactagtgtgaaccgcctcgtg

SEQ ID NO: 566740 - DNA, 25 bp, Mus musculus
cagcactatatgctgggccccaaga

SEQ ID NO: 566741 - DNA, 25 bp, Mus musculus
cagcactatatggtgggccccaaga

SEQ ID NO: 566742 - DNA, 25 bp, Mus musculus
cagcactatggtcgtggagcacccc

SEQ ID NO: 566743 - DNA, 25 bp, Mus musculus
cagcactatggtggtggagcacccc

SEQ ID NO: 566744 - DNA, 25 bp, Mus musculus
cagcactcaaaactcaggcagggct

SEQ ID NO: 566745 - DNA, 25 bp, Mus musculus
cagcactcaaaagtcaggcagggct

SEQ ID NO: 566746 - DNA, 25 bp, Mus musculus
cagcactcgagcaccaaagggtcat

SEQ ID NO: 566747 - DNA, 25 bp, Mus musculus
cagcactcgagctccaaagggtcat

SEQ ID NO: 566748 - DNA, 25 bp, Mus musculus
cagcactctagccagcagactgaca

SEQ ID NO: 566749 - DNA, 25 bp, Mus musculus
cagcactctagcgagcagactgaca

SEQ ID NO: 566750 - DNA, 25 bp, Mus musculus
cagcactcttaactctcgaagtgag

SEQ ID NO: 566751 - DNA, 25 bp, Mus musculus
cagcactcttaagtctcgaagtgag

SEQ ID NO: 566752 - DNA, 25 bp, Mus musculus
cagcactgaagcagggggatatcca

SEQ ID NO: 566753 - DNA, 25 bp, Mus musculus
cagcactgaagctgggggatatcca

SEQ ID NO: 566754 - DNA, 25 bp, Mus musculus
cagcactgacttcctgtttgaaaaa

SEQ ID NO: 566755 - DNA, 25 bp, Mus musculus
cagcactgacttgctgtttgaaaaa

SEQ ID NO: 566756 - DNA, 25 bp, Mus musculus
cagcactgagaaagatttggaggaa

SEQ ID NO: 566757 - DNA, 25 bp, Mus musculus
cagcactgagaatgatttggaggaa

SEQ ID NO: 566758 - DNA, 25 bp, Mus musculus
cagcactgagagaaaagctagccac

SEQ ID NO: 566759 - DNA, 25 bp, Mus musculus
cagcactgagagagcaggcgcctga

SEQ ID NO: 566760 - DNA, 25 bp, Mus musculus
cagcactgagagtaaagctagccac

SEQ ID NO: 566761 - DNA, 25 bp, Mus musculus
cagcactgagagtgcaggcgcctga

SEQ ID NO: 566762 - DNA, 25 bp, Mus musculus
cagcactgagcgctaagtcaaaggc

SEQ ID NO: 566763 - DNA, 25 bp, Mus musculus
cagcactgagcggtaagtcaaaggc

SEQ ID NO: 566764 - DNA, 25 bp, Mus musculus
cagcactgataacactgtcatggct

SEQ ID NO: 566765 - DNA, 25 bp, Mus musculus
cagcactgataagactgtcatggct

SEQ ID NO: 566766 - DNA, 25 bp, Mus musculus
cagcactgctatagttcttaatgga

SEQ ID NO: 566767 - DNA, 25 bp, Mus musculus
cagcactgctattgttcttaatgga

SEQ ID NO: 566768 - DNA, 25 bp, Mus musculus
cagcactggagccttattatggaaa

SEQ ID NO: 566769 - DNA, 25 bp, Mus musculus
cagcactggagcgttattatggaaa

SEQ ID NO: 566770 - DNA, 25 bp, Mus musculus
cagcactggagtccatgacaccgtg

SEQ ID NO: 566771 - DNA, 25 bp, Mus musculus
cagcactggagtgcatgacaccgtg

SEQ ID NO: 566772 - DNA, 25 bp, Mus musculus
cagcactgggacctggaaggattca

SEQ ID NO: 566773 - DNA, 25 bp, Mus musculus
cagcactgggacgtggaaggattca

SEQ ID NO: 566774 - DNA, 25 bp, Mus musculus
cagcactgggtcctaagagctgcca

SEQ ID NO: 566775 - DNA, 25 bp, Mus musculus
cagcactgggtcgtaagagctgcca

SEQ ID NO: 566776 - DNA, 25 bp, Mus musculus
cagcactgtgggagaagcacagccc

SEQ ID NO: 566777 - DNA, 25 bp, Mus musculus
cagcactgtgggtgaagcacagccc

SEQ ID NO: 566778 - DNA, 25 bp, Mus musculus
cagcactgtgttatggctggctcac

SEQ ID NO: 566779 - DNA, 25 bp, Mus musculus
cagcactgtgttttggctggctcac

SEQ ID NO: 566780 - DNA, 25 bp, Mus musculus
cagcacttacgtagtcatggagcag

SEQ ID NO: 566781 - DNA, 25 bp, Mus musculus
cagcacttacgttgtcatggagcag

SEQ ID NO: 566782 - DNA, 25 bp, Mus musculus
cagcacttcattatggaggaagcca

SEQ ID NO: 566783 - DNA, 25 bp, Mus musculus
cagcacttcattttggaggaagcca

SEQ ID NO: 566784 - DNA, 25 bp, Mus musculus
cagcacttgagtcgctatttcctgc

SEQ ID NO: 566785 - DNA, 25 bp, Mus musculus
cagcacttgagtggctatttcctgc

SEQ ID NO: 566786 - DNA, 25 bp, Mus musculus
cagcacttgcagactgccctcagga

SEQ ID NO: 566787 - DNA, 25 bp, Mus musculus
cagcacttgcagtctgccctcagga

SEQ ID NO: 566788 - DNA, 25 bp, Mus musculus
cagcacttgcttcgactatacgaca

SEQ ID NO: 566789 - DNA, 25 bp, Mus musculus
cagcacttgcttggactatacgaca

SEQ ID NO: 566790 - DNA, 25 bp, Mus musculus
cagcactttggaagatctgaatacc

SEQ ID NO: 566791 - DNA, 25 bp, Mus musculus
cagcactttggatgatctgaatacc

SEQ ID NO: 566792 - DNA, 25 bp, Mus musculus
cagcagaaaattagcatcagttatc

SEQ ID NO: 566793 - DNA, 25 bp, Mus musculus
cagcagaaaatttgcatcagttatc

SEQ ID NO: 566794 - DNA, 25 bp, Mus musculus
cagcagaaacgacccaatcctgagc

SEQ ID NO: 566795 - DNA, 25 bp, Mus musculus
cagcagaaacgagccaatcctgagc

SEQ ID NO: 566796 - DNA, 25 bp, Mus musculus
cagcagaaactcatgcatatggtaa

SEQ ID NO: 566797 - DNA, 25 bp, Mus musculus
cagcagaaactcttgcatatggtaa

SEQ ID NO: 566798 - DNA, 25 bp, Mus musculus
cagcagaaagctatggaatattgat

SEQ ID NO: 566799 - DNA, 25 bp, Mus musculus
cagcagaaagctttggaatattgat

SEQ ID NO: 566800 - DNA, 25 bp, Mus musculus
cagcagaaagtgaacgatgcttcaa

SEQ ID NO: 566801 - DNA, 25 bp, Mus musculus
cagcagaaagtgtacgatgcttcaa

SEQ ID NO: 566802 - DNA, 25 bp, Mus musculus
cagcagaacatgaagggagttgttt

SEQ ID NO: 566803 - DNA, 25 bp, Mus musculus
cagcagaacatgtagggagttgttt

SEQ ID NO: 566804 - DNA, 25 bp, Mus musculus
cagcagaagacaacgtaccaagtga

SEQ ID NO: 566805 - DNA, 25 bp, Mus musculus
cagcagaagacatcgtaccaagtga

SEQ ID NO: 566806 - DNA, 25 bp, Mus musculus
cagcagaagacgctgcgcatgtaca

SEQ ID NO: 566807 - DNA, 25 bp, Mus musculus
cagcagaagacggtgcgcatgtaca

SEQ ID NO: 566808 - DNA, 25 bp, Mus musculus
cagcagaagcaactgtccctggaga

SEQ ID NO: 566809 - DNA, 25 bp, Mus musculus
cagcagaagcaagtgtccctggaga

SEQ ID NO: 566810 - DNA, 25 bp, Mus musculus
cagcagaaggtcacatggacacaag

SEQ ID NO: 566811 - DNA, 25 bp, Mus musculus
cagcagaaggtctcatggacacaag

SEQ ID NO: 566812 - DNA, 25 bp, Mus musculus
cagcagaagtaaaagcccggattca

SEQ ID NO: 566813 - DNA, 25 bp, Mus musculus
cagcagaagtaatagcccggattca

SEQ ID NO: 566814 - DNA, 25 bp, Mus musculus
cagcagaatcaactggcagtggagc

SEQ ID NO: 566815 - DNA, 25 bp, Mus musculus
cagcagaatcaagtggcagtggagc

SEQ ID NO: 566816 - DNA, 25 bp, Mus musculus
cagcagaatgccacagaggcagaga

SEQ ID NO: 566817 - DNA, 25 bp, Mus musculus
cagcagaatgcctcagaggcagaga

SEQ ID NO: 566818 - DNA, 25 bp, Mus musculus
cagcagacagaaaatagtgatccca

SEQ ID NO: 566819 - DNA, 25 bp, Mus musculus
cagcagacagaactactcgagccaa

SEQ ID NO: 566820 - DNA, 25 bp, Mus musculus
cagcagacagaagtactcgagccaa

SEQ ID NO: 566821 - DNA, 25 bp, Mus musculus
cagcagacagaatatagtgatccca

SEQ ID NO: 566822 - DNA, 25 bp, Mus musculus
cagcagacagagagaagtggtacct

SEQ ID NO: 566823 - DNA, 25 bp, Mus musculus
cagcagacagagatttaacgtcttc

SEQ ID NO: 566824 - DNA, 25 bp, Mus musculus
cagcagacagagtgaagtggtacct

SEQ ID NO: 566825 - DNA, 25 bp, Mus musculus
cagcagacagagttttaacgtcttc

SEQ ID NO: 566826 - DNA, 25 bp, Mus musculus
cagcagacaggccttcgagtccatg

SEQ ID NO: 566827 - DNA, 25 bp, Mus musculus
cagcagacaggcgttcgagtccatg

SEQ ID NO: 566828 - DNA, 25 bp, Mus musculus
cagcagaccaccagagtatgaattc

SEQ ID NO: 566829 - DNA, 25 bp, Mus musculus
cagcagaccacctgagtatgaattc

SEQ ID NO: 566830 - DNA, 25 bp, Mus musculus
cagcagaccccacacagcatgtgtg

SEQ ID NO: 566831 - DNA, 25 bp, Mus musculus
cagcagaccccagacagcatgtgtg

SEQ ID NO: 566832 - DNA, 25 bp, Mus musculus
cagcagactcgtatagtcacaattc

SEQ ID NO: 566833 - DNA, 25 bp, Mus musculus
cagcagactcgtttagtcacaattc

SEQ ID NO: 566834 - DNA, 25 bp, Mus musculus
cagcagactgtcctgcctgaaggtc

SEQ ID NO: 566835 - DNA, 25 bp, Mus musculus
cagcagactgtcgtgcctgaaggtc

SEQ ID NO: 566836 - DNA, 25 bp, Mus musculus
cagcagactttaaagtagtccggtc

SEQ ID NO: 566837 - DNA, 25 bp, Mus musculus
cagcagactttatagtagtccggtc

SEQ ID NO: 566838 - DNA, 25 bp, Mus musculus
cagcagagcccgatcatggttgatc

SEQ ID NO: 566839 - DNA, 25 bp, Mus musculus
cagcagagcccgttcatggttgatc

SEQ ID NO: 566840 - DNA, 25 bp, Mus musculus
cagcagagcctccaccatttagcta

SEQ ID NO: 566841 - DNA, 25 bp, Mus musculus
cagcagagcctcgaccatttagcta

SEQ ID NO: 566842 - DNA, 25 bp, Mus musculus
cagcagagcctgatattatatcaac

SEQ ID NO: 566843 - DNA, 25 bp, Mus musculus
cagcagagcctgttattatatcaac

SEQ ID NO: 566844 - DNA, 25 bp, Mus musculus
cagcagagctagcaggcctgagcta

SEQ ID NO: 566845 - DNA, 25 bp, Mus musculus
cagcagagctaggaggcctgagcta

SEQ ID NO: 566846 - DNA, 25 bp, Mus musculus
cagcagagctcacagtctggtctgc

SEQ ID NO: 566847 - DNA, 25 bp, Mus musculus
cagcagagctcagagtctggtctgc

SEQ ID NO: 566848 - DNA, 25 bp, Mus musculus
cagcagagctccacctattccggaa

SEQ ID NO: 566849 - DNA, 25 bp, Mus musculus
cagcagagctcctcctattccggaa

SEQ ID NO: 566850 - DNA, 25 bp, Mus musculus
cagcagaggaatcaagttcacaata

SEQ ID NO: 566851 - DNA, 25 bp, Mus musculus
cagcagaggaatgaagttcacaata

SEQ ID NO: 566852 - DNA, 25 bp, Mus musculus
cagcagaggagcaaagccagcatgt

SEQ ID NO: 566853 - DNA, 25 bp, Mus musculus
cagcagaggagctaagccagcatgt

SEQ ID NO: 566854 - DNA, 25 bp, Mus musculus
cagcagaggagtatcagatgagccc

SEQ ID NO: 566855 - DNA, 25 bp, Mus musculus
cagcagaggagtttcagatgagccc

SEQ ID NO: 566856 - DNA, 25 bp, Mus musculus
cagcagagggagctccagatgaacc

SEQ ID NO: 566857 - DNA, 25 bp, Mus musculus
cagcagagggaggtccagatgaacc

SEQ ID NO: 566858 - DNA, 25 bp, Mus musculus
cagcagaggtagaaatcaaggacct

SEQ ID NO: 566859 - DNA, 25 bp, Mus musculus
cagcagaggtagtaatcaaggacct

SEQ ID NO: 566860 - DNA, 25 bp, Mus musculus
cagcagagtatgcatatacagtttc

SEQ ID NO: 566861 - DNA, 25 bp, Mus musculus
cagcagagtatggatatacagtttc

SEQ ID NO: 566862 - DNA, 25 bp, Mus musculus
cagcagagtcgacgttttggcagct

SEQ ID NO: 566863 - DNA, 25 bp, Mus musculus
cagcagagtcgaggttttggcagct

SEQ ID NO: 566864 - DNA, 25 bp, Mus musculus
cagcagagtctgctgcaatgcaccc

SEQ ID NO: 566865 - DNA, 25 bp, Mus musculus
cagcagagtctggtgcaatgcaccc

SEQ ID NO: 566866 - DNA, 25 bp, Mus musculus
cagcagagtgcgcagctgcaacctg

SEQ ID NO: 566867 - DNA, 25 bp, Mus musculus
cagcagagtgcggagctgcaacctg

SEQ ID NO: 566868 - DNA, 25 bp, Mus musculus
cagcagatacgcatacagcagcagc

SEQ ID NO: 566869 - DNA, 25 bp, Mus musculus
cagcagatacgcttacagcagcagc

SEQ ID NO: 566870 - DNA, 25 bp, Mus musculus
cagcagatgcctcttgcctcaggag

SEQ ID NO: 566871 - DNA, 25 bp, Mus musculus
cagcagatgcctgttgcctcaggag

SEQ ID NO: 566872 - DNA, 25 bp, Mus musculus
cagcagattagcatcgtcaacagca

SEQ ID NO: 566873 - DNA, 25 bp, Mus musculus
cagcagattagcttcgtcaacagca

SEQ ID NO: 566874 - DNA, 25 bp, Mus musculus
cagcagattctgagcaacaagttcc

SEQ ID NO: 566875 - DNA, 25 bp, Mus musculus
cagcagattctgtgcaacaagttcc

SEQ ID NO: 566876 - DNA, 25 bp, Mus musculus
cagcagattgtccagctaatccgac

SEQ ID NO: 566877 - DNA, 25 bp, Mus musculus
cagcagattgtcgagctaatccgac

SEQ ID NO: 566878 - DNA, 25 bp, Mus musculus
cagcagcaaatcctattgagtctca

SEQ ID NO: 566879 - DNA, 25 bp, Mus musculus
cagcagcaaatcgtattgagtctca

SEQ ID NO: 566880 - DNA, 25 bp, Mus musculus
cagcagcaacacaggcactggtggg

SEQ ID NO: 566881 - DNA, 25 bp, Mus musculus
cagcagcaacactggcactggtggg

SEQ ID NO: 566882 - DNA, 25 bp, Mus musculus
cagcagcaagcgctttggaaagttg

SEQ ID NO: 566883 - DNA, 25 bp, Mus musculus
cagcagcaagcggtttggaaagttg

SEQ ID NO: 566884 - DNA, 25 bp, Mus musculus
cagcagcaagtgcttatgtcatgtc

SEQ ID NO: 566885 - DNA, 25 bp, Mus musculus
cagcagcaagtggttatgtcatgtc

SEQ ID NO: 566886 - DNA, 25 bp, Mus musculus
cagcagcaatgtcgatgatcctgga

SEQ ID NO: 566887 - DNA, 25 bp, Mus musculus
cagcagcaatgtggatgatcctgga

SEQ ID NO: 566888 - DNA, 25 bp, Mus musculus
cagcagcaatttccatatcagtgtg

SEQ ID NO: 566889 - DNA, 25 bp, Mus musculus
cagcagcaatttgcatatcagtgtg

SEQ ID NO: 566890 - DNA, 25 bp, Mus musculus
cagcagcacaggacgtcctggctct

SEQ ID NO: 566891 - DNA, 25 bp, Mus musculus
cagcagcacaggtcgtcctggctct

SEQ ID NO: 566892 - DNA, 25 bp, Mus musculus
cagcagcacagtccctgtgtcttca

SEQ ID NO: 566893 - DNA, 25 bp, Mus musculus
cagcagcacagtgcctgtgtcttca

SEQ ID NO: 566894 - DNA, 25 bp, Mus musculus
cagcagcacgcactggtggttagca

SEQ ID NO: 566895 - DNA, 25 bp, Mus musculus
cagcagcacgcagtggtggttagca

SEQ ID NO: 566896 - DNA, 25 bp, Mus musculus
cagcagcacgtgactggctgtgccc

SEQ ID NO: 566897 - DNA, 25 bp, Mus musculus
cagcagcacgtgtctggctgtgccc

SEQ ID NO: 566898 - DNA, 25 bp, Mus musculus
cagcagcactgacgcgggcttgttc

SEQ ID NO: 566899 - DNA, 25 bp, Mus musculus
cagcagcactgacgtggagcagtac

SEQ ID NO: 566900 - DNA, 25 bp, Mus musculus
cagcagcactgaggcgggcttgttc

SEQ ID NO: 566901 - DNA, 25 bp, Mus musculus
cagcagcactgaggtggagcagtac

SEQ ID NO: 566902 - DNA, 25 bp, Mus musculus
cagcagcagaatatgatgagctggc

SEQ ID NO: 566903 - DNA, 25 bp, Mus musculus
cagcagcagaatcggctgtgcctca

SEQ ID NO: 566904 - DNA, 25 bp, Mus musculus
cagcagcagaatgggctgtgcctca

SEQ ID NO: 566905 - DNA, 25 bp, Mus musculus
cagcagcagaatttgatgagctggc

SEQ ID NO: 566906 - DNA, 25 bp, Mus musculus
cagcagcagactcggtaagcctcga

SEQ ID NO: 566907 - DNA, 25 bp, Mus musculus
cagcagcagactgggtaagcctcga

SEQ ID NO: 566908 - DNA, 25 bp, Mus musculus
cagcagcagaggagtttcagatgag

SEQ ID NO: 566909 - DNA, 25 bp, Mus musculus
cagcagcagaggtgtttcagatgag

SEQ ID NO: 566910 - DNA, 25 bp, Mus musculus
cagcagcagataccagccagggctg

SEQ ID NO: 566911 - DNA, 25 bp, Mus musculus
cagcagcagatagcagccagggctg

SEQ ID NO: 566912 - DNA, 25 bp, Mus musculus
cagcagcagctactaaatcagcaag

SEQ ID NO: 566913 - DNA, 25 bp, Mus musculus
cagcagcagctagtaaatcagcaag

SEQ ID NO: 566914 - DNA, 25 bp, Mus musculus
cagcagcaggatatctccattggct

SEQ ID NO: 566915 - DNA, 25 bp, Mus musculus
cagcagcaggatttctccattggct

SEQ ID NO: 566916 - DNA, 25 bp, Mus musculus
cagcagcagggacttgactagaagt

SEQ ID NO: 566917 - DNA, 25 bp, Mus musculus
cagcagcagggagttgactagaagt

SEQ ID NO: 566918 - DNA, 25 bp, Mus musculus
cagcagcagtgtaactgggaagcca

SEQ ID NO: 566919 - DNA, 25 bp, Mus musculus
cagcagcagtgttactgggaagcca

SEQ ID NO: 566920 - DNA, 25 bp, Mus musculus
cagcagcatccaaagccatggagaa

SEQ ID NO: 566921 - DNA, 25 bp, Mus musculus
cagcagcatccatagccatggagaa

SEQ ID NO: 566922 - DNA, 25 bp, Mus musculus
cagcagcatcttcggcttcagcgtg

SEQ ID NO: 566923 - DNA, 25 bp, Mus musculus
cagcagcatcttgggcttcagcgtg

SEQ ID NO: 566924 - DNA, 25 bp, Mus musculus
cagcagcatgttcaaatgagtacca

SEQ ID NO: 566925 - DNA, 25 bp, Mus musculus
cagcagcatgttgaaatgagtacca

SEQ ID NO: 566926 - DNA, 25 bp, Mus musculus
cagcagcattgcaactctggatcta

SEQ ID NO: 566927 - DNA, 25 bp, Mus musculus
cagcagcattgctactctggatcta

SEQ ID NO: 566928 - DNA, 25 bp, Mus musculus
cagcagcattggcattcctattgct

SEQ ID NO: 566929 - DNA, 25 bp, Mus musculus
cagcagcattgggattcctattgct

SEQ ID NO: 566930 - DNA, 25 bp, Mus musculus
cagcagccactgatttctgtagggt

SEQ ID NO: 566931 - DNA, 25 bp, Mus musculus
cagcagccactgttttctgtagggt

SEQ ID NO: 566932 - DNA, 25 bp, Mus musculus
cagcagccatgcaaatcaagacgga

SEQ ID NO: 566933 - DNA, 25 bp, Mus musculus
cagcagccatgctaatcaagacgga

SEQ ID NO: 566934 - DNA, 25 bp, Mus musculus
cagcagccccatcatcggtctagtt

SEQ ID NO: 566935 - DNA, 25 bp, Mus musculus
cagcagccccatgatcggtctagtt

SEQ ID NO: 566936 - DNA, 25 bp, Mus musculus
cagcagcccctgagcctagggtagc

SEQ ID NO: 566937 - DNA, 25 bp, Mus musculus
cagcagcccctgtgcctagggtagc

SEQ ID NO: 566938 - DNA, 25 bp, Mus musculus
cagcagcccttcatggccgcggtga

SEQ ID NO: 566939 - DNA, 25 bp, Mus musculus
cagcagcccttcttggccgcggtga

SEQ ID NO: 566940 - DNA, 25 bp, Mus musculus
cagcagccggagagccaagagtgta

SEQ ID NO: 566941 - DNA, 25 bp, Mus musculus
cagcagccggagtgccaagagtgta

SEQ ID NO: 566942 - DNA, 25 bp, Mus musculus
cagcagcctcgactgttcgtgggca

SEQ ID NO: 566943 - DNA, 25 bp, Mus musculus
cagcagcctcgagtgttcgtgggca

SEQ ID NO: 566944 - DNA, 25 bp, Mus musculus
cagcagcctgccactgacgcttttg

SEQ ID NO: 566945 - DNA, 25 bp, Mus musculus
cagcagcctgcctctgacgcttttg

SEQ ID NO: 566946 - DNA, 25 bp, Mus musculus
cagcagcctttgagtggacgagtca

SEQ ID NO: 566947 - DNA, 25 bp, Mus musculus
cagcagcctttgtgtggacgagtca

SEQ ID NO: 566948 - DNA, 25 bp, Mus musculus
cagcagcgagtaagttgtccgaaat

SEQ ID NO: 566949 - DNA, 25 bp, Mus musculus
cagcagcgagtatgttgtccgaaat

SEQ ID NO: 566950 - DNA, 25 bp, Mus musculus
cagcagcgcattagactcagaagtc

SEQ ID NO: 566951 - DNA, 25 bp, Mus musculus
cagcagcgcatttgactcagaagtc

SEQ ID NO: 566952 - DNA, 25 bp, Mus musculus
cagcagcgctgaatgtcaggatgaa

SEQ ID NO: 566953 - DNA, 25 bp, Mus musculus
cagcagcgctgattgtcaggatgaa

SEQ ID NO: 566954 - DNA, 25 bp, Mus musculus
cagcagcggcatccccatacggatt

SEQ ID NO: 566955 - DNA, 25 bp, Mus musculus
cagcagcggcatgcccatacggatt

SEQ ID NO: 566956 - DNA, 25 bp, Mus musculus
cagcagcggctcatctacagtggca

SEQ ID NO: 566957 - DNA, 25 bp, Mus musculus
cagcagcggctcttctacagtggca

SEQ ID NO: 566958 - DNA, 25 bp, Mus musculus
cagcagcgtcgtcatgggcctagtt

SEQ ID NO: 566959 - DNA, 25 bp, Mus musculus
cagcagcgtcgtgatgggcctagtt

SEQ ID NO: 566960 - DNA, 25 bp, Mus musculus
cagcagcgtgctcgccgtttaaaag

SEQ ID NO: 566961 - DNA, 25 bp, Mus musculus
cagcagcgtgctggccgtttaaaag

SEQ ID NO: 566962 - DNA, 25 bp, Mus musculus
cagcagcgtttgaggctgtggccca

SEQ ID NO: 566963 - DNA, 25 bp, Mus musculus
cagcagcgtttgcaagcccctgcag

SEQ ID NO: 566964 - DNA, 25 bp, Mus musculus
cagcagcgtttggaagcccctgcag

SEQ ID NO: 566965 - DNA, 25 bp, Mus musculus
cagcagcgtttgtggctgtggccca

SEQ ID NO: 566966 - DNA, 25 bp, Mus musculus
cagcagctaagaactacccctgcga

SEQ ID NO: 566967 - DNA, 25 bp, Mus musculus
cagcagctaagaagtggaaccgacc

SEQ ID NO: 566968 - DNA, 25 bp, Mus musculus
cagcagctaagatctacccctgcga

SEQ ID NO: 566969 - DNA, 25 bp, Mus musculus
cagcagctaagatgtggaaccgacc

SEQ ID NO: 566970 - DNA, 25 bp, Mus musculus
cagcagctactgaaggacccaatat

SEQ ID NO: 566971 - DNA, 25 bp, Mus musculus
cagcagctactgtaggacccaatat

SEQ ID NO: 566972 - DNA, 25 bp, Mus musculus
cagcagctcagaaaatgtttgagga

SEQ ID NO: 566973 - DNA, 25 bp, Mus musculus
cagcagctcagacgattcggacacc

SEQ ID NO: 566974 - DNA, 25 bp, Mus musculus
cagcagctcagaggattcggacacc

SEQ ID NO: 566975 - DNA, 25 bp, Mus musculus
cagcagctcagataatgtttgagga

SEQ ID NO: 566976 - DNA, 25 bp, Mus musculus
cagcagctccagactacatgccaga

SEQ ID NO: 566977 - DNA, 25 bp, Mus musculus
cagcagctccagtctacatgccaga

SEQ ID NO: 566978 - DNA, 25 bp, Mus musculus
cagcagctcctcaacttctggcgat

SEQ ID NO: 566979 - DNA, 25 bp, Mus musculus
cagcagctcctctacttctggcgat

SEQ ID NO: 566980 - DNA, 25 bp, Mus musculus
cagcagctcgagacactgcagctgg

SEQ ID NO: 566981 - DNA, 25 bp, Mus musculus
cagcagctcgagtcactgcagctgg

SEQ ID NO: 566982 - DNA, 25 bp, Mus musculus
cagcagctcgtcattcctatcagaa

SEQ ID NO: 566983 - DNA, 25 bp, Mus musculus
cagcagctcgtctttcctatcagaa

SEQ ID NO: 566984 - DNA, 25 bp, Mus musculus
cagcagctgaggctcctacctagca

SEQ ID NO: 566985 - DNA, 25 bp, Mus musculus
cagcagctgagggtcctacctagca

SEQ ID NO: 566986 - DNA, 25 bp, Mus musculus
cagcagctgattcaacagcagcaca

SEQ ID NO: 566987 - DNA, 25 bp, Mus musculus
cagcagctgattgaacagcagcaca

SEQ ID NO: 566988 - DNA, 25 bp, Mus musculus
cagcagctgccaacatagatgaagt

SEQ ID NO: 566989 - DNA, 25 bp, Mus musculus
cagcagctgccatcatagatgaagt

SEQ ID NO: 566990 - DNA, 25 bp, Mus musculus
cagcagctggcgcaagtcacccgtg

SEQ ID NO: 566991 - DNA, 25 bp, Mus musculus
cagcagctggcggaagtcacccgtg

SEQ ID NO: 566992 - DNA, 25 bp, Mus musculus
cagcagctgggacctgcacagatcc

SEQ ID NO: 566993 - DNA, 25 bp, Mus musculus
cagcagctgggagctgcacagatcc

SEQ ID NO: 566994 - DNA, 25 bp, Mus musculus
cagcagctgggcaccctcatcttgg

SEQ ID NO: 566995 - DNA, 25 bp, Mus musculus
cagcagctgggctccctcatcttgg

SEQ ID NO: 566996 - DNA, 25 bp, Mus musculus
cagcagctgggtcaggaaaaccctc

SEQ ID NO: 566997 - DNA, 25 bp, Mus musculus
cagcagctgggtgaggaaaaccctc

SEQ ID NO: 566998 - DNA, 25 bp, Mus musculus
cagcagctgtagcatgaccgggact

SEQ ID NO: 566999 - DNA, 25 bp, Mus musculus
cagcagctgtaggatgaccgggact

SEQ ID NO: 567000 - DNA, 25 bp, Mus musculus
cagcagctgttacagacaaaacata

SEQ ID NO: 567001 - DNA, 25 bp, Mus musculus
cagcagctgttagagacaaaacata

SEQ ID NO: 567002 - DNA, 25 bp, Mus musculus
cagcagcttctgcatgtacaccacg

SEQ ID NO: 567003 - DNA, 25 bp, Mus musculus
cagcagcttctggatgtacaccacg

SEQ ID NO: 567004 - DNA, 25 bp, Mus musculus
cagcagcttgctcagaaggaaaagg

SEQ ID NO: 567005 - DNA, 25 bp, Mus musculus
cagcagcttgctgagaaggaaaagg

SEQ ID NO: 567006 - DNA, 25 bp, Mus musculus
cagcagctttcaataacgtgggaac

SEQ ID NO: 567007 - DNA, 25 bp, Mus musculus
cagcagctttcattaacgtgggaac

SEQ ID NO: 567008 - DNA, 25 bp, Mus musculus
cagcaggaaactcccaactggtcag

SEQ ID NO: 567009 - DNA, 25 bp, Mus musculus
cagcaggaaactgccaactggtcag

SEQ ID NO: 567010 - DNA, 25 bp, Mus musculus
cagcaggaacaacgccagggtttac

SEQ ID NO: 567011 - DNA, 25 bp, Mus musculus
cagcaggaacaaggccagggtttac

SEQ ID NO: 567012 - DNA, 25 bp, Mus musculus
cagcaggaacatcgccgctgcctga

SEQ ID NO: 567013 - DNA, 25 bp, Mus musculus
cagcaggaacatggccgctgcctga

SEQ ID NO: 567014 - DNA, 25 bp, Mus musculus
cagcaggacaggaactaaacccaga

SEQ ID NO: 567015 - DNA, 25 bp, Mus musculus
cagcaggacaggtactaaacccaga

SEQ ID NO: 567016 - DNA, 25 bp, Mus musculus
cagcaggacctgagccctggacagg

SEQ ID NO: 567017 - DNA, 25 bp, Mus musculus
cagcaggacctgatgggcagagcca

SEQ ID NO: 567018 - DNA, 25 bp, Mus musculus
cagcaggacctgtgccctggacagg

SEQ ID NO: 567019 - DNA, 25 bp, Mus musculus
cagcaggacctgttgggcagagcca

SEQ ID NO: 567020 - DNA, 25 bp, Mus musculus
cagcaggactcacatcatgatggca

SEQ ID NO: 567021 - DNA, 25 bp, Mus musculus
cagcaggactcagatcatgatggca

SEQ ID NO: 567022 - DNA, 25 bp, Mus musculus
cagcaggactgcactgtatggtgtg

SEQ ID NO: 567023 - DNA, 25 bp, Mus musculus
cagcaggactgctctgtatggtgtg

SEQ ID NO: 567024 - DNA, 25 bp, Mus musculus
cagcaggagacgagtttcagaacgg

SEQ ID NO: 567025 - DNA, 25 bp, Mus musculus
cagcaggagacgtgtttcagaacgg

SEQ ID NO: 567026 - DNA, 25 bp, Mus musculus
cagcaggagcggcttcaagccatcg

SEQ ID NO: 567027 - DNA, 25 bp, Mus musculus
cagcaggagcgggttcaagccatcg

SEQ ID NO: 567028 - DNA, 25 bp, Mus musculus
cagcaggagggccagaagctgccgt

SEQ ID NO: 567029 - DNA, 25 bp, Mus musculus
cagcaggagggcgagaagctgccgt

SEQ ID NO: 567030 - DNA, 25 bp, Mus musculus
cagcaggagggtatcagtcaggtac

SEQ ID NO: 567031 - DNA, 25 bp, Mus musculus
cagcaggagggtttcagtcaggtac

SEQ ID NO: 567032 - DNA, 25 bp, Mus musculus
cagcaggagttacgcgcgatgcttt

SEQ ID NO: 567033 - DNA, 25 bp, Mus musculus
cagcaggagttaggcgcgatgcttt

SEQ ID NO: 567034 - DNA, 25 bp, Mus musculus
cagcaggatcatcgcagatcttggt

SEQ ID NO: 567035 - DNA, 25 bp, Mus musculus
cagcaggatcatggcagatcttggt

SEQ ID NO: 567036 - DNA, 25 bp, Mus musculus
cagcaggattgtccaggacctgagt

SEQ ID NO: 567037 - DNA, 25 bp, Mus musculus
cagcaggattgtgcaggacctgagt

SEQ ID NO: 567038 - DNA, 25 bp, Mus musculus
cagcaggcaaggagccagagcacct

SEQ ID NO: 567039 - DNA, 25 bp, Mus musculus
cagcaggcaaggtgccagagcacct

SEQ ID NO: 567040 - DNA, 25 bp, Mus musculus
cagcaggcaatgcaatggcatccga

SEQ ID NO: 567041 - DNA, 25 bp, Mus musculus
cagcaggcaatggaatggcatccga

SEQ ID NO: 567042 - DNA, 25 bp, Mus musculus
cagcaggcagcaatgaacatagtca

SEQ ID NO: 567043 - DNA, 25 bp, Mus musculus
cagcaggcagcattgaacatagtca

SEQ ID NO: 567044 - DNA, 25 bp, Mus musculus
cagcaggcagggactcgtagactat

SEQ ID NO: 567045 - DNA, 25 bp, Mus musculus
cagcaggcagggtctcgtagactat

SEQ ID NO: 567046 - DNA, 25 bp, Mus musculus
cagcaggcagtaccaactgcagcag

SEQ ID NO: 567047 - DNA, 25 bp, Mus musculus
cagcaggcagtaccatcactaaacc

SEQ ID NO: 567048 - DNA, 25 bp, Mus musculus
cagcaggcagtagcaactgcagcag

SEQ ID NO: 567049 - DNA, 25 bp, Mus musculus
cagcaggcagtagcatcactaaacc

SEQ ID NO: 567050 - DNA, 25 bp, Mus musculus
cagcaggcattcatggagactgtga

SEQ ID NO: 567051 - DNA, 25 bp, Mus musculus
cagcaggcattcttggagactgtga

SEQ ID NO: 567052 - DNA, 25 bp, Mus musculus
cagcaggccaagctgaaggaactgc

SEQ ID NO: 567053 - DNA, 25 bp, Mus musculus
cagcaggccaaggtgaaggaactgc

SEQ ID NO: 567054 - DNA, 25 bp, Mus musculus
cagcaggcgttgcagtatattcagc

SEQ ID NO: 567055 - DNA, 25 bp, Mus musculus
cagcaggcgttggagtatattcagc

SEQ ID NO: 567056 - DNA, 25 bp, Mus musculus
cagcaggctctcattgagcagagct

SEQ ID NO: 567057 - DNA, 25 bp, Mus musculus
cagcaggctctctttgagcagagct

SEQ ID NO: 567058 - DNA, 25 bp, Mus musculus
cagcaggctggcaacagtgcccagc

SEQ ID NO: 567059 - DNA, 25 bp, Mus musculus
cagcaggctggctacagtgcccagc

SEQ ID NO: 567060 - DNA, 25 bp, Mus musculus
cagcagggcaggaggtatccctaaa

SEQ ID NO: 567061 - DNA, 25 bp, Mus musculus
cagcagggcaggtggtatccctaaa

SEQ ID NO: 567062 - DNA, 25 bp, Mus musculus
cagcagggccacacctgggccagga

SEQ ID NO: 567063 - DNA, 25 bp, Mus musculus
cagcagggccactcctgggccagga

SEQ ID NO: 567064 - DNA, 25 bp, Mus musculus
cagcagggcttgaacttggaagatc

SEQ ID NO: 567065 - DNA, 25 bp, Mus musculus
cagcagggcttgtacttggaagatc

SEQ ID NO: 567066 - DNA, 25 bp, Mus musculus
cagcagggtaaacaagtggcctccc

SEQ ID NO: 567067 - DNA, 25 bp, Mus musculus
cagcagggtaaagaagtggcctccc

SEQ ID NO: 567068 - DNA, 25 bp, Mus musculus
cagcaggtagaaataatggtgaggc

SEQ ID NO: 567069 - DNA, 25 bp, Mus musculus
cagcaggtagaattaatggtgaggc

SEQ ID NO: 567070 - DNA, 25 bp, Mus musculus
cagcaggtagcactgaaacctctga

SEQ ID NO: 567071 - DNA, 25 bp, Mus musculus
cagcaggtagcagtgaaacctctga

SEQ ID NO: 567072 - DNA, 25 bp, Mus musculus
cagcaggtagctctgtaaagccagc

SEQ ID NO: 567073 - DNA, 25 bp, Mus musculus
cagcaggtagctgtgtaaagccagc

SEQ ID NO: 567074 - DNA, 25 bp, Mus musculus
cagcaggtcaacaggaccacactca

SEQ ID NO: 567075 - DNA, 25 bp, Mus musculus
cagcaggtcaactggaccacactca

SEQ ID NO: 567076 - DNA, 25 bp, Mus musculus
cagcaggtccagatccaccagattg

SEQ ID NO: 567077 - DNA, 25 bp, Mus musculus
cagcaggtccagttccaccagattg

SEQ ID NO: 567078 - DNA, 25 bp, Mus musculus
cagcaggtctctcatgaaacctttt

SEQ ID NO: 567079 - DNA, 25 bp, Mus musculus
cagcaggtctctgatgaaacctttt

SEQ ID NO: 567080 - DNA, 25 bp, Mus musculus
cagcaggtctgaagtgggagatcca

SEQ ID NO: 567081 - DNA, 25 bp, Mus musculus
cagcaggtctgatgtgggagatcca

SEQ ID NO: 567082 - DNA, 25 bp, Mus musculus
cagcaggtctttaccagtattgaca

SEQ ID NO: 567083 - DNA, 25 bp, Mus musculus
cagcaggtcttttccagtattgaca

SEQ ID NO: 567084 - DNA, 25 bp, Mus musculus
cagcaggtgacgctagcggatctca

SEQ ID NO: 567085 - DNA, 25 bp, Mus musculus
cagcaggtgacggtagcggatctca

SEQ ID NO: 567086 - DNA, 25 bp, Mus musculus
cagcaggtgagtaagagctttctcc

SEQ ID NO: 567087 - DNA, 25 bp, Mus musculus
cagcaggtgagttagagctttctcc

SEQ ID NO: 567088 - DNA, 25 bp, Mus musculus
cagcaggtgcttcctggcctacctt

SEQ ID NO: 567089 - DNA, 25 bp, Mus musculus
cagcaggtgcttgctggcctacctt

SEQ ID NO: 567090 - DNA, 25 bp, Mus musculus
cagcaggtgtccagtcaataaagag

SEQ ID NO: 567091 - DNA, 25 bp, Mus musculus
cagcaggtgtcctgtcaataaagag

SEQ ID NO: 567092 - DNA, 25 bp, Mus musculus
cagcaggtgttgaagaccttaggat

SEQ ID NO: 567093 - DNA, 25 bp, Mus musculus
cagcaggtgttgtagaccttaggat

SEQ ID NO: 567094 - DNA, 25 bp, Mus musculus
cagcaggtgtttcaatggaaggacc

SEQ ID NO: 567095 - DNA, 25 bp, Mus musculus
cagcaggtgtttgaatggaaggacc

SEQ ID NO: 567096 - DNA, 25 bp, Mus musculus
cagcagtaaagactcatctgtccca

SEQ ID NO: 567097 - DNA, 25 bp, Mus musculus
cagcagtaaagagtcatctgtccca

SEQ ID NO: 567098 - DNA, 25 bp, Mus musculus
cagcagtaagcaaacggtggaagca

SEQ ID NO: 567099 - DNA, 25 bp, Mus musculus
cagcagtaagcatacggtggaagca

SEQ ID NO: 567100 - DNA, 25 bp, Mus musculus
cagcagtacagtatggcattccgga

SEQ ID NO: 567101 - DNA, 25 bp, Mus musculus
cagcagtacagtttggcattccgga

SEQ ID NO: 567102 - DNA, 25 bp, Mus musculus
cagcagtatcagaagtcagtgttcc

SEQ ID NO: 567103 - DNA, 25 bp, Mus musculus
cagcagtatcagtagtcagtgttcc

SEQ ID NO: 567104 - DNA, 25 bp, Mus musculus
cagcagtcacggacctggattcgca

SEQ ID NO: 567105 - DNA, 25 bp, Mus musculus
cagcagtcacggtcctggattcgca

SEQ ID NO: 567106 - DNA, 25 bp, Mus musculus
cagcagtcagctcagatctccaaag

SEQ ID NO: 567107 - DNA, 25 bp, Mus musculus
cagcagtcagctctcaacacctaag

SEQ ID NO: 567108 - DNA, 25 bp, Mus musculus
cagcagtcagctgagatctccaaag

SEQ ID NO: 567109 - DNA, 25 bp, Mus musculus
cagcagtcagctgtcaacacctaag

SEQ ID NO: 567110 - DNA, 25 bp, Mus musculus
cagcagtcattgcttcgtttccacc

SEQ ID NO: 567111 - DNA, 25 bp, Mus musculus
cagcagtcattggttcgtttccacc

SEQ ID NO: 567112 - DNA, 25 bp, Mus musculus
cagcagtcccggcaggtcatcgaca

SEQ ID NO: 567113 - DNA, 25 bp, Mus musculus
cagcagtcccgggaggtcatcgaca

SEQ ID NO: 567114 - DNA, 25 bp, Mus musculus
cagcagtcggcgactttctacgtat

SEQ ID NO: 567115 - DNA, 25 bp, Mus musculus
cagcagtcggcgtctttctacgtat

SEQ ID NO: 567116 - DNA, 25 bp, Mus musculus
cagcagtctggaatatattagacaa

SEQ ID NO: 567117 - DNA, 25 bp, Mus musculus
cagcagtctggattatattagacaa

SEQ ID NO: 567118 - DNA, 25 bp, Mus musculus
cagcagtctgtcagaatccttacca

SEQ ID NO: 567119 - DNA, 25 bp, Mus musculus
cagcagtctgtctgaatccttacca

SEQ ID NO: 567120 - DNA, 25 bp, Mus musculus
cagcagtcttccatgaggatgtgca

SEQ ID NO: 567121 - DNA, 25 bp, Mus musculus
cagcagtcttccttgaggatgtgca

SEQ ID NO: 567122 - DNA, 25 bp, Mus musculus
cagcagtgaagtacctacagaattc

SEQ ID NO: 567123 - DNA, 25 bp, Mus musculus
cagcagtgaagttcctacagaattc

SEQ ID NO: 567124 - DNA, 25 bp, Mus musculus
cagcagtgaatcatgggaatccccg

SEQ ID NO: 567125 - DNA, 25 bp, Mus musculus
cagcagtgaatcttgggaatccccg

SEQ ID NO: 567126 - DNA, 25 bp, Mus musculus
cagcagtgacctatataagaggaca

SEQ ID NO: 567127 - DNA, 25 bp, Mus musculus
cagcagtgacctttataagaggaca

SEQ ID NO: 567128 - DNA, 25 bp, Mus musculus
cagcagtgataaccaggtggagaca

SEQ ID NO: 567129 - DNA, 25 bp, Mus musculus
cagcagtgataagcaggtggagaca

SEQ ID NO: 567130 - DNA, 25 bp, Mus musculus
cagcagtgatccaccctttgaagtg

SEQ ID NO: 567131 - DNA, 25 bp, Mus musculus
cagcagtgatcctccctttgaagtg

SEQ ID NO: 567132 - DNA, 25 bp, Mus musculus
cagcagtgcataatccttcacagcc

SEQ ID NO: 567133 - DNA, 25 bp, Mus musculus
cagcagtgcatattccttcacagcc

SEQ ID NO: 567134 - DNA, 25 bp, Mus musculus
cagcagtgcatcaacgaggctcagc

SEQ ID NO: 567135 - DNA, 25 bp, Mus musculus
cagcagtgcatctacgaggctcagc

SEQ ID NO: 567136 - DNA, 25 bp, Mus musculus
cagcagtgctggaccaaagaggacc

SEQ ID NO: 567137 - DNA, 25 bp, Mus musculus
cagcagtgctggctactttagccac

SEQ ID NO: 567138 - DNA, 25 bp, Mus musculus
cagcagtgctgggtactttagccac

SEQ ID NO: 567139 - DNA, 25 bp, Mus musculus
cagcagtgctggtccaaagaggacc

SEQ ID NO: 567140 - DNA, 25 bp, Mus musculus
cagcagtggacaagttggctttatc

SEQ ID NO: 567141 - DNA, 25 bp, Mus musculus
cagcagtggacatgttggctttatc

SEQ ID NO: 567142 - DNA, 25 bp, Mus musculus
cagcagtggaggacaagttaaatgt

SEQ ID NO: 567143 - DNA, 25 bp, Mus musculus
cagcagtggaggtcaagttaaatgt

SEQ ID NO: 567144 - DNA, 25 bp, Mus musculus
cagcagtgtcacctctaagatccgc

SEQ ID NO: 567145 - DNA, 25 bp, Mus musculus
cagcagtgtcacgtctaagatccgc

SEQ ID NO: 567146 - DNA, 25 bp, Mus musculus
cagcagtgtgcccacttctgtgaga

SEQ ID NO: 567147 - DNA, 25 bp, Mus musculus
cagcagtgtgccgacttctgtgaga

SEQ ID NO: 567148 - DNA, 25 bp, Mus musculus
cagcagtgtttcaggatgacgaacc

SEQ ID NO: 567149 - DNA, 25 bp, Mus musculus
cagcagtgtttctggatgacgaacc

SEQ ID NO: 567150 - DNA, 25 bp, Mus musculus
cagcagttacaaaatgggcagcagc

SEQ ID NO: 567151 - DNA, 25 bp, Mus musculus
cagcagttacaatatgggcagcagc

SEQ ID NO: 567152 - DNA, 25 bp, Mus musculus
cagcagttcaaacaagaggtggaaa

SEQ ID NO: 567153 - DNA, 25 bp, Mus musculus
cagcagttcaaagaagaggtggaaa

SEQ ID NO: 567154 - DNA, 25 bp, Mus musculus
cagcagttccctctggacctggaga

SEQ ID NO: 567155 - DNA, 25 bp, Mus musculus
cagcagttccctgtggacctggaga

SEQ ID NO: 567156 - DNA, 25 bp, Mus musculus
cagcagttccttagcctgaagccga

SEQ ID NO: 567157 - DNA, 25 bp, Mus musculus
cagcagttcctttgcctgaagccga

SEQ ID NO: 567158 - DNA, 25 bp, Mus musculus
cagcagttctcgcttctggaaacaa

SEQ ID NO: 567159 - DNA, 25 bp, Mus musculus
cagcagttctcggttctggaaacaa

SEQ ID NO: 567160 - DNA, 25 bp, Mus musculus
cagcagttgaacattcatggattgt

SEQ ID NO: 567161 - DNA, 25 bp, Mus musculus
cagcagttgaactttcatggattgt

SEQ ID NO: 567162 - DNA, 25 bp, Mus musculus
cagcagttgaagcaatgccaagtaa

SEQ ID NO: 567163 - DNA, 25 bp, Mus musculus
cagcagttgaaggaatgccaagtaa

SEQ ID NO: 567164 - DNA, 25 bp, Mus musculus
cagcagttgccccttagaatgtgga

SEQ ID NO: 567165 - DNA, 25 bp, Mus musculus
cagcagttgcccgttagaatgtgga

SEQ ID NO: 567166 - DNA, 25 bp, Mus musculus
cagcagttgcgaagcactgaggcaa

SEQ ID NO: 567167 - DNA, 25 bp, Mus musculus
cagcagttgcgatgcactgaggcaa

SEQ ID NO: 567168 - DNA, 25 bp, Mus musculus
cagcagttgcttccatacaggagca

SEQ ID NO: 567169 - DNA, 25 bp, Mus musculus
cagcagttgcttgcatacaggagca

SEQ ID NO: 567170 - DNA, 25 bp, Mus musculus
cagcagttgggaagcaggccaagaa

SEQ ID NO: 567171 - DNA, 25 bp, Mus musculus
cagcagttgggatgcaggccaagaa

SEQ ID NO: 567172 - DNA, 25 bp, Mus musculus
cagcagttgtgaaaagtgggtacca

SEQ ID NO: 567173 - DNA, 25 bp, Mus musculus
cagcagttgtgataagtgggtacca

SEQ ID NO: 567174 - DNA, 25 bp, Mus musculus
cagcagtttccacagttcggtcagg

SEQ ID NO: 567175 - DNA, 25 bp, Mus musculus
cagcagtttccagagttcggtcagg

SEQ ID NO: 567176 - DNA, 25 bp, Mus musculus
cagcagtttgaccacctcttccggg

SEQ ID NO: 567177 - DNA, 25 bp, Mus musculus
cagcagtttgacgacctcttccggg

SEQ ID NO: 567178 - DNA, 25 bp, Mus musculus
cagcagtttgcaccactacagctca

SEQ ID NO: 567179 - DNA, 25 bp, Mus musculus
cagcagtttgcagcactacagctca

SEQ ID NO: 567180 - DNA, 25 bp, Mus musculus
cagcagttttgaccagtggatgctg

SEQ ID NO: 567181 - DNA, 25 bp, Mus musculus
cagcagttttgagcagtggatgctg

SEQ ID NO: 567182 - DNA, 25 bp, Mus musculus
cagcataagaaaaacagaagtgtca

SEQ ID NO: 567183 - DNA, 25 bp, Mus musculus
cagcataagaaatacagaagtgtca

SEQ ID NO: 567184 - DNA, 25 bp, Mus musculus
cagcataagaccatctgtagtggtt

SEQ ID NO: 567185 - DNA, 25 bp, Mus musculus
cagcataagaccttctgtagtggtt

SEQ ID NO: 567186 - DNA, 25 bp, Mus musculus
cagcataccacacgatcctcagaga

SEQ ID NO: 567187 - DNA, 25 bp, Mus musculus
cagcataccacaggatcctcagaga

SEQ ID NO: 567188 - DNA, 25 bp, Mus musculus
cagcatacgggccttcggagaagct

SEQ ID NO: 567189 - DNA, 25 bp, Mus musculus
cagcatacgggcgttcggagaagct

SEQ ID NO: 567190 - DNA, 25 bp, Mus musculus
cagcatacggtgctgtgtttggaaa

SEQ ID NO: 567191 - DNA, 25 bp, Mus musculus
cagcatacggtggtgtgtttggaaa

SEQ ID NO: 567192 - DNA, 25 bp, Mus musculus
cagcatagagaccaacatccgtgtg

SEQ ID NO: 567193 - DNA, 25 bp, Mus musculus
cagcatagagacgaacatccgtgtg

SEQ ID NO: 567194 - DNA, 25 bp, Mus musculus
cagcatagtgatcagagcagtgcaa

SEQ ID NO: 567195 - DNA, 25 bp, Mus musculus
cagcatagtgatgagagcagtgcaa

SEQ ID NO: 567196 - DNA, 25 bp, Mus musculus
cagcatatcgtacacgttgtcacgg

SEQ ID NO: 567197 - DNA, 25 bp, Mus musculus
cagcatatcgtagacgttgtcacgg

SEQ ID NO: 567198 - DNA, 25 bp, Mus musculus
cagcatcaagccatctaccatgtgg

SEQ ID NO: 567199 - DNA, 25 bp, Mus musculus
cagcatcaagcccttgctgcgcaga

SEQ ID NO: 567200 - DNA, 25 bp, Mus musculus
cagcatcaagccgttgctgcgcaga

SEQ ID NO: 567201 - DNA, 25 bp, Mus musculus
cagcatcaagccttctaccatgtgg

SEQ ID NO: 567202 - DNA, 25 bp, Mus musculus
cagcatcaatccctgccttaatggg

SEQ ID NO: 567203 - DNA, 25 bp, Mus musculus
cagcatcaatccgtgccttaatggg

SEQ ID NO: 567204 - DNA, 25 bp, Mus musculus
cagcatcaccgacggtgtcaccgag

SEQ ID NO: 567205 - DNA, 25 bp, Mus musculus
cagcatcaccgagggtgtcaccgag

SEQ ID NO: 567206 - DNA, 25 bp, Mus musculus
cagcatcagcgacgaacagattaag

SEQ ID NO: 567207 - DNA, 25 bp, Mus musculus
cagcatcagcgaggaacagattaag

SEQ ID NO: 567208 - DNA, 25 bp, Mus musculus
cagcatcaggccaaggtgctgatgt

SEQ ID NO: 567209 - DNA, 25 bp, Mus musculus
cagcatcaggcctaggtgctgatgt

SEQ ID NO: 567210 - DNA, 25 bp, Mus musculus
cagcatcaggtgcaactatgtggcc

SEQ ID NO: 567211 - DNA, 25 bp, Mus musculus
cagcatcaggtggaactatgtggcc

SEQ ID NO: 567212 - DNA, 25 bp, Mus musculus
cagcatcattaactcaggaacttca

SEQ ID NO: 567213 - DNA, 25 bp, Mus musculus
cagcatcattaagtcaggaacttca

SEQ ID NO: 567214 - DNA, 25 bp, Mus musculus
cagcatccaggtcctgcatgcgttt

SEQ ID NO: 567215 - DNA, 25 bp, Mus musculus
cagcatccaggtgctgcatgcgttt

SEQ ID NO: 567216 - DNA, 25 bp, Mus musculus
cagcatccagtcagctgccactttt

SEQ ID NO: 567217 - DNA, 25 bp, Mus musculus
cagcatccagtctgctgccactttt

SEQ ID NO: 567218 - DNA, 25 bp, Mus musculus
cagcatcccaaacgtgtcagccgat

SEQ ID NO: 567219 - DNA, 25 bp, Mus musculus
cagcatcccaaaggtgtcagccgat

SEQ ID NO: 567220 - DNA, 25 bp, Mus musculus
cagcatcccagacaatgaggtgatc

SEQ ID NO: 567221 - DNA, 25 bp, Mus musculus
cagcatcccagagaatgaggtgatc

SEQ ID NO: 567222 - DNA, 25 bp, Mus musculus
cagcatccccttcatacagggcaag

SEQ ID NO: 567223 - DNA, 25 bp, Mus musculus
cagcatccccttgatacagggcaag

SEQ ID NO: 567224 - DNA, 25 bp, Mus musculus
cagcatccggccaggaatggtgcct

SEQ ID NO: 567225 - DNA, 25 bp, Mus musculus
cagcatccggcctggaatggtgcct

SEQ ID NO: 567226 - DNA, 25 bp, Mus musculus
cagcatccggtactttgagatcaca

SEQ ID NO: 567227 - DNA, 25 bp, Mus musculus
cagcatccggtagtttgagatcaca

SEQ ID NO: 567228 - DNA, 25 bp, Mus musculus
cagcatcctctactggctgggcaat

SEQ ID NO: 567229 - DNA, 25 bp, Mus musculus
cagcatcctctagtggctgggcaat

SEQ ID NO: 567230 - DNA, 25 bp, Mus musculus
cagcatcctgagcacagccgagtat

SEQ ID NO: 567231 - DNA, 25 bp, Mus musculus
cagcatcctgaggacagccgagtat

SEQ ID NO: 567232 - DNA, 25 bp, Mus musculus
cagcatcctgctccaaagatgatag

SEQ ID NO: 567233 - DNA, 25 bp, Mus musculus
cagcatcctgctgcaaagatgatag

SEQ ID NO: 567234 - DNA, 25 bp, Mus musculus
cagcatcgacaaccctggctacgag

SEQ ID NO: 567235 - DNA, 25 bp, Mus musculus
cagcatcgacaagcctggctacgag

SEQ ID NO: 567236 - DNA, 25 bp, Mus musculus
cagcatcgatgaagctgagtgtttc

SEQ ID NO: 567237 - DNA, 25 bp, Mus musculus
cagcatcgatgatgctgagtgtttc

SEQ ID NO: 567238 - DNA, 25 bp, Mus musculus
cagcatcgcgccacttcatgaagga

SEQ ID NO: 567239 - DNA, 25 bp, Mus musculus
cagcatcgcgcctcttcatgaagga

SEQ ID NO: 567240 - DNA, 25 bp, Mus musculus
cagcatcgctctcgcctcttgagga

SEQ ID NO: 567241 - DNA, 25 bp, Mus musculus
cagcatcgctctggcctcttgagga

SEQ ID NO: 567242 - DNA, 25 bp, Mus musculus
cagcatcgtatcatcagaggaggac

SEQ ID NO: 567243 - DNA, 25 bp, Mus musculus
cagcatcgtatcttcagaggaggac

SEQ ID NO: 567244 - DNA, 25 bp, Mus musculus
cagcatcgtcaacgcagtgatgtgg

SEQ ID NO: 567245 - DNA, 25 bp, Mus musculus
cagcatcgtcaaggcagtgatgtgg

SEQ ID NO: 567246 - DNA, 25 bp, Mus musculus
cagcatctatcacagtatctagtac

SEQ ID NO: 567247 - DNA, 25 bp, Mus musculus
cagcatctatcagagtatctagtac

SEQ ID NO: 567248 - DNA, 25 bp, Mus musculus
cagcatctcatccactctgtgtgag

SEQ ID NO: 567249 - DNA, 25 bp, Mus musculus
cagcatctcatcgactctgtgtgag

SEQ ID NO: 567250 - DNA, 25 bp, Mus musculus
cagcatctgactacctgtgcacctt

SEQ ID NO: 567251 - DNA, 25 bp, Mus musculus
cagcatctgacttcctgtgcacctt

SEQ ID NO: 567252 - DNA, 25 bp, Mus musculus
cagcatctggagcatcctcagaaaa

SEQ ID NO: 567253 - DNA, 25 bp, Mus musculus
cagcatctggaggatcctcagaaaa

SEQ ID NO: 567254 - DNA, 25 bp, Mus musculus
cagcatctggcaactatttatgaga

SEQ ID NO: 567255 - DNA, 25 bp, Mus musculus
cagcatctggcatctatttatgaga

SEQ ID NO: 567256 - DNA, 25 bp, Mus musculus
cagcatcttctaattatgggacaga

SEQ ID NO: 567257 - DNA, 25 bp, Mus musculus
cagcatcttctatttatgggacaga

SEQ ID NO: 567258 - DNA, 25 bp, Mus musculus
cagcatcttgtgcactttgactgcc

SEQ ID NO: 567259 - DNA, 25 bp, Mus musculus
cagcatcttgtggactttgactgcc

SEQ ID NO: 567260 - DNA, 25 bp, Mus musculus
cagcatgaacatctgatccacctca

SEQ ID NO: 567261 - DNA, 25 bp, Mus musculus
cagcatgaacatgtgatccacctca

SEQ ID NO: 567262 - DNA, 25 bp, Mus musculus
cagcatgacatgagccgcttccatt

SEQ ID NO: 567263 - DNA, 25 bp, Mus musculus
cagcatgacatgtgccgcttccatt

SEQ ID NO: 567264 - DNA, 25 bp, Mus musculus
cagcatgagcgtaaccactggagaa

SEQ ID NO: 567265 - DNA, 25 bp, Mus musculus
cagcatgagcgttaccactggagaa

SEQ ID NO: 567266 - DNA, 25 bp, Mus musculus
cagcatgatccacgaatccgactgc

SEQ ID NO: 567267 - DNA, 25 bp, Mus musculus
cagcatgatccaggaatccgactgc

SEQ ID NO: 567268 - DNA, 25 bp, Mus musculus
cagcatgcaccaataccctggaagc

SEQ ID NO: 567269 - DNA, 25 bp, Mus musculus
cagcatgcaccattaccctggaagc

SEQ ID NO: 567270 - DNA, 25 bp, Mus musculus
cagcatgcagtgctttagagaatgg

SEQ ID NO: 567271 - DNA, 25 bp, Mus musculus
cagcatgcagtggtttagagaatgg

SEQ ID NO: 567272 - DNA, 25 bp, Mus musculus
cagcatgcgctgagatctaggagaa

SEQ ID NO: 567273 - DNA, 25 bp, Mus musculus
cagcatgcgctgtgatctaggagaa

SEQ ID NO: 567274 - DNA, 25 bp, Mus musculus
cagcatgcgtacagactgggcagcc

SEQ ID NO: 567275 - DNA, 25 bp, Mus musculus
cagcatgcgtactgactgggcagcc

SEQ ID NO: 567276 - DNA, 25 bp, Mus musculus
cagcatgctccgagatgttcagtgg

SEQ ID NO: 567277 - DNA, 25 bp, Mus musculus
cagcatgctccgtgatgttcagtgg

SEQ ID NO: 567278 - DNA, 25 bp, Mus musculus
cagcatgctcgcactagcgggcgtg

SEQ ID NO: 567279 - DNA, 25 bp, Mus musculus
cagcatgctcgctctagcgggcgtg

SEQ ID NO: 567280 - DNA, 25 bp, Mus musculus
cagcatggatgcagtctgctctgcc

SEQ ID NO: 567281 - DNA, 25 bp, Mus musculus
cagcatggatgccaccagtgagaga

SEQ ID NO: 567282 - DNA, 25 bp, Mus musculus
cagcatggatgcgaccagtgagaga

SEQ ID NO: 567283 - DNA, 25 bp, Mus musculus
cagcatggatgctgtctgctctgcc

SEQ ID NO: 567284 - DNA, 25 bp, Mus musculus
cagcatggattaatgtgcaacacaa

SEQ ID NO: 567285 - DNA, 25 bp, Mus musculus
cagcatggattattgtgcaacacaa

SEQ ID NO: 567286 - DNA, 25 bp, Mus musculus
cagcatggcaggaggaagctgtccc

SEQ ID NO: 567287 - DNA, 25 bp, Mus musculus
cagcatggcaggtggaagctgtccc

SEQ ID NO: 567288 - DNA, 25 bp, Mus musculus
cagcatggctagcacggccttggaa

SEQ ID NO: 567289 - DNA, 25 bp, Mus musculus
cagcatggctaggacggccttggaa

SEQ ID NO: 567290 - DNA, 25 bp, Mus musculus
cagcatggcttcactggtatcccca

SEQ ID NO: 567291 - DNA, 25 bp, Mus musculus
cagcatggcttcctgctgcgggacc

SEQ ID NO: 567292 - DNA, 25 bp, Mus musculus
cagcatggcttcgtgctgcgggacc

SEQ ID NO: 567293 - DNA, 25 bp, Mus musculus
cagcatggcttctctggtatcccca

SEQ ID NO: 567294 - DNA, 25 bp, Mus musculus
cagcatgggaacaaccaggaggaag

SEQ ID NO: 567295 - DNA, 25 bp, Mus musculus
cagcatgggaactaccaggaggaag

SEQ ID NO: 567296 - DNA, 25 bp, Mus musculus
cagcatgtaaagacatgggatacaa

SEQ ID NO: 567297 - DNA, 25 bp, Mus musculus
cagcatgtaaagtcatgggatacaa

SEQ ID NO: 567298 - DNA, 25 bp, Mus musculus
cagcatgtactgcaacatggtcgac

SEQ ID NO: 567299 - DNA, 25 bp, Mus musculus
cagcatgtactggaacatggtcgac

SEQ ID NO: 567300 - DNA, 25 bp, Mus musculus
cagcatgtacttatcagctgtaatg

SEQ ID NO: 567301 - DNA, 25 bp, Mus musculus
cagcatgtacttttcagctgtaatg

SEQ ID NO: 567302 - DNA, 25 bp, Mus musculus
cagcatgtccaaccacaaacttatt

SEQ ID NO: 567303 - DNA, 25 bp, Mus musculus
cagcatgtccaagcacaaacttatt

SEQ ID NO: 567304 - DNA, 25 bp, Mus musculus
cagcatgttctcctttcaccggcaa

SEQ ID NO: 567305 - DNA, 25 bp, Mus musculus
cagcatgttctcgtttcaccggcaa

SEQ ID NO: 567306 - DNA, 25 bp, Mus musculus
cagcatgttgaaatgagtaccacag

SEQ ID NO: 567307 - DNA, 25 bp, Mus musculus
cagcatgttgaattgagtaccacag

SEQ ID NO: 567308 - DNA, 25 bp, Mus musculus
cagcattaatatccttttctcctgg

SEQ ID NO: 567309 - DNA, 25 bp, Mus musculus
cagcattaatatgcttttctcctgg

SEQ ID NO: 567310 - DNA, 25 bp, Mus musculus
cagcattaggacatttagaggttac

SEQ ID NO: 567311 - DNA, 25 bp, Mus musculus
cagcattaggacttttagaggttac

SEQ ID NO: 567312 - DNA, 25 bp, Mus musculus
cagcattatgtcagtagctcagagg

SEQ ID NO: 567313 - DNA, 25 bp, Mus musculus
cagcattatgtctgtagctcagagg

SEQ ID NO: 567314 - DNA, 25 bp, Mus musculus
cagcattcagaaagtgtataagacc

SEQ ID NO: 567315 - DNA, 25 bp, Mus musculus
cagcattcagaatgtgtataagacc

SEQ ID NO: 567316 - DNA, 25 bp, Mus musculus
cagcattcggatatcttcaatgtca

SEQ ID NO: 567317 - DNA, 25 bp, Mus musculus
cagcattcggatcatgtcctgccct

SEQ ID NO: 567318 - DNA, 25 bp, Mus musculus
cagcattcggatgatgtcctgccct

SEQ ID NO: 567319 - DNA, 25 bp, Mus musculus
cagcattcggatttcttcaatgtca

SEQ ID NO: 567320 - DNA, 25 bp, Mus musculus
cagcattcttgacctggcagcttgt

SEQ ID NO: 567321 - DNA, 25 bp, Mus musculus
cagcattcttgagctggcagcttgt

SEQ ID NO: 567322 - DNA, 25 bp, Mus musculus
cagcattgaacactcgggcgagtat

SEQ ID NO: 567323 - DNA, 25 bp, Mus musculus
cagcattgaacagtcgggcgagtat

SEQ ID NO: 567324 - DNA, 25 bp, Mus musculus
cagcattgagacatgtttgtaatcg

SEQ ID NO: 567325 - DNA, 25 bp, Mus musculus
cagcattgagacttgtttgtaatcg

SEQ ID NO: 567326 - DNA, 25 bp, Mus musculus
cagcattgatctcatgtactttccc

SEQ ID NO: 567327 - DNA, 25 bp, Mus musculus
cagcattgatctgatgtactttccc

SEQ ID NO: 567328 - DNA, 25 bp, Mus musculus
cagcattgccaacatggacggcaag

SEQ ID NO: 567329 - DNA, 25 bp, Mus musculus
cagcattgccaagatggacggcaag

SEQ ID NO: 567330 - DNA, 25 bp, Mus musculus
cagcattgcgcactgatgaagtgat

SEQ ID NO: 567331 - DNA, 25 bp, Mus musculus
cagcattgcgcagtgatgaagtgat

SEQ ID NO: 567332 - DNA, 25 bp, Mus musculus
cagcattgctagactttctctccag

SEQ ID NO: 567333 - DNA, 25 bp, Mus musculus
cagcattgctagtctttctctccag

SEQ ID NO: 567334 - DNA, 25 bp, Mus musculus
cagcattggcgacgttgaatctgca

SEQ ID NO: 567335 - DNA, 25 bp, Mus musculus
cagcattggcgaggttgaatctgca

SEQ ID NO: 567336 - DNA, 25 bp, Mus musculus
cagcatttcagcagatactcataag

SEQ ID NO: 567337 - DNA, 25 bp, Mus musculus
cagcatttcagctgatactcataag

SEQ ID NO: 567338 - DNA, 25 bp, Mus musculus
cagcatttcagtcgaggttgtatct

SEQ ID NO: 567339 - DNA, 25 bp, Mus musculus
cagcatttcagtggaggttgtatct

SEQ ID NO: 567340 - DNA, 25 bp, Mus musculus
cagcatttggaacagggtgcttccc

SEQ ID NO: 567341 - DNA, 25 bp, Mus musculus
cagcatttggaagagggtgcttccc

SEQ ID NO: 567342 - DNA, 25 bp, Mus musculus
cagcatttggtaagtgcttggttcc

SEQ ID NO: 567343 - DNA, 25 bp, Mus musculus
cagcatttggtatgtgcttggttcc

SEQ ID NO: 567344 - DNA, 25 bp, Mus musculus
cagcattttcataggagggagtttc

SEQ ID NO: 567345 - DNA, 25 bp, Mus musculus
cagcattttcattggagggagtttc

SEQ ID NO: 567346 - DNA, 25 bp, Mus musculus
cagccaaaacatagtacatatctga

SEQ ID NO: 567347 - DNA, 25 bp, Mus musculus
cagccaaaacattgtacatatctga

SEQ ID NO: 567348 - DNA, 25 bp, Mus musculus
cagccaaagctactttaggagagac

SEQ ID NO: 567349 - DNA, 25 bp, Mus musculus
cagccaaagctagtttaggagagac

SEQ ID NO: 567350 - DNA, 25 bp, Mus musculus
cagccaaatctacatggagactagg

SEQ ID NO: 567351 - DNA, 25 bp, Mus musculus
cagccaaatctagatggagactagg

SEQ ID NO: 567352 - DNA, 25 bp, Mus musculus
cagccaacggctactcaatgaggtc

SEQ ID NO: 567353 - DNA, 25 bp, Mus musculus
cagccaacggcttctcaatgaggtc

SEQ ID NO: 567354 - DNA, 25 bp, Mus musculus
cagccaacgtgtccgagtccattag

SEQ ID NO: 567355 - DNA, 25 bp, Mus musculus
cagccaacgtgtgcgagtccattag

SEQ ID NO: 567356 - DNA, 25 bp, Mus musculus
cagccaagaaaaagttaccagtacc

SEQ ID NO: 567357 - DNA, 25 bp, Mus musculus
cagccaagaaaatgttaccagtacc

SEQ ID NO: 567358 - DNA, 25 bp, Mus musculus
cagccaagaacgcacatctggtgac

SEQ ID NO: 567359 - DNA, 25 bp, Mus musculus
cagccaagaacggacatctggtgac

SEQ ID NO: 567360 - DNA, 25 bp, Mus musculus
cagccaagaagaaagggagatatct

SEQ ID NO: 567361 - DNA, 25 bp, Mus musculus
cagccaagaagatagggagatatct

SEQ ID NO: 567362 - DNA, 25 bp, Mus musculus
cagccaagcctaatcactgagggca

SEQ ID NO: 567363 - DNA, 25 bp, Mus musculus
cagccaagcctattcactgagggca

SEQ ID NO: 567364 - DNA, 25 bp, Mus musculus
cagccaagctctcggatgtccgaga

SEQ ID NO: 567365 - DNA, 25 bp, Mus musculus
cagccaagctctgggatgtccgaga

SEQ ID NO: 567366 - DNA, 25 bp, Mus musculus
cagccaaggaggagcaaaagtcaga

SEQ ID NO: 567367 - DNA, 25 bp, Mus musculus
cagccaaggaggtgcaaaagtcaga

SEQ ID NO: 567368 - DNA, 25 bp, Mus musculus
cagccaaggctacattgacactgag

SEQ ID NO: 567369 - DNA, 25 bp, Mus musculus
cagccaaggctagattgacactgag

SEQ ID NO: 567370 - DNA, 25 bp, Mus musculus
cagccaaggcttagacatctctccg

SEQ ID NO: 567371 - DNA, 25 bp, Mus musculus
cagccaaggctttgacatctctccg

SEQ ID NO: 567372 - DNA, 25 bp, Mus musculus
cagccaaggtcccagtgcttgtcca

SEQ ID NO: 567373 - DNA, 25 bp, Mus musculus
cagccaaggtccgagtgcttgtcca

SEQ ID NO: 567374 - DNA, 25 bp, Mus musculus
cagccaagtcacagtgcagcgcgcg

SEQ ID NO: 567375 - DNA, 25 bp, Mus musculus
cagccaagtcactgtgcagcgcgcg

SEQ ID NO: 567376 - DNA, 25 bp, Mus musculus
cagccaagtgctatgacatgccgat

SEQ ID NO: 567377 - DNA, 25 bp, Mus musculus
cagccaagtgctttgacatgccgat

SEQ ID NO: 567378 - DNA, 25 bp, Mus musculus
cagccaataatgatcacacagtagt

SEQ ID NO: 567379 - DNA, 25 bp, Mus musculus
cagccaataatgttcacacagtagt

SEQ ID NO: 567380 - DNA, 25 bp, Mus musculus
cagccaatacgaactgcctgacagc

SEQ ID NO: 567381 - DNA, 25 bp, Mus musculus
cagccaatacgatctgcctgacagc

SEQ ID NO: 567382 - DNA, 25 bp, Mus musculus
cagccaatcatgcaagcccttagag

SEQ ID NO: 567383 - DNA, 25 bp, Mus musculus
cagccaatcatggaagcccttagag

SEQ ID NO: 567384 - DNA, 25 bp, Mus musculus
cagccaatgagaatgtgtcagacaa

SEQ ID NO: 567385 - DNA, 25 bp, Mus musculus
cagccaatgagattgtgtcagacaa

SEQ ID NO: 567386 - DNA, 25 bp, Mus musculus
cagccaatgctaaatgaccccagtt

SEQ ID NO: 567387 - DNA, 25 bp, Mus musculus
cagccaatgctatatgaccccagtt

SEQ ID NO: 567388 - DNA, 25 bp, Mus musculus
cagccaatgctcagtggagttcaga

SEQ ID NO: 567389 - DNA, 25 bp, Mus musculus
cagccaatgctctgtggagttcaga

SEQ ID NO: 567390 - DNA, 25 bp, Mus musculus
cagccaatggaccaagatttatctt

SEQ ID NO: 567391 - DNA, 25 bp, Mus musculus
cagccaatggacgaagatttatctt

SEQ ID NO: 567392 - DNA, 25 bp, Mus musculus
cagccaattggcacggagacatggc

SEQ ID NO: 567393 - DNA, 25 bp, Mus musculus
cagccaattggctcggagacatggc

SEQ ID NO: 567394 - DNA, 25 bp, Mus musculus
cagccacaagtcaggaaggacaaat

SEQ ID NO: 567395 - DNA, 25 bp, Mus musculus
cagccacaagtctggaaggacaaat

SEQ ID NO: 567396 - DNA, 25 bp, Mus musculus
cagccacaatgacaggtaagactcg

SEQ ID NO: 567397 - DNA, 25 bp, Mus musculus
cagccacaatgagaggtaagactcg

SEQ ID NO: 567398 - DNA, 25 bp, Mus musculus
cagccacaatggacagaacctatgc

SEQ ID NO: 567399 - DNA, 25 bp, Mus musculus
cagccacaatggtcagaacctatgc

SEQ ID NO: 567400 - DNA, 25 bp, Mus musculus
cagccacagacactgtgctcacaga

SEQ ID NO: 567401 - DNA, 25 bp, Mus musculus
cagccacagacagtgtgctcacaga

SEQ ID NO: 567402 - DNA, 25 bp, Mus musculus
cagccacagccactattgcaggagc

SEQ ID NO: 567403 - DNA, 25 bp, Mus musculus
cagccacagccagtattgcaggagc

SEQ ID NO: 567404 - DNA, 25 bp, Mus musculus
cagccacaggccagtgggacgcaga

SEQ ID NO: 567405 - DNA, 25 bp, Mus musculus
cagccacaggcctgtgggacgcaga

SEQ ID NO: 567406 - DNA, 25 bp, Mus musculus
cagccacagtctcaatggttcggga

SEQ ID NO: 567407 - DNA, 25 bp, Mus musculus
cagccacagtctgaatggttcggga

SEQ ID NO: 567408 - DNA, 25 bp, Mus musculus
cagccacagtggaagtaactttacc

SEQ ID NO: 567409 - DNA, 25 bp, Mus musculus
cagccacagtggtagtaactttacc

SEQ ID NO: 567410 - DNA, 25 bp, Mus musculus
cagccacatactcgaatccgagtct

SEQ ID NO: 567411 - DNA, 25 bp, Mus musculus
cagccacatactggaatccgagtct

SEQ ID NO: 567412 - DNA, 25 bp, Mus musculus
cagccacatgccacatggagggagc

SEQ ID NO: 567413 - DNA, 25 bp, Mus musculus
cagccacatgcctcatggagggagc

SEQ ID NO: 567414 - DNA, 25 bp, Mus musculus
cagccacatggtatgaggttcctgt

SEQ ID NO: 567415 - DNA, 25 bp, Mus musculus
cagccacatggtttgaggttcctgt

SEQ ID NO: 567416 - DNA, 25 bp, Mus musculus
cagccaccacacactgtcctcaagt

SEQ ID NO: 567417 - DNA, 25 bp, Mus musculus
cagccaccacactctgtcctcaagt

SEQ ID NO: 567418 - DNA, 25 bp, Mus musculus
cagccaccatgaattacgggccatg

SEQ ID NO: 567419 - DNA, 25 bp, Mus musculus
cagccaccatgatttacgggccatg

SEQ ID NO: 567420 - DNA, 25 bp, Mus musculus
cagccacccggtagtaatcttcctt

SEQ ID NO: 567421 - DNA, 25 bp, Mus musculus
cagccacccggttgtaatcttcctt

SEQ ID NO: 567422 - DNA, 25 bp, Mus musculus
cagccaccgagacgctggttctgtc

SEQ ID NO: 567423 - DNA, 25 bp, Mus musculus
cagccaccgagaggctggttctgtc

SEQ ID NO: 567424 - DNA, 25 bp, Mus musculus
cagccaccggaaaggaggttcagga

SEQ ID NO: 567425 - DNA, 25 bp, Mus musculus
cagccaccggaatggaggttcagga

SEQ ID NO: 567426 - DNA, 25 bp, Mus musculus
cagccaccggctctcaggatttgtg

SEQ ID NO: 567427 - DNA, 25 bp, Mus musculus
cagccaccggctgtcaggatttgtg

SEQ ID NO: 567428 - DNA, 25 bp, Mus musculus
cagccaccgtgaagttggcagcagg

SEQ ID NO: 567429 - DNA, 25 bp, Mus musculus
cagccaccgtgatgttggcagcagg

SEQ ID NO: 567430 - DNA, 25 bp, Mus musculus
cagccacctctgaattacactttaa

SEQ ID NO: 567431 - DNA, 25 bp, Mus musculus
cagccacctctgtattacactttaa

SEQ ID NO: 567432 - DNA, 25 bp, Mus musculus
cagccaccttgcagagctgtgataa

SEQ ID NO: 567433 - DNA, 25 bp, Mus musculus
cagccaccttgctgagctgtgataa

SEQ ID NO: 567434 - DNA, 25 bp, Mus musculus
cagccacctttgacaaacacggaga

SEQ ID NO: 567435 - DNA, 25 bp, Mus musculus
cagccacctttgtcaaacacggaga

SEQ ID NO: 567436 - DNA, 25 bp, Mus musculus
cagccacgatccacgatatttctaa

SEQ ID NO: 567437 - DNA, 25 bp, Mus musculus
cagccacgatcctcgatatttctaa

SEQ ID NO: 567438 - DNA, 25 bp, Mus musculus
cagccacgctccaatacagtgcagt

SEQ ID NO: 567439 - DNA, 25 bp, Mus musculus
cagccacgctcctatacagtgcagt

SEQ ID NO: 567440 - DNA, 25 bp, Mus musculus
cagccacggaaaatagggaagaagt

SEQ ID NO: 567441 - DNA, 25 bp, Mus musculus
cagccacggaaattagggaagaagt

SEQ ID NO: 567442 - DNA, 25 bp, Mus musculus
cagccacggagtcggcggagatctt

SEQ ID NO: 567443 - DNA, 25 bp, Mus musculus
cagccacggagtgggcggagatctt

SEQ ID NO: 567444 - DNA, 25 bp, Mus musculus
cagccacggcacatttctgttgcaa

SEQ ID NO: 567445 - DNA, 25 bp, Mus musculus
cagccacggcacttttctgttgcaa

SEQ ID NO: 567446 - DNA, 25 bp, Mus musculus
cagccacggccaagattacagctca

SEQ ID NO: 567447 - DNA, 25 bp, Mus musculus
cagccacggccatgattacagctca

SEQ ID NO: 567448 - DNA, 25 bp, Mus musculus
cagccactaacacggtggacatcct

SEQ ID NO: 567449 - DNA, 25 bp, Mus musculus
cagccactaacagggtggacatcct

SEQ ID NO: 567450 - DNA, 25 bp, Mus musculus
cagccactaagaagagaaggagcgc

SEQ ID NO: 567451 - DNA, 25 bp, Mus musculus
cagccactaagatgagaaggagcgc

SEQ ID NO: 567452 - DNA, 25 bp, Mus musculus
cagccactatgtctctgagcagtgc

SEQ ID NO: 567453 - DNA, 25 bp, Mus musculus
cagccactatgtgtctgagcagtgc

SEQ ID NO: 567454 - DNA, 25 bp, Mus musculus
cagccactgtatcgagttgaaagcc

SEQ ID NO: 567455 - DNA, 25 bp, Mus musculus
cagccactgtatggagttgaaagcc

SEQ ID NO: 567456 - DNA, 25 bp, Mus musculus
cagccagaacaacaactacaattgt

SEQ ID NO: 567457 - DNA, 25 bp, Mus musculus
cagccagaacaagaactacaattgt

SEQ ID NO: 567458 - DNA, 25 bp, Mus musculus
cagccagaagtgctgcgaatataca

SEQ ID NO: 567459 - DNA, 25 bp, Mus musculus
cagccagaagtggtgcgaatataca

SEQ ID NO: 567460 - DNA, 25 bp, Mus musculus
cagccagacactaaaggccattcga

SEQ ID NO: 567461 - DNA, 25 bp, Mus musculus
cagccagacacttaaggccattcga

SEQ ID NO: 567462 - DNA, 25 bp, Mus musculus
cagccagagtggaccacacagggtc

SEQ ID NO: 567463 - DNA, 25 bp, Mus musculus
cagccagagtggtccacacagggtc

SEQ ID NO: 567464 - DNA, 25 bp, Mus musculus
cagccagatgagcagctcaagccca

SEQ ID NO: 567465 - DNA, 25 bp, Mus musculus
cagccagatgaggagctcaagccca

SEQ ID NO: 567466 - DNA, 25 bp, Mus musculus
cagccagattctcgtggacacagag

SEQ ID NO: 567467 - DNA, 25 bp, Mus musculus
cagccagattctggtggacacagag

SEQ ID NO: 567468 - DNA, 25 bp, Mus musculus
cagccagatttcagcgcatgaggga

SEQ ID NO: 567469 - DNA, 25 bp, Mus musculus
cagccagatttctgcgcatgaggga

SEQ ID NO: 567470 - DNA, 25 bp, Mus musculus
cagccagcatgtcatccacaaatac

SEQ ID NO: 567471 - DNA, 25 bp, Mus musculus
cagccagcatgtgatccacaaatac

SEQ ID NO: 567472 - DNA, 25 bp, Mus musculus
cagccagccttgaggactgagtagc

SEQ ID NO: 567473 - DNA, 25 bp, Mus musculus
cagccagccttgtggactgagtagc

SEQ ID NO: 567474 - DNA, 25 bp, Mus musculus
cagccagcctttatacatcctcaag

SEQ ID NO: 567475 - DNA, 25 bp, Mus musculus
cagccagcctttttacatcctcaag

SEQ ID NO: 567476 - DNA, 25 bp, Mus musculus
cagccagcgaccagatgaagcagtg

SEQ ID NO: 567477 - DNA, 25 bp, Mus musculus
cagccagcgacctgatgaagcagtg

SEQ ID NO: 567478 - DNA, 25 bp, Mus musculus
cagccagcgcagagttccttcacag

SEQ ID NO: 567479 - DNA, 25 bp, Mus musculus
cagccagcgcagtgttccttcacag

SEQ ID NO: 567480 - DNA, 25 bp, Mus musculus
cagccagcggagaactacaagaaca

SEQ ID NO: 567481 - DNA, 25 bp, Mus musculus
cagccagcggagtactacaagaaca

SEQ ID NO: 567482 - DNA, 25 bp, Mus musculus
cagccagcgggacgagaaggagttc

SEQ ID NO: 567483 - DNA, 25 bp, Mus musculus
cagccagcgggaggagaaggagttc

SEQ ID NO: 567484 - DNA, 25 bp, Mus musculus
cagccagctataccagagaatccac

SEQ ID NO: 567485 - DNA, 25 bp, Mus musculus
cagccagctatagcagagaatccac

SEQ ID NO: 567486 - DNA, 25 bp, Mus musculus
cagccagctctgagtgaacctggaa

SEQ ID NO: 567487 - DNA, 25 bp, Mus musculus
cagccagctctgtgtgaacctggaa

SEQ ID NO: 567488 - DNA, 25 bp, Mus musculus
cagccagctgtgaccagccgctatg

SEQ ID NO: 567489 - DNA, 25 bp, Mus musculus
cagccagctgtgtccagccgctatg

SEQ ID NO: 567490 - DNA, 25 bp, Mus musculus
cagccagcttctcttggagacagac

SEQ ID NO: 567491 - DNA, 25 bp, Mus musculus
cagccagcttctgttggagacagac

SEQ ID NO: 567492 - DNA, 25 bp, Mus musculus
cagccaggaataagctacacacttg

SEQ ID NO: 567493 - DNA, 25 bp, Mus musculus
cagccaggaatatgctacacacttg

SEQ ID NO: 567494 - DNA, 25 bp, Mus musculus
cagccaggaatcacggtccaacaag

SEQ ID NO: 567495 - DNA, 25 bp, Mus musculus
cagccaggaatctcggtccaacaag

SEQ ID NO: 567496 - DNA, 25 bp, Mus musculus
cagccaggagctagacgtgaaacga

SEQ ID NO: 567497 - DNA, 25 bp, Mus musculus
cagccaggagctctgaaagtcccag

SEQ ID NO: 567498 - DNA, 25 bp, Mus musculus
cagccaggagctgtgaaagtcccag

SEQ ID NO: 567499 - DNA, 25 bp, Mus musculus
cagccaggagcttgacgtgaaacga

SEQ ID NO: 567500 - DNA, 25 bp, Mus musculus
cagccaggatctcgccgagtgctgc

SEQ ID NO: 567501 - DNA, 25 bp, Mus musculus
cagccaggatctggccgagtgctgc

SEQ ID NO: 567502 - DNA, 25 bp, Mus musculus
cagccaggccaaccgcaagttgcag

SEQ ID NO: 567503 - DNA, 25 bp, Mus musculus
cagccaggccaagcgcaagttgcag

SEQ ID NO: 567504 - DNA, 25 bp, Mus musculus
cagccagggaagatcatttccattt

SEQ ID NO: 567505 - DNA, 25 bp, Mus musculus
cagccagggaagttcatttccattt

SEQ ID NO: 567506 - DNA, 25 bp, Mus musculus
cagccagggcccacagaatggagtc

SEQ ID NO: 567507 - DNA, 25 bp, Mus musculus
cagccagggccctcagaatggagtc

SEQ ID NO: 567508 - DNA, 25 bp, Mus musculus
cagccagggcctcgtttgtcagcct

SEQ ID NO: 567509 - DNA, 25 bp, Mus musculus
cagccagggcctggtttgtcagcct

SEQ ID NO: 567510 - DNA, 25 bp, Mus musculus
cagccagggtctagcaatggccgtg

SEQ ID NO: 567511 - DNA, 25 bp, Mus musculus
cagccagggtcttgcaatggccgtg

SEQ ID NO: 567512 - DNA, 25 bp, Mus musculus
cagccaggtgaaaattcagcaaatg

SEQ ID NO: 567513 - DNA, 25 bp, Mus musculus
cagccaggtgaatattcagcaaatg

SEQ ID NO: 567514 - DNA, 25 bp, Mus musculus
cagccaggtgagctaggttactcag

SEQ ID NO: 567515 - DNA, 25 bp, Mus musculus
cagccaggtgaggtaggttactcag

SEQ ID NO: 567516 - DNA, 25 bp, Mus musculus
cagccaggtggactcaggctccttg

SEQ ID NO: 567517 - DNA, 25 bp, Mus musculus
cagccaggtggagtcaggctccttg

SEQ ID NO: 567518 - DNA, 25 bp, Mus musculus
cagccaggtggtcgacttctaccag

SEQ ID NO: 567519 - DNA, 25 bp, Mus musculus
cagccaggtggtggacttctaccag

SEQ ID NO: 567520 - DNA, 25 bp, Mus musculus
cagccaggttctccagttgatggga

SEQ ID NO: 567521 - DNA, 25 bp, Mus musculus
cagccaggttctgcagttgatggga

SEQ ID NO: 567522 - DNA, 25 bp, Mus musculus
cagccagtatccagagtttacccgg

SEQ ID NO: 567523 - DNA, 25 bp, Mus musculus
cagccagtatcctgagtttacccgg

SEQ ID NO: 567524 - DNA, 25 bp, Mus musculus
cagccagtcaccaactgtgagccgg

SEQ ID NO: 567525 - DNA, 25 bp, Mus musculus
cagccagtcacctactgtgagccgg

SEQ ID NO: 567526 - DNA, 25 bp, Mus musculus
cagccagtggagcaagatctttgat

SEQ ID NO: 567527 - DNA, 25 bp, Mus musculus
cagccagtggaggaagatctttgat

SEQ ID NO: 567528 - DNA, 25 bp, Mus musculus
cagccagttagaaggaccagggtat

SEQ ID NO: 567529 - DNA, 25 bp, Mus musculus
cagccagttagatggaccagggtat

SEQ ID NO: 567530 - DNA, 25 bp, Mus musculus
cagccataccacaatgagctgtgaa

SEQ ID NO: 567531 - DNA, 25 bp, Mus musculus
cagccataccactatgagctgtgaa

SEQ ID NO: 567532 - DNA, 25 bp, Mus musculus
cagccatactgcatctggtgaggaa

SEQ ID NO: 567533 - DNA, 25 bp, Mus musculus
cagccatactgcttctggtgaggaa

SEQ ID NO: 567534 - DNA, 25 bp, Mus musculus
cagccatatcatcttggaatcatat

SEQ ID NO: 567535 - DNA, 25 bp, Mus musculus
cagccatatcatgttggaatcatat

SEQ ID NO: 567536 - DNA, 25 bp, Mus musculus
cagccatcaaaaactcacaagaaag

SEQ ID NO: 567537 - DNA, 25 bp, Mus musculus
cagccatcaaaatctcacaagaaag

SEQ ID NO: 567538 - DNA, 25 bp, Mus musculus
cagccatcacagacacagagcttct

SEQ ID NO: 567539 - DNA, 25 bp, Mus musculus
cagccatcacagtcacagagcttct

SEQ ID NO: 567540 - DNA, 25 bp, Mus musculus
cagccatcacctcgatttacttgtt

SEQ ID NO: 567541 - DNA, 25 bp, Mus musculus
cagccatcacctggatttacttgtt

SEQ ID NO: 567542 - DNA, 25 bp, Mus musculus
cagccatcgtgtaccagaagcaact

SEQ ID NO: 567543 - DNA, 25 bp, Mus musculus
cagccatcgtgttccagaagcaact

SEQ ID NO: 567544 - DNA, 25 bp, Mus musculus
cagccatctgttctgtcttcggaag

SEQ ID NO: 567545 - DNA, 25 bp, Mus musculus
cagccatctgttgtgtcttcggaag

SEQ ID NO: 567546 - DNA, 25 bp, Mus musculus
cagccatgaagtattcccagaaggg

SEQ ID NO: 567547 - DNA, 25 bp, Mus musculus
cagccatgaagttttcccagaaggg

SEQ ID NO: 567548 - DNA, 25 bp, Mus musculus
cagccatgaataccgggtgtgccag

SEQ ID NO: 567549 - DNA, 25 bp, Mus musculus
cagccatgaatagcgggtgtgccag

SEQ ID NO: 567550 - DNA, 25 bp, Mus musculus
cagccatgagatctgaggccacagc

SEQ ID NO: 567551 - DNA, 25 bp, Mus musculus
cagccatgagatgtgaggccacagc

SEQ ID NO: 567552 - DNA, 25 bp, Mus musculus
cagccatgagtaagctgtggttcaa

SEQ ID NO: 567553 - DNA, 25 bp, Mus musculus
cagccatgagtatgctgtggttcaa

SEQ ID NO: 567554 - DNA, 25 bp, Mus musculus
cagccatgattacgccagaacctgc

SEQ ID NO: 567555 - DNA, 25 bp, Mus musculus
cagccatgattaggccagaacctgc

SEQ ID NO: 567556 - DNA, 25 bp, Mus musculus
cagccatgcgcacagatcagtacaa

SEQ ID NO: 567557 - DNA, 25 bp, Mus musculus
cagccatgcgcagagatcagtacaa

SEQ ID NO: 567558 - DNA, 25 bp, Mus musculus
cagccatgctaaacaagacggagtc

SEQ ID NO: 567559 - DNA, 25 bp, Mus musculus
cagccatgctaatcaagacggagtc

SEQ ID NO: 567560 - DNA, 25 bp, Mus musculus
cagccatgctagcagttttctttgc

SEQ ID NO: 567561 - DNA, 25 bp, Mus musculus
cagccatgctaggagttttctttgc

SEQ ID NO: 567562 - DNA, 25 bp, Mus musculus
cagccatggagaacgctcacacaaa

SEQ ID NO: 567563 - DNA, 25 bp, Mus musculus
cagccatggagatcgctcacacaaa

SEQ ID NO: 567564 - DNA, 25 bp, Mus musculus
cagccatggcctcggagtcagtgaa

SEQ ID NO: 567565 - DNA, 25 bp, Mus musculus
cagccatggcctgggagtcagtgaa

SEQ ID NO: 567566 - DNA, 25 bp, Mus musculus
cagccatggcgtaaaggcggctcgt

SEQ ID NO: 567567 - DNA, 25 bp, Mus musculus
cagccatggcgttaaggcggctcgt

SEQ ID NO: 567568 - DNA, 25 bp, Mus musculus
cagccatgtataatcttggtgccat

SEQ ID NO: 567569 - DNA, 25 bp, Mus musculus
cagccatgtatattcttggtgccat

SEQ ID NO: 567570 - DNA, 25 bp, Mus musculus
cagccattcaccagtgcatggtttc

SEQ ID NO: 567571 - DNA, 25 bp, Mus musculus
cagccattcacctgtgcatggtttc

SEQ ID NO: 567572 - DNA, 25 bp, Mus musculus
cagccattcatgcattaggattata

SEQ ID NO: 567573 - DNA, 25 bp, Mus musculus
cagccattcatggattaggattata

SEQ ID NO: 567574 - DNA, 25 bp, Mus musculus
cagccattcattcatatatttcacc

SEQ ID NO: 567575 - DNA, 25 bp, Mus musculus
cagccattcattgatatatttcacc

SEQ ID NO: 567576 - DNA, 25 bp, Mus musculus
cagccattcctcatatactgcaata

SEQ ID NO: 567577 - DNA, 25 bp, Mus musculus
cagccattcctcttatactgcaata

SEQ ID NO: 567578 - DNA, 25 bp, Mus musculus
cagccattgaccagggcagaaccat

SEQ ID NO: 567579 - DNA, 25 bp, Mus musculus
cagccattgaccaggttgagaagcg

SEQ ID NO: 567580 - DNA, 25 bp, Mus musculus
cagccattgacctgggcagaaccat

SEQ ID NO: 567581 - DNA, 25 bp, Mus musculus
cagccattgacctggttgagaagcg

SEQ ID NO: 567582 - DNA, 25 bp, Mus musculus
cagccattgatcaatctttatggac

SEQ ID NO: 567583 - DNA, 25 bp, Mus musculus
cagccattgatctatctttatggac

SEQ ID NO: 567584 - DNA, 25 bp, Mus musculus
cagccattggacaagagtgctacca

SEQ ID NO: 567585 - DNA, 25 bp, Mus musculus
cagccattggactagagtgctacca

SEQ ID NO: 567586 - DNA, 25 bp, Mus musculus
cagccattgttgcttactcggaacg

SEQ ID NO: 567587 - DNA, 25 bp, Mus musculus
cagccattgttggttactcggaacg

SEQ ID NO: 567588 - DNA, 25 bp, Mus musculus
cagccattttgtcgtgtgactcacc

SEQ ID NO: 567589 - DNA, 25 bp, Mus musculus
cagccattttgtggtgtgactcacc

SEQ ID NO: 567590 - DNA, 25 bp, Mus musculus
cagccatttttgatcaaaactaacc

SEQ ID NO: 567591 - DNA, 25 bp, Mus musculus
cagccatttttgttcaaaactaacc

SEQ ID NO: 567592 - DNA, 25 bp, Mus musculus
cagcccaaaacacatgtgctaggtg

SEQ ID NO: 567593 - DNA, 25 bp, Mus musculus
cagcccaaaacagatgtgctaggtg

SEQ ID NO: 567594 - DNA, 25 bp, Mus musculus
cagcccaaaagacgtcaaagttgtg

SEQ ID NO: 567595 - DNA, 25 bp, Mus musculus
cagcccaaaagaggtcaaagttgtg

SEQ ID NO: 567596 - DNA, 25 bp, Mus musculus
cagcccaaaagcaccccagaaagta

SEQ ID NO: 567597 - DNA, 25 bp, Mus musculus
cagcccaaaagctccccagaaagta

SEQ ID NO: 567598 - DNA, 25 bp, Mus musculus
cagcccaaacggaggcagtcatcat

SEQ ID NO: 567599 - DNA, 25 bp, Mus musculus
cagcccaaacggtggcagtcatcat

SEQ ID NO: 567600 - DNA, 25 bp, Mus musculus
cagcccaaagagctgtatcagcaac

SEQ ID NO: 567601 - DNA, 25 bp, Mus musculus
cagcccaaagaggtgtatcagcaac

SEQ ID NO: 567602 - DNA, 25 bp, Mus musculus
cagcccaaggaacaatatttccaag

SEQ ID NO: 567603 - DNA, 25 bp, Mus musculus
cagcccaaggaagaatatttccaag

SEQ ID NO: 567604 - DNA, 25 bp, Mus musculus
cagcccaagtcactggaagatttga

SEQ ID NO: 567605 - DNA, 25 bp, Mus musculus
cagcccaagtcagtggaagatttga

SEQ ID NO: 567606 - DNA, 25 bp, Mus musculus
cagcccacactgacggacatcgtgg

SEQ ID NO: 567607 - DNA, 25 bp, Mus musculus
cagcccacactgtcggacatcgtgg

SEQ ID NO: 567608 - DNA, 25 bp, Mus musculus
cagcccacagggacatcttgcaaaa

SEQ ID NO: 567609 - DNA, 25 bp, Mus musculus
cagcccacagggtcatcttgcaaaa

SEQ ID NO: 567610 - DNA, 25 bp, Mus musculus
cagcccactctcatggaccagttta

SEQ ID NO: 567611 - DNA, 25 bp, Mus musculus
cagcccactctcttggaccagttta

SEQ ID NO: 567612 - DNA, 25 bp, Mus musculus
cagcccagacaacttacccggattt

SEQ ID NO: 567613 - DNA, 25 bp, Mus musculus
cagcccagacaagttacccggattt

SEQ ID NO: 567614 - DNA, 25 bp, Mus musculus
cagcccagagagctgagaaaggact

SEQ ID NO: 567615 - DNA, 25 bp, Mus musculus
cagcccagagaggtgagaaaggact

SEQ ID NO: 567616 - DNA, 25 bp, Mus musculus
cagcccagagatcaagcggtggcct

SEQ ID NO: 567617 - DNA, 25 bp, Mus musculus
cagcccagagatgaagcggtggcct

SEQ ID NO: 567618 - DNA, 25 bp, Mus musculus
cagcccagaggaatggcagagagca

SEQ ID NO: 567619 - DNA, 25 bp, Mus musculus
cagcccagaggattggcagagagca

SEQ ID NO: 567620 - DNA, 25 bp, Mus musculus
cagcccagagggacctgacaacctg

SEQ ID NO: 567621 - DNA, 25 bp, Mus musculus
cagcccagagggtcctgacaacctg

SEQ ID NO: 567622 - DNA, 25 bp, Mus musculus
cagcccagagtcatcagtttccata

SEQ ID NO: 567623 - DNA, 25 bp, Mus musculus
cagcccagagtcttcagtttccata

SEQ ID NO: 567624 - DNA, 25 bp, Mus musculus
cagcccagcagcagcagtatggagg

SEQ ID NO: 567625 - DNA, 25 bp, Mus musculus
cagcccagcagctgcagtatggagg

SEQ ID NO: 567626 - DNA, 25 bp, Mus musculus
cagcccagccctaatgagcaacagt

SEQ ID NO: 567627 - DNA, 25 bp, Mus musculus
cagcccagcccttatgagcaacagt

SEQ ID NO: 567628 - DNA, 25 bp, Mus musculus
cagcccagctaaagaaggagtgatc

SEQ ID NO: 567629 - DNA, 25 bp, Mus musculus
cagcccagctaatgaaggagtgatc

SEQ ID NO: 567630 - DNA, 25 bp, Mus musculus
cagcccagctcacctggaggaaagg

SEQ ID NO: 567631 - DNA, 25 bp, Mus musculus
cagcccagctcagctggaggaaagg

SEQ ID NO: 567632 - DNA, 25 bp, Mus musculus
cagcccaggaaacggcatgttttat

SEQ ID NO: 567633 - DNA, 25 bp, Mus musculus
cagcccaggaaagggcatgttttat

SEQ ID NO: 567634 - DNA, 25 bp, Mus musculus
cagcccaggagaacacatggcaggg

SEQ ID NO: 567635 - DNA, 25 bp, Mus musculus
cagcccaggagaatttggaccaccg

SEQ ID NO: 567636 - DNA, 25 bp, Mus musculus
cagcccaggagatcacatggcaggg

SEQ ID NO: 567637 - DNA, 25 bp, Mus musculus
cagcccaggagattttggaccaccg

SEQ ID NO: 567638 - DNA, 25 bp, Mus musculus
cagcccagtgtgagggtcgtgccat

SEQ ID NO: 567639 - DNA, 25 bp, Mus musculus
cagcccagtgtgtgggtcgtgccat

SEQ ID NO: 567640 - DNA, 25 bp, Mus musculus
cagcccagttggagttcctagccca

SEQ ID NO: 567641 - DNA, 25 bp, Mus musculus
cagcccagttggtgttcctagccca

SEQ ID NO: 567642 - DNA, 25 bp, Mus musculus
cagcccatggagacgacgggcgcca

SEQ ID NO: 567643 - DNA, 25 bp, Mus musculus
cagcccatggagtcgacgggcgcca

SEQ ID NO: 567644 - DNA, 25 bp, Mus musculus
cagcccatgtcactgtaatagcgag

SEQ ID NO: 567645 - DNA, 25 bp, Mus musculus
cagcccatgtcagtgtaatagcgag

SEQ ID NO: 567646 - DNA, 25 bp, Mus musculus
cagcccattcgcaggagccactgga

SEQ ID NO: 567647 - DNA, 25 bp, Mus musculus
cagcccattcgctggagccactgga

SEQ ID NO: 567648 - DNA, 25 bp, Mus musculus
cagcccattgcgagtctctgagaaa

SEQ ID NO: 567649 - DNA, 25 bp, Mus musculus
cagcccattgcgtgtctctgagaaa

SEQ ID NO: 567650 - DNA, 25 bp, Mus musculus
cagccccaaaatcgttaaggttgca

SEQ ID NO: 567651 - DNA, 25 bp, Mus musculus
cagccccaaaatggttaaggttgca

SEQ ID NO: 567652 - DNA, 25 bp, Mus musculus
cagccccaaagaaggaacccaaagg

SEQ ID NO: 567653 - DNA, 25 bp, Mus musculus
cagccccaaagatggaacccaaagg

SEQ ID NO: 567654 - DNA, 25 bp, Mus musculus
cagccccacagtagtaggttataag

SEQ ID NO: 567655 - DNA, 25 bp, Mus musculus
cagccccacagttgtaggttataag

SEQ ID NO: 567656 - DNA, 25 bp, Mus musculus
cagccccagtatcgaaccttctgtg

SEQ ID NO: 567657 - DNA, 25 bp, Mus musculus
cagccccagtatggaaccttctgtg

SEQ ID NO: 567658 - DNA, 25 bp, Mus musculus
cagccccatcacctctgatgaggag

SEQ ID NO: 567659 - DNA, 25 bp, Mus musculus
cagccccatcacgtctgatgaggag

SEQ ID NO: 567660 - DNA, 25 bp, Mus musculus
cagccccgacacagtacatcttagt

SEQ ID NO: 567661 - DNA, 25 bp, Mus musculus
cagccccgacactgtacatcttagt

SEQ ID NO: 567662 - DNA, 25 bp, Mus musculus
cagccccgcctgacaggatgagcag

SEQ ID NO: 567663 - DNA, 25 bp, Mus musculus
cagccccgcctgtcaggatgagcag

SEQ ID NO: 567664 - DNA, 25 bp, Mus musculus
cagccccgggaaaagcagctaacat

SEQ ID NO: 567665 - DNA, 25 bp, Mus musculus
cagccccgggaatagcagctaacat

SEQ ID NO: 567666 - DNA, 25 bp, Mus musculus
cagccccgtggtcctttggcttaac

SEQ ID NO: 567667 - DNA, 25 bp, Mus musculus
cagccccgtggtgctttggcttaac

SEQ ID NO: 567668 - DNA, 25 bp, Mus musculus
cagcccctgagaagtagcaggcgca

SEQ ID NO: 567669 - DNA, 25 bp, Mus musculus
cagcccctgagatgtagcaggcgca

SEQ ID NO: 567670 - DNA, 25 bp, Mus musculus
cagcccctgcgtctggttaactgca

SEQ ID NO: 567671 - DNA, 25 bp, Mus musculus
cagcccctgcgtgtggttaactgca

SEQ ID NO: 567672 - DNA, 25 bp, Mus musculus
cagcccctgtgaaccagcgtgtgga

SEQ ID NO: 567673 - DNA, 25 bp, Mus musculus
cagcccctgtgatccagcgtgtgga

SEQ ID NO: 567674 - DNA, 25 bp, Mus musculus
cagcccgacgtgcagagtaaggaaa

SEQ ID NO: 567675 - DNA, 25 bp, Mus musculus
cagcccgacgtggagagtaaggaaa

SEQ ID NO: 567676 - DNA, 25 bp, Mus musculus
cagcccgacttgatgatctcgcgca

SEQ ID NO: 567677 - DNA, 25 bp, Mus musculus
cagcccgacttgttgatctcgcgca

SEQ ID NO: 567678 - DNA, 25 bp, Mus musculus
cagcccgactttctttacacaacag

SEQ ID NO: 567679 - DNA, 25 bp, Mus musculus
cagcccgactttgtttacacaacag

SEQ ID NO: 567680 - DNA, 25 bp, Mus musculus
cagcccgagcttaccccgttggtgg

SEQ ID NO: 567681 - DNA, 25 bp, Mus musculus
cagcccgagctttccccgttggtgg

SEQ ID NO: 567682 - DNA, 25 bp, Mus musculus
cagcccgatgtcacagaggcctgtt

SEQ ID NO: 567683 - DNA, 25 bp, Mus musculus
cagcccgatgtctcagaggcctgtt

SEQ ID NO: 567684 - DNA, 25 bp, Mus musculus
cagcccgcaacaagggcagcctttt

SEQ ID NO: 567685 - DNA, 25 bp, Mus musculus
cagcccgcaacatgggcagcctttt

SEQ ID NO: 567686 - DNA, 25 bp, Mus musculus
cagcccgctatgatggcagacgtgg

SEQ ID NO: 567687 - DNA, 25 bp, Mus musculus
cagcccgctatgttggcagacgtgg

SEQ ID NO: 567688 - DNA, 25 bp, Mus musculus
cagcccggatatcagccctaaacat

SEQ ID NO: 567689 - DNA, 25 bp, Mus musculus
cagcccggatatgagccctaaacat

SEQ ID NO: 567690 - DNA, 25 bp, Mus musculus
cagcccgggccacattaagtaactt

SEQ ID NO: 567691 - DNA, 25 bp, Mus musculus
cagcccgggccagattaagtaactt

SEQ ID NO: 567692 - DNA, 25 bp, Mus musculus
cagcccggtgctctcagtcagagtt

SEQ ID NO: 567693 - DNA, 25 bp, Mus musculus
cagcccggtgctgtcagtcagagtt

SEQ ID NO: 567694 - DNA, 25 bp, Mus musculus
cagcccggtggccaatgctgatcca

SEQ ID NO: 567695 - DNA, 25 bp, Mus musculus
cagcccggtggcgaatgctgatcca

SEQ ID NO: 567696 - DNA, 25 bp, Mus musculus
cagcccggtttcctgggcgaccaga

SEQ ID NO: 567697 - DNA, 25 bp, Mus musculus
cagcccggtttcgtgggcgaccaga

SEQ ID NO: 567698 - DNA, 25 bp, Mus musculus
cagcccgtcttgcaataaggagtga

SEQ ID NO: 567699 - DNA, 25 bp, Mus musculus
cagcccgtcttggaataaggagtga

SEQ ID NO: 567700 - DNA, 25 bp, Mus musculus
cagcccgtgttccaggtctggtgca

SEQ ID NO: 567701 - DNA, 25 bp, Mus musculus
cagcccgtgttcgaggtctggtgca

SEQ ID NO: 567702 - DNA, 25 bp, Mus musculus
cagccctaaccacagctatgagggc

SEQ ID NO: 567703 - DNA, 25 bp, Mus musculus
cagccctaaccagagctatgagggc

SEQ ID NO: 567704 - DNA, 25 bp, Mus musculus
cagccctacacaattgatatcaacc

SEQ ID NO: 567705 - DNA, 25 bp, Mus musculus
cagccctacacatttgatatcaacc

SEQ ID NO: 567706 - DNA, 25 bp, Mus musculus
cagccctacgctactggcagagtat

SEQ ID NO: 567707 - DNA, 25 bp, Mus musculus
cagccctacgcttctggcagagtat

SEQ ID NO: 567708 - DNA, 25 bp, Mus musculus
cagccctacgtgagcaagctggatt

SEQ ID NO: 567709 - DNA, 25 bp, Mus musculus
cagccctacgtgtgcaagctggatt

SEQ ID NO: 567710 - DNA, 25 bp, Mus musculus
cagccctactaaaggaggacgctgg

SEQ ID NO: 567711 - DNA, 25 bp, Mus musculus
cagccctactaatggaggacgctgg

SEQ ID NO: 567712 - DNA, 25 bp, Mus musculus
cagccctagtcccagatggaacatg

SEQ ID NO: 567713 - DNA, 25 bp, Mus musculus
cagccctagtccgagatggaacatg

SEQ ID NO: 567714 - DNA, 25 bp, Mus musculus
cagccctagtctcgaacttcatcaa

SEQ ID NO: 567715 - DNA, 25 bp, Mus musculus
cagccctagtctggaacttcatcaa

SEQ ID NO: 567716 - DNA, 25 bp, Mus musculus
cagccctataaactgggccgccagt

SEQ ID NO: 567717 - DNA, 25 bp, Mus musculus
cagccctataaagtgggccgccagt

SEQ ID NO: 567718 - DNA, 25 bp, Mus musculus
cagccctatgagaggatttcctaca

SEQ ID NO: 567719 - DNA, 25 bp, Mus musculus
cagccctatgagtggatttcctaca

SEQ ID NO: 567720 - DNA, 25 bp, Mus musculus
cagccctcacaaacaggacttgaag

SEQ ID NO: 567721 - DNA, 25 bp, Mus musculus
cagccctcacaatcaggacttgaag

SEQ ID NO: 567722 - DNA, 25 bp, Mus musculus
cagccctcacagacgggctcgagga

SEQ ID NO: 567723 - DNA, 25 bp, Mus musculus
cagccctcacagtcgggctcgagga

SEQ ID NO: 567724 - DNA, 25 bp, Mus musculus
cagccctcagctattagacatgttc

SEQ ID NO: 567725 - DNA, 25 bp, Mus musculus
cagccctcagcttttagacatgttc

SEQ ID NO: 567726 - DNA, 25 bp, Mus musculus
cagccctcagtaagtggaggctgcc

SEQ ID NO: 567727 - DNA, 25 bp, Mus musculus
cagccctcagtatgtggaggctgcc

SEQ ID NO: 567728 - DNA, 25 bp, Mus musculus
cagccctccttgcaggtgtgggaca

SEQ ID NO: 567729 - DNA, 25 bp, Mus musculus
cagccctccttggaggtgtgggaca

SEQ ID NO: 567730 - DNA, 25 bp, Mus musculus
cagccctcgaatccgtgaccagagt

SEQ ID NO: 567731 - DNA, 25 bp, Mus musculus
cagccctcgaatgcgtgaccagagt

SEQ ID NO: 567732 - DNA, 25 bp, Mus musculus
cagccctcttatacagctttctgag

SEQ ID NO: 567733 - DNA, 25 bp, Mus musculus
cagccctcttattcagctttctgag

SEQ ID NO: 567734 - DNA, 25 bp, Mus musculus
cagccctgctgaaattgatgcttct

SEQ ID NO: 567735 - DNA, 25 bp, Mus musculus
cagccctgctgatattgatgcttct

SEQ ID NO: 567736 - DNA, 25 bp, Mus musculus
cagccctggaaacaagcgcaaggaa

SEQ ID NO: 567737 - DNA, 25 bp, Mus musculus
cagccctggaaacgatgccgagaga

SEQ ID NO: 567738 - DNA, 25 bp, Mus musculus
cagccctggaaagaagcgcaaggaa

SEQ ID NO: 567739 - DNA, 25 bp, Mus musculus
cagccctggaaaggatgccgagaga

SEQ ID NO: 567740 - DNA, 25 bp, Mus musculus
cagccctggaagcaatatgtggcca

SEQ ID NO: 567741 - DNA, 25 bp, Mus musculus
cagccctggaaggaatatgtggcca

SEQ ID NO: 567742 - DNA, 25 bp, Mus musculus
cagccctggacaactgatgaaacag

SEQ ID NO: 567743 - DNA, 25 bp, Mus musculus
cagccctggacatctgatgaaacag

SEQ ID NO: 567744 - DNA, 25 bp, Mus musculus
cagccctggatcatctggacccaag

SEQ ID NO: 567745 - DNA, 25 bp, Mus musculus
cagccctggatcttctggacccaag

SEQ ID NO: 567746 - DNA, 25 bp, Mus musculus
cagccctggctgagttaaaattgca

SEQ ID NO: 567747 - DNA, 25 bp, Mus musculus
cagccctggctgtgttaaaattgca

SEQ ID NO: 567748 - DNA, 25 bp, Mus musculus
cagccctggtgcatacactggacga

SEQ ID NO: 567749 - DNA, 25 bp, Mus musculus
cagccctggtgcttacactggacga

SEQ ID NO: 567750 - DNA, 25 bp, Mus musculus
cagccctgtaatatcacagccccag

SEQ ID NO: 567751 - DNA, 25 bp, Mus musculus
cagccctgtaatttcacagccccag

SEQ ID NO: 567752 - DNA, 25 bp, Mus musculus
cagccctgtacaaaggtcatggcca

SEQ ID NO: 567753 - DNA, 25 bp, Mus musculus
cagccctgtacataggtcatggcca

SEQ ID NO: 567754 - DNA, 25 bp, Mus musculus
cagccctgtcttagccacgtttgaa

SEQ ID NO: 567755 - DNA, 25 bp, Mus musculus
cagccctgtctttgccacgtttgaa

SEQ ID NO: 567756 - DNA, 25 bp, Mus musculus
cagccctgtgatcggtgccatgacc

SEQ ID NO: 567757 - DNA, 25 bp, Mus musculus
cagccctgtgatgggtgccatgacc

SEQ ID NO: 567758 - DNA, 25 bp, Mus musculus
cagccctgtggacggagctaccaga

SEQ ID NO: 567759 - DNA, 25 bp, Mus musculus
cagccctgtggagggagctaccaga

SEQ ID NO: 567760 - DNA, 25 bp, Mus musculus
cagcccttcgacacgatgaaggtga

SEQ ID NO: 567761 - DNA, 25 bp, Mus musculus
cagcccttcgactcgatgaaggtga

SEQ ID NO: 567762 - DNA, 25 bp, Mus musculus
cagcccttctctcggtcattgttat

SEQ ID NO: 567763 - DNA, 25 bp, Mus musculus
cagcccttctctgggtcattgttat

SEQ ID NO: 567764 - DNA, 25 bp, Mus musculus
cagcccttctggaatgcgctgaccc

SEQ ID NO: 567765 - DNA, 25 bp, Mus musculus
cagcccttctggtatgcgctgaccc

SEQ ID NO: 567766 - DNA, 25 bp, Mus musculus
cagcccttcttcattaagaccatcg

SEQ ID NO: 567767 - DNA, 25 bp, Mus musculus
cagcccttcttctttaagaccatcg

SEQ ID NO: 567768 - DNA, 25 bp, Mus musculus
cagcccttgcataatcattgaaaca

SEQ ID NO: 567769 - DNA, 25 bp, Mus musculus
cagcccttgcattatcattgaaaca

SEQ ID NO: 567770 - DNA, 25 bp, Mus musculus
cagcccttggcacctcgggtacagt

SEQ ID NO: 567771 - DNA, 25 bp, Mus musculus
cagcccttggcagctcgggtacagt

SEQ ID NO: 567772 - DNA, 25 bp, Mus musculus
cagcccttgggtatcctgaggcttt

SEQ ID NO: 567773 - DNA, 25 bp, Mus musculus
cagcccttgggtttcctgaggcttt

SEQ ID NO: 567774 - DNA, 25 bp, Mus musculus
cagcccttgtacagcgcaaaactgg

SEQ ID NO: 567775 - DNA, 25 bp, Mus musculus
cagcccttgtactgcgcaaaactgg

SEQ ID NO: 567776 - DNA, 25 bp, Mus musculus
cagccctttcatcaataatgtggag

SEQ ID NO: 567777 - DNA, 25 bp, Mus musculus
cagccctttcatgaataatgtggag

SEQ ID NO: 567778 - DNA, 25 bp, Mus musculus
cagccctttggaaaacagtgagtca

SEQ ID NO: 567779 - DNA, 25 bp, Mus musculus
cagccctttggataacagtgagtca

SEQ ID NO: 567780 - DNA, 25 bp, Mus musculus
cagccgaacggtcagcaggattaca

SEQ ID NO: 567781 - DNA, 25 bp, Mus musculus
cagccgaacggtgagcaggattaca

SEQ ID NO: 567782 - DNA, 25 bp, Mus musculus
cagccgaaggaaacacagaaggcgg

SEQ ID NO: 567783 - DNA, 25 bp, Mus musculus
cagccgaaggaatcacagaaggcgg

SEQ ID NO: 567784 - DNA, 25 bp, Mus musculus
cagccgaagttacaagacttgaatc

SEQ ID NO: 567785 - DNA, 25 bp, Mus musculus
cagccgaagttagaagacttgaatc

SEQ ID NO: 567786 - DNA, 25 bp, Mus musculus
cagccgaagttcctctgaatgcaag

SEQ ID NO: 567787 - DNA, 25 bp, Mus musculus
cagccgaagttcgtctgaatgcaag

SEQ ID NO: 567788 - DNA, 25 bp, Mus musculus
cagccgaccagtcaagggtcagtga

SEQ ID NO: 567789 - DNA, 25 bp, Mus musculus
cagccgaccagtgaagggtcagtga

SEQ ID NO: 567790 - DNA, 25 bp, Mus musculus
cagccgactggaccgttgtcagcca

SEQ ID NO: 567791 - DNA, 25 bp, Mus musculus
cagccgactggagcgttgtcagcca

SEQ ID NO: 567792 - DNA, 25 bp, Mus musculus
cagccgagacccaggaggaatgtgc

SEQ ID NO: 567793 - DNA, 25 bp, Mus musculus
cagccgagaccctggaggaatgtgc

SEQ ID NO: 567794 - DNA, 25 bp, Mus musculus
cagccgagatcaacgtggagagaga

SEQ ID NO: 567795 - DNA, 25 bp, Mus musculus
cagccgagatcatcgtggagagaga

SEQ ID NO: 567796 - DNA, 25 bp, Mus musculus
cagccgatgcacagtactaaggaag

SEQ ID NO: 567797 - DNA, 25 bp, Mus musculus
cagccgatgcactgtactaaggaag

SEQ ID NO: 567798 - DNA, 25 bp, Mus musculus
cagccgatgcttccagctgagcgag

SEQ ID NO: 567799 - DNA, 25 bp, Mus musculus
cagccgatgcttgcagctgagcgag

SEQ ID NO: 567800 - DNA, 25 bp, Mus musculus
cagccgattcggcagctccttgaca

SEQ ID NO: 567801 - DNA, 25 bp, Mus musculus
cagccgattcgggagctccttgaca

SEQ ID NO: 567802 - DNA, 25 bp, Mus musculus
cagccgcagggcaagtgatcttgct

SEQ ID NO: 567803 - DNA, 25 bp, Mus musculus
cagccgcagggctagtgatcttgct

SEQ ID NO: 567804 - DNA, 25 bp, Mus musculus
cagccgcattctaaaggatctccct

SEQ ID NO: 567805 - DNA, 25 bp, Mus musculus
cagccgcattcttaaggatctccct

SEQ ID NO: 567806 - DNA, 25 bp, Mus musculus
cagccgccctgtcgcacaagttggg

SEQ ID NO: 567807 - DNA, 25 bp, Mus musculus
cagccgccctgtggcacaagttggg

SEQ ID NO: 567808 - DNA, 25 bp, Mus musculus
cagccgcctaacagaggccgtgagg

SEQ ID NO: 567809 - DNA, 25 bp, Mus musculus
cagccgcctaactgaggccgtgagg

SEQ ID NO: 567810 - DNA, 25 bp, Mus musculus
cagccgcgagggactacttgtgcgt

SEQ ID NO: 567811 - DNA, 25 bp, Mus musculus
cagccgcgagggtctacttgtgcgt

SEQ ID NO: 567812 - DNA, 25 bp, Mus musculus
cagccgcgtggtacctgacagctgc

SEQ ID NO: 567813 - DNA, 25 bp, Mus musculus
cagccgcgtggttcctgacagctgc

SEQ ID NO: 567814 - DNA, 25 bp, Mus musculus
cagccgctcaggattggtgctaggc

SEQ ID NO: 567815 - DNA, 25 bp, Mus musculus
cagccgctcaggtttggtgctaggc

SEQ ID NO: 567816 - DNA, 25 bp, Mus musculus
cagccgctctagaggctaaagacag

SEQ ID NO: 567817 - DNA, 25 bp, Mus musculus
cagccgctctagtggctaaagacag

SEQ ID NO: 567818 - DNA, 25 bp, Mus musculus
cagccgcttgcaccgagtggcacag

SEQ ID NO: 567819 - DNA, 25 bp, Mus musculus
cagccgcttgcagcgagtggcacag

SEQ ID NO: 567820 - DNA, 25 bp, Mus musculus
cagccgctttgtcaactgtgtgcga

SEQ ID NO: 567821 - DNA, 25 bp, Mus musculus
cagccgctttgtgaactgtgtgcga

SEQ ID NO: 567822 - DNA, 25 bp, Mus musculus
cagccggaagttcctatccgtgggt

SEQ ID NO: 567823 - DNA, 25 bp, Mus musculus
cagccggaagttgctatccgtgggt

SEQ ID NO: 567824 - DNA, 25 bp, Mus musculus
cagccggatgagcatgcgtcgttaa

SEQ ID NO: 567825 - DNA, 25 bp, Mus musculus
cagccggatgaggatgcgtcgttaa

SEQ ID NO: 567826 - DNA, 25 bp, Mus musculus
cagccggattgcctgctacctggaa

SEQ ID NO: 567827 - DNA, 25 bp, Mus musculus
cagccggattgcgtgctacctggaa

SEQ ID NO: 567828 - DNA, 25 bp, Mus musculus
cagccggcaggcatttatctccaaa

SEQ ID NO: 567829 - DNA, 25 bp, Mus musculus
cagccggcaggcttttatctccaaa

SEQ ID NO: 567830 - DNA, 25 bp, Mus musculus
cagccggccagtcctactttgtgga

SEQ ID NO: 567831 - DNA, 25 bp, Mus musculus
cagccggccagtgctactttgtgga

SEQ ID NO: 567832 - DNA, 25 bp, Mus musculus
cagccggcccgtctaaggttttgat

SEQ ID NO: 567833 - DNA, 25 bp, Mus musculus
cagccggcccgtgtaaggttttgat

SEQ ID NO: 567834 - DNA, 25 bp, Mus musculus
cagccggccgctattggtggatgta

SEQ ID NO: 567835 - DNA, 25 bp, Mus musculus
cagccggccgcttttggtggatgta

SEQ ID NO: 567836 - DNA, 25 bp, Mus musculus
cagccgggaccgcttcctcaaggat

SEQ ID NO: 567837 - DNA, 25 bp, Mus musculus
cagccgggaccggttcctcaaggat

SEQ ID NO: 567838 - DNA, 25 bp, Mus musculus
cagccgggacttaggctgggatccc

SEQ ID NO: 567839 - DNA, 25 bp, Mus musculus
cagccgggactttggctgggatccc

SEQ ID NO: 567840 - DNA, 25 bp, Mus musculus
cagccgggagccatttgtggtcaaa

SEQ ID NO: 567841 - DNA, 25 bp, Mus musculus
cagccgggagccttttgtggtcaaa

SEQ ID NO: 567842 - DNA, 25 bp, Mus musculus
cagccgggcagcagtcctggtccag

SEQ ID NO: 567843 - DNA, 25 bp, Mus musculus
cagccgggcagctgtcctggtccag

SEQ ID NO: 567844 - DNA, 25 bp, Mus musculus
cagccgggcgggaggttgcgacggc

SEQ ID NO: 567845 - DNA, 25 bp, Mus musculus
cagccgggcgggtggttgcgacggc

SEQ ID NO: 567846 - DNA, 25 bp, Mus musculus
cagccgggttctccaagctgtggaa

SEQ ID NO: 567847 - DNA, 25 bp, Mus musculus
cagccgggttctgcaagctgtggaa

SEQ ID NO: 567848 - DNA, 25 bp, Mus musculus
cagccggtgaccatgttcgacaaga

SEQ ID NO: 567849 - DNA, 25 bp, Mus musculus
cagccggtgaccttgttcgacaaga

SEQ ID NO: 567850 - DNA, 25 bp, Mus musculus
cagccggtttcacttaaagagcgca

SEQ ID NO: 567851 - DNA, 25 bp, Mus musculus
cagccggtttcagttaaagagcgca

SEQ ID NO: 567852 - DNA, 25 bp, Mus musculus
cagccgtagagacgtcagcatgaag

SEQ ID NO: 567853 - DNA, 25 bp, Mus musculus
cagccgtagagaggtcagcatgaag

SEQ ID NO: 567854 - DNA, 25 bp, Mus musculus
cagccgtatcctcacgcatgtgtac

SEQ ID NO: 567855 - DNA, 25 bp, Mus musculus
cagccgtatcctgacgcatgtgtac

SEQ ID NO: 567856 - DNA, 25 bp, Mus musculus
cagccgtccataaagccaacatcat

SEQ ID NO: 567857 - DNA, 25 bp, Mus musculus
cagccgtccatatagccaacatcat

SEQ ID NO: 567858 - DNA, 25 bp, Mus musculus
cagccgtccatcacaactggggtca

SEQ ID NO: 567859 - DNA, 25 bp, Mus musculus
cagccgtccatctcaactggggtca

SEQ ID NO: 567860 - DNA, 25 bp, Mus musculus
cagccgtcccatcggagagcagatt

SEQ ID NO: 567861 - DNA, 25 bp, Mus musculus
cagccgtcccatgggagagcagatt

SEQ ID NO: 567862 - DNA, 25 bp, Mus musculus
cagccgtcggtgctgagtccatcta

SEQ ID NO: 567863 - DNA, 25 bp, Mus musculus
cagccgtcggtggtgagtccatcta

SEQ ID NO: 567864 - DNA, 25 bp, Mus musculus
cagccgtcttgacgagctcaaagcc

SEQ ID NO: 567865 - DNA, 25 bp, Mus musculus
cagccgtcttgaggagctcaaagcc

SEQ ID NO: 567866 - DNA, 25 bp, Mus musculus
cagccgtgagcaactcctacgtggt

SEQ ID NO: 567867 - DNA, 25 bp, Mus musculus
cagccgtgagcatctcctacgtggt

SEQ ID NO: 567868 - DNA, 25 bp, Mus musculus
cagccgtgcactcaagcagatggga

SEQ ID NO: 567869 - DNA, 25 bp, Mus musculus
cagccgtgcactgaagcagatggga

SEQ ID NO: 567870 - DNA, 25 bp, Mus musculus
cagccgtggatgatagcctctaaaa

SEQ ID NO: 567871 - DNA, 25 bp, Mus musculus
cagccgtggatgttagcctctaaaa

SEQ ID NO: 567872 - DNA, 25 bp, Mus musculus
cagccgtgggcaagaacttcctgca

SEQ ID NO: 567873 - DNA, 25 bp, Mus musculus
cagccgtgggcatgaacttcctgca

SEQ ID NO: 567874 - DNA, 25 bp, Mus musculus
cagccgtgggctatgaagagttctc

SEQ ID NO: 567875 - DNA, 25 bp, Mus musculus
cagccgtgggctttgaagagttctc

SEQ ID NO: 567876 - DNA, 25 bp, Mus musculus
cagccgtggtggatcgatacagcac

SEQ ID NO: 567877 - DNA, 25 bp, Mus musculus
cagccgtggtggttcgatacagcac

SEQ ID NO: 567878 - DNA, 25 bp, Mus musculus
cagccgtggtttaccgttcagaagg

SEQ ID NO: 567879 - DNA, 25 bp, Mus musculus
cagccgtggttttccgttcagaagg

SEQ ID NO: 567880 - DNA, 25 bp, Mus musculus
cagccgttctacacaagatttgatc

SEQ ID NO: 567881 - DNA, 25 bp, Mus musculus
cagccgttctactcaagatttgatc

SEQ ID NO: 567882 - DNA, 25 bp, Mus musculus
cagccgttctctctggaggaacagg

SEQ ID NO: 567883 - DNA, 25 bp, Mus musculus
cagccgttctctgtggaggaacagg

SEQ ID NO: 567884 - DNA, 25 bp, Mus musculus
cagccgttggcaatgcacatccatc

SEQ ID NO: 567885 - DNA, 25 bp, Mus musculus
cagccgttggcattgcacatccatc

SEQ ID NO: 567886 - DNA, 25 bp, Mus musculus
cagcctaaaagtccgtgtccaggca

SEQ ID NO: 567887 - DNA, 25 bp, Mus musculus
cagcctaaaagtgcgtgtccaggca

SEQ ID NO: 567888 - DNA, 25 bp, Mus musculus
cagcctaacggcctcgtatgtgcgg

SEQ ID NO: 567889 - DNA, 25 bp, Mus musculus
cagcctaacggcgtcgtatgtgcgg

SEQ ID NO: 567890 - DNA, 25 bp, Mus musculus
cagcctaagacactgctggtaatca

SEQ ID NO: 567891 - DNA, 25 bp, Mus musculus
cagcctaagacagtgctggtaatca

SEQ ID NO: 567892 - DNA, 25 bp, Mus musculus
cagcctaagtgacctctgtgttatc

SEQ ID NO: 567893 - DNA, 25 bp, Mus musculus
cagcctaagtgagctctgtgttatc

SEQ ID NO: 567894 - DNA, 25 bp, Mus musculus
cagcctaatggtcaggagatgaccc

SEQ ID NO: 567895 - DNA, 25 bp, Mus musculus
cagcctaatggtgaggagatgaccc

SEQ ID NO: 567896 - DNA, 25 bp, Mus musculus
cagcctacaccaccctggagtttga

SEQ ID NO: 567897 - DNA, 25 bp, Mus musculus
cagcctacaccagcctggagtttga

SEQ ID NO: 567898 - DNA, 25 bp, Mus musculus
cagcctacccttcagccgggactgc

SEQ ID NO: 567899 - DNA, 25 bp, Mus musculus
cagcctacccttgagccgggactgc

SEQ ID NO: 567900 - DNA, 25 bp, Mus musculus
cagcctaccgagaagagactctgag

SEQ ID NO: 567901 - DNA, 25 bp, Mus musculus
cagcctaccgagtagagactctgag

SEQ ID NO: 567902 - DNA, 25 bp, Mus musculus
cagcctacctgaacccagagatgaa

SEQ ID NO: 567903 - DNA, 25 bp, Mus musculus
cagcctacctgatcccagagatgaa

SEQ ID NO: 567904 - DNA, 25 bp, Mus musculus
cagcctactggacatcaggatgact

SEQ ID NO: 567905 - DNA, 25 bp, Mus musculus
cagcctactggagatcaggatgact

SEQ ID NO: 567906 - DNA, 25 bp, Mus musculus
cagcctagactacattccaggccag

SEQ ID NO: 567907 - DNA, 25 bp, Mus musculus
cagcctagactagattccaggccag

SEQ ID NO: 567908 - DNA, 25 bp, Mus musculus
cagcctagcaccacttatcaagtcg

SEQ ID NO: 567909 - DNA, 25 bp, Mus musculus
cagcctagcacctcttatcaagtcg

SEQ ID NO: 567910 - DNA, 25 bp, Mus musculus
cagcctagctcaatccctgagatca

SEQ ID NO: 567911 - DNA, 25 bp, Mus musculus
cagcctagctcattccctgagatca

SEQ ID NO: 567912 - DNA, 25 bp, Mus musculus
cagcctagtctaactttaggcgtgg

SEQ ID NO: 567913 - DNA, 25 bp, Mus musculus
cagcctagtctatctttaggcgtgg

SEQ ID NO: 567914 - DNA, 25 bp, Mus musculus
cagcctatcaccacagagaccttat

SEQ ID NO: 567915 - DNA, 25 bp, Mus musculus
cagcctatcacctcagagaccttat

SEQ ID NO: 567916 - DNA, 25 bp, Mus musculus
cagcctatctccagaggaggcagta

SEQ ID NO: 567917 - DNA, 25 bp, Mus musculus
cagcctatctcctgaggaggcagta

SEQ ID NO: 567918 - DNA, 25 bp, Mus musculus
cagcctatgaccagtactgccgaga

SEQ ID NO: 567919 - DNA, 25 bp, Mus musculus
cagcctatgacctgtactgccgaga

SEQ ID NO: 567920 - DNA, 25 bp, Mus musculus
cagcctatggaaaccggcctggagg

SEQ ID NO: 567921 - DNA, 25 bp, Mus musculus
cagcctatggaatccggcctggagg

SEQ ID NO: 567922 - DNA, 25 bp, Mus musculus
cagcctatggacatgggtactatca

SEQ ID NO: 567923 - DNA, 25 bp, Mus musculus
cagcctatggacttgggtactatca

SEQ ID NO: 567924 - DNA, 25 bp, Mus musculus
cagcctatgtggactatgaggacat

SEQ ID NO: 567925 - DNA, 25 bp, Mus musculus
cagcctatgtggtctatgaggacat

SEQ ID NO: 567926 - DNA, 25 bp, Mus musculus
cagcctatgttaacagtacttagaa

SEQ ID NO: 567927 - DNA, 25 bp, Mus musculus
cagcctatgttatcagtacttagaa

SEQ ID NO: 567928 - DNA, 25 bp, Mus musculus
cagcctattatgctgcagagaagat

SEQ ID NO: 567929 - DNA, 25 bp, Mus musculus
cagcctattatggtgcagagaagat

SEQ ID NO: 567930 - DNA, 25 bp, Mus musculus
cagcctattgtaccagcagtcacag

SEQ ID NO: 567931 - DNA, 25 bp, Mus musculus
cagcctattgtagcagcagtcacag

SEQ ID NO: 567932 - DNA, 25 bp, Mus musculus
cagcctcaagatccattaccagcag

SEQ ID NO: 567933 - DNA, 25 bp, Mus musculus
cagcctcaagatgcattaccagcag

SEQ ID NO: 567934 - DNA, 25 bp, Mus musculus
cagcctcaaggcattacgtcaccaa

SEQ ID NO: 567935 - DNA, 25 bp, Mus musculus
cagcctcaaggctttacgtcaccaa

SEQ ID NO: 567936 - DNA, 25 bp, Mus musculus
cagcctcaatggagatcatccagaa

SEQ ID NO: 567937 - DNA, 25 bp, Mus musculus
cagcctcaatggtgatcatccagaa

SEQ ID NO: 567938 - DNA, 25 bp, Mus musculus
cagcctcactgaaccggatctgaga

SEQ ID NO: 567939 - DNA, 25 bp, Mus musculus
cagcctcactgatccggatctgaga

SEQ ID NO: 567940 - DNA, 25 bp, Mus musculus
cagcctcactgtcgactagagaacg

SEQ ID NO: 567941 - DNA, 25 bp, Mus musculus
cagcctcactgtggactagagaacg

SEQ ID NO: 567942 - DNA, 25 bp, Mus musculus
cagcctcagcaaactggtggccgag

SEQ ID NO: 567943 - DNA, 25 bp, Mus musculus
cagcctcagcaatctggtggccgag

SEQ ID NO: 567944 - DNA, 25 bp, Mus musculus
cagcctcagccacggaaacaatgag

SEQ ID NO: 567945 - DNA, 25 bp, Mus musculus
cagcctcagccagggaaacaatgag

SEQ ID NO: 567946 - DNA, 25 bp, Mus musculus
cagcctcattgacaatatcttgaag

SEQ ID NO: 567947 - DNA, 25 bp, Mus musculus
cagcctcattgaccattgtcaggac

SEQ ID NO: 567948 - DNA, 25 bp, Mus musculus
cagcctcattgagaatatcttgaag

SEQ ID NO: 567949 - DNA, 25 bp, Mus musculus
cagcctcattgagcattgtcaggac

SEQ ID NO: 567950 - DNA, 25 bp, Mus musculus
cagcctccaataataaagcacctga

SEQ ID NO: 567951 - DNA, 25 bp, Mus musculus
cagcctccaatattaaagcacctga

SEQ ID NO: 567952 - DNA, 25 bp, Mus musculus
cagcctccagagcaattcggtttca

SEQ ID NO: 567953 - DNA, 25 bp, Mus musculus
cagcctccagaggaattcggtttca

SEQ ID NO: 567954 - DNA, 25 bp, Mus musculus
cagcctccagtgaggactctgagtc

SEQ ID NO: 567955 - DNA, 25 bp, Mus musculus
cagcctccagtgtggactctgagtc

SEQ ID NO: 567956 - DNA, 25 bp, Mus musculus
cagcctccatggatgacattctgtt

SEQ ID NO: 567957 - DNA, 25 bp, Mus musculus
cagcctccatggttgacattctgtt

SEQ ID NO: 567958 - DNA, 25 bp, Mus musculus
cagcctccgagtcggcgggctcatt

SEQ ID NO: 567959 - DNA, 25 bp, Mus musculus
cagcctccgagtgggcgggctcatt

SEQ ID NO: 567960 - DNA, 25 bp, Mus musculus
cagcctccgcagctcagtaatctga

SEQ ID NO: 567961 - DNA, 25 bp, Mus musculus
cagcctccgcaggtcagtaatctga

SEQ ID NO: 567962 - DNA, 25 bp, Mus musculus
cagcctcctgagagcgagctcagag

SEQ ID NO: 567963 - DNA, 25 bp, Mus musculus
cagcctcctgagtgcgagctcagag

SEQ ID NO: 567964 - DNA, 25 bp, Mus musculus
cagcctcctggtaacttgaccttct

SEQ ID NO: 567965 - DNA, 25 bp, Mus musculus
cagcctcctggttacttgaccttct

SEQ ID NO: 567966 - DNA, 25 bp, Mus musculus
cagcctcctttgaagctggacagca

SEQ ID NO: 567967 - DNA, 25 bp, Mus musculus
cagcctcctttgtagctggacagca

SEQ ID NO: 567968 - DNA, 25 bp, Mus musculus
cagcctcgaggacaaaacatcttag

SEQ ID NO: 567969 - DNA, 25 bp, Mus musculus
cagcctcgaggagaaaacatcttag

SEQ ID NO: 567970 - DNA, 25 bp, Mus musculus
cagcctcgggctcaatgaatgagcc

SEQ ID NO: 567971 - DNA, 25 bp, Mus musculus
cagcctcgggctgaatgaatgagcc

SEQ ID NO: 567972 - DNA, 25 bp, Mus musculus
cagcctctcctgctcgggatgacaa

SEQ ID NO: 567973 - DNA, 25 bp, Mus musculus
cagcctctcctggtcgggatgacaa

SEQ ID NO: 567974 - DNA, 25 bp, Mus musculus
cagcctctctgaagctctggacttg

SEQ ID NO: 567975 - DNA, 25 bp, Mus musculus
cagcctctctgatgctctggacttg

SEQ ID NO: 567976 - DNA, 25 bp, Mus musculus
cagcctctgagtatgcaggctctcc

SEQ ID NO: 567977 - DNA, 25 bp, Mus musculus
cagcctctgagtttgcaggctctcc

SEQ ID NO: 567978 - DNA, 25 bp, Mus musculus
cagcctctggagatgtgcctagtcg

SEQ ID NO: 567979 - DNA, 25 bp, Mus musculus
cagcctctggagttgtgcctagtcg

SEQ ID NO: 567980 - DNA, 25 bp, Mus musculus
cagcctctggatacctttagaagga

SEQ ID NO: 567981 - DNA, 25 bp, Mus musculus
cagcctctggattcctttagaagga

SEQ ID NO: 567982 - DNA, 25 bp, Mus musculus
cagcctctgggcactaaagcatgaa

SEQ ID NO: 567983 - DNA, 25 bp, Mus musculus
cagcctctgggctctaaagcatgaa

SEQ ID NO: 567984 - DNA, 25 bp, Mus musculus
cagcctctgtacaatgtggccgaga

SEQ ID NO: 567985 - DNA, 25 bp, Mus musculus
cagcctctgtactatgtggccgaga

SEQ ID NO: 567986 - DNA, 25 bp, Mus musculus
cagcctctgtctcgtccgagatgac

SEQ ID NO: 567987 - DNA, 25 bp, Mus musculus
cagcctctgtctggtccgagatgac

SEQ ID NO: 567988 - DNA, 25 bp, Mus musculus
cagcctctgttcatcgggatgccaa

SEQ ID NO: 567989 - DNA, 25 bp, Mus musculus
cagcctctgttcttcgggatgccaa

SEQ ID NO: 567990 - DNA, 25 bp, Mus musculus
cagcctcttaccacaacgttcagga

SEQ ID NO: 567991 - DNA, 25 bp, Mus musculus
cagcctcttacctcaacgttcagga

SEQ ID NO: 567992 - DNA, 25 bp, Mus musculus
cagcctcttgtccaagcaggcatat

SEQ ID NO: 567993 - DNA, 25 bp, Mus musculus
cagcctcttgtcgaagcaggcatat

SEQ ID NO: 567994 - DNA, 25 bp, Mus musculus
cagcctgaacagagcgagcctgtcg

SEQ ID NO: 567995 - DNA, 25 bp, Mus musculus
cagcctgaacagtgcgagcctgtcg

SEQ ID NO: 567996 - DNA, 25 bp, Mus musculus
cagcctgaaggacacagttgaaccc

SEQ ID NO: 567997 - DNA, 25 bp, Mus musculus
cagcctgaaggagacagttgaaccc

SEQ ID NO: 567998 - DNA, 25 bp, Mus musculus
cagcctgacactccagtgatttcag

SEQ ID NO: 567999 - DNA, 25 bp, Mus musculus
cagcctgacactgcagtgatttcag

SEQ ID NO: 568000 - DNA, 25 bp, Mus musculus
cagcctgacaggaaaggacaggagc

SEQ ID NO: 568001 - DNA, 25 bp, Mus musculus
cagcctgacaggtaaggacaggagc

SEQ ID NO: 568002 - DNA, 25 bp, Mus musculus
cagcctgacctacatgacatcttga

SEQ ID NO: 568003 - DNA, 25 bp, Mus musculus
cagcctgacctagatgacatcttga

SEQ ID NO: 568004 - DNA, 25 bp, Mus musculus
cagcctgagatccactgagtttatc

SEQ ID NO: 568005 - DNA, 25 bp, Mus musculus
cagcctgagatcgactgagtttatc

SEQ ID NO: 568006 - DNA, 25 bp, Mus musculus
cagcctgagcaaacaaatgggaaca

SEQ ID NO: 568007 - DNA, 25 bp, Mus musculus
cagcctgagcaatcaaatgggaaca

SEQ ID NO: 568008 - DNA, 25 bp, Mus musculus
cagcctgagggcatactgggcacag

SEQ ID NO: 568009 - DNA, 25 bp, Mus musculus
cagcctgagggcttactgggcacag

SEQ ID NO: 568010 - DNA, 25 bp, Mus musculus
cagcctgataatagagccgacccag

SEQ ID NO: 568011 - DNA, 25 bp, Mus musculus
cagcctgataattgagccgacccag

SEQ ID NO: 568012 - DNA, 25 bp, Mus musculus
cagcctgatggcacccgaatggtca

SEQ ID NO: 568013 - DNA, 25 bp, Mus musculus
cagcctgatggcactctggtcatca

SEQ ID NO: 568014 - DNA, 25 bp, Mus musculus
cagcctgatggctcccgaatggtca

SEQ ID NO: 568015 - DNA, 25 bp, Mus musculus
cagcctgatggctctctggtcatca

SEQ ID NO: 568016 - DNA, 25 bp, Mus musculus
cagcctgcaaagaaaagatgatttc

SEQ ID NO: 568017 - DNA, 25 bp, Mus musculus
cagcctgcaaagtaaagatgatttc

SEQ ID NO: 568018 - DNA, 25 bp, Mus musculus
cagcctgcaagaactggcacattgt

SEQ ID NO: 568019 - DNA, 25 bp, Mus musculus
cagcctgcaagatctggcacattgt

SEQ ID NO: 568020 - DNA, 25 bp, Mus musculus
cagcctgcaattccacacaataatt

SEQ ID NO: 568021 - DNA, 25 bp, Mus musculus
cagcctgcaattgcacacaataatt

SEQ ID NO: 568022 - DNA, 25 bp, Mus musculus
cagcctgcagctatactttttcgaa

SEQ ID NO: 568023 - DNA, 25 bp, Mus musculus
cagcctgcagctttactttttcgaa

SEQ ID NO: 568024 - DNA, 25 bp, Mus musculus
cagcctgcagtaacgggtgacacag

SEQ ID NO: 568025 - DNA, 25 bp, Mus musculus
cagcctgcagtatcgggtgacacag

SEQ ID NO: 568026 - DNA, 25 bp, Mus musculus
cagcctgccatgctagacataagca

SEQ ID NO: 568027 - DNA, 25 bp, Mus musculus
cagcctgccatggtagacataagca

SEQ ID NO: 568028 - DNA, 25 bp, Mus musculus
cagcctgcgctgctcaaatgcaaga

SEQ ID NO: 568029 - DNA, 25 bp, Mus musculus
cagcctgcgctggtcaaatgcaaga

SEQ ID NO: 568030 - DNA, 25 bp, Mus musculus
cagcctgctggcaatcctgctggta

SEQ ID NO: 568031 - DNA, 25 bp, Mus musculus
cagcctgctggctatcctgctggta

SEQ ID NO: 568032 - DNA, 25 bp, Mus musculus
cagcctgcttgtagtgagctgtgac

SEQ ID NO: 568033 - DNA, 25 bp, Mus musculus
cagcctgcttgttgtgagctgtgac

SEQ ID NO: 568034 - DNA, 25 bp, Mus musculus
cagcctggaaggcaaccctgtgtcc

SEQ ID NO: 568035 - DNA, 25 bp, Mus musculus
cagcctggaagggaaccctgtgtcc

SEQ ID NO: 568036 - DNA, 25 bp, Mus musculus
cagcctggacgacgaactggaagat

SEQ ID NO: 568037 - DNA, 25 bp, Mus musculus
cagcctggacgaggaactggaagat

SEQ ID NO: 568038 - DNA, 25 bp, Mus musculus
cagcctggaggaccttttcgacctg

SEQ ID NO: 568039 - DNA, 25 bp, Mus musculus
cagcctggaggagcttttcgacctg

SEQ ID NO: 568040 - DNA, 25 bp, Mus musculus
cagcctggccctccggtacatgaag

SEQ ID NO: 568041 - DNA, 25 bp, Mus musculus
cagcctggccctgcggtacatgaag

SEQ ID NO: 568042 - DNA, 25 bp, Mus musculus
cagcctggccgaaaacgccgttggg

SEQ ID NO: 568043 - DNA, 25 bp, Mus musculus
cagcctggccgataacgccgttggg

SEQ ID NO: 568044 - DNA, 25 bp, Mus musculus
cagcctggcctcaatatgtgtctag

SEQ ID NO: 568045 - DNA, 25 bp, Mus musculus
cagcctggcctctatatgtgtctag

SEQ ID NO: 568046 - DNA, 25 bp, Mus musculus
cagcctggcggacagcatgccttcg

SEQ ID NO: 568047 - DNA, 25 bp, Mus musculus
cagcctggcggagagcatgccttcg

SEQ ID NO: 568048 - DNA, 25 bp, Mus musculus
cagcctggctgaattgatgaactca

SEQ ID NO: 568049 - DNA, 25 bp, Mus musculus
cagcctggctgacgaatcctgtcct

SEQ ID NO: 568050 - DNA, 25 bp, Mus musculus
cagcctggctgaggaatcctgtcct

SEQ ID NO: 568051 - DNA, 25 bp, Mus musculus
cagcctggctgatttgatgaactca

SEQ ID NO: 568052 - DNA, 25 bp, Mus musculus
cagcctggcttgaactctgggttgg

SEQ ID NO: 568053 - DNA, 25 bp, Mus musculus
cagcctggcttgtactctgggttgg

SEQ ID NO: 568054 - DNA, 25 bp, Mus musculus
cagcctgggcacagatggctcacac

SEQ ID NO: 568055 - DNA, 25 bp, Mus musculus
cagcctgggcactgatggctcacac

SEQ ID NO: 568056 - DNA, 25 bp, Mus musculus
cagcctgggcttcaccatctcagtg

SEQ ID NO: 568057 - DNA, 25 bp, Mus musculus
cagcctgggcttgaccatctcagtg

SEQ ID NO: 568058 - DNA, 25 bp, Mus musculus
cagcctggtacgaggtgctccccta

SEQ ID NO: 568059 - DNA, 25 bp, Mus musculus
cagcctggtacgtggtgctccccta

SEQ ID NO: 568060 - DNA, 25 bp, Mus musculus
cagcctggtactagtcgtggagagc

SEQ ID NO: 568061 - DNA, 25 bp, Mus musculus
cagcctggtacttgtcgtggagagc

SEQ ID NO: 568062 - DNA, 25 bp, Mus musculus
cagcctggtagaatgccagaggact

SEQ ID NO: 568063 - DNA, 25 bp, Mus musculus
cagcctggtagattgccagaggact

SEQ ID NO: 568064 - DNA, 25 bp, Mus musculus
cagcctggtgaccatgtcagcgtca

SEQ ID NO: 568065 - DNA, 25 bp, Mus musculus
cagcctggtgacgatgtcagcgtca

SEQ ID NO: 568066 - DNA, 25 bp, Mus musculus
cagcctgtactgcagagtgggcatc

SEQ ID NO: 568067 - DNA, 25 bp, Mus musculus
cagcctgtactggagagtgggcatc

SEQ ID NO: 568068 - DNA, 25 bp, Mus musculus
cagcctgtatgcacaccagaaagga

SEQ ID NO: 568069 - DNA, 25 bp, Mus musculus
cagcctgtatgctcaccagaaagga

SEQ ID NO: 568070 - DNA, 25 bp, Mus musculus
cagcctgtcatgctggccgtctgca

SEQ ID NO: 568071 - DNA, 25 bp, Mus musculus
cagcctgtcatggtggccgtctgca

SEQ ID NO: 568072 - DNA, 25 bp, Mus musculus
cagcctgtcggaacgactgtgagac

SEQ ID NO: 568073 - DNA, 25 bp, Mus musculus
cagcctgtcggatcgactgtgagac

SEQ ID NO: 568074 - DNA, 25 bp, Mus musculus
cagcctgtctgccatcattgatggc

SEQ ID NO: 568075 - DNA, 25 bp, Mus musculus
cagcctgtctgcgatcattgatggc

SEQ ID NO: 568076 - DNA, 25 bp, Mus musculus
cagcctgtgagaaattctccaacaa

SEQ ID NO: 568077 - DNA, 25 bp, Mus musculus
cagcctgtgagatattctccaacaa

SEQ ID NO: 568078 - DNA, 25 bp, Mus musculus
cagcctgtgcagatgtcattttggc

SEQ ID NO: 568079 - DNA, 25 bp, Mus musculus
cagcctgtgcagttgtcattttggc

SEQ ID NO: 568080 - DNA, 25 bp, Mus musculus
cagcctgtgccgctgttacgaagag

SEQ ID NO: 568081 - DNA, 25 bp, Mus musculus
cagcctgtgccggtgttacgaagag

SEQ ID NO: 568082 - DNA, 25 bp, Mus musculus
cagcctgtggcacggtagcctgttc

SEQ ID NO: 568083 - DNA, 25 bp, Mus musculus
cagcctgtggcagggtagcctgttc

SEQ ID NO: 568084 - DNA, 25 bp, Mus musculus
cagcctgtgggaaaaactcatcttc

SEQ ID NO: 568085 - DNA, 25 bp, Mus musculus
cagcctgtgggaagcttctctagaa

SEQ ID NO: 568086 - DNA, 25 bp, Mus musculus
cagcctgtgggataaactcatcttc

SEQ ID NO: 568087 - DNA, 25 bp, Mus musculus
cagcctgtgggatgcttctctagaa

SEQ ID NO: 568088 - DNA, 25 bp, Mus musculus
cagcctgtgtccagatgggaaaggc

SEQ ID NO: 568089 - DNA, 25 bp, Mus musculus
cagcctgtgtcctgatgggaaaggc

SEQ ID NO: 568090 - DNA, 25 bp, Mus musculus
cagcctgtgtgaacggcctgcggaa

SEQ ID NO: 568091 - DNA, 25 bp, Mus musculus
cagcctgtgtgatcggcctgcggaa

SEQ ID NO: 568092 - DNA, 25 bp, Mus musculus
cagcctgttccaaacagtgatgctg

SEQ ID NO: 568093 - DNA, 25 bp, Mus musculus
cagcctgttccatacagtgatgctg

SEQ ID NO: 568094 - DNA, 25 bp, Mus musculus
cagcctgttcttacgaggaggagaa

SEQ ID NO: 568095 - DNA, 25 bp, Mus musculus
cagcctgttctttcgaggaggagaa

SEQ ID NO: 568096 - DNA, 25 bp, Mus musculus
cagcctgttgctcgactcctaagac

SEQ ID NO: 568097 - DNA, 25 bp, Mus musculus
cagcctgttgctggactcctaagac

SEQ ID NO: 568098 - DNA, 25 bp, Mus musculus
cagcctgttgtacctagtccagcaa

SEQ ID NO: 568099 - DNA, 25 bp, Mus musculus
cagcctgttgtagctagtccagcaa

SEQ ID NO: 568100 - DNA, 25 bp, Mus musculus
cagccttacagcagcagagattccc

SEQ ID NO: 568101 - DNA, 25 bp, Mus musculus
cagccttacagctgcagagattccc

SEQ ID NO: 568102 - DNA, 25 bp, Mus musculus
cagccttaccctaggactctgacag

SEQ ID NO: 568103 - DNA, 25 bp, Mus musculus
cagccttacccttggactctgacag

SEQ ID NO: 568104 - DNA, 25 bp, Mus musculus
cagccttagagtactggagccagtc

SEQ ID NO: 568105 - DNA, 25 bp, Mus musculus
cagccttagagttctggagccagtc

SEQ ID NO: 568106 - DNA, 25 bp, Mus musculus
cagccttaggtgatgtgccacatta

SEQ ID NO: 568107 - DNA, 25 bp, Mus musculus
cagccttaggtgttgtgccacatta

SEQ ID NO: 568108 - DNA, 25 bp, Mus musculus
cagccttatgccctgagtacctaga

SEQ ID NO: 568109 - DNA, 25 bp, Mus musculus
cagccttatgccgtgagtacctaga

SEQ ID NO: 568110 - DNA, 25 bp, Mus musculus
cagccttcaacaatcggacttttgg

SEQ ID NO: 568111 - DNA, 25 bp, Mus musculus
cagccttcaacattcggacttttgg

SEQ ID NO: 568112 - DNA, 25 bp, Mus musculus
cagccttcaccgaaacaagaccatg

SEQ ID NO: 568113 - DNA, 25 bp, Mus musculus
cagccttcaccgtaacaagaccatg

SEQ ID NO: 568114 - DNA, 25 bp, Mus musculus
cagccttcacgtacaccttgttaaa

SEQ ID NO: 568115 - DNA, 25 bp, Mus musculus
cagccttcacgttcaccttgttaaa

SEQ ID NO: 568116 - DNA, 25 bp, Mus musculus
cagccttcaggcagtgcctagactg

SEQ ID NO: 568117 - DNA, 25 bp, Mus musculus
cagccttcaggctgtgcctagactg

SEQ ID NO: 568118 - DNA, 25 bp, Mus musculus
cagccttcctggagcaaacactgtc

SEQ ID NO: 568119 - DNA, 25 bp, Mus musculus
cagccttcctggtgcaaacactgtc

SEQ ID NO: 568120 - DNA, 25 bp, Mus musculus
cagccttcggcgctggataccctgg

SEQ ID NO: 568121 - DNA, 25 bp, Mus musculus
cagccttcggcggtggataccctgg

SEQ ID NO: 568122 - DNA, 25 bp, Mus musculus
cagccttctaaaatcaagagatatt

SEQ ID NO: 568123 - DNA, 25 bp, Mus musculus
cagccttctaaattcaagagatatt

SEQ ID NO: 568124 - DNA, 25 bp, Mus musculus
cagccttctctgaccgtacctagtg

SEQ ID NO: 568125 - DNA, 25 bp, Mus musculus
cagccttctctgtccgtacctagtg

SEQ ID NO: 568126 - DNA, 25 bp, Mus musculus
cagccttctgtgcttaggagcccgg

SEQ ID NO: 568127 - DNA, 25 bp, Mus musculus
cagccttctgtggttaggagcccgg

SEQ ID NO: 568128 - DNA, 25 bp, Mus musculus
cagccttgactgctcctgggaagag

SEQ ID NO: 568129 - DNA, 25 bp, Mus musculus
cagccttgactggtcctgggaagag

SEQ ID NO: 568130 - DNA, 25 bp, Mus musculus
cagccttgagcaatttcttacaaag

SEQ ID NO: 568131 - DNA, 25 bp, Mus musculus
cagccttgagcattttcttacaaag

SEQ ID NO: 568132 - DNA, 25 bp, Mus musculus
cagccttgagggaaatcaagattct

SEQ ID NO: 568133 - DNA, 25 bp, Mus musculus
cagccttgagggtaatcaagattct

SEQ ID NO: 568134 - DNA, 25 bp, Mus musculus
cagccttgcctgatgaatgtagatg

SEQ ID NO: 568135 - DNA, 25 bp, Mus musculus
cagccttgcctgttgaatgtagatg

SEQ ID NO: 568136 - DNA, 25 bp, Mus musculus
cagccttgcgtcaaatctcagcatg

SEQ ID NO: 568137 - DNA, 25 bp, Mus musculus
cagccttgcgtctaatctcagcatg

SEQ ID NO: 568138 - DNA, 25 bp, Mus musculus
cagccttgctctcttttggcagcgt

SEQ ID NO: 568139 - DNA, 25 bp, Mus musculus
cagccttgctctgttttggcagcgt

SEQ ID NO: 568140 - DNA, 25 bp, Mus musculus
cagccttgcttgctgtggaacagtg

SEQ ID NO: 568141 - DNA, 25 bp, Mus musculus
cagccttgcttggtgtggaacagtg

SEQ ID NO: 568142 - DNA, 25 bp, Mus musculus
cagccttggcgacactgagtttgag

SEQ ID NO: 568143 - DNA, 25 bp, Mus musculus
cagccttggcgagactgagtttgag

SEQ ID NO: 568144 - DNA, 25 bp, Mus musculus
cagccttgggaacagaacgctgcgc

SEQ ID NO: 568145 - DNA, 25 bp, Mus musculus
cagccttgggaagagaacgctgcgc

SEQ ID NO: 568146 - DNA, 25 bp, Mus musculus
cagccttgtcctacagacggtgaca

SEQ ID NO: 568147 - DNA, 25 bp, Mus musculus
cagccttgtccttcagacggtgaca

SEQ ID NO: 568148 - DNA, 25 bp, Mus musculus
cagccttgtgagcaatggcactgac

SEQ ID NO: 568149 - DNA, 25 bp, Mus musculus
cagccttgtgaggaatggcactgac

SEQ ID NO: 568150 - DNA, 25 bp, Mus musculus
cagcctttccatacctagccgtgag

SEQ ID NO: 568151 - DNA, 25 bp, Mus musculus
cagcctttccattcctagccgtgag

SEQ ID NO: 568152 - DNA, 25 bp, Mus musculus
cagcctttgaacagagcctagggtc

SEQ ID NO: 568153 - DNA, 25 bp, Mus musculus
cagcctttgaactgagcctagggtc

SEQ ID NO: 568154 - DNA, 25 bp, Mus musculus
cagcctttgaagaacagttgagcca

SEQ ID NO: 568155 - DNA, 25 bp, Mus musculus
cagcctttgaagtacagttgagcca

SEQ ID NO: 568156 - DNA, 25 bp, Mus musculus
cagcctttgagaccaggagcacatt

SEQ ID NO: 568157 - DNA, 25 bp, Mus musculus
cagcctttgagagcaggagcacatt

SEQ ID NO: 568158 - DNA, 25 bp, Mus musculus
cagcctttgccgacaccttttatgc

SEQ ID NO: 568159 - DNA, 25 bp, Mus musculus
cagcctttgccgtcaccttttatgc

SEQ ID NO: 568160 - DNA, 25 bp, Mus musculus
cagcctttggatcctgtggtacccc

SEQ ID NO: 568161 - DNA, 25 bp, Mus musculus
cagcctttggatgctgtggtacccc

SEQ ID NO: 568162 - DNA, 25 bp, Mus musculus
cagcctttggtgacacaagcacaag

SEQ ID NO: 568163 - DNA, 25 bp, Mus musculus
cagcctttggtgattaatccagata

SEQ ID NO: 568164 - DNA, 25 bp, Mus musculus
cagcctttggtgtcacaagcacaag

SEQ ID NO: 568165 - DNA, 25 bp, Mus musculus
cagcctttggtgtttaatccagata

SEQ ID NO: 568166 - DNA, 25 bp, Mus musculus
cagcctttgtagagccgtttgtaat

SEQ ID NO: 568167 - DNA, 25 bp, Mus musculus
cagcctttgtagtgccgtttgtaat

SEQ ID NO: 568168 - DNA, 25 bp, Mus musculus
cagccttttctccaagtatagcaag

SEQ ID NO: 568169 - DNA, 25 bp, Mus musculus
cagccttttctcgaagtatagcaag

SEQ ID NO: 568170 - DNA, 25 bp, Mus musculus
cagccttttctgattgagcttaacc

SEQ ID NO: 568171 - DNA, 25 bp, Mus musculus
cagccttttctgtttgagcttaacc

SEQ ID NO: 568172 - DNA, 25 bp, Mus musculus
cagcgaaagaacatgcagcttacag

SEQ ID NO: 568173 - DNA, 25 bp, Mus musculus
cagcgaaagaacttgcagcttacag

SEQ ID NO: 568174 - DNA, 25 bp, Mus musculus
cagcgaaagggtcatccgttctgaa

SEQ ID NO: 568175 - DNA, 25 bp, Mus musculus
cagcgaaagggtgatccgttctgaa

SEQ ID NO: 568176 - DNA, 25 bp, Mus musculus
cagcgaactgttcaactgggcagat

SEQ ID NO: 568177 - DNA, 25 bp, Mus musculus
cagcgaactgttgaactgggcagat

SEQ ID NO: 568178 - DNA, 25 bp, Mus musculus
cagcgaacttgaagaaacagaggtc

SEQ ID NO: 568179 - DNA, 25 bp, Mus musculus
cagcgaacttgatgaaacagaggtc

SEQ ID NO: 568180 - DNA, 25 bp, Mus musculus
cagcgaacttgtcagcaatggagtc

SEQ ID NO: 568181 - DNA, 25 bp, Mus musculus
cagcgaacttgtgagcaatggagtc

SEQ ID NO: 568182 - DNA, 25 bp, Mus musculus
cagcgaagacagagtcggtgcagta

SEQ ID NO: 568183 - DNA, 25 bp, Mus musculus
cagcgaagacagtgtcggtgcagta

SEQ ID NO: 568184 - DNA, 25 bp, Mus musculus
cagcgaagattacaggcctatgaca

SEQ ID NO: 568185 - DNA, 25 bp, Mus musculus
cagcgaagattagaggcctatgaca

SEQ ID NO: 568186 - DNA, 25 bp, Mus musculus
cagcgaagcctgcaagccatgatgt

SEQ ID NO: 568187 - DNA, 25 bp, Mus musculus
cagcgaagcctggaagccatgatgt

SEQ ID NO: 568188 - DNA, 25 bp, Mus musculus
cagcgaagggaacagagtaaagcac

SEQ ID NO: 568189 - DNA, 25 bp, Mus musculus
cagcgaagggaagagagtaaagcac

SEQ ID NO: 568190 - DNA, 25 bp, Mus musculus
cagcgaagtcaacacggatgtgaat

SEQ ID NO: 568191 - DNA, 25 bp, Mus musculus
cagcgaagtcaagacggatgtgaat

SEQ ID NO: 568192 - DNA, 25 bp, Mus musculus
cagcgaatcgggaggcttggtacaa

SEQ ID NO: 568193 - DNA, 25 bp, Mus musculus
cagcgaatcgggtggcttggtacaa

SEQ ID NO: 568194 - DNA, 25 bp, Mus musculus
cagcgaatctttcagagggtccgac

SEQ ID NO: 568195 - DNA, 25 bp, Mus musculus
cagcgaatctttgagagggtccgac

SEQ ID NO: 568196 - DNA, 25 bp, Mus musculus
cagcgaatgctgaacgtgtgggcac

SEQ ID NO: 568197 - DNA, 25 bp, Mus musculus
cagcgaatgctgtacgtgtgggcac

SEQ ID NO: 568198 - DNA, 25 bp, Mus musculus
cagcgacaaagaaggctacaaacac

SEQ ID NO: 568199 - DNA, 25 bp, Mus musculus
cagcgacaaagatggctacaaacac

SEQ ID NO: 568200 - DNA, 25 bp, Mus musculus
cagcgacaagggactgagtctgaac

SEQ ID NO: 568201 - DNA, 25 bp, Mus musculus
cagcgacaagggtctgagtctgaac

SEQ ID NO: 568202 - DNA, 25 bp, Mus musculus
cagcgacaatgcacgcaaggacttt

SEQ ID NO: 568203 - DNA, 25 bp, Mus musculus
cagcgacaatgctcgcaaggacttt

SEQ ID NO: 568204 - DNA, 25 bp, Mus musculus
cagcgacaccatcaggtgagacctt

SEQ ID NO: 568205 - DNA, 25 bp, Mus musculus
cagcgacaccatgaggtgagacctt

SEQ ID NO: 568206 - DNA, 25 bp, Mus musculus
cagcgacactcacccagaaaactta

SEQ ID NO: 568207 - DNA, 25 bp, Mus musculus
cagcgacactcagccagaaaactta

SEQ ID NO: 568208 - DNA, 25 bp, Mus musculus
cagcgacagcgactggaaggtcctt

SEQ ID NO: 568209 - DNA, 25 bp, Mus musculus
cagcgacagcgagtggaaggtcctt

SEQ ID NO: 568210 - DNA, 25 bp, Mus musculus
cagcgacatcagaccctcgggggcg

SEQ ID NO: 568211 - DNA, 25 bp, Mus musculus
cagcgacatcagtccctcgggggcg

SEQ ID NO: 568212 - DNA, 25 bp, Mus musculus
cagcgacatggtccgctacctgggt

SEQ ID NO: 568213 - DNA, 25 bp, Mus musculus
cagcgacatggtgcgctacctgggt

SEQ ID NO: 568214 - DNA, 25 bp, Mus musculus
cagcgaccagatcaagcagtggaag

SEQ ID NO: 568215 - DNA, 25 bp, Mus musculus
cagcgaccagatgaagcagtggaag

SEQ ID NO: 568216 - DNA, 25 bp, Mus musculus
cagcgaccagctcttttataccaag

SEQ ID NO: 568217 - DNA, 25 bp, Mus musculus
cagcgaccagctgttttataccaag

SEQ ID NO: 568218 - DNA, 25 bp, Mus musculus
cagcgaccgggtcactgctgctgct

SEQ ID NO: 568219 - DNA, 25 bp, Mus musculus
cagcgaccgggtgactgctgctgct

SEQ ID NO: 568220 - DNA, 25 bp, Mus musculus
cagcgacctgctattatgccttcgt

SEQ ID NO: 568221 - DNA, 25 bp, Mus musculus
cagcgacctgcttttatgccttcgt

SEQ ID NO: 568222 - DNA, 25 bp, Mus musculus
cagcgacgtccacctcaagatgagt

SEQ ID NO: 568223 - DNA, 25 bp, Mus musculus
cagcgacgtccagctcaagatgagt

SEQ ID NO: 568224 - DNA, 25 bp, Mus musculus
cagcgactagagatcaattgccagg

SEQ ID NO: 568225 - DNA, 25 bp, Mus musculus
cagcgactagagttcaattgccagg

SEQ ID NO: 568226 - DNA, 25 bp, Mus musculus
cagcgactatttaaagagagctaga

SEQ ID NO: 568227 - DNA, 25 bp, Mus musculus
cagcgactattttaagagagctaga

SEQ ID NO: 568228 - DNA, 25 bp, Mus musculus
cagcgactcttgcagatagactccg

SEQ ID NO: 568229 - DNA, 25 bp, Mus musculus
cagcgactcttggagatagactccg

SEQ ID NO: 568230 - DNA, 25 bp, Mus musculus
cagcgactggtcatccctgtggact

SEQ ID NO: 568231 - DNA, 25 bp, Mus musculus
cagcgactggtcttccctgtggact

SEQ ID NO: 568232 - DNA, 25 bp, Mus musculus
cagcgacttaagaccggcgaggagt

SEQ ID NO: 568233 - DNA, 25 bp, Mus musculus
cagcgacttaagtccggcgaggagt

SEQ ID NO: 568234 - DNA, 25 bp, Mus musculus
cagcgagaacgacaagagaagcgca

SEQ ID NO: 568235 - DNA, 25 bp, Mus musculus
cagcgagaacgagaagagaagcgca

SEQ ID NO: 568236 - DNA, 25 bp, Mus musculus
cagcgagaactccatggagaagcac

SEQ ID NO: 568237 - DNA, 25 bp, Mus musculus
cagcgagaactcgatggagaagcac

SEQ ID NO: 568238 - DNA, 25 bp, Mus musculus
cagcgagaatatctacaccatcatg

SEQ ID NO: 568239 - DNA, 25 bp, Mus musculus
cagcgagaatatgtacaccatcatg

SEQ ID NO: 568240 - DNA, 25 bp, Mus musculus
cagcgagacccaaagccgggtccga

SEQ ID NO: 568241 - DNA, 25 bp, Mus musculus
cagcgagacccatagccgggtccga

SEQ ID NO: 568242 - DNA, 25 bp, Mus musculus
cagcgagaccttcactcgagacaac

SEQ ID NO: 568243 - DNA, 25 bp, Mus musculus
cagcgagaccttgactcgagacaac

SEQ ID NO: 568244 - DNA, 25 bp, Mus musculus
cagcgagactctcgtctgtcttgga

SEQ ID NO: 568245 - DNA, 25 bp, Mus musculus
cagcgagactctggtctgtcttgga

SEQ ID NO: 568246 - DNA, 25 bp, Mus musculus
cagcgagagtgacaacagcgcagac

SEQ ID NO: 568247 - DNA, 25 bp, Mus musculus
cagcgagagtgagaacagcgcagac

SEQ ID NO: 568248 - DNA, 25 bp, Mus musculus
cagcgagatatcactgtcaactgtc

SEQ ID NO: 568249 - DNA, 25 bp, Mus musculus
cagcgagatatctctgtcaactgtc

SEQ ID NO: 568250 - DNA, 25 bp, Mus musculus
cagcgagatcgacgagttttaccag

SEQ ID NO: 568251 - DNA, 25 bp, Mus musculus
cagcgagatcgaggagttttaccag

SEQ ID NO: 568252 - DNA, 25 bp, Mus musculus
cagcgagcgactaagctcggtgcgc

SEQ ID NO: 568253 - DNA, 25 bp, Mus musculus
cagcgagcgacttagctcggtgcgc

SEQ ID NO: 568254 - DNA, 25 bp, Mus musculus
cagcgagcttataggttcgtgcaag

SEQ ID NO: 568255 - DNA, 25 bp, Mus musculus
cagcgagcttattggttcgtgcaag

SEQ ID NO: 568256 - DNA, 25 bp, Mus musculus
cagcgagggcagaagtgggagggca

SEQ ID NO: 568257 - DNA, 25 bp, Mus musculus
cagcgagggcagtagtgggagggca

SEQ ID NO: 568258 - DNA, 25 bp, Mus musculus
cagcgagtacgtcaagaactttgag

SEQ ID NO: 568259 - DNA, 25 bp, Mus musculus
cagcgagtacgtgaagaactttgag

SEQ ID NO: 568260 - DNA, 25 bp, Mus musculus
cagcgagtagtaaggcggccttcct

SEQ ID NO: 568261 - DNA, 25 bp, Mus musculus
cagcgagtagtatggcggccttcct

SEQ ID NO: 568262 - DNA, 25 bp, Mus musculus
cagcgagtgactcgaacactggtcc

SEQ ID NO: 568263 - DNA, 25 bp, Mus musculus
cagcgagtgactggaacactggtcc

SEQ ID NO: 568264 - DNA, 25 bp, Mus musculus
cagcgagtgagtcgctcgcagaacc

SEQ ID NO: 568265 - DNA, 25 bp, Mus musculus
cagcgagtgagtggctcgcagaacc

SEQ ID NO: 568266 - DNA, 25 bp, Mus musculus
cagcgagtggatcggttactgcctc

SEQ ID NO: 568267 - DNA, 25 bp, Mus musculus
cagcgagtggatgggttactgcctc

SEQ ID NO: 568268 - DNA, 25 bp, Mus musculus
cagcgatatgcacctttctacctac

SEQ ID NO: 568269 - DNA, 25 bp, Mus musculus
cagcgatatgcagctttctacctac

SEQ ID NO: 568270 - DNA, 25 bp, Mus musculus
cagcgatgacatagagagtgcattc

SEQ ID NO: 568271 - DNA, 25 bp, Mus musculus
cagcgatgacattgagagtgcattc

SEQ ID NO: 568272 - DNA, 25 bp, Mus musculus
cagcgatgagtcattcgccatgatt

SEQ ID NO: 568273 - DNA, 25 bp, Mus musculus
cagcgatgagtctttcgccatgatt

SEQ ID NO: 568274 - DNA, 25 bp, Mus musculus
cagcgatgcagaagacagtaagacg

SEQ ID NO: 568275 - DNA, 25 bp, Mus musculus
cagcgatgcagatgacagtaagacg

SEQ ID NO: 568276 - DNA, 25 bp, Mus musculus
cagcgatgcctgagaagaccaaagc

SEQ ID NO: 568277 - DNA, 25 bp, Mus musculus
cagcgatgcctgtgaagaccaaagc

SEQ ID NO: 568278 - DNA, 25 bp, Mus musculus
cagcgatgtcgaatcctagagccat

SEQ ID NO: 568279 - DNA, 25 bp, Mus musculus
cagcgatgtcgattcctagagccat

SEQ ID NO: 568280 - DNA, 25 bp, Mus musculus
cagcgatgtggacctactctgcaag

SEQ ID NO: 568281 - DNA, 25 bp, Mus musculus
cagcgatgtggagctactctgcaag

SEQ ID NO: 568282 - DNA, 25 bp, Mus musculus
cagcgattcataacaccattgaaag

SEQ ID NO: 568283 - DNA, 25 bp, Mus musculus
cagcgattcatatcaccattgaaag

SEQ ID NO: 568284 - DNA, 25 bp, Mus musculus
cagcgattccgtcccttgagtgtgt

SEQ ID NO: 568285 - DNA, 25 bp, Mus musculus
cagcgattccgtgccttgagtgtgt

SEQ ID NO: 568286 - DNA, 25 bp, Mus musculus
cagcgatttgaaagagctttgtgga

SEQ ID NO: 568287 - DNA, 25 bp, Mus musculus
cagcgatttgaatgagctttgtgga

SEQ ID NO: 568288 - DNA, 25 bp, Mus musculus
cagcgcaaaaatctccggtgtttct

SEQ ID NO: 568289 - DNA, 25 bp, Mus musculus
cagcgcaaaaatgtccggtgtttct

SEQ ID NO: 568290 - DNA, 25 bp, Mus musculus
cagcgcaagatacatttttgtagaa

SEQ ID NO: 568291 - DNA, 25 bp, Mus musculus
cagcgcaagatagatttttgtagaa

SEQ ID NO: 568292 - DNA, 25 bp, Mus musculus
cagcgcacacggctgttagacagcg

SEQ ID NO: 568293 - DNA, 25 bp, Mus musculus
cagcgcacacgggtgttagacagcg

SEQ ID NO: 568294 - DNA, 25 bp, Mus musculus
cagcgcaccaggcaagggcttatct

SEQ ID NO: 568295 - DNA, 25 bp, Mus musculus
cagcgcaccagggaagggcttatct

SEQ ID NO: 568296 - DNA, 25 bp, Mus musculus
cagcgcacctgtacagacttctgca

SEQ ID NO: 568297 - DNA, 25 bp, Mus musculus
cagcgcacctgttcagacttctgca

SEQ ID NO: 568298 - DNA, 25 bp, Mus musculus
cagcgcagtcgacgtgcagacgtac

SEQ ID NO: 568299 - DNA, 25 bp, Mus musculus
cagcgcagtcgaggtgcagacgtac

SEQ ID NO: 568300 - DNA, 25 bp, Mus musculus
cagcgcatcactcgcttatctcggg

SEQ ID NO: 568301 - DNA, 25 bp, Mus musculus
cagcgcatcactggcttatctcggg

SEQ ID NO: 568302 - DNA, 25 bp, Mus musculus
cagcgcattctgacctgggctcaga

SEQ ID NO: 568303 - DNA, 25 bp, Mus musculus
cagcgcattctgtcctgggctcaga

SEQ ID NO: 568304 - DNA, 25 bp, Mus musculus
cagcgccacctgaggatttcctgga

SEQ ID NO: 568305 - DNA, 25 bp, Mus musculus
cagcgccacctgtggatttcctgga

SEQ ID NO: 568306 - DNA, 25 bp, Mus musculus
cagcgccagccgacttttgtggtct

SEQ ID NO: 568307 - DNA, 25 bp, Mus musculus
cagcgccagccgtcttttgtggtct

SEQ ID NO: 568308 - DNA, 25 bp, Mus musculus
cagcgccagcttagtgatgttgtag

SEQ ID NO: 568309 - DNA, 25 bp, Mus musculus
cagcgccagctttgtgatgttgtag

SEQ ID NO: 568310 - DNA, 25 bp, Mus musculus
cagcgccagttacaagaacctcaca

SEQ ID NO: 568311 - DNA, 25 bp, Mus musculus
cagcgccagttagaagaacctcaca

SEQ ID NO: 568312 - DNA, 25 bp, Mus musculus
cagcgcccctgcatgttaaaagggt

SEQ ID NO: 568313 - DNA, 25 bp, Mus musculus
cagcgcccctgcttgttaaaagggt

SEQ ID NO: 568314 - DNA, 25 bp, Mus musculus
cagcgcccgaggaactgacagtggt

SEQ ID NO: 568315 - DNA, 25 bp, Mus musculus
cagcgcccgaggtactgacagtggt

SEQ ID NO: 568316 - DNA, 25 bp, Mus musculus
cagcgccctccacagtaacagtgaa

SEQ ID NO: 568317 - DNA, 25 bp, Mus musculus
cagcgccctccagagtaacagtgaa

SEQ ID NO: 568318 - DNA, 25 bp, Mus musculus
cagcgccctctacgcagcggaagtg

SEQ ID NO: 568319 - DNA, 25 bp, Mus musculus
cagcgccctctaggcagcggaagtg

SEQ ID NO: 568320 - DNA, 25 bp, Mus musculus
cagcgccctgggaggtttgccagca

SEQ ID NO: 568321 - DNA, 25 bp, Mus musculus
cagcgccctgggtggtttgccagca

SEQ ID NO: 568322 - DNA, 25 bp, Mus musculus
cagcgccctgtgagattaatgtaaa

SEQ ID NO: 568323 - DNA, 25 bp, Mus musculus
cagcgccctgtgtgattaatgtaaa

SEQ ID NO: 568324 - DNA, 25 bp, Mus musculus
cagcgccgaccaagacctgttctgt

SEQ ID NO: 568325 - DNA, 25 bp, Mus musculus
cagcgccgaccatgacctgttctgt

SEQ ID NO: 568326 - DNA, 25 bp, Mus musculus
cagcgccgttgtagtgggcatagtc

SEQ ID NO: 568327 - DNA, 25 bp, Mus musculus
cagcgccgttgttgtgggcatagtc

SEQ ID NO: 568328 - DNA, 25 bp, Mus musculus
cagcgcctaaagaggagcaacagga

SEQ ID NO: 568329 - DNA, 25 bp, Mus musculus
cagcgcctaaagtggagcaacagga

SEQ ID NO: 568330 - DNA, 25 bp, Mus musculus
cagcgcctatcccaagtacctggag

SEQ ID NO: 568331 - DNA, 25 bp, Mus musculus
cagcgcctatccgaagtacctggag

SEQ ID NO: 568332 - DNA, 25 bp, Mus musculus
cagcgcctccgaagtggcgtaaggt

SEQ ID NO: 568333 - DNA, 25 bp, Mus musculus
cagcgcctccgatgtggcgtaaggt

SEQ ID NO: 568334 - DNA, 25 bp, Mus musculus
cagcgcctctctaacgacttcgtgg

SEQ ID NO: 568335 - DNA, 25 bp, Mus musculus
cagcgcctctcttacgacttcgtgg

SEQ ID NO: 568336 - DNA, 25 bp, Mus musculus
cagcgcctggagcagtccatatgtg

SEQ ID NO: 568337 - DNA, 25 bp, Mus musculus
cagcgcctggaggagtccatatgtg

SEQ ID NO: 568338 - DNA, 25 bp, Mus musculus
cagcgcctgtccaatgagtgtgtca

SEQ ID NO: 568339 - DNA, 25 bp, Mus musculus
cagcgcctgtcctatgagtgtgtca

SEQ ID NO: 568340 - DNA, 25 bp, Mus musculus
cagcgcctgtgacggatgttgttac

SEQ ID NO: 568341 - DNA, 25 bp, Mus musculus
cagcgcctgtgagggatgttgttac

SEQ ID NO: 568342 - DNA, 25 bp, Mus musculus
cagcgcgaacgcagagagcattctg

SEQ ID NO: 568343 - DNA, 25 bp, Mus musculus
cagcgcgaacgctgagagcattctg

SEQ ID NO: 568344 - DNA, 25 bp, Mus musculus
cagcgcgcgaatcgtctggaccaac

SEQ ID NO: 568345 - DNA, 25 bp, Mus musculus
cagcgcgcgaatggtctggaccaac

SEQ ID NO: 568346 - DNA, 25 bp, Mus musculus
cagcgcgcttcaagctggtcaaaag

SEQ ID NO: 568347 - DNA, 25 bp, Mus musculus
cagcgcgcttcatgctggtcaaaag

SEQ ID NO: 568348 - DNA, 25 bp, Mus musculus
cagcgcggtgtcagcctgcacgctg

SEQ ID NO: 568349 - DNA, 25 bp, Mus musculus
cagcgcggtgtctgcctgcacgctg

SEQ ID NO: 568350 - DNA, 25 bp, Mus musculus
cagcgcgttcagactgtacagagga

SEQ ID NO: 568351 - DNA, 25 bp, Mus musculus
cagcgcgttcagtctgtacagagga

SEQ ID NO: 568352 - DNA, 25 bp, Mus musculus
cagcgcgtttataggcatcggcttc

SEQ ID NO: 568353 - DNA, 25 bp, Mus musculus
cagcgcgtttattggcatcggcttc

SEQ ID NO: 568354 - DNA, 25 bp, Mus musculus
cagcgcgtttctcgagtgtgagccc

SEQ ID NO: 568355 - DNA, 25 bp, Mus musculus
cagcgcgtttctggagtgtgagccc

SEQ ID NO: 568356 - DNA, 25 bp, Mus musculus
cagcgctatgagagggtggtcatca

SEQ ID NO: 568357 - DNA, 25 bp, Mus musculus
cagcgctatgagtgggtggtcatca

SEQ ID NO: 568358 - DNA, 25 bp, Mus musculus
cagcgctctgctcaccaagtgtgtg

SEQ ID NO: 568359 - DNA, 25 bp, Mus musculus
cagcgctctgctgaccaagtgtgtg

SEQ ID NO: 568360 - DNA, 25 bp, Mus musculus
cagcgctcttggaaaataaccccta

SEQ ID NO: 568361 - DNA, 25 bp, Mus musculus
cagcgctcttggtaaataaccccta

SEQ ID NO: 568362 - DNA, 25 bp, Mus musculus
cagcgctctttaagctggagggagt

SEQ ID NO: 568363 - DNA, 25 bp, Mus musculus
cagcgctctttatgctggagggagt

SEQ ID NO: 568364 - DNA, 25 bp, Mus musculus
cagcgctgagcaatgtccgctggct

SEQ ID NO: 568365 - DNA, 25 bp, Mus musculus
cagcgctgagcattgtccgctggct

SEQ ID NO: 568366 - DNA, 25 bp, Mus musculus
cagcgctgctgtcacactcttcaag

SEQ ID NO: 568367 - DNA, 25 bp, Mus musculus
cagcgctgctgtgacactcttcaag

SEQ ID NO: 568368 - DNA, 25 bp, Mus musculus
cagcgctgtagccagcctctgaaac

SEQ ID NO: 568369 - DNA, 25 bp, Mus musculus
cagcgctgtagcgagcctctgaaac

SEQ ID NO: 568370 - DNA, 25 bp, Mus musculus
cagcgctgtatgcaccacgtggtgc

SEQ ID NO: 568371 - DNA, 25 bp, Mus musculus
cagcgctgtatggaccacgtggtgc

SEQ ID NO: 568372 - DNA, 25 bp, Mus musculus
cagcgctgtcctagcaagagagaaa

SEQ ID NO: 568373 - DNA, 25 bp, Mus musculus
cagcgctgtccttgcaagagagaaa

SEQ ID NO: 568374 - DNA, 25 bp, Mus musculus
cagcgctgtcgacaagctgcagcaa

SEQ ID NO: 568375 - DNA, 25 bp, Mus musculus
cagcgctgtcgagaagctgcagcaa

SEQ ID NO: 568376 - DNA, 25 bp, Mus musculus
cagcgctgtggaagtcaagagcaag

SEQ ID NO: 568377 - DNA, 25 bp, Mus musculus
cagcgctgtggatgtcaagagcaag

SEQ ID NO: 568378 - DNA, 25 bp, Mus musculus
cagcgctgtgtgaacagcaccagca

SEQ ID NO: 568379 - DNA, 25 bp, Mus musculus
cagcgctgtgtgagctcatgccagg

SEQ ID NO: 568380 - DNA, 25 bp, Mus musculus
cagcgctgtgtgtacagcaccagca

SEQ ID NO: 568381 - DNA, 25 bp, Mus musculus
cagcgctgtgtgtgctcatgccagg

SEQ ID NO: 568382 - DNA, 25 bp, Mus musculus
cagcgcttggctaatgttgcggcaa

SEQ ID NO: 568383 - DNA, 25 bp, Mus musculus
cagcgcttggcttatgttgcggcaa

SEQ ID NO: 568384 - DNA, 25 bp, Mus musculus
cagcgctttcttacactgcgagtac

SEQ ID NO: 568385 - DNA, 25 bp, Mus musculus
cagcgctttctttcactgcgagtac

SEQ ID NO: 568386 - DNA, 25 bp, Mus musculus
cagcgctttttacagctctggagcc

SEQ ID NO: 568387 - DNA, 25 bp, Mus musculus
cagcgctttttagagctctggagcc

SEQ ID NO: 568388 - DNA, 25 bp, Mus musculus
cagcggaaacatccggcaaatttca

SEQ ID NO: 568389 - DNA, 25 bp, Mus musculus
cagcggaaacatgcggcaaatttca

SEQ ID NO: 568390 - DNA, 25 bp, Mus musculus
cagcggaaagcacagaatgtctgaa

SEQ ID NO: 568391 - DNA, 25 bp, Mus musculus
cagcggaaagcagagaatgtctgaa

SEQ ID NO: 568392 - DNA, 25 bp, Mus musculus
cagcggaaagtgatctgcatcccca

SEQ ID NO: 568393 - DNA, 25 bp, Mus musculus
cagcggaaagtgttctgcatcccca

SEQ ID NO: 568394 - DNA, 25 bp, Mus musculus
cagcggaaccaccagggtcatgaag

SEQ ID NO: 568395 - DNA, 25 bp, Mus musculus
cagcggaaccacgagggtcatgaag

SEQ ID NO: 568396 - DNA, 25 bp, Mus musculus
cagcggagaccgaggacttttctca

SEQ ID NO: 568397 - DNA, 25 bp, Mus musculus
cagcggagaccgtggacttttctca

SEQ ID NO: 568398 - DNA, 25 bp, Mus musculus
cagcggagccttagtgggccaacga

SEQ ID NO: 568399 - DNA, 25 bp, Mus musculus
cagcggagcctttgtgggccaacga

SEQ ID NO: 568400 - DNA, 25 bp, Mus musculus
cagcggagcgaaaatggagctattc

SEQ ID NO: 568401 - DNA, 25 bp, Mus musculus
cagcggagcgaatatggagctattc

SEQ ID NO: 568402 - DNA, 25 bp, Mus musculus
cagcggagctccagaatcacttcaa

SEQ ID NO: 568403 - DNA, 25 bp, Mus musculus
cagcggagctcctgaatcacttcaa

SEQ ID NO: 568404 - DNA, 25 bp, Mus musculus
cagcggagctggatcctccggcaga

SEQ ID NO: 568405 - DNA, 25 bp, Mus musculus
cagcggagctggttcctccggcaga

SEQ ID NO: 568406 - DNA, 25 bp, Mus musculus
cagcggagcttgctcaacaaatgga

SEQ ID NO: 568407 - DNA, 25 bp, Mus musculus
cagcggagcttggtcaacaaatgga

SEQ ID NO: 568408 - DNA, 25 bp, Mus musculus
cagcggaggaagactggtatcactt

SEQ ID NO: 568409 - DNA, 25 bp, Mus musculus
cagcggaggaagtctggtatcactt

SEQ ID NO: 568410 - DNA, 25 bp, Mus musculus
cagcggaggattcttgtggctacca

SEQ ID NO: 568411 - DNA, 25 bp, Mus musculus
cagcggaggattgttgtggctacca

SEQ ID NO: 568412 - DNA, 25 bp, Mus musculus
cagcggagtcggatgctcagtatct

SEQ ID NO: 568413 - DNA, 25 bp, Mus musculus
cagcggagtcggttgctcagtatct

SEQ ID NO: 568414 - DNA, 25 bp, Mus musculus
cagcggagttataaacagaagaaga

SEQ ID NO: 568415 - DNA, 25 bp, Mus musculus
cagcggagttattaacagaagaaga

SEQ ID NO: 568416 - DNA, 25 bp, Mus musculus
cagcggatgcttcctgaactggcca

SEQ ID NO: 568417 - DNA, 25 bp, Mus musculus
cagcggatgcttgctgaactggcca

SEQ ID NO: 568418 - DNA, 25 bp, Mus musculus
cagcggatgtagaggccttcattct

SEQ ID NO: 568419 - DNA, 25 bp, Mus musculus
cagcggatgtagtggccttcattct

SEQ ID NO: 568420 - DNA, 25 bp, Mus musculus
cagcggcaaaatatggtatctgcga

SEQ ID NO: 568421 - DNA, 25 bp, Mus musculus
cagcggcaaaatttggtatctgcga

SEQ ID NO: 568422 - DNA, 25 bp, Mus musculus
cagcggcaacctacggagtcaggac

SEQ ID NO: 568423 - DNA, 25 bp, Mus musculus
cagcggcaaccttcggagtcaggac

SEQ ID NO: 568424 - DNA, 25 bp, Mus musculus
cagcggcagaacaatggaatcaacg

SEQ ID NO: 568425 - DNA, 25 bp, Mus musculus
cagcggcagaactatggaatcaacg

SEQ ID NO: 568426 - DNA, 25 bp, Mus musculus
cagcggcagattctgtcacagacga

SEQ ID NO: 568427 - DNA, 25 bp, Mus musculus
cagcggcagattgtgtcacagacga

SEQ ID NO: 568428 - DNA, 25 bp, Mus musculus
cagcggcagcatcgaaaaccttgaa

SEQ ID NO: 568429 - DNA, 25 bp, Mus musculus
cagcggcagcatggaaaaccttgaa

SEQ ID NO: 568430 - DNA, 25 bp, Mus musculus
cagcggcaggaccaacctgtactgg

SEQ ID NO: 568431 - DNA, 25 bp, Mus musculus
cagcggcaggacgaacctgtactgg

SEQ ID NO: 568432 - DNA, 25 bp, Mus musculus
cagcggcaggatcatggcagcttta

SEQ ID NO: 568433 - DNA, 25 bp, Mus musculus
cagcggcaggatgatggcagcttta

SEQ ID NO: 568434 - DNA, 25 bp, Mus musculus
cagcggcagtttcattttggtctct

SEQ ID NO: 568435 - DNA, 25 bp, Mus musculus
cagcggcagtttgattttggtctct

SEQ ID NO: 568436 - DNA, 25 bp, Mus musculus
cagcggccgtacagcccattacaag

SEQ ID NO: 568437 - DNA, 25 bp, Mus musculus
cagcggccgtactgcccattacaag

SEQ ID NO: 568438 - DNA, 25 bp, Mus musculus
cagcggcggcaacaggatgaacaac

SEQ ID NO: 568439 - DNA, 25 bp, Mus musculus
cagcggcggcaagaggatgaacaac

SEQ ID NO: 568440 - DNA, 25 bp, Mus musculus
cagcggcgttggcaagacatctcta

SEQ ID NO: 568441 - DNA, 25 bp, Mus musculus
cagcggcgttgggaagacatctcta

SEQ ID NO: 568442 - DNA, 25 bp, Mus musculus
cagcggctaactcaatacatggagc

SEQ ID NO: 568443 - DNA, 25 bp, Mus musculus
cagcggctaactgaatacatggagc

SEQ ID NO: 568444 - DNA, 25 bp, Mus musculus
cagcggctcatcaacagtggcaagc

SEQ ID NO: 568445 - DNA, 25 bp, Mus musculus
cagcggctcatctacagtggcaagc

SEQ ID NO: 568446 - DNA, 25 bp, Mus musculus
cagcggctccaaatttctgccttca

SEQ ID NO: 568447 - DNA, 25 bp, Mus musculus
cagcggctccaattttctgccttca

SEQ ID NO: 568448 - DNA, 25 bp, Mus musculus
cagcggctccaccatcgagaagagc

SEQ ID NO: 568449 - DNA, 25 bp, Mus musculus
cagcggctccacgatcgagaagagc

SEQ ID NO: 568450 - DNA, 25 bp, Mus musculus
cagcggctgacaaagggctcgagcc

SEQ ID NO: 568451 - DNA, 25 bp, Mus musculus
cagcggctgacatagggctcgagcc

SEQ ID NO: 568452 - DNA, 25 bp, Mus musculus
cagcggctgatacggcttgcaaaga

SEQ ID NO: 568453 - DNA, 25 bp, Mus musculus
cagcggctgatagggcttgcaaaga

SEQ ID NO: 568454 - DNA, 25 bp, Mus musculus
cagcggctggataacgagatggacc

SEQ ID NO: 568455 - DNA, 25 bp, Mus musculus
cagcggctggattacgagatggacc

SEQ ID NO: 568456 - DNA, 25 bp, Mus musculus
cagcggctggtgcagttcatgacaa

SEQ ID NO: 568457 - DNA, 25 bp, Mus musculus
cagcggctggtggagttcatgacaa

SEQ ID NO: 568458 - DNA, 25 bp, Mus musculus
cagcggcttcagagggaacagagaa

SEQ ID NO: 568459 - DNA, 25 bp, Mus musculus
cagcggcttcagtgggaacagagaa

SEQ ID NO: 568460 - DNA, 25 bp, Mus musculus
cagcggcttccgcttggtggacctc

SEQ ID NO: 568461 - DNA, 25 bp, Mus musculus
cagcggcttccggttggtggacctc

SEQ ID NO: 568462 - DNA, 25 bp, Mus musculus
cagcggcttgatccgtcagaaacgg

SEQ ID NO: 568463 - DNA, 25 bp, Mus musculus
cagcggcttgatgcgtcagaaacgg

SEQ ID NO: 568464 - DNA, 25 bp, Mus musculus
cagcggctttttactcagtgacaac

SEQ ID NO: 568465 - DNA, 25 bp, Mus musculus
cagcggcttttttctcagtgacaac

SEQ ID NO: 568466 - DNA, 25 bp, Mus musculus
cagcgggaaccacgagcaagaacga

SEQ ID NO: 568467 - DNA, 25 bp, Mus musculus
cagcgggaaccaggagcaagaacga

SEQ ID NO: 568468 - DNA, 25 bp, Mus musculus
cagcgggaagagatcctgttagcca

SEQ ID NO: 568469 - DNA, 25 bp, Mus musculus
cagcgggaagagttcctgttagcca

SEQ ID NO: 568470 - DNA, 25 bp, Mus musculus
cagcgggaaggtcatgtacgccttc

SEQ ID NO: 568471 - DNA, 25 bp, Mus musculus
cagcgggaaggtgatgtacgccttc

SEQ ID NO: 568472 - DNA, 25 bp, Mus musculus
cagcgggaagtacacatttgcagcc

SEQ ID NO: 568473 - DNA, 25 bp, Mus musculus
cagcgggaagtagacatttgcagcc

SEQ ID NO: 568474 - DNA, 25 bp, Mus musculus
cagcgggcacatatacaaccagaat

SEQ ID NO: 568475 - DNA, 25 bp, Mus musculus
cagcgggcacatttacaaccagaat

SEQ ID NO: 568476 - DNA, 25 bp, Mus musculus
cagcgggcacctcaatttccagatt

SEQ ID NO: 568477 - DNA, 25 bp, Mus musculus
cagcgggcacctgaatttccagatt

SEQ ID NO: 568478 - DNA, 25 bp, Mus musculus
cagcgggcactacccatctatgaga

SEQ ID NO: 568479 - DNA, 25 bp, Mus musculus
cagcgggcactagccatctatgaga

SEQ ID NO: 568480 - DNA, 25 bp, Mus musculus
cagcgggcatgaccgatccaccagg

SEQ ID NO: 568481 - DNA, 25 bp, Mus musculus
cagcgggcatgagcgatccaccagg

SEQ ID NO: 568482 - DNA, 25 bp, Mus musculus
cagcgggccactcgcatcagctttg

SEQ ID NO: 568483 - DNA, 25 bp, Mus musculus
cagcgggccactggcatcagctttg

SEQ ID NO: 568484 - DNA, 25 bp, Mus musculus
cagcgggcctgacgcatggctccat

SEQ ID NO: 568485 - DNA, 25 bp, Mus musculus
cagcgggcctgaggcatggctccat

SEQ ID NO: 568486 - DNA, 25 bp, Mus musculus
cagcgggctctccttaagttcttat

SEQ ID NO: 568487 - DNA, 25 bp, Mus musculus
cagcgggctctcgttaagttcttat

SEQ ID NO: 568488 - DNA, 25 bp, Mus musculus
cagcggggctccaaggttacaatgc

SEQ ID NO: 568489 - DNA, 25 bp, Mus musculus
cagcggggctcctaggttacaatgc

SEQ ID NO: 568490 - DNA, 25 bp, Mus musculus
cagcgggtacaaccttcatgatgac

SEQ ID NO: 568491 - DNA, 25 bp, Mus musculus
cagcgggtacaagcttcatgatgac

SEQ ID NO: 568492 - DNA, 25 bp, Mus musculus
cagcgggtccctcctgacatgatct

SEQ ID NO: 568493 - DNA, 25 bp, Mus musculus
cagcgggtccctgctgacatgatct

SEQ ID NO: 568494 - DNA, 25 bp, Mus musculus
cagcgggtcttcaagatgacattcc

SEQ ID NO: 568495 - DNA, 25 bp, Mus musculus
cagcgggtcttctagatgacattcc

SEQ ID NO: 568496 - DNA, 25 bp, Mus musculus
cagcgggtgcgactgtcttggaacc

SEQ ID NO: 568497 - DNA, 25 bp, Mus musculus
cagcgggtgcgagtgtcttggaacc

SEQ ID NO: 568498 - DNA, 25 bp, Mus musculus
cagcggtaccctcgaaatgtcatca

SEQ ID NO: 568499 - DNA, 25 bp, Mus musculus
cagcggtaccctggaaatgtcatca

SEQ ID NO: 568500 - DNA, 25 bp, Mus musculus
cagcggtactgtcagtgcaatactg

SEQ ID NO: 568501 - DNA, 25 bp, Mus musculus
cagcggtactgtgagtgcaatactg

SEQ ID NO: 568502 - DNA, 25 bp, Mus musculus
cagcggtataccacttgcagagcaa

SEQ ID NO: 568503 - DNA, 25 bp, Mus musculus
cagcggtatacctcttgcagagcaa

SEQ ID NO: 568504 - DNA, 25 bp, Mus musculus
cagcggtcatttagtgggcctggca

SEQ ID NO: 568505 - DNA, 25 bp, Mus musculus
cagcggtcattttgtgggcctggca

SEQ ID NO: 568506 - DNA, 25 bp, Mus musculus
cagcggtcttgactgttttgtggtc

SEQ ID NO: 568507 - DNA, 25 bp, Mus musculus
cagcggtcttgagtgttttgtggtc

SEQ ID NO: 568508 - DNA, 25 bp, Mus musculus
cagcggtgtggaacatcgctcacgg

SEQ ID NO: 568509 - DNA, 25 bp, Mus musculus
cagcggtgtggatcatcgctcacgg

SEQ ID NO: 568510 - DNA, 25 bp, Mus musculus
cagcggtgtttcaggcatgaggaac

SEQ ID NO: 568511 - DNA, 25 bp, Mus musculus
cagcggtgtttctggcatgaggaac

SEQ ID NO: 568512 - DNA, 25 bp, Mus musculus
cagcggttctttaacactaagtcct

SEQ ID NO: 568513 - DNA, 25 bp, Mus musculus
cagcggttcttttacactaagtcct

SEQ ID NO: 568514 - DNA, 25 bp, Mus musculus
cagcgtaatggcagggaaagcttcc

SEQ ID NO: 568515 - DNA, 25 bp, Mus musculus
cagcgtaatggctgggaaagcttcc

SEQ ID NO: 568516 - DNA, 25 bp, Mus musculus
cagcgtactcaactctaaggcagag

SEQ ID NO: 568517 - DNA, 25 bp, Mus musculus
cagcgtactcaagtctaaggcagag

SEQ ID NO: 568518 - DNA, 25 bp, Mus musculus
cagcgtatcttccaggtgaacgcac

SEQ ID NO: 568519 - DNA, 25 bp, Mus musculus
cagcgtatcttcgaggtgaacgcac

SEQ ID NO: 568520 - DNA, 25 bp, Mus musculus
cagcgtatgagacacgattcaataa

SEQ ID NO: 568521 - DNA, 25 bp, Mus musculus
cagcgtatgagagacgattcaataa

SEQ ID NO: 568522 - DNA, 25 bp, Mus musculus
cagcgtcaagctcttgtcagaacac

SEQ ID NO: 568523 - DNA, 25 bp, Mus musculus
cagcgtcaagctgttgtcagaacac

SEQ ID NO: 568524 - DNA, 25 bp, Mus musculus
cagcgtcaccggagtgcggctcgca

SEQ ID NO: 568525 - DNA, 25 bp, Mus musculus
cagcgtcaccggtgtgcggctcgca

SEQ ID NO: 568526 - DNA, 25 bp, Mus musculus
cagcgtcacgctcaaggtcgccagt

SEQ ID NO: 568527 - DNA, 25 bp, Mus musculus
cagcgtcacgctgaaggtcgccagt

SEQ ID NO: 568528 - DNA, 25 bp, Mus musculus
cagcgtcagcagagcagttgcaaca

SEQ ID NO: 568529 - DNA, 25 bp, Mus musculus
cagcgtcagcagtgcagttgcaaca

SEQ ID NO: 568530 - DNA, 25 bp, Mus musculus
cagcgtcccaatagtctatgagaag

SEQ ID NO: 568531 - DNA, 25 bp, Mus musculus
cagcgtcccaattgtctatgagaag

SEQ ID NO: 568532 - DNA, 25 bp, Mus musculus
cagcgtcccctgctgtgggcgagaa

SEQ ID NO: 568533 - DNA, 25 bp, Mus musculus
cagcgtcccctggtgtgggcgagaa

SEQ ID NO: 568534 - DNA, 25 bp, Mus musculus
cagcgtccctttcgtctggtccaga

SEQ ID NO: 568535 - DNA, 25 bp, Mus musculus
cagcgtccctttggtctggtccaga

SEQ ID NO: 568536 - DNA, 25 bp, Mus musculus
cagcgtccttccatcgcaaggaact

SEQ ID NO: 568537 - DNA, 25 bp, Mus musculus
cagcgtccttccttcgcaaggaact

SEQ ID NO: 568538 - DNA, 25 bp, Mus musculus
cagcgtccttggaacgtgagcaggc

SEQ ID NO: 568539 - DNA, 25 bp, Mus musculus
cagcgtccttggtacgtgagcaggc

SEQ ID NO: 568540 - DNA, 25 bp, Mus musculus
cagcgtcgaagaagggcaagtagcc

SEQ ID NO: 568541 - DNA, 25 bp, Mus musculus
cagcgtcgaagatgggcaagtagcc

SEQ ID NO: 568542 - DNA, 25 bp, Mus musculus
cagcgtcgagtcactgctggaggct

SEQ ID NO: 568543 - DNA, 25 bp, Mus musculus
cagcgtcgagtctctgctggaggct

SEQ ID NO: 568544 - DNA, 25 bp, Mus musculus
cagcgtctcttaaatgacatcagca

SEQ ID NO: 568545 - DNA, 25 bp, Mus musculus
cagcgtctcttatatgacatcagca

SEQ ID NO: 568546 - DNA, 25 bp, Mus musculus
cagcgtctgactcccttcgaggaag

SEQ ID NO: 568547 - DNA, 25 bp, Mus musculus
cagcgtctgactgccttcgaggaag

SEQ ID NO: 568548 - DNA, 25 bp, Mus musculus
cagcgtctgcagagaacatgatgga

SEQ ID NO: 568549 - DNA, 25 bp, Mus musculus
cagcgtctgcagtgaacatgatgga

SEQ ID NO: 568550 - DNA, 25 bp, Mus musculus
cagcgtctgggcactcagaagttct

SEQ ID NO: 568551 - DNA, 25 bp, Mus musculus
cagcgtctgggctctcagaagttct

SEQ ID NO: 568552 - DNA, 25 bp, Mus musculus
cagcgtcttgtgagagatcaaagag

SEQ ID NO: 568553 - DNA, 25 bp, Mus musculus
cagcgtcttgtgtgagatcaaagag

SEQ ID NO: 568554 - DNA, 25 bp, Mus musculus
cagcgtgactgtcgaagaattctgt

SEQ ID NO: 568555 - DNA, 25 bp, Mus musculus
cagcgtgactgtggaagaattctgt

SEQ ID NO: 568556 - DNA, 25 bp, Mus musculus
cagcgtgatcctccgagacattgca

SEQ ID NO: 568557 - DNA, 25 bp, Mus musculus
cagcgtgatcctgcgagacattgca

SEQ ID NO: 568558 - DNA, 25 bp, Mus musculus
cagcgtgcagatcaaggaggaaccc

SEQ ID NO: 568559 - DNA, 25 bp, Mus musculus
cagcgtgcagatgaaggaggaaccc

SEQ ID NO: 568560 - DNA, 25 bp, Mus musculus
cagcgtgcccggcagtatatctaca

SEQ ID NO: 568561 - DNA, 25 bp, Mus musculus
cagcgtgcccgggagtatatctaca

SEQ ID NO: 568562 - DNA, 25 bp, Mus musculus
cagcgtgcccttacaagtgctgacg

SEQ ID NO: 568563 - DNA, 25 bp, Mus musculus
cagcgtgccctttcaagtgctgacg

SEQ ID NO: 568564 - DNA, 25 bp, Mus musculus
cagcgtgccggaagcgctcatgtac

SEQ ID NO: 568565 - DNA, 25 bp, Mus musculus
cagcgtgccggatgcgctcatgtac

SEQ ID NO: 568566 - DNA, 25 bp, Mus musculus
cagcgtgcctaacgactccagtgta

SEQ ID NO: 568567 - DNA, 25 bp, Mus musculus
cagcgtgcctaaggactccagtgta

SEQ ID NO: 568568 - DNA, 25 bp, Mus musculus
cagcgtgcggccagtactggagatc

SEQ ID NO: 568569 - DNA, 25 bp, Mus musculus
cagcgtgcggcctgtactggagatc

SEQ ID NO: 568570 - DNA, 25 bp, Mus musculus
cagcgtgctactagaaggatgggaa

SEQ ID NO: 568571 - DNA, 25 bp, Mus musculus
cagcgtgctacttgaaggatgggaa

SEQ ID NO: 568572 - DNA, 25 bp, Mus musculus
cagcgtgctctactccagctcaggt

SEQ ID NO: 568573 - DNA, 25 bp, Mus musculus
cagcgtgctctagtccagctcaggt

SEQ ID NO: 568574 - DNA, 25 bp, Mus musculus
cagcgtggacctccatgtgtacgag

SEQ ID NO: 568575 - DNA, 25 bp, Mus musculus
cagcgtggacctgcatgtgtacgag

SEQ ID NO: 568576 - DNA, 25 bp, Mus musculus
cagcgtggatggacacacgtgtatt

SEQ ID NO: 568577 - DNA, 25 bp, Mus musculus
cagcgtggatggtcacacgtgtatt

SEQ ID NO: 568578 - DNA, 25 bp, Mus musculus
cagcgtggtatcagagcaactggag

SEQ ID NO: 568579 - DNA, 25 bp, Mus musculus
cagcgtggtatctgagcaactggag

SEQ ID NO: 568580 - DNA, 25 bp, Mus musculus
cagcgtggtggcattctgcccagga

SEQ ID NO: 568581 - DNA, 25 bp, Mus musculus
cagcgtggtggctttctgcccagga

SEQ ID NO: 568582 - DNA, 25 bp, Mus musculus
cagcgtgtaggaataatacctccaa

SEQ ID NO: 568583 - DNA, 25 bp, Mus musculus
cagcgtgtaggattaatacctccaa

SEQ ID NO: 568584 - DNA, 25 bp, Mus musculus
cagcgtgtcatgatgacataccagg

SEQ ID NO: 568585 - DNA, 25 bp, Mus musculus
cagcgtgtcatgttgacataccagg

SEQ ID NO: 568586 - DNA, 25 bp, Mus musculus
cagcgtgtggctccgagggacagca

SEQ ID NO: 568587 - DNA, 25 bp, Mus musculus
cagcgtgtggctgcgagggacagca

SEQ ID NO: 568588 - DNA, 25 bp, Mus musculus
cagcgttcacaccaggaacctcaga

SEQ ID NO: 568589 - DNA, 25 bp, Mus musculus
cagcgttcacacgaggaacctcaga

SEQ ID NO: 568590 - DNA, 25 bp, Mus musculus
cagcgttcatatacagctggagggc

SEQ ID NO: 568591 - DNA, 25 bp, Mus musculus
cagcgttcatattcagctggagggc

SEQ ID NO: 568592 - DNA, 25 bp, Mus musculus
cagcgttcgtgtcctcgggtctgaa

SEQ ID NO: 568593 - DNA, 25 bp, Mus musculus
cagcgttcgtgtgctcgggtctgaa

SEQ ID NO: 568594 - DNA, 25 bp, Mus musculus
cagcgttgccataccatcgagatgg

SEQ ID NO: 568595 - DNA, 25 bp, Mus musculus
cagcgttgccattccatcgagatgg

SEQ ID NO: 568596 - DNA, 25 bp, Mus musculus
cagcgttggcgaagagcctcggaaa

SEQ ID NO: 568597 - DNA, 25 bp, Mus musculus
cagcgttggcgatgagcctcggaaa

SEQ ID NO: 568598 - DNA, 25 bp, Mus musculus
cagcgttggtggcacccaatggatc

SEQ ID NO: 568599 - DNA, 25 bp, Mus musculus
cagcgttggtgggacccaatggatc

SEQ ID NO: 568600 - DNA, 25 bp, Mus musculus
cagcgtttaccacatctttgcggac

SEQ ID NO: 568601 - DNA, 25 bp, Mus musculus
cagcgtttaccagatctttgcggac

SEQ ID NO: 568602 - DNA, 25 bp, Mus musculus
cagcgtttccaaaatcatccagctg

SEQ ID NO: 568603 - DNA, 25 bp, Mus musculus
cagcgtttccaatatcatccagctg

SEQ ID NO: 568604 - DNA, 25 bp, Mus musculus
cagcgtttgcggaggatccccaggc

SEQ ID NO: 568605 - DNA, 25 bp, Mus musculus
cagcgtttgcggtggatccccaggc

SEQ ID NO: 568606 - DNA, 25 bp, Mus musculus
cagcgtttgctgaaagaagaaatat

SEQ ID NO: 568607 - DNA, 25 bp, Mus musculus
cagcgtttgctgtaagaagaaatat

SEQ ID NO: 568608 - DNA, 25 bp, Mus musculus
cagcgtttggagatctggaaatatt

SEQ ID NO: 568609 - DNA, 25 bp, Mus musculus
cagcgtttggagttctggaaatatt

SEQ ID NO: 568610 - DNA, 25 bp, Mus musculus
cagcgtttgggaacacatcgaggtg

SEQ ID NO: 568611 - DNA, 25 bp, Mus musculus
cagcgtttgggatcacatcgaggtg

SEQ ID NO: 568612 - DNA, 25 bp, Mus musculus
cagcgtttgtgtacattgggatgga

SEQ ID NO: 568613 - DNA, 25 bp, Mus musculus
cagcgtttgtgttcattgggatgga

SEQ ID NO: 568614 - DNA, 25 bp, Mus musculus
cagcgttttaacatagtcctctggg

SEQ ID NO: 568615 - DNA, 25 bp, Mus musculus
cagcgttttaacttagtcctctggg

SEQ ID NO: 568616 - DNA, 25 bp, Mus musculus
cagcgttttccaaagagtttgtcat

SEQ ID NO: 568617 - DNA, 25 bp, Mus musculus
cagcgttttccatagagtttgtcat

SEQ ID NO: 568618 - DNA, 25 bp, Mus musculus
cagctaaacacgctgaatattcggt

SEQ ID NO: 568619 - DNA, 25 bp, Mus musculus
cagctaaacacggtgaatattcggt

SEQ ID NO: 568620 - DNA, 25 bp, Mus musculus
cagctaaactgcagccacgagctct

SEQ ID NO: 568621 - DNA, 25 bp, Mus musculus
cagctaaactgctgccacgagctct

SEQ ID NO: 568622 - DNA, 25 bp, Mus musculus
cagctaaagtcaattcgaggaagag

SEQ ID NO: 568623 - DNA, 25 bp, Mus musculus
cagctaaagtcatttcgaggaagag

SEQ ID NO: 568624 - DNA, 25 bp, Mus musculus
cagctaaagtgtataaagaggaaca

SEQ ID NO: 568625 - DNA, 25 bp, Mus musculus
cagctaaagtgtttaaagaggaaca

SEQ ID NO: 568626 - DNA, 25 bp, Mus musculus
cagctaacaaagcatgagcacggcc

SEQ ID NO: 568627 - DNA, 25 bp, Mus musculus
cagctaacaaaggatgagcacggcc

SEQ ID NO: 568628 - DNA, 25 bp, Mus musculus
cagctaacactgagtgcagttcatc

SEQ ID NO: 568629 - DNA, 25 bp, Mus musculus
cagctaacactgtgtgcagttcatc

SEQ ID NO: 568630 - DNA, 25 bp, Mus musculus
cagctaagctttcttaaccctgctg

SEQ ID NO: 568631 - DNA, 25 bp, Mus musculus
cagctaagctttgttaaccctgctg

SEQ ID NO: 568632 - DNA, 25 bp, Mus musculus
cagctaaggagcaccatggaggagc

SEQ ID NO: 568633 - DNA, 25 bp, Mus musculus
cagctaaggagctccatggaggagc

SEQ ID NO: 568634 - DNA, 25 bp, Mus musculus
cagctaaggcgcctacaagaggaga

SEQ ID NO: 568635 - DNA, 25 bp, Mus musculus
cagctaaggcgcgtacaagaggaga

SEQ ID NO: 568636 - DNA, 25 bp, Mus musculus
cagctaatagaacacatcgtgcgtg

SEQ ID NO: 568637 - DNA, 25 bp, Mus musculus
cagctaatagaagacatcgtgcgtg

SEQ ID NO: 568638 - DNA, 25 bp, Mus musculus
cagctaatctgtctgcagacgacga

SEQ ID NO: 568639 - DNA, 25 bp, Mus musculus
cagctaatctgtgtgcagacgacga

SEQ ID NO: 568640 - DNA, 25 bp, Mus musculus
cagctaatgaggacgacagcgaagg

SEQ ID NO: 568641 - DNA, 25 bp, Mus musculus
cagctaatgaggtcgacagcgaagg

SEQ ID NO: 568642 - DNA, 25 bp, Mus musculus
cagctacaagaaataaaggaggttc

SEQ ID NO: 568643 - DNA, 25 bp, Mus musculus
cagctacaagaattaaaggaggttc

SEQ ID NO: 568644 - DNA, 25 bp, Mus musculus
cagctacaagttcgcacggtggacc

SEQ ID NO: 568645 - DNA, 25 bp, Mus musculus
cagctacaagttggcacggtggacc

SEQ ID NO: 568646 - DNA, 25 bp, Mus musculus
cagctacacgtgaggatcacgaaac

SEQ ID NO: 568647 - DNA, 25 bp, Mus musculus
cagctacacgtgtggatcacgaaac

SEQ ID NO: 568648 - DNA, 25 bp, Mus musculus
cagctacactgaaaccaaagatccc

SEQ ID NO: 568649 - DNA, 25 bp, Mus musculus
cagctacactgataccaaagatccc

SEQ ID NO: 568650 - DNA, 25 bp, Mus musculus
cagctacagcacagagggcttgaag

SEQ ID NO: 568651 - DNA, 25 bp, Mus musculus
cagctacagcactgagggcttgaag

SEQ ID NO: 568652 - DNA, 25 bp, Mus musculus
cagctacaggaacagtccgtgtttt

SEQ ID NO: 568653 - DNA, 25 bp, Mus musculus
cagctacaggaagagtccgtgtttt

SEQ ID NO: 568654 - DNA, 25 bp, Mus musculus
cagctacaggttctgcctgctccag

SEQ ID NO: 568655 - DNA, 25 bp, Mus musculus
cagctacaggttgtgcctgctccag

SEQ ID NO: 568656 - DNA, 25 bp, Mus musculus
cagctacatgagcagtacaagatcc

SEQ ID NO: 568657 - DNA, 25 bp, Mus musculus
cagctacatgagctctgggcctgtg

SEQ ID NO: 568658 - DNA, 25 bp, Mus musculus
cagctacatgaggagtacaagatcc

SEQ ID NO: 568659 - DNA, 25 bp, Mus musculus
cagctacatgaggtctgggcctgtg

SEQ ID NO: 568660 - DNA, 25 bp, Mus musculus
cagctaccacctacttaattttcta

SEQ ID NO: 568661 - DNA, 25 bp, Mus musculus
cagctaccaccttcttaattttcta

SEQ ID NO: 568662 - DNA, 25 bp, Mus musculus
cagctaccaggtcaacattccacag

SEQ ID NO: 568663 - DNA, 25 bp, Mus musculus
cagctaccaggtgaacattccacag

SEQ ID NO: 568664 - DNA, 25 bp, Mus musculus
cagctaccggagatggtgagctcag

SEQ ID NO: 568665 - DNA, 25 bp, Mus musculus
cagctaccggagttggtgagctcag

SEQ ID NO: 568666 - DNA, 25 bp, Mus musculus
cagctacctgaaaaagcttccggtg

SEQ ID NO: 568667 - DNA, 25 bp, Mus musculus
cagctacctgaataagcttccggtg

SEQ ID NO: 568668 - DNA, 25 bp, Mus musculus
cagctacctgagcagatgcacagct

SEQ ID NO: 568669 - DNA, 25 bp, Mus musculus
cagctacctgaggagatgcacagct

SEQ ID NO: 568670 - DNA, 25 bp, Mus musculus
cagctacctggtccctgaatcagac

SEQ ID NO: 568671 - DNA, 25 bp, Mus musculus
cagctacctggtgcctgaatcagac

SEQ ID NO: 568672 - DNA, 25 bp, Mus musculus
cagctacgggcaatgtgaagcttgg

SEQ ID NO: 568673 - DNA, 25 bp, Mus musculus
cagctacgggcattgtgaagcttgg

SEQ ID NO: 568674 - DNA, 25 bp, Mus musculus
cagctacgtgaaagggatgaaaatc

SEQ ID NO: 568675 - DNA, 25 bp, Mus musculus
cagctacgtgaatgggatgaaaatc

SEQ ID NO: 568676 - DNA, 25 bp, Mus musculus
cagctactcctcactaaactgtgtt

SEQ ID NO: 568677 - DNA, 25 bp, Mus musculus
cagctactcctctctaaactgtgtt

SEQ ID NO: 568678 - DNA, 25 bp, Mus musculus
cagctactgcagagtatccaaagga

SEQ ID NO: 568679 - DNA, 25 bp, Mus musculus
cagctactgcagtgtatccaaagga

SEQ ID NO: 568680 - DNA, 25 bp, Mus musculus
cagctactggagattgcagagtctc

SEQ ID NO: 568681 - DNA, 25 bp, Mus musculus
cagctactggagtttgcagagtctc

SEQ ID NO: 568682 - DNA, 25 bp, Mus musculus
cagctactgggtcgcaatggtcagt

SEQ ID NO: 568683 - DNA, 25 bp, Mus musculus
cagctactgggtggcaatggtcagt

SEQ ID NO: 568684 - DNA, 25 bp, Mus musculus
cagctactggtgcaacggagacaag

SEQ ID NO: 568685 - DNA, 25 bp, Mus musculus
cagctactggtggaacggagacaag

SEQ ID NO: 568686 - DNA, 25 bp, Mus musculus
cagctactggttctttgtgggcctt

SEQ ID NO: 568687 - DNA, 25 bp, Mus musculus
cagctactggttgtttgtgggcctt

SEQ ID NO: 568688 - DNA, 25 bp, Mus musculus
cagctactgtgacgacgaggtggac

SEQ ID NO: 568689 - DNA, 25 bp, Mus musculus
cagctactgtgaggacgaggtggac

SEQ ID NO: 568690 - DNA, 25 bp, Mus musculus
cagctacttcagctgcaaaccacta

SEQ ID NO: 568691 - DNA, 25 bp, Mus musculus
cagctacttcaggtgcaaaccacta

SEQ ID NO: 568692 - DNA, 25 bp, Mus musculus
cagctacttccgaagagtgtacggt

SEQ ID NO: 568693 - DNA, 25 bp, Mus musculus
cagctacttccgtagagtgtacggt

SEQ ID NO: 568694 - DNA, 25 bp, Mus musculus
cagctagagcgcagctgaggcacta

SEQ ID NO: 568695 - DNA, 25 bp, Mus musculus
cagctagagcgctgctgaggcacta

SEQ ID NO: 568696 - DNA, 25 bp, Mus musculus
cagctagagtggacaaaaactgcca

SEQ ID NO: 568697 - DNA, 25 bp, Mus musculus
cagctagagtggtcaaaaactgcca

SEQ ID NO: 568698 - DNA, 25 bp, Mus musculus
cagctagcaacgctgctgtgttact

SEQ ID NO: 568699 - DNA, 25 bp, Mus musculus
cagctagcaacggtgctgtgttact

SEQ ID NO: 568700 - DNA, 25 bp, Mus musculus
cagctagcaggtctgagaggctttc

SEQ ID NO: 568701 - DNA, 25 bp, Mus musculus
cagctagcaggtgtgagaggctttc

SEQ ID NO: 568702 - DNA, 25 bp, Mus musculus
cagctagccgctaggttagttggtc

SEQ ID NO: 568703 - DNA, 25 bp, Mus musculus
cagctagccgcttggttagttggtc

SEQ ID NO: 568704 - DNA, 25 bp, Mus musculus
cagctagctatccagcgcctgcagg

SEQ ID NO: 568705 - DNA, 25 bp, Mus musculus
cagctagctatcgagcgcctgcagg

SEQ ID NO: 568706 - DNA, 25 bp, Mus musculus
cagctagctgggacaagtttacagg

SEQ ID NO: 568707 - DNA, 25 bp, Mus musculus
cagctagctgggtcaagtttacagg

SEQ ID NO: 568708 - DNA, 25 bp, Mus musculus
cagctaggatagcagaggagatcta

SEQ ID NO: 568709 - DNA, 25 bp, Mus musculus
cagctaggataggagaggagatcta

SEQ ID NO: 568710 - DNA, 25 bp, Mus musculus
cagctagggcatcccctgctggtca

SEQ ID NO: 568711 - DNA, 25 bp, Mus musculus
cagctagggcatgccctgctggtca

SEQ ID NO: 568712 - DNA, 25 bp, Mus musculus
cagctaggtccgacagccaatttat

SEQ ID NO: 568713 - DNA, 25 bp, Mus musculus
cagctaggtccgtcagccaatttat

SEQ ID NO: 568714 - DNA, 25 bp, Mus musculus
cagctaggttctcctttctggtcct

SEQ ID NO: 568715 - DNA, 25 bp, Mus musculus
cagctaggttctgctttctggtcct

SEQ ID NO: 568716 - DNA, 25 bp, Mus musculus
cagctagtaacacaatgctctggtc

SEQ ID NO: 568717 - DNA, 25 bp, Mus musculus
cagctagtaacagaatgctctggtc

SEQ ID NO: 568718 - DNA, 25 bp, Mus musculus
cagctagtcctacgtacatctttac

SEQ ID NO: 568719 - DNA, 25 bp, Mus musculus
cagctagtcctaggtacatctttac

SEQ ID NO: 568720 - DNA, 25 bp, Mus musculus
cagctagtgcgcatgtttctcatga

SEQ ID NO: 568721 - DNA, 25 bp, Mus musculus
cagctagtgcgcttgtttctcatga

SEQ ID NO: 568722 - DNA, 25 bp, Mus musculus
cagctagtgttgagcctttagaaga

SEQ ID NO: 568723 - DNA, 25 bp, Mus musculus
cagctagtgttgtgcctttagaaga

SEQ ID NO: 568724 - DNA, 25 bp, Mus musculus
cagctagttgctcgtgttgcgttca

SEQ ID NO: 568725 - DNA, 25 bp, Mus musculus
cagctagttgctggtgttgcgttca

SEQ ID NO: 568726 - DNA, 25 bp, Mus musculus
cagctataagagagctagacaatct

SEQ ID NO: 568727 - DNA, 25 bp, Mus musculus
cagctataagagtgctagacaatct

SEQ ID NO: 568728 - DNA, 25 bp, Mus musculus
cagctataagctatctgggcagaga

SEQ ID NO: 568729 - DNA, 25 bp, Mus musculus
cagctataagctttctgggcagaga

SEQ ID NO: 568730 - DNA, 25 bp, Mus musculus
cagctataagtgagacaacgggttt

SEQ ID NO: 568731 - DNA, 25 bp, Mus musculus
cagctataagtgtgacaacgggttt

SEQ ID NO: 568732 - DNA, 25 bp, Mus musculus
cagctatcacgaagggcattatccc

SEQ ID NO: 568733 - DNA, 25 bp, Mus musculus
cagctatcacgatgggcattatccc

SEQ ID NO: 568734 - DNA, 25 bp, Mus musculus
cagctatcctggctgagccttagag

SEQ ID NO: 568735 - DNA, 25 bp, Mus musculus
cagctatcctgggtgagccttagag

SEQ ID NO: 568736 - DNA, 25 bp, Mus musculus
cagctatctccgcaacagggcagtt

SEQ ID NO: 568737 - DNA, 25 bp, Mus musculus
cagctatctccggaacagggcagtt

SEQ ID NO: 568738 - DNA, 25 bp, Mus musculus
cagctatgacctcaattgtgacaag

SEQ ID NO: 568739 - DNA, 25 bp, Mus musculus
cagctatgacctgaattgtgacaag

SEQ ID NO: 568740 - DNA, 25 bp, Mus musculus
cagctatgcttaaatcctggaggcc

SEQ ID NO: 568741 - DNA, 25 bp, Mus musculus
cagctatgcttatatcctggaggcc

SEQ ID NO: 568742 - DNA, 25 bp, Mus musculus
cagctatgggaaaaatggccgtgac

SEQ ID NO: 568743 - DNA, 25 bp, Mus musculus
cagctatgggaataatggccgtgac

SEQ ID NO: 568744 - DNA, 25 bp, Mus musculus
cagctatggtacatataagtgtacc

SEQ ID NO: 568745 - DNA, 25 bp, Mus musculus
cagctatggtacttataagtgtacc

SEQ ID NO: 568746 - DNA, 25 bp, Mus musculus
cagctatgtgttagagttcatgtgc

SEQ ID NO: 568747 - DNA, 25 bp, Mus musculus
cagctatgtgtttgagttcatgtgc

SEQ ID NO: 568748 - DNA, 25 bp, Mus musculus
cagctatgttcgcagttcctatgaa

SEQ ID NO: 568749 - DNA, 25 bp, Mus musculus
cagctatgttcggagttcctatgaa

SEQ ID NO: 568750 - DNA, 25 bp, Mus musculus
cagctatgttgaccttctctacatt

SEQ ID NO: 568751 - DNA, 25 bp, Mus musculus
cagctatgttgagcttctctacatt

SEQ ID NO: 568752 - DNA, 25 bp, Mus musculus
cagctattgctcaggagattggtcg

SEQ ID NO: 568753 - DNA, 25 bp, Mus musculus
cagctattgctctggagattggtcg

SEQ ID NO: 568754 - DNA, 25 bp, Mus musculus
cagctatttgaccttggtaactgac

SEQ ID NO: 568755 - DNA, 25 bp, Mus musculus
cagctatttgacgttggtaactgac

SEQ ID NO: 568756 - DNA, 25 bp, Mus musculus
cagctcaaaaggcaggcagatactt

SEQ ID NO: 568757 - DNA, 25 bp, Mus musculus
cagctcaaaagggaggcagatactt

SEQ ID NO: 568758 - DNA, 25 bp, Mus musculus
cagctcaaatggctgtcagtaacac

SEQ ID NO: 568759 - DNA, 25 bp, Mus musculus
cagctcaaatgggtgtcagtaacac

SEQ ID NO: 568760 - DNA, 25 bp, Mus musculus
cagctcaactcgcagagtctcacag

SEQ ID NO: 568761 - DNA, 25 bp, Mus musculus
cagctcaactcggagagtctcacag

SEQ ID NO: 568762 - DNA, 25 bp, Mus musculus
cagctcaagaagatgtgagacttca

SEQ ID NO: 568763 - DNA, 25 bp, Mus musculus
cagctcaagaagttgtgagacttca

SEQ ID NO: 568764 - DNA, 25 bp, Mus musculus
cagctcaaggtcaaccaccagcagt

SEQ ID NO: 568765 - DNA, 25 bp, Mus musculus
cagctcaaggtctaccaccagcagt

SEQ ID NO: 568766 - DNA, 25 bp, Mus musculus
cagctcaatagtcaactctttgttg

SEQ ID NO: 568767 - DNA, 25 bp, Mus musculus
cagctcaatagtgaactctttgttg

SEQ ID NO: 568768 - DNA, 25 bp, Mus musculus
cagctcaatttacaaaagcccaggg

SEQ ID NO: 568769 - DNA, 25 bp, Mus musculus
cagctcaatttagaaaagcccaggg

SEQ ID NO: 568770 - DNA, 25 bp, Mus musculus
cagctcacaggactttctggttccc

SEQ ID NO: 568771 - DNA, 25 bp, Mus musculus
cagctcacaggagtttctggttccc

SEQ ID NO: 568772 - DNA, 25 bp, Mus musculus
cagctcactgctaaactgaacataa

SEQ ID NO: 568773 - DNA, 25 bp, Mus musculus
cagctcactgcttaactgaacataa

SEQ ID NO: 568774 - DNA, 25 bp, Mus musculus
cagctcactggcagaccaacggaaa

SEQ ID NO: 568775 - DNA, 25 bp, Mus musculus
cagctcactggctgaccaacggaaa

SEQ ID NO: 568776 - DNA, 25 bp, Mus musculus
cagctcacttggcttcctccaggaa

SEQ ID NO: 568777 - DNA, 25 bp, Mus musculus
cagctcacttgggttcctccaggaa

SEQ ID NO: 568778 - DNA, 25 bp, Mus musculus
cagctcacttgtatcctgggacagt

SEQ ID NO: 568779 - DNA, 25 bp, Mus musculus
cagctcacttgtttcctgggacagt

SEQ ID NO: 568780 - DNA, 25 bp, Mus musculus
cagctcagaactacgcacacttgac

SEQ ID NO: 568781 - DNA, 25 bp, Mus musculus
cagctcagaacttcgcacacttgac

SEQ ID NO: 568782 - DNA, 25 bp, Mus musculus
cagctcagaggaatcggacaccgag

SEQ ID NO: 568783 - DNA, 25 bp, Mus musculus
cagctcagaggattcggacaccgag

SEQ ID NO: 568784 - DNA, 25 bp, Mus musculus
cagctcagatctccaaagccctggt

SEQ ID NO: 568785 - DNA, 25 bp, Mus musculus
cagctcagatctgcaaagccctggt

SEQ ID NO: 568786 - DNA, 25 bp, Mus musculus
cagctcagcagaagtaaaagcccgg

SEQ ID NO: 568787 - DNA, 25 bp, Mus musculus
cagctcagcagatgtaaaagcccgg

SEQ ID NO: 568788 - DNA, 25 bp, Mus musculus
cagctcagcgttcctctggcgcata

SEQ ID NO: 568789 - DNA, 25 bp, Mus musculus
cagctcagcgttgctctggcgcata

SEQ ID NO: 568790 - DNA, 25 bp, Mus musculus
cagctcagggctcggcaatttgcca

SEQ ID NO: 568791 - DNA, 25 bp, Mus musculus
cagctcagggctgggcaatttgcca

SEQ ID NO: 568792 - DNA, 25 bp, Mus musculus
cagctcaggttgcactgagtcactg

SEQ ID NO: 568793 - DNA, 25 bp, Mus musculus
cagctcaggttggactgagtcactg

SEQ ID NO: 568794 - DNA, 25 bp, Mus musculus
cagctcagtaccagaaggaggtgaa

SEQ ID NO: 568795 - DNA, 25 bp, Mus musculus
cagctcagtacctgaaggaggtgaa

SEQ ID NO: 568796 - DNA, 25 bp, Mus musculus
cagctcagtcaaccccagcttttgg

SEQ ID NO: 568797 - DNA, 25 bp, Mus musculus
cagctcagtcaagcccagcttttgg

SEQ ID NO: 568798 - DNA, 25 bp, Mus musculus
cagctcagtgacagtaacctcgaac

SEQ ID NO: 568799 - DNA, 25 bp, Mus musculus
cagctcagtgactgtaacctcgaac

SEQ ID NO: 568800 - DNA, 25 bp, Mus musculus
cagctcagttggctagcacagcttg

SEQ ID NO: 568801 - DNA, 25 bp, Mus musculus
cagctcagttgggtagcacagcttg

SEQ ID NO: 568802 - DNA, 25 bp, Mus musculus
cagctcatagcccaggacctggatg

SEQ ID NO: 568803 - DNA, 25 bp, Mus musculus
cagctcatagccgaggacctggatg

SEQ ID NO: 568804 - DNA, 25 bp, Mus musculus
cagctcatctcgatttgactgcaac

SEQ ID NO: 568805 - DNA, 25 bp, Mus musculus
cagctcatctcgttttgactgcaac

SEQ ID NO: 568806 - DNA, 25 bp, Mus musculus
cagctcatcttcagactggcgagtt

SEQ ID NO: 568807 - DNA, 25 bp, Mus musculus
cagctcatcttctgactggcgagtt

SEQ ID NO: 568808 - DNA, 25 bp, Mus musculus
cagctcatgcagaacatgctgtccg

SEQ ID NO: 568809 - DNA, 25 bp, Mus musculus
cagctcatgcagtacatgctgtccg

SEQ ID NO: 568810 - DNA, 25 bp, Mus musculus
cagctcatgcgccattactgcctgt

SEQ ID NO: 568811 - DNA, 25 bp, Mus musculus
cagctcatgcgcgattactgcctgt

SEQ ID NO: 568812 - DNA, 25 bp, Mus musculus
cagctcatgctgatgggccttttga

SEQ ID NO: 568813 - DNA, 25 bp, Mus musculus
cagctcatgctgttgggccttttga

SEQ ID NO: 568814 - DNA, 25 bp, Mus musculus
cagctcatggtaagctcctgaggcc

SEQ ID NO: 568815 - DNA, 25 bp, Mus musculus
cagctcatggtatgctcctgaggcc

SEQ ID NO: 568816 - DNA, 25 bp, Mus musculus
cagctcattaagacccagaagtttc

SEQ ID NO: 568817 - DNA, 25 bp, Mus musculus
cagctcattaagtcccagaagtttc

SEQ ID NO: 568818 - DNA, 25 bp, Mus musculus
cagctcattatcattgctgatgaca

SEQ ID NO: 568819 - DNA, 25 bp, Mus musculus
cagctcattatctttgctgatgaca

SEQ ID NO: 568820 - DNA, 25 bp, Mus musculus
cagctcattcagagaacaggtgaag

SEQ ID NO: 568821 - DNA, 25 bp, Mus musculus
cagctcattcagtgaacaggtgaag

SEQ ID NO: 568822 - DNA, 25 bp, Mus musculus
cagctcattcggctgtactgtaaga

SEQ ID NO: 568823 - DNA, 25 bp, Mus musculus
cagctcattcgggtgtactgtaaga

SEQ ID NO: 568824 - DNA, 25 bp, Mus musculus
cagctccacgtccaagtacaaagta

SEQ ID NO: 568825 - DNA, 25 bp, Mus musculus
cagctccacgtcgaagtacaaagta

SEQ ID NO: 568826 - DNA, 25 bp, Mus musculus
cagctccagagcagatgcccgttga

SEQ ID NO: 568827 - DNA, 25 bp, Mus musculus
cagctccagagctgatgcccgttga

SEQ ID NO: 568828 - DNA, 25 bp, Mus musculus
cagctccagcaaccagatactgtgg

SEQ ID NO: 568829 - DNA, 25 bp, Mus musculus
cagctccagcaagcagatactgtgg

SEQ ID NO: 568830 - DNA, 25 bp, Mus musculus
cagctccagccaaggcgggtaagga

SEQ ID NO: 568831 - DNA, 25 bp, Mus musculus
cagctccagccatggcgggtaagga

SEQ ID NO: 568832 - DNA, 25 bp, Mus musculus
cagctccagggacttaactgttctt

SEQ ID NO: 568833 - DNA, 25 bp, Mus musculus
cagctccagggagttaactgttctt

SEQ ID NO: 568834 - DNA, 25 bp, Mus musculus
cagctccatcaaagccaagacgctg

SEQ ID NO: 568835 - DNA, 25 bp, Mus musculus
cagctccatcaatgccaagacgctg

SEQ ID NO: 568836 - DNA, 25 bp, Mus musculus
cagctccatcagagccagtactatg

SEQ ID NO: 568837 - DNA, 25 bp, Mus musculus
cagctccatcagtgccagtactatg

SEQ ID NO: 568838 - DNA, 25 bp, Mus musculus
cagctccatgatctgaggaaagtgg

SEQ ID NO: 568839 - DNA, 25 bp, Mus musculus
cagctccatgatgtgaggaaagtgg

SEQ ID NO: 568840 - DNA, 25 bp, Mus musculus
cagctccatgggaagatctctggtt

SEQ ID NO: 568841 - DNA, 25 bp, Mus musculus
cagctccatgggtagatctctggtt

SEQ ID NO: 568842 - DNA, 25 bp, Mus musculus
cagctccattcgcaacttgaggcca

SEQ ID NO: 568843 - DNA, 25 bp, Mus musculus
cagctccattcggaacttgaggcca

SEQ ID NO: 568844 - DNA, 25 bp, Mus musculus
cagctcccagacctggctttggagg

SEQ ID NO: 568845 - DNA, 25 bp, Mus musculus
cagctcccagacgtggctttggagg

SEQ ID NO: 568846 - DNA, 25 bp, Mus musculus
cagctcccagccctgtgatgggtgc

SEQ ID NO: 568847 - DNA, 25 bp, Mus musculus
cagctcccagccgtgtgatgggtgc

SEQ ID NO: 568848 - DNA, 25 bp, Mus musculus
cagctcccagtcatgtagttacagt

SEQ ID NO: 568849 - DNA, 25 bp, Mus musculus
cagctcccagtcttgtagttacagt

SEQ ID NO: 568850 - DNA, 25 bp, Mus musculus
cagctccccgtgaggagataagtgg

SEQ ID NO: 568851 - DNA, 25 bp, Mus musculus
cagctccccgtgtggagataagtgg

SEQ ID NO: 568852 - DNA, 25 bp, Mus musculus
cagctcccttagcaatgacagcagt

SEQ ID NO: 568853 - DNA, 25 bp, Mus musculus
cagctcccttaggaatgacagcagt

SEQ ID NO: 568854 - DNA, 25 bp, Mus musculus
cagctccgaattacgtatagaaaaa

SEQ ID NO: 568855 - DNA, 25 bp, Mus musculus
cagctccgaatttcgtatagaaaaa

SEQ ID NO: 568856 - DNA, 25 bp, Mus musculus
cagctccgaggcagaaagtgccacg

SEQ ID NO: 568857 - DNA, 25 bp, Mus musculus
cagctccgaggctgaaagtgccacg

SEQ ID NO: 568858 - DNA, 25 bp, Mus musculus
cagctccggaaccaagtggccattt

SEQ ID NO: 568859 - DNA, 25 bp, Mus musculus
cagctccggaacgaagtggccattt

SEQ ID NO: 568860 - DNA, 25 bp, Mus musculus
cagctccggagcaccagaaatggct

SEQ ID NO: 568861 - DNA, 25 bp, Mus musculus
cagctccggagctccagaaatggct

SEQ ID NO: 568862 - DNA, 25 bp, Mus musculus
cagctccgtcccaggactctgatat

SEQ ID NO: 568863 - DNA, 25 bp, Mus musculus
cagctccgtccctggactctgatat

SEQ ID NO: 568864 - DNA, 25 bp, Mus musculus
cagctcctaaaacatgagaatgtgg

SEQ ID NO: 568865 - DNA, 25 bp, Mus musculus
cagctcctaaaagatgagaatgtgg

SEQ ID NO: 568866 - DNA, 25 bp, Mus musculus
cagctcctacagcaatgagccgcag

SEQ ID NO: 568867 - DNA, 25 bp, Mus musculus
cagctcctacaggaatgagccgcag

SEQ ID NO: 568868 - DNA, 25 bp, Mus musculus
cagctcctagagcaggcagtaagca

SEQ ID NO: 568869 - DNA, 25 bp, Mus musculus
cagctcctagaggaggcagtaagca

SEQ ID NO: 568870 - DNA, 25 bp, Mus musculus
cagctcctagtcaaatataaccggc

SEQ ID NO: 568871 - DNA, 25 bp, Mus musculus
cagctcctagtctaatataaccggc

SEQ ID NO: 568872 - DNA, 25 bp, Mus musculus
cagctcctcatcctgttggtggcgg

SEQ ID NO: 568873 - DNA, 25 bp, Mus musculus
cagctcctcatcgtgttggtggcgg

SEQ ID NO: 568874 - DNA, 25 bp, Mus musculus
cagctcctcgagaggtcatgtctac

SEQ ID NO: 568875 - DNA, 25 bp, Mus musculus
cagctcctcgagtggtcatgtctac

SEQ ID NO: 568876 - DNA, 25 bp, Mus musculus
cagctcctgggcatagtgggtatcc

SEQ ID NO: 568877 - DNA, 25 bp, Mus musculus
cagctcctgggcttagtgggtatcc

SEQ ID NO: 568878 - DNA, 25 bp, Mus musculus
cagctcctggttcccagtatggcac

SEQ ID NO: 568879 - DNA, 25 bp, Mus musculus
cagctcctggttgccagtatggcac

SEQ ID NO: 568880 - DNA, 25 bp, Mus musculus
cagctcctttatcccggaaccttgg

SEQ ID NO: 568881 - DNA, 25 bp, Mus musculus
cagctcctttatgccggaaccttgg

SEQ ID NO: 568882 - DNA, 25 bp, Mus musculus
cagctcgaaccacattaagaggtaa

SEQ ID NO: 568883 - DNA, 25 bp, Mus musculus
cagctcgaaccagattaagaggtaa

SEQ ID NO: 568884 - DNA, 25 bp, Mus musculus
cagctcgagagcctgcatctaaaat

SEQ ID NO: 568885 - DNA, 25 bp, Mus musculus
cagctcgagagcgtgcatctaaaat

SEQ ID NO: 568886 - DNA, 25 bp, Mus musculus
cagctcgagcgaccctggccaagat

SEQ ID NO: 568887 - DNA, 25 bp, Mus musculus
cagctcgagcgagcctggccaagat

SEQ ID NO: 568888 - DNA, 25 bp, Mus musculus
cagctcgagtcaacgtgcctgtcat

SEQ ID NO: 568889 - DNA, 25 bp, Mus musculus
cagctcgagtcatcgtgcctgtcat

SEQ ID NO: 568890 - DNA, 25 bp, Mus musculus
cagctcgatatgcaaacgtatccca

SEQ ID NO: 568891 - DNA, 25 bp, Mus musculus
cagctcgatatggaaacgtatccca

SEQ ID NO: 568892 - DNA, 25 bp, Mus musculus
cagctcgcgagtcgaaggaacccca

SEQ ID NO: 568893 - DNA, 25 bp, Mus musculus
cagctcgcgagtggaaggaacccca

SEQ ID NO: 568894 - DNA, 25 bp, Mus musculus
cagctcgctcgaagggctgcttaca

SEQ ID NO: 568895 - DNA, 25 bp, Mus musculus
cagctcgctcgatgggctgcttaca

SEQ ID NO: 568896 - DNA, 25 bp, Mus musculus
cagctcggactgacctttatgaatg

SEQ ID NO: 568897 - DNA, 25 bp, Mus musculus
cagctcggactgtcctttatgaatg

SEQ ID NO: 568898 - DNA, 25 bp, Mus musculus
cagctcggctgcagtgtgacctcga

SEQ ID NO: 568899 - DNA, 25 bp, Mus musculus
cagctcggctgctgtgtgacctcga

SEQ ID NO: 568900 - DNA, 25 bp, Mus musculus
cagctcgtagtaacttggaagaatc

SEQ ID NO: 568901 - DNA, 25 bp, Mus musculus
cagctcgtagtatcttggaagaatc

SEQ ID NO: 568902 - DNA, 25 bp, Mus musculus
cagctctactcacactctgatgacg

SEQ ID NO: 568903 - DNA, 25 bp, Mus musculus
cagctctactcagactctgatgacg

SEQ ID NO: 568904 - DNA, 25 bp, Mus musculus
cagctctatggtcctaccaacgtgg

SEQ ID NO: 568905 - DNA, 25 bp, Mus musculus
cagctctatggtgctaccaacgtgg

SEQ ID NO: 568906 - DNA, 25 bp, Mus musculus
cagctctatgtcagaaccttctttg

SEQ ID NO: 568907 - DNA, 25 bp, Mus musculus
cagctctatgtctgaaccttctttg

SEQ ID NO: 568908 - DNA, 25 bp, Mus musculus
cagctctcaactaccctcaggagga

SEQ ID NO: 568909 - DNA, 25 bp, Mus musculus
cagctctcaacttccctcaggagga

SEQ ID NO: 568910 - DNA, 25 bp, Mus musculus
cagctctccggtcggacaacggatc

SEQ ID NO: 568911 - DNA, 25 bp, Mus musculus
cagctctccggtgggacaacggatc

SEQ ID NO: 568912 - DNA, 25 bp, Mus musculus
cagctctccttcaagctgcaggtca

SEQ ID NO: 568913 - DNA, 25 bp, Mus musculus
cagctctccttctagctgcaggtca

SEQ ID NO: 568914 - DNA, 25 bp, Mus musculus
cagctctctagacgctcatattcgc

SEQ ID NO: 568915 - DNA, 25 bp, Mus musculus
cagctctctagaggctcatattcgc

SEQ ID NO: 568916 - DNA, 25 bp, Mus musculus
cagctctctttgcaaatgaataaag

SEQ ID NO: 568917 - DNA, 25 bp, Mus musculus
cagctctctttggaaatgaataaag

SEQ ID NO: 568918 - DNA, 25 bp, Mus musculus
cagctctgaacaaacgggggaaggc

SEQ ID NO: 568919 - DNA, 25 bp, Mus musculus
cagctctgaacatacgggggaaggc

SEQ ID NO: 568920 - DNA, 25 bp, Mus musculus
cagctctgacatcgcccactgaagg

SEQ ID NO: 568921 - DNA, 25 bp, Mus musculus
cagctctgacatggcccactgaagg

SEQ ID NO: 568922 - DNA, 25 bp, Mus musculus
cagctctgatatacttctcttggga

SEQ ID NO: 568923 - DNA, 25 bp, Mus musculus
cagctctgatattcttctcttggga

SEQ ID NO: 568924 - DNA, 25 bp, Mus musculus
cagctctgcagcataaagaaaatcc

SEQ ID NO: 568925 - DNA, 25 bp, Mus musculus
cagctctgcagcttaaagaaaatcc

SEQ ID NO: 568926 - DNA, 25 bp, Mus musculus
cagctctgccgactgtgtgtccgga

SEQ ID NO: 568927 - DNA, 25 bp, Mus musculus
cagctctgccgagtgtgtgtccgga

SEQ ID NO: 568928 - DNA, 25 bp, Mus musculus
cagctctgcctgaaggtaccgagga

SEQ ID NO: 568929 - DNA, 25 bp, Mus musculus
cagctctgcctgtaggtaccgagga

SEQ ID NO: 568930 - DNA, 25 bp, Mus musculus
cagctctggctacgactcggctata

SEQ ID NO: 568931 - DNA, 25 bp, Mus musculus
cagctctggctaggactcggctata

SEQ ID NO: 568932 - DNA, 25 bp, Mus musculus
cagctctgggagcagtacttattct

SEQ ID NO: 568933 - DNA, 25 bp, Mus musculus
cagctctgggaggagtacttattct

SEQ ID NO: 568934 - DNA, 25 bp, Mus musculus
cagctctggtcactgctctacttct

SEQ ID NO: 568935 - DNA, 25 bp, Mus musculus
cagctctggtcagtgctctacttct

SEQ ID NO: 568936 - DNA, 25 bp, Mus musculus
cagctctgtacaaggaacaatggct

SEQ ID NO: 568937 - DNA, 25 bp, Mus musculus
cagctctgtacatggaacaatggct

SEQ ID NO: 568938 - DNA, 25 bp, Mus musculus
cagctctgtagcactgggcttcaca

SEQ ID NO: 568939 - DNA, 25 bp, Mus musculus
cagctctgtagctctgggcttcaca

SEQ ID NO: 568940 - DNA, 25 bp, Mus musculus
cagctctgtcctcgaggaagagcga

SEQ ID NO: 568941 - DNA, 25 bp, Mus musculus
cagctctgtcctggaggaagagcga

SEQ ID NO: 568942 - DNA, 25 bp, Mus musculus
cagctctgtttgacttgaggacaca

SEQ ID NO: 568943 - DNA, 25 bp, Mus musculus
cagctctgtttgtcttgaggacaca

SEQ ID NO: 568944 - DNA, 25 bp, Mus musculus
cagctcttagtgagccacttttctt

SEQ ID NO: 568945 - DNA, 25 bp, Mus musculus
cagctcttagtgtgccacttttctt

SEQ ID NO: 568946 - DNA, 25 bp, Mus musculus
cagctcttcactcttgtggagtggg

SEQ ID NO: 568947 - DNA, 25 bp, Mus musculus
cagctcttcactgttgtggagtggg

SEQ ID NO: 568948 - DNA, 25 bp, Mus musculus
cagctcttcatcacaaagccaggac

SEQ ID NO: 568949 - DNA, 25 bp, Mus musculus
cagctcttcatctcaaagccaggac

SEQ ID NO: 568950 - DNA, 25 bp, Mus musculus
cagctcttcgataacattcagtctg

SEQ ID NO: 568951 - DNA, 25 bp, Mus musculus
cagctcttcgattacattcagtctg

SEQ ID NO: 568952 - DNA, 25 bp, Mus musculus
cagctcttctcgctgcaaaaggaag

SEQ ID NO: 568953 - DNA, 25 bp, Mus musculus
cagctcttctcggtgcaaaaggaag

SEQ ID NO: 568954 - DNA, 25 bp, Mus musculus
cagctcttgcctacctgctgctatg

SEQ ID NO: 568955 - DNA, 25 bp, Mus musculus
cagctcttgccttcctgctgctatg

SEQ ID NO: 568956 - DNA, 25 bp, Mus musculus
cagctcttggccagtgtcatcgcag

SEQ ID NO: 568957 - DNA, 25 bp, Mus musculus
cagctcttggcctgtgtcatcgcag

SEQ ID NO: 568958 - DNA, 25 bp, Mus musculus
cagctctttaagcagctttacatcg

SEQ ID NO: 568959 - DNA, 25 bp, Mus musculus
cagctctttaaggagctttacatcg

SEQ ID NO: 568960 - DNA, 25 bp, Mus musculus
cagctctttagccagattggacctt

SEQ ID NO: 568961 - DNA, 25 bp, Mus musculus
cagctctttagcgagattggacctt

SEQ ID NO: 568962 - DNA, 25 bp, Mus musculus
cagctgaaaccgaagagggaacagt

SEQ ID NO: 568963 - DNA, 25 bp, Mus musculus
cagctgaaaccgtagagggaacagt

SEQ ID NO: 568964 - DNA, 25 bp, Mus musculus
cagctgaaactacagcgtgccacag

SEQ ID NO: 568965 - DNA, 25 bp, Mus musculus
cagctgaaactagagcgtgccacag

SEQ ID NO: 568966 - DNA, 25 bp, Mus musculus
cagctgaaagacaacagcaacatca

SEQ ID NO: 568967 - DNA, 25 bp, Mus musculus
cagctgaaagactacagcaacatca

SEQ ID NO: 568968 - DNA, 25 bp, Mus musculus
cagctgaaagttaaggacttggttt

SEQ ID NO: 568969 - DNA, 25 bp, Mus musculus
cagctgaaagtttaggacttggttt

SEQ ID NO: 568970 - DNA, 25 bp, Mus musculus
cagctgaagacaattaacctgcaga

SEQ ID NO: 568971 - DNA, 25 bp, Mus musculus
cagctgaagacatttaacctgcaga

SEQ ID NO: 568972 - DNA, 25 bp, Mus musculus
cagctgaaggccattgataatgaag

SEQ ID NO: 568973 - DNA, 25 bp, Mus musculus
cagctgaaggcctttgataatgaag

SEQ ID NO: 568974 - DNA, 25 bp, Mus musculus
cagctgaaggtaccatgtgagaact

SEQ ID NO: 568975 - DNA, 25 bp, Mus musculus
cagctgaaggtagcatgtgagaact

SEQ ID NO: 568976 - DNA, 25 bp, Mus musculus
cagctgaaggtgaccgcgctagcca

SEQ ID NO: 568977 - DNA, 25 bp, Mus musculus
cagctgaaggtgactcctgggtgct

SEQ ID NO: 568978 - DNA, 25 bp, Mus musculus
cagctgaaggtgtccgcgctagcca

SEQ ID NO: 568979 - DNA, 25 bp, Mus musculus
cagctgaaggtgtctcctgggtgct

SEQ ID NO: 568980 - DNA, 25 bp, Mus musculus
cagctgaagtttcgacgtgcatcga

SEQ ID NO: 568981 - DNA, 25 bp, Mus musculus
cagctgaagtttggacgtgcatcga

SEQ ID NO: 568982 - DNA, 25 bp, Mus musculus
cagctgaatgacaaatggcagggtt

SEQ ID NO: 568983 - DNA, 25 bp, Mus musculus
cagctgaatgactaatggcagggtt

SEQ ID NO: 568984 - DNA, 25 bp, Mus musculus
cagctgaatgtgaaagccaggccat

SEQ ID NO: 568985 - DNA, 25 bp, Mus musculus
cagctgaatgtgtaagccaggccat

SEQ ID NO: 568986 - DNA, 25 bp, Mus musculus
cagctgaattcaaaggtgccgtgga

SEQ ID NO: 568987 - DNA, 25 bp, Mus musculus
cagctgaattcataggtgccgtgga

SEQ ID NO: 568988 - DNA, 25 bp, Mus musculus
cagctgacaagtaaccacggacagg

SEQ ID NO: 568989 - DNA, 25 bp, Mus musculus
cagctgacaagttaccacggacagg

SEQ ID NO: 568990 - DNA, 25 bp, Mus musculus
cagctgacacctagatcttcgactt

SEQ ID NO: 568991 - DNA, 25 bp, Mus musculus
cagctgacaccttgatcttcgactt

SEQ ID NO: 568992 - DNA, 25 bp, Mus musculus
cagctgacagagactggcgtcgtca

SEQ ID NO: 568993 - DNA, 25 bp, Mus musculus
cagctgacagagtctggcgtcgtca

SEQ ID NO: 568994 - DNA, 25 bp, Mus musculus
cagctgacagggatgctaatggaga

SEQ ID NO: 568995 - DNA, 25 bp, Mus musculus
cagctgacagggttgctaatggaga

SEQ ID NO: 568996 - DNA, 25 bp, Mus musculus
cagctgacgtgaagagactccacag

SEQ ID NO: 568997 - DNA, 25 bp, Mus musculus
cagctgacgtgatgagactccacag

SEQ ID NO: 568998 - DNA, 25 bp, Mus musculus
cagctgactacgataaggacggcaa

SEQ ID NO: 568999 - DNA, 25 bp, Mus musculus
cagctgactacgttaaggacggcaa

SEQ ID NO: 569000 - DNA, 25 bp, Mus musculus
cagctgactcaaaatgtttgtctca

SEQ ID NO: 569001 - DNA, 25 bp, Mus musculus
cagctgactcaatatgtttgtctca

SEQ ID NO: 569002 - DNA, 25 bp, Mus musculus
cagctgactcagctaacgaccaaga

SEQ ID NO: 569003 - DNA, 25 bp, Mus musculus
cagctgactcaggtaacgaccaaga

SEQ ID NO: 569004 - DNA, 25 bp, Mus musculus
cagctgactccactgcatccatgaa

SEQ ID NO: 569005 - DNA, 25 bp, Mus musculus
cagctgactccagtgcatccatgaa

SEQ ID NO: 569006 - DNA, 25 bp, Mus musculus
cagctgactcctctgcctgtgagca

SEQ ID NO: 569007 - DNA, 25 bp, Mus musculus
cagctgactcctgtgcctgtgagca

SEQ ID NO: 569008 - DNA, 25 bp, Mus musculus
cagctgactctgaaaagccctgcct

SEQ ID NO: 569009 - DNA, 25 bp, Mus musculus
cagctgactctgcttggacatgata

SEQ ID NO: 569010 - DNA, 25 bp, Mus musculus
cagctgactctggttggacatgata

SEQ ID NO: 569011 - DNA, 25 bp, Mus musculus
cagctgactctgtaaagccctgcct

SEQ ID NO: 569012 - DNA, 25 bp, Mus musculus
cagctgagaagaccattggcaccga

SEQ ID NO: 569013 - DNA, 25 bp, Mus musculus
cagctgagaagagcattggcaccga

SEQ ID NO: 569014 - DNA, 25 bp, Mus musculus
cagctgagatcaactgcggactgca

SEQ ID NO: 569015 - DNA, 25 bp, Mus musculus
cagctgagatcatctgcggactgca

SEQ ID NO: 569016 - DNA, 25 bp, Mus musculus
cagctgagatccaaagagcagaagg

SEQ ID NO: 569017 - DNA, 25 bp, Mus musculus
cagctgagatcctaagagcagaagg

SEQ ID NO: 569018 - DNA, 25 bp, Mus musculus
cagctgagattgactccctgtggga

SEQ ID NO: 569019 - DNA, 25 bp, Mus musculus
cagctgagattgtctccctgtggga

SEQ ID NO: 569020 - DNA, 25 bp, Mus musculus
cagctgagcgttctggtggatgaca

SEQ ID NO: 569021 - DNA, 25 bp, Mus musculus
cagctgagcgttgtggtggatgaca

SEQ ID NO: 569022 - DNA, 25 bp, Mus musculus
cagctgagctgaaatgtatacttaa

SEQ ID NO: 569023 - DNA, 25 bp, Mus musculus
cagctgagctgatatgtatacttaa

SEQ ID NO: 569024 - DNA, 25 bp, Mus musculus
cagctgaggaggcaacacatgtgtc

SEQ ID NO: 569025 - DNA, 25 bp, Mus musculus
cagctgaggagggaacacatgtgtc

SEQ ID NO: 569026 - DNA, 25 bp, Mus musculus
cagctgaggattacaacatctatgg

SEQ ID NO: 569027 - DNA, 25 bp, Mus musculus
cagctgaggatttcaacatctatgg

SEQ ID NO: 569028 - DNA, 25 bp, Mus musculus
cagctgaggcacaagagctccaggc

SEQ ID NO: 569029 - DNA, 25 bp, Mus musculus
cagctgaggcactagagctccaggc

SEQ ID NO: 569030 - DNA, 25 bp, Mus musculus
cagctgaggctaataacctggcagc

SEQ ID NO: 569031 - DNA, 25 bp, Mus musculus
cagctgaggctattaacctggcagc

SEQ ID NO: 569032 - DNA, 25 bp, Mus musculus
cagctgaggcttagatgttgctgcc

SEQ ID NO: 569033 - DNA, 25 bp, Mus musculus
cagctgaggctttgatgttgctgcc

SEQ ID NO: 569034 - DNA, 25 bp, Mus musculus
cagctgagtacaagtttagtgattc

SEQ ID NO: 569035 - DNA, 25 bp, Mus musculus
cagctgagtacatgtttagtgattc

SEQ ID NO: 569036 - DNA, 25 bp, Mus musculus
cagctgagttctcggagcccagtga

SEQ ID NO: 569037 - DNA, 25 bp, Mus musculus
cagctgagttctgggagcccagtga

SEQ ID NO: 569038 - DNA, 25 bp, Mus musculus
cagctgatagagaagtgggaagaaa

SEQ ID NO: 569039 - DNA, 25 bp, Mus musculus
cagctgatagagtagtgggaagaaa

SEQ ID NO: 569040 - DNA, 25 bp, Mus musculus
cagctgatcatgcaggcagaagccg

SEQ ID NO: 569041 - DNA, 25 bp, Mus musculus
cagctgatcatggaggcagaagccg

SEQ ID NO: 569042 - DNA, 25 bp, Mus musculus
cagctgatgaaaagttcaactttca

SEQ ID NO: 569043 - DNA, 25 bp, Mus musculus
cagctgatgaaatgttcaactttca

SEQ ID NO: 569044 - DNA, 25 bp, Mus musculus
cagctgatgacaaggtcttggacct

SEQ ID NO: 569045 - DNA, 25 bp, Mus musculus
cagctgatgacatggtcttggacct

SEQ ID NO: 569046 - DNA, 25 bp, Mus musculus
cagctgatgcctactacaaagccaa

SEQ ID NO: 569047 - DNA, 25 bp, Mus musculus
cagctgatgccttctacaaagccaa

SEQ ID NO: 569048 - DNA, 25 bp, Mus musculus
cagctgatggagagctggtgaccct

SEQ ID NO: 569049 - DNA, 25 bp, Mus musculus
cagctgatggagtgctggtgaccct

SEQ ID NO: 569050 - DNA, 25 bp, Mus musculus
cagctgattctgatccggaaaaaga

SEQ ID NO: 569051 - DNA, 25 bp, Mus musculus
cagctgattctgttccggaaaaaga

SEQ ID NO: 569052 - DNA, 25 bp, Mus musculus
cagctgcaagacatgggcctcattg

SEQ ID NO: 569053 - DNA, 25 bp, Mus musculus
cagctgcaagacttgggcctcattg

SEQ ID NO: 569054 - DNA, 25 bp, Mus musculus
cagctgcacatgcagcgggtcattg

SEQ ID NO: 569055 - DNA, 25 bp, Mus musculus
cagctgcacatggagcgggtcattg

SEQ ID NO: 569056 - DNA, 25 bp, Mus musculus
cagctgcaccggcttctgactcagt

SEQ ID NO: 569057 - DNA, 25 bp, Mus musculus
cagctgcaccgggttctgactcagt

SEQ ID NO: 569058 - DNA, 25 bp, Mus musculus
cagctgcacctgcagtaccgctttt

SEQ ID NO: 569059 - DNA, 25 bp, Mus musculus
cagctgcacctggagtaccgctttt

SEQ ID NO: 569060 - DNA, 25 bp, Mus musculus
cagctgcagcctcaagatttttaac

SEQ ID NO: 569061 - DNA, 25 bp, Mus musculus
cagctgcagcctgaagatttttaac

SEQ ID NO: 569062 - DNA, 25 bp, Mus musculus
cagctgcagcgccagttcaacaagc

SEQ ID NO: 569063 - DNA, 25 bp, Mus musculus
cagctgcagcgcgagttcaacaagc

SEQ ID NO: 569064 - DNA, 25 bp, Mus musculus
cagctgcagcttatgagctttggga

SEQ ID NO: 569065 - DNA, 25 bp, Mus musculus
cagctgcagcttttgagctttggga

SEQ ID NO: 569066 - DNA, 25 bp, Mus musculus
cagctgcagttcacttcagagcaca

SEQ ID NO: 569067 - DNA, 25 bp, Mus musculus
cagctgcagttctcttcagagcaca

SEQ ID NO: 569068 - DNA, 25 bp, Mus musculus
cagctgcatctgatgggaccactaa

SEQ ID NO: 569069 - DNA, 25 bp, Mus musculus
cagctgcatctgttgggaccactaa

SEQ ID NO: 569070 - DNA, 25 bp, Mus musculus
cagctgcatgaaccccacagggact

SEQ ID NO: 569071 - DNA, 25 bp, Mus musculus
cagctgcatgaagcccacagggact

SEQ ID NO: 569072 - DNA, 25 bp, Mus musculus
cagctgcatgtgatgccctggacca

SEQ ID NO: 569073 - DNA, 25 bp, Mus musculus
cagctgcatgtgttgccctggacca

SEQ ID NO: 569074 - DNA, 25 bp, Mus musculus
cagctgccaacaaagatgaagtgca

SEQ ID NO: 569075 - DNA, 25 bp, Mus musculus
cagctgccaacatagatgaagtgca

SEQ ID NO: 569076 - DNA, 25 bp, Mus musculus
cagctgccacctatggggagatcag

SEQ ID NO: 569077 - DNA, 25 bp, Mus musculus
cagctgccacctttggggagatcag

SEQ ID NO: 569078 - DNA, 25 bp, Mus musculus
cagctgccagagctgttccacaaga

SEQ ID NO: 569079 - DNA, 25 bp, Mus musculus
cagctgccagaggtgttccacaaga

SEQ ID NO: 569080 - DNA, 25 bp, Mus musculus
cagctgccagttagtgggttggaac

SEQ ID NO: 569081 - DNA, 25 bp, Mus musculus
cagctgccagtttgtgggttggaac

SEQ ID NO: 569082 - DNA, 25 bp, Mus musculus
cagctgcccactccctgtctgagcc

SEQ ID NO: 569083 - DNA, 25 bp, Mus musculus
cagctgcccactgcctgtctgagcc

SEQ ID NO: 569084 - DNA, 25 bp, Mus musculus
cagctgccccgaatcactgagagat

SEQ ID NO: 569085 - DNA, 25 bp, Mus musculus
cagctgccccgattcactgagagat

SEQ ID NO: 569086 - DNA, 25 bp, Mus musculus
cagctgcccggacaagtcagtgatc

SEQ ID NO: 569087 - DNA, 25 bp, Mus musculus
cagctgcccggagaagtcagtgatc

SEQ ID NO: 569088 - DNA, 25 bp, Mus musculus
cagctgcccgggagaaacatgaggc

SEQ ID NO: 569089 - DNA, 25 bp, Mus musculus
cagctgcccgggtgaaacatgaggc

SEQ ID NO: 569090 - DNA, 25 bp, Mus musculus
cagctgcctaaaaacacctctcaaa

SEQ ID NO: 569091 - DNA, 25 bp, Mus musculus
cagctgcctaaatacacctctcaaa

SEQ ID NO: 569092 - DNA, 25 bp, Mus musculus
cagctgcctggacccattcgggagt

SEQ ID NO: 569093 - DNA, 25 bp, Mus musculus
cagctgcctggagccattcgggagt

SEQ ID NO: 569094 - DNA, 25 bp, Mus musculus
cagctgcgacgtactgtcactgaag

SEQ ID NO: 569095 - DNA, 25 bp, Mus musculus
cagctgcgacgttctgtcactgaag

SEQ ID NO: 569096 - DNA, 25 bp, Mus musculus
cagctgcgagccatcatgaggcgtg

SEQ ID NO: 569097 - DNA, 25 bp, Mus musculus
cagctgcgagccttcatgaggcgtg

SEQ ID NO: 569098 - DNA, 25 bp, Mus musculus
cagctgcgcagactgtatgaaacct

SEQ ID NO: 569099 - DNA, 25 bp, Mus musculus
cagctgcgcagagtgtatgaaacct

SEQ ID NO: 569100 - DNA, 25 bp, Mus musculus
cagctgcgcgacctcatggacaact

SEQ ID NO: 569101 - DNA, 25 bp, Mus musculus
cagctgcgcgacgtcatggacaact

SEQ ID NO: 569102 - DNA, 25 bp, Mus musculus
cagctgcgcttgcaaggaacttaac

SEQ ID NO: 569103 - DNA, 25 bp, Mus musculus
cagctgcgcttggaaggaacttaac

SEQ ID NO: 569104 - DNA, 25 bp, Mus musculus
cagctgcggcggactatggagaaca

SEQ ID NO: 569105 - DNA, 25 bp, Mus musculus
cagctgcggcggtctatggagaaca

SEQ ID NO: 569106 - DNA, 25 bp, Mus musculus
cagctgcggtttacgccttatgcct

SEQ ID NO: 569107 - DNA, 25 bp, Mus musculus
cagctgcggttttcgccttatgcct

SEQ ID NO: 569108 - DNA, 25 bp, Mus musculus
cagctgcgtatcagtgatcacaaac

SEQ ID NO: 569109 - DNA, 25 bp, Mus musculus
cagctgcgtatctgtgatcacaaac

SEQ ID NO: 569110 - DNA, 25 bp, Mus musculus
cagctgcgtcggaggaatgaacaga

SEQ ID NO: 569111 - DNA, 25 bp, Mus musculus
cagctgcgtcggtggaatgaacaga

SEQ ID NO: 569112 - DNA, 25 bp, Mus musculus
cagctgcgtgcacaaatgctactgc

SEQ ID NO: 569113 - DNA, 25 bp, Mus musculus
cagctgcgtgcagaaatgctactgc

SEQ ID NO: 569114 - DNA, 25 bp, Mus musculus
cagctgcgtgggaggactgttccca

SEQ ID NO: 569115 - DNA, 25 bp, Mus musculus
cagctgcgtgggtggactgttccca

SEQ ID NO: 569116 - DNA, 25 bp, Mus musculus
cagctgctaagcacaaggaacgatt

SEQ ID NO: 569117 - DNA, 25 bp, Mus musculus
cagctgctaagctcaaggaacgatt

SEQ ID NO: 569118 - DNA, 25 bp, Mus musculus
cagctgctaccgatctgggtgtgaa

SEQ ID NO: 569119 - DNA, 25 bp, Mus musculus
cagctgctaccgttctgggtgtgaa

SEQ ID NO: 569120 - DNA, 25 bp, Mus musculus
cagctgctacctagaggagacactc

SEQ ID NO: 569121 - DNA, 25 bp, Mus musculus
cagctgctaccttgaggagacactc

SEQ ID NO: 569122 - DNA, 25 bp, Mus musculus
cagctgctacttagacatcgagtgg

SEQ ID NO: 569123 - DNA, 25 bp, Mus musculus
cagctgctactttgacatcgagtgg

SEQ ID NO: 569124 - DNA, 25 bp, Mus musculus
cagctgctagatctcctggaccgtg

SEQ ID NO: 569125 - DNA, 25 bp, Mus musculus
cagctgctagatgtcctggaccgtg

SEQ ID NO: 569126 - DNA, 25 bp, Mus musculus
cagctgctcagacagtgtcgagtac

SEQ ID NO: 569127 - DNA, 25 bp, Mus musculus
cagctgctcagagagtgtcgagtac

SEQ ID NO: 569128 - DNA, 25 bp, Mus musculus
cagctgctcagtacggggctcacga

SEQ ID NO: 569129 - DNA, 25 bp, Mus musculus
cagctgctcagttcggggctcacga

SEQ ID NO: 569130 - DNA, 25 bp, Mus musculus
cagctgctccctcgagacgagttct

SEQ ID NO: 569131 - DNA, 25 bp, Mus musculus
cagctgctccctggagacgagttct

SEQ ID NO: 569132 - DNA, 25 bp, Mus musculus
cagctgctctgccagaatggcggca

SEQ ID NO: 569133 - DNA, 25 bp, Mus musculus
cagctgctctgcgagaatggcggca

SEQ ID NO: 569134 - DNA, 25 bp, Mus musculus
cagctgctgaatcacaggccgatga

SEQ ID NO: 569135 - DNA, 25 bp, Mus musculus
cagctgctgaatgacaggccgatga

SEQ ID NO: 569136 - DNA, 25 bp, Mus musculus
cagctgctgatgagcttgtgtcaca

SEQ ID NO: 569137 - DNA, 25 bp, Mus musculus
cagctgctgatgtgcttgtgtcaca

SEQ ID NO: 569138 - DNA, 25 bp, Mus musculus
cagctgctgcaaccgcagtatcaca

SEQ ID NO: 569139 - DNA, 25 bp, Mus musculus
cagctgctgcaagcgcagtatcaca

SEQ ID NO: 569140 - DNA, 25 bp, Mus musculus
cagctgctgcataagctgctatgaa

SEQ ID NO: 569141 - DNA, 25 bp, Mus musculus
cagctgctgcattagctgctatgaa

SEQ ID NO: 569142 - DNA, 25 bp, Mus musculus
cagctgctgcgacgactgtcttaca

SEQ ID NO: 569143 - DNA, 25 bp, Mus musculus
cagctgctgcgaggactgtcttaca

SEQ ID NO: 569144 - DNA, 25 bp, Mus musculus
cagctgctgctacagtccctcggag

SEQ ID NO: 569145 - DNA, 25 bp, Mus musculus
cagctgctgctagagtccctcggag

SEQ ID NO: 569146 - DNA, 25 bp, Mus musculus
cagctgctgtcacggctgcatattg

SEQ ID NO: 569147 - DNA, 25 bp, Mus musculus
cagctgctgtcagggctgcatattg

SEQ ID NO: 569148 - DNA, 25 bp, Mus musculus
cagctgctgtccaattccgaatgtc

SEQ ID NO: 569149 - DNA, 25 bp, Mus musculus
cagctgctgtcctattccgaatgtc

SEQ ID NO: 569150 - DNA, 25 bp, Mus musculus
cagctgctgtctaaggcctgtgtgc

SEQ ID NO: 569151 - DNA, 25 bp, Mus musculus
cagctgctgtcttaggcctgtgtgc

SEQ ID NO: 569152 - DNA, 25 bp, Mus musculus
cagctgctgtggagaaactggaaga

SEQ ID NO: 569153 - DNA, 25 bp, Mus musculus
cagctgctgtggcacgttcatccaa

SEQ ID NO: 569154 - DNA, 25 bp, Mus musculus
cagctgctgtgggacgttcatccaa

SEQ ID NO: 569155 - DNA, 25 bp, Mus musculus
cagctgctgtggtgaaactggaaga

SEQ ID NO: 569156 - DNA, 25 bp, Mus musculus
cagctgcttagaaaacatgccgtca

SEQ ID NO: 569157 - DNA, 25 bp, Mus musculus
cagctgcttagataacatgccgtca

SEQ ID NO: 569158 - DNA, 25 bp, Mus musculus
cagctgcttgacatcgaaaggaccc

SEQ ID NO: 569159 - DNA, 25 bp, Mus musculus
cagctgcttgacttcgaaaggaccc

SEQ ID NO: 569160 - DNA, 25 bp, Mus musculus
cagctgcttgggaaaagtctgcaag

SEQ ID NO: 569161 - DNA, 25 bp, Mus musculus
cagctgcttgggtaaagtctgcaag

SEQ ID NO: 569162 - DNA, 25 bp, Mus musculus
cagctggaaactaatctaaagagaa

SEQ ID NO: 569163 - DNA, 25 bp, Mus musculus
cagctggaaacttatctaaagagaa

SEQ ID NO: 569164 - DNA, 25 bp, Mus musculus
cagctggaacagctatatatacgtg

SEQ ID NO: 569165 - DNA, 25 bp, Mus musculus
cagctggaacaggtatatatacgtg

SEQ ID NO: 569166 - DNA, 25 bp, Mus musculus
cagctggaagtcatgctgacgccat

SEQ ID NO: 569167 - DNA, 25 bp, Mus musculus
cagctggaagtcttgctgacgccat

SEQ ID NO: 569168 - DNA, 25 bp, Mus musculus
cagctggaatgacaaagcaggtcag

SEQ ID NO: 569169 - DNA, 25 bp, Mus musculus
cagctggaatgagaaagcaggtcag

SEQ ID NO: 569170 - DNA, 25 bp, Mus musculus
cagctggacagcatgataagggtgc

SEQ ID NO: 569171 - DNA, 25 bp, Mus musculus
cagctggacagcttgataagggtgc

SEQ ID NO: 569172 - DNA, 25 bp, Mus musculus
cagctggactgacccgtcgctgtcg

SEQ ID NO: 569173 - DNA, 25 bp, Mus musculus
cagctggactgagccgtcgctgtcg

SEQ ID NO: 569174 - DNA, 25 bp, Mus musculus
cagctggagagtacctacacaaaaa

SEQ ID NO: 569175 - DNA, 25 bp, Mus musculus
cagctggagagttcctacacaaaaa

SEQ ID NO: 569176 - DNA, 25 bp, Mus musculus
cagctggatctaagctgagagaaat

SEQ ID NO: 569177 - DNA, 25 bp, Mus musculus
cagctggatctatgctgagagaaat

SEQ ID NO: 569178 - DNA, 25 bp, Mus musculus
cagctggatgaaagggagcacacca

SEQ ID NO: 569179 - DNA, 25 bp, Mus musculus
cagctggatgaatgggagcacacca

SEQ ID NO: 569180 - DNA, 25 bp, Mus musculus
cagctggatgagctccgccaggtca

SEQ ID NO: 569181 - DNA, 25 bp, Mus musculus
cagctggatgaggtccgccaggtca

SEQ ID NO: 569182 - DNA, 25 bp, Mus musculus
cagctggatggtctacgtgcactac

SEQ ID NO: 569183 - DNA, 25 bp, Mus musculus
cagctggatggtgtacgtgcactac

SEQ ID NO: 569184 - DNA, 25 bp, Mus musculus
cagctggcacgcagggtttacaggc

SEQ ID NO: 569185 - DNA, 25 bp, Mus musculus
cagctggcacgctgggtttacaggc

SEQ ID NO: 569186 - DNA, 25 bp, Mus musculus
cagctggcagaaattgattttcggc

SEQ ID NO: 569187 - DNA, 25 bp, Mus musculus
cagctggcagaatttgattttcggc

SEQ ID NO: 569188 - DNA, 25 bp, Mus musculus
cagctggcagagaactcctttgcca

SEQ ID NO: 569189 - DNA, 25 bp, Mus musculus
cagctggcagagtactcctttgcca

SEQ ID NO: 569190 - DNA, 25 bp, Mus musculus
cagctggcagggagaacagcgacaa

SEQ ID NO: 569191 - DNA, 25 bp, Mus musculus
cagctggcagggtgaacagcgacaa

SEQ ID NO: 569192 - DNA, 25 bp, Mus musculus
cagctggcctggattgatactgacc

SEQ ID NO: 569193 - DNA, 25 bp, Mus musculus
cagctggcctggtttgatactgacc

SEQ ID NO: 569194 - DNA, 25 bp, Mus musculus
cagctggccttcatgcgagtgtact

SEQ ID NO: 569195 - DNA, 25 bp, Mus musculus
cagctggccttcttgcgagtgtact

SEQ ID NO: 569196 - DNA, 25 bp, Mus musculus
cagctggcggaactcacccgtgaag

SEQ ID NO: 569197 - DNA, 25 bp, Mus musculus
cagctggcggaagtcacccgtgaag

SEQ ID NO: 569198 - DNA, 25 bp, Mus musculus
cagctggctagacgcatggagtact

SEQ ID NO: 569199 - DNA, 25 bp, Mus musculus
cagctggctagaggcatggagtact

SEQ ID NO: 569200 - DNA, 25 bp, Mus musculus
cagctggctcatcagctgggactcc

SEQ ID NO: 569201 - DNA, 25 bp, Mus musculus
cagctggctcatgagctgggactcc

SEQ ID NO: 569202 - DNA, 25 bp, Mus musculus
cagctggctggacagttatctgaga

SEQ ID NO: 569203 - DNA, 25 bp, Mus musculus
cagctggctggagagttatctgaga

SEQ ID NO: 569204 - DNA, 25 bp, Mus musculus
cagctggcttctactccggtgacag

SEQ ID NO: 569205 - DNA, 25 bp, Mus musculus
cagctggcttcttctccggtgacag

SEQ ID NO: 569206 - DNA, 25 bp, Mus musculus
cagctggctttacctattcagccca

SEQ ID NO: 569207 - DNA, 25 bp, Mus musculus
cagctggctttagctattcagccca

SEQ ID NO: 569208 - DNA, 25 bp, Mus musculus
cagctgggaaccatagtggataact

SEQ ID NO: 569209 - DNA, 25 bp, Mus musculus
cagctgggaaccttagtggataact

SEQ ID NO: 569210 - DNA, 25 bp, Mus musculus
cagctgggaagcacaccgtctgtat

SEQ ID NO: 569211 - DNA, 25 bp, Mus musculus
cagctgggaagctcaccgtctgtat

SEQ ID NO: 569212 - DNA, 25 bp, Mus musculus
cagctgggagatcctggtacttgtt

SEQ ID NO: 569213 - DNA, 25 bp, Mus musculus
cagctgggagatgctggtacttgtt

SEQ ID NO: 569214 - DNA, 25 bp, Mus musculus
cagctgggagtcaagacactggcta

SEQ ID NO: 569215 - DNA, 25 bp, Mus musculus
cagctgggagtctagacactggcta

SEQ ID NO: 569216 - DNA, 25 bp, Mus musculus
cagctgggatctacctaacttggag

SEQ ID NO: 569217 - DNA, 25 bp, Mus musculus
cagctgggatcttcctaacttggag

SEQ ID NO: 569218 - DNA, 25 bp, Mus musculus
cagctgggcacaagatgaggtctac

SEQ ID NO: 569219 - DNA, 25 bp, Mus musculus
cagctgggcacatgatgaggtctac

SEQ ID NO: 569220 - DNA, 25 bp, Mus musculus
cagctgggcagcagtcagtcacaga

SEQ ID NO: 569221 - DNA, 25 bp, Mus musculus
cagctgggcagctgtcagtcacaga

SEQ ID NO: 569222 - DNA, 25 bp, Mus musculus
cagctgggcatccttgttgggattc

SEQ ID NO: 569223 - DNA, 25 bp, Mus musculus
cagctgggcatcgttgttgggattc

SEQ ID NO: 569224 - DNA, 25 bp, Mus musculus
cagctgggccggatttgtgcacccc

SEQ ID NO: 569225 - DNA, 25 bp, Mus musculus
cagctgggccggttttgtgcacccc

SEQ ID NO: 569226 - DNA, 25 bp, Mus musculus
cagctgggcctgcagtcattggccc

SEQ ID NO: 569227 - DNA, 25 bp, Mus musculus
cagctgggcctggagtcattggccc

SEQ ID NO: 569228 - DNA, 25 bp, Mus musculus
cagctgggctatcatttggtgtctc

SEQ ID NO: 569229 - DNA, 25 bp, Mus musculus
cagctgggctatgatttggtgtctc

SEQ ID NO: 569230 - DNA, 25 bp, Mus musculus
cagctgggctgtcatcactccagct

SEQ ID NO: 569231 - DNA, 25 bp, Mus musculus
cagctgggctgtgatcactccagct

SEQ ID NO: 569232 - DNA, 25 bp, Mus musculus
cagctgggctttacttaaagatgag

SEQ ID NO: 569233 - DNA, 25 bp, Mus musculus
cagctgggcttttcttaaagatgag

SEQ ID NO: 569234 - DNA, 25 bp, Mus musculus
cagctggggacaactttcttcaaat

SEQ ID NO: 569235 - DNA, 25 bp, Mus musculus
cagctggggacatctttcttcaaat

SEQ ID NO: 569236 - DNA, 25 bp, Mus musculus
cagctggggcagctactccacagtt

SEQ ID NO: 569237 - DNA, 25 bp, Mus musculus
cagctggggcaggtactccacagtt

SEQ ID NO: 569238 - DNA, 25 bp, Mus musculus
cagctgggtacacctgctcagagca

SEQ ID NO: 569239 - DNA, 25 bp, Mus musculus
cagctgggtacagctgctcagagca

SEQ ID NO: 569240 - DNA, 25 bp, Mus musculus
cagctggtagagaagttgggtcaac

SEQ ID NO: 569241 - DNA, 25 bp, Mus musculus
cagctggtagagtagttgggtcaac

SEQ ID NO: 569242 - DNA, 25 bp, Mus musculus
cagctggtagctccatttgacaaga

SEQ ID NO: 569243 - DNA, 25 bp, Mus musculus
cagctggtagctgcatttgacaaga

SEQ ID NO: 569244 - DNA, 25 bp, Mus musculus
cagctggtatctcgaagataacatc

SEQ ID NO: 569245 - DNA, 25 bp, Mus musculus
cagctggtatctggaagataacatc

SEQ ID NO: 569246 - DNA, 25 bp, Mus musculus
cagctggtatggcaccagcgccatt

SEQ ID NO: 569247 - DNA, 25 bp, Mus musculus
cagctggtatgggaccagcgccatt

SEQ ID NO: 569248 - DNA, 25 bp, Mus musculus
cagctggtcacacagaagttccgtg

SEQ ID NO: 569249 - DNA, 25 bp, Mus musculus
cagctggtcacagagaagttccgtg

SEQ ID NO: 569250 - DNA, 25 bp, Mus musculus
cagctggtcagcctgggcatttttg

SEQ ID NO: 569251 - DNA, 25 bp, Mus musculus
cagctggtcagcgtgggcatttttg

SEQ ID NO: 569252 - DNA, 25 bp, Mus musculus
cagctggtcctccaggccaatggaa

SEQ ID NO: 569253 - DNA, 25 bp, Mus musculus
cagctggtcctcgaggccaatggaa

SEQ ID NO: 569254 - DNA, 25 bp, Mus musculus
cagctggtgaataagtcagtcagcc

SEQ ID NO: 569255 - DNA, 25 bp, Mus musculus
cagctggtgaattagtcagtcagcc

SEQ ID NO: 569256 - DNA, 25 bp, Mus musculus
cagctggtgacacgacgcacatgga

SEQ ID NO: 569257 - DNA, 25 bp, Mus musculus
cagctggtgacaggacgcacatgga

SEQ ID NO: 569258 - DNA, 25 bp, Mus musculus
cagctggtgagcagcggctacgact

SEQ ID NO: 569259 - DNA, 25 bp, Mus musculus
cagctggtgagctgcggctacgact

SEQ ID NO: 569260 - DNA, 25 bp, Mus musculus
cagctggtgagtatacataatttca

SEQ ID NO: 569261 - DNA, 25 bp, Mus musculus
cagctggtgagtttacataatttca

SEQ ID NO: 569262 - DNA, 25 bp, Mus musculus
cagctggtggacacggcacggacac

SEQ ID NO: 569263 - DNA, 25 bp, Mus musculus
cagctggtggactcggcacggacac

SEQ ID NO: 569264 - DNA, 25 bp, Mus musculus
cagctggttgtaaacattgcgatcc

SEQ ID NO: 569265 - DNA, 25 bp, Mus musculus
cagctggttgtatacattgcgatcc

SEQ ID NO: 569266 - DNA, 25 bp, Mus musculus
cagctgtaaccaagcctcagcaggg

SEQ ID NO: 569267 - DNA, 25 bp, Mus musculus
cagctgtaaccatgcctcagcaggg

SEQ ID NO: 569268 - DNA, 25 bp, Mus musculus
cagctgtaccctcagaactcggagc

SEQ ID NO: 569269 - DNA, 25 bp, Mus musculus
cagctgtaccctgagaactcggagc

SEQ ID NO: 569270 - DNA, 25 bp, Mus musculus
cagctgtactgcaggactggatttc

SEQ ID NO: 569271 - DNA, 25 bp, Mus musculus
cagctgtactgctggactggatttc

SEQ ID NO: 569272 - DNA, 25 bp, Mus musculus
cagctgtagtcaatgcattttattc

SEQ ID NO: 569273 - DNA, 25 bp, Mus musculus
cagctgtagtcattgcattttattc

SEQ ID NO: 569274 - DNA, 25 bp, Mus musculus
cagctgtcagatcataaggtcatca

SEQ ID NO: 569275 - DNA, 25 bp, Mus musculus
cagctgtcagatgataaggtcatca

SEQ ID NO: 569276 - DNA, 25 bp, Mus musculus
cagctgtcagtcacaaagcctctgg

SEQ ID NO: 569277 - DNA, 25 bp, Mus musculus
cagctgtcagtcacagaggtggcaa

SEQ ID NO: 569278 - DNA, 25 bp, Mus musculus
cagctgtcagtctcaaagcctctgg

SEQ ID NO: 569279 - DNA, 25 bp, Mus musculus
cagctgtcagtctcagaggtggcaa

SEQ ID NO: 569280 - DNA, 25 bp, Mus musculus
cagctgtcatatcatgaggttgtga

SEQ ID NO: 569281 - DNA, 25 bp, Mus musculus
cagctgtcatatgatgaggttgtga

SEQ ID NO: 569282 - DNA, 25 bp, Mus musculus
cagctgtccaccatcgggcgttgtg

SEQ ID NO: 569283 - DNA, 25 bp, Mus musculus
cagctgtccaccttcgggcgttgtg

SEQ ID NO: 569284 - DNA, 25 bp, Mus musculus
cagctgtccagcatgagcacccttg

SEQ ID NO: 569285 - DNA, 25 bp, Mus musculus
cagctgtccagcttgagcacccttg

SEQ ID NO: 569286 - DNA, 25 bp, Mus musculus
cagctgtcccagctgcagtgcctga

SEQ ID NO: 569287 - DNA, 25 bp, Mus musculus
cagctgtcccaggtgcagtgcctga

SEQ ID NO: 569288 - DNA, 25 bp, Mus musculus
cagctgtccgtaaatcttcaactaa

SEQ ID NO: 569289 - DNA, 25 bp, Mus musculus
cagctgtccgtatatcttcaactaa

SEQ ID NO: 569290 - DNA, 25 bp, Mus musculus
cagctgtcctacaatgcgggagccc

SEQ ID NO: 569291 - DNA, 25 bp, Mus musculus
cagctgtcctactatgcgggagccc

SEQ ID NO: 569292 - DNA, 25 bp, Mus musculus
cagctgtcgggtaaaaaattctatg

SEQ ID NO: 569293 - DNA, 25 bp, Mus musculus
cagctgtcgggttaaaaattctatg

SEQ ID NO: 569294 - DNA, 25 bp, Mus musculus
cagctgtctctcatcagtggctgtg

SEQ ID NO: 569295 - DNA, 25 bp, Mus musculus
cagctgtctctcttcagtggctgtg

SEQ ID NO: 569296 - DNA, 25 bp, Mus musculus
cagctgtctgaaaggaatctgatga

SEQ ID NO: 569297 - DNA, 25 bp, Mus musculus
cagctgtctgaatggaatctgatga

SEQ ID NO: 569298 - DNA, 25 bp, Mus musculus
cagctgtgaaggaaactaagtgagg

SEQ ID NO: 569299 - DNA, 25 bp, Mus musculus
cagctgtgaaggtaactaagtgagg

SEQ ID NO: 569300 - DNA, 25 bp, Mus musculus
cagctgtgacacatgggcctggaga

SEQ ID NO: 569301 - DNA, 25 bp, Mus musculus
cagctgtgacacttgggcctggaga

SEQ ID NO: 569302 - DNA, 25 bp, Mus musculus
cagctgtgacgacattgaggacgac

SEQ ID NO: 569303 - DNA, 25 bp, Mus musculus
cagctgtgacgagattgaggacgac

SEQ ID NO: 569304 - DNA, 25 bp, Mus musculus
cagctgtgagaacggtgacaccacc

SEQ ID NO: 569305 - DNA, 25 bp, Mus musculus
cagctgtgagaagggtgacaccacc

SEQ ID NO: 569306 - DNA, 25 bp, Mus musculus
cagctgtgagctaccacatttaaac

SEQ ID NO: 569307 - DNA, 25 bp, Mus musculus
cagctgtgagcttccacatttaaac

SEQ ID NO: 569308 - DNA, 25 bp, Mus musculus
cagctgtgattgagggacctcccgg

SEQ ID NO: 569309 - DNA, 25 bp, Mus musculus
cagctgtgattgtgggacctcccgg

SEQ ID NO: 569310 - DNA, 25 bp, Mus musculus
cagctgtgcagaatatcattaccga

SEQ ID NO: 569311 - DNA, 25 bp, Mus musculus
cagctgtgcagattatcattaccga

SEQ ID NO: 569312 - DNA, 25 bp, Mus musculus
cagctgtgccttctgatggcgacaa

SEQ ID NO: 569313 - DNA, 25 bp, Mus musculus
cagctgtgccttcttccagtgtttc

SEQ ID NO: 569314 - DNA, 25 bp, Mus musculus
cagctgtgccttgtgatggcgacaa

SEQ ID NO: 569315 - DNA, 25 bp, Mus musculus
cagctgtgccttgttccagtgtttc

SEQ ID NO: 569316 - DNA, 25 bp, Mus musculus
cagctgtgcgccagatgaatcctta

SEQ ID NO: 569317 - DNA, 25 bp, Mus musculus
cagctgtgcgcctgatgaatcctta

SEQ ID NO: 569318 - DNA, 25 bp, Mus musculus
cagctgtgctatctttgaagcctga

SEQ ID NO: 569319 - DNA, 25 bp, Mus musculus
cagctgtgctatgtttgaagcctga

SEQ ID NO: 569320 - DNA, 25 bp, Mus musculus
cagctgtgctgaaggtaagaaatgg

SEQ ID NO: 569321 - DNA, 25 bp, Mus musculus
cagctgtgctgatggtaagaaatgg

SEQ ID NO: 569322 - DNA, 25 bp, Mus musculus
cagctgtggctacaacgatctgaca

SEQ ID NO: 569323 - DNA, 25 bp, Mus musculus
cagctgtggctagaacgatctgaca

SEQ ID NO: 569324 - DNA, 25 bp, Mus musculus
cagctgtggtccctcaccaatatta

SEQ ID NO: 569325 - DNA, 25 bp, Mus musculus
cagctgtggtccgtcaccaatatta

SEQ ID NO: 569326 - DNA, 25 bp, Mus musculus
cagctgtggtgcaggagctatgcac

SEQ ID NO: 569327 - DNA, 25 bp, Mus musculus
cagctgtggtgctggagctatgcac

SEQ ID NO: 569328 - DNA, 25 bp, Mus musculus
cagctgtgtgcgcacctagactgca

SEQ ID NO: 569329 - DNA, 25 bp, Mus musculus
cagctgtgtgcggacctagactgca

SEQ ID NO: 569330 - DNA, 25 bp, Mus musculus
cagctgtgttgacctgtctacctgg

SEQ ID NO: 569331 - DNA, 25 bp, Mus musculus
cagctgtgttgagctgtctacctgg

SEQ ID NO: 569332 - DNA, 25 bp, Mus musculus
cagctgtgttgcatttaatgggcag

SEQ ID NO: 569333 - DNA, 25 bp, Mus musculus
cagctgtgttgcttttaatgggcag

SEQ ID NO: 569334 - DNA, 25 bp, Mus musculus
cagctgttgagacgttcgtgctcaa

SEQ ID NO: 569335 - DNA, 25 bp, Mus musculus
cagctgttgagaggttcgtgctcaa

SEQ ID NO: 569336 - DNA, 25 bp, Mus musculus
cagctgttggacatggatggtttcc

SEQ ID NO: 569337 - DNA, 25 bp, Mus musculus
cagctgttggacttggatggtttcc

SEQ ID NO: 569338 - DNA, 25 bp, Mus musculus
cagctgttggatcccgagcctgtgc

SEQ ID NO: 569339 - DNA, 25 bp, Mus musculus
cagctgttggatgccgagcctgtgc

SEQ ID NO: 569340 - DNA, 25 bp, Mus musculus
cagctgttgtgcatagcaagagccc

SEQ ID NO: 569341 - DNA, 25 bp, Mus musculus
cagctgttgtgcttagcaagagccc

SEQ ID NO: 569342 - DNA, 25 bp, Mus musculus
cagctgtttaaacgcgccgtctaac

SEQ ID NO: 569343 - DNA, 25 bp, Mus musculus
cagctgtttaaaggcgccgtctaac

SEQ ID NO: 569344 - DNA, 25 bp, Mus musculus
cagctgtttccacgatgtctagaag

SEQ ID NO: 569345 - DNA, 25 bp, Mus musculus
cagctgtttccaggatgtctagaag

SEQ ID NO: 569346 - DNA, 25 bp, Mus musculus
cagcttaaaggcacatcagatgacg

SEQ ID NO: 569347 - DNA, 25 bp, Mus musculus
cagcttaaaggctcatcagatgacg

SEQ ID NO: 569348 - DNA, 25 bp, Mus musculus
cagcttaatgctaacagcatcggtg

SEQ ID NO: 569349 - DNA, 25 bp, Mus musculus
cagcttaatgcttacagcatcggtg

SEQ ID NO: 569350 - DNA, 25 bp, Mus musculus
cagcttagtaggataatgaagacac

SEQ ID NO: 569351 - DNA, 25 bp, Mus musculus
cagcttagtaggttaatgaagacac

SEQ ID NO: 569352 - DNA, 25 bp, Mus musculus
cagcttagttcacgatgttggacca

SEQ ID NO: 569353 - DNA, 25 bp, Mus musculus
cagcttagttcaggatgttggacca

SEQ ID NO: 569354 - DNA, 25 bp, Mus musculus
cagcttataaggcaagggcttggct

SEQ ID NO: 569355 - DNA, 25 bp, Mus musculus
cagcttataagggaagggcttggct

SEQ ID NO: 569356 - DNA, 25 bp, Mus musculus
cagcttatgatgataaggacaacac

SEQ ID NO: 569357 - DNA, 25 bp, Mus musculus
cagcttatgatgttaaggacaacac

SEQ ID NO: 569358 - DNA, 25 bp, Mus musculus
cagcttattaaaccttttctccgaa

SEQ ID NO: 569359 - DNA, 25 bp, Mus musculus
cagcttattaaagcttttctccgaa

SEQ ID NO: 569360 - DNA, 25 bp, Mus musculus
cagcttcaaccaagtttttcacttg

SEQ ID NO: 569361 - DNA, 25 bp, Mus musculus
cagcttcaaccatgtttttcacttg

SEQ ID NO: 569362 - DNA, 25 bp, Mus musculus
cagcttcaagtgcatcgcctgccag

SEQ ID NO: 569363 - DNA, 25 bp, Mus musculus
cagcttcaagtggatcgcctgccag

SEQ ID NO: 569364 - DNA, 25 bp, Mus musculus
cagcttcacaaacggtggcaaagga

SEQ ID NO: 569365 - DNA, 25 bp, Mus musculus
cagcttcacaaagggtggcaaagga

SEQ ID NO: 569366 - DNA, 25 bp, Mus musculus
cagcttcagcagataatgcgtctga

SEQ ID NO: 569367 - DNA, 25 bp, Mus musculus
cagcttcagcagttaatgcgtctga

SEQ ID NO: 569368 - DNA, 25 bp, Mus musculus
cagcttcagcgaatctttgagaggg

SEQ ID NO: 569369 - DNA, 25 bp, Mus musculus
cagcttcagcgattctttgagaggg

SEQ ID NO: 569370 - DNA, 25 bp, Mus musculus
cagcttcagggtcgtcgtgatgacc

SEQ ID NO: 569371 - DNA, 25 bp, Mus musculus
cagcttcagggtggtcgtgatgacc

SEQ ID NO: 569372 - DNA, 25 bp, Mus musculus
cagcttcaggtcattcacttcaggg

SEQ ID NO: 569373 - DNA, 25 bp, Mus musculus
cagcttcaggtctttcacttcaggg

SEQ ID NO: 569374 - DNA, 25 bp, Mus musculus
cagcttcatcctatatgctgcaggg

SEQ ID NO: 569375 - DNA, 25 bp, Mus musculus
cagcttcatcctttatgctgcaggg

SEQ ID NO: 569376 - DNA, 25 bp, Mus musculus
cagcttcatggacagcgacatgttt

SEQ ID NO: 569377 - DNA, 25 bp, Mus musculus
cagcttcatggagagcgacatgttt

SEQ ID NO: 569378 - DNA, 25 bp, Mus musculus
cagcttccagtgactggaaaagtca

SEQ ID NO: 569379 - DNA, 25 bp, Mus musculus
cagcttccagtgtctggaaaagtca

SEQ ID NO: 569380 - DNA, 25 bp, Mus musculus
cagcttccatgcctgtcacattaaa

SEQ ID NO: 569381 - DNA, 25 bp, Mus musculus
cagcttccatgcgtgtcacattaaa

SEQ ID NO: 569382 - DNA, 25 bp, Mus musculus
cagcttcccgtacagatacaagcag

SEQ ID NO: 569383 - DNA, 25 bp, Mus musculus
cagcttcccgtagagatacaagcag

SEQ ID NO: 569384 - DNA, 25 bp, Mus musculus
cagcttccgctaaggatggacccct

SEQ ID NO: 569385 - DNA, 25 bp, Mus musculus
cagcttccgctatggatggacccct

SEQ ID NO: 569386 - DNA, 25 bp, Mus musculus
cagcttcctaaccaaagaggagctg

SEQ ID NO: 569387 - DNA, 25 bp, Mus musculus
cagcttcctaacgaaagaggagctg

SEQ ID NO: 569388 - DNA, 25 bp, Mus musculus
cagcttcctacaacctgtcactgtg

SEQ ID NO: 569389 - DNA, 25 bp, Mus musculus
cagcttcctacatcctgtcactgtg

SEQ ID NO: 569390 - DNA, 25 bp, Mus musculus
cagcttcctcacaggttccacgagt

SEQ ID NO: 569391 - DNA, 25 bp, Mus musculus
cagcttcctcactggttccacgagt

SEQ ID NO: 569392 - DNA, 25 bp, Mus musculus
cagcttccttcaacacgtgacaggg

SEQ ID NO: 569393 - DNA, 25 bp, Mus musculus
cagcttccttcatcacgtgacaggg

SEQ ID NO: 569394 - DNA, 25 bp, Mus musculus
cagcttcgagatcccctttgagcag

SEQ ID NO: 569395 - DNA, 25 bp, Mus musculus
cagcttcgagatgccctttgagcag

SEQ ID NO: 569396 - DNA, 25 bp, Mus musculus
cagcttcgatgacggcagtgtgtcc

SEQ ID NO: 569397 - DNA, 25 bp, Mus musculus
cagcttcgatgagggcagtgtgtcc

SEQ ID NO: 569398 - DNA, 25 bp, Mus musculus
cagcttcgctcccaagacttgctga

SEQ ID NO: 569399 - DNA, 25 bp, Mus musculus
cagcttcgctccgaagacttgctga

SEQ ID NO: 569400 - DNA, 25 bp, Mus musculus
cagcttctaggaaaaatgctagggc

SEQ ID NO: 569401 - DNA, 25 bp, Mus musculus
cagcttctaggataaatgctagggc

SEQ ID NO: 569402 - DNA, 25 bp, Mus musculus
cagcttctcagtccgcgccgtgaag

SEQ ID NO: 569403 - DNA, 25 bp, Mus musculus
cagcttctcagtgcgcgccgtgaag

SEQ ID NO: 569404 - DNA, 25 bp, Mus musculus
cagcttctcatacctctggattctt

SEQ ID NO: 569405 - DNA, 25 bp, Mus musculus
cagcttctcatagctctggattctt

SEQ ID NO: 569406 - DNA, 25 bp, Mus musculus
cagcttctcctaccttgataaggca

SEQ ID NO: 569407 - DNA, 25 bp, Mus musculus
cagcttctcctagcttgataaggca

SEQ ID NO: 569408 - DNA, 25 bp, Mus musculus
cagcttctctggctgatctctggaa

SEQ ID NO: 569409 - DNA, 25 bp, Mus musculus
cagcttctctgggtgatctctggaa

SEQ ID NO: 569410 - DNA, 25 bp, Mus musculus
cagcttctgcctcagagtcaggtgg

SEQ ID NO: 569411 - DNA, 25 bp, Mus musculus
cagcttctgcctgagagtcaggtgg

SEQ ID NO: 569412 - DNA, 25 bp, Mus musculus
cagcttctggagcatatgcagaggt

SEQ ID NO: 569413 - DNA, 25 bp, Mus musculus
cagcttctggaggatatgcagaggt

SEQ ID NO: 569414 - DNA, 25 bp, Mus musculus
cagcttctgggactcttaagccaag

SEQ ID NO: 569415 - DNA, 25 bp, Mus musculus
cagcttctgggagtcttaagccaag

SEQ ID NO: 569416 - DNA, 25 bp, Mus musculus
cagcttctggtacctatcagtcctt

SEQ ID NO: 569417 - DNA, 25 bp, Mus musculus
cagcttctggtagctatcagtcctt

SEQ ID NO: 569418 - DNA, 25 bp, Mus musculus
cagcttctttttcagcgcagaagat

SEQ ID NO: 569419 - DNA, 25 bp, Mus musculus
cagcttctttttgagcgcagaagat

SEQ ID NO: 569420 - DNA, 25 bp, Mus musculus
cagcttgaaattcttgagccctaca

SEQ ID NO: 569421 - DNA, 25 bp, Mus musculus
cagcttgaaattgttgagccctaca

SEQ ID NO: 569422 - DNA, 25 bp, Mus musculus
cagcttgaatgtcagctgcagacag

SEQ ID NO: 569423 - DNA, 25 bp, Mus musculus
cagcttgaatgtgagctgcagacag

SEQ ID NO: 569424 - DNA, 25 bp, Mus musculus
cagcttgacaagaacaaactacagg

SEQ ID NO: 569425 - DNA, 25 bp, Mus musculus
cagcttgacaagtacaaactacagg

SEQ ID NO: 569426 - DNA, 25 bp, Mus musculus
cagcttgagaggcttttggataagc

SEQ ID NO: 569427 - DNA, 25 bp, Mus musculus
cagcttgagagggttttggataagc

SEQ ID NO: 569428 - DNA, 25 bp, Mus musculus
cagcttgagcccactggttggttcg

SEQ ID NO: 569429 - DNA, 25 bp, Mus musculus
cagcttgagccctctggttggttcg

SEQ ID NO: 569430 - DNA, 25 bp, Mus musculus
cagcttgagtgcctaaagcaatagg

SEQ ID NO: 569431 - DNA, 25 bp, Mus musculus
cagcttgagtgcgtaaagcaatagg

SEQ ID NO: 569432 - DNA, 25 bp, Mus musculus
cagcttgatcttacacggtgccgat

SEQ ID NO: 569433 - DNA, 25 bp, Mus musculus
cagcttgatctttcacggtgccgat

SEQ ID NO: 569434 - DNA, 25 bp, Mus musculus
cagcttgatgctcacacaaggattt

SEQ ID NO: 569435 - DNA, 25 bp, Mus musculus
cagcttgatgctgacacaaggattt

SEQ ID NO: 569436 - DNA, 25 bp, Mus musculus
cagcttgcaagccaggaagacgact

SEQ ID NO: 569437 - DNA, 25 bp, Mus musculus
cagcttgcaagcgaggaagacgact

SEQ ID NO: 569438 - DNA, 25 bp, Mus musculus
cagcttgccagcaggctggctgtgc

SEQ ID NO: 569439 - DNA, 25 bp, Mus musculus
cagcttgccagctggctggctgtgc

SEQ ID NO: 569440 - DNA, 25 bp, Mus musculus
cagcttgctgacatgattccttgca

SEQ ID NO: 569441 - DNA, 25 bp, Mus musculus
cagcttgctgacttgattccttgca

SEQ ID NO: 569442 - DNA, 25 bp, Mus musculus
cagcttgctgcgaaccaggaggaag

SEQ ID NO: 569443 - DNA, 25 bp, Mus musculus
cagcttgctgcgtaccaggaggaag

SEQ ID NO: 569444 - DNA, 25 bp, Mus musculus
cagcttgctggcaggaggacctgtt

SEQ ID NO: 569445 - DNA, 25 bp, Mus musculus
cagcttgctggctggaggacctgtt

SEQ ID NO: 569446 - DNA, 25 bp, Mus musculus
cagcttggagagcaaaggcacttcc

SEQ ID NO: 569447 - DNA, 25 bp, Mus musculus
cagcttggagaggaaaggcacttcc

SEQ ID NO: 569448 - DNA, 25 bp, Mus musculus
cagcttggagatctaactctatggc

SEQ ID NO: 569449 - DNA, 25 bp, Mus musculus
cagcttggagatgtaactctatggc

SEQ ID NO: 569450 - DNA, 25 bp, Mus musculus
cagcttggagttatgaccagctacc

SEQ ID NO: 569451 - DNA, 25 bp, Mus musculus
cagcttggagttttgaccagctacc

SEQ ID NO: 569452 - DNA, 25 bp, Mus musculus
cagcttggcaccagccaggacatgg

SEQ ID NO: 569453 - DNA, 25 bp, Mus musculus
cagcttggcacctgccaggacatgg

SEQ ID NO: 569454 - DNA, 25 bp, Mus musculus
cagcttggcgtcagcgccatggacg

SEQ ID NO: 569455 - DNA, 25 bp, Mus musculus
cagcttggcgtctgcgccatggacg

SEQ ID NO: 569456 - DNA, 25 bp, Mus musculus
cagcttggctcaccatgtttgatgc

SEQ ID NO: 569457 - DNA, 25 bp, Mus musculus
cagcttggctcagcatgtttgatgc

SEQ ID NO: 569458 - DNA, 25 bp, Mus musculus
cagcttgggctacggttttgtgaac

SEQ ID NO: 569459 - DNA, 25 bp, Mus musculus
cagcttgggctagggttttgtgaac

SEQ ID NO: 569460 - DNA, 25 bp, Mus musculus
cagcttgggctgaatatgaagcaga

SEQ ID NO: 569461 - DNA, 25 bp, Mus musculus
cagcttgggctgtatatgaagcaga

SEQ ID NO: 569462 - DNA, 25 bp, Mus musculus
cagcttggtgcacacctagcagaca

SEQ ID NO: 569463 - DNA, 25 bp, Mus musculus
cagcttggtgcagacctagcagaca

SEQ ID NO: 569464 - DNA, 25 bp, Mus musculus
cagcttggttgcaccgtagtacggc

SEQ ID NO: 569465 - DNA, 25 bp, Mus musculus
cagcttggttgctccgtagtacggc

SEQ ID NO: 569466 - DNA, 25 bp, Mus musculus
cagcttgtaggaacggcccttttgc

SEQ ID NO: 569467 - DNA, 25 bp, Mus musculus
cagcttgtaggatcggcccttttgc

SEQ ID NO: 569468 - DNA, 25 bp, Mus musculus
cagcttgtaggcaccatggccggga

SEQ ID NO: 569469 - DNA, 25 bp, Mus musculus
cagcttgtaggctccatggccggga

SEQ ID NO: 569470 - DNA, 25 bp, Mus musculus
cagcttgtcaagaggcaatgggaga

SEQ ID NO: 569471 - DNA, 25 bp, Mus musculus
cagcttgtcaagtggcaatgggaga

SEQ ID NO: 569472 - DNA, 25 bp, Mus musculus
cagcttgtgcttaggtctggcagag

SEQ ID NO: 569473 - DNA, 25 bp, Mus musculus
cagcttgtgctttggtctggcagag

SEQ ID NO: 569474 - DNA, 25 bp, Mus musculus
cagcttgtggcccttttgggcacag

SEQ ID NO: 569475 - DNA, 25 bp, Mus musculus
cagcttgtggccgttttgggcacag

SEQ ID NO: 569476 - DNA, 25 bp, Mus musculus
cagcttgtgggacagctctcaagaa

SEQ ID NO: 569477 - DNA, 25 bp, Mus musculus
cagcttgtgggagagctctcaagaa

SEQ ID NO: 569478 - DNA, 25 bp, Mus musculus
cagcttgtgtgaatgctgcctcccc

SEQ ID NO: 569479 - DNA, 25 bp, Mus musculus
cagcttgtgtgattgctgcctcccc

SEQ ID NO: 569480 - DNA, 25 bp, Mus musculus
cagctttaacacaggcctgtgcagg

SEQ ID NO: 569481 - DNA, 25 bp, Mus musculus
cagctttaacactggcctgtgcagg

SEQ ID NO: 569482 - DNA, 25 bp, Mus musculus
cagctttaaccgaggcgatgtcttc

SEQ ID NO: 569483 - DNA, 25 bp, Mus musculus
cagctttaaccgtggcgatgtcttc

SEQ ID NO: 569484 - DNA, 25 bp, Mus musculus
cagctttacaagaatctagtcggac

SEQ ID NO: 569485 - DNA, 25 bp, Mus musculus
cagctttacaagtatctagtcggac

SEQ ID NO: 569486 - DNA, 25 bp, Mus musculus
cagctttactagaccctctgtggga

SEQ ID NO: 569487 - DNA, 25 bp, Mus musculus
cagctttactagtccctctgtggga

SEQ ID NO: 569488 - DNA, 25 bp, Mus musculus
cagctttactttatcgaagatccct

SEQ ID NO: 569489 - DNA, 25 bp, Mus musculus
cagctttactttttcgaagatccct

SEQ ID NO: 569490 - DNA, 25 bp, Mus musculus
cagctttagcaactgtaaccatggg

SEQ ID NO: 569491 - DNA, 25 bp, Mus musculus
cagctttagcaagtgtaaccatggg

SEQ ID NO: 569492 - DNA, 25 bp, Mus musculus
cagctttattacaaggtgggcaaaa

SEQ ID NO: 569493 - DNA, 25 bp, Mus musculus
cagctttattactaggtgggcaaaa

SEQ ID NO: 569494 - DNA, 25 bp, Mus musculus
cagctttattgactcagatgaggag

SEQ ID NO: 569495 - DNA, 25 bp, Mus musculus
cagctttattgagtcagatgaggag

SEQ ID NO: 569496 - DNA, 25 bp, Mus musculus
cagctttcacaccatgatactcatt

SEQ ID NO: 569497 - DNA, 25 bp, Mus musculus
cagctttcacacgatgatactcatt

SEQ ID NO: 569498 - DNA, 25 bp, Mus musculus
cagctttccacccattcagaggacg

SEQ ID NO: 569499 - DNA, 25 bp, Mus musculus
cagctttccaccgattcagaggacg

SEQ ID NO: 569500 - DNA, 25 bp, Mus musculus
cagctttctcaacgcatgtggactc

SEQ ID NO: 569501 - DNA, 25 bp, Mus musculus
cagctttctcaaggcatgtggactc

SEQ ID NO: 569502 - DNA, 25 bp, Mus musculus
cagctttctccactctacgaacatt

SEQ ID NO: 569503 - DNA, 25 bp, Mus musculus
cagctttctccagtctacgaacatt

SEQ ID NO: 569504 - DNA, 25 bp, Mus musculus
cagctttgaagtaccgttcgagcaa

SEQ ID NO: 569505 - DNA, 25 bp, Mus musculus
cagctttgaagttccgttcgagcaa

SEQ ID NO: 569506 - DNA, 25 bp, Mus musculus
cagctttgagctctacttggcccta

SEQ ID NO: 569507 - DNA, 25 bp, Mus musculus
cagctttgagctgtacttggcccta

SEQ ID NO: 569508 - DNA, 25 bp, Mus musculus
cagctttgaggaccgtgtggcttcc

SEQ ID NO: 569509 - DNA, 25 bp, Mus musculus
cagctttgaggagcgtgtggcttcc

SEQ ID NO: 569510 - DNA, 25 bp, Mus musculus
cagctttgaggtccctctcttgaga

SEQ ID NO: 569511 - DNA, 25 bp, Mus musculus
cagctttgaggtgcctctcttgaga

SEQ ID NO: 569512 - DNA, 25 bp, Mus musculus
cagctttgagtactttctggcttgc

SEQ ID NO: 569513 - DNA, 25 bp, Mus musculus
cagctttgagtagtttctggcttgc

SEQ ID NO: 569514 - DNA, 25 bp, Mus musculus
cagctttgatttcttggccctgaac

SEQ ID NO: 569515 - DNA, 25 bp, Mus musculus
cagctttgatttgttggccctgaac

SEQ ID NO: 569516 - DNA, 25 bp, Mus musculus
cagctttgcaaaagagccgagatct

SEQ ID NO: 569517 - DNA, 25 bp, Mus musculus
cagctttgcaaatgagccgagatct

SEQ ID NO: 569518 - DNA, 25 bp, Mus musculus
cagctttgcactcgtcctgtaacaa

SEQ ID NO: 569519 - DNA, 25 bp, Mus musculus
cagctttgcactggtcctgtaacaa

SEQ ID NO: 569520 - DNA, 25 bp, Mus musculus
cagctttgccttagttcaccgagca

SEQ ID NO: 569521 - DNA, 25 bp, Mus musculus
cagctttgcctttgttcaccgagca

SEQ ID NO: 569522 - DNA, 25 bp, Mus musculus
cagctttgctggctcttactaagaa

SEQ ID NO: 569523 - DNA, 25 bp, Mus musculus
cagctttgctgggtcttactaagaa

SEQ ID NO: 569524 - DNA, 25 bp, Mus musculus
cagctttggaccagtgtcagatgtg

SEQ ID NO: 569525 - DNA, 25 bp, Mus musculus
cagctttggacctgtgtcagatgtg

SEQ ID NO: 569526 - DNA, 25 bp, Mus musculus
cagctttggaggcatctcagcacct

SEQ ID NO: 569527 - DNA, 25 bp, Mus musculus
cagctttggagggatctcagcacct

SEQ ID NO: 569528 - DNA, 25 bp, Mus musculus
cagctttggccaagaccgtgacttc

SEQ ID NO: 569529 - DNA, 25 bp, Mus musculus
cagctttggccatgaccgtgacttc

SEQ ID NO: 569530 - DNA, 25 bp, Mus musculus
cagctttggcctcagtgatctctat

SEQ ID NO: 569531 - DNA, 25 bp, Mus musculus
cagctttggcctgagtgatctctat

SEQ ID NO: 569532 - DNA, 25 bp, Mus musculus
cagctttggtggagggagtctctat

SEQ ID NO: 569533 - DNA, 25 bp, Mus musculus
cagctttggtggtgggagtctctat

SEQ ID NO: 569534 - DNA, 25 bp, Mus musculus
cagctttgtgcaactctcagatgcc

SEQ ID NO: 569535 - DNA, 25 bp, Mus musculus
cagctttgtgcatctctcagatgcc

SEQ ID NO: 569536 - DNA, 25 bp, Mus musculus
cagcttttacatatcagaatggtgg

SEQ ID NO: 569537 - DNA, 25 bp, Mus musculus
cagcttttacatttcagaatggtgg

SEQ ID NO: 569538 - DNA, 25 bp, Mus musculus
cagcttttacctaataccacaacgg

SEQ ID NO: 569539 - DNA, 25 bp, Mus musculus
cagcttttaccttataccacaacgg

SEQ ID NO: 569540 - DNA, 25 bp, Mus musculus
cagcttttagctaactttggtgaaa

SEQ ID NO: 569541 - DNA, 25 bp, Mus musculus
cagcttttagcttactttggtgaaa

SEQ ID NO: 569542 - DNA, 25 bp, Mus musculus
cagcttttcaagcacgtaagtgaga

SEQ ID NO: 569543 - DNA, 25 bp, Mus musculus
cagcttttcaaggacgtaagtgaga

SEQ ID NO: 569544 - DNA, 25 bp, Mus musculus
cagcttttgactatacggctccaag

SEQ ID NO: 569545 - DNA, 25 bp, Mus musculus
cagcttttgactttacggctccaag

SEQ ID NO: 569546 - DNA, 25 bp, Mus musculus
cagcttttggaaaccagcagaacag

SEQ ID NO: 569547 - DNA, 25 bp, Mus musculus
cagcttttggaatccagcagaacag

SEQ ID NO: 569548 - DNA, 25 bp, Mus musculus
cagcttttggagaccgacgctgtta

SEQ ID NO: 569549 - DNA, 25 bp, Mus musculus
cagcttttggagtccgacgctgtta

SEQ ID NO: 569550 - DNA, 25 bp, Mus musculus
cagcttttggtcatgatccatcagc

SEQ ID NO: 569551 - DNA, 25 bp, Mus musculus
cagcttttggtcttgatccatcagc

SEQ ID NO: 569552 - DNA, 25 bp, Mus musculus
cagcttttggttacagcatctgaag

SEQ ID NO: 569553 - DNA, 25 bp, Mus musculus
cagcttttggtttcagcatctgaag

SEQ ID NO: 569554 - DNA, 25 bp, Mus musculus
cagctttttctcagtcgctcaaggc

SEQ ID NO: 569555 - DNA, 25 bp, Mus musculus
cagctttttctctgtcgctcaaggc

SEQ ID NO: 569556 - DNA, 25 bp, Mus musculus
caggaaaaatcaagcggatcagagg

SEQ ID NO: 569557 - DNA, 25 bp, Mus musculus
caggaaaaatcatgcggatcagagg

SEQ ID NO: 569558 - DNA, 25 bp, Mus musculus
caggaaaacctcatgggacaccagg

SEQ ID NO: 569559 - DNA, 25 bp, Mus musculus
caggaaaacctcttgggacaccagg

SEQ ID NO: 569560 - DNA, 25 bp, Mus musculus
caggaaaaggagatctctagttctt

SEQ ID NO: 569561 - DNA, 25 bp, Mus musculus
caggaaaaggagttctctagttctt

SEQ ID NO: 569562 - DNA, 25 bp, Mus musculus
caggaaaaggcaaatgtccctatga

SEQ ID NO: 569563 - DNA, 25 bp, Mus musculus
caggaaaaggcatatgtccctatga

SEQ ID NO: 569564 - DNA, 25 bp, Mus musculus
caggaaaaggctacggcatttgcag

SEQ ID NO: 569565 - DNA, 25 bp, Mus musculus
caggaaaaggcttcggcatttgcag

SEQ ID NO: 569566 - DNA, 25 bp, Mus musculus
caggaaaaggtacttgctgaacctg

SEQ ID NO: 569567 - DNA, 25 bp, Mus musculus
caggaaaaggtagttgctgaacctg

SEQ ID NO: 569568 - DNA, 25 bp, Mus musculus
caggaaaagtctctcttctgccgaa

SEQ ID NO: 569569 - DNA, 25 bp, Mus musculus
caggaaaagtctgtcttctgccgaa

SEQ ID NO: 569570 - DNA, 25 bp, Mus musculus
caggaaacctgtagcactggtggac

SEQ ID NO: 569571 - DNA, 25 bp, Mus musculus
caggaaacctgttgcactggtggac

SEQ ID NO: 569572 - DNA, 25 bp, Mus musculus
caggaaacgtctcctcgggagttca

SEQ ID NO: 569573 - DNA, 25 bp, Mus musculus
caggaaacgtctgctcgggagttca

SEQ ID NO: 569574 - DNA, 25 bp, Mus musculus
caggaaactcttccagcagatccga

SEQ ID NO: 569575 - DNA, 25 bp, Mus musculus
caggaaactcttgcagcagatccga

SEQ ID NO: 569576 - DNA, 25 bp, Mus musculus
caggaaactggtctgctcggcaagt

SEQ ID NO: 569577 - DNA, 25 bp, Mus musculus
caggaaactggtgtgctcggcaagt

SEQ ID NO: 569578 - DNA, 25 bp, Mus musculus
caggaaactgtgctgcctgcagcaa

SEQ ID NO: 569579 - DNA, 25 bp, Mus musculus
caggaaactgtggtgcctgcagcaa

SEQ ID NO: 569580 - DNA, 25 bp, Mus musculus
caggaaacttgaagataatatggtc

SEQ ID NO: 569581 - DNA, 25 bp, Mus musculus
caggaaacttgatgataatatggtc

SEQ ID NO: 569582 - DNA, 25 bp, Mus musculus
caggaaagatggaaagcccttcgat

SEQ ID NO: 569583 - DNA, 25 bp, Mus musculus
caggaaagatggtaagcccttcgat

SEQ ID NO: 569584 - DNA, 25 bp, Mus musculus
caggaaagatttcgaacaatcactt

SEQ ID NO: 569585 - DNA, 25 bp, Mus musculus
caggaaagatttggaacaatcactt

SEQ ID NO: 569586 - DNA, 25 bp, Mus musculus
caggaaagggagagacccacatcag

SEQ ID NO: 569587 - DNA, 25 bp, Mus musculus
caggaaagggagtgacccacatcag

SEQ ID NO: 569588 - DNA, 25 bp, Mus musculus
caggaaagggctcttcgagagcaat

SEQ ID NO: 569589 - DNA, 25 bp, Mus musculus
caggaaagggctgttcgagagcaat

SEQ ID NO: 569590 - DNA, 25 bp, Mus musculus
caggaaagtagtagagccccaaatc

SEQ ID NO: 569591 - DNA, 25 bp, Mus musculus
caggaaagtagttgagccccaaatc

SEQ ID NO: 569592 - DNA, 25 bp, Mus musculus
caggaaagtatcaggtctcatttga

SEQ ID NO: 569593 - DNA, 25 bp, Mus musculus
caggaaagtatctggtctcatttga

SEQ ID NO: 569594 - DNA, 25 bp, Mus musculus
caggaaagttggatgctgtatttga

SEQ ID NO: 569595 - DNA, 25 bp, Mus musculus
caggaaagttggttgctgtatttga

SEQ ID NO: 569596 - DNA, 25 bp, Mus musculus
caggaaatgaacatagaactcattc

SEQ ID NO: 569597 - DNA, 25 bp, Mus musculus
caggaaatgaacttagaactcattc

SEQ ID NO: 569598 - DNA, 25 bp, Mus musculus
caggaaatgacgagaagaaagccaa

SEQ ID NO: 569599 - DNA, 25 bp, Mus musculus
caggaaatgacgtgaagaaagccaa

SEQ ID NO: 569600 - DNA, 25 bp, Mus musculus
caggaaatgatgagaaaccaggacc

SEQ ID NO: 569601 - DNA, 25 bp, Mus musculus
caggaaatgatgtgaaaccaggacc

SEQ ID NO: 569602 - DNA, 25 bp, Mus musculus
caggaaatgcctcagccaagattca

SEQ ID NO: 569603 - DNA, 25 bp, Mus musculus
caggaaatgcctgagccaagattca

SEQ ID NO: 569604 - DNA, 25 bp, Mus musculus
caggaaatggctattgatatcattc

SEQ ID NO: 569605 - DNA, 25 bp, Mus musculus
caggaaatggcttttgatatcattc

SEQ ID NO: 569606 - DNA, 25 bp, Mus musculus
caggaaatgttgaagtgtaatgctt

SEQ ID NO: 569607 - DNA, 25 bp, Mus musculus
caggaaatgttgtagtgtaatgctt

SEQ ID NO: 569608 - DNA, 25 bp, Mus musculus
caggaaatgtttcaaatctccccaa

SEQ ID NO: 569609 - DNA, 25 bp, Mus musculus
caggaaatgtttgaaatctccccaa

SEQ ID NO: 569610 - DNA, 25 bp, Mus musculus
caggaaattgctcccatgaacaaga

SEQ ID NO: 569611 - DNA, 25 bp, Mus musculus
caggaaattgctgccatgaacaaga

SEQ ID NO: 569612 - DNA, 25 bp, Mus musculus
caggaaatttacacaagaagctaca

SEQ ID NO: 569613 - DNA, 25 bp, Mus musculus
caggaaatttactcaagaagctaca

SEQ ID NO: 569614 - DNA, 25 bp, Mus musculus
caggaacaactgcactctacgactt

SEQ ID NO: 569615 - DNA, 25 bp, Mus musculus
caggaacaactggactctacgactt

SEQ ID NO: 569616 - DNA, 25 bp, Mus musculus
caggaacaagacagcagagactgga

SEQ ID NO: 569617 - DNA, 25 bp, Mus musculus
caggaacaagactgcagagactgga

SEQ ID NO: 569618 - DNA, 25 bp, Mus musculus
caggaacaaggcaacctgccaagac

SEQ ID NO: 569619 - DNA, 25 bp, Mus musculus
caggaacaaggctacctgccaagac

SEQ ID NO: 569620 - DNA, 25 bp, Mus musculus
caggaacacagcaatgctggtctgt

SEQ ID NO: 569621 - DNA, 25 bp, Mus musculus
caggaacacagctatgctggtctgt

SEQ ID NO: 569622 - DNA, 25 bp, Mus musculus
caggaacaccggcaccatgggccag

SEQ ID NO: 569623 - DNA, 25 bp, Mus musculus
caggaacaccgggaccatgggccag

SEQ ID NO: 569624 - DNA, 25 bp, Mus musculus
caggaacagcctcatgcagctgaag

SEQ ID NO: 569625 - DNA, 25 bp, Mus musculus
caggaacagcctgatgcagctgaag

SEQ ID NO: 569626 - DNA, 25 bp, Mus musculus
caggaacatgacactgagaagtggt

SEQ ID NO: 569627 - DNA, 25 bp, Mus musculus
caggaacatgactctgagaagtggt

SEQ ID NO: 569628 - DNA, 25 bp, Mus musculus
caggaacatggcctctgctgtgagt

SEQ ID NO: 569629 - DNA, 25 bp, Mus musculus
caggaacatggcgtctgctgtgagt

SEQ ID NO: 569630 - DNA, 25 bp, Mus musculus
caggaacattcaccctgtgcatccg

SEQ ID NO: 569631 - DNA, 25 bp, Mus musculus
caggaacattcagcctgtgcatccg

SEQ ID NO: 569632 - DNA, 25 bp, Mus musculus
caggaaccaagacaacagactttaa

SEQ ID NO: 569633 - DNA, 25 bp, Mus musculus
caggaaccaagagaacagactttaa

SEQ ID NO: 569634 - DNA, 25 bp, Mus musculus
caggaaccaatcagtctctccagtt

SEQ ID NO: 569635 - DNA, 25 bp, Mus musculus
caggaaccaatctgtctctccagtt

SEQ ID NO: 569636 - DNA, 25 bp, Mus musculus
caggaaccactcctagagtcagagg

SEQ ID NO: 569637 - DNA, 25 bp, Mus musculus
caggaaccactcgtagagtcagagg

SEQ ID NO: 569638 - DNA, 25 bp, Mus musculus
caggaacccagaccttggccatggt

SEQ ID NO: 569639 - DNA, 25 bp, Mus musculus
caggaacccagagcttggccatggt

SEQ ID NO: 569640 - DNA, 25 bp, Mus musculus
caggaacccagtatgcaggacaaag

SEQ ID NO: 569641 - DNA, 25 bp, Mus musculus
caggaacccagtttgcaggacaaag

SEQ ID NO: 569642 - DNA, 25 bp, Mus musculus
caggaaccccagaacatggacaatt

SEQ ID NO: 569643 - DNA, 25 bp, Mus musculus
caggaaccccagtacatggacaatt

SEQ ID NO: 569644 - DNA, 25 bp, Mus musculus
caggaaccctggatgtctccttgaa

SEQ ID NO: 569645 - DNA, 25 bp, Mus musculus
caggaaccctggttgtctccttgaa

SEQ ID NO: 569646 - DNA, 25 bp, Mus musculus
caggaaccgctgatgcttaagatcc

SEQ ID NO: 569647 - DNA, 25 bp, Mus musculus
caggaaccgctgttgcttaagatcc

SEQ ID NO: 569648 - DNA, 25 bp, Mus musculus
caggaaccggatccattcacctacg

SEQ ID NO: 569649 - DNA, 25 bp, Mus musculus
caggaaccggatgcattcacctacg

SEQ ID NO: 569650 - DNA, 25 bp, Mus musculus
caggaaccgtggctgctgagctaac

SEQ ID NO: 569651 - DNA, 25 bp, Mus musculus
caggaaccgtgggtgctgagctaac

SEQ ID NO: 569652 - DNA, 25 bp, Mus musculus
caggaacctgacaggcacagggcag

SEQ ID NO: 569653 - DNA, 25 bp, Mus musculus
caggaacctgacatacgttcaggaa

SEQ ID NO: 569654 - DNA, 25 bp, Mus musculus
caggaacctgactggcacagggcag

SEQ ID NO: 569655 - DNA, 25 bp, Mus musculus
caggaacctgacttacgttcaggaa

SEQ ID NO: 569656 - DNA, 25 bp, Mus musculus
caggaacctgagagatcggtttgcc

SEQ ID NO: 569657 - DNA, 25 bp, Mus musculus
caggaacctgagtgatcggtttgcc

SEQ ID NO: 569658 - DNA, 25 bp, Mus musculus
caggaaccttcaatgtgattgacat

SEQ ID NO: 569659 - DNA, 25 bp, Mus musculus
caggaaccttcattgtgattgacat

SEQ ID NO: 569660 - DNA, 25 bp, Mus musculus
caggaacctttcacaacagccatta

SEQ ID NO: 569661 - DNA, 25 bp, Mus musculus
caggaacctttctcaacagccatta

SEQ ID NO: 569662 - DNA, 25 bp, Mus musculus
caggaacgagttatatgatgacgcc

SEQ ID NO: 569663 - DNA, 25 bp, Mus musculus
caggaacgagttccagtgtagagac

SEQ ID NO: 569664 - DNA, 25 bp, Mus musculus
caggaacgagttgcagtgtagagac

SEQ ID NO: 569665 - DNA, 25 bp, Mus musculus
caggaacgagttttatgatgacgcc

SEQ ID NO: 569666 - DNA, 25 bp, Mus musculus
caggaacggagtctgtgagaacaca

SEQ ID NO: 569667 - DNA, 25 bp, Mus musculus
caggaacggagtgtgtgagaacaca

SEQ ID NO: 569668 - DNA, 25 bp, Mus musculus
caggaactatacctcgcccacaagg

SEQ ID NO: 569669 - DNA, 25 bp, Mus musculus
caggaactatacgtcgcccacaagg

SEQ ID NO: 569670 - DNA, 25 bp, Mus musculus
caggaactccacagttataacattt

SEQ ID NO: 569671 - DNA, 25 bp, Mus musculus
caggaactccactgttataacattt

SEQ ID NO: 569672 - DNA, 25 bp, Mus musculus
caggaactcccaaggtggctgctag

SEQ ID NO: 569673 - DNA, 25 bp, Mus musculus
caggaactcccatggtggctgctag

SEQ ID NO: 569674 - DNA, 25 bp, Mus musculus
caggaactccccacttttggacagg

SEQ ID NO: 569675 - DNA, 25 bp, Mus musculus
caggaactcccctcttttggacagg

SEQ ID NO: 569676 - DNA, 25 bp, Mus musculus
caggaactctggaatcccaacttga

SEQ ID NO: 569677 - DNA, 25 bp, Mus musculus
caggaactctggtatcccaacttga

SEQ ID NO: 569678 - DNA, 25 bp, Mus musculus
caggaactgctaatcaaccatggga

SEQ ID NO: 569679 - DNA, 25 bp, Mus musculus
caggaactgctattcaaccatggga

SEQ ID NO: 569680 - DNA, 25 bp, Mus musculus
caggaacttcctcttcagaaaggca

SEQ ID NO: 569681 - DNA, 25 bp, Mus musculus
caggaacttcctgttcagaaaggca

SEQ ID NO: 569682 - DNA, 25 bp, Mus musculus
caggaacttcggaggccaaagattc

SEQ ID NO: 569683 - DNA, 25 bp, Mus musculus
caggaacttcggtggccaaagattc

SEQ ID NO: 569684 - DNA, 25 bp, Mus musculus
caggaacttcttctttggctacagc

SEQ ID NO: 569685 - DNA, 25 bp, Mus musculus
caggaacttcttgtttggctacagc

SEQ ID NO: 569686 - DNA, 25 bp, Mus musculus
caggaagaactgacagacgaggaga

SEQ ID NO: 569687 - DNA, 25 bp, Mus musculus
caggaagaactgtcagacgaggaga

SEQ ID NO: 569688 - DNA, 25 bp, Mus musculus
caggaagaatctatctgatggatct

SEQ ID NO: 569689 - DNA, 25 bp, Mus musculus
caggaagaatctcttacttttcgaa

SEQ ID NO: 569690 - DNA, 25 bp, Mus musculus
caggaagaatctgttacttttcgaa

SEQ ID NO: 569691 - DNA, 25 bp, Mus musculus
caggaagaatctttctgatggatct

SEQ ID NO: 569692 - DNA, 25 bp, Mus musculus
caggaagacacacgttggagcaaaa

SEQ ID NO: 569693 - DNA, 25 bp, Mus musculus
caggaagacacaggttggagcaaaa

SEQ ID NO: 569694 - DNA, 25 bp, Mus musculus
caggaagactcactaaatcacacca

SEQ ID NO: 569695 - DNA, 25 bp, Mus musculus
caggaagactcagtaaatcacacca

SEQ ID NO: 569696 - DNA, 25 bp, Mus musculus
caggaagaggatcagcgcggatttt

SEQ ID NO: 569697 - DNA, 25 bp, Mus musculus
caggaagaggatgagcgcggatttt

SEQ ID NO: 569698 - DNA, 25 bp, Mus musculus
caggaagagtccctgttttagaaga

SEQ ID NO: 569699 - DNA, 25 bp, Mus musculus
caggaagagtccgtgttttagaaga

SEQ ID NO: 569700 - DNA, 25 bp, Mus musculus
caggaagataagattctggacagcc

SEQ ID NO: 569701 - DNA, 25 bp, Mus musculus
caggaagataagtttctggacagcc

SEQ ID NO: 569702 - DNA, 25 bp, Mus musculus
caggaagatccgcattatggcctcc

SEQ ID NO: 569703 - DNA, 25 bp, Mus musculus
caggaagatccggattatggcctcc

SEQ ID NO: 569704 - DNA, 25 bp, Mus musculus
caggaagatgcaatagcacaacagg

SEQ ID NO: 569705 - DNA, 25 bp, Mus musculus
caggaagatgcattagcacaacagg

SEQ ID NO: 569706 - DNA, 25 bp, Mus musculus
caggaagatgccatttattggacgt

SEQ ID NO: 569707 - DNA, 25 bp, Mus musculus
caggaagatgccttttattggacgt

SEQ ID NO: 569708 - DNA, 25 bp, Mus musculus
caggaagcaggacagaactttacag

SEQ ID NO: 569709 - DNA, 25 bp, Mus musculus
caggaagcaggagagaactttacag

SEQ ID NO: 569710 - DNA, 25 bp, Mus musculus
caggaagccacaaccgctggaagga

SEQ ID NO: 569711 - DNA, 25 bp, Mus musculus
caggaagccacatccgctggaagga

SEQ ID NO: 569712 - DNA, 25 bp, Mus musculus
caggaagccagacgccggaagaaaa

SEQ ID NO: 569713 - DNA, 25 bp, Mus musculus
caggaagccagaggccggaagaaaa

SEQ ID NO: 569714 - DNA, 25 bp, Mus musculus
caggaagcccaaaaagagacaggac

SEQ ID NO: 569715 - DNA, 25 bp, Mus musculus
caggaagcccaataagagacaggac

SEQ ID NO: 569716 - DNA, 25 bp, Mus musculus
caggaagccctcaagcaaggctggc

SEQ ID NO: 569717 - DNA, 25 bp, Mus musculus
caggaagccctcatcacagtgaaag

SEQ ID NO: 569718 - DNA, 25 bp, Mus musculus
caggaagccctctagcaaggctggc

SEQ ID NO: 569719 - DNA, 25 bp, Mus musculus
caggaagccctcttcacagtgaaag

SEQ ID NO: 569720 - DNA, 25 bp, Mus musculus
caggaagccgttacaaggaccagac

SEQ ID NO: 569721 - DNA, 25 bp, Mus musculus
caggaagccgtttcaaggaccagac

SEQ ID NO: 569722 - DNA, 25 bp, Mus musculus
caggaagcctcacgcagagcgctgt

SEQ ID NO: 569723 - DNA, 25 bp, Mus musculus
caggaagcctcaggcagagcgctgt

SEQ ID NO: 569724 - DNA, 25 bp, Mus musculus
caggaagcctggatgtactacaagc

SEQ ID NO: 569725 - DNA, 25 bp, Mus musculus
caggaagcctggttgtactacaagc

SEQ ID NO: 569726 - DNA, 25 bp, Mus musculus
caggaagcctgtccatgacgaccat

SEQ ID NO: 569727 - DNA, 25 bp, Mus musculus
caggaagcctgtgcatgacgaccat

SEQ ID NO: 569728 - DNA, 25 bp, Mus musculus
caggaagcctttcatcttataagta

SEQ ID NO: 569729 - DNA, 25 bp, Mus musculus
caggaagcctttgatcttataagta

SEQ ID NO: 569730 - DNA, 25 bp, Mus musculus
caggaagcgcagagtatcgatgaaa

SEQ ID NO: 569731 - DNA, 25 bp, Mus musculus
caggaagcgcagtgtatcgatgaaa

SEQ ID NO: 569732 - DNA, 25 bp, Mus musculus
caggaagcggaaccagtttccattg

SEQ ID NO: 569733 - DNA, 25 bp, Mus musculus
caggaagcggaagcagtttccattg

SEQ ID NO: 569734 - DNA, 25 bp, Mus musculus
caggaagctgctacaagctgtggcc

SEQ ID NO: 569735 - DNA, 25 bp, Mus musculus
caggaagctgcttcaagctgtggcc

SEQ ID NO: 569736 - DNA, 25 bp, Mus musculus
caggaagctttcactatggcccaca

SEQ ID NO: 569737 - DNA, 25 bp, Mus musculus
caggaagctttctctatggcccaca

SEQ ID NO: 569738 - DNA, 25 bp, Mus musculus
caggaagctttgcagatgagccgaa

SEQ ID NO: 569739 - DNA, 25 bp, Mus musculus
caggaagctttggagatgagccgaa

SEQ ID NO: 569740 - DNA, 25 bp, Mus musculus
caggaaggactcctggagcactgca

SEQ ID NO: 569741 - DNA, 25 bp, Mus musculus
caggaaggactcgtggagcactgca

SEQ ID NO: 569742 - DNA, 25 bp, Mus musculus
caggaaggaggtcttgtcattaata

SEQ ID NO: 569743 - DNA, 25 bp, Mus musculus
caggaaggaggtgttgtcattaata

SEQ ID NO: 569744 - DNA, 25 bp, Mus musculus
caggaaggattcacaacaggttttc

SEQ ID NO: 569745 - DNA, 25 bp, Mus musculus
caggaaggattctcaacaggttttc

SEQ ID NO: 569746 - DNA, 25 bp, Mus musculus
caggaaggcgctcttgactctgctg

SEQ ID NO: 569747 - DNA, 25 bp, Mus musculus
caggaaggcgctgttgactctgctg

SEQ ID NO: 569748 - DNA, 25 bp, Mus musculus
caggaaggctcacatgtgctgtgct

SEQ ID NO: 569749 - DNA, 25 bp, Mus musculus
caggaaggctcagatgtgctgtgct

SEQ ID NO: 569750 - DNA, 25 bp, Mus musculus
caggaaggctggacaagaactacga

SEQ ID NO: 569751 - DNA, 25 bp, Mus musculus
caggaaggctggtcaagaactacga

SEQ ID NO: 569752 - DNA, 25 bp, Mus musculus
caggaaggtgacactgattctcata

SEQ ID NO: 569753 - DNA, 25 bp, Mus musculus
caggaaggtgactctgattctcata

SEQ ID NO: 569754 - DNA, 25 bp, Mus musculus
caggaaggtgagagcctcacgctga

SEQ ID NO: 569755 - DNA, 25 bp, Mus musculus
caggaaggtgagtgcctcacgctga

SEQ ID NO: 569756 - DNA, 25 bp, Mus musculus
caggaaggttacaagccagggcctc

SEQ ID NO: 569757 - DNA, 25 bp, Mus musculus
caggaaggttactagccagggcctc

SEQ ID NO: 569758 - DNA, 25 bp, Mus musculus
caggaagtacgactgaggcagctca

SEQ ID NO: 569759 - DNA, 25 bp, Mus musculus
caggaagtacgagtgaggcagctca

SEQ ID NO: 569760 - DNA, 25 bp, Mus musculus
caggaagtagccaatgacttgctgg

SEQ ID NO: 569761 - DNA, 25 bp, Mus musculus
caggaagtagcctatgacttgctgg

SEQ ID NO: 569762 - DNA, 25 bp, Mus musculus
caggaagtcaacactgagccgtatg

SEQ ID NO: 569763 - DNA, 25 bp, Mus musculus
caggaagtcaactctgagccgtatg

SEQ ID NO: 569764 - DNA, 25 bp, Mus musculus
caggaagtcactaaatgccggtgct

SEQ ID NO: 569765 - DNA, 25 bp, Mus musculus
caggaagtcacttaatgccggtgct

SEQ ID NO: 569766 - DNA, 25 bp, Mus musculus
caggaagtctgcacaggcaggcagg

SEQ ID NO: 569767 - DNA, 25 bp, Mus musculus
caggaagtctgctcaggcaggcagg

SEQ ID NO: 569768 - DNA, 25 bp, Mus musculus
caggaagtctggactgaaacagtct

SEQ ID NO: 569769 - DNA, 25 bp, Mus musculus
caggaagtctggtctgaaacagtct

SEQ ID NO: 569770 - DNA, 25 bp, Mus musculus
caggaagtgaaaatgtggtgccccg

SEQ ID NO: 569771 - DNA, 25 bp, Mus musculus
caggaagtgaaattgtggtgccccg

SEQ ID NO: 569772 - DNA, 25 bp, Mus musculus
caggaagtgatcaccctgccctctg

SEQ ID NO: 569773 - DNA, 25 bp, Mus musculus
caggaagtgatctccctgccctctg

SEQ ID NO: 569774 - DNA, 25 bp, Mus musculus
caggaagttctcactcgaggtcggc

SEQ ID NO: 569775 - DNA, 25 bp, Mus musculus
caggaagttctctctcgaggtcggc

SEQ ID NO: 569776 - DNA, 25 bp, Mus musculus
caggaagttctgcacatgaggaaca

SEQ ID NO: 569777 - DNA, 25 bp, Mus musculus
caggaagttctggacatgaggaaca

SEQ ID NO: 569778 - DNA, 25 bp, Mus musculus
caggaatacaaactcagacttggca

SEQ ID NO: 569779 - DNA, 25 bp, Mus musculus
caggaatacaaagtcagacttggca

SEQ ID NO: 569780 - DNA, 25 bp, Mus musculus
caggaatactatcacaggaaggctc

SEQ ID NO: 569781 - DNA, 25 bp, Mus musculus
caggaatactatgacaggaaggctc

SEQ ID NO: 569782 - DNA, 25 bp, Mus musculus
caggaatatatccagcagcctgttg

SEQ ID NO: 569783 - DNA, 25 bp, Mus musculus
caggaatatatcgagcagcctgttg

SEQ ID NO: 569784 - DNA, 25 bp, Mus musculus
caggaatattaccagcagtggagtc

SEQ ID NO: 569785 - DNA, 25 bp, Mus musculus
caggaatattacgagcagtggagtc

SEQ ID NO: 569786 - DNA, 25 bp, Mus musculus
caggaatcaagaaactcagccaggt

SEQ ID NO: 569787 - DNA, 25 bp, Mus musculus
caggaatcaagatactcagccaggt

SEQ ID NO: 569788 - DNA, 25 bp, Mus musculus
caggaatcacggaccaacaagacgt

SEQ ID NO: 569789 - DNA, 25 bp, Mus musculus
caggaatcacggtccaacaagacgt

SEQ ID NO: 569790 - DNA, 25 bp, Mus musculus
caggaatccctcaccaactggtact

SEQ ID NO: 569791 - DNA, 25 bp, Mus musculus
caggaatccctctccaactggtact

SEQ ID NO: 569792 - DNA, 25 bp, Mus musculus
caggaatcgcggctgaagttctcca

SEQ ID NO: 569793 - DNA, 25 bp, Mus musculus
caggaatcgcgggtgaagttctcca

SEQ ID NO: 569794 - DNA, 25 bp, Mus musculus
caggaatctatcagcaaggaggagc

SEQ ID NO: 569795 - DNA, 25 bp, Mus musculus
caggaatctatctgcaaggaggagc

SEQ ID NO: 569796 - DNA, 25 bp, Mus musculus
caggaatctgaacaaagaccaaaat

SEQ ID NO: 569797 - DNA, 25 bp, Mus musculus
caggaatctgaagaaagaccaaaat

SEQ ID NO: 569798 - DNA, 25 bp, Mus musculus
caggaatctgggataattactgtgt

SEQ ID NO: 569799 - DNA, 25 bp, Mus musculus
caggaatctgggttaattactgtgt

SEQ ID NO: 569800 - DNA, 25 bp, Mus musculus
caggaatctgtaataacaatgaagt

SEQ ID NO: 569801 - DNA, 25 bp, Mus musculus
caggaatctgtattaacaatgaagt

SEQ ID NO: 569802 - DNA, 25 bp, Mus musculus
caggaatgcaacaccacagctaaca

SEQ ID NO: 569803 - DNA, 25 bp, Mus musculus
caggaatgcaactccacagctaaca

SEQ ID NO: 569804 - DNA, 25 bp, Mus musculus
caggaatgcactctgtctacacaca

SEQ ID NO: 569805 - DNA, 25 bp, Mus musculus
caggaatgcactgtgtctacacaca

SEQ ID NO: 569806 - DNA, 25 bp, Mus musculus
caggaatgcctcatccctaaggcta

SEQ ID NO: 569807 - DNA, 25 bp, Mus musculus
caggaatgcctcttccctaaggcta

SEQ ID NO: 569808 - DNA, 25 bp, Mus musculus
caggaatgctgacgaaaactcggcc

SEQ ID NO: 569809 - DNA, 25 bp, Mus musculus
caggaatgctgaggaaaactcggcc

SEQ ID NO: 569810 - DNA, 25 bp, Mus musculus
caggaatggcagcacctgaatgaag

SEQ ID NO: 569811 - DNA, 25 bp, Mus musculus
caggaatggcaggacctgaatgaag

SEQ ID NO: 569812 - DNA, 25 bp, Mus musculus
caggaatggcttacatcgagcgcat

SEQ ID NO: 569813 - DNA, 25 bp, Mus musculus
caggaatggctttcatcgagcgcat

SEQ ID NO: 569814 - DNA, 25 bp, Mus musculus
caggaatggtccctccaatgatgcc

SEQ ID NO: 569815 - DNA, 25 bp, Mus musculus
caggaatggtccgtccaatgatgcc

SEQ ID NO: 569816 - DNA, 25 bp, Mus musculus
caggaatggtgcctatcagcaggat

SEQ ID NO: 569817 - DNA, 25 bp, Mus musculus
caggaatggtgcgtatcagcaggat

SEQ ID NO: 569818 - DNA, 25 bp, Mus musculus
caggaatggttaagaatttgaccga

SEQ ID NO: 569819 - DNA, 25 bp, Mus musculus
caggaatggttatgaatttgaccga

SEQ ID NO: 569820 - DNA, 25 bp, Mus musculus
caggaatgtcgaagaaaatgccacg

SEQ ID NO: 569821 - DNA, 25 bp, Mus musculus
caggaatgtcgatgaaaatgccacg

SEQ ID NO: 569822 - DNA, 25 bp, Mus musculus
caggaatgtgccaacatctatggct

SEQ ID NO: 569823 - DNA, 25 bp, Mus musculus
caggaatgtgcctacatctatggct

SEQ ID NO: 569824 - DNA, 25 bp, Mus musculus
caggaattaggacattcttagcctc

SEQ ID NO: 569825 - DNA, 25 bp, Mus musculus
caggaattaggagattcttagcctc

SEQ ID NO: 569826 - DNA, 25 bp, Mus musculus
caggaattcaaacagaagggctctg

SEQ ID NO: 569827 - DNA, 25 bp, Mus musculus
caggaattcaaagagaagggctctg

SEQ ID NO: 569828 - DNA, 25 bp, Mus musculus
caggaattcaagcatcgatctggaa

SEQ ID NO: 569829 - DNA, 25 bp, Mus musculus
caggaattcaaggatcgatctggaa

SEQ ID NO: 569830 - DNA, 25 bp, Mus musculus
caggaattccttcgctgtctaatgg

SEQ ID NO: 569831 - DNA, 25 bp, Mus musculus
caggaattccttggctgtctaatgg

SEQ ID NO: 569832 - DNA, 25 bp, Mus musculus
caggaattgcccaggcctgcaagta

SEQ ID NO: 569833 - DNA, 25 bp, Mus musculus
caggaattgccctggcctgcaagta

SEQ ID NO: 569834 - DNA, 25 bp, Mus musculus
caggaattgctgagcgataaatcgg

SEQ ID NO: 569835 - DNA, 25 bp, Mus musculus
caggaattgctgtgcgataaatcgg

SEQ ID NO: 569836 - DNA, 25 bp, Mus musculus
caggaattgcttctctgctccaggc

SEQ ID NO: 569837 - DNA, 25 bp, Mus musculus
caggaattgcttgtctgctccaggc

SEQ ID NO: 569838 - DNA, 25 bp, Mus musculus
caggaattggctctgcaacagaagc

SEQ ID NO: 569839 - DNA, 25 bp, Mus musculus
caggaattggctgtgcaacagaagc

SEQ ID NO: 569840 - DNA, 25 bp, Mus musculus
caggaatttaaacgttcaacctctg

SEQ ID NO: 569841 - DNA, 25 bp, Mus musculus
caggaatttaaaggttcaacctctg

SEQ ID NO: 569842 - DNA, 25 bp, Mus musculus
caggaatttataatggaagccagca

SEQ ID NO: 569843 - DNA, 25 bp, Mus musculus
caggaatttatattggaagccagca

SEQ ID NO: 569844 - DNA, 25 bp, Mus musculus
caggaatttcttccttggagctcag

SEQ ID NO: 569845 - DNA, 25 bp, Mus musculus
caggaatttcttgcttggagctcag

SEQ ID NO: 569846 - DNA, 25 bp, Mus musculus
caggacaaaattagacctttgtggc

SEQ ID NO: 569847 - DNA, 25 bp, Mus musculus
caggacaaaatttgacctttgtggc

SEQ ID NO: 569848 - DNA, 25 bp, Mus musculus
caggacaaaggccccattgtagaga

SEQ ID NO: 569849 - DNA, 25 bp, Mus musculus
caggacaaaggcgccattgtagaga

SEQ ID NO: 569850 - DNA, 25 bp, Mus musculus
caggacaaattgatgcagacaacaa

SEQ ID NO: 569851 - DNA, 25 bp, Mus musculus
caggacaaattgctgtggaagctca

SEQ ID NO: 569852 - DNA, 25 bp, Mus musculus
caggacaaattggtgtggaagctca

SEQ ID NO: 569853 - DNA, 25 bp, Mus musculus
caggacaaattgttgcagacaacaa

SEQ ID NO: 569854 - DNA, 25 bp, Mus musculus
caggacaacccaactaccagtggct

SEQ ID NO: 569855 - DNA, 25 bp, Mus musculus
caggacaacccatctaccagtggct

SEQ ID NO: 569856 - DNA, 25 bp, Mus musculus
caggacaactcgagatgagaaacgg

SEQ ID NO: 569857 - DNA, 25 bp, Mus musculus
caggacaactcgtgatgagaaacgg

SEQ ID NO: 569858 - DNA, 25 bp, Mus musculus
caggacaagattcggcccctctgga

SEQ ID NO: 569859 - DNA, 25 bp, Mus musculus
caggacaagattgggcccctctgga

SEQ ID NO: 569860 - DNA, 25 bp, Mus musculus
caggacaagctgcttggttacatca

SEQ ID NO: 569861 - DNA, 25 bp, Mus musculus
caggacaagctggttggttacatca

SEQ ID NO: 569862 - DNA, 25 bp, Mus musculus
caggacaaggatctgactgatgaat

SEQ ID NO: 569863 - DNA, 25 bp, Mus musculus
caggacaaggatgtgactgatgaat

SEQ ID NO: 569864 - DNA, 25 bp, Mus musculus
caggacaagttccatgtgtctctgc

SEQ ID NO: 569865 - DNA, 25 bp, Mus musculus
caggacaagttcgatgtgtctctgc

SEQ ID NO: 569866 - DNA, 25 bp, Mus musculus
caggacacaggccagaaatgctccg

SEQ ID NO: 569867 - DNA, 25 bp, Mus musculus
caggacacaggcgagaaatgctccg

SEQ ID NO: 569868 - DNA, 25 bp, Mus musculus
caggacacataccagatcatgaagg

SEQ ID NO: 569869 - DNA, 25 bp, Mus musculus
caggacacatacgagatcatgaagg

SEQ ID NO: 569870 - DNA, 25 bp, Mus musculus
caggacaccttgaaatgcggaagca

SEQ ID NO: 569871 - DNA, 25 bp, Mus musculus
caggacaccttgtaatgcggaagca

SEQ ID NO: 569872 - DNA, 25 bp, Mus musculus
caggacacgcttctaagagtaatgc

SEQ ID NO: 569873 - DNA, 25 bp, Mus musculus
caggacacgcttgtaagagtaatgc

SEQ ID NO: 569874 - DNA, 25 bp, Mus musculus
caggacacggaaccgcaagtcagag

SEQ ID NO: 569875 - DNA, 25 bp, Mus musculus
caggacacggaagcgcaagtcagag

SEQ ID NO: 569876 - DNA, 25 bp, Mus musculus
caggacagaaccatctgaaggagat

SEQ ID NO: 569877 - DNA, 25 bp, Mus musculus
caggacagaaccttctgaaggagat

SEQ ID NO: 569878 - DNA, 25 bp, Mus musculus
caggacagactccacacatggccat

SEQ ID NO: 569879 - DNA, 25 bp, Mus musculus
caggacagactcgacacatggccat

SEQ ID NO: 569880 - DNA, 25 bp, Mus musculus
caggacagctgtatgctcatcaacc

SEQ ID NO: 569881 - DNA, 25 bp, Mus musculus
caggacagctgtttgctcatcaacc

SEQ ID NO: 569882 - DNA, 25 bp, Mus musculus
caggacaggaaaagacgagaagaaa

SEQ ID NO: 569883 - DNA, 25 bp, Mus musculus
caggacaggaaatgacgagaagaaa

SEQ ID NO: 569884 - DNA, 25 bp, Mus musculus
caggacaggagacctctctgcagtg

SEQ ID NO: 569885 - DNA, 25 bp, Mus musculus
caggacaggagagctctctgcagtg

SEQ ID NO: 569886 - DNA, 25 bp, Mus musculus
caggacaggagcaaaccgagctttc

SEQ ID NO: 569887 - DNA, 25 bp, Mus musculus
caggacaggagctaaccgagctttc

SEQ ID NO: 569888 - DNA, 25 bp, Mus musculus
caggacagggagcttggacagggtt

SEQ ID NO: 569889 - DNA, 25 bp, Mus musculus
caggacagggaggttggacagggtt

SEQ ID NO: 569890 - DNA, 25 bp, Mus musculus
caggacagtgacagtaaggactctc

SEQ ID NO: 569891 - DNA, 25 bp, Mus musculus
caggacagtgactgtaaggactctc

SEQ ID NO: 569892 - DNA, 25 bp, Mus musculus
caggacagtttgctaccagtggaaa

SEQ ID NO: 569893 - DNA, 25 bp, Mus musculus
caggacagtttggtaccagtggaaa

SEQ ID NO: 569894 - DNA, 25 bp, Mus musculus
caggacatcattcccatcttgggta

SEQ ID NO: 569895 - DNA, 25 bp, Mus musculus
caggacatcattgccatcttgggta

SEQ ID NO: 569896 - DNA, 25 bp, Mus musculus
caggacatcgagaatgcgtacaaga

SEQ ID NO: 569897 - DNA, 25 bp, Mus musculus
caggacatcgagtatgcgtacaaga

SEQ ID NO: 569898 - DNA, 25 bp, Mus musculus
caggacatgattaatgaggtggatg

SEQ ID NO: 569899 - DNA, 25 bp, Mus musculus
caggacatgatttatgaggtggatg

SEQ ID NO: 569900 - DNA, 25 bp, Mus musculus
caggacatgtgtaaattgcttgaga

SEQ ID NO: 569901 - DNA, 25 bp, Mus musculus
caggacatgtgttaattgcttgaga

SEQ ID NO: 569902 - DNA, 25 bp, Mus musculus
caggacattaagaacgtcgtgctgc

SEQ ID NO: 569903 - DNA, 25 bp, Mus musculus
caggacattaagtacgtcgtgctgc

SEQ ID NO: 569904 - DNA, 25 bp, Mus musculus
caggacattactcccgtgcgcctta

SEQ ID NO: 569905 - DNA, 25 bp, Mus musculus
caggacattactgccgtgcgcctta

SEQ ID NO: 569906 - DNA, 25 bp, Mus musculus
caggacattaggagtcttcccacag

SEQ ID NO: 569907 - DNA, 25 bp, Mus musculus
caggacattaggtgtcttcccacag

SEQ ID NO: 569908 - DNA, 25 bp, Mus musculus
caggacattcgcataagtctctgga

SEQ ID NO: 569909 - DNA, 25 bp, Mus musculus
caggacattcgcttaagtctctgga

SEQ ID NO: 569910 - DNA, 25 bp, Mus musculus
caggaccaacgcaacagtgtgcaga

SEQ ID NO: 569911 - DNA, 25 bp, Mus musculus
caggaccaacgctacagtgtgcaga

SEQ ID NO: 569912 - DNA, 25 bp, Mus musculus
caggaccacctgaagctgttcaaga

SEQ ID NO: 569913 - DNA, 25 bp, Mus musculus
caggaccacctgtagctgttcaaga

SEQ ID NO: 569914 - DNA, 25 bp, Mus musculus
caggaccacgagaagctgttcgagc

SEQ ID NO: 569915 - DNA, 25 bp, Mus musculus
caggaccacgagtagctgttcgagc

SEQ ID NO: 569916 - DNA, 25 bp, Mus musculus
caggaccactgcaataaaatagaac

SEQ ID NO: 569917 - DNA, 25 bp, Mus musculus
caggaccactgctataaaatagaac

SEQ ID NO: 569918 - DNA, 25 bp, Mus musculus
caggaccaggccatacagatgaagc

SEQ ID NO: 569919 - DNA, 25 bp, Mus musculus
caggaccaggccttacagatgaagc

SEQ ID NO: 569920 - DNA, 25 bp, Mus musculus
caggaccagttgaacagtgtggagc

SEQ ID NO: 569921 - DNA, 25 bp, Mus musculus
caggaccagttgtacagtgtggagc

SEQ ID NO: 569922 - DNA, 25 bp, Mus musculus
caggaccatcagattgagtttggac

SEQ ID NO: 569923 - DNA, 25 bp, Mus musculus
caggaccatcagtttgagtttggac

SEQ ID NO: 569924 - DNA, 25 bp, Mus musculus
caggaccatcctatatgacatgtac

SEQ ID NO: 569925 - DNA, 25 bp, Mus musculus
caggaccatcctttatgacatgtac

SEQ ID NO: 569926 - DNA, 25 bp, Mus musculus
caggaccatggcatcttcccatcag

SEQ ID NO: 569927 - DNA, 25 bp, Mus musculus
caggaccatggcttcttcccatcag

SEQ ID NO: 569928 - DNA, 25 bp, Mus musculus
caggacccactgcacttagtaggcg

SEQ ID NO: 569929 - DNA, 25 bp, Mus musculus
caggacccactggacttagtaggcg

SEQ ID NO: 569930 - DNA, 25 bp, Mus musculus
caggaccccttaatctctgttggag

SEQ ID NO: 569931 - DNA, 25 bp, Mus musculus
caggaccccttattctctgttggag

SEQ ID NO: 569932 - DNA, 25 bp, Mus musculus
caggacccctttcgtgctaggcaag

SEQ ID NO: 569933 - DNA, 25 bp, Mus musculus
caggacccctttggtgctaggcaag

SEQ ID NO: 569934 - DNA, 25 bp, Mus musculus
caggacccgtgactgaggttcgcac

SEQ ID NO: 569935 - DNA, 25 bp, Mus musculus
caggacccgtgagtgaggttcgcac

SEQ ID NO: 569936 - DNA, 25 bp, Mus musculus
caggacccgtggatgcaggagttca

SEQ ID NO: 569937 - DNA, 25 bp, Mus musculus
caggacccgtggttgcaggagttca

SEQ ID NO: 569938 - DNA, 25 bp, Mus musculus
caggaccctgcaaaccagcggataa

SEQ ID NO: 569939 - DNA, 25 bp, Mus musculus
caggaccctgcataccagcggataa

SEQ ID NO: 569940 - DNA, 25 bp, Mus musculus
caggaccctggcagttacccagaga

SEQ ID NO: 569941 - DNA, 25 bp, Mus musculus
caggaccctggctgttacccagaga

SEQ ID NO: 569942 - DNA, 25 bp, Mus musculus
caggaccctgttctagagtcttggg

SEQ ID NO: 569943 - DNA, 25 bp, Mus musculus
caggaccctgttgtagagtcttggg

SEQ ID NO: 569944 - DNA, 25 bp, Mus musculus
caggaccgtcagagacctcgttata

SEQ ID NO: 569945 - DNA, 25 bp, Mus musculus
caggaccgtcagtgacctcgttata

SEQ ID NO: 569946 - DNA, 25 bp, Mus musculus
caggacctgaaacatcacatgcgag

SEQ ID NO: 569947 - DNA, 25 bp, Mus musculus
caggacctgaaagatcacatgcgag

SEQ ID NO: 569948 - DNA, 25 bp, Mus musculus
caggacctgagtcagtcttgcttca

SEQ ID NO: 569949 - DNA, 25 bp, Mus musculus
caggacctgagtgagtcttgcttca

SEQ ID NO: 569950 - DNA, 25 bp, Mus musculus
caggacctgctacagcggctgctgt

SEQ ID NO: 569951 - DNA, 25 bp, Mus musculus
caggacctgctagagcggctgctgt

SEQ ID NO: 569952 - DNA, 25 bp, Mus musculus
caggacctggatatgctgccctggg

SEQ ID NO: 569953 - DNA, 25 bp, Mus musculus
caggacctggatttgctgccctggg

SEQ ID NO: 569954 - DNA, 25 bp, Mus musculus
caggaccttcatctcctccagatat

SEQ ID NO: 569955 - DNA, 25 bp, Mus musculus
caggaccttcatgtcctccagatat

SEQ ID NO: 569956 - DNA, 25 bp, Mus musculus
caggaccttccaactcatcgcggag

SEQ ID NO: 569957 - DNA, 25 bp, Mus musculus
caggaccttccatctcatcgcggag

SEQ ID NO: 569958 - DNA, 25 bp, Mus musculus
caggaccttcctcagtatcgtaaag

SEQ ID NO: 569959 - DNA, 25 bp, Mus musculus
caggaccttcctgagtatcgtaaag

SEQ ID NO: 569960 - DNA, 25 bp, Mus musculus
caggaccttgctcgcagctatggca

SEQ ID NO: 569961 - DNA, 25 bp, Mus musculus
caggaccttgctggcagctatggca

SEQ ID NO: 569962 - DNA, 25 bp, Mus musculus
caggacctttgtccaagactgatgg

SEQ ID NO: 569963 - DNA, 25 bp, Mus musculus
caggacctttgtgcaagactgatgg

SEQ ID NO: 569964 - DNA, 25 bp, Mus musculus
caggacgacattcaagattgcttga

SEQ ID NO: 569965 - DNA, 25 bp, Mus musculus
caggacgacattgaagattgcttga

SEQ ID NO: 569966 - DNA, 25 bp, Mus musculus
caggacgacgctatggtggactact

SEQ ID NO: 569967 - DNA, 25 bp, Mus musculus
caggacgacgctttggtggactact

SEQ ID NO: 569968 - DNA, 25 bp, Mus musculus
caggacgaggcacaagaagacgtta

SEQ ID NO: 569969 - DNA, 25 bp, Mus musculus
caggacgaggcagaagaagacgtta

SEQ ID NO: 569970 - DNA, 25 bp, Mus musculus
caggacgatgagatacgcttgaaga

SEQ ID NO: 569971 - DNA, 25 bp, Mus musculus
caggacgatgagttacgcttgaaga

SEQ ID NO: 569972 - DNA, 25 bp, Mus musculus
caggacgatgctcagtctaaagtca

SEQ ID NO: 569973 - DNA, 25 bp, Mus musculus
caggacgatgctgagtctaaagtca

SEQ ID NO: 569974 - DNA, 25 bp, Mus musculus
caggacgccggcacttctccaggaa

SEQ ID NO: 569975 - DNA, 25 bp, Mus musculus
caggacgccggcctgtacacagctg

SEQ ID NO: 569976 - DNA, 25 bp, Mus musculus
caggacgccggcgtgtacacagctg

SEQ ID NO: 569977 - DNA, 25 bp, Mus musculus
caggacgccggctcttctccaggaa

SEQ ID NO: 569978 - DNA, 25 bp, Mus musculus
caggacgcgcggcagaatctttccc

SEQ ID NO: 569979 - DNA, 25 bp, Mus musculus
caggacgcgcgggagaatctttccc

SEQ ID NO: 569980 - DNA, 25 bp, Mus musculus
caggacggaattacactttctggca

SEQ ID NO: 569981 - DNA, 25 bp, Mus musculus
caggacggaatttcactttctggca

SEQ ID NO: 569982 - DNA, 25 bp, Mus musculus
caggacggacttcgcttttggacaa

SEQ ID NO: 569983 - DNA, 25 bp, Mus musculus
caggacggacttggcttttggacaa

SEQ ID NO: 569984 - DNA, 25 bp, Mus musculus
caggacggagtaacaccaagtcaga

SEQ ID NO: 569985 - DNA, 25 bp, Mus musculus
caggacggagtatcaccaagtcaga

SEQ ID NO: 569986 - DNA, 25 bp, Mus musculus
caggacggccgcatcttcatcggga

SEQ ID NO: 569987 - DNA, 25 bp, Mus musculus
caggacggccgcttcttcatcggga

SEQ ID NO: 569988 - DNA, 25 bp, Mus musculus
caggacggtgtgcatggtttccaat

SEQ ID NO: 569989 - DNA, 25 bp, Mus musculus
caggacggtgtggatggtttccaat

SEQ ID NO: 569990 - DNA, 25 bp, Mus musculus
caggacgtagttctcacagcatgac

SEQ ID NO: 569991 - DNA, 25 bp, Mus musculus
caggacgtagttgtcacagcatgac

SEQ ID NO: 569992 - DNA, 25 bp, Mus musculus
caggacgtgcttcgatccagagtca

SEQ ID NO: 569993 - DNA, 25 bp, Mus musculus
caggacgtgcttggatccagagtca

SEQ ID NO: 569994 - DNA, 25 bp, Mus musculus
caggacgtgtcaaagcttttgctca

SEQ ID NO: 569995 - DNA, 25 bp, Mus musculus
caggacgtgtcatagcttttgctca

SEQ ID NO: 569996 - DNA, 25 bp, Mus musculus
caggactacttcaccctggtccgta

SEQ ID NO: 569997 - DNA, 25 bp, Mus musculus
caggactacttctccctggtccgta

SEQ ID NO: 569998 - DNA, 25 bp, Mus musculus
caggactatactatgctgatcaaca

SEQ ID NO: 569999 - DNA, 25 bp, Mus musculus
caggactatactttgctgatcaaca

SEQ ID NO: 570000 - DNA, 25 bp, Mus musculus
caggactatttaagagcaatcaggt

SEQ ID NO: 570001 - DNA, 25 bp, Mus musculus
caggactatttatgagcaatcaggt

SEQ ID NO: 570002 - DNA, 25 bp, Mus musculus
caggactcgggcaaaacggaaatct

SEQ ID NO: 570003 - DNA, 25 bp, Mus musculus
caggactcgggctaaacggaaatct

SEQ ID NO: 570004 - DNA, 25 bp, Mus musculus
caggactctgtgactgagaggccac

SEQ ID NO: 570005 - DNA, 25 bp, Mus musculus
caggactctgtgtctgagaggccac

SEQ ID NO: 570006 - DNA, 25 bp, Mus musculus
caggactgaatgaagatgaggtcgc

SEQ ID NO: 570007 - DNA, 25 bp, Mus musculus
caggactgaatgtagatgaggtcgc

SEQ ID NO: 570008 - DNA, 25 bp, Mus musculus
caggactgacttatctactcgtgca

SEQ ID NO: 570009 - DNA, 25 bp, Mus musculus
caggactgacttttctactcgtgca

SEQ ID NO: 570010 - DNA, 25 bp, Mus musculus
caggactgatccatatggaagaaga

SEQ ID NO: 570011 - DNA, 25 bp, Mus musculus
caggactgatccttatggaagaaga

SEQ ID NO: 570012 - DNA, 25 bp, Mus musculus
caggactgcctgctatagtgacgcc

SEQ ID NO: 570013 - DNA, 25 bp, Mus musculus
caggactgcctggtatagtgacgcc

SEQ ID NO: 570014 - DNA, 25 bp, Mus musculus
caggactgcgggatgtcgcatcaga

SEQ ID NO: 570015 - DNA, 25 bp, Mus musculus
caggactgcgggttgtcgcatcaga

SEQ ID NO: 570016 - DNA, 25 bp, Mus musculus
caggactgctgaaggctcctccaca

SEQ ID NO: 570017 - DNA, 25 bp, Mus musculus
caggactgctgatggctcctccaca

SEQ ID NO: 570018 - DNA, 25 bp, Mus musculus
caggactgctgcctactgcaggtca

SEQ ID NO: 570019 - DNA, 25 bp, Mus musculus
caggactgctgcgtactgcaggtca

SEQ ID NO: 570020 - DNA, 25 bp, Mus musculus
caggactgcttcattgctgcaactc

SEQ ID NO: 570021 - DNA, 25 bp, Mus musculus
caggactgcttctttgctgcaactc

SEQ ID NO: 570022 - DNA, 25 bp, Mus musculus
caggactggacgacactcgaagggc

SEQ ID NO: 570023 - DNA, 25 bp, Mus musculus
caggactggacgtcactcgaagggc

SEQ ID NO: 570024 - DNA, 25 bp, Mus musculus
caggactggctcaatggcaaggagt

SEQ ID NO: 570025 - DNA, 25 bp, Mus musculus
caggactggctcattcttagcaaca

SEQ ID NO: 570026 - DNA, 25 bp, Mus musculus
caggactggctctatggcaaggagt

SEQ ID NO: 570027 - DNA, 25 bp, Mus musculus
caggactggctctttcttagcaaca

SEQ ID NO: 570028 - DNA, 25 bp, Mus musculus
caggactgggcaccctgctcgatgc

SEQ ID NO: 570029 - DNA, 25 bp, Mus musculus
caggactgggcagcctgctcgatgc

SEQ ID NO: 570030 - DNA, 25 bp, Mus musculus
caggactggtgtactgctgaatgca

SEQ ID NO: 570031 - DNA, 25 bp, Mus musculus
caggactggtgttctgctgaatgca

SEQ ID NO: 570032 - DNA, 25 bp, Mus musculus
caggactgtctcagtagtctcagga

SEQ ID NO: 570033 - DNA, 25 bp, Mus musculus
caggactgtctctgtagtctcagga

SEQ ID NO: 570034 - DNA, 25 bp, Mus musculus
caggactgtgcaactttgtggagag

SEQ ID NO: 570035 - DNA, 25 bp, Mus musculus
caggactgtgcatctttgtggagag

SEQ ID NO: 570036 - DNA, 25 bp, Mus musculus
caggactgttctagtccccagggaa

SEQ ID NO: 570037 - DNA, 25 bp, Mus musculus
caggactgttcttgtccccagggaa

SEQ ID NO: 570038 - DNA, 25 bp, Mus musculus
caggacttactgctcaccagagggt

SEQ ID NO: 570039 - DNA, 25 bp, Mus musculus
caggacttactggtcaccagagggt

SEQ ID NO: 570040 - DNA, 25 bp, Mus musculus
caggacttagctcaagaggttggca

SEQ ID NO: 570041 - DNA, 25 bp, Mus musculus
caggacttagctgaagaggttggca

SEQ ID NO: 570042 - DNA, 25 bp, Mus musculus
caggacttcagcaatgtcttgccga

SEQ ID NO: 570043 - DNA, 25 bp, Mus musculus
caggacttcagctatgtcttgccga

SEQ ID NO: 570044 - DNA, 25 bp, Mus musculus
caggacttccctcctgtcaactggg

SEQ ID NO: 570045 - DNA, 25 bp, Mus musculus
caggacttccctgctgtcaactggg

SEQ ID NO: 570046 - DNA, 25 bp, Mus musculus
caggacttcttcagcacctgccgat

SEQ ID NO: 570047 - DNA, 25 bp, Mus musculus
caggacttcttctgcacctgccgat

SEQ ID NO: 570048 - DNA, 25 bp, Mus musculus
caggactttcgacgacattgcccgg

SEQ ID NO: 570049 - DNA, 25 bp, Mus musculus
caggactttcgaggacattgcccgg

SEQ ID NO: 570050 - DNA, 25 bp, Mus musculus
caggactttgagaatacagcaatct

SEQ ID NO: 570051 - DNA, 25 bp, Mus musculus
caggactttgagtatacagcaatct

SEQ ID NO: 570052 - DNA, 25 bp, Mus musculus
caggactttgcacatgtactggatg

SEQ ID NO: 570053 - DNA, 25 bp, Mus musculus
caggactttgcagatgtactggatg

SEQ ID NO: 570054 - DNA, 25 bp, Mus musculus
caggagaaaagcagcctctgttccc

SEQ ID NO: 570055 - DNA, 25 bp, Mus musculus
caggagaaaagctgcctctgttccc

SEQ ID NO: 570056 - DNA, 25 bp, Mus musculus
caggagaaagttacaaccacgctga

SEQ ID NO: 570057 - DNA, 25 bp, Mus musculus
caggagaaagtttcaaccacgctga

SEQ ID NO: 570058 - DNA, 25 bp, Mus musculus
caggagaagcaactcggacagtgac

SEQ ID NO: 570059 - DNA, 25 bp, Mus musculus
caggagaagcaagtcggacagtgac

SEQ ID NO: 570060 - DNA, 25 bp, Mus musculus
caggagaagctcctcttcgagaacc

SEQ ID NO: 570061 - DNA, 25 bp, Mus musculus
caggagaagctcgtcttcgagaacc

SEQ ID NO: 570062 - DNA, 25 bp, Mus musculus
caggagaaggaccagcaaggcatca

SEQ ID NO: 570063 - DNA, 25 bp, Mus musculus
caggagaaggacgagcaaggcatca

SEQ ID NO: 570064 - DNA, 25 bp, Mus musculus
caggagaaggccatttttgctcagt

SEQ ID NO: 570065 - DNA, 25 bp, Mus musculus
caggagaaggccttttttgctcagt

SEQ ID NO: 570066 - DNA, 25 bp, Mus musculus
caggagaagggaccccgtggaggag

SEQ ID NO: 570067 - DNA, 25 bp, Mus musculus
caggagaagggagcccgtggaggag

SEQ ID NO: 570068 - DNA, 25 bp, Mus musculus
caggagaagggccacctctcatcac

SEQ ID NO: 570069 - DNA, 25 bp, Mus musculus
caggagaagggcgacctctcatcac

SEQ ID NO: 570070 - DNA, 25 bp, Mus musculus
caggagaatcatcgaacagtcgaca

SEQ ID NO: 570071 - DNA, 25 bp, Mus musculus
caggagaatcatggaacagtcgaca

SEQ ID NO: 570072 - DNA, 25 bp, Mus musculus
caggagacaatcatctgtgaggcaa

SEQ ID NO: 570073 - DNA, 25 bp, Mus musculus
caggagacaatcttctgtgaggcaa

SEQ ID NO: 570074 - DNA, 25 bp, Mus musculus
caggagacaattacagaggccatag

SEQ ID NO: 570075 - DNA, 25 bp, Mus musculus
caggagacaatttcagaggccatag

SEQ ID NO: 570076 - DNA, 25 bp, Mus musculus
caggagacacacaggctgctactca

SEQ ID NO: 570077 - DNA, 25 bp, Mus musculus
caggagacacactggctgctactca

SEQ ID NO: 570078 - DNA, 25 bp, Mus musculus
caggagacactgcacgttcaggagc

SEQ ID NO: 570079 - DNA, 25 bp, Mus musculus
caggagacactggacgttcaggagc

SEQ ID NO: 570080 - DNA, 25 bp, Mus musculus
caggagacagtcagtgcttgtcaaa

SEQ ID NO: 570081 - DNA, 25 bp, Mus musculus
caggagacagtctgtgcttgtcaaa

SEQ ID NO: 570082 - DNA, 25 bp, Mus musculus
caggagacatccctaaagcgctgga

SEQ ID NO: 570083 - DNA, 25 bp, Mus musculus
caggagacatccgtaaagcgctgga

SEQ ID NO: 570084 - DNA, 25 bp, Mus musculus
caggagacatctactgcccttttag

SEQ ID NO: 570085 - DNA, 25 bp, Mus musculus
caggagacatcttctgcccttttag

SEQ ID NO: 570086 - DNA, 25 bp, Mus musculus
caggagacatgtaggagtggatcca

SEQ ID NO: 570087 - DNA, 25 bp, Mus musculus
caggagacatgtatacaccaatgcc

SEQ ID NO: 570088 - DNA, 25 bp, Mus musculus
caggagacatgttggagtggatcca

SEQ ID NO: 570089 - DNA, 25 bp, Mus musculus
caggagacatgtttacaccaatgcc

SEQ ID NO: 570090 - DNA, 25 bp, Mus musculus
caggagacatttccgccaccttgac

SEQ ID NO: 570091 - DNA, 25 bp, Mus musculus
caggagacatttgcgccaccttgac

SEQ ID NO: 570092 - DNA, 25 bp, Mus musculus
caggagaccaagatggatctcataa

SEQ ID NO: 570093 - DNA, 25 bp, Mus musculus
caggagaccaagttggatctcataa

SEQ ID NO: 570094 - DNA, 25 bp, Mus musculus
caggagaccatgaagtccgtaaaca

SEQ ID NO: 570095 - DNA, 25 bp, Mus musculus
caggagaccatgtagtccgtaaaca

SEQ ID NO: 570096 - DNA, 25 bp, Mus musculus
caggagactcgcagaatctgtaaac

SEQ ID NO: 570097 - DNA, 25 bp, Mus musculus
caggagactcgctgaatctgtaaac

SEQ ID NO: 570098 - DNA, 25 bp, Mus musculus
caggagagaactatacagaggtggc

SEQ ID NO: 570099 - DNA, 25 bp, Mus musculus
caggagagaactttacagaggtggc

SEQ ID NO: 570100 - DNA, 25 bp, Mus musculus
caggagagaagaatcctttgagcca

SEQ ID NO: 570101 - DNA, 25 bp, Mus musculus
caggagagaagattcctttgagcca

SEQ ID NO: 570102 - DNA, 25 bp, Mus musculus
caggagagaattagtgatgatgagc

SEQ ID NO: 570103 - DNA, 25 bp, Mus musculus
caggagagaatttgtgatgatgagc

SEQ ID NO: 570104 - DNA, 25 bp, Mus musculus
caggagagatggaagaagagttaat

SEQ ID NO: 570105 - DNA, 25 bp, Mus musculus
caggagagatggtagaagagttaat

SEQ ID NO: 570106 - DNA, 25 bp, Mus musculus
caggagagccgtccaggaccatttc

SEQ ID NO: 570107 - DNA, 25 bp, Mus musculus
caggagagccgtgcaggaccatttc

SEQ ID NO: 570108 - DNA, 25 bp, Mus musculus
caggagagcctacttgaggtacagc

SEQ ID NO: 570109 - DNA, 25 bp, Mus musculus
caggagagcctagttgaggtacagc

SEQ ID NO: 570110 - DNA, 25 bp, Mus musculus
caggagagtatgcaattggctagcc

SEQ ID NO: 570111 - DNA, 25 bp, Mus musculus
caggagagtatggaattggctagcc

SEQ ID NO: 570112 - DNA, 25 bp, Mus musculus
caggagagtcgaagtcaaagcagga

SEQ ID NO: 570113 - DNA, 25 bp, Mus musculus
caggagagtcgatgtcaaagcagga

SEQ ID NO: 570114 - DNA, 25 bp, Mus musculus
caggagatacagcttcgagtcacag

SEQ ID NO: 570115 - DNA, 25 bp, Mus musculus
caggagatacaggttcgagtcacag

SEQ ID NO: 570116 - DNA, 25 bp, Mus musculus
caggagatagatcgctacgccagtg

SEQ ID NO: 570117 - DNA, 25 bp, Mus musculus
caggagatagatggctacgccagtg

SEQ ID NO: 570118 - DNA, 25 bp, Mus musculus
caggagatcatgaagcagacagggt

SEQ ID NO: 570119 - DNA, 25 bp, Mus musculus
caggagatcatgtagcagacagggt

SEQ ID NO: 570120 - DNA, 25 bp, Mus musculus
caggagatcctgatcagttggaaaa

SEQ ID NO: 570121 - DNA, 25 bp, Mus musculus
caggagatcctgttcagttggaaaa

SEQ ID NO: 570122 - DNA, 25 bp, Mus musculus
caggagatcgcacctgtgcaggcac

SEQ ID NO: 570123 - DNA, 25 bp, Mus musculus
caggagatcgcagctgtgcaggcac

SEQ ID NO: 570124 - DNA, 25 bp, Mus musculus
caggagatcgtaagcctgtatgaga

SEQ ID NO: 570125 - DNA, 25 bp, Mus musculus
caggagatcgtatgcctgtatgaga

SEQ ID NO: 570126 - DNA, 25 bp, Mus musculus
caggagatgaccacaacagcaaaat

SEQ ID NO: 570127 - DNA, 25 bp, Mus musculus
caggagatgacctcaacagcaaaat

SEQ ID NO: 570128 - DNA, 25 bp, Mus musculus
caggagatgctactgagagtgtcac

SEQ ID NO: 570129 - DNA, 25 bp, Mus musculus
caggagatgctagtgagagtgtcac

SEQ ID NO: 570130 - DNA, 25 bp, Mus musculus
caggagatgctcatgagcaccatca

SEQ ID NO: 570131 - DNA, 25 bp, Mus musculus
caggagatgctcttgagcaccatca

SEQ ID NO: 570132 - DNA, 25 bp, Mus musculus
caggagatgctgagccgcattgaga

SEQ ID NO: 570133 - DNA, 25 bp, Mus musculus
caggagatgctgtgccgcattgaga

SEQ ID NO: 570134 - DNA, 25 bp, Mus musculus
caggagatgggaacgacaacagtcc

SEQ ID NO: 570135 - DNA, 25 bp, Mus musculus
caggagatgggatcgacaacagtcc

SEQ ID NO: 570136 - DNA, 25 bp, Mus musculus
caggagatgtggactgcagatccct

SEQ ID NO: 570137 - DNA, 25 bp, Mus musculus
caggagatgtggtctgcagatccct

SEQ ID NO: 570138 - DNA, 25 bp, Mus musculus
caggagcaaaacaagccctaacttc

SEQ ID NO: 570139 - DNA, 25 bp, Mus musculus
caggagcaaaactagccctaacttc

SEQ ID NO: 570140 - DNA, 25 bp, Mus musculus
caggagcaaacccagctttcatgct

SEQ ID NO: 570141 - DNA, 25 bp, Mus musculus
caggagcaaaccgagctttcatgct

SEQ ID NO: 570142 - DNA, 25 bp, Mus musculus
caggagcaaaggctacaaccgttct

SEQ ID NO: 570143 - DNA, 25 bp, Mus musculus
caggagcaaagggtacaaccgttct

SEQ ID NO: 570144 - DNA, 25 bp, Mus musculus
caggagcaaatgaagaagggcaaca

SEQ ID NO: 570145 - DNA, 25 bp, Mus musculus
caggagcaaatgtagaagggcaaca

SEQ ID NO: 570146 - DNA, 25 bp, Mus musculus
caggagcaagagatgtctattgtaa

SEQ ID NO: 570147 - DNA, 25 bp, Mus musculus
caggagcaagagttgtctattgtaa

SEQ ID NO: 570148 - DNA, 25 bp, Mus musculus
caggagcaaggcaacagcaggtgct

SEQ ID NO: 570149 - DNA, 25 bp, Mus musculus
caggagcaaggctacagcaggtgct

SEQ ID NO: 570150 - DNA, 25 bp, Mus musculus
caggagcaagtgctgaatgcaagca

SEQ ID NO: 570151 - DNA, 25 bp, Mus musculus
caggagcaagtggtgaatgcaagca

SEQ ID NO: 570152 - DNA, 25 bp, Mus musculus
caggagcacctactgtcagctggct

SEQ ID NO: 570153 - DNA, 25 bp, Mus musculus
caggagcacctagtgtcagctggct

SEQ ID NO: 570154 - DNA, 25 bp, Mus musculus
caggagcagaagatcactgtggtcc

SEQ ID NO: 570155 - DNA, 25 bp, Mus musculus
caggagcagaagttcactgtggtcc

SEQ ID NO: 570156 - DNA, 25 bp, Mus musculus
caggagcaggaactagagtctgcct

SEQ ID NO: 570157 - DNA, 25 bp, Mus musculus
caggagcaggaagtagagtctgcct

SEQ ID NO: 570158 - DNA, 25 bp, Mus musculus
caggagcaggcgactggaaaccaga

SEQ ID NO: 570159 - DNA, 25 bp, Mus musculus
caggagcaggcgtctggaaaccaga

SEQ ID NO: 570160 - DNA, 25 bp, Mus musculus
caggagccaatgataaactgaaatg

SEQ ID NO: 570161 - DNA, 25 bp, Mus musculus
caggagccaatgttaaactgaaatg

SEQ ID NO: 570162 - DNA, 25 bp, Mus musculus
caggagccactccagtccttgagtg

SEQ ID NO: 570163 - DNA, 25 bp, Mus musculus
caggagccactcgagtccttgagtg

SEQ ID NO: 570164 - DNA, 25 bp, Mus musculus
caggagccaggacgcaaagacgctc

SEQ ID NO: 570165 - DNA, 25 bp, Mus musculus
caggagccaggaggcaaagacgctc

SEQ ID NO: 570166 - DNA, 25 bp, Mus musculus
caggagccatggatctgctcaagct

SEQ ID NO: 570167 - DNA, 25 bp, Mus musculus
caggagccatggttctgctcaagct

SEQ ID NO: 570168 - DNA, 25 bp, Mus musculus
caggagcccggcactaggatgaagt

SEQ ID NO: 570169 - DNA, 25 bp, Mus musculus
caggagcccggctctaggatgaagt

SEQ ID NO: 570170 - DNA, 25 bp, Mus musculus
caggagccctccctttggagatgcc

SEQ ID NO: 570171 - DNA, 25 bp, Mus musculus
caggagccctccgtttggagatgcc

SEQ ID NO: 570172 - DNA, 25 bp, Mus musculus
caggagccctggattcaatcagtga

SEQ ID NO: 570173 - DNA, 25 bp, Mus musculus
caggagccctggtttcaatcagtga

SEQ ID NO: 570174 - DNA, 25 bp, Mus musculus
caggagccgtacaggttcagcgaga

SEQ ID NO: 570175 - DNA, 25 bp, Mus musculus
caggagccgtactggttcagcgaga

SEQ ID NO: 570176 - DNA, 25 bp, Mus musculus
caggagccgtgacttccggcctgct

SEQ ID NO: 570177 - DNA, 25 bp, Mus musculus
caggagccgtgagttccggcctgct

SEQ ID NO: 570178 - DNA, 25 bp, Mus musculus
caggagcctacaatctcagcagatt

SEQ ID NO: 570179 - DNA, 25 bp, Mus musculus
caggagcctacattctcagcagatt

SEQ ID NO: 570180 - DNA, 25 bp, Mus musculus
caggagcctcctccgcagctttgtt

SEQ ID NO: 570181 - DNA, 25 bp, Mus musculus
caggagcctcctgcgcagctttgtt

SEQ ID NO: 570182 - DNA, 25 bp, Mus musculus
caggagcctcgccttgtgctggtct

SEQ ID NO: 570183 - DNA, 25 bp, Mus musculus
caggagcctcgcgttgtgctggtct

SEQ ID NO: 570184 - DNA, 25 bp, Mus musculus
caggagcctctacagctccaagatc

SEQ ID NO: 570185 - DNA, 25 bp, Mus musculus
caggagcctctagagctccaagatc

SEQ ID NO: 570186 - DNA, 25 bp, Mus musculus
caggagcctctgactaggcggcaaa

SEQ ID NO: 570187 - DNA, 25 bp, Mus musculus
caggagcctctgtctaggcggcaaa

SEQ ID NO: 570188 - DNA, 25 bp, Mus musculus
caggagcctgaacttccatgggatg

SEQ ID NO: 570189 - DNA, 25 bp, Mus musculus
caggagcctgaagttccatgggatg

SEQ ID NO: 570190 - DNA, 25 bp, Mus musculus
caggagcctgccagatcttgaggag

SEQ ID NO: 570191 - DNA, 25 bp, Mus musculus
caggagcctgcctgatcttgaggag

SEQ ID NO: 570192 - DNA, 25 bp, Mus musculus
caggagcgaccacaaatcatggcac

SEQ ID NO: 570193 - DNA, 25 bp, Mus musculus
caggagcgaccagaaatcatggcac

SEQ ID NO: 570194 - DNA, 25 bp, Mus musculus
caggagcggattcacaagatctggc

SEQ ID NO: 570195 - DNA, 25 bp, Mus musculus
caggagcggattgacaagatctggc

SEQ ID NO: 570196 - DNA, 25 bp, Mus musculus
caggagcggtacagggctataacgt

SEQ ID NO: 570197 - DNA, 25 bp, Mus musculus
caggagcggtactgggctataacgt

SEQ ID NO: 570198 - DNA, 25 bp, Mus musculus
caggagctaaatcagctcagtgcca

SEQ ID NO: 570199 - DNA, 25 bp, Mus musculus
caggagctaaatgagctcagtgcca

SEQ ID NO: 570200 - DNA, 25 bp, Mus musculus
caggagctacatcagcagctggcat

SEQ ID NO: 570201 - DNA, 25 bp, Mus musculus
caggagctacatgagcagctggcat

SEQ ID NO: 570202 - DNA, 25 bp, Mus musculus
caggagctagacactctgaaggacc

SEQ ID NO: 570203 - DNA, 25 bp, Mus musculus
caggagctagactctctgaaggacc

SEQ ID NO: 570204 - DNA, 25 bp, Mus musculus
caggagctagctcacgagctggcca

SEQ ID NO: 570205 - DNA, 25 bp, Mus musculus
caggagctagctgacgagctggcca

SEQ ID NO: 570206 - DNA, 25 bp, Mus musculus
caggagctatgcactacacgggtgc

SEQ ID NO: 570207 - DNA, 25 bp, Mus musculus
caggagctatgctctacacgggtgc

SEQ ID NO: 570208 - DNA, 25 bp, Mus musculus
caggagctcaaacaacgggagagac

SEQ ID NO: 570209 - DNA, 25 bp, Mus musculus
caggagctcaaagaacgggagagac

SEQ ID NO: 570210 - DNA, 25 bp, Mus musculus
caggagctcacaagagatcaaggac

SEQ ID NO: 570211 - DNA, 25 bp, Mus musculus
caggagctcacatgagatcaaggac

SEQ ID NO: 570212 - DNA, 25 bp, Mus musculus
caggagctcagtaggctacagaggc

SEQ ID NO: 570213 - DNA, 25 bp, Mus musculus
caggagctcagttggctacagaggc

SEQ ID NO: 570214 - DNA, 25 bp, Mus musculus
caggagctcatacaccagcttgagt

SEQ ID NO: 570215 - DNA, 25 bp, Mus musculus
caggagctcatagaccagcttgagt

SEQ ID NO: 570216 - DNA, 25 bp, Mus musculus
caggagctcatgcaactgaaggctg

SEQ ID NO: 570217 - DNA, 25 bp, Mus musculus
caggagctcatggaactgaaggctg

SEQ ID NO: 570218 - DNA, 25 bp, Mus musculus
caggagctctaaagccttccaggag

SEQ ID NO: 570219 - DNA, 25 bp, Mus musculus
caggagctctaatgccttccaggag

SEQ ID NO: 570220 - DNA, 25 bp, Mus musculus
caggagctctcaccttgtgtcttca

SEQ ID NO: 570221 - DNA, 25 bp, Mus musculus
caggagctctcagcttgtgtcttca

SEQ ID NO: 570222 - DNA, 25 bp, Mus musculus
caggagctgaccagcctccaacggg

SEQ ID NO: 570223 - DNA, 25 bp, Mus musculus
caggagctgacctgcctccaacggg

SEQ ID NO: 570224 - DNA, 25 bp, Mus musculus
caggagctgataatttgcccaatga

SEQ ID NO: 570225 - DNA, 25 bp, Mus musculus
caggagctgatattttgcccaatga

SEQ ID NO: 570226 - DNA, 25 bp, Mus musculus
caggagctgcgtaagattgaggccc

SEQ ID NO: 570227 - DNA, 25 bp, Mus musculus
caggagctgcgttagattgaggccc

SEQ ID NO: 570228 - DNA, 25 bp, Mus musculus
caggagctgctactctagaaggagc

SEQ ID NO: 570229 - DNA, 25 bp, Mus musculus
caggagctgctagtctagaaggagc

SEQ ID NO: 570230 - DNA, 25 bp, Mus musculus
caggagctggacagattcgccaatc

SEQ ID NO: 570231 - DNA, 25 bp, Mus musculus
caggagctggactgattcgccaatc

SEQ ID NO: 570232 - DNA, 25 bp, Mus musculus
caggagctggtacaatccttgcagg

SEQ ID NO: 570233 - DNA, 25 bp, Mus musculus
caggagctggtagaatccttgcagg

SEQ ID NO: 570234 - DNA, 25 bp, Mus musculus
caggagctgtcccaagaaatcaagg

SEQ ID NO: 570235 - DNA, 25 bp, Mus musculus
caggagctgtccgaagaaatcaagg

SEQ ID NO: 570236 - DNA, 25 bp, Mus musculus
caggagctgtcgatgaccgaggcct

SEQ ID NO: 570237 - DNA, 25 bp, Mus musculus
caggagctgtcgttgaccgaggcct

SEQ ID NO: 570238 - DNA, 25 bp, Mus musculus
caggagctgtgaaagtcccagctga

SEQ ID NO: 570239 - DNA, 25 bp, Mus musculus
caggagctgtgatagtcccagctga

SEQ ID NO: 570240 - DNA, 25 bp, Mus musculus
caggagctgtgcagcattctgggat

SEQ ID NO: 570241 - DNA, 25 bp, Mus musculus
caggagctgtgctgcattctgggat

SEQ ID NO: 570242 - DNA, 25 bp, Mus musculus
caggagcttaacagcctcttgcagc

SEQ ID NO: 570243 - DNA, 25 bp, Mus musculus
caggagcttaactgcctcttgcagc

SEQ ID NO: 570244 - DNA, 25 bp, Mus musculus
caggagcttcccctgggcatgaaag

SEQ ID NO: 570245 - DNA, 25 bp, Mus musculus
caggagcttcccgtgggcatgaaag

SEQ ID NO: 570246 - DNA, 25 bp, Mus musculus
caggagcttggactttggtgctacc

SEQ ID NO: 570247 - DNA, 25 bp, Mus musculus
caggagcttggagtttggtgctacc

SEQ ID NO: 570248 - DNA, 25 bp, Mus musculus
caggaggaaaaaatggcagcagcag

SEQ ID NO: 570249 - DNA, 25 bp, Mus musculus
caggaggaaaaattggcagcagcag

SEQ ID NO: 570250 - DNA, 25 bp, Mus musculus
caggaggaaacacgctaatacagag

SEQ ID NO: 570251 - DNA, 25 bp, Mus musculus
caggaggaaacaggctaatacagag

SEQ ID NO: 570252 - DNA, 25 bp, Mus musculus
caggaggaatacaacacactgttcc

SEQ ID NO: 570253 - DNA, 25 bp, Mus musculus
caggaggaatactacacactgttcc

SEQ ID NO: 570254 - DNA, 25 bp, Mus musculus
caggaggacaaccaagctcccgact

SEQ ID NO: 570255 - DNA, 25 bp, Mus musculus
caggaggacaacgaagctcccgact

SEQ ID NO: 570256 - DNA, 25 bp, Mus musculus
caggaggacaccatccacggaagac

SEQ ID NO: 570257 - DNA, 25 bp, Mus musculus
caggaggacaccttccacggaagac

SEQ ID NO: 570258 - DNA, 25 bp, Mus musculus
caggaggagatcatcagtctccttt

SEQ ID NO: 570259 - DNA, 25 bp, Mus musculus
caggaggagatcttcagtctccttt

SEQ ID NO: 570260 - DNA, 25 bp, Mus musculus
caggaggagcaaacagatacagaga

SEQ ID NO: 570261 - DNA, 25 bp, Mus musculus
caggaggagcaatcagatacagaga

SEQ ID NO: 570262 - DNA, 25 bp, Mus musculus
caggaggagcagaacttgtaagtgc

SEQ ID NO: 570263 - DNA, 25 bp, Mus musculus
caggaggagcagtacttgtaagtgc

SEQ ID NO: 570264 - DNA, 25 bp, Mus musculus
caggaggagcccagctaagttctga

SEQ ID NO: 570265 - DNA, 25 bp, Mus musculus
caggaggagccctgctaagttctga

SEQ ID NO: 570266 - DNA, 25 bp, Mus musculus
caggaggagcctcgtaaacagcctc

SEQ ID NO: 570267 - DNA, 25 bp, Mus musculus
caggaggagcctggtaaacagcctc

SEQ ID NO: 570268 - DNA, 25 bp, Mus musculus
caggaggagctcatggtctccatgg

SEQ ID NO: 570269 - DNA, 25 bp, Mus musculus
caggaggagctcttggtctccatgg

SEQ ID NO: 570270 - DNA, 25 bp, Mus musculus
caggaggaggacaagaaagtgatct

SEQ ID NO: 570271 - DNA, 25 bp, Mus musculus
caggaggaggactagaaagtgatct

SEQ ID NO: 570272 - DNA, 25 bp, Mus musculus
caggaggcaattaggattgcccagg

SEQ ID NO: 570273 - DNA, 25 bp, Mus musculus
caggaggcaatttggattgcccagg

SEQ ID NO: 570274 - DNA, 25 bp, Mus musculus
caggaggccaatcgaagcacagcgt

SEQ ID NO: 570275 - DNA, 25 bp, Mus musculus
caggaggccaatggaagcacagcgt

SEQ ID NO: 570276 - DNA, 25 bp, Mus musculus
caggaggccaggatccagaagctac

SEQ ID NO: 570277 - DNA, 25 bp, Mus musculus
caggaggccaggttccagaagctac

SEQ ID NO: 570278 - DNA, 25 bp, Mus musculus
caggaggccgccattgtcggctact

SEQ ID NO: 570279 - DNA, 25 bp, Mus musculus
caggaggccgcctttgtcggctact

SEQ ID NO: 570280 - DNA, 25 bp, Mus musculus
caggaggcctacctgcgcgtagtca

SEQ ID NO: 570281 - DNA, 25 bp, Mus musculus
caggaggcctacgtgcgcgtagtca

SEQ ID NO: 570282 - DNA, 25 bp, Mus musculus
caggaggctctgattggaagttttc

SEQ ID NO: 570283 - DNA, 25 bp, Mus musculus
caggaggctctgtttggaagttttc

SEQ ID NO: 570284 - DNA, 25 bp, Mus musculus
caggagggcaagcaacagtatctgc

SEQ ID NO: 570285 - DNA, 25 bp, Mus musculus
caggagggcaaggaacagtatctgc

SEQ ID NO: 570286 - DNA, 25 bp, Mus musculus
caggagggcaataaggtagtgaaca

SEQ ID NO: 570287 - DNA, 25 bp, Mus musculus
caggagggcaattaggtagtgaaca

SEQ ID NO: 570288 - DNA, 25 bp, Mus musculus
caggaggtatacaacctaattcgtt

SEQ ID NO: 570289 - DNA, 25 bp, Mus musculus
caggaggtatactacctaattcgtt

SEQ ID NO: 570290 - DNA, 25 bp, Mus musculus
caggaggtattcaaccagttcaggg

SEQ ID NO: 570291 - DNA, 25 bp, Mus musculus
caggaggtattctaccagttcaggg

SEQ ID NO: 570292 - DNA, 25 bp, Mus musculus
caggaggtcaccctggtcccacatt

SEQ ID NO: 570293 - DNA, 25 bp, Mus musculus
caggaggtcaccgtggtcccacatt

SEQ ID NO: 570294 - DNA, 25 bp, Mus musculus
caggaggtcgtgaccacccgcaacg

SEQ ID NO: 570295 - DNA, 25 bp, Mus musculus
caggaggtcgtgtccacccgcaacg

SEQ ID NO: 570296 - DNA, 25 bp, Mus musculus
caggaggtgacaaggacacacttca

SEQ ID NO: 570297 - DNA, 25 bp, Mus musculus
caggaggtgacatggacacacttca

SEQ ID NO: 570298 - DNA, 25 bp, Mus musculus
caggaggttacactgtctcaattct

SEQ ID NO: 570299 - DNA, 25 bp, Mus musculus
caggaggttacagtgtctcaattct

SEQ ID NO: 570300 - DNA, 25 bp, Mus musculus
caggaggttctcagcatcacagtgt

SEQ ID NO: 570301 - DNA, 25 bp, Mus musculus
caggaggttctctgcatcacagtgt

SEQ ID NO: 570302 - DNA, 25 bp, Mus musculus
caggaggtttggcaaaacatgttac

SEQ ID NO: 570303 - DNA, 25 bp, Mus musculus
caggaggtttgggaaaacatgttac

SEQ ID NO: 570304 - DNA, 25 bp, Mus musculus
caggagtaaacgacaaaatggcaga

SEQ ID NO: 570305 - DNA, 25 bp, Mus musculus
caggagtaaacgtcaaaatggcaga

SEQ ID NO: 570306 - DNA, 25 bp, Mus musculus
caggagtacgcaaggtttgaatccc

SEQ ID NO: 570307 - DNA, 25 bp, Mus musculus
caggagtacgcatggtttgaatccc

SEQ ID NO: 570308 - DNA, 25 bp, Mus musculus
caggagtagctccatagttgggccc

SEQ ID NO: 570309 - DNA, 25 bp, Mus musculus
caggagtagctcgatagttgggccc

SEQ ID NO: 570310 - DNA, 25 bp, Mus musculus
caggagtatactcgtgcacacccca

SEQ ID NO: 570311 - DNA, 25 bp, Mus musculus
caggagtatactctcacagagttcc

SEQ ID NO: 570312 - DNA, 25 bp, Mus musculus
caggagtatactggtgcacacccca

SEQ ID NO: 570313 - DNA, 25 bp, Mus musculus
caggagtatactgtcacagagttcc

SEQ ID NO: 570314 - DNA, 25 bp, Mus musculus
caggagtcactgactacatttacca

SEQ ID NO: 570315 - DNA, 25 bp, Mus musculus
caggagtcactgtctacatttacca

SEQ ID NO: 570316 - DNA, 25 bp, Mus musculus
caggagtcagaccagcggaaatgta

SEQ ID NO: 570317 - DNA, 25 bp, Mus musculus
caggagtcagacgagcggaaatgta

SEQ ID NO: 570318 - DNA, 25 bp, Mus musculus
caggagtcagagcagaatcaggaaa

SEQ ID NO: 570319 - DNA, 25 bp, Mus musculus
caggagtcagaggagaatcaggaaa

SEQ ID NO: 570320 - DNA, 25 bp, Mus musculus
caggagtcatctccaggcataatgg

SEQ ID NO: 570321 - DNA, 25 bp, Mus musculus
caggagtcatctgcaggcataatgg

SEQ ID NO: 570322 - DNA, 25 bp, Mus musculus
caggagtcccctctttgacatcagg

SEQ ID NO: 570323 - DNA, 25 bp, Mus musculus
caggagtcccctgtttgacatcagg

SEQ ID NO: 570324 - DNA, 25 bp, Mus musculus
caggagtcccggaggactcggccca

SEQ ID NO: 570325 - DNA, 25 bp, Mus musculus
caggagtcccggtggactcggccca

SEQ ID NO: 570326 - DNA, 25 bp, Mus musculus
caggagtccttcaccgcggtgcagg

SEQ ID NO: 570327 - DNA, 25 bp, Mus musculus
caggagtccttctccgcggtgcagg

SEQ ID NO: 570328 - DNA, 25 bp, Mus musculus
caggagtcgcttcaattcattgaca

SEQ ID NO: 570329 - DNA, 25 bp, Mus musculus
caggagtcgcttgaattcattgaca

SEQ ID NO: 570330 - DNA, 25 bp, Mus musculus
caggagtctggaaaagttgggtcta

SEQ ID NO: 570331 - DNA, 25 bp, Mus musculus
caggagtctggataagttgggtcta

SEQ ID NO: 570332 - DNA, 25 bp, Mus musculus
caggagtctgtgcattgacttaccc

SEQ ID NO: 570333 - DNA, 25 bp, Mus musculus
caggagtctgtggattgacttaccc

SEQ ID NO: 570334 - DNA, 25 bp, Mus musculus
caggagtgatgtaccaggagagtct

SEQ ID NO: 570335 - DNA, 25 bp, Mus musculus
caggagtgatgttccaggagagtct

SEQ ID NO: 570336 - DNA, 25 bp, Mus musculus
caggagtgcatgaacacctgccggg

SEQ ID NO: 570337 - DNA, 25 bp, Mus musculus
caggagtgcatgtacacctgccggg

SEQ ID NO: 570338 - DNA, 25 bp, Mus musculus
caggagtgcttcataaatatccaca

SEQ ID NO: 570339 - DNA, 25 bp, Mus musculus
caggagtgcttcttaaatatccaca

SEQ ID NO: 570340 - DNA, 25 bp, Mus musculus
caggagtgtaacagcttgccggaca

SEQ ID NO: 570341 - DNA, 25 bp, Mus musculus
caggagtgtaactgcttgccggaca

SEQ ID NO: 570342 - DNA, 25 bp, Mus musculus
caggagtgtacaacagcctgaacca

SEQ ID NO: 570343 - DNA, 25 bp, Mus musculus
caggagtgtacatcagcctgaacca

SEQ ID NO: 570344 - DNA, 25 bp, Mus musculus
caggagtgtcaacatcttggcagga

SEQ ID NO: 570345 - DNA, 25 bp, Mus musculus
caggagtgtcaagatcttggcagga

SEQ ID NO: 570346 - DNA, 25 bp, Mus musculus
caggagtgtcgcattataatacgag

SEQ ID NO: 570347 - DNA, 25 bp, Mus musculus
caggagtgtcgctttataatacgag

SEQ ID NO: 570348 - DNA, 25 bp, Mus musculus
caggagtgtgaacacatcctagagt

SEQ ID NO: 570349 - DNA, 25 bp, Mus musculus
caggagtgtgaagacatcctagagt

SEQ ID NO: 570350 - DNA, 25 bp, Mus musculus
caggagtgtttgaggctcgtgtcac

SEQ ID NO: 570351 - DNA, 25 bp, Mus musculus
caggagtgtttgtggctcgtgtcac

SEQ ID NO: 570352 - DNA, 25 bp, Mus musculus
caggagttagcgaagaagtcagtga

SEQ ID NO: 570353 - DNA, 25 bp, Mus musculus
caggagttagcgtagaagtcagtga

SEQ ID NO: 570354 - DNA, 25 bp, Mus musculus
caggagttagggacagaatatatct

SEQ ID NO: 570355 - DNA, 25 bp, Mus musculus
caggagttagggtcagaatatatct

SEQ ID NO: 570356 - DNA, 25 bp, Mus musculus
caggagttatttcgtcctcccagcg

SEQ ID NO: 570357 - DNA, 25 bp, Mus musculus
caggagttatttggtcctcccagcg

SEQ ID NO: 570358 - DNA, 25 bp, Mus musculus
caggagttcaagcatgtggccctga

SEQ ID NO: 570359 - DNA, 25 bp, Mus musculus
caggagttcaaggatgtggccctga

SEQ ID NO: 570360 - DNA, 25 bp, Mus musculus
caggagtttcttagccagatatggc

SEQ ID NO: 570361 - DNA, 25 bp, Mus musculus
caggagtttctttgccagatatggc

SEQ ID NO: 570362 - DNA, 25 bp, Mus musculus
caggagtttgacacaatggaagacc

SEQ ID NO: 570363 - DNA, 25 bp, Mus musculus
caggagtttgactcaatggaagacc

SEQ ID NO: 570364 - DNA, 25 bp, Mus musculus
caggagtttgctcagcttctggctc

SEQ ID NO: 570365 - DNA, 25 bp, Mus musculus
caggagtttgctcctgatgtacggc

SEQ ID NO: 570366 - DNA, 25 bp, Mus musculus
caggagtttgctgagcttctggctc

SEQ ID NO: 570367 - DNA, 25 bp, Mus musculus
caggagtttgctgctgatgtacggc

SEQ ID NO: 570368 - DNA, 25 bp, Mus musculus
caggagtttggaattgaagtagtga

SEQ ID NO: 570369 - DNA, 25 bp, Mus musculus
caggagtttggatttgaagtagtga

SEQ ID NO: 570370 - DNA, 25 bp, Mus musculus
caggatactgttcgtgtgttacacc

SEQ ID NO: 570371 - DNA, 25 bp, Mus musculus
caggatactgttggtgtgttacacc

SEQ ID NO: 570372 - DNA, 25 bp, Mus musculus
caggatagccccacatctggcaagt

SEQ ID NO: 570373 - DNA, 25 bp, Mus musculus
caggatagcccctcatctggcaagt

SEQ ID NO: 570374 - DNA, 25 bp, Mus musculus
caggatagccgcaggctgccggttt

SEQ ID NO: 570375 - DNA, 25 bp, Mus musculus
caggatagccgctggctgccggttt

SEQ ID NO: 570376 - DNA, 25 bp, Mus musculus
caggatagcgacactccagcccagg

SEQ ID NO: 570377 - DNA, 25 bp, Mus musculus
caggatagcgactctccagcccagg

SEQ ID NO: 570378 - DNA, 25 bp, Mus musculus
caggatagctgtctctccaccctga

SEQ ID NO: 570379 - DNA, 25 bp, Mus musculus
caggatagctgtgtctccaccctga

SEQ ID NO: 570380 - DNA, 25 bp, Mus musculus
caggatatccttctgtccagtgcac

SEQ ID NO: 570381 - DNA, 25 bp, Mus musculus
caggatatccttgtgtccagtgcac

SEQ ID NO: 570382 - DNA, 25 bp, Mus musculus
caggatatcgaacagcagctgggct

SEQ ID NO: 570383 - DNA, 25 bp, Mus musculus
caggatatcgaagagcagctgggct

SEQ ID NO: 570384 - DNA, 25 bp, Mus musculus
caggatatgtggaaacccggtggta

SEQ ID NO: 570385 - DNA, 25 bp, Mus musculus
caggatatgtggtaacccggtggta

SEQ ID NO: 570386 - DNA, 25 bp, Mus musculus
caggatcagataaagagccaggagc

SEQ ID NO: 570387 - DNA, 25 bp, Mus musculus
caggatcagatacattgtggagaga

SEQ ID NO: 570388 - DNA, 25 bp, Mus musculus
caggatcagatagattgtggagaga

SEQ ID NO: 570389 - DNA, 25 bp, Mus musculus
caggatcagatatagagccaggagc

SEQ ID NO: 570390 - DNA, 25 bp, Mus musculus
caggatcaggcgatcgccagtcaca

SEQ ID NO: 570391 - DNA, 25 bp, Mus musculus
caggatcaggcgttcgccagtcaca

SEQ ID NO: 570392 - DNA, 25 bp, Mus musculus
caggatcattggaatcgacatcaac

SEQ ID NO: 570393 - DNA, 25 bp, Mus musculus
caggatcattggtatcgacatcaac

SEQ ID NO: 570394 - DNA, 25 bp, Mus musculus
caggatcccgccagagaacgccgtg

SEQ ID NO: 570395 - DNA, 25 bp, Mus musculus
caggatcccgcctgagaacgccgtg

SEQ ID NO: 570396 - DNA, 25 bp, Mus musculus
caggatccgcaaaccacgtgggcta

SEQ ID NO: 570397 - DNA, 25 bp, Mus musculus
caggatccgcaatccacgtgggcta

SEQ ID NO: 570398 - DNA, 25 bp, Mus musculus
caggatcctagtactcaggcacgga

SEQ ID NO: 570399 - DNA, 25 bp, Mus musculus
caggatcctagttctcaggcacgga

SEQ ID NO: 570400 - DNA, 25 bp, Mus musculus
caggatcctcctattgcatgcgact

SEQ ID NO: 570401 - DNA, 25 bp, Mus musculus
caggatcctcctccgaaagaaagct

SEQ ID NO: 570402 - DNA, 25 bp, Mus musculus
caggatcctcctgcgaaagaaagct

SEQ ID NO: 570403 - DNA, 25 bp, Mus musculus
caggatcctccttttgcatgcgact

SEQ ID NO: 570404 - DNA, 25 bp, Mus musculus
caggatcctgaactggaaggctgaa

SEQ ID NO: 570405 - DNA, 25 bp, Mus musculus
caggatcctgaagtggaaggctgaa

SEQ ID NO: 570406 - DNA, 25 bp, Mus musculus
caggatcctggtcttcatacagaga

SEQ ID NO: 570407 - DNA, 25 bp, Mus musculus
caggatcctggtgttcatacagaga

SEQ ID NO: 570408 - DNA, 25 bp, Mus musculus
caggatcgacgaatactcatgtaca

SEQ ID NO: 570409 - DNA, 25 bp, Mus musculus
caggatcgacgattactcatgtaca

SEQ ID NO: 570410 - DNA, 25 bp, Mus musculus
caggatcggtgcactgtatgtacga

SEQ ID NO: 570411 - DNA, 25 bp, Mus musculus
caggatcggtgctctgtatgtacga

SEQ ID NO: 570412 - DNA, 25 bp, Mus musculus
caggatctcacgaaggatgaggcag

SEQ ID NO: 570413 - DNA, 25 bp, Mus musculus
caggatctcacgtaggatgaggcag

SEQ ID NO: 570414 - DNA, 25 bp, Mus musculus
caggatctccagaaagactttgcac

SEQ ID NO: 570415 - DNA, 25 bp, Mus musculus
caggatctccagtaagactttgcac

SEQ ID NO: 570416 - DNA, 25 bp, Mus musculus
caggatctcgacagcagacattgcc

SEQ ID NO: 570417 - DNA, 25 bp, Mus musculus
caggatctcgactgcagacattgcc

SEQ ID NO: 570418 - DNA, 25 bp, Mus musculus
caggatctcgttcttccataatgaa

SEQ ID NO: 570419 - DNA, 25 bp, Mus musculus
caggatctcgttgttccataatgaa

SEQ ID NO: 570420 - DNA, 25 bp, Mus musculus
caggatctgactcactgcttacagg

SEQ ID NO: 570421 - DNA, 25 bp, Mus musculus
caggatctgactgactgcttacagg

SEQ ID NO: 570422 - DNA, 25 bp, Mus musculus
caggatctgccaaccccttcagatt

SEQ ID NO: 570423 - DNA, 25 bp, Mus musculus
caggatctgccatccccttcagatt

SEQ ID NO: 570424 - DNA, 25 bp, Mus musculus
caggatctggctcggacagctgctc

SEQ ID NO: 570425 - DNA, 25 bp, Mus musculus
caggatctggctgggacagctgctc

SEQ ID NO: 570426 - DNA, 25 bp, Mus musculus
caggatctgggcactggaactgaag

SEQ ID NO: 570427 - DNA, 25 bp, Mus musculus
caggatctgggctctggaactgaag

SEQ ID NO: 570428 - DNA, 25 bp, Mus musculus
caggatcttatacaccgaggatgga

SEQ ID NO: 570429 - DNA, 25 bp, Mus musculus
caggatcttatagaccgaggatgga

SEQ ID NO: 570430 - DNA, 25 bp, Mus musculus
caggatgaaacgatggctatgaaat

SEQ ID NO: 570431 - DNA, 25 bp, Mus musculus
caggatgaaacgttggctatgaaat

SEQ ID NO: 570432 - DNA, 25 bp, Mus musculus
caggatgaagaaccactcaaacaag

SEQ ID NO: 570433 - DNA, 25 bp, Mus musculus
caggatgaagaagcactcaaacaag

SEQ ID NO: 570434 - DNA, 25 bp, Mus musculus
caggatgaagagcagaccccacatg

SEQ ID NO: 570435 - DNA, 25 bp, Mus musculus
caggatgaagaggagaccccacatg

SEQ ID NO: 570436 - DNA, 25 bp, Mus musculus
caggatgacatgagcttctgtgcca

SEQ ID NO: 570437 - DNA, 25 bp, Mus musculus
caggatgacatgtgcttctgtgcca

SEQ ID NO: 570438 - DNA, 25 bp, Mus musculus
caggatgacctcctcggactcgatg

SEQ ID NO: 570439 - DNA, 25 bp, Mus musculus
caggatgacctcgtcggactcgatg

SEQ ID NO: 570440 - DNA, 25 bp, Mus musculus
caggatgacgaaccggcagtatttc

SEQ ID NO: 570441 - DNA, 25 bp, Mus musculus
caggatgacgaagcggcagtatttc

SEQ ID NO: 570442 - DNA, 25 bp, Mus musculus
caggatgactccatctttatccgga

SEQ ID NO: 570443 - DNA, 25 bp, Mus musculus
caggatgactccttctttatccgga

SEQ ID NO: 570444 - DNA, 25 bp, Mus musculus
caggatgagaagctacaagcaagaa

SEQ ID NO: 570445 - DNA, 25 bp, Mus musculus
caggatgagaaggtacaagcaagaa

SEQ ID NO: 570446 - DNA, 25 bp, Mus musculus
caggatgagataactgaaagagaag

SEQ ID NO: 570447 - DNA, 25 bp, Mus musculus
caggatgagatatctgaaagagaag

SEQ ID NO: 570448 - DNA, 25 bp, Mus musculus
caggatgaggccaccagtgccttca

SEQ ID NO: 570449 - DNA, 25 bp, Mus musculus
caggatgaggcctccagtgccttca

SEQ ID NO: 570450 - DNA, 25 bp, Mus musculus
caggatgaggttcctgcttctgcca

SEQ ID NO: 570451 - DNA, 25 bp, Mus musculus
caggatgaggttgctgcttctgcca

SEQ ID NO: 570452 - DNA, 25 bp, Mus musculus
caggatgcacatattcagcatgaat

SEQ ID NO: 570453 - DNA, 25 bp, Mus musculus
caggatgcacattttcagcatgaat

SEQ ID NO: 570454 - DNA, 25 bp, Mus musculus
caggatgcagaccaggcctccgagt

SEQ ID NO: 570455 - DNA, 25 bp, Mus musculus
caggatgcagacgaggcctccgagt

SEQ ID NO: 570456 - DNA, 25 bp, Mus musculus
caggatgcaggacccaggacagatt

SEQ ID NO: 570457 - DNA, 25 bp, Mus musculus
caggatgcaggagccaggacagatt

SEQ ID NO: 570458 - DNA, 25 bp, Mus musculus
caggatgcagtacgccttgagcagc

SEQ ID NO: 570459 - DNA, 25 bp, Mus musculus
caggatgcagtaggccttgagcagc

SEQ ID NO: 570460 - DNA, 25 bp, Mus musculus
caggatgccccgaactgccaagaag

SEQ ID NO: 570461 - DNA, 25 bp, Mus musculus
caggatgccccgtactgccaagaag

SEQ ID NO: 570462 - DNA, 25 bp, Mus musculus
caggatgcctccctgagctgtaaat

SEQ ID NO: 570463 - DNA, 25 bp, Mus musculus
caggatgcctccgtgagctgtaaat

SEQ ID NO: 570464 - DNA, 25 bp, Mus musculus
caggatgcctggaccatgggcacaa

SEQ ID NO: 570465 - DNA, 25 bp, Mus musculus
caggatgcctggtccatgggcacaa

SEQ ID NO: 570466 - DNA, 25 bp, Mus musculus
caggatgccttcagcaactccgaca

SEQ ID NO: 570467 - DNA, 25 bp, Mus musculus
caggatgccttctgcaactccgaca

SEQ ID NO: 570468 - DNA, 25 bp, Mus musculus
caggatgctgaacagggacgtttcc

SEQ ID NO: 570469 - DNA, 25 bp, Mus musculus
caggatgctgaagagggacgtttcc

SEQ ID NO: 570470 - DNA, 25 bp, Mus musculus
caggatgctgatctaatcgtggcaa

SEQ ID NO: 570471 - DNA, 25 bp, Mus musculus
caggatgctgatgtaatcgtggcaa

SEQ ID NO: 570472 - DNA, 25 bp, Mus musculus
caggatgctgccatcaacctgcagt

SEQ ID NO: 570473 - DNA, 25 bp, Mus musculus
caggatgctgccttcaacctgcagt

SEQ ID NO: 570474 - DNA, 25 bp, Mus musculus
caggatgcttatcaaggagtaccac

SEQ ID NO: 570475 - DNA, 25 bp, Mus musculus
caggatgcttatgaaggagtaccac

SEQ ID NO: 570476 - DNA, 25 bp, Mus musculus
caggatgcttgtcaggcactgaaga

SEQ ID NO: 570477 - DNA, 25 bp, Mus musculus
caggatgcttgtgaggcactgaaga

SEQ ID NO: 570478 - DNA, 25 bp, Mus musculus
caggatggagctcaactctctgctg

SEQ ID NO: 570479 - DNA, 25 bp, Mus musculus
caggatggagctgaactctctgctg

SEQ ID NO: 570480 - DNA, 25 bp, Mus musculus
caggatggattcactgctcattgca

SEQ ID NO: 570481 - DNA, 25 bp, Mus musculus
caggatggattctctgctcattgca

SEQ ID NO: 570482 - DNA, 25 bp, Mus musculus
caggatggctacacacccgaagagt

SEQ ID NO: 570483 - DNA, 25 bp, Mus musculus
caggatggctactcacccgaagagt

SEQ ID NO: 570484 - DNA, 25 bp, Mus musculus
caggatggctgcatgaaactgtcca

SEQ ID NO: 570485 - DNA, 25 bp, Mus musculus
caggatggctgcttgaaactgtcca

SEQ ID NO: 570486 - DNA, 25 bp, Mus musculus
caggatggcttgatgttacactgac

SEQ ID NO: 570487 - DNA, 25 bp, Mus musculus
caggatggcttgttgttacactgac

SEQ ID NO: 570488 - DNA, 25 bp, Mus musculus
caggatgggatcagcacccttgcag

SEQ ID NO: 570489 - DNA, 25 bp, Mus musculus
caggatgggatcagctgagcaagac

SEQ ID NO: 570490 - DNA, 25 bp, Mus musculus
caggatgggatctgcacccttgcag

SEQ ID NO: 570491 - DNA, 25 bp, Mus musculus
caggatgggatctgctgagcaagac

SEQ ID NO: 570492 - DNA, 25 bp, Mus musculus
caggatgggcaaccaaacaggagca

SEQ ID NO: 570493 - DNA, 25 bp, Mus musculus
caggatgggcaagcaaacaggagca

SEQ ID NO: 570494 - DNA, 25 bp, Mus musculus
caggatgggcttcgcatttggcacc

SEQ ID NO: 570495 - DNA, 25 bp, Mus musculus
caggatgggcttggcatttggcacc

SEQ ID NO: 570496 - DNA, 25 bp, Mus musculus
caggatggggatatgaggtcttcac

SEQ ID NO: 570497 - DNA, 25 bp, Mus musculus
caggatggggatttgaggtcttcac

SEQ ID NO: 570498 - DNA, 25 bp, Mus musculus
caggatgggtacacggccctgttag

SEQ ID NO: 570499 - DNA, 25 bp, Mus musculus
caggatgggtactcggccctgttag

SEQ ID NO: 570500 - DNA, 25 bp, Mus musculus
caggatgggtgaacaagaatgtcct

SEQ ID NO: 570501 - DNA, 25 bp, Mus musculus
caggatgggtgaattcaatgagaag

SEQ ID NO: 570502 - DNA, 25 bp, Mus musculus
caggatgggtgatcaagaatgtcct

SEQ ID NO: 570503 - DNA, 25 bp, Mus musculus
caggatgggtgatttcaatgagaag

SEQ ID NO: 570504 - DNA, 25 bp, Mus musculus
caggatggtcataggctttcctggc

SEQ ID NO: 570505 - DNA, 25 bp, Mus musculus
caggatggtcattggctttcctggc

SEQ ID NO: 570506 - DNA, 25 bp, Mus musculus
caggatggtggtcaagtcttccgtt

SEQ ID NO: 570507 - DNA, 25 bp, Mus musculus
caggatggtggtgaagtcttccgtt

SEQ ID NO: 570508 - DNA, 25 bp, Mus musculus
caggatggtgtcaatgtcttccata

SEQ ID NO: 570509 - DNA, 25 bp, Mus musculus
caggatggtgtcactcgaagattca

SEQ ID NO: 570510 - DNA, 25 bp, Mus musculus
caggatggtgtctatgtcttccata

SEQ ID NO: 570511 - DNA, 25 bp, Mus musculus
caggatggtgtctctcgaagattca

SEQ ID NO: 570512 - DNA, 25 bp, Mus musculus
caggatgtcagaattgtcagcaact

SEQ ID NO: 570513 - DNA, 25 bp, Mus musculus
caggatgtcagatttgtcagcaact

SEQ ID NO: 570514 - DNA, 25 bp, Mus musculus
caggatgtccagatgccttcaaaaa

SEQ ID NO: 570515 - DNA, 25 bp, Mus musculus
caggatgtccagttgccttcaaaaa

SEQ ID NO: 570516 - DNA, 25 bp, Mus musculus
caggatgtgcaccttcttgtcatgc

SEQ ID NO: 570517 - DNA, 25 bp, Mus musculus
caggatgtgcacgttcttgtcatgc

SEQ ID NO: 570518 - DNA, 25 bp, Mus musculus
caggatgtggagagcagtagcagca

SEQ ID NO: 570519 - DNA, 25 bp, Mus musculus
caggatgtggagtgcagtagcagca

SEQ ID NO: 570520 - DNA, 25 bp, Mus musculus
caggatgtgggcacaaaaactacca

SEQ ID NO: 570521 - DNA, 25 bp, Mus musculus
caggatgtgggctcaaaaactacca

SEQ ID NO: 570522 - DNA, 25 bp, Mus musculus
caggatgtggttatcactgacgaga

SEQ ID NO: 570523 - DNA, 25 bp, Mus musculus
caggatgtggttttcactgacgaga

SEQ ID NO: 570524 - DNA, 25 bp, Mus musculus
caggattaccgaaagctgagcagca

SEQ ID NO: 570525 - DNA, 25 bp, Mus musculus
caggattaccgatagctgagcagca

SEQ ID NO: 570526 - DNA, 25 bp, Mus musculus
caggattagagcagcctcactgact

SEQ ID NO: 570527 - DNA, 25 bp, Mus musculus
caggattagagctgcctcactgact

SEQ ID NO: 570528 - DNA, 25 bp, Mus musculus
caggattatacactagctttgcagc

SEQ ID NO: 570529 - DNA, 25 bp, Mus musculus
caggattatacagtagctttgcagc

SEQ ID NO: 570530 - DNA, 25 bp, Mus musculus
caggattatgcacgaagaacaccgc

SEQ ID NO: 570531 - DNA, 25 bp, Mus musculus
caggattatgcaggaagaacaccgc

SEQ ID NO: 570532 - DNA, 25 bp, Mus musculus
caggattatgtcaatgggactgatc

SEQ ID NO: 570533 - DNA, 25 bp, Mus musculus
caggattatgtctatgggactgatc

SEQ ID NO: 570534 - DNA, 25 bp, Mus musculus
caggattcaacgcaactgaagatgc

SEQ ID NO: 570535 - DNA, 25 bp, Mus musculus
caggattcaacggaactgaagatgc

SEQ ID NO: 570536 - DNA, 25 bp, Mus musculus
caggattcaccacgacctcgagagg

SEQ ID NO: 570537 - DNA, 25 bp, Mus musculus
caggattcaccaggacctcgagagg

SEQ ID NO: 570538 - DNA, 25 bp, Mus musculus
caggattcagcccagtttgtgctca

SEQ ID NO: 570539 - DNA, 25 bp, Mus musculus
caggattcagccgagtttgtgctca

SEQ ID NO: 570540 - DNA, 25 bp, Mus musculus
caggattcatagacttcatagctga

SEQ ID NO: 570541 - DNA, 25 bp, Mus musculus
caggattcatagtcttcatagctga

SEQ ID NO: 570542 - DNA, 25 bp, Mus musculus
caggattccatcagcgacccttgtg

SEQ ID NO: 570543 - DNA, 25 bp, Mus musculus
caggattccatctgcgacccttgtg

SEQ ID NO: 570544 - DNA, 25 bp, Mus musculus
caggattcctatcctgctgcggtga

SEQ ID NO: 570545 - DNA, 25 bp, Mus musculus
caggattcctatgctgctgcggtga

SEQ ID NO: 570546 - DNA, 25 bp, Mus musculus
caggattctaagcttcaggagattc

SEQ ID NO: 570547 - DNA, 25 bp, Mus musculus
caggattctaaggttcaggagattc

SEQ ID NO: 570548 - DNA, 25 bp, Mus musculus
caggattctactaaccctattaaga

SEQ ID NO: 570549 - DNA, 25 bp, Mus musculus
caggattctacttaccctattaaga

SEQ ID NO: 570550 - DNA, 25 bp, Mus musculus
caggattctgagagcccttggaccg

SEQ ID NO: 570551 - DNA, 25 bp, Mus musculus
caggattctgagtgcccttggaccg

SEQ ID NO: 570552 - DNA, 25 bp, Mus musculus
caggattctgcaaggcgatgtcaaa

SEQ ID NO: 570553 - DNA, 25 bp, Mus musculus
caggattctgcatggcgatgtcaaa

SEQ ID NO: 570554 - DNA, 25 bp, Mus musculus
caggattctgcccaatgaggacgat

SEQ ID NO: 570555 - DNA, 25 bp, Mus musculus
caggattctgccgaatgaggacgat

SEQ ID NO: 570556 - DNA, 25 bp, Mus musculus
caggattctggaacctggaccgctt

SEQ ID NO: 570557 - DNA, 25 bp, Mus musculus
caggattctggatcctggaccgctt

SEQ ID NO: 570558 - DNA, 25 bp, Mus musculus
caggattgatgcatattcctgatct

SEQ ID NO: 570559 - DNA, 25 bp, Mus musculus
caggattgatgcttattcctgatct

SEQ ID NO: 570560 - DNA, 25 bp, Mus musculus
caggattgccctctcgctgatggac

SEQ ID NO: 570561 - DNA, 25 bp, Mus musculus
caggattgccctgtcgctgatggac

SEQ ID NO: 570562 - DNA, 25 bp, Mus musculus
caggatttcactcctaggaaaagga

SEQ ID NO: 570563 - DNA, 25 bp, Mus musculus
caggatttcactgctaggaaaagga

SEQ ID NO: 570564 - DNA, 25 bp, Mus musculus
caggatttggaaagcaagcctcagg

SEQ ID NO: 570565 - DNA, 25 bp, Mus musculus
caggatttggaatgcaagcctcagg

SEQ ID NO: 570566 - DNA, 25 bp, Mus musculus
caggatttgtacagcctcaatgaga

SEQ ID NO: 570567 - DNA, 25 bp, Mus musculus
caggatttgtactgcctcaatgaga

SEQ ID NO: 570568 - DNA, 25 bp, Mus musculus
caggattttcatcgtgctttgtgct

SEQ ID NO: 570569 - DNA, 25 bp, Mus musculus
caggattttcatggtgctttgtgct

SEQ ID NO: 570570 - DNA, 25 bp, Mus musculus
caggattttgatccatgcagggcaa

SEQ ID NO: 570571 - DNA, 25 bp, Mus musculus
caggattttgatgcatgcagggcaa

SEQ ID NO: 570572 - DNA, 25 bp, Mus musculus
caggcaaactgaagagctattacac

SEQ ID NO: 570573 - DNA, 25 bp, Mus musculus
caggcaaactgatgagctattacac

SEQ ID NO: 570574 - DNA, 25 bp, Mus musculus
caggcaaagcctccggcaatgggaa

SEQ ID NO: 570575 - DNA, 25 bp, Mus musculus
caggcaaagcctgcggcaatgggaa

SEQ ID NO: 570576 - DNA, 25 bp, Mus musculus
caggcaaaggagatctgagtcacac

SEQ ID NO: 570577 - DNA, 25 bp, Mus musculus
caggcaaaggagttctgagtcacac

SEQ ID NO: 570578 - DNA, 25 bp, Mus musculus
caggcaaagtgaaggtcatgaagga

SEQ ID NO: 570579 - DNA, 25 bp, Mus musculus
caggcaaagtgatggtcatgaagga

SEQ ID NO: 570580 - DNA, 25 bp, Mus musculus
caggcaaatagtatcttcaatcggc

SEQ ID NO: 570581 - DNA, 25 bp, Mus musculus
caggcaaatagtttcttcaatcggc

SEQ ID NO: 570582 - DNA, 25 bp, Mus musculus
caggcaaatgagatcatgtggaata

SEQ ID NO: 570583 - DNA, 25 bp, Mus musculus
caggcaaatgagttcatgtggaata

SEQ ID NO: 570584 - DNA, 25 bp, Mus musculus
caggcaaattctcctccaagggata

SEQ ID NO: 570585 - DNA, 25 bp, Mus musculus
caggcaaattctgctccaagggata

SEQ ID NO: 570586 - DNA, 25 bp, Mus musculus
caggcaacacggcaagaacttatct

SEQ ID NO: 570587 - DNA, 25 bp, Mus musculus
caggcaacacgggaagaacttatct

SEQ ID NO: 570588 - DNA, 25 bp, Mus musculus
caggcaacaggactctggcagagcc

SEQ ID NO: 570589 - DNA, 25 bp, Mus musculus
caggcaacaggagtctggcagagcc

SEQ ID NO: 570590 - DNA, 25 bp, Mus musculus
caggcaacgttgacctctataaaaa

SEQ ID NO: 570591 - DNA, 25 bp, Mus musculus
caggcaacgttgtcctctataaaaa

SEQ ID NO: 570592 - DNA, 25 bp, Mus musculus
caggcaactggaagccgctttggaa

SEQ ID NO: 570593 - DNA, 25 bp, Mus musculus
caggcaactggatgccgctttggaa

SEQ ID NO: 570594 - DNA, 25 bp, Mus musculus
caggcaagaactattctcatgcaat

SEQ ID NO: 570595 - DNA, 25 bp, Mus musculus
caggcaagaacttttctcatgcaat

SEQ ID NO: 570596 - DNA, 25 bp, Mus musculus
caggcaagaggaagttgaggaccat

SEQ ID NO: 570597 - DNA, 25 bp, Mus musculus
caggcaagaggatgttgaggaccat

SEQ ID NO: 570598 - DNA, 25 bp, Mus musculus
caggcaaggagccagagcacctcag

SEQ ID NO: 570599 - DNA, 25 bp, Mus musculus
caggcaaggagcgagagcacctcag

SEQ ID NO: 570600 - DNA, 25 bp, Mus musculus
caggcaagtacactgtggtgcacac

SEQ ID NO: 570601 - DNA, 25 bp, Mus musculus
caggcaagtacagtgtggtgcacac

SEQ ID NO: 570602 - DNA, 25 bp, Mus musculus
caggcaagtgtacgcacatacccag

SEQ ID NO: 570603 - DNA, 25 bp, Mus musculus
caggcaagtgtaggcacatacccag

SEQ ID NO: 570604 - DNA, 25 bp, Mus musculus
caggcaatatgaagcccaaactgat

SEQ ID NO: 570605 - DNA, 25 bp, Mus musculus
caggcaatatgatgcccaaactgat

SEQ ID NO: 570606 - DNA, 25 bp, Mus musculus
caggcaatcctgcttgtgtgtgcac

SEQ ID NO: 570607 - DNA, 25 bp, Mus musculus
caggcaatcctggttgtgtgtgcac

SEQ ID NO: 570608 - DNA, 25 bp, Mus musculus
caggcaatggaacgaaaggcccacc

SEQ ID NO: 570609 - DNA, 25 bp, Mus musculus
caggcaatggaaggaaaggcccacc

SEQ ID NO: 570610 - DNA, 25 bp, Mus musculus
caggcaatgtctagccagatgctac

SEQ ID NO: 570611 - DNA, 25 bp, Mus musculus
caggcaatgtcttgccagatgctac

SEQ ID NO: 570612 - DNA, 25 bp, Mus musculus
caggcaatttggataccaggattca

SEQ ID NO: 570613 - DNA, 25 bp, Mus musculus
caggcaatttggttaccaggattca

SEQ ID NO: 570614 - DNA, 25 bp, Mus musculus
caggcacaacgacaacattatgatc

SEQ ID NO: 570615 - DNA, 25 bp, Mus musculus
caggcacaacgagaacattatgatc

SEQ ID NO: 570616 - DNA, 25 bp, Mus musculus
caggcacactgaaggatcccctggg

SEQ ID NO: 570617 - DNA, 25 bp, Mus musculus
caggcacactgatggatcccctggg

SEQ ID NO: 570618 - DNA, 25 bp, Mus musculus
caggcacagagtctatggtcagtca

SEQ ID NO: 570619 - DNA, 25 bp, Mus musculus
caggcacagagtgtatggtcagtca

SEQ ID NO: 570620 - DNA, 25 bp, Mus musculus
caggcacagccgagaacactggagc

SEQ ID NO: 570621 - DNA, 25 bp, Mus musculus
caggcacagccgtgaacactggagc

SEQ ID NO: 570622 - DNA, 25 bp, Mus musculus
caggcacaggtgagctcagatatcc

SEQ ID NO: 570623 - DNA, 25 bp, Mus musculus
caggcacaggtgtgctcagatatcc

SEQ ID NO: 570624 - DNA, 25 bp, Mus musculus
caggcacaggttctgggagacccac

SEQ ID NO: 570625 - DNA, 25 bp, Mus musculus
caggcacaggttgtgggagacccac

SEQ ID NO: 570626 - DNA, 25 bp, Mus musculus
caggcaccatgtctccggagtcctt

SEQ ID NO: 570627 - DNA, 25 bp, Mus musculus
caggcaccatgtgtccggagtcctt

SEQ ID NO: 570628 - DNA, 25 bp, Mus musculus
caggcaccgggtcccggatacaggc

SEQ ID NO: 570629 - DNA, 25 bp, Mus musculus
caggcaccgggtgccggatacaggc

SEQ ID NO: 570630 - DNA, 25 bp, Mus musculus
caggcaccgtgaactcagaacagta

SEQ ID NO: 570631 - DNA, 25 bp, Mus musculus
caggcaccgtgatctcagaacagta

SEQ ID NO: 570632 - DNA, 25 bp, Mus musculus
caggcacctcttactgcgattgaag

SEQ ID NO: 570633 - DNA, 25 bp, Mus musculus
caggcacctctttctgcgattgaag

SEQ ID NO: 570634 - DNA, 25 bp, Mus musculus
caggcacctgacaggtattgaaagc

SEQ ID NO: 570635 - DNA, 25 bp, Mus musculus
caggcacctgactggtattgaaagc

SEQ ID NO: 570636 - DNA, 25 bp, Mus musculus
caggcacctggaaatagttctggac

SEQ ID NO: 570637 - DNA, 25 bp, Mus musculus
caggcacctggatatagttctggac

SEQ ID NO: 570638 - DNA, 25 bp, Mus musculus
caggcacggcttacaaatttcgagt

SEQ ID NO: 570639 - DNA, 25 bp, Mus musculus
caggcacggctttcaaatttcgagt

SEQ ID NO: 570640 - DNA, 25 bp, Mus musculus
caggcacggtacatggacaaggaag

SEQ ID NO: 570641 - DNA, 25 bp, Mus musculus
caggcacggtacttggacaaggaag

SEQ ID NO: 570642 - DNA, 25 bp, Mus musculus
caggcactaaagagagctagctgca

SEQ ID NO: 570643 - DNA, 25 bp, Mus musculus
caggcactaaagtgagctagctgca

SEQ ID NO: 570644 - DNA, 25 bp, Mus musculus
caggcactactgacgttggagctat

SEQ ID NO: 570645 - DNA, 25 bp, Mus musculus
caggcactactgtcgttggagctat

SEQ ID NO: 570646 - DNA, 25 bp, Mus musculus
caggcactcactcaaagctgaggct

SEQ ID NO: 570647 - DNA, 25 bp, Mus musculus
caggcactcactgaaagctgaggct

SEQ ID NO: 570648 - DNA, 25 bp, Mus musculus
caggcactcccaactacgaatgcaa

SEQ ID NO: 570649 - DNA, 25 bp, Mus musculus
caggcactcccatctacgaatgcaa

SEQ ID NO: 570650 - DNA, 25 bp, Mus musculus
caggcactgagtacaggccagggtc

SEQ ID NO: 570651 - DNA, 25 bp, Mus musculus
caggcactgagttcaggccagggtc

SEQ ID NO: 570652 - DNA, 25 bp, Mus musculus
caggcactgccaccgggcgaatcgt

SEQ ID NO: 570653 - DNA, 25 bp, Mus musculus
caggcactgccagcgggcgaatcgt

SEQ ID NO: 570654 - DNA, 25 bp, Mus musculus
caggcactgctccagacttggaaaa

SEQ ID NO: 570655 - DNA, 25 bp, Mus musculus
caggcactgctcgagacttggaaaa

SEQ ID NO: 570656 - DNA, 25 bp, Mus musculus
caggcactgtgcaagtgtccaagag

SEQ ID NO: 570657 - DNA, 25 bp, Mus musculus
caggcactgtgctagtgtccaagag

SEQ ID NO: 570658 - DNA, 25 bp, Mus musculus
caggcacttacgaactgggaatgtg

SEQ ID NO: 570659 - DNA, 25 bp, Mus musculus
caggcacttacgtactgggaatgtg

SEQ ID NO: 570660 - DNA, 25 bp, Mus musculus
caggcacttgcaatgatctggacgc

SEQ ID NO: 570661 - DNA, 25 bp, Mus musculus
caggcacttgcattgatctggacgc

SEQ ID NO: 570662 - DNA, 25 bp, Mus musculus
caggcagaaatcaatgacttggaga

SEQ ID NO: 570663 - DNA, 25 bp, Mus musculus
caggcagaaatctatgacttggaga

SEQ ID NO: 570664 - DNA, 25 bp, Mus musculus
caggcagaaattcggcagaaggatt

SEQ ID NO: 570665 - DNA, 25 bp, Mus musculus
caggcagaaattgggcagaaggatt

SEQ ID NO: 570666 - DNA, 25 bp, Mus musculus
caggcagaagttcgaagaaatgaag

SEQ ID NO: 570667 - DNA, 25 bp, Mus musculus
caggcagaagttggaagaaatgaag

SEQ ID NO: 570668 - DNA, 25 bp, Mus musculus
caggcagacagtcagatgacaggat

SEQ ID NO: 570669 - DNA, 25 bp, Mus musculus
caggcagacagtgagatgacaggat

SEQ ID NO: 570670 - DNA, 25 bp, Mus musculus
caggcagaccatatacttcagggac

SEQ ID NO: 570671 - DNA, 25 bp, Mus musculus
caggcagaccatttacttcagggac

SEQ ID NO: 570672 - DNA, 25 bp, Mus musculus
caggcagagcacaacctgtggtacg

SEQ ID NO: 570673 - DNA, 25 bp, Mus musculus
caggcagagcactacctgtggtacg

SEQ ID NO: 570674 - DNA, 25 bp, Mus musculus
caggcagagctgcagatttactagc

SEQ ID NO: 570675 - DNA, 25 bp, Mus musculus
caggcagagctggagatttactagc

SEQ ID NO: 570676 - DNA, 25 bp, Mus musculus
caggcagagcttaagaaggcccgat

SEQ ID NO: 570677 - DNA, 25 bp, Mus musculus
caggcagagctttagaaggcccgat

SEQ ID NO: 570678 - DNA, 25 bp, Mus musculus
caggcagatgctatggcagccagca

SEQ ID NO: 570679 - DNA, 25 bp, Mus musculus
caggcagatgctttggcagccagca

SEQ ID NO: 570680 - DNA, 25 bp, Mus musculus
caggcagatggtactctcaagccag

SEQ ID NO: 570681 - DNA, 25 bp, Mus musculus
caggcagatggttctctcaagccag

SEQ ID NO: 570682 - DNA, 25 bp, Mus musculus
caggcagatgtccaggcagagcctc

SEQ ID NO: 570683 - DNA, 25 bp, Mus musculus
caggcagatgtcgaggcagagcctc

SEQ ID NO: 570684 - DNA, 25 bp, Mus musculus
caggcagcaatgaacatagtcaact

SEQ ID NO: 570685 - DNA, 25 bp, Mus musculus
caggcagcaatgtacatagtcaact

SEQ ID NO: 570686 - DNA, 25 bp, Mus musculus
caggcagcagctcctatgagccgag

SEQ ID NO: 570687 - DNA, 25 bp, Mus musculus
caggcagcagctgctatgagccgag

SEQ ID NO: 570688 - DNA, 25 bp, Mus musculus
caggcagcagttattaacacgggaa

SEQ ID NO: 570689 - DNA, 25 bp, Mus musculus
caggcagcagtttttaacacgggaa

SEQ ID NO: 570690 - DNA, 25 bp, Mus musculus
caggcagcccgcaatgatggcagac

SEQ ID NO: 570691 - DNA, 25 bp, Mus musculus
caggcagcccgctatgatggcagac

SEQ ID NO: 570692 - DNA, 25 bp, Mus musculus
caggcagcctgtcgctgatggttct

SEQ ID NO: 570693 - DNA, 25 bp, Mus musculus
caggcagcctgtggctgatggttct

SEQ ID NO: 570694 - DNA, 25 bp, Mus musculus
caggcagccttcctgctaaccggtg

SEQ ID NO: 570695 - DNA, 25 bp, Mus musculus
caggcagccttcgtgctaaccggtg

SEQ ID NO: 570696 - DNA, 25 bp, Mus musculus
caggcagcgctcatggaaaataacc

SEQ ID NO: 570697 - DNA, 25 bp, Mus musculus
caggcagcgctcttggaaaataacc

SEQ ID NO: 570698 - DNA, 25 bp, Mus musculus
caggcagcgtatctgtggctgacac

SEQ ID NO: 570699 - DNA, 25 bp, Mus musculus
caggcagcgtatgtgtggctgacac

SEQ ID NO: 570700 - DNA, 25 bp, Mus musculus
caggcagctcatcacactggctggg

SEQ ID NO: 570701 - DNA, 25 bp, Mus musculus
caggcagctcatgacactggctggg

SEQ ID NO: 570702 - DNA, 25 bp, Mus musculus
caggcagctgggaccacgtggtggg

SEQ ID NO: 570703 - DNA, 25 bp, Mus musculus
caggcagctgggtccacgtggtggg

SEQ ID NO: 570704 - DNA, 25 bp, Mus musculus
caggcagctgttcgccctgtcctgt

SEQ ID NO: 570705 - DNA, 25 bp, Mus musculus
caggcagctgttggccctgtcctgt

SEQ ID NO: 570706 - DNA, 25 bp, Mus musculus
caggcaggatggaccgtccatcctg

SEQ ID NO: 570707 - DNA, 25 bp, Mus musculus
caggcaggatggtccgtccatcctg

SEQ ID NO: 570708 - DNA, 25 bp, Mus musculus
caggcaggctacacgggcagctact

SEQ ID NO: 570709 - DNA, 25 bp, Mus musculus
caggcaggctactcgggcagctact

SEQ ID NO: 570710 - DNA, 25 bp, Mus musculus
caggcagtaagaagcatcagttcca

SEQ ID NO: 570711 - DNA, 25 bp, Mus musculus
caggcagtaagatgcatcagttcca

SEQ ID NO: 570712 - DNA, 25 bp, Mus musculus
caggcagtgggcaggaatatagcca

SEQ ID NO: 570713 - DNA, 25 bp, Mus musculus
caggcagtgggctggaatatagcca

SEQ ID NO: 570714 - DNA, 25 bp, Mus musculus
caggcagtgtctatcaagaaggaaa

SEQ ID NO: 570715 - DNA, 25 bp, Mus musculus
caggcagtgtctccgtgacacggac

SEQ ID NO: 570716 - DNA, 25 bp, Mus musculus
caggcagtgtctgcgtgacacggac

SEQ ID NO: 570717 - DNA, 25 bp, Mus musculus
caggcagtgtctttcaagaaggaaa

SEQ ID NO: 570718 - DNA, 25 bp, Mus musculus
caggcatacaagattggaatgaagt

SEQ ID NO: 570719 - DNA, 25 bp, Mus musculus
caggcatacaagtttggaatgaagt

SEQ ID NO: 570720 - DNA, 25 bp, Mus musculus
caggcatcagagacgccatatggga

SEQ ID NO: 570721 - DNA, 25 bp, Mus musculus
caggcatcagagtcgccatatggga

SEQ ID NO: 570722 - DNA, 25 bp, Mus musculus
caggcatccattagacgaaataagg

SEQ ID NO: 570723 - DNA, 25 bp, Mus musculus
caggcatccatttgacgaaataagg

SEQ ID NO: 570724 - DNA, 25 bp, Mus musculus
caggcatccgggacatcatgatcac

SEQ ID NO: 570725 - DNA, 25 bp, Mus musculus
caggcatccgggtcatcatgatcac

SEQ ID NO: 570726 - DNA, 25 bp, Mus musculus
caggcatcgtgtacctgagcccaga

SEQ ID NO: 570727 - DNA, 25 bp, Mus musculus
caggcatcgtgttcctgagcccaga

SEQ ID NO: 570728 - DNA, 25 bp, Mus musculus
caggcatcgtttcccagccagaaca

SEQ ID NO: 570729 - DNA, 25 bp, Mus musculus
caggcatcgtttgccagccagaaca

SEQ ID NO: 570730 - DNA, 25 bp, Mus musculus
caggcatctaggagaacctcataaa

SEQ ID NO: 570731 - DNA, 25 bp, Mus musculus
caggcatctaggtgaacctcataaa

SEQ ID NO: 570732 - DNA, 25 bp, Mus musculus
caggcatgaactccagaactgaagc

SEQ ID NO: 570733 - DNA, 25 bp, Mus musculus
caggcatgaactgcagaactgaagc

SEQ ID NO: 570734 - DNA, 25 bp, Mus musculus
caggcatgacccagcttctgggttc

SEQ ID NO: 570735 - DNA, 25 bp, Mus musculus
caggcatgaccctgcttctgggttc

SEQ ID NO: 570736 - DNA, 25 bp, Mus musculus
caggcatggacaccggaggctcctt

SEQ ID NO: 570737 - DNA, 25 bp, Mus musculus
caggcatggacagcggaggctcctt

SEQ ID NO: 570738 - DNA, 25 bp, Mus musculus
caggcatggactactcctttgatgc

SEQ ID NO: 570739 - DNA, 25 bp, Mus musculus
caggcatggacttctcctttgatgc

SEQ ID NO: 570740 - DNA, 25 bp, Mus musculus
caggcatggatcctcaaaaccggcg

SEQ ID NO: 570741 - DNA, 25 bp, Mus musculus
caggcatggatcgtcaaaaccggcg

SEQ ID NO: 570742 - DNA, 25 bp, Mus musculus
caggcatggcagaccgcatcttggt

SEQ ID NO: 570743 - DNA, 25 bp, Mus musculus
caggcatggcagtccgcatcttggt

SEQ ID NO: 570744 - DNA, 25 bp, Mus musculus
caggcatggctaaggcattctgccc

SEQ ID NO: 570745 - DNA, 25 bp, Mus musculus
caggcatggctatggcattctgccc

SEQ ID NO: 570746 - DNA, 25 bp, Mus musculus
caggcatgttctagctgtgtataca

SEQ ID NO: 570747 - DNA, 25 bp, Mus musculus
caggcatgttcttgctgtgtataca

SEQ ID NO: 570748 - DNA, 25 bp, Mus musculus
caggcattcatgcagactgtgatga

SEQ ID NO: 570749 - DNA, 25 bp, Mus musculus
caggcattcatggagactgtgatga

SEQ ID NO: 570750 - DNA, 25 bp, Mus musculus
caggcattctggagcaggttgtgaa

SEQ ID NO: 570751 - DNA, 25 bp, Mus musculus
caggcattctggtgcaggttgtgaa

SEQ ID NO: 570752 - DNA, 25 bp, Mus musculus
caggcattctgtattgtgggcagtc

SEQ ID NO: 570753 - DNA, 25 bp, Mus musculus
caggcattctgttttgtgggcagtc

SEQ ID NO: 570754 - DNA, 25 bp, Mus musculus
caggcatttatcaccaaagctgggc

SEQ ID NO: 570755 - DNA, 25 bp, Mus musculus
caggcatttatctccaaagctgggc

SEQ ID NO: 570756 - DNA, 25 bp, Mus musculus
caggcatttcagagggacatggctt

SEQ ID NO: 570757 - DNA, 25 bp, Mus musculus
caggcatttcagtgggacatggctt

SEQ ID NO: 570758 - DNA, 25 bp, Mus musculus
caggcattttgtcaccttgtcaagg

SEQ ID NO: 570759 - DNA, 25 bp, Mus musculus
caggcattttgtgaccttgtcaagg

SEQ ID NO: 570760 - DNA, 25 bp, Mus musculus
caggccaaacaccaagagtcagtgt

SEQ ID NO: 570761 - DNA, 25 bp, Mus musculus
caggccaaacacgaagagtcagtgt

SEQ ID NO: 570762 - DNA, 25 bp, Mus musculus
caggccaaaccccagaaggtggtgg

SEQ ID NO: 570763 - DNA, 25 bp, Mus musculus
caggccaaacccgagaaggtggtgg

SEQ ID NO: 570764 - DNA, 25 bp, Mus musculus
caggccaaagtccattcctggtggc

SEQ ID NO: 570765 - DNA, 25 bp, Mus musculus
caggccaaagtcgattcctggtggc

SEQ ID NO: 570766 - DNA, 25 bp, Mus musculus
caggccaaccaaaccacattgtgta

SEQ ID NO: 570767 - DNA, 25 bp, Mus musculus
caggccaaccaatccacattgtgta

SEQ ID NO: 570768 - DNA, 25 bp, Mus musculus
caggccaagaacatgattgatgctg

SEQ ID NO: 570769 - DNA, 25 bp, Mus musculus
caggccaagaacttgattgatgctg

SEQ ID NO: 570770 - DNA, 25 bp, Mus musculus
caggccaagagccaggtggtcttct

SEQ ID NO: 570771 - DNA, 25 bp, Mus musculus
caggccaagagcgaggtggtcttct

SEQ ID NO: 570772 - DNA, 25 bp, Mus musculus
caggccaagtcacgcatgggaaaaa

SEQ ID NO: 570773 - DNA, 25 bp, Mus musculus
caggccaagtcaggcatgggaaaaa

SEQ ID NO: 570774 - DNA, 25 bp, Mus musculus
caggccaatgaactacggaaggtca

SEQ ID NO: 570775 - DNA, 25 bp, Mus musculus
caggccaatgaagtacggaaggtca

SEQ ID NO: 570776 - DNA, 25 bp, Mus musculus
caggccaatttgcacctcattcaaa

SEQ ID NO: 570777 - DNA, 25 bp, Mus musculus
caggccaatttggacctcattcaaa

SEQ ID NO: 570778 - DNA, 25 bp, Mus musculus
caggccacacacaagtctgcagtgt

SEQ ID NO: 570779 - DNA, 25 bp, Mus musculus
caggccacacactagtctgcagtgt

SEQ ID NO: 570780 - DNA, 25 bp, Mus musculus
caggccacagccatctcattctaga

SEQ ID NO: 570781 - DNA, 25 bp, Mus musculus
caggccacagccttctcattctaga

SEQ ID NO: 570782 - DNA, 25 bp, Mus musculus
caggccacagtgactttcatctctt

SEQ ID NO: 570783 - DNA, 25 bp, Mus musculus
caggccacagtgtctttcatctctt

SEQ ID NO: 570784 - DNA, 25 bp, Mus musculus
caggccaccgaaccacagtgaggat

SEQ ID NO: 570785 - DNA, 25 bp, Mus musculus
caggccaccgaagcacagtgaggat

SEQ ID NO: 570786 - DNA, 25 bp, Mus musculus
caggccacctttaagcccgatggaa

SEQ ID NO: 570787 - DNA, 25 bp, Mus musculus
caggccaccttttagcccgatggaa

SEQ ID NO: 570788 - DNA, 25 bp, Mus musculus
caggccactcagcacatttttagct

SEQ ID NO: 570789 - DNA, 25 bp, Mus musculus
caggccactcaggacatttttagct

SEQ ID NO: 570790 - DNA, 25 bp, Mus musculus
caggccactgctctgtatataaaac

SEQ ID NO: 570791 - DNA, 25 bp, Mus musculus
caggccactgctgtgtatataaaac

SEQ ID NO: 570792 - DNA, 25 bp, Mus musculus
caggccagaaggctgtcgaaccctt

SEQ ID NO: 570793 - DNA, 25 bp, Mus musculus
caggccagaagggtgtcgaaccctt

SEQ ID NO: 570794 - DNA, 25 bp, Mus musculus
caggccagaatacgcatgcgtacag

SEQ ID NO: 570795 - DNA, 25 bp, Mus musculus
caggccagaataggcatgcgtacag

SEQ ID NO: 570796 - DNA, 25 bp, Mus musculus
caggccagagcactgtgctggccat

SEQ ID NO: 570797 - DNA, 25 bp, Mus musculus
caggccagagcagtgtgctggccat

SEQ ID NO: 570798 - DNA, 25 bp, Mus musculus
caggccagaggtatggatgatcaca

SEQ ID NO: 570799 - DNA, 25 bp, Mus musculus
caggccagaggtttggatgatcaca

SEQ ID NO: 570800 - DNA, 25 bp, Mus musculus
caggccagcgtaaagcgacttcgag

SEQ ID NO: 570801 - DNA, 25 bp, Mus musculus
caggccagcgtatagcgacttcgag

SEQ ID NO: 570802 - DNA, 25 bp, Mus musculus
caggccagctccctctatgatgaca

SEQ ID NO: 570803 - DNA, 25 bp, Mus musculus
caggccagctccgtctatgatgaca

SEQ ID NO: 570804 - DNA, 25 bp, Mus musculus
caggccaggccaacaagggcaagtg

SEQ ID NO: 570805 - DNA, 25 bp, Mus musculus
caggccaggccatcaagggcaagtg

SEQ ID NO: 570806 - DNA, 25 bp, Mus musculus
caggccaggctgaaccacgctcttg

SEQ ID NO: 570807 - DNA, 25 bp, Mus musculus
caggccaggctgtaccacgctcttg

SEQ ID NO: 570808 - DNA, 25 bp, Mus musculus
caggccagggacataacttcagcag

SEQ ID NO: 570809 - DNA, 25 bp, Mus musculus
caggccagggacttaacttcagcag

SEQ ID NO: 570810 - DNA, 25 bp, Mus musculus
caggccaggtgtacacaggaagatc

SEQ ID NO: 570811 - DNA, 25 bp, Mus musculus
caggccaggtgttcacaggaagatc

SEQ ID NO: 570812 - DNA, 25 bp, Mus musculus
caggccagtcccaactactgcagta

SEQ ID NO: 570813 - DNA, 25 bp, Mus musculus
caggccagtccctactactgcagta

SEQ ID NO: 570814 - DNA, 25 bp, Mus musculus
caggccatagacatcaatgaaccaa

SEQ ID NO: 570815 - DNA, 25 bp, Mus musculus
caggccatagacttcaatgaaccaa

SEQ ID NO: 570816 - DNA, 25 bp, Mus musculus
caggccatcgctatgagagggacca

SEQ ID NO: 570817 - DNA, 25 bp, Mus musculus
caggccatcgctttgagagggacca

SEQ ID NO: 570818 - DNA, 25 bp, Mus musculus
caggccatcggcaatggcaatgggt

SEQ ID NO: 570819 - DNA, 25 bp, Mus musculus
caggccatcggctatggcaatgggt

SEQ ID NO: 570820 - DNA, 25 bp, Mus musculus
caggccatgaagatggtagtcactg

SEQ ID NO: 570821 - DNA, 25 bp, Mus musculus
caggccatgaagttggtagtcactg

SEQ ID NO: 570822 - DNA, 25 bp, Mus musculus
caggccatgcccctgtacttgtgga

SEQ ID NO: 570823 - DNA, 25 bp, Mus musculus
caggccatgcccgtgtacttgtgga

SEQ ID NO: 570824 - DNA, 25 bp, Mus musculus
caggccatggagaggctaattgaac

SEQ ID NO: 570825 - DNA, 25 bp, Mus musculus
caggccatggagtggctaattgaac

SEQ ID NO: 570826 - DNA, 25 bp, Mus musculus
caggccatgggtctggccctctatt

SEQ ID NO: 570827 - DNA, 25 bp, Mus musculus
caggccatgggtgtggccctctatt

SEQ ID NO: 570828 - DNA, 25 bp, Mus musculus
caggcccacagtctgctgcagtttt

SEQ ID NO: 570829 - DNA, 25 bp, Mus musculus
caggcccacagtgtgctgcagtttt

SEQ ID NO: 570830 - DNA, 25 bp, Mus musculus
caggcccagcagcatttcatgggac

SEQ ID NO: 570831 - DNA, 25 bp, Mus musculus
caggcccagcaggatttcatgggac

SEQ ID NO: 570832 - DNA, 25 bp, Mus musculus
caggcccagggacttgtgttcagat

SEQ ID NO: 570833 - DNA, 25 bp, Mus musculus
caggcccagggagttgtgttcagat

SEQ ID NO: 570834 - DNA, 25 bp, Mus musculus
caggcccaggttagcagtacatgac

SEQ ID NO: 570835 - DNA, 25 bp, Mus musculus
caggcccaggtttgcagtacatgac

SEQ ID NO: 570836 - DNA, 25 bp, Mus musculus
caggcccatgtcaacccacaggaga

SEQ ID NO: 570837 - DNA, 25 bp, Mus musculus
caggcccatgtctacccacaggaga

SEQ ID NO: 570838 - DNA, 25 bp, Mus musculus
caggccccagcacatacttctttgt

SEQ ID NO: 570839 - DNA, 25 bp, Mus musculus
caggccccagcagatacttctttgt

SEQ ID NO: 570840 - DNA, 25 bp, Mus musculus
caggccccagttattgtgaaaacag

SEQ ID NO: 570841 - DNA, 25 bp, Mus musculus
caggccccagtttttgtgaaaacag

SEQ ID NO: 570842 - DNA, 25 bp, Mus musculus
caggccccgcggaggacgtcttcag

SEQ ID NO: 570843 - DNA, 25 bp, Mus musculus
caggccccgcggtggacgtcttcag

SEQ ID NO: 570844 - DNA, 25 bp, Mus musculus
caggcccctcctcagcagtatggtg

SEQ ID NO: 570845 - DNA, 25 bp, Mus musculus
caggcccctcctgagcagtatggtg

SEQ ID NO: 570846 - DNA, 25 bp, Mus musculus
caggcccctcggatggatagtcgga

SEQ ID NO: 570847 - DNA, 25 bp, Mus musculus
caggcccctcggttggatagtcgga

SEQ ID NO: 570848 - DNA, 25 bp, Mus musculus
caggcccctttgatccagtacctgg

SEQ ID NO: 570849 - DNA, 25 bp, Mus musculus
caggcccctttgttccagtacctgg

SEQ ID NO: 570850 - DNA, 25 bp, Mus musculus
caggcccgaaatcgcagcgagctat

SEQ ID NO: 570851 - DNA, 25 bp, Mus musculus
caggcccgaaatggcagcgagctat

SEQ ID NO: 570852 - DNA, 25 bp, Mus musculus
caggcccggaagctgctagttcaga

SEQ ID NO: 570853 - DNA, 25 bp, Mus musculus
caggcccggaaggtgctagttcaga

SEQ ID NO: 570854 - DNA, 25 bp, Mus musculus
caggcccggctcagctggaagtggg

SEQ ID NO: 570855 - DNA, 25 bp, Mus musculus
caggcccggctctgctggaagtggg

SEQ ID NO: 570856 - DNA, 25 bp, Mus musculus
caggccctaccgactagcaacaggg

SEQ ID NO: 570857 - DNA, 25 bp, Mus musculus
caggccctaccgtctagcaacaggg

SEQ ID NO: 570858 - DNA, 25 bp, Mus musculus
caggccctcaggaagaatccagaga

SEQ ID NO: 570859 - DNA, 25 bp, Mus musculus
caggccctcaggtagaatccagaga

SEQ ID NO: 570860 - DNA, 25 bp, Mus musculus
caggccctccagagcgtgccggaga

SEQ ID NO: 570861 - DNA, 25 bp, Mus musculus
caggccctccagtgcgtgccggaga

SEQ ID NO: 570862 - DNA, 25 bp, Mus musculus
caggccctgatcacagccctgatgg

SEQ ID NO: 570863 - DNA, 25 bp, Mus musculus
caggccctgatctcagccctgatgg

SEQ ID NO: 570864 - DNA, 25 bp, Mus musculus
caggccctggaaagtagatgggtct

SEQ ID NO: 570865 - DNA, 25 bp, Mus musculus
caggccctggaatgtagatgggtct

SEQ ID NO: 570866 - DNA, 25 bp, Mus musculus
caggccctggacaggctagagagca

SEQ ID NO: 570867 - DNA, 25 bp, Mus musculus
caggccctggactggctagagagca

SEQ ID NO: 570868 - DNA, 25 bp, Mus musculus
caggccctgtggcaccaggcttctt

SEQ ID NO: 570869 - DNA, 25 bp, Mus musculus
caggccctgtgggaccaggcttctt

SEQ ID NO: 570870 - DNA, 25 bp, Mus musculus
caggcccttcctcgttcttataagg

SEQ ID NO: 570871 - DNA, 25 bp, Mus musculus
caggcccttcctggttcttataagg

SEQ ID NO: 570872 - DNA, 25 bp, Mus musculus
caggccgaattgacgacggtgtcca

SEQ ID NO: 570873 - DNA, 25 bp, Mus musculus
caggccgaattgtcgacggtgtcca

SEQ ID NO: 570874 - DNA, 25 bp, Mus musculus
caggccgagtgtccgctcaatgagc

SEQ ID NO: 570875 - DNA, 25 bp, Mus musculus
caggccgagtgtgcgctcaatgagc

SEQ ID NO: 570876 - DNA, 25 bp, Mus musculus
caggccgcactcagaccatggtatc

SEQ ID NO: 570877 - DNA, 25 bp, Mus musculus
caggccgcactctgaccatggtatc

SEQ ID NO: 570878 - DNA, 25 bp, Mus musculus
caggccgccaacctcggtgacttgg

SEQ ID NO: 570879 - DNA, 25 bp, Mus musculus
caggccgccaacgtcggtgacttgg

SEQ ID NO: 570880 - DNA, 25 bp, Mus musculus
caggccgcgaccactttgccgaggg

SEQ ID NO: 570881 - DNA, 25 bp, Mus musculus
caggccgcgacctctttgccgaggg

SEQ ID NO: 570882 - DNA, 25 bp, Mus musculus
caggccgcgaggaaaaaatcacttt

SEQ ID NO: 570883 - DNA, 25 bp, Mus musculus
caggccgcgaggtaaaaatcacttt

SEQ ID NO: 570884 - DNA, 25 bp, Mus musculus
caggccgcgcgaacatggcgcttgt

SEQ ID NO: 570885 - DNA, 25 bp, Mus musculus
caggccgcgcgatcatggcgcttgt

SEQ ID NO: 570886 - DNA, 25 bp, Mus musculus
caggccgggaaccatccttggaaat

SEQ ID NO: 570887 - DNA, 25 bp, Mus musculus
caggccgggaacgatccttggaaat

SEQ ID NO: 570888 - DNA, 25 bp, Mus musculus
caggccgggatgattggttcttcaa

SEQ ID NO: 570889 - DNA, 25 bp, Mus musculus
caggccgggatgtttggttcttcaa

SEQ ID NO: 570890 - DNA, 25 bp, Mus musculus
caggccggggccattgatctcagga

SEQ ID NO: 570891 - DNA, 25 bp, Mus musculus
caggccggggcctttgatctcagga

SEQ ID NO: 570892 - DNA, 25 bp, Mus musculus
caggccgtgatgagcagccgatgct

SEQ ID NO: 570893 - DNA, 25 bp, Mus musculus
caggccgtgatgtgcagccgatgct

SEQ ID NO: 570894 - DNA, 25 bp, Mus musculus
caggcctaaatacgctggatatagc

SEQ ID NO: 570895 - DNA, 25 bp, Mus musculus
caggcctaaataggctggatatagc

SEQ ID NO: 570896 - DNA, 25 bp, Mus musculus
caggcctacttcaggaccattgagg

SEQ ID NO: 570897 - DNA, 25 bp, Mus musculus
caggcctacttctggaccattgagg

SEQ ID NO: 570898 - DNA, 25 bp, Mus musculus
caggcctagggtccatttctcagca

SEQ ID NO: 570899 - DNA, 25 bp, Mus musculus
caggcctagggtgcatttctcagca

SEQ ID NO: 570900 - DNA, 25 bp, Mus musculus
caggcctcaggcacattatagtcaa

SEQ ID NO: 570901 - DNA, 25 bp, Mus musculus
caggcctcaggctcattatagtcaa

SEQ ID NO: 570902 - DNA, 25 bp, Mus musculus
caggcctcagggacaagtatgtctt

SEQ ID NO: 570903 - DNA, 25 bp, Mus musculus
caggcctcagggtcaagtatgtctt

SEQ ID NO: 570904 - DNA, 25 bp, Mus musculus
caggcctccaagctggaccagtttg

SEQ ID NO: 570905 - DNA, 25 bp, Mus musculus
caggcctccaaggtggaccagtttg

SEQ ID NO: 570906 - DNA, 25 bp, Mus musculus
caggcctcccagaggtctcttctac

SEQ ID NO: 570907 - DNA, 25 bp, Mus musculus
caggcctcccagtggtctcttctac

SEQ ID NO: 570908 - DNA, 25 bp, Mus musculus
caggcctccctgcatggatagttct

SEQ ID NO: 570909 - DNA, 25 bp, Mus musculus
caggcctccctggatggatagttct

SEQ ID NO: 570910 - DNA, 25 bp, Mus musculus
caggcctcggtcctagaagatggca

SEQ ID NO: 570911 - DNA, 25 bp, Mus musculus
caggcctcggtcgtagaagatggca

SEQ ID NO: 570912 - DNA, 25 bp, Mus musculus
caggcctcttgcaatgcggaaggag

SEQ ID NO: 570913 - DNA, 25 bp, Mus musculus
caggcctcttgctatgcggaaggag

SEQ ID NO: 570914 - DNA, 25 bp, Mus musculus
caggcctgaaaaaagcacacaggac

SEQ ID NO: 570915 - DNA, 25 bp, Mus musculus
caggcctgaaaatagcacacaggac

SEQ ID NO: 570916 - DNA, 25 bp, Mus musculus
caggcctgactcacgggtaaaggca

SEQ ID NO: 570917 - DNA, 25 bp, Mus musculus
caggcctgactctcgggtaaaggca

SEQ ID NO: 570918 - DNA, 25 bp, Mus musculus
caggcctgagccctaagaactgtgc

SEQ ID NO: 570919 - DNA, 25 bp, Mus musculus
caggcctgagccgtaagaactgtgc

SEQ ID NO: 570920 - DNA, 25 bp, Mus musculus
caggcctgcaagagtacaccttcac

SEQ ID NO: 570921 - DNA, 25 bp, Mus musculus
caggcctgcaagtgtacaccttcac

SEQ ID NO: 570922 - DNA, 25 bp, Mus musculus
caggcctgcaatagctgtacttggg

SEQ ID NO: 570923 - DNA, 25 bp, Mus musculus
caggcctgcaattgctgtacttggg

SEQ ID NO: 570924 - DNA, 25 bp, Mus musculus
caggcctgccttaggctatagcaaa

SEQ ID NO: 570925 - DNA, 25 bp, Mus musculus
caggcctgcctttggctatagcaaa

SEQ ID NO: 570926 - DNA, 25 bp, Mus musculus
caggcctggcatcttggctcatgga

SEQ ID NO: 570927 - DNA, 25 bp, Mus musculus
caggcctggcatgttggctcatgga

SEQ ID NO: 570928 - DNA, 25 bp, Mus musculus
caggcctggccacgagctaacgaag

SEQ ID NO: 570929 - DNA, 25 bp, Mus musculus
caggcctggccaggagctaacgaag

SEQ ID NO: 570930 - DNA, 25 bp, Mus musculus
caggcctggcttataaagaacaaaa

SEQ ID NO: 570931 - DNA, 25 bp, Mus musculus
caggcctggcttttaaagaacaaaa

SEQ ID NO: 570932 - DNA, 25 bp, Mus musculus
caggcctgggtgacgtcaacgcagc

SEQ ID NO: 570933 - DNA, 25 bp, Mus musculus
caggcctgggtgtcgtcaacgcagc

SEQ ID NO: 570934 - DNA, 25 bp, Mus musculus
caggcctggtctctctgggacctca

SEQ ID NO: 570935 - DNA, 25 bp, Mus musculus
caggcctggtctgtctgggacctca

SEQ ID NO: 570936 - DNA, 25 bp, Mus musculus
caggcctgtctgaaaaggttgtgaa

SEQ ID NO: 570937 - DNA, 25 bp, Mus musculus
caggcctgtctgctcttgagattgg

SEQ ID NO: 570938 - DNA, 25 bp, Mus musculus
caggcctgtctgcttgctgttgaga

SEQ ID NO: 570939 - DNA, 25 bp, Mus musculus
caggcctgtctggtcttgagattgg

SEQ ID NO: 570940 - DNA, 25 bp, Mus musculus
caggcctgtctggttgctgttgaga

SEQ ID NO: 570941 - DNA, 25 bp, Mus musculus
caggcctgtctgtaaaggttgtgaa

SEQ ID NO: 570942 - DNA, 25 bp, Mus musculus
caggcctgtgacacaggctgggact

SEQ ID NO: 570943 - DNA, 25 bp, Mus musculus
caggcctgtgactcaggctgggact

SEQ ID NO: 570944 - DNA, 25 bp, Mus musculus
caggcctgtgatagtcctcagcgga

SEQ ID NO: 570945 - DNA, 25 bp, Mus musculus
caggcctgtgattgtcctcagcgga

SEQ ID NO: 570946 - DNA, 25 bp, Mus musculus
caggccttaaagcagttggagcaac

SEQ ID NO: 570947 - DNA, 25 bp, Mus musculus
caggccttaaaggagttggagcaac

SEQ ID NO: 570948 - DNA, 25 bp, Mus musculus
caggccttacctccagatctttggg

SEQ ID NO: 570949 - DNA, 25 bp, Mus musculus
caggccttacctgcagatctttggg

SEQ ID NO: 570950 - DNA, 25 bp, Mus musculus
caggccttcatgcatatcgatcggg

SEQ ID NO: 570951 - DNA, 25 bp, Mus musculus
caggccttcatggatatcgatcggg

SEQ ID NO: 570952 - DNA, 25 bp, Mus musculus
caggccttcgagcagaacatggccc

SEQ ID NO: 570953 - DNA, 25 bp, Mus musculus
caggccttcgaggagaacatggccc

SEQ ID NO: 570954 - DNA, 25 bp, Mus musculus
caggccttctgtcattttgctagga

SEQ ID NO: 570955 - DNA, 25 bp, Mus musculus
caggccttctgtgattttgctagga

SEQ ID NO: 570956 - DNA, 25 bp, Mus musculus
caggccttggaaaagactgcttaca

SEQ ID NO: 570957 - DNA, 25 bp, Mus musculus
caggccttggaatagactgcttaca

SEQ ID NO: 570958 - DNA, 25 bp, Mus musculus
caggccttgttgctggccaagaaca

SEQ ID NO: 570959 - DNA, 25 bp, Mus musculus
caggccttgttggtggccaagaaca

SEQ ID NO: 570960 - DNA, 25 bp, Mus musculus
caggcctttaacctactctcacaag

SEQ ID NO: 570961 - DNA, 25 bp, Mus musculus
caggcctttaacgtactctcacaag

SEQ ID NO: 570962 - DNA, 25 bp, Mus musculus
caggcctttcctaggacaccttggc

SEQ ID NO: 570963 - DNA, 25 bp, Mus musculus
caggcctttccttggacaccttggc

SEQ ID NO: 570964 - DNA, 25 bp, Mus musculus
caggcctttgaccagatgctcagga

SEQ ID NO: 570965 - DNA, 25 bp, Mus musculus
caggcctttgacgagatgctcagga

SEQ ID NO: 570966 - DNA, 25 bp, Mus musculus
caggcctttgagatgggagatacaa

SEQ ID NO: 570967 - DNA, 25 bp, Mus musculus
caggcctttgagttgggagatacaa

SEQ ID NO: 570968 - DNA, 25 bp, Mus musculus
caggcgaaaccacgagagacccagg

SEQ ID NO: 570969 - DNA, 25 bp, Mus musculus
caggcgaaaccaggagagacccagg

SEQ ID NO: 570970 - DNA, 25 bp, Mus musculus
caggcgaaggatcacgccaagctag

SEQ ID NO: 570971 - DNA, 25 bp, Mus musculus
caggcgaaggatgacgccaagctag

SEQ ID NO: 570972 - DNA, 25 bp, Mus musculus
caggcgagaaaacctctctagagtc

SEQ ID NO: 570973 - DNA, 25 bp, Mus musculus
caggcgagaaaagctctctagagtc

SEQ ID NO: 570974 - DNA, 25 bp, Mus musculus
caggcgagccagcacaaagtgtgca

SEQ ID NO: 570975 - DNA, 25 bp, Mus musculus
caggcgagccaggacaaagtgtgca

SEQ ID NO: 570976 - DNA, 25 bp, Mus musculus
caggcgagctggagtccaagcagct

SEQ ID NO: 570977 - DNA, 25 bp, Mus musculus
caggcgagctggtgtccaagcagct

SEQ ID NO: 570978 - DNA, 25 bp, Mus musculus
caggcgaggatgctattgagaccca

SEQ ID NO: 570979 - DNA, 25 bp, Mus musculus
caggcgaggatggtattgagaccca

SEQ ID NO: 570980 - DNA, 25 bp, Mus musculus
caggcgatgtgcaggtctgatagct

SEQ ID NO: 570981 - DNA, 25 bp, Mus musculus
caggcgatgtgctggtctgatagct

SEQ ID NO: 570982 - DNA, 25 bp, Mus musculus
caggcgatttgtctgtctgttacag

SEQ ID NO: 570983 - DNA, 25 bp, Mus musculus
caggcgatttgtgtgtctgttacag

SEQ ID NO: 570984 - DNA, 25 bp, Mus musculus
caggcgcaatgcacatgtgaagcca

SEQ ID NO: 570985 - DNA, 25 bp, Mus musculus
caggcgcaatgctcatgtgaagcca

SEQ ID NO: 570986 - DNA, 25 bp, Mus musculus
caggcgcaatgtcacaagctgctca

SEQ ID NO: 570987 - DNA, 25 bp, Mus musculus
caggcgcaatgtgacaagctgctca

SEQ ID NO: 570988 - DNA, 25 bp, Mus musculus
caggcgcaggctacgtggctcgcca

SEQ ID NO: 570989 - DNA, 25 bp, Mus musculus
caggcgcaggcttcgtggctcgcca

SEQ ID NO: 570990 - DNA, 25 bp, Mus musculus
caggcgccaaagaggccactgcggc

SEQ ID NO: 570991 - DNA, 25 bp, Mus musculus
caggcgccaaagtggccactgcggc

SEQ ID NO: 570992 - DNA, 25 bp, Mus musculus
caggcgccatgtacatcctgggtac

SEQ ID NO: 570993 - DNA, 25 bp, Mus musculus
caggcgccatgttcatcctgggtac

SEQ ID NO: 570994 - DNA, 25 bp, Mus musculus
caggcgcgaataattactgggaggt

SEQ ID NO: 570995 - DNA, 25 bp, Mus musculus
caggcgcgaatatttactgggaggt

SEQ ID NO: 570996 - DNA, 25 bp, Mus musculus
caggcgcggagtaagacctcgccgt

SEQ ID NO: 570997 - DNA, 25 bp, Mus musculus
caggcgcggagttagacctcgccgt

SEQ ID NO: 570998 - DNA, 25 bp, Mus musculus
caggcgcggtgcacagtgctcttct

SEQ ID NO: 570999 - DNA, 25 bp, Mus musculus
caggcgcggtgctcagtgctcttct

SEQ ID NO: 571000 - DNA, 25 bp, Mus musculus
caggcgctctggaagtttgtaaaca

SEQ ID NO: 571001 - DNA, 25 bp, Mus musculus
caggcgctctggtagtttgtaaaca

SEQ ID NO: 571002 - DNA, 25 bp, Mus musculus
caggcgctgctgctacaatggctgt

SEQ ID NO: 571003 - DNA, 25 bp, Mus musculus
caggcgctgctgctacatgctagga

SEQ ID NO: 571004 - DNA, 25 bp, Mus musculus
caggcgctgctggtacaatggctgt

SEQ ID NO: 571005 - DNA, 25 bp, Mus musculus
caggcgctgctggtacatgctagga

SEQ ID NO: 571006 - DNA, 25 bp, Mus musculus
caggcgctggcccactttgctgtgc

SEQ ID NO: 571007 - DNA, 25 bp, Mus musculus
caggcgctggccgactttgctgtgc

SEQ ID NO: 571008 - DNA, 25 bp, Mus musculus
caggcgcttaaacggtggagtagag

SEQ ID NO: 571009 - DNA, 25 bp, Mus musculus
caggcgcttaaagggtggagtagag

SEQ ID NO: 571010 - DNA, 25 bp, Mus musculus
caggcgcttctgacgttgttcttga

SEQ ID NO: 571011 - DNA, 25 bp, Mus musculus
caggcgcttctgtcgttgttcttga

SEQ ID NO: 571012 - DNA, 25 bp, Mus musculus
caggcgcttgtaagattccatgcag

SEQ ID NO: 571013 - DNA, 25 bp, Mus musculus
caggcgcttgtatgattccatgcag

SEQ ID NO: 571014 - DNA, 25 bp, Mus musculus
caggcgcttttgcatcctagccgca

SEQ ID NO: 571015 - DNA, 25 bp, Mus musculus
caggcgcttttggatcctagccgca

SEQ ID NO: 571016 - DNA, 25 bp, Mus musculus
caggcggaggagatgctgagtggca

SEQ ID NO: 571017 - DNA, 25 bp, Mus musculus
caggcggaggagttgctgagtggca

SEQ ID NO: 571018 - DNA, 25 bp, Mus musculus
caggcggagtagacaatctgctcgt

SEQ ID NO: 571019 - DNA, 25 bp, Mus musculus
caggcggagtagtcaatctgctcgt

SEQ ID NO: 571020 - DNA, 25 bp, Mus musculus
caggcggcaggtcaagtctgccctt

SEQ ID NO: 571021 - DNA, 25 bp, Mus musculus
caggcggcaggtgaagtctgccctt

SEQ ID NO: 571022 - DNA, 25 bp, Mus musculus
caggcggcgagaagctcggtcccac

SEQ ID NO: 571023 - DNA, 25 bp, Mus musculus
caggcggcgagatgctcggtcccac

SEQ ID NO: 571024 - DNA, 25 bp, Mus musculus
caggcggcgccgacgtgtagacttc

SEQ ID NO: 571025 - DNA, 25 bp, Mus musculus
caggcggcgccgtcgtgtagacttc

SEQ ID NO: 571026 - DNA, 25 bp, Mus musculus
caggcggcggagacattccccttct

SEQ ID NO: 571027 - DNA, 25 bp, Mus musculus
caggcggcggagtcattccccttct

SEQ ID NO: 571028 - DNA, 25 bp, Mus musculus
caggcggctaccatctgcaggtcta

SEQ ID NO: 571029 - DNA, 25 bp, Mus musculus
caggcggctaccttctgcaggtcta

SEQ ID NO: 571030 - DNA, 25 bp, Mus musculus
caggcggctcgcagggtaaagcact

SEQ ID NO: 571031 - DNA, 25 bp, Mus musculus
caggcggctcgctgggtaaagcact

SEQ ID NO: 571032 - DNA, 25 bp, Mus musculus
caggcgggactgcaggccaacttct

SEQ ID NO: 571033 - DNA, 25 bp, Mus musculus
caggcgggactggaggccaacttct

SEQ ID NO: 571034 - DNA, 25 bp, Mus musculus
caggcgggtttcacttgcattggaa

SEQ ID NO: 571035 - DNA, 25 bp, Mus musculus
caggcgggtttctcttgcattggaa

SEQ ID NO: 571036 - DNA, 25 bp, Mus musculus
caggcggtagaacctccacctgact

SEQ ID NO: 571037 - DNA, 25 bp, Mus musculus
caggcggtagaagctccacctgact

SEQ ID NO: 571038 - DNA, 25 bp, Mus musculus
caggcgtaagctccagagcggctaa

SEQ ID NO: 571039 - DNA, 25 bp, Mus musculus
caggcgtaagctgcagagcggctaa

SEQ ID NO: 571040 - DNA, 25 bp, Mus musculus
caggcgtaagtcatccctgtttgct

SEQ ID NO: 571041 - DNA, 25 bp, Mus musculus
caggcgtaagtcttccctgtttgct

SEQ ID NO: 571042 - DNA, 25 bp, Mus musculus
caggcgtcctagctgctgttctaac

SEQ ID NO: 571043 - DNA, 25 bp, Mus musculus
caggcgtcctaggtgctgttctaac

SEQ ID NO: 571044 - DNA, 25 bp, Mus musculus
caggcgtctgcaccaatactgtagg

SEQ ID NO: 571045 - DNA, 25 bp, Mus musculus
caggcgtctgcagcaatactgtagg

SEQ ID NO: 571046 - DNA, 25 bp, Mus musculus
caggcgtgagtgagaatgtgccaac

SEQ ID NO: 571047 - DNA, 25 bp, Mus musculus
caggcgtgagtgtgaatgtgccaac

SEQ ID NO: 571048 - DNA, 25 bp, Mus musculus
caggcgttatccctagaatcaaacg

SEQ ID NO: 571049 - DNA, 25 bp, Mus musculus
caggcgttatccgtagaatcaaacg

SEQ ID NO: 571050 - DNA, 25 bp, Mus musculus
caggcgttatcgatccggatccagg

SEQ ID NO: 571051 - DNA, 25 bp, Mus musculus
caggcgttatcgttccggatccagg

SEQ ID NO: 571052 - DNA, 25 bp, Mus musculus
caggcgttatctctcataaatagtc

SEQ ID NO: 571053 - DNA, 25 bp, Mus musculus
caggcgttatctgtcataaatagtc

SEQ ID NO: 571054 - DNA, 25 bp, Mus musculus
caggcgtttaatccttacaaggctc

SEQ ID NO: 571055 - DNA, 25 bp, Mus musculus
caggcgtttaatgcttacaaggctc

SEQ ID NO: 571056 - DNA, 25 bp, Mus musculus
caggcgtttggacagaagatcacca

SEQ ID NO: 571057 - DNA, 25 bp, Mus musculus
caggcgtttggagagaagatcacca

SEQ ID NO: 571058 - DNA, 25 bp, Mus musculus
caggctaagcctacctcccaggagt

SEQ ID NO: 571059 - DNA, 25 bp, Mus musculus
caggctaagccttcctcccaggagt

SEQ ID NO: 571060 - DNA, 25 bp, Mus musculus
caggctaagtccaaccataggtgtc

SEQ ID NO: 571061 - DNA, 25 bp, Mus musculus
caggctaagtcctaccataggtgtc

SEQ ID NO: 571062 - DNA, 25 bp, Mus musculus
caggctaatgctagaatctgcagta

SEQ ID NO: 571063 - DNA, 25 bp, Mus musculus
caggctaatgcttgaatctgcagta

SEQ ID NO: 571064 - DNA, 25 bp, Mus musculus
caggctaatgttatgtcgcttactc

SEQ ID NO: 571065 - DNA, 25 bp, Mus musculus
caggctaatgttttgtcgcttactc

SEQ ID NO: 571066 - DNA, 25 bp, Mus musculus
caggctacactgcatatttttgcga

SEQ ID NO: 571067 - DNA, 25 bp, Mus musculus
caggctacactggatatttttgcga

SEQ ID NO: 571068 - DNA, 25 bp, Mus musculus
caggctacagccaagactcgttctt

SEQ ID NO: 571069 - DNA, 25 bp, Mus musculus
caggctacagcctagactcgttctt

SEQ ID NO: 571070 - DNA, 25 bp, Mus musculus
caggctaccctgacatcgttgaaga

SEQ ID NO: 571071 - DNA, 25 bp, Mus musculus
caggctaccctgtcatcgttgaaga

SEQ ID NO: 571072 - DNA, 25 bp, Mus musculus
caggctacggaaatcttgaatgaat

SEQ ID NO: 571073 - DNA, 25 bp, Mus musculus
caggctacggaattcttgaatgaat

SEQ ID NO: 571074 - DNA, 25 bp, Mus musculus
caggctactgggatggtgtccgata

SEQ ID NO: 571075 - DNA, 25 bp, Mus musculus
caggctactgggttggtgtccgata

SEQ ID NO: 571076 - DNA, 25 bp, Mus musculus
caggctagtgttccccagagctccg

SEQ ID NO: 571077 - DNA, 25 bp, Mus musculus
caggctagtgttgcccagagctccg

SEQ ID NO: 571078 - DNA, 25 bp, Mus musculus
caggctatcattacctgcgttcaac

SEQ ID NO: 571079 - DNA, 25 bp, Mus musculus
caggctatcatttcctgcgttcaac

SEQ ID NO: 571080 - DNA, 25 bp, Mus musculus
caggctatctctaccaggagcagca

SEQ ID NO: 571081 - DNA, 25 bp, Mus musculus
caggctatctcttccaggagcagca

SEQ ID NO: 571082 - DNA, 25 bp, Mus musculus
caggctatgaggcacagaactgctc

SEQ ID NO: 571083 - DNA, 25 bp, Mus musculus
caggctatgagggacagaactgctc

SEQ ID NO: 571084 - DNA, 25 bp, Mus musculus
caggctatggaaccagaatctctct

SEQ ID NO: 571085 - DNA, 25 bp, Mus musculus
caggctatggaagcagaatctctct

SEQ ID NO: 571086 - DNA, 25 bp, Mus musculus
caggctatgtccacacagatggtga

SEQ ID NO: 571087 - DNA, 25 bp, Mus musculus
caggctatgtcctcacagatggtga

SEQ ID NO: 571088 - DNA, 25 bp, Mus musculus
caggctcagatgatgcaaagctcat

SEQ ID NO: 571089 - DNA, 25 bp, Mus musculus
caggctcagatgttgcaaagctcat

SEQ ID NO: 571090 - DNA, 25 bp, Mus musculus
caggctcagcctctacagtctgtct

SEQ ID NO: 571091 - DNA, 25 bp, Mus musculus
caggctcagcctgtacagtctgtct

SEQ ID NO: 571092 - DNA, 25 bp, Mus musculus
caggctcaggccaagtttgacagct

SEQ ID NO: 571093 - DNA, 25 bp, Mus musculus
caggctcaggcctagtttgacagct

SEQ ID NO: 571094 - DNA, 25 bp, Mus musculus
caggctcagtggaaggaacatccta

SEQ ID NO: 571095 - DNA, 25 bp, Mus musculus
caggctcagtggtaggaacatccta

SEQ ID NO: 571096 - DNA, 25 bp, Mus musculus
caggctcattgcagctgagcgagag

SEQ ID NO: 571097 - DNA, 25 bp, Mus musculus
caggctcattgctgctgagcgagag

SEQ ID NO: 571098 - DNA, 25 bp, Mus musculus
caggctcattgtcccttacgctggg

SEQ ID NO: 571099 - DNA, 25 bp, Mus musculus
caggctcattgtgccttacgctggg

SEQ ID NO: 571100 - DNA, 25 bp, Mus musculus
caggctccaagtccacaggagtgtg

SEQ ID NO: 571101 - DNA, 25 bp, Mus musculus
caggctccaagtgcacaggagtgtg

SEQ ID NO: 571102 - DNA, 25 bp, Mus musculus
caggctccatcacgtgcaaaggata

SEQ ID NO: 571103 - DNA, 25 bp, Mus musculus
caggctccatcaggtgcaaaggata

SEQ ID NO: 571104 - DNA, 25 bp, Mus musculus
caggctccatgcaaattctagtagg

SEQ ID NO: 571105 - DNA, 25 bp, Mus musculus
caggctccatgctaattctagtagg

SEQ ID NO: 571106 - DNA, 25 bp, Mus musculus
caggctccatttcgtggcttcaaaa

SEQ ID NO: 571107 - DNA, 25 bp, Mus musculus
caggctccatttggtggcttcaaaa

SEQ ID NO: 571108 - DNA, 25 bp, Mus musculus
caggctcccatcatcagcagatgtg

SEQ ID NO: 571109 - DNA, 25 bp, Mus musculus
caggctcccatcttcagcagatgtg

SEQ ID NO: 571110 - DNA, 25 bp, Mus musculus
caggctccccgtaagagatgagtca

SEQ ID NO: 571111 - DNA, 25 bp, Mus musculus
caggctccccgttagagatgagtca

SEQ ID NO: 571112 - DNA, 25 bp, Mus musculus
caggctcccgcgagaccgtggtgct

SEQ ID NO: 571113 - DNA, 25 bp, Mus musculus
caggctcccgcgtgaccgtggtgct

SEQ ID NO: 571114 - DNA, 25 bp, Mus musculus
caggctccgagcagtctctggtgcg

SEQ ID NO: 571115 - DNA, 25 bp, Mus musculus
caggctccgagctgtctctggtgcg

SEQ ID NO: 571116 - DNA, 25 bp, Mus musculus
caggctccggtgatttaatgatagg

SEQ ID NO: 571117 - DNA, 25 bp, Mus musculus
caggctccggtgttttaatgatagg

SEQ ID NO: 571118 - DNA, 25 bp, Mus musculus
caggctcctcgaagtaccagcttaa

SEQ ID NO: 571119 - DNA, 25 bp, Mus musculus
caggctcctcgatgtaccagcttaa

SEQ ID NO: 571120 - DNA, 25 bp, Mus musculus
caggctcctgccaagtaatacaaca

SEQ ID NO: 571121 - DNA, 25 bp, Mus musculus
caggctcctgcctagtaatacaaca

SEQ ID NO: 571122 - DNA, 25 bp, Mus musculus
caggctcctggacgtcctgagcact

SEQ ID NO: 571123 - DNA, 25 bp, Mus musculus
caggctcctggaggtcctgagcact

SEQ ID NO: 571124 - DNA, 25 bp, Mus musculus
caggctcggtgtctggctcaccttg

SEQ ID NO: 571125 - DNA, 25 bp, Mus musculus
caggctcggtgtgtggctcaccttg

SEQ ID NO: 571126 - DNA, 25 bp, Mus musculus
caggctctcagcagggttaaagagg

SEQ ID NO: 571127 - DNA, 25 bp, Mus musculus
caggctctcagctgggttaaagagg

SEQ ID NO: 571128 - DNA, 25 bp, Mus musculus
caggctctcagtccatcacagtggg

SEQ ID NO: 571129 - DNA, 25 bp, Mus musculus
caggctctcagtgcatcacagtggg

SEQ ID NO: 571130 - DNA, 25 bp, Mus musculus
caggctctccctcttgaggcagaat

SEQ ID NO: 571131 - DNA, 25 bp, Mus musculus
caggctctccctgttgaggcagaat

SEQ ID NO: 571132 - DNA, 25 bp, Mus musculus
caggctctctgtacaggaaaaccag

SEQ ID NO: 571133 - DNA, 25 bp, Mus musculus
caggctctctgttcaggaaaaccag

SEQ ID NO: 571134 - DNA, 25 bp, Mus musculus
caggctctgcaacatttagccccag

SEQ ID NO: 571135 - DNA, 25 bp, Mus musculus
caggctctgcaagatttagccccag

SEQ ID NO: 571136 - DNA, 25 bp, Mus musculus
caggctctgcgacgcttcagaggac

SEQ ID NO: 571137 - DNA, 25 bp, Mus musculus
caggctctgcgaggcttcagaggac

SEQ ID NO: 571138 - DNA, 25 bp, Mus musculus
caggctctgttgacatgaaggtgaa

SEQ ID NO: 571139 - DNA, 25 bp, Mus musculus
caggctctgttgtcatgaaggtgaa

SEQ ID NO: 571140 - DNA, 25 bp, Mus musculus
caggctgaccagaacgaccttagtt

SEQ ID NO: 571141 - DNA, 25 bp, Mus musculus
caggctgaccagtacgaccttagtt

SEQ ID NO: 571142 - DNA, 25 bp, Mus musculus
caggctgacctcattgacgcagtta

SEQ ID NO: 571143 - DNA, 25 bp, Mus musculus
caggctgacctctttgacgcagtta

SEQ ID NO: 571144 - DNA, 25 bp, Mus musculus
caggctgacttcaagagtctgtgaa

SEQ ID NO: 571145 - DNA, 25 bp, Mus musculus
caggctgacttctagagtctgtgaa

SEQ ID NO: 571146 - DNA, 25 bp, Mus musculus
caggctgagatgattattcagaatg

SEQ ID NO: 571147 - DNA, 25 bp, Mus musculus
caggctgagatgtttattcagaatg

SEQ ID NO: 571148 - DNA, 25 bp, Mus musculus
caggctgagcggatttggccaatcg

SEQ ID NO: 571149 - DNA, 25 bp, Mus musculus
caggctgagcggttttggccaatcg

SEQ ID NO: 571150 - DNA, 25 bp, Mus musculus
caggctgagtaaaatcagaatgtac

SEQ ID NO: 571151 - DNA, 25 bp, Mus musculus
caggctgagtaatatcagaatgtac

SEQ ID NO: 571152 - DNA, 25 bp, Mus musculus
caggctgcatgaccgaagttcctga

SEQ ID NO: 571153 - DNA, 25 bp, Mus musculus
caggctgcatgagcgaagttcctga

SEQ ID NO: 571154 - DNA, 25 bp, Mus musculus
caggctgcatggaggcaaggactca

SEQ ID NO: 571155 - DNA, 25 bp, Mus musculus
caggctgcatggtggcaaggactca

SEQ ID NO: 571156 - DNA, 25 bp, Mus musculus
caggctgccctcacctagtatggct

SEQ ID NO: 571157 - DNA, 25 bp, Mus musculus
caggctgccctctcctagtatggct

SEQ ID NO: 571158 - DNA, 25 bp, Mus musculus
caggctgccggaagatccctgtcct

SEQ ID NO: 571159 - DNA, 25 bp, Mus musculus
caggctgccggatgatccctgtcct

SEQ ID NO: 571160 - DNA, 25 bp, Mus musculus
caggctgcctggagcgagcacttgc

SEQ ID NO: 571161 - DNA, 25 bp, Mus musculus
caggctgcctggtgcgagcacttgc

SEQ ID NO: 571162 - DNA, 25 bp, Mus musculus
caggctgcgaagcttaaagccacga

SEQ ID NO: 571163 - DNA, 25 bp, Mus musculus
caggctgcgaaggttaaagccacga

SEQ ID NO: 571164 - DNA, 25 bp, Mus musculus
caggctgcgcaacgacaagggatta

SEQ ID NO: 571165 - DNA, 25 bp, Mus musculus
caggctgcgcaaggacaagggatta

SEQ ID NO: 571166 - DNA, 25 bp, Mus musculus
caggctgctcaaaggctatggaaag

SEQ ID NO: 571167 - DNA, 25 bp, Mus musculus
caggctgctcaatggctatggaaag

SEQ ID NO: 571168 - DNA, 25 bp, Mus musculus
caggctgctgagcacaagtcttggc

SEQ ID NO: 571169 - DNA, 25 bp, Mus musculus
caggctgctgaggacaagtcttggc

SEQ ID NO: 571170 - DNA, 25 bp, Mus musculus
caggctgctgtgaagaagaggaacc

SEQ ID NO: 571171 - DNA, 25 bp, Mus musculus
caggctgctgtgcttcatgccacag

SEQ ID NO: 571172 - DNA, 25 bp, Mus musculus
caggctgctgtggttcatgccacag

SEQ ID NO: 571173 - DNA, 25 bp, Mus musculus
caggctgctgtgtagaagaggaacc

SEQ ID NO: 571174 - DNA, 25 bp, Mus musculus
caggctggaactacgcaatcgggtg

SEQ ID NO: 571175 - DNA, 25 bp, Mus musculus
caggctggaacttcgcaatcgggtg

SEQ ID NO: 571176 - DNA, 25 bp, Mus musculus
caggctggacatccaccagggtaca

SEQ ID NO: 571177 - DNA, 25 bp, Mus musculus
caggctggacatgcaccagggtaca

SEQ ID NO: 571178 - DNA, 25 bp, Mus musculus
caggctggacctcacagggaatgca

SEQ ID NO: 571179 - DNA, 25 bp, Mus musculus
caggctggacctgacagggaatgca

SEQ ID NO: 571180 - DNA, 25 bp, Mus musculus
caggctggagctccaagtcagttca

SEQ ID NO: 571181 - DNA, 25 bp, Mus musculus
caggctggagctgcaagtcagttca

SEQ ID NO: 571182 - DNA, 25 bp, Mus musculus
caggctggagttcttgcccatcctc

SEQ ID NO: 571183 - DNA, 25 bp, Mus musculus
caggctggagttgttgcccatcctc

SEQ ID NO: 571184 - DNA, 25 bp, Mus musculus
caggctggatatatggtgtacaagt

SEQ ID NO: 571185 - DNA, 25 bp, Mus musculus
caggctggatatttggtgtacaagt

SEQ ID NO: 571186 - DNA, 25 bp, Mus musculus
caggctggatcactgctactgtgag

SEQ ID NO: 571187 - DNA, 25 bp, Mus musculus
caggctggatcagtgctactgtgag

SEQ ID NO: 571188 - DNA, 25 bp, Mus musculus
caggctggatctactacagaactag

SEQ ID NO: 571189 - DNA, 25 bp, Mus musculus
caggctggatcttctacagaactag

SEQ ID NO: 571190 - DNA, 25 bp, Mus musculus
caggctggatggacgtgtcattgac

SEQ ID NO: 571191 - DNA, 25 bp, Mus musculus
caggctggatggtcgtgtcattgac

SEQ ID NO: 571192 - DNA, 25 bp, Mus musculus
caggctggcctacaagtcacggtat

SEQ ID NO: 571193 - DNA, 25 bp, Mus musculus
caggctggcctagaagtcacggtat

SEQ ID NO: 571194 - DNA, 25 bp, Mus musculus
caggctggcctcaatttcatgatcc

SEQ ID NO: 571195 - DNA, 25 bp, Mus musculus
caggctggcctctatttcatgatcc

SEQ ID NO: 571196 - DNA, 25 bp, Mus musculus
caggctggctacagtgcccagcagc

SEQ ID NO: 571197 - DNA, 25 bp, Mus musculus
caggctggctactgtgcccagcagc

SEQ ID NO: 571198 - DNA, 25 bp, Mus musculus
caggctggctgcatggtgtccagtc

SEQ ID NO: 571199 - DNA, 25 bp, Mus musculus
caggctggctgcttggtgtccagtc

SEQ ID NO: 571200 - DNA, 25 bp, Mus musculus
caggctggctgtcatgggctccctt

SEQ ID NO: 571201 - DNA, 25 bp, Mus musculus
caggctggctgtctcccagttgtca

SEQ ID NO: 571202 - DNA, 25 bp, Mus musculus
caggctggctgtgatgggctccctt

SEQ ID NO: 571203 - DNA, 25 bp, Mus musculus
caggctggctgtgtcccagttgtca

SEQ ID NO: 571204 - DNA, 25 bp, Mus musculus
caggctggtgtgactttaaacttcc

SEQ ID NO: 571205 - DNA, 25 bp, Mus musculus
caggctggtgtgtctttaaacttcc

SEQ ID NO: 571206 - DNA, 25 bp, Mus musculus
caggctgtactcaggatcttgggac

SEQ ID NO: 571207 - DNA, 25 bp, Mus musculus
caggctgtactctggatcttgggac

SEQ ID NO: 571208 - DNA, 25 bp, Mus musculus
caggctgtgaagcttcagtcattcc

SEQ ID NO: 571209 - DNA, 25 bp, Mus musculus
caggctgtgaaggttcagtcattcc

SEQ ID NO: 571210 - DNA, 25 bp, Mus musculus
caggctgtgacactgtggttcgtca

SEQ ID NO: 571211 - DNA, 25 bp, Mus musculus
caggctgtgacagtgtggttcgtca

SEQ ID NO: 571212 - DNA, 25 bp, Mus musculus
caggctgtgcggcatgcctttcagc

SEQ ID NO: 571213 - DNA, 25 bp, Mus musculus
caggctgtgcgggatgcctttcagc

SEQ ID NO: 571214 - DNA, 25 bp, Mus musculus
caggctgtgctacgctgccagagcc

SEQ ID NO: 571215 - DNA, 25 bp, Mus musculus
caggctgtgctaggctgccagagcc

SEQ ID NO: 571216 - DNA, 25 bp, Mus musculus
caggctgtgctgattggctgatatc

SEQ ID NO: 571217 - DNA, 25 bp, Mus musculus
caggctgtgctgtttggctgatatc

SEQ ID NO: 571218 - DNA, 25 bp, Mus musculus
caggctgtgtcaaagtcaccaagta

SEQ ID NO: 571219 - DNA, 25 bp, Mus musculus
caggctgtgtcatagtcaccaagta

SEQ ID NO: 571220 - DNA, 25 bp, Mus musculus
caggctgtgtctcgttgattgagac

SEQ ID NO: 571221 - DNA, 25 bp, Mus musculus
caggctgtgtctggttgattgagac

SEQ ID NO: 571222 - DNA, 25 bp, Mus musculus
caggctgtgttcacgctgcctcagt

SEQ ID NO: 571223 - DNA, 25 bp, Mus musculus
caggctgtgttctcgctgcctcagt

SEQ ID NO: 571224 - DNA, 25 bp, Mus musculus
caggctgttcaaaactctggtccca

SEQ ID NO: 571225 - DNA, 25 bp, Mus musculus
caggctgttcaatactctggtccca

SEQ ID NO: 571226 - DNA, 25 bp, Mus musculus
caggctgttcccagtatgcaaacaa

SEQ ID NO: 571227 - DNA, 25 bp, Mus musculus
caggctgttccctgtatgcaaacaa

SEQ ID NO: 571228 - DNA, 25 bp, Mus musculus
caggcttaaggcaaatggtcttccc

SEQ ID NO: 571229 - DNA, 25 bp, Mus musculus
caggcttaaggctaatggtcttccc

SEQ ID NO: 571230 - DNA, 25 bp, Mus musculus
caggcttaaggtctgcgctgcccac

SEQ ID NO: 571231 - DNA, 25 bp, Mus musculus
caggcttaaggtgtgcgctgcccac

SEQ ID NO: 571232 - DNA, 25 bp, Mus musculus
caggcttaatgaatgtccagaaggc

SEQ ID NO: 571233 - DNA, 25 bp, Mus musculus
caggcttaatgattgtccagaaggc

SEQ ID NO: 571234 - DNA, 25 bp, Mus musculus
caggcttacgatatcccggccatca

SEQ ID NO: 571235 - DNA, 25 bp, Mus musculus
caggcttacgatttcccggccatca

SEQ ID NO: 571236 - DNA, 25 bp, Mus musculus
caggcttactgacctggctgatcca

SEQ ID NO: 571237 - DNA, 25 bp, Mus musculus
caggcttactgagctggctgatcca

SEQ ID NO: 571238 - DNA, 25 bp, Mus musculus
caggcttactgtctactgcaagaga

SEQ ID NO: 571239 - DNA, 25 bp, Mus musculus
caggcttactgtgtactgcaagaga

SEQ ID NO: 571240 - DNA, 25 bp, Mus musculus
caggcttaggttcagcaaacgggta

SEQ ID NO: 571241 - DNA, 25 bp, Mus musculus
caggcttaggttgagcaaacgggta

SEQ ID NO: 571242 - DNA, 25 bp, Mus musculus
caggcttcagcgaccacgagctggt

SEQ ID NO: 571243 - DNA, 25 bp, Mus musculus
caggcttcagcgtccacgagctggt

SEQ ID NO: 571244 - DNA, 25 bp, Mus musculus
caggcttcagttccgcaaatgtact

SEQ ID NO: 571245 - DNA, 25 bp, Mus musculus
caggcttcagttgcgcaaatgtact

SEQ ID NO: 571246 - DNA, 25 bp, Mus musculus
caggcttcatctaactgctgggaca

SEQ ID NO: 571247 - DNA, 25 bp, Mus musculus
caggcttcatcttactgctgggaca

SEQ ID NO: 571248 - DNA, 25 bp, Mus musculus
caggcttccacgaacgtccagaaga

SEQ ID NO: 571249 - DNA, 25 bp, Mus musculus
caggcttccacgtacgtccagaaga

SEQ ID NO: 571250 - DNA, 25 bp, Mus musculus
caggcttccagcaactcattcaaaa

SEQ ID NO: 571251 - DNA, 25 bp, Mus musculus
caggcttccagctactcattcaaaa

SEQ ID NO: 571252 - DNA, 25 bp, Mus musculus
caggcttcggaaacaagaaggagaa

SEQ ID NO: 571253 - DNA, 25 bp, Mus musculus
caggcttcggaatcaagaaggagaa

SEQ ID NO: 571254 - DNA, 25 bp, Mus musculus
caggcttcgtggctcgccatcgtcg

SEQ ID NO: 571255 - DNA, 25 bp, Mus musculus
caggcttcgtgggtcgccatcgtcg

SEQ ID NO: 571256 - DNA, 25 bp, Mus musculus
caggcttctgagacctctcttagta

SEQ ID NO: 571257 - DNA, 25 bp, Mus musculus
caggcttctgagtcctctcttagta

SEQ ID NO: 571258 - DNA, 25 bp, Mus musculus
caggcttctgcgacaatgcaccttc

SEQ ID NO: 571259 - DNA, 25 bp, Mus musculus
caggcttctgcgtcaatgcaccttc

SEQ ID NO: 571260 - DNA, 25 bp, Mus musculus
caggcttgactcacgggagcactga

SEQ ID NO: 571261 - DNA, 25 bp, Mus musculus
caggcttgactctcgggagcactga

SEQ ID NO: 571262 - DNA, 25 bp, Mus musculus
caggcttgccttagagtactacaca

SEQ ID NO: 571263 - DNA, 25 bp, Mus musculus
caggcttgcctttgagtactacaca

SEQ ID NO: 571264 - DNA, 25 bp, Mus musculus
caggcttggctcactgtgaagactc

SEQ ID NO: 571265 - DNA, 25 bp, Mus musculus
caggcttggctctctgtgaagactc

SEQ ID NO: 571266 - DNA, 25 bp, Mus musculus
caggcttgtaccctgtagcgggttc

SEQ ID NO: 571267 - DNA, 25 bp, Mus musculus
caggcttgtaccgtgtagcgggttc

SEQ ID NO: 571268 - DNA, 25 bp, Mus musculus
caggcttgtccaccagaggcaagaa

SEQ ID NO: 571269 - DNA, 25 bp, Mus musculus
caggcttgtccagcagaggcaagaa

SEQ ID NO: 571270 - DNA, 25 bp, Mus musculus
caggctttaccgcaggaccaataag

SEQ ID NO: 571271 - DNA, 25 bp, Mus musculus
caggctttaccggaggaccaataag

SEQ ID NO: 571272 - DNA, 25 bp, Mus musculus
caggctttaggactgcaggtattcc

SEQ ID NO: 571273 - DNA, 25 bp, Mus musculus
caggctttaggagtgcaggtattcc

SEQ ID NO: 571274 - DNA, 25 bp, Mus musculus
caggctttatgccagtggcactgtc

SEQ ID NO: 571275 - DNA, 25 bp, Mus musculus
caggctttatgcgagtggcactgtc

SEQ ID NO: 571276 - DNA, 25 bp, Mus musculus
caggctttcaaacaactgctaaggg

SEQ ID NO: 571277 - DNA, 25 bp, Mus musculus
caggctttcaaagaactgctaaggg

SEQ ID NO: 571278 - DNA, 25 bp, Mus musculus
caggctttgaaaacatacccagtaa

SEQ ID NO: 571279 - DNA, 25 bp, Mus musculus
caggctttgaaaccatcccatataa

SEQ ID NO: 571280 - DNA, 25 bp, Mus musculus
caggctttgaaagcatcccatataa

SEQ ID NO: 571281 - DNA, 25 bp, Mus musculus
caggctttgaaatcatacccagtaa

SEQ ID NO: 571282 - DNA, 25 bp, Mus musculus
caggctttgagtatgttccaaagaa

SEQ ID NO: 571283 - DNA, 25 bp, Mus musculus
caggctttgagtttgttccaaagaa

SEQ ID NO: 571284 - DNA, 25 bp, Mus musculus
caggctttggcgagaactcccgggt

SEQ ID NO: 571285 - DNA, 25 bp, Mus musculus
caggctttggcgtgaactcccgggt

SEQ ID NO: 571286 - DNA, 25 bp, Mus musculus
caggctttgttacgcacccaggtaa

SEQ ID NO: 571287 - DNA, 25 bp, Mus musculus
caggctttgttaggcacccaggtaa

SEQ ID NO: 571288 - DNA, 25 bp, Mus musculus
caggcttttccaatttcttacaggg

SEQ ID NO: 571289 - DNA, 25 bp, Mus musculus
caggcttttccattttcttacaggg

SEQ ID NO: 571290 - DNA, 25 bp, Mus musculus
caggcttttgatcccttctgtgaag

SEQ ID NO: 571291 - DNA, 25 bp, Mus musculus
caggcttttgatgccttctgtgaag

SEQ ID NO: 571292 - DNA, 25 bp, Mus musculus
caggcttttggtcaccgcatccgag

SEQ ID NO: 571293 - DNA, 25 bp, Mus musculus
caggcttttggtgaccgcatccgag

SEQ ID NO: 571294 - DNA, 25 bp, Mus musculus
cagggaaagactaacctcttactgt

SEQ ID NO: 571295 - DNA, 25 bp, Mus musculus
cagggaaagacttacctcttactgt

SEQ ID NO: 571296 - DNA, 25 bp, Mus musculus
cagggaaagctcatggacccgggct

SEQ ID NO: 571297 - DNA, 25 bp, Mus musculus
cagggaaagctcttggacccgggct

SEQ ID NO: 571298 - DNA, 25 bp, Mus musculus
cagggaaataacagatacgggcagc

SEQ ID NO: 571299 - DNA, 25 bp, Mus musculus
cagggaaataactgatacgggcagc

SEQ ID NO: 571300 - DNA, 25 bp, Mus musculus
cagggaaatttcatacgttcttgcc

SEQ ID NO: 571301 - DNA, 25 bp, Mus musculus
cagggaaatttcttacgttcttgcc

SEQ ID NO: 571302 - DNA, 25 bp, Mus musculus
cagggaacaacactggtgatgaaca

SEQ ID NO: 571303 - DNA, 25 bp, Mus musculus
cagggaacaacagtggtgatgaaca

SEQ ID NO: 571304 - DNA, 25 bp, Mus musculus
cagggaactacacgagaaagagaaa

SEQ ID NO: 571305 - DNA, 25 bp, Mus musculus
cagggaactacaggagaaagagaaa

SEQ ID NO: 571306 - DNA, 25 bp, Mus musculus
cagggaactcccagtgctctgaatt

SEQ ID NO: 571307 - DNA, 25 bp, Mus musculus
cagggaactccctgtgctctgaatt

SEQ ID NO: 571308 - DNA, 25 bp, Mus musculus
cagggaacttgaattaggtgtacca

SEQ ID NO: 571309 - DNA, 25 bp, Mus musculus
cagggaacttgatttaggtgtacca

SEQ ID NO: 571310 - DNA, 25 bp, Mus musculus
cagggaagaccacaaccaccgcggt

SEQ ID NO: 571311 - DNA, 25 bp, Mus musculus
cagggaagaccagaaccaccgcggt

SEQ ID NO: 571312 - DNA, 25 bp, Mus musculus
cagggaagacccagattgctcgagc

SEQ ID NO: 571313 - DNA, 25 bp, Mus musculus
cagggaagaccctgattgctcgagc

SEQ ID NO: 571314 - DNA, 25 bp, Mus musculus
cagggaagagtccttcagcggcctc

SEQ ID NO: 571315 - DNA, 25 bp, Mus musculus
cagggaagagtcgttcagcggcctc

SEQ ID NO: 571316 - DNA, 25 bp, Mus musculus
cagggaagatacactggcaaggaac

SEQ ID NO: 571317 - DNA, 25 bp, Mus musculus
cagggaagatactctggcaaggaac

SEQ ID NO: 571318 - DNA, 25 bp, Mus musculus
cagggaagatcaagcgagctgtgct

SEQ ID NO: 571319 - DNA, 25 bp, Mus musculus
cagggaagatcatgcgagctgtgct

SEQ ID NO: 571320 - DNA, 25 bp, Mus musculus
cagggaagatcgctctctgcagagt

SEQ ID NO: 571321 - DNA, 25 bp, Mus musculus
cagggaagatcggtctctgcagagt

SEQ ID NO: 571322 - DNA, 25 bp, Mus musculus
cagggaagatgaatactttgagaac

SEQ ID NO: 571323 - DNA, 25 bp, Mus musculus
cagggaagatgattactttgagaac

SEQ ID NO: 571324 - DNA, 25 bp, Mus musculus
cagggaagccttactactacaacaa

SEQ ID NO: 571325 - DNA, 25 bp, Mus musculus
cagggaagcctttctactacaacaa

SEQ ID NO: 571326 - DNA, 25 bp, Mus musculus
cagggaagctcgatttgcagaagac

SEQ ID NO: 571327 - DNA, 25 bp, Mus musculus
cagggaagctcgttttgcagaagac

SEQ ID NO: 571328 - DNA, 25 bp, Mus musculus
cagggaagtcccacatgcactgacg

SEQ ID NO: 571329 - DNA, 25 bp, Mus musculus
cagggaagtccctcatgcactgacg

SEQ ID NO: 571330 - DNA, 25 bp, Mus musculus
cagggaagtctcagtgctatcaact

SEQ ID NO: 571331 - DNA, 25 bp, Mus musculus
cagggaagtctctgtgctatcaact

SEQ ID NO: 571332 - DNA, 25 bp, Mus musculus
cagggaagttacagttgacaccaag

SEQ ID NO: 571333 - DNA, 25 bp, Mus musculus
cagggaagttactgttgacaccaag

SEQ ID NO: 571334 - DNA, 25 bp, Mus musculus
cagggaataaaccatacgcgtgtaa

SEQ ID NO: 571335 - DNA, 25 bp, Mus musculus
cagggaataaacgatacgcgtgtaa

SEQ ID NO: 571336 - DNA, 25 bp, Mus musculus
cagggaatccaaaactatcacagtg

SEQ ID NO: 571337 - DNA, 25 bp, Mus musculus
cagggaatccaatactatcacagtg

SEQ ID NO: 571338 - DNA, 25 bp, Mus musculus
cagggaatgacgcaacccatgccct

SEQ ID NO: 571339 - DNA, 25 bp, Mus musculus
cagggaatgacggaacccatgccct

SEQ ID NO: 571340 - DNA, 25 bp, Mus musculus
cagggacaaattacgaagagagcgc

SEQ ID NO: 571341 - DNA, 25 bp, Mus musculus
cagggacaaatttcgaagagagcgc

SEQ ID NO: 571342 - DNA, 25 bp, Mus musculus
cagggacaagaacagcaaaggtgac

SEQ ID NO: 571343 - DNA, 25 bp, Mus musculus
cagggacaagaagagcaaaggtgac

SEQ ID NO: 571344 - DNA, 25 bp, Mus musculus
cagggacaccaactgtttgagacaa

SEQ ID NO: 571345 - DNA, 25 bp, Mus musculus
cagggacaccaagtgtttgagacaa

SEQ ID NO: 571346 - DNA, 25 bp, Mus musculus
cagggacactctagctatatgtggc

SEQ ID NO: 571347 - DNA, 25 bp, Mus musculus
cagggacactcttgctatatgtggc

SEQ ID NO: 571348 - DNA, 25 bp, Mus musculus
cagggacagattaagctcattttaa

SEQ ID NO: 571349 - DNA, 25 bp, Mus musculus
cagggacagatttagctcattttaa

SEQ ID NO: 571350 - DNA, 25 bp, Mus musculus
cagggacagcatcacagtggtactg

SEQ ID NO: 571351 - DNA, 25 bp, Mus musculus
cagggacagcatgacagtggtactg

SEQ ID NO: 571352 - DNA, 25 bp, Mus musculus
cagggacagcgcacttgcagatgcg

SEQ ID NO: 571353 - DNA, 25 bp, Mus musculus
cagggacagcgctcttgcagatgcg

SEQ ID NO: 571354 - DNA, 25 bp, Mus musculus
cagggacagtatctgatgctgcttt

SEQ ID NO: 571355 - DNA, 25 bp, Mus musculus
cagggacagtatgtgatgctgcttt

SEQ ID NO: 571356 - DNA, 25 bp, Mus musculus
cagggaccagaaccgtgacaacaat

SEQ ID NO: 571357 - DNA, 25 bp, Mus musculus
cagggaccagaagcgtgacaacaat

SEQ ID NO: 571358 - DNA, 25 bp, Mus musculus
cagggacccctaaagctctggaagt

SEQ ID NO: 571359 - DNA, 25 bp, Mus musculus
cagggacccctatagctctggaagt

SEQ ID NO: 571360 - DNA, 25 bp, Mus musculus
cagggacccctccttagtggtagct

SEQ ID NO: 571361 - DNA, 25 bp, Mus musculus
cagggacccctcgttagtggtagct

SEQ ID NO: 571362 - DNA, 25 bp, Mus musculus
cagggaccgaatagtgattgtcacc

SEQ ID NO: 571363 - DNA, 25 bp, Mus musculus
cagggaccgaattgtgattgtcacc

SEQ ID NO: 571364 - DNA, 25 bp, Mus musculus
cagggacctcagcacaagtaccttc

SEQ ID NO: 571365 - DNA, 25 bp, Mus musculus
cagggacctcaggacaagtaccttc

SEQ ID NO: 571366 - DNA, 25 bp, Mus musculus
cagggacctctgatgagcacatggc

SEQ ID NO: 571367 - DNA, 25 bp, Mus musculus
cagggacctctgttgagcacatggc

SEQ ID NO: 571368 - DNA, 25 bp, Mus musculus
cagggacgaggtccatttcgacccc

SEQ ID NO: 571369 - DNA, 25 bp, Mus musculus
cagggacgaggtgcatttcgacccc

SEQ ID NO: 571370 - DNA, 25 bp, Mus musculus
cagggacgcctccatgatttcttca

SEQ ID NO: 571371 - DNA, 25 bp, Mus musculus
cagggacgcctcgatgatttcttca

SEQ ID NO: 571372 - DNA, 25 bp, Mus musculus
cagggacgcttactggctcttaaaa

SEQ ID NO: 571373 - DNA, 25 bp, Mus musculus
cagggacgcttagtggctcttaaaa

SEQ ID NO: 571374 - DNA, 25 bp, Mus musculus
cagggacgtatccacaatttgggta

SEQ ID NO: 571375 - DNA, 25 bp, Mus musculus
cagggacgtatcgacaatttgggta

SEQ ID NO: 571376 - DNA, 25 bp, Mus musculus
cagggacgttgtcaccctggtgaaa

SEQ ID NO: 571377 - DNA, 25 bp, Mus musculus
cagggacgttgtgaccctggtgaaa

SEQ ID NO: 571378 - DNA, 25 bp, Mus musculus
cagggactaagtccctccagggttc

SEQ ID NO: 571379 - DNA, 25 bp, Mus musculus
cagggactaagtgcctccagggttc

SEQ ID NO: 571380 - DNA, 25 bp, Mus musculus
cagggactacgcagcgaaaggctgc

SEQ ID NO: 571381 - DNA, 25 bp, Mus musculus
cagggactacgctgcgaaaggctgc

SEQ ID NO: 571382 - DNA, 25 bp, Mus musculus
cagggactatgcagctgcggtcgct

SEQ ID NO: 571383 - DNA, 25 bp, Mus musculus
cagggactatgctgctgcggtcgct

SEQ ID NO: 571384 - DNA, 25 bp, Mus musculus
cagggactcaagcagctgtggcact

SEQ ID NO: 571385 - DNA, 25 bp, Mus musculus
cagggactcaaggagctgtggcact

SEQ ID NO: 571386 - DNA, 25 bp, Mus musculus
cagggactcccacccatgtaggtgg

SEQ ID NO: 571387 - DNA, 25 bp, Mus musculus
cagggactcccagccatgtaggtgg

SEQ ID NO: 571388 - DNA, 25 bp, Mus musculus
cagggactcctgagaagtgcacccg

SEQ ID NO: 571389 - DNA, 25 bp, Mus musculus
cagggactcctgattttagctacgg

SEQ ID NO: 571390 - DNA, 25 bp, Mus musculus
cagggactcctgtgaagtgcacccg

SEQ ID NO: 571391 - DNA, 25 bp, Mus musculus
cagggactcctgtttttagctacgg

SEQ ID NO: 571392 - DNA, 25 bp, Mus musculus
cagggactctgtagctcaccaaggt

SEQ ID NO: 571393 - DNA, 25 bp, Mus musculus
cagggactctgttgctcaccaaggt

SEQ ID NO: 571394 - DNA, 25 bp, Mus musculus
cagggactgagccactaataactgg

SEQ ID NO: 571395 - DNA, 25 bp, Mus musculus
cagggactgagcgactaataactgg

SEQ ID NO: 571396 - DNA, 25 bp, Mus musculus
cagggactgcagagctacgagtgct

SEQ ID NO: 571397 - DNA, 25 bp, Mus musculus
cagggactgcagtgctacgagtgct

SEQ ID NO: 571398 - DNA, 25 bp, Mus musculus
cagggactgtacagaagatgacaga

SEQ ID NO: 571399 - DNA, 25 bp, Mus musculus
cagggactgtactgaagatgacaga

SEQ ID NO: 571400 - DNA, 25 bp, Mus musculus
cagggactgtccattttgaaatcaa

SEQ ID NO: 571401 - DNA, 25 bp, Mus musculus
cagggactgtcctttttgaaatcaa

SEQ ID NO: 571402 - DNA, 25 bp, Mus musculus
cagggagaaccgcatgagatttcca

SEQ ID NO: 571403 - DNA, 25 bp, Mus musculus
cagggagaaccggatgagatttcca

SEQ ID NO: 571404 - DNA, 25 bp, Mus musculus
cagggagaatatcctgcatggagac

SEQ ID NO: 571405 - DNA, 25 bp, Mus musculus
cagggagaatatgctgcatggagac

SEQ ID NO: 571406 - DNA, 25 bp, Mus musculus
cagggagactgcaatttcatgctgg

SEQ ID NO: 571407 - DNA, 25 bp, Mus musculus
cagggagactgctatttcatgctgg

SEQ ID NO: 571408 - DNA, 25 bp, Mus musculus
cagggagagatgctctacctggcta

SEQ ID NO: 571409 - DNA, 25 bp, Mus musculus
cagggagagatggtctacctggcta

SEQ ID NO: 571410 - DNA, 25 bp, Mus musculus
cagggagagattccaagaaaacagc

SEQ ID NO: 571411 - DNA, 25 bp, Mus musculus
cagggagagattgcaagaaaacagc

SEQ ID NO: 571412 - DNA, 25 bp, Mus musculus
cagggagaggccaaggtaagagttt

SEQ ID NO: 571413 - DNA, 25 bp, Mus musculus
cagggagaggcctaggtaagagttt

SEQ ID NO: 571414 - DNA, 25 bp, Mus musculus
cagggagagtggagataattgtcaa

SEQ ID NO: 571415 - DNA, 25 bp, Mus musculus
cagggagagtggtgataattgtcaa

SEQ ID NO: 571416 - DNA, 25 bp, Mus musculus
cagggagcactaagaacggaagttg

SEQ ID NO: 571417 - DNA, 25 bp, Mus musculus
cagggagcactatgaacggaagttg

SEQ ID NO: 571418 - DNA, 25 bp, Mus musculus
cagggagcagagaggtggcgggcat

SEQ ID NO: 571419 - DNA, 25 bp, Mus musculus
cagggagcagagtggtggcgggcat

SEQ ID NO: 571420 - DNA, 25 bp, Mus musculus
cagggagcgatgatgtgtataagca

SEQ ID NO: 571421 - DNA, 25 bp, Mus musculus
cagggagcgatgttgtgtataagca

SEQ ID NO: 571422 - DNA, 25 bp, Mus musculus
cagggagcggcaacaccatggtgat

SEQ ID NO: 571423 - DNA, 25 bp, Mus musculus
cagggagcggcatcaccatggtgat

SEQ ID NO: 571424 - DNA, 25 bp, Mus musculus
cagggagcttggaagacgatcagca

SEQ ID NO: 571425 - DNA, 25 bp, Mus musculus
cagggagcttggtagacgatcagca

SEQ ID NO: 571426 - DNA, 25 bp, Mus musculus
cagggaggaaacagttcccctgcgg

SEQ ID NO: 571427 - DNA, 25 bp, Mus musculus
cagggaggaaactgttcccctgcgg

SEQ ID NO: 571428 - DNA, 25 bp, Mus musculus
cagggaggacctacctgtgcagaga

SEQ ID NO: 571429 - DNA, 25 bp, Mus musculus
cagggaggaccttcctgtgcagaga

SEQ ID NO: 571430 - DNA, 25 bp, Mus musculus
cagggaggacttacctctgatcgag

SEQ ID NO: 571431 - DNA, 25 bp, Mus musculus
cagggaggacttcatgtgactagat

SEQ ID NO: 571432 - DNA, 25 bp, Mus musculus
cagggaggacttgatgtgactagat

SEQ ID NO: 571433 - DNA, 25 bp, Mus musculus
cagggaggactttcctctgatcgag

SEQ ID NO: 571434 - DNA, 25 bp, Mus musculus
cagggaggatccctgtcctgtcttt

SEQ ID NO: 571435 - DNA, 25 bp, Mus musculus
cagggaggatccgtgtcctgtcttt

SEQ ID NO: 571436 - DNA, 25 bp, Mus musculus
cagggaggcattccgcctgctgtca

SEQ ID NO: 571437 - DNA, 25 bp, Mus musculus
cagggaggcattgcgcctgctgtca

SEQ ID NO: 571438 - DNA, 25 bp, Mus musculus
cagggaggccaacatcactgaagag

SEQ ID NO: 571439 - DNA, 25 bp, Mus musculus
cagggaggccaagatcactgaagag

SEQ ID NO: 571440 - DNA, 25 bp, Mus musculus
cagggagggacgctttcaagaataa

SEQ ID NO: 571441 - DNA, 25 bp, Mus musculus
cagggagggacggtttcaagaataa

SEQ ID NO: 571442 - DNA, 25 bp, Mus musculus
cagggaggttgtcacggtacccatc

SEQ ID NO: 571443 - DNA, 25 bp, Mus musculus
cagggaggttgtgacggtacccatc

SEQ ID NO: 571444 - DNA, 25 bp, Mus musculus
cagggagtagctagatcaaaacaga

SEQ ID NO: 571445 - DNA, 25 bp, Mus musculus
cagggagtagcttgatcaaaacaga

SEQ ID NO: 571446 - DNA, 25 bp, Mus musculus
cagggagtgaagcaagtcctgctcc

SEQ ID NO: 571447 - DNA, 25 bp, Mus musculus
cagggagtgaaggaagtcctgctcc

SEQ ID NO: 571448 - DNA, 25 bp, Mus musculus
cagggagtgacaactgcacttttaa

SEQ ID NO: 571449 - DNA, 25 bp, Mus musculus
cagggagtgacatctgcacttttaa

SEQ ID NO: 571450 - DNA, 25 bp, Mus musculus
cagggagtttgaatccttattcctc

SEQ ID NO: 571451 - DNA, 25 bp, Mus musculus
cagggagtttgattccttattcctc

SEQ ID NO: 571452 - DNA, 25 bp, Mus musculus
cagggataagaaaggcatggaccgt

SEQ ID NO: 571453 - DNA, 25 bp, Mus musculus
cagggataagaatggcatggaccgt

SEQ ID NO: 571454 - DNA, 25 bp, Mus musculus
cagggatacgaacccgcacaggacg

SEQ ID NO: 571455 - DNA, 25 bp, Mus musculus
cagggatacgaagccgcacaggacg

SEQ ID NO: 571456 - DNA, 25 bp, Mus musculus
cagggatactggacttgacgacaca

SEQ ID NO: 571457 - DNA, 25 bp, Mus musculus
cagggatactggtcttgacgacaca

SEQ ID NO: 571458 - DNA, 25 bp, Mus musculus
cagggatatggcaccctcgacagtg

SEQ ID NO: 571459 - DNA, 25 bp, Mus musculus
cagggatatggctccctcgacagtg

SEQ ID NO: 571460 - DNA, 25 bp, Mus musculus
cagggatccgagctgctcatgagcc

SEQ ID NO: 571461 - DNA, 25 bp, Mus musculus
cagggatccgaggtgctcatgagcc

SEQ ID NO: 571462 - DNA, 25 bp, Mus musculus
cagggatcgtagctggtctgattca

SEQ ID NO: 571463 - DNA, 25 bp, Mus musculus
cagggatcgtaggtggtctgattca

SEQ ID NO: 571464 - DNA, 25 bp, Mus musculus
cagggatctgcaagctgctgtacca

SEQ ID NO: 571465 - DNA, 25 bp, Mus musculus
cagggatctgcatgctgctgtacca

SEQ ID NO: 571466 - DNA, 25 bp, Mus musculus
cagggatcttttcggcaacactgtc

SEQ ID NO: 571467 - DNA, 25 bp, Mus musculus
cagggatcttttgggcaacactgtc

SEQ ID NO: 571468 - DNA, 25 bp, Mus musculus
cagggatgaagtatgaggacgtccc

SEQ ID NO: 571469 - DNA, 25 bp, Mus musculus
cagggatgaagtttgaggacgtccc

SEQ ID NO: 571470 - DNA, 25 bp, Mus musculus
cagggatgacatagggagaacgaat

SEQ ID NO: 571471 - DNA, 25 bp, Mus musculus
cagggatgacattgggagaacgaat

SEQ ID NO: 571472 - DNA, 25 bp, Mus musculus
cagggatgagagcaacatgctcaag

SEQ ID NO: 571473 - DNA, 25 bp, Mus musculus
cagggatgagaggaacatgctcaag

SEQ ID NO: 571474 - DNA, 25 bp, Mus musculus
cagggatgagccatgtagaaaggcc

SEQ ID NO: 571475 - DNA, 25 bp, Mus musculus
cagggatgagccttgtagaaaggcc

SEQ ID NO: 571476 - DNA, 25 bp, Mus musculus
cagggatgatcaaagccagcagggt

SEQ ID NO: 571477 - DNA, 25 bp, Mus musculus
cagggatgatcatagccagcagggt

SEQ ID NO: 571478 - DNA, 25 bp, Mus musculus
cagggatgcttaatcagctcatacc

SEQ ID NO: 571479 - DNA, 25 bp, Mus musculus
cagggatgcttattcagctcatacc

SEQ ID NO: 571480 - DNA, 25 bp, Mus musculus
cagggatggcaaaccatcttggtgc

SEQ ID NO: 571481 - DNA, 25 bp, Mus musculus
cagggatggcaatccatcttggtgc

SEQ ID NO: 571482 - DNA, 25 bp, Mus musculus
cagggatggcagcaataaaatattt

SEQ ID NO: 571483 - DNA, 25 bp, Mus musculus
cagggatggcaggaataaaatattt

SEQ ID NO: 571484 - DNA, 25 bp, Mus musculus
cagggatgggtcagacccctaccag

SEQ ID NO: 571485 - DNA, 25 bp, Mus musculus
cagggatgggtctgacccctaccag

SEQ ID NO: 571486 - DNA, 25 bp, Mus musculus
cagggatgtcatactagtagaggca

SEQ ID NO: 571487 - DNA, 25 bp, Mus musculus
cagggatgtcattctagtagaggca

SEQ ID NO: 571488 - DNA, 25 bp, Mus musculus
cagggattctcgaccctctctgagg

SEQ ID NO: 571489 - DNA, 25 bp, Mus musculus
cagggattctcgtccctctctgagg

SEQ ID NO: 571490 - DNA, 25 bp, Mus musculus
cagggattgagtactgtctgtcaga

SEQ ID NO: 571491 - DNA, 25 bp, Mus musculus
cagggattgagttctgtctgtcaga

SEQ ID NO: 571492 - DNA, 25 bp, Mus musculus
cagggattgcttcaactgtcgcttc

SEQ ID NO: 571493 - DNA, 25 bp, Mus musculus
cagggattgcttgaactgtcgcttc

SEQ ID NO: 571494 - DNA, 25 bp, Mus musculus
cagggattgtggatgtaagccttgc

SEQ ID NO: 571495 - DNA, 25 bp, Mus musculus
cagggattgtggttgtaagccttgc

SEQ ID NO: 571496 - DNA, 25 bp, Mus musculus
cagggatttgttaccctcctcttca

SEQ ID NO: 571497 - DNA, 25 bp, Mus musculus
cagggatttgtttccctcctcttca

SEQ ID NO: 571498 - DNA, 25 bp, Mus musculus
cagggattttggatcatcctttgga

SEQ ID NO: 571499 - DNA, 25 bp, Mus musculus
cagggattttggttcatcctttgga

SEQ ID NO: 571500 - DNA, 25 bp, Mus musculus
cagggcaaaggacttcaccaatgtt

SEQ ID NO: 571501 - DNA, 25 bp, Mus musculus
cagggcaaaggagttcaccaatgtt

SEQ ID NO: 571502 - DNA, 25 bp, Mus musculus
cagggcaacatcaacaagcccaaca

SEQ ID NO: 571503 - DNA, 25 bp, Mus musculus
cagggcaacatctacaagcccaaca

SEQ ID NO: 571504 - DNA, 25 bp, Mus musculus
cagggcaacccacaataaaaatcag

SEQ ID NO: 571505 - DNA, 25 bp, Mus musculus
cagggcaacccagaataaaaatcag

SEQ ID NO: 571506 - DNA, 25 bp, Mus musculus
cagggcaagctgattgcttgcaaac

SEQ ID NO: 571507 - DNA, 25 bp, Mus musculus
cagggcaagctgtttgcttgcaaac

SEQ ID NO: 571508 - DNA, 25 bp, Mus musculus
cagggcaataccaagtccagtgatc

SEQ ID NO: 571509 - DNA, 25 bp, Mus musculus
cagggcaatacctagtccagtgatc

SEQ ID NO: 571510 - DNA, 25 bp, Mus musculus
cagggcacatgacgacctcagcatc

SEQ ID NO: 571511 - DNA, 25 bp, Mus musculus
cagggcacatgaggacctcagcatc

SEQ ID NO: 571512 - DNA, 25 bp, Mus musculus
cagggcaccaacatcctgtttgcct

SEQ ID NO: 571513 - DNA, 25 bp, Mus musculus
cagggcaccaacttcctgtttgcct

SEQ ID NO: 571514 - DNA, 25 bp, Mus musculus
cagggcaccggcacagtcaagagga

SEQ ID NO: 571515 - DNA, 25 bp, Mus musculus
cagggcaccggctcagtcaagagga

SEQ ID NO: 571516 - DNA, 25 bp, Mus musculus
cagggcagaaggactcacagctaaa

SEQ ID NO: 571517 - DNA, 25 bp, Mus musculus
cagggcagaaggtctcacagctaaa

SEQ ID NO: 571518 - DNA, 25 bp, Mus musculus
cagggcagacgccttcatagtgctg

SEQ ID NO: 571519 - DNA, 25 bp, Mus musculus
cagggcagacgcgttcatagtgctg

SEQ ID NO: 571520 - DNA, 25 bp, Mus musculus
cagggcagactgatatcttccggaa

SEQ ID NO: 571521 - DNA, 25 bp, Mus musculus
cagggcagactgttatcttccggaa

SEQ ID NO: 571522 - DNA, 25 bp, Mus musculus
cagggcagcagcaagcacaggagat

SEQ ID NO: 571523 - DNA, 25 bp, Mus musculus
cagggcagcagctagcacaggagat

SEQ ID NO: 571524 - DNA, 25 bp, Mus musculus
cagggcagcgtcagtcaggcaaaga

SEQ ID NO: 571525 - DNA, 25 bp, Mus musculus
cagggcagcgtctgtcaggcaaaga

SEQ ID NO: 571526 - DNA, 25 bp, Mus musculus
cagggcagctagagagtcgcttgac

SEQ ID NO: 571527 - DNA, 25 bp, Mus musculus
cagggcagctagtgagtcgcttgac

SEQ ID NO: 571528 - DNA, 25 bp, Mus musculus
cagggcagctgcaaaaggtaacaac

SEQ ID NO: 571529 - DNA, 25 bp, Mus musculus
cagggcagctgctaaaggtaacaac

SEQ ID NO: 571530 - DNA, 25 bp, Mus musculus
cagggcaggtggaatccctaaaggt

SEQ ID NO: 571531 - DNA, 25 bp, Mus musculus
cagggcaggtggtatccctaaaggt

SEQ ID NO: 571532 - DNA, 25 bp, Mus musculus
cagggcagtccaacactgtgcagaa

SEQ ID NO: 571533 - DNA, 25 bp, Mus musculus
cagggcagtccatcactgtgcagaa

SEQ ID NO: 571534 - DNA, 25 bp, Mus musculus
cagggcagtgagctgtcccacagaa

SEQ ID NO: 571535 - DNA, 25 bp, Mus musculus
cagggcagtgaggtgtcccacagaa

SEQ ID NO: 571536 - DNA, 25 bp, Mus musculus
cagggcagtgccaaagctagagcca

SEQ ID NO: 571537 - DNA, 25 bp, Mus musculus
cagggcagtgcctaagctagagcca

SEQ ID NO: 571538 - DNA, 25 bp, Mus musculus
cagggcatgaggaggtccgcacatt

SEQ ID NO: 571539 - DNA, 25 bp, Mus musculus
cagggcatgaggtggtccgcacatt

SEQ ID NO: 571540 - DNA, 25 bp, Mus musculus
cagggcatgctactgtgtgcttctg

SEQ ID NO: 571541 - DNA, 25 bp, Mus musculus
cagggcatgctagtgtgtgcttctg

SEQ ID NO: 571542 - DNA, 25 bp, Mus musculus
cagggcatgtgtacgcaatgaaaat

SEQ ID NO: 571543 - DNA, 25 bp, Mus musculus
cagggcatgtgttcgcaatgaaaat

SEQ ID NO: 571544 - DNA, 25 bp, Mus musculus
cagggcattcttatatgtaccagac

SEQ ID NO: 571545 - DNA, 25 bp, Mus musculus
cagggcattcttttatgtaccagac

SEQ ID NO: 571546 - DNA, 25 bp, Mus musculus
cagggcattgcaaagctgtaccaca

SEQ ID NO: 571547 - DNA, 25 bp, Mus musculus
cagggcattgcatagctgtaccaca

SEQ ID NO: 571548 - DNA, 25 bp, Mus musculus
cagggcattgggaaacatccagata

SEQ ID NO: 571549 - DNA, 25 bp, Mus musculus
cagggcattgggtaacatccagata

SEQ ID NO: 571550 - DNA, 25 bp, Mus musculus
cagggccaacaacggcagcaagcag

SEQ ID NO: 571551 - DNA, 25 bp, Mus musculus
cagggccaacaagggcagcaagcag

SEQ ID NO: 571552 - DNA, 25 bp, Mus musculus
cagggccacaggacccgcatctgga

SEQ ID NO: 571553 - DNA, 25 bp, Mus musculus
cagggccacaggtcccgcatctgga

SEQ ID NO: 571554 - DNA, 25 bp, Mus musculus
cagggccacatacaagcagcaagaa

SEQ ID NO: 571555 - DNA, 25 bp, Mus musculus
cagggccacatagaagcagcaagaa

SEQ ID NO: 571556 - DNA, 25 bp, Mus musculus
cagggccaccaaagcgccttgtaga

SEQ ID NO: 571557 - DNA, 25 bp, Mus musculus
cagggccaccaatgcgccttgtaga

SEQ ID NO: 571558 - DNA, 25 bp, Mus musculus
cagggccagaatccgtggttcctcc

SEQ ID NO: 571559 - DNA, 25 bp, Mus musculus
cagggccagaatgcgtggttcctcc

SEQ ID NO: 571560 - DNA, 25 bp, Mus musculus
cagggccagatactccttcgcagtt

SEQ ID NO: 571561 - DNA, 25 bp, Mus musculus
cagggccagatagtccttcgcagtt

SEQ ID NO: 571562 - DNA, 25 bp, Mus musculus
cagggccaggagctagatcccagaa

SEQ ID NO: 571563 - DNA, 25 bp, Mus musculus
cagggccaggaggtagatcccagaa

SEQ ID NO: 571564 - DNA, 25 bp, Mus musculus
cagggccagtttattgcgtctggat

SEQ ID NO: 571565 - DNA, 25 bp, Mus musculus
cagggccagttttttgcgtctggat

SEQ ID NO: 571566 - DNA, 25 bp, Mus musculus
cagggccatgccattgaggctagaa

SEQ ID NO: 571567 - DNA, 25 bp, Mus musculus
cagggccatgcctttgaggctagaa

SEQ ID NO: 571568 - DNA, 25 bp, Mus musculus
cagggcccatatcatggagcaagag

SEQ ID NO: 571569 - DNA, 25 bp, Mus musculus
cagggcccatatgatggagcaagag

SEQ ID NO: 571570 - DNA, 25 bp, Mus musculus
cagggccccgtcaacaaaggagtct

SEQ ID NO: 571571 - DNA, 25 bp, Mus musculus
cagggccccgtctacaaaggagtct

SEQ ID NO: 571572 - DNA, 25 bp, Mus musculus
cagggcccctgcacttcagtggcta

SEQ ID NO: 571573 - DNA, 25 bp, Mus musculus
cagggcccctgctcttcagtggcta

SEQ ID NO: 571574 - DNA, 25 bp, Mus musculus
cagggccgactgacagcgagttcct

SEQ ID NO: 571575 - DNA, 25 bp, Mus musculus
cagggccgactgtcagcgagttcct

SEQ ID NO: 571576 - DNA, 25 bp, Mus musculus
cagggccgagctattccagcaagta

SEQ ID NO: 571577 - DNA, 25 bp, Mus musculus
cagggccgagctctcatgaacctac

SEQ ID NO: 571578 - DNA, 25 bp, Mus musculus
cagggccgagctgtcatgaacctac

SEQ ID NO: 571579 - DNA, 25 bp, Mus musculus
cagggccgagcttttccagcaagta

SEQ ID NO: 571580 - DNA, 25 bp, Mus musculus
cagggcctacctctggtgtaaggaa

SEQ ID NO: 571581 - DNA, 25 bp, Mus musculus
cagggcctacctgtggtgtaaggaa

SEQ ID NO: 571582 - DNA, 25 bp, Mus musculus
cagggcctctctaggccttgggcat

SEQ ID NO: 571583 - DNA, 25 bp, Mus musculus
cagggcctctcttggccttgggcat

SEQ ID NO: 571584 - DNA, 25 bp, Mus musculus
cagggcctgagtctcgccatctctg

SEQ ID NO: 571585 - DNA, 25 bp, Mus musculus
cagggcctgagtgtcgccatctctg

SEQ ID NO: 571586 - DNA, 25 bp, Mus musculus
cagggcctggtgatcgttttcacca

SEQ ID NO: 571587 - DNA, 25 bp, Mus musculus
cagggcctggtgttcgttttcacca

SEQ ID NO: 571588 - DNA, 25 bp, Mus musculus
cagggcctgtggctccagattgtca

SEQ ID NO: 571589 - DNA, 25 bp, Mus musculus
cagggcctgtgggtccagattgtca

SEQ ID NO: 571590 - DNA, 25 bp, Mus musculus
cagggccttccacacggttgtgttg

SEQ ID NO: 571591 - DNA, 25 bp, Mus musculus
cagggccttccagacggttgtgttg

SEQ ID NO: 571592 - DNA, 25 bp, Mus musculus
cagggccttcctcgactttataaga

SEQ ID NO: 571593 - DNA, 25 bp, Mus musculus
cagggccttcctggactttataaga

SEQ ID NO: 571594 - DNA, 25 bp, Mus musculus
cagggccttctgaagcagccaagct

SEQ ID NO: 571595 - DNA, 25 bp, Mus musculus
cagggccttctgtagcagccaagct

SEQ ID NO: 571596 - DNA, 25 bp, Mus musculus
cagggccttgccaagtctcagggaa

SEQ ID NO: 571597 - DNA, 25 bp, Mus musculus
cagggccttgcctagtctcagggaa

SEQ ID NO: 571598 - DNA, 25 bp, Mus musculus
cagggccttgtcagcaacgtaaaca

SEQ ID NO: 571599 - DNA, 25 bp, Mus musculus
cagggccttgtctgcaacgtaaaca

SEQ ID NO: 571600 - DNA, 25 bp, Mus musculus
cagggcgatactcctccaagtgagg

SEQ ID NO: 571601 - DNA, 25 bp, Mus musculus
cagggcgatactgctccaagtgagg

SEQ ID NO: 571602 - DNA, 25 bp, Mus musculus
cagggcgccctgagatctgaggact

SEQ ID NO: 571603 - DNA, 25 bp, Mus musculus
cagggcgccctgtgatctgaggact

SEQ ID NO: 571604 - DNA, 25 bp, Mus musculus
cagggcgcgggcattctctgtacct

SEQ ID NO: 571605 - DNA, 25 bp, Mus musculus
cagggcgcgggctttctctgtacct

SEQ ID NO: 571606 - DNA, 25 bp, Mus musculus
cagggcgctctgcatttcttcaagg

SEQ ID NO: 571607 - DNA, 25 bp, Mus musculus
cagggcgctctggatttcttcaagg

SEQ ID NO: 571608 - DNA, 25 bp, Mus musculus
cagggcggcctcattgtgggaatca

SEQ ID NO: 571609 - DNA, 25 bp, Mus musculus
cagggcggcctctttgtgggaatca

SEQ ID NO: 571610 - DNA, 25 bp, Mus musculus
cagggcggctgcaacagctgcacat

SEQ ID NO: 571611 - DNA, 25 bp, Mus musculus
cagggcggctgctacagctgcacat

SEQ ID NO: 571612 - DNA, 25 bp, Mus musculus
cagggcgtccctatcagaccgggct

SEQ ID NO: 571613 - DNA, 25 bp, Mus musculus
cagggcgtccctttcagaccgggct

SEQ ID NO: 571614 - DNA, 25 bp, Mus musculus
cagggcgtgctccagacgattttgt

SEQ ID NO: 571615 - DNA, 25 bp, Mus musculus
cagggcgtgctcgagacgattttgt

SEQ ID NO: 571616 - DNA, 25 bp, Mus musculus
cagggcgttctcacgcgcctgtgga

SEQ ID NO: 571617 - DNA, 25 bp, Mus musculus
cagggcgttctctcgcgcctgtgga

SEQ ID NO: 571618 - DNA, 25 bp, Mus musculus
cagggctacaagaggctcaacagca

SEQ ID NO: 571619 - DNA, 25 bp, Mus musculus
cagggctacaagtggctcaacagca

SEQ ID NO: 571620 - DNA, 25 bp, Mus musculus
cagggctaccccatgtttctgagag

SEQ ID NO: 571621 - DNA, 25 bp, Mus musculus
cagggctaccccttgtttctgagag

SEQ ID NO: 571622 - DNA, 25 bp, Mus musculus
cagggctaccgtcctgcagaagacg

SEQ ID NO: 571623 - DNA, 25 bp, Mus musculus
cagggctaccgtgctgcagaagacg

SEQ ID NO: 571624 - DNA, 25 bp, Mus musculus
cagggctaggtaatgaatgtgactc

SEQ ID NO: 571625 - DNA, 25 bp, Mus musculus
cagggctaggtattgaatgtgactc

SEQ ID NO: 571626 - DNA, 25 bp, Mus musculus
cagggctatggaaccactgtgaagg

SEQ ID NO: 571627 - DNA, 25 bp, Mus musculus
cagggctatggatccactgtgaagg

SEQ ID NO: 571628 - DNA, 25 bp, Mus musculus
cagggctccagaacggttagctgca

SEQ ID NO: 571629 - DNA, 25 bp, Mus musculus
cagggctccagatcggttagctgca

SEQ ID NO: 571630 - DNA, 25 bp, Mus musculus
cagggctccctgacttggatagaga

SEQ ID NO: 571631 - DNA, 25 bp, Mus musculus
cagggctccctgtcttggatagaga

SEQ ID NO: 571632 - DNA, 25 bp, Mus musculus
cagggctcgcccagattggttgctc

SEQ ID NO: 571633 - DNA, 25 bp, Mus musculus
cagggctcgccctgattggttgctc

SEQ ID NO: 571634 - DNA, 25 bp, Mus musculus
cagggctctctgcagaatcacagat

SEQ ID NO: 571635 - DNA, 25 bp, Mus musculus
cagggctctctggagaatcacagat

SEQ ID NO: 571636 - DNA, 25 bp, Mus musculus
cagggctctgatcccacattgtgtg

SEQ ID NO: 571637 - DNA, 25 bp, Mus musculus
cagggctctgatgccacattgtgtg

SEQ ID NO: 571638 - DNA, 25 bp, Mus musculus
cagggctcttacacgggtgtgatcc

SEQ ID NO: 571639 - DNA, 25 bp, Mus musculus
cagggctcttactcgggtgtgatcc

SEQ ID NO: 571640 - DNA, 25 bp, Mus musculus
cagggctgccccaacaatgaactgg

SEQ ID NO: 571641 - DNA, 25 bp, Mus musculus
cagggctgcccctacaatgaactgg

SEQ ID NO: 571642 - DNA, 25 bp, Mus musculus
cagggctgctgcaattgtcattggc

SEQ ID NO: 571643 - DNA, 25 bp, Mus musculus
cagggctgctgctattgtcattggc

SEQ ID NO: 571644 - DNA, 25 bp, Mus musculus
cagggctgtcatcctgtaccacaag

SEQ ID NO: 571645 - DNA, 25 bp, Mus musculus
cagggctgtcatgctgtaccacaag

SEQ ID NO: 571646 - DNA, 25 bp, Mus musculus
cagggctgtctcagtatgggaaccc

SEQ ID NO: 571647 - DNA, 25 bp, Mus musculus
cagggctgtctctgtatgggaaccc

SEQ ID NO: 571648 - DNA, 25 bp, Mus musculus
cagggctgtctgagaggagagaact

SEQ ID NO: 571649 - DNA, 25 bp, Mus musculus
cagggctgtctgtgaggagagaact

SEQ ID NO: 571650 - DNA, 25 bp, Mus musculus
cagggctgtgtaagtccccagggct

SEQ ID NO: 571651 - DNA, 25 bp, Mus musculus
cagggctgtgtatgtccccagggct

SEQ ID NO: 571652 - DNA, 25 bp, Mus musculus
cagggcttacagcatcccaagatac

SEQ ID NO: 571653 - DNA, 25 bp, Mus musculus
cagggcttacaggatcccaagatac

SEQ ID NO: 571654 - DNA, 25 bp, Mus musculus
cagggcttcagaactcacaggacag

SEQ ID NO: 571655 - DNA, 25 bp, Mus musculus
cagggcttcagatctcacaggacag

SEQ ID NO: 571656 - DNA, 25 bp, Mus musculus
cagggcttccagctggtcaatggca

SEQ ID NO: 571657 - DNA, 25 bp, Mus musculus
cagggcttccaggtggtcaatggca

SEQ ID NO: 571658 - DNA, 25 bp, Mus musculus
cagggcttctggcattctaggaaaa

SEQ ID NO: 571659 - DNA, 25 bp, Mus musculus
cagggcttctgggattctaggaaaa

SEQ ID NO: 571660 - DNA, 25 bp, Mus musculus
cagggcttgaatcaaatcctggctt

SEQ ID NO: 571661 - DNA, 25 bp, Mus musculus
cagggcttgaatgaaatcctggctt

SEQ ID NO: 571662 - DNA, 25 bp, Mus musculus
cagggcttgaccccgcgattctttc

SEQ ID NO: 571663 - DNA, 25 bp, Mus musculus
cagggcttgaccgcgcgattctttc

SEQ ID NO: 571664 - DNA, 25 bp, Mus musculus
cagggcttgtttactatggctgatg

SEQ ID NO: 571665 - DNA, 25 bp, Mus musculus
cagggcttgttttctatggctgatg

SEQ ID NO: 571666 - DNA, 25 bp, Mus musculus
cagggctttcggctccttgcttttc

SEQ ID NO: 571667 - DNA, 25 bp, Mus musculus
cagggctttcgggtccttgcttttc

SEQ ID NO: 571668 - DNA, 25 bp, Mus musculus
cagggctttggccacttgaagttcc

SEQ ID NO: 571669 - DNA, 25 bp, Mus musculus
cagggctttggcgacttgaagttcc

SEQ ID NO: 571670 - DNA, 25 bp, Mus musculus
caggggacaggaatgcaatgcaaat

SEQ ID NO: 571671 - DNA, 25 bp, Mus musculus
caggggacaggattgcaatgcaaat

SEQ ID NO: 571672 - DNA, 25 bp, Mus musculus
caggggattcccagtacattgtcac

SEQ ID NO: 571673 - DNA, 25 bp, Mus musculus
caggggattccctgtacattgtcac

SEQ ID NO: 571674 - DNA, 25 bp, Mus musculus
caggggctggttagcctccccagga

SEQ ID NO: 571675 - DNA, 25 bp, Mus musculus
caggggctggtttgcctccccagga

SEQ ID NO: 571676 - DNA, 25 bp, Mus musculus
caggggttctgccaataaatgccat

SEQ ID NO: 571677 - DNA, 25 bp, Mus musculus
caggggttctgcgaataaatgccat

SEQ ID NO: 571678 - DNA, 25 bp, Mus musculus
cagggtaaagagagtcacctagcac

SEQ ID NO: 571679 - DNA, 25 bp, Mus musculus
cagggtaaagagtgtcacctagcac

SEQ ID NO: 571680 - DNA, 25 bp, Mus musculus
cagggtaattgtctctgatgtccaa

SEQ ID NO: 571681 - DNA, 25 bp, Mus musculus
cagggtaattgtgtctgatgtccaa

SEQ ID NO: 571682 - DNA, 25 bp, Mus musculus
cagggtactaaacactggaggtcca

SEQ ID NO: 571683 - DNA, 25 bp, Mus musculus
cagggtactaaagactggaggtcca

SEQ ID NO: 571684 - DNA, 25 bp, Mus musculus
cagggtactgctacgatttccgcaa

SEQ ID NO: 571685 - DNA, 25 bp, Mus musculus
cagggtactgcttcgatttccgcaa

SEQ ID NO: 571686 - DNA, 25 bp, Mus musculus
cagggtactgggagagtatgtcccc

SEQ ID NO: 571687 - DNA, 25 bp, Mus musculus
cagggtactgggtgagtatgtcccc

SEQ ID NO: 571688 - DNA, 25 bp, Mus musculus
cagggtagttcacccaccagcatgt

SEQ ID NO: 571689 - DNA, 25 bp, Mus musculus
cagggtagttcagccaccagcatgt

SEQ ID NO: 571690 - DNA, 25 bp, Mus musculus
cagggtatctgcctggaactaagtg

SEQ ID NO: 571691 - DNA, 25 bp, Mus musculus
cagggtatctgcgtggaactaagtg

SEQ ID NO: 571692 - DNA, 25 bp, Mus musculus
cagggtatgaacaaaaggactttga

SEQ ID NO: 571693 - DNA, 25 bp, Mus musculus
cagggtatgaactaaaggactttga

SEQ ID NO: 571694 - DNA, 25 bp, Mus musculus
cagggtatgggcacagctgaggttc

SEQ ID NO: 571695 - DNA, 25 bp, Mus musculus
cagggtatgggctcagctgaggttc

SEQ ID NO: 571696 - DNA, 25 bp, Mus musculus
cagggtcaagtaagtcttgctggtc

SEQ ID NO: 571697 - DNA, 25 bp, Mus musculus
cagggtcaagtatgtcttgctggtc

SEQ ID NO: 571698 - DNA, 25 bp, Mus musculus
cagggtcacaataaaacactaagtt

SEQ ID NO: 571699 - DNA, 25 bp, Mus musculus
cagggtcacaattaaacactaagtt

SEQ ID NO: 571700 - DNA, 25 bp, Mus musculus
cagggtcagcgcaggaccaactgtc

SEQ ID NO: 571701 - DNA, 25 bp, Mus musculus
cagggtcagcgctggaccaactgtc

SEQ ID NO: 571702 - DNA, 25 bp, Mus musculus
cagggtcagcttcgcaacgcttttg

SEQ ID NO: 571703 - DNA, 25 bp, Mus musculus
cagggtcagcttggcaacgcttttg

SEQ ID NO: 571704 - DNA, 25 bp, Mus musculus
cagggtcaggttcaccttagagtca

SEQ ID NO: 571705 - DNA, 25 bp, Mus musculus
cagggtcaggttgaccttagagtca

SEQ ID NO: 571706 - DNA, 25 bp, Mus musculus
cagggtcatcggcaagcacaaaaca

SEQ ID NO: 571707 - DNA, 25 bp, Mus musculus
cagggtcatcgggaagcacaaaaca

SEQ ID NO: 571708 - DNA, 25 bp, Mus musculus
cagggtcatgcccttatccaagcca

SEQ ID NO: 571709 - DNA, 25 bp, Mus musculus
cagggtcatgccgttatccaagcca

SEQ ID NO: 571710 - DNA, 25 bp, Mus musculus
cagggtccctggcagagagccatct

SEQ ID NO: 571711 - DNA, 25 bp, Mus musculus
cagggtccctgggagagagccatct

SEQ ID NO: 571712 - DNA, 25 bp, Mus musculus
cagggtcccttgcatctccgactgg

SEQ ID NO: 571713 - DNA, 25 bp, Mus musculus
cagggtcccttggatctccgactgg

SEQ ID NO: 571714 - DNA, 25 bp, Mus musculus
cagggtcctttcatggcatgtaaca

SEQ ID NO: 571715 - DNA, 25 bp, Mus musculus
cagggtcctttcttggcatgtaaca

SEQ ID NO: 571716 - DNA, 25 bp, Mus musculus
cagggtcggagacctccgatgctaa

SEQ ID NO: 571717 - DNA, 25 bp, Mus musculus
cagggtcggagagctccgatgctaa

SEQ ID NO: 571718 - DNA, 25 bp, Mus musculus
cagggtcgtcgaccacgtggaacaa

SEQ ID NO: 571719 - DNA, 25 bp, Mus musculus
cagggtcgtcgagcacgtggaacaa

SEQ ID NO: 571720 - DNA, 25 bp, Mus musculus
cagggtctacatatcactcaacttt

SEQ ID NO: 571721 - DNA, 25 bp, Mus musculus
cagggtctacatttcactcaacttt

SEQ ID NO: 571722 - DNA, 25 bp, Mus musculus
cagggtctgagacgcatcactggca

SEQ ID NO: 571723 - DNA, 25 bp, Mus musculus
cagggtctgagaggcatcactggca

SEQ ID NO: 571724 - DNA, 25 bp, Mus musculus
cagggtcttatacatgctgagcaca

SEQ ID NO: 571725 - DNA, 25 bp, Mus musculus
cagggtcttatagatgctgagcaca

SEQ ID NO: 571726 - DNA, 25 bp, Mus musculus
cagggtgaaactcctggacgccata

SEQ ID NO: 571727 - DNA, 25 bp, Mus musculus
cagggtgaaactgctggacgccata

SEQ ID NO: 571728 - DNA, 25 bp, Mus musculus
cagggtgaagacagcagggaatcaa

SEQ ID NO: 571729 - DNA, 25 bp, Mus musculus
cagggtgaagactgcagggaatcaa

SEQ ID NO: 571730 - DNA, 25 bp, Mus musculus
cagggtgacctgacttgacctaacc

SEQ ID NO: 571731 - DNA, 25 bp, Mus musculus
cagggtgacctgtcttgacctaacc

SEQ ID NO: 571732 - DNA, 25 bp, Mus musculus
cagggtgctcgccaaagctacacca

SEQ ID NO: 571733 - DNA, 25 bp, Mus musculus
cagggtgctcgcgaaagctacacca

SEQ ID NO: 571734 - DNA, 25 bp, Mus musculus
cagggtggaaagacaatctgcctga

SEQ ID NO: 571735 - DNA, 25 bp, Mus musculus
cagggtggaaagtcaatctgcctga

SEQ ID NO: 571736 - DNA, 25 bp, Mus musculus
cagggtggacccatagtgccaaata

SEQ ID NO: 571737 - DNA, 25 bp, Mus musculus
cagggtggacccttagtgccaaata

SEQ ID NO: 571738 - DNA, 25 bp, Mus musculus
cagggtggacgtcattgtagccaac

SEQ ID NO: 571739 - DNA, 25 bp, Mus musculus
cagggtggacgtgattgtagccaac

SEQ ID NO: 571740 - DNA, 25 bp, Mus musculus
cagggtggctacaactgtgagtttg

SEQ ID NO: 571741 - DNA, 25 bp, Mus musculus
cagggtggctactactgtgagtttg

SEQ ID NO: 571742 - DNA, 25 bp, Mus musculus
cagggtggctataatcccatgcaag

SEQ ID NO: 571743 - DNA, 25 bp, Mus musculus
cagggtggctattatcccatgcaag

SEQ ID NO: 571744 - DNA, 25 bp, Mus musculus
cagggtgggacaagtacttcctgga

SEQ ID NO: 571745 - DNA, 25 bp, Mus musculus
cagggtgggacatgtacttcctgga

SEQ ID NO: 571746 - DNA, 25 bp, Mus musculus
cagggtgggcctcaggaaacaccaa

SEQ ID NO: 571747 - DNA, 25 bp, Mus musculus
cagggtgggcctgaggaaacaccaa

SEQ ID NO: 571748 - DNA, 25 bp, Mus musculus
cagggtggtacacaagctatagctc

SEQ ID NO: 571749 - DNA, 25 bp, Mus musculus
cagggtggtacagaagctatagctc

SEQ ID NO: 571750 - DNA, 25 bp, Mus musculus
cagggtgtacgccaacatgttcaag

SEQ ID NO: 571751 - DNA, 25 bp, Mus musculus
cagggtgtacgcgaacatgttcaag

SEQ ID NO: 571752 - DNA, 25 bp, Mus musculus
cagggtgtcatccacaaggatgcac

SEQ ID NO: 571753 - DNA, 25 bp, Mus musculus
cagggtgtcatcgacaaggatgcac

SEQ ID NO: 571754 - DNA, 25 bp, Mus musculus
cagggtgtccaacaacagagccatc

SEQ ID NO: 571755 - DNA, 25 bp, Mus musculus
cagggtgtccaagaacagagccatc

SEQ ID NO: 571756 - DNA, 25 bp, Mus musculus
cagggtgtcccgctcattaacagtg

SEQ ID NO: 571757 - DNA, 25 bp, Mus musculus
cagggtgtcccggtcattaacagtg

SEQ ID NO: 571758 - DNA, 25 bp, Mus musculus
cagggtgtccgtctctgtacgcgtc

SEQ ID NO: 571759 - DNA, 25 bp, Mus musculus
cagggtgtccgtgtctgtacgcgtc

SEQ ID NO: 571760 - DNA, 25 bp, Mus musculus
cagggtgtctgtctccgctttggcc

SEQ ID NO: 571761 - DNA, 25 bp, Mus musculus
cagggtgtctgtgtccgctttggcc

SEQ ID NO: 571762 - DNA, 25 bp, Mus musculus
cagggtgtggcgacacaatcagaag

SEQ ID NO: 571763 - DNA, 25 bp, Mus musculus
cagggtgtggcgtcacaatcagaag

SEQ ID NO: 571764 - DNA, 25 bp, Mus musculus
cagggtgttgctatctcacaaagcc

SEQ ID NO: 571765 - DNA, 25 bp, Mus musculus
cagggtgttgctttctcacaaagcc

SEQ ID NO: 571766 - DNA, 25 bp, Mus musculus
cagggtgttggcaatgtgcccattg

SEQ ID NO: 571767 - DNA, 25 bp, Mus musculus
cagggtgttggctatgtgcccattg

SEQ ID NO: 571768 - DNA, 25 bp, Mus musculus
cagggtgttgtgcttcccatggtac

SEQ ID NO: 571769 - DNA, 25 bp, Mus musculus
cagggtgttgtggttcccatggtac

SEQ ID NO: 571770 - DNA, 25 bp, Mus musculus
cagggttcactcataacaaccccag

SEQ ID NO: 571771 - DNA, 25 bp, Mus musculus
cagggttcactcttaacaaccccag

SEQ ID NO: 571772 - DNA, 25 bp, Mus musculus
cagggttcagaaaactaaatacaga

SEQ ID NO: 571773 - DNA, 25 bp, Mus musculus
cagggttcagaatactaaatacaga

SEQ ID NO: 571774 - DNA, 25 bp, Mus musculus
cagggttccaagcagctcaccacat

SEQ ID NO: 571775 - DNA, 25 bp, Mus musculus
cagggttccaaggagctcaccacat

SEQ ID NO: 571776 - DNA, 25 bp, Mus musculus
cagggttcccgcagcaatggatgcc

SEQ ID NO: 571777 - DNA, 25 bp, Mus musculus
cagggttcccgctgcaatggatgcc

SEQ ID NO: 571778 - DNA, 25 bp, Mus musculus
cagggttccggactgaatgcgaaaa

SEQ ID NO: 571779 - DNA, 25 bp, Mus musculus
cagggttccggagtgaatgcgaaaa

SEQ ID NO: 571780 - DNA, 25 bp, Mus musculus
cagggttgcagtctgatgcaagcat

SEQ ID NO: 571781 - DNA, 25 bp, Mus musculus
cagggttgcagtgtgatgcaagcat

SEQ ID NO: 571782 - DNA, 25 bp, Mus musculus
cagggttggctactggtatcattac

SEQ ID NO: 571783 - DNA, 25 bp, Mus musculus
cagggttggctagtggtatcattac

SEQ ID NO: 571784 - DNA, 25 bp, Mus musculus
cagggttggcttcccctgccagttt

SEQ ID NO: 571785 - DNA, 25 bp, Mus musculus
cagggttggcttgccctgccagttt

SEQ ID NO: 571786 - DNA, 25 bp, Mus musculus
cagggttgtacaaagcaatgaatgg

SEQ ID NO: 571787 - DNA, 25 bp, Mus musculus
cagggttgtacatagcaatgaatgg

SEQ ID NO: 571788 - DNA, 25 bp, Mus musculus
cagggtttactcagcctggcatcac

SEQ ID NO: 571789 - DNA, 25 bp, Mus musculus
cagggtttactctgcctggcatcac

SEQ ID NO: 571790 - DNA, 25 bp, Mus musculus
cagggtttgagaatcggcttcgcca

SEQ ID NO: 571791 - DNA, 25 bp, Mus musculus
cagggtttgagattcggcttcgcca

SEQ ID NO: 571792 - DNA, 25 bp, Mus musculus
cagggtttgtgaacaggctcccagg

SEQ ID NO: 571793 - DNA, 25 bp, Mus musculus
cagggtttgtgatcaggctcccagg

SEQ ID NO: 571794 - DNA, 25 bp, Mus musculus
caggtaaactcaacgcacagaagct

SEQ ID NO: 571795 - DNA, 25 bp, Mus musculus
caggtaaactcatcgcacagaagct

SEQ ID NO: 571796 - DNA, 25 bp, Mus musculus
caggtaaatgcaatggagattactc

SEQ ID NO: 571797 - DNA, 25 bp, Mus musculus
caggtaaatgcattggagattactc

SEQ ID NO: 571798 - DNA, 25 bp, Mus musculus
caggtaacctgtctggtgtgaacca

SEQ ID NO: 571799 - DNA, 25 bp, Mus musculus
caggtaacctgtgtggtgtgaacca

SEQ ID NO: 571800 - DNA, 25 bp, Mus musculus
caggtaacgctcagggctccttcca

SEQ ID NO: 571801 - DNA, 25 bp, Mus musculus
caggtaacgctctgggctccttcca

SEQ ID NO: 571802 - DNA, 25 bp, Mus musculus
caggtaagggatactgcatccaggg

SEQ ID NO: 571803 - DNA, 25 bp, Mus musculus
caggtaagggattctgcatccaggg

SEQ ID NO: 571804 - DNA, 25 bp, Mus musculus
caggtaagtgttaccagatcttaac

SEQ ID NO: 571805 - DNA, 25 bp, Mus musculus
caggtaagtgtttccagatcttaac

SEQ ID NO: 571806 - DNA, 25 bp, Mus musculus
caggtaattgcaaccacagttctac

SEQ ID NO: 571807 - DNA, 25 bp, Mus musculus
caggtaattgcatccacagttctac

SEQ ID NO: 571808 - DNA, 25 bp, Mus musculus
caggtacaccttctgagaagaagga

SEQ ID NO: 571809 - DNA, 25 bp, Mus musculus
caggtacaccttgtgagaagaagga

SEQ ID NO: 571810 - DNA, 25 bp, Mus musculus
caggtacagtggatatgaggctctc

SEQ ID NO: 571811 - DNA, 25 bp, Mus musculus
caggtacagtggttatgaggctctc

SEQ ID NO: 571812 - DNA, 25 bp, Mus musculus
caggtaccaaatagtttaacatctc

SEQ ID NO: 571813 - DNA, 25 bp, Mus musculus
caggtaccaaattgtttaacatctc

SEQ ID NO: 571814 - DNA, 25 bp, Mus musculus
caggtaccgcttacctcaagtgggc

SEQ ID NO: 571815 - DNA, 25 bp, Mus musculus
caggtaccgctttcctcaagtgggc

SEQ ID NO: 571816 - DNA, 25 bp, Mus musculus
caggtacctagcatgtcgttaaact

SEQ ID NO: 571817 - DNA, 25 bp, Mus musculus
caggtacctagcttgtcgttaaact

SEQ ID NO: 571818 - DNA, 25 bp, Mus musculus
caggtacctcctactcggataccat

SEQ ID NO: 571819 - DNA, 25 bp, Mus musculus
caggtacctccttctcggataccat

SEQ ID NO: 571820 - DNA, 25 bp, Mus musculus
caggtacggctgaaacaccggaagc

SEQ ID NO: 571821 - DNA, 25 bp, Mus musculus
caggtacggctgtaacaccggaagc

SEQ ID NO: 571822 - DNA, 25 bp, Mus musculus
caggtactacccagaggtgaacgag

SEQ ID NO: 571823 - DNA, 25 bp, Mus musculus
caggtactaccctgaggtgaacgag

SEQ ID NO: 571824 - DNA, 25 bp, Mus musculus
caggtactgaccatcaggcttggcc

SEQ ID NO: 571825 - DNA, 25 bp, Mus musculus
caggtactgaccttcaggcttggcc

SEQ ID NO: 571826 - DNA, 25 bp, Mus musculus
caggtactgaggcaaaatcgtgtgt

SEQ ID NO: 571827 - DNA, 25 bp, Mus musculus
caggtactgagggaaaatcgtgtgt

SEQ ID NO: 571828 - DNA, 25 bp, Mus musculus
caggtacttggacttacagcatcac

SEQ ID NO: 571829 - DNA, 25 bp, Mus musculus
caggtacttggagttacagcatcac

SEQ ID NO: 571830 - DNA, 25 bp, Mus musculus
caggtacttgtcagcctgctggcgc

SEQ ID NO: 571831 - DNA, 25 bp, Mus musculus
caggtacttgtctgcctgctggcgc

SEQ ID NO: 571832 - DNA, 25 bp, Mus musculus
caggtagaacttaatatggagctcc

SEQ ID NO: 571833 - DNA, 25 bp, Mus musculus
caggtagaactttatatggagctcc

SEQ ID NO: 571834 - DNA, 25 bp, Mus musculus
caggtagactgtcaaaatgactcag

SEQ ID NO: 571835 - DNA, 25 bp, Mus musculus
caggtagactgtgaaaatgactcag

SEQ ID NO: 571836 - DNA, 25 bp, Mus musculus
caggtagagcggatcggcgatatag

SEQ ID NO: 571837 - DNA, 25 bp, Mus musculus
caggtagagcggttcggcgatatag

SEQ ID NO: 571838 - DNA, 25 bp, Mus musculus
caggtagatcatagtgttgtgctct

SEQ ID NO: 571839 - DNA, 25 bp, Mus musculus
caggtagatcattgtgttgtgctct

SEQ ID NO: 571840 - DNA, 25 bp, Mus musculus
caggtagcagatcaggacctactgc

SEQ ID NO: 571841 - DNA, 25 bp, Mus musculus
caggtagcagatgaggacctactgc

SEQ ID NO: 571842 - DNA, 25 bp, Mus musculus
caggtagccctgcacggcattcagt

SEQ ID NO: 571843 - DNA, 25 bp, Mus musculus
caggtagccctggacggcattcagt

SEQ ID NO: 571844 - DNA, 25 bp, Mus musculus
caggtagctcaccagaccatggtga

SEQ ID NO: 571845 - DNA, 25 bp, Mus musculus
caggtagctcacgagaccatggtga

SEQ ID NO: 571846 - DNA, 25 bp, Mus musculus
caggtagctgctctgttacacaaca

SEQ ID NO: 571847 - DNA, 25 bp, Mus musculus
caggtagctgctgtgttacacaaca

SEQ ID NO: 571848 - DNA, 25 bp, Mus musculus
caggtagcttatctggtgttccaga

SEQ ID NO: 571849 - DNA, 25 bp, Mus musculus
caggtagcttatgtggtgttccaga

SEQ ID NO: 571850 - DNA, 25 bp, Mus musculus
caggtaggagtaactcaggaggccc

SEQ ID NO: 571851 - DNA, 25 bp, Mus musculus
caggtaggagtatctcaggaggccc

SEQ ID NO: 571852 - DNA, 25 bp, Mus musculus
caggtagtcagccacaaggaggaaa

SEQ ID NO: 571853 - DNA, 25 bp, Mus musculus
caggtagtcagcgacaaggaggaaa

SEQ ID NO: 571854 - DNA, 25 bp, Mus musculus
caggtagtccatagtccaagcaagc

SEQ ID NO: 571855 - DNA, 25 bp, Mus musculus
caggtagtccattgtccaagcaagc

SEQ ID NO: 571856 - DNA, 25 bp, Mus musculus
caggtagtgagtccgcccaggagca

SEQ ID NO: 571857 - DNA, 25 bp, Mus musculus
caggtagtgagtgcgcccaggagca

SEQ ID NO: 571858 - DNA, 25 bp, Mus musculus
caggtagtggagaacatgaccagga

SEQ ID NO: 571859 - DNA, 25 bp, Mus musculus
caggtagtggagtacatgaccagga

SEQ ID NO: 571860 - DNA, 25 bp, Mus musculus
caggtagttgaaactgttggaaacc

SEQ ID NO: 571861 - DNA, 25 bp, Mus musculus
caggtagttgaatctgttggaaacc

SEQ ID NO: 571862 - DNA, 25 bp, Mus musculus
caggtatatatacgtggcagcaaga

SEQ ID NO: 571863 - DNA, 25 bp, Mus musculus
caggtatatataggtggcagcaaga

SEQ ID NO: 571864 - DNA, 25 bp, Mus musculus
caggtatatgtcatgcctccaccag

SEQ ID NO: 571865 - DNA, 25 bp, Mus musculus
caggtatatgtcttgcctccaccag

SEQ ID NO: 571866 - DNA, 25 bp, Mus musculus
caggtatcttacatgacccatcaag

SEQ ID NO: 571867 - DNA, 25 bp, Mus musculus
caggtatcttacttgacccatcaag

SEQ ID NO: 571868 - DNA, 25 bp, Mus musculus
caggtatgaacacgcactctcgagc

SEQ ID NO: 571869 - DNA, 25 bp, Mus musculus
caggtatgaacaggcactctcgagc

SEQ ID NO: 571870 - DNA, 25 bp, Mus musculus
caggtatgccatatttacagggtta

SEQ ID NO: 571871 - DNA, 25 bp, Mus musculus
caggtatgccatttttacagggtta

SEQ ID NO: 571872 - DNA, 25 bp, Mus musculus
caggtatgccgtcccaagtggagct

SEQ ID NO: 571873 - DNA, 25 bp, Mus musculus
caggtatgccgtgccaagtggagct

SEQ ID NO: 571874 - DNA, 25 bp, Mus musculus
caggtatggctgacactggtttcag

SEQ ID NO: 571875 - DNA, 25 bp, Mus musculus
caggtatggctgtcactggtttcag

SEQ ID NO: 571876 - DNA, 25 bp, Mus musculus
caggtattccatccaggcactgctc

SEQ ID NO: 571877 - DNA, 25 bp, Mus musculus
caggtattccatgcaggcactgctc

SEQ ID NO: 571878 - DNA, 25 bp, Mus musculus
caggtatttctaagtcggctatttg

SEQ ID NO: 571879 - DNA, 25 bp, Mus musculus
caggtatttctatgtcggctatttg

SEQ ID NO: 571880 - DNA, 25 bp, Mus musculus
caggtcaaagatccattgaagatgg

SEQ ID NO: 571881 - DNA, 25 bp, Mus musculus
caggtcaaagatgcattgaagatgg

SEQ ID NO: 571882 - DNA, 25 bp, Mus musculus
caggtcaaggaacagcttctgcagt

SEQ ID NO: 571883 - DNA, 25 bp, Mus musculus
caggtcaaggaagagcttctgcagt

SEQ ID NO: 571884 - DNA, 25 bp, Mus musculus
caggtcacactgctggctgttattg

SEQ ID NO: 571885 - DNA, 25 bp, Mus musculus
caggtcacactggtggctgttattg

SEQ ID NO: 571886 - DNA, 25 bp, Mus musculus
caggtcaccttcctaggagaactga

SEQ ID NO: 571887 - DNA, 25 bp, Mus musculus
caggtcaccttcgtaggagaactga

SEQ ID NO: 571888 - DNA, 25 bp, Mus musculus
caggtcacgctcaatgtctttgaaa

SEQ ID NO: 571889 - DNA, 25 bp, Mus musculus
caggtcacgctctatgtctttgaaa

SEQ ID NO: 571890 - DNA, 25 bp, Mus musculus
caggtcacggctcctgagctgaact

SEQ ID NO: 571891 - DNA, 25 bp, Mus musculus
caggtcacggctgctgagctgaact

SEQ ID NO: 571892 - DNA, 25 bp, Mus musculus
caggtcagaaaacactgcctcttgt

SEQ ID NO: 571893 - DNA, 25 bp, Mus musculus
caggtcagaaaagactgcctcttgt

SEQ ID NO: 571894 - DNA, 25 bp, Mus musculus
caggtcagaggcaagcttgactcat

SEQ ID NO: 571895 - DNA, 25 bp, Mus musculus
caggtcagaggctagcttgactcat

SEQ ID NO: 571896 - DNA, 25 bp, Mus musculus
caggtcagagttacttccgggctct

SEQ ID NO: 571897 - DNA, 25 bp, Mus musculus
caggtcagagtttcttccgggctct

SEQ ID NO: 571898 - DNA, 25 bp, Mus musculus
caggtcagcaatcttttgtctcagc

SEQ ID NO: 571899 - DNA, 25 bp, Mus musculus
caggtcagcaatgttttgtctcagc

SEQ ID NO: 571900 - DNA, 25 bp, Mus musculus
caggtcagcctaaactgccaggagt

SEQ ID NO: 571901 - DNA, 25 bp, Mus musculus
caggtcagcctatactgccaggagt

SEQ ID NO: 571902 - DNA, 25 bp, Mus musculus
caggtcagccttcgatactggtcac

SEQ ID NO: 571903 - DNA, 25 bp, Mus musculus
caggtcagccttggatactggtcac

SEQ ID NO: 571904 - DNA, 25 bp, Mus musculus
caggtcaggagcaccattcaggaaa

SEQ ID NO: 571905 - DNA, 25 bp, Mus musculus
caggtcaggagctccattcaggaaa

SEQ ID NO: 571906 - DNA, 25 bp, Mus musculus
caggtcaggatacatgggctgctcc

SEQ ID NO: 571907 - DNA, 25 bp, Mus musculus
caggtcaggatagatgggctgctcc

SEQ ID NO: 571908 - DNA, 25 bp, Mus musculus
caggtcagtcagatttgcatccagg

SEQ ID NO: 571909 - DNA, 25 bp, Mus musculus
caggtcagtcagttttgcatccagg

SEQ ID NO: 571910 - DNA, 25 bp, Mus musculus
caggtcagtgtgacagtggctcgct

SEQ ID NO: 571911 - DNA, 25 bp, Mus musculus
caggtcagtgtgtcagtggctcgct

SEQ ID NO: 571912 - DNA, 25 bp, Mus musculus
caggtcatcaaacacaatttaaggt

SEQ ID NO: 571913 - DNA, 25 bp, Mus musculus
caggtcatcaaagacaatttaaggt

SEQ ID NO: 571914 - DNA, 25 bp, Mus musculus
caggtcatcgttctgtcctctggga

SEQ ID NO: 571915 - DNA, 25 bp, Mus musculus
caggtcatcgttgtgtcctctggga

SEQ ID NO: 571916 - DNA, 25 bp, Mus musculus
caggtcatgactccatttggaggca

SEQ ID NO: 571917 - DNA, 25 bp, Mus musculus
caggtcatgactgcatttggaggca

SEQ ID NO: 571918 - DNA, 25 bp, Mus musculus
caggtcatgaggcttgccgacaagc

SEQ ID NO: 571919 - DNA, 25 bp, Mus musculus
caggtcatgagggttgccgacaagc

SEQ ID NO: 571920 - DNA, 25 bp, Mus musculus
caggtcatggacactcgaattcaga

SEQ ID NO: 571921 - DNA, 25 bp, Mus musculus
caggtcatggactctcgaattcaga

SEQ ID NO: 571922 - DNA, 25 bp, Mus musculus
caggtcatgggcatgttggccttcc

SEQ ID NO: 571923 - DNA, 25 bp, Mus musculus
caggtcatgggcttgttggccttcc

SEQ ID NO: 571924 - DNA, 25 bp, Mus musculus
caggtcatgtgaccttacagatcca

SEQ ID NO: 571925 - DNA, 25 bp, Mus musculus
caggtcatgtgagcttacagatcca

SEQ ID NO: 571926 - DNA, 25 bp, Mus musculus
caggtccacgttcgtgcttgtgcca

SEQ ID NO: 571927 - DNA, 25 bp, Mus musculus
caggtccacgttggtgcttgtgcca

SEQ ID NO: 571928 - DNA, 25 bp, Mus musculus
caggtccactgactgcaagagcagc

SEQ ID NO: 571929 - DNA, 25 bp, Mus musculus
caggtccactgagtgcaagagcagc

SEQ ID NO: 571930 - DNA, 25 bp, Mus musculus
caggtccagggacattcagccattc

SEQ ID NO: 571931 - DNA, 25 bp, Mus musculus
caggtccagggagattcagccattc

SEQ ID NO: 571932 - DNA, 25 bp, Mus musculus
caggtccaggtccagaaagaaccta

SEQ ID NO: 571933 - DNA, 25 bp, Mus musculus
caggtccaggtcgagaaagaaccta

SEQ ID NO: 571934 - DNA, 25 bp, Mus musculus
caggtccccactatgaggatggagc

SEQ ID NO: 571935 - DNA, 25 bp, Mus musculus
caggtccccactttgaggatggagc

SEQ ID NO: 571936 - DNA, 25 bp, Mus musculus
caggtccccaggacatctatgatgt

SEQ ID NO: 571937 - DNA, 25 bp, Mus musculus
caggtccccaggtcatctatgatgt

SEQ ID NO: 571938 - DNA, 25 bp, Mus musculus
caggtcccttcccttgggtgcgctt

SEQ ID NO: 571939 - DNA, 25 bp, Mus musculus
caggtcccttccgttgggtgcgctt

SEQ ID NO: 571940 - DNA, 25 bp, Mus musculus
caggtccggattccctggtccgagt

SEQ ID NO: 571941 - DNA, 25 bp, Mus musculus
caggtccggattgcctggtccgagt

SEQ ID NO: 571942 - DNA, 25 bp, Mus musculus
caggtccggctcattgagtgttcca

SEQ ID NO: 571943 - DNA, 25 bp, Mus musculus
caggtccggctctttgagtgttcca

SEQ ID NO: 571944 - DNA, 25 bp, Mus musculus
caggtcctacaacggatcctatcac

SEQ ID NO: 571945 - DNA, 25 bp, Mus musculus
caggtcctacaagggatcctatcac

SEQ ID NO: 571946 - DNA, 25 bp, Mus musculus
caggtcctagagagcccaagtggga

SEQ ID NO: 571947 - DNA, 25 bp, Mus musculus
caggtcctagagtgcccaagtggga

SEQ ID NO: 571948 - DNA, 25 bp, Mus musculus
caggtcctcagaatcagggatgtga

SEQ ID NO: 571949 - DNA, 25 bp, Mus musculus
caggtcctcagattcagggatgtga

SEQ ID NO: 571950 - DNA, 25 bp, Mus musculus
caggtcctgcatccgtttgtggaac

SEQ ID NO: 571951 - DNA, 25 bp, Mus musculus
caggtcctgcatgcgtttgtggaac

SEQ ID NO: 571952 - DNA, 25 bp, Mus musculus
caggtcctgcctatcagctgagttc

SEQ ID NO: 571953 - DNA, 25 bp, Mus musculus
caggtcctgcctttcagctgagttc

SEQ ID NO: 571954 - DNA, 25 bp, Mus musculus
caggtcctgggcatggtagagaacc

SEQ ID NO: 571955 - DNA, 25 bp, Mus musculus
caggtcctgggcttggtagagaacc

SEQ ID NO: 571956 - DNA, 25 bp, Mus musculus
caggtccttgacagtggccgaggaa

SEQ ID NO: 571957 - DNA, 25 bp, Mus musculus
caggtccttgactgtggccgaggaa

SEQ ID NO: 571958 - DNA, 25 bp, Mus musculus
caggtcgagagcaggatggtggccc

SEQ ID NO: 571959 - DNA, 25 bp, Mus musculus
caggtcgagagctggatggtggccc

SEQ ID NO: 571960 - DNA, 25 bp, Mus musculus
caggtcgcactgcattttcaccatc

SEQ ID NO: 571961 - DNA, 25 bp, Mus musculus
caggtcgcactggattttcaccatc

SEQ ID NO: 571962 - DNA, 25 bp, Mus musculus
caggtcgccatcaggcagaggaact

SEQ ID NO: 571963 - DNA, 25 bp, Mus musculus
caggtcgccatctggcagaggaact

SEQ ID NO: 571964 - DNA, 25 bp, Mus musculus
caggtcgcccttctattcttgcagg

SEQ ID NO: 571965 - DNA, 25 bp, Mus musculus
caggtcgcccttgtattcttgcagg

SEQ ID NO: 571966 - DNA, 25 bp, Mus musculus
caggtcgctctgcatatccaggcct

SEQ ID NO: 571967 - DNA, 25 bp, Mus musculus
caggtcgctctggatatccaggcct

SEQ ID NO: 571968 - DNA, 25 bp, Mus musculus
caggtcgtgacgctcactgcagact

SEQ ID NO: 571969 - DNA, 25 bp, Mus musculus
caggtcgtgacggtcactgcagact

SEQ ID NO: 571970 - DNA, 25 bp, Mus musculus
caggtctaaacccaaagccagtgag

SEQ ID NO: 571971 - DNA, 25 bp, Mus musculus
caggtctaaaccgaaagccagtgag

SEQ ID NO: 571972 - DNA, 25 bp, Mus musculus
caggtctacaccatcttgactgtgc

SEQ ID NO: 571973 - DNA, 25 bp, Mus musculus
caggtctacaccttcttgactgtgc

SEQ ID NO: 571974 - DNA, 25 bp, Mus musculus
caggtctaccacatccttggatgag

SEQ ID NO: 571975 - DNA, 25 bp, Mus musculus
caggtctaccacttccttggatgag

SEQ ID NO: 571976 - DNA, 25 bp, Mus musculus
caggtctattgactaaggtctggca

SEQ ID NO: 571977 - DNA, 25 bp, Mus musculus
caggtctattgagtaaggtctggca

SEQ ID NO: 571978 - DNA, 25 bp, Mus musculus
caggtctccaagctgtccagattgg

SEQ ID NO: 571979 - DNA, 25 bp, Mus musculus
caggtctccaaggtgtccagattgg

SEQ ID NO: 571980 - DNA, 25 bp, Mus musculus
caggtctcgcttcagtttgctggtt

SEQ ID NO: 571981 - DNA, 25 bp, Mus musculus
caggtctcgcttgagtttgctggtt

SEQ ID NO: 571982 - DNA, 25 bp, Mus musculus
caggtctctggtaccatcatggatc

SEQ ID NO: 571983 - DNA, 25 bp, Mus musculus
caggtctctggttccatcatggatc

SEQ ID NO: 571984 - DNA, 25 bp, Mus musculus
caggtctgaactcctgacaaggtgc

SEQ ID NO: 571985 - DNA, 25 bp, Mus musculus
caggtctgaactgctgacaaggtgc

SEQ ID NO: 571986 - DNA, 25 bp, Mus musculus
caggtctgagatcttcacacaagca

SEQ ID NO: 571987 - DNA, 25 bp, Mus musculus
caggtctgagatgttcacacaagca

SEQ ID NO: 571988 - DNA, 25 bp, Mus musculus
caggtctggctgatggcacagcgtc

SEQ ID NO: 571989 - DNA, 25 bp, Mus musculus
caggtctggctgttggcacagcgtc

SEQ ID NO: 571990 - DNA, 25 bp, Mus musculus
caggtctgtggacagccagttgatt

SEQ ID NO: 571991 - DNA, 25 bp, Mus musculus
caggtctgtggagagccagttgatt

SEQ ID NO: 571992 - DNA, 25 bp, Mus musculus
caggtctgttctcactgctgcagcc

SEQ ID NO: 571993 - DNA, 25 bp, Mus musculus
caggtctgttctgactgctgcagcc

SEQ ID NO: 571994 - DNA, 25 bp, Mus musculus
caggtcttcccgatcacctatgaga

SEQ ID NO: 571995 - DNA, 25 bp, Mus musculus
caggtcttcccgttcacctatgaga

SEQ ID NO: 571996 - DNA, 25 bp, Mus musculus
caggtcttgtgcaggtagccatggc

SEQ ID NO: 571997 - DNA, 25 bp, Mus musculus
caggtcttgtgctggtagccatggc

SEQ ID NO: 571998 - DNA, 25 bp, Mus musculus
caggtgaacaccacggattgctggg

SEQ ID NO: 571999 - DNA, 25 bp, Mus musculus
caggtgaacacctcggattgctggg

SEQ ID NO: 572000 - DNA, 25 bp, Mus musculus
caggtgaaccacacccagactatgg

SEQ ID NO: 572001 - DNA, 25 bp, Mus musculus
caggtgaaccactcccagactatgg

SEQ ID NO: 572002 - DNA, 25 bp, Mus musculus
caggtgaacgcacccattaattgcg

SEQ ID NO: 572003 - DNA, 25 bp, Mus musculus
caggtgaacgcagccattaattgcg

SEQ ID NO: 572004 - DNA, 25 bp, Mus musculus
caggtgaacgtgatactcgcaaact

SEQ ID NO: 572005 - DNA, 25 bp, Mus musculus
caggtgaacgtgttactcgcaaact

SEQ ID NO: 572006 - DNA, 25 bp, Mus musculus
caggtgaactctacgtccctcaact

SEQ ID NO: 572007 - DNA, 25 bp, Mus musculus
caggtgaactcttcgtccctcaact

SEQ ID NO: 572008 - DNA, 25 bp, Mus musculus
caggtgaagcccaacgtggaagaag

SEQ ID NO: 572009 - DNA, 25 bp, Mus musculus
caggtgaagccctacgtggaagaag

SEQ ID NO: 572010 - DNA, 25 bp, Mus musculus
caggtgaagtgcactgaggctgccc

SEQ ID NO: 572011 - DNA, 25 bp, Mus musculus
caggtgaagtgctctgaggctgccc

SEQ ID NO: 572012 - DNA, 25 bp, Mus musculus
caggtgacactgcatgctattcttg

SEQ ID NO: 572013 - DNA, 25 bp, Mus musculus
caggtgacactggatgctattcttg

SEQ ID NO: 572014 - DNA, 25 bp, Mus musculus
caggtgacatcaatgctcggagaac

SEQ ID NO: 572015 - DNA, 25 bp, Mus musculus
caggtgacatcattgctcggagaac

SEQ ID NO: 572016 - DNA, 25 bp, Mus musculus
caggtgaccctgcaaattggagtag

SEQ ID NO: 572017 - DNA, 25 bp, Mus musculus
caggtgaccctggaaattggagtag

SEQ ID NO: 572018 - DNA, 25 bp, Mus musculus
caggtgagaaaactgcaaggcacca

SEQ ID NO: 572019 - DNA, 25 bp, Mus musculus
caggtgagaaaagtgcaaggcacca

SEQ ID NO: 572020 - DNA, 25 bp, Mus musculus
caggtgagaactcagataagcctga

SEQ ID NO: 572021 - DNA, 25 bp, Mus musculus
caggtgagaactgagataagcctga

SEQ ID NO: 572022 - DNA, 25 bp, Mus musculus
caggtgagacctctgttttcggtta

SEQ ID NO: 572023 - DNA, 25 bp, Mus musculus
caggtgagacctgtgttttcggtta

SEQ ID NO: 572024 - DNA, 25 bp, Mus musculus
caggtgagcaaaccagggttccctg

SEQ ID NO: 572025 - DNA, 25 bp, Mus musculus
caggtgagcaaagcagggttccctg

SEQ ID NO: 572026 - DNA, 25 bp, Mus musculus
caggtgagcttccagtgtctgtgca

SEQ ID NO: 572027 - DNA, 25 bp, Mus musculus
caggtgagcttcgagtgtctgtgca

SEQ ID NO: 572028 - DNA, 25 bp, Mus musculus
caggtgaggcttcgcttgagttact

SEQ ID NO: 572029 - DNA, 25 bp, Mus musculus
caggtgaggcttggcttgagttact

SEQ ID NO: 572030 - DNA, 25 bp, Mus musculus
caggtgaggtagcttactcaggctc

SEQ ID NO: 572031 - DNA, 25 bp, Mus musculus
caggtgaggtaggttactcaggctc

SEQ ID NO: 572032 - DNA, 25 bp, Mus musculus
caggtgataaggagctgctgctagt

SEQ ID NO: 572033 - DNA, 25 bp, Mus musculus
caggtgataaggtgctgctgctagt

SEQ ID NO: 572034 - DNA, 25 bp, Mus musculus
caggtgatacccattgaagaatttc

SEQ ID NO: 572035 - DNA, 25 bp, Mus musculus
caggtgataccctttgaagaatttc

SEQ ID NO: 572036 - DNA, 25 bp, Mus musculus
caggtgatccgacccgtcctgaagg

SEQ ID NO: 572037 - DNA, 25 bp, Mus musculus
caggtgatccgagccgtcctgaagg

SEQ ID NO: 572038 - DNA, 25 bp, Mus musculus
caggtgatctttcaggagggttcct

SEQ ID NO: 572039 - DNA, 25 bp, Mus musculus
caggtgatctttgaggagggttcct

SEQ ID NO: 572040 - DNA, 25 bp, Mus musculus
caggtgatgagaatagctgaagtca

SEQ ID NO: 572041 - DNA, 25 bp, Mus musculus
caggtgatgagattagctgaagtca

SEQ ID NO: 572042 - DNA, 25 bp, Mus musculus
caggtgatgcttattcggaagagtc

SEQ ID NO: 572043 - DNA, 25 bp, Mus musculus
caggtgatgctttttcggaagagtc

SEQ ID NO: 572044 - DNA, 25 bp, Mus musculus
caggtgatggccaccagctgggctt

SEQ ID NO: 572045 - DNA, 25 bp, Mus musculus
caggtgatggcctccagctgggctt

SEQ ID NO: 572046 - DNA, 25 bp, Mus musculus
caggtgatgtgaagcttctggacac

SEQ ID NO: 572047 - DNA, 25 bp, Mus musculus
caggtgatgtgatgcttctggacac

SEQ ID NO: 572048 - DNA, 25 bp, Mus musculus
caggtgatgtgcagtgtaactcttc

SEQ ID NO: 572049 - DNA, 25 bp, Mus musculus
caggtgatgtgctgtgtaactcttc

SEQ ID NO: 572050 - DNA, 25 bp, Mus musculus
caggtgattggtagcctggtgtccc

SEQ ID NO: 572051 - DNA, 25 bp, Mus musculus
caggtgattggttgcctggtgtccc

SEQ ID NO: 572052 - DNA, 25 bp, Mus musculus
caggtgattgttacttctagtacta

SEQ ID NO: 572053 - DNA, 25 bp, Mus musculus
caggtgattgtttcttctagtacta

SEQ ID NO: 572054 - DNA, 25 bp, Mus musculus
caggtgatttccagtctgtgagcac

SEQ ID NO: 572055 - DNA, 25 bp, Mus musculus
caggtgatttcctgtctgtgagcac

SEQ ID NO: 572056 - DNA, 25 bp, Mus musculus
caggtgcaaaggataactcggagac

SEQ ID NO: 572057 - DNA, 25 bp, Mus musculus
caggtgcaaaggttaactcggagac

SEQ ID NO: 572058 - DNA, 25 bp, Mus musculus
caggtgcacccacatgatgtggata

SEQ ID NO: 572059 - DNA, 25 bp, Mus musculus
caggtgcacccagatgatgtggata

SEQ ID NO: 572060 - DNA, 25 bp, Mus musculus
caggtgcacgcccaaaggtggcttc

SEQ ID NO: 572061 - DNA, 25 bp, Mus musculus
caggtgcacgcccagaatggagatt

SEQ ID NO: 572062 - DNA, 25 bp, Mus musculus
caggtgcacgccgaaaggtggcttc

SEQ ID NO: 572063 - DNA, 25 bp, Mus musculus
caggtgcacgccgagaatggagatt

SEQ ID NO: 572064 - DNA, 25 bp, Mus musculus
caggtgcagatcacacaggacagcg

SEQ ID NO: 572065 - DNA, 25 bp, Mus musculus
caggtgcagatctcacaggacagcg

SEQ ID NO: 572066 - DNA, 25 bp, Mus musculus
caggtgcagcaaagatcaatggctc

SEQ ID NO: 572067 - DNA, 25 bp, Mus musculus
caggtgcagcaatgatcaatggctc

SEQ ID NO: 572068 - DNA, 25 bp, Mus musculus
caggtgcagcctagtctatctttag

SEQ ID NO: 572069 - DNA, 25 bp, Mus musculus
caggtgcagccttgtctatctttag

SEQ ID NO: 572070 - DNA, 25 bp, Mus musculus
caggtgcagctccacactggtgcag

SEQ ID NO: 572071 - DNA, 25 bp, Mus musculus
caggtgcagctcgacactggtgcag

SEQ ID NO: 572072 - DNA, 25 bp, Mus musculus
caggtgcagtctatggaaggtgcca

SEQ ID NO: 572073 - DNA, 25 bp, Mus musculus
caggtgcagtctttggaaggtgcca

SEQ ID NO: 572074 - DNA, 25 bp, Mus musculus
caggtgcattgccaagcttgcccag

SEQ ID NO: 572075 - DNA, 25 bp, Mus musculus
caggtgcattgcgaagcttgcccag

SEQ ID NO: 572076 - DNA, 25 bp, Mus musculus
caggtgccacagattacattaccgg

SEQ ID NO: 572077 - DNA, 25 bp, Mus musculus
caggtgccacagtttacattaccgg

SEQ ID NO: 572078 - DNA, 25 bp, Mus musculus
caggtgccactgctactgtggtcga

SEQ ID NO: 572079 - DNA, 25 bp, Mus musculus
caggtgccactggtactgtggtcga

SEQ ID NO: 572080 - DNA, 25 bp, Mus musculus
caggtgccagtgaactgacggtcag

SEQ ID NO: 572081 - DNA, 25 bp, Mus musculus
caggtgccagtgtactgacggtcag

SEQ ID NO: 572082 - DNA, 25 bp, Mus musculus
caggtgccccctcaagatgacgatg

SEQ ID NO: 572083 - DNA, 25 bp, Mus musculus
caggtgccccctgaagatgacgatg

SEQ ID NO: 572084 - DNA, 25 bp, Mus musculus
caggtgcccgacatggcgagtgctg

SEQ ID NO: 572085 - DNA, 25 bp, Mus musculus
caggtgcccgacttggcgagtgctg

SEQ ID NO: 572086 - DNA, 25 bp, Mus musculus
caggtgcccttccatggcatgtggc

SEQ ID NO: 572087 - DNA, 25 bp, Mus musculus
caggtgcccttcgatggcatgtggc

SEQ ID NO: 572088 - DNA, 25 bp, Mus musculus
caggtgcctgccctggcatttgcag

SEQ ID NO: 572089 - DNA, 25 bp, Mus musculus
caggtgcctgccgtggcatttgcag

SEQ ID NO: 572090 - DNA, 25 bp, Mus musculus
caggtgcgaccgactgactgattcg

SEQ ID NO: 572091 - DNA, 25 bp, Mus musculus
caggtgcgaccgtctgactgattcg

SEQ ID NO: 572092 - DNA, 25 bp, Mus musculus
caggtgcgagatccatacatcctca

SEQ ID NO: 572093 - DNA, 25 bp, Mus musculus
caggtgcgagatgcatacatcctca

SEQ ID NO: 572094 - DNA, 25 bp, Mus musculus
caggtgctaaagcagcttctgggtc

SEQ ID NO: 572095 - DNA, 25 bp, Mus musculus
caggtgctaaaggagcttctgggtc

SEQ ID NO: 572096 - DNA, 25 bp, Mus musculus
caggtgctgaagagcaactgcgtct

SEQ ID NO: 572097 - DNA, 25 bp, Mus musculus
caggtgctgaagtgcaactgcgtct

SEQ ID NO: 572098 - DNA, 25 bp, Mus musculus
caggtgctgaatcggcgcttcatgt

SEQ ID NO: 572099 - DNA, 25 bp, Mus musculus
caggtgctgaatgggcgcttcatgt

SEQ ID NO: 572100 - DNA, 25 bp, Mus musculus
caggtgctgcctcagagtggacaac

SEQ ID NO: 572101 - DNA, 25 bp, Mus musculus
caggtgctgcctgagagtggacaac

SEQ ID NO: 572102 - DNA, 25 bp, Mus musculus
caggtgctgcgtctacggttcacta

SEQ ID NO: 572103 - DNA, 25 bp, Mus musculus
caggtgctgcgtgtacggttcacta

SEQ ID NO: 572104 - DNA, 25 bp, Mus musculus
caggtgctgctcattactatgtaac

SEQ ID NO: 572105 - DNA, 25 bp, Mus musculus
caggtgctgctctttactatgtaac

SEQ ID NO: 572106 - DNA, 25 bp, Mus musculus
caggtgctgggaattaacacgcgca

SEQ ID NO: 572107 - DNA, 25 bp, Mus musculus
caggtgctgggatttaacacgcgca

SEQ ID NO: 572108 - DNA, 25 bp, Mus musculus
caggtgctgtagatctctccgatcc

SEQ ID NO: 572109 - DNA, 25 bp, Mus musculus
caggtgctgtagttctctccgatcc

SEQ ID NO: 572110 - DNA, 25 bp, Mus musculus
caggtgctgtgtcctgagcactccc

SEQ ID NO: 572111 - DNA, 25 bp, Mus musculus
caggtgctgtgtgctgagcactccc

SEQ ID NO: 572112 - DNA, 25 bp, Mus musculus
caggtgctgtttcacctggtctgtg

SEQ ID NO: 572113 - DNA, 25 bp, Mus musculus
caggtgctgtttgacctggtctgtg

SEQ ID NO: 572114 - DNA, 25 bp, Mus musculus
caggtgcttactattcctcagtccc

SEQ ID NO: 572115 - DNA, 25 bp, Mus musculus
caggtgcttacttttcctcagtccc

SEQ ID NO: 572116 - DNA, 25 bp, Mus musculus
caggtgcttcctcagatgtcgctct

SEQ ID NO: 572117 - DNA, 25 bp, Mus musculus
caggtgcttcctgagatgtcgctct

SEQ ID NO: 572118 - DNA, 25 bp, Mus musculus
caggtgcttgccagaactgcaataa

SEQ ID NO: 572119 - DNA, 25 bp, Mus musculus
caggtgcttgcctgaactgcaataa

SEQ ID NO: 572120 - DNA, 25 bp, Mus musculus
caggtgcttttcagtaccccgaaag

SEQ ID NO: 572121 - DNA, 25 bp, Mus musculus
caggtgcttttctgtaccccgaaag

SEQ ID NO: 572122 - DNA, 25 bp, Mus musculus
caggtggaaatgacctagagcttgg

SEQ ID NO: 572123 - DNA, 25 bp, Mus musculus
caggtggaaatgtcctagagcttgg

SEQ ID NO: 572124 - DNA, 25 bp, Mus musculus
caggtggaactaagtggccaagaac

SEQ ID NO: 572125 - DNA, 25 bp, Mus musculus
caggtggaactatgtggccaagaac

SEQ ID NO: 572126 - DNA, 25 bp, Mus musculus
caggtggacaagcccatcgaaagcc

SEQ ID NO: 572127 - DNA, 25 bp, Mus musculus
caggtggacaaggccatcgaaagcc

SEQ ID NO: 572128 - DNA, 25 bp, Mus musculus
caggtggacaccattcaccggctgc

SEQ ID NO: 572129 - DNA, 25 bp, Mus musculus
caggtggacacctttcaccggctgc

SEQ ID NO: 572130 - DNA, 25 bp, Mus musculus
caggtggagagcagatcatctctgc

SEQ ID NO: 572131 - DNA, 25 bp, Mus musculus
caggtggagagctgatcatctctgc

SEQ ID NO: 572132 - DNA, 25 bp, Mus musculus
caggtggagctcagcacgcaccaca

SEQ ID NO: 572133 - DNA, 25 bp, Mus musculus
caggtggagctctgcacgcaccaca

SEQ ID NO: 572134 - DNA, 25 bp, Mus musculus
caggtggatcaaagcaggccatgag

SEQ ID NO: 572135 - DNA, 25 bp, Mus musculus
caggtggatcaatgcaggccatgag

SEQ ID NO: 572136 - DNA, 25 bp, Mus musculus
caggtggcaagtcagacttgatgta

SEQ ID NO: 572137 - DNA, 25 bp, Mus musculus
caggtggcaagtgagacttgatgta

SEQ ID NO: 572138 - DNA, 25 bp, Mus musculus
caggtggcaccaaagactacattgt

SEQ ID NO: 572139 - DNA, 25 bp, Mus musculus
caggtggcaccatagactacattgt

SEQ ID NO: 572140 - DNA, 25 bp, Mus musculus
caggtggcactcctggaacaagtga

SEQ ID NO: 572141 - DNA, 25 bp, Mus musculus
caggtggcactcgtggaacaagtga

SEQ ID NO: 572142 - DNA, 25 bp, Mus musculus
caggtggcactgcaaattacctggt

SEQ ID NO: 572143 - DNA, 25 bp, Mus musculus
caggtggcactggaaattacctggt

SEQ ID NO: 572144 - DNA, 25 bp, Mus musculus
caggtggcagaaaaggtggcctcca

SEQ ID NO: 572145 - DNA, 25 bp, Mus musculus
caggtggcagaataggtggcctcca

SEQ ID NO: 572146 - DNA, 25 bp, Mus musculus
caggtggcatccagcatccaccaga

SEQ ID NO: 572147 - DNA, 25 bp, Mus musculus
caggtggcatcctgcatccaccaga

SEQ ID NO: 572148 - DNA, 25 bp, Mus musculus
caggtggcccgacgcatgcagtatc

SEQ ID NO: 572149 - DNA, 25 bp, Mus musculus
caggtggcccgaggcatgcagtatc

SEQ ID NO: 572150 - DNA, 25 bp, Mus musculus
caggtggcctaccaagactcggact

SEQ ID NO: 572151 - DNA, 25 bp, Mus musculus
caggtggcctacgaagactcggact

SEQ ID NO: 572152 - DNA, 25 bp, Mus musculus
caggtggcgacacaacctatagcag

SEQ ID NO: 572153 - DNA, 25 bp, Mus musculus
caggtggcgacagaacctatagcag

SEQ ID NO: 572154 - DNA, 25 bp, Mus musculus
caggtggcggtacctgccaatcagc

SEQ ID NO: 572155 - DNA, 25 bp, Mus musculus
caggtggcggtagctgccaatcagc

SEQ ID NO: 572156 - DNA, 25 bp, Mus musculus
caggtggctagcattgccatgggtc

SEQ ID NO: 572157 - DNA, 25 bp, Mus musculus
caggtggctagctttgccatgggtc

SEQ ID NO: 572158 - DNA, 25 bp, Mus musculus
caggtggctgatctcaataagcagg

SEQ ID NO: 572159 - DNA, 25 bp, Mus musculus
caggtggctgatgtcaataagcagg

SEQ ID NO: 572160 - DNA, 25 bp, Mus musculus
caggtggctggcaagaagtgtggct

SEQ ID NO: 572161 - DNA, 25 bp, Mus musculus
caggtggctggctagaagtgtggct

SEQ ID NO: 572162 - DNA, 25 bp, Mus musculus
caggtggctttacggaacattgcca

SEQ ID NO: 572163 - DNA, 25 bp, Mus musculus
caggtggctttagggaacattgcca

SEQ ID NO: 572164 - DNA, 25 bp, Mus musculus
caggtgggaaccagggcccagacca

SEQ ID NO: 572165 - DNA, 25 bp, Mus musculus
caggtgggaacctgggcccagacca

SEQ ID NO: 572166 - DNA, 25 bp, Mus musculus
caggtgggccatcactttaggagca

SEQ ID NO: 572167 - DNA, 25 bp, Mus musculus
caggtgggccatgactttaggagca

SEQ ID NO: 572168 - DNA, 25 bp, Mus musculus
caggtgggcggaaccatctcctctg

SEQ ID NO: 572169 - DNA, 25 bp, Mus musculus
caggtgggcggatccatctcctctg

SEQ ID NO: 572170 - DNA, 25 bp, Mus musculus
caggtgggcgtgacacctgtgccta

SEQ ID NO: 572171 - DNA, 25 bp, Mus musculus
caggtgggcgtgtcacctgtgccta

SEQ ID NO: 572172 - DNA, 25 bp, Mus musculus
caggtgggtccaagtcacagagtcg

SEQ ID NO: 572173 - DNA, 25 bp, Mus musculus
caggtgggtccatgtcacagagtcg

SEQ ID NO: 572174 - DNA, 25 bp, Mus musculus
caggtggtagagaactatgccagcc

SEQ ID NO: 572175 - DNA, 25 bp, Mus musculus
caggtggtagagtactatgccagcc

SEQ ID NO: 572176 - DNA, 25 bp, Mus musculus
caggtggtcaagatcttggtggtca

SEQ ID NO: 572177 - DNA, 25 bp, Mus musculus
caggtggtcaagttcttggtggtca

SEQ ID NO: 572178 - DNA, 25 bp, Mus musculus
caggtggtcctgcatctttatccac

SEQ ID NO: 572179 - DNA, 25 bp, Mus musculus
caggtggtcctggatctttatccac

SEQ ID NO: 572180 - DNA, 25 bp, Mus musculus
caggtggtggacatctaccagccga

SEQ ID NO: 572181 - DNA, 25 bp, Mus musculus
caggtggtggacttctaccagccga

SEQ ID NO: 572182 - DNA, 25 bp, Mus musculus
caggtggtggttatggctcacccat

SEQ ID NO: 572183 - DNA, 25 bp, Mus musculus
caggtggtggttttggctcacccat

SEQ ID NO: 572184 - DNA, 25 bp, Mus musculus
caggtggtgttgacccgccccgctg

SEQ ID NO: 572185 - DNA, 25 bp, Mus musculus
caggtggtgttgtcccgccccgctg

SEQ ID NO: 572186 - DNA, 25 bp, Mus musculus
caggtggttattacagaccctgaga

SEQ ID NO: 572187 - DNA, 25 bp, Mus musculus
caggtggttatttcagaccctgaga

SEQ ID NO: 572188 - DNA, 25 bp, Mus musculus
caggtggtttgaacccaagtcttcc

SEQ ID NO: 572189 - DNA, 25 bp, Mus musculus
caggtggtttgatcccaagtcttcc

SEQ ID NO: 572190 - DNA, 25 bp, Mus musculus
caggtgtaaacaacaaaggaatcac

SEQ ID NO: 572191 - DNA, 25 bp, Mus musculus
caggtgtaaacatcaaaggaatcac

SEQ ID NO: 572192 - DNA, 25 bp, Mus musculus
caggtgtacaagctgcgccatgtgc

SEQ ID NO: 572193 - DNA, 25 bp, Mus musculus
caggtgtacaaggtgcgccatgtgc

SEQ ID NO: 572194 - DNA, 25 bp, Mus musculus
caggtgtaccctagccacgtggtgg

SEQ ID NO: 572195 - DNA, 25 bp, Mus musculus
caggtgtacccttgccacgtggtgg

SEQ ID NO: 572196 - DNA, 25 bp, Mus musculus
caggtgtacggcatcttggaggtca

SEQ ID NO: 572197 - DNA, 25 bp, Mus musculus
caggtgtacggcttcttggaggtca

SEQ ID NO: 572198 - DNA, 25 bp, Mus musculus
caggtgtacgtcctacaaggttacg

SEQ ID NO: 572199 - DNA, 25 bp, Mus musculus
caggtgtacgtcgtacaaggttacg

SEQ ID NO: 572200 - DNA, 25 bp, Mus musculus
caggtgtagaatcgaaaaactgttt

SEQ ID NO: 572201 - DNA, 25 bp, Mus musculus
caggtgtagaatggaaaaactgttt

SEQ ID NO: 572202 - DNA, 25 bp, Mus musculus
caggtgtagtggagctttgattccg

SEQ ID NO: 572203 - DNA, 25 bp, Mus musculus
caggtgtagtggtgctttgattccg

SEQ ID NO: 572204 - DNA, 25 bp, Mus musculus
caggtgtcagagaaggagtttaact

SEQ ID NO: 572205 - DNA, 25 bp, Mus musculus
caggtgtcagagtaggagtttaact

SEQ ID NO: 572206 - DNA, 25 bp, Mus musculus
caggtgtcagatctcactgtcactc

SEQ ID NO: 572207 - DNA, 25 bp, Mus musculus
caggtgtcagatgtcactgtcactc

SEQ ID NO: 572208 - DNA, 25 bp, Mus musculus
caggtgtcagctatccagaggagga

SEQ ID NO: 572209 - DNA, 25 bp, Mus musculus
caggtgtcagctttccagaggagga

SEQ ID NO: 572210 - DNA, 25 bp, Mus musculus
caggtgtccaggatgactgtgaatg

SEQ ID NO: 572211 - DNA, 25 bp, Mus musculus
caggtgtccaggttgactgtgaatg

SEQ ID NO: 572212 - DNA, 25 bp, Mus musculus
caggtgtcccgcctgaaaggcagat

SEQ ID NO: 572213 - DNA, 25 bp, Mus musculus
caggtgtcccgcgtgaaaggcagat

SEQ ID NO: 572214 - DNA, 25 bp, Mus musculus
caggtgtctcatctggtggcagcac

SEQ ID NO: 572215 - DNA, 25 bp, Mus musculus
caggtgtctcatgtggtggcagcac

SEQ ID NO: 572216 - DNA, 25 bp, Mus musculus
caggtgtctggtcctaaagtcatcg

SEQ ID NO: 572217 - DNA, 25 bp, Mus musculus
caggtgtctggtgctaaagtcatcg

SEQ ID NO: 572218 - DNA, 25 bp, Mus musculus
caggtgtctgtcctcatcaattttg

SEQ ID NO: 572219 - DNA, 25 bp, Mus musculus
caggtgtctgtcgtcatcaattttg

SEQ ID NO: 572220 - DNA, 25 bp, Mus musculus
caggtgtgaaacaacatgcagttca

SEQ ID NO: 572221 - DNA, 25 bp, Mus musculus
caggtgtgaaactacatgcagttca

SEQ ID NO: 572222 - DNA, 25 bp, Mus musculus
caggtgtgacatagaaagaagcaaa

SEQ ID NO: 572223 - DNA, 25 bp, Mus musculus
caggtgtgacattgaaagaagcaaa

SEQ ID NO: 572224 - DNA, 25 bp, Mus musculus
caggtgtgcaacctgtgccagaaga

SEQ ID NO: 572225 - DNA, 25 bp, Mus musculus
caggtgtgcaacgtgtgccagaaga

SEQ ID NO: 572226 - DNA, 25 bp, Mus musculus
caggtgtgccctcccgctgtttcaa

SEQ ID NO: 572227 - DNA, 25 bp, Mus musculus
caggtgtgccctgccgctgtttcaa

SEQ ID NO: 572228 - DNA, 25 bp, Mus musculus
caggtgtgctctacctgccacagca

SEQ ID NO: 572229 - DNA, 25 bp, Mus musculus
caggtgtgctcttcctgccacagca

SEQ ID NO: 572230 - DNA, 25 bp, Mus musculus
caggtgtgggttctacctacaagag

SEQ ID NO: 572231 - DNA, 25 bp, Mus musculus
caggtgtgggttgtacctacaagag

SEQ ID NO: 572232 - DNA, 25 bp, Mus musculus
caggtgtgtctcatgccctgagatt

SEQ ID NO: 572233 - DNA, 25 bp, Mus musculus
caggtgtgtctcttgccctgagatt

SEQ ID NO: 572234 - DNA, 25 bp, Mus musculus
caggtgtgtcttcccgggacgtcta

SEQ ID NO: 572235 - DNA, 25 bp, Mus musculus
caggtgtgtcttgccgggacgtcta

SEQ ID NO: 572236 - DNA, 25 bp, Mus musculus
caggtgtgtgagacccagttccaaa

SEQ ID NO: 572237 - DNA, 25 bp, Mus musculus
caggtgtgtgagtcccagttccaaa

SEQ ID NO: 572238 - DNA, 25 bp, Mus musculus
caggtgtgttccatatgacaagaca

SEQ ID NO: 572239 - DNA, 25 bp, Mus musculus
caggtgtgttccttatgacaagaca

SEQ ID NO: 572240 - DNA, 25 bp, Mus musculus
caggtgttagaaagtgagcgtaatc

SEQ ID NO: 572241 - DNA, 25 bp, Mus musculus
caggtgttagaatgtgagcgtaatc

SEQ ID NO: 572242 - DNA, 25 bp, Mus musculus
caggtgttctatcactggccagaga

SEQ ID NO: 572243 - DNA, 25 bp, Mus musculus
caggtgttctatgactggccagaga

SEQ ID NO: 572244 - DNA, 25 bp, Mus musculus
caggtgttgaagaccttaggatcat

SEQ ID NO: 572245 - DNA, 25 bp, Mus musculus
caggtgttgaagtccttaggatcat

SEQ ID NO: 572246 - DNA, 25 bp, Mus musculus
caggtgttgcttccgccacttctct

SEQ ID NO: 572247 - DNA, 25 bp, Mus musculus
caggtgttgcttgcgccacttctct

SEQ ID NO: 572248 - DNA, 25 bp, Mus musculus
caggtgtttgggaaaggtctgatca

SEQ ID NO: 572249 - DNA, 25 bp, Mus musculus
caggtgtttgggtaaggtctgatca

SEQ ID NO: 572250 - DNA, 25 bp, Mus musculus
caggtgtttggtcatcaccatggca

SEQ ID NO: 572251 - DNA, 25 bp, Mus musculus
caggtgtttggtgatcaccatggca

SEQ ID NO: 572252 - DNA, 25 bp, Mus musculus
caggttaacaatagccctctgcagc

SEQ ID NO: 572253 - DNA, 25 bp, Mus musculus
caggttaacaattgccctctgcagc

SEQ ID NO: 572254 - DNA, 25 bp, Mus musculus
caggttaatactactcggacacgga

SEQ ID NO: 572255 - DNA, 25 bp, Mus musculus
caggttaatacttctcggacacgga

SEQ ID NO: 572256 - DNA, 25 bp, Mus musculus
caggttaattcacgaggtgtctttt

SEQ ID NO: 572257 - DNA, 25 bp, Mus musculus
caggttaattcaggaggtgtctttt

SEQ ID NO: 572258 - DNA, 25 bp, Mus musculus
caggttaccgatcgcaaccatgagt

SEQ ID NO: 572259 - DNA, 25 bp, Mus musculus
caggttaccgatggcaaccatgagt

SEQ ID NO: 572260 - DNA, 25 bp, Mus musculus
caggttagtatcagaattctcatca

SEQ ID NO: 572261 - DNA, 25 bp, Mus musculus
caggttagtatctgaattctcatca

SEQ ID NO: 572262 - DNA, 25 bp, Mus musculus
caggttatggcaccaagtatgtcag

SEQ ID NO: 572263 - DNA, 25 bp, Mus musculus
caggttatggcagcaagtatgtcag

SEQ ID NO: 572264 - DNA, 25 bp, Mus musculus
caggttattgctacctacgctgcta

SEQ ID NO: 572265 - DNA, 25 bp, Mus musculus
caggttattgcttcctacgctgcta

SEQ ID NO: 572266 - DNA, 25 bp, Mus musculus
caggttcaagatccgtgacatggac

SEQ ID NO: 572267 - DNA, 25 bp, Mus musculus
caggttcaagatgcgtgacatggac

SEQ ID NO: 572268 - DNA, 25 bp, Mus musculus
caggttcaccggaccaggaaggctt

SEQ ID NO: 572269 - DNA, 25 bp, Mus musculus
caggttcaccggtccaggaaggctt

SEQ ID NO: 572270 - DNA, 25 bp, Mus musculus
caggttcactctcgaggagctgtgt

SEQ ID NO: 572271 - DNA, 25 bp, Mus musculus
caggttcactctggaggagctgtgt

SEQ ID NO: 572272 - DNA, 25 bp, Mus musculus
caggttcagcggaaagtgatctgca

SEQ ID NO: 572273 - DNA, 25 bp, Mus musculus
caggttcagcggagagtaggtctac

SEQ ID NO: 572274 - DNA, 25 bp, Mus musculus
caggttcagcggtaagtgatctgca

SEQ ID NO: 572275 - DNA, 25 bp, Mus musculus
caggttcagcggtgagtaggtctac

SEQ ID NO: 572276 - DNA, 25 bp, Mus musculus
caggttcaggccactcaagggtgga

SEQ ID NO: 572277 - DNA, 25 bp, Mus musculus
caggttcaggcctctcaagggtgga

SEQ ID NO: 572278 - DNA, 25 bp, Mus musculus
caggttcatagcctttagtcccagg

SEQ ID NO: 572279 - DNA, 25 bp, Mus musculus
caggttcatagcgtttagtcccagg

SEQ ID NO: 572280 - DNA, 25 bp, Mus musculus
caggttcatgcactgattcatccag

SEQ ID NO: 572281 - DNA, 25 bp, Mus musculus
caggttcatgcagtgattcatccag

SEQ ID NO: 572282 - DNA, 25 bp, Mus musculus
caggttccgtttaatgaagtgcgat

SEQ ID NO: 572283 - DNA, 25 bp, Mus musculus
caggttccgttttatgaagtgcgat

SEQ ID NO: 572284 - DNA, 25 bp, Mus musculus
caggttctacatccaatggcacaag

SEQ ID NO: 572285 - DNA, 25 bp, Mus musculus
caggttctacatgcaatggcacaag

SEQ ID NO: 572286 - DNA, 25 bp, Mus musculus
caggttctcaccagttatgtcagga

SEQ ID NO: 572287 - DNA, 25 bp, Mus musculus
caggttctcacctgttatgtcagga

SEQ ID NO: 572288 - DNA, 25 bp, Mus musculus
caggttctcgctcaagaagctgaag

SEQ ID NO: 572289 - DNA, 25 bp, Mus musculus
caggttctcgctgaagaagctgaag

SEQ ID NO: 572290 - DNA, 25 bp, Mus musculus
caggttctgatgagtctcatgtggc

SEQ ID NO: 572291 - DNA, 25 bp, Mus musculus
caggttctgatgtgtctcatgtggc

SEQ ID NO: 572292 - DNA, 25 bp, Mus musculus
caggttctgcatcacgttcggcggc

SEQ ID NO: 572293 - DNA, 25 bp, Mus musculus
caggttctgcatgacgttcggcggc

SEQ ID NO: 572294 - DNA, 25 bp, Mus musculus
caggttctgcccaatttgtcacagg

SEQ ID NO: 572295 - DNA, 25 bp, Mus musculus
caggttctgccctatttgtcacagg

SEQ ID NO: 572296 - DNA, 25 bp, Mus musculus
caggttctgcgaacgtgttcaggac

SEQ ID NO: 572297 - DNA, 25 bp, Mus musculus
caggttctgcgatcgtgttcaggac

SEQ ID NO: 572298 - DNA, 25 bp, Mus musculus
caggttctggacaacaggctgaggc

SEQ ID NO: 572299 - DNA, 25 bp, Mus musculus
caggttctggacagtgctgcgatcc

SEQ ID NO: 572300 - DNA, 25 bp, Mus musculus
caggttctggactacaggctgaggc

SEQ ID NO: 572301 - DNA, 25 bp, Mus musculus
caggttctggactgtgctgcgatcc

SEQ ID NO: 572302 - DNA, 25 bp, Mus musculus
caggttcttgctacaaagtctgcca

SEQ ID NO: 572303 - DNA, 25 bp, Mus musculus
caggttcttgcttcaaagtctgcca

SEQ ID NO: 572304 - DNA, 25 bp, Mus musculus
caggttgaacctctggaccctcctg

SEQ ID NO: 572305 - DNA, 25 bp, Mus musculus
caggttgaacctgtggaccctcctg

SEQ ID NO: 572306 - DNA, 25 bp, Mus musculus
caggttgacgccaaagaataacctg

SEQ ID NO: 572307 - DNA, 25 bp, Mus musculus
caggttgacgcctaagaataacctg

SEQ ID NO: 572308 - DNA, 25 bp, Mus musculus
caggttgctggacttcagtgaccac

SEQ ID NO: 572309 - DNA, 25 bp, Mus musculus
caggttgctggagttcagtgaccac

SEQ ID NO: 572310 - DNA, 25 bp, Mus musculus
caggttggagctcacgtgattttca

SEQ ID NO: 572311 - DNA, 25 bp, Mus musculus
caggttggagctgacgtgattttca

SEQ ID NO: 572312 - DNA, 25 bp, Mus musculus
caggttggccaaaaccaccatgttc

SEQ ID NO: 572313 - DNA, 25 bp, Mus musculus
caggttggccaacctcgcctgcttg

SEQ ID NO: 572314 - DNA, 25 bp, Mus musculus
caggttggccaagctcgcctgcttg

SEQ ID NO: 572315 - DNA, 25 bp, Mus musculus
caggttggccaataccaccatgttc

SEQ ID NO: 572316 - DNA, 25 bp, Mus musculus
caggttgggaagaggaatccagttc

SEQ ID NO: 572317 - DNA, 25 bp, Mus musculus
caggttgggaagtggaatccagttc

SEQ ID NO: 572318 - DNA, 25 bp, Mus musculus
caggttggtcacaatctgttatagg

SEQ ID NO: 572319 - DNA, 25 bp, Mus musculus
caggttggtcactatctgttatagg

SEQ ID NO: 572320 - DNA, 25 bp, Mus musculus
caggttggtggtccagatagataat

SEQ ID NO: 572321 - DNA, 25 bp, Mus musculus
caggttggtggtgcagatagataat

SEQ ID NO: 572322 - DNA, 25 bp, Mus musculus
caggttgtaccgaaggtgcgacctc

SEQ ID NO: 572323 - DNA, 25 bp, Mus musculus
caggttgtaccgtaggtgcgacctc

SEQ ID NO: 572324 - DNA, 25 bp, Mus musculus
caggttgtgaatagtagggatgctc

SEQ ID NO: 572325 - DNA, 25 bp, Mus musculus
caggttgtgaattgtagggatgctc

SEQ ID NO: 572326 - DNA, 25 bp, Mus musculus
caggttgtggtaatgctcgtcggct

SEQ ID NO: 572327 - DNA, 25 bp, Mus musculus
caggttgtggtattgctcgtcggct

SEQ ID NO: 572328 - DNA, 25 bp, Mus musculus
caggttgtttgtaccatcgggccgc

SEQ ID NO: 572329 - DNA, 25 bp, Mus musculus
caggttgtttgttccatcgggccgc

SEQ ID NO: 572330 - DNA, 25 bp, Mus musculus
caggtttcagaacccagttgtggga

SEQ ID NO: 572331 - DNA, 25 bp, Mus musculus
caggtttcagaagccagttgtggga

SEQ ID NO: 572332 - DNA, 25 bp, Mus musculus
caggtttcctgcagaaggcgatccc

SEQ ID NO: 572333 - DNA, 25 bp, Mus musculus
caggtttcctgctgaaggcgatccc

SEQ ID NO: 572334 - DNA, 25 bp, Mus musculus
caggtttccttccatgcaggccaca

SEQ ID NO: 572335 - DNA, 25 bp, Mus musculus
caggtttccttcgatgcaggccaca

SEQ ID NO: 572336 - DNA, 25 bp, Mus musculus
caggtttcgtgtctactcctggaaa

SEQ ID NO: 572337 - DNA, 25 bp, Mus musculus
caggtttcgtgtgtactcctggaaa

SEQ ID NO: 572338 - DNA, 25 bp, Mus musculus
caggtttctggcataggtcagtaga

SEQ ID NO: 572339 - DNA, 25 bp, Mus musculus
caggtttctggcttaggtcagtaga

SEQ ID NO: 572340 - DNA, 25 bp, Mus musculus
caggtttgcacacttctggttctga

SEQ ID NO: 572341 - DNA, 25 bp, Mus musculus
caggtttgcacagttctggttctga

SEQ ID NO: 572342 - DNA, 25 bp, Mus musculus
caggtttgcagacgacaccgatagg

SEQ ID NO: 572343 - DNA, 25 bp, Mus musculus
caggtttgcagaggacaccgatagg

SEQ ID NO: 572344 - DNA, 25 bp, Mus musculus
caggtttgcatgagagtcgtgcaag

SEQ ID NO: 572345 - DNA, 25 bp, Mus musculus
caggtttgcatgtgagtcgtgcaag

SEQ ID NO: 572346 - DNA, 25 bp, Mus musculus
caggtttgctggatggatttatgac

SEQ ID NO: 572347 - DNA, 25 bp, Mus musculus
caggtttgctggttggatttatgac

SEQ ID NO: 572348 - DNA, 25 bp, Mus musculus
caggtttggccaactcctatgcagt

SEQ ID NO: 572349 - DNA, 25 bp, Mus musculus
caggtttggccatctcctatgcagt

SEQ ID NO: 572350 - DNA, 25 bp, Mus musculus
caggtttgggctatcctcaccagat

SEQ ID NO: 572351 - DNA, 25 bp, Mus musculus
caggtttgggctttcctcaccagat

SEQ ID NO: 572352 - DNA, 25 bp, Mus musculus
caggtttgtgacaagaagtgagaac

SEQ ID NO: 572353 - DNA, 25 bp, Mus musculus
caggtttgtgactagaagtgagaac

SEQ ID NO: 572354 - DNA, 25 bp, Mus musculus
caggtttgtggcagttaccagcaca

SEQ ID NO: 572355 - DNA, 25 bp, Mus musculus
caggtttgtggctgttaccagcaca

SEQ ID NO: 572356 - DNA, 25 bp, Mus musculus
caggttttaccaccaacattgtgga

SEQ ID NO: 572357 - DNA, 25 bp, Mus musculus
caggttttaccagcaacattgtgga

SEQ ID NO: 572358 - DNA, 25 bp, Mus musculus
caggttttcaaactggcctcctccg

SEQ ID NO: 572359 - DNA, 25 bp, Mus musculus
caggttttcaaagtggcctcctccg

SEQ ID NO: 572360 - DNA, 25 bp, Mus musculus
caggttttctgtcgaatacaaatgt

SEQ ID NO: 572361 - DNA, 25 bp, Mus musculus
caggttttctgtggaatacaaatgt

SEQ ID NO: 572362 - DNA, 25 bp, Mus musculus
caggttttggagagaattgccacag

SEQ ID NO: 572363 - DNA, 25 bp, Mus musculus
caggttttggagtgaattgccacag

SEQ ID NO: 572364 - DNA, 25 bp, Mus musculus
caggttttgtatatctccaggcaag

SEQ ID NO: 572365 - DNA, 25 bp, Mus musculus
caggttttgtatttctccaggcaag

SEQ ID NO: 572366 - DNA, 25 bp, Mus musculus
cagtaaaaatgtcactttatttcca

SEQ ID NO: 572367 - DNA, 25 bp, Mus musculus
cagtaaaaatgtgactttatttcca

SEQ ID NO: 572368 - DNA, 25 bp, Mus musculus
cagtaaaagtcgcagcaggagccag

SEQ ID NO: 572369 - DNA, 25 bp, Mus musculus
cagtaaaagtcggagcaggagccag

SEQ ID NO: 572370 - DNA, 25 bp, Mus musculus
cagtaaagaagactctgaacatctg

SEQ ID NO: 572371 - DNA, 25 bp, Mus musculus
cagtaaagaagagtctgaacatctg

SEQ ID NO: 572372 - DNA, 25 bp, Mus musculus
cagtaaagagtcatctgtcccaggc

SEQ ID NO: 572373 - DNA, 25 bp, Mus musculus
cagtaaagagtcttctgtcccaggc

SEQ ID NO: 572374 - DNA, 25 bp, Mus musculus
cagtaaagctgaagaaaagacagct

SEQ ID NO: 572375 - DNA, 25 bp, Mus musculus
cagtaaagctgatgaaaagacagct

SEQ ID NO: 572376 - DNA, 25 bp, Mus musculus
cagtaaataccacggccactgggca

SEQ ID NO: 572377 - DNA, 25 bp, Mus musculus
cagtaaataccagggccactgggca

SEQ ID NO: 572378 - DNA, 25 bp, Mus musculus
cagtaacaagtgaataaacctcttt

SEQ ID NO: 572379 - DNA, 25 bp, Mus musculus
cagtaacaagtgtataaacctcttt

SEQ ID NO: 572380 - DNA, 25 bp, Mus musculus
cagtaacaggcgcttacagcagacc

SEQ ID NO: 572381 - DNA, 25 bp, Mus musculus
cagtaacaggcggttacagcagacc

SEQ ID NO: 572382 - DNA, 25 bp, Mus musculus
cagtaaccacagaggtgatgtgctg

SEQ ID NO: 572383 - DNA, 25 bp, Mus musculus
cagtaaccacagtggtgatgtgctg

SEQ ID NO: 572384 - DNA, 25 bp, Mus musculus
cagtaaccacggacctgaggctgat

SEQ ID NO: 572385 - DNA, 25 bp, Mus musculus
cagtaaccacggtcctgaggctgat

SEQ ID NO: 572386 - DNA, 25 bp, Mus musculus
cagtaacccatactacttgggaggc

SEQ ID NO: 572387 - DNA, 25 bp, Mus musculus
cagtaacccatagtacttgggaggc

SEQ ID NO: 572388 - DNA, 25 bp, Mus musculus
cagtaacctctcagtggagaacgct

SEQ ID NO: 572389 - DNA, 25 bp, Mus musculus
cagtaacctctctgtggagaacgct

SEQ ID NO: 572390 - DNA, 25 bp, Mus musculus
cagtaacctcttataagtctgctta

SEQ ID NO: 572391 - DNA, 25 bp, Mus musculus
cagtaacctcttttaagtctgctta

SEQ ID NO: 572392 - DNA, 25 bp, Mus musculus
cagtaacctgcaaggaatgtgctag

SEQ ID NO: 572393 - DNA, 25 bp, Mus musculus
cagtaacctgcatggaatgtgctag

SEQ ID NO: 572394 - DNA, 25 bp, Mus musculus
cagtaacctttgaggatggccgctc

SEQ ID NO: 572395 - DNA, 25 bp, Mus musculus
cagtaacctttgtggatggccgctc

SEQ ID NO: 572396 - DNA, 25 bp, Mus musculus
cagtaacgccatcaaatccaatcca

SEQ ID NO: 572397 - DNA, 25 bp, Mus musculus
cagtaacgccatgaaatccaatcca

SEQ ID NO: 572398 - DNA, 25 bp, Mus musculus
cagtaacggagaaaatggagtccca

SEQ ID NO: 572399 - DNA, 25 bp, Mus musculus
cagtaacggagataatggagtccca

SEQ ID NO: 572400 - DNA, 25 bp, Mus musculus
cagtaacggagccagacctgagaaa

SEQ ID NO: 572401 - DNA, 25 bp, Mus musculus
cagtaacggagcgagacctgagaaa

SEQ ID NO: 572402 - DNA, 25 bp, Mus musculus
cagtaacggcgcaggaggcatttta

SEQ ID NO: 572403 - DNA, 25 bp, Mus musculus
cagtaacggcgctggaggcatttta

SEQ ID NO: 572404 - DNA, 25 bp, Mus musculus
cagtaactatgacgacgatgagaag

SEQ ID NO: 572405 - DNA, 25 bp, Mus musculus
cagtaactatgaggacgatgagaag

SEQ ID NO: 572406 - DNA, 25 bp, Mus musculus
cagtaactgcaactatgaagttgtc

SEQ ID NO: 572407 - DNA, 25 bp, Mus musculus
cagtaactgcaagtatgaagttgtc

SEQ ID NO: 572408 - DNA, 25 bp, Mus musculus
cagtaactggatagctgtcacctcc

SEQ ID NO: 572409 - DNA, 25 bp, Mus musculus
cagtaactggattgctgtcacctcc

SEQ ID NO: 572410 - DNA, 25 bp, Mus musculus
cagtaactggtaactgaggctctct

SEQ ID NO: 572411 - DNA, 25 bp, Mus musculus
cagtaactggtatctgaggctctct

SEQ ID NO: 572412 - DNA, 25 bp, Mus musculus
cagtaacttctgctatgaggccatg

SEQ ID NO: 572413 - DNA, 25 bp, Mus musculus
cagtaacttctggtatgaggccatg

SEQ ID NO: 572414 - DNA, 25 bp, Mus musculus
cagtaagaagcaacagttccaggat

SEQ ID NO: 572415 - DNA, 25 bp, Mus musculus
cagtaagaagcatcagttccaggat

SEQ ID NO: 572416 - DNA, 25 bp, Mus musculus
cagtaagaatttcgaactcgcccgt

SEQ ID NO: 572417 - DNA, 25 bp, Mus musculus
cagtaagaatttggaactcgcccgt

SEQ ID NO: 572418 - DNA, 25 bp, Mus musculus
cagtaagactttctgccgggctcag

SEQ ID NO: 572419 - DNA, 25 bp, Mus musculus
cagtaagactttgtgccgggctcag

SEQ ID NO: 572420 - DNA, 25 bp, Mus musculus
cagtaagagaatcccgtcgtggagt

SEQ ID NO: 572421 - DNA, 25 bp, Mus musculus
cagtaagagaatgccgtcgtggagt

SEQ ID NO: 572422 - DNA, 25 bp, Mus musculus
cagtaagagctgctggcaactgaac

SEQ ID NO: 572423 - DNA, 25 bp, Mus musculus
cagtaagagctggtggcaactgaac

SEQ ID NO: 572424 - DNA, 25 bp, Mus musculus
cagtaagagtaaagaccacgccgag

SEQ ID NO: 572425 - DNA, 25 bp, Mus musculus
cagtaagagtaatgaccacgccgag

SEQ ID NO: 572426 - DNA, 25 bp, Mus musculus
cagtaagagttcatcagggccaaga

SEQ ID NO: 572427 - DNA, 25 bp, Mus musculus
cagtaagagttcttcagggccaaga

SEQ ID NO: 572428 - DNA, 25 bp, Mus musculus
cagtaagatcataagcagcgatcgg

SEQ ID NO: 572429 - DNA, 25 bp, Mus musculus
cagtaagatcattagcagcgatcgg

SEQ ID NO: 572430 - DNA, 25 bp, Mus musculus
cagtaagatctgatggcataacgac

SEQ ID NO: 572431 - DNA, 25 bp, Mus musculus
cagtaagatctgttggcataacgac

SEQ ID NO: 572432 - DNA, 25 bp, Mus musculus
cagtaagcaggacatcgaagagtcc

SEQ ID NO: 572433 - DNA, 25 bp, Mus musculus
cagtaagcaggagatcgaagagtcc

SEQ ID NO: 572434 - DNA, 25 bp, Mus musculus
cagtaaggactcacactgcagatcc

SEQ ID NO: 572435 - DNA, 25 bp, Mus musculus
cagtaaggactctcactgcagatcc

SEQ ID NO: 572436 - DNA, 25 bp, Mus musculus
cagtaaggcctgaagctgtgcccca

SEQ ID NO: 572437 - DNA, 25 bp, Mus musculus
cagtaaggcctgtagctgtgcccca

SEQ ID NO: 572438 - DNA, 25 bp, Mus musculus
cagtaagtgctacatgtgccagttg

SEQ ID NO: 572439 - DNA, 25 bp, Mus musculus
cagtaagtgctagatgtgccagttg

SEQ ID NO: 572440 - DNA, 25 bp, Mus musculus
cagtaagtgctgaggcctcgagatc

SEQ ID NO: 572441 - DNA, 25 bp, Mus musculus
cagtaagtgctgtggcctcgagatc

SEQ ID NO: 572442 - DNA, 25 bp, Mus musculus
cagtaatacaacaccgggaagatgg

SEQ ID NO: 572443 - DNA, 25 bp, Mus musculus
cagtaatacaactccgggaagatgg

SEQ ID NO: 572444 - DNA, 25 bp, Mus musculus
cagtaatgatgaagaccccaagaca

SEQ ID NO: 572445 - DNA, 25 bp, Mus musculus
cagtaatgatgatgaccccaagaca

SEQ ID NO: 572446 - DNA, 25 bp, Mus musculus
cagtaatgatgccttcttcagcttg

SEQ ID NO: 572447 - DNA, 25 bp, Mus musculus
cagtaatgatgcgttcttcagcttg

SEQ ID NO: 572448 - DNA, 25 bp, Mus musculus
cagtaatggaacagtcttatacaca

SEQ ID NO: 572449 - DNA, 25 bp, Mus musculus
cagtaatggaactgtcttatacaca

SEQ ID NO: 572450 - DNA, 25 bp, Mus musculus
cagtaattctttcaagtcgatctgt

SEQ ID NO: 572451 - DNA, 25 bp, Mus musculus
cagtaattctttgaagtcgatctgt

SEQ ID NO: 572452 - DNA, 25 bp, Mus musculus
cagtacaaacgtcagctttaaagaa

SEQ ID NO: 572453 - DNA, 25 bp, Mus musculus
cagtacaaacgtgagctttaaagaa

SEQ ID NO: 572454 - DNA, 25 bp, Mus musculus
cagtacaagtgcctggtcatcaagt

SEQ ID NO: 572455 - DNA, 25 bp, Mus musculus
cagtacaagtgcgtggtcatcaagt

SEQ ID NO: 572456 - DNA, 25 bp, Mus musculus
cagtacaagttgatgcaggacagca

SEQ ID NO: 572457 - DNA, 25 bp, Mus musculus
cagtacaagttgttgcaggacagca

SEQ ID NO: 572458 - DNA, 25 bp, Mus musculus
cagtacaatggaccagaagagaaca

SEQ ID NO: 572459 - DNA, 25 bp, Mus musculus
cagtacaatggagcagaagagaaca

SEQ ID NO: 572460 - DNA, 25 bp, Mus musculus
cagtacacatgaccatgggtcctac

SEQ ID NO: 572461 - DNA, 25 bp, Mus musculus
cagtacacatgagcatgggtcctac

SEQ ID NO: 572462 - DNA, 25 bp, Mus musculus
cagtacacctggatctgcacactca

SEQ ID NO: 572463 - DNA, 25 bp, Mus musculus
cagtacacctggttctgcacactca

SEQ ID NO: 572464 - DNA, 25 bp, Mus musculus
cagtacacggaacaccagatctggg

SEQ ID NO: 572465 - DNA, 25 bp, Mus musculus
cagtacacggaagaccagatctggg

SEQ ID NO: 572466 - DNA, 25 bp, Mus musculus
cagtacagtgccatgtagtggacaa

SEQ ID NO: 572467 - DNA, 25 bp, Mus musculus
cagtacagtgccttgtagtggacaa

SEQ ID NO: 572468 - DNA, 25 bp, Mus musculus
cagtacagtttaatgttacaacaga

SEQ ID NO: 572469 - DNA, 25 bp, Mus musculus
cagtacagtttattgttacaacaga

SEQ ID NO: 572470 - DNA, 25 bp, Mus musculus
cagtacataggtcaaatctgccgct

SEQ ID NO: 572471 - DNA, 25 bp, Mus musculus
cagtacataggtgaaatctgccgct

SEQ ID NO: 572472 - DNA, 25 bp, Mus musculus
cagtacatattcaccttgaagagaa

SEQ ID NO: 572473 - DNA, 25 bp, Mus musculus
cagtacatattctccttgaagagaa

SEQ ID NO: 572474 - DNA, 25 bp, Mus musculus
cagtacatgatgctcatggttggct

SEQ ID NO: 572475 - DNA, 25 bp, Mus musculus
cagtacatgatggtcatggttggct

SEQ ID NO: 572476 - DNA, 25 bp, Mus musculus
cagtacatgcccacacgatgctgct

SEQ ID NO: 572477 - DNA, 25 bp, Mus musculus
cagtacatgccctcacgatgctgct

SEQ ID NO: 572478 - DNA, 25 bp, Mus musculus
cagtacatggaaagcaccgtggcct

SEQ ID NO: 572479 - DNA, 25 bp, Mus musculus
cagtacatggaatgcaccgtggcct

SEQ ID NO: 572480 - DNA, 25 bp, Mus musculus
cagtacatgtaaaggcgagcacatt

SEQ ID NO: 572481 - DNA, 25 bp, Mus musculus
cagtacatgtaatggcgagcacatt

SEQ ID NO: 572482 - DNA, 25 bp, Mus musculus
cagtaccaacgtcgccatgcttcag

SEQ ID NO: 572483 - DNA, 25 bp, Mus musculus
cagtaccaacgtggccatgcttcag

SEQ ID NO: 572484 - DNA, 25 bp, Mus musculus
cagtaccaagccagggatgctactc

SEQ ID NO: 572485 - DNA, 25 bp, Mus musculus
cagtaccaagccagtgtaatccact

SEQ ID NO: 572486 - DNA, 25 bp, Mus musculus
cagtaccaagcctgggatgctactc

SEQ ID NO: 572487 - DNA, 25 bp, Mus musculus
cagtaccaagcctgtgtaatccact

SEQ ID NO: 572488 - DNA, 25 bp, Mus musculus
cagtaccaatctaagtgtggtggga

SEQ ID NO: 572489 - DNA, 25 bp, Mus musculus
cagtaccaatcttagtgtggtggga

SEQ ID NO: 572490 - DNA, 25 bp, Mus musculus
cagtaccacactagcttttttccag

SEQ ID NO: 572491 - DNA, 25 bp, Mus musculus
cagtaccacacttgcttttttccag

SEQ ID NO: 572492 - DNA, 25 bp, Mus musculus
cagtaccaccctccaagttggagtt

SEQ ID NO: 572493 - DNA, 25 bp, Mus musculus
cagtaccaccctgcaagttggagtt

SEQ ID NO: 572494 - DNA, 25 bp, Mus musculus
cagtaccagagacaaagacaagctt

SEQ ID NO: 572495 - DNA, 25 bp, Mus musculus
cagtaccagagagaaagacaagctt

SEQ ID NO: 572496 - DNA, 25 bp, Mus musculus
cagtaccagatcatcatgacaatga

SEQ ID NO: 572497 - DNA, 25 bp, Mus musculus
cagtaccagatcttcatgacaatga

SEQ ID NO: 572498 - DNA, 25 bp, Mus musculus
cagtaccagccaagcctcaggaaaa

SEQ ID NO: 572499 - DNA, 25 bp, Mus musculus
cagtaccagccatgcctcaggaaaa

SEQ ID NO: 572500 - DNA, 25 bp, Mus musculus
cagtaccatggcagtcgcagcaaca

SEQ ID NO: 572501 - DNA, 25 bp, Mus musculus
cagtaccatggctgtcgcagcaaca

SEQ ID NO: 572502 - DNA, 25 bp, Mus musculus
cagtaccattaacgttaacattcga

SEQ ID NO: 572503 - DNA, 25 bp, Mus musculus
cagtaccattaaggttaacattcga

SEQ ID NO: 572504 - DNA, 25 bp, Mus musculus
cagtaccccaccatggatgagctag

SEQ ID NO: 572505 - DNA, 25 bp, Mus musculus
cagtaccccaccttggatgagctag

SEQ ID NO: 572506 - DNA, 25 bp, Mus musculus
cagtaccctgttctgtgtctcttct

SEQ ID NO: 572507 - DNA, 25 bp, Mus musculus
cagtaccctgttgtgtgtctcttct

SEQ ID NO: 572508 - DNA, 25 bp, Mus musculus
cagtaccgtcggcaacgacacgttc

SEQ ID NO: 572509 - DNA, 25 bp, Mus musculus
cagtaccgtcgggaacgacacgttc

SEQ ID NO: 572510 - DNA, 25 bp, Mus musculus
cagtaccgtgccctggtctacagca

SEQ ID NO: 572511 - DNA, 25 bp, Mus musculus
cagtaccgtgccgtggtctacagca

SEQ ID NO: 572512 - DNA, 25 bp, Mus musculus
cagtacctaccacgccatcattgga

SEQ ID NO: 572513 - DNA, 25 bp, Mus musculus
cagtacctaccaggccatcattgga

SEQ ID NO: 572514 - DNA, 25 bp, Mus musculus
cagtacctagacagagcggagaagc

SEQ ID NO: 572515 - DNA, 25 bp, Mus musculus
cagtacctagactgagcggagaagc

SEQ ID NO: 572516 - DNA, 25 bp, Mus musculus
cagtacctggtcaacacgagcagca

SEQ ID NO: 572517 - DNA, 25 bp, Mus musculus
cagtacctggtctacacgagcagca

SEQ ID NO: 572518 - DNA, 25 bp, Mus musculus
cagtaccttggccagtgatcgcagc

SEQ ID NO: 572519 - DNA, 25 bp, Mus musculus
cagtaccttggcgagtgatcgcagc

SEQ ID NO: 572520 - DNA, 25 bp, Mus musculus
cagtacgaccagattggtgatgaca

SEQ ID NO: 572521 - DNA, 25 bp, Mus musculus
cagtacgaccagtttggtgatgaca

SEQ ID NO: 572522 - DNA, 25 bp, Mus musculus
cagtacgactcgctggaatgcccgt

SEQ ID NO: 572523 - DNA, 25 bp, Mus musculus
cagtacgactcggtggaatgcccgt

SEQ ID NO: 572524 - DNA, 25 bp, Mus musculus
cagtacgagcgcagcatcgtggact

SEQ ID NO: 572525 - DNA, 25 bp, Mus musculus
cagtacgagcgctgcatcgtggact

SEQ ID NO: 572526 - DNA, 25 bp, Mus musculus
cagtacgagctgaaccctggagagg

SEQ ID NO: 572527 - DNA, 25 bp, Mus musculus
cagtacgagctgtaccctggagagg

SEQ ID NO: 572528 - DNA, 25 bp, Mus musculus
cagtacggacgacccataagtggac

SEQ ID NO: 572529 - DNA, 25 bp, Mus musculus
cagtacggacgagccataagtggac

SEQ ID NO: 572530 - DNA, 25 bp, Mus musculus
cagtacggcacgctctgtgctctca

SEQ ID NO: 572531 - DNA, 25 bp, Mus musculus
cagtacggcacggtctgtgctctca

SEQ ID NO: 572532 - DNA, 25 bp, Mus musculus
cagtacggcgaaccctcggcgctgt

SEQ ID NO: 572533 - DNA, 25 bp, Mus musculus
cagtacggcgaagcctcggcgctgt

SEQ ID NO: 572534 - DNA, 25 bp, Mus musculus
cagtacgtggcccagtctgtgcagc

SEQ ID NO: 572535 - DNA, 25 bp, Mus musculus
cagtacgtggccgagtctgtgcagc

SEQ ID NO: 572536 - DNA, 25 bp, Mus musculus
cagtactacgcaaatgtaacggagc

SEQ ID NO: 572537 - DNA, 25 bp, Mus musculus
cagtactacgcatatgtaacggagc

SEQ ID NO: 572538 - DNA, 25 bp, Mus musculus
cagtactctgggacacttaggcttg

SEQ ID NO: 572539 - DNA, 25 bp, Mus musculus
cagtactctgggtcacttaggcttg

SEQ ID NO: 572540 - DNA, 25 bp, Mus musculus
cagtactgccacagcgatcacaatc

SEQ ID NO: 572541 - DNA, 25 bp, Mus musculus
cagtactgccactgcgatcacaatc

SEQ ID NO: 572542 - DNA, 25 bp, Mus musculus
cagtactggcatcaccctatcaagg

SEQ ID NO: 572543 - DNA, 25 bp, Mus musculus
cagtactggcatgaccctatcaagg

SEQ ID NO: 572544 - DNA, 25 bp, Mus musculus
cagtactggctccatgggaagatca

SEQ ID NO: 572545 - DNA, 25 bp, Mus musculus
cagtactggctcgatgggaagatca

SEQ ID NO: 572546 - DNA, 25 bp, Mus musculus
cagtactgtcagaatggcacgccag

SEQ ID NO: 572547 - DNA, 25 bp, Mus musculus
cagtactgtcagtatggcacgccag

SEQ ID NO: 572548 - DNA, 25 bp, Mus musculus
cagtacttaggaagctgtccgggct

SEQ ID NO: 572549 - DNA, 25 bp, Mus musculus
cagtacttaggatgctgtccgggct

SEQ ID NO: 572550 - DNA, 25 bp, Mus musculus
cagtacttcccacacagtgagcagt

SEQ ID NO: 572551 - DNA, 25 bp, Mus musculus
cagtacttcccagacagtgagcagt

SEQ ID NO: 572552 - DNA, 25 bp, Mus musculus
cagtacttgaggctgggcaaggccg

SEQ ID NO: 572553 - DNA, 25 bp, Mus musculus
cagtacttgagggtgggcaaggccg

SEQ ID NO: 572554 - DNA, 25 bp, Mus musculus
cagtacttgggaaaacagcggagct

SEQ ID NO: 572555 - DNA, 25 bp, Mus musculus
cagtacttgggataacagcggagct

SEQ ID NO: 572556 - DNA, 25 bp, Mus musculus
cagtagaacaagctaaatcaagatg

SEQ ID NO: 572557 - DNA, 25 bp, Mus musculus
cagtagaacaaggtaaatcaagatg

SEQ ID NO: 572558 - DNA, 25 bp, Mus musculus
cagtagaagcgtagaaacccaagcc

SEQ ID NO: 572559 - DNA, 25 bp, Mus musculus
cagtagaagcgttgaaacccaagcc

SEQ ID NO: 572560 - DNA, 25 bp, Mus musculus
cagtagaagtcccagaagaatcttc

SEQ ID NO: 572561 - DNA, 25 bp, Mus musculus
cagtagaagtccgagaagaatcttc

SEQ ID NO: 572562 - DNA, 25 bp, Mus musculus
cagtagacccctacaaagccacagg

SEQ ID NO: 572563 - DNA, 25 bp, Mus musculus
cagtagaccccttcaaagccacagg

SEQ ID NO: 572564 - DNA, 25 bp, Mus musculus
cagtagacttcccagtagtggcccc

SEQ ID NO: 572565 - DNA, 25 bp, Mus musculus
cagtagacttccgagtagtggcccc

SEQ ID NO: 572566 - DNA, 25 bp, Mus musculus
cagtagagatgactggatacgcaag

SEQ ID NO: 572567 - DNA, 25 bp, Mus musculus
cagtagagatgagtggatacgcaag

SEQ ID NO: 572568 - DNA, 25 bp, Mus musculus
cagtagagtcagctgcagcctagtc

SEQ ID NO: 572569 - DNA, 25 bp, Mus musculus
cagtagagtcaggtgcagcctagtc

SEQ ID NO: 572570 - DNA, 25 bp, Mus musculus
cagtagagtccaaccaggccgagga

SEQ ID NO: 572571 - DNA, 25 bp, Mus musculus
cagtagagtccatccaggccgagga

SEQ ID NO: 572572 - DNA, 25 bp, Mus musculus
cagtagagttttcccacgtgacgag

SEQ ID NO: 572573 - DNA, 25 bp, Mus musculus
cagtagagttttgccacgtgacgag

SEQ ID NO: 572574 - DNA, 25 bp, Mus musculus
cagtagatcagtcacagtgcccttc

SEQ ID NO: 572575 - DNA, 25 bp, Mus musculus
cagtagatcagtgacagtgcccttc

SEQ ID NO: 572576 - DNA, 25 bp, Mus musculus
cagtagatgaaccaatgtctaagca

SEQ ID NO: 572577 - DNA, 25 bp, Mus musculus
cagtagatgaacgaatgtctaagca

SEQ ID NO: 572578 - DNA, 25 bp, Mus musculus
cagtagattggcaaaatataggaca

SEQ ID NO: 572579 - DNA, 25 bp, Mus musculus
cagtagattggctaaatataggaca

SEQ ID NO: 572580 - DNA, 25 bp, Mus musculus
cagtagatttagactgtgggagtca

SEQ ID NO: 572581 - DNA, 25 bp, Mus musculus
cagtagatttagtctgtgggagtca

SEQ ID NO: 572582 - DNA, 25 bp, Mus musculus
cagtagcaactcaggatgggatcag

SEQ ID NO: 572583 - DNA, 25 bp, Mus musculus
cagtagcaactctggatgggatcag

SEQ ID NO: 572584 - DNA, 25 bp, Mus musculus
cagtagcactgtaacgccctgacgg

SEQ ID NO: 572585 - DNA, 25 bp, Mus musculus
cagtagcactgttacgccctgacgg

SEQ ID NO: 572586 - DNA, 25 bp, Mus musculus
cagtagcaggcaattctcattgaac

SEQ ID NO: 572587 - DNA, 25 bp, Mus musculus
cagtagcaggcatttctcattgaac

SEQ ID NO: 572588 - DNA, 25 bp, Mus musculus
cagtagcaggctctaactgagacag

SEQ ID NO: 572589 - DNA, 25 bp, Mus musculus
cagtagcaggctgtaactgagacag

SEQ ID NO: 572590 - DNA, 25 bp, Mus musculus
cagtagcatatgaatttatgtccca

SEQ ID NO: 572591 - DNA, 25 bp, Mus musculus
cagtagcatatgtatttatgtccca

SEQ ID NO: 572592 - DNA, 25 bp, Mus musculus
cagtagcatcagataactgggatca

SEQ ID NO: 572593 - DNA, 25 bp, Mus musculus
cagtagcatcagttaactgggatca

SEQ ID NO: 572594 - DNA, 25 bp, Mus musculus
cagtagcattggaggctgccagacc

SEQ ID NO: 572595 - DNA, 25 bp, Mus musculus
cagtagcattggtggctgccagacc

SEQ ID NO: 572596 - DNA, 25 bp, Mus musculus
cagtagccaagtaggccgagatgca

SEQ ID NO: 572597 - DNA, 25 bp, Mus musculus
cagtagccaagttggccgagatgca

SEQ ID NO: 572598 - DNA, 25 bp, Mus musculus
cagtagccagttaatgttaagttgg

SEQ ID NO: 572599 - DNA, 25 bp, Mus musculus
cagtagccagtttatgttaagttgg

SEQ ID NO: 572600 - DNA, 25 bp, Mus musculus
cagtagcccgtcatcaaagtggtca

SEQ ID NO: 572601 - DNA, 25 bp, Mus musculus
cagtagcccgtcttcaaagtggtca

SEQ ID NO: 572602 - DNA, 25 bp, Mus musculus
cagtagccgagacaagcgagagtca

SEQ ID NO: 572603 - DNA, 25 bp, Mus musculus
cagtagccgagagaagcgagagtca

SEQ ID NO: 572604 - DNA, 25 bp, Mus musculus
cagtagcctaggaaagactctctcc

SEQ ID NO: 572605 - DNA, 25 bp, Mus musculus
cagtagcctaggtaagactctctcc

SEQ ID NO: 572606 - DNA, 25 bp, Mus musculus
cagtagcctgatacccttgatggag

SEQ ID NO: 572607 - DNA, 25 bp, Mus musculus
cagtagcctgattcccttgatggag

SEQ ID NO: 572608 - DNA, 25 bp, Mus musculus
cagtagccttcacctcatgtacaac

SEQ ID NO: 572609 - DNA, 25 bp, Mus musculus
cagtagccttcagctcatgtacaac

SEQ ID NO: 572610 - DNA, 25 bp, Mus musculus
cagtagctatgtcctcactgctgaa

SEQ ID NO: 572611 - DNA, 25 bp, Mus musculus
cagtagctatgtgctcactgctgaa

SEQ ID NO: 572612 - DNA, 25 bp, Mus musculus
cagtagctcagacgcgatgtggacc

SEQ ID NO: 572613 - DNA, 25 bp, Mus musculus
cagtagctcagaggcgatgtggacc

SEQ ID NO: 572614 - DNA, 25 bp, Mus musculus
cagtagcttctacggtcttgggcag

SEQ ID NO: 572615 - DNA, 25 bp, Mus musculus
cagtagcttctagggtcttgggcag

SEQ ID NO: 572616 - DNA, 25 bp, Mus musculus
cagtagcttgctacgtgggtcggtc

SEQ ID NO: 572617 - DNA, 25 bp, Mus musculus
cagtagcttgcttcgtgggtcggtc

SEQ ID NO: 572618 - DNA, 25 bp, Mus musculus
cagtagcttgggatggaggtctttc

SEQ ID NO: 572619 - DNA, 25 bp, Mus musculus
cagtagcttgggttggaggtctttc

SEQ ID NO: 572620 - DNA, 25 bp, Mus musculus
cagtaggagcatccagaatctttta

SEQ ID NO: 572621 - DNA, 25 bp, Mus musculus
cagtaggagcatgcagaatctttta

SEQ ID NO: 572622 - DNA, 25 bp, Mus musculus
cagtaggagctccagtctggcgatc

SEQ ID NO: 572623 - DNA, 25 bp, Mus musculus
cagtaggagctcgagtctggcgatc

SEQ ID NO: 572624 - DNA, 25 bp, Mus musculus
cagtaggaggatacggattaagcat

SEQ ID NO: 572625 - DNA, 25 bp, Mus musculus
cagtaggaggattcggattaagcat

SEQ ID NO: 572626 - DNA, 25 bp, Mus musculus
cagtaggccttgatagaagtcctcc

SEQ ID NO: 572627 - DNA, 25 bp, Mus musculus
cagtaggccttgttagaagtcctcc

SEQ ID NO: 572628 - DNA, 25 bp, Mus musculus
cagtaggtaacaactgtaacgcttc

SEQ ID NO: 572629 - DNA, 25 bp, Mus musculus
cagtaggtaacatctgtaacgcttc

SEQ ID NO: 572630 - DNA, 25 bp, Mus musculus
cagtaggtagagcatttagaccgca

SEQ ID NO: 572631 - DNA, 25 bp, Mus musculus
cagtaggtagaggatttagaccgca

SEQ ID NO: 572632 - DNA, 25 bp, Mus musculus
cagtagtagattacttcacagtccc

SEQ ID NO: 572633 - DNA, 25 bp, Mus musculus
cagtagtagatttcttcacagtccc

SEQ ID NO: 572634 - DNA, 25 bp, Mus musculus
cagtagtagcagaagagttggagac

SEQ ID NO: 572635 - DNA, 25 bp, Mus musculus
cagtagtagcagtagagttggagac

SEQ ID NO: 572636 - DNA, 25 bp, Mus musculus
cagtagtcacccaggttggaatcat

SEQ ID NO: 572637 - DNA, 25 bp, Mus musculus
cagtagtcaccctggttggaatcat

SEQ ID NO: 572638 - DNA, 25 bp, Mus musculus
cagtagtcaggtcgcgagtctgccc

SEQ ID NO: 572639 - DNA, 25 bp, Mus musculus
cagtagtcaggtggcgagtctgccc

SEQ ID NO: 572640 - DNA, 25 bp, Mus musculus
cagtagtcctctatgatgaggtgga

SEQ ID NO: 572641 - DNA, 25 bp, Mus musculus
cagtagtcctctttgatgaggtgga

SEQ ID NO: 572642 - DNA, 25 bp, Mus musculus
cagtagtctgtcctcaggcttctga

SEQ ID NO: 572643 - DNA, 25 bp, Mus musculus
cagtagtctgtcgtcaggcttctga

SEQ ID NO: 572644 - DNA, 25 bp, Mus musculus
cagtagtgagcaccttgaatgtcct

SEQ ID NO: 572645 - DNA, 25 bp, Mus musculus
cagtagtgagcagcttgaatgtcct

SEQ ID NO: 572646 - DNA, 25 bp, Mus musculus
cagtagtgatgtcaacagtgatggc

SEQ ID NO: 572647 - DNA, 25 bp, Mus musculus
cagtagtgatgtgaacagtgatggc

SEQ ID NO: 572648 - DNA, 25 bp, Mus musculus
cagtagtgccagacgctttcaggtc

SEQ ID NO: 572649 - DNA, 25 bp, Mus musculus
cagtagtgccagtcgctttcaggtc

SEQ ID NO: 572650 - DNA, 25 bp, Mus musculus
cagtagtggcctctccatgaaagcc

SEQ ID NO: 572651 - DNA, 25 bp, Mus musculus
cagtagtggcctgtccatgaaagcc

SEQ ID NO: 572652 - DNA, 25 bp, Mus musculus
cagtagttacctagcaagattgtct

SEQ ID NO: 572653 - DNA, 25 bp, Mus musculus
cagtagttaccttgcaagattgtct

SEQ ID NO: 572654 - DNA, 25 bp, Mus musculus
cagtagttcagtatagtgacccata

SEQ ID NO: 572655 - DNA, 25 bp, Mus musculus
cagtagttcagtttagtgacccata

SEQ ID NO: 572656 - DNA, 25 bp, Mus musculus
cagtagttggaaattttggtgaagc

SEQ ID NO: 572657 - DNA, 25 bp, Mus musculus
cagtagttggaatttttggtgaagc

SEQ ID NO: 572658 - DNA, 25 bp, Mus musculus
cagtagtttgccaactggaagttct

SEQ ID NO: 572659 - DNA, 25 bp, Mus musculus
cagtagtttgcctactggaagttct

SEQ ID NO: 572660 - DNA, 25 bp, Mus musculus
cagtataaaaagagccgtattcctt

SEQ ID NO: 572661 - DNA, 25 bp, Mus musculus
cagtataaaaagtgccgtattcctt

SEQ ID NO: 572662 - DNA, 25 bp, Mus musculus
cagtataaactacattgatgtgact

SEQ ID NO: 572663 - DNA, 25 bp, Mus musculus
cagtataaactagattgatgtgact

SEQ ID NO: 572664 - DNA, 25 bp, Mus musculus
cagtataatgggaaacttagagttt

SEQ ID NO: 572665 - DNA, 25 bp, Mus musculus
cagtataatgggtaacttagagttt

SEQ ID NO: 572666 - DNA, 25 bp, Mus musculus
cagtatacgttaataattcaagcca

SEQ ID NO: 572667 - DNA, 25 bp, Mus musculus
cagtatacgttattaattcaagcca

SEQ ID NO: 572668 - DNA, 25 bp, Mus musculus
cagtatagcagtcggcctggtcagc

SEQ ID NO: 572669 - DNA, 25 bp, Mus musculus
cagtatagcagtgggcctggtcagc

SEQ ID NO: 572670 - DNA, 25 bp, Mus musculus
cagtatatcattatggttaatctcc

SEQ ID NO: 572671 - DNA, 25 bp, Mus musculus
cagtatatcattttggttaatctcc

SEQ ID NO: 572672 - DNA, 25 bp, Mus musculus
cagtatatcctcagaccttacatct

SEQ ID NO: 572673 - DNA, 25 bp, Mus musculus
cagtatatcctctgaccttacatct

SEQ ID NO: 572674 - DNA, 25 bp, Mus musculus
cagtatatgaaactgatcagctctt

SEQ ID NO: 572675 - DNA, 25 bp, Mus musculus
cagtatatgaaagtgatcagctctt

SEQ ID NO: 572676 - DNA, 25 bp, Mus musculus
cagtatatgactacgagcaggaggg

SEQ ID NO: 572677 - DNA, 25 bp, Mus musculus
cagtatatgacttcgagcaggaggg

SEQ ID NO: 572678 - DNA, 25 bp, Mus musculus
cagtatatggcaaatgggtggcaag

SEQ ID NO: 572679 - DNA, 25 bp, Mus musculus
cagtatatggcatatgggtggcaag

SEQ ID NO: 572680 - DNA, 25 bp, Mus musculus
cagtatatttctcagtgctgcttgc

SEQ ID NO: 572681 - DNA, 25 bp, Mus musculus
cagtatatttctgagtgctgcttgc

SEQ ID NO: 572682 - DNA, 25 bp, Mus musculus
cagtatcaacgcaatggcagctgta

SEQ ID NO: 572683 - DNA, 25 bp, Mus musculus
cagtatcaacgctatggcagctgta

SEQ ID NO: 572684 - DNA, 25 bp, Mus musculus
cagtatcacagcatcgaagaagatg

SEQ ID NO: 572685 - DNA, 25 bp, Mus musculus
cagtatcacagcttcgaagaagatg

SEQ ID NO: 572686 - DNA, 25 bp, Mus musculus
cagtatcacatcattctggcccagc

SEQ ID NO: 572687 - DNA, 25 bp, Mus musculus
cagtatcacatctttctggcccagc

SEQ ID NO: 572688 - DNA, 25 bp, Mus musculus
cagtatcagatacgacacagcagcc

SEQ ID NO: 572689 - DNA, 25 bp, Mus musculus
cagtatcagataggacacagcagcc

SEQ ID NO: 572690 - DNA, 25 bp, Mus musculus
cagtatcatctgcattgatcctgat

SEQ ID NO: 572691 - DNA, 25 bp, Mus musculus
cagtatcatctggattgatcctgat

SEQ ID NO: 572692 - DNA, 25 bp, Mus musculus
cagtatcatgtcaatgtgagtctgg

SEQ ID NO: 572693 - DNA, 25 bp, Mus musculus
cagtatcatgtctatgtgagtctgg

SEQ ID NO: 572694 - DNA, 25 bp, Mus musculus
cagtatccaacacttgccttttgcc

SEQ ID NO: 572695 - DNA, 25 bp, Mus musculus
cagtatccaacagttgccttttgcc

SEQ ID NO: 572696 - DNA, 25 bp, Mus musculus
cagtatccagagattacccggaaga

SEQ ID NO: 572697 - DNA, 25 bp, Mus musculus
cagtatccagagtttacccggaaga

SEQ ID NO: 572698 - DNA, 25 bp, Mus musculus
cagtatccagttctccgtcaaaaag

SEQ ID NO: 572699 - DNA, 25 bp, Mus musculus
cagtatccagttgtccgtcaaaaag

SEQ ID NO: 572700 - DNA, 25 bp, Mus musculus
cagtatccccagaagtgagtcggca

SEQ ID NO: 572701 - DNA, 25 bp, Mus musculus
cagtatccccagtagtgagtcggca

SEQ ID NO: 572702 - DNA, 25 bp, Mus musculus
cagtatccctatctatggcatgagg

SEQ ID NO: 572703 - DNA, 25 bp, Mus musculus
cagtatccctatgtatggcatgagg

SEQ ID NO: 572704 - DNA, 25 bp, Mus musculus
cagtatcgctatcgtagcggcgtcc

SEQ ID NO: 572705 - DNA, 25 bp, Mus musculus
cagtatcgctatggtagcggcgtcc

SEQ ID NO: 572706 - DNA, 25 bp, Mus musculus
cagtatcggagccattgactctagg

SEQ ID NO: 572707 - DNA, 25 bp, Mus musculus
cagtatcggagcgattgactctagg

SEQ ID NO: 572708 - DNA, 25 bp, Mus musculus
cagtatcgttggatcgtgctggact

SEQ ID NO: 572709 - DNA, 25 bp, Mus musculus
cagtatcgttggttcgtgctggact

SEQ ID NO: 572710 - DNA, 25 bp, Mus musculus
cagtatctaaaaagagccctccttg

SEQ ID NO: 572711 - DNA, 25 bp, Mus musculus
cagtatctaaaatgagccctccttg

SEQ ID NO: 572712 - DNA, 25 bp, Mus musculus
cagtatctgtttaccggagtatgac

SEQ ID NO: 572713 - DNA, 25 bp, Mus musculus
cagtatctgttttccggagtatgac

SEQ ID NO: 572714 - DNA, 25 bp, Mus musculus
cagtatctttgtaaagaactgtgta

SEQ ID NO: 572715 - DNA, 25 bp, Mus musculus
cagtatctttgttaagaactgtgta

SEQ ID NO: 572716 - DNA, 25 bp, Mus musculus
cagtatgacctccactattggctgg

SEQ ID NO: 572717 - DNA, 25 bp, Mus musculus
cagtatgacctcgactattggctgg

SEQ ID NO: 572718 - DNA, 25 bp, Mus musculus
cagtatgacgagagccatgtgatca

SEQ ID NO: 572719 - DNA, 25 bp, Mus musculus
cagtatgacgagtgccatgtgatca

SEQ ID NO: 572720 - DNA, 25 bp, Mus musculus
cagtatgacggcagtgaggattcag

SEQ ID NO: 572721 - DNA, 25 bp, Mus musculus
cagtatgacggctgtgaggattcag

SEQ ID NO: 572722 - DNA, 25 bp, Mus musculus
cagtatgactgtcgcatgaagctgg

SEQ ID NO: 572723 - DNA, 25 bp, Mus musculus
cagtatgactgtggcatgaagctgg

SEQ ID NO: 572724 - DNA, 25 bp, Mus musculus
cagtatgagatgctgtaaagagaag

SEQ ID NO: 572725 - DNA, 25 bp, Mus musculus
cagtatgagatggtgtaaagagaag

SEQ ID NO: 572726 - DNA, 25 bp, Mus musculus
cagtatgatagcaacacctggtacc

SEQ ID NO: 572727 - DNA, 25 bp, Mus musculus
cagtatgatagctacacctggtacc

SEQ ID NO: 572728 - DNA, 25 bp, Mus musculus
cagtatgatgaaccagtagcacagt

SEQ ID NO: 572729 - DNA, 25 bp, Mus musculus
cagtatgatgaagcagtagcacagt

SEQ ID NO: 572730 - DNA, 25 bp, Mus musculus
cagtatgcacttcttggtagcagaa

SEQ ID NO: 572731 - DNA, 25 bp, Mus musculus
cagtatgcacttgttggtagcagaa

SEQ ID NO: 572732 - DNA, 25 bp, Mus musculus
cagtatgcagatcccctggagcacc

SEQ ID NO: 572733 - DNA, 25 bp, Mus musculus
cagtatgcagatgccctggagcacc

SEQ ID NO: 572734 - DNA, 25 bp, Mus musculus
cagtatgcattaccagcagctcagc

SEQ ID NO: 572735 - DNA, 25 bp, Mus musculus
cagtatgcattagcagcagctcagc

SEQ ID NO: 572736 - DNA, 25 bp, Mus musculus
cagtatgctataaagaacatcttca

SEQ ID NO: 572737 - DNA, 25 bp, Mus musculus
cagtatgctatatagaacatcttca

SEQ ID NO: 572738 - DNA, 25 bp, Mus musculus
cagtatgctggcaaaaggactttcc

SEQ ID NO: 572739 - DNA, 25 bp, Mus musculus
cagtatgctggctaaaggactttcc

SEQ ID NO: 572740 - DNA, 25 bp, Mus musculus
cagtatggacagaatatggcaaatg

SEQ ID NO: 572741 - DNA, 25 bp, Mus musculus
cagtatggacagtatatggcaaatg

SEQ ID NO: 572742 - DNA, 25 bp, Mus musculus
cagtatggacctcgaaaccaaaatg

SEQ ID NO: 572743 - DNA, 25 bp, Mus musculus
cagtatggacctggaaaccaaaatg

SEQ ID NO: 572744 - DNA, 25 bp, Mus musculus
cagtatggaggaacagttggtaccg

SEQ ID NO: 572745 - DNA, 25 bp, Mus musculus
cagtatggaggatcagttggtaccg

SEQ ID NO: 572746 - DNA, 25 bp, Mus musculus
cagtatggattcagcgaggctgaca

SEQ ID NO: 572747 - DNA, 25 bp, Mus musculus
cagtatggattctgcgaggctgaca

SEQ ID NO: 572748 - DNA, 25 bp, Mus musculus
cagtatggcaataatgttattcagc

SEQ ID NO: 572749 - DNA, 25 bp, Mus musculus
cagtatggcaattatgttattcagc

SEQ ID NO: 572750 - DNA, 25 bp, Mus musculus
cagtatggcggcacggcagaccctg

SEQ ID NO: 572751 - DNA, 25 bp, Mus musculus
cagtatggcggctcggcagaccctg

SEQ ID NO: 572752 - DNA, 25 bp, Mus musculus
cagtatggcttaacttctttgtgct

SEQ ID NO: 572753 - DNA, 25 bp, Mus musculus
cagtatggcttatcttctttgtgct

SEQ ID NO: 572754 - DNA, 25 bp, Mus musculus
cagtatgggctgatgaacaatttcc

SEQ ID NO: 572755 - DNA, 25 bp, Mus musculus
cagtatgggctgttgaacaatttcc

SEQ ID NO: 572756 - DNA, 25 bp, Mus musculus
cagtatgggtggctacacggacatc

SEQ ID NO: 572757 - DNA, 25 bp, Mus musculus
cagtatgggtgggtacacggacatc

SEQ ID NO: 572758 - DNA, 25 bp, Mus musculus
cagtatgtccccagaattgtgtttg

SEQ ID NO: 572759 - DNA, 25 bp, Mus musculus
cagtatgtcccctgaattgtgtttg

SEQ ID NO: 572760 - DNA, 25 bp, Mus musculus
cagtatgtgcgtctggattgtaaga

SEQ ID NO: 572761 - DNA, 25 bp, Mus musculus
cagtatgtgcgtgtggattgtaaga

SEQ ID NO: 572762 - DNA, 25 bp, Mus musculus
cagtatgtggtacctccagggacca

SEQ ID NO: 572763 - DNA, 25 bp, Mus musculus
cagtatgtggtagctccagggacca

SEQ ID NO: 572764 - DNA, 25 bp, Mus musculus
cagtatgtggtgaacttggattctt

SEQ ID NO: 572765 - DNA, 25 bp, Mus musculus
cagtatgtggtgtacttggattctt

SEQ ID NO: 572766 - DNA, 25 bp, Mus musculus
cagtatgtgtacaacctggtcccca

SEQ ID NO: 572767 - DNA, 25 bp, Mus musculus
cagtatgtgtactacctggtcccca

SEQ ID NO: 572768 - DNA, 25 bp, Mus musculus
cagtatgttcctcgcaatggcttca

SEQ ID NO: 572769 - DNA, 25 bp, Mus musculus
cagtatgttcctggcaatggcttca

SEQ ID NO: 572770 - DNA, 25 bp, Mus musculus
cagtattactgtccacaagcatcca

SEQ ID NO: 572771 - DNA, 25 bp, Mus musculus
cagtattactgtgcacaagcatcca

SEQ ID NO: 572772 - DNA, 25 bp, Mus musculus
cagtattagagcatttcatccaagg

SEQ ID NO: 572773 - DNA, 25 bp, Mus musculus
cagtattagagcttttcatccaagg

SEQ ID NO: 572774 - DNA, 25 bp, Mus musculus
cagtattagcatctccgtggagatg

SEQ ID NO: 572775 - DNA, 25 bp, Mus musculus
cagtattagcatgtccgtggagatg

SEQ ID NO: 572776 - DNA, 25 bp, Mus musculus
cagtattagtgcctcgtcacaatga

SEQ ID NO: 572777 - DNA, 25 bp, Mus musculus
cagtattagtgcgtcgtcacaatga

SEQ ID NO: 572778 - DNA, 25 bp, Mus musculus
cagtattatctaacatcgccagaat

SEQ ID NO: 572779 - DNA, 25 bp, Mus musculus
cagtattatctatcatcgccagaat

SEQ ID NO: 572780 - DNA, 25 bp, Mus musculus
cagtattattcaaaaagaacagctc

SEQ ID NO: 572781 - DNA, 25 bp, Mus musculus
cagtattattcataaagaacagctc

SEQ ID NO: 572782 - DNA, 25 bp, Mus musculus
cagtattcacggcacgaaagcatga

SEQ ID NO: 572783 - DNA, 25 bp, Mus musculus
cagtattcacgggacgaaagcatga

SEQ ID NO: 572784 - DNA, 25 bp, Mus musculus
cagtattcatgtaaatggtggcaga

SEQ ID NO: 572785 - DNA, 25 bp, Mus musculus
cagtattcatgttaatggtggcaga

SEQ ID NO: 572786 - DNA, 25 bp, Mus musculus
cagtattcctgtaatatatgaacgg

SEQ ID NO: 572787 - DNA, 25 bp, Mus musculus
cagtattcctgttatatatgaacgg

SEQ ID NO: 572788 - DNA, 25 bp, Mus musculus
cagtattctatacattgttcgtagt

SEQ ID NO: 572789 - DNA, 25 bp, Mus musculus
cagtattctatagattgttcgtagt

SEQ ID NO: 572790 - DNA, 25 bp, Mus musculus
cagtattctcccctcgaggaggacc

SEQ ID NO: 572791 - DNA, 25 bp, Mus musculus
cagtattctcccgtcgaggaggacc

SEQ ID NO: 572792 - DNA, 25 bp, Mus musculus
cagtattctggtactagaaagccag

SEQ ID NO: 572793 - DNA, 25 bp, Mus musculus
cagtattctggttctagaaagccag

SEQ ID NO: 572794 - DNA, 25 bp, Mus musculus
cagtattgaccaagacacagaagat

SEQ ID NO: 572795 - DNA, 25 bp, Mus musculus
cagtattgaccatgacacagaagat

SEQ ID NO: 572796 - DNA, 25 bp, Mus musculus
cagtattgcaacatcaaggtggtgg

SEQ ID NO: 572797 - DNA, 25 bp, Mus musculus
cagtattgcaacttcaaggtggtgg

SEQ ID NO: 572798 - DNA, 25 bp, Mus musculus
cagtattgccaccaaaaacggattg

SEQ ID NO: 572799 - DNA, 25 bp, Mus musculus
cagtattgccacgaaaaacggattg

SEQ ID NO: 572800 - DNA, 25 bp, Mus musculus
cagtattggcatctatgtcagggtg

SEQ ID NO: 572801 - DNA, 25 bp, Mus musculus
cagtattggcatgtatgtcagggtg

SEQ ID NO: 572802 - DNA, 25 bp, Mus musculus
cagtatttacttcagccattccgag

SEQ ID NO: 572803 - DNA, 25 bp, Mus musculus
cagtatttacttgagccattccgag

SEQ ID NO: 572804 - DNA, 25 bp, Mus musculus
cagtatttcctgctgctgtagctaa

SEQ ID NO: 572805 - DNA, 25 bp, Mus musculus
cagtatttcctggtgctgtagctaa

SEQ ID NO: 572806 - DNA, 25 bp, Mus musculus
cagtatttgctgatgttctctgcag

SEQ ID NO: 572807 - DNA, 25 bp, Mus musculus
cagtatttgctgttgttctctgcag

SEQ ID NO: 572808 - DNA, 25 bp, Mus musculus
cagtattttagaaacttacttggga

SEQ ID NO: 572809 - DNA, 25 bp, Mus musculus
cagtattttagatacttacttggga

SEQ ID NO: 572810 - DNA, 25 bp, Mus musculus
cagtcaaagaagcttggcacgtaca

SEQ ID NO: 572811 - DNA, 25 bp, Mus musculus
cagtcaaagaaggttggcacgtaca

SEQ ID NO: 572812 - DNA, 25 bp, Mus musculus
cagtcaaagtagagcacgatcgtct

SEQ ID NO: 572813 - DNA, 25 bp, Mus musculus
cagtcaaagtagtgcacgatcgtct

SEQ ID NO: 572814 - DNA, 25 bp, Mus musculus
cagtcaacaattatggcgtgaagca

SEQ ID NO: 572815 - DNA, 25 bp, Mus musculus
cagtcaacaattttggcgtgaagca

SEQ ID NO: 572816 - DNA, 25 bp, Mus musculus
cagtcaacacgtaattatccacagg

SEQ ID NO: 572817 - DNA, 25 bp, Mus musculus
cagtcaacacgttattatccacagg

SEQ ID NO: 572818 - DNA, 25 bp, Mus musculus
cagtcaacctcaagaagtggagttt

SEQ ID NO: 572819 - DNA, 25 bp, Mus musculus
cagtcaacctcatgaagtggagttt

SEQ ID NO: 572820 - DNA, 25 bp, Mus musculus
cagtcaacgctgaagagtgcactac

SEQ ID NO: 572821 - DNA, 25 bp, Mus musculus
cagtcaacgctgtagagtgcactac

SEQ ID NO: 572822 - DNA, 25 bp, Mus musculus
cagtcaactcagcttatggcagcaa

SEQ ID NO: 572823 - DNA, 25 bp, Mus musculus
cagtcaactcaggttatggcagcaa

SEQ ID NO: 572824 - DNA, 25 bp, Mus musculus
cagtcaactctgagacagtcaatcc

SEQ ID NO: 572825 - DNA, 25 bp, Mus musculus
cagtcaactctgtgacagtcaatcc

SEQ ID NO: 572826 - DNA, 25 bp, Mus musculus
cagtcaagagttccgacgactgatc

SEQ ID NO: 572827 - DNA, 25 bp, Mus musculus
cagtcaagagttgcgacgactgatc

SEQ ID NO: 572828 - DNA, 25 bp, Mus musculus
cagtcaagcccaccttttggagacc

SEQ ID NO: 572829 - DNA, 25 bp, Mus musculus
cagtcaagcccagcttttggagacc

SEQ ID NO: 572830 - DNA, 25 bp, Mus musculus
cagtcaaggtggcacctgctttttg

SEQ ID NO: 572831 - DNA, 25 bp, Mus musculus
cagtcaaggtgggacctgctttttg

SEQ ID NO: 572832 - DNA, 25 bp, Mus musculus
cagtcaagtccccttggcactgcag

SEQ ID NO: 572833 - DNA, 25 bp, Mus musculus
cagtcaagtcccgttggcactgcag

SEQ ID NO: 572834 - DNA, 25 bp, Mus musculus
cagtcaagtgcaacaagaatgacgc

SEQ ID NO: 572835 - DNA, 25 bp, Mus musculus
cagtcaagtgcatcaagaatgacgc

SEQ ID NO: 572836 - DNA, 25 bp, Mus musculus
cagtcaagtgttaaagctgtacact

SEQ ID NO: 572837 - DNA, 25 bp, Mus musculus
cagtcaagtgtttaagctgtacact

SEQ ID NO: 572838 - DNA, 25 bp, Mus musculus
cagtcaagttaaagtgcctttcatc

SEQ ID NO: 572839 - DNA, 25 bp, Mus musculus
cagtcaagttaatgtgcctttcatc

SEQ ID NO: 572840 - DNA, 25 bp, Mus musculus
cagtcaagttctcggcaaagcagca

SEQ ID NO: 572841 - DNA, 25 bp, Mus musculus
cagtcaagttctgggcaaagcagca

SEQ ID NO: 572842 - DNA, 25 bp, Mus musculus
cagtcaagttgcatttgaaaaagca

SEQ ID NO: 572843 - DNA, 25 bp, Mus musculus
cagtcaagttgcttttgaaaaagca

SEQ ID NO: 572844 - DNA, 25 bp, Mus musculus
cagtcaatgacactggagaatatcg

SEQ ID NO: 572845 - DNA, 25 bp, Mus musculus
cagtcaatgacagtggagaatatcg

SEQ ID NO: 572846 - DNA, 25 bp, Mus musculus
cagtcaatggagacacttggcccct

SEQ ID NO: 572847 - DNA, 25 bp, Mus musculus
cagtcaatggagtcacttggcccct

SEQ ID NO: 572848 - DNA, 25 bp, Mus musculus
cagtcaattgtgaactagcatttca

SEQ ID NO: 572849 - DNA, 25 bp, Mus musculus
cagtcaattgtgtactagcatttca

SEQ ID NO: 572850 - DNA, 25 bp, Mus musculus
cagtcacaactgctatctcgtggag

SEQ ID NO: 572851 - DNA, 25 bp, Mus musculus
cagtcacaactggtatctcgtggag

SEQ ID NO: 572852 - DNA, 25 bp, Mus musculus
cagtcacaagcacagcactaaggct

SEQ ID NO: 572853 - DNA, 25 bp, Mus musculus
cagtcacaagcagagcactaaggct

SEQ ID NO: 572854 - DNA, 25 bp, Mus musculus
cagtcacaaggcacatcaagatggt

SEQ ID NO: 572855 - DNA, 25 bp, Mus musculus
cagtcacaaggctcatcaagatggt

SEQ ID NO: 572856 - DNA, 25 bp, Mus musculus
cagtcacacaaaacatgaagaatcc

SEQ ID NO: 572857 - DNA, 25 bp, Mus musculus
cagtcacacaaatcatgaagaatcc

SEQ ID NO: 572858 - DNA, 25 bp, Mus musculus
cagtcacacctgatgccagcgtgta

SEQ ID NO: 572859 - DNA, 25 bp, Mus musculus
cagtcacacctgttgccagcgtgta

SEQ ID NO: 572860 - DNA, 25 bp, Mus musculus
cagtcacagagcatctcatcgtggt

SEQ ID NO: 572861 - DNA, 25 bp, Mus musculus
cagtcacagagcttctcatcgtggt

SEQ ID NO: 572862 - DNA, 25 bp, Mus musculus
cagtcacagccaagggatgtccttg

SEQ ID NO: 572863 - DNA, 25 bp, Mus musculus
cagtcacagccatgggatgtccttg

SEQ ID NO: 572864 - DNA, 25 bp, Mus musculus
cagtcacatgcacgcggagttgagc

SEQ ID NO: 572865 - DNA, 25 bp, Mus musculus
cagtcacatgcaggcggagttgagc

SEQ ID NO: 572866 - DNA, 25 bp, Mus musculus
cagtcacccattacattgctgtcta

SEQ ID NO: 572867 - DNA, 25 bp, Mus musculus
cagtcacccatttcattgctgtcta

SEQ ID NO: 572868 - DNA, 25 bp, Mus musculus
cagtcacccggacatgggagcttat

SEQ ID NO: 572869 - DNA, 25 bp, Mus musculus
cagtcacccggagatgggagcttat

SEQ ID NO: 572870 - DNA, 25 bp, Mus musculus
cagtcacctgtgatgcagcccatga

SEQ ID NO: 572871 - DNA, 25 bp, Mus musculus
cagtcacctgtgttgcagcccatga

SEQ ID NO: 572872 - DNA, 25 bp, Mus musculus
cagtcaccttttcatttgacgtggg

SEQ ID NO: 572873 - DNA, 25 bp, Mus musculus
cagtcaccttttgatttgacgtggg

SEQ ID NO: 572874 - DNA, 25 bp, Mus musculus
cagtcacggactaggatcatttaaa

SEQ ID NO: 572875 - DNA, 25 bp, Mus musculus
cagtcacggacttggatcatttaaa

SEQ ID NO: 572876 - DNA, 25 bp, Mus musculus
cagtcacggtccaggattcgcaagg

SEQ ID NO: 572877 - DNA, 25 bp, Mus musculus
cagtcacggtcctggattcgcaagg

SEQ ID NO: 572878 - DNA, 25 bp, Mus musculus
cagtcactaaggagctgttgttaac

SEQ ID NO: 572879 - DNA, 25 bp, Mus musculus
cagtcactaaggtgctgttgttaac

SEQ ID NO: 572880 - DNA, 25 bp, Mus musculus
cagtcactacggctgcaatgcagaa

SEQ ID NO: 572881 - DNA, 25 bp, Mus musculus
cagtcactacgggtgcaatgcagaa

SEQ ID NO: 572882 - DNA, 25 bp, Mus musculus
cagtcactcgtgacctgaggtgtga

SEQ ID NO: 572883 - DNA, 25 bp, Mus musculus
cagtcactcgtgtcctgaggtgtga

SEQ ID NO: 572884 - DNA, 25 bp, Mus musculus
cagtcactgccaagcagcatggagt

SEQ ID NO: 572885 - DNA, 25 bp, Mus musculus
cagtcactgccatgcagcatggagt

SEQ ID NO: 572886 - DNA, 25 bp, Mus musculus
cagtcactgcgtaagaagggaagaa

SEQ ID NO: 572887 - DNA, 25 bp, Mus musculus
cagtcactgcgttagaagggaagaa

SEQ ID NO: 572888 - DNA, 25 bp, Mus musculus
cagtcactggaaagctacctcaggc

SEQ ID NO: 572889 - DNA, 25 bp, Mus musculus
cagtcactggaatgctacctcaggc

SEQ ID NO: 572890 - DNA, 25 bp, Mus musculus
cagtcactgtacaaagagtggatca

SEQ ID NO: 572891 - DNA, 25 bp, Mus musculus
cagtcactgtactaagagtggatca

SEQ ID NO: 572892 - DNA, 25 bp, Mus musculus
cagtcactgtttcggctatggtcgt

SEQ ID NO: 572893 - DNA, 25 bp, Mus musculus
cagtcactgtttgggctatggtcgt

SEQ ID NO: 572894 - DNA, 25 bp, Mus musculus
cagtcagaacggcaaggacaacccg

SEQ ID NO: 572895 - DNA, 25 bp, Mus musculus
cagtcagaacgggaaggacaacccg

SEQ ID NO: 572896 - DNA, 25 bp, Mus musculus
cagtcagaagaaaaagacttcacaa

SEQ ID NO: 572897 - DNA, 25 bp, Mus musculus
cagtcagaagaataagacttcacaa

SEQ ID NO: 572898 - DNA, 25 bp, Mus musculus
cagtcagaagaccttggaaatgacc

SEQ ID NO: 572899 - DNA, 25 bp, Mus musculus
cagtcagaagacgttggaaatgacc

SEQ ID NO: 572900 - DNA, 25 bp, Mus musculus
cagtcagaagccagtagacagtggt

SEQ ID NO: 572901 - DNA, 25 bp, Mus musculus
cagtcagaagcctgtagacagtggt

SEQ ID NO: 572902 - DNA, 25 bp, Mus musculus
cagtcagactatagaacagatggtt

SEQ ID NO: 572903 - DNA, 25 bp, Mus musculus
cagtcagactattgaacagatggtt

SEQ ID NO: 572904 - DNA, 25 bp, Mus musculus
cagtcagagatccatacgtacttca

SEQ ID NO: 572905 - DNA, 25 bp, Mus musculus
cagtcagagatcgatacgtacttca

SEQ ID NO: 572906 - DNA, 25 bp, Mus musculus
cagtcagatcaaatgctccgagggc

SEQ ID NO: 572907 - DNA, 25 bp, Mus musculus
cagtcagatcaattgctccgagggc

SEQ ID NO: 572908 - DNA, 25 bp, Mus musculus
cagtcagatcgcatggatatcgtcc

SEQ ID NO: 572909 - DNA, 25 bp, Mus musculus
cagtcagatcgcttggatatcgtcc

SEQ ID NO: 572910 - DNA, 25 bp, Mus musculus
cagtcagcagcaccgggtcatcggc

SEQ ID NO: 572911 - DNA, 25 bp, Mus musculus
cagtcagcagcagcgggtcatcggc

SEQ ID NO: 572912 - DNA, 25 bp, Mus musculus
cagtcagcatcgaatcccagttcgg

SEQ ID NO: 572913 - DNA, 25 bp, Mus musculus
cagtcagcatcgtatcccagttcgg

SEQ ID NO: 572914 - DNA, 25 bp, Mus musculus
cagtcagcctctcgaaccgtattca

SEQ ID NO: 572915 - DNA, 25 bp, Mus musculus
cagtcagcctctggaaccgtattca

SEQ ID NO: 572916 - DNA, 25 bp, Mus musculus
cagtcagcgaagatcccctgatgga

SEQ ID NO: 572917 - DNA, 25 bp, Mus musculus
cagtcagcgaagttcccctgatgga

SEQ ID NO: 572918 - DNA, 25 bp, Mus musculus
cagtcagctctcaacacctaagtca

SEQ ID NO: 572919 - DNA, 25 bp, Mus musculus
cagtcagctctctacacctaagtca

SEQ ID NO: 572920 - DNA, 25 bp, Mus musculus
cagtcagcttttcatcgctgtgaca

SEQ ID NO: 572921 - DNA, 25 bp, Mus musculus
cagtcagcttttgatcgctgtgaca

SEQ ID NO: 572922 - DNA, 25 bp, Mus musculus
cagtcaggaagaaaaccaagtgtca

SEQ ID NO: 572923 - DNA, 25 bp, Mus musculus
cagtcaggaagataaccaagtgtca

SEQ ID NO: 572924 - DNA, 25 bp, Mus musculus
cagtcaggagacaaacaatgattca

SEQ ID NO: 572925 - DNA, 25 bp, Mus musculus
cagtcaggagactaacaatgattca

SEQ ID NO: 572926 - DNA, 25 bp, Mus musculus
cagtcagggcttcggctaccccaaa

SEQ ID NO: 572927 - DNA, 25 bp, Mus musculus
cagtcagggcttgggctaccccaaa

SEQ ID NO: 572928 - DNA, 25 bp, Mus musculus
cagtcaggtcttccagaacaattac

SEQ ID NO: 572929 - DNA, 25 bp, Mus musculus
cagtcaggtcttgcagaacaattac

SEQ ID NO: 572930 - DNA, 25 bp, Mus musculus
cagtcagtaacaccccggattattg

SEQ ID NO: 572931 - DNA, 25 bp, Mus musculus
cagtcagtaacagcccggattattg

SEQ ID NO: 572932 - DNA, 25 bp, Mus musculus
cagtcagtattaaggagtcttggga

SEQ ID NO: 572933 - DNA, 25 bp, Mus musculus
cagtcagtattatggagtcttggga

SEQ ID NO: 572934 - DNA, 25 bp, Mus musculus
cagtcagtcatgacctttgtgcccg

SEQ ID NO: 572935 - DNA, 25 bp, Mus musculus
cagtcagtcatgtcctttgtgcccg

SEQ ID NO: 572936 - DNA, 25 bp, Mus musculus
cagtcagtgagactcgggtgcccac

SEQ ID NO: 572937 - DNA, 25 bp, Mus musculus
cagtcagtgagagtcgggtgcccac

SEQ ID NO: 572938 - DNA, 25 bp, Mus musculus
cagtcagtgatcaggctgtagccct

SEQ ID NO: 572939 - DNA, 25 bp, Mus musculus
cagtcagtgatctggctgtagccct

SEQ ID NO: 572940 - DNA, 25 bp, Mus musculus
cagtcagtgccacctattttgtcgg

SEQ ID NO: 572941 - DNA, 25 bp, Mus musculus
cagtcagtgccagctattttgtcgg

SEQ ID NO: 572942 - DNA, 25 bp, Mus musculus
cagtcagtgcctccatcaaaacggg

SEQ ID NO: 572943 - DNA, 25 bp, Mus musculus
cagtcagtgcctgcatcaaaacggg

SEQ ID NO: 572944 - DNA, 25 bp, Mus musculus
cagtcagtgggaactacaagaaagg

SEQ ID NO: 572945 - DNA, 25 bp, Mus musculus
cagtcagtgggatctacaagaaagg

SEQ ID NO: 572946 - DNA, 25 bp, Mus musculus
cagtcagtgtcgcttagcggacgct

SEQ ID NO: 572947 - DNA, 25 bp, Mus musculus
cagtcagtgtcggttagcggacgct

SEQ ID NO: 572948 - DNA, 25 bp, Mus musculus
cagtcagtgtctctcgggttgtctc

SEQ ID NO: 572949 - DNA, 25 bp, Mus musculus
cagtcagtgtctgtcgggttgtctc

SEQ ID NO: 572950 - DNA, 25 bp, Mus musculus
cagtcagttgcaagcagagaaaaac

SEQ ID NO: 572951 - DNA, 25 bp, Mus musculus
cagtcagttgcatgcagagaaaaac

SEQ ID NO: 572952 - DNA, 25 bp, Mus musculus
cagtcagtttctcctgtccaggcca

SEQ ID NO: 572953 - DNA, 25 bp, Mus musculus
cagtcagtttctgctgtccaggcca

SEQ ID NO: 572954 - DNA, 25 bp, Mus musculus
cagtcatacgtgcaggtggcctttc

SEQ ID NO: 572955 - DNA, 25 bp, Mus musculus
cagtcatacgtggaggtggcctttc

SEQ ID NO: 572956 - DNA, 25 bp, Mus musculus
cagtcatactgacaaatcattgcca

SEQ ID NO: 572957 - DNA, 25 bp, Mus musculus
cagtcatactgagaaatcattgcca

SEQ ID NO: 572958 - DNA, 25 bp, Mus musculus
cagtcatagccgcagcagctggtcc

SEQ ID NO: 572959 - DNA, 25 bp, Mus musculus
cagtcatagccggagcagctggtcc

SEQ ID NO: 572960 - DNA, 25 bp, Mus musculus
cagtcatcagccagggtggcaactt

SEQ ID NO: 572961 - DNA, 25 bp, Mus musculus
cagtcatcagcctgggtggcaactt

SEQ ID NO: 572962 - DNA, 25 bp, Mus musculus
cagtcatcatgacaataagagagcc

SEQ ID NO: 572963 - DNA, 25 bp, Mus musculus
cagtcatcatgagaataagagagcc

SEQ ID NO: 572964 - DNA, 25 bp, Mus musculus
cagtcatcccttagctgtggaggga

SEQ ID NO: 572965 - DNA, 25 bp, Mus musculus
cagtcatccctttgctgtggaggga

SEQ ID NO: 572966 - DNA, 25 bp, Mus musculus
cagtcatcctgccaaagcatgggac

SEQ ID NO: 572967 - DNA, 25 bp, Mus musculus
cagtcatcctgcgaaagcatgggac

SEQ ID NO: 572968 - DNA, 25 bp, Mus musculus
cagtcatcggacactggatcagctg

SEQ ID NO: 572969 - DNA, 25 bp, Mus musculus
cagtcatcggactctggatcagctg

SEQ ID NO: 572970 - DNA, 25 bp, Mus musculus
cagtcatctttgacagatccaggga

SEQ ID NO: 572971 - DNA, 25 bp, Mus musculus
cagtcatctttgtcagatccaggga

SEQ ID NO: 572972 - DNA, 25 bp, Mus musculus
cagtcatgaaagatggaatggaaaa

SEQ ID NO: 572973 - DNA, 25 bp, Mus musculus
cagtcatgaaagttggaatggaaaa

SEQ ID NO: 572974 - DNA, 25 bp, Mus musculus
cagtcatgaggccagagctgatcat

SEQ ID NO: 572975 - DNA, 25 bp, Mus musculus
cagtcatgaggcgagagctgatcat

SEQ ID NO: 572976 - DNA, 25 bp, Mus musculus
cagtcatggcctcagaatgaagaca

SEQ ID NO: 572977 - DNA, 25 bp, Mus musculus
cagtcatggcctgagaatgaagaca

SEQ ID NO: 572978 - DNA, 25 bp, Mus musculus
cagtcatggcttcggcatatatttc

SEQ ID NO: 572979 - DNA, 25 bp, Mus musculus
cagtcatggcttgggcatatatttc

SEQ ID NO: 572980 - DNA, 25 bp, Mus musculus
cagtcatgtcctcggagcttgtcaa

SEQ ID NO: 572981 - DNA, 25 bp, Mus musculus
cagtcatgtcctgggagcttgtcaa

SEQ ID NO: 572982 - DNA, 25 bp, Mus musculus
cagtcatgtggtagatgctgaggtt

SEQ ID NO: 572983 - DNA, 25 bp, Mus musculus
cagtcatgtggttgatgctgaggtt

SEQ ID NO: 572984 - DNA, 25 bp, Mus musculus
cagtcattaaacacggaatcggtcc

SEQ ID NO: 572985 - DNA, 25 bp, Mus musculus
cagtcattaaactcggaatcggtcc

SEQ ID NO: 572986 - DNA, 25 bp, Mus musculus
cagtcattccagatgaaaagatgcc

SEQ ID NO: 572987 - DNA, 25 bp, Mus musculus
cagtcattccagttgaaaagatgcc

SEQ ID NO: 572988 - DNA, 25 bp, Mus musculus
cagtccaaccccaaattcctttgtg

SEQ ID NO: 572989 - DNA, 25 bp, Mus musculus
cagtccaacccctaattcctttgtg

SEQ ID NO: 572990 - DNA, 25 bp, Mus musculus
cagtccaacctgacagacatgcggt

SEQ ID NO: 572991 - DNA, 25 bp, Mus musculus
cagtccaacctgtcagacatgcggt

SEQ ID NO: 572992 - DNA, 25 bp, Mus musculus
cagtccaacgtcaggaggatgcata

SEQ ID NO: 572993 - DNA, 25 bp, Mus musculus
cagtccaacgtctggaggatgcata

SEQ ID NO: 572994 - DNA, 25 bp, Mus musculus
cagtccaaggcactgactgcctgac

SEQ ID NO: 572995 - DNA, 25 bp, Mus musculus
cagtccaaggcagtgactgcctgac

SEQ ID NO: 572996 - DNA, 25 bp, Mus musculus
cagtccaagtataaggtgaacttca

SEQ ID NO: 572997 - DNA, 25 bp, Mus musculus
cagtccaagtattaggtgaacttca

SEQ ID NO: 572998 - DNA, 25 bp, Mus musculus
cagtccaagtgtcgctcgaaggata

SEQ ID NO: 572999 - DNA, 25 bp, Mus musculus
cagtccaagtgtggctcgaaggata

SEQ ID NO: 573000 - DNA, 25 bp, Mus musculus
cagtccacaagtaggtgatgcctac

SEQ ID NO: 573001 - DNA, 25 bp, Mus musculus
cagtccacaagttggtgatgcctac

SEQ ID NO: 573002 - DNA, 25 bp, Mus musculus
cagtccaccggacagttcctgcaag

SEQ ID NO: 573003 - DNA, 25 bp, Mus musculus
cagtccaccggagagttcctgcaag

SEQ ID NO: 573004 - DNA, 25 bp, Mus musculus
cagtccaccttcacaggatttggct

SEQ ID NO: 573005 - DNA, 25 bp, Mus musculus
cagtccaccttctcaggatttggct

SEQ ID NO: 573006 - DNA, 25 bp, Mus musculus
cagtccactgtgaaagccaccaagg

SEQ ID NO: 573007 - DNA, 25 bp, Mus musculus
cagtccactgtgtaagccaccaagg

SEQ ID NO: 573008 - DNA, 25 bp, Mus musculus
cagtccagaaaaatctactgctaat

SEQ ID NO: 573009 - DNA, 25 bp, Mus musculus
cagtccagaaaattctactgctaat

SEQ ID NO: 573010 - DNA, 25 bp, Mus musculus
cagtccagcactacaagggaccgag

SEQ ID NO: 573011 - DNA, 25 bp, Mus musculus
cagtccagcacttcaagggaccgag

SEQ ID NO: 573012 - DNA, 25 bp, Mus musculus
cagtccagccaaacctggtttttaa

SEQ ID NO: 573013 - DNA, 25 bp, Mus musculus
cagtccagccaatcctggtttttaa

SEQ ID NO: 573014 - DNA, 25 bp, Mus musculus
cagtccaggagactgttgccaagat

SEQ ID NO: 573015 - DNA, 25 bp, Mus musculus
cagtccaggagagtgttgccaagat

SEQ ID NO: 573016 - DNA, 25 bp, Mus musculus
cagtccaggcctccaagattgtagg

SEQ ID NO: 573017 - DNA, 25 bp, Mus musculus
cagtccaggcctgcaagattgtagg

SEQ ID NO: 573018 - DNA, 25 bp, Mus musculus
cagtccagtgttagtgtctctcaca

SEQ ID NO: 573019 - DNA, 25 bp, Mus musculus
cagtccagtgtttgtgtctctcaca

SEQ ID NO: 573020 - DNA, 25 bp, Mus musculus
cagtccatagctctgcccagatcaa

SEQ ID NO: 573021 - DNA, 25 bp, Mus musculus
cagtccatagctgtgcccagatcaa

SEQ ID NO: 573022 - DNA, 25 bp, Mus musculus
cagtccatcaccaatgaattggcta

SEQ ID NO: 573023 - DNA, 25 bp, Mus musculus
cagtccatcacctatgaattggcta

SEQ ID NO: 573024 - DNA, 25 bp, Mus musculus
cagtccatcattatctgcaactcct

SEQ ID NO: 573025 - DNA, 25 bp, Mus musculus
cagtccatcattttctgcaactcct

SEQ ID NO: 573026 - DNA, 25 bp, Mus musculus
cagtccatcgagcaccgggagaagc

SEQ ID NO: 573027 - DNA, 25 bp, Mus musculus
cagtccatcgaggaccgggagaagc

SEQ ID NO: 573028 - DNA, 25 bp, Mus musculus
cagtccatcgctcccagggcagaaa

SEQ ID NO: 573029 - DNA, 25 bp, Mus musculus
cagtccatcgctgccagggcagaaa

SEQ ID NO: 573030 - DNA, 25 bp, Mus musculus
cagtccatctctaaccctgaacagg

SEQ ID NO: 573031 - DNA, 25 bp, Mus musculus
cagtccatctcttaccctgaacagg

SEQ ID NO: 573032 - DNA, 25 bp, Mus musculus
cagtccatgaagattatgcatgaga

SEQ ID NO: 573033 - DNA, 25 bp, Mus musculus
cagtccatgaagtttatgcatgaga

SEQ ID NO: 573034 - DNA, 25 bp, Mus musculus
cagtccatgatgaagtggccaacaa

SEQ ID NO: 573035 - DNA, 25 bp, Mus musculus
cagtccatgatgtagtggccaacaa

SEQ ID NO: 573036 - DNA, 25 bp, Mus musculus
cagtccatgggcaactggcagatca

SEQ ID NO: 573037 - DNA, 25 bp, Mus musculus
cagtccatgggctactggcagatca

SEQ ID NO: 573038 - DNA, 25 bp, Mus musculus
cagtccattaaacccattgccctgg

SEQ ID NO: 573039 - DNA, 25 bp, Mus musculus
cagtccattaaagccattgccctgg

SEQ ID NO: 573040 - DNA, 25 bp, Mus musculus
cagtccattgtgaatgtgatgacgg

SEQ ID NO: 573041 - DNA, 25 bp, Mus musculus
cagtccattgtgtatgtgatgacgg

SEQ ID NO: 573042 - DNA, 25 bp, Mus musculus
cagtcccaagaaatgttttgaaggt

SEQ ID NO: 573043 - DNA, 25 bp, Mus musculus
cagtcccaagaattgttttgaaggt

SEQ ID NO: 573044 - DNA, 25 bp, Mus musculus
cagtcccaagatcgaaatgagttcc

SEQ ID NO: 573045 - DNA, 25 bp, Mus musculus
cagtcccaagatggaaatgagttcc

SEQ ID NO: 573046 - DNA, 25 bp, Mus musculus
cagtcccacaatacccggcggaggg

SEQ ID NO: 573047 - DNA, 25 bp, Mus musculus
cagtcccacaattcccggcggaggg

SEQ ID NO: 573048 - DNA, 25 bp, Mus musculus
cagtcccacggactggatatggatg

SEQ ID NO: 573049 - DNA, 25 bp, Mus musculus
cagtcccacggagtggatatggatg

SEQ ID NO: 573050 - DNA, 25 bp, Mus musculus
cagtcccatcaccatggttgccaaa

SEQ ID NO: 573051 - DNA, 25 bp, Mus musculus
cagtcccatcacgatggttgccaaa

SEQ ID NO: 573052 - DNA, 25 bp, Mus musculus
cagtccccagataatttctcctgta

SEQ ID NO: 573053 - DNA, 25 bp, Mus musculus
cagtccccagatcatgcccatttgt

SEQ ID NO: 573054 - DNA, 25 bp, Mus musculus
cagtccccagatgatgcccatttgt

SEQ ID NO: 573055 - DNA, 25 bp, Mus musculus
cagtccccagattatttctcctgta

SEQ ID NO: 573056 - DNA, 25 bp, Mus musculus
cagtccccgagtagatccagtatca

SEQ ID NO: 573057 - DNA, 25 bp, Mus musculus
cagtccccgagttgatccagtatca

SEQ ID NO: 573058 - DNA, 25 bp, Mus musculus
cagtcccctgttactcaccaaagga

SEQ ID NO: 573059 - DNA, 25 bp, Mus musculus
cagtcccctgtttctcaccaaagga

SEQ ID NO: 573060 - DNA, 25 bp, Mus musculus
cagtcccgctggagttctagtgtgc

SEQ ID NO: 573061 - DNA, 25 bp, Mus musculus
cagtcccgctggtgttctagtgtgc

SEQ ID NO: 573062 - DNA, 25 bp, Mus musculus
cagtccctcaatagctctctggagg

SEQ ID NO: 573063 - DNA, 25 bp, Mus musculus
cagtccctcaattgctctctggagg

SEQ ID NO: 573064 - DNA, 25 bp, Mus musculus
cagtccctggaacacttggcgcgcg

SEQ ID NO: 573065 - DNA, 25 bp, Mus musculus
cagtccctggaagacttggcgcgcg

SEQ ID NO: 573066 - DNA, 25 bp, Mus musculus
cagtccctggtgaaacagaacagtg

SEQ ID NO: 573067 - DNA, 25 bp, Mus musculus
cagtccctggtgtaacagaacagtg

SEQ ID NO: 573068 - DNA, 25 bp, Mus musculus
cagtcccttgtgaccattattgcca

SEQ ID NO: 573069 - DNA, 25 bp, Mus musculus
cagtcccttgtgtccattattgcca

SEQ ID NO: 573070 - DNA, 25 bp, Mus musculus
cagtcccttgttcaacagagagctt

SEQ ID NO: 573071 - DNA, 25 bp, Mus musculus
cagtcccttgttgaacagagagctt

SEQ ID NO: 573072 - DNA, 25 bp, Mus musculus
cagtccgaagttcgtctgagccagc

SEQ ID NO: 573073 - DNA, 25 bp, Mus musculus
cagtccgaagttggtctgagccagc

SEQ ID NO: 573074 - DNA, 25 bp, Mus musculus
cagtccgacgtgaactcgtacggca

SEQ ID NO: 573075 - DNA, 25 bp, Mus musculus
cagtccgacgtgtactcgtacggca

SEQ ID NO: 573076 - DNA, 25 bp, Mus musculus
cagtccgatgaacgacttcagcctc

SEQ ID NO: 573077 - DNA, 25 bp, Mus musculus
cagtccgatgaaggacttcagcctc

SEQ ID NO: 573078 - DNA, 25 bp, Mus musculus
cagtccgcacacaatgtcattgtca

SEQ ID NO: 573079 - DNA, 25 bp, Mus musculus
cagtccgcacactatgtcattgtca

SEQ ID NO: 573080 - DNA, 25 bp, Mus musculus
cagtccgcccataaagaagtactcg

SEQ ID NO: 573081 - DNA, 25 bp, Mus musculus
cagtccgcccattaagaagtactcg

SEQ ID NO: 573082 - DNA, 25 bp, Mus musculus
cagtccgctgacctgattgtgttat

SEQ ID NO: 573083 - DNA, 25 bp, Mus musculus
cagtccgctgacgtgattgtgttat

SEQ ID NO: 573084 - DNA, 25 bp, Mus musculus
cagtccgctggaatgctatatgaaa

SEQ ID NO: 573085 - DNA, 25 bp, Mus musculus
cagtccgctggattgctatatgaaa

SEQ ID NO: 573086 - DNA, 25 bp, Mus musculus
cagtccggaagcactcctagggttt

SEQ ID NO: 573087 - DNA, 25 bp, Mus musculus
cagtccggaagctctcctagggttt

SEQ ID NO: 573088 - DNA, 25 bp, Mus musculus
cagtccggagatccctatttaacaa

SEQ ID NO: 573089 - DNA, 25 bp, Mus musculus
cagtccggagatgcctatttaacaa

SEQ ID NO: 573090 - DNA, 25 bp, Mus musculus
cagtccgggcctccgaagcgaagat

SEQ ID NO: 573091 - DNA, 25 bp, Mus musculus
cagtccgggcctgcgaagcgaagat

SEQ ID NO: 573092 - DNA, 25 bp, Mus musculus
cagtccgtgcctaagaggatctctc

SEQ ID NO: 573093 - DNA, 25 bp, Mus musculus
cagtccgtgccttagaggatctctc

SEQ ID NO: 573094 - DNA, 25 bp, Mus musculus
cagtcctaactgaggtgttttcctc

SEQ ID NO: 573095 - DNA, 25 bp, Mus musculus
cagtcctaactgtggtgttttcctc

SEQ ID NO: 573096 - DNA, 25 bp, Mus musculus
cagtcctaagctctctaccataggg

SEQ ID NO: 573097 - DNA, 25 bp, Mus musculus
cagtcctaagctgtctaccataggg

SEQ ID NO: 573098 - DNA, 25 bp, Mus musculus
cagtcctagggaagtatctcttcgg

SEQ ID NO: 573099 - DNA, 25 bp, Mus musculus
cagtcctagggatgtatctcttcgg

SEQ ID NO: 573100 - DNA, 25 bp, Mus musculus
cagtcctatcctacccctgttgttg

SEQ ID NO: 573101 - DNA, 25 bp, Mus musculus
cagtcctatccttcccctgttgttg

SEQ ID NO: 573102 - DNA, 25 bp, Mus musculus
cagtcctatcttagaagatgatgaa

SEQ ID NO: 573103 - DNA, 25 bp, Mus musculus
cagtcctatctttgaagatgatgaa

SEQ ID NO: 573104 - DNA, 25 bp, Mus musculus
cagtcctatgacaacagatacacaa

SEQ ID NO: 573105 - DNA, 25 bp, Mus musculus
cagtcctatgactacagatacacaa

SEQ ID NO: 573106 - DNA, 25 bp, Mus musculus
cagtcctatgagatcttgcagaaga

SEQ ID NO: 573107 - DNA, 25 bp, Mus musculus
cagtcctatgagttcttgcagaaga

SEQ ID NO: 573108 - DNA, 25 bp, Mus musculus
cagtcctattgcattcagaaaacca

SEQ ID NO: 573109 - DNA, 25 bp, Mus musculus
cagtcctattgctttcagaaaacca

SEQ ID NO: 573110 - DNA, 25 bp, Mus musculus
cagtcctcaggtattggctggacca

SEQ ID NO: 573111 - DNA, 25 bp, Mus musculus
cagtcctcaggttttggctggacca

SEQ ID NO: 573112 - DNA, 25 bp, Mus musculus
cagtcctcggctctgccaaaatgca

SEQ ID NO: 573113 - DNA, 25 bp, Mus musculus
cagtcctcggctgtgccaaaatgca

SEQ ID NO: 573114 - DNA, 25 bp, Mus musculus
cagtcctctttgaaatcaacagaaa

SEQ ID NO: 573115 - DNA, 25 bp, Mus musculus
cagtcctctttgtaatcaacagaaa

SEQ ID NO: 573116 - DNA, 25 bp, Mus musculus
cagtcctgaggaacatacaaaatcc

SEQ ID NO: 573117 - DNA, 25 bp, Mus musculus
cagtcctgaggatcatacaaaatcc

SEQ ID NO: 573118 - DNA, 25 bp, Mus musculus
cagtcctgatgacccagacagcaaa

SEQ ID NO: 573119 - DNA, 25 bp, Mus musculus
cagtcctgatgagccagacagcaaa

SEQ ID NO: 573120 - DNA, 25 bp, Mus musculus
cagtcctgccctctttataatctgc

SEQ ID NO: 573121 - DNA, 25 bp, Mus musculus
cagtcctgccctgtttataatctgc

SEQ ID NO: 573122 - DNA, 25 bp, Mus musculus
cagtcctgctagctacagtggtcct

SEQ ID NO: 573123 - DNA, 25 bp, Mus musculus
cagtcctgctaggtacagtggtcct

SEQ ID NO: 573124 - DNA, 25 bp, Mus musculus
cagtcctggatgacaacgagggacc

SEQ ID NO: 573125 - DNA, 25 bp, Mus musculus
cagtcctggatgtcaacgagggacc

SEQ ID NO: 573126 - DNA, 25 bp, Mus musculus
cagtcctggcccagcactttcaagg

SEQ ID NO: 573127 - DNA, 25 bp, Mus musculus
cagtcctggccctgcactttcaagg

SEQ ID NO: 573128 - DNA, 25 bp, Mus musculus
cagtcctggcgaaagatgctcttgt

SEQ ID NO: 573129 - DNA, 25 bp, Mus musculus
cagtcctggcgatagatgctcttgt

SEQ ID NO: 573130 - DNA, 25 bp, Mus musculus
cagtcctggtgaagaaccattttac

SEQ ID NO: 573131 - DNA, 25 bp, Mus musculus
cagtcctggtgatgaaccattttac

SEQ ID NO: 573132 - DNA, 25 bp, Mus musculus
cagtcctggtttcataacgggagca

SEQ ID NO: 573133 - DNA, 25 bp, Mus musculus
cagtcctggtttgataacgggagca

SEQ ID NO: 573134 - DNA, 25 bp, Mus musculus
cagtccttagatcctttggttccat

SEQ ID NO: 573135 - DNA, 25 bp, Mus musculus
cagtccttagatgctttggttccat

SEQ ID NO: 573136 - DNA, 25 bp, Mus musculus
cagtccttcatgaggcctcgatgaa

SEQ ID NO: 573137 - DNA, 25 bp, Mus musculus
cagtccttcatgtggcctcgatgaa

SEQ ID NO: 573138 - DNA, 25 bp, Mus musculus
cagtccttcctgattagcttatgcc

SEQ ID NO: 573139 - DNA, 25 bp, Mus musculus
cagtccttcctgtttagcttatgcc

SEQ ID NO: 573140 - DNA, 25 bp, Mus musculus
cagtccttggctagcagcaacagtg

SEQ ID NO: 573141 - DNA, 25 bp, Mus musculus
cagtccttggcttgcagcaacagtg

SEQ ID NO: 573142 - DNA, 25 bp, Mus musculus
cagtccttgttcaccaacatgaaga

SEQ ID NO: 573143 - DNA, 25 bp, Mus musculus
cagtccttgttctccaacatgaaga

SEQ ID NO: 573144 - DNA, 25 bp, Mus musculus
cagtcctttctgaaggagaaaccca

SEQ ID NO: 573145 - DNA, 25 bp, Mus musculus
cagtcctttctgtaggagaaaccca

SEQ ID NO: 573146 - DNA, 25 bp, Mus musculus
cagtccttttagaagactactgtgt

SEQ ID NO: 573147 - DNA, 25 bp, Mus musculus
cagtccttttagtagactactgtgt

SEQ ID NO: 573148 - DNA, 25 bp, Mus musculus
cagtcgaagattcgctccttggata

SEQ ID NO: 573149 - DNA, 25 bp, Mus musculus
cagtcgaagattggctccttggata

SEQ ID NO: 573150 - DNA, 25 bp, Mus musculus
cagtcgacagccactgtgtctgtga

SEQ ID NO: 573151 - DNA, 25 bp, Mus musculus
cagtcgacagcctctgtgtctgtga

SEQ ID NO: 573152 - DNA, 25 bp, Mus musculus
cagtcgacttctccaggcaatcgcg

SEQ ID NO: 573153 - DNA, 25 bp, Mus musculus
cagtcgacttctgcaggcaatcgcg

SEQ ID NO: 573154 - DNA, 25 bp, Mus musculus
cagtcgactttgctgttgtcagtga

SEQ ID NO: 573155 - DNA, 25 bp, Mus musculus
cagtcgactttggtgttgtcagtga

SEQ ID NO: 573156 - DNA, 25 bp, Mus musculus
cagtcgatggaacgaaggctcgctc

SEQ ID NO: 573157 - DNA, 25 bp, Mus musculus
cagtcgatggaaggaaggctcgctc

SEQ ID NO: 573158 - DNA, 25 bp, Mus musculus
cagtcgattcctccaagtgagctcg

SEQ ID NO: 573159 - DNA, 25 bp, Mus musculus
cagtcgattcctgcaagtgagctcg

SEQ ID NO: 573160 - DNA, 25 bp, Mus musculus
cagtcgcaaaagcaagccatcttct

SEQ ID NO: 573161 - DNA, 25 bp, Mus musculus
cagtcgcaaaaggaagccatcttct

SEQ ID NO: 573162 - DNA, 25 bp, Mus musculus
cagtcgcagctgatggctttgaaga

SEQ ID NO: 573163 - DNA, 25 bp, Mus musculus
cagtcgcagctgttggctttgaaga

SEQ ID NO: 573164 - DNA, 25 bp, Mus musculus
cagtcgcctgtcaaaggagctgctg

SEQ ID NO: 573165 - DNA, 25 bp, Mus musculus
cagtcgcctgtctaaggagctgctg

SEQ ID NO: 573166 - DNA, 25 bp, Mus musculus
cagtcgccttcaaggaacgccttca

SEQ ID NO: 573167 - DNA, 25 bp, Mus musculus
cagtcgccttcatggaacgccttca

SEQ ID NO: 573168 - DNA, 25 bp, Mus musculus
cagtcgcgccttattcgttacgaga

SEQ ID NO: 573169 - DNA, 25 bp, Mus musculus
cagtcgcgcctttttcgttacgaga

SEQ ID NO: 573170 - DNA, 25 bp, Mus musculus
cagtcgcggaagatcttcaactgca

SEQ ID NO: 573171 - DNA, 25 bp, Mus musculus
cagtcgcggaagttcttcaactgca

SEQ ID NO: 573172 - DNA, 25 bp, Mus musculus
cagtcgcggaggagattagttcgga

SEQ ID NO: 573173 - DNA, 25 bp, Mus musculus
cagtcgcggaggtgattagttcgga

SEQ ID NO: 573174 - DNA, 25 bp, Mus musculus
cagtcgctcataactctggacttga

SEQ ID NO: 573175 - DNA, 25 bp, Mus musculus
cagtcgctcatatctctggacttga

SEQ ID NO: 573176 - DNA, 25 bp, Mus musculus
cagtcgctgtccatagacacttttt

SEQ ID NO: 573177 - DNA, 25 bp, Mus musculus
cagtcgctgtccttagacacttttt

SEQ ID NO: 573178 - DNA, 25 bp, Mus musculus
cagtcgcttccactatggcttcaac

SEQ ID NO: 573179 - DNA, 25 bp, Mus musculus
cagtcgcttccagtatggcttcaac

SEQ ID NO: 573180 - DNA, 25 bp, Mus musculus
cagtcgcttcggcaagtttgttcag

SEQ ID NO: 573181 - DNA, 25 bp, Mus musculus
cagtcgcttcgggaagtttgttcag

SEQ ID NO: 573182 - DNA, 25 bp, Mus musculus
cagtcggagatcatcagccgttaca

SEQ ID NO: 573183 - DNA, 25 bp, Mus musculus
cagtcggagatcttcagccgttaca

SEQ ID NO: 573184 - DNA, 25 bp, Mus musculus
cagtcgggtcggactctgctctcgg

SEQ ID NO: 573185 - DNA, 25 bp, Mus musculus
cagtcgggtcggtctctgctctcgg

SEQ ID NO: 573186 - DNA, 25 bp, Mus musculus
cagtcggtgggaaacaaaagcatgt

SEQ ID NO: 573187 - DNA, 25 bp, Mus musculus
cagtcggtgggatacaaaagcatgt

SEQ ID NO: 573188 - DNA, 25 bp, Mus musculus
cagtcgtcccagcatgctgtgtcct

SEQ ID NO: 573189 - DNA, 25 bp, Mus musculus
cagtcgtcccaggatgctgtgtcct

SEQ ID NO: 573190 - DNA, 25 bp, Mus musculus
cagtcgtctccacgatctaagcaga

SEQ ID NO: 573191 - DNA, 25 bp, Mus musculus
cagtcgtctccaggatctaagcaga

SEQ ID NO: 573192 - DNA, 25 bp, Mus musculus
cagtcgtctcttacggatttgggca

SEQ ID NO: 573193 - DNA, 25 bp, Mus musculus
cagtcgtctctttcggatttgggca

SEQ ID NO: 573194 - DNA, 25 bp, Mus musculus
cagtcgtgcgagacttgtagcagca

SEQ ID NO: 573195 - DNA, 25 bp, Mus musculus
cagtcgtgcgagtcttgtagcagca

SEQ ID NO: 573196 - DNA, 25 bp, Mus musculus
cagtcgtggcatataaggatgccat

SEQ ID NO: 573197 - DNA, 25 bp, Mus musculus
cagtcgtggcatttaaggatgccat

SEQ ID NO: 573198 - DNA, 25 bp, Mus musculus
cagtcgtggctgcacacagcagaga

SEQ ID NO: 573199 - DNA, 25 bp, Mus musculus
cagtcgtggctggacacagcagaga

SEQ ID NO: 573200 - DNA, 25 bp, Mus musculus
cagtctaacccaagcctagtcaaca

SEQ ID NO: 573201 - DNA, 25 bp, Mus musculus
cagtctaacccatgcctagtcaaca

SEQ ID NO: 573202 - DNA, 25 bp, Mus musculus
cagtctaacgctcaatagaagtggt

SEQ ID NO: 573203 - DNA, 25 bp, Mus musculus
cagtctaacgctgaatagaagtggt

SEQ ID NO: 573204 - DNA, 25 bp, Mus musculus
cagtctaagaggctcgcagtcgctt

SEQ ID NO: 573205 - DNA, 25 bp, Mus musculus
cagtctaagagggtcgcagtcgctt

SEQ ID NO: 573206 - DNA, 25 bp, Mus musculus
cagtctaattgaagccaacggagaa

SEQ ID NO: 573207 - DNA, 25 bp, Mus musculus
cagtctaattgatgccaacggagaa

SEQ ID NO: 573208 - DNA, 25 bp, Mus musculus
cagtctacaaagcatacaaggtcag

SEQ ID NO: 573209 - DNA, 25 bp, Mus musculus
cagtctacaaaggatacaaggtcag

SEQ ID NO: 573210 - DNA, 25 bp, Mus musculus
cagtctacatctccaaagaggaaaa

SEQ ID NO: 573211 - DNA, 25 bp, Mus musculus
cagtctacatctgcaaagaggaaaa

SEQ ID NO: 573212 - DNA, 25 bp, Mus musculus
cagtctacctctcggatcttgatca

SEQ ID NO: 573213 - DNA, 25 bp, Mus musculus
cagtctacctctgggatcttgatca

SEQ ID NO: 573214 - DNA, 25 bp, Mus musculus
cagtctaccttgcatctaatggcag

SEQ ID NO: 573215 - DNA, 25 bp, Mus musculus
cagtctaccttggatctaatggcag

SEQ ID NO: 573216 - DNA, 25 bp, Mus musculus
cagtctactgtaatgtgcacaagca

SEQ ID NO: 573217 - DNA, 25 bp, Mus musculus
cagtctactgtattgtgcacaagca

SEQ ID NO: 573218 - DNA, 25 bp, Mus musculus
cagtctagacctagccaccagtggg

SEQ ID NO: 573219 - DNA, 25 bp, Mus musculus
cagtctagaccttgccaccagtggg

SEQ ID NO: 573220 - DNA, 25 bp, Mus musculus
cagtctagagttcgcctgtttgagg

SEQ ID NO: 573221 - DNA, 25 bp, Mus musculus
cagtctagagttggcctgtttgagg

SEQ ID NO: 573222 - DNA, 25 bp, Mus musculus
cagtctagcgttcgaacttcctgcc

SEQ ID NO: 573223 - DNA, 25 bp, Mus musculus
cagtctagcgttggaacttcctgcc

SEQ ID NO: 573224 - DNA, 25 bp, Mus musculus
cagtctaggaccctagcagttcaca

SEQ ID NO: 573225 - DNA, 25 bp, Mus musculus
cagtctaggaccgtagcagttcaca

SEQ ID NO: 573226 - DNA, 25 bp, Mus musculus
cagtctagttctaatggcggagccg

SEQ ID NO: 573227 - DNA, 25 bp, Mus musculus
cagtctagttcttatggcggagccg

SEQ ID NO: 573228 - DNA, 25 bp, Mus musculus
cagtctatcaaacccatacttaaga

SEQ ID NO: 573229 - DNA, 25 bp, Mus musculus
cagtctatcaaagccatacttaaga

SEQ ID NO: 573230 - DNA, 25 bp, Mus musculus
cagtctcaaggaagaaggtctggag

SEQ ID NO: 573231 - DNA, 25 bp, Mus musculus
cagtctcaaggatgaaggtctggag

SEQ ID NO: 573232 - DNA, 25 bp, Mus musculus
cagtctcacagtcgccaagtgctgg

SEQ ID NO: 573233 - DNA, 25 bp, Mus musculus
cagtctcacagtggccaagtgctgg

SEQ ID NO: 573234 - DNA, 25 bp, Mus musculus
cagtctcactgcatggagccagagg

SEQ ID NO: 573235 - DNA, 25 bp, Mus musculus
cagtctcactgcttggagccagagg

SEQ ID NO: 573236 - DNA, 25 bp, Mus musculus
cagtctcagactaaatcaatggcat

SEQ ID NO: 573237 - DNA, 25 bp, Mus musculus
cagtctcagacttaatcaatggcat

SEQ ID NO: 573238 - DNA, 25 bp, Mus musculus
cagtctcagtctacatatggcaaca

SEQ ID NO: 573239 - DNA, 25 bp, Mus musculus
cagtctcagtctcgtacgggtaaaa

SEQ ID NO: 573240 - DNA, 25 bp, Mus musculus
cagtctcagtctggtacgggtaaaa

SEQ ID NO: 573241 - DNA, 25 bp, Mus musculus
cagtctcagtcttcatatggcaaca

SEQ ID NO: 573242 - DNA, 25 bp, Mus musculus
cagtctcattcgcatttggtgtcac

SEQ ID NO: 573243 - DNA, 25 bp, Mus musculus
cagtctcattcggatttggtgtcac

SEQ ID NO: 573244 - DNA, 25 bp, Mus musculus
cagtctccacagagcagtttcccag

SEQ ID NO: 573245 - DNA, 25 bp, Mus musculus
cagtctccacagtgcagtttcccag

SEQ ID NO: 573246 - DNA, 25 bp, Mus musculus
cagtctccactgattgccgccttgt

SEQ ID NO: 573247 - DNA, 25 bp, Mus musculus
cagtctccactgtttgccgccttgt

SEQ ID NO: 573248 - DNA, 25 bp, Mus musculus
cagtctccaggaacgagcctctcag

SEQ ID NO: 573249 - DNA, 25 bp, Mus musculus
cagtctccaggatcgagcctctcag

SEQ ID NO: 573250 - DNA, 25 bp, Mus musculus
cagtctcctcacatgctgacatgga

SEQ ID NO: 573251 - DNA, 25 bp, Mus musculus
cagtctcctcacttgctgacatgga

SEQ ID NO: 573252 - DNA, 25 bp, Mus musculus
cagtctcctcttcttttatcgagtg

SEQ ID NO: 573253 - DNA, 25 bp, Mus musculus
cagtctcctcttgttttatcgagtg

SEQ ID NO: 573254 - DNA, 25 bp, Mus musculus
cagtctcctgcaaacagagcccaga

SEQ ID NO: 573255 - DNA, 25 bp, Mus musculus
cagtctcctgcatacagagcccaga

SEQ ID NO: 573256 - DNA, 25 bp, Mus musculus
cagtctcctttgacaccagaaagta

SEQ ID NO: 573257 - DNA, 25 bp, Mus musculus
cagtctcctttgtcaccagaaagta

SEQ ID NO: 573258 - DNA, 25 bp, Mus musculus
cagtctcgaggacctgaggagcaaa

SEQ ID NO: 573259 - DNA, 25 bp, Mus musculus
cagtctcgaggagctgaggagcaaa

SEQ ID NO: 573260 - DNA, 25 bp, Mus musculus
cagtctcggcttctgcttgtctagc

SEQ ID NO: 573261 - DNA, 25 bp, Mus musculus
cagtctcggcttgtgcttgtctagc

SEQ ID NO: 573262 - DNA, 25 bp, Mus musculus
cagtctcggtccatggaagtccctc

SEQ ID NO: 573263 - DNA, 25 bp, Mus musculus
cagtctcggtccttggaagtccctc

SEQ ID NO: 573264 - DNA, 25 bp, Mus musculus
cagtctcgtgctaccattggccaaa

SEQ ID NO: 573265 - DNA, 25 bp, Mus musculus
cagtctcgtgcttccattggccaaa

SEQ ID NO: 573266 - DNA, 25 bp, Mus musculus
cagtctctaactagatggtagccag

SEQ ID NO: 573267 - DNA, 25 bp, Mus musculus
cagtctctaacttgatggtagccag

SEQ ID NO: 573268 - DNA, 25 bp, Mus musculus
cagtctctactgagctgccgtgttt

SEQ ID NO: 573269 - DNA, 25 bp, Mus musculus
cagtctctactgtgctgccgtgttt

SEQ ID NO: 573270 - DNA, 25 bp, Mus musculus
cagtctctaggccaaaagcttgtga

SEQ ID NO: 573271 - DNA, 25 bp, Mus musculus
cagtctctaggcgaaaagcttgtga

SEQ ID NO: 573272 - DNA, 25 bp, Mus musculus
cagtctctcagacctaactgttctc

SEQ ID NO: 573273 - DNA, 25 bp, Mus musculus
cagtctctcagagctaactgttctc

SEQ ID NO: 573274 - DNA, 25 bp, Mus musculus
cagtctctctatattggaagagcaa

SEQ ID NO: 573275 - DNA, 25 bp, Mus musculus
cagtctctctattttggaagagcaa

SEQ ID NO: 573276 - DNA, 25 bp, Mus musculus
cagtctctctgactggcatatgcag

SEQ ID NO: 573277 - DNA, 25 bp, Mus musculus
cagtctctctgagtggcatatgcag

SEQ ID NO: 573278 - DNA, 25 bp, Mus musculus
cagtctctgaagctatagattattc

SEQ ID NO: 573279 - DNA, 25 bp, Mus musculus
cagtctctgaaggtatagattattc

SEQ ID NO: 573280 - DNA, 25 bp, Mus musculus
cagtctctgagtcccttgcccaagg

SEQ ID NO: 573281 - DNA, 25 bp, Mus musculus
cagtctctgagtgccttgcccaagg

SEQ ID NO: 573282 - DNA, 25 bp, Mus musculus
cagtctctggagacctcaggtcacc

SEQ ID NO: 573283 - DNA, 25 bp, Mus musculus
cagtctctggagtcctcaggtcacc

SEQ ID NO: 573284 - DNA, 25 bp, Mus musculus
cagtctctggcccagatgccgaaga

SEQ ID NO: 573285 - DNA, 25 bp, Mus musculus
cagtctctggccgagatgccgaaga

SEQ ID NO: 573286 - DNA, 25 bp, Mus musculus
cagtctcttgttagggccggtgaca

SEQ ID NO: 573287 - DNA, 25 bp, Mus musculus
cagtctcttgtttgggccggtgaca

SEQ ID NO: 573288 - DNA, 25 bp, Mus musculus
cagtctgacggtaccgggcgccgca

SEQ ID NO: 573289 - DNA, 25 bp, Mus musculus
cagtctgacggttccgggcgccgca

SEQ ID NO: 573290 - DNA, 25 bp, Mus musculus
cagtctgagcacagaggatctggtc

SEQ ID NO: 573291 - DNA, 25 bp, Mus musculus
cagtctgagcactgaggatctggtc

SEQ ID NO: 573292 - DNA, 25 bp, Mus musculus
cagtctgagtcactggttcctcttg

SEQ ID NO: 573293 - DNA, 25 bp, Mus musculus
cagtctgagtcagtggttcctcttg

SEQ ID NO: 573294 - DNA, 25 bp, Mus musculus
cagtctgagtcgctggttcctttgg

SEQ ID NO: 573295 - DNA, 25 bp, Mus musculus
cagtctgagtcggtggttcctttgg

SEQ ID NO: 573296 - DNA, 25 bp, Mus musculus
cagtctgcaagccagagggtagcca

SEQ ID NO: 573297 - DNA, 25 bp, Mus musculus
cagtctgcaagcgagagggtagcca

SEQ ID NO: 573298 - DNA, 25 bp, Mus musculus
cagtctgcagaaatgcctctttggc

SEQ ID NO: 573299 - DNA, 25 bp, Mus musculus
cagtctgcagaattgcctctttggc

SEQ ID NO: 573300 - DNA, 25 bp, Mus musculus
cagtctgcagtgagtggtgtgaaac

SEQ ID NO: 573301 - DNA, 25 bp, Mus musculus
cagtctgcagtgtgtggtgtgaaac

SEQ ID NO: 573302 - DNA, 25 bp, Mus musculus
cagtctgcccttccaagaggaggag

SEQ ID NO: 573303 - DNA, 25 bp, Mus musculus
cagtctgcccttgcaagaggaggag

SEQ ID NO: 573304 - DNA, 25 bp, Mus musculus
cagtctgccgcaagttcatgcaaga

SEQ ID NO: 573305 - DNA, 25 bp, Mus musculus
cagtctgccgcatgttcatgcaaga

SEQ ID NO: 573306 - DNA, 25 bp, Mus musculus
cagtctgcctcaagtacctgctctt

SEQ ID NO: 573307 - DNA, 25 bp, Mus musculus
cagtctgcctcatgtacctgctctt

SEQ ID NO: 573308 - DNA, 25 bp, Mus musculus
cagtctgcgggtctggcccatcatg

SEQ ID NO: 573309 - DNA, 25 bp, Mus musculus
cagtctgcgggtgtggcccatcatg

SEQ ID NO: 573310 - DNA, 25 bp, Mus musculus
cagtctgctggactaccttatgcca

SEQ ID NO: 573311 - DNA, 25 bp, Mus musculus
cagtctgctggagtaccttatgcca

SEQ ID NO: 573312 - DNA, 25 bp, Mus musculus
cagtctgcttctattttcaggcagg

SEQ ID NO: 573313 - DNA, 25 bp, Mus musculus
cagtctgcttcttttttcaggcagg

SEQ ID NO: 573314 - DNA, 25 bp, Mus musculus
cagtctgctttcaattaatgtatca

SEQ ID NO: 573315 - DNA, 25 bp, Mus musculus
cagtctgctttctattaatgtatca

SEQ ID NO: 573316 - DNA, 25 bp, Mus musculus
cagtctggaagaagcacggtgaatc

SEQ ID NO: 573317 - DNA, 25 bp, Mus musculus
cagtctggaagatgcacggtgaatc

SEQ ID NO: 573318 - DNA, 25 bp, Mus musculus
cagtctggactgaatctcactgact

SEQ ID NO: 573319 - DNA, 25 bp, Mus musculus
cagtctggactgtatctcactgact

SEQ ID NO: 573320 - DNA, 25 bp, Mus musculus
cagtctggagggagtgcacgtcatc

SEQ ID NO: 573321 - DNA, 25 bp, Mus musculus
cagtctggagggtgtgcacgtcatc

SEQ ID NO: 573322 - DNA, 25 bp, Mus musculus
cagtctggatcaacaacattgggca

SEQ ID NO: 573323 - DNA, 25 bp, Mus musculus
cagtctggatcatcaacattgggca

SEQ ID NO: 573324 - DNA, 25 bp, Mus musculus
cagtctgggaagacagagctctccc

SEQ ID NO: 573325 - DNA, 25 bp, Mus musculus
cagtctgggaagtcagagctctccc

SEQ ID NO: 573326 - DNA, 25 bp, Mus musculus
cagtctgggtttcaagggttcctca

SEQ ID NO: 573327 - DNA, 25 bp, Mus musculus
cagtctgggtttgaagggttcctca

SEQ ID NO: 573328 - DNA, 25 bp, Mus musculus
cagtctggtaacactgttgtgtcac

SEQ ID NO: 573329 - DNA, 25 bp, Mus musculus
cagtctggtaactctgttgtgtcac

SEQ ID NO: 573330 - DNA, 25 bp, Mus musculus
cagtctggtagtatacaggcccaca

SEQ ID NO: 573331 - DNA, 25 bp, Mus musculus
cagtctggtagtttacaggcccaca

SEQ ID NO: 573332 - DNA, 25 bp, Mus musculus
cagtctgtagatcgacaggtgacac

SEQ ID NO: 573333 - DNA, 25 bp, Mus musculus
cagtctgtagatggacaggtgacac

SEQ ID NO: 573334 - DNA, 25 bp, Mus musculus
cagtctgtccacaaagagggatacc

SEQ ID NO: 573335 - DNA, 25 bp, Mus musculus
cagtctgtccactaagagggatacc

SEQ ID NO: 573336 - DNA, 25 bp, Mus musculus
cagtctgtctcccttcgaagtaaga

SEQ ID NO: 573337 - DNA, 25 bp, Mus musculus
cagtctgtctccgttcgaagtaaga

SEQ ID NO: 573338 - DNA, 25 bp, Mus musculus
cagtctgtctttcttcagagttatc

SEQ ID NO: 573339 - DNA, 25 bp, Mus musculus
cagtctgtctttgttcagagttatc

SEQ ID NO: 573340 - DNA, 25 bp, Mus musculus
cagtctgtgacaattggaaccaagt

SEQ ID NO: 573341 - DNA, 25 bp, Mus musculus
cagtctgtgacatttggaaccaagt

SEQ ID NO: 573342 - DNA, 25 bp, Mus musculus
cagtctgtgtgaagatctcctgtca

SEQ ID NO: 573343 - DNA, 25 bp, Mus musculus
cagtctgtgtgatgatctcctgtca

SEQ ID NO: 573344 - DNA, 25 bp, Mus musculus
cagtctgttctgcacagcggctact

SEQ ID NO: 573345 - DNA, 25 bp, Mus musculus
cagtctgttctggacagcggctact

SEQ ID NO: 573346 - DNA, 25 bp, Mus musculus
cagtcttaccgaaggatgtgcacga

SEQ ID NO: 573347 - DNA, 25 bp, Mus musculus
cagtcttaccgatggatgtgcacga

SEQ ID NO: 573348 - DNA, 25 bp, Mus musculus
cagtcttaccgtacagtggcttcct

SEQ ID NO: 573349 - DNA, 25 bp, Mus musculus
cagtcttaccgttcagtggcttcct

SEQ ID NO: 573350 - DNA, 25 bp, Mus musculus
cagtcttactacacactactggaag

SEQ ID NO: 573351 - DNA, 25 bp, Mus musculus
cagtcttactactcactactggaag

SEQ ID NO: 573352 - DNA, 25 bp, Mus musculus
cagtcttattgacttagtggtggct

SEQ ID NO: 573353 - DNA, 25 bp, Mus musculus
cagtcttattgagttagtggtggct

SEQ ID NO: 573354 - DNA, 25 bp, Mus musculus
cagtcttcagggactcaagatctac

SEQ ID NO: 573355 - DNA, 25 bp, Mus musculus
cagtcttcagggtctcaagatctac

SEQ ID NO: 573356 - DNA, 25 bp, Mus musculus
cagtcttcatcaaagcgttgcctga

SEQ ID NO: 573357 - DNA, 25 bp, Mus musculus
cagtcttcatcatagcgttgcctga

SEQ ID NO: 573358 - DNA, 25 bp, Mus musculus
cagtcttccaaaattggtggataac

SEQ ID NO: 573359 - DNA, 25 bp, Mus musculus
cagtcttccaaatttggtggataac

SEQ ID NO: 573360 - DNA, 25 bp, Mus musculus
cagtcttccaacattaccgctggga

SEQ ID NO: 573361 - DNA, 25 bp, Mus musculus
cagtcttccaactttaccgctggga

SEQ ID NO: 573362 - DNA, 25 bp, Mus musculus
cagtcttccacaacaaactcaagga

SEQ ID NO: 573363 - DNA, 25 bp, Mus musculus
cagtcttccacatcaaactcaagga

SEQ ID NO: 573364 - DNA, 25 bp, Mus musculus
cagtcttccatgaggatgtgcatgg

SEQ ID NO: 573365 - DNA, 25 bp, Mus musculus
cagtcttccatgtggatgtgcatgg

SEQ ID NO: 573366 - DNA, 25 bp, Mus musculus
cagtcttccgcgaaccctggaagca

SEQ ID NO: 573367 - DNA, 25 bp, Mus musculus
cagtcttccgcgtaccctggaagca

SEQ ID NO: 573368 - DNA, 25 bp, Mus musculus
cagtcttcctatatgatgacgctgg

SEQ ID NO: 573369 - DNA, 25 bp, Mus musculus
cagtcttcctatttgatgacgctgg

SEQ ID NO: 573370 - DNA, 25 bp, Mus musculus
cagtcttctgggagcaaacctgcag

SEQ ID NO: 573371 - DNA, 25 bp, Mus musculus
cagtcttctgggtgcaaacctgcag

SEQ ID NO: 573372 - DNA, 25 bp, Mus musculus
cagtcttgacaacagctccataaat

SEQ ID NO: 573373 - DNA, 25 bp, Mus musculus
cagtcttgacaagagctccataaat

SEQ ID NO: 573374 - DNA, 25 bp, Mus musculus
cagtcttgccagaacactggtagta

SEQ ID NO: 573375 - DNA, 25 bp, Mus musculus
cagtcttgccagtacactggtagta

SEQ ID NO: 573376 - DNA, 25 bp, Mus musculus
cagtcttggagcacctttcattgta

SEQ ID NO: 573377 - DNA, 25 bp, Mus musculus
cagtcttggagctcctttcattgta

SEQ ID NO: 573378 - DNA, 25 bp, Mus musculus
cagtcttggcacctgctgcttacta

SEQ ID NO: 573379 - DNA, 25 bp, Mus musculus
cagtcttggcacgtgctgcttacta

SEQ ID NO: 573380 - DNA, 25 bp, Mus musculus
cagtcttggctcacgttcctgtgca

SEQ ID NO: 573381 - DNA, 25 bp, Mus musculus
cagtcttggctctcgttcctgtgca

SEQ ID NO: 573382 - DNA, 25 bp, Mus musculus
cagtcttggttgctttctggccttc

SEQ ID NO: 573383 - DNA, 25 bp, Mus musculus
cagtcttggttggtttctggccttc

SEQ ID NO: 573384 - DNA, 25 bp, Mus musculus
cagtcttgtccccagcttagggtct

SEQ ID NO: 573385 - DNA, 25 bp, Mus musculus
cagtcttgtcccgagcttagggtct

SEQ ID NO: 573386 - DNA, 25 bp, Mus musculus
cagtctttaaaactccagtgttaca

SEQ ID NO: 573387 - DNA, 25 bp, Mus musculus
cagtctttaaaagtccagtgttaca

SEQ ID NO: 573388 - DNA, 25 bp, Mus musculus
cagtctttaaataagatgcccagca

SEQ ID NO: 573389 - DNA, 25 bp, Mus musculus
cagtctttaaattagatgcccagca

SEQ ID NO: 573390 - DNA, 25 bp, Mus musculus
cagtctttcactaaatgaacgtttc

SEQ ID NO: 573391 - DNA, 25 bp, Mus musculus
cagtctttcacttaatgaacgtttc

SEQ ID NO: 573392 - DNA, 25 bp, Mus musculus
cagtctttcagacaataaactagga

SEQ ID NO: 573393 - DNA, 25 bp, Mus musculus
cagtctttcagagaataaactagga

SEQ ID NO: 573394 - DNA, 25 bp, Mus musculus
cagtctttcttaccttttctcgccg

SEQ ID NO: 573395 - DNA, 25 bp, Mus musculus
cagtctttcttagcttttctcgccg

SEQ ID NO: 573396 - DNA, 25 bp, Mus musculus
cagtctttgcagattatcatcgatg

SEQ ID NO: 573397 - DNA, 25 bp, Mus musculus
cagtctttgcagtttatcatcgatg

SEQ ID NO: 573398 - DNA, 25 bp, Mus musculus
cagtctttgcggcacaagggctaca

SEQ ID NO: 573399 - DNA, 25 bp, Mus musculus
cagtctttgcgggacaagggctaca

SEQ ID NO: 573400 - DNA, 25 bp, Mus musculus
cagtcttttactatgagattctaaa

SEQ ID NO: 573401 - DNA, 25 bp, Mus musculus
cagtcttttactttgagattctaaa

SEQ ID NO: 573402 - DNA, 25 bp, Mus musculus
cagtgaaaaagcagatttactggag

SEQ ID NO: 573403 - DNA, 25 bp, Mus musculus
cagtgaaaaagctgatttactggag

SEQ ID NO: 573404 - DNA, 25 bp, Mus musculus
cagtgaaaacagacctgaaaatgag

SEQ ID NO: 573405 - DNA, 25 bp, Mus musculus
cagtgaaaacagtcctgaaaatgag

SEQ ID NO: 573406 - DNA, 25 bp, Mus musculus
cagtgaaacataccaccttccatgg

SEQ ID NO: 573407 - DNA, 25 bp, Mus musculus
cagtgaaacatagcaccttccatgg

SEQ ID NO: 573408 - DNA, 25 bp, Mus musculus
cagtgaaacatcaaaggagttggct

SEQ ID NO: 573409 - DNA, 25 bp, Mus musculus
cagtgaaacatcaagaagacattgt

SEQ ID NO: 573410 - DNA, 25 bp, Mus musculus
cagtgaaacatctaaggagttggct

SEQ ID NO: 573411 - DNA, 25 bp, Mus musculus
cagtgaaacatctagaagacattgt

SEQ ID NO: 573412 - DNA, 25 bp, Mus musculus
cagtgaaatggaaggaaggactcac

SEQ ID NO: 573413 - DNA, 25 bp, Mus musculus
cagtgaaatggatggaaggactcac

SEQ ID NO: 573414 - DNA, 25 bp, Mus musculus
cagtgaacatcacgcagtgctgcag

SEQ ID NO: 573415 - DNA, 25 bp, Mus musculus
cagtgaacatcaggcagtgctgcag

SEQ ID NO: 573416 - DNA, 25 bp, Mus musculus
cagtgaacatgaaggagctgtacag

SEQ ID NO: 573417 - DNA, 25 bp, Mus musculus
cagtgaacatgatggagctgtacag

SEQ ID NO: 573418 - DNA, 25 bp, Mus musculus
cagtgaaccagccacaagtggtgat

SEQ ID NO: 573419 - DNA, 25 bp, Mus musculus
cagtgaaccagcgacaagtggtgat

SEQ ID NO: 573420 - DNA, 25 bp, Mus musculus
cagtgaaccctgacatgtcagtgtg

SEQ ID NO: 573421 - DNA, 25 bp, Mus musculus
cagtgaaccctgtcatgtcagtgtg

SEQ ID NO: 573422 - DNA, 25 bp, Mus musculus
cagtgaacctgtcgaactgggcagt

SEQ ID NO: 573423 - DNA, 25 bp, Mus musculus
cagtgaacctgtggaactgggcagt

SEQ ID NO: 573424 - DNA, 25 bp, Mus musculus
cagtgaactatgactttgatgagga

SEQ ID NO: 573425 - DNA, 25 bp, Mus musculus
cagtgaactatgtctttgatgagga

SEQ ID NO: 573426 - DNA, 25 bp, Mus musculus
cagtgaactgttatgacatcttgga

SEQ ID NO: 573427 - DNA, 25 bp, Mus musculus
cagtgaactgttttgacatcttgga

SEQ ID NO: 573428 - DNA, 25 bp, Mus musculus
cagtgaagaagccaggctggcccaa

SEQ ID NO: 573429 - DNA, 25 bp, Mus musculus
cagtgaagaagcgaggctggcccaa

SEQ ID NO: 573430 - DNA, 25 bp, Mus musculus
cagtgaagaagtaaaagcgagcagt

SEQ ID NO: 573431 - DNA, 25 bp, Mus musculus
cagtgaagaagttaaagcgagcagt

SEQ ID NO: 573432 - DNA, 25 bp, Mus musculus
cagtgaagagatccgccccatcaag

SEQ ID NO: 573433 - DNA, 25 bp, Mus musculus
cagtgaagagatgcgccccatcaag

SEQ ID NO: 573434 - DNA, 25 bp, Mus musculus
cagtgaagatgacattcgcagggca

SEQ ID NO: 573435 - DNA, 25 bp, Mus musculus
cagtgaagatgacttctatgatgct

SEQ ID NO: 573436 - DNA, 25 bp, Mus musculus
cagtgaagatgagattcgcagggca

SEQ ID NO: 573437 - DNA, 25 bp, Mus musculus
cagtgaagatgagttctatgatgct

SEQ ID NO: 573438 - DNA, 25 bp, Mus musculus
cagtgaagcagacatagacgagagc

SEQ ID NO: 573439 - DNA, 25 bp, Mus musculus
cagtgaagcagagatagacgagagc

SEQ ID NO: 573440 - DNA, 25 bp, Mus musculus
cagtgaagcatgattttctagaaaa

SEQ ID NO: 573441 - DNA, 25 bp, Mus musculus
cagtgaagcatgtttttctagaaaa

SEQ ID NO: 573442 - DNA, 25 bp, Mus musculus
cagtgaagccataggagacaagtct

SEQ ID NO: 573443 - DNA, 25 bp, Mus musculus
cagtgaagccatcattgccttcctc

SEQ ID NO: 573444 - DNA, 25 bp, Mus musculus
cagtgaagccatgattgccttcctc

SEQ ID NO: 573445 - DNA, 25 bp, Mus musculus
cagtgaagccattggagacaagtct

SEQ ID NO: 573446 - DNA, 25 bp, Mus musculus
cagtgaagctgacctagctactgac

SEQ ID NO: 573447 - DNA, 25 bp, Mus musculus
cagtgaagctgagctagctactgac

SEQ ID NO: 573448 - DNA, 25 bp, Mus musculus
cagtgaagctgcctcttcctaagca

SEQ ID NO: 573449 - DNA, 25 bp, Mus musculus
cagtgaagctgcgtcttcctaagca

SEQ ID NO: 573450 - DNA, 25 bp, Mus musculus
cagtgaagctttccaaactgttgtc

SEQ ID NO: 573451 - DNA, 25 bp, Mus musculus
cagtgaagctttgcaaactgttgtc

SEQ ID NO: 573452 - DNA, 25 bp, Mus musculus
cagtgaaggaagctggttccgttcc

SEQ ID NO: 573453 - DNA, 25 bp, Mus musculus
cagtgaaggaaggtggttccgttcc

SEQ ID NO: 573454 - DNA, 25 bp, Mus musculus
cagtgaaggaatactggcagtagat

SEQ ID NO: 573455 - DNA, 25 bp, Mus musculus
cagtgaaggaattctggcagtagat

SEQ ID NO: 573456 - DNA, 25 bp, Mus musculus
cagtgaagggctacttagagatgcc

SEQ ID NO: 573457 - DNA, 25 bp, Mus musculus
cagtgaagggcttcttagagatgcc

SEQ ID NO: 573458 - DNA, 25 bp, Mus musculus
cagtgaaggtgcagcggaccatttt

SEQ ID NO: 573459 - DNA, 25 bp, Mus musculus
cagtgaaggtgcaggagtctctagc

SEQ ID NO: 573460 - DNA, 25 bp, Mus musculus
cagtgaaggtgctgcggaccatttt

SEQ ID NO: 573461 - DNA, 25 bp, Mus musculus
cagtgaaggtgctggagtctctagc

SEQ ID NO: 573462 - DNA, 25 bp, Mus musculus
cagtgaagtgttcccacacattaga

SEQ ID NO: 573463 - DNA, 25 bp, Mus musculus
cagtgaagtgttgccacacattaga

SEQ ID NO: 573464 - DNA, 25 bp, Mus musculus
cagtgaagttatctgtttcttaccg

SEQ ID NO: 573465 - DNA, 25 bp, Mus musculus
cagtgaagttatgtgtttcttaccg

SEQ ID NO: 573466 - DNA, 25 bp, Mus musculus
cagtgaatcaggaggcgaactcatt

SEQ ID NO: 573467 - DNA, 25 bp, Mus musculus
cagtgaatcaggtggcgaactcatt

SEQ ID NO: 573468 - DNA, 25 bp, Mus musculus
cagtgaatcattcaggtggcaggcc

SEQ ID NO: 573469 - DNA, 25 bp, Mus musculus
cagtgaatcattgaggtggcaggcc

SEQ ID NO: 573470 - DNA, 25 bp, Mus musculus
cagtgaatccgcacctgttgcagag

SEQ ID NO: 573471 - DNA, 25 bp, Mus musculus
cagtgaatccgctcctgttgcagag

SEQ ID NO: 573472 - DNA, 25 bp, Mus musculus
cagtgaatcctgcaacataaactgc

SEQ ID NO: 573473 - DNA, 25 bp, Mus musculus
cagtgaatcctggaacataaactgc

SEQ ID NO: 573474 - DNA, 25 bp, Mus musculus
cagtgaatgagtccttcaagccgga

SEQ ID NO: 573475 - DNA, 25 bp, Mus musculus
cagtgaatgagtgcttcaagccgga

SEQ ID NO: 573476 - DNA, 25 bp, Mus musculus
cagtgaatgatgacctgcccaattg

SEQ ID NO: 573477 - DNA, 25 bp, Mus musculus
cagtgaatgatgtcctgcccaattg

SEQ ID NO: 573478 - DNA, 25 bp, Mus musculus
cagtgaatgctacagtaagccggag

SEQ ID NO: 573479 - DNA, 25 bp, Mus musculus
cagtgaatgctagagtaagccggag

SEQ ID NO: 573480 - DNA, 25 bp, Mus musculus
cagtgaattgcaacagcaattaaag

SEQ ID NO: 573481 - DNA, 25 bp, Mus musculus
cagtgaattgcatcagcaattaaag

SEQ ID NO: 573482 - DNA, 25 bp, Mus musculus
cagtgacaacccaaggcttcccttt

SEQ ID NO: 573483 - DNA, 25 bp, Mus musculus
cagtgacaaccctaggcttcccttt

SEQ ID NO: 573484 - DNA, 25 bp, Mus musculus
cagtgacaacgaagttgaagtcatc

SEQ ID NO: 573485 - DNA, 25 bp, Mus musculus
cagtgacaacgatgttgaagtcatc

SEQ ID NO: 573486 - DNA, 25 bp, Mus musculus
cagtgacaagctctctaggatggcc

SEQ ID NO: 573487 - DNA, 25 bp, Mus musculus
cagtgacaagctgtctaggatggcc

SEQ ID NO: 573488 - DNA, 25 bp, Mus musculus
cagtgacaagtccagcacctatgtg

SEQ ID NO: 573489 - DNA, 25 bp, Mus musculus
cagtgacaagtcgagcacctatgtg

SEQ ID NO: 573490 - DNA, 25 bp, Mus musculus
cagtgacacacacatttcctactta

SEQ ID NO: 573491 - DNA, 25 bp, Mus musculus
cagtgacacacagatttcctactta

SEQ ID NO: 573492 - DNA, 25 bp, Mus musculus
cagtgacacgaacgaagcatccctg

SEQ ID NO: 573493 - DNA, 25 bp, Mus musculus
cagtgacacgaaggaagcatccctg

SEQ ID NO: 573494 - DNA, 25 bp, Mus musculus
cagtgacagcccaagtctggaactt

SEQ ID NO: 573495 - DNA, 25 bp, Mus musculus
cagtgacagccctagtctggaactt

SEQ ID NO: 573496 - DNA, 25 bp, Mus musculus
cagtgacagcggagaatgaacctac

SEQ ID NO: 573497 - DNA, 25 bp, Mus musculus
cagtgacagcggtgaatgaacctac

SEQ ID NO: 573498 - DNA, 25 bp, Mus musculus
cagtgacaggtgagacctctgtgga

SEQ ID NO: 573499 - DNA, 25 bp, Mus musculus
cagtgacaggtgtgacctctgtgga

SEQ ID NO: 573500 - DNA, 25 bp, Mus musculus
cagtgacagtaacgactctcactgc

SEQ ID NO: 573501 - DNA, 25 bp, Mus musculus
cagtgacagtaaggactctcactgc

SEQ ID NO: 573502 - DNA, 25 bp, Mus musculus
cagtgacatgacagacagcaaggcc

SEQ ID NO: 573503 - DNA, 25 bp, Mus musculus
cagtgacatgactgacagcaaggcc

SEQ ID NO: 573504 - DNA, 25 bp, Mus musculus
cagtgacatgctacagaggcacgtg

SEQ ID NO: 573505 - DNA, 25 bp, Mus musculus
cagtgacatgcttcagaggcacgtg

SEQ ID NO: 573506 - DNA, 25 bp, Mus musculus
cagtgaccacggattctgaaaaggg

SEQ ID NO: 573507 - DNA, 25 bp, Mus musculus
cagtgaccacggtttctgaaaaggg

SEQ ID NO: 573508 - DNA, 25 bp, Mus musculus
cagtgaccactccagcaagaagtcc

SEQ ID NO: 573509 - DNA, 25 bp, Mus musculus
cagtgaccactcgagcaagaagtcc

SEQ ID NO: 573510 - DNA, 25 bp, Mus musculus
cagtgacccctgctaaaactgaggt

SEQ ID NO: 573511 - DNA, 25 bp, Mus musculus
cagtgacccctggtaaaactgaggt

SEQ ID NO: 573512 - DNA, 25 bp, Mus musculus
cagtgaccctcccatcagtgagagt

SEQ ID NO: 573513 - DNA, 25 bp, Mus musculus
cagtgaccctccgatcagtgagagt

SEQ ID NO: 573514 - DNA, 25 bp, Mus musculus
cagtgaccggagctacaaagtgtgc

SEQ ID NO: 573515 - DNA, 25 bp, Mus musculus
cagtgaccggaggtacaaagtgtgc

SEQ ID NO: 573516 - DNA, 25 bp, Mus musculus
cagtgacctgttaggctgcagagag

SEQ ID NO: 573517 - DNA, 25 bp, Mus musculus
cagtgacctgtttggctgcagagag

SEQ ID NO: 573518 - DNA, 25 bp, Mus musculus
cagtgacgaggacaagacccttcgg

SEQ ID NO: 573519 - DNA, 25 bp, Mus musculus
cagtgacgaggagaagacccttcgg

SEQ ID NO: 573520 - DNA, 25 bp, Mus musculus
cagtgacggagaactgtctgaaaac

SEQ ID NO: 573521 - DNA, 25 bp, Mus musculus
cagtgacggagatctgtctgaaaac

SEQ ID NO: 573522 - DNA, 25 bp, Mus musculus
cagtgacgtcacaggaatggagcta

SEQ ID NO: 573523 - DNA, 25 bp, Mus musculus
cagtgacgtcactggaatggagcta

SEQ ID NO: 573524 - DNA, 25 bp, Mus musculus
cagtgactaagcatctggagaagat

SEQ ID NO: 573525 - DNA, 25 bp, Mus musculus
cagtgactaagcttctggagaagat

SEQ ID NO: 573526 - DNA, 25 bp, Mus musculus
cagtgactaagtcgccaccttctgc

SEQ ID NO: 573527 - DNA, 25 bp, Mus musculus
cagtgactaagtggccaccttctgc

SEQ ID NO: 573528 - DNA, 25 bp, Mus musculus
cagtgactacacctctggacgtggc

SEQ ID NO: 573529 - DNA, 25 bp, Mus musculus
cagtgactacacgtctggacgtggc

SEQ ID NO: 573530 - DNA, 25 bp, Mus musculus
cagtgactacggcaagctcaccaaa

SEQ ID NO: 573531 - DNA, 25 bp, Mus musculus
cagtgactacgggaagctcaccaaa

SEQ ID NO: 573532 - DNA, 25 bp, Mus musculus
cagtgactatatacaccccgtgtgt

SEQ ID NO: 573533 - DNA, 25 bp, Mus musculus
cagtgactatattcaccccgtgtgt

SEQ ID NO: 573534 - DNA, 25 bp, Mus musculus
cagtgactccgcaacctcgatcaat

SEQ ID NO: 573535 - DNA, 25 bp, Mus musculus
cagtgactccgctacctcgatcaat

SEQ ID NO: 573536 - DNA, 25 bp, Mus musculus
cagtgactcctacagattgatccag

SEQ ID NO: 573537 - DNA, 25 bp, Mus musculus
cagtgactcctagagattgatccag

SEQ ID NO: 573538 - DNA, 25 bp, Mus musculus
cagtgactcggtattcagccacgac

SEQ ID NO: 573539 - DNA, 25 bp, Mus musculus
cagtgactcggttttcagccacgac

SEQ ID NO: 573540 - DNA, 25 bp, Mus musculus
cagtgactctcgaccttctggaaga

SEQ ID NO: 573541 - DNA, 25 bp, Mus musculus
cagtgactctcgtccttctggaaga

SEQ ID NO: 573542 - DNA, 25 bp, Mus musculus
cagtgactctgccagagatgaggtg

SEQ ID NO: 573543 - DNA, 25 bp, Mus musculus
cagtgactctgcgagagatgaggtg

SEQ ID NO: 573544 - DNA, 25 bp, Mus musculus
cagtgactcttacccacatggatgg

SEQ ID NO: 573545 - DNA, 25 bp, Mus musculus
cagtgactcttagccacatggatgg

SEQ ID NO: 573546 - DNA, 25 bp, Mus musculus
cagtgactgacaagaagttactccc

SEQ ID NO: 573547 - DNA, 25 bp, Mus musculus
cagtgactgacatgaagttactccc

SEQ ID NO: 573548 - DNA, 25 bp, Mus musculus
cagtgactgtcaagacctctggctc

SEQ ID NO: 573549 - DNA, 25 bp, Mus musculus
cagtgactgtcatgacctctggctc

SEQ ID NO: 573550 - DNA, 25 bp, Mus musculus
cagtgacttaggatctaatgggaca

SEQ ID NO: 573551 - DNA, 25 bp, Mus musculus
cagtgacttaggttctaatgggaca

SEQ ID NO: 573552 - DNA, 25 bp, Mus musculus
cagtgacttcgtagagtgccaaagc

SEQ ID NO: 573553 - DNA, 25 bp, Mus musculus
cagtgacttcgttgagtgccaaagc

SEQ ID NO: 573554 - DNA, 25 bp, Mus musculus
cagtgactttggaatgtctcggcaa

SEQ ID NO: 573555 - DNA, 25 bp, Mus musculus
cagtgactttggtatgtctcggcaa

SEQ ID NO: 573556 - DNA, 25 bp, Mus musculus
cagtgagaaaaacaccggaggtagc

SEQ ID NO: 573557 - DNA, 25 bp, Mus musculus
cagtgagaaaaagaccggaggtagc

SEQ ID NO: 573558 - DNA, 25 bp, Mus musculus
cagtgagaaactctccatctacgac

SEQ ID NO: 573559 - DNA, 25 bp, Mus musculus
cagtgagaaactgtccatctacgac

SEQ ID NO: 573560 - DNA, 25 bp, Mus musculus
cagtgagaagcaaaaatccaggacc

SEQ ID NO: 573561 - DNA, 25 bp, Mus musculus
cagtgagaagcataaatccaggacc

SEQ ID NO: 573562 - DNA, 25 bp, Mus musculus
cagtgagaaggcatttggagtcctc

SEQ ID NO: 573563 - DNA, 25 bp, Mus musculus
cagtgagaaggcttttggagtcctc

SEQ ID NO: 573564 - DNA, 25 bp, Mus musculus
cagtgagaagtcatcccgggcagcc

SEQ ID NO: 573565 - DNA, 25 bp, Mus musculus
cagtgagaagtcttcccgggcagcc

SEQ ID NO: 573566 - DNA, 25 bp, Mus musculus
cagtgagaatctccgagctggcatt

SEQ ID NO: 573567 - DNA, 25 bp, Mus musculus
cagtgagaatctgcgagctggcatt

SEQ ID NO: 573568 - DNA, 25 bp, Mus musculus
cagtgagacggaccccgaagacaaa

SEQ ID NO: 573569 - DNA, 25 bp, Mus musculus
cagtgagacggagcccgaagacaaa

SEQ ID NO: 573570 - DNA, 25 bp, Mus musculus
cagtgagactctatcgggaaacaaa

SEQ ID NO: 573571 - DNA, 25 bp, Mus musculus
cagtgagactctttcgggaaacaaa

SEQ ID NO: 573572 - DNA, 25 bp, Mus musculus
cagtgagagcacagacttggaaaca

SEQ ID NO: 573573 - DNA, 25 bp, Mus musculus
cagtgagagcactgacttggaaaca

SEQ ID NO: 573574 - DNA, 25 bp, Mus musculus
cagtgagagccaaccagagctgctt

SEQ ID NO: 573575 - DNA, 25 bp, Mus musculus
cagtgagagccatccagagctgctt

SEQ ID NO: 573576 - DNA, 25 bp, Mus musculus
cagtgagaggaaccgtatctatatc

SEQ ID NO: 573577 - DNA, 25 bp, Mus musculus
cagtgagaggaagcgtatctatatc

SEQ ID NO: 573578 - DNA, 25 bp, Mus musculus
cagtgagagtctcagcattgagaac

SEQ ID NO: 573579 - DNA, 25 bp, Mus musculus
cagtgagagtctgagcattgagaac

SEQ ID NO: 573580 - DNA, 25 bp, Mus musculus
cagtgagatgcaagagaacaaaaag

SEQ ID NO: 573581 - DNA, 25 bp, Mus musculus
cagtgagatgcatgagaacaaaaag

SEQ ID NO: 573582 - DNA, 25 bp, Mus musculus
cagtgagattgtcctgtctatacca

SEQ ID NO: 573583 - DNA, 25 bp, Mus musculus
cagtgagattgtgctgtctatacca

SEQ ID NO: 573584 - DNA, 25 bp, Mus musculus
cagtgagcaccaactgaaggctttt

SEQ ID NO: 573585 - DNA, 25 bp, Mus musculus
cagtgagcaccatctgaaggctttt

SEQ ID NO: 573586 - DNA, 25 bp, Mus musculus
cagtgagcaggccaaagtccattcc

SEQ ID NO: 573587 - DNA, 25 bp, Mus musculus
cagtgagcaggcgaaagtccattcc

SEQ ID NO: 573588 - DNA, 25 bp, Mus musculus
cagtgagcagtaagcctcctgaagt

SEQ ID NO: 573589 - DNA, 25 bp, Mus musculus
cagtgagcagtatgcctcctgaagt

SEQ ID NO: 573590 - DNA, 25 bp, Mus musculus
cagtgagccgctcggccgcaaaagc

SEQ ID NO: 573591 - DNA, 25 bp, Mus musculus
cagtgagccgctgggccgcaaaagc

SEQ ID NO: 573592 - DNA, 25 bp, Mus musculus
cagtgagcgagcctctcagtcattg

SEQ ID NO: 573593 - DNA, 25 bp, Mus musculus
cagtgagcgagcgtctcagtcattg

SEQ ID NO: 573594 - DNA, 25 bp, Mus musculus
cagtgagctggccacagtccacaac

SEQ ID NO: 573595 - DNA, 25 bp, Mus musculus
cagtgagctggcgacagtccacaac

SEQ ID NO: 573596 - DNA, 25 bp, Mus musculus
cagtgagcttcgatcgctggaatgt

SEQ ID NO: 573597 - DNA, 25 bp, Mus musculus
cagtgagcttcgttcgctggaatgt

SEQ ID NO: 573598 - DNA, 25 bp, Mus musculus
cagtgaggaaacctcgagagacttt

SEQ ID NO: 573599 - DNA, 25 bp, Mus musculus
cagtgaggaaacgtcgagagacttt

SEQ ID NO: 573600 - DNA, 25 bp, Mus musculus
cagtgaggaaccaacgtaaactctt

SEQ ID NO: 573601 - DNA, 25 bp, Mus musculus
cagtgaggaacctacgtaaactctt

SEQ ID NO: 573602 - DNA, 25 bp, Mus musculus
cagtgaggacgaaggactctatgaa

SEQ ID NO: 573603 - DNA, 25 bp, Mus musculus
cagtgaggacgatggactctatgaa

SEQ ID NO: 573604 - DNA, 25 bp, Mus musculus
cagtgaggagcactatctatggtcg

SEQ ID NO: 573605 - DNA, 25 bp, Mus musculus
cagtgaggagcagtatctatggtcg

SEQ ID NO: 573606 - DNA, 25 bp, Mus musculus
cagtgaggagtcagggaccacagat

SEQ ID NO: 573607 - DNA, 25 bp, Mus musculus
cagtgaggagtctgggaccacagat

SEQ ID NO: 573608 - DNA, 25 bp, Mus musculus
cagtgaggattcagaagacaccgac

SEQ ID NO: 573609 - DNA, 25 bp, Mus musculus
cagtgaggattcagcctcttgaaga

SEQ ID NO: 573610 - DNA, 25 bp, Mus musculus
cagtgaggattctgaagacaccgac

SEQ ID NO: 573611 - DNA, 25 bp, Mus musculus
cagtgaggattctgcctcttgaaga

SEQ ID NO: 573612 - DNA, 25 bp, Mus musculus
cagtgaggcccacgctcgaccagat

SEQ ID NO: 573613 - DNA, 25 bp, Mus musculus
cagtgaggcccaggctcgaccagat

SEQ ID NO: 573614 - DNA, 25 bp, Mus musculus
cagtgaggctatagctaccctggct

SEQ ID NO: 573615 - DNA, 25 bp, Mus musculus
cagtgaggctattgctaccctggct

SEQ ID NO: 573616 - DNA, 25 bp, Mus musculus
cagtgaggctctagggtgcaccctg

SEQ ID NO: 573617 - DNA, 25 bp, Mus musculus
cagtgaggctcttgggtgcaccctg

SEQ ID NO: 573618 - DNA, 25 bp, Mus musculus
cagtgaggctgtcactccagaagac

SEQ ID NO: 573619 - DNA, 25 bp, Mus musculus
cagtgaggctgtgactccagaagac

SEQ ID NO: 573620 - DNA, 25 bp, Mus musculus
cagtgaggcttgagtcttgcataac

SEQ ID NO: 573621 - DNA, 25 bp, Mus musculus
cagtgaggcttgtgtcttgcataac

SEQ ID NO: 573622 - DNA, 25 bp, Mus musculus
cagtgaggtcttcggttttgcttgc

SEQ ID NO: 573623 - DNA, 25 bp, Mus musculus
cagtgaggtcttgggttttgcttgc

SEQ ID NO: 573624 - DNA, 25 bp, Mus musculus
cagtgaggtgctatccgacatgaca

SEQ ID NO: 573625 - DNA, 25 bp, Mus musculus
cagtgaggtgctttccgacatgaca

SEQ ID NO: 573626 - DNA, 25 bp, Mus musculus
cagtgaggtttacaaggccacttgc

SEQ ID NO: 573627 - DNA, 25 bp, Mus musculus
cagtgaggtttagaaggccacttgc

SEQ ID NO: 573628 - DNA, 25 bp, Mus musculus
cagtgagtaaccacgtgtacctgga

SEQ ID NO: 573629 - DNA, 25 bp, Mus musculus
cagtgagtaacctcgtgtacctgga

SEQ ID NO: 573630 - DNA, 25 bp, Mus musculus
cagtgagtaccactctgtgaagcta

SEQ ID NO: 573631 - DNA, 25 bp, Mus musculus
cagtgagtaccagtctgtgaagcta

SEQ ID NO: 573632 - DNA, 25 bp, Mus musculus
cagtgagtaccgctggcacatcaac

SEQ ID NO: 573633 - DNA, 25 bp, Mus musculus
cagtgagtaccggtggcacatcaac

SEQ ID NO: 573634 - DNA, 25 bp, Mus musculus
cagtgagtcagaaaccagtcagtac

SEQ ID NO: 573635 - DNA, 25 bp, Mus musculus
cagtgagtcagataccagtcagtac

SEQ ID NO: 573636 - DNA, 25 bp, Mus musculus
cagtgagtcggtctgccagctcttc

SEQ ID NO: 573637 - DNA, 25 bp, Mus musculus
cagtgagtcggtgtgccagctcttc

SEQ ID NO: 573638 - DNA, 25 bp, Mus musculus
cagtgagtgctgcagagatatctta

SEQ ID NO: 573639 - DNA, 25 bp, Mus musculus
cagtgagtgctggagagatatctta

SEQ ID NO: 573640 - DNA, 25 bp, Mus musculus
cagtgagtggtcacgttagcagcca

SEQ ID NO: 573641 - DNA, 25 bp, Mus musculus
cagtgagtggtctcgttagcagcca

SEQ ID NO: 573642 - DNA, 25 bp, Mus musculus
cagtgagtgtcgaagctctaggttt

SEQ ID NO: 573643 - DNA, 25 bp, Mus musculus
cagtgagtgtcgtagctctaggttt

SEQ ID NO: 573644 - DNA, 25 bp, Mus musculus
cagtgagtgttgctcatgtgcagcc

SEQ ID NO: 573645 - DNA, 25 bp, Mus musculus
cagtgagtgttggtcatgtgcagcc

SEQ ID NO: 573646 - DNA, 25 bp, Mus musculus
cagtgagtgtttctccagttgccat

SEQ ID NO: 573647 - DNA, 25 bp, Mus musculus
cagtgagtgtttgtccagttgccat

SEQ ID NO: 573648 - DNA, 25 bp, Mus musculus
cagtgagttcaaatttgtaagggcc

SEQ ID NO: 573649 - DNA, 25 bp, Mus musculus
cagtgagttcaattttgtaagggcc

SEQ ID NO: 573650 - DNA, 25 bp, Mus musculus
cagtgataaatgagtcgaacctcca

SEQ ID NO: 573651 - DNA, 25 bp, Mus musculus
cagtgataaatgtgtcgaacctcca

SEQ ID NO: 573652 - DNA, 25 bp, Mus musculus
cagtgatacttaagcccctgggaca

SEQ ID NO: 573653 - DNA, 25 bp, Mus musculus
cagtgatacttatgcccctgggaca

SEQ ID NO: 573654 - DNA, 25 bp, Mus musculus
cagtgatcagataccggcaggatga

SEQ ID NO: 573655 - DNA, 25 bp, Mus musculus
cagtgatcagattccggcaggatga

SEQ ID NO: 573656 - DNA, 25 bp, Mus musculus
cagtgatcatgacgcgaaccttccc

SEQ ID NO: 573657 - DNA, 25 bp, Mus musculus
cagtgatcatgaggcgaaccttccc

SEQ ID NO: 573658 - DNA, 25 bp, Mus musculus
cagtgatccaggcagctttcaccag

SEQ ID NO: 573659 - DNA, 25 bp, Mus musculus
cagtgatccagggagctttcaccag

SEQ ID NO: 573660 - DNA, 25 bp, Mus musculus
cagtgatccggtctctcttgcgtca

SEQ ID NO: 573661 - DNA, 25 bp, Mus musculus
cagtgatccggtgtctcttgcgtca

SEQ ID NO: 573662 - DNA, 25 bp, Mus musculus
cagtgatcctccctttgaagtgcgt

SEQ ID NO: 573663 - DNA, 25 bp, Mus musculus
cagtgatcctccgtttgaagtgcgt

SEQ ID NO: 573664 - DNA, 25 bp, Mus musculus
cagtgatcgggcacaatgactccgg

SEQ ID NO: 573665 - DNA, 25 bp, Mus musculus
cagtgatcgggctcaatgactccgg

SEQ ID NO: 573666 - DNA, 25 bp, Mus musculus
cagtgatcttggcacatgaaggtgc

SEQ ID NO: 573667 - DNA, 25 bp, Mus musculus
cagtgatcttgggacatgaaggtgc

SEQ ID NO: 573668 - DNA, 25 bp, Mus musculus
cagtgatgaagaaggacggcatgac

SEQ ID NO: 573669 - DNA, 25 bp, Mus musculus
cagtgatgaagatggacggcatgac

SEQ ID NO: 573670 - DNA, 25 bp, Mus musculus
cagtgatgacacagatctgcagatc

SEQ ID NO: 573671 - DNA, 25 bp, Mus musculus
cagtgatgacactgatctgcagatc

SEQ ID NO: 573672 - DNA, 25 bp, Mus musculus
cagtgatgacctattccgcttttcc

SEQ ID NO: 573673 - DNA, 25 bp, Mus musculus
cagtgatgaccttttccgcttttcc

SEQ ID NO: 573674 - DNA, 25 bp, Mus musculus
cagtgatgagatcgcccagcatgca

SEQ ID NO: 573675 - DNA, 25 bp, Mus musculus
cagtgatgagatggcccagcatgca

SEQ ID NO: 573676 - DNA, 25 bp, Mus musculus
cagtgatgatgtatctgtcactagg

SEQ ID NO: 573677 - DNA, 25 bp, Mus musculus
cagtgatgatgtttctgtcactagg

SEQ ID NO: 573678 - DNA, 25 bp, Mus musculus
cagtgatgcaggctcctaccgctgc

SEQ ID NO: 573679 - DNA, 25 bp, Mus musculus
cagtgatgcagggtcctaccgctgc

SEQ ID NO: 573680 - DNA, 25 bp, Mus musculus
cagtgatgcagtcctggtcaacgcc

SEQ ID NO: 573681 - DNA, 25 bp, Mus musculus
cagtgatgcagtgctggtcaacgcc

SEQ ID NO: 573682 - DNA, 25 bp, Mus musculus
cagtgatgctgtctggcaactcaga

SEQ ID NO: 573683 - DNA, 25 bp, Mus musculus
cagtgatgctgtgtggcaactcaga

SEQ ID NO: 573684 - DNA, 25 bp, Mus musculus
cagtgatgcttcaagtgttaaaggg

SEQ ID NO: 573685 - DNA, 25 bp, Mus musculus
cagtgatgcttctagtgttaaaggg

SEQ ID NO: 573686 - DNA, 25 bp, Mus musculus
cagtgatggaacagacacctgagca

SEQ ID NO: 573687 - DNA, 25 bp, Mus musculus
cagtgatggaactgacacctgagca

SEQ ID NO: 573688 - DNA, 25 bp, Mus musculus
cagtgatggcataaggaccttaata

SEQ ID NO: 573689 - DNA, 25 bp, Mus musculus
cagtgatggcattaggaccttaata

SEQ ID NO: 573690 - DNA, 25 bp, Mus musculus
cagtgatggctaaattgaggactac

SEQ ID NO: 573691 - DNA, 25 bp, Mus musculus
cagtgatggctatattgaggactac

SEQ ID NO: 573692 - DNA, 25 bp, Mus musculus
cagtgatggctgatgtactgcaggc

SEQ ID NO: 573693 - DNA, 25 bp, Mus musculus
cagtgatggctgttgtactgcaggc

SEQ ID NO: 573694 - DNA, 25 bp, Mus musculus
cagtgatggtgaccctggacctaaa

SEQ ID NO: 573695 - DNA, 25 bp, Mus musculus
cagtgatggtgagcctggacctaaa

SEQ ID NO: 573696 - DNA, 25 bp, Mus musculus
cagtgatgttgcattggacatttta

SEQ ID NO: 573697 - DNA, 25 bp, Mus musculus
cagtgatgttgctttggacatttta

SEQ ID NO: 573698 - DNA, 25 bp, Mus musculus
cagtgattatcaccaggagtcctac

SEQ ID NO: 573699 - DNA, 25 bp, Mus musculus
cagtgattatcagcaggagtcctac

SEQ ID NO: 573700 - DNA, 25 bp, Mus musculus
cagtgattatggcatctatacaatg

SEQ ID NO: 573701 - DNA, 25 bp, Mus musculus
cagtgattatgggatctatacaatg

SEQ ID NO: 573702 - DNA, 25 bp, Mus musculus
cagtgattcaacagctctggtcgag

SEQ ID NO: 573703 - DNA, 25 bp, Mus musculus
cagtgattcaactgctctggtcgag

SEQ ID NO: 573704 - DNA, 25 bp, Mus musculus
cagtgattcgggagtacaggccctc

SEQ ID NO: 573705 - DNA, 25 bp, Mus musculus
cagtgattcgggtgtacaggccctc

SEQ ID NO: 573706 - DNA, 25 bp, Mus musculus
cagtgatttgaactaggcattggac

SEQ ID NO: 573707 - DNA, 25 bp, Mus musculus
cagtgatttgaagtaggcattggac

SEQ ID NO: 573708 - DNA, 25 bp, Mus musculus
cagtgatttttgaaccagatgcaat

SEQ ID NO: 573709 - DNA, 25 bp, Mus musculus
cagtgatttttgtaccagatgcaat

SEQ ID NO: 573710 - DNA, 25 bp, Mus musculus
cagtgcaaagcaatgtttcacatta

SEQ ID NO: 573711 - DNA, 25 bp, Mus musculus
cagtgcaaagcattgtttcacatta

SEQ ID NO: 573712 - DNA, 25 bp, Mus musculus
cagtgcaaccctacccagatctgta

SEQ ID NO: 573713 - DNA, 25 bp, Mus musculus
cagtgcaacccttcccagatctgta

SEQ ID NO: 573714 - DNA, 25 bp, Mus musculus
cagtgcaagcgtctagggacacagt

SEQ ID NO: 573715 - DNA, 25 bp, Mus musculus
cagtgcaagcgtgtagggacacagt

SEQ ID NO: 573716 - DNA, 25 bp, Mus musculus
cagtgcaatgatctccgagtcaacc

SEQ ID NO: 573717 - DNA, 25 bp, Mus musculus
cagtgcaatgatgtccgagtcaacc

SEQ ID NO: 573718 - DNA, 25 bp, Mus musculus
cagtgcacaaatcgccgctgcatta

SEQ ID NO: 573719 - DNA, 25 bp, Mus musculus
cagtgcacaaatggccgctgcatta

SEQ ID NO: 573720 - DNA, 25 bp, Mus musculus
cagtgcacacaacccgatcaggagt

SEQ ID NO: 573721 - DNA, 25 bp, Mus musculus
cagtgcacacaagccgatcaggagt

SEQ ID NO: 573722 - DNA, 25 bp, Mus musculus
cagtgcacatgtattgatggcgccg

SEQ ID NO: 573723 - DNA, 25 bp, Mus musculus
cagtgcacatgttttgatggcgccg

SEQ ID NO: 573724 - DNA, 25 bp, Mus musculus
cagtgcaccagaagtgaaaaggact

SEQ ID NO: 573725 - DNA, 25 bp, Mus musculus
cagtgcaccagatgtgaaaaggact

SEQ ID NO: 573726 - DNA, 25 bp, Mus musculus
cagtgcaccatgagtaaacgtgaat

SEQ ID NO: 573727 - DNA, 25 bp, Mus musculus
cagtgcaccatgtgtaaacgtgaat

SEQ ID NO: 573728 - DNA, 25 bp, Mus musculus
cagtgcaccccgagacctttttgac

SEQ ID NO: 573729 - DNA, 25 bp, Mus musculus
cagtgcaccccgtgacctttttgac

SEQ ID NO: 573730 - DNA, 25 bp, Mus musculus
cagtgcaccctgctaagacttcaat

SEQ ID NO: 573731 - DNA, 25 bp, Mus musculus
cagtgcaccctggtaagacttcaat

SEQ ID NO: 573732 - DNA, 25 bp, Mus musculus
cagtgcacccttcgaggcgcctgag

SEQ ID NO: 573733 - DNA, 25 bp, Mus musculus
cagtgcacccttggaggcgcctgag

SEQ ID NO: 573734 - DNA, 25 bp, Mus musculus
cagtgcacgccgcaagttgtagtcc

SEQ ID NO: 573735 - DNA, 25 bp, Mus musculus
cagtgcacgccggaagttgtagtcc

SEQ ID NO: 573736 - DNA, 25 bp, Mus musculus
cagtgcactcacagatgagaagaca

SEQ ID NO: 573737 - DNA, 25 bp, Mus musculus
cagtgcactcactgatgagaagaca

SEQ ID NO: 573738 - DNA, 25 bp, Mus musculus
cagtgcagaattattggaacaacat

SEQ ID NO: 573739 - DNA, 25 bp, Mus musculus
cagtgcagaatttttggaacaacat

SEQ ID NO: 573740 - DNA, 25 bp, Mus musculus
cagtgcagactgcattgaggagccc

SEQ ID NO: 573741 - DNA, 25 bp, Mus musculus
cagtgcagactggattgaggagccc

SEQ ID NO: 573742 - DNA, 25 bp, Mus musculus
cagtgcagagcgcaatgacgataaa

SEQ ID NO: 573743 - DNA, 25 bp, Mus musculus
cagtgcagagcggaatgacgataaa

SEQ ID NO: 573744 - DNA, 25 bp, Mus musculus
cagtgcagatgccaacatccaggac

SEQ ID NO: 573745 - DNA, 25 bp, Mus musculus
cagtgcagatgcgaacatccaggac

SEQ ID NO: 573746 - DNA, 25 bp, Mus musculus
cagtgcagatgtctccttctttttc

SEQ ID NO: 573747 - DNA, 25 bp, Mus musculus
cagtgcagatgtgtccttctttttc

SEQ ID NO: 573748 - DNA, 25 bp, Mus musculus
cagtgcagccgaacctgaagttcaa

SEQ ID NO: 573749 - DNA, 25 bp, Mus musculus
cagtgcagccgatcctgaagttcaa

SEQ ID NO: 573750 - DNA, 25 bp, Mus musculus
cagtgcagcgtaagagagacgattc

SEQ ID NO: 573751 - DNA, 25 bp, Mus musculus
cagtgcagcgtatgagagacgattc

SEQ ID NO: 573752 - DNA, 25 bp, Mus musculus
cagtgcaggcagcacagtctgccca

SEQ ID NO: 573753 - DNA, 25 bp, Mus musculus
cagtgcaggcaggacagtctgccca

SEQ ID NO: 573754 - DNA, 25 bp, Mus musculus
cagtgcaggtttccaccatcccata

SEQ ID NO: 573755 - DNA, 25 bp, Mus musculus
cagtgcaggtttgcaccatcccata

SEQ ID NO: 573756 - DNA, 25 bp, Mus musculus
cagtgcagtgagactttcccaacag

SEQ ID NO: 573757 - DNA, 25 bp, Mus musculus
cagtgcagtgagtctttcccaacag

SEQ ID NO: 573758 - DNA, 25 bp, Mus musculus
cagtgcagtgtcaccaagagggaaa

SEQ ID NO: 573759 - DNA, 25 bp, Mus musculus
cagtgcagtgtctccaagagggaaa

SEQ ID NO: 573760 - DNA, 25 bp, Mus musculus
cagtgcagttatcaaagctgggtat

SEQ ID NO: 573761 - DNA, 25 bp, Mus musculus
cagtgcagttatgaaagctgggtat

SEQ ID NO: 573762 - DNA, 25 bp, Mus musculus
cagtgcagttctaaaaggatctcca

SEQ ID NO: 573763 - DNA, 25 bp, Mus musculus
cagtgcagttcttaaaggatctcca

SEQ ID NO: 573764 - DNA, 25 bp, Mus musculus
cagtgcatccacagtactgagcagt

SEQ ID NO: 573765 - DNA, 25 bp, Mus musculus
cagtgcatccactgtactgagcagt

SEQ ID NO: 573766 - DNA, 25 bp, Mus musculus
cagtgcatcggaatcttggtttcaa

SEQ ID NO: 573767 - DNA, 25 bp, Mus musculus
cagtgcatcggattcttggtttcaa

SEQ ID NO: 573768 - DNA, 25 bp, Mus musculus
cagtgcatgctcatcaggagggaga

SEQ ID NO: 573769 - DNA, 25 bp, Mus musculus
cagtgcatgctcttcaggagggaga

SEQ ID NO: 573770 - DNA, 25 bp, Mus musculus
cagtgcatgtccctggagaccgtca

SEQ ID NO: 573771 - DNA, 25 bp, Mus musculus
cagtgcatgtccgtggagaccgtca

SEQ ID NO: 573772 - DNA, 25 bp, Mus musculus
cagtgcattcccatcaacctaaaaa

SEQ ID NO: 573773 - DNA, 25 bp, Mus musculus
cagtgcattcccttcaacctaaaaa

SEQ ID NO: 573774 - DNA, 25 bp, Mus musculus
cagtgcattgcacaatcatggatga

SEQ ID NO: 573775 - DNA, 25 bp, Mus musculus
cagtgcattgcagaatcatggatga

SEQ ID NO: 573776 - DNA, 25 bp, Mus musculus
cagtgccaacgacgacatgcctgta

SEQ ID NO: 573777 - DNA, 25 bp, Mus musculus
cagtgccaacgaggacatgcctgta

SEQ ID NO: 573778 - DNA, 25 bp, Mus musculus
cagtgccaacggcagcaacagtatt

SEQ ID NO: 573779 - DNA, 25 bp, Mus musculus
cagtgccaacgggagcaacagtatt

SEQ ID NO: 573780 - DNA, 25 bp, Mus musculus
cagtgccaatgacaaaggcttgtac

SEQ ID NO: 573781 - DNA, 25 bp, Mus musculus
cagtgccaatgagaaaggcttgtac

SEQ ID NO: 573782 - DNA, 25 bp, Mus musculus
cagtgccacaaacagggatgggcca

SEQ ID NO: 573783 - DNA, 25 bp, Mus musculus
cagtgccacaaagagggatgggcca

SEQ ID NO: 573784 - DNA, 25 bp, Mus musculus
cagtgccacgtgatcccacagatgt

SEQ ID NO: 573785 - DNA, 25 bp, Mus musculus
cagtgccacgtgttcccacagatgt

SEQ ID NO: 573786 - DNA, 25 bp, Mus musculus
cagtgccagcagctcttgagttcaa

SEQ ID NO: 573787 - DNA, 25 bp, Mus musculus
cagtgccagcaggtcttgagttcaa

SEQ ID NO: 573788 - DNA, 25 bp, Mus musculus
cagtgccaggttccgtatcctccaa

SEQ ID NO: 573789 - DNA, 25 bp, Mus musculus
cagtgccaggttgcgtatcctccaa

SEQ ID NO: 573790 - DNA, 25 bp, Mus musculus
cagtgccatgcccaagtgatgagga

SEQ ID NO: 573791 - DNA, 25 bp, Mus musculus
cagtgccatgccgaagtgatgagga

SEQ ID NO: 573792 - DNA, 25 bp, Mus musculus
cagtgccatgtgacctttcggttgc

SEQ ID NO: 573793 - DNA, 25 bp, Mus musculus
cagtgccatgtgtcctttcggttgc

SEQ ID NO: 573794 - DNA, 25 bp, Mus musculus
cagtgccattacacaaggcagttga

SEQ ID NO: 573795 - DNA, 25 bp, Mus musculus
cagtgccattactcaaggcagttga

SEQ ID NO: 573796 - DNA, 25 bp, Mus musculus
cagtgcccacttcctatattgataa

SEQ ID NO: 573797 - DNA, 25 bp, Mus musculus
cagtgcccacttgctatattgataa

SEQ ID NO: 573798 - DNA, 25 bp, Mus musculus
cagtgcccagcccacctgtgattat

SEQ ID NO: 573799 - DNA, 25 bp, Mus musculus
cagtgcccagccgacctgtgattat

SEQ ID NO: 573800 - DNA, 25 bp, Mus musculus
cagtgcccgactacacagagtgaga

SEQ ID NO: 573801 - DNA, 25 bp, Mus musculus
cagtgcccgacttcacagagtgaga

SEQ ID NO: 573802 - DNA, 25 bp, Mus musculus
cagtgcccgtaaaagcaccactact

SEQ ID NO: 573803 - DNA, 25 bp, Mus musculus
cagtgcccgtaatagcaccactact

SEQ ID NO: 573804 - DNA, 25 bp, Mus musculus
cagtgccctattctgtcctctggca

SEQ ID NO: 573805 - DNA, 25 bp, Mus musculus
cagtgccctattgtgtcctctggca

SEQ ID NO: 573806 - DNA, 25 bp, Mus musculus
cagtgccctcgacgtcggaggcctt

SEQ ID NO: 573807 - DNA, 25 bp, Mus musculus
cagtgccctcgaggtcggaggcctt

SEQ ID NO: 573808 - DNA, 25 bp, Mus musculus
cagtgccctcttatggtcttcccag

SEQ ID NO: 573809 - DNA, 25 bp, Mus musculus
cagtgccctcttttggtcttcccag

SEQ ID NO: 573810 - DNA, 25 bp, Mus musculus
cagtgccctgcaccaagattgatta

SEQ ID NO: 573811 - DNA, 25 bp, Mus musculus
cagtgccctgcagcaagattgatta

SEQ ID NO: 573812 - DNA, 25 bp, Mus musculus
cagtgccgaacacgtctttactact

SEQ ID NO: 573813 - DNA, 25 bp, Mus musculus
cagtgccgaacaggtctttactact

SEQ ID NO: 573814 - DNA, 25 bp, Mus musculus
cagtgccgccttagtaccatggcta

SEQ ID NO: 573815 - DNA, 25 bp, Mus musculus
cagtgccgcctttgtaccatggcta

SEQ ID NO: 573816 - DNA, 25 bp, Mus musculus
cagtgccgcgacagctgtagtggtt

SEQ ID NO: 573817 - DNA, 25 bp, Mus musculus
cagtgccgcgactgctgtagtggtt

SEQ ID NO: 573818 - DNA, 25 bp, Mus musculus
cagtgccgggacaccgagccctgtt

SEQ ID NO: 573819 - DNA, 25 bp, Mus musculus
cagtgccgggactccgagccctgtt

SEQ ID NO: 573820 - DNA, 25 bp, Mus musculus
cagtgccgtggtatcaattccaatg

SEQ ID NO: 573821 - DNA, 25 bp, Mus musculus
cagtgccgtggtttcaattccaatg

SEQ ID NO: 573822 - DNA, 25 bp, Mus musculus
cagtgcctatttcaacatgtttgaa

SEQ ID NO: 573823 - DNA, 25 bp, Mus musculus
cagtgcctatttgaacatgtttgaa

SEQ ID NO: 573824 - DNA, 25 bp, Mus musculus
cagtgcctcaataaaacagctcagt

SEQ ID NO: 573825 - DNA, 25 bp, Mus musculus
cagtgcctcaattaaacagctcagt

SEQ ID NO: 573826 - DNA, 25 bp, Mus musculus
cagtgcctcagtactggaagccctg

SEQ ID NO: 573827 - DNA, 25 bp, Mus musculus
cagtgcctcagttctggaagccctg

SEQ ID NO: 573828 - DNA, 25 bp, Mus musculus
cagtgcctgaatctctggctgacta

SEQ ID NO: 573829 - DNA, 25 bp, Mus musculus
cagtgcctgaatgtctggctgacta

SEQ ID NO: 573830 - DNA, 25 bp, Mus musculus
cagtgcctgcgcatgtttgtgcctc

SEQ ID NO: 573831 - DNA, 25 bp, Mus musculus
cagtgcctgcgcttgtttgtgcctc

SEQ ID NO: 573832 - DNA, 25 bp, Mus musculus
cagtgcctggccacgatgtggaagc

SEQ ID NO: 573833 - DNA, 25 bp, Mus musculus
cagtgcctggcctcgatgtggaagc

SEQ ID NO: 573834 - DNA, 25 bp, Mus musculus
cagtgcctgtgacatagcttagcaa

SEQ ID NO: 573835 - DNA, 25 bp, Mus musculus
cagtgcctgtgagatagcttagcaa

SEQ ID NO: 573836 - DNA, 25 bp, Mus musculus
cagtgcctgtttcggccacttcaga

SEQ ID NO: 573837 - DNA, 25 bp, Mus musculus
cagtgcctgtttgggccacttcaga

SEQ ID NO: 573838 - DNA, 25 bp, Mus musculus
cagtgccttaagagtggatagccca

SEQ ID NO: 573839 - DNA, 25 bp, Mus musculus
cagtgccttaagtgtggatagccca

SEQ ID NO: 573840 - DNA, 25 bp, Mus musculus
cagtgccttatacaccatgatgaag

SEQ ID NO: 573841 - DNA, 25 bp, Mus musculus
cagtgccttatagaccatgatgaag

SEQ ID NO: 573842 - DNA, 25 bp, Mus musculus
cagtgccttccgagggagccaggct

SEQ ID NO: 573843 - DNA, 25 bp, Mus musculus
cagtgccttccgtgggagccaggct

SEQ ID NO: 573844 - DNA, 25 bp, Mus musculus
cagtgccttcgtcggtctgtccttc

SEQ ID NO: 573845 - DNA, 25 bp, Mus musculus
cagtgccttcgtgggtctgtccttc

SEQ ID NO: 573846 - DNA, 25 bp, Mus musculus
cagtgcgagcgcctcatggagaccg

SEQ ID NO: 573847 - DNA, 25 bp, Mus musculus
cagtgcgagcgcgtcatggagaccg

SEQ ID NO: 573848 - DNA, 25 bp, Mus musculus
cagtgcgatacactgatgattcaga

SEQ ID NO: 573849 - DNA, 25 bp, Mus musculus
cagtgcgatacagtgatgattcaga

SEQ ID NO: 573850 - DNA, 25 bp, Mus musculus
cagtgcgccgacctcaataaggaag

SEQ ID NO: 573851 - DNA, 25 bp, Mus musculus
cagtgcgccgacgtcaataaggaag

SEQ ID NO: 573852 - DNA, 25 bp, Mus musculus
cagtgcgctcaactcagtggtggcc

SEQ ID NO: 573853 - DNA, 25 bp, Mus musculus
cagtgcgctcaagtcagtggtggcc

SEQ ID NO: 573854 - DNA, 25 bp, Mus musculus
cagtgcgctggacaccaccgttaat

SEQ ID NO: 573855 - DNA, 25 bp, Mus musculus
cagtgcgctggagaccaccgttaat

SEQ ID NO: 573856 - DNA, 25 bp, Mus musculus
cagtgcggcaaactgttcaggcgaa

SEQ ID NO: 573857 - DNA, 25 bp, Mus musculus
cagtgcggcaaagtgttcaggcgaa

SEQ ID NO: 573858 - DNA, 25 bp, Mus musculus
cagtgcgggacgatggcttgaattc

SEQ ID NO: 573859 - DNA, 25 bp, Mus musculus
cagtgcgggacgttggcttgaattc

SEQ ID NO: 573860 - DNA, 25 bp, Mus musculus
cagtgcgttccaattgtggcttttc

SEQ ID NO: 573861 - DNA, 25 bp, Mus musculus
cagtgcgttccatttgtggcttttc

SEQ ID NO: 573862 - DNA, 25 bp, Mus musculus
cagtgctaaaggaattggcaagaga

SEQ ID NO: 573863 - DNA, 25 bp, Mus musculus
cagtgctaaaggtattggcaagaga

SEQ ID NO: 573864 - DNA, 25 bp, Mus musculus
cagtgctaacccaaaaatgaaggct

SEQ ID NO: 573865 - DNA, 25 bp, Mus musculus
cagtgctaaccctaaaatgaaggct

SEQ ID NO: 573866 - DNA, 25 bp, Mus musculus
cagtgctaagtgcacgcagaggttc

SEQ ID NO: 573867 - DNA, 25 bp, Mus musculus
cagtgctaagtggacgcagaggttc

SEQ ID NO: 573868 - DNA, 25 bp, Mus musculus
cagtgctacggaccccaaggccatt

SEQ ID NO: 573869 - DNA, 25 bp, Mus musculus
cagtgctacggagcccaaggccatt

SEQ ID NO: 573870 - DNA, 25 bp, Mus musculus
cagtgctagccaagcatgaggaaag

SEQ ID NO: 573871 - DNA, 25 bp, Mus musculus
cagtgctagccatgcatgaggaaag

SEQ ID NO: 573872 - DNA, 25 bp, Mus musculus
cagtgctagccccatagtcgtggac

SEQ ID NO: 573873 - DNA, 25 bp, Mus musculus
cagtgctagcccgatagtcgtggac

SEQ ID NO: 573874 - DNA, 25 bp, Mus musculus
cagtgctatgatacacaggcagata

SEQ ID NO: 573875 - DNA, 25 bp, Mus musculus
cagtgctatgattcacaggcagata

SEQ ID NO: 573876 - DNA, 25 bp, Mus musculus
cagtgctatggtatcaatggtcacc

SEQ ID NO: 573877 - DNA, 25 bp, Mus musculus
cagtgctatggtttcaatggtcacc

SEQ ID NO: 573878 - DNA, 25 bp, Mus musculus
cagtgctcaaccactgacgtgatgc

SEQ ID NO: 573879 - DNA, 25 bp, Mus musculus
cagtgctcaacctctgacgtgatgc

SEQ ID NO: 573880 - DNA, 25 bp, Mus musculus
cagtgctcaccacagaggatgggct

SEQ ID NO: 573881 - DNA, 25 bp, Mus musculus
cagtgctcaccagagaggatgggct

SEQ ID NO: 573882 - DNA, 25 bp, Mus musculus
cagtgctcaggcaacttcatgggtt

SEQ ID NO: 573883 - DNA, 25 bp, Mus musculus
cagtgctcaggctacttcatgggtt

SEQ ID NO: 573884 - DNA, 25 bp, Mus musculus
cagtgctcctatccgtgaatcccaa

SEQ ID NO: 573885 - DNA, 25 bp, Mus musculus
cagtgctcctatgcgtgaatcccaa

SEQ ID NO: 573886 - DNA, 25 bp, Mus musculus
cagtgctcgtgccaacatcacgctg

SEQ ID NO: 573887 - DNA, 25 bp, Mus musculus
cagtgctcgtgcgaacatcacgctg

SEQ ID NO: 573888 - DNA, 25 bp, Mus musculus
cagtgctcttctcaccggcgttgta

SEQ ID NO: 573889 - DNA, 25 bp, Mus musculus
cagtgctcttctgaccggcgttgta

SEQ ID NO: 573890 - DNA, 25 bp, Mus musculus
cagtgctcttttaaccatgcatcct

SEQ ID NO: 573891 - DNA, 25 bp, Mus musculus
cagtgctctttttaccatgcatcct

SEQ ID NO: 573892 - DNA, 25 bp, Mus musculus
cagtgctgaatacctgctgcctgcg

SEQ ID NO: 573893 - DNA, 25 bp, Mus musculus
cagtgctgaatagctgctgcctgcg

SEQ ID NO: 573894 - DNA, 25 bp, Mus musculus
cagtgctgacgtatctgaggacagc

SEQ ID NO: 573895 - DNA, 25 bp, Mus musculus
cagtgctgacgtttctgaggacagc

SEQ ID NO: 573896 - DNA, 25 bp, Mus musculus
cagtgctgacttctctagcatgctc

SEQ ID NO: 573897 - DNA, 25 bp, Mus musculus
cagtgctgacttgtctagcatgctc

SEQ ID NO: 573898 - DNA, 25 bp, Mus musculus
cagtgctgagccctccagtggcttt

SEQ ID NO: 573899 - DNA, 25 bp, Mus musculus
cagtgctgagccgtccagtggcttt

SEQ ID NO: 573900 - DNA, 25 bp, Mus musculus
cagtgctgatcgatacctttcaggc

SEQ ID NO: 573901 - DNA, 25 bp, Mus musculus
cagtgctgatcgttacctttcaggc

SEQ ID NO: 573902 - DNA, 25 bp, Mus musculus
cagtgctgcccacgatggacaacat

SEQ ID NO: 573903 - DNA, 25 bp, Mus musculus
cagtgctgcccaggatggacaacat

SEQ ID NO: 573904 - DNA, 25 bp, Mus musculus
cagtgctgctggcttgactgcctca

SEQ ID NO: 573905 - DNA, 25 bp, Mus musculus
cagtgctgctgggttgactgcctca

SEQ ID NO: 573906 - DNA, 25 bp, Mus musculus
cagtgctgctgtcactaatctctct

SEQ ID NO: 573907 - DNA, 25 bp, Mus musculus
cagtgctgctgtgactaatctctct

SEQ ID NO: 573908 - DNA, 25 bp, Mus musculus
cagtgctgggtactttagccacacc

SEQ ID NO: 573909 - DNA, 25 bp, Mus musculus
cagtgctgggtagtttagccacacc

SEQ ID NO: 573910 - DNA, 25 bp, Mus musculus
cagtgctggtcaataggctccttgg

SEQ ID NO: 573911 - DNA, 25 bp, Mus musculus
cagtgctggtcattaggctccttgg

SEQ ID NO: 573912 - DNA, 25 bp, Mus musculus
cagtgctgtcgaaaagcccagggta

SEQ ID NO: 573913 - DNA, 25 bp, Mus musculus
cagtgctgtcgataagcccagggta

SEQ ID NO: 573914 - DNA, 25 bp, Mus musculus
cagtgcttccaaaggtgcagcctct

SEQ ID NO: 573915 - DNA, 25 bp, Mus musculus
cagtgcttccaatggtgcagcctct

SEQ ID NO: 573916 - DNA, 25 bp, Mus musculus
cagtgcttcgcaagatggaaaatta

SEQ ID NO: 573917 - DNA, 25 bp, Mus musculus
cagtgcttcgcatgatggaaaatta

SEQ ID NO: 573918 - DNA, 25 bp, Mus musculus
cagtgcttgacaaagagaatattct

SEQ ID NO: 573919 - DNA, 25 bp, Mus musculus
cagtgcttgacatagagaatattct

SEQ ID NO: 573920 - DNA, 25 bp, Mus musculus
cagtgcttgatcacttcgatggcag

SEQ ID NO: 573921 - DNA, 25 bp, Mus musculus
cagtgcttgatctcttcgatggcag

SEQ ID NO: 573922 - DNA, 25 bp, Mus musculus
cagtgcttgctaaatgttctgtaca

SEQ ID NO: 573923 - DNA, 25 bp, Mus musculus
cagtgcttgctatatgttctgtaca

SEQ ID NO: 573924 - DNA, 25 bp, Mus musculus
cagtgcttgtatcagatctacattg

SEQ ID NO: 573925 - DNA, 25 bp, Mus musculus
cagtgcttgtatgagatctacattg

SEQ ID NO: 573926 - DNA, 25 bp, Mus musculus
cagtgctttgccagagtgatggagt

SEQ ID NO: 573927 - DNA, 25 bp, Mus musculus
cagtgctttgcctgagtgatggagt

SEQ ID NO: 573928 - DNA, 25 bp, Mus musculus
cagtggaaactgactcctgacctgg

SEQ ID NO: 573929 - DNA, 25 bp, Mus musculus
cagtggaaactgtctcctgacctgg

SEQ ID NO: 573930 - DNA, 25 bp, Mus musculus
cagtggaacagacatagcagcttgg

SEQ ID NO: 573931 - DNA, 25 bp, Mus musculus
cagtggaacagagatagcagcttgg

SEQ ID NO: 573932 - DNA, 25 bp, Mus musculus
cagtggaaccctcgaacccatattt

SEQ ID NO: 573933 - DNA, 25 bp, Mus musculus
cagtggaaccctggaacccatattt

SEQ ID NO: 573934 - DNA, 25 bp, Mus musculus
cagtggaagaaaagaagccttcagc

SEQ ID NO: 573935 - DNA, 25 bp, Mus musculus
cagtggaagaaatgaagccttcagc

SEQ ID NO: 573936 - DNA, 25 bp, Mus musculus
cagtggaagatgatcggccacctca

SEQ ID NO: 573937 - DNA, 25 bp, Mus musculus
cagtggaagatgttcggccacctca

SEQ ID NO: 573938 - DNA, 25 bp, Mus musculus
cagtggaagcaacagcttgctgcgt

SEQ ID NO: 573939 - DNA, 25 bp, Mus musculus
cagtggaagcaagagcttgctgcgt

SEQ ID NO: 573940 - DNA, 25 bp, Mus musculus
cagtggaagcttcctccttggcgca

SEQ ID NO: 573941 - DNA, 25 bp, Mus musculus
cagtggaagcttgctccttggcgca

SEQ ID NO: 573942 - DNA, 25 bp, Mus musculus
cagtggaaggaacagtgtcacttgc

SEQ ID NO: 573943 - DNA, 25 bp, Mus musculus
cagtggaaggaagagtgtcacttgc

SEQ ID NO: 573944 - DNA, 25 bp, Mus musculus
cagtggaaggacatcaaagataaca

SEQ ID NO: 573945 - DNA, 25 bp, Mus musculus
cagtggaaggacttcaaagataaca

SEQ ID NO: 573946 - DNA, 25 bp, Mus musculus
cagtggaaggtgattactgaactgt

SEQ ID NO: 573947 - DNA, 25 bp, Mus musculus
cagtggaaggtgtttactgaactgt

SEQ ID NO: 573948 - DNA, 25 bp, Mus musculus
cagtggaatcctcattctggtggga

SEQ ID NO: 573949 - DNA, 25 bp, Mus musculus
cagtggaatcctgattctggtggga

SEQ ID NO: 573950 - DNA, 25 bp, Mus musculus
cagtggaatctgcactcgaacagtg

SEQ ID NO: 573951 - DNA, 25 bp, Mus musculus
cagtggaatctggactcgaacagtg

SEQ ID NO: 573952 - DNA, 25 bp, Mus musculus
cagtggaatgaaatgcttgaagaac

SEQ ID NO: 573953 - DNA, 25 bp, Mus musculus
cagtggaatgaattgcttgaagaac

SEQ ID NO: 573954 - DNA, 25 bp, Mus musculus
cagtggaatgctcgaggcttttagc

SEQ ID NO: 573955 - DNA, 25 bp, Mus musculus
cagtggaatgctggaggcttttagc

SEQ ID NO: 573956 - DNA, 25 bp, Mus musculus
cagtggaatttgaataaggaagtga

SEQ ID NO: 573957 - DNA, 25 bp, Mus musculus
cagtggaatttgtataaggaagtga

SEQ ID NO: 573958 - DNA, 25 bp, Mus musculus
cagtggacaatgctggacttttctc

SEQ ID NO: 573959 - DNA, 25 bp, Mus musculus
cagtggacaatggtggacttttctc

SEQ ID NO: 573960 - DNA, 25 bp, Mus musculus
cagtggaccccaagttggcctgggt

SEQ ID NO: 573961 - DNA, 25 bp, Mus musculus
cagtggaccccatgttggcctgggt

SEQ ID NO: 573962 - DNA, 25 bp, Mus musculus
cagtggacctgtaggtatggagcac

SEQ ID NO: 573963 - DNA, 25 bp, Mus musculus
cagtggacctgttggtatggagcac

SEQ ID NO: 573964 - DNA, 25 bp, Mus musculus
cagtggacgaaaccgcacgagctga

SEQ ID NO: 573965 - DNA, 25 bp, Mus musculus
cagtggacgaaagcgcacgagctga

SEQ ID NO: 573966 - DNA, 25 bp, Mus musculus
cagtggacgaggctggtcgagaagc

SEQ ID NO: 573967 - DNA, 25 bp, Mus musculus
cagtggacgagggtggtcgagaagc

SEQ ID NO: 573968 - DNA, 25 bp, Mus musculus
cagtggactctacctcggcatgaac

SEQ ID NO: 573969 - DNA, 25 bp, Mus musculus
cagtggactctagctcggcatgaac

SEQ ID NO: 573970 - DNA, 25 bp, Mus musculus
cagtggacttccagggtgttacata

SEQ ID NO: 573971 - DNA, 25 bp, Mus musculus
cagtggacttcctgggtgttacata

SEQ ID NO: 573972 - DNA, 25 bp, Mus musculus
cagtggagacacacagactgacacc

SEQ ID NO: 573973 - DNA, 25 bp, Mus musculus
cagtggagacactcagactgacacc

SEQ ID NO: 573974 - DNA, 25 bp, Mus musculus
cagtggagaccaagatcagaatgaa

SEQ ID NO: 573975 - DNA, 25 bp, Mus musculus
cagtggagaccatgatcagaatgaa

SEQ ID NO: 573976 - DNA, 25 bp, Mus musculus
cagtggagacgcaaacggagaccaa

SEQ ID NO: 573977 - DNA, 25 bp, Mus musculus
cagtggagacgctaacggagaccaa

SEQ ID NO: 573978 - DNA, 25 bp, Mus musculus
cagtggagagaaatgtaggacacac

SEQ ID NO: 573979 - DNA, 25 bp, Mus musculus
cagtggagagaattgtaggacacac

SEQ ID NO: 573980 - DNA, 25 bp, Mus musculus
cagtggagcacaacttcaaagctgg

SEQ ID NO: 573981 - DNA, 25 bp, Mus musculus
cagtggagcacatcttcaaagctgg

SEQ ID NO: 573982 - DNA, 25 bp, Mus musculus
cagtggagcttccacgggtatctat

SEQ ID NO: 573983 - DNA, 25 bp, Mus musculus
cagtggagcttcgacgggtatctat

SEQ ID NO: 573984 - DNA, 25 bp, Mus musculus
cagtggaggacaagcaaactgagga

SEQ ID NO: 573985 - DNA, 25 bp, Mus musculus
cagtggaggacatgcaaactgagga

SEQ ID NO: 573986 - DNA, 25 bp, Mus musculus
cagtggaggaccatttgtcatgaag

SEQ ID NO: 573987 - DNA, 25 bp, Mus musculus
cagtggaggaccttttgtcatgaag

SEQ ID NO: 573988 - DNA, 25 bp, Mus musculus
cagtggaggagcacaagagcgttat

SEQ ID NO: 573989 - DNA, 25 bp, Mus musculus
cagtggaggagctcaagagcgttat

SEQ ID NO: 573990 - DNA, 25 bp, Mus musculus
cagtggaggcatctgtgaatattgc

SEQ ID NO: 573991 - DNA, 25 bp, Mus musculus
cagtggaggcatgtgtgaatattgc

SEQ ID NO: 573992 - DNA, 25 bp, Mus musculus
cagtggaggccaagtttcttcgttc

SEQ ID NO: 573993 - DNA, 25 bp, Mus musculus
cagtggaggccatgtttcttcgttc

SEQ ID NO: 573994 - DNA, 25 bp, Mus musculus
cagtggaggctgatgtagaccttca

SEQ ID NO: 573995 - DNA, 25 bp, Mus musculus
cagtggaggctgttgtagaccttca

SEQ ID NO: 573996 - DNA, 25 bp, Mus musculus
cagtggaggtcaagttaaatgtgaa

SEQ ID NO: 573997 - DNA, 25 bp, Mus musculus
cagtggaggtcatgttaaatgtgaa

SEQ ID NO: 573998 - DNA, 25 bp, Mus musculus
cagtggagtattccgaactcagcgc

SEQ ID NO: 573999 - DNA, 25 bp, Mus musculus
cagtggagtattgcgaactcagcgc

SEQ ID NO: 574000 - DNA, 25 bp, Mus musculus
cagtggagtcaaaccaatcctgtgg

SEQ ID NO: 574001 - DNA, 25 bp, Mus musculus
cagtggagtcaatccaatcctgtgg

SEQ ID NO: 574002 - DNA, 25 bp, Mus musculus
cagtggagttccacaggacctctct

SEQ ID NO: 574003 - DNA, 25 bp, Mus musculus
cagtggagttcctcaggacctctct

SEQ ID NO: 574004 - DNA, 25 bp, Mus musculus
cagtggatgaaccacccagagacgg

SEQ ID NO: 574005 - DNA, 25 bp, Mus musculus
cagtggatgaacgacccagagacgg

SEQ ID NO: 574006 - DNA, 25 bp, Mus musculus
cagtggatgataccgacatgctgga

SEQ ID NO: 574007 - DNA, 25 bp, Mus musculus
cagtggatgatagcgacatgctgga

SEQ ID NO: 574008 - DNA, 25 bp, Mus musculus
cagtggatgctgattcattgtgacc

SEQ ID NO: 574009 - DNA, 25 bp, Mus musculus
cagtggatgctgtttcattgtgacc

SEQ ID NO: 574010 - DNA, 25 bp, Mus musculus
cagtggattgatattacagatgtac

SEQ ID NO: 574011 - DNA, 25 bp, Mus musculus
cagtggattgattttacagatgtac

SEQ ID NO: 574012 - DNA, 25 bp, Mus musculus
cagtggatttccctaaaagaactag

SEQ ID NO: 574013 - DNA, 25 bp, Mus musculus
cagtggatttccgtaaaagaactag

SEQ ID NO: 574014 - DNA, 25 bp, Mus musculus
cagtggcaactgcacgccagaatct

SEQ ID NO: 574015 - DNA, 25 bp, Mus musculus
cagtggcaactggacgccagaatct

SEQ ID NO: 574016 - DNA, 25 bp, Mus musculus
cagtggcaatgacagccgtaaagca

SEQ ID NO: 574017 - DNA, 25 bp, Mus musculus
cagtggcaatgagagccgtaaagca

SEQ ID NO: 574018 - DNA, 25 bp, Mus musculus
cagtggcaatggcttgttgctcaaa

SEQ ID NO: 574019 - DNA, 25 bp, Mus musculus
cagtggcaatgggttgttgctcaaa

SEQ ID NO: 574020 - DNA, 25 bp, Mus musculus
cagtggcaccagctgaaagcctgag

SEQ ID NO: 574021 - DNA, 25 bp, Mus musculus
cagtggcaccaggtgaaagcctgag

SEQ ID NO: 574022 - DNA, 25 bp, Mus musculus
cagtggcaccctcaacaggtggttc

SEQ ID NO: 574023 - DNA, 25 bp, Mus musculus
cagtggcaccctgaacaggtggttc

SEQ ID NO: 574024 - DNA, 25 bp, Mus musculus
cagtggcactgcacttggagcggct

SEQ ID NO: 574025 - DNA, 25 bp, Mus musculus
cagtggcactgctcttggagcggct

SEQ ID NO: 574026 - DNA, 25 bp, Mus musculus
cagtggcacttaaggctgtacagcc

SEQ ID NO: 574027 - DNA, 25 bp, Mus musculus
cagtggcacttatggctgtacagcc

SEQ ID NO: 574028 - DNA, 25 bp, Mus musculus
cagtggcagcagctcagcatattta

SEQ ID NO: 574029 - DNA, 25 bp, Mus musculus
cagtggcagcaggtcagcatattta

SEQ ID NO: 574030 - DNA, 25 bp, Mus musculus
cagtggcagcctccgggccacagaa

SEQ ID NO: 574031 - DNA, 25 bp, Mus musculus
cagtggcagcctgcgggccacagaa

SEQ ID NO: 574032 - DNA, 25 bp, Mus musculus
cagtggcagtgacctcactacagac

SEQ ID NO: 574033 - DNA, 25 bp, Mus musculus
cagtggcagtgagctcactacagac

SEQ ID NO: 574034 - DNA, 25 bp, Mus musculus
cagtggcagtgcaacagtgaaagac

SEQ ID NO: 574035 - DNA, 25 bp, Mus musculus
cagtggcagtgcagcgtgtgtcaat

SEQ ID NO: 574036 - DNA, 25 bp, Mus musculus
cagtggcagtgctacagtgaaagac

SEQ ID NO: 574037 - DNA, 25 bp, Mus musculus
cagtggcagtgctgcgtgtgtcaat

SEQ ID NO: 574038 - DNA, 25 bp, Mus musculus
cagtggcatgctcccagttccattg

SEQ ID NO: 574039 - DNA, 25 bp, Mus musculus
cagtggcatgctgccagttccattg

SEQ ID NO: 574040 - DNA, 25 bp, Mus musculus
cagtggccaaagctgaccccagatg

SEQ ID NO: 574041 - DNA, 25 bp, Mus musculus
cagtggccaaaggtgaccccagatg

SEQ ID NO: 574042 - DNA, 25 bp, Mus musculus
cagtggccaaatcgcatcacactag

SEQ ID NO: 574043 - DNA, 25 bp, Mus musculus
cagtggccaaatggcatcacactag

SEQ ID NO: 574044 - DNA, 25 bp, Mus musculus
cagtggccaggaaaccaaagcctta

SEQ ID NO: 574045 - DNA, 25 bp, Mus musculus
cagtggccaggataccaaagcctta

SEQ ID NO: 574046 - DNA, 25 bp, Mus musculus
cagtggcccagaatgctttgcatcg

SEQ ID NO: 574047 - DNA, 25 bp, Mus musculus
cagtggcccagattgctttgcatcg

SEQ ID NO: 574048 - DNA, 25 bp, Mus musculus
cagtggcccggacttttcggttgca

SEQ ID NO: 574049 - DNA, 25 bp, Mus musculus
cagtggcccggagttttcggttgca

SEQ ID NO: 574050 - DNA, 25 bp, Mus musculus
cagtggccctctattctgagactcc

SEQ ID NO: 574051 - DNA, 25 bp, Mus musculus
cagtggccctcttttctgagactcc

SEQ ID NO: 574052 - DNA, 25 bp, Mus musculus
cagtggccgcctagttgactccaaa

SEQ ID NO: 574053 - DNA, 25 bp, Mus musculus
cagtggccgccttgttgactccaaa

SEQ ID NO: 574054 - DNA, 25 bp, Mus musculus
cagtggccgggacagaacagaccta

SEQ ID NO: 574055 - DNA, 25 bp, Mus musculus
cagtggccgggagagaacagaccta

SEQ ID NO: 574056 - DNA, 25 bp, Mus musculus
cagtggcctccaccatggcgttgct

SEQ ID NO: 574057 - DNA, 25 bp, Mus musculus
cagtggcctccagcatggcgttgct

SEQ ID NO: 574058 - DNA, 25 bp, Mus musculus
cagtggcctggcctatctgaatggt

SEQ ID NO: 574059 - DNA, 25 bp, Mus musculus
cagtggcctggcgtatctgaatggt

SEQ ID NO: 574060 - DNA, 25 bp, Mus musculus
cagtggcgaagactcagatctcaag

SEQ ID NO: 574061 - DNA, 25 bp, Mus musculus
cagtggcgaagagtcagatctcaag

SEQ ID NO: 574062 - DNA, 25 bp, Mus musculus
cagtggcgccacattctgagcaagc

SEQ ID NO: 574063 - DNA, 25 bp, Mus musculus
cagtggcgccactttctgagcaagc

SEQ ID NO: 574064 - DNA, 25 bp, Mus musculus
cagtggcggctcctattccatcaaa

SEQ ID NO: 574065 - DNA, 25 bp, Mus musculus
cagtggcggctcgtattccatcaaa

SEQ ID NO: 574066 - DNA, 25 bp, Mus musculus
cagtggcgtaaaaatgacagggttc

SEQ ID NO: 574067 - DNA, 25 bp, Mus musculus
cagtggcgtaaatatgacagggttc

SEQ ID NO: 574068 - DNA, 25 bp, Mus musculus
cagtggcgtcagagacagtgtccca

SEQ ID NO: 574069 - DNA, 25 bp, Mus musculus
cagtggcgtcagtgacagtgtccca

SEQ ID NO: 574070 - DNA, 25 bp, Mus musculus
cagtggctacaacatagtgactaca

SEQ ID NO: 574071 - DNA, 25 bp, Mus musculus
cagtggctacaagatagtgactaca

SEQ ID NO: 574072 - DNA, 25 bp, Mus musculus
cagtggctacgacacacaagctgtt

SEQ ID NO: 574073 - DNA, 25 bp, Mus musculus
cagtggctacgagacacaagctgtt

SEQ ID NO: 574074 - DNA, 25 bp, Mus musculus
cagtggctactgcagaggacccaac

SEQ ID NO: 574075 - DNA, 25 bp, Mus musculus
cagtggctactggagaggacccaac

SEQ ID NO: 574076 - DNA, 25 bp, Mus musculus
cagtggctagctcttgccctccatt

SEQ ID NO: 574077 - DNA, 25 bp, Mus musculus
cagtggctagctgttgccctccatt

SEQ ID NO: 574078 - DNA, 25 bp, Mus musculus
cagtggctatgacatgccctatgct

SEQ ID NO: 574079 - DNA, 25 bp, Mus musculus
cagtggctatgagatgccctatgct

SEQ ID NO: 574080 - DNA, 25 bp, Mus musculus
cagtggctcagcacgcgggccagct

SEQ ID NO: 574081 - DNA, 25 bp, Mus musculus
cagtggctcagcatgtagccttttc

SEQ ID NO: 574082 - DNA, 25 bp, Mus musculus
cagtggctcagctcgcgggccagct

SEQ ID NO: 574083 - DNA, 25 bp, Mus musculus
cagtggctcagcttgtagccttttc

SEQ ID NO: 574084 - DNA, 25 bp, Mus musculus
cagtggctccagagctgccttcagc

SEQ ID NO: 574085 - DNA, 25 bp, Mus musculus
cagtggctccagtgctgccttcagc

SEQ ID NO: 574086 - DNA, 25 bp, Mus musculus
cagtggctctgcaacgccaacaaga

SEQ ID NO: 574087 - DNA, 25 bp, Mus musculus
cagtggctctgctacgccaacaaga

SEQ ID NO: 574088 - DNA, 25 bp, Mus musculus
cagtggctgaagctctgggtatcct

SEQ ID NO: 574089 - DNA, 25 bp, Mus musculus
cagtggctgaaggtctgggtatcct

SEQ ID NO: 574090 - DNA, 25 bp, Mus musculus
cagtggctgacactggaagccccac

SEQ ID NO: 574091 - DNA, 25 bp, Mus musculus
cagtggctgacagtggaagccccac

SEQ ID NO: 574092 - DNA, 25 bp, Mus musculus
cagtggctgcagactgcttcaggga

SEQ ID NO: 574093 - DNA, 25 bp, Mus musculus
cagtggctgcagtctgcttcaggga

SEQ ID NO: 574094 - DNA, 25 bp, Mus musculus
cagtggctggaactacgtcttagat

SEQ ID NO: 574095 - DNA, 25 bp, Mus musculus
cagtggctggaagtacgtcttagat

SEQ ID NO: 574096 - DNA, 25 bp, Mus musculus
cagtggctgtgtcccccaccatttg

SEQ ID NO: 574097 - DNA, 25 bp, Mus musculus
cagtggctgtgtgccccaccatttg

SEQ ID NO: 574098 - DNA, 25 bp, Mus musculus
cagtggcttactcaacgtgcttgag

SEQ ID NO: 574099 - DNA, 25 bp, Mus musculus
cagtggcttactgaacgtgcttgag

SEQ ID NO: 574100 - DNA, 25 bp, Mus musculus
cagtggcttggtcgaagacaaatca

SEQ ID NO: 574101 - DNA, 25 bp, Mus musculus
cagtggcttggtggaagacaaatca

SEQ ID NO: 574102 - DNA, 25 bp, Mus musculus
cagtggctttgaaccaggagccttt

SEQ ID NO: 574103 - DNA, 25 bp, Mus musculus
cagtggctttgatccaggagccttt

SEQ ID NO: 574104 - DNA, 25 bp, Mus musculus
cagtggctttgcacatccgctatca

SEQ ID NO: 574105 - DNA, 25 bp, Mus musculus
cagtggctttgctcatccgctatca

SEQ ID NO: 574106 - DNA, 25 bp, Mus musculus
cagtgggaaacaccactgtacctca

SEQ ID NO: 574107 - DNA, 25 bp, Mus musculus
cagtgggaaacagcactgtacctca

SEQ ID NO: 574108 - DNA, 25 bp, Mus musculus
cagtgggaaagtcagtcacaaggct

SEQ ID NO: 574109 - DNA, 25 bp, Mus musculus
cagtgggaaagtgagtcacaaggct

SEQ ID NO: 574110 - DNA, 25 bp, Mus musculus
cagtgggaaccacatgaaggaatct

SEQ ID NO: 574111 - DNA, 25 bp, Mus musculus
cagtgggaaccagatgaaggaatct

SEQ ID NO: 574112 - DNA, 25 bp, Mus musculus
cagtgggaactacaagaaaggagaa

SEQ ID NO: 574113 - DNA, 25 bp, Mus musculus
cagtgggaactagaagaaaggagaa

SEQ ID NO: 574114 - DNA, 25 bp, Mus musculus
cagtgggaactcaccacctagcagc

SEQ ID NO: 574115 - DNA, 25 bp, Mus musculus
cagtgggaactctccacctagcagc

SEQ ID NO: 574116 - DNA, 25 bp, Mus musculus
cagtgggaagtgaaacgtaagatga

SEQ ID NO: 574117 - DNA, 25 bp, Mus musculus
cagtgggaagtgtaacgtaagatga

SEQ ID NO: 574118 - DNA, 25 bp, Mus musculus
cagtgggaatcgataaagacaaacc

SEQ ID NO: 574119 - DNA, 25 bp, Mus musculus
cagtgggaatcgttaaagacaaacc

SEQ ID NO: 574120 - DNA, 25 bp, Mus musculus
cagtgggaatgacctgactaacttc

SEQ ID NO: 574121 - DNA, 25 bp, Mus musculus
cagtgggaatgagctgactaacttc

SEQ ID NO: 574122 - DNA, 25 bp, Mus musculus
cagtgggacagtagcgacagtctaa

SEQ ID NO: 574123 - DNA, 25 bp, Mus musculus
cagtgggacagttgcgacagtctaa

SEQ ID NO: 574124 - DNA, 25 bp, Mus musculus
cagtgggaccagcttgcagacccaa

SEQ ID NO: 574125 - DNA, 25 bp, Mus musculus
cagtgggaccaggttgcagacccaa

SEQ ID NO: 574126 - DNA, 25 bp, Mus musculus
cagtgggacgcacattctaatgata

SEQ ID NO: 574127 - DNA, 25 bp, Mus musculus
cagtgggacgcagattctaatgata

SEQ ID NO: 574128 - DNA, 25 bp, Mus musculus
cagtgggactgtatcaaccccaagt

SEQ ID NO: 574129 - DNA, 25 bp, Mus musculus
cagtgggactgtttcaaccccaagt

SEQ ID NO: 574130 - DNA, 25 bp, Mus musculus
cagtgggagacaattagtgaacgct

SEQ ID NO: 574131 - DNA, 25 bp, Mus musculus
cagtgggagacatttagtgaacgct

SEQ ID NO: 574132 - DNA, 25 bp, Mus musculus
cagtgggagccacctctttcaagga

SEQ ID NO: 574133 - DNA, 25 bp, Mus musculus
cagtgggagccagctctttcaagga

SEQ ID NO: 574134 - DNA, 25 bp, Mus musculus
cagtgggaggtacctgctttcccca

SEQ ID NO: 574135 - DNA, 25 bp, Mus musculus
cagtgggaggtagctgctttcccca

SEQ ID NO: 574136 - DNA, 25 bp, Mus musculus
cagtgggaggtcaacagctgctttt

SEQ ID NO: 574137 - DNA, 25 bp, Mus musculus
cagtgggaggtctacagctgctttt

SEQ ID NO: 574138 - DNA, 25 bp, Mus musculus
cagtgggatctcaatgcctggacca

SEQ ID NO: 574139 - DNA, 25 bp, Mus musculus
cagtgggatctctatgcctggacca

SEQ ID NO: 574140 - DNA, 25 bp, Mus musculus
cagtgggcaagacgccatattaagt

SEQ ID NO: 574141 - DNA, 25 bp, Mus musculus
cagtgggcaagaggccatattaagt

SEQ ID NO: 574142 - DNA, 25 bp, Mus musculus
cagtgggcagcgaggaagccctcct

SEQ ID NO: 574143 - DNA, 25 bp, Mus musculus
cagtgggcagcgtggaagccctcct

SEQ ID NO: 574144 - DNA, 25 bp, Mus musculus
cagtgggcaggaatatagccaaccc

SEQ ID NO: 574145 - DNA, 25 bp, Mus musculus
cagtgggcaggattatagccaaccc

SEQ ID NO: 574146 - DNA, 25 bp, Mus musculus
cagtgggccacaaacacagtagcag

SEQ ID NO: 574147 - DNA, 25 bp, Mus musculus
cagtgggccacatacacagtagcag

SEQ ID NO: 574148 - DNA, 25 bp, Mus musculus
cagtgggccactccctagaagctgc

SEQ ID NO: 574149 - DNA, 25 bp, Mus musculus
cagtgggccactgcctagaagctgc

SEQ ID NO: 574150 - DNA, 25 bp, Mus musculus
cagtgggccatccacaatgatgagt

SEQ ID NO: 574151 - DNA, 25 bp, Mus musculus
cagtgggccatcgacaatgatgagt

SEQ ID NO: 574152 - DNA, 25 bp, Mus musculus
cagtgggccattcgatacgtgagct

SEQ ID NO: 574153 - DNA, 25 bp, Mus musculus
cagtgggccattggatacgtgagct

SEQ ID NO: 574154 - DNA, 25 bp, Mus musculus
cagtgggccttaaaggcacgcagcc

SEQ ID NO: 574155 - DNA, 25 bp, Mus musculus
cagtgggccttataggcacgcagcc

SEQ ID NO: 574156 - DNA, 25 bp, Mus musculus
cagtgggcggtaactgccaggacta

SEQ ID NO: 574157 - DNA, 25 bp, Mus musculus
cagtgggcggtatctgccaggacta

SEQ ID NO: 574158 - DNA, 25 bp, Mus musculus
cagtgggctatcacccttatgcaac

SEQ ID NO: 574159 - DNA, 25 bp, Mus musculus
cagtgggctatctcccttatgcaac

SEQ ID NO: 574160 - DNA, 25 bp, Mus musculus
cagtggggctcacctacggtgctca

SEQ ID NO: 574161 - DNA, 25 bp, Mus musculus
cagtggggctcagctacggtgctca

SEQ ID NO: 574162 - DNA, 25 bp, Mus musculus
cagtgggtactgactgcccggcaat

SEQ ID NO: 574163 - DNA, 25 bp, Mus musculus
cagtgggtactgtctgcccggcaat

SEQ ID NO: 574164 - DNA, 25 bp, Mus musculus
cagtgggttatgaattcaatgtatc

SEQ ID NO: 574165 - DNA, 25 bp, Mus musculus
cagtgggttatgtattcaatgtatc

SEQ ID NO: 574166 - DNA, 25 bp, Mus musculus
cagtgggttcccctgcagcactgca

SEQ ID NO: 574167 - DNA, 25 bp, Mus musculus
cagtgggttcccgtgcagcactgca

SEQ ID NO: 574168 - DNA, 25 bp, Mus musculus
cagtgggttgccatttttctgtatc

SEQ ID NO: 574169 - DNA, 25 bp, Mus musculus
cagtgggttgccttttttctgtatc

SEQ ID NO: 574170 - DNA, 25 bp, Mus musculus
cagtgggtttacagctgctccatct

SEQ ID NO: 574171 - DNA, 25 bp, Mus musculus
cagtgggtttactgctgctccatct

SEQ ID NO: 574172 - DNA, 25 bp, Mus musculus
cagtggtactggctcagcacttctt

SEQ ID NO: 574173 - DNA, 25 bp, Mus musculus
cagtggtactgggtcagcacttctt

SEQ ID NO: 574174 - DNA, 25 bp, Mus musculus
cagtggtacttgctcaagatcgcca

SEQ ID NO: 574175 - DNA, 25 bp, Mus musculus
cagtggtacttggtcaagatcgcca

SEQ ID NO: 574176 - DNA, 25 bp, Mus musculus
cagtggtatcaaactcaatggagac

SEQ ID NO: 574177 - DNA, 25 bp, Mus musculus
cagtggtatcaatctcaatggagac

SEQ ID NO: 574178 - DNA, 25 bp, Mus musculus
cagtggtcacaaatagagggggtca

SEQ ID NO: 574179 - DNA, 25 bp, Mus musculus
cagtggtcacaattagagggggtca

SEQ ID NO: 574180 - DNA, 25 bp, Mus musculus
cagtggtcacagcatccctggatga

SEQ ID NO: 574181 - DNA, 25 bp, Mus musculus
cagtggtcacaggatccctggatga

SEQ ID NO: 574182 - DNA, 25 bp, Mus musculus
cagtggtcacgtcagtggcaaatat

SEQ ID NO: 574183 - DNA, 25 bp, Mus musculus
cagtggtcacgtgagtggcaaatat

SEQ ID NO: 574184 - DNA, 25 bp, Mus musculus
cagtggtcagagcagggtgtagcgt

SEQ ID NO: 574185 - DNA, 25 bp, Mus musculus
cagtggtcagaggagggtgtagcgt

SEQ ID NO: 574186 - DNA, 25 bp, Mus musculus
cagtggtcctccattcgccttcgga

SEQ ID NO: 574187 - DNA, 25 bp, Mus musculus
cagtggtcctcctttcgccttcgga

SEQ ID NO: 574188 - DNA, 25 bp, Mus musculus
cagtggtcgttcatggcaatgggcc

SEQ ID NO: 574189 - DNA, 25 bp, Mus musculus
cagtggtcgttcttggcaatgggcc

SEQ ID NO: 574190 - DNA, 25 bp, Mus musculus
cagtggtctgtaacctggagattgt

SEQ ID NO: 574191 - DNA, 25 bp, Mus musculus
cagtggtctgtatcctggagattgt

SEQ ID NO: 574192 - DNA, 25 bp, Mus musculus
cagtggtgaactatggctccctgcc

SEQ ID NO: 574193 - DNA, 25 bp, Mus musculus
cagtggtgaactttggctccctgcc

SEQ ID NO: 574194 - DNA, 25 bp, Mus musculus
cagtggtgacaccattcggagaatc

SEQ ID NO: 574195 - DNA, 25 bp, Mus musculus
cagtggtgacacgattcggagaatc

SEQ ID NO: 574196 - DNA, 25 bp, Mus musculus
cagtggtgacgtactctatgacaaa

SEQ ID NO: 574197 - DNA, 25 bp, Mus musculus
cagtggtgacgttctctatgacaaa

SEQ ID NO: 574198 - DNA, 25 bp, Mus musculus
cagtggtgagccaaagagctccacc

SEQ ID NO: 574199 - DNA, 25 bp, Mus musculus
cagtggtgagcctaagagctccacc

SEQ ID NO: 574200 - DNA, 25 bp, Mus musculus
cagtggtgctggcagtctcgtgtcc

SEQ ID NO: 574201 - DNA, 25 bp, Mus musculus
cagtggtgctggctgcccacgacct

SEQ ID NO: 574202 - DNA, 25 bp, Mus musculus
cagtggtgctgggagtctcgtgtcc

SEQ ID NO: 574203 - DNA, 25 bp, Mus musculus
cagtggtgctgggtgcccacgacct

SEQ ID NO: 574204 - DNA, 25 bp, Mus musculus
cagtggtggcatcaggccttctaca

SEQ ID NO: 574205 - DNA, 25 bp, Mus musculus
cagtggtggcatgaggccttctaca

SEQ ID NO: 574206 - DNA, 25 bp, Mus musculus
cagtggtgtaaaagcagctggagat

SEQ ID NO: 574207 - DNA, 25 bp, Mus musculus
cagtggtgtaaatgcagctggagat

SEQ ID NO: 574208 - DNA, 25 bp, Mus musculus
cagtggtgtgatcaagctacagtag

SEQ ID NO: 574209 - DNA, 25 bp, Mus musculus
cagtggtgtgatgaagctacagtag

SEQ ID NO: 574210 - DNA, 25 bp, Mus musculus
cagtggttccacctcagtattacgg

SEQ ID NO: 574211 - DNA, 25 bp, Mus musculus
cagtggttccacgtcagtattacgg

SEQ ID NO: 574212 - DNA, 25 bp, Mus musculus
cagtggttgcagcatgctttccaaa

SEQ ID NO: 574213 - DNA, 25 bp, Mus musculus
cagtggttgcaggatgctttccaaa

SEQ ID NO: 574214 - DNA, 25 bp, Mus musculus
cagtggttgctaagagacccgctcc

SEQ ID NO: 574215 - DNA, 25 bp, Mus musculus
cagtggttgctatgagacccgctcc

SEQ ID NO: 574216 - DNA, 25 bp, Mus musculus
cagtggttgggacgtcgacaaatca

SEQ ID NO: 574217 - DNA, 25 bp, Mus musculus
cagtggttgggaggtcgacaaatca

SEQ ID NO: 574218 - DNA, 25 bp, Mus musculus
cagtggttgtgactttatggatgta

SEQ ID NO: 574219 - DNA, 25 bp, Mus musculus
cagtggttgtgagtttatggatgta

SEQ ID NO: 574220 - DNA, 25 bp, Mus musculus
cagtggtttcctacctcgtgcccag

SEQ ID NO: 574221 - DNA, 25 bp, Mus musculus
cagtggtttccttcctcgtgcccag

SEQ ID NO: 574222 - DNA, 25 bp, Mus musculus
cagtggtttctcagcttgttccaaa

SEQ ID NO: 574223 - DNA, 25 bp, Mus musculus
cagtggtttctctgcttgttccaaa

SEQ ID NO: 574224 - DNA, 25 bp, Mus musculus
cagtggtttggacctgcatggccct

SEQ ID NO: 574225 - DNA, 25 bp, Mus musculus
cagtggtttggagctgcatggccct

SEQ ID NO: 574226 - DNA, 25 bp, Mus musculus
cagtgtaaaccccagctacctggtg

SEQ ID NO: 574227 - DNA, 25 bp, Mus musculus
cagtgtaaacccgagctacctggtg

SEQ ID NO: 574228 - DNA, 25 bp, Mus musculus
cagtgtaaagataactatgagatcc

SEQ ID NO: 574229 - DNA, 25 bp, Mus musculus
cagtgtaaagattactatgagatcc

SEQ ID NO: 574230 - DNA, 25 bp, Mus musculus
cagtgtaacattagtggctgagcaa

SEQ ID NO: 574231 - DNA, 25 bp, Mus musculus
cagtgtaacatttgtggctgagcaa

SEQ ID NO: 574232 - DNA, 25 bp, Mus musculus
cagtgtaagtacctgcataggaagg

SEQ ID NO: 574233 - DNA, 25 bp, Mus musculus
cagtgtaagtacgtgcataggaagg

SEQ ID NO: 574234 - DNA, 25 bp, Mus musculus
cagtgtacacagagcgttacatggg

SEQ ID NO: 574235 - DNA, 25 bp, Mus musculus
cagtgtacacagtgcgttacatggg

SEQ ID NO: 574236 - DNA, 25 bp, Mus musculus
cagtgtacacttctctggtgtgaga

SEQ ID NO: 574237 - DNA, 25 bp, Mus musculus
cagtgtacacttgtctggtgtgaga

SEQ ID NO: 574238 - DNA, 25 bp, Mus musculus
cagtgtacctctatggcatggtctg

SEQ ID NO: 574239 - DNA, 25 bp, Mus musculus
cagtgtacctctttggcatggtctg

SEQ ID NO: 574240 - DNA, 25 bp, Mus musculus
cagtgtactatgaagaaagcaaacc

SEQ ID NO: 574241 - DNA, 25 bp, Mus musculus
cagtgtactatgtagaaagcaaacc

SEQ ID NO: 574242 - DNA, 25 bp, Mus musculus
cagtgtagcactagcctagaaggct

SEQ ID NO: 574243 - DNA, 25 bp, Mus musculus
cagtgtagcacttgcctagaaggct

SEQ ID NO: 574244 - DNA, 25 bp, Mus musculus
cagtgtagcagtattatcaccggag

SEQ ID NO: 574245 - DNA, 25 bp, Mus musculus
cagtgtagcagttttatcaccggag

SEQ ID NO: 574246 - DNA, 25 bp, Mus musculus
cagtgtagccagctcagcgctggtc

SEQ ID NO: 574247 - DNA, 25 bp, Mus musculus
cagtgtagccaggtcagcgctggtc

SEQ ID NO: 574248 - DNA, 25 bp, Mus musculus
cagtgtatcagaacgccatggtgca

SEQ ID NO: 574249 - DNA, 25 bp, Mus musculus
cagtgtatcagatcgccatggtgca

SEQ ID NO: 574250 - DNA, 25 bp, Mus musculus
cagtgtatccctcgaagtagaccca

SEQ ID NO: 574251 - DNA, 25 bp, Mus musculus
cagtgtatccctggaagtagaccca

SEQ ID NO: 574252 - DNA, 25 bp, Mus musculus
cagtgtatcgatctgagcggcacca

SEQ ID NO: 574253 - DNA, 25 bp, Mus musculus
cagtgtatcgatgtgagcggcacca

SEQ ID NO: 574254 - DNA, 25 bp, Mus musculus
cagtgtatggaaataattgagagcc

SEQ ID NO: 574255 - DNA, 25 bp, Mus musculus
cagtgtatggaattaattgagagcc

SEQ ID NO: 574256 - DNA, 25 bp, Mus musculus
cagtgtcaacacatcaagctagcgg

SEQ ID NO: 574257 - DNA, 25 bp, Mus musculus
cagtgtcaacacttcaagctagcgg

SEQ ID NO: 574258 - DNA, 25 bp, Mus musculus
cagtgtcaagtacgagctgcgtgtc

SEQ ID NO: 574259 - DNA, 25 bp, Mus musculus
cagtgtcaagtaggagctgcgtgtc

SEQ ID NO: 574260 - DNA, 25 bp, Mus musculus
cagtgtcacacaaatacccattgtg

SEQ ID NO: 574261 - DNA, 25 bp, Mus musculus
cagtgtcacacatatacccattgtg

SEQ ID NO: 574262 - DNA, 25 bp, Mus musculus
cagtgtcaccgcagatggcttctca

SEQ ID NO: 574263 - DNA, 25 bp, Mus musculus
cagtgtcaccgctgatggcttctca

SEQ ID NO: 574264 - DNA, 25 bp, Mus musculus
cagtgtcacttgaactttgtccctc

SEQ ID NO: 574265 - DNA, 25 bp, Mus musculus
cagtgtcacttgtactttgtccctc

SEQ ID NO: 574266 - DNA, 25 bp, Mus musculus
cagtgtcagaatctcgacagtgcag

SEQ ID NO: 574267 - DNA, 25 bp, Mus musculus
cagtgtcagaatgtcgacagtgcag

SEQ ID NO: 574268 - DNA, 25 bp, Mus musculus
cagtgtcagagtaagaaattatagg

SEQ ID NO: 574269 - DNA, 25 bp, Mus musculus
cagtgtcagagttagaaattatagg

SEQ ID NO: 574270 - DNA, 25 bp, Mus musculus
cagtgtcagcctattctgtttgagc

SEQ ID NO: 574271 - DNA, 25 bp, Mus musculus
cagtgtcagccttttctgtttgagc

SEQ ID NO: 574272 - DNA, 25 bp, Mus musculus
cagtgtcagcgtatcttccaggtga

SEQ ID NO: 574273 - DNA, 25 bp, Mus musculus
cagtgtcagcgtttcttccaggtga

SEQ ID NO: 574274 - DNA, 25 bp, Mus musculus
cagtgtcagctacagtttggttcca

SEQ ID NO: 574275 - DNA, 25 bp, Mus musculus
cagtgtcagctagagtttggttcca

SEQ ID NO: 574276 - DNA, 25 bp, Mus musculus
cagtgtcaggaacaaggaggcggaa

SEQ ID NO: 574277 - DNA, 25 bp, Mus musculus
cagtgtcaggaagaaggaggcggaa

SEQ ID NO: 574278 - DNA, 25 bp, Mus musculus
cagtgtcaggtgaccagtctccaag

SEQ ID NO: 574279 - DNA, 25 bp, Mus musculus
cagtgtcaggtgtccagtctccaag

SEQ ID NO: 574280 - DNA, 25 bp, Mus musculus
cagtgtcatggaagttaacagtggg

SEQ ID NO: 574281 - DNA, 25 bp, Mus musculus
cagtgtcatggatgttaacagtggg

SEQ ID NO: 574282 - DNA, 25 bp, Mus musculus
cagtgtcattctaaaaacgagcacc

SEQ ID NO: 574283 - DNA, 25 bp, Mus musculus
cagtgtcattcttaaaacgagcacc

SEQ ID NO: 574284 - DNA, 25 bp, Mus musculus
cagtgtccagatacatgatgtcccg

SEQ ID NO: 574285 - DNA, 25 bp, Mus musculus
cagtgtccagattcatgatgtcccg

SEQ ID NO: 574286 - DNA, 25 bp, Mus musculus
cagtgtccatgcacctggtgtttcc

SEQ ID NO: 574287 - DNA, 25 bp, Mus musculus
cagtgtccatgctcctggtgtttcc

SEQ ID NO: 574288 - DNA, 25 bp, Mus musculus
cagtgtccattacttgtcttctaag

SEQ ID NO: 574289 - DNA, 25 bp, Mus musculus
cagtgtccattagttgtcttctaag

SEQ ID NO: 574290 - DNA, 25 bp, Mus musculus
cagtgtcccctcaccattcaggtgt

SEQ ID NO: 574291 - DNA, 25 bp, Mus musculus
cagtgtcccctctccattcaggtgt

SEQ ID NO: 574292 - DNA, 25 bp, Mus musculus
cagtgtcccgtcacagtgcttctag

SEQ ID NO: 574293 - DNA, 25 bp, Mus musculus
cagtgtcccgtctcagtgcttctag

SEQ ID NO: 574294 - DNA, 25 bp, Mus musculus
cagtgtccctataggccctgattgt

SEQ ID NO: 574295 - DNA, 25 bp, Mus musculus
cagtgtccctattggccctgattgt

SEQ ID NO: 574296 - DNA, 25 bp, Mus musculus
cagtgtccctggaaatgtactaaat

SEQ ID NO: 574297 - DNA, 25 bp, Mus musculus
cagtgtccctggtaatgtactaaat

SEQ ID NO: 574298 - DNA, 25 bp, Mus musculus
cagtgtccgagacagctgtatcccg

SEQ ID NO: 574299 - DNA, 25 bp, Mus musculus
cagtgtccgagagagctgtatcccg

SEQ ID NO: 574300 - DNA, 25 bp, Mus musculus
cagtgtccggaacctgctgcaaggc

SEQ ID NO: 574301 - DNA, 25 bp, Mus musculus
cagtgtccggaagctgctgcaaggc

SEQ ID NO: 574302 - DNA, 25 bp, Mus musculus
cagtgtccggacataggagaagcca

SEQ ID NO: 574303 - DNA, 25 bp, Mus musculus
cagtgtccggacttaggagaagcca

SEQ ID NO: 574304 - DNA, 25 bp, Mus musculus
cagtgtcgcttaccggacgctgtca

SEQ ID NO: 574305 - DNA, 25 bp, Mus musculus
cagtgtcgcttagcggacgctgtca

SEQ ID NO: 574306 - DNA, 25 bp, Mus musculus
cagtgtcgggctacgtgcaggctct

SEQ ID NO: 574307 - DNA, 25 bp, Mus musculus
cagtgtcgggcttcgtgcaggctct

SEQ ID NO: 574308 - DNA, 25 bp, Mus musculus
cagtgtcgtatacactagaagactt

SEQ ID NO: 574309 - DNA, 25 bp, Mus musculus
cagtgtcgtatagactagaagactt

SEQ ID NO: 574310 - DNA, 25 bp, Mus musculus
cagtgtctaagcagcgatgggttca

SEQ ID NO: 574311 - DNA, 25 bp, Mus musculus
cagtgtctaagctgcgatgggttca

SEQ ID NO: 574312 - DNA, 25 bp, Mus musculus
cagtgtctactcaggtggagtttgt

SEQ ID NO: 574313 - DNA, 25 bp, Mus musculus
cagtgtctactctggtggagtttgt

SEQ ID NO: 574314 - DNA, 25 bp, Mus musculus
cagtgtctactgagtgaaggtgata

SEQ ID NO: 574315 - DNA, 25 bp, Mus musculus
cagtgtctactgtgtgaaggtgata

SEQ ID NO: 574316 - DNA, 25 bp, Mus musculus
cagtgtctaggcacctacgctgatg

SEQ ID NO: 574317 - DNA, 25 bp, Mus musculus
cagtgtctaggctcctacgctgatg

SEQ ID NO: 574318 - DNA, 25 bp, Mus musculus
cagtgtctatgcagggttcgattcc

SEQ ID NO: 574319 - DNA, 25 bp, Mus musculus
cagtgtctatgctgggttcgattcc

SEQ ID NO: 574320 - DNA, 25 bp, Mus musculus
cagtgtctcaagacacaggtgtgtg

SEQ ID NO: 574321 - DNA, 25 bp, Mus musculus
cagtgtctcaagtcacaggtgtgtg

SEQ ID NO: 574322 - DNA, 25 bp, Mus musculus
cagtgtctcccgagtgtatgaagaa

SEQ ID NO: 574323 - DNA, 25 bp, Mus musculus
cagtgtctcccgtgtgtatgaagaa

SEQ ID NO: 574324 - DNA, 25 bp, Mus musculus
cagtgtctcgagaattgaacttttc

SEQ ID NO: 574325 - DNA, 25 bp, Mus musculus
cagtgtctcgagtattgaacttttc

SEQ ID NO: 574326 - DNA, 25 bp, Mus musculus
cagtgtctgccccatattggtttgc

SEQ ID NO: 574327 - DNA, 25 bp, Mus musculus
cagtgtctgcccgatattggtttgc

SEQ ID NO: 574328 - DNA, 25 bp, Mus musculus
cagtgtctgctgagaagggaaactc

SEQ ID NO: 574329 - DNA, 25 bp, Mus musculus
cagtgtctgctgtgaagggaaactc

SEQ ID NO: 574330 - DNA, 25 bp, Mus musculus
cagtgtctggtaaaaagcccggagc

SEQ ID NO: 574331 - DNA, 25 bp, Mus musculus
cagtgtctggtataaagcccggagc

SEQ ID NO: 574332 - DNA, 25 bp, Mus musculus
cagtgtcttcgtattgtatgccaca

SEQ ID NO: 574333 - DNA, 25 bp, Mus musculus
cagtgtcttcgttttgtatgccaca

SEQ ID NO: 574334 - DNA, 25 bp, Mus musculus
cagtgtcttgatcgaggagaataat

SEQ ID NO: 574335 - DNA, 25 bp, Mus musculus
cagtgtcttgatggaggagaataat

SEQ ID NO: 574336 - DNA, 25 bp, Mus musculus
cagtgtgaaatcactcccctcatct

SEQ ID NO: 574337 - DNA, 25 bp, Mus musculus
cagtgtgaaatctctcccctcatct

SEQ ID NO: 574338 - DNA, 25 bp, Mus musculus
cagtgtgaagcgcatgacgcctgac

SEQ ID NO: 574339 - DNA, 25 bp, Mus musculus
cagtgtgaagcggatgacgcctgac

SEQ ID NO: 574340 - DNA, 25 bp, Mus musculus
cagtgtgaatgcactggttccagat

SEQ ID NO: 574341 - DNA, 25 bp, Mus musculus
cagtgtgaatgctctggttccagat

SEQ ID NO: 574342 - DNA, 25 bp, Mus musculus
cagtgtgacccaagcttattaccga

SEQ ID NO: 574343 - DNA, 25 bp, Mus musculus
cagtgtgacccatgcttattaccga

SEQ ID NO: 574344 - DNA, 25 bp, Mus musculus
cagtgtgactgacctagtaagagtg

SEQ ID NO: 574345 - DNA, 25 bp, Mus musculus
cagtgtgactgagctagtaagagtg

SEQ ID NO: 574346 - DNA, 25 bp, Mus musculus
cagtgtgagctgctcctagaagagc

SEQ ID NO: 574347 - DNA, 25 bp, Mus musculus
cagtgtgagctggtcctagaagagc

SEQ ID NO: 574348 - DNA, 25 bp, Mus musculus
cagtgtgagcttccctatttctgtc

SEQ ID NO: 574349 - DNA, 25 bp, Mus musculus
cagtgtgagcttgcctatttctgtc

SEQ ID NO: 574350 - DNA, 25 bp, Mus musculus
cagtgtgaggctctatatgaagctc

SEQ ID NO: 574351 - DNA, 25 bp, Mus musculus
cagtgtgaggctgtatatgaagctc

SEQ ID NO: 574352 - DNA, 25 bp, Mus musculus
cagtgtgagtgtcaacacaacacca

SEQ ID NO: 574353 - DNA, 25 bp, Mus musculus
cagtgtgagtgtgaacacaacacca

SEQ ID NO: 574354 - DNA, 25 bp, Mus musculus
cagtgtgataaccagcggtattacc

SEQ ID NO: 574355 - DNA, 25 bp, Mus musculus
cagtgtgataacgagcggtattacc

SEQ ID NO: 574356 - DNA, 25 bp, Mus musculus
cagtgtgatcccattatagcccagc

SEQ ID NO: 574357 - DNA, 25 bp, Mus musculus
cagtgtgatccctttatagcccagc

SEQ ID NO: 574358 - DNA, 25 bp, Mus musculus
cagtgtgatgcaagcatggcagttg

SEQ ID NO: 574359 - DNA, 25 bp, Mus musculus
cagtgtgatgcatgcatggcagttg

SEQ ID NO: 574360 - DNA, 25 bp, Mus musculus
cagtgtgattatctgggacccctac

SEQ ID NO: 574361 - DNA, 25 bp, Mus musculus
cagtgtgattatgtgggacccctac

SEQ ID NO: 574362 - DNA, 25 bp, Mus musculus
cagtgtgattgtactcgcacgggct

SEQ ID NO: 574363 - DNA, 25 bp, Mus musculus
cagtgtgattgttctcgcacgggct

SEQ ID NO: 574364 - DNA, 25 bp, Mus musculus
cagtgtgcaaggaaaatacttaaca

SEQ ID NO: 574365 - DNA, 25 bp, Mus musculus
cagtgtgcaaggtaaatacttaaca

SEQ ID NO: 574366 - DNA, 25 bp, Mus musculus
cagtgtgcagatactaccatggtag

SEQ ID NO: 574367 - DNA, 25 bp, Mus musculus
cagtgtgcagattctaccatggtag

SEQ ID NO: 574368 - DNA, 25 bp, Mus musculus
cagtgtgcagctatctgaggtttca

SEQ ID NO: 574369 - DNA, 25 bp, Mus musculus
cagtgtgcagctttctgaggtttca

SEQ ID NO: 574370 - DNA, 25 bp, Mus musculus
cagtgtgctgctcacagtgaatgcc

SEQ ID NO: 574371 - DNA, 25 bp, Mus musculus
cagtgtgctgctgacagtgaatgcc

SEQ ID NO: 574372 - DNA, 25 bp, Mus musculus
cagtgtggacaacctttccatgaaa

SEQ ID NO: 574373 - DNA, 25 bp, Mus musculus
cagtgtggacaagctttccatgaaa

SEQ ID NO: 574374 - DNA, 25 bp, Mus musculus
cagtgtggctgcattccaggtgatg

SEQ ID NO: 574375 - DNA, 25 bp, Mus musculus
cagtgtggctgctttccaggtgatg

SEQ ID NO: 574376 - DNA, 25 bp, Mus musculus
cagtgtgggagcatcatgccactca

SEQ ID NO: 574377 - DNA, 25 bp, Mus musculus
cagtgtgggagcttcatgccactca

SEQ ID NO: 574378 - DNA, 25 bp, Mus musculus
cagtgtgggatacccatctcggata

SEQ ID NO: 574379 - DNA, 25 bp, Mus musculus
cagtgtgggatagccatctcggata

SEQ ID NO: 574380 - DNA, 25 bp, Mus musculus
cagtgtgggcgtccactgacagccc

SEQ ID NO: 574381 - DNA, 25 bp, Mus musculus
cagtgtgggcgtgcactgacagccc

SEQ ID NO: 574382 - DNA, 25 bp, Mus musculus
cagtgtggtcacactcggattcctc

SEQ ID NO: 574383 - DNA, 25 bp, Mus musculus
cagtgtggtcactctcggattcctc

SEQ ID NO: 574384 - DNA, 25 bp, Mus musculus
cagtgtggtctaagtctgtggcaag

SEQ ID NO: 574385 - DNA, 25 bp, Mus musculus
cagtgtggtctatgtctgtggcaag

SEQ ID NO: 574386 - DNA, 25 bp, Mus musculus
cagtgtggtctgcttcctgtcacct

SEQ ID NO: 574387 - DNA, 25 bp, Mus musculus
cagtgtggtctggttcctgtcacct

SEQ ID NO: 574388 - DNA, 25 bp, Mus musculus
cagtgtgtagaaagaaaatgccctt

SEQ ID NO: 574389 - DNA, 25 bp, Mus musculus
cagtgtgtagaatgaaaatgccctt

SEQ ID NO: 574390 - DNA, 25 bp, Mus musculus
cagtgtgtagccaaaaggtggtcgt

SEQ ID NO: 574391 - DNA, 25 bp, Mus musculus
cagtgtgtagcctaaaggtggtcgt

SEQ ID NO: 574392 - DNA, 25 bp, Mus musculus
cagtgtgtcattagtctcagagaac

SEQ ID NO: 574393 - DNA, 25 bp, Mus musculus
cagtgtgtcattcgtactgctcagg

SEQ ID NO: 574394 - DNA, 25 bp, Mus musculus
cagtgtgtcattggtactgctcagg

SEQ ID NO: 574395 - DNA, 25 bp, Mus musculus
cagtgtgtcatttgtctcagagaac

SEQ ID NO: 574396 - DNA, 25 bp, Mus musculus
cagtgtgtgcctcgcccctcggatt

SEQ ID NO: 574397 - DNA, 25 bp, Mus musculus
cagtgtgtgcctggcccctcggatt

SEQ ID NO: 574398 - DNA, 25 bp, Mus musculus
cagtgtgtgctacagcgctgctgtc

SEQ ID NO: 574399 - DNA, 25 bp, Mus musculus
cagtgtgtgctagagcgctgctgtc

SEQ ID NO: 574400 - DNA, 25 bp, Mus musculus
cagtgtgtgggcaatagccgcagca

SEQ ID NO: 574401 - DNA, 25 bp, Mus musculus
cagtgtgtgggctatagccgcagca

SEQ ID NO: 574402 - DNA, 25 bp, Mus musculus
cagtgtgtgtgtcaaccgctttggc

SEQ ID NO: 574403 - DNA, 25 bp, Mus musculus
cagtgtgtgtgtgaaccgctttggc

SEQ ID NO: 574404 - DNA, 25 bp, Mus musculus
cagtgtgttaagcaacgccggcaag

SEQ ID NO: 574405 - DNA, 25 bp, Mus musculus
cagtgtgttaaggaacgccggcaag

SEQ ID NO: 574406 - DNA, 25 bp, Mus musculus
cagtgttacactcgagttttcggtt

SEQ ID NO: 574407 - DNA, 25 bp, Mus musculus
cagtgttacactggagttttcggtt

SEQ ID NO: 574408 - DNA, 25 bp, Mus musculus
cagtgttactcaagtaaccaggacc

SEQ ID NO: 574409 - DNA, 25 bp, Mus musculus
cagtgttactcatgtaaccaggacc

SEQ ID NO: 574410 - DNA, 25 bp, Mus musculus
cagtgttactgcattcctgaggaat

SEQ ID NO: 574411 - DNA, 25 bp, Mus musculus
cagtgttactgctttcctgaggaat

SEQ ID NO: 574412 - DNA, 25 bp, Mus musculus
cagtgttagtctaggacaaatgcac

SEQ ID NO: 574413 - DNA, 25 bp, Mus musculus
cagtgttagtcttggacaaatgcac

SEQ ID NO: 574414 - DNA, 25 bp, Mus musculus
cagtgttcacagaggactgcaacgt

SEQ ID NO: 574415 - DNA, 25 bp, Mus musculus
cagtgttcacagtggactgcaacgt

SEQ ID NO: 574416 - DNA, 25 bp, Mus musculus
cagtgttcagaaatacattgtggtc

SEQ ID NO: 574417 - DNA, 25 bp, Mus musculus
cagtgttcagaattacattgtggtc

SEQ ID NO: 574418 - DNA, 25 bp, Mus musculus
cagtgttccatcaacagggatggca

SEQ ID NO: 574419 - DNA, 25 bp, Mus musculus
cagtgttccatctacagggatggca

SEQ ID NO: 574420 - DNA, 25 bp, Mus musculus
cagtgttcctcccagtgcggcatta

SEQ ID NO: 574421 - DNA, 25 bp, Mus musculus
cagtgttcctccgagtgcggcatta

SEQ ID NO: 574422 - DNA, 25 bp, Mus musculus
cagtgttctcctccctcatgctgga

SEQ ID NO: 574423 - DNA, 25 bp, Mus musculus
cagtgttctcctgcctcatgctgga

SEQ ID NO: 574424 - DNA, 25 bp, Mus musculus
cagtgttctgtaccaatgccatcaa

SEQ ID NO: 574425 - DNA, 25 bp, Mus musculus
cagtgttctgtagcaatgccatcaa

SEQ ID NO: 574426 - DNA, 25 bp, Mus musculus
cagtgttgaagccttggtctgtcat

SEQ ID NO: 574427 - DNA, 25 bp, Mus musculus
cagtgttgaagcgttggtctgtcat

SEQ ID NO: 574428 - DNA, 25 bp, Mus musculus
cagtgttgatgtcggtatttactta

SEQ ID NO: 574429 - DNA, 25 bp, Mus musculus
cagtgttgatgtgggtatttactta

SEQ ID NO: 574430 - DNA, 25 bp, Mus musculus
cagtgttggaagatataagggcagc

SEQ ID NO: 574431 - DNA, 25 bp, Mus musculus
cagtgttggaagttataagggcagc

SEQ ID NO: 574432 - DNA, 25 bp, Mus musculus
cagtgttggaccacgggatccaagc

SEQ ID NO: 574433 - DNA, 25 bp, Mus musculus
cagtgttggacctcgggatccaagc

SEQ ID NO: 574434 - DNA, 25 bp, Mus musculus
cagtgttggtaacaagaacccgtct

SEQ ID NO: 574435 - DNA, 25 bp, Mus musculus
cagtgttggtaagaagaacccgtct

SEQ ID NO: 574436 - DNA, 25 bp, Mus musculus
cagtgttgtcatcagtggttaagga

SEQ ID NO: 574437 - DNA, 25 bp, Mus musculus
cagtgttgtcatgagtggttaagga

SEQ ID NO: 574438 - DNA, 25 bp, Mus musculus
cagtgttgtgcaacctcagttatga

SEQ ID NO: 574439 - DNA, 25 bp, Mus musculus
cagtgttgtgcatcctcagttatga

SEQ ID NO: 574440 - DNA, 25 bp, Mus musculus
cagtgttgtggtctccttcttcctc

SEQ ID NO: 574441 - DNA, 25 bp, Mus musculus
cagtgttgtggtgtccttcttcctc

SEQ ID NO: 574442 - DNA, 25 bp, Mus musculus
cagtgttgttggctactgtatgccc

SEQ ID NO: 574443 - DNA, 25 bp, Mus musculus
cagtgttgttgggtactgtatgccc

SEQ ID NO: 574444 - DNA, 25 bp, Mus musculus
cagtgtttagagagcgagaagcatg

SEQ ID NO: 574445 - DNA, 25 bp, Mus musculus
cagtgtttagagtgcgagaagcatg

SEQ ID NO: 574446 - DNA, 25 bp, Mus musculus
cagtgtttcctcatcgtggtggcga

SEQ ID NO: 574447 - DNA, 25 bp, Mus musculus
cagtgtttcctcttcgtggtggcga

SEQ ID NO: 574448 - DNA, 25 bp, Mus musculus
cagtgtttgacacacatcaagaacc

SEQ ID NO: 574449 - DNA, 25 bp, Mus musculus
cagtgtttgacagacatcaagaacc

SEQ ID NO: 574450 - DNA, 25 bp, Mus musculus
cagtgttttagcaagcacgaggcac

SEQ ID NO: 574451 - DNA, 25 bp, Mus musculus
cagtgttttagctagcacgaggcac

SEQ ID NO: 574452 - DNA, 25 bp, Mus musculus
cagtgttttccaacctgttagaatc

SEQ ID NO: 574453 - DNA, 25 bp, Mus musculus
cagtgttttccatcctgttagaatc

SEQ ID NO: 574454 - DNA, 25 bp, Mus musculus
cagtgttttggtcaacagtgggcca

SEQ ID NO: 574455 - DNA, 25 bp, Mus musculus
cagtgttttggtgaacagtgggcca

SEQ ID NO: 574456 - DNA, 25 bp, Mus musculus
cagttaaacctcaatgtgcaatgtc

SEQ ID NO: 574457 - DNA, 25 bp, Mus musculus
cagttaaacctctatgtgcaatgtc

SEQ ID NO: 574458 - DNA, 25 bp, Mus musculus
cagttaaactttatccctggctctg

SEQ ID NO: 574459 - DNA, 25 bp, Mus musculus
cagttaaactttttccctggctctg

SEQ ID NO: 574460 - DNA, 25 bp, Mus musculus
cagttaaagtgtcagaaccttaaag

SEQ ID NO: 574461 - DNA, 25 bp, Mus musculus
cagttaaagtgtgagaaccttaaag

SEQ ID NO: 574462 - DNA, 25 bp, Mus musculus
cagttaacaatcaaggaaccgtggg

SEQ ID NO: 574463 - DNA, 25 bp, Mus musculus
cagttaacaatctaggaaccgtggg

SEQ ID NO: 574464 - DNA, 25 bp, Mus musculus
cagttaacatggctgcgactagttg

SEQ ID NO: 574465 - DNA, 25 bp, Mus musculus
cagttaacatgggtgcgactagttg

SEQ ID NO: 574466 - DNA, 25 bp, Mus musculus
cagttaactgaaacctctgaagagg

SEQ ID NO: 574467 - DNA, 25 bp, Mus musculus
cagttaactgaatcctctgaagagg

SEQ ID NO: 574468 - DNA, 25 bp, Mus musculus
cagttaagaataatggatcagacct

SEQ ID NO: 574469 - DNA, 25 bp, Mus musculus
cagttaagaatattggatcagacct

SEQ ID NO: 574470 - DNA, 25 bp, Mus musculus
cagttaatttcacgctgcccagggc

SEQ ID NO: 574471 - DNA, 25 bp, Mus musculus
cagttaatttcaggctgcccagggc

SEQ ID NO: 574472 - DNA, 25 bp, Mus musculus
cagttacaaaacatcggtgggcgac

SEQ ID NO: 574473 - DNA, 25 bp, Mus musculus
cagttacaaaacttcggtgggcgac

SEQ ID NO: 574474 - DNA, 25 bp, Mus musculus
cagttacagaagaggttcccgccgc

SEQ ID NO: 574475 - DNA, 25 bp, Mus musculus
cagttacagaagtggttcccgccgc

SEQ ID NO: 574476 - DNA, 25 bp, Mus musculus
cagttacagggaaaaaacctccatg

SEQ ID NO: 574477 - DNA, 25 bp, Mus musculus
cagttacagggataaaacctccatg

SEQ ID NO: 574478 - DNA, 25 bp, Mus musculus
cagttacagtgtctggattcgggct

SEQ ID NO: 574479 - DNA, 25 bp, Mus musculus
cagttacagtgtgtggattcgggct

SEQ ID NO: 574480 - DNA, 25 bp, Mus musculus
cagttacatggtcttggcaccagtg

SEQ ID NO: 574481 - DNA, 25 bp, Mus musculus
cagttacatggtgttggcaccagtg

SEQ ID NO: 574482 - DNA, 25 bp, Mus musculus
cagttaccaaaaatgaacttgccgt

SEQ ID NO: 574483 - DNA, 25 bp, Mus musculus
cagttaccaaaattgaacttgccgt

SEQ ID NO: 574484 - DNA, 25 bp, Mus musculus
cagttacccatgcatctgccttttc

SEQ ID NO: 574485 - DNA, 25 bp, Mus musculus
cagttacccatggatctgccttttc

SEQ ID NO: 574486 - DNA, 25 bp, Mus musculus
cagttaccctgaagaggactactct

SEQ ID NO: 574487 - DNA, 25 bp, Mus musculus
cagttaccctgatgaggactactct

SEQ ID NO: 574488 - DNA, 25 bp, Mus musculus
cagttacgacaaccatacttatggc

SEQ ID NO: 574489 - DNA, 25 bp, Mus musculus
cagttacgacaagcatacttatggc

SEQ ID NO: 574490 - DNA, 25 bp, Mus musculus
cagttactatgtctctgcctacaga

SEQ ID NO: 574491 - DNA, 25 bp, Mus musculus
cagttactatgtgtctgcctacaga

SEQ ID NO: 574492 - DNA, 25 bp, Mus musculus
cagttactccctcataacttcatag

SEQ ID NO: 574493 - DNA, 25 bp, Mus musculus
cagttactccctgataacttcatag

SEQ ID NO: 574494 - DNA, 25 bp, Mus musculus
cagttactgactaatgaatgattga

SEQ ID NO: 574495 - DNA, 25 bp, Mus musculus
cagttactgacttatgaatgattga

SEQ ID NO: 574496 - DNA, 25 bp, Mus musculus
cagttactgctacagcaggcgcagg

SEQ ID NO: 574497 - DNA, 25 bp, Mus musculus
cagttactgctagagcaggcgcagg

SEQ ID NO: 574498 - DNA, 25 bp, Mus musculus
cagttacttgctctgtgcaatggga

SEQ ID NO: 574499 - DNA, 25 bp, Mus musculus
cagttacttgctgtgtgcaatggga

SEQ ID NO: 574500 - DNA, 25 bp, Mus musculus
cagttagagccaccagtaagaggac

SEQ ID NO: 574501 - DNA, 25 bp, Mus musculus
cagttagagccagcagtaagaggac

SEQ ID NO: 574502 - DNA, 25 bp, Mus musculus
cagttagagctgcagcgcataggcc

SEQ ID NO: 574503 - DNA, 25 bp, Mus musculus
cagttagagctggagcgcataggcc

SEQ ID NO: 574504 - DNA, 25 bp, Mus musculus
cagttagaggctagtggaatgagaa

SEQ ID NO: 574505 - DNA, 25 bp, Mus musculus
cagttagaggcttgtggaatgagaa

SEQ ID NO: 574506 - DNA, 25 bp, Mus musculus
cagttagagtcaccccggagggagg

SEQ ID NO: 574507 - DNA, 25 bp, Mus musculus
cagttagagtcagcccggagggagg

SEQ ID NO: 574508 - DNA, 25 bp, Mus musculus
cagttagatgaacagatcaaggagc

SEQ ID NO: 574509 - DNA, 25 bp, Mus musculus
cagttagatgaagagatcaaggagc

SEQ ID NO: 574510 - DNA, 25 bp, Mus musculus
cagttagattggcagcaggttgact

SEQ ID NO: 574511 - DNA, 25 bp, Mus musculus
cagttagattgggagcaggttgact

SEQ ID NO: 574512 - DNA, 25 bp, Mus musculus
cagttagctgccattcctgagttta

SEQ ID NO: 574513 - DNA, 25 bp, Mus musculus
cagttagctgcctttcctgagttta

SEQ ID NO: 574514 - DNA, 25 bp, Mus musculus
cagttaggctggctgatttggatcc

SEQ ID NO: 574515 - DNA, 25 bp, Mus musculus
cagttaggctgggtgatttggatcc

SEQ ID NO: 574516 - DNA, 25 bp, Mus musculus
cagttaggttccagaatgccagcca

SEQ ID NO: 574517 - DNA, 25 bp, Mus musculus
cagttaggttcctgaatgccagcca

SEQ ID NO: 574518 - DNA, 25 bp, Mus musculus
cagttagtaggacgacttcaggcca

SEQ ID NO: 574519 - DNA, 25 bp, Mus musculus
cagttagtaggaggacttcaggcca

SEQ ID NO: 574520 - DNA, 25 bp, Mus musculus
cagttagtgtagctttgttgcgcca

SEQ ID NO: 574521 - DNA, 25 bp, Mus musculus
cagttagtgtaggtttgttgcgcca

SEQ ID NO: 574522 - DNA, 25 bp, Mus musculus
cagttagttctgattgaaaaagaca

SEQ ID NO: 574523 - DNA, 25 bp, Mus musculus
cagttagttctgtttgaaaaagaca

SEQ ID NO: 574524 - DNA, 25 bp, Mus musculus
cagttatatctgaatgatgctttcc

SEQ ID NO: 574525 - DNA, 25 bp, Mus musculus
cagttatatctgtatgatgctttcc

SEQ ID NO: 574526 - DNA, 25 bp, Mus musculus
cagttatctgggacagaacaactag

SEQ ID NO: 574527 - DNA, 25 bp, Mus musculus
cagttatctgggtcagaacaactag

SEQ ID NO: 574528 - DNA, 25 bp, Mus musculus
cagttatctgtccagaaaccagatc

SEQ ID NO: 574529 - DNA, 25 bp, Mus musculus
cagttatctgtcgagaaaccagatc

SEQ ID NO: 574530 - DNA, 25 bp, Mus musculus
cagttatgatcccaggatcagacca

SEQ ID NO: 574531 - DNA, 25 bp, Mus musculus
cagttatgatccgaggatcagacca

SEQ ID NO: 574532 - DNA, 25 bp, Mus musculus
cagttatgatggctttggacccttc

SEQ ID NO: 574533 - DNA, 25 bp, Mus musculus
cagttatgatgggtttggacccttc

SEQ ID NO: 574534 - DNA, 25 bp, Mus musculus
cagttattcaacagccacgacaaaa

SEQ ID NO: 574535 - DNA, 25 bp, Mus musculus
cagttattcaactgccacgacaaaa

SEQ ID NO: 574536 - DNA, 25 bp, Mus musculus
cagttattcagtcagatcggaccct

SEQ ID NO: 574537 - DNA, 25 bp, Mus musculus
cagttattcagtgagatcggaccct

SEQ ID NO: 574538 - DNA, 25 bp, Mus musculus
cagttattcattagtccaagtgtcc

SEQ ID NO: 574539 - DNA, 25 bp, Mus musculus
cagttattcatttgtccaagtgtcc

SEQ ID NO: 574540 - DNA, 25 bp, Mus musculus
cagttattgccgctggccctacggt

SEQ ID NO: 574541 - DNA, 25 bp, Mus musculus
cagttattgccggtggccctacggt

SEQ ID NO: 574542 - DNA, 25 bp, Mus musculus
cagttattgctcagggatccaacga

SEQ ID NO: 574543 - DNA, 25 bp, Mus musculus
cagttattgctctgggatccaacga

SEQ ID NO: 574544 - DNA, 25 bp, Mus musculus
cagttatttaagcaagtgaccagtg

SEQ ID NO: 574545 - DNA, 25 bp, Mus musculus
cagttatttaaggaagtgaccagtg

SEQ ID NO: 574546 - DNA, 25 bp, Mus musculus
cagttatttacaccaggtggctccc

SEQ ID NO: 574547 - DNA, 25 bp, Mus musculus
cagttatttacagcaggtggctccc

SEQ ID NO: 574548 - DNA, 25 bp, Mus musculus
cagttcaaccccacagacttttagt

SEQ ID NO: 574549 - DNA, 25 bp, Mus musculus
cagttcaacccctcagacttttagt

SEQ ID NO: 574550 - DNA, 25 bp, Mus musculus
cagttcaacctcaatccagaaacat

SEQ ID NO: 574551 - DNA, 25 bp, Mus musculus
cagttcaacctctatccagaaacat

SEQ ID NO: 574552 - DNA, 25 bp, Mus musculus
cagttcaagaatcgattgttatcgc

SEQ ID NO: 574553 - DNA, 25 bp, Mus musculus
cagttcaagaatggattgttatcgc

SEQ ID NO: 574554 - DNA, 25 bp, Mus musculus
cagttcaagcaccatggctcaggcc

SEQ ID NO: 574555 - DNA, 25 bp, Mus musculus
cagttcaagcacgatggctcaggcc

SEQ ID NO: 574556 - DNA, 25 bp, Mus musculus
cagttcaaggatattcagcggagga

SEQ ID NO: 574557 - DNA, 25 bp, Mus musculus
cagttcaaggattttcagcggagga

SEQ ID NO: 574558 - DNA, 25 bp, Mus musculus
cagttcaatgcacccaacgacattg

SEQ ID NO: 574559 - DNA, 25 bp, Mus musculus
cagttcaatgcagccaacgacattg

SEQ ID NO: 574560 - DNA, 25 bp, Mus musculus
cagttcaccgtcagactggcatcgg

SEQ ID NO: 574561 - DNA, 25 bp, Mus musculus
cagttcaccgtctgactggcatcgg

SEQ ID NO: 574562 - DNA, 25 bp, Mus musculus
cagttcacggtaaacaagcggatgt

SEQ ID NO: 574563 - DNA, 25 bp, Mus musculus
cagttcacggtatacaagcggatgt

SEQ ID NO: 574564 - DNA, 25 bp, Mus musculus
cagttcactgctctgcctggctgga

SEQ ID NO: 574565 - DNA, 25 bp, Mus musculus
cagttcactgctgtgcctggctgga

SEQ ID NO: 574566 - DNA, 25 bp, Mus musculus
cagttcactgttagactaagtgttc

SEQ ID NO: 574567 - DNA, 25 bp, Mus musculus
cagttcactgtttgactaagtgttc

SEQ ID NO: 574568 - DNA, 25 bp, Mus musculus
cagttcagaactacccggatgatgg

SEQ ID NO: 574569 - DNA, 25 bp, Mus musculus
cagttcagaacttcccggatgatgg

SEQ ID NO: 574570 - DNA, 25 bp, Mus musculus
cagttcagacaacgcccctgtggtg

SEQ ID NO: 574571 - DNA, 25 bp, Mus musculus
cagttcagacaaggcccctgtggtg

SEQ ID NO: 574572 - DNA, 25 bp, Mus musculus
cagttcagaccaagaattcactgca

SEQ ID NO: 574573 - DNA, 25 bp, Mus musculus
cagttcagaccatgaattcactgca

SEQ ID NO: 574574 - DNA, 25 bp, Mus musculus
cagttcagagaactccaagtgcagt

SEQ ID NO: 574575 - DNA, 25 bp, Mus musculus
cagttcagagaagtccaagtgcagt

SEQ ID NO: 574576 - DNA, 25 bp, Mus musculus
cagttcagatcacaagctaggctcc

SEQ ID NO: 574577 - DNA, 25 bp, Mus musculus
cagttcagatcagaagctaggctcc

SEQ ID NO: 574578 - DNA, 25 bp, Mus musculus
cagttcagcaagctattgagcaaaa

SEQ ID NO: 574579 - DNA, 25 bp, Mus musculus
cagttcagcaaggtattgagcaaaa

SEQ ID NO: 574580 - DNA, 25 bp, Mus musculus
cagttcagcctcaatacgtctcctt

SEQ ID NO: 574581 - DNA, 25 bp, Mus musculus
cagttcagcctctatacgtctcctt

SEQ ID NO: 574582 - DNA, 25 bp, Mus musculus
cagttcaggaccatcgaagatgact

SEQ ID NO: 574583 - DNA, 25 bp, Mus musculus
cagttcaggaccttcgaagatgact

SEQ ID NO: 574584 - DNA, 25 bp, Mus musculus
cagttcaggactaggctgccttcca

SEQ ID NO: 574585 - DNA, 25 bp, Mus musculus
cagttcaggacttggctgccttcca

SEQ ID NO: 574586 - DNA, 25 bp, Mus musculus
cagttcaggccacgagcaggctttc

SEQ ID NO: 574587 - DNA, 25 bp, Mus musculus
cagttcaggccaggagcaggctttc

SEQ ID NO: 574588 - DNA, 25 bp, Mus musculus
cagttcaggctaccacggctgtcaa

SEQ ID NO: 574589 - DNA, 25 bp, Mus musculus
cagttcaggctagcacggctgtcaa

SEQ ID NO: 574590 - DNA, 25 bp, Mus musculus
cagttcagggaacatcggtctctgc

SEQ ID NO: 574591 - DNA, 25 bp, Mus musculus
cagttcagggaagatcggtctctgc

SEQ ID NO: 574592 - DNA, 25 bp, Mus musculus
cagttcaggtcaacactggatatca

SEQ ID NO: 574593 - DNA, 25 bp, Mus musculus
cagttcaggtcatcactggatatca

SEQ ID NO: 574594 - DNA, 25 bp, Mus musculus
cagttcagtgagctttacaaggcca

SEQ ID NO: 574595 - DNA, 25 bp, Mus musculus
cagttcagtgaggtttacaaggcca

SEQ ID NO: 574596 - DNA, 25 bp, Mus musculus
cagttcagtgatccatctcctatgc

SEQ ID NO: 574597 - DNA, 25 bp, Mus musculus
cagttcagtgatgcatctcctatgc

SEQ ID NO: 574598 - DNA, 25 bp, Mus musculus
cagttcatcagcaaatttccatgtg

SEQ ID NO: 574599 - DNA, 25 bp, Mus musculus
cagttcatcagctaatttccatgtg

SEQ ID NO: 574600 - DNA, 25 bp, Mus musculus
cagttcatgatgactctgacaggaa

SEQ ID NO: 574601 - DNA, 25 bp, Mus musculus
cagttcatgatgtctctgacaggaa

SEQ ID NO: 574602 - DNA, 25 bp, Mus musculus
cagttcatgcaacagagagtggccg

SEQ ID NO: 574603 - DNA, 25 bp, Mus musculus
cagttcatgcaagagagagtggccg

SEQ ID NO: 574604 - DNA, 25 bp, Mus musculus
cagttcatgctgcaacatggtgccc

SEQ ID NO: 574605 - DNA, 25 bp, Mus musculus
cagttcatgctggaacatggtgccc

SEQ ID NO: 574606 - DNA, 25 bp, Mus musculus
cagttcattcacaagcctacacaac

SEQ ID NO: 574607 - DNA, 25 bp, Mus musculus
cagttcattcactagcctacacaac

SEQ ID NO: 574608 - DNA, 25 bp, Mus musculus
cagttcattccaacagagttcagag

SEQ ID NO: 574609 - DNA, 25 bp, Mus musculus
cagttcattccatcagagttcagag

SEQ ID NO: 574610 - DNA, 25 bp, Mus musculus
cagttccaaagtacttacaacagag

SEQ ID NO: 574611 - DNA, 25 bp, Mus musculus
cagttccaaagttcttacaacagag

SEQ ID NO: 574612 - DNA, 25 bp, Mus musculus
cagttccaagacagcttctcctacg

SEQ ID NO: 574613 - DNA, 25 bp, Mus musculus
cagttccaagactgcttctcctacg

SEQ ID NO: 574614 - DNA, 25 bp, Mus musculus
cagttccaatttcagataatgcctc

SEQ ID NO: 574615 - DNA, 25 bp, Mus musculus
cagttccaatttgagataatgcctc

SEQ ID NO: 574616 - DNA, 25 bp, Mus musculus
cagttccacgggaggatcaagagtt

SEQ ID NO: 574617 - DNA, 25 bp, Mus musculus
cagttccacgggtggatcaagagtt

SEQ ID NO: 574618 - DNA, 25 bp, Mus musculus
cagttccacgtgatcgatgccgagg

SEQ ID NO: 574619 - DNA, 25 bp, Mus musculus
cagttccacgtgttcgatgccgagg

SEQ ID NO: 574620 - DNA, 25 bp, Mus musculus
cagttccactggactgggctgaagt

SEQ ID NO: 574621 - DNA, 25 bp, Mus musculus
cagttccactggtctgggctgaagt

SEQ ID NO: 574622 - DNA, 25 bp, Mus musculus
cagttccagaacatgcggcaagtga

SEQ ID NO: 574623 - DNA, 25 bp, Mus musculus
cagttccagaacttgcggcaagtga

SEQ ID NO: 574624 - DNA, 25 bp, Mus musculus
cagttccagactcggcttgtgtcgg

SEQ ID NO: 574625 - DNA, 25 bp, Mus musculus
cagttccagactgggcttgtgtcgg

SEQ ID NO: 574626 - DNA, 25 bp, Mus musculus
cagttccagggacggagctactttg

SEQ ID NO: 574627 - DNA, 25 bp, Mus musculus
cagttccagggagggagctactttg

SEQ ID NO: 574628 - DNA, 25 bp, Mus musculus
cagttccaggtgatgctgcccaagg

SEQ ID NO: 574629 - DNA, 25 bp, Mus musculus
cagttccaggtgttgctgcccaagg

SEQ ID NO: 574630 - DNA, 25 bp, Mus musculus
cagttcccaccacagatgtatctca

SEQ ID NO: 574631 - DNA, 25 bp, Mus musculus
cagttcccaccagagatgtatctca

SEQ ID NO: 574632 - DNA, 25 bp, Mus musculus
cagttcccgatacagtaattttgac

SEQ ID NO: 574633 - DNA, 25 bp, Mus musculus
cagttcccgatagagtaattttgac

SEQ ID NO: 574634 - DNA, 25 bp, Mus musculus
cagttccctaggaggtagtccctgg

SEQ ID NO: 574635 - DNA, 25 bp, Mus musculus
cagttccctaggtggtagtccctgg

SEQ ID NO: 574636 - DNA, 25 bp, Mus musculus
cagttccctcacagtctggtcaggg

SEQ ID NO: 574637 - DNA, 25 bp, Mus musculus
cagttccctcactgtctggtcaggg

SEQ ID NO: 574638 - DNA, 25 bp, Mus musculus
cagttccctcataataaaaaggtca

SEQ ID NO: 574639 - DNA, 25 bp, Mus musculus
cagttccctcattataaaaaggtca

SEQ ID NO: 574640 - DNA, 25 bp, Mus musculus
cagttccctgatatcttcgcccggg

SEQ ID NO: 574641 - DNA, 25 bp, Mus musculus
cagttccctgatttcttcgcccggg

SEQ ID NO: 574642 - DNA, 25 bp, Mus musculus
cagttcccttggagaagtgtatcca

SEQ ID NO: 574643 - DNA, 25 bp, Mus musculus
cagttcccttggtgaagtgtatcca

SEQ ID NO: 574644 - DNA, 25 bp, Mus musculus
cagttccgacgtatgcgcatggtgg

SEQ ID NO: 574645 - DNA, 25 bp, Mus musculus
cagttccgacgtttgcgcatggtgg

SEQ ID NO: 574646 - DNA, 25 bp, Mus musculus
cagttccgcactagtttgccaggga

SEQ ID NO: 574647 - DNA, 25 bp, Mus musculus
cagttccgcacttgtttgccaggga

SEQ ID NO: 574648 - DNA, 25 bp, Mus musculus
cagttccgtcgacttggctctgtga

SEQ ID NO: 574649 - DNA, 25 bp, Mus musculus
cagttccgtcgagttggctctgtga

SEQ ID NO: 574650 - DNA, 25 bp, Mus musculus
cagttcctcatgagctctagagcca

SEQ ID NO: 574651 - DNA, 25 bp, Mus musculus
cagttcctcatgtgctctagagcca

SEQ ID NO: 574652 - DNA, 25 bp, Mus musculus
cagttcctgactctgcagttgctag

SEQ ID NO: 574653 - DNA, 25 bp, Mus musculus
cagttcctgactgtgcagttgctag

SEQ ID NO: 574654 - DNA, 25 bp, Mus musculus
cagttcctggagcttaacatgcgac

SEQ ID NO: 574655 - DNA, 25 bp, Mus musculus
cagttcctggaggttaacatgcgac

SEQ ID NO: 574656 - DNA, 25 bp, Mus musculus
cagttcctggcactccctgagttga

SEQ ID NO: 574657 - DNA, 25 bp, Mus musculus
cagttcctggcagtccctgagttga

SEQ ID NO: 574658 - DNA, 25 bp, Mus musculus
cagttcctgggaacgtgcgaccaga

SEQ ID NO: 574659 - DNA, 25 bp, Mus musculus
cagttcctgggatcgtgcgaccaga

SEQ ID NO: 574660 - DNA, 25 bp, Mus musculus
cagttcctgggcaagaacgtacagg

SEQ ID NO: 574661 - DNA, 25 bp, Mus musculus
cagttcctgggctagaacgtacagg

SEQ ID NO: 574662 - DNA, 25 bp, Mus musculus
cagttcgaagagagcttgggctgcc

SEQ ID NO: 574663 - DNA, 25 bp, Mus musculus
cagttcgaagagtgcttgggctgcc

SEQ ID NO: 574664 - DNA, 25 bp, Mus musculus
cagttcgaccccaataagctggcac

SEQ ID NO: 574665 - DNA, 25 bp, Mus musculus
cagttcgacccctataagctggcac

SEQ ID NO: 574666 - DNA, 25 bp, Mus musculus
cagttcgagaaaattgccatagaaa

SEQ ID NO: 574667 - DNA, 25 bp, Mus musculus
cagttcgagaaatttgccatagaaa

SEQ ID NO: 574668 - DNA, 25 bp, Mus musculus
cagttcgattggacagcctggctgc

SEQ ID NO: 574669 - DNA, 25 bp, Mus musculus
cagttcgattggtcagcctggctgc

SEQ ID NO: 574670 - DNA, 25 bp, Mus musculus
cagttcgccagccaagccaatatgg

SEQ ID NO: 574671 - DNA, 25 bp, Mus musculus
cagttcgccagcgaagccaatatgg

SEQ ID NO: 574672 - DNA, 25 bp, Mus musculus
cagttcgcgtcgactgaccagagtc

SEQ ID NO: 574673 - DNA, 25 bp, Mus musculus
cagttcgcgtcgtctgaccagagtc

SEQ ID NO: 574674 - DNA, 25 bp, Mus musculus
cagttcggcaacaagtacatccagc

SEQ ID NO: 574675 - DNA, 25 bp, Mus musculus
cagttcggcaactagtacatccagc

SEQ ID NO: 574676 - DNA, 25 bp, Mus musculus
cagttcgtgaacagtgtccgacagc

SEQ ID NO: 574677 - DNA, 25 bp, Mus musculus
cagttcgtgaactgtgtccgacagc

SEQ ID NO: 574678 - DNA, 25 bp, Mus musculus
cagttcgtgaggaggccttgttaag

SEQ ID NO: 574679 - DNA, 25 bp, Mus musculus
cagttcgtgaggtggccttgttaag

SEQ ID NO: 574680 - DNA, 25 bp, Mus musculus
cagttcgtggtgcacctgctcattg

SEQ ID NO: 574681 - DNA, 25 bp, Mus musculus
cagttcgtggtggacctgctcattg

SEQ ID NO: 574682 - DNA, 25 bp, Mus musculus
cagttcgtgtatcacctcagatggc

SEQ ID NO: 574683 - DNA, 25 bp, Mus musculus
cagttcgtgtatgacctcagatggc

SEQ ID NO: 574684 - DNA, 25 bp, Mus musculus
cagttctaagtgcagctccagttga

SEQ ID NO: 574685 - DNA, 25 bp, Mus musculus
cagttctaagtggagctccagttga

SEQ ID NO: 574686 - DNA, 25 bp, Mus musculus
cagttctaccatccagatcagaaag

SEQ ID NO: 574687 - DNA, 25 bp, Mus musculus
cagttctaccatgcagatcagaaag

SEQ ID NO: 574688 - DNA, 25 bp, Mus musculus
cagttctagacaatttccccttgtg

SEQ ID NO: 574689 - DNA, 25 bp, Mus musculus
cagttctagacattttccccttgtg

SEQ ID NO: 574690 - DNA, 25 bp, Mus musculus
cagttctagcggacgctctacccga

SEQ ID NO: 574691 - DNA, 25 bp, Mus musculus
cagttctagcggtcgctctacccga

SEQ ID NO: 574692 - DNA, 25 bp, Mus musculus
cagttctatactccttcctgaacag

SEQ ID NO: 574693 - DNA, 25 bp, Mus musculus
cagttctatactgcttcctgaacag

SEQ ID NO: 574694 - DNA, 25 bp, Mus musculus
cagttctatggacgcgacagctaca

SEQ ID NO: 574695 - DNA, 25 bp, Mus musculus
cagttctatggaggcgacagctaca

SEQ ID NO: 574696 - DNA, 25 bp, Mus musculus
cagttctcaagtcaggagtccagca

SEQ ID NO: 574697 - DNA, 25 bp, Mus musculus
cagttctcaagtgaggagtccagca

SEQ ID NO: 574698 - DNA, 25 bp, Mus musculus
cagttctcactaaggcagctctagg

SEQ ID NO: 574699 - DNA, 25 bp, Mus musculus
cagttctcactatggcagctctagg

SEQ ID NO: 574700 - DNA, 25 bp, Mus musculus
cagttctccagacctatggatcagc

SEQ ID NO: 574701 - DNA, 25 bp, Mus musculus
cagttctccagagctatggatcagc

SEQ ID NO: 574702 - DNA, 25 bp, Mus musculus
cagttctcctggaagtcggtcaaga

SEQ ID NO: 574703 - DNA, 25 bp, Mus musculus
cagttctcctggtagtcggtcaaga

SEQ ID NO: 574704 - DNA, 25 bp, Mus musculus
cagttctcggttctggaaacaatga

SEQ ID NO: 574705 - DNA, 25 bp, Mus musculus
cagttctcggttgtggaaacaatga

SEQ ID NO: 574706 - DNA, 25 bp, Mus musculus
cagttctcttaaatcacagcccagg

SEQ ID NO: 574707 - DNA, 25 bp, Mus musculus
cagttctcttaattcacagcccagg

SEQ ID NO: 574708 - DNA, 25 bp, Mus musculus
cagttctgaaagagacgtgtggagc

SEQ ID NO: 574709 - DNA, 25 bp, Mus musculus
cagttctgaaagtgacgtgtggagc

SEQ ID NO: 574710 - DNA, 25 bp, Mus musculus
cagttctgacaccagggatggacca

SEQ ID NO: 574711 - DNA, 25 bp, Mus musculus
cagttctgacacgagggatggacca

SEQ ID NO: 574712 - DNA, 25 bp, Mus musculus
cagttctgaccacgaagctacagcg

SEQ ID NO: 574713 - DNA, 25 bp, Mus musculus
cagttctgaccaggaagctacagcg

SEQ ID NO: 574714 - DNA, 25 bp, Mus musculus
cagttctgaggacgatgcttgagca

SEQ ID NO: 574715 - DNA, 25 bp, Mus musculus
cagttctgaggaggatgcttgagca

SEQ ID NO: 574716 - DNA, 25 bp, Mus musculus
cagttctgaggcctgtacttgtgtg

SEQ ID NO: 574717 - DNA, 25 bp, Mus musculus
cagttctgaggcgtgtacttgtgtg

SEQ ID NO: 574718 - DNA, 25 bp, Mus musculus
cagttctgcatgcagtcagactgga

SEQ ID NO: 574719 - DNA, 25 bp, Mus musculus
cagttctgcatggagtcagactgga

SEQ ID NO: 574720 - DNA, 25 bp, Mus musculus
cagttctgcccacggcacttgggag

SEQ ID NO: 574721 - DNA, 25 bp, Mus musculus
cagttctgcccagggcacttgggag

SEQ ID NO: 574722 - DNA, 25 bp, Mus musculus
cagttctggaagcaggagtttatca

SEQ ID NO: 574723 - DNA, 25 bp, Mus musculus
cagttctggaaggaggagtttatca

SEQ ID NO: 574724 - DNA, 25 bp, Mus musculus
cagttctggctcctcagctcttgct

SEQ ID NO: 574725 - DNA, 25 bp, Mus musculus
cagttctggctcgtcagctcttgct

SEQ ID NO: 574726 - DNA, 25 bp, Mus musculus
cagttctgtgatctggagtttgtgc

SEQ ID NO: 574727 - DNA, 25 bp, Mus musculus
cagttctgtgatgtggagtttgtgc

SEQ ID NO: 574728 - DNA, 25 bp, Mus musculus
cagttctgtgccactgaggctctga

SEQ ID NO: 574729 - DNA, 25 bp, Mus musculus
cagttctgtgcctctgaggctctga

SEQ ID NO: 574730 - DNA, 25 bp, Mus musculus
cagttcttaatccagaatggcctgc

SEQ ID NO: 574731 - DNA, 25 bp, Mus musculus
cagttcttaatcgagaatggcctgc

SEQ ID NO: 574732 - DNA, 25 bp, Mus musculus
cagttcttaattcgagaccaggagc

SEQ ID NO: 574733 - DNA, 25 bp, Mus musculus
cagttcttaattggagaccaggagc

SEQ ID NO: 574734 - DNA, 25 bp, Mus musculus
cagttcttccaacacctggatgatg

SEQ ID NO: 574735 - DNA, 25 bp, Mus musculus
cagttcttccaagacctggatgatg

SEQ ID NO: 574736 - DNA, 25 bp, Mus musculus
cagttcttcctacggtgttgcccag

SEQ ID NO: 574737 - DNA, 25 bp, Mus musculus
cagttcttcctagggtgttgcccag

SEQ ID NO: 574738 - DNA, 25 bp, Mus musculus
cagttcttccttatccaggagcgag

SEQ ID NO: 574739 - DNA, 25 bp, Mus musculus
cagttcttccttttccaggagcgag

SEQ ID NO: 574740 - DNA, 25 bp, Mus musculus
cagttcttctgtctgacaaattgga

SEQ ID NO: 574741 - DNA, 25 bp, Mus musculus
cagttcttctgtgtgacaaattgga

SEQ ID NO: 574742 - DNA, 25 bp, Mus musculus
cagttcttcttcaagctggtgggca

SEQ ID NO: 574743 - DNA, 25 bp, Mus musculus
cagttcttcttctagctggtgggca

SEQ ID NO: 574744 - DNA, 25 bp, Mus musculus
cagttcttgaatcactttggacacc

SEQ ID NO: 574745 - DNA, 25 bp, Mus musculus
cagttcttgaatgactttggacacc

SEQ ID NO: 574746 - DNA, 25 bp, Mus musculus
cagttctttcttcattgtggaggac

SEQ ID NO: 574747 - DNA, 25 bp, Mus musculus
cagttctttcttgattgtggaggac

SEQ ID NO: 574748 - DNA, 25 bp, Mus musculus
cagttgaacatgcagcatattgaag

SEQ ID NO: 574749 - DNA, 25 bp, Mus musculus
cagttgaacatggagcatattgaag

SEQ ID NO: 574750 - DNA, 25 bp, Mus musculus
cagttgaaccctcaggtgacgcaga

SEQ ID NO: 574751 - DNA, 25 bp, Mus musculus
cagttgaaccctgaggtgacgcaga

SEQ ID NO: 574752 - DNA, 25 bp, Mus musculus
cagttgaagcgaagcaggagaaagt

SEQ ID NO: 574753 - DNA, 25 bp, Mus musculus
cagttgaagcgatgcaggagaaagt

SEQ ID NO: 574754 - DNA, 25 bp, Mus musculus
cagttgaagctcattttaagactcg

SEQ ID NO: 574755 - DNA, 25 bp, Mus musculus
cagttgaagctctttttaagactcg

SEQ ID NO: 574756 - DNA, 25 bp, Mus musculus
cagttgaatattaggccccatgggc

SEQ ID NO: 574757 - DNA, 25 bp, Mus musculus
cagttgaatatttggccccatgggc

SEQ ID NO: 574758 - DNA, 25 bp, Mus musculus
cagttgaatgagaacacggagcgga

SEQ ID NO: 574759 - DNA, 25 bp, Mus musculus
cagttgaatgagtacacggagcgga

SEQ ID NO: 574760 - DNA, 25 bp, Mus musculus
cagttgaattgtataagaaggcaaa

SEQ ID NO: 574761 - DNA, 25 bp, Mus musculus
cagttgaattgtttaagaaggcaaa

SEQ ID NO: 574762 - DNA, 25 bp, Mus musculus
cagttgacattgcagcacccaggga

SEQ ID NO: 574763 - DNA, 25 bp, Mus musculus
cagttgacattggagcacccaggga

SEQ ID NO: 574764 - DNA, 25 bp, Mus musculus
cagttgaccctgagaggccgcatag

SEQ ID NO: 574765 - DNA, 25 bp, Mus musculus
cagttgaccctgtgaggccgcatag

SEQ ID NO: 574766 - DNA, 25 bp, Mus musculus
cagttgactccaaccaggcagaaga

SEQ ID NO: 574767 - DNA, 25 bp, Mus musculus
cagttgactccatccaggcagaaga

SEQ ID NO: 574768 - DNA, 25 bp, Mus musculus
cagttgactgctatgtggctgtcag

SEQ ID NO: 574769 - DNA, 25 bp, Mus musculus
cagttgactgctttgtggctgtcag

SEQ ID NO: 574770 - DNA, 25 bp, Mus musculus
cagttgacttccctggtgaagattc

SEQ ID NO: 574771 - DNA, 25 bp, Mus musculus
cagttgacttccgtggtgaagattc

SEQ ID NO: 574772 - DNA, 25 bp, Mus musculus
cagttgagacccagctatcttcccg

SEQ ID NO: 574773 - DNA, 25 bp, Mus musculus
cagttgagaccctgctatcttcccg

SEQ ID NO: 574774 - DNA, 25 bp, Mus musculus
cagttgagatggacattcaggctgc

SEQ ID NO: 574775 - DNA, 25 bp, Mus musculus
cagttgagatggtcattcaggctgc

SEQ ID NO: 574776 - DNA, 25 bp, Mus musculus
cagttgagtagcacagagaacaggc

SEQ ID NO: 574777 - DNA, 25 bp, Mus musculus
cagttgagtagctcagagaacaggc

SEQ ID NO: 574778 - DNA, 25 bp, Mus musculus
cagttgataaatctcagcccttctc

SEQ ID NO: 574779 - DNA, 25 bp, Mus musculus
cagttgataaatgtcagcccttctc

SEQ ID NO: 574780 - DNA, 25 bp, Mus musculus
cagttgatgtgaacctagcccacca

SEQ ID NO: 574781 - DNA, 25 bp, Mus musculus
cagttgatgtgatcctagcccacca

SEQ ID NO: 574782 - DNA, 25 bp, Mus musculus
cagttgcaaccacgactctgaaagg

SEQ ID NO: 574783 - DNA, 25 bp, Mus musculus
cagttgcaaccaggactctgaaagg

SEQ ID NO: 574784 - DNA, 25 bp, Mus musculus
cagttgcacagtcgaatgactcctc

SEQ ID NO: 574785 - DNA, 25 bp, Mus musculus
cagttgcacagtggaatgactcctc

SEQ ID NO: 574786 - DNA, 25 bp, Mus musculus
cagttgcacctaagtcaggagggac

SEQ ID NO: 574787 - DNA, 25 bp, Mus musculus
cagttgcacctatgtcaggagggac

SEQ ID NO: 574788 - DNA, 25 bp, Mus musculus
cagttgcagaggcaactttctcaag

SEQ ID NO: 574789 - DNA, 25 bp, Mus musculus
cagttgcagagggaactttctcaag

SEQ ID NO: 574790 - DNA, 25 bp, Mus musculus
cagttgcagcacacagcgggtttgg

SEQ ID NO: 574791 - DNA, 25 bp, Mus musculus
cagttgcagcactcagcgggtttgg

SEQ ID NO: 574792 - DNA, 25 bp, Mus musculus
cagttgcaggtgctttggcagcgga

SEQ ID NO: 574793 - DNA, 25 bp, Mus musculus
cagttgcaggtggtttggcagcgga

SEQ ID NO: 574794 - DNA, 25 bp, Mus musculus
cagttgcagtgcacaggttctccct

SEQ ID NO: 574795 - DNA, 25 bp, Mus musculus
cagttgcagtgctcaggttctccct

SEQ ID NO: 574796 - DNA, 25 bp, Mus musculus
cagttgccaaggatgcggtttctca

SEQ ID NO: 574797 - DNA, 25 bp, Mus musculus
cagttgccaaggttgcggtttctca

SEQ ID NO: 574798 - DNA, 25 bp, Mus musculus
cagttgccacccattgatgtcaaga

SEQ ID NO: 574799 - DNA, 25 bp, Mus musculus
cagttgccaccctttgatgtcaaga

SEQ ID NO: 574800 - DNA, 25 bp, Mus musculus
cagttgccagcaaacgccagtcttg

SEQ ID NO: 574801 - DNA, 25 bp, Mus musculus
cagttgccagcatacgccagtcttg

SEQ ID NO: 574802 - DNA, 25 bp, Mus musculus
cagttgccaggacaaatcaaggtca

SEQ ID NO: 574803 - DNA, 25 bp, Mus musculus
cagttgccaggagaaatcaaggtca

SEQ ID NO: 574804 - DNA, 25 bp, Mus musculus
cagttgcccaatcttgccgatctga

SEQ ID NO: 574805 - DNA, 25 bp, Mus musculus
cagttgcccaatgttgccgatctga

SEQ ID NO: 574806 - DNA, 25 bp, Mus musculus
cagttgccccagaattcattttcag

SEQ ID NO: 574807 - DNA, 25 bp, Mus musculus
cagttgccccagtattcattttcag

SEQ ID NO: 574808 - DNA, 25 bp, Mus musculus
cagttgccctgtcgagtcggtacct

SEQ ID NO: 574809 - DNA, 25 bp, Mus musculus
cagttgccctgtggagtcggtacct

SEQ ID NO: 574810 - DNA, 25 bp, Mus musculus
cagttgccggaacccgaaagagacc

SEQ ID NO: 574811 - DNA, 25 bp, Mus musculus
cagttgccggaagccgaaagagacc

SEQ ID NO: 574812 - DNA, 25 bp, Mus musculus
cagttgccgtgacgaagctaaggat

SEQ ID NO: 574813 - DNA, 25 bp, Mus musculus
cagttgccgtgaggaagctaaggat

SEQ ID NO: 574814 - DNA, 25 bp, Mus musculus
cagttgcctcctagctggaacgctt

SEQ ID NO: 574815 - DNA, 25 bp, Mus musculus
cagttgcctccttgctggaacgctt

SEQ ID NO: 574816 - DNA, 25 bp, Mus musculus
cagttgcctgggagacaaacaaaaa

SEQ ID NO: 574817 - DNA, 25 bp, Mus musculus
cagttgcctgggtgacaaacaaaaa

SEQ ID NO: 574818 - DNA, 25 bp, Mus musculus
cagttgcgcctaatctccttggtgg

SEQ ID NO: 574819 - DNA, 25 bp, Mus musculus
cagttgcgcctattctccttggtgg

SEQ ID NO: 574820 - DNA, 25 bp, Mus musculus
cagttgctcctgagagttggtctcc

SEQ ID NO: 574821 - DNA, 25 bp, Mus musculus
cagttgctcctgtgagttggtctcc

SEQ ID NO: 574822 - DNA, 25 bp, Mus musculus
cagttgctccttaagctgtatgcca

SEQ ID NO: 574823 - DNA, 25 bp, Mus musculus
cagttgctcctttagctgtatgcca

SEQ ID NO: 574824 - DNA, 25 bp, Mus musculus
cagttgctctcgaacctggaacaaa

SEQ ID NO: 574825 - DNA, 25 bp, Mus musculus
cagttgctctcgtacctggaacaaa

SEQ ID NO: 574826 - DNA, 25 bp, Mus musculus
cagttgctggaaacaccttgttggc

SEQ ID NO: 574827 - DNA, 25 bp, Mus musculus
cagttgctggaatcaccttgttggc

SEQ ID NO: 574828 - DNA, 25 bp, Mus musculus
cagttgcttaatctaggaaggcgac

SEQ ID NO: 574829 - DNA, 25 bp, Mus musculus
cagttgcttaatgtaggaaggcgac

SEQ ID NO: 574830 - DNA, 25 bp, Mus musculus
cagttggaaacccagaagaagaggc

SEQ ID NO: 574831 - DNA, 25 bp, Mus musculus
cagttggaaaccgagaagaagaggc

SEQ ID NO: 574832 - DNA, 25 bp, Mus musculus
cagttggaagcaaagctggataagc

SEQ ID NO: 574833 - DNA, 25 bp, Mus musculus
cagttggaagcatagctggataagc

SEQ ID NO: 574834 - DNA, 25 bp, Mus musculus
cagttggaaggtctaaatgtggaac

SEQ ID NO: 574835 - DNA, 25 bp, Mus musculus
cagttggaaggtgtaaatgtggaac

SEQ ID NO: 574836 - DNA, 25 bp, Mus musculus
cagttggaattgatcacaccttttc

SEQ ID NO: 574837 - DNA, 25 bp, Mus musculus
cagttggaattgttcacaccttttc

SEQ ID NO: 574838 - DNA, 25 bp, Mus musculus
cagttggacctgaccggactatgca

SEQ ID NO: 574839 - DNA, 25 bp, Mus musculus
cagttggacctgtccggactatgca

SEQ ID NO: 574840 - DNA, 25 bp, Mus musculus
cagttggagactccggccatcaccg

SEQ ID NO: 574841 - DNA, 25 bp, Mus musculus
cagttggagactgcggccatcaccg

SEQ ID NO: 574842 - DNA, 25 bp, Mus musculus
cagttggagctgcacattttcgaag

SEQ ID NO: 574843 - DNA, 25 bp, Mus musculus
cagttggagctggacattttcgaag

SEQ ID NO: 574844 - DNA, 25 bp, Mus musculus
cagttggatctacaacgtgcccatt

SEQ ID NO: 574845 - DNA, 25 bp, Mus musculus
cagttggatctagaacgtgcccatt

SEQ ID NO: 574846 - DNA, 25 bp, Mus musculus
cagttggcacttcagcctgtcagga

SEQ ID NO: 574847 - DNA, 25 bp, Mus musculus
cagttggcacttgagcctgtcagga

SEQ ID NO: 574848 - DNA, 25 bp, Mus musculus
cagttggccccaagactgtcttttc

SEQ ID NO: 574849 - DNA, 25 bp, Mus musculus
cagttggccccatgactgtcttttc

SEQ ID NO: 574850 - DNA, 25 bp, Mus musculus
cagttggccttacggagaggactcc

SEQ ID NO: 574851 - DNA, 25 bp, Mus musculus
cagttggccttagggagaggactcc

SEQ ID NO: 574852 - DNA, 25 bp, Mus musculus
cagttggcgctgcagaatgtcctca

SEQ ID NO: 574853 - DNA, 25 bp, Mus musculus
cagttggcgctggagaatgtcctca

SEQ ID NO: 574854 - DNA, 25 bp, Mus musculus
cagttggctaaaactgagctgttca

SEQ ID NO: 574855 - DNA, 25 bp, Mus musculus
cagttggctaaatctgagctgttca

SEQ ID NO: 574856 - DNA, 25 bp, Mus musculus
cagttggctcgacaggcactagata

SEQ ID NO: 574857 - DNA, 25 bp, Mus musculus
cagttggctcgagaggcactagata

SEQ ID NO: 574858 - DNA, 25 bp, Mus musculus
cagttgggaatactcacagtgcagt

SEQ ID NO: 574859 - DNA, 25 bp, Mus musculus
cagttgggaatagtcacagtgcagt

SEQ ID NO: 574860 - DNA, 25 bp, Mus musculus
cagttgggactacaaatgatggata

SEQ ID NO: 574861 - DNA, 25 bp, Mus musculus
cagttgggactagaaatgatggata

SEQ ID NO: 574862 - DNA, 25 bp, Mus musculus
cagttgggtagcacagcttgtcctg

SEQ ID NO: 574863 - DNA, 25 bp, Mus musculus
cagttgggtagctcagcttgtcctg

SEQ ID NO: 574864 - DNA, 25 bp, Mus musculus
cagttggtgaagcttaacttggcga

SEQ ID NO: 574865 - DNA, 25 bp, Mus musculus
cagttggtgaaggttaacttggcga

SEQ ID NO: 574866 - DNA, 25 bp, Mus musculus
cagttggtgagaatttccttggacg

SEQ ID NO: 574867 - DNA, 25 bp, Mus musculus
cagttggtgagattttccttggacg

SEQ ID NO: 574868 - DNA, 25 bp, Mus musculus
cagttggtggctacttcctggcagg

SEQ ID NO: 574869 - DNA, 25 bp, Mus musculus
cagttggtggcttcttcctggcagg

SEQ ID NO: 574870 - DNA, 25 bp, Mus musculus
cagttggtgttaagccccagggcct

SEQ ID NO: 574871 - DNA, 25 bp, Mus musculus
cagttggtgttatgccccagggcct

SEQ ID NO: 574872 - DNA, 25 bp, Mus musculus
cagttgtaattgcttcacagttaga

SEQ ID NO: 574873 - DNA, 25 bp, Mus musculus
cagttgtaattggttcacagttaga

SEQ ID NO: 574874 - DNA, 25 bp, Mus musculus
cagttgtacaacagacgatctctgg

SEQ ID NO: 574875 - DNA, 25 bp, Mus musculus
cagttgtacaactgacgatctctgg

SEQ ID NO: 574876 - DNA, 25 bp, Mus musculus
cagttgtcaaagaatgagcgggaga

SEQ ID NO: 574877 - DNA, 25 bp, Mus musculus
cagttgtcaaagtatgagcgggaga

SEQ ID NO: 574878 - DNA, 25 bp, Mus musculus
cagttgtctgggaccctgggtatcc

SEQ ID NO: 574879 - DNA, 25 bp, Mus musculus
cagttgtctgggtccctgggtatcc

SEQ ID NO: 574880 - DNA, 25 bp, Mus musculus
cagttgtgaaggatcccaaaggaaa

SEQ ID NO: 574881 - DNA, 25 bp, Mus musculus
cagttgtgaaggttcccaaaggaaa

SEQ ID NO: 574882 - DNA, 25 bp, Mus musculus
cagttgtgatggctctttatgcgac

SEQ ID NO: 574883 - DNA, 25 bp, Mus musculus
cagttgtgatgggtctttatgcgac

SEQ ID NO: 574884 - DNA, 25 bp, Mus musculus
cagttgtgattgatccaggtccggg

SEQ ID NO: 574885 - DNA, 25 bp, Mus musculus
cagttgtgattgttccaggtccggg

SEQ ID NO: 574886 - DNA, 25 bp, Mus musculus
cagttgtgccttcttggacagacca

SEQ ID NO: 574887 - DNA, 25 bp, Mus musculus
cagttgtgccttgttggacagacca

SEQ ID NO: 574888 - DNA, 25 bp, Mus musculus
cagttgtggaagatgtgaccctagg

SEQ ID NO: 574889 - DNA, 25 bp, Mus musculus
cagttgtggaagttgtgaccctagg

SEQ ID NO: 574890 - DNA, 25 bp, Mus musculus
cagttgtggagcaggtccagcagct

SEQ ID NO: 574891 - DNA, 25 bp, Mus musculus
cagttgtggagctggtccagcagct

SEQ ID NO: 574892 - DNA, 25 bp, Mus musculus
cagttgtggcatatccaaagaggag

SEQ ID NO: 574893 - DNA, 25 bp, Mus musculus
cagttgtggcatttccaaagaggag

SEQ ID NO: 574894 - DNA, 25 bp, Mus musculus
cagttgtggccacctttgtttcata

SEQ ID NO: 574895 - DNA, 25 bp, Mus musculus
cagttgtggccagctttgtttcata

SEQ ID NO: 574896 - DNA, 25 bp, Mus musculus
cagttgtgggatccttggcacacat

SEQ ID NO: 574897 - DNA, 25 bp, Mus musculus
cagttgtgggatgcttggcacacat

SEQ ID NO: 574898 - DNA, 25 bp, Mus musculus
cagttgtgtaagacagagcagcgtc

SEQ ID NO: 574899 - DNA, 25 bp, Mus musculus
cagttgtgtaagtcagagcagcgtc

SEQ ID NO: 574900 - DNA, 25 bp, Mus musculus
cagttgtgtggaatggctccctgct

SEQ ID NO: 574901 - DNA, 25 bp, Mus musculus
cagttgtgtggattggctccctgct

SEQ ID NO: 574902 - DNA, 25 bp, Mus musculus
cagttgttaaagcaagttgaggcac

SEQ ID NO: 574903 - DNA, 25 bp, Mus musculus
cagttgttaaaggaagttgaggcac

SEQ ID NO: 574904 - DNA, 25 bp, Mus musculus
cagttgttccagaaatggtcggtga

SEQ ID NO: 574905 - DNA, 25 bp, Mus musculus
cagttgttccagtaatggtcggtga

SEQ ID NO: 574906 - DNA, 25 bp, Mus musculus
cagttgttgaccctcatggatggcc

SEQ ID NO: 574907 - DNA, 25 bp, Mus musculus
cagttgttgaccgtcatggatggcc

SEQ ID NO: 574908 - DNA, 25 bp, Mus musculus
cagttgttgctgaccgtgttatggc

SEQ ID NO: 574909 - DNA, 25 bp, Mus musculus
cagttgttgctgtccgtgttatggc

SEQ ID NO: 574910 - DNA, 25 bp, Mus musculus
cagttgttggcaaaatgataaagac

SEQ ID NO: 574911 - DNA, 25 bp, Mus musculus
cagttgttggcataatgataaagac

SEQ ID NO: 574912 - DNA, 25 bp, Mus musculus
cagttgttgtggaagccttagctgc

SEQ ID NO: 574913 - DNA, 25 bp, Mus musculus
cagttgttgtggtagccttagctgc

SEQ ID NO: 574914 - DNA, 25 bp, Mus musculus
cagttgtttatcacgtgaagagaag

SEQ ID NO: 574915 - DNA, 25 bp, Mus musculus
cagttgtttatctcgtgaagagaag

SEQ ID NO: 574916 - DNA, 25 bp, Mus musculus
cagttgtttgatcagccgtagcagc

SEQ ID NO: 574917 - DNA, 25 bp, Mus musculus
cagttgtttgatgagccgtagcagc

SEQ ID NO: 574918 - DNA, 25 bp, Mus musculus
cagtttaaatcacaaggagttgacg

SEQ ID NO: 574919 - DNA, 25 bp, Mus musculus
cagtttaaatcagaaggagttgacg

SEQ ID NO: 574920 - DNA, 25 bp, Mus musculus
cagtttaacgagagcttcgccgaga

SEQ ID NO: 574921 - DNA, 25 bp, Mus musculus
cagtttaacgagtgcttcgccgaga

SEQ ID NO: 574922 - DNA, 25 bp, Mus musculus
cagtttaactgtctcagaagggacc

SEQ ID NO: 574923 - DNA, 25 bp, Mus musculus
cagtttaactgtgtcagaagggacc

SEQ ID NO: 574924 - DNA, 25 bp, Mus musculus
cagtttaagaagatcctcggctaca

SEQ ID NO: 574925 - DNA, 25 bp, Mus musculus
cagtttaagaagttcctcggctaca

SEQ ID NO: 574926 - DNA, 25 bp, Mus musculus
cagtttacattaccggccgccatct

SEQ ID NO: 574927 - DNA, 25 bp, Mus musculus
cagtttacattagcggccgccatct

SEQ ID NO: 574928 - DNA, 25 bp, Mus musculus
cagtttataagccaccagttcccgg

SEQ ID NO: 574929 - DNA, 25 bp, Mus musculus
cagtttataagcgaccagttcccgg

SEQ ID NO: 574930 - DNA, 25 bp, Mus musculus
cagtttatagctactcatgcaggga

SEQ ID NO: 574931 - DNA, 25 bp, Mus musculus
cagtttatagcttctcatgcaggga

SEQ ID NO: 574932 - DNA, 25 bp, Mus musculus
cagtttatccttcgcgtgtcgcccg

SEQ ID NO: 574933 - DNA, 25 bp, Mus musculus
cagtttatccttggcgtgtcgcccg

SEQ ID NO: 574934 - DNA, 25 bp, Mus musculus
cagtttatgagtctctgggatggac

SEQ ID NO: 574935 - DNA, 25 bp, Mus musculus
cagtttatgagtgtctgggatggac

SEQ ID NO: 574936 - DNA, 25 bp, Mus musculus
cagtttcagaaacgatcaattgacc

SEQ ID NO: 574937 - DNA, 25 bp, Mus musculus
cagtttcagaaaggatcaattgacc

SEQ ID NO: 574938 - DNA, 25 bp, Mus musculus
cagtttcagaggaaccatggtgcac

SEQ ID NO: 574939 - DNA, 25 bp, Mus musculus
cagtttcagaggtaccatggtgcac

SEQ ID NO: 574940 - DNA, 25 bp, Mus musculus
cagtttcagcatctgctacgcaagc

SEQ ID NO: 574941 - DNA, 25 bp, Mus musculus
cagtttcagcatgtgctacgcaagc

SEQ ID NO: 574942 - DNA, 25 bp, Mus musculus
cagtttcagtgcacaaatggccgct

SEQ ID NO: 574943 - DNA, 25 bp, Mus musculus
cagtttcagtgctcaaatggccgct

SEQ ID NO: 574944 - DNA, 25 bp, Mus musculus
cagtttcagttcattaaaggcacca

SEQ ID NO: 574945 - DNA, 25 bp, Mus musculus
cagtttcagttctttaaaggcacca

SEQ ID NO: 574946 - DNA, 25 bp, Mus musculus
cagtttcatctgcagctctcaggca

SEQ ID NO: 574947 - DNA, 25 bp, Mus musculus
cagtttcatctggagctctcaggca

SEQ ID NO: 574948 - DNA, 25 bp, Mus musculus
cagtttcatgttcggcttagaaaca

SEQ ID NO: 574949 - DNA, 25 bp, Mus musculus
cagtttcatgttgggcttagaaaca

SEQ ID NO: 574950 - DNA, 25 bp, Mus musculus
cagtttccaaaaaggctacggattt

SEQ ID NO: 574951 - DNA, 25 bp, Mus musculus
cagtttccaaaatggctacggattt

SEQ ID NO: 574952 - DNA, 25 bp, Mus musculus
cagtttccatgaaaaccctgagaag

SEQ ID NO: 574953 - DNA, 25 bp, Mus musculus
cagtttccatgaaatctgcctatgg

SEQ ID NO: 574954 - DNA, 25 bp, Mus musculus
cagtttccatgataaccctgagaag

SEQ ID NO: 574955 - DNA, 25 bp, Mus musculus
cagtttccatgatatctgcctatgg

SEQ ID NO: 574956 - DNA, 25 bp, Mus musculus
cagtttccccagatgacagtcagct

SEQ ID NO: 574957 - DNA, 25 bp, Mus musculus
cagtttccccagttgacagtcagct

SEQ ID NO: 574958 - DNA, 25 bp, Mus musculus
cagtttcccgatcgtgtggacgtgc

SEQ ID NO: 574959 - DNA, 25 bp, Mus musculus
cagtttcccgatggtgtggacgtgc

SEQ ID NO: 574960 - DNA, 25 bp, Mus musculus
cagtttccctatctgtaaagcgggc

SEQ ID NO: 574961 - DNA, 25 bp, Mus musculus
cagtttccctatgtgtaaagcgggc

SEQ ID NO: 574962 - DNA, 25 bp, Mus musculus
cagtttcccttgagggaatccttga

SEQ ID NO: 574963 - DNA, 25 bp, Mus musculus
cagtttcccttgtgggaatccttga

SEQ ID NO: 574964 - DNA, 25 bp, Mus musculus
cagtttcgctttccctgtagagggc

SEQ ID NO: 574965 - DNA, 25 bp, Mus musculus
cagtttcgctttgcctgtagagggc

SEQ ID NO: 574966 - DNA, 25 bp, Mus musculus
cagtttcggcctcttcatgcaggaa

SEQ ID NO: 574967 - DNA, 25 bp, Mus musculus
cagtttcggcctgttcatgcaggaa

SEQ ID NO: 574968 - DNA, 25 bp, Mus musculus
cagtttctaaggcaagacagaattc

SEQ ID NO: 574969 - DNA, 25 bp, Mus musculus
cagtttctaagggaagacagaattc

SEQ ID NO: 574970 - DNA, 25 bp, Mus musculus
cagtttctacacagcaaaggcatta

SEQ ID NO: 574971 - DNA, 25 bp, Mus musculus
cagtttctacactgcaaaggcatta

SEQ ID NO: 574972 - DNA, 25 bp, Mus musculus
cagtttctacgtagtcatgtggaaa

SEQ ID NO: 574973 - DNA, 25 bp, Mus musculus
cagtttctacgttgtcatgtggaaa

SEQ ID NO: 574974 - DNA, 25 bp, Mus musculus
cagtttctagtccagaatacaccaa

SEQ ID NO: 574975 - DNA, 25 bp, Mus musculus
cagtttctagtcgagaatacaccaa

SEQ ID NO: 574976 - DNA, 25 bp, Mus musculus
cagtttctcagtcaacatgctggaa

SEQ ID NO: 574977 - DNA, 25 bp, Mus musculus
cagtttctcagtgaacatgctggaa

SEQ ID NO: 574978 - DNA, 25 bp, Mus musculus
cagtttctccgtcaggaacgaggta

SEQ ID NO: 574979 - DNA, 25 bp, Mus musculus
cagtttctccgtgaggaacgaggta

SEQ ID NO: 574980 - DNA, 25 bp, Mus musculus
cagtttctctacagactttgaaaag

SEQ ID NO: 574981 - DNA, 25 bp, Mus musculus
cagtttctctactgactttgaaaag

SEQ ID NO: 574982 - DNA, 25 bp, Mus musculus
cagtttctgcatctactgagccgca

SEQ ID NO: 574983 - DNA, 25 bp, Mus musculus
cagtttctgcatgtactgagccgca

SEQ ID NO: 574984 - DNA, 25 bp, Mus musculus
cagtttctgctccttgccaagtcgg

SEQ ID NO: 574985 - DNA, 25 bp, Mus musculus
cagtttctgctcgttgccaagtcgg

SEQ ID NO: 574986 - DNA, 25 bp, Mus musculus
cagtttctggttcctgcgtctacta

SEQ ID NO: 574987 - DNA, 25 bp, Mus musculus
cagtttctggttgctgcgtctacta

SEQ ID NO: 574988 - DNA, 25 bp, Mus musculus
cagtttctgtaaactgtcacctaaa

SEQ ID NO: 574989 - DNA, 25 bp, Mus musculus
cagtttctgtaatctgtcacctaaa

SEQ ID NO: 574990 - DNA, 25 bp, Mus musculus
cagtttctgtctaatccggaacgta

SEQ ID NO: 574991 - DNA, 25 bp, Mus musculus
cagtttctgtcttatccggaacgta

SEQ ID NO: 574992 - DNA, 25 bp, Mus musculus
cagtttcttatacctacaagtaaag

SEQ ID NO: 574993 - DNA, 25 bp, Mus musculus
cagtttcttatagctacaagtaaag

SEQ ID NO: 574994 - DNA, 25 bp, Mus musculus
cagtttcttgccatcaatggattcc

SEQ ID NO: 574995 - DNA, 25 bp, Mus musculus
cagtttcttgccttcaatggattcc

SEQ ID NO: 574996 - DNA, 25 bp, Mus musculus
cagtttcttgtgaatcagatgttga

SEQ ID NO: 574997 - DNA, 25 bp, Mus musculus
cagtttcttgtgtatcagatgttga

SEQ ID NO: 574998 - DNA, 25 bp, Mus musculus
cagtttgaaagcaaaaaccgctcac

SEQ ID NO: 574999 - DNA, 25 bp, Mus musculus
cagtttgaaagctaaaaccgctcac

SEQ ID NO: 575000 - DNA, 25 bp, Mus musculus
cagtttgaagacatactagttagaa

SEQ ID NO: 575001 - DNA, 25 bp, Mus musculus
cagtttgaagacttactagttagaa

SEQ ID NO: 575002 - DNA, 25 bp, Mus musculus
cagtttgaatggctggaaaatacac

SEQ ID NO: 575003 - DNA, 25 bp, Mus musculus
cagtttgaatgggtggaaaatacac

SEQ ID NO: 575004 - DNA, 25 bp, Mus musculus
cagtttgaatgtcaagatggtagct

SEQ ID NO: 575005 - DNA, 25 bp, Mus musculus
cagtttgaatgtgaagatggtagct

SEQ ID NO: 575006 - DNA, 25 bp, Mus musculus
cagtttgacaaaatcctcgagctga

SEQ ID NO: 575007 - DNA, 25 bp, Mus musculus
cagtttgacaaattcctcgagctga

SEQ ID NO: 575008 - DNA, 25 bp, Mus musculus
cagtttgacgatcacgatcagggcc

SEQ ID NO: 575009 - DNA, 25 bp, Mus musculus
cagtttgacgatgacgatcagggcc

SEQ ID NO: 575010 - DNA, 25 bp, Mus musculus
cagtttgagagcaccatcggcttca

SEQ ID NO: 575011 - DNA, 25 bp, Mus musculus
cagtttgagagctccatcggcttca

SEQ ID NO: 575012 - DNA, 25 bp, Mus musculus
cagtttgagatcagatagatggacg

SEQ ID NO: 575013 - DNA, 25 bp, Mus musculus
cagtttgagatctgatagatggacg

SEQ ID NO: 575014 - DNA, 25 bp, Mus musculus
cagtttgagcgcattaaccaggcca

SEQ ID NO: 575015 - DNA, 25 bp, Mus musculus
cagtttgagcgctttaaccaggcca

SEQ ID NO: 575016 - DNA, 25 bp, Mus musculus
cagtttgagctcagagtcttgggaa

SEQ ID NO: 575017 - DNA, 25 bp, Mus musculus
cagtttgagctctgagtcttgggaa

SEQ ID NO: 575018 - DNA, 25 bp, Mus musculus
cagtttgaggaaatcggccgggcct

SEQ ID NO: 575019 - DNA, 25 bp, Mus musculus
cagtttgaggaacgactggagctca

SEQ ID NO: 575020 - DNA, 25 bp, Mus musculus
cagtttgaggaaggactggagctca

SEQ ID NO: 575021 - DNA, 25 bp, Mus musculus
cagtttgaggaattcggccgggcct

SEQ ID NO: 575022 - DNA, 25 bp, Mus musculus
cagtttgaggaccattcccagtttc

SEQ ID NO: 575023 - DNA, 25 bp, Mus musculus
cagtttgaggacgattcccagtttc

SEQ ID NO: 575024 - DNA, 25 bp, Mus musculus
cagtttgagtccaacaggacctgga

SEQ ID NO: 575025 - DNA, 25 bp, Mus musculus
cagtttgagtcctacaggacctgga

SEQ ID NO: 575026 - DNA, 25 bp, Mus musculus
cagtttgataaaaatgcctatgtct

SEQ ID NO: 575027 - DNA, 25 bp, Mus musculus
cagtttgataaaactccgtggcagt

SEQ ID NO: 575028 - DNA, 25 bp, Mus musculus
cagtttgataaatatgcctatgtct

SEQ ID NO: 575029 - DNA, 25 bp, Mus musculus
cagtttgataaatctccgtggcagt

SEQ ID NO: 575030 - DNA, 25 bp, Mus musculus
cagtttgataccagcatgaaaggaa

SEQ ID NO: 575031 - DNA, 25 bp, Mus musculus
cagtttgatacctgcatgaaaggaa

SEQ ID NO: 575032 - DNA, 25 bp, Mus musculus
cagtttgatagaatcaagacccttg

SEQ ID NO: 575033 - DNA, 25 bp, Mus musculus
cagtttgatagattcaagacccttg

SEQ ID NO: 575034 - DNA, 25 bp, Mus musculus
cagtttgatgcacgattcacacggc

SEQ ID NO: 575035 - DNA, 25 bp, Mus musculus
cagtttgatgcaggattcacacggc

SEQ ID NO: 575036 - DNA, 25 bp, Mus musculus
cagtttgattttcgtctctgcatcc

SEQ ID NO: 575037 - DNA, 25 bp, Mus musculus
cagtttgattttggtctctgcatcc

SEQ ID NO: 575038 - DNA, 25 bp, Mus musculus
cagtttgcacaaaatgggaatatct

SEQ ID NO: 575039 - DNA, 25 bp, Mus musculus
cagtttgcacaatatgggaatatct

SEQ ID NO: 575040 - DNA, 25 bp, Mus musculus
cagtttgcacacataaggtgttcac

SEQ ID NO: 575041 - DNA, 25 bp, Mus musculus
cagtttgcacacttaaggtgttcac

SEQ ID NO: 575042 - DNA, 25 bp, Mus musculus
cagtttgccaggacactttagcagt

SEQ ID NO: 575043 - DNA, 25 bp, Mus musculus
cagtttgccaggtcactttagcagt

SEQ ID NO: 575044 - DNA, 25 bp, Mus musculus
cagtttgccattattgccgacgcct

SEQ ID NO: 575045 - DNA, 25 bp, Mus musculus
cagtttgccatttttgccgacgcct

SEQ ID NO: 575046 - DNA, 25 bp, Mus musculus
cagtttgccttcctgcacatgcgcg

SEQ ID NO: 575047 - DNA, 25 bp, Mus musculus
cagtttgccttcgtgcacatgcgcg

SEQ ID NO: 575048 - DNA, 25 bp, Mus musculus
cagtttgctgagcttgctaacggta

SEQ ID NO: 575049 - DNA, 25 bp, Mus musculus
cagtttgctgaggttgctaacggta

SEQ ID NO: 575050 - DNA, 25 bp, Mus musculus
cagtttgctggtactggcaacctga

SEQ ID NO: 575051 - DNA, 25 bp, Mus musculus
cagtttgctggttctggcaacctga

SEQ ID NO: 575052 - DNA, 25 bp, Mus musculus
cagtttggaagaagcctgatttaga

SEQ ID NO: 575053 - DNA, 25 bp, Mus musculus
cagtttggaagatgcctgatttaga

SEQ ID NO: 575054 - DNA, 25 bp, Mus musculus
cagtttggaatcacttgctcatgtc

SEQ ID NO: 575055 - DNA, 25 bp, Mus musculus
cagtttggaatctcttgctcatgtc

SEQ ID NO: 575056 - DNA, 25 bp, Mus musculus
cagtttggacagcaagactggaagt

SEQ ID NO: 575057 - DNA, 25 bp, Mus musculus
cagtttggacaggaagactggaagt

SEQ ID NO: 575058 - DNA, 25 bp, Mus musculus
cagtttggcagactcttttcattcc

SEQ ID NO: 575059 - DNA, 25 bp, Mus musculus
cagtttggcagagtcttttcattcc

SEQ ID NO: 575060 - DNA, 25 bp, Mus musculus
cagtttggctacaacactggagtca

SEQ ID NO: 575061 - DNA, 25 bp, Mus musculus
cagtttggctactacactggagtca

SEQ ID NO: 575062 - DNA, 25 bp, Mus musculus
cagtttgggacaatcgattctgcga

SEQ ID NO: 575063 - DNA, 25 bp, Mus musculus
cagtttgggacattcgattctgcga

SEQ ID NO: 575064 - DNA, 25 bp, Mus musculus
cagtttgggatccatggagaatcat

SEQ ID NO: 575065 - DNA, 25 bp, Mus musculus
cagtttgggatcgatggagaatcat

SEQ ID NO: 575066 - DNA, 25 bp, Mus musculus
cagtttgggcaacaacctcctgggc

SEQ ID NO: 575067 - DNA, 25 bp, Mus musculus
cagtttgggcaagaacctcctgggc

SEQ ID NO: 575068 - DNA, 25 bp, Mus musculus
cagtttgggtttagcttagtagaca

SEQ ID NO: 575069 - DNA, 25 bp, Mus musculus
cagtttgggttttgcttagtagaca

SEQ ID NO: 575070 - DNA, 25 bp, Mus musculus
cagtttggtagactcgggatagcaa

SEQ ID NO: 575071 - DNA, 25 bp, Mus musculus
cagtttggtagagtcgggatagcaa

SEQ ID NO: 575072 - DNA, 25 bp, Mus musculus
cagtttggtcaaaggataatctcta

SEQ ID NO: 575073 - DNA, 25 bp, Mus musculus
cagtttggtcaatggataatctcta

SEQ ID NO: 575074 - DNA, 25 bp, Mus musculus
cagtttgtacagagagcgagagcct

SEQ ID NO: 575075 - DNA, 25 bp, Mus musculus
cagtttgtacagtgagcgagagcct

SEQ ID NO: 575076 - DNA, 25 bp, Mus musculus
cagtttgtcacacctactgatgttg

SEQ ID NO: 575077 - DNA, 25 bp, Mus musculus
cagtttgtcacagctactgatgttg

SEQ ID NO: 575078 - DNA, 25 bp, Mus musculus
cagtttgtggatatgtcactggcca

SEQ ID NO: 575079 - DNA, 25 bp, Mus musculus
cagtttgtggatcttgaggcaacga

SEQ ID NO: 575080 - DNA, 25 bp, Mus musculus
cagtttgtggatgttgaggcaacga

SEQ ID NO: 575081 - DNA, 25 bp, Mus musculus
cagtttgtggatttgtcactggcca

SEQ ID NO: 575082 - DNA, 25 bp, Mus musculus
cagtttgtggccatggttgtggacc

SEQ ID NO: 575083 - DNA, 25 bp, Mus musculus
cagtttgtggccttggttgtggacc

SEQ ID NO: 575084 - DNA, 25 bp, Mus musculus
cagtttgtgtctcacgtggcctggg

SEQ ID NO: 575085 - DNA, 25 bp, Mus musculus
cagtttgtgtctgacgtggcctggg

SEQ ID NO: 575086 - DNA, 25 bp, Mus musculus
cagtttgtgtgaccctgagcagttc

SEQ ID NO: 575087 - DNA, 25 bp, Mus musculus
cagtttgtgtgagcctgagcagttc

SEQ ID NO: 575088 - DNA, 25 bp, Mus musculus
cagtttgtgttgctgcacccaacca

SEQ ID NO: 575089 - DNA, 25 bp, Mus musculus
cagtttgtgttggtgcacccaacca

SEQ ID NO: 575090 - DNA, 25 bp, Mus musculus
cagtttgttcaacccatctgcctgc

SEQ ID NO: 575091 - DNA, 25 bp, Mus musculus
cagtttgttcaagccatctgcctgc

SEQ ID NO: 575092 - DNA, 25 bp, Mus musculus
cagttttaaaggaggctccagggca

SEQ ID NO: 575093 - DNA, 25 bp, Mus musculus
cagttttaaaggtggctccagggca

SEQ ID NO: 575094 - DNA, 25 bp, Mus musculus
cagttttacaaccaacgagtcaagc

SEQ ID NO: 575095 - DNA, 25 bp, Mus musculus
cagttttacaacgaacgagtcaagc

SEQ ID NO: 575096 - DNA, 25 bp, Mus musculus
cagttttatataccagagacagtat

SEQ ID NO: 575097 - DNA, 25 bp, Mus musculus
cagttttatatagcagagacagtat

SEQ ID NO: 575098 - DNA, 25 bp, Mus musculus
cagttttatggactgattctggaac

SEQ ID NO: 575099 - DNA, 25 bp, Mus musculus
cagttttatggagtgattctggaac

SEQ ID NO: 575100 - DNA, 25 bp, Mus musculus
cagttttatgttacaatcttgggct

SEQ ID NO: 575101 - DNA, 25 bp, Mus musculus
cagttttatgtttcaatcttgggct

SEQ ID NO: 575102 - DNA, 25 bp, Mus musculus
cagttttcagagattttgcagtttc

SEQ ID NO: 575103 - DNA, 25 bp, Mus musculus
cagttttcagagtttttgcagtttc

SEQ ID NO: 575104 - DNA, 25 bp, Mus musculus
cagttttcagataaacctgtccaag

SEQ ID NO: 575105 - DNA, 25 bp, Mus musculus
cagttttcagattaacctgtccaag

SEQ ID NO: 575106 - DNA, 25 bp, Mus musculus
cagttttccaccatttattccctca

SEQ ID NO: 575107 - DNA, 25 bp, Mus musculus
cagttttccaccttttattccctca

SEQ ID NO: 575108 - DNA, 25 bp, Mus musculus
cagttttctgcgaggtggaacatta

SEQ ID NO: 575109 - DNA, 25 bp, Mus musculus
cagttttctgcgtggtggaacatta

SEQ ID NO: 575110 - DNA, 25 bp, Mus musculus
cagttttctggaatcgttcgggagg

SEQ ID NO: 575111 - DNA, 25 bp, Mus musculus
cagttttctggattcgttcgggagg

SEQ ID NO: 575112 - DNA, 25 bp, Mus musculus
cagttttctggcacagatctgagac

SEQ ID NO: 575113 - DNA, 25 bp, Mus musculus
cagttttctggctcagatctgagac

SEQ ID NO: 575114 - DNA, 25 bp, Mus musculus
cagttttgaaagcacagcagatgac

SEQ ID NO: 575115 - DNA, 25 bp, Mus musculus
cagttttgaaaggacagcagatgac

SEQ ID NO: 575116 - DNA, 25 bp, Mus musculus
cagttttgaatacctgtctaaacag

SEQ ID NO: 575117 - DNA, 25 bp, Mus musculus
cagttttgaatagctgtctaaacag

SEQ ID NO: 575118 - DNA, 25 bp, Mus musculus
cagttttgagacagccatgttcata

SEQ ID NO: 575119 - DNA, 25 bp, Mus musculus
cagttttgagactgccatgttcata

SEQ ID NO: 575120 - DNA, 25 bp, Mus musculus
cagttttgagcgcttccgccgtgtt

SEQ ID NO: 575121 - DNA, 25 bp, Mus musculus
cagttttgagcggttccgccgtgtt

SEQ ID NO: 575122 - DNA, 25 bp, Mus musculus
cagttttggaaacgtgagtacagcc

SEQ ID NO: 575123 - DNA, 25 bp, Mus musculus
cagttttggaaaggtgagtacagcc

SEQ ID NO: 575124 - DNA, 25 bp, Mus musculus
cagttttggatgattcaggaccctc

SEQ ID NO: 575125 - DNA, 25 bp, Mus musculus
cagttttggatgtttcaggaccctc

SEQ ID NO: 575126 - DNA, 25 bp, Mus musculus
cagttttggccgaggagtacatgga

SEQ ID NO: 575127 - DNA, 25 bp, Mus musculus
cagttttggccgtggagtacatgga

SEQ ID NO: 575128 - DNA, 25 bp, Mus musculus
cagtttttcgatcaggtcaggtgat

SEQ ID NO: 575129 - DNA, 25 bp, Mus musculus
cagtttttcgatgaggtcaggtgat

SEQ ID NO: 575130 - DNA, 25 bp, Mus musculus
cagtttttctcacctcagatgaaga

SEQ ID NO: 575131 - DNA, 25 bp, Mus musculus
cagtttttctcagctcagatgaaga

SEQ ID NO: 575132 - DNA, 25 bp, Mus musculus
cagtttttggaacatgcagtgagga

SEQ ID NO: 575133 - DNA, 25 bp, Mus musculus
cagtttttggaagatgcagtgagga

SEQ ID NO: 575134 - DNA, 25 bp, Mus musculus
cagttttttgcgcaagagtattatc

SEQ ID NO: 575135 - DNA, 25 bp, Mus musculus
cagttttttgcggaagagtattatc

SEQ ID NO: 575136 - DNA, 25 bp, Mus musculus
cataaaaaccatccaggctgctcgc

SEQ ID NO: 575137 - DNA, 25 bp, Mus musculus
cataaaaaccatgcaggctgctcgc

SEQ ID NO: 575138 - DNA, 25 bp, Mus musculus
cataaaaatagaacagcagtctgga

SEQ ID NO: 575139 - DNA, 25 bp, Mus musculus
cataaaaatagatcagcagtctgga

SEQ ID NO: 575140 - DNA, 25 bp, Mus musculus
cataaaacgattagatttgttggtc

SEQ ID NO: 575141 - DNA, 25 bp, Mus musculus
cataaaacgatttgatttgttggtc

SEQ ID NO: 575142 - DNA, 25 bp, Mus musculus
cataaaactagcagatgcaggtggt

SEQ ID NO: 575143 - DNA, 25 bp, Mus musculus
cataaaactagctgatgcaggtggt

SEQ ID NO: 575144 - DNA, 25 bp, Mus musculus
cataaaagaagccatgcaaatcaga

SEQ ID NO: 575145 - DNA, 25 bp, Mus musculus
cataaaagaagcgatgcaaatcaga

SEQ ID NO: 575146 - DNA, 25 bp, Mus musculus
cataaaagatgtagcagccaagagg

SEQ ID NO: 575147 - DNA, 25 bp, Mus musculus
cataaaagatgtcactttcaacacg

SEQ ID NO: 575148 - DNA, 25 bp, Mus musculus
cataaaagatgtgactttcaacacg

SEQ ID NO: 575149 - DNA, 25 bp, Mus musculus
cataaaagatgttgcagccaagagg

SEQ ID NO: 575150 - DNA, 25 bp, Mus musculus
cataaaatccatatactctgcctgc

SEQ ID NO: 575151 - DNA, 25 bp, Mus musculus
cataaaatccatttactctgcctgc

SEQ ID NO: 575152 - DNA, 25 bp, Mus musculus
cataaaattttcatggcacaaggag

SEQ ID NO: 575153 - DNA, 25 bp, Mus musculus
cataaaattttcttggcacaaggag

SEQ ID NO: 575154 - DNA, 25 bp, Mus musculus
cataaacaactgctcagcgcctgct

SEQ ID NO: 575155 - DNA, 25 bp, Mus musculus
cataaacaactggtcagcgcctgct

SEQ ID NO: 575156 - DNA, 25 bp, Mus musculus
cataaacagcaacagatggccaaga

SEQ ID NO: 575157 - DNA, 25 bp, Mus musculus
cataaacagcaagagatggccaaga

SEQ ID NO: 575158 - DNA, 25 bp, Mus musculus
cataaacattaactataggaatcct

SEQ ID NO: 575159 - DNA, 25 bp, Mus musculus
cataaacattaagtataggaatcct

SEQ ID NO: 575160 - DNA, 25 bp, Mus musculus
cataaaccaggacaggtgacactgc

SEQ ID NO: 575161 - DNA, 25 bp, Mus musculus
cataaaccaggagaggtgacactgc

SEQ ID NO: 575162 - DNA, 25 bp, Mus musculus
cataaaccaggcctggccaacctgg

SEQ ID NO: 575163 - DNA, 25 bp, Mus musculus
cataaaccaggcgtggccaacctgg

SEQ ID NO: 575164 - DNA, 25 bp, Mus musculus
cataaaccatccatgctacagccta

SEQ ID NO: 575165 - DNA, 25 bp, Mus musculus
cataaaccatccttgctacagccta

SEQ ID NO: 575166 - DNA, 25 bp, Mus musculus
cataaaccccgaagaggctgtagcc

SEQ ID NO: 575167 - DNA, 25 bp, Mus musculus
cataaaccccgatgaggctgtagcc

SEQ ID NO: 575168 - DNA, 25 bp, Mus musculus
cataaacgatgtcccttcaagattc

SEQ ID NO: 575169 - DNA, 25 bp, Mus musculus
cataaacgatgtgccttcaagattc

SEQ ID NO: 575170 - DNA, 25 bp, Mus musculus
cataaactcaacctgaagtgggtgg

SEQ ID NO: 575171 - DNA, 25 bp, Mus musculus
cataaactcaacgtgaagtgggtgg

SEQ ID NO: 575172 - DNA, 25 bp, Mus musculus
cataaactcattatcagtggattct

SEQ ID NO: 575173 - DNA, 25 bp, Mus musculus
cataaactcattttcagtggattct

SEQ ID NO: 575174 - DNA, 25 bp, Mus musculus
cataaactccagaagggtgtctcac

SEQ ID NO: 575175 - DNA, 25 bp, Mus musculus
cataaactccagtagggtgtctcac

SEQ ID NO: 575176 - DNA, 25 bp, Mus musculus
cataaactgactatgagtgatggag

SEQ ID NO: 575177 - DNA, 25 bp, Mus musculus
cataaactgactttgagtgatggag

SEQ ID NO: 575178 - DNA, 25 bp, Mus musculus
cataaagaaagcaggagatggatcc

SEQ ID NO: 575179 - DNA, 25 bp, Mus musculus
cataaagaaagctggagatggatcc

SEQ ID NO: 575180 - DNA, 25 bp, Mus musculus
cataaagcaaatcggctgtctgcca

SEQ ID NO: 575181 - DNA, 25 bp, Mus musculus
cataaagcaaatgggctgtctgcca

SEQ ID NO: 575182 - DNA, 25 bp, Mus musculus
cataaaggatagagagcaggttgcc

SEQ ID NO: 575183 - DNA, 25 bp, Mus musculus
cataaaggatagtgagcaggttgcc

SEQ ID NO: 575184 - DNA, 25 bp, Mus musculus
cataaaggcatgactatatcacgtc

SEQ ID NO: 575185 - DNA, 25 bp, Mus musculus
cataaaggcatgtctatatcacgtc

SEQ ID NO: 575186 - DNA, 25 bp, Mus musculus
cataaaggctctaagagatcaggca

SEQ ID NO: 575187 - DNA, 25 bp, Mus musculus
cataaaggctcttagagatcaggca

SEQ ID NO: 575188 - DNA, 25 bp, Mus musculus
cataaaggctggcactggtcctcag

SEQ ID NO: 575189 - DNA, 25 bp, Mus musculus
cataaaggctgggactggtcctcag

SEQ ID NO: 575190 - DNA, 25 bp, Mus musculus
cataaaggcttcaggtgtcagctgc

SEQ ID NO: 575191 - DNA, 25 bp, Mus musculus
cataaaggcttctggtgtcagctgc

SEQ ID NO: 575192 - DNA, 25 bp, Mus musculus
cataaatacaaacgtgggcaagaag

SEQ ID NO: 575193 - DNA, 25 bp, Mus musculus
cataaatacaaaggtgggcaagaag

SEQ ID NO: 575194 - DNA, 25 bp, Mus musculus
cataaatactctctggcgggtaaaa

SEQ ID NO: 575195 - DNA, 25 bp, Mus musculus
cataaatactctgtggcgggtaaaa

SEQ ID NO: 575196 - DNA, 25 bp, Mus musculus
cataaatgaccgagaaaagcccctg

SEQ ID NO: 575197 - DNA, 25 bp, Mus musculus
cataaatgaccgtgaaaagcccctg

SEQ ID NO: 575198 - DNA, 25 bp, Mus musculus
cataaatgccaaattcccagtggac

SEQ ID NO: 575199 - DNA, 25 bp, Mus musculus
cataaatgccaatttcccagtggac

SEQ ID NO: 575200 - DNA, 25 bp, Mus musculus
cataaatgtagaaggtaagcatgtc

SEQ ID NO: 575201 - DNA, 25 bp, Mus musculus
cataaatgtagatggtaagcatgtc

SEQ ID NO: 575202 - DNA, 25 bp, Mus musculus
cataaatgttatcatcgatgattca

SEQ ID NO: 575203 - DNA, 25 bp, Mus musculus
cataaatgttatgatcgatgattca

SEQ ID NO: 575204 - DNA, 25 bp, Mus musculus
cataaattgcggaaactgaacccac

SEQ ID NO: 575205 - DNA, 25 bp, Mus musculus
cataaattgcggtaactgaacccac

SEQ ID NO: 575206 - DNA, 25 bp, Mus musculus
cataacaagtgcacaaaggaagctc

SEQ ID NO: 575207 - DNA, 25 bp, Mus musculus
cataacaagtgctcaaaggaagctc

SEQ ID NO: 575208 - DNA, 25 bp, Mus musculus
cataacaggcaaaacaacatggtgc

SEQ ID NO: 575209 - DNA, 25 bp, Mus musculus
cataacaggcaatacaacatggtgc

SEQ ID NO: 575210 - DNA, 25 bp, Mus musculus
cataacatcccgcttgtcatttcca

SEQ ID NO: 575211 - DNA, 25 bp, Mus musculus
cataacatcccggttgtcatttcca

SEQ ID NO: 575212 - DNA, 25 bp, Mus musculus
cataacatcgtacctcttcgcaggg

SEQ ID NO: 575213 - DNA, 25 bp, Mus musculus
cataacatcgtagctcttcgcaggg

SEQ ID NO: 575214 - DNA, 25 bp, Mus musculus
cataaccaaaagatgaggtcccagt

SEQ ID NO: 575215 - DNA, 25 bp, Mus musculus
cataaccaaaagttgaggtcccagt

SEQ ID NO: 575216 - DNA, 25 bp, Mus musculus
cataaccttatcagcctttgcacta

SEQ ID NO: 575217 - DNA, 25 bp, Mus musculus
cataaccttatctgcctttgcacta

SEQ ID NO: 575218 - DNA, 25 bp, Mus musculus
cataaccttggaatcctatgtggtc

SEQ ID NO: 575219 - DNA, 25 bp, Mus musculus
cataaccttggattcctatgtggtc

SEQ ID NO: 575220 - DNA, 25 bp, Mus musculus
cataacgagaacacttggccaaagg

SEQ ID NO: 575221 - DNA, 25 bp, Mus musculus
cataacgagaactcttggccaaagg

SEQ ID NO: 575222 - DNA, 25 bp, Mus musculus
cataacgccatgaataaaaagtaac

SEQ ID NO: 575223 - DNA, 25 bp, Mus musculus
cataacgccatgtataaaaagtaac

SEQ ID NO: 575224 - DNA, 25 bp, Mus musculus
cataacggattcaaacggaagacac

SEQ ID NO: 575225 - DNA, 25 bp, Mus musculus
cataacggattctaacggaagacac

SEQ ID NO: 575226 - DNA, 25 bp, Mus musculus
cataacggtctgcacttctctgcca

SEQ ID NO: 575227 - DNA, 25 bp, Mus musculus
cataacggtctggacttctctgcca

SEQ ID NO: 575228 - DNA, 25 bp, Mus musculus
cataactggatccacatatgcacca

SEQ ID NO: 575229 - DNA, 25 bp, Mus musculus
cataactggatcgacatatgcacca

SEQ ID NO: 575230 - DNA, 25 bp, Mus musculus
cataactggtaaatcatggagacta

SEQ ID NO: 575231 - DNA, 25 bp, Mus musculus
cataactggtaattcatggagacta

SEQ ID NO: 575232 - DNA, 25 bp, Mus musculus
cataacttccagctattgaaagggt

SEQ ID NO: 575233 - DNA, 25 bp, Mus musculus
cataacttccaggtattgaaagggt

SEQ ID NO: 575234 - DNA, 25 bp, Mus musculus
cataagaacagcactggctcactga

SEQ ID NO: 575235 - DNA, 25 bp, Mus musculus
cataagaacagctctggctcactga

SEQ ID NO: 575236 - DNA, 25 bp, Mus musculus
cataagaagtcaccgtttcggaggc

SEQ ID NO: 575237 - DNA, 25 bp, Mus musculus
cataagaagtcagcgtttcggaggc

SEQ ID NO: 575238 - DNA, 25 bp, Mus musculus
cataagaataatccaagccatgtgg

SEQ ID NO: 575239 - DNA, 25 bp, Mus musculus
cataagaataatgcaagccatgtgg

SEQ ID NO: 575240 - DNA, 25 bp, Mus musculus
cataagaatggacaactagttgtgg

SEQ ID NO: 575241 - DNA, 25 bp, Mus musculus
cataagaatggagaactagttgtgg

SEQ ID NO: 575242 - DNA, 25 bp, Mus musculus
cataagacagcaactggcatctatt

SEQ ID NO: 575243 - DNA, 25 bp, Mus musculus
cataagacagcatctggcatctatt

SEQ ID NO: 575244 - DNA, 25 bp, Mus musculus
cataagagggcacccgtctccttta

SEQ ID NO: 575245 - DNA, 25 bp, Mus musculus
cataagagggcagccgtctccttta

SEQ ID NO: 575246 - DNA, 25 bp, Mus musculus
cataagatcccactggatgggtagc

SEQ ID NO: 575247 - DNA, 25 bp, Mus musculus
cataagatcccagtggatgggtagc

SEQ ID NO: 575248 - DNA, 25 bp, Mus musculus
cataagatgttcaagtggagttcca

SEQ ID NO: 575249 - DNA, 25 bp, Mus musculus
cataagatgttctagtggagttcca

SEQ ID NO: 575250 - DNA, 25 bp, Mus musculus
cataagattctgaccgagtgctcca

SEQ ID NO: 575251 - DNA, 25 bp, Mus musculus
cataagattctgtccgagtgctcca

SEQ ID NO: 575252 - DNA, 25 bp, Mus musculus
cataagcagcatctagccaggcagt

SEQ ID NO: 575253 - DNA, 25 bp, Mus musculus
cataagcagcatgtagccaggcagt

SEQ ID NO: 575254 - DNA, 25 bp, Mus musculus
cataagcatattagtcccgatgacc

SEQ ID NO: 575255 - DNA, 25 bp, Mus musculus
cataagcatatttgtcccgatgacc

SEQ ID NO: 575256 - DNA, 25 bp, Mus musculus
cataagccagagcatcgttcttcca

SEQ ID NO: 575257 - DNA, 25 bp, Mus musculus
cataagccagaggatcgttcttcca

SEQ ID NO: 575258 - DNA, 25 bp, Mus musculus
cataagccgaataagtattttcggg

SEQ ID NO: 575259 - DNA, 25 bp, Mus musculus
cataagccgaattagtattttcggg

SEQ ID NO: 575260 - DNA, 25 bp, Mus musculus
cataagcggatcacaaagttagcag

SEQ ID NO: 575261 - DNA, 25 bp, Mus musculus
cataagcggatctcaaagttagcag

SEQ ID NO: 575262 - DNA, 25 bp, Mus musculus
cataagctacagaacacctttcatg

SEQ ID NO: 575263 - DNA, 25 bp, Mus musculus
cataagctacagtacacctttcatg

SEQ ID NO: 575264 - DNA, 25 bp, Mus musculus
cataagctccgccttcctggaagct

SEQ ID NO: 575265 - DNA, 25 bp, Mus musculus
cataagctccgcgttcctggaagct

SEQ ID NO: 575266 - DNA, 25 bp, Mus musculus
cataagctgatgcatgacgatgcca

SEQ ID NO: 575267 - DNA, 25 bp, Mus musculus
cataagctgatggatgacgatgcca

SEQ ID NO: 575268 - DNA, 25 bp, Mus musculus
cataaggctagaaaatttccatagg

SEQ ID NO: 575269 - DNA, 25 bp, Mus musculus
cataaggctagataatttccatagg

SEQ ID NO: 575270 - DNA, 25 bp, Mus musculus
cataagggccccagtgtaacctcag

SEQ ID NO: 575271 - DNA, 25 bp, Mus musculus
cataagggcccctgtgtaacctcag

SEQ ID NO: 575272 - DNA, 25 bp, Mus musculus
cataagggctaaattcatgggttcc

SEQ ID NO: 575273 - DNA, 25 bp, Mus musculus
cataagggctaatttcatgggttcc

SEQ ID NO: 575274 - DNA, 25 bp, Mus musculus
cataagggctagcagtcagaaaagg

SEQ ID NO: 575275 - DNA, 25 bp, Mus musculus
cataagggctaggagtcagaaaagg

SEQ ID NO: 575276 - DNA, 25 bp, Mus musculus
cataagggtaaacaccgacacttcg

SEQ ID NO: 575277 - DNA, 25 bp, Mus musculus
cataagggtaaagaccgacacttcg

SEQ ID NO: 575278 - DNA, 25 bp, Mus musculus
cataaggtgtaccaacttagccggg

SEQ ID NO: 575279 - DNA, 25 bp, Mus musculus
cataaggtgtacgaacttagccggg

SEQ ID NO: 575280 - DNA, 25 bp, Mus musculus
cataaggttgatcgagatgtcgaag

SEQ ID NO: 575281 - DNA, 25 bp, Mus musculus
cataaggttgatggagatgtcgaag

SEQ ID NO: 575282 - DNA, 25 bp, Mus musculus
cataagtcagtcagagtgcgcgcgc

SEQ ID NO: 575283 - DNA, 25 bp, Mus musculus
cataagtcagtctgagtgcgcgcgc

SEQ ID NO: 575284 - DNA, 25 bp, Mus musculus
cataagtccgatattggcaaatttg

SEQ ID NO: 575285 - DNA, 25 bp, Mus musculus
cataagtccgattttggcaaatttg

SEQ ID NO: 575286 - DNA, 25 bp, Mus musculus
cataagtgcccaagagcttcggagc

SEQ ID NO: 575287 - DNA, 25 bp, Mus musculus
cataagtgcccatgagcttcggagc

SEQ ID NO: 575288 - DNA, 25 bp, Mus musculus
cataagtgctctctgtggtgagcct

SEQ ID NO: 575289 - DNA, 25 bp, Mus musculus
cataagtgctctgtgtggtgagcct

SEQ ID NO: 575290 - DNA, 25 bp, Mus musculus
cataagtggcttcgcatacgagtac

SEQ ID NO: 575291 - DNA, 25 bp, Mus musculus
cataagtggcttggcatacgagtac

SEQ ID NO: 575292 - DNA, 25 bp, Mus musculus
cataagttcatgctacagacaattt

SEQ ID NO: 575293 - DNA, 25 bp, Mus musculus
cataagttcatggtacagacaattt

SEQ ID NO: 575294 - DNA, 25 bp, Mus musculus
cataataaaaagctcacttcagctc

SEQ ID NO: 575295 - DNA, 25 bp, Mus musculus
cataataaaaaggtcacttcagctc

SEQ ID NO: 575296 - DNA, 25 bp, Mus musculus
cataataagtcacggcaagggcacg

SEQ ID NO: 575297 - DNA, 25 bp, Mus musculus
cataataagtcagggcaagggcacg

SEQ ID NO: 575298 - DNA, 25 bp, Mus musculus
cataatacgaagacaaccacctggt

SEQ ID NO: 575299 - DNA, 25 bp, Mus musculus
cataatacgaagtcaaccacctggt

SEQ ID NO: 575300 - DNA, 25 bp, Mus musculus
cataatcactgtcagggagcgccga

SEQ ID NO: 575301 - DNA, 25 bp, Mus musculus
cataatcactgtgagggagcgccga

SEQ ID NO: 575302 - DNA, 25 bp, Mus musculus
cataatcagaagacatatctacctg

SEQ ID NO: 575303 - DNA, 25 bp, Mus musculus
cataatcagaagtcatatctacctg

SEQ ID NO: 575304 - DNA, 25 bp, Mus musculus
cataatcatcaacaggtggtggagc

SEQ ID NO: 575305 - DNA, 25 bp, Mus musculus
cataatcatcaagaggtggtggagc

SEQ ID NO: 575306 - DNA, 25 bp, Mus musculus
cataatccacaacccagaacctgag

SEQ ID NO: 575307 - DNA, 25 bp, Mus musculus
cataatccacaagccagaacctgag

SEQ ID NO: 575308 - DNA, 25 bp, Mus musculus
cataatccgtggagggctcacccgt

SEQ ID NO: 575309 - DNA, 25 bp, Mus musculus
cataatccgtggtgggctcacccgt

SEQ ID NO: 575310 - DNA, 25 bp, Mus musculus
cataatcggagaagtggtggaccag

SEQ ID NO: 575311 - DNA, 25 bp, Mus musculus
cataatcggagactatgctggagag

SEQ ID NO: 575312 - DNA, 25 bp, Mus musculus
cataatcggagagtatgctggagag

SEQ ID NO: 575313 - DNA, 25 bp, Mus musculus
cataatcggagatgtggtggaccag

SEQ ID NO: 575314 - DNA, 25 bp, Mus musculus
cataatctcatactggccagtccca

SEQ ID NO: 575315 - DNA, 25 bp, Mus musculus
cataatctcatagtggccagtccca

SEQ ID NO: 575316 - DNA, 25 bp, Mus musculus
cataatctgtctctagtggcacaca

SEQ ID NO: 575317 - DNA, 25 bp, Mus musculus
cataatctgtctgtagtggcacaca

SEQ ID NO: 575318 - DNA, 25 bp, Mus musculus
cataatgaagccacatggcactggg

SEQ ID NO: 575319 - DNA, 25 bp, Mus musculus
cataatgaagcctcatggcactggg

SEQ ID NO: 575320 - DNA, 25 bp, Mus musculus
cataatgacataagtgtccagcttc

SEQ ID NO: 575321 - DNA, 25 bp, Mus musculus
cataatgacatatgtgtccagcttc

SEQ ID NO: 575322 - DNA, 25 bp, Mus musculus
cataatgcagtcctttgaaaaccca

SEQ ID NO: 575323 - DNA, 25 bp, Mus musculus
cataatgcagtcgtttgaaaaccca

SEQ ID NO: 575324 - DNA, 25 bp, Mus musculus
cataatggatctagtaagcagcctc

SEQ ID NO: 575325 - DNA, 25 bp, Mus musculus
cataatggatcttgtaagcagcctc

SEQ ID NO: 575326 - DNA, 25 bp, Mus musculus
cataatgggacgaaagccttcctct

SEQ ID NO: 575327 - DNA, 25 bp, Mus musculus
cataatgggacgtaagccttcctct

SEQ ID NO: 575328 - DNA, 25 bp, Mus musculus
cataatggtttaacatctacaaagt

SEQ ID NO: 575329 - DNA, 25 bp, Mus musculus
cataatggtttatcatctacaaagt

SEQ ID NO: 575330 - DNA, 25 bp, Mus musculus
cataatgtacggaaagaaccgaggg

SEQ ID NO: 575331 - DNA, 25 bp, Mus musculus
cataatgtacggtaagaaccgaggg

SEQ ID NO: 575332 - DNA, 25 bp, Mus musculus
cataatgtgtggatgcagtttggac

SEQ ID NO: 575333 - DNA, 25 bp, Mus musculus
cataatgtgtggttgcagtttggac

SEQ ID NO: 575334 - DNA, 25 bp, Mus musculus
cataatgttcatcgtggttggctgc

SEQ ID NO: 575335 - DNA, 25 bp, Mus musculus
cataatgttcatggtggttggctgc

SEQ ID NO: 575336 - DNA, 25 bp, Mus musculus
cataattaaacgatgccccaacctc

SEQ ID NO: 575337 - DNA, 25 bp, Mus musculus
cataattaaacgttgccccaacctc

SEQ ID NO: 575338 - DNA, 25 bp, Mus musculus
cataattagtcacagccatgactag

SEQ ID NO: 575339 - DNA, 25 bp, Mus musculus
cataattagtcagagccatgactag

SEQ ID NO: 575340 - DNA, 25 bp, Mus musculus
cataattctggcacatcactttggc

SEQ ID NO: 575341 - DNA, 25 bp, Mus musculus
cataattctggctcatcactttggc

SEQ ID NO: 575342 - DNA, 25 bp, Mus musculus
cataattcttatcgccaaggatgca

SEQ ID NO: 575343 - DNA, 25 bp, Mus musculus
cataattcttatggccaaggatgca

SEQ ID NO: 575344 - DNA, 25 bp, Mus musculus
cataattgaaataggtatccggacc

SEQ ID NO: 575345 - DNA, 25 bp, Mus musculus
cataattgaaattggtatccggacc

SEQ ID NO: 575346 - DNA, 25 bp, Mus musculus
cataattgacaaactggctgctggc

SEQ ID NO: 575347 - DNA, 25 bp, Mus musculus
cataattgacaatctggctgctggc

SEQ ID NO: 575348 - DNA, 25 bp, Mus musculus
cataattggcaaatttgtaaggaac

SEQ ID NO: 575349 - DNA, 25 bp, Mus musculus
cataattggcaattttgtaaggaac

SEQ ID NO: 575350 - DNA, 25 bp, Mus musculus
catacaaacgaaagggtcattggtg

SEQ ID NO: 575351 - DNA, 25 bp, Mus musculus
catacaaacgaatgggtcattggtg

SEQ ID NO: 575352 - DNA, 25 bp, Mus musculus
catacaaagaagctgtgagcaagta

SEQ ID NO: 575353 - DNA, 25 bp, Mus musculus
catacaaagaaggtgtgagcaagta

SEQ ID NO: 575354 - DNA, 25 bp, Mus musculus
catacaaaggaaacgatgcgcttcg

SEQ ID NO: 575355 - DNA, 25 bp, Mus musculus
catacaaaggaatcgatgcgcttcg

SEQ ID NO: 575356 - DNA, 25 bp, Mus musculus
catacaaattctattcctggagcaa

SEQ ID NO: 575357 - DNA, 25 bp, Mus musculus
catacaaattcttttcctggagcaa

SEQ ID NO: 575358 - DNA, 25 bp, Mus musculus
catacaaccagtctttgccatagta

SEQ ID NO: 575359 - DNA, 25 bp, Mus musculus
catacaaccagtgtttgccatagta

SEQ ID NO: 575360 - DNA, 25 bp, Mus musculus
catacaaccggtattgtggagacca

SEQ ID NO: 575361 - DNA, 25 bp, Mus musculus
catacaaccggttttgtggagacca

SEQ ID NO: 575362 - DNA, 25 bp, Mus musculus
catacaactatgagggaaaaggctc

SEQ ID NO: 575363 - DNA, 25 bp, Mus musculus
catacaactatgtgggaaaaggctc

SEQ ID NO: 575364 - DNA, 25 bp, Mus musculus
catacaagcaagaagtcaaaattta

SEQ ID NO: 575365 - DNA, 25 bp, Mus musculus
catacaagcaagtagtcaaaattta

SEQ ID NO: 575366 - DNA, 25 bp, Mus musculus
catacaagcaatcacccatattgct

SEQ ID NO: 575367 - DNA, 25 bp, Mus musculus
catacaagcaatgacccatattgct

SEQ ID NO: 575368 - DNA, 25 bp, Mus musculus
catacaagctagagaagcaacttct

SEQ ID NO: 575369 - DNA, 25 bp, Mus musculus
catacaagctagtgaagcaacttct

SEQ ID NO: 575370 - DNA, 25 bp, Mus musculus
catacaagctgaagaaggcaacccc

SEQ ID NO: 575371 - DNA, 25 bp, Mus musculus
catacaagctgatgaaggcaacccc

SEQ ID NO: 575372 - DNA, 25 bp, Mus musculus
catacaaggacacgtgccagtgtac

SEQ ID NO: 575373 - DNA, 25 bp, Mus musculus
catacaaggacaggtgccagtgtac

SEQ ID NO: 575374 - DNA, 25 bp, Mus musculus
catacaagttgtcattgttgggcca

SEQ ID NO: 575375 - DNA, 25 bp, Mus musculus
catacaagttgtgattgttgggcca

SEQ ID NO: 575376 - DNA, 25 bp, Mus musculus
catacaatcattcgcacatccctgg

SEQ ID NO: 575377 - DNA, 25 bp, Mus musculus
catacaatcattggcacatccctgg

SEQ ID NO: 575378 - DNA, 25 bp, Mus musculus
catacaatctggcagatgagagact

SEQ ID NO: 575379 - DNA, 25 bp, Mus musculus
catacaatctgggagatgagagact

SEQ ID NO: 575380 - DNA, 25 bp, Mus musculus
catacacacggaagcatttcttgct

SEQ ID NO: 575381 - DNA, 25 bp, Mus musculus
catacacacggatgcatttcttgct

SEQ ID NO: 575382 - DNA, 25 bp, Mus musculus
catacaccatgacaggggcaacgga

SEQ ID NO: 575383 - DNA, 25 bp, Mus musculus
catacaccatgagaggggcaacgga

SEQ ID NO: 575384 - DNA, 25 bp, Mus musculus
catacaccggcaagctcaatgctgt

SEQ ID NO: 575385 - DNA, 25 bp, Mus musculus
catacaccggcatgctcaatgctgt

SEQ ID NO: 575386 - DNA, 25 bp, Mus musculus
catacactggcccatgggtttcaag

SEQ ID NO: 575387 - DNA, 25 bp, Mus musculus
catacactggccgatgggtttcaag

SEQ ID NO: 575388 - DNA, 25 bp, Mus musculus
catacagaaaaacactagatttgga

SEQ ID NO: 575389 - DNA, 25 bp, Mus musculus
catacagaaaaagactagatttgga

SEQ ID NO: 575390 - DNA, 25 bp, Mus musculus
catacagaagtgacgggaggcagct

SEQ ID NO: 575391 - DNA, 25 bp, Mus musculus
catacagaagtgtcgggaggcagct

SEQ ID NO: 575392 - DNA, 25 bp, Mus musculus
catacagagagactgagtgcaagtc

SEQ ID NO: 575393 - DNA, 25 bp, Mus musculus
catacagagagagtgagtgcaagtc

SEQ ID NO: 575394 - DNA, 25 bp, Mus musculus
catacagagatgctcgagtggcaca

SEQ ID NO: 575395 - DNA, 25 bp, Mus musculus
catacagagatggtcgagtggcaca

SEQ ID NO: 575396 - DNA, 25 bp, Mus musculus
catacagagcttccttctcttttca

SEQ ID NO: 575397 - DNA, 25 bp, Mus musculus
catacagagcttgcttctcttttca

SEQ ID NO: 575398 - DNA, 25 bp, Mus musculus
catacagatcccaccgtgatcaaga

SEQ ID NO: 575399 - DNA, 25 bp, Mus musculus
catacagatccctccgtgatcaaga

SEQ ID NO: 575400 - DNA, 25 bp, Mus musculus
catacagatggcctctcagccacag

SEQ ID NO: 575401 - DNA, 25 bp, Mus musculus
catacagatggcgtctcagccacag

SEQ ID NO: 575402 - DNA, 25 bp, Mus musculus
catacagccttgcagcagatgcgga

SEQ ID NO: 575403 - DNA, 25 bp, Mus musculus
catacagccttggagcagatgcgga

SEQ ID NO: 575404 - DNA, 25 bp, Mus musculus
catacagctgttattcaaaagccac

SEQ ID NO: 575405 - DNA, 25 bp, Mus musculus
catacagctgtttttcaaaagccac

SEQ ID NO: 575406 - DNA, 25 bp, Mus musculus
catacagcttacatgataatacaga

SEQ ID NO: 575407 - DNA, 25 bp, Mus musculus
catacagcttacttgataatacaga

SEQ ID NO: 575408 - DNA, 25 bp, Mus musculus
catacaggagcaaagtagacaaagg

SEQ ID NO: 575409 - DNA, 25 bp, Mus musculus
catacaggagcatagtagacaaagg

SEQ ID NO: 575410 - DNA, 25 bp, Mus musculus
catacaggcaccatatggctcctga

SEQ ID NO: 575411 - DNA, 25 bp, Mus musculus
catacaggcaccttatggctcctga

SEQ ID NO: 575412 - DNA, 25 bp, Mus musculus
catacagggaacaggcggtgtcaac

SEQ ID NO: 575413 - DNA, 25 bp, Mus musculus
catacagggaactggcggtgtcaac

SEQ ID NO: 575414 - DNA, 25 bp, Mus musculus
catacagggtgtacatgcagcgtct

SEQ ID NO: 575415 - DNA, 25 bp, Mus musculus
catacagggtgttcatgcagcgtct

SEQ ID NO: 575416 - DNA, 25 bp, Mus musculus
catacagtccatccaaagagaagtc

SEQ ID NO: 575417 - DNA, 25 bp, Mus musculus
catacagtccatgcaaagagaagtc

SEQ ID NO: 575418 - DNA, 25 bp, Mus musculus
catacagtccggaattctacaatgg

SEQ ID NO: 575419 - DNA, 25 bp, Mus musculus
catacagtccggtattctacaatgg

SEQ ID NO: 575420 - DNA, 25 bp, Mus musculus
catacagtgggacagaacgaagcct

SEQ ID NO: 575421 - DNA, 25 bp, Mus musculus
catacagtgggagagaacgaagcct

SEQ ID NO: 575422 - DNA, 25 bp, Mus musculus
catacagttcttaaggctcgcacac

SEQ ID NO: 575423 - DNA, 25 bp, Mus musculus
catacagttctttaggctcgcacac

SEQ ID NO: 575424 - DNA, 25 bp, Mus musculus
catacagttttacagttaaggcttt

SEQ ID NO: 575425 - DNA, 25 bp, Mus musculus
catacagttttagagttaaggcttt

SEQ ID NO: 575426 - DNA, 25 bp, Mus musculus
catacatacctacagctgggaagtg

SEQ ID NO: 575427 - DNA, 25 bp, Mus musculus
catacatacctagagctgggaagtg

SEQ ID NO: 575428 - DNA, 25 bp, Mus musculus
catacatctcaaccccgtgacatta

SEQ ID NO: 575429 - DNA, 25 bp, Mus musculus
catacatctcaagcccgtgacatta

SEQ ID NO: 575430 - DNA, 25 bp, Mus musculus
catacatggcctctctacagaaagc

SEQ ID NO: 575431 - DNA, 25 bp, Mus musculus
catacatggcctgtctacagaaagc

SEQ ID NO: 575432 - DNA, 25 bp, Mus musculus
catacatgggtcctacaagtgccaa

SEQ ID NO: 575433 - DNA, 25 bp, Mus musculus
catacatgggtcgtacaagtgccaa

SEQ ID NO: 575434 - DNA, 25 bp, Mus musculus
catacatggttgaaggcggcagttc

SEQ ID NO: 575435 - DNA, 25 bp, Mus musculus
catacatggttgtaggcggcagttc

SEQ ID NO: 575436 - DNA, 25 bp, Mus musculus
catacatgtactcgatgccttcaga

SEQ ID NO: 575437 - DNA, 25 bp, Mus musculus
catacatgtactggatgccttcaga

SEQ ID NO: 575438 - DNA, 25 bp, Mus musculus
catacattcaatagagaccgggacc

SEQ ID NO: 575439 - DNA, 25 bp, Mus musculus
catacattcaattgagaccgggacc

SEQ ID NO: 575440 - DNA, 25 bp, Mus musculus
catacattctcaaacctttaacttg

SEQ ID NO: 575441 - DNA, 25 bp, Mus musculus
catacattctcatacctttaacttg

SEQ ID NO: 575442 - DNA, 25 bp, Mus musculus
catacattctgtcggattccttcac

SEQ ID NO: 575443 - DNA, 25 bp, Mus musculus
catacattctgtgggattccttcac

SEQ ID NO: 575444 - DNA, 25 bp, Mus musculus
catacattgggaccgtggttatatc

SEQ ID NO: 575445 - DNA, 25 bp, Mus musculus
catacattgggagcgtggttatatc

SEQ ID NO: 575446 - DNA, 25 bp, Mus musculus
cataccaaaagccaaacttaaagag

SEQ ID NO: 575447 - DNA, 25 bp, Mus musculus
cataccaaaagcgaaacttaaagag

SEQ ID NO: 575448 - DNA, 25 bp, Mus musculus
cataccaagaggagagggtgcacgt

SEQ ID NO: 575449 - DNA, 25 bp, Mus musculus
cataccaagaggtgagggtgcacgt

SEQ ID NO: 575450 - DNA, 25 bp, Mus musculus
cataccaagcgcctgggcattatca

SEQ ID NO: 575451 - DNA, 25 bp, Mus musculus
cataccaagcgcgtgggcattatca

SEQ ID NO: 575452 - DNA, 25 bp, Mus musculus
cataccaagttcatcgtgaaatccc

SEQ ID NO: 575453 - DNA, 25 bp, Mus musculus
cataccaagttcttcgtgaaatccc

SEQ ID NO: 575454 - DNA, 25 bp, Mus musculus
cataccagagagatgattgtgtgaa

SEQ ID NO: 575455 - DNA, 25 bp, Mus musculus
cataccagagagttgattgtgtgaa

SEQ ID NO: 575456 - DNA, 25 bp, Mus musculus
cataccagcctgaatttggaaaaaa

SEQ ID NO: 575457 - DNA, 25 bp, Mus musculus
cataccagcctgtatttggaaaaaa

SEQ ID NO: 575458 - DNA, 25 bp, Mus musculus
cataccagccttaggagtgcatagt

SEQ ID NO: 575459 - DNA, 25 bp, Mus musculus
cataccagcctttggagtgcatagt

SEQ ID NO: 575460 - DNA, 25 bp, Mus musculus
cataccagggtccttctgcatgatg

SEQ ID NO: 575461 - DNA, 25 bp, Mus musculus
cataccagggtcgttctgcatgatg

SEQ ID NO: 575462 - DNA, 25 bp, Mus musculus
cataccatccagacactgtttagta

SEQ ID NO: 575463 - DNA, 25 bp, Mus musculus
cataccatccagtcactgtttagta

SEQ ID NO: 575464 - DNA, 25 bp, Mus musculus
cataccatgcgtaacaaggccctgg

SEQ ID NO: 575465 - DNA, 25 bp, Mus musculus
cataccatgcgttacaaggccctgg

SEQ ID NO: 575466 - DNA, 25 bp, Mus musculus
cataccatggaaagcacttgaatga

SEQ ID NO: 575467 - DNA, 25 bp, Mus musculus
cataccatggaatgcacttgaatga

SEQ ID NO: 575468 - DNA, 25 bp, Mus musculus
cataccatgggtcagggttccggac

SEQ ID NO: 575469 - DNA, 25 bp, Mus musculus
cataccatgggtgagggttccggac

SEQ ID NO: 575470 - DNA, 25 bp, Mus musculus
catacccagttgagatacttccagg

SEQ ID NO: 575471 - DNA, 25 bp, Mus musculus
catacccagttgtgatacttccagg

SEQ ID NO: 575472 - DNA, 25 bp, Mus musculus
catacccgagtaaggcatgttccag

SEQ ID NO: 575473 - DNA, 25 bp, Mus musculus
catacccgagtatggcatgttccag

SEQ ID NO: 575474 - DNA, 25 bp, Mus musculus
catacccgggtgctttgctgaagtc

SEQ ID NO: 575475 - DNA, 25 bp, Mus musculus
catacccgggtggtttgctgaagtc

SEQ ID NO: 575476 - DNA, 25 bp, Mus musculus
cataccctcagaagagcacctggga

SEQ ID NO: 575477 - DNA, 25 bp, Mus musculus
cataccctcagatgagcacctggga

SEQ ID NO: 575478 - DNA, 25 bp, Mus musculus
cataccctcattctggataacaggg

SEQ ID NO: 575479 - DNA, 25 bp, Mus musculus
cataccctcattgtggataacaggg

SEQ ID NO: 575480 - DNA, 25 bp, Mus musculus
cataccctggcaatccggtggagga

SEQ ID NO: 575481 - DNA, 25 bp, Mus musculus
cataccctggcattccggtggagga

SEQ ID NO: 575482 - DNA, 25 bp, Mus musculus
cataccctgtttctggagggaagga

SEQ ID NO: 575483 - DNA, 25 bp, Mus musculus
cataccctgtttgtggagggaagga

SEQ ID NO: 575484 - DNA, 25 bp, Mus musculus
cataccgatcaaattcccagggaca

SEQ ID NO: 575485 - DNA, 25 bp, Mus musculus
cataccgatcaatttcccagggaca

SEQ ID NO: 575486 - DNA, 25 bp, Mus musculus
cataccgctctaaagaaatggtgat

SEQ ID NO: 575487 - DNA, 25 bp, Mus musculus
cataccgctctatagaaatggtgat

SEQ ID NO: 575488 - DNA, 25 bp, Mus musculus
cataccggacacacccaggctaggg

SEQ ID NO: 575489 - DNA, 25 bp, Mus musculus
cataccggacactcccaggctaggg

SEQ ID NO: 575490 - DNA, 25 bp, Mus musculus
cataccggactgagctgtatcgcta

SEQ ID NO: 575491 - DNA, 25 bp, Mus musculus
cataccggactgtgctgtatcgcta

SEQ ID NO: 575492 - DNA, 25 bp, Mus musculus
cataccggtatccagtgccagctgt

SEQ ID NO: 575493 - DNA, 25 bp, Mus musculus
cataccggtatcgagtgccagctgt

SEQ ID NO: 575494 - DNA, 25 bp, Mus musculus
cataccgtggcaccgtggtatggat

SEQ ID NO: 575495 - DNA, 25 bp, Mus musculus
cataccgtggcagcgtggtatggat

SEQ ID NO: 575496 - DNA, 25 bp, Mus musculus
catacctaatacattgttttcactg

SEQ ID NO: 575497 - DNA, 25 bp, Mus musculus
catacctaatactttgttttcactg

SEQ ID NO: 575498 - DNA, 25 bp, Mus musculus
catacctaatagcacaagtggctgc

SEQ ID NO: 575499 - DNA, 25 bp, Mus musculus
catacctaataggacaagtggctgc

SEQ ID NO: 575500 - DNA, 25 bp, Mus musculus
catacctacagcagggaagtgagac

SEQ ID NO: 575501 - DNA, 25 bp, Mus musculus
catacctacagctgggaagtgagac

SEQ ID NO: 575502 - DNA, 25 bp, Mus musculus
catacctagaaactcatcagcacct

SEQ ID NO: 575503 - DNA, 25 bp, Mus musculus
catacctagaaagtcatcagcacct

SEQ ID NO: 575504 - DNA, 25 bp, Mus musculus
catacctatggcatatcgaggtgga

SEQ ID NO: 575505 - DNA, 25 bp, Mus musculus
catacctatggcttatcgaggtgga

SEQ ID NO: 575506 - DNA, 25 bp, Mus musculus
catacctattcacgagtgtgaagct

SEQ ID NO: 575507 - DNA, 25 bp, Mus musculus
catacctattcaggagtgtgaagct

SEQ ID NO: 575508 - DNA, 25 bp, Mus musculus
catacctcgcacaggtgagtgtgga

SEQ ID NO: 575509 - DNA, 25 bp, Mus musculus
catacctcgcactggtgagtgtgga

SEQ ID NO: 575510 - DNA, 25 bp, Mus musculus
catacctgacttagcactgattctg

SEQ ID NO: 575511 - DNA, 25 bp, Mus musculus
catacctgactttgcactgattctg

SEQ ID NO: 575512 - DNA, 25 bp, Mus musculus
catacctgaggcctcgaagttgcag

SEQ ID NO: 575513 - DNA, 25 bp, Mus musculus
catacctgaggcgtcgaagttgcag

SEQ ID NO: 575514 - DNA, 25 bp, Mus musculus
catacctgctgaatattgatagcac

SEQ ID NO: 575515 - DNA, 25 bp, Mus musculus
catacctgctgattattgatagcac

SEQ ID NO: 575516 - DNA, 25 bp, Mus musculus
catacctgctgtcttggtgggaaca

SEQ ID NO: 575517 - DNA, 25 bp, Mus musculus
catacctgctgtgttggtgggaaca

SEQ ID NO: 575518 - DNA, 25 bp, Mus musculus
catacctggacaacatgaaagcccc

SEQ ID NO: 575519 - DNA, 25 bp, Mus musculus
catacctggacatcatgaaagcccc

SEQ ID NO: 575520 - DNA, 25 bp, Mus musculus
catacctggtaaactcttgggcgcc

SEQ ID NO: 575521 - DNA, 25 bp, Mus musculus
catacctggtaatctcttgggcgcc

SEQ ID NO: 575522 - DNA, 25 bp, Mus musculus
cataccttatgccttattaggtgga

SEQ ID NO: 575523 - DNA, 25 bp, Mus musculus
cataccttatgcgttattaggtgga

SEQ ID NO: 575524 - DNA, 25 bp, Mus musculus
cataccttggctctgaggacgtggt

SEQ ID NO: 575525 - DNA, 25 bp, Mus musculus
cataccttggctgtgaggacgtggt

SEQ ID NO: 575526 - DNA, 25 bp, Mus musculus
cataccttgggaaagcatgcaacag

SEQ ID NO: 575527 - DNA, 25 bp, Mus musculus
cataccttgggatagcatgcaacag

SEQ ID NO: 575528 - DNA, 25 bp, Mus musculus
catacctttgagacctggcacagcc

SEQ ID NO: 575529 - DNA, 25 bp, Mus musculus
catacctttgagtcctggcacagcc

SEQ ID NO: 575530 - DNA, 25 bp, Mus musculus
catacgaataagagaatcattctgc

SEQ ID NO: 575531 - DNA, 25 bp, Mus musculus
catacgaataagtgaatcattctgc

SEQ ID NO: 575532 - DNA, 25 bp, Mus musculus
catacgaatggactgtccccaaaga

SEQ ID NO: 575533 - DNA, 25 bp, Mus musculus
catacgaatggagtgtccccaaaga

SEQ ID NO: 575534 - DNA, 25 bp, Mus musculus
catacgaggaaactacattttctga

SEQ ID NO: 575535 - DNA, 25 bp, Mus musculus
catacgaggaaagtacattttctga

SEQ ID NO: 575536 - DNA, 25 bp, Mus musculus
catacgagtttcaagcagtggagag

SEQ ID NO: 575537 - DNA, 25 bp, Mus musculus
catacgagtttctagcagtggagag

SEQ ID NO: 575538 - DNA, 25 bp, Mus musculus
catacgcactagctgtcattgggct

SEQ ID NO: 575539 - DNA, 25 bp, Mus musculus
catacgcactaggtgtcattgggct

SEQ ID NO: 575540 - DNA, 25 bp, Mus musculus
catacgccgaggactatatcatgga

SEQ ID NO: 575541 - DNA, 25 bp, Mus musculus
catacgccgaggtctatatcatgga

SEQ ID NO: 575542 - DNA, 25 bp, Mus musculus
catacggaactcatgaagaccccgg

SEQ ID NO: 575543 - DNA, 25 bp, Mus musculus
catacggaactcttgaagaccccgg

SEQ ID NO: 575544 - DNA, 25 bp, Mus musculus
catacggattaaaagggctggactg

SEQ ID NO: 575545 - DNA, 25 bp, Mus musculus
catacggattaatagggctggactg

SEQ ID NO: 575546 - DNA, 25 bp, Mus musculus
catacggcgaatcctaggtctccca

SEQ ID NO: 575547 - DNA, 25 bp, Mus musculus
catacggcgaatgctaggtctccca

SEQ ID NO: 575548 - DNA, 25 bp, Mus musculus
catacgggagccagaacttaaagca

SEQ ID NO: 575549 - DNA, 25 bp, Mus musculus
catacgggagcctgaacttaaagca

SEQ ID NO: 575550 - DNA, 25 bp, Mus musculus
catacgggccagacttggtttgaga

SEQ ID NO: 575551 - DNA, 25 bp, Mus musculus
catacgggccagtcttggtttgaga

SEQ ID NO: 575552 - DNA, 25 bp, Mus musculus
catacgggcctcagcctagctcatt

SEQ ID NO: 575553 - DNA, 25 bp, Mus musculus
catacgggcctctgcctagctcatt

SEQ ID NO: 575554 - DNA, 25 bp, Mus musculus
catacgggccttcggagaagctgcc

SEQ ID NO: 575555 - DNA, 25 bp, Mus musculus
catacgggccttgggagaagctgcc

SEQ ID NO: 575556 - DNA, 25 bp, Mus musculus
catacggtggaaagatgtagctgga

SEQ ID NO: 575557 - DNA, 25 bp, Mus musculus
catacggtggaatgatgtagctgga

SEQ ID NO: 575558 - DNA, 25 bp, Mus musculus
catacggtggtgagtttggaaataa

SEQ ID NO: 575559 - DNA, 25 bp, Mus musculus
catacggtggtgtgtttggaaataa

SEQ ID NO: 575560 - DNA, 25 bp, Mus musculus
catacgtcctcacagacatcatgac

SEQ ID NO: 575561 - DNA, 25 bp, Mus musculus
catacgtcctcagagacatcatgac

SEQ ID NO: 575562 - DNA, 25 bp, Mus musculus
catacgttcaggacgtgtcaaagct

SEQ ID NO: 575563 - DNA, 25 bp, Mus musculus
catacgttcaggtcgtgtcaaagct

SEQ ID NO: 575564 - DNA, 25 bp, Mus musculus
catactacacataccccagcaggta

SEQ ID NO: 575565 - DNA, 25 bp, Mus musculus
catactacacattccccagcaggta

SEQ ID NO: 575566 - DNA, 25 bp, Mus musculus
catactacactgcttgggaagggtg

SEQ ID NO: 575567 - DNA, 25 bp, Mus musculus
catactacactggttgggaagggtg

SEQ ID NO: 575568 - DNA, 25 bp, Mus musculus
catactatcctcctagccaaattgc

SEQ ID NO: 575569 - DNA, 25 bp, Mus musculus
catactatcctcgtagccaaattgc

SEQ ID NO: 575570 - DNA, 25 bp, Mus musculus
catactatgaagactatagtgtcct

SEQ ID NO: 575571 - DNA, 25 bp, Mus musculus
catactatgaagtctatagtgtcct

SEQ ID NO: 575572 - DNA, 25 bp, Mus musculus
catactatgatacttttgtgaatca

SEQ ID NO: 575573 - DNA, 25 bp, Mus musculus
catactatgatagttttgtgaatca

SEQ ID NO: 575574 - DNA, 25 bp, Mus musculus
catactcagcccatgaggaggaaat

SEQ ID NO: 575575 - DNA, 25 bp, Mus musculus
catactcagcccttgaggaggaaat

SEQ ID NO: 575576 - DNA, 25 bp, Mus musculus
catactcatgccctcaccatgaaga

SEQ ID NO: 575577 - DNA, 25 bp, Mus musculus
catactcatgccgtcaccatgaaga

SEQ ID NO: 575578 - DNA, 25 bp, Mus musculus
catactccagatcatcttcggtggg

SEQ ID NO: 575579 - DNA, 25 bp, Mus musculus
catactccagatgatcttcggtggg

SEQ ID NO: 575580 - DNA, 25 bp, Mus musculus
catactcccagacctggcagagcag

SEQ ID NO: 575581 - DNA, 25 bp, Mus musculus
catactcccagagctggcagagcag

SEQ ID NO: 575582 - DNA, 25 bp, Mus musculus
catactccgtgacagcggagctcct

SEQ ID NO: 575583 - DNA, 25 bp, Mus musculus
catactccgtgagagcggagctcct

SEQ ID NO: 575584 - DNA, 25 bp, Mus musculus
catactcctttacacaagatggccg

SEQ ID NO: 575585 - DNA, 25 bp, Mus musculus
catactcctttagacaagatggccg

SEQ ID NO: 575586 - DNA, 25 bp, Mus musculus
catactcggaataaggtggcaagac

SEQ ID NO: 575587 - DNA, 25 bp, Mus musculus
catactcggaattaggtggcaagac

SEQ ID NO: 575588 - DNA, 25 bp, Mus musculus
catactctaagaactccaagcgctg

SEQ ID NO: 575589 - DNA, 25 bp, Mus musculus
catactctaagatctccaagcgctg

SEQ ID NO: 575590 - DNA, 25 bp, Mus musculus
catactctgaacaccctgagaaagt

SEQ ID NO: 575591 - DNA, 25 bp, Mus musculus
catactctgaactccctgagaaagt

SEQ ID NO: 575592 - DNA, 25 bp, Mus musculus
catactgaattcatcctgtgggtct

SEQ ID NO: 575593 - DNA, 25 bp, Mus musculus
catactgaattcttcctgtgggtct

SEQ ID NO: 575594 - DNA, 25 bp, Mus musculus
catactgacctcctcatgctgctga

SEQ ID NO: 575595 - DNA, 25 bp, Mus musculus
catactgacctcgtcatgctgctga

SEQ ID NO: 575596 - DNA, 25 bp, Mus musculus
catactgcagaaacaatcgtgattt

SEQ ID NO: 575597 - DNA, 25 bp, Mus musculus
catactgcagaatcaatcgtgattt

SEQ ID NO: 575598 - DNA, 25 bp, Mus musculus
catactgccagtctgtgagagggca

SEQ ID NO: 575599 - DNA, 25 bp, Mus musculus
catactgccagtgtgtgagagggca

SEQ ID NO: 575600 - DNA, 25 bp, Mus musculus
catactgcctgacctgcttctgtga

SEQ ID NO: 575601 - DNA, 25 bp, Mus musculus
catactgcctgagctgcttctgtga

SEQ ID NO: 575602 - DNA, 25 bp, Mus musculus
catactgccttgagggtggactcta

SEQ ID NO: 575603 - DNA, 25 bp, Mus musculus
catactgccttgtgggtggactcta

SEQ ID NO: 575604 - DNA, 25 bp, Mus musculus
catactgcgcgtccgccagctttta

SEQ ID NO: 575605 - DNA, 25 bp, Mus musculus
catactgcgcgtgcgccagctttta

SEQ ID NO: 575606 - DNA, 25 bp, Mus musculus
catactgctacaagcgggtcgtggg

SEQ ID NO: 575607 - DNA, 25 bp, Mus musculus
catactgctacatgcgggtcgtggg

SEQ ID NO: 575608 - DNA, 25 bp, Mus musculus
catactgtaggcacaagtgtgggcc

SEQ ID NO: 575609 - DNA, 25 bp, Mus musculus
catactgtaggctcaagtgtgggcc

SEQ ID NO: 575610 - DNA, 25 bp, Mus musculus
catactgtatgcagattcgaattgc

SEQ ID NO: 575611 - DNA, 25 bp, Mus musculus
catactgtatgctgattcgaattgc

SEQ ID NO: 575612 - DNA, 25 bp, Mus musculus
catactgtcacacccgctctgatgt

SEQ ID NO: 575613 - DNA, 25 bp, Mus musculus
catactgtcacagccgctctgatgt

SEQ ID NO: 575614 - DNA, 25 bp, Mus musculus
catactgtctggatgatgacgagca

SEQ ID NO: 575615 - DNA, 25 bp, Mus musculus
catactgtctggttgatgacgagca

SEQ ID NO: 575616 - DNA, 25 bp, Mus musculus
catactgtgtttccttcaacaaaga

SEQ ID NO: 575617 - DNA, 25 bp, Mus musculus
catactgtgtttgcttcaacaaaga

SEQ ID NO: 575618 - DNA, 25 bp, Mus musculus
catactgttctcacccaaaggcctg

SEQ ID NO: 575619 - DNA, 25 bp, Mus musculus
catactgttctctcccaaaggcctg

SEQ ID NO: 575620 - DNA, 25 bp, Mus musculus
catacttaagttctttcctgtggaa

SEQ ID NO: 575621 - DNA, 25 bp, Mus musculus
catacttaagttgtttcctgtggaa

SEQ ID NO: 575622 - DNA, 25 bp, Mus musculus
catacttaatccaagtaagagaggc

SEQ ID NO: 575623 - DNA, 25 bp, Mus musculus
catacttaatcctagtaagagaggc

SEQ ID NO: 575624 - DNA, 25 bp, Mus musculus
catacttacagaagttgatcctaac

SEQ ID NO: 575625 - DNA, 25 bp, Mus musculus
catacttacagatgttgatcctaac

SEQ ID NO: 575626 - DNA, 25 bp, Mus musculus
catacttacggtcctgggaaatgta

SEQ ID NO: 575627 - DNA, 25 bp, Mus musculus
catacttacggtgctgggaaatgta

SEQ ID NO: 575628 - DNA, 25 bp, Mus musculus
catacttcatgaattccagagccct

SEQ ID NO: 575629 - DNA, 25 bp, Mus musculus
catacttcatgatttccagagccct

SEQ ID NO: 575630 - DNA, 25 bp, Mus musculus
catacttcctgccagtgattgggtt

SEQ ID NO: 575631 - DNA, 25 bp, Mus musculus
catacttcctgcgagtgattgggtt

SEQ ID NO: 575632 - DNA, 25 bp, Mus musculus
catacttctgtgatctccaatgaca

SEQ ID NO: 575633 - DNA, 25 bp, Mus musculus
catacttctgtgttctccaatgaca

SEQ ID NO: 575634 - DNA, 25 bp, Mus musculus
catacttggtttcagtcacaggacc

SEQ ID NO: 575635 - DNA, 25 bp, Mus musculus
catacttggtttgagtcacaggacc

SEQ ID NO: 575636 - DNA, 25 bp, Mus musculus
catacttgtatgctccaaaagatga

SEQ ID NO: 575637 - DNA, 25 bp, Mus musculus
catacttgtatggtccaaaagatga

SEQ ID NO: 575638 - DNA, 25 bp, Mus musculus
catactttggtcacggagctccaga

SEQ ID NO: 575639 - DNA, 25 bp, Mus musculus
catactttggtctcggagctccaga

SEQ ID NO: 575640 - DNA, 25 bp, Mus musculus
catagaaaacaacaatatcaagtcc

SEQ ID NO: 575641 - DNA, 25 bp, Mus musculus
catagaaaacaagaatatcaagtcc

SEQ ID NO: 575642 - DNA, 25 bp, Mus musculus
catagaaaaccacacttgctgggac

SEQ ID NO: 575643 - DNA, 25 bp, Mus musculus
catagaaaaccagacttgctgggac

SEQ ID NO: 575644 - DNA, 25 bp, Mus musculus
catagaaaatcaaagtgtggcagca

SEQ ID NO: 575645 - DNA, 25 bp, Mus musculus
catagaaaatcatagtgtggcagca

SEQ ID NO: 575646 - DNA, 25 bp, Mus musculus
catagaaagaaaagtggtaattccg

SEQ ID NO: 575647 - DNA, 25 bp, Mus musculus
catagaaagaaatgtggtaattccg

SEQ ID NO: 575648 - DNA, 25 bp, Mus musculus
catagaaagctcacaagacacagga

SEQ ID NO: 575649 - DNA, 25 bp, Mus musculus
catagaaagctctcaagacacagga

SEQ ID NO: 575650 - DNA, 25 bp, Mus musculus
catagaaaggaaatggccttactac

SEQ ID NO: 575651 - DNA, 25 bp, Mus musculus
catagaaaggaattggccttactac

SEQ ID NO: 575652 - DNA, 25 bp, Mus musculus
catagaaagggcagtagatgatgga

SEQ ID NO: 575653 - DNA, 25 bp, Mus musculus
catagaaagggctgtagatgatgga

SEQ ID NO: 575654 - DNA, 25 bp, Mus musculus
catagaaatgtgaccatcaaaactg

SEQ ID NO: 575655 - DNA, 25 bp, Mus musculus
catagaaatgtgtccatcaaaactg

SEQ ID NO: 575656 - DNA, 25 bp, Mus musculus
catagaactaaacccaacccactgg

SEQ ID NO: 575657 - DNA, 25 bp, Mus musculus
catagaactaaagccaacccactgg

SEQ ID NO: 575658 - DNA, 25 bp, Mus musculus
catagaagatagcagtccacatgca

SEQ ID NO: 575659 - DNA, 25 bp, Mus musculus
catagaagataggagtccacatgca

SEQ ID NO: 575660 - DNA, 25 bp, Mus musculus
catagaagcaagcaagcggaataaa

SEQ ID NO: 575661 - DNA, 25 bp, Mus musculus
catagaagcaaggaagcggaataaa

SEQ ID NO: 575662 - DNA, 25 bp, Mus musculus
catagaagccggcattcttgttggg

SEQ ID NO: 575663 - DNA, 25 bp, Mus musculus
catagaagccgggattcttgttggg

SEQ ID NO: 575664 - DNA, 25 bp, Mus musculus
catagaagtgatctgtccacctggg

SEQ ID NO: 575665 - DNA, 25 bp, Mus musculus
catagaagtgatgtgtccacctggg

SEQ ID NO: 575666 - DNA, 25 bp, Mus musculus
catagaagttgcatatttaaagaca

SEQ ID NO: 575667 - DNA, 25 bp, Mus musculus
catagaagttgcttatttaaagaca

SEQ ID NO: 575668 - DNA, 25 bp, Mus musculus
catagaatacagaaagaagtgggac

SEQ ID NO: 575669 - DNA, 25 bp, Mus musculus
catagaatacagtaagaagtgggac

SEQ ID NO: 575670 - DNA, 25 bp, Mus musculus
catagaatcagtcgtgcaggaccga

SEQ ID NO: 575671 - DNA, 25 bp, Mus musculus
catagaatcagtggtgcaggaccga

SEQ ID NO: 575672 - DNA, 25 bp, Mus musculus
catagaatgacacgaatgatgcagg

SEQ ID NO: 575673 - DNA, 25 bp, Mus musculus
catagaatgacaggaatgatgcagg

SEQ ID NO: 575674 - DNA, 25 bp, Mus musculus
catagaatggacacacattgactac

SEQ ID NO: 575675 - DNA, 25 bp, Mus musculus
catagaatggactcacattgactac

SEQ ID NO: 575676 - DNA, 25 bp, Mus musculus
catagaatggctccctcaaaatgac

SEQ ID NO: 575677 - DNA, 25 bp, Mus musculus
catagaatggctgcctcaaaatgac

SEQ ID NO: 575678 - DNA, 25 bp, Mus musculus
catagaatgtacaaggaacgacaag

SEQ ID NO: 575679 - DNA, 25 bp, Mus musculus
catagaatgtactaggaacgacaag

SEQ ID NO: 575680 - DNA, 25 bp, Mus musculus
catagacaaaaaagattttgcagcc

SEQ ID NO: 575681 - DNA, 25 bp, Mus musculus
catagacaaaaatgattttgcagcc

SEQ ID NO: 575682 - DNA, 25 bp, Mus musculus
catagacaaagcagatgccattgtc

SEQ ID NO: 575683 - DNA, 25 bp, Mus musculus
catagacaaagctgatgccattgtc

SEQ ID NO: 575684 - DNA, 25 bp, Mus musculus
catagacaacaacgcactgtatgac

SEQ ID NO: 575685 - DNA, 25 bp, Mus musculus
catagacaacaaggcactgtatgac

SEQ ID NO: 575686 - DNA, 25 bp, Mus musculus
catagacaagatccagatgaatacc

SEQ ID NO: 575687 - DNA, 25 bp, Mus musculus
catagacaagatgcagatgaatacc

SEQ ID NO: 575688 - DNA, 25 bp, Mus musculus
catagacaagggattctgagcttac

SEQ ID NO: 575689 - DNA, 25 bp, Mus musculus
catagacaagggtttctgagcttac

SEQ ID NO: 575690 - DNA, 25 bp, Mus musculus
catagacagcaaacgcagggagggc

SEQ ID NO: 575691 - DNA, 25 bp, Mus musculus
catagacagcaatcgcagggagggc

SEQ ID NO: 575692 - DNA, 25 bp, Mus musculus
catagacattgtactctccatcgtg

SEQ ID NO: 575693 - DNA, 25 bp, Mus musculus
catagacattgttctctccatcgtg

SEQ ID NO: 575694 - DNA, 25 bp, Mus musculus
catagaccagcgcttggtgttccgg

SEQ ID NO: 575695 - DNA, 25 bp, Mus musculus
catagaccagcggttggtgttccgg

SEQ ID NO: 575696 - DNA, 25 bp, Mus musculus
catagacctgcgaatctttctgact

SEQ ID NO: 575697 - DNA, 25 bp, Mus musculus
catagacctgcgtatctttctgact

SEQ ID NO: 575698 - DNA, 25 bp, Mus musculus
catagacgccatctccttcttgtcg

SEQ ID NO: 575699 - DNA, 25 bp, Mus musculus
catagacgccatgtccttcttgtcg

SEQ ID NO: 575700 - DNA, 25 bp, Mus musculus
catagacggcatccagtatctgtat

SEQ ID NO: 575701 - DNA, 25 bp, Mus musculus
catagacggcatgcagtatctgtat

SEQ ID NO: 575702 - DNA, 25 bp, Mus musculus
catagactccatacaccagctggga

SEQ ID NO: 575703 - DNA, 25 bp, Mus musculus
catagactccattcaccagctggga

SEQ ID NO: 575704 - DNA, 25 bp, Mus musculus
catagactgaggctgccagtgtctc

SEQ ID NO: 575705 - DNA, 25 bp, Mus musculus
catagactgagggtgccagtgtctc

SEQ ID NO: 575706 - DNA, 25 bp, Mus musculus
catagactgccactggattgatatt

SEQ ID NO: 575707 - DNA, 25 bp, Mus musculus
catagactgccagtggattgatatt

SEQ ID NO: 575708 - DNA, 25 bp, Mus musculus
catagagacaaacttctttgacgat

SEQ ID NO: 575709 - DNA, 25 bp, Mus musculus
catagagacaaagttctttgacgat

SEQ ID NO: 575710 - DNA, 25 bp, Mus musculus
catagagaccaacatccgtgtggcc

SEQ ID NO: 575711 - DNA, 25 bp, Mus musculus
catagagaccaagatccgtgtggcc

SEQ ID NO: 575712 - DNA, 25 bp, Mus musculus
catagagaggagacaccatggatta

SEQ ID NO: 575713 - DNA, 25 bp, Mus musculus
catagagaggagtcaccatggatta

SEQ ID NO: 575714 - DNA, 25 bp, Mus musculus
catagagatgaaagagcctgttcac

SEQ ID NO: 575715 - DNA, 25 bp, Mus musculus
catagagatgaatgagcctgttcac

SEQ ID NO: 575716 - DNA, 25 bp, Mus musculus
catagagatggaacggaccctgact

SEQ ID NO: 575717 - DNA, 25 bp, Mus musculus
catagagatggatcggaccctgact

SEQ ID NO: 575718 - DNA, 25 bp, Mus musculus
catagagcaggacatggagcaagtt

SEQ ID NO: 575719 - DNA, 25 bp, Mus musculus
catagagcaggagatggagcaagtt

SEQ ID NO: 575720 - DNA, 25 bp, Mus musculus
catagagcccagagcgtctttgctt

SEQ ID NO: 575721 - DNA, 25 bp, Mus musculus
catagagcccagtgcgtctttgctt

SEQ ID NO: 575722 - DNA, 25 bp, Mus musculus
catagagcgtgcaggcttggctgcc

SEQ ID NO: 575723 - DNA, 25 bp, Mus musculus
catagagcgtgctggcttggctgcc

SEQ ID NO: 575724 - DNA, 25 bp, Mus musculus
catagagctgggacgaatcctggag

SEQ ID NO: 575725 - DNA, 25 bp, Mus musculus
catagagctgggtcgaatcctggag

SEQ ID NO: 575726 - DNA, 25 bp, Mus musculus
catagaggaattcctaaaggaggca

SEQ ID NO: 575727 - DNA, 25 bp, Mus musculus
catagaggaattgctaaaggaggca

SEQ ID NO: 575728 - DNA, 25 bp, Mus musculus
catagaggacttagagtgagggctt

SEQ ID NO: 575729 - DNA, 25 bp, Mus musculus
catagaggactttgagtgagggctt

SEQ ID NO: 575730 - DNA, 25 bp, Mus musculus
catagaggatgcagactctagagtg

SEQ ID NO: 575731 - DNA, 25 bp, Mus musculus
catagaggatgctgactctagagtg

SEQ ID NO: 575732 - DNA, 25 bp, Mus musculus
catagaggctacaatagaaacagct

SEQ ID NO: 575733 - DNA, 25 bp, Mus musculus
catagaggctactatagaaacagct

SEQ ID NO: 575734 - DNA, 25 bp, Mus musculus
catagaggctctagtacgcaccgtc

SEQ ID NO: 575735 - DNA, 25 bp, Mus musculus
catagaggctcttgtacgcaccgtc

SEQ ID NO: 575736 - DNA, 25 bp, Mus musculus
catagagttaataggaaaccgcaag

SEQ ID NO: 575737 - DNA, 25 bp, Mus musculus
catagagttaattggaaaccgcaag

SEQ ID NO: 575738 - DNA, 25 bp, Mus musculus
catagatattctaggtctcagggac

SEQ ID NO: 575739 - DNA, 25 bp, Mus musculus
catagatattcttggtctcagggac

SEQ ID NO: 575740 - DNA, 25 bp, Mus musculus
catagatattttcagaggctctgcg

SEQ ID NO: 575741 - DNA, 25 bp, Mus musculus
catagatattttgagaggctctgcg

SEQ ID NO: 575742 - DNA, 25 bp, Mus musculus
catagatcaggccaaactagatgag

SEQ ID NO: 575743 - DNA, 25 bp, Mus musculus
catagatcaggcgaaactagatgag

SEQ ID NO: 575744 - DNA, 25 bp, Mus musculus
catagatcgcatcgtgggcgacgac

SEQ ID NO: 575745 - DNA, 25 bp, Mus musculus
catagatcgcatggtgggcgacgac

SEQ ID NO: 575746 - DNA, 25 bp, Mus musculus
catagatgaactccgcaatgaggac

SEQ ID NO: 575747 - DNA, 25 bp, Mus musculus
catagatgaactgcgcaatgaggac

SEQ ID NO: 575748 - DNA, 25 bp, Mus musculus
catagatgaatgagccaatgacact

SEQ ID NO: 575749 - DNA, 25 bp, Mus musculus
catagatgaatgtgccaatgacact

SEQ ID NO: 575750 - DNA, 25 bp, Mus musculus
catagatgagctatggaatgaattc

SEQ ID NO: 575751 - DNA, 25 bp, Mus musculus
catagatgagctttggaatgaattc

SEQ ID NO: 575752 - DNA, 25 bp, Mus musculus
catagatgcgtgaggctacaacgac

SEQ ID NO: 575753 - DNA, 25 bp, Mus musculus
catagatgcgtgtggctacaacgac

SEQ ID NO: 575754 - DNA, 25 bp, Mus musculus
catagatggtgacaaaggacctcgg

SEQ ID NO: 575755 - DNA, 25 bp, Mus musculus
catagatggtgagaaaggacctcgg

SEQ ID NO: 575756 - DNA, 25 bp, Mus musculus
catagatgtctcagagattcaacag

SEQ ID NO: 575757 - DNA, 25 bp, Mus musculus
catagatgtctctgagattcaacag

SEQ ID NO: 575758 - DNA, 25 bp, Mus musculus
catagcaagttcaggcttctggcaa

SEQ ID NO: 575759 - DNA, 25 bp, Mus musculus
catagcaagttctggcttctggcaa

SEQ ID NO: 575760 - DNA, 25 bp, Mus musculus
catagcaatgaaaggagaaggttac

SEQ ID NO: 575761 - DNA, 25 bp, Mus musculus
catagcaatgaatggagaaggttac

SEQ ID NO: 575762 - DNA, 25 bp, Mus musculus
catagcaccttccatggtgaggata

SEQ ID NO: 575763 - DNA, 25 bp, Mus musculus
catagcaccttcgatggtgaggata

SEQ ID NO: 575764 - DNA, 25 bp, Mus musculus
catagcagagctcggaattctcatc

SEQ ID NO: 575765 - DNA, 25 bp, Mus musculus
catagcagagctgggaattctcatc

SEQ ID NO: 575766 - DNA, 25 bp, Mus musculus
catagcagcaatcaaggaagacgtg

SEQ ID NO: 575767 - DNA, 25 bp, Mus musculus
catagcagcaatgaaggaagacgtg

SEQ ID NO: 575768 - DNA, 25 bp, Mus musculus
catagcagggatccagcatggctgc

SEQ ID NO: 575769 - DNA, 25 bp, Mus musculus
catagcagggatgcagcatggctgc

SEQ ID NO: 575770 - DNA, 25 bp, Mus musculus
catagcaggtaaatgagaagcgaag

SEQ ID NO: 575771 - DNA, 25 bp, Mus musculus
catagcaggtaattgagaagcgaag

SEQ ID NO: 575772 - DNA, 25 bp, Mus musculus
catagcagtgccacagaacagggca

SEQ ID NO: 575773 - DNA, 25 bp, Mus musculus
catagcagtgcctcagaacagggca

SEQ ID NO: 575774 - DNA, 25 bp, Mus musculus
catagcagtgttactcgagttggaa

SEQ ID NO: 575775 - DNA, 25 bp, Mus musculus
catagcagtgtttctcgagttggaa

SEQ ID NO: 575776 - DNA, 25 bp, Mus musculus
catagcagttaccaggagagtgcct

SEQ ID NO: 575777 - DNA, 25 bp, Mus musculus
catagcagttacgaggagagtgcct

SEQ ID NO: 575778 - DNA, 25 bp, Mus musculus
catagccagataccaggttgttaac

SEQ ID NO: 575779 - DNA, 25 bp, Mus musculus
catagccagatagcaggttgttaac

SEQ ID NO: 575780 - DNA, 25 bp, Mus musculus
catagccagatgaagaagcaacacc

SEQ ID NO: 575781 - DNA, 25 bp, Mus musculus
catagccagatgtagaagcaacacc

SEQ ID NO: 575782 - DNA, 25 bp, Mus musculus
catagccagcacacactgaggcagg

SEQ ID NO: 575783 - DNA, 25 bp, Mus musculus
catagccagcactcactgaggcagg

SEQ ID NO: 575784 - DNA, 25 bp, Mus musculus
catagccagcgtaggcgatgagcct

SEQ ID NO: 575785 - DNA, 25 bp, Mus musculus
catagccagcgttggcgatgagcct

SEQ ID NO: 575786 - DNA, 25 bp, Mus musculus
catagccaggatcgttgcacatgcc

SEQ ID NO: 575787 - DNA, 25 bp, Mus musculus
catagccaggatggttgcacatgcc

SEQ ID NO: 575788 - DNA, 25 bp, Mus musculus
catagccatcgacgtggaccccagg

SEQ ID NO: 575789 - DNA, 25 bp, Mus musculus
catagccatcgaggtggaccccagg

SEQ ID NO: 575790 - DNA, 25 bp, Mus musculus
catagccatcttctgtagcatcagc

SEQ ID NO: 575791 - DNA, 25 bp, Mus musculus
catagccatcttgtgtagcatcagc

SEQ ID NO: 575792 - DNA, 25 bp, Mus musculus
catagccgtggtatcaagctagtgg

SEQ ID NO: 575793 - DNA, 25 bp, Mus musculus
catagccgtggtttcaagctagtgg

SEQ ID NO: 575794 - DNA, 25 bp, Mus musculus
catagcctagtcctgcattatggtc

SEQ ID NO: 575795 - DNA, 25 bp, Mus musculus
catagcctagtcgtgcattatggtc

SEQ ID NO: 575796 - DNA, 25 bp, Mus musculus
catagcctgctcacagaaaatgcaa

SEQ ID NO: 575797 - DNA, 25 bp, Mus musculus
catagcctgctctcagaaaatgcaa

SEQ ID NO: 575798 - DNA, 25 bp, Mus musculus
catagccttagtcaataagatgtta

SEQ ID NO: 575799 - DNA, 25 bp, Mus musculus
catagccttagtgaataagatgtta

SEQ ID NO: 575800 - DNA, 25 bp, Mus musculus
catagcgtacttaggcgtgtccgcc

SEQ ID NO: 575801 - DNA, 25 bp, Mus musculus
catagcgtactttggcgtgtccgcc

SEQ ID NO: 575802 - DNA, 25 bp, Mus musculus
catagcgtgtgccaagaagatcctg

SEQ ID NO: 575803 - DNA, 25 bp, Mus musculus
catagcgtgtgcgaagaagatcctg

SEQ ID NO: 575804 - DNA, 25 bp, Mus musculus
catagcgttagactgagcaggctcc

SEQ ID NO: 575805 - DNA, 25 bp, Mus musculus
catagcgttagagtgagcaggctcc

SEQ ID NO: 575806 - DNA, 25 bp, Mus musculus
catagctaaatgagcttatgtagac

SEQ ID NO: 575807 - DNA, 25 bp, Mus musculus
catagctaaatgtgcttatgtagac

SEQ ID NO: 575808 - DNA, 25 bp, Mus musculus
catagctctagcagaactacttgga

SEQ ID NO: 575809 - DNA, 25 bp, Mus musculus
catagctctagctgaactacttgga

SEQ ID NO: 575810 - DNA, 25 bp, Mus musculus
catagctctagtccttacggatggg

SEQ ID NO: 575811 - DNA, 25 bp, Mus musculus
catagctctagtgcttacggatggg

SEQ ID NO: 575812 - DNA, 25 bp, Mus musculus
catagctgccatcaagacgaagcgc

SEQ ID NO: 575813 - DNA, 25 bp, Mus musculus
catagctgccatgaagacgaagcgc

SEQ ID NO: 575814 - DNA, 25 bp, Mus musculus
catagctgcctaagagcaactcaca

SEQ ID NO: 575815 - DNA, 25 bp, Mus musculus
catagctgcctatgagcaactcaca

SEQ ID NO: 575816 - DNA, 25 bp, Mus musculus
catagctgctacatctgctaaagaa

SEQ ID NO: 575817 - DNA, 25 bp, Mus musculus
catagctgctacttctgctaaagaa

SEQ ID NO: 575818 - DNA, 25 bp, Mus musculus
catagctggaacacaccacagtgca

SEQ ID NO: 575819 - DNA, 25 bp, Mus musculus
catagctggaactcaccacagtgca

SEQ ID NO: 575820 - DNA, 25 bp, Mus musculus
catagctggtctatcagaacgctgt

SEQ ID NO: 575821 - DNA, 25 bp, Mus musculus
catagctggtctttcagaacgctgt

SEQ ID NO: 575822 - DNA, 25 bp, Mus musculus
catagctgtgacctataaccgcgat

SEQ ID NO: 575823 - DNA, 25 bp, Mus musculus
catagctgtgacgtataaccgcgat

SEQ ID NO: 575824 - DNA, 25 bp, Mus musculus
catagcttatcaactcttgtctgac

SEQ ID NO: 575825 - DNA, 25 bp, Mus musculus
catagcttatcatctcttgtctgac

SEQ ID NO: 575826 - DNA, 25 bp, Mus musculus
catagcttcagaagcatttgctaca

SEQ ID NO: 575827 - DNA, 25 bp, Mus musculus
catagcttcagatgcatttgctaca

SEQ ID NO: 575828 - DNA, 25 bp, Mus musculus
catagcttgctgaaacccagtacca

SEQ ID NO: 575829 - DNA, 25 bp, Mus musculus
catagcttgctgtaacccagtacca

SEQ ID NO: 575830 - DNA, 25 bp, Mus musculus
catagcttgggacccctgtcgtagt

SEQ ID NO: 575831 - DNA, 25 bp, Mus musculus
catagcttgggagccctgtcgtagt

SEQ ID NO: 575832 - DNA, 25 bp, Mus musculus
catagcttgtggagctgggccgcgt

SEQ ID NO: 575833 - DNA, 25 bp, Mus musculus
catagcttgtggtgctgggccgcgt

SEQ ID NO: 575834 - DNA, 25 bp, Mus musculus
catagctttaaccagacagcccaga

SEQ ID NO: 575835 - DNA, 25 bp, Mus musculus
catagctttaacgagacagcccaga

SEQ ID NO: 575836 - DNA, 25 bp, Mus musculus
catagcttttctcagccgccgagga

SEQ ID NO: 575837 - DNA, 25 bp, Mus musculus
catagcttttctgagccgccgagga

SEQ ID NO: 575838 - DNA, 25 bp, Mus musculus
cataggaacctcatccttggaacgc

SEQ ID NO: 575839 - DNA, 25 bp, Mus musculus
cataggaacctcttccttggaacgc

SEQ ID NO: 575840 - DNA, 25 bp, Mus musculus
cataggaagacaaccaactgcagcc

SEQ ID NO: 575841 - DNA, 25 bp, Mus musculus
cataggaagacatccaactgcagcc

SEQ ID NO: 575842 - DNA, 25 bp, Mus musculus
cataggaataggcacaggagcatct

SEQ ID NO: 575843 - DNA, 25 bp, Mus musculus
cataggaatagggacaggagcatct

SEQ ID NO: 575844 - DNA, 25 bp, Mus musculus
cataggaatggcctgtaggcctttt

SEQ ID NO: 575845 - DNA, 25 bp, Mus musculus
cataggaatggcgtgtaggcctttt

SEQ ID NO: 575846 - DNA, 25 bp, Mus musculus
cataggacctctaatactctgtaaa

SEQ ID NO: 575847 - DNA, 25 bp, Mus musculus
cataggacctcttatactctgtaaa

SEQ ID NO: 575848 - DNA, 25 bp, Mus musculus
cataggacttctagtagggatcaca

SEQ ID NO: 575849 - DNA, 25 bp, Mus musculus
cataggacttcttgtagggatcaca

SEQ ID NO: 575850 - DNA, 25 bp, Mus musculus
cataggacttgaatgtgacagagta

SEQ ID NO: 575851 - DNA, 25 bp, Mus musculus
cataggacttgattgtgacagagta

SEQ ID NO: 575852 - DNA, 25 bp, Mus musculus
cataggaggcatagctcagatcacc

SEQ ID NO: 575853 - DNA, 25 bp, Mus musculus
cataggaggcattgctcagatcacc

SEQ ID NO: 575854 - DNA, 25 bp, Mus musculus
cataggagtcttatgtaaagaggtt

SEQ ID NO: 575855 - DNA, 25 bp, Mus musculus
cataggagtcttttgtaaagaggtt

SEQ ID NO: 575856 - DNA, 25 bp, Mus musculus
cataggatacatcttcagtgggaga

SEQ ID NO: 575857 - DNA, 25 bp, Mus musculus
cataggatacatgttcagtgggaga

SEQ ID NO: 575858 - DNA, 25 bp, Mus musculus
cataggatcacaacgacaggagaag

SEQ ID NO: 575859 - DNA, 25 bp, Mus musculus
cataggatcacatcgacaggagaag

SEQ ID NO: 575860 - DNA, 25 bp, Mus musculus
cataggatgggtccacaactgtatt

SEQ ID NO: 575861 - DNA, 25 bp, Mus musculus
cataggatgggtgcacaactgtatt

SEQ ID NO: 575862 - DNA, 25 bp, Mus musculus
cataggatggttcgaatgtaaaggc

SEQ ID NO: 575863 - DNA, 25 bp, Mus musculus
cataggatggttggaatgtaaaggc

SEQ ID NO: 575864 - DNA, 25 bp, Mus musculus
cataggatttataagtggttggaag

SEQ ID NO: 575865 - DNA, 25 bp, Mus musculus
cataggatttattagtggttggaag

SEQ ID NO: 575866 - DNA, 25 bp, Mus musculus
cataggcacagaacgatcacagcgc

SEQ ID NO: 575867 - DNA, 25 bp, Mus musculus
cataggcacagatcgatcacagcgc

SEQ ID NO: 575868 - DNA, 25 bp, Mus musculus
cataggcaccgtattgcgtgagacg

SEQ ID NO: 575869 - DNA, 25 bp, Mus musculus
cataggcaccgttttgcgtgagacg

SEQ ID NO: 575870 - DNA, 25 bp, Mus musculus
cataggcacctgagtgcgtgtgacg

SEQ ID NO: 575871 - DNA, 25 bp, Mus musculus
cataggcacctgtgtgcgtgtgacg

SEQ ID NO: 575872 - DNA, 25 bp, Mus musculus
cataggcatagaaccagattttccc

SEQ ID NO: 575873 - DNA, 25 bp, Mus musculus
cataggcatagatccagattttccc

SEQ ID NO: 575874 - DNA, 25 bp, Mus musculus
cataggcatgcaatgaatgaacttg

SEQ ID NO: 575875 - DNA, 25 bp, Mus musculus
cataggcatgcattgaatgaacttg

SEQ ID NO: 575876 - DNA, 25 bp, Mus musculus
cataggccagtacacatcagaaggg

SEQ ID NO: 575877 - DNA, 25 bp, Mus musculus
cataggccagtagacatcagaaggg

SEQ ID NO: 575878 - DNA, 25 bp, Mus musculus
cataggccctttcgagaacggtgct

SEQ ID NO: 575879 - DNA, 25 bp, Mus musculus
cataggccctttggagaacggtgct

SEQ ID NO: 575880 - DNA, 25 bp, Mus musculus
cataggcgaatcagcatgggtaccc

SEQ ID NO: 575881 - DNA, 25 bp, Mus musculus
cataggcgaatctgcatgggtaccc

SEQ ID NO: 575882 - DNA, 25 bp, Mus musculus
cataggcgtccaacttggaacatac

SEQ ID NO: 575883 - DNA, 25 bp, Mus musculus
cataggcgtccatcttggaacatac

SEQ ID NO: 575884 - DNA, 25 bp, Mus musculus
cataggctacatagagaagttgcag

SEQ ID NO: 575885 - DNA, 25 bp, Mus musculus
cataggctacattgagaagttgcag

SEQ ID NO: 575886 - DNA, 25 bp, Mus musculus
cataggctagaaaagaatgtgtctg

SEQ ID NO: 575887 - DNA, 25 bp, Mus musculus
cataggctagaatagaatgtgtctg

SEQ ID NO: 575888 - DNA, 25 bp, Mus musculus
cataggctgatcagttcagcctgtc

SEQ ID NO: 575889 - DNA, 25 bp, Mus musculus
cataggctgatctgttcagcctgtc

SEQ ID NO: 575890 - DNA, 25 bp, Mus musculus
cataggcttttgaggcataaactga

SEQ ID NO: 575891 - DNA, 25 bp, Mus musculus
cataggcttttgtggcataaactga

SEQ ID NO: 575892 - DNA, 25 bp, Mus musculus
catagggaatacctgtcaccttctc

SEQ ID NO: 575893 - DNA, 25 bp, Mus musculus
catagggaatacgtgtcaccttctc

SEQ ID NO: 575894 - DNA, 25 bp, Mus musculus
catagggctgtcatgctatttcaca

SEQ ID NO: 575895 - DNA, 25 bp, Mus musculus
catagggctgtcttgctatttcaca

SEQ ID NO: 575896 - DNA, 25 bp, Mus musculus
catagggtgtgcaccagaacctggg

SEQ ID NO: 575897 - DNA, 25 bp, Mus musculus
catagggtgtgctccagaacctggg

SEQ ID NO: 575898 - DNA, 25 bp, Mus musculus
catagggttagcattgttggtcgcc

SEQ ID NO: 575899 - DNA, 25 bp, Mus musculus
catagggttagctttgttggtcgcc

SEQ ID NO: 575900 - DNA, 25 bp, Mus musculus
cataggtagtatacaaagaagtgat

SEQ ID NO: 575901 - DNA, 25 bp, Mus musculus
cataggtagtattcaaagaagtgat

SEQ ID NO: 575902 - DNA, 25 bp, Mus musculus
cataggtatcccatccctgaccaag

SEQ ID NO: 575903 - DNA, 25 bp, Mus musculus
cataggtatcccttccctgaccaag

SEQ ID NO: 575904 - DNA, 25 bp, Mus musculus
cataggtcggtgcaagagtgcttac

SEQ ID NO: 575905 - DNA, 25 bp, Mus musculus
cataggtcggtggaagagtgcttac

SEQ ID NO: 575906 - DNA, 25 bp, Mus musculus
cataggtgagctccagttggtgtta

SEQ ID NO: 575907 - DNA, 25 bp, Mus musculus
cataggtgagctgcagttggtgtta

SEQ ID NO: 575908 - DNA, 25 bp, Mus musculus
cataggtggacacccgaactgtaac

SEQ ID NO: 575909 - DNA, 25 bp, Mus musculus
cataggtggacagccgaactgtaac

SEQ ID NO: 575910 - DNA, 25 bp, Mus musculus
cataggttcccgactgttgccctta

SEQ ID NO: 575911 - DNA, 25 bp, Mus musculus
cataggttcccgtctgttgccctta

SEQ ID NO: 575912 - DNA, 25 bp, Mus musculus
catagtaactatagggcagctttgg

SEQ ID NO: 575913 - DNA, 25 bp, Mus musculus
catagtaactattgggcagctttgg

SEQ ID NO: 575914 - DNA, 25 bp, Mus musculus
catagtaattggaatcctggagctg

SEQ ID NO: 575915 - DNA, 25 bp, Mus musculus
catagtaattggtatcctggagctg

SEQ ID NO: 575916 - DNA, 25 bp, Mus musculus
catagtacagatatgttagaaatag

SEQ ID NO: 575917 - DNA, 25 bp, Mus musculus
catagtacagatttgttagaaatag

SEQ ID NO: 575918 - DNA, 25 bp, Mus musculus
catagtaccagaccatcggcatagg

SEQ ID NO: 575919 - DNA, 25 bp, Mus musculus
catagtaccagagcatcggcatagg

SEQ ID NO: 575920 - DNA, 25 bp, Mus musculus
catagtagaaatccagttagcagtc

SEQ ID NO: 575921 - DNA, 25 bp, Mus musculus
catagtagaaatgcagttagcagtc

SEQ ID NO: 575922 - DNA, 25 bp, Mus musculus
catagtagcagtccagaaagcaaaa

SEQ ID NO: 575923 - DNA, 25 bp, Mus musculus
catagtagcagtgcagaaagcaaaa

SEQ ID NO: 575924 - DNA, 25 bp, Mus musculus
catagtagccatctgtctgcagcga

SEQ ID NO: 575925 - DNA, 25 bp, Mus musculus
catagtagccatgtgtctgcagcga

SEQ ID NO: 575926 - DNA, 25 bp, Mus musculus
catagtagctggaactgcaggcgca

SEQ ID NO: 575927 - DNA, 25 bp, Mus musculus
catagtagctggtactgcaggcgca

SEQ ID NO: 575928 - DNA, 25 bp, Mus musculus
catagtcaccgcagatgatggacgg

SEQ ID NO: 575929 - DNA, 25 bp, Mus musculus
catagtcaccgctgatgatggacgg

SEQ ID NO: 575930 - DNA, 25 bp, Mus musculus
catagtcagaatcagccaaggcttt

SEQ ID NO: 575931 - DNA, 25 bp, Mus musculus
catagtcagaatgagccaaggcttt

SEQ ID NO: 575932 - DNA, 25 bp, Mus musculus
catagtcagcaccaagactggttta

SEQ ID NO: 575933 - DNA, 25 bp, Mus musculus
catagtcagcacgaagactggttta

SEQ ID NO: 575934 - DNA, 25 bp, Mus musculus
catagtcagcatccttttgcagaag

SEQ ID NO: 575935 - DNA, 25 bp, Mus musculus
catagtcagcatgcttttgcagaag

SEQ ID NO: 575936 - DNA, 25 bp, Mus musculus
catagtccaggacaagttcacgggc

SEQ ID NO: 575937 - DNA, 25 bp, Mus musculus
catagtccaggagaagttcacgggc

SEQ ID NO: 575938 - DNA, 25 bp, Mus musculus
catagtctcgtcattcctctacagg

SEQ ID NO: 575939 - DNA, 25 bp, Mus musculus
catagtctcgtctttcctctacagg

SEQ ID NO: 575940 - DNA, 25 bp, Mus musculus
catagtgaaatacaacggcggcgac

SEQ ID NO: 575941 - DNA, 25 bp, Mus musculus
catagtgaaatagaacggcggcgac

SEQ ID NO: 575942 - DNA, 25 bp, Mus musculus
catagtgaagatacccacgtgcgtt

SEQ ID NO: 575943 - DNA, 25 bp, Mus musculus
catagtgaagattcccacgtgcgtt

SEQ ID NO: 575944 - DNA, 25 bp, Mus musculus
catagtgacggacttcatggagaac

SEQ ID NO: 575945 - DNA, 25 bp, Mus musculus
catagtgacggagttcatggagaac

SEQ ID NO: 575946 - DNA, 25 bp, Mus musculus
catagtgactatcacattgaggcgg

SEQ ID NO: 575947 - DNA, 25 bp, Mus musculus
catagtgactatgacattgaggcgg

SEQ ID NO: 575948 - DNA, 25 bp, Mus musculus
catagtgagcttcagctggcctgga

SEQ ID NO: 575949 - DNA, 25 bp, Mus musculus
catagtgagcttgagctggcctgga

SEQ ID NO: 575950 - DNA, 25 bp, Mus musculus
catagtgccaaacaggtcagattta

SEQ ID NO: 575951 - DNA, 25 bp, Mus musculus
catagtgccaaagaggtcagattta

SEQ ID NO: 575952 - DNA, 25 bp, Mus musculus
catagtgcccacagtagcttctaca

SEQ ID NO: 575953 - DNA, 25 bp, Mus musculus
catagtgcccactgtagcttctaca

SEQ ID NO: 575954 - DNA, 25 bp, Mus musculus
catagtgcgctacatccaaggcagc

SEQ ID NO: 575955 - DNA, 25 bp, Mus musculus
catagtgcgctaccgtaggtcgcga

SEQ ID NO: 575956 - DNA, 25 bp, Mus musculus
catagtgcgctagatccaaggcagc

SEQ ID NO: 575957 - DNA, 25 bp, Mus musculus
catagtgcgctagcgtaggtcgcga

SEQ ID NO: 575958 - DNA, 25 bp, Mus musculus
catagtggagagaagtcccctgagt

SEQ ID NO: 575959 - DNA, 25 bp, Mus musculus
catagtggagagtagtcccctgagt

SEQ ID NO: 575960 - DNA, 25 bp, Mus musculus
catagtggatggaaatcataaactc

SEQ ID NO: 575961 - DNA, 25 bp, Mus musculus
catagtggatggtaatcataaactc

SEQ ID NO: 575962 - DNA, 25 bp, Mus musculus
catagtggtgttcatcttcctagcc

SEQ ID NO: 575963 - DNA, 25 bp, Mus musculus
catagtggtgttgatcttcctagcc

SEQ ID NO: 575964 - DNA, 25 bp, Mus musculus
catagtgtcgacagtgattccttgt

SEQ ID NO: 575965 - DNA, 25 bp, Mus musculus
catagtgtcgactgtgattccttgt

SEQ ID NO: 575966 - DNA, 25 bp, Mus musculus
catagtgtctacagggaaaggccca

SEQ ID NO: 575967 - DNA, 25 bp, Mus musculus
catagtgtctactgggaaaggccca

SEQ ID NO: 575968 - DNA, 25 bp, Mus musculus
catagtgttgcacatagaccccaat

SEQ ID NO: 575969 - DNA, 25 bp, Mus musculus
catagtgttgcagatagaccccaat

SEQ ID NO: 575970 - DNA, 25 bp, Mus musculus
catagttactataacatctgagtac

SEQ ID NO: 575971 - DNA, 25 bp, Mus musculus
catagttactattacatctgagtac

SEQ ID NO: 575972 - DNA, 25 bp, Mus musculus
catagttactgtattatttcaggag

SEQ ID NO: 575973 - DNA, 25 bp, Mus musculus
catagttactgttttatttcaggag

SEQ ID NO: 575974 - DNA, 25 bp, Mus musculus
catagttatcagagcctcacgcctg

SEQ ID NO: 575975 - DNA, 25 bp, Mus musculus
catagttatcagtgcctcacgcctg

SEQ ID NO: 575976 - DNA, 25 bp, Mus musculus
catagttcgagaaggcaggctctat

SEQ ID NO: 575977 - DNA, 25 bp, Mus musculus
catagttcgagatggcaggctctat

SEQ ID NO: 575978 - DNA, 25 bp, Mus musculus
catagttcggtgacttgtggcagct

SEQ ID NO: 575979 - DNA, 25 bp, Mus musculus
catagttcggtgtcttgtggcagct

SEQ ID NO: 575980 - DNA, 25 bp, Mus musculus
catagttctgaaacattcaaaagtc

SEQ ID NO: 575981 - DNA, 25 bp, Mus musculus
catagttctgaatcattcaaaagtc

SEQ ID NO: 575982 - DNA, 25 bp, Mus musculus
catagttctgtcaatctagatgagt

SEQ ID NO: 575983 - DNA, 25 bp, Mus musculus
catagttctgtctatctagatgagt

SEQ ID NO: 575984 - DNA, 25 bp, Mus musculus
catagttgatctccttgtatgaata

SEQ ID NO: 575985 - DNA, 25 bp, Mus musculus
catagttgatctgcttgtatgaata

SEQ ID NO: 575986 - DNA, 25 bp, Mus musculus
catagttgattcagacgaagaaggc

SEQ ID NO: 575987 - DNA, 25 bp, Mus musculus
catagttgattctgacgaagaaggc

SEQ ID NO: 575988 - DNA, 25 bp, Mus musculus
catagttgccctccaagttatgcag

SEQ ID NO: 575989 - DNA, 25 bp, Mus musculus
catagttgccctgcaagttatgcag

SEQ ID NO: 575990 - DNA, 25 bp, Mus musculus
catagttgcggaacctcacctgcaa

SEQ ID NO: 575991 - DNA, 25 bp, Mus musculus
catagttgcggatcctcacctgcaa

SEQ ID NO: 575992 - DNA, 25 bp, Mus musculus
catagttggcgtcttgttagccatt

SEQ ID NO: 575993 - DNA, 25 bp, Mus musculus
catagttggcgtgttgttagccatt

SEQ ID NO: 575994 - DNA, 25 bp, Mus musculus
catagttttaatccacttgagagtc

SEQ ID NO: 575995 - DNA, 25 bp, Mus musculus
catagttttaatgcacttgagagtc

SEQ ID NO: 575996 - DNA, 25 bp, Mus musculus
catagttttacacacagctccaggc

SEQ ID NO: 575997 - DNA, 25 bp, Mus musculus
catagttttacagacagctccaggc

SEQ ID NO: 575998 - DNA, 25 bp, Mus musculus
catataaacagtcaagtctccattg

SEQ ID NO: 575999 - DNA, 25 bp, Mus musculus
catataaacagtgaagtctccattg

SEQ ID NO: 576000 - DNA, 25 bp, Mus musculus
catataaactagaagtggtgggaga

SEQ ID NO: 576001 - DNA, 25 bp, Mus musculus
catataaactagtagtggtgggaga

SEQ ID NO: 576002 - DNA, 25 bp, Mus musculus
catataacaaatcgtttgcaggagc

SEQ ID NO: 576003 - DNA, 25 bp, Mus musculus
catataacaaatggtttgcaggagc

SEQ ID NO: 576004 - DNA, 25 bp, Mus musculus
catataacccttcaacactagagaa

SEQ ID NO: 576005 - DNA, 25 bp, Mus musculus
catataacccttgaacactagagaa

SEQ ID NO: 576006 - DNA, 25 bp, Mus musculus
catataaggaatacagcactcgtgt

SEQ ID NO: 576007 - DNA, 25 bp, Mus musculus
catataaggaattcagcactcgtgt

SEQ ID NO: 576008 - DNA, 25 bp, Mus musculus
catataatgcccagaggtgagctgt

SEQ ID NO: 576009 - DNA, 25 bp, Mus musculus
catataatgccctgaggtgagctgt

SEQ ID NO: 576010 - DNA, 25 bp, Mus musculus
catataattcaaagcctggtcacca

SEQ ID NO: 576011 - DNA, 25 bp, Mus musculus
catataattcaatgcctggtcacca

SEQ ID NO: 576012 - DNA, 25 bp, Mus musculus
catatacagagtcatgtacagttgc

SEQ ID NO: 576013 - DNA, 25 bp, Mus musculus
catatacagagtgatgtacagttgc

SEQ ID NO: 576014 - DNA, 25 bp, Mus musculus
catatacccattctggccaccttgg

SEQ ID NO: 576015 - DNA, 25 bp, Mus musculus
catatacccattgtggccaccttgg

SEQ ID NO: 576016 - DNA, 25 bp, Mus musculus
catatactatagagccttagagaag

SEQ ID NO: 576017 - DNA, 25 bp, Mus musculus
catatactatagtgccttagagaag

SEQ ID NO: 576018 - DNA, 25 bp, Mus musculus
catatactgatcactgcacaaatcc

SEQ ID NO: 576019 - DNA, 25 bp, Mus musculus
catatactgatctctgcacaaatcc

SEQ ID NO: 576020 - DNA, 25 bp, Mus musculus
catatactgtttctgcaatggtgag

SEQ ID NO: 576021 - DNA, 25 bp, Mus musculus
catatactgtttgtgcaatggtgag

SEQ ID NO: 576022 - DNA, 25 bp, Mus musculus
catatagaccagcacctgaggacat

SEQ ID NO: 576023 - DNA, 25 bp, Mus musculus
catatagaccaggacctgaggacat

SEQ ID NO: 576024 - DNA, 25 bp, Mus musculus
catatagatgagaagaactttgtgg

SEQ ID NO: 576025 - DNA, 25 bp, Mus musculus
catatagatgagtagaactttgtgg

SEQ ID NO: 576026 - DNA, 25 bp, Mus musculus
catataggctggaacaggctgagac

SEQ ID NO: 576027 - DNA, 25 bp, Mus musculus
catataggctggtacaggctgagac

SEQ ID NO: 576028 - DNA, 25 bp, Mus musculus
catatagggcggatgtcagagacta

SEQ ID NO: 576029 - DNA, 25 bp, Mus musculus
catatagggcggttgtcagagacta

SEQ ID NO: 576030 - DNA, 25 bp, Mus musculus
catatataaggcctttccacccctg

SEQ ID NO: 576031 - DNA, 25 bp, Mus musculus
catatataaggcgtttccacccctg

SEQ ID NO: 576032 - DNA, 25 bp, Mus musculus
catatatactgaaagcagtttgccc

SEQ ID NO: 576033 - DNA, 25 bp, Mus musculus
catatatactgatagcagtttgccc

SEQ ID NO: 576034 - DNA, 25 bp, Mus musculus
catatatgtggaacgcctctcaagg

SEQ ID NO: 576035 - DNA, 25 bp, Mus musculus
catatatgtggatcgcctctcaagg

SEQ ID NO: 576036 - DNA, 25 bp, Mus musculus
catatattattactgctgctcctcc

SEQ ID NO: 576037 - DNA, 25 bp, Mus musculus
catatattattagtgctgctcctcc

SEQ ID NO: 576038 - DNA, 25 bp, Mus musculus
catatcaagcgacagctcaggtttc

SEQ ID NO: 576039 - DNA, 25 bp, Mus musculus
catatcaagcgagagctcaggtttc

SEQ ID NO: 576040 - DNA, 25 bp, Mus musculus
catatcagcatgataccaaggtgga

SEQ ID NO: 576041 - DNA, 25 bp, Mus musculus
catatcagcatgttaccaaggtgga

SEQ ID NO: 576042 - DNA, 25 bp, Mus musculus
catatcagtgtgcaggaatcagtgg

SEQ ID NO: 576043 - DNA, 25 bp, Mus musculus
catatcagtgtggaggaatcagtgg

SEQ ID NO: 576044 - DNA, 25 bp, Mus musculus
catatcatgatgagaccagactgaa

SEQ ID NO: 576045 - DNA, 25 bp, Mus musculus
catatcatgatgtgaccagactgaa

SEQ ID NO: 576046 - DNA, 25 bp, Mus musculus
catatccaaattcctgcagttccag

SEQ ID NO: 576047 - DNA, 25 bp, Mus musculus
catatccaaattgctgcagttccag

SEQ ID NO: 576048 - DNA, 25 bp, Mus musculus
catatccagacccattgtgaagtca

SEQ ID NO: 576049 - DNA, 25 bp, Mus musculus
catatccagaccgattgtgaagtca

SEQ ID NO: 576050 - DNA, 25 bp, Mus musculus
catatccagaggctgctgtggcctc

SEQ ID NO: 576051 - DNA, 25 bp, Mus musculus
catatccagagggtgctgtggcctc

SEQ ID NO: 576052 - DNA, 25 bp, Mus musculus
catatccagtggagcaaaccaggta

SEQ ID NO: 576053 - DNA, 25 bp, Mus musculus
catatccagtggtgcaaaccaggta

SEQ ID NO: 576054 - DNA, 25 bp, Mus musculus
catatccatgcaacccttgtataaa

SEQ ID NO: 576055 - DNA, 25 bp, Mus musculus
catatccatgcatcccttgtataaa

SEQ ID NO: 576056 - DNA, 25 bp, Mus musculus
catatcccacaaactcaagatgctc

SEQ ID NO: 576057 - DNA, 25 bp, Mus musculus
catatcccacaatctcaagatgctc

SEQ ID NO: 576058 - DNA, 25 bp, Mus musculus
catatcccactactgctccggaaat

SEQ ID NO: 576059 - DNA, 25 bp, Mus musculus
catatcccactagtgctccggaaat

SEQ ID NO: 576060 - DNA, 25 bp, Mus musculus
catatccctcacctctgggctatgg

SEQ ID NO: 576061 - DNA, 25 bp, Mus musculus
catatccctcacgtctgggctatgg

SEQ ID NO: 576062 - DNA, 25 bp, Mus musculus
catatcctaggaccccagaggaacg

SEQ ID NO: 576063 - DNA, 25 bp, Mus musculus
catatcctaggagcccagaggaacg

SEQ ID NO: 576064 - DNA, 25 bp, Mus musculus
catatcctatgtaggctgagaagag

SEQ ID NO: 576065 - DNA, 25 bp, Mus musculus
catatcctatgttggctgagaagag

SEQ ID NO: 576066 - DNA, 25 bp, Mus musculus
catatccttccacgtgatgctcctg

SEQ ID NO: 576067 - DNA, 25 bp, Mus musculus
catatccttccaggtgatgctcctg

SEQ ID NO: 576068 - DNA, 25 bp, Mus musculus
catatcgactacaacaagaaaacca

SEQ ID NO: 576069 - DNA, 25 bp, Mus musculus
catatcgactactacaagaaaacca

SEQ ID NO: 576070 - DNA, 25 bp, Mus musculus
catatctacccgcaccggaggctgg

SEQ ID NO: 576071 - DNA, 25 bp, Mus musculus
catatctacccggaccggaggctgg

SEQ ID NO: 576072 - DNA, 25 bp, Mus musculus
catatctcactcctagctggtgcag

SEQ ID NO: 576073 - DNA, 25 bp, Mus musculus
catatctcactcgtagctggtgcag

SEQ ID NO: 576074 - DNA, 25 bp, Mus musculus
catatctcatccaacagcgactgga

SEQ ID NO: 576075 - DNA, 25 bp, Mus musculus
catatctcatcctacagcgactgga

SEQ ID NO: 576076 - DNA, 25 bp, Mus musculus
catatctctttcctattcaagttaa

SEQ ID NO: 576077 - DNA, 25 bp, Mus musculus
catatctctttcgtattcaagttaa

SEQ ID NO: 576078 - DNA, 25 bp, Mus musculus
catatctggaggaagctgctccggc

SEQ ID NO: 576079 - DNA, 25 bp, Mus musculus
catatctggaggtagctgctccggc

SEQ ID NO: 576080 - DNA, 25 bp, Mus musculus
catatctggattctgatgtcctgga

SEQ ID NO: 576081 - DNA, 25 bp, Mus musculus
catatctggattgtgatgtcctgga

SEQ ID NO: 576082 - DNA, 25 bp, Mus musculus
catatctgggtaagcatcaaagaat

SEQ ID NO: 576083 - DNA, 25 bp, Mus musculus
catatctgggtatgcatcaaagaat

SEQ ID NO: 576084 - DNA, 25 bp, Mus musculus
catatctgttaacgttgaaaagctt

SEQ ID NO: 576085 - DNA, 25 bp, Mus musculus
catatctgttaaggttgaaaagctt

SEQ ID NO: 576086 - DNA, 25 bp, Mus musculus
catatcttactgacggagcagcggt

SEQ ID NO: 576087 - DNA, 25 bp, Mus musculus
catatcttactgtcggagcagcggt

SEQ ID NO: 576088 - DNA, 25 bp, Mus musculus
catatcttgctgagtgggtttgagg

SEQ ID NO: 576089 - DNA, 25 bp, Mus musculus
catatcttgctgtgtgggtttgagg

SEQ ID NO: 576090 - DNA, 25 bp, Mus musculus
catatgaaaatgaagagcgatggct

SEQ ID NO: 576091 - DNA, 25 bp, Mus musculus
catatgaaaatgtagagcgatggct

SEQ ID NO: 576092 - DNA, 25 bp, Mus musculus
catatgaagaagactggagattact

SEQ ID NO: 576093 - DNA, 25 bp, Mus musculus
catatgaagaagtctggagattact

SEQ ID NO: 576094 - DNA, 25 bp, Mus musculus
catatgaccgttctatcactgtgga

SEQ ID NO: 576095 - DNA, 25 bp, Mus musculus
catatgaccgttgtatcactgtgga

SEQ ID NO: 576096 - DNA, 25 bp, Mus musculus
catatgactattccacgtcacaaca

SEQ ID NO: 576097 - DNA, 25 bp, Mus musculus
catatgactattgcacgtcacaaca

SEQ ID NO: 576098 - DNA, 25 bp, Mus musculus
catatgagccttcagatggttcggg

SEQ ID NO: 576099 - DNA, 25 bp, Mus musculus
catatgagccttgagatggttcggg

SEQ ID NO: 576100 - DNA, 25 bp, Mus musculus
catatgagcgcaccctgatgatgga

SEQ ID NO: 576101 - DNA, 25 bp, Mus musculus
catatgagcgcagcctgatgatgga

SEQ ID NO: 576102 - DNA, 25 bp, Mus musculus
catatgagctggcattacaaactgg

SEQ ID NO: 576103 - DNA, 25 bp, Mus musculus
catatgagctgggattacaaactgg

SEQ ID NO: 576104 - DNA, 25 bp, Mus musculus
catatgagtgtacgtgcattggaga

SEQ ID NO: 576105 - DNA, 25 bp, Mus musculus
catatgagtgtaggtgcattggaga

SEQ ID NO: 576106 - DNA, 25 bp, Mus musculus
catatgatacacagaagatcaatct

SEQ ID NO: 576107 - DNA, 25 bp, Mus musculus
catatgatacactgaagatcaatct

SEQ ID NO: 576108 - DNA, 25 bp, Mus musculus
catatgatattgagcagttgcccac

SEQ ID NO: 576109 - DNA, 25 bp, Mus musculus
catatgatattgtgcagttgcccac

SEQ ID NO: 576110 - DNA, 25 bp, Mus musculus
catatgatgaggatgtgagtcagtc

SEQ ID NO: 576111 - DNA, 25 bp, Mus musculus
catatgatgaggttgtgagtcagtc

SEQ ID NO: 576112 - DNA, 25 bp, Mus musculus
catatgattgaacatgcacagaaag

SEQ ID NO: 576113 - DNA, 25 bp, Mus musculus
catatgattgaagatgcacagaaag

SEQ ID NO: 576114 - DNA, 25 bp, Mus musculus
catatgcagaggcaatgaaccgagc

SEQ ID NO: 576115 - DNA, 25 bp, Mus musculus
catatgcagagggaatgaaccgagc

SEQ ID NO: 576116 - DNA, 25 bp, Mus musculus
catatgcagtgtagctggaggccct

SEQ ID NO: 576117 - DNA, 25 bp, Mus musculus
catatgcagtgttgctggaggccct

SEQ ID NO: 576118 - DNA, 25 bp, Mus musculus
catatgcatttgctccggccacatt

SEQ ID NO: 576119 - DNA, 25 bp, Mus musculus
catatgcatttggtccggccacatt

SEQ ID NO: 576120 - DNA, 25 bp, Mus musculus
catatgccccagagtgatatagctg

SEQ ID NO: 576121 - DNA, 25 bp, Mus musculus
catatgccccagtgtgatatagctg

SEQ ID NO: 576122 - DNA, 25 bp, Mus musculus
catatgcggtagacagacacagcct

SEQ ID NO: 576123 - DNA, 25 bp, Mus musculus
catatgcggtagtcagacacagcct

SEQ ID NO: 576124 - DNA, 25 bp, Mus musculus
catatgcgtcctcttaatatcttac

SEQ ID NO: 576125 - DNA, 25 bp, Mus musculus
catatgcgtcctgttaatatcttac

SEQ ID NO: 576126 - DNA, 25 bp, Mus musculus
catatgctactgaggacagccgtgc

SEQ ID NO: 576127 - DNA, 25 bp, Mus musculus
catatgctactgtggacagccgtgc

SEQ ID NO: 576128 - DNA, 25 bp, Mus musculus
catatgctcacgaaagaaggtctgg

SEQ ID NO: 576129 - DNA, 25 bp, Mus musculus
catatgctcacgtaagaaggtctgg

SEQ ID NO: 576130 - DNA, 25 bp, Mus musculus
catatggaaagcagtgctcttgtac

SEQ ID NO: 576131 - DNA, 25 bp, Mus musculus
catatggaaagctgtgctcttgtac

SEQ ID NO: 576132 - DNA, 25 bp, Mus musculus
catatggaagaacaagtgcctggtt

SEQ ID NO: 576133 - DNA, 25 bp, Mus musculus
catatggaagaagaagtgcctggtt

SEQ ID NO: 576134 - DNA, 25 bp, Mus musculus
catatggccccacgagatcctggca

SEQ ID NO: 576135 - DNA, 25 bp, Mus musculus
catatggccccaggagatcctggca

SEQ ID NO: 576136 - DNA, 25 bp, Mus musculus
catatggcctagcttttggtctaca

SEQ ID NO: 576137 - DNA, 25 bp, Mus musculus
catatggcctaggttttggtctaca

SEQ ID NO: 576138 - DNA, 25 bp, Mus musculus
catatgggatttacaacatgtgggt

SEQ ID NO: 576139 - DNA, 25 bp, Mus musculus
catatgggattttcaacatgtgggt

SEQ ID NO: 576140 - DNA, 25 bp, Mus musculus
catatgggccctcgcttcggtggtt

SEQ ID NO: 576141 - DNA, 25 bp, Mus musculus
catatgggccctggcttcggtggtt

SEQ ID NO: 576142 - DNA, 25 bp, Mus musculus
catatgggctttctcttccgtttcc

SEQ ID NO: 576143 - DNA, 25 bp, Mus musculus
catatgggctttgtcttccgtttcc

SEQ ID NO: 576144 - DNA, 25 bp, Mus musculus
catatggtcaagagtggcaccaccc

SEQ ID NO: 576145 - DNA, 25 bp, Mus musculus
catatggtcaagtgtggcaccaccc

SEQ ID NO: 576146 - DNA, 25 bp, Mus musculus
catatggtcagtagcctgggagaca

SEQ ID NO: 576147 - DNA, 25 bp, Mus musculus
catatggtcagttgcctgggagaca

SEQ ID NO: 576148 - DNA, 25 bp, Mus musculus
catatggtctgccaccatgaagcct

SEQ ID NO: 576149 - DNA, 25 bp, Mus musculus
catatggtctgcgaccatgaagcct

SEQ ID NO: 576150 - DNA, 25 bp, Mus musculus
catatggtggtcatactctgagtcc

SEQ ID NO: 576151 - DNA, 25 bp, Mus musculus
catatggtggtcttactctgagtcc

SEQ ID NO: 576152 - DNA, 25 bp, Mus musculus
catatgtagtgaatggagatggacg

SEQ ID NO: 576153 - DNA, 25 bp, Mus musculus
catatgtagtgattggagatggacg

SEQ ID NO: 576154 - DNA, 25 bp, Mus musculus
catatgtctacgaaaagagcccctc

SEQ ID NO: 576155 - DNA, 25 bp, Mus musculus
catatgtctacgtaaagagcccctc

SEQ ID NO: 576156 - DNA, 25 bp, Mus musculus
catatgtgaaggcatggcgtacctg

SEQ ID NO: 576157 - DNA, 25 bp, Mus musculus
catatgtgaagggatggcgtacctg

SEQ ID NO: 576158 - DNA, 25 bp, Mus musculus
catatgtgaccaagattcgggtctc

SEQ ID NO: 576159 - DNA, 25 bp, Mus musculus
catatgtgaccatgattcgggtctc

SEQ ID NO: 576160 - DNA, 25 bp, Mus musculus
catatgtgattacctctttcctgac

SEQ ID NO: 576161 - DNA, 25 bp, Mus musculus
catatgtgattagctctttcctgac

SEQ ID NO: 576162 - DNA, 25 bp, Mus musculus
catatgtggtgaagctgagcgctgc

SEQ ID NO: 576163 - DNA, 25 bp, Mus musculus
catatgtggtgatgctgagcgctgc

SEQ ID NO: 576164 - DNA, 25 bp, Mus musculus
catatgtgtggccaatttttgttag

SEQ ID NO: 576165 - DNA, 25 bp, Mus musculus
catatgtgtggcgaatttttgttag

SEQ ID NO: 576166 - DNA, 25 bp, Mus musculus
catatgtttatgatctgactgtcac

SEQ ID NO: 576167 - DNA, 25 bp, Mus musculus
catatgtttatgttctgactgtcac

SEQ ID NO: 576168 - DNA, 25 bp, Mus musculus
catatgtttgatcgaaggtttatcc

SEQ ID NO: 576169 - DNA, 25 bp, Mus musculus
catatgtttgatggaaggtttatcc

SEQ ID NO: 576170 - DNA, 25 bp, Mus musculus
catattaatgaaaggcacagctgct

SEQ ID NO: 576171 - DNA, 25 bp, Mus musculus
catattaatgaatggcacagctgct

SEQ ID NO: 576172 - DNA, 25 bp, Mus musculus
catattacacgcctaaccagttagc

SEQ ID NO: 576173 - DNA, 25 bp, Mus musculus
catattacacgcgtaaccagttagc

SEQ ID NO: 576174 - DNA, 25 bp, Mus musculus
catattacggctccttcgttacccg

SEQ ID NO: 576175 - DNA, 25 bp, Mus musculus
catattacggctgcttcgttacccg

SEQ ID NO: 576176 - DNA, 25 bp, Mus musculus
catattagtggcatcgaggttctca

SEQ ID NO: 576177 - DNA, 25 bp, Mus musculus
catattagtggcttcgaggttctca

SEQ ID NO: 576178 - DNA, 25 bp, Mus musculus
catattataccaaggccttcattgc

SEQ ID NO: 576179 - DNA, 25 bp, Mus musculus
catattataccatggccttcattgc

SEQ ID NO: 576180 - DNA, 25 bp, Mus musculus
catattatgcatcggattgcacagc

SEQ ID NO: 576181 - DNA, 25 bp, Mus musculus
catattatgcatgggattgcacagc

SEQ ID NO: 576182 - DNA, 25 bp, Mus musculus
catattcaatgactatgcggccacc

SEQ ID NO: 576183 - DNA, 25 bp, Mus musculus
catattcaatgagtatgcggccacc

SEQ ID NO: 576184 - DNA, 25 bp, Mus musculus
catattcaattacttctggtgtccc

SEQ ID NO: 576185 - DNA, 25 bp, Mus musculus
catattcaattagttctggtgtccc

SEQ ID NO: 576186 - DNA, 25 bp, Mus musculus
catattcaccaccttattcaccgag

SEQ ID NO: 576187 - DNA, 25 bp, Mus musculus
catattcaccacgttattcaccgag

SEQ ID NO: 576188 - DNA, 25 bp, Mus musculus
catattcagggtacgaaaccggagg

SEQ ID NO: 576189 - DNA, 25 bp, Mus musculus
catattcagggttcgaaaccggagg

SEQ ID NO: 576190 - DNA, 25 bp, Mus musculus
catattcatcccatggctgtagagc

SEQ ID NO: 576191 - DNA, 25 bp, Mus musculus
catattcatcccttggctgtagagc

SEQ ID NO: 576192 - DNA, 25 bp, Mus musculus
catattccagggagattctgggctc

SEQ ID NO: 576193 - DNA, 25 bp, Mus musculus
catattccagggtgattctgggctc

SEQ ID NO: 576194 - DNA, 25 bp, Mus musculus
catattcccacaagatgccacgaag

SEQ ID NO: 576195 - DNA, 25 bp, Mus musculus
catattcccacatgatgccacgaag

SEQ ID NO: 576196 - DNA, 25 bp, Mus musculus
catattccgggtagctctgacctta

SEQ ID NO: 576197 - DNA, 25 bp, Mus musculus
catattccgggttgctctgacctta

SEQ ID NO: 576198 - DNA, 25 bp, Mus musculus
catattcctgatcttccacaggagt

SEQ ID NO: 576199 - DNA, 25 bp, Mus musculus
catattcctgatgttccacaggagt

SEQ ID NO: 576200 - DNA, 25 bp, Mus musculus
catattcctggtcggcgtggagaat

SEQ ID NO: 576201 - DNA, 25 bp, Mus musculus
catattcctggtgggcgtggagaat

SEQ ID NO: 576202 - DNA, 25 bp, Mus musculus
catattcgacagacacacgtgacca

SEQ ID NO: 576203 - DNA, 25 bp, Mus musculus
catattcgacagtcacacgtgacca

SEQ ID NO: 576204 - DNA, 25 bp, Mus musculus
catattctgcaaagtgaggtcatca

SEQ ID NO: 576205 - DNA, 25 bp, Mus musculus
catattctgcaatgtgaggtcatca

SEQ ID NO: 576206 - DNA, 25 bp, Mus musculus
catattctgtgtccgtggcatggac

SEQ ID NO: 576207 - DNA, 25 bp, Mus musculus
catattctgtgtgcgtggcatggac

SEQ ID NO: 576208 - DNA, 25 bp, Mus musculus
catattgctaatcgcacatctgaga

SEQ ID NO: 576209 - DNA, 25 bp, Mus musculus
catattgctaatggcacatctgaga

SEQ ID NO: 576210 - DNA, 25 bp, Mus musculus
catattgctgcaatcaggaccactg

SEQ ID NO: 576211 - DNA, 25 bp, Mus musculus
catattgctgcattcaggaccactg

SEQ ID NO: 576212 - DNA, 25 bp, Mus musculus
catattggaaaacgtaatcttgtcg

SEQ ID NO: 576213 - DNA, 25 bp, Mus musculus
catattggaaaaggtaatcttgtcg

SEQ ID NO: 576214 - DNA, 25 bp, Mus musculus
catattggttcgaccagcgcttcaa

SEQ ID NO: 576215 - DNA, 25 bp, Mus musculus
catattggttcgtccagcgcttcaa

SEQ ID NO: 576216 - DNA, 25 bp, Mus musculus
catattgtccccacccatggaacgg

SEQ ID NO: 576217 - DNA, 25 bp, Mus musculus
catattgtcccctcccatggaacgg

SEQ ID NO: 576218 - DNA, 25 bp, Mus musculus
catattgtgggaagcgctttacacg

SEQ ID NO: 576219 - DNA, 25 bp, Mus musculus
catattgtgggatgcgctttacacg

SEQ ID NO: 576220 - DNA, 25 bp, Mus musculus
catattgttcttctcatctccaaca

SEQ ID NO: 576221 - DNA, 25 bp, Mus musculus
catattgttcttgtcatctccaaca

SEQ ID NO: 576222 - DNA, 25 bp, Mus musculus
catatttagatgaccttgttgggaa

SEQ ID NO: 576223 - DNA, 25 bp, Mus musculus
catatttagatgtccttgttgggaa

SEQ ID NO: 576224 - DNA, 25 bp, Mus musculus
catatttcaaatcatctttggatcg

SEQ ID NO: 576225 - DNA, 25 bp, Mus musculus
catatttcaaatgatctttggatcg

SEQ ID NO: 576226 - DNA, 25 bp, Mus musculus
catatttcgctgagagactttataa

SEQ ID NO: 576227 - DNA, 25 bp, Mus musculus
catatttcgctgtgagactttataa

SEQ ID NO: 576228 - DNA, 25 bp, Mus musculus
catatttcgtgtcaatttgggagag

SEQ ID NO: 576229 - DNA, 25 bp, Mus musculus
catatttcgtgtgaatttgggagag

SEQ ID NO: 576230 - DNA, 25 bp, Mus musculus
catatttgaccaccgtgccgtagag

SEQ ID NO: 576231 - DNA, 25 bp, Mus musculus
catatttgaccagcgtgccgtagag

SEQ ID NO: 576232 - DNA, 25 bp, Mus musculus
catatttgagatcgatccgcacctg

SEQ ID NO: 576233 - DNA, 25 bp, Mus musculus
catatttgagatggatccgcacctg

SEQ ID NO: 576234 - DNA, 25 bp, Mus musculus
catatttgaggacaagatcaagaag

SEQ ID NO: 576235 - DNA, 25 bp, Mus musculus
catatttgaggagaagatcaagaag

SEQ ID NO: 576236 - DNA, 25 bp, Mus musculus
catatttgagtacgttaagctgcca

SEQ ID NO: 576237 - DNA, 25 bp, Mus musculus
catatttgagtaggttaagctgcca

SEQ ID NO: 576238 - DNA, 25 bp, Mus musculus
catatttgatgcattggtgaggtcc

SEQ ID NO: 576239 - DNA, 25 bp, Mus musculus
catatttgatgctttggtgaggtcc

SEQ ID NO: 576240 - DNA, 25 bp, Mus musculus
catatttgcctgacccattcttcgt

SEQ ID NO: 576241 - DNA, 25 bp, Mus musculus
catatttgcctgtcccattcttcgt

SEQ ID NO: 576242 - DNA, 25 bp, Mus musculus
catatttgctgactccacacgggtg

SEQ ID NO: 576243 - DNA, 25 bp, Mus musculus
catatttgctgagtccacacgggtg

SEQ ID NO: 576244 - DNA, 25 bp, Mus musculus
catatttggccaagtcttcatggtc

SEQ ID NO: 576245 - DNA, 25 bp, Mus musculus
catatttggccatgtcttcatggtc

SEQ ID NO: 576246 - DNA, 25 bp, Mus musculus
catattttcacaacaggtggctaca

SEQ ID NO: 576247 - DNA, 25 bp, Mus musculus
catattttcacatcaggtggctaca

SEQ ID NO: 576248 - DNA, 25 bp, Mus musculus
catattttggatctgggtcttctgt

SEQ ID NO: 576249 - DNA, 25 bp, Mus musculus
catattttggatgtgggtcttctgt

SEQ ID NO: 576250 - DNA, 25 bp, Mus musculus
catcaaaaaacgagaagcagcagaa

SEQ ID NO: 576251 - DNA, 25 bp, Mus musculus
catcaaaaaacgtgaagcagcagaa

SEQ ID NO: 576252 - DNA, 25 bp, Mus musculus
catcaaaaagttccttaaactggtg

SEQ ID NO: 576253 - DNA, 25 bp, Mus musculus
catcaaaaagttgcttaaactggtg

SEQ ID NO: 576254 - DNA, 25 bp, Mus musculus
catcaaaacgtcagaagtggtcaga

SEQ ID NO: 576255 - DNA, 25 bp, Mus musculus
catcaaaacgtctgaagtggtcaga

SEQ ID NO: 576256 - DNA, 25 bp, Mus musculus
catcaaaactgaaatcccactgggc

SEQ ID NO: 576257 - DNA, 25 bp, Mus musculus
catcaaaactgatatcccactgggc

SEQ ID NO: 576258 - DNA, 25 bp, Mus musculus
catcaaaccactagatgactgccag

SEQ ID NO: 576259 - DNA, 25 bp, Mus musculus
catcaaaccacttgatgactgccag

SEQ ID NO: 576260 - DNA, 25 bp, Mus musculus
catcaaacggcacaaggtgcgcatt

SEQ ID NO: 576261 - DNA, 25 bp, Mus musculus
catcaaacggcagaaggtgcgcatt

SEQ ID NO: 576262 - DNA, 25 bp, Mus musculus
catcaaacgggtcatagatgagacc

SEQ ID NO: 576263 - DNA, 25 bp, Mus musculus
catcaaacgggtgatagatgagacc

SEQ ID NO: 576264 - DNA, 25 bp, Mus musculus
catcaaactcaacgaccaggtgctg

SEQ ID NO: 576265 - DNA, 25 bp, Mus musculus
catcaaactcaaggaccaggtgctg

SEQ ID NO: 576266 - DNA, 25 bp, Mus musculus
catcaaacttcacgagctgttgaag

SEQ ID NO: 576267 - DNA, 25 bp, Mus musculus
catcaaacttcaggagctgttgaag

SEQ ID NO: 576268 - DNA, 25 bp, Mus musculus
catcaaagaacacatgaggaagtac

SEQ ID NO: 576269 - DNA, 25 bp, Mus musculus
catcaaagaacagatgaggaagtac

SEQ ID NO: 576270 - DNA, 25 bp, Mus musculus
catcaaagaccgaagtaaagtgact

SEQ ID NO: 576271 - DNA, 25 bp, Mus musculus
catcaaagaccgtagtaaagtgact

SEQ ID NO: 576272 - DNA, 25 bp, Mus musculus
catcaaagagcaactggcacctgtt

SEQ ID NO: 576273 - DNA, 25 bp, Mus musculus
catcaaagagcatctggcacctgtt

SEQ ID NO: 576274 - DNA, 25 bp, Mus musculus
catcaaagctggctgcatcttgtgt

SEQ ID NO: 576275 - DNA, 25 bp, Mus musculus
catcaaagctgggtgcatcttgtgt

SEQ ID NO: 576276 - DNA, 25 bp, Mus musculus
catcaaagctgtcattgagcagagg

SEQ ID NO: 576277 - DNA, 25 bp, Mus musculus
catcaaagctgtgattgagcagagg

SEQ ID NO: 576278 - DNA, 25 bp, Mus musculus
catcaaaggcgaagtgggagagcct

SEQ ID NO: 576279 - DNA, 25 bp, Mus musculus
catcaaaggcgatgtgggagagcct

SEQ ID NO: 576280 - DNA, 25 bp, Mus musculus
catcaaaggcttaggcttccaaaca

SEQ ID NO: 576281 - DNA, 25 bp, Mus musculus
catcaaaggcttatacagggcgaga

SEQ ID NO: 576282 - DNA, 25 bp, Mus musculus
catcaaaggctttggcttccaaaca

SEQ ID NO: 576283 - DNA, 25 bp, Mus musculus
catcaaaggcttttacagggcgaga

SEQ ID NO: 576284 - DNA, 25 bp, Mus musculus
catcaaagtggcaagccccgtgaaa

SEQ ID NO: 576285 - DNA, 25 bp, Mus musculus
catcaaagtggctagccccgtgaaa

SEQ ID NO: 576286 - DNA, 25 bp, Mus musculus
catcaaatcgggacaacaagaaggg

SEQ ID NO: 576287 - DNA, 25 bp, Mus musculus
catcaaatcgggtcaacaagaaggg

SEQ ID NO: 576288 - DNA, 25 bp, Mus musculus
catcaacaaccacaagtacaatttc

SEQ ID NO: 576289 - DNA, 25 bp, Mus musculus
catcaacaaccagaagtacaatttc

SEQ ID NO: 576290 - DNA, 25 bp, Mus musculus
catcaacaagacactaggtcctgct

SEQ ID NO: 576291 - DNA, 25 bp, Mus musculus
catcaacaagactctaggtcctgct

SEQ ID NO: 576292 - DNA, 25 bp, Mus musculus
catcaacaatgacgacaacttctgc

SEQ ID NO: 576293 - DNA, 25 bp, Mus musculus
catcaacaatgaggacaacttctgc

SEQ ID NO: 576294 - DNA, 25 bp, Mus musculus
catcaacacactctgcttatgacag

SEQ ID NO: 576295 - DNA, 25 bp, Mus musculus
catcaacacactgtgcttatgacag

SEQ ID NO: 576296 - DNA, 25 bp, Mus musculus
catcaacacagtcggtagctacgaa

SEQ ID NO: 576297 - DNA, 25 bp, Mus musculus
catcaacacagtgggtagctacgaa

SEQ ID NO: 576298 - DNA, 25 bp, Mus musculus
catcaacaccgcctggtccaacttc

SEQ ID NO: 576299 - DNA, 25 bp, Mus musculus
catcaacaccgcgtggtccaacttc

SEQ ID NO: 576300 - DNA, 25 bp, Mus musculus
catcaacacctgaggctgggtcaag

SEQ ID NO: 576301 - DNA, 25 bp, Mus musculus
catcaacacctgtggctgggtcaag

SEQ ID NO: 576302 - DNA, 25 bp, Mus musculus
catcaacagaccctcttaggaaaga

SEQ ID NO: 576303 - DNA, 25 bp, Mus musculus
catcaacagaccgtcttaggaaaga

SEQ ID NO: 576304 - DNA, 25 bp, Mus musculus
catcaacatcctcgcgggcattaat

SEQ ID NO: 576305 - DNA, 25 bp, Mus musculus
catcaacatcctggcgggcattaat

SEQ ID NO: 576306 - DNA, 25 bp, Mus musculus
catcaacatcgacatctatgccgtg

SEQ ID NO: 576307 - DNA, 25 bp, Mus musculus
catcaacatcgagatctatgccgtg

SEQ ID NO: 576308 - DNA, 25 bp, Mus musculus
catcaaccaggacgcgctggtgctc

SEQ ID NO: 576309 - DNA, 25 bp, Mus musculus
catcaaccaggaggcgctggtgctc

SEQ ID NO: 576310 - DNA, 25 bp, Mus musculus
catcaacccacgagttgccttgcgt

SEQ ID NO: 576311 - DNA, 25 bp, Mus musculus
catcaacccacgtgttgccttgcgt

SEQ ID NO: 576312 - DNA, 25 bp, Mus musculus
catcaacccctaaggcaacagagag

SEQ ID NO: 576313 - DNA, 25 bp, Mus musculus
catcaacccctatggcaacagagag

SEQ ID NO: 576314 - DNA, 25 bp, Mus musculus
catcaaccctgtcactggaagggtg

SEQ ID NO: 576315 - DNA, 25 bp, Mus musculus
catcaaccctgtgactggaagggtg

SEQ ID NO: 576316 - DNA, 25 bp, Mus musculus
catcaaccgtaactgcttgtttctc

SEQ ID NO: 576317 - DNA, 25 bp, Mus musculus
catcaaccgtaagtgcttgtttctc

SEQ ID NO: 576318 - DNA, 25 bp, Mus musculus
catcaacctctgagacatgtgcgtt

SEQ ID NO: 576319 - DNA, 25 bp, Mus musculus
catcaacctctgtgacatgtgcgtt

SEQ ID NO: 576320 - DNA, 25 bp, Mus musculus
catcaacctgttcgatacggcggag

SEQ ID NO: 576321 - DNA, 25 bp, Mus musculus
catcaacctgttggatacggcggag

SEQ ID NO: 576322 - DNA, 25 bp, Mus musculus
catcaacgagtgattactacctgga

SEQ ID NO: 576323 - DNA, 25 bp, Mus musculus
catcaacgagtgtttactacctgga

SEQ ID NO: 576324 - DNA, 25 bp, Mus musculus
catcaacgctgaatgccccatgaga

SEQ ID NO: 576325 - DNA, 25 bp, Mus musculus
catcaacgctgattgccccatgaga

SEQ ID NO: 576326 - DNA, 25 bp, Mus musculus
catcaacggacgaggcattcttgga

SEQ ID NO: 576327 - DNA, 25 bp, Mus musculus
catcaacggacgtggcattcttgga

SEQ ID NO: 576328 - DNA, 25 bp, Mus musculus
catcaacggaggcaatactctggcg

SEQ ID NO: 576329 - DNA, 25 bp, Mus musculus
catcaacggagggaatactctggcg

SEQ ID NO: 576330 - DNA, 25 bp, Mus musculus
catcaacggcctccgaaggatcttg

SEQ ID NO: 576331 - DNA, 25 bp, Mus musculus
catcaacggcctgcgaaggatcttg

SEQ ID NO: 576332 - DNA, 25 bp, Mus musculus
catcaactatgaagagaccctcagc

SEQ ID NO: 576333 - DNA, 25 bp, Mus musculus
catcaactatgatgagaccctcagc

SEQ ID NO: 576334 - DNA, 25 bp, Mus musculus
catcaactgataaagaccctgaaga

SEQ ID NO: 576335 - DNA, 25 bp, Mus musculus
catcaactgatatagaccctgaaga

SEQ ID NO: 576336 - DNA, 25 bp, Mus musculus
catcaactggacctaaagaggcctc

SEQ ID NO: 576337 - DNA, 25 bp, Mus musculus
catcaactggacgtaaagaggcctc

SEQ ID NO: 576338 - DNA, 25 bp, Mus musculus
catcaacttggtatggtctcctgga

SEQ ID NO: 576339 - DNA, 25 bp, Mus musculus
catcaacttggtttggtctcctgga

SEQ ID NO: 576340 - DNA, 25 bp, Mus musculus
catcaagaacaaccccgaatattct

SEQ ID NO: 576341 - DNA, 25 bp, Mus musculus
catcaagaacaagcccgaatattct

SEQ ID NO: 576342 - DNA, 25 bp, Mus musculus
catcaagaatgaagagggcagacgt

SEQ ID NO: 576343 - DNA, 25 bp, Mus musculus
catcaagaatgacgcaactgcccag

SEQ ID NO: 576344 - DNA, 25 bp, Mus musculus
catcaagaatgactgcaacccagtt

SEQ ID NO: 576345 - DNA, 25 bp, Mus musculus
catcaagaatgaggcaactgcccag

SEQ ID NO: 576346 - DNA, 25 bp, Mus musculus
catcaagaatgagtgcaacccagtt

SEQ ID NO: 576347 - DNA, 25 bp, Mus musculus
catcaagaatgatgagggcagacgt

SEQ ID NO: 576348 - DNA, 25 bp, Mus musculus
catcaagaccatctattcggtgcct

SEQ ID NO: 576349 - DNA, 25 bp, Mus musculus
catcaagaccatgtattcggtgcct

SEQ ID NO: 576350 - DNA, 25 bp, Mus musculus
catcaagacgctcaatgaatgggac

SEQ ID NO: 576351 - DNA, 25 bp, Mus musculus
catcaagacgctgaatgaatgggac

SEQ ID NO: 576352 - DNA, 25 bp, Mus musculus
catcaagactcgattcagcagtgtg

SEQ ID NO: 576353 - DNA, 25 bp, Mus musculus
catcaagactcgtttcagcagtgtg

SEQ ID NO: 576354 - DNA, 25 bp, Mus musculus
catcaagaggttaatgctacaaagc

SEQ ID NO: 576355 - DNA, 25 bp, Mus musculus
catcaagaggtttatgctacaaagc

SEQ ID NO: 576356 - DNA, 25 bp, Mus musculus
catcaagattgaaggaataagaatc

SEQ ID NO: 576357 - DNA, 25 bp, Mus musculus
catcaagattgatggaataagaatc

SEQ ID NO: 576358 - DNA, 25 bp, Mus musculus
catcaagattggcttgtttgctgac

SEQ ID NO: 576359 - DNA, 25 bp, Mus musculus
catcaagattgggttgtttgctgac

SEQ ID NO: 576360 - DNA, 25 bp, Mus musculus
catcaagcaaacagagctggtagcc

SEQ ID NO: 576361 - DNA, 25 bp, Mus musculus
catcaagcaaactgagctggtagcc

SEQ ID NO: 576362 - DNA, 25 bp, Mus musculus
catcaagcaaagcaaacccaaactt

SEQ ID NO: 576363 - DNA, 25 bp, Mus musculus
catcaagcaaaggaaacccaaactt

SEQ ID NO: 576364 - DNA, 25 bp, Mus musculus
catcaagcacgactccaacatcggg

SEQ ID NO: 576365 - DNA, 25 bp, Mus musculus
catcaagcacgagtccaacatcggg

SEQ ID NO: 576366 - DNA, 25 bp, Mus musculus
catcaagcagctacatatcagcagc

SEQ ID NO: 576367 - DNA, 25 bp, Mus musculus
catcaagcagcttcatatcagcagc

SEQ ID NO: 576368 - DNA, 25 bp, Mus musculus
catcaagcaggaagggattggagct

SEQ ID NO: 576369 - DNA, 25 bp, Mus musculus
catcaagcaggatgggattggagct

SEQ ID NO: 576370 - DNA, 25 bp, Mus musculus
catcaagcaggtatgcatgagagtc

SEQ ID NO: 576371 - DNA, 25 bp, Mus musculus
catcaagcaggtttgcatgagagtc

SEQ ID NO: 576372 - DNA, 25 bp, Mus musculus
catcaagcctgtctttgagcgcttc

SEQ ID NO: 576373 - DNA, 25 bp, Mus musculus
catcaagcctgtgtttgagcgcttc

SEQ ID NO: 576374 - DNA, 25 bp, Mus musculus
catcaagctggtcaatctgctctcc

SEQ ID NO: 576375 - DNA, 25 bp, Mus musculus
catcaagctggtgaatctgctctcc

SEQ ID NO: 576376 - DNA, 25 bp, Mus musculus
catcaagcttcgcaaaagcatgtgg

SEQ ID NO: 576377 - DNA, 25 bp, Mus musculus
catcaagcttcggaaaagcatgtgg

SEQ ID NO: 576378 - DNA, 25 bp, Mus musculus
catcaaggaaatcgttttgtccagg

SEQ ID NO: 576379 - DNA, 25 bp, Mus musculus
catcaaggaaatggttttgtccagg

SEQ ID NO: 576380 - DNA, 25 bp, Mus musculus
catcaaggaagcatggactgcaacg

SEQ ID NO: 576381 - DNA, 25 bp, Mus musculus
catcaaggaagccaaactacagcat

SEQ ID NO: 576382 - DNA, 25 bp, Mus musculus
catcaaggaagcgaaactacagcat

SEQ ID NO: 576383 - DNA, 25 bp, Mus musculus
catcaaggaagcttggactgcaacg

SEQ ID NO: 576384 - DNA, 25 bp, Mus musculus
catcaaggagctcgctgtggagact

SEQ ID NO: 576385 - DNA, 25 bp, Mus musculus
catcaaggagctggctgtggagact

SEQ ID NO: 576386 - DNA, 25 bp, Mus musculus
catcaaggagttccgggagatgacc

SEQ ID NO: 576387 - DNA, 25 bp, Mus musculus
catcaaggagttgcgggagatgacc

SEQ ID NO: 576388 - DNA, 25 bp, Mus musculus
catcaaggccatcaatgaaggttcc

SEQ ID NO: 576389 - DNA, 25 bp, Mus musculus
catcaaggccatgaatgaaggttcc

SEQ ID NO: 576390 - DNA, 25 bp, Mus musculus
catcaaggctatcagggtttcagga

SEQ ID NO: 576391 - DNA, 25 bp, Mus musculus
catcaaggctatgagggtttcagga

SEQ ID NO: 576392 - DNA, 25 bp, Mus musculus
catcaagggctgcaacataagccgc

SEQ ID NO: 576393 - DNA, 25 bp, Mus musculus
catcaagggctggaacataagccgc

SEQ ID NO: 576394 - DNA, 25 bp, Mus musculus
catcaaggttatcgacgtcaccgag

SEQ ID NO: 576395 - DNA, 25 bp, Mus musculus
catcaaggttatggacgtcaccgag

SEQ ID NO: 576396 - DNA, 25 bp, Mus musculus
catcaagtacacaggctacgggaat

SEQ ID NO: 576397 - DNA, 25 bp, Mus musculus
catcaagtacactggctacgggaat

SEQ ID NO: 576398 - DNA, 25 bp, Mus musculus
catcaagtacatagggatgcggaat

SEQ ID NO: 576399 - DNA, 25 bp, Mus musculus
catcaagtacattgggatgcggaat

SEQ ID NO: 576400 - DNA, 25 bp, Mus musculus
catcaagtcagcatcaatgcatccg

SEQ ID NO: 576401 - DNA, 25 bp, Mus musculus
catcaagtcagcttcaatgcatccg

SEQ ID NO: 576402 - DNA, 25 bp, Mus musculus
catcaagtccgtcgtgggctgcatc

SEQ ID NO: 576403 - DNA, 25 bp, Mus musculus
catcaagtccgtggtgggctgcatc

SEQ ID NO: 576404 - DNA, 25 bp, Mus musculus
catcaagttcagctcttccttggaa

SEQ ID NO: 576405 - DNA, 25 bp, Mus musculus
catcaagttcaggtcttccttggaa

SEQ ID NO: 576406 - DNA, 25 bp, Mus musculus
catcaagttgaactaccaccatttg

SEQ ID NO: 576407 - DNA, 25 bp, Mus musculus
catcaagttgaagtaccaccatttg

SEQ ID NO: 576408 - DNA, 25 bp, Mus musculus
catcaagttggaccagacgtccctg

SEQ ID NO: 576409 - DNA, 25 bp, Mus musculus
catcaagttggagcagacgtccctg

SEQ ID NO: 576410 - DNA, 25 bp, Mus musculus
catcaagttgtaccccacaaacttc

SEQ ID NO: 576411 - DNA, 25 bp, Mus musculus
catcaagttgtagcccacaaacttc

SEQ ID NO: 576412 - DNA, 25 bp, Mus musculus
catcaagttgtcaacagaagctgaa

SEQ ID NO: 576413 - DNA, 25 bp, Mus musculus
catcaagttgtctacagaagctgaa

SEQ ID NO: 576414 - DNA, 25 bp, Mus musculus
catcaataacttaagtttttgccgg

SEQ ID NO: 576415 - DNA, 25 bp, Mus musculus
catcaataactttagtttttgccgg

SEQ ID NO: 576416 - DNA, 25 bp, Mus musculus
catcaataagacaaggcagatcgcc

SEQ ID NO: 576417 - DNA, 25 bp, Mus musculus
catcaataagactaggcagatcgcc

SEQ ID NO: 576418 - DNA, 25 bp, Mus musculus
catcaatactcgactgtatatttgg

SEQ ID NO: 576419 - DNA, 25 bp, Mus musculus
catcaatactcgtctgtatatttgg

SEQ ID NO: 576420 - DNA, 25 bp, Mus musculus
catcaatatagaagccataagtggc

SEQ ID NO: 576421 - DNA, 25 bp, Mus musculus
catcaatatagatgccataagtggc

SEQ ID NO: 576422 - DNA, 25 bp, Mus musculus
catcaatatcatccatgtgcagacg

SEQ ID NO: 576423 - DNA, 25 bp, Mus musculus
catcaatatcatgcatgtgcagacg

SEQ ID NO: 576424 - DNA, 25 bp, Mus musculus
catcaatcagagcttgctggcgccg

SEQ ID NO: 576425 - DNA, 25 bp, Mus musculus
catcaatcagaggttgctggcgccg

SEQ ID NO: 576426 - DNA, 25 bp, Mus musculus
catcaatcccgactggaactttgag

SEQ ID NO: 576427 - DNA, 25 bp, Mus musculus
catcaatcccgagtggaactttgag

SEQ ID NO: 576428 - DNA, 25 bp, Mus musculus
catcaatcggataactgcaaacacg

SEQ ID NO: 576429 - DNA, 25 bp, Mus musculus
catcaatcggattactgcaaacacg

SEQ ID NO: 576430 - DNA, 25 bp, Mus musculus
catcaatctcctagagacagtgttc

SEQ ID NO: 576431 - DNA, 25 bp, Mus musculus
catcaatctccttgagacagtgttc

SEQ ID NO: 576432 - DNA, 25 bp, Mus musculus
catcaatcttcgacactttaagagg

SEQ ID NO: 576433 - DNA, 25 bp, Mus musculus
catcaatcttcgtcactttaagagg

SEQ ID NO: 576434 - DNA, 25 bp, Mus musculus
catcaatgaagaagacgttgaagct

SEQ ID NO: 576435 - DNA, 25 bp, Mus musculus
catcaatgaagatgacgttgaagct

SEQ ID NO: 576436 - DNA, 25 bp, Mus musculus
catcaatgaaggatttgaattgctg

SEQ ID NO: 576437 - DNA, 25 bp, Mus musculus
catcaatgaaggttttgaattgctg

SEQ ID NO: 576438 - DNA, 25 bp, Mus musculus
catcaatgaattaaaggaactggcc

SEQ ID NO: 576439 - DNA, 25 bp, Mus musculus
catcaatgaatttaaggaactggcc

SEQ ID NO: 576440 - DNA, 25 bp, Mus musculus
catcaatgagatacagcccagcgtc

SEQ ID NO: 576441 - DNA, 25 bp, Mus musculus
catcaatgagattcagcccagcgtc

SEQ ID NO: 576442 - DNA, 25 bp, Mus musculus
catcaatgaggcctgctgggacgtc

SEQ ID NO: 576443 - DNA, 25 bp, Mus musculus
catcaatgaggcgtgctgggacgtc

SEQ ID NO: 576444 - DNA, 25 bp, Mus musculus
catcaatgcaacacaaagatcttcc

SEQ ID NO: 576445 - DNA, 25 bp, Mus musculus
catcaatgcaactcaaagatcttcc

SEQ ID NO: 576446 - DNA, 25 bp, Mus musculus
catcaatgcattcagagggataagg

SEQ ID NO: 576447 - DNA, 25 bp, Mus musculus
catcaatgcattgagagggataagg

SEQ ID NO: 576448 - DNA, 25 bp, Mus musculus
catcaatgctgtcgtcctgctgatc

SEQ ID NO: 576449 - DNA, 25 bp, Mus musculus
catcaatgctgtggtcctgctgatc

SEQ ID NO: 576450 - DNA, 25 bp, Mus musculus
catcaatggattctcgacttcaaag

SEQ ID NO: 576451 - DNA, 25 bp, Mus musculus
catcaatggattgtcgacttcaaag

SEQ ID NO: 576452 - DNA, 25 bp, Mus musculus
catcaatgggctagttaactgtctg

SEQ ID NO: 576453 - DNA, 25 bp, Mus musculus
catcaatgggcttgttaactgtctg

SEQ ID NO: 576454 - DNA, 25 bp, Mus musculus
catcaatgtaccaccacccagaggg

SEQ ID NO: 576455 - DNA, 25 bp, Mus musculus
catcaatgtacctccacccagaggg

SEQ ID NO: 576456 - DNA, 25 bp, Mus musculus
catcaatgtgagctatctgagggag

SEQ ID NO: 576457 - DNA, 25 bp, Mus musculus
catcaatgtgaggtatctgagggag

SEQ ID NO: 576458 - DNA, 25 bp, Mus musculus
catcaatgtggtcgacaaataccca

SEQ ID NO: 576459 - DNA, 25 bp, Mus musculus
catcaatgtggtggacaaataccca

SEQ ID NO: 576460 - DNA, 25 bp, Mus musculus
catcaattgggaagatctcttggcc

SEQ ID NO: 576461 - DNA, 25 bp, Mus musculus
catcaattgggatgatctcttggcc

SEQ ID NO: 576462 - DNA, 25 bp, Mus musculus
catcaattttgacctccctgtggac

SEQ ID NO: 576463 - DNA, 25 bp, Mus musculus
catcaattttgagctccctgtggac

SEQ ID NO: 576464 - DNA, 25 bp, Mus musculus
catcacaatccaacagtctggccag

SEQ ID NO: 576465 - DNA, 25 bp, Mus musculus
catcacaatccatcagtctggccag

SEQ ID NO: 576466 - DNA, 25 bp, Mus musculus
catcacaatggtatcctaggaatct

SEQ ID NO: 576467 - DNA, 25 bp, Mus musculus
catcacaatggtttcctaggaatct

SEQ ID NO: 576468 - DNA, 25 bp, Mus musculus
catcacaatgtgacacggtgggaaa

SEQ ID NO: 576469 - DNA, 25 bp, Mus musculus
catcacaatgtgtcacggtgggaaa

SEQ ID NO: 576470 - DNA, 25 bp, Mus musculus
catcacacaggaacgattctctcgc

SEQ ID NO: 576471 - DNA, 25 bp, Mus musculus
catcacacaggatcgattctctcgc

SEQ ID NO: 576472 - DNA, 25 bp, Mus musculus
catcacagaagtatgaagaggggcg

SEQ ID NO: 576473 - DNA, 25 bp, Mus musculus
catcacagaagtttgaagaggggcg

SEQ ID NO: 576474 - DNA, 25 bp, Mus musculus
catcacagcctgagcagttgtcatt

SEQ ID NO: 576475 - DNA, 25 bp, Mus musculus
catcacagcctgtgcagttgtcatt

SEQ ID NO: 576476 - DNA, 25 bp, Mus musculus
catcacagcgaacttggatattaga

SEQ ID NO: 576477 - DNA, 25 bp, Mus musculus
catcacagcgaagttggatattaga

SEQ ID NO: 576478 - DNA, 25 bp, Mus musculus
catcacaggcaaccggttgctgctt

SEQ ID NO: 576479 - DNA, 25 bp, Mus musculus
catcacaggcaagcggttgctgctt

SEQ ID NO: 576480 - DNA, 25 bp, Mus musculus
catcacagggaacttcagtcccaag

SEQ ID NO: 576481 - DNA, 25 bp, Mus musculus
catcacagggaagttcagtcccaag

SEQ ID NO: 576482 - DNA, 25 bp, Mus musculus
catcacagggttatgacttgtcacg

SEQ ID NO: 576483 - DNA, 25 bp, Mus musculus
catcacagggttttgacttgtcacg

SEQ ID NO: 576484 - DNA, 25 bp, Mus musculus
catcacagttgacagtgttactgct

SEQ ID NO: 576485 - DNA, 25 bp, Mus musculus
catcacagttgagagtgttactgct

SEQ ID NO: 576486 - DNA, 25 bp, Mus musculus
catcacatatcgactgccggagctg

SEQ ID NO: 576487 - DNA, 25 bp, Mus musculus
catcacatatcgtctgccggagctg

SEQ ID NO: 576488 - DNA, 25 bp, Mus musculus
catcacatcgcacagcctcctggtg

SEQ ID NO: 576489 - DNA, 25 bp, Mus musculus
catcacatcgcagagcctcctggtg

SEQ ID NO: 576490 - DNA, 25 bp, Mus musculus
catcaccaagtactccatgcagtca

SEQ ID NO: 576491 - DNA, 25 bp, Mus musculus
catcaccaagtagtccatgcagtca

SEQ ID NO: 576492 - DNA, 25 bp, Mus musculus
catcaccaatgaagaggcctatgca

SEQ ID NO: 576493 - DNA, 25 bp, Mus musculus
catcaccaatgatgaggcctatgca

SEQ ID NO: 576494 - DNA, 25 bp, Mus musculus
catcaccaggatcatcaaggaggcg

SEQ ID NO: 576495 - DNA, 25 bp, Mus musculus
catcaccaggatgatcaaggaggcg

SEQ ID NO: 576496 - DNA, 25 bp, Mus musculus
catcaccagtcacgaacgggaccag

SEQ ID NO: 576497 - DNA, 25 bp, Mus musculus
catcaccagtcaggaacgggaccag

SEQ ID NO: 576498 - DNA, 25 bp, Mus musculus
catcaccatagccagcgctgtgaac

SEQ ID NO: 576499 - DNA, 25 bp, Mus musculus
catcaccatagcgagcgctgtgaac

SEQ ID NO: 576500 - DNA, 25 bp, Mus musculus
catcaccatgatcaagattgtgctc

SEQ ID NO: 576501 - DNA, 25 bp, Mus musculus
catcaccatgatgaagattgtgctc

SEQ ID NO: 576502 - DNA, 25 bp, Mus musculus
catcaccatgggacacatgcacggc

SEQ ID NO: 576503 - DNA, 25 bp, Mus musculus
catcaccatgggtcacatgcacggc

SEQ ID NO: 576504 - DNA, 25 bp, Mus musculus
catcaccatggtagccaaactcagc

SEQ ID NO: 576505 - DNA, 25 bp, Mus musculus
catcaccatggttgccaaactcagc

SEQ ID NO: 576506 - DNA, 25 bp, Mus musculus
catcacccagtcaggagagtttgtc

SEQ ID NO: 576507 - DNA, 25 bp, Mus musculus
catcacccagtctggagagtttgtc

SEQ ID NO: 576508 - DNA, 25 bp, Mus musculus
catcaccccgcgctagagagttggg

SEQ ID NO: 576509 - DNA, 25 bp, Mus musculus
catcaccccgcggtagagagttggg

SEQ ID NO: 576510 - DNA, 25 bp, Mus musculus
catcacccgggaagaattctccaag

SEQ ID NO: 576511 - DNA, 25 bp, Mus musculus
catcacccgggatgaattctccaag

SEQ ID NO: 576512 - DNA, 25 bp, Mus musculus
catcacccttaaaacgttgcagcag

SEQ ID NO: 576513 - DNA, 25 bp, Mus musculus
catcacccttaatacgttgcagcag

SEQ ID NO: 576514 - DNA, 25 bp, Mus musculus
catcaccgtgggatgttgggatctc

SEQ ID NO: 576515 - DNA, 25 bp, Mus musculus
catcaccgtgggttgttgggatctc

SEQ ID NO: 576516 - DNA, 25 bp, Mus musculus
catcaccgtggtcattcttctagga

SEQ ID NO: 576517 - DNA, 25 bp, Mus musculus
catcaccgtggtgattcttctagga

SEQ ID NO: 576518 - DNA, 25 bp, Mus musculus
catcacctatgaattggctatcatt

SEQ ID NO: 576519 - DNA, 25 bp, Mus musculus
catcacctatgatttggctatcatt

SEQ ID NO: 576520 - DNA, 25 bp, Mus musculus
catcacctatgtactccagaaacga

SEQ ID NO: 576521 - DNA, 25 bp, Mus musculus
catcacctatgttctccagaaacga

SEQ ID NO: 576522 - DNA, 25 bp, Mus musculus
catcacctccagcacatagttcggt

SEQ ID NO: 576523 - DNA, 25 bp, Mus musculus
catcacctccaggacatagttcggt

SEQ ID NO: 576524 - DNA, 25 bp, Mus musculus
catcacctcgaaagcgccagaaaga

SEQ ID NO: 576525 - DNA, 25 bp, Mus musculus
catcacctcgaatgcgccagaaaga

SEQ ID NO: 576526 - DNA, 25 bp, Mus musculus
catcacctcggaaaataaagacaca

SEQ ID NO: 576527 - DNA, 25 bp, Mus musculus
catcacctcggataataaagacaca

SEQ ID NO: 576528 - DNA, 25 bp, Mus musculus
catcacctgcaacaagacgggaacc

SEQ ID NO: 576529 - DNA, 25 bp, Mus musculus
catcacctgcaagaagacgggaacc

SEQ ID NO: 576530 - DNA, 25 bp, Mus musculus
catcacctggacaggggttcccggt

SEQ ID NO: 576531 - DNA, 25 bp, Mus musculus
catcacctggactggggttcccggt

SEQ ID NO: 576532 - DNA, 25 bp, Mus musculus
catcacctgtggagacacaagagca

SEQ ID NO: 576533 - DNA, 25 bp, Mus musculus
catcacctgtggtgacacaagagca

SEQ ID NO: 576534 - DNA, 25 bp, Mus musculus
catcaccttgaacatccagtttttg

SEQ ID NO: 576535 - DNA, 25 bp, Mus musculus
catcaccttgaagatccagtttttg

SEQ ID NO: 576536 - DNA, 25 bp, Mus musculus
catcaccttgcaccagccctggttc

SEQ ID NO: 576537 - DNA, 25 bp, Mus musculus
catcaccttgcagcagccctggttc

SEQ ID NO: 576538 - DNA, 25 bp, Mus musculus
catcacgctaagctgccatagctgg

SEQ ID NO: 576539 - DNA, 25 bp, Mus musculus
catcacgctaaggtgccatagctgg

SEQ ID NO: 576540 - DNA, 25 bp, Mus musculus
catcacgctcacagggtgaggaggc

SEQ ID NO: 576541 - DNA, 25 bp, Mus musculus
catcacgctcactgggtgaggaggc

SEQ ID NO: 576542 - DNA, 25 bp, Mus musculus
catcacgctgacagtagacggccga

SEQ ID NO: 576543 - DNA, 25 bp, Mus musculus
catcacgctgactgtagacggccga

SEQ ID NO: 576544 - DNA, 25 bp, Mus musculus
catcacgctggacctccatggagat

SEQ ID NO: 576545 - DNA, 25 bp, Mus musculus
catcacgctggagctccatggagat

SEQ ID NO: 576546 - DNA, 25 bp, Mus musculus
catcacggaagaaacatgacatgtg

SEQ ID NO: 576547 - DNA, 25 bp, Mus musculus
catcacggaagatacatgacatgtg

SEQ ID NO: 576548 - DNA, 25 bp, Mus musculus
catcacggtgacaatgagaaacagt

SEQ ID NO: 576549 - DNA, 25 bp, Mus musculus
catcacggtgactatgagaaacagt

SEQ ID NO: 576550 - DNA, 25 bp, Mus musculus
catcacgtacctcctctcgatatgg

SEQ ID NO: 576551 - DNA, 25 bp, Mus musculus
catcacgtacctgctctcgatatgg

SEQ ID NO: 576552 - DNA, 25 bp, Mus musculus
catcacgtccctcagggaggaggac

SEQ ID NO: 576553 - DNA, 25 bp, Mus musculus
catcacgtccctgagggaggaggac

SEQ ID NO: 576554 - DNA, 25 bp, Mus musculus
catcacgtggccctgatttgcctgc

SEQ ID NO: 576555 - DNA, 25 bp, Mus musculus
catcacgtggccgtgatttgcctgc

SEQ ID NO: 576556 - DNA, 25 bp, Mus musculus
catcactactgaatcctgtggaggg

SEQ ID NO: 576557 - DNA, 25 bp, Mus musculus
catcactactgattcctgtggaggg

SEQ ID NO: 576558 - DNA, 25 bp, Mus musculus
catcactagaataaagcaactggtc

SEQ ID NO: 576559 - DNA, 25 bp, Mus musculus
catcactagaattaagcaactggtc

SEQ ID NO: 576560 - DNA, 25 bp, Mus musculus
catcactagcttatacccatcacgg

SEQ ID NO: 576561 - DNA, 25 bp, Mus musculus
catcactagcttttacccatcacgg

SEQ ID NO: 576562 - DNA, 25 bp, Mus musculus
catcactagtagacctcagggtgcc

SEQ ID NO: 576563 - DNA, 25 bp, Mus musculus
catcactagtagtcctcagggtgcc

SEQ ID NO: 576564 - DNA, 25 bp, Mus musculus
catcactatcaaagacgacaagggc

SEQ ID NO: 576565 - DNA, 25 bp, Mus musculus
catcactatcaatgacgacaagggc

SEQ ID NO: 576566 - DNA, 25 bp, Mus musculus
catcactatttcatggtgtgtgaag

SEQ ID NO: 576567 - DNA, 25 bp, Mus musculus
catcactatttcttggtgtgtgaag

SEQ ID NO: 576568 - DNA, 25 bp, Mus musculus
catcactcaagtatgaaataaaagc

SEQ ID NO: 576569 - DNA, 25 bp, Mus musculus
catcactcaagtttgaaataaaagc

SEQ ID NO: 576570 - DNA, 25 bp, Mus musculus
catcactccctacgcaggagtagtg

SEQ ID NO: 576571 - DNA, 25 bp, Mus musculus
catcactccctaggcaggagtagtg

SEQ ID NO: 576572 - DNA, 25 bp, Mus musculus
catcactctcaacagcatggatgcc

SEQ ID NO: 576573 - DNA, 25 bp, Mus musculus
catcactctcaagagcatggatgcc

SEQ ID NO: 576574 - DNA, 25 bp, Mus musculus
catcactctggccatgaaccgagat

SEQ ID NO: 576575 - DNA, 25 bp, Mus musculus
catcactctggcgatgaaccgagat

SEQ ID NO: 576576 - DNA, 25 bp, Mus musculus
catcactgagatagaggtgctgtcg

SEQ ID NO: 576577 - DNA, 25 bp, Mus musculus
catcactgagattgaggtgctgtcg

SEQ ID NO: 576578 - DNA, 25 bp, Mus musculus
catcactgaggacatggcagagaag

SEQ ID NO: 576579 - DNA, 25 bp, Mus musculus
catcactgaggagatggcagagaag

SEQ ID NO: 576580 - DNA, 25 bp, Mus musculus
catcactgagtcagaagaggtggtc

SEQ ID NO: 576581 - DNA, 25 bp, Mus musculus
catcactgagtctgaagaggtggtc

SEQ ID NO: 576582 - DNA, 25 bp, Mus musculus
catcactgccaaacagtatgagatg

SEQ ID NO: 576583 - DNA, 25 bp, Mus musculus
catcactgccaatcagtatgagatg

SEQ ID NO: 576584 - DNA, 25 bp, Mus musculus
catcactgccctcgctcagatgagg

SEQ ID NO: 576585 - DNA, 25 bp, Mus musculus
catcactgccctggctcagatgagg

SEQ ID NO: 576586 - DNA, 25 bp, Mus musculus
catcactgccgaccatgtgggcaga

SEQ ID NO: 576587 - DNA, 25 bp, Mus musculus
catcactgccgagcatgtgggcaga

SEQ ID NO: 576588 - DNA, 25 bp, Mus musculus
catcactgctaactggaccagctgg

SEQ ID NO: 576589 - DNA, 25 bp, Mus musculus
catcactgctaagtggaccagctgg

SEQ ID NO: 576590 - DNA, 25 bp, Mus musculus
catcactgctgacgaactgcggaga

SEQ ID NO: 576591 - DNA, 25 bp, Mus musculus
catcactgctgaggaactgcggaga

SEQ ID NO: 576592 - DNA, 25 bp, Mus musculus
catcactgctgtcgccaaatactca

SEQ ID NO: 576593 - DNA, 25 bp, Mus musculus
catcactgctgtggccaaatactca

SEQ ID NO: 576594 - DNA, 25 bp, Mus musculus
catcactgcttgaaaaaagaacgag

SEQ ID NO: 576595 - DNA, 25 bp, Mus musculus
catcactgcttgtaaaaagaacgag

SEQ ID NO: 576596 - DNA, 25 bp, Mus musculus
catcactggaaaaaaggaccagagc

SEQ ID NO: 576597 - DNA, 25 bp, Mus musculus
catcactggaaataaggaccagagc

SEQ ID NO: 576598 - DNA, 25 bp, Mus musculus
catcactggaggctgcccttgtgcc

SEQ ID NO: 576599 - DNA, 25 bp, Mus musculus
catcactggagggtgcccttgtgcc

SEQ ID NO: 576600 - DNA, 25 bp, Mus musculus
catcactggataacagctgcctgtt

SEQ ID NO: 576601 - DNA, 25 bp, Mus musculus
catcactggatatcagctgcctgtt

SEQ ID NO: 576602 - DNA, 25 bp, Mus musculus
catcactggcaaactctttgaggta

SEQ ID NO: 576603 - DNA, 25 bp, Mus musculus
catcactggcaaatacgcttctcat

SEQ ID NO: 576604 - DNA, 25 bp, Mus musculus
catcactggcaatctctttgaggta

SEQ ID NO: 576605 - DNA, 25 bp, Mus musculus
catcactggcaattacgcttctcat

SEQ ID NO: 576606 - DNA, 25 bp, Mus musculus
catcactggcatagttggagacaaa

SEQ ID NO: 576607 - DNA, 25 bp, Mus musculus
catcactggcattgttggagacaaa

SEQ ID NO: 576608 - DNA, 25 bp, Mus musculus
catcactgggaactatgcatcccac

SEQ ID NO: 576609 - DNA, 25 bp, Mus musculus
catcactgggaagtatgcatcccac

SEQ ID NO: 576610 - DNA, 25 bp, Mus musculus
catcactgggtcagctgatgttagg

SEQ ID NO: 576611 - DNA, 25 bp, Mus musculus
catcactgggtctgctgatgttagg

SEQ ID NO: 576612 - DNA, 25 bp, Mus musculus
catcactgggttaggcagaaggacc

SEQ ID NO: 576613 - DNA, 25 bp, Mus musculus
catcactgggttcgcaagactcagg

SEQ ID NO: 576614 - DNA, 25 bp, Mus musculus
catcactgggttggcaagactcagg

SEQ ID NO: 576615 - DNA, 25 bp, Mus musculus
catcactgggtttggcagaaggacc

SEQ ID NO: 576616 - DNA, 25 bp, Mus musculus
catcactggtccagagggccatgtg

SEQ ID NO: 576617 - DNA, 25 bp, Mus musculus
catcactggtcctgagggccatgtg

SEQ ID NO: 576618 - DNA, 25 bp, Mus musculus
catcactggtgtcgaggcagagaat

SEQ ID NO: 576619 - DNA, 25 bp, Mus musculus
catcactggtgtggaggcagagaat

SEQ ID NO: 576620 - DNA, 25 bp, Mus musculus
catcactgtactcgctgtcatcttc

SEQ ID NO: 576621 - DNA, 25 bp, Mus musculus
catcactgtactggctgtcatcttc

SEQ ID NO: 576622 - DNA, 25 bp, Mus musculus
catcactgtcctcagagacaatgga

SEQ ID NO: 576623 - DNA, 25 bp, Mus musculus
catcactgtcctgagagacaatgga

SEQ ID NO: 576624 - DNA, 25 bp, Mus musculus
catcactgtgagaccaacatcaatg

SEQ ID NO: 576625 - DNA, 25 bp, Mus musculus
catcactgtgagtccaacatcaatg

SEQ ID NO: 576626 - DNA, 25 bp, Mus musculus
catcactgtggcacacatcgtggtg

SEQ ID NO: 576627 - DNA, 25 bp, Mus musculus
catcactgtggctcacatcgtggtg

SEQ ID NO: 576628 - DNA, 25 bp, Mus musculus
catcacttcaacacttttgacaagg

SEQ ID NO: 576629 - DNA, 25 bp, Mus musculus
catcacttcaactcttttgacaagg

SEQ ID NO: 576630 - DNA, 25 bp, Mus musculus
catcacttccatcaacttcagcaaa

SEQ ID NO: 576631 - DNA, 25 bp, Mus musculus
catcacttccatgaacttcagcaaa

SEQ ID NO: 576632 - DNA, 25 bp, Mus musculus
catcacttccttaggattttggaac

SEQ ID NO: 576633 - DNA, 25 bp, Mus musculus
catcacttcctttggattttggaac

SEQ ID NO: 576634 - DNA, 25 bp, Mus musculus
catcacttggttctctgggtacaga

SEQ ID NO: 576635 - DNA, 25 bp, Mus musculus
catcacttggttgtctgggtacaga

SEQ ID NO: 576636 - DNA, 25 bp, Mus musculus
catcactttcataggcaagtggagc

SEQ ID NO: 576637 - DNA, 25 bp, Mus musculus
catcactttcattggcaagtggagc

SEQ ID NO: 576638 - DNA, 25 bp, Mus musculus
catcagaaaataatcagaaattggg

SEQ ID NO: 576639 - DNA, 25 bp, Mus musculus
catcagaaaatattcagaaattggg

SEQ ID NO: 576640 - DNA, 25 bp, Mus musculus
catcagaaaatccatgagctcttct

SEQ ID NO: 576641 - DNA, 25 bp, Mus musculus
catcagaaaatcgatgagctcttct

SEQ ID NO: 576642 - DNA, 25 bp, Mus musculus
catcagaaaggtcggtacggcaagc

SEQ ID NO: 576643 - DNA, 25 bp, Mus musculus
catcagaaaggtgggtacggcaagc

SEQ ID NO: 576644 - DNA, 25 bp, Mus musculus
catcagaaatggctcttatgacatt

SEQ ID NO: 576645 - DNA, 25 bp, Mus musculus
catcagaaatgggtcttatgacatt

SEQ ID NO: 576646 - DNA, 25 bp, Mus musculus
catcagaaattcacgtccattggtc

SEQ ID NO: 576647 - DNA, 25 bp, Mus musculus
catcagaaattctcgtccattggtc

SEQ ID NO: 576648 - DNA, 25 bp, Mus musculus
catcagaacaccctagaaggcgtgg

SEQ ID NO: 576649 - DNA, 25 bp, Mus musculus
catcagaacaccgtagaaggcgtgg

SEQ ID NO: 576650 - DNA, 25 bp, Mus musculus
catcagaagacacacagtaggagga

SEQ ID NO: 576651 - DNA, 25 bp, Mus musculus
catcagaagacagacagtaggagga

SEQ ID NO: 576652 - DNA, 25 bp, Mus musculus
catcagaagactatccgaacagagc

SEQ ID NO: 576653 - DNA, 25 bp, Mus musculus
catcagaagactttccgaacagagc

SEQ ID NO: 576654 - DNA, 25 bp, Mus musculus
catcagaagcgcagtaaggaggcag

SEQ ID NO: 576655 - DNA, 25 bp, Mus musculus
catcagaagcgctgtaaggaggcag

SEQ ID NO: 576656 - DNA, 25 bp, Mus musculus
catcagaaggacatgagcctcagga

SEQ ID NO: 576657 - DNA, 25 bp, Mus musculus
catcagaaggacttgagcctcagga

SEQ ID NO: 576658 - DNA, 25 bp, Mus musculus
catcagaagttacttgaaagggcta

SEQ ID NO: 576659 - DNA, 25 bp, Mus musculus
catcagaagttagttgaaagggcta

SEQ ID NO: 576660 - DNA, 25 bp, Mus musculus
catcagaatggcatgtatgggctgc

SEQ ID NO: 576661 - DNA, 25 bp, Mus musculus
catcagaatggcttgtatgggctgc

SEQ ID NO: 576662 - DNA, 25 bp, Mus musculus
catcagacactgctaagttggaggt

SEQ ID NO: 576663 - DNA, 25 bp, Mus musculus
catcagacactggtaagttggaggt

SEQ ID NO: 576664 - DNA, 25 bp, Mus musculus
catcagaccatgataggatgggcaa

SEQ ID NO: 576665 - DNA, 25 bp, Mus musculus
catcagaccatgttaggatgggcaa

SEQ ID NO: 576666 - DNA, 25 bp, Mus musculus
catcagacgcaacgtgtttggctgt

SEQ ID NO: 576667 - DNA, 25 bp, Mus musculus
catcagacgcaaggtgtttggctgt

SEQ ID NO: 576668 - DNA, 25 bp, Mus musculus
catcagacgccacagggcttgatgc

SEQ ID NO: 576669 - DNA, 25 bp, Mus musculus
catcagacgccagagggcttgatgc

SEQ ID NO: 576670 - DNA, 25 bp, Mus musculus
catcagactgggagagaggtccttc

SEQ ID NO: 576671 - DNA, 25 bp, Mus musculus
catcagactgggtgagaggtccttc

SEQ ID NO: 576672 - DNA, 25 bp, Mus musculus
catcagacttctctagggctattgg

SEQ ID NO: 576673 - DNA, 25 bp, Mus musculus
catcagacttctgtagggctattgg

SEQ ID NO: 576674 - DNA, 25 bp, Mus musculus
catcagagacaacaagcagtactgt

SEQ ID NO: 576675 - DNA, 25 bp, Mus musculus
catcagagacaagaagcagtactgt

SEQ ID NO: 576676 - DNA, 25 bp, Mus musculus
catcagagagaaagtcatcaaggtg

SEQ ID NO: 576677 - DNA, 25 bp, Mus musculus
catcagagagaatgtcatcaaggtg

SEQ ID NO: 576678 - DNA, 25 bp, Mus musculus
catcagagatcacctttccagcaag

SEQ ID NO: 576679 - DNA, 25 bp, Mus musculus
catcagagatcagctttccagcaag

SEQ ID NO: 576680 - DNA, 25 bp, Mus musculus
catcagagcaaaagtgactagggcg

SEQ ID NO: 576681 - DNA, 25 bp, Mus musculus
catcagagcaaatgtgactagggcg

SEQ ID NO: 576682 - DNA, 25 bp, Mus musculus
catcagagggaacccgctgatcttt

SEQ ID NO: 576683 - DNA, 25 bp, Mus musculus
catcagagggaagccgctgatcttt

SEQ ID NO: 576684 - DNA, 25 bp, Mus musculus
catcagagttggcttttgtcaagga

SEQ ID NO: 576685 - DNA, 25 bp, Mus musculus
catcagagttgggttttgtcaagga

SEQ ID NO: 576686 - DNA, 25 bp, Mus musculus
catcagagtttgcaaataaagctag

SEQ ID NO: 576687 - DNA, 25 bp, Mus musculus
catcagagtttggaaataaagctag

SEQ ID NO: 576688 - DNA, 25 bp, Mus musculus
catcagatatacacattgacaatgg

SEQ ID NO: 576689 - DNA, 25 bp, Mus musculus
catcagatatactcattgacaatgg

SEQ ID NO: 576690 - DNA, 25 bp, Mus musculus
catcagatgtgcctcaggcgttcgg

SEQ ID NO: 576691 - DNA, 25 bp, Mus musculus
catcagatgtgcgtcaggcgttcgg

SEQ ID NO: 576692 - DNA, 25 bp, Mus musculus
catcagattcaactcagacctttta

SEQ ID NO: 576693 - DNA, 25 bp, Mus musculus
catcagattcaagtcagacctttta

SEQ ID NO: 576694 - DNA, 25 bp, Mus musculus
catcagatttctcttacgaatgtgt

SEQ ID NO: 576695 - DNA, 25 bp, Mus musculus
catcagatttctgttacgaatgtgt

SEQ ID NO: 576696 - DNA, 25 bp, Mus musculus
catcagcaaactcgcagacagggtt

SEQ ID NO: 576697 - DNA, 25 bp, Mus musculus
catcagcaaactggcagacagggtt

SEQ ID NO: 576698 - DNA, 25 bp, Mus musculus
catcagcaaatgctgttcagtccat

SEQ ID NO: 576699 - DNA, 25 bp, Mus musculus
catcagcaaatggtgttcagtccat

SEQ ID NO: 576700 - DNA, 25 bp, Mus musculus
catcagcaacaaagtgcctggcact

SEQ ID NO: 576701 - DNA, 25 bp, Mus musculus
catcagcaacaacagaatagtgggc

SEQ ID NO: 576702 - DNA, 25 bp, Mus musculus
catcagcaacaagagaatagtgggc

SEQ ID NO: 576703 - DNA, 25 bp, Mus musculus
catcagcaacaatgtgcctggcact

SEQ ID NO: 576704 - DNA, 25 bp, Mus musculus
catcagcaacccagggactgtgacc

SEQ ID NO: 576705 - DNA, 25 bp, Mus musculus
catcagcaaccctgggactgtgacc

SEQ ID NO: 576706 - DNA, 25 bp, Mus musculus
catcagcaacggaggacatccaggt

SEQ ID NO: 576707 - DNA, 25 bp, Mus musculus
catcagcaacggtggacatccaggt

SEQ ID NO: 576708 - DNA, 25 bp, Mus musculus
catcagcagtctaactcattgagca

SEQ ID NO: 576709 - DNA, 25 bp, Mus musculus
catcagcagtcttactcattgagca

SEQ ID NO: 576710 - DNA, 25 bp, Mus musculus
catcagcatcgtcggccagagcaac

SEQ ID NO: 576711 - DNA, 25 bp, Mus musculus
catcagcatcgtgggccagagcaac

SEQ ID NO: 576712 - DNA, 25 bp, Mus musculus
catcagcatggcagactatgtgtct

SEQ ID NO: 576713 - DNA, 25 bp, Mus musculus
catcagcatggctgactatgtgtct

SEQ ID NO: 576714 - DNA, 25 bp, Mus musculus
catcagccaaagaagatgagagcat

SEQ ID NO: 576715 - DNA, 25 bp, Mus musculus
catcagccaaagtagatgagagcat

SEQ ID NO: 576716 - DNA, 25 bp, Mus musculus
catcagccatgcaaggagcctactt

SEQ ID NO: 576717 - DNA, 25 bp, Mus musculus
catcagccatgctaggagcctactt

SEQ ID NO: 576718 - DNA, 25 bp, Mus musculus
catcagccgaaactccagaaatgag

SEQ ID NO: 576719 - DNA, 25 bp, Mus musculus
catcagccgaaagtccagaaatgag

SEQ ID NO: 576720 - DNA, 25 bp, Mus musculus
catcagccgagtcgatgtggaagat

SEQ ID NO: 576721 - DNA, 25 bp, Mus musculus
catcagccgagtggatgtggaagat

SEQ ID NO: 576722 - DNA, 25 bp, Mus musculus
catcagccgcttcaggccggaggat

SEQ ID NO: 576723 - DNA, 25 bp, Mus musculus
catcagccgcttgaggccggaggat

SEQ ID NO: 576724 - DNA, 25 bp, Mus musculus
catcagcctcttcatctacatggtg

SEQ ID NO: 576725 - DNA, 25 bp, Mus musculus
catcagcctcttgatctacatggtg

SEQ ID NO: 576726 - DNA, 25 bp, Mus musculus
catcagcctggaatcaagttataat

SEQ ID NO: 576727 - DNA, 25 bp, Mus musculus
catcagcctggattcaagttataat

SEQ ID NO: 576728 - DNA, 25 bp, Mus musculus
catcagccttgcagcggcttgaagg

SEQ ID NO: 576729 - DNA, 25 bp, Mus musculus
catcagccttgctgcggcttgaagg

SEQ ID NO: 576730 - DNA, 25 bp, Mus musculus
catcagcgaagactctgaaggcagc

SEQ ID NO: 576731 - DNA, 25 bp, Mus musculus
catcagcgaagagtctgaaggcagc

SEQ ID NO: 576732 - DNA, 25 bp, Mus musculus
catcagcgatacacatgtgcaagct

SEQ ID NO: 576733 - DNA, 25 bp, Mus musculus
catcagcgatactcatgtgcaagct

SEQ ID NO: 576734 - DNA, 25 bp, Mus musculus
catcagcgatcccatgaagaccctg

SEQ ID NO: 576735 - DNA, 25 bp, Mus musculus
catcagcgatccgatgaagaccctg

SEQ ID NO: 576736 - DNA, 25 bp, Mus musculus
catcagcgccccagcttgttaaaag

SEQ ID NO: 576737 - DNA, 25 bp, Mus musculus
catcagcgcccctgcttgttaaaag

SEQ ID NO: 576738 - DNA, 25 bp, Mus musculus
catcagcgggcacatttacaaccag

SEQ ID NO: 576739 - DNA, 25 bp, Mus musculus
catcagcgggcagatttacaaccag

SEQ ID NO: 576740 - DNA, 25 bp, Mus musculus
catcagctaacaaatgcacttgtgg

SEQ ID NO: 576741 - DNA, 25 bp, Mus musculus
catcagctaacatatgcacttgtgg

SEQ ID NO: 576742 - DNA, 25 bp, Mus musculus
catcagctaattccctgaaagatga

SEQ ID NO: 576743 - DNA, 25 bp, Mus musculus
catcagctaattgcctgaaagatga

SEQ ID NO: 576744 - DNA, 25 bp, Mus musculus
catcagctactaaatgcgtttcttc

SEQ ID NO: 576745 - DNA, 25 bp, Mus musculus
catcagctactatatgcgtttcttc

SEQ ID NO: 576746 - DNA, 25 bp, Mus musculus
catcagctagaaccaaaggccagaa

SEQ ID NO: 576747 - DNA, 25 bp, Mus musculus
catcagctagaagcaaaggccagaa

SEQ ID NO: 576748 - DNA, 25 bp, Mus musculus
catcagctggatcgtttgcagccag

SEQ ID NO: 576749 - DNA, 25 bp, Mus musculus
catcagctggatggtttgcagccag

SEQ ID NO: 576750 - DNA, 25 bp, Mus musculus
catcagctggctaccgactctacat

SEQ ID NO: 576751 - DNA, 25 bp, Mus musculus
catcagctggcttccgactctacat

SEQ ID NO: 576752 - DNA, 25 bp, Mus musculus
catcagctggttccacaatggccac

SEQ ID NO: 576753 - DNA, 25 bp, Mus musculus
catcagctggttgcacaatggccac

SEQ ID NO: 576754 - DNA, 25 bp, Mus musculus
catcagctgtgacgagccttatctg

SEQ ID NO: 576755 - DNA, 25 bp, Mus musculus
catcagctgtgaggagccttatctg

SEQ ID NO: 576756 - DNA, 25 bp, Mus musculus
catcagcttggacaaggtgtgcgac

SEQ ID NO: 576757 - DNA, 25 bp, Mus musculus
catcagcttggagaaggtgtgcgac

SEQ ID NO: 576758 - DNA, 25 bp, Mus musculus
catcaggaacaaactcagccaggca

SEQ ID NO: 576759 - DNA, 25 bp, Mus musculus
catcaggaacaatctcagccaggca

SEQ ID NO: 576760 - DNA, 25 bp, Mus musculus
catcaggaacgtactgtggacacac

SEQ ID NO: 576761 - DNA, 25 bp, Mus musculus
catcaggaacgttctgtggacacac

SEQ ID NO: 576762 - DNA, 25 bp, Mus musculus
catcaggaagtgaacctggtggtga

SEQ ID NO: 576763 - DNA, 25 bp, Mus musculus
catcaggaagtgtacctggtggtga

SEQ ID NO: 576764 - DNA, 25 bp, Mus musculus
catcaggaatcgagtggacacgtca

SEQ ID NO: 576765 - DNA, 25 bp, Mus musculus
catcaggaatcgtgtggacacgtca

SEQ ID NO: 576766 - DNA, 25 bp, Mus musculus
catcaggaatctacctgacagaagt

SEQ ID NO: 576767 - DNA, 25 bp, Mus musculus
catcaggaatcttcctgacagaagt

SEQ ID NO: 576768 - DNA, 25 bp, Mus musculus
catcaggccgagcttgtcgagagaa

SEQ ID NO: 576769 - DNA, 25 bp, Mus musculus
catcaggccgaggttgtcgagagaa

SEQ ID NO: 576770 - DNA, 25 bp, Mus musculus
catcaggcgggtccagagagtacaa

SEQ ID NO: 576771 - DNA, 25 bp, Mus musculus
catcaggcgggtgcagagagtacaa

SEQ ID NO: 576772 - DNA, 25 bp, Mus musculus
catcagggacaactaccgctctgag

SEQ ID NO: 576773 - DNA, 25 bp, Mus musculus
catcagggacaagtaccgctctgag

SEQ ID NO: 576774 - DNA, 25 bp, Mus musculus
catcagggactacttctcaaggcca

SEQ ID NO: 576775 - DNA, 25 bp, Mus musculus
catcagggactagttctcaaggcca

SEQ ID NO: 576776 - DNA, 25 bp, Mus musculus
catcagggagataaattcaactcag

SEQ ID NO: 576777 - DNA, 25 bp, Mus musculus
catcagggagattaattcaactcag

SEQ ID NO: 576778 - DNA, 25 bp, Mus musculus
catcagggagcaacagatggccaag

SEQ ID NO: 576779 - DNA, 25 bp, Mus musculus
catcagggagcatcagatggccaag

SEQ ID NO: 576780 - DNA, 25 bp, Mus musculus
catcagggaggcaattggactgaga

SEQ ID NO: 576781 - DNA, 25 bp, Mus musculus
catcagggaggctattggactgaga

SEQ ID NO: 576782 - DNA, 25 bp, Mus musculus
catcagggatctagctatcgggtca

SEQ ID NO: 576783 - DNA, 25 bp, Mus musculus
catcagggatcttgctatcgggtca

SEQ ID NO: 576784 - DNA, 25 bp, Mus musculus
catcagggcgagatctcaggtgtct

SEQ ID NO: 576785 - DNA, 25 bp, Mus musculus
catcagggcgagttctcaggtgtct

SEQ ID NO: 576786 - DNA, 25 bp, Mus musculus
catcagggctctctgcagaatcaca

SEQ ID NO: 576787 - DNA, 25 bp, Mus musculus
catcagggctctgtgcagaatcaca

SEQ ID NO: 576788 - DNA, 25 bp, Mus musculus
catcagggtgggaagagctacctca

SEQ ID NO: 576789 - DNA, 25 bp, Mus musculus
catcagggtgggtagagctacctca

SEQ ID NO: 576790 - DNA, 25 bp, Mus musculus
catcagggttttccaatgagtggag

SEQ ID NO: 576791 - DNA, 25 bp, Mus musculus
catcagggttttgcaatgagtggag

SEQ ID NO: 576792 - DNA, 25 bp, Mus musculus
catcaggtcagacaaacactgggct

SEQ ID NO: 576793 - DNA, 25 bp, Mus musculus
catcaggtcagagaaacactgggct

SEQ ID NO: 576794 - DNA, 25 bp, Mus musculus
catcaggtcagcatgctcgctggga

SEQ ID NO: 576795 - DNA, 25 bp, Mus musculus
catcaggtcagcttgctcgctggga

SEQ ID NO: 576796 - DNA, 25 bp, Mus musculus
catcaggtggaactatgtggccaag

SEQ ID NO: 576797 - DNA, 25 bp, Mus musculus
catcaggtggaagtatgtggccaag

SEQ ID NO: 576798 - DNA, 25 bp, Mus musculus
catcaggtgggcaactggccgctgt

SEQ ID NO: 576799 - DNA, 25 bp, Mus musculus
catcaggtgggctactggccgctgt

SEQ ID NO: 576800 - DNA, 25 bp, Mus musculus
catcaggtgtttacagtgtgactga

SEQ ID NO: 576801 - DNA, 25 bp, Mus musculus
catcaggtgttttcagtgtgactga

SEQ ID NO: 576802 - DNA, 25 bp, Mus musculus
catcaggttcatagttagcttcagc

SEQ ID NO: 576803 - DNA, 25 bp, Mus musculus
catcaggttcattgttagcttcagc

SEQ ID NO: 576804 - DNA, 25 bp, Mus musculus
catcaggttccaagttgggccgaac

SEQ ID NO: 576805 - DNA, 25 bp, Mus musculus
catcaggttccatgttgggccgaac

SEQ ID NO: 576806 - DNA, 25 bp, Mus musculus
catcaggtttgactttaggaaaaga

SEQ ID NO: 576807 - DNA, 25 bp, Mus musculus
catcaggtttgagtttaggaaaaga

SEQ ID NO: 576808 - DNA, 25 bp, Mus musculus
catcagtacatgaaatggcgagcac

SEQ ID NO: 576809 - DNA, 25 bp, Mus musculus
catcagtacatgtaatggcgagcac

SEQ ID NO: 576810 - DNA, 25 bp, Mus musculus
catcagtacttcacctgctgctttg

SEQ ID NO: 576811 - DNA, 25 bp, Mus musculus
catcagtacttctcctgctgctttg

SEQ ID NO: 576812 - DNA, 25 bp, Mus musculus
catcagtatcaccactgagtcactc

SEQ ID NO: 576813 - DNA, 25 bp, Mus musculus
catcagtatcacgactgagtcactc

SEQ ID NO: 576814 - DNA, 25 bp, Mus musculus
catcagtatcggatgtgatactgcc

SEQ ID NO: 576815 - DNA, 25 bp, Mus musculus
catcagtatcggttgtgatactgcc

SEQ ID NO: 576816 - DNA, 25 bp, Mus musculus
catcagtatttgctgttgttctctg

SEQ ID NO: 576817 - DNA, 25 bp, Mus musculus
catcagtatttggtgttgttctctg

SEQ ID NO: 576818 - DNA, 25 bp, Mus musculus
catcagtcctcacgtattggctgga

SEQ ID NO: 576819 - DNA, 25 bp, Mus musculus
catcagtcctcaggtattggctgga

SEQ ID NO: 576820 - DNA, 25 bp, Mus musculus
catcagtcgcttcgccagctttggg

SEQ ID NO: 576821 - DNA, 25 bp, Mus musculus
catcagtcgcttggccagctttggg

SEQ ID NO: 576822 - DNA, 25 bp, Mus musculus
catcagtctcacagtggccaagtgc

SEQ ID NO: 576823 - DNA, 25 bp, Mus musculus
catcagtctcactgtggccaagtgc

SEQ ID NO: 576824 - DNA, 25 bp, Mus musculus
catcagtctcatcccttttggagcg

SEQ ID NO: 576825 - DNA, 25 bp, Mus musculus
catcagtctcatgccttttggagcg

SEQ ID NO: 576826 - DNA, 25 bp, Mus musculus
catcagtctggacggtgtgcacgtc

SEQ ID NO: 576827 - DNA, 25 bp, Mus musculus
catcagtctggagggtgtgcacgtc

SEQ ID NO: 576828 - DNA, 25 bp, Mus musculus
catcagtgatccagacctgggcttc

SEQ ID NO: 576829 - DNA, 25 bp, Mus musculus
catcagtgatcctgacctgggcttc

SEQ ID NO: 576830 - DNA, 25 bp, Mus musculus
catcagtgctatcgctcggagctgg

SEQ ID NO: 576831 - DNA, 25 bp, Mus musculus
catcagtgctatggctcggagctgg

SEQ ID NO: 576832 - DNA, 25 bp, Mus musculus
catcagtgctgacattgctgatcaa

SEQ ID NO: 576833 - DNA, 25 bp, Mus musculus
catcagtgctgagattgctgatcaa

SEQ ID NO: 576834 - DNA, 25 bp, Mus musculus
catcagtggagtcttcgccaccaag

SEQ ID NO: 576835 - DNA, 25 bp, Mus musculus
catcagtggagtgttcgccaccaag

SEQ ID NO: 576836 - DNA, 25 bp, Mus musculus
catcagtggatccaagtggatgccc

SEQ ID NO: 576837 - DNA, 25 bp, Mus musculus
catcagtggatcgaagtggatgccc

SEQ ID NO: 576838 - DNA, 25 bp, Mus musculus
catcagtggcaacagtttgctagcc

SEQ ID NO: 576839 - DNA, 25 bp, Mus musculus
catcagtggcaagagtttgctagcc

SEQ ID NO: 576840 - DNA, 25 bp, Mus musculus
catcagtggcggatggagataaacg

SEQ ID NO: 576841 - DNA, 25 bp, Mus musculus
catcagtggcggttggagataaacg

SEQ ID NO: 576842 - DNA, 25 bp, Mus musculus
catcagtggctgatgacagatttaa

SEQ ID NO: 576843 - DNA, 25 bp, Mus musculus
catcagtggctgttgacagatttaa

SEQ ID NO: 576844 - DNA, 25 bp, Mus musculus
catcagtgggctcccaaggaccatg

SEQ ID NO: 576845 - DNA, 25 bp, Mus musculus
catcagtgggctgccaaggaccatg

SEQ ID NO: 576846 - DNA, 25 bp, Mus musculus
catcagtggtgcaaaggagatctgc

SEQ ID NO: 576847 - DNA, 25 bp, Mus musculus
catcagtggtgctaaggagatctgc

SEQ ID NO: 576848 - DNA, 25 bp, Mus musculus
catcagtgtcgccaggagcttcaaa

SEQ ID NO: 576849 - DNA, 25 bp, Mus musculus
catcagtgtcgcgaggagcttcaaa

SEQ ID NO: 576850 - DNA, 25 bp, Mus musculus
catcagtgtgatcttcgagttcctg

SEQ ID NO: 576851 - DNA, 25 bp, Mus musculus
catcagtgtgatgttcgagttcctg

SEQ ID NO: 576852 - DNA, 25 bp, Mus musculus
catcagttgctcaaaggtagtaacc

SEQ ID NO: 576853 - DNA, 25 bp, Mus musculus
catcagttgctctaaggtagtaacc

SEQ ID NO: 576854 - DNA, 25 bp, Mus musculus
catcagtttggtctgtgaagctgtg

SEQ ID NO: 576855 - DNA, 25 bp, Mus musculus
catcagtttggtgtgtgaagctgtg

SEQ ID NO: 576856 - DNA, 25 bp, Mus musculus
catcataataagacagggcaagggc

SEQ ID NO: 576857 - DNA, 25 bp, Mus musculus
catcataataagtcagggcaagggc

SEQ ID NO: 576858 - DNA, 25 bp, Mus musculus
catcataatgccagtggctccccag

SEQ ID NO: 576859 - DNA, 25 bp, Mus musculus
catcataatgcctgtggctccccag

SEQ ID NO: 576860 - DNA, 25 bp, Mus musculus
catcatacaagaatgcagcttctgc

SEQ ID NO: 576861 - DNA, 25 bp, Mus musculus
catcatacaagattgcagcttctgc

SEQ ID NO: 576862 - DNA, 25 bp, Mus musculus
catcatagaagaagtgactcacccc

SEQ ID NO: 576863 - DNA, 25 bp, Mus musculus
catcatagaagatgtgactcacccc

SEQ ID NO: 576864 - DNA, 25 bp, Mus musculus
catcatagagacaaagttctttgac

SEQ ID NO: 576865 - DNA, 25 bp, Mus musculus
catcatagagacagatgaggagcag

SEQ ID NO: 576866 - DNA, 25 bp, Mus musculus
catcatagagactaagttctttgac

SEQ ID NO: 576867 - DNA, 25 bp, Mus musculus
catcatagagactgatgaggagcag

SEQ ID NO: 576868 - DNA, 25 bp, Mus musculus
catcatatatgtcgaagcctctgga

SEQ ID NO: 576869 - DNA, 25 bp, Mus musculus
catcatatatgtggaagcctctgga

SEQ ID NO: 576870 - DNA, 25 bp, Mus musculus
catcatatggagaggtagaagtctt

SEQ ID NO: 576871 - DNA, 25 bp, Mus musculus
catcatatggagtggtagaagtctt

SEQ ID NO: 576872 - DNA, 25 bp, Mus musculus
catcatcaatctcctagagacagtg

SEQ ID NO: 576873 - DNA, 25 bp, Mus musculus
catcatcaatctgctagagacagtg

SEQ ID NO: 576874 - DNA, 25 bp, Mus musculus
catcatcaccgtctttgtgactgtg

SEQ ID NO: 576875 - DNA, 25 bp, Mus musculus
catcatcaccgtgtttgtgactgtg

SEQ ID NO: 576876 - DNA, 25 bp, Mus musculus
catcatcagcagatggcggatccag

SEQ ID NO: 576877 - DNA, 25 bp, Mus musculus
catcatcagcagttggcggatccag

SEQ ID NO: 576878 - DNA, 25 bp, Mus musculus
catcatcagccactagaaaactggg

SEQ ID NO: 576879 - DNA, 25 bp, Mus musculus
catcatcagccagtagaaaactggg

SEQ ID NO: 576880 - DNA, 25 bp, Mus musculus
catcatcaggcccttaacttcaaca

SEQ ID NO: 576881 - DNA, 25 bp, Mus musculus
catcatcaggccgttaacttcaaca

SEQ ID NO: 576882 - DNA, 25 bp, Mus musculus
catcatcagtatccttgtctctgcc

SEQ ID NO: 576883 - DNA, 25 bp, Mus musculus
catcatcagtatgcttgtctctgcc

SEQ ID NO: 576884 - DNA, 25 bp, Mus musculus
catcatcagttaagacggagtcagt

SEQ ID NO: 576885 - DNA, 25 bp, Mus musculus
catcatcagttatgacggagtcagt

SEQ ID NO: 576886 - DNA, 25 bp, Mus musculus
catcatcatcgtccaacgcttcaag

SEQ ID NO: 576887 - DNA, 25 bp, Mus musculus
catcatcatcgtgcaacgcttcaag

SEQ ID NO: 576888 - DNA, 25 bp, Mus musculus
catcatccaagtctgaaggttctcc

SEQ ID NO: 576889 - DNA, 25 bp, Mus musculus
catcatccaagtgtgaaggttctcc

SEQ ID NO: 576890 - DNA, 25 bp, Mus musculus
catcatccacatcctgtttggagtc

SEQ ID NO: 576891 - DNA, 25 bp, Mus musculus
catcatccacatgctgtttggagtc

SEQ ID NO: 576892 - DNA, 25 bp, Mus musculus
catcatccacgtaccagcagaacag

SEQ ID NO: 576893 - DNA, 25 bp, Mus musculus
catcatccacgttccagcagaacag

SEQ ID NO: 576894 - DNA, 25 bp, Mus musculus
catcatccactgatgtgtgcaggcc

SEQ ID NO: 576895 - DNA, 25 bp, Mus musculus
catcatccactgttgtgtgcaggcc

SEQ ID NO: 576896 - DNA, 25 bp, Mus musculus
catcatccagaaacttccttggaag

SEQ ID NO: 576897 - DNA, 25 bp, Mus musculus
catcatccagaatcttccttggaag

SEQ ID NO: 576898 - DNA, 25 bp, Mus musculus
catcatcccagtcgttatggctggg

SEQ ID NO: 576899 - DNA, 25 bp, Mus musculus
catcatcccagtggttatggctggg

SEQ ID NO: 576900 - DNA, 25 bp, Mus musculus
catcatcccctaagcaggaatcgac

SEQ ID NO: 576901 - DNA, 25 bp, Mus musculus
catcatcccctatgcaggaatcgac

SEQ ID NO: 576902 - DNA, 25 bp, Mus musculus
catcatccgcataggcacttcaggc

SEQ ID NO: 576903 - DNA, 25 bp, Mus musculus
catcatccgcattggcacttcaggc

SEQ ID NO: 576904 - DNA, 25 bp, Mus musculus
catcatcctcccacttgggagaatt

SEQ ID NO: 576905 - DNA, 25 bp, Mus musculus
catcatcctccctcttgggagaatt

SEQ ID NO: 576906 - DNA, 25 bp, Mus musculus
catcatcctggacgacgagctgatc

SEQ ID NO: 576907 - DNA, 25 bp, Mus musculus
catcatcctggaggacgagctgatc

SEQ ID NO: 576908 - DNA, 25 bp, Mus musculus
catcatcctttgcagctccatcggg

SEQ ID NO: 576909 - DNA, 25 bp, Mus musculus
catcatcctttggagctccatcggg

SEQ ID NO: 576910 - DNA, 25 bp, Mus musculus
catcatcgacatcgacgccgtgtgc

SEQ ID NO: 576911 - DNA, 25 bp, Mus musculus
catcatcgacatggacgccgtgtgc

SEQ ID NO: 576912 - DNA, 25 bp, Mus musculus
catcatcgcagacggtgccattgac

SEQ ID NO: 576913 - DNA, 25 bp, Mus musculus
catcatcgcagagggtgccattgac

SEQ ID NO: 576914 - DNA, 25 bp, Mus musculus
catcatcggtagagcgcgctgcaaa

SEQ ID NO: 576915 - DNA, 25 bp, Mus musculus
catcatcggtagtgcgcgctgcaaa

SEQ ID NO: 576916 - DNA, 25 bp, Mus musculus
catcatcgtcatcgaaagccttgcc

SEQ ID NO: 576917 - DNA, 25 bp, Mus musculus
catcatcgtcatggaaagccttgcc

SEQ ID NO: 576918 - DNA, 25 bp, Mus musculus
catcatcgtcctcaggactaacaag

SEQ ID NO: 576919 - DNA, 25 bp, Mus musculus
catcatcgtcctgaggactaacaag

SEQ ID NO: 576920 - DNA, 25 bp, Mus musculus
catcatcgtggacggacacagcgtg

SEQ ID NO: 576921 - DNA, 25 bp, Mus musculus
catcatcgtggagggacacagcgtg

SEQ ID NO: 576922 - DNA, 25 bp, Mus musculus
catcatcgtgggagtctgcctgggc

SEQ ID NO: 576923 - DNA, 25 bp, Mus musculus
catcatcgtgggtgtctgcctgggc

SEQ ID NO: 576924 - DNA, 25 bp, Mus musculus
catcatctactccttcgtcttctgg

SEQ ID NO: 576925 - DNA, 25 bp, Mus musculus
catcatctactcgttcgtcttctgg

SEQ ID NO: 576926 - DNA, 25 bp, Mus musculus
catcatctctgtagacatctctgtg

SEQ ID NO: 576927 - DNA, 25 bp, Mus musculus
catcatctctgttgacatctctgtg

SEQ ID NO: 576928 - DNA, 25 bp, Mus musculus
catcatctgagccaggtgcagaata

SEQ ID NO: 576929 - DNA, 25 bp, Mus musculus
catcatctgagcgaggtgcagaata

SEQ ID NO: 576930 - DNA, 25 bp, Mus musculus
catcatctgcctatgatagtaaaga

SEQ ID NO: 576931 - DNA, 25 bp, Mus musculus
catcatctgcctttgatagtaaaga

SEQ ID NO: 576932 - DNA, 25 bp, Mus musculus
catcatctgggacagttataccaca

SEQ ID NO: 576933 - DNA, 25 bp, Mus musculus
catcatctgggagagttataccaca

SEQ ID NO: 576934 - DNA, 25 bp, Mus musculus
catcatcttaggaagcccaatggaa

SEQ ID NO: 576935 - DNA, 25 bp, Mus musculus
catcatcttaggtagcccaatggaa

SEQ ID NO: 576936 - DNA, 25 bp, Mus musculus
catcatcttcatcctgtttggctgt

SEQ ID NO: 576937 - DNA, 25 bp, Mus musculus
catcatcttcatgctgtttggctgt

SEQ ID NO: 576938 - DNA, 25 bp, Mus musculus
catcatcttgctcacagctggacaa

SEQ ID NO: 576939 - DNA, 25 bp, Mus musculus
catcatcttgctgacagctggacaa

SEQ ID NO: 576940 - DNA, 25 bp, Mus musculus
catcatcttggcatctctcctggca

SEQ ID NO: 576941 - DNA, 25 bp, Mus musculus
catcatcttggcttctctcctggca

SEQ ID NO: 576942 - DNA, 25 bp, Mus musculus
catcatctttagatatgaatcggac

SEQ ID NO: 576943 - DNA, 25 bp, Mus musculus
catcatctttagttatgaatcggac

SEQ ID NO: 576944 - DNA, 25 bp, Mus musculus
catcatctttcactaccgggccagt

SEQ ID NO: 576945 - DNA, 25 bp, Mus musculus
catcatctttcagtaccgggccagt

SEQ ID NO: 576946 - DNA, 25 bp, Mus musculus
catcatctttgaagaaatcgatgcc

SEQ ID NO: 576947 - DNA, 25 bp, Mus musculus
catcatctttgactactacgttggc

SEQ ID NO: 576948 - DNA, 25 bp, Mus musculus
catcatctttgagtactacgttggc

SEQ ID NO: 576949 - DNA, 25 bp, Mus musculus
catcatctttgatgaaatcgatgcc

SEQ ID NO: 576950 - DNA, 25 bp, Mus musculus
catcatgaaaatcctaaggagcttg

SEQ ID NO: 576951 - DNA, 25 bp, Mus musculus
catcatgaaaatgctaaggagcttg

SEQ ID NO: 576952 - DNA, 25 bp, Mus musculus
catcatgaacccagcacagagttac

SEQ ID NO: 576953 - DNA, 25 bp, Mus musculus
catcatgaaccctgcacagagttac

SEQ ID NO: 576954 - DNA, 25 bp, Mus musculus
catcatgaagccacttgatcacaag

SEQ ID NO: 576955 - DNA, 25 bp, Mus musculus
catcatgaagccagaggagatttca

SEQ ID NO: 576956 - DNA, 25 bp, Mus musculus
catcatgaagcctcttgatcacaag

SEQ ID NO: 576957 - DNA, 25 bp, Mus musculus
catcatgaagcctgaggagatttca

SEQ ID NO: 576958 - DNA, 25 bp, Mus musculus
catcatgaatgcatcagctgatgaa

SEQ ID NO: 576959 - DNA, 25 bp, Mus musculus
catcatgaatgcttcagctgatgaa

SEQ ID NO: 576960 - DNA, 25 bp, Mus musculus
catcatgacagtcctcgagcgggac

SEQ ID NO: 576961 - DNA, 25 bp, Mus musculus
catcatgacagtgctcgagcgggac

SEQ ID NO: 576962 - DNA, 25 bp, Mus musculus
catcatgagagaaaagatgcccaaa

SEQ ID NO: 576963 - DNA, 25 bp, Mus musculus
catcatgagagataagatgcccaaa

SEQ ID NO: 576964 - DNA, 25 bp, Mus musculus
catcatgagagcaatggctttgcgg

SEQ ID NO: 576965 - DNA, 25 bp, Mus musculus
catcatgagagctatggctttgcgg

SEQ ID NO: 576966 - DNA, 25 bp, Mus musculus
catcatgagggcctggatcttcttt

SEQ ID NO: 576967 - DNA, 25 bp, Mus musculus
catcatgagggcgtggatcttcttt

SEQ ID NO: 576968 - DNA, 25 bp, Mus musculus
catcatgagtaaccagtacggcagc

SEQ ID NO: 576969 - DNA, 25 bp, Mus musculus
catcatgagtaagcagtacggcagc

SEQ ID NO: 576970 - DNA, 25 bp, Mus musculus
catcatgataggaggttctaacaac

SEQ ID NO: 576971 - DNA, 25 bp, Mus musculus
catcatgataggtggttctaacaac

SEQ ID NO: 576972 - DNA, 25 bp, Mus musculus
catcatgatatcaggcaatgtcttg

SEQ ID NO: 576973 - DNA, 25 bp, Mus musculus
catcatgatatctggcaatgtcttg

SEQ ID NO: 576974 - DNA, 25 bp, Mus musculus
catcatgatgaaagtggtaaagggc

SEQ ID NO: 576975 - DNA, 25 bp, Mus musculus
catcatgatgaatgtggtaaagggc

SEQ ID NO: 576976 - DNA, 25 bp, Mus musculus
catcatgattgtcaggagggccatc

SEQ ID NO: 576977 - DNA, 25 bp, Mus musculus
catcatgattgtgaggagggccatc

SEQ ID NO: 576978 - DNA, 25 bp, Mus musculus
catcatgccccgactgagtgaggag

SEQ ID NO: 576979 - DNA, 25 bp, Mus musculus
catcatgccccgtctgagtgaggag

SEQ ID NO: 576980 - DNA, 25 bp, Mus musculus
catcatgcggcacggaaagggccaa

SEQ ID NO: 576981 - DNA, 25 bp, Mus musculus
catcatgcggcagggaaagggccaa

SEQ ID NO: 576982 - DNA, 25 bp, Mus musculus
catcatgctaatctgcaatgccaaa

SEQ ID NO: 576983 - DNA, 25 bp, Mus musculus
catcatgctaatgtgcaatgccaaa

SEQ ID NO: 576984 - DNA, 25 bp, Mus musculus
catcatgctcatagaagtgtacttc

SEQ ID NO: 576985 - DNA, 25 bp, Mus musculus
catcatgctcattgaagtgtacttc

SEQ ID NO: 576986 - DNA, 25 bp, Mus musculus
catcatgctgcacctgtttgatgag

SEQ ID NO: 576987 - DNA, 25 bp, Mus musculus
catcatgctgcagctgtttgatgag

SEQ ID NO: 576988 - DNA, 25 bp, Mus musculus
catcatgctggtcgaagagggcttc

SEQ ID NO: 576989 - DNA, 25 bp, Mus musculus
catcatgctggtggaagagggcttc

SEQ ID NO: 576990 - DNA, 25 bp, Mus musculus
catcatgctttgctacagaagcgcc

SEQ ID NO: 576991 - DNA, 25 bp, Mus musculus
catcatgctttggtacagaagcgcc

SEQ ID NO: 576992 - DNA, 25 bp, Mus musculus
catcatggaagaaacctaaaggatc

SEQ ID NO: 576993 - DNA, 25 bp, Mus musculus
catcatggaagatacctaaaggatc

SEQ ID NO: 576994 - DNA, 25 bp, Mus musculus
catcatggaccaactcatcgcgctg

SEQ ID NO: 576995 - DNA, 25 bp, Mus musculus
catcatggaccatctcatcgcgctg

SEQ ID NO: 576996 - DNA, 25 bp, Mus musculus
catcatggacgaccccactgctggt

SEQ ID NO: 576997 - DNA, 25 bp, Mus musculus
catcatggacgagcccactgctggt

SEQ ID NO: 576998 - DNA, 25 bp, Mus musculus
catcatggagaaaatccgatttggg

SEQ ID NO: 576999 - DNA, 25 bp, Mus musculus
catcatggagaatatccgatttggg

SEQ ID NO: 577000 - DNA, 25 bp, Mus musculus
catcatggagagagttcaggaagca

SEQ ID NO: 577001 - DNA, 25 bp, Mus musculus
catcatggagagtgttcaggaagca

SEQ ID NO: 577002 - DNA, 25 bp, Mus musculus
catcatggagttacacccagaggac

SEQ ID NO: 577003 - DNA, 25 bp, Mus musculus
catcatggagtttcacccagaggac

SEQ ID NO: 577004 - DNA, 25 bp, Mus musculus
catcatggatgtctataagttggcg

SEQ ID NO: 577005 - DNA, 25 bp, Mus musculus
catcatggatgtgtataagttggcg

SEQ ID NO: 577006 - DNA, 25 bp, Mus musculus
catcatggcagaccgcaacgtgctg

SEQ ID NO: 577007 - DNA, 25 bp, Mus musculus
catcatggcagagcgcaacgtgctg

SEQ ID NO: 577008 - DNA, 25 bp, Mus musculus
catcatggcaggaattgcatttggc

SEQ ID NO: 577009 - DNA, 25 bp, Mus musculus
catcatggcaggtattgcatttggc

SEQ ID NO: 577010 - DNA, 25 bp, Mus musculus
catcatggcggacatgattactggg

SEQ ID NO: 577011 - DNA, 25 bp, Mus musculus
catcatggcggaccctagagataag

SEQ ID NO: 577012 - DNA, 25 bp, Mus musculus
catcatggcggagatgattactggg

SEQ ID NO: 577013 - DNA, 25 bp, Mus musculus
catcatggcggagcctagagataag

SEQ ID NO: 577014 - DNA, 25 bp, Mus musculus
catcatggctgacctgttgaccgga

SEQ ID NO: 577015 - DNA, 25 bp, Mus musculus
catcatggctgagctgttgaccgga

SEQ ID NO: 577016 - DNA, 25 bp, Mus musculus
catcatggcttcaagagtctctgaa

SEQ ID NO: 577017 - DNA, 25 bp, Mus musculus
catcatggcttctagagtctctgaa

SEQ ID NO: 577018 - DNA, 25 bp, Mus musculus
catcatgggaagcattaaatactca

SEQ ID NO: 577019 - DNA, 25 bp, Mus musculus
catcatgggaaggattaaatactca

SEQ ID NO: 577020 - DNA, 25 bp, Mus musculus
catcatgggcgtcaatgtgggtact

SEQ ID NO: 577021 - DNA, 25 bp, Mus musculus
catcatgggcgtgaatgtgggtact

SEQ ID NO: 577022 - DNA, 25 bp, Mus musculus
catcatggtattccccttactaaaa

SEQ ID NO: 577023 - DNA, 25 bp, Mus musculus
catcatggtattgcccttactaaaa

SEQ ID NO: 577024 - DNA, 25 bp, Mus musculus
catcatggtgagaatcaggagagct

SEQ ID NO: 577025 - DNA, 25 bp, Mus musculus
catcatggtgagtatcaggagagct

SEQ ID NO: 577026 - DNA, 25 bp, Mus musculus
catcatgtcagccaaggacgagcgg

SEQ ID NO: 577027 - DNA, 25 bp, Mus musculus
catcatgtcagcgaaggacgagcgg

SEQ ID NO: 577028 - DNA, 25 bp, Mus musculus
catcatgtggatcgacagcctgctg

SEQ ID NO: 577029 - DNA, 25 bp, Mus musculus
catcatgtggatggacagcctgctg

SEQ ID NO: 577030 - DNA, 25 bp, Mus musculus
catcatgttgataaattggaccgtc

SEQ ID NO: 577031 - DNA, 25 bp, Mus musculus
catcatgttgattaattggaccgtc

SEQ ID NO: 577032 - DNA, 25 bp, Mus musculus
catcattatgaactactcagtgaaa

SEQ ID NO: 577033 - DNA, 25 bp, Mus musculus
catcattatgaagtactcagtgaaa

SEQ ID NO: 577034 - DNA, 25 bp, Mus musculus
catcattcagatacttcagtctcaa

SEQ ID NO: 577035 - DNA, 25 bp, Mus musculus
catcattcagattcttcagtctcaa

SEQ ID NO: 577036 - DNA, 25 bp, Mus musculus
catcattcccgtaattgccaagtca

SEQ ID NO: 577037 - DNA, 25 bp, Mus musculus
catcattcccgttattgccaagtca

SEQ ID NO: 577038 - DNA, 25 bp, Mus musculus
catcattctggccagtggtggaccc

SEQ ID NO: 577039 - DNA, 25 bp, Mus musculus
catcattctggcgagtggtggaccc

SEQ ID NO: 577040 - DNA, 25 bp, Mus musculus
catcattgacaaaaagcgttacctc

SEQ ID NO: 577041 - DNA, 25 bp, Mus musculus
catcattgacaataagcgttacctc

SEQ ID NO: 577042 - DNA, 25 bp, Mus musculus
catcattgaggaagacatgaggccc

SEQ ID NO: 577043 - DNA, 25 bp, Mus musculus
catcattgaggatgacatgaggccc

SEQ ID NO: 577044 - DNA, 25 bp, Mus musculus
catcattgatgtcgtgggtgcaccc

SEQ ID NO: 577045 - DNA, 25 bp, Mus musculus
catcattgatgtggtgggtgcaccc

SEQ ID NO: 577046 - DNA, 25 bp, Mus musculus
catcattggaggagtcattgctgtg

SEQ ID NO: 577047 - DNA, 25 bp, Mus musculus
catcattggaggcattgtggctttc

SEQ ID NO: 577048 - DNA, 25 bp, Mus musculus
catcattggagggattgtggctttc

SEQ ID NO: 577049 - DNA, 25 bp, Mus musculus
catcattggaggtgtcattgctgtg

SEQ ID NO: 577050 - DNA, 25 bp, Mus musculus
catcattggtgacaagtcgttccgg

SEQ ID NO: 577051 - DNA, 25 bp, Mus musculus
catcattggtgagaagtcgttccgg

SEQ ID NO: 577052 - DNA, 25 bp, Mus musculus
catcattgtacaccaattcaccaag

SEQ ID NO: 577053 - DNA, 25 bp, Mus musculus
catcattgtacagcaattcaccaag

SEQ ID NO: 577054 - DNA, 25 bp, Mus musculus
catcattgtcatcgccaatggccaa

SEQ ID NO: 577055 - DNA, 25 bp, Mus musculus
catcattgtcatggccaatggccaa

SEQ ID NO: 577056 - DNA, 25 bp, Mus musculus
catcattgtgttcctctgtgaattc

SEQ ID NO: 577057 - DNA, 25 bp, Mus musculus
catcattgtgttgctctgtgaattc

SEQ ID NO: 577058 - DNA, 25 bp, Mus musculus
catcattgttcaagactggtctgcc

SEQ ID NO: 577059 - DNA, 25 bp, Mus musculus
catcattgttcatgactggtctgcc

SEQ ID NO: 577060 - DNA, 25 bp, Mus musculus
catcatttgtataccggacatttga

SEQ ID NO: 577061 - DNA, 25 bp, Mus musculus
catcatttgtattccggacatttga

SEQ ID NO: 577062 - DNA, 25 bp, Mus musculus
catcattttctccaacggtgaccta

SEQ ID NO: 577063 - DNA, 25 bp, Mus musculus
catcattttctcgaacggtgaccta

SEQ ID NO: 577064 - DNA, 25 bp, Mus musculus
catccaaagattcattcagtgctca

SEQ ID NO: 577065 - DNA, 25 bp, Mus musculus
catccaaagattgattcagtgctca

SEQ ID NO: 577066 - DNA, 25 bp, Mus musculus
catccaaagtaccaagagactgcct

SEQ ID NO: 577067 - DNA, 25 bp, Mus musculus
catccaaagtacgaagagactgcct

SEQ ID NO: 577068 - DNA, 25 bp, Mus musculus
catccaaagtgcaccgtggagactc

SEQ ID NO: 577069 - DNA, 25 bp, Mus musculus
catccaaagtgctccgtggagactc

SEQ ID NO: 577070 - DNA, 25 bp, Mus musculus
catccaaccttgaaaactctgcagc

SEQ ID NO: 577071 - DNA, 25 bp, Mus musculus
catccaaccttgtaaactctgcagc

SEQ ID NO: 577072 - DNA, 25 bp, Mus musculus
catccaagacacagagggtaacact

SEQ ID NO: 577073 - DNA, 25 bp, Mus musculus
catccaagacactgagggtaacact

SEQ ID NO: 577074 - DNA, 25 bp, Mus musculus
catccaagcaaaagaagaactgtgg

SEQ ID NO: 577075 - DNA, 25 bp, Mus musculus
catccaagcaaatgaagaactgtgg

SEQ ID NO: 577076 - DNA, 25 bp, Mus musculus
catccaaggaagatgctcggcttca

SEQ ID NO: 577077 - DNA, 25 bp, Mus musculus
catccaaggaagttgctcggcttca

SEQ ID NO: 577078 - DNA, 25 bp, Mus musculus
catccaaggtttagcaaggcgacga

SEQ ID NO: 577079 - DNA, 25 bp, Mus musculus
catccaaggttttgcaaggcgacga

SEQ ID NO: 577080 - DNA, 25 bp, Mus musculus
catccaatcaatcaagaaagagtat

SEQ ID NO: 577081 - DNA, 25 bp, Mus musculus
catccaatcaatgaagaaagagtat

SEQ ID NO: 577082 - DNA, 25 bp, Mus musculus
catccaatccggatctctcggtcga

SEQ ID NO: 577083 - DNA, 25 bp, Mus musculus
catccaatccggttctctcggtcga

SEQ ID NO: 577084 - DNA, 25 bp, Mus musculus
catccaatgcatcaacagttatcag

SEQ ID NO: 577085 - DNA, 25 bp, Mus musculus
catccaatgcatgaacagttatcag

SEQ ID NO: 577086 - DNA, 25 bp, Mus musculus
catccaatggcacaaggctttctgc

SEQ ID NO: 577087 - DNA, 25 bp, Mus musculus
catccaatggcagaaggctttctgc

SEQ ID NO: 577088 - DNA, 25 bp, Mus musculus
catccaatggccaaatggaattaca

SEQ ID NO: 577089 - DNA, 25 bp, Mus musculus
catccaatggcctaatggaattaca

SEQ ID NO: 577090 - DNA, 25 bp, Mus musculus
catccacaaggacgcccagaggatc

SEQ ID NO: 577091 - DNA, 25 bp, Mus musculus
catccacaaggaggcccagaggatc

SEQ ID NO: 577092 - DNA, 25 bp, Mus musculus
catccacacacaaaatcacgctagt

SEQ ID NO: 577093 - DNA, 25 bp, Mus musculus
catccacacacataatcacgctagt

SEQ ID NO: 577094 - DNA, 25 bp, Mus musculus
catccacacagccatgaagttttcc

SEQ ID NO: 577095 - DNA, 25 bp, Mus musculus
catccacacagcgatgaagttttcc

SEQ ID NO: 577096 - DNA, 25 bp, Mus musculus
catccacactgtcccagaaggcagg

SEQ ID NO: 577097 - DNA, 25 bp, Mus musculus
catccacactgtgccagaaggcagg

SEQ ID NO: 577098 - DNA, 25 bp, Mus musculus
catccacatgggattagaatagccg

SEQ ID NO: 577099 - DNA, 25 bp, Mus musculus
catccacatgggtttagaatagccg

SEQ ID NO: 577100 - DNA, 25 bp, Mus musculus
catccacccaacatgcggaacgtgt

SEQ ID NO: 577101 - DNA, 25 bp, Mus musculus
catccacccaacttgcggaacgtgt

SEQ ID NO: 577102 - DNA, 25 bp, Mus musculus
catccaccgaagaggtcggactgcc

SEQ ID NO: 577103 - DNA, 25 bp, Mus musculus
catccaccgaagtggtcggactgcc

SEQ ID NO: 577104 - DNA, 25 bp, Mus musculus
catccaccgagtagcagacatttct

SEQ ID NO: 577105 - DNA, 25 bp, Mus musculus
catccaccgagttgcagacatttct

SEQ ID NO: 577106 - DNA, 25 bp, Mus musculus
catccaccgataagaacatggtcgc

SEQ ID NO: 577107 - DNA, 25 bp, Mus musculus
catccaccgatatgaacatggtcgc

SEQ ID NO: 577108 - DNA, 25 bp, Mus musculus
catccacctgggactgaagagaagt

SEQ ID NO: 577109 - DNA, 25 bp, Mus musculus
catccacctgggtctgaagagaagt

SEQ ID NO: 577110 - DNA, 25 bp, Mus musculus
catccaccttagctcaaagggtgaa

SEQ ID NO: 577111 - DNA, 25 bp, Mus musculus
catccaccttaggtcaaagggtgaa

SEQ ID NO: 577112 - DNA, 25 bp, Mus musculus
catccacgatttcctcaaatatgag

SEQ ID NO: 577113 - DNA, 25 bp, Mus musculus
catccacgatttgctcaaatatgag

SEQ ID NO: 577114 - DNA, 25 bp, Mus musculus
catccacgctgaaatctgcttttta

SEQ ID NO: 577115 - DNA, 25 bp, Mus musculus
catccacgctgatatctgcttttta

SEQ ID NO: 577116 - DNA, 25 bp, Mus musculus
catccacgctgtcctgtttcaaata

SEQ ID NO: 577117 - DNA, 25 bp, Mus musculus
catccacgctgtgctgtttcaaata

SEQ ID NO: 577118 - DNA, 25 bp, Mus musculus
catccacgcttcaatgtcaacagaa

SEQ ID NO: 577119 - DNA, 25 bp, Mus musculus
catccacgcttctatgtcaacagaa

SEQ ID NO: 577120 - DNA, 25 bp, Mus musculus
catccacggtataggttgcatgctg

SEQ ID NO: 577121 - DNA, 25 bp, Mus musculus
catccacggtattggttgcatgctg

SEQ ID NO: 577122 - DNA, 25 bp, Mus musculus
catccactacccagcagatgagggc

SEQ ID NO: 577123 - DNA, 25 bp, Mus musculus
catccactaccctgcagatgagggc

SEQ ID NO: 577124 - DNA, 25 bp, Mus musculus
catccactgtccacatgatgggcag

SEQ ID NO: 577125 - DNA, 25 bp, Mus musculus
catccactgtcctcatgatgggcag

SEQ ID NO: 577126 - DNA, 25 bp, Mus musculus
catccagaaaagagcgctgccagtt

SEQ ID NO: 577127 - DNA, 25 bp, Mus musculus
catccagaaaagtgcgctgccagtt

SEQ ID NO: 577128 - DNA, 25 bp, Mus musculus
catccagaaactaccttggaagaaa

SEQ ID NO: 577129 - DNA, 25 bp, Mus musculus
catccagaaacttccttggaagaaa

SEQ ID NO: 577130 - DNA, 25 bp, Mus musculus
catccagaagctccgctataaggtg

SEQ ID NO: 577131 - DNA, 25 bp, Mus musculus
catccagaagctgcgctataaggtg

SEQ ID NO: 577132 - DNA, 25 bp, Mus musculus
catccagaagtacgcaacggaagag

SEQ ID NO: 577133 - DNA, 25 bp, Mus musculus
catccagaagtaggcaacggaagag

SEQ ID NO: 577134 - DNA, 25 bp, Mus musculus
catccagaatctagacaaggcccgg

SEQ ID NO: 577135 - DNA, 25 bp, Mus musculus
catccagaatcttgacaaggcccgg

SEQ ID NO: 577136 - DNA, 25 bp, Mus musculus
catccagacaagaaccatgcgcctg

SEQ ID NO: 577137 - DNA, 25 bp, Mus musculus
catccagacaagtaccatgcgcctg

SEQ ID NO: 577138 - DNA, 25 bp, Mus musculus
catccagacactctttagtaaactt

SEQ ID NO: 577139 - DNA, 25 bp, Mus musculus
catccagacactgtttagtaaactt

SEQ ID NO: 577140 - DNA, 25 bp, Mus musculus
catccagagtgacgtggagaacctg

SEQ ID NO: 577141 - DNA, 25 bp, Mus musculus
catccagagtgaggtggagaacctg

SEQ ID NO: 577142 - DNA, 25 bp, Mus musculus
catccagatagcacacagtttgtat

SEQ ID NO: 577143 - DNA, 25 bp, Mus musculus
catccagatagctcacagtttgtat

SEQ ID NO: 577144 - DNA, 25 bp, Mus musculus
catccagatcaacgtgatgacccca

SEQ ID NO: 577145 - DNA, 25 bp, Mus musculus
catccagatcaaggtgatgacccca

SEQ ID NO: 577146 - DNA, 25 bp, Mus musculus
catccagcacttcgcgggcagagtg

SEQ ID NO: 577147 - DNA, 25 bp, Mus musculus
catccagcacttggcgggcagagtg

SEQ ID NO: 577148 - DNA, 25 bp, Mus musculus
catccagcagacatggaacaggaca

SEQ ID NO: 577149 - DNA, 25 bp, Mus musculus
catccagcagacttggaacaggaca

SEQ ID NO: 577150 - DNA, 25 bp, Mus musculus
catccagcagagacttccaaggagg

SEQ ID NO: 577151 - DNA, 25 bp, Mus musculus
catccagcagagtcttccaaggagg

SEQ ID NO: 577152 - DNA, 25 bp, Mus musculus
catccagcagatcgctgagggcgaa

SEQ ID NO: 577153 - DNA, 25 bp, Mus musculus
catccagcagatggctgagggcgaa

SEQ ID NO: 577154 - DNA, 25 bp, Mus musculus
catccagcagtgcttgctaaatgtt

SEQ ID NO: 577155 - DNA, 25 bp, Mus musculus
catccagcagtggttgctaaatgtt

SEQ ID NO: 577156 - DNA, 25 bp, Mus musculus
catccagccaggagatatagtcatg

SEQ ID NO: 577157 - DNA, 25 bp, Mus musculus
catccagccaggtgatatagtcatg

SEQ ID NO: 577158 - DNA, 25 bp, Mus musculus
catccagccttaaggcgaatggttt

SEQ ID NO: 577159 - DNA, 25 bp, Mus musculus
catccagccttatggcgaatggttt

SEQ ID NO: 577160 - DNA, 25 bp, Mus musculus
catccagctgagaagagctaaggaa

SEQ ID NO: 577161 - DNA, 25 bp, Mus musculus
catccagctgagtagagctaaggaa

SEQ ID NO: 577162 - DNA, 25 bp, Mus musculus
catccagctgtaagccaggatcaca

SEQ ID NO: 577163 - DNA, 25 bp, Mus musculus
catccagctgtatgccaggatcaca

SEQ ID NO: 577164 - DNA, 25 bp, Mus musculus
catccagctgttcgttcaagatctg

SEQ ID NO: 577165 - DNA, 25 bp, Mus musculus
catccagctgttggttcaagatctg

SEQ ID NO: 577166 - DNA, 25 bp, Mus musculus
catccaggaagacgtgacagctaga

SEQ ID NO: 577167 - DNA, 25 bp, Mus musculus
catccaggaagaggtgacagctaga

SEQ ID NO: 577168 - DNA, 25 bp, Mus musculus
catccaggacggagtatcaccaagt

SEQ ID NO: 577169 - DNA, 25 bp, Mus musculus
catccaggacggtgtatcaccaagt

SEQ ID NO: 577170 - DNA, 25 bp, Mus musculus
catccaggagcacctagtgtcagct

SEQ ID NO: 577171 - DNA, 25 bp, Mus musculus
catccaggagcagctagtgtcagct

SEQ ID NO: 577172 - DNA, 25 bp, Mus musculus
catccaggagttaggcctgcagttc

SEQ ID NO: 577173 - DNA, 25 bp, Mus musculus
catccaggagtttggcctgcagttc

SEQ ID NO: 577174 - DNA, 25 bp, Mus musculus
catccaggccctcaatgggcgctgg

SEQ ID NO: 577175 - DNA, 25 bp, Mus musculus
catccaggccctgaatgggcgctgg

SEQ ID NO: 577176 - DNA, 25 bp, Mus musculus
catccaggcctcagaaacagcatgg

SEQ ID NO: 577177 - DNA, 25 bp, Mus musculus
catccaggcctctgaaacagcatgg

SEQ ID NO: 577178 - DNA, 25 bp, Mus musculus
catccaggcctgctggcggtcttac

SEQ ID NO: 577179 - DNA, 25 bp, Mus musculus
catccaggcctggtggcggtcttac

SEQ ID NO: 577180 - DNA, 25 bp, Mus musculus
catccagggctgcatcgtcttgcag

SEQ ID NO: 577181 - DNA, 25 bp, Mus musculus
catccagggctggatcgtcttgcag

SEQ ID NO: 577182 - DNA, 25 bp, Mus musculus
catccaggtcctccatgcgtttgtg

SEQ ID NO: 577183 - DNA, 25 bp, Mus musculus
catccaggtcctgcatgcgtttgtg

SEQ ID NO: 577184 - DNA, 25 bp, Mus musculus
catccaggtcgcactgcattttcac

SEQ ID NO: 577185 - DNA, 25 bp, Mus musculus
catccaggtcgctctgcattttcac

SEQ ID NO: 577186 - DNA, 25 bp, Mus musculus
catccaggtcgtcgacttggcacca

SEQ ID NO: 577187 - DNA, 25 bp, Mus musculus
catccaggtcgtggacttggcacca

SEQ ID NO: 577188 - DNA, 25 bp, Mus musculus
catccaggtggcattcatcactctg

SEQ ID NO: 577189 - DNA, 25 bp, Mus musculus
catccaggtggctttcatcactctg

SEQ ID NO: 577190 - DNA, 25 bp, Mus musculus
catccagtatggagacgctgccctg

SEQ ID NO: 577191 - DNA, 25 bp, Mus musculus
catccagtatggtgacgctgccctg

SEQ ID NO: 577192 - DNA, 25 bp, Mus musculus
catccagtcccgctgtgcggtgctc

SEQ ID NO: 577193 - DNA, 25 bp, Mus musculus
catccagtcccggtgtgcggtgctc

SEQ ID NO: 577194 - DNA, 25 bp, Mus musculus
catccagtctatcatggccatcgtg

SEQ ID NO: 577195 - DNA, 25 bp, Mus musculus
catccagtctatgatggccatcgtg

SEQ ID NO: 577196 - DNA, 25 bp, Mus musculus
catccagtgatgagcgggacagcac

SEQ ID NO: 577197 - DNA, 25 bp, Mus musculus
catccagtgatgtgcgggacagcac

SEQ ID NO: 577198 - DNA, 25 bp, Mus musculus
catccagtgcaaagacgtcgatgag

SEQ ID NO: 577199 - DNA, 25 bp, Mus musculus
catccagtgcaatgacgtcgatgag

SEQ ID NO: 577200 - DNA, 25 bp, Mus musculus
catccagtgcgacactctggtctgc

SEQ ID NO: 577201 - DNA, 25 bp, Mus musculus
catccagtgcgagactctggtctgc

SEQ ID NO: 577202 - DNA, 25 bp, Mus musculus
catccagtggccagaatatgacaga

SEQ ID NO: 577203 - DNA, 25 bp, Mus musculus
catccagtggcctgaatatgacaga

SEQ ID NO: 577204 - DNA, 25 bp, Mus musculus
catccagtgtctcaatggcaagctg

SEQ ID NO: 577205 - DNA, 25 bp, Mus musculus
catccagtgtctcaccgtgcacaga

SEQ ID NO: 577206 - DNA, 25 bp, Mus musculus
catccagtgtctgaatggcaagctg

SEQ ID NO: 577207 - DNA, 25 bp, Mus musculus
catccagtgtctgaccgtgcacaga

SEQ ID NO: 577208 - DNA, 25 bp, Mus musculus
catccagttcctcatccatgttggg

SEQ ID NO: 577209 - DNA, 25 bp, Mus musculus
catccagttcctgatccatgttggg

SEQ ID NO: 577210 - DNA, 25 bp, Mus musculus
catccagtttccagggtggtccaag

SEQ ID NO: 577211 - DNA, 25 bp, Mus musculus
catccagtttcctgggtggtccaag

SEQ ID NO: 577212 - DNA, 25 bp, Mus musculus
catccagtttctccacgaagacgag

SEQ ID NO: 577213 - DNA, 25 bp, Mus musculus
catccagtttctgcacgaagacgag

SEQ ID NO: 577214 - DNA, 25 bp, Mus musculus
catccagtttgactttcagatcctc

SEQ ID NO: 577215 - DNA, 25 bp, Mus musculus
catccagtttgagtttcagatcctc

SEQ ID NO: 577216 - DNA, 25 bp, Mus musculus
catccagtttgcactacgaagaggc

SEQ ID NO: 577217 - DNA, 25 bp, Mus musculus
catccagtttgctctacgaagaggc

SEQ ID NO: 577218 - DNA, 25 bp, Mus musculus
catccataatccaaggtgttgcttt

SEQ ID NO: 577219 - DNA, 25 bp, Mus musculus
catccataatcctaggtgttgcttt

SEQ ID NO: 577220 - DNA, 25 bp, Mus musculus
catccatactttcagtcccttcggg

SEQ ID NO: 577221 - DNA, 25 bp, Mus musculus
catccatactttgagtcccttcggg

SEQ ID NO: 577222 - DNA, 25 bp, Mus musculus
catccataggtgagctccagttggt

SEQ ID NO: 577223 - DNA, 25 bp, Mus musculus
catccataggtgtgctccagttggt

SEQ ID NO: 577224 - DNA, 25 bp, Mus musculus
catccatagtaaaagatagttctgc

SEQ ID NO: 577225 - DNA, 25 bp, Mus musculus
catccatagtaatagatagttctgc

SEQ ID NO: 577226 - DNA, 25 bp, Mus musculus
catccatataataggagacatcaac

SEQ ID NO: 577227 - DNA, 25 bp, Mus musculus
catccatataattggagacatcaac

SEQ ID NO: 577228 - DNA, 25 bp, Mus musculus
catccatccaggctacggttttctt

SEQ ID NO: 577229 - DNA, 25 bp, Mus musculus
catccatccagggtacggttttctt

SEQ ID NO: 577230 - DNA, 25 bp, Mus musculus
catccatccataagaagaagtcagg

SEQ ID NO: 577231 - DNA, 25 bp, Mus musculus
catccatccatatgaagaagtcagg

SEQ ID NO: 577232 - DNA, 25 bp, Mus musculus
catccatccttcagacctatgtgta

SEQ ID NO: 577233 - DNA, 25 bp, Mus musculus
catccatccttctgacctatgtgta

SEQ ID NO: 577234 - DNA, 25 bp, Mus musculus
catccatgacagaagatggcttcac

SEQ ID NO: 577235 - DNA, 25 bp, Mus musculus
catccatgacagtagatggcttcac

SEQ ID NO: 577236 - DNA, 25 bp, Mus musculus
catccatgagaaatacaccaaggcc

SEQ ID NO: 577237 - DNA, 25 bp, Mus musculus
catccatgagaattacaccaaggcc

SEQ ID NO: 577238 - DNA, 25 bp, Mus musculus
catccatgcagcatcgaaggtgttc

SEQ ID NO: 577239 - DNA, 25 bp, Mus musculus
catccatgcagcttcgaaggtgttc

SEQ ID NO: 577240 - DNA, 25 bp, Mus musculus
catccatgcctacaacaaaaggcag

SEQ ID NO: 577241 - DNA, 25 bp, Mus musculus
catccatgcctagaacaaaaggcag

SEQ ID NO: 577242 - DNA, 25 bp, Mus musculus
catccatgctgtagtgttgcctaga

SEQ ID NO: 577243 - DNA, 25 bp, Mus musculus
catccatgctgttgtgttgcctaga

SEQ ID NO: 577244 - DNA, 25 bp, Mus musculus
catccatggatcaggtcggaacaaa

SEQ ID NO: 577245 - DNA, 25 bp, Mus musculus
catccatggatctggtcggaacaaa

SEQ ID NO: 577246 - DNA, 25 bp, Mus musculus
catccatgggaaacagtcactacgg

SEQ ID NO: 577247 - DNA, 25 bp, Mus musculus
catccatgggaatcagtcactacgg

SEQ ID NO: 577248 - DNA, 25 bp, Mus musculus
catccatgtactctgaggccaagca

SEQ ID NO: 577249 - DNA, 25 bp, Mus musculus
catccatgtactgtgaggccaagca

SEQ ID NO: 577250 - DNA, 25 bp, Mus musculus
catccatgtcatccaaaattattgg

SEQ ID NO: 577251 - DNA, 25 bp, Mus musculus
catccatgtcatgcaaaattattgg

SEQ ID NO: 577252 - DNA, 25 bp, Mus musculus
catccatgtcttacagctccagtac

SEQ ID NO: 577253 - DNA, 25 bp, Mus musculus
catccatgtctttcagctccagtac

SEQ ID NO: 577254 - DNA, 25 bp, Mus musculus
catccatgtggccatcgtctgtgcc

SEQ ID NO: 577255 - DNA, 25 bp, Mus musculus
catccatgtggcgatcgtctgtgcc

SEQ ID NO: 577256 - DNA, 25 bp, Mus musculus
catccattccccagtgtcagcaaaa

SEQ ID NO: 577257 - DNA, 25 bp, Mus musculus
catccattcccctgtgtcagcaaaa

SEQ ID NO: 577258 - DNA, 25 bp, Mus musculus
catccattgcgtcagacagacagtc

SEQ ID NO: 577259 - DNA, 25 bp, Mus musculus
catccattgcgtgagacagacagtc

SEQ ID NO: 577260 - DNA, 25 bp, Mus musculus
catccattgtggcttgagaccggcc

SEQ ID NO: 577261 - DNA, 25 bp, Mus musculus
catccattgtgggttgagaccggcc

SEQ ID NO: 577262 - DNA, 25 bp, Mus musculus
catccatttttacagcggaccagac

SEQ ID NO: 577263 - DNA, 25 bp, Mus musculus
catccatttttagagcggaccagac

SEQ ID NO: 577264 - DNA, 25 bp, Mus musculus
catcccaaaaagacctgctgaattt

SEQ ID NO: 577265 - DNA, 25 bp, Mus musculus
catcccaaaaagtcctgctgaattt

SEQ ID NO: 577266 - DNA, 25 bp, Mus musculus
catcccaaaagcaggtgagaaagga

SEQ ID NO: 577267 - DNA, 25 bp, Mus musculus
catcccaaaagctggtgagaaagga

SEQ ID NO: 577268 - DNA, 25 bp, Mus musculus
catcccaagtttccagctggaggga

SEQ ID NO: 577269 - DNA, 25 bp, Mus musculus
catcccaagtttgcagctggaggga

SEQ ID NO: 577270 - DNA, 25 bp, Mus musculus
catcccacaaggatcagcgcagcgt

SEQ ID NO: 577271 - DNA, 25 bp, Mus musculus
catcccacaaggttcagcgcagcgt

SEQ ID NO: 577272 - DNA, 25 bp, Mus musculus
catcccacatggaggtgtcccgtct

SEQ ID NO: 577273 - DNA, 25 bp, Mus musculus
catcccacatggcatgaggccacag

SEQ ID NO: 577274 - DNA, 25 bp, Mus musculus
catcccacatgggatgaggccacag

SEQ ID NO: 577275 - DNA, 25 bp, Mus musculus
catcccacatggtggtgtcccgtct

SEQ ID NO: 577276 - DNA, 25 bp, Mus musculus
catcccagaaagcagggcgactgga

SEQ ID NO: 577277 - DNA, 25 bp, Mus musculus
catcccagaaaggagggcgactgga

SEQ ID NO: 577278 - DNA, 25 bp, Mus musculus
catcccagaaggagtgatagctcga

SEQ ID NO: 577279 - DNA, 25 bp, Mus musculus
catcccagaaggtgtgatagctcga

SEQ ID NO: 577280 - DNA, 25 bp, Mus musculus
catcccagaggaccggcggagtcct

SEQ ID NO: 577281 - DNA, 25 bp, Mus musculus
catcccagaggagcggcggagtcct

SEQ ID NO: 577282 - DNA, 25 bp, Mus musculus
catcccagatgccaagaagagaggc

SEQ ID NO: 577283 - DNA, 25 bp, Mus musculus
catcccagatgcgaagaagagaggc

SEQ ID NO: 577284 - DNA, 25 bp, Mus musculus
catcccagccggagtgcccaggaaa

SEQ ID NO: 577285 - DNA, 25 bp, Mus musculus
catcccagccggtgtgcccaggaaa

SEQ ID NO: 577286 - DNA, 25 bp, Mus musculus
catcccaggcagagctggttctgag

SEQ ID NO: 577287 - DNA, 25 bp, Mus musculus
catcccaggcagtgctggttctgag

SEQ ID NO: 577288 - DNA, 25 bp, Mus musculus
catcccagggttccttttatgggaa

SEQ ID NO: 577289 - DNA, 25 bp, Mus musculus
catcccagggttgcttttatgggaa

SEQ ID NO: 577290 - DNA, 25 bp, Mus musculus
catccccaagcaagagtcatggcgg

SEQ ID NO: 577291 - DNA, 25 bp, Mus musculus
catccccaagcatgagtcatggcgg

SEQ ID NO: 577292 - DNA, 25 bp, Mus musculus
catccccaagttcggcattgagaag

SEQ ID NO: 577293 - DNA, 25 bp, Mus musculus
catccccaagttgggcattgagaag

SEQ ID NO: 577294 - DNA, 25 bp, Mus musculus
catccccaatgcaaatatgaatgag

SEQ ID NO: 577295 - DNA, 25 bp, Mus musculus
catccccaatgctaatatgaatgag

SEQ ID NO: 577296 - DNA, 25 bp, Mus musculus
catccccactggactggttgctggg

SEQ ID NO: 577297 - DNA, 25 bp, Mus musculus
catccccactggtctggttgctggg

SEQ ID NO: 577298 - DNA, 25 bp, Mus musculus
catccccagagaaagacttgtccct

SEQ ID NO: 577299 - DNA, 25 bp, Mus musculus
catccccagagatagacttgtccct

SEQ ID NO: 577300 - DNA, 25 bp, Mus musculus
catccccgagggatttgagcatctt

SEQ ID NO: 577301 - DNA, 25 bp, Mus musculus
catccccgagggttttgagcatctt

SEQ ID NO: 577302 - DNA, 25 bp, Mus musculus
catccccggaggagagagacaagaa

SEQ ID NO: 577303 - DNA, 25 bp, Mus musculus
catccccggaggtgagagacaagaa

SEQ ID NO: 577304 - DNA, 25 bp, Mus musculus
catccccggtcacagtaatttctct

SEQ ID NO: 577305 - DNA, 25 bp, Mus musculus
catccccggtcagagtaatttctct

SEQ ID NO: 577306 - DNA, 25 bp, Mus musculus
catccccgttatagagtatgagcag

SEQ ID NO: 577307 - DNA, 25 bp, Mus musculus
catccccgttattgagtatgagcag

SEQ ID NO: 577308 - DNA, 25 bp, Mus musculus
catcccctctgtcggagtagtgaac

SEQ ID NO: 577309 - DNA, 25 bp, Mus musculus
catcccctctgtgggagtagtgaac

SEQ ID NO: 577310 - DNA, 25 bp, Mus musculus
catcccctgaccaatgaaggtggtg

SEQ ID NO: 577311 - DNA, 25 bp, Mus musculus
catcccctgacctatgaaggtggtg

SEQ ID NO: 577312 - DNA, 25 bp, Mus musculus
catcccctgaggaattggaccaggg

SEQ ID NO: 577313 - DNA, 25 bp, Mus musculus
catcccctgaggtattggaccaggg

SEQ ID NO: 577314 - DNA, 25 bp, Mus musculus
catcccgaagtgcagtggagatcgc

SEQ ID NO: 577315 - DNA, 25 bp, Mus musculus
catcccgaagtggagtggagatcgc

SEQ ID NO: 577316 - DNA, 25 bp, Mus musculus
catcccgagtggagagtccagcttt

SEQ ID NO: 577317 - DNA, 25 bp, Mus musculus
catcccgagtggtgagtccagcttt

SEQ ID NO: 577318 - DNA, 25 bp, Mus musculus
catcccgcaggacgaggatgaccat

SEQ ID NO: 577319 - DNA, 25 bp, Mus musculus
catcccgcaggaggaggatgaccat

SEQ ID NO: 577320 - DNA, 25 bp, Mus musculus
catcccgcatggaggtttctttgcg

SEQ ID NO: 577321 - DNA, 25 bp, Mus musculus
catcccgcatggtggtttctttgcg

SEQ ID NO: 577322 - DNA, 25 bp, Mus musculus
catcccggaaggctcagtaaccaag

SEQ ID NO: 577323 - DNA, 25 bp, Mus musculus
catcccggaagggtcagtaaccaag

SEQ ID NO: 577324 - DNA, 25 bp, Mus musculus
catcccggagggaggcgagccaaaa

SEQ ID NO: 577325 - DNA, 25 bp, Mus musculus
catcccggagggtggcgagccaaaa

SEQ ID NO: 577326 - DNA, 25 bp, Mus musculus
catcccggcgtaagagtgagttccg

SEQ ID NO: 577327 - DNA, 25 bp, Mus musculus
catcccggcgtatgagtgagttccg

SEQ ID NO: 577328 - DNA, 25 bp, Mus musculus
catcccggctggagagaccagcacg

SEQ ID NO: 577329 - DNA, 25 bp, Mus musculus
catcccggctggtgagaccagcacg

SEQ ID NO: 577330 - DNA, 25 bp, Mus musculus
catcccggtcttacatcttagtgag

SEQ ID NO: 577331 - DNA, 25 bp, Mus musculus
catcccggtctttcatcttagtgag

SEQ ID NO: 577332 - DNA, 25 bp, Mus musculus
catcccggttgtcatttccaaaata

SEQ ID NO: 577333 - DNA, 25 bp, Mus musculus
catcccggttgtgatttccaaaata

SEQ ID NO: 577334 - DNA, 25 bp, Mus musculus
catcccgtacgccacctttgtgttg

SEQ ID NO: 577335 - DNA, 25 bp, Mus musculus
catcccgtacgcgacctttgtgttg

SEQ ID NO: 577336 - DNA, 25 bp, Mus musculus
catcccgtggataggaactttgcac

SEQ ID NO: 577337 - DNA, 25 bp, Mus musculus
catcccgtggattggaactttgcac

SEQ ID NO: 577338 - DNA, 25 bp, Mus musculus
catcccgtgttcaacaagacccttt

SEQ ID NO: 577339 - DNA, 25 bp, Mus musculus
catcccgtgttctacaagacccttt

SEQ ID NO: 577340 - DNA, 25 bp, Mus musculus
catccctagggcattcatcctgagg

SEQ ID NO: 577341 - DNA, 25 bp, Mus musculus
catccctagggctttcatcctgagg

SEQ ID NO: 577342 - DNA, 25 bp, Mus musculus
catccctatgtacttccagtaccag

SEQ ID NO: 577343 - DNA, 25 bp, Mus musculus
catccctatgtagttccagtaccag

SEQ ID NO: 577344 - DNA, 25 bp, Mus musculus
catccctcaggaaatatggcctcct

SEQ ID NO: 577345 - DNA, 25 bp, Mus musculus
catccctcaggatatatggcctcct

SEQ ID NO: 577346 - DNA, 25 bp, Mus musculus
catccctcgctcatccaatgattat

SEQ ID NO: 577347 - DNA, 25 bp, Mus musculus
catccctcgctcttccaatgattat

SEQ ID NO: 577348 - DNA, 25 bp, Mus musculus
catccctcgggcctgatggctacgg

SEQ ID NO: 577349 - DNA, 25 bp, Mus musculus
catccctcgggcgtgatggctacgg

SEQ ID NO: 577350 - DNA, 25 bp, Mus musculus
catccctcgtgcagaagaaattact

SEQ ID NO: 577351 - DNA, 25 bp, Mus musculus
catccctcgtgctgaagaaattact

SEQ ID NO: 577352 - DNA, 25 bp, Mus musculus
catccctgacggagagggcagacat

SEQ ID NO: 577353 - DNA, 25 bp, Mus musculus
catccctgacggtgagggcagacat

SEQ ID NO: 577354 - DNA, 25 bp, Mus musculus
catccctgagatcactgagaagcca

SEQ ID NO: 577355 - DNA, 25 bp, Mus musculus
catccctgagatgactgagaagcca

SEQ ID NO: 577356 - DNA, 25 bp, Mus musculus
catccctggaaaagccaacaaaagc

SEQ ID NO: 577357 - DNA, 25 bp, Mus musculus
catccctggaaatgccaacaaaagc

SEQ ID NO: 577358 - DNA, 25 bp, Mus musculus
catccctggcagattgagtcctaca

SEQ ID NO: 577359 - DNA, 25 bp, Mus musculus
catccctggcagtttgagtcctaca

SEQ ID NO: 577360 - DNA, 25 bp, Mus musculus
catccctggcctcggaaatgggctg

SEQ ID NO: 577361 - DNA, 25 bp, Mus musculus
catccctggcctgggaaatgggctg

SEQ ID NO: 577362 - DNA, 25 bp, Mus musculus
catccctggtgtcgccagtggtgtc

SEQ ID NO: 577363 - DNA, 25 bp, Mus musculus
catccctggtgtggccagtggtgtc

SEQ ID NO: 577364 - DNA, 25 bp, Mus musculus
catccctgtgagcatctgtttataa

SEQ ID NO: 577365 - DNA, 25 bp, Mus musculus
catccctgtgaggatctgtttataa

SEQ ID NO: 577366 - DNA, 25 bp, Mus musculus
catccctgtgtaaggaagccaggca

SEQ ID NO: 577367 - DNA, 25 bp, Mus musculus
catccctgtgtaagtaggagtgaat

SEQ ID NO: 577368 - DNA, 25 bp, Mus musculus
catccctgtgtatggaagccaggca

SEQ ID NO: 577369 - DNA, 25 bp, Mus musculus
catccctgtgtatgtaggagtgaat

SEQ ID NO: 577370 - DNA, 25 bp, Mus musculus
catccctgtgtcagcttctctcgtg

SEQ ID NO: 577371 - DNA, 25 bp, Mus musculus
catccctgtgtctgcttctctcgtg

SEQ ID NO: 577372 - DNA, 25 bp, Mus musculus
catccctgttcacgtggataccgtc

SEQ ID NO: 577373 - DNA, 25 bp, Mus musculus
catccctgttcaggtggataccgtc

SEQ ID NO: 577374 - DNA, 25 bp, Mus musculus
catccctgtttcagctgccatggta

SEQ ID NO: 577375 - DNA, 25 bp, Mus musculus
catccctgtttctgctgccatggta

SEQ ID NO: 577376 - DNA, 25 bp, Mus musculus
catcccttaagcaggggtagaatcc

SEQ ID NO: 577377 - DNA, 25 bp, Mus musculus
catcccttaagctggggtagaatcc

SEQ ID NO: 577378 - DNA, 25 bp, Mus musculus
catcccttcagtacaatggaccaga

SEQ ID NO: 577379 - DNA, 25 bp, Mus musculus
catcccttcagttcaatggaccaga

SEQ ID NO: 577380 - DNA, 25 bp, Mus musculus
catcccttctcacaaacagactgag

SEQ ID NO: 577381 - DNA, 25 bp, Mus musculus
catcccttctcagaaacagactgag

SEQ ID NO: 577382 - DNA, 25 bp, Mus musculus
catccctttctacggcatcttggga

SEQ ID NO: 577383 - DNA, 25 bp, Mus musculus
catccctttctagggcatcttggga

SEQ ID NO: 577384 - DNA, 25 bp, Mus musculus
catccctttgggaaactggacaata

SEQ ID NO: 577385 - DNA, 25 bp, Mus musculus
catccctttgggtaactggacaata

SEQ ID NO: 577386 - DNA, 25 bp, Mus musculus
catccgaagcaacgctggacatggc

SEQ ID NO: 577387 - DNA, 25 bp, Mus musculus
catccgaagcaaggctggacatggc

SEQ ID NO: 577388 - DNA, 25 bp, Mus musculus
catccgaagcacaccgacagagagt

SEQ ID NO: 577389 - DNA, 25 bp, Mus musculus
catccgaagcactccgacagagagt

SEQ ID NO: 577390 - DNA, 25 bp, Mus musculus
catccgaatatcatcaagtatctgg

SEQ ID NO: 577391 - DNA, 25 bp, Mus musculus
catccgaatatcttcaagtatctgg

SEQ ID NO: 577392 - DNA, 25 bp, Mus musculus
catccgaatggtccctgaggacatt

SEQ ID NO: 577393 - DNA, 25 bp, Mus musculus
catccgaatggtgcctgaggacatt

SEQ ID NO: 577394 - DNA, 25 bp, Mus musculus
catccgaccaccaaggttggaggga

SEQ ID NO: 577395 - DNA, 25 bp, Mus musculus
catccgaccacctaggttggaggga

SEQ ID NO: 577396 - DNA, 25 bp, Mus musculus
catccgaggatgacacagcttggat

SEQ ID NO: 577397 - DNA, 25 bp, Mus musculus
catccgaggatgtcacagcttggat

SEQ ID NO: 577398 - DNA, 25 bp, Mus musculus
catccgagtgctcggcatccaggtg

SEQ ID NO: 577399 - DNA, 25 bp, Mus musculus
catccgagtgctgggcatccaggtg

SEQ ID NO: 577400 - DNA, 25 bp, Mus musculus
catccgagtgtaacctgagagaagc

SEQ ID NO: 577401 - DNA, 25 bp, Mus musculus
catccgagtgtatcctgagagaagc

SEQ ID NO: 577402 - DNA, 25 bp, Mus musculus
catccgatgtggacacagggctact

SEQ ID NO: 577403 - DNA, 25 bp, Mus musculus
catccgatgtggtcacagggctact

SEQ ID NO: 577404 - DNA, 25 bp, Mus musculus
catccgcaacttcgaggtcaagttc

SEQ ID NO: 577405 - DNA, 25 bp, Mus musculus
catccgcaacttggaggtcaagttc

SEQ ID NO: 577406 - DNA, 25 bp, Mus musculus
catccgccatgacaacgcggtgcag

SEQ ID NO: 577407 - DNA, 25 bp, Mus musculus
catccgccatgagaacgcggtgcag

SEQ ID NO: 577408 - DNA, 25 bp, Mus musculus
catccgccggctcggatgatcagtc

SEQ ID NO: 577409 - DNA, 25 bp, Mus musculus
catccgccggctgggatgatcagtc

SEQ ID NO: 577410 - DNA, 25 bp, Mus musculus
catccgcgtcctcggtgatctgcat

SEQ ID NO: 577411 - DNA, 25 bp, Mus musculus
catccgcgtcctgggtgatctgcat

SEQ ID NO: 577412 - DNA, 25 bp, Mus musculus
catccgctgcagatcgtgttcgcct

SEQ ID NO: 577413 - DNA, 25 bp, Mus musculus
catccgctgcagttcgtgttcgcct

SEQ ID NO: 577414 - DNA, 25 bp, Mus musculus
catccggaaccgcatcctggagatt

SEQ ID NO: 577415 - DNA, 25 bp, Mus musculus
catccggaaccggatcctggagatt

SEQ ID NO: 577416 - DNA, 25 bp, Mus musculus
catccggacacacaccaacgagaag

SEQ ID NO: 577417 - DNA, 25 bp, Mus musculus
catccggacacagaccaacgagaag

SEQ ID NO: 577418 - DNA, 25 bp, Mus musculus
catccggacattcgtcgtgtcaatt

SEQ ID NO: 577419 - DNA, 25 bp, Mus musculus
catccggacattggtcgtgtcaatt

SEQ ID NO: 577420 - DNA, 25 bp, Mus musculus
catccggagcgtcatcaagcagggt

SEQ ID NO: 577421 - DNA, 25 bp, Mus musculus
catccggagcgtgatcaagcagggt

SEQ ID NO: 577422 - DNA, 25 bp, Mus musculus
catccggcggcgagtctacgatgcc

SEQ ID NO: 577423 - DNA, 25 bp, Mus musculus
catccggcggcgtgtctacgatgcc

SEQ ID NO: 577424 - DNA, 25 bp, Mus musculus
catccggctgcccaggaaatttcag

SEQ ID NO: 577425 - DNA, 25 bp, Mus musculus
catccggctgccgaggaaatttcag

SEQ ID NO: 577426 - DNA, 25 bp, Mus musculus
catccggctggcctgcagcaaagtg

SEQ ID NO: 577427 - DNA, 25 bp, Mus musculus
catccggctggcgtgcagcaaagtg

SEQ ID NO: 577428 - DNA, 25 bp, Mus musculus
catccgggaggtccgaccatgtaca

SEQ ID NO: 577429 - DNA, 25 bp, Mus musculus
catccgggaggtgcgaccatgtaca

SEQ ID NO: 577430 - DNA, 25 bp, Mus musculus
catccggtatggctctgcaagatct

SEQ ID NO: 577431 - DNA, 25 bp, Mus musculus
catccggtatgggtctgcaagatct

SEQ ID NO: 577432 - DNA, 25 bp, Mus musculus
catccggtctgcacgacttcaaata

SEQ ID NO: 577433 - DNA, 25 bp, Mus musculus
catccggtctgctcgacttcaaata

SEQ ID NO: 577434 - DNA, 25 bp, Mus musculus
catccggtgcatagtgatgggcaat

SEQ ID NO: 577435 - DNA, 25 bp, Mus musculus
catccggtgcattgtgatgggcaat

SEQ ID NO: 577436 - DNA, 25 bp, Mus musculus
catccggttgaacaccaaggccttc

SEQ ID NO: 577437 - DNA, 25 bp, Mus musculus
catccggttgaagaccaaggccttc

SEQ ID NO: 577438 - DNA, 25 bp, Mus musculus
catccgtacggcagagcacttcctg

SEQ ID NO: 577439 - DNA, 25 bp, Mus musculus
catccgtacggctgagcacttcctg

SEQ ID NO: 577440 - DNA, 25 bp, Mus musculus
catccgtatgagcttcgtcaaaggc

SEQ ID NO: 577441 - DNA, 25 bp, Mus musculus
catccgtatgaggttcgtcaaaggc

SEQ ID NO: 577442 - DNA, 25 bp, Mus musculus
catccgtcggcccaagcttagtcgg

SEQ ID NO: 577443 - DNA, 25 bp, Mus musculus
catccgtcggccgaagcttagtcgg

SEQ ID NO: 577444 - DNA, 25 bp, Mus musculus
catccgtctgaacacggtgaagcca

SEQ ID NO: 577445 - DNA, 25 bp, Mus musculus
catccgtctgaagacggtgaagcca

SEQ ID NO: 577446 - DNA, 25 bp, Mus musculus
catccgtgaggcagtagaggagatc

SEQ ID NO: 577447 - DNA, 25 bp, Mus musculus
catccgtgaggctgtagaggagatc

SEQ ID NO: 577448 - DNA, 25 bp, Mus musculus
catccgtgtcggagacgtctatggc

SEQ ID NO: 577449 - DNA, 25 bp, Mus musculus
catccgtgtcggtgacgtctatggc

SEQ ID NO: 577450 - DNA, 25 bp, Mus musculus
catccgtgtgccaccggccagaggt

SEQ ID NO: 577451 - DNA, 25 bp, Mus musculus
catccgtgtgcctccggccagaggt

SEQ ID NO: 577452 - DNA, 25 bp, Mus musculus
catccgttctcccttatggcgagga

SEQ ID NO: 577453 - DNA, 25 bp, Mus musculus
catccgttctccgttatggcgagga

SEQ ID NO: 577454 - DNA, 25 bp, Mus musculus
catcctactatgacaaccaggactt

SEQ ID NO: 577455 - DNA, 25 bp, Mus musculus
catcctactatgtcaaccaggactt

SEQ ID NO: 577456 - DNA, 25 bp, Mus musculus
catcctagactaacgggcatcctgg

SEQ ID NO: 577457 - DNA, 25 bp, Mus musculus
catcctagactatcgggcatcctgg

SEQ ID NO: 577458 - DNA, 25 bp, Mus musculus
catcctagcaggcaaaatctacgtg

SEQ ID NO: 577459 - DNA, 25 bp, Mus musculus
catcctagcagggaaaatctacgtg

SEQ ID NO: 577460 - DNA, 25 bp, Mus musculus
catcctaggctaagaggctgcctca

SEQ ID NO: 577461 - DNA, 25 bp, Mus musculus
catcctaggctatgaggctgcctca

SEQ ID NO: 577462 - DNA, 25 bp, Mus musculus
catcctaggtcactggcttttgctg

SEQ ID NO: 577463 - DNA, 25 bp, Mus musculus
catcctaggtcagtggcttttgctg

SEQ ID NO: 577464 - DNA, 25 bp, Mus musculus
catcctataaagacatggtgagcaa

SEQ ID NO: 577465 - DNA, 25 bp, Mus musculus
catcctataaagtcatggtgagcaa

SEQ ID NO: 577466 - DNA, 25 bp, Mus musculus
catcctataaatcacgaaaatcaag

SEQ ID NO: 577467 - DNA, 25 bp, Mus musculus
catcctataaatgacgaaaatcaag

SEQ ID NO: 577468 - DNA, 25 bp, Mus musculus
catcctatatggaaacgggcctggc

SEQ ID NO: 577469 - DNA, 25 bp, Mus musculus
catcctatatggtaacgggcctggc

SEQ ID NO: 577470 - DNA, 25 bp, Mus musculus
catcctatccaacccagtggcaggg

SEQ ID NO: 577471 - DNA, 25 bp, Mus musculus
catcctatccaagccagtggcaggg

SEQ ID NO: 577472 - DNA, 25 bp, Mus musculus
catcctcaagcacgagcaggcgtct

SEQ ID NO: 577473 - DNA, 25 bp, Mus musculus
catcctcaagcaggagcaggcgtct

SEQ ID NO: 577474 - DNA, 25 bp, Mus musculus
catcctcaaggaaccagtgcgtgta

SEQ ID NO: 577475 - DNA, 25 bp, Mus musculus
catcctcaaggatccagtgcgtgta

SEQ ID NO: 577476 - DNA, 25 bp, Mus musculus
catcctcagatcagaagtgcattga

SEQ ID NO: 577477 - DNA, 25 bp, Mus musculus
catcctcagatctgaagtgcattga

SEQ ID NO: 577478 - DNA, 25 bp, Mus musculus
catcctcagatgacccttgggatga

SEQ ID NO: 577479 - DNA, 25 bp, Mus musculus
catcctcagatgtcccttgggatga

SEQ ID NO: 577480 - DNA, 25 bp, Mus musculus
catcctcagattagccatccaggac

SEQ ID NO: 577481 - DNA, 25 bp, Mus musculus
catcctcagatttgccatccaggac

SEQ ID NO: 577482 - DNA, 25 bp, Mus musculus
catcctcagcctcagagggcgacga

SEQ ID NO: 577483 - DNA, 25 bp, Mus musculus
catcctcagcctgagagggcgacga

SEQ ID NO: 577484 - DNA, 25 bp, Mus musculus
catcctcagtgaccaagccatgtcg

SEQ ID NO: 577485 - DNA, 25 bp, Mus musculus
catcctcagtgagcaagccatgtcg

SEQ ID NO: 577486 - DNA, 25 bp, Mus musculus
catcctcagttaagacacgctacag

SEQ ID NO: 577487 - DNA, 25 bp, Mus musculus
catcctcagttatgacacgctacag

SEQ ID NO: 577488 - DNA, 25 bp, Mus musculus
catcctcattctagtgtgtgcttgg

SEQ ID NO: 577489 - DNA, 25 bp, Mus musculus
catcctcattcttgtgtgtgcttgg

SEQ ID NO: 577490 - DNA, 25 bp, Mus musculus
catcctccagagacatggaagcttt

SEQ ID NO: 577491 - DNA, 25 bp, Mus musculus
catcctccagagtcatggaagcttt

SEQ ID NO: 577492 - DNA, 25 bp, Mus musculus
catcctccaggtatactcatctcag

SEQ ID NO: 577493 - DNA, 25 bp, Mus musculus
catcctccaggtttactcatctcag

SEQ ID NO: 577494 - DNA, 25 bp, Mus musculus
catcctcccatgagtctctgagtct

SEQ ID NO: 577495 - DNA, 25 bp, Mus musculus
catcctcccatgtgtctctgagtct

SEQ ID NO: 577496 - DNA, 25 bp, Mus musculus
catcctccctgaagaggattgctgt

SEQ ID NO: 577497 - DNA, 25 bp, Mus musculus
catcctccctgatgaggattgctgt

SEQ ID NO: 577498 - DNA, 25 bp, Mus musculus
catcctccgtggaggcgctgagcag

SEQ ID NO: 577499 - DNA, 25 bp, Mus musculus
catcctccgtggtggcgctgagcag

SEQ ID NO: 577500 - DNA, 25 bp, Mus musculus
catcctcctctacgttctggcttta

SEQ ID NO: 577501 - DNA, 25 bp, Mus musculus
catcctcctctaggttctggcttta

SEQ ID NO: 577502 - DNA, 25 bp, Mus musculus
catcctccttggctcagtgggctct

SEQ ID NO: 577503 - DNA, 25 bp, Mus musculus
catcctccttgggtcagtgggctct

SEQ ID NO: 577504 - DNA, 25 bp, Mus musculus
catcctcgcctcaggacactttgag

SEQ ID NO: 577505 - DNA, 25 bp, Mus musculus
catcctcgcctctggacactttgag

SEQ ID NO: 577506 - DNA, 25 bp, Mus musculus
catcctctacaaagccacaaagctt

SEQ ID NO: 577507 - DNA, 25 bp, Mus musculus
catcctctacaatgccacaaagctt

SEQ ID NO: 577508 - DNA, 25 bp, Mus musculus
catcctctcatcaggatacgtccat

SEQ ID NO: 577509 - DNA, 25 bp, Mus musculus
catcctctcatctggatacgtccat

SEQ ID NO: 577510 - DNA, 25 bp, Mus musculus
catcctctcgcacgatttactggag

SEQ ID NO: 577511 - DNA, 25 bp, Mus musculus
catcctctcgcaggatttactggag

SEQ ID NO: 577512 - DNA, 25 bp, Mus musculus
catcctctcgttaagaaggtagaaa

SEQ ID NO: 577513 - DNA, 25 bp, Mus musculus
catcctctcgtttagaaggtagaaa

SEQ ID NO: 577514 - DNA, 25 bp, Mus musculus
catcctctgctgagtcaggtgccgg

SEQ ID NO: 577515 - DNA, 25 bp, Mus musculus
catcctctgctgtgtcaggtgccgg

SEQ ID NO: 577516 - DNA, 25 bp, Mus musculus
catcctctggcccacgtcttgaagg

SEQ ID NO: 577517 - DNA, 25 bp, Mus musculus
catcctctggccgacgtcttgaagg

SEQ ID NO: 577518 - DNA, 25 bp, Mus musculus
catcctctgggcagtaacgactctg

SEQ ID NO: 577519 - DNA, 25 bp, Mus musculus
catcctctgggctgtaacgactctg

SEQ ID NO: 577520 - DNA, 25 bp, Mus musculus
catcctctttatcaacatcatccgg

SEQ ID NO: 577521 - DNA, 25 bp, Mus musculus
catcctctttatgaacatcatccgg

SEQ ID NO: 577522 - DNA, 25 bp, Mus musculus
catcctgaacttcagccagagttag

SEQ ID NO: 577523 - DNA, 25 bp, Mus musculus
catcctgaacttgagccagagttag

SEQ ID NO: 577524 - DNA, 25 bp, Mus musculus
catcctgaagaacacggctagcctc

SEQ ID NO: 577525 - DNA, 25 bp, Mus musculus
catcctgaagaagacggctagcctc

SEQ ID NO: 577526 - DNA, 25 bp, Mus musculus
catcctgaatgccaagggagaagaa

SEQ ID NO: 577527 - DNA, 25 bp, Mus musculus
catcctgaatgcgaagggagaagaa

SEQ ID NO: 577528 - DNA, 25 bp, Mus musculus
catcctgagcctagtgccacgagtt

SEQ ID NO: 577529 - DNA, 25 bp, Mus musculus
catcctgagccttgtgccacgagtt

SEQ ID NO: 577530 - DNA, 25 bp, Mus musculus
catcctgaggcacccctacataaaa

SEQ ID NO: 577531 - DNA, 25 bp, Mus musculus
catcctgaggcagccctacataaaa

SEQ ID NO: 577532 - DNA, 25 bp, Mus musculus
catcctgaggttcatctcgtgcaac

SEQ ID NO: 577533 - DNA, 25 bp, Mus musculus
catcctgaggttgatctcgtgcaac

SEQ ID NO: 577534 - DNA, 25 bp, Mus musculus
catcctgagttaagtcgtcatcgct

SEQ ID NO: 577535 - DNA, 25 bp, Mus musculus
catcctgagttatgtcgtcatcgct

SEQ ID NO: 577536 - DNA, 25 bp, Mus musculus
catcctgatggcctgcaaagcttac

SEQ ID NO: 577537 - DNA, 25 bp, Mus musculus
catcctgatggcgtgcaaagcttac

SEQ ID NO: 577538 - DNA, 25 bp, Mus musculus
catcctgcaaagagggtcaagggcg

SEQ ID NO: 577539 - DNA, 25 bp, Mus musculus
catcctgcaaagtgggtcaagggcg

SEQ ID NO: 577540 - DNA, 25 bp, Mus musculus
catcctgcagtgattgggcctggct

SEQ ID NO: 577541 - DNA, 25 bp, Mus musculus
catcctgcagtgtttgggcctggct

SEQ ID NO: 577542 - DNA, 25 bp, Mus musculus
catcctgccttgataaacttggtga

SEQ ID NO: 577543 - DNA, 25 bp, Mus musculus
catcctgccttgttaaacttggtga

SEQ ID NO: 577544 - DNA, 25 bp, Mus musculus
catcctgcgccgagtgaccttctgt

SEQ ID NO: 577545 - DNA, 25 bp, Mus musculus
catcctgcgccgtgtgaccttctgt

SEQ ID NO: 577546 - DNA, 25 bp, Mus musculus
catcctgctgcaaaagctcgctcgg

SEQ ID NO: 577547 - DNA, 25 bp, Mus musculus
catcctgctgcataagctcgctcgg

SEQ ID NO: 577548 - DNA, 25 bp, Mus musculus
catcctgctggcaatgctctatggc

SEQ ID NO: 577549 - DNA, 25 bp, Mus musculus
catcctgctggctatgctctatggc

SEQ ID NO: 577550 - DNA, 25 bp, Mus musculus
catcctgctttactaggtcaagtct

SEQ ID NO: 577551 - DNA, 25 bp, Mus musculus
catcctgctttagtaggtcaagtct

SEQ ID NO: 577552 - DNA, 25 bp, Mus musculus
catcctggaacgctgacagcgttgg

SEQ ID NO: 577553 - DNA, 25 bp, Mus musculus
catcctggaacggtgacagcgttgg

SEQ ID NO: 577554 - DNA, 25 bp, Mus musculus
catcctggaactagcgctgtacacc

SEQ ID NO: 577555 - DNA, 25 bp, Mus musculus
catcctggaacttgcgctgtacacc

SEQ ID NO: 577556 - DNA, 25 bp, Mus musculus
catcctggacggctaacctcagagc

SEQ ID NO: 577557 - DNA, 25 bp, Mus musculus
catcctggacgggtaacctcagagc

SEQ ID NO: 577558 - DNA, 25 bp, Mus musculus
catcctggagatagtatacgcctcg

SEQ ID NO: 577559 - DNA, 25 bp, Mus musculus
catcctggagattgtatacgcctcg

SEQ ID NO: 577560 - DNA, 25 bp, Mus musculus
catcctggcaaccacgttgactggg

SEQ ID NO: 577561 - DNA, 25 bp, Mus musculus
catcctggcaacgacgttgactggg

SEQ ID NO: 577562 - DNA, 25 bp, Mus musculus
catcctggccaacctcgagaagtac

SEQ ID NO: 577563 - DNA, 25 bp, Mus musculus
catcctggccaagctcgagaagtac

SEQ ID NO: 577564 - DNA, 25 bp, Mus musculus
catcctggctacatggccttcctca

SEQ ID NO: 577565 - DNA, 25 bp, Mus musculus
catcctggctacttggccttcctca

SEQ ID NO: 577566 - DNA, 25 bp, Mus musculus
catcctggctttcggacttccggag

SEQ ID NO: 577567 - DNA, 25 bp, Mus musculus
catcctggctttgggacttccggag

SEQ ID NO: 577568 - DNA, 25 bp, Mus musculus
catcctgggaacaccccatggacgg

SEQ ID NO: 577569 - DNA, 25 bp, Mus musculus
catcctgggaactccccatggacgg

SEQ ID NO: 577570 - DNA, 25 bp, Mus musculus
catcctgggaggaatgttctgcact

SEQ ID NO: 577571 - DNA, 25 bp, Mus musculus
catcctgggaggtatgttctgcact

SEQ ID NO: 577572 - DNA, 25 bp, Mus musculus
catcctgggcatctttggtaccgtg

SEQ ID NO: 577573 - DNA, 25 bp, Mus musculus
catcctgggcatgtttggtaccgtg

SEQ ID NO: 577574 - DNA, 25 bp, Mus musculus
catcctgggtatcccgccagtgtgt

SEQ ID NO: 577575 - DNA, 25 bp, Mus musculus
catcctgggtatgccgccagtgtgt

SEQ ID NO: 577576 - DNA, 25 bp, Mus musculus
catcctggtatgaggagttccggcg

SEQ ID NO: 577577 - DNA, 25 bp, Mus musculus
catcctggtatgtggagttccggcg

SEQ ID NO: 577578 - DNA, 25 bp, Mus musculus
catcctggtgctaacatggactgtc

SEQ ID NO: 577579 - DNA, 25 bp, Mus musculus
catcctggtgcttacatggactgtc

SEQ ID NO: 577580 - DNA, 25 bp, Mus musculus
catcctgtaagcaaggcagctggcc

SEQ ID NO: 577581 - DNA, 25 bp, Mus musculus
catcctgtaagctaggcagctggcc

SEQ ID NO: 577582 - DNA, 25 bp, Mus musculus
catcctgtacaaaacctgtgtctgc

SEQ ID NO: 577583 - DNA, 25 bp, Mus musculus
catcctgtacaatacctgtgtctgc

SEQ ID NO: 577584 - DNA, 25 bp, Mus musculus
catcctgtaccaacttcgtatgcgg

SEQ ID NO: 577585 - DNA, 25 bp, Mus musculus
catcctgtaccatcttcgtatgcgg

SEQ ID NO: 577586 - DNA, 25 bp, Mus musculus
catcctgtccatcgtgtgcctgatg

SEQ ID NO: 577587 - DNA, 25 bp, Mus musculus
catcctgtccatggtgtgcctgatg

SEQ ID NO: 577588 - DNA, 25 bp, Mus musculus
catcctgtcgatcgctgctgtgtta

SEQ ID NO: 577589 - DNA, 25 bp, Mus musculus
catcctgtcgatggctgctgtgtta

SEQ ID NO: 577590 - DNA, 25 bp, Mus musculus
catcctgtgcgtcggtgagtatttc

SEQ ID NO: 577591 - DNA, 25 bp, Mus musculus
catcctgtgcgtgggtgagtatttc

SEQ ID NO: 577592 - DNA, 25 bp, Mus musculus
catcctgtgtcaattggaactcgag

SEQ ID NO: 577593 - DNA, 25 bp, Mus musculus
catcctgtgtcatttggaactcgag

SEQ ID NO: 577594 - DNA, 25 bp, Mus musculus
catcctgtgtcgctgtgagaatatt

SEQ ID NO: 577595 - DNA, 25 bp, Mus musculus
catcctgtgtcggtgtgagaatatt

SEQ ID NO: 577596 - DNA, 25 bp, Mus musculus
catcctgttgcaacttccctgtggc

SEQ ID NO: 577597 - DNA, 25 bp, Mus musculus
catcctgttgcatcttccctgtggc

SEQ ID NO: 577598 - DNA, 25 bp, Mus musculus
catcctgtttctcgctgtgcaggga

SEQ ID NO: 577599 - DNA, 25 bp, Mus musculus
catcctgtttctggctgtgcaggga

SEQ ID NO: 577600 - DNA, 25 bp, Mus musculus
catccttaactgaccggtccagtgg

SEQ ID NO: 577601 - DNA, 25 bp, Mus musculus
catccttaactgtccggtccagtgg

SEQ ID NO: 577602 - DNA, 25 bp, Mus musculus
catccttaagcaagccatagacaag

SEQ ID NO: 577603 - DNA, 25 bp, Mus musculus
catccttaagcatgccatagacaag

SEQ ID NO: 577604 - DNA, 25 bp, Mus musculus
catccttacatccttgggttcaacc

SEQ ID NO: 577605 - DNA, 25 bp, Mus musculus
catccttacatcgttgggttcaacc

SEQ ID NO: 577606 - DNA, 25 bp, Mus musculus
catccttagtgacgaggagttctat

SEQ ID NO: 577607 - DNA, 25 bp, Mus musculus
catccttagtgaggaggagttctat

SEQ ID NO: 577608 - DNA, 25 bp, Mus musculus
catccttatcttatacaagtggaca

SEQ ID NO: 577609 - DNA, 25 bp, Mus musculus
catccttatcttttacaagtggaca

SEQ ID NO: 577610 - DNA, 25 bp, Mus musculus
catccttatggcagcagagtcattc

SEQ ID NO: 577611 - DNA, 25 bp, Mus musculus
catccttatggctgcagagtcattc

SEQ ID NO: 577612 - DNA, 25 bp, Mus musculus
catccttattgacatcattcgagag

SEQ ID NO: 577613 - DNA, 25 bp, Mus musculus
catccttattgagatcattcgagag

SEQ ID NO: 577614 - DNA, 25 bp, Mus musculus
catccttcatgtaccagcgagtact

SEQ ID NO: 577615 - DNA, 25 bp, Mus musculus
catccttcatgttccagcgagtact

SEQ ID NO: 577616 - DNA, 25 bp, Mus musculus
catccttccaggcacaggagctgga

SEQ ID NO: 577617 - DNA, 25 bp, Mus musculus
catccttccagggacaggagctgga

SEQ ID NO: 577618 - DNA, 25 bp, Mus musculus
catccttgctcccttcctttaaggg

SEQ ID NO: 577619 - DNA, 25 bp, Mus musculus
catccttgctccgttcctttaaggg

SEQ ID NO: 577620 - DNA, 25 bp, Mus musculus
catccttgcttacacagaggaccag

SEQ ID NO: 577621 - DNA, 25 bp, Mus musculus
catccttgcttagacagaggaccag

SEQ ID NO: 577622 - DNA, 25 bp, Mus musculus
catccttgcttgcaggggcttgtca

SEQ ID NO: 577623 - DNA, 25 bp, Mus musculus
catccttgcttggaggggcttgtca

SEQ ID NO: 577624 - DNA, 25 bp, Mus musculus
catccttggaaaacctgccacggac

SEQ ID NO: 577625 - DNA, 25 bp, Mus musculus
catccttggaaatcctgccacggac

SEQ ID NO: 577626 - DNA, 25 bp, Mus musculus
catccttggcttcggagaccttggc

SEQ ID NO: 577627 - DNA, 25 bp, Mus musculus
catccttggcttgggagaccttggc

SEQ ID NO: 577628 - DNA, 25 bp, Mus musculus
catccttgggcaagtccaacgagga

SEQ ID NO: 577629 - DNA, 25 bp, Mus musculus
catccttgggcatgtccaacgagga

SEQ ID NO: 577630 - DNA, 25 bp, Mus musculus
catccttgtcccagtgggtgaggga

SEQ ID NO: 577631 - DNA, 25 bp, Mus musculus
catccttgtccctgtgggtgaggga

SEQ ID NO: 577632 - DNA, 25 bp, Mus musculus
catccttgtgcaacaccagagagtc

SEQ ID NO: 577633 - DNA, 25 bp, Mus musculus
catccttgtgcatcaccagagagtc

SEQ ID NO: 577634 - DNA, 25 bp, Mus musculus
catccttgtgttagacctgggtggc

SEQ ID NO: 577635 - DNA, 25 bp, Mus musculus
catccttgtgtttgacctgggtggc

SEQ ID NO: 577636 - DNA, 25 bp, Mus musculus
catccttgtttcatcgccgagggcc

SEQ ID NO: 577637 - DNA, 25 bp, Mus musculus
catccttgtttcttcgccgagggcc

SEQ ID NO: 577638 - DNA, 25 bp, Mus musculus
catcctttctacctggcactggagg

SEQ ID NO: 577639 - DNA, 25 bp, Mus musculus
catcctttctacgtggcactggagg

SEQ ID NO: 577640 - DNA, 25 bp, Mus musculus
catcctttgcctctagccctggaga

SEQ ID NO: 577641 - DNA, 25 bp, Mus musculus
catcctttgcctgtagccctggaga

SEQ ID NO: 577642 - DNA, 25 bp, Mus musculus
catccttttaccaatgtgccggaca

SEQ ID NO: 577643 - DNA, 25 bp, Mus musculus
catccttttacctatgtgccggaca

SEQ ID NO: 577644 - DNA, 25 bp, Mus musculus
catcgaaagccgcaccatcgtagct

SEQ ID NO: 577645 - DNA, 25 bp, Mus musculus
catcgaaagccggaccatcgtagct

SEQ ID NO: 577646 - DNA, 25 bp, Mus musculus
catcgaaagtatcgagacacgctgg

SEQ ID NO: 577647 - DNA, 25 bp, Mus musculus
catcgaaagtatggagacacgctgg

SEQ ID NO: 577648 - DNA, 25 bp, Mus musculus
catcgaaagtgtacagacaaaggct

SEQ ID NO: 577649 - DNA, 25 bp, Mus musculus
catcgaaagtgttcagacaaaggct

SEQ ID NO: 577650 - DNA, 25 bp, Mus musculus
catcgaacttcgacactgacaagaa

SEQ ID NO: 577651 - DNA, 25 bp, Mus musculus
catcgaacttcgtcactgacaagaa

SEQ ID NO: 577652 - DNA, 25 bp, Mus musculus
catcgaagaagaagagtggcgagtt

SEQ ID NO: 577653 - DNA, 25 bp, Mus musculus
catcgaagaagatgagtggcgagtt

SEQ ID NO: 577654 - DNA, 25 bp, Mus musculus
catcgaagacccagtacgacctgag

SEQ ID NO: 577655 - DNA, 25 bp, Mus musculus
catcgaagaccctgtacgacctgag

SEQ ID NO: 577656 - DNA, 25 bp, Mus musculus
catcgaagatgacttggtatcggcc

SEQ ID NO: 577657 - DNA, 25 bp, Mus musculus
catcgaagatgagttggtatcggcc

SEQ ID NO: 577658 - DNA, 25 bp, Mus musculus
catcgaagccctactggaagcaggc

SEQ ID NO: 577659 - DNA, 25 bp, Mus musculus
catcgaagcccttctggaagcaggc

SEQ ID NO: 577660 - DNA, 25 bp, Mus musculus
catcgaatacatcaagagccagccc

SEQ ID NO: 577661 - DNA, 25 bp, Mus musculus
catcgaatacatgaagagccagccc

SEQ ID NO: 577662 - DNA, 25 bp, Mus musculus
catcgaatcagaaactgtgcgtacc

SEQ ID NO: 577663 - DNA, 25 bp, Mus musculus
catcgaatcagatactgtgcgtacc

SEQ ID NO: 577664 - DNA, 25 bp, Mus musculus
catcgaatcctgcaccggatgcgct

SEQ ID NO: 577665 - DNA, 25 bp, Mus musculus
catcgaatcctggaccggatgcgct

SEQ ID NO: 577666 - DNA, 25 bp, Mus musculus
catcgaatgtttcaacccacgtgcc

SEQ ID NO: 577667 - DNA, 25 bp, Mus musculus
catcgaatgtttgaacccacgtgcc

SEQ ID NO: 577668 - DNA, 25 bp, Mus musculus
catcgacaacgtctgcgagttggcg

SEQ ID NO: 577669 - DNA, 25 bp, Mus musculus
catcgacaacgtgtgcgagttggcg

SEQ ID NO: 577670 - DNA, 25 bp, Mus musculus
catcgacatcatagtcatccggcag

SEQ ID NO: 577671 - DNA, 25 bp, Mus musculus
catcgacatcattgtcatccggcag

SEQ ID NO: 577672 - DNA, 25 bp, Mus musculus
catcgacatgtccaaaatgggactg

SEQ ID NO: 577673 - DNA, 25 bp, Mus musculus
catcgacatgtcgaaaatgggactg

SEQ ID NO: 577674 - DNA, 25 bp, Mus musculus
catcgacctggacttcaagggtcag

SEQ ID NO: 577675 - DNA, 25 bp, Mus musculus
catcgacctggagttcaagggtcag

SEQ ID NO: 577676 - DNA, 25 bp, Mus musculus
catcgaccttatcgtccgctgtgaa

SEQ ID NO: 577677 - DNA, 25 bp, Mus musculus
catcgaccttatggtccgctgtgaa

SEQ ID NO: 577678 - DNA, 25 bp, Mus musculus
catcgacgggagaaatgactgaagc

SEQ ID NO: 577679 - DNA, 25 bp, Mus musculus
catcgacgggagtaatgactgaagc

SEQ ID NO: 577680 - DNA, 25 bp, Mus musculus
catcgacgttccaaaaaccattcag

SEQ ID NO: 577681 - DNA, 25 bp, Mus musculus
catcgacgttcctaaaaccattcag

SEQ ID NO: 577682 - DNA, 25 bp, Mus musculus
catcgactgctccagggcgagagca

SEQ ID NO: 577683 - DNA, 25 bp, Mus musculus
catcgactgctcgagggcgagagca

SEQ ID NO: 577684 - DNA, 25 bp, Mus musculus
catcgacttcaacgtcaagacggtc

SEQ ID NO: 577685 - DNA, 25 bp, Mus musculus
catcgacttcaaggtcaagacggtc

SEQ ID NO: 577686 - DNA, 25 bp, Mus musculus
catcgacttcgacatgaaaatcggg

SEQ ID NO: 577687 - DNA, 25 bp, Mus musculus
catcgacttcgagatgaaaatcggg

SEQ ID NO: 577688 - DNA, 25 bp, Mus musculus
catcgagaacgaagaggccttcgcc

SEQ ID NO: 577689 - DNA, 25 bp, Mus musculus
catcgagaacgatgaggccttcgcc

SEQ ID NO: 577690 - DNA, 25 bp, Mus musculus
catcgagaagtgatcagtgcctggt

SEQ ID NO: 577691 - DNA, 25 bp, Mus musculus
catcgagaagtgttcagtgcctggt

SEQ ID NO: 577692 - DNA, 25 bp, Mus musculus
catcgagaatcacaactcacgccag

SEQ ID NO: 577693 - DNA, 25 bp, Mus musculus
catcgagaatcagaactcacgccag

SEQ ID NO: 577694 - DNA, 25 bp, Mus musculus
catcgagaatgcctacaagaaaacc

SEQ ID NO: 577695 - DNA, 25 bp, Mus musculus
catcgagaatgcgtacaagaaaacc

SEQ ID NO: 577696 - DNA, 25 bp, Mus musculus
catcgagaccttagcaatgaacatc

SEQ ID NO: 577697 - DNA, 25 bp, Mus musculus
catcgagacctttgcaatgaacatc

SEQ ID NO: 577698 - DNA, 25 bp, Mus musculus
catcgagagagccaagcaggtcacg

SEQ ID NO: 577699 - DNA, 25 bp, Mus musculus
catcgagagagcgaagcaggtcacg

SEQ ID NO: 577700 - DNA, 25 bp, Mus musculus
catcgagcatctagtaaggcagtct

SEQ ID NO: 577701 - DNA, 25 bp, Mus musculus
catcgagcatcttgtaaggcagtct

SEQ ID NO: 577702 - DNA, 25 bp, Mus musculus
catcgaggacggcatcggcctgttc

SEQ ID NO: 577703 - DNA, 25 bp, Mus musculus
catcgaggacgggatcggcctgttc

SEQ ID NO: 577704 - DNA, 25 bp, Mus musculus
catcgaggagctctttcaaggaatc

SEQ ID NO: 577705 - DNA, 25 bp, Mus musculus
catcgaggagctgtttcaaggaatc

SEQ ID NO: 577706 - DNA, 25 bp, Mus musculus
catcgaggccttagagacttggcgc

SEQ ID NO: 577707 - DNA, 25 bp, Mus musculus
catcgaggcctttgagacttggcgc

SEQ ID NO: 577708 - DNA, 25 bp, Mus musculus
catcgaggcgctcaagaagcttaac

SEQ ID NO: 577709 - DNA, 25 bp, Mus musculus
catcgaggcgctgaagaagcttaac

SEQ ID NO: 577710 - DNA, 25 bp, Mus musculus
catcgaggcggtaaagcgcaagatc

SEQ ID NO: 577711 - DNA, 25 bp, Mus musculus
catcgaggcggttaagcgcaagatc

SEQ ID NO: 577712 - DNA, 25 bp, Mus musculus
catcgaggtgatctacgcacagtgc

SEQ ID NO: 577713 - DNA, 25 bp, Mus musculus
catcgaggtgatgtacgcacagtgc

SEQ ID NO: 577714 - DNA, 25 bp, Mus musculus
catcgagtggatccgtaggcatctt

SEQ ID NO: 577715 - DNA, 25 bp, Mus musculus
catcgagtggatgcgtaggcatctt

SEQ ID NO: 577716 - DNA, 25 bp, Mus musculus
catcgagtgtttccgctgtgtagcc

SEQ ID NO: 577717 - DNA, 25 bp, Mus musculus
catcgagtgtttgcgctgtgtagcc

SEQ ID NO: 577718 - DNA, 25 bp, Mus musculus
catcgataacgacttctgtggcact

SEQ ID NO: 577719 - DNA, 25 bp, Mus musculus
catcgataacgagttctgtggcact

SEQ ID NO: 577720 - DNA, 25 bp, Mus musculus
catcgataatcgaacaggctgcggt

SEQ ID NO: 577721 - DNA, 25 bp, Mus musculus
catcgataatcgtacaggctgcggt

SEQ ID NO: 577722 - DNA, 25 bp, Mus musculus
catcgatccatcaaaagttcacaac

SEQ ID NO: 577723 - DNA, 25 bp, Mus musculus
catcgatccatctaaagttcacaac

SEQ ID NO: 577724 - DNA, 25 bp, Mus musculus
catcgatccccaaggagaatttcag

SEQ ID NO: 577725 - DNA, 25 bp, Mus musculus
catcgatccccatggagaatttcag

SEQ ID NO: 577726 - DNA, 25 bp, Mus musculus
catcgatgagtgagcacagggcgcg

SEQ ID NO: 577727 - DNA, 25 bp, Mus musculus
catcgatgagtgtgcacagggcgcg

SEQ ID NO: 577728 - DNA, 25 bp, Mus musculus
catcgatgctgtcgccaagtttaca

SEQ ID NO: 577729 - DNA, 25 bp, Mus musculus
catcgatgctgtggccaagtttaca

SEQ ID NO: 577730 - DNA, 25 bp, Mus musculus
catcgatggaaacttcctctaccac

SEQ ID NO: 577731 - DNA, 25 bp, Mus musculus
catcgatggaaagttcctctaccac

SEQ ID NO: 577732 - DNA, 25 bp, Mus musculus
catcgatggcatcgtgtcatttcca

SEQ ID NO: 577733 - DNA, 25 bp, Mus musculus
catcgatggcatggtgtcatttcca

SEQ ID NO: 577734 - DNA, 25 bp, Mus musculus
catcgatgtggtcaggaataaaatc

SEQ ID NO: 577735 - DNA, 25 bp, Mus musculus
catcgatgtggtgaggaataaaatc

SEQ ID NO: 577736 - DNA, 25 bp, Mus musculus
catcgatgttctattcccgcacatg

SEQ ID NO: 577737 - DNA, 25 bp, Mus musculus
catcgatgttcttttcccgcacatg

SEQ ID NO: 577738 - DNA, 25 bp, Mus musculus
catcgattatggaaagctgggcgac

SEQ ID NO: 577739 - DNA, 25 bp, Mus musculus
catcgattatggtaagctgggcgac

SEQ ID NO: 577740 - DNA, 25 bp, Mus musculus
catcgattgaacctagaactcagtc

SEQ ID NO: 577741 - DNA, 25 bp, Mus musculus
catcgattgaacgtagaactcagtc

SEQ ID NO: 577742 - DNA, 25 bp, Mus musculus
catcgcacccggaagtgaagctact

SEQ ID NO: 577743 - DNA, 25 bp, Mus musculus
catcgcacccggtagtgaagctact

SEQ ID NO: 577744 - DNA, 25 bp, Mus musculus
catcgcaccgtgctgtacatgtgca

SEQ ID NO: 577745 - DNA, 25 bp, Mus musculus
catcgcaccgtggtgtacatgtgca

SEQ ID NO: 577746 - DNA, 25 bp, Mus musculus
catcgcacggagcagaattcgccta

SEQ ID NO: 577747 - DNA, 25 bp, Mus musculus
catcgcacggaggagaattcgccta

SEQ ID NO: 577748 - DNA, 25 bp, Mus musculus
catcgcagatctaggttatggccac

SEQ ID NO: 577749 - DNA, 25 bp, Mus musculus
catcgcagatcttggttatggccac

SEQ ID NO: 577750 - DNA, 25 bp, Mus musculus
catcgcagatgtattgcacatgaac

SEQ ID NO: 577751 - DNA, 25 bp, Mus musculus
catcgcagatgttttgcacatgaac

SEQ ID NO: 577752 - DNA, 25 bp, Mus musculus
catcgcagctttcaacaagatctga

SEQ ID NO: 577753 - DNA, 25 bp, Mus musculus
catcgcagctttgaacaagatctga

SEQ ID NO: 577754 - DNA, 25 bp, Mus musculus
catcgcaggacaagacctcaatgaa

SEQ ID NO: 577755 - DNA, 25 bp, Mus musculus
catcgcaggacatgacctcaatgaa

SEQ ID NO: 577756 - DNA, 25 bp, Mus musculus
catcgcagtcaaacttggactttgg

SEQ ID NO: 577757 - DNA, 25 bp, Mus musculus
catcgcagtcaatcttggactttgg

SEQ ID NO: 577758 - DNA, 25 bp, Mus musculus
catcgcatgaggacagagaccaagg

SEQ ID NO: 577759 - DNA, 25 bp, Mus musculus
catcgcatgaggtcagagaccaagg

SEQ ID NO: 577760 - DNA, 25 bp, Mus musculus
catcgcattgacacaggcacggtac

SEQ ID NO: 577761 - DNA, 25 bp, Mus musculus
catcgcattgactcaggcacggtac

SEQ ID NO: 577762 - DNA, 25 bp, Mus musculus
catcgccacggtcattttcagcagt

SEQ ID NO: 577763 - DNA, 25 bp, Mus musculus
catcgccacggtgattttcagcagt

SEQ ID NO: 577764 - DNA, 25 bp, Mus musculus
catcgccactaacggagtggtgcca

SEQ ID NO: 577765 - DNA, 25 bp, Mus musculus
catcgccactaagggagtggtgcca

SEQ ID NO: 577766 - DNA, 25 bp, Mus musculus
catcgccagagaatattctgcttaa

SEQ ID NO: 577767 - DNA, 25 bp, Mus musculus
catcgccagagattattctgcttaa

SEQ ID NO: 577768 - DNA, 25 bp, Mus musculus
catcgccatgtccttgcagatggat

SEQ ID NO: 577769 - DNA, 25 bp, Mus musculus
catcgccatgtcgttgcagatggat

SEQ ID NO: 577770 - DNA, 25 bp, Mus musculus
catcgcccacagcaggtgagttaga

SEQ ID NO: 577771 - DNA, 25 bp, Mus musculus
catcgcccacaggaggtgagttaga

SEQ ID NO: 577772 - DNA, 25 bp, Mus musculus
catcgcccactaagagcaatctgca

SEQ ID NO: 577773 - DNA, 25 bp, Mus musculus
catcgcccactatgagcaatctgca

SEQ ID NO: 577774 - DNA, 25 bp, Mus musculus
catcgcccaggcactaaaaactcaa

SEQ ID NO: 577775 - DNA, 25 bp, Mus musculus
catcgcccaggctctaaaaactcaa

SEQ ID NO: 577776 - DNA, 25 bp, Mus musculus
catcgccctggcaggagttggtgtt

SEQ ID NO: 577777 - DNA, 25 bp, Mus musculus
catcgccctggctggagttggtgtt

SEQ ID NO: 577778 - DNA, 25 bp, Mus musculus
catcgcgctgggaagatgacgtgat

SEQ ID NO: 577779 - DNA, 25 bp, Mus musculus
catcgcgctgggtagatgacgtgat

SEQ ID NO: 577780 - DNA, 25 bp, Mus musculus
catcgcgcttcgaggctgaagtaca

SEQ ID NO: 577781 - DNA, 25 bp, Mus musculus
catcgcgcttcgtggctgaagtaca

SEQ ID NO: 577782 - DNA, 25 bp, Mus musculus
catcgcggaggtacgcggacatcca

SEQ ID NO: 577783 - DNA, 25 bp, Mus musculus
catcgcggaggttcgcggacatcca

SEQ ID NO: 577784 - DNA, 25 bp, Mus musculus
catcgcggtgcaccgaatcaagcgg

SEQ ID NO: 577785 - DNA, 25 bp, Mus musculus
catcgcggtgcagcgaatcaagcgg

SEQ ID NO: 577786 - DNA, 25 bp, Mus musculus
catcgcggtgctagtgttgctcttc

SEQ ID NO: 577787 - DNA, 25 bp, Mus musculus
catcgcggtgcttgtgttgctcttc

SEQ ID NO: 577788 - DNA, 25 bp, Mus musculus
catcgctacgacaacgggaacttct

SEQ ID NO: 577789 - DNA, 25 bp, Mus musculus
catcgctacgactacgggaacttct

SEQ ID NO: 577790 - DNA, 25 bp, Mus musculus
catcgctagcaactgggtgtgcgat

SEQ ID NO: 577791 - DNA, 25 bp, Mus musculus
catcgctagcaagtgggtgtgcgat

SEQ ID NO: 577792 - DNA, 25 bp, Mus musculus
catcgctgacctagtggtgggactc

SEQ ID NO: 577793 - DNA, 25 bp, Mus musculus
catcgctgaccttgtggtgggactc

SEQ ID NO: 577794 - DNA, 25 bp, Mus musculus
catcgctgagaacggctttactggc

SEQ ID NO: 577795 - DNA, 25 bp, Mus musculus
catcgctgagaagggctttactggc

SEQ ID NO: 577796 - DNA, 25 bp, Mus musculus
catcgctgcatgaaaacctgacaca

SEQ ID NO: 577797 - DNA, 25 bp, Mus musculus
catcgctgcatgtaaacctgacaca

SEQ ID NO: 577798 - DNA, 25 bp, Mus musculus
catcgctgcgaaaaaagggcctctt

SEQ ID NO: 577799 - DNA, 25 bp, Mus musculus
catcgctgcgaataaagggcctctt

SEQ ID NO: 577800 - DNA, 25 bp, Mus musculus
catcgctggtggcatgaattacctg

SEQ ID NO: 577801 - DNA, 25 bp, Mus musculus
catcgctggtgggatgaattacctg

SEQ ID NO: 577802 - DNA, 25 bp, Mus musculus
catcgctgtggccagggccaactgt

SEQ ID NO: 577803 - DNA, 25 bp, Mus musculus
catcgctgtggcgagggccaactgt

SEQ ID NO: 577804 - DNA, 25 bp, Mus musculus
catcgctgtgggatgcacctgcatc

SEQ ID NO: 577805 - DNA, 25 bp, Mus musculus
catcgctgtgggttgcacctgcatc

SEQ ID NO: 577806 - DNA, 25 bp, Mus musculus
catcgctgttatccaagaggtcaga

SEQ ID NO: 577807 - DNA, 25 bp, Mus musculus
catcgctgttatgcaagaggtcaga

SEQ ID NO: 577808 - DNA, 25 bp, Mus musculus
catcgctgttccacgccaaatggga

SEQ ID NO: 577809 - DNA, 25 bp, Mus musculus
catcgctgttcctcgccaaatggga

SEQ ID NO: 577810 - DNA, 25 bp, Mus musculus
catcgcttgcaaaacggggcttcag

SEQ ID NO: 577811 - DNA, 25 bp, Mus musculus
catcgcttgcaatacggggcttcag

SEQ ID NO: 577812 - DNA, 25 bp, Mus musculus
catcgcttgttcatcgtgcatgaga

SEQ ID NO: 577813 - DNA, 25 bp, Mus musculus
catcgcttgttcttcgtgcatgaga

SEQ ID NO: 577814 - DNA, 25 bp, Mus musculus
catcggaacagtcctgtgtggcctg

SEQ ID NO: 577815 - DNA, 25 bp, Mus musculus
catcggaacagtgctgtgtggcctg

SEQ ID NO: 577816 - DNA, 25 bp, Mus musculus
catcggagatggaagtactggcctc

SEQ ID NO: 577817 - DNA, 25 bp, Mus musculus
catcggagatggtagtactggcctc

SEQ ID NO: 577818 - DNA, 25 bp, Mus musculus
catcggagccttcgccatgagtgaa

SEQ ID NO: 577819 - DNA, 25 bp, Mus musculus
catcggagccttggccatgagtgaa

SEQ ID NO: 577820 - DNA, 25 bp, Mus musculus
catcggagtctacctgccgtgcctg

SEQ ID NO: 577821 - DNA, 25 bp, Mus musculus
catcggagtctagctgccgtgcctg

SEQ ID NO: 577822 - DNA, 25 bp, Mus musculus
catcggagtctcatgttctgttggc

SEQ ID NO: 577823 - DNA, 25 bp, Mus musculus
catcggagtctcttgttctgttggc

SEQ ID NO: 577824 - DNA, 25 bp, Mus musculus
catcggatactcactggtgtgggct

SEQ ID NO: 577825 - DNA, 25 bp, Mus musculus
catcggatactctctggtgtgggct

SEQ ID NO: 577826 - DNA, 25 bp, Mus musculus
catcggatctgcagctgtgcttggc

SEQ ID NO: 577827 - DNA, 25 bp, Mus musculus
catcggatctgctgctgtgcttggc

SEQ ID NO: 577828 - DNA, 25 bp, Mus musculus
catcggattcttcctatttcaggcg

SEQ ID NO: 577829 - DNA, 25 bp, Mus musculus
catcggattcttgctatttcaggcg

SEQ ID NO: 577830 - DNA, 25 bp, Mus musculus
catcggcaaattacaagaggaggcc

SEQ ID NO: 577831 - DNA, 25 bp, Mus musculus
catcggcaaatttcaagaggaggcc

SEQ ID NO: 577832 - DNA, 25 bp, Mus musculus
catcggcaatctacacgggaagcgt

SEQ ID NO: 577833 - DNA, 25 bp, Mus musculus
catcggcaatcttcacgggaagcgt

SEQ ID NO: 577834 - DNA, 25 bp, Mus musculus
catcggcaatggcaatgggttgatc

SEQ ID NO: 577835 - DNA, 25 bp, Mus musculus
catcggcaatgggaatgggttgatc

SEQ ID NO: 577836 - DNA, 25 bp, Mus musculus
catcggcagcggacattttgtgggc

SEQ ID NO: 577837 - DNA, 25 bp, Mus musculus
catcggcagcggtcattttgtgggc

SEQ ID NO: 577838 - DNA, 25 bp, Mus musculus
catcggcaggttatgcttgaaatat

SEQ ID NO: 577839 - DNA, 25 bp, Mus musculus
catcggcaggttttgcttgaaatat

SEQ ID NO: 577840 - DNA, 25 bp, Mus musculus
catcggcatcatcatcatccttgtg

SEQ ID NO: 577841 - DNA, 25 bp, Mus musculus
catcggcatcatgatcatccttgtg

SEQ ID NO: 577842 - DNA, 25 bp, Mus musculus
catcggcatggtcattggacatgaa

SEQ ID NO: 577843 - DNA, 25 bp, Mus musculus
catcggcatggtgattggacatgaa

SEQ ID NO: 577844 - DNA, 25 bp, Mus musculus
catcggccacaaagaagtgatcggg

SEQ ID NO: 577845 - DNA, 25 bp, Mus musculus
catcggccacaatgaagtgatcggg

SEQ ID NO: 577846 - DNA, 25 bp, Mus musculus
catcggccctgcagatgggttctga

SEQ ID NO: 577847 - DNA, 25 bp, Mus musculus
catcggccctgctgatgggttctga

SEQ ID NO: 577848 - DNA, 25 bp, Mus musculus
catcggcgaagacaacagagagtcg

SEQ ID NO: 577849 - DNA, 25 bp, Mus musculus
catcggcgaagagaacagagagtcg

SEQ ID NO: 577850 - DNA, 25 bp, Mus musculus
catcggcgtcgtcgtgggtcacatc

SEQ ID NO: 577851 - DNA, 25 bp, Mus musculus
catcggcgtcgtggtgggtcacatc

SEQ ID NO: 577852 - DNA, 25 bp, Mus musculus
catcggctcacaagacaaagcacga

SEQ ID NO: 577853 - DNA, 25 bp, Mus musculus
catcggctcacatgacaaagcacga

SEQ ID NO: 577854 - DNA, 25 bp, Mus musculus
catcggctggaaagatttcactgca

SEQ ID NO: 577855 - DNA, 25 bp, Mus musculus
catcggctggaatgatttcactgca

SEQ ID NO: 577856 - DNA, 25 bp, Mus musculus
catcggctggacctggtacttccta

SEQ ID NO: 577857 - DNA, 25 bp, Mus musculus
catcggctggacgtggtacttccta

SEQ ID NO: 577858 - DNA, 25 bp, Mus musculus
catcggctgtccctctatgtgctgc

SEQ ID NO: 577859 - DNA, 25 bp, Mus musculus
catcggctgtccgtctatgtgctgc

SEQ ID NO: 577860 - DNA, 25 bp, Mus musculus
catcggcttaatacagcccttggga

SEQ ID NO: 577861 - DNA, 25 bp, Mus musculus
catcggcttaattcagcccttggga

SEQ ID NO: 577862 - DNA, 25 bp, Mus musculus
catcgggacagaaaggtgttcaagt

SEQ ID NO: 577863 - DNA, 25 bp, Mus musculus
catcgggacagataggtgttcaagt

SEQ ID NO: 577864 - DNA, 25 bp, Mus musculus
catcgggagttgacgtctataagaa

SEQ ID NO: 577865 - DNA, 25 bp, Mus musculus
catcgggagttgtcgtctataagaa

SEQ ID NO: 577866 - DNA, 25 bp, Mus musculus
catcgggccccactgctttgagcta

SEQ ID NO: 577867 - DNA, 25 bp, Mus musculus
catcgggccccagtgctttgagcta

SEQ ID NO: 577868 - DNA, 25 bp, Mus musculus
catcgggccctcaaaatgattgtgg

SEQ ID NO: 577869 - DNA, 25 bp, Mus musculus
catcgggccctctaaatgattgtgg

SEQ ID NO: 577870 - DNA, 25 bp, Mus musculus
catcgggctggaaaaggacaaaccc

SEQ ID NO: 577871 - DNA, 25 bp, Mus musculus
catcgggctggataaggacaaaccc

SEQ ID NO: 577872 - DNA, 25 bp, Mus musculus
catcgggtaagtccccttgtcttgg

SEQ ID NO: 577873 - DNA, 25 bp, Mus musculus
catcgggtaagtgcccttgtcttgg

SEQ ID NO: 577874 - DNA, 25 bp, Mus musculus
catcgggtattaagtcattggcctc

SEQ ID NO: 577875 - DNA, 25 bp, Mus musculus
catcgggtattatgtcattggcctc

SEQ ID NO: 577876 - DNA, 25 bp, Mus musculus
catcggtctagtaccagtgagcagc

SEQ ID NO: 577877 - DNA, 25 bp, Mus musculus
catcggtctagttccagtgagcagc

SEQ ID NO: 577878 - DNA, 25 bp, Mus musculus
catcggtgaagcagcagggaagcta

SEQ ID NO: 577879 - DNA, 25 bp, Mus musculus
catcggtgaagctgcagggaagcta

SEQ ID NO: 577880 - DNA, 25 bp, Mus musculus
catcggtgaccacatcttggacctg

SEQ ID NO: 577881 - DNA, 25 bp, Mus musculus
catcggtgaccagatcttggacctg

SEQ ID NO: 577882 - DNA, 25 bp, Mus musculus
catcggtgcatgctccacagtgtat

SEQ ID NO: 577883 - DNA, 25 bp, Mus musculus
catcggtgcatggtccacagtgtat

SEQ ID NO: 577884 - DNA, 25 bp, Mus musculus
catcggtgggcgacaactttgcctt

SEQ ID NO: 577885 - DNA, 25 bp, Mus musculus
catcggtgggcgtcaactttgcctt

SEQ ID NO: 577886 - DNA, 25 bp, Mus musculus
catcggtgtcatagtctactgctgc

SEQ ID NO: 577887 - DNA, 25 bp, Mus musculus
catcggtgtcattgtctactgctgc

SEQ ID NO: 577888 - DNA, 25 bp, Mus musculus
catcggtgtccgaggcaaatggaag

SEQ ID NO: 577889 - DNA, 25 bp, Mus musculus
catcggtgtccgtggcaaatggaag

SEQ ID NO: 577890 - DNA, 25 bp, Mus musculus
catcggttccatcaccgtggtgatt

SEQ ID NO: 577891 - DNA, 25 bp, Mus musculus
catcggttccatgaccgtggtgatt

SEQ ID NO: 577892 - DNA, 25 bp, Mus musculus
catcggttgcctagggaatgaccac

SEQ ID NO: 577893 - DNA, 25 bp, Mus musculus
catcggttgccttgggaatgaccac

SEQ ID NO: 577894 - DNA, 25 bp, Mus musculus
catcgtaccaagagaacagtctcta

SEQ ID NO: 577895 - DNA, 25 bp, Mus musculus
catcgtaccaagtgaacagtctcta

SEQ ID NO: 577896 - DNA, 25 bp, Mus musculus
catcgtaccttcagcagttgaacat

SEQ ID NO: 577897 - DNA, 25 bp, Mus musculus
catcgtaccttctgcagttgaacat

SEQ ID NO: 577898 - DNA, 25 bp, Mus musculus
catcgtagctctacgcagggcaaaa

SEQ ID NO: 577899 - DNA, 25 bp, Mus musculus
catcgtagctcttcgcagggcaaaa

SEQ ID NO: 577900 - DNA, 25 bp, Mus musculus
catcgtagggaacactcatgggcag

SEQ ID NO: 577901 - DNA, 25 bp, Mus musculus
catcgtagggaagactcatgggcag

SEQ ID NO: 577902 - DNA, 25 bp, Mus musculus
catcgtagtctcaccgtagctcctg

SEQ ID NO: 577903 - DNA, 25 bp, Mus musculus
catcgtagtctctccgtagctcctg

SEQ ID NO: 577904 - DNA, 25 bp, Mus musculus
catcgtatagttagagggcctctgc

SEQ ID NO: 577905 - DNA, 25 bp, Mus musculus
catcgtatagtttgagggcctctgc

SEQ ID NO: 577906 - DNA, 25 bp, Mus musculus
catcgtatccaacaccaaggaaggg

SEQ ID NO: 577907 - DNA, 25 bp, Mus musculus
catcgtatccaagaccaaggaaggg

SEQ ID NO: 577908 - DNA, 25 bp, Mus musculus
catcgtatcccacttcggacagaga

SEQ ID NO: 577909 - DNA, 25 bp, Mus musculus
catcgtatcccagttcggacagaga

SEQ ID NO: 577910 - DNA, 25 bp, Mus musculus
catcgtcaatgtccctggagagtca

SEQ ID NO: 577911 - DNA, 25 bp, Mus musculus
catcgtcaatgtgcctggagagtca

SEQ ID NO: 577912 - DNA, 25 bp, Mus musculus
catcgtcactgcaaggagccggtgg

SEQ ID NO: 577913 - DNA, 25 bp, Mus musculus
catcgtcactgctaggagccggtgg

SEQ ID NO: 577914 - DNA, 25 bp, Mus musculus
catcgtcagtcacgtcaaagtaccg

SEQ ID NO: 577915 - DNA, 25 bp, Mus musculus
catcgtcagtcaggtcaaagtaccg

SEQ ID NO: 577916 - DNA, 25 bp, Mus musculus
catcgtcatgtaagccgtgggcgtg

SEQ ID NO: 577917 - DNA, 25 bp, Mus musculus
catcgtcatgtatgccgtgggcgtg

SEQ ID NO: 577918 - DNA, 25 bp, Mus musculus
catcgtccacgacatcgacagcatt

SEQ ID NO: 577919 - DNA, 25 bp, Mus musculus
catcgtccacgagatcgacagcatt

SEQ ID NO: 577920 - DNA, 25 bp, Mus musculus
catcgtccgcttcgtggaggagact

SEQ ID NO: 577921 - DNA, 25 bp, Mus musculus
catcgtccgcttggtggaggagact

SEQ ID NO: 577922 - DNA, 25 bp, Mus musculus
catcgtccgtaaagtggaggcgcaa

SEQ ID NO: 577923 - DNA, 25 bp, Mus musculus
catcgtccgtaatgtggaggcgcaa

SEQ ID NO: 577924 - DNA, 25 bp, Mus musculus
catcgtccttgacagggttgctgga

SEQ ID NO: 577925 - DNA, 25 bp, Mus musculus
catcgtccttgagagggttgctgga

SEQ ID NO: 577926 - DNA, 25 bp, Mus musculus
catcgtcggcctctttatcttctac

SEQ ID NO: 577927 - DNA, 25 bp, Mus musculus
catcgtcggcctgtttatcttctac

SEQ ID NO: 577928 - DNA, 25 bp, Mus musculus
catcgtcgttctagtttttcaggtc

SEQ ID NO: 577929 - DNA, 25 bp, Mus musculus
catcgtcgttcttgtttttcaggtc

SEQ ID NO: 577930 - DNA, 25 bp, Mus musculus
catcgtctacacagaggccattaaa

SEQ ID NO: 577931 - DNA, 25 bp, Mus musculus
catcgtctacactgaggccattaaa

SEQ ID NO: 577932 - DNA, 25 bp, Mus musculus
catcgtctcaggcaagtatgacagc

SEQ ID NO: 577933 - DNA, 25 bp, Mus musculus
catcgtctcagggaagtatgacagc

SEQ ID NO: 577934 - DNA, 25 bp, Mus musculus
catcgtctcatcagtcccgttggag

SEQ ID NO: 577935 - DNA, 25 bp, Mus musculus
catcgtctcatctgtcccgttggag

SEQ ID NO: 577936 - DNA, 25 bp, Mus musculus
catcgtctgtatcgaggagatggat

SEQ ID NO: 577937 - DNA, 25 bp, Mus musculus
catcgtctgtatggaggagatggat

SEQ ID NO: 577938 - DNA, 25 bp, Mus musculus
catcgtcttctgcaacagttcaaat

SEQ ID NO: 577939 - DNA, 25 bp, Mus musculus
catcgtcttctggaacagttcaaat

SEQ ID NO: 577940 - DNA, 25 bp, Mus musculus
catcgtgagaacatgaaacaggcgc

SEQ ID NO: 577941 - DNA, 25 bp, Mus musculus
catcgtgagaacttgaaacaggcgc

SEQ ID NO: 577942 - DNA, 25 bp, Mus musculus
catcgtgcagccagggaagagacct

SEQ ID NO: 577943 - DNA, 25 bp, Mus musculus
catcgtgcagcctgggaagagacct

SEQ ID NO: 577944 - DNA, 25 bp, Mus musculus
catcgtgcatgacatctgtggatgg

SEQ ID NO: 577945 - DNA, 25 bp, Mus musculus
catcgtgcatgagatctgtggatgg

SEQ ID NO: 577946 - DNA, 25 bp, Mus musculus
catcgtgccaggcatgaaggctgct

SEQ ID NO: 577947 - DNA, 25 bp, Mus musculus
catcgtgccagggatgaaggctgct

SEQ ID NO: 577948 - DNA, 25 bp, Mus musculus
catcgtgctgtacgagctgatggct

SEQ ID NO: 577949 - DNA, 25 bp, Mus musculus
catcgtgctgtaggagctgatggct

SEQ ID NO: 577950 - DNA, 25 bp, Mus musculus
catcgtgctttgagctgctacatga

SEQ ID NO: 577951 - DNA, 25 bp, Mus musculus
catcgtgctttgtgctgctacatga

SEQ ID NO: 577952 - DNA, 25 bp, Mus musculus
catcgtggagaactgtaactgccgc

SEQ ID NO: 577953 - DNA, 25 bp, Mus musculus
catcgtggagaagtgtaactgccgc

SEQ ID NO: 577954 - DNA, 25 bp, Mus musculus
catcgtggagacatactatggacca

SEQ ID NO: 577955 - DNA, 25 bp, Mus musculus
catcgtggagacttactatggacca

SEQ ID NO: 577956 - DNA, 25 bp, Mus musculus
catcgtggagatatcactgacctgc

SEQ ID NO: 577957 - DNA, 25 bp, Mus musculus
catcgtggagatttcactgacctgc

SEQ ID NO: 577958 - DNA, 25 bp, Mus musculus
catcgtggctggatatgggtcacca

SEQ ID NO: 577959 - DNA, 25 bp, Mus musculus
catcgtggctggttatgggtcacca

SEQ ID NO: 577960 - DNA, 25 bp, Mus musculus
catcgtggctgtcatagtgtgtacc

SEQ ID NO: 577961 - DNA, 25 bp, Mus musculus
catcgtggctgtgatagtgtgtacc

SEQ ID NO: 577962 - DNA, 25 bp, Mus musculus
catcgtgggccacagcaacgaccgg

SEQ ID NO: 577963 - DNA, 25 bp, Mus musculus
catcgtgggccagagcaacgaccgg

SEQ ID NO: 577964 - DNA, 25 bp, Mus musculus
catcgtggtcaaacagcaaaggcca

SEQ ID NO: 577965 - DNA, 25 bp, Mus musculus
catcgtggtcaatcagcaaaggcca

SEQ ID NO: 577966 - DNA, 25 bp, Mus musculus
catcgtggtcacaatacctcgtccg

SEQ ID NO: 577967 - DNA, 25 bp, Mus musculus
catcgtggtcacattggttgaaatg

SEQ ID NO: 577968 - DNA, 25 bp, Mus musculus
catcgtggtcactatacctcgtccg

SEQ ID NO: 577969 - DNA, 25 bp, Mus musculus
catcgtggtcactttggttgaaatg

SEQ ID NO: 577970 - DNA, 25 bp, Mus musculus
catcgtggtctgaggaaacatcaca

SEQ ID NO: 577971 - DNA, 25 bp, Mus musculus
catcgtggtctgtggaaacatcaca

SEQ ID NO: 577972 - DNA, 25 bp, Mus musculus
catcgtggtggacgccacctctcta

SEQ ID NO: 577973 - DNA, 25 bp, Mus musculus
catcgtggtggaggccacctctcta

SEQ ID NO: 577974 - DNA, 25 bp, Mus musculus
catcgtggtgggaggtgcagctgag

SEQ ID NO: 577975 - DNA, 25 bp, Mus musculus
catcgtggtgggtggtgcagctgag

SEQ ID NO: 577976 - DNA, 25 bp, Mus musculus
catcgtgtacgacagcaacaccagt

SEQ ID NO: 577977 - DNA, 25 bp, Mus musculus
catcgtgtacgagagcaacaccagt

SEQ ID NO: 577978 - DNA, 25 bp, Mus musculus
catcgtgtggtgctcatcttcaagc

SEQ ID NO: 577979 - DNA, 25 bp, Mus musculus
catcgtgtggtggtcatcttcaagc

SEQ ID NO: 577980 - DNA, 25 bp, Mus musculus
catcgtgtggttcaagacatgggcc

SEQ ID NO: 577981 - DNA, 25 bp, Mus musculus
catcgtgtggttgaagacatgggcc

SEQ ID NO: 577982 - DNA, 25 bp, Mus musculus
catcgtgtttataattggaggagcc

SEQ ID NO: 577983 - DNA, 25 bp, Mus musculus
catcgtgtttattattggaggagcc

SEQ ID NO: 577984 - DNA, 25 bp, Mus musculus
catcgttcctggagggaagagcatg

SEQ ID NO: 577985 - DNA, 25 bp, Mus musculus
catcgttcctggtgggaagagcatg

SEQ ID NO: 577986 - DNA, 25 bp, Mus musculus
catcgttcgagcaaggtacttgggc

SEQ ID NO: 577987 - DNA, 25 bp, Mus musculus
catcgttcgagctaggtacttgggc

SEQ ID NO: 577988 - DNA, 25 bp, Mus musculus
catcgttctcttactcaacaagaag

SEQ ID NO: 577989 - DNA, 25 bp, Mus musculus
catcgttctctttctcaacaagaag

SEQ ID NO: 577990 - DNA, 25 bp, Mus musculus
catcgttctgtcctctgggaccaag

SEQ ID NO: 577991 - DNA, 25 bp, Mus musculus
catcgttctgtcgtctgggaccaag

SEQ ID NO: 577992 - DNA, 25 bp, Mus musculus
catcgttctgtgctagccctcggaa

SEQ ID NO: 577993 - DNA, 25 bp, Mus musculus
catcgttctgtggtagccctcggaa

SEQ ID NO: 577994 - DNA, 25 bp, Mus musculus
catcgttggagacgaacccctatga

SEQ ID NO: 577995 - DNA, 25 bp, Mus musculus
catcgttggagaggaacccctatga

SEQ ID NO: 577996 - DNA, 25 bp, Mus musculus
catcgtttccttactgaagtcagga

SEQ ID NO: 577997 - DNA, 25 bp, Mus musculus
catcgtttcctttctgaagtcagga

SEQ ID NO: 577998 - DNA, 25 bp, Mus musculus
catcgttttcacaagcgtcgggacc

SEQ ID NO: 577999 - DNA, 25 bp, Mus musculus
catcgttttcactagcgtcgggacc

SEQ ID NO: 578000 - DNA, 25 bp, Mus musculus
catctaaaatttaaccaagagtcgg

SEQ ID NO: 578001 - DNA, 25 bp, Mus musculus
catctaaaattttaccaagagtcgg

SEQ ID NO: 578002 - DNA, 25 bp, Mus musculus
catctaaatagacttaaggtgcacc

SEQ ID NO: 578003 - DNA, 25 bp, Mus musculus
catctaaatagagttaaggtgcacc

SEQ ID NO: 578004 - DNA, 25 bp, Mus musculus
catctaacacatatgtggctcccca

SEQ ID NO: 578005 - DNA, 25 bp, Mus musculus
catctaacacatttgtggctcccca

SEQ ID NO: 578006 - DNA, 25 bp, Mus musculus
catctaagagccaagatgtacggca

SEQ ID NO: 578007 - DNA, 25 bp, Mus musculus
catctaagagcctagatgtacggca

SEQ ID NO: 578008 - DNA, 25 bp, Mus musculus
catctaatgggtatatagtggccac

SEQ ID NO: 578009 - DNA, 25 bp, Mus musculus
catctaatgggtttatagtggccac

SEQ ID NO: 578010 - DNA, 25 bp, Mus musculus
catctacaaaagctgagtttacttc

SEQ ID NO: 578011 - DNA, 25 bp, Mus musculus
catctacaaaaggtgagtttacttc

SEQ ID NO: 578012 - DNA, 25 bp, Mus musculus
catctacaacaacatgaagcagttc

SEQ ID NO: 578013 - DNA, 25 bp, Mus musculus
catctacaacaagatgaagcagttc

SEQ ID NO: 578014 - DNA, 25 bp, Mus musculus
catctacaagcacggccttaaatgt

SEQ ID NO: 578015 - DNA, 25 bp, Mus musculus
catctacaagcagggccttaaatgt

SEQ ID NO: 578016 - DNA, 25 bp, Mus musculus
catctacactacagaagttcacaag

SEQ ID NO: 578017 - DNA, 25 bp, Mus musculus
catctacactactgaagttcacaag

SEQ ID NO: 578018 - DNA, 25 bp, Mus musculus
catctacagcagaggaggtcaagtt

SEQ ID NO: 578019 - DNA, 25 bp, Mus musculus
catctacagcagtggaggtcaagtt

SEQ ID NO: 578020 - DNA, 25 bp, Mus musculus
catctacagcggcaacgcaggttcc

SEQ ID NO: 578021 - DNA, 25 bp, Mus musculus
catctacagcgggaacgcaggttcc

SEQ ID NO: 578022 - DNA, 25 bp, Mus musculus
catctacatcagctgtgcatcggag

SEQ ID NO: 578023 - DNA, 25 bp, Mus musculus
catctacatcaggtgtgcatcggag

SEQ ID NO: 578024 - DNA, 25 bp, Mus musculus
catctacatctacacggatcacatg

SEQ ID NO: 578025 - DNA, 25 bp, Mus musculus
catctacatctagacggatcacatg

SEQ ID NO: 578026 - DNA, 25 bp, Mus musculus
catctacattagctcagattatgtg

SEQ ID NO: 578027 - DNA, 25 bp, Mus musculus
catctacattaggtcagattatgtg

SEQ ID NO: 578028 - DNA, 25 bp, Mus musculus
catctacattctcattgctgtggga

SEQ ID NO: 578029 - DNA, 25 bp, Mus musculus
catctacattctgattgctgtggga

SEQ ID NO: 578030 - DNA, 25 bp, Mus musculus
catctaccacatcttcatagcgggc

SEQ ID NO: 578031 - DNA, 25 bp, Mus musculus
catctaccacatgttcatagcgggc

SEQ ID NO: 578032 - DNA, 25 bp, Mus musculus
catctaccctttaggttggcctgta

SEQ ID NO: 578033 - DNA, 25 bp, Mus musculus
catctacccttttggttggcctgta

SEQ ID NO: 578034 - DNA, 25 bp, Mus musculus
catctaccgtaacagcttgagacac

SEQ ID NO: 578035 - DNA, 25 bp, Mus musculus
catctaccgtaagagcttgagacac

SEQ ID NO: 578036 - DNA, 25 bp, Mus musculus
catctacctggccaatctggaggtc

SEQ ID NO: 578037 - DNA, 25 bp, Mus musculus
catctacctggcgaatctggaggtc

SEQ ID NO: 578038 - DNA, 25 bp, Mus musculus
catctacgacagaaagttcctgctg

SEQ ID NO: 578039 - DNA, 25 bp, Mus musculus
catctacgacagtaagttcctgctg

SEQ ID NO: 578040 - DNA, 25 bp, Mus musculus
catctacgagatcgctgctggttac

SEQ ID NO: 578041 - DNA, 25 bp, Mus musculus
catctacgagatggctgctggttac

SEQ ID NO: 578042 - DNA, 25 bp, Mus musculus
catctagagatgagggcatggcaga

SEQ ID NO: 578043 - DNA, 25 bp, Mus musculus
catctagagatgtgggcatggcaga

SEQ ID NO: 578044 - DNA, 25 bp, Mus musculus
catctagagtaaaagctccaagctc

SEQ ID NO: 578045 - DNA, 25 bp, Mus musculus
catctagagtaatagctccaagctc

SEQ ID NO: 578046 - DNA, 25 bp, Mus musculus
catctagggacgagccaggaataca

SEQ ID NO: 578047 - DNA, 25 bp, Mus musculus
catctagggacgtgccaggaataca

SEQ ID NO: 578048 - DNA, 25 bp, Mus musculus
catctagggtggcagcggctaccta

SEQ ID NO: 578049 - DNA, 25 bp, Mus musculus
catctagggtgggagcggctaccta

SEQ ID NO: 578050 - DNA, 25 bp, Mus musculus
catctagtctgtccttctcggagtc

SEQ ID NO: 578051 - DNA, 25 bp, Mus musculus
catctagtctgtgcttctcggagtc

SEQ ID NO: 578052 - DNA, 25 bp, Mus musculus
catctagtgggacgacagtgacttc

SEQ ID NO: 578053 - DNA, 25 bp, Mus musculus
catctagtgggaggacagtgacttc

SEQ ID NO: 578054 - DNA, 25 bp, Mus musculus
catctataagatcaagagcggcacc

SEQ ID NO: 578055 - DNA, 25 bp, Mus musculus
catctataagatgaagagcggcacc

SEQ ID NO: 578056 - DNA, 25 bp, Mus musculus
catctataatcacataggctatggg

SEQ ID NO: 578057 - DNA, 25 bp, Mus musculus
catctataatcagataggctatggg

SEQ ID NO: 578058 - DNA, 25 bp, Mus musculus
catctatagctgaggcagccacagg

SEQ ID NO: 578059 - DNA, 25 bp, Mus musculus
catctatagctgtggcagccacagg

SEQ ID NO: 578060 - DNA, 25 bp, Mus musculus
catctatcagatagagcattactcc

SEQ ID NO: 578061 - DNA, 25 bp, Mus musculus
catctatcagattgagcattactcc

SEQ ID NO: 578062 - DNA, 25 bp, Mus musculus
catctatgagaacagcggtgccaag

SEQ ID NO: 578063 - DNA, 25 bp, Mus musculus
catctatgagaagagcggtgccaag

SEQ ID NO: 578064 - DNA, 25 bp, Mus musculus
catctatgatgtagaaatggacaca

SEQ ID NO: 578065 - DNA, 25 bp, Mus musculus
catctatgatgttgaaatggacaca

SEQ ID NO: 578066 - DNA, 25 bp, Mus musculus
catctatgctgaaagggctggctac

SEQ ID NO: 578067 - DNA, 25 bp, Mus musculus
catctatgctgatagggctggctac

SEQ ID NO: 578068 - DNA, 25 bp, Mus musculus
catctatgctggcaagatcttgagt

SEQ ID NO: 578069 - DNA, 25 bp, Mus musculus
catctatgctgggaagatcttgagt

SEQ ID NO: 578070 - DNA, 25 bp, Mus musculus
catctatggcatcatcatggcaatt

SEQ ID NO: 578071 - DNA, 25 bp, Mus musculus
catctatggcatgatcatggcaatt

SEQ ID NO: 578072 - DNA, 25 bp, Mus musculus
catctatggtggctcatcagcagcc

SEQ ID NO: 578073 - DNA, 25 bp, Mus musculus
catctatggtgggtcatcagcagcc

SEQ ID NO: 578074 - DNA, 25 bp, Mus musculus
catctatgtgcgacttacgttgcaa

SEQ ID NO: 578075 - DNA, 25 bp, Mus musculus
catctatgtgcgtcttacgttgcaa

SEQ ID NO: 578076 - DNA, 25 bp, Mus musculus
catctatgtggcaggtgcctttgac

SEQ ID NO: 578077 - DNA, 25 bp, Mus musculus
catctatgtggccttcctccgtggc

SEQ ID NO: 578078 - DNA, 25 bp, Mus musculus
catctatgtggcgttcctccgtggc

SEQ ID NO: 578079 - DNA, 25 bp, Mus musculus
catctatgtggctggtgcctttgac

SEQ ID NO: 578080 - DNA, 25 bp, Mus musculus
catctattcaacacgccccgatgtg

SEQ ID NO: 578081 - DNA, 25 bp, Mus musculus
catctattcaactcgccccgatgtg

SEQ ID NO: 578082 - DNA, 25 bp, Mus musculus
catctattgaggagcagtagggaac

SEQ ID NO: 578083 - DNA, 25 bp, Mus musculus
catctattgaggtgcagtagggaac

SEQ ID NO: 578084 - DNA, 25 bp, Mus musculus
catctcaagatccttggccaccgta

SEQ ID NO: 578085 - DNA, 25 bp, Mus musculus
catctcaagatcgttggccaccgta

SEQ ID NO: 578086 - DNA, 25 bp, Mus musculus
catctcaagctgcatcaaaagataa

SEQ ID NO: 578087 - DNA, 25 bp, Mus musculus
catctcaagctggatcaaaagataa

SEQ ID NO: 578088 - DNA, 25 bp, Mus musculus
catctcaaggaccagactgtgtata

SEQ ID NO: 578089 - DNA, 25 bp, Mus musculus
catctcaaggacgagactgtgtata

SEQ ID NO: 578090 - DNA, 25 bp, Mus musculus
catctcacatagcttagactggcct

SEQ ID NO: 578091 - DNA, 25 bp, Mus musculus
catctcacataggttagactggcct

SEQ ID NO: 578092 - DNA, 25 bp, Mus musculus
catctcacgcaaagtggcgcttgtc

SEQ ID NO: 578093 - DNA, 25 bp, Mus musculus
catctcacgcaatgtggcgcttgtc

SEQ ID NO: 578094 - DNA, 25 bp, Mus musculus
catctcacgtgactgctggtctcct

SEQ ID NO: 578095 - DNA, 25 bp, Mus musculus
catctcacgtgagtgctggtctcct

SEQ ID NO: 578096 - DNA, 25 bp, Mus musculus
catctcactctgaatccatgcatgt

SEQ ID NO: 578097 - DNA, 25 bp, Mus musculus
catctcactctgtatccatgcatgt

SEQ ID NO: 578098 - DNA, 25 bp, Mus musculus
catctcactgctccacagtgcagat

SEQ ID NO: 578099 - DNA, 25 bp, Mus musculus
catctcactgctgcacagtgcagat

SEQ ID NO: 578100 - DNA, 25 bp, Mus musculus
catctcagaagcatgactgtggcca

SEQ ID NO: 578101 - DNA, 25 bp, Mus musculus
catctcagaagcttgactgtggcca

SEQ ID NO: 578102 - DNA, 25 bp, Mus musculus
catctcagaagtcatcagcgtcacg

SEQ ID NO: 578103 - DNA, 25 bp, Mus musculus
catctcagaagtgatcagcgtcacg

SEQ ID NO: 578104 - DNA, 25 bp, Mus musculus
catctcagacttccaagaaaaagtc

SEQ ID NO: 578105 - DNA, 25 bp, Mus musculus
catctcagacttgcaagaaaaagtc

SEQ ID NO: 578106 - DNA, 25 bp, Mus musculus
catctcagagaccagacgtggagcg

SEQ ID NO: 578107 - DNA, 25 bp, Mus musculus
catctcagagacgagacgtggagcg

SEQ ID NO: 578108 - DNA, 25 bp, Mus musculus
catctcagagcacgcatgatgctgc

SEQ ID NO: 578109 - DNA, 25 bp, Mus musculus
catctcagagcaggcatgatgctgc

SEQ ID NO: 578110 - DNA, 25 bp, Mus musculus
catctcagagttacaggatgacctg

SEQ ID NO: 578111 - DNA, 25 bp, Mus musculus
catctcagagtttcaggatgacctg

SEQ ID NO: 578112 - DNA, 25 bp, Mus musculus
catctcagctgtcgatgggctgacc

SEQ ID NO: 578113 - DNA, 25 bp, Mus musculus
catctcagctgtggatgggctgacc

SEQ ID NO: 578114 - DNA, 25 bp, Mus musculus
catctcaggacacctgtcagtcaca

SEQ ID NO: 578115 - DNA, 25 bp, Mus musculus
catctcaggacagctgtcagtcaca

SEQ ID NO: 578116 - DNA, 25 bp, Mus musculus
catctcaggcgcatgcggaactgga

SEQ ID NO: 578117 - DNA, 25 bp, Mus musculus
catctcaggcgcttgcggaactgga

SEQ ID NO: 578118 - DNA, 25 bp, Mus musculus
catctcagggcccaaaacggaggca

SEQ ID NO: 578119 - DNA, 25 bp, Mus musculus
catctcagggccgaaaacggaggca

SEQ ID NO: 578120 - DNA, 25 bp, Mus musculus
catctcagtgccctggtggcatctg

SEQ ID NO: 578121 - DNA, 25 bp, Mus musculus
catctcagtgccgtggtggcatctg

SEQ ID NO: 578122 - DNA, 25 bp, Mus musculus
catctcatagcacgaacacacacgg

SEQ ID NO: 578123 - DNA, 25 bp, Mus musculus
catctcatagcaggaacacacacgg

SEQ ID NO: 578124 - DNA, 25 bp, Mus musculus
catctcataggcactgtagtcacca

SEQ ID NO: 578125 - DNA, 25 bp, Mus musculus
catctcataggctctgtagtcacca

SEQ ID NO: 578126 - DNA, 25 bp, Mus musculus
catctcatagtacctggctgggacc

SEQ ID NO: 578127 - DNA, 25 bp, Mus musculus
catctcatagtagctggctgggacc

SEQ ID NO: 578128 - DNA, 25 bp, Mus musculus
catctcatatggcatggtgggcgca

SEQ ID NO: 578129 - DNA, 25 bp, Mus musculus
catctcatatgggatggtgggcgca

SEQ ID NO: 578130 - DNA, 25 bp, Mus musculus
catctcatgggcaattgtcttctct

SEQ ID NO: 578131 - DNA, 25 bp, Mus musculus
catctcatgggctattgtcttctct

SEQ ID NO: 578132 - DNA, 25 bp, Mus musculus
catctcatttgtagccagtcaccag

SEQ ID NO: 578133 - DNA, 25 bp, Mus musculus
catctcatttgttgccagtcaccag

SEQ ID NO: 578134 - DNA, 25 bp, Mus musculus
catctccaagcaaagctggctcacg

SEQ ID NO: 578135 - DNA, 25 bp, Mus musculus
catctccaagcatagctggctcacg

SEQ ID NO: 578136 - DNA, 25 bp, Mus musculus
catctccaagtccagcagaaagtcc

SEQ ID NO: 578137 - DNA, 25 bp, Mus musculus
catctccaagtcctagaagtcctaa

SEQ ID NO: 578138 - DNA, 25 bp, Mus musculus
catctccaagtcgagcagaaagtcc

SEQ ID NO: 578139 - DNA, 25 bp, Mus musculus
catctccaagtcgtagaagtcctaa

SEQ ID NO: 578140 - DNA, 25 bp, Mus musculus
catctccaccttcggagaggccgtt

SEQ ID NO: 578141 - DNA, 25 bp, Mus musculus
catctccaccttgggagaggccgtt

SEQ ID NO: 578142 - DNA, 25 bp, Mus musculus
catctccagagtcgatggtccaaca

SEQ ID NO: 578143 - DNA, 25 bp, Mus musculus
catctccagagtcggaaggcccagt

SEQ ID NO: 578144 - DNA, 25 bp, Mus musculus
catctccagagtggatggtccaaca

SEQ ID NO: 578145 - DNA, 25 bp, Mus musculus
catctccagagtgggaaggcccagt

SEQ ID NO: 578146 - DNA, 25 bp, Mus musculus
catctccaggccagaggtgggagaa

SEQ ID NO: 578147 - DNA, 25 bp, Mus musculus
catctccaggcctgaggtgggagaa

SEQ ID NO: 578148 - DNA, 25 bp, Mus musculus
catctcccaattacagagaccgaag

SEQ ID NO: 578149 - DNA, 25 bp, Mus musculus
catctcccaatttcagagaccgaag

SEQ ID NO: 578150 - DNA, 25 bp, Mus musculus
catctcccaggacgagtttcagatc

SEQ ID NO: 578151 - DNA, 25 bp, Mus musculus
catctcccaggaggagtttcagatc

SEQ ID NO: 578152 - DNA, 25 bp, Mus musculus
catctcccctaaccttgagcttgag

SEQ ID NO: 578153 - DNA, 25 bp, Mus musculus
catctcccctaagcttgagcttgag

SEQ ID NO: 578154 - DNA, 25 bp, Mus musculus
catctcccctgactgtagcatgctg

SEQ ID NO: 578155 - DNA, 25 bp, Mus musculus
catctcccctgagtgtagcatgctg

SEQ ID NO: 578156 - DNA, 25 bp, Mus musculus
catctccctcatcttccgagaccag

SEQ ID NO: 578157 - DNA, 25 bp, Mus musculus
catctccctcatgttccgagaccag

SEQ ID NO: 578158 - DNA, 25 bp, Mus musculus
catctccgacatcttgttcatcttc

SEQ ID NO: 578159 - DNA, 25 bp, Mus musculus
catctccgacatgttgttcatcttc

SEQ ID NO: 578160 - DNA, 25 bp, Mus musculus
catctccgcagtagggcaaaatgac

SEQ ID NO: 578161 - DNA, 25 bp, Mus musculus
catctccgcagttgggcaaaatgac

SEQ ID NO: 578162 - DNA, 25 bp, Mus musculus
catctccggctaaacatcgggccaa

SEQ ID NO: 578163 - DNA, 25 bp, Mus musculus
catctccggctatacatcgggccaa

SEQ ID NO: 578164 - DNA, 25 bp, Mus musculus
catctcctaagcctcgattcaagag

SEQ ID NO: 578165 - DNA, 25 bp, Mus musculus
catctcctaagcgtcgattcaagag

SEQ ID NO: 578166 - DNA, 25 bp, Mus musculus
catctcctacaactaccgtgaggac

SEQ ID NO: 578167 - DNA, 25 bp, Mus musculus
catctcctacaagtaccgtgaggac

SEQ ID NO: 578168 - DNA, 25 bp, Mus musculus
catctcctatgcagtgtgggctacc

SEQ ID NO: 578169 - DNA, 25 bp, Mus musculus
catctcctatgctgtgtgggctacc

SEQ ID NO: 578170 - DNA, 25 bp, Mus musculus
catctcctgaagcacacaggctttc

SEQ ID NO: 578171 - DNA, 25 bp, Mus musculus
catctcctgaaggacacaggctttc

SEQ ID NO: 578172 - DNA, 25 bp, Mus musculus
catctcctgaccatcttgtttgcca

SEQ ID NO: 578173 - DNA, 25 bp, Mus musculus
catctcctgaccttcttgtttgcca

SEQ ID NO: 578174 - DNA, 25 bp, Mus musculus
catctcctgatgatttggacttcag

SEQ ID NO: 578175 - DNA, 25 bp, Mus musculus
catctcctgatgttttggacttcag

SEQ ID NO: 578176 - DNA, 25 bp, Mus musculus
catctcctgctcactgttgggcacg

SEQ ID NO: 578177 - DNA, 25 bp, Mus musculus
catctcctgctctctgttgggcacg

SEQ ID NO: 578178 - DNA, 25 bp, Mus musculus
catctcctgctgcaaggtatgggca

SEQ ID NO: 578179 - DNA, 25 bp, Mus musculus
catctcctgctggaaggtatgggca

SEQ ID NO: 578180 - DNA, 25 bp, Mus musculus
catctcctgggaagaccagtattca

SEQ ID NO: 578181 - DNA, 25 bp, Mus musculus
catctcctgggatgaccagtattca

SEQ ID NO: 578182 - DNA, 25 bp, Mus musculus
catctccttctaagacaagcgtggc

SEQ ID NO: 578183 - DNA, 25 bp, Mus musculus
catctccttctatgacaagcgtggc

SEQ ID NO: 578184 - DNA, 25 bp, Mus musculus
catctcgaaactacatcatggaagg

SEQ ID NO: 578185 - DNA, 25 bp, Mus musculus
catctcgaaacttcatcatggaagg

SEQ ID NO: 578186 - DNA, 25 bp, Mus musculus
catctcgggcatcctactgtggtac

SEQ ID NO: 578187 - DNA, 25 bp, Mus musculus
catctcgggcatgctactgtggtac

SEQ ID NO: 578188 - DNA, 25 bp, Mus musculus
catctcgggtgactgaggacacagc

SEQ ID NO: 578189 - DNA, 25 bp, Mus musculus
catctcgggtgagtgaggacacagc

SEQ ID NO: 578190 - DNA, 25 bp, Mus musculus
catctcggtagacgacagtgtcttc

SEQ ID NO: 578191 - DNA, 25 bp, Mus musculus
catctcggtagaggacagtgtcttc

SEQ ID NO: 578192 - DNA, 25 bp, Mus musculus
catctcgtatagaaactcattagtc

SEQ ID NO: 578193 - DNA, 25 bp, Mus musculus
catctcgtatagtaactcattagtc

SEQ ID NO: 578194 - DNA, 25 bp, Mus musculus
catctcgtatcaagcctgagcgggt

SEQ ID NO: 578195 - DNA, 25 bp, Mus musculus
catctcgtatcatgcctgagcgggt

SEQ ID NO: 578196 - DNA, 25 bp, Mus musculus
catctcgtcccgattattttcacaa

SEQ ID NO: 578197 - DNA, 25 bp, Mus musculus
catctcgtcccgtttattttcacaa

SEQ ID NO: 578198 - DNA, 25 bp, Mus musculus
catctcgtgtgacttaagctggcct

SEQ ID NO: 578199 - DNA, 25 bp, Mus musculus
catctcgtgtgagttaagctggcct

SEQ ID NO: 578200 - DNA, 25 bp, Mus musculus
catctctacaggcaagtacgcacgc

SEQ ID NO: 578201 - DNA, 25 bp, Mus musculus
catctctacagggaagtacgcacgc

SEQ ID NO: 578202 - DNA, 25 bp, Mus musculus
catctctccaacactcagtttaagg

SEQ ID NO: 578203 - DNA, 25 bp, Mus musculus
catctctccaactctcagtttaagg

SEQ ID NO: 578204 - DNA, 25 bp, Mus musculus
catctctcctggcactggctctgat

SEQ ID NO: 578205 - DNA, 25 bp, Mus musculus
catctctcctgggactggctctgat

SEQ ID NO: 578206 - DNA, 25 bp, Mus musculus
catctctgaataacggcagctttga

SEQ ID NO: 578207 - DNA, 25 bp, Mus musculus
catctctgaatatcggcagctttga

SEQ ID NO: 578208 - DNA, 25 bp, Mus musculus
catctctgattgcagctgatcctcg

SEQ ID NO: 578209 - DNA, 25 bp, Mus musculus
catctctgattggagctgatcctcg

SEQ ID NO: 578210 - DNA, 25 bp, Mus musculus
catctctgcaagcagcaacacagct

SEQ ID NO: 578211 - DNA, 25 bp, Mus musculus
catctctgcaaggagcaacacagct

SEQ ID NO: 578212 - DNA, 25 bp, Mus musculus
catctctgctgtagtagacaaagat

SEQ ID NO: 578213 - DNA, 25 bp, Mus musculus
catctctgctgttgtagacaaagat

SEQ ID NO: 578214 - DNA, 25 bp, Mus musculus
catctctgcttcaatcattgtcttc

SEQ ID NO: 578215 - DNA, 25 bp, Mus musculus
catctctgcttctatcattgtcttc

SEQ ID NO: 578216 - DNA, 25 bp, Mus musculus
catctctggaaaatgggacgggaac

SEQ ID NO: 578217 - DNA, 25 bp, Mus musculus
catctctggaaattgggacgggaac

SEQ ID NO: 578218 - DNA, 25 bp, Mus musculus
catctctggaagctcctttttagca

SEQ ID NO: 578219 - DNA, 25 bp, Mus musculus
catctctggaaggtcctttttagca

SEQ ID NO: 578220 - DNA, 25 bp, Mus musculus
catctctggacactcgcggatggga

SEQ ID NO: 578221 - DNA, 25 bp, Mus musculus
catctctggacagtcgcggatggga

SEQ ID NO: 578222 - DNA, 25 bp, Mus musculus
catctctgggaacctaaggatctgg

SEQ ID NO: 578223 - DNA, 25 bp, Mus musculus
catctctgggaagctaaggatctgg

SEQ ID NO: 578224 - DNA, 25 bp, Mus musculus
catctctgggacagggatgagtgcc

SEQ ID NO: 578225 - DNA, 25 bp, Mus musculus
catctctgggactgggatgagtgcc

SEQ ID NO: 578226 - DNA, 25 bp, Mus musculus
catctctggtgactggtgactgtcc

SEQ ID NO: 578227 - DNA, 25 bp, Mus musculus
catctctggtgagtggtgactgtcc

SEQ ID NO: 578228 - DNA, 25 bp, Mus musculus
catctctgtaggagcatcggccatg

SEQ ID NO: 578229 - DNA, 25 bp, Mus musculus
catctctgtaggtgcatcggccatg

SEQ ID NO: 578230 - DNA, 25 bp, Mus musculus
catctctgtcttcgcagcagaaatt

SEQ ID NO: 578231 - DNA, 25 bp, Mus musculus
catctctgtcttggcagcagaaatt

SEQ ID NO: 578232 - DNA, 25 bp, Mus musculus
catctcttataccaacaatagaaag

SEQ ID NO: 578233 - DNA, 25 bp, Mus musculus
catctcttatacgaacaatagaaag

SEQ ID NO: 578234 - DNA, 25 bp, Mus musculus
catctcttcagaacgctcggattca

SEQ ID NO: 578235 - DNA, 25 bp, Mus musculus
catctcttcagatcgctcggattca

SEQ ID NO: 578236 - DNA, 25 bp, Mus musculus
catctcttctgccacatcgttttct

SEQ ID NO: 578237 - DNA, 25 bp, Mus musculus
catctcttctgcgacatcgttttct

SEQ ID NO: 578238 - DNA, 25 bp, Mus musculus
catctcttgggcctcagtggcaagg

SEQ ID NO: 578239 - DNA, 25 bp, Mus musculus
catctcttgggcgtcagtggcaagg

SEQ ID NO: 578240 - DNA, 25 bp, Mus musculus
catctcttgtacagttggaatcacg

SEQ ID NO: 578241 - DNA, 25 bp, Mus musculus
catctcttgtactgttggaatcacg

SEQ ID NO: 578242 - DNA, 25 bp, Mus musculus
catctcttgtttagaagccatgaca

SEQ ID NO: 578243 - DNA, 25 bp, Mus musculus
catctcttgttttgaagccatgaca

SEQ ID NO: 578244 - DNA, 25 bp, Mus musculus
catctctttattctagcctttggaa

SEQ ID NO: 578245 - DNA, 25 bp, Mus musculus
catctctttattgtagcctttggaa

SEQ ID NO: 578246 - DNA, 25 bp, Mus musculus
catctcttttggctgggaccagtga

SEQ ID NO: 578247 - DNA, 25 bp, Mus musculus
catctcttttgggtgggaccagtga

SEQ ID NO: 578248 - DNA, 25 bp, Mus musculus
catctgaaaaacagccacaggaatt

SEQ ID NO: 578249 - DNA, 25 bp, Mus musculus
catctgaaaaactgccacaggaatt

SEQ ID NO: 578250 - DNA, 25 bp, Mus musculus
catctgaaaataagagagcttccaa

SEQ ID NO: 578251 - DNA, 25 bp, Mus musculus
catctgaaaatatgagagcttccaa

SEQ ID NO: 578252 - DNA, 25 bp, Mus musculus
catctgaactcaactggaggcctga

SEQ ID NO: 578253 - DNA, 25 bp, Mus musculus
catctgaactcatctggaggcctga

SEQ ID NO: 578254 - DNA, 25 bp, Mus musculus
catctgaagagacgaaagggaaagc

SEQ ID NO: 578255 - DNA, 25 bp, Mus musculus
catctgaagagaggaaagggaaagc

SEQ ID NO: 578256 - DNA, 25 bp, Mus musculus
catctgaaggcccagtagctgggac

SEQ ID NO: 578257 - DNA, 25 bp, Mus musculus
catctgaaggccgagtagctgggac

SEQ ID NO: 578258 - DNA, 25 bp, Mus musculus
catctgaagttgcagatgaacctcc

SEQ ID NO: 578259 - DNA, 25 bp, Mus musculus
catctgaagttggagatgaacctcc

SEQ ID NO: 578260 - DNA, 25 bp, Mus musculus
catctgaatagaaccggaagacccc

SEQ ID NO: 578261 - DNA, 25 bp, Mus musculus
catctgaatagatccggaagacccc

SEQ ID NO: 578262 - DNA, 25 bp, Mus musculus
catctgacactgacagcagcctgga

SEQ ID NO: 578263 - DNA, 25 bp, Mus musculus
catctgacactgacgaagttcctga

SEQ ID NO: 578264 - DNA, 25 bp, Mus musculus
catctgacactgtcagcagcctgga

SEQ ID NO: 578265 - DNA, 25 bp, Mus musculus
catctgacactgtcgaagttcctga

SEQ ID NO: 578266 - DNA, 25 bp, Mus musculus
catctgacacttcgaaaaagaaggg

SEQ ID NO: 578267 - DNA, 25 bp, Mus musculus
catctgacacttggaaaaagaaggg

SEQ ID NO: 578268 - DNA, 25 bp, Mus musculus
catctgacagaacttgccactgtgc

SEQ ID NO: 578269 - DNA, 25 bp, Mus musculus
catctgacagaagttgccactgtgc

SEQ ID NO: 578270 - DNA, 25 bp, Mus musculus
catctgacctctctggatcccatga

SEQ ID NO: 578271 - DNA, 25 bp, Mus musculus
catctgacctctgtggatcccatga

SEQ ID NO: 578272 - DNA, 25 bp, Mus musculus
catctgagaaatatgataagatacc

SEQ ID NO: 578273 - DNA, 25 bp, Mus musculus
catctgagaaatttgataagatacc

SEQ ID NO: 578274 - DNA, 25 bp, Mus musculus
catctgagatacattagaccttaca

SEQ ID NO: 578275 - DNA, 25 bp, Mus musculus
catctgagatactttagaccttaca

SEQ ID NO: 578276 - DNA, 25 bp, Mus musculus
catctgagggaactccacttggaca

SEQ ID NO: 578277 - DNA, 25 bp, Mus musculus
catctgagggaagtccacttggaca

SEQ ID NO: 578278 - DNA, 25 bp, Mus musculus
catctgagtaggctgacggtcccta

SEQ ID NO: 578279 - DNA, 25 bp, Mus musculus
catctgagtagggtgacggtcccta

SEQ ID NO: 578280 - DNA, 25 bp, Mus musculus
catctgagtgatcctgacttccaag

SEQ ID NO: 578281 - DNA, 25 bp, Mus musculus
catctgagtgatgctgacttccaag

SEQ ID NO: 578282 - DNA, 25 bp, Mus musculus
catctgagtggcaacttcggtgtgg

SEQ ID NO: 578283 - DNA, 25 bp, Mus musculus
catctgagtggctacttcggtgtgg

SEQ ID NO: 578284 - DNA, 25 bp, Mus musculus
catctgatctgacaggtacgttcat

SEQ ID NO: 578285 - DNA, 25 bp, Mus musculus
catctgatctgagaggtacgttcat

SEQ ID NO: 578286 - DNA, 25 bp, Mus musculus
catctgatgactctcgccagttaga

SEQ ID NO: 578287 - DNA, 25 bp, Mus musculus
catctgatgactgtcgccagttaga

SEQ ID NO: 578288 - DNA, 25 bp, Mus musculus
catctgatggcgaagatcgaccacc

SEQ ID NO: 578289 - DNA, 25 bp, Mus musculus
catctgatggcgtagatcgaccacc

SEQ ID NO: 578290 - DNA, 25 bp, Mus musculus
catctgattcgactagaagggaaca

SEQ ID NO: 578291 - DNA, 25 bp, Mus musculus
catctgattcgagtagaagggaaca

SEQ ID NO: 578292 - DNA, 25 bp, Mus musculus
catctgatttctatcccaggcggtg

SEQ ID NO: 578293 - DNA, 25 bp, Mus musculus
catctgatttctttcccaggcggtg

SEQ ID NO: 578294 - DNA, 25 bp, Mus musculus
catctgatttgaaggcagactcaat

SEQ ID NO: 578295 - DNA, 25 bp, Mus musculus
catctgatttgatggcagactcaat

SEQ ID NO: 578296 - DNA, 25 bp, Mus musculus
catctgcaaaaaccctacgagataa

SEQ ID NO: 578297 - DNA, 25 bp, Mus musculus
catctgcaaaaagcctacgagataa

SEQ ID NO: 578298 - DNA, 25 bp, Mus musculus
catctgcaataaagaatggaggcaa

SEQ ID NO: 578299 - DNA, 25 bp, Mus musculus
catctgcaataatgaatggaggcaa

SEQ ID NO: 578300 - DNA, 25 bp, Mus musculus
catctgcaccaacgttattgggagc

SEQ ID NO: 578301 - DNA, 25 bp, Mus musculus
catctgcaccaaggttattgggagc

SEQ ID NO: 578302 - DNA, 25 bp, Mus musculus
catctgcacccaacagaatattttg

SEQ ID NO: 578303 - DNA, 25 bp, Mus musculus
catctgcacccatcagaatattttg

SEQ ID NO: 578304 - DNA, 25 bp, Mus musculus
catctgcacgtcaggctgctcctaa

SEQ ID NO: 578305 - DNA, 25 bp, Mus musculus
catctgcacgtctggctgctcctaa

SEQ ID NO: 578306 - DNA, 25 bp, Mus musculus
catctgcagatcaacccggatggca

SEQ ID NO: 578307 - DNA, 25 bp, Mus musculus
catctgcagatctacccggatggca

SEQ ID NO: 578308 - DNA, 25 bp, Mus musculus
catctgcagcctcaccaggtgggct

SEQ ID NO: 578309 - DNA, 25 bp, Mus musculus
catctgcagcctgaccaggtgggct

SEQ ID NO: 578310 - DNA, 25 bp, Mus musculus
catctgcagcgaaatatcaatgaga

SEQ ID NO: 578311 - DNA, 25 bp, Mus musculus
catctgcagcgatatatcaatgaga

SEQ ID NO: 578312 - DNA, 25 bp, Mus musculus
catctgcagctgaaagacatcctca

SEQ ID NO: 578313 - DNA, 25 bp, Mus musculus
catctgcagctgtaagacatcctca

SEQ ID NO: 578314 - DNA, 25 bp, Mus musculus
catctgcaggaaccacattatggat

SEQ ID NO: 578315 - DNA, 25 bp, Mus musculus
catctgcaggaagcacattatggat

SEQ ID NO: 578316 - DNA, 25 bp, Mus musculus
catctgcaggatcgcgtttaatggc

SEQ ID NO: 578317 - DNA, 25 bp, Mus musculus
catctgcaggatggcgtttaatggc

SEQ ID NO: 578318 - DNA, 25 bp, Mus musculus
catctgcaggctccgtgtgaggtac

SEQ ID NO: 578319 - DNA, 25 bp, Mus musculus
catctgcaggctgcgtgtgaggtac

SEQ ID NO: 578320 - DNA, 25 bp, Mus musculus
catctgcagtggctttactgctgct

SEQ ID NO: 578321 - DNA, 25 bp, Mus musculus
catctgcagtgggtttactgctgct

SEQ ID NO: 578322 - DNA, 25 bp, Mus musculus
catctgcagtttcctgctactcagc

SEQ ID NO: 578323 - DNA, 25 bp, Mus musculus
catctgcagtttgctgctactcagc

SEQ ID NO: 578324 - DNA, 25 bp, Mus musculus
catctgccatggagcttcggaggaa

SEQ ID NO: 578325 - DNA, 25 bp, Mus musculus
catctgccatggtgcttcggaggaa

SEQ ID NO: 578326 - DNA, 25 bp, Mus musculus
catctgcccctcatgtggaggtgga

SEQ ID NO: 578327 - DNA, 25 bp, Mus musculus
catctgcccctcttgtggaggtgga

SEQ ID NO: 578328 - DNA, 25 bp, Mus musculus
catctgccgcagagctaaggcccat

SEQ ID NO: 578329 - DNA, 25 bp, Mus musculus
catctgccgcagtgctaaggcccat

SEQ ID NO: 578330 - DNA, 25 bp, Mus musculus
catctgcctgtcactaagattgtga

SEQ ID NO: 578331 - DNA, 25 bp, Mus musculus
catctgcctgtctctaagattgtga

SEQ ID NO: 578332 - DNA, 25 bp, Mus musculus
catctgcctttgatagtaaagaaag

SEQ ID NO: 578333 - DNA, 25 bp, Mus musculus
catctgcctttgttagtaaagaaag

SEQ ID NO: 578334 - DNA, 25 bp, Mus musculus
catctgcgagcaagcggaatatcac

SEQ ID NO: 578335 - DNA, 25 bp, Mus musculus
catctgcgagcatgcggaatatcac

SEQ ID NO: 578336 - DNA, 25 bp, Mus musculus
catctgcgcctgctttctatagcca

SEQ ID NO: 578337 - DNA, 25 bp, Mus musculus
catctgcgcctggtttctatagcca

SEQ ID NO: 578338 - DNA, 25 bp, Mus musculus
catctgcggactccagtttctacac

SEQ ID NO: 578339 - DNA, 25 bp, Mus musculus
catctgcggactgcagtttctacac

SEQ ID NO: 578340 - DNA, 25 bp, Mus musculus
catctgcgtggcctatcgtgacttc

SEQ ID NO: 578341 - DNA, 25 bp, Mus musculus
catctgcgtggcgtatcgtgacttc

SEQ ID NO: 578342 - DNA, 25 bp, Mus musculus
catctgcgtggtcggcatcgaagac

SEQ ID NO: 578343 - DNA, 25 bp, Mus musculus
catctgcgtggtgggcatcgaagac

SEQ ID NO: 578344 - DNA, 25 bp, Mus musculus
catctgcgtgttcttagatgttgca

SEQ ID NO: 578345 - DNA, 25 bp, Mus musculus
catctgcgtgttgttagatgttgca

SEQ ID NO: 578346 - DNA, 25 bp, Mus musculus
catctgctacgcagtggctactaca

SEQ ID NO: 578347 - DNA, 25 bp, Mus musculus
catctgctacgctgtggctactaca

SEQ ID NO: 578348 - DNA, 25 bp, Mus musculus
catctgctagaaacagaaaggactc

SEQ ID NO: 578349 - DNA, 25 bp, Mus musculus
catctgctagaatcagaaaggactc

SEQ ID NO: 578350 - DNA, 25 bp, Mus musculus
catctgctcctacgtgcgcatggtc

SEQ ID NO: 578351 - DNA, 25 bp, Mus musculus
catctgctcctaggtgcgcatggtc

SEQ ID NO: 578352 - DNA, 25 bp, Mus musculus
catctgctcctcaatggacaaacta

SEQ ID NO: 578353 - DNA, 25 bp, Mus musculus
catctgctcctctatggacaaacta

SEQ ID NO: 578354 - DNA, 25 bp, Mus musculus
catctgctcggcacagaaagctgga

SEQ ID NO: 578355 - DNA, 25 bp, Mus musculus
catctgctcggctcagaaagctgga

SEQ ID NO: 578356 - DNA, 25 bp, Mus musculus
catctgctctgacacatccttcatg

SEQ ID NO: 578357 - DNA, 25 bp, Mus musculus
catctgctctgagacatccttcatg

SEQ ID NO: 578358 - DNA, 25 bp, Mus musculus
catctgctgagactctactgcggtg

SEQ ID NO: 578359 - DNA, 25 bp, Mus musculus
catctgctgagagtctactgcggtg

SEQ ID NO: 578360 - DNA, 25 bp, Mus musculus
catctgctgatgacactggtgacac

SEQ ID NO: 578361 - DNA, 25 bp, Mus musculus
catctgctgatgtcactggtgacac

SEQ ID NO: 578362 - DNA, 25 bp, Mus musculus
catctgctgcaaacctcaggatgca

SEQ ID NO: 578363 - DNA, 25 bp, Mus musculus
catctgctgcaatcctcaggatgca

SEQ ID NO: 578364 - DNA, 25 bp, Mus musculus
catctgctgcataatcgctgggcta

SEQ ID NO: 578365 - DNA, 25 bp, Mus musculus
catctgctgcatcagtccttgtttg

SEQ ID NO: 578366 - DNA, 25 bp, Mus musculus
catctgctgcatgagtccttgtttg

SEQ ID NO: 578367 - DNA, 25 bp, Mus musculus
catctgctgcattatcgctgggcta

SEQ ID NO: 578368 - DNA, 25 bp, Mus musculus
catctgctggataacacggagaggc

SEQ ID NO: 578369 - DNA, 25 bp, Mus musculus
catctgctggattacacggagaggc

SEQ ID NO: 578370 - DNA, 25 bp, Mus musculus
catctgcttcaaacaagaatgtgtg

SEQ ID NO: 578371 - DNA, 25 bp, Mus musculus
catctgcttcaaacattccaggttc

SEQ ID NO: 578372 - DNA, 25 bp, Mus musculus
catctgcttcaatcaagaatgtgtg

SEQ ID NO: 578373 - DNA, 25 bp, Mus musculus
catctgcttcaatcattccaggttc

SEQ ID NO: 578374 - DNA, 25 bp, Mus musculus
catctgcttcccctagtttgtgtag

SEQ ID NO: 578375 - DNA, 25 bp, Mus musculus
catctgcttcccgtagtttgtgtag

SEQ ID NO: 578376 - DNA, 25 bp, Mus musculus
catctgcttcggcagagagcgcagc

SEQ ID NO: 578377 - DNA, 25 bp, Mus musculus
catctgcttcgggagagagcgcagc

SEQ ID NO: 578378 - DNA, 25 bp, Mus musculus
catctgctttatctgcccggctctg

SEQ ID NO: 578379 - DNA, 25 bp, Mus musculus
catctgctttatgtgcccggctctg

SEQ ID NO: 578380 - DNA, 25 bp, Mus musculus
catctgctttgacgcagcaacaaag

SEQ ID NO: 578381 - DNA, 25 bp, Mus musculus
catctgctttgaggcagcaacaaag

SEQ ID NO: 578382 - DNA, 25 bp, Mus musculus
catctggaaacccaggccgggactg

SEQ ID NO: 578383 - DNA, 25 bp, Mus musculus
catctggaaaccgaggccgggactg

SEQ ID NO: 578384 - DNA, 25 bp, Mus musculus
catctggaagagagagccatgaggc

SEQ ID NO: 578385 - DNA, 25 bp, Mus musculus
catctggaagagtgagccatgaggc

SEQ ID NO: 578386 - DNA, 25 bp, Mus musculus
catctggaagcccaccctggtgatc

SEQ ID NO: 578387 - DNA, 25 bp, Mus musculus
catctggaagccgaccctggtgatc

SEQ ID NO: 578388 - DNA, 25 bp, Mus musculus
catctggacctgcacttcgtgggca

SEQ ID NO: 578389 - DNA, 25 bp, Mus musculus
catctggacctggacttcgtgggca

SEQ ID NO: 578390 - DNA, 25 bp, Mus musculus
catctggagaatccagcaggcccag

SEQ ID NO: 578391 - DNA, 25 bp, Mus musculus
catctggagaatgcagcaggcccag

SEQ ID NO: 578392 - DNA, 25 bp, Mus musculus
catctggagatcaccactgagagag

SEQ ID NO: 578393 - DNA, 25 bp, Mus musculus
catctggagatctccactgagagag

SEQ ID NO: 578394 - DNA, 25 bp, Mus musculus
catctggagtacatgagcaccctga

SEQ ID NO: 578395 - DNA, 25 bp, Mus musculus
catctggagtacttgagcaccctga

SEQ ID NO: 578396 - DNA, 25 bp, Mus musculus
catctggagtctctcatgattgcca

SEQ ID NO: 578397 - DNA, 25 bp, Mus musculus
catctggagtctgtcatgattgcca

SEQ ID NO: 578398 - DNA, 25 bp, Mus musculus
catctggagtgcactaataccgctc

SEQ ID NO: 578399 - DNA, 25 bp, Mus musculus
catctggagtgctctaataccgctc

SEQ ID NO: 578400 - DNA, 25 bp, Mus musculus
catctggatctcatagtccgagact

SEQ ID NO: 578401 - DNA, 25 bp, Mus musculus
catctggatctcttagtccgagact

SEQ ID NO: 578402 - DNA, 25 bp, Mus musculus
catctggattgaacctgatgacttc

SEQ ID NO: 578403 - DNA, 25 bp, Mus musculus
catctggattgatcctgatgacttc

SEQ ID NO: 578404 - DNA, 25 bp, Mus musculus
catctggcagagcaacttcaggaga

SEQ ID NO: 578405 - DNA, 25 bp, Mus musculus
catctggcagaggaacttcaggaga

SEQ ID NO: 578406 - DNA, 25 bp, Mus musculus
catctggccgagctcaccctgatgt

SEQ ID NO: 578407 - DNA, 25 bp, Mus musculus
catctggccgaggtcaccctgatgt

SEQ ID NO: 578408 - DNA, 25 bp, Mus musculus
catctggccgcacagtatgggcatt

SEQ ID NO: 578409 - DNA, 25 bp, Mus musculus
catctggccgcagagtatgggcatt

SEQ ID NO: 578410 - DNA, 25 bp, Mus musculus
catctggccttgaccgtcatgctgg

SEQ ID NO: 578411 - DNA, 25 bp, Mus musculus
catctggccttgtccgtcatgctgg

SEQ ID NO: 578412 - DNA, 25 bp, Mus musculus
catctgggaaacactcgaaggacat

SEQ ID NO: 578413 - DNA, 25 bp, Mus musculus
catctgggaaactctcgaaggacat

SEQ ID NO: 578414 - DNA, 25 bp, Mus musculus
catctgggaaagctagcagtgctgc

SEQ ID NO: 578415 - DNA, 25 bp, Mus musculus
catctgggaaaggtagcagtgctgc

SEQ ID NO: 578416 - DNA, 25 bp, Mus musculus
catctgggacagatataccacaaac

SEQ ID NO: 578417 - DNA, 25 bp, Mus musculus
catctgggacagttataccacaaac

SEQ ID NO: 578418 - DNA, 25 bp, Mus musculus
catctgggacctctttttctacgag

SEQ ID NO: 578419 - DNA, 25 bp, Mus musculus
catctgggacctgtttttctacgag

SEQ ID NO: 578420 - DNA, 25 bp, Mus musculus
catctgggacggagcagaagaaccc

SEQ ID NO: 578421 - DNA, 25 bp, Mus musculus
catctgggacggtgcagaagaaccc

SEQ ID NO: 578422 - DNA, 25 bp, Mus musculus
catctgggaggcctaccgagagttt

SEQ ID NO: 578423 - DNA, 25 bp, Mus musculus
catctgggaggcgtaccgagagttt

SEQ ID NO: 578424 - DNA, 25 bp, Mus musculus
catctgggaggtccccgaacgatac

SEQ ID NO: 578425 - DNA, 25 bp, Mus musculus
catctgggaggtgcccgaacgatac

SEQ ID NO: 578426 - DNA, 25 bp, Mus musculus
catctgggagtactacagctgttgt

SEQ ID NO: 578427 - DNA, 25 bp, Mus musculus
catctgggagtagtacagctgttgt

SEQ ID NO: 578428 - DNA, 25 bp, Mus musculus
catctgggcacacaagagtagcact

SEQ ID NO: 578429 - DNA, 25 bp, Mus musculus
catctgggcacagaagagtagcact

SEQ ID NO: 578430 - DNA, 25 bp, Mus musculus
catctgggccgcctatgataggaac

SEQ ID NO: 578431 - DNA, 25 bp, Mus musculus
catctgggccgcgtatgataggaac

SEQ ID NO: 578432 - DNA, 25 bp, Mus musculus
catctgggcctcagcctttggagaa

SEQ ID NO: 578433 - DNA, 25 bp, Mus musculus
catctgggcctctgcctttggagaa

SEQ ID NO: 578434 - DNA, 25 bp, Mus musculus
catctgggcttaactgcttgggcaa

SEQ ID NO: 578435 - DNA, 25 bp, Mus musculus
catctgggcttatctgcttgggcaa

SEQ ID NO: 578436 - DNA, 25 bp, Mus musculus
catctggggcatctgtaccatctca

SEQ ID NO: 578437 - DNA, 25 bp, Mus musculus
catctggggcatgtgtaccatctca

SEQ ID NO: 578438 - DNA, 25 bp, Mus musculus
catctgggggaaaccgtgatgctca

SEQ ID NO: 578439 - DNA, 25 bp, Mus musculus
catctgggggaatccgtgatgctca

SEQ ID NO: 578440 - DNA, 25 bp, Mus musculus
catctgggtaggcaagcgttgactt

SEQ ID NO: 578441 - DNA, 25 bp, Mus musculus
catctgggtagggaagcgttgactt

SEQ ID NO: 578442 - DNA, 25 bp, Mus musculus
catctgggtcttagcatcactggta

SEQ ID NO: 578443 - DNA, 25 bp, Mus musculus
catctgggtctttgcatcactggta

SEQ ID NO: 578444 - DNA, 25 bp, Mus musculus
catctgggttcgatacaagcgtaac

SEQ ID NO: 578445 - DNA, 25 bp, Mus musculus
catctgggttcgttacaagcgtaac

SEQ ID NO: 578446 - DNA, 25 bp, Mus musculus
catctggtaaagcaccagggacaac

SEQ ID NO: 578447 - DNA, 25 bp, Mus musculus
catctggtaaaggaccagggacaac

SEQ ID NO: 578448 - DNA, 25 bp, Mus musculus
catctggtttagaatatcttatcac

SEQ ID NO: 578449 - DNA, 25 bp, Mus musculus
catctggtttagtatatcttatcac

SEQ ID NO: 578450 - DNA, 25 bp, Mus musculus
catctgtaagttagttgatactgtt

SEQ ID NO: 578451 - DNA, 25 bp, Mus musculus
catctgtaagtttgttgatactgtt

SEQ ID NO: 578452 - DNA, 25 bp, Mus musculus
catctgtacacaagggctgccactg

SEQ ID NO: 578453 - DNA, 25 bp, Mus musculus
catctgtacacatgggctgccactg

SEQ ID NO: 578454 - DNA, 25 bp, Mus musculus
catctgtagagacttcctgaggaac

SEQ ID NO: 578455 - DNA, 25 bp, Mus musculus
catctgtagagagttcctgaggaac

SEQ ID NO: 578456 - DNA, 25 bp, Mus musculus
catctgtaggtaattcttgaaccct

SEQ ID NO: 578457 - DNA, 25 bp, Mus musculus
catctgtaggtatttcttgaaccct

SEQ ID NO: 578458 - DNA, 25 bp, Mus musculus
catctgtatcctagtgaatggcata

SEQ ID NO: 578459 - DNA, 25 bp, Mus musculus
catctgtatccttgtgaatggcata

SEQ ID NO: 578460 - DNA, 25 bp, Mus musculus
catctgtatgaacactggtggctcc

SEQ ID NO: 578461 - DNA, 25 bp, Mus musculus
catctgtatgaagactggtggctcc

SEQ ID NO: 578462 - DNA, 25 bp, Mus musculus
catctgtatggcacacagggcaacg

SEQ ID NO: 578463 - DNA, 25 bp, Mus musculus
catctgtatggctcacagggcaacg

SEQ ID NO: 578464 - DNA, 25 bp, Mus musculus
catctgtcccgtaggaggcaaaacc

SEQ ID NO: 578465 - DNA, 25 bp, Mus musculus
catctgtcccgttggaggcaaaacc

SEQ ID NO: 578466 - DNA, 25 bp, Mus musculus
catctgtccgttagctggaaggtgt

SEQ ID NO: 578467 - DNA, 25 bp, Mus musculus
catctgtccgtttgctggaaggtgt

SEQ ID NO: 578468 - DNA, 25 bp, Mus musculus
catctgtcggctacccagtgggcga

SEQ ID NO: 578469 - DNA, 25 bp, Mus musculus
catctgtcggcttcccagtgggcga

SEQ ID NO: 578470 - DNA, 25 bp, Mus musculus
catctgtctcatacagtgtaccgca

SEQ ID NO: 578471 - DNA, 25 bp, Mus musculus
catctgtctcattcagtgtaccgca

SEQ ID NO: 578472 - DNA, 25 bp, Mus musculus
catctgtctctaaccatcgctgtgg

SEQ ID NO: 578473 - DNA, 25 bp, Mus musculus
catctgtctctaagggatgggccga

SEQ ID NO: 578474 - DNA, 25 bp, Mus musculus
catctgtctctatccatcgctgtgg

SEQ ID NO: 578475 - DNA, 25 bp, Mus musculus
catctgtctctatgggatgggccga

SEQ ID NO: 578476 - DNA, 25 bp, Mus musculus
catctgtctgtgctcagaggaaaag

SEQ ID NO: 578477 - DNA, 25 bp, Mus musculus
catctgtctgtggtcagaggaaaag

SEQ ID NO: 578478 - DNA, 25 bp, Mus musculus
catctgtgaacgcacaggcaatgac

SEQ ID NO: 578479 - DNA, 25 bp, Mus musculus
catctgtgaacggacaggcaatgac

SEQ ID NO: 578480 - DNA, 25 bp, Mus musculus
catctgtgacaaccagagggattgc

SEQ ID NO: 578481 - DNA, 25 bp, Mus musculus
catctgtgacaagcagagggattgc

SEQ ID NO: 578482 - DNA, 25 bp, Mus musculus
catctgtgacgtcggcaaccgggaa

SEQ ID NO: 578483 - DNA, 25 bp, Mus musculus
catctgtgacgtgggcaaccgggaa

SEQ ID NO: 578484 - DNA, 25 bp, Mus musculus
catctgtgagatcgacgaatctgtg

SEQ ID NO: 578485 - DNA, 25 bp, Mus musculus
catctgtgagatcggaactcctgaa

SEQ ID NO: 578486 - DNA, 25 bp, Mus musculus
catctgtgagatggacgaatctgtg

SEQ ID NO: 578487 - DNA, 25 bp, Mus musculus
catctgtgagatgggaactcctgaa

SEQ ID NO: 578488 - DNA, 25 bp, Mus musculus
catctgtgatatcctgcgctgtgca

SEQ ID NO: 578489 - DNA, 25 bp, Mus musculus
catctgtgatatgctgcgctgtgca

SEQ ID NO: 578490 - DNA, 25 bp, Mus musculus
catctgtgatgcagggtattacggg

SEQ ID NO: 578491 - DNA, 25 bp, Mus musculus
catctgtgatgctgggtattacggg

SEQ ID NO: 578492 - DNA, 25 bp, Mus musculus
catctgtgcatgaagaatatgcctc

SEQ ID NO: 578493 - DNA, 25 bp, Mus musculus
catctgtgcatgtagaatatgcctc

SEQ ID NO: 578494 - DNA, 25 bp, Mus musculus
catctgtgctgaagcgtgccgagga

SEQ ID NO: 578495 - DNA, 25 bp, Mus musculus
catctgtgctgatgcgtgccgagga

SEQ ID NO: 578496 - DNA, 25 bp, Mus musculus
catctgtggacaaagcagtatctga

SEQ ID NO: 578497 - DNA, 25 bp, Mus musculus
catctgtggacatagcagtatctga

SEQ ID NO: 578498 - DNA, 25 bp, Mus musculus
catctgtggagtctgtctgtaaacc

SEQ ID NO: 578499 - DNA, 25 bp, Mus musculus
catctgtggagtgtgtctgtaaacc

SEQ ID NO: 578500 - DNA, 25 bp, Mus musculus
catctgtggccccaaaggaggacac

SEQ ID NO: 578501 - DNA, 25 bp, Mus musculus
catctgtggcccgaaaggaggacac

SEQ ID NO: 578502 - DNA, 25 bp, Mus musculus
catctgtgggaaaacatgacagact

SEQ ID NO: 578503 - DNA, 25 bp, Mus musculus
catctgtgggaatacatgacagact

SEQ ID NO: 578504 - DNA, 25 bp, Mus musculus
catctgtgggcaacgggatcgacca

SEQ ID NO: 578505 - DNA, 25 bp, Mus musculus
catctgtgggcatcgggatcgacca

SEQ ID NO: 578506 - DNA, 25 bp, Mus musculus
catctgtggtcgatccagaggaaaa

SEQ ID NO: 578507 - DNA, 25 bp, Mus musculus
catctgtggtcgttccagaggaaaa

SEQ ID NO: 578508 - DNA, 25 bp, Mus musculus
catctgtgtagtatgcagttgcaag

SEQ ID NO: 578509 - DNA, 25 bp, Mus musculus
catctgtgtagtttgcagttgcaag

SEQ ID NO: 578510 - DNA, 25 bp, Mus musculus
catctgtgtgctatgtgcatctcac

SEQ ID NO: 578511 - DNA, 25 bp, Mus musculus
catctgtgtgctttgtgcatctcac

SEQ ID NO: 578512 - DNA, 25 bp, Mus musculus
catctgttaggtcatatcttgtgta

SEQ ID NO: 578513 - DNA, 25 bp, Mus musculus
catctgttaggtgatatcttgtgta

SEQ ID NO: 578514 - DNA, 25 bp, Mus musculus
catctgttcactaggcttgctggcg

SEQ ID NO: 578515 - DNA, 25 bp, Mus musculus
catctgttcacttggcttgctggcg

SEQ ID NO: 578516 - DNA, 25 bp, Mus musculus
catctgttgctaatgccaccgccat

SEQ ID NO: 578517 - DNA, 25 bp, Mus musculus
catctgttgctattgccaccgccat

SEQ ID NO: 578518 - DNA, 25 bp, Mus musculus
catctgtttgataatggtctgggca

SEQ ID NO: 578519 - DNA, 25 bp, Mus musculus
catctgtttgattatggtctgggca

SEQ ID NO: 578520 - DNA, 25 bp, Mus musculus
catctgtttttaccctgtttatgtc

SEQ ID NO: 578521 - DNA, 25 bp, Mus musculus
catctgtttttagcctgtttatgtc

SEQ ID NO: 578522 - DNA, 25 bp, Mus musculus
catcttaaaactccaacgtgaggag

SEQ ID NO: 578523 - DNA, 25 bp, Mus musculus
catcttaaaactgcaacgtgaggag

SEQ ID NO: 578524 - DNA, 25 bp, Mus musculus
catcttaagcccacgctcggtggcg

SEQ ID NO: 578525 - DNA, 25 bp, Mus musculus
catcttaagccctcgctcggtggcg

SEQ ID NO: 578526 - DNA, 25 bp, Mus musculus
catcttaaggatccttacgggagac

SEQ ID NO: 578527 - DNA, 25 bp, Mus musculus
catcttaaggatgcttacgggagac

SEQ ID NO: 578528 - DNA, 25 bp, Mus musculus
catcttacacccaagtgagaaggga

SEQ ID NO: 578529 - DNA, 25 bp, Mus musculus
catcttacaccctagtgagaaggga

SEQ ID NO: 578530 - DNA, 25 bp, Mus musculus
catcttacgaggagcaaatgatttc

SEQ ID NO: 578531 - DNA, 25 bp, Mus musculus
catcttacgaggtgcaaatgatttc

SEQ ID NO: 578532 - DNA, 25 bp, Mus musculus
catcttactctgattggagttttaa

SEQ ID NO: 578533 - DNA, 25 bp, Mus musculus
catcttactctgtttggagttttaa

SEQ ID NO: 578534 - DNA, 25 bp, Mus musculus
catcttagccggcaaggatgcagca

SEQ ID NO: 578535 - DNA, 25 bp, Mus musculus
catcttagccgggaaggatgcagca

SEQ ID NO: 578536 - DNA, 25 bp, Mus musculus
catcttatcctgctggatccatggg

SEQ ID NO: 578537 - DNA, 25 bp, Mus musculus
catcttatcctggtggatccatggg

SEQ ID NO: 578538 - DNA, 25 bp, Mus musculus
catcttcacagaatttaaggtggtg

SEQ ID NO: 578539 - DNA, 25 bp, Mus musculus
catcttcacagattttaaggtggtg

SEQ ID NO: 578540 - DNA, 25 bp, Mus musculus
catcttcagagcaaatggtagggtg

SEQ ID NO: 578541 - DNA, 25 bp, Mus musculus
catcttcagagctaatggtagggtg

SEQ ID NO: 578542 - DNA, 25 bp, Mus musculus
catcttcagtctcggcactcgggag

SEQ ID NO: 578543 - DNA, 25 bp, Mus musculus
catcttcagtctgggcactcgggag

SEQ ID NO: 578544 - DNA, 25 bp, Mus musculus
catcttcagtggcaccgtggtctag

SEQ ID NO: 578545 - DNA, 25 bp, Mus musculus
catcttcagtgggaccgtggtctag

SEQ ID NO: 578546 - DNA, 25 bp, Mus musculus
catcttcatccacggcttgtccgtg

SEQ ID NO: 578547 - DNA, 25 bp, Mus musculus
catcttcatccagggcttgtccgtg

SEQ ID NO: 578548 - DNA, 25 bp, Mus musculus
catcttccagccagatatgctggta

SEQ ID NO: 578549 - DNA, 25 bp, Mus musculus
catcttccagcctgatatgctggta

SEQ ID NO: 578550 - DNA, 25 bp, Mus musculus
catcttccaggcagagacggcggat

SEQ ID NO: 578551 - DNA, 25 bp, Mus musculus
catcttccaggctgagacggcggat

SEQ ID NO: 578552 - DNA, 25 bp, Mus musculus
catcttccagttaggaatctcttgc

SEQ ID NO: 578553 - DNA, 25 bp, Mus musculus
catcttccagtttggaatctcttgc

SEQ ID NO: 578554 - DNA, 25 bp, Mus musculus
catcttcccataatgccgtggcttg

SEQ ID NO: 578555 - DNA, 25 bp, Mus musculus
catcttcccatattgccgtggcttg

SEQ ID NO: 578556 - DNA, 25 bp, Mus musculus
catcttccggaacaggagcatcctt

SEQ ID NO: 578557 - DNA, 25 bp, Mus musculus
catcttccggaagaggagcatcctt

SEQ ID NO: 578558 - DNA, 25 bp, Mus musculus
catcttccggagagactcccgagga

SEQ ID NO: 578559 - DNA, 25 bp, Mus musculus
catcttccggagtgactcccgagga

SEQ ID NO: 578560 - DNA, 25 bp, Mus musculus
catcttccgtctctggcagaacgcg

SEQ ID NO: 578561 - DNA, 25 bp, Mus musculus
catcttccgtctgtggcagaacgcg

SEQ ID NO: 578562 - DNA, 25 bp, Mus musculus
catcttcctggaaccggatctctat

SEQ ID NO: 578563 - DNA, 25 bp, Mus musculus
catcttcctggatccggatctctat

SEQ ID NO: 578564 - DNA, 25 bp, Mus musculus
catcttcctgtacaccggagagctg

SEQ ID NO: 578565 - DNA, 25 bp, Mus musculus
catcttcctgtagaccggagagctg

SEQ ID NO: 578566 - DNA, 25 bp, Mus musculus
catcttcgacttcaggcctgttagt

SEQ ID NO: 578567 - DNA, 25 bp, Mus musculus
catcttcgacttgaggcctgttagt

SEQ ID NO: 578568 - DNA, 25 bp, Mus musculus
catcttcgagagctttgggtatgtt

SEQ ID NO: 578569 - DNA, 25 bp, Mus musculus
catcttcgagaggtttgggtatgtt

SEQ ID NO: 578570 - DNA, 25 bp, Mus musculus
catcttcgagtgctgcagtgttctg

SEQ ID NO: 578571 - DNA, 25 bp, Mus musculus
catcttcgagtggtgcagtgttctg

SEQ ID NO: 578572 - DNA, 25 bp, Mus musculus
catcttcgctccacgactggacaat

SEQ ID NO: 578573 - DNA, 25 bp, Mus musculus
catcttcgctcctcgactggacaat

SEQ ID NO: 578574 - DNA, 25 bp, Mus musculus
catcttcgtgaacgacgctgtgctc

SEQ ID NO: 578575 - DNA, 25 bp, Mus musculus
catcttcgtgaaggacgctgtgctc

SEQ ID NO: 578576 - DNA, 25 bp, Mus musculus
catcttcgtggtaatgattgtgctg

SEQ ID NO: 578577 - DNA, 25 bp, Mus musculus
catcttcgtggttatgattgtgctg

SEQ ID NO: 578578 - DNA, 25 bp, Mus musculus
catcttcgtgtaagggccgctgacc

SEQ ID NO: 578579 - DNA, 25 bp, Mus musculus
catcttcgtgtatgggccgctgacc

SEQ ID NO: 578580 - DNA, 25 bp, Mus musculus
catcttctcgataaaggactttcag

SEQ ID NO: 578581 - DNA, 25 bp, Mus musculus
catcttctcgattaaggactttcag

SEQ ID NO: 578582 - DNA, 25 bp, Mus musculus
catcttctgaggatccgctcaactc

SEQ ID NO: 578583 - DNA, 25 bp, Mus musculus
catcttctgaggttccgctcaactc

SEQ ID NO: 578584 - DNA, 25 bp, Mus musculus
catcttctgctgattcttggtggcc

SEQ ID NO: 578585 - DNA, 25 bp, Mus musculus
catcttctgctgtttcttggtggcc

SEQ ID NO: 578586 - DNA, 25 bp, Mus musculus
catcttctggctaaaagcagattcc

SEQ ID NO: 578587 - DNA, 25 bp, Mus musculus
catcttctggcttaaagcagattcc

SEQ ID NO: 578588 - DNA, 25 bp, Mus musculus
catcttctggtgcatatagacgaac

SEQ ID NO: 578589 - DNA, 25 bp, Mus musculus
catcttctggtggatatagacgaac

SEQ ID NO: 578590 - DNA, 25 bp, Mus musculus
catcttctgtgtcgcactcagcggc

SEQ ID NO: 578591 - DNA, 25 bp, Mus musculus
catcttctgtgtggcactcagcggc

SEQ ID NO: 578592 - DNA, 25 bp, Mus musculus
catcttctgttgagcaaaccctgca

SEQ ID NO: 578593 - DNA, 25 bp, Mus musculus
catcttctgttgtgcaaaccctgca

SEQ ID NO: 578594 - DNA, 25 bp, Mus musculus
catcttcttcctaatgaggccactg

SEQ ID NO: 578595 - DNA, 25 bp, Mus musculus
catcttcttccttatgaggccactg

SEQ ID NO: 578596 - DNA, 25 bp, Mus musculus
catcttcttcggagggcggtcccga

SEQ ID NO: 578597 - DNA, 25 bp, Mus musculus
catcttcttcggtgggcggtcccga

SEQ ID NO: 578598 - DNA, 25 bp, Mus musculus
catcttctttatcgtaaccgagctc

SEQ ID NO: 578599 - DNA, 25 bp, Mus musculus
catcttctttatggtaaccgagctc

SEQ ID NO: 578600 - DNA, 25 bp, Mus musculus
catcttgactgtccagctctttgca

SEQ ID NO: 578601 - DNA, 25 bp, Mus musculus
catcttgactgtgcagctctttgca

SEQ ID NO: 578602 - DNA, 25 bp, Mus musculus
catcttgagcgacaaggcatcttcc

SEQ ID NO: 578603 - DNA, 25 bp, Mus musculus
catcttgagcgagaaggcatcttcc

SEQ ID NO: 578604 - DNA, 25 bp, Mus musculus
catcttgcacggctcatgagccaca

SEQ ID NO: 578605 - DNA, 25 bp, Mus musculus
catcttgcacgggtcatgagccaca

SEQ ID NO: 578606 - DNA, 25 bp, Mus musculus
catcttgcagggacagcatcgtgct

SEQ ID NO: 578607 - DNA, 25 bp, Mus musculus
catcttgcagggtcagcatcgtgct

SEQ ID NO: 578608 - DNA, 25 bp, Mus musculus
catcttgcctctcatgcggaggagg

SEQ ID NO: 578609 - DNA, 25 bp, Mus musculus
catcttgcctctgatgcggaggagg

SEQ ID NO: 578610 - DNA, 25 bp, Mus musculus
catcttgcgaagaccccaagctctt

SEQ ID NO: 578611 - DNA, 25 bp, Mus musculus
catcttgcgaagtccccaagctctt

SEQ ID NO: 578612 - DNA, 25 bp, Mus musculus
catcttgctcacagctggacaagtc

SEQ ID NO: 578613 - DNA, 25 bp, Mus musculus
catcttgctcactgctggacaagtc

SEQ ID NO: 578614 - DNA, 25 bp, Mus musculus
catcttgcttggacactgctttgcc

SEQ ID NO: 578615 - DNA, 25 bp, Mus musculus
catcttgcttggtcactgctttgcc

SEQ ID NO: 578616 - DNA, 25 bp, Mus musculus
catcttggaaacagggcagcgtccc

SEQ ID NO: 578617 - DNA, 25 bp, Mus musculus
catcttggaaactgggcagcgtccc

SEQ ID NO: 578618 - DNA, 25 bp, Mus musculus
catcttggcactctggcttccacat

SEQ ID NO: 578619 - DNA, 25 bp, Mus musculus
catcttggcactgtggcttccacat

SEQ ID NO: 578620 - DNA, 25 bp, Mus musculus
catcttggcgtacttctaccctcgg

SEQ ID NO: 578621 - DNA, 25 bp, Mus musculus
catcttggcgtagttctaccctcgg

SEQ ID NO: 578622 - DNA, 25 bp, Mus musculus
catcttggcttacccatcaacttga

SEQ ID NO: 578623 - DNA, 25 bp, Mus musculus
catcttggcttagccatcaacttga

SEQ ID NO: 578624 - DNA, 25 bp, Mus musculus
catcttgggagaaactagtacagta

SEQ ID NO: 578625 - DNA, 25 bp, Mus musculus
catcttgggagatactagtacagta

SEQ ID NO: 578626 - DNA, 25 bp, Mus musculus
catcttgggcatcgtgtaccgctcg

SEQ ID NO: 578627 - DNA, 25 bp, Mus musculus
catcttgggcatggtgtaccgctcg

SEQ ID NO: 578628 - DNA, 25 bp, Mus musculus
catcttgggtgaagagaggtctaca

SEQ ID NO: 578629 - DNA, 25 bp, Mus musculus
catcttgggtgatgagaggtctaca

SEQ ID NO: 578630 - DNA, 25 bp, Mus musculus
catcttgtagagagaagcatgcaga

SEQ ID NO: 578631 - DNA, 25 bp, Mus musculus
catcttgtagagtgaagcatgcaga

SEQ ID NO: 578632 - DNA, 25 bp, Mus musculus
catcttgtagccctggaagccgcta

SEQ ID NO: 578633 - DNA, 25 bp, Mus musculus
catcttgtagccgtggaagccgcta

SEQ ID NO: 578634 - DNA, 25 bp, Mus musculus
catcttgtcaacctgaatgaggacc

SEQ ID NO: 578635 - DNA, 25 bp, Mus musculus
catcttgtcaacgtgaatgaggacc

SEQ ID NO: 578636 - DNA, 25 bp, Mus musculus
catcttgtcatcatgtaggatccca

SEQ ID NO: 578637 - DNA, 25 bp, Mus musculus
catcttgtcatcttgtaggatccca

SEQ ID NO: 578638 - DNA, 25 bp, Mus musculus
catcttgtcccgatttgatatgatc

SEQ ID NO: 578639 - DNA, 25 bp, Mus musculus
catcttgtcccgttttgatatgatc

SEQ ID NO: 578640 - DNA, 25 bp, Mus musculus
catcttgtctaaactccctattggg

SEQ ID NO: 578641 - DNA, 25 bp, Mus musculus
catcttgtctaatctccctattggg

SEQ ID NO: 578642 - DNA, 25 bp, Mus musculus
catcttgtgggtcagctggttagtc

SEQ ID NO: 578643 - DNA, 25 bp, Mus musculus
catcttgtgggtgagctggttagtc

SEQ ID NO: 578644 - DNA, 25 bp, Mus musculus
catcttgttgatcctgggtctgaag

SEQ ID NO: 578645 - DNA, 25 bp, Mus musculus
catcttgttgatcgtgttaaacgaa

SEQ ID NO: 578646 - DNA, 25 bp, Mus musculus
catcttgttgatgctgggtctgaag

SEQ ID NO: 578647 - DNA, 25 bp, Mus musculus
catcttgttgatggtgttaaacgaa

SEQ ID NO: 578648 - DNA, 25 bp, Mus musculus
catcttgttgtgagaagcaaaaggc

SEQ ID NO: 578649 - DNA, 25 bp, Mus musculus
catcttgttgtgtgaagcaaaaggc

SEQ ID NO: 578650 - DNA, 25 bp, Mus musculus
catcttgtttgccatcgtaggagga

SEQ ID NO: 578651 - DNA, 25 bp, Mus musculus
catcttgtttgcgatcgtaggagga

SEQ ID NO: 578652 - DNA, 25 bp, Mus musculus
catctttaaagaagtacggagtggg

SEQ ID NO: 578653 - DNA, 25 bp, Mus musculus
catctttaaagatgtacggagtggg

SEQ ID NO: 578654 - DNA, 25 bp, Mus musculus
catctttaacagcagtagcacgctc

SEQ ID NO: 578655 - DNA, 25 bp, Mus musculus
catctttaacaggagtagcacgctc

SEQ ID NO: 578656 - DNA, 25 bp, Mus musculus
catctttaagtcaggtggcatccca

SEQ ID NO: 578657 - DNA, 25 bp, Mus musculus
catctttaagtctggtggcatccca

SEQ ID NO: 578658 - DNA, 25 bp, Mus musculus
catctttacagaaatgtcctttcgg

SEQ ID NO: 578659 - DNA, 25 bp, Mus musculus
catctttacagatatgtcctttcgg

SEQ ID NO: 578660 - DNA, 25 bp, Mus musculus
catctttacctaagagtggctctgc

SEQ ID NO: 578661 - DNA, 25 bp, Mus musculus
catctttacctatgagtggctctgc

SEQ ID NO: 578662 - DNA, 25 bp, Mus musculus
catctttagataagaatcggacctt

SEQ ID NO: 578663 - DNA, 25 bp, Mus musculus
catctttagatatgaatcggacctt

SEQ ID NO: 578664 - DNA, 25 bp, Mus musculus
catctttcagctcaggatttcaaca

SEQ ID NO: 578665 - DNA, 25 bp, Mus musculus
catctttcagctgaggatttcaaca

SEQ ID NO: 578666 - DNA, 25 bp, Mus musculus
catctttcccaaagttgagcaagaa

SEQ ID NO: 578667 - DNA, 25 bp, Mus musculus
catctttcccaatgttgagcaagaa

SEQ ID NO: 578668 - DNA, 25 bp, Mus musculus
catctttctagcaagcaagagaagc

SEQ ID NO: 578669 - DNA, 25 bp, Mus musculus
catctttctagcagacgggaaggtg

SEQ ID NO: 578670 - DNA, 25 bp, Mus musculus
catctttctagctagcaagagaagc

SEQ ID NO: 578671 - DNA, 25 bp, Mus musculus
catctttctagctgacgggaaggtg

SEQ ID NO: 578672 - DNA, 25 bp, Mus musculus
catctttctccgagggttggagctc

SEQ ID NO: 578673 - DNA, 25 bp, Mus musculus
catctttctccgtgggttggagctc

SEQ ID NO: 578674 - DNA, 25 bp, Mus musculus
catctttctgacacggatgcattgg

SEQ ID NO: 578675 - DNA, 25 bp, Mus musculus
catctttctgactcggatgcattgg

SEQ ID NO: 578676 - DNA, 25 bp, Mus musculus
catctttgaaggagtggagtgccga

SEQ ID NO: 578677 - DNA, 25 bp, Mus musculus
catctttgaaggtgtggagtgccga

SEQ ID NO: 578678 - DNA, 25 bp, Mus musculus
catctttgacagatccagggacgag

SEQ ID NO: 578679 - DNA, 25 bp, Mus musculus
catctttgacagttccagggacgag

SEQ ID NO: 578680 - DNA, 25 bp, Mus musculus
catctttgacttcgtagcactgagc

SEQ ID NO: 578681 - DNA, 25 bp, Mus musculus
catctttgacttggtagcactgagc

SEQ ID NO: 578682 - DNA, 25 bp, Mus musculus
catctttgaggtcgtagcacaggac

SEQ ID NO: 578683 - DNA, 25 bp, Mus musculus
catctttgaggtggtagcacaggac

SEQ ID NO: 578684 - DNA, 25 bp, Mus musculus
catctttggcacacccgagtttgtc

SEQ ID NO: 578685 - DNA, 25 bp, Mus musculus
catctttggcactcccgagtttgtc

SEQ ID NO: 578686 - DNA, 25 bp, Mus musculus
catctttggtcacggtattcggtca

SEQ ID NO: 578687 - DNA, 25 bp, Mus musculus
catctttggtcagggtattcggtca

SEQ ID NO: 578688 - DNA, 25 bp, Mus musculus
catcttttcctacctctttccaaag

SEQ ID NO: 578689 - DNA, 25 bp, Mus musculus
catcttttcctagctctttccaaag

SEQ ID NO: 578690 - DNA, 25 bp, Mus musculus
catcttttgttgagccaagccctga

SEQ ID NO: 578691 - DNA, 25 bp, Mus musculus
catcttttgttgtgccaagccctga

SEQ ID NO: 578692 - DNA, 25 bp, Mus musculus
catctttttcagctctaggaatgat

SEQ ID NO: 578693 - DNA, 25 bp, Mus musculus
catctttttcaggtctaggaatgat

SEQ ID NO: 578694 - DNA, 25 bp, Mus musculus
catctttttcccagctgctactggg

SEQ ID NO: 578695 - DNA, 25 bp, Mus musculus
catctttttccctgctgctactggg

SEQ ID NO: 578696 - DNA, 25 bp, Mus musculus
catgaaaaacatactaactggctgg

SEQ ID NO: 578697 - DNA, 25 bp, Mus musculus
catgaaaaacattctaactggctgg

SEQ ID NO: 578698 - DNA, 25 bp, Mus musculus
catgaaaacatgacctgcttggccc

SEQ ID NO: 578699 - DNA, 25 bp, Mus musculus
catgaaaacatgtcctgcttggccc

SEQ ID NO: 578700 - DNA, 25 bp, Mus musculus
catgaaaaccaacttctgcaccggg

SEQ ID NO: 578701 - DNA, 25 bp, Mus musculus
catgaaaaccaagttctgcaccggg

SEQ ID NO: 578702 - DNA, 25 bp, Mus musculus
catgaaaactgcaaagacacttgtg

SEQ ID NO: 578703 - DNA, 25 bp, Mus musculus
catgaaaactgctaagacacttgtg

SEQ ID NO: 578704 - DNA, 25 bp, Mus musculus
catgaaaagaaacctcattgtgtga

SEQ ID NO: 578705 - DNA, 25 bp, Mus musculus
catgaaaagaaagctcattgtgtga

SEQ ID NO: 578706 - DNA, 25 bp, Mus musculus
catgaaaatgttctcaagtgtccca

SEQ ID NO: 578707 - DNA, 25 bp, Mus musculus
catgaaaatgttgtcaagtgtccca

SEQ ID NO: 578708 - DNA, 25 bp, Mus musculus
catgaaaccgccagttcacggaact

SEQ ID NO: 578709 - DNA, 25 bp, Mus musculus
catgaaaccgcctgttcacggaact

SEQ ID NO: 578710 - DNA, 25 bp, Mus musculus
catgaaactgtaaccattgaattga

SEQ ID NO: 578711 - DNA, 25 bp, Mus musculus
catgaaactgtatccattgaattga

SEQ ID NO: 578712 - DNA, 25 bp, Mus musculus
catgaaacttttcgcaatagagctg

SEQ ID NO: 578713 - DNA, 25 bp, Mus musculus
catgaaacttttggcaatagagctg

SEQ ID NO: 578714 - DNA, 25 bp, Mus musculus
catgaaagaaatccagggattaacc

SEQ ID NO: 578715 - DNA, 25 bp, Mus musculus
catgaaagaaatgcagggattaacc

SEQ ID NO: 578716 - DNA, 25 bp, Mus musculus
catgaaagaataagcctggtcttgt

SEQ ID NO: 578717 - DNA, 25 bp, Mus musculus
catgaaagaatatgcctggtcttgt

SEQ ID NO: 578718 - DNA, 25 bp, Mus musculus
catgaaagagatccaatctacaaga

SEQ ID NO: 578719 - DNA, 25 bp, Mus musculus
catgaaagagatgcaatctacaaga

SEQ ID NO: 578720 - DNA, 25 bp, Mus musculus
catgaaagatccaagtcgcagcagt

SEQ ID NO: 578721 - DNA, 25 bp, Mus musculus
catgaaagatcctagtcgcagcagt

SEQ ID NO: 578722 - DNA, 25 bp, Mus musculus
catgaaagatttcgaccgccatcta

SEQ ID NO: 578723 - DNA, 25 bp, Mus musculus
catgaaagatttggaccgccatcta

SEQ ID NO: 578724 - DNA, 25 bp, Mus musculus
catgaaagccccatcacggatgagg

SEQ ID NO: 578725 - DNA, 25 bp, Mus musculus
catgaaagccccttcacggatgagg

SEQ ID NO: 578726 - DNA, 25 bp, Mus musculus
catgaaaggaagaacaacgaagaaa

SEQ ID NO: 578727 - DNA, 25 bp, Mus musculus
catgaaaggaagtacaacgaagaaa

SEQ ID NO: 578728 - DNA, 25 bp, Mus musculus
catgaaaggatcctacagtctggtg

SEQ ID NO: 578729 - DNA, 25 bp, Mus musculus
catgaaaggatcgtacagtctggtg

SEQ ID NO: 578730 - DNA, 25 bp, Mus musculus
catgaaaggattaagggctccttcc

SEQ ID NO: 578731 - DNA, 25 bp, Mus musculus
catgaaaggatttagggctccttcc

SEQ ID NO: 578732 - DNA, 25 bp, Mus musculus
catgaaagtaacataattttcccag

SEQ ID NO: 578733 - DNA, 25 bp, Mus musculus
catgaaagtaacttaattttcccag

SEQ ID NO: 578734 - DNA, 25 bp, Mus musculus
catgaaagtcatagaaagccgagcc

SEQ ID NO: 578735 - DNA, 25 bp, Mus musculus
catgaaagtcattgaaagccgagcc

SEQ ID NO: 578736 - DNA, 25 bp, Mus musculus
catgaaagtcctcgatgacctgaat

SEQ ID NO: 578737 - DNA, 25 bp, Mus musculus
catgaaagtcctggatgacctgaat

SEQ ID NO: 578738 - DNA, 25 bp, Mus musculus
catgaaagtgatcttcttaaggcaa

SEQ ID NO: 578739 - DNA, 25 bp, Mus musculus
catgaaagtgatgttcttaaggcaa

SEQ ID NO: 578740 - DNA, 25 bp, Mus musculus
catgaaatcccaactgcacagtgga

SEQ ID NO: 578741 - DNA, 25 bp, Mus musculus
catgaaatcccatctgcacagtgga

SEQ ID NO: 578742 - DNA, 25 bp, Mus musculus
catgaaatgtttcgcctgaaaccta

SEQ ID NO: 578743 - DNA, 25 bp, Mus musculus
catgaaatgtttggcctgaaaccta

SEQ ID NO: 578744 - DNA, 25 bp, Mus musculus
catgaacaacggcagctgtgagcag

SEQ ID NO: 578745 - DNA, 25 bp, Mus musculus
catgaacaacgggagctgtgagcag

SEQ ID NO: 578746 - DNA, 25 bp, Mus musculus
catgaacaagctaaaaaacaacaag

SEQ ID NO: 578747 - DNA, 25 bp, Mus musculus
catgaacaagcttaaaaacaacaag

SEQ ID NO: 578748 - DNA, 25 bp, Mus musculus
catgaacaaggtctaaatcagcctg

SEQ ID NO: 578749 - DNA, 25 bp, Mus musculus
catgaacaaggtgtaaatcagcctg

SEQ ID NO: 578750 - DNA, 25 bp, Mus musculus
catgaacacaatcttcagcaagaag

SEQ ID NO: 578751 - DNA, 25 bp, Mus musculus
catgaacacaatgttcagcaagaag

SEQ ID NO: 578752 - DNA, 25 bp, Mus musculus
catgaacacagtcgaccttggccag

SEQ ID NO: 578753 - DNA, 25 bp, Mus musculus
catgaacacagtggaccttggccag

SEQ ID NO: 578754 - DNA, 25 bp, Mus musculus
catgaacacattatcgggatggtcc

SEQ ID NO: 578755 - DNA, 25 bp, Mus musculus
catgaacacattttcgggatggtcc

SEQ ID NO: 578756 - DNA, 25 bp, Mus musculus
catgaacactttcggcagctacaag

SEQ ID NO: 578757 - DNA, 25 bp, Mus musculus
catgaacactttgggcagctacaag

SEQ ID NO: 578758 - DNA, 25 bp, Mus musculus
catgaacagcttcagaggcttttgg

SEQ ID NO: 578759 - DNA, 25 bp, Mus musculus
catgaacagcttcatgctgacacaa

SEQ ID NO: 578760 - DNA, 25 bp, Mus musculus
catgaacagcttgagaggcttttgg

SEQ ID NO: 578761 - DNA, 25 bp, Mus musculus
catgaacagcttgatgctgacacaa

SEQ ID NO: 578762 - DNA, 25 bp, Mus musculus
catgaacagtggagtagataatgcc

SEQ ID NO: 578763 - DNA, 25 bp, Mus musculus
catgaacagtggtgtagataatgcc

SEQ ID NO: 578764 - DNA, 25 bp, Mus musculus
catgaacatgcacagtctgaatggg

SEQ ID NO: 578765 - DNA, 25 bp, Mus musculus
catgaacatgcaccctacttggtgg

SEQ ID NO: 578766 - DNA, 25 bp, Mus musculus
catgaacatgcagagtctgaatggg

SEQ ID NO: 578767 - DNA, 25 bp, Mus musculus
catgaacatgcagcctacttggtgg

SEQ ID NO: 578768 - DNA, 25 bp, Mus musculus
catgaacatttcatccacagaagta

SEQ ID NO: 578769 - DNA, 25 bp, Mus musculus
catgaacatttcttccacagaagta

SEQ ID NO: 578770 - DNA, 25 bp, Mus musculus
catgaacccatgcatttactaggcc

SEQ ID NO: 578771 - DNA, 25 bp, Mus musculus
catgaacccatggatttactaggcc

SEQ ID NO: 578772 - DNA, 25 bp, Mus musculus
catgaacccgagagtggttggcgtc

SEQ ID NO: 578773 - DNA, 25 bp, Mus musculus
catgaacccgagtgtggttggcgtc

SEQ ID NO: 578774 - DNA, 25 bp, Mus musculus
catgaaccgagaaggctctagtggg

SEQ ID NO: 578775 - DNA, 25 bp, Mus musculus
catgaaccgagatggctctagtggg

SEQ ID NO: 578776 - DNA, 25 bp, Mus musculus
catgaaccgcatatctactcggatg

SEQ ID NO: 578777 - DNA, 25 bp, Mus musculus
catgaaccgcatctgcgtgctagat

SEQ ID NO: 578778 - DNA, 25 bp, Mus musculus
catgaaccgcatgtgcgtgctagat

SEQ ID NO: 578779 - DNA, 25 bp, Mus musculus
catgaaccgcatttctactcggatg

SEQ ID NO: 578780 - DNA, 25 bp, Mus musculus
catgaacctggactccagcagcaac

SEQ ID NO: 578781 - DNA, 25 bp, Mus musculus
catgaacctggagtccagcagcaac

SEQ ID NO: 578782 - DNA, 25 bp, Mus musculus
catgaacctggtacctggtggaagt

SEQ ID NO: 578783 - DNA, 25 bp, Mus musculus
catgaacctggttcctggtggaagt

SEQ ID NO: 578784 - DNA, 25 bp, Mus musculus
catgaaccttcaaaacttggctcac

SEQ ID NO: 578785 - DNA, 25 bp, Mus musculus
catgaaccttcataacttggctcac

SEQ ID NO: 578786 - DNA, 25 bp, Mus musculus
catgaacgaccacttctacaatgcc

SEQ ID NO: 578787 - DNA, 25 bp, Mus musculus
catgaacgaccagttctacaatgcc

SEQ ID NO: 578788 - DNA, 25 bp, Mus musculus
catgaacgacgtagccattgtgaag

SEQ ID NO: 578789 - DNA, 25 bp, Mus musculus
catgaacgacgttgccattgtgaag

SEQ ID NO: 578790 - DNA, 25 bp, Mus musculus
catgaacgcaagagtgagcccatag

SEQ ID NO: 578791 - DNA, 25 bp, Mus musculus
catgaacgcaagtgtgagcccatag

SEQ ID NO: 578792 - DNA, 25 bp, Mus musculus
catgaacgtcttaatgctagatgag

SEQ ID NO: 578793 - DNA, 25 bp, Mus musculus
catgaacgtctttatgctagatgag

SEQ ID NO: 578794 - DNA, 25 bp, Mus musculus
catgaacgtggacttggcctttctg

SEQ ID NO: 578795 - DNA, 25 bp, Mus musculus
catgaacgtggagttggcctttctg

SEQ ID NO: 578796 - DNA, 25 bp, Mus musculus
catgaactccaacagaaaccttcta

SEQ ID NO: 578797 - DNA, 25 bp, Mus musculus
catgaactccaaccacaatattcgg

SEQ ID NO: 578798 - DNA, 25 bp, Mus musculus
catgaactccaagagaaaccttcta

SEQ ID NO: 578799 - DNA, 25 bp, Mus musculus
catgaactccaagcacaatattcgg

SEQ ID NO: 578800 - DNA, 25 bp, Mus musculus
catgaactctggattgtctggcctc

SEQ ID NO: 578801 - DNA, 25 bp, Mus musculus
catgaactctggtttgtctggcctc

SEQ ID NO: 578802 - DNA, 25 bp, Mus musculus
catgaactgatgatttccaccaaaa

SEQ ID NO: 578803 - DNA, 25 bp, Mus musculus
catgaactgatgttttccaccaaaa

SEQ ID NO: 578804 - DNA, 25 bp, Mus musculus
catgaactgggcacctgaaaggaaa

SEQ ID NO: 578805 - DNA, 25 bp, Mus musculus
catgaactgggccattgtggctgac

SEQ ID NO: 578806 - DNA, 25 bp, Mus musculus
catgaactgggcgattgtggctgac

SEQ ID NO: 578807 - DNA, 25 bp, Mus musculus
catgaactgggctcctgaaaggaaa

SEQ ID NO: 578808 - DNA, 25 bp, Mus musculus
catgaacttcgtaggctgaactccg

SEQ ID NO: 578809 - DNA, 25 bp, Mus musculus
catgaacttcgtcaagctgctgcac

SEQ ID NO: 578810 - DNA, 25 bp, Mus musculus
catgaacttcgtgaagctgctgcac

SEQ ID NO: 578811 - DNA, 25 bp, Mus musculus
catgaacttcgttggctgaactccg

SEQ ID NO: 578812 - DNA, 25 bp, Mus musculus
catgaagaaaaccaccggcctttgt

SEQ ID NO: 578813 - DNA, 25 bp, Mus musculus
catgaagaaaacgaccggcctttgt

SEQ ID NO: 578814 - DNA, 25 bp, Mus musculus
catgaagaaactatggtagtgacga

SEQ ID NO: 578815 - DNA, 25 bp, Mus musculus
catgaagaaactttggtagtgacga

SEQ ID NO: 578816 - DNA, 25 bp, Mus musculus
catgaagaaagacgagcttacaaag

SEQ ID NO: 578817 - DNA, 25 bp, Mus musculus
catgaagaaagaggagcttacaaag

SEQ ID NO: 578818 - DNA, 25 bp, Mus musculus
catgaagaaagcactcaagctgcta

SEQ ID NO: 578819 - DNA, 25 bp, Mus musculus
catgaagaaagctctcaagctgcta

SEQ ID NO: 578820 - DNA, 25 bp, Mus musculus
catgaagaacatagccagtgacact

SEQ ID NO: 578821 - DNA, 25 bp, Mus musculus
catgaagaacattgccagtgacact

SEQ ID NO: 578822 - DNA, 25 bp, Mus musculus
catgaagaacgcaacactttacctg

SEQ ID NO: 578823 - DNA, 25 bp, Mus musculus
catgaagaacgctacactttacctg

SEQ ID NO: 578824 - DNA, 25 bp, Mus musculus
catgaagaatccaaaagctaagacc

SEQ ID NO: 578825 - DNA, 25 bp, Mus musculus
catgaagaatcctaaagctaagacc

SEQ ID NO: 578826 - DNA, 25 bp, Mus musculus
catgaagaatttcttgtgagagaag

SEQ ID NO: 578827 - DNA, 25 bp, Mus musculus
catgaagaatttgttgtgagagaag

SEQ ID NO: 578828 - DNA, 25 bp, Mus musculus
catgaagacaacagtaccagcggct

SEQ ID NO: 578829 - DNA, 25 bp, Mus musculus
catgaagacaactgtaccagcggct

SEQ ID NO: 578830 - DNA, 25 bp, Mus musculus
catgaagaccaactttaaagagacc

SEQ ID NO: 578831 - DNA, 25 bp, Mus musculus
catgaagaccaagtttaaagagacc

SEQ ID NO: 578832 - DNA, 25 bp, Mus musculus
catgaagaccctcgagtggctgtcc

SEQ ID NO: 578833 - DNA, 25 bp, Mus musculus
catgaagaccctggagtggctgtcc

SEQ ID NO: 578834 - DNA, 25 bp, Mus musculus
catgaagacttcctagataactctc

SEQ ID NO: 578835 - DNA, 25 bp, Mus musculus
catgaagacttcgtagataactctc

SEQ ID NO: 578836 - DNA, 25 bp, Mus musculus
catgaagagataaggaaacttattt

SEQ ID NO: 578837 - DNA, 25 bp, Mus musculus
catgaagagatacctcagtgcacag

SEQ ID NO: 578838 - DNA, 25 bp, Mus musculus
catgaagagatagctcagtgcacag

SEQ ID NO: 578839 - DNA, 25 bp, Mus musculus
catgaagagatatggaaacttattt

SEQ ID NO: 578840 - DNA, 25 bp, Mus musculus
catgaagagcgaaaacaaactcccc

SEQ ID NO: 578841 - DNA, 25 bp, Mus musculus
catgaagagcgataacaaactcccc

SEQ ID NO: 578842 - DNA, 25 bp, Mus musculus
catgaagagtttcgttacaaagtag

SEQ ID NO: 578843 - DNA, 25 bp, Mus musculus
catgaagagtttggttacaaagtag

SEQ ID NO: 578844 - DNA, 25 bp, Mus musculus
catgaagatactaccaagatgaacc

SEQ ID NO: 578845 - DNA, 25 bp, Mus musculus
catgaagatacttccaagatgaacc

SEQ ID NO: 578846 - DNA, 25 bp, Mus musculus
catgaagatgaccataactttgagc

SEQ ID NO: 578847 - DNA, 25 bp, Mus musculus
catgaagatgacgataactttgagc

SEQ ID NO: 578848 - DNA, 25 bp, Mus musculus
catgaagatggtagtcactgacccc

SEQ ID NO: 578849 - DNA, 25 bp, Mus musculus
catgaagatggttgtcactgacccc

SEQ ID NO: 578850 - DNA, 25 bp, Mus musculus
catgaagatgtgaagaaggcgctgc

SEQ ID NO: 578851 - DNA, 25 bp, Mus musculus
catgaagatgtgtagaaggcgctgc

SEQ ID NO: 578852 - DNA, 25 bp, Mus musculus
catgaagattggcattgaggcaaag

SEQ ID NO: 578853 - DNA, 25 bp, Mus musculus
catgaagattgggattgaggcaaag

SEQ ID NO: 578854 - DNA, 25 bp, Mus musculus
catgaagcagacagggtacctgact

SEQ ID NO: 578855 - DNA, 25 bp, Mus musculus
catgaagcagactgggtacctgact

SEQ ID NO: 578856 - DNA, 25 bp, Mus musculus
catgaagccaaacgagccgatgacg

SEQ ID NO: 578857 - DNA, 25 bp, Mus musculus
catgaagccaaaggagccgatgacg

SEQ ID NO: 578858 - DNA, 25 bp, Mus musculus
catgaagccacaccgctgtctcaga

SEQ ID NO: 578859 - DNA, 25 bp, Mus musculus
catgaagccacagcgctgtctcaga

SEQ ID NO: 578860 - DNA, 25 bp, Mus musculus
catgaagcctgtactgtgatctaga

SEQ ID NO: 578861 - DNA, 25 bp, Mus musculus
catgaagcctgttctgtgatctaga

SEQ ID NO: 578862 - DNA, 25 bp, Mus musculus
catgaagccttcctggtggatctga

SEQ ID NO: 578863 - DNA, 25 bp, Mus musculus
catgaagccttcgtggtggatctga

SEQ ID NO: 578864 - DNA, 25 bp, Mus musculus
catgaagcgcccatctgtggtcaaa

SEQ ID NO: 578865 - DNA, 25 bp, Mus musculus
catgaagcgcccttctgtggtcaaa

SEQ ID NO: 578866 - DNA, 25 bp, Mus musculus
catgaagcggtaagtgtggcagccc

SEQ ID NO: 578867 - DNA, 25 bp, Mus musculus
catgaagcggtatgtgtggcagccc

SEQ ID NO: 578868 - DNA, 25 bp, Mus musculus
catgaagcgtcaaatcagaactgcc

SEQ ID NO: 578869 - DNA, 25 bp, Mus musculus
catgaagcgtcatatcagaactgcc

SEQ ID NO: 578870 - DNA, 25 bp, Mus musculus
catgaagcgtgtctgtaccaggaac

SEQ ID NO: 578871 - DNA, 25 bp, Mus musculus
catgaagcgtgtgtgtaccaggaac

SEQ ID NO: 578872 - DNA, 25 bp, Mus musculus
catgaagctcagaaggctccagaag

SEQ ID NO: 578873 - DNA, 25 bp, Mus musculus
catgaagctcagtaggctccagaag

SEQ ID NO: 578874 - DNA, 25 bp, Mus musculus
catgaagctgctcgaacagagagca

SEQ ID NO: 578875 - DNA, 25 bp, Mus musculus
catgaagctgctggaacagagagca

SEQ ID NO: 578876 - DNA, 25 bp, Mus musculus
catgaagctggacctcgatgccctg

SEQ ID NO: 578877 - DNA, 25 bp, Mus musculus
catgaagctggagctcgatgccctg

SEQ ID NO: 578878 - DNA, 25 bp, Mus musculus
catgaagctgtgctggccacacagt

SEQ ID NO: 578879 - DNA, 25 bp, Mus musculus
catgaagctgtggtggccacacagt

SEQ ID NO: 578880 - DNA, 25 bp, Mus musculus
catgaaggacgcattgcagatctcc

SEQ ID NO: 578881 - DNA, 25 bp, Mus musculus
catgaaggacgctttgcagatctcc

SEQ ID NO: 578882 - DNA, 25 bp, Mus musculus
catgaaggatcacatgtcagcttca

SEQ ID NO: 578883 - DNA, 25 bp, Mus musculus
catgaaggatcagatgtcagcttca

SEQ ID NO: 578884 - DNA, 25 bp, Mus musculus
catgaaggcaatatatgtcagagta

SEQ ID NO: 578885 - DNA, 25 bp, Mus musculus
catgaaggcaatttatgtcagagta

SEQ ID NO: 578886 - DNA, 25 bp, Mus musculus
catgaagggtctcgcaggcatcaga

SEQ ID NO: 578887 - DNA, 25 bp, Mus musculus
catgaagggtctggcaggcatcaga

SEQ ID NO: 578888 - DNA, 25 bp, Mus musculus
catgaaggtcataccagccgtgagc

SEQ ID NO: 578889 - DNA, 25 bp, Mus musculus
catgaaggtcatcagatgcgctgtt

SEQ ID NO: 578890 - DNA, 25 bp, Mus musculus
catgaaggtcatgagatgcgctgtt

SEQ ID NO: 578891 - DNA, 25 bp, Mus musculus
catgaaggtcattccagccgtgagc

SEQ ID NO: 578892 - DNA, 25 bp, Mus musculus
catgaaggttcacgcctctgctaca

SEQ ID NO: 578893 - DNA, 25 bp, Mus musculus
catgaaggttcaggcctctgctaca

SEQ ID NO: 578894 - DNA, 25 bp, Mus musculus
catgaaggttccagatgatccggag

SEQ ID NO: 578895 - DNA, 25 bp, Mus musculus
catgaaggttcctgatgatccggag

SEQ ID NO: 578896 - DNA, 25 bp, Mus musculus
catgaagtactcagagctggctaca

SEQ ID NO: 578897 - DNA, 25 bp, Mus musculus
catgaagtactctgagctggctaca

SEQ ID NO: 578898 - DNA, 25 bp, Mus musculus
catgaagtccacctccagatgcagg

SEQ ID NO: 578899 - DNA, 25 bp, Mus musculus
catgaagtccacgtccagatgcagg

SEQ ID NO: 578900 - DNA, 25 bp, Mus musculus
catgaagtccgtaaacagatgttgc

SEQ ID NO: 578901 - DNA, 25 bp, Mus musculus
catgaagtccgttaacagatgttgc

SEQ ID NO: 578902 - DNA, 25 bp, Mus musculus
catgaagtcctcatttgaatgccaa

SEQ ID NO: 578903 - DNA, 25 bp, Mus musculus
catgaagtcctcttttgaatgccaa

SEQ ID NO: 578904 - DNA, 25 bp, Mus musculus
catgaagtgccaaggataaggcctg

SEQ ID NO: 578905 - DNA, 25 bp, Mus musculus
catgaagtgccatggataaggcctg

SEQ ID NO: 578906 - DNA, 25 bp, Mus musculus
catgaagtgtggcatccttccaatt

SEQ ID NO: 578907 - DNA, 25 bp, Mus musculus
catgaagtgtgggatccttccaatt

SEQ ID NO: 578908 - DNA, 25 bp, Mus musculus
catgaagttagcctgcgaagcgctg

SEQ ID NO: 578909 - DNA, 25 bp, Mus musculus
catgaagttagcgtgcgaagcgctg

SEQ ID NO: 578910 - DNA, 25 bp, Mus musculus
catgaagttccactataaggaggac

SEQ ID NO: 578911 - DNA, 25 bp, Mus musculus
catgaagttccagtataaggaggac

SEQ ID NO: 578912 - DNA, 25 bp, Mus musculus
catgaagttcccattgaaggacaga

SEQ ID NO: 578913 - DNA, 25 bp, Mus musculus
catgaagttccctttgaaggacaga

SEQ ID NO: 578914 - DNA, 25 bp, Mus musculus
catgaagttgggagacaacggagaa

SEQ ID NO: 578915 - DNA, 25 bp, Mus musculus
catgaagttgggtgacaacggagaa

SEQ ID NO: 578916 - DNA, 25 bp, Mus musculus
catgaagtttttagatactacccca

SEQ ID NO: 578917 - DNA, 25 bp, Mus musculus
catgaagttttttgatactacccca

SEQ ID NO: 578918 - DNA, 25 bp, Mus musculus
catgaataccggctgtgccagctgc

SEQ ID NO: 578919 - DNA, 25 bp, Mus musculus
catgaataccgggtgtgccagctgc

SEQ ID NO: 578920 - DNA, 25 bp, Mus musculus
catgaatagactcacccagctggaa

SEQ ID NO: 578921 - DNA, 25 bp, Mus musculus
catgaatagactcagctttttgagg

SEQ ID NO: 578922 - DNA, 25 bp, Mus musculus
catgaatagactgacccagctggaa

SEQ ID NO: 578923 - DNA, 25 bp, Mus musculus
catgaatagactgagctttttgagg

SEQ ID NO: 578924 - DNA, 25 bp, Mus musculus
catgaatcaaccaggccacctcaga

SEQ ID NO: 578925 - DNA, 25 bp, Mus musculus
catgaatcaacctggccacctcaga

SEQ ID NO: 578926 - DNA, 25 bp, Mus musculus
catgaatcacatctaatgctgacag

SEQ ID NO: 578927 - DNA, 25 bp, Mus musculus
catgaatcacatgtaatgctgacag

SEQ ID NO: 578928 - DNA, 25 bp, Mus musculus
catgaatccctcctttaatcgggca

SEQ ID NO: 578929 - DNA, 25 bp, Mus musculus
catgaatccctcgtttaatcgggca

SEQ ID NO: 578930 - DNA, 25 bp, Mus musculus
catgaatcgttccttgatttgtctc

SEQ ID NO: 578931 - DNA, 25 bp, Mus musculus
catgaatcgttcgttgatttgtctc

SEQ ID NO: 578932 - DNA, 25 bp, Mus musculus
catgaatgacaccatcgtttctggg

SEQ ID NO: 578933 - DNA, 25 bp, Mus musculus
catgaatgacacgatcgtttctggg

SEQ ID NO: 578934 - DNA, 25 bp, Mus musculus
catgaatgagagattccttttgtga

SEQ ID NO: 578935 - DNA, 25 bp, Mus musculus
catgaatgagagtttccttttgtga

SEQ ID NO: 578936 - DNA, 25 bp, Mus musculus
catgaatgcatgcaaaaccagtcgc

SEQ ID NO: 578937 - DNA, 25 bp, Mus musculus
catgaatgcatggaaaaccagtcgc

SEQ ID NO: 578938 - DNA, 25 bp, Mus musculus
catgaatgcttacatggcatataga

SEQ ID NO: 578939 - DNA, 25 bp, Mus musculus
catgaatgcttagatggcatataga

SEQ ID NO: 578940 - DNA, 25 bp, Mus musculus
catgaatggcaacaaggccagtgag

SEQ ID NO: 578941 - DNA, 25 bp, Mus musculus
catgaatggcaagaaggccagtgag

SEQ ID NO: 578942 - DNA, 25 bp, Mus musculus
catgaatggctaaggatcacacacc

SEQ ID NO: 578943 - DNA, 25 bp, Mus musculus
catgaatggctatggatcacacacc

SEQ ID NO: 578944 - DNA, 25 bp, Mus musculus
catgaatgggttaattgaccagatc

SEQ ID NO: 578945 - DNA, 25 bp, Mus musculus
catgaatgggtttattgaccagatc

SEQ ID NO: 578946 - DNA, 25 bp, Mus musculus
catgaattcatacagctgtgtgagg

SEQ ID NO: 578947 - DNA, 25 bp, Mus musculus
catgaattcatagagctgtgtgagg

SEQ ID NO: 578948 - DNA, 25 bp, Mus musculus
catgaattgggccacagtctgggtt

SEQ ID NO: 578949 - DNA, 25 bp, Mus musculus
catgaattgggcgacagtctgggtt

SEQ ID NO: 578950 - DNA, 25 bp, Mus musculus
catgaatttgaaccaactctgggtg

SEQ ID NO: 578951 - DNA, 25 bp, Mus musculus
catgaatttgaagcaactctgggtg

SEQ ID NO: 578952 - DNA, 25 bp, Mus musculus
catgacaaacatattcaagttctgc

SEQ ID NO: 578953 - DNA, 25 bp, Mus musculus
catgacaaacattttcaagttctgc

SEQ ID NO: 578954 - DNA, 25 bp, Mus musculus
catgacaaagctacaaaggatgcca

SEQ ID NO: 578955 - DNA, 25 bp, Mus musculus
catgacaaagcttcaaaggatgcca

SEQ ID NO: 578956 - DNA, 25 bp, Mus musculus
catgacaaagtactgaaagtgctgt

SEQ ID NO: 578957 - DNA, 25 bp, Mus musculus
catgacaaagtagtgaaagtgctgt

SEQ ID NO: 578958 - DNA, 25 bp, Mus musculus
catgacaacagacagcatctagcca

SEQ ID NO: 578959 - DNA, 25 bp, Mus musculus
catgacaacagagagcatctagcca

SEQ ID NO: 578960 - DNA, 25 bp, Mus musculus
catgacaacccactgaagagagagg

SEQ ID NO: 578961 - DNA, 25 bp, Mus musculus
catgacaacccagtgaagagagagg

SEQ ID NO: 578962 - DNA, 25 bp, Mus musculus
catgacaagagacaagagggctgca

SEQ ID NO: 578963 - DNA, 25 bp, Mus musculus
catgacaagagagaagagggctgca

SEQ ID NO: 578964 - DNA, 25 bp, Mus musculus
catgacaagggactgaagatatgcc

SEQ ID NO: 578965 - DNA, 25 bp, Mus musculus
catgacaagggagtgaagatatgcc

SEQ ID NO: 578966 - DNA, 25 bp, Mus musculus
catgacaataataaacctgcctccg

SEQ ID NO: 578967 - DNA, 25 bp, Mus musculus
catgacaataattaacctgcctccg

SEQ ID NO: 578968 - DNA, 25 bp, Mus musculus
catgacaatgatcagccgcagggac

SEQ ID NO: 578969 - DNA, 25 bp, Mus musculus
catgacaatgatgagccgcagggac

SEQ ID NO: 578970 - DNA, 25 bp, Mus musculus
catgacaatgcacttcatcagccac

SEQ ID NO: 578971 - DNA, 25 bp, Mus musculus
catgacaatgcagttcatcagccac

SEQ ID NO: 578972 - DNA, 25 bp, Mus musculus
catgacacacctcgatacagatgtg

SEQ ID NO: 578973 - DNA, 25 bp, Mus musculus
catgacacacctggatacagatgtg

SEQ ID NO: 578974 - DNA, 25 bp, Mus musculus
catgacacctgcctctaatacacag

SEQ ID NO: 578975 - DNA, 25 bp, Mus musculus
catgacacctgcgtctaatacacag

SEQ ID NO: 578976 - DNA, 25 bp, Mus musculus
catgacagagctataaggaggagaa

SEQ ID NO: 578977 - DNA, 25 bp, Mus musculus
catgacagagctttaaggaggagaa

SEQ ID NO: 578978 - DNA, 25 bp, Mus musculus
catgacagatagatttacaaaagca

SEQ ID NO: 578979 - DNA, 25 bp, Mus musculus
catgacagatagttttacaaaagca

SEQ ID NO: 578980 - DNA, 25 bp, Mus musculus
catgacagattccatccagggatac

SEQ ID NO: 578981 - DNA, 25 bp, Mus musculus
catgacagattcgatccagggatac

SEQ ID NO: 578982 - DNA, 25 bp, Mus musculus
catgacagcctaccatggcagctat

SEQ ID NO: 578983 - DNA, 25 bp, Mus musculus
catgacagcctagcatggcagctat

SEQ ID NO: 578984 - DNA, 25 bp, Mus musculus
catgacagcgcactacgacgagttc

SEQ ID NO: 578985 - DNA, 25 bp, Mus musculus
catgacagcgcagtacgacgagttc

SEQ ID NO: 578986 - DNA, 25 bp, Mus musculus
catgacaggtgaagtcctacagatc

SEQ ID NO: 578987 - DNA, 25 bp, Mus musculus
catgacaggtgatgtcctacagatc

SEQ ID NO: 578988 - DNA, 25 bp, Mus musculus
catgacatacgacaagctcagccgg

SEQ ID NO: 578989 - DNA, 25 bp, Mus musculus
catgacatacgagaagctcagccgg

SEQ ID NO: 578990 - DNA, 25 bp, Mus musculus
catgacatcatcagtcgagaatccc

SEQ ID NO: 578991 - DNA, 25 bp, Mus musculus
catgacatcatctgtcgagaatccc

SEQ ID NO: 578992 - DNA, 25 bp, Mus musculus
catgacatccggcactatgacctgg

SEQ ID NO: 578993 - DNA, 25 bp, Mus musculus
catgacatccgggactatgacctgg

SEQ ID NO: 578994 - DNA, 25 bp, Mus musculus
catgacatctatctgattggcaccc

SEQ ID NO: 578995 - DNA, 25 bp, Mus musculus
catgacatctatgtgattggcaccc

SEQ ID NO: 578996 - DNA, 25 bp, Mus musculus
catgacatgtggattattaaagagc

SEQ ID NO: 578997 - DNA, 25 bp, Mus musculus
catgacatgtggtttattaaagagc

SEQ ID NO: 578998 - DNA, 25 bp, Mus musculus
catgacattcctcagattttttggc

SEQ ID NO: 578999 - DNA, 25 bp, Mus musculus
catgacattcctgagattttttggc

SEQ ID NO: 579000 - DNA, 25 bp, Mus musculus
catgaccaatgacactcgggaacgg

SEQ ID NO: 579001 - DNA, 25 bp, Mus musculus
catgaccaatgagactcgggaacgg

SEQ ID NO: 579002 - DNA, 25 bp, Mus musculus
catgaccacacaaggtaggcagcgt

SEQ ID NO: 579003 - DNA, 25 bp, Mus musculus
catgaccacacatggtaggcagcgt

SEQ ID NO: 579004 - DNA, 25 bp, Mus musculus
catgaccactatcgaggccgggagt

SEQ ID NO: 579005 - DNA, 25 bp, Mus musculus
catgaccactatggaggccgggagt

SEQ ID NO: 579006 - DNA, 25 bp, Mus musculus
catgaccagaggcaatgccaagtac

SEQ ID NO: 579007 - DNA, 25 bp, Mus musculus
catgaccagagggaatgccaagtac

SEQ ID NO: 579008 - DNA, 25 bp, Mus musculus
catgaccagtaacaggcggttacag

SEQ ID NO: 579009 - DNA, 25 bp, Mus musculus
catgaccagtaagaggcggttacag

SEQ ID NO: 579010 - DNA, 25 bp, Mus musculus
catgaccagtcaagaccttatgaag

SEQ ID NO: 579011 - DNA, 25 bp, Mus musculus
catgaccagtcatgaccttatgaag

SEQ ID NO: 579012 - DNA, 25 bp, Mus musculus
catgaccagtggagactacgctttc

SEQ ID NO: 579013 - DNA, 25 bp, Mus musculus
catgaccagtggtgactacgctttc

SEQ ID NO: 579014 - DNA, 25 bp, Mus musculus
catgaccatatacagagtgatgtac

SEQ ID NO: 579015 - DNA, 25 bp, Mus musculus
catgaccatatagagagtgatgtac

SEQ ID NO: 579016 - DNA, 25 bp, Mus musculus
catgaccatgaacagccatcaggct

SEQ ID NO: 579017 - DNA, 25 bp, Mus musculus
catgaccatgaagagccatcaggct

SEQ ID NO: 579018 - DNA, 25 bp, Mus musculus
catgacccacgtcttggcaggaggc

SEQ ID NO: 579019 - DNA, 25 bp, Mus musculus
catgacccacgtgttggcaggaggc

SEQ ID NO: 579020 - DNA, 25 bp, Mus musculus
catgacccatttctctaactatgga

SEQ ID NO: 579021 - DNA, 25 bp, Mus musculus
catgacccatttgtctaactatgga

SEQ ID NO: 579022 - DNA, 25 bp, Mus musculus
catgaccccaaacgatgcaatggca

SEQ ID NO: 579023 - DNA, 25 bp, Mus musculus
catgaccccaaaggatgcaatggca

SEQ ID NO: 579024 - DNA, 25 bp, Mus musculus
catgaccccagcagatgatttctgt

SEQ ID NO: 579025 - DNA, 25 bp, Mus musculus
catgaccccagctgatgatttctgt

SEQ ID NO: 579026 - DNA, 25 bp, Mus musculus
catgaccccttgataattcctggca

SEQ ID NO: 579027 - DNA, 25 bp, Mus musculus
catgaccccttgttaattcctggca

SEQ ID NO: 579028 - DNA, 25 bp, Mus musculus
catgaccctatgaggcaatgggagc

SEQ ID NO: 579029 - DNA, 25 bp, Mus musculus
catgaccctatgtggcaatgggagc

SEQ ID NO: 579030 - DNA, 25 bp, Mus musculus
catgaccctgaacaagacagaccca

SEQ ID NO: 579031 - DNA, 25 bp, Mus musculus
catgaccctgaagaagacagaccca

SEQ ID NO: 579032 - DNA, 25 bp, Mus musculus
catgaccgagcacaaaatacccagt

SEQ ID NO: 579033 - DNA, 25 bp, Mus musculus
catgaccgagcagaaaatacccagt

SEQ ID NO: 579034 - DNA, 25 bp, Mus musculus
catgaccgcatgaatgtgggcagca

SEQ ID NO: 579035 - DNA, 25 bp, Mus musculus
catgaccgcatgtatgtgggcagca

SEQ ID NO: 579036 - DNA, 25 bp, Mus musculus
catgaccgcctgcatttgcctgtga

SEQ ID NO: 579037 - DNA, 25 bp, Mus musculus
catgaccgcctggatttgcctgtga

SEQ ID NO: 579038 - DNA, 25 bp, Mus musculus
catgaccgtcgtacacaatcttacg

SEQ ID NO: 579039 - DNA, 25 bp, Mus musculus
catgaccgtcgttcacaatcttacg

SEQ ID NO: 579040 - DNA, 25 bp, Mus musculus
catgacctcactcggaagctataac

SEQ ID NO: 579041 - DNA, 25 bp, Mus musculus
catgacctcactgggaagctataac

SEQ ID NO: 579042 - DNA, 25 bp, Mus musculus
catgacctgcacaaaagatgcgcgg

SEQ ID NO: 579043 - DNA, 25 bp, Mus musculus
catgacctgcactaaagatgcgcgg

SEQ ID NO: 579044 - DNA, 25 bp, Mus musculus
catgacctggagctactgagaaagc

SEQ ID NO: 579045 - DNA, 25 bp, Mus musculus
catgacctggaggtactgagaaagc

SEQ ID NO: 579046 - DNA, 25 bp, Mus musculus
catgacctggtgagtggtaagtaga

SEQ ID NO: 579047 - DNA, 25 bp, Mus musculus
catgacctggtgtgtggtaagtaga

SEQ ID NO: 579048 - DNA, 25 bp, Mus musculus
catgaccttctactccgaaagatgt

SEQ ID NO: 579049 - DNA, 25 bp, Mus musculus
catgaccttctagtccgaaagatgt

SEQ ID NO: 579050 - DNA, 25 bp, Mus musculus
catgaccttgctcggctgctgagca

SEQ ID NO: 579051 - DNA, 25 bp, Mus musculus
catgaccttgctgggctgctgagca

SEQ ID NO: 579052 - DNA, 25 bp, Mus musculus
catgaccttggaaggcgtgctgaac

SEQ ID NO: 579053 - DNA, 25 bp, Mus musculus
catgaccttggatggcgtgctgaac

SEQ ID NO: 579054 - DNA, 25 bp, Mus musculus
catgacctttgtagtccagagcagc

SEQ ID NO: 579055 - DNA, 25 bp, Mus musculus
catgacctttgttgtccagagcagc

SEQ ID NO: 579056 - DNA, 25 bp, Mus musculus
catgacgaacaaattctatgcagca

SEQ ID NO: 579057 - DNA, 25 bp, Mus musculus
catgacgaacaatttctatgcagca

SEQ ID NO: 579058 - DNA, 25 bp, Mus musculus
catgacgagaatccatctatggaag

SEQ ID NO: 579059 - DNA, 25 bp, Mus musculus
catgacgagaatgcatctatggaag

SEQ ID NO: 579060 - DNA, 25 bp, Mus musculus
catgacgattcacatcctcctcaag

SEQ ID NO: 579061 - DNA, 25 bp, Mus musculus
catgacgattcagatcctcctcaag

SEQ ID NO: 579062 - DNA, 25 bp, Mus musculus
catgacgctcatcggagagaacggc

SEQ ID NO: 579063 - DNA, 25 bp, Mus musculus
catgacgctcatgggagagaacggc

SEQ ID NO: 579064 - DNA, 25 bp, Mus musculus
catgacgctctcagcctacattgag

SEQ ID NO: 579065 - DNA, 25 bp, Mus musculus
catgacgctctctgcctacattgag

SEQ ID NO: 579066 - DNA, 25 bp, Mus musculus
catgacggacggagcccagcaggcc

SEQ ID NO: 579067 - DNA, 25 bp, Mus musculus
catgacggacggtgcccagcaggcc

SEQ ID NO: 579068 - DNA, 25 bp, Mus musculus
catgacggtcagatggccatttatc

SEQ ID NO: 579069 - DNA, 25 bp, Mus musculus
catgacggtcagttggccatttatc

SEQ ID NO: 579070 - DNA, 25 bp, Mus musculus
catgacggtttgagctctcgtgccc

SEQ ID NO: 579071 - DNA, 25 bp, Mus musculus
catgacggtttgtgctctcgtgccc

SEQ ID NO: 579072 - DNA, 25 bp, Mus musculus
catgactaagagaagaaaccactgg

SEQ ID NO: 579073 - DNA, 25 bp, Mus musculus
catgactaagagtagaaaccactgg

SEQ ID NO: 579074 - DNA, 25 bp, Mus musculus
catgactacatcagctgggagtcct

SEQ ID NO: 579075 - DNA, 25 bp, Mus musculus
catgactacatctgctgggagtcct

SEQ ID NO: 579076 - DNA, 25 bp, Mus musculus
catgactccaagctgaagatttgga

SEQ ID NO: 579077 - DNA, 25 bp, Mus musculus
catgactccaaggtgaagatttgga

SEQ ID NO: 579078 - DNA, 25 bp, Mus musculus
catgactccggcatccggttgaaca

SEQ ID NO: 579079 - DNA, 25 bp, Mus musculus
catgactccggcttccggttgaaca

SEQ ID NO: 579080 - DNA, 25 bp, Mus musculus
catgactccttcaaactaccagcag

SEQ ID NO: 579081 - DNA, 25 bp, Mus musculus
catgactccttctaactaccagcag

SEQ ID NO: 579082 - DNA, 25 bp, Mus musculus
catgactcgcatagtaatgatagag

SEQ ID NO: 579083 - DNA, 25 bp, Mus musculus
catgactcgcattgtaatgatagag

SEQ ID NO: 579084 - DNA, 25 bp, Mus musculus
catgactcgccacgaacagggcgct

SEQ ID NO: 579085 - DNA, 25 bp, Mus musculus
catgactcgccaggaacagggcgct

SEQ ID NO: 579086 - DNA, 25 bp, Mus musculus
catgactcgcgaattcaaacctgga

SEQ ID NO: 579087 - DNA, 25 bp, Mus musculus
catgactcgcgatttcaaacctgga

SEQ ID NO: 579088 - DNA, 25 bp, Mus musculus
catgactctaagaaggttttcctac

SEQ ID NO: 579089 - DNA, 25 bp, Mus musculus
catgactctaagtaggttttcctac

SEQ ID NO: 579090 - DNA, 25 bp, Mus musculus
catgactcttccacactgacctgta

SEQ ID NO: 579091 - DNA, 25 bp, Mus musculus
catgactcttcctcactgacctgta

SEQ ID NO: 579092 - DNA, 25 bp, Mus musculus
catgactgaacgctttgactgccac

SEQ ID NO: 579093 - DNA, 25 bp, Mus musculus
catgactgaacggtttgactgccac

SEQ ID NO: 579094 - DNA, 25 bp, Mus musculus
catgactgagcacggtgaagatatc

SEQ ID NO: 579095 - DNA, 25 bp, Mus musculus
catgactgagcagggtgaagatatc

SEQ ID NO: 579096 - DNA, 25 bp, Mus musculus
catgactgagttcaagcgtggcctg

SEQ ID NO: 579097 - DNA, 25 bp, Mus musculus
catgactgagttgaagcgtggcctg

SEQ ID NO: 579098 - DNA, 25 bp, Mus musculus
catgactgcctcacgacataaccaa

SEQ ID NO: 579099 - DNA, 25 bp, Mus musculus
catgactgcctctcgacataaccaa

SEQ ID NO: 579100 - DNA, 25 bp, Mus musculus
catgactggccacaaatacttgctg

SEQ ID NO: 579101 - DNA, 25 bp, Mus musculus
catgactggccagaaatacttgctg

SEQ ID NO: 579102 - DNA, 25 bp, Mus musculus
catgactggctgaacagctatgtgt

SEQ ID NO: 579103 - DNA, 25 bp, Mus musculus
catgactggctgagctacctggccc

SEQ ID NO: 579104 - DNA, 25 bp, Mus musculus
catgactggctgtacagctatgtgt

SEQ ID NO: 579105 - DNA, 25 bp, Mus musculus
catgactggctgtgctacctggccc

SEQ ID NO: 579106 - DNA, 25 bp, Mus musculus
catgactggtgaatttagaaaatac

SEQ ID NO: 579107 - DNA, 25 bp, Mus musculus
catgactggtgattttagaaaatac

SEQ ID NO: 579108 - DNA, 25 bp, Mus musculus
catgacttctgaatacaattccaag

SEQ ID NO: 579109 - DNA, 25 bp, Mus musculus
catgacttctgattacaattccaag

SEQ ID NO: 579110 - DNA, 25 bp, Mus musculus
catgactttgctatcaactttgacc

SEQ ID NO: 579111 - DNA, 25 bp, Mus musculus
catgactttgctttcaactttgacc

SEQ ID NO: 579112 - DNA, 25 bp, Mus musculus
catgagaaaacaaggcatccacatg

SEQ ID NO: 579113 - DNA, 25 bp, Mus musculus
catgagaaaacatggcatccacatg

SEQ ID NO: 579114 - DNA, 25 bp, Mus musculus
catgagaaactgaataaaagggaca

SEQ ID NO: 579115 - DNA, 25 bp, Mus musculus
catgagaaactgtataaaagggaca

SEQ ID NO: 579116 - DNA, 25 bp, Mus musculus
catgagaaagtcaccagtagccgag

SEQ ID NO: 579117 - DNA, 25 bp, Mus musculus
catgagaaagtctccagtagccgag

SEQ ID NO: 579118 - DNA, 25 bp, Mus musculus
catgagaatgatccagctacacaac

SEQ ID NO: 579119 - DNA, 25 bp, Mus musculus
catgagaatgatgcagctacacaac

SEQ ID NO: 579120 - DNA, 25 bp, Mus musculus
catgagaatgtcagacctgatatgg

SEQ ID NO: 579121 - DNA, 25 bp, Mus musculus
catgagaatgtctgacctgatatgg

SEQ ID NO: 579122 - DNA, 25 bp, Mus musculus
catgagaattacaccaaggccctgg

SEQ ID NO: 579123 - DNA, 25 bp, Mus musculus
catgagaattactccaaggccctgg

SEQ ID NO: 579124 - DNA, 25 bp, Mus musculus
catgagacaaagctgcaccgaggga

SEQ ID NO: 579125 - DNA, 25 bp, Mus musculus
catgagacaaaggtgcaccgaggga

SEQ ID NO: 579126 - DNA, 25 bp, Mus musculus
catgagacacacaaaacactccaaa

SEQ ID NO: 579127 - DNA, 25 bp, Mus musculus
catgagacacactaaacactccaaa

SEQ ID NO: 579128 - DNA, 25 bp, Mus musculus
catgagaccctgagtgaagacagaa

SEQ ID NO: 579129 - DNA, 25 bp, Mus musculus
catgagaccctgtgtgaagacagaa

SEQ ID NO: 579130 - DNA, 25 bp, Mus musculus
catgagaccggcatcaatagattct

SEQ ID NO: 579131 - DNA, 25 bp, Mus musculus
catgagaccggcttcaatagattct

SEQ ID NO: 579132 - DNA, 25 bp, Mus musculus
catgagacctggactgggcacgtca

SEQ ID NO: 579133 - DNA, 25 bp, Mus musculus
catgagacctggtctgggcacgtca

SEQ ID NO: 579134 - DNA, 25 bp, Mus musculus
catgagagaaacacctcgggagcca

SEQ ID NO: 579135 - DNA, 25 bp, Mus musculus
catgagagaaactcctcgggagcca

SEQ ID NO: 579136 - DNA, 25 bp, Mus musculus
catgagaggtacaactagatcttcc

SEQ ID NO: 579137 - DNA, 25 bp, Mus musculus
catgagaggtactactagatcttcc

SEQ ID NO: 579138 - DNA, 25 bp, Mus musculus
catgagagtccgaaagtaagcctgg

SEQ ID NO: 579139 - DNA, 25 bp, Mus musculus
catgagagtccgtaagtaagcctgg

SEQ ID NO: 579140 - DNA, 25 bp, Mus musculus
catgagatgcgcagtttgcctagga

SEQ ID NO: 579141 - DNA, 25 bp, Mus musculus
catgagatgcgctgtttgcctagga

SEQ ID NO: 579142 - DNA, 25 bp, Mus musculus
catgagatgtatcacttgatgctgg

SEQ ID NO: 579143 - DNA, 25 bp, Mus musculus
catgagatgtatgacttgatgctgg

SEQ ID NO: 579144 - DNA, 25 bp, Mus musculus
catgagattgacacttatgatgatc

SEQ ID NO: 579145 - DNA, 25 bp, Mus musculus
catgagattgactcttatgatgatc

SEQ ID NO: 579146 - DNA, 25 bp, Mus musculus
catgagattgttccctgcagtttga

SEQ ID NO: 579147 - DNA, 25 bp, Mus musculus
catgagattgttgcctgcagtttga

SEQ ID NO: 579148 - DNA, 25 bp, Mus musculus
catgagcaaaagcaaggtggacaac

SEQ ID NO: 579149 - DNA, 25 bp, Mus musculus
catgagcaaaaggaaggtggacaac

SEQ ID NO: 579150 - DNA, 25 bp, Mus musculus
catgagcaagcaccaaacaggcagg

SEQ ID NO: 579151 - DNA, 25 bp, Mus musculus
catgagcaagcagcaaacaggcagg

SEQ ID NO: 579152 - DNA, 25 bp, Mus musculus
catgagcaatgacgacgctgtacgg

SEQ ID NO: 579153 - DNA, 25 bp, Mus musculus
catgagcaatgaggacgctgtacgg

SEQ ID NO: 579154 - DNA, 25 bp, Mus musculus
catgagcaccgtcatgcagctgcag

SEQ ID NO: 579155 - DNA, 25 bp, Mus musculus
catgagcaccgtgatgcagctgcag

SEQ ID NO: 579156 - DNA, 25 bp, Mus musculus
catgagcacctcaggtggcactgcc

SEQ ID NO: 579157 - DNA, 25 bp, Mus musculus
catgagcacctctggtggcactgcc

SEQ ID NO: 579158 - DNA, 25 bp, Mus musculus
catgagcacggacccgctgtctgca

SEQ ID NO: 579159 - DNA, 25 bp, Mus musculus
catgagcacggagccgctgtctgca

SEQ ID NO: 579160 - DNA, 25 bp, Mus musculus
catgagcagaagctggcgcaaagtc

SEQ ID NO: 579161 - DNA, 25 bp, Mus musculus
catgagcagaaggtggcgcaaagtc

SEQ ID NO: 579162 - DNA, 25 bp, Mus musculus
catgagcagactcgctatttattca

SEQ ID NO: 579163 - DNA, 25 bp, Mus musculus
catgagcagactggctatttattca

SEQ ID NO: 579164 - DNA, 25 bp, Mus musculus
catgagcagccgagtccacgaggct

SEQ ID NO: 579165 - DNA, 25 bp, Mus musculus
catgagcagccgtgtccacgaggct

SEQ ID NO: 579166 - DNA, 25 bp, Mus musculus
catgagcagcggctactgcagcctg

SEQ ID NO: 579167 - DNA, 25 bp, Mus musculus
catgagcagcgggtactgcagcctg

SEQ ID NO: 579168 - DNA, 25 bp, Mus musculus
catgagcagctgactatggagagac

SEQ ID NO: 579169 - DNA, 25 bp, Mus musculus
catgagcagctgtctatggagagac

SEQ ID NO: 579170 - DNA, 25 bp, Mus musculus
catgagcagtacaagatccacaaag

SEQ ID NO: 579171 - DNA, 25 bp, Mus musculus
catgagcagtactagatccacaaag

SEQ ID NO: 579172 - DNA, 25 bp, Mus musculus
catgagcagtttagtgtcacagatg

SEQ ID NO: 579173 - DNA, 25 bp, Mus musculus
catgagcagttttgtgtcacagatg

SEQ ID NO: 579174 - DNA, 25 bp, Mus musculus
catgagcatcaacacgcacttgggc

SEQ ID NO: 579175 - DNA, 25 bp, Mus musculus
catgagcatcaagacgcacttgggc

SEQ ID NO: 579176 - DNA, 25 bp, Mus musculus
catgagccaaagcagggatttgcag

SEQ ID NO: 579177 - DNA, 25 bp, Mus musculus
catgagccaaaggagggatttgcag

SEQ ID NO: 579178 - DNA, 25 bp, Mus musculus
catgagccacagcatggagggaatc

SEQ ID NO: 579179 - DNA, 25 bp, Mus musculus
catgagccacaggatggagggaatc

SEQ ID NO: 579180 - DNA, 25 bp, Mus musculus
catgagccctttaacagtgacagac

SEQ ID NO: 579181 - DNA, 25 bp, Mus musculus
catgagcccttttacagtgacagac

SEQ ID NO: 579182 - DNA, 25 bp, Mus musculus
catgagccggagacagacatcttat

SEQ ID NO: 579183 - DNA, 25 bp, Mus musculus
catgagccggagtcagacatcttat

SEQ ID NO: 579184 - DNA, 25 bp, Mus musculus
catgagcctaccagaggacagtaag

SEQ ID NO: 579185 - DNA, 25 bp, Mus musculus
catgagcctacctgaggacagtaag

SEQ ID NO: 579186 - DNA, 25 bp, Mus musculus
catgagcctatcagctgggctccct

SEQ ID NO: 579187 - DNA, 25 bp, Mus musculus
catgagcctatctgctgggctccct

SEQ ID NO: 579188 - DNA, 25 bp, Mus musculus
catgagcgaagtacctgagatggag

SEQ ID NO: 579189 - DNA, 25 bp, Mus musculus
catgagcgaagttcctgagatggag

SEQ ID NO: 579190 - DNA, 25 bp, Mus musculus
catgagcgagatcaaagtagctctg

SEQ ID NO: 579191 - DNA, 25 bp, Mus musculus
catgagcgagatgaaagtagctctg

SEQ ID NO: 579192 - DNA, 25 bp, Mus musculus
catgagcgccagaacctgctgtgtc

SEQ ID NO: 579193 - DNA, 25 bp, Mus musculus
catgagcgccagtacctgctgtgtc

SEQ ID NO: 579194 - DNA, 25 bp, Mus musculus
catgagcgccatcgccactaacgga

SEQ ID NO: 579195 - DNA, 25 bp, Mus musculus
catgagcgccatggccactaacgga

SEQ ID NO: 579196 - DNA, 25 bp, Mus musculus
catgagcgctggcacattgggatct

SEQ ID NO: 579197 - DNA, 25 bp, Mus musculus
catgagcgctgggacattgggatct

SEQ ID NO: 579198 - DNA, 25 bp, Mus musculus
catgagcggaaacttcgaggcatga

SEQ ID NO: 579199 - DNA, 25 bp, Mus musculus
catgagcggaaagttcgaggcatga

SEQ ID NO: 579200 - DNA, 25 bp, Mus musculus
catgagcggtccatcacgcagatca

SEQ ID NO: 579201 - DNA, 25 bp, Mus musculus
catgagcggtccttcacgcagatca

SEQ ID NO: 579202 - DNA, 25 bp, Mus musculus
catgagcgtaaccactggagaagat

SEQ ID NO: 579203 - DNA, 25 bp, Mus musculus
catgagcgtaacgactggagaagat

SEQ ID NO: 579204 - DNA, 25 bp, Mus musculus
catgagcgtcctctttgtgacaaac

SEQ ID NO: 579205 - DNA, 25 bp, Mus musculus
catgagcgtcctgtttgtgacaaac

SEQ ID NO: 579206 - DNA, 25 bp, Mus musculus
catgagcgtgtgatagtcccggcct

SEQ ID NO: 579207 - DNA, 25 bp, Mus musculus
catgagcgtgtgttagtcccggcct

SEQ ID NO: 579208 - DNA, 25 bp, Mus musculus
catgagctcagaaccagtctgggct

SEQ ID NO: 579209 - DNA, 25 bp, Mus musculus
catgagctcagatccagtctgggct

SEQ ID NO: 579210 - DNA, 25 bp, Mus musculus
catgagctccctcaggtccgtgtgc

SEQ ID NO: 579211 - DNA, 25 bp, Mus musculus
catgagctccctgaggtccgtgtgc

SEQ ID NO: 579212 - DNA, 25 bp, Mus musculus
catgagctgcgtatgcgcggcaaga

SEQ ID NO: 579213 - DNA, 25 bp, Mus musculus
catgagctgcgtttgcgcggcaaga

SEQ ID NO: 579214 - DNA, 25 bp, Mus musculus
catgagctttacaagactctgggag

SEQ ID NO: 579215 - DNA, 25 bp, Mus musculus
catgagctttactagactctgggag

SEQ ID NO: 579216 - DNA, 25 bp, Mus musculus
catgaggaacaaatgctgcagcgcc

SEQ ID NO: 579217 - DNA, 25 bp, Mus musculus
catgaggaacaattgctgcagcgcc

SEQ ID NO: 579218 - DNA, 25 bp, Mus musculus
catgaggaatttatcccagcgtttc

SEQ ID NO: 579219 - DNA, 25 bp, Mus musculus
catgaggaatttttcccagcgtttc

SEQ ID NO: 579220 - DNA, 25 bp, Mus musculus
catgaggactacatggagggcatcc

SEQ ID NO: 579221 - DNA, 25 bp, Mus musculus
catgaggactacttggagggcatcc

SEQ ID NO: 579222 - DNA, 25 bp, Mus musculus
catgaggaggaaatggctgcttatt

SEQ ID NO: 579223 - DNA, 25 bp, Mus musculus
catgaggaggaattggctgcttatt

SEQ ID NO: 579224 - DNA, 25 bp, Mus musculus
catgaggagtataagagcaagggca

SEQ ID NO: 579225 - DNA, 25 bp, Mus musculus
catgaggagtattagagcaagggca

SEQ ID NO: 579226 - DNA, 25 bp, Mus musculus
catgaggcatgcacgaggcgtgcac

SEQ ID NO: 579227 - DNA, 25 bp, Mus musculus
catgaggcatgctcgaggcgtgcac

SEQ ID NO: 579228 - DNA, 25 bp, Mus musculus
catgaggccatgagtccaaaaacaa

SEQ ID NO: 579229 - DNA, 25 bp, Mus musculus
catgaggccatgtgtccaaaaacaa

SEQ ID NO: 579230 - DNA, 25 bp, Mus musculus
catgaggccccaatcttggtagatc

SEQ ID NO: 579231 - DNA, 25 bp, Mus musculus
catgaggccccattcttggtagatc

SEQ ID NO: 579232 - DNA, 25 bp, Mus musculus
catgaggcccgacaagcagaagaga

SEQ ID NO: 579233 - DNA, 25 bp, Mus musculus
catgaggcccgagaagcagaagaga

SEQ ID NO: 579234 - DNA, 25 bp, Mus musculus
catgaggctgagcaagtgcggccct

SEQ ID NO: 579235 - DNA, 25 bp, Mus musculus
catgaggctgaggaagtgcggccct

SEQ ID NO: 579236 - DNA, 25 bp, Mus musculus
catgaggcttggagtcgagcttcca

SEQ ID NO: 579237 - DNA, 25 bp, Mus musculus
catgaggcttggtgtcgagcttcca

SEQ ID NO: 579238 - DNA, 25 bp, Mus musculus
catgagggctacctccatgcagacc

SEQ ID NO: 579239 - DNA, 25 bp, Mus musculus
catgagggctacgtccatgcagacc

SEQ ID NO: 579240 - DNA, 25 bp, Mus musculus
catgagggtcatatcaccagcgata

SEQ ID NO: 579241 - DNA, 25 bp, Mus musculus
catgagggtcatttcaccagcgata

SEQ ID NO: 579242 - DNA, 25 bp, Mus musculus
catgagggtcccaaccttcatttcc

SEQ ID NO: 579243 - DNA, 25 bp, Mus musculus
catgagggtccctaccttcatttcc

SEQ ID NO: 579244 - DNA, 25 bp, Mus musculus
catgagggttatcacagctattatt

SEQ ID NO: 579245 - DNA, 25 bp, Mus musculus
catgagggttatgacagctattatt

SEQ ID NO: 579246 - DNA, 25 bp, Mus musculus
catgaggtcttgacggaggcacgct

SEQ ID NO: 579247 - DNA, 25 bp, Mus musculus
catgaggtcttgtcggaggcacgct

SEQ ID NO: 579248 - DNA, 25 bp, Mus musculus
catgaggtggagctgcagtactaca

SEQ ID NO: 579249 - DNA, 25 bp, Mus musculus
catgaggtggaggtgcagtactaca

SEQ ID NO: 579250 - DNA, 25 bp, Mus musculus
catgaggtgtccataaatgggttcc

SEQ ID NO: 579251 - DNA, 25 bp, Mus musculus
catgaggtgtccttaaatgggttcc

SEQ ID NO: 579252 - DNA, 25 bp, Mus musculus
catgaggtgtctcccaacgcaggac

SEQ ID NO: 579253 - DNA, 25 bp, Mus musculus
catgaggtgtctgccaacgcaggac

SEQ ID NO: 579254 - DNA, 25 bp, Mus musculus
catgaggttacgatttaacgtggcc

SEQ ID NO: 579255 - DNA, 25 bp, Mus musculus
catgaggttacgttttaacgtggcc

SEQ ID NO: 579256 - DNA, 25 bp, Mus musculus
catgaggttcttcacgaagctggac

SEQ ID NO: 579257 - DNA, 25 bp, Mus musculus
catgaggttcttgacgaagctggac

SEQ ID NO: 579258 - DNA, 25 bp, Mus musculus
catgagtatatcatctgcttcgtcc

SEQ ID NO: 579259 - DNA, 25 bp, Mus musculus
catgagtatatcttctgcttcgtcc

SEQ ID NO: 579260 - DNA, 25 bp, Mus musculus
catgagtatcgaagacatggtcttc

SEQ ID NO: 579261 - DNA, 25 bp, Mus musculus
catgagtatcgatgacatggtcttc

SEQ ID NO: 579262 - DNA, 25 bp, Mus musculus
catgagtatgtgatagctgtgagaa

SEQ ID NO: 579263 - DNA, 25 bp, Mus musculus
catgagtatgtgttagctgtgagaa

SEQ ID NO: 579264 - DNA, 25 bp, Mus musculus
catgagtcagagatctactgtaagg

SEQ ID NO: 579265 - DNA, 25 bp, Mus musculus
catgagtcagagttctactgtaagg

SEQ ID NO: 579266 - DNA, 25 bp, Mus musculus
catgagtcgggtaatgcagtaccat

SEQ ID NO: 579267 - DNA, 25 bp, Mus musculus
catgagtcgggttatgcagtaccat

SEQ ID NO: 579268 - DNA, 25 bp, Mus musculus
catgagtcgttcacctgctaggacc

SEQ ID NO: 579269 - DNA, 25 bp, Mus musculus
catgagtcgttctcctgctaggacc

SEQ ID NO: 579270 - DNA, 25 bp, Mus musculus
catgagtctgcacgagttcacgagg

SEQ ID NO: 579271 - DNA, 25 bp, Mus musculus
catgagtctgcaggagttcacgagg

SEQ ID NO: 579272 - DNA, 25 bp, Mus musculus
catgagtgacttcgattcttcgagc

SEQ ID NO: 579273 - DNA, 25 bp, Mus musculus
catgagtgacttggattcttcgagc

SEQ ID NO: 579274 - DNA, 25 bp, Mus musculus
catgagtgccaacttcgagcggctg

SEQ ID NO: 579275 - DNA, 25 bp, Mus musculus
catgagtgccaagttcgagcggctg

SEQ ID NO: 579276 - DNA, 25 bp, Mus musculus
catgagtggacgatcaaacaccgtt

SEQ ID NO: 579277 - DNA, 25 bp, Mus musculus
catgagtggacgttcaaacaccgtt

SEQ ID NO: 579278 - DNA, 25 bp, Mus musculus
catgagtgtgtgagcactttggagg

SEQ ID NO: 579279 - DNA, 25 bp, Mus musculus
catgagtgtgtgtgcactttggagg

SEQ ID NO: 579280 - DNA, 25 bp, Mus musculus
catgagttcagacggcacaagggat

SEQ ID NO: 579281 - DNA, 25 bp, Mus musculus
catgagttcagagggcacaagggat

SEQ ID NO: 579282 - DNA, 25 bp, Mus musculus
catgagttctgacttcctgcgcttc

SEQ ID NO: 579283 - DNA, 25 bp, Mus musculus
catgagttctgagttcctgcgcttc

SEQ ID NO: 579284 - DNA, 25 bp, Mus musculus
catgagttgcaacgtgatcattgag

SEQ ID NO: 579285 - DNA, 25 bp, Mus musculus
catgagttgcaaggtgatcattgag

SEQ ID NO: 579286 - DNA, 25 bp, Mus musculus
catgagttgtctcccaaagaggtga

SEQ ID NO: 579287 - DNA, 25 bp, Mus musculus
catgagttgtctgccaaagaggtga

SEQ ID NO: 579288 - DNA, 25 bp, Mus musculus
catgagtttcccagccccaagtggg

SEQ ID NO: 579289 - DNA, 25 bp, Mus musculus
catgagtttccctgccccaagtggg

SEQ ID NO: 579290 - DNA, 25 bp, Mus musculus
catgataaagaacaaaccggccagt

SEQ ID NO: 579291 - DNA, 25 bp, Mus musculus
catgataaagaagaaaccggccagt

SEQ ID NO: 579292 - DNA, 25 bp, Mus musculus
catgataacaagacccgactccgga

SEQ ID NO: 579293 - DNA, 25 bp, Mus musculus
catgataacaagatgacacatacgg

SEQ ID NO: 579294 - DNA, 25 bp, Mus musculus
catgataacaagtcccgactccgga

SEQ ID NO: 579295 - DNA, 25 bp, Mus musculus
catgataacaagttgacacatacgg

SEQ ID NO: 579296 - DNA, 25 bp, Mus musculus
catgataagcccatgcttgggtgta

SEQ ID NO: 579297 - DNA, 25 bp, Mus musculus
catgataagcccttgcttgggtgta

SEQ ID NO: 579298 - DNA, 25 bp, Mus musculus
catgataagggaatgggttccaatc

SEQ ID NO: 579299 - DNA, 25 bp, Mus musculus
catgataagggattgggttccaatc

SEQ ID NO: 579300 - DNA, 25 bp, Mus musculus
catgataagttcattaaaagaggtc

SEQ ID NO: 579301 - DNA, 25 bp, Mus musculus
catgataagttctttaaaagaggtc

SEQ ID NO: 579302 - DNA, 25 bp, Mus musculus
catgatacaaggaggtgtgtacggc

SEQ ID NO: 579303 - DNA, 25 bp, Mus musculus
catgatacaaggtggtgtgtacggc

SEQ ID NO: 579304 - DNA, 25 bp, Mus musculus
catgataccattattctttaccacc

SEQ ID NO: 579305 - DNA, 25 bp, Mus musculus
catgataccatttttctttaccacc

SEQ ID NO: 579306 - DNA, 25 bp, Mus musculus
catgatacgggacctcatagagacc

SEQ ID NO: 579307 - DNA, 25 bp, Mus musculus
catgatacgggagctcatagagacc

SEQ ID NO: 579308 - DNA, 25 bp, Mus musculus
catgatagagtgatcagccaaggat

SEQ ID NO: 579309 - DNA, 25 bp, Mus musculus
catgatagagtgttcagccaaggat

SEQ ID NO: 579310 - DNA, 25 bp, Mus musculus
catgatagctgtcctccaagtggcc

SEQ ID NO: 579311 - DNA, 25 bp, Mus musculus
catgatagctgtgctccaagtggcc

SEQ ID NO: 579312 - DNA, 25 bp, Mus musculus
catgataggctccaccacgagccag

SEQ ID NO: 579313 - DNA, 25 bp, Mus musculus
catgataggctcgaccacgagccag

SEQ ID NO: 579314 - DNA, 25 bp, Mus musculus
catgatagtcagaacctgaaggctg

SEQ ID NO: 579315 - DNA, 25 bp, Mus musculus
catgatagtcagtacctgaaggctg

SEQ ID NO: 579316 - DNA, 25 bp, Mus musculus
catgatatcaggcaatgtcttgcca

SEQ ID NO: 579317 - DNA, 25 bp, Mus musculus
catgatatcagggaatgtcttgcca

SEQ ID NO: 579318 - DNA, 25 bp, Mus musculus
catgatatctgtccagctgacccac

SEQ ID NO: 579319 - DNA, 25 bp, Mus musculus
catgatatctgtgcagctgacccac

SEQ ID NO: 579320 - DNA, 25 bp, Mus musculus
catgatcaacaacatcgacaagaat

SEQ ID NO: 579321 - DNA, 25 bp, Mus musculus
catgatcaacaagatcgacaagaat

SEQ ID NO: 579322 - DNA, 25 bp, Mus musculus
catgatcaagcacgagggagatgca

SEQ ID NO: 579323 - DNA, 25 bp, Mus musculus
catgatcaagcaggagggagatgca

SEQ ID NO: 579324 - DNA, 25 bp, Mus musculus
catgatcagagtctgtcctcctgtg

SEQ ID NO: 579325 - DNA, 25 bp, Mus musculus
catgatcagagtgtgtcctcctgtg

SEQ ID NO: 579326 - DNA, 25 bp, Mus musculus
catgatcagcaaccaaatggctaag

SEQ ID NO: 579327 - DNA, 25 bp, Mus musculus
catgatcagcaagcaaatggctaag

SEQ ID NO: 579328 - DNA, 25 bp, Mus musculus
catgatcagcccactggctcagcag

SEQ ID NO: 579329 - DNA, 25 bp, Mus musculus
catgatcagccctctggctcagcag

SEQ ID NO: 579330 - DNA, 25 bp, Mus musculus
catgatcatggactgcaagtacacg

SEQ ID NO: 579331 - DNA, 25 bp, Mus musculus
catgatcatggagtgcaagtacacg

SEQ ID NO: 579332 - DNA, 25 bp, Mus musculus
catgatccactgcaccaggagctgt

SEQ ID NO: 579333 - DNA, 25 bp, Mus musculus
catgatccactggaccaggagctgt

SEQ ID NO: 579334 - DNA, 25 bp, Mus musculus
catgatccagatatacactccgtgc

SEQ ID NO: 579335 - DNA, 25 bp, Mus musculus
catgatccagatttacactccgtgc

SEQ ID NO: 579336 - DNA, 25 bp, Mus musculus
catgatccagcccactgcaagtggt

SEQ ID NO: 579337 - DNA, 25 bp, Mus musculus
catgatccagccgactgcaagtggt

SEQ ID NO: 579338 - DNA, 25 bp, Mus musculus
catgatccaggaatccgactgcggc

SEQ ID NO: 579339 - DNA, 25 bp, Mus musculus
catgatccaggattccgactgcggc

SEQ ID NO: 579340 - DNA, 25 bp, Mus musculus
catgatcctaacattgtcgttacca

SEQ ID NO: 579341 - DNA, 25 bp, Mus musculus
catgatcctaactttgtcgttacca

SEQ ID NO: 579342 - DNA, 25 bp, Mus musculus
catgatcctagtcgtggctgcccag

SEQ ID NO: 579343 - DNA, 25 bp, Mus musculus
catgatcctagtggtggctgcccag

SEQ ID NO: 579344 - DNA, 25 bp, Mus musculus
catgatcctgatatgtgccatggct

SEQ ID NO: 579345 - DNA, 25 bp, Mus musculus
catgatcctgatttgtgccatggct

SEQ ID NO: 579346 - DNA, 25 bp, Mus musculus
catgatccttaaatttgccaaagaa

SEQ ID NO: 579347 - DNA, 25 bp, Mus musculus
catgatccttaattttgccaaagaa

SEQ ID NO: 579348 - DNA, 25 bp, Mus musculus
catgatcggagcatgctggacgagt

SEQ ID NO: 579349 - DNA, 25 bp, Mus musculus
catgatcggagcttgctggacgagt

SEQ ID NO: 579350 - DNA, 25 bp, Mus musculus
catgatcgtcaccttagtggcccgg

SEQ ID NO: 579351 - DNA, 25 bp, Mus musculus
catgatcgtcacgttagtggcccgg

SEQ ID NO: 579352 - DNA, 25 bp, Mus musculus
catgatctacacatttttctgtgca

SEQ ID NO: 579353 - DNA, 25 bp, Mus musculus
catgatctacacttttttctgtgca

SEQ ID NO: 579354 - DNA, 25 bp, Mus musculus
catgatctactgcacgacaggaacc

SEQ ID NO: 579355 - DNA, 25 bp, Mus musculus
catgatctactggacgacaggaacc

SEQ ID NO: 579356 - DNA, 25 bp, Mus musculus
catgatctgaggaaagtggaagccg

SEQ ID NO: 579357 - DNA, 25 bp, Mus musculus
catgatctgaggtaagtggaagccg

SEQ ID NO: 579358 - DNA, 25 bp, Mus musculus
catgatctgataagctggaaaccca

SEQ ID NO: 579359 - DNA, 25 bp, Mus musculus
catgatctgatatgctggaaaccca

SEQ ID NO: 579360 - DNA, 25 bp, Mus musculus
catgatctgccaacaaggagccaac

SEQ ID NO: 579361 - DNA, 25 bp, Mus musculus
catgatctgccatcaaggagccaac

SEQ ID NO: 579362 - DNA, 25 bp, Mus musculus
catgatgaacacagagaccacctga

SEQ ID NO: 579363 - DNA, 25 bp, Mus musculus
catgatgaacactgagaccacctga

SEQ ID NO: 579364 - DNA, 25 bp, Mus musculus
catgatgaccgtcgctgtgttcctc

SEQ ID NO: 579365 - DNA, 25 bp, Mus musculus
catgatgaccgtggctgtgttcctc

SEQ ID NO: 579366 - DNA, 25 bp, Mus musculus
catgatgacctgcatctttccacca

SEQ ID NO: 579367 - DNA, 25 bp, Mus musculus
catgatgacctggatctttccacca

SEQ ID NO: 579368 - DNA, 25 bp, Mus musculus
catgatgacgtcacagatcccaaaa

SEQ ID NO: 579369 - DNA, 25 bp, Mus musculus
catgatgacgtctcagatcccaaaa

SEQ ID NO: 579370 - DNA, 25 bp, Mus musculus
catgatgactccctatgtggtgacg

SEQ ID NO: 579371 - DNA, 25 bp, Mus musculus
catgatgactccgtatgtggtgacg

SEQ ID NO: 579372 - DNA, 25 bp, Mus musculus
catgatgagcatacagagtgttaac

SEQ ID NO: 579373 - DNA, 25 bp, Mus musculus
catgatgagcattcagagtgttaac

SEQ ID NO: 579374 - DNA, 25 bp, Mus musculus
catgatgagctaatccgaaggatcc

SEQ ID NO: 579375 - DNA, 25 bp, Mus musculus
catgatgagctattccgaaggatcc

SEQ ID NO: 579376 - DNA, 25 bp, Mus musculus
catgatgagctgacaactctcggac

SEQ ID NO: 579377 - DNA, 25 bp, Mus musculus
catgatgagctgtcaactctcggac

SEQ ID NO: 579378 - DNA, 25 bp, Mus musculus
catgatgaggtgagctctaggtccc

SEQ ID NO: 579379 - DNA, 25 bp, Mus musculus
catgatgaggtgtgctctaggtccc

SEQ ID NO: 579380 - DNA, 25 bp, Mus musculus
catgatgagtgcagcaaaattcggg

SEQ ID NO: 579381 - DNA, 25 bp, Mus musculus
catgatgagtgctgcaaaattcggg

SEQ ID NO: 579382 - DNA, 25 bp, Mus musculus
catgatgatcatcggcaaaaagccc

SEQ ID NO: 579383 - DNA, 25 bp, Mus musculus
catgatgatcatgggcaaaaagccc

SEQ ID NO: 579384 - DNA, 25 bp, Mus musculus
catgatgattctcccgtgcaggcag

SEQ ID NO: 579385 - DNA, 25 bp, Mus musculus
catgatgattctgccgtgcaggcag

SEQ ID NO: 579386 - DNA, 25 bp, Mus musculus
catgatgcacccctggtacatacct

SEQ ID NO: 579387 - DNA, 25 bp, Mus musculus
catgatgcacccgtggtacatacct

SEQ ID NO: 579388 - DNA, 25 bp, Mus musculus
catgatgcagaacctctcggtgcag

SEQ ID NO: 579389 - DNA, 25 bp, Mus musculus
catgatgcagaagctctcggtgcag

SEQ ID NO: 579390 - DNA, 25 bp, Mus musculus
catgatgcggtcctgaggtttaatg

SEQ ID NO: 579391 - DNA, 25 bp, Mus musculus
catgatgcggtcgtgaggtttaatg

SEQ ID NO: 579392 - DNA, 25 bp, Mus musculus
catgatgctagacctagaccaggaa

SEQ ID NO: 579393 - DNA, 25 bp, Mus musculus
catgatgctagagctagaccaggaa

SEQ ID NO: 579394 - DNA, 25 bp, Mus musculus
catgatgctgccaaatggctatgtc

SEQ ID NO: 579395 - DNA, 25 bp, Mus musculus
catgatgctgcctaatggctatgtc

SEQ ID NO: 579396 - DNA, 25 bp, Mus musculus
catgatggaagacctgcctggcctg

SEQ ID NO: 579397 - DNA, 25 bp, Mus musculus
catgatggaagagctgcctggcctg

SEQ ID NO: 579398 - DNA, 25 bp, Mus musculus
catgatggacacatctacgccctga

SEQ ID NO: 579399 - DNA, 25 bp, Mus musculus
catgatggacacttctacgccctga

SEQ ID NO: 579400 - DNA, 25 bp, Mus musculus
catgatggacagagaggacagacgt

SEQ ID NO: 579401 - DNA, 25 bp, Mus musculus
catgatggacagtgaggacagacgt

SEQ ID NO: 579402 - DNA, 25 bp, Mus musculus
catgatggacccatgtgcgacctcc

SEQ ID NO: 579403 - DNA, 25 bp, Mus musculus
catgatggacccttgtgcgacctcc

SEQ ID NO: 579404 - DNA, 25 bp, Mus musculus
catgatggaccgcaacaaagcagct

SEQ ID NO: 579405 - DNA, 25 bp, Mus musculus
catgatggaccggaacaaagcagct

SEQ ID NO: 579406 - DNA, 25 bp, Mus musculus
catgatggatggaggcttcaccctg

SEQ ID NO: 579407 - DNA, 25 bp, Mus musculus
catgatggatggtggcttcaccctg

SEQ ID NO: 579408 - DNA, 25 bp, Mus musculus
catgatggcatccattctctccgca

SEQ ID NO: 579409 - DNA, 25 bp, Mus musculus
catgatggcatcgattctctccgca

SEQ ID NO: 579410 - DNA, 25 bp, Mus musculus
catgatggcgatacgggagctcaaa

SEQ ID NO: 579411 - DNA, 25 bp, Mus musculus
catgatggcgattcgggagctcaaa

SEQ ID NO: 579412 - DNA, 25 bp, Mus musculus
catgatggctatctcctacagcaag

SEQ ID NO: 579413 - DNA, 25 bp, Mus musculus
catgatggctatgtcctacagcaag

SEQ ID NO: 579414 - DNA, 25 bp, Mus musculus
catgatggctttcattgaacaagaa

SEQ ID NO: 579415 - DNA, 25 bp, Mus musculus
catgatggctttgattgaacaagaa

SEQ ID NO: 579416 - DNA, 25 bp, Mus musculus
catgatggtagtactgctgggtctc

SEQ ID NO: 579417 - DNA, 25 bp, Mus musculus
catgatggtagttctgctgggtctc

SEQ ID NO: 579418 - DNA, 25 bp, Mus musculus
catgatggtcatcgttggctatcca

SEQ ID NO: 579419 - DNA, 25 bp, Mus musculus
catgatggtcatggttggctatcca

SEQ ID NO: 579420 - DNA, 25 bp, Mus musculus
catgatggtctcactaactgataaa

SEQ ID NO: 579421 - DNA, 25 bp, Mus musculus
catgatggtctctctaactgataaa

SEQ ID NO: 579422 - DNA, 25 bp, Mus musculus
catgatggtgacaaaacaggagaac

SEQ ID NO: 579423 - DNA, 25 bp, Mus musculus
catgatggtgactaaacaggagaac

SEQ ID NO: 579424 - DNA, 25 bp, Mus musculus
catgatggtggtatacaggctaacc

SEQ ID NO: 579425 - DNA, 25 bp, Mus musculus
catgatggtggtttacaggctaacc

SEQ ID NO: 579426 - DNA, 25 bp, Mus musculus
catgatggtgttcggaactccgtca

SEQ ID NO: 579427 - DNA, 25 bp, Mus musculus
catgatggtgttgggaactccgtca

SEQ ID NO: 579428 - DNA, 25 bp, Mus musculus
catgatgtagacacactggtactga

SEQ ID NO: 579429 - DNA, 25 bp, Mus musculus
catgatgtagactcactggtactga

SEQ ID NO: 579430 - DNA, 25 bp, Mus musculus
catgatgtcaagaaactggccagca

SEQ ID NO: 579431 - DNA, 25 bp, Mus musculus
catgatgtcaagtaactggccagca

SEQ ID NO: 579432 - DNA, 25 bp, Mus musculus
catgatgtcacacctggtgaagatc

SEQ ID NO: 579433 - DNA, 25 bp, Mus musculus
catgatgtcacagctggtgaagatc

SEQ ID NO: 579434 - DNA, 25 bp, Mus musculus
catgatgtccgcagcaatgggagct

SEQ ID NO: 579435 - DNA, 25 bp, Mus musculus
catgatgtccgctgcaatgggagct

SEQ ID NO: 579436 - DNA, 25 bp, Mus musculus
catgatgtcttgaagaaagcgcgga

SEQ ID NO: 579437 - DNA, 25 bp, Mus musculus
catgatgtcttgtagaaagcgcgga

SEQ ID NO: 579438 - DNA, 25 bp, Mus musculus
catgatgtgttacagtgtgaatccc

SEQ ID NO: 579439 - DNA, 25 bp, Mus musculus
catgatgtgttagagtgtgaatccc

SEQ ID NO: 579440 - DNA, 25 bp, Mus musculus
catgatgttcagcactatgccgata

SEQ ID NO: 579441 - DNA, 25 bp, Mus musculus
catgatgttcaggactatgccgata

SEQ ID NO: 579442 - DNA, 25 bp, Mus musculus
catgatgttggaatctgttgcctgg

SEQ ID NO: 579443 - DNA, 25 bp, Mus musculus
catgatgttggattctgttgcctgg

SEQ ID NO: 579444 - DNA, 25 bp, Mus musculus
catgatgttggtcaaacagtcccga

SEQ ID NO: 579445 - DNA, 25 bp, Mus musculus
catgatgttggtgaaacagtcccga

SEQ ID NO: 579446 - DNA, 25 bp, Mus musculus
catgatgtttggctacctggcggac

SEQ ID NO: 579447 - DNA, 25 bp, Mus musculus
catgatgtttgggtacctggcggac

SEQ ID NO: 579448 - DNA, 25 bp, Mus musculus
catgattaatgacgtggatgctgat

SEQ ID NO: 579449 - DNA, 25 bp, Mus musculus
catgattaatgaggtggatgctgat

SEQ ID NO: 579450 - DNA, 25 bp, Mus musculus
catgattagaacacccagacccaga

SEQ ID NO: 579451 - DNA, 25 bp, Mus musculus
catgattagaactcccagacccaga

SEQ ID NO: 579452 - DNA, 25 bp, Mus musculus
catgattatactcagctgctggcac

SEQ ID NO: 579453 - DNA, 25 bp, Mus musculus
catgattatactgagctgctggcac

SEQ ID NO: 579454 - DNA, 25 bp, Mus musculus
catgattccataaggtatggaccgg

SEQ ID NO: 579455 - DNA, 25 bp, Mus musculus
catgattccatatggtatggaccgg

SEQ ID NO: 579456 - DNA, 25 bp, Mus musculus
catgattccttgcatcctgcagtac

SEQ ID NO: 579457 - DNA, 25 bp, Mus musculus
catgattccttggatcctgcagtac

SEQ ID NO: 579458 - DNA, 25 bp, Mus musculus
catgattcgagacagtgaaacaaag

SEQ ID NO: 579459 - DNA, 25 bp, Mus musculus
catgattcgagacgtggctggccaa

SEQ ID NO: 579460 - DNA, 25 bp, Mus musculus
catgattcgagagagtgaaacaaag

SEQ ID NO: 579461 - DNA, 25 bp, Mus musculus
catgattcgagaggtggctggccaa

SEQ ID NO: 579462 - DNA, 25 bp, Mus musculus
catgattcgttaacagctttcatca

SEQ ID NO: 579463 - DNA, 25 bp, Mus musculus
catgattcgttatcagctttcatca

SEQ ID NO: 579464 - DNA, 25 bp, Mus musculus
catgattcttggacatcttttcagc

SEQ ID NO: 579465 - DNA, 25 bp, Mus musculus
catgattcttggtcatcttttcagc

SEQ ID NO: 579466 - DNA, 25 bp, Mus musculus
catgattgaccgctttgatgttcgt

SEQ ID NO: 579467 - DNA, 25 bp, Mus musculus
catgattgaccggtttgatgttcgt

SEQ ID NO: 579468 - DNA, 25 bp, Mus musculus
catgattgaggcagcccggtattat

SEQ ID NO: 579469 - DNA, 25 bp, Mus musculus
catgattgaggctgcccggtattat

SEQ ID NO: 579470 - DNA, 25 bp, Mus musculus
catgattgcagccaagatggagact

SEQ ID NO: 579471 - DNA, 25 bp, Mus musculus
catgattgcagcgaagatggagact

SEQ ID NO: 579472 - DNA, 25 bp, Mus musculus
catgattgcatcagagacctgggcc

SEQ ID NO: 579473 - DNA, 25 bp, Mus musculus
catgattgcatctgagacctgggcc

SEQ ID NO: 579474 - DNA, 25 bp, Mus musculus
catgattgggctcatgctgggatcc

SEQ ID NO: 579475 - DNA, 25 bp, Mus musculus
catgattgggctgatgctgggatcc

SEQ ID NO: 579476 - DNA, 25 bp, Mus musculus
catgattggtgaagaggtgccgcct

SEQ ID NO: 579477 - DNA, 25 bp, Mus musculus
catgattggtgatgaggtgccgcct

SEQ ID NO: 579478 - DNA, 25 bp, Mus musculus
catgattgtgaactttgctccaccc

SEQ ID NO: 579479 - DNA, 25 bp, Mus musculus
catgattgtgaagtttgctccaccc

SEQ ID NO: 579480 - DNA, 25 bp, Mus musculus
catgattgtgagcagggccatcaag

SEQ ID NO: 579481 - DNA, 25 bp, Mus musculus
catgattgtgaggagggccatcaag

SEQ ID NO: 579482 - DNA, 25 bp, Mus musculus
catgattgtgcccaagcagcggaaa

SEQ ID NO: 579483 - DNA, 25 bp, Mus musculus
catgattgtgccgaagcagcggaaa

SEQ ID NO: 579484 - DNA, 25 bp, Mus musculus
catgatttccagctatgggcttgta

SEQ ID NO: 579485 - DNA, 25 bp, Mus musculus
catgatttccaggtatgggcttgta

SEQ ID NO: 579486 - DNA, 25 bp, Mus musculus
catgatttggagagagggccagcac

SEQ ID NO: 579487 - DNA, 25 bp, Mus musculus
catgatttggagtgagggccagcac

SEQ ID NO: 579488 - DNA, 25 bp, Mus musculus
catgattttcaaccacttgctctgg

SEQ ID NO: 579489 - DNA, 25 bp, Mus musculus
catgattttcaacctcttgcattag

SEQ ID NO: 579490 - DNA, 25 bp, Mus musculus
catgattttcaagcacttgctctgg

SEQ ID NO: 579491 - DNA, 25 bp, Mus musculus
catgattttcaagctcttgcattag

SEQ ID NO: 579492 - DNA, 25 bp, Mus musculus
catgattttcacctcacagtagaag

SEQ ID NO: 579493 - DNA, 25 bp, Mus musculus
catgattttcacgtcacagtagaag

SEQ ID NO: 579494 - DNA, 25 bp, Mus musculus
catgcaaaaaatcttcgcccgggaa

SEQ ID NO: 579495 - DNA, 25 bp, Mus musculus
catgcaaaaaatgttcgcccgggaa

SEQ ID NO: 579496 - DNA, 25 bp, Mus musculus
catgcaaaacaccttaacaagattt

SEQ ID NO: 579497 - DNA, 25 bp, Mus musculus
catgcaaaacacgttaacaagattt

SEQ ID NO: 579498 - DNA, 25 bp, Mus musculus
catgcaaacatcagagccaggccct

SEQ ID NO: 579499 - DNA, 25 bp, Mus musculus
catgcaaacatctgagccaggccct

SEQ ID NO: 579500 - DNA, 25 bp, Mus musculus
catgcaaactctcacagcaatgtga

SEQ ID NO: 579501 - DNA, 25 bp, Mus musculus
catgcaaactctgacagcaatgtga

SEQ ID NO: 579502 - DNA, 25 bp, Mus musculus
catgcaaactgcattgttcaccggg

SEQ ID NO: 579503 - DNA, 25 bp, Mus musculus
catgcaaactgctttgttcaccggg

SEQ ID NO: 579504 - DNA, 25 bp, Mus musculus
catgcaacaggcagtattccaaggt

SEQ ID NO: 579505 - DNA, 25 bp, Mus musculus
catgcaacaggctgtattccaaggt

SEQ ID NO: 579506 - DNA, 25 bp, Mus musculus
catgcaacgactaccatgggcttgt

SEQ ID NO: 579507 - DNA, 25 bp, Mus musculus
catgcaacgacttccatgggcttgt

SEQ ID NO: 579508 - DNA, 25 bp, Mus musculus
catgcaagaaagcacttcagtcagg

SEQ ID NO: 579509 - DNA, 25 bp, Mus musculus
catgcaagaaaggacttcagtcagg

SEQ ID NO: 579510 - DNA, 25 bp, Mus musculus
catgcaagaacgctgccaagtgcct

SEQ ID NO: 579511 - DNA, 25 bp, Mus musculus
catgcaagaacggtgccaagtgcct

SEQ ID NO: 579512 - DNA, 25 bp, Mus musculus
catgcaagagaactataccaagcca

SEQ ID NO: 579513 - DNA, 25 bp, Mus musculus
catgcaagagaagtataccaagcca

SEQ ID NO: 579514 - DNA, 25 bp, Mus musculus
catgcaagaggtagttctgagcctg

SEQ ID NO: 579515 - DNA, 25 bp, Mus musculus
catgcaagaggttgttctgagcctg

SEQ ID NO: 579516 - DNA, 25 bp, Mus musculus
catgcaaggagcctacttgccacag

SEQ ID NO: 579517 - DNA, 25 bp, Mus musculus
catgcaaggagcgtacttgccacag

SEQ ID NO: 579518 - DNA, 25 bp, Mus musculus
catgcaatcaaaagcgactctgcag

SEQ ID NO: 579519 - DNA, 25 bp, Mus musculus
catgcaatcaaatgcgactctgcag

SEQ ID NO: 579520 - DNA, 25 bp, Mus musculus
catgcaatctgaatctcaggaggca

SEQ ID NO: 579521 - DNA, 25 bp, Mus musculus
catgcaatctgattctcaggaggca

SEQ ID NO: 579522 - DNA, 25 bp, Mus musculus
catgcaatgaaactgtggtcatccc

SEQ ID NO: 579523 - DNA, 25 bp, Mus musculus
catgcaatgaaagtgtggtcatccc

SEQ ID NO: 579524 - DNA, 25 bp, Mus musculus
catgcaatgccacttggaagacctg

SEQ ID NO: 579525 - DNA, 25 bp, Mus musculus
catgcaatgccagttggaagacctg

SEQ ID NO: 579526 - DNA, 25 bp, Mus musculus
catgcaattatgatggccctgtcac

SEQ ID NO: 579527 - DNA, 25 bp, Mus musculus
catgcaattatgttggccctgtcac

SEQ ID NO: 579528 - DNA, 25 bp, Mus musculus
catgcacaacatagcagagaagaaa

SEQ ID NO: 579529 - DNA, 25 bp, Mus musculus
catgcacaacattgcagagaagaaa

SEQ ID NO: 579530 - DNA, 25 bp, Mus musculus
catgcacaagtacctttggtggaag

SEQ ID NO: 579531 - DNA, 25 bp, Mus musculus
catgcacaagtagctttggtggaag

SEQ ID NO: 579532 - DNA, 25 bp, Mus musculus
catgcacaagtgaaatgaaaagaca

SEQ ID NO: 579533 - DNA, 25 bp, Mus musculus
catgcacaagtgtaatgaaaagaca

SEQ ID NO: 579534 - DNA, 25 bp, Mus musculus
catgcacagaaacagcttcagaagt

SEQ ID NO: 579535 - DNA, 25 bp, Mus musculus
catgcacagaaagagcttcagaagt

SEQ ID NO: 579536 - DNA, 25 bp, Mus musculus
catgcaccccctctgttgcgggaaa

SEQ ID NO: 579537 - DNA, 25 bp, Mus musculus
catgcaccccctgtgttgcgggaaa

SEQ ID NO: 579538 - DNA, 25 bp, Mus musculus
catgcacccctgatagtctgtatac

SEQ ID NO: 579539 - DNA, 25 bp, Mus musculus
catgcacccctgttagtctgtatac

SEQ ID NO: 579540 - DNA, 25 bp, Mus musculus
catgcacccgcacctgctcgagctg

SEQ ID NO: 579541 - DNA, 25 bp, Mus musculus
catgcacccgcagctgctcgagctg

SEQ ID NO: 579542 - DNA, 25 bp, Mus musculus
catgcaccgctaatcatcgatgaga

SEQ ID NO: 579543 - DNA, 25 bp, Mus musculus
catgcaccgctattcatcgatgaga

SEQ ID NO: 579544 - DNA, 25 bp, Mus musculus
catgcacctcttatcacaagtcagg

SEQ ID NO: 579545 - DNA, 25 bp, Mus musculus
catgcacctcttttcacaagtcagg

SEQ ID NO: 579546 - DNA, 25 bp, Mus musculus
catgcacctggtaacatccctggca

SEQ ID NO: 579547 - DNA, 25 bp, Mus musculus
catgcacctggttacatccctggca

SEQ ID NO: 579548 - DNA, 25 bp, Mus musculus
catgcacctgtgacggacatggtca

SEQ ID NO: 579549 - DNA, 25 bp, Mus musculus
catgcacctgtgtcggacatggtca

SEQ ID NO: 579550 - DNA, 25 bp, Mus musculus
catgcaccttggcaagaaaacggac

SEQ ID NO: 579551 - DNA, 25 bp, Mus musculus
catgcaccttgggaagaaaacggac

SEQ ID NO: 579552 - DNA, 25 bp, Mus musculus
catgcacctttactggaatttgagg

SEQ ID NO: 579553 - DNA, 25 bp, Mus musculus
catgcacctttagtggaatttgagg

SEQ ID NO: 579554 - DNA, 25 bp, Mus musculus
catgcacgccgtcggcacttcgggt

SEQ ID NO: 579555 - DNA, 25 bp, Mus musculus
catgcacgccgtgggcacttcgggt

SEQ ID NO: 579556 - DNA, 25 bp, Mus musculus
catgcactaggactgctctatcacc

SEQ ID NO: 579557 - DNA, 25 bp, Mus musculus
catgcactaggagtgctctatcacc

SEQ ID NO: 579558 - DNA, 25 bp, Mus musculus
catgcactctgtatgcgaagaggaa

SEQ ID NO: 579559 - DNA, 25 bp, Mus musculus
catgcactctgtttgcgaagaggaa

SEQ ID NO: 579560 - DNA, 25 bp, Mus musculus
catgcactgacgaagagatcacagt

SEQ ID NO: 579561 - DNA, 25 bp, Mus musculus
catgcactgacgtagagatcacagt

SEQ ID NO: 579562 - DNA, 25 bp, Mus musculus
catgcactgggcatagatcattcca

SEQ ID NO: 579563 - DNA, 25 bp, Mus musculus
catgcactgggcttagatcattcca

SEQ ID NO: 579564 - DNA, 25 bp, Mus musculus
catgcactgtgaccacacggtgggt

SEQ ID NO: 579565 - DNA, 25 bp, Mus musculus
catgcactgtgagcacacggtgggt

SEQ ID NO: 579566 - DNA, 25 bp, Mus musculus
catgcacttgaacgtgggcgtccca

SEQ ID NO: 579567 - DNA, 25 bp, Mus musculus
catgcacttgaaggtgggcgtccca

SEQ ID NO: 579568 - DNA, 25 bp, Mus musculus
catgcactttagaaatgaacgcaca

SEQ ID NO: 579569 - DNA, 25 bp, Mus musculus
catgcactttagtaatgaacgcaca

SEQ ID NO: 579570 - DNA, 25 bp, Mus musculus
catgcactttggaggctcagaaaat

SEQ ID NO: 579571 - DNA, 25 bp, Mus musculus
catgcactttggtggctcagaaaat

SEQ ID NO: 579572 - DNA, 25 bp, Mus musculus
catgcagaactacaatggcaatgat

SEQ ID NO: 579573 - DNA, 25 bp, Mus musculus
catgcagaactagaatggcaatgat

SEQ ID NO: 579574 - DNA, 25 bp, Mus musculus
catgcagaagaaccctgggtccacc

SEQ ID NO: 579575 - DNA, 25 bp, Mus musculus
catgcagaagaagcctgggtccacc

SEQ ID NO: 579576 - DNA, 25 bp, Mus musculus
catgcagaagccaacacagtctatg

SEQ ID NO: 579577 - DNA, 25 bp, Mus musculus
catgcagaagcctacacagtctatg

SEQ ID NO: 579578 - DNA, 25 bp, Mus musculus
catgcagaagctcactcatggtgtc

SEQ ID NO: 579579 - DNA, 25 bp, Mus musculus
catgcagaagctgactcatggtgtc

SEQ ID NO: 579580 - DNA, 25 bp, Mus musculus
catgcagaatacctcgaaccgggtg

SEQ ID NO: 579581 - DNA, 25 bp, Mus musculus
catgcagaatacgtcgaaccgggtg

SEQ ID NO: 579582 - DNA, 25 bp, Mus musculus
catgcagactccatgcttcacactg

SEQ ID NO: 579583 - DNA, 25 bp, Mus musculus
catgcagactccttgcttcacactg

SEQ ID NO: 579584 - DNA, 25 bp, Mus musculus
catgcagagaacatccactcagaga

SEQ ID NO: 579585 - DNA, 25 bp, Mus musculus
catgcagagaacttccactcagaga

SEQ ID NO: 579586 - DNA, 25 bp, Mus musculus
catgcagagcaccatcagggaggaa

SEQ ID NO: 579587 - DNA, 25 bp, Mus musculus
catgcagagcacgatcagggaggaa

SEQ ID NO: 579588 - DNA, 25 bp, Mus musculus
catgcagatgcaaaagtccaggtgc

SEQ ID NO: 579589 - DNA, 25 bp, Mus musculus
catgcagatgcataagtccaggtgc

SEQ ID NO: 579590 - DNA, 25 bp, Mus musculus
catgcagatgctccctaaggagaag

SEQ ID NO: 579591 - DNA, 25 bp, Mus musculus
catgcagatgctgcctaaggagaag

SEQ ID NO: 579592 - DNA, 25 bp, Mus musculus
catgcagatgtcaacccttttcaga

SEQ ID NO: 579593 - DNA, 25 bp, Mus musculus
catgcagatgtctacccttttcaga

SEQ ID NO: 579594 - DNA, 25 bp, Mus musculus
catgcagcaccacaccaggcggtgg

SEQ ID NO: 579595 - DNA, 25 bp, Mus musculus
catgcagcaccagaccaggcggtgg

SEQ ID NO: 579596 - DNA, 25 bp, Mus musculus
catgcagcagataggtgtcttttac

SEQ ID NO: 579597 - DNA, 25 bp, Mus musculus
catgcagcagattggtgtcttttac

SEQ ID NO: 579598 - DNA, 25 bp, Mus musculus
catgcagcagggactatgctaccgg

SEQ ID NO: 579599 - DNA, 25 bp, Mus musculus
catgcagcagggtctatgctaccgg

SEQ ID NO: 579600 - DNA, 25 bp, Mus musculus
catgcagcagttactgcagatgctc

SEQ ID NO: 579601 - DNA, 25 bp, Mus musculus
catgcagcagtttctgcagatgctc

SEQ ID NO: 579602 - DNA, 25 bp, Mus musculus
catgcagcatcgcttccttggttta

SEQ ID NO: 579603 - DNA, 25 bp, Mus musculus
catgcagcatcggttccttggttta

SEQ ID NO: 579604 - DNA, 25 bp, Mus musculus
catgcagcatgtatgaaatgtgcgg

SEQ ID NO: 579605 - DNA, 25 bp, Mus musculus
catgcagcatgtttgaaatgtgcgg

SEQ ID NO: 579606 - DNA, 25 bp, Mus musculus
catgcagcctacatggtggacagct

SEQ ID NO: 579607 - DNA, 25 bp, Mus musculus
catgcagcctacttggtggacagct

SEQ ID NO: 579608 - DNA, 25 bp, Mus musculus
catgcagcctatagaaaatacacag

SEQ ID NO: 579609 - DNA, 25 bp, Mus musculus
catgcagcctattgaaaatacacag

SEQ ID NO: 579610 - DNA, 25 bp, Mus musculus
catgcagcgccactacatggagcgg

SEQ ID NO: 579611 - DNA, 25 bp, Mus musculus
catgcagcgccagtacatggagcgg

SEQ ID NO: 579612 - DNA, 25 bp, Mus musculus
catgcagctatacccgggctggtcc

SEQ ID NO: 579613 - DNA, 25 bp, Mus musculus
catgcagctatagccgggctggtcc

SEQ ID NO: 579614 - DNA, 25 bp, Mus musculus
catgcagctgaaagacaaatggcag

SEQ ID NO: 579615 - DNA, 25 bp, Mus musculus
catgcagctgaatgacaaatggcag

SEQ ID NO: 579616 - DNA, 25 bp, Mus musculus
catgcagctgcgcaagatcagggac

SEQ ID NO: 579617 - DNA, 25 bp, Mus musculus
catgcagctgcggaagatcagggac

SEQ ID NO: 579618 - DNA, 25 bp, Mus musculus
catgcagctggtaaccgaaatgggc

SEQ ID NO: 579619 - DNA, 25 bp, Mus musculus
catgcagctggttaccgaaatgggc

SEQ ID NO: 579620 - DNA, 25 bp, Mus musculus
catgcaggaattagaaagtgacacg

SEQ ID NO: 579621 - DNA, 25 bp, Mus musculus
catgcaggaatttgaaagtgacacg

SEQ ID NO: 579622 - DNA, 25 bp, Mus musculus
catgcaggatcgagtgtgacaggaa

SEQ ID NO: 579623 - DNA, 25 bp, Mus musculus
catgcaggatcgtgtgtgacaggaa

SEQ ID NO: 579624 - DNA, 25 bp, Mus musculus
catgcaggcattcccacccaggtgg

SEQ ID NO: 579625 - DNA, 25 bp, Mus musculus
catgcaggcattgccacccaggtgg

SEQ ID NO: 579626 - DNA, 25 bp, Mus musculus
catgcaggccaacattgagcagttc

SEQ ID NO: 579627 - DNA, 25 bp, Mus musculus
catgcaggccaagattgagcagttc

SEQ ID NO: 579628 - DNA, 25 bp, Mus musculus
catgcaggcccaactgtcgagggtt

SEQ ID NO: 579629 - DNA, 25 bp, Mus musculus
catgcaggcccatctgtcgagggtt

SEQ ID NO: 579630 - DNA, 25 bp, Mus musculus
catgcaggcccgaggttatggttac

SEQ ID NO: 579631 - DNA, 25 bp, Mus musculus
catgcaggcccgctttgtgatcctg

SEQ ID NO: 579632 - DNA, 25 bp, Mus musculus
catgcaggcccggtttgtgatcctg

SEQ ID NO: 579633 - DNA, 25 bp, Mus musculus
catgcaggcccgtggttatggttac

SEQ ID NO: 579634 - DNA, 25 bp, Mus musculus
catgcaggccggctttatggcagtt

SEQ ID NO: 579635 - DNA, 25 bp, Mus musculus
catgcaggccgggtttatggcagtt

SEQ ID NO: 579636 - DNA, 25 bp, Mus musculus
catgcagggcctctgcctgctcagg

SEQ ID NO: 579637 - DNA, 25 bp, Mus musculus
catgcagggcctgtgcctgctcagg

SEQ ID NO: 579638 - DNA, 25 bp, Mus musculus
catgcaggtgccatactgaggtctg

SEQ ID NO: 579639 - DNA, 25 bp, Mus musculus
catgcaggtgccttactgaggtctg

SEQ ID NO: 579640 - DNA, 25 bp, Mus musculus
catgcaggttcaactgagcagcgga

SEQ ID NO: 579641 - DNA, 25 bp, Mus musculus
catgcaggttcatctgagcagcgga

SEQ ID NO: 579642 - DNA, 25 bp, Mus musculus
catgcaggtttcaaagtatggtgac

SEQ ID NO: 579643 - DNA, 25 bp, Mus musculus
catgcaggtttctaagtatggtgac

SEQ ID NO: 579644 - DNA, 25 bp, Mus musculus
catgcaggttttaagaaactccggg

SEQ ID NO: 579645 - DNA, 25 bp, Mus musculus
catgcaggttttcaatgctgatgcc

SEQ ID NO: 579646 - DNA, 25 bp, Mus musculus
catgcaggttttgaatgctgatgcc

SEQ ID NO: 579647 - DNA, 25 bp, Mus musculus
catgcaggtttttagaaactccggg

SEQ ID NO: 579648 - DNA, 25 bp, Mus musculus
catgcagtacataggagaaggtgcg

SEQ ID NO: 579649 - DNA, 25 bp, Mus musculus
catgcagtacattggagaaggtgcg

SEQ ID NO: 579650 - DNA, 25 bp, Mus musculus
catgcagtactacgccagcatctac

SEQ ID NO: 579651 - DNA, 25 bp, Mus musculus
catgcagtactaggccagcatctac

SEQ ID NO: 579652 - DNA, 25 bp, Mus musculus
catgcagtacttctccagctttgcc

SEQ ID NO: 579653 - DNA, 25 bp, Mus musculus
catgcagtacttgtccagctttgcc

SEQ ID NO: 579654 - DNA, 25 bp, Mus musculus
catgcagtatctcgagtctcggaag

SEQ ID NO: 579655 - DNA, 25 bp, Mus musculus
catgcagtatctggagtctcggaag

SEQ ID NO: 579656 - DNA, 25 bp, Mus musculus
catgcagtatgaattgaatcggaac

SEQ ID NO: 579657 - DNA, 25 bp, Mus musculus
catgcagtatgatttgaatcggaac

SEQ ID NO: 579658 - DNA, 25 bp, Mus musculus
catgcagtcagtagcaagcagagaa

SEQ ID NO: 579659 - DNA, 25 bp, Mus musculus
catgcagtcagttgcaagcagagaa

SEQ ID NO: 579660 - DNA, 25 bp, Mus musculus
catgcagtgcctaccgtgggagcca

SEQ ID NO: 579661 - DNA, 25 bp, Mus musculus
catgcagtgccttccgtgggagcca

SEQ ID NO: 579662 - DNA, 25 bp, Mus musculus
catgcagtggttctactttgatgct

SEQ ID NO: 579663 - DNA, 25 bp, Mus musculus
catgcagtggttgtactttgatgct

SEQ ID NO: 579664 - DNA, 25 bp, Mus musculus
catgcagtgtgcaaggaaaatactt

SEQ ID NO: 579665 - DNA, 25 bp, Mus musculus
catgcagtgtgctaggaaaatactt

SEQ ID NO: 579666 - DNA, 25 bp, Mus musculus
catgcagtgtgtaccgagcgggctt

SEQ ID NO: 579667 - DNA, 25 bp, Mus musculus
catgcagtgtgttccgagcgggctt

SEQ ID NO: 579668 - DNA, 25 bp, Mus musculus
catgcagttcagcagacagtgactc

SEQ ID NO: 579669 - DNA, 25 bp, Mus musculus
catgcagttcaggagacagtgactc

SEQ ID NO: 579670 - DNA, 25 bp, Mus musculus
catgcagttgctctcatttgggctt

SEQ ID NO: 579671 - DNA, 25 bp, Mus musculus
catgcagttgctgtcatttgggctt

SEQ ID NO: 579672 - DNA, 25 bp, Mus musculus
catgcagtttctctacacagacaag

SEQ ID NO: 579673 - DNA, 25 bp, Mus musculus
catgcagtttctgtacacagacaag

SEQ ID NO: 579674 - DNA, 25 bp, Mus musculus
catgcatacattcggtatggtgtga

SEQ ID NO: 579675 - DNA, 25 bp, Mus musculus
catgcatacattgggtatggtgtga

SEQ ID NO: 579676 - DNA, 25 bp, Mus musculus
catgcatacctgcacaacatgaaag

SEQ ID NO: 579677 - DNA, 25 bp, Mus musculus
catgcatacctggacaacatgaaag

SEQ ID NO: 579678 - DNA, 25 bp, Mus musculus
catgcatagctaccaataagcacgg

SEQ ID NO: 579679 - DNA, 25 bp, Mus musculus
catgcatagctagcaataagcacgg

SEQ ID NO: 579680 - DNA, 25 bp, Mus musculus
catgcatatcttaaggaatggttgt

SEQ ID NO: 579681 - DNA, 25 bp, Mus musculus
catgcatatctttaggaatggttgt

SEQ ID NO: 579682 - DNA, 25 bp, Mus musculus
catgcatcagctcttctctctggtg

SEQ ID NO: 579683 - DNA, 25 bp, Mus musculus
catgcatcagctgttctctctggtg

SEQ ID NO: 579684 - DNA, 25 bp, Mus musculus
catgcatcccttctataaataaagc

SEQ ID NO: 579685 - DNA, 25 bp, Mus musculus
catgcatcccttgtataaataaagc

SEQ ID NO: 579686 - DNA, 25 bp, Mus musculus
catgcatcgttgcagaggaacccct

SEQ ID NO: 579687 - DNA, 25 bp, Mus musculus
catgcatcgttggagaggaacccct

SEQ ID NO: 579688 - DNA, 25 bp, Mus musculus
catgcatctgctcgtgggtcgatac

SEQ ID NO: 579689 - DNA, 25 bp, Mus musculus
catgcatctgctggtgggtcgatac

SEQ ID NO: 579690 - DNA, 25 bp, Mus musculus
catgcatgaaaaagttctcaagtgt

SEQ ID NO: 579691 - DNA, 25 bp, Mus musculus
catgcatgaaaatgttctcaagtgt

SEQ ID NO: 579692 - DNA, 25 bp, Mus musculus
catgcatgatggcaacgtcatcact

SEQ ID NO: 579693 - DNA, 25 bp, Mus musculus
catgcatgatgggaacgtcatcact

SEQ ID NO: 579694 - DNA, 25 bp, Mus musculus
catgcatgcatcacccagggcaagt

SEQ ID NO: 579695 - DNA, 25 bp, Mus musculus
catgcatgcatctcccagggcaagt

SEQ ID NO: 579696 - DNA, 25 bp, Mus musculus
catgcatgctgtcaaggaagtgttc

SEQ ID NO: 579697 - DNA, 25 bp, Mus musculus
catgcatgctgtgaaggaagtgttc

SEQ ID NO: 579698 - DNA, 25 bp, Mus musculus
catgcatggcccacaggatgaggag

SEQ ID NO: 579699 - DNA, 25 bp, Mus musculus
catgcatggccctcaggatgaggag

SEQ ID NO: 579700 - DNA, 25 bp, Mus musculus
catgcatggccgagaagctgaacct

SEQ ID NO: 579701 - DNA, 25 bp, Mus musculus
catgcatggccgtgaagctgaacct

SEQ ID NO: 579702 - DNA, 25 bp, Mus musculus
catgcatggcgtctaatgagcagga

SEQ ID NO: 579703 - DNA, 25 bp, Mus musculus
catgcatggcgtgtaatgagcagga

SEQ ID NO: 579704 - DNA, 25 bp, Mus musculus
catgcatggcttaagatgaaaagtc

SEQ ID NO: 579705 - DNA, 25 bp, Mus musculus
catgcatggctttagatgaaaagtc

SEQ ID NO: 579706 - DNA, 25 bp, Mus musculus
catgcatgggttatctacatctcag

SEQ ID NO: 579707 - DNA, 25 bp, Mus musculus
catgcatgggttttctacatctcag

SEQ ID NO: 579708 - DNA, 25 bp, Mus musculus
catgcatgttaaaagactcctgaat

SEQ ID NO: 579709 - DNA, 25 bp, Mus musculus
catgcatgttaatagactcctgaat

SEQ ID NO: 579710 - DNA, 25 bp, Mus musculus
catgcattatatctggacagcccca

SEQ ID NO: 579711 - DNA, 25 bp, Mus musculus
catgcattatatgtggacagcccca

SEQ ID NO: 579712 - DNA, 25 bp, Mus musculus
catgcattgatacagattttagacc

SEQ ID NO: 579713 - DNA, 25 bp, Mus musculus
catgcattgatagagattttagacc

SEQ ID NO: 579714 - DNA, 25 bp, Mus musculus
catgccaaaagacagcgtggagttt

SEQ ID NO: 579715 - DNA, 25 bp, Mus musculus
catgccaaaagagagcgtggagttt

SEQ ID NO: 579716 - DNA, 25 bp, Mus musculus
catgccaaagaacccggatggacaa

SEQ ID NO: 579717 - DNA, 25 bp, Mus musculus
catgccaaagaagccggatggacaa

SEQ ID NO: 579718 - DNA, 25 bp, Mus musculus
catgccaacgtgctggtttacagct

SEQ ID NO: 579719 - DNA, 25 bp, Mus musculus
catgccaacgtggtggtttacagct

SEQ ID NO: 579720 - DNA, 25 bp, Mus musculus
catgccaagaaacaagctgcccaga

SEQ ID NO: 579721 - DNA, 25 bp, Mus musculus
catgccaagaaagaagctgcccaga

SEQ ID NO: 579722 - DNA, 25 bp, Mus musculus
catgccaagtggatcttttccagag

SEQ ID NO: 579723 - DNA, 25 bp, Mus musculus
catgccaagtggttcttttccagag

SEQ ID NO: 579724 - DNA, 25 bp, Mus musculus
catgccaatactacttggaccaaga

SEQ ID NO: 579725 - DNA, 25 bp, Mus musculus
catgccaatacttcttggaccaaga

SEQ ID NO: 579726 - DNA, 25 bp, Mus musculus
catgccaatgcgcttttggatgacc

SEQ ID NO: 579727 - DNA, 25 bp, Mus musculus
catgccaatgcggttttggatgacc

SEQ ID NO: 579728 - DNA, 25 bp, Mus musculus
catgccaatttgaaggtaaacgtgg

SEQ ID NO: 579729 - DNA, 25 bp, Mus musculus
catgccaatttgtaggtaaacgtgg

SEQ ID NO: 579730 - DNA, 25 bp, Mus musculus
catgccacaagccacactttgctgg

SEQ ID NO: 579731 - DNA, 25 bp, Mus musculus
catgccacaagcgacactttgctgg

SEQ ID NO: 579732 - DNA, 25 bp, Mus musculus
catgccaccacccatcaggaaaata

SEQ ID NO: 579733 - DNA, 25 bp, Mus musculus
catgccaccaccgatcaggaaaata

SEQ ID NO: 579734 - DNA, 25 bp, Mus musculus
catgccacctccagttagcatggca

SEQ ID NO: 579735 - DNA, 25 bp, Mus musculus
catgccacctcctgttagcatggca

SEQ ID NO: 579736 - DNA, 25 bp, Mus musculus
catgccactcaaatcacgaggaccg

SEQ ID NO: 579737 - DNA, 25 bp, Mus musculus
catgccactcaattcacgaggaccg

SEQ ID NO: 579738 - DNA, 25 bp, Mus musculus
catgccactgcaaatgttttctcaa

SEQ ID NO: 579739 - DNA, 25 bp, Mus musculus
catgccactgcatatgttttctcaa

SEQ ID NO: 579740 - DNA, 25 bp, Mus musculus
catgccagggcacctgctgcaagaa

SEQ ID NO: 579741 - DNA, 25 bp, Mus musculus
catgccagggcagctgctgcaagaa

SEQ ID NO: 579742 - DNA, 25 bp, Mus musculus
catgccatggctctgtatgaccgtg

SEQ ID NO: 579743 - DNA, 25 bp, Mus musculus
catgccatggctgtgtatgaccgtg

SEQ ID NO: 579744 - DNA, 25 bp, Mus musculus
catgccattcgcctgttcctggaat

SEQ ID NO: 579745 - DNA, 25 bp, Mus musculus
catgccattcgcgtgttcctggaat

SEQ ID NO: 579746 - DNA, 25 bp, Mus musculus
catgccattgctcgtgttggacatt

SEQ ID NO: 579747 - DNA, 25 bp, Mus musculus
catgccattgctggtgttggacatt

SEQ ID NO: 579748 - DNA, 25 bp, Mus musculus
catgccattgtaagataggttctct

SEQ ID NO: 579749 - DNA, 25 bp, Mus musculus
catgccattgtatgataggttctct

SEQ ID NO: 579750 - DNA, 25 bp, Mus musculus
catgccattgtcaccaggacaaaca

SEQ ID NO: 579751 - DNA, 25 bp, Mus musculus
catgccattgtctccaggacaaaca

SEQ ID NO: 579752 - DNA, 25 bp, Mus musculus
catgcccaaggtactgcagtggcta

SEQ ID NO: 579753 - DNA, 25 bp, Mus musculus
catgcccaaggttctgcagtggcta

SEQ ID NO: 579754 - DNA, 25 bp, Mus musculus
catgcccagtgcctatgatgtacca

SEQ ID NO: 579755 - DNA, 25 bp, Mus musculus
catgcccagtgcgtatgatgtacca

SEQ ID NO: 579756 - DNA, 25 bp, Mus musculus
catgcccatacgcattgaaaaccca

SEQ ID NO: 579757 - DNA, 25 bp, Mus musculus
catgcccatacggattgaaaaccca

SEQ ID NO: 579758 - DNA, 25 bp, Mus musculus
catgcccatggtctctggagcacca

SEQ ID NO: 579759 - DNA, 25 bp, Mus musculus
catgcccatggtgtctggagcacca

SEQ ID NO: 579760 - DNA, 25 bp, Mus musculus
catgccccagcaccgaaggactggg

SEQ ID NO: 579761 - DNA, 25 bp, Mus musculus
catgccccagcagcgaaggactggg

SEQ ID NO: 579762 - DNA, 25 bp, Mus musculus
catgcccctagtatcgacatcacta

SEQ ID NO: 579763 - DNA, 25 bp, Mus musculus
catgcccctagtttcgacatcacta

SEQ ID NO: 579764 - DNA, 25 bp, Mus musculus
catgcccctattccaaagacagtga

SEQ ID NO: 579765 - DNA, 25 bp, Mus musculus
catgcccctattgcaaagacagtga

SEQ ID NO: 579766 - DNA, 25 bp, Mus musculus
catgcccgagacacgctctacgtgg

SEQ ID NO: 579767 - DNA, 25 bp, Mus musculus
catgcccgagactcgctctacgtgg

SEQ ID NO: 579768 - DNA, 25 bp, Mus musculus
catgcccgcctcattgtagttttta

SEQ ID NO: 579769 - DNA, 25 bp, Mus musculus
catgcccgcctctttgtagttttta

SEQ ID NO: 579770 - DNA, 25 bp, Mus musculus
catgcccggaaaagctcggttcgaa

SEQ ID NO: 579771 - DNA, 25 bp, Mus musculus
catgcccggaaatgctcggttcgaa

SEQ ID NO: 579772 - DNA, 25 bp, Mus musculus
catgccctcatgaactggactctgg

SEQ ID NO: 579773 - DNA, 25 bp, Mus musculus
catgccctcatgtactggactctgg

SEQ ID NO: 579774 - DNA, 25 bp, Mus musculus
catgccctgaacaatgtcaacaagg

SEQ ID NO: 579775 - DNA, 25 bp, Mus musculus
catgccctgaactatgtcaacaagg

SEQ ID NO: 579776 - DNA, 25 bp, Mus musculus
catgccctggctagtttaaacccct

SEQ ID NO: 579777 - DNA, 25 bp, Mus musculus
catgccctggcttgtttaaacccct

SEQ ID NO: 579778 - DNA, 25 bp, Mus musculus
catgcccttacactaaattcagagg

SEQ ID NO: 579779 - DNA, 25 bp, Mus musculus
catgcccttacagtaaattcagagg

SEQ ID NO: 579780 - DNA, 25 bp, Mus musculus
catgccctttgacatccgtttgcca

SEQ ID NO: 579781 - DNA, 25 bp, Mus musculus
catgccctttgagatccgtttgcca

SEQ ID NO: 579782 - DNA, 25 bp, Mus musculus
catgccgaagccacgattgttgtca

SEQ ID NO: 579783 - DNA, 25 bp, Mus musculus
catgccgaagcctcgattgttgtca

SEQ ID NO: 579784 - DNA, 25 bp, Mus musculus
catgccgaatcaaaagaactcctgg

SEQ ID NO: 579785 - DNA, 25 bp, Mus musculus
catgccgaatcataagaactcctgg

SEQ ID NO: 579786 - DNA, 25 bp, Mus musculus
catgccgaggttctcgccagaatca

SEQ ID NO: 579787 - DNA, 25 bp, Mus musculus
catgccgaggttgtcgccagaatca

SEQ ID NO: 579788 - DNA, 25 bp, Mus musculus
catgccgagtgacctgtccactagt

SEQ ID NO: 579789 - DNA, 25 bp, Mus musculus
catgccgagtgagctgtccactagt

SEQ ID NO: 579790 - DNA, 25 bp, Mus musculus
catgccgctgtgactatgaactaga

SEQ ID NO: 579791 - DNA, 25 bp, Mus musculus
catgccgctgtgtctatgaactaga

SEQ ID NO: 579792 - DNA, 25 bp, Mus musculus
catgcctacaagcagctatggaaca

SEQ ID NO: 579793 - DNA, 25 bp, Mus musculus
catgcctacaaggagctatggaaca

SEQ ID NO: 579794 - DNA, 25 bp, Mus musculus
catgcctatgccacaggctgcacaa

SEQ ID NO: 579795 - DNA, 25 bp, Mus musculus
catgcctatgcctcaggctgcacaa

SEQ ID NO: 579796 - DNA, 25 bp, Mus musculus
catgcctcagagagggacccatagc

SEQ ID NO: 579797 - DNA, 25 bp, Mus musculus
catgcctcagagtgggacccatagc

SEQ ID NO: 579798 - DNA, 25 bp, Mus musculus
catgcctcagatacttccaacagat

SEQ ID NO: 579799 - DNA, 25 bp, Mus musculus
catgcctcagattcttccaacagat

SEQ ID NO: 579800 - DNA, 25 bp, Mus musculus
catgcctcatatagataatgatgtg

SEQ ID NO: 579801 - DNA, 25 bp, Mus musculus
catgcctcatattgataatgatgtg

SEQ ID NO: 579802 - DNA, 25 bp, Mus musculus
catgcctcatggagggagcccaaac

SEQ ID NO: 579803 - DNA, 25 bp, Mus musculus
catgcctcatggtgggagcccaaac

SEQ ID NO: 579804 - DNA, 25 bp, Mus musculus
catgcctcctgacttggtggacgtc

SEQ ID NO: 579805 - DNA, 25 bp, Mus musculus
catgcctcctgagttggtggacgtc

SEQ ID NO: 579806 - DNA, 25 bp, Mus musculus
catgcctgccgtcttgtgttagcca

SEQ ID NO: 579807 - DNA, 25 bp, Mus musculus
catgcctgccgtgttgtgttagcca

SEQ ID NO: 579808 - DNA, 25 bp, Mus musculus
catgcctgctaccaccgagtgtaga

SEQ ID NO: 579809 - DNA, 25 bp, Mus musculus
catgcctgctacgaccgagtgtaga

SEQ ID NO: 579810 - DNA, 25 bp, Mus musculus
catgcctgctgacgtgctctgcagg

SEQ ID NO: 579811 - DNA, 25 bp, Mus musculus
catgcctgctgaggtgctctgcagg

SEQ ID NO: 579812 - DNA, 25 bp, Mus musculus
catgcctgctgtagagaactgtcca

SEQ ID NO: 579813 - DNA, 25 bp, Mus musculus
catgcctgctgttgagaactgtcca

SEQ ID NO: 579814 - DNA, 25 bp, Mus musculus
catgcctggaggagagggataacca

SEQ ID NO: 579815 - DNA, 25 bp, Mus musculus
catgcctggaggagcatcaatggca

SEQ ID NO: 579816 - DNA, 25 bp, Mus musculus
catgcctggaggtgagggataacca

SEQ ID NO: 579817 - DNA, 25 bp, Mus musculus
catgcctggaggtgcatcaatggca

SEQ ID NO: 579818 - DNA, 25 bp, Mus musculus
catgcctggtttcaggatggtttta

SEQ ID NO: 579819 - DNA, 25 bp, Mus musculus
catgcctggtttgaggatggtttta

SEQ ID NO: 579820 - DNA, 25 bp, Mus musculus
catgcctgtgaaccaagccaagaca

SEQ ID NO: 579821 - DNA, 25 bp, Mus musculus
catgcctgtgaagcaagccaagaca

SEQ ID NO: 579822 - DNA, 25 bp, Mus musculus
catgccttacggatgtggccggtcc

SEQ ID NO: 579823 - DNA, 25 bp, Mus musculus
catgccttacggttgtggccggtcc

SEQ ID NO: 579824 - DNA, 25 bp, Mus musculus
catgccttattgagtccgtggatga

SEQ ID NO: 579825 - DNA, 25 bp, Mus musculus
catgccttattgtgtccgtggatga

SEQ ID NO: 579826 - DNA, 25 bp, Mus musculus
catgccttctgaattgcggacagaa

SEQ ID NO: 579827 - DNA, 25 bp, Mus musculus
catgccttctgatttgcggacagaa

SEQ ID NO: 579828 - DNA, 25 bp, Mus musculus
catgccttgacacatgaagttatca

SEQ ID NO: 579829 - DNA, 25 bp, Mus musculus
catgccttgacagatgaagttatca

SEQ ID NO: 579830 - DNA, 25 bp, Mus musculus
catgccttgtttctcagttccctca

SEQ ID NO: 579831 - DNA, 25 bp, Mus musculus
catgccttgtttgtcagttccctca

SEQ ID NO: 579832 - DNA, 25 bp, Mus musculus
catgcgagatctatgccagagcggc

SEQ ID NO: 579833 - DNA, 25 bp, Mus musculus
catgcgagatctttgccagagcggc

SEQ ID NO: 579834 - DNA, 25 bp, Mus musculus
catgcgagctctcctaaagccttgg

SEQ ID NO: 579835 - DNA, 25 bp, Mus musculus
catgcgagctctgctaaagccttgg

SEQ ID NO: 579836 - DNA, 25 bp, Mus musculus
catgcgagtcttagtgcggcctgcg

SEQ ID NO: 579837 - DNA, 25 bp, Mus musculus
catgcgagtctttgtgcggcctgcg

SEQ ID NO: 579838 - DNA, 25 bp, Mus musculus
catgcgatgcccattcgctccttga

SEQ ID NO: 579839 - DNA, 25 bp, Mus musculus
catgcgatgccctttcgctccttga

SEQ ID NO: 579840 - DNA, 25 bp, Mus musculus
catgcgcaacaccagtaagcagcag

SEQ ID NO: 579841 - DNA, 25 bp, Mus musculus
catgcgcaacacgagtaagcagcag

SEQ ID NO: 579842 - DNA, 25 bp, Mus musculus
catgcgcaatgacatctccagtcac

SEQ ID NO: 579843 - DNA, 25 bp, Mus musculus
catgcgcaatgagatctccagtcac

SEQ ID NO: 579844 - DNA, 25 bp, Mus musculus
catgcgcacctgctcgctcaggata

SEQ ID NO: 579845 - DNA, 25 bp, Mus musculus
catgcgcacctggtcgctcaggata

SEQ ID NO: 579846 - DNA, 25 bp, Mus musculus
catgcgcactggatctgcgctggga

SEQ ID NO: 579847 - DNA, 25 bp, Mus musculus
catgcgcactggttctgcgctggga

SEQ ID NO: 579848 - DNA, 25 bp, Mus musculus
catgcgccatccattgaatgctgag

SEQ ID NO: 579849 - DNA, 25 bp, Mus musculus
catgcgccatcctttgaatgctgag

SEQ ID NO: 579850 - DNA, 25 bp, Mus musculus
catgcgctagctctcatcggtttgc

SEQ ID NO: 579851 - DNA, 25 bp, Mus musculus
catgcgctagctgtcatcggtttgc

SEQ ID NO: 579852 - DNA, 25 bp, Mus musculus
catgcgctccccacagatggtgtct

SEQ ID NO: 579853 - DNA, 25 bp, Mus musculus
catgcgctcccctcagatggtgtct

SEQ ID NO: 579854 - DNA, 25 bp, Mus musculus
catgcggaggaaactgagtgcagcc

SEQ ID NO: 579855 - DNA, 25 bp, Mus musculus
catgcggaggaatctgagtgcagcc

SEQ ID NO: 579856 - DNA, 25 bp, Mus musculus
catgcggagtaaaccttcatatttc

SEQ ID NO: 579857 - DNA, 25 bp, Mus musculus
catgcggagtaatccttcatatttc

SEQ ID NO: 579858 - DNA, 25 bp, Mus musculus
catgcggatcatcactcggatgggc

SEQ ID NO: 579859 - DNA, 25 bp, Mus musculus
catgcggatcatgactcggatgggc

SEQ ID NO: 579860 - DNA, 25 bp, Mus musculus
catgcggccaggcaagttgtctgac

SEQ ID NO: 579861 - DNA, 25 bp, Mus musculus
catgcggccagggaagttgtctgac

SEQ ID NO: 579862 - DNA, 25 bp, Mus musculus
catgcgggacgcagactacattgct

SEQ ID NO: 579863 - DNA, 25 bp, Mus musculus
catgcgggacgctgactacattgct

SEQ ID NO: 579864 - DNA, 25 bp, Mus musculus
catgcgggagccacttgtctctggg

SEQ ID NO: 579865 - DNA, 25 bp, Mus musculus
catgcgggagcctcttgtctctggg

SEQ ID NO: 579866 - DNA, 25 bp, Mus musculus
catgcgggatcactatatgagggca

SEQ ID NO: 579867 - DNA, 25 bp, Mus musculus
catgcgggatcagtatatgagggca

SEQ ID NO: 579868 - DNA, 25 bp, Mus musculus
catgcgggctccacggtgtgataca

SEQ ID NO: 579869 - DNA, 25 bp, Mus musculus
catgcgggctcctcggtgtgataca

SEQ ID NO: 579870 - DNA, 25 bp, Mus musculus
catgcggtgcaacctgggatatttg

SEQ ID NO: 579871 - DNA, 25 bp, Mus musculus
catgcggtgcaagctgggatatttg

SEQ ID NO: 579872 - DNA, 25 bp, Mus musculus
catgcggttcaacccactgtttaga

SEQ ID NO: 579873 - DNA, 25 bp, Mus musculus
catgcggttcaagccactgtttaga

SEQ ID NO: 579874 - DNA, 25 bp, Mus musculus
catgcgtacggcaggactatttcct

SEQ ID NO: 579875 - DNA, 25 bp, Mus musculus
catgcgtacggctggactatttcct

SEQ ID NO: 579876 - DNA, 25 bp, Mus musculus
catgcgtatggcagacttctggctc

SEQ ID NO: 579877 - DNA, 25 bp, Mus musculus
catgcgtatggctgacttctggctc

SEQ ID NO: 579878 - DNA, 25 bp, Mus musculus
catgcgtcacggacagcactttgag

SEQ ID NO: 579879 - DNA, 25 bp, Mus musculus
catgcgtcacggtcagcactttgag

SEQ ID NO: 579880 - DNA, 25 bp, Mus musculus
catgcgtgactgcagtgacagagcc

SEQ ID NO: 579881 - DNA, 25 bp, Mus musculus
catgcgtgactggagtgacagagcc

SEQ ID NO: 579882 - DNA, 25 bp, Mus musculus
catgcgtgtgctaaaatgtgggcac

SEQ ID NO: 579883 - DNA, 25 bp, Mus musculus
catgcgtgtgcttaaatgtgggcac

SEQ ID NO: 579884 - DNA, 25 bp, Mus musculus
catgcgtttgtgcaactgcacgagt

SEQ ID NO: 579885 - DNA, 25 bp, Mus musculus
catgcgtttgtggaactgcacgagt

SEQ ID NO: 579886 - DNA, 25 bp, Mus musculus
catgctaatcacatacgacgatgtg

SEQ ID NO: 579887 - DNA, 25 bp, Mus musculus
catgctaatcacttacgacgatgtg

SEQ ID NO: 579888 - DNA, 25 bp, Mus musculus
catgctacaccaaatgtgcttaata

SEQ ID NO: 579889 - DNA, 25 bp, Mus musculus
catgctacaccatatgtgcttaata

SEQ ID NO: 579890 - DNA, 25 bp, Mus musculus
catgctaccactccatcagtcagga

SEQ ID NO: 579891 - DNA, 25 bp, Mus musculus
catgctaccactcgattcccaggga

SEQ ID NO: 579892 - DNA, 25 bp, Mus musculus
catgctaccactgcatcagtcagga

SEQ ID NO: 579893 - DNA, 25 bp, Mus musculus
catgctaccactggattcccaggga

SEQ ID NO: 579894 - DNA, 25 bp, Mus musculus
catgctacgatacgagatgagtctc

SEQ ID NO: 579895 - DNA, 25 bp, Mus musculus
catgctacgataggagatgagtctc

SEQ ID NO: 579896 - DNA, 25 bp, Mus musculus
catgctacgccacactgaagaccaa

SEQ ID NO: 579897 - DNA, 25 bp, Mus musculus
catgctacgccagactgaagaccaa

SEQ ID NO: 579898 - DNA, 25 bp, Mus musculus
catgctagctgtcatgtatgcggga

SEQ ID NO: 579899 - DNA, 25 bp, Mus musculus
catgctagctgtgatgtatgcggga

SEQ ID NO: 579900 - DNA, 25 bp, Mus musculus
catgctaggtatctgttgtatgacc

SEQ ID NO: 579901 - DNA, 25 bp, Mus musculus
catgctaggtatgtgttgtatgacc

SEQ ID NO: 579902 - DNA, 25 bp, Mus musculus
catgctagtgatacaagttcatcca

SEQ ID NO: 579903 - DNA, 25 bp, Mus musculus
catgctagtgattcaagttcatcca

SEQ ID NO: 579904 - DNA, 25 bp, Mus musculus
catgctatgcagattgatttcctca

SEQ ID NO: 579905 - DNA, 25 bp, Mus musculus
catgctatgcagtttgatttcctca

SEQ ID NO: 579906 - DNA, 25 bp, Mus musculus
catgctcacagtcgtctgtatcctg

SEQ ID NO: 579907 - DNA, 25 bp, Mus musculus
catgctcacagtggtctgtatcctg

SEQ ID NO: 579908 - DNA, 25 bp, Mus musculus
catgctcactagagtgttcgtggga

SEQ ID NO: 579909 - DNA, 25 bp, Mus musculus
catgctcactagtgtgttcgtggga

SEQ ID NO: 579910 - DNA, 25 bp, Mus musculus
catgctcagcctcgtttagtgtctt

SEQ ID NO: 579911 - DNA, 25 bp, Mus musculus
catgctcagcctggtttagtgtctt

SEQ ID NO: 579912 - DNA, 25 bp, Mus musculus
catgctcagtctcatggcgcacaca

SEQ ID NO: 579913 - DNA, 25 bp, Mus musculus
catgctcagtctgatggcgcacaca

SEQ ID NO: 579914 - DNA, 25 bp, Mus musculus
catgctcatgctctgcatagagtgg

SEQ ID NO: 579915 - DNA, 25 bp, Mus musculus
catgctcatgctgtgcatagagtgg

SEQ ID NO: 579916 - DNA, 25 bp, Mus musculus
catgctcatggtcaagccgggattg

SEQ ID NO: 579917 - DNA, 25 bp, Mus musculus
catgctcatggtgaagccgggattg

SEQ ID NO: 579918 - DNA, 25 bp, Mus musculus
catgctcattctcaaattccaggaa

SEQ ID NO: 579919 - DNA, 25 bp, Mus musculus
catgctcattctgaaattccaggaa

SEQ ID NO: 579920 - DNA, 25 bp, Mus musculus
catgctccaccgctgggatgacagc

SEQ ID NO: 579921 - DNA, 25 bp, Mus musculus
catgctccaccggtgggatgacagc

SEQ ID NO: 579922 - DNA, 25 bp, Mus musculus
catgctccatgtagtgcacagccag

SEQ ID NO: 579923 - DNA, 25 bp, Mus musculus
catgctccatgttgtgcacagccag

SEQ ID NO: 579924 - DNA, 25 bp, Mus musculus
catgctcccagtaccattgttgaca

SEQ ID NO: 579925 - DNA, 25 bp, Mus musculus
catgctcccagttccattgttgaca

SEQ ID NO: 579926 - DNA, 25 bp, Mus musculus
catgctccgagaagctatgttagcc

SEQ ID NO: 579927 - DNA, 25 bp, Mus musculus
catgctccgagatgctatgttagcc

SEQ ID NO: 579928 - DNA, 25 bp, Mus musculus
catgctccgcgaagtgacccaggag

SEQ ID NO: 579929 - DNA, 25 bp, Mus musculus
catgctccgcgatgtgacccaggag

SEQ ID NO: 579930 - DNA, 25 bp, Mus musculus
catgctccgtatcccaggagacctt

SEQ ID NO: 579931 - DNA, 25 bp, Mus musculus
catgctccgtatgccaggagacctt

SEQ ID NO: 579932 - DNA, 25 bp, Mus musculus
catgctccgtgaagttcagtgggca

SEQ ID NO: 579933 - DNA, 25 bp, Mus musculus
catgctccgtgatgttcagtgggca

SEQ ID NO: 579934 - DNA, 25 bp, Mus musculus
catgctcctgcgagaagatcaagga

SEQ ID NO: 579935 - DNA, 25 bp, Mus musculus
catgctcctgcgtgaagatcaagga

SEQ ID NO: 579936 - DNA, 25 bp, Mus musculus
catgctcgagctattagacgggaga

SEQ ID NO: 579937 - DNA, 25 bp, Mus musculus
catgctcgagcttttagacgggaga

SEQ ID NO: 579938 - DNA, 25 bp, Mus musculus
catgctcgctggcaagactccctgg

SEQ ID NO: 579939 - DNA, 25 bp, Mus musculus
catgctcgctgggaagactccctgg

SEQ ID NO: 579940 - DNA, 25 bp, Mus musculus
catgctcgggcacccttggctcgga

SEQ ID NO: 579941 - DNA, 25 bp, Mus musculus
catgctcgggcagccttggctcgga

SEQ ID NO: 579942 - DNA, 25 bp, Mus musculus
catgctctataacgtgagttgggcc

SEQ ID NO: 579943 - DNA, 25 bp, Mus musculus
catgctctataaggtgagttgggcc

SEQ ID NO: 579944 - DNA, 25 bp, Mus musculus
catgctctccaaagttggaacgtgg

SEQ ID NO: 579945 - DNA, 25 bp, Mus musculus
catgctctccaatgttggaacgtgg

SEQ ID NO: 579946 - DNA, 25 bp, Mus musculus
catgctctgaacagtcacagaatga

SEQ ID NO: 579947 - DNA, 25 bp, Mus musculus
catgctctgaactgtcacagaatga

SEQ ID NO: 579948 - DNA, 25 bp, Mus musculus
catgctctgcttcggaatggcttta

SEQ ID NO: 579949 - DNA, 25 bp, Mus musculus
catgctctgcttgggaatggcttta

SEQ ID NO: 579950 - DNA, 25 bp, Mus musculus
catgctctggatcgacatggccatg

SEQ ID NO: 579951 - DNA, 25 bp, Mus musculus
catgctctggatggacatggccatg

SEQ ID NO: 579952 - DNA, 25 bp, Mus musculus
catgctctgggacaaagttctgcca

SEQ ID NO: 579953 - DNA, 25 bp, Mus musculus
catgctctgggagaaagttctgcca

SEQ ID NO: 579954 - DNA, 25 bp, Mus musculus
catgctctggtcagtcttcagcacg

SEQ ID NO: 579955 - DNA, 25 bp, Mus musculus
catgctctggtctgtcttcagcacg

SEQ ID NO: 579956 - DNA, 25 bp, Mus musculus
catgctcttctgcatggcctgtgaa

SEQ ID NO: 579957 - DNA, 25 bp, Mus musculus
catgctcttctggatggcctgtgaa

SEQ ID NO: 579958 - DNA, 25 bp, Mus musculus
catgctgaaagccagcgctgcgtct

SEQ ID NO: 579959 - DNA, 25 bp, Mus musculus
catgctgaaagcgagcgctgcgtct

SEQ ID NO: 579960 - DNA, 25 bp, Mus musculus
catgctgaaatactgcagatcctcc

SEQ ID NO: 579961 - DNA, 25 bp, Mus musculus
catgctgaaatagtgcagatcctcc

SEQ ID NO: 579962 - DNA, 25 bp, Mus musculus
catgctgaagcaacgggactacgag

SEQ ID NO: 579963 - DNA, 25 bp, Mus musculus
catgctgaagcatcgggactacgag

SEQ ID NO: 579964 - DNA, 25 bp, Mus musculus
catgctgaagccaggaactaaaacc

SEQ ID NO: 579965 - DNA, 25 bp, Mus musculus
catgctgaagcctggaactaaaacc

SEQ ID NO: 579966 - DNA, 25 bp, Mus musculus
catgctgaaggcagccctcagtggg

SEQ ID NO: 579967 - DNA, 25 bp, Mus musculus
catgctgaaggctgccctcagtggg

SEQ ID NO: 579968 - DNA, 25 bp, Mus musculus
catgctgaatggctcggagccaaaa

SEQ ID NO: 579969 - DNA, 25 bp, Mus musculus
catgctgaatgggtcggagccaaaa

SEQ ID NO: 579970 - DNA, 25 bp, Mus musculus
catgctgacatgcaggtgacagtcc

SEQ ID NO: 579971 - DNA, 25 bp, Mus musculus
catgctgacatggaggtgacagtcc

SEQ ID NO: 579972 - DNA, 25 bp, Mus musculus
catgctgaggatagagctgatggac

SEQ ID NO: 579973 - DNA, 25 bp, Mus musculus
catgctgaggattgagctgatggac

SEQ ID NO: 579974 - DNA, 25 bp, Mus musculus
catgctgatcgccatccaacacaag

SEQ ID NO: 579975 - DNA, 25 bp, Mus musculus
catgctgatcgcgatccaacacaag

SEQ ID NO: 579976 - DNA, 25 bp, Mus musculus
catgctgatttcagcccttcggatg

SEQ ID NO: 579977 - DNA, 25 bp, Mus musculus
catgctgatttctgcccttcggatg

SEQ ID NO: 579978 - DNA, 25 bp, Mus musculus
catgctgcaaagcagagtctccgct

SEQ ID NO: 579979 - DNA, 25 bp, Mus musculus
catgctgcaaaggagagtctccgct

SEQ ID NO: 579980 - DNA, 25 bp, Mus musculus
catgctgcaactagaactcaaagag

SEQ ID NO: 579981 - DNA, 25 bp, Mus musculus
catgctgcaacttgaactcaaagag

SEQ ID NO: 579982 - DNA, 25 bp, Mus musculus
catgctgcaagtaggagcactgcac

SEQ ID NO: 579983 - DNA, 25 bp, Mus musculus
catgctgcaagttggagcactgcac

SEQ ID NO: 579984 - DNA, 25 bp, Mus musculus
catgctgcactcctgaactgtttgg

SEQ ID NO: 579985 - DNA, 25 bp, Mus musculus
catgctgcactcctgtacctctgag

SEQ ID NO: 579986 - DNA, 25 bp, Mus musculus
catgctgcactcgtgaactgtttgg

SEQ ID NO: 579987 - DNA, 25 bp, Mus musculus
catgctgcactcgtgtacctctgag

SEQ ID NO: 579988 - DNA, 25 bp, Mus musculus
catgctgcagcgagcttgttgaagg

SEQ ID NO: 579989 - DNA, 25 bp, Mus musculus
catgctgcagcgtgcttgttgaagg

SEQ ID NO: 579990 - DNA, 25 bp, Mus musculus
catgctgcaggacaccatgaagtcc

SEQ ID NO: 579991 - DNA, 25 bp, Mus musculus
catgctgcaggagaccatgaagtcc

SEQ ID NO: 579992 - DNA, 25 bp, Mus musculus
catgctgcagttagctttctgtaaa

SEQ ID NO: 579993 - DNA, 25 bp, Mus musculus
catgctgcagtttgctttctgtaaa

SEQ ID NO: 579994 - DNA, 25 bp, Mus musculus
catgctgccattcctaagtactttg

SEQ ID NO: 579995 - DNA, 25 bp, Mus musculus
catgctgccattgctaagtactttg

SEQ ID NO: 579996 - DNA, 25 bp, Mus musculus
catgctgccgctctcatctctgatg

SEQ ID NO: 579997 - DNA, 25 bp, Mus musculus
catgctgccgctgtcatctctgatg

SEQ ID NO: 579998 - DNA, 25 bp, Mus musculus
catgctgcgcagcacctgtggaccg

SEQ ID NO: 579999 - DNA, 25 bp, Mus musculus
catgctgcgcaggacctgtggaccg

SEQ ID NO: 580000 - DNA, 25 bp, Mus musculus
catgctgcggtaagtgcagaagaag

SEQ ID NO: 580001 - DNA, 25 bp, Mus musculus
catgctgcggtatgtgcagaagaag

SEQ ID NO: 580002 - DNA, 25 bp, Mus musculus
catgctgcgtcccaaggctttgacg

SEQ ID NO: 580003 - DNA, 25 bp, Mus musculus
catgctgcgtccgaaggctttgacg

SEQ ID NO: 580004 - DNA, 25 bp, Mus musculus
catgctgctacaataaggctcattt

SEQ ID NO: 580005 - DNA, 25 bp, Mus musculus
catgctgctacattaaggctcattt

SEQ ID NO: 580006 - DNA, 25 bp, Mus musculus
catgctgctcgtcagtgctcgatga

SEQ ID NO: 580007 - DNA, 25 bp, Mus musculus
catgctgctcgtgagtgctcgatga

SEQ ID NO: 580008 - DNA, 25 bp, Mus musculus
catgctgctctgagatcttttaatg

SEQ ID NO: 580009 - DNA, 25 bp, Mus musculus
catgctgctctgtgatcttttaatg

SEQ ID NO: 580010 - DNA, 25 bp, Mus musculus
catgctgcttcacagagggtgctga

SEQ ID NO: 580011 - DNA, 25 bp, Mus musculus
catgctgcttcagagagggtgctga

SEQ ID NO: 580012 - DNA, 25 bp, Mus musculus
catgctggacgacgtcagtgatgca

SEQ ID NO: 580013 - DNA, 25 bp, Mus musculus
catgctggacgaggtcagtgatgca

SEQ ID NO: 580014 - DNA, 25 bp, Mus musculus
catgctggactaactgcaggtgagc

SEQ ID NO: 580015 - DNA, 25 bp, Mus musculus
catgctggactatctgcaggtgagc

SEQ ID NO: 580016 - DNA, 25 bp, Mus musculus
catgctggagagaattggcgtgccc

SEQ ID NO: 580017 - DNA, 25 bp, Mus musculus
catgctggagagtattggcgtgccc

SEQ ID NO: 580018 - DNA, 25 bp, Mus musculus
catgctggaggacattcgtgaaaac

SEQ ID NO: 580019 - DNA, 25 bp, Mus musculus
catgctggaggagattcgtgaaaac

SEQ ID NO: 580020 - DNA, 25 bp, Mus musculus
catgctggagtgaccgcagcctaca

SEQ ID NO: 580021 - DNA, 25 bp, Mus musculus
catgctggagtgtccgcagcctaca

SEQ ID NO: 580022 - DNA, 25 bp, Mus musculus
catgctggatgaactggtggacgaa

SEQ ID NO: 580023 - DNA, 25 bp, Mus musculus
catgctggatgatctggtggacgaa

SEQ ID NO: 580024 - DNA, 25 bp, Mus musculus
catgctggattcaaaaagatatgcc

SEQ ID NO: 580025 - DNA, 25 bp, Mus musculus
catgctggattctaaaagatatgcc

SEQ ID NO: 580026 - DNA, 25 bp, Mus musculus
catgctggccggccacagtgaatca

SEQ ID NO: 580027 - DNA, 25 bp, Mus musculus
catgctggccgggcacagtgaatca

SEQ ID NO: 580028 - DNA, 25 bp, Mus musculus
catgctggcgctcaaatacctgggc

SEQ ID NO: 580029 - DNA, 25 bp, Mus musculus
catgctggcgctgaaatacctgggc

SEQ ID NO: 580030 - DNA, 25 bp, Mus musculus
catgctgggaaaatcgggtatcctg

SEQ ID NO: 580031 - DNA, 25 bp, Mus musculus
catgctgggaaattcgggtatcctg

SEQ ID NO: 580032 - DNA, 25 bp, Mus musculus
catgctgggagcaatctgtgccatc

SEQ ID NO: 580033 - DNA, 25 bp, Mus musculus
catgctgggagctatctgtgccatc

SEQ ID NO: 580034 - DNA, 25 bp, Mus musculus
catgctgggctacaagaggcacctg

SEQ ID NO: 580035 - DNA, 25 bp, Mus musculus
catgctgggctagaagaggcacctg

SEQ ID NO: 580036 - DNA, 25 bp, Mus musculus
catgctgggctcaatgagtgctcag

SEQ ID NO: 580037 - DNA, 25 bp, Mus musculus
catgctgggctctatgagtgctcag

SEQ ID NO: 580038 - DNA, 25 bp, Mus musculus
catgctgggtgaaagcgatgccacg

SEQ ID NO: 580039 - DNA, 25 bp, Mus musculus
catgctgggtgatagcgatgccacg

SEQ ID NO: 580040 - DNA, 25 bp, Mus musculus
catgctggtaggcagctttggccca

SEQ ID NO: 580041 - DNA, 25 bp, Mus musculus
catgctggtagggagctttggccca

SEQ ID NO: 580042 - DNA, 25 bp, Mus musculus
catgctggttaaagcagctgacgac

SEQ ID NO: 580043 - DNA, 25 bp, Mus musculus
catgctggttaatgcagctgacgac

SEQ ID NO: 580044 - DNA, 25 bp, Mus musculus
catgctgtatgtagaggctatgtcc

SEQ ID NO: 580045 - DNA, 25 bp, Mus musculus
catgctgtatgttgaggctatgtcc

SEQ ID NO: 580046 - DNA, 25 bp, Mus musculus
catgctgtcccacggcgtgtccatg

SEQ ID NO: 580047 - DNA, 25 bp, Mus musculus
catgctgtcccagggcgtgtccatg

SEQ ID NO: 580048 - DNA, 25 bp, Mus musculus
catgctgtcctcagtatacaataag

SEQ ID NO: 580049 - DNA, 25 bp, Mus musculus
catgctgtcctctgtatacaataag

SEQ ID NO: 580050 - DNA, 25 bp, Mus musculus
catgctgtcgagctgaccatctcat

SEQ ID NO: 580051 - DNA, 25 bp, Mus musculus
catgctgtcgaggtgaccatctcat

SEQ ID NO: 580052 - DNA, 25 bp, Mus musculus
catgctgtgaaaatctgggatataa

SEQ ID NO: 580053 - DNA, 25 bp, Mus musculus
catgctgtgaaattctgggatataa

SEQ ID NO: 580054 - DNA, 25 bp, Mus musculus
catgctgtggaaaaagctcatcgag

SEQ ID NO: 580055 - DNA, 25 bp, Mus musculus
catgctgtggaataagctcatcgag

SEQ ID NO: 580056 - DNA, 25 bp, Mus musculus
catgctgtgggtaggtgtagagtca

SEQ ID NO: 580057 - DNA, 25 bp, Mus musculus
catgctgtgggttggtgtagagtca

SEQ ID NO: 580058 - DNA, 25 bp, Mus musculus
catgctgtgtcgcatgctgggcttc

SEQ ID NO: 580059 - DNA, 25 bp, Mus musculus
catgctgtgtcggatgctgggcttc

SEQ ID NO: 580060 - DNA, 25 bp, Mus musculus
catgctgtttggagtcagcctgagc

SEQ ID NO: 580061 - DNA, 25 bp, Mus musculus
catgctgtttggtgtcagcctgagc

SEQ ID NO: 580062 - DNA, 25 bp, Mus musculus
catgcttacaggagctgtgcagcat

SEQ ID NO: 580063 - DNA, 25 bp, Mus musculus
catgcttacaggtgctgtgcagcat

SEQ ID NO: 580064 - DNA, 25 bp, Mus musculus
catgcttcacgactgaagatgaaga

SEQ ID NO: 580065 - DNA, 25 bp, Mus musculus
catgcttcacgagtgaagatgaaga

SEQ ID NO: 580066 - DNA, 25 bp, Mus musculus
catgcttcataacatcgaccaagag

SEQ ID NO: 580067 - DNA, 25 bp, Mus musculus
catgcttcataagatcgaccaagag

SEQ ID NO: 580068 - DNA, 25 bp, Mus musculus
catgcttccgggatttgggcacagg

SEQ ID NO: 580069 - DNA, 25 bp, Mus musculus
catgcttccgggttttgggcacagg

SEQ ID NO: 580070 - DNA, 25 bp, Mus musculus
catgcttcctgacttttgctttctt

SEQ ID NO: 580071 - DNA, 25 bp, Mus musculus
catgcttcctgagttttgctttctt

SEQ ID NO: 580072 - DNA, 25 bp, Mus musculus
catgcttcctgcaccgggtctatct

SEQ ID NO: 580073 - DNA, 25 bp, Mus musculus
catgcttcctgctccgggtctatct

SEQ ID NO: 580074 - DNA, 25 bp, Mus musculus
catgcttcgtatacatcccttcagt

SEQ ID NO: 580075 - DNA, 25 bp, Mus musculus
catgcttcgtattcatcccttcagt

SEQ ID NO: 580076 - DNA, 25 bp, Mus musculus
catgcttctgtaatgtgtaccccga

SEQ ID NO: 580077 - DNA, 25 bp, Mus musculus
catgcttctgtattgtgtaccccga

SEQ ID NO: 580078 - DNA, 25 bp, Mus musculus
catgcttctgtgagcatatggctct

SEQ ID NO: 580079 - DNA, 25 bp, Mus musculus
catgcttctgtgtgcatatggctct

SEQ ID NO: 580080 - DNA, 25 bp, Mus musculus
catgcttgatgccatcagaagagca

SEQ ID NO: 580081 - DNA, 25 bp, Mus musculus
catgcttgatgcgatcagaagagca

SEQ ID NO: 580082 - DNA, 25 bp, Mus musculus
catgcttgatttaggcttggctcga

SEQ ID NO: 580083 - DNA, 25 bp, Mus musculus
catgcttgattttggcttggctcga

SEQ ID NO: 580084 - DNA, 25 bp, Mus musculus
catgcttgcgcccttggtgtactaa

SEQ ID NO: 580085 - DNA, 25 bp, Mus musculus
catgcttgcgccgttggtgtactaa

SEQ ID NO: 580086 - DNA, 25 bp, Mus musculus
catgcttggtgacaccagttgacca

SEQ ID NO: 580087 - DNA, 25 bp, Mus musculus
catgcttggtgagaccagttgacca

SEQ ID NO: 580088 - DNA, 25 bp, Mus musculus
catgctttactgcagcgacgaggaa

SEQ ID NO: 580089 - DNA, 25 bp, Mus musculus
catgctttactggagcgacgaggaa

SEQ ID NO: 580090 - DNA, 25 bp, Mus musculus
catgctttgcatcgagagctgggcc

SEQ ID NO: 580091 - DNA, 25 bp, Mus musculus
catgctttgcatggagagctgggcc

SEQ ID NO: 580092 - DNA, 25 bp, Mus musculus
catgcttttatgaccattgggcctg

SEQ ID NO: 580093 - DNA, 25 bp, Mus musculus
catgcttttatgtccattgggcctg

SEQ ID NO: 580094 - DNA, 25 bp, Mus musculus
catgcttttgatcatgagtggcaaa

SEQ ID NO: 580095 - DNA, 25 bp, Mus musculus
catgcttttgatgatgagtggcaaa

SEQ ID NO: 580096 - DNA, 25 bp, Mus musculus
catgcttttggcagtgcactggtac

SEQ ID NO: 580097 - DNA, 25 bp, Mus musculus
catgcttttggctgtgcactggtac

SEQ ID NO: 580098 - DNA, 25 bp, Mus musculus
catgcttttgtccaaactgaaggag

SEQ ID NO: 580099 - DNA, 25 bp, Mus musculus
catgcttttgtcgaaactgaaggag

SEQ ID NO: 580100 - DNA, 25 bp, Mus musculus
catggaaaacatccctacagtgggc

SEQ ID NO: 580101 - DNA, 25 bp, Mus musculus
catggaaaacatgcctacagtgggc

SEQ ID NO: 580102 - DNA, 25 bp, Mus musculus
catggaaaaggtcaaagtacaggaa

SEQ ID NO: 580103 - DNA, 25 bp, Mus musculus
catggaaaaggtgaaagtacaggaa

SEQ ID NO: 580104 - DNA, 25 bp, Mus musculus
catggaaaatgtacctgcaggacct

SEQ ID NO: 580105 - DNA, 25 bp, Mus musculus
catggaaaatgttcctgcaggacct

SEQ ID NO: 580106 - DNA, 25 bp, Mus musculus
catggaaacagcaaacatcgtggtc

SEQ ID NO: 580107 - DNA, 25 bp, Mus musculus
catggaaacagcaccattttcttgg

SEQ ID NO: 580108 - DNA, 25 bp, Mus musculus
catggaaacagctaacatcgtggtc

SEQ ID NO: 580109 - DNA, 25 bp, Mus musculus
catggaaacagctccattttcttgg

SEQ ID NO: 580110 - DNA, 25 bp, Mus musculus
catggaaagaagaaaactatctcta

SEQ ID NO: 580111 - DNA, 25 bp, Mus musculus
catggaaagaagtaaactatctcta

SEQ ID NO: 580112 - DNA, 25 bp, Mus musculus
catggaaagcgacggcctctgctac

SEQ ID NO: 580113 - DNA, 25 bp, Mus musculus
catggaaagcgagggcctctgctac

SEQ ID NO: 580114 - DNA, 25 bp, Mus musculus
catggaaagcggcaccaagagctgt

SEQ ID NO: 580115 - DNA, 25 bp, Mus musculus
catggaaagcgggaccaagagctgt

SEQ ID NO: 580116 - DNA, 25 bp, Mus musculus
catggaaagtatacaacatctagcg

SEQ ID NO: 580117 - DNA, 25 bp, Mus musculus
catggaaagtattcaacatctagcg

SEQ ID NO: 580118 - DNA, 25 bp, Mus musculus
catggaacaagaagtcctccaagct

SEQ ID NO: 580119 - DNA, 25 bp, Mus musculus
catggaacaagatgtcctccaagct

SEQ ID NO: 580120 - DNA, 25 bp, Mus musculus
catggaacgcaacttcagcccctgg

SEQ ID NO: 580121 - DNA, 25 bp, Mus musculus
catggaacgcaagttcagcccctgg

SEQ ID NO: 580122 - DNA, 25 bp, Mus musculus
catggaacgcctacaaagaatatta

SEQ ID NO: 580123 - DNA, 25 bp, Mus musculus
catggaacgccttcaaagaatatta

SEQ ID NO: 580124 - DNA, 25 bp, Mus musculus
catggaagaagtccctgtttgcccc

SEQ ID NO: 580125 - DNA, 25 bp, Mus musculus
catggaagaagtgcctgtttgcccc

SEQ ID NO: 580126 - DNA, 25 bp, Mus musculus
catggaagagaaagcgctagaagtt

SEQ ID NO: 580127 - DNA, 25 bp, Mus musculus
catggaagagaatgcgctagaagtt

SEQ ID NO: 580128 - DNA, 25 bp, Mus musculus
catggaagatagacccaccatggtt

SEQ ID NO: 580129 - DNA, 25 bp, Mus musculus
catggaagatagtcccaccatggtt

SEQ ID NO: 580130 - DNA, 25 bp, Mus musculus
catggaagcacgctgctaagcacgg

SEQ ID NO: 580131 - DNA, 25 bp, Mus musculus
catggaagcacggtgctaagcacgg

SEQ ID NO: 580132 - DNA, 25 bp, Mus musculus
catggaagccttcactaagttgacg

SEQ ID NO: 580133 - DNA, 25 bp, Mus musculus
catggaagccttgactaagttgacg

SEQ ID NO: 580134 - DNA, 25 bp, Mus musculus
catggaagctccagtcaaggtgatc

SEQ ID NO: 580135 - DNA, 25 bp, Mus musculus
catggaagctcctgtcaaggtgatc

SEQ ID NO: 580136 - DNA, 25 bp, Mus musculus
catggaaggcctccctgagttagaa

SEQ ID NO: 580137 - DNA, 25 bp, Mus musculus
catggaaggcctgcctgagttagaa

SEQ ID NO: 580138 - DNA, 25 bp, Mus musculus
catggaagtacaagagggatatggc

SEQ ID NO: 580139 - DNA, 25 bp, Mus musculus
catggaagtacatgagggatatggc

SEQ ID NO: 580140 - DNA, 25 bp, Mus musculus
catggaagtccaagaattgttccgg

SEQ ID NO: 580141 - DNA, 25 bp, Mus musculus
catggaagtccatgaattgttccgg

SEQ ID NO: 580142 - DNA, 25 bp, Mus musculus
catggaatagagagcttgcttgggc

SEQ ID NO: 580143 - DNA, 25 bp, Mus musculus
catggaatagagtgcttgcttgggc

SEQ ID NO: 580144 - DNA, 25 bp, Mus musculus
catggaatattcctgcctggagcct

SEQ ID NO: 580145 - DNA, 25 bp, Mus musculus
catggaatattcgtgcctggagcct

SEQ ID NO: 580146 - DNA, 25 bp, Mus musculus
catggaatatttcagttggactgcc

SEQ ID NO: 580147 - DNA, 25 bp, Mus musculus
catggaatatttgagttggactgcc

SEQ ID NO: 580148 - DNA, 25 bp, Mus musculus
catggaatccaacaaggatgaagcc

SEQ ID NO: 580149 - DNA, 25 bp, Mus musculus
catggaatccaagaaggatgaagcc

SEQ ID NO: 580150 - DNA, 25 bp, Mus musculus
catggaatcccgaggaaagtcagcc

SEQ ID NO: 580151 - DNA, 25 bp, Mus musculus
catggaatcccgtggaaagtcagcc

SEQ ID NO: 580152 - DNA, 25 bp, Mus musculus
catggaattagtcaacaatatgctg

SEQ ID NO: 580153 - DNA, 25 bp, Mus musculus
catggaattagtgaacaatatgctg

SEQ ID NO: 580154 - DNA, 25 bp, Mus musculus
catggaattgccaatgaagacattg

SEQ ID NO: 580155 - DNA, 25 bp, Mus musculus
catggaattgcctatgaagacattg

SEQ ID NO: 580156 - DNA, 25 bp, Mus musculus
catggaatttcccttttcggaggag

SEQ ID NO: 580157 - DNA, 25 bp, Mus musculus
catggaatttccgttttcggaggag

SEQ ID NO: 580158 - DNA, 25 bp, Mus musculus
catggacaagcaccctggaggactc

SEQ ID NO: 580159 - DNA, 25 bp, Mus musculus
catggacaagcagcctggaggactc

SEQ ID NO: 580160 - DNA, 25 bp, Mus musculus
catggacaaggaagatgcacttatc

SEQ ID NO: 580161 - DNA, 25 bp, Mus musculus
catggacaaggatgatgcacttatc

SEQ ID NO: 580162 - DNA, 25 bp, Mus musculus
catggacaagttatggtggcacaca

SEQ ID NO: 580163 - DNA, 25 bp, Mus musculus
catggacaagttttggtggcacaca

SEQ ID NO: 580164 - DNA, 25 bp, Mus musculus
catggacaattcaatgacctcaagg

SEQ ID NO: 580165 - DNA, 25 bp, Mus musculus
catggacaattctatgacctcaagg

SEQ ID NO: 580166 - DNA, 25 bp, Mus musculus
catggacaccatagagaaatcaaat

SEQ ID NO: 580167 - DNA, 25 bp, Mus musculus
catggacaccattgagaaatcaaat

SEQ ID NO: 580168 - DNA, 25 bp, Mus musculus
catggacaccgaagggcttttatac

SEQ ID NO: 580169 - DNA, 25 bp, Mus musculus
catggacaccgatgggcttttatac

SEQ ID NO: 580170 - DNA, 25 bp, Mus musculus
catggacactcgaattcagatgggc

SEQ ID NO: 580171 - DNA, 25 bp, Mus musculus
catggacactcgtattcagatgggc

SEQ ID NO: 580172 - DNA, 25 bp, Mus musculus
catggacactgcatctgacgacctc

SEQ ID NO: 580173 - DNA, 25 bp, Mus musculus
catggacactgcttctgacgacctc

SEQ ID NO: 580174 - DNA, 25 bp, Mus musculus
catggacagcaactcgcctctcttt

SEQ ID NO: 580175 - DNA, 25 bp, Mus musculus
catggacagcaagtcgcctctcttt

SEQ ID NO: 580176 - DNA, 25 bp, Mus musculus
catggacagcagagcatattccttc

SEQ ID NO: 580177 - DNA, 25 bp, Mus musculus
catggacagcagtgcatattccttc

SEQ ID NO: 580178 - DNA, 25 bp, Mus musculus
catggacagctactggcatagccgc

SEQ ID NO: 580179 - DNA, 25 bp, Mus musculus
catggacagctagtggcatagccgc

SEQ ID NO: 580180 - DNA, 25 bp, Mus musculus
catggacagctgattttggtctggt

SEQ ID NO: 580181 - DNA, 25 bp, Mus musculus
catggacagctgtttttggtctggt

SEQ ID NO: 580182 - DNA, 25 bp, Mus musculus
catggacagtgtctgcctggcccct

SEQ ID NO: 580183 - DNA, 25 bp, Mus musculus
catggacagtgtgtgcctggcccct

SEQ ID NO: 580184 - DNA, 25 bp, Mus musculus
catggacatcgacgcgctcaagaag

SEQ ID NO: 580185 - DNA, 25 bp, Mus musculus
catggacatcgaggcgctcaagaag

SEQ ID NO: 580186 - DNA, 25 bp, Mus musculus
catggacatctgctggaaaaaagtc

SEQ ID NO: 580187 - DNA, 25 bp, Mus musculus
catggacatctggtggaaaaaagtc

SEQ ID NO: 580188 - DNA, 25 bp, Mus musculus
catggacatgcgcaaagcccttttc

SEQ ID NO: 580189 - DNA, 25 bp, Mus musculus
catggacatgcggaaagcccttttc

SEQ ID NO: 580190 - DNA, 25 bp, Mus musculus
catggaccaactcatcgcgctgctg

SEQ ID NO: 580191 - DNA, 25 bp, Mus musculus
catggaccaactgatcgcgctgctg

SEQ ID NO: 580192 - DNA, 25 bp, Mus musculus
catggaccacgaccatgaagaagtc

SEQ ID NO: 580193 - DNA, 25 bp, Mus musculus
catggaccacgagcatgaagaagtc

SEQ ID NO: 580194 - DNA, 25 bp, Mus musculus
catggaccactcatgatgctggccc

SEQ ID NO: 580195 - DNA, 25 bp, Mus musculus
catggaccactcttgatgctggccc

SEQ ID NO: 580196 - DNA, 25 bp, Mus musculus
catggaccccagagacatgatgcgg

SEQ ID NO: 580197 - DNA, 25 bp, Mus musculus
catggaccccagtgacatgatgcgg

SEQ ID NO: 580198 - DNA, 25 bp, Mus musculus
catggacccggtagctgtgttccgc

SEQ ID NO: 580199 - DNA, 25 bp, Mus musculus
catggacccggttgctgtgttccgc

SEQ ID NO: 580200 - DNA, 25 bp, Mus musculus
catggaccctagcactgagtgatct

SEQ ID NO: 580201 - DNA, 25 bp, Mus musculus
catggaccctaggactgagtgatct

SEQ ID NO: 580202 - DNA, 25 bp, Mus musculus
catggaccctgccctacgggagcag

SEQ ID NO: 580203 - DNA, 25 bp, Mus musculus
catggaccctgcgctacgggagcag

SEQ ID NO: 580204 - DNA, 25 bp, Mus musculus
catggaccgtcaagcagcacaacgg

SEQ ID NO: 580205 - DNA, 25 bp, Mus musculus
catggaccgtcatgcagcacaacgg

SEQ ID NO: 580206 - DNA, 25 bp, Mus musculus
catggaccgtggactccctagacaa

SEQ ID NO: 580207 - DNA, 25 bp, Mus musculus
catggaccgtggtctccctagacaa

SEQ ID NO: 580208 - DNA, 25 bp, Mus musculus
catggacctactagaggtagccacc

SEQ ID NO: 580209 - DNA, 25 bp, Mus musculus
catggacctacttgaggtagccacc

SEQ ID NO: 580210 - DNA, 25 bp, Mus musculus
catggacctgtccaactcagtgata

SEQ ID NO: 580211 - DNA, 25 bp, Mus musculus
catggacctgtcgaactcagtgata

SEQ ID NO: 580212 - DNA, 25 bp, Mus musculus
catggaccttttccaaactccctgg

SEQ ID NO: 580213 - DNA, 25 bp, Mus musculus
catggaccttttgcaaactccctgg

SEQ ID NO: 580214 - DNA, 25 bp, Mus musculus
catggacgaaagagaaactcattgc

SEQ ID NO: 580215 - DNA, 25 bp, Mus musculus
catggacgaaagtgaaactcattgc

SEQ ID NO: 580216 - DNA, 25 bp, Mus musculus
catggacgaccgctttgggcagatc

SEQ ID NO: 580217 - DNA, 25 bp, Mus musculus
catggacgaccggtttgggcagatc

SEQ ID NO: 580218 - DNA, 25 bp, Mus musculus
catggacgagaaaggaccttgatgg

SEQ ID NO: 580219 - DNA, 25 bp, Mus musculus
catggacgagaatggaccttgatgg

SEQ ID NO: 580220 - DNA, 25 bp, Mus musculus
catggacgagctagtggagcactac

SEQ ID NO: 580221 - DNA, 25 bp, Mus musculus
catggacgagcttgtggagcactac

SEQ ID NO: 580222 - DNA, 25 bp, Mus musculus
catggacggtcaccttgcggaatcg

SEQ ID NO: 580223 - DNA, 25 bp, Mus musculus
catggacggtcagcttgcggaatcg

SEQ ID NO: 580224 - DNA, 25 bp, Mus musculus
catggacgtagactcctggtgcctc

SEQ ID NO: 580225 - DNA, 25 bp, Mus musculus
catggacgtagagtcctggtgcctc

SEQ ID NO: 580226 - DNA, 25 bp, Mus musculus
catggacgtagccagcgagtacaca

SEQ ID NO: 580227 - DNA, 25 bp, Mus musculus
catggacgtagcgagcgagtacaca

SEQ ID NO: 580228 - DNA, 25 bp, Mus musculus
catggacgtcctcgtctgcaacggg

SEQ ID NO: 580229 - DNA, 25 bp, Mus musculus
catggacgtcctggtctgcaacggg

SEQ ID NO: 580230 - DNA, 25 bp, Mus musculus
catggactccaaagtgaaaaagtac

SEQ ID NO: 580231 - DNA, 25 bp, Mus musculus
catggactccaatgtgaaaaagtac

SEQ ID NO: 580232 - DNA, 25 bp, Mus musculus
catggactccatataacccagtgac

SEQ ID NO: 580233 - DNA, 25 bp, Mus musculus
catggactccatttaacccagtgac

SEQ ID NO: 580234 - DNA, 25 bp, Mus musculus
catggactctgcaagtggctgccca

SEQ ID NO: 580235 - DNA, 25 bp, Mus musculus
catggactctgctagtggctgccca

SEQ ID NO: 580236 - DNA, 25 bp, Mus musculus
catggactctgtcaaggactggtgc

SEQ ID NO: 580237 - DNA, 25 bp, Mus musculus
catggactctgtgaaggactggtgc

SEQ ID NO: 580238 - DNA, 25 bp, Mus musculus
catggactgcatcaacaagctaaaa

SEQ ID NO: 580239 - DNA, 25 bp, Mus musculus
catggactgcatgaacaagctaaaa

SEQ ID NO: 580240 - DNA, 25 bp, Mus musculus
catggactgtccagcaggccactga

SEQ ID NO: 580241 - DNA, 25 bp, Mus musculus
catggactgtcctgcaggccactga

SEQ ID NO: 580242 - DNA, 25 bp, Mus musculus
catggactgtctcgcgcttcttcct

SEQ ID NO: 580243 - DNA, 25 bp, Mus musculus
catggactgtctggcgcttcttcct

SEQ ID NO: 580244 - DNA, 25 bp, Mus musculus
catggacttgaacgagtcgttagcg

SEQ ID NO: 580245 - DNA, 25 bp, Mus musculus
catggacttgaaggagtcgttagcg

SEQ ID NO: 580246 - DNA, 25 bp, Mus musculus
catggactttaaccctgagttgcct

SEQ ID NO: 580247 - DNA, 25 bp, Mus musculus
catggactttaagcctgagttgcct

SEQ ID NO: 580248 - DNA, 25 bp, Mus musculus
catggagaaaatcgagccaataaac

SEQ ID NO: 580249 - DNA, 25 bp, Mus musculus
catggagaaaatggagccaataaac

SEQ ID NO: 580250 - DNA, 25 bp, Mus musculus
catggagaacccagatagacagccc

SEQ ID NO: 580251 - DNA, 25 bp, Mus musculus
catggagaaccctgatagacagccc

SEQ ID NO: 580252 - DNA, 25 bp, Mus musculus
catggagaacctcatcgagctgcac

SEQ ID NO: 580253 - DNA, 25 bp, Mus musculus
catggagaacctgatcgagctgcac

SEQ ID NO: 580254 - DNA, 25 bp, Mus musculus
catggagaacggctgcctgcttgac

SEQ ID NO: 580255 - DNA, 25 bp, Mus musculus
catggagaacgggtgcctgcttgac

SEQ ID NO: 580256 - DNA, 25 bp, Mus musculus
catggagaagaccaggatgcgcctt

SEQ ID NO: 580257 - DNA, 25 bp, Mus musculus
catggagaagacgaggatgcgcctt

SEQ ID NO: 580258 - DNA, 25 bp, Mus musculus
catggagaatgcactcgcttctgtc

SEQ ID NO: 580259 - DNA, 25 bp, Mus musculus
catggagaatgctctcgcttctgtc

SEQ ID NO: 580260 - DNA, 25 bp, Mus musculus
catggagacagtcagaagccgctgc

SEQ ID NO: 580261 - DNA, 25 bp, Mus musculus
catggagacagtgagaagccgctgc

SEQ ID NO: 580262 - DNA, 25 bp, Mus musculus
catggagacccaaaagagaatgtac

SEQ ID NO: 580263 - DNA, 25 bp, Mus musculus
catggagacccataagagaatgtac

SEQ ID NO: 580264 - DNA, 25 bp, Mus musculus
catggagaccggctggaagaaccgt

SEQ ID NO: 580265 - DNA, 25 bp, Mus musculus
catggagaccgggtggaagaaccgt

SEQ ID NO: 580266 - DNA, 25 bp, Mus musculus
catggagacggtctgctaactacgt

SEQ ID NO: 580267 - DNA, 25 bp, Mus musculus
catggagacggtgtgctaactacgt

SEQ ID NO: 580268 - DNA, 25 bp, Mus musculus
catggagactacaagaaatgattga

SEQ ID NO: 580269 - DNA, 25 bp, Mus musculus
catggagactactagaaatgattga

SEQ ID NO: 580270 - DNA, 25 bp, Mus musculus
catggagagacccactgcctgtgga

SEQ ID NO: 580271 - DNA, 25 bp, Mus musculus
catggagagaccgactgcctgtgga

SEQ ID NO: 580272 - DNA, 25 bp, Mus musculus
catggagagcagaggccatgctgca

SEQ ID NO: 580273 - DNA, 25 bp, Mus musculus
catggagagcagtggccatgctgca

SEQ ID NO: 580274 - DNA, 25 bp, Mus musculus
catggagagccaccagcgggaccat

SEQ ID NO: 580275 - DNA, 25 bp, Mus musculus
catggagagccagcagcgggaccat

SEQ ID NO: 580276 - DNA, 25 bp, Mus musculus
catggagagccgcaagaagacgaaa

SEQ ID NO: 580277 - DNA, 25 bp, Mus musculus
catggagagccggaagaagacgaaa

SEQ ID NO: 580278 - DNA, 25 bp, Mus musculus
catggagagcgaagggatcctactg

SEQ ID NO: 580279 - DNA, 25 bp, Mus musculus
catggagagcgatgggatcctactg

SEQ ID NO: 580280 - DNA, 25 bp, Mus musculus
catggagagttgatggtctgtctgc

SEQ ID NO: 580281 - DNA, 25 bp, Mus musculus
catggagagttgttggtctgtctgc

SEQ ID NO: 580282 - DNA, 25 bp, Mus musculus
catggagatcagattagtcagccag

SEQ ID NO: 580283 - DNA, 25 bp, Mus musculus
catggagatcagtttagtcagccag

SEQ ID NO: 580284 - DNA, 25 bp, Mus musculus
catggagatggactcaagtgcccgc

SEQ ID NO: 580285 - DNA, 25 bp, Mus musculus
catggagatggagtcaagtgcccgc

SEQ ID NO: 580286 - DNA, 25 bp, Mus musculus
catggagatgtgagggtacttactg

SEQ ID NO: 580287 - DNA, 25 bp, Mus musculus
catggagatgtgtgggtacttactg

SEQ ID NO: 580288 - DNA, 25 bp, Mus musculus
catggagatttactgtgagcgagtc

SEQ ID NO: 580289 - DNA, 25 bp, Mus musculus
catggagatttagtgtgagcgagtc

SEQ ID NO: 580290 - DNA, 25 bp, Mus musculus
catggagcatatccaacgccgtcac

SEQ ID NO: 580291 - DNA, 25 bp, Mus musculus
catggagcatatgcaacgccgtcac

SEQ ID NO: 580292 - DNA, 25 bp, Mus musculus
catggagccacacgtcaggtcaggc

SEQ ID NO: 580293 - DNA, 25 bp, Mus musculus
catggagccacaggtcaggtcaggc

SEQ ID NO: 580294 - DNA, 25 bp, Mus musculus
catggagcccacacaggttgcagag

SEQ ID NO: 580295 - DNA, 25 bp, Mus musculus
catggagcccactcaggttgcagag

SEQ ID NO: 580296 - DNA, 25 bp, Mus musculus
catggagcccctataccaacaaacg

SEQ ID NO: 580297 - DNA, 25 bp, Mus musculus
catggagcccctttaccaacaaacg

SEQ ID NO: 580298 - DNA, 25 bp, Mus musculus
catggagcctgcctttcacagaggg

SEQ ID NO: 580299 - DNA, 25 bp, Mus musculus
catggagcctgcgtttcacagaggg

SEQ ID NO: 580300 - DNA, 25 bp, Mus musculus
catggagcgacaaggactggaccat

SEQ ID NO: 580301 - DNA, 25 bp, Mus musculus
catggagcgacacctgaagatccac

SEQ ID NO: 580302 - DNA, 25 bp, Mus musculus
catggagcgacagctgaagatccac

SEQ ID NO: 580303 - DNA, 25 bp, Mus musculus
catggagcgacatggactggaccat

SEQ ID NO: 580304 - DNA, 25 bp, Mus musculus
catggagctaatcaacaatgtcgcc

SEQ ID NO: 580305 - DNA, 25 bp, Mus musculus
catggagctaatgaacaatgtcgcc

SEQ ID NO: 580306 - DNA, 25 bp, Mus musculus
catggagctcatcggcacatgtgca

SEQ ID NO: 580307 - DNA, 25 bp, Mus musculus
catggagctcatgggcacatgtgca

SEQ ID NO: 580308 - DNA, 25 bp, Mus musculus
catggagcttataaatggttatccc

SEQ ID NO: 580309 - DNA, 25 bp, Mus musculus
catggagcttattaatggttatccc

SEQ ID NO: 580310 - DNA, 25 bp, Mus musculus
catggagctttactggtaaaagcga

SEQ ID NO: 580311 - DNA, 25 bp, Mus musculus
catggagctttagtggtaaaagcga

SEQ ID NO: 580312 - DNA, 25 bp, Mus musculus
catggaggaaggactctaacccagg

SEQ ID NO: 580313 - DNA, 25 bp, Mus musculus
catggaggaaggtctctaacccagg

SEQ ID NO: 580314 - DNA, 25 bp, Mus musculus
catggaggagcaacatcaggaagct

SEQ ID NO: 580315 - DNA, 25 bp, Mus musculus
catggaggagcatcatcaggaagct

SEQ ID NO: 580316 - DNA, 25 bp, Mus musculus
catggaggatctacgcaaccgactc

SEQ ID NO: 580317 - DNA, 25 bp, Mus musculus
catggaggatcttcgcaaccgactc

SEQ ID NO: 580318 - DNA, 25 bp, Mus musculus
catggaggcactcgccttagctgag

SEQ ID NO: 580319 - DNA, 25 bp, Mus musculus
catggaggcactggccttagctgag

SEQ ID NO: 580320 - DNA, 25 bp, Mus musculus
catggaggcctaagacaagaagata

SEQ ID NO: 580321 - DNA, 25 bp, Mus musculus
catggaggcctatgacaagaagata

SEQ ID NO: 580322 - DNA, 25 bp, Mus musculus
catggaggcctcatctacttccagg

SEQ ID NO: 580323 - DNA, 25 bp, Mus musculus
catggaggcctcttctacttccagg

SEQ ID NO: 580324 - DNA, 25 bp, Mus musculus
catggaggctggcaactactggttt

SEQ ID NO: 580325 - DNA, 25 bp, Mus musculus
catggaggctgggaactactggttt

SEQ ID NO: 580326 - DNA, 25 bp, Mus musculus
catggaggcttcacaggagggacac

SEQ ID NO: 580327 - DNA, 25 bp, Mus musculus
catggaggcttctcaggagggacac

SEQ ID NO: 580328 - DNA, 25 bp, Mus musculus
catggaggctttctttcggcgccgc

SEQ ID NO: 580329 - DNA, 25 bp, Mus musculus
catggaggctttgtttcggcgccgc

SEQ ID NO: 580330 - DNA, 25 bp, Mus musculus
catggagggcaacgccgactttgct

SEQ ID NO: 580331 - DNA, 25 bp, Mus musculus
catggagggcaaggccgactttgct

SEQ ID NO: 580332 - DNA, 25 bp, Mus musculus
catggagggtgtcattacaccacta

SEQ ID NO: 580333 - DNA, 25 bp, Mus musculus
catggagggtgtgattacaccacta

SEQ ID NO: 580334 - DNA, 25 bp, Mus musculus
catggagggttgagagccctatgct

SEQ ID NO: 580335 - DNA, 25 bp, Mus musculus
catggagggttgtgagccctatgct

SEQ ID NO: 580336 - DNA, 25 bp, Mus musculus
catggaggtacgcagccttgttacc

SEQ ID NO: 580337 - DNA, 25 bp, Mus musculus
catggaggtacggagccttgttacc

SEQ ID NO: 580338 - DNA, 25 bp, Mus musculus
catggaggtgaacagaactgacgac

SEQ ID NO: 580339 - DNA, 25 bp, Mus musculus
catggaggtgaagagaactgacgac

SEQ ID NO: 580340 - DNA, 25 bp, Mus musculus
catggaggtgacagtcctaactcac

SEQ ID NO: 580341 - DNA, 25 bp, Mus musculus
catggaggtgactgtcctaactcac

SEQ ID NO: 580342 - DNA, 25 bp, Mus musculus
catggaggttcgaccagggtgcaac

SEQ ID NO: 580343 - DNA, 25 bp, Mus musculus
catggaggttcgtccagggtgcaac

SEQ ID NO: 580344 - DNA, 25 bp, Mus musculus
catggagtatagctgtggcactgca

SEQ ID NO: 580345 - DNA, 25 bp, Mus musculus
catggagtataggtgtggcactgca

SEQ ID NO: 580346 - DNA, 25 bp, Mus musculus
catggagtccatatgggagactgaa

SEQ ID NO: 580347 - DNA, 25 bp, Mus musculus
catggagtccatttgggagactgaa

SEQ ID NO: 580348 - DNA, 25 bp, Mus musculus
catggagtccttacctggtatagga

SEQ ID NO: 580349 - DNA, 25 bp, Mus musculus
catggagtcctttcctggtatagga

SEQ ID NO: 580350 - DNA, 25 bp, Mus musculus
catggagtcgtccaccgctgtgtaa

SEQ ID NO: 580351 - DNA, 25 bp, Mus musculus
catggagtcgtcgaccgctgtgtaa

SEQ ID NO: 580352 - DNA, 25 bp, Mus musculus
catggagtctttcacacagtgtttc

SEQ ID NO: 580353 - DNA, 25 bp, Mus musculus
catggagtctttgacacagtgtttc

SEQ ID NO: 580354 - DNA, 25 bp, Mus musculus
catggagtgcaacctcggtgaaatc

SEQ ID NO: 580355 - DNA, 25 bp, Mus musculus
catggagtgcaagctcggtgaaatc

SEQ ID NO: 580356 - DNA, 25 bp, Mus musculus
catggagtgcttccgagaagctgcc

SEQ ID NO: 580357 - DNA, 25 bp, Mus musculus
catggagtgcttgcgagaagctgcc

SEQ ID NO: 580358 - DNA, 25 bp, Mus musculus
catggagtggatccctattcacacc

SEQ ID NO: 580359 - DNA, 25 bp, Mus musculus
catggagtggatgcctattcacacc

SEQ ID NO: 580360 - DNA, 25 bp, Mus musculus
catggagtggccactcaggctgaca

SEQ ID NO: 580361 - DNA, 25 bp, Mus musculus
catggagtggcctctcaggctgaca

SEQ ID NO: 580362 - DNA, 25 bp, Mus musculus
catggagttacacccagaggacacg

SEQ ID NO: 580363 - DNA, 25 bp, Mus musculus
catggagttacagccagaggacacg

SEQ ID NO: 580364 - DNA, 25 bp, Mus musculus
catggagttgtgctctcaacggctc

SEQ ID NO: 580365 - DNA, 25 bp, Mus musculus
catggagttgtggtctcaacggctc

SEQ ID NO: 580366 - DNA, 25 bp, Mus musculus
catggagtttgaactgaatggaaat

SEQ ID NO: 580367 - DNA, 25 bp, Mus musculus
catggagtttgatctgaatggaaat

SEQ ID NO: 580368 - DNA, 25 bp, Mus musculus
catggatacagtcacagaggctgat

SEQ ID NO: 580369 - DNA, 25 bp, Mus musculus
catggatacagtgacagaggctgat

SEQ ID NO: 580370 - DNA, 25 bp, Mus musculus
catggatatcagagaaagaaatcca

SEQ ID NO: 580371 - DNA, 25 bp, Mus musculus
catggatatcagtgaaagaaatcca

SEQ ID NO: 580372 - DNA, 25 bp, Mus musculus
catggatatgaacaaggccattgcc

SEQ ID NO: 580373 - DNA, 25 bp, Mus musculus
catggatatgaagaaggccattgcc

SEQ ID NO: 580374 - DNA, 25 bp, Mus musculus
catggatcaaacatgctgtcctcag

SEQ ID NO: 580375 - DNA, 25 bp, Mus musculus
catggatcaaacttgctgtcctcag

SEQ ID NO: 580376 - DNA, 25 bp, Mus musculus
catggatcacctaacaacagcgatt

SEQ ID NO: 580377 - DNA, 25 bp, Mus musculus
catggatcaccttacaacagcgatt

SEQ ID NO: 580378 - DNA, 25 bp, Mus musculus
catggatccaaacaactaggtgggc

SEQ ID NO: 580379 - DNA, 25 bp, Mus musculus
catggatccaaagaactaggtgggc

SEQ ID NO: 580380 - DNA, 25 bp, Mus musculus
catggatccccacagctggtacgaa

SEQ ID NO: 580381 - DNA, 25 bp, Mus musculus
catggatccccagagctggtacgaa

SEQ ID NO: 580382 - DNA, 25 bp, Mus musculus
catggatcccttatcgattacttga

SEQ ID NO: 580383 - DNA, 25 bp, Mus musculus
catggatcccttttcgattacttga

SEQ ID NO: 580384 - DNA, 25 bp, Mus musculus
catggatcgaagactcaggttcttc

SEQ ID NO: 580385 - DNA, 25 bp, Mus musculus
catggatcgaagtctcaggttcttc

SEQ ID NO: 580386 - DNA, 25 bp, Mus musculus
catggatcgcgaagaggaacctctg

SEQ ID NO: 580387 - DNA, 25 bp, Mus musculus
catggatcgcgatgaggaacctctg

SEQ ID NO: 580388 - DNA, 25 bp, Mus musculus
catggatcgctgagaccaggtggct

SEQ ID NO: 580389 - DNA, 25 bp, Mus musculus
catggatcgctgtgaccaggtggct

SEQ ID NO: 580390 - DNA, 25 bp, Mus musculus
catggatgaatcactgcagtttaac

SEQ ID NO: 580391 - DNA, 25 bp, Mus musculus
catggatgaatctctgcagtttaac

SEQ ID NO: 580392 - DNA, 25 bp, Mus musculus
catggatgaatgagacaacacactc

SEQ ID NO: 580393 - DNA, 25 bp, Mus musculus
catggatgaatgtgacaacacactc

SEQ ID NO: 580394 - DNA, 25 bp, Mus musculus
catggatgacatactgtttgaggac

SEQ ID NO: 580395 - DNA, 25 bp, Mus musculus
catggatgacatcaagctgctggaa

SEQ ID NO: 580396 - DNA, 25 bp, Mus musculus
catggatgacatgaagctgctggaa

SEQ ID NO: 580397 - DNA, 25 bp, Mus musculus
catggatgacattctgtttgaggac

SEQ ID NO: 580398 - DNA, 25 bp, Mus musculus
catggatgcagtcattcgggagtac

SEQ ID NO: 580399 - DNA, 25 bp, Mus musculus
catggatgcagtgattcgggagtac

SEQ ID NO: 580400 - DNA, 25 bp, Mus musculus
catggatgccaccagtgagagagac

SEQ ID NO: 580401 - DNA, 25 bp, Mus musculus
catggatgccacgagtgagagagac

SEQ ID NO: 580402 - DNA, 25 bp, Mus musculus
catggatggcataaaaggagaggaa

SEQ ID NO: 580403 - DNA, 25 bp, Mus musculus
catggatggcattaaaggagaggaa

SEQ ID NO: 580404 - DNA, 25 bp, Mus musculus
catggatggcctaaagcagagagca

SEQ ID NO: 580405 - DNA, 25 bp, Mus musculus
catggatggcctctttggtacaatc

SEQ ID NO: 580406 - DNA, 25 bp, Mus musculus
catggatggcctgtttggtacaatc

SEQ ID NO: 580407 - DNA, 25 bp, Mus musculus
catggatggccttaagcagagagca

SEQ ID NO: 580408 - DNA, 25 bp, Mus musculus
catggatgtggtctcaggacgctcc

SEQ ID NO: 580409 - DNA, 25 bp, Mus musculus
catggatgtggtgtcaggacgctcc

SEQ ID NO: 580410 - DNA, 25 bp, Mus musculus
catggatgtttccttcgcagagggc

SEQ ID NO: 580411 - DNA, 25 bp, Mus musculus
catggatgtttcgttcgcagagggc

SEQ ID NO: 580412 - DNA, 25 bp, Mus musculus
catggatgttttctaagtgttggca

SEQ ID NO: 580413 - DNA, 25 bp, Mus musculus
catggatgttttgtaagtgttggca

SEQ ID NO: 580414 - DNA, 25 bp, Mus musculus
catggattattaaaaactggacacc

SEQ ID NO: 580415 - DNA, 25 bp, Mus musculus
catggattattataaactggacacc

SEQ ID NO: 580416 - DNA, 25 bp, Mus musculus
catggattcaaaattcaaactgtgg

SEQ ID NO: 580417 - DNA, 25 bp, Mus musculus
catggattcaaatttcaaactgtgg

SEQ ID NO: 580418 - DNA, 25 bp, Mus musculus
catggattcacaaaaactgaatggt

SEQ ID NO: 580419 - DNA, 25 bp, Mus musculus
catggattcacataaactgaatggt

SEQ ID NO: 580420 - DNA, 25 bp, Mus musculus
catggattctacagtggaggatgct

SEQ ID NO: 580421 - DNA, 25 bp, Mus musculus
catggattctactgtggaggatgct

SEQ ID NO: 580422 - DNA, 25 bp, Mus musculus
catggatttcagaactacctgtgag

SEQ ID NO: 580423 - DNA, 25 bp, Mus musculus
catggatttcagtactacctgtgag

SEQ ID NO: 580424 - DNA, 25 bp, Mus musculus
catggatttcatagtggctgcatcc

SEQ ID NO: 580425 - DNA, 25 bp, Mus musculus
catggatttcattgtggctgcatcc

SEQ ID NO: 580426 - DNA, 25 bp, Mus musculus
catggatttttcagatcaattgtgc

SEQ ID NO: 580427 - DNA, 25 bp, Mus musculus
catggatttttctgatcaattgtgc

SEQ ID NO: 580428 - DNA, 25 bp, Mus musculus
catggcaaaagtacacagactgttg

SEQ ID NO: 580429 - DNA, 25 bp, Mus musculus
catggcaaaagttcacagactgttg

SEQ ID NO: 580430 - DNA, 25 bp, Mus musculus
catggcaaacttctactggcttctg

SEQ ID NO: 580431 - DNA, 25 bp, Mus musculus
catggcaaacttgtactggcttctg

SEQ ID NO: 580432 - DNA, 25 bp, Mus musculus
catggcaaatacagtggtggagcct

SEQ ID NO: 580433 - DNA, 25 bp, Mus musculus
catggcaaatactgtggtggagcct

SEQ ID NO: 580434 - DNA, 25 bp, Mus musculus
catggcaacaagagcaccatcccat

SEQ ID NO: 580435 - DNA, 25 bp, Mus musculus
catggcaacaagtgcaccatcccat

SEQ ID NO: 580436 - DNA, 25 bp, Mus musculus
catggcaacgcactgtacttgtttg

SEQ ID NO: 580437 - DNA, 25 bp, Mus musculus
catggcaacgcagtgtacttgtttg

SEQ ID NO: 580438 - DNA, 25 bp, Mus musculus
catggcaactggaaagtccaaaggc

SEQ ID NO: 580439 - DNA, 25 bp, Mus musculus
catggcaactggtaagtccaaaggc

SEQ ID NO: 580440 - DNA, 25 bp, Mus musculus
catggcaagaaactgataactgcct

SEQ ID NO: 580441 - DNA, 25 bp, Mus musculus
catggcaagaaagtgataactgcct

SEQ ID NO: 580442 - DNA, 25 bp, Mus musculus
catggcaagctacttgggtattggc

SEQ ID NO: 580443 - DNA, 25 bp, Mus musculus
catggcaagctagttgggtattggc

SEQ ID NO: 580444 - DNA, 25 bp, Mus musculus
catggcaagtcgacagtacgtctac

SEQ ID NO: 580445 - DNA, 25 bp, Mus musculus
catggcaagtcgtcagtacgtctac

SEQ ID NO: 580446 - DNA, 25 bp, Mus musculus
catggcaagtgtagtgtctcctggg

SEQ ID NO: 580447 - DNA, 25 bp, Mus musculus
catggcaagtgttgtgtctcctggg

SEQ ID NO: 580448 - DNA, 25 bp, Mus musculus
catggcaatacaaaggatcaagaga

SEQ ID NO: 580449 - DNA, 25 bp, Mus musculus
catggcaatacataggatcaagaga

SEQ ID NO: 580450 - DNA, 25 bp, Mus musculus
catggcaccagacagggtcacttct

SEQ ID NO: 580451 - DNA, 25 bp, Mus musculus
catggcaccagagagggtcacttct

SEQ ID NO: 580452 - DNA, 25 bp, Mus musculus
catggcaccctcacagtttgctgct

SEQ ID NO: 580453 - DNA, 25 bp, Mus musculus
catggcaccctctcagtttgctgct

SEQ ID NO: 580454 - DNA, 25 bp, Mus musculus
catggcaccgctagggcagtttgtg

SEQ ID NO: 580455 - DNA, 25 bp, Mus musculus
catggcaccgcttgggcagtttgtg

SEQ ID NO: 580456 - DNA, 25 bp, Mus musculus
catggcacctcgctcaaggagaagc

SEQ ID NO: 580457 - DNA, 25 bp, Mus musculus
catggcacctcggtcaaggagaagc

SEQ ID NO: 580458 - DNA, 25 bp, Mus musculus
catggcacgccacctgtgttggtaa

SEQ ID NO: 580459 - DNA, 25 bp, Mus musculus
catggcacgccagctgtgttggtaa

SEQ ID NO: 580460 - DNA, 25 bp, Mus musculus
catggcacgcttaggcttgctcgcg

SEQ ID NO: 580461 - DNA, 25 bp, Mus musculus
catggcacgctttggcttgctcgcg

SEQ ID NO: 580462 - DNA, 25 bp, Mus musculus
catggcacgtgtcaggtttgtgaaa

SEQ ID NO: 580463 - DNA, 25 bp, Mus musculus
catggcacgtgtgaggtttgtgaaa

SEQ ID NO: 580464 - DNA, 25 bp, Mus musculus
catggcactacacggctgtgatgaa

SEQ ID NO: 580465 - DNA, 25 bp, Mus musculus
catggcactacagggctgtgatgaa

SEQ ID NO: 580466 - DNA, 25 bp, Mus musculus
catggcactctcagaaatgaaggtt

SEQ ID NO: 580467 - DNA, 25 bp, Mus musculus
catggcactctctgaaatgaaggtt

SEQ ID NO: 580468 - DNA, 25 bp, Mus musculus
catggcactggcctcctgattgaga

SEQ ID NO: 580469 - DNA, 25 bp, Mus musculus
catggcactggcgtcctgattgaga

SEQ ID NO: 580470 - DNA, 25 bp, Mus musculus
catggcagaagcaattggcatcgac

SEQ ID NO: 580471 - DNA, 25 bp, Mus musculus
catggcagaagctattggcatcgac

SEQ ID NO: 580472 - DNA, 25 bp, Mus musculus
catggcagacccagacttctgggca

SEQ ID NO: 580473 - DNA, 25 bp, Mus musculus
catggcagaccctgacttctgggca

SEQ ID NO: 580474 - DNA, 25 bp, Mus musculus
catggcagagatctggactcgtagc

SEQ ID NO: 580475 - DNA, 25 bp, Mus musculus
catggcagagatgtggactcgtagc

SEQ ID NO: 580476 - DNA, 25 bp, Mus musculus
catggcagatatcgatgagctcttc

SEQ ID NO: 580477 - DNA, 25 bp, Mus musculus
catggcagatatggatgagctcttc

SEQ ID NO: 580478 - DNA, 25 bp, Mus musculus
catggcagatgcaatgtggagactc

SEQ ID NO: 580479 - DNA, 25 bp, Mus musculus
catggcagatgctatgtggagactc

SEQ ID NO: 580480 - DNA, 25 bp, Mus musculus
catggcagcaagaaaagtgcctgca

SEQ ID NO: 580481 - DNA, 25 bp, Mus musculus
catggcagcaagtaaagtgcctgca

SEQ ID NO: 580482 - DNA, 25 bp, Mus musculus
catggcagcagcaactacactgggc

SEQ ID NO: 580483 - DNA, 25 bp, Mus musculus
catggcagcagctactacactgggc

SEQ ID NO: 580484 - DNA, 25 bp, Mus musculus
catggcagcctgcatgaagtctgtc

SEQ ID NO: 580485 - DNA, 25 bp, Mus musculus
catggcagcctggatgaagtctgtc

SEQ ID NO: 580486 - DNA, 25 bp, Mus musculus
catggcagcgctcagcaatgtccgc

SEQ ID NO: 580487 - DNA, 25 bp, Mus musculus
catggcagcgctgagcaatgtccgc

SEQ ID NO: 580488 - DNA, 25 bp, Mus musculus
catggcagcggcaagctctttgtac

SEQ ID NO: 580489 - DNA, 25 bp, Mus musculus
catggcagcggctagctctttgtac

SEQ ID NO: 580490 - DNA, 25 bp, Mus musculus
catggcagctggcaatactagttca

SEQ ID NO: 580491 - DNA, 25 bp, Mus musculus
catggcagctgggaatactagttca

SEQ ID NO: 580492 - DNA, 25 bp, Mus musculus
catggcaggaatagcatttggcttt

SEQ ID NO: 580493 - DNA, 25 bp, Mus musculus
catggcaggaattgcatttggcttt

SEQ ID NO: 580494 - DNA, 25 bp, Mus musculus
catggcaggaccaaggccagtagtg

SEQ ID NO: 580495 - DNA, 25 bp, Mus musculus
catggcaggacctaggccagtagtg

SEQ ID NO: 580496 - DNA, 25 bp, Mus musculus
catggcaggatccaaccgctccggg

SEQ ID NO: 580497 - DNA, 25 bp, Mus musculus
catggcaggatcgaaccgctccggg

SEQ ID NO: 580498 - DNA, 25 bp, Mus musculus
catggcaggtgtctgttactagtaa

SEQ ID NO: 580499 - DNA, 25 bp, Mus musculus
catggcaggtgtgtgttactagtaa

SEQ ID NO: 580500 - DNA, 25 bp, Mus musculus
catggcagtgtaaggaatgtaagac

SEQ ID NO: 580501 - DNA, 25 bp, Mus musculus
catggcagtgtatggaatgtaagac

SEQ ID NO: 580502 - DNA, 25 bp, Mus musculus
catggcagtgttacctgagggccag

SEQ ID NO: 580503 - DNA, 25 bp, Mus musculus
catggcagtgtttcctgagggccag

SEQ ID NO: 580504 - DNA, 25 bp, Mus musculus
catggcatacaacgacaggtgccag

SEQ ID NO: 580505 - DNA, 25 bp, Mus musculus
catggcatacaaggacaggtgccag

SEQ ID NO: 580506 - DNA, 25 bp, Mus musculus
catggcatcaaccactgtgagggta

SEQ ID NO: 580507 - DNA, 25 bp, Mus musculus
catggcatcaacgactgtgagggta

SEQ ID NO: 580508 - DNA, 25 bp, Mus musculus
catggcatccctactcaagaaggag

SEQ ID NO: 580509 - DNA, 25 bp, Mus musculus
catggcatcccttctcaagaaggag

SEQ ID NO: 580510 - DNA, 25 bp, Mus musculus
catggcatctaacagacagattggg

SEQ ID NO: 580511 - DNA, 25 bp, Mus musculus
catggcatctaagagacagattggg

SEQ ID NO: 580512 - DNA, 25 bp, Mus musculus
catggcatcttcaactggctcacag

SEQ ID NO: 580513 - DNA, 25 bp, Mus musculus
catggcatcttctactggctcacag

SEQ ID NO: 580514 - DNA, 25 bp, Mus musculus
catggcatgggacacaccttcttgg

SEQ ID NO: 580515 - DNA, 25 bp, Mus musculus
catggcatgggagacaccttcttgg

SEQ ID NO: 580516 - DNA, 25 bp, Mus musculus
catggcatgggcattccttccatcg

SEQ ID NO: 580517 - DNA, 25 bp, Mus musculus
catggcatgggctttccttccatcg

SEQ ID NO: 580518 - DNA, 25 bp, Mus musculus
catggccaaaatcgaggtgaaatcc

SEQ ID NO: 580519 - DNA, 25 bp, Mus musculus
catggccaaaatggaggtgaaatcc

SEQ ID NO: 580520 - DNA, 25 bp, Mus musculus
catggccaaactcaaatacctgctg

SEQ ID NO: 580521 - DNA, 25 bp, Mus musculus
catggccaaactgaaatacctgctg

SEQ ID NO: 580522 - DNA, 25 bp, Mus musculus
catggccaaagcaagggccgccctg

SEQ ID NO: 580523 - DNA, 25 bp, Mus musculus
catggccaaagctagggccgccctg

SEQ ID NO: 580524 - DNA, 25 bp, Mus musculus
catggccaacatcgcggtgcagcga

SEQ ID NO: 580525 - DNA, 25 bp, Mus musculus
catggccaacatggcggtgcagcga

SEQ ID NO: 580526 - DNA, 25 bp, Mus musculus
catggccaacgtcgagttgagttcc

SEQ ID NO: 580527 - DNA, 25 bp, Mus musculus
catggccaacgtggagttgagttcc

SEQ ID NO: 580528 - DNA, 25 bp, Mus musculus
catggccaagcactacgactcggtg

SEQ ID NO: 580529 - DNA, 25 bp, Mus musculus
catggccaagcagtacgactcggtg

SEQ ID NO: 580530 - DNA, 25 bp, Mus musculus
catggccacatgagtatctcctttg

SEQ ID NO: 580531 - DNA, 25 bp, Mus musculus
catggccacatgtgtatctcctttg

SEQ ID NO: 580532 - DNA, 25 bp, Mus musculus
catggccagaaaagcatcgttcaga

SEQ ID NO: 580533 - DNA, 25 bp, Mus musculus
catggccagaaatgcatcgttcaga

SEQ ID NO: 580534 - DNA, 25 bp, Mus musculus
catggccagcaacaagtgtcagtgt

SEQ ID NO: 580535 - DNA, 25 bp, Mus musculus
catggccagcaagaagtgtcagtgt

SEQ ID NO: 580536 - DNA, 25 bp, Mus musculus
catggccaggaaccccaccgtgtgt

SEQ ID NO: 580537 - DNA, 25 bp, Mus musculus
catggccaggaagcccaccgtgtgt

SEQ ID NO: 580538 - DNA, 25 bp, Mus musculus
catggccagtttagacataggctag

SEQ ID NO: 580539 - DNA, 25 bp, Mus musculus
catggccagttttgacataggctag

SEQ ID NO: 580540 - DNA, 25 bp, Mus musculus
catggccatgaccattcagatcctc

SEQ ID NO: 580541 - DNA, 25 bp, Mus musculus
catggccatgacgattcagatcctc

SEQ ID NO: 580542 - DNA, 25 bp, Mus musculus
catggccatggacatgcggaaagcc

SEQ ID NO: 580543 - DNA, 25 bp, Mus musculus
catggccatggagatgcggaaagcc

SEQ ID NO: 580544 - DNA, 25 bp, Mus musculus
catggccatgttactatgcaaggag

SEQ ID NO: 580545 - DNA, 25 bp, Mus musculus
catggccatgtttctatgcaaggag

SEQ ID NO: 580546 - DNA, 25 bp, Mus musculus
catggcccactacactgtctttaag

SEQ ID NO: 580547 - DNA, 25 bp, Mus musculus
catggcccactagactgtctttaag

SEQ ID NO: 580548 - DNA, 25 bp, Mus musculus
catggcccagcgaacacaatatctt

SEQ ID NO: 580549 - DNA, 25 bp, Mus musculus
catggcccagcgatctggacaaagg

SEQ ID NO: 580550 - DNA, 25 bp, Mus musculus
catggcccagcgtacacaatatctt

SEQ ID NO: 580551 - DNA, 25 bp, Mus musculus
catggcccagcgttctggacaaagg

SEQ ID NO: 580552 - DNA, 25 bp, Mus musculus
catggcccagctagagacttgtgtg

SEQ ID NO: 580553 - DNA, 25 bp, Mus musculus
catggcccagcttgagacttgtgtg

SEQ ID NO: 580554 - DNA, 25 bp, Mus musculus
catggcccaggcacttcaagaatac

SEQ ID NO: 580555 - DNA, 25 bp, Mus musculus
catggcccaggctcttcaagaatac

SEQ ID NO: 580556 - DNA, 25 bp, Mus musculus
catggcccgcggagaccaatttttt

SEQ ID NO: 580557 - DNA, 25 bp, Mus musculus
catggcccgcggtgaccaatttttt

SEQ ID NO: 580558 - DNA, 25 bp, Mus musculus
catggcccggagaagctgtctgaga

SEQ ID NO: 580559 - DNA, 25 bp, Mus musculus
catggcccggagtagctgtctgaga

SEQ ID NO: 580560 - DNA, 25 bp, Mus musculus
catggccctgagattgtatcgacag

SEQ ID NO: 580561 - DNA, 25 bp, Mus musculus
catggccctgagtttgtatcgacag

SEQ ID NO: 580562 - DNA, 25 bp, Mus musculus
catggccctggcctgcaaagatcgc

SEQ ID NO: 580563 - DNA, 25 bp, Mus musculus
catggccctggcgtgcaaagatcgc

SEQ ID NO: 580564 - DNA, 25 bp, Mus musculus
catggccgacaacatgaagaagatc

SEQ ID NO: 580565 - DNA, 25 bp, Mus musculus
catggccgacaagatgaagaagatc

SEQ ID NO: 580566 - DNA, 25 bp, Mus musculus
catggccgagaacctgaacctcact

SEQ ID NO: 580567 - DNA, 25 bp, Mus musculus
catggccgagaagctgaacctcact

SEQ ID NO: 580568 - DNA, 25 bp, Mus musculus
catggccgccatcctgtttgagaag

SEQ ID NO: 580569 - DNA, 25 bp, Mus musculus
catggccgccatgctgtttgagaag

SEQ ID NO: 580570 - DNA, 25 bp, Mus musculus
catggccgccctccgggccaaggaa

SEQ ID NO: 580571 - DNA, 25 bp, Mus musculus
catggccgccctgcgggccaaggaa

SEQ ID NO: 580572 - DNA, 25 bp, Mus musculus
catggccgctgcctgatagaagacc

SEQ ID NO: 580573 - DNA, 25 bp, Mus musculus
catggccgctgcgtgatagaagacc

SEQ ID NO: 580574 - DNA, 25 bp, Mus musculus
catggcctactaagacttcaatggg

SEQ ID NO: 580575 - DNA, 25 bp, Mus musculus
catggcctactatgacttcaatggg

SEQ ID NO: 580576 - DNA, 25 bp, Mus musculus
catggcctatatccgtggtgtgtac

SEQ ID NO: 580577 - DNA, 25 bp, Mus musculus
catggcctatatgcgtggtgtgtac

SEQ ID NO: 580578 - DNA, 25 bp, Mus musculus
catggcctcaaacgccatatcatct

SEQ ID NO: 580579 - DNA, 25 bp, Mus musculus
catggcctcaaaggccatatcatct

SEQ ID NO: 580580 - DNA, 25 bp, Mus musculus
catggcctccacaggttgcagaaaa

SEQ ID NO: 580581 - DNA, 25 bp, Mus musculus
catggcctccactggttgcagaaaa

SEQ ID NO: 580582 - DNA, 25 bp, Mus musculus
catggcctcggtcgtggaatacaag

SEQ ID NO: 580583 - DNA, 25 bp, Mus musculus
catggcctcggtggtggaatacaag

SEQ ID NO: 580584 - DNA, 25 bp, Mus musculus
catggcctgggcactagtgtgtaaa

SEQ ID NO: 580585 - DNA, 25 bp, Mus musculus
catggcctgggctctagtgtgtaaa

SEQ ID NO: 580586 - DNA, 25 bp, Mus musculus
catggcctgtgactccccattctag

SEQ ID NO: 580587 - DNA, 25 bp, Mus musculus
catggcctgtgagtccccattctag

SEQ ID NO: 580588 - DNA, 25 bp, Mus musculus
catggccttgagcttgctgagactc

SEQ ID NO: 580589 - DNA, 25 bp, Mus musculus
catggccttgaggttgctgagactc

SEQ ID NO: 580590 - DNA, 25 bp, Mus musculus
catggcgaggttcacaagccagccc

SEQ ID NO: 580591 - DNA, 25 bp, Mus musculus
catggcgaggttgacaagccagccc

SEQ ID NO: 580592 - DNA, 25 bp, Mus musculus
catggcgcaaagctcaggaagtctg

SEQ ID NO: 580593 - DNA, 25 bp, Mus musculus
catggcgcaaaggtcaggaagtctg

SEQ ID NO: 580594 - DNA, 25 bp, Mus musculus
catggcgcaggacaacgccgctttc

SEQ ID NO: 580595 - DNA, 25 bp, Mus musculus
catggcgcaggagaacgccgctttc

SEQ ID NO: 580596 - DNA, 25 bp, Mus musculus
catggcgcattacaacttcaagaag

SEQ ID NO: 580597 - DNA, 25 bp, Mus musculus
catggcgcattagaacttcaagaag

SEQ ID NO: 580598 - DNA, 25 bp, Mus musculus
catggcgctggaagggatgatccta

SEQ ID NO: 580599 - DNA, 25 bp, Mus musculus
catggcgctggatgggatgatccta

SEQ ID NO: 580600 - DNA, 25 bp, Mus musculus
catggcgcttgtcccctgccaggtg

SEQ ID NO: 580601 - DNA, 25 bp, Mus musculus
catggcgcttgtgccctgccaggtg

SEQ ID NO: 580602 - DNA, 25 bp, Mus musculus
catggcggaagaacttccttcgcgt

SEQ ID NO: 580603 - DNA, 25 bp, Mus musculus
catggcggaagatcttccttcgcgt

SEQ ID NO: 580604 - DNA, 25 bp, Mus musculus
catggcggagtcctcagcggccact

SEQ ID NO: 580605 - DNA, 25 bp, Mus musculus
catggcggagtcgtcagcggccact

SEQ ID NO: 580606 - DNA, 25 bp, Mus musculus
catggcggccgtatttgatttagac

SEQ ID NO: 580607 - DNA, 25 bp, Mus musculus
catggcggccgtttttgatttagac

SEQ ID NO: 580608 - DNA, 25 bp, Mus musculus
catggcggtgagacttcctggatca

SEQ ID NO: 580609 - DNA, 25 bp, Mus musculus
catggcggtgagtcttcctggatca

SEQ ID NO: 580610 - DNA, 25 bp, Mus musculus
catggcgtctaaagagcaggacagt

SEQ ID NO: 580611 - DNA, 25 bp, Mus musculus
catggcgtctaatgagcaggacagt

SEQ ID NO: 580612 - DNA, 25 bp, Mus musculus
catggcgtgcctagtgaccctggag

SEQ ID NO: 580613 - DNA, 25 bp, Mus musculus
catggcgtgccttgtgaccctggag

SEQ ID NO: 580614 - DNA, 25 bp, Mus musculus
catggcgtggttagaaatcctgacc

SEQ ID NO: 580615 - DNA, 25 bp, Mus musculus
catggcgtggtttgaaatcctgacc

SEQ ID NO: 580616 - DNA, 25 bp, Mus musculus
catggcgttcctattactgaccgaa

SEQ ID NO: 580617 - DNA, 25 bp, Mus musculus
catggcgttccttttactgaccgaa

SEQ ID NO: 580618 - DNA, 25 bp, Mus musculus
catggcgttgtccatgtacctgtca

SEQ ID NO: 580619 - DNA, 25 bp, Mus musculus
catggcgttgtcgatgtacctgtca

SEQ ID NO: 580620 - DNA, 25 bp, Mus musculus
catggctaaaaaacaggcctggctt

SEQ ID NO: 580621 - DNA, 25 bp, Mus musculus
catggctaaaaatcaggcctggctt

SEQ ID NO: 580622 - DNA, 25 bp, Mus musculus
catggctacatcagcaaatctggac

SEQ ID NO: 580623 - DNA, 25 bp, Mus musculus
catggctacatctgcaaatctggac

SEQ ID NO: 580624 - DNA, 25 bp, Mus musculus
catggctaccggcaagtctaaggga

SEQ ID NO: 580625 - DNA, 25 bp, Mus musculus
catggctaccgggaagtctaaggga

SEQ ID NO: 580626 - DNA, 25 bp, Mus musculus
catggctacgatcttgccaaggtct

SEQ ID NO: 580627 - DNA, 25 bp, Mus musculus
catggctacgatgttgccaaggtct

SEQ ID NO: 580628 - DNA, 25 bp, Mus musculus
catggctatgttaccttcaggttaa

SEQ ID NO: 580629 - DNA, 25 bp, Mus musculus
catggctatgtttccttcaggttaa

SEQ ID NO: 580630 - DNA, 25 bp, Mus musculus
catggctcatggcagaggtgctgca

SEQ ID NO: 580631 - DNA, 25 bp, Mus musculus
catggctcatgggagaggtgctgca

SEQ ID NO: 580632 - DNA, 25 bp, Mus musculus
catggctccatcactgtgaccctgg

SEQ ID NO: 580633 - DNA, 25 bp, Mus musculus
catggctccatctctgtgaccctgg

SEQ ID NO: 580634 - DNA, 25 bp, Mus musculus
catggctcccgaaatcatccgaagc

SEQ ID NO: 580635 - DNA, 25 bp, Mus musculus
catggctcccgatatcatccgaagc

SEQ ID NO: 580636 - DNA, 25 bp, Mus musculus
catggctccgcgcttgtgcatcatc

SEQ ID NO: 580637 - DNA, 25 bp, Mus musculus
catggctccgcggttgtgcatcatc

SEQ ID NO: 580638 - DNA, 25 bp, Mus musculus
catggctcctttcacctggatgtca

SEQ ID NO: 580639 - DNA, 25 bp, Mus musculus
catggctcctttgacctggatgtca

SEQ ID NO: 580640 - DNA, 25 bp, Mus musculus
catggctctttaagccgacgttagt

SEQ ID NO: 580641 - DNA, 25 bp, Mus musculus
catggctctttatgccgacgttagt

SEQ ID NO: 580642 - DNA, 25 bp, Mus musculus
catggctgaagcagtgggaatcgat

SEQ ID NO: 580643 - DNA, 25 bp, Mus musculus
catggctgaagctgtgggaatcgat

SEQ ID NO: 580644 - DNA, 25 bp, Mus musculus
catggctgacacaaagctgtttgta

SEQ ID NO: 580645 - DNA, 25 bp, Mus musculus
catggctgacactaagctgtttgta

SEQ ID NO: 580646 - DNA, 25 bp, Mus musculus
catggctgactgctactttgggaaa

SEQ ID NO: 580647 - DNA, 25 bp, Mus musculus
catggctgactggtactttgggaaa

SEQ ID NO: 580648 - DNA, 25 bp, Mus musculus
catggctgagagactgaatacgggt

SEQ ID NO: 580649 - DNA, 25 bp, Mus musculus
catggctgagagtctgaatacgggt

SEQ ID NO: 580650 - DNA, 25 bp, Mus musculus
catggctgagctcttgaccggaaga

SEQ ID NO: 580651 - DNA, 25 bp, Mus musculus
catggctgagctgttgaccggaaga

SEQ ID NO: 580652 - DNA, 25 bp, Mus musculus
catggctgcaaaactctgaagaaag

SEQ ID NO: 580653 - DNA, 25 bp, Mus musculus
catggctgcaaatctctgaagaaag

SEQ ID NO: 580654 - DNA, 25 bp, Mus musculus
catggctgcagcaccgtggaaagga

SEQ ID NO: 580655 - DNA, 25 bp, Mus musculus
catggctgcagctccgtggaaagga

SEQ ID NO: 580656 - DNA, 25 bp, Mus musculus
catggctgccacctgtgagatcagc

SEQ ID NO: 580657 - DNA, 25 bp, Mus musculus
catggctgccacgtgtgagatcagc

SEQ ID NO: 580658 - DNA, 25 bp, Mus musculus
catggctgcgacaagttgttccccg

SEQ ID NO: 580659 - DNA, 25 bp, Mus musculus
catggctgcgactagttgttccccg

SEQ ID NO: 580660 - DNA, 25 bp, Mus musculus
catggctgctacctttctgaagaag

SEQ ID NO: 580661 - DNA, 25 bp, Mus musculus
catggctgctacgtttctgaagaag

SEQ ID NO: 580662 - DNA, 25 bp, Mus musculus
catggctggaaacaacacctggttt

SEQ ID NO: 580663 - DNA, 25 bp, Mus musculus
catggctggaaagaacacctggttt

SEQ ID NO: 580664 - DNA, 25 bp, Mus musculus
catggctggactacttgttggagcc

SEQ ID NO: 580665 - DNA, 25 bp, Mus musculus
catggctggacttcttgttggagcc

SEQ ID NO: 580666 - DNA, 25 bp, Mus musculus
catggctggcatagtccagtacaac

SEQ ID NO: 580667 - DNA, 25 bp, Mus musculus
catggctggcattgtccagtacaac

SEQ ID NO: 580668 - DNA, 25 bp, Mus musculus
catggctgtccaccactacatagag

SEQ ID NO: 580669 - DNA, 25 bp, Mus musculus
catggctgtccagcactacatagag

SEQ ID NO: 580670 - DNA, 25 bp, Mus musculus
catggctgtcgcagcaacatcaaag

SEQ ID NO: 580671 - DNA, 25 bp, Mus musculus
catggctgtcgctgcaacatcaaag

SEQ ID NO: 580672 - DNA, 25 bp, Mus musculus
catggctgtcttctcaaacaagggc

SEQ ID NO: 580673 - DNA, 25 bp, Mus musculus
catggctgtcttgtcaaacaagggc

SEQ ID NO: 580674 - DNA, 25 bp, Mus musculus
catggctgtggcaaaatatccaaca

SEQ ID NO: 580675 - DNA, 25 bp, Mus musculus
catggctgtggctaaatatccaaca

SEQ ID NO: 580676 - DNA, 25 bp, Mus musculus
catggctgttatcttctcgaatttt

SEQ ID NO: 580677 - DNA, 25 bp, Mus musculus
catggctgttatgttctcgaatttt

SEQ ID NO: 580678 - DNA, 25 bp, Mus musculus
catggctgttttcgaaaagcaggac

SEQ ID NO: 580679 - DNA, 25 bp, Mus musculus
catggctgttttggaaaagcaggac

SEQ ID NO: 580680 - DNA, 25 bp, Mus musculus
catggcttcaaacctttatgtctag

SEQ ID NO: 580681 - DNA, 25 bp, Mus musculus
catggcttcaaagctttatgtctag

SEQ ID NO: 580682 - DNA, 25 bp, Mus musculus
catggcttccaccaggaggaagtga

SEQ ID NO: 580683 - DNA, 25 bp, Mus musculus
catggcttccacgaggaggaagtga

SEQ ID NO: 580684 - DNA, 25 bp, Mus musculus
catggcttccgtccaagtgaacggc

SEQ ID NO: 580685 - DNA, 25 bp, Mus musculus
catggcttccgtgcaagtgaacggc

SEQ ID NO: 580686 - DNA, 25 bp, Mus musculus
catggcttgttgatggagaaggttt

SEQ ID NO: 580687 - DNA, 25 bp, Mus musculus
catggcttgttgttggagaaggttt

SEQ ID NO: 580688 - DNA, 25 bp, Mus musculus
catggctttgctcgagtgatcctca

SEQ ID NO: 580689 - DNA, 25 bp, Mus musculus
catggctttgctggagtgatcctca

SEQ ID NO: 580690 - DNA, 25 bp, Mus musculus
catgggaaaactcctgtggagatcc

SEQ ID NO: 580691 - DNA, 25 bp, Mus musculus
catgggaaaactgctgtggagatcc

SEQ ID NO: 580692 - DNA, 25 bp, Mus musculus
catgggaaaggaagtcaagcagcac

SEQ ID NO: 580693 - DNA, 25 bp, Mus musculus
catgggaaaggatgtcaagcagcac

SEQ ID NO: 580694 - DNA, 25 bp, Mus musculus
catgggaacaaaccctcccaggagc

SEQ ID NO: 580695 - DNA, 25 bp, Mus musculus
catgggaacaaagcctcccaggagc

SEQ ID NO: 580696 - DNA, 25 bp, Mus musculus
catgggaacatgatctcgccgcgct

SEQ ID NO: 580697 - DNA, 25 bp, Mus musculus
catgggaacatgttctcgccgcgct

SEQ ID NO: 580698 - DNA, 25 bp, Mus musculus
catgggacatgaacaggcctgagca

SEQ ID NO: 580699 - DNA, 25 bp, Mus musculus
catgggacatgatcaggcctgagca

SEQ ID NO: 580700 - DNA, 25 bp, Mus musculus
catgggacggcgacccgagtacaca

SEQ ID NO: 580701 - DNA, 25 bp, Mus musculus
catgggacggcgtcccgagtacaca

SEQ ID NO: 580702 - DNA, 25 bp, Mus musculus
catgggagaaagcatcgtttcctct

SEQ ID NO: 580703 - DNA, 25 bp, Mus musculus
catgggagaaaggatcgtttcctct

SEQ ID NO: 580704 - DNA, 25 bp, Mus musculus
catgggagacaccttcttgggacgt

SEQ ID NO: 580705 - DNA, 25 bp, Mus musculus
catgggagacacgttcttgggacgt

SEQ ID NO: 580706 - DNA, 25 bp, Mus musculus
catgggagacttcaatgctggctgc

SEQ ID NO: 580707 - DNA, 25 bp, Mus musculus
catgggagacttgaatgctggctgc

SEQ ID NO: 580708 - DNA, 25 bp, Mus musculus
catgggagagcacattcaggaacct

SEQ ID NO: 580709 - DNA, 25 bp, Mus musculus
catgggagagcagattcaggaacct

SEQ ID NO: 580710 - DNA, 25 bp, Mus musculus
catgggagcctactttgtacgtggc

SEQ ID NO: 580711 - DNA, 25 bp, Mus musculus
catgggagcctagtttgtacgtggc

SEQ ID NO: 580712 - DNA, 25 bp, Mus musculus
catgggagctttccttgactccacg

SEQ ID NO: 580713 - DNA, 25 bp, Mus musculus
catgggagctttgcttgactccacg

SEQ ID NO: 580714 - DNA, 25 bp, Mus musculus
catgggaggcaaagagtcgagcatc

SEQ ID NO: 580715 - DNA, 25 bp, Mus musculus
catgggaggcaacacatctagagcc

SEQ ID NO: 580716 - DNA, 25 bp, Mus musculus
catgggaggcaagacatctagagcc

SEQ ID NO: 580717 - DNA, 25 bp, Mus musculus
catgggaggcaatgagtcgagcatc

SEQ ID NO: 580718 - DNA, 25 bp, Mus musculus
catgggaggcttcatagaaacagag

SEQ ID NO: 580719 - DNA, 25 bp, Mus musculus
catgggaggcttgatagaaacagag

SEQ ID NO: 580720 - DNA, 25 bp, Mus musculus
catgggatactcagattacaggaca

SEQ ID NO: 580721 - DNA, 25 bp, Mus musculus
catgggatactctgattacaggaca

SEQ ID NO: 580722 - DNA, 25 bp, Mus musculus
catgggatacttcgtgatttatgtg

SEQ ID NO: 580723 - DNA, 25 bp, Mus musculus
catgggatacttggtgatttatgtg

SEQ ID NO: 580724 - DNA, 25 bp, Mus musculus
catgggatcagtacggaaagatatt

SEQ ID NO: 580725 - DNA, 25 bp, Mus musculus
catgggatcagttcggaaagatatt

SEQ ID NO: 580726 - DNA, 25 bp, Mus musculus
catgggatcgtgagctgcacagctt

SEQ ID NO: 580727 - DNA, 25 bp, Mus musculus
catgggatcgtgtgctgcacagctt

SEQ ID NO: 580728 - DNA, 25 bp, Mus musculus
catgggatgatgaaaacctggccaa

SEQ ID NO: 580729 - DNA, 25 bp, Mus musculus
catgggatgatgtaaacctggccaa

SEQ ID NO: 580730 - DNA, 25 bp, Mus musculus
catgggattcacaggacctttgaaa

SEQ ID NO: 580731 - DNA, 25 bp, Mus musculus
catgggattcactggacctttgaaa

SEQ ID NO: 580732 - DNA, 25 bp, Mus musculus
catgggattcatcatggacttacgg

SEQ ID NO: 580733 - DNA, 25 bp, Mus musculus
catgggattcatgatggacttacgg

SEQ ID NO: 580734 - DNA, 25 bp, Mus musculus
catgggattcttcaaccgtgaagca

SEQ ID NO: 580735 - DNA, 25 bp, Mus musculus
catgggattcttgaaccgtgaagca

SEQ ID NO: 580736 - DNA, 25 bp, Mus musculus
catgggattgcacagccaggaatgc

SEQ ID NO: 580737 - DNA, 25 bp, Mus musculus
catgggattgcagagccaggaatgc

SEQ ID NO: 580738 - DNA, 25 bp, Mus musculus
catgggcaaatacctgtggtagagt

SEQ ID NO: 580739 - DNA, 25 bp, Mus musculus
catgggcaaatagctgtggtagagt

SEQ ID NO: 580740 - DNA, 25 bp, Mus musculus
catgggcaacctccagatcgacttt

SEQ ID NO: 580741 - DNA, 25 bp, Mus musculus
catgggcaacctgcagatcgacttt

SEQ ID NO: 580742 - DNA, 25 bp, Mus musculus
catgggcaacgtctacatgctctac

SEQ ID NO: 580743 - DNA, 25 bp, Mus musculus
catgggcaacgtgtacatgctctac

SEQ ID NO: 580744 - DNA, 25 bp, Mus musculus
catgggcaatgcattcctgggcctc

SEQ ID NO: 580745 - DNA, 25 bp, Mus musculus
catgggcaatgctttcctgggcctc

SEQ ID NO: 580746 - DNA, 25 bp, Mus musculus
catgggcacaatccaggaaaggatc

SEQ ID NO: 580747 - DNA, 25 bp, Mus musculus
catgggcacaatgcaggaaaggatc

SEQ ID NO: 580748 - DNA, 25 bp, Mus musculus
catgggcaccaaagtcattgttgct

SEQ ID NO: 580749 - DNA, 25 bp, Mus musculus
catgggcaccaatgtcattgttgct

SEQ ID NO: 580750 - DNA, 25 bp, Mus musculus
catgggcaccgaagccatatcacaa

SEQ ID NO: 580751 - DNA, 25 bp, Mus musculus
catgggcaccgatgccatatcacaa

SEQ ID NO: 580752 - DNA, 25 bp, Mus musculus
catgggcactgaactgggcaaactc

SEQ ID NO: 580753 - DNA, 25 bp, Mus musculus
catgggcactgatctgggcaaactc

SEQ ID NO: 580754 - DNA, 25 bp, Mus musculus
catgggcagcctattcgggcgcgtc

SEQ ID NO: 580755 - DNA, 25 bp, Mus musculus
catgggcagccttttcgggcgcgtc

SEQ ID NO: 580756 - DNA, 25 bp, Mus musculus
catgggcagtatcctattggctaag

SEQ ID NO: 580757 - DNA, 25 bp, Mus musculus
catgggcagtatgctattggctaag

SEQ ID NO: 580758 - DNA, 25 bp, Mus musculus
catgggcatactccggagcctaggc

SEQ ID NO: 580759 - DNA, 25 bp, Mus musculus
catgggcatactgcggagcctaggc

SEQ ID NO: 580760 - DNA, 25 bp, Mus musculus
catgggcatattaccaaggagtttc

SEQ ID NO: 580761 - DNA, 25 bp, Mus musculus
catgggcatatttccaaggagtttc

SEQ ID NO: 580762 - DNA, 25 bp, Mus musculus
catgggcatttaatccatcaagaag

SEQ ID NO: 580763 - DNA, 25 bp, Mus musculus
catgggcatttattccatcaagaag

SEQ ID NO: 580764 - DNA, 25 bp, Mus musculus
catgggccacttagacagctctgct

SEQ ID NO: 580765 - DNA, 25 bp, Mus musculus
catgggccactttgacagctctgct

SEQ ID NO: 580766 - DNA, 25 bp, Mus musculus
catgggccaggcagtcttcacgagg

SEQ ID NO: 580767 - DNA, 25 bp, Mus musculus
catgggccaggctgtcttcacgagg

SEQ ID NO: 580768 - DNA, 25 bp, Mus musculus
catgggccatgcaccctagaagagg

SEQ ID NO: 580769 - DNA, 25 bp, Mus musculus
catgggccatgctccctagaagagg

SEQ ID NO: 580770 - DNA, 25 bp, Mus musculus
catgggccatttactcatatgtttg

SEQ ID NO: 580771 - DNA, 25 bp, Mus musculus
catgggccattttctcatatgtttg

SEQ ID NO: 580772 - DNA, 25 bp, Mus musculus
catgggccccacagaatggagactc

SEQ ID NO: 580773 - DNA, 25 bp, Mus musculus
catgggccccactgaatggagactc

SEQ ID NO: 580774 - DNA, 25 bp, Mus musculus
catgggcccgcactccatgtcggta

SEQ ID NO: 580775 - DNA, 25 bp, Mus musculus
catgggcccgcagtccatgtcggta

SEQ ID NO: 580776 - DNA, 25 bp, Mus musculus
catgggcctcacctatctgggctcg

SEQ ID NO: 580777 - DNA, 25 bp, Mus musculus
catgggcctcacgtatctgggctcg

SEQ ID NO: 580778 - DNA, 25 bp, Mus musculus
catgggcctcatagacattctgaca

SEQ ID NO: 580779 - DNA, 25 bp, Mus musculus
catgggcctcattgacattctgaca

SEQ ID NO: 580780 - DNA, 25 bp, Mus musculus
catgggcctgaaacaatttagtgac

SEQ ID NO: 580781 - DNA, 25 bp, Mus musculus
catgggcctgaatcaatttagtgac

SEQ ID NO: 580782 - DNA, 25 bp, Mus musculus
catgggcctgctagcctacctgaag

SEQ ID NO: 580783 - DNA, 25 bp, Mus musculus
catgggcctgcttgcctacctgaag

SEQ ID NO: 580784 - DNA, 25 bp, Mus musculus
catgggcctggcctttagaagttac

SEQ ID NO: 580785 - DNA, 25 bp, Mus musculus
catgggcctggcgtttagaagttac

SEQ ID NO: 580786 - DNA, 25 bp, Mus musculus
catgggcgctcgaagaggtccaagt

SEQ ID NO: 580787 - DNA, 25 bp, Mus musculus
catgggcgctcgtagaggtccaagt

SEQ ID NO: 580788 - DNA, 25 bp, Mus musculus
catgggcgctgaatacatcattatg

SEQ ID NO: 580789 - DNA, 25 bp, Mus musculus
catgggcgctgattacatcattatg

SEQ ID NO: 580790 - DNA, 25 bp, Mus musculus
catgggcggcttcatctttctgggc

SEQ ID NO: 580791 - DNA, 25 bp, Mus musculus
catgggcggcttgatctttctgggc

SEQ ID NO: 580792 - DNA, 25 bp, Mus musculus
catgggcggtatccatcgactggca

SEQ ID NO: 580793 - DNA, 25 bp, Mus musculus
catgggcggtatgcatcgactggca

SEQ ID NO: 580794 - DNA, 25 bp, Mus musculus
catgggcgtcaaagtgggtacttcg

SEQ ID NO: 580795 - DNA, 25 bp, Mus musculus
catgggcgtcaatgtgggtacttcg

SEQ ID NO: 580796 - DNA, 25 bp, Mus musculus
catgggcgttgcagtaggaattgaa

SEQ ID NO: 580797 - DNA, 25 bp, Mus musculus
catgggcgttgctgtaggaattgaa

SEQ ID NO: 580798 - DNA, 25 bp, Mus musculus
catgggctaccacccgtacaatatg

SEQ ID NO: 580799 - DNA, 25 bp, Mus musculus
catgggctaccagccgtacaatatg

SEQ ID NO: 580800 - DNA, 25 bp, Mus musculus
catgggctactcatatgattgtgtc

SEQ ID NO: 580801 - DNA, 25 bp, Mus musculus
catgggctactcttatgattgtgtc

SEQ ID NO: 580802 - DNA, 25 bp, Mus musculus
catgggctcacaagaagatgactca

SEQ ID NO: 580803 - DNA, 25 bp, Mus musculus
catgggctcacatgaagatgactca

SEQ ID NO: 580804 - DNA, 25 bp, Mus musculus
catgggctcacgaaggtcgttcatc

SEQ ID NO: 580805 - DNA, 25 bp, Mus musculus
catgggctcacgtaggtcgttcatc

SEQ ID NO: 580806 - DNA, 25 bp, Mus musculus
catgggctcatccaccatttcaagc

SEQ ID NO: 580807 - DNA, 25 bp, Mus musculus
catgggctcatcgaccatttcaagc

SEQ ID NO: 580808 - DNA, 25 bp, Mus musculus
catgggctcccaagaactatattga

SEQ ID NO: 580809 - DNA, 25 bp, Mus musculus
catgggctcccatgaactatattga

SEQ ID NO: 580810 - DNA, 25 bp, Mus musculus
catgggctgagaaccgctggcttag

SEQ ID NO: 580811 - DNA, 25 bp, Mus musculus
catgggctgagatccgctggcttag

SEQ ID NO: 580812 - DNA, 25 bp, Mus musculus
catgggctgaggacttgcaagcgcc

SEQ ID NO: 580813 - DNA, 25 bp, Mus musculus
catgggctgaggtcttgcaagcgcc

SEQ ID NO: 580814 - DNA, 25 bp, Mus musculus
catgggctgcttcggtgtcaccaga

SEQ ID NO: 580815 - DNA, 25 bp, Mus musculus
catgggctgcttgggtgtcaccaga

SEQ ID NO: 580816 - DNA, 25 bp, Mus musculus
catgggcttattactcaactgtgga

SEQ ID NO: 580817 - DNA, 25 bp, Mus musculus
catgggcttatttctcaactgtgga

SEQ ID NO: 580818 - DNA, 25 bp, Mus musculus
catgggcttggcaatccttatcttt

SEQ ID NO: 580819 - DNA, 25 bp, Mus musculus
catgggcttggctatccttatcttt

SEQ ID NO: 580820 - DNA, 25 bp, Mus musculus
catgggctttaccaagaccacttac

SEQ ID NO: 580821 - DNA, 25 bp, Mus musculus
catgggctttacgaagaccacttac

SEQ ID NO: 580822 - DNA, 25 bp, Mus musculus
catgggtaccccaataagtgaagag

SEQ ID NO: 580823 - DNA, 25 bp, Mus musculus
catgggtacccctataagtgaagag

SEQ ID NO: 580824 - DNA, 25 bp, Mus musculus
catgggtactatcaagaggagactt

SEQ ID NO: 580825 - DNA, 25 bp, Mus musculus
catgggtactatgaagaggagactt

SEQ ID NO: 580826 - DNA, 25 bp, Mus musculus
catgggtaggcacatcgacatgagt

SEQ ID NO: 580827 - DNA, 25 bp, Mus musculus
catgggtaggcagatcgacatgagt

SEQ ID NO: 580828 - DNA, 25 bp, Mus musculus
catgggtatcgacatctactgggat

SEQ ID NO: 580829 - DNA, 25 bp, Mus musculus
catgggtatcgagatctactgggat

SEQ ID NO: 580830 - DNA, 25 bp, Mus musculus
catgggtccagtccatagctgtgcc

SEQ ID NO: 580831 - DNA, 25 bp, Mus musculus
catgggtccagtgcatagctgtgcc

SEQ ID NO: 580832 - DNA, 25 bp, Mus musculus
catgggtcctacaagtgccaatgta

SEQ ID NO: 580833 - DNA, 25 bp, Mus musculus
catgggtcctactagtgccaatgta

SEQ ID NO: 580834 - DNA, 25 bp, Mus musculus
catgggtcctttagcagttgccaac

SEQ ID NO: 580835 - DNA, 25 bp, Mus musculus
catgggtccttttgcagttgccaac

SEQ ID NO: 580836 - DNA, 25 bp, Mus musculus
catgggtctaacagctccgaggaga

SEQ ID NO: 580837 - DNA, 25 bp, Mus musculus
catgggtctaactgctccgaggaga

SEQ ID NO: 580838 - DNA, 25 bp, Mus musculus
catgggtctcacaaggaaactggca

SEQ ID NO: 580839 - DNA, 25 bp, Mus musculus
catgggtctcactaggaaactggca

SEQ ID NO: 580840 - DNA, 25 bp, Mus musculus
catgggtctcccaattccagaagac

SEQ ID NO: 580841 - DNA, 25 bp, Mus musculus
catgggtctccctattccagaagac

SEQ ID NO: 580842 - DNA, 25 bp, Mus musculus
catgggtctcctctcggacccggtg

SEQ ID NO: 580843 - DNA, 25 bp, Mus musculus
catgggtctcctgtcggacccggtg

SEQ ID NO: 580844 - DNA, 25 bp, Mus musculus
catgggtctgacaactctttgagtg

SEQ ID NO: 580845 - DNA, 25 bp, Mus musculus
catgggtctgactactctttgagtg

SEQ ID NO: 580846 - DNA, 25 bp, Mus musculus
catgggtctgtccacaaccttagcc

SEQ ID NO: 580847 - DNA, 25 bp, Mus musculus
catgggtctgtcgacaaccttagcc

SEQ ID NO: 580848 - DNA, 25 bp, Mus musculus
catgggtgagggagcagtcttccac

SEQ ID NO: 580849 - DNA, 25 bp, Mus musculus
catgggtgagggtgcagtcttccac

SEQ ID NO: 580850 - DNA, 25 bp, Mus musculus
catgggtgccatccacttgagtgaa

SEQ ID NO: 580851 - DNA, 25 bp, Mus musculus
catgggtgccatgcacttgagtgaa

SEQ ID NO: 580852 - DNA, 25 bp, Mus musculus
catgggtgtcataaaaaagatggtt

SEQ ID NO: 580853 - DNA, 25 bp, Mus musculus
catgggtgtcattaaaaagatggtt

SEQ ID NO: 580854 - DNA, 25 bp, Mus musculus
catgggtgttctcgacatttatggc

SEQ ID NO: 580855 - DNA, 25 bp, Mus musculus
catgggtgttctggacatttatggc

SEQ ID NO: 580856 - DNA, 25 bp, Mus musculus
catgggttactgagaagaatggatc

SEQ ID NO: 580857 - DNA, 25 bp, Mus musculus
catgggttactgtgaagaatggatc

SEQ ID NO: 580858 - DNA, 25 bp, Mus musculus
catgggttcataccaaagatagctg

SEQ ID NO: 580859 - DNA, 25 bp, Mus musculus
catgggttcatagcaaagatagctg

SEQ ID NO: 580860 - DNA, 25 bp, Mus musculus
catgggttctctcgacgccatggag

SEQ ID NO: 580861 - DNA, 25 bp, Mus musculus
catgggttctctggacgccatggag

SEQ ID NO: 580862 - DNA, 25 bp, Mus musculus
catgggttgactccttgcttctgcc

SEQ ID NO: 580863 - DNA, 25 bp, Mus musculus
catgggttgactgcttgcttctgcc

SEQ ID NO: 580864 - DNA, 25 bp, Mus musculus
catgggtttaacctcagcgaccggt

SEQ ID NO: 580865 - DNA, 25 bp, Mus musculus
catgggtttaacgtcagcgaccggt

SEQ ID NO: 580866 - DNA, 25 bp, Mus musculus
catggtaaaacaagcccaagaggaa

SEQ ID NO: 580867 - DNA, 25 bp, Mus musculus
catggtaaaacatgcccaagaggaa

SEQ ID NO: 580868 - DNA, 25 bp, Mus musculus
catggtaaacaaagccatgagtgcc

SEQ ID NO: 580869 - DNA, 25 bp, Mus musculus
catggtaaacaatgccatgagtgcc

SEQ ID NO: 580870 - DNA, 25 bp, Mus musculus
catggtaactacagtggttggtgtg

SEQ ID NO: 580871 - DNA, 25 bp, Mus musculus
catggtaactactgtggttggtgtg

SEQ ID NO: 580872 - DNA, 25 bp, Mus musculus
catggtacacaaaggatatggattt

SEQ ID NO: 580873 - DNA, 25 bp, Mus musculus
catggtacacaatggatatggattt

SEQ ID NO: 580874 - DNA, 25 bp, Mus musculus
catggtacacgtagaagaacatttt

SEQ ID NO: 580875 - DNA, 25 bp, Mus musculus
catggtacacgttgaagaacatttt

SEQ ID NO: 580876 - DNA, 25 bp, Mus musculus
catggtaccaaaagccttggatttg

SEQ ID NO: 580877 - DNA, 25 bp, Mus musculus
catggtaccaaatgccttggatttg

SEQ ID NO: 580878 - DNA, 25 bp, Mus musculus
catggtaccaagacacagatcggcc

SEQ ID NO: 580879 - DNA, 25 bp, Mus musculus
catggtaccaagtcacagatcggcc

SEQ ID NO: 580880 - DNA, 25 bp, Mus musculus
catggtacctagcaggatcttctgg

SEQ ID NO: 580881 - DNA, 25 bp, Mus musculus
catggtacctaggaggatcttctgg

SEQ ID NO: 580882 - DNA, 25 bp, Mus musculus
catggtaccttccatcttggtcaac

SEQ ID NO: 580883 - DNA, 25 bp, Mus musculus
catggtaccttcgatcttggtcaac

SEQ ID NO: 580884 - DNA, 25 bp, Mus musculus
catggtacgagacaactaactccca

SEQ ID NO: 580885 - DNA, 25 bp, Mus musculus
catggtacgagagaactaactccca

SEQ ID NO: 580886 - DNA, 25 bp, Mus musculus
catggtactaaaataggatcaattc

SEQ ID NO: 580887 - DNA, 25 bp, Mus musculus
catggtactaaattaggatcaattc

SEQ ID NO: 580888 - DNA, 25 bp, Mus musculus
catggtactgggaagatggttcacc

SEQ ID NO: 580889 - DNA, 25 bp, Mus musculus
catggtactgggtagatggttcacc

SEQ ID NO: 580890 - DNA, 25 bp, Mus musculus
catggtactggtcagcagctctgtg

SEQ ID NO: 580891 - DNA, 25 bp, Mus musculus
catggtactggtgagcagctctgtg

SEQ ID NO: 580892 - DNA, 25 bp, Mus musculus
catggtagaatcaattaaacactgc

SEQ ID NO: 580893 - DNA, 25 bp, Mus musculus
catggtagaatctattaaacactgc

SEQ ID NO: 580894 - DNA, 25 bp, Mus musculus
catggtagatacaaaggaaacgtgg

SEQ ID NO: 580895 - DNA, 25 bp, Mus musculus
catggtagatactaaggaaacgtgg

SEQ ID NO: 580896 - DNA, 25 bp, Mus musculus
catggtaggccgagggtatgcatcc

SEQ ID NO: 580897 - DNA, 25 bp, Mus musculus
catggtaggccgtgggtatgcatcc

SEQ ID NO: 580898 - DNA, 25 bp, Mus musculus
catggtatccctcctgacagactac

SEQ ID NO: 580899 - DNA, 25 bp, Mus musculus
catggtatccctgctgacagactac

SEQ ID NO: 580900 - DNA, 25 bp, Mus musculus
catggtatgaggatcctgtccatct

SEQ ID NO: 580901 - DNA, 25 bp, Mus musculus
catggtatgaggttcctgtccatct

SEQ ID NO: 580902 - DNA, 25 bp, Mus musculus
catggtatttctatttaatcaatgg

SEQ ID NO: 580903 - DNA, 25 bp, Mus musculus
catggtatttctttttaatcaatgg

SEQ ID NO: 580904 - DNA, 25 bp, Mus musculus
catggtcagcgcctacatgtaccca

SEQ ID NO: 580905 - DNA, 25 bp, Mus musculus
catggtcagcgcgtacatgtaccca

SEQ ID NO: 580906 - DNA, 25 bp, Mus musculus
catggtcagtttcggcccactaggg

SEQ ID NO: 580907 - DNA, 25 bp, Mus musculus
catggtcagtttgggcccactaggg

SEQ ID NO: 580908 - DNA, 25 bp, Mus musculus
catggtcatcaaagcggtagccttt

SEQ ID NO: 580909 - DNA, 25 bp, Mus musculus
catggtcatcaatgcggtagccttt

SEQ ID NO: 580910 - DNA, 25 bp, Mus musculus
catggtcatctcctgcctgttgtcg

SEQ ID NO: 580911 - DNA, 25 bp, Mus musculus
catggtcatctcgtgcctgttgtcg

SEQ ID NO: 580912 - DNA, 25 bp, Mus musculus
catggtcatgcgagcctcagtgtca

SEQ ID NO: 580913 - DNA, 25 bp, Mus musculus
catggtcatgcgtgcctcagtgtca

SEQ ID NO: 580914 - DNA, 25 bp, Mus musculus
catggtcatgggagccactgtagtc

SEQ ID NO: 580915 - DNA, 25 bp, Mus musculus
catggtcatgggtgccactgtagtc

SEQ ID NO: 580916 - DNA, 25 bp, Mus musculus
catggtcattggacatgaaatcaca

SEQ ID NO: 580917 - DNA, 25 bp, Mus musculus
catggtcattggtcatgaaatcaca

SEQ ID NO: 580918 - DNA, 25 bp, Mus musculus
catggtccatatagcccctcttcta

SEQ ID NO: 580919 - DNA, 25 bp, Mus musculus
catggtccatattgcccctcttcta

SEQ ID NO: 580920 - DNA, 25 bp, Mus musculus
catggtccgggaacctcggctctta

SEQ ID NO: 580921 - DNA, 25 bp, Mus musculus
catggtccgggatcctcggctctta

SEQ ID NO: 580922 - DNA, 25 bp, Mus musculus
catggtcctggtccccttcaagacc

SEQ ID NO: 580923 - DNA, 25 bp, Mus musculus
catggtcctggtgcccttcaagacc

SEQ ID NO: 580924 - DNA, 25 bp, Mus musculus
catggtcgacctcaagacaagagca

SEQ ID NO: 580925 - DNA, 25 bp, Mus musculus
catggtcgacctgaagacaagagca

SEQ ID NO: 580926 - DNA, 25 bp, Mus musculus
catggtcggaccagggagttacttc

SEQ ID NO: 580927 - DNA, 25 bp, Mus musculus
catggtcggacctgggagttacttc

SEQ ID NO: 580928 - DNA, 25 bp, Mus musculus
catggtcggcagatggttggaaacc

SEQ ID NO: 580929 - DNA, 25 bp, Mus musculus
catggtcggcagttggttggaaacc

SEQ ID NO: 580930 - DNA, 25 bp, Mus musculus
catggtcgtggaatcctccaataca

SEQ ID NO: 580931 - DNA, 25 bp, Mus musculus
catggtcgtggattcctccaataca

SEQ ID NO: 580932 - DNA, 25 bp, Mus musculus
catggtctcctgcttgtgcttgggt

SEQ ID NO: 580933 - DNA, 25 bp, Mus musculus
catggtctcctggttgtgcttgggt

SEQ ID NO: 580934 - DNA, 25 bp, Mus musculus
catggtctctggagcaccagcacaa

SEQ ID NO: 580935 - DNA, 25 bp, Mus musculus
catggtctctggtgcaccagcacaa

SEQ ID NO: 580936 - DNA, 25 bp, Mus musculus
catggtctgggacttctggagtctt

SEQ ID NO: 580937 - DNA, 25 bp, Mus musculus
catggtctgggagttctggagtctt

SEQ ID NO: 580938 - DNA, 25 bp, Mus musculus
catggtcttcttcatcctcggggga

SEQ ID NO: 580939 - DNA, 25 bp, Mus musculus
catggtcttcttgatcctcggggga

SEQ ID NO: 580940 - DNA, 25 bp, Mus musculus
catggtcttggtcgtattcatcggc

SEQ ID NO: 580941 - DNA, 25 bp, Mus musculus
catggtcttggtggtattcatcggc

SEQ ID NO: 580942 - DNA, 25 bp, Mus musculus
catggtgaaattatagcagttatcc

SEQ ID NO: 580943 - DNA, 25 bp, Mus musculus
catggtgaaattttagcagttatcc

SEQ ID NO: 580944 - DNA, 25 bp, Mus musculus
catggtgaacatagcacattatgtt

SEQ ID NO: 580945 - DNA, 25 bp, Mus musculus
catggtgaacattgcacattatgtt

SEQ ID NO: 580946 - DNA, 25 bp, Mus musculus
catggtgacaccaactaagattgat

SEQ ID NO: 580947 - DNA, 25 bp, Mus musculus
catggtgacacctactaagattgat

SEQ ID NO: 580948 - DNA, 25 bp, Mus musculus
catggtgacctgagacccgtggatt

SEQ ID NO: 580949 - DNA, 25 bp, Mus musculus
catggtgacctgtgacccgtggatt

SEQ ID NO: 580950 - DNA, 25 bp, Mus musculus
catggtgactgaacgtgcctcatac

SEQ ID NO: 580951 - DNA, 25 bp, Mus musculus
catggtgactgatcgtgcctcatac

SEQ ID NO: 580952 - DNA, 25 bp, Mus musculus
catggtgagactcggtctgcagtac

SEQ ID NO: 580953 - DNA, 25 bp, Mus musculus
catggtgagactgggtctgcagtac

SEQ ID NO: 580954 - DNA, 25 bp, Mus musculus
catggtgagcgtcccagtgttcagc

SEQ ID NO: 580955 - DNA, 25 bp, Mus musculus
catggtgagcgtgccagtgttcagc

SEQ ID NO: 580956 - DNA, 25 bp, Mus musculus
catggtgaggtcctgcgtagaatcc

SEQ ID NO: 580957 - DNA, 25 bp, Mus musculus
catggtgaggtcgtgcgtagaatcc

SEQ ID NO: 580958 - DNA, 25 bp, Mus musculus
catggtgagtagcatcactgcgtcc

SEQ ID NO: 580959 - DNA, 25 bp, Mus musculus
catggtgagtaggatcactgcgtcc

SEQ ID NO: 580960 - DNA, 25 bp, Mus musculus
catggtgagtgtcatgtggcccaac

SEQ ID NO: 580961 - DNA, 25 bp, Mus musculus
catggtgagtgtgatgtggcccaac

SEQ ID NO: 580962 - DNA, 25 bp, Mus musculus
catggtgatagacaacggcatagtg

SEQ ID NO: 580963 - DNA, 25 bp, Mus musculus
catggtgatagagaacggcatagtg

SEQ ID NO: 580964 - DNA, 25 bp, Mus musculus
catggtgatccgagctcacatctta

SEQ ID NO: 580965 - DNA, 25 bp, Mus musculus
catggtgatccgtgctcacatctta

SEQ ID NO: 580966 - DNA, 25 bp, Mus musculus
catggtgcacagatcttcaaaagag

SEQ ID NO: 580967 - DNA, 25 bp, Mus musculus
catggtgcacagttcttcaaaagag

SEQ ID NO: 580968 - DNA, 25 bp, Mus musculus
catggtgcactaaatcaagcagaag

SEQ ID NO: 580969 - DNA, 25 bp, Mus musculus
catggtgcactatatcaagcagaag

SEQ ID NO: 580970 - DNA, 25 bp, Mus musculus
catggtgcagtgctcacagctcagc

SEQ ID NO: 580971 - DNA, 25 bp, Mus musculus
catggtgcagtggtcacagctcagc

SEQ ID NO: 580972 - DNA, 25 bp, Mus musculus
catggtgcattaaggccactccaac

SEQ ID NO: 580973 - DNA, 25 bp, Mus musculus
catggtgcattatggccactccaac

SEQ ID NO: 580974 - DNA, 25 bp, Mus musculus
catggtgccaagctgctctacgcgt

SEQ ID NO: 580975 - DNA, 25 bp, Mus musculus
catggtgccaaggtgctctacgcgt

SEQ ID NO: 580976 - DNA, 25 bp, Mus musculus
catggtgcccccaggtatagaagac

SEQ ID NO: 580977 - DNA, 25 bp, Mus musculus
catggtgccccctggtatagaagac

SEQ ID NO: 580978 - DNA, 25 bp, Mus musculus
catggtgcccgtcatccaaggatga

SEQ ID NO: 580979 - DNA, 25 bp, Mus musculus
catggtgcccgtgatccaaggatga

SEQ ID NO: 580980 - DNA, 25 bp, Mus musculus
catggtgctgaacctcacactgcgc

SEQ ID NO: 580981 - DNA, 25 bp, Mus musculus
catggtgctgaagctcacactgcgc

SEQ ID NO: 580982 - DNA, 25 bp, Mus musculus
catggtgctgataaatggtgctgag

SEQ ID NO: 580983 - DNA, 25 bp, Mus musculus
catggtgctgattaatggtgctgag

SEQ ID NO: 580984 - DNA, 25 bp, Mus musculus
catggtgctggccaggctttgctac

SEQ ID NO: 580985 - DNA, 25 bp, Mus musculus
catggtgctggcgaggctttgctac

SEQ ID NO: 580986 - DNA, 25 bp, Mus musculus
catggtggaaatacaggctggtact

SEQ ID NO: 580987 - DNA, 25 bp, Mus musculus
catggtggaaattcaggctggtact

SEQ ID NO: 580988 - DNA, 25 bp, Mus musculus
catggtggaagtcaccctgcaccca

SEQ ID NO: 580989 - DNA, 25 bp, Mus musculus
catggtggaagtgaccctgcaccca

SEQ ID NO: 580990 - DNA, 25 bp, Mus musculus
catggtggagcaccgtgcctctaat

SEQ ID NO: 580991 - DNA, 25 bp, Mus musculus
catggtggagcagcgtgcctctaat

SEQ ID NO: 580992 - DNA, 25 bp, Mus musculus
catggtggagtaagtgttgagctca

SEQ ID NO: 580993 - DNA, 25 bp, Mus musculus
catggtggagtatgtgttgagctca

SEQ ID NO: 580994 - DNA, 25 bp, Mus musculus
catggtggagttagctgtagccaca

SEQ ID NO: 580995 - DNA, 25 bp, Mus musculus
catggtggagtttgctgtagccaca

SEQ ID NO: 580996 - DNA, 25 bp, Mus musculus
catggtggatagcactcttccctgt

SEQ ID NO: 580997 - DNA, 25 bp, Mus musculus
catggtggataggactcttccctgt

SEQ ID NO: 580998 - DNA, 25 bp, Mus musculus
catggtggccttagtgaaccgagcc

SEQ ID NO: 580999 - DNA, 25 bp, Mus musculus
catggtggcctttgtgaaccgagcc

SEQ ID NO: 581000 - DNA, 25 bp, Mus musculus
catggtggcgtaaactcaaagtctc

SEQ ID NO: 581001 - DNA, 25 bp, Mus musculus
catggtggcgtatactcaaagtctc

SEQ ID NO: 581002 - DNA, 25 bp, Mus musculus
catggtggctcaatctggtgtgtct

SEQ ID NO: 581003 - DNA, 25 bp, Mus musculus
catggtggctcattctggtgtgtct

SEQ ID NO: 581004 - DNA, 25 bp, Mus musculus
catggtggctgtaataagattctaa

SEQ ID NO: 581005 - DNA, 25 bp, Mus musculus
catggtggctgttataagattctaa

SEQ ID NO: 581006 - DNA, 25 bp, Mus musculus
catggtgggaaactacacttgcgaa

SEQ ID NO: 581007 - DNA, 25 bp, Mus musculus
catggtgggaaagtacacttgcgaa

SEQ ID NO: 581008 - DNA, 25 bp, Mus musculus
catggtgggcatatataacttggtc

SEQ ID NO: 581009 - DNA, 25 bp, Mus musculus
catggtgggcatttataacttggtc

SEQ ID NO: 581010 - DNA, 25 bp, Mus musculus
catggtgggtcacccttagctcggc

SEQ ID NO: 581011 - DNA, 25 bp, Mus musculus
catggtgggtcagccttagctcggc

SEQ ID NO: 581012 - DNA, 25 bp, Mus musculus
catggtggtgttctttaatgatctc

SEQ ID NO: 581013 - DNA, 25 bp, Mus musculus
catggtggtgttgtttaatgatctc

SEQ ID NO: 581014 - DNA, 25 bp, Mus musculus
catggtggttcaacgctgctgacgg

SEQ ID NO: 581015 - DNA, 25 bp, Mus musculus
catggtggttcatcgctgctgacgg

SEQ ID NO: 581016 - DNA, 25 bp, Mus musculus
catggtggttggcatctgtctccca

SEQ ID NO: 581017 - DNA, 25 bp, Mus musculus
catggtggttgggatctgtctccca

SEQ ID NO: 581018 - DNA, 25 bp, Mus musculus
catggtggttgtcattcactttgga

SEQ ID NO: 581019 - DNA, 25 bp, Mus musculus
catggtggttgtgattcactttgga

SEQ ID NO: 581020 - DNA, 25 bp, Mus musculus
catggtggtttcattgcgctgtata

SEQ ID NO: 581021 - DNA, 25 bp, Mus musculus
catggtggtttctttgcgctgtata

SEQ ID NO: 581022 - DNA, 25 bp, Mus musculus
catggtgtaattctttctggatata

SEQ ID NO: 581023 - DNA, 25 bp, Mus musculus
catggtgtaattgtttctggatata

SEQ ID NO: 581024 - DNA, 25 bp, Mus musculus
catggtgtcagtcagcttattaaag

SEQ ID NO: 581025 - DNA, 25 bp, Mus musculus
catggtgtcagtgagcttattaaag

SEQ ID NO: 581026 - DNA, 25 bp, Mus musculus
catggtgtccttccctgtagcttca

SEQ ID NO: 581027 - DNA, 25 bp, Mus musculus
catggtgtccttgcctgtagcttca

SEQ ID NO: 581028 - DNA, 25 bp, Mus musculus
catggtgtgatgcatcctgtccccg

SEQ ID NO: 581029 - DNA, 25 bp, Mus musculus
catggtgtgatggatcctgtccccg

SEQ ID NO: 581030 - DNA, 25 bp, Mus musculus
catggtgttgccagtagtgggtaca

SEQ ID NO: 581031 - DNA, 25 bp, Mus musculus
catggtgttgcctgtagtgggtaca

SEQ ID NO: 581032 - DNA, 25 bp, Mus musculus
catggtgtttaacgacgtgctgctc

SEQ ID NO: 581033 - DNA, 25 bp, Mus musculus
catggtgtttaaggacgtgctgctc

SEQ ID NO: 581034 - DNA, 25 bp, Mus musculus
catggttaatctccgagccaaaggg

SEQ ID NO: 581035 - DNA, 25 bp, Mus musculus
catggttaatctgcgagccaaaggg

SEQ ID NO: 581036 - DNA, 25 bp, Mus musculus
catggttacagcaggcttgtgccac

SEQ ID NO: 581037 - DNA, 25 bp, Mus musculus
catggttacagcatctacctacgca

SEQ ID NO: 581038 - DNA, 25 bp, Mus musculus
catggttacagctggcttgtgccac

SEQ ID NO: 581039 - DNA, 25 bp, Mus musculus
catggttacagcttctacctacgca

SEQ ID NO: 581040 - DNA, 25 bp, Mus musculus
catggttactcacgagagtgacaac

SEQ ID NO: 581041 - DNA, 25 bp, Mus musculus
catggttactcaggagagtgacaac

SEQ ID NO: 581042 - DNA, 25 bp, Mus musculus
catggttagcatcagcaactgagat

SEQ ID NO: 581043 - DNA, 25 bp, Mus musculus
catggttagcatgagcaactgagat

SEQ ID NO: 581044 - DNA, 25 bp, Mus musculus
catggttatagccaagatgtccatc

SEQ ID NO: 581045 - DNA, 25 bp, Mus musculus
catggttatagcgaagatgtccatc

SEQ ID NO: 581046 - DNA, 25 bp, Mus musculus
catggttccataaattctacataaa

SEQ ID NO: 581047 - DNA, 25 bp, Mus musculus
catggttccatatattctacataaa

SEQ ID NO: 581048 - DNA, 25 bp, Mus musculus
catggttcctctccgggcttccaga

SEQ ID NO: 581049 - DNA, 25 bp, Mus musculus
catggttcctctgcgggcttccaga

SEQ ID NO: 581050 - DNA, 25 bp, Mus musculus
catggttcgagaaggtgtctacttc

SEQ ID NO: 581051 - DNA, 25 bp, Mus musculus
catggttcgagatggtgtctacttc

SEQ ID NO: 581052 - DNA, 25 bp, Mus musculus
catggttctcaacaggaggccacac

SEQ ID NO: 581053 - DNA, 25 bp, Mus musculus
catggttctcaagaggaggccacac

SEQ ID NO: 581054 - DNA, 25 bp, Mus musculus
catggttctgcacgctgagatgttg

SEQ ID NO: 581055 - DNA, 25 bp, Mus musculus
catggttctgcaggctgagatgttg

SEQ ID NO: 581056 - DNA, 25 bp, Mus musculus
catggttctggacctgtacctggat

SEQ ID NO: 581057 - DNA, 25 bp, Mus musculus
catggttctggagctgtacctggat

SEQ ID NO: 581058 - DNA, 25 bp, Mus musculus
catggttctgttagcagccagccca

SEQ ID NO: 581059 - DNA, 25 bp, Mus musculus
catggttctgtttgcagccagccca

SEQ ID NO: 581060 - DNA, 25 bp, Mus musculus
catggttgaccaagtgactgaggtc

SEQ ID NO: 581061 - DNA, 25 bp, Mus musculus
catggttgaccatgtgactgaggtc

SEQ ID NO: 581062 - DNA, 25 bp, Mus musculus
catggttgaccgacttcctaccgtt

SEQ ID NO: 581063 - DNA, 25 bp, Mus musculus
catggttgaccgtcttcctaccgtt

SEQ ID NO: 581064 - DNA, 25 bp, Mus musculus
catggttgccaaacactacgtctgc

SEQ ID NO: 581065 - DNA, 25 bp, Mus musculus
catggttgccaatcactacgtctgc

SEQ ID NO: 581066 - DNA, 25 bp, Mus musculus
catggttggctaaccagacttcctg

SEQ ID NO: 581067 - DNA, 25 bp, Mus musculus
catggttggctatccagacttcctg

SEQ ID NO: 581068 - DNA, 25 bp, Mus musculus
catggttggtaaatcgtatcaacga

SEQ ID NO: 581069 - DNA, 25 bp, Mus musculus
catggttggtaattcgtatcaacga

SEQ ID NO: 581070 - DNA, 25 bp, Mus musculus
catggttgtcacaggtgtgcaacgt

SEQ ID NO: 581071 - DNA, 25 bp, Mus musculus
catggttgtcactggtgtgcaacgt

SEQ ID NO: 581072 - DNA, 25 bp, Mus musculus
catggttgtgccaccccaggaacct

SEQ ID NO: 581073 - DNA, 25 bp, Mus musculus
catggttgtgcctccccaggaacct

SEQ ID NO: 581074 - DNA, 25 bp, Mus musculus
catggttgtgctactatcggcggtg

SEQ ID NO: 581075 - DNA, 25 bp, Mus musculus
catggttgtgcttctatcggcggtg

SEQ ID NO: 581076 - DNA, 25 bp, Mus musculus
catggttgttgcatcaagttgtccc

SEQ ID NO: 581077 - DNA, 25 bp, Mus musculus
catggttgttgcttcaagttgtccc

SEQ ID NO: 581078 - DNA, 25 bp, Mus musculus
catggtttatgaaccatctctgtga

SEQ ID NO: 581079 - DNA, 25 bp, Mus musculus
catggtttatgatccatctctgtga

SEQ ID NO: 581080 - DNA, 25 bp, Mus musculus
catggtttcagcatttacatttcag

SEQ ID NO: 581081 - DNA, 25 bp, Mus musculus
catggtttcagcttttacatttcag

SEQ ID NO: 581082 - DNA, 25 bp, Mus musculus
catggtttgcatcattgccaaccca

SEQ ID NO: 581083 - DNA, 25 bp, Mus musculus
catggtttgcatgattgccaaccca

SEQ ID NO: 581084 - DNA, 25 bp, Mus musculus
catggttttcaaatccatgctgaga

SEQ ID NO: 581085 - DNA, 25 bp, Mus musculus
catggttttcaattccatgctgaga

SEQ ID NO: 581086 - DNA, 25 bp, Mus musculus
catggttttcatccctagtggctac

SEQ ID NO: 581087 - DNA, 25 bp, Mus musculus
catggttttcatgcctagtggctac

SEQ ID NO: 581088 - DNA, 25 bp, Mus musculus
catggttttctactctcgggacgcc

SEQ ID NO: 581089 - DNA, 25 bp, Mus musculus
catggttttctagtctcgggacgcc

SEQ ID NO: 581090 - DNA, 25 bp, Mus musculus
catgtaaaaggacgcgaatgggctc

SEQ ID NO: 581091 - DNA, 25 bp, Mus musculus
catgtaaaaggaggcgaatgggctc

SEQ ID NO: 581092 - DNA, 25 bp, Mus musculus
catgtaaaatgcagaggagtcctgg

SEQ ID NO: 581093 - DNA, 25 bp, Mus musculus
catgtaaaatgctgaggagtcctgg

SEQ ID NO: 581094 - DNA, 25 bp, Mus musculus
catgtaaacactcgaatcacgtgcc

SEQ ID NO: 581095 - DNA, 25 bp, Mus musculus
catgtaaacactggaatcacgtgcc

SEQ ID NO: 581096 - DNA, 25 bp, Mus musculus
catgtaaagtgacttgcgaaaccgg

SEQ ID NO: 581097 - DNA, 25 bp, Mus musculus
catgtaaagtgagttgcgaaaccgg

SEQ ID NO: 581098 - DNA, 25 bp, Mus musculus
catgtaaattcaacaggcgtgaggg

SEQ ID NO: 581099 - DNA, 25 bp, Mus musculus
catgtaaattcatcaggcgtgaggg

SEQ ID NO: 581100 - DNA, 25 bp, Mus musculus
catgtaacggttaaaccagcctcgc

SEQ ID NO: 581101 - DNA, 25 bp, Mus musculus
catgtaacggtttaaccagcctcgc

SEQ ID NO: 581102 - DNA, 25 bp, Mus musculus
catgtaacgtgaccatccacaaccg

SEQ ID NO: 581103 - DNA, 25 bp, Mus musculus
catgtaacgtgagcatccacaaccg

SEQ ID NO: 581104 - DNA, 25 bp, Mus musculus
catgtaagcagccttatcgacgctt

SEQ ID NO: 581105 - DNA, 25 bp, Mus musculus
catgtaagcagcgttatcgacgctt

SEQ ID NO: 581106 - DNA, 25 bp, Mus musculus
catgtaagccttccagaatccacgg

SEQ ID NO: 581107 - DNA, 25 bp, Mus musculus
catgtaagccttgcagaatccacgg

SEQ ID NO: 581108 - DNA, 25 bp, Mus musculus
catgtaaggccacgctataatgaag

SEQ ID NO: 581109 - DNA, 25 bp, Mus musculus
catgtaaggccaggctataatgaag

SEQ ID NO: 581110 - DNA, 25 bp, Mus musculus
catgtaagtacacctagcaaactct

SEQ ID NO: 581111 - DNA, 25 bp, Mus musculus
catgtaagtacagctagcaaactct

SEQ ID NO: 581112 - DNA, 25 bp, Mus musculus
catgtaatgcacaccctgaaccaag

SEQ ID NO: 581113 - DNA, 25 bp, Mus musculus
catgtaatgcactccctgaaccaag

SEQ ID NO: 581114 - DNA, 25 bp, Mus musculus
catgtaatggcgagcacattcgata

SEQ ID NO: 581115 - DNA, 25 bp, Mus musculus
catgtaatggcgtgcacattcgata

SEQ ID NO: 581116 - DNA, 25 bp, Mus musculus
catgtaatgtcgcaatgcggaggcc

SEQ ID NO: 581117 - DNA, 25 bp, Mus musculus
catgtaatgtcggaatgcggaggcc

SEQ ID NO: 581118 - DNA, 25 bp, Mus musculus
catgtacaaagcactgggatccacc

SEQ ID NO: 581119 - DNA, 25 bp, Mus musculus
catgtacaaagctctgggatccacc

SEQ ID NO: 581120 - DNA, 25 bp, Mus musculus
catgtacaacgtccgcatcatgagg

SEQ ID NO: 581121 - DNA, 25 bp, Mus musculus
catgtacaacgtgcgcatcatgagg

SEQ ID NO: 581122 - DNA, 25 bp, Mus musculus
catgtacacgccaggagatgcctga

SEQ ID NO: 581123 - DNA, 25 bp, Mus musculus
catgtacacgcctggagatgcctga

SEQ ID NO: 581124 - DNA, 25 bp, Mus musculus
catgtacagattctcgtagaattca

SEQ ID NO: 581125 - DNA, 25 bp, Mus musculus
catgtacagattgtcgtagaattca

SEQ ID NO: 581126 - DNA, 25 bp, Mus musculus
catgtacagttgagaaaaatgcaaa

SEQ ID NO: 581127 - DNA, 25 bp, Mus musculus
catgtacagttgtgaaaaatgcaaa

SEQ ID NO: 581128 - DNA, 25 bp, Mus musculus
catgtacatcttatgggctttgagt

SEQ ID NO: 581129 - DNA, 25 bp, Mus musculus
catgtacatcttttgggctttgagt

SEQ ID NO: 581130 - DNA, 25 bp, Mus musculus
catgtacatgcgcaggaagtgccag

SEQ ID NO: 581131 - DNA, 25 bp, Mus musculus
catgtacatgcggaggaagtgccag

SEQ ID NO: 581132 - DNA, 25 bp, Mus musculus
catgtacatggtcaacaatcggaac

SEQ ID NO: 581133 - DNA, 25 bp, Mus musculus
catgtacatggtgaacaatcggaac

SEQ ID NO: 581134 - DNA, 25 bp, Mus musculus
catgtacatgtgcagaactcaggtc

SEQ ID NO: 581135 - DNA, 25 bp, Mus musculus
catgtacatgtggagaactcaggtc

SEQ ID NO: 581136 - DNA, 25 bp, Mus musculus
catgtaccaacaacaaccagagtct

SEQ ID NO: 581137 - DNA, 25 bp, Mus musculus
catgtaccaacatcaaccagagtct

SEQ ID NO: 581138 - DNA, 25 bp, Mus musculus
catgtaccacagagcacagaagatg

SEQ ID NO: 581139 - DNA, 25 bp, Mus musculus
catgtaccacagtgcacagaagatg

SEQ ID NO: 581140 - DNA, 25 bp, Mus musculus
catgtaccagagcatgccactcctt

SEQ ID NO: 581141 - DNA, 25 bp, Mus musculus
catgtaccagaggatgccactcctt

SEQ ID NO: 581142 - DNA, 25 bp, Mus musculus
catgtacccaacaggtgcccctggg

SEQ ID NO: 581143 - DNA, 25 bp, Mus musculus
catgtacccaactggtgcccctggg

SEQ ID NO: 581144 - DNA, 25 bp, Mus musculus
catgtacccacaaatatacgagcaa

SEQ ID NO: 581145 - DNA, 25 bp, Mus musculus
catgtacccacatatatacgagcaa

SEQ ID NO: 581146 - DNA, 25 bp, Mus musculus
catgtacccaccaacatacctggag

SEQ ID NO: 581147 - DNA, 25 bp, Mus musculus
catgtacccacctacatacctggag

SEQ ID NO: 581148 - DNA, 25 bp, Mus musculus
catgtacccgaacaacagaactgat

SEQ ID NO: 581149 - DNA, 25 bp, Mus musculus
catgtacccgaagaacagaactgat

SEQ ID NO: 581150 - DNA, 25 bp, Mus musculus
catgtacccggtcgactccgtgaag

SEQ ID NO: 581151 - DNA, 25 bp, Mus musculus
catgtacccggtggactccgtgaag

SEQ ID NO: 581152 - DNA, 25 bp, Mus musculus
catgtaccgagtcagtgtagaaaat

SEQ ID NO: 581153 - DNA, 25 bp, Mus musculus
catgtaccgagtgagtgtagaaaat

SEQ ID NO: 581154 - DNA, 25 bp, Mus musculus
catgtaccgctgagagtgcaagccc

SEQ ID NO: 581155 - DNA, 25 bp, Mus musculus
catgtaccgctgtgagtgcaagccc

SEQ ID NO: 581156 - DNA, 25 bp, Mus musculus
catgtacctgagagtaatatgaatg

SEQ ID NO: 581157 - DNA, 25 bp, Mus musculus
catgtacctgagtgtaatatgaatg

SEQ ID NO: 581158 - DNA, 25 bp, Mus musculus
catgtactcctactacggcctgtct

SEQ ID NO: 581159 - DNA, 25 bp, Mus musculus
catgtactcctagtacggcctgtct

SEQ ID NO: 581160 - DNA, 25 bp, Mus musculus
catgtactggaccatgctgcagcaa

SEQ ID NO: 581161 - DNA, 25 bp, Mus musculus
catgtactggacgatgctgcagcaa

SEQ ID NO: 581162 - DNA, 25 bp, Mus musculus
catgtacttaaaagtgtgaaagatc

SEQ ID NO: 581163 - DNA, 25 bp, Mus musculus
catgtacttaaatgtgtgaaagatc

SEQ ID NO: 581164 - DNA, 25 bp, Mus musculus
catgtacttcacagaggagcctcct

SEQ ID NO: 581165 - DNA, 25 bp, Mus musculus
catgtacttcactgaggagcctcct

SEQ ID NO: 581166 - DNA, 25 bp, Mus musculus
catgtagaagtaatttgttatgcca

SEQ ID NO: 581167 - DNA, 25 bp, Mus musculus
catgtagaagtattttgttatgcca

SEQ ID NO: 581168 - DNA, 25 bp, Mus musculus
catgtagaccttctcctgtgccaaa

SEQ ID NO: 581169 - DNA, 25 bp, Mus musculus
catgtagaccttgtcctgtgccaaa

SEQ ID NO: 581170 - DNA, 25 bp, Mus musculus
catgtagagaagaggcacttccatt

SEQ ID NO: 581171 - DNA, 25 bp, Mus musculus
catgtagagaagtggcacttccatt

SEQ ID NO: 581172 - DNA, 25 bp, Mus musculus
catgtagagagcacgccagaagact

SEQ ID NO: 581173 - DNA, 25 bp, Mus musculus
catgtagagagctcgccagaagact

SEQ ID NO: 581174 - DNA, 25 bp, Mus musculus
catgtagattggcacactgttcaca

SEQ ID NO: 581175 - DNA, 25 bp, Mus musculus
catgtagattgggacactgttcaca

SEQ ID NO: 581176 - DNA, 25 bp, Mus musculus
catgtagcacttctcttcacgaggc

SEQ ID NO: 581177 - DNA, 25 bp, Mus musculus
catgtagcacttgtcttcacgaggc

SEQ ID NO: 581178 - DNA, 25 bp, Mus musculus
catgtagccatgaagacaggatggg

SEQ ID NO: 581179 - DNA, 25 bp, Mus musculus
catgtagccatgtagacaggatggg

SEQ ID NO: 581180 - DNA, 25 bp, Mus musculus
catgtaggaaatctttcatgcttga

SEQ ID NO: 581181 - DNA, 25 bp, Mus musculus
catgtaggaaatgtttcatgcttga

SEQ ID NO: 581182 - DNA, 25 bp, Mus musculus
catgtaggagttccttggcccaaag

SEQ ID NO: 581183 - DNA, 25 bp, Mus musculus
catgtaggagttgcttggcccaaag

SEQ ID NO: 581184 - DNA, 25 bp, Mus musculus
catgtaggctcaactgctcagaaag

SEQ ID NO: 581185 - DNA, 25 bp, Mus musculus
catgtaggctcatctgctcagaaag

SEQ ID NO: 581186 - DNA, 25 bp, Mus musculus
catgtagggactagtggctgttcca

SEQ ID NO: 581187 - DNA, 25 bp, Mus musculus
catgtagggacttgtggctgttcca

SEQ ID NO: 581188 - DNA, 25 bp, Mus musculus
catgtagtagttagatcctcagcac

SEQ ID NO: 581189 - DNA, 25 bp, Mus musculus
catgtagtagtttgatcctcagcac

SEQ ID NO: 581190 - DNA, 25 bp, Mus musculus
catgtagttctaccctgtcggaaat

SEQ ID NO: 581191 - DNA, 25 bp, Mus musculus
catgtagttctagcctgtcggaaat

SEQ ID NO: 581192 - DNA, 25 bp, Mus musculus
catgtataagcccaagaaggtggtt

SEQ ID NO: 581193 - DNA, 25 bp, Mus musculus
catgtataagccgaagaaggtggtt

SEQ ID NO: 581194 - DNA, 25 bp, Mus musculus
catgtataccaaccttcgcacggtc

SEQ ID NO: 581195 - DNA, 25 bp, Mus musculus
catgtataccaagcttcgcacggtc

SEQ ID NO: 581196 - DNA, 25 bp, Mus musculus
catgtatatcagctactgctgtgat

SEQ ID NO: 581197 - DNA, 25 bp, Mus musculus
catgtatatcaggtactgctgtgat

SEQ ID NO: 581198 - DNA, 25 bp, Mus musculus
catgtatatctactggactcagctc

SEQ ID NO: 581199 - DNA, 25 bp, Mus musculus
catgtatatctagtggactcagctc

SEQ ID NO: 581200 - DNA, 25 bp, Mus musculus
catgtatcatgccagcaagctgagc

SEQ ID NO: 581201 - DNA, 25 bp, Mus musculus
catgtatcatgcgagcaagctgagc

SEQ ID NO: 581202 - DNA, 25 bp, Mus musculus
catgtatctgaccttcttccttgaa

SEQ ID NO: 581203 - DNA, 25 bp, Mus musculus
catgtatctgacgttcttccttgaa

SEQ ID NO: 581204 - DNA, 25 bp, Mus musculus
catgtatgaaatcgagacatcagga

SEQ ID NO: 581205 - DNA, 25 bp, Mus musculus
catgtatgaaatggagacatcagga

SEQ ID NO: 581206 - DNA, 25 bp, Mus musculus
catgtatgataaactaaggatgttg

SEQ ID NO: 581207 - DNA, 25 bp, Mus musculus
catgtatgataatctaaggatgttg

SEQ ID NO: 581208 - DNA, 25 bp, Mus musculus
catgtatgatgacgtaagagatgcc

SEQ ID NO: 581209 - DNA, 25 bp, Mus musculus
catgtatgatgaggtaagagatgcc

SEQ ID NO: 581210 - DNA, 25 bp, Mus musculus
catgtatgggccctgggtccctgca

SEQ ID NO: 581211 - DNA, 25 bp, Mus musculus
catgtatgggccgtgggtccctgca

SEQ ID NO: 581212 - DNA, 25 bp, Mus musculus
catgtatgggctccaccaggatgtg

SEQ ID NO: 581213 - DNA, 25 bp, Mus musculus
catgtatgggctgcaccaggatgtg

SEQ ID NO: 581214 - DNA, 25 bp, Mus musculus
catgtatggtgtcaccagcatgtac

SEQ ID NO: 581215 - DNA, 25 bp, Mus musculus
catgtatggtgtgaccagcatgtac

SEQ ID NO: 581216 - DNA, 25 bp, Mus musculus
catgtatgtcatcaagacatgtgca

SEQ ID NO: 581217 - DNA, 25 bp, Mus musculus
catgtatgtcatgaagacatgtgca

SEQ ID NO: 581218 - DNA, 25 bp, Mus musculus
catgtatgtggaaggaactgcagcc

SEQ ID NO: 581219 - DNA, 25 bp, Mus musculus
catgtatgtggatggaactgcagcc

SEQ ID NO: 581220 - DNA, 25 bp, Mus musculus
catgtattgaaacccaccagtttca

SEQ ID NO: 581221 - DNA, 25 bp, Mus musculus
catgtattgaaagccaccagtttca

SEQ ID NO: 581222 - DNA, 25 bp, Mus musculus
catgtattgaagcagtcgttctcag

SEQ ID NO: 581223 - DNA, 25 bp, Mus musculus
catgtattgaaggagtcgttctcag

SEQ ID NO: 581224 - DNA, 25 bp, Mus musculus
catgtattgcaacgtactggagacc

SEQ ID NO: 581225 - DNA, 25 bp, Mus musculus
catgtattgcaaggtactggagacc

SEQ ID NO: 581226 - DNA, 25 bp, Mus musculus
catgtattgcatcttgttcctggcg

SEQ ID NO: 581227 - DNA, 25 bp, Mus musculus
catgtattgcatgttgttcctggcg

SEQ ID NO: 581228 - DNA, 25 bp, Mus musculus
catgtatttccgagaccgcagcggg

SEQ ID NO: 581229 - DNA, 25 bp, Mus musculus
catgtatttccgtgaccgcagcggg

SEQ ID NO: 581230 - DNA, 25 bp, Mus musculus
catgtatttgacagttacggagggc

SEQ ID NO: 581231 - DNA, 25 bp, Mus musculus
catgtatttgactgttacggagggc

SEQ ID NO: 581232 - DNA, 25 bp, Mus musculus
catgtcaaaaagctactgtatgccc

SEQ ID NO: 581233 - DNA, 25 bp, Mus musculus
catgtcaaaaaggtactgtatgccc

SEQ ID NO: 581234 - DNA, 25 bp, Mus musculus
catgtcaaaaggagtaccttgcctt

SEQ ID NO: 581235 - DNA, 25 bp, Mus musculus
catgtcaaaaggtgtaccttgcctt

SEQ ID NO: 581236 - DNA, 25 bp, Mus musculus
catgtcaaacagcaatgcacgtctt

SEQ ID NO: 581237 - DNA, 25 bp, Mus musculus
catgtcaaacaggaatgcacgtctt

SEQ ID NO: 581238 - DNA, 25 bp, Mus musculus
catgtcaacagacactagataggga

SEQ ID NO: 581239 - DNA, 25 bp, Mus musculus
catgtcaacagagactagataggga

SEQ ID NO: 581240 - DNA, 25 bp, Mus musculus
catgtcaagggaaccgcagaactgg

SEQ ID NO: 581241 - DNA, 25 bp, Mus musculus
catgtcaagggatccgcagaactgg

SEQ ID NO: 581242 - DNA, 25 bp, Mus musculus
catgtcaagtcaccactggcttcag

SEQ ID NO: 581243 - DNA, 25 bp, Mus musculus
catgtcaagtcagcactggcttcag

SEQ ID NO: 581244 - DNA, 25 bp, Mus musculus
catgtcaatgaaaagccgtccagcc

SEQ ID NO: 581245 - DNA, 25 bp, Mus musculus
catgtcaatgaatagccgtccagcc

SEQ ID NO: 581246 - DNA, 25 bp, Mus musculus
catgtcacaagtagctaaggatgtc

SEQ ID NO: 581247 - DNA, 25 bp, Mus musculus
catgtcacaagttgctaaggatgtc

SEQ ID NO: 581248 - DNA, 25 bp, Mus musculus
catgtcacccgacagaatccatgag

SEQ ID NO: 581249 - DNA, 25 bp, Mus musculus
catgtcacccgagagaatccatgag

SEQ ID NO: 581250 - DNA, 25 bp, Mus musculus
catgtcaccggcatgtgggtgtacc

SEQ ID NO: 581251 - DNA, 25 bp, Mus musculus
catgtcaccggcttgtgggtgtacc

SEQ ID NO: 581252 - DNA, 25 bp, Mus musculus
catgtcacggatatgggtaaccaaa

SEQ ID NO: 581253 - DNA, 25 bp, Mus musculus
catgtcacggatttgggtaaccaaa

SEQ ID NO: 581254 - DNA, 25 bp, Mus musculus
catgtcagacgcacagacaaagtgg

SEQ ID NO: 581255 - DNA, 25 bp, Mus musculus
catgtcagacgctcagacaaagtgg

SEQ ID NO: 581256 - DNA, 25 bp, Mus musculus
catgtcagaggcagacccatttgga

SEQ ID NO: 581257 - DNA, 25 bp, Mus musculus
catgtcagaggctgacccatttgga

SEQ ID NO: 581258 - DNA, 25 bp, Mus musculus
catgtcagcggtcgaccgtggaggc

SEQ ID NO: 581259 - DNA, 25 bp, Mus musculus
catgtcagcggtggaccgtggaggc

SEQ ID NO: 581260 - DNA, 25 bp, Mus musculus
catgtcagctgaccaacaggcttaa

SEQ ID NO: 581261 - DNA, 25 bp, Mus musculus
catgtcagctgagcaacaggcttaa

SEQ ID NO: 581262 - DNA, 25 bp, Mus musculus
catgtcaggccgagtgcgtggtaac

SEQ ID NO: 581263 - DNA, 25 bp, Mus musculus
catgtcaggccgtgtgcgtggtaac

SEQ ID NO: 581264 - DNA, 25 bp, Mus musculus
catgtcagtcatcaggccagagctg

SEQ ID NO: 581265 - DNA, 25 bp, Mus musculus
catgtcagtcatgaggccagagctg

SEQ ID NO: 581266 - DNA, 25 bp, Mus musculus
catgtcataataaacatagccaggg

SEQ ID NO: 581267 - DNA, 25 bp, Mus musculus
catgtcataatatacatagccaggg

SEQ ID NO: 581268 - DNA, 25 bp, Mus musculus
catgtcatacgactatccggaatac

SEQ ID NO: 581269 - DNA, 25 bp, Mus musculus
catgtcatacgagtatccggaatac

SEQ ID NO: 581270 - DNA, 25 bp, Mus musculus
catgtcatagtgcattgtgctgcag

SEQ ID NO: 581271 - DNA, 25 bp, Mus musculus
catgtcatagtggattgtgctgcag

SEQ ID NO: 581272 - DNA, 25 bp, Mus musculus
catgtcatcgagaggctgcgctttg

SEQ ID NO: 581273 - DNA, 25 bp, Mus musculus
catgtcatcgagtggctgcgctttg

SEQ ID NO: 581274 - DNA, 25 bp, Mus musculus
catgtcatggaacggtcacccacag

SEQ ID NO: 581275 - DNA, 25 bp, Mus musculus
catgtcatggaagggtcacccacag

SEQ ID NO: 581276 - DNA, 25 bp, Mus musculus
catgtcattgatctgcatgggcaca

SEQ ID NO: 581277 - DNA, 25 bp, Mus musculus
catgtcattgatgtgcatgggcaca

SEQ ID NO: 581278 - DNA, 25 bp, Mus musculus
catgtcatttgcagttggaaagtcg

SEQ ID NO: 581279 - DNA, 25 bp, Mus musculus
catgtcatttgctgttggaaagtcg

SEQ ID NO: 581280 - DNA, 25 bp, Mus musculus
catgtcatttgtcccagccagcttt

SEQ ID NO: 581281 - DNA, 25 bp, Mus musculus
catgtcatttgtgccagccagcttt

SEQ ID NO: 581282 - DNA, 25 bp, Mus musculus
catgtccaaaatcggactgatcaac

SEQ ID NO: 581283 - DNA, 25 bp, Mus musculus
catgtccaaaatgggactgatcaac

SEQ ID NO: 581284 - DNA, 25 bp, Mus musculus
catgtccaatccaggtgatgtccga

SEQ ID NO: 581285 - DNA, 25 bp, Mus musculus
catgtccaatcctggtgatgtccga

SEQ ID NO: 581286 - DNA, 25 bp, Mus musculus
catgtccaatggcacaagcgatgct

SEQ ID NO: 581287 - DNA, 25 bp, Mus musculus
catgtccaatgggacaagcgatgct

SEQ ID NO: 581288 - DNA, 25 bp, Mus musculus
catgtccacagactgcgagaacctt

SEQ ID NO: 581289 - DNA, 25 bp, Mus musculus
catgtccacagagtgcgagaacctt

SEQ ID NO: 581290 - DNA, 25 bp, Mus musculus
catgtccacattcaggcaagaggat

SEQ ID NO: 581291 - DNA, 25 bp, Mus musculus
catgtccacattgaggcaagaggat

SEQ ID NO: 581292 - DNA, 25 bp, Mus musculus
catgtccaccttcccgcagtgaggg

SEQ ID NO: 581293 - DNA, 25 bp, Mus musculus
catgtccaccttgccgcagtgaggg

SEQ ID NO: 581294 - DNA, 25 bp, Mus musculus
catgtccacgcacagtcaaacagct

SEQ ID NO: 581295 - DNA, 25 bp, Mus musculus
catgtccacgcagagtcaaacagct

SEQ ID NO: 581296 - DNA, 25 bp, Mus musculus
catgtccacggactgtgaaaatctg

SEQ ID NO: 581297 - DNA, 25 bp, Mus musculus
catgtccacggagtgtgaaaatctg

SEQ ID NO: 581298 - DNA, 25 bp, Mus musculus
catgtccaggagaccaaattccaga

SEQ ID NO: 581299 - DNA, 25 bp, Mus musculus
catgtccaggagtccaaattccaga

SEQ ID NO: 581300 - DNA, 25 bp, Mus musculus
catgtccagggcacagatctcagct

SEQ ID NO: 581301 - DNA, 25 bp, Mus musculus
catgtccagggctcagatctcagct

SEQ ID NO: 581302 - DNA, 25 bp, Mus musculus
catgtccatgctcggatggcaacta

SEQ ID NO: 581303 - DNA, 25 bp, Mus musculus
catgtccatgctgggatggcaacta

SEQ ID NO: 581304 - DNA, 25 bp, Mus musculus
catgtccatggacgaccccttcttt

SEQ ID NO: 581305 - DNA, 25 bp, Mus musculus
catgtccatggaggaccccttcttt

SEQ ID NO: 581306 - DNA, 25 bp, Mus musculus
catgtccattggcactctcctggct

SEQ ID NO: 581307 - DNA, 25 bp, Mus musculus
catgtccattgggactctcctggct

SEQ ID NO: 581308 - DNA, 25 bp, Mus musculus
catgtcccagggagtggactgcgat

SEQ ID NO: 581309 - DNA, 25 bp, Mus musculus
catgtcccagggtgtggactgcgat

SEQ ID NO: 581310 - DNA, 25 bp, Mus musculus
catgtcccatgaaggtagatcctct

SEQ ID NO: 581311 - DNA, 25 bp, Mus musculus
catgtcccatgatggtagatcctct

SEQ ID NO: 581312 - DNA, 25 bp, Mus musculus
catgtccctggaagactttgagcag

SEQ ID NO: 581313 - DNA, 25 bp, Mus musculus
catgtccctggatgactttgagcag

SEQ ID NO: 581314 - DNA, 25 bp, Mus musculus
catgtccctgtcacttcagaactgt

SEQ ID NO: 581315 - DNA, 25 bp, Mus musculus
catgtccctgtctcttcagaactgt

SEQ ID NO: 581316 - DNA, 25 bp, Mus musculus
catgtccgactaacagatgaaattt

SEQ ID NO: 581317 - DNA, 25 bp, Mus musculus
catgtccgactatcagatgaaattt

SEQ ID NO: 581318 - DNA, 25 bp, Mus musculus
catgtccgaggaagacggtgatgac

SEQ ID NO: 581319 - DNA, 25 bp, Mus musculus
catgtccgaggatgacggtgatgac

SEQ ID NO: 581320 - DNA, 25 bp, Mus musculus
catgtccgccagcattctgaggtgg

SEQ ID NO: 581321 - DNA, 25 bp, Mus musculus
catgtccgccaggattctgaggtgg

SEQ ID NO: 581322 - DNA, 25 bp, Mus musculus
catgtccgctggatctcaacagaac

SEQ ID NO: 581323 - DNA, 25 bp, Mus musculus
catgtccgctggttctcaacagaac

SEQ ID NO: 581324 - DNA, 25 bp, Mus musculus
catgtccggagactgatgctgaaaa

SEQ ID NO: 581325 - DNA, 25 bp, Mus musculus
catgtccggagagtgatgctgaaaa

SEQ ID NO: 581326 - DNA, 25 bp, Mus musculus
catgtccgtggacatgaatggtatt

SEQ ID NO: 581327 - DNA, 25 bp, Mus musculus
catgtccgtggagatgaatggtatt

SEQ ID NO: 581328 - DNA, 25 bp, Mus musculus
catgtcctctgcagaaattgttgca

SEQ ID NO: 581329 - DNA, 25 bp, Mus musculus
catgtcctctgctgaaattgttgca

SEQ ID NO: 581330 - DNA, 25 bp, Mus musculus
catgtcctggagaagcaccagagcc

SEQ ID NO: 581331 - DNA, 25 bp, Mus musculus
catgtcctggagtagcaccagagcc

SEQ ID NO: 581332 - DNA, 25 bp, Mus musculus
catgtcctggatcggcctgggccac

SEQ ID NO: 581333 - DNA, 25 bp, Mus musculus
catgtcctggatgggcctgggccac

SEQ ID NO: 581334 - DNA, 25 bp, Mus musculus
catgtcctgtgtacaactatcaaag

SEQ ID NO: 581335 - DNA, 25 bp, Mus musculus
catgtcctgtgttcaactatcaaag

SEQ ID NO: 581336 - DNA, 25 bp, Mus musculus
catgtccttccgaaaagttgtgcgg

SEQ ID NO: 581337 - DNA, 25 bp, Mus musculus
catgtccttccgtaaagttgtgcgg

SEQ ID NO: 581338 - DNA, 25 bp, Mus musculus
catgtccttgcacatggatcgcagg

SEQ ID NO: 581339 - DNA, 25 bp, Mus musculus
catgtccttgcagatggatcgcagg

SEQ ID NO: 581340 - DNA, 25 bp, Mus musculus
catgtcgattatctagctgatcaga

SEQ ID NO: 581341 - DNA, 25 bp, Mus musculus
catgtcgattatgtagctgatcaga

SEQ ID NO: 581342 - DNA, 25 bp, Mus musculus
catgtcgcacatccgtttgttcttt

SEQ ID NO: 581343 - DNA, 25 bp, Mus musculus
catgtcgcacatgcgtttgttcttt

SEQ ID NO: 581344 - DNA, 25 bp, Mus musculus
catgtcggacaactacggaggcaca

SEQ ID NO: 581345 - DNA, 25 bp, Mus musculus
catgtcggacaagtacggaggcaca

SEQ ID NO: 581346 - DNA, 25 bp, Mus musculus
catgtcggatggagccacttctacc

SEQ ID NO: 581347 - DNA, 25 bp, Mus musculus
catgtcggatggtgccacttctacc

SEQ ID NO: 581348 - DNA, 25 bp, Mus musculus
catgtcggcaagaatgtgcaacgcc

SEQ ID NO: 581349 - DNA, 25 bp, Mus musculus
catgtcggcaagtatgtgcaacgcc

SEQ ID NO: 581350 - DNA, 25 bp, Mus musculus
catgtcggcgtcagtggtgtccgtc

SEQ ID NO: 581351 - DNA, 25 bp, Mus musculus
catgtcggcgtctgtggtgtccgtc

SEQ ID NO: 581352 - DNA, 25 bp, Mus musculus
catgtcgggccacaccgatgtggat

SEQ ID NO: 581353 - DNA, 25 bp, Mus musculus
catgtcgggccagaccgatgtggat

SEQ ID NO: 581354 - DNA, 25 bp, Mus musculus
catgtcgtgacacatgatgatgaac

SEQ ID NO: 581355 - DNA, 25 bp, Mus musculus
catgtcgtgacagatgatgatgaac

SEQ ID NO: 581356 - DNA, 25 bp, Mus musculus
catgtcgtggctcactcaaggctga

SEQ ID NO: 581357 - DNA, 25 bp, Mus musculus
catgtcgtggctgactcaaggctga

SEQ ID NO: 581358 - DNA, 25 bp, Mus musculus
catgtcgtgtatagcagacagcgga

SEQ ID NO: 581359 - DNA, 25 bp, Mus musculus
catgtcgtgtattgcagacagcgga

SEQ ID NO: 581360 - DNA, 25 bp, Mus musculus
catgtctaagcaaagaaaactgcct

SEQ ID NO: 581361 - DNA, 25 bp, Mus musculus
catgtctaagcatagaaaactgcct

SEQ ID NO: 581362 - DNA, 25 bp, Mus musculus
catgtctacgagcattgaaactgga

SEQ ID NO: 581363 - DNA, 25 bp, Mus musculus
catgtctacgaggattgaaactgga

SEQ ID NO: 581364 - DNA, 25 bp, Mus musculus
catgtctacttacaccctggaggaa

SEQ ID NO: 581365 - DNA, 25 bp, Mus musculus
catgtctacttagaccctggaggaa

SEQ ID NO: 581366 - DNA, 25 bp, Mus musculus
catgtctcaatccatagaagtcttg

SEQ ID NO: 581367 - DNA, 25 bp, Mus musculus
catgtctcaatcgatagaagtcttg

SEQ ID NO: 581368 - DNA, 25 bp, Mus musculus
catgtctcgagactccctggagctt

SEQ ID NO: 581369 - DNA, 25 bp, Mus musculus
catgtctcgagagtccctggagctt

SEQ ID NO: 581370 - DNA, 25 bp, Mus musculus
catgtctcgcaaagggagcaacttt

SEQ ID NO: 581371 - DNA, 25 bp, Mus musculus
catgtctcgcaatgggagcaacttt

SEQ ID NO: 581372 - DNA, 25 bp, Mus musculus
catgtctctaaaaaagggccccagg

SEQ ID NO: 581373 - DNA, 25 bp, Mus musculus
catgtctctaaataagggccccagg

SEQ ID NO: 581374 - DNA, 25 bp, Mus musculus
catgtctctggtcgcggaagcgttc

SEQ ID NO: 581375 - DNA, 25 bp, Mus musculus
catgtctctggtggcggaagcgttc

SEQ ID NO: 581376 - DNA, 25 bp, Mus musculus
catgtctcttgacgagaagatggag

SEQ ID NO: 581377 - DNA, 25 bp, Mus musculus
catgtctcttgaggagaagatggag

SEQ ID NO: 581378 - DNA, 25 bp, Mus musculus
catgtctgaagcagggaaaatcagc

SEQ ID NO: 581379 - DNA, 25 bp, Mus musculus
catgtctgaagctgggaaaatcagc

SEQ ID NO: 581380 - DNA, 25 bp, Mus musculus
catgtctgacctacccactgagaaa

SEQ ID NO: 581381 - DNA, 25 bp, Mus musculus
catgtctgaccttcccactgagaaa

SEQ ID NO: 581382 - DNA, 25 bp, Mus musculus
catgtctggttaatctctgtgcacc

SEQ ID NO: 581383 - DNA, 25 bp, Mus musculus
catgtctggttattctctgtgcacc

SEQ ID NO: 581384 - DNA, 25 bp, Mus musculus
catgtctgtgcgcagaagggccact

SEQ ID NO: 581385 - DNA, 25 bp, Mus musculus
catgtctgtgcggagaagggccact

SEQ ID NO: 581386 - DNA, 25 bp, Mus musculus
catgtctgtgtcacgtgttggccag

SEQ ID NO: 581387 - DNA, 25 bp, Mus musculus
catgtctgtgtctcgtgttggccag

SEQ ID NO: 581388 - DNA, 25 bp, Mus musculus
catgtctgttgtatctgtggagacc

SEQ ID NO: 581389 - DNA, 25 bp, Mus musculus
catgtctgttgtttctgtggagacc

SEQ ID NO: 581390 - DNA, 25 bp, Mus musculus
catgtcttccctcaatttaaggaaa

SEQ ID NO: 581391 - DNA, 25 bp, Mus musculus
catgtcttccctgaatttaaggaaa

SEQ ID NO: 581392 - DNA, 25 bp, Mus musculus
catgtcttcttactggagtccttcg

SEQ ID NO: 581393 - DNA, 25 bp, Mus musculus
catgtcttcttagtggagtccttcg

SEQ ID NO: 581394 - DNA, 25 bp, Mus musculus
catgtcttggcaaccttaaacagga

SEQ ID NO: 581395 - DNA, 25 bp, Mus musculus
catgtcttggcatccttaaacagga

SEQ ID NO: 581396 - DNA, 25 bp, Mus musculus
catgtgaaacccaccttagctgcgg

SEQ ID NO: 581397 - DNA, 25 bp, Mus musculus
catgtgaaaccctccttagctgcgg

SEQ ID NO: 581398 - DNA, 25 bp, Mus musculus
catgtgaaacttaccgactttggcc

SEQ ID NO: 581399 - DNA, 25 bp, Mus musculus
catgtgaaactttccgactttggcc

SEQ ID NO: 581400 - DNA, 25 bp, Mus musculus
catgtgaactgccaggctgcaatat

SEQ ID NO: 581401 - DNA, 25 bp, Mus musculus
catgtgaactgcgaggctgcaatat

SEQ ID NO: 581402 - DNA, 25 bp, Mus musculus
catgtgaagcaccaactggctgaga

SEQ ID NO: 581403 - DNA, 25 bp, Mus musculus
catgtgaagcacgaactggctgaga

SEQ ID NO: 581404 - DNA, 25 bp, Mus musculus
catgtgaagcagagcattgtggctc

SEQ ID NO: 581405 - DNA, 25 bp, Mus musculus
catgtgaagcagtgcattgtggctc

SEQ ID NO: 581406 - DNA, 25 bp, Mus musculus
catgtgaatagcaacaggaactcgc

SEQ ID NO: 581407 - DNA, 25 bp, Mus musculus
catgtgaatagctacaggaactcgc

SEQ ID NO: 581408 - DNA, 25 bp, Mus musculus
catgtgacaagtaccgggccaaagg

SEQ ID NO: 581409 - DNA, 25 bp, Mus musculus
catgtgacaagttccgggccaaagg

SEQ ID NO: 581410 - DNA, 25 bp, Mus musculus
catgtgacaatcaggtgtctgacag

SEQ ID NO: 581411 - DNA, 25 bp, Mus musculus
catgtgacaatctggtgtctgacag

SEQ ID NO: 581412 - DNA, 25 bp, Mus musculus
catgtgacatttcgccatgggaaac

SEQ ID NO: 581413 - DNA, 25 bp, Mus musculus
catgtgacatttggccatgggaaac

SEQ ID NO: 581414 - DNA, 25 bp, Mus musculus
catgtgaccttcagcagctgactgg

SEQ ID NO: 581415 - DNA, 25 bp, Mus musculus
catgtgaccttctgcagctgactgg

SEQ ID NO: 581416 - DNA, 25 bp, Mus musculus
catgtgacgggcagtggcatctctt

SEQ ID NO: 581417 - DNA, 25 bp, Mus musculus
catgtgacgggctgtggcatctctt

SEQ ID NO: 581418 - DNA, 25 bp, Mus musculus
catgtgacggtaccccgcggagcct

SEQ ID NO: 581419 - DNA, 25 bp, Mus musculus
catgtgacggtagcccgcggagcct

SEQ ID NO: 581420 - DNA, 25 bp, Mus musculus
catgtgacttctcaggtctaagcgg

SEQ ID NO: 581421 - DNA, 25 bp, Mus musculus
catgtgacttctgaggtctaagcgg

SEQ ID NO: 581422 - DNA, 25 bp, Mus musculus
catgtgacttttcgagaggaagccc

SEQ ID NO: 581423 - DNA, 25 bp, Mus musculus
catgtgacttttggagaggaagccc

SEQ ID NO: 581424 - DNA, 25 bp, Mus musculus
catgtgagaacacaccgggctccta

SEQ ID NO: 581425 - DNA, 25 bp, Mus musculus
catgtgagaacagaccgggctccta

SEQ ID NO: 581426 - DNA, 25 bp, Mus musculus
catgtgagccctctctgtattggca

SEQ ID NO: 581427 - DNA, 25 bp, Mus musculus
catgtgagccctgtctgtattggca

SEQ ID NO: 581428 - DNA, 25 bp, Mus musculus
catgtgaggaacaactcacttcatt

SEQ ID NO: 581429 - DNA, 25 bp, Mus musculus
catgtgaggaactactcacttcatt

SEQ ID NO: 581430 - DNA, 25 bp, Mus musculus
catgtgagtcgaatgatgctggcct

SEQ ID NO: 581431 - DNA, 25 bp, Mus musculus
catgtgagtcgattgatgctggcct

SEQ ID NO: 581432 - DNA, 25 bp, Mus musculus
catgtgagttggcacaacaagagat

SEQ ID NO: 581433 - DNA, 25 bp, Mus musculus
catgtgagttgggacaacaagagat

SEQ ID NO: 581434 - DNA, 25 bp, Mus musculus
catgtgagtttcaataagtcagaac

SEQ ID NO: 581435 - DNA, 25 bp, Mus musculus
catgtgagtttctataagtcagaac

SEQ ID NO: 581436 - DNA, 25 bp, Mus musculus
catgtgataaccagggagagaatcg

SEQ ID NO: 581437 - DNA, 25 bp, Mus musculus
catgtgataacctgggagagaatcg

SEQ ID NO: 581438 - DNA, 25 bp, Mus musculus
catgtgatagttatggcagcaacca

SEQ ID NO: 581439 - DNA, 25 bp, Mus musculus
catgtgatagttttggcagcaacca

SEQ ID NO: 581440 - DNA, 25 bp, Mus musculus
catgtgatcctcaattctttgcaga

SEQ ID NO: 581441 - DNA, 25 bp, Mus musculus
catgtgatcctctattctttgcaga

SEQ ID NO: 581442 - DNA, 25 bp, Mus musculus
catgtgatctccaatgaagaactga

SEQ ID NO: 581443 - DNA, 25 bp, Mus musculus
catgtgatctcctatgaagaactga

SEQ ID NO: 581444 - DNA, 25 bp, Mus musculus
catgtgatgagcaaatctgcagcga

SEQ ID NO: 581445 - DNA, 25 bp, Mus musculus
catgtgatgagctaatctgcagcga

SEQ ID NO: 581446 - DNA, 25 bp, Mus musculus
catgtgatgcgcaaggacagaagta

SEQ ID NO: 581447 - DNA, 25 bp, Mus musculus
catgtgatgcgctaggacagaagta

SEQ ID NO: 581448 - DNA, 25 bp, Mus musculus
catgtgatggcgaatgcctcctgca

SEQ ID NO: 581449 - DNA, 25 bp, Mus musculus
catgtgatggcgtatgcctcctgca

SEQ ID NO: 581450 - DNA, 25 bp, Mus musculus
catgtgcaagttaaagcccctttta

SEQ ID NO: 581451 - DNA, 25 bp, Mus musculus
catgtgcaagtttaagcccctttta

SEQ ID NO: 581452 - DNA, 25 bp, Mus musculus
catgtgcaattgatcctgagtactc

SEQ ID NO: 581453 - DNA, 25 bp, Mus musculus
catgtgcaattgttcctgagtactc

SEQ ID NO: 581454 - DNA, 25 bp, Mus musculus
catgtgcacctaagtgaaccgtggc

SEQ ID NO: 581455 - DNA, 25 bp, Mus musculus
catgtgcacctatgtgaaccgtggc

SEQ ID NO: 581456 - DNA, 25 bp, Mus musculus
catgtgcaccttcgacttctatgag

SEQ ID NO: 581457 - DNA, 25 bp, Mus musculus
catgtgcaccttggacttctatgag

SEQ ID NO: 581458 - DNA, 25 bp, Mus musculus
catgtgcactggaagacgtggctcg

SEQ ID NO: 581459 - DNA, 25 bp, Mus musculus
catgtgcactggtagacgtggctcg

SEQ ID NO: 581460 - DNA, 25 bp, Mus musculus
catgtgcagcctagatgcagcgatc

SEQ ID NO: 581461 - DNA, 25 bp, Mus musculus
catgtgcagccttgatgcagcgatc

SEQ ID NO: 581462 - DNA, 25 bp, Mus musculus
catgtgcagcttcagagcaggtgcc

SEQ ID NO: 581463 - DNA, 25 bp, Mus musculus
catgtgcagcttgagagcaggtgcc

SEQ ID NO: 581464 - DNA, 25 bp, Mus musculus
catgtgcagtgaacaacggaggctg

SEQ ID NO: 581465 - DNA, 25 bp, Mus musculus
catgtgcagtgatcaacggaggctg

SEQ ID NO: 581466 - DNA, 25 bp, Mus musculus
catgtgcattctctccggctgtgac

SEQ ID NO: 581467 - DNA, 25 bp, Mus musculus
catgtgcattctgtccggctgtgac

SEQ ID NO: 581468 - DNA, 25 bp, Mus musculus
catgtgcattgtaaacggaggtggc

SEQ ID NO: 581469 - DNA, 25 bp, Mus musculus
catgtgcattgttaacggaggtggc

SEQ ID NO: 581470 - DNA, 25 bp, Mus musculus
catgtgccagaacctcaaatcggtg

SEQ ID NO: 581471 - DNA, 25 bp, Mus musculus
catgtgccagaagctcaaatcggtg

SEQ ID NO: 581472 - DNA, 25 bp, Mus musculus
catgtgcccaagaaaggaccctttg

SEQ ID NO: 581473 - DNA, 25 bp, Mus musculus
catgtgcccaagtaaggaccctttg

SEQ ID NO: 581474 - DNA, 25 bp, Mus musculus
catgtgcccagaagaggctgttagg

SEQ ID NO: 581475 - DNA, 25 bp, Mus musculus
catgtgcccagatgaggctgttagg

SEQ ID NO: 581476 - DNA, 25 bp, Mus musculus
catgtgccgcggagcctggccatgt

SEQ ID NO: 581477 - DNA, 25 bp, Mus musculus
catgtgccgcggtgcctggccatgt

SEQ ID NO: 581478 - DNA, 25 bp, Mus musculus
catgtgccggatcatagttcatttc

SEQ ID NO: 581479 - DNA, 25 bp, Mus musculus
catgtgccggatgatagttcatttc

SEQ ID NO: 581480 - DNA, 25 bp, Mus musculus
catgtgccgggtacttggaatgtct

SEQ ID NO: 581481 - DNA, 25 bp, Mus musculus
catgtgccgggttcttggaatgtct

SEQ ID NO: 581482 - DNA, 25 bp, Mus musculus
catgtgcctgcacgctgctattgga

SEQ ID NO: 581483 - DNA, 25 bp, Mus musculus
catgtgcctgcaggctgctattgga

SEQ ID NO: 581484 - DNA, 25 bp, Mus musculus
catgtgcgacctcctgtggtctgac

SEQ ID NO: 581485 - DNA, 25 bp, Mus musculus
catgtgcgacctgctgtggtctgac

SEQ ID NO: 581486 - DNA, 25 bp, Mus musculus
catgtgcgagcacattctaggagcc

SEQ ID NO: 581487 - DNA, 25 bp, Mus musculus
catgtgcgagcagattctaggagcc

SEQ ID NO: 581488 - DNA, 25 bp, Mus musculus
catgtgcgcatgctcacactctacg

SEQ ID NO: 581489 - DNA, 25 bp, Mus musculus
catgtgcgcatggtcacactctacg

SEQ ID NO: 581490 - DNA, 25 bp, Mus musculus
catgtgcgctttcaggtaagggacc

SEQ ID NO: 581491 - DNA, 25 bp, Mus musculus
catgtgcgctttgaggtaagggacc

SEQ ID NO: 581492 - DNA, 25 bp, Mus musculus
catgtgcgtgccagatacctacttt

SEQ ID NO: 581493 - DNA, 25 bp, Mus musculus
catgtgcgtgcctgatacctacttt

SEQ ID NO: 581494 - DNA, 25 bp, Mus musculus
catgtgctcagtcgccaggagtgca

SEQ ID NO: 581495 - DNA, 25 bp, Mus musculus
catgtgctcagtggccaggagtgca

SEQ ID NO: 581496 - DNA, 25 bp, Mus musculus
catgtgctccacagtatagctggcg

SEQ ID NO: 581497 - DNA, 25 bp, Mus musculus
catgtgctccactgtatagctggcg

SEQ ID NO: 581498 - DNA, 25 bp, Mus musculus
catgtgctgtctccgatactggtac

SEQ ID NO: 581499 - DNA, 25 bp, Mus musculus
catgtgctgtctgcgatactggtac

SEQ ID NO: 581500 - DNA, 25 bp, Mus musculus
catgtgcttgaactatactgcgaaa

SEQ ID NO: 581501 - DNA, 25 bp, Mus musculus
catgtgcttgaagtatactgcgaaa

SEQ ID NO: 581502 - DNA, 25 bp, Mus musculus
catgtgcttgccctcacaggaggca

SEQ ID NO: 581503 - DNA, 25 bp, Mus musculus
catgtgcttgccgtcacaggaggca

SEQ ID NO: 581504 - DNA, 25 bp, Mus musculus
catgtgcttgtaaaacatagtgaag

SEQ ID NO: 581505 - DNA, 25 bp, Mus musculus
catgtgcttgtataacatagtgaag

SEQ ID NO: 581506 - DNA, 25 bp, Mus musculus
catgtgcttgtccaaggccttaaag

SEQ ID NO: 581507 - DNA, 25 bp, Mus musculus
catgtgcttgtcgaaggccttaaag

SEQ ID NO: 581508 - DNA, 25 bp, Mus musculus
catgtggaagctcaccagagatgag

SEQ ID NO: 581509 - DNA, 25 bp, Mus musculus
catgtggaagctgaccagagatgag

SEQ ID NO: 581510 - DNA, 25 bp, Mus musculus
catgtggaaggaaacagagtatttc

SEQ ID NO: 581511 - DNA, 25 bp, Mus musculus
catgtggaaggatacagagtatttc

SEQ ID NO: 581512 - DNA, 25 bp, Mus musculus
catgtggaataaattaacagcagac

SEQ ID NO: 581513 - DNA, 25 bp, Mus musculus
catgtggaataatttaacagcagac

SEQ ID NO: 581514 - DNA, 25 bp, Mus musculus
catgtggaatcacccggagactcct

SEQ ID NO: 581515 - DNA, 25 bp, Mus musculus
catgtggaatcagccggagactcct

SEQ ID NO: 581516 - DNA, 25 bp, Mus musculus
catgtggacaataggcctccaagac

SEQ ID NO: 581517 - DNA, 25 bp, Mus musculus
catgtggacaattggcctccaagac

SEQ ID NO: 581518 - DNA, 25 bp, Mus musculus
catgtggacattaataaacgtgcgc

SEQ ID NO: 581519 - DNA, 25 bp, Mus musculus
catgtggacatttataaacgtgcgc

SEQ ID NO: 581520 - DNA, 25 bp, Mus musculus
catgtggaccagaatgaaaccaaag

SEQ ID NO: 581521 - DNA, 25 bp, Mus musculus
catgtggaccagtatgaaaccaaag

SEQ ID NO: 581522 - DNA, 25 bp, Mus musculus
catgtggaccatcaataactttagt

SEQ ID NO: 581523 - DNA, 25 bp, Mus musculus
catgtggaccatgaataactttagt

SEQ ID NO: 581524 - DNA, 25 bp, Mus musculus
catgtggacgatcccattccatcac

SEQ ID NO: 581525 - DNA, 25 bp, Mus musculus
catgtggacgatgccattccatcac

SEQ ID NO: 581526 - DNA, 25 bp, Mus musculus
catgtggacgccatgtgcgttccta

SEQ ID NO: 581527 - DNA, 25 bp, Mus musculus
catgtggacgccttgtgcgttccta

SEQ ID NO: 581528 - DNA, 25 bp, Mus musculus
catgtggactatatcacaggccctg

SEQ ID NO: 581529 - DNA, 25 bp, Mus musculus
catgtggactatttcacaggccctg

SEQ ID NO: 581530 - DNA, 25 bp, Mus musculus
catgtggagcacagtggtcgccaaa

SEQ ID NO: 581531 - DNA, 25 bp, Mus musculus
catgtggagcactgtggtcgccaaa

SEQ ID NO: 581532 - DNA, 25 bp, Mus musculus
catgtggagcctagtagattgtggt

SEQ ID NO: 581533 - DNA, 25 bp, Mus musculus
catgtggagccttgtagattgtggt

SEQ ID NO: 581534 - DNA, 25 bp, Mus musculus
catgtggagcgtacctaaaacctta

SEQ ID NO: 581535 - DNA, 25 bp, Mus musculus
catgtggagcgttcctaaaacctta

SEQ ID NO: 581536 - DNA, 25 bp, Mus musculus
catgtggaggtgcacaactacagac

SEQ ID NO: 581537 - DNA, 25 bp, Mus musculus
catgtggaggtggacaactacagac

SEQ ID NO: 581538 - DNA, 25 bp, Mus musculus
catgtggatgaacgaacagtgtagc

SEQ ID NO: 581539 - DNA, 25 bp, Mus musculus
catgtggatgaaggaacagtgtagc

SEQ ID NO: 581540 - DNA, 25 bp, Mus musculus
catgtggcacagactgcctcaagta

SEQ ID NO: 581541 - DNA, 25 bp, Mus musculus
catgtggcacagtctgcctcaagta

SEQ ID NO: 581542 - DNA, 25 bp, Mus musculus
catgtggcacccagtgatcctggcc

SEQ ID NO: 581543 - DNA, 25 bp, Mus musculus
catgtggcaccctgtgatcctggcc

SEQ ID NO: 581544 - DNA, 25 bp, Mus musculus
catgtggcatggcattcccaaatca

SEQ ID NO: 581545 - DNA, 25 bp, Mus musculus
catgtggcatgggattcccaaatca

SEQ ID NO: 581546 - DNA, 25 bp, Mus musculus
catgtggccatcctctgtgccggat

SEQ ID NO: 581547 - DNA, 25 bp, Mus musculus
catgtggccatcgtctgtgccggat

SEQ ID NO: 581548 - DNA, 25 bp, Mus musculus
catgtggccttaagaaaagaagtca

SEQ ID NO: 581549 - DNA, 25 bp, Mus musculus
catgtggccttatgaaaagaagtca

SEQ ID NO: 581550 - DNA, 25 bp, Mus musculus
catgtggcggtgatgcgcaaccgct

SEQ ID NO: 581551 - DNA, 25 bp, Mus musculus
catgtggcggtgttgcgcaaccgct

SEQ ID NO: 581552 - DNA, 25 bp, Mus musculus
catgtggctgatcacctatgttggt

SEQ ID NO: 581553 - DNA, 25 bp, Mus musculus
catgtggctgatgacctatgttggt

SEQ ID NO: 581554 - DNA, 25 bp, Mus musculus
catgtggctgtcactgtcgttggtg

SEQ ID NO: 581555 - DNA, 25 bp, Mus musculus
catgtggctgtctctgtcgttggtg

SEQ ID NO: 581556 - DNA, 25 bp, Mus musculus
catgtgggaaggaaacatacttgcc

SEQ ID NO: 581557 - DNA, 25 bp, Mus musculus
catgtgggaaggtaacatacttgcc

SEQ ID NO: 581558 - DNA, 25 bp, Mus musculus
catgtgggcagaagtgctccatggc

SEQ ID NO: 581559 - DNA, 25 bp, Mus musculus
catgtgggcagatgtgctccatggc

SEQ ID NO: 581560 - DNA, 25 bp, Mus musculus
catgtgggccccatgtttgaccagt

SEQ ID NO: 581561 - DNA, 25 bp, Mus musculus
catgtgggccccttgtttgaccagt

SEQ ID NO: 581562 - DNA, 25 bp, Mus musculus
catgtgggtacaactgcaactaaga

SEQ ID NO: 581563 - DNA, 25 bp, Mus musculus
catgtgggtacatctgcaactaaga

SEQ ID NO: 581564 - DNA, 25 bp, Mus musculus
catgtgggtatcactttttggagcg

SEQ ID NO: 581565 - DNA, 25 bp, Mus musculus
catgtgggtatctctttttggagcg

SEQ ID NO: 581566 - DNA, 25 bp, Mus musculus
catgtggtaaaaacggagtctggca

SEQ ID NO: 581567 - DNA, 25 bp, Mus musculus
catgtggtaaaatcggagtctggca

SEQ ID NO: 581568 - DNA, 25 bp, Mus musculus
catgtggtattgactgccaggtcgg

SEQ ID NO: 581569 - DNA, 25 bp, Mus musculus
catgtggtattgtctgccaggtcgg

SEQ ID NO: 581570 - DNA, 25 bp, Mus musculus
catgtggtcaaacccctggcacttg

SEQ ID NO: 581571 - DNA, 25 bp, Mus musculus
catgtggtcaaagccctggcacttg

SEQ ID NO: 581572 - DNA, 25 bp, Mus musculus
catgtggtcaccctcaaaattcagt

SEQ ID NO: 581573 - DNA, 25 bp, Mus musculus
catgtggtcaccgtcaaaattcagt

SEQ ID NO: 581574 - DNA, 25 bp, Mus musculus
catgtggtcatccatacagctgggt

SEQ ID NO: 581575 - DNA, 25 bp, Mus musculus
catgtggtcatcgatacagctgggt

SEQ ID NO: 581576 - DNA, 25 bp, Mus musculus
catgtggtcgaaactgggcattggc

SEQ ID NO: 581577 - DNA, 25 bp, Mus musculus
catgtggtcgaatctgggcattggc

SEQ ID NO: 581578 - DNA, 25 bp, Mus musculus
catgtggtgcagcagagtccacctg

SEQ ID NO: 581579 - DNA, 25 bp, Mus musculus
catgtggtgcaggagagtccacctg

SEQ ID NO: 581580 - DNA, 25 bp, Mus musculus
catgtggtgcgcattctcacgggcg

SEQ ID NO: 581581 - DNA, 25 bp, Mus musculus
catgtggtgcgctttctcacgggcg

SEQ ID NO: 581582 - DNA, 25 bp, Mus musculus
catgtggtggttaggagaagttcaa

SEQ ID NO: 581583 - DNA, 25 bp, Mus musculus
catgtggtggtttggagaagttcaa

SEQ ID NO: 581584 - DNA, 25 bp, Mus musculus
catgtggtgttcacctgtggagact

SEQ ID NO: 581585 - DNA, 25 bp, Mus musculus
catgtggtgttctcctgtggagact

SEQ ID NO: 581586 - DNA, 25 bp, Mus musculus
catgtggttcatctacgtgctgagc

SEQ ID NO: 581587 - DNA, 25 bp, Mus musculus
catgtggttcatgtacgtgctgagc

SEQ ID NO: 581588 - DNA, 25 bp, Mus musculus
catgtggtttcaagccccattccga

SEQ ID NO: 581589 - DNA, 25 bp, Mus musculus
catgtggtttcatgccccattccga

SEQ ID NO: 581590 - DNA, 25 bp, Mus musculus
catgtgtaaccactgcgaattttgc

SEQ ID NO: 581591 - DNA, 25 bp, Mus musculus
catgtgtaaccagtgcgaattttgc

SEQ ID NO: 581592 - DNA, 25 bp, Mus musculus
catgtgtaactgaaggctggcttac

SEQ ID NO: 581593 - DNA, 25 bp, Mus musculus
catgtgtaactgtaggctggcttac

SEQ ID NO: 581594 - DNA, 25 bp, Mus musculus
catgtgtcaggaccttcgagtgctc

SEQ ID NO: 581595 - DNA, 25 bp, Mus musculus
catgtgtcaggagcttcgagtgctc

SEQ ID NO: 581596 - DNA, 25 bp, Mus musculus
catgtgtcagtcatcgtaattgtgc

SEQ ID NO: 581597 - DNA, 25 bp, Mus musculus
catgtgtcagtcttcgtaattgtgc

SEQ ID NO: 581598 - DNA, 25 bp, Mus musculus
catgtgtccagtatcgaagtgacgg

SEQ ID NO: 581599 - DNA, 25 bp, Mus musculus
catgtgtccagtttcgaagtgacgg

SEQ ID NO: 581600 - DNA, 25 bp, Mus musculus
catgtgtcgacgcatggtctgcgac

SEQ ID NO: 581601 - DNA, 25 bp, Mus musculus
catgtgtcgacggatggtctgcgac

SEQ ID NO: 581602 - DNA, 25 bp, Mus musculus
catgtgtcgccacgagtggaagttc

SEQ ID NO: 581603 - DNA, 25 bp, Mus musculus
catgtgtcgccaggagtggaagttc

SEQ ID NO: 581604 - DNA, 25 bp, Mus musculus
catgtgtgacatagacattcgcccg

SEQ ID NO: 581605 - DNA, 25 bp, Mus musculus
catgtgtgacattgacattcgcccg

SEQ ID NO: 581606 - DNA, 25 bp, Mus musculus
catgtgtgaggacgccctctgcagt

SEQ ID NO: 581607 - DNA, 25 bp, Mus musculus
catgtgtgaggaggccctctgcagt

SEQ ID NO: 581608 - DNA, 25 bp, Mus musculus
catgtgtgatatcaagactcagcag

SEQ ID NO: 581609 - DNA, 25 bp, Mus musculus
catgtgtgatatgaagactcagcag

SEQ ID NO: 581610 - DNA, 25 bp, Mus musculus
catgtgtgcgcaatgtaagacttta

SEQ ID NO: 581611 - DNA, 25 bp, Mus musculus
catgtgtgcgcattgtaagacttta

SEQ ID NO: 581612 - DNA, 25 bp, Mus musculus
catgtgtggagacttccttcagcac

SEQ ID NO: 581613 - DNA, 25 bp, Mus musculus
catgtgtggagagttccttcagcac

SEQ ID NO: 581614 - DNA, 25 bp, Mus musculus
catgtgtggcccaaactagcctcga

SEQ ID NO: 581615 - DNA, 25 bp, Mus musculus
catgtgtggccctaactagcctcga

SEQ ID NO: 581616 - DNA, 25 bp, Mus musculus
catgtgtgtctcacgtactgcaggc

SEQ ID NO: 581617 - DNA, 25 bp, Mus musculus
catgtgtgtctctcgtactgcaggc

SEQ ID NO: 581618 - DNA, 25 bp, Mus musculus
catgtgtgtggaatgattcaatgcc

SEQ ID NO: 581619 - DNA, 25 bp, Mus musculus
catgtgtgtggattgattcaatgcc

SEQ ID NO: 581620 - DNA, 25 bp, Mus musculus
catgtgtgttgaagcataaagcata

SEQ ID NO: 581621 - DNA, 25 bp, Mus musculus
catgtgtgttgatgcataaagcata

SEQ ID NO: 581622 - DNA, 25 bp, Mus musculus
catgtgttaagaactgtgggcaccg

SEQ ID NO: 581623 - DNA, 25 bp, Mus musculus
catgtgttaagatctgtgggcaccg

SEQ ID NO: 581624 - DNA, 25 bp, Mus musculus
catgtgttcctgaaggccaagaccc

SEQ ID NO: 581625 - DNA, 25 bp, Mus musculus
catgtgttcctgtaggccaagaccc

SEQ ID NO: 581626 - DNA, 25 bp, Mus musculus
catgtgttctagcagcccaaggtga

SEQ ID NO: 581627 - DNA, 25 bp, Mus musculus
catgtgttctaggagcccaaggtga

SEQ ID NO: 581628 - DNA, 25 bp, Mus musculus
catgtgttctatcagctgctctcag

SEQ ID NO: 581629 - DNA, 25 bp, Mus musculus
catgtgttctatgagctgctctcag

SEQ ID NO: 581630 - DNA, 25 bp, Mus musculus
catgtgttctcacggactttgtgcc

SEQ ID NO: 581631 - DNA, 25 bp, Mus musculus
catgtgttctcagggactttgtgcc

SEQ ID NO: 581632 - DNA, 25 bp, Mus musculus
catgtgttgttcagcgtacttcctt

SEQ ID NO: 581633 - DNA, 25 bp, Mus musculus
catgtgttgttctgcgtacttcctt

SEQ ID NO: 581634 - DNA, 25 bp, Mus musculus
catgtgtttcctcacgctggtgtga

SEQ ID NO: 581635 - DNA, 25 bp, Mus musculus
catgtgtttcctgacgctggtgtga

SEQ ID NO: 581636 - DNA, 25 bp, Mus musculus
catgtgtttcttatggtcctaagaa

SEQ ID NO: 581637 - DNA, 25 bp, Mus musculus
catgtgtttcttttggtcctaagaa

SEQ ID NO: 581638 - DNA, 25 bp, Mus musculus
catgtgtttgagacagccgtgccac

SEQ ID NO: 581639 - DNA, 25 bp, Mus musculus
catgtgtttgagtcagccgtgccac

SEQ ID NO: 581640 - DNA, 25 bp, Mus musculus
catgttaaaagactcctgaataaac

SEQ ID NO: 581641 - DNA, 25 bp, Mus musculus
catgttaaaagagtcctgaataaac

SEQ ID NO: 581642 - DNA, 25 bp, Mus musculus
catgttaagtgaaaatggccaattc

SEQ ID NO: 581643 - DNA, 25 bp, Mus musculus
catgttaagtgataatggccaattc

SEQ ID NO: 581644 - DNA, 25 bp, Mus musculus
catgttaattttagggcaaaactgc

SEQ ID NO: 581645 - DNA, 25 bp, Mus musculus
catgttaatttttgggcaaaactgc

SEQ ID NO: 581646 - DNA, 25 bp, Mus musculus
catgttagcctgatctccattaagt

SEQ ID NO: 581647 - DNA, 25 bp, Mus musculus
catgttagcctgttctccattaagt

SEQ ID NO: 581648 - DNA, 25 bp, Mus musculus
catgttaggcttccgcttggatgct

SEQ ID NO: 581649 - DNA, 25 bp, Mus musculus
catgttaggcttgcgcttggatgct

SEQ ID NO: 581650 - DNA, 25 bp, Mus musculus
catgttataacaaagatggaactag

SEQ ID NO: 581651 - DNA, 25 bp, Mus musculus
catgttataacatagatggaactag

SEQ ID NO: 581652 - DNA, 25 bp, Mus musculus
catgttatgggacacagttaaggaa

SEQ ID NO: 581653 - DNA, 25 bp, Mus musculus
catgttatgggagacagttaaggaa

SEQ ID NO: 581654 - DNA, 25 bp, Mus musculus
catgttcaaacacttcaacaagctg

SEQ ID NO: 581655 - DNA, 25 bp, Mus musculus
catgttcaaacagttcaacaagctg

SEQ ID NO: 581656 - DNA, 25 bp, Mus musculus
catgttcaacaactccaaggactct

SEQ ID NO: 581657 - DNA, 25 bp, Mus musculus
catgttcaacaagtccaaggactct

SEQ ID NO: 581658 - DNA, 25 bp, Mus musculus
catgttcaacccagaggagcgcagt

SEQ ID NO: 581659 - DNA, 25 bp, Mus musculus
catgttcaaccctgaggagcgcagt

SEQ ID NO: 581660 - DNA, 25 bp, Mus musculus
catgttcaagaacttcgcagagcgg

SEQ ID NO: 581661 - DNA, 25 bp, Mus musculus
catgttcaagaagttcgcagagcgg

SEQ ID NO: 581662 - DNA, 25 bp, Mus musculus
catgttcaagttcctgatcattggc

SEQ ID NO: 581663 - DNA, 25 bp, Mus musculus
catgttcaagttgctgatcattggc

SEQ ID NO: 581664 - DNA, 25 bp, Mus musculus
catgttcacaaacatggcaacttgg

SEQ ID NO: 581665 - DNA, 25 bp, Mus musculus
catgttcacaaagatggcaacttgg

SEQ ID NO: 581666 - DNA, 25 bp, Mus musculus
catgttcacacaccagtacctgcag

SEQ ID NO: 581667 - DNA, 25 bp, Mus musculus
catgttcacacagcagtacctgcag

SEQ ID NO: 581668 - DNA, 25 bp, Mus musculus
catgttcaccagatcgatgcagtgc

SEQ ID NO: 581669 - DNA, 25 bp, Mus musculus
catgttcaccagttcgatgcagtgc

SEQ ID NO: 581670 - DNA, 25 bp, Mus musculus
catgttcacgcgagctctggagtac

SEQ ID NO: 581671 - DNA, 25 bp, Mus musculus
catgttcacgcgtgctctggagtac

SEQ ID NO: 581672 - DNA, 25 bp, Mus musculus
catgttcactatcctgtatctggtg

SEQ ID NO: 581673 - DNA, 25 bp, Mus musculus
catgttcactatgctgtatctggtg

SEQ ID NO: 581674 - DNA, 25 bp, Mus musculus
catgttcagagacgttgtaaagaca

SEQ ID NO: 581675 - DNA, 25 bp, Mus musculus
catgttcagagaggttgtaaagaca

SEQ ID NO: 581676 - DNA, 25 bp, Mus musculus
catgttcagcttaatgaggcctgga

SEQ ID NO: 581677 - DNA, 25 bp, Mus musculus
catgttcagctttatgaggcctgga

SEQ ID NO: 581678 - DNA, 25 bp, Mus musculus
catgttcattgaagatgaccgccgg

SEQ ID NO: 581679 - DNA, 25 bp, Mus musculus
catgttcattgatgatgaccgccgg

SEQ ID NO: 581680 - DNA, 25 bp, Mus musculus
catgttcccgcactgaaattgctgc

SEQ ID NO: 581681 - DNA, 25 bp, Mus musculus
catgttcccgcagtgaaattgctgc

SEQ ID NO: 581682 - DNA, 25 bp, Mus musculus
catgttccctaacgcagagctccgt

SEQ ID NO: 581683 - DNA, 25 bp, Mus musculus
catgttccctaaggcagagctccgt

SEQ ID NO: 581684 - DNA, 25 bp, Mus musculus
catgttccctgacacgctagatgag

SEQ ID NO: 581685 - DNA, 25 bp, Mus musculus
catgttccctgagacgctagatgag

SEQ ID NO: 581686 - DNA, 25 bp, Mus musculus
catgttccctgcaaatggcagcatt

SEQ ID NO: 581687 - DNA, 25 bp, Mus musculus
catgttccctgctaatggcagcatt

SEQ ID NO: 581688 - DNA, 25 bp, Mus musculus
catgttcctcttccgagtaacggtg

SEQ ID NO: 581689 - DNA, 25 bp, Mus musculus
catgttcctcttgcgagtaacggtg

SEQ ID NO: 581690 - DNA, 25 bp, Mus musculus
catgttcctggaagactcctttcgc

SEQ ID NO: 581691 - DNA, 25 bp, Mus musculus
catgttcctggatgactcctttcgc

SEQ ID NO: 581692 - DNA, 25 bp, Mus musculus
catgttcggcccacttctgtgcggt

SEQ ID NO: 581693 - DNA, 25 bp, Mus musculus
catgttcggccctcttctgtgcggt

SEQ ID NO: 581694 - DNA, 25 bp, Mus musculus
catgttcggtgtcgtaggcatcccc

SEQ ID NO: 581695 - DNA, 25 bp, Mus musculus
catgttcggtgtggtaggcatcccc

SEQ ID NO: 581696 - DNA, 25 bp, Mus musculus
catgttcgttctacagttctaatgc

SEQ ID NO: 581697 - DNA, 25 bp, Mus musculus
catgttcgttcttcagttctaatgc

SEQ ID NO: 581698 - DNA, 25 bp, Mus musculus
catgttctcagaacttcttagtgac

SEQ ID NO: 581699 - DNA, 25 bp, Mus musculus
catgttctcagatcttcttagtgac

SEQ ID NO: 581700 - DNA, 25 bp, Mus musculus
catgttctccacatgttggaaaaac

SEQ ID NO: 581701 - DNA, 25 bp, Mus musculus
catgttctccacttgttggaaaaac

SEQ ID NO: 581702 - DNA, 25 bp, Mus musculus
catgttctgaaacggcagcgttgat

SEQ ID NO: 581703 - DNA, 25 bp, Mus musculus
catgttctgaaagggcagcgttgat

SEQ ID NO: 581704 - DNA, 25 bp, Mus musculus
catgttctggaacctggaaaccttg

SEQ ID NO: 581705 - DNA, 25 bp, Mus musculus
catgttctggaactttcaacgctac

SEQ ID NO: 581706 - DNA, 25 bp, Mus musculus
catgttctggaagctggaaaccttg

SEQ ID NO: 581707 - DNA, 25 bp, Mus musculus
catgttctggaagtttcaacgctac

SEQ ID NO: 581708 - DNA, 25 bp, Mus musculus
catgttctggctccgcttctaggca

SEQ ID NO: 581709 - DNA, 25 bp, Mus musculus
catgttctggctgcgcttctaggca

SEQ ID NO: 581710 - DNA, 25 bp, Mus musculus
catgttctgggtagggcacgtgttc

SEQ ID NO: 581711 - DNA, 25 bp, Mus musculus
catgttctgggttgggcacgtgttc

SEQ ID NO: 581712 - DNA, 25 bp, Mus musculus
catgttgaaagaagccgccgtgatc

SEQ ID NO: 581713 - DNA, 25 bp, Mus musculus
catgttgaaagatgccgccgtgatc

SEQ ID NO: 581714 - DNA, 25 bp, Mus musculus
catgttgaaatgagtaccacaggct

SEQ ID NO: 581715 - DNA, 25 bp, Mus musculus
catgttgaaatgtgtaccacaggct

SEQ ID NO: 581716 - DNA, 25 bp, Mus musculus
catgttgagcaaacggacctgagcc

SEQ ID NO: 581717 - DNA, 25 bp, Mus musculus
catgttgagcaatcggacctgagcc

SEQ ID NO: 581718 - DNA, 25 bp, Mus musculus
catgttgccatcctcactgcaagga

SEQ ID NO: 581719 - DNA, 25 bp, Mus musculus
catgttgccatcgtcactgcaagga

SEQ ID NO: 581720 - DNA, 25 bp, Mus musculus
catgttgcccatcaaagtgcgggca

SEQ ID NO: 581721 - DNA, 25 bp, Mus musculus
catgttgcccatgaaagtgcgggca

SEQ ID NO: 581722 - DNA, 25 bp, Mus musculus
catgttgcctagacagcctgctggg

SEQ ID NO: 581723 - DNA, 25 bp, Mus musculus
catgttgcctagtcagcctgctggg

SEQ ID NO: 581724 - DNA, 25 bp, Mus musculus
catgttgctaacactgggtatggga

SEQ ID NO: 581725 - DNA, 25 bp, Mus musculus
catgttgctaactctgggtatggga

SEQ ID NO: 581726 - DNA, 25 bp, Mus musculus
catgttgctaagctgcagctacccc

SEQ ID NO: 581727 - DNA, 25 bp, Mus musculus
catgttgctaaggtgcagctacccc

SEQ ID NO: 581728 - DNA, 25 bp, Mus musculus
catgttgctgccagcctgcagtatc

SEQ ID NO: 581729 - DNA, 25 bp, Mus musculus
catgttgctgcctgcctgcagtatc

SEQ ID NO: 581730 - DNA, 25 bp, Mus musculus
catgttgcttctctgcgagtctatc

SEQ ID NO: 581731 - DNA, 25 bp, Mus musculus
catgttgcttctgtgcgagtctatc

SEQ ID NO: 581732 - DNA, 25 bp, Mus musculus
catgttgcttggaagagattcctgc

SEQ ID NO: 581733 - DNA, 25 bp, Mus musculus
catgttgcttggtagagattcctgc

SEQ ID NO: 581734 - DNA, 25 bp, Mus musculus
catgttggagtgcatccaagagaaa

SEQ ID NO: 581735 - DNA, 25 bp, Mus musculus
catgttggagtggatccaagagaaa

SEQ ID NO: 581736 - DNA, 25 bp, Mus musculus
catgttggagttcttgaaatccttt

SEQ ID NO: 581737 - DNA, 25 bp, Mus musculus
catgttggagttgttgaaatccttt

SEQ ID NO: 581738 - DNA, 25 bp, Mus musculus
catgttggcatgagttattgtcata

SEQ ID NO: 581739 - DNA, 25 bp, Mus musculus
catgttggcatgtgttattgtcata

SEQ ID NO: 581740 - DNA, 25 bp, Mus musculus
catgttggctggcagggtcccctct

SEQ ID NO: 581741 - DNA, 25 bp, Mus musculus
catgttggctgggagggtcccctct

SEQ ID NO: 581742 - DNA, 25 bp, Mus musculus
catgttgggcaaatgggagctctga

SEQ ID NO: 581743 - DNA, 25 bp, Mus musculus
catgttgggcaattgggagctctga

SEQ ID NO: 581744 - DNA, 25 bp, Mus musculus
catgttggtgccagctgttgaggac

SEQ ID NO: 581745 - DNA, 25 bp, Mus musculus
catgttggtgcctgctgttgaggac

SEQ ID NO: 581746 - DNA, 25 bp, Mus musculus
catgttgtactgagctgctgaagag

SEQ ID NO: 581747 - DNA, 25 bp, Mus musculus
catgttgtactgtgctgctgaagag

SEQ ID NO: 581748 - DNA, 25 bp, Mus musculus
catgttgtagccagtcaactgcagt

SEQ ID NO: 581749 - DNA, 25 bp, Mus musculus
catgttgtagcctgtcaactgcagt

SEQ ID NO: 581750 - DNA, 25 bp, Mus musculus
catgttgtcatgaaggcccttgtga

SEQ ID NO: 581751 - DNA, 25 bp, Mus musculus
catgttgtcatgtaggcccttgtga

SEQ ID NO: 581752 - DNA, 25 bp, Mus musculus
catgttgtccttctttctcatggaa

SEQ ID NO: 581753 - DNA, 25 bp, Mus musculus
catgttgtccttgtttctcatggaa

SEQ ID NO: 581754 - DNA, 25 bp, Mus musculus
catgttgtgaggctttgcttccgca

SEQ ID NO: 581755 - DNA, 25 bp, Mus musculus
catgttgtgagggtttgcttccgca

SEQ ID NO: 581756 - DNA, 25 bp, Mus musculus
catgttgtgcccagtgagaaggtca

SEQ ID NO: 581757 - DNA, 25 bp, Mus musculus
catgttgtgccctgtgagaaggtca

SEQ ID NO: 581758 - DNA, 25 bp, Mus musculus
catgttgtgggtctctgagaagcta

SEQ ID NO: 581759 - DNA, 25 bp, Mus musculus
catgttgtgggtgtctgagaagcta

SEQ ID NO: 581760 - DNA, 25 bp, Mus musculus
catgttgttataacagtacttggtc

SEQ ID NO: 581761 - DNA, 25 bp, Mus musculus
catgttgttatatcagtacttggtc

SEQ ID NO: 581762 - DNA, 25 bp, Mus musculus
catgtttaactcaggcgaggatggc

SEQ ID NO: 581763 - DNA, 25 bp, Mus musculus
catgtttaactctggcgaggatggc

SEQ ID NO: 581764 - DNA, 25 bp, Mus musculus
catgtttaccatcgtccttgtcacc

SEQ ID NO: 581765 - DNA, 25 bp, Mus musculus
catgtttaccatggtccttgtcacc

SEQ ID NO: 581766 - DNA, 25 bp, Mus musculus
catgtttagccgagagaagtaacac

SEQ ID NO: 581767 - DNA, 25 bp, Mus musculus
catgtttagccgtgagaagtaacac

SEQ ID NO: 581768 - DNA, 25 bp, Mus musculus
catgtttcaagcacagtagtgaaag

SEQ ID NO: 581769 - DNA, 25 bp, Mus musculus
catgtttcaagctcagtagtgaaag

SEQ ID NO: 581770 - DNA, 25 bp, Mus musculus
catgtttcaaggcaggaggctctct

SEQ ID NO: 581771 - DNA, 25 bp, Mus musculus
catgtttcaagggaggaggctctct

SEQ ID NO: 581772 - DNA, 25 bp, Mus musculus
catgtttcagttcccagttgacacc

SEQ ID NO: 581773 - DNA, 25 bp, Mus musculus
catgtttcagttgccagttgacacc

SEQ ID NO: 581774 - DNA, 25 bp, Mus musculus
catgtttccaaacataatgggccca

SEQ ID NO: 581775 - DNA, 25 bp, Mus musculus
catgtttccaaagataatgggccca

SEQ ID NO: 581776 - DNA, 25 bp, Mus musculus
catgtttgatgactctccgcctcct

SEQ ID NO: 581777 - DNA, 25 bp, Mus musculus
catgtttgatgagtctccgcctcct

SEQ ID NO: 581778 - DNA, 25 bp, Mus musculus
catgtttgatggacttattctgcac

SEQ ID NO: 581779 - DNA, 25 bp, Mus musculus
catgtttgatggtcttattctgcac

SEQ ID NO: 581780 - DNA, 25 bp, Mus musculus
catgtttgccagctacgtccctgaa

SEQ ID NO: 581781 - DNA, 25 bp, Mus musculus
catgtttgccaggtacgtccctgaa

SEQ ID NO: 581782 - DNA, 25 bp, Mus musculus
catgtttgctaaccaggctccctgg

SEQ ID NO: 581783 - DNA, 25 bp, Mus musculus
catgtttgctaagcaggctccctgg

SEQ ID NO: 581784 - DNA, 25 bp, Mus musculus
catgtttgctcccacacagaggaca

SEQ ID NO: 581785 - DNA, 25 bp, Mus musculus
catgtttgctccgacacagaggaca

SEQ ID NO: 581786 - DNA, 25 bp, Mus musculus
catgtttgctgactaccttgccagt

SEQ ID NO: 581787 - DNA, 25 bp, Mus musculus
catgtttgctgagtaccttgccagt

SEQ ID NO: 581788 - DNA, 25 bp, Mus musculus
catgtttgggatatttggtgccaat

SEQ ID NO: 581789 - DNA, 25 bp, Mus musculus
catgtttgggatttttggtgccaat

SEQ ID NO: 581790 - DNA, 25 bp, Mus musculus
catgtttggttcaatggccgtttga

SEQ ID NO: 581791 - DNA, 25 bp, Mus musculus
catgtttggttctatggccgtttga

SEQ ID NO: 581792 - DNA, 25 bp, Mus musculus
catgtttgtcatcaactggtgggca

SEQ ID NO: 581793 - DNA, 25 bp, Mus musculus
catgtttgtcatgaactggtgggca

SEQ ID NO: 581794 - DNA, 25 bp, Mus musculus
catgtttgttcgagagacatctgcc

SEQ ID NO: 581795 - DNA, 25 bp, Mus musculus
catgtttgttcgtgagacatctgcc

SEQ ID NO: 581796 - DNA, 25 bp, Mus musculus
catgttttaagcagtgccgtggcac

SEQ ID NO: 581797 - DNA, 25 bp, Mus musculus
catgttttaagctgtgccgtggcac

SEQ ID NO: 581798 - DNA, 25 bp, Mus musculus
catgtttttacaccagcccgcagat

SEQ ID NO: 581799 - DNA, 25 bp, Mus musculus
catgtttttacagcagcccgcagat

SEQ ID NO: 581800 - DNA, 25 bp, Mus musculus
cattaaaaacatcgaagtttcccag

SEQ ID NO: 581801 - DNA, 25 bp, Mus musculus
cattaaaaacatggaagtttcccag

SEQ ID NO: 581802 - DNA, 25 bp, Mus musculus
cattaaaacgtgcaaggaagacctt

SEQ ID NO: 581803 - DNA, 25 bp, Mus musculus
cattaaaacgtggaaggaagacctt

SEQ ID NO: 581804 - DNA, 25 bp, Mus musculus
cattaaaagaagatgtgattcatcc

SEQ ID NO: 581805 - DNA, 25 bp, Mus musculus
cattaaaagaagttgtgattcatcc

SEQ ID NO: 581806 - DNA, 25 bp, Mus musculus
cattaaaagtcacagttctaaggcc

SEQ ID NO: 581807 - DNA, 25 bp, Mus musculus
cattaaaagtcagagttctaaggcc

SEQ ID NO: 581808 - DNA, 25 bp, Mus musculus
cattaaaatgatatcccgagggagc

SEQ ID NO: 581809 - DNA, 25 bp, Mus musculus
cattaaaatgatttcccgagggagc

SEQ ID NO: 581810 - DNA, 25 bp, Mus musculus
cattaaacaggccaagatccactac

SEQ ID NO: 581811 - DNA, 25 bp, Mus musculus
cattaaacaggcgaagatccactac

SEQ ID NO: 581812 - DNA, 25 bp, Mus musculus
cattaaacagtcagccagtgggacc

SEQ ID NO: 581813 - DNA, 25 bp, Mus musculus
cattaaacagtctgccagtgggacc

SEQ ID NO: 581814 - DNA, 25 bp, Mus musculus
cattaaagcactcaatagaaatagt

SEQ ID NO: 581815 - DNA, 25 bp, Mus musculus
cattaaagcactgaatagaaatagt

SEQ ID NO: 581816 - DNA, 25 bp, Mus musculus
cattaaaggtctcatgacaaaagtt

SEQ ID NO: 581817 - DNA, 25 bp, Mus musculus
cattaaaggtctgatgacaaaagtt

SEQ ID NO: 581818 - DNA, 25 bp, Mus musculus
cattaaagtctgagaccccgtgcct

SEQ ID NO: 581819 - DNA, 25 bp, Mus musculus
cattaaagtctgtgaccccgtgcct

SEQ ID NO: 581820 - DNA, 25 bp, Mus musculus
cattaaatagcactaggcctccctc

SEQ ID NO: 581821 - DNA, 25 bp, Mus musculus
cattaaatagcagtaggcctccctc

SEQ ID NO: 581822 - DNA, 25 bp, Mus musculus
cattaaatcagaaaaccttacccgg

SEQ ID NO: 581823 - DNA, 25 bp, Mus musculus
cattaaatcagataaccttacccgg

SEQ ID NO: 581824 - DNA, 25 bp, Mus musculus
cattaaatctttagaacagactgga

SEQ ID NO: 581825 - DNA, 25 bp, Mus musculus
cattaaatcttttgaacagactgga

SEQ ID NO: 581826 - DNA, 25 bp, Mus musculus
cattaacaatgactggcacgacgcc

SEQ ID NO: 581827 - DNA, 25 bp, Mus musculus
cattaacaatgagtggcacgacgcc

SEQ ID NO: 581828 - DNA, 25 bp, Mus musculus
cattaacactggatggcctcctgga

SEQ ID NO: 581829 - DNA, 25 bp, Mus musculus
cattaacactggttggcctcctgga

SEQ ID NO: 581830 - DNA, 25 bp, Mus musculus
cattaacagcaaccggcgaggccga

SEQ ID NO: 581831 - DNA, 25 bp, Mus musculus
cattaacagcaagcggcgaggccga

SEQ ID NO: 581832 - DNA, 25 bp, Mus musculus
cattaacattgacccgtgtgctaag

SEQ ID NO: 581833 - DNA, 25 bp, Mus musculus
cattaacattgagccgtgtgctaag

SEQ ID NO: 581834 - DNA, 25 bp, Mus musculus
cattaaccatcacgactgtatggct

SEQ ID NO: 581835 - DNA, 25 bp, Mus musculus
cattaaccatcaggactgtatggct

SEQ ID NO: 581836 - DNA, 25 bp, Mus musculus
cattaaccatgtccccgagaagcgg

SEQ ID NO: 581837 - DNA, 25 bp, Mus musculus
cattaaccatgtgcccgagaagcgg

SEQ ID NO: 581838 - DNA, 25 bp, Mus musculus
cattaacctgccacagggagtgcgc

SEQ ID NO: 581839 - DNA, 25 bp, Mus musculus
cattaacctgcctcagggagtgcgc

SEQ ID NO: 581840 - DNA, 25 bp, Mus musculus
cattaacgagctcactgccctggtt

SEQ ID NO: 581841 - DNA, 25 bp, Mus musculus
cattaacgagctgactgccctggtt

SEQ ID NO: 581842 - DNA, 25 bp, Mus musculus
cattaactgtgcctatgtcaagtgg

SEQ ID NO: 581843 - DNA, 25 bp, Mus musculus
cattaactgtgcgtatgtcaagtgg

SEQ ID NO: 581844 - DNA, 25 bp, Mus musculus
cattaacttcgaagcctttcttgga

SEQ ID NO: 581845 - DNA, 25 bp, Mus musculus
cattaacttcgatgcctttcttgga

SEQ ID NO: 581846 - DNA, 25 bp, Mus musculus
cattaagaacgtcgtgctgcagacc

SEQ ID NO: 581847 - DNA, 25 bp, Mus musculus
cattaagaacgtggtgctgcagacc

SEQ ID NO: 581848 - DNA, 25 bp, Mus musculus
cattaagaacttcgatgacaccatt

SEQ ID NO: 581849 - DNA, 25 bp, Mus musculus
cattaagaacttggatgacaccatt

SEQ ID NO: 581850 - DNA, 25 bp, Mus musculus
cattaagagagcaccagtgatctgg

SEQ ID NO: 581851 - DNA, 25 bp, Mus musculus
cattaagagagctccagtgatctgg

SEQ ID NO: 581852 - DNA, 25 bp, Mus musculus
cattaagagtgacgatgaagctgcc

SEQ ID NO: 581853 - DNA, 25 bp, Mus musculus
cattaagagtgaggatgaagctgcc

SEQ ID NO: 581854 - DNA, 25 bp, Mus musculus
cattaagatggaagacggagttgtc

SEQ ID NO: 581855 - DNA, 25 bp, Mus musculus
cattaagatggatgacggagttgtc

SEQ ID NO: 581856 - DNA, 25 bp, Mus musculus
cattaagcacctaatggaggcagaa

SEQ ID NO: 581857 - DNA, 25 bp, Mus musculus
cattaagcaccttatggaggcagaa

SEQ ID NO: 581858 - DNA, 25 bp, Mus musculus
cattaaggacttagcccttgacccg

SEQ ID NO: 581859 - DNA, 25 bp, Mus musculus
cattaaggactttgcccttgacccg

SEQ ID NO: 581860 - DNA, 25 bp, Mus musculus
cattaaggtgtgaggtcgtgttacc

SEQ ID NO: 581861 - DNA, 25 bp, Mus musculus
cattaaggtgtgtggtcgtgttacc

SEQ ID NO: 581862 - DNA, 25 bp, Mus musculus
cattaaggttaacattcgaaatgcc

SEQ ID NO: 581863 - DNA, 25 bp, Mus musculus
cattaaggttaagattcgaaatgcc

SEQ ID NO: 581864 - DNA, 25 bp, Mus musculus
cattaaggttcaagaggattcctcc

SEQ ID NO: 581865 - DNA, 25 bp, Mus musculus
cattaaggttcatgaggattcctcc

SEQ ID NO: 581866 - DNA, 25 bp, Mus musculus
cattaagtctgacacatctggaagc

SEQ ID NO: 581867 - DNA, 25 bp, Mus musculus
cattaagtctgagacatctggaagc

SEQ ID NO: 581868 - DNA, 25 bp, Mus musculus
cattaatcgttcagctcgactgttc

SEQ ID NO: 581869 - DNA, 25 bp, Mus musculus
cattaatcgttctgctcgactgttc

SEQ ID NO: 581870 - DNA, 25 bp, Mus musculus
cattaatctgtaagtgcggcgcggc

SEQ ID NO: 581871 - DNA, 25 bp, Mus musculus
cattaatctgtatgtgcggcgcggc

SEQ ID NO: 581872 - DNA, 25 bp, Mus musculus
cattaatgacttctcccgtgaaaag

SEQ ID NO: 581873 - DNA, 25 bp, Mus musculus
cattaatgacttgtcccgtgaaaag

SEQ ID NO: 581874 - DNA, 25 bp, Mus musculus
cattaatgcctccatttatgatgag

SEQ ID NO: 581875 - DNA, 25 bp, Mus musculus
cattaatgcctcgatttatgatgag

SEQ ID NO: 581876 - DNA, 25 bp, Mus musculus
cattaatggccgcaggcagctcctc

SEQ ID NO: 581877 - DNA, 25 bp, Mus musculus
cattaatggccggaggcagctcctc

SEQ ID NO: 581878 - DNA, 25 bp, Mus musculus
cattaatgtgacagctacagccatg

SEQ ID NO: 581879 - DNA, 25 bp, Mus musculus
cattaatgtgactgctacagccatg

SEQ ID NO: 581880 - DNA, 25 bp, Mus musculus
cattaatgtggacttaactgaagaa

SEQ ID NO: 581881 - DNA, 25 bp, Mus musculus
cattaatgtggagttaactgaagaa

SEQ ID NO: 581882 - DNA, 25 bp, Mus musculus
cattaattcgctaagcagaagccca

SEQ ID NO: 581883 - DNA, 25 bp, Mus musculus
cattaattcgcttagcagaagccca

SEQ ID NO: 581884 - DNA, 25 bp, Mus musculus
cattaattgacgaaagctcccagac

SEQ ID NO: 581885 - DNA, 25 bp, Mus musculus
cattaattgacgtaagctcccagac

SEQ ID NO: 581886 - DNA, 25 bp, Mus musculus
cattaattgggtacatacatttggg

SEQ ID NO: 581887 - DNA, 25 bp, Mus musculus
cattaattgggttcatacatttggg

SEQ ID NO: 581888 - DNA, 25 bp, Mus musculus
cattacaaagtgctaaaccggcgta

SEQ ID NO: 581889 - DNA, 25 bp, Mus musculus
cattacaaagtggtaaaccggcgta

SEQ ID NO: 581890 - DNA, 25 bp, Mus musculus
cattacaagaagaaccccatggtgg

SEQ ID NO: 581891 - DNA, 25 bp, Mus musculus
cattacaagaagtaccccatggtgg

SEQ ID NO: 581892 - DNA, 25 bp, Mus musculus
cattacaagataaggcaagccgtgt

SEQ ID NO: 581893 - DNA, 25 bp, Mus musculus
cattacaagatatggcaagccgtgt

SEQ ID NO: 581894 - DNA, 25 bp, Mus musculus
cattacaagtcaatcaaagtcagca

SEQ ID NO: 581895 - DNA, 25 bp, Mus musculus
cattacaagtcattcaaagtcagca

SEQ ID NO: 581896 - DNA, 25 bp, Mus musculus
cattacaagttgacctccacggtga

SEQ ID NO: 581897 - DNA, 25 bp, Mus musculus
cattacaagttgtcctccacggtga

SEQ ID NO: 581898 - DNA, 25 bp, Mus musculus
cattacacagcacaagcagatagtg

SEQ ID NO: 581899 - DNA, 25 bp, Mus musculus
cattacacagcagaagcagatagtg

SEQ ID NO: 581900 - DNA, 25 bp, Mus musculus
cattacacggagatccttccaagaa

SEQ ID NO: 581901 - DNA, 25 bp, Mus musculus
cattacacggagttccttccaagaa

SEQ ID NO: 581902 - DNA, 25 bp, Mus musculus
cattacagatgaaatagcccaggct

SEQ ID NO: 581903 - DNA, 25 bp, Mus musculus
cattacagatgatatagcccaggct

SEQ ID NO: 581904 - DNA, 25 bp, Mus musculus
cattacagtgccattactcaaggca

SEQ ID NO: 581905 - DNA, 25 bp, Mus musculus
cattacagtgcctttactcaaggca

SEQ ID NO: 581906 - DNA, 25 bp, Mus musculus
cattacagttcccagccgtgctgga

SEQ ID NO: 581907 - DNA, 25 bp, Mus musculus
cattacagttccgagccgtgctgga

SEQ ID NO: 581908 - DNA, 25 bp, Mus musculus
cattacatggagagccggaagaaga

SEQ ID NO: 581909 - DNA, 25 bp, Mus musculus
cattacatggagtgccggaagaaga

SEQ ID NO: 581910 - DNA, 25 bp, Mus musculus
cattaccaacaaagctgttaaaggc

SEQ ID NO: 581911 - DNA, 25 bp, Mus musculus
cattaccaacaatgctgttaaaggc

SEQ ID NO: 581912 - DNA, 25 bp, Mus musculus
cattaccaagtaccctgtcagaagt

SEQ ID NO: 581913 - DNA, 25 bp, Mus musculus
cattaccaagtagcctgtcagaagt

SEQ ID NO: 581914 - DNA, 25 bp, Mus musculus
cattacccatgtagtgaatgtggct

SEQ ID NO: 581915 - DNA, 25 bp, Mus musculus
cattacccatgttgtgaatgtggct

SEQ ID NO: 581916 - DNA, 25 bp, Mus musculus
cattaccccaacagggacatccatt

SEQ ID NO: 581917 - DNA, 25 bp, Mus musculus
cattaccccaactgggacatccatt

SEQ ID NO: 581918 - DNA, 25 bp, Mus musculus
cattacccggtgagggctgtccaat

SEQ ID NO: 581919 - DNA, 25 bp, Mus musculus
cattacccggtgtgggctgtccaat

SEQ ID NO: 581920 - DNA, 25 bp, Mus musculus
cattacctcatgaaagacagcctca

SEQ ID NO: 581921 - DNA, 25 bp, Mus musculus
cattacctcatgtaagacagcctca

SEQ ID NO: 581922 - DNA, 25 bp, Mus musculus
cattacctgcagctcaaccttgcgg

SEQ ID NO: 581923 - DNA, 25 bp, Mus musculus
cattacctgcaggtcaaccttgcgg

SEQ ID NO: 581924 - DNA, 25 bp, Mus musculus
cattacctggacctgctggcaatgt

SEQ ID NO: 581925 - DNA, 25 bp, Mus musculus
cattacctggacgtgctggcaatgt

SEQ ID NO: 581926 - DNA, 25 bp, Mus musculus
cattaccttggccagaggcttgaac

SEQ ID NO: 581927 - DNA, 25 bp, Mus musculus
cattaccttggcgagaggcttgaac

SEQ ID NO: 581928 - DNA, 25 bp, Mus musculus
cattacgagaaaccagaccgaacgc

SEQ ID NO: 581929 - DNA, 25 bp, Mus musculus
cattacgagaaagcagaccgaacgc

SEQ ID NO: 581930 - DNA, 25 bp, Mus musculus
cattacgaggatacttgcatttcga

SEQ ID NO: 581931 - DNA, 25 bp, Mus musculus
cattacgaggattcttgcatttcga

SEQ ID NO: 581932 - DNA, 25 bp, Mus musculus
cattacgctgctaataaaggccacg

SEQ ID NO: 581933 - DNA, 25 bp, Mus musculus
cattacgctgcttataaaggccacg

SEQ ID NO: 581934 - DNA, 25 bp, Mus musculus
cattacggcgtgatcacctgcgagg

SEQ ID NO: 581935 - DNA, 25 bp, Mus musculus
cattacggcgtgttcacctgcgagg

SEQ ID NO: 581936 - DNA, 25 bp, Mus musculus
cattacggtcctctttaagagccca

SEQ ID NO: 581937 - DNA, 25 bp, Mus musculus
cattacggtcctgtttaagagccca

SEQ ID NO: 581938 - DNA, 25 bp, Mus musculus
cattacggtgttaggctgaattcca

SEQ ID NO: 581939 - DNA, 25 bp, Mus musculus
cattacggtgtttggctgaattcca

SEQ ID NO: 581940 - DNA, 25 bp, Mus musculus
cattactaacacctatgattagggc

SEQ ID NO: 581941 - DNA, 25 bp, Mus musculus
cattactaacacgtatgattagggc

SEQ ID NO: 581942 - DNA, 25 bp, Mus musculus
cattactatcggacagtccattgtg

SEQ ID NO: 581943 - DNA, 25 bp, Mus musculus
cattactatcggtcagtccattgtg

SEQ ID NO: 581944 - DNA, 25 bp, Mus musculus
cattactcaaggcagttgaatgagg

SEQ ID NO: 581945 - DNA, 25 bp, Mus musculus
cattactcaagggagttgaatgagg

SEQ ID NO: 581946 - DNA, 25 bp, Mus musculus
cattactcaattctgtggcagttgg

SEQ ID NO: 581947 - DNA, 25 bp, Mus musculus
cattactcaattgtgtggcagttgg

SEQ ID NO: 581948 - DNA, 25 bp, Mus musculus
cattactccctcatacagatatggg

SEQ ID NO: 581949 - DNA, 25 bp, Mus musculus
cattactccctcttacagatatggg

SEQ ID NO: 581950 - DNA, 25 bp, Mus musculus
cattactcgcatctgggagaggctt

SEQ ID NO: 581951 - DNA, 25 bp, Mus musculus
cattactcgcatgtgggagaggctt

SEQ ID NO: 581952 - DNA, 25 bp, Mus musculus
cattactctggaatttatggcctga

SEQ ID NO: 581953 - DNA, 25 bp, Mus musculus
cattactctggattttatggcctga

SEQ ID NO: 581954 - DNA, 25 bp, Mus musculus
cattactgccacagccaggcaggct

SEQ ID NO: 581955 - DNA, 25 bp, Mus musculus
cattactgccactgccaggcaggct

SEQ ID NO: 581956 - DNA, 25 bp, Mus musculus
cattactgctggcttgactgatgca

SEQ ID NO: 581957 - DNA, 25 bp, Mus musculus
cattactgctgggttgactgatgca

SEQ ID NO: 581958 - DNA, 25 bp, Mus musculus
cattacttacacatggaagctcctg

SEQ ID NO: 581959 - DNA, 25 bp, Mus musculus
cattacttacacttggaagctcctg

SEQ ID NO: 581960 - DNA, 25 bp, Mus musculus
cattacttaccacagcccaggcgaa

SEQ ID NO: 581961 - DNA, 25 bp, Mus musculus
cattacttaccagagcccaggcgaa

SEQ ID NO: 581962 - DNA, 25 bp, Mus musculus
cattacttagtgcatttggatacca

SEQ ID NO: 581963 - DNA, 25 bp, Mus musculus
cattacttagtggatttggatacca

SEQ ID NO: 581964 - DNA, 25 bp, Mus musculus
cattacttcgatccttgtgggtttg

SEQ ID NO: 581965 - DNA, 25 bp, Mus musculus
cattacttcgatgcttgtgggtttg

SEQ ID NO: 581966 - DNA, 25 bp, Mus musculus
cattacttgcttagcttgagcccag

SEQ ID NO: 581967 - DNA, 25 bp, Mus musculus
cattacttgctttgcttgagcccag

SEQ ID NO: 581968 - DNA, 25 bp, Mus musculus
cattagacccggacatggaagagca

SEQ ID NO: 581969 - DNA, 25 bp, Mus musculus
cattagacccggtcatggaagagca

SEQ ID NO: 581970 - DNA, 25 bp, Mus musculus
cattagaggaaaacttggtggtggc

SEQ ID NO: 581971 - DNA, 25 bp, Mus musculus
cattagaggaaatcttggtggtggc

SEQ ID NO: 581972 - DNA, 25 bp, Mus musculus
cattagaggccaatatactcagccg

SEQ ID NO: 581973 - DNA, 25 bp, Mus musculus
cattagaggccattatactcagccg

SEQ ID NO: 581974 - DNA, 25 bp, Mus musculus
cattagagtctactgtcagagagct

SEQ ID NO: 581975 - DNA, 25 bp, Mus musculus
cattagagtctagtgtcagagagct

SEQ ID NO: 581976 - DNA, 25 bp, Mus musculus
cattagagtgaaccctgtccagtgg

SEQ ID NO: 581977 - DNA, 25 bp, Mus musculus
cattagagtgaagcctgtccagtgg

SEQ ID NO: 581978 - DNA, 25 bp, Mus musculus
cattagagtggtagagagtgactgc

SEQ ID NO: 581979 - DNA, 25 bp, Mus musculus
cattagagtggttgagagtgactgc

SEQ ID NO: 581980 - DNA, 25 bp, Mus musculus
cattagatgcccagaaatggagtta

SEQ ID NO: 581981 - DNA, 25 bp, Mus musculus
cattagatgccctgaaatggagtta

SEQ ID NO: 581982 - DNA, 25 bp, Mus musculus
cattagcacaacaggcctttgaaga

SEQ ID NO: 581983 - DNA, 25 bp, Mus musculus
cattagcacaactggcctttgaaga

SEQ ID NO: 581984 - DNA, 25 bp, Mus musculus
cattagcagctgcttcatctagggt

SEQ ID NO: 581985 - DNA, 25 bp, Mus musculus
cattagcagctggttcatctagggt

SEQ ID NO: 581986 - DNA, 25 bp, Mus musculus
cattagcagtgtcggaatagatggc

SEQ ID NO: 581987 - DNA, 25 bp, Mus musculus
cattagcagtgtgggaatagatggc

SEQ ID NO: 581988 - DNA, 25 bp, Mus musculus
cattagcatctcattagctgtccgc

SEQ ID NO: 581989 - DNA, 25 bp, Mus musculus
cattagcatctctttagctgtccgc

SEQ ID NO: 581990 - DNA, 25 bp, Mus musculus
cattagccaaccacaaccgcgtggt

SEQ ID NO: 581991 - DNA, 25 bp, Mus musculus
cattagccaacctcaaccgcgtggt

SEQ ID NO: 581992 - DNA, 25 bp, Mus musculus
cattagccagctcctctacgacggt

SEQ ID NO: 581993 - DNA, 25 bp, Mus musculus
cattagccagctgctctacgacggt

SEQ ID NO: 581994 - DNA, 25 bp, Mus musculus
cattagcggagaacacctgtgcagc

SEQ ID NO: 581995 - DNA, 25 bp, Mus musculus
cattagcggagatcacctgtgcagc

SEQ ID NO: 581996 - DNA, 25 bp, Mus musculus
cattagcggagtcatatttggacat

SEQ ID NO: 581997 - DNA, 25 bp, Mus musculus
cattagcggagtgatatttggacat

SEQ ID NO: 581998 - DNA, 25 bp, Mus musculus
cattagctatggcaatgatgacaga

SEQ ID NO: 581999 - DNA, 25 bp, Mus musculus
cattagctatgggaatgatgacaga

SEQ ID NO: 582000 - DNA, 25 bp, Mus musculus
cattagctcggtacagtgtctgacg

SEQ ID NO: 582001 - DNA, 25 bp, Mus musculus
cattagctcggttcagtgtctgacg

SEQ ID NO: 582002 - DNA, 25 bp, Mus musculus
cattagctgcctacattctgccgaa

SEQ ID NO: 582003 - DNA, 25 bp, Mus musculus
cattagctgccttcattctgccgaa

SEQ ID NO: 582004 - DNA, 25 bp, Mus musculus
cattagctgctaagaatgggagaaa

SEQ ID NO: 582005 - DNA, 25 bp, Mus musculus
cattagctgctatgaatgggagaaa

SEQ ID NO: 582006 - DNA, 25 bp, Mus musculus
cattagcttctacaccaaagggcgg

SEQ ID NO: 582007 - DNA, 25 bp, Mus musculus
cattagcttctagaccaaagggcgg

SEQ ID NO: 582008 - DNA, 25 bp, Mus musculus
cattaggagataccttaacccggag

SEQ ID NO: 582009 - DNA, 25 bp, Mus musculus
cattaggagatagcttaacccggag

SEQ ID NO: 582010 - DNA, 25 bp, Mus musculus
cattaggagggtatatcattgttgg

SEQ ID NO: 582011 - DNA, 25 bp, Mus musculus
cattaggagggtttatcattgttgg

SEQ ID NO: 582012 - DNA, 25 bp, Mus musculus
cattaggagtctacccacagatgac

SEQ ID NO: 582013 - DNA, 25 bp, Mus musculus
cattaggagtcttcccacagatgac

SEQ ID NO: 582014 - DNA, 25 bp, Mus musculus
cattagggagagacggcacactctc

SEQ ID NO: 582015 - DNA, 25 bp, Mus musculus
cattagggagagtcggcacactctc

SEQ ID NO: 582016 - DNA, 25 bp, Mus musculus
cattaggggacaacagaagctgtgc

SEQ ID NO: 582017 - DNA, 25 bp, Mus musculus
cattaggggacatcagaagctgtgc

SEQ ID NO: 582018 - DNA, 25 bp, Mus musculus
cattagggtggtagcagtgaatgac

SEQ ID NO: 582019 - DNA, 25 bp, Mus musculus
cattagggtggttgcagtgaatgac

SEQ ID NO: 582020 - DNA, 25 bp, Mus musculus
cattagtatcgaagctctgaccagc

SEQ ID NO: 582021 - DNA, 25 bp, Mus musculus
cattagtatcgatgctctgaccagc

SEQ ID NO: 582022 - DNA, 25 bp, Mus musculus
cattagtattaacagatgaaggtca

SEQ ID NO: 582023 - DNA, 25 bp, Mus musculus
cattagtattaagagatgaaggtca

SEQ ID NO: 582024 - DNA, 25 bp, Mus musculus
cattagtctgtactgtttcccgggc

SEQ ID NO: 582025 - DNA, 25 bp, Mus musculus
cattagtctgtagtgtttcccgggc

SEQ ID NO: 582026 - DNA, 25 bp, Mus musculus
cattagtgatcacaaggatcccagg

SEQ ID NO: 582027 - DNA, 25 bp, Mus musculus
cattagtgatcagaaggatcccagg

SEQ ID NO: 582028 - DNA, 25 bp, Mus musculus
cattagttaaagatacctggtcatc

SEQ ID NO: 582029 - DNA, 25 bp, Mus musculus
cattagttaaagttacctggtcatc

SEQ ID NO: 582030 - DNA, 25 bp, Mus musculus
cattagttgtgccaggcttggtcct

SEQ ID NO: 582031 - DNA, 25 bp, Mus musculus
cattagttgtgcgaggcttggtcct

SEQ ID NO: 582032 - DNA, 25 bp, Mus musculus
cattataaacgactgctcaggtttt

SEQ ID NO: 582033 - DNA, 25 bp, Mus musculus
cattataaacgagtgctcaggtttt

SEQ ID NO: 582034 - DNA, 25 bp, Mus musculus
cattataagcttcattggcatcgct

SEQ ID NO: 582035 - DNA, 25 bp, Mus musculus
cattataagcttgattggcatcgct

SEQ ID NO: 582036 - DNA, 25 bp, Mus musculus
cattataataatacccagaggcctc

SEQ ID NO: 582037 - DNA, 25 bp, Mus musculus
cattataataattcccagaggcctc

SEQ ID NO: 582038 - DNA, 25 bp, Mus musculus
cattatacggcgatggtgctgctaa

SEQ ID NO: 582039 - DNA, 25 bp, Mus musculus
cattatacggcgttggtgctgctaa

SEQ ID NO: 582040 - DNA, 25 bp, Mus musculus
cattatattgaacataactgtttgc

SEQ ID NO: 582041 - DNA, 25 bp, Mus musculus
cattatattgaagataactgtttgc

SEQ ID NO: 582042 - DNA, 25 bp, Mus musculus
cattatcaaccccatctcaggacag

SEQ ID NO: 582043 - DNA, 25 bp, Mus musculus
cattatcaacccgatctcaggacag

SEQ ID NO: 582044 - DNA, 25 bp, Mus musculus
cattatcaagaaaactcagcaagtt

SEQ ID NO: 582045 - DNA, 25 bp, Mus musculus
cattatcaagaatactcagcaagtt

SEQ ID NO: 582046 - DNA, 25 bp, Mus musculus
cattatcaagcgcatattggcagca

SEQ ID NO: 582047 - DNA, 25 bp, Mus musculus
cattatcaagcggatattggcagca

SEQ ID NO: 582048 - DNA, 25 bp, Mus musculus
cattatcacagaatcagggaatccc

SEQ ID NO: 582049 - DNA, 25 bp, Mus musculus
cattatcacagattcagggaatccc

SEQ ID NO: 582050 - DNA, 25 bp, Mus musculus
cattatcactttcgaaatgagggag

SEQ ID NO: 582051 - DNA, 25 bp, Mus musculus
cattatcactttggaaatgagggag

SEQ ID NO: 582052 - DNA, 25 bp, Mus musculus
cattatcagccacagagaggagacg

SEQ ID NO: 582053 - DNA, 25 bp, Mus musculus
cattatcagccagagagaggagacg

SEQ ID NO: 582054 - DNA, 25 bp, Mus musculus
cattatcattgacccctttgacgac

SEQ ID NO: 582055 - DNA, 25 bp, Mus musculus
cattatcattgagccctttgacgac

SEQ ID NO: 582056 - DNA, 25 bp, Mus musculus
cattatccaagactcaacgaaagac

SEQ ID NO: 582057 - DNA, 25 bp, Mus musculus
cattatccaagagtcaacgaaagac

SEQ ID NO: 582058 - DNA, 25 bp, Mus musculus
cattatcccagcaacaggatcagtg

SEQ ID NO: 582059 - DNA, 25 bp, Mus musculus
cattatcccagctacaggatcagtg

SEQ ID NO: 582060 - DNA, 25 bp, Mus musculus
cattatcctccccaacacggatggg

SEQ ID NO: 582061 - DNA, 25 bp, Mus musculus
cattatcctcccgaacacggatggg

SEQ ID NO: 582062 - DNA, 25 bp, Mus musculus
cattatccttttctgggtgctatgg

SEQ ID NO: 582063 - DNA, 25 bp, Mus musculus
cattatccttttgtgggtgctatgg

SEQ ID NO: 582064 - DNA, 25 bp, Mus musculus
cattatcggaaaacggatgcaaaac

SEQ ID NO: 582065 - DNA, 25 bp, Mus musculus
cattatcggaaatcggatgcaaaac

SEQ ID NO: 582066 - DNA, 25 bp, Mus musculus
cattatctgcttcgtggatgttcac

SEQ ID NO: 582067 - DNA, 25 bp, Mus musculus
cattatctgcttggtggatgttcac

SEQ ID NO: 582068 - DNA, 25 bp, Mus musculus
cattatctggaactgacacaaggaa

SEQ ID NO: 582069 - DNA, 25 bp, Mus musculus
cattatctggaagtgacacaaggaa

SEQ ID NO: 582070 - DNA, 25 bp, Mus musculus
cattatgaacacagaacaaagccaa

SEQ ID NO: 582071 - DNA, 25 bp, Mus musculus
cattatgaacactgaacaaagccaa

SEQ ID NO: 582072 - DNA, 25 bp, Mus musculus
cattatgacaggcacctgggaatgg

SEQ ID NO: 582073 - DNA, 25 bp, Mus musculus
cattatgacagggacctgggaatgg

SEQ ID NO: 582074 - DNA, 25 bp, Mus musculus
cattatgagcatccgtgtgcaggga

SEQ ID NO: 582075 - DNA, 25 bp, Mus musculus
cattatgagcatgcgtgtgcaggga

SEQ ID NO: 582076 - DNA, 25 bp, Mus musculus
cattatgatggacaccaaggacccg

SEQ ID NO: 582077 - DNA, 25 bp, Mus musculus
cattatgatggagaccaaggacccg

SEQ ID NO: 582078 - DNA, 25 bp, Mus musculus
cattatggctccctggctgagaggt

SEQ ID NO: 582079 - DNA, 25 bp, Mus musculus
cattatggctccgtggctgagaggt

SEQ ID NO: 582080 - DNA, 25 bp, Mus musculus
cattatgggacactggagccacagg

SEQ ID NO: 582081 - DNA, 25 bp, Mus musculus
cattatgggacagtggagccacagg

SEQ ID NO: 582082 - DNA, 25 bp, Mus musculus
cattatggttaaactccttatcgca

SEQ ID NO: 582083 - DNA, 25 bp, Mus musculus
cattatggttaatctccttatcgca

SEQ ID NO: 582084 - DNA, 25 bp, Mus musculus
cattatgtcagtagctcagaggcga

SEQ ID NO: 582085 - DNA, 25 bp, Mus musculus
cattatgtcagttgctcagaggcga

SEQ ID NO: 582086 - DNA, 25 bp, Mus musculus
cattatgtggaacgatcaacagtca

SEQ ID NO: 582087 - DNA, 25 bp, Mus musculus
cattatgtggaaggatcaacagtca

SEQ ID NO: 582088 - DNA, 25 bp, Mus musculus
cattatgttagcaggagaaggccgg

SEQ ID NO: 582089 - DNA, 25 bp, Mus musculus
cattatgttagctggagaaggccgg

SEQ ID NO: 582090 - DNA, 25 bp, Mus musculus
cattatgttcagaggcaaggagaat

SEQ ID NO: 582091 - DNA, 25 bp, Mus musculus
cattatgttcagtggcaaggagaat

SEQ ID NO: 582092 - DNA, 25 bp, Mus musculus
cattattactttagtccatgtggca

SEQ ID NO: 582093 - DNA, 25 bp, Mus musculus
cattattacttttgtccatgtggca

SEQ ID NO: 582094 - DNA, 25 bp, Mus musculus
cattattagcagagcggatgtgatc

SEQ ID NO: 582095 - DNA, 25 bp, Mus musculus
cattattagcagtgcggatgtgatc

SEQ ID NO: 582096 - DNA, 25 bp, Mus musculus
cattattcggcgcaagcctctcttc

SEQ ID NO: 582097 - DNA, 25 bp, Mus musculus
cattattcggcggaagcctctcttc

SEQ ID NO: 582098 - DNA, 25 bp, Mus musculus
cattattcgtctctttctggtagaa

SEQ ID NO: 582099 - DNA, 25 bp, Mus musculus
cattattcgtctgtttctggtagaa

SEQ ID NO: 582100 - DNA, 25 bp, Mus musculus
cattattcttctcatgggactgttc

SEQ ID NO: 582101 - DNA, 25 bp, Mus musculus
cattattcttctgatgggactgttc

SEQ ID NO: 582102 - DNA, 25 bp, Mus musculus
cattattgaggacctgctgcctgcc

SEQ ID NO: 582103 - DNA, 25 bp, Mus musculus
cattattgaggagctgctgcctgcc

SEQ ID NO: 582104 - DNA, 25 bp, Mus musculus
cattattggaaaagttctcagcacc

SEQ ID NO: 582105 - DNA, 25 bp, Mus musculus
cattattggaaatgttctcagcacc

SEQ ID NO: 582106 - DNA, 25 bp, Mus musculus
cattatttcctcaaggccagtagat

SEQ ID NO: 582107 - DNA, 25 bp, Mus musculus
cattatttcctctaggccagtagat

SEQ ID NO: 582108 - DNA, 25 bp, Mus musculus
cattcaaaacaccaccttcagcaga

SEQ ID NO: 582109 - DNA, 25 bp, Mus musculus
cattcaaaacacgaccttcagcaga

SEQ ID NO: 582110 - DNA, 25 bp, Mus musculus
cattcaaagccaagatggagtcctt

SEQ ID NO: 582111 - DNA, 25 bp, Mus musculus
cattcaaagccatgatggagtcctt

SEQ ID NO: 582112 - DNA, 25 bp, Mus musculus
cattcaaagcctagcgcagacagct

SEQ ID NO: 582113 - DNA, 25 bp, Mus musculus
cattcaaagccttgcgcagacagct

SEQ ID NO: 582114 - DNA, 25 bp, Mus musculus
cattcaacagaacgtccgcgtgctg

SEQ ID NO: 582115 - DNA, 25 bp, Mus musculus
cattcaacagaaggtccgcgtgctg

SEQ ID NO: 582116 - DNA, 25 bp, Mus musculus
cattcaacagggaatacacccacag

SEQ ID NO: 582117 - DNA, 25 bp, Mus musculus
cattcaacagggtatacacccacag

SEQ ID NO: 582118 - DNA, 25 bp, Mus musculus
cattcaagacaaagtccattccatc

SEQ ID NO: 582119 - DNA, 25 bp, Mus musculus
cattcaagacaacagtgttccattg

SEQ ID NO: 582120 - DNA, 25 bp, Mus musculus
cattcaagacaagagtgttccattg

SEQ ID NO: 582121 - DNA, 25 bp, Mus musculus
cattcaagacaatgtccattccatc

SEQ ID NO: 582122 - DNA, 25 bp, Mus musculus
cattcaagagatacaataaatatat

SEQ ID NO: 582123 - DNA, 25 bp, Mus musculus
cattcaagagattcaataaatatat

SEQ ID NO: 582124 - DNA, 25 bp, Mus musculus
cattcaagcactagcgattcggcga

SEQ ID NO: 582125 - DNA, 25 bp, Mus musculus
cattcaagcacttgcgattcggcga

SEQ ID NO: 582126 - DNA, 25 bp, Mus musculus
cattcaagcagtaggtcgaagactt

SEQ ID NO: 582127 - DNA, 25 bp, Mus musculus
cattcaagcagttggtcgaagactt

SEQ ID NO: 582128 - DNA, 25 bp, Mus musculus
cattcaagctgtactcgccgaagga

SEQ ID NO: 582129 - DNA, 25 bp, Mus musculus
cattcaagctgttctcgccgaagga

SEQ ID NO: 582130 - DNA, 25 bp, Mus musculus
cattcaaggactctaccgaggctat

SEQ ID NO: 582131 - DNA, 25 bp, Mus musculus
cattcaaggactgtaccgaggctat

SEQ ID NO: 582132 - DNA, 25 bp, Mus musculus
cattcaagggaaccaaggacctgca

SEQ ID NO: 582133 - DNA, 25 bp, Mus musculus
cattcaagggaagcaaggacctgca

SEQ ID NO: 582134 - DNA, 25 bp, Mus musculus
cattcaagtcccaggaggcatctgc

SEQ ID NO: 582135 - DNA, 25 bp, Mus musculus
cattcaagtccctggaggcatctgc

SEQ ID NO: 582136 - DNA, 25 bp, Mus musculus
cattcaagtggccaagagctctgca

SEQ ID NO: 582137 - DNA, 25 bp, Mus musculus
cattcaagtggcgaagagctctgca

SEQ ID NO: 582138 - DNA, 25 bp, Mus musculus
cattcaataaggaaccaaaatggct

SEQ ID NO: 582139 - DNA, 25 bp, Mus musculus
cattcaataaggtaccaaaatggct

SEQ ID NO: 582140 - DNA, 25 bp, Mus musculus
cattcaatctcacaggatgcggtac

SEQ ID NO: 582141 - DNA, 25 bp, Mus musculus
cattcaatctcagaggatgcggtac

SEQ ID NO: 582142 - DNA, 25 bp, Mus musculus
cattcaatgtcccagcctattatgg

SEQ ID NO: 582143 - DNA, 25 bp, Mus musculus
cattcaatgtccgagcctattatgg

SEQ ID NO: 582144 - DNA, 25 bp, Mus musculus
cattcaatgtcgaggcctggcatgg

SEQ ID NO: 582145 - DNA, 25 bp, Mus musculus
cattcaatgtcgtggcctggcatgg

SEQ ID NO: 582146 - DNA, 25 bp, Mus musculus
cattcacaaaatcgataaatgcaca

SEQ ID NO: 582147 - DNA, 25 bp, Mus musculus
cattcacaaaatggataaatgcaca

SEQ ID NO: 582148 - DNA, 25 bp, Mus musculus
cattcacaagtgaccgacagcacgt

SEQ ID NO: 582149 - DNA, 25 bp, Mus musculus
cattcacaagtgtccgacagcacgt

SEQ ID NO: 582150 - DNA, 25 bp, Mus musculus
cattcacagactctgctcacgctga

SEQ ID NO: 582151 - DNA, 25 bp, Mus musculus
cattcacagactgtgctcacgctga

SEQ ID NO: 582152 - DNA, 25 bp, Mus musculus
cattcacagtgaccgcttcagggcc

SEQ ID NO: 582153 - DNA, 25 bp, Mus musculus
cattcacagtgagcgcttcagggcc

SEQ ID NO: 582154 - DNA, 25 bp, Mus musculus
cattcaccagtgcagaacacaccaa

SEQ ID NO: 582155 - DNA, 25 bp, Mus musculus
cattcaccagtggagaacacaccaa

SEQ ID NO: 582156 - DNA, 25 bp, Mus musculus
cattcaccatccagtatcgggacat

SEQ ID NO: 582157 - DNA, 25 bp, Mus musculus
cattcaccatcctgtatcgggacat

SEQ ID NO: 582158 - DNA, 25 bp, Mus musculus
cattcaccattaatatcttgaaaga

SEQ ID NO: 582159 - DNA, 25 bp, Mus musculus
cattcaccattattatcttgaaaga

SEQ ID NO: 582160 - DNA, 25 bp, Mus musculus
cattcaccgtagaagtgaggcctag

SEQ ID NO: 582161 - DNA, 25 bp, Mus musculus
cattcaccgtagtagtgaggcctag

SEQ ID NO: 582162 - DNA, 25 bp, Mus musculus
cattcacctgcactgtaaagatcct

SEQ ID NO: 582163 - DNA, 25 bp, Mus musculus
cattcacctgcagtgtaaagatcct

SEQ ID NO: 582164 - DNA, 25 bp, Mus musculus
cattcacgacgtaccagttagggta

SEQ ID NO: 582165 - DNA, 25 bp, Mus musculus
cattcacgacgttccagttagggta

SEQ ID NO: 582166 - DNA, 25 bp, Mus musculus
cattcactcctaccatggcttggat

SEQ ID NO: 582167 - DNA, 25 bp, Mus musculus
cattcactcctagcatggcttggat

SEQ ID NO: 582168 - DNA, 25 bp, Mus musculus
cattcactctggaatcaaagacctc

SEQ ID NO: 582169 - DNA, 25 bp, Mus musculus
cattcactctggtatcaaagacctc

SEQ ID NO: 582170 - DNA, 25 bp, Mus musculus
cattcactggtgatgaacccgtgcc

SEQ ID NO: 582171 - DNA, 25 bp, Mus musculus
cattcactggtgttgaacccgtgcc

SEQ ID NO: 582172 - DNA, 25 bp, Mus musculus
cattcagaagctaatggcaaattcc

SEQ ID NO: 582173 - DNA, 25 bp, Mus musculus
cattcagaagctacgtgcagaagga

SEQ ID NO: 582174 - DNA, 25 bp, Mus musculus
cattcagaagcttatggcaaattcc

SEQ ID NO: 582175 - DNA, 25 bp, Mus musculus
cattcagaagcttcgtgcagaagga

SEQ ID NO: 582176 - DNA, 25 bp, Mus musculus
cattcagaaggaaggaagtctctgt

SEQ ID NO: 582177 - DNA, 25 bp, Mus musculus
cattcagaaggatggaagtctctgt

SEQ ID NO: 582178 - DNA, 25 bp, Mus musculus
cattcagaagttagtgccctacctc

SEQ ID NO: 582179 - DNA, 25 bp, Mus musculus
cattcagaagtttgtgccctacctc

SEQ ID NO: 582180 - DNA, 25 bp, Mus musculus
cattcagaatggctgtcttgtgtcc

SEQ ID NO: 582181 - DNA, 25 bp, Mus musculus
cattcagaatgggtgtcttgtgtcc

SEQ ID NO: 582182 - DNA, 25 bp, Mus musculus
cattcagacttgcatgggtgtgcaa

SEQ ID NO: 582183 - DNA, 25 bp, Mus musculus
cattcagacttggatgggtgtgcaa

SEQ ID NO: 582184 - DNA, 25 bp, Mus musculus
cattcagagatgaccttctcaacct

SEQ ID NO: 582185 - DNA, 25 bp, Mus musculus
cattcagagatgtccttctcaacct

SEQ ID NO: 582186 - DNA, 25 bp, Mus musculus
cattcagagcacaattgagcctcgg

SEQ ID NO: 582187 - DNA, 25 bp, Mus musculus
cattcagagcactattgagcctcgg

SEQ ID NO: 582188 - DNA, 25 bp, Mus musculus
cattcagatactacagtctcaaaac

SEQ ID NO: 582189 - DNA, 25 bp, Mus musculus
cattcagatacttcagtctcaaaac

SEQ ID NO: 582190 - DNA, 25 bp, Mus musculus
cattcagatggtccggtcccagagg

SEQ ID NO: 582191 - DNA, 25 bp, Mus musculus
cattcagatggtgcggtcccagagg

SEQ ID NO: 582192 - DNA, 25 bp, Mus musculus
cattcagcaaagcagatcggctggg

SEQ ID NO: 582193 - DNA, 25 bp, Mus musculus
cattcagcaaaggagatcggctggg

SEQ ID NO: 582194 - DNA, 25 bp, Mus musculus
cattcagcaagaagagtacctgccc

SEQ ID NO: 582195 - DNA, 25 bp, Mus musculus
cattcagcaagacaacatgtggtgg

SEQ ID NO: 582196 - DNA, 25 bp, Mus musculus
cattcagcaagagaacatgtggtgg

SEQ ID NO: 582197 - DNA, 25 bp, Mus musculus
cattcagcaagatgagtacctgccc

SEQ ID NO: 582198 - DNA, 25 bp, Mus musculus
cattcagcagatcgtgaacgagcac

SEQ ID NO: 582199 - DNA, 25 bp, Mus musculus
cattcagcagatggtgaacgagcac

SEQ ID NO: 582200 - DNA, 25 bp, Mus musculus
cattcagcattgagaacttcaaacg

SEQ ID NO: 582201 - DNA, 25 bp, Mus musculus
cattcagcattgtgaacttcaaacg

SEQ ID NO: 582202 - DNA, 25 bp, Mus musculus
cattcagccaccacagaacacagtg

SEQ ID NO: 582203 - DNA, 25 bp, Mus musculus
cattcagccaccacctggaaggaga

SEQ ID NO: 582204 - DNA, 25 bp, Mus musculus
cattcagccacctcagaacacagtg

SEQ ID NO: 582205 - DNA, 25 bp, Mus musculus
cattcagccacctcctggaaggaga

SEQ ID NO: 582206 - DNA, 25 bp, Mus musculus
cattcagcctgacctaaacggattt

SEQ ID NO: 582207 - DNA, 25 bp, Mus musculus
cattcagcctgagctaaacggattt

SEQ ID NO: 582208 - DNA, 25 bp, Mus musculus
cattcagcctttcgtgatcctccag

SEQ ID NO: 582209 - DNA, 25 bp, Mus musculus
cattcagcctttggtgatcctccag

SEQ ID NO: 582210 - DNA, 25 bp, Mus musculus
cattcagcgaggaggccacactttt

SEQ ID NO: 582211 - DNA, 25 bp, Mus musculus
cattcagcgaggtggccacactttt

SEQ ID NO: 582212 - DNA, 25 bp, Mus musculus
cattcagcgcttctggaaggactcg

SEQ ID NO: 582213 - DNA, 25 bp, Mus musculus
cattcagcgcttgtggaaggactcg

SEQ ID NO: 582214 - DNA, 25 bp, Mus musculus
cattcaggaatacatacgacagctg

SEQ ID NO: 582215 - DNA, 25 bp, Mus musculus
cattcaggaatagatacgacagctg

SEQ ID NO: 582216 - DNA, 25 bp, Mus musculus
cattcaggaccgaaacaacttcttc

SEQ ID NO: 582217 - DNA, 25 bp, Mus musculus
cattcaggaccgtaacaacttcttc

SEQ ID NO: 582218 - DNA, 25 bp, Mus musculus
cattcaggcaagaggatgttgagga

SEQ ID NO: 582219 - DNA, 25 bp, Mus musculus
cattcaggcaagtggatgttgagga

SEQ ID NO: 582220 - DNA, 25 bp, Mus musculus
cattcaggccataggcttctcgggc

SEQ ID NO: 582221 - DNA, 25 bp, Mus musculus
cattcaggccattggcttctcgggc

SEQ ID NO: 582222 - DNA, 25 bp, Mus musculus
cattcaggctggcttctcattttca

SEQ ID NO: 582223 - DNA, 25 bp, Mus musculus
cattcaggctgggttctcattttca

SEQ ID NO: 582224 - DNA, 25 bp, Mus musculus
cattcagggaggaagaattgtagat

SEQ ID NO: 582225 - DNA, 25 bp, Mus musculus
cattcagggaggtagaattgtagat

SEQ ID NO: 582226 - DNA, 25 bp, Mus musculus
cattcagggcttctccgccaagtgg

SEQ ID NO: 582227 - DNA, 25 bp, Mus musculus
cattcagggcttgtccgccaagtgg

SEQ ID NO: 582228 - DNA, 25 bp, Mus musculus
cattcaggtattcatgggaagcctc

SEQ ID NO: 582229 - DNA, 25 bp, Mus musculus
cattcaggtattgatgggaagcctc

SEQ ID NO: 582230 - DNA, 25 bp, Mus musculus
cattcaggtcaacgatgaggatggc

SEQ ID NO: 582231 - DNA, 25 bp, Mus musculus
cattcaggtcaaggatgaggatggc

SEQ ID NO: 582232 - DNA, 25 bp, Mus musculus
cattcagtactgagtccggccacgg

SEQ ID NO: 582233 - DNA, 25 bp, Mus musculus
cattcagtactgtgtccggccacgg

SEQ ID NO: 582234 - DNA, 25 bp, Mus musculus
cattcagtctgaaatcagcatgtga

SEQ ID NO: 582235 - DNA, 25 bp, Mus musculus
cattcagtctgatatcagcatgtga

SEQ ID NO: 582236 - DNA, 25 bp, Mus musculus
cattcagtctgtctccagctatctg

SEQ ID NO: 582237 - DNA, 25 bp, Mus musculus
cattcagtctgtgtccagctatctg

SEQ ID NO: 582238 - DNA, 25 bp, Mus musculus
cattcagtgagcatcccgtgctggg

SEQ ID NO: 582239 - DNA, 25 bp, Mus musculus
cattcagtgagcttcccgtgctggg

SEQ ID NO: 582240 - DNA, 25 bp, Mus musculus
cattcagtggctcaagcacatcgag

SEQ ID NO: 582241 - DNA, 25 bp, Mus musculus
cattcagtggctgaagcacatcgag

SEQ ID NO: 582242 - DNA, 25 bp, Mus musculus
cattcagtgtcacctgaccgactgt

SEQ ID NO: 582243 - DNA, 25 bp, Mus musculus
cattcagtgtcagctgaccgactgt

SEQ ID NO: 582244 - DNA, 25 bp, Mus musculus
cattcagttatcagggacagaacaa

SEQ ID NO: 582245 - DNA, 25 bp, Mus musculus
cattcagttatctgggacagaacaa

SEQ ID NO: 582246 - DNA, 25 bp, Mus musculus
cattcagtttcccagccaatcatgg

SEQ ID NO: 582247 - DNA, 25 bp, Mus musculus
cattcagtttccgagccaatcatgg

SEQ ID NO: 582248 - DNA, 25 bp, Mus musculus
cattcagtttgtctcaaccttacag

SEQ ID NO: 582249 - DNA, 25 bp, Mus musculus
cattcagtttgtgtcaaccttacag

SEQ ID NO: 582250 - DNA, 25 bp, Mus musculus
cattcataaccccagtccgtggatc

SEQ ID NO: 582251 - DNA, 25 bp, Mus musculus
cattcataacccgagtccgtggatc

SEQ ID NO: 582252 - DNA, 25 bp, Mus musculus
cattcataagttaggcttcagtact

SEQ ID NO: 582253 - DNA, 25 bp, Mus musculus
cattcataagtttggcttcagtact

SEQ ID NO: 582254 - DNA, 25 bp, Mus musculus
cattcatagtcactcttaaaggagg

SEQ ID NO: 582255 - DNA, 25 bp, Mus musculus
cattcatagtcagtcttaaaggagg

SEQ ID NO: 582256 - DNA, 25 bp, Mus musculus
cattcatatattacaccttgagatg

SEQ ID NO: 582257 - DNA, 25 bp, Mus musculus
cattcatatatttcaccttgagatg

SEQ ID NO: 582258 - DNA, 25 bp, Mus musculus
cattcatcacaactgtaccccagag

SEQ ID NO: 582259 - DNA, 25 bp, Mus musculus
cattcatcacaagtgtaccccagag

SEQ ID NO: 582260 - DNA, 25 bp, Mus musculus
cattcatcacttcgacgaatgccca

SEQ ID NO: 582261 - DNA, 25 bp, Mus musculus
cattcatcacttggacgaatgccca

SEQ ID NO: 582262 - DNA, 25 bp, Mus musculus
cattcatcatgtactctgaccaaac

SEQ ID NO: 582263 - DNA, 25 bp, Mus musculus
cattcatcatgttctctgaccaaac

SEQ ID NO: 582264 - DNA, 25 bp, Mus musculus
cattcatctccacacctttagaggt

SEQ ID NO: 582265 - DNA, 25 bp, Mus musculus
cattcatctccagacctttagaggt

SEQ ID NO: 582266 - DNA, 25 bp, Mus musculus
cattcatctctgctacattccttca

SEQ ID NO: 582267 - DNA, 25 bp, Mus musculus
cattcatctctggtacattccttca

SEQ ID NO: 582268 - DNA, 25 bp, Mus musculus
cattcatgagggagctatcactcac

SEQ ID NO: 582269 - DNA, 25 bp, Mus musculus
cattcatgagggtgctatcactcac

SEQ ID NO: 582270 - DNA, 25 bp, Mus musculus
cattcatgcagaagaacttttagat

SEQ ID NO: 582271 - DNA, 25 bp, Mus musculus
cattcatgcagatgaacttttagat

SEQ ID NO: 582272 - DNA, 25 bp, Mus musculus
cattcatgccaaacctggctccaga

SEQ ID NO: 582273 - DNA, 25 bp, Mus musculus
cattcatgccaatcctggctccaga

SEQ ID NO: 582274 - DNA, 25 bp, Mus musculus
cattcatggaatcaaacacgccacg

SEQ ID NO: 582275 - DNA, 25 bp, Mus musculus
cattcatggaatgaaacacgccacg

SEQ ID NO: 582276 - DNA, 25 bp, Mus musculus
cattcatggattcttgccgccctgc

SEQ ID NO: 582277 - DNA, 25 bp, Mus musculus
cattcatggattgttgccgccctgc

SEQ ID NO: 582278 - DNA, 25 bp, Mus musculus
cattcatggcatacctctttgaact

SEQ ID NO: 582279 - DNA, 25 bp, Mus musculus
cattcatggcattcctctttgaact

SEQ ID NO: 582280 - DNA, 25 bp, Mus musculus
cattcatggcgcagaattcatctct

SEQ ID NO: 582281 - DNA, 25 bp, Mus musculus
cattcatggcgctgaattcatctct

SEQ ID NO: 582282 - DNA, 25 bp, Mus musculus
cattcatggctgagtctaaagggca

SEQ ID NO: 582283 - DNA, 25 bp, Mus musculus
cattcatggctgtgtctaaagggca

SEQ ID NO: 582284 - DNA, 25 bp, Mus musculus
cattcatgggcactgatctgggcaa

SEQ ID NO: 582285 - DNA, 25 bp, Mus musculus
cattcatgggcagtgatctgggcaa

SEQ ID NO: 582286 - DNA, 25 bp, Mus musculus
cattcatgtagtccccatggaggac

SEQ ID NO: 582287 - DNA, 25 bp, Mus musculus
cattcatgtagtgcccatggaggac

SEQ ID NO: 582288 - DNA, 25 bp, Mus musculus
cattcattacttccactgcctaaga

SEQ ID NO: 582289 - DNA, 25 bp, Mus musculus
cattcattacttgcactgcctaaga

SEQ ID NO: 582290 - DNA, 25 bp, Mus musculus
cattcattatcgcaaaacggatgca

SEQ ID NO: 582291 - DNA, 25 bp, Mus musculus
cattcattatcggaaaacggatgca

SEQ ID NO: 582292 - DNA, 25 bp, Mus musculus
cattcattctgaagactacagcaag

SEQ ID NO: 582293 - DNA, 25 bp, Mus musculus
cattcattctgatgactacagcaag

SEQ ID NO: 582294 - DNA, 25 bp, Mus musculus
cattcattgactaccgtctacttaa

SEQ ID NO: 582295 - DNA, 25 bp, Mus musculus
cattcattgacttccgtctacttaa

SEQ ID NO: 582296 - DNA, 25 bp, Mus musculus
cattcattgagacatctgctctaga

SEQ ID NO: 582297 - DNA, 25 bp, Mus musculus
cattcattgagagatctgctctaga

SEQ ID NO: 582298 - DNA, 25 bp, Mus musculus
cattcattgcagagagaatcttctg

SEQ ID NO: 582299 - DNA, 25 bp, Mus musculus
cattcattgcagtgagaatcttctg

SEQ ID NO: 582300 - DNA, 25 bp, Mus musculus
cattcatttatgctgggtgccttgg

SEQ ID NO: 582301 - DNA, 25 bp, Mus musculus
cattcatttatggtgggtgccttgg

SEQ ID NO: 582302 - DNA, 25 bp, Mus musculus
cattcatttctgcattacgttagta

SEQ ID NO: 582303 - DNA, 25 bp, Mus musculus
cattcatttctggattacgttagta

SEQ ID NO: 582304 - DNA, 25 bp, Mus musculus
cattccaaagatatatgtgcaccgc

SEQ ID NO: 582305 - DNA, 25 bp, Mus musculus
cattccaaagatttatgtgcaccgc

SEQ ID NO: 582306 - DNA, 25 bp, Mus musculus
cattccaagatgatattcctaagga

SEQ ID NO: 582307 - DNA, 25 bp, Mus musculus
cattccaagatgttattcctaagga

SEQ ID NO: 582308 - DNA, 25 bp, Mus musculus
cattccaagttgaaaatgctagtct

SEQ ID NO: 582309 - DNA, 25 bp, Mus musculus
cattccaagttgtaaatgctagtct

SEQ ID NO: 582310 - DNA, 25 bp, Mus musculus
cattccacagtcatgtgagcagtgt

SEQ ID NO: 582311 - DNA, 25 bp, Mus musculus
cattccacagtcttgtgagcagtgt

SEQ ID NO: 582312 - DNA, 25 bp, Mus musculus
cattccacggtgaaggagaccaaga

SEQ ID NO: 582313 - DNA, 25 bp, Mus musculus
cattccacggtgtaggagaccaaga

SEQ ID NO: 582314 - DNA, 25 bp, Mus musculus
cattccactcccaaggtctagttta

SEQ ID NO: 582315 - DNA, 25 bp, Mus musculus
cattccactccctaggtctagttta

SEQ ID NO: 582316 - DNA, 25 bp, Mus musculus
cattccagaatgcaatgatgacggc

SEQ ID NO: 582317 - DNA, 25 bp, Mus musculus
cattccagaatggaatgatgacggc

SEQ ID NO: 582318 - DNA, 25 bp, Mus musculus
cattccagatgcctggccaatctgc

SEQ ID NO: 582319 - DNA, 25 bp, Mus musculus
cattccagatgcgtggccaatctgc

SEQ ID NO: 582320 - DNA, 25 bp, Mus musculus
cattccagtgcccaagtacttgtct

SEQ ID NO: 582321 - DNA, 25 bp, Mus musculus
cattccagtgccgaagtacttgtct

SEQ ID NO: 582322 - DNA, 25 bp, Mus musculus
cattccataaagaatagtctgctgg

SEQ ID NO: 582323 - DNA, 25 bp, Mus musculus
cattccataaagtatagtctgctgg

SEQ ID NO: 582324 - DNA, 25 bp, Mus musculus
cattccataagtatgcctgccatga

SEQ ID NO: 582325 - DNA, 25 bp, Mus musculus
cattccataagtttgcctgccatga

SEQ ID NO: 582326 - DNA, 25 bp, Mus musculus
cattccatacaaagagaagccagag

SEQ ID NO: 582327 - DNA, 25 bp, Mus musculus
cattccatacaatgagaagccagag

SEQ ID NO: 582328 - DNA, 25 bp, Mus musculus
cattccatgacactgcaggattatc

SEQ ID NO: 582329 - DNA, 25 bp, Mus musculus
cattccatgacagtgcaggattatc

SEQ ID NO: 582330 - DNA, 25 bp, Mus musculus
cattccatgagcaggtgccctgcta

SEQ ID NO: 582331 - DNA, 25 bp, Mus musculus
cattccatgagctggtgccctgcta

SEQ ID NO: 582332 - DNA, 25 bp, Mus musculus
cattccatgcagaagggctcaacaa

SEQ ID NO: 582333 - DNA, 25 bp, Mus musculus
cattccatgcagtagggctcaacaa

SEQ ID NO: 582334 - DNA, 25 bp, Mus musculus
cattcccaaacaagatgccttgtac

SEQ ID NO: 582335 - DNA, 25 bp, Mus musculus
cattcccaaacatgatgccttgtac

SEQ ID NO: 582336 - DNA, 25 bp, Mus musculus
cattcccaatgccagtagcgaggcc

SEQ ID NO: 582337 - DNA, 25 bp, Mus musculus
cattcccaatgccttcaggtctagg

SEQ ID NO: 582338 - DNA, 25 bp, Mus musculus
cattcccaatgcgagtagcgaggcc

SEQ ID NO: 582339 - DNA, 25 bp, Mus musculus
cattcccaatgcgttcaggtctagg

SEQ ID NO: 582340 - DNA, 25 bp, Mus musculus
cattcccaccacacgaagggctggt

SEQ ID NO: 582341 - DNA, 25 bp, Mus musculus
cattcccaccactcgaagggctggt

SEQ ID NO: 582342 - DNA, 25 bp, Mus musculus
cattcccagatgatgtctgcattgt

SEQ ID NO: 582343 - DNA, 25 bp, Mus musculus
cattcccagatgttgtctgcattgt

SEQ ID NO: 582344 - DNA, 25 bp, Mus musculus
cattcccagcaaatacgtggctcca

SEQ ID NO: 582345 - DNA, 25 bp, Mus musculus
cattcccagcaattacgtggctcca

SEQ ID NO: 582346 - DNA, 25 bp, Mus musculus
cattcccaggaacttgcaagtgcgg

SEQ ID NO: 582347 - DNA, 25 bp, Mus musculus
cattcccaggaagttgcaagtgcgg

SEQ ID NO: 582348 - DNA, 25 bp, Mus musculus
cattcccatggaagaatcactgcag

SEQ ID NO: 582349 - DNA, 25 bp, Mus musculus
cattcccatggatgaatcactgcag

SEQ ID NO: 582350 - DNA, 25 bp, Mus musculus
cattcccatgttagatgactctccg

SEQ ID NO: 582351 - DNA, 25 bp, Mus musculus
cattcccatgtttgatgactctccg

SEQ ID NO: 582352 - DNA, 25 bp, Mus musculus
cattccccaagcaggagctgggcct

SEQ ID NO: 582353 - DNA, 25 bp, Mus musculus
cattccccaagctggagctgggcct

SEQ ID NO: 582354 - DNA, 25 bp, Mus musculus
cattccccacccagcttatgatgat

SEQ ID NO: 582355 - DNA, 25 bp, Mus musculus
cattccccaccctgcttatgatgat

SEQ ID NO: 582356 - DNA, 25 bp, Mus musculus
cattccccgcggagttaccggcagt

SEQ ID NO: 582357 - DNA, 25 bp, Mus musculus
cattccccgcggtgttaccggcagt

SEQ ID NO: 582358 - DNA, 25 bp, Mus musculus
cattcccgcgcgcaggcaacggaag

SEQ ID NO: 582359 - DNA, 25 bp, Mus musculus
cattcccgcgcggaggcaacggaag

SEQ ID NO: 582360 - DNA, 25 bp, Mus musculus
cattcccggaagagcagaagccgga

SEQ ID NO: 582361 - DNA, 25 bp, Mus musculus
cattcccggaagtgcagaagccgga

SEQ ID NO: 582362 - DNA, 25 bp, Mus musculus
cattccctacttccatgtgagggag

SEQ ID NO: 582363 - DNA, 25 bp, Mus musculus
cattccctacttgcatgtgagggag

SEQ ID NO: 582364 - DNA, 25 bp, Mus musculus
cattccctcagtcgaggtatttgaa

SEQ ID NO: 582365 - DNA, 25 bp, Mus musculus
cattccctcagtggaggtatttgaa

SEQ ID NO: 582366 - DNA, 25 bp, Mus musculus
cattccctgacaacgtgatgtttcg

SEQ ID NO: 582367 - DNA, 25 bp, Mus musculus
cattccctgacatcgtgatgtttcg

SEQ ID NO: 582368 - DNA, 25 bp, Mus musculus
cattccctgcctaatagtcttgaga

SEQ ID NO: 582369 - DNA, 25 bp, Mus musculus
cattccctgccttatagtcttgaga

SEQ ID NO: 582370 - DNA, 25 bp, Mus musculus
cattccctggaactggtggcttctc

SEQ ID NO: 582371 - DNA, 25 bp, Mus musculus
cattccctggaagtggtggcttctc

SEQ ID NO: 582372 - DNA, 25 bp, Mus musculus
cattcccttaggacattagggtctc

SEQ ID NO: 582373 - DNA, 25 bp, Mus musculus
cattcccttaggtcattagggtctc

SEQ ID NO: 582374 - DNA, 25 bp, Mus musculus
cattccgagacaagcgagaactggc

SEQ ID NO: 582375 - DNA, 25 bp, Mus musculus
cattccgagacatgcgagaactggc

SEQ ID NO: 582376 - DNA, 25 bp, Mus musculus
cattccgatcatcatgggctccaac

SEQ ID NO: 582377 - DNA, 25 bp, Mus musculus
cattccgatcatgatgggctccaac

SEQ ID NO: 582378 - DNA, 25 bp, Mus musculus
cattccgatctacgagaagaagtac

SEQ ID NO: 582379 - DNA, 25 bp, Mus musculus
cattccgatctaggagaagaagtac

SEQ ID NO: 582380 - DNA, 25 bp, Mus musculus
cattccgatgaccaacagctgtgat

SEQ ID NO: 582381 - DNA, 25 bp, Mus musculus
cattccgatgacgaacagctgtgat

SEQ ID NO: 582382 - DNA, 25 bp, Mus musculus
cattccggcagcctgtggacgctgt

SEQ ID NO: 582383 - DNA, 25 bp, Mus musculus
cattccggcagcgtgtggacgctgt

SEQ ID NO: 582384 - DNA, 25 bp, Mus musculus
cattccgggaatatcttcgaacaga

SEQ ID NO: 582385 - DNA, 25 bp, Mus musculus
cattccgggaatttcttcgaacaga

SEQ ID NO: 582386 - DNA, 25 bp, Mus musculus
cattccgggatacaagaaccagggc

SEQ ID NO: 582387 - DNA, 25 bp, Mus musculus
cattccgggatagaagaaccagggc

SEQ ID NO: 582388 - DNA, 25 bp, Mus musculus
cattccgggctgcaattcctatttc

SEQ ID NO: 582389 - DNA, 25 bp, Mus musculus
cattccgggctggaattcctatttc

SEQ ID NO: 582390 - DNA, 25 bp, Mus musculus
cattccgtcgcacccagaaggagtt

SEQ ID NO: 582391 - DNA, 25 bp, Mus musculus
cattccgtcgcagccagaaggagtt

SEQ ID NO: 582392 - DNA, 25 bp, Mus musculus
cattcctaaaggatgggcagtccag

SEQ ID NO: 582393 - DNA, 25 bp, Mus musculus
cattcctaaaggttgggcagtccag

SEQ ID NO: 582394 - DNA, 25 bp, Mus musculus
cattcctaaggaaacagtacacgga

SEQ ID NO: 582395 - DNA, 25 bp, Mus musculus
cattcctaaggatacagtacacgga

SEQ ID NO: 582396 - DNA, 25 bp, Mus musculus
cattcctacctacatgccatcagga

SEQ ID NO: 582397 - DNA, 25 bp, Mus musculus
cattcctacctagatgccatcagga

SEQ ID NO: 582398 - DNA, 25 bp, Mus musculus
cattcctataatacccatggtgctg

SEQ ID NO: 582399 - DNA, 25 bp, Mus musculus
cattcctataattcccatggtgctg

SEQ ID NO: 582400 - DNA, 25 bp, Mus musculus
cattcctatctgcagtctctgacag

SEQ ID NO: 582401 - DNA, 25 bp, Mus musculus
cattcctatctggagtctctgacag

SEQ ID NO: 582402 - DNA, 25 bp, Mus musculus
cattcctcaagtcctatggtacaag

SEQ ID NO: 582403 - DNA, 25 bp, Mus musculus
cattcctcaagtgctatggtacaag

SEQ ID NO: 582404 - DNA, 25 bp, Mus musculus
cattcctccgggaatgacagccgtt

SEQ ID NO: 582405 - DNA, 25 bp, Mus musculus
cattcctccgggtatgacagccgtt

SEQ ID NO: 582406 - DNA, 25 bp, Mus musculus
cattcctctggaagggcctgtctgt

SEQ ID NO: 582407 - DNA, 25 bp, Mus musculus
cattcctctggaaggtgtccgtcat

SEQ ID NO: 582408 - DNA, 25 bp, Mus musculus
cattcctctggatgggcctgtctgt

SEQ ID NO: 582409 - DNA, 25 bp, Mus musculus
cattcctctggatggtgtccgtcat

SEQ ID NO: 582410 - DNA, 25 bp, Mus musculus
cattcctgaagacacagaaagccga

SEQ ID NO: 582411 - DNA, 25 bp, Mus musculus
cattcctgaagagacagaaagccga

SEQ ID NO: 582412 - DNA, 25 bp, Mus musculus
cattcctgaagtcgatcagatccta

SEQ ID NO: 582413 - DNA, 25 bp, Mus musculus
cattcctgaagtggatcagatccta

SEQ ID NO: 582414 - DNA, 25 bp, Mus musculus
cattcctgagaacaatcgaccttta

SEQ ID NO: 582415 - DNA, 25 bp, Mus musculus
cattcctgagaagaatcgaccttta

SEQ ID NO: 582416 - DNA, 25 bp, Mus musculus
cattcctgattgacaaggagtcaga

SEQ ID NO: 582417 - DNA, 25 bp, Mus musculus
cattcctgattgtcaaggagtcaga

SEQ ID NO: 582418 - DNA, 25 bp, Mus musculus
cattcctgcgtactctaagagaggg

SEQ ID NO: 582419 - DNA, 25 bp, Mus musculus
cattcctgcgtagtctaagagaggg

SEQ ID NO: 582420 - DNA, 25 bp, Mus musculus
cattcctgggtgaggcatgagtgtc

SEQ ID NO: 582421 - DNA, 25 bp, Mus musculus
cattcctgggtgtggcatgagtgtc

SEQ ID NO: 582422 - DNA, 25 bp, Mus musculus
cattcctggtgtatatgtcccatgg

SEQ ID NO: 582423 - DNA, 25 bp, Mus musculus
cattcctggtgtttatgtcccatgg

SEQ ID NO: 582424 - DNA, 25 bp, Mus musculus
cattcctggttgagcacgggctggt

SEQ ID NO: 582425 - DNA, 25 bp, Mus musculus
cattcctggttgtgcacgggctggt

SEQ ID NO: 582426 - DNA, 25 bp, Mus musculus
cattcctgtcccaagatgagataca

SEQ ID NO: 582427 - DNA, 25 bp, Mus musculus
cattcctgtccctagatgagataca

SEQ ID NO: 582428 - DNA, 25 bp, Mus musculus
cattcctgttcgagggctgtggcga

SEQ ID NO: 582429 - DNA, 25 bp, Mus musculus
cattcctgttcgtgggctgtggcga

SEQ ID NO: 582430 - DNA, 25 bp, Mus musculus
cattcctgttgaagtagtagtcaac

SEQ ID NO: 582431 - DNA, 25 bp, Mus musculus
cattcctgttgatgtagtagtcaac

SEQ ID NO: 582432 - DNA, 25 bp, Mus musculus
cattccttaaatctaatttgctagg

SEQ ID NO: 582433 - DNA, 25 bp, Mus musculus
cattccttaaatgtaatttgctagg

SEQ ID NO: 582434 - DNA, 25 bp, Mus musculus
cattccttacttagtaggatggagg

SEQ ID NO: 582435 - DNA, 25 bp, Mus musculus
cattccttactttgtaggatggagg

SEQ ID NO: 582436 - DNA, 25 bp, Mus musculus
cattccttctctacaccgggatgtg

SEQ ID NO: 582437 - DNA, 25 bp, Mus musculus
cattccttctcttcaccgggatgtg

SEQ ID NO: 582438 - DNA, 25 bp, Mus musculus
cattccttctttaaatgtggcttca

SEQ ID NO: 582439 - DNA, 25 bp, Mus musculus
cattccttcttttaatgtggcttca

SEQ ID NO: 582440 - DNA, 25 bp, Mus musculus
cattccttggtgctgagtcagacct

SEQ ID NO: 582441 - DNA, 25 bp, Mus musculus
cattccttggtggtgagtcagacct

SEQ ID NO: 582442 - DNA, 25 bp, Mus musculus
cattcgaaagtaagtacctgccaga

SEQ ID NO: 582443 - DNA, 25 bp, Mus musculus
cattcgaaagtatgtacctgccaga

SEQ ID NO: 582444 - DNA, 25 bp, Mus musculus
cattcgaaatgccaattccctggga

SEQ ID NO: 582445 - DNA, 25 bp, Mus musculus
cattcgaaatgcgaattccctggga

SEQ ID NO: 582446 - DNA, 25 bp, Mus musculus
cattcgaagggactgtgcacgctct

SEQ ID NO: 582447 - DNA, 25 bp, Mus musculus
cattcgaagggagtgtgcacgctct

SEQ ID NO: 582448 - DNA, 25 bp, Mus musculus
cattcgaagtatcctggccaccagt

SEQ ID NO: 582449 - DNA, 25 bp, Mus musculus
cattcgaagtatgctggccaccagt

SEQ ID NO: 582450 - DNA, 25 bp, Mus musculus
cattcgaatgaacctggaaaacggg

SEQ ID NO: 582451 - DNA, 25 bp, Mus musculus
cattcgaatgaagctggaaaacggg

SEQ ID NO: 582452 - DNA, 25 bp, Mus musculus
cattcgactccgcaagggcttagct

SEQ ID NO: 582453 - DNA, 25 bp, Mus musculus
cattcgactccggaagggcttagct

SEQ ID NO: 582454 - DNA, 25 bp, Mus musculus
cattcgagaagtataggcaaggcct

SEQ ID NO: 582455 - DNA, 25 bp, Mus musculus
cattcgagaagtttaggcaaggcct

SEQ ID NO: 582456 - DNA, 25 bp, Mus musculus
cattcgagcaaactgcatgcagtac

SEQ ID NO: 582457 - DNA, 25 bp, Mus musculus
cattcgagcaaagtgcatgcagtac

SEQ ID NO: 582458 - DNA, 25 bp, Mus musculus
cattcgaggagtagtcttcgtcaag

SEQ ID NO: 582459 - DNA, 25 bp, Mus musculus
cattcgaggagttgtcttcgtcaag

SEQ ID NO: 582460 - DNA, 25 bp, Mus musculus
cattcgaggcctcaagaaacatttt

SEQ ID NO: 582461 - DNA, 25 bp, Mus musculus
cattcgaggcctgaagaaacatttt

SEQ ID NO: 582462 - DNA, 25 bp, Mus musculus
cattcgaggttgagtatagcctggg

SEQ ID NO: 582463 - DNA, 25 bp, Mus musculus
cattcgaggttgtgtatagcctggg

SEQ ID NO: 582464 - DNA, 25 bp, Mus musculus
cattcgagttacagacagacttggt

SEQ ID NO: 582465 - DNA, 25 bp, Mus musculus
cattcgagttactgacagacttggt

SEQ ID NO: 582466 - DNA, 25 bp, Mus musculus
cattcgatcaggagaacgacgacta

SEQ ID NO: 582467 - DNA, 25 bp, Mus musculus
cattcgatcaggtgaacgacgacta

SEQ ID NO: 582468 - DNA, 25 bp, Mus musculus
cattcgcaatgaagtagaatgtctg

SEQ ID NO: 582469 - DNA, 25 bp, Mus musculus
cattcgcaatgatgtagaatgtctg

SEQ ID NO: 582470 - DNA, 25 bp, Mus musculus
cattcgcataaaccctcagtcctgg

SEQ ID NO: 582471 - DNA, 25 bp, Mus musculus
cattcgcataaagcctcagtcctgg

SEQ ID NO: 582472 - DNA, 25 bp, Mus musculus
cattcgcatctcagacaccaacata

SEQ ID NO: 582473 - DNA, 25 bp, Mus musculus
cattcgcatctctgacaccaacata

SEQ ID NO: 582474 - DNA, 25 bp, Mus musculus
cattcgccaggcctttatcagaaag

SEQ ID NO: 582475 - DNA, 25 bp, Mus musculus
cattcgccaggcgtttatcagaaag

SEQ ID NO: 582476 - DNA, 25 bp, Mus musculus
cattcgcccggacgtagataggtgt

SEQ ID NO: 582477 - DNA, 25 bp, Mus musculus
cattcgcccggaggtagataggtgt

SEQ ID NO: 582478 - DNA, 25 bp, Mus musculus
cattcgccgcctaagaaggaaggaa

SEQ ID NO: 582479 - DNA, 25 bp, Mus musculus
cattcgccgccttagaaggaaggaa

SEQ ID NO: 582480 - DNA, 25 bp, Mus musculus
cattcgccgtagactagagcctttc

SEQ ID NO: 582481 - DNA, 25 bp, Mus musculus
cattcgccgtagtctagagcctttc

SEQ ID NO: 582482 - DNA, 25 bp, Mus musculus
cattcgccgtgactgcatgtggagc

SEQ ID NO: 582483 - DNA, 25 bp, Mus musculus
cattcgccgtgagtgcatgtggagc

SEQ ID NO: 582484 - DNA, 25 bp, Mus musculus
cattcgcctcataggcgagtttgtc

SEQ ID NO: 582485 - DNA, 25 bp, Mus musculus
cattcgcctcattggcgagtttgtc

SEQ ID NO: 582486 - DNA, 25 bp, Mus musculus
cattcgcctcttattggagttgccc

SEQ ID NO: 582487 - DNA, 25 bp, Mus musculus
cattcgcctctttttggagttgccc

SEQ ID NO: 582488 - DNA, 25 bp, Mus musculus
cattcgcggaggagcagttgtcagc

SEQ ID NO: 582489 - DNA, 25 bp, Mus musculus
cattcgcggaggtgcagttgtcagc

SEQ ID NO: 582490 - DNA, 25 bp, Mus musculus
cattcgcgttggagaagaacttgag

SEQ ID NO: 582491 - DNA, 25 bp, Mus musculus
cattcgcgttggtgaagaacttgag

SEQ ID NO: 582492 - DNA, 25 bp, Mus musculus
cattcgctgctgctgaactgatcca

SEQ ID NO: 582493 - DNA, 25 bp, Mus musculus
cattcgctgctggtgaactgatcca

SEQ ID NO: 582494 - DNA, 25 bp, Mus musculus
cattcgctggtcctgagtagctcca

SEQ ID NO: 582495 - DNA, 25 bp, Mus musculus
cattcgctggtcgtgagtagctcca

SEQ ID NO: 582496 - DNA, 25 bp, Mus musculus
cattcggaagtaagaaatgttcgcc

SEQ ID NO: 582497 - DNA, 25 bp, Mus musculus
cattcggaagtatgaaatgttcgcc

SEQ ID NO: 582498 - DNA, 25 bp, Mus musculus
cattcggacagacgtcagcggcttc

SEQ ID NO: 582499 - DNA, 25 bp, Mus musculus
cattcggacagaggtcagcggcttc

SEQ ID NO: 582500 - DNA, 25 bp, Mus musculus
cattcggacagcacaatttacaaaa

SEQ ID NO: 582501 - DNA, 25 bp, Mus musculus
cattcggacagctcaatttacaaaa

SEQ ID NO: 582502 - DNA, 25 bp, Mus musculus
cattcggagtggctcaatgtcacct

SEQ ID NO: 582503 - DNA, 25 bp, Mus musculus
cattcggagtgggtcaatgtcacct

SEQ ID NO: 582504 - DNA, 25 bp, Mus musculus
cattcggatgcccattctaatttct

SEQ ID NO: 582505 - DNA, 25 bp, Mus musculus
cattcggatgccgattctaatttct

SEQ ID NO: 582506 - DNA, 25 bp, Mus musculus
cattcggatttgctgtcacccagac

SEQ ID NO: 582507 - DNA, 25 bp, Mus musculus
cattcggatttggtgtcacccagac

SEQ ID NO: 582508 - DNA, 25 bp, Mus musculus
cattcgggacttagtgcgtcaggag

SEQ ID NO: 582509 - DNA, 25 bp, Mus musculus
cattcgggactttgtgcgtcaggag

SEQ ID NO: 582510 - DNA, 25 bp, Mus musculus
cattcgggcaagcaaggggacaaat

SEQ ID NO: 582511 - DNA, 25 bp, Mus musculus
cattcgggcaaggaaggggacaaat

SEQ ID NO: 582512 - DNA, 25 bp, Mus musculus
cattcgggtgtactgtaagaagaaa

SEQ ID NO: 582513 - DNA, 25 bp, Mus musculus
cattcgggtgtagtgtaagaagaaa

SEQ ID NO: 582514 - DNA, 25 bp, Mus musculus
cattcggtggatatactaaaacaag

SEQ ID NO: 582515 - DNA, 25 bp, Mus musculus
cattcggtggatttactaaaacaag

SEQ ID NO: 582516 - DNA, 25 bp, Mus musculus
cattcggttgaaataaatcatgttt

SEQ ID NO: 582517 - DNA, 25 bp, Mus musculus
cattcggttgaattaaatcatgttt

SEQ ID NO: 582518 - DNA, 25 bp, Mus musculus
cattcgtatcttcaaaaattcctca

SEQ ID NO: 582519 - DNA, 25 bp, Mus musculus
cattcgtatcttgaaaaattcctca

SEQ ID NO: 582520 - DNA, 25 bp, Mus musculus
cattcgtcagcacggttggcatcga

SEQ ID NO: 582521 - DNA, 25 bp, Mus musculus
cattcgtcagcagggttggcatcga

SEQ ID NO: 582522 - DNA, 25 bp, Mus musculus
cattcgtccgatcggcggctgtacg

SEQ ID NO: 582523 - DNA, 25 bp, Mus musculus
cattcgtccgatgggcggctgtacg

SEQ ID NO: 582524 - DNA, 25 bp, Mus musculus
cattcgtgatgtcgccaagcgagtg

SEQ ID NO: 582525 - DNA, 25 bp, Mus musculus
cattcgtgatgtggccaagcgagtg

SEQ ID NO: 582526 - DNA, 25 bp, Mus musculus
cattcgtgcggaccgtgacattcta

SEQ ID NO: 582527 - DNA, 25 bp, Mus musculus
cattcgtgcggagcgtgacattcta

SEQ ID NO: 582528 - DNA, 25 bp, Mus musculus
cattcgttcctaagggcatgtccaa

SEQ ID NO: 582529 - DNA, 25 bp, Mus musculus
cattcgttcctatgggcatgtccaa

SEQ ID NO: 582530 - DNA, 25 bp, Mus musculus
cattcgtttccacttgtttgtggac

SEQ ID NO: 582531 - DNA, 25 bp, Mus musculus
cattcgtttccagttgtttgtggac

SEQ ID NO: 582532 - DNA, 25 bp, Mus musculus
cattctaatcgactggttggtggaa

SEQ ID NO: 582533 - DNA, 25 bp, Mus musculus
cattctaatcgagtggttggtggaa

SEQ ID NO: 582534 - DNA, 25 bp, Mus musculus
cattctacctgtagttctgtcctcc

SEQ ID NO: 582535 - DNA, 25 bp, Mus musculus
cattctacctgttgttctgtcctcc

SEQ ID NO: 582536 - DNA, 25 bp, Mus musculus
cattctacgaacaagtggactggtt

SEQ ID NO: 582537 - DNA, 25 bp, Mus musculus
cattctacgaactagtggactggtt

SEQ ID NO: 582538 - DNA, 25 bp, Mus musculus
cattctagaactcgggggtccagag

SEQ ID NO: 582539 - DNA, 25 bp, Mus musculus
cattctagaactggggggtccagag

SEQ ID NO: 582540 - DNA, 25 bp, Mus musculus
cattctagagccaaagaggacaaag

SEQ ID NO: 582541 - DNA, 25 bp, Mus musculus
cattctagagcctaagaggacaaag

SEQ ID NO: 582542 - DNA, 25 bp, Mus musculus
cattctagagtgctaaactctccac

SEQ ID NO: 582543 - DNA, 25 bp, Mus musculus
cattctagagtggtaaactctccac

SEQ ID NO: 582544 - DNA, 25 bp, Mus musculus
cattctagtggacgcagacagtttg

SEQ ID NO: 582545 - DNA, 25 bp, Mus musculus
cattctagtggaggcagacagtttg

SEQ ID NO: 582546 - DNA, 25 bp, Mus musculus
cattctagtggccaaagacagcttg

SEQ ID NO: 582547 - DNA, 25 bp, Mus musculus
cattctagtggcgaaagacagcttg

SEQ ID NO: 582548 - DNA, 25 bp, Mus musculus
cattctagtgtgagcttggcactgg

SEQ ID NO: 582549 - DNA, 25 bp, Mus musculus
cattctagtgtgtgcttggcactgg

SEQ ID NO: 582550 - DNA, 25 bp, Mus musculus
cattctatcagacactgtgggcccg

SEQ ID NO: 582551 - DNA, 25 bp, Mus musculus
cattctatcagagactgtgggcccg

SEQ ID NO: 582552 - DNA, 25 bp, Mus musculus
cattctatgggccttgctgtttgca

SEQ ID NO: 582553 - DNA, 25 bp, Mus musculus
cattctatgggcgttgctgtttgca

SEQ ID NO: 582554 - DNA, 25 bp, Mus musculus
cattctatgttcaccagtggttggg

SEQ ID NO: 582555 - DNA, 25 bp, Mus musculus
cattctatgttctccagtggttggg

SEQ ID NO: 582556 - DNA, 25 bp, Mus musculus
cattctcaacatcccgttagtgacg

SEQ ID NO: 582557 - DNA, 25 bp, Mus musculus
cattctcaacatgccgttagtgacg

SEQ ID NO: 582558 - DNA, 25 bp, Mus musculus
cattctcaaggcctctgtggactac

SEQ ID NO: 582559 - DNA, 25 bp, Mus musculus
cattctcaaggcgtctgtggactac

SEQ ID NO: 582560 - DNA, 25 bp, Mus musculus
cattctcaccgaaaacatactcctt

SEQ ID NO: 582561 - DNA, 25 bp, Mus musculus
cattctcaccgataacatactcctt

SEQ ID NO: 582562 - DNA, 25 bp, Mus musculus
cattctcagaagaacagggcatgat

SEQ ID NO: 582563 - DNA, 25 bp, Mus musculus
cattctcagaagtacagggcatgat

SEQ ID NO: 582564 - DNA, 25 bp, Mus musculus
cattctcagagtaactaaggactgc

SEQ ID NO: 582565 - DNA, 25 bp, Mus musculus
cattctcagagttactaaggactgc

SEQ ID NO: 582566 - DNA, 25 bp, Mus musculus
cattctcaggatatctaactcaagt

SEQ ID NO: 582567 - DNA, 25 bp, Mus musculus
cattctcaggatttctaactcaagt

SEQ ID NO: 582568 - DNA, 25 bp, Mus musculus
cattctcagggtactaagggaagcc

SEQ ID NO: 582569 - DNA, 25 bp, Mus musculus
cattctcagggttctaagggaagcc

SEQ ID NO: 582570 - DNA, 25 bp, Mus musculus
cattctcagtgaagtccctctctga

SEQ ID NO: 582571 - DNA, 25 bp, Mus musculus
cattctcagtgatgtccctctctga

SEQ ID NO: 582572 - DNA, 25 bp, Mus musculus
cattctcatgaacaggataatccat

SEQ ID NO: 582573 - DNA, 25 bp, Mus musculus
cattctcatgaagaggataatccat

SEQ ID NO: 582574 - DNA, 25 bp, Mus musculus
cattctccatgcagtaaggcgatga

SEQ ID NO: 582575 - DNA, 25 bp, Mus musculus
cattctccatgctgtaaggcgatga

SEQ ID NO: 582576 - DNA, 25 bp, Mus musculus
cattctcctgggactatggccacag

SEQ ID NO: 582577 - DNA, 25 bp, Mus musculus
cattctcctgggtctatggccacag

SEQ ID NO: 582578 - DNA, 25 bp, Mus musculus
cattctcgggataaactattgagga

SEQ ID NO: 582579 - DNA, 25 bp, Mus musculus
cattctcgggattaactattgagga

SEQ ID NO: 582580 - DNA, 25 bp, Mus musculus
cattctcgtgctcctaggctgtggc

SEQ ID NO: 582581 - DNA, 25 bp, Mus musculus
cattctcgtgctgctaggctgtggc

SEQ ID NO: 582582 - DNA, 25 bp, Mus musculus
cattctcgtgtgcacccagaggaac

SEQ ID NO: 582583 - DNA, 25 bp, Mus musculus
cattctcgtgtggacccagaggaac

SEQ ID NO: 582584 - DNA, 25 bp, Mus musculus
cattctcgttctagggactgtctgg

SEQ ID NO: 582585 - DNA, 25 bp, Mus musculus
cattctcgttcttgggactgtctgg

SEQ ID NO: 582586 - DNA, 25 bp, Mus musculus
cattctctactcagtgctctctctg

SEQ ID NO: 582587 - DNA, 25 bp, Mus musculus
cattctctactctgtgctctctctg

SEQ ID NO: 582588 - DNA, 25 bp, Mus musculus
cattctctgtttcttagcctgcgaa

SEQ ID NO: 582589 - DNA, 25 bp, Mus musculus
cattctctgtttgttagcctgcgaa

SEQ ID NO: 582590 - DNA, 25 bp, Mus musculus
cattctcttagtcatgggttggatg

SEQ ID NO: 582591 - DNA, 25 bp, Mus musculus
cattctcttagtgatgggttggatg

SEQ ID NO: 582592 - DNA, 25 bp, Mus musculus
cattctcttccacgttggtgatggc

SEQ ID NO: 582593 - DNA, 25 bp, Mus musculus
cattctcttccaggttggtgatggc

SEQ ID NO: 582594 - DNA, 25 bp, Mus musculus
cattctcttgtaaacatgtgtgtgg

SEQ ID NO: 582595 - DNA, 25 bp, Mus musculus
cattctcttgtatacatgtgtgtgg

SEQ ID NO: 582596 - DNA, 25 bp, Mus musculus
cattctgactcactaggtccgggac

SEQ ID NO: 582597 - DNA, 25 bp, Mus musculus
cattctgactcagtaggtccgggac

SEQ ID NO: 582598 - DNA, 25 bp, Mus musculus
cattctgccgtgagtgccagtgacc

SEQ ID NO: 582599 - DNA, 25 bp, Mus musculus
cattctgccgtgtgtgccagtgacc

SEQ ID NO: 582600 - DNA, 25 bp, Mus musculus
cattctgcctgtcgataatcccgtt

SEQ ID NO: 582601 - DNA, 25 bp, Mus musculus
cattctgcctgtggataatcccgtt

SEQ ID NO: 582602 - DNA, 25 bp, Mus musculus
cattctgcgaacaaactcagcggac

SEQ ID NO: 582603 - DNA, 25 bp, Mus musculus
cattctgcgaactaactcagcggac

SEQ ID NO: 582604 - DNA, 25 bp, Mus musculus
cattctgctcatattccttggacac

SEQ ID NO: 582605 - DNA, 25 bp, Mus musculus
cattctgctcattttccttggacac

SEQ ID NO: 582606 - DNA, 25 bp, Mus musculus
cattctggaatgagtggagcagttc

SEQ ID NO: 582607 - DNA, 25 bp, Mus musculus
cattctggaatgtgtggagcagttc

SEQ ID NO: 582608 - DNA, 25 bp, Mus musculus
cattctggagaccttccggcattca

SEQ ID NO: 582609 - DNA, 25 bp, Mus musculus
cattctggagacgttccggcattca

SEQ ID NO: 582610 - DNA, 25 bp, Mus musculus
cattctggagtcacacaagagtccc

SEQ ID NO: 582611 - DNA, 25 bp, Mus musculus
cattctggagtctcacaagagtccc

SEQ ID NO: 582612 - DNA, 25 bp, Mus musculus
cattctggatcgctgcgatgacgcc

SEQ ID NO: 582613 - DNA, 25 bp, Mus musculus
cattctggatcggtgcgatgacgcc

SEQ ID NO: 582614 - DNA, 25 bp, Mus musculus
cattctggatttcctactaggacgt

SEQ ID NO: 582615 - DNA, 25 bp, Mus musculus
cattctggatttgctactaggacgt

SEQ ID NO: 582616 - DNA, 25 bp, Mus musculus
cattctggcagacttagcagtgggc

SEQ ID NO: 582617 - DNA, 25 bp, Mus musculus
cattctggcagagttagcagtgggc

SEQ ID NO: 582618 - DNA, 25 bp, Mus musculus
cattctggcattagaaaaaagcctc

SEQ ID NO: 582619 - DNA, 25 bp, Mus musculus
cattctggcatttgaaaaaagcctc

SEQ ID NO: 582620 - DNA, 25 bp, Mus musculus
cattctggccatcgtgactacatct

SEQ ID NO: 582621 - DNA, 25 bp, Mus musculus
cattctggccatggtgactacatct

SEQ ID NO: 582622 - DNA, 25 bp, Mus musculus
cattctgggacacagtcaaggactc

SEQ ID NO: 582623 - DNA, 25 bp, Mus musculus
cattctgggacagagtcaaggactc

SEQ ID NO: 582624 - DNA, 25 bp, Mus musculus
cattctgggccgctattttgccaga

SEQ ID NO: 582625 - DNA, 25 bp, Mus musculus
cattctgggccggtattttgccaga

SEQ ID NO: 582626 - DNA, 25 bp, Mus musculus
cattctgggcttcgcaaagtgctta

SEQ ID NO: 582627 - DNA, 25 bp, Mus musculus
cattctgggcttggcaaagtgctta

SEQ ID NO: 582628 - DNA, 25 bp, Mus musculus
cattctggtaagcttctcggaggag

SEQ ID NO: 582629 - DNA, 25 bp, Mus musculus
cattctggtaaggttctcggaggag

SEQ ID NO: 582630 - DNA, 25 bp, Mus musculus
cattctggtaggaaccactggaccc

SEQ ID NO: 582631 - DNA, 25 bp, Mus musculus
cattctggtaggtaccactggaccc

SEQ ID NO: 582632 - DNA, 25 bp, Mus musculus
cattctggtcagacctcctacatca

SEQ ID NO: 582633 - DNA, 25 bp, Mus musculus
cattctggtcagtcctcctacatca

SEQ ID NO: 582634 - DNA, 25 bp, Mus musculus
cattctgtacaacgaacagaggctg

SEQ ID NO: 582635 - DNA, 25 bp, Mus musculus
cattctgtacaaggaacagaggctg

SEQ ID NO: 582636 - DNA, 25 bp, Mus musculus
cattctgtactaacagacgacttta

SEQ ID NO: 582637 - DNA, 25 bp, Mus musculus
cattctgtactatcagacgacttta

SEQ ID NO: 582638 - DNA, 25 bp, Mus musculus
cattctgtagaacacctgttgcaag

SEQ ID NO: 582639 - DNA, 25 bp, Mus musculus
cattctgtagaagacctgttgcaag

SEQ ID NO: 582640 - DNA, 25 bp, Mus musculus
cattctgtctggcatgcagccatcg

SEQ ID NO: 582641 - DNA, 25 bp, Mus musculus
cattctgtctgggatgcagccatcg

SEQ ID NO: 582642 - DNA, 25 bp, Mus musculus
cattctgtggacatacgatatgtgg

SEQ ID NO: 582643 - DNA, 25 bp, Mus musculus
cattctgtggacttacgatatgtgg

SEQ ID NO: 582644 - DNA, 25 bp, Mus musculus
cattctgtggtgctcacgaagttga

SEQ ID NO: 582645 - DNA, 25 bp, Mus musculus
cattctgtggtggtcacgaagttga

SEQ ID NO: 582646 - DNA, 25 bp, Mus musculus
cattctgtgtcaacttgccggaaat

SEQ ID NO: 582647 - DNA, 25 bp, Mus musculus
cattctgtgtcatcttgccggaaat

SEQ ID NO: 582648 - DNA, 25 bp, Mus musculus
cattctgttcttccggacgctcaca

SEQ ID NO: 582649 - DNA, 25 bp, Mus musculus
cattctgttcttgcggacgctcaca

SEQ ID NO: 582650 - DNA, 25 bp, Mus musculus
cattctgttgttcgtcatgcgttgt

SEQ ID NO: 582651 - DNA, 25 bp, Mus musculus
cattctgttgttggtcatgcgttgt

SEQ ID NO: 582652 - DNA, 25 bp, Mus musculus
cattcttaaaaccagcacctgcttt

SEQ ID NO: 582653 - DNA, 25 bp, Mus musculus
cattcttaaaacgagcacctgcttt

SEQ ID NO: 582654 - DNA, 25 bp, Mus musculus
cattcttaaaagcagtgtaccacct

SEQ ID NO: 582655 - DNA, 25 bp, Mus musculus
cattcttaaaaggagtgtaccacct

SEQ ID NO: 582656 - DNA, 25 bp, Mus musculus
cattcttaagtactaagctccaaga

SEQ ID NO: 582657 - DNA, 25 bp, Mus musculus
cattcttaagtagtaagctccaaga

SEQ ID NO: 582658 - DNA, 25 bp, Mus musculus
cattcttagattcttcgactctgca

SEQ ID NO: 582659 - DNA, 25 bp, Mus musculus
cattcttagattgttcgactctgca

SEQ ID NO: 582660 - DNA, 25 bp, Mus musculus
cattcttcaccactggactgcggga

SEQ ID NO: 582661 - DNA, 25 bp, Mus musculus
cattcttcaccagtggactgcggga

SEQ ID NO: 582662 - DNA, 25 bp, Mus musculus
cattcttcactgatgggacacttcg

SEQ ID NO: 582663 - DNA, 25 bp, Mus musculus
cattcttcactgttgggacacttcg

SEQ ID NO: 582664 - DNA, 25 bp, Mus musculus
cattcttccactcacgtactgctgt

SEQ ID NO: 582665 - DNA, 25 bp, Mus musculus
cattcttccactgacgtactgctgt

SEQ ID NO: 582666 - DNA, 25 bp, Mus musculus
cattcttctcaacagcagcattcct

SEQ ID NO: 582667 - DNA, 25 bp, Mus musculus
cattcttctcaagagcagcattcct

SEQ ID NO: 582668 - DNA, 25 bp, Mus musculus
cattcttgccctaggaaccttatga

SEQ ID NO: 582669 - DNA, 25 bp, Mus musculus
cattcttgcccttggaaccttatga

SEQ ID NO: 582670 - DNA, 25 bp, Mus musculus
cattcttggatgatgtggttccctt

SEQ ID NO: 582671 - DNA, 25 bp, Mus musculus
cattcttggatgttgtggttccctt

SEQ ID NO: 582672 - DNA, 25 bp, Mus musculus
cattcttggtggaatcgaagaagag

SEQ ID NO: 582673 - DNA, 25 bp, Mus musculus
cattcttggtggtatcgaagaagag

SEQ ID NO: 582674 - DNA, 25 bp, Mus musculus
cattctttctggcattggtgtttcc

SEQ ID NO: 582675 - DNA, 25 bp, Mus musculus
cattctttctgggattggtgtttcc

SEQ ID NO: 582676 - DNA, 25 bp, Mus musculus
cattctttgcatcgcccgtctgaag

SEQ ID NO: 582677 - DNA, 25 bp, Mus musculus
cattctttgcatcttgatcctggga

SEQ ID NO: 582678 - DNA, 25 bp, Mus musculus
cattctttgcatggcccgtctgaag

SEQ ID NO: 582679 - DNA, 25 bp, Mus musculus
cattctttgcatgttgatcctggga

SEQ ID NO: 582680 - DNA, 25 bp, Mus musculus
cattctttggatccattgggataga

SEQ ID NO: 582681 - DNA, 25 bp, Mus musculus
cattctttggatgcattgggataga

SEQ ID NO: 582682 - DNA, 25 bp, Mus musculus
cattctttgtgcagctgtgacatcc

SEQ ID NO: 582683 - DNA, 25 bp, Mus musculus
cattctttgtgctgctgtgacatcc

SEQ ID NO: 582684 - DNA, 25 bp, Mus musculus
cattcttttaagaggagtgtgaaga

SEQ ID NO: 582685 - DNA, 25 bp, Mus musculus
cattcttttaagtggagtgtgaaga

SEQ ID NO: 582686 - DNA, 25 bp, Mus musculus
cattcttttttgaagctcgaagcaa

SEQ ID NO: 582687 - DNA, 25 bp, Mus musculus
cattcttttttgtagctcgaagcaa

SEQ ID NO: 582688 - DNA, 25 bp, Mus musculus
cattgaaaaatacgcttgaacacct

SEQ ID NO: 582689 - DNA, 25 bp, Mus musculus
cattgaaaaataggcttgaacacct

SEQ ID NO: 582690 - DNA, 25 bp, Mus musculus
cattgaaaactcatcgttatgggaa

SEQ ID NO: 582691 - DNA, 25 bp, Mus musculus
cattgaaaactcttcgttatgggaa

SEQ ID NO: 582692 - DNA, 25 bp, Mus musculus
cattgaaaatggagcaagtgtttgc

SEQ ID NO: 582693 - DNA, 25 bp, Mus musculus
cattgaaaatggtgcaagtgtttgc

SEQ ID NO: 582694 - DNA, 25 bp, Mus musculus
cattgaaagaaaagccttcctagag

SEQ ID NO: 582695 - DNA, 25 bp, Mus musculus
cattgaaagaaatgccttcctagag

SEQ ID NO: 582696 - DNA, 25 bp, Mus musculus
cattgaaagaagcaaatgagatctt

SEQ ID NO: 582697 - DNA, 25 bp, Mus musculus
cattgaaagaaggaaatgagatctt

SEQ ID NO: 582698 - DNA, 25 bp, Mus musculus
cattgaaagaatatagcaccacata

SEQ ID NO: 582699 - DNA, 25 bp, Mus musculus
cattgaaagaatttagcaccacata

SEQ ID NO: 582700 - DNA, 25 bp, Mus musculus
cattgaaagccaagagactcctaga

SEQ ID NO: 582701 - DNA, 25 bp, Mus musculus
cattgaaagccatgagactcctaga

SEQ ID NO: 582702 - DNA, 25 bp, Mus musculus
cattgaaataaacaaccaggcagca

SEQ ID NO: 582703 - DNA, 25 bp, Mus musculus
cattgaaataaagaaccaggcagca

SEQ ID NO: 582704 - DNA, 25 bp, Mus musculus
cattgaaatcaaatcaaagtctacc

SEQ ID NO: 582705 - DNA, 25 bp, Mus musculus
cattgaaatcaattcaaagtctacc

SEQ ID NO: 582706 - DNA, 25 bp, Mus musculus
cattgaaatgttcctttgccaagct

SEQ ID NO: 582707 - DNA, 25 bp, Mus musculus
cattgaaatgttgctttgccaagct

SEQ ID NO: 582708 - DNA, 25 bp, Mus musculus
cattgaacaagaagccaatgagaaa

SEQ ID NO: 582709 - DNA, 25 bp, Mus musculus
cattgaacaagatgccaatgagaaa

SEQ ID NO: 582710 - DNA, 25 bp, Mus musculus
cattgaacagagcattaagtctgag

SEQ ID NO: 582711 - DNA, 25 bp, Mus musculus
cattgaacagaggattaagtctgag

SEQ ID NO: 582712 - DNA, 25 bp, Mus musculus
cattgaacagcacaatgagtcgctc

SEQ ID NO: 582713 - DNA, 25 bp, Mus musculus
cattgaacagcagaatgagtcgctc

SEQ ID NO: 582714 - DNA, 25 bp, Mus musculus
cattgaacgagcaagctacgctctg

SEQ ID NO: 582715 - DNA, 25 bp, Mus musculus
cattgaacgagctagctacgctctg

SEQ ID NO: 582716 - DNA, 25 bp, Mus musculus
cattgaactctactggaatagctac

SEQ ID NO: 582717 - DNA, 25 bp, Mus musculus
cattgaactctagtggaatagctac

SEQ ID NO: 582718 - DNA, 25 bp, Mus musculus
cattgaagaagcaaaggcccgagca

SEQ ID NO: 582719 - DNA, 25 bp, Mus musculus
cattgaagaagctaaggcccgagca

SEQ ID NO: 582720 - DNA, 25 bp, Mus musculus
cattgaagacatagttcgagatggc

SEQ ID NO: 582721 - DNA, 25 bp, Mus musculus
cattgaagacattgttcgagatggc

SEQ ID NO: 582722 - DNA, 25 bp, Mus musculus
cattgaagctcaacgaaatagtggg

SEQ ID NO: 582723 - DNA, 25 bp, Mus musculus
cattgaagctcatcgaaatagtggg

SEQ ID NO: 582724 - DNA, 25 bp, Mus musculus
cattgaagctggcatcatcggagtc

SEQ ID NO: 582725 - DNA, 25 bp, Mus musculus
cattgaagctgggatcatcggagtc

SEQ ID NO: 582726 - DNA, 25 bp, Mus musculus
cattgaaggtgtagtcctgcgagat

SEQ ID NO: 582727 - DNA, 25 bp, Mus musculus
cattgaaggtgttgtcctgcgagat

SEQ ID NO: 582728 - DNA, 25 bp, Mus musculus
cattgaatgtcccagaggagcacgg

SEQ ID NO: 582729 - DNA, 25 bp, Mus musculus
cattgaatgtccgagaggagcacgg

SEQ ID NO: 582730 - DNA, 25 bp, Mus musculus
cattgacaactgaaagcttgttaca

SEQ ID NO: 582731 - DNA, 25 bp, Mus musculus
cattgacaactgtaagcttgttaca

SEQ ID NO: 582732 - DNA, 25 bp, Mus musculus
cattgacaagataatcggccgctgc

SEQ ID NO: 582733 - DNA, 25 bp, Mus musculus
cattgacaagattatcggccgctgc

SEQ ID NO: 582734 - DNA, 25 bp, Mus musculus
cattgacaagttactcttattgcct

SEQ ID NO: 582735 - DNA, 25 bp, Mus musculus
cattgacaagtttctcttattgcct

SEQ ID NO: 582736 - DNA, 25 bp, Mus musculus
cattgacaatggatttctttctgaa

SEQ ID NO: 582737 - DNA, 25 bp, Mus musculus
cattgacaatggttttctttctgaa

SEQ ID NO: 582738 - DNA, 25 bp, Mus musculus
cattgacagagtcactgcactcaca

SEQ ID NO: 582739 - DNA, 25 bp, Mus musculus
cattgacagagtgactgcactcaca

SEQ ID NO: 582740 - DNA, 25 bp, Mus musculus
cattgacagctactattacgggaag

SEQ ID NO: 582741 - DNA, 25 bp, Mus musculus
cattgacagctagtattacgggaag

SEQ ID NO: 582742 - DNA, 25 bp, Mus musculus
cattgacaggcaactaggagaacct

SEQ ID NO: 582743 - DNA, 25 bp, Mus musculus
cattgacaggcatctaggagaacct

SEQ ID NO: 582744 - DNA, 25 bp, Mus musculus
cattgacatgctccgagtggaacag

SEQ ID NO: 582745 - DNA, 25 bp, Mus musculus
cattgacatgctgcgagtggaacag

SEQ ID NO: 582746 - DNA, 25 bp, Mus musculus
cattgacattccactctagccttga

SEQ ID NO: 582747 - DNA, 25 bp, Mus musculus
cattgacattcctctctagccttga

SEQ ID NO: 582748 - DNA, 25 bp, Mus musculus
cattgaccaggtagagaagcggagt

SEQ ID NO: 582749 - DNA, 25 bp, Mus musculus
cattgaccaggttgagaagcggagt

SEQ ID NO: 582750 - DNA, 25 bp, Mus musculus
cattgacccacaagctgaagggcag

SEQ ID NO: 582751 - DNA, 25 bp, Mus musculus
cattgacccacatgctgaagggcag

SEQ ID NO: 582752 - DNA, 25 bp, Mus musculus
cattgacccatcatctggtgtggca

SEQ ID NO: 582753 - DNA, 25 bp, Mus musculus
cattgacccatcttctggtgtggca

SEQ ID NO: 582754 - DNA, 25 bp, Mus musculus
cattgaccccaaagctgagcttatg

SEQ ID NO: 582755 - DNA, 25 bp, Mus musculus
cattgaccccaatgctgagcttatg

SEQ ID NO: 582756 - DNA, 25 bp, Mus musculus
cattgacccgaaattaaagtggatc

SEQ ID NO: 582757 - DNA, 25 bp, Mus musculus
cattgacccgaatttaaagtggatc

SEQ ID NO: 582758 - DNA, 25 bp, Mus musculus
cattgaccgaaacagttctctcctc

SEQ ID NO: 582759 - DNA, 25 bp, Mus musculus
cattgaccgaaagagttctctcctc

SEQ ID NO: 582760 - DNA, 25 bp, Mus musculus
cattgaccggcaaggaaagcctatc

SEQ ID NO: 582761 - DNA, 25 bp, Mus musculus
cattgaccggcatggaaagcctatc

SEQ ID NO: 582762 - DNA, 25 bp, Mus musculus
cattgacctactcaagctacagcag

SEQ ID NO: 582763 - DNA, 25 bp, Mus musculus
cattgacctactgaagctacagcag

SEQ ID NO: 582764 - DNA, 25 bp, Mus musculus
cattgacctcacaaggaacgagggt

SEQ ID NO: 582765 - DNA, 25 bp, Mus musculus
cattgacctcactaggaacgagggt

SEQ ID NO: 582766 - DNA, 25 bp, Mus musculus
cattgacgacgacgacagctttaac

SEQ ID NO: 582767 - DNA, 25 bp, Mus musculus
cattgacgacgaggacagctttaac

SEQ ID NO: 582768 - DNA, 25 bp, Mus musculus
cattgacgagtgagcagaagggcgc

SEQ ID NO: 582769 - DNA, 25 bp, Mus musculus
cattgacgagtgatcctttgagcgg

SEQ ID NO: 582770 - DNA, 25 bp, Mus musculus
cattgacgagtgtgcagaagggcgc

SEQ ID NO: 582771 - DNA, 25 bp, Mus musculus
cattgacgagtgttcctttgagcgg

SEQ ID NO: 582772 - DNA, 25 bp, Mus musculus
cattgacgatgtagtgaacaaaatt

SEQ ID NO: 582773 - DNA, 25 bp, Mus musculus
cattgacgatgttgtgaacaaaatt

SEQ ID NO: 582774 - DNA, 25 bp, Mus musculus
cattgactacagattggtggcggct

SEQ ID NO: 582775 - DNA, 25 bp, Mus musculus
cattgactacagcatgaggtgcatc

SEQ ID NO: 582776 - DNA, 25 bp, Mus musculus
cattgactacaggatgaggtgcatc

SEQ ID NO: 582777 - DNA, 25 bp, Mus musculus
cattgactacagtttggtggcggct

SEQ ID NO: 582778 - DNA, 25 bp, Mus musculus
cattgactactgcagctttggaaac

SEQ ID NO: 582779 - DNA, 25 bp, Mus musculus
cattgactactggagctttggaaac

SEQ ID NO: 582780 - DNA, 25 bp, Mus musculus
cattgactatgcattgaagttaaag

SEQ ID NO: 582781 - DNA, 25 bp, Mus musculus
cattgactatgctttgaagttaaag

SEQ ID NO: 582782 - DNA, 25 bp, Mus musculus
cattgactcaagaaatggaggcccg

SEQ ID NO: 582783 - DNA, 25 bp, Mus musculus
cattgactcaagtaatggaggcccg

SEQ ID NO: 582784 - DNA, 25 bp, Mus musculus
cattgactcaggcacggtacttgga

SEQ ID NO: 582785 - DNA, 25 bp, Mus musculus
cattgactcagggacggtacttgga

SEQ ID NO: 582786 - DNA, 25 bp, Mus musculus
cattgactcataccctagtcctgca

SEQ ID NO: 582787 - DNA, 25 bp, Mus musculus
cattgactcatagcctagtcctgca

SEQ ID NO: 582788 - DNA, 25 bp, Mus musculus
cattgactccagaactggccccagt

SEQ ID NO: 582789 - DNA, 25 bp, Mus musculus
cattgactccagtactggccccagt

SEQ ID NO: 582790 - DNA, 25 bp, Mus musculus
cattgacttcatctcaagggagacc

SEQ ID NO: 582791 - DNA, 25 bp, Mus musculus
cattgacttcatgtcaagggagacc

SEQ ID NO: 582792 - DNA, 25 bp, Mus musculus
cattgacttcctagctgagaaggac

SEQ ID NO: 582793 - DNA, 25 bp, Mus musculus
cattgacttccttgctgagaaggac

SEQ ID NO: 582794 - DNA, 25 bp, Mus musculus
cattgacttcgtatgtactttcgta

SEQ ID NO: 582795 - DNA, 25 bp, Mus musculus
cattgacttcgtttgtactttcgta

SEQ ID NO: 582796 - DNA, 25 bp, Mus musculus
cattgacttgggagcctgtccatgc

SEQ ID NO: 582797 - DNA, 25 bp, Mus musculus
cattgacttgggtgcctgtccatgc

SEQ ID NO: 582798 - DNA, 25 bp, Mus musculus
cattgacttgtcaaaccccagtgct

SEQ ID NO: 582799 - DNA, 25 bp, Mus musculus
cattgacttgtctaaccccagtgct

SEQ ID NO: 582800 - DNA, 25 bp, Mus musculus
cattgagaaacaagaactctaaaca

SEQ ID NO: 582801 - DNA, 25 bp, Mus musculus
cattgagaaacatgaactctaaaca

SEQ ID NO: 582802 - DNA, 25 bp, Mus musculus
cattgagaaactacgcctgtctgac

SEQ ID NO: 582803 - DNA, 25 bp, Mus musculus
cattgagaaacttcgcctgtctgac

SEQ ID NO: 582804 - DNA, 25 bp, Mus musculus
cattgagaacccaaggcactttgtg

SEQ ID NO: 582805 - DNA, 25 bp, Mus musculus
cattgagaaccctaggcactttgtg

SEQ ID NO: 582806 - DNA, 25 bp, Mus musculus
cattgagaagaaagtagagctctac

SEQ ID NO: 582807 - DNA, 25 bp, Mus musculus
cattgagaagaatgtagagctctac

SEQ ID NO: 582808 - DNA, 25 bp, Mus musculus
cattgagaagcaactcaagcgccgt

SEQ ID NO: 582809 - DNA, 25 bp, Mus musculus
cattgagaagcatctcaagcgccgt

SEQ ID NO: 582810 - DNA, 25 bp, Mus musculus
cattgagaaggaccggccacagctg

SEQ ID NO: 582811 - DNA, 25 bp, Mus musculus
cattgagaaggagcggccacagctg

SEQ ID NO: 582812 - DNA, 25 bp, Mus musculus
cattgagacactcatcaagaacttc

SEQ ID NO: 582813 - DNA, 25 bp, Mus musculus
cattgagacactgatcaagaacttc

SEQ ID NO: 582814 - DNA, 25 bp, Mus musculus
cattgagacagacccagtgtttacc

SEQ ID NO: 582815 - DNA, 25 bp, Mus musculus
cattgagacagagccagtgtttacc

SEQ ID NO: 582816 - DNA, 25 bp, Mus musculus
cattgagacatcagctctagattct

SEQ ID NO: 582817 - DNA, 25 bp, Mus musculus
cattgagacatctgctctagattct

SEQ ID NO: 582818 - DNA, 25 bp, Mus musculus
cattgagaccagagcaaatgtgaaa

SEQ ID NO: 582819 - DNA, 25 bp, Mus musculus
cattgagaccagtgcaaatgtgaaa

SEQ ID NO: 582820 - DNA, 25 bp, Mus musculus
cattgagacggaacacaatgcctac

SEQ ID NO: 582821 - DNA, 25 bp, Mus musculus
cattgagacggatcacaatgcctac

SEQ ID NO: 582822 - DNA, 25 bp, Mus musculus
cattgagagctaccgtgaccccttt

SEQ ID NO: 582823 - DNA, 25 bp, Mus musculus
cattgagagctagcgtgaccccttt

SEQ ID NO: 582824 - DNA, 25 bp, Mus musculus
cattgagatcaacgatggccgtggt

SEQ ID NO: 582825 - DNA, 25 bp, Mus musculus
cattgagatcaaggatggccgtggt

SEQ ID NO: 582826 - DNA, 25 bp, Mus musculus
cattgagatgcacgccatcacagcc

SEQ ID NO: 582827 - DNA, 25 bp, Mus musculus
cattgagatgcaggccatcacagcc

SEQ ID NO: 582828 - DNA, 25 bp, Mus musculus
cattgagatgctcgaaacagacacc

SEQ ID NO: 582829 - DNA, 25 bp, Mus musculus
cattgagatgctggaaacagacacc

SEQ ID NO: 582830 - DNA, 25 bp, Mus musculus
cattgagatgttagagcatctggtc

SEQ ID NO: 582831 - DNA, 25 bp, Mus musculus
cattgagatgtttgagcatctggtc

SEQ ID NO: 582832 - DNA, 25 bp, Mus musculus
cattgagcaaaacaatcaactgctg

SEQ ID NO: 582833 - DNA, 25 bp, Mus musculus
cattgagcaaaagaatcaactgctg

SEQ ID NO: 582834 - DNA, 25 bp, Mus musculus
cattgagcagcacgttctgagagcc

SEQ ID NO: 582835 - DNA, 25 bp, Mus musculus
cattgagcagcaggttctgagagcc

SEQ ID NO: 582836 - DNA, 25 bp, Mus musculus
cattgagcatgcagagttctcaggg

SEQ ID NO: 582837 - DNA, 25 bp, Mus musculus
cattgagcatgctgagttctcaggg

SEQ ID NO: 582838 - DNA, 25 bp, Mus musculus
cattgagcatgtacgagacggcagt

SEQ ID NO: 582839 - DNA, 25 bp, Mus musculus
cattgagcatgttcgagacggcagt

SEQ ID NO: 582840 - DNA, 25 bp, Mus musculus
cattgagcccttagacgacaggacc

SEQ ID NO: 582841 - DNA, 25 bp, Mus musculus
cattgagccctttgacgacaggacc

SEQ ID NO: 582842 - DNA, 25 bp, Mus musculus
cattgagccgagagtcaggagctgc

SEQ ID NO: 582843 - DNA, 25 bp, Mus musculus
cattgagccgagtgtcaggagctgc

SEQ ID NO: 582844 - DNA, 25 bp, Mus musculus
cattgagcgcaccttccatgtggaa

SEQ ID NO: 582845 - DNA, 25 bp, Mus musculus
cattgagcgcacgttccatgtggaa

SEQ ID NO: 582846 - DNA, 25 bp, Mus musculus
cattgagcgtccagcagatgtggaa

SEQ ID NO: 582847 - DNA, 25 bp, Mus musculus
cattgagcgtcctgcagatgtggaa

SEQ ID NO: 582848 - DNA, 25 bp, Mus musculus
cattgagctcctcgaaagatcttgc

SEQ ID NO: 582849 - DNA, 25 bp, Mus musculus
cattgagctcctggaaagatcttgc

SEQ ID NO: 582850 - DNA, 25 bp, Mus musculus
cattgagctgaacccctgtcggtca

SEQ ID NO: 582851 - DNA, 25 bp, Mus musculus
cattgagctgaagccctgtcggtca

SEQ ID NO: 582852 - DNA, 25 bp, Mus musculus
cattgaggacgaaggagtcctggac

SEQ ID NO: 582853 - DNA, 25 bp, Mus musculus
cattgaggacgatggagtcctggac

SEQ ID NO: 582854 - DNA, 25 bp, Mus musculus
cattgaggagtgcatactgtcaggc

SEQ ID NO: 582855 - DNA, 25 bp, Mus musculus
cattgaggagtggatactgtcaggc

SEQ ID NO: 582856 - DNA, 25 bp, Mus musculus
cattgaggatggagatgcatatgcc

SEQ ID NO: 582857 - DNA, 25 bp, Mus musculus
cattgaggatggtgatgcatatgcc

SEQ ID NO: 582858 - DNA, 25 bp, Mus musculus
cattgaggcagcacacaggttgctt

SEQ ID NO: 582859 - DNA, 25 bp, Mus musculus
cattgaggcagctcacaggttgctt

SEQ ID NO: 582860 - DNA, 25 bp, Mus musculus
cattgaggccaacctgcaagctctc

SEQ ID NO: 582861 - DNA, 25 bp, Mus musculus
cattgaggccaagctgcaagctctc

SEQ ID NO: 582862 - DNA, 25 bp, Mus musculus
cattgaggccctcaacatcatggaa

SEQ ID NO: 582863 - DNA, 25 bp, Mus musculus
cattgaggccctcactcaggtgttc

SEQ ID NO: 582864 - DNA, 25 bp, Mus musculus
cattgaggccctgaacatcatggaa

SEQ ID NO: 582865 - DNA, 25 bp, Mus musculus
cattgaggccctgactcaggtgttc

SEQ ID NO: 582866 - DNA, 25 bp, Mus musculus
cattgaggctcaccatgacagcatc

SEQ ID NO: 582867 - DNA, 25 bp, Mus musculus
cattgaggctcagcatgacagcatc

SEQ ID NO: 582868 - DNA, 25 bp, Mus musculus
cattgagggtatcatctttggtggc

SEQ ID NO: 582869 - DNA, 25 bp, Mus musculus
cattgagggtatgatctttggtggc

SEQ ID NO: 582870 - DNA, 25 bp, Mus musculus
cattgagggttgaaagacccagccc

SEQ ID NO: 582871 - DNA, 25 bp, Mus musculus
cattgagggttgtaagacccagccc

SEQ ID NO: 582872 - DNA, 25 bp, Mus musculus
cattgaggtggcacagaagctgtta

SEQ ID NO: 582873 - DNA, 25 bp, Mus musculus
cattgaggtggctcagaagctgtta

SEQ ID NO: 582874 - DNA, 25 bp, Mus musculus
cattgagtacaactctgccaacaga

SEQ ID NO: 582875 - DNA, 25 bp, Mus musculus
cattgagtacaagtctgccaacaga

SEQ ID NO: 582876 - DNA, 25 bp, Mus musculus
cattgagtactgcttgggttgtatc

SEQ ID NO: 582877 - DNA, 25 bp, Mus musculus
cattgagtactggttgggttgtatc

SEQ ID NO: 582878 - DNA, 25 bp, Mus musculus
cattgagtcactcatcaaacacatg

SEQ ID NO: 582879 - DNA, 25 bp, Mus musculus
cattgagtcactgatcaaacacatg

SEQ ID NO: 582880 - DNA, 25 bp, Mus musculus
cattgagtctgtcagctctgacggt

SEQ ID NO: 582881 - DNA, 25 bp, Mus musculus
cattgagtctgtgagctctgacggt

SEQ ID NO: 582882 - DNA, 25 bp, Mus musculus
cattgagtgaacctttgacaaagcc

SEQ ID NO: 582883 - DNA, 25 bp, Mus musculus
cattgagtgaacgtttgacaaagcc

SEQ ID NO: 582884 - DNA, 25 bp, Mus musculus
cattgagtgctccaagcactttttc

SEQ ID NO: 582885 - DNA, 25 bp, Mus musculus
cattgagtgctcgaagcactttttc

SEQ ID NO: 582886 - DNA, 25 bp, Mus musculus
cattgagtgtgtacagccccagtct

SEQ ID NO: 582887 - DNA, 25 bp, Mus musculus
cattgagtgtgttcagccccagtct

SEQ ID NO: 582888 - DNA, 25 bp, Mus musculus
cattgagttctacaagcatgagagc

SEQ ID NO: 582889 - DNA, 25 bp, Mus musculus
cattgagttctagaagcatgagagc

SEQ ID NO: 582890 - DNA, 25 bp, Mus musculus
cattgataaaacagtatgacttgcc

SEQ ID NO: 582891 - DNA, 25 bp, Mus musculus
cattgataaaactgtatgacttgcc

SEQ ID NO: 582892 - DNA, 25 bp, Mus musculus
cattgataaggacagcaagacccgc

SEQ ID NO: 582893 - DNA, 25 bp, Mus musculus
cattgataaggagagcaagacccgc

SEQ ID NO: 582894 - DNA, 25 bp, Mus musculus
cattgatagcctccaagatcagcaa

SEQ ID NO: 582895 - DNA, 25 bp, Mus musculus
cattgatagcctgcaagatcagcaa

SEQ ID NO: 582896 - DNA, 25 bp, Mus musculus
cattgatatcgacatccaccatggt

SEQ ID NO: 582897 - DNA, 25 bp, Mus musculus
cattgatatcgagatccaccatggt

SEQ ID NO: 582898 - DNA, 25 bp, Mus musculus
cattgatcaatcattatggacttct

SEQ ID NO: 582899 - DNA, 25 bp, Mus musculus
cattgatcaatctttatggacttct

SEQ ID NO: 582900 - DNA, 25 bp, Mus musculus
cattgatcacatccataagtacggc

SEQ ID NO: 582901 - DNA, 25 bp, Mus musculus
cattgatcacatgcataagtacggc

SEQ ID NO: 582902 - DNA, 25 bp, Mus musculus
cattgatcccaaagccaagggctgg

SEQ ID NO: 582903 - DNA, 25 bp, Mus musculus
cattgatcccaatgccaagggctgg

SEQ ID NO: 582904 - DNA, 25 bp, Mus musculus
cattgatctcgtctcccatggatac

SEQ ID NO: 582905 - DNA, 25 bp, Mus musculus
cattgatctcgtgtcccatggatac

SEQ ID NO: 582906 - DNA, 25 bp, Mus musculus
cattgatctgatctactttccctac

SEQ ID NO: 582907 - DNA, 25 bp, Mus musculus
cattgatctgatgtactttccctac

SEQ ID NO: 582908 - DNA, 25 bp, Mus musculus
cattgatgaagcagaagaagctata

SEQ ID NO: 582909 - DNA, 25 bp, Mus musculus
cattgatgaagctgaagaagctata

SEQ ID NO: 582910 - DNA, 25 bp, Mus musculus
cattgatgaattatgccgaaagttc

SEQ ID NO: 582911 - DNA, 25 bp, Mus musculus
cattgatgaattttgccgaaagttc

SEQ ID NO: 582912 - DNA, 25 bp, Mus musculus
cattgatgacatcgaagccttcact

SEQ ID NO: 582913 - DNA, 25 bp, Mus musculus
cattgatgacatggaagccttcact

SEQ ID NO: 582914 - DNA, 25 bp, Mus musculus
cattgatgaccacagtaagttctga

SEQ ID NO: 582915 - DNA, 25 bp, Mus musculus
cattgatgaccagagtaagttctga

SEQ ID NO: 582916 - DNA, 25 bp, Mus musculus
cattgatgactgcattgggaactgg

SEQ ID NO: 582917 - DNA, 25 bp, Mus musculus
cattgatgactggattgggaactgg

SEQ ID NO: 582918 - DNA, 25 bp, Mus musculus
cattgatgagctctacggaggcctg

SEQ ID NO: 582919 - DNA, 25 bp, Mus musculus
cattgatgagctgtacggaggcctg

SEQ ID NO: 582920 - DNA, 25 bp, Mus musculus
cattgatgcagcaacggaagcaaag

SEQ ID NO: 582921 - DNA, 25 bp, Mus musculus
cattgatgcagctacggaagcaaag

SEQ ID NO: 582922 - DNA, 25 bp, Mus musculus
cattgatgctgaagtgctgcagaat

SEQ ID NO: 582923 - DNA, 25 bp, Mus musculus
cattgatgctgatgtgctgcagaat

SEQ ID NO: 582924 - DNA, 25 bp, Mus musculus
cattgatggaatctgctttggaagt

SEQ ID NO: 582925 - DNA, 25 bp, Mus musculus
cattgatggaatgtgctttggaagt

SEQ ID NO: 582926 - DNA, 25 bp, Mus musculus
cattgatggagaaggccaggtcaat

SEQ ID NO: 582927 - DNA, 25 bp, Mus musculus
cattgatggagatggccaggtcaat

SEQ ID NO: 582928 - DNA, 25 bp, Mus musculus
cattgatgggatacgaattaacagc

SEQ ID NO: 582929 - DNA, 25 bp, Mus musculus
cattgatgggattcgaattaacagc

SEQ ID NO: 582930 - DNA, 25 bp, Mus musculus
cattgatgggtacccgtcacctgct

SEQ ID NO: 582931 - DNA, 25 bp, Mus musculus
cattgatgggtagccgtcacctgct

SEQ ID NO: 582932 - DNA, 25 bp, Mus musculus
cattgatgtagcaggtaaaaggtgc

SEQ ID NO: 582933 - DNA, 25 bp, Mus musculus
cattgatgtagctggtaaaaggtgc

SEQ ID NO: 582934 - DNA, 25 bp, Mus musculus
cattgatgtcatacattatcggaaa

SEQ ID NO: 582935 - DNA, 25 bp, Mus musculus
cattgatgtcattcattatcggaaa

SEQ ID NO: 582936 - DNA, 25 bp, Mus musculus
cattgattattacctggcagcattc

SEQ ID NO: 582937 - DNA, 25 bp, Mus musculus
cattgattattagctggcagcattc

SEQ ID NO: 582938 - DNA, 25 bp, Mus musculus
cattgattgccgctatccgtatgag

SEQ ID NO: 582939 - DNA, 25 bp, Mus musculus
cattgattgccggtatccgtatgag

SEQ ID NO: 582940 - DNA, 25 bp, Mus musculus
cattgattggcacgaatggcgagac

SEQ ID NO: 582941 - DNA, 25 bp, Mus musculus
cattgattggcaggaatggcgagac

SEQ ID NO: 582942 - DNA, 25 bp, Mus musculus
cattgattgtgcatctgtatatggc

SEQ ID NO: 582943 - DNA, 25 bp, Mus musculus
cattgattgtgcttctgtatatggc

SEQ ID NO: 582944 - DNA, 25 bp, Mus musculus
cattgcaaacttaggagggaacccg

SEQ ID NO: 582945 - DNA, 25 bp, Mus musculus
cattgcaaactttggagggaacccg

SEQ ID NO: 582946 - DNA, 25 bp, Mus musculus
cattgcaactggaaagcttttgcat

SEQ ID NO: 582947 - DNA, 25 bp, Mus musculus
cattgcaactggtaagcttttgcat

SEQ ID NO: 582948 - DNA, 25 bp, Mus musculus
cattgcaagcgcagttggcggctgc

SEQ ID NO: 582949 - DNA, 25 bp, Mus musculus
cattgcaagcgctgttggcggctgc

SEQ ID NO: 582950 - DNA, 25 bp, Mus musculus
cattgcaagtgtctagatccctggc

SEQ ID NO: 582951 - DNA, 25 bp, Mus musculus
cattgcaagtgtgtagatccctggc

SEQ ID NO: 582952 - DNA, 25 bp, Mus musculus
cattgcaattatccctcctcagctg

SEQ ID NO: 582953 - DNA, 25 bp, Mus musculus
cattgcaattatgcctcctcagctg

SEQ ID NO: 582954 - DNA, 25 bp, Mus musculus
cattgcacagagagactacatccct

SEQ ID NO: 582955 - DNA, 25 bp, Mus musculus
cattgcacagagtgactacatccct

SEQ ID NO: 582956 - DNA, 25 bp, Mus musculus
cattgcacattaagttgatgagaga

SEQ ID NO: 582957 - DNA, 25 bp, Mus musculus
cattgcacattatgttgatgagaga

SEQ ID NO: 582958 - DNA, 25 bp, Mus musculus
cattgcagacctccgcgtggcagtt

SEQ ID NO: 582959 - DNA, 25 bp, Mus musculus
cattgcagacctgcgcgtggcagtt

SEQ ID NO: 582960 - DNA, 25 bp, Mus musculus
cattgcagagctctgggccgtgttc

SEQ ID NO: 582961 - DNA, 25 bp, Mus musculus
cattgcagagctgtgggccgtgttc

SEQ ID NO: 582962 - DNA, 25 bp, Mus musculus
cattgcagcacccaagagaaggcct

SEQ ID NO: 582963 - DNA, 25 bp, Mus musculus
cattgcagcaccgaagagaaggcct

SEQ ID NO: 582964 - DNA, 25 bp, Mus musculus
cattgcagcctgaagtagataaact

SEQ ID NO: 582965 - DNA, 25 bp, Mus musculus
cattgcagcctgtagtagataaact

SEQ ID NO: 582966 - DNA, 25 bp, Mus musculus
cattgcaggcaaccctctgggtgtg

SEQ ID NO: 582967 - DNA, 25 bp, Mus musculus
cattgcaggcaagcctctgggtgtg

SEQ ID NO: 582968 - DNA, 25 bp, Mus musculus
cattgcaggcatagttagacttggc

SEQ ID NO: 582969 - DNA, 25 bp, Mus musculus
cattgcaggcattgttagacttggc

SEQ ID NO: 582970 - DNA, 25 bp, Mus musculus
cattgcaggcctagcagagctggga

SEQ ID NO: 582971 - DNA, 25 bp, Mus musculus
cattgcaggccttgcagagctggga

SEQ ID NO: 582972 - DNA, 25 bp, Mus musculus
cattgcaggtgtcatggcgacgctt

SEQ ID NO: 582973 - DNA, 25 bp, Mus musculus
cattgcaggtgtgatggcgacgctt

SEQ ID NO: 582974 - DNA, 25 bp, Mus musculus
cattgcagtacacacccaggaagtt

SEQ ID NO: 582975 - DNA, 25 bp, Mus musculus
cattgcagtacagacccaggaagtt

SEQ ID NO: 582976 - DNA, 25 bp, Mus musculus
cattgcagtagtccgccctccagga

SEQ ID NO: 582977 - DNA, 25 bp, Mus musculus
cattgcagtagtgcgccctccagga

SEQ ID NO: 582978 - DNA, 25 bp, Mus musculus
cattgcatcagtcggctttcacgag

SEQ ID NO: 582979 - DNA, 25 bp, Mus musculus
cattgcatcagtgggctttcacgag

SEQ ID NO: 582980 - DNA, 25 bp, Mus musculus
cattgcatcgttagccatggtgaca

SEQ ID NO: 582981 - DNA, 25 bp, Mus musculus
cattgcatcgtttgccatggtgaca

SEQ ID NO: 582982 - DNA, 25 bp, Mus musculus
cattgcatctccagtccgggcaaca

SEQ ID NO: 582983 - DNA, 25 bp, Mus musculus
cattgcatctcctgtccgggcaaca

SEQ ID NO: 582984 - DNA, 25 bp, Mus musculus
cattgcatggccacatcacctgatg

SEQ ID NO: 582985 - DNA, 25 bp, Mus musculus
cattgcatggcctcatcacctgatg

SEQ ID NO: 582986 - DNA, 25 bp, Mus musculus
cattgcatggtgctactgaacccca

SEQ ID NO: 582987 - DNA, 25 bp, Mus musculus
cattgcatggtggtactgaacccca

SEQ ID NO: 582988 - DNA, 25 bp, Mus musculus
cattgcattcatacgtgagggaccc

SEQ ID NO: 582989 - DNA, 25 bp, Mus musculus
cattgcattcattcgtgagggaccc

SEQ ID NO: 582990 - DNA, 25 bp, Mus musculus
cattgccaacctcttcaacaaatac

SEQ ID NO: 582991 - DNA, 25 bp, Mus musculus
cattgccaacctgttcaacaaatac

SEQ ID NO: 582992 - DNA, 25 bp, Mus musculus
cattgccaacggcagcgatgacggt

SEQ ID NO: 582993 - DNA, 25 bp, Mus musculus
cattgccaacgggagcgatgacggt

SEQ ID NO: 582994 - DNA, 25 bp, Mus musculus
cattgccaagatcaatcaacgtttg

SEQ ID NO: 582995 - DNA, 25 bp, Mus musculus
cattgccaagatgaatcaacgtttg

SEQ ID NO: 582996 - DNA, 25 bp, Mus musculus
cattgccacaagcaggttagaagac

SEQ ID NO: 582997 - DNA, 25 bp, Mus musculus
cattgccacaaggaggttagaagac

SEQ ID NO: 582998 - DNA, 25 bp, Mus musculus
cattgccacaggagagcagctgctg

SEQ ID NO: 582999 - DNA, 25 bp, Mus musculus
cattgccacaggtgagcagctgctg

SEQ ID NO: 583000 - DNA, 25 bp, Mus musculus
cattgccacccacgtggtggtggaa

SEQ ID NO: 583001 - DNA, 25 bp, Mus musculus
cattgccacccaggtggtggtggaa

SEQ ID NO: 583002 - DNA, 25 bp, Mus musculus
cattgccacttacgattttcctccg

SEQ ID NO: 583003 - DNA, 25 bp, Mus musculus
cattgccacttaggattttcctccg

SEQ ID NO: 583004 - DNA, 25 bp, Mus musculus
cattgccagccccactttgaagttg

SEQ ID NO: 583005 - DNA, 25 bp, Mus musculus
cattgccagcccgactttgaagttg

SEQ ID NO: 583006 - DNA, 25 bp, Mus musculus
cattgccatattcatcactcaagtg

SEQ ID NO: 583007 - DNA, 25 bp, Mus musculus
cattgccatattgatcactcaagtg

SEQ ID NO: 583008 - DNA, 25 bp, Mus musculus
cattgccatgacagtgcctagaaag

SEQ ID NO: 583009 - DNA, 25 bp, Mus musculus
cattgccatgactgtgcctagaaag

SEQ ID NO: 583010 - DNA, 25 bp, Mus musculus
cattgccattgaaggactggatgcc

SEQ ID NO: 583011 - DNA, 25 bp, Mus musculus
cattgccattgatggactggatgcc

SEQ ID NO: 583012 - DNA, 25 bp, Mus musculus
cattgcccaccacaaaggacagata

SEQ ID NO: 583013 - DNA, 25 bp, Mus musculus
cattgcccaccagaaaggacagata

SEQ ID NO: 583014 - DNA, 25 bp, Mus musculus
cattgcccacctaagtgcctcagga

SEQ ID NO: 583015 - DNA, 25 bp, Mus musculus
cattgcccaccttagtgcctcagga

SEQ ID NO: 583016 - DNA, 25 bp, Mus musculus
cattgcccagatctaccatgcagtt

SEQ ID NO: 583017 - DNA, 25 bp, Mus musculus
cattgcccagatgtaccatgcagtt

SEQ ID NO: 583018 - DNA, 25 bp, Mus musculus
cattgcccctagcttacagaaacga

SEQ ID NO: 583019 - DNA, 25 bp, Mus musculus
cattgcccctaggttacagaaacga

SEQ ID NO: 583020 - DNA, 25 bp, Mus musculus
cattgcccctgcattgtgcgagttc

SEQ ID NO: 583021 - DNA, 25 bp, Mus musculus
cattgcccctgctttgtgcgagttc

SEQ ID NO: 583022 - DNA, 25 bp, Mus musculus
cattgcccgaagaatcttaagttgc

SEQ ID NO: 583023 - DNA, 25 bp, Mus musculus
cattgcccgaagtatcttaagttgc

SEQ ID NO: 583024 - DNA, 25 bp, Mus musculus
cattgcccggcaagctgatattgtg

SEQ ID NO: 583025 - DNA, 25 bp, Mus musculus
cattgcccggcatgctgatattgtg

SEQ ID NO: 583026 - DNA, 25 bp, Mus musculus
cattgccgaaggcatctcagagctg

SEQ ID NO: 583027 - DNA, 25 bp, Mus musculus
cattgccgaagggatctcagagctg

SEQ ID NO: 583028 - DNA, 25 bp, Mus musculus
cattgccgacgtccagtgttacact

SEQ ID NO: 583029 - DNA, 25 bp, Mus musculus
cattgccgacgtgcagtgttacact

SEQ ID NO: 583030 - DNA, 25 bp, Mus musculus
cattgccggccacctgaaggacgct

SEQ ID NO: 583031 - DNA, 25 bp, Mus musculus
cattgccggccagctgaaggacgct

SEQ ID NO: 583032 - DNA, 25 bp, Mus musculus
cattgccggtcaaggccgaaaggac

SEQ ID NO: 583033 - DNA, 25 bp, Mus musculus
cattgccggtcatggccgaaaggac

SEQ ID NO: 583034 - DNA, 25 bp, Mus musculus
cattgccggttcaagctgagccaac

SEQ ID NO: 583035 - DNA, 25 bp, Mus musculus
cattgccggttctagctgagccaac

SEQ ID NO: 583036 - DNA, 25 bp, Mus musculus
cattgccgtaatccaggatatttag

SEQ ID NO: 583037 - DNA, 25 bp, Mus musculus
cattgccgtaatgcaggatatttag

SEQ ID NO: 583038 - DNA, 25 bp, Mus musculus
cattgcctagccagtgacatgctga

SEQ ID NO: 583039 - DNA, 25 bp, Mus musculus
cattgcctagcctgtgacatgctga

SEQ ID NO: 583040 - DNA, 25 bp, Mus musculus
cattgcctcccacacgatgaacaag

SEQ ID NO: 583041 - DNA, 25 bp, Mus musculus
cattgcctcccagacgatgaacaag

SEQ ID NO: 583042 - DNA, 25 bp, Mus musculus
cattgcctgagtcagagcatctacc

SEQ ID NO: 583043 - DNA, 25 bp, Mus musculus
cattgcctgagtgagagcatctacc

SEQ ID NO: 583044 - DNA, 25 bp, Mus musculus
cattgcctggatcaagtttgatgcc

SEQ ID NO: 583045 - DNA, 25 bp, Mus musculus
cattgcctggatgaagtttgatgcc

SEQ ID NO: 583046 - DNA, 25 bp, Mus musculus
cattgcctggctaaagaggttcttg

SEQ ID NO: 583047 - DNA, 25 bp, Mus musculus
cattgcctggcttaagaggttcttg

SEQ ID NO: 583048 - DNA, 25 bp, Mus musculus
cattgccttccgacatctcttcctg

SEQ ID NO: 583049 - DNA, 25 bp, Mus musculus
cattgccttccgtcatctcttcctg

SEQ ID NO: 583050 - DNA, 25 bp, Mus musculus
cattgccttgtgcattctgtcctgg

SEQ ID NO: 583051 - DNA, 25 bp, Mus musculus
cattgccttgtggattctgtcctgg

SEQ ID NO: 583052 - DNA, 25 bp, Mus musculus
cattgccttgttaggagtcatagcc

SEQ ID NO: 583053 - DNA, 25 bp, Mus musculus
cattgccttgtttggagtcatagcc

SEQ ID NO: 583054 - DNA, 25 bp, Mus musculus
cattgcgaaccacacaggcaggtca

SEQ ID NO: 583055 - DNA, 25 bp, Mus musculus
cattgcgaaccagacaggcaggtca

SEQ ID NO: 583056 - DNA, 25 bp, Mus musculus
cattgcgactaacatctgtgagacc

SEQ ID NO: 583057 - DNA, 25 bp, Mus musculus
cattgcgactaagatctgtgagacc

SEQ ID NO: 583058 - DNA, 25 bp, Mus musculus
cattgcgactggagatcattgataa

SEQ ID NO: 583059 - DNA, 25 bp, Mus musculus
cattgcgactggtgatcattgataa

SEQ ID NO: 583060 - DNA, 25 bp, Mus musculus
cattgcgagcacaaggagagatttc

SEQ ID NO: 583061 - DNA, 25 bp, Mus musculus
cattgcgagcactaggagagatttc

SEQ ID NO: 583062 - DNA, 25 bp, Mus musculus
cattgcgccggtacgttctctcgct

SEQ ID NO: 583063 - DNA, 25 bp, Mus musculus
cattgcgccggttcgttctctcgct

SEQ ID NO: 583064 - DNA, 25 bp, Mus musculus
cattgcgcgttgcttaactcccagg

SEQ ID NO: 583065 - DNA, 25 bp, Mus musculus
cattgcgcgttggttaactcccagg

SEQ ID NO: 583066 - DNA, 25 bp, Mus musculus
cattgcgggaaaaagacttcggtat

SEQ ID NO: 583067 - DNA, 25 bp, Mus musculus
cattgcgggaaatagacttcggtat

SEQ ID NO: 583068 - DNA, 25 bp, Mus musculus
cattgcgggacacttctatggccac

SEQ ID NO: 583069 - DNA, 25 bp, Mus musculus
cattgcgggacagttctatggccac

SEQ ID NO: 583070 - DNA, 25 bp, Mus musculus
cattgcggtgaaaccacatttgttt

SEQ ID NO: 583071 - DNA, 25 bp, Mus musculus
cattgcggtgaatccacatttgttt

SEQ ID NO: 583072 - DNA, 25 bp, Mus musculus
cattgcgtatttcctgcctgtggaa

SEQ ID NO: 583073 - DNA, 25 bp, Mus musculus
cattgcgtatttgctgcctgtggaa

SEQ ID NO: 583074 - DNA, 25 bp, Mus musculus
cattgcgtggagagtcctgtgtact

SEQ ID NO: 583075 - DNA, 25 bp, Mus musculus
cattgcgtggagtgtcctgtgtact

SEQ ID NO: 583076 - DNA, 25 bp, Mus musculus
cattgctaagaacaagcgctggaac

SEQ ID NO: 583077 - DNA, 25 bp, Mus musculus
cattgctaagaagaagcgctggaac

SEQ ID NO: 583078 - DNA, 25 bp, Mus musculus
cattgctaagcaactcacatatgaa

SEQ ID NO: 583079 - DNA, 25 bp, Mus musculus
cattgctaagcaccacacgtgcaga

SEQ ID NO: 583080 - DNA, 25 bp, Mus musculus
cattgctaagcagcacacgtgcaga

SEQ ID NO: 583081 - DNA, 25 bp, Mus musculus
cattgctaagcatctcacatatgaa

SEQ ID NO: 583082 - DNA, 25 bp, Mus musculus
cattgctaatcccaaagccgaggga

SEQ ID NO: 583083 - DNA, 25 bp, Mus musculus
cattgctaatccgaaagccgaggga

SEQ ID NO: 583084 - DNA, 25 bp, Mus musculus
cattgctactgtctccatctgtaag

SEQ ID NO: 583085 - DNA, 25 bp, Mus musculus
cattgctactgtgtccatctgtaag

SEQ ID NO: 583086 - DNA, 25 bp, Mus musculus
cattgctagctaaggcaaacggtgg

SEQ ID NO: 583087 - DNA, 25 bp, Mus musculus
cattgctagctatggcaaacggtgg

SEQ ID NO: 583088 - DNA, 25 bp, Mus musculus
cattgctatactcattgcaaacaag

SEQ ID NO: 583089 - DNA, 25 bp, Mus musculus
cattgctatactgattgcaaacaag

SEQ ID NO: 583090 - DNA, 25 bp, Mus musculus
cattgctatccaacgtggaatgccc

SEQ ID NO: 583091 - DNA, 25 bp, Mus musculus
cattgctatccatcgtggaatgccc

SEQ ID NO: 583092 - DNA, 25 bp, Mus musculus
cattgctatggcaacaaaagagaat

SEQ ID NO: 583093 - DNA, 25 bp, Mus musculus
cattgctatggctacaaaagagaat

SEQ ID NO: 583094 - DNA, 25 bp, Mus musculus
cattgctatttcactggagatccgc

SEQ ID NO: 583095 - DNA, 25 bp, Mus musculus
cattgctatttctctggagatccgc

SEQ ID NO: 583096 - DNA, 25 bp, Mus musculus
cattgctcaaaacaggaagcgagag

SEQ ID NO: 583097 - DNA, 25 bp, Mus musculus
cattgctcaaaagaggaagcgagag

SEQ ID NO: 583098 - DNA, 25 bp, Mus musculus
cattgctcaaggaaacaggaactct

SEQ ID NO: 583099 - DNA, 25 bp, Mus musculus
cattgctcaaggtaacaggaactct

SEQ ID NO: 583100 - DNA, 25 bp, Mus musculus
cattgctcagtaatggctgggctgc

SEQ ID NO: 583101 - DNA, 25 bp, Mus musculus
cattgctcagtattggctgggctgc

SEQ ID NO: 583102 - DNA, 25 bp, Mus musculus
cattgctccaggcaaagcctgtagc

SEQ ID NO: 583103 - DNA, 25 bp, Mus musculus
cattgctccagggaaagcctgtagc

SEQ ID NO: 583104 - DNA, 25 bp, Mus musculus
cattgctcgggaagctaaaattgag

SEQ ID NO: 583105 - DNA, 25 bp, Mus musculus
cattgctcgggatgctaaaattgag

SEQ ID NO: 583106 - DNA, 25 bp, Mus musculus
cattgctcgtgtaggacatttttga

SEQ ID NO: 583107 - DNA, 25 bp, Mus musculus
cattgctcgtgttggacatttttga

SEQ ID NO: 583108 - DNA, 25 bp, Mus musculus
cattgctgaactcaatgagacctgg

SEQ ID NO: 583109 - DNA, 25 bp, Mus musculus
cattgctgaactgaatgagacctgg

SEQ ID NO: 583110 - DNA, 25 bp, Mus musculus
cattgctgacgacaggtgtcgagcc

SEQ ID NO: 583111 - DNA, 25 bp, Mus musculus
cattgctgacgagaggtgtcgagcc

SEQ ID NO: 583112 - DNA, 25 bp, Mus musculus
cattgctgaggcaaagctactgcgc

SEQ ID NO: 583113 - DNA, 25 bp, Mus musculus
cattgctgaggctaagctactgcgc

SEQ ID NO: 583114 - DNA, 25 bp, Mus musculus
cattgctgagtcagatgaaatgagt

SEQ ID NO: 583115 - DNA, 25 bp, Mus musculus
cattgctgagtctgatgaaatgagt

SEQ ID NO: 583116 - DNA, 25 bp, Mus musculus
cattgctgagtgcacactcaaggag

SEQ ID NO: 583117 - DNA, 25 bp, Mus musculus
cattgctgagtggacactcaaggag

SEQ ID NO: 583118 - DNA, 25 bp, Mus musculus
cattgctgagttattactgttgctg

SEQ ID NO: 583119 - DNA, 25 bp, Mus musculus
cattgctgagtttttactgttgctg

SEQ ID NO: 583120 - DNA, 25 bp, Mus musculus
cattgctgataaaggaggtattggc

SEQ ID NO: 583121 - DNA, 25 bp, Mus musculus
cattgctgataatggaggtattggc

SEQ ID NO: 583122 - DNA, 25 bp, Mus musculus
cattgctgatgtactcgctgccctg

SEQ ID NO: 583123 - DNA, 25 bp, Mus musculus
cattgctgatgttctcgctgccctg

SEQ ID NO: 583124 - DNA, 25 bp, Mus musculus
cattgctgcagtatactagatctcc

SEQ ID NO: 583125 - DNA, 25 bp, Mus musculus
cattgctgcagtttactagatctcc

SEQ ID NO: 583126 - DNA, 25 bp, Mus musculus
cattgctgccaaaatggataccgtg

SEQ ID NO: 583127 - DNA, 25 bp, Mus musculus
cattgctgccaaagtgtgtgcctgc

SEQ ID NO: 583128 - DNA, 25 bp, Mus musculus
cattgctgccaatatggataccgtg

SEQ ID NO: 583129 - DNA, 25 bp, Mus musculus
cattgctgccaatgtgtgtgcctgc

SEQ ID NO: 583130 - DNA, 25 bp, Mus musculus
cattgctgcgcacgtagactgtaca

SEQ ID NO: 583131 - DNA, 25 bp, Mus musculus
cattgctgcgcaggtagactgtaca

SEQ ID NO: 583132 - DNA, 25 bp, Mus musculus
cattgctgctccaggtgtgccagga

SEQ ID NO: 583133 - DNA, 25 bp, Mus musculus
cattgctgctcctggtgtgccagga

SEQ ID NO: 583134 - DNA, 25 bp, Mus musculus
cattgctggagtcgcatttggaatt

SEQ ID NO: 583135 - DNA, 25 bp, Mus musculus
cattgctggagtggcatttggaatt

SEQ ID NO: 583136 - DNA, 25 bp, Mus musculus
cattgctggcatcctggcctatgtc

SEQ ID NO: 583137 - DNA, 25 bp, Mus musculus
cattgctggcatgctggcctatgtc

SEQ ID NO: 583138 - DNA, 25 bp, Mus musculus
cattgctggcccatctctctctggc

SEQ ID NO: 583139 - DNA, 25 bp, Mus musculus
cattgctggcccttctctctctggc

SEQ ID NO: 583140 - DNA, 25 bp, Mus musculus
cattgctggcgtacagagcctagga

SEQ ID NO: 583141 - DNA, 25 bp, Mus musculus
cattgctggcgttcagagcctagga

SEQ ID NO: 583142 - DNA, 25 bp, Mus musculus
cattgctggcttcgtgaaggtgaaa

SEQ ID NO: 583143 - DNA, 25 bp, Mus musculus
cattgctggcttggtgaaggtgaaa

SEQ ID NO: 583144 - DNA, 25 bp, Mus musculus
cattgctgtacacagagagcgaggc

SEQ ID NO: 583145 - DNA, 25 bp, Mus musculus
cattgctgtacagagagagcgaggc

SEQ ID NO: 583146 - DNA, 25 bp, Mus musculus
cattgctgtgggagccgatgctgcc

SEQ ID NO: 583147 - DNA, 25 bp, Mus musculus
cattgctgtgggagtcttccttctc

SEQ ID NO: 583148 - DNA, 25 bp, Mus musculus
cattgctgtgggtgccgatgctgcc

SEQ ID NO: 583149 - DNA, 25 bp, Mus musculus
cattgctgtgggtgtcttccttctc

SEQ ID NO: 583150 - DNA, 25 bp, Mus musculus
cattgcttaagcaggaactggccat

SEQ ID NO: 583151 - DNA, 25 bp, Mus musculus
cattgcttaagctggaactggccat

SEQ ID NO: 583152 - DNA, 25 bp, Mus musculus
cattgcttcaggaatctgctacacc

SEQ ID NO: 583153 - DNA, 25 bp, Mus musculus
cattgcttcaggtatctgctacacc

SEQ ID NO: 583154 - DNA, 25 bp, Mus musculus
cattgcttccatcttgcttgctgac

SEQ ID NO: 583155 - DNA, 25 bp, Mus musculus
cattgcttccatgttgcttgctgac

SEQ ID NO: 583156 - DNA, 25 bp, Mus musculus
cattgcttctggaaaccctggacct

SEQ ID NO: 583157 - DNA, 25 bp, Mus musculus
cattgcttctggtaaccctggacct

SEQ ID NO: 583158 - DNA, 25 bp, Mus musculus
cattgcttctttccaaaaggagatc

SEQ ID NO: 583159 - DNA, 25 bp, Mus musculus
cattgcttctttgcaaaaggagatc

SEQ ID NO: 583160 - DNA, 25 bp, Mus musculus
cattgcttggcacgtatcagccgct

SEQ ID NO: 583161 - DNA, 25 bp, Mus musculus
cattgcttggcaggtatcagccgct

SEQ ID NO: 583162 - DNA, 25 bp, Mus musculus
cattgcttgttcacaggatgggaat

SEQ ID NO: 583163 - DNA, 25 bp, Mus musculus
cattgcttgttctcaggatgggaat

SEQ ID NO: 583164 - DNA, 25 bp, Mus musculus
cattgctttatcaggtagggatatc

SEQ ID NO: 583165 - DNA, 25 bp, Mus musculus
cattgctttatctggtagggatatc

SEQ ID NO: 583166 - DNA, 25 bp, Mus musculus
cattgctttcaaatcttctacccca

SEQ ID NO: 583167 - DNA, 25 bp, Mus musculus
cattgctttcaattcttctacccca

SEQ ID NO: 583168 - DNA, 25 bp, Mus musculus
cattgctttttccatatatgtgggc

SEQ ID NO: 583169 - DNA, 25 bp, Mus musculus
cattgctttttcgatatatgtgggc

SEQ ID NO: 583170 - DNA, 25 bp, Mus musculus
cattggaaaagcatctggccgggct

SEQ ID NO: 583171 - DNA, 25 bp, Mus musculus
cattggaaaagcttctggccgggct

SEQ ID NO: 583172 - DNA, 25 bp, Mus musculus
cattggaaacccaagcttggagctt

SEQ ID NO: 583173 - DNA, 25 bp, Mus musculus
cattggaaaccctagcttggagctt

SEQ ID NO: 583174 - DNA, 25 bp, Mus musculus
cattggaaacggagactgagacaga

SEQ ID NO: 583175 - DNA, 25 bp, Mus musculus
cattggaaacggtgactgagacaga

SEQ ID NO: 583176 - DNA, 25 bp, Mus musculus
cattggaaactgattgacatcatgg

SEQ ID NO: 583177 - DNA, 25 bp, Mus musculus
cattggaaactgtttgacatcatgg

SEQ ID NO: 583178 - DNA, 25 bp, Mus musculus
cattggaaagaactgcccgactgtt

SEQ ID NO: 583179 - DNA, 25 bp, Mus musculus
cattggaaagaagtgcccgactgtt

SEQ ID NO: 583180 - DNA, 25 bp, Mus musculus
cattggaaaggcagataagcttgct

SEQ ID NO: 583181 - DNA, 25 bp, Mus musculus
cattggaaaggctgataagcttgct

SEQ ID NO: 583182 - DNA, 25 bp, Mus musculus
cattggaaccgtagtggtagcttgg

SEQ ID NO: 583183 - DNA, 25 bp, Mus musculus
cattggaaccgttgtggtagcttgg

SEQ ID NO: 583184 - DNA, 25 bp, Mus musculus
cattggaagtttagaggcggctgac

SEQ ID NO: 583185 - DNA, 25 bp, Mus musculus
cattggaagttttgaggcggctgac

SEQ ID NO: 583186 - DNA, 25 bp, Mus musculus
cattggaatattaagcccgggagtg

SEQ ID NO: 583187 - DNA, 25 bp, Mus musculus
cattggaatattcccaagtccatgg

SEQ ID NO: 583188 - DNA, 25 bp, Mus musculus
cattggaatattgccaagtccatgg

SEQ ID NO: 583189 - DNA, 25 bp, Mus musculus
cattggaatatttagcccgggagtg

SEQ ID NO: 583190 - DNA, 25 bp, Mus musculus
cattggaatcatctttaaacatggt

SEQ ID NO: 583191 - DNA, 25 bp, Mus musculus
cattggaatcatgtttaaacatggt

SEQ ID NO: 583192 - DNA, 25 bp, Mus musculus
cattggaattatcgtgatgctggtc

SEQ ID NO: 583193 - DNA, 25 bp, Mus musculus
cattggaattatggtgatgctggtc

SEQ ID NO: 583194 - DNA, 25 bp, Mus musculus
cattggaattcacgagggctgctct

SEQ ID NO: 583195 - DNA, 25 bp, Mus musculus
cattggaattcaggagggctgctct

SEQ ID NO: 583196 - DNA, 25 bp, Mus musculus
cattggaattgtcacgatcctcatg

SEQ ID NO: 583197 - DNA, 25 bp, Mus musculus
cattggaattgtgacgatcctcatg

SEQ ID NO: 583198 - DNA, 25 bp, Mus musculus
cattggacaaagcaagctagaggag

SEQ ID NO: 583199 - DNA, 25 bp, Mus musculus
cattggacaaaggaagctagaggag

SEQ ID NO: 583200 - DNA, 25 bp, Mus musculus
cattggacacagattttatagcagc

SEQ ID NO: 583201 - DNA, 25 bp, Mus musculus
cattggacacagtttttatagcagc

SEQ ID NO: 583202 - DNA, 25 bp, Mus musculus
cattggacatgaaatcacacatgga

SEQ ID NO: 583203 - DNA, 25 bp, Mus musculus
cattggacatgatatcacacatgga

SEQ ID NO: 583204 - DNA, 25 bp, Mus musculus
cattggacctatcttggcttctcga

SEQ ID NO: 583205 - DNA, 25 bp, Mus musculus
cattggacctatgttggcttctcga

SEQ ID NO: 583206 - DNA, 25 bp, Mus musculus
cattggacctcaaaatcagtgaaga

SEQ ID NO: 583207 - DNA, 25 bp, Mus musculus
cattggacctcataatcagtgaaga

SEQ ID NO: 583208 - DNA, 25 bp, Mus musculus
cattggacctggacttgtgctctcc

SEQ ID NO: 583209 - DNA, 25 bp, Mus musculus
cattggacctggtcttgtgctctcc

SEQ ID NO: 583210 - DNA, 25 bp, Mus musculus
cattggactagactgctaccaggac

SEQ ID NO: 583211 - DNA, 25 bp, Mus musculus
cattggactagagtgctaccaggac

SEQ ID NO: 583212 - DNA, 25 bp, Mus musculus
cattggagatgcagttgtgatatcc

SEQ ID NO: 583213 - DNA, 25 bp, Mus musculus
cattggagatgctgttgtgatatcc

SEQ ID NO: 583214 - DNA, 25 bp, Mus musculus
cattggagcagaactccgagacctt

SEQ ID NO: 583215 - DNA, 25 bp, Mus musculus
cattggagcagatctccgagacctt

SEQ ID NO: 583216 - DNA, 25 bp, Mus musculus
cattggagccccagtgctaggaagc

SEQ ID NO: 583217 - DNA, 25 bp, Mus musculus
cattggagcccctgtgctaggaagc

SEQ ID NO: 583218 - DNA, 25 bp, Mus musculus
cattggagggatagtggctttcatt

SEQ ID NO: 583219 - DNA, 25 bp, Mus musculus
cattggagggattgtggctttcatt

SEQ ID NO: 583220 - DNA, 25 bp, Mus musculus
cattggagggcgagctccatgacct

SEQ ID NO: 583221 - DNA, 25 bp, Mus musculus
cattggagggcgtgctccatgacct

SEQ ID NO: 583222 - DNA, 25 bp, Mus musculus
cattggaggtccaggctccagcttt

SEQ ID NO: 583223 - DNA, 25 bp, Mus musculus
cattggaggtcctggctccagcttt

SEQ ID NO: 583224 - DNA, 25 bp, Mus musculus
cattggagtgtcagtggccttcatc

SEQ ID NO: 583225 - DNA, 25 bp, Mus musculus
cattggagtgtctgtggccttcatc

SEQ ID NO: 583226 - DNA, 25 bp, Mus musculus
cattggagttaacaagaggaaagct

SEQ ID NO: 583227 - DNA, 25 bp, Mus musculus
cattggagttaagaagaggaaagct

SEQ ID NO: 583228 - DNA, 25 bp, Mus musculus
cattggatacttaggtctatgaggc

SEQ ID NO: 583229 - DNA, 25 bp, Mus musculus
cattggatactttggtctatgaggc

SEQ ID NO: 583230 - DNA, 25 bp, Mus musculus
cattggatccgtccggtaccgagtc

SEQ ID NO: 583231 - DNA, 25 bp, Mus musculus
cattggatccgtgcggtaccgagtc

SEQ ID NO: 583232 - DNA, 25 bp, Mus musculus
cattggatcgtacacagtgagggct

SEQ ID NO: 583233 - DNA, 25 bp, Mus musculus
cattggatcgtagacagtgagggct

SEQ ID NO: 583234 - DNA, 25 bp, Mus musculus
cattggatgtggacacgctcactgg

SEQ ID NO: 583235 - DNA, 25 bp, Mus musculus
cattggatgtggtcacgctcactgg

SEQ ID NO: 583236 - DNA, 25 bp, Mus musculus
cattggattccccagtgagatcatc

SEQ ID NO: 583237 - DNA, 25 bp, Mus musculus
cattggattcccgagtgagatcatc

SEQ ID NO: 583238 - DNA, 25 bp, Mus musculus
cattggatttgcagaaagagcttaa

SEQ ID NO: 583239 - DNA, 25 bp, Mus musculus
cattggatttgctgaaagagcttaa

SEQ ID NO: 583240 - DNA, 25 bp, Mus musculus
cattggatttggagactacgtggca

SEQ ID NO: 583241 - DNA, 25 bp, Mus musculus
cattggatttggtgactacgtggca

SEQ ID NO: 583242 - DNA, 25 bp, Mus musculus
cattggcaaaggacggtttggagaa

SEQ ID NO: 583243 - DNA, 25 bp, Mus musculus
cattggcaaaggcaactacgggaag

SEQ ID NO: 583244 - DNA, 25 bp, Mus musculus
cattggcaaagggaactacgggaag

SEQ ID NO: 583245 - DNA, 25 bp, Mus musculus
cattggcaaaggtcggtttggagaa

SEQ ID NO: 583246 - DNA, 25 bp, Mus musculus
cattggcaaggcaggcgccatgaca

SEQ ID NO: 583247 - DNA, 25 bp, Mus musculus
cattggcaaggctggcgccatgaca

SEQ ID NO: 583248 - DNA, 25 bp, Mus musculus
cattggcacagcctatgccgtactc

SEQ ID NO: 583249 - DNA, 25 bp, Mus musculus
cattggcacagcgtatgccgtactc

SEQ ID NO: 583250 - DNA, 25 bp, Mus musculus
cattggcacattccacctggcaagg

SEQ ID NO: 583251 - DNA, 25 bp, Mus musculus
cattggcacattgcacctggcaagg

SEQ ID NO: 583252 - DNA, 25 bp, Mus musculus
cattggcacgggagattaaaagcat

SEQ ID NO: 583253 - DNA, 25 bp, Mus musculus
cattggcacgggtgattaaaagcat

SEQ ID NO: 583254 - DNA, 25 bp, Mus musculus
cattggcagagaatcgggcactgct

SEQ ID NO: 583255 - DNA, 25 bp, Mus musculus
cattggcagagattcgggcactgct

SEQ ID NO: 583256 - DNA, 25 bp, Mus musculus
cattggcatcagagagatatttgca

SEQ ID NO: 583257 - DNA, 25 bp, Mus musculus
cattggcatcagtgagatatttgca

SEQ ID NO: 583258 - DNA, 25 bp, Mus musculus
cattggcatgctcgcctggccatct

SEQ ID NO: 583259 - DNA, 25 bp, Mus musculus
cattggcatgctggcctggccatct

SEQ ID NO: 583260 - DNA, 25 bp, Mus musculus
cattggcattccaattgctgtgcct

SEQ ID NO: 583261 - DNA, 25 bp, Mus musculus
cattggcattcctattgctgtgcct

SEQ ID NO: 583262 - DNA, 25 bp, Mus musculus
cattggccaaaacccaggaattgct

SEQ ID NO: 583263 - DNA, 25 bp, Mus musculus
cattggccaaaagccaggaattgct

SEQ ID NO: 583264 - DNA, 25 bp, Mus musculus
cattggccaaagaatgatcagaaag

SEQ ID NO: 583265 - DNA, 25 bp, Mus musculus
cattggccaaagtatgatcagaaag

SEQ ID NO: 583266 - DNA, 25 bp, Mus musculus
cattggccaagccttaggctgcatg

SEQ ID NO: 583267 - DNA, 25 bp, Mus musculus
cattggccaagcgttaggctgcatg

SEQ ID NO: 583268 - DNA, 25 bp, Mus musculus
cattggccagagcacaccatttcga

SEQ ID NO: 583269 - DNA, 25 bp, Mus musculus
cattggccagaggacaccatttcga

SEQ ID NO: 583270 - DNA, 25 bp, Mus musculus
cattggccaggtcgttttggacaac

SEQ ID NO: 583271 - DNA, 25 bp, Mus musculus
cattggccaggtggttttggacaac

SEQ ID NO: 583272 - DNA, 25 bp, Mus musculus
cattggccatgcaggctatgttcca

SEQ ID NO: 583273 - DNA, 25 bp, Mus musculus
cattggccatgctggctatgttcca

SEQ ID NO: 583274 - DNA, 25 bp, Mus musculus
cattggccgtgacatccggaagaaa

SEQ ID NO: 583275 - DNA, 25 bp, Mus musculus
cattggccgtgagatccggaagaaa

SEQ ID NO: 583276 - DNA, 25 bp, Mus musculus
cattggccgtggaaatgaccaggta

SEQ ID NO: 583277 - DNA, 25 bp, Mus musculus
cattggccgtggtaatgaccaggta

SEQ ID NO: 583278 - DNA, 25 bp, Mus musculus
cattggcctgcacgtccggagtttg

SEQ ID NO: 583279 - DNA, 25 bp, Mus musculus
cattggcctgcaggtccggagtttg

SEQ ID NO: 583280 - DNA, 25 bp, Mus musculus
cattggcctggacattaagctctgc

SEQ ID NO: 583281 - DNA, 25 bp, Mus musculus
cattggcctggagattaagctctgc

SEQ ID NO: 583282 - DNA, 25 bp, Mus musculus
cattggcgccttaacagagttcaca

SEQ ID NO: 583283 - DNA, 25 bp, Mus musculus
cattggcgcctttacagagttcaca

SEQ ID NO: 583284 - DNA, 25 bp, Mus musculus
cattggcgctgaaaatgaactaggg

SEQ ID NO: 583285 - DNA, 25 bp, Mus musculus
cattggcgctgataatgaactaggg

SEQ ID NO: 583286 - DNA, 25 bp, Mus musculus
cattggcggaggatagtctgtaatc

SEQ ID NO: 583287 - DNA, 25 bp, Mus musculus
cattggcggaggttagtctgtaatc

SEQ ID NO: 583288 - DNA, 25 bp, Mus musculus
cattggcggcctcaaaccatttacc

SEQ ID NO: 583289 - DNA, 25 bp, Mus musculus
cattggcggcctgaaaccatttacc

SEQ ID NO: 583290 - DNA, 25 bp, Mus musculus
cattggcggtgtcctcctcgatttt

SEQ ID NO: 583291 - DNA, 25 bp, Mus musculus
cattggcggtgtgctcctcgatttt

SEQ ID NO: 583292 - DNA, 25 bp, Mus musculus
cattggcgtcacaattttatctcag

SEQ ID NO: 583293 - DNA, 25 bp, Mus musculus
cattggcgtcactattttatctcag

SEQ ID NO: 583294 - DNA, 25 bp, Mus musculus
cattggcgtgtactgtcttagtgtc

SEQ ID NO: 583295 - DNA, 25 bp, Mus musculus
cattggcgtgtagtgtcttagtgtc

SEQ ID NO: 583296 - DNA, 25 bp, Mus musculus
cattggctaaagagaagacttggaa

SEQ ID NO: 583297 - DNA, 25 bp, Mus musculus
cattggctaaagagaggcagaaaaa

SEQ ID NO: 583298 - DNA, 25 bp, Mus musculus
cattggctaaagtgaagacttggaa

SEQ ID NO: 583299 - DNA, 25 bp, Mus musculus
cattggctaaagtgaggcagaaaaa

SEQ ID NO: 583300 - DNA, 25 bp, Mus musculus
cattggctaagcatcgaaggctgcc

SEQ ID NO: 583301 - DNA, 25 bp, Mus musculus
cattggctaagcttcgaaggctgcc

SEQ ID NO: 583302 - DNA, 25 bp, Mus musculus
cattggctacttcaagagcaaagac

SEQ ID NO: 583303 - DNA, 25 bp, Mus musculus
cattggctacttgaagagcaaagac

SEQ ID NO: 583304 - DNA, 25 bp, Mus musculus
cattggctagtgctgggcactcata

SEQ ID NO: 583305 - DNA, 25 bp, Mus musculus
cattggctagtggtgggcactcata

SEQ ID NO: 583306 - DNA, 25 bp, Mus musculus
cattggctcctcctacatctggcgg

SEQ ID NO: 583307 - DNA, 25 bp, Mus musculus
cattggctcctcgtacatctggcgg

SEQ ID NO: 583308 - DNA, 25 bp, Mus musculus
cattggctctctcatggacgactac

SEQ ID NO: 583309 - DNA, 25 bp, Mus musculus
cattggctctctgatggacgactac

SEQ ID NO: 583310 - DNA, 25 bp, Mus musculus
cattggctctgccacggacatctgg

SEQ ID NO: 583311 - DNA, 25 bp, Mus musculus
cattggctctgcgacggacatctgg

SEQ ID NO: 583312 - DNA, 25 bp, Mus musculus
cattggctcttgaggctgtggcagc

SEQ ID NO: 583313 - DNA, 25 bp, Mus musculus
cattggctcttgtggctgtggcagc

SEQ ID NO: 583314 - DNA, 25 bp, Mus musculus
cattggctgtctcaaaaggtgtggc

SEQ ID NO: 583315 - DNA, 25 bp, Mus musculus
cattggctgtctgaaaaggtgtggc

SEQ ID NO: 583316 - DNA, 25 bp, Mus musculus
cattggcttcaacaaggtcacccta

SEQ ID NO: 583317 - DNA, 25 bp, Mus musculus
cattggcttcaagaaggtcacccta

SEQ ID NO: 583318 - DNA, 25 bp, Mus musculus
cattggcttccaacgagttgtggaa

SEQ ID NO: 583319 - DNA, 25 bp, Mus musculus
cattggcttccatcgagttgtggaa

SEQ ID NO: 583320 - DNA, 25 bp, Mus musculus
cattggcttcctcgtactcgcatgg

SEQ ID NO: 583321 - DNA, 25 bp, Mus musculus
cattggcttcctggtactcgcatgg

SEQ ID NO: 583322 - DNA, 25 bp, Mus musculus
cattggcttcgtcttcgtggtgagc

SEQ ID NO: 583323 - DNA, 25 bp, Mus musculus
cattggcttcgtgttcgtggtgagc

SEQ ID NO: 583324 - DNA, 25 bp, Mus musculus
cattggcttgacagaagaattttgt

SEQ ID NO: 583325 - DNA, 25 bp, Mus musculus
cattggcttgactgaagaattttgt

SEQ ID NO: 583326 - DNA, 25 bp, Mus musculus
cattgggaacgtatcatgtgcaacc

SEQ ID NO: 583327 - DNA, 25 bp, Mus musculus
cattgggaacgtttcatgtgcaacc

SEQ ID NO: 583328 - DNA, 25 bp, Mus musculus
cattgggaatgaatctgaggtggca

SEQ ID NO: 583329 - DNA, 25 bp, Mus musculus
cattgggaatgattctgaggtggca

SEQ ID NO: 583330 - DNA, 25 bp, Mus musculus
cattgggaatgtccaagttcttcta

SEQ ID NO: 583331 - DNA, 25 bp, Mus musculus
cattgggaatgtgcaagttcttcta

SEQ ID NO: 583332 - DNA, 25 bp, Mus musculus
cattgggatatccaagcactgctta

SEQ ID NO: 583333 - DNA, 25 bp, Mus musculus
cattgggatatcgaagcactgctta

SEQ ID NO: 583334 - DNA, 25 bp, Mus musculus
cattgggatcctcctttctcgggtg

SEQ ID NO: 583335 - DNA, 25 bp, Mus musculus
cattgggatcctgctttctcgggtg

SEQ ID NO: 583336 - DNA, 25 bp, Mus musculus
cattgggattacctcattgttcatt

SEQ ID NO: 583337 - DNA, 25 bp, Mus musculus
cattgggattacgtcattgttcatt

SEQ ID NO: 583338 - DNA, 25 bp, Mus musculus
cattgggcaacacaacataatcatc

SEQ ID NO: 583339 - DNA, 25 bp, Mus musculus
cattgggcaacagaacataatcatc

SEQ ID NO: 583340 - DNA, 25 bp, Mus musculus
cattgggcccgcaaggacaaggcct

SEQ ID NO: 583341 - DNA, 25 bp, Mus musculus
cattgggcccgctaggacaaggcct

SEQ ID NO: 583342 - DNA, 25 bp, Mus musculus
cattgggcctgtatcaatgaacgtg

SEQ ID NO: 583343 - DNA, 25 bp, Mus musculus
cattgggcctgtttcaatgaacgtg

SEQ ID NO: 583344 - DNA, 25 bp, Mus musculus
cattgggcgtccacggtggaaactt

SEQ ID NO: 583345 - DNA, 25 bp, Mus musculus
cattgggcgtcctcggtggaaactt

SEQ ID NO: 583346 - DNA, 25 bp, Mus musculus
cattgggtccttagtgggctcagga

SEQ ID NO: 583347 - DNA, 25 bp, Mus musculus
cattgggtcctttgtgggctcagga

SEQ ID NO: 583348 - DNA, 25 bp, Mus musculus
cattgggtctccagttgctggcctt

SEQ ID NO: 583349 - DNA, 25 bp, Mus musculus
cattgggtctcctgttgctggcctt

SEQ ID NO: 583350 - DNA, 25 bp, Mus musculus
cattgggtgagcctcctggcttcct

SEQ ID NO: 583351 - DNA, 25 bp, Mus musculus
cattgggtgagcgtcctggcttcct

SEQ ID NO: 583352 - DNA, 25 bp, Mus musculus
cattgggtgagtactgcagagtcac

SEQ ID NO: 583353 - DNA, 25 bp, Mus musculus
cattgggtgagttctgcagagtcac

SEQ ID NO: 583354 - DNA, 25 bp, Mus musculus
cattgggtgatcattttattgagat

SEQ ID NO: 583355 - DNA, 25 bp, Mus musculus
cattgggtgatctttttattgagat

SEQ ID NO: 583356 - DNA, 25 bp, Mus musculus
cattgggttccacacaaagatgact

SEQ ID NO: 583357 - DNA, 25 bp, Mus musculus
cattgggttccagacaaagatgact

SEQ ID NO: 583358 - DNA, 25 bp, Mus musculus
cattgggttgttccctgctgtgact

SEQ ID NO: 583359 - DNA, 25 bp, Mus musculus
cattgggttgttgcctgctgtgact

SEQ ID NO: 583360 - DNA, 25 bp, Mus musculus
cattggtaacggcaacaagatgacc

SEQ ID NO: 583361 - DNA, 25 bp, Mus musculus
cattggtaacgggaacaagatgacc

SEQ ID NO: 583362 - DNA, 25 bp, Mus musculus
cattggtactgcacaggctaataag

SEQ ID NO: 583363 - DNA, 25 bp, Mus musculus
cattggtactgctcaggctaataag

SEQ ID NO: 583364 - DNA, 25 bp, Mus musculus
cattggtcaaccacgaaagacaaca

SEQ ID NO: 583365 - DNA, 25 bp, Mus musculus
cattggtcaacctcgaaagacaaca

SEQ ID NO: 583366 - DNA, 25 bp, Mus musculus
cattggtcctggacatcagccgcta

SEQ ID NO: 583367 - DNA, 25 bp, Mus musculus
cattggtcctggtcatcagccgcta

SEQ ID NO: 583368 - DNA, 25 bp, Mus musculus
cattggtcgggaagtgtctgctcag

SEQ ID NO: 583369 - DNA, 25 bp, Mus musculus
cattggtcgggatgtgtctgctcag

SEQ ID NO: 583370 - DNA, 25 bp, Mus musculus
cattggtcgtctcgtgctgcgagtc

SEQ ID NO: 583371 - DNA, 25 bp, Mus musculus
cattggtcgtctggtgctgcgagtc

SEQ ID NO: 583372 - DNA, 25 bp, Mus musculus
cattggtcgttcagccccaagaggt

SEQ ID NO: 583373 - DNA, 25 bp, Mus musculus
cattggtcgttctgccccaagaggt

SEQ ID NO: 583374 - DNA, 25 bp, Mus musculus
cattggtctggtacagggcctccgg

SEQ ID NO: 583375 - DNA, 25 bp, Mus musculus
cattggtctggtcggccatttgcac

SEQ ID NO: 583376 - DNA, 25 bp, Mus musculus
cattggtctggtgggccatttgcac

SEQ ID NO: 583377 - DNA, 25 bp, Mus musculus
cattggtctggttcagggcctccgg

SEQ ID NO: 583378 - DNA, 25 bp, Mus musculus
cattggtgacgaagtgactcagctc

SEQ ID NO: 583379 - DNA, 25 bp, Mus musculus
cattggtgacgatgtgactcagctc

SEQ ID NO: 583380 - DNA, 25 bp, Mus musculus
cattggtgagaccaggttctcgctc

SEQ ID NO: 583381 - DNA, 25 bp, Mus musculus
cattggtgagacgaggttctcgctc

SEQ ID NO: 583382 - DNA, 25 bp, Mus musculus
cattggtgagagagcatggagcttt

SEQ ID NO: 583383 - DNA, 25 bp, Mus musculus
cattggtgagagtgcatggagcttt

SEQ ID NO: 583384 - DNA, 25 bp, Mus musculus
cattggtgccacagtccatgagctt

SEQ ID NO: 583385 - DNA, 25 bp, Mus musculus
cattggtgccactgtccatgagctt

SEQ ID NO: 583386 - DNA, 25 bp, Mus musculus
cattggtgccagagaacagggtgac

SEQ ID NO: 583387 - DNA, 25 bp, Mus musculus
cattggtgccagtgaacagggtgac

SEQ ID NO: 583388 - DNA, 25 bp, Mus musculus
cattggtgccctcgtaatatacttc

SEQ ID NO: 583389 - DNA, 25 bp, Mus musculus
cattggtgccctggtaatatacttc

SEQ ID NO: 583390 - DNA, 25 bp, Mus musculus
cattggtgctagaatccttacaata

SEQ ID NO: 583391 - DNA, 25 bp, Mus musculus
cattggtgctagtatccttacaata

SEQ ID NO: 583392 - DNA, 25 bp, Mus musculus
cattggtggcaaatggcttcctgaa

SEQ ID NO: 583393 - DNA, 25 bp, Mus musculus
cattggtggcaattggcttcctgaa

SEQ ID NO: 583394 - DNA, 25 bp, Mus musculus
cattggtggtcaaatgggattgttc

SEQ ID NO: 583395 - DNA, 25 bp, Mus musculus
cattggtggtcatatgggattgttc

SEQ ID NO: 583396 - DNA, 25 bp, Mus musculus
cattggtggtgtcattagtaggttc

SEQ ID NO: 583397 - DNA, 25 bp, Mus musculus
cattggtggtgtgattagtaggttc

SEQ ID NO: 583398 - DNA, 25 bp, Mus musculus
cattggtgtcacaggtatcaaagca

SEQ ID NO: 583399 - DNA, 25 bp, Mus musculus
cattggtgtcactggtatcaaagca

SEQ ID NO: 583400 - DNA, 25 bp, Mus musculus
cattggtgtccaagaacttgcggca

SEQ ID NO: 583401 - DNA, 25 bp, Mus musculus
cattggtgtccatgaacttgcggca

SEQ ID NO: 583402 - DNA, 25 bp, Mus musculus
cattggtgtcctcccctgtggatcg

SEQ ID NO: 583403 - DNA, 25 bp, Mus musculus
cattggtgtcctgccctgtggatcg

SEQ ID NO: 583404 - DNA, 25 bp, Mus musculus
cattggtgtgttcctcagcaagcgg

SEQ ID NO: 583405 - DNA, 25 bp, Mus musculus
cattggtgtgttgctcagcaagcgg

SEQ ID NO: 583406 - DNA, 25 bp, Mus musculus
cattggtgttaccttcacctcagaa

SEQ ID NO: 583407 - DNA, 25 bp, Mus musculus
cattggtgttacgttcacctcagaa

SEQ ID NO: 583408 - DNA, 25 bp, Mus musculus
cattggttcaacctagacaggacag

SEQ ID NO: 583409 - DNA, 25 bp, Mus musculus
cattggttcaacgtagacaggacag

SEQ ID NO: 583410 - DNA, 25 bp, Mus musculus
cattggtttgttacagaggttgctc

SEQ ID NO: 583411 - DNA, 25 bp, Mus musculus
cattggtttgtttcagaggttgctc

SEQ ID NO: 583412 - DNA, 25 bp, Mus musculus
cattgtaaaagcactcgtcactgtg

SEQ ID NO: 583413 - DNA, 25 bp, Mus musculus
cattgtaaaagctctcgtcactgtg

SEQ ID NO: 583414 - DNA, 25 bp, Mus musculus
cattgtaaacggaggtggcatccgg

SEQ ID NO: 583415 - DNA, 25 bp, Mus musculus
cattgtaaacggtggtggcatccgg

SEQ ID NO: 583416 - DNA, 25 bp, Mus musculus
cattgtaagcaacagcggtgggtca

SEQ ID NO: 583417 - DNA, 25 bp, Mus musculus
cattgtaagcaagagcggtgggtca

SEQ ID NO: 583418 - DNA, 25 bp, Mus musculus
cattgtaataaactagagacgcttc

SEQ ID NO: 583419 - DNA, 25 bp, Mus musculus
cattgtaataaagtagagacgcttc

SEQ ID NO: 583420 - DNA, 25 bp, Mus musculus
cattgtaatggccttgactggcgtc

SEQ ID NO: 583421 - DNA, 25 bp, Mus musculus
cattgtaatggcgttgactggcgtc

SEQ ID NO: 583422 - DNA, 25 bp, Mus musculus
cattgtaattggcattgggaattct

SEQ ID NO: 583423 - DNA, 25 bp, Mus musculus
cattgtaattgggattgggaattct

SEQ ID NO: 583424 - DNA, 25 bp, Mus musculus
cattgtacaggccaagatctcatcc

SEQ ID NO: 583425 - DNA, 25 bp, Mus musculus
cattgtacaggcgaagatctcatcc

SEQ ID NO: 583426 - DNA, 25 bp, Mus musculus
cattgtactagaatccgtggttgac

SEQ ID NO: 583427 - DNA, 25 bp, Mus musculus
cattgtactagattccgtggttgac

SEQ ID NO: 583428 - DNA, 25 bp, Mus musculus
cattgtactgtcacagcacctgggc

SEQ ID NO: 583429 - DNA, 25 bp, Mus musculus
cattgtactgtctcagcacctgggc

SEQ ID NO: 583430 - DNA, 25 bp, Mus musculus
cattgtacttctagtggccgcggga

SEQ ID NO: 583431 - DNA, 25 bp, Mus musculus
cattgtacttcttgtggccgcggga

SEQ ID NO: 583432 - DNA, 25 bp, Mus musculus
cattgtagatgaagcttatggcttc

SEQ ID NO: 583433 - DNA, 25 bp, Mus musculus
cattgtagatgaattgaagcaagaa

SEQ ID NO: 583434 - DNA, 25 bp, Mus musculus
cattgtagatgatgcttatggcttc

SEQ ID NO: 583435 - DNA, 25 bp, Mus musculus
cattgtagatgatttgaagcaagaa

SEQ ID NO: 583436 - DNA, 25 bp, Mus musculus
cattgtagctatcgtaatagctggc

SEQ ID NO: 583437 - DNA, 25 bp, Mus musculus
cattgtagctatggtaatagctggc

SEQ ID NO: 583438 - DNA, 25 bp, Mus musculus
cattgtaggagcaagcttctggagt

SEQ ID NO: 583439 - DNA, 25 bp, Mus musculus
cattgtaggagctagcttctggagt

SEQ ID NO: 583440 - DNA, 25 bp, Mus musculus
cattgtagttggcagtgactcaggc

SEQ ID NO: 583441 - DNA, 25 bp, Mus musculus
cattgtagttgggagtgactcaggc

SEQ ID NO: 583442 - DNA, 25 bp, Mus musculus
cattgtagttgtaggcataagtgga

SEQ ID NO: 583443 - DNA, 25 bp, Mus musculus
cattgtagttgttggcataagtgga

SEQ ID NO: 583444 - DNA, 25 bp, Mus musculus
cattgtatacatcaagcctgtactg

SEQ ID NO: 583445 - DNA, 25 bp, Mus musculus
cattgtatacatgaagcctgtactg

SEQ ID NO: 583446 - DNA, 25 bp, Mus musculus
cattgtatactcctgtgagtggcca

SEQ ID NO: 583447 - DNA, 25 bp, Mus musculus
cattgtatactcgtgtgagtggcca

SEQ ID NO: 583448 - DNA, 25 bp, Mus musculus
cattgtatctgcctatggcccagtc

SEQ ID NO: 583449 - DNA, 25 bp, Mus musculus
cattgtatctgcgtatggcccagtc

SEQ ID NO: 583450 - DNA, 25 bp, Mus musculus
cattgtcacccaagagttctcaaga

SEQ ID NO: 583451 - DNA, 25 bp, Mus musculus
cattgtcacccatgagttctcaaga

SEQ ID NO: 583452 - DNA, 25 bp, Mus musculus
cattgtcactcgagtgtctgaagtc

SEQ ID NO: 583453 - DNA, 25 bp, Mus musculus
cattgtcactcgtgtgtctgaagtc

SEQ ID NO: 583454 - DNA, 25 bp, Mus musculus
cattgtcatccactttggtgtcgcg

SEQ ID NO: 583455 - DNA, 25 bp, Mus musculus
cattgtcatccagtttggtgtcgcg

SEQ ID NO: 583456 - DNA, 25 bp, Mus musculus
cattgtccaaagcagtggatatcat

SEQ ID NO: 583457 - DNA, 25 bp, Mus musculus
cattgtccaaaggagtggatatcat

SEQ ID NO: 583458 - DNA, 25 bp, Mus musculus
cattgtccaggacttcaccaaacag

SEQ ID NO: 583459 - DNA, 25 bp, Mus musculus
cattgtccaggagttcaccaaacag

SEQ ID NO: 583460 - DNA, 25 bp, Mus musculus
cattgtccattgaagagaggaccga

SEQ ID NO: 583461 - DNA, 25 bp, Mus musculus
cattgtccattgtagagaggaccga

SEQ ID NO: 583462 - DNA, 25 bp, Mus musculus
cattgtcccagaatcgctaccacgt

SEQ ID NO: 583463 - DNA, 25 bp, Mus musculus
cattgtcccagattcgctaccacgt

SEQ ID NO: 583464 - DNA, 25 bp, Mus musculus
cattgtcccagtatagaagtgacta

SEQ ID NO: 583465 - DNA, 25 bp, Mus musculus
cattgtcccagtttagaagtgacta

SEQ ID NO: 583466 - DNA, 25 bp, Mus musculus
cattgtccgcgtcatgcagttgcca

SEQ ID NO: 583467 - DNA, 25 bp, Mus musculus
cattgtccgcgtgatgcagttgcca

SEQ ID NO: 583468 - DNA, 25 bp, Mus musculus
cattgtccgggccatggacactttg

SEQ ID NO: 583469 - DNA, 25 bp, Mus musculus
cattgtccgggcgatggacactttg

SEQ ID NO: 583470 - DNA, 25 bp, Mus musculus
cattgtcctcggaggtgcaaaggag

SEQ ID NO: 583471 - DNA, 25 bp, Mus musculus
cattgtcctcggtggtgcaaaggag

SEQ ID NO: 583472 - DNA, 25 bp, Mus musculus
cattgtcctgcactcacctagtgta

SEQ ID NO: 583473 - DNA, 25 bp, Mus musculus
cattgtcctgcagtcacctagtgta

SEQ ID NO: 583474 - DNA, 25 bp, Mus musculus
cattgtcctgttccacaaggtcaca

SEQ ID NO: 583475 - DNA, 25 bp, Mus musculus
cattgtcctgttgcacaaggtcaca

SEQ ID NO: 583476 - DNA, 25 bp, Mus musculus
cattgtcgccttagcagaggaagca

SEQ ID NO: 583477 - DNA, 25 bp, Mus musculus
cattgtcgcctttgcagaggaagca

SEQ ID NO: 583478 - DNA, 25 bp, Mus musculus
cattgtcggctactgcgacgccaaa

SEQ ID NO: 583479 - DNA, 25 bp, Mus musculus
cattgtcggctagtgcgacgccaaa

SEQ ID NO: 583480 - DNA, 25 bp, Mus musculus
cattgtctctctacttatccccaga

SEQ ID NO: 583481 - DNA, 25 bp, Mus musculus
cattgtctctcttcttatccccaga

SEQ ID NO: 583482 - DNA, 25 bp, Mus musculus
cattgtctctgtcaacggcactaca

SEQ ID NO: 583483 - DNA, 25 bp, Mus musculus
cattgtctctgtgaacggcactaca

SEQ ID NO: 583484 - DNA, 25 bp, Mus musculus
cattgtctggacagccaatcagtga

SEQ ID NO: 583485 - DNA, 25 bp, Mus musculus
cattgtctggactgccaatcagtga

SEQ ID NO: 583486 - DNA, 25 bp, Mus musculus
cattgtcttgctatgtcgcccaacc

SEQ ID NO: 583487 - DNA, 25 bp, Mus musculus
cattgtcttgctttgtcgcccaacc

SEQ ID NO: 583488 - DNA, 25 bp, Mus musculus
cattgtcttttcacatggtctcgga

SEQ ID NO: 583489 - DNA, 25 bp, Mus musculus
cattgtcttttctcatggtctcgga

SEQ ID NO: 583490 - DNA, 25 bp, Mus musculus
cattgtgaaagccatcgctcgtctc

SEQ ID NO: 583491 - DNA, 25 bp, Mus musculus
cattgtgaaagcgatcgctcgtctc

SEQ ID NO: 583492 - DNA, 25 bp, Mus musculus
cattgtgaacagcacgtactatgca

SEQ ID NO: 583493 - DNA, 25 bp, Mus musculus
cattgtgaacaggacgtactatgca

SEQ ID NO: 583494 - DNA, 25 bp, Mus musculus
cattgtgaacatccatggcgcagtc

SEQ ID NO: 583495 - DNA, 25 bp, Mus musculus
cattgtgaacatgcatggcgcagtc

SEQ ID NO: 583496 - DNA, 25 bp, Mus musculus
cattgtgaagtcagcgtggatggac

SEQ ID NO: 583497 - DNA, 25 bp, Mus musculus
cattgtgaagtctgcgtggatggac

SEQ ID NO: 583498 - DNA, 25 bp, Mus musculus
cattgtgagcttagtcaaccagaag

SEQ ID NO: 583499 - DNA, 25 bp, Mus musculus
cattgtgagctttgtcaaccagaag

SEQ ID NO: 583500 - DNA, 25 bp, Mus musculus
cattgtgaggataaccagtctggaa

SEQ ID NO: 583501 - DNA, 25 bp, Mus musculus
cattgtgaggattaccagtctggaa

SEQ ID NO: 583502 - DNA, 25 bp, Mus musculus
cattgtgaggggaaccacccggcct

SEQ ID NO: 583503 - DNA, 25 bp, Mus musculus
cattgtgaggggtaccacccggcct

SEQ ID NO: 583504 - DNA, 25 bp, Mus musculus
cattgtgatgccaagcatatccgag

SEQ ID NO: 583505 - DNA, 25 bp, Mus musculus
cattgtgatgcctagcatatccgag

SEQ ID NO: 583506 - DNA, 25 bp, Mus musculus
cattgtgattagcaaagggacccca

SEQ ID NO: 583507 - DNA, 25 bp, Mus musculus
cattgtgattaggaaagggacccca

SEQ ID NO: 583508 - DNA, 25 bp, Mus musculus
cattgtgattgacatccttattgac

SEQ ID NO: 583509 - DNA, 25 bp, Mus musculus
cattgtgattgaccagaacgacaac

SEQ ID NO: 583510 - DNA, 25 bp, Mus musculus
cattgtgattgagatccttattgac

SEQ ID NO: 583511 - DNA, 25 bp, Mus musculus
cattgtgattgagcagaacgacaac

SEQ ID NO: 583512 - DNA, 25 bp, Mus musculus
cattgtgcaccacgtcgccatctgg

SEQ ID NO: 583513 - DNA, 25 bp, Mus musculus
cattgtgcaccaggtcgccatctgg

SEQ ID NO: 583514 - DNA, 25 bp, Mus musculus
cattgtgcacttcgaagatctttga

SEQ ID NO: 583515 - DNA, 25 bp, Mus musculus
cattgtgcacttggaagatctttga

SEQ ID NO: 583516 - DNA, 25 bp, Mus musculus
cattgtgcagcccattctttagcat

SEQ ID NO: 583517 - DNA, 25 bp, Mus musculus
cattgtgcagccgattctttagcat

SEQ ID NO: 583518 - DNA, 25 bp, Mus musculus
cattgtgcatgacaaggtgttgaac

SEQ ID NO: 583519 - DNA, 25 bp, Mus musculus
cattgtgcatgagaaggtgttgaac

SEQ ID NO: 583520 - DNA, 25 bp, Mus musculus
cattgtgccacaagttaattttagg

SEQ ID NO: 583521 - DNA, 25 bp, Mus musculus
cattgtgccacatgttaattttagg

SEQ ID NO: 583522 - DNA, 25 bp, Mus musculus
cattgtgcgtctctatgaagtcata

SEQ ID NO: 583523 - DNA, 25 bp, Mus musculus
cattgtgcgtctgtatgaagtcata

SEQ ID NO: 583524 - DNA, 25 bp, Mus musculus
cattgtgctcttacgcctgcataag

SEQ ID NO: 583525 - DNA, 25 bp, Mus musculus
cattgtgctctttcgcctgcataag

SEQ ID NO: 583526 - DNA, 25 bp, Mus musculus
cattgtgctggcactctttgaacgc

SEQ ID NO: 583527 - DNA, 25 bp, Mus musculus
cattgtgctggctctctttgaacgc

SEQ ID NO: 583528 - DNA, 25 bp, Mus musculus
cattgtgctggtagagaccatagct

SEQ ID NO: 583529 - DNA, 25 bp, Mus musculus
cattgtgctggttgagaccatagct

SEQ ID NO: 583530 - DNA, 25 bp, Mus musculus
cattgtggaacgcaagcggctagat

SEQ ID NO: 583531 - DNA, 25 bp, Mus musculus
cattgtggaacggaagcggctagat

SEQ ID NO: 583532 - DNA, 25 bp, Mus musculus
cattgtggacccagtcgactctgag

SEQ ID NO: 583533 - DNA, 25 bp, Mus musculus
cattgtggaccctgtcgactctgag

SEQ ID NO: 583534 - DNA, 25 bp, Mus musculus
cattgtggagaaactccgcacctac

SEQ ID NO: 583535 - DNA, 25 bp, Mus musculus
cattgtggagaatctccgcacctac

SEQ ID NO: 583536 - DNA, 25 bp, Mus musculus
cattgtggcaccctataagatagag

SEQ ID NO: 583537 - DNA, 25 bp, Mus musculus
cattgtggcaccgtataagatagag

SEQ ID NO: 583538 - DNA, 25 bp, Mus musculus
cattgtggcatcactgggtttggca

SEQ ID NO: 583539 - DNA, 25 bp, Mus musculus
cattgtggcatctctgggtttggca

SEQ ID NO: 583540 - DNA, 25 bp, Mus musculus
cattgtggccaccttggtatctggt

SEQ ID NO: 583541 - DNA, 25 bp, Mus musculus
cattgtggccacgttggtatctggt

SEQ ID NO: 583542 - DNA, 25 bp, Mus musculus
cattgtggcctgcaacgagatcgaa

SEQ ID NO: 583543 - DNA, 25 bp, Mus musculus
cattgtggcctggaacgagatcgaa

SEQ ID NO: 583544 - DNA, 25 bp, Mus musculus
cattgtgggaaactcctgagcactc

SEQ ID NO: 583545 - DNA, 25 bp, Mus musculus
cattgtgggaaagtcctgagcactc

SEQ ID NO: 583546 - DNA, 25 bp, Mus musculus
cattgtgggcctaccggaagtggaa

SEQ ID NO: 583547 - DNA, 25 bp, Mus musculus
cattgtgggccttccggaagtggaa

SEQ ID NO: 583548 - DNA, 25 bp, Mus musculus
cattgtgggctaacatgaacatgat

SEQ ID NO: 583549 - DNA, 25 bp, Mus musculus
cattgtgggctatcatgaacatgat

SEQ ID NO: 583550 - DNA, 25 bp, Mus musculus
cattgtgggtgacaaacatgacctc

SEQ ID NO: 583551 - DNA, 25 bp, Mus musculus
cattgtgggtgagaaacatgacctc

SEQ ID NO: 583552 - DNA, 25 bp, Mus musculus
cattgtggtagactgtcctgatgaa

SEQ ID NO: 583553 - DNA, 25 bp, Mus musculus
cattgtggtagagtgtcctgatgaa

SEQ ID NO: 583554 - DNA, 25 bp, Mus musculus
cattgtggttgaaaactgtgccatc

SEQ ID NO: 583555 - DNA, 25 bp, Mus musculus
cattgtggttgataactgtgccatc

SEQ ID NO: 583556 - DNA, 25 bp, Mus musculus
cattgtggtttacacggacagggaa

SEQ ID NO: 583557 - DNA, 25 bp, Mus musculus
cattgtggtttagacggacagggaa

SEQ ID NO: 583558 - DNA, 25 bp, Mus musculus
cattgtgtccctcctgaacgtgtac

SEQ ID NO: 583559 - DNA, 25 bp, Mus musculus
cattgtgtccctgctgaacgtgtac

SEQ ID NO: 583560 - DNA, 25 bp, Mus musculus
cattgtgtcctgcaaagatggacgg

SEQ ID NO: 583561 - DNA, 25 bp, Mus musculus
cattgtgtcctggaaagatggacgg

SEQ ID NO: 583562 - DNA, 25 bp, Mus musculus
cattgtgtctctcgcctttgctgac

SEQ ID NO: 583563 - DNA, 25 bp, Mus musculus
cattgtgtctctggcctttgctgac

SEQ ID NO: 583564 - DNA, 25 bp, Mus musculus
cattgtgtctgaaggagcaatcgac

SEQ ID NO: 583565 - DNA, 25 bp, Mus musculus
cattgtgtctgatggagcaatcgac

SEQ ID NO: 583566 - DNA, 25 bp, Mus musculus
cattgtgtctgtcatcaatagtact

SEQ ID NO: 583567 - DNA, 25 bp, Mus musculus
cattgtgtctgtgatcaatagtact

SEQ ID NO: 583568 - DNA, 25 bp, Mus musculus
cattgtgtgagacgcaagcggcacc

SEQ ID NO: 583569 - DNA, 25 bp, Mus musculus
cattgtgtgagaggcaagcggcacc

SEQ ID NO: 583570 - DNA, 25 bp, Mus musculus
cattgtgtggaacgcattcagcccc

SEQ ID NO: 583571 - DNA, 25 bp, Mus musculus
cattgtgtggaaggcattcagcccc

SEQ ID NO: 583572 - DNA, 25 bp, Mus musculus
cattgtgtgttgatagtcctgtgac

SEQ ID NO: 583573 - DNA, 25 bp, Mus musculus
cattgtgtgttgttagtcctgtgac

SEQ ID NO: 583574 - DNA, 25 bp, Mus musculus
cattgtgttccaaggagacgagagc

SEQ ID NO: 583575 - DNA, 25 bp, Mus musculus
cattgtgttccatggagacgagagc

SEQ ID NO: 583576 - DNA, 25 bp, Mus musculus
cattgtgttgctacagattgctaaa

SEQ ID NO: 583577 - DNA, 25 bp, Mus musculus
cattgtgttgcttcagattgctaaa

SEQ ID NO: 583578 - DNA, 25 bp, Mus musculus
cattgtgtttaaagctgggagccca

SEQ ID NO: 583579 - DNA, 25 bp, Mus musculus
cattgtgtttaatgctgggagccca

SEQ ID NO: 583580 - DNA, 25 bp, Mus musculus
cattgttaaagccagtagctctgca

SEQ ID NO: 583581 - DNA, 25 bp, Mus musculus
cattgttaaagcgagtagctctgca

SEQ ID NO: 583582 - DNA, 25 bp, Mus musculus
cattgttacagtcgaccaaccccag

SEQ ID NO: 583583 - DNA, 25 bp, Mus musculus
cattgttacagtggaccaaccccag

SEQ ID NO: 583584 - DNA, 25 bp, Mus musculus
cattgttagaaactggaacgtatga

SEQ ID NO: 583585 - DNA, 25 bp, Mus musculus
cattgttagaaagtggaacgtatga

SEQ ID NO: 583586 - DNA, 25 bp, Mus musculus
cattgttcaagaagggacggtggcc

SEQ ID NO: 583587 - DNA, 25 bp, Mus musculus
cattgttcaagatgggacggtggcc

SEQ ID NO: 583588 - DNA, 25 bp, Mus musculus
cattgttcgtgtactgcaggctcca

SEQ ID NO: 583589 - DNA, 25 bp, Mus musculus
cattgttcgtgttctgcaggctcca

SEQ ID NO: 583590 - DNA, 25 bp, Mus musculus
cattgttctcctagacaaggccatg

SEQ ID NO: 583591 - DNA, 25 bp, Mus musculus
cattgttctccttgacaaggccatg

SEQ ID NO: 583592 - DNA, 25 bp, Mus musculus
cattgttctgtcagctcgtggtggg

SEQ ID NO: 583593 - DNA, 25 bp, Mus musculus
cattgttctgtctgctcgtggtggg

SEQ ID NO: 583594 - DNA, 25 bp, Mus musculus
cattgttgagcacgctcgaggcccg

SEQ ID NO: 583595 - DNA, 25 bp, Mus musculus
cattgttgagcaggctcgaggcccg

SEQ ID NO: 583596 - DNA, 25 bp, Mus musculus
cattgttgcttactcggaacgtgaa

SEQ ID NO: 583597 - DNA, 25 bp, Mus musculus
cattgttgcttagtcggaacgtgaa

SEQ ID NO: 583598 - DNA, 25 bp, Mus musculus
cattgttggccaagaaggaaaaaga

SEQ ID NO: 583599 - DNA, 25 bp, Mus musculus
cattgttggccatgaaggaaaaaga

SEQ ID NO: 583600 - DNA, 25 bp, Mus musculus
cattgttggtaaccagtcccctgta

SEQ ID NO: 583601 - DNA, 25 bp, Mus musculus
cattgttggtaagcagtcccctgta

SEQ ID NO: 583602 - DNA, 25 bp, Mus musculus
cattgttggtgacggtcgtgcctac

SEQ ID NO: 583603 - DNA, 25 bp, Mus musculus
cattgttggtgagggtcgtgcctac

SEQ ID NO: 583604 - DNA, 25 bp, Mus musculus
cattgttgtgtgcagcattgctttc

SEQ ID NO: 583605 - DNA, 25 bp, Mus musculus
cattgttgtgtggagcattgctttc

SEQ ID NO: 583606 - DNA, 25 bp, Mus musculus
cattgtttccatctgtggtgggctg

SEQ ID NO: 583607 - DNA, 25 bp, Mus musculus
cattgtttccatgtgtggtgggctg

SEQ ID NO: 583608 - DNA, 25 bp, Mus musculus
cattgttttgaacaacacctggcca

SEQ ID NO: 583609 - DNA, 25 bp, Mus musculus
cattgttttgaagaacacctggcca

SEQ ID NO: 583610 - DNA, 25 bp, Mus musculus
cattgttttgtaaaacgtctttacg

SEQ ID NO: 583611 - DNA, 25 bp, Mus musculus
cattgttttgtataacgtctttacg

SEQ ID NO: 583612 - DNA, 25 bp, Mus musculus
catttaaaaaatcgaccgcattact

SEQ ID NO: 583613 - DNA, 25 bp, Mus musculus
catttaaaaaatggaccgcattact

SEQ ID NO: 583614 - DNA, 25 bp, Mus musculus
catttaaaactgaggtgtcattcca

SEQ ID NO: 583615 - DNA, 25 bp, Mus musculus
catttaaaactgtggtgtcattcca

SEQ ID NO: 583616 - DNA, 25 bp, Mus musculus
catttaaactctcgcaatttgactt

SEQ ID NO: 583617 - DNA, 25 bp, Mus musculus
catttaaactctggcaatttgactt

SEQ ID NO: 583618 - DNA, 25 bp, Mus musculus
catttaaagaggaagatcctgtgaa

SEQ ID NO: 583619 - DNA, 25 bp, Mus musculus
catttaaagaggtagatcctgtgaa

SEQ ID NO: 583620 - DNA, 25 bp, Mus musculus
catttaaatattagaacactgacag

SEQ ID NO: 583621 - DNA, 25 bp, Mus musculus
catttaaatatttgaacactgacag

SEQ ID NO: 583622 - DNA, 25 bp, Mus musculus
catttaaatcagagatcctgttctg

SEQ ID NO: 583623 - DNA, 25 bp, Mus musculus
catttaaatcagtgatcctgttctg

SEQ ID NO: 583624 - DNA, 25 bp, Mus musculus
catttaacaaaaccaatggattgcg

SEQ ID NO: 583625 - DNA, 25 bp, Mus musculus
catttaacaaaagcaatggattgcg

SEQ ID NO: 583626 - DNA, 25 bp, Mus musculus
catttaacatatcgaaagctgtgct

SEQ ID NO: 583627 - DNA, 25 bp, Mus musculus
catttaacatatggaaagctgtgct

SEQ ID NO: 583628 - DNA, 25 bp, Mus musculus
catttaacatcacccaccgcttcac

SEQ ID NO: 583629 - DNA, 25 bp, Mus musculus
catttaacatcagccaccgcttcac

SEQ ID NO: 583630 - DNA, 25 bp, Mus musculus
catttaacccagagactgtgaggtc

SEQ ID NO: 583631 - DNA, 25 bp, Mus musculus
catttaacccagtgactgtgaggtc

SEQ ID NO: 583632 - DNA, 25 bp, Mus musculus
catttaacgacacaaggttgccagg

SEQ ID NO: 583633 - DNA, 25 bp, Mus musculus
catttaacgacagaaggttgccagg

SEQ ID NO: 583634 - DNA, 25 bp, Mus musculus
catttaatcggacagcgtttttaca

SEQ ID NO: 583635 - DNA, 25 bp, Mus musculus
catttaatcggagagcgtttttaca

SEQ ID NO: 583636 - DNA, 25 bp, Mus musculus
catttaatgaccagaacggtactgg

SEQ ID NO: 583637 - DNA, 25 bp, Mus musculus
catttaatgacctgaacggtactgg

SEQ ID NO: 583638 - DNA, 25 bp, Mus musculus
catttacaaaagcaggcacggcctc

SEQ ID NO: 583639 - DNA, 25 bp, Mus musculus
catttacaaaaggaggcacggcctc

SEQ ID NO: 583640 - DNA, 25 bp, Mus musculus
catttacaccacaggaaccgaagag

SEQ ID NO: 583641 - DNA, 25 bp, Mus musculus
catttacaccactggaaccgaagag

SEQ ID NO: 583642 - DNA, 25 bp, Mus musculus
catttaccaaaccaaagatgatctc

SEQ ID NO: 583643 - DNA, 25 bp, Mus musculus
catttaccaaacgaaagatgatctc

SEQ ID NO: 583644 - DNA, 25 bp, Mus musculus
catttaccagtcaggagagctgcgt

SEQ ID NO: 583645 - DNA, 25 bp, Mus musculus
catttaccagtctggagagctgcgt

SEQ ID NO: 583646 - DNA, 25 bp, Mus musculus
catttaccataccattctcctgaag

SEQ ID NO: 583647 - DNA, 25 bp, Mus musculus
catttaccatacgattctcctgaag

SEQ ID NO: 583648 - DNA, 25 bp, Mus musculus
catttacccaacagtggctgaggtc

SEQ ID NO: 583649 - DNA, 25 bp, Mus musculus
catttacccaactgtggctgaggtc

SEQ ID NO: 583650 - DNA, 25 bp, Mus musculus
catttacccgttcttggattttatg

SEQ ID NO: 583651 - DNA, 25 bp, Mus musculus
catttacccgttgttggattttatg

SEQ ID NO: 583652 - DNA, 25 bp, Mus musculus
catttacctgaaaagcttatgattc

SEQ ID NO: 583653 - DNA, 25 bp, Mus musculus
catttacctgaatagcttatgattc

SEQ ID NO: 583654 - DNA, 25 bp, Mus musculus
catttacgcggtccaggtgatcgca

SEQ ID NO: 583655 - DNA, 25 bp, Mus musculus
catttacgcggtgcaggtgatcgca

SEQ ID NO: 583656 - DNA, 25 bp, Mus musculus
catttacgctggaaaggaaggtaca

SEQ ID NO: 583657 - DNA, 25 bp, Mus musculus
catttacgctggtaaggaaggtaca

SEQ ID NO: 583658 - DNA, 25 bp, Mus musculus
catttacttcggcagctgaggacaa

SEQ ID NO: 583659 - DNA, 25 bp, Mus musculus
catttacttcgggagctgaggacaa

SEQ ID NO: 583660 - DNA, 25 bp, Mus musculus
catttagagtatagctaacaccatc

SEQ ID NO: 583661 - DNA, 25 bp, Mus musculus
catttagagtattgctaacaccatc

SEQ ID NO: 583662 - DNA, 25 bp, Mus musculus
catttaggtgtgctccccaagtgtg

SEQ ID NO: 583663 - DNA, 25 bp, Mus musculus
catttaggtgtggtccccaagtgtg

SEQ ID NO: 583664 - DNA, 25 bp, Mus musculus
catttagtctgaagaaggcacctga

SEQ ID NO: 583665 - DNA, 25 bp, Mus musculus
catttagtctgatgaaggcacctga

SEQ ID NO: 583666 - DNA, 25 bp, Mus musculus
catttagtttgaagctggttgctgt

SEQ ID NO: 583667 - DNA, 25 bp, Mus musculus
catttagtttgatgctggttgctgt

SEQ ID NO: 583668 - DNA, 25 bp, Mus musculus
catttataccatagacggatccagg

SEQ ID NO: 583669 - DNA, 25 bp, Mus musculus
catttataccattgacggatccagg

SEQ ID NO: 583670 - DNA, 25 bp, Mus musculus
catttataccggcaagaattacagg

SEQ ID NO: 583671 - DNA, 25 bp, Mus musculus
catttataccgggaagaattacagg

SEQ ID NO: 583672 - DNA, 25 bp, Mus musculus
catttatatcccacttcctgatgag

SEQ ID NO: 583673 - DNA, 25 bp, Mus musculus
catttatatccctcttcctgatgag

SEQ ID NO: 583674 - DNA, 25 bp, Mus musculus
catttatcagcgagggacatcgtcc

SEQ ID NO: 583675 - DNA, 25 bp, Mus musculus
catttatcagcgtgggacatcgtcc

SEQ ID NO: 583676 - DNA, 25 bp, Mus musculus
catttatcgctcaggccttgtgcct

SEQ ID NO: 583677 - DNA, 25 bp, Mus musculus
catttatcgctctggccttgtgcct

SEQ ID NO: 583678 - DNA, 25 bp, Mus musculus
catttatgactcatgggcttacaga

SEQ ID NO: 583679 - DNA, 25 bp, Mus musculus
catttatgactcttgggcttacaga

SEQ ID NO: 583680 - DNA, 25 bp, Mus musculus
catttatgatatctgccgccgtaac

SEQ ID NO: 583681 - DNA, 25 bp, Mus musculus
catttatgatatgtgccgccgtaac

SEQ ID NO: 583682 - DNA, 25 bp, Mus musculus
catttatgctcacaaagtccttctc

SEQ ID NO: 583683 - DNA, 25 bp, Mus musculus
catttatgctcagaaagtccttctc

SEQ ID NO: 583684 - DNA, 25 bp, Mus musculus
catttatgctgaagaccctgagcca

SEQ ID NO: 583685 - DNA, 25 bp, Mus musculus
catttatgctgatgaccctgagcca

SEQ ID NO: 583686 - DNA, 25 bp, Mus musculus
catttatggcgacgagtggtgtgtc

SEQ ID NO: 583687 - DNA, 25 bp, Mus musculus
catttatggcgaggagtggtgtgtc

SEQ ID NO: 583688 - DNA, 25 bp, Mus musculus
catttatggtgaaggtcatcaggtc

SEQ ID NO: 583689 - DNA, 25 bp, Mus musculus
catttatggtgatggtcatcaggtc

SEQ ID NO: 583690 - DNA, 25 bp, Mus musculus
catttatggttaagtggacgcagct

SEQ ID NO: 583691 - DNA, 25 bp, Mus musculus
catttatggttatgtggacgcagct

SEQ ID NO: 583692 - DNA, 25 bp, Mus musculus
catttatgtgtcaatgagaggcact

SEQ ID NO: 583693 - DNA, 25 bp, Mus musculus
catttatgtgtctatgagaggcact

SEQ ID NO: 583694 - DNA, 25 bp, Mus musculus
catttatgtgtgagaagggattaac

SEQ ID NO: 583695 - DNA, 25 bp, Mus musculus
catttatgtgtgtgaagggattaac

SEQ ID NO: 583696 - DNA, 25 bp, Mus musculus
catttattaaaacaccctctgtgca

SEQ ID NO: 583697 - DNA, 25 bp, Mus musculus
catttattaaaagaccctctgtgca

SEQ ID NO: 583698 - DNA, 25 bp, Mus musculus
catttattacaaaaggagcctggga

SEQ ID NO: 583699 - DNA, 25 bp, Mus musculus
catttattacaataggagcctggga

SEQ ID NO: 583700 - DNA, 25 bp, Mus musculus
catttattccatcaagaagtttggc

SEQ ID NO: 583701 - DNA, 25 bp, Mus musculus
catttattccatgaagaagtttggc

SEQ ID NO: 583702 - DNA, 25 bp, Mus musculus
catttattgaaactcgccaggatgg

SEQ ID NO: 583703 - DNA, 25 bp, Mus musculus
catttattgaaagtcgccaggatgg

SEQ ID NO: 583704 - DNA, 25 bp, Mus musculus
catttattggtacagatggagcact

SEQ ID NO: 583705 - DNA, 25 bp, Mus musculus
catttattggtagagatggagcact

SEQ ID NO: 583706 - DNA, 25 bp, Mus musculus
catttattgtagaggaggctccagg

SEQ ID NO: 583707 - DNA, 25 bp, Mus musculus
catttattgtagtggaggctccagg

SEQ ID NO: 583708 - DNA, 25 bp, Mus musculus
catttattttccagaagcagcagcc

SEQ ID NO: 583709 - DNA, 25 bp, Mus musculus
catttattttcctgaagcagcagcc

SEQ ID NO: 583710 - DNA, 25 bp, Mus musculus
catttcaaaacccttcatggcatga

SEQ ID NO: 583711 - DNA, 25 bp, Mus musculus
catttcaaaaccgttcatggcatga

SEQ ID NO: 583712 - DNA, 25 bp, Mus musculus
catttcaaacctatgtgggccagga

SEQ ID NO: 583713 - DNA, 25 bp, Mus musculus
catttcaaacctttgtgggccagga

SEQ ID NO: 583714 - DNA, 25 bp, Mus musculus
catttcaacgatacccagcatcatt

SEQ ID NO: 583715 - DNA, 25 bp, Mus musculus
catttcaacgattcccagcatcatt

SEQ ID NO: 583716 - DNA, 25 bp, Mus musculus
catttcaacttgctgtcctccaggg

SEQ ID NO: 583717 - DNA, 25 bp, Mus musculus
catttcaacttggtgtcctccaggg

SEQ ID NO: 583718 - DNA, 25 bp, Mus musculus
catttcaactttcagagtttcggca

SEQ ID NO: 583719 - DNA, 25 bp, Mus musculus
catttcaactttgagagtttcggca

SEQ ID NO: 583720 - DNA, 25 bp, Mus musculus
catttcaagaacaattagcagagca

SEQ ID NO: 583721 - DNA, 25 bp, Mus musculus
catttcaagaactattagcagagca

SEQ ID NO: 583722 - DNA, 25 bp, Mus musculus
catttcaagaatattgtgcactgtg

SEQ ID NO: 583723 - DNA, 25 bp, Mus musculus
catttcaagaattttgtgcactgtg

SEQ ID NO: 583724 - DNA, 25 bp, Mus musculus
catttcaagccaaggctgcacccgg

SEQ ID NO: 583725 - DNA, 25 bp, Mus musculus
catttcaagccatggctgcacccgg

SEQ ID NO: 583726 - DNA, 25 bp, Mus musculus
catttcaagctccatatggtgacct

SEQ ID NO: 583727 - DNA, 25 bp, Mus musculus
catttcaagctcgatatggtgacct

SEQ ID NO: 583728 - DNA, 25 bp, Mus musculus
catttcaaggctatggcttgtatct

SEQ ID NO: 583729 - DNA, 25 bp, Mus musculus
catttcaaggctttggcttgtatct

SEQ ID NO: 583730 - DNA, 25 bp, Mus musculus
catttcaagggcagagatcatttct

SEQ ID NO: 583731 - DNA, 25 bp, Mus musculus
catttcaagggctgagatcatttct

SEQ ID NO: 583732 - DNA, 25 bp, Mus musculus
catttcaatgatcagtctcctctgg

SEQ ID NO: 583733 - DNA, 25 bp, Mus musculus
catttcaatgatgagtctcctctgg

SEQ ID NO: 583734 - DNA, 25 bp, Mus musculus
catttcacatggagacgggaggcaa

SEQ ID NO: 583735 - DNA, 25 bp, Mus musculus
catttcacatggtgacgggaggcaa

SEQ ID NO: 583736 - DNA, 25 bp, Mus musculus
catttcactgatactgagtctccat

SEQ ID NO: 583737 - DNA, 25 bp, Mus musculus
catttcactgattctgagtctccat

SEQ ID NO: 583738 - DNA, 25 bp, Mus musculus
catttcactgcacaaaaggagctcc

SEQ ID NO: 583739 - DNA, 25 bp, Mus musculus
catttcactgcagaaaaggagctcc

SEQ ID NO: 583740 - DNA, 25 bp, Mus musculus
catttcagaagtcgatcgattgcag

SEQ ID NO: 583741 - DNA, 25 bp, Mus musculus
catttcagaagtggatcgattgcag

SEQ ID NO: 583742 - DNA, 25 bp, Mus musculus
catttcagagttcagtaaactggac

SEQ ID NO: 583743 - DNA, 25 bp, Mus musculus
catttcagagttgagtaaactggac

SEQ ID NO: 583744 - DNA, 25 bp, Mus musculus
catttcagatgtcgactgcgtacgc

SEQ ID NO: 583745 - DNA, 25 bp, Mus musculus
catttcagatgtggactgcgtacgc

SEQ ID NO: 583746 - DNA, 25 bp, Mus musculus
catttcagctttccgtccatcttta

SEQ ID NO: 583747 - DNA, 25 bp, Mus musculus
catttcagctttgcgtccatcttta

SEQ ID NO: 583748 - DNA, 25 bp, Mus musculus
catttcaggagtcttaccaggtcta

SEQ ID NO: 583749 - DNA, 25 bp, Mus musculus
catttcaggagtgttaccaggtcta

SEQ ID NO: 583750 - DNA, 25 bp, Mus musculus
catttcagtggacgttgtatctgga

SEQ ID NO: 583751 - DNA, 25 bp, Mus musculus
catttcagtggaggttgtatctgga

SEQ ID NO: 583752 - DNA, 25 bp, Mus musculus
catttcagtgggacatggcttgtct

SEQ ID NO: 583753 - DNA, 25 bp, Mus musculus
catttcagtgggtcatggcttgtct

SEQ ID NO: 583754 - DNA, 25 bp, Mus musculus
catttcagttttatgcggaagagta

SEQ ID NO: 583755 - DNA, 25 bp, Mus musculus
catttcagttttttgcggaagagta

SEQ ID NO: 583756 - DNA, 25 bp, Mus musculus
catttcatccagctggctcatgagc

SEQ ID NO: 583757 - DNA, 25 bp, Mus musculus
catttcatccaggtggctcatgagc

SEQ ID NO: 583758 - DNA, 25 bp, Mus musculus
catttcatcccacgagctaggtcag

SEQ ID NO: 583759 - DNA, 25 bp, Mus musculus
catttcatcccaggagctaggtcag

SEQ ID NO: 583760 - DNA, 25 bp, Mus musculus
catttcatgggacggccttgatcct

SEQ ID NO: 583761 - DNA, 25 bp, Mus musculus
catttcatgggagggccttgatcct

SEQ ID NO: 583762 - DNA, 25 bp, Mus musculus
catttcattgctaggacaggccggg

SEQ ID NO: 583763 - DNA, 25 bp, Mus musculus
catttcattgcttggacaggccggg

SEQ ID NO: 583764 - DNA, 25 bp, Mus musculus
catttcattggtagtatggcccgcg

SEQ ID NO: 583765 - DNA, 25 bp, Mus musculus
catttcattggttgtatggcccgcg

SEQ ID NO: 583766 - DNA, 25 bp, Mus musculus
catttcattgttccagagtcctctt

SEQ ID NO: 583767 - DNA, 25 bp, Mus musculus
catttcattgttgcagagtcctctt

SEQ ID NO: 583768 - DNA, 25 bp, Mus musculus
catttccacgccctgacttgtgagg

SEQ ID NO: 583769 - DNA, 25 bp, Mus musculus
catttccacgccgtgacttgtgagg

SEQ ID NO: 583770 - DNA, 25 bp, Mus musculus
catttccagagacacagaactagct

SEQ ID NO: 583771 - DNA, 25 bp, Mus musculus
catttccagagagacagaactagct

SEQ ID NO: 583772 - DNA, 25 bp, Mus musculus
catttccagttgactgaggtggcca

SEQ ID NO: 583773 - DNA, 25 bp, Mus musculus
catttccagttgtctgaggtggcca

SEQ ID NO: 583774 - DNA, 25 bp, Mus musculus
catttccataacctgaggaagtccg

SEQ ID NO: 583775 - DNA, 25 bp, Mus musculus
catttccataacgtgaggaagtccg

SEQ ID NO: 583776 - DNA, 25 bp, Mus musculus
catttccatcctagtcggctgccaa

SEQ ID NO: 583777 - DNA, 25 bp, Mus musculus
catttccatccttgtcggctgccaa

SEQ ID NO: 583778 - DNA, 25 bp, Mus musculus
catttcccagaacgatgagcactgc

SEQ ID NO: 583779 - DNA, 25 bp, Mus musculus
catttcccagaaggatgagcactgc

SEQ ID NO: 583780 - DNA, 25 bp, Mus musculus
catttccccgaaagagatcgaaagg

SEQ ID NO: 583781 - DNA, 25 bp, Mus musculus
catttccccgaatgagatcgaaagg

SEQ ID NO: 583782 - DNA, 25 bp, Mus musculus
catttcccttatatgctgtaactca

SEQ ID NO: 583783 - DNA, 25 bp, Mus musculus
catttcccttatttgctgtaactca

SEQ ID NO: 583784 - DNA, 25 bp, Mus musculus
catttccctttgagattccctggca

SEQ ID NO: 583785 - DNA, 25 bp, Mus musculus
catttccctttgtgattccctggca

SEQ ID NO: 583786 - DNA, 25 bp, Mus musculus
catttccgaaccatctaccacatgt

SEQ ID NO: 583787 - DNA, 25 bp, Mus musculus
catttccgaaccttctaccacatgt

SEQ ID NO: 583788 - DNA, 25 bp, Mus musculus
catttccgagtcagggccaagacct

SEQ ID NO: 583789 - DNA, 25 bp, Mus musculus
catttccgagtctgggccaagacct

SEQ ID NO: 583790 - DNA, 25 bp, Mus musculus
catttccgggccaacatcttggacg

SEQ ID NO: 583791 - DNA, 25 bp, Mus musculus
catttccgggcctacatcttggacg

SEQ ID NO: 583792 - DNA, 25 bp, Mus musculus
catttccgtcatcattcttgggcgt

SEQ ID NO: 583793 - DNA, 25 bp, Mus musculus
catttccgtcatgattcttgggcgt

SEQ ID NO: 583794 - DNA, 25 bp, Mus musculus
catttcctcaggctgtgcatgttct

SEQ ID NO: 583795 - DNA, 25 bp, Mus musculus
catttcctcagggtgtgcatgttct

SEQ ID NO: 583796 - DNA, 25 bp, Mus musculus
catttcctctacagtgtatagttgc

SEQ ID NO: 583797 - DNA, 25 bp, Mus musculus
catttcctctactgtgtatagttgc

SEQ ID NO: 583798 - DNA, 25 bp, Mus musculus
catttcctggaacagcatgaacgca

SEQ ID NO: 583799 - DNA, 25 bp, Mus musculus
catttcctggaagagcatgaacgca

SEQ ID NO: 583800 - DNA, 25 bp, Mus musculus
catttcctgttcactcggactcaac

SEQ ID NO: 583801 - DNA, 25 bp, Mus musculus
catttcctgttctctcggactcaac

SEQ ID NO: 583802 - DNA, 25 bp, Mus musculus
catttccttcaaaatactgtatggt

SEQ ID NO: 583803 - DNA, 25 bp, Mus musculus
catttccttcaatatactgtatggt

SEQ ID NO: 583804 - DNA, 25 bp, Mus musculus
catttccttgagagggcttctgtct

SEQ ID NO: 583805 - DNA, 25 bp, Mus musculus
catttccttgagtgggcttctgtct

SEQ ID NO: 583806 - DNA, 25 bp, Mus musculus
catttcgacgaccacgagttgtggt

SEQ ID NO: 583807 - DNA, 25 bp, Mus musculus
catttcgacgacgacgagttgtggt

SEQ ID NO: 583808 - DNA, 25 bp, Mus musculus
catttcgcactgctcactgcttatg

SEQ ID NO: 583809 - DNA, 25 bp, Mus musculus
catttcgcactggtcactgcttatg

SEQ ID NO: 583810 - DNA, 25 bp, Mus musculus
catttcggaggcaagatcacctacg

SEQ ID NO: 583811 - DNA, 25 bp, Mus musculus
catttcggaggctagatcacctacg

SEQ ID NO: 583812 - DNA, 25 bp, Mus musculus
catttcggatggagagtagcgcagc

SEQ ID NO: 583813 - DNA, 25 bp, Mus musculus
catttcggatggtgagtagcgcagc

SEQ ID NO: 583814 - DNA, 25 bp, Mus musculus
catttcgggaagagaattatgtagt

SEQ ID NO: 583815 - DNA, 25 bp, Mus musculus
catttcgggaagtgaattatgtagt

SEQ ID NO: 583816 - DNA, 25 bp, Mus musculus
catttcggggaacctgcaccgcatt

SEQ ID NO: 583817 - DNA, 25 bp, Mus musculus
catttcggggaagctgcaccgcatt

SEQ ID NO: 583818 - DNA, 25 bp, Mus musculus
catttctcatttcgctggcaaggcg

SEQ ID NO: 583819 - DNA, 25 bp, Mus musculus
catttctcatttggctggcaaggcg

SEQ ID NO: 583820 - DNA, 25 bp, Mus musculus
catttctcccttatcttggcaacct

SEQ ID NO: 583821 - DNA, 25 bp, Mus musculus
catttctcccttttcttggcaacct

SEQ ID NO: 583822 - DNA, 25 bp, Mus musculus
catttctccgatccagaagtcccag

SEQ ID NO: 583823 - DNA, 25 bp, Mus musculus
catttctccgatgcagaagtcccag

SEQ ID NO: 583824 - DNA, 25 bp, Mus musculus
catttctcctagcactgagtttggg

SEQ ID NO: 583825 - DNA, 25 bp, Mus musculus
catttctcctaggactgagtttggg

SEQ ID NO: 583826 - DNA, 25 bp, Mus musculus
catttctctgcaataccatgtggtt

SEQ ID NO: 583827 - DNA, 25 bp, Mus musculus
catttctctgcattaccatgtggtt

SEQ ID NO: 583828 - DNA, 25 bp, Mus musculus
catttctctgtgaaaagcacacttg

SEQ ID NO: 583829 - DNA, 25 bp, Mus musculus
catttctctgtgtaaagcacacttg

SEQ ID NO: 583830 - DNA, 25 bp, Mus musculus
catttctgaaggaactcactcgaca

SEQ ID NO: 583831 - DNA, 25 bp, Mus musculus
catttctgaaggtactcactcgaca

SEQ ID NO: 583832 - DNA, 25 bp, Mus musculus
catttctgaagtcctctttaccctg

SEQ ID NO: 583833 - DNA, 25 bp, Mus musculus
catttctgaagtgctctttaccctg

SEQ ID NO: 583834 - DNA, 25 bp, Mus musculus
catttctgacatacctatttgaagt

SEQ ID NO: 583835 - DNA, 25 bp, Mus musculus
catttctgacattcctatttgaagt

SEQ ID NO: 583836 - DNA, 25 bp, Mus musculus
catttctgccttcaagaacatcgag

SEQ ID NO: 583837 - DNA, 25 bp, Mus musculus
catttctgccttgaagaacatcgag

SEQ ID NO: 583838 - DNA, 25 bp, Mus musculus
catttctgctgaaattctgggtgtg

SEQ ID NO: 583839 - DNA, 25 bp, Mus musculus
catttctgctgatattctgggtgtg

SEQ ID NO: 583840 - DNA, 25 bp, Mus musculus
catttctggaaccacgaccagagcc

SEQ ID NO: 583841 - DNA, 25 bp, Mus musculus
catttctggaacgacgaccagagcc

SEQ ID NO: 583842 - DNA, 25 bp, Mus musculus
catttctggccaacaaagggcttgt

SEQ ID NO: 583843 - DNA, 25 bp, Mus musculus
catttctggccatcaaagggcttgt

SEQ ID NO: 583844 - DNA, 25 bp, Mus musculus
catttctggctgactccctggtacg

SEQ ID NO: 583845 - DNA, 25 bp, Mus musculus
catttctggctgtctccctggtacg

SEQ ID NO: 583846 - DNA, 25 bp, Mus musculus
catttctggtaccttggccaaagac

SEQ ID NO: 583847 - DNA, 25 bp, Mus musculus
catttctggtacgttggccaaagac

SEQ ID NO: 583848 - DNA, 25 bp, Mus musculus
catttctgtagtcacttacatgacg

SEQ ID NO: 583849 - DNA, 25 bp, Mus musculus
catttctgtagtgacttacatgacg

SEQ ID NO: 583850 - DNA, 25 bp, Mus musculus
catttctgtcaaaggaagagtcttt

SEQ ID NO: 583851 - DNA, 25 bp, Mus musculus
catttctgtcaatggaagagtcttt

SEQ ID NO: 583852 - DNA, 25 bp, Mus musculus
catttctgtctgaacgattgtcagt

SEQ ID NO: 583853 - DNA, 25 bp, Mus musculus
catttctgtctgtacgattgtcagt

SEQ ID NO: 583854 - DNA, 25 bp, Mus musculus
catttctgtttcctttatatggcca

SEQ ID NO: 583855 - DNA, 25 bp, Mus musculus
catttctgtttcgtttatatggcca

SEQ ID NO: 583856 - DNA, 25 bp, Mus musculus
catttcttatacaactgcagtgaac

SEQ ID NO: 583857 - DNA, 25 bp, Mus musculus
catttcttatactactgcagtgaac

SEQ ID NO: 583858 - DNA, 25 bp, Mus musculus
catttcttcacgagggactgtcagc

SEQ ID NO: 583859 - DNA, 25 bp, Mus musculus
catttcttcacgtgggactgtcagc

SEQ ID NO: 583860 - DNA, 25 bp, Mus musculus
catttcttcagcatgggcaaatgtg

SEQ ID NO: 583861 - DNA, 25 bp, Mus musculus
catttcttcagcttgggcaaatgtg

SEQ ID NO: 583862 - DNA, 25 bp, Mus musculus
catttcttccaaccatgaacccata

SEQ ID NO: 583863 - DNA, 25 bp, Mus musculus
catttcttccaagcatgaacccata

SEQ ID NO: 583864 - DNA, 25 bp, Mus musculus
catttcttgaatcgcttgaagaaca

SEQ ID NO: 583865 - DNA, 25 bp, Mus musculus
catttcttgaatggcttgaagaaca

SEQ ID NO: 583866 - DNA, 25 bp, Mus musculus
catttgaagggaaaactgaccgcac

SEQ ID NO: 583867 - DNA, 25 bp, Mus musculus
catttgaagggataactgaccgcac

SEQ ID NO: 583868 - DNA, 25 bp, Mus musculus
catttgaagtatcagggaggaaacc

SEQ ID NO: 583869 - DNA, 25 bp, Mus musculus
catttgaagtatgagggaggaaacc

SEQ ID NO: 583870 - DNA, 25 bp, Mus musculus
catttgaatcctagaacaggttgcc

SEQ ID NO: 583871 - DNA, 25 bp, Mus musculus
catttgaatccttgaacaggttgcc

SEQ ID NO: 583872 - DNA, 25 bp, Mus musculus
catttgaatggtaggacataaacca

SEQ ID NO: 583873 - DNA, 25 bp, Mus musculus
catttgaatggttggacataaacca

SEQ ID NO: 583874 - DNA, 25 bp, Mus musculus
catttgacagatatggcagagtggc

SEQ ID NO: 583875 - DNA, 25 bp, Mus musculus
catttgacagatttggcagagtggc

SEQ ID NO: 583876 - DNA, 25 bp, Mus musculus
catttgacatagcttcagatgcatt

SEQ ID NO: 583877 - DNA, 25 bp, Mus musculus
catttgacataggttcagatgcatt

SEQ ID NO: 583878 - DNA, 25 bp, Mus musculus
catttgacctcgaccaattaaaagg

SEQ ID NO: 583879 - DNA, 25 bp, Mus musculus
catttgacctcgtccaattaaaagg

SEQ ID NO: 583880 - DNA, 25 bp, Mus musculus
catttgacttcgctagtcggtgacg

SEQ ID NO: 583881 - DNA, 25 bp, Mus musculus
catttgacttcggtagtcggtgacg

SEQ ID NO: 583882 - DNA, 25 bp, Mus musculus
catttgacttgcatgtcttctaaaa

SEQ ID NO: 583883 - DNA, 25 bp, Mus musculus
catttgacttgcttgtcttctaaaa

SEQ ID NO: 583884 - DNA, 25 bp, Mus musculus
catttgagaagtattcggacgaagt

SEQ ID NO: 583885 - DNA, 25 bp, Mus musculus
catttgagaagttttcggacgaagt

SEQ ID NO: 583886 - DNA, 25 bp, Mus musculus
catttgagatgtacttcctggaagg

SEQ ID NO: 583887 - DNA, 25 bp, Mus musculus
catttgagatgttcttcctggaagg

SEQ ID NO: 583888 - DNA, 25 bp, Mus musculus
catttgaggaccatccagcaagatt

SEQ ID NO: 583889 - DNA, 25 bp, Mus musculus
catttgaggaccttccagcaagatt

SEQ ID NO: 583890 - DNA, 25 bp, Mus musculus
catttgagggctctgttcgtgcaag

SEQ ID NO: 583891 - DNA, 25 bp, Mus musculus
catttgagggctgtgttcgtgcaag

SEQ ID NO: 583892 - DNA, 25 bp, Mus musculus
catttgatacttcagaaggactctc

SEQ ID NO: 583893 - DNA, 25 bp, Mus musculus
catttgatacttgagaaggactctc

SEQ ID NO: 583894 - DNA, 25 bp, Mus musculus
catttgatatttctaggcactggga

SEQ ID NO: 583895 - DNA, 25 bp, Mus musculus
catttgatatttgtaggcactggga

SEQ ID NO: 583896 - DNA, 25 bp, Mus musculus
catttgatcacgcaagtgacgactg

SEQ ID NO: 583897 - DNA, 25 bp, Mus musculus
catttgatcacggaagtgacgactg

SEQ ID NO: 583898 - DNA, 25 bp, Mus musculus
catttgatgaagagcataggcatgc

SEQ ID NO: 583899 - DNA, 25 bp, Mus musculus
catttgatgaagtgcataggcatgc

SEQ ID NO: 583900 - DNA, 25 bp, Mus musculus
catttgatgcccacagtcgggaggc

SEQ ID NO: 583901 - DNA, 25 bp, Mus musculus
catttgatgccctcagtcgggaggc

SEQ ID NO: 583902 - DNA, 25 bp, Mus musculus
catttgatgggtacatcagcaggcc

SEQ ID NO: 583903 - DNA, 25 bp, Mus musculus
catttgatgggttcatcagcaggcc

SEQ ID NO: 583904 - DNA, 25 bp, Mus musculus
catttgcaaatcatcagactgcata

SEQ ID NO: 583905 - DNA, 25 bp, Mus musculus
catttgcaaatcttcagactgcata

SEQ ID NO: 583906 - DNA, 25 bp, Mus musculus
catttgcaatccatgtcgtatctgg

SEQ ID NO: 583907 - DNA, 25 bp, Mus musculus
catttgcaatccttgtcgtatctgg

SEQ ID NO: 583908 - DNA, 25 bp, Mus musculus
catttgcacttcagggattgcaaga

SEQ ID NO: 583909 - DNA, 25 bp, Mus musculus
catttgcacttctgggattgcaaga

SEQ ID NO: 583910 - DNA, 25 bp, Mus musculus
catttgcagcaactgcttcgaagca

SEQ ID NO: 583911 - DNA, 25 bp, Mus musculus
catttgcagcaagtgcttcgaagca

SEQ ID NO: 583912 - DNA, 25 bp, Mus musculus
catttgcaggcccaaggatgctgtg

SEQ ID NO: 583913 - DNA, 25 bp, Mus musculus
catttgcaggccgaaggatgctgtg

SEQ ID NO: 583914 - DNA, 25 bp, Mus musculus
catttgcagtgcatatacaggaaac

SEQ ID NO: 583915 - DNA, 25 bp, Mus musculus
catttgcagtgcttatacaggaaac

SEQ ID NO: 583916 - DNA, 25 bp, Mus musculus
catttgccagagcagcatgcattgt

SEQ ID NO: 583917 - DNA, 25 bp, Mus musculus
catttgccagaggagcatgcattgt

SEQ ID NO: 583918 - DNA, 25 bp, Mus musculus
catttgcctacaatgagacacgagg

SEQ ID NO: 583919 - DNA, 25 bp, Mus musculus
catttgcctacattgagacacgagg

SEQ ID NO: 583920 - DNA, 25 bp, Mus musculus
catttgcctactcttttgcacaggg

SEQ ID NO: 583921 - DNA, 25 bp, Mus musculus
catttgcctactgttttgcacaggg

SEQ ID NO: 583922 - DNA, 25 bp, Mus musculus
catttgcctggacctaagattttca

SEQ ID NO: 583923 - DNA, 25 bp, Mus musculus
catttgcctggagctaagattttca

SEQ ID NO: 583924 - DNA, 25 bp, Mus musculus
catttgccttgtctggccaaatact

SEQ ID NO: 583925 - DNA, 25 bp, Mus musculus
catttgccttgtgtggccaaatact

SEQ ID NO: 583926 - DNA, 25 bp, Mus musculus
catttgcgaagcagctgaaccgcac

SEQ ID NO: 583927 - DNA, 25 bp, Mus musculus
catttgcgaagctgctgaaccgcac

SEQ ID NO: 583928 - DNA, 25 bp, Mus musculus
catttgctaatccagaggctgagtg

SEQ ID NO: 583929 - DNA, 25 bp, Mus musculus
catttgctaatcgagaggctgagtg

SEQ ID NO: 583930 - DNA, 25 bp, Mus musculus
catttgctgaaaagccttggtatca

SEQ ID NO: 583931 - DNA, 25 bp, Mus musculus
catttgctgaaatgccttggtatca

SEQ ID NO: 583932 - DNA, 25 bp, Mus musculus
catttgctgaatacattttgatgga

SEQ ID NO: 583933 - DNA, 25 bp, Mus musculus
catttgctgaattcattttgatgga

SEQ ID NO: 583934 - DNA, 25 bp, Mus musculus
catttgctgcccatgaacgagacag

SEQ ID NO: 583935 - DNA, 25 bp, Mus musculus
catttgctgcccttgaacgagacag

SEQ ID NO: 583936 - DNA, 25 bp, Mus musculus
catttgctggtgcaatgagtctcga

SEQ ID NO: 583937 - DNA, 25 bp, Mus musculus
catttgctggtggaatgagtctcga

SEQ ID NO: 583938 - DNA, 25 bp, Mus musculus
catttgctgtgtctgctgtcgcctc

SEQ ID NO: 583939 - DNA, 25 bp, Mus musculus
catttgctgtgtgtgctgtcgcctc

SEQ ID NO: 583940 - DNA, 25 bp, Mus musculus
catttgctgttgcaaagtcggacag

SEQ ID NO: 583941 - DNA, 25 bp, Mus musculus
catttgctgttggaaagtcggacag

SEQ ID NO: 583942 - DNA, 25 bp, Mus musculus
catttgctttctccgagggcaaaga

SEQ ID NO: 583943 - DNA, 25 bp, Mus musculus
catttgctttctgcgagggcaaaga

SEQ ID NO: 583944 - DNA, 25 bp, Mus musculus
catttggaaaggcactcgcttttct

SEQ ID NO: 583945 - DNA, 25 bp, Mus musculus
catttggaaagggactcgcttttct

SEQ ID NO: 583946 - DNA, 25 bp, Mus musculus
catttggaagcccatttgaggagtc

SEQ ID NO: 583947 - DNA, 25 bp, Mus musculus
catttggaagccgatttgaggagtc

SEQ ID NO: 583948 - DNA, 25 bp, Mus musculus
catttggacagaatcttcgaacgcc

SEQ ID NO: 583949 - DNA, 25 bp, Mus musculus
catttggacagattcttcgaacgcc

SEQ ID NO: 583950 - DNA, 25 bp, Mus musculus
catttggacgctcctgtatctagac

SEQ ID NO: 583951 - DNA, 25 bp, Mus musculus
catttggacgctgctgtatctagac

SEQ ID NO: 583952 - DNA, 25 bp, Mus musculus
catttggagaacagctacataagcc

SEQ ID NO: 583953 - DNA, 25 bp, Mus musculus
catttggagaactgctacataagcc

SEQ ID NO: 583954 - DNA, 25 bp, Mus musculus
catttggagaagagtgctgtcttgc

SEQ ID NO: 583955 - DNA, 25 bp, Mus musculus
catttggagaagtgtgctgtcttgc

SEQ ID NO: 583956 - DNA, 25 bp, Mus musculus
catttggagccacttacagatgagc

SEQ ID NO: 583957 - DNA, 25 bp, Mus musculus
catttggagccagttacagatgagc

SEQ ID NO: 583958 - DNA, 25 bp, Mus musculus
catttggagcccagaaggaggcaga

SEQ ID NO: 583959 - DNA, 25 bp, Mus musculus
catttggagccctgaaggaggcaga

SEQ ID NO: 583960 - DNA, 25 bp, Mus musculus
catttggagctacttctcaccgacc

SEQ ID NO: 583961 - DNA, 25 bp, Mus musculus
catttggagctagttctcaccgacc

SEQ ID NO: 583962 - DNA, 25 bp, Mus musculus
catttggagctgaacgggcttcaca

SEQ ID NO: 583963 - DNA, 25 bp, Mus musculus
catttggagctgtacgggcttcaca

SEQ ID NO: 583964 - DNA, 25 bp, Mus musculus
catttggaggatagtccacgcccgt

SEQ ID NO: 583965 - DNA, 25 bp, Mus musculus
catttggaggattgtccacgcccgt

SEQ ID NO: 583966 - DNA, 25 bp, Mus musculus
catttggaggctcacgatttcctga

SEQ ID NO: 583967 - DNA, 25 bp, Mus musculus
catttggaggctgacgatttcctga

SEQ ID NO: 583968 - DNA, 25 bp, Mus musculus
catttggatcccatcaaaggaagtc

SEQ ID NO: 583969 - DNA, 25 bp, Mus musculus
catttggatcccttcaaaggaagtc

SEQ ID NO: 583970 - DNA, 25 bp, Mus musculus
catttggcacatcctactggctggt

SEQ ID NO: 583971 - DNA, 25 bp, Mus musculus
catttggcacatgctactggctggt

SEQ ID NO: 583972 - DNA, 25 bp, Mus musculus
catttggcattgagaagtatgtgcc

SEQ ID NO: 583973 - DNA, 25 bp, Mus musculus
catttggcattgtgaagtatgtgcc

SEQ ID NO: 583974 - DNA, 25 bp, Mus musculus
catttggcccatcgtgaagtcagtc

SEQ ID NO: 583975 - DNA, 25 bp, Mus musculus
catttggcccatggtgaagtcagtc

SEQ ID NO: 583976 - DNA, 25 bp, Mus musculus
catttggccttgaccaaccagcgga

SEQ ID NO: 583977 - DNA, 25 bp, Mus musculus
catttggccttgtccaaccagcgga

SEQ ID NO: 583978 - DNA, 25 bp, Mus musculus
catttggctgatcgcagcaggtagc

SEQ ID NO: 583979 - DNA, 25 bp, Mus musculus
catttggctgatggcagcaggtagc

SEQ ID NO: 583980 - DNA, 25 bp, Mus musculus
catttggctttacttacacacgtgg

SEQ ID NO: 583981 - DNA, 25 bp, Mus musculus
catttggctttagttacacacgtgg

SEQ ID NO: 583982 - DNA, 25 bp, Mus musculus
catttgggaacaaccattggcgatt

SEQ ID NO: 583983 - DNA, 25 bp, Mus musculus
catttgggaacatccattggcgatt

SEQ ID NO: 583984 - DNA, 25 bp, Mus musculus
catttgggaagtcagcgctctgcgc

SEQ ID NO: 583985 - DNA, 25 bp, Mus musculus
catttgggaagtgagcgctctgcgc

SEQ ID NO: 583986 - DNA, 25 bp, Mus musculus
catttgggaattcctacttaagtac

SEQ ID NO: 583987 - DNA, 25 bp, Mus musculus
catttgggaattgctacttaagtac

SEQ ID NO: 583988 - DNA, 25 bp, Mus musculus
catttgggcagaagtaggagacacc

SEQ ID NO: 583989 - DNA, 25 bp, Mus musculus
catttgggcagatgtaggagacacc

SEQ ID NO: 583990 - DNA, 25 bp, Mus musculus
catttgggcgtaactcaccgggagg

SEQ ID NO: 583991 - DNA, 25 bp, Mus musculus
catttgggcgtatctcaccgggagg

SEQ ID NO: 583992 - DNA, 25 bp, Mus musculus
catttgggctgtcagcttcgggccc

SEQ ID NO: 583993 - DNA, 25 bp, Mus musculus
catttgggctgtgagcttcgggccc

SEQ ID NO: 583994 - DNA, 25 bp, Mus musculus
catttggtaagtccttggttcctat

SEQ ID NO: 583995 - DNA, 25 bp, Mus musculus
catttggtaagtgcttggttcctat

SEQ ID NO: 583996 - DNA, 25 bp, Mus musculus
catttggtcctgcatccctgagcgc

SEQ ID NO: 583997 - DNA, 25 bp, Mus musculus
catttggtcctggatccctgagcgc

SEQ ID NO: 583998 - DNA, 25 bp, Mus musculus
catttggtgcctcacttcggtgatc

SEQ ID NO: 583999 - DNA, 25 bp, Mus musculus
catttggtgcctgacttcggtgatc

SEQ ID NO: 584000 - DNA, 25 bp, Mus musculus
catttggtgctacagttgtgtgtgc

SEQ ID NO: 584001 - DNA, 25 bp, Mus musculus
catttggtgctacctttcttgggac

SEQ ID NO: 584002 - DNA, 25 bp, Mus musculus
catttggtgctagagttgtgtgtgc

SEQ ID NO: 584003 - DNA, 25 bp, Mus musculus
catttggtgctagctttcttgggac

SEQ ID NO: 584004 - DNA, 25 bp, Mus musculus
catttggtggccagatcatggcatg

SEQ ID NO: 584005 - DNA, 25 bp, Mus musculus
catttggtggcctgatcatggcatg

SEQ ID NO: 584006 - DNA, 25 bp, Mus musculus
catttggtgtccactttaaagtagt

SEQ ID NO: 584007 - DNA, 25 bp, Mus musculus
catttggtgtcctctttaaagtagt

SEQ ID NO: 584008 - DNA, 25 bp, Mus musculus
catttggtgttccatcggtgattgt

SEQ ID NO: 584009 - DNA, 25 bp, Mus musculus
catttggtgttcgatcggtgattgt

SEQ ID NO: 584010 - DNA, 25 bp, Mus musculus
catttgtaatggagaagtggatcgt

SEQ ID NO: 584011 - DNA, 25 bp, Mus musculus
catttgtaatggtgaagtggatcgt

SEQ ID NO: 584012 - DNA, 25 bp, Mus musculus
catttgtacacacctgtcatcggga

SEQ ID NO: 584013 - DNA, 25 bp, Mus musculus
catttgtacacagctgtcatcggga

SEQ ID NO: 584014 - DNA, 25 bp, Mus musculus
catttgtagtagctggctccctggt

SEQ ID NO: 584015 - DNA, 25 bp, Mus musculus
catttgtagtaggtggctccctggt

SEQ ID NO: 584016 - DNA, 25 bp, Mus musculus
catttgtattctagtacatgctgac

SEQ ID NO: 584017 - DNA, 25 bp, Mus musculus
catttgtattcttgtacatgctgac

SEQ ID NO: 584018 - DNA, 25 bp, Mus musculus
catttgtccctgaggccaagtagca

SEQ ID NO: 584019 - DNA, 25 bp, Mus musculus
catttgtccctgtggccaagtagca

SEQ ID NO: 584020 - DNA, 25 bp, Mus musculus
catttgtctcagctgctggttgagc

SEQ ID NO: 584021 - DNA, 25 bp, Mus musculus
catttgtctcaggtgctggttgagc

SEQ ID NO: 584022 - DNA, 25 bp, Mus musculus
catttgtcttccctgagtcttgact

SEQ ID NO: 584023 - DNA, 25 bp, Mus musculus
catttgtcttccgtgagtcttgact

SEQ ID NO: 584024 - DNA, 25 bp, Mus musculus
catttgtgattccaactagtgggac

SEQ ID NO: 584025 - DNA, 25 bp, Mus musculus
catttgtgattcgaactagtgggac

SEQ ID NO: 584026 - DNA, 25 bp, Mus musculus
catttgtgccaactggaaaactaat

SEQ ID NO: 584027 - DNA, 25 bp, Mus musculus
catttgtgccaagtggaaaactaat

SEQ ID NO: 584028 - DNA, 25 bp, Mus musculus
catttgtgggcaaagtatgcatgga

SEQ ID NO: 584029 - DNA, 25 bp, Mus musculus
catttgtgggcatagtatgcatgga

SEQ ID NO: 584030 - DNA, 25 bp, Mus musculus
catttgtgggtacacccttctggat

SEQ ID NO: 584031 - DNA, 25 bp, Mus musculus
catttgtgggtagacccttctggat

SEQ ID NO: 584032 - DNA, 25 bp, Mus musculus
catttgtggtcaatgtggccttgat

SEQ ID NO: 584033 - DNA, 25 bp, Mus musculus
catttgtggtcattgtggccttgat

SEQ ID NO: 584034 - DNA, 25 bp, Mus musculus
catttgtggttaagccttaggcaca

SEQ ID NO: 584035 - DNA, 25 bp, Mus musculus
catttgtggttatgccttaggcaca

SEQ ID NO: 584036 - DNA, 25 bp, Mus musculus
catttgtgtagcctagagttcagcc

SEQ ID NO: 584037 - DNA, 25 bp, Mus musculus
catttgtgtagcgtagagttcagcc

SEQ ID NO: 584038 - DNA, 25 bp, Mus musculus
catttgtgtatgcatctagcgaaga

SEQ ID NO: 584039 - DNA, 25 bp, Mus musculus
catttgtgtatggatctagcgaaga

SEQ ID NO: 584040 - DNA, 25 bp, Mus musculus
catttgttcaataggaaaactggca

SEQ ID NO: 584041 - DNA, 25 bp, Mus musculus
catttgttcaattggaaaactggca

SEQ ID NO: 584042 - DNA, 25 bp, Mus musculus
catttgtttgtgagtctgggcccag

SEQ ID NO: 584043 - DNA, 25 bp, Mus musculus
catttgtttgtgtgtctgggcccag

SEQ ID NO: 584044 - DNA, 25 bp, Mus musculus
cattttaaccctcatggagcatctc

SEQ ID NO: 584045 - DNA, 25 bp, Mus musculus
cattttaaccctgatggagcatctc

SEQ ID NO: 584046 - DNA, 25 bp, Mus musculus
cattttaactgtagaaggacagcag

SEQ ID NO: 584047 - DNA, 25 bp, Mus musculus
cattttaactgttgaaggacagcag

SEQ ID NO: 584048 - DNA, 25 bp, Mus musculus
cattttaagaagagttcgagaagca

SEQ ID NO: 584049 - DNA, 25 bp, Mus musculus
cattttaagaagtgttcgagaagca

SEQ ID NO: 584050 - DNA, 25 bp, Mus musculus
cattttacagtgagactcggttgaa

SEQ ID NO: 584051 - DNA, 25 bp, Mus musculus
cattttacagtgtgactcggttgaa

SEQ ID NO: 584052 - DNA, 25 bp, Mus musculus
cattttaccatcatgactttaaaga

SEQ ID NO: 584053 - DNA, 25 bp, Mus musculus
cattttaccatcttgactttaaaga

SEQ ID NO: 584054 - DNA, 25 bp, Mus musculus
cattttacgggaacaaagtgggtct

SEQ ID NO: 584055 - DNA, 25 bp, Mus musculus
cattttacgggatcaaagtgggtct

SEQ ID NO: 584056 - DNA, 25 bp, Mus musculus
cattttactggaaatgttctcagga

SEQ ID NO: 584057 - DNA, 25 bp, Mus musculus
cattttactggatatgttctcagga

SEQ ID NO: 584058 - DNA, 25 bp, Mus musculus
cattttactgttcggtttctgaggc

SEQ ID NO: 584059 - DNA, 25 bp, Mus musculus
cattttactgttgggtttctgaggc

SEQ ID NO: 584060 - DNA, 25 bp, Mus musculus
cattttagacccacccttgtagtag

SEQ ID NO: 584061 - DNA, 25 bp, Mus musculus
cattttagaccctcccttgtagtag

SEQ ID NO: 584062 - DNA, 25 bp, Mus musculus
cattttagagcaactcgagcaacta

SEQ ID NO: 584063 - DNA, 25 bp, Mus musculus
cattttagagcatctcgagcaacta

SEQ ID NO: 584064 - DNA, 25 bp, Mus musculus
cattttataatgacgtggatgtgca

SEQ ID NO: 584065 - DNA, 25 bp, Mus musculus
cattttataatgtcgtggatgtgca

SEQ ID NO: 584066 - DNA, 25 bp, Mus musculus
cattttatgcagagaagagtatacc

SEQ ID NO: 584067 - DNA, 25 bp, Mus musculus
cattttatgcagtgaagagtatacc

SEQ ID NO: 584068 - DNA, 25 bp, Mus musculus
cattttatgccaagaagtgacagaa

SEQ ID NO: 584069 - DNA, 25 bp, Mus musculus
cattttatgccatgaagtgacagaa

SEQ ID NO: 584070 - DNA, 25 bp, Mus musculus
cattttatgtgacgaatcctgggag

SEQ ID NO: 584071 - DNA, 25 bp, Mus musculus
cattttatgtgaggaatcctgggag

SEQ ID NO: 584072 - DNA, 25 bp, Mus musculus
cattttattcctcaggccgaaatca

SEQ ID NO: 584073 - DNA, 25 bp, Mus musculus
cattttattcctgaggccgaaatca

SEQ ID NO: 584074 - DNA, 25 bp, Mus musculus
cattttatttataggaggcatggcc

SEQ ID NO: 584075 - DNA, 25 bp, Mus musculus
cattttatttattggaggcatggcc

SEQ ID NO: 584076 - DNA, 25 bp, Mus musculus
cattttcaagacactagcatcggcc

SEQ ID NO: 584077 - DNA, 25 bp, Mus musculus
cattttcaagactctagcatcggcc

SEQ ID NO: 584078 - DNA, 25 bp, Mus musculus
cattttcaagggaaaggcacaccaa

SEQ ID NO: 584079 - DNA, 25 bp, Mus musculus
cattttcaagggtaaggcacaccaa

SEQ ID NO: 584080 - DNA, 25 bp, Mus musculus
cattttcactagaggagctactgag

SEQ ID NO: 584081 - DNA, 25 bp, Mus musculus
cattttcactagtggagctactgag

SEQ ID NO: 584082 - DNA, 25 bp, Mus musculus
cattttcagcagaagacgctgcgca

SEQ ID NO: 584083 - DNA, 25 bp, Mus musculus
cattttcagcagtagacgctgcgca

SEQ ID NO: 584084 - DNA, 25 bp, Mus musculus
cattttcagcatcaatatgaagagc

SEQ ID NO: 584085 - DNA, 25 bp, Mus musculus
cattttcagcatgaatatgaagagc

SEQ ID NO: 584086 - DNA, 25 bp, Mus musculus
cattttcagggcaacatgaggacca

SEQ ID NO: 584087 - DNA, 25 bp, Mus musculus
cattttcagggctacatgaggacca

SEQ ID NO: 584088 - DNA, 25 bp, Mus musculus
cattttcataatccaggcccagggt

SEQ ID NO: 584089 - DNA, 25 bp, Mus musculus
cattttcataatgcaggcccagggt

SEQ ID NO: 584090 - DNA, 25 bp, Mus musculus
cattttcatcgcagcgctgagcgct

SEQ ID NO: 584091 - DNA, 25 bp, Mus musculus
cattttcatcgctgcgctgagcgct

SEQ ID NO: 584092 - DNA, 25 bp, Mus musculus
cattttcatgcccagcgacgggcgg

SEQ ID NO: 584093 - DNA, 25 bp, Mus musculus
cattttcatgccgagcgacgggcgg

SEQ ID NO: 584094 - DNA, 25 bp, Mus musculus
cattttccagtaccctggacctgtg

SEQ ID NO: 584095 - DNA, 25 bp, Mus musculus
cattttccagtagcctggacctgtg

SEQ ID NO: 584096 - DNA, 25 bp, Mus musculus
cattttccatggagtaatgggcaaa

SEQ ID NO: 584097 - DNA, 25 bp, Mus musculus
cattttccatggtgtaatgggcaaa

SEQ ID NO: 584098 - DNA, 25 bp, Mus musculus
cattttccgagtacacagttgtggc

SEQ ID NO: 584099 - DNA, 25 bp, Mus musculus
cattttccgagttcacagttgtggc

SEQ ID NO: 584100 - DNA, 25 bp, Mus musculus
cattttcctggtaacagaccatgat

SEQ ID NO: 584101 - DNA, 25 bp, Mus musculus
cattttcctggttacagaccatgat

SEQ ID NO: 584102 - DNA, 25 bp, Mus musculus
cattttcctttgcagaggcggctca

SEQ ID NO: 584103 - DNA, 25 bp, Mus musculus
cattttcctttggagaggcggctca

SEQ ID NO: 584104 - DNA, 25 bp, Mus musculus
cattttcgaagtccacatactaccg

SEQ ID NO: 584105 - DNA, 25 bp, Mus musculus
cattttcgaagtgcacatactaccg

SEQ ID NO: 584106 - DNA, 25 bp, Mus musculus
cattttcggcttaacggacagtgac

SEQ ID NO: 584107 - DNA, 25 bp, Mus musculus
cattttcggctttacggacagtgac

SEQ ID NO: 584108 - DNA, 25 bp, Mus musculus
cattttcggtgaacctcaattgtca

SEQ ID NO: 584109 - DNA, 25 bp, Mus musculus
cattttcggtgatcctcaattgtca

SEQ ID NO: 584110 - DNA, 25 bp, Mus musculus
cattttcgtaagaactctctgggca

SEQ ID NO: 584111 - DNA, 25 bp, Mus musculus
cattttcgtaagtactctctgggca

SEQ ID NO: 584112 - DNA, 25 bp, Mus musculus
cattttcgtgatcactgtctggaag

SEQ ID NO: 584113 - DNA, 25 bp, Mus musculus
cattttcgtgatgactgtctggaag

SEQ ID NO: 584114 - DNA, 25 bp, Mus musculus
cattttctacccaagccattggaag

SEQ ID NO: 584115 - DNA, 25 bp, Mus musculus
cattttctaccctagccattggaag

SEQ ID NO: 584116 - DNA, 25 bp, Mus musculus
cattttctacttaggctaaggacaa

SEQ ID NO: 584117 - DNA, 25 bp, Mus musculus
cattttctactttggctaaggacaa

SEQ ID NO: 584118 - DNA, 25 bp, Mus musculus
cattttctccaacggtgacctagac

SEQ ID NO: 584119 - DNA, 25 bp, Mus musculus
cattttctccaagggtgacctagac

SEQ ID NO: 584120 - DNA, 25 bp, Mus musculus
cattttctctctagcctcggattgg

SEQ ID NO: 584121 - DNA, 25 bp, Mus musculus
cattttctctcttgcctcggattgg

SEQ ID NO: 584122 - DNA, 25 bp, Mus musculus
cattttctctggcaggccacctggt

SEQ ID NO: 584123 - DNA, 25 bp, Mus musculus
cattttctctgggaggccacctggt

SEQ ID NO: 584124 - DNA, 25 bp, Mus musculus
cattttctcttgacaattttccaaa

SEQ ID NO: 584125 - DNA, 25 bp, Mus musculus
cattttctcttgtcaattttccaaa

SEQ ID NO: 584126 - DNA, 25 bp, Mus musculus
cattttctgctcctgccaagttggc

SEQ ID NO: 584127 - DNA, 25 bp, Mus musculus
cattttctgctcgtgccaagttggc

SEQ ID NO: 584128 - DNA, 25 bp, Mus musculus
cattttcttatgctctgaaccaagc

SEQ ID NO: 584129 - DNA, 25 bp, Mus musculus
cattttcttatggtctgaaccaagc

SEQ ID NO: 584130 - DNA, 25 bp, Mus musculus
cattttcttggacaacagtaccttt

SEQ ID NO: 584131 - DNA, 25 bp, Mus musculus
cattttcttggagaacagtaccttt

SEQ ID NO: 584132 - DNA, 25 bp, Mus musculus
cattttctttggagccaccatcttc

SEQ ID NO: 584133 - DNA, 25 bp, Mus musculus
cattttctttggtgccaccatcttc

SEQ ID NO: 584134 - DNA, 25 bp, Mus musculus
cattttgaaagcaaccagaggactt

SEQ ID NO: 584135 - DNA, 25 bp, Mus musculus
cattttgaaagctaccagaggactt

SEQ ID NO: 584136 - DNA, 25 bp, Mus musculus
cattttgaacagcatccgattcagt

SEQ ID NO: 584137 - DNA, 25 bp, Mus musculus
cattttgaacaggatccgattcagt

SEQ ID NO: 584138 - DNA, 25 bp, Mus musculus
cattttgacacaagaggagggctac

SEQ ID NO: 584139 - DNA, 25 bp, Mus musculus
cattttgacacatgaggagggctac

SEQ ID NO: 584140 - DNA, 25 bp, Mus musculus
cattttgacctgcacacagagacac

SEQ ID NO: 584141 - DNA, 25 bp, Mus musculus
cattttgacctggacacagagacac

SEQ ID NO: 584142 - DNA, 25 bp, Mus musculus
cattttgagagtcgccgatggcaga

SEQ ID NO: 584143 - DNA, 25 bp, Mus musculus
cattttgagagtggccgatggcaga

SEQ ID NO: 584144 - DNA, 25 bp, Mus musculus
cattttgcaaaacggaatgcatctt

SEQ ID NO: 584145 - DNA, 25 bp, Mus musculus
cattttgcaaaagggaatgcatctt

SEQ ID NO: 584146 - DNA, 25 bp, Mus musculus
cattttgcaaagaagataaagcgag

SEQ ID NO: 584147 - DNA, 25 bp, Mus musculus
cattttgcaaagtagataaagcgag

SEQ ID NO: 584148 - DNA, 25 bp, Mus musculus
cattttgcaagccagcctttttggt

SEQ ID NO: 584149 - DNA, 25 bp, Mus musculus
cattttgcaagcgagcctttttggt

SEQ ID NO: 584150 - DNA, 25 bp, Mus musculus
cattttgcagctcattacctcagca

SEQ ID NO: 584151 - DNA, 25 bp, Mus musculus
cattttgcagctgattacctcagca

SEQ ID NO: 584152 - DNA, 25 bp, Mus musculus
cattttgccataattagtcacagcc

SEQ ID NO: 584153 - DNA, 25 bp, Mus musculus
cattttgccatatttagtcacagcc

SEQ ID NO: 584154 - DNA, 25 bp, Mus musculus
cattttgcgtttagcctcttgggct

SEQ ID NO: 584155 - DNA, 25 bp, Mus musculus
cattttgcgttttgcctcttgggct

SEQ ID NO: 584156 - DNA, 25 bp, Mus musculus
cattttgcttccaaaccagagggtc

SEQ ID NO: 584157 - DNA, 25 bp, Mus musculus
cattttgcttcctaaccagagggtc

SEQ ID NO: 584158 - DNA, 25 bp, Mus musculus
cattttggaataaaggagtccctca

SEQ ID NO: 584159 - DNA, 25 bp, Mus musculus
cattttggaatataggagtccctca

SEQ ID NO: 584160 - DNA, 25 bp, Mus musculus
cattttggagaacgcaacaacatac

SEQ ID NO: 584161 - DNA, 25 bp, Mus musculus
cattttggagaaggcaacaacatac

SEQ ID NO: 584162 - DNA, 25 bp, Mus musculus
cattttggaggaagagaaccggctg

SEQ ID NO: 584163 - DNA, 25 bp, Mus musculus
cattttggaggaagccatcacggga

SEQ ID NO: 584164 - DNA, 25 bp, Mus musculus
cattttggaggatgagaaccggctg

SEQ ID NO: 584165 - DNA, 25 bp, Mus musculus
cattttggaggatgccatcacggga

SEQ ID NO: 584166 - DNA, 25 bp, Mus musculus
cattttggccagagccacatctgca

SEQ ID NO: 584167 - DNA, 25 bp, Mus musculus
cattttggccagtgccacatctgca

SEQ ID NO: 584168 - DNA, 25 bp, Mus musculus
cattttgggatgaatactaactgga

SEQ ID NO: 584169 - DNA, 25 bp, Mus musculus
cattttgggatgtatactaactgga

SEQ ID NO: 584170 - DNA, 25 bp, Mus musculus
cattttgggtggaagcgatcactga

SEQ ID NO: 584171 - DNA, 25 bp, Mus musculus
cattttgggtggtagcgatcactga

SEQ ID NO: 584172 - DNA, 25 bp, Mus musculus
cattttgtgactattctcttgccct

SEQ ID NO: 584173 - DNA, 25 bp, Mus musculus
cattttgtgacttttctcttgccct

SEQ ID NO: 584174 - DNA, 25 bp, Mus musculus
cattttgtgggacttgaagtttctc

SEQ ID NO: 584175 - DNA, 25 bp, Mus musculus
cattttgtgggagttgaagtttctc

SEQ ID NO: 584176 - DNA, 25 bp, Mus musculus
cattttgttttgaagctaggtatta

SEQ ID NO: 584177 - DNA, 25 bp, Mus musculus
cattttgttttgtagctaggtatta

SEQ ID NO: 584178 - DNA, 25 bp, Mus musculus
catttttaacatcaaccctgccaca

SEQ ID NO: 584179 - DNA, 25 bp, Mus musculus
catttttaacatgaaccctgccaca

SEQ ID NO: 584180 - DNA, 25 bp, Mus musculus
catttttagccgcttttatcatagg

SEQ ID NO: 584181 - DNA, 25 bp, Mus musculus
catttttagccggttttatcatagg

SEQ ID NO: 584182 - DNA, 25 bp, Mus musculus
catttttagtacaggccatcggcac

SEQ ID NO: 584183 - DNA, 25 bp, Mus musculus
catttttagtactggccatcggcac

SEQ ID NO: 584184 - DNA, 25 bp, Mus musculus
catttttattggcagaattgggtac

SEQ ID NO: 584185 - DNA, 25 bp, Mus musculus
catttttattgggagaattgggtac

SEQ ID NO: 584186 - DNA, 25 bp, Mus musculus
catttttccgagactcggaacagca

SEQ ID NO: 584187 - DNA, 25 bp, Mus musculus
catttttccgagtctcggaacagca

SEQ ID NO: 584188 - DNA, 25 bp, Mus musculus
catttttccgccagcagtgacgtca

SEQ ID NO: 584189 - DNA, 25 bp, Mus musculus
catttttccgcctgcagtgacgtca

SEQ ID NO: 584190 - DNA, 25 bp, Mus musculus
catttttcctatccagatatcgcag

SEQ ID NO: 584191 - DNA, 25 bp, Mus musculus
catttttcctatgcagatatcgcag

SEQ ID NO: 584192 - DNA, 25 bp, Mus musculus
catttttctggacgttttacactct

SEQ ID NO: 584193 - DNA, 25 bp, Mus musculus
catttttctggaggttttacactct

SEQ ID NO: 584194 - DNA, 25 bp, Mus musculus
catttttgaggaactgcccggagtc

SEQ ID NO: 584195 - DNA, 25 bp, Mus musculus
catttttgaggatctgcccggagtc

SEQ ID NO: 584196 - DNA, 25 bp, Mus musculus
catttttgcaataaccagtcagagg

SEQ ID NO: 584197 - DNA, 25 bp, Mus musculus
catttttgcaattaccagtcagagg

SEQ ID NO: 584198 - DNA, 25 bp, Mus musculus
catttttgcagaagtgtaatctgcc

SEQ ID NO: 584199 - DNA, 25 bp, Mus musculus
catttttgcagatgtgtaatctgcc

SEQ ID NO: 584200 - DNA, 25 bp, Mus musculus
catttttgccacctatcttcctgaa

SEQ ID NO: 584201 - DNA, 25 bp, Mus musculus
catttttgccacgtatcttcctgaa

SEQ ID NO: 584202 - DNA, 25 bp, Mus musculus
catttttggaagcaacatttaccag

SEQ ID NO: 584203 - DNA, 25 bp, Mus musculus
catttttggaaggaacatttaccag

SEQ ID NO: 584204 - DNA, 25 bp, Mus musculus
catttttgggtaataacaatcagtc

SEQ ID NO: 584205 - DNA, 25 bp, Mus musculus
catttttgggtattaacaatcagtc

SEQ ID NO: 584206 - DNA, 25 bp, Mus musculus
cattttttcttgactcacctctagg

SEQ ID NO: 584207 - DNA, 25 bp, Mus musculus
cattttttcttgtctcacctctagg

SEQ ID NO: 584208 - DNA, 25 bp, Mus musculus
cattttttggaaatgacctgctgga

SEQ ID NO: 584209 - DNA, 25 bp, Mus musculus
cattttttggaattgacctgctgga

SEQ ID NO: 584210 - DNA, 25 bp, Mus musculus
ccaaaaaaccaccatcaaagctgaa

SEQ ID NO: 584211 - DNA, 25 bp, Mus musculus
ccaaaaaaccacgatcaaagctgaa

SEQ ID NO: 584212 - DNA, 25 bp, Mus musculus
ccaaaaaagacccaatcatcaagct

SEQ ID NO: 584213 - DNA, 25 bp, Mus musculus
ccaaaaaagaccgaatcatcaagct

SEQ ID NO: 584214 - DNA, 25 bp, Mus musculus
ccaaaaaagcagaaggcaagtctct

SEQ ID NO: 584215 - DNA, 25 bp, Mus musculus
ccaaaaaagcagtaggcaagtctct

SEQ ID NO: 584216 - DNA, 25 bp, Mus musculus
ccaaaaacaatcagccccatggtgt

SEQ ID NO: 584217 - DNA, 25 bp, Mus musculus
ccaaaaacaatctgccccatggtgt

SEQ ID NO: 584218 - DNA, 25 bp, Mus musculus
ccaaaaactacgaggttgttctcag

SEQ ID NO: 584219 - DNA, 25 bp, Mus musculus
ccaaaaactacgtggttgttctcag

SEQ ID NO: 584220 - DNA, 25 bp, Mus musculus
ccaaaaagatggctgtgcagtcggt

SEQ ID NO: 584221 - DNA, 25 bp, Mus musculus
ccaaaaagatgggtgtgcagtcggt

SEQ ID NO: 584222 - DNA, 25 bp, Mus musculus
ccaaaaagctctagggaaggatgac

SEQ ID NO: 584223 - DNA, 25 bp, Mus musculus
ccaaaaagctcttgggaaggatgac

SEQ ID NO: 584224 - DNA, 25 bp, Mus musculus
ccaaaaaggatgatgatgtccagat

SEQ ID NO: 584225 - DNA, 25 bp, Mus musculus
ccaaaaaggatgttgatgtccagat

SEQ ID NO: 584226 - DNA, 25 bp, Mus musculus
ccaaaaatgaggagagggcaggtct

SEQ ID NO: 584227 - DNA, 25 bp, Mus musculus
ccaaaaatgaggtgagggcaggtct

SEQ ID NO: 584228 - DNA, 25 bp, Mus musculus
ccaaaacagatgagctaggtgttca

SEQ ID NO: 584229 - DNA, 25 bp, Mus musculus
ccaaaacagatgtgctaggtgttca

SEQ ID NO: 584230 - DNA, 25 bp, Mus musculus
ccaaaacatggaacgaagtctcagg

SEQ ID NO: 584231 - DNA, 25 bp, Mus musculus
ccaaaacatggatcgaagtctcagg

SEQ ID NO: 584232 - DNA, 25 bp, Mus musculus
ccaaaacattttccagtagcctgga

SEQ ID NO: 584233 - DNA, 25 bp, Mus musculus
ccaaaacattttgcagtagcctgga

SEQ ID NO: 584234 - DNA, 25 bp, Mus musculus
ccaaaaccgtgccttgtggaaatga

SEQ ID NO: 584235 - DNA, 25 bp, Mus musculus
ccaaaaccgtgcgttgtggaaatga

SEQ ID NO: 584236 - DNA, 25 bp, Mus musculus
ccaaaactcagaatagaagactaag

SEQ ID NO: 584237 - DNA, 25 bp, Mus musculus
ccaaaactcagattagaagactaag

SEQ ID NO: 584238 - DNA, 25 bp, Mus musculus
ccaaaagaaccactgatcagcgggt

SEQ ID NO: 584239 - DNA, 25 bp, Mus musculus
ccaaaagaaccagtgatcagcgggt

SEQ ID NO: 584240 - DNA, 25 bp, Mus musculus
ccaaaagagaatagatgtcctcaga

SEQ ID NO: 584241 - DNA, 25 bp, Mus musculus
ccaaaagagaattgatgtcctcaga

SEQ ID NO: 584242 - DNA, 25 bp, Mus musculus
ccaaaagattgaccagtgtgactac

SEQ ID NO: 584243 - DNA, 25 bp, Mus musculus
ccaaaagattgagcagtgtgactac

SEQ ID NO: 584244 - DNA, 25 bp, Mus musculus
ccaaaagcaagaaatcaccgattgg

SEQ ID NO: 584245 - DNA, 25 bp, Mus musculus
ccaaaagcaagatatcaccgattgg

SEQ ID NO: 584246 - DNA, 25 bp, Mus musculus
ccaaaagccaaccacagtcacagtg

SEQ ID NO: 584247 - DNA, 25 bp, Mus musculus
ccaaaagccaacgacagtcacagtg

SEQ ID NO: 584248 - DNA, 25 bp, Mus musculus
ccaaaagcgtctcagaagaaagtgg

SEQ ID NO: 584249 - DNA, 25 bp, Mus musculus
ccaaaagcgtctgagaagaaagtgg

SEQ ID NO: 584250 - DNA, 25 bp, Mus musculus
ccaaaaggagccaatcccacgagag

SEQ ID NO: 584251 - DNA, 25 bp, Mus musculus
ccaaaaggagcctatcccacgagag

SEQ ID NO: 584252 - DNA, 25 bp, Mus musculus
ccaaaagtcagccatgtttgagaag

SEQ ID NO: 584253 - DNA, 25 bp, Mus musculus
ccaaaagtcagcgatgtttgagaag

SEQ ID NO: 584254 - DNA, 25 bp, Mus musculus
ccaaaagtccctccctatgaattat

SEQ ID NO: 584255 - DNA, 25 bp, Mus musculus
ccaaaagtccctgcctatgaattat

SEQ ID NO: 584256 - DNA, 25 bp, Mus musculus
ccaaaatagaggaagcatgcgagat

SEQ ID NO: 584257 - DNA, 25 bp, Mus musculus
ccaaaatagaggtagcatgcgagat

SEQ ID NO: 584258 - DNA, 25 bp, Mus musculus
ccaaaatcacagacatcaccaggaa

SEQ ID NO: 584259 - DNA, 25 bp, Mus musculus
ccaaaatcacagtcatcaccaggaa

SEQ ID NO: 584260 - DNA, 25 bp, Mus musculus
ccaaaatccggacaacgaagcggct

SEQ ID NO: 584261 - DNA, 25 bp, Mus musculus
ccaaaatccggagaacgaagcggct

SEQ ID NO: 584262 - DNA, 25 bp, Mus musculus
ccaaaatccttcagggagaacaagt

SEQ ID NO: 584263 - DNA, 25 bp, Mus musculus
ccaaaatccttctgggagaacaagt

SEQ ID NO: 584264 - DNA, 25 bp, Mus musculus
ccaaaatcctttcaggaggtacagt

SEQ ID NO: 584265 - DNA, 25 bp, Mus musculus
ccaaaatcctttgaggaggtacagt

SEQ ID NO: 584266 - DNA, 25 bp, Mus musculus
ccaaaatgacagagctctaccagtc

SEQ ID NO: 584267 - DNA, 25 bp, Mus musculus
ccaaaatgacagtgctctaccagtc

SEQ ID NO: 584268 - DNA, 25 bp, Mus musculus
ccaaaatgatgaaagagaattgacc

SEQ ID NO: 584269 - DNA, 25 bp, Mus musculus
ccaaaatgatgatagagaattgacc

SEQ ID NO: 584270 - DNA, 25 bp, Mus musculus
ccaaaatgatgcaaatcaacctgac

SEQ ID NO: 584271 - DNA, 25 bp, Mus musculus
ccaaaatgatgctaatcaacctgac

SEQ ID NO: 584272 - DNA, 25 bp, Mus musculus
ccaaaatgccggaggagtggtagta

SEQ ID NO: 584273 - DNA, 25 bp, Mus musculus
ccaaaatgccggtggagtggtagta

SEQ ID NO: 584274 - DNA, 25 bp, Mus musculus
ccaaaatggcctcggttctgtggga

SEQ ID NO: 584275 - DNA, 25 bp, Mus musculus
ccaaaatggcctgggttctgtggga

SEQ ID NO: 584276 - DNA, 25 bp, Mus musculus
ccaaaatggtcaaatagtaggcagc

SEQ ID NO: 584277 - DNA, 25 bp, Mus musculus
ccaaaatggtcatatagtaggcagc

SEQ ID NO: 584278 - DNA, 25 bp, Mus musculus
ccaaaatggtgacatgattgaccca

SEQ ID NO: 584279 - DNA, 25 bp, Mus musculus
ccaaaatggtgagatgattgaccca

SEQ ID NO: 584280 - DNA, 25 bp, Mus musculus
ccaaaattagaaagatggctccctt

SEQ ID NO: 584281 - DNA, 25 bp, Mus musculus
ccaaaattagaatgatggctccctt

SEQ ID NO: 584282 - DNA, 25 bp, Mus musculus
ccaaacaaattcaggattcagtagc

SEQ ID NO: 584283 - DNA, 25 bp, Mus musculus
ccaaacaaattctggattcagtagc

SEQ ID NO: 584284 - DNA, 25 bp, Mus musculus
ccaaacaagcagatcccattgtaga

SEQ ID NO: 584285 - DNA, 25 bp, Mus musculus
ccaaacaagcagttcccattgtaga

SEQ ID NO: 584286 - DNA, 25 bp, Mus musculus
ccaaacaagccactgacaacggagc

SEQ ID NO: 584287 - DNA, 25 bp, Mus musculus
ccaaacaagccagtgacaacggagc

SEQ ID NO: 584288 - DNA, 25 bp, Mus musculus
ccaaacaaggtgatttatgggaaat

SEQ ID NO: 584289 - DNA, 25 bp, Mus musculus
ccaaacaaggtgttttatgggaaat

SEQ ID NO: 584290 - DNA, 25 bp, Mus musculus
ccaaacaatctgatgttcaattaca

SEQ ID NO: 584291 - DNA, 25 bp, Mus musculus
ccaaacaatctgttgttcaattaca

SEQ ID NO: 584292 - DNA, 25 bp, Mus musculus
ccaaacactctcctgattggataca

SEQ ID NO: 584293 - DNA, 25 bp, Mus musculus
ccaaacactctcgtgattggataca

SEQ ID NO: 584294 - DNA, 25 bp, Mus musculus
ccaaacaggaatagattgataagct

SEQ ID NO: 584295 - DNA, 25 bp, Mus musculus
ccaaacaggaattgattgataagct

SEQ ID NO: 584296 - DNA, 25 bp, Mus musculus
ccaaacatcatgaccctgaacaaga

SEQ ID NO: 584297 - DNA, 25 bp, Mus musculus
ccaaacatcatgtccctgaacaaga

SEQ ID NO: 584298 - DNA, 25 bp, Mus musculus
ccaaaccaagtgcaaagtctatcta

SEQ ID NO: 584299 - DNA, 25 bp, Mus musculus
ccaaaccaagtggaaagtctatcta

SEQ ID NO: 584300 - DNA, 25 bp, Mus musculus
ccaaaccacagaaggcctggctggg

SEQ ID NO: 584301 - DNA, 25 bp, Mus musculus
ccaaaccacagatggcctggctggg

SEQ ID NO: 584302 - DNA, 25 bp, Mus musculus
ccaaaccacgatcgctgggtggcaa

SEQ ID NO: 584303 - DNA, 25 bp, Mus musculus
ccaaaccacgatggctgggtggcaa

SEQ ID NO: 584304 - DNA, 25 bp, Mus musculus
ccaaaccagcccaaagtccaggtgc

SEQ ID NO: 584305 - DNA, 25 bp, Mus musculus
ccaaaccagccctaagtccaggtgc

SEQ ID NO: 584306 - DNA, 25 bp, Mus musculus
ccaaaccagttcagcctctatacgt

SEQ ID NO: 584307 - DNA, 25 bp, Mus musculus
ccaaaccagttctgcctctatacgt

SEQ ID NO: 584308 - DNA, 25 bp, Mus musculus
ccaaacccatttctggaggacgaca

SEQ ID NO: 584309 - DNA, 25 bp, Mus musculus
ccaaacccatttgtggaggacgaca

SEQ ID NO: 584310 - DNA, 25 bp, Mus musculus
ccaaacctacaaaacaaaatgtgca

SEQ ID NO: 584311 - DNA, 25 bp, Mus musculus
ccaaacctacaatacaaaatgtgca

SEQ ID NO: 584312 - DNA, 25 bp, Mus musculus
ccaaacctatctaccatcaggaatc

SEQ ID NO: 584313 - DNA, 25 bp, Mus musculus
ccaaacctatcttccatcaggaatc

SEQ ID NO: 584314 - DNA, 25 bp, Mus musculus
ccaaacctgaaaacattctgcaact

SEQ ID NO: 584315 - DNA, 25 bp, Mus musculus
ccaaacctgaaatcattctgcaact

SEQ ID NO: 584316 - DNA, 25 bp, Mus musculus
ccaaacctgacaaggctgtatccat

SEQ ID NO: 584317 - DNA, 25 bp, Mus musculus
ccaaacctgacatggctgtatccat

SEQ ID NO: 584318 - DNA, 25 bp, Mus musculus
ccaaaccttgtgcacatggcggcac

SEQ ID NO: 584319 - DNA, 25 bp, Mus musculus
ccaaaccttgtggacatggcggcac

SEQ ID NO: 584320 - DNA, 25 bp, Mus musculus
ccaaacgactttcgggagactcctg

SEQ ID NO: 584321 - DNA, 25 bp, Mus musculus
ccaaacgactttggggagactcctg

SEQ ID NO: 584322 - DNA, 25 bp, Mus musculus
ccaaacgcagcactcttaagtctcg

SEQ ID NO: 584323 - DNA, 25 bp, Mus musculus
ccaaacgcagcagtcttaagtctcg

SEQ ID NO: 584324 - DNA, 25 bp, Mus musculus
ccaaacggagcacggagatatcttt

SEQ ID NO: 584325 - DNA, 25 bp, Mus musculus
ccaaacggagcagggagatatcttt

SEQ ID NO: 584326 - DNA, 25 bp, Mus musculus
ccaaacgttggaatgtaaaatgtgc

SEQ ID NO: 584327 - DNA, 25 bp, Mus musculus
ccaaacgttggattgtaaaatgtgc

SEQ ID NO: 584328 - DNA, 25 bp, Mus musculus
ccaaacgtttccctgctgagcggca

SEQ ID NO: 584329 - DNA, 25 bp, Mus musculus
ccaaacgtttccgtgctgagcggca

SEQ ID NO: 584330 - DNA, 25 bp, Mus musculus
ccaaactaactccatggtgaccctg

SEQ ID NO: 584331 - DNA, 25 bp, Mus musculus
ccaaactaactcgatggtgaccctg

SEQ ID NO: 584332 - DNA, 25 bp, Mus musculus
ccaaactagatgagtgggaagagaa

SEQ ID NO: 584333 - DNA, 25 bp, Mus musculus
ccaaactagatgtgtgggaagagaa

SEQ ID NO: 584334 - DNA, 25 bp, Mus musculus
ccaaactaggttccgtggcagaaga

SEQ ID NO: 584335 - DNA, 25 bp, Mus musculus
ccaaactaggttgcgtggcagaaga

SEQ ID NO: 584336 - DNA, 25 bp, Mus musculus
ccaaactagtttctgggaacagcac

SEQ ID NO: 584337 - DNA, 25 bp, Mus musculus
ccaaactagtttgtgggaacagcac

SEQ ID NO: 584338 - DNA, 25 bp, Mus musculus
ccaaactcgagccactggacagtaa

SEQ ID NO: 584339 - DNA, 25 bp, Mus musculus
ccaaactcgagcgactggacagtaa

SEQ ID NO: 584340 - DNA, 25 bp, Mus musculus
ccaaactcgcataatgagcaggtca

SEQ ID NO: 584341 - DNA, 25 bp, Mus musculus
ccaaactcgcattatgagcaggtca

SEQ ID NO: 584342 - DNA, 25 bp, Mus musculus
ccaaactctcgaatcaaaggtgcaa

SEQ ID NO: 584343 - DNA, 25 bp, Mus musculus
ccaaactctcgattcaaaggtgcaa

SEQ ID NO: 584344 - DNA, 25 bp, Mus musculus
ccaaactgagcaacacagaaaagaa

SEQ ID NO: 584345 - DNA, 25 bp, Mus musculus
ccaaactgagcaatttgatgctgtc

SEQ ID NO: 584346 - DNA, 25 bp, Mus musculus
ccaaactgagcatcacagaaaagaa

SEQ ID NO: 584347 - DNA, 25 bp, Mus musculus
ccaaactgagcattttgatgctgtc

SEQ ID NO: 584348 - DNA, 25 bp, Mus musculus
ccaaactgcagtagctctgttgtca

SEQ ID NO: 584349 - DNA, 25 bp, Mus musculus
ccaaactgcagttgctctgttgtca

SEQ ID NO: 584350 - DNA, 25 bp, Mus musculus
ccaaactggaccagcagcagggaca

SEQ ID NO: 584351 - DNA, 25 bp, Mus musculus
ccaaactggacctgcagcagggaca

SEQ ID NO: 584352 - DNA, 25 bp, Mus musculus
ccaaactggtgtccgtcttcttgtt

SEQ ID NO: 584353 - DNA, 25 bp, Mus musculus
ccaaactggtgtgcgtcttcttgtt

SEQ ID NO: 584354 - DNA, 25 bp, Mus musculus
ccaaactgttgtcaatagttatcag

SEQ ID NO: 584355 - DNA, 25 bp, Mus musculus
ccaaactgttgtgaatagttatcag

SEQ ID NO: 584356 - DNA, 25 bp, Mus musculus
ccaaagaaatatccagttataagca

SEQ ID NO: 584357 - DNA, 25 bp, Mus musculus
ccaaagaaatatgcagttataagca

SEQ ID NO: 584358 - DNA, 25 bp, Mus musculus
ccaaagaaatgactcgagccatggg

SEQ ID NO: 584359 - DNA, 25 bp, Mus musculus
ccaaagaaatgagtcgagccatggg

SEQ ID NO: 584360 - DNA, 25 bp, Mus musculus
ccaaagaaccgtaagtgcaggttca

SEQ ID NO: 584361 - DNA, 25 bp, Mus musculus
ccaaagaaccgttagtgcaggttca

SEQ ID NO: 584362 - DNA, 25 bp, Mus musculus
ccaaagaagaaacgctgcagtaatg

SEQ ID NO: 584363 - DNA, 25 bp, Mus musculus
ccaaagaagaaaggctgcagtaatg

SEQ ID NO: 584364 - DNA, 25 bp, Mus musculus
ccaaagaagccgcatggacaatcag

SEQ ID NO: 584365 - DNA, 25 bp, Mus musculus
ccaaagaagccggatggacaatcag

SEQ ID NO: 584366 - DNA, 25 bp, Mus musculus
ccaaagaaggcaaggtgaatatttg

SEQ ID NO: 584367 - DNA, 25 bp, Mus musculus
ccaaagaaggcatggtgaatatttg

SEQ ID NO: 584368 - DNA, 25 bp, Mus musculus
ccaaagaagggcatgggctcgccca

SEQ ID NO: 584369 - DNA, 25 bp, Mus musculus
ccaaagaagggcttgggctcgccca

SEQ ID NO: 584370 - DNA, 25 bp, Mus musculus
ccaaagaatcttcggagatggacac

SEQ ID NO: 584371 - DNA, 25 bp, Mus musculus
ccaaagaatcttgggagatggacac

SEQ ID NO: 584372 - DNA, 25 bp, Mus musculus
ccaaagaatggcctggaagagaact

SEQ ID NO: 584373 - DNA, 25 bp, Mus musculus
ccaaagaatggcgtggaagagaact

SEQ ID NO: 584374 - DNA, 25 bp, Mus musculus
ccaaagacatcgaggagaattattt

SEQ ID NO: 584375 - DNA, 25 bp, Mus musculus
ccaaagacatcgtggagaattattt

SEQ ID NO: 584376 - DNA, 25 bp, Mus musculus
ccaaagacccagaggctcctcggag

SEQ ID NO: 584377 - DNA, 25 bp, Mus musculus
ccaaagacccagtggctcctcggag

SEQ ID NO: 584378 - DNA, 25 bp, Mus musculus
ccaaagaccgagagacacgaccctt

SEQ ID NO: 584379 - DNA, 25 bp, Mus musculus
ccaaagaccgagtgacacgaccctt

SEQ ID NO: 584380 - DNA, 25 bp, Mus musculus
ccaaagacggcaatgtactgcttca

SEQ ID NO: 584381 - DNA, 25 bp, Mus musculus
ccaaagacggcattgtactgcttca

SEQ ID NO: 584382 - DNA, 25 bp, Mus musculus
ccaaagagaggcactgtggagagct

SEQ ID NO: 584383 - DNA, 25 bp, Mus musculus
ccaaagagaggctctgtggagagct

SEQ ID NO: 584384 - DNA, 25 bp, Mus musculus
ccaaagagatggagggcaatgacaa

SEQ ID NO: 584385 - DNA, 25 bp, Mus musculus
ccaaagagatggctgccttgttccc

SEQ ID NO: 584386 - DNA, 25 bp, Mus musculus
ccaaagagatgggtgccttgttccc

SEQ ID NO: 584387 - DNA, 25 bp, Mus musculus
ccaaagagatggtgggcaatgacaa

SEQ ID NO: 584388 - DNA, 25 bp, Mus musculus
ccaaagagcctgaggcagccatcaa

SEQ ID NO: 584389 - DNA, 25 bp, Mus musculus
ccaaagagcctgtggcagccatcaa

SEQ ID NO: 584390 - DNA, 25 bp, Mus musculus
ccaaagagctccagctggcagcagt

SEQ ID NO: 584391 - DNA, 25 bp, Mus musculus
ccaaagagctcctgctggcagcagt

SEQ ID NO: 584392 - DNA, 25 bp, Mus musculus
ccaaagagcttgatgaacgagtaac

SEQ ID NO: 584393 - DNA, 25 bp, Mus musculus
ccaaagagcttgttgaacgagtaac

SEQ ID NO: 584394 - DNA, 25 bp, Mus musculus
ccaaagaggagaactgtactttgca

SEQ ID NO: 584395 - DNA, 25 bp, Mus musculus
ccaaagaggagatctgtactttgca

SEQ ID NO: 584396 - DNA, 25 bp, Mus musculus
ccaaagaggtgtatcagcaacagca

SEQ ID NO: 584397 - DNA, 25 bp, Mus musculus
ccaaagaggtgtttcagcaacagca

SEQ ID NO: 584398 - DNA, 25 bp, Mus musculus
ccaaagagtcgcactttgttcgaat

SEQ ID NO: 584399 - DNA, 25 bp, Mus musculus
ccaaagagtcgctctttgttcgaat

SEQ ID NO: 584400 - DNA, 25 bp, Mus musculus
ccaaagagtgaacttcgggcaaagt

SEQ ID NO: 584401 - DNA, 25 bp, Mus musculus
ccaaagagtgaagttcgggcaaagt

SEQ ID NO: 584402 - DNA, 25 bp, Mus musculus
ccaaagatcaggatcatcactcaga

SEQ ID NO: 584403 - DNA, 25 bp, Mus musculus
ccaaagatcaggttcatcactcaga

SEQ ID NO: 584404 - DNA, 25 bp, Mus musculus
ccaaagatcccgcacaagcagttag

SEQ ID NO: 584405 - DNA, 25 bp, Mus musculus
ccaaagatcccggacaagcagttag

SEQ ID NO: 584406 - DNA, 25 bp, Mus musculus
ccaaagatgatcaccgtgttgcaac

SEQ ID NO: 584407 - DNA, 25 bp, Mus musculus
ccaaagatgatctccgtgttgcaac

SEQ ID NO: 584408 - DNA, 25 bp, Mus musculus
ccaaagatgcctaccgagcagtgaa

SEQ ID NO: 584409 - DNA, 25 bp, Mus musculus
ccaaagatgccttccgagcagtgaa

SEQ ID NO: 584410 - DNA, 25 bp, Mus musculus
ccaaagatgctgaggctattaccaa

SEQ ID NO: 584411 - DNA, 25 bp, Mus musculus
ccaaagatgctgtggctattaccaa

SEQ ID NO: 584412 - DNA, 25 bp, Mus musculus
ccaaagatggaacccaaaggtgatg

SEQ ID NO: 584413 - DNA, 25 bp, Mus musculus
ccaaagatggaagccaaaggtgatg

SEQ ID NO: 584414 - DNA, 25 bp, Mus musculus
ccaaagatgtctcggaaatccctcg

SEQ ID NO: 584415 - DNA, 25 bp, Mus musculus
ccaaagatgtctgggaaatccctcg

SEQ ID NO: 584416 - DNA, 25 bp, Mus musculus
ccaaagattccgacttggtggaagc

SEQ ID NO: 584417 - DNA, 25 bp, Mus musculus
ccaaagattccgtcttggtggaagc

SEQ ID NO: 584418 - DNA, 25 bp, Mus musculus
ccaaagatttatctgcaccgcctca

SEQ ID NO: 584419 - DNA, 25 bp, Mus musculus
ccaaagatttatgtgcaccgcctca

SEQ ID NO: 584420 - DNA, 25 bp, Mus musculus
ccaaagcaagttaatgtagacaaat

SEQ ID NO: 584421 - DNA, 25 bp, Mus musculus
ccaaagcaagtttatgtagacaaat

SEQ ID NO: 584422 - DNA, 25 bp, Mus musculus
ccaaagcactctccaccaggatagt

SEQ ID NO: 584423 - DNA, 25 bp, Mus musculus
ccaaagcactctgcaccaggatagt

SEQ ID NO: 584424 - DNA, 25 bp, Mus musculus
ccaaagcagagaccgggaaatagaa

SEQ ID NO: 584425 - DNA, 25 bp, Mus musculus
ccaaagcagagagcgggaaatagaa

SEQ ID NO: 584426 - DNA, 25 bp, Mus musculus
ccaaagcagattacctaaggccact

SEQ ID NO: 584427 - DNA, 25 bp, Mus musculus
ccaaagcagatttcctaaggccact

SEQ ID NO: 584428 - DNA, 25 bp, Mus musculus
ccaaagccacggattggtgtagcca

SEQ ID NO: 584429 - DNA, 25 bp, Mus musculus
ccaaagccacggtttggtgtagcca

SEQ ID NO: 584430 - DNA, 25 bp, Mus musculus
ccaaagccactcagaaggtgcagct

SEQ ID NO: 584431 - DNA, 25 bp, Mus musculus
ccaaagccactctgaaggtgcagct

SEQ ID NO: 584432 - DNA, 25 bp, Mus musculus
ccaaagccctgaaatatcatatctg

SEQ ID NO: 584433 - DNA, 25 bp, Mus musculus
ccaaagccctgatatatcatatctg

SEQ ID NO: 584434 - DNA, 25 bp, Mus musculus
ccaaagccctggaggatgctggtgt

SEQ ID NO: 584435 - DNA, 25 bp, Mus musculus
ccaaagccctggtggatgctggtgt

SEQ ID NO: 584436 - DNA, 25 bp, Mus musculus
ccaaagccggacagggcatgctcgg

SEQ ID NO: 584437 - DNA, 25 bp, Mus musculus
ccaaagccggactgggcatgctcgg

SEQ ID NO: 584438 - DNA, 25 bp, Mus musculus
ccaaagcgatagcaaactgcggcct

SEQ ID NO: 584439 - DNA, 25 bp, Mus musculus
ccaaagcgataggaaactgcggcct

SEQ ID NO: 584440 - DNA, 25 bp, Mus musculus
ccaaagctacgtccgcttcgtggag

SEQ ID NO: 584441 - DNA, 25 bp, Mus musculus
ccaaagctacgtgcgcttcgtggag

SEQ ID NO: 584442 - DNA, 25 bp, Mus musculus
ccaaagctatacatcaaggtggatg

SEQ ID NO: 584443 - DNA, 25 bp, Mus musculus
ccaaagctatacttcaaggtggatg

SEQ ID NO: 584444 - DNA, 25 bp, Mus musculus
ccaaagctatgaaattgggaagatg

SEQ ID NO: 584445 - DNA, 25 bp, Mus musculus
ccaaagctatgatattgggaagatg

SEQ ID NO: 584446 - DNA, 25 bp, Mus musculus
ccaaagctctatattccaaggaaga

SEQ ID NO: 584447 - DNA, 25 bp, Mus musculus
ccaaagctctattttccaaggaaga

SEQ ID NO: 584448 - DNA, 25 bp, Mus musculus
ccaaagctgaggctgctggctcgct

SEQ ID NO: 584449 - DNA, 25 bp, Mus musculus
ccaaagctgagggtgctggctcgct

SEQ ID NO: 584450 - DNA, 25 bp, Mus musculus
ccaaagctggcacggaggaaacaat

SEQ ID NO: 584451 - DNA, 25 bp, Mus musculus
ccaaagctggcagggaggaaacaat

SEQ ID NO: 584452 - DNA, 25 bp, Mus musculus
ccaaagctggccagggtatcccggc

SEQ ID NO: 584453 - DNA, 25 bp, Mus musculus
ccaaagctggcctgggtatcccggc

SEQ ID NO: 584454 - DNA, 25 bp, Mus musculus
ccaaagctgttaaagtgtcatctga

SEQ ID NO: 584455 - DNA, 25 bp, Mus musculus
ccaaagctgttatagtgtcatctga

SEQ ID NO: 584456 - DNA, 25 bp, Mus musculus
ccaaaggaaaatcctggcagaggac

SEQ ID NO: 584457 - DNA, 25 bp, Mus musculus
ccaaaggaaaatgctggcagaggac

SEQ ID NO: 584458 - DNA, 25 bp, Mus musculus
ccaaaggaagatctcttgtctgctc

SEQ ID NO: 584459 - DNA, 25 bp, Mus musculus
ccaaaggaagatgtcttgtctgctc

SEQ ID NO: 584460 - DNA, 25 bp, Mus musculus
ccaaaggaatttaaattaggacatg

SEQ ID NO: 584461 - DNA, 25 bp, Mus musculus
ccaaaggaattttaattaggacatg

SEQ ID NO: 584462 - DNA, 25 bp, Mus musculus
ccaaaggacataaaatggcatttta

SEQ ID NO: 584463 - DNA, 25 bp, Mus musculus
ccaaaggacatataatggcatttta

SEQ ID NO: 584464 - DNA, 25 bp, Mus musculus
ccaaaggacatgacatttttacgct

SEQ ID NO: 584465 - DNA, 25 bp, Mus musculus
ccaaaggacatgtcatttttacgct

SEQ ID NO: 584466 - DNA, 25 bp, Mus musculus
ccaaaggagcaaagatcactcacca

SEQ ID NO: 584467 - DNA, 25 bp, Mus musculus
ccaaaggagcaatgatcactcacca

SEQ ID NO: 584468 - DNA, 25 bp, Mus musculus
ccaaaggagcagagactggcagcgt

SEQ ID NO: 584469 - DNA, 25 bp, Mus musculus
ccaaaggagcagtgactggcagcgt

SEQ ID NO: 584470 - DNA, 25 bp, Mus musculus
ccaaaggagctgctccagagagcga

SEQ ID NO: 584471 - DNA, 25 bp, Mus musculus
ccaaaggagctggtccagagagcga

SEQ ID NO: 584472 - DNA, 25 bp, Mus musculus
ccaaaggaggaaccgtgaaagctgc

SEQ ID NO: 584473 - DNA, 25 bp, Mus musculus
ccaaaggaggaagcgtgaaagctgc

SEQ ID NO: 584474 - DNA, 25 bp, Mus musculus
ccaaaggagtggatatcatattctc

SEQ ID NO: 584475 - DNA, 25 bp, Mus musculus
ccaaaggagtggttatcatattctc

SEQ ID NO: 584476 - DNA, 25 bp, Mus musculus
ccaaaggctgccacagaagggcgat

SEQ ID NO: 584477 - DNA, 25 bp, Mus musculus
ccaaaggctgcctcagaagggcgat

SEQ ID NO: 584478 - DNA, 25 bp, Mus musculus
ccaaagggatcccagtgatgggcca

SEQ ID NO: 584479 - DNA, 25 bp, Mus musculus
ccaaagggatccgagtgatgggcca

SEQ ID NO: 584480 - DNA, 25 bp, Mus musculus
ccaaagggcacacgtttctaggagg

SEQ ID NO: 584481 - DNA, 25 bp, Mus musculus
ccaaagggcacaggtttctaggagg

SEQ ID NO: 584482 - DNA, 25 bp, Mus musculus
ccaaaggtcaccctacaggagatgc

SEQ ID NO: 584483 - DNA, 25 bp, Mus musculus
ccaaaggtcaccgtacaggagatgc

SEQ ID NO: 584484 - DNA, 25 bp, Mus musculus
ccaaaggtcagaatgggcaggcagc

SEQ ID NO: 584485 - DNA, 25 bp, Mus musculus
ccaaaggtcagattgggcaggcagc

SEQ ID NO: 584486 - DNA, 25 bp, Mus musculus
ccaaaggtgtacagccgggcattgt

SEQ ID NO: 584487 - DNA, 25 bp, Mus musculus
ccaaaggtgtactgccgggcattgt

SEQ ID NO: 584488 - DNA, 25 bp, Mus musculus
ccaaagtcgccaccgggaattttcg

SEQ ID NO: 584489 - DNA, 25 bp, Mus musculus
ccaaagtcgccagcgggaattttcg

SEQ ID NO: 584490 - DNA, 25 bp, Mus musculus
ccaaagtgctgtacgtgcaggtagt

SEQ ID NO: 584491 - DNA, 25 bp, Mus musculus
ccaaagtgctgttcgtgcaggtagt

SEQ ID NO: 584492 - DNA, 25 bp, Mus musculus
ccaaagtggagaaatacgagatctc

SEQ ID NO: 584493 - DNA, 25 bp, Mus musculus
ccaaagtggagatatacgagatctc

SEQ ID NO: 584494 - DNA, 25 bp, Mus musculus
ccaaagtgtcaacgtttctgaggcc

SEQ ID NO: 584495 - DNA, 25 bp, Mus musculus
ccaaagtgtcaaggtttctgaggcc

SEQ ID NO: 584496 - DNA, 25 bp, Mus musculus
ccaaagtgtgtaattagacacgact

SEQ ID NO: 584497 - DNA, 25 bp, Mus musculus
ccaaagtgtgtacctgttggccctg

SEQ ID NO: 584498 - DNA, 25 bp, Mus musculus
ccaaagtgtgtagctgttggccctg

SEQ ID NO: 584499 - DNA, 25 bp, Mus musculus
ccaaagtgtgtatttagacacgact

SEQ ID NO: 584500 - DNA, 25 bp, Mus musculus
ccaaagtgtttcagaaaagctgcac

SEQ ID NO: 584501 - DNA, 25 bp, Mus musculus
ccaaagtgtttctgaaaagctgcac

SEQ ID NO: 584502 - DNA, 25 bp, Mus musculus
ccaaagttctctccaggaatgaaga

SEQ ID NO: 584503 - DNA, 25 bp, Mus musculus
ccaaagttctctgcaggaatgaaga

SEQ ID NO: 584504 - DNA, 25 bp, Mus musculus
ccaaagttgtagcacttagtaataa

SEQ ID NO: 584505 - DNA, 25 bp, Mus musculus
ccaaagttgtaggacttagtaataa

SEQ ID NO: 584506 - DNA, 25 bp, Mus musculus
ccaaagttgtccctgttagagcaga

SEQ ID NO: 584507 - DNA, 25 bp, Mus musculus
ccaaagttgtccgtgttagagcaga

SEQ ID NO: 584508 - DNA, 25 bp, Mus musculus
ccaaagtttgcacgaaagaatatga

SEQ ID NO: 584509 - DNA, 25 bp, Mus musculus
ccaaagtttgcaggaaagaatatga

SEQ ID NO: 584510 - DNA, 25 bp, Mus musculus
ccaaataactgcagtggagtaagaa

SEQ ID NO: 584511 - DNA, 25 bp, Mus musculus
ccaaataactgctgtggagtaagaa

SEQ ID NO: 584512 - DNA, 25 bp, Mus musculus
ccaaataatgcaccgagactgtggc

SEQ ID NO: 584513 - DNA, 25 bp, Mus musculus
ccaaataatgcagcgagactgtggc

SEQ ID NO: 584514 - DNA, 25 bp, Mus musculus
ccaaatactgtgaacctgtagttaa

SEQ ID NO: 584515 - DNA, 25 bp, Mus musculus
ccaaatactgtgtacctgtagttaa

SEQ ID NO: 584516 - DNA, 25 bp, Mus musculus
ccaaatagctatagaggctgtgaac

SEQ ID NO: 584517 - DNA, 25 bp, Mus musculus
ccaaatagctattgaggctgtgaac

SEQ ID NO: 584518 - DNA, 25 bp, Mus musculus
ccaaatagctgtcaacctaaccgtt

SEQ ID NO: 584519 - DNA, 25 bp, Mus musculus
ccaaatagctgtgaacctaaccgtt

SEQ ID NO: 584520 - DNA, 25 bp, Mus musculus
ccaaataggaggagcagtgaagtta

SEQ ID NO: 584521 - DNA, 25 bp, Mus musculus
ccaaataggaggtgcagtgaagtta

SEQ ID NO: 584522 - DNA, 25 bp, Mus musculus
ccaaatattctcattccaggcagag

SEQ ID NO: 584523 - DNA, 25 bp, Mus musculus
ccaaatattctctttccaggcagag

SEQ ID NO: 584524 - DNA, 25 bp, Mus musculus
ccaaatcaacaccaacccggagagt

SEQ ID NO: 584525 - DNA, 25 bp, Mus musculus
ccaaatcaacacgaacccggagagt

SEQ ID NO: 584526 - DNA, 25 bp, Mus musculus
ccaaatcaagagaccttcctgagct

SEQ ID NO: 584527 - DNA, 25 bp, Mus musculus
ccaaatcaagagtccttcctgagct

SEQ ID NO: 584528 - DNA, 25 bp, Mus musculus
ccaaatcagattcagccttgagtgc

SEQ ID NO: 584529 - DNA, 25 bp, Mus musculus
ccaaatcagattgagccttgagtgc

SEQ ID NO: 584530 - DNA, 25 bp, Mus musculus
ccaaatctactcagagttccgtgag

SEQ ID NO: 584531 - DNA, 25 bp, Mus musculus
ccaaatctactctgagttccgtgag

SEQ ID NO: 584532 - DNA, 25 bp, Mus musculus
ccaaatctgtcaccccaagtcggat

SEQ ID NO: 584533 - DNA, 25 bp, Mus musculus
ccaaatctgtcagcccaagtcggat

SEQ ID NO: 584534 - DNA, 25 bp, Mus musculus
ccaaatgaagttcgccctgagcaag

SEQ ID NO: 584535 - DNA, 25 bp, Mus musculus
ccaaatgaagttggccctgagcaag

SEQ ID NO: 584536 - DNA, 25 bp, Mus musculus
ccaaatgaccagagtgtaaaagtgt

SEQ ID NO: 584537 - DNA, 25 bp, Mus musculus
ccaaatgaccagtgtgtaaaagtgt

SEQ ID NO: 584538 - DNA, 25 bp, Mus musculus
ccaaatgataggctgagcagcatgt

SEQ ID NO: 584539 - DNA, 25 bp, Mus musculus
ccaaatgatagggtgagcagcatgt

SEQ ID NO: 584540 - DNA, 25 bp, Mus musculus
ccaaatgcggaccaggagaacactg

SEQ ID NO: 584541 - DNA, 25 bp, Mus musculus
ccaaatgcggacgaggagaacactg

SEQ ID NO: 584542 - DNA, 25 bp, Mus musculus
ccaaatgctgtactagggaggtgtc

SEQ ID NO: 584543 - DNA, 25 bp, Mus musculus
ccaaatgctgtagtagggaggtgtc

SEQ ID NO: 584544 - DNA, 25 bp, Mus musculus
ccaaatgggactctgtctccagcat

SEQ ID NO: 584545 - DNA, 25 bp, Mus musculus
ccaaatgggactgtgtctccagcat

SEQ ID NO: 584546 - DNA, 25 bp, Mus musculus
ccaaatgggtacattcatgggtgtc

SEQ ID NO: 584547 - DNA, 25 bp, Mus musculus
ccaaatgggtactttcatgggtgtc

SEQ ID NO: 584548 - DNA, 25 bp, Mus musculus
ccaaatgtagtgagtattccaatag

SEQ ID NO: 584549 - DNA, 25 bp, Mus musculus
ccaaatgtagtgtgtattccaatag

SEQ ID NO: 584550 - DNA, 25 bp, Mus musculus
ccaaatgtgccgagatgtatgtgag

SEQ ID NO: 584551 - DNA, 25 bp, Mus musculus
ccaaatgtgccgtgatgtatgtgag

SEQ ID NO: 584552 - DNA, 25 bp, Mus musculus
ccaaatgtgttcagtctggaccacc

SEQ ID NO: 584553 - DNA, 25 bp, Mus musculus
ccaaatgtgttctgtctggaccacc

SEQ ID NO: 584554 - DNA, 25 bp, Mus musculus
ccaaatgttgggaaatccagcttca

SEQ ID NO: 584555 - DNA, 25 bp, Mus musculus
ccaaatgttgggtaatccagcttca

SEQ ID NO: 584556 - DNA, 25 bp, Mus musculus
ccaaattatgtcaggtctgttgata

SEQ ID NO: 584557 - DNA, 25 bp, Mus musculus
ccaaattatgtctggtctgttgata

SEQ ID NO: 584558 - DNA, 25 bp, Mus musculus
ccaaattcatcccactgaagccatg

SEQ ID NO: 584559 - DNA, 25 bp, Mus musculus
ccaaattcatccgactgaagccatg

SEQ ID NO: 584560 - DNA, 25 bp, Mus musculus
ccaaattctctgcaaagtttggaga

SEQ ID NO: 584561 - DNA, 25 bp, Mus musculus
ccaaattctctggaaagtttggaga

SEQ ID NO: 584562 - DNA, 25 bp, Mus musculus
ccaaattctggtatcaaggtctgta

SEQ ID NO: 584563 - DNA, 25 bp, Mus musculus
ccaaattctggtttcaaggtctgta

SEQ ID NO: 584564 - DNA, 25 bp, Mus musculus
ccaaattgagaacgctgcatctcga

SEQ ID NO: 584565 - DNA, 25 bp, Mus musculus
ccaaattgagaaggctgcatctcga

SEQ ID NO: 584566 - DNA, 25 bp, Mus musculus
ccaacaaacagaccatggaagaact

SEQ ID NO: 584567 - DNA, 25 bp, Mus musculus
ccaacaaacagagcatggaagaact

SEQ ID NO: 584568 - DNA, 25 bp, Mus musculus
ccaacaaacatgaaagcagccttat

SEQ ID NO: 584569 - DNA, 25 bp, Mus musculus
ccaacaaacatgtaagcagccttat

SEQ ID NO: 584570 - DNA, 25 bp, Mus musculus
ccaacaaactggcaggagctctggg

SEQ ID NO: 584571 - DNA, 25 bp, Mus musculus
ccaacaaactgggaggagctctggg

SEQ ID NO: 584572 - DNA, 25 bp, Mus musculus
ccaacaaaggagatgaggaggtgcc

SEQ ID NO: 584573 - DNA, 25 bp, Mus musculus
ccaacaaaggagttgaggaggtgcc

SEQ ID NO: 584574 - DNA, 25 bp, Mus musculus
ccaacaacaactcttaggctagtga

SEQ ID NO: 584575 - DNA, 25 bp, Mus musculus
ccaacaacaactgttaggctagtga

SEQ ID NO: 584576 - DNA, 25 bp, Mus musculus
ccaacaacactacctctgaaggaga

SEQ ID NO: 584577 - DNA, 25 bp, Mus musculus
ccaacaacactagctctgaaggaga

SEQ ID NO: 584578 - DNA, 25 bp, Mus musculus
ccaacaacatgaatgaccgctttga

SEQ ID NO: 584579 - DNA, 25 bp, Mus musculus
ccaacaacatgattgaccgctttga

SEQ ID NO: 584580 - DNA, 25 bp, Mus musculus
ccaacaactgtgagagcagcattga

SEQ ID NO: 584581 - DNA, 25 bp, Mus musculus
ccaacaactgtgtgagcagcattga

SEQ ID NO: 584582 - DNA, 25 bp, Mus musculus
ccaacaagaagaatgcccacagcgt

SEQ ID NO: 584583 - DNA, 25 bp, Mus musculus
ccaacaagaagattgcccacagcgt

SEQ ID NO: 584584 - DNA, 25 bp, Mus musculus
ccaacaagcaggacatccgggtcta

SEQ ID NO: 584585 - DNA, 25 bp, Mus musculus
ccaacaagcaggtcatccgggtcta

SEQ ID NO: 584586 - DNA, 25 bp, Mus musculus
ccaacaaggagactggcaaggcttc

SEQ ID NO: 584587 - DNA, 25 bp, Mus musculus
ccaacaaggagagtggcaaggcttc

SEQ ID NO: 584588 - DNA, 25 bp, Mus musculus
ccaacaagggatcgccttgggaaag

SEQ ID NO: 584589 - DNA, 25 bp, Mus musculus
ccaacaagggatggccttgggaaag

SEQ ID NO: 584590 - DNA, 25 bp, Mus musculus
ccaacaatgcaaagaagtgtaactg

SEQ ID NO: 584591 - DNA, 25 bp, Mus musculus
ccaacaatgcaatgaagtgtaactg

SEQ ID NO: 584592 - DNA, 25 bp, Mus musculus
ccaacacacagaacagttggtacag

SEQ ID NO: 584593 - DNA, 25 bp, Mus musculus
ccaacacacagatcagttggtacag

SEQ ID NO: 584594 - DNA, 25 bp, Mus musculus
ccaacacagattcgcttaagtttgc

SEQ ID NO: 584595 - DNA, 25 bp, Mus musculus
ccaacacagattggcttaagtttgc

SEQ ID NO: 584596 - DNA, 25 bp, Mus musculus
ccaacacagtctagaaaaggagtga

SEQ ID NO: 584597 - DNA, 25 bp, Mus musculus
ccaacacagtcttgaaaaggagtga

SEQ ID NO: 584598 - DNA, 25 bp, Mus musculus
ccaacaccctggagactgtagccaa

SEQ ID NO: 584599 - DNA, 25 bp, Mus musculus
ccaacaccctggtgactgtagccaa

SEQ ID NO: 584600 - DNA, 25 bp, Mus musculus
ccaacacctcaaaagacatctgcta

SEQ ID NO: 584601 - DNA, 25 bp, Mus musculus
ccaacacctcaatagacatctgcta

SEQ ID NO: 584602 - DNA, 25 bp, Mus musculus
ccaacacgcattatgtgtcacagaa

SEQ ID NO: 584603 - DNA, 25 bp, Mus musculus
ccaacacgcattttgtgtcacagaa

SEQ ID NO: 584604 - DNA, 25 bp, Mus musculus
ccaacactctaaatgaccagctgct

SEQ ID NO: 584605 - DNA, 25 bp, Mus musculus
ccaacactctaattgaccagctgct

SEQ ID NO: 584606 - DNA, 25 bp, Mus musculus
ccaacactggaccatcaagagggtt

SEQ ID NO: 584607 - DNA, 25 bp, Mus musculus
ccaacactggacgatcaagagggtt

SEQ ID NO: 584608 - DNA, 25 bp, Mus musculus
ccaacactgggaaaagctcaaagag

SEQ ID NO: 584609 - DNA, 25 bp, Mus musculus
ccaacactgggataagctcaaagag

SEQ ID NO: 584610 - DNA, 25 bp, Mus musculus
ccaacactgggtacaagcccttgta

SEQ ID NO: 584611 - DNA, 25 bp, Mus musculus
ccaacactgggtacactcggaggaa

SEQ ID NO: 584612 - DNA, 25 bp, Mus musculus
ccaacactgggttcaagcccttgta

SEQ ID NO: 584613 - DNA, 25 bp, Mus musculus
ccaacactgggttcactcggaggaa

SEQ ID NO: 584614 - DNA, 25 bp, Mus musculus
ccaacagaaaccagtctatcaaagc

SEQ ID NO: 584615 - DNA, 25 bp, Mus musculus
ccaacagaaacctgtctatcaaagc

SEQ ID NO: 584616 - DNA, 25 bp, Mus musculus
ccaacagacattaacagaactgtca

SEQ ID NO: 584617 - DNA, 25 bp, Mus musculus
ccaacagacatttacagaactgtca

SEQ ID NO: 584618 - DNA, 25 bp, Mus musculus
ccaacagactctcgaggccagggca

SEQ ID NO: 584619 - DNA, 25 bp, Mus musculus
ccaacagactctggaggccagggca

SEQ ID NO: 584620 - DNA, 25 bp, Mus musculus
ccaacagatggacgttcaaggcgct

SEQ ID NO: 584621 - DNA, 25 bp, Mus musculus
ccaacagatggaggttcaaggcgct

SEQ ID NO: 584622 - DNA, 25 bp, Mus musculus
ccaacagattgcagagtcaagcttg

SEQ ID NO: 584623 - DNA, 25 bp, Mus musculus
ccaacagattgctgagtcaagcttg

SEQ ID NO: 584624 - DNA, 25 bp, Mus musculus
ccaacagccctgattgcctgagcaa

SEQ ID NO: 584625 - DNA, 25 bp, Mus musculus
ccaacagccctgtttgcctgagcaa

SEQ ID NO: 584626 - DNA, 25 bp, Mus musculus
ccaacagcgacactggagaagagct

SEQ ID NO: 584627 - DNA, 25 bp, Mus musculus
ccaacagcgacagtggagaagagct

SEQ ID NO: 584628 - DNA, 25 bp, Mus musculus
ccaacagctctcaggcatcaatgct

SEQ ID NO: 584629 - DNA, 25 bp, Mus musculus
ccaacagctctctggcatcaatgct

SEQ ID NO: 584630 - DNA, 25 bp, Mus musculus
ccaacaggaactagtgctgcgtgta

SEQ ID NO: 584631 - DNA, 25 bp, Mus musculus
ccaacaggaacttgtgctgcgtgta

SEQ ID NO: 584632 - DNA, 25 bp, Mus musculus
ccaacaggaaggattctcaacaggt

SEQ ID NO: 584633 - DNA, 25 bp, Mus musculus
ccaacaggaaggtttctcaacaggt

SEQ ID NO: 584634 - DNA, 25 bp, Mus musculus
ccaacaggcctgacatcattgatcc

SEQ ID NO: 584635 - DNA, 25 bp, Mus musculus
ccaacaggcctgtcatcattgatcc

SEQ ID NO: 584636 - DNA, 25 bp, Mus musculus
ccaacagggacaaccattccttcta

SEQ ID NO: 584637 - DNA, 25 bp, Mus musculus
ccaacagggacatccattccttcta

SEQ ID NO: 584638 - DNA, 25 bp, Mus musculus
ccaacagtactcagatcatcagcaa

SEQ ID NO: 584639 - DNA, 25 bp, Mus musculus
ccaacagtactctgatcatcagcaa

SEQ ID NO: 584640 - DNA, 25 bp, Mus musculus
ccaacagtatatcaaagtgatcagc

SEQ ID NO: 584641 - DNA, 25 bp, Mus musculus
ccaacagtatatgaaagtgatcagc

SEQ ID NO: 584642 - DNA, 25 bp, Mus musculus
ccaacagtgtgtcgtctcaagttag

SEQ ID NO: 584643 - DNA, 25 bp, Mus musculus
ccaacagtgtgtggtctcaagttag

SEQ ID NO: 584644 - DNA, 25 bp, Mus musculus
ccaacataatggagtcagacaaagg

SEQ ID NO: 584645 - DNA, 25 bp, Mus musculus
ccaacataatggtgtcagacaaagg

SEQ ID NO: 584646 - DNA, 25 bp, Mus musculus
ccaacatacaggagcggctgggaga

SEQ ID NO: 584647 - DNA, 25 bp, Mus musculus
ccaacatacaggtgcggctgggaga

SEQ ID NO: 584648 - DNA, 25 bp, Mus musculus
ccaacatagatgaagtgcagaagtc

SEQ ID NO: 584649 - DNA, 25 bp, Mus musculus
ccaacatagatgtagtgcagaagtc

SEQ ID NO: 584650 - DNA, 25 bp, Mus musculus
ccaacatagtggcaaaggctcattc

SEQ ID NO: 584651 - DNA, 25 bp, Mus musculus
ccaacatagtgggaaaggctcattc

SEQ ID NO: 584652 - DNA, 25 bp, Mus musculus
ccaacatatgagctggcattacaaa

SEQ ID NO: 584653 - DNA, 25 bp, Mus musculus
ccaacatatgaggtggcattacaaa

SEQ ID NO: 584654 - DNA, 25 bp, Mus musculus
ccaacatcatcaagtccgacgctga

SEQ ID NO: 584655 - DNA, 25 bp, Mus musculus
ccaacatcatcatgtccgacgctga

SEQ ID NO: 584656 - DNA, 25 bp, Mus musculus
ccaacatcgcggagcagcgaatcaa

SEQ ID NO: 584657 - DNA, 25 bp, Mus musculus
ccaacatcgcggtgcagcgaatcaa

SEQ ID NO: 584658 - DNA, 25 bp, Mus musculus
ccaacatcggatcccaagagaaagg

SEQ ID NO: 584659 - DNA, 25 bp, Mus musculus
ccaacatcggatgccaagagaaagg

SEQ ID NO: 584660 - DNA, 25 bp, Mus musculus
ccaacatggtggacacagagagccc

SEQ ID NO: 584661 - DNA, 25 bp, Mus musculus
ccaacatggtggtcacagagagccc

SEQ ID NO: 584662 - DNA, 25 bp, Mus musculus
ccaacatgtaccctcctggagagta

SEQ ID NO: 584663 - DNA, 25 bp, Mus musculus
ccaacatgtaccgtcctggagagta

SEQ ID NO: 584664 - DNA, 25 bp, Mus musculus
ccaacatgtcctcttagaacaagaa

SEQ ID NO: 584665 - DNA, 25 bp, Mus musculus
ccaacatgtcctgttagaacaagaa

SEQ ID NO: 584666 - DNA, 25 bp, Mus musculus
ccaacattctgtcgagatgcataca

SEQ ID NO: 584667 - DNA, 25 bp, Mus musculus
ccaacattctgtggagatgcataca

SEQ ID NO: 584668 - DNA, 25 bp, Mus musculus
ccaacattgaggctcaccatgacag

SEQ ID NO: 584669 - DNA, 25 bp, Mus musculus
ccaacattgagggtcaccatgacag

SEQ ID NO: 584670 - DNA, 25 bp, Mus musculus
ccaacattgccacaggagagcagct

SEQ ID NO: 584671 - DNA, 25 bp, Mus musculus
ccaacattgccagaggagagcagct

SEQ ID NO: 584672 - DNA, 25 bp, Mus musculus
ccaacatttgacctgtgtgacacca

SEQ ID NO: 584673 - DNA, 25 bp, Mus musculus
ccaacatttgacgtgtgtgacacca

SEQ ID NO: 584674 - DNA, 25 bp, Mus musculus
ccaaccaaagtcaaactgtaggaag

SEQ ID NO: 584675 - DNA, 25 bp, Mus musculus
ccaaccaaagtctaactgtaggaag

SEQ ID NO: 584676 - DNA, 25 bp, Mus musculus
ccaaccaagttcagtgtggagcggc

SEQ ID NO: 584677 - DNA, 25 bp, Mus musculus
ccaaccaagttctgtgtggagcggc

SEQ ID NO: 584678 - DNA, 25 bp, Mus musculus
ccaaccacagcgagaagcagtatat

SEQ ID NO: 584679 - DNA, 25 bp, Mus musculus
ccaaccacagcgtgaagcagtatat

SEQ ID NO: 584680 - DNA, 25 bp, Mus musculus
ccaaccacctcgaccacgaaatgag

SEQ ID NO: 584681 - DNA, 25 bp, Mus musculus
ccaaccacctcgtccacgaaatgag

SEQ ID NO: 584682 - DNA, 25 bp, Mus musculus
ccaaccagcgcaaggagatggcgaa

SEQ ID NO: 584683 - DNA, 25 bp, Mus musculus
ccaaccagcgcatggagatggcgaa

SEQ ID NO: 584684 - DNA, 25 bp, Mus musculus
ccaaccaggacaatatgagttttct

SEQ ID NO: 584685 - DNA, 25 bp, Mus musculus
ccaaccaggacattatgagttttct

SEQ ID NO: 584686 - DNA, 25 bp, Mus musculus
ccaaccaggagcagatagacaagat

SEQ ID NO: 584687 - DNA, 25 bp, Mus musculus
ccaaccaggagctgatagacaagat

SEQ ID NO: 584688 - DNA, 25 bp, Mus musculus
ccaaccaggccacagggtggagtct

SEQ ID NO: 584689 - DNA, 25 bp, Mus musculus
ccaaccaggccagagggtggagtct

SEQ ID NO: 584690 - DNA, 25 bp, Mus musculus
ccaaccaggcgaaagggatgtttct

SEQ ID NO: 584691 - DNA, 25 bp, Mus musculus
ccaaccaggcgatagggatgtttct

SEQ ID NO: 584692 - DNA, 25 bp, Mus musculus
ccaaccagtggaacaagtttaagtc

SEQ ID NO: 584693 - DNA, 25 bp, Mus musculus
ccaaccagtggatcaagtttaagtc

SEQ ID NO: 584694 - DNA, 25 bp, Mus musculus
ccaaccatagttaaagtgaagagcc

SEQ ID NO: 584695 - DNA, 25 bp, Mus musculus
ccaaccatagtttaagtgaagagcc

SEQ ID NO: 584696 - DNA, 25 bp, Mus musculus
ccaaccatcgagactgggactatgc

SEQ ID NO: 584697 - DNA, 25 bp, Mus musculus
ccaaccatcgagtctgggactatgc

SEQ ID NO: 584698 - DNA, 25 bp, Mus musculus
ccaacccagaggaggtggtcgcagt

SEQ ID NO: 584699 - DNA, 25 bp, Mus musculus
ccaacccagaggtggtggtcgcagt

SEQ ID NO: 584700 - DNA, 25 bp, Mus musculus
ccaacccagggacggaaacagtgag

SEQ ID NO: 584701 - DNA, 25 bp, Mus musculus
ccaacccagggagggaaacagtgag

SEQ ID NO: 584702 - DNA, 25 bp, Mus musculus
ccaaccccagccaaaggcagggata

SEQ ID NO: 584703 - DNA, 25 bp, Mus musculus
ccaaccccagcctaaggcagggata

SEQ ID NO: 584704 - DNA, 25 bp, Mus musculus
ccaaccctactcaggatgcctttga

SEQ ID NO: 584705 - DNA, 25 bp, Mus musculus
ccaaccctactctggatgcctttga

SEQ ID NO: 584706 - DNA, 25 bp, Mus musculus
ccaaccctagatcggattctgaacc

SEQ ID NO: 584707 - DNA, 25 bp, Mus musculus
ccaaccctagatgggattctgaacc

SEQ ID NO: 584708 - DNA, 25 bp, Mus musculus
ccaaccctagcgatatgattgatga

SEQ ID NO: 584709 - DNA, 25 bp, Mus musculus
ccaaccctagcgttatgattgatga

SEQ ID NO: 584710 - DNA, 25 bp, Mus musculus
ccaaccctgggcctttcggagatgt

SEQ ID NO: 584711 - DNA, 25 bp, Mus musculus
ccaaccctgggcgtttcggagatgt

SEQ ID NO: 584712 - DNA, 25 bp, Mus musculus
ccaacccttggcagtgtggcagtga

SEQ ID NO: 584713 - DNA, 25 bp, Mus musculus
ccaacccttggctgtgtggcagtga

SEQ ID NO: 584714 - DNA, 25 bp, Mus musculus
ccaaccgatacaccaaccgtgtggt

SEQ ID NO: 584715 - DNA, 25 bp, Mus musculus
ccaaccgatacagcaaccgtgtggt

SEQ ID NO: 584716 - DNA, 25 bp, Mus musculus
ccaacctacaatactatgcctaggg

SEQ ID NO: 584717 - DNA, 25 bp, Mus musculus
ccaacctacaatattttgtcctgca

SEQ ID NO: 584718 - DNA, 25 bp, Mus musculus
ccaacctacaattctatgcctaggg

SEQ ID NO: 584719 - DNA, 25 bp, Mus musculus
ccaacctacaattttttgtcctgca

SEQ ID NO: 584720 - DNA, 25 bp, Mus musculus
ccaacctacgtaccagaaagtggct

SEQ ID NO: 584721 - DNA, 25 bp, Mus musculus
ccaacctacgtagcagaaagtggct

SEQ ID NO: 584722 - DNA, 25 bp, Mus musculus
ccaacctcaaccagaccgtggatga

SEQ ID NO: 584723 - DNA, 25 bp, Mus musculus
ccaacctcaacctgaccgtggatga

SEQ ID NO: 584724 - DNA, 25 bp, Mus musculus
ccaacctcacacagagggactacag

SEQ ID NO: 584725 - DNA, 25 bp, Mus musculus
ccaacctcacactgagggactacag

SEQ ID NO: 584726 - DNA, 25 bp, Mus musculus
ccaacctgcaaccagcacagtttat

SEQ ID NO: 584727 - DNA, 25 bp, Mus musculus
ccaacctgcaacgagcacagtttat

SEQ ID NO: 584728 - DNA, 25 bp, Mus musculus
ccaacctgtataaccgaggactgca

SEQ ID NO: 584729 - DNA, 25 bp, Mus musculus
ccaacctgtatatccgaggactgca

SEQ ID NO: 584730 - DNA, 25 bp, Mus musculus
ccaacctgtctaagtcctcagaggg

SEQ ID NO: 584731 - DNA, 25 bp, Mus musculus
ccaacctgtctatgtcctcagaggg

SEQ ID NO: 584732 - DNA, 25 bp, Mus musculus
ccaaccttggatctgaaaattgcct

SEQ ID NO: 584733 - DNA, 25 bp, Mus musculus
ccaaccttggatgtgaaaattgcct

SEQ ID NO: 584734 - DNA, 25 bp, Mus musculus
ccaacgagaggaacgtgtccacgcg

SEQ ID NO: 584735 - DNA, 25 bp, Mus musculus
ccaacgagaggatcgtgtccacgcg

SEQ ID NO: 584736 - DNA, 25 bp, Mus musculus
ccaacgagatgaacaagaagtctga

SEQ ID NO: 584737 - DNA, 25 bp, Mus musculus
ccaacgagatgatcaagaagtctga

SEQ ID NO: 584738 - DNA, 25 bp, Mus musculus
ccaacgagctgaatctcagcggtaa

SEQ ID NO: 584739 - DNA, 25 bp, Mus musculus
ccaacgagctgattctcagcggtaa

SEQ ID NO: 584740 - DNA, 25 bp, Mus musculus
ccaacgataagcagtggttctggct

SEQ ID NO: 584741 - DNA, 25 bp, Mus musculus
ccaacgataagctgtggttctggct

SEQ ID NO: 584742 - DNA, 25 bp, Mus musculus
ccaacgatgaggaggatgaagatcc

SEQ ID NO: 584743 - DNA, 25 bp, Mus musculus
ccaacgatgaggtggatgaagatcc

SEQ ID NO: 584744 - DNA, 25 bp, Mus musculus
ccaacgccaagcactgatgcggagt

SEQ ID NO: 584745 - DNA, 25 bp, Mus musculus
ccaacgccaagctctgatgcggagt

SEQ ID NO: 584746 - DNA, 25 bp, Mus musculus
ccaacgctattaaagctgcggtcag

SEQ ID NO: 584747 - DNA, 25 bp, Mus musculus
ccaacgctattatagctgcggtcag

SEQ ID NO: 584748 - DNA, 25 bp, Mus musculus
ccaacgctttccaagtgggatcaaa

SEQ ID NO: 584749 - DNA, 25 bp, Mus musculus
ccaacgctttcctagtgggatcaaa

SEQ ID NO: 584750 - DNA, 25 bp, Mus musculus
ccaacgggagcaacagtattagcat

SEQ ID NO: 584751 - DNA, 25 bp, Mus musculus
ccaacgggagcatcagtattagcat

SEQ ID NO: 584752 - DNA, 25 bp, Mus musculus
ccaacgggattccatagggagatac

SEQ ID NO: 584753 - DNA, 25 bp, Mus musculus
ccaacgggattcgatagggagatac

SEQ ID NO: 584754 - DNA, 25 bp, Mus musculus
ccaacgggcctcaacagtcagagtc

SEQ ID NO: 584755 - DNA, 25 bp, Mus musculus
ccaacgggcctctacagtcagagtc

SEQ ID NO: 584756 - DNA, 25 bp, Mus musculus
ccaacggtcacacctcatgatggag

SEQ ID NO: 584757 - DNA, 25 bp, Mus musculus
ccaacggtcacagctcatgatggag

SEQ ID NO: 584758 - DNA, 25 bp, Mus musculus
ccaacgtccgggagggaaatgcact

SEQ ID NO: 584759 - DNA, 25 bp, Mus musculus
ccaacgtccgggtgggaaatgcact

SEQ ID NO: 584760 - DNA, 25 bp, Mus musculus
ccaacgtcgtgcacttgacagagaa

SEQ ID NO: 584761 - DNA, 25 bp, Mus musculus
ccaacgtcgtgctcttgacagagaa

SEQ ID NO: 584762 - DNA, 25 bp, Mus musculus
ccaacgtgctgcactcggagcaggg

SEQ ID NO: 584763 - DNA, 25 bp, Mus musculus
ccaacgtgctgctctcggagcaggg

SEQ ID NO: 584764 - DNA, 25 bp, Mus musculus
ccaacgtggtgaatctgcatgaggt

SEQ ID NO: 584765 - DNA, 25 bp, Mus musculus
ccaacgtggtgattctgcatgaggt

SEQ ID NO: 584766 - DNA, 25 bp, Mus musculus
ccaacgtggtggattacagctacca

SEQ ID NO: 584767 - DNA, 25 bp, Mus musculus
ccaacgtggtggtttacagctacca

SEQ ID NO: 584768 - DNA, 25 bp, Mus musculus
ccaacgtgttgaccctgaatggtac

SEQ ID NO: 584769 - DNA, 25 bp, Mus musculus
ccaacgtgttgagcctgaatggtac

SEQ ID NO: 584770 - DNA, 25 bp, Mus musculus
ccaactaaccatcgtgccccagtac

SEQ ID NO: 584771 - DNA, 25 bp, Mus musculus
ccaactaaccatggtgccccagtac

SEQ ID NO: 584772 - DNA, 25 bp, Mus musculus
ccaactaagaagatagacttgtcag

SEQ ID NO: 584773 - DNA, 25 bp, Mus musculus
ccaactaagaagttagacttgtcag

SEQ ID NO: 584774 - DNA, 25 bp, Mus musculus
ccaactactacgagatgatgctgac

SEQ ID NO: 584775 - DNA, 25 bp, Mus musculus
ccaactactacgtgatgatgctgac

SEQ ID NO: 584776 - DNA, 25 bp, Mus musculus
ccaactactagtcgagttgctttgg

SEQ ID NO: 584777 - DNA, 25 bp, Mus musculus
ccaactactagtggagttgctttgg

SEQ ID NO: 584778 - DNA, 25 bp, Mus musculus
ccaactactccaaccatctgaatgg

SEQ ID NO: 584779 - DNA, 25 bp, Mus musculus
ccaactactccatccatctgaatgg

SEQ ID NO: 584780 - DNA, 25 bp, Mus musculus
ccaactagaagacaacagtatccag

SEQ ID NO: 584781 - DNA, 25 bp, Mus musculus
ccaactagaagagaacagtatccag

SEQ ID NO: 584782 - DNA, 25 bp, Mus musculus
ccaactagagaaactgtgcaaacag

SEQ ID NO: 584783 - DNA, 25 bp, Mus musculus
ccaactagagaatctgtgcaaacag

SEQ ID NO: 584784 - DNA, 25 bp, Mus musculus
ccaactagggatccgaatgcaacac

SEQ ID NO: 584785 - DNA, 25 bp, Mus musculus
ccaactagggatgcgaatgcaacac

SEQ ID NO: 584786 - DNA, 25 bp, Mus musculus
ccaactatgaagaaggagacgaata

SEQ ID NO: 584787 - DNA, 25 bp, Mus musculus
ccaactatgaagtaggagacgaata

SEQ ID NO: 584788 - DNA, 25 bp, Mus musculus
ccaactatgatacctcggtgaggcc

SEQ ID NO: 584789 - DNA, 25 bp, Mus musculus
ccaactatgatagctcggtgaggcc

SEQ ID NO: 584790 - DNA, 25 bp, Mus musculus
ccaactcagaatccattgccatttc

SEQ ID NO: 584791 - DNA, 25 bp, Mus musculus
ccaactcagaatgcattgccatttc

SEQ ID NO: 584792 - DNA, 25 bp, Mus musculus
ccaactcatgggaggctaatgtaga

SEQ ID NO: 584793 - DNA, 25 bp, Mus musculus
ccaactcatgggtggctaatgtaga

SEQ ID NO: 584794 - DNA, 25 bp, Mus musculus
ccaactccagctattgagtcgtgag

SEQ ID NO: 584795 - DNA, 25 bp, Mus musculus
ccaactccagcttttgagtcgtgag

SEQ ID NO: 584796 - DNA, 25 bp, Mus musculus
ccaactccaggcaggacactctgtg

SEQ ID NO: 584797 - DNA, 25 bp, Mus musculus
ccaactccaggctggacactctgtg

SEQ ID NO: 584798 - DNA, 25 bp, Mus musculus
ccaactccttttatagagcgcttta

SEQ ID NO: 584799 - DNA, 25 bp, Mus musculus
ccaactccttttttagagcgcttta

SEQ ID NO: 584800 - DNA, 25 bp, Mus musculus
ccaactcgggtcagcagtagtgcca

SEQ ID NO: 584801 - DNA, 25 bp, Mus musculus
ccaactcgggtctgcagtagtgcca

SEQ ID NO: 584802 - DNA, 25 bp, Mus musculus
ccaactctcagtataaggagtcggc

SEQ ID NO: 584803 - DNA, 25 bp, Mus musculus
ccaactctcagtttaaggagtcggc

SEQ ID NO: 584804 - DNA, 25 bp, Mus musculus
ccaactgaaggaacatctgcggaag

SEQ ID NO: 584805 - DNA, 25 bp, Mus musculus
ccaactgaaggatcatctgcggaag

SEQ ID NO: 584806 - DNA, 25 bp, Mus musculus
ccaactgaaggtaatgagagactgc

SEQ ID NO: 584807 - DNA, 25 bp, Mus musculus
ccaactgaaggttatgagagactgc

SEQ ID NO: 584808 - DNA, 25 bp, Mus musculus
ccaactgaatatcagaggaacggga

SEQ ID NO: 584809 - DNA, 25 bp, Mus musculus
ccaactgaatatgagaggaacggga

SEQ ID NO: 584810 - DNA, 25 bp, Mus musculus
ccaactgacgccacccttgatgata

SEQ ID NO: 584811 - DNA, 25 bp, Mus musculus
ccaactgacgcctcccttgatgata

SEQ ID NO: 584812 - DNA, 25 bp, Mus musculus
ccaactgacggtcgatctctgccaa

SEQ ID NO: 584813 - DNA, 25 bp, Mus musculus
ccaactgacggtggatctctgccaa

SEQ ID NO: 584814 - DNA, 25 bp, Mus musculus
ccaactgagcaaccttctgggctat

SEQ ID NO: 584815 - DNA, 25 bp, Mus musculus
ccaactgagcaagcttctgggctat

SEQ ID NO: 584816 - DNA, 25 bp, Mus musculus
ccaactgcaaccagcgctatggctg

SEQ ID NO: 584817 - DNA, 25 bp, Mus musculus
ccaactgcaacctgcgctatggctg

SEQ ID NO: 584818 - DNA, 25 bp, Mus musculus
ccaactgcccaaagatgtattttac

SEQ ID NO: 584819 - DNA, 25 bp, Mus musculus
ccaactgcccaatgatgtattttac

SEQ ID NO: 584820 - DNA, 25 bp, Mus musculus
ccaactgctaggcaatttcaaccag

SEQ ID NO: 584821 - DNA, 25 bp, Mus musculus
ccaactgctagggaatttcaaccag

SEQ ID NO: 584822 - DNA, 25 bp, Mus musculus
ccaactgctgcacgatggaggcgaa

SEQ ID NO: 584823 - DNA, 25 bp, Mus musculus
ccaactgctgcaggatggaggcgaa

SEQ ID NO: 584824 - DNA, 25 bp, Mus musculus
ccaactggatccaggagtcccagaa

SEQ ID NO: 584825 - DNA, 25 bp, Mus musculus
ccaactggatcctggagtcccagaa

SEQ ID NO: 584826 - DNA, 25 bp, Mus musculus
ccaactggcgtccacgcttcaagtt

SEQ ID NO: 584827 - DNA, 25 bp, Mus musculus
ccaactggcgtcgacgcttcaagtt

SEQ ID NO: 584828 - DNA, 25 bp, Mus musculus
ccaactgggaagctacaagagacac

SEQ ID NO: 584829 - DNA, 25 bp, Mus musculus
ccaactgggaaggtacaagagacac

SEQ ID NO: 584830 - DNA, 25 bp, Mus musculus
ccaactgggagaactggtaaaagtg

SEQ ID NO: 584831 - DNA, 25 bp, Mus musculus
ccaactgggagatctggtaaaagtg

SEQ ID NO: 584832 - DNA, 25 bp, Mus musculus
ccaactgtaacaatcaaggtctatg

SEQ ID NO: 584833 - DNA, 25 bp, Mus musculus
ccaactgtaacattcaaggtctatg

SEQ ID NO: 584834 - DNA, 25 bp, Mus musculus
ccaactgtcaagaaagggaaaagtg

SEQ ID NO: 584835 - DNA, 25 bp, Mus musculus
ccaactgtcaagtaagggaaaagtg

SEQ ID NO: 584836 - DNA, 25 bp, Mus musculus
ccaactgtcacaccgatgtgtgcaa

SEQ ID NO: 584837 - DNA, 25 bp, Mus musculus
ccaactgtcacagcgatgtgtgcaa

SEQ ID NO: 584838 - DNA, 25 bp, Mus musculus
ccaactgtcgcacggccgagaagat

SEQ ID NO: 584839 - DNA, 25 bp, Mus musculus
ccaactgtcgcagggccgagaagat

SEQ ID NO: 584840 - DNA, 25 bp, Mus musculus
ccaactgtgtggactaagatgcatc

SEQ ID NO: 584841 - DNA, 25 bp, Mus musculus
ccaactgtgtggtctaagatgcatc

SEQ ID NO: 584842 - DNA, 25 bp, Mus musculus
ccaactgttagtctacaatggtgtt

SEQ ID NO: 584843 - DNA, 25 bp, Mus musculus
ccaactgttagtgtacaatggtgtt

SEQ ID NO: 584844 - DNA, 25 bp, Mus musculus
ccaactgttgcgctgtaatgtagac

SEQ ID NO: 584845 - DNA, 25 bp, Mus musculus
ccaactgttgcggtgtaatgtagac

SEQ ID NO: 584846 - DNA, 25 bp, Mus musculus
ccaacttagcctcgcatatctctaa

SEQ ID NO: 584847 - DNA, 25 bp, Mus musculus
ccaacttagcctggcatatctctaa

SEQ ID NO: 584848 - DNA, 25 bp, Mus musculus
ccaacttccttcaaggagtggaatg

SEQ ID NO: 584849 - DNA, 25 bp, Mus musculus
ccaacttccttctaggagtggaatg

SEQ ID NO: 584850 - DNA, 25 bp, Mus musculus
ccaacttctttgctccgctgcttgg

SEQ ID NO: 584851 - DNA, 25 bp, Mus musculus
ccaacttctttggtccgctgcttgg

SEQ ID NO: 584852 - DNA, 25 bp, Mus musculus
ccaacttgaggccttacaatgaagc

SEQ ID NO: 584853 - DNA, 25 bp, Mus musculus
ccaacttgaggcgttacaatgaagc

SEQ ID NO: 584854 - DNA, 25 bp, Mus musculus
ccaacttgcatcctggcagtcattg

SEQ ID NO: 584855 - DNA, 25 bp, Mus musculus
ccaacttgcatcgtggcagtcattg

SEQ ID NO: 584856 - DNA, 25 bp, Mus musculus
ccaacttgtgtgcaacctctcatgc

SEQ ID NO: 584857 - DNA, 25 bp, Mus musculus
ccaacttgtgtggaacctctcatgc

SEQ ID NO: 584858 - DNA, 25 bp, Mus musculus
ccaactttatgactgggagtgacct

SEQ ID NO: 584859 - DNA, 25 bp, Mus musculus
ccaactttatgagtgggagtgacct

SEQ ID NO: 584860 - DNA, 25 bp, Mus musculus
ccaactttcctgatattgtagacag

SEQ ID NO: 584861 - DNA, 25 bp, Mus musculus
ccaactttcctgttattgtagacag

SEQ ID NO: 584862 - DNA, 25 bp, Mus musculus
ccaactttctacagaacttccaggt

SEQ ID NO: 584863 - DNA, 25 bp, Mus musculus
ccaactttctactgaacttccaggt

SEQ ID NO: 584864 - DNA, 25 bp, Mus musculus
ccaactttctcactagaggaggagc

SEQ ID NO: 584865 - DNA, 25 bp, Mus musculus
ccaactttctcagtagaggaggagc

SEQ ID NO: 584866 - DNA, 25 bp, Mus musculus
ccaactttctgtccctttgggacag

SEQ ID NO: 584867 - DNA, 25 bp, Mus musculus
ccaactttctgtgcctttgggacag

SEQ ID NO: 584868 - DNA, 25 bp, Mus musculus
ccaactttgagaacttatctgaaag

SEQ ID NO: 584869 - DNA, 25 bp, Mus musculus
ccaactttgagatcttatctgaaag

SEQ ID NO: 584870 - DNA, 25 bp, Mus musculus
ccaacttttcagctgtcaggtttcg

SEQ ID NO: 584871 - DNA, 25 bp, Mus musculus
ccaacttttcaggtgtcaggtttcg

SEQ ID NO: 584872 - DNA, 25 bp, Mus musculus
ccaagaaaagaaccagataagaaag

SEQ ID NO: 584873 - DNA, 25 bp, Mus musculus
ccaagaaaagaagcagataagaaag

SEQ ID NO: 584874 - DNA, 25 bp, Mus musculus
ccaagaaaagtcagcctgactgcag

SEQ ID NO: 584875 - DNA, 25 bp, Mus musculus
ccaagaaaagtctgcctgactgcag

SEQ ID NO: 584876 - DNA, 25 bp, Mus musculus
ccaagaaagatgctgactggtggac

SEQ ID NO: 584877 - DNA, 25 bp, Mus musculus
ccaagaaagatggtgactggtggac

SEQ ID NO: 584878 - DNA, 25 bp, Mus musculus
ccaagaaagccaaaactatgtatat

SEQ ID NO: 584879 - DNA, 25 bp, Mus musculus
ccaagaaagccataactatgtatat

SEQ ID NO: 584880 - DNA, 25 bp, Mus musculus
ccaagaaagtagctgcttctaagcc

SEQ ID NO: 584881 - DNA, 25 bp, Mus musculus
ccaagaaagtaggtgcttctaagcc

SEQ ID NO: 584882 - DNA, 25 bp, Mus musculus
ccaagaaagtttcatctgggttcga

SEQ ID NO: 584883 - DNA, 25 bp, Mus musculus
ccaagaaagtttgatctgggttcga

SEQ ID NO: 584884 - DNA, 25 bp, Mus musculus
ccaagaaatgttatgaaggtgaaag

SEQ ID NO: 584885 - DNA, 25 bp, Mus musculus
ccaagaaatgttttgaaggtgaaag

SEQ ID NO: 584886 - DNA, 25 bp, Mus musculus
ccaagaaattgaaagcatggagaag

SEQ ID NO: 584887 - DNA, 25 bp, Mus musculus
ccaagaaattgatagcatggagaag

SEQ ID NO: 584888 - DNA, 25 bp, Mus musculus
ccaagaaattgcctataatcaagaa

SEQ ID NO: 584889 - DNA, 25 bp, Mus musculus
ccaagaaattgcgtataatcaagaa

SEQ ID NO: 584890 - DNA, 25 bp, Mus musculus
ccaagaacacacagaccaagaccaa

SEQ ID NO: 584891 - DNA, 25 bp, Mus musculus
ccaagaacacactgaccaagaccaa

SEQ ID NO: 584892 - DNA, 25 bp, Mus musculus
ccaagaactcagaaccagaggaagt

SEQ ID NO: 584893 - DNA, 25 bp, Mus musculus
ccaagaactcagtaccagaggaagt

SEQ ID NO: 584894 - DNA, 25 bp, Mus musculus
ccaagaagaaaacggtcacacgcgt

SEQ ID NO: 584895 - DNA, 25 bp, Mus musculus
ccaagaagaaaagggtcacacgcgt

SEQ ID NO: 584896 - DNA, 25 bp, Mus musculus
ccaagaagaacaaaccatcccacgg

SEQ ID NO: 584897 - DNA, 25 bp, Mus musculus
ccaagaagaacataccatcccacgg

SEQ ID NO: 584898 - DNA, 25 bp, Mus musculus
ccaagaagaaggaagctgagcaaac

SEQ ID NO: 584899 - DNA, 25 bp, Mus musculus
ccaagaagaaggtagctgagcaaac

SEQ ID NO: 584900 - DNA, 25 bp, Mus musculus
ccaagaagaggacgcaacagaactt

SEQ ID NO: 584901 - DNA, 25 bp, Mus musculus
ccaagaagaggaggcaacagaactt

SEQ ID NO: 584902 - DNA, 25 bp, Mus musculus
ccaagaagatccaggctatcaaagg

SEQ ID NO: 584903 - DNA, 25 bp, Mus musculus
ccaagaagatcctggctatcaaagg

SEQ ID NO: 584904 - DNA, 25 bp, Mus musculus
ccaagaagcatcagtatgagattag

SEQ ID NO: 584905 - DNA, 25 bp, Mus musculus
ccaagaagcatctgtatgagattag

SEQ ID NO: 584906 - DNA, 25 bp, Mus musculus
ccaagaagcctgcaattggccagca

SEQ ID NO: 584907 - DNA, 25 bp, Mus musculus
ccaagaagcctggaattggccagca

SEQ ID NO: 584908 - DNA, 25 bp, Mus musculus
ccaagaagcggcaactgctggacag

SEQ ID NO: 584909 - DNA, 25 bp, Mus musculus
ccaagaagcggctactgctggacag

SEQ ID NO: 584910 - DNA, 25 bp, Mus musculus
ccaagaagctagaagagtcggatgc

SEQ ID NO: 584911 - DNA, 25 bp, Mus musculus
ccaagaagctagtagagtcggatgc

SEQ ID NO: 584912 - DNA, 25 bp, Mus musculus
ccaagaaggcatcgacgtaagggaa

SEQ ID NO: 584913 - DNA, 25 bp, Mus musculus
ccaagaaggcatggacgtaagggaa

SEQ ID NO: 584914 - DNA, 25 bp, Mus musculus
ccaagaagggagagtgaatcgagtc

SEQ ID NO: 584915 - DNA, 25 bp, Mus musculus
ccaagaagggagtgtgaatcgagtc

SEQ ID NO: 584916 - DNA, 25 bp, Mus musculus
ccaagaaggtttactgacgtgaatc

SEQ ID NO: 584917 - DNA, 25 bp, Mus musculus
ccaagaaggttttctgacgtgaatc

SEQ ID NO: 584918 - DNA, 25 bp, Mus musculus
ccaagaagttggaactctatatgag

SEQ ID NO: 584919 - DNA, 25 bp, Mus musculus
ccaagaagttggtactctatatgag

SEQ ID NO: 584920 - DNA, 25 bp, Mus musculus
ccaagaatgcagagaagtcaactgg

SEQ ID NO: 584921 - DNA, 25 bp, Mus musculus
ccaagaatgcagtgaagtcaactgg

SEQ ID NO: 584922 - DNA, 25 bp, Mus musculus
ccaagaatgggcagaagcgagccaa

SEQ ID NO: 584923 - DNA, 25 bp, Mus musculus
ccaagaatgggctgaagcgagccaa

SEQ ID NO: 584924 - DNA, 25 bp, Mus musculus
ccaagaatgtgacccaccacaagct

SEQ ID NO: 584925 - DNA, 25 bp, Mus musculus
ccaagaatgtgagccaccacaagct

SEQ ID NO: 584926 - DNA, 25 bp, Mus musculus
ccaagaattcagagatgtagagagg

SEQ ID NO: 584927 - DNA, 25 bp, Mus musculus
ccaagaattcagtgatgtagagagg

SEQ ID NO: 584928 - DNA, 25 bp, Mus musculus
ccaagaattggaagtgaagtgctct

SEQ ID NO: 584929 - DNA, 25 bp, Mus musculus
ccaagaattggatgtgaagtgctct

SEQ ID NO: 584930 - DNA, 25 bp, Mus musculus
ccaagaatttgccatcgtgcccttg

SEQ ID NO: 584931 - DNA, 25 bp, Mus musculus
ccaagaatttgcgatcgtgcccttg

SEQ ID NO: 584932 - DNA, 25 bp, Mus musculus
ccaagacaaaccagtgggctcttca

SEQ ID NO: 584933 - DNA, 25 bp, Mus musculus
ccaagacaaacctgtgggctcttca

SEQ ID NO: 584934 - DNA, 25 bp, Mus musculus
ccaagacacaagctgggcacgtgta

SEQ ID NO: 584935 - DNA, 25 bp, Mus musculus
ccaagacacaaggtgggcacgtgta

SEQ ID NO: 584936 - DNA, 25 bp, Mus musculus
ccaagacacactcgaagggcttagg

SEQ ID NO: 584937 - DNA, 25 bp, Mus musculus
ccaagacacactggaagggcttagg

SEQ ID NO: 584938 - DNA, 25 bp, Mus musculus
ccaagacactgcagctcctcaatga

SEQ ID NO: 584939 - DNA, 25 bp, Mus musculus
ccaagacactgctgctcctcaatga

SEQ ID NO: 584940 - DNA, 25 bp, Mus musculus
ccaagacagaatctttgagacaatg

SEQ ID NO: 584941 - DNA, 25 bp, Mus musculus
ccaagacagaatgtttgagacaatg

SEQ ID NO: 584942 - DNA, 25 bp, Mus musculus
ccaagacatgaacgcttacctggag

SEQ ID NO: 584943 - DNA, 25 bp, Mus musculus
ccaagacatgaaggcttacctggag

SEQ ID NO: 584944 - DNA, 25 bp, Mus musculus
ccaagaccaagaaaatggcgccagt

SEQ ID NO: 584945 - DNA, 25 bp, Mus musculus
ccaagaccaagataatggcgccagt

SEQ ID NO: 584946 - DNA, 25 bp, Mus musculus
ccaagacccacaaccaggagtgcaa

SEQ ID NO: 584947 - DNA, 25 bp, Mus musculus
ccaagacccacatccaggagtgcaa

SEQ ID NO: 584948 - DNA, 25 bp, Mus musculus
ccaagaccccacagaaggagcgtgt

SEQ ID NO: 584949 - DNA, 25 bp, Mus musculus
ccaagaccccactgaaggagcgtgt

SEQ ID NO: 584950 - DNA, 25 bp, Mus musculus
ccaagaccctgaccaagtaccaaga

SEQ ID NO: 584951 - DNA, 25 bp, Mus musculus
ccaagaccctgagcaagtaccaaga

SEQ ID NO: 584952 - DNA, 25 bp, Mus musculus
ccaagaccgagacctcacatgctgg

SEQ ID NO: 584953 - DNA, 25 bp, Mus musculus
ccaagaccgagagctcacatgctgg

SEQ ID NO: 584954 - DNA, 25 bp, Mus musculus
ccaagaccggccagaagtcggacaa

SEQ ID NO: 584955 - DNA, 25 bp, Mus musculus
ccaagaccggcctgaagtcggacaa

SEQ ID NO: 584956 - DNA, 25 bp, Mus musculus
ccaagacgaagcagcagatcgagga

SEQ ID NO: 584957 - DNA, 25 bp, Mus musculus
ccaagacgaagctgcagatcgagga

SEQ ID NO: 584958 - DNA, 25 bp, Mus musculus
ccaagacggagacatagatcccgat

SEQ ID NO: 584959 - DNA, 25 bp, Mus musculus
ccaagacggagagatagatcccgat

SEQ ID NO: 584960 - DNA, 25 bp, Mus musculus
ccaagacgggcaacagagagtgcca

SEQ ID NO: 584961 - DNA, 25 bp, Mus musculus
ccaagacgggcatcagagagtgcca

SEQ ID NO: 584962 - DNA, 25 bp, Mus musculus
ccaagactaagtctaagactctgga

SEQ ID NO: 584963 - DNA, 25 bp, Mus musculus
ccaagactaagtgtaagactctgga

SEQ ID NO: 584964 - DNA, 25 bp, Mus musculus
ccaagactacctagatgagctcaag

SEQ ID NO: 584965 - DNA, 25 bp, Mus musculus
ccaagactaccttgatgagctcaag

SEQ ID NO: 584966 - DNA, 25 bp, Mus musculus
ccaagactcaggagcagtgtggtgt

SEQ ID NO: 584967 - DNA, 25 bp, Mus musculus
ccaagactcaggtgcagtgtggtgt

SEQ ID NO: 584968 - DNA, 25 bp, Mus musculus
ccaagactcgttcttcccaatttgg

SEQ ID NO: 584969 - DNA, 25 bp, Mus musculus
ccaagactcgttgttcccaatttgg

SEQ ID NO: 584970 - DNA, 25 bp, Mus musculus
ccaagactctagcaagactgttgtg

SEQ ID NO: 584971 - DNA, 25 bp, Mus musculus
ccaagactctaggaagactgttgtg

SEQ ID NO: 584972 - DNA, 25 bp, Mus musculus
ccaagactgtgtccagagcaaggca

SEQ ID NO: 584973 - DNA, 25 bp, Mus musculus
ccaagactgtgtgcagagcaaggca

SEQ ID NO: 584974 - DNA, 25 bp, Mus musculus
ccaagacttccaagcatttgacctc

SEQ ID NO: 584975 - DNA, 25 bp, Mus musculus
ccaagacttccatgcatttgacctc

SEQ ID NO: 584976 - DNA, 25 bp, Mus musculus
ccaagacttggcctcagccctagga

SEQ ID NO: 584977 - DNA, 25 bp, Mus musculus
ccaagacttggcgtcagccctagga

SEQ ID NO: 584978 - DNA, 25 bp, Mus musculus
ccaagactttggacctaccgctgga

SEQ ID NO: 584979 - DNA, 25 bp, Mus musculus
ccaagactttggtcctaccgctgga

SEQ ID NO: 584980 - DNA, 25 bp, Mus musculus
ccaagagaaaaacagttacagtcaa

SEQ ID NO: 584981 - DNA, 25 bp, Mus musculus
ccaagagaaaaagagttacagtcaa

SEQ ID NO: 584982 - DNA, 25 bp, Mus musculus
ccaagagaaacaacagtcaggtgaa

SEQ ID NO: 584983 - DNA, 25 bp, Mus musculus
ccaagagaaacatcagtcaggtgaa

SEQ ID NO: 584984 - DNA, 25 bp, Mus musculus
ccaagagaagatcaatgagtatctg

SEQ ID NO: 584985 - DNA, 25 bp, Mus musculus
ccaagagaagatgaatgagtatctg

SEQ ID NO: 584986 - DNA, 25 bp, Mus musculus
ccaagagacgctcctgaccagaact

SEQ ID NO: 584987 - DNA, 25 bp, Mus musculus
ccaagagacgctgctgaccagaact

SEQ ID NO: 584988 - DNA, 25 bp, Mus musculus
ccaagagagcatctgtcagttgttg

SEQ ID NO: 584989 - DNA, 25 bp, Mus musculus
ccaagagagcatgtgtcagttgttg

SEQ ID NO: 584990 - DNA, 25 bp, Mus musculus
ccaagagagcctaggcgactcgggc

SEQ ID NO: 584991 - DNA, 25 bp, Mus musculus
ccaagagagccttggcgactcgggc

SEQ ID NO: 584992 - DNA, 25 bp, Mus musculus
ccaagagaggaaagcggctcaagtt

SEQ ID NO: 584993 - DNA, 25 bp, Mus musculus
ccaagagaggaatgcggctcaagtt

SEQ ID NO: 584994 - DNA, 25 bp, Mus musculus
ccaagagatgaacggtctcctcaca

SEQ ID NO: 584995 - DNA, 25 bp, Mus musculus
ccaagagatgaagggtctcctcaca

SEQ ID NO: 584996 - DNA, 25 bp, Mus musculus
ccaagagatgagacttacaagcccc

SEQ ID NO: 584997 - DNA, 25 bp, Mus musculus
ccaagagatgagtcttacaagcccc

SEQ ID NO: 584998 - DNA, 25 bp, Mus musculus
ccaagagcaaagctagaggttccaa

SEQ ID NO: 584999 - DNA, 25 bp, Mus musculus
ccaagagcaaaggtagaggttccaa

SEQ ID NO: 585000 - DNA, 25 bp, Mus musculus
ccaagagcaacaaagaactgtatgg

SEQ ID NO: 585001 - DNA, 25 bp, Mus musculus
ccaagagcaacatagaactgtatgg

SEQ ID NO: 585002 - DNA, 25 bp, Mus musculus
ccaagagcactcctttaggagttaa

SEQ ID NO: 585003 - DNA, 25 bp, Mus musculus
ccaagagcactcgtttaggagttaa

SEQ ID NO: 585004 - DNA, 25 bp, Mus musculus
ccaagagctgaacgataccgatctg

SEQ ID NO: 585005 - DNA, 25 bp, Mus musculus
ccaagagctgaaggataccgatctg

SEQ ID NO: 585006 - DNA, 25 bp, Mus musculus
ccaagagctgagcattcaggcgaat

SEQ ID NO: 585007 - DNA, 25 bp, Mus musculus
ccaagagctgaggattcaggcgaat

SEQ ID NO: 585008 - DNA, 25 bp, Mus musculus
ccaagagcttctcctctgtaagcag

SEQ ID NO: 585009 - DNA, 25 bp, Mus musculus
ccaagagcttctgctctgtaagcag

SEQ ID NO: 585010 - DNA, 25 bp, Mus musculus
ccaagaggacttcggtcaccagtat

SEQ ID NO: 585011 - DNA, 25 bp, Mus musculus
ccaagaggacttgggtcaccagtat

SEQ ID NO: 585012 - DNA, 25 bp, Mus musculus
ccaagaggagccctggagcgccact

SEQ ID NO: 585013 - DNA, 25 bp, Mus musculus
ccaagaggagccgtggagcgccact

SEQ ID NO: 585014 - DNA, 25 bp, Mus musculus
ccaagaggatagaatctaaagccac

SEQ ID NO: 585015 - DNA, 25 bp, Mus musculus
ccaagaggatagtatctaaagccac

SEQ ID NO: 585016 - DNA, 25 bp, Mus musculus
ccaagaggcactcacttatgggagt

SEQ ID NO: 585017 - DNA, 25 bp, Mus musculus
ccaagaggcactgacttatgggagt

SEQ ID NO: 585018 - DNA, 25 bp, Mus musculus
ccaagaggcagccttgcctgtgaat

SEQ ID NO: 585019 - DNA, 25 bp, Mus musculus
ccaagaggcagcgttgcctgtgaat

SEQ ID NO: 585020 - DNA, 25 bp, Mus musculus
ccaagaggctttcagctgtctagca

SEQ ID NO: 585021 - DNA, 25 bp, Mus musculus
ccaagaggctttgagctgtctagca

SEQ ID NO: 585022 - DNA, 25 bp, Mus musculus
ccaagagggagtctgtatatattat

SEQ ID NO: 585023 - DNA, 25 bp, Mus musculus
ccaagagggagtgtgtatatattat

SEQ ID NO: 585024 - DNA, 25 bp, Mus musculus
ccaagagggtggctcactgttaatg

SEQ ID NO: 585025 - DNA, 25 bp, Mus musculus
ccaagagggtgggtcactgttaatg

SEQ ID NO: 585026 - DNA, 25 bp, Mus musculus
ccaagagtgtatatgtgtatcggcg

SEQ ID NO: 585027 - DNA, 25 bp, Mus musculus
ccaagagtgtatttgtgtatcggcg

SEQ ID NO: 585028 - DNA, 25 bp, Mus musculus
ccaagagtgttcataggtgactcag

SEQ ID NO: 585029 - DNA, 25 bp, Mus musculus
ccaagagtgttcttaggtgactcag

SEQ ID NO: 585030 - DNA, 25 bp, Mus musculus
ccaagataaactcaatcaggtttcc

SEQ ID NO: 585031 - DNA, 25 bp, Mus musculus
ccaagataaactgaatcaggtttcc

SEQ ID NO: 585032 - DNA, 25 bp, Mus musculus
ccaagatagccgagttcaccgtcag

SEQ ID NO: 585033 - DNA, 25 bp, Mus musculus
ccaagatagccgtgttcaccgtcag

SEQ ID NO: 585034 - DNA, 25 bp, Mus musculus
ccaagatatccaagttttccgactg

SEQ ID NO: 585035 - DNA, 25 bp, Mus musculus
ccaagatatccatgttttccgactg

SEQ ID NO: 585036 - DNA, 25 bp, Mus musculus
ccaagatcactccatggatgaagtg

SEQ ID NO: 585037 - DNA, 25 bp, Mus musculus
ccaagatcactcgatggatgaagtg

SEQ ID NO: 585038 - DNA, 25 bp, Mus musculus
ccaagatcccagaaggttctcctgc

SEQ ID NO: 585039 - DNA, 25 bp, Mus musculus
ccaagatcccagtaggttctcctgc

SEQ ID NO: 585040 - DNA, 25 bp, Mus musculus
ccaagatcctttagttggacgaggc

SEQ ID NO: 585041 - DNA, 25 bp, Mus musculus
ccaagatccttttgttggacgaggc

SEQ ID NO: 585042 - DNA, 25 bp, Mus musculus
ccaagatcgcacagctggaggaggc

SEQ ID NO: 585043 - DNA, 25 bp, Mus musculus
ccaagatcgcactgctggaggaggc

SEQ ID NO: 585044 - DNA, 25 bp, Mus musculus
ccaagatcggccaaggcacattcgg

SEQ ID NO: 585045 - DNA, 25 bp, Mus musculus
ccaagatcggcctaggcacattcgg

SEQ ID NO: 585046 - DNA, 25 bp, Mus musculus
ccaagatctgcgagagtggcaaaaa

SEQ ID NO: 585047 - DNA, 25 bp, Mus musculus
ccaagatctgcgtgagtggcaaaaa

SEQ ID NO: 585048 - DNA, 25 bp, Mus musculus
ccaagatcttctagaacccggagaa

SEQ ID NO: 585049 - DNA, 25 bp, Mus musculus
ccaagatcttcttgaacccggagaa

SEQ ID NO: 585050 - DNA, 25 bp, Mus musculus
ccaagatgaaagcttatcctcattg

SEQ ID NO: 585051 - DNA, 25 bp, Mus musculus
ccaagatgaaaggttatcctcattg

SEQ ID NO: 585052 - DNA, 25 bp, Mus musculus
ccaagatgacagactgagaggcctg

SEQ ID NO: 585053 - DNA, 25 bp, Mus musculus
ccaagatgacagtctgagaggcctg

SEQ ID NO: 585054 - DNA, 25 bp, Mus musculus
ccaagatgactgagcgagcgctgga

SEQ ID NO: 585055 - DNA, 25 bp, Mus musculus
ccaagatgactgtgcgagcgctgga

SEQ ID NO: 585056 - DNA, 25 bp, Mus musculus
ccaagatgatctcaaagatgaattc

SEQ ID NO: 585057 - DNA, 25 bp, Mus musculus
ccaagatgatctgaaagatgaattc

SEQ ID NO: 585058 - DNA, 25 bp, Mus musculus
ccaagatggaaactcataaaccaag

SEQ ID NO: 585059 - DNA, 25 bp, Mus musculus
ccaagatggaaagtcataaaccaag

SEQ ID NO: 585060 - DNA, 25 bp, Mus musculus
ccaagatggcatctgcacgaacaca

SEQ ID NO: 585061 - DNA, 25 bp, Mus musculus
ccaagatggcatgtgcacgaacaca

SEQ ID NO: 585062 - DNA, 25 bp, Mus musculus
ccaagatggcgtcgtggctgccgga

SEQ ID NO: 585063 - DNA, 25 bp, Mus musculus
ccaagatggcgtggtggctgccgga

SEQ ID NO: 585064 - DNA, 25 bp, Mus musculus
ccaagatgggagagatgatgctcgc

SEQ ID NO: 585065 - DNA, 25 bp, Mus musculus
ccaagatgggagtgatgatgctcgc

SEQ ID NO: 585066 - DNA, 25 bp, Mus musculus
ccaagatgggcaaattctgctcagt

SEQ ID NO: 585067 - DNA, 25 bp, Mus musculus
ccaagatgggcatattctgctcagt

SEQ ID NO: 585068 - DNA, 25 bp, Mus musculus
ccaagattcttgctcattaacaaaa

SEQ ID NO: 585069 - DNA, 25 bp, Mus musculus
ccaagattcttggtcattaacaaaa

SEQ ID NO: 585070 - DNA, 25 bp, Mus musculus
ccaagattgcctcggtaactttact

SEQ ID NO: 585071 - DNA, 25 bp, Mus musculus
ccaagattgcctgggtaactttact

SEQ ID NO: 585072 - DNA, 25 bp, Mus musculus
ccaagatttctgacttcagctggaa

SEQ ID NO: 585073 - DNA, 25 bp, Mus musculus
ccaagatttctgtcttcagctggaa

SEQ ID NO: 585074 - DNA, 25 bp, Mus musculus
ccaagcaaccgcagagaaaactacc

SEQ ID NO: 585075 - DNA, 25 bp, Mus musculus
ccaagcaaccgctgagaaaactacc

SEQ ID NO: 585076 - DNA, 25 bp, Mus musculus
ccaagcaagaggctagatgccatgg

SEQ ID NO: 585077 - DNA, 25 bp, Mus musculus
ccaagcaagagggtagatgccatgg

SEQ ID NO: 585078 - DNA, 25 bp, Mus musculus
ccaagcaagtcaccgtcgatgccgt

SEQ ID NO: 585079 - DNA, 25 bp, Mus musculus
ccaagcaagtcagcgtcgatgccgt

SEQ ID NO: 585080 - DNA, 25 bp, Mus musculus
ccaagcaagtgaagccagcagagga

SEQ ID NO: 585081 - DNA, 25 bp, Mus musculus
ccaagcaagtgatgccagcagagga

SEQ ID NO: 585082 - DNA, 25 bp, Mus musculus
ccaagcacgtgacggtgcccctagt

SEQ ID NO: 585083 - DNA, 25 bp, Mus musculus
ccaagcacgtgagggtgcccctagt

SEQ ID NO: 585084 - DNA, 25 bp, Mus musculus
ccaagcactccaatatgggacagtg

SEQ ID NO: 585085 - DNA, 25 bp, Mus musculus
ccaagcactccattatgggacagtg

SEQ ID NO: 585086 - DNA, 25 bp, Mus musculus
ccaagcactgatccggagtacccag

SEQ ID NO: 585087 - DNA, 25 bp, Mus musculus
ccaagcactgatgcggagtacccag

SEQ ID NO: 585088 - DNA, 25 bp, Mus musculus
ccaagcacttcaagaactgacccag

SEQ ID NO: 585089 - DNA, 25 bp, Mus musculus
ccaagcacttcatgaactgacccag

SEQ ID NO: 585090 - DNA, 25 bp, Mus musculus
ccaagcagaatgagtcaggttagcc

SEQ ID NO: 585091 - DNA, 25 bp, Mus musculus
ccaagcagaatgtgtcaggttagcc

SEQ ID NO: 585092 - DNA, 25 bp, Mus musculus
ccaagcagcatgcagttcactatgt

SEQ ID NO: 585093 - DNA, 25 bp, Mus musculus
ccaagcagcatggagttcactatgt

SEQ ID NO: 585094 - DNA, 25 bp, Mus musculus
ccaagcagcggacggaaaacatgca

SEQ ID NO: 585095 - DNA, 25 bp, Mus musculus
ccaagcagcggagggaaaacatgca

SEQ ID NO: 585096 - DNA, 25 bp, Mus musculus
ccaagcagctgcatcactgtatggc

SEQ ID NO: 585097 - DNA, 25 bp, Mus musculus
ccaagcagctgcttcactgtatggc

SEQ ID NO: 585098 - DNA, 25 bp, Mus musculus
ccaagcaggaagctcagcggctgaa

SEQ ID NO: 585099 - DNA, 25 bp, Mus musculus
ccaagcaggaaggtcagcggctgaa

SEQ ID NO: 585100 - DNA, 25 bp, Mus musculus
ccaagcaggacacagaaattccacc

SEQ ID NO: 585101 - DNA, 25 bp, Mus musculus
ccaagcaggacagagaaattccacc

SEQ ID NO: 585102 - DNA, 25 bp, Mus musculus
ccaagcaggatgaggaaaggctgaa

SEQ ID NO: 585103 - DNA, 25 bp, Mus musculus
ccaagcaggatgtggaaaggctgaa

SEQ ID NO: 585104 - DNA, 25 bp, Mus musculus
ccaagcagtatgaaaagtctgaaaa

SEQ ID NO: 585105 - DNA, 25 bp, Mus musculus
ccaagcagtatgtaaagtctgaaaa

SEQ ID NO: 585106 - DNA, 25 bp, Mus musculus
ccaagcatcgcaacagcatggaggt

SEQ ID NO: 585107 - DNA, 25 bp, Mus musculus
ccaagcatcgcatcagcatggaggt

SEQ ID NO: 585108 - DNA, 25 bp, Mus musculus
ccaagcatggagatcctggtgatgc

SEQ ID NO: 585109 - DNA, 25 bp, Mus musculus
ccaagcatggagttcctggtgatgc

SEQ ID NO: 585110 - DNA, 25 bp, Mus musculus
ccaagccaacatagaggctcaccat

SEQ ID NO: 585111 - DNA, 25 bp, Mus musculus
ccaagccaacattgaggctcaccat

SEQ ID NO: 585112 - DNA, 25 bp, Mus musculus
ccaagccagaaaaggaaggtgccca

SEQ ID NO: 585113 - DNA, 25 bp, Mus musculus
ccaagccagaaatggaaggtgccca

SEQ ID NO: 585114 - DNA, 25 bp, Mus musculus
ccaagccagagcatgagaatcggat

SEQ ID NO: 585115 - DNA, 25 bp, Mus musculus
ccaagccagagcttgagaatcggat

SEQ ID NO: 585116 - DNA, 25 bp, Mus musculus
ccaagccagaggagatcttcaaatt

SEQ ID NO: 585117 - DNA, 25 bp, Mus musculus
ccaagccagaggtgatcttcaaatt

SEQ ID NO: 585118 - DNA, 25 bp, Mus musculus
ccaagccagtgaatgctgccattca

SEQ ID NO: 585119 - DNA, 25 bp, Mus musculus
ccaagccagtgattgctgccattca

SEQ ID NO: 585120 - DNA, 25 bp, Mus musculus
ccaagcccattaattttgatggagc

SEQ ID NO: 585121 - DNA, 25 bp, Mus musculus
ccaagcccattatttttgatggagc

SEQ ID NO: 585122 - DNA, 25 bp, Mus musculus
ccaagcccctgaagaaccgtgatgt

SEQ ID NO: 585123 - DNA, 25 bp, Mus musculus
ccaagcccctgatgaaccgtgatgt

SEQ ID NO: 585124 - DNA, 25 bp, Mus musculus
ccaagcccgacgagggcaaatacac

SEQ ID NO: 585125 - DNA, 25 bp, Mus musculus
ccaagcccgacgtgggcaaatacac

SEQ ID NO: 585126 - DNA, 25 bp, Mus musculus
ccaagccctctgctttctagtgatg

SEQ ID NO: 585127 - DNA, 25 bp, Mus musculus
ccaagccctctggtttctagtgatg

SEQ ID NO: 585128 - DNA, 25 bp, Mus musculus
ccaagccctttgacctcagcgaggt

SEQ ID NO: 585129 - DNA, 25 bp, Mus musculus
ccaagccctttgtcctcagcgaggt

SEQ ID NO: 585130 - DNA, 25 bp, Mus musculus
ccaagccgtgtgcatcagcacgaat

SEQ ID NO: 585131 - DNA, 25 bp, Mus musculus
ccaagccgtgtggatcagcacgaat

SEQ ID NO: 585132 - DNA, 25 bp, Mus musculus
ccaagcctagaaaagtggagctgtc

SEQ ID NO: 585133 - DNA, 25 bp, Mus musculus
ccaagcctagaatagtggagctgtc

SEQ ID NO: 585134 - DNA, 25 bp, Mus musculus
ccaagcctattcactgagggcaaag

SEQ ID NO: 585135 - DNA, 25 bp, Mus musculus
ccaagcctattctctgagggcaaag

SEQ ID NO: 585136 - DNA, 25 bp, Mus musculus
ccaagcctgactatgacatccgagc

SEQ ID NO: 585137 - DNA, 25 bp, Mus musculus
ccaagcctgactttgacatccgagc

SEQ ID NO: 585138 - DNA, 25 bp, Mus musculus
ccaagcctggaaacctgaatgtgat

SEQ ID NO: 585139 - DNA, 25 bp, Mus musculus
ccaagcctggaatcctgaatgtgat

SEQ ID NO: 585140 - DNA, 25 bp, Mus musculus
ccaagcctgggtaaatgtgggatgc

SEQ ID NO: 585141 - DNA, 25 bp, Mus musculus
ccaagcctgggttaatgtgggatgc

SEQ ID NO: 585142 - DNA, 25 bp, Mus musculus
ccaagcgaagtgaggcacagcggca

SEQ ID NO: 585143 - DNA, 25 bp, Mus musculus
ccaagcgaagtgtggcacagcggca

SEQ ID NO: 585144 - DNA, 25 bp, Mus musculus
ccaagcgagtgaaggctgggttgca

SEQ ID NO: 585145 - DNA, 25 bp, Mus musculus
ccaagcgagtgatggctgggttgca

SEQ ID NO: 585146 - DNA, 25 bp, Mus musculus
ccaagcgcgcagatttcgtcgccgg

SEQ ID NO: 585147 - DNA, 25 bp, Mus musculus
ccaagcgcgcagttttcgtcgccgg

SEQ ID NO: 585148 - DNA, 25 bp, Mus musculus
ccaagcgcgcctacagagagttgcg

SEQ ID NO: 585149 - DNA, 25 bp, Mus musculus
ccaagcgcgccttcagagagttgcg

SEQ ID NO: 585150 - DNA, 25 bp, Mus musculus
ccaagcgcgttgctcttgctcacat

SEQ ID NO: 585151 - DNA, 25 bp, Mus musculus
ccaagcgcgttggtcttgctcacat

SEQ ID NO: 585152 - DNA, 25 bp, Mus musculus
ccaagcgctgctcagagattggacg

SEQ ID NO: 585153 - DNA, 25 bp, Mus musculus
ccaagcgctgctgagagattggacg

SEQ ID NO: 585154 - DNA, 25 bp, Mus musculus
ccaagcgcttgacctgtcactgaag

SEQ ID NO: 585155 - DNA, 25 bp, Mus musculus
ccaagcgcttgagctgtcactgaag

SEQ ID NO: 585156 - DNA, 25 bp, Mus musculus
ccaagcggccttcgctgtgaacatc

SEQ ID NO: 585157 - DNA, 25 bp, Mus musculus
ccaagcggccttggctgtgaacatc

SEQ ID NO: 585158 - DNA, 25 bp, Mus musculus
ccaagcggtactccaagaatgccag

SEQ ID NO: 585159 - DNA, 25 bp, Mus musculus
ccaagcggtactgcaagaatgccag

SEQ ID NO: 585160 - DNA, 25 bp, Mus musculus
ccaagcgtgagaacgtggaccgcaa

SEQ ID NO: 585161 - DNA, 25 bp, Mus musculus
ccaagcgtgagatcgtggaccgcaa

SEQ ID NO: 585162 - DNA, 25 bp, Mus musculus
ccaagcgtgaggagatggatttgca

SEQ ID NO: 585163 - DNA, 25 bp, Mus musculus
ccaagcgtgaggtgatggatttgca

SEQ ID NO: 585164 - DNA, 25 bp, Mus musculus
ccaagcgtttaaagaagacagtctc

SEQ ID NO: 585165 - DNA, 25 bp, Mus musculus
ccaagcgtttaatgaagacagtctc

SEQ ID NO: 585166 - DNA, 25 bp, Mus musculus
ccaagctcagaacgacagtcactcg

SEQ ID NO: 585167 - DNA, 25 bp, Mus musculus
ccaagctcagaaggacagtcactcg

SEQ ID NO: 585168 - DNA, 25 bp, Mus musculus
ccaagctccagtctagcgtcctggg

SEQ ID NO: 585169 - DNA, 25 bp, Mus musculus
ccaagctccagtgtagcgtcctggg

SEQ ID NO: 585170 - DNA, 25 bp, Mus musculus
ccaagctgcgaaaagagaaggccat

SEQ ID NO: 585171 - DNA, 25 bp, Mus musculus
ccaagctgcgaatagagaaggccat

SEQ ID NO: 585172 - DNA, 25 bp, Mus musculus
ccaagctggacaaactggatgtcct

SEQ ID NO: 585173 - DNA, 25 bp, Mus musculus
ccaagctggacatactggatgtcct

SEQ ID NO: 585174 - DNA, 25 bp, Mus musculus
ccaagctggataaaccagatgtggt

SEQ ID NO: 585175 - DNA, 25 bp, Mus musculus
ccaagctggatataccagatgtggt

SEQ ID NO: 585176 - DNA, 25 bp, Mus musculus
ccaagctggctgaaacctcctacaa

SEQ ID NO: 585177 - DNA, 25 bp, Mus musculus
ccaagctggctgtaacctcctacaa

SEQ ID NO: 585178 - DNA, 25 bp, Mus musculus
ccaagctgtctgaaacagtttcagc

SEQ ID NO: 585179 - DNA, 25 bp, Mus musculus
ccaagctgtctgtaacagtttcagc

SEQ ID NO: 585180 - DNA, 25 bp, Mus musculus
ccaagcttacaaagaagctttgtgt

SEQ ID NO: 585181 - DNA, 25 bp, Mus musculus
ccaagcttacaatgaagctttgtgt

SEQ ID NO: 585182 - DNA, 25 bp, Mus musculus
ccaagcttattgacaatgaccacta

SEQ ID NO: 585183 - DNA, 25 bp, Mus musculus
ccaagcttattgtcaatgaccacta

SEQ ID NO: 585184 - DNA, 25 bp, Mus musculus
ccaagcttgctacgacttctctgta

SEQ ID NO: 585185 - DNA, 25 bp, Mus musculus
ccaagcttgctaggacttctctgta

SEQ ID NO: 585186 - DNA, 25 bp, Mus musculus
ccaagcttttacactgggtctggga

SEQ ID NO: 585187 - DNA, 25 bp, Mus musculus
ccaagcttttactctgggtctggga

SEQ ID NO: 585188 - DNA, 25 bp, Mus musculus
ccaaggaacataagaagttgtttct

SEQ ID NO: 585189 - DNA, 25 bp, Mus musculus
ccaaggaacatatgaagttgtttct

SEQ ID NO: 585190 - DNA, 25 bp, Mus musculus
ccaaggaagggcaagaattgagcct

SEQ ID NO: 585191 - DNA, 25 bp, Mus musculus
ccaaggaagggctagaattgagcct

SEQ ID NO: 585192 - DNA, 25 bp, Mus musculus
ccaaggacaaccctctgaacgaagg

SEQ ID NO: 585193 - DNA, 25 bp, Mus musculus
ccaaggacaaccgtctgaacgaagg

SEQ ID NO: 585194 - DNA, 25 bp, Mus musculus
ccaaggacacagacttctaccgttt

SEQ ID NO: 585195 - DNA, 25 bp, Mus musculus
ccaaggacacagtcttctaccgttt

SEQ ID NO: 585196 - DNA, 25 bp, Mus musculus
ccaaggacagcacaacaagcgatgt

SEQ ID NO: 585197 - DNA, 25 bp, Mus musculus
ccaaggacagcagaacaagcgatgt

SEQ ID NO: 585198 - DNA, 25 bp, Mus musculus
ccaaggaccaccatagactttgagg

SEQ ID NO: 585199 - DNA, 25 bp, Mus musculus
ccaaggaccaccttagactttgagg

SEQ ID NO: 585200 - DNA, 25 bp, Mus musculus
ccaaggaccagcaccggaagctgtg

SEQ ID NO: 585201 - DNA, 25 bp, Mus musculus
ccaaggaccagctccggaagctgtg

SEQ ID NO: 585202 - DNA, 25 bp, Mus musculus
ccaaggactccaagaatatcaaggc

SEQ ID NO: 585203 - DNA, 25 bp, Mus musculus
ccaaggactccatgaatatcaaggc

SEQ ID NO: 585204 - DNA, 25 bp, Mus musculus
ccaaggacttggcacttcctagagt

SEQ ID NO: 585205 - DNA, 25 bp, Mus musculus
ccaaggacttgggacttcctagagt

SEQ ID NO: 585206 - DNA, 25 bp, Mus musculus
ccaaggagaaaacctgtgatcgact

SEQ ID NO: 585207 - DNA, 25 bp, Mus musculus
ccaaggagaaaagctgtgatcgact

SEQ ID NO: 585208 - DNA, 25 bp, Mus musculus
ccaaggagacaccaaggaacagtag

SEQ ID NO: 585209 - DNA, 25 bp, Mus musculus
ccaaggagacacgaaggaacagtag

SEQ ID NO: 585210 - DNA, 25 bp, Mus musculus
ccaaggagaccgaaggcttcggaat

SEQ ID NO: 585211 - DNA, 25 bp, Mus musculus
ccaaggagaccgtaggcttcggaat

SEQ ID NO: 585212 - DNA, 25 bp, Mus musculus
ccaaggagaggcaccgaggcatgca

SEQ ID NO: 585213 - DNA, 25 bp, Mus musculus
ccaaggagaggctccgaggcatgca

SEQ ID NO: 585214 - DNA, 25 bp, Mus musculus
ccaaggagattcagactcctgagga

SEQ ID NO: 585215 - DNA, 25 bp, Mus musculus
ccaaggagattctgactcctgagga

SEQ ID NO: 585216 - DNA, 25 bp, Mus musculus
ccaaggagcagcaatctgaagctac

SEQ ID NO: 585217 - DNA, 25 bp, Mus musculus
ccaaggagcagctatctgaagctac

SEQ ID NO: 585218 - DNA, 25 bp, Mus musculus
ccaaggaggagacccagctagaaac

SEQ ID NO: 585219 - DNA, 25 bp, Mus musculus
ccaaggaggagagccagctagaaac

SEQ ID NO: 585220 - DNA, 25 bp, Mus musculus
ccaaggaggcaaagctgcgtgacct

SEQ ID NO: 585221 - DNA, 25 bp, Mus musculus
ccaaggaggcaatgctgcgtgacct

SEQ ID NO: 585222 - DNA, 25 bp, Mus musculus
ccaaggagggcaacccagccgagat

SEQ ID NO: 585223 - DNA, 25 bp, Mus musculus
ccaaggagggcatcccagccgagat

SEQ ID NO: 585224 - DNA, 25 bp, Mus musculus
ccaaggatagtgcatggaagccaac

SEQ ID NO: 585225 - DNA, 25 bp, Mus musculus
ccaaggatagtggatggaagccaac

SEQ ID NO: 585226 - DNA, 25 bp, Mus musculus
ccaaggatctgacttagcatggcag

SEQ ID NO: 585227 - DNA, 25 bp, Mus musculus
ccaaggatctgagttagcatggcag

SEQ ID NO: 585228 - DNA, 25 bp, Mus musculus
ccaaggatgcatcccttcagccgag

SEQ ID NO: 585229 - DNA, 25 bp, Mus musculus
ccaaggatgcatgccttcagccgag

SEQ ID NO: 585230 - DNA, 25 bp, Mus musculus
ccaaggattcctacccacgcagtgt

SEQ ID NO: 585231 - DNA, 25 bp, Mus musculus
ccaaggattccttcccacgcagtgt

SEQ ID NO: 585232 - DNA, 25 bp, Mus musculus
ccaaggcaacgtctatcatctcaag

SEQ ID NO: 585233 - DNA, 25 bp, Mus musculus
ccaaggcaacgtgtatcatctcaag

SEQ ID NO: 585234 - DNA, 25 bp, Mus musculus
ccaaggcacagacggactatgagct

SEQ ID NO: 585235 - DNA, 25 bp, Mus musculus
ccaaggcacagagggactatgagct

SEQ ID NO: 585236 - DNA, 25 bp, Mus musculus
ccaaggcactgacggaacgctggct

SEQ ID NO: 585237 - DNA, 25 bp, Mus musculus
ccaaggcactgagggaacgctggct

SEQ ID NO: 585238 - DNA, 25 bp, Mus musculus
ccaaggcagaaaagctgtccctgga

SEQ ID NO: 585239 - DNA, 25 bp, Mus musculus
ccaaggcagaaatgctgtccctgga

SEQ ID NO: 585240 - DNA, 25 bp, Mus musculus
ccaaggcagagtctgttcacaggcc

SEQ ID NO: 585241 - DNA, 25 bp, Mus musculus
ccaaggcagagtgtgttcacaggcc

SEQ ID NO: 585242 - DNA, 25 bp, Mus musculus
ccaaggcagccaagactttatgtgt

SEQ ID NO: 585243 - DNA, 25 bp, Mus musculus
ccaaggcagccatgactttatgtgt

SEQ ID NO: 585244 - DNA, 25 bp, Mus musculus
ccaaggcctggaacaatgcagccac

SEQ ID NO: 585245 - DNA, 25 bp, Mus musculus
ccaaggcctggatcaatgcagccac

SEQ ID NO: 585246 - DNA, 25 bp, Mus musculus
ccaaggcctgttcaaccagtgtaaa

SEQ ID NO: 585247 - DNA, 25 bp, Mus musculus
ccaaggcctgttgaaccagtgtaaa

SEQ ID NO: 585248 - DNA, 25 bp, Mus musculus
ccaaggcgatcacctgaaaaacagg

SEQ ID NO: 585249 - DNA, 25 bp, Mus musculus
ccaaggcgatcagctgaaaaacagg

SEQ ID NO: 585250 - DNA, 25 bp, Mus musculus
ccaaggcggacacaggcagatacag

SEQ ID NO: 585251 - DNA, 25 bp, Mus musculus
ccaaggcggacactctgcaggatga

SEQ ID NO: 585252 - DNA, 25 bp, Mus musculus
ccaaggcggacagaggcagatacag

SEQ ID NO: 585253 - DNA, 25 bp, Mus musculus
ccaaggcggacagtctgcaggatga

SEQ ID NO: 585254 - DNA, 25 bp, Mus musculus
ccaaggcggcctcgtggtacttctg

SEQ ID NO: 585255 - DNA, 25 bp, Mus musculus
ccaaggcggcctggtggtacttctg

SEQ ID NO: 585256 - DNA, 25 bp, Mus musculus
ccaaggcgggatccacgtaagagcc

SEQ ID NO: 585257 - DNA, 25 bp, Mus musculus
ccaaggcgggatgcacgtaagagcc

SEQ ID NO: 585258 - DNA, 25 bp, Mus musculus
ccaaggctatgacgcacccggcgtg

SEQ ID NO: 585259 - DNA, 25 bp, Mus musculus
ccaaggctatgaggcacccggcgtg

SEQ ID NO: 585260 - DNA, 25 bp, Mus musculus
ccaaggctctggcaatgacgacagc

SEQ ID NO: 585261 - DNA, 25 bp, Mus musculus
ccaaggctctgggaatgacgacagc

SEQ ID NO: 585262 - DNA, 25 bp, Mus musculus
ccaaggctgctgagagcatggcaga

SEQ ID NO: 585263 - DNA, 25 bp, Mus musculus
ccaaggctgctgtgagcatggcaga

SEQ ID NO: 585264 - DNA, 25 bp, Mus musculus
ccaaggctggcaccgtagggacaca

SEQ ID NO: 585265 - DNA, 25 bp, Mus musculus
ccaaggctggcactatttggcagca

SEQ ID NO: 585266 - DNA, 25 bp, Mus musculus
ccaaggctggcagcgtagggacaca

SEQ ID NO: 585267 - DNA, 25 bp, Mus musculus
ccaaggctggcagtatttggcagca

SEQ ID NO: 585268 - DNA, 25 bp, Mus musculus
ccaaggctgtgtccatgagtgatat

SEQ ID NO: 585269 - DNA, 25 bp, Mus musculus
ccaaggctgtgtgcatgagtgatat

SEQ ID NO: 585270 - DNA, 25 bp, Mus musculus
ccaaggcttacccatctgtctgtca

SEQ ID NO: 585271 - DNA, 25 bp, Mus musculus
ccaaggcttaccgatctgtctgtca

SEQ ID NO: 585272 - DNA, 25 bp, Mus musculus
ccaaggcttcgacattgtgttgaat

SEQ ID NO: 585273 - DNA, 25 bp, Mus musculus
ccaaggcttcgagattgtgttgaat

SEQ ID NO: 585274 - DNA, 25 bp, Mus musculus
ccaaggcttgctaaaggatgggact

SEQ ID NO: 585275 - DNA, 25 bp, Mus musculus
ccaaggcttgcttaaggatgggact

SEQ ID NO: 585276 - DNA, 25 bp, Mus musculus
ccaaggctttgacgcaggtgctaag

SEQ ID NO: 585277 - DNA, 25 bp, Mus musculus
ccaaggctttgaggcaggtgctaag

SEQ ID NO: 585278 - DNA, 25 bp, Mus musculus
ccaagggaaggtccttcaagaagga

SEQ ID NO: 585279 - DNA, 25 bp, Mus musculus
ccaagggaaggtgcttcaagaagga

SEQ ID NO: 585280 - DNA, 25 bp, Mus musculus
ccaagggaccagaaacagacgtggc

SEQ ID NO: 585281 - DNA, 25 bp, Mus musculus
ccaagggaccagtaacagacgtggc

SEQ ID NO: 585282 - DNA, 25 bp, Mus musculus
ccaagggactctcgtcactgtctct

SEQ ID NO: 585283 - DNA, 25 bp, Mus musculus
ccaagggactctggtcactgtctct

SEQ ID NO: 585284 - DNA, 25 bp, Mus musculus
ccaagggaggcgagcgctctcgtat

SEQ ID NO: 585285 - DNA, 25 bp, Mus musculus
ccaagggaggcgtgcgctctcgtat

SEQ ID NO: 585286 - DNA, 25 bp, Mus musculus
ccaagggagtgtaggcggcctctac

SEQ ID NO: 585287 - DNA, 25 bp, Mus musculus
ccaagggagtgttggcggcctctac

SEQ ID NO: 585288 - DNA, 25 bp, Mus musculus
ccaagggataccagaccagagcggg

SEQ ID NO: 585289 - DNA, 25 bp, Mus musculus
ccaagggatacctgaccagagcggg

SEQ ID NO: 585290 - DNA, 25 bp, Mus musculus
ccaagggcacaacagtggcagtcca

SEQ ID NO: 585291 - DNA, 25 bp, Mus musculus
ccaagggcacaagagtggcagtcca

SEQ ID NO: 585292 - DNA, 25 bp, Mus musculus
ccaagggccagaatactactacatt

SEQ ID NO: 585293 - DNA, 25 bp, Mus musculus
ccaagggccagattactactacatt

SEQ ID NO: 585294 - DNA, 25 bp, Mus musculus
ccaagggcctgcctttgtcacgtgg

SEQ ID NO: 585295 - DNA, 25 bp, Mus musculus
ccaagggcctgcgtttgtcacgtgg

SEQ ID NO: 585296 - DNA, 25 bp, Mus musculus
ccaagggcgactacgagaaggtgtt

SEQ ID NO: 585297 - DNA, 25 bp, Mus musculus
ccaagggcgacttcgagaaggtgtt

SEQ ID NO: 585298 - DNA, 25 bp, Mus musculus
ccaagggcgcggataccgcctggaa

SEQ ID NO: 585299 - DNA, 25 bp, Mus musculus
ccaagggcgcggttaccgcctggaa

SEQ ID NO: 585300 - DNA, 25 bp, Mus musculus
ccaagggctatgcatttgtacactt

SEQ ID NO: 585301 - DNA, 25 bp, Mus musculus
ccaagggctatggatttgtacactt

SEQ ID NO: 585302 - DNA, 25 bp, Mus musculus
ccaagggtgtcaatgagtgcctgaa

SEQ ID NO: 585303 - DNA, 25 bp, Mus musculus
ccaagggtgtcattgagtgcctgaa

SEQ ID NO: 585304 - DNA, 25 bp, Mus musculus
ccaagggttaccacagaacattcaa

SEQ ID NO: 585305 - DNA, 25 bp, Mus musculus
ccaagggttacctcagaacattcaa

SEQ ID NO: 585306 - DNA, 25 bp, Mus musculus
ccaaggtaagtgatagaggccccag

SEQ ID NO: 585307 - DNA, 25 bp, Mus musculus
ccaaggtaagtgttagaggccccag

SEQ ID NO: 585308 - DNA, 25 bp, Mus musculus
ccaaggtcacagctaggtccgacag

SEQ ID NO: 585309 - DNA, 25 bp, Mus musculus
ccaaggtcacaggtaggtccgacag

SEQ ID NO: 585310 - DNA, 25 bp, Mus musculus
ccaaggtcaccaatgtgctggagcc

SEQ ID NO: 585311 - DNA, 25 bp, Mus musculus
ccaaggtcaccattgtgctggagcc

SEQ ID NO: 585312 - DNA, 25 bp, Mus musculus
ccaaggtcagggctatcagcgaagt

SEQ ID NO: 585313 - DNA, 25 bp, Mus musculus
ccaaggtcaggggtatcagcgaagt

SEQ ID NO: 585314 - DNA, 25 bp, Mus musculus
ccaaggtcattgagctgatggacac

SEQ ID NO: 585315 - DNA, 25 bp, Mus musculus
ccaaggtcattgtgctgatggacac

SEQ ID NO: 585316 - DNA, 25 bp, Mus musculus
ccaaggtcctcaatgcaaacagagg

SEQ ID NO: 585317 - DNA, 25 bp, Mus musculus
ccaaggtcctcattgcaaacagagg

SEQ ID NO: 585318 - DNA, 25 bp, Mus musculus
ccaaggtctcgacgtgttaagcaag

SEQ ID NO: 585319 - DNA, 25 bp, Mus musculus
ccaaggtctcgaggtgttaagcaag

SEQ ID NO: 585320 - DNA, 25 bp, Mus musculus
ccaaggtcttttagtgcagggccca

SEQ ID NO: 585321 - DNA, 25 bp, Mus musculus
ccaaggtctttttgtgcagggccca

SEQ ID NO: 585322 - DNA, 25 bp, Mus musculus
ccaaggtgaaataaaacgtctctct

SEQ ID NO: 585323 - DNA, 25 bp, Mus musculus
ccaaggtgaaattaaacgtctctct

SEQ ID NO: 585324 - DNA, 25 bp, Mus musculus
ccaaggtgaagaattggaaccagga

SEQ ID NO: 585325 - DNA, 25 bp, Mus musculus
ccaaggtgaagatttggaaccagga

SEQ ID NO: 585326 - DNA, 25 bp, Mus musculus
ccaaggtgactgaggtaagaagcaa

SEQ ID NO: 585327 - DNA, 25 bp, Mus musculus
ccaaggtgactgtggtaagaagcaa

SEQ ID NO: 585328 - DNA, 25 bp, Mus musculus
ccaaggtgagcacggcagttgttcc

SEQ ID NO: 585329 - DNA, 25 bp, Mus musculus
ccaaggtgagcagggcagttgttcc

SEQ ID NO: 585330 - DNA, 25 bp, Mus musculus
ccaaggtgatcaatattcaggcatg

SEQ ID NO: 585331 - DNA, 25 bp, Mus musculus
ccaaggtgatcattattcaggcatg

SEQ ID NO: 585332 - DNA, 25 bp, Mus musculus
ccaaggtgctaactctcagtgaggt

SEQ ID NO: 585333 - DNA, 25 bp, Mus musculus
ccaaggtgctaagtctcagtgaggt

SEQ ID NO: 585334 - DNA, 25 bp, Mus musculus
ccaaggtgctggctaagagggagct

SEQ ID NO: 585335 - DNA, 25 bp, Mus musculus
ccaaggtgctgggtaagagggagct

SEQ ID NO: 585336 - DNA, 25 bp, Mus musculus
ccaaggtggaccagtggctgggtgt

SEQ ID NO: 585337 - DNA, 25 bp, Mus musculus
ccaaggtggacctgtggctgggtgt

SEQ ID NO: 585338 - DNA, 25 bp, Mus musculus
ccaaggtggctcacgacagcagtaa

SEQ ID NO: 585339 - DNA, 25 bp, Mus musculus
ccaaggtggctctcgacagcagtaa

SEQ ID NO: 585340 - DNA, 25 bp, Mus musculus
ccaaggttaccacgttacgatgaag

SEQ ID NO: 585341 - DNA, 25 bp, Mus musculus
ccaaggttaccaggttacgatgaag

SEQ ID NO: 585342 - DNA, 25 bp, Mus musculus
ccaaggttctgcaactgttgctatt

SEQ ID NO: 585343 - DNA, 25 bp, Mus musculus
ccaaggttctgctactgttgctatt

SEQ ID NO: 585344 - DNA, 25 bp, Mus musculus
ccaaggtttcgaaaaatgcctggag

SEQ ID NO: 585345 - DNA, 25 bp, Mus musculus
ccaaggtttcgataaatgcctggag

SEQ ID NO: 585346 - DNA, 25 bp, Mus musculus
ccaagtaaagggagaagccaaacag

SEQ ID NO: 585347 - DNA, 25 bp, Mus musculus
ccaagtaaagggtgaagccaaacag

SEQ ID NO: 585348 - DNA, 25 bp, Mus musculus
ccaagtaatttgcattctgaagttg

SEQ ID NO: 585349 - DNA, 25 bp, Mus musculus
ccaagtaatttggattctgaagttg

SEQ ID NO: 585350 - DNA, 25 bp, Mus musculus
ccaagtacacgacggaccacatggg

SEQ ID NO: 585351 - DNA, 25 bp, Mus musculus
ccaagtacacgagggaccacatggg

SEQ ID NO: 585352 - DNA, 25 bp, Mus musculus
ccaagtacttttatgaccaatgtcc

SEQ ID NO: 585353 - DNA, 25 bp, Mus musculus
ccaagtacttttttgaccaatgtcc

SEQ ID NO: 585354 - DNA, 25 bp, Mus musculus
ccaagtagacaacacaaaggtcacc

SEQ ID NO: 585355 - DNA, 25 bp, Mus musculus
ccaagtagacaagacaaaggtcacc

SEQ ID NO: 585356 - DNA, 25 bp, Mus musculus
ccaagtagacataaggatggagggc

SEQ ID NO: 585357 - DNA, 25 bp, Mus musculus
ccaagtagacattaggatggagggc

SEQ ID NO: 585358 - DNA, 25 bp, Mus musculus
ccaagtagagctccgggaacaaatt

SEQ ID NO: 585359 - DNA, 25 bp, Mus musculus
ccaagtagagctgcgggaacaaatt

SEQ ID NO: 585360 - DNA, 25 bp, Mus musculus
ccaagtagcagcaagcctcgagtga

SEQ ID NO: 585361 - DNA, 25 bp, Mus musculus
ccaagtagcagctagcctcgagtga

SEQ ID NO: 585362 - DNA, 25 bp, Mus musculus
ccaagtagcatacgaacaatgccca

SEQ ID NO: 585363 - DNA, 25 bp, Mus musculus
ccaagtagcataggaacaatgccca

SEQ ID NO: 585364 - DNA, 25 bp, Mus musculus
ccaagtagctataatgtttccaacc

SEQ ID NO: 585365 - DNA, 25 bp, Mus musculus
ccaagtagctattatgtttccaacc

SEQ ID NO: 585366 - DNA, 25 bp, Mus musculus
ccaagtagtggcatcctatgaggag

SEQ ID NO: 585367 - DNA, 25 bp, Mus musculus
ccaagtagtggcttcctatgaggag

SEQ ID NO: 585368 - DNA, 25 bp, Mus musculus
ccaagtataattcctgttgcctacg

SEQ ID NO: 585369 - DNA, 25 bp, Mus musculus
ccaagtataattgctgttgcctacg

SEQ ID NO: 585370 - DNA, 25 bp, Mus musculus
ccaagtatatcaaggagtctccaaa

SEQ ID NO: 585371 - DNA, 25 bp, Mus musculus
ccaagtatatcatggagtctccaaa

SEQ ID NO: 585372 - DNA, 25 bp, Mus musculus
ccaagtatcatcaaaaccatcccag

SEQ ID NO: 585373 - DNA, 25 bp, Mus musculus
ccaagtatcatctaaaccatcccag

SEQ ID NO: 585374 - DNA, 25 bp, Mus musculus
ccaagtatctcgaaccagggagcct

SEQ ID NO: 585375 - DNA, 25 bp, Mus musculus
ccaagtatctcgtaccagggagcct

SEQ ID NO: 585376 - DNA, 25 bp, Mus musculus
ccaagtatggtgagcagctgtgtgc

SEQ ID NO: 585377 - DNA, 25 bp, Mus musculus
ccaagtatggtgtgcagctgtgtgc

SEQ ID NO: 585378 - DNA, 25 bp, Mus musculus
ccaagtcagaacatagagaagccct

SEQ ID NO: 585379 - DNA, 25 bp, Mus musculus
ccaagtcagaacttagagaagccct

SEQ ID NO: 585380 - DNA, 25 bp, Mus musculus
ccaagtcagcaaagatgagcgccca

SEQ ID NO: 585381 - DNA, 25 bp, Mus musculus
ccaagtcagcaatgatgagcgccca

SEQ ID NO: 585382 - DNA, 25 bp, Mus musculus
ccaagtccatcaaggctgctgctgg

SEQ ID NO: 585383 - DNA, 25 bp, Mus musculus
ccaagtccatcatggctgctgctgg

SEQ ID NO: 585384 - DNA, 25 bp, Mus musculus
ccaagtccatgaagtttgtggatgg

SEQ ID NO: 585385 - DNA, 25 bp, Mus musculus
ccaagtccatgatgtttgtggatgg

SEQ ID NO: 585386 - DNA, 25 bp, Mus musculus
ccaagtcctggcataactacatgtg

SEQ ID NO: 585387 - DNA, 25 bp, Mus musculus
ccaagtcctggcttaactacatgtg

SEQ ID NO: 585388 - DNA, 25 bp, Mus musculus
ccaagtcggagccaatgtgcagtca

SEQ ID NO: 585389 - DNA, 25 bp, Mus musculus
ccaagtcggagcgaatgtgcagtca

SEQ ID NO: 585390 - DNA, 25 bp, Mus musculus
ccaagtcggtggaccacgaggagac

SEQ ID NO: 585391 - DNA, 25 bp, Mus musculus
ccaagtcggtggtccacgaggagac

SEQ ID NO: 585392 - DNA, 25 bp, Mus musculus
ccaagtcgtaagacgcccgggagtg

SEQ ID NO: 585393 - DNA, 25 bp, Mus musculus
ccaagtcgtaagtcgcccgggagtg

SEQ ID NO: 585394 - DNA, 25 bp, Mus musculus
ccaagtctcccaagagctgagatta

SEQ ID NO: 585395 - DNA, 25 bp, Mus musculus
ccaagtctcccatgagctgagatta

SEQ ID NO: 585396 - DNA, 25 bp, Mus musculus
ccaagtctgtgactgaagacgtcca

SEQ ID NO: 585397 - DNA, 25 bp, Mus musculus
ccaagtctgtgagtgaagacgtcca

SEQ ID NO: 585398 - DNA, 25 bp, Mus musculus
ccaagtcttcctatcagagagtggc

SEQ ID NO: 585399 - DNA, 25 bp, Mus musculus
ccaagtcttcctttcagagagtggc

SEQ ID NO: 585400 - DNA, 25 bp, Mus musculus
ccaagtgaccaaagcagtggtacct

SEQ ID NO: 585401 - DNA, 25 bp, Mus musculus
ccaagtgaccaatgcagtggtacct

SEQ ID NO: 585402 - DNA, 25 bp, Mus musculus
ccaagtgacggaccggaagtgctcc

SEQ ID NO: 585403 - DNA, 25 bp, Mus musculus
ccaagtgacggagcggaagtgctcc

SEQ ID NO: 585404 - DNA, 25 bp, Mus musculus
ccaagtgactccactgaagcccagt

SEQ ID NO: 585405 - DNA, 25 bp, Mus musculus
ccaagtgactcctctgaagcccagt

SEQ ID NO: 585406 - DNA, 25 bp, Mus musculus
ccaagtgacttcacaaaatattgga

SEQ ID NO: 585407 - DNA, 25 bp, Mus musculus
ccaagtgacttctcaaaatattgga

SEQ ID NO: 585408 - DNA, 25 bp, Mus musculus
ccaagtgagggacaacagagtgacc

SEQ ID NO: 585409 - DNA, 25 bp, Mus musculus
ccaagtgagggagaacagagtgacc

SEQ ID NO: 585410 - DNA, 25 bp, Mus musculus
ccaagtgagtctacgtcagggcact

SEQ ID NO: 585411 - DNA, 25 bp, Mus musculus
ccaagtgagtcttcgtcagggcact

SEQ ID NO: 585412 - DNA, 25 bp, Mus musculus
ccaagtgataaaccagaaggaggaa

SEQ ID NO: 585413 - DNA, 25 bp, Mus musculus
ccaagtgataaagcagaaggaggaa

SEQ ID NO: 585414 - DNA, 25 bp, Mus musculus
ccaagtgcagttcagccactgaaac

SEQ ID NO: 585415 - DNA, 25 bp, Mus musculus
ccaagtgcagttgagccactgaaac

SEQ ID NO: 585416 - DNA, 25 bp, Mus musculus
ccaagtgcatgaccggatttttgtg

SEQ ID NO: 585417 - DNA, 25 bp, Mus musculus
ccaagtgcatgagcggatttttgtg

SEQ ID NO: 585418 - DNA, 25 bp, Mus musculus
ccaagtgctcacagttctgcactac

SEQ ID NO: 585419 - DNA, 25 bp, Mus musculus
ccaagtgctcactgttctgcactac

SEQ ID NO: 585420 - DNA, 25 bp, Mus musculus
ccaagtggaacaaggccatcgaggt

SEQ ID NO: 585421 - DNA, 25 bp, Mus musculus
ccaagtggaacatggccatcgaggt

SEQ ID NO: 585422 - DNA, 25 bp, Mus musculus
ccaagtggacagagcacctcatctt

SEQ ID NO: 585423 - DNA, 25 bp, Mus musculus
ccaagtggacagtgcacctcatctt

SEQ ID NO: 585424 - DNA, 25 bp, Mus musculus
ccaagtggagttagcagacataggc

SEQ ID NO: 585425 - DNA, 25 bp, Mus musculus
ccaagtggagtttgcagacataggc

SEQ ID NO: 585426 - DNA, 25 bp, Mus musculus
ccaagtggcgagagcggctggccat

SEQ ID NO: 585427 - DNA, 25 bp, Mus musculus
ccaagtggcgagtgcggctggccat

SEQ ID NO: 585428 - DNA, 25 bp, Mus musculus
ccaagtggctgcactgcattgggtc

SEQ ID NO: 585429 - DNA, 25 bp, Mus musculus
ccaagtggctgctctgcattgggtc

SEQ ID NO: 585430 - DNA, 25 bp, Mus musculus
ccaagtgggagcaatccaggacccg

SEQ ID NO: 585431 - DNA, 25 bp, Mus musculus
ccaagtgggagctatccaggacccg

SEQ ID NO: 585432 - DNA, 25 bp, Mus musculus
ccaagtgggtggagaataagtcatc

SEQ ID NO: 585433 - DNA, 25 bp, Mus musculus
ccaagtgggtggtgaataagtcatc

SEQ ID NO: 585434 - DNA, 25 bp, Mus musculus
ccaagtggtcagaaaacggctctca

SEQ ID NO: 585435 - DNA, 25 bp, Mus musculus
ccaagtggtcagtaaacggctctca

SEQ ID NO: 585436 - DNA, 25 bp, Mus musculus
ccaagtgtaacaactgtaaggagtg

SEQ ID NO: 585437 - DNA, 25 bp, Mus musculus
ccaagtgtaacatctgtaaggagtg

SEQ ID NO: 585438 - DNA, 25 bp, Mus musculus
ccaagtgtaaccagacagatcacca

SEQ ID NO: 585439 - DNA, 25 bp, Mus musculus
ccaagtgtaacctgacagatcacca

SEQ ID NO: 585440 - DNA, 25 bp, Mus musculus
ccaagtgtaagtaagtcggtagagt

SEQ ID NO: 585441 - DNA, 25 bp, Mus musculus
ccaagtgtaagttagtcggtagagt

SEQ ID NO: 585442 - DNA, 25 bp, Mus musculus
ccaagtgtccgcacctgaaggatga

SEQ ID NO: 585443 - DNA, 25 bp, Mus musculus
ccaagtgtccgctcctgaaggatga

SEQ ID NO: 585444 - DNA, 25 bp, Mus musculus
ccaagtgtcgagagcccatctatga

SEQ ID NO: 585445 - DNA, 25 bp, Mus musculus
ccaagtgtcgagtgcccatctatga

SEQ ID NO: 585446 - DNA, 25 bp, Mus musculus
ccaagtgtcgttctgtggtctcaga

SEQ ID NO: 585447 - DNA, 25 bp, Mus musculus
ccaagtgtcgttgtgtggtctcaga

SEQ ID NO: 585448 - DNA, 25 bp, Mus musculus
ccaagtgtgcctcggatgacctcag

SEQ ID NO: 585449 - DNA, 25 bp, Mus musculus
ccaagtgtgcctgggatgacctcag

SEQ ID NO: 585450 - DNA, 25 bp, Mus musculus
ccaagtgtgggaatagaggccaaaa

SEQ ID NO: 585451 - DNA, 25 bp, Mus musculus
ccaagtgtgggattagaggccaaaa

SEQ ID NO: 585452 - DNA, 25 bp, Mus musculus
ccaagtgtgtggagaaggaggtcat

SEQ ID NO: 585453 - DNA, 25 bp, Mus musculus
ccaagtgtgtggtgaaggaggtcat

SEQ ID NO: 585454 - DNA, 25 bp, Mus musculus
ccaagtgtgtgtcgtaactggtgcc

SEQ ID NO: 585455 - DNA, 25 bp, Mus musculus
ccaagtgtgtgtggtaactggtgcc

SEQ ID NO: 585456 - DNA, 25 bp, Mus musculus
ccaagtgtgttgacaagtggttgaa

SEQ ID NO: 585457 - DNA, 25 bp, Mus musculus
ccaagtgtgttgtcaagtggttgaa

SEQ ID NO: 585458 - DNA, 25 bp, Mus musculus
ccaagtgtttcacgctgcgctgtga

SEQ ID NO: 585459 - DNA, 25 bp, Mus musculus
ccaagtgtttcaggctgcgctgtga

SEQ ID NO: 585460 - DNA, 25 bp, Mus musculus
ccaagtgtttgacgccaagtgcctg

SEQ ID NO: 585461 - DNA, 25 bp, Mus musculus
ccaagtgtttgaggccaagtgcctg

SEQ ID NO: 585462 - DNA, 25 bp, Mus musculus
ccaagttagtgtatagcatccttga

SEQ ID NO: 585463 - DNA, 25 bp, Mus musculus
ccaagttagtgtttagcatccttga

SEQ ID NO: 585464 - DNA, 25 bp, Mus musculus
ccaagttcatggctctgatctgtga

SEQ ID NO: 585465 - DNA, 25 bp, Mus musculus
ccaagttcatgggtctgatctgtga

SEQ ID NO: 585466 - DNA, 25 bp, Mus musculus
ccaagttcgacacctggaagaacag

SEQ ID NO: 585467 - DNA, 25 bp, Mus musculus
ccaagttcgacagctggaagaacag

SEQ ID NO: 585468 - DNA, 25 bp, Mus musculus
ccaagttcggcaatgagaaggaggt

SEQ ID NO: 585469 - DNA, 25 bp, Mus musculus
ccaagttcggcattgagaaggaggt

SEQ ID NO: 585470 - DNA, 25 bp, Mus musculus
ccaagttctaaaccacgggctgtga

SEQ ID NO: 585471 - DNA, 25 bp, Mus musculus
ccaagttctaaagcacgggctgtga

SEQ ID NO: 585472 - DNA, 25 bp, Mus musculus
ccaagttgacgcagcacgggttgca

SEQ ID NO: 585473 - DNA, 25 bp, Mus musculus
ccaagttgacgctgcacgggttgca

SEQ ID NO: 585474 - DNA, 25 bp, Mus musculus
ccaagttgtgggactccagtcggga

SEQ ID NO: 585475 - DNA, 25 bp, Mus musculus
ccaagttgtgggtctccagtcggga

SEQ ID NO: 585476 - DNA, 25 bp, Mus musculus
ccaagtttattgaaatgtcctcatc

SEQ ID NO: 585477 - DNA, 25 bp, Mus musculus
ccaagtttattgtaatgtcctcatc

SEQ ID NO: 585478 - DNA, 25 bp, Mus musculus
ccaagtttgaagagatgtgtgcact

SEQ ID NO: 585479 - DNA, 25 bp, Mus musculus
ccaagtttgaagtgatgtgtgcact

SEQ ID NO: 585480 - DNA, 25 bp, Mus musculus
ccaagtttgaggagtacggcccagt

SEQ ID NO: 585481 - DNA, 25 bp, Mus musculus
ccaagtttgaggtgtacggcccagt

SEQ ID NO: 585482 - DNA, 25 bp, Mus musculus
ccaagtttggataatgagtggaaag

SEQ ID NO: 585483 - DNA, 25 bp, Mus musculus
ccaagtttggattatgagtggaaag

SEQ ID NO: 585484 - DNA, 25 bp, Mus musculus
ccaataaagaacataggaatgtgtc

SEQ ID NO: 585485 - DNA, 25 bp, Mus musculus
ccaataaagaacttaggaatgtgtc

SEQ ID NO: 585486 - DNA, 25 bp, Mus musculus
ccaataaatcatctatggagagtga

SEQ ID NO: 585487 - DNA, 25 bp, Mus musculus
ccaataaatcatgtatggagagtga

SEQ ID NO: 585488 - DNA, 25 bp, Mus musculus
ccaataactttgcatcggagcagga

SEQ ID NO: 585489 - DNA, 25 bp, Mus musculus
ccaataactttggatcggagcagga

SEQ ID NO: 585490 - DNA, 25 bp, Mus musculus
ccaataagatggctctgaagtttca

SEQ ID NO: 585491 - DNA, 25 bp, Mus musculus
ccaataagatgggtctgaagtttca

SEQ ID NO: 585492 - DNA, 25 bp, Mus musculus
ccaataagctggcaccttccggcaa

SEQ ID NO: 585493 - DNA, 25 bp, Mus musculus
ccaataagctgggaccttccggcaa

SEQ ID NO: 585494 - DNA, 25 bp, Mus musculus
ccaataagggcaagaaggtgactcc

SEQ ID NO: 585495 - DNA, 25 bp, Mus musculus
ccaataagggcatgaaggtgactcc

SEQ ID NO: 585496 - DNA, 25 bp, Mus musculus
ccaataagtattccgctgacccgga

SEQ ID NO: 585497 - DNA, 25 bp, Mus musculus
ccaataagtattgcgctgacccgga

SEQ ID NO: 585498 - DNA, 25 bp, Mus musculus
ccaataatgagaccggcgtcatcat

SEQ ID NO: 585499 - DNA, 25 bp, Mus musculus
ccaataatgagagcggcgtcatcat

SEQ ID NO: 585500 - DNA, 25 bp, Mus musculus
ccaatagcggcaacggaaagatgac

SEQ ID NO: 585501 - DNA, 25 bp, Mus musculus
ccaatagcggcatcggaaagatgac

SEQ ID NO: 585502 - DNA, 25 bp, Mus musculus
ccaatagtcaacagagccagagcag

SEQ ID NO: 585503 - DNA, 25 bp, Mus musculus
ccaatagtcaactgagccagagcag

SEQ ID NO: 585504 - DNA, 25 bp, Mus musculus
ccaatagtctagctttgaatgccag

SEQ ID NO: 585505 - DNA, 25 bp, Mus musculus
ccaatagtctaggtttgaatgccag

SEQ ID NO: 585506 - DNA, 25 bp, Mus musculus
ccaatagttatgactctgatgaagc

SEQ ID NO: 585507 - DNA, 25 bp, Mus musculus
ccaatagttatgtctctgatgaagc

SEQ ID NO: 585508 - DNA, 25 bp, Mus musculus
ccaatatccagtcgcttggaaagat

SEQ ID NO: 585509 - DNA, 25 bp, Mus musculus
ccaatatccagtggcttggaaagat

SEQ ID NO: 585510 - DNA, 25 bp, Mus musculus
ccaatatgatcgactgattttgaaa

SEQ ID NO: 585511 - DNA, 25 bp, Mus musculus
ccaatatgatcgtctgattttgaaa

SEQ ID NO: 585512 - DNA, 25 bp, Mus musculus
ccaatatggcggagtgcatcgcggt

SEQ ID NO: 585513 - DNA, 25 bp, Mus musculus
ccaatatggcggtgtgcatcgcggt

SEQ ID NO: 585514 - DNA, 25 bp, Mus musculus
ccaatatgtccgatgtgagatggaa

SEQ ID NO: 585515 - DNA, 25 bp, Mus musculus
ccaatatgtccgttgtgagatggaa

SEQ ID NO: 585516 - DNA, 25 bp, Mus musculus
ccaatatttatcacctcttgaagag

SEQ ID NO: 585517 - DNA, 25 bp, Mus musculus
ccaatatttatctcctcttgaagag

SEQ ID NO: 585518 - DNA, 25 bp, Mus musculus
ccaatcaaagcaagaggagccggtc

SEQ ID NO: 585519 - DNA, 25 bp, Mus musculus
ccaatcaaagcatgaggagccggtc

SEQ ID NO: 585520 - DNA, 25 bp, Mus musculus
ccaatcacaattccgaagatgaagg

SEQ ID NO: 585521 - DNA, 25 bp, Mus musculus
ccaatcacaattgcgaagatgaagg

SEQ ID NO: 585522 - DNA, 25 bp, Mus musculus
ccaatcagaacgaggtgagaagtcg

SEQ ID NO: 585523 - DNA, 25 bp, Mus musculus
ccaatcagaacgtggtgagaagtcg

SEQ ID NO: 585524 - DNA, 25 bp, Mus musculus
ccaatcatgtccctgtctcttcaga

SEQ ID NO: 585525 - DNA, 25 bp, Mus musculus
ccaatcatgtccgtgtctcttcaga

SEQ ID NO: 585526 - DNA, 25 bp, Mus musculus
ccaatccaatatctccgttgtgaga

SEQ ID NO: 585527 - DNA, 25 bp, Mus musculus
ccaatccaatatgtccgttgtgaga

SEQ ID NO: 585528 - DNA, 25 bp, Mus musculus
ccaatccacattctgtacgttcctt

SEQ ID NO: 585529 - DNA, 25 bp, Mus musculus
ccaatccacattgtgtacgttcctt

SEQ ID NO: 585530 - DNA, 25 bp, Mus musculus
ccaatccatagtacctttgaggatg

SEQ ID NO: 585531 - DNA, 25 bp, Mus musculus
ccaatccatagttcctttgaggatg

SEQ ID NO: 585532 - DNA, 25 bp, Mus musculus
ccaatcctcatcacactacgggaag

SEQ ID NO: 585533 - DNA, 25 bp, Mus musculus
ccaatcctcatctcactacgggaag

SEQ ID NO: 585534 - DNA, 25 bp, Mus musculus
ccaatcggtgagagaaggtcaagat

SEQ ID NO: 585535 - DNA, 25 bp, Mus musculus
ccaatcggtgagtgaaggtcaagat

SEQ ID NO: 585536 - DNA, 25 bp, Mus musculus
ccaatcgtctccaagaagggatacc

SEQ ID NO: 585537 - DNA, 25 bp, Mus musculus
ccaatcgtctcctagaagggatacc

SEQ ID NO: 585538 - DNA, 25 bp, Mus musculus
ccaatctaagttccccagggtacct

SEQ ID NO: 585539 - DNA, 25 bp, Mus musculus
ccaatctaagttgcccagggtacct

SEQ ID NO: 585540 - DNA, 25 bp, Mus musculus
ccaatctggacaacctggacacagc

SEQ ID NO: 585541 - DNA, 25 bp, Mus musculus
ccaatctggacatcctggacacagc

SEQ ID NO: 585542 - DNA, 25 bp, Mus musculus
ccaatctgtttgagaatgcgggcga

SEQ ID NO: 585543 - DNA, 25 bp, Mus musculus
ccaatctgtttgtgaatgcgggcga

SEQ ID NO: 585544 - DNA, 25 bp, Mus musculus
ccaatcttcgatatgctacacgaga

SEQ ID NO: 585545 - DNA, 25 bp, Mus musculus
ccaatcttcgatttgctacacgaga

SEQ ID NO: 585546 - DNA, 25 bp, Mus musculus
ccaatcttgggtcaagggctgtcag

SEQ ID NO: 585547 - DNA, 25 bp, Mus musculus
ccaatcttgggtgaagggctgtcag

SEQ ID NO: 585548 - DNA, 25 bp, Mus musculus
ccaatctttggtctgatgtcccaga

SEQ ID NO: 585549 - DNA, 25 bp, Mus musculus
ccaatctttggtgtgatgtcccaga

SEQ ID NO: 585550 - DNA, 25 bp, Mus musculus
ccaatgaaagggacagggctcacag

SEQ ID NO: 585551 - DNA, 25 bp, Mus musculus
ccaatgaaagggtcagggctcacag

SEQ ID NO: 585552 - DNA, 25 bp, Mus musculus
ccaatgaacaggcagtccattctct

SEQ ID NO: 585553 - DNA, 25 bp, Mus musculus
ccaatgaacagggagtccattctct

SEQ ID NO: 585554 - DNA, 25 bp, Mus musculus
ccaatgaagcgcaacaggtggactt

SEQ ID NO: 585555 - DNA, 25 bp, Mus musculus
ccaatgaagcgctacaggtggactt

SEQ ID NO: 585556 - DNA, 25 bp, Mus musculus
ccaatgaatcggctcctggctgtcc

SEQ ID NO: 585557 - DNA, 25 bp, Mus musculus
ccaatgaatcgggtcctggctgtcc

SEQ ID NO: 585558 - DNA, 25 bp, Mus musculus
ccaatgacatgtatcgatataatga

SEQ ID NO: 585559 - DNA, 25 bp, Mus musculus
ccaatgacatgtttcgatataatga

SEQ ID NO: 585560 - DNA, 25 bp, Mus musculus
ccaatgaccgtgctgaccatggcca

SEQ ID NO: 585561 - DNA, 25 bp, Mus musculus
ccaatgaccgtggtgaccatggcca

SEQ ID NO: 585562 - DNA, 25 bp, Mus musculus
ccaatgacggtgagactgctgagga

SEQ ID NO: 585563 - DNA, 25 bp, Mus musculus
ccaatgacggtgtgactgctgagga

SEQ ID NO: 585564 - DNA, 25 bp, Mus musculus
ccaatgagaagcatctgacccagca

SEQ ID NO: 585565 - DNA, 25 bp, Mus musculus
ccaatgagaagcttctgacccagca

SEQ ID NO: 585566 - DNA, 25 bp, Mus musculus
ccaatgagagcgctgtttctcatcc

SEQ ID NO: 585567 - DNA, 25 bp, Mus musculus
ccaatgagagcggtgtttctcatcc

SEQ ID NO: 585568 - DNA, 25 bp, Mus musculus
ccaatgagatgtcctggaaaatata

SEQ ID NO: 585569 - DNA, 25 bp, Mus musculus
ccaatgagatgtgctggaaaatata

SEQ ID NO: 585570 - DNA, 25 bp, Mus musculus
ccaatgaggaatacaggcaggtggt

SEQ ID NO: 585571 - DNA, 25 bp, Mus musculus
ccaatgaggaatcggagactgcatc

SEQ ID NO: 585572 - DNA, 25 bp, Mus musculus
ccaatgaggaatgggagactgcatc

SEQ ID NO: 585573 - DNA, 25 bp, Mus musculus
ccaatgaggaattcaggcaggtggt

SEQ ID NO: 585574 - DNA, 25 bp, Mus musculus
ccaatgaggacgataaattcactgt

SEQ ID NO: 585575 - DNA, 25 bp, Mus musculus
ccaatgaggacgttaaattcactgt

SEQ ID NO: 585576 - DNA, 25 bp, Mus musculus
ccaatgagttctatgatggcgacca

SEQ ID NO: 585577 - DNA, 25 bp, Mus musculus
ccaatgagttctttgatggcgacca

SEQ ID NO: 585578 - DNA, 25 bp, Mus musculus
ccaatgatccctcatgcagagtgtt

SEQ ID NO: 585579 - DNA, 25 bp, Mus musculus
ccaatgatccctgatgcagagtgtt

SEQ ID NO: 585580 - DNA, 25 bp, Mus musculus
ccaatgatgcacatctgccccagag

SEQ ID NO: 585581 - DNA, 25 bp, Mus musculus
ccaatgatgcacttctgccccagag

SEQ ID NO: 585582 - DNA, 25 bp, Mus musculus
ccaatgatgggcaaaggatgtttga

SEQ ID NO: 585583 - DNA, 25 bp, Mus musculus
ccaatgatgggctaaggatgtttga

SEQ ID NO: 585584 - DNA, 25 bp, Mus musculus
ccaatgattcaacaaatggtattct

SEQ ID NO: 585585 - DNA, 25 bp, Mus musculus
ccaatgattcaagaaatggtattct

SEQ ID NO: 585586 - DNA, 25 bp, Mus musculus
ccaatgcaatcgagggtgtgtggca

SEQ ID NO: 585587 - DNA, 25 bp, Mus musculus
ccaatgcaatcgtgggtgtgtggca

SEQ ID NO: 585588 - DNA, 25 bp, Mus musculus
ccaatgcagtggctgtcgctatgta

SEQ ID NO: 585589 - DNA, 25 bp, Mus musculus
ccaatgcagtgggtgtcgctatgta

SEQ ID NO: 585590 - DNA, 25 bp, Mus musculus
ccaatgcatggaacagaaactcagc

SEQ ID NO: 585591 - DNA, 25 bp, Mus musculus
ccaatgcatggatcagaaactcagc

SEQ ID NO: 585592 - DNA, 25 bp, Mus musculus
ccaatgcattgaaagttaatttgac

SEQ ID NO: 585593 - DNA, 25 bp, Mus musculus
ccaatgcattgatagttaatttgac

SEQ ID NO: 585594 - DNA, 25 bp, Mus musculus
ccaatgccatgtattttaagaccaa

SEQ ID NO: 585595 - DNA, 25 bp, Mus musculus
ccaatgccatgttttttaagaccaa

SEQ ID NO: 585596 - DNA, 25 bp, Mus musculus
ccaatgccgataaaggagaaacaac

SEQ ID NO: 585597 - DNA, 25 bp, Mus musculus
ccaatgccgatataggagaaacaac

SEQ ID NO: 585598 - DNA, 25 bp, Mus musculus
ccaatgcgaacgctgcgatcaagaa

SEQ ID NO: 585599 - DNA, 25 bp, Mus musculus
ccaatgcgaacggtgcgatcaagaa

SEQ ID NO: 585600 - DNA, 25 bp, Mus musculus
ccaatgctgaggagggcccgttcat

SEQ ID NO: 585601 - DNA, 25 bp, Mus musculus
ccaatgctgaggtgggcccgttcat

SEQ ID NO: 585602 - DNA, 25 bp, Mus musculus
ccaatgctgcagctgatccgagccg

SEQ ID NO: 585603 - DNA, 25 bp, Mus musculus
ccaatgctgcaggtgatccgagccg

SEQ ID NO: 585604 - DNA, 25 bp, Mus musculus
ccaatgctgtgacagagatggcctg

SEQ ID NO: 585605 - DNA, 25 bp, Mus musculus
ccaatgctgtgagagagatggcctg

SEQ ID NO: 585606 - DNA, 25 bp, Mus musculus
ccaatgcttcgcaaccagaaagcaa

SEQ ID NO: 585607 - DNA, 25 bp, Mus musculus
ccaatgcttcgctaccagaaagcaa

SEQ ID NO: 585608 - DNA, 25 bp, Mus musculus
ccaatggaacagagtccaggagatg

SEQ ID NO: 585609 - DNA, 25 bp, Mus musculus
ccaatggaacagtgtccaggagatg

SEQ ID NO: 585610 - DNA, 25 bp, Mus musculus
ccaatggacgctacctggatggagg

SEQ ID NO: 585611 - DNA, 25 bp, Mus musculus
ccaatggacgcttcctggatggagg

SEQ ID NO: 585612 - DNA, 25 bp, Mus musculus
ccaatggagatcagcctcaatggca

SEQ ID NO: 585613 - DNA, 25 bp, Mus musculus
ccaatggagatctgcctcaatggca

SEQ ID NO: 585614 - DNA, 25 bp, Mus musculus
ccaatggattgccaacagattttga

SEQ ID NO: 585615 - DNA, 25 bp, Mus musculus
ccaatggattgcgaacagattttga

SEQ ID NO: 585616 - DNA, 25 bp, Mus musculus
ccaatggcagctatcactgcaccaa

SEQ ID NO: 585617 - DNA, 25 bp, Mus musculus
ccaatggcagctttcactgcaccaa

SEQ ID NO: 585618 - DNA, 25 bp, Mus musculus
ccaatggcaggcagtgtcccgggat

SEQ ID NO: 585619 - DNA, 25 bp, Mus musculus
ccaatggcaggctgtgtcccgggat

SEQ ID NO: 585620 - DNA, 25 bp, Mus musculus
ccaatggcaggtcgtcactgagtgt

SEQ ID NO: 585621 - DNA, 25 bp, Mus musculus
ccaatggcaggtggtcactgagtgt

SEQ ID NO: 585622 - DNA, 25 bp, Mus musculus
ccaatggcctgaagtacatgttcac

SEQ ID NO: 585623 - DNA, 25 bp, Mus musculus
ccaatggcctgatgtacatgttcac

SEQ ID NO: 585624 - DNA, 25 bp, Mus musculus
ccaatggctggcctcagagtgaaga

SEQ ID NO: 585625 - DNA, 25 bp, Mus musculus
ccaatggctggcgtcagagtgaaga

SEQ ID NO: 585626 - DNA, 25 bp, Mus musculus
ccaatggcttttagctaagaccgaa

SEQ ID NO: 585627 - DNA, 25 bp, Mus musculus
ccaatggctttttgctaagaccgaa

SEQ ID NO: 585628 - DNA, 25 bp, Mus musculus
ccaatgggaacgctgtgagtgtcca

SEQ ID NO: 585629 - DNA, 25 bp, Mus musculus
ccaatgggaacggtgtgagtgtcca

SEQ ID NO: 585630 - DNA, 25 bp, Mus musculus
ccaatgtctcttcggagcctggctt

SEQ ID NO: 585631 - DNA, 25 bp, Mus musculus
ccaatgtctcttgggagcctggctt

SEQ ID NO: 585632 - DNA, 25 bp, Mus musculus
ccaatgtcttctccagcggcagtgg

SEQ ID NO: 585633 - DNA, 25 bp, Mus musculus
ccaatgtcttctgcagcggcagtgg

SEQ ID NO: 585634 - DNA, 25 bp, Mus musculus
ccaatgtgaaccagactctgaggcc

SEQ ID NO: 585635 - DNA, 25 bp, Mus musculus
ccaatgtgaaccaggcctacctggg

SEQ ID NO: 585636 - DNA, 25 bp, Mus musculus
ccaatgtgaacctgactctgaggcc

SEQ ID NO: 585637 - DNA, 25 bp, Mus musculus
ccaatgtgaacctggcctacctggg

SEQ ID NO: 585638 - DNA, 25 bp, Mus musculus
ccaatgtgcatgagtggtttcctac

SEQ ID NO: 585639 - DNA, 25 bp, Mus musculus
ccaatgtgcatgtgtggtttcctac

SEQ ID NO: 585640 - DNA, 25 bp, Mus musculus
ccaatgtgggagatcaacttcaagt

SEQ ID NO: 585641 - DNA, 25 bp, Mus musculus
ccaatgtgggagttcaacttcaagt

SEQ ID NO: 585642 - DNA, 25 bp, Mus musculus
ccaatgtgtgcgacgatgaccagct

SEQ ID NO: 585643 - DNA, 25 bp, Mus musculus
ccaatgtgtgcgtcgatgaccagct

SEQ ID NO: 585644 - DNA, 25 bp, Mus musculus
ccaatgtgtttaaggatttgtagat

SEQ ID NO: 585645 - DNA, 25 bp, Mus musculus
ccaatgtgtttatggatttgtagat

SEQ ID NO: 585646 - DNA, 25 bp, Mus musculus
ccaatgttcagtcttgacatagcct

SEQ ID NO: 585647 - DNA, 25 bp, Mus musculus
ccaatgttcagtgttgacatagcct

SEQ ID NO: 585648 - DNA, 25 bp, Mus musculus
ccaatgttttgaactggcgggcact

SEQ ID NO: 585649 - DNA, 25 bp, Mus musculus
ccaatgttttgatctggcgggcact

SEQ ID NO: 585650 - DNA, 25 bp, Mus musculus
ccaattaatgtaactaccagactca

SEQ ID NO: 585651 - DNA, 25 bp, Mus musculus
ccaattaatgtatctaccagactca

SEQ ID NO: 585652 - DNA, 25 bp, Mus musculus
ccaattactatgaggaattctccat

SEQ ID NO: 585653 - DNA, 25 bp, Mus musculus
ccaattactatgtggaattctccat

SEQ ID NO: 585654 - DNA, 25 bp, Mus musculus
ccaattagtgatcgaaggctacaag

SEQ ID NO: 585655 - DNA, 25 bp, Mus musculus
ccaattagtgatggaaggctacaag

SEQ ID NO: 585656 - DNA, 25 bp, Mus musculus
ccaattatgtcaagggagtgattca

SEQ ID NO: 585657 - DNA, 25 bp, Mus musculus
ccaattatgtcatgggagtgattca

SEQ ID NO: 585658 - DNA, 25 bp, Mus musculus
ccaattattattacgatgtttccca

SEQ ID NO: 585659 - DNA, 25 bp, Mus musculus
ccaattattatttcgatgtttccca

SEQ ID NO: 585660 - DNA, 25 bp, Mus musculus
ccaattattgcacgtttcattagag

SEQ ID NO: 585661 - DNA, 25 bp, Mus musculus
ccaattattgcaggtttcattagag

SEQ ID NO: 585662 - DNA, 25 bp, Mus musculus
ccaattcgttaccaggagaagtact

SEQ ID NO: 585663 - DNA, 25 bp, Mus musculus
ccaattcgttacgaggagaagtact

SEQ ID NO: 585664 - DNA, 25 bp, Mus musculus
ccaattctctacagatgaaaacgtg

SEQ ID NO: 585665 - DNA, 25 bp, Mus musculus
ccaattctctactgatgaaaacgtg

SEQ ID NO: 585666 - DNA, 25 bp, Mus musculus
ccaattcttccgagatgtcacagcg

SEQ ID NO: 585667 - DNA, 25 bp, Mus musculus
ccaattcttccgtgatgtcacagcg

SEQ ID NO: 585668 - DNA, 25 bp, Mus musculus
ccaattcttgagatggattataaca

SEQ ID NO: 585669 - DNA, 25 bp, Mus musculus
ccaattcttgagttggattataaca

SEQ ID NO: 585670 - DNA, 25 bp, Mus musculus
ccaattctttgtcatagaagagtac

SEQ ID NO: 585671 - DNA, 25 bp, Mus musculus
ccaattctttgtgatagaagagtac

SEQ ID NO: 585672 - DNA, 25 bp, Mus musculus
ccaattgactttcaaacgaatagga

SEQ ID NO: 585673 - DNA, 25 bp, Mus musculus
ccaattgactttgaaacgaatagga

SEQ ID NO: 585674 - DNA, 25 bp, Mus musculus
ccaattgctgagagagagagttaac

SEQ ID NO: 585675 - DNA, 25 bp, Mus musculus
ccaattgctgagtgagagagttaac

SEQ ID NO: 585676 - DNA, 25 bp, Mus musculus
ccaatttcaaaacgaccatgcttcg

SEQ ID NO: 585677 - DNA, 25 bp, Mus musculus
ccaatttcaaaaggaccatgcttcg

SEQ ID NO: 585678 - DNA, 25 bp, Mus musculus
ccaatttgaagtatttgctgcatca

SEQ ID NO: 585679 - DNA, 25 bp, Mus musculus
ccaatttgaagtttttgctgcatca

SEQ ID NO: 585680 - DNA, 25 bp, Mus musculus
ccaatttgccaacggttagctgctc

SEQ ID NO: 585681 - DNA, 25 bp, Mus musculus
ccaatttgccaagggttagctgctc

SEQ ID NO: 585682 - DNA, 25 bp, Mus musculus
ccacaaaaacaccatcttctgatgt

SEQ ID NO: 585683 - DNA, 25 bp, Mus musculus
ccacaaaaacacgatcttctgatgt

SEQ ID NO: 585684 - DNA, 25 bp, Mus musculus
ccacaaaacactcgcaggaatcgtc

SEQ ID NO: 585685 - DNA, 25 bp, Mus musculus
ccacaaaacactggcaggaatcgtc

SEQ ID NO: 585686 - DNA, 25 bp, Mus musculus
ccacaaaagagactgagggcttccg

SEQ ID NO: 585687 - DNA, 25 bp, Mus musculus
ccacaaaagagagtgagggcttccg

SEQ ID NO: 585688 - DNA, 25 bp, Mus musculus
ccacaaaagcccaggatgactgtct

SEQ ID NO: 585689 - DNA, 25 bp, Mus musculus
ccacaaaagccctggatgactgtct

SEQ ID NO: 585690 - DNA, 25 bp, Mus musculus
ccacaaaggaggcacatgtatcaac

SEQ ID NO: 585691 - DNA, 25 bp, Mus musculus
ccacaaaggagggacatgtatcaac

SEQ ID NO: 585692 - DNA, 25 bp, Mus musculus
ccacaaaggcccctggaaaggcact

SEQ ID NO: 585693 - DNA, 25 bp, Mus musculus
ccacaaaggcccgtggaaaggcact

SEQ ID NO: 585694 - DNA, 25 bp, Mus musculus
ccacaacaaaagcaagacattctta

SEQ ID NO: 585695 - DNA, 25 bp, Mus musculus
ccacaacaaaaggaagacattctta

SEQ ID NO: 585696 - DNA, 25 bp, Mus musculus
ccacaacaaccaaccaagtcaaaga

SEQ ID NO: 585697 - DNA, 25 bp, Mus musculus
ccacaacaaccatccaagtcaaaga

SEQ ID NO: 585698 - DNA, 25 bp, Mus musculus
ccacaacaagtgagcattgaagcca

SEQ ID NO: 585699 - DNA, 25 bp, Mus musculus
ccacaacaagtgtgcattgaagcca

SEQ ID NO: 585700 - DNA, 25 bp, Mus musculus
ccacaacagatcaggtgcccatgcg

SEQ ID NO: 585701 - DNA, 25 bp, Mus musculus
ccacaacagatctggtgcccatgcg

SEQ ID NO: 585702 - DNA, 25 bp, Mus musculus
ccacaacatgggagaatctattctt

SEQ ID NO: 585703 - DNA, 25 bp, Mus musculus
ccacaacatgggtgaatctattctt

SEQ ID NO: 585704 - DNA, 25 bp, Mus musculus
ccacaacccagaacctgaggacgat

SEQ ID NO: 585705 - DNA, 25 bp, Mus musculus
ccacaacccagatcctgaggacgat

SEQ ID NO: 585706 - DNA, 25 bp, Mus musculus
ccacaaccttagcaagagggacttg

SEQ ID NO: 585707 - DNA, 25 bp, Mus musculus
ccacaaccttaggaagagggacttg

SEQ ID NO: 585708 - DNA, 25 bp, Mus musculus
ccacaacggtagagaaagacattga

SEQ ID NO: 585709 - DNA, 25 bp, Mus musculus
ccacaacggtagtgaaagacattga

SEQ ID NO: 585710 - DNA, 25 bp, Mus musculus
ccacaactataacgaaatgcgccag

SEQ ID NO: 585711 - DNA, 25 bp, Mus musculus
ccacaactataaggaaatgcgccag

SEQ ID NO: 585712 - DNA, 25 bp, Mus musculus
ccacaactgctaccaaatagctgtg

SEQ ID NO: 585713 - DNA, 25 bp, Mus musculus
ccacaactgctagcaaatagctgtg

SEQ ID NO: 585714 - DNA, 25 bp, Mus musculus
ccacaactggcaagcacaagggcta

SEQ ID NO: 585715 - DNA, 25 bp, Mus musculus
ccacaactggcatgcacaagggcta

SEQ ID NO: 585716 - DNA, 25 bp, Mus musculus
ccacaacttctgctcctatgaggag

SEQ ID NO: 585717 - DNA, 25 bp, Mus musculus
ccacaacttctggtcctatgaggag

SEQ ID NO: 585718 - DNA, 25 bp, Mus musculus
ccacaactttgtcaaggccatcaat

SEQ ID NO: 585719 - DNA, 25 bp, Mus musculus
ccacaactttgtgaaggccatcaat

SEQ ID NO: 585720 - DNA, 25 bp, Mus musculus
ccacaagaagtaatgcagggaggga

SEQ ID NO: 585721 - DNA, 25 bp, Mus musculus
ccacaagaagtattgcagggaggga

SEQ ID NO: 585722 - DNA, 25 bp, Mus musculus
ccacaagaagtgctcgaacgaacct

SEQ ID NO: 585723 - DNA, 25 bp, Mus musculus
ccacaagaagtggtcgaacgaacct

SEQ ID NO: 585724 - DNA, 25 bp, Mus musculus
ccacaagaggcacgtgagcttgtct

SEQ ID NO: 585725 - DNA, 25 bp, Mus musculus
ccacaagaggcaggtgagcttgtct

SEQ ID NO: 585726 - DNA, 25 bp, Mus musculus
ccacaagaggtcagtgtgccattgc

SEQ ID NO: 585727 - DNA, 25 bp, Mus musculus
ccacaagaggtctgtgtgccattgc

SEQ ID NO: 585728 - DNA, 25 bp, Mus musculus
ccacaagcatggctacagtgtttta

SEQ ID NO: 585729 - DNA, 25 bp, Mus musculus
ccacaagcatgggtacagtgtttta

SEQ ID NO: 585730 - DNA, 25 bp, Mus musculus
ccacaagccctgcaagtctgcggaa

SEQ ID NO: 585731 - DNA, 25 bp, Mus musculus
ccacaagccctggaagtctgcggaa

SEQ ID NO: 585732 - DNA, 25 bp, Mus musculus
ccacaagccgaaagagttaccagcc

SEQ ID NO: 585733 - DNA, 25 bp, Mus musculus
ccacaagccgaatgagttaccagcc

SEQ ID NO: 585734 - DNA, 25 bp, Mus musculus
ccacaagcctatctgctagaggaga

SEQ ID NO: 585735 - DNA, 25 bp, Mus musculus
ccacaagcctatgtgctagaggaga

SEQ ID NO: 585736 - DNA, 25 bp, Mus musculus
ccacaagcgcaaactcagtgcctag

SEQ ID NO: 585737 - DNA, 25 bp, Mus musculus
ccacaagcgcaatctcagtgcctag

SEQ ID NO: 585738 - DNA, 25 bp, Mus musculus
ccacaagcgggaatggaatcttttc

SEQ ID NO: 585739 - DNA, 25 bp, Mus musculus
ccacaagcgggattggaatcttttc

SEQ ID NO: 585740 - DNA, 25 bp, Mus musculus
ccacaagctcttcgtctggagagcg

SEQ ID NO: 585741 - DNA, 25 bp, Mus musculus
ccacaagctcttggtctggagagcg

SEQ ID NO: 585742 - DNA, 25 bp, Mus musculus
ccacaagggatcaggctccatatag

SEQ ID NO: 585743 - DNA, 25 bp, Mus musculus
ccacaagggatctggctccatatag

SEQ ID NO: 585744 - DNA, 25 bp, Mus musculus
ccacaagtaaatcatgctgaagtag

SEQ ID NO: 585745 - DNA, 25 bp, Mus musculus
ccacaagtaaatgatgctgaagtag

SEQ ID NO: 585746 - DNA, 25 bp, Mus musculus
ccacaagtaaccagggaagatattg

SEQ ID NO: 585747 - DNA, 25 bp, Mus musculus
ccacaagtaacctgggaagatattg

SEQ ID NO: 585748 - DNA, 25 bp, Mus musculus
ccacaagttggtcatgcctacatcc

SEQ ID NO: 585749 - DNA, 25 bp, Mus musculus
ccacaagttggtgatgcctacatcc

SEQ ID NO: 585750 - DNA, 25 bp, Mus musculus
ccacaataaagaattgagactggag

SEQ ID NO: 585751 - DNA, 25 bp, Mus musculus
ccacaataaagatttgagactggag

SEQ ID NO: 585752 - DNA, 25 bp, Mus musculus
ccacaatgagtgatagattctcagc

SEQ ID NO: 585753 - DNA, 25 bp, Mus musculus
ccacaatgagtgttagattctcagc

SEQ ID NO: 585754 - DNA, 25 bp, Mus musculus
ccacaatggtggctaaacgggacat

SEQ ID NO: 585755 - DNA, 25 bp, Mus musculus
ccacaatggtgggtaaacgggacat

SEQ ID NO: 585756 - DNA, 25 bp, Mus musculus
ccacaatgtcttcagaggtggagac

SEQ ID NO: 585757 - DNA, 25 bp, Mus musculus
ccacaatgtcttgagaggtggagac

SEQ ID NO: 585758 - DNA, 25 bp, Mus musculus
ccacacaagacaatcacttgggtgt

SEQ ID NO: 585759 - DNA, 25 bp, Mus musculus
ccacacaagacattcacttgggtgt

SEQ ID NO: 585760 - DNA, 25 bp, Mus musculus
ccacacaaggtacgcagcgtttttc

SEQ ID NO: 585761 - DNA, 25 bp, Mus musculus
ccacacaaggtaggcagcgtttttc

SEQ ID NO: 585762 - DNA, 25 bp, Mus musculus
ccacacagattgctggtctcaattg

SEQ ID NO: 585763 - DNA, 25 bp, Mus musculus
ccacacagattggtggtctcaattg

SEQ ID NO: 585764 - DNA, 25 bp, Mus musculus
ccacacatgaggaggacctcaccaa

SEQ ID NO: 585765 - DNA, 25 bp, Mus musculus
ccacacatgaggtggacctcaccaa

SEQ ID NO: 585766 - DNA, 25 bp, Mus musculus
ccacaccaagggcatagatatcatc

SEQ ID NO: 585767 - DNA, 25 bp, Mus musculus
ccacaccaaggggatagatatcatc

SEQ ID NO: 585768 - DNA, 25 bp, Mus musculus
ccacaccatagactggctgagggaa

SEQ ID NO: 585769 - DNA, 25 bp, Mus musculus
ccacaccatagagtggctgagggaa

SEQ ID NO: 585770 - DNA, 25 bp, Mus musculus
ccacacccaaccattctgggatgtg

SEQ ID NO: 585771 - DNA, 25 bp, Mus musculus
ccacacccaacctttctgggatgtg

SEQ ID NO: 585772 - DNA, 25 bp, Mus musculus
ccacacctactgactcaagtgtatt

SEQ ID NO: 585773 - DNA, 25 bp, Mus musculus
ccacacctactgtctcaagtgtatt

SEQ ID NO: 585774 - DNA, 25 bp, Mus musculus
ccacacctaggaagttcgtgatttc

SEQ ID NO: 585775 - DNA, 25 bp, Mus musculus
ccacacctaggatgttcgtgatttc

SEQ ID NO: 585776 - DNA, 25 bp, Mus musculus
ccacacctgccaaattgagttagag

SEQ ID NO: 585777 - DNA, 25 bp, Mus musculus
ccacacctgccatattgagttagag

SEQ ID NO: 585778 - DNA, 25 bp, Mus musculus
ccacacctgtgacaggaagcaaaga

SEQ ID NO: 585779 - DNA, 25 bp, Mus musculus
ccacacctgtgagaggaagcaaaga

SEQ ID NO: 585780 - DNA, 25 bp, Mus musculus
ccacacgagtgtcaagccacacaag

SEQ ID NO: 585781 - DNA, 25 bp, Mus musculus
ccacacgagtgtgaagccacacaag

SEQ ID NO: 585782 - DNA, 25 bp, Mus musculus
ccacacggagatcccagaaggaatt

SEQ ID NO: 585783 - DNA, 25 bp, Mus musculus
ccacacggagatgccagaaggaatt

SEQ ID NO: 585784 - DNA, 25 bp, Mus musculus
ccacacggtggaattattgccacag

SEQ ID NO: 585785 - DNA, 25 bp, Mus musculus
ccacacggtggatttattgccacag

SEQ ID NO: 585786 - DNA, 25 bp, Mus musculus
ccacacgtcggtatctggacggcga

SEQ ID NO: 585787 - DNA, 25 bp, Mus musculus
ccacacgtcggtttctggacggcga

SEQ ID NO: 585788 - DNA, 25 bp, Mus musculus
ccacactaattaccccggagtggaa

SEQ ID NO: 585789 - DNA, 25 bp, Mus musculus
ccacactaattagcccggagtggaa

SEQ ID NO: 585790 - DNA, 25 bp, Mus musculus
ccacactagagaaagtcatcgagat

SEQ ID NO: 585791 - DNA, 25 bp, Mus musculus
ccacactagagatagtcatcgagat

SEQ ID NO: 585792 - DNA, 25 bp, Mus musculus
ccacactcatttcttggtgtaacaa

SEQ ID NO: 585793 - DNA, 25 bp, Mus musculus
ccacactcatttgttggtgtaacaa

SEQ ID NO: 585794 - DNA, 25 bp, Mus musculus
ccacactctcggatgttgccggtta

SEQ ID NO: 585795 - DNA, 25 bp, Mus musculus
ccacactctcggttgttgccggtta

SEQ ID NO: 585796 - DNA, 25 bp, Mus musculus
ccacactgacccacatcaatgaggt

SEQ ID NO: 585797 - DNA, 25 bp, Mus musculus
ccacactgaccctcatcaatgaggt

SEQ ID NO: 585798 - DNA, 25 bp, Mus musculus
ccacactgctgaagggcggcgcttc

SEQ ID NO: 585799 - DNA, 25 bp, Mus musculus
ccacactgctgatgggcggcgcttc

SEQ ID NO: 585800 - DNA, 25 bp, Mus musculus
ccacactgctttaggtagggagtca

SEQ ID NO: 585801 - DNA, 25 bp, Mus musculus
ccacactgcttttggtagggagtca

SEQ ID NO: 585802 - DNA, 25 bp, Mus musculus
ccacactggacacactgctttttat

SEQ ID NO: 585803 - DNA, 25 bp, Mus musculus
ccacactggacagactgctttttat

SEQ ID NO: 585804 - DNA, 25 bp, Mus musculus
ccacacttacctagtcataggatca

SEQ ID NO: 585805 - DNA, 25 bp, Mus musculus
ccacacttaccttgtcataggatca

SEQ ID NO: 585806 - DNA, 25 bp, Mus musculus
ccacacttcgagatgttctccttgt

SEQ ID NO: 585807 - DNA, 25 bp, Mus musculus
ccacacttcgagttgttctccttgt

SEQ ID NO: 585808 - DNA, 25 bp, Mus musculus
ccacacttgcagcatggtaactttc

SEQ ID NO: 585809 - DNA, 25 bp, Mus musculus
ccacacttgcaggatggtaactttc

SEQ ID NO: 585810 - DNA, 25 bp, Mus musculus
ccacagaaaagcaaaaggagtcacc

SEQ ID NO: 585811 - DNA, 25 bp, Mus musculus
ccacagaaaagctaaaggagtcacc

SEQ ID NO: 585812 - DNA, 25 bp, Mus musculus
ccacagacagcactttgttggagaa

SEQ ID NO: 585813 - DNA, 25 bp, Mus musculus
ccacagacagcagtttgttggagaa

SEQ ID NO: 585814 - DNA, 25 bp, Mus musculus
ccacagaccttccagctagggaatg

SEQ ID NO: 585815 - DNA, 25 bp, Mus musculus
ccacagaccttcgagctagggaatg

SEQ ID NO: 585816 - DNA, 25 bp, Mus musculus
ccacagacgatgagtcggtgagcga

SEQ ID NO: 585817 - DNA, 25 bp, Mus musculus
ccacagacgatgtgtcggtgagcga

SEQ ID NO: 585818 - DNA, 25 bp, Mus musculus
ccacagacgcttatgtgagctgctt

SEQ ID NO: 585819 - DNA, 25 bp, Mus musculus
ccacagacgcttttgtgagctgctt

SEQ ID NO: 585820 - DNA, 25 bp, Mus musculus
ccacagagaacccactgggaaaatg

SEQ ID NO: 585821 - DNA, 25 bp, Mus musculus
ccacagagaaccgactgggaaaatg

SEQ ID NO: 585822 - DNA, 25 bp, Mus musculus
ccacagagactgatggcctgaccag

SEQ ID NO: 585823 - DNA, 25 bp, Mus musculus
ccacagagactgttggcctgaccag

SEQ ID NO: 585824 - DNA, 25 bp, Mus musculus
ccacagagcccaaggtcctagcaaa

SEQ ID NO: 585825 - DNA, 25 bp, Mus musculus
ccacagagcccatggtcctagcaaa

SEQ ID NO: 585826 - DNA, 25 bp, Mus musculus
ccacagagcgtgctgtcactgtgtc

SEQ ID NO: 585827 - DNA, 25 bp, Mus musculus
ccacagagcgtggtgtcactgtgtc

SEQ ID NO: 585828 - DNA, 25 bp, Mus musculus
ccacagagctgcaggttcgggacct

SEQ ID NO: 585829 - DNA, 25 bp, Mus musculus
ccacagagctgctggttcgggacct

SEQ ID NO: 585830 - DNA, 25 bp, Mus musculus
ccacagagcttgactgagtggcgca

SEQ ID NO: 585831 - DNA, 25 bp, Mus musculus
ccacagagcttgtctgagtggcgca

SEQ ID NO: 585832 - DNA, 25 bp, Mus musculus
ccacagaggaaaagatcagagaata

SEQ ID NO: 585833 - DNA, 25 bp, Mus musculus
ccacagaggaaatgatcagagaata

SEQ ID NO: 585834 - DNA, 25 bp, Mus musculus
ccacagaggatcaaatgaggctcct

SEQ ID NO: 585835 - DNA, 25 bp, Mus musculus
ccacagaggatctaatgaggctcct

SEQ ID NO: 585836 - DNA, 25 bp, Mus musculus
ccacagaggctcctaagatgtccaa

SEQ ID NO: 585837 - DNA, 25 bp, Mus musculus
ccacagaggctcgtaagatgtccaa

SEQ ID NO: 585838 - DNA, 25 bp, Mus musculus
ccacagaggtgcaggctgcagtaat

SEQ ID NO: 585839 - DNA, 25 bp, Mus musculus
ccacagaggtgctggctgcagtaat

SEQ ID NO: 585840 - DNA, 25 bp, Mus musculus
ccacagatctggatgcccgaatgca

SEQ ID NO: 585841 - DNA, 25 bp, Mus musculus
ccacagatctggttgcccgaatgca

SEQ ID NO: 585842 - DNA, 25 bp, Mus musculus
ccacagatgaggacaatacttttag

SEQ ID NO: 585843 - DNA, 25 bp, Mus musculus
ccacagatgaggacatataaaccaa

SEQ ID NO: 585844 - DNA, 25 bp, Mus musculus
ccacagatgaggtcaatacttttag

SEQ ID NO: 585845 - DNA, 25 bp, Mus musculus
ccacagatgaggtcatataaaccaa

SEQ ID NO: 585846 - DNA, 25 bp, Mus musculus
ccacagcacatgcatttcagaacta

SEQ ID NO: 585847 - DNA, 25 bp, Mus musculus
ccacagcacatggatttcagaacta

SEQ ID NO: 585848 - DNA, 25 bp, Mus musculus
ccacagcagaacagcggagctttcg

SEQ ID NO: 585849 - DNA, 25 bp, Mus musculus
ccacagcagaactgcggagctttcg

SEQ ID NO: 585850 - DNA, 25 bp, Mus musculus
ccacagcagtatcagaagtcagtgt

SEQ ID NO: 585851 - DNA, 25 bp, Mus musculus
ccacagcagtatgagaagtcagtgt

SEQ ID NO: 585852 - DNA, 25 bp, Mus musculus
ccacagcagtctaaagttgattgag

SEQ ID NO: 585853 - DNA, 25 bp, Mus musculus
ccacagcagtcttaagttgattgag

SEQ ID NO: 585854 - DNA, 25 bp, Mus musculus
ccacagcagtgcagatcggcctcta

SEQ ID NO: 585855 - DNA, 25 bp, Mus musculus
ccacagcagtgctgatcggcctcta

SEQ ID NO: 585856 - DNA, 25 bp, Mus musculus
ccacagccatggatctacaggtgca

SEQ ID NO: 585857 - DNA, 25 bp, Mus musculus
ccacagccatggttctacaggtgca

SEQ ID NO: 585858 - DNA, 25 bp, Mus musculus
ccacagcgggctcggctatagcagc

SEQ ID NO: 585859 - DNA, 25 bp, Mus musculus
ccacagcgggctgggctatagcagc

SEQ ID NO: 585860 - DNA, 25 bp, Mus musculus
ccacagctaagcaggtgctggatcc

SEQ ID NO: 585861 - DNA, 25 bp, Mus musculus
ccacagctaagctggtgctggatcc

SEQ ID NO: 585862 - DNA, 25 bp, Mus musculus
ccacagctcaagcagagaaagagat

SEQ ID NO: 585863 - DNA, 25 bp, Mus musculus
ccacagctcaaggagagaaagagat

SEQ ID NO: 585864 - DNA, 25 bp, Mus musculus
ccacagctcatgcagaacatgctgt

SEQ ID NO: 585865 - DNA, 25 bp, Mus musculus
ccacagctcatggagaacatgctgt

SEQ ID NO: 585866 - DNA, 25 bp, Mus musculus
ccacagctgcttcagaatccagcat

SEQ ID NO: 585867 - DNA, 25 bp, Mus musculus
ccacagctgcttgagaatccagcat

SEQ ID NO: 585868 - DNA, 25 bp, Mus musculus
ccacagctgttcactgggtttgcag

SEQ ID NO: 585869 - DNA, 25 bp, Mus musculus
ccacagctgttctctgggtttgcag

SEQ ID NO: 585870 - DNA, 25 bp, Mus musculus
ccacagctttctaacacggaccatg

SEQ ID NO: 585871 - DNA, 25 bp, Mus musculus
ccacagctttcttacacggaccatg

SEQ ID NO: 585872 - DNA, 25 bp, Mus musculus
ccacaggaaaggcagtgacccacat

SEQ ID NO: 585873 - DNA, 25 bp, Mus musculus
ccacaggaaagggagtgacccacat

SEQ ID NO: 585874 - DNA, 25 bp, Mus musculus
ccacaggaaagtcaagggcaaaggc

SEQ ID NO: 585875 - DNA, 25 bp, Mus musculus
ccacaggaaagtgaagggcaaaggc

SEQ ID NO: 585876 - DNA, 25 bp, Mus musculus
ccacaggagaacattaaggccaccc

SEQ ID NO: 585877 - DNA, 25 bp, Mus musculus
ccacaggagaactttaaggccaccc

SEQ ID NO: 585878 - DNA, 25 bp, Mus musculus
ccacaggagaagagactccaagcag

SEQ ID NO: 585879 - DNA, 25 bp, Mus musculus
ccacaggagaagtgactccaagcag

SEQ ID NO: 585880 - DNA, 25 bp, Mus musculus
ccacaggagagtaacaccaccatca

SEQ ID NO: 585881 - DNA, 25 bp, Mus musculus
ccacaggagagttacaccaccatca

SEQ ID NO: 585882 - DNA, 25 bp, Mus musculus
ccacaggattctacagcatgtccag

SEQ ID NO: 585883 - DNA, 25 bp, Mus musculus
ccacaggattcttcagcatgtccag

SEQ ID NO: 585884 - DNA, 25 bp, Mus musculus
ccacaggcaagtccatcgtgtttgg

SEQ ID NO: 585885 - DNA, 25 bp, Mus musculus
ccacaggcaagtgcatcgtgtttgg

SEQ ID NO: 585886 - DNA, 25 bp, Mus musculus
ccacaggcaggccttgcttaacgat

SEQ ID NO: 585887 - DNA, 25 bp, Mus musculus
ccacaggcaggcgttgcttaacgat

SEQ ID NO: 585888 - DNA, 25 bp, Mus musculus
ccacaggccccgagtggtatgggac

SEQ ID NO: 585889 - DNA, 25 bp, Mus musculus
ccacaggccccgtgtggtatgggac

SEQ ID NO: 585890 - DNA, 25 bp, Mus musculus
ccacaggcctgtcggacgcagagct

SEQ ID NO: 585891 - DNA, 25 bp, Mus musculus
ccacaggcctgtgggacgcagagct

SEQ ID NO: 585892 - DNA, 25 bp, Mus musculus
ccacagggccagaggcatcagttct

SEQ ID NO: 585893 - DNA, 25 bp, Mus musculus
ccacagggccagtggcatcagttct

SEQ ID NO: 585894 - DNA, 25 bp, Mus musculus
ccacagggcccacggtctgggctaa

SEQ ID NO: 585895 - DNA, 25 bp, Mus musculus
ccacagggcccagggtctgggctaa

SEQ ID NO: 585896 - DNA, 25 bp, Mus musculus
ccacagggcttgatgccatatggtc

SEQ ID NO: 585897 - DNA, 25 bp, Mus musculus
ccacagggcttgttgccatatggtc

SEQ ID NO: 585898 - DNA, 25 bp, Mus musculus
ccacagggtgctcgacgtagcctgt

SEQ ID NO: 585899 - DNA, 25 bp, Mus musculus
ccacagggtgctggacgtagcctgt

SEQ ID NO: 585900 - DNA, 25 bp, Mus musculus
ccacaggtagagcagctgggtctcc

SEQ ID NO: 585901 - DNA, 25 bp, Mus musculus
ccacaggtagaggagctgggtctcc

SEQ ID NO: 585902 - DNA, 25 bp, Mus musculus
ccacaggtatggagcagtatttgca

SEQ ID NO: 585903 - DNA, 25 bp, Mus musculus
ccacaggtatggtgcagtatttgca

SEQ ID NO: 585904 - DNA, 25 bp, Mus musculus
ccacaggtatgtccctgggattctg

SEQ ID NO: 585905 - DNA, 25 bp, Mus musculus
ccacaggtatgtgcctgggattctg

SEQ ID NO: 585906 - DNA, 25 bp, Mus musculus
ccacaggtgctactggagggcttaa

SEQ ID NO: 585907 - DNA, 25 bp, Mus musculus
ccacaggtgctagtggagggcttaa

SEQ ID NO: 585908 - DNA, 25 bp, Mus musculus
ccacaggtggctctacggaagcctc

SEQ ID NO: 585909 - DNA, 25 bp, Mus musculus
ccacaggtggctgtacggaagcctc

SEQ ID NO: 585910 - DNA, 25 bp, Mus musculus
ccacaggtttttcgcaaaagtaatg

SEQ ID NO: 585911 - DNA, 25 bp, Mus musculus
ccacaggtttttggcaaaagtaatg

SEQ ID NO: 585912 - DNA, 25 bp, Mus musculus
ccacagtactaaccgtcgtaggcgg

SEQ ID NO: 585913 - DNA, 25 bp, Mus musculus
ccacagtactaagcgtcgtaggcgg

SEQ ID NO: 585914 - DNA, 25 bp, Mus musculus
ccacagtagcatatgggaggatggc

SEQ ID NO: 585915 - DNA, 25 bp, Mus musculus
ccacagtagcatttgggaggatggc

SEQ ID NO: 585916 - DNA, 25 bp, Mus musculus
ccacagtgggccataaaggcacgca

SEQ ID NO: 585917 - DNA, 25 bp, Mus musculus
ccacagtgggccttaaaggcacgca

SEQ ID NO: 585918 - DNA, 25 bp, Mus musculus
ccacagtgggtaaacaaagttgcaa

SEQ ID NO: 585919 - DNA, 25 bp, Mus musculus
ccacagtgggtatacaaagttgcaa

SEQ ID NO: 585920 - DNA, 25 bp, Mus musculus
ccacagtggtccagggaagtactgg

SEQ ID NO: 585921 - DNA, 25 bp, Mus musculus
ccacagtggtcctgggaagtactgg

SEQ ID NO: 585922 - DNA, 25 bp, Mus musculus
ccacagtgtacaagaaggtggacgg

SEQ ID NO: 585923 - DNA, 25 bp, Mus musculus
ccacagtgtacatgaaggtggacgg

SEQ ID NO: 585924 - DNA, 25 bp, Mus musculus
ccacagttcagaccaagaattcact

SEQ ID NO: 585925 - DNA, 25 bp, Mus musculus
ccacagttcagagcaagaattcact

SEQ ID NO: 585926 - DNA, 25 bp, Mus musculus
ccacagttcgcacgtgagcggcgct

SEQ ID NO: 585927 - DNA, 25 bp, Mus musculus
ccacagttcgcaggtgagcggcgct

SEQ ID NO: 585928 - DNA, 25 bp, Mus musculus
ccacagttgcctccttgctggaacg

SEQ ID NO: 585929 - DNA, 25 bp, Mus musculus
ccacagttgcctgcttgctggaacg

SEQ ID NO: 585930 - DNA, 25 bp, Mus musculus
ccacagttgctaaggagctcgctga

SEQ ID NO: 585931 - DNA, 25 bp, Mus musculus
ccacagttgctatggagctcgctga

SEQ ID NO: 585932 - DNA, 25 bp, Mus musculus
ccacagttttctcacggtcggagca

SEQ ID NO: 585933 - DNA, 25 bp, Mus musculus
ccacagttttctgacggtcggagca

SEQ ID NO: 585934 - DNA, 25 bp, Mus musculus
ccacatacaaacaacgcaacgagga

SEQ ID NO: 585935 - DNA, 25 bp, Mus musculus
ccacatacaaactacgcaacgagga

SEQ ID NO: 585936 - DNA, 25 bp, Mus musculus
ccacatacggatcttccaagagcaa

SEQ ID NO: 585937 - DNA, 25 bp, Mus musculus
ccacatacggatgttccaagagcaa

SEQ ID NO: 585938 - DNA, 25 bp, Mus musculus
ccacatactggaatccgagtctggg

SEQ ID NO: 585939 - DNA, 25 bp, Mus musculus
ccacatactggattccgagtctggg

SEQ ID NO: 585940 - DNA, 25 bp, Mus musculus
ccacataggctcagggactcaaacc

SEQ ID NO: 585941 - DNA, 25 bp, Mus musculus
ccacataggctctgggactcaaacc

SEQ ID NO: 585942 - DNA, 25 bp, Mus musculus
ccacatagtgtgcacagagggatct

SEQ ID NO: 585943 - DNA, 25 bp, Mus musculus
ccacatagtgtggacagagggatct

SEQ ID NO: 585944 - DNA, 25 bp, Mus musculus
ccacatatgcaccaattggagaagt

SEQ ID NO: 585945 - DNA, 25 bp, Mus musculus
ccacatatgcacgaattggagaagt

SEQ ID NO: 585946 - DNA, 25 bp, Mus musculus
ccacatatgcttaacagagtcttca

SEQ ID NO: 585947 - DNA, 25 bp, Mus musculus
ccacatatgctttacagagtcttca

SEQ ID NO: 585948 - DNA, 25 bp, Mus musculus
ccacatatgggtcatgatttgaaga

SEQ ID NO: 585949 - DNA, 25 bp, Mus musculus
ccacatatgggtgatgatttgaaga

SEQ ID NO: 585950 - DNA, 25 bp, Mus musculus
ccacatatgtatctgatcaaggatc

SEQ ID NO: 585951 - DNA, 25 bp, Mus musculus
ccacatatgtatgtgatcaaggatc

SEQ ID NO: 585952 - DNA, 25 bp, Mus musculus
ccacatcaaactcacagactttgga

SEQ ID NO: 585953 - DNA, 25 bp, Mus musculus
ccacatcaaactgacagactttgga

SEQ ID NO: 585954 - DNA, 25 bp, Mus musculus
ccacatcaagatacagaacactggg

SEQ ID NO: 585955 - DNA, 25 bp, Mus musculus
ccacatcaagattcagaacactggg

SEQ ID NO: 585956 - DNA, 25 bp, Mus musculus
ccacatcaagcacgccatcctgtcg

SEQ ID NO: 585957 - DNA, 25 bp, Mus musculus
ccacatcaagcaggccatcctgtcg

SEQ ID NO: 585958 - DNA, 25 bp, Mus musculus
ccacatcacgtcaagcattcagggc

SEQ ID NO: 585959 - DNA, 25 bp, Mus musculus
ccacatcacgtctagcattcagggc

SEQ ID NO: 585960 - DNA, 25 bp, Mus musculus
ccacatcactgtagttgcccattca

SEQ ID NO: 585961 - DNA, 25 bp, Mus musculus
ccacatcactgttgttgcccattca

SEQ ID NO: 585962 - DNA, 25 bp, Mus musculus
ccacatcagcaaagaagaaagcaaa

SEQ ID NO: 585963 - DNA, 25 bp, Mus musculus
ccacatcagcaaccctgggactgtg

SEQ ID NO: 585964 - DNA, 25 bp, Mus musculus
ccacatcagcaagcctgggactgtg

SEQ ID NO: 585965 - DNA, 25 bp, Mus musculus
ccacatcagcaatgaagaaagcaaa

SEQ ID NO: 585966 - DNA, 25 bp, Mus musculus
ccacatccgcagcagggtgttccgg

SEQ ID NO: 585967 - DNA, 25 bp, Mus musculus
ccacatccgcaggagggtgttccgg

SEQ ID NO: 585968 - DNA, 25 bp, Mus musculus
ccacatcctggtcagctgagcagag

SEQ ID NO: 585969 - DNA, 25 bp, Mus musculus
ccacatcctggtgagctgagcagag

SEQ ID NO: 585970 - DNA, 25 bp, Mus musculus
ccacatctgagaccatttgtccttg

SEQ ID NO: 585971 - DNA, 25 bp, Mus musculus
ccacatctgagagcatttgtccttg

SEQ ID NO: 585972 - DNA, 25 bp, Mus musculus
ccacatctgcaaccaggtgcagact

SEQ ID NO: 585973 - DNA, 25 bp, Mus musculus
ccacatctgcaagcaggtgcagact

SEQ ID NO: 585974 - DNA, 25 bp, Mus musculus
ccacatctggcactatgatgacgaa

SEQ ID NO: 585975 - DNA, 25 bp, Mus musculus
ccacatctggcagtatgatgacgaa

SEQ ID NO: 585976 - DNA, 25 bp, Mus musculus
ccacatctgggactactacagctgt

SEQ ID NO: 585977 - DNA, 25 bp, Mus musculus
ccacatctgggagtactacagctgt

SEQ ID NO: 585978 - DNA, 25 bp, Mus musculus
ccacatctgtatctcacatgcttgg

SEQ ID NO: 585979 - DNA, 25 bp, Mus musculus
ccacatctgtatgtcacatgcttgg

SEQ ID NO: 585980 - DNA, 25 bp, Mus musculus
ccacatctgtgacatcaacggacag

SEQ ID NO: 585981 - DNA, 25 bp, Mus musculus
ccacatctgtgagatcaacggacag

SEQ ID NO: 585982 - DNA, 25 bp, Mus musculus
ccacatgcagcacattgcacggcag

SEQ ID NO: 585983 - DNA, 25 bp, Mus musculus
ccacatgcagcagattgcacggcag

SEQ ID NO: 585984 - DNA, 25 bp, Mus musculus
ccacatggcactcaggctaagcctt

SEQ ID NO: 585985 - DNA, 25 bp, Mus musculus
ccacatggcactgaggctaagcctt

SEQ ID NO: 585986 - DNA, 25 bp, Mus musculus
ccacatggtatgaggttcctgtcca

SEQ ID NO: 585987 - DNA, 25 bp, Mus musculus
ccacatggtatgtggttcctgtcca

SEQ ID NO: 585988 - DNA, 25 bp, Mus musculus
ccacatggttatagccaagatgtcc

SEQ ID NO: 585989 - DNA, 25 bp, Mus musculus
ccacatggttattgccaagatgtcc

SEQ ID NO: 585990 - DNA, 25 bp, Mus musculus
ccacatgtgactattggagaggaag

SEQ ID NO: 585991 - DNA, 25 bp, Mus musculus
ccacatgtgacttttggagaggaag

SEQ ID NO: 585992 - DNA, 25 bp, Mus musculus
ccacatgtggcaatggaattcagca

SEQ ID NO: 585993 - DNA, 25 bp, Mus musculus
ccacatgtggcattggaattcagca

SEQ ID NO: 585994 - DNA, 25 bp, Mus musculus
ccacattacagaagaccgtaccaag

SEQ ID NO: 585995 - DNA, 25 bp, Mus musculus
ccacattacagatgaccgtaccaag

SEQ ID NO: 585996 - DNA, 25 bp, Mus musculus
ccacattaggggagctgaagcagaa

SEQ ID NO: 585997 - DNA, 25 bp, Mus musculus
ccacattaggggtgctgaagcagaa

SEQ ID NO: 585998 - DNA, 25 bp, Mus musculus
ccacattcccaaacaagatgccttg

SEQ ID NO: 585999 - DNA, 25 bp, Mus musculus
ccacattcccaatcaagatgccttg

SEQ ID NO: 586000 - DNA, 25 bp, Mus musculus
ccacattgactactataagaaaacc

SEQ ID NO: 586001 - DNA, 25 bp, Mus musculus
ccacattgactagtataagaaaacc

SEQ ID NO: 586002 - DNA, 25 bp, Mus musculus
ccacattgctgacgacaggtgtcga

SEQ ID NO: 586003 - DNA, 25 bp, Mus musculus
ccacattgctgaggacaggtgtcga

SEQ ID NO: 586004 - DNA, 25 bp, Mus musculus
ccacattggtgaccgcatggccatg

SEQ ID NO: 586005 - DNA, 25 bp, Mus musculus
ccacattggtgagcgcatggccatg

SEQ ID NO: 586006 - DNA, 25 bp, Mus musculus
ccacattgtcgcctttgcagaggaa

SEQ ID NO: 586007 - DNA, 25 bp, Mus musculus
ccacattgtcgcgtttgcagaggaa

SEQ ID NO: 586008 - DNA, 25 bp, Mus musculus
ccacattgtgctaactgatgagcca

SEQ ID NO: 586009 - DNA, 25 bp, Mus musculus
ccacattgtgcttactgatgagcca

SEQ ID NO: 586010 - DNA, 25 bp, Mus musculus
ccacattgtggaacgcaagcggcta

SEQ ID NO: 586011 - DNA, 25 bp, Mus musculus
ccacattgtggatcgcaagcggcta

SEQ ID NO: 586012 - DNA, 25 bp, Mus musculus
ccacatttactgcacacactggaga

SEQ ID NO: 586013 - DNA, 25 bp, Mus musculus
ccacatttactggacacactggaga

SEQ ID NO: 586014 - DNA, 25 bp, Mus musculus
ccacatttccttcagagggcttctg

SEQ ID NO: 586015 - DNA, 25 bp, Mus musculus
ccacatttccttgagagggcttctg

SEQ ID NO: 586016 - DNA, 25 bp, Mus musculus
ccacatttggatacagttggtgaaa

SEQ ID NO: 586017 - DNA, 25 bp, Mus musculus
ccacatttggattcagttggtgaaa

SEQ ID NO: 586018 - DNA, 25 bp, Mus musculus
ccacattttggcctatcagaagcag

SEQ ID NO: 586019 - DNA, 25 bp, Mus musculus
ccacattttggcgtatcagaagcag

SEQ ID NO: 586020 - DNA, 25 bp, Mus musculus
ccacattttggtagggacagagaaa

SEQ ID NO: 586021 - DNA, 25 bp, Mus musculus
ccacattttggttgggacagagaaa

SEQ ID NO: 586022 - DNA, 25 bp, Mus musculus
ccaccaaaaatcagctttggagcag

SEQ ID NO: 586023 - DNA, 25 bp, Mus musculus
ccaccaaaaatctgctttggagcag

SEQ ID NO: 586024 - DNA, 25 bp, Mus musculus
ccaccaaagctgaggagggagatcg

SEQ ID NO: 586025 - DNA, 25 bp, Mus musculus
ccaccaaagctgtggagggagatcg

SEQ ID NO: 586026 - DNA, 25 bp, Mus musculus
ccaccaaaggctaaggaagtccgtg

SEQ ID NO: 586027 - DNA, 25 bp, Mus musculus
ccaccaaaggcttaggaagtccgtg

SEQ ID NO: 586028 - DNA, 25 bp, Mus musculus
ccaccaaccagacagagtacatggg

SEQ ID NO: 586029 - DNA, 25 bp, Mus musculus
ccaccaaccagagagagtacatggg

SEQ ID NO: 586030 - DNA, 25 bp, Mus musculus
ccaccaagaaggacaaacaggaaga

SEQ ID NO: 586031 - DNA, 25 bp, Mus musculus
ccaccaagaaggtcaaacaggaaga

SEQ ID NO: 586032 - DNA, 25 bp, Mus musculus
ccaccaagacccaaagatacagttg

SEQ ID NO: 586033 - DNA, 25 bp, Mus musculus
ccaccaagaccctaagatacagttg

SEQ ID NO: 586034 - DNA, 25 bp, Mus musculus
ccaccaagctggactatcagatctt

SEQ ID NO: 586035 - DNA, 25 bp, Mus musculus
ccaccaagctggtctatcagatctt

SEQ ID NO: 586036 - DNA, 25 bp, Mus musculus
ccaccaaggttgcagggagacaaca

SEQ ID NO: 586037 - DNA, 25 bp, Mus musculus
ccaccaaggttggagggagacaaca

SEQ ID NO: 586038 - DNA, 25 bp, Mus musculus
ccaccaatacaactagagaaagaag

SEQ ID NO: 586039 - DNA, 25 bp, Mus musculus
ccaccaatacaagtagagaaagaag

SEQ ID NO: 586040 - DNA, 25 bp, Mus musculus
ccaccaatatgcagggtttcaccaa

SEQ ID NO: 586041 - DNA, 25 bp, Mus musculus
ccaccaatatgctgggtttcaccaa

SEQ ID NO: 586042 - DNA, 25 bp, Mus musculus
ccaccaatgggaagaggcatagtct

SEQ ID NO: 586043 - DNA, 25 bp, Mus musculus
ccaccaatgggatgaggcatagtct

SEQ ID NO: 586044 - DNA, 25 bp, Mus musculus
ccaccaccaagaaggcaggcgggac

SEQ ID NO: 586045 - DNA, 25 bp, Mus musculus
ccaccaccaagatggcaggcgggac

SEQ ID NO: 586046 - DNA, 25 bp, Mus musculus
ccaccaccgcttaggttctgctggg

SEQ ID NO: 586047 - DNA, 25 bp, Mus musculus
ccaccaccgctttggttctgctggg

SEQ ID NO: 586048 - DNA, 25 bp, Mus musculus
ccaccacgcttcattggaccagagt

SEQ ID NO: 586049 - DNA, 25 bp, Mus musculus
ccaccacgcttctttggaccagagt

SEQ ID NO: 586050 - DNA, 25 bp, Mus musculus
ccaccacggaggaggaagccgtgct

SEQ ID NO: 586051 - DNA, 25 bp, Mus musculus
ccaccacggaggtggaagccgtgct

SEQ ID NO: 586052 - DNA, 25 bp, Mus musculus
ccaccacggctgaagagcgagtgtt

SEQ ID NO: 586053 - DNA, 25 bp, Mus musculus
ccaccacggctgtagagcgagtgtt

SEQ ID NO: 586054 - DNA, 25 bp, Mus musculus
ccaccacggttactgaggtcatcca

SEQ ID NO: 586055 - DNA, 25 bp, Mus musculus
ccaccacggttagtgaggtcatcca

SEQ ID NO: 586056 - DNA, 25 bp, Mus musculus
ccaccactggccagatgattgttct

SEQ ID NO: 586057 - DNA, 25 bp, Mus musculus
ccaccactggcctgatgattgttct

SEQ ID NO: 586058 - DNA, 25 bp, Mus musculus
ccaccactgtgtccaagtggccgca

SEQ ID NO: 586059 - DNA, 25 bp, Mus musculus
ccaccactgtgtgcaagtggccgca

SEQ ID NO: 586060 - DNA, 25 bp, Mus musculus
ccaccacttcacagaagtggttttt

SEQ ID NO: 586061 - DNA, 25 bp, Mus musculus
ccaccacttcactgaagtggttttt

SEQ ID NO: 586062 - DNA, 25 bp, Mus musculus
ccaccagagacgcagagacggagac

SEQ ID NO: 586063 - DNA, 25 bp, Mus musculus
ccaccagagacggagagacggagac

SEQ ID NO: 586064 - DNA, 25 bp, Mus musculus
ccaccagaggaccttcgtcctggag

SEQ ID NO: 586065 - DNA, 25 bp, Mus musculus
ccaccagaggacgttcgtcctggag

SEQ ID NO: 586066 - DNA, 25 bp, Mus musculus
ccaccagagggcctgaaagagagaa

SEQ ID NO: 586067 - DNA, 25 bp, Mus musculus
ccaccagagggcgtgaaagagagaa

SEQ ID NO: 586068 - DNA, 25 bp, Mus musculus
ccaccagatttcaacaccaacgggt

SEQ ID NO: 586069 - DNA, 25 bp, Mus musculus
ccaccagatttctacaccaacgggt

SEQ ID NO: 586070 - DNA, 25 bp, Mus musculus
ccaccagcccgtcagtgaatgggcg

SEQ ID NO: 586071 - DNA, 25 bp, Mus musculus
ccaccagcccgtgagtgaatgggcg

SEQ ID NO: 586072 - DNA, 25 bp, Mus musculus
ccaccagctcatactgcgtgtcaag

SEQ ID NO: 586073 - DNA, 25 bp, Mus musculus
ccaccagctcattctgcgtgtcaag

SEQ ID NO: 586074 - DNA, 25 bp, Mus musculus
ccaccagctgccagtgaccaaggag

SEQ ID NO: 586075 - DNA, 25 bp, Mus musculus
ccaccagctgcctgtgaccaaggag

SEQ ID NO: 586076 - DNA, 25 bp, Mus musculus
ccaccaggaacacagcgctagaggc

SEQ ID NO: 586077 - DNA, 25 bp, Mus musculus
ccaccaggaacagagcgctagaggc

SEQ ID NO: 586078 - DNA, 25 bp, Mus musculus
ccaccaggacggctattcgctggag

SEQ ID NO: 586079 - DNA, 25 bp, Mus musculus
ccaccaggacgggtattcgctggag

SEQ ID NO: 586080 - DNA, 25 bp, Mus musculus
ccaccaggagtacctgaagatgctg

SEQ ID NO: 586081 - DNA, 25 bp, Mus musculus
ccaccaggagtagctgaagatgctg

SEQ ID NO: 586082 - DNA, 25 bp, Mus musculus
ccaccagggatccttataatgagag

SEQ ID NO: 586083 - DNA, 25 bp, Mus musculus
ccaccagggatcgttataatgagag

SEQ ID NO: 586084 - DNA, 25 bp, Mus musculus
ccaccaggtcgcactggatatccag

SEQ ID NO: 586085 - DNA, 25 bp, Mus musculus
ccaccaggtcgctctggatatccag

SEQ ID NO: 586086 - DNA, 25 bp, Mus musculus
ccaccagtacatcgagggcttcaag

SEQ ID NO: 586087 - DNA, 25 bp, Mus musculus
ccaccagtacatggagggcttcaag

SEQ ID NO: 586088 - DNA, 25 bp, Mus musculus
ccaccagtcacgcaaatgtcacagt

SEQ ID NO: 586089 - DNA, 25 bp, Mus musculus
ccaccagtcacggaaatgtcacagt

SEQ ID NO: 586090 - DNA, 25 bp, Mus musculus
ccaccagtgaaacgcatatctacca

SEQ ID NO: 586091 - DNA, 25 bp, Mus musculus
ccaccagtgaaaggcatatctacca

SEQ ID NO: 586092 - DNA, 25 bp, Mus musculus
ccaccagttcgactggaagtcaagc

SEQ ID NO: 586093 - DNA, 25 bp, Mus musculus
ccaccagttcgagtggaagtcaagc

SEQ ID NO: 586094 - DNA, 25 bp, Mus musculus
ccaccagttcttcaagacctctgga

SEQ ID NO: 586095 - DNA, 25 bp, Mus musculus
ccaccagttcttgaagacctctgga

SEQ ID NO: 586096 - DNA, 25 bp, Mus musculus
ccaccataggatacggctttgtgct

SEQ ID NO: 586097 - DNA, 25 bp, Mus musculus
ccaccataggattcggctttgtgct

SEQ ID NO: 586098 - DNA, 25 bp, Mus musculus
ccaccatcagcaacaatgtgcctgg

SEQ ID NO: 586099 - DNA, 25 bp, Mus musculus
ccaccatcagcatcaatgtgcctgg

SEQ ID NO: 586100 - DNA, 25 bp, Mus musculus
ccaccatcagctcgattgaaaacgg

SEQ ID NO: 586101 - DNA, 25 bp, Mus musculus
ccaccatcagctggattgaaaacgg

SEQ ID NO: 586102 - DNA, 25 bp, Mus musculus
ccaccatcgaggatcccagaggcag

SEQ ID NO: 586103 - DNA, 25 bp, Mus musculus
ccaccatcgaggttcccagaggcag

SEQ ID NO: 586104 - DNA, 25 bp, Mus musculus
ccaccatctcctcgaatgtcaatgg

SEQ ID NO: 586105 - DNA, 25 bp, Mus musculus
ccaccatctcctggaatgtcaatgg

SEQ ID NO: 586106 - DNA, 25 bp, Mus musculus
ccaccatgaattacgggccatggag

SEQ ID NO: 586107 - DNA, 25 bp, Mus musculus
ccaccatgaatttcgggccatggag

SEQ ID NO: 586108 - DNA, 25 bp, Mus musculus
ccaccatgattgacgggagtggtgc

SEQ ID NO: 586109 - DNA, 25 bp, Mus musculus
ccaccatgattgtcgggagtggtgc

SEQ ID NO: 586110 - DNA, 25 bp, Mus musculus
ccaccatggatgagctagctgagat

SEQ ID NO: 586111 - DNA, 25 bp, Mus musculus
ccaccatggatgtgctagctgagat

SEQ ID NO: 586112 - DNA, 25 bp, Mus musculus
ccaccatggtggaggaacagtttgt

SEQ ID NO: 586113 - DNA, 25 bp, Mus musculus
ccaccatggtggtggaacagtttgt

SEQ ID NO: 586114 - DNA, 25 bp, Mus musculus
ccaccatgttctcgcgggcgagcgt

SEQ ID NO: 586115 - DNA, 25 bp, Mus musculus
ccaccatgttctggcgggcgagcgt

SEQ ID NO: 586116 - DNA, 25 bp, Mus musculus
ccaccattcaggctggcttctcatt

SEQ ID NO: 586117 - DNA, 25 bp, Mus musculus
ccaccattcagggtggcttctcatt

SEQ ID NO: 586118 - DNA, 25 bp, Mus musculus
ccaccattgaagataccgggaaatc

SEQ ID NO: 586119 - DNA, 25 bp, Mus musculus
ccaccattgaagttaccgggaaatc

SEQ ID NO: 586120 - DNA, 25 bp, Mus musculus
ccacccaagggaacttgtgcaggtt

SEQ ID NO: 586121 - DNA, 25 bp, Mus musculus
ccacccaagggatcttgtgcaggtt

SEQ ID NO: 586122 - DNA, 25 bp, Mus musculus
ccacccacaggcctaagaacaagag

SEQ ID NO: 586123 - DNA, 25 bp, Mus musculus
ccacccacaggcgtaagaacaagag

SEQ ID NO: 586124 - DNA, 25 bp, Mus musculus
ccacccagagtgcatatggcgcaag

SEQ ID NO: 586125 - DNA, 25 bp, Mus musculus
ccacccagagtggatatggcgcaag

SEQ ID NO: 586126 - DNA, 25 bp, Mus musculus
ccacccaggagtctggacatggcta

SEQ ID NO: 586127 - DNA, 25 bp, Mus musculus
ccacccaggagtgtggacatggcta

SEQ ID NO: 586128 - DNA, 25 bp, Mus musculus
ccacccaggtccaagtatgagccag

SEQ ID NO: 586129 - DNA, 25 bp, Mus musculus
ccacccaggtcctagtatgagccag

SEQ ID NO: 586130 - DNA, 25 bp, Mus musculus
ccaccccaaagtcgaggaatgtata

SEQ ID NO: 586131 - DNA, 25 bp, Mus musculus
ccaccccaaagtggaggaatgtata

SEQ ID NO: 586132 - DNA, 25 bp, Mus musculus
ccaccccagaaacgcaggaacaggt

SEQ ID NO: 586133 - DNA, 25 bp, Mus musculus
ccaccccagaaaggcaggaacaggt

SEQ ID NO: 586134 - DNA, 25 bp, Mus musculus
ccacccctgaagaagacctttgact

SEQ ID NO: 586135 - DNA, 25 bp, Mus musculus
ccacccctgaagtagacctttgact

SEQ ID NO: 586136 - DNA, 25 bp, Mus musculus
ccaccccttgaaacagaagctgctg

SEQ ID NO: 586137 - DNA, 25 bp, Mus musculus
ccaccccttgaatcagaagctgctg

SEQ ID NO: 586138 - DNA, 25 bp, Mus musculus
ccacccgatgagagtggtcctggct

SEQ ID NO: 586139 - DNA, 25 bp, Mus musculus
ccacccgatgagtgtggtcctggct

SEQ ID NO: 586140 - DNA, 25 bp, Mus musculus
ccacccggacacagttgaaggtctt

SEQ ID NO: 586141 - DNA, 25 bp, Mus musculus
ccacccggacactgttgaaggtctt

SEQ ID NO: 586142 - DNA, 25 bp, Mus musculus
ccacccggctcaaacaggctggaat

SEQ ID NO: 586143 - DNA, 25 bp, Mus musculus
ccacccggctcatacaggctggaat

SEQ ID NO: 586144 - DNA, 25 bp, Mus musculus
ccacccgggactccgctgaggatgt

SEQ ID NO: 586145 - DNA, 25 bp, Mus musculus
ccacccgggactgcgctgaggatgt

SEQ ID NO: 586146 - DNA, 25 bp, Mus musculus
ccaccctcaggccatatggtgaata

SEQ ID NO: 586147 - DNA, 25 bp, Mus musculus
ccaccctcaggcgatatggtgaata

SEQ ID NO: 586148 - DNA, 25 bp, Mus musculus
ccaccctcgaagagtccggctgaag

SEQ ID NO: 586149 - DNA, 25 bp, Mus musculus
ccaccctcgaagtgtccggctgaag

SEQ ID NO: 586150 - DNA, 25 bp, Mus musculus
ccacccttggttatatgaactgcca

SEQ ID NO: 586151 - DNA, 25 bp, Mus musculus
ccacccttggttttatgaactgcca

SEQ ID NO: 586152 - DNA, 25 bp, Mus musculus
ccaccgaagtggcactttattcata

SEQ ID NO: 586153 - DNA, 25 bp, Mus musculus
ccaccgaagtgggactttattcata

SEQ ID NO: 586154 - DNA, 25 bp, Mus musculus
ccaccgacctgacagacatgactat

SEQ ID NO: 586155 - DNA, 25 bp, Mus musculus
ccaccgacctgagagacatgactat

SEQ ID NO: 586156 - DNA, 25 bp, Mus musculus
ccaccgacggagcaagtgaaaaaat

SEQ ID NO: 586157 - DNA, 25 bp, Mus musculus
ccaccgacggaggaagtgaaaaaat

SEQ ID NO: 586158 - DNA, 25 bp, Mus musculus
ccaccgagagcgacgtctggagcct

SEQ ID NO: 586159 - DNA, 25 bp, Mus musculus
ccaccgagagcgtcgtctggagcct

SEQ ID NO: 586160 - DNA, 25 bp, Mus musculus
ccaccgagatcaatgagggcacgca

SEQ ID NO: 586161 - DNA, 25 bp, Mus musculus
ccaccgagatcattgagggcacgca

SEQ ID NO: 586162 - DNA, 25 bp, Mus musculus
ccaccgaggctgactacactcagga

SEQ ID NO: 586163 - DNA, 25 bp, Mus musculus
ccaccgaggctgtctacactcagga

SEQ ID NO: 586164 - DNA, 25 bp, Mus musculus
ccaccgagggcgcagaggtcctctt

SEQ ID NO: 586165 - DNA, 25 bp, Mus musculus
ccaccgagggcggagaggtcctctt

SEQ ID NO: 586166 - DNA, 25 bp, Mus musculus
ccaccgcagagcaatcgaatcagga

SEQ ID NO: 586167 - DNA, 25 bp, Mus musculus
ccaccgcagagctatcgaatcagga

SEQ ID NO: 586168 - DNA, 25 bp, Mus musculus
ccaccgccattcagactgtggcaga

SEQ ID NO: 586169 - DNA, 25 bp, Mus musculus
ccaccgccattctgactgtggcaga

SEQ ID NO: 586170 - DNA, 25 bp, Mus musculus
ccaccgcgagtgcaaaacggagatg

SEQ ID NO: 586171 - DNA, 25 bp, Mus musculus
ccaccgcgagtggaaaacggagatg

SEQ ID NO: 586172 - DNA, 25 bp, Mus musculus
ccaccggagagtacctgcaagtggg

SEQ ID NO: 586173 - DNA, 25 bp, Mus musculus
ccaccggagagttcctgcaagtggg

SEQ ID NO: 586174 - DNA, 25 bp, Mus musculus
ccaccggctgtaatcgatgcattga

SEQ ID NO: 586175 - DNA, 25 bp, Mus musculus
ccaccggctgtattcgatgcattga

SEQ ID NO: 586176 - DNA, 25 bp, Mus musculus
ccaccgggaagcagctctttgatca

SEQ ID NO: 586177 - DNA, 25 bp, Mus musculus
ccaccgggaagctgctctttgatca

SEQ ID NO: 586178 - DNA, 25 bp, Mus musculus
ccaccgggcgaaacgtggcagtcat

SEQ ID NO: 586179 - DNA, 25 bp, Mus musculus
ccaccgggcgaatcgtggcagtcat

SEQ ID NO: 586180 - DNA, 25 bp, Mus musculus
ccaccgggggagactcaacatccag

SEQ ID NO: 586181 - DNA, 25 bp, Mus musculus
ccaccgggggagtctcaacatccag

SEQ ID NO: 586182 - DNA, 25 bp, Mus musculus
ccaccgtgaagaccatggcggagca

SEQ ID NO: 586183 - DNA, 25 bp, Mus musculus
ccaccgtgaagagcatggcggagca

SEQ ID NO: 586184 - DNA, 25 bp, Mus musculus
ccaccgtgatgaactacaaggagtc

SEQ ID NO: 586185 - DNA, 25 bp, Mus musculus
ccaccgtgatgatctacaaggagtc

SEQ ID NO: 586186 - DNA, 25 bp, Mus musculus
ccaccgtggacgacctcagattgag

SEQ ID NO: 586187 - DNA, 25 bp, Mus musculus
ccaccgtggacgtcctcagattgag

SEQ ID NO: 586188 - DNA, 25 bp, Mus musculus
ccaccgtggtcactgtccggaagct

SEQ ID NO: 586189 - DNA, 25 bp, Mus musculus
ccaccgtggtcagtgtccggaagct

SEQ ID NO: 586190 - DNA, 25 bp, Mus musculus
ccaccgtggtgaatgatgagcgctt

SEQ ID NO: 586191 - DNA, 25 bp, Mus musculus
ccaccgtggtgattgatgagcgctt

SEQ ID NO: 586192 - DNA, 25 bp, Mus musculus
ccaccgtgtcataagccaggctggg

SEQ ID NO: 586193 - DNA, 25 bp, Mus musculus
ccaccgtgtcattagccaggctggg

SEQ ID NO: 586194 - DNA, 25 bp, Mus musculus
ccaccgttttgacgtacctaggatg

SEQ ID NO: 586195 - DNA, 25 bp, Mus musculus
ccaccgttttgaggtacctaggatg

SEQ ID NO: 586196 - DNA, 25 bp, Mus musculus
ccacctaaaaatcaagagccagaag

SEQ ID NO: 586197 - DNA, 25 bp, Mus musculus
ccacctaaaaatgaagagccagaag

SEQ ID NO: 586198 - DNA, 25 bp, Mus musculus
ccacctaacccaattgctcatgggt

SEQ ID NO: 586199 - DNA, 25 bp, Mus musculus
ccacctaacccatttgctcatgggt

SEQ ID NO: 586200 - DNA, 25 bp, Mus musculus
ccacctacagtgcagtattccgaac

SEQ ID NO: 586201 - DNA, 25 bp, Mus musculus
ccacctacagtggagtattccgaac

SEQ ID NO: 586202 - DNA, 25 bp, Mus musculus
ccacctacatacctggagcctggga

SEQ ID NO: 586203 - DNA, 25 bp, Mus musculus
ccacctacatacgtggagcctggga

SEQ ID NO: 586204 - DNA, 25 bp, Mus musculus
ccacctatactaatcttggacagaa

SEQ ID NO: 586205 - DNA, 25 bp, Mus musculus
ccacctatactattcttggacagaa

SEQ ID NO: 586206 - DNA, 25 bp, Mus musculus
ccacctatgtttcgcagacatcttt

SEQ ID NO: 586207 - DNA, 25 bp, Mus musculus
ccacctatgtttggcagacatcttt

SEQ ID NO: 586208 - DNA, 25 bp, Mus musculus
ccacctcagtatctgttttccggag

SEQ ID NO: 586209 - DNA, 25 bp, Mus musculus
ccacctcagtatgtgttttccggag

SEQ ID NO: 586210 - DNA, 25 bp, Mus musculus
ccacctcccaggctattaatgtggg

SEQ ID NO: 586211 - DNA, 25 bp, Mus musculus
ccacctcccagggtattaatgtggg

SEQ ID NO: 586212 - DNA, 25 bp, Mus musculus
ccacctcctagcaatcatcttgtta

SEQ ID NO: 586213 - DNA, 25 bp, Mus musculus
ccacctcctagctatcatcttgtta

SEQ ID NO: 586214 - DNA, 25 bp, Mus musculus
ccacctcctatgcagaccagatgtt

SEQ ID NO: 586215 - DNA, 25 bp, Mus musculus
ccacctcctatggagaccagatgtt

SEQ ID NO: 586216 - DNA, 25 bp, Mus musculus
ccacctcgacctcgtttgatactta

SEQ ID NO: 586217 - DNA, 25 bp, Mus musculus
ccacctcgacctggtttgatactta

SEQ ID NO: 586218 - DNA, 25 bp, Mus musculus
ccacctcggaaacacttggtccgag

SEQ ID NO: 586219 - DNA, 25 bp, Mus musculus
ccacctcggaaagacttggtccgag

SEQ ID NO: 586220 - DNA, 25 bp, Mus musculus
ccacctcgggaaaaacacaccggag

SEQ ID NO: 586221 - DNA, 25 bp, Mus musculus
ccacctcgggaataacacaccggag

SEQ ID NO: 586222 - DNA, 25 bp, Mus musculus
ccacctctgagcagagagctatggc

SEQ ID NO: 586223 - DNA, 25 bp, Mus musculus
ccacctctgagctgagagctatggc

SEQ ID NO: 586224 - DNA, 25 bp, Mus musculus
ccacctcttacaattaggtggctga

SEQ ID NO: 586225 - DNA, 25 bp, Mus musculus
ccacctcttacatttaggtggctga

SEQ ID NO: 586226 - DNA, 25 bp, Mus musculus
ccacctcttggtcggcagatctgaa

SEQ ID NO: 586227 - DNA, 25 bp, Mus musculus
ccacctcttggtgggcagatctgaa

SEQ ID NO: 586228 - DNA, 25 bp, Mus musculus
ccacctgaccggatagctgaacggg

SEQ ID NO: 586229 - DNA, 25 bp, Mus musculus
ccacctgaccggttagctgaacggg

SEQ ID NO: 586230 - DNA, 25 bp, Mus musculus
ccacctgagtatcaattcttctggg

SEQ ID NO: 586231 - DNA, 25 bp, Mus musculus
ccacctgagtatgaattcttctggg

SEQ ID NO: 586232 - DNA, 25 bp, Mus musculus
ccacctgcactactatggcatgagg

SEQ ID NO: 586233 - DNA, 25 bp, Mus musculus
ccacctgcactagtatggcatgagg

SEQ ID NO: 586234 - DNA, 25 bp, Mus musculus
ccacctgcgggtagttcagtgctct

SEQ ID NO: 586235 - DNA, 25 bp, Mus musculus
ccacctgcgggttgttcagtgctct

SEQ ID NO: 586236 - DNA, 25 bp, Mus musculus
ccacctgctcgtaatgagctatggg

SEQ ID NO: 586237 - DNA, 25 bp, Mus musculus
ccacctgctcgttatgagctatggg

SEQ ID NO: 586238 - DNA, 25 bp, Mus musculus
ccacctggaccacatcaagaaggtg

SEQ ID NO: 586239 - DNA, 25 bp, Mus musculus
ccacctggaccagatcaagaaggtg

SEQ ID NO: 586240 - DNA, 25 bp, Mus musculus
ccacctggaggcaaagtcactattc

SEQ ID NO: 586241 - DNA, 25 bp, Mus musculus
ccacctggaggctaagtcactattc

SEQ ID NO: 586242 - DNA, 25 bp, Mus musculus
ccacctggtcggacttttgcacgat

SEQ ID NO: 586243 - DNA, 25 bp, Mus musculus
ccacctggtcggtcttttgcacgat

SEQ ID NO: 586244 - DNA, 25 bp, Mus musculus
ccacctggtggtcttggtcccaagg

SEQ ID NO: 586245 - DNA, 25 bp, Mus musculus
ccacctggtggtgttggtcccaagg

SEQ ID NO: 586246 - DNA, 25 bp, Mus musculus
ccacctggtgttatgggtcctgaac

SEQ ID NO: 586247 - DNA, 25 bp, Mus musculus
ccacctggtgttttgggtcctgaac

SEQ ID NO: 586248 - DNA, 25 bp, Mus musculus
ccacctggttggatcctcgtctctg

SEQ ID NO: 586249 - DNA, 25 bp, Mus musculus
ccacctggttggttcctcgtctctg

SEQ ID NO: 586250 - DNA, 25 bp, Mus musculus
ccacctgtgtatccttcggttgaca

SEQ ID NO: 586251 - DNA, 25 bp, Mus musculus
ccacctgtgtatgcttcggttgaca

SEQ ID NO: 586252 - DNA, 25 bp, Mus musculus
ccaccttccgttcggaggagattca

SEQ ID NO: 586253 - DNA, 25 bp, Mus musculus
ccaccttccgttgggaggagattca

SEQ ID NO: 586254 - DNA, 25 bp, Mus musculus
ccaccttctcagagcgcattttcat

SEQ ID NO: 586255 - DNA, 25 bp, Mus musculus
ccaccttctcagtgcgcattttcat

SEQ ID NO: 586256 - DNA, 25 bp, Mus musculus
ccaccttcttggagctgtgatgtga

SEQ ID NO: 586257 - DNA, 25 bp, Mus musculus
ccaccttcttggtgctgtgatgtga

SEQ ID NO: 586258 - DNA, 25 bp, Mus musculus
ccaccttgccgacagaagcccaagg

SEQ ID NO: 586259 - DNA, 25 bp, Mus musculus
ccaccttgccgagagaagcccaagg

SEQ ID NO: 586260 - DNA, 25 bp, Mus musculus
ccaccttgcgacaggctgctgagga

SEQ ID NO: 586261 - DNA, 25 bp, Mus musculus
ccaccttgcgactggctgctgagga

SEQ ID NO: 586262 - DNA, 25 bp, Mus musculus
ccaccttgggacaccttgattccaa

SEQ ID NO: 586263 - DNA, 25 bp, Mus musculus
ccaccttgggacagctttaccacaa

SEQ ID NO: 586264 - DNA, 25 bp, Mus musculus
ccaccttgggactccttgattccaa

SEQ ID NO: 586265 - DNA, 25 bp, Mus musculus
ccaccttgggactgctttaccacaa

SEQ ID NO: 586266 - DNA, 25 bp, Mus musculus
ccaccttgtactctgttcaggaggc

SEQ ID NO: 586267 - DNA, 25 bp, Mus musculus
ccaccttgtactgtgttcaggaggc

SEQ ID NO: 586268 - DNA, 25 bp, Mus musculus
ccacctttgacaaacacggagagca

SEQ ID NO: 586269 - DNA, 25 bp, Mus musculus
ccacctttgacatacacggagagca

SEQ ID NO: 586270 - DNA, 25 bp, Mus musculus
ccaccttttgggatcaaaggtcaag

SEQ ID NO: 586271 - DNA, 25 bp, Mus musculus
ccaccttttgggttcaaaggtcaag

SEQ ID NO: 586272 - DNA, 25 bp, Mus musculus
ccacgaaatgacaaatcaggagtct

SEQ ID NO: 586273 - DNA, 25 bp, Mus musculus
ccacgaaatgactaatcaggagtct

SEQ ID NO: 586274 - DNA, 25 bp, Mus musculus
ccacgaactgcccaggagcgagcag

SEQ ID NO: 586275 - DNA, 25 bp, Mus musculus
ccacgaactgccgaggagcgagcag

SEQ ID NO: 586276 - DNA, 25 bp, Mus musculus
ccacgaagagctcggcctctcatgt

SEQ ID NO: 586277 - DNA, 25 bp, Mus musculus
ccacgaagagctgggcctctcatgt

SEQ ID NO: 586278 - DNA, 25 bp, Mus musculus
ccacgaagccttagagaggcgcagg

SEQ ID NO: 586279 - DNA, 25 bp, Mus musculus
ccacgaagcctttgagaggcgcagg

SEQ ID NO: 586280 - DNA, 25 bp, Mus musculus
ccacgaagtaagctttcacgagtaa

SEQ ID NO: 586281 - DNA, 25 bp, Mus musculus
ccacgaagtaaggtttcacgagtaa

SEQ ID NO: 586282 - DNA, 25 bp, Mus musculus
ccacgacagccacgtggacagagga

SEQ ID NO: 586283 - DNA, 25 bp, Mus musculus
ccacgacagccaggtggacagagga

SEQ ID NO: 586284 - DNA, 25 bp, Mus musculus
ccacgaccggcgaatatttgtgtct

SEQ ID NO: 586285 - DNA, 25 bp, Mus musculus
ccacgaccggcgtatatttgtgtct

SEQ ID NO: 586286 - DNA, 25 bp, Mus musculus
ccacgacggatcagacccttgaact

SEQ ID NO: 586287 - DNA, 25 bp, Mus musculus
ccacgacggatctgacccttgaact

SEQ ID NO: 586288 - DNA, 25 bp, Mus musculus
ccacgacgttctcagcaacagcaag

SEQ ID NO: 586289 - DNA, 25 bp, Mus musculus
ccacgacgttctgagcaacagcaag

SEQ ID NO: 586290 - DNA, 25 bp, Mus musculus
ccacgactcttgaacatcagaagac

SEQ ID NO: 586291 - DNA, 25 bp, Mus musculus
ccacgactcttgtacatcagaagac

SEQ ID NO: 586292 - DNA, 25 bp, Mus musculus
ccacgactggttaatcttcaaggag

SEQ ID NO: 586293 - DNA, 25 bp, Mus musculus
ccacgactggtttatcttcaaggag

SEQ ID NO: 586294 - DNA, 25 bp, Mus musculus
ccacgagaagctcttcgagctgatc

SEQ ID NO: 586295 - DNA, 25 bp, Mus musculus
ccacgagaagctgttcgagctgatc

SEQ ID NO: 586296 - DNA, 25 bp, Mus musculus
ccacgagacccaaaccacttgttgg

SEQ ID NO: 586297 - DNA, 25 bp, Mus musculus
ccacgagacccataccacttgttgg

SEQ ID NO: 586298 - DNA, 25 bp, Mus musculus
ccacgagagtgtcccaatattgagg

SEQ ID NO: 586299 - DNA, 25 bp, Mus musculus
ccacgagagtgtgccaatattgagg

SEQ ID NO: 586300 - DNA, 25 bp, Mus musculus
ccacgaggagagcataccgagccca

SEQ ID NO: 586301 - DNA, 25 bp, Mus musculus
ccacgaggagaggataccgagccca

SEQ ID NO: 586302 - DNA, 25 bp, Mus musculus
ccacgagggcgtcggactgaccttc

SEQ ID NO: 586303 - DNA, 25 bp, Mus musculus
ccacgagggcgtgggactgaccttc

SEQ ID NO: 586304 - DNA, 25 bp, Mus musculus
ccacgagtatgtcccctgggtgctg

SEQ ID NO: 586305 - DNA, 25 bp, Mus musculus
ccacgagtatgtgccctgggtgctg

SEQ ID NO: 586306 - DNA, 25 bp, Mus musculus
ccacgagtgtcacagaggcagctgt

SEQ ID NO: 586307 - DNA, 25 bp, Mus musculus
ccacgagtgtcagagaggcagctgt

SEQ ID NO: 586308 - DNA, 25 bp, Mus musculus
ccacgagttcagcaggaacaacagg

SEQ ID NO: 586309 - DNA, 25 bp, Mus musculus
ccacgagttcaggaggaacaacagg

SEQ ID NO: 586310 - DNA, 25 bp, Mus musculus
ccacgagttccaagccaagtgtgtt

SEQ ID NO: 586311 - DNA, 25 bp, Mus musculus
ccacgagttccatgccaagtgtgtt

SEQ ID NO: 586312 - DNA, 25 bp, Mus musculus
ccacgagttggacgatagcagcagt

SEQ ID NO: 586313 - DNA, 25 bp, Mus musculus
ccacgagttggaggatagcagcagt

SEQ ID NO: 586314 - DNA, 25 bp, Mus musculus
ccacgatccacgagtacgagcagca

SEQ ID NO: 586315 - DNA, 25 bp, Mus musculus
ccacgatccacgtgtacgagcagca

SEQ ID NO: 586316 - DNA, 25 bp, Mus musculus
ccacgatccggaacaaggcagcgtg

SEQ ID NO: 586317 - DNA, 25 bp, Mus musculus
ccacgatccggatcaaggcagcgtg

SEQ ID NO: 586318 - DNA, 25 bp, Mus musculus
ccacgatgagatcagcatggccatg

SEQ ID NO: 586319 - DNA, 25 bp, Mus musculus
ccacgatgagatgagcatggccatg

SEQ ID NO: 586320 - DNA, 25 bp, Mus musculus
ccacgatgaggccttctccactgaa

SEQ ID NO: 586321 - DNA, 25 bp, Mus musculus
ccacgatgaggcgttctccactgaa

SEQ ID NO: 586322 - DNA, 25 bp, Mus musculus
ccacgatgcttgacactgccttcat

SEQ ID NO: 586323 - DNA, 25 bp, Mus musculus
ccacgatgcttgtcactgccttcat

SEQ ID NO: 586324 - DNA, 25 bp, Mus musculus
ccacgatgttgtcgctatggcacga

SEQ ID NO: 586325 - DNA, 25 bp, Mus musculus
ccacgatgttgtggctatggcacga

SEQ ID NO: 586326 - DNA, 25 bp, Mus musculus
ccacgcaacgggaagaggtcaacaa

SEQ ID NO: 586327 - DNA, 25 bp, Mus musculus
ccacgcaacgggtagaggtcaacaa

SEQ ID NO: 586328 - DNA, 25 bp, Mus musculus
ccacgcaagtttctgcacagcggga

SEQ ID NO: 586329 - DNA, 25 bp, Mus musculus
ccacgcaagtttgtgcacagcggga

SEQ ID NO: 586330 - DNA, 25 bp, Mus musculus
ccacgcacatgtcgcggcacgtgtt

SEQ ID NO: 586331 - DNA, 25 bp, Mus musculus
ccacgcacatgtggcggcacgtgtt

SEQ ID NO: 586332 - DNA, 25 bp, Mus musculus
ccacgcagatatcggacgcctggct

SEQ ID NO: 586333 - DNA, 25 bp, Mus musculus
ccacgcagatatgggacgcctggct

SEQ ID NO: 586334 - DNA, 25 bp, Mus musculus
ccacgcagcagtctgggaggcgaca

SEQ ID NO: 586335 - DNA, 25 bp, Mus musculus
ccacgcagcagtgtgggaggcgaca

SEQ ID NO: 586336 - DNA, 25 bp, Mus musculus
ccacgcagtgataggtggcgtcgta

SEQ ID NO: 586337 - DNA, 25 bp, Mus musculus
ccacgcagtgattggtggcgtcgta

SEQ ID NO: 586338 - DNA, 25 bp, Mus musculus
ccacgcccgggaagagtgcagaata

SEQ ID NO: 586339 - DNA, 25 bp, Mus musculus
ccacgcccgggatgagtgcagaata

SEQ ID NO: 586340 - DNA, 25 bp, Mus musculus
ccacgccctgacatgtgagggctgc

SEQ ID NO: 586341 - DNA, 25 bp, Mus musculus
ccacgccctgacttgtgagggctgc

SEQ ID NO: 586342 - DNA, 25 bp, Mus musculus
ccacgcgctgccatcgagctggcct

SEQ ID NO: 586343 - DNA, 25 bp, Mus musculus
ccacgcgctgccttcgagctggcct

SEQ ID NO: 586344 - DNA, 25 bp, Mus musculus
ccacgcgcttggctaagtacaggct

SEQ ID NO: 586345 - DNA, 25 bp, Mus musculus
ccacgcgcttgggtaagtacaggct

SEQ ID NO: 586346 - DNA, 25 bp, Mus musculus
ccacgcggagtgagtctggttacca

SEQ ID NO: 586347 - DNA, 25 bp, Mus musculus
ccacgcggagtgtgtctggttacca

SEQ ID NO: 586348 - DNA, 25 bp, Mus musculus
ccacgcggtactctgacacttcagt

SEQ ID NO: 586349 - DNA, 25 bp, Mus musculus
ccacgcggtactgtgacacttcagt

SEQ ID NO: 586350 - DNA, 25 bp, Mus musculus
ccacgctgtagaccaatgggaacaa

SEQ ID NO: 586351 - DNA, 25 bp, Mus musculus
ccacgctgtagagcaatgggaacaa

SEQ ID NO: 586352 - DNA, 25 bp, Mus musculus
ccacggacaaagagattgaggttct

SEQ ID NO: 586353 - DNA, 25 bp, Mus musculus
ccacggacaaagtgattgaggttct

SEQ ID NO: 586354 - DNA, 25 bp, Mus musculus
ccacggacaactccgttgattttca

SEQ ID NO: 586355 - DNA, 25 bp, Mus musculus
ccacggacaactgcgttgattttca

SEQ ID NO: 586356 - DNA, 25 bp, Mus musculus
ccacggactgtgaaaatctgcttaa

SEQ ID NO: 586357 - DNA, 25 bp, Mus musculus
ccacggactgtgtaaatctgcttaa

SEQ ID NO: 586358 - DNA, 25 bp, Mus musculus
ccacggagaaaaacagggaaggtga

SEQ ID NO: 586359 - DNA, 25 bp, Mus musculus
ccacggagaaaatcagggaaggtga

SEQ ID NO: 586360 - DNA, 25 bp, Mus musculus
ccacggagagtaactgtgaggtgcc

SEQ ID NO: 586361 - DNA, 25 bp, Mus musculus
ccacggagagtatctgtgaggtgcc

SEQ ID NO: 586362 - DNA, 25 bp, Mus musculus
ccacggagcatccaggatgaaggct

SEQ ID NO: 586363 - DNA, 25 bp, Mus musculus
ccacggagcatcgaggatgaaggct

SEQ ID NO: 586364 - DNA, 25 bp, Mus musculus
ccacggagcttgagaaatgccggct

SEQ ID NO: 586365 - DNA, 25 bp, Mus musculus
ccacggagcttgtgaaatgccggct

SEQ ID NO: 586366 - DNA, 25 bp, Mus musculus
ccacggaggcgcctggtgaatactt

SEQ ID NO: 586367 - DNA, 25 bp, Mus musculus
ccacggaggcgcgtggtgaatactt

SEQ ID NO: 586368 - DNA, 25 bp, Mus musculus
ccacggatgaccaggattttaagca

SEQ ID NO: 586369 - DNA, 25 bp, Mus musculus
ccacggatgacctggattttaagca

SEQ ID NO: 586370 - DNA, 25 bp, Mus musculus
ccacggatggctaaggatgcaaatc

SEQ ID NO: 586371 - DNA, 25 bp, Mus musculus
ccacggatggcttaggatgcaaatc

SEQ ID NO: 586372 - DNA, 25 bp, Mus musculus
ccacggatgttgctgaccaaagcaa

SEQ ID NO: 586373 - DNA, 25 bp, Mus musculus
ccacggatgttggtgaccaaagcaa

SEQ ID NO: 586374 - DNA, 25 bp, Mus musculus
ccacggattggtctagccatcggtg

SEQ ID NO: 586375 - DNA, 25 bp, Mus musculus
ccacggattggtgtagccatcggtg

SEQ ID NO: 586376 - DNA, 25 bp, Mus musculus
ccacggcaacatcgccttgaacggt

SEQ ID NO: 586377 - DNA, 25 bp, Mus musculus
ccacggcaacatggccttgaacggt

SEQ ID NO: 586378 - DNA, 25 bp, Mus musculus
ccacggcagccgacaaatgacctgt

SEQ ID NO: 586379 - DNA, 25 bp, Mus musculus
ccacggcagccgtcaaatgacctgt

SEQ ID NO: 586380 - DNA, 25 bp, Mus musculus
ccacggcagcgcaatgcaaagagca

SEQ ID NO: 586381 - DNA, 25 bp, Mus musculus
ccacggcagcgctatgcaaagagca

SEQ ID NO: 586382 - DNA, 25 bp, Mus musculus
ccacggcaggtgctagagtactatg

SEQ ID NO: 586383 - DNA, 25 bp, Mus musculus
ccacggcaggtggtagagtactatg

SEQ ID NO: 586384 - DNA, 25 bp, Mus musculus
ccacggcatattcaatgggagtcag

SEQ ID NO: 586385 - DNA, 25 bp, Mus musculus
ccacggcatattgaatgggagtcag

SEQ ID NO: 586386 - DNA, 25 bp, Mus musculus
ccacggccaaacatggatggagctg

SEQ ID NO: 586387 - DNA, 25 bp, Mus musculus
ccacggccaaacttggatggagctg

SEQ ID NO: 586388 - DNA, 25 bp, Mus musculus
ccacggccacagcttccaatacaag

SEQ ID NO: 586389 - DNA, 25 bp, Mus musculus
ccacggccacaggttccaatacaag

SEQ ID NO: 586390 - DNA, 25 bp, Mus musculus
ccacggccactacccttgagtctat

SEQ ID NO: 586391 - DNA, 25 bp, Mus musculus
ccacggccactagccttgagtctat

SEQ ID NO: 586392 - DNA, 25 bp, Mus musculus
ccacggccagtgcactttcctggat

SEQ ID NO: 586393 - DNA, 25 bp, Mus musculus
ccacggccagtggactttcctggat

SEQ ID NO: 586394 - DNA, 25 bp, Mus musculus
ccacggccttttactgcgctacgga

SEQ ID NO: 586395 - DNA, 25 bp, Mus musculus
ccacggcctttttctgcgctacgga

SEQ ID NO: 586396 - DNA, 25 bp, Mus musculus
ccacggcgacgacagaaccagcagt

SEQ ID NO: 586397 - DNA, 25 bp, Mus musculus
ccacggcgacgagagaaccagcagt

SEQ ID NO: 586398 - DNA, 25 bp, Mus musculus
ccacggctcaggagaacagtatcgt

SEQ ID NO: 586399 - DNA, 25 bp, Mus musculus
ccacggctcaggtgaacagtatcgt

SEQ ID NO: 586400 - DNA, 25 bp, Mus musculus
ccacggcttcggaagcgaccggctg

SEQ ID NO: 586401 - DNA, 25 bp, Mus musculus
ccacggcttcggtagcgaccggctg

SEQ ID NO: 586402 - DNA, 25 bp, Mus musculus
ccacgggcaagccacacgtggctta

SEQ ID NO: 586403 - DNA, 25 bp, Mus musculus
ccacgggcaagcgacacgtggctta

SEQ ID NO: 586404 - DNA, 25 bp, Mus musculus
ccacggtagaccacagggagggctc

SEQ ID NO: 586405 - DNA, 25 bp, Mus musculus
ccacggtagacctcagggagggctc

SEQ ID NO: 586406 - DNA, 25 bp, Mus musculus
ccacggtctaccagaagctaggagg

SEQ ID NO: 586407 - DNA, 25 bp, Mus musculus
ccacggtctacctgaagctaggagg

SEQ ID NO: 586408 - DNA, 25 bp, Mus musculus
ccacggtgaggccaagaaaatggct

SEQ ID NO: 586409 - DNA, 25 bp, Mus musculus
ccacggtgaggcgaagaaaatggct

SEQ ID NO: 586410 - DNA, 25 bp, Mus musculus
ccacggtgatcgagagcctggagat

SEQ ID NO: 586411 - DNA, 25 bp, Mus musculus
ccacggtgatcgtgagcctggagat

SEQ ID NO: 586412 - DNA, 25 bp, Mus musculus
ccacggtggccaaaattcttagctt

SEQ ID NO: 586413 - DNA, 25 bp, Mus musculus
ccacggtggccataattcttagctt

SEQ ID NO: 586414 - DNA, 25 bp, Mus musculus
ccacggtggctgaaatagatgggct

SEQ ID NO: 586415 - DNA, 25 bp, Mus musculus
ccacggtggctgtaatagatgggct

SEQ ID NO: 586416 - DNA, 25 bp, Mus musculus
ccacggtggcttctgtcccaaggaa

SEQ ID NO: 586417 - DNA, 25 bp, Mus musculus
ccacggtggcttgtgtcccaaggaa

SEQ ID NO: 586418 - DNA, 25 bp, Mus musculus
ccacggtgtggaagatctacagcaa

SEQ ID NO: 586419 - DNA, 25 bp, Mus musculus
ccacggtgtggatgatctacagcaa

SEQ ID NO: 586420 - DNA, 25 bp, Mus musculus
ccacggtgtgttcgccgagcgctac

SEQ ID NO: 586421 - DNA, 25 bp, Mus musculus
ccacggtgtgttggccgagcgctac

SEQ ID NO: 586422 - DNA, 25 bp, Mus musculus
ccacggttagctcgcgacctggcgt

SEQ ID NO: 586423 - DNA, 25 bp, Mus musculus
ccacggttagctggcgacctggcgt

SEQ ID NO: 586424 - DNA, 25 bp, Mus musculus
ccacgtaacttgatgatcgatatcc

SEQ ID NO: 586425 - DNA, 25 bp, Mus musculus
ccacgtaacttgttgatcgatatcc

SEQ ID NO: 586426 - DNA, 25 bp, Mus musculus
ccacgtaagtgcacagtctcccggt

SEQ ID NO: 586427 - DNA, 25 bp, Mus musculus
ccacgtaagtgctcagtctcccggt

SEQ ID NO: 586428 - DNA, 25 bp, Mus musculus
ccacgtacaacgaggccctggtgtt

SEQ ID NO: 586429 - DNA, 25 bp, Mus musculus
ccacgtacaacgtggccctggtgtt

SEQ ID NO: 586430 - DNA, 25 bp, Mus musculus
ccacgtcaaattcacaacccagatt

SEQ ID NO: 586431 - DNA, 25 bp, Mus musculus
ccacgtcaaattgacaacccagatt

SEQ ID NO: 586432 - DNA, 25 bp, Mus musculus
ccacgtcactgccttactttgtgct

SEQ ID NO: 586433 - DNA, 25 bp, Mus musculus
ccacgtcactgcgttactttgtgct

SEQ ID NO: 586434 - DNA, 25 bp, Mus musculus
ccacgtcagaggagacacggtggcc

SEQ ID NO: 586435 - DNA, 25 bp, Mus musculus
ccacgtcagaggtgacacggtggcc

SEQ ID NO: 586436 - DNA, 25 bp, Mus musculus
ccacgtcatgagctgatatgtgcct

SEQ ID NO: 586437 - DNA, 25 bp, Mus musculus
ccacgtcatgaggtgatatgtgcct

SEQ ID NO: 586438 - DNA, 25 bp, Mus musculus
ccacgtctccatcggaggatgggca

SEQ ID NO: 586439 - DNA, 25 bp, Mus musculus
ccacgtctccatgggaggatgggca

SEQ ID NO: 586440 - DNA, 25 bp, Mus musculus
ccacgtgaaaccagggaaagcgcgg

SEQ ID NO: 586441 - DNA, 25 bp, Mus musculus
ccacgtgaaacctgggaaagcgcgg

SEQ ID NO: 586442 - DNA, 25 bp, Mus musculus
ccacgtgaaaggattgcacttgaat

SEQ ID NO: 586443 - DNA, 25 bp, Mus musculus
ccacgtgaaaggtttgcacttgaat

SEQ ID NO: 586444 - DNA, 25 bp, Mus musculus
ccacgtgcagtacattcacacggaa

SEQ ID NO: 586445 - DNA, 25 bp, Mus musculus
ccacgtgcagtagattcacacggaa

SEQ ID NO: 586446 - DNA, 25 bp, Mus musculus
ccacgtgcagtgagaaggcctttct

SEQ ID NO: 586447 - DNA, 25 bp, Mus musculus
ccacgtgcagtgtgaaggcctttct

SEQ ID NO: 586448 - DNA, 25 bp, Mus musculus
ccacgtggagctcatcaggctgctg

SEQ ID NO: 586449 - DNA, 25 bp, Mus musculus
ccacgtggagctgatcaggctgctg

SEQ ID NO: 586450 - DNA, 25 bp, Mus musculus
ccacgtgggatgcaagaaatgccct

SEQ ID NO: 586451 - DNA, 25 bp, Mus musculus
ccacgtgggatggaagaaatgccct

SEQ ID NO: 586452 - DNA, 25 bp, Mus musculus
ccacgtgggcttccgcttttagagc

SEQ ID NO: 586453 - DNA, 25 bp, Mus musculus
ccacgtgggcttgcgcttttagagc

SEQ ID NO: 586454 - DNA, 25 bp, Mus musculus
ccacgttgtccacaagtttgtcatt

SEQ ID NO: 586455 - DNA, 25 bp, Mus musculus
ccacgttgtccagaagtttgtcatt

SEQ ID NO: 586456 - DNA, 25 bp, Mus musculus
ccactaagccggctgtccgagcagt

SEQ ID NO: 586457 - DNA, 25 bp, Mus musculus
ccactaagccgggtgtccgagcagt

SEQ ID NO: 586458 - DNA, 25 bp, Mus musculus
ccactaataactcggaccctcaaga

SEQ ID NO: 586459 - DNA, 25 bp, Mus musculus
ccactaataactgggaccctcaaga

SEQ ID NO: 586460 - DNA, 25 bp, Mus musculus
ccactacacctgcaaaaatatcttt

SEQ ID NO: 586461 - DNA, 25 bp, Mus musculus
ccactacacctggaaaaatatcttt

SEQ ID NO: 586462 - DNA, 25 bp, Mus musculus
ccactacacgttcggtaaaagcagg

SEQ ID NO: 586463 - DNA, 25 bp, Mus musculus
ccactacacgttgggtaaaagcagg

SEQ ID NO: 586464 - DNA, 25 bp, Mus musculus
ccactacatcatcaacagcagcggc

SEQ ID NO: 586465 - DNA, 25 bp, Mus musculus
ccactacatcatgaacagcagcggc

SEQ ID NO: 586466 - DNA, 25 bp, Mus musculus
ccactacctgaacagcggccgggag

SEQ ID NO: 586467 - DNA, 25 bp, Mus musculus
ccactacctgaagagcggccgggag

SEQ ID NO: 586468 - DNA, 25 bp, Mus musculus
ccactacgaaggattcctctggatg

SEQ ID NO: 586469 - DNA, 25 bp, Mus musculus
ccactacgaaggtttcctctggatg

SEQ ID NO: 586470 - DNA, 25 bp, Mus musculus
ccactacggagtacacgcatgtgaa

SEQ ID NO: 586471 - DNA, 25 bp, Mus musculus
ccactacggagttcacgcatgtgaa

SEQ ID NO: 586472 - DNA, 25 bp, Mus musculus
ccactagctattctgtggagtgctc

SEQ ID NO: 586473 - DNA, 25 bp, Mus musculus
ccactagctattgtgtggagtgctc

SEQ ID NO: 586474 - DNA, 25 bp, Mus musculus
ccactagctgttcagtctccttcag

SEQ ID NO: 586475 - DNA, 25 bp, Mus musculus
ccactagctgttgagtctccttcag

SEQ ID NO: 586476 - DNA, 25 bp, Mus musculus
ccactagcttcacggcattggaggc

SEQ ID NO: 586477 - DNA, 25 bp, Mus musculus
ccactagcttcagggcattggaggc

SEQ ID NO: 586478 - DNA, 25 bp, Mus musculus
ccactataagagagtggagagtcca

SEQ ID NO: 586479 - DNA, 25 bp, Mus musculus
ccactataagagtgtggagagtcca

SEQ ID NO: 586480 - DNA, 25 bp, Mus musculus
ccactataggttatggccaaggcca

SEQ ID NO: 586481 - DNA, 25 bp, Mus musculus
ccactataggttttggccaaggcca

SEQ ID NO: 586482 - DNA, 25 bp, Mus musculus
ccactatagtccctacaagagggag

SEQ ID NO: 586483 - DNA, 25 bp, Mus musculus
ccactatagtccgtacaagagggag

SEQ ID NO: 586484 - DNA, 25 bp, Mus musculus
ccactatcagagagtagagacgcca

SEQ ID NO: 586485 - DNA, 25 bp, Mus musculus
ccactatcagagtgtagagacgcca

SEQ ID NO: 586486 - DNA, 25 bp, Mus musculus
ccactatcgactctggttgcccgag

SEQ ID NO: 586487 - DNA, 25 bp, Mus musculus
ccactatcgactgtggttgcccgag

SEQ ID NO: 586488 - DNA, 25 bp, Mus musculus
ccactatgaggtccggctggcttca

SEQ ID NO: 586489 - DNA, 25 bp, Mus musculus
ccactatgaggtgcggctggcttca

SEQ ID NO: 586490 - DNA, 25 bp, Mus musculus
ccactatgctgtctattacagggtg

SEQ ID NO: 586491 - DNA, 25 bp, Mus musculus
ccactatgctgtgtattacagggtg

SEQ ID NO: 586492 - DNA, 25 bp, Mus musculus
ccactatggatacagtgtgcctctg

SEQ ID NO: 586493 - DNA, 25 bp, Mus musculus
ccactatggatagagtgtgcctctg

SEQ ID NO: 586494 - DNA, 25 bp, Mus musculus
ccactatgggcacctgtctctaggg

SEQ ID NO: 586495 - DNA, 25 bp, Mus musculus
ccactatgggcagctgtctctaggg

SEQ ID NO: 586496 - DNA, 25 bp, Mus musculus
ccactatggttacagcaccgggcag

SEQ ID NO: 586497 - DNA, 25 bp, Mus musculus
ccactatggttagagcaccgggcag

SEQ ID NO: 586498 - DNA, 25 bp, Mus musculus
ccactcaaagttccaaggaaggctt

SEQ ID NO: 586499 - DNA, 25 bp, Mus musculus
ccactcaaagttgcaaggaaggctt

SEQ ID NO: 586500 - DNA, 25 bp, Mus musculus
ccactcagaactcaggatgaactgg

SEQ ID NO: 586501 - DNA, 25 bp, Mus musculus
ccactcagaactgaggatgaactgg

SEQ ID NO: 586502 - DNA, 25 bp, Mus musculus
ccactcagcattagatcacggaagt

SEQ ID NO: 586503 - DNA, 25 bp, Mus musculus
ccactcagcatttgatcacggaagt

SEQ ID NO: 586504 - DNA, 25 bp, Mus musculus
ccactcagtgctatggtttcaatgg

SEQ ID NO: 586505 - DNA, 25 bp, Mus musculus
ccactcagtgctttggtttcaatgg

SEQ ID NO: 586506 - DNA, 25 bp, Mus musculus
ccactccaagaacccaagcatggaa

SEQ ID NO: 586507 - DNA, 25 bp, Mus musculus
ccactccaagaagccaagcatggaa

SEQ ID NO: 586508 - DNA, 25 bp, Mus musculus
ccactccacaggcaagagatgtcga

SEQ ID NO: 586509 - DNA, 25 bp, Mus musculus
ccactccacagggaagagatgtcga

SEQ ID NO: 586510 - DNA, 25 bp, Mus musculus
ccactcccatcaactggacgtaaag

SEQ ID NO: 586511 - DNA, 25 bp, Mus musculus
ccactcccatcatctggacgtaaag

SEQ ID NO: 586512 - DNA, 25 bp, Mus musculus
ccactccccataaggatgagcttga

SEQ ID NO: 586513 - DNA, 25 bp, Mus musculus
ccactccccatatggatgagcttga

SEQ ID NO: 586514 - DNA, 25 bp, Mus musculus
ccactcctgacgcagaataagcaga

SEQ ID NO: 586515 - DNA, 25 bp, Mus musculus
ccactcctgacggagaataagcaga

SEQ ID NO: 586516 - DNA, 25 bp, Mus musculus
ccactcctggagagaggatcgttct

SEQ ID NO: 586517 - DNA, 25 bp, Mus musculus
ccactcctggagtgaggatcgttct

SEQ ID NO: 586518 - DNA, 25 bp, Mus musculus
ccactcgataagaatgcctgtcatg

SEQ ID NO: 586519 - DNA, 25 bp, Mus musculus
ccactcgataagtatgcctgtcatg

SEQ ID NO: 586520 - DNA, 25 bp, Mus musculus
ccactcgctgaacccgttttcagtt

SEQ ID NO: 586521 - DNA, 25 bp, Mus musculus
ccactcgctgaagccgttttcagtt

SEQ ID NO: 586522 - DNA, 25 bp, Mus musculus
ccactcggcagaagatgcgcgagtg

SEQ ID NO: 586523 - DNA, 25 bp, Mus musculus
ccactcggcagatgatgcgcgagtg

SEQ ID NO: 586524 - DNA, 25 bp, Mus musculus
ccactcggcgggacgtgtctgagat

SEQ ID NO: 586525 - DNA, 25 bp, Mus musculus
ccactcggcgggtcgtgtctgagat

SEQ ID NO: 586526 - DNA, 25 bp, Mus musculus
ccactcgttagtctcctcctagaag

SEQ ID NO: 586527 - DNA, 25 bp, Mus musculus
ccactcgttagtgtcctcctagaag

SEQ ID NO: 586528 - DNA, 25 bp, Mus musculus
ccactctatgagagacttcacaggg

SEQ ID NO: 586529 - DNA, 25 bp, Mus musculus
ccactctatgagtgacttcacaggg

SEQ ID NO: 586530 - DNA, 25 bp, Mus musculus
ccactctccggtaaaagcacagatt

SEQ ID NO: 586531 - DNA, 25 bp, Mus musculus
ccactctccggttaaagcacagatt

SEQ ID NO: 586532 - DNA, 25 bp, Mus musculus
ccactctgcaggaatgtgggccctc

SEQ ID NO: 586533 - DNA, 25 bp, Mus musculus
ccactctgcaggtatgtgggccctc

SEQ ID NO: 586534 - DNA, 25 bp, Mus musculus
ccactctgcagtctttgcgggacaa

SEQ ID NO: 586535 - DNA, 25 bp, Mus musculus
ccactctgcagtgtttgcgggacaa

SEQ ID NO: 586536 - DNA, 25 bp, Mus musculus
ccactctgtcaaatatctgtctaac

SEQ ID NO: 586537 - DNA, 25 bp, Mus musculus
ccactctgtcaattatctgtctaac

SEQ ID NO: 586538 - DNA, 25 bp, Mus musculus
ccactcttaagtataggatcacgtg

SEQ ID NO: 586539 - DNA, 25 bp, Mus musculus
ccactcttaagtttaggatcacgtg

SEQ ID NO: 586540 - DNA, 25 bp, Mus musculus
ccactcttgatgcagaacagtttga

SEQ ID NO: 586541 - DNA, 25 bp, Mus musculus
ccactcttgatggagaacagtttga

SEQ ID NO: 586542 - DNA, 25 bp, Mus musculus
ccactctttggtccaacagtgacat

SEQ ID NO: 586543 - DNA, 25 bp, Mus musculus
ccactctttggtgcaacagtgacat

SEQ ID NO: 586544 - DNA, 25 bp, Mus musculus
ccactgaatagtaatcacacaggct

SEQ ID NO: 586545 - DNA, 25 bp, Mus musculus
ccactgaatagttatcacacaggct

SEQ ID NO: 586546 - DNA, 25 bp, Mus musculus
ccactgaatatgactctcgggtgaa

SEQ ID NO: 586547 - DNA, 25 bp, Mus musculus
ccactgaatatgtctctcgggtgaa

SEQ ID NO: 586548 - DNA, 25 bp, Mus musculus
ccactgacgggcaaacagtgtgtca

SEQ ID NO: 586549 - DNA, 25 bp, Mus musculus
ccactgacgggctaacagtgtgtca

SEQ ID NO: 586550 - DNA, 25 bp, Mus musculus
ccactgagagaaatgggaagccaga

SEQ ID NO: 586551 - DNA, 25 bp, Mus musculus
ccactgagagaattgggaagccaga

SEQ ID NO: 586552 - DNA, 25 bp, Mus musculus
ccactgaggaccaacagaagcagag

SEQ ID NO: 586553 - DNA, 25 bp, Mus musculus
ccactgaggacctacagaagcagag

SEQ ID NO: 586554 - DNA, 25 bp, Mus musculus
ccactgaggataactgtagggcatg

SEQ ID NO: 586555 - DNA, 25 bp, Mus musculus
ccactgaggatatctgtagggcatg

SEQ ID NO: 586556 - DNA, 25 bp, Mus musculus
ccactgaggcgcacaaggaggtcgt

SEQ ID NO: 586557 - DNA, 25 bp, Mus musculus
ccactgaggcgctcaaggaggtcgt

SEQ ID NO: 586558 - DNA, 25 bp, Mus musculus
ccactgatgattacgttctgggaga

SEQ ID NO: 586559 - DNA, 25 bp, Mus musculus
ccactgatgatttcgttctgggaga

SEQ ID NO: 586560 - DNA, 25 bp, Mus musculus
ccactgatgctaattctagaagaag

SEQ ID NO: 586561 - DNA, 25 bp, Mus musculus
ccactgatgctatttctagaagaag

SEQ ID NO: 586562 - DNA, 25 bp, Mus musculus
ccactgatgtgtacttgctgattag

SEQ ID NO: 586563 - DNA, 25 bp, Mus musculus
ccactgatgtgttcttgctgattag

SEQ ID NO: 586564 - DNA, 25 bp, Mus musculus
ccactgcaagtgctgcccttagggt

SEQ ID NO: 586565 - DNA, 25 bp, Mus musculus
ccactgcaagtggtgcccttagggt

SEQ ID NO: 586566 - DNA, 25 bp, Mus musculus
ccactgcactggagccacagatggg

SEQ ID NO: 586567 - DNA, 25 bp, Mus musculus
ccactgcactggtgccacagatggg

SEQ ID NO: 586568 - DNA, 25 bp, Mus musculus
ccactgccaaggagaacaggaggat

SEQ ID NO: 586569 - DNA, 25 bp, Mus musculus
ccactgccaaggtgaacaggaggat

SEQ ID NO: 586570 - DNA, 25 bp, Mus musculus
ccactgccagtgaggagtatgtcac

SEQ ID NO: 586571 - DNA, 25 bp, Mus musculus
ccactgccagtgtggagtatgtcac

SEQ ID NO: 586572 - DNA, 25 bp, Mus musculus
ccactgccggtgcaatggccagcct

SEQ ID NO: 586573 - DNA, 25 bp, Mus musculus
ccactgccggtggaatggccagcct

SEQ ID NO: 586574 - DNA, 25 bp, Mus musculus
ccactgcctgggacaacctggctgt

SEQ ID NO: 586575 - DNA, 25 bp, Mus musculus
ccactgcctgggtcaacctggctgt

SEQ ID NO: 586576 - DNA, 25 bp, Mus musculus
ccactgcctttcaagtctcttgatg

SEQ ID NO: 586577 - DNA, 25 bp, Mus musculus
ccactgcctttctagtctcttgatg

SEQ ID NO: 586578 - DNA, 25 bp, Mus musculus
ccactgcggcacctccttagggatt

SEQ ID NO: 586579 - DNA, 25 bp, Mus musculus
ccactgcggcacgtccttagggatt

SEQ ID NO: 586580 - DNA, 25 bp, Mus musculus
ccactgctgatacggtgaccctgac

SEQ ID NO: 586581 - DNA, 25 bp, Mus musculus
ccactgctgatagggtgaccctgac

SEQ ID NO: 586582 - DNA, 25 bp, Mus musculus
ccactgcttcttcctcgttgaaatg

SEQ ID NO: 586583 - DNA, 25 bp, Mus musculus
ccactgcttcttgctcgttgaaatg

SEQ ID NO: 586584 - DNA, 25 bp, Mus musculus
ccactgctttgacctactgagtgta

SEQ ID NO: 586585 - DNA, 25 bp, Mus musculus
ccactgctttgagctactgagtgta

SEQ ID NO: 586586 - DNA, 25 bp, Mus musculus
ccactggagctgatcaacagcatag

SEQ ID NO: 586587 - DNA, 25 bp, Mus musculus
ccactggagctgttcaacagcatag

SEQ ID NO: 586588 - DNA, 25 bp, Mus musculus
ccactgggacacatgtaaagagctc

SEQ ID NO: 586589 - DNA, 25 bp, Mus musculus
ccactgggacacttgtaaagagctc

SEQ ID NO: 586590 - DNA, 25 bp, Mus musculus
ccactgggacagaggagaccctgga

SEQ ID NO: 586591 - DNA, 25 bp, Mus musculus
ccactgggacagtggagaccctgga

SEQ ID NO: 586592 - DNA, 25 bp, Mus musculus
ccactgggcaaacccagtgtagcct

SEQ ID NO: 586593 - DNA, 25 bp, Mus musculus
ccactgggcaaagccagtgtagcct

SEQ ID NO: 586594 - DNA, 25 bp, Mus musculus
ccactggtctggatgctgggcagaa

SEQ ID NO: 586595 - DNA, 25 bp, Mus musculus
ccactggtctggttgctgggcagaa

SEQ ID NO: 586596 - DNA, 25 bp, Mus musculus
ccactggtggcaatgatgatatgta

SEQ ID NO: 586597 - DNA, 25 bp, Mus musculus
ccactggtggcattgatgatatgta

SEQ ID NO: 586598 - DNA, 25 bp, Mus musculus
ccactggttggtacgcagggttcac

SEQ ID NO: 586599 - DNA, 25 bp, Mus musculus
ccactggttggttcgcagggttcac

SEQ ID NO: 586600 - DNA, 25 bp, Mus musculus
ccactgtcaagtcgctgttccagcg

SEQ ID NO: 586601 - DNA, 25 bp, Mus musculus
ccactgtcaagtggctgttccagcg

SEQ ID NO: 586602 - DNA, 25 bp, Mus musculus
ccactgtcactacggactgggtaag

SEQ ID NO: 586603 - DNA, 25 bp, Mus musculus
ccactgtcactagggactgggtaag

SEQ ID NO: 586604 - DNA, 25 bp, Mus musculus
ccactgtcagaaagctaagggaagc

SEQ ID NO: 586605 - DNA, 25 bp, Mus musculus
ccactgtcagaatgctaagggaagc

SEQ ID NO: 586606 - DNA, 25 bp, Mus musculus
ccactgtcataacttcttcttggga

SEQ ID NO: 586607 - DNA, 25 bp, Mus musculus
ccactgtcataagttcttcttggga

SEQ ID NO: 586608 - DNA, 25 bp, Mus musculus
ccactgtccatgagctttcccgaga

SEQ ID NO: 586609 - DNA, 25 bp, Mus musculus
ccactgtccatgtgctttcccgaga

SEQ ID NO: 586610 - DNA, 25 bp, Mus musculus
ccactgtcttaactggaagctcaaa

SEQ ID NO: 586611 - DNA, 25 bp, Mus musculus
ccactgtcttaagtggaagctcaaa

SEQ ID NO: 586612 - DNA, 25 bp, Mus musculus
ccactgtgcaaaaaaggacgaacct

SEQ ID NO: 586613 - DNA, 25 bp, Mus musculus
ccactgtgcaaataaggacgaacct

SEQ ID NO: 586614 - DNA, 25 bp, Mus musculus
ccactgtgcccgagcagatgccaaa

SEQ ID NO: 586615 - DNA, 25 bp, Mus musculus
ccactgtgcccgtgcagatgccaaa

SEQ ID NO: 586616 - DNA, 25 bp, Mus musculus
ccactgtggaccagatgccctacag

SEQ ID NO: 586617 - DNA, 25 bp, Mus musculus
ccactgtggacctgatgccctacag

SEQ ID NO: 586618 - DNA, 25 bp, Mus musculus
ccactgtggagccacggtgggcatg

SEQ ID NO: 586619 - DNA, 25 bp, Mus musculus
ccactgtggagcgacggtgggcatg

SEQ ID NO: 586620 - DNA, 25 bp, Mus musculus
ccactgtggaggaatttaaatttca

SEQ ID NO: 586621 - DNA, 25 bp, Mus musculus
ccactgtggaggtatttaaatttca

SEQ ID NO: 586622 - DNA, 25 bp, Mus musculus
ccactgtggcagatgttgtttatga

SEQ ID NO: 586623 - DNA, 25 bp, Mus musculus
ccactgtggcagttgttgtttatga

SEQ ID NO: 586624 - DNA, 25 bp, Mus musculus
ccactgtgggagcagcaatttcctc

SEQ ID NO: 586625 - DNA, 25 bp, Mus musculus
ccactgtgggaggagcaatttcctc

SEQ ID NO: 586626 - DNA, 25 bp, Mus musculus
ccactgtgggctccatggagaaaga

SEQ ID NO: 586627 - DNA, 25 bp, Mus musculus
ccactgtgggctgcatggagaaaga

SEQ ID NO: 586628 - DNA, 25 bp, Mus musculus
ccactgtggtgtagcatggatatga

SEQ ID NO: 586629 - DNA, 25 bp, Mus musculus
ccactgtggtgttgcatggatatga

SEQ ID NO: 586630 - DNA, 25 bp, Mus musculus
ccactgtgtgttcgttgatgttact

SEQ ID NO: 586631 - DNA, 25 bp, Mus musculus
ccactgtgtgttggttgatgttact

SEQ ID NO: 586632 - DNA, 25 bp, Mus musculus
ccactgttcaacacgagatgcagct

SEQ ID NO: 586633 - DNA, 25 bp, Mus musculus
ccactgttcaactcgagatgcagct

SEQ ID NO: 586634 - DNA, 25 bp, Mus musculus
ccactgttgagtctgcgtgaatccc

SEQ ID NO: 586635 - DNA, 25 bp, Mus musculus
ccactgttgagtgtgcgtgaatccc

SEQ ID NO: 586636 - DNA, 25 bp, Mus musculus
ccactgtttgcaactaaagggctgt

SEQ ID NO: 586637 - DNA, 25 bp, Mus musculus
ccactgtttgcatctaaagggctgt

SEQ ID NO: 586638 - DNA, 25 bp, Mus musculus
ccacttaaatggatgttccctggaa

SEQ ID NO: 586639 - DNA, 25 bp, Mus musculus
ccacttaaatggttgttccctggaa

SEQ ID NO: 586640 - DNA, 25 bp, Mus musculus
ccacttagaaggacttagaaggact

SEQ ID NO: 586641 - DNA, 25 bp, Mus musculus
ccacttagaaggtcttagaaggact

SEQ ID NO: 586642 - DNA, 25 bp, Mus musculus
ccacttagaatgaaaaaccagtata

SEQ ID NO: 586643 - DNA, 25 bp, Mus musculus
ccacttagaatgtaaaaccagtata

SEQ ID NO: 586644 - DNA, 25 bp, Mus musculus
ccacttatgcgtcgcactgctagag

SEQ ID NO: 586645 - DNA, 25 bp, Mus musculus
ccacttatgcgtggcactgctagag

SEQ ID NO: 586646 - DNA, 25 bp, Mus musculus
ccacttcacaggacatcaaacacaa

SEQ ID NO: 586647 - DNA, 25 bp, Mus musculus
ccacttcacaggtcatcaaacacaa

SEQ ID NO: 586648 - DNA, 25 bp, Mus musculus
ccacttcagctcattcgccgatgag

SEQ ID NO: 586649 - DNA, 25 bp, Mus musculus
ccacttcagctctttcgccgatgag

SEQ ID NO: 586650 - DNA, 25 bp, Mus musculus
ccacttcagggacggactggactcg

SEQ ID NO: 586651 - DNA, 25 bp, Mus musculus
ccacttcagggagggactggactcg

SEQ ID NO: 586652 - DNA, 25 bp, Mus musculus
ccacttccaaagatgcagacgagcc

SEQ ID NO: 586653 - DNA, 25 bp, Mus musculus
ccacttccaaagttgcagacgagcc

SEQ ID NO: 586654 - DNA, 25 bp, Mus musculus
ccacttcgaggacccagggccgatg

SEQ ID NO: 586655 - DNA, 25 bp, Mus musculus
ccacttcgaggagccagggccgatg

SEQ ID NO: 586656 - DNA, 25 bp, Mus musculus
ccacttcgctatatggatggtgtcc

SEQ ID NO: 586657 - DNA, 25 bp, Mus musculus
ccacttcgctatttggatggtgtcc

SEQ ID NO: 586658 - DNA, 25 bp, Mus musculus
ccacttcggtgtctgtgtagacagc

SEQ ID NO: 586659 - DNA, 25 bp, Mus musculus
ccacttcggtgtgtgtgtagacagc

SEQ ID NO: 586660 - DNA, 25 bp, Mus musculus
ccacttctatgtccagggtagaggc

SEQ ID NO: 586661 - DNA, 25 bp, Mus musculus
ccacttctatgtgcagggtagaggc

SEQ ID NO: 586662 - DNA, 25 bp, Mus musculus
ccacttctccctctagatggctatg

SEQ ID NO: 586663 - DNA, 25 bp, Mus musculus
ccacttctccctgtagatggctatg

SEQ ID NO: 586664 - DNA, 25 bp, Mus musculus
ccacttctgccacatctgtggcaag

SEQ ID NO: 586665 - DNA, 25 bp, Mus musculus
ccacttctgccagatctgtggcaag

SEQ ID NO: 586666 - DNA, 25 bp, Mus musculus
ccacttctgtatctggtttcctgtc

SEQ ID NO: 586667 - DNA, 25 bp, Mus musculus
ccacttctgtatgtggtttcctgtc

SEQ ID NO: 586668 - DNA, 25 bp, Mus musculus
ccacttgaacctcactggggagagt

SEQ ID NO: 586669 - DNA, 25 bp, Mus musculus
ccacttgaacctgactggggagagt

SEQ ID NO: 586670 - DNA, 25 bp, Mus musculus
ccacttgacgtcaatgacatgaaga

SEQ ID NO: 586671 - DNA, 25 bp, Mus musculus
ccacttgacgtctatgacatgaaga

SEQ ID NO: 586672 - DNA, 25 bp, Mus musculus
ccacttgataggacacagtagcgag

SEQ ID NO: 586673 - DNA, 25 bp, Mus musculus
ccacttgataggtcacagtagcgag

SEQ ID NO: 586674 - DNA, 25 bp, Mus musculus
ccacttgcaagaacgagttgataaa

SEQ ID NO: 586675 - DNA, 25 bp, Mus musculus
ccacttgcaagatcgagttgataaa

SEQ ID NO: 586676 - DNA, 25 bp, Mus musculus
ccacttgcgggaagagcagactgct

SEQ ID NO: 586677 - DNA, 25 bp, Mus musculus
ccacttgcgggatgagcagactgct

SEQ ID NO: 586678 - DNA, 25 bp, Mus musculus
ccacttgggcaacctggagttggat

SEQ ID NO: 586679 - DNA, 25 bp, Mus musculus
ccacttgggcaagctggagttggat

SEQ ID NO: 586680 - DNA, 25 bp, Mus musculus
ccacttgtgccgctggctccagagg

SEQ ID NO: 586681 - DNA, 25 bp, Mus musculus
ccacttgtgccggtggctccagagg

SEQ ID NO: 586682 - DNA, 25 bp, Mus musculus
ccacttgtggcactgtactacacta

SEQ ID NO: 586683 - DNA, 25 bp, Mus musculus
ccacttgtggcagtgtactacacta

SEQ ID NO: 586684 - DNA, 25 bp, Mus musculus
ccactttaacgacctggaggccagc

SEQ ID NO: 586685 - DNA, 25 bp, Mus musculus
ccactttaacgagctggaggccagc

SEQ ID NO: 586686 - DNA, 25 bp, Mus musculus
ccactttagcaaataaacatgccag

SEQ ID NO: 586687 - DNA, 25 bp, Mus musculus
ccactttagcaattaaacatgccag

SEQ ID NO: 586688 - DNA, 25 bp, Mus musculus
ccactttatcaaagacaacttcaag

SEQ ID NO: 586689 - DNA, 25 bp, Mus musculus
ccactttatcaatgacaacttcaag

SEQ ID NO: 586690 - DNA, 25 bp, Mus musculus
ccactttcatgcctctgatcatgtg

SEQ ID NO: 586691 - DNA, 25 bp, Mus musculus
ccactttcatgcgtctgatcatgtg

SEQ ID NO: 586692 - DNA, 25 bp, Mus musculus
ccactttccctgcagctgagatctg

SEQ ID NO: 586693 - DNA, 25 bp, Mus musculus
ccactttccctggagctgagatctg

SEQ ID NO: 586694 - DNA, 25 bp, Mus musculus
ccactttctgacaggtgtgtgcgcc

SEQ ID NO: 586695 - DNA, 25 bp, Mus musculus
ccactttctgactggtgtgtgcgcc

SEQ ID NO: 586696 - DNA, 25 bp, Mus musculus
ccactttgaagtagggtggtcctgg

SEQ ID NO: 586697 - DNA, 25 bp, Mus musculus
ccactttgaagttgggtggtcctgg

SEQ ID NO: 586698 - DNA, 25 bp, Mus musculus
ccactttgagtgatgtctggtcttt

SEQ ID NO: 586699 - DNA, 25 bp, Mus musculus
ccactttgagtgttgtctggtcttt

SEQ ID NO: 586700 - DNA, 25 bp, Mus musculus
ccactttgatatcctgaagccctat

SEQ ID NO: 586701 - DNA, 25 bp, Mus musculus
ccactttgatatgctgaagccctat

SEQ ID NO: 586702 - DNA, 25 bp, Mus musculus
ccactttgcagtccctgtttggaga

SEQ ID NO: 586703 - DNA, 25 bp, Mus musculus
ccactttgcagtgcctgtttggaga

SEQ ID NO: 586704 - DNA, 25 bp, Mus musculus
ccactttgccccagggaagagcttc

SEQ ID NO: 586705 - DNA, 25 bp, Mus musculus
ccactttgcccctgggaagagcttc

SEQ ID NO: 586706 - DNA, 25 bp, Mus musculus
ccactttgggaacgagcatgtggtt

SEQ ID NO: 586707 - DNA, 25 bp, Mus musculus
ccactttgggaaggagcatgtggtt

SEQ ID NO: 586708 - DNA, 25 bp, Mus musculus
ccactttgtgagacctgtgtggagg

SEQ ID NO: 586709 - DNA, 25 bp, Mus musculus
ccactttgtgagtcctgtgtggagg

SEQ ID NO: 586710 - DNA, 25 bp, Mus musculus
ccactttgtgctcaagccccagaga

SEQ ID NO: 586711 - DNA, 25 bp, Mus musculus
ccactttgtgctgaagccccagaga

SEQ ID NO: 586712 - DNA, 25 bp, Mus musculus
ccacttttacctcagggacctggct

SEQ ID NO: 586713 - DNA, 25 bp, Mus musculus
ccacttttacctgagggacctggct

SEQ ID NO: 586714 - DNA, 25 bp, Mus musculus
ccacttttgatcagaaccagtcaga

SEQ ID NO: 586715 - DNA, 25 bp, Mus musculus
ccacttttgatctgaaccagtcaga

SEQ ID NO: 586716 - DNA, 25 bp, Mus musculus
ccacttttgctacagagcaaggctt

SEQ ID NO: 586717 - DNA, 25 bp, Mus musculus
ccacttttgctagagagcaaggctt

SEQ ID NO: 586718 - DNA, 25 bp, Mus musculus
ccactttttgggatgtatttctcgg

SEQ ID NO: 586719 - DNA, 25 bp, Mus musculus
ccactttttgggttgtatttctcgg

SEQ ID NO: 586720 - DNA, 25 bp, Mus musculus
ccagaaaaaccaacgtgatcgttag

SEQ ID NO: 586721 - DNA, 25 bp, Mus musculus
ccagaaaaaccatcgtgatcgttag

SEQ ID NO: 586722 - DNA, 25 bp, Mus musculus
ccagaaaacattctcttggactgcc

SEQ ID NO: 586723 - DNA, 25 bp, Mus musculus
ccagaaaacattgtcttggactgcc

SEQ ID NO: 586724 - DNA, 25 bp, Mus musculus
ccagaaaacgcaaggaatgtcccga

SEQ ID NO: 586725 - DNA, 25 bp, Mus musculus
ccagaaaacgcatggaatgtcccga

SEQ ID NO: 586726 - DNA, 25 bp, Mus musculus
ccagaaaagggtcaagggaatatgc

SEQ ID NO: 586727 - DNA, 25 bp, Mus musculus
ccagaaaagggtgaagggaatatgc

SEQ ID NO: 586728 - DNA, 25 bp, Mus musculus
ccagaaaagtggctgaaggtcaagt

SEQ ID NO: 586729 - DNA, 25 bp, Mus musculus
ccagaaaagtgggtgaaggtcaagt

SEQ ID NO: 586730 - DNA, 25 bp, Mus musculus
ccagaaaataggacccatgggccac

SEQ ID NO: 586731 - DNA, 25 bp, Mus musculus
ccagaaaataggtcccatgggccac

SEQ ID NO: 586732 - DNA, 25 bp, Mus musculus
ccagaaaatgcaacgcacaagttag

SEQ ID NO: 586733 - DNA, 25 bp, Mus musculus
ccagaaaatgcatcgcacaagttag

SEQ ID NO: 586734 - DNA, 25 bp, Mus musculus
ccagaaaattcacggtgctcaggat

SEQ ID NO: 586735 - DNA, 25 bp, Mus musculus
ccagaaaattcagggtgctcaggat

SEQ ID NO: 586736 - DNA, 25 bp, Mus musculus
ccagaaacaactactgcggcatgca

SEQ ID NO: 586737 - DNA, 25 bp, Mus musculus
ccagaaacaacttctgcggcatgca

SEQ ID NO: 586738 - DNA, 25 bp, Mus musculus
ccagaaacaggtaattgcaaccaca

SEQ ID NO: 586739 - DNA, 25 bp, Mus musculus
ccagaaacaggttattgcaaccaca

SEQ ID NO: 586740 - DNA, 25 bp, Mus musculus
ccagaaactgaaactaaaacaggca

SEQ ID NO: 586741 - DNA, 25 bp, Mus musculus
ccagaaactgaatctaaaacaggca

SEQ ID NO: 586742 - DNA, 25 bp, Mus musculus
ccagaaactgggatggtaagcacaa

SEQ ID NO: 586743 - DNA, 25 bp, Mus musculus
ccagaaactgggttggtaagcacaa

SEQ ID NO: 586744 - DNA, 25 bp, Mus musculus
ccagaaagagaaagacttgcaactt

SEQ ID NO: 586745 - DNA, 25 bp, Mus musculus
ccagaaagagaatgacttgcaactt

SEQ ID NO: 586746 - DNA, 25 bp, Mus musculus
ccagaaagatgaaggatacagacag

SEQ ID NO: 586747 - DNA, 25 bp, Mus musculus
ccagaaagatgatggatacagacag

SEQ ID NO: 586748 - DNA, 25 bp, Mus musculus
ccagaaagcaggaacccaaggactt

SEQ ID NO: 586749 - DNA, 25 bp, Mus musculus
ccagaaagcaggtacccaaggactt

SEQ ID NO: 586750 - DNA, 25 bp, Mus musculus
ccagaaagcccacggcatgccagaa

SEQ ID NO: 586751 - DNA, 25 bp, Mus musculus
ccagaaagcccagggcatgccagaa

SEQ ID NO: 586752 - DNA, 25 bp, Mus musculus
ccagaaagggagatgtatgcttgct

SEQ ID NO: 586753 - DNA, 25 bp, Mus musculus
ccagaaagggagttgtatgcttgct

SEQ ID NO: 586754 - DNA, 25 bp, Mus musculus
ccagaaagggatcgacttcattttg

SEQ ID NO: 586755 - DNA, 25 bp, Mus musculus
ccagaaagggatggacttcattttg

SEQ ID NO: 586756 - DNA, 25 bp, Mus musculus
ccagaaagggtcaacaagaatgtgt

SEQ ID NO: 586757 - DNA, 25 bp, Mus musculus
ccagaaagggtctacaagaatgtgt

SEQ ID NO: 586758 - DNA, 25 bp, Mus musculus
ccagaaagtaaacgcagccattgcc

SEQ ID NO: 586759 - DNA, 25 bp, Mus musculus
ccagaaagtaaaggcagccattgcc

SEQ ID NO: 586760 - DNA, 25 bp, Mus musculus
ccagaaagtatcaatgggacagacg

SEQ ID NO: 586761 - DNA, 25 bp, Mus musculus
ccagaaagtatctatgggacagacg

SEQ ID NO: 586762 - DNA, 25 bp, Mus musculus
ccagaaagtgaaaggatttggaggc

SEQ ID NO: 586763 - DNA, 25 bp, Mus musculus
ccagaaagtgaatggatttggaggc

SEQ ID NO: 586764 - DNA, 25 bp, Mus musculus
ccagaaagtggcagaggattacgtc

SEQ ID NO: 586765 - DNA, 25 bp, Mus musculus
ccagaaagtggccaaagatattgcc

SEQ ID NO: 586766 - DNA, 25 bp, Mus musculus
ccagaaagtggcgaaagatattgcc

SEQ ID NO: 586767 - DNA, 25 bp, Mus musculus
ccagaaagtggctgaggattacgtc

SEQ ID NO: 586768 - DNA, 25 bp, Mus musculus
ccagaaatcactacgggagaagcaa

SEQ ID NO: 586769 - DNA, 25 bp, Mus musculus
ccagaaatcacttcgggagaagcaa

SEQ ID NO: 586770 - DNA, 25 bp, Mus musculus
ccagaaatgcccaggctattgctga

SEQ ID NO: 586771 - DNA, 25 bp, Mus musculus
ccagaaatgccctggctattgctga

SEQ ID NO: 586772 - DNA, 25 bp, Mus musculus
ccagaaattacaacagaagatatca

SEQ ID NO: 586773 - DNA, 25 bp, Mus musculus
ccagaaattacatcagaagatatca

SEQ ID NO: 586774 - DNA, 25 bp, Mus musculus
ccagaacaagaactacaattgtgga

SEQ ID NO: 586775 - DNA, 25 bp, Mus musculus
ccagaacaagaagtacaattgtgga

SEQ ID NO: 586776 - DNA, 25 bp, Mus musculus
ccagaacaatctctgcaggaaaagt

SEQ ID NO: 586777 - DNA, 25 bp, Mus musculus
ccagaacaatctgtgcaggaaaagt

SEQ ID NO: 586778 - DNA, 25 bp, Mus musculus
ccagaacatcagagttcaagcatct

SEQ ID NO: 586779 - DNA, 25 bp, Mus musculus
ccagaacatcagtgttcaagcatct

SEQ ID NO: 586780 - DNA, 25 bp, Mus musculus
ccagaacatggacaattccaaggca

SEQ ID NO: 586781 - DNA, 25 bp, Mus musculus
ccagaacatggagaattccaaggca

SEQ ID NO: 586782 - DNA, 25 bp, Mus musculus
ccagaaccatcaatgcaaacatggc

SEQ ID NO: 586783 - DNA, 25 bp, Mus musculus
ccagaaccatcattgcaaacatggc

SEQ ID NO: 586784 - DNA, 25 bp, Mus musculus
ccagaacccgaacatcttgcgataa

SEQ ID NO: 586785 - DNA, 25 bp, Mus musculus
ccagaacccgaagatcttgcgataa

SEQ ID NO: 586786 - DNA, 25 bp, Mus musculus
ccagaaccgggaatcagaggatgct

SEQ ID NO: 586787 - DNA, 25 bp, Mus musculus
ccagaaccgggattcagaggatgct

SEQ ID NO: 586788 - DNA, 25 bp, Mus musculus
ccagaacggcttctgtaactgcaaa

SEQ ID NO: 586789 - DNA, 25 bp, Mus musculus
ccagaacggcttgtgtaactgcaaa

SEQ ID NO: 586790 - DNA, 25 bp, Mus musculus
ccagaacggtacaggcgtctgtcga

SEQ ID NO: 586791 - DNA, 25 bp, Mus musculus
ccagaacggtactggcgtctgtcga

SEQ ID NO: 586792 - DNA, 25 bp, Mus musculus
ccagaactatttcaggacccacttt

SEQ ID NO: 586793 - DNA, 25 bp, Mus musculus
ccagaactatttgaggacccacttt

SEQ ID NO: 586794 - DNA, 25 bp, Mus musculus
ccagaactctccaggaacttcgtgt

SEQ ID NO: 586795 - DNA, 25 bp, Mus musculus
ccagaactctcctggaacttcgtgt

SEQ ID NO: 586796 - DNA, 25 bp, Mus musculus
ccagaactgcagcatcatgtaatct

SEQ ID NO: 586797 - DNA, 25 bp, Mus musculus
ccagaactgcaggatcatgtaatct

SEQ ID NO: 586798 - DNA, 25 bp, Mus musculus
ccagaactgctgctaaaaccctgtt

SEQ ID NO: 586799 - DNA, 25 bp, Mus musculus
ccagaactgctggtaaaaccctgtt

SEQ ID NO: 586800 - DNA, 25 bp, Mus musculus
ccagaactggtacatggctggctgt

SEQ ID NO: 586801 - DNA, 25 bp, Mus musculus
ccagaactggtagatggctggctgt

SEQ ID NO: 586802 - DNA, 25 bp, Mus musculus
ccagaacttggaattagcatatcag

SEQ ID NO: 586803 - DNA, 25 bp, Mus musculus
ccagaacttggatttagcatatcag

SEQ ID NO: 586804 - DNA, 25 bp, Mus musculus
ccagaactttgaaatggccttctca

SEQ ID NO: 586805 - DNA, 25 bp, Mus musculus
ccagaactttgatatggccttctca

SEQ ID NO: 586806 - DNA, 25 bp, Mus musculus
ccagaactttgtaatcagcagcaag

SEQ ID NO: 586807 - DNA, 25 bp, Mus musculus
ccagaactttgttatcagcagcaag

SEQ ID NO: 586808 - DNA, 25 bp, Mus musculus
ccagaagaagttcgaggctatcaaa

SEQ ID NO: 586809 - DNA, 25 bp, Mus musculus
ccagaagaagttggaggctatcaaa

SEQ ID NO: 586810 - DNA, 25 bp, Mus musculus
ccagaagaatgaatcgacagaaagt

SEQ ID NO: 586811 - DNA, 25 bp, Mus musculus
ccagaagaatgattcgacagaaagt

SEQ ID NO: 586812 - DNA, 25 bp, Mus musculus
ccagaagacaggaggcctggacaag

SEQ ID NO: 586813 - DNA, 25 bp, Mus musculus
ccagaagacaggtggcctggacaag

SEQ ID NO: 586814 - DNA, 25 bp, Mus musculus
ccagaagaccaaagccatatctgag

SEQ ID NO: 586815 - DNA, 25 bp, Mus musculus
ccagaagaccaatgccatatctgag

SEQ ID NO: 586816 - DNA, 25 bp, Mus musculus
ccagaagacctgcttgaagtgaacc

SEQ ID NO: 586817 - DNA, 25 bp, Mus musculus
ccagaagacctggttgaagtgaacc

SEQ ID NO: 586818 - DNA, 25 bp, Mus musculus
ccagaagacttgcacccattccagg

SEQ ID NO: 586819 - DNA, 25 bp, Mus musculus
ccagaagacttggacccattccagg

SEQ ID NO: 586820 - DNA, 25 bp, Mus musculus
ccagaagagtacaagcagaaaatta

SEQ ID NO: 586821 - DNA, 25 bp, Mus musculus
ccagaagagtactagcagaaaatta

SEQ ID NO: 586822 - DNA, 25 bp, Mus musculus
ccagaagatgagaatgcagacgcag

SEQ ID NO: 586823 - DNA, 25 bp, Mus musculus
ccagaagatgagtatgcagacgcag

SEQ ID NO: 586824 - DNA, 25 bp, Mus musculus
ccagaagcagaaattccagggccaa

SEQ ID NO: 586825 - DNA, 25 bp, Mus musculus
ccagaagcagaatttccagggccaa

SEQ ID NO: 586826 - DNA, 25 bp, Mus musculus
ccagaagccactcggagatttttca

SEQ ID NO: 586827 - DNA, 25 bp, Mus musculus
ccagaagccactgggagatttttca

SEQ ID NO: 586828 - DNA, 25 bp, Mus musculus
ccagaagccgaacaagtgagagtaa

SEQ ID NO: 586829 - DNA, 25 bp, Mus musculus
ccagaagccgaagaagtgagagtaa

SEQ ID NO: 586830 - DNA, 25 bp, Mus musculus
ccagaagccgccaaagaccgagaga

SEQ ID NO: 586831 - DNA, 25 bp, Mus musculus
ccagaagccgcctaagaccgagaga

SEQ ID NO: 586832 - DNA, 25 bp, Mus musculus
ccagaagcctcaagatagtacggag

SEQ ID NO: 586833 - DNA, 25 bp, Mus musculus
ccagaagcctcatgatagtacggag

SEQ ID NO: 586834 - DNA, 25 bp, Mus musculus
ccagaagctaatcaaaataaggatg

SEQ ID NO: 586835 - DNA, 25 bp, Mus musculus
ccagaagctaatgaaaataaggatg

SEQ ID NO: 586836 - DNA, 25 bp, Mus musculus
ccagaagctagaccgcctgggcctg

SEQ ID NO: 586837 - DNA, 25 bp, Mus musculus
ccagaagctagagcgcctgggcctg

SEQ ID NO: 586838 - DNA, 25 bp, Mus musculus
ccagaagctgcgctataaggtggat

SEQ ID NO: 586839 - DNA, 25 bp, Mus musculus
ccagaagctgcggtataaggtggat

SEQ ID NO: 586840 - DNA, 25 bp, Mus musculus
ccagaaggagtgatagctcgaagga

SEQ ID NO: 586841 - DNA, 25 bp, Mus musculus
ccagaaggagtgttagctcgaagga

SEQ ID NO: 586842 - DNA, 25 bp, Mus musculus
ccagaaggcgagaggtgtgcttggt

SEQ ID NO: 586843 - DNA, 25 bp, Mus musculus
ccagaaggcgagtggtgtgcttggt

SEQ ID NO: 586844 - DNA, 25 bp, Mus musculus
ccagaaggctgtcgaacccttgtat

SEQ ID NO: 586845 - DNA, 25 bp, Mus musculus
ccagaaggctgtggaacccttgtat

SEQ ID NO: 586846 - DNA, 25 bp, Mus musculus
ccagaagggcagagaaaggcagcta

SEQ ID NO: 586847 - DNA, 25 bp, Mus musculus
ccagaagggcagtgaaaggcagcta

SEQ ID NO: 586848 - DNA, 25 bp, Mus musculus
ccagaaggtggccatgttagtccaa

SEQ ID NO: 586849 - DNA, 25 bp, Mus musculus
ccagaaggtggcgatgttagtccaa

SEQ ID NO: 586850 - DNA, 25 bp, Mus musculus
ccagaagtacgcaacggaagaggcc

SEQ ID NO: 586851 - DNA, 25 bp, Mus musculus
ccagaagtacgctacggaagaggcc

SEQ ID NO: 586852 - DNA, 25 bp, Mus musculus
ccagaagtcaccacagaagattgcc

SEQ ID NO: 586853 - DNA, 25 bp, Mus musculus
ccagaagtcacctcagaagattgcc

SEQ ID NO: 586854 - DNA, 25 bp, Mus musculus
ccagaagtcctcatctcaagggagc

SEQ ID NO: 586855 - DNA, 25 bp, Mus musculus
ccagaagtcctcttctcaagggagc

SEQ ID NO: 586856 - DNA, 25 bp, Mus musculus
ccagaagtcgacctgtggagcctcg

SEQ ID NO: 586857 - DNA, 25 bp, Mus musculus
ccagaagtcgacgtgtggagcctcg

SEQ ID NO: 586858 - DNA, 25 bp, Mus musculus
ccagaagtctataccaacagggacc

SEQ ID NO: 586859 - DNA, 25 bp, Mus musculus
ccagaagtctatacccattgggacc

SEQ ID NO: 586860 - DNA, 25 bp, Mus musculus
ccagaagtctattccaacagggacc

SEQ ID NO: 586861 - DNA, 25 bp, Mus musculus
ccagaagtctattcccattgggacc

SEQ ID NO: 586862 - DNA, 25 bp, Mus musculus
ccagaagtgcctaagtggagacatt

SEQ ID NO: 586863 - DNA, 25 bp, Mus musculus
ccagaagtgccttagtggagacatt

SEQ ID NO: 586864 - DNA, 25 bp, Mus musculus
ccagaagtggtaagagtataactca

SEQ ID NO: 586865 - DNA, 25 bp, Mus musculus
ccagaagtggtatgagtataactca

SEQ ID NO: 586866 - DNA, 25 bp, Mus musculus
ccagaagtggtgatgggaaagccct

SEQ ID NO: 586867 - DNA, 25 bp, Mus musculus
ccagaagtggtgttgggaaagccct

SEQ ID NO: 586868 - DNA, 25 bp, Mus musculus
ccagaagtgtaacccatgtgcggac

SEQ ID NO: 586869 - DNA, 25 bp, Mus musculus
ccagaagtgtaagccatgtgcggac

SEQ ID NO: 586870 - DNA, 25 bp, Mus musculus
ccagaagttgggaagcagaatctgt

SEQ ID NO: 586871 - DNA, 25 bp, Mus musculus
ccagaagttgggtagcagaatctgt

SEQ ID NO: 586872 - DNA, 25 bp, Mus musculus
ccagaatagtggctttgaatacacc

SEQ ID NO: 586873 - DNA, 25 bp, Mus musculus
ccagaatagtgggtttgaatacacc

SEQ ID NO: 586874 - DNA, 25 bp, Mus musculus
ccagaatatgagaaccctgaataag

SEQ ID NO: 586875 - DNA, 25 bp, Mus musculus
ccagaatatgagtaccctgaataag

SEQ ID NO: 586876 - DNA, 25 bp, Mus musculus
ccagaatattaaatcaaagagagac

SEQ ID NO: 586877 - DNA, 25 bp, Mus musculus
ccagaatattaattcaaagagagac

SEQ ID NO: 586878 - DNA, 25 bp, Mus musculus
ccagaatcagaaaggacaagaatac

SEQ ID NO: 586879 - DNA, 25 bp, Mus musculus
ccagaatcagaatggacaagaatac

SEQ ID NO: 586880 - DNA, 25 bp, Mus musculus
ccagaatccatgcagaagctgcgct

SEQ ID NO: 586881 - DNA, 25 bp, Mus musculus
ccagaatccatggagaagctgcgct

SEQ ID NO: 586882 - DNA, 25 bp, Mus musculus
ccagaatcctgtcccttaataataa

SEQ ID NO: 586883 - DNA, 25 bp, Mus musculus
ccagaatcctgtgccttaataataa

SEQ ID NO: 586884 - DNA, 25 bp, Mus musculus
ccagaatgaagacgcccagttcgtg

SEQ ID NO: 586885 - DNA, 25 bp, Mus musculus
ccagaatgaagaggcccagttcgtg

SEQ ID NO: 586886 - DNA, 25 bp, Mus musculus
ccagaatgatgaattggaaagtcag

SEQ ID NO: 586887 - DNA, 25 bp, Mus musculus
ccagaatgatgatttggaaagtcag

SEQ ID NO: 586888 - DNA, 25 bp, Mus musculus
ccagaatgcaatcatgacggcacct

SEQ ID NO: 586889 - DNA, 25 bp, Mus musculus
ccagaatgcaatgatgacggcacct

SEQ ID NO: 586890 - DNA, 25 bp, Mus musculus
ccagaatgcgagacagaactgggtg

SEQ ID NO: 586891 - DNA, 25 bp, Mus musculus
ccagaatgcgagtcagaactgggtg

SEQ ID NO: 586892 - DNA, 25 bp, Mus musculus
ccagaatgcttcatctttggagcaa

SEQ ID NO: 586893 - DNA, 25 bp, Mus musculus
ccagaatgcttcttctttggagcaa

SEQ ID NO: 586894 - DNA, 25 bp, Mus musculus
ccagaatgtagcaaacctcgggaca

SEQ ID NO: 586895 - DNA, 25 bp, Mus musculus
ccagaatgtagctaacctcgggaca

SEQ ID NO: 586896 - DNA, 25 bp, Mus musculus
ccagaatgtcgcattcatctagaaa

SEQ ID NO: 586897 - DNA, 25 bp, Mus musculus
ccagaatgtcgctttcatctagaaa

SEQ ID NO: 586898 - DNA, 25 bp, Mus musculus
ccagaatgttcaaccacaactgtga

SEQ ID NO: 586899 - DNA, 25 bp, Mus musculus
ccagaatgttcatccacaactgtga

SEQ ID NO: 586900 - DNA, 25 bp, Mus musculus
ccagaattaaacctcacacaagtca

SEQ ID NO: 586901 - DNA, 25 bp, Mus musculus
ccagaattaaacgtcacacaagtca

SEQ ID NO: 586902 - DNA, 25 bp, Mus musculus
ccagaattattccagcgtgtaggaa

SEQ ID NO: 586903 - DNA, 25 bp, Mus musculus
ccagaattattcgagcgtgtaggaa

SEQ ID NO: 586904 - DNA, 25 bp, Mus musculus
ccagaattctatcatgaagacgtca

SEQ ID NO: 586905 - DNA, 25 bp, Mus musculus
ccagaattctatgatgaagacgtca

SEQ ID NO: 586906 - DNA, 25 bp, Mus musculus
ccagaattggctatatttatgataa

SEQ ID NO: 586907 - DNA, 25 bp, Mus musculus
ccagaattggctttatttatgataa

SEQ ID NO: 586908 - DNA, 25 bp, Mus musculus
ccagaattggtgctgatgcagctca

SEQ ID NO: 586909 - DNA, 25 bp, Mus musculus
ccagaattggtggtgatgcagctca

SEQ ID NO: 586910 - DNA, 25 bp, Mus musculus
ccagaatttaaactccttgaggacg

SEQ ID NO: 586911 - DNA, 25 bp, Mus musculus
ccagaatttaaagtccttgaggacg

SEQ ID NO: 586912 - DNA, 25 bp, Mus musculus
ccagaatttaggctacagatgccca

SEQ ID NO: 586913 - DNA, 25 bp, Mus musculus
ccagaatttagggtacagatgccca

SEQ ID NO: 586914 - DNA, 25 bp, Mus musculus
ccagacaaagccagagctgacttac

SEQ ID NO: 586915 - DNA, 25 bp, Mus musculus
ccagacaaagcctgagctgacttac

SEQ ID NO: 586916 - DNA, 25 bp, Mus musculus
ccagacaaaggcattggatccaagt

SEQ ID NO: 586917 - DNA, 25 bp, Mus musculus
ccagacaaaggctttggatccaagt

SEQ ID NO: 586918 - DNA, 25 bp, Mus musculus
ccagacaacgtccaggtggaagtca

SEQ ID NO: 586919 - DNA, 25 bp, Mus musculus
ccagacaacgtcgaggtggaagtca

SEQ ID NO: 586920 - DNA, 25 bp, Mus musculus
ccagacaagagccatgaagatcctc

SEQ ID NO: 586921 - DNA, 25 bp, Mus musculus
ccagacaagagcgatgaagatcctc

SEQ ID NO: 586922 - DNA, 25 bp, Mus musculus
ccagacacaagcaaccatcggtttt

SEQ ID NO: 586923 - DNA, 25 bp, Mus musculus
ccagacacaagctaccatcggtttt

SEQ ID NO: 586924 - DNA, 25 bp, Mus musculus
ccagacaccttgctttttgactatt

SEQ ID NO: 586925 - DNA, 25 bp, Mus musculus
ccagacaccttggtttttgactatt

SEQ ID NO: 586926 - DNA, 25 bp, Mus musculus
ccagacactcccaaaagacattttc

SEQ ID NO: 586927 - DNA, 25 bp, Mus musculus
ccagacactccctaaagacattttc

SEQ ID NO: 586928 - DNA, 25 bp, Mus musculus
ccagacagaactccggaagatcctc

SEQ ID NO: 586929 - DNA, 25 bp, Mus musculus
ccagacagaactgcggaagatcctc

SEQ ID NO: 586930 - DNA, 25 bp, Mus musculus
ccagacagaaggattgagataagca

SEQ ID NO: 586931 - DNA, 25 bp, Mus musculus
ccagacagaaggtttgagataagca

SEQ ID NO: 586932 - DNA, 25 bp, Mus musculus
ccagacagacagacccctcaatggg

SEQ ID NO: 586933 - DNA, 25 bp, Mus musculus
ccagacagacagtcccctcaatggg

SEQ ID NO: 586934 - DNA, 25 bp, Mus musculus
ccagacagcaaacctaccagaacag

SEQ ID NO: 586935 - DNA, 25 bp, Mus musculus
ccagacagcaaagctaccagaacag

SEQ ID NO: 586936 - DNA, 25 bp, Mus musculus
ccagacatcactccttgtaaaaaga

SEQ ID NO: 586937 - DNA, 25 bp, Mus musculus
ccagacatcactgcttgtaaaaaga

SEQ ID NO: 586938 - DNA, 25 bp, Mus musculus
ccagacatgggaatattcccccgtg

SEQ ID NO: 586939 - DNA, 25 bp, Mus musculus
ccagacatgggattattcccccgtg

SEQ ID NO: 586940 - DNA, 25 bp, Mus musculus
ccagacatgttacgaggccagagca

SEQ ID NO: 586941 - DNA, 25 bp, Mus musculus
ccagacatgttaggaggccagagca

SEQ ID NO: 586942 - DNA, 25 bp, Mus musculus
ccagacattgttcggctttgccttc

SEQ ID NO: 586943 - DNA, 25 bp, Mus musculus
ccagacattgttgggctttgccttc

SEQ ID NO: 586944 - DNA, 25 bp, Mus musculus
ccagaccaagaacttggaactctat

SEQ ID NO: 586945 - DNA, 25 bp, Mus musculus
ccagaccaagaagttggaactctat

SEQ ID NO: 586946 - DNA, 25 bp, Mus musculus
ccagaccagaaacacttctgagtca

SEQ ID NO: 586947 - DNA, 25 bp, Mus musculus
ccagaccagaaagacttctgagtca

SEQ ID NO: 586948 - DNA, 25 bp, Mus musculus
ccagaccagatgaccaagaagaagc

SEQ ID NO: 586949 - DNA, 25 bp, Mus musculus
ccagaccagatgtccaagaagaagc

SEQ ID NO: 586950 - DNA, 25 bp, Mus musculus
ccagaccagcgaagccggcgggcat

SEQ ID NO: 586951 - DNA, 25 bp, Mus musculus
ccagaccagcgatgccggcgggcat

SEQ ID NO: 586952 - DNA, 25 bp, Mus musculus
ccagaccagtttcatcaggtggtag

SEQ ID NO: 586953 - DNA, 25 bp, Mus musculus
ccagaccagtttgatcaggtggtag

SEQ ID NO: 586954 - DNA, 25 bp, Mus musculus
ccagaccatggtcatgcagtttatt

SEQ ID NO: 586955 - DNA, 25 bp, Mus musculus
ccagaccatggtgatgcagtttatt

SEQ ID NO: 586956 - DNA, 25 bp, Mus musculus
ccagaccatgttaaccctactcatg

SEQ ID NO: 586957 - DNA, 25 bp, Mus musculus
ccagaccatgtttaccctactcatg

SEQ ID NO: 586958 - DNA, 25 bp, Mus musculus
ccagaccctaggattgcctgttaga

SEQ ID NO: 586959 - DNA, 25 bp, Mus musculus
ccagaccctaggtttgcctgttaga

SEQ ID NO: 586960 - DNA, 25 bp, Mus musculus
ccagaccctccaatggagagtgagg

SEQ ID NO: 586961 - DNA, 25 bp, Mus musculus
ccagaccctccattggagagtgagg

SEQ ID NO: 586962 - DNA, 25 bp, Mus musculus
ccagaccctgctaatccagaatggg

SEQ ID NO: 586963 - DNA, 25 bp, Mus musculus
ccagaccctgcttatccagaatggg

SEQ ID NO: 586964 - DNA, 25 bp, Mus musculus
ccagaccctttcattcatgagccgt

SEQ ID NO: 586965 - DNA, 25 bp, Mus musculus
ccagaccctttctttcatgagccgt

SEQ ID NO: 586966 - DNA, 25 bp, Mus musculus
ccagaccggttcattgagtgctaca

SEQ ID NO: 586967 - DNA, 25 bp, Mus musculus
ccagaccggttctttgagtgctaca

SEQ ID NO: 586968 - DNA, 25 bp, Mus musculus
ccagacctcagtaggaagagtgaag

SEQ ID NO: 586969 - DNA, 25 bp, Mus musculus
ccagacctcagttggaagagtgaag

SEQ ID NO: 586970 - DNA, 25 bp, Mus musculus
ccagacctcggcattgggaaggcca

SEQ ID NO: 586971 - DNA, 25 bp, Mus musculus
ccagacctcggctttgggaaggcca

SEQ ID NO: 586972 - DNA, 25 bp, Mus musculus
ccagacgccgggactgtccagcgaa

SEQ ID NO: 586973 - DNA, 25 bp, Mus musculus
ccagacgccgggtctgtccagcgaa

SEQ ID NO: 586974 - DNA, 25 bp, Mus musculus
ccagacggtagtcgtggagtacaca

SEQ ID NO: 586975 - DNA, 25 bp, Mus musculus
ccagacggtagtggtggagtacaca

SEQ ID NO: 586976 - DNA, 25 bp, Mus musculus
ccagacggttgtcttggaccccgag

SEQ ID NO: 586977 - DNA, 25 bp, Mus musculus
ccagacggttgtgttggaccccgag

SEQ ID NO: 586978 - DNA, 25 bp, Mus musculus
ccagactacgaactttgaggagagg

SEQ ID NO: 586979 - DNA, 25 bp, Mus musculus
ccagactacgaagtttgaggagagg

SEQ ID NO: 586980 - DNA, 25 bp, Mus musculus
ccagactagcatctctcagtgggtt

SEQ ID NO: 586981 - DNA, 25 bp, Mus musculus
ccagactagcatgtctcagtgggtt

SEQ ID NO: 586982 - DNA, 25 bp, Mus musculus
ccagactatcaaccctgtggctggg

SEQ ID NO: 586983 - DNA, 25 bp, Mus musculus
ccagactatcaagcctgtggctggg

SEQ ID NO: 586984 - DNA, 25 bp, Mus musculus
ccagactcaagaagccagtgcccgg

SEQ ID NO: 586985 - DNA, 25 bp, Mus musculus
ccagactcaagatgccagtgcccgg

SEQ ID NO: 586986 - DNA, 25 bp, Mus musculus
ccagactcctcgaccactgtggagg

SEQ ID NO: 586987 - DNA, 25 bp, Mus musculus
ccagactcctcgtccactgtggagg

SEQ ID NO: 586988 - DNA, 25 bp, Mus musculus
ccagactgattcctcaggaacaaag

SEQ ID NO: 586989 - DNA, 25 bp, Mus musculus
ccagactgattcgtcaggaacaaag

SEQ ID NO: 586990 - DNA, 25 bp, Mus musculus
ccagactgcatgagctgcaccgagg

SEQ ID NO: 586991 - DNA, 25 bp, Mus musculus
ccagactgcatgtgctgcaccgagg

SEQ ID NO: 586992 - DNA, 25 bp, Mus musculus
ccagactgcctaaatcggacttcaa

SEQ ID NO: 586993 - DNA, 25 bp, Mus musculus
ccagactgcctatatcggacttcaa

SEQ ID NO: 586994 - DNA, 25 bp, Mus musculus
ccagactgggtcacgccttctttat

SEQ ID NO: 586995 - DNA, 25 bp, Mus musculus
ccagactgggtctcgccttctttat

SEQ ID NO: 586996 - DNA, 25 bp, Mus musculus
ccagacttcacacaggtgctggaag

SEQ ID NO: 586997 - DNA, 25 bp, Mus musculus
ccagacttcacagaggtgctggaag

SEQ ID NO: 586998 - DNA, 25 bp, Mus musculus
ccagacttgagacaaatgctcctaa

SEQ ID NO: 586999 - DNA, 25 bp, Mus musculus
ccagacttgagagaaatgctcctaa

SEQ ID NO: 587000 - DNA, 25 bp, Mus musculus
ccagactttgccaggtgtgacaggg

SEQ ID NO: 587001 - DNA, 25 bp, Mus musculus
ccagactttgcctggtgtgacaggg

SEQ ID NO: 587002 - DNA, 25 bp, Mus musculus
ccagagaaacctccccggagtgcaa

SEQ ID NO: 587003 - DNA, 25 bp, Mus musculus
ccagagaaacctgcccggagtgcaa

SEQ ID NO: 587004 - DNA, 25 bp, Mus musculus
ccagagaaagacctgtgtagtgtca

SEQ ID NO: 587005 - DNA, 25 bp, Mus musculus
ccagagaaagacgtgtgtagtgtca

SEQ ID NO: 587006 - DNA, 25 bp, Mus musculus
ccagagaacatcctatgtgagcacc

SEQ ID NO: 587007 - DNA, 25 bp, Mus musculus
ccagagaacatcgtatgtgagcacc

SEQ ID NO: 587008 - DNA, 25 bp, Mus musculus
ccagagaagaatcctgacgatttct

SEQ ID NO: 587009 - DNA, 25 bp, Mus musculus
ccagagaagaatgctgacgatttct

SEQ ID NO: 587010 - DNA, 25 bp, Mus musculus
ccagagaagagtccaagggaaacct

SEQ ID NO: 587011 - DNA, 25 bp, Mus musculus
ccagagaagagtgcaagggaaacct

SEQ ID NO: 587012 - DNA, 25 bp, Mus musculus
ccagagaagataatggtgagtcacc

SEQ ID NO: 587013 - DNA, 25 bp, Mus musculus
ccagagaagatattggtgagtcacc

SEQ ID NO: 587014 - DNA, 25 bp, Mus musculus
ccagagaagctgaccttggtgattg

SEQ ID NO: 587015 - DNA, 25 bp, Mus musculus
ccagagaagctgtccttggtgattg

SEQ ID NO: 587016 - DNA, 25 bp, Mus musculus
ccagagaaggctcccctggatgggc

SEQ ID NO: 587017 - DNA, 25 bp, Mus musculus
ccagagaaggctgccctggatgggc

SEQ ID NO: 587018 - DNA, 25 bp, Mus musculus
ccagagaagggcaattcgtttgtca

SEQ ID NO: 587019 - DNA, 25 bp, Mus musculus
ccagagaagggctattcgtttgtca

SEQ ID NO: 587020 - DNA, 25 bp, Mus musculus
ccagagaagtgcacagatgtaccca

SEQ ID NO: 587021 - DNA, 25 bp, Mus musculus
ccagagaagtgctcagatgtaccca

SEQ ID NO: 587022 - DNA, 25 bp, Mus musculus
ccagagaatcgccttccacagaaac

SEQ ID NO: 587023 - DNA, 25 bp, Mus musculus
ccagagaatcgcgttccacagaaac

SEQ ID NO: 587024 - DNA, 25 bp, Mus musculus
ccagagaatcttataggagctttac

SEQ ID NO: 587025 - DNA, 25 bp, Mus musculus
ccagagaatcttttaggagctttac

SEQ ID NO: 587026 - DNA, 25 bp, Mus musculus
ccagagaatgctaccaggcctgagc

SEQ ID NO: 587027 - DNA, 25 bp, Mus musculus
ccagagaatgcttccaggcctgagc

SEQ ID NO: 587028 - DNA, 25 bp, Mus musculus
ccagagacacgtcgctcagggaaac

SEQ ID NO: 587029 - DNA, 25 bp, Mus musculus
ccagagacacgtggctcagggaaac

SEQ ID NO: 587030 - DNA, 25 bp, Mus musculus
ccagagaccaaactcaagatccaag

SEQ ID NO: 587031 - DNA, 25 bp, Mus musculus
ccagagaccaaagtcaagatccaag

SEQ ID NO: 587032 - DNA, 25 bp, Mus musculus
ccagagacgactacacagaggaacg

SEQ ID NO: 587033 - DNA, 25 bp, Mus musculus
ccagagacgacttcacagaggaacg

SEQ ID NO: 587034 - DNA, 25 bp, Mus musculus
ccagagagaggacacggctaaagca

SEQ ID NO: 587035 - DNA, 25 bp, Mus musculus
ccagagagaggagacggctaaagca

SEQ ID NO: 587036 - DNA, 25 bp, Mus musculus
ccagagagatttagactccaagcgg

SEQ ID NO: 587037 - DNA, 25 bp, Mus musculus
ccagagagattttgactccaagcgg

SEQ ID NO: 587038 - DNA, 25 bp, Mus musculus
ccagagagcagtcggtccccagaac

SEQ ID NO: 587039 - DNA, 25 bp, Mus musculus
ccagagagcagtgggtccccagaac

SEQ ID NO: 587040 - DNA, 25 bp, Mus musculus
ccagagagcctacgccagggagcct

SEQ ID NO: 587041 - DNA, 25 bp, Mus musculus
ccagagagcctaggccagggagcct

SEQ ID NO: 587042 - DNA, 25 bp, Mus musculus
ccagagaggagtattaaagagacac

SEQ ID NO: 587043 - DNA, 25 bp, Mus musculus
ccagagaggagttttaaagagacac

SEQ ID NO: 587044 - DNA, 25 bp, Mus musculus
ccagagagggaaccatgggaatatt

SEQ ID NO: 587045 - DNA, 25 bp, Mus musculus
ccagagagggaagcatgggaatatt

SEQ ID NO: 587046 - DNA, 25 bp, Mus musculus
ccagagagggacatcaaagtacgcc

SEQ ID NO: 587047 - DNA, 25 bp, Mus musculus
ccagagagggacttcaaagtacgcc

SEQ ID NO: 587048 - DNA, 25 bp, Mus musculus
ccagagagggccagttgctaagtct

SEQ ID NO: 587049 - DNA, 25 bp, Mus musculus
ccagagagggcctgttgctaagtct

SEQ ID NO: 587050 - DNA, 25 bp, Mus musculus
ccagagagggctcatgccaaggacc

SEQ ID NO: 587051 - DNA, 25 bp, Mus musculus
ccagagagggctgatgccaaggacc

SEQ ID NO: 587052 - DNA, 25 bp, Mus musculus
ccagagagtagcaaggatggatctt

SEQ ID NO: 587053 - DNA, 25 bp, Mus musculus
ccagagagtagctaggatggatctt

SEQ ID NO: 587054 - DNA, 25 bp, Mus musculus
ccagagagtatcatggagtgcgcca

SEQ ID NO: 587055 - DNA, 25 bp, Mus musculus
ccagagagtatcttggagtgcgcca

SEQ ID NO: 587056 - DNA, 25 bp, Mus musculus
ccagagagtcggctctaaactcttc

SEQ ID NO: 587057 - DNA, 25 bp, Mus musculus
ccagagagtcgggtctaaactcttc

SEQ ID NO: 587058 - DNA, 25 bp, Mus musculus
ccagagagtggccttggtggccagt

SEQ ID NO: 587059 - DNA, 25 bp, Mus musculus
ccagagagtggcgttggtggccagt

SEQ ID NO: 587060 - DNA, 25 bp, Mus musculus
ccagagataaagacgggcggccgtt

SEQ ID NO: 587061 - DNA, 25 bp, Mus musculus
ccagagataaagtcgggcggccgtt

SEQ ID NO: 587062 - DNA, 25 bp, Mus musculus
ccagagataggcagccaataaaaag

SEQ ID NO: 587063 - DNA, 25 bp, Mus musculus
ccagagataggctgccaataaaaag

SEQ ID NO: 587064 - DNA, 25 bp, Mus musculus
ccagagatcattcaacgagcaagct

SEQ ID NO: 587065 - DNA, 25 bp, Mus musculus
ccagagatcattgaacgagcaagct

SEQ ID NO: 587066 - DNA, 25 bp, Mus musculus
ccagagatgaataatgagctcgcct

SEQ ID NO: 587067 - DNA, 25 bp, Mus musculus
ccagagatgaattatgagctcgcct

SEQ ID NO: 587068 - DNA, 25 bp, Mus musculus
ccagagatggccaaaagcaaggaca

SEQ ID NO: 587069 - DNA, 25 bp, Mus musculus
ccagagatggcctaaagcaaggaca

SEQ ID NO: 587070 - DNA, 25 bp, Mus musculus
ccagagatgtggaaggccgtggcct

SEQ ID NO: 587071 - DNA, 25 bp, Mus musculus
ccagagatgtggtaggccgtggcct

SEQ ID NO: 587072 - DNA, 25 bp, Mus musculus
ccagagattccaaagaagctccagg

SEQ ID NO: 587073 - DNA, 25 bp, Mus musculus
ccagagattccatagaagctccagg

SEQ ID NO: 587074 - DNA, 25 bp, Mus musculus
ccagagcaaaggcaagggaagtctc

SEQ ID NO: 587075 - DNA, 25 bp, Mus musculus
ccagagcaaagggaagggaagtctc

SEQ ID NO: 587076 - DNA, 25 bp, Mus musculus
ccagagcaagggaaaggcaggtata

SEQ ID NO: 587077 - DNA, 25 bp, Mus musculus
ccagagcaagggtaaggcaggtata

SEQ ID NO: 587078 - DNA, 25 bp, Mus musculus
ccagagcacagacgagatacgggcg

SEQ ID NO: 587079 - DNA, 25 bp, Mus musculus
ccagagcacagaggagatacgggcg

SEQ ID NO: 587080 - DNA, 25 bp, Mus musculus
ccagagcaccaacttggcgggagcc

SEQ ID NO: 587081 - DNA, 25 bp, Mus musculus
ccagagcaccaagttggcgggagcc

SEQ ID NO: 587082 - DNA, 25 bp, Mus musculus
ccagagcaccctctgagtgaacaag

SEQ ID NO: 587083 - DNA, 25 bp, Mus musculus
ccagagcaccctgtgagtgaacaag

SEQ ID NO: 587084 - DNA, 25 bp, Mus musculus
ccagagcaggaacccgtttcaagga

SEQ ID NO: 587085 - DNA, 25 bp, Mus musculus
ccagagcaggaagccgtttcaagga

SEQ ID NO: 587086 - DNA, 25 bp, Mus musculus
ccagagcaggacaccctctatgagg

SEQ ID NO: 587087 - DNA, 25 bp, Mus musculus
ccagagcaggactccctctatgagg

SEQ ID NO: 587088 - DNA, 25 bp, Mus musculus
ccagagcatgaccatcgaaaacgca

SEQ ID NO: 587089 - DNA, 25 bp, Mus musculus
ccagagcatgacgatcgaaaacgca

SEQ ID NO: 587090 - DNA, 25 bp, Mus musculus
ccagagccaggcaaaggccacaaat

SEQ ID NO: 587091 - DNA, 25 bp, Mus musculus
ccagagccaggctaaggccacaaat

SEQ ID NO: 587092 - DNA, 25 bp, Mus musculus
ccagagccatgacaggagggataaa

SEQ ID NO: 587093 - DNA, 25 bp, Mus musculus
ccagagccatgagaggagggataaa

SEQ ID NO: 587094 - DNA, 25 bp, Mus musculus
ccagagccccttctatggagataag

SEQ ID NO: 587095 - DNA, 25 bp, Mus musculus
ccagagccccttgtatggagataag

SEQ ID NO: 587096 - DNA, 25 bp, Mus musculus
ccagagccggcactaaagattcatt

SEQ ID NO: 587097 - DNA, 25 bp, Mus musculus
ccagagccggcagtaaagattcatt

SEQ ID NO: 587098 - DNA, 25 bp, Mus musculus
ccagagccgtcaacgcctggatgga

SEQ ID NO: 587099 - DNA, 25 bp, Mus musculus
ccagagccgtcatcgcctggatgga

SEQ ID NO: 587100 - DNA, 25 bp, Mus musculus
ccagagcgctgaccctgattggcaa

SEQ ID NO: 587101 - DNA, 25 bp, Mus musculus
ccagagcgctgagcctgattggcaa

SEQ ID NO: 587102 - DNA, 25 bp, Mus musculus
ccagagcgcttgagttaggttccta

SEQ ID NO: 587103 - DNA, 25 bp, Mus musculus
ccagagcgcttgtgttaggttccta

SEQ ID NO: 587104 - DNA, 25 bp, Mus musculus
ccagagcggccacgagtttgctgtc

SEQ ID NO: 587105 - DNA, 25 bp, Mus musculus
ccagagcggccaggagtttgctgtc

SEQ ID NO: 587106 - DNA, 25 bp, Mus musculus
ccagagcgtcatacgcgtggataag

SEQ ID NO: 587107 - DNA, 25 bp, Mus musculus
ccagagcgtcattcgcgtggataag

SEQ ID NO: 587108 - DNA, 25 bp, Mus musculus
ccagagctaaggaaattgaagtgaa

SEQ ID NO: 587109 - DNA, 25 bp, Mus musculus
ccagagctaaggtaattgaagtgaa

SEQ ID NO: 587110 - DNA, 25 bp, Mus musculus
ccagagctccggctaaggcttgccg

SEQ ID NO: 587111 - DNA, 25 bp, Mus musculus
ccagagctccgggtaaggcttgccg

SEQ ID NO: 587112 - DNA, 25 bp, Mus musculus
ccagagctcctgctatgcattagat

SEQ ID NO: 587113 - DNA, 25 bp, Mus musculus
ccagagctcctggtatgcattagat

SEQ ID NO: 587114 - DNA, 25 bp, Mus musculus
ccagagctgggtcggcagtcatact

SEQ ID NO: 587115 - DNA, 25 bp, Mus musculus
ccagagctgggtgggcagtcatact

SEQ ID NO: 587116 - DNA, 25 bp, Mus musculus
ccagagcttagtcctggaaaacttc

SEQ ID NO: 587117 - DNA, 25 bp, Mus musculus
ccagagcttagtgctggaaaacttc

SEQ ID NO: 587118 - DNA, 25 bp, Mus musculus
ccagaggaaatgcactggtctgagc

SEQ ID NO: 587119 - DNA, 25 bp, Mus musculus
ccagaggaaatggactggtctgagc

SEQ ID NO: 587120 - DNA, 25 bp, Mus musculus
ccagaggaacaaactgctcttcatt

SEQ ID NO: 587121 - DNA, 25 bp, Mus musculus
ccagaggaacaatctgctcttcatt

SEQ ID NO: 587122 - DNA, 25 bp, Mus musculus
ccagaggaacatcacggagaggact

SEQ ID NO: 587123 - DNA, 25 bp, Mus musculus
ccagaggaacatgacggagaggact

SEQ ID NO: 587124 - DNA, 25 bp, Mus musculus
ccagaggaatacctgcccactgtgt

SEQ ID NO: 587125 - DNA, 25 bp, Mus musculus
ccagaggaatacgtgcccactgtgt

SEQ ID NO: 587126 - DNA, 25 bp, Mus musculus
ccagaggaccagaggttaatttatt

SEQ ID NO: 587127 - DNA, 25 bp, Mus musculus
ccagaggaccagtggttaatttatt

SEQ ID NO: 587128 - DNA, 25 bp, Mus musculus
ccagaggactatccaacctcctagg

SEQ ID NO: 587129 - DNA, 25 bp, Mus musculus
ccagaggactatgcaacctcctagg

SEQ ID NO: 587130 - DNA, 25 bp, Mus musculus
ccagaggagagtcctcatgtgtcca

SEQ ID NO: 587131 - DNA, 25 bp, Mus musculus
ccagaggagagtgctcatgtgtcca

SEQ ID NO: 587132 - DNA, 25 bp, Mus musculus
ccagaggagcttatacagggatgtc

SEQ ID NO: 587133 - DNA, 25 bp, Mus musculus
ccagaggagcttttacagggatgtc

SEQ ID NO: 587134 - DNA, 25 bp, Mus musculus
ccagaggaggtacctgccgaagtct

SEQ ID NO: 587135 - DNA, 25 bp, Mus musculus
ccagaggaggtagctgccgaagtct

SEQ ID NO: 587136 - DNA, 25 bp, Mus musculus
ccagaggatcatcggtctacgggca

SEQ ID NO: 587137 - DNA, 25 bp, Mus musculus
ccagaggatcatgggtctacgggca

SEQ ID NO: 587138 - DNA, 25 bp, Mus musculus
ccagaggatgagcaaataaagggca

SEQ ID NO: 587139 - DNA, 25 bp, Mus musculus
ccagaggatgaggaaataaagggca

SEQ ID NO: 587140 - DNA, 25 bp, Mus musculus
ccagaggcagagctcaacgtccact

SEQ ID NO: 587141 - DNA, 25 bp, Mus musculus
ccagaggcagaggtcaacgtccact

SEQ ID NO: 587142 - DNA, 25 bp, Mus musculus
ccagaggccacgatgagacaaaggg

SEQ ID NO: 587143 - DNA, 25 bp, Mus musculus
ccagaggccacgttgagacaaaggg

SEQ ID NO: 587144 - DNA, 25 bp, Mus musculus
ccagaggcccttattgaccgagtct

SEQ ID NO: 587145 - DNA, 25 bp, Mus musculus
ccagaggccctttttgaccgagtct

SEQ ID NO: 587146 - DNA, 25 bp, Mus musculus
ccagaggctcagcatttggaaagca

SEQ ID NO: 587147 - DNA, 25 bp, Mus musculus
ccagaggctcaggatttggaaagca

SEQ ID NO: 587148 - DNA, 25 bp, Mus musculus
ccagaggctccccatggcgagatta

SEQ ID NO: 587149 - DNA, 25 bp, Mus musculus
ccagaggctcccgatggcgagatta

SEQ ID NO: 587150 - DNA, 25 bp, Mus musculus
ccagaggctgccaaagtcgcttcca

SEQ ID NO: 587151 - DNA, 25 bp, Mus musculus
ccagaggctgcctaagtcgcttcca

SEQ ID NO: 587152 - DNA, 25 bp, Mus musculus
ccagagggagtaacagggacagtac

SEQ ID NO: 587153 - DNA, 25 bp, Mus musculus
ccagagggagtatcagggacagtac

SEQ ID NO: 587154 - DNA, 25 bp, Mus musculus
ccagagggatgcattcggcaggact

SEQ ID NO: 587155 - DNA, 25 bp, Mus musculus
ccagagggatgctttcggcaggact

SEQ ID NO: 587156 - DNA, 25 bp, Mus musculus
ccagagggtttgacactgctgttgc

SEQ ID NO: 587157 - DNA, 25 bp, Mus musculus
ccagagggtttgtcactgctgttgc

SEQ ID NO: 587158 - DNA, 25 bp, Mus musculus
ccagaggtacaacgaagtgatggct

SEQ ID NO: 587159 - DNA, 25 bp, Mus musculus
ccagaggtacaaggaagtgatggct

SEQ ID NO: 587160 - DNA, 25 bp, Mus musculus
ccagaggtaccacgcgctgaagatc

SEQ ID NO: 587161 - DNA, 25 bp, Mus musculus
ccagaggtaccaggcgctgaagatc

SEQ ID NO: 587162 - DNA, 25 bp, Mus musculus
ccagaggtagtgacatttggttact

SEQ ID NO: 587163 - DNA, 25 bp, Mus musculus
ccagaggtagtgtcatttggttact

SEQ ID NO: 587164 - DNA, 25 bp, Mus musculus
ccagaggtgaagcacttttgtccca

SEQ ID NO: 587165 - DNA, 25 bp, Mus musculus
ccagaggtgaaggacttttgtccca

SEQ ID NO: 587166 - DNA, 25 bp, Mus musculus
ccagaggtgaggcttctcacagcaa

SEQ ID NO: 587167 - DNA, 25 bp, Mus musculus
ccagaggtgagggttctcacagcaa

SEQ ID NO: 587168 - DNA, 25 bp, Mus musculus
ccagaggtgctgattggagttagct

SEQ ID NO: 587169 - DNA, 25 bp, Mus musculus
ccagaggtgctgtttggagttagct

SEQ ID NO: 587170 - DNA, 25 bp, Mus musculus
ccagaggtgggcaaaaggctgtcca

SEQ ID NO: 587171 - DNA, 25 bp, Mus musculus
ccagaggtgggcagcgttcaaaagt

SEQ ID NO: 587172 - DNA, 25 bp, Mus musculus
ccagaggtgggctaaaggctgtcca

SEQ ID NO: 587173 - DNA, 25 bp, Mus musculus
ccagaggtgggctgcgttcaaaagt

SEQ ID NO: 587174 - DNA, 25 bp, Mus musculus
ccagaggtgttcatgcagacgggtt

SEQ ID NO: 587175 - DNA, 25 bp, Mus musculus
ccagaggtgttcttgcagacgggtt

SEQ ID NO: 587176 - DNA, 25 bp, Mus musculus
ccagaggtttgcagtttgagagttc

SEQ ID NO: 587177 - DNA, 25 bp, Mus musculus
ccagaggtttgctgtttgagagttc

SEQ ID NO: 587178 - DNA, 25 bp, Mus musculus
ccagagtaaaggaggaatcctgtcc

SEQ ID NO: 587179 - DNA, 25 bp, Mus musculus
ccagagtaaaggtggaatcctgtcc

SEQ ID NO: 587180 - DNA, 25 bp, Mus musculus
ccagagtaacagatgtggcttgact

SEQ ID NO: 587181 - DNA, 25 bp, Mus musculus
ccagagtaacagttgtggcttgact

SEQ ID NO: 587182 - DNA, 25 bp, Mus musculus
ccagagtaagttctgatgacttctc

SEQ ID NO: 587183 - DNA, 25 bp, Mus musculus
ccagagtaagttgtgatgacttctc

SEQ ID NO: 587184 - DNA, 25 bp, Mus musculus
ccagagtacaatccctgtggaaagt

SEQ ID NO: 587185 - DNA, 25 bp, Mus musculus
ccagagtacaatgcctgtggaaagt

SEQ ID NO: 587186 - DNA, 25 bp, Mus musculus
ccagagtatattcagagtttatcgc

SEQ ID NO: 587187 - DNA, 25 bp, Mus musculus
ccagagtatattgagagtttatcgc

SEQ ID NO: 587188 - DNA, 25 bp, Mus musculus
ccagagtattcaccggatttttacg

SEQ ID NO: 587189 - DNA, 25 bp, Mus musculus
ccagagtattcagcggatttttacg

SEQ ID NO: 587190 - DNA, 25 bp, Mus musculus
ccagagtccagactgcctgagactg

SEQ ID NO: 587191 - DNA, 25 bp, Mus musculus
ccagagtccagagtgcctgagactg

SEQ ID NO: 587192 - DNA, 25 bp, Mus musculus
ccagagtccatacgctggctggttc

SEQ ID NO: 587193 - DNA, 25 bp, Mus musculus
ccagagtccataggctggctggttc

SEQ ID NO: 587194 - DNA, 25 bp, Mus musculus
ccagagtgaaaactcggttgtgaag

SEQ ID NO: 587195 - DNA, 25 bp, Mus musculus
ccagagtgaaaagtcggttgtgaag

SEQ ID NO: 587196 - DNA, 25 bp, Mus musculus
ccagagtgatggagttcaagctagc

SEQ ID NO: 587197 - DNA, 25 bp, Mus musculus
ccagagtgatggtgttcaagctagc

SEQ ID NO: 587198 - DNA, 25 bp, Mus musculus
ccagagtgccaaaggtgggatcagc

SEQ ID NO: 587199 - DNA, 25 bp, Mus musculus
ccagagtgccaatggtgggatcagc

SEQ ID NO: 587200 - DNA, 25 bp, Mus musculus
ccagagtgggacaacatcgtttgct

SEQ ID NO: 587201 - DNA, 25 bp, Mus musculus
ccagagtgggactacatcgtttgct

SEQ ID NO: 587202 - DNA, 25 bp, Mus musculus
ccagagtgggcaaacctctgtggga

SEQ ID NO: 587203 - DNA, 25 bp, Mus musculus
ccagagtgggcatacctctgtggga

SEQ ID NO: 587204 - DNA, 25 bp, Mus musculus
ccagagtggtctaggatacaccaaa

SEQ ID NO: 587205 - DNA, 25 bp, Mus musculus
ccagagtggtcttggatacaccaaa

SEQ ID NO: 587206 - DNA, 25 bp, Mus musculus
ccagagtgtaaaatcttggaaggca

SEQ ID NO: 587207 - DNA, 25 bp, Mus musculus
ccagagtgtaaattcttggaaggca

SEQ ID NO: 587208 - DNA, 25 bp, Mus musculus
ccagagtgtgatcgagaggttttat

SEQ ID NO: 587209 - DNA, 25 bp, Mus musculus
ccagagtgtgatggagaggttttat

SEQ ID NO: 587210 - DNA, 25 bp, Mus musculus
ccagagttcagcaactgcacaagat

SEQ ID NO: 587211 - DNA, 25 bp, Mus musculus
ccagagttcagctactgcacaagat

SEQ ID NO: 587212 - DNA, 25 bp, Mus musculus
ccagagttcattccgtgctcccatg

SEQ ID NO: 587213 - DNA, 25 bp, Mus musculus
ccagagttcattgcgtgctcccatg

SEQ ID NO: 587214 - DNA, 25 bp, Mus musculus
ccagagttccctctgtggcagctgt

SEQ ID NO: 587215 - DNA, 25 bp, Mus musculus
ccagagttccctgtgtggcagctgt

SEQ ID NO: 587216 - DNA, 25 bp, Mus musculus
ccagagttgcttaggatatgaccac

SEQ ID NO: 587217 - DNA, 25 bp, Mus musculus
ccagagttgctttggatatgaccac

SEQ ID NO: 587218 - DNA, 25 bp, Mus musculus
ccagagttggcgaaaagagcgtttc

SEQ ID NO: 587219 - DNA, 25 bp, Mus musculus
ccagagttggcgtaaagagcgtttc

SEQ ID NO: 587220 - DNA, 25 bp, Mus musculus
ccagagtttcttcaaggatagtcat

SEQ ID NO: 587221 - DNA, 25 bp, Mus musculus
ccagagtttcttgaaggatagtcat

SEQ ID NO: 587222 - DNA, 25 bp, Mus musculus
ccagagtttgccatgccagcatcag

SEQ ID NO: 587223 - DNA, 25 bp, Mus musculus
ccagagtttgccttgccagcatcag

SEQ ID NO: 587224 - DNA, 25 bp, Mus musculus
ccagagttttccagtgcttcaatct

SEQ ID NO: 587225 - DNA, 25 bp, Mus musculus
ccagagttttcctgtgcttcaatct

SEQ ID NO: 587226 - DNA, 25 bp, Mus musculus
ccagataattcacgccaagaagaga

SEQ ID NO: 587227 - DNA, 25 bp, Mus musculus
ccagataattcaggccaagaagaga

SEQ ID NO: 587228 - DNA, 25 bp, Mus musculus
ccagatacaaagattggtagcttca

SEQ ID NO: 587229 - DNA, 25 bp, Mus musculus
ccagatacaaagtttggtagcttca

SEQ ID NO: 587230 - DNA, 25 bp, Mus musculus
ccagatactgtgcagcctgatgcca

SEQ ID NO: 587231 - DNA, 25 bp, Mus musculus
ccagatactgtggagcctgatgcca

SEQ ID NO: 587232 - DNA, 25 bp, Mus musculus
ccagatacttcacgcatctatgtgg

SEQ ID NO: 587233 - DNA, 25 bp, Mus musculus
ccagatacttcaggcatctatgtgg

SEQ ID NO: 587234 - DNA, 25 bp, Mus musculus
ccagatacttctcggaatggttgaa

SEQ ID NO: 587235 - DNA, 25 bp, Mus musculus
ccagatacttctgggaatggttgaa

SEQ ID NO: 587236 - DNA, 25 bp, Mus musculus
ccagatagacatcctggacaccgct

SEQ ID NO: 587237 - DNA, 25 bp, Mus musculus
ccagatagacatgctggacaccgct

SEQ ID NO: 587238 - DNA, 25 bp, Mus musculus
ccagatagggctagcaatatgaacc

SEQ ID NO: 587239 - DNA, 25 bp, Mus musculus
ccagatagggcttgcaatatgaacc

SEQ ID NO: 587240 - DNA, 25 bp, Mus musculus
ccagatatatatcggtggccagtag

SEQ ID NO: 587241 - DNA, 25 bp, Mus musculus
ccagatatatatgggtggccagtag

SEQ ID NO: 587242 - DNA, 25 bp, Mus musculus
ccagatatgtacctccaagaaaagc

SEQ ID NO: 587243 - DNA, 25 bp, Mus musculus
ccagatatgtacgtccaagaaaagc

SEQ ID NO: 587244 - DNA, 25 bp, Mus musculus
ccagatcaacgccagcaagaacgag

SEQ ID NO: 587245 - DNA, 25 bp, Mus musculus
ccagatcaacgcgagcaagaacgag

SEQ ID NO: 587246 - DNA, 25 bp, Mus musculus
ccagatcaccacatctgttgcactg

SEQ ID NO: 587247 - DNA, 25 bp, Mus musculus
ccagatcaccacttctgttgcactg

SEQ ID NO: 587248 - DNA, 25 bp, Mus musculus
ccagatcagctgaaactctactcgg

SEQ ID NO: 587249 - DNA, 25 bp, Mus musculus
ccagatcagctgtaactctactcgg

SEQ ID NO: 587250 - DNA, 25 bp, Mus musculus
ccagatcatcaactccaagtgggag

SEQ ID NO: 587251 - DNA, 25 bp, Mus musculus
ccagatcatcaagtccaagtgggag

SEQ ID NO: 587252 - DNA, 25 bp, Mus musculus
ccagatcatctccaaaaatttgcac

SEQ ID NO: 587253 - DNA, 25 bp, Mus musculus
ccagatcatctcgaaaaatttgcac

SEQ ID NO: 587254 - DNA, 25 bp, Mus musculus
ccagatcccacgctgcactgaagaa

SEQ ID NO: 587255 - DNA, 25 bp, Mus musculus
ccagatcccacggtgcactgaagaa

SEQ ID NO: 587256 - DNA, 25 bp, Mus musculus
ccagatcctggcagattaccttaca

SEQ ID NO: 587257 - DNA, 25 bp, Mus musculus
ccagatcctggctgattaccttaca

SEQ ID NO: 587258 - DNA, 25 bp, Mus musculus
ccagatcctggtcttgtattcattg

SEQ ID NO: 587259 - DNA, 25 bp, Mus musculus
ccagatcctggtgttgtattcattg

SEQ ID NO: 587260 - DNA, 25 bp, Mus musculus
ccagatcgaaggcaagaggtaacac

SEQ ID NO: 587261 - DNA, 25 bp, Mus musculus
ccagatcgaagggaagaggtaacac

SEQ ID NO: 587262 - DNA, 25 bp, Mus musculus
ccagatctacgaccctcaggatgtg

SEQ ID NO: 587263 - DNA, 25 bp, Mus musculus
ccagatctacgagcctcaggatgtg

SEQ ID NO: 587264 - DNA, 25 bp, Mus musculus
ccagatctgccacttgttttaataa

SEQ ID NO: 587265 - DNA, 25 bp, Mus musculus
ccagatctgccagttgttttaataa

SEQ ID NO: 587266 - DNA, 25 bp, Mus musculus
ccagatctgggaagctctagagaga

SEQ ID NO: 587267 - DNA, 25 bp, Mus musculus
ccagatctgggaccaggagaataca

SEQ ID NO: 587268 - DNA, 25 bp, Mus musculus
ccagatctgggagcaggagaataca

SEQ ID NO: 587269 - DNA, 25 bp, Mus musculus
ccagatctgggatgctctagagaga

SEQ ID NO: 587270 - DNA, 25 bp, Mus musculus
ccagatctgtgcagttattctggag

SEQ ID NO: 587271 - DNA, 25 bp, Mus musculus
ccagatctgtgctgttattctggag

SEQ ID NO: 587272 - DNA, 25 bp, Mus musculus
ccagatcttcagcttcatcaaggtc

SEQ ID NO: 587273 - DNA, 25 bp, Mus musculus
ccagatcttcaggttcatcaaggtc

SEQ ID NO: 587274 - DNA, 25 bp, Mus musculus
ccagatcttcctcagtttgggccct

SEQ ID NO: 587275 - DNA, 25 bp, Mus musculus
ccagatcttcctgagtttgggccct

SEQ ID NO: 587276 - DNA, 25 bp, Mus musculus
ccagatgaaagacccagactgagcc

SEQ ID NO: 587277 - DNA, 25 bp, Mus musculus
ccagatgaaagagccagactgagcc

SEQ ID NO: 587278 - DNA, 25 bp, Mus musculus
ccagatgaaatccaaaggccacctg

SEQ ID NO: 587279 - DNA, 25 bp, Mus musculus
ccagatgaaatcgaaaggccacctg

SEQ ID NO: 587280 - DNA, 25 bp, Mus musculus
ccagatgaagaacgtcagtctgggc

SEQ ID NO: 587281 - DNA, 25 bp, Mus musculus
ccagatgaagaaggtcagtctgggc

SEQ ID NO: 587282 - DNA, 25 bp, Mus musculus
ccagatgaattacagactgctgttg

SEQ ID NO: 587283 - DNA, 25 bp, Mus musculus
ccagatgaattagagactgctgttg

SEQ ID NO: 587284 - DNA, 25 bp, Mus musculus
ccagatgatgaacttcaacaagttc

SEQ ID NO: 587285 - DNA, 25 bp, Mus musculus
ccagatgatgaagttcaacaagttc

SEQ ID NO: 587286 - DNA, 25 bp, Mus musculus
ccagatgcagaccttctggaaggat

SEQ ID NO: 587287 - DNA, 25 bp, Mus musculus
ccagatgcagacgttctggaaggat

SEQ ID NO: 587288 - DNA, 25 bp, Mus musculus
ccagatgcccacaattgagagagta

SEQ ID NO: 587289 - DNA, 25 bp, Mus musculus
ccagatgcccactattgagagagta

SEQ ID NO: 587290 - DNA, 25 bp, Mus musculus
ccagatgctcaacgatggagccaaa

SEQ ID NO: 587291 - DNA, 25 bp, Mus musculus
ccagatgctcaaggatggagccaaa

SEQ ID NO: 587292 - DNA, 25 bp, Mus musculus
ccagatgctgcgagacatttgctcc

SEQ ID NO: 587293 - DNA, 25 bp, Mus musculus
ccagatgctgcgtgacatttgctcc

SEQ ID NO: 587294 - DNA, 25 bp, Mus musculus
ccagatgctgttagttgctatcaga

SEQ ID NO: 587295 - DNA, 25 bp, Mus musculus
ccagatgctgtttgttgctatcaga

SEQ ID NO: 587296 - DNA, 25 bp, Mus musculus
ccagatgcttatcgcccagtgggtc

SEQ ID NO: 587297 - DNA, 25 bp, Mus musculus
ccagatgcttatggcccagtgggtc

SEQ ID NO: 587298 - DNA, 25 bp, Mus musculus
ccagatggcacacttaaatataaga

SEQ ID NO: 587299 - DNA, 25 bp, Mus musculus
ccagatggcacagttaaatataaga

SEQ ID NO: 587300 - DNA, 25 bp, Mus musculus
ccagatggcagtatggtgggaaacc

SEQ ID NO: 587301 - DNA, 25 bp, Mus musculus
ccagatggcagtttggtgggaaacc

SEQ ID NO: 587302 - DNA, 25 bp, Mus musculus
ccagatggcatcatggcagcctacc

SEQ ID NO: 587303 - DNA, 25 bp, Mus musculus
ccagatggcatcttggcagcctacc

SEQ ID NO: 587304 - DNA, 25 bp, Mus musculus
ccagatgggtccagcttcaacatga

SEQ ID NO: 587305 - DNA, 25 bp, Mus musculus
ccagatgggtcctgcttcaacatga

SEQ ID NO: 587306 - DNA, 25 bp, Mus musculus
ccagatggtagcacccggcgtccag

SEQ ID NO: 587307 - DNA, 25 bp, Mus musculus
ccagatggtagctcccggcgtccag

SEQ ID NO: 587308 - DNA, 25 bp, Mus musculus
ccagatgtcactccattggaagagt

SEQ ID NO: 587309 - DNA, 25 bp, Mus musculus
ccagatgtcactgcattggaagagt

SEQ ID NO: 587310 - DNA, 25 bp, Mus musculus
ccagatgtccaacaagaagccatag

SEQ ID NO: 587311 - DNA, 25 bp, Mus musculus
ccagatgtccaagaagaagccatag

SEQ ID NO: 587312 - DNA, 25 bp, Mus musculus
ccagatgtccacactccaagcttta

SEQ ID NO: 587313 - DNA, 25 bp, Mus musculus
ccagatgtccactctccaagcttta

SEQ ID NO: 587314 - DNA, 25 bp, Mus musculus
ccagatgtgaatcttttccagagga

SEQ ID NO: 587315 - DNA, 25 bp, Mus musculus
ccagatgtgaatgttttccagagga

SEQ ID NO: 587316 - DNA, 25 bp, Mus musculus
ccagatgtgagcctctcattttcaa

SEQ ID NO: 587317 - DNA, 25 bp, Mus musculus
ccagatgtgagcgtctcattttcaa

SEQ ID NO: 587318 - DNA, 25 bp, Mus musculus
ccagatgtgtaaagacaaagagcgg

SEQ ID NO: 587319 - DNA, 25 bp, Mus musculus
ccagatgtgtaatgacaaagagcgg

SEQ ID NO: 587320 - DNA, 25 bp, Mus musculus
ccagatgtgtctcctaaggactttg

SEQ ID NO: 587321 - DNA, 25 bp, Mus musculus
ccagatgtgtctgctaaggactttg

SEQ ID NO: 587322 - DNA, 25 bp, Mus musculus
ccagattaaaccaagtaggagtcag

SEQ ID NO: 587323 - DNA, 25 bp, Mus musculus
ccagattaaacctagtaggagtcag

SEQ ID NO: 587324 - DNA, 25 bp, Mus musculus
ccagattccgagagcgtattcatta

SEQ ID NO: 587325 - DNA, 25 bp, Mus musculus
ccagattccgagtgcgtattcatta

SEQ ID NO: 587326 - DNA, 25 bp, Mus musculus
ccagattcctgcagaagcgtggctt

SEQ ID NO: 587327 - DNA, 25 bp, Mus musculus
ccagattcctgctgaagcgtggctt

SEQ ID NO: 587328 - DNA, 25 bp, Mus musculus
ccagattctagaacttagagaaaac

SEQ ID NO: 587329 - DNA, 25 bp, Mus musculus
ccagattctagatcttagagaaaac

SEQ ID NO: 587330 - DNA, 25 bp, Mus musculus
ccagattgaccccaacacaaagaag

SEQ ID NO: 587331 - DNA, 25 bp, Mus musculus
ccagattgacccgaacacaaagaag

SEQ ID NO: 587332 - DNA, 25 bp, Mus musculus
ccagattggaccatgtaaaaactgc

SEQ ID NO: 587333 - DNA, 25 bp, Mus musculus
ccagattggaccttgtaaaaactgc

SEQ ID NO: 587334 - DNA, 25 bp, Mus musculus
ccagattgtcttctggacggaggac

SEQ ID NO: 587335 - DNA, 25 bp, Mus musculus
ccagattgtcttgtggacggaggac

SEQ ID NO: 587336 - DNA, 25 bp, Mus musculus
ccagattgtgttctggactttcctg

SEQ ID NO: 587337 - DNA, 25 bp, Mus musculus
ccagattgtgttgtggactttcctg

SEQ ID NO: 587338 - DNA, 25 bp, Mus musculus
ccagatttcacactccatccagatg

SEQ ID NO: 587339 - DNA, 25 bp, Mus musculus
ccagatttcacagtccatccagatg

SEQ ID NO: 587340 - DNA, 25 bp, Mus musculus
ccagatttctttcccttggcccttg

SEQ ID NO: 587341 - DNA, 25 bp, Mus musculus
ccagatttctttgccttggcccttg

SEQ ID NO: 587342 - DNA, 25 bp, Mus musculus
ccagatttgatacacgaagctctcc

SEQ ID NO: 587343 - DNA, 25 bp, Mus musculus
ccagatttgatagacgaagctctcc

SEQ ID NO: 587344 - DNA, 25 bp, Mus musculus
ccagattttaagacggcaggtgtca

SEQ ID NO: 587345 - DNA, 25 bp, Mus musculus
ccagattttaagtcggcaggtgtca

SEQ ID NO: 587346 - DNA, 25 bp, Mus musculus
ccagcaaaagtaaggagtctatttg

SEQ ID NO: 587347 - DNA, 25 bp, Mus musculus
ccagcaaaagtatggagtctatttg

SEQ ID NO: 587348 - DNA, 25 bp, Mus musculus
ccagcaaagatgcaccaaaaggaat

SEQ ID NO: 587349 - DNA, 25 bp, Mus musculus
ccagcaaagatggaccaaaaggaat

SEQ ID NO: 587350 - DNA, 25 bp, Mus musculus
ccagcaaagcggagtgctctgcaga

SEQ ID NO: 587351 - DNA, 25 bp, Mus musculus
ccagcaaagcggtgtgctctgcaga

SEQ ID NO: 587352 - DNA, 25 bp, Mus musculus
ccagcaaagggccacctgagcaagt

SEQ ID NO: 587353 - DNA, 25 bp, Mus musculus
ccagcaaagggcgacctgagcaagt

SEQ ID NO: 587354 - DNA, 25 bp, Mus musculus
ccagcaaagtcaacatttccgtgaa

SEQ ID NO: 587355 - DNA, 25 bp, Mus musculus
ccagcaaagtcatcatttccgtgaa

SEQ ID NO: 587356 - DNA, 25 bp, Mus musculus
ccagcaaagtttcgagtaggcaacg

SEQ ID NO: 587357 - DNA, 25 bp, Mus musculus
ccagcaaagtttggagtaggcaacg

SEQ ID NO: 587358 - DNA, 25 bp, Mus musculus
ccagcaacctagctgtgaacgaaga

SEQ ID NO: 587359 - DNA, 25 bp, Mus musculus
ccagcaacctaggtgtgaacgaaga

SEQ ID NO: 587360 - DNA, 25 bp, Mus musculus
ccagcaacgtggattctctcttcta

SEQ ID NO: 587361 - DNA, 25 bp, Mus musculus
ccagcaacgtggtttctctcttcta

SEQ ID NO: 587362 - DNA, 25 bp, Mus musculus
ccagcaactcagacagggccgggat

SEQ ID NO: 587363 - DNA, 25 bp, Mus musculus
ccagcaactcagagagcagatagaa

SEQ ID NO: 587364 - DNA, 25 bp, Mus musculus
ccagcaactcagtcagggccgggat

SEQ ID NO: 587365 - DNA, 25 bp, Mus musculus
ccagcaactcagtgagcagatagaa

SEQ ID NO: 587366 - DNA, 25 bp, Mus musculus
ccagcaactccaagctatatcggag

SEQ ID NO: 587367 - DNA, 25 bp, Mus musculus
ccagcaactccatgctatatcggag

SEQ ID NO: 587368 - DNA, 25 bp, Mus musculus
ccagcaagaagaagcggagagagcc

SEQ ID NO: 587369 - DNA, 25 bp, Mus musculus
ccagcaagaagatgcggagagagcc

SEQ ID NO: 587370 - DNA, 25 bp, Mus musculus
ccagcaagacctatggcaccttcag

SEQ ID NO: 587371 - DNA, 25 bp, Mus musculus
ccagcaagacctttggcaccttcag

SEQ ID NO: 587372 - DNA, 25 bp, Mus musculus
ccagcaagcagcatcacaagctcag

SEQ ID NO: 587373 - DNA, 25 bp, Mus musculus
ccagcaagcagcttcacaagctcag

SEQ ID NO: 587374 - DNA, 25 bp, Mus musculus
ccagcaagcatgcagttactgtatc

SEQ ID NO: 587375 - DNA, 25 bp, Mus musculus
ccagcaagcatggagttactgtatc

SEQ ID NO: 587376 - DNA, 25 bp, Mus musculus
ccagcaagctctcgacctggaagtc

SEQ ID NO: 587377 - DNA, 25 bp, Mus musculus
ccagcaagctctggacctggaagtc

SEQ ID NO: 587378 - DNA, 25 bp, Mus musculus
ccagcaaggtggacacagtattcag

SEQ ID NO: 587379 - DNA, 25 bp, Mus musculus
ccagcaaggtggtcacagtattcag

SEQ ID NO: 587380 - DNA, 25 bp, Mus musculus
ccagcaagtctcaggaaatggtgca

SEQ ID NO: 587381 - DNA, 25 bp, Mus musculus
ccagcaagtctctggaaatggtgca

SEQ ID NO: 587382 - DNA, 25 bp, Mus musculus
ccagcaagtgtgcatcaacacagtg

SEQ ID NO: 587383 - DNA, 25 bp, Mus musculus
ccagcaagtgtggatcaacacagtg

SEQ ID NO: 587384 - DNA, 25 bp, Mus musculus
ccagcaatcaaccagaggcagccag

SEQ ID NO: 587385 - DNA, 25 bp, Mus musculus
ccagcaatcaacgagaggcagccag

SEQ ID NO: 587386 - DNA, 25 bp, Mus musculus
ccagcaatgatacatgtttagaaag

SEQ ID NO: 587387 - DNA, 25 bp, Mus musculus
ccagcaatgatagatgtttagaaag

SEQ ID NO: 587388 - DNA, 25 bp, Mus musculus
ccagcaatgggcctacagagcaaaa

SEQ ID NO: 587389 - DNA, 25 bp, Mus musculus
ccagcaatgggcgtacagagcaaaa

SEQ ID NO: 587390 - DNA, 25 bp, Mus musculus
ccagcaattacgaggctccagttga

SEQ ID NO: 587391 - DNA, 25 bp, Mus musculus
ccagcaattacgtggctccagttga

SEQ ID NO: 587392 - DNA, 25 bp, Mus musculus
ccagcacacagaccagcttgtgcag

SEQ ID NO: 587393 - DNA, 25 bp, Mus musculus
ccagcacacagagcagcttgtgcag

SEQ ID NO: 587394 - DNA, 25 bp, Mus musculus
ccagcacacctgaataccagacaat

SEQ ID NO: 587395 - DNA, 25 bp, Mus musculus
ccagcacacctgtataccagacaat

SEQ ID NO: 587396 - DNA, 25 bp, Mus musculus
ccagcacacggacgatgatgctgac

SEQ ID NO: 587397 - DNA, 25 bp, Mus musculus
ccagcacacggaggatgatgctgac

SEQ ID NO: 587398 - DNA, 25 bp, Mus musculus
ccagcacagataacttgggcactaa

SEQ ID NO: 587399 - DNA, 25 bp, Mus musculus
ccagcacagatatcttgggcactaa

SEQ ID NO: 587400 - DNA, 25 bp, Mus musculus
ccagcacatcaaccaggtttgcatg

SEQ ID NO: 587401 - DNA, 25 bp, Mus musculus
ccagcacatcaagcaggtttgcatg

SEQ ID NO: 587402 - DNA, 25 bp, Mus musculus
ccagcaccaaagaagaagtagacat

SEQ ID NO: 587403 - DNA, 25 bp, Mus musculus
ccagcaccaaagtagaagtagacat

SEQ ID NO: 587404 - DNA, 25 bp, Mus musculus
ccagcacctgttaagaccatgacca

SEQ ID NO: 587405 - DNA, 25 bp, Mus musculus
ccagcacctgtttagaccatgacca

SEQ ID NO: 587406 - DNA, 25 bp, Mus musculus
ccagcacgaagacttcatcaggcta

SEQ ID NO: 587407 - DNA, 25 bp, Mus musculus
ccagcacgaagagttcatcaggcta

SEQ ID NO: 587408 - DNA, 25 bp, Mus musculus
ccagcacgcctgaggaccttgagca

SEQ ID NO: 587409 - DNA, 25 bp, Mus musculus
ccagcacgcctgtggaccttgagca

SEQ ID NO: 587410 - DNA, 25 bp, Mus musculus
ccagcacggactactacaaaagagg

SEQ ID NO: 587411 - DNA, 25 bp, Mus musculus
ccagcacggacttctacaaaagagg

SEQ ID NO: 587412 - DNA, 25 bp, Mus musculus
ccagcacgggaacccatatttctac

SEQ ID NO: 587413 - DNA, 25 bp, Mus musculus
ccagcacgggaagccatatttctac

SEQ ID NO: 587414 - DNA, 25 bp, Mus musculus
ccagcactagctcgagaggtctcct

SEQ ID NO: 587415 - DNA, 25 bp, Mus musculus
ccagcactagctggagaggtctcct

SEQ ID NO: 587416 - DNA, 25 bp, Mus musculus
ccagcactgatgagcaagatgcaat

SEQ ID NO: 587417 - DNA, 25 bp, Mus musculus
ccagcactgatgtgcaagatgcaat

SEQ ID NO: 587418 - DNA, 25 bp, Mus musculus
ccagcacttaagcaaacgggaattc

SEQ ID NO: 587419 - DNA, 25 bp, Mus musculus
ccagcacttaaggaaacgggaattc

SEQ ID NO: 587420 - DNA, 25 bp, Mus musculus
ccagcacttctgcagactcttcaag

SEQ ID NO: 587421 - DNA, 25 bp, Mus musculus
ccagcacttctggagactcttcaag

SEQ ID NO: 587422 - DNA, 25 bp, Mus musculus
ccagcagaaaacaaggcggagtctg

SEQ ID NO: 587423 - DNA, 25 bp, Mus musculus
ccagcagaaaactaggcggagtctg

SEQ ID NO: 587424 - DNA, 25 bp, Mus musculus
ccagcagaaaatcttaatcagtacc

SEQ ID NO: 587425 - DNA, 25 bp, Mus musculus
ccagcagaaaatgttaatcagtacc

SEQ ID NO: 587426 - DNA, 25 bp, Mus musculus
ccagcagaaggaaggcttgacttcc

SEQ ID NO: 587427 - DNA, 25 bp, Mus musculus
ccagcagaaggatggcttgacttcc

SEQ ID NO: 587428 - DNA, 25 bp, Mus musculus
ccagcagaccatctgttcgcgggat

SEQ ID NO: 587429 - DNA, 25 bp, Mus musculus
ccagcagaccatgtgttcgcgggat

SEQ ID NO: 587430 - DNA, 25 bp, Mus musculus
ccagcagagccccttcatggttgat

SEQ ID NO: 587431 - DNA, 25 bp, Mus musculus
ccagcagagcccgttcatggttgat

SEQ ID NO: 587432 - DNA, 25 bp, Mus musculus
ccagcagatcagctcaggccctggt

SEQ ID NO: 587433 - DNA, 25 bp, Mus musculus
ccagcagatcaggtcaggccctggt

SEQ ID NO: 587434 - DNA, 25 bp, Mus musculus
ccagcagatctaagcaaggcagtac

SEQ ID NO: 587435 - DNA, 25 bp, Mus musculus
ccagcagatctatgcaaggcagtac

SEQ ID NO: 587436 - DNA, 25 bp, Mus musculus
ccagcagattaaaatgcagtccaca

SEQ ID NO: 587437 - DNA, 25 bp, Mus musculus
ccagcagattaatatgcagtccaca

SEQ ID NO: 587438 - DNA, 25 bp, Mus musculus
ccagcagcaacaccgagactgcttt

SEQ ID NO: 587439 - DNA, 25 bp, Mus musculus
ccagcagcaacagcgagactgcttt

SEQ ID NO: 587440 - DNA, 25 bp, Mus musculus
ccagcagcagagctctaggtccaga

SEQ ID NO: 587441 - DNA, 25 bp, Mus musculus
ccagcagcagaggtctaggtccaga

SEQ ID NO: 587442 - DNA, 25 bp, Mus musculus
ccagcagcaggacctgagccctgga

SEQ ID NO: 587443 - DNA, 25 bp, Mus musculus
ccagcagcaggagctgagccctgga

SEQ ID NO: 587444 - DNA, 25 bp, Mus musculus
ccagcagcatttcatgggacggcct

SEQ ID NO: 587445 - DNA, 25 bp, Mus musculus
ccagcagcatttgatgggacggcct

SEQ ID NO: 587446 - DNA, 25 bp, Mus musculus
ccagcagccctgagcctgactggga

SEQ ID NO: 587447 - DNA, 25 bp, Mus musculus
ccagcagccctgtgcctgactggga

SEQ ID NO: 587448 - DNA, 25 bp, Mus musculus
ccagcagcctgcaggtgaaccggcc

SEQ ID NO: 587449 - DNA, 25 bp, Mus musculus
ccagcagcctgctggtgaaccggcc

SEQ ID NO: 587450 - DNA, 25 bp, Mus musculus
ccagcagcgagtaaggtgaagtcca

SEQ ID NO: 587451 - DNA, 25 bp, Mus musculus
ccagcagcgagttaggtgaagtcca

SEQ ID NO: 587452 - DNA, 25 bp, Mus musculus
ccagcagcggccagaagaagtcagg

SEQ ID NO: 587453 - DNA, 25 bp, Mus musculus
ccagcagcggcctgaagaagtcagg

SEQ ID NO: 587454 - DNA, 25 bp, Mus musculus
ccagcagctcaaacgagaagccaga

SEQ ID NO: 587455 - DNA, 25 bp, Mus musculus
ccagcagctcaatcgagaagccaga

SEQ ID NO: 587456 - DNA, 25 bp, Mus musculus
ccagcagctctgcagcaaggtgacg

SEQ ID NO: 587457 - DNA, 25 bp, Mus musculus
ccagcagctctggagcaaggtgacg

SEQ ID NO: 587458 - DNA, 25 bp, Mus musculus
ccagcagctgatccaagatattaag

SEQ ID NO: 587459 - DNA, 25 bp, Mus musculus
ccagcagctgatgcaagatattaag

SEQ ID NO: 587460 - DNA, 25 bp, Mus musculus
ccagcagctgcactatggaggaaca

SEQ ID NO: 587461 - DNA, 25 bp, Mus musculus
ccagcagctgcagtatggaggaaca

SEQ ID NO: 587462 - DNA, 25 bp, Mus musculus
ccagcagctgggacaggaaaaccct

SEQ ID NO: 587463 - DNA, 25 bp, Mus musculus
ccagcagctgggtcaggaaaaccct

SEQ ID NO: 587464 - DNA, 25 bp, Mus musculus
ccagcaggaaggatcccaaattcag

SEQ ID NO: 587465 - DNA, 25 bp, Mus musculus
ccagcaggaaggttcccaaattcag

SEQ ID NO: 587466 - DNA, 25 bp, Mus musculus
ccagcaggcctgcattgaggccaag

SEQ ID NO: 587467 - DNA, 25 bp, Mus musculus
ccagcaggcctggattgaggccaag

SEQ ID NO: 587468 - DNA, 25 bp, Mus musculus
ccagcaggctggctgagtatcaacc

SEQ ID NO: 587469 - DNA, 25 bp, Mus musculus
ccagcaggctgggtgagtatcaacc

SEQ ID NO: 587470 - DNA, 25 bp, Mus musculus
ccagcaggcttaccaagaagcattt

SEQ ID NO: 587471 - DNA, 25 bp, Mus musculus
ccagcaggcttagcaagaagcattt

SEQ ID NO: 587472 - DNA, 25 bp, Mus musculus
ccagcagggacacagttctgtcaca

SEQ ID NO: 587473 - DNA, 25 bp, Mus musculus
ccagcagggacagagttctgtcaca

SEQ ID NO: 587474 - DNA, 25 bp, Mus musculus
ccagcagggccaccgagctggttca

SEQ ID NO: 587475 - DNA, 25 bp, Mus musculus
ccagcagggccagcgagctggttca

SEQ ID NO: 587476 - DNA, 25 bp, Mus musculus
ccagcaggtgctagaccagagagag

SEQ ID NO: 587477 - DNA, 25 bp, Mus musculus
ccagcaggtgcttgaccagagagag

SEQ ID NO: 587478 - DNA, 25 bp, Mus musculus
ccagcagtacgaactggaccttcgg

SEQ ID NO: 587479 - DNA, 25 bp, Mus musculus
ccagcagtacgatctggaccttcgg

SEQ ID NO: 587480 - DNA, 25 bp, Mus musculus
ccagcagtacgtctgggtaaaggaa

SEQ ID NO: 587481 - DNA, 25 bp, Mus musculus
ccagcagtacgtgtgggtaaaggaa

SEQ ID NO: 587482 - DNA, 25 bp, Mus musculus
ccagcagtattccagacatctgtga

SEQ ID NO: 587483 - DNA, 25 bp, Mus musculus
ccagcagtattcgagacatctgtga

SEQ ID NO: 587484 - DNA, 25 bp, Mus musculus
ccagcagtcagaaagcaaactctct

SEQ ID NO: 587485 - DNA, 25 bp, Mus musculus
ccagcagtcagacgcctacaaggtc

SEQ ID NO: 587486 - DNA, 25 bp, Mus musculus
ccagcagtcagaggcctacaaggtc

SEQ ID NO: 587487 - DNA, 25 bp, Mus musculus
ccagcagtcagatagcaaactctct

SEQ ID NO: 587488 - DNA, 25 bp, Mus musculus
ccagcagtgcccacctgggtttgga

SEQ ID NO: 587489 - DNA, 25 bp, Mus musculus
ccagcagtgccctcctgggtttgga

SEQ ID NO: 587490 - DNA, 25 bp, Mus musculus
ccagcagtggaacgacttcaaagat

SEQ ID NO: 587491 - DNA, 25 bp, Mus musculus
ccagcagtggaaggacttcaaagat

SEQ ID NO: 587492 - DNA, 25 bp, Mus musculus
ccagcagtggctactgcagccagga

SEQ ID NO: 587493 - DNA, 25 bp, Mus musculus
ccagcagtggcttctgcagccagga

SEQ ID NO: 587494 - DNA, 25 bp, Mus musculus
ccagcagtgggccatcgacaatgat

SEQ ID NO: 587495 - DNA, 25 bp, Mus musculus
ccagcagtgggcgatcgacaatgat

SEQ ID NO: 587496 - DNA, 25 bp, Mus musculus
ccagcagtgggtcagttatgctgac

SEQ ID NO: 587497 - DNA, 25 bp, Mus musculus
ccagcagtgggtgagttatgctgac

SEQ ID NO: 587498 - DNA, 25 bp, Mus musculus
ccagcagtggtgatggtaatagtgc

SEQ ID NO: 587499 - DNA, 25 bp, Mus musculus
ccagcagtggtgttggtaatagtgc

SEQ ID NO: 587500 - DNA, 25 bp, Mus musculus
ccagcataatgcaggagcagaagcc

SEQ ID NO: 587501 - DNA, 25 bp, Mus musculus
ccagcataatgctggagcagaagcc

SEQ ID NO: 587502 - DNA, 25 bp, Mus musculus
ccagcatagagacccaccgttggaa

SEQ ID NO: 587503 - DNA, 25 bp, Mus musculus
ccagcatagagagccaccgttggaa

SEQ ID NO: 587504 - DNA, 25 bp, Mus musculus
ccagcatatctgctttcttgacatg

SEQ ID NO: 587505 - DNA, 25 bp, Mus musculus
ccagcatatctggtttcttgacatg

SEQ ID NO: 587506 - DNA, 25 bp, Mus musculus
ccagcatcaactcgtcttcagagtg

SEQ ID NO: 587507 - DNA, 25 bp, Mus musculus
ccagcatcaactggtcttcagagtg

SEQ ID NO: 587508 - DNA, 25 bp, Mus musculus
ccagcatcatccagctgtcagaaga

SEQ ID NO: 587509 - DNA, 25 bp, Mus musculus
ccagcatcatcctgctgtcagaaga

SEQ ID NO: 587510 - DNA, 25 bp, Mus musculus
ccagcatcatgacggcctggatctt

SEQ ID NO: 587511 - DNA, 25 bp, Mus musculus
ccagcatcatgagggcctggatctt

SEQ ID NO: 587512 - DNA, 25 bp, Mus musculus
ccagcatccgctagttgaaggccac

SEQ ID NO: 587513 - DNA, 25 bp, Mus musculus
ccagcatccgcttgttgaaggccac

SEQ ID NO: 587514 - DNA, 25 bp, Mus musculus
ccagcatccttgaactcttacaaag

SEQ ID NO: 587515 - DNA, 25 bp, Mus musculus
ccagcatccttgtactcttacaaag

SEQ ID NO: 587516 - DNA, 25 bp, Mus musculus
ccagcatcgaacagaaaaccgagag

SEQ ID NO: 587517 - DNA, 25 bp, Mus musculus
ccagcatcgaactgaaaaccgagag

SEQ ID NO: 587518 - DNA, 25 bp, Mus musculus
ccagcatgaaagcaagaacaacgaa

SEQ ID NO: 587519 - DNA, 25 bp, Mus musculus
ccagcatgaaaggaagaacaacgaa

SEQ ID NO: 587520 - DNA, 25 bp, Mus musculus
ccagcatgattgcagatgcagtgaa

SEQ ID NO: 587521 - DNA, 25 bp, Mus musculus
ccagcatgattggagatgcagtgaa

SEQ ID NO: 587522 - DNA, 25 bp, Mus musculus
ccagcatgctccctgatgttcagtg

SEQ ID NO: 587523 - DNA, 25 bp, Mus musculus
ccagcatgctccgtgatgttcagtg

SEQ ID NO: 587524 - DNA, 25 bp, Mus musculus
ccagcatggatgatgtacaagtgcc

SEQ ID NO: 587525 - DNA, 25 bp, Mus musculus
ccagcatggatgattccttcgcaga

SEQ ID NO: 587526 - DNA, 25 bp, Mus musculus
ccagcatggatgcttcagatcggag

SEQ ID NO: 587527 - DNA, 25 bp, Mus musculus
ccagcatggatggttcagatcggag

SEQ ID NO: 587528 - DNA, 25 bp, Mus musculus
ccagcatggatgttgtacaagtgcc

SEQ ID NO: 587529 - DNA, 25 bp, Mus musculus
ccagcatggatgtttccttcgcaga

SEQ ID NO: 587530 - DNA, 25 bp, Mus musculus
ccagcatggcagctgttgtcctgga

SEQ ID NO: 587531 - DNA, 25 bp, Mus musculus
ccagcatggcaggtgttgtcctgga

SEQ ID NO: 587532 - DNA, 25 bp, Mus musculus
ccagcatgggtacctatccaaagaa

SEQ ID NO: 587533 - DNA, 25 bp, Mus musculus
ccagcatgggtagctatccaaagaa

SEQ ID NO: 587534 - DNA, 25 bp, Mus musculus
ccagcatggtcaccgcctacatgta

SEQ ID NO: 587535 - DNA, 25 bp, Mus musculus
ccagcatggtcagcgcctacatgta

SEQ ID NO: 587536 - DNA, 25 bp, Mus musculus
ccagcatgtgctagatccttgtaga

SEQ ID NO: 587537 - DNA, 25 bp, Mus musculus
ccagcatgtgctctgtgatatgcaa

SEQ ID NO: 587538 - DNA, 25 bp, Mus musculus
ccagcatgtgctgtgtgatatgcaa

SEQ ID NO: 587539 - DNA, 25 bp, Mus musculus
ccagcatgtgcttgatccttgtaga

SEQ ID NO: 587540 - DNA, 25 bp, Mus musculus
ccagcattagaacaactactgaagg

SEQ ID NO: 587541 - DNA, 25 bp, Mus musculus
ccagcattagaagaactactgaagg

SEQ ID NO: 587542 - DNA, 25 bp, Mus musculus
ccagcattcggaagatgtcctgccc

SEQ ID NO: 587543 - DNA, 25 bp, Mus musculus
ccagcattcggatgatgtcctgccc

SEQ ID NO: 587544 - DNA, 25 bp, Mus musculus
ccagcattggaacaggtcattgtga

SEQ ID NO: 587545 - DNA, 25 bp, Mus musculus
ccagcattggaagaggtcattgtga

SEQ ID NO: 587546 - DNA, 25 bp, Mus musculus
ccagcattgtgtctcgttttgtcca

SEQ ID NO: 587547 - DNA, 25 bp, Mus musculus
ccagcattgtgtgtcgttttgtcca

SEQ ID NO: 587548 - DNA, 25 bp, Mus musculus
ccagcatttggtaagtgcttggttc

SEQ ID NO: 587549 - DNA, 25 bp, Mus musculus
ccagcatttggttagtgcttggttc

SEQ ID NO: 587550 - DNA, 25 bp, Mus musculus
ccagcattttgacggttttgtggtg

SEQ ID NO: 587551 - DNA, 25 bp, Mus musculus
ccagcattttgagggttttgtggtg

SEQ ID NO: 587552 - DNA, 25 bp, Mus musculus
ccagccaaaaccaccatgaagaaag

SEQ ID NO: 587553 - DNA, 25 bp, Mus musculus
ccagccaaaacctccatgaagaaag

SEQ ID NO: 587554 - DNA, 25 bp, Mus musculus
ccagccaaagcactggagggaaccg

SEQ ID NO: 587555 - DNA, 25 bp, Mus musculus
ccagccaaagcagtggagggaaccg

SEQ ID NO: 587556 - DNA, 25 bp, Mus musculus
ccagccaactatctccagaagcgtg

SEQ ID NO: 587557 - DNA, 25 bp, Mus musculus
ccagccaactatgtccagaagcgtg

SEQ ID NO: 587558 - DNA, 25 bp, Mus musculus
ccagccaagccacggatttgttgtc

SEQ ID NO: 587559 - DNA, 25 bp, Mus musculus
ccagccaagccagggatttgttgtc

SEQ ID NO: 587560 - DNA, 25 bp, Mus musculus
ccagccaagtaaagtcccgaggact

SEQ ID NO: 587561 - DNA, 25 bp, Mus musculus
ccagccaagtaatgtcccgaggact

SEQ ID NO: 587562 - DNA, 25 bp, Mus musculus
ccagccaagtttctggaggtcctgg

SEQ ID NO: 587563 - DNA, 25 bp, Mus musculus
ccagccaagtttgtggaggtcctgg

SEQ ID NO: 587564 - DNA, 25 bp, Mus musculus
ccagccaatttaattcagcaacaag

SEQ ID NO: 587565 - DNA, 25 bp, Mus musculus
ccagccaatttatttcagcaacaag

SEQ ID NO: 587566 - DNA, 25 bp, Mus musculus
ccagccacacacattgcatgaggtg

SEQ ID NO: 587567 - DNA, 25 bp, Mus musculus
ccagccacacactttgcatgaggtg

SEQ ID NO: 587568 - DNA, 25 bp, Mus musculus
ccagccacacagctctatgtctgaa

SEQ ID NO: 587569 - DNA, 25 bp, Mus musculus
ccagccacacaggtctatgtctgaa

SEQ ID NO: 587570 - DNA, 25 bp, Mus musculus
ccagccacatctcgttttagctatg

SEQ ID NO: 587571 - DNA, 25 bp, Mus musculus
ccagccacatctggttttagctatg

SEQ ID NO: 587572 - DNA, 25 bp, Mus musculus
ccagccaccaccagcggaggaggag

SEQ ID NO: 587573 - DNA, 25 bp, Mus musculus
ccagccaccacctgcggaggaggag

SEQ ID NO: 587574 - DNA, 25 bp, Mus musculus
ccagccaccctgaaatttttccatg

SEQ ID NO: 587575 - DNA, 25 bp, Mus musculus
ccagccaccctgtaatttttccatg

SEQ ID NO: 587576 - DNA, 25 bp, Mus musculus
ccagccactgcccagtacgaatttg

SEQ ID NO: 587577 - DNA, 25 bp, Mus musculus
ccagccactgccgagtacgaatttg

SEQ ID NO: 587578 - DNA, 25 bp, Mus musculus
ccagccacttcgctatttggatggt

SEQ ID NO: 587579 - DNA, 25 bp, Mus musculus
ccagccacttcggtatttggatggt

SEQ ID NO: 587580 - DNA, 25 bp, Mus musculus
ccagccaggaggaacaagcactcct

SEQ ID NO: 587581 - DNA, 25 bp, Mus musculus
ccagccaggaggtacaagcactcct

SEQ ID NO: 587582 - DNA, 25 bp, Mus musculus
ccagccaggatcatgattcctccga

SEQ ID NO: 587583 - DNA, 25 bp, Mus musculus
ccagccaggatcttgattcctccga

SEQ ID NO: 587584 - DNA, 25 bp, Mus musculus
ccagccagggtcctatggttccaaa

SEQ ID NO: 587585 - DNA, 25 bp, Mus musculus
ccagccagggtcgtatggttccaaa

SEQ ID NO: 587586 - DNA, 25 bp, Mus musculus
ccagccaggtcacgaggaaaactat

SEQ ID NO: 587587 - DNA, 25 bp, Mus musculus
ccagccaggtcaggaggaaaactat

SEQ ID NO: 587588 - DNA, 25 bp, Mus musculus
ccagccaggtgcatactattcctca

SEQ ID NO: 587589 - DNA, 25 bp, Mus musculus
ccagccaggtgcttactattcctca

SEQ ID NO: 587590 - DNA, 25 bp, Mus musculus
ccagccaggtgtactgcaaggtggt

SEQ ID NO: 587591 - DNA, 25 bp, Mus musculus
ccagccaggtgttctgcaaggtggt

SEQ ID NO: 587592 - DNA, 25 bp, Mus musculus
ccagccagtgtgcatcactgattgg

SEQ ID NO: 587593 - DNA, 25 bp, Mus musculus
ccagccagtgtggatcactgattgg

SEQ ID NO: 587594 - DNA, 25 bp, Mus musculus
ccagccatgcccagatgtaaagtat

SEQ ID NO: 587595 - DNA, 25 bp, Mus musculus
ccagccatgccctgatgtaaagtat

SEQ ID NO: 587596 - DNA, 25 bp, Mus musculus
ccagccattcagcaaaggagatcgg

SEQ ID NO: 587597 - DNA, 25 bp, Mus musculus
ccagccattcaggaaaggagatcgg

SEQ ID NO: 587598 - DNA, 25 bp, Mus musculus
ccagccattgctatccatcgtggaa

SEQ ID NO: 587599 - DNA, 25 bp, Mus musculus
ccagccattgctttccatcgtggaa

SEQ ID NO: 587600 - DNA, 25 bp, Mus musculus
ccagcccagacaagttacccggatt

SEQ ID NO: 587601 - DNA, 25 bp, Mus musculus
ccagcccagacatgttacccggatt

SEQ ID NO: 587602 - DNA, 25 bp, Mus musculus
ccagcccatcagagctgacattgct

SEQ ID NO: 587603 - DNA, 25 bp, Mus musculus
ccagcccatcagtgctgacattgct

SEQ ID NO: 587604 - DNA, 25 bp, Mus musculus
ccagcccatctaaggtgggtcatca

SEQ ID NO: 587605 - DNA, 25 bp, Mus musculus
ccagcccatctatggtgggtcatca

SEQ ID NO: 587606 - DNA, 25 bp, Mus musculus
ccagcccgcttcaagccagggtggg

SEQ ID NO: 587607 - DNA, 25 bp, Mus musculus
ccagcccgcttctagccagggtggg

SEQ ID NO: 587608 - DNA, 25 bp, Mus musculus
ccagcccggagaacctccggagagg

SEQ ID NO: 587609 - DNA, 25 bp, Mus musculus
ccagcccggagatcctccggagagg

SEQ ID NO: 587610 - DNA, 25 bp, Mus musculus
ccagcccgtgccatgagaaagcaaa

SEQ ID NO: 587611 - DNA, 25 bp, Mus musculus
ccagcccgtgccttgagaaagcaaa

SEQ ID NO: 587612 - DNA, 25 bp, Mus musculus
ccagccctaatgagcaacagtacac

SEQ ID NO: 587613 - DNA, 25 bp, Mus musculus
ccagccctaatgtgcaacagtacac

SEQ ID NO: 587614 - DNA, 25 bp, Mus musculus
ccagccctacacatttgatatcaac

SEQ ID NO: 587615 - DNA, 25 bp, Mus musculus
ccagccctacacttttgatatcaac

SEQ ID NO: 587616 - DNA, 25 bp, Mus musculus
ccagccctgaacctgagcaaggagg

SEQ ID NO: 587617 - DNA, 25 bp, Mus musculus
ccagccctgaacgtgagcaaggagg

SEQ ID NO: 587618 - DNA, 25 bp, Mus musculus
ccagccctggcaaccgggaacgtgg

SEQ ID NO: 587619 - DNA, 25 bp, Mus musculus
ccagccctggcatccgggaacgtgg

SEQ ID NO: 587620 - DNA, 25 bp, Mus musculus
ccagccgagagcctcgagctgctga

SEQ ID NO: 587621 - DNA, 25 bp, Mus musculus
ccagccgagagcgtcgagctgctga

SEQ ID NO: 587622 - DNA, 25 bp, Mus musculus
ccagccgcccagagaatgccattat

SEQ ID NO: 587623 - DNA, 25 bp, Mus musculus
ccagccgcccagtgaatgccattat

SEQ ID NO: 587624 - DNA, 25 bp, Mus musculus
ccagccgccttcatcagtatgcaga

SEQ ID NO: 587625 - DNA, 25 bp, Mus musculus
ccagccgccttcttcagtatgcaga

SEQ ID NO: 587626 - DNA, 25 bp, Mus musculus
ccagccgctgccagatacagtgcag

SEQ ID NO: 587627 - DNA, 25 bp, Mus musculus
ccagccgctgcctgatacagtgcag

SEQ ID NO: 587628 - DNA, 25 bp, Mus musculus
ccagccggaacacaggaacaaaggg

SEQ ID NO: 587629 - DNA, 25 bp, Mus musculus
ccagccggaacagaggaacaaaggg

SEQ ID NO: 587630 - DNA, 25 bp, Mus musculus
ccagccgggtaacgcagccaggctt

SEQ ID NO: 587631 - DNA, 25 bp, Mus musculus
ccagccgggtaaggcagccaggctt

SEQ ID NO: 587632 - DNA, 25 bp, Mus musculus
ccagccggtggaactcagcccggga

SEQ ID NO: 587633 - DNA, 25 bp, Mus musculus
ccagccggtggaagtgcggcaacaa

SEQ ID NO: 587634 - DNA, 25 bp, Mus musculus
ccagccggtggatctcagcccggga

SEQ ID NO: 587635 - DNA, 25 bp, Mus musculus
ccagccggtggatgtgcggcaacaa

SEQ ID NO: 587636 - DNA, 25 bp, Mus musculus
ccagccgtgaccagaaaagacaaca

SEQ ID NO: 587637 - DNA, 25 bp, Mus musculus
ccagccgtgacctgaaaagacaaca

SEQ ID NO: 587638 - DNA, 25 bp, Mus musculus
ccagccgtgctaatgactatgtgca

SEQ ID NO: 587639 - DNA, 25 bp, Mus musculus
ccagccgtgctattgactatgtgca

SEQ ID NO: 587640 - DNA, 25 bp, Mus musculus
ccagccgtggtgatggctttgccag

SEQ ID NO: 587641 - DNA, 25 bp, Mus musculus
ccagccgtggtgttggctttgccag

SEQ ID NO: 587642 - DNA, 25 bp, Mus musculus
ccagcctacctgaacccagagatga

SEQ ID NO: 587643 - DNA, 25 bp, Mus musculus
ccagcctacctgtacccagagatga

SEQ ID NO: 587644 - DNA, 25 bp, Mus musculus
ccagcctagtccaccgagggcaggg

SEQ ID NO: 587645 - DNA, 25 bp, Mus musculus
ccagcctagtcctccgagggcaggg

SEQ ID NO: 587646 - DNA, 25 bp, Mus musculus
ccagcctcagggatcaagttcaaag

SEQ ID NO: 587647 - DNA, 25 bp, Mus musculus
ccagcctcagggttcaagttcaaag

SEQ ID NO: 587648 - DNA, 25 bp, Mus musculus
ccagcctccaatattaaagcacctg

SEQ ID NO: 587649 - DNA, 25 bp, Mus musculus
ccagcctccaattttaaagcacctg

SEQ ID NO: 587650 - DNA, 25 bp, Mus musculus
ccagcctcgggtcatttcctttgaa

SEQ ID NO: 587651 - DNA, 25 bp, Mus musculus
ccagcctcgggtgatttcctttgaa

SEQ ID NO: 587652 - DNA, 25 bp, Mus musculus
ccagcctgaaacatggtggctgtaa

SEQ ID NO: 587653 - DNA, 25 bp, Mus musculus
ccagcctgaaacttggtggctgtaa

SEQ ID NO: 587654 - DNA, 25 bp, Mus musculus
ccagcctgaagaaggtgagaaatca

SEQ ID NO: 587655 - DNA, 25 bp, Mus musculus
ccagcctgaagatggtgagaaatca

SEQ ID NO: 587656 - DNA, 25 bp, Mus musculus
ccagcctgacaacgaaaggaaaatg

SEQ ID NO: 587657 - DNA, 25 bp, Mus musculus
ccagcctgacaaggaaaggaaaatg

SEQ ID NO: 587658 - DNA, 25 bp, Mus musculus
ccagcctgacagctaaggacaggag

SEQ ID NO: 587659 - DNA, 25 bp, Mus musculus
ccagcctgacaggtaaggacaggag

SEQ ID NO: 587660 - DNA, 25 bp, Mus musculus
ccagcctgagctctgactactttgc

SEQ ID NO: 587661 - DNA, 25 bp, Mus musculus
ccagcctgagctgtgactactttgc

SEQ ID NO: 587662 - DNA, 25 bp, Mus musculus
ccagcctgaggtagagggagctaac

SEQ ID NO: 587663 - DNA, 25 bp, Mus musculus
ccagcctgaggttgagggagctaac

SEQ ID NO: 587664 - DNA, 25 bp, Mus musculus
ccagcctgatatcctggtaatgagg

SEQ ID NO: 587665 - DNA, 25 bp, Mus musculus
ccagcctgatatgctggtaatgagg

SEQ ID NO: 587666 - DNA, 25 bp, Mus musculus
ccagcctgatggagctccgagcttt

SEQ ID NO: 587667 - DNA, 25 bp, Mus musculus
ccagcctgatggtgctccgagcttt

SEQ ID NO: 587668 - DNA, 25 bp, Mus musculus
ccagcctgcaataccacacaataat

SEQ ID NO: 587669 - DNA, 25 bp, Mus musculus
ccagcctgcaattccacacaataat

SEQ ID NO: 587670 - DNA, 25 bp, Mus musculus
ccagcctgcaggaggccaatggaag

SEQ ID NO: 587671 - DNA, 25 bp, Mus musculus
ccagcctgcaggtggccaatggaag

SEQ ID NO: 587672 - DNA, 25 bp, Mus musculus
ccagcctgcatgctccgcgatgtga

SEQ ID NO: 587673 - DNA, 25 bp, Mus musculus
ccagcctgcatggtccgcgatgtga

SEQ ID NO: 587674 - DNA, 25 bp, Mus musculus
ccagcctgctgacgccttgatctgg

SEQ ID NO: 587675 - DNA, 25 bp, Mus musculus
ccagcctgctgaggccttgatctgg

SEQ ID NO: 587676 - DNA, 25 bp, Mus musculus
ccagcctggagccttctactgcgag

SEQ ID NO: 587677 - DNA, 25 bp, Mus musculus
ccagcctggagcgttctactgcgag

SEQ ID NO: 587678 - DNA, 25 bp, Mus musculus
ccagcctggcgtctcgtacgcagtg

SEQ ID NO: 587679 - DNA, 25 bp, Mus musculus
ccagcctggcgtgtcgtacgcagtg

SEQ ID NO: 587680 - DNA, 25 bp, Mus musculus
ccagcctggtctccgttatgactgt

SEQ ID NO: 587681 - DNA, 25 bp, Mus musculus
ccagcctggtctgcgttatgactgt

SEQ ID NO: 587682 - DNA, 25 bp, Mus musculus
ccagcctggtttactgtatgttcca

SEQ ID NO: 587683 - DNA, 25 bp, Mus musculus
ccagcctggttttctgtatgttcca

SEQ ID NO: 587684 - DNA, 25 bp, Mus musculus
ccagcctgtatcagggttggcttcc

SEQ ID NO: 587685 - DNA, 25 bp, Mus musculus
ccagcctgtatctgggttggcttcc

SEQ ID NO: 587686 - DNA, 25 bp, Mus musculus
ccagccttatggactaaggaattac

SEQ ID NO: 587687 - DNA, 25 bp, Mus musculus
ccagccttatggtctaaggaattac

SEQ ID NO: 587688 - DNA, 25 bp, Mus musculus
ccagccttcgacactgactgataag

SEQ ID NO: 587689 - DNA, 25 bp, Mus musculus
ccagccttcgactctgactgataag

SEQ ID NO: 587690 - DNA, 25 bp, Mus musculus
ccagccttgagaaatgcagctgtga

SEQ ID NO: 587691 - DNA, 25 bp, Mus musculus
ccagccttgagatatgcagctgtga

SEQ ID NO: 587692 - DNA, 25 bp, Mus musculus
ccagccttgaggactgagtagctac

SEQ ID NO: 587693 - DNA, 25 bp, Mus musculus
ccagccttgaggtctgagtagctac

SEQ ID NO: 587694 - DNA, 25 bp, Mus musculus
ccagccttgcgtcaaatctcagcat

SEQ ID NO: 587695 - DNA, 25 bp, Mus musculus
ccagccttgcgtgaaatctcagcat

SEQ ID NO: 587696 - DNA, 25 bp, Mus musculus
ccagcgaacgagcaagccagcgagt

SEQ ID NO: 587697 - DNA, 25 bp, Mus musculus
ccagcgaacgaggaagccagcgagt

SEQ ID NO: 587698 - DNA, 25 bp, Mus musculus
ccagcgaatacgcagaggaccaggc

SEQ ID NO: 587699 - DNA, 25 bp, Mus musculus
ccagcgaatacggagaggaccaggc

SEQ ID NO: 587700 - DNA, 25 bp, Mus musculus
ccagcgaatcggcaggcttggtaca

SEQ ID NO: 587701 - DNA, 25 bp, Mus musculus
ccagcgaatcgggaggcttggtaca

SEQ ID NO: 587702 - DNA, 25 bp, Mus musculus
ccagcgaatgggaacggttctgttc

SEQ ID NO: 587703 - DNA, 25 bp, Mus musculus
ccagcgaatgggtacggttctgttc

SEQ ID NO: 587704 - DNA, 25 bp, Mus musculus
ccagcgactcgaccgtcggagttaa

SEQ ID NO: 587705 - DNA, 25 bp, Mus musculus
ccagcgactcgagcgtcggagttaa

SEQ ID NO: 587706 - DNA, 25 bp, Mus musculus
ccagcgacttgaagacggtttccca

SEQ ID NO: 587707 - DNA, 25 bp, Mus musculus
ccagcgacttgatgacggtttccca

SEQ ID NO: 587708 - DNA, 25 bp, Mus musculus
ccagcgagccggagctcctgaagcg

SEQ ID NO: 587709 - DNA, 25 bp, Mus musculus
ccagcgagccggtgctcctgaagcg

SEQ ID NO: 587710 - DNA, 25 bp, Mus musculus
ccagcgaggattatgtggatccatg

SEQ ID NO: 587711 - DNA, 25 bp, Mus musculus
ccagcgaggattttgtggatccatg

SEQ ID NO: 587712 - DNA, 25 bp, Mus musculus
ccagcgagtgagacgctcgcagaac

SEQ ID NO: 587713 - DNA, 25 bp, Mus musculus
ccagcgagtgagtcgctcgcagaac

SEQ ID NO: 587714 - DNA, 25 bp, Mus musculus
ccagcgatcagcataaacaacctag

SEQ ID NO: 587715 - DNA, 25 bp, Mus musculus
ccagcgatcagcttaaacaacctag

SEQ ID NO: 587716 - DNA, 25 bp, Mus musculus
ccagcgatctgaacgcaagaagtgg

SEQ ID NO: 587717 - DNA, 25 bp, Mus musculus
ccagcgatctgatcgcaagaagtgg

SEQ ID NO: 587718 - DNA, 25 bp, Mus musculus
ccagcgatctggacaaaggccaaga

SEQ ID NO: 587719 - DNA, 25 bp, Mus musculus
ccagcgatctggtcaaaggccaaga

SEQ ID NO: 587720 - DNA, 25 bp, Mus musculus
ccagcgattgtccaacatagaaagg

SEQ ID NO: 587721 - DNA, 25 bp, Mus musculus
ccagcgattgtccaagaattcctca

SEQ ID NO: 587722 - DNA, 25 bp, Mus musculus
ccagcgattgtcgaacatagaaagg

SEQ ID NO: 587723 - DNA, 25 bp, Mus musculus
ccagcgattgtcgaagaattcctca

SEQ ID NO: 587724 - DNA, 25 bp, Mus musculus
ccagcgcaatgtccgatcgctcggg

SEQ ID NO: 587725 - DNA, 25 bp, Mus musculus
ccagcgcaatgtgcgatcgctcggg

SEQ ID NO: 587726 - DNA, 25 bp, Mus musculus
ccagcgccagggagcaggacctcat

SEQ ID NO: 587727 - DNA, 25 bp, Mus musculus
ccagcgccagggtgcaggacctcat

SEQ ID NO: 587728 - DNA, 25 bp, Mus musculus
ccagcgccatttataagcaagactg

SEQ ID NO: 587729 - DNA, 25 bp, Mus musculus
ccagcgccatttttaagcaagactg

SEQ ID NO: 587730 - DNA, 25 bp, Mus musculus
ccagcgcctggaccttcgggatgac

SEQ ID NO: 587731 - DNA, 25 bp, Mus musculus
ccagcgcctggagcttcgggatgac

SEQ ID NO: 587732 - DNA, 25 bp, Mus musculus
ccagcgcgccggcatttagggataa

SEQ ID NO: 587733 - DNA, 25 bp, Mus musculus
ccagcgcgccgggatttagggataa

SEQ ID NO: 587734 - DNA, 25 bp, Mus musculus
ccagcgcgctggaaggagttcatgc

SEQ ID NO: 587735 - DNA, 25 bp, Mus musculus
ccagcgcgctggtaggagttcatgc

SEQ ID NO: 587736 - DNA, 25 bp, Mus musculus
ccagcgctaggccagagatgataca

SEQ ID NO: 587737 - DNA, 25 bp, Mus musculus
ccagcgctaggcgagagatgataca

SEQ ID NO: 587738 - DNA, 25 bp, Mus musculus
ccagcgctcaaacggcaagcttcga

SEQ ID NO: 587739 - DNA, 25 bp, Mus musculus
ccagcgctcaaagggcaagcttcga

SEQ ID NO: 587740 - DNA, 25 bp, Mus musculus
ccagcggacatcagccagaagcaag

SEQ ID NO: 587741 - DNA, 25 bp, Mus musculus
ccagcggacatctgccagaagcaag

SEQ ID NO: 587742 - DNA, 25 bp, Mus musculus
ccagcggagagaagccaaacttcaa

SEQ ID NO: 587743 - DNA, 25 bp, Mus musculus
ccagcggagagatgccaaacttcaa

SEQ ID NO: 587744 - DNA, 25 bp, Mus musculus
ccagcggagccaaagacggaatcat

SEQ ID NO: 587745 - DNA, 25 bp, Mus musculus
ccagcggagccatagacggaatcat

SEQ ID NO: 587746 - DNA, 25 bp, Mus musculus
ccagcggagtcgcatgctcagtatc

SEQ ID NO: 587747 - DNA, 25 bp, Mus musculus
ccagcggagtcggatgctcagtatc

SEQ ID NO: 587748 - DNA, 25 bp, Mus musculus
ccagcggatgcaacagacaaatgtt

SEQ ID NO: 587749 - DNA, 25 bp, Mus musculus
ccagcggatgcatcagacaaatgtt

SEQ ID NO: 587750 - DNA, 25 bp, Mus musculus
ccagcggccagacctgctgtgcggg

SEQ ID NO: 587751 - DNA, 25 bp, Mus musculus
ccagcggccagagctgctgtgcggg

SEQ ID NO: 587752 - DNA, 25 bp, Mus musculus
ccagcggccaggcaatatgaagccc

SEQ ID NO: 587753 - DNA, 25 bp, Mus musculus
ccagcggccagggaatatgaagccc

SEQ ID NO: 587754 - DNA, 25 bp, Mus musculus
ccagcggcctttagccccagtggat

SEQ ID NO: 587755 - DNA, 25 bp, Mus musculus
ccagcggccttttgccccagtggat

SEQ ID NO: 587756 - DNA, 25 bp, Mus musculus
ccagcggcttatagagattctctct

SEQ ID NO: 587757 - DNA, 25 bp, Mus musculus
ccagcggcttattgagattctctct

SEQ ID NO: 587758 - DNA, 25 bp, Mus musculus
ccagcgggaccaagagaactacgtg

SEQ ID NO: 587759 - DNA, 25 bp, Mus musculus
ccagcgggaccatgagaactacgtg

SEQ ID NO: 587760 - DNA, 25 bp, Mus musculus
ccagcgggccttctttgcagtacaa

SEQ ID NO: 587761 - DNA, 25 bp, Mus musculus
ccagcgggccttgtttgcagtacaa

SEQ ID NO: 587762 - DNA, 25 bp, Mus musculus
ccagcgggcggcagatggctctact

SEQ ID NO: 587763 - DNA, 25 bp, Mus musculus
ccagcgggcggctgatggctctact

SEQ ID NO: 587764 - DNA, 25 bp, Mus musculus
ccagcgggtcccagctgacatgatc

SEQ ID NO: 587765 - DNA, 25 bp, Mus musculus
ccagcgggtccctgctgacatgatc

SEQ ID NO: 587766 - DNA, 25 bp, Mus musculus
ccagcggtactgacagtgcaatact

SEQ ID NO: 587767 - DNA, 25 bp, Mus musculus
ccagcggtactgtcagtgcaatact

SEQ ID NO: 587768 - DNA, 25 bp, Mus musculus
ccagcggtaggcaagcttactatca

SEQ ID NO: 587769 - DNA, 25 bp, Mus musculus
ccagcggtaggctagcttactatca

SEQ ID NO: 587770 - DNA, 25 bp, Mus musculus
ccagcggtgtgcacgaacagacaag

SEQ ID NO: 587771 - DNA, 25 bp, Mus musculus
ccagcggtgtgctcgaacagacaag

SEQ ID NO: 587772 - DNA, 25 bp, Mus musculus
ccagcgtaaagccacttcgagcaca

SEQ ID NO: 587773 - DNA, 25 bp, Mus musculus
ccagcgtaaagcgacttcgagcaca

SEQ ID NO: 587774 - DNA, 25 bp, Mus musculus
ccagcgtcggaaagtgtgacatcga

SEQ ID NO: 587775 - DNA, 25 bp, Mus musculus
ccagcgtcggaatgtgtgacatcga

SEQ ID NO: 587776 - DNA, 25 bp, Mus musculus
ccagcgtcgttgaggactgtgacaa

SEQ ID NO: 587777 - DNA, 25 bp, Mus musculus
ccagcgtcgttgtggactgtgacaa

SEQ ID NO: 587778 - DNA, 25 bp, Mus musculus
ccagcgtctcgcagaagtggacttg

SEQ ID NO: 587779 - DNA, 25 bp, Mus musculus
ccagcgtctcgctgaagtggacttg

SEQ ID NO: 587780 - DNA, 25 bp, Mus musculus
ccagcgtgggtaccaagaaccagag

SEQ ID NO: 587781 - DNA, 25 bp, Mus musculus
ccagcgtgggtagcaagaaccagag

SEQ ID NO: 587782 - DNA, 25 bp, Mus musculus
ccagcgtgtggacttgttcagatgc

SEQ ID NO: 587783 - DNA, 25 bp, Mus musculus
ccagcgtgtggagttgttcagatgc

SEQ ID NO: 587784 - DNA, 25 bp, Mus musculus
ccagcgttttcaacttttctcagct

SEQ ID NO: 587785 - DNA, 25 bp, Mus musculus
ccagcgttttcatcttttctcagct

SEQ ID NO: 587786 - DNA, 25 bp, Mus musculus
ccagctaagatcagtggaaatccag

SEQ ID NO: 587787 - DNA, 25 bp, Mus musculus
ccagctaagatctgtggaaatccag

SEQ ID NO: 587788 - DNA, 25 bp, Mus musculus
ccagctaagctaagcgtgttatccc

SEQ ID NO: 587789 - DNA, 25 bp, Mus musculus
ccagctaagctatgcgtgttatccc

SEQ ID NO: 587790 - DNA, 25 bp, Mus musculus
ccagctaagcttacttaaccctgct

SEQ ID NO: 587791 - DNA, 25 bp, Mus musculus
ccagctaagctttcttaaccctgct

SEQ ID NO: 587792 - DNA, 25 bp, Mus musculus
ccagctacacgtataaggccacagt

SEQ ID NO: 587793 - DNA, 25 bp, Mus musculus
ccagctacacgtttaaggccacagt

SEQ ID NO: 587794 - DNA, 25 bp, Mus musculus
ccagctaccaagcaggcagaaatct

SEQ ID NO: 587795 - DNA, 25 bp, Mus musculus
ccagctaccaaggaggcagaaatct

SEQ ID NO: 587796 - DNA, 25 bp, Mus musculus
ccagctacgaagagtgccgggccga

SEQ ID NO: 587797 - DNA, 25 bp, Mus musculus
ccagctacgaagtgtgccgggccga

SEQ ID NO: 587798 - DNA, 25 bp, Mus musculus
ccagctacgggccagaaaaactcaa

SEQ ID NO: 587799 - DNA, 25 bp, Mus musculus
ccagctacgggcgagaaaaactcaa

SEQ ID NO: 587800 - DNA, 25 bp, Mus musculus
ccagctactggtcgaacggagacaa

SEQ ID NO: 587801 - DNA, 25 bp, Mus musculus
ccagctactggtggaacggagacaa

SEQ ID NO: 587802 - DNA, 25 bp, Mus musculus
ccagctagaagacatgctgagacct

SEQ ID NO: 587803 - DNA, 25 bp, Mus musculus
ccagctagaagagatgctgagacct

SEQ ID NO: 587804 - DNA, 25 bp, Mus musculus
ccagctagagctcagcaaagtgcgt

SEQ ID NO: 587805 - DNA, 25 bp, Mus musculus
ccagctagagctgagcaaagtgcgt

SEQ ID NO: 587806 - DNA, 25 bp, Mus musculus
ccagctagctggcacaagtttacag

SEQ ID NO: 587807 - DNA, 25 bp, Mus musculus
ccagctagctgggacaagtttacag

SEQ ID NO: 587808 - DNA, 25 bp, Mus musculus
ccagctatcctgaacaatgacagat

SEQ ID NO: 587809 - DNA, 25 bp, Mus musculus
ccagctatcctgtacaatgacagat

SEQ ID NO: 587810 - DNA, 25 bp, Mus musculus
ccagctatcgacaattaataaaaga

SEQ ID NO: 587811 - DNA, 25 bp, Mus musculus
ccagctatcgactattaataaaaga

SEQ ID NO: 587812 - DNA, 25 bp, Mus musculus
ccagctatcgggaccatgtgaagga

SEQ ID NO: 587813 - DNA, 25 bp, Mus musculus
ccagctatcgggtccatgtgaagga

SEQ ID NO: 587814 - DNA, 25 bp, Mus musculus
ccagctattgctcaggagattggtc

SEQ ID NO: 587815 - DNA, 25 bp, Mus musculus
ccagctattgctgaggagattggtc

SEQ ID NO: 587816 - DNA, 25 bp, Mus musculus
ccagctcaagctcgcatgtgagatc

SEQ ID NO: 587817 - DNA, 25 bp, Mus musculus
ccagctcaagctggcatgtgagatc

SEQ ID NO: 587818 - DNA, 25 bp, Mus musculus
ccagctcagtagaagcatgtgtcag

SEQ ID NO: 587819 - DNA, 25 bp, Mus musculus
ccagctcagtagtagcatgtgtcag

SEQ ID NO: 587820 - DNA, 25 bp, Mus musculus
ccagctcatgctcatgggccttttg

SEQ ID NO: 587821 - DNA, 25 bp, Mus musculus
ccagctcatgctgatgggccttttg

SEQ ID NO: 587822 - DNA, 25 bp, Mus musculus
ccagctcatggcaattttgggcagc

SEQ ID NO: 587823 - DNA, 25 bp, Mus musculus
ccagctcatggctattttgggcagc

SEQ ID NO: 587824 - DNA, 25 bp, Mus musculus
ccagctccaccgctctgaaagggat

SEQ ID NO: 587825 - DNA, 25 bp, Mus musculus
ccagctccaccggtctgaaagggat

SEQ ID NO: 587826 - DNA, 25 bp, Mus musculus
ccagctccagagagtaaagaagccg

SEQ ID NO: 587827 - DNA, 25 bp, Mus musculus
ccagctccagagtgtaaagaagccg

SEQ ID NO: 587828 - DNA, 25 bp, Mus musculus
ccagctccatgtctgtggagacgac

SEQ ID NO: 587829 - DNA, 25 bp, Mus musculus
ccagctccatgtgtgtggagacgac

SEQ ID NO: 587830 - DNA, 25 bp, Mus musculus
ccagctccgtctatgatgacagcta

SEQ ID NO: 587831 - DNA, 25 bp, Mus musculus
ccagctccgtctttgatgacagcta

SEQ ID NO: 587832 - DNA, 25 bp, Mus musculus
ccagctcctgttctctagcagagga

SEQ ID NO: 587833 - DNA, 25 bp, Mus musculus
ccagctcctgttgtctagcagagga

SEQ ID NO: 587834 - DNA, 25 bp, Mus musculus
ccagctccttgtcacggcttcagat

SEQ ID NO: 587835 - DNA, 25 bp, Mus musculus
ccagctccttgtgacggcttcagat

SEQ ID NO: 587836 - DNA, 25 bp, Mus musculus
ccagctcgaaagcacggcgctatgt

SEQ ID NO: 587837 - DNA, 25 bp, Mus musculus
ccagctcgaaaggacggcgctatgt

SEQ ID NO: 587838 - DNA, 25 bp, Mus musculus
ccagctctcttcagtctatggagac

SEQ ID NO: 587839 - DNA, 25 bp, Mus musculus
ccagctctcttctgtctatggagac

SEQ ID NO: 587840 - DNA, 25 bp, Mus musculus
ccagctctggtcatcctaggaatag

SEQ ID NO: 587841 - DNA, 25 bp, Mus musculus
ccagctctggtcttcctaggaatag

SEQ ID NO: 587842 - DNA, 25 bp, Mus musculus
ccagctctgtcaagagcccagctgg

SEQ ID NO: 587843 - DNA, 25 bp, Mus musculus
ccagctctgtcatgagcccagctgg

SEQ ID NO: 587844 - DNA, 25 bp, Mus musculus
ccagctctgtggcaatgaatattac

SEQ ID NO: 587845 - DNA, 25 bp, Mus musculus
ccagctctgtgggaatgaatattac

SEQ ID NO: 587846 - DNA, 25 bp, Mus musculus
ccagctctgttgagggcggaagtcc

SEQ ID NO: 587847 - DNA, 25 bp, Mus musculus
ccagctctgttgtgggcggaagtcc

SEQ ID NO: 587848 - DNA, 25 bp, Mus musculus
ccagctcttctgcaggcttatgagt

SEQ ID NO: 587849 - DNA, 25 bp, Mus musculus
ccagctcttctggaggcttatgagt

SEQ ID NO: 587850 - DNA, 25 bp, Mus musculus
ccagctcttgctatcggacgcgcag

SEQ ID NO: 587851 - DNA, 25 bp, Mus musculus
ccagctcttgctttcggacgcgcag

SEQ ID NO: 587852 - DNA, 25 bp, Mus musculus
ccagctcttggaaggggctataaca

SEQ ID NO: 587853 - DNA, 25 bp, Mus musculus
ccagctcttggatggggctataaca

SEQ ID NO: 587854 - DNA, 25 bp, Mus musculus
ccagctgacgtgatgagactccaca

SEQ ID NO: 587855 - DNA, 25 bp, Mus musculus
ccagctgacgtgttgagactccaca

SEQ ID NO: 587856 - DNA, 25 bp, Mus musculus
ccagctgactcacgtaacgaccaag

SEQ ID NO: 587857 - DNA, 25 bp, Mus musculus
ccagctgactcaggtaacgaccaag

SEQ ID NO: 587858 - DNA, 25 bp, Mus musculus
ccagctgagccacctgaagcagtac

SEQ ID NO: 587859 - DNA, 25 bp, Mus musculus
ccagctgagccagctgaagcagtac

SEQ ID NO: 587860 - DNA, 25 bp, Mus musculus
ccagctgaggagaggcagtgagtcc

SEQ ID NO: 587861 - DNA, 25 bp, Mus musculus
ccagctgaggagtggcagtgagtcc

SEQ ID NO: 587862 - DNA, 25 bp, Mus musculus
ccagctgagggtcccaaagacagga

SEQ ID NO: 587863 - DNA, 25 bp, Mus musculus
ccagctgagggtgccaaagacagga

SEQ ID NO: 587864 - DNA, 25 bp, Mus musculus
ccagctgatcatccaggcagaagcc

SEQ ID NO: 587865 - DNA, 25 bp, Mus musculus
ccagctgatcatgcaggcagaagcc

SEQ ID NO: 587866 - DNA, 25 bp, Mus musculus
ccagctgatcgtagtggaggactga

SEQ ID NO: 587867 - DNA, 25 bp, Mus musculus
ccagctgatcgttgtggaggactga

SEQ ID NO: 587868 - DNA, 25 bp, Mus musculus
ccagctgattgacgcgggtccttct

SEQ ID NO: 587869 - DNA, 25 bp, Mus musculus
ccagctgattgaggcgggtccttct

SEQ ID NO: 587870 - DNA, 25 bp, Mus musculus
ccagctgccattccggtggctggct

SEQ ID NO: 587871 - DNA, 25 bp, Mus musculus
ccagctgccattgcggtggctggct

SEQ ID NO: 587872 - DNA, 25 bp, Mus musculus
ccagctgcctcaaaggagaattcag

SEQ ID NO: 587873 - DNA, 25 bp, Mus musculus
ccagctgcctcataggagaattcag

SEQ ID NO: 587874 - DNA, 25 bp, Mus musculus
ccagctgcgataactattgaaatca

SEQ ID NO: 587875 - DNA, 25 bp, Mus musculus
ccagctgcgatatctattgaaatca

SEQ ID NO: 587876 - DNA, 25 bp, Mus musculus
ccagctgcgcagactgtatgaaacc

SEQ ID NO: 587877 - DNA, 25 bp, Mus musculus
ccagctgcgcagtctgtatgaaacc

SEQ ID NO: 587878 - DNA, 25 bp, Mus musculus
ccagctgcgctgacctctttgtcta

SEQ ID NO: 587879 - DNA, 25 bp, Mus musculus
ccagctgcgctgtcctctttgtcta

SEQ ID NO: 587880 - DNA, 25 bp, Mus musculus
ccagctgcgtacattgcctctggct

SEQ ID NO: 587881 - DNA, 25 bp, Mus musculus
ccagctgcgtactttgcctctggct

SEQ ID NO: 587882 - DNA, 25 bp, Mus musculus
ccagctgcgttgattcctggtgcta

SEQ ID NO: 587883 - DNA, 25 bp, Mus musculus
ccagctgcgttgtttcctggtgcta

SEQ ID NO: 587884 - DNA, 25 bp, Mus musculus
ccagctgctcctaattcgagatgag

SEQ ID NO: 587885 - DNA, 25 bp, Mus musculus
ccagctgctccttattcgagatgag

SEQ ID NO: 587886 - DNA, 25 bp, Mus musculus
ccagctgctgcaagcgcagtatcac

SEQ ID NO: 587887 - DNA, 25 bp, Mus musculus
ccagctgctgcatgcgcagtatcac

SEQ ID NO: 587888 - DNA, 25 bp, Mus musculus
ccagctggaaaacctgatggagaac

SEQ ID NO: 587889 - DNA, 25 bp, Mus musculus
ccagctggaaaagctgatggagaac

SEQ ID NO: 587890 - DNA, 25 bp, Mus musculus
ccagctggaaatctagggagaccag

SEQ ID NO: 587891 - DNA, 25 bp, Mus musculus
ccagctggaaatgtagggagaccag

SEQ ID NO: 587892 - DNA, 25 bp, Mus musculus
ccagctggaagaccttgtgatcgag

SEQ ID NO: 587893 - DNA, 25 bp, Mus musculus
ccagctggaagagcttgtgatcgag

SEQ ID NO: 587894 - DNA, 25 bp, Mus musculus
ccagctggaagtcttgctgacgcca

SEQ ID NO: 587895 - DNA, 25 bp, Mus musculus
ccagctggaagtgttgctgacgcca

SEQ ID NO: 587896 - DNA, 25 bp, Mus musculus
ccagctggcccaacgaaatatatca

SEQ ID NO: 587897 - DNA, 25 bp, Mus musculus
ccagctggcccacaattggatcaaa

SEQ ID NO: 587898 - DNA, 25 bp, Mus musculus
ccagctggcccagaattggatcaaa

SEQ ID NO: 587899 - DNA, 25 bp, Mus musculus
ccagctggcccatcgaaatatatca

SEQ ID NO: 587900 - DNA, 25 bp, Mus musculus
ccagctgggaagcaggttacaactt

SEQ ID NO: 587901 - DNA, 25 bp, Mus musculus
ccagctgggaaggaggttacaactt

SEQ ID NO: 587902 - DNA, 25 bp, Mus musculus
ccagctgggcttagcaccaggcgat

SEQ ID NO: 587903 - DNA, 25 bp, Mus musculus
ccagctgggctttgcaccaggcgat

SEQ ID NO: 587904 - DNA, 25 bp, Mus musculus
ccagctggtctaagtggaaagggct

SEQ ID NO: 587905 - DNA, 25 bp, Mus musculus
ccagctggtctatgtggaaagggct

SEQ ID NO: 587906 - DNA, 25 bp, Mus musculus
ccagctggtggtcacattccgggaa

SEQ ID NO: 587907 - DNA, 25 bp, Mus musculus
ccagctggtggtgacattccgggaa

SEQ ID NO: 587908 - DNA, 25 bp, Mus musculus
ccagctgtcacaagcagttttccca

SEQ ID NO: 587909 - DNA, 25 bp, Mus musculus
ccagctgtcacatgcagttttccca

SEQ ID NO: 587910 - DNA, 25 bp, Mus musculus
ccagctgtgcctacttccagtgttt

SEQ ID NO: 587911 - DNA, 25 bp, Mus musculus
ccagctgtgccttcttccagtgttt

SEQ ID NO: 587912 - DNA, 25 bp, Mus musculus
ccagctgtggatccactggactcca

SEQ ID NO: 587913 - DNA, 25 bp, Mus musculus
ccagctgtggatgcactggactcca

SEQ ID NO: 587914 - DNA, 25 bp, Mus musculus
ccagctgtttgtcatctgctaattt

SEQ ID NO: 587915 - DNA, 25 bp, Mus musculus
ccagctgtttgtgatctgctaattt

SEQ ID NO: 587916 - DNA, 25 bp, Mus musculus
ccagcttagatgatctggacccaaa

SEQ ID NO: 587917 - DNA, 25 bp, Mus musculus
ccagcttagatgttctggacccaaa

SEQ ID NO: 587918 - DNA, 25 bp, Mus musculus
ccagcttatcaaagttgtgcacaca

SEQ ID NO: 587919 - DNA, 25 bp, Mus musculus
ccagcttatcaatgttgtgcacaca

SEQ ID NO: 587920 - DNA, 25 bp, Mus musculus
ccagcttatcctaacactggcatgg

SEQ ID NO: 587921 - DNA, 25 bp, Mus musculus
ccagcttatccttacactggcatgg

SEQ ID NO: 587922 - DNA, 25 bp, Mus musculus
ccagcttccagaaccgagactatgt

SEQ ID NO: 587923 - DNA, 25 bp, Mus musculus
ccagcttccagatccgagactatgt

SEQ ID NO: 587924 - DNA, 25 bp, Mus musculus
ccagcttcccgtacagatacaagca

SEQ ID NO: 587925 - DNA, 25 bp, Mus musculus
ccagcttcccgttcagatacaagca

SEQ ID NO: 587926 - DNA, 25 bp, Mus musculus
ccagcttcctcgaaagtgatcagag

SEQ ID NO: 587927 - DNA, 25 bp, Mus musculus
ccagcttcctcgtaagtgatcagag

SEQ ID NO: 587928 - DNA, 25 bp, Mus musculus
ccagcttcgagcacgtggaccgctt

SEQ ID NO: 587929 - DNA, 25 bp, Mus musculus
ccagcttcgagctcgtggaccgctt

SEQ ID NO: 587930 - DNA, 25 bp, Mus musculus
ccagcttctctgacgcggaggaagt

SEQ ID NO: 587931 - DNA, 25 bp, Mus musculus
ccagcttctctgtcgcggaggaagt

SEQ ID NO: 587932 - DNA, 25 bp, Mus musculus
ccagcttctggtcgatcaggccaaa

SEQ ID NO: 587933 - DNA, 25 bp, Mus musculus
ccagcttctggtggatcaggccaaa

SEQ ID NO: 587934 - DNA, 25 bp, Mus musculus
ccagcttgccaaagcagtcagcctg

SEQ ID NO: 587935 - DNA, 25 bp, Mus musculus
ccagcttgccaatgcagtcagcctg

SEQ ID NO: 587936 - DNA, 25 bp, Mus musculus
ccagcttggagaagtggagaattta

SEQ ID NO: 587937 - DNA, 25 bp, Mus musculus
ccagcttggagatgtggagaattta

SEQ ID NO: 587938 - DNA, 25 bp, Mus musculus
ccagcttggcgtctgcgccatggac

SEQ ID NO: 587939 - DNA, 25 bp, Mus musculus
ccagcttggcgtgtgcgccatggac

SEQ ID NO: 587940 - DNA, 25 bp, Mus musculus
ccagcttggcttcgatgtgcaacct

SEQ ID NO: 587941 - DNA, 25 bp, Mus musculus
ccagcttggcttggatgtgcaacct

SEQ ID NO: 587942 - DNA, 25 bp, Mus musculus
ccagcttgggtaccatagcgggtac

SEQ ID NO: 587943 - DNA, 25 bp, Mus musculus
ccagcttgggtagcatagcgggtac

SEQ ID NO: 587944 - DNA, 25 bp, Mus musculus
ccagcttggttgcatcctgatttag

SEQ ID NO: 587945 - DNA, 25 bp, Mus musculus
ccagcttggttggatcctgatttag

SEQ ID NO: 587946 - DNA, 25 bp, Mus musculus
ccagcttgtggcaggtgagcacagc

SEQ ID NO: 587947 - DNA, 25 bp, Mus musculus
ccagcttgtggctggtgagcacagc

SEQ ID NO: 587948 - DNA, 25 bp, Mus musculus
ccagcttgtgtgctgcatgtcaaga

SEQ ID NO: 587949 - DNA, 25 bp, Mus musculus
ccagcttgtgtggtgcatgtcaaga

SEQ ID NO: 587950 - DNA, 25 bp, Mus musculus
ccagctttcacgctgcttcatttca

SEQ ID NO: 587951 - DNA, 25 bp, Mus musculus
ccagctttcacggtgcttcatttca

SEQ ID NO: 587952 - DNA, 25 bp, Mus musculus
ccagctttcagccaatgaggtttct

SEQ ID NO: 587953 - DNA, 25 bp, Mus musculus
ccagctttcagcgaatgaggtttct

SEQ ID NO: 587954 - DNA, 25 bp, Mus musculus
ccagctttgagaaagcggcacaatg

SEQ ID NO: 587955 - DNA, 25 bp, Mus musculus
ccagctttgagatagcggcacaatg

SEQ ID NO: 587956 - DNA, 25 bp, Mus musculus
ccagctttgcaaattgatggcaaag

SEQ ID NO: 587957 - DNA, 25 bp, Mus musculus
ccagctttgcaatttgatggcaaag

SEQ ID NO: 587958 - DNA, 25 bp, Mus musculus
ccagctttgccaaggttttgaatga

SEQ ID NO: 587959 - DNA, 25 bp, Mus musculus
ccagctttgccatggttttgaatga

SEQ ID NO: 587960 - DNA, 25 bp, Mus musculus
ccagctttgcctatgcccagagttt

SEQ ID NO: 587961 - DNA, 25 bp, Mus musculus
ccagctttgcctttgcccagagttt

SEQ ID NO: 587962 - DNA, 25 bp, Mus musculus
ccagctttgctacatgtcacaggcg

SEQ ID NO: 587963 - DNA, 25 bp, Mus musculus
ccagctttgctagatgtcacaggcg

SEQ ID NO: 587964 - DNA, 25 bp, Mus musculus
ccagctttgctcaggaccagcagct

SEQ ID NO: 587965 - DNA, 25 bp, Mus musculus
ccagctttgctctggaccagcagct

SEQ ID NO: 587966 - DNA, 25 bp, Mus musculus
ccagctttggacctgtgtcagatgt

SEQ ID NO: 587967 - DNA, 25 bp, Mus musculus
ccagctttggacgtgtgtcagatgt

SEQ ID NO: 587968 - DNA, 25 bp, Mus musculus
ccagctttgggcattggatccatat

SEQ ID NO: 587969 - DNA, 25 bp, Mus musculus
ccagctttgggctttggatccatat

SEQ ID NO: 587970 - DNA, 25 bp, Mus musculus
ccagctttgtgaagttgtagatgtc

SEQ ID NO: 587971 - DNA, 25 bp, Mus musculus
ccagctttgtgatgttgtagatgtc

SEQ ID NO: 587972 - DNA, 25 bp, Mus musculus
ccagcttttggcatcggagctcgaa

SEQ ID NO: 587973 - DNA, 25 bp, Mus musculus
ccagcttttggcttcggagctcgaa

SEQ ID NO: 587974 - DNA, 25 bp, Mus musculus
ccaggaaaatgaagatggttgggca

SEQ ID NO: 587975 - DNA, 25 bp, Mus musculus
ccaggaaaatgatgatggttgggca

SEQ ID NO: 587976 - DNA, 25 bp, Mus musculus
ccaggaaacgcacgcactgcgtgcg

SEQ ID NO: 587977 - DNA, 25 bp, Mus musculus
ccaggaaacgcaggcactgcgtgcg

SEQ ID NO: 587978 - DNA, 25 bp, Mus musculus
ccaggaaagagcaggagtctcccaa

SEQ ID NO: 587979 - DNA, 25 bp, Mus musculus
ccaggaaagagctggagtctcccaa

SEQ ID NO: 587980 - DNA, 25 bp, Mus musculus
ccaggaaataatccttatggatccc

SEQ ID NO: 587981 - DNA, 25 bp, Mus musculus
ccaggaaataatgcttatggatccc

SEQ ID NO: 587982 - DNA, 25 bp, Mus musculus
ccaggaaatgaacatagaactcatt

SEQ ID NO: 587983 - DNA, 25 bp, Mus musculus
ccaggaaatgaagatagaactcatt

SEQ ID NO: 587984 - DNA, 25 bp, Mus musculus
ccaggaaatggcaagagaatagtca

SEQ ID NO: 587985 - DNA, 25 bp, Mus musculus
ccaggaaatggctagagaatagtca

SEQ ID NO: 587986 - DNA, 25 bp, Mus musculus
ccaggaacaaaaagacaccagtttg

SEQ ID NO: 587987 - DNA, 25 bp, Mus musculus
ccaggaacaaaatgacaccagtttg

SEQ ID NO: 587988 - DNA, 25 bp, Mus musculus
ccaggaacagccacatgcagctgaa

SEQ ID NO: 587989 - DNA, 25 bp, Mus musculus
ccaggaacagcctcatgcagctgaa

SEQ ID NO: 587990 - DNA, 25 bp, Mus musculus
ccaggaaccagacttgctttggata

SEQ ID NO: 587991 - DNA, 25 bp, Mus musculus
ccaggaaccagagttgctttggata

SEQ ID NO: 587992 - DNA, 25 bp, Mus musculus
ccaggaaccattccttggaagagga

SEQ ID NO: 587993 - DNA, 25 bp, Mus musculus
ccaggaaccattgcttggaagagga

SEQ ID NO: 587994 - DNA, 25 bp, Mus musculus
ccaggaactcggcagaacgatcgtc

SEQ ID NO: 587995 - DNA, 25 bp, Mus musculus
ccaggaactcgggagaacgatcgtc

SEQ ID NO: 587996 - DNA, 25 bp, Mus musculus
ccaggaactggactcactgatgttg

SEQ ID NO: 587997 - DNA, 25 bp, Mus musculus
ccaggaactggagtcactgatgttg

SEQ ID NO: 587998 - DNA, 25 bp, Mus musculus
ccaggaagaataagcacagtgccaa

SEQ ID NO: 587999 - DNA, 25 bp, Mus musculus
ccaggaagaatatgcacagtgccaa

SEQ ID NO: 588000 - DNA, 25 bp, Mus musculus
ccaggaagagatcattgacaccaat

SEQ ID NO: 588001 - DNA, 25 bp, Mus musculus
ccaggaagagatgattgacaccaat

SEQ ID NO: 588002 - DNA, 25 bp, Mus musculus
ccaggaagattacatagaaaaatac

SEQ ID NO: 588003 - DNA, 25 bp, Mus musculus
ccaggaagattagatagaaaaatac

SEQ ID NO: 588004 - DNA, 25 bp, Mus musculus
ccaggaagcaatccctcaagaggcg

SEQ ID NO: 588005 - DNA, 25 bp, Mus musculus
ccaggaagcaatgcctcaagaggcg

SEQ ID NO: 588006 - DNA, 25 bp, Mus musculus
ccaggaagcccaccgtgtgtgagtc

SEQ ID NO: 588007 - DNA, 25 bp, Mus musculus
ccaggaagcccagcgtgtgtgagtc

SEQ ID NO: 588008 - DNA, 25 bp, Mus musculus
ccaggaagccctcatcacagtgaaa

SEQ ID NO: 588009 - DNA, 25 bp, Mus musculus
ccaggaagccctgatcacagtgaaa

SEQ ID NO: 588010 - DNA, 25 bp, Mus musculus
ccaggaagctctatagacagataca

SEQ ID NO: 588011 - DNA, 25 bp, Mus musculus
ccaggaagctctttagacagataca

SEQ ID NO: 588012 - DNA, 25 bp, Mus musculus
ccaggaaggaccacgtggacttgtg

SEQ ID NO: 588013 - DNA, 25 bp, Mus musculus
ccaggaaggacctcgtggacttgtg

SEQ ID NO: 588014 - DNA, 25 bp, Mus musculus
ccaggaaggtctcggtccacttctt

SEQ ID NO: 588015 - DNA, 25 bp, Mus musculus
ccaggaaggtctgggtccacttctt

SEQ ID NO: 588016 - DNA, 25 bp, Mus musculus
ccaggaagtcttctgtgttgaaaag

SEQ ID NO: 588017 - DNA, 25 bp, Mus musculus
ccaggaagtcttgtgtgttgaaaag

SEQ ID NO: 588018 - DNA, 25 bp, Mus musculus
ccaggaagttgcagtggtgtacttc

SEQ ID NO: 588019 - DNA, 25 bp, Mus musculus
ccaggaagttgctgtggtgtacttc

SEQ ID NO: 588020 - DNA, 25 bp, Mus musculus
ccaggaatcagaaagctgccatctt

SEQ ID NO: 588021 - DNA, 25 bp, Mus musculus
ccaggaatcagatagctgccatctt

SEQ ID NO: 588022 - DNA, 25 bp, Mus musculus
ccaggaatcagcaaagacttaagag

SEQ ID NO: 588023 - DNA, 25 bp, Mus musculus
ccaggaatcagccaagagtgccagg

SEQ ID NO: 588024 - DNA, 25 bp, Mus musculus
ccaggaatcagcgaagagtgccagg

SEQ ID NO: 588025 - DNA, 25 bp, Mus musculus
ccaggaatcagctaagacttaagag

SEQ ID NO: 588026 - DNA, 25 bp, Mus musculus
ccaggaatcatgcaaggctagggac

SEQ ID NO: 588027 - DNA, 25 bp, Mus musculus
ccaggaatcatggaaggctagggac

SEQ ID NO: 588028 - DNA, 25 bp, Mus musculus
ccaggaatccttcagacaagttatc

SEQ ID NO: 588029 - DNA, 25 bp, Mus musculus
ccaggaatccttgagacaagttatc

SEQ ID NO: 588030 - DNA, 25 bp, Mus musculus
ccaggaatggacagccggaagcaga

SEQ ID NO: 588031 - DNA, 25 bp, Mus musculus
ccaggaatggactgccggaagcaga

SEQ ID NO: 588032 - DNA, 25 bp, Mus musculus
ccaggaatgtaacacgaagtaccga

SEQ ID NO: 588033 - DNA, 25 bp, Mus musculus
ccaggaatgtaagacgaagtaccga

SEQ ID NO: 588034 - DNA, 25 bp, Mus musculus
ccaggaattcctcttgtccaagtca

SEQ ID NO: 588035 - DNA, 25 bp, Mus musculus
ccaggaattcctgttgtccaagtca

SEQ ID NO: 588036 - DNA, 25 bp, Mus musculus
ccaggacaacacaaaggagggagag

SEQ ID NO: 588037 - DNA, 25 bp, Mus musculus
ccaggacaacactaaggagggagag

SEQ ID NO: 588038 - DNA, 25 bp, Mus musculus
ccaggacaactccagatgagaaacg

SEQ ID NO: 588039 - DNA, 25 bp, Mus musculus
ccaggacaactcgagatgagaaacg

SEQ ID NO: 588040 - DNA, 25 bp, Mus musculus
ccaggacaagttcacgggcatccag

SEQ ID NO: 588041 - DNA, 25 bp, Mus musculus
ccaggacaagttgacgggcatccag

SEQ ID NO: 588042 - DNA, 25 bp, Mus musculus
ccaggacacaagacagtacgtgtgc

SEQ ID NO: 588043 - DNA, 25 bp, Mus musculus
ccaggacacaagcacagggttagaa

SEQ ID NO: 588044 - DNA, 25 bp, Mus musculus
ccaggacacaaggacagggttagaa

SEQ ID NO: 588045 - DNA, 25 bp, Mus musculus
ccaggacacaagtcagtacgtgtgc

SEQ ID NO: 588046 - DNA, 25 bp, Mus musculus
ccaggacagtggagtgaccacaact

SEQ ID NO: 588047 - DNA, 25 bp, Mus musculus
ccaggacagtggtgtgaccacaact

SEQ ID NO: 588048 - DNA, 25 bp, Mus musculus
ccaggacatcatcttcacttctggg

SEQ ID NO: 588049 - DNA, 25 bp, Mus musculus
ccaggacatcatgttcacttctggg

SEQ ID NO: 588050 - DNA, 25 bp, Mus musculus
ccaggacatcttataccaggaggat

SEQ ID NO: 588051 - DNA, 25 bp, Mus musculus
ccaggacatcttttaccaggaggat

SEQ ID NO: 588052 - DNA, 25 bp, Mus musculus
ccaggacatgagctgcatagaatga

SEQ ID NO: 588053 - DNA, 25 bp, Mus musculus
ccaggacatgaggtgcatagaatga

SEQ ID NO: 588054 - DNA, 25 bp, Mus musculus
ccaggacatttaacaggtgccacct

SEQ ID NO: 588055 - DNA, 25 bp, Mus musculus
ccaggacatttatcaggtgccacct

SEQ ID NO: 588056 - DNA, 25 bp, Mus musculus
ccaggaccatatccgggctcattac

SEQ ID NO: 588057 - DNA, 25 bp, Mus musculus
ccaggaccatatgcgggctcattac

SEQ ID NO: 588058 - DNA, 25 bp, Mus musculus
ccaggaccttaccaagcagctgcag

SEQ ID NO: 588059 - DNA, 25 bp, Mus musculus
ccaggaccttacgaagcagctgcag

SEQ ID NO: 588060 - DNA, 25 bp, Mus musculus
ccaggaccttatcaaaggtatccca

SEQ ID NO: 588061 - DNA, 25 bp, Mus musculus
ccaggaccttatgaaaggtatccca

SEQ ID NO: 588062 - DNA, 25 bp, Mus musculus
ccaggaccttgactttgagtggctg

SEQ ID NO: 588063 - DNA, 25 bp, Mus musculus
ccaggaccttgagtttgagtggctg

SEQ ID NO: 588064 - DNA, 25 bp, Mus musculus
ccaggacgacctcgtgaagaccaaa

SEQ ID NO: 588065 - DNA, 25 bp, Mus musculus
ccaggacgacctggtgaagaccaaa

SEQ ID NO: 588066 - DNA, 25 bp, Mus musculus
ccaggacgctttccggagcagagca

SEQ ID NO: 588067 - DNA, 25 bp, Mus musculus
ccaggacgctttgcggagcagagca

SEQ ID NO: 588068 - DNA, 25 bp, Mus musculus
ccaggacgtcagcaacccagtcatt

SEQ ID NO: 588069 - DNA, 25 bp, Mus musculus
ccaggacgtcaggaacccagtcatt

SEQ ID NO: 588070 - DNA, 25 bp, Mus musculus
ccaggactatgtcagtctacaggat

SEQ ID NO: 588071 - DNA, 25 bp, Mus musculus
ccaggactatgtgagtctacaggat

SEQ ID NO: 588072 - DNA, 25 bp, Mus musculus
ccaggactcaataatttgttcgaca

SEQ ID NO: 588073 - DNA, 25 bp, Mus musculus
ccaggactcaattatttgttcgaca

SEQ ID NO: 588074 - DNA, 25 bp, Mus musculus
ccaggactctcaagctggcatcata

SEQ ID NO: 588075 - DNA, 25 bp, Mus musculus
ccaggactctcatgctggcatcata

SEQ ID NO: 588076 - DNA, 25 bp, Mus musculus
ccaggactctgcaaagggctcatcc

SEQ ID NO: 588077 - DNA, 25 bp, Mus musculus
ccaggactctgctaagggctcatcc

SEQ ID NO: 588078 - DNA, 25 bp, Mus musculus
ccaggactgatcaaatgggaagacc

SEQ ID NO: 588079 - DNA, 25 bp, Mus musculus
ccaggactgatctaatgggaagacc

SEQ ID NO: 588080 - DNA, 25 bp, Mus musculus
ccaggactgtcacatgcagctgaga

SEQ ID NO: 588081 - DNA, 25 bp, Mus musculus
ccaggactgtcagatgcagctgaga

SEQ ID NO: 588082 - DNA, 25 bp, Mus musculus
ccaggactgtgtaaacgtgcagtgt

SEQ ID NO: 588083 - DNA, 25 bp, Mus musculus
ccaggactgtgttaacgtgcagtgt

SEQ ID NO: 588084 - DNA, 25 bp, Mus musculus
ccaggacttccgcagtttccggtca

SEQ ID NO: 588085 - DNA, 25 bp, Mus musculus
ccaggacttccggagtttccggtca

SEQ ID NO: 588086 - DNA, 25 bp, Mus musculus
ccaggagaaacacccgtactacgag

SEQ ID NO: 588087 - DNA, 25 bp, Mus musculus
ccaggagaaacagccgtactacgag

SEQ ID NO: 588088 - DNA, 25 bp, Mus musculus
ccaggagaaagcatgtgagcagccc

SEQ ID NO: 588089 - DNA, 25 bp, Mus musculus
ccaggagaaagcttgtgagcagccc

SEQ ID NO: 588090 - DNA, 25 bp, Mus musculus
ccaggagaacctcctagctgtgggc

SEQ ID NO: 588091 - DNA, 25 bp, Mus musculus
ccaggagaacctgctagctgtgggc

SEQ ID NO: 588092 - DNA, 25 bp, Mus musculus
ccaggagaacgtaccgcaggcacat

SEQ ID NO: 588093 - DNA, 25 bp, Mus musculus
ccaggagaacgttccgcaggcacat

SEQ ID NO: 588094 - DNA, 25 bp, Mus musculus
ccaggagacatcaactgccctttta

SEQ ID NO: 588095 - DNA, 25 bp, Mus musculus
ccaggagacatctactgccctttta

SEQ ID NO: 588096 - DNA, 25 bp, Mus musculus
ccaggagacttactttaagtcccag

SEQ ID NO: 588097 - DNA, 25 bp, Mus musculus
ccaggagacttagtttaagtcccag

SEQ ID NO: 588098 - DNA, 25 bp, Mus musculus
ccaggagagaaacctgtcatgagct

SEQ ID NO: 588099 - DNA, 25 bp, Mus musculus
ccaggagagaaagctgtcatgagct

SEQ ID NO: 588100 - DNA, 25 bp, Mus musculus
ccaggagagtgaaaacttatatcag

SEQ ID NO: 588101 - DNA, 25 bp, Mus musculus
ccaggagagtgataacttatatcag

SEQ ID NO: 588102 - DNA, 25 bp, Mus musculus
ccaggagagtgtagccaagatgata

SEQ ID NO: 588103 - DNA, 25 bp, Mus musculus
ccaggagagtgttgccaagatgata

SEQ ID NO: 588104 - DNA, 25 bp, Mus musculus
ccaggagatcagaaccccaggagcc

SEQ ID NO: 588105 - DNA, 25 bp, Mus musculus
ccaggagatcagagaaatgcatgat

SEQ ID NO: 588106 - DNA, 25 bp, Mus musculus
ccaggagatcagtaccccaggagcc

SEQ ID NO: 588107 - DNA, 25 bp, Mus musculus
ccaggagatcagtgaaatgcatgat

SEQ ID NO: 588108 - DNA, 25 bp, Mus musculus
ccaggagatttacagccaggttcag

SEQ ID NO: 588109 - DNA, 25 bp, Mus musculus
ccaggagatttagagccaggttcag

SEQ ID NO: 588110 - DNA, 25 bp, Mus musculus
ccaggagcagccaagtctgcagtgg

SEQ ID NO: 588111 - DNA, 25 bp, Mus musculus
ccaggagcagcctagtctgcagtgg

SEQ ID NO: 588112 - DNA, 25 bp, Mus musculus
ccaggagcagctcacgaaagagaag

SEQ ID NO: 588113 - DNA, 25 bp, Mus musculus
ccaggagcagctgacgaaagagaag

SEQ ID NO: 588114 - DNA, 25 bp, Mus musculus
ccaggagcagttcatccagatgttg

SEQ ID NO: 588115 - DNA, 25 bp, Mus musculus
ccaggagcagttgatccagatgttg

SEQ ID NO: 588116 - DNA, 25 bp, Mus musculus
ccaggagcccaaaggttgcagttcc

SEQ ID NO: 588117 - DNA, 25 bp, Mus musculus
ccaggagcccaatggttgcagttcc

SEQ ID NO: 588118 - DNA, 25 bp, Mus musculus
ccaggagcctctacagctccaagat

SEQ ID NO: 588119 - DNA, 25 bp, Mus musculus
ccaggagcctcttcagctccaagat

SEQ ID NO: 588120 - DNA, 25 bp, Mus musculus
ccaggagctcatccaactgaaggct

SEQ ID NO: 588121 - DNA, 25 bp, Mus musculus
ccaggagctcatgcaactgaaggct

SEQ ID NO: 588122 - DNA, 25 bp, Mus musculus
ccaggagctcgacatcaggaagaac

SEQ ID NO: 588123 - DNA, 25 bp, Mus musculus
ccaggagctcgagatcaggaagaac

SEQ ID NO: 588124 - DNA, 25 bp, Mus musculus
ccaggagctgtgaaagtcccagctg

SEQ ID NO: 588125 - DNA, 25 bp, Mus musculus
ccaggagctgtgtaagtcccagctg

SEQ ID NO: 588126 - DNA, 25 bp, Mus musculus
ccaggaggaagcagcctgctcggaa

SEQ ID NO: 588127 - DNA, 25 bp, Mus musculus
ccaggaggaagctgcctgctcggaa

SEQ ID NO: 588128 - DNA, 25 bp, Mus musculus
ccaggaggacacatgaaagagatcc

SEQ ID NO: 588129 - DNA, 25 bp, Mus musculus
ccaggaggacacttgaaagagatcc

SEQ ID NO: 588130 - DNA, 25 bp, Mus musculus
ccaggaggaccaagccgctgggcat

SEQ ID NO: 588131 - DNA, 25 bp, Mus musculus
ccaggaggaccatgccgctgggcat

SEQ ID NO: 588132 - DNA, 25 bp, Mus musculus
ccaggaggagccacctgccaagctg

SEQ ID NO: 588133 - DNA, 25 bp, Mus musculus
ccaggaggagcctcctgccaagctg

SEQ ID NO: 588134 - DNA, 25 bp, Mus musculus
ccaggaggagttacagatcatccgg

SEQ ID NO: 588135 - DNA, 25 bp, Mus musculus
ccaggaggagtttcagatcatccgg

SEQ ID NO: 588136 - DNA, 25 bp, Mus musculus
ccaggaggcaaacgatgattcggct

SEQ ID NO: 588137 - DNA, 25 bp, Mus musculus
ccaggaggcaaaggatgattcggct

SEQ ID NO: 588138 - DNA, 25 bp, Mus musculus
ccaggagggagaagtaacctttgag

SEQ ID NO: 588139 - DNA, 25 bp, Mus musculus
ccaggagggagatgtaacctttgag

SEQ ID NO: 588140 - DNA, 25 bp, Mus musculus
ccaggagtcaagctgtagagctaca

SEQ ID NO: 588141 - DNA, 25 bp, Mus musculus
ccaggagtcaaggtgtagagctaca

SEQ ID NO: 588142 - DNA, 25 bp, Mus musculus
ccaggagtccaacgagatgttcccc

SEQ ID NO: 588143 - DNA, 25 bp, Mus musculus
ccaggagtccaaggagatgttcccc

SEQ ID NO: 588144 - DNA, 25 bp, Mus musculus
ccaggagtgaacaagcgaaggcaga

SEQ ID NO: 588145 - DNA, 25 bp, Mus musculus
ccaggagtgaactagcgaaggcaga

SEQ ID NO: 588146 - DNA, 25 bp, Mus musculus
ccaggagtgagcagcttcctacaga

SEQ ID NO: 588147 - DNA, 25 bp, Mus musculus
ccaggagtgagctgcttcctacaga

SEQ ID NO: 588148 - DNA, 25 bp, Mus musculus
ccaggagtggaaaggtcacctctca

SEQ ID NO: 588149 - DNA, 25 bp, Mus musculus
ccaggagtggaatggtcacctctca

SEQ ID NO: 588150 - DNA, 25 bp, Mus musculus
ccaggagttctcacctgacgtcgtc

SEQ ID NO: 588151 - DNA, 25 bp, Mus musculus
ccaggagttctctcctgacgtcgtc

SEQ ID NO: 588152 - DNA, 25 bp, Mus musculus
ccaggagttgatcgctgaagcaaaa

SEQ ID NO: 588153 - DNA, 25 bp, Mus musculus
ccaggagttgatggctgaagcaaaa

SEQ ID NO: 588154 - DNA, 25 bp, Mus musculus
ccaggataccaaagccttaagtgac

SEQ ID NO: 588155 - DNA, 25 bp, Mus musculus
ccaggataccaatgccttaagtgac

SEQ ID NO: 588156 - DNA, 25 bp, Mus musculus
ccaggataccggcagagtcctagtg

SEQ ID NO: 588157 - DNA, 25 bp, Mus musculus
ccaggataccgggagagtcctagtg

SEQ ID NO: 588158 - DNA, 25 bp, Mus musculus
ccaggatagaggcacaggaactgct

SEQ ID NO: 588159 - DNA, 25 bp, Mus musculus
ccaggatagagggacaggaactgct

SEQ ID NO: 588160 - DNA, 25 bp, Mus musculus
ccaggatagcgaaagagcgagcaga

SEQ ID NO: 588161 - DNA, 25 bp, Mus musculus
ccaggatagcgatagagcgagcaga

SEQ ID NO: 588162 - DNA, 25 bp, Mus musculus
ccaggatccagtaaaaataatggtg

SEQ ID NO: 588163 - DNA, 25 bp, Mus musculus
ccaggatccagttaaaataatggtg

SEQ ID NO: 588164 - DNA, 25 bp, Mus musculus
ccaggatcctctagatcaagctgac

SEQ ID NO: 588165 - DNA, 25 bp, Mus musculus
ccaggatcctcttgatcaagctgac

SEQ ID NO: 588166 - DNA, 25 bp, Mus musculus
ccaggatcgaaaccaagacagtcat

SEQ ID NO: 588167 - DNA, 25 bp, Mus musculus
ccaggatcgaaagcaagacagtcat

SEQ ID NO: 588168 - DNA, 25 bp, Mus musculus
ccaggatcggtgctctgtatgtacg

SEQ ID NO: 588169 - DNA, 25 bp, Mus musculus
ccaggatcggtggtctgtatgtacg

SEQ ID NO: 588170 - DNA, 25 bp, Mus musculus
ccaggatctgttctgccggctaatc

SEQ ID NO: 588171 - DNA, 25 bp, Mus musculus
ccaggatctgttgtgccggctaatc

SEQ ID NO: 588172 - DNA, 25 bp, Mus musculus
ccaggatgagggagctatcccagtg

SEQ ID NO: 588173 - DNA, 25 bp, Mus musculus
ccaggatgagggtgctatcccagtg

SEQ ID NO: 588174 - DNA, 25 bp, Mus musculus
ccaggatgatgtcaatggacaatgg

SEQ ID NO: 588175 - DNA, 25 bp, Mus musculus
ccaggatgatgtgaatggacaatgg

SEQ ID NO: 588176 - DNA, 25 bp, Mus musculus
ccaggatgcgccatgaagcaagtaa

SEQ ID NO: 588177 - DNA, 25 bp, Mus musculus
ccaggatgcgccttgaagcaagtaa

SEQ ID NO: 588178 - DNA, 25 bp, Mus musculus
ccaggatggacccttcagttataga

SEQ ID NO: 588179 - DNA, 25 bp, Mus musculus
ccaggatggaccgttcagttataga

SEQ ID NO: 588180 - DNA, 25 bp, Mus musculus
ccaggatggcatagggcagcgtcaa

SEQ ID NO: 588181 - DNA, 25 bp, Mus musculus
ccaggatggcattgggcagcgtcaa

SEQ ID NO: 588182 - DNA, 25 bp, Mus musculus
ccaggatgggagacacaatttatca

SEQ ID NO: 588183 - DNA, 25 bp, Mus musculus
ccaggatgggagtcacaatttatca

SEQ ID NO: 588184 - DNA, 25 bp, Mus musculus
ccaggatgtcagatttgtcagcaac

SEQ ID NO: 588185 - DNA, 25 bp, Mus musculus
ccaggatgtcagttttgtcagcaac

SEQ ID NO: 588186 - DNA, 25 bp, Mus musculus
ccaggatgtctcacagtgcaagtag

SEQ ID NO: 588187 - DNA, 25 bp, Mus musculus
ccaggatgtctctcagtgcaagtag

SEQ ID NO: 588188 - DNA, 25 bp, Mus musculus
ccaggatgtggaagtcaagtacttt

SEQ ID NO: 588189 - DNA, 25 bp, Mus musculus
ccaggatgtggaccgattctgccgc

SEQ ID NO: 588190 - DNA, 25 bp, Mus musculus
ccaggatgtggagcgattctgccgc

SEQ ID NO: 588191 - DNA, 25 bp, Mus musculus
ccaggatgtggatgtcaagtacttt

SEQ ID NO: 588192 - DNA, 25 bp, Mus musculus
ccaggattcggcaaggaggctctgt

SEQ ID NO: 588193 - DNA, 25 bp, Mus musculus
ccaggattcggctaggaggctctgt

SEQ ID NO: 588194 - DNA, 25 bp, Mus musculus
ccaggattgcctcatggaggtgttt

SEQ ID NO: 588195 - DNA, 25 bp, Mus musculus
ccaggattgcctgatggaggtgttt

SEQ ID NO: 588196 - DNA, 25 bp, Mus musculus
ccaggatttaggcatcagggctttc

SEQ ID NO: 588197 - DNA, 25 bp, Mus musculus
ccaggatttagggatcagggctttc

SEQ ID NO: 588198 - DNA, 25 bp, Mus musculus
ccaggcaaacctcagagcatcttga

SEQ ID NO: 588199 - DNA, 25 bp, Mus musculus
ccaggcaaacctgagagcatcttga

SEQ ID NO: 588200 - DNA, 25 bp, Mus musculus
ccaggcaagcggatgggaatcacaa

SEQ ID NO: 588201 - DNA, 25 bp, Mus musculus
ccaggcaagcggttgggaatcacaa

SEQ ID NO: 588202 - DNA, 25 bp, Mus musculus
ccaggcaatgtccactttaaattgg

SEQ ID NO: 588203 - DNA, 25 bp, Mus musculus
ccaggcaatgtcgactttaaattgg

SEQ ID NO: 588204 - DNA, 25 bp, Mus musculus
ccaggcacagagaccggagtatatt

SEQ ID NO: 588205 - DNA, 25 bp, Mus musculus
ccaggcacagagtccggagtatatt

SEQ ID NO: 588206 - DNA, 25 bp, Mus musculus
ccaggcacagcccagaacactggag

SEQ ID NO: 588207 - DNA, 25 bp, Mus musculus
ccaggcacagccgagaacactggag

SEQ ID NO: 588208 - DNA, 25 bp, Mus musculus
ccaggcactgttcactgttgagtta

SEQ ID NO: 588209 - DNA, 25 bp, Mus musculus
ccaggcactgttgactgttgagtta

SEQ ID NO: 588210 - DNA, 25 bp, Mus musculus
ccaggcagaactaagacaggcattc

SEQ ID NO: 588211 - DNA, 25 bp, Mus musculus
ccaggcagaacttagacaggcattc

SEQ ID NO: 588212 - DNA, 25 bp, Mus musculus
ccaggcagacctaggtgtagccgca

SEQ ID NO: 588213 - DNA, 25 bp, Mus musculus
ccaggcagaccttggtgtagccgca

SEQ ID NO: 588214 - DNA, 25 bp, Mus musculus
ccaggcagacgtcaagtttattcag

SEQ ID NO: 588215 - DNA, 25 bp, Mus musculus
ccaggcagacgtgaagtttattcag

SEQ ID NO: 588216 - DNA, 25 bp, Mus musculus
ccaggcagagcaccattggaaactc

SEQ ID NO: 588217 - DNA, 25 bp, Mus musculus
ccaggcagagcagcattggaaactc

SEQ ID NO: 588218 - DNA, 25 bp, Mus musculus
ccaggcagagtaagtggagaagttc

SEQ ID NO: 588219 - DNA, 25 bp, Mus musculus
ccaggcagagtatgtggagaagttc

SEQ ID NO: 588220 - DNA, 25 bp, Mus musculus
ccaggcagagtgaggacctgtgctt

SEQ ID NO: 588221 - DNA, 25 bp, Mus musculus
ccaggcagagtgtggacctgtgctt

SEQ ID NO: 588222 - DNA, 25 bp, Mus musculus
ccaggcagccttcatgggatttgtc

SEQ ID NO: 588223 - DNA, 25 bp, Mus musculus
ccaggcagccttgatgggatttgtc

SEQ ID NO: 588224 - DNA, 25 bp, Mus musculus
ccaggcagctcactcgctctggtca

SEQ ID NO: 588225 - DNA, 25 bp, Mus musculus
ccaggcagctcagtcgctctggtca

SEQ ID NO: 588226 - DNA, 25 bp, Mus musculus
ccaggcagctgaaagaagatctgtc

SEQ ID NO: 588227 - DNA, 25 bp, Mus musculus
ccaggcagctgatagaagatctgtc

SEQ ID NO: 588228 - DNA, 25 bp, Mus musculus
ccaggcaggttgaatccctgaaaac

SEQ ID NO: 588229 - DNA, 25 bp, Mus musculus
ccaggcaggttgtatccctgaaaac

SEQ ID NO: 588230 - DNA, 25 bp, Mus musculus
ccaggcagtctgaaatgggacctcg

SEQ ID NO: 588231 - DNA, 25 bp, Mus musculus
ccaggcagtctgtaatgggacctcg

SEQ ID NO: 588232 - DNA, 25 bp, Mus musculus
ccaggcatccgtcaaaaacttccag

SEQ ID NO: 588233 - DNA, 25 bp, Mus musculus
ccaggcatccgtgaaaaacttccag

SEQ ID NO: 588234 - DNA, 25 bp, Mus musculus
ccaggcatgatgctagacctagacc

SEQ ID NO: 588235 - DNA, 25 bp, Mus musculus
ccaggcatgatggtagacctagacc

SEQ ID NO: 588236 - DNA, 25 bp, Mus musculus
ccaggcattatcctggttggcacta

SEQ ID NO: 588237 - DNA, 25 bp, Mus musculus
ccaggcattatcgtggttggcacta

SEQ ID NO: 588238 - DNA, 25 bp, Mus musculus
ccaggcattctgagagacacaagga

SEQ ID NO: 588239 - DNA, 25 bp, Mus musculus
ccaggcattctgtgagacacaagga

SEQ ID NO: 588240 - DNA, 25 bp, Mus musculus
ccaggcattggtcccagtgaacagg

SEQ ID NO: 588241 - DNA, 25 bp, Mus musculus
ccaggcattggtgccagtgaacagg

SEQ ID NO: 588242 - DNA, 25 bp, Mus musculus
ccaggccaatgaagtacggaaggtc

SEQ ID NO: 588243 - DNA, 25 bp, Mus musculus
ccaggccaatgatgtacggaaggtc

SEQ ID NO: 588244 - DNA, 25 bp, Mus musculus
ccaggccacctcagactctttgtga

SEQ ID NO: 588245 - DNA, 25 bp, Mus musculus
ccaggccacctctgactctttgtga

SEQ ID NO: 588246 - DNA, 25 bp, Mus musculus
ccaggccagcatcaatgaaatcaag

SEQ ID NO: 588247 - DNA, 25 bp, Mus musculus
ccaggccagcatgaatgaaatcaag

SEQ ID NO: 588248 - DNA, 25 bp, Mus musculus
ccaggccaggaaatagggatccgca

SEQ ID NO: 588249 - DNA, 25 bp, Mus musculus
ccaggccaggaattagggatccgca

SEQ ID NO: 588250 - DNA, 25 bp, Mus musculus
ccaggccaggcgacgcttctgcaag

SEQ ID NO: 588251 - DNA, 25 bp, Mus musculus
ccaggccaggcgtcgcttctgcaag

SEQ ID NO: 588252 - DNA, 25 bp, Mus musculus
ccaggccatattcaatacatgccca

SEQ ID NO: 588253 - DNA, 25 bp, Mus musculus
ccaggccatattgaatacatgccca

SEQ ID NO: 588254 - DNA, 25 bp, Mus musculus
ccaggcccacagagattggagctat

SEQ ID NO: 588255 - DNA, 25 bp, Mus musculus
ccaggcccacagtgattggagctat

SEQ ID NO: 588256 - DNA, 25 bp, Mus musculus
ccaggcccatgaaggcgagcccagt

SEQ ID NO: 588257 - DNA, 25 bp, Mus musculus
ccaggcccatgatggcgagcccagt

SEQ ID NO: 588258 - DNA, 25 bp, Mus musculus
ccaggcccgacgagcggtgtgccat

SEQ ID NO: 588259 - DNA, 25 bp, Mus musculus
ccaggcccgacgtgcggtgtgccat

SEQ ID NO: 588260 - DNA, 25 bp, Mus musculus
ccaggccctgctctgattaggaaca

SEQ ID NO: 588261 - DNA, 25 bp, Mus musculus
ccaggccctgctgtgattaggaaca

SEQ ID NO: 588262 - DNA, 25 bp, Mus musculus
ccaggcctacagacgaagatcagcg

SEQ ID NO: 588263 - DNA, 25 bp, Mus musculus
ccaggcctacagtcgaagatcagcg

SEQ ID NO: 588264 - DNA, 25 bp, Mus musculus
ccaggcctacttcgcgtgtgaaaaa

SEQ ID NO: 588265 - DNA, 25 bp, Mus musculus
ccaggcctacttggcgtgtgaaaaa

SEQ ID NO: 588266 - DNA, 25 bp, Mus musculus
ccaggcctccatccagaatggtaaa

SEQ ID NO: 588267 - DNA, 25 bp, Mus musculus
ccaggcctccatgcagaatggtaaa

SEQ ID NO: 588268 - DNA, 25 bp, Mus musculus
ccaggcctccgtactgcaggtgtct

SEQ ID NO: 588269 - DNA, 25 bp, Mus musculus
ccaggcctccgttctgcaggtgtct

SEQ ID NO: 588270 - DNA, 25 bp, Mus musculus
ccaggcctggcaagaacataaagca

SEQ ID NO: 588271 - DNA, 25 bp, Mus musculus
ccaggcctggcatgaacataaagca

SEQ ID NO: 588272 - DNA, 25 bp, Mus musculus
ccaggcctggtacaatgggttgtaa

SEQ ID NO: 588273 - DNA, 25 bp, Mus musculus
ccaggcctggtagaatgggttgtaa

SEQ ID NO: 588274 - DNA, 25 bp, Mus musculus
ccaggccttagaagactttggtaca

SEQ ID NO: 588275 - DNA, 25 bp, Mus musculus
ccaggccttagatgactttggtaca

SEQ ID NO: 588276 - DNA, 25 bp, Mus musculus
ccaggccttcgacgagaacatggcc

SEQ ID NO: 588277 - DNA, 25 bp, Mus musculus
ccaggccttcgaggagaacatggcc

SEQ ID NO: 588278 - DNA, 25 bp, Mus musculus
ccaggccttgccctttgagcagaag

SEQ ID NO: 588279 - DNA, 25 bp, Mus musculus
ccaggccttgccgtttgagcagaag

SEQ ID NO: 588280 - DNA, 25 bp, Mus musculus
ccaggcgacgagatgtcttggtcaa

SEQ ID NO: 588281 - DNA, 25 bp, Mus musculus
ccaggcgacgagttgtcttggtcaa

SEQ ID NO: 588282 - DNA, 25 bp, Mus musculus
ccaggcgagccacgacaaagtgtgc

SEQ ID NO: 588283 - DNA, 25 bp, Mus musculus
ccaggcgagccaggacaaagtgtgc

SEQ ID NO: 588284 - DNA, 25 bp, Mus musculus
ccaggcgcgcgactctgagcgcaaa

SEQ ID NO: 588285 - DNA, 25 bp, Mus musculus
ccaggcgcgcgagtctgagcgcaaa

SEQ ID NO: 588286 - DNA, 25 bp, Mus musculus
ccaggcgcttctactagtcgggcaa

SEQ ID NO: 588287 - DNA, 25 bp, Mus musculus
ccaggcgcttcttctagtcgggcaa

SEQ ID NO: 588288 - DNA, 25 bp, Mus musculus
ccaggcggcacaagaaggtggcttt

SEQ ID NO: 588289 - DNA, 25 bp, Mus musculus
ccaggcggcacatgaaggtggcttt

SEQ ID NO: 588290 - DNA, 25 bp, Mus musculus
ccaggcggcaggacaagtctgccct

SEQ ID NO: 588291 - DNA, 25 bp, Mus musculus
ccaggcggcaggtcaagtctgccct

SEQ ID NO: 588292 - DNA, 25 bp, Mus musculus
ccaggcggcgctcctttgaagagcc

SEQ ID NO: 588293 - DNA, 25 bp, Mus musculus
ccaggcggcgctgctttgaagagcc

SEQ ID NO: 588294 - DNA, 25 bp, Mus musculus
ccaggcggtccgcatcgagaatctg

SEQ ID NO: 588295 - DNA, 25 bp, Mus musculus
ccaggcggtccggatcgagaatctg

SEQ ID NO: 588296 - DNA, 25 bp, Mus musculus
ccaggcggtgctcagcgatgtccta

SEQ ID NO: 588297 - DNA, 25 bp, Mus musculus
ccaggcggtgctgagcgatgtccta

SEQ ID NO: 588298 - DNA, 25 bp, Mus musculus
ccaggcgtcccacgcagtgatgaag

SEQ ID NO: 588299 - DNA, 25 bp, Mus musculus
ccaggcgtcccaggcagtgatgaag

SEQ ID NO: 588300 - DNA, 25 bp, Mus musculus
ccaggcgtttctcgatgtgagccac

SEQ ID NO: 588301 - DNA, 25 bp, Mus musculus
ccaggcgtttctggatgtgagccac

SEQ ID NO: 588302 - DNA, 25 bp, Mus musculus
ccaggcgtttgcactggagcgacga

SEQ ID NO: 588303 - DNA, 25 bp, Mus musculus
ccaggcgtttgctctggagcgacga

SEQ ID NO: 588304 - DNA, 25 bp, Mus musculus
ccaggctaagccaaaagcatcagca

SEQ ID NO: 588305 - DNA, 25 bp, Mus musculus
ccaggctaagcctaaagcatcagca

SEQ ID NO: 588306 - DNA, 25 bp, Mus musculus
ccaggctattgacttggaggaccta

SEQ ID NO: 588307 - DNA, 25 bp, Mus musculus
ccaggctattgagttggaggaccta

SEQ ID NO: 588308 - DNA, 25 bp, Mus musculus
ccaggctcatcgcattcttcctatt

SEQ ID NO: 588309 - DNA, 25 bp, Mus musculus
ccaggctcatcggattcttcctatt

SEQ ID NO: 588310 - DNA, 25 bp, Mus musculus
ccaggctcatgaatgtcatcgagaa

SEQ ID NO: 588311 - DNA, 25 bp, Mus musculus
ccaggctcatgattgtcatcgagaa

SEQ ID NO: 588312 - DNA, 25 bp, Mus musculus
ccaggctccgggagctgcgtgtctt

SEQ ID NO: 588313 - DNA, 25 bp, Mus musculus
ccaggctccgggtgctgcgtgtctt

SEQ ID NO: 588314 - DNA, 25 bp, Mus musculus
ccaggctctgaacccagttacaagc

SEQ ID NO: 588315 - DNA, 25 bp, Mus musculus
ccaggctctgaagccagttacaagc

SEQ ID NO: 588316 - DNA, 25 bp, Mus musculus
ccaggctgaacactgaattgcaaca

SEQ ID NO: 588317 - DNA, 25 bp, Mus musculus
ccaggctgaacagtgaattgcaaca

SEQ ID NO: 588318 - DNA, 25 bp, Mus musculus
ccaggctgcagaaacgatggcggct

SEQ ID NO: 588319 - DNA, 25 bp, Mus musculus
ccaggctgcagatacgatggcggct

SEQ ID NO: 588320 - DNA, 25 bp, Mus musculus
ccaggctgcggaccacttctttgag

SEQ ID NO: 588321 - DNA, 25 bp, Mus musculus
ccaggctgcggagcacttctttgag

SEQ ID NO: 588322 - DNA, 25 bp, Mus musculus
ccaggctggacactctgtgcccaga

SEQ ID NO: 588323 - DNA, 25 bp, Mus musculus
ccaggctggacagtctgtgcccaga

SEQ ID NO: 588324 - DNA, 25 bp, Mus musculus
ccaggctggcatatgaatagtccac

SEQ ID NO: 588325 - DNA, 25 bp, Mus musculus
ccaggctggcatttgaatagtccac

SEQ ID NO: 588326 - DNA, 25 bp, Mus musculus
ccaggctgggagacccattgccaga

SEQ ID NO: 588327 - DNA, 25 bp, Mus musculus
ccaggctgggagtcccattgccaga

SEQ ID NO: 588328 - DNA, 25 bp, Mus musculus
ccaggctgtcacaggcaagcgagca

SEQ ID NO: 588329 - DNA, 25 bp, Mus musculus
ccaggctgtcactggcaagcgagca

SEQ ID NO: 588330 - DNA, 25 bp, Mus musculus
ccaggctgtgacagaggccatgaag

SEQ ID NO: 588331 - DNA, 25 bp, Mus musculus
ccaggctgtgactgaggccatgaag

SEQ ID NO: 588332 - DNA, 25 bp, Mus musculus
ccaggctgtgctcattggctgatat

SEQ ID NO: 588333 - DNA, 25 bp, Mus musculus
ccaggctgtgctgattggctgatat

SEQ ID NO: 588334 - DNA, 25 bp, Mus musculus
ccaggcttcggaagagctgccgagc

SEQ ID NO: 588335 - DNA, 25 bp, Mus musculus
ccaggcttcggacgacagagtctgt

SEQ ID NO: 588336 - DNA, 25 bp, Mus musculus
ccaggcttcggaggacagagtctgt

SEQ ID NO: 588337 - DNA, 25 bp, Mus musculus
ccaggcttcggatgagctgccgagc

SEQ ID NO: 588338 - DNA, 25 bp, Mus musculus
ccaggcttctcaccatggagattaa

SEQ ID NO: 588339 - DNA, 25 bp, Mus musculus
ccaggcttctcagcatggagattaa

SEQ ID NO: 588340 - DNA, 25 bp, Mus musculus
ccaggcttgcctagacttcagattc

SEQ ID NO: 588341 - DNA, 25 bp, Mus musculus
ccaggcttgccttgacttcagattc

SEQ ID NO: 588342 - DNA, 25 bp, Mus musculus
ccaggcttgcggaagctaacaagga

SEQ ID NO: 588343 - DNA, 25 bp, Mus musculus
ccaggcttgcggtagctaacaagga

SEQ ID NO: 588344 - DNA, 25 bp, Mus musculus
ccaggcttgggaagtcgtggccaac

SEQ ID NO: 588345 - DNA, 25 bp, Mus musculus
ccaggcttgggatgtcgtggccaac

SEQ ID NO: 588346 - DNA, 25 bp, Mus musculus
ccaggcttttcacgtagctgagagg

SEQ ID NO: 588347 - DNA, 25 bp, Mus musculus
ccaggcttttcaggtagctgagagg

SEQ ID NO: 588348 - DNA, 25 bp, Mus musculus
ccagggaaaacacccctttcatcaa

SEQ ID NO: 588349 - DNA, 25 bp, Mus musculus
ccagggaaaacagccctttcatcaa

SEQ ID NO: 588350 - DNA, 25 bp, Mus musculus
ccagggaaatctcaccagagcactt

SEQ ID NO: 588351 - DNA, 25 bp, Mus musculus
ccagggaaatctgaccagagcactt

SEQ ID NO: 588352 - DNA, 25 bp, Mus musculus
ccagggaaatgacctcaaaattgat

SEQ ID NO: 588353 - DNA, 25 bp, Mus musculus
ccagggaaatgagctcaaaattgat

SEQ ID NO: 588354 - DNA, 25 bp, Mus musculus
ccagggaactaaaagaggtgaagca

SEQ ID NO: 588355 - DNA, 25 bp, Mus musculus
ccagggaactaatagaggtgaagca

SEQ ID NO: 588356 - DNA, 25 bp, Mus musculus
ccagggaactagcaactcttcttca

SEQ ID NO: 588357 - DNA, 25 bp, Mus musculus
ccagggaactaggaactcttcttca

SEQ ID NO: 588358 - DNA, 25 bp, Mus musculus
ccagggaagaatctgtaaggaaact

SEQ ID NO: 588359 - DNA, 25 bp, Mus musculus
ccagggaagaatgtgtaaggaaact

SEQ ID NO: 588360 - DNA, 25 bp, Mus musculus
ccagggaatctgctttagactgctc

SEQ ID NO: 588361 - DNA, 25 bp, Mus musculus
ccagggaatctggtttagactgctc

SEQ ID NO: 588362 - DNA, 25 bp, Mus musculus
ccagggaattaaagaagaacaagaa

SEQ ID NO: 588363 - DNA, 25 bp, Mus musculus
ccagggaattaatgaagaacaagaa

SEQ ID NO: 588364 - DNA, 25 bp, Mus musculus
ccagggacacatcgagtggctcttt

SEQ ID NO: 588365 - DNA, 25 bp, Mus musculus
ccagggacacatggagtggctcttt

SEQ ID NO: 588366 - DNA, 25 bp, Mus musculus
ccagggacagatcgcggagtatcca

SEQ ID NO: 588367 - DNA, 25 bp, Mus musculus
ccagggacagatggcggagtatcca

SEQ ID NO: 588368 - DNA, 25 bp, Mus musculus
ccagggaccaagagtgagatcgcag

SEQ ID NO: 588369 - DNA, 25 bp, Mus musculus
ccagggaccaagtgtgagatcgcag

SEQ ID NO: 588370 - DNA, 25 bp, Mus musculus
ccagggaccagtcagagctctgctt

SEQ ID NO: 588371 - DNA, 25 bp, Mus musculus
ccagggaccagtgagagctctgctt

SEQ ID NO: 588372 - DNA, 25 bp, Mus musculus
ccagggacgcttactggctcttaaa

SEQ ID NO: 588373 - DNA, 25 bp, Mus musculus
ccagggacgctttctggctcttaaa

SEQ ID NO: 588374 - DNA, 25 bp, Mus musculus
ccagggacgttcactgacaccacat

SEQ ID NO: 588375 - DNA, 25 bp, Mus musculus
ccagggacgttctctgacaccacat

SEQ ID NO: 588376 - DNA, 25 bp, Mus musculus
ccagggactgaacagtctctcatac

SEQ ID NO: 588377 - DNA, 25 bp, Mus musculus
ccagggactgaagagtctctcatac

SEQ ID NO: 588378 - DNA, 25 bp, Mus musculus
ccagggactgataattttctgaaga

SEQ ID NO: 588379 - DNA, 25 bp, Mus musculus
ccagggactgattattttctgaaga

SEQ ID NO: 588380 - DNA, 25 bp, Mus musculus
ccagggagagtgacagtggccttaa

SEQ ID NO: 588381 - DNA, 25 bp, Mus musculus
ccagggagagtgtcagtggccttaa

SEQ ID NO: 588382 - DNA, 25 bp, Mus musculus
ccagggagatgaagcagcgtgatat

SEQ ID NO: 588383 - DNA, 25 bp, Mus musculus
ccagggagatgatgcagcgtgatat

SEQ ID NO: 588384 - DNA, 25 bp, Mus musculus
ccagggagcagcatatggacaggaa

SEQ ID NO: 588385 - DNA, 25 bp, Mus musculus
ccagggagcagcttatggacaggaa

SEQ ID NO: 588386 - DNA, 25 bp, Mus musculus
ccagggagccaacatggcagctgcc

SEQ ID NO: 588387 - DNA, 25 bp, Mus musculus
ccagggagccaagatggcagctgcc

SEQ ID NO: 588388 - DNA, 25 bp, Mus musculus
ccagggagcggaacagtcttctgct

SEQ ID NO: 588389 - DNA, 25 bp, Mus musculus
ccagggagcggatcagtcttctgct

SEQ ID NO: 588390 - DNA, 25 bp, Mus musculus
ccagggaggagtactactgcctcag

SEQ ID NO: 588391 - DNA, 25 bp, Mus musculus
ccagggaggagttctactgcctcag

SEQ ID NO: 588392 - DNA, 25 bp, Mus musculus
ccagggaggcgacggctctgaaaaa

SEQ ID NO: 588393 - DNA, 25 bp, Mus musculus
ccagggaggcgagggctctgaaaaa

SEQ ID NO: 588394 - DNA, 25 bp, Mus musculus
ccagggaggtacatggcctctgtca

SEQ ID NO: 588395 - DNA, 25 bp, Mus musculus
ccagggaggtacttggcctctgtca

SEQ ID NO: 588396 - DNA, 25 bp, Mus musculus
ccagggaggtatcaccatatggacc

SEQ ID NO: 588397 - DNA, 25 bp, Mus musculus
ccagggaggtatgaccatatggacc

SEQ ID NO: 588398 - DNA, 25 bp, Mus musculus
ccagggaggtcgagctgttctcccg

SEQ ID NO: 588399 - DNA, 25 bp, Mus musculus
ccagggaggtcgtgctgttctcccg

SEQ ID NO: 588400 - DNA, 25 bp, Mus musculus
ccagggagtccacgctccagcgtgt

SEQ ID NO: 588401 - DNA, 25 bp, Mus musculus
ccagggagtccaggctccagcgtgt

SEQ ID NO: 588402 - DNA, 25 bp, Mus musculus
ccagggatcaggagctaggccgttt

SEQ ID NO: 588403 - DNA, 25 bp, Mus musculus
ccagggatcaggtgctaggccgttt

SEQ ID NO: 588404 - DNA, 25 bp, Mus musculus
ccagggatccacatgtgcgcatggt

SEQ ID NO: 588405 - DNA, 25 bp, Mus musculus
ccagggatccacttgtgcgcatggt

SEQ ID NO: 588406 - DNA, 25 bp, Mus musculus
ccagggatttaactcctcaacagat

SEQ ID NO: 588407 - DNA, 25 bp, Mus musculus
ccagggatttaagtcctcaacagat

SEQ ID NO: 588408 - DNA, 25 bp, Mus musculus
ccagggcaacaacgtgaagaaactc

SEQ ID NO: 588409 - DNA, 25 bp, Mus musculus
ccagggcaacaaggtgaagaaactc

SEQ ID NO: 588410 - DNA, 25 bp, Mus musculus
ccagggcaacagctgtagcagatga

SEQ ID NO: 588411 - DNA, 25 bp, Mus musculus
ccagggcaacaggtgtagcagatga

SEQ ID NO: 588412 - DNA, 25 bp, Mus musculus
ccagggcagaaaatgagcaggcagc

SEQ ID NO: 588413 - DNA, 25 bp, Mus musculus
ccagggcagaaattgagcaggcagc

SEQ ID NO: 588414 - DNA, 25 bp, Mus musculus
ccagggcagactacaggtgtacatg

SEQ ID NO: 588415 - DNA, 25 bp, Mus musculus
ccagggcagacttcaggtgtacatg

SEQ ID NO: 588416 - DNA, 25 bp, Mus musculus
ccagggcaggagattacagttattc

SEQ ID NO: 588417 - DNA, 25 bp, Mus musculus
ccagggcaggagtttacagttattc

SEQ ID NO: 588418 - DNA, 25 bp, Mus musculus
ccagggcaggcgctacaactctttt

SEQ ID NO: 588419 - DNA, 25 bp, Mus musculus
ccagggcaggcggtacaactctttt

SEQ ID NO: 588420 - DNA, 25 bp, Mus musculus
ccagggcatgagaggagacaagacc

SEQ ID NO: 588421 - DNA, 25 bp, Mus musculus
ccagggcatgagtggagacaagacc

SEQ ID NO: 588422 - DNA, 25 bp, Mus musculus
ccagggccacggacaacttggaagt

SEQ ID NO: 588423 - DNA, 25 bp, Mus musculus
ccagggccacggtcaacttggaagt

SEQ ID NO: 588424 - DNA, 25 bp, Mus musculus
ccagggccatggcacagttgtcaat

SEQ ID NO: 588425 - DNA, 25 bp, Mus musculus
ccagggccatgggacagttgtcaat

SEQ ID NO: 588426 - DNA, 25 bp, Mus musculus
ccagggcctcatcagtggctccaat

SEQ ID NO: 588427 - DNA, 25 bp, Mus musculus
ccagggcctcatgagtggctccaat

SEQ ID NO: 588428 - DNA, 25 bp, Mus musculus
ccagggcctccaactggactggagc

SEQ ID NO: 588429 - DNA, 25 bp, Mus musculus
ccagggcctccatctggactggagc

SEQ ID NO: 588430 - DNA, 25 bp, Mus musculus
ccagggccttgaaggtggtaagact

SEQ ID NO: 588431 - DNA, 25 bp, Mus musculus
ccagggccttgatggtggtaagact

SEQ ID NO: 588432 - DNA, 25 bp, Mus musculus
ccagggcgatataatgagcaacctg

SEQ ID NO: 588433 - DNA, 25 bp, Mus musculus
ccagggcgatattatgagcaacctg

SEQ ID NO: 588434 - DNA, 25 bp, Mus musculus
ccagggctacaacaggctcaacagc

SEQ ID NO: 588435 - DNA, 25 bp, Mus musculus
ccagggctacaagaggctcaacagc

SEQ ID NO: 588436 - DNA, 25 bp, Mus musculus
ccagggctccataattggtgtgcac

SEQ ID NO: 588437 - DNA, 25 bp, Mus musculus
ccagggctccattattggtgtgcac

SEQ ID NO: 588438 - DNA, 25 bp, Mus musculus
ccagggctcctaagtctgtgtctgt

SEQ ID NO: 588439 - DNA, 25 bp, Mus musculus
ccagggctcctatgtctgtgtctgt

SEQ ID NO: 588440 - DNA, 25 bp, Mus musculus
ccagggctgcaaagcgtaggtacca

SEQ ID NO: 588441 - DNA, 25 bp, Mus musculus
ccagggctgcaatgcgtaggtacca

SEQ ID NO: 588442 - DNA, 25 bp, Mus musculus
ccagggctggtgaccctaaggttgt

SEQ ID NO: 588443 - DNA, 25 bp, Mus musculus
ccagggctggtgtccctaaggttgt

SEQ ID NO: 588444 - DNA, 25 bp, Mus musculus
ccagggctgtggattctatgacagt

SEQ ID NO: 588445 - DNA, 25 bp, Mus musculus
ccagggctgtggtttctatgacagt

SEQ ID NO: 588446 - DNA, 25 bp, Mus musculus
ccagggcttcgtaaatactagccaa

SEQ ID NO: 588447 - DNA, 25 bp, Mus musculus
ccagggcttcgttaatactagccaa

SEQ ID NO: 588448 - DNA, 25 bp, Mus musculus
ccagggctttgtataggcctgacaa

SEQ ID NO: 588449 - DNA, 25 bp, Mus musculus
ccagggctttgtttaggcctgacaa

SEQ ID NO: 588450 - DNA, 25 bp, Mus musculus
ccagggtacactctctatagcttca

SEQ ID NO: 588451 - DNA, 25 bp, Mus musculus
ccagggtacactgtctatagcttca

SEQ ID NO: 588452 - DNA, 25 bp, Mus musculus
ccagggtaccacaaacttatggatt

SEQ ID NO: 588453 - DNA, 25 bp, Mus musculus
ccagggtaccactaacttatggatt

SEQ ID NO: 588454 - DNA, 25 bp, Mus musculus
ccagggtatagactttctgcgcccc

SEQ ID NO: 588455 - DNA, 25 bp, Mus musculus
ccagggtatagagtttctgcgcccc

SEQ ID NO: 588456 - DNA, 25 bp, Mus musculus
ccagggtcagtaaggagcagtgacc

SEQ ID NO: 588457 - DNA, 25 bp, Mus musculus
ccagggtcagtatggagcagtgacc

SEQ ID NO: 588458 - DNA, 25 bp, Mus musculus
ccagggtctgctagcggcaccgcag

SEQ ID NO: 588459 - DNA, 25 bp, Mus musculus
ccagggtctgcttgcggcaccgcag

SEQ ID NO: 588460 - DNA, 25 bp, Mus musculus
ccagggtctggcagtacctcggctt

SEQ ID NO: 588461 - DNA, 25 bp, Mus musculus
ccagggtctggctgtacctcggctt

SEQ ID NO: 588462 - DNA, 25 bp, Mus musculus
ccagggtgaagcaggcgttatcgtt

SEQ ID NO: 588463 - DNA, 25 bp, Mus musculus
ccagggtgaagctggcgttatcgtt

SEQ ID NO: 588464 - DNA, 25 bp, Mus musculus
ccagggtgagcacactgtatgcgaa

SEQ ID NO: 588465 - DNA, 25 bp, Mus musculus
ccagggtgagcagactgtatgcgaa

SEQ ID NO: 588466 - DNA, 25 bp, Mus musculus
ccagggtgatcgcaggcatcagcaa

SEQ ID NO: 588467 - DNA, 25 bp, Mus musculus
ccagggtgatcggaggcatcagcaa

SEQ ID NO: 588468 - DNA, 25 bp, Mus musculus
ccagggtggccaccaagggtgagga

SEQ ID NO: 588469 - DNA, 25 bp, Mus musculus
ccagggtggccagcaagggtgagga

SEQ ID NO: 588470 - DNA, 25 bp, Mus musculus
ccagggtgggaaataacacagtcca

SEQ ID NO: 588471 - DNA, 25 bp, Mus musculus
ccagggtgggaattaacacagtcca

SEQ ID NO: 588472 - DNA, 25 bp, Mus musculus
ccagggtgtaccagtcgtgggccta

SEQ ID NO: 588473 - DNA, 25 bp, Mus musculus
ccagggtgtacctgtcgtgggccta

SEQ ID NO: 588474 - DNA, 25 bp, Mus musculus
ccagggtgttgcattctcacaaagc

SEQ ID NO: 588475 - DNA, 25 bp, Mus musculus
ccagggtgttgctttctcacaaagc

SEQ ID NO: 588476 - DNA, 25 bp, Mus musculus
ccagggttggaaaggaaatgctaat

SEQ ID NO: 588477 - DNA, 25 bp, Mus musculus
ccagggttggaatggaaatgctaat

SEQ ID NO: 588478 - DNA, 25 bp, Mus musculus
ccagggttgggaccacagagtaact

SEQ ID NO: 588479 - DNA, 25 bp, Mus musculus
ccagggttgggagcacagagtaact

SEQ ID NO: 588480 - DNA, 25 bp, Mus musculus
ccagggttgggtctttccaggctca

SEQ ID NO: 588481 - DNA, 25 bp, Mus musculus
ccagggttgggtgtttccaggctca

SEQ ID NO: 588482 - DNA, 25 bp, Mus musculus
ccaggtaaggtgacatggactgagt

SEQ ID NO: 588483 - DNA, 25 bp, Mus musculus
ccaggtaaggtgtcatggactgagt

SEQ ID NO: 588484 - DNA, 25 bp, Mus musculus
ccaggtacccacaaaggcactctga

SEQ ID NO: 588485 - DNA, 25 bp, Mus musculus
ccaggtacccactaaggcactctga

SEQ ID NO: 588486 - DNA, 25 bp, Mus musculus
ccaggtacctgtaagcatctcggct

SEQ ID NO: 588487 - DNA, 25 bp, Mus musculus
ccaggtacctgttagcatctcggct

SEQ ID NO: 588488 - DNA, 25 bp, Mus musculus
ccaggtactacccagaggtgaacga

SEQ ID NO: 588489 - DNA, 25 bp, Mus musculus
ccaggtactaccgagaggtgaacga

SEQ ID NO: 588490 - DNA, 25 bp, Mus musculus
ccaggtagacctcgaagccgactgc

SEQ ID NO: 588491 - DNA, 25 bp, Mus musculus
ccaggtagacctggaagccgactgc

SEQ ID NO: 588492 - DNA, 25 bp, Mus musculus
ccaggtagcaaacagggtaacagcc

SEQ ID NO: 588493 - DNA, 25 bp, Mus musculus
ccaggtagcaaagagggtaacagcc

SEQ ID NO: 588494 - DNA, 25 bp, Mus musculus
ccaggtagcaatcagctccaaattt

SEQ ID NO: 588495 - DNA, 25 bp, Mus musculus
ccaggtagcaatgagctccaaattt

SEQ ID NO: 588496 - DNA, 25 bp, Mus musculus
ccaggtatgacaacaagggctgcaa

SEQ ID NO: 588497 - DNA, 25 bp, Mus musculus
ccaggtatgacatcaagggctgcaa

SEQ ID NO: 588498 - DNA, 25 bp, Mus musculus
ccaggtatggcaacaaatgtcttta

SEQ ID NO: 588499 - DNA, 25 bp, Mus musculus
ccaggtatggcatcaaatgtcttta

SEQ ID NO: 588500 - DNA, 25 bp, Mus musculus
ccaggtatgtggactcaggatgatt

SEQ ID NO: 588501 - DNA, 25 bp, Mus musculus
ccaggtatgtggtctcaggatgatt

SEQ ID NO: 588502 - DNA, 25 bp, Mus musculus
ccaggtcaaagaaactgtggattca

SEQ ID NO: 588503 - DNA, 25 bp, Mus musculus
ccaggtcaaagatactgtggattca

SEQ ID NO: 588504 - DNA, 25 bp, Mus musculus
ccaggtcaacccaagcacatgcatt

SEQ ID NO: 588505 - DNA, 25 bp, Mus musculus
ccaggtcaaccctagcacatgcatt

SEQ ID NO: 588506 - DNA, 25 bp, Mus musculus
ccaggtcacccaccgaattaatttg

SEQ ID NO: 588507 - DNA, 25 bp, Mus musculus
ccaggtcacccagcgaattaatttg

SEQ ID NO: 588508 - DNA, 25 bp, Mus musculus
ccaggtcagcaaacacatgggaggg

SEQ ID NO: 588509 - DNA, 25 bp, Mus musculus
ccaggtcagcaatcacatgggaggg

SEQ ID NO: 588510 - DNA, 25 bp, Mus musculus
ccaggtcagctgatacagaaatggc

SEQ ID NO: 588511 - DNA, 25 bp, Mus musculus
ccaggtcagctgttacagaaatggc

SEQ ID NO: 588512 - DNA, 25 bp, Mus musculus
ccaggtcaggcgattttcctgggtc

SEQ ID NO: 588513 - DNA, 25 bp, Mus musculus
ccaggtcaggcgtttttcctgggtc

SEQ ID NO: 588514 - DNA, 25 bp, Mus musculus
ccaggtcagtggctgtcactgtgaa

SEQ ID NO: 588515 - DNA, 25 bp, Mus musculus
ccaggtcagtgggtgtcactgtgaa

SEQ ID NO: 588516 - DNA, 25 bp, Mus musculus
ccaggtcataggattcatcagccag

SEQ ID NO: 588517 - DNA, 25 bp, Mus musculus
ccaggtcataggtttcatcagccag

SEQ ID NO: 588518 - DNA, 25 bp, Mus musculus
ccaggtcatgacatttaaggaggca

SEQ ID NO: 588519 - DNA, 25 bp, Mus musculus
ccaggtcatgacttttaaggaggca

SEQ ID NO: 588520 - DNA, 25 bp, Mus musculus
ccaggtcatgggaccaagaggagcc

SEQ ID NO: 588521 - DNA, 25 bp, Mus musculus
ccaggtcatgggtccaagaggagcc

SEQ ID NO: 588522 - DNA, 25 bp, Mus musculus
ccaggtccctgccattgcaagtatg

SEQ ID NO: 588523 - DNA, 25 bp, Mus musculus
ccaggtccctgcgattgcaagtatg

SEQ ID NO: 588524 - DNA, 25 bp, Mus musculus
ccaggtcctgttcgtcattgccaaa

SEQ ID NO: 588525 - DNA, 25 bp, Mus musculus
ccaggtcctgttggtcattgccaaa

SEQ ID NO: 588526 - DNA, 25 bp, Mus musculus
ccaggtccttctctggacgtttagc

SEQ ID NO: 588527 - DNA, 25 bp, Mus musculus
ccaggtccttctgtggacgtttagc

SEQ ID NO: 588528 - DNA, 25 bp, Mus musculus
ccaggtcggtgtagagacctacggc

SEQ ID NO: 588529 - DNA, 25 bp, Mus musculus
ccaggtcggtgttgagacctacggc

SEQ ID NO: 588530 - DNA, 25 bp, Mus musculus
ccaggtctatggcttctatgatgag

SEQ ID NO: 588531 - DNA, 25 bp, Mus musculus
ccaggtctatgggttctatgatgag

SEQ ID NO: 588532 - DNA, 25 bp, Mus musculus
ccaggtctgcttcactgtgtgctcg

SEQ ID NO: 588533 - DNA, 25 bp, Mus musculus
ccaggtctgcttgactgtgtgctcg

SEQ ID NO: 588534 - DNA, 25 bp, Mus musculus
ccaggtctggtgcatatcggatttg

SEQ ID NO: 588535 - DNA, 25 bp, Mus musculus
ccaggtctggtggatatcggatttg

SEQ ID NO: 588536 - DNA, 25 bp, Mus musculus
ccaggtcttctcatgtatccactga

SEQ ID NO: 588537 - DNA, 25 bp, Mus musculus
ccaggtcttctcttgtatccactga

SEQ ID NO: 588538 - DNA, 25 bp, Mus musculus
ccaggtgacaggcagtgcccactgc

SEQ ID NO: 588539 - DNA, 25 bp, Mus musculus
ccaggtgacagggagtgcccactgc

SEQ ID NO: 588540 - DNA, 25 bp, Mus musculus
ccaggtgacctgctttttggctgat

SEQ ID NO: 588541 - DNA, 25 bp, Mus musculus
ccaggtgacctggtttttggctgat

SEQ ID NO: 588542 - DNA, 25 bp, Mus musculus
ccaggtgactggactctagtgggaa

SEQ ID NO: 588543 - DNA, 25 bp, Mus musculus
ccaggtgactggtctctagtgggaa

SEQ ID NO: 588544 - DNA, 25 bp, Mus musculus
ccaggtgagcgacgacgatcagata

SEQ ID NO: 588545 - DNA, 25 bp, Mus musculus
ccaggtgagcgaggacgatcagata

SEQ ID NO: 588546 - DNA, 25 bp, Mus musculus
ccaggtgaggttagaggaacacctg

SEQ ID NO: 588547 - DNA, 25 bp, Mus musculus
ccaggtgaggtttgaggaacacctg

SEQ ID NO: 588548 - DNA, 25 bp, Mus musculus
ccaggtgcaagtcctccgggtctgc

SEQ ID NO: 588549 - DNA, 25 bp, Mus musculus
ccaggtgcaagtgctccgggtctgc

SEQ ID NO: 588550 - DNA, 25 bp, Mus musculus
ccaggtgccgatcgaagtccttaag

SEQ ID NO: 588551 - DNA, 25 bp, Mus musculus
ccaggtgccgatggaagtccttaag

SEQ ID NO: 588552 - DNA, 25 bp, Mus musculus
ccaggtgcgagtccaaaggttctga

SEQ ID NO: 588553 - DNA, 25 bp, Mus musculus
ccaggtgcgagtgcaaaggttctga

SEQ ID NO: 588554 - DNA, 25 bp, Mus musculus
ccaggtgcgggcacggactgcagct

SEQ ID NO: 588555 - DNA, 25 bp, Mus musculus
ccaggtgcgggctcggactgcagct

SEQ ID NO: 588556 - DNA, 25 bp, Mus musculus
ccaggtgctcatcgtgcaggaaaac

SEQ ID NO: 588557 - DNA, 25 bp, Mus musculus
ccaggtgctcatggtgcaggaaaac

SEQ ID NO: 588558 - DNA, 25 bp, Mus musculus
ccaggtgctccacatcaacggtgaa

SEQ ID NO: 588559 - DNA, 25 bp, Mus musculus
ccaggtgctccagatcaacggtgaa

SEQ ID NO: 588560 - DNA, 25 bp, Mus musculus
ccaggtggaagacagtgcagcactt

SEQ ID NO: 588561 - DNA, 25 bp, Mus musculus
ccaggtggaagagagtgcagcactt

SEQ ID NO: 588562 - DNA, 25 bp, Mus musculus
ccaggtggacacctttcaccggctg

SEQ ID NO: 588563 - DNA, 25 bp, Mus musculus
ccaggtggacacgtttcaccggctg

SEQ ID NO: 588564 - DNA, 25 bp, Mus musculus
ccaggtggagatctctccttgccaa

SEQ ID NO: 588565 - DNA, 25 bp, Mus musculus
ccaggtggagatgtctccttgccaa

SEQ ID NO: 588566 - DNA, 25 bp, Mus musculus
ccaggtggatcccatgtgtctgcag

SEQ ID NO: 588567 - DNA, 25 bp, Mus musculus
ccaggtggatccgatgtgtctgcag

SEQ ID NO: 588568 - DNA, 25 bp, Mus musculus
ccaggtggccctcgctaactggcag

SEQ ID NO: 588569 - DNA, 25 bp, Mus musculus
ccaggtggccctggctaactggcag

SEQ ID NO: 588570 - DNA, 25 bp, Mus musculus
ccaggtggttacactgtgattaata

SEQ ID NO: 588571 - DNA, 25 bp, Mus musculus
ccaggtggttactctgtgattaata

SEQ ID NO: 588572 - DNA, 25 bp, Mus musculus
ccaggtgtcagaagtcactgtcact

SEQ ID NO: 588573 - DNA, 25 bp, Mus musculus
ccaggtgtcagacaaggagtttaac

SEQ ID NO: 588574 - DNA, 25 bp, Mus musculus
ccaggtgtcagacaataaggattcc

SEQ ID NO: 588575 - DNA, 25 bp, Mus musculus
ccaggtgtcagagaaggagtttaac

SEQ ID NO: 588576 - DNA, 25 bp, Mus musculus
ccaggtgtcagagaataaggattcc

SEQ ID NO: 588577 - DNA, 25 bp, Mus musculus
ccaggtgtcagatgtcactgtcact

SEQ ID NO: 588578 - DNA, 25 bp, Mus musculus
ccaggtgtctgaagtgcagaagcga

SEQ ID NO: 588579 - DNA, 25 bp, Mus musculus
ccaggtgtctgatgtgcagaagcga

SEQ ID NO: 588580 - DNA, 25 bp, Mus musculus
ccaggtgtgggtactacctacaaga

SEQ ID NO: 588581 - DNA, 25 bp, Mus musculus
ccaggtgtgggttctacctacaaga

SEQ ID NO: 588582 - DNA, 25 bp, Mus musculus
ccaggtgtgtcaacgggctgagcac

SEQ ID NO: 588583 - DNA, 25 bp, Mus musculus
ccaggtgtgtcatcgggctgagcac

SEQ ID NO: 588584 - DNA, 25 bp, Mus musculus
ccaggtgttgctccccaaggatgtc

SEQ ID NO: 588585 - DNA, 25 bp, Mus musculus
ccaggtgttgctgcccaaggatgtc

SEQ ID NO: 588586 - DNA, 25 bp, Mus musculus
ccaggtgttggtcatgctgaacctg

SEQ ID NO: 588587 - DNA, 25 bp, Mus musculus
ccaggtgttggtgatgctgaacctg

SEQ ID NO: 588588 - DNA, 25 bp, Mus musculus
ccaggttagcagaacatgacatgtg

SEQ ID NO: 588589 - DNA, 25 bp, Mus musculus
ccaggttagcagtacatgacatgtg

SEQ ID NO: 588590 - DNA, 25 bp, Mus musculus
ccaggttagtatcagaattctcatc

SEQ ID NO: 588591 - DNA, 25 bp, Mus musculus
ccaggttagtatgagaattctcatc

SEQ ID NO: 588592 - DNA, 25 bp, Mus musculus
ccaggttcagagcaaaaagaagatc

SEQ ID NO: 588593 - DNA, 25 bp, Mus musculus
ccaggttcagaggaaaaagaagatc

SEQ ID NO: 588594 - DNA, 25 bp, Mus musculus
ccaggttccgttaaatgaagtgcga

SEQ ID NO: 588595 - DNA, 25 bp, Mus musculus
ccaggttccgtttaatgaagtgcga

SEQ ID NO: 588596 - DNA, 25 bp, Mus musculus
ccaggttctcgcacttatctgtgaa

SEQ ID NO: 588597 - DNA, 25 bp, Mus musculus
ccaggttctcgctcttatctgtgaa

SEQ ID NO: 588598 - DNA, 25 bp, Mus musculus
ccaggttctgccctatttgtcacag

SEQ ID NO: 588599 - DNA, 25 bp, Mus musculus
ccaggttctgccgtatttgtcacag

SEQ ID NO: 588600 - DNA, 25 bp, Mus musculus
ccaggttctggacagtgctgcgatc

SEQ ID NO: 588601 - DNA, 25 bp, Mus musculus
ccaggttctggactggatcagctac

SEQ ID NO: 588602 - DNA, 25 bp, Mus musculus
ccaggttctggagagtgctgcgatc

SEQ ID NO: 588603 - DNA, 25 bp, Mus musculus
ccaggttctggagtggatcagctac

SEQ ID NO: 588604 - DNA, 25 bp, Mus musculus
ccaggttgacgactgaagaatcaca

SEQ ID NO: 588605 - DNA, 25 bp, Mus musculus
ccaggttgacgagtgaagaatcaca

SEQ ID NO: 588606 - DNA, 25 bp, Mus musculus
ccaggttgcagacaccgggagacct

SEQ ID NO: 588607 - DNA, 25 bp, Mus musculus
ccaggttgcagagaccgggagacct

SEQ ID NO: 588608 - DNA, 25 bp, Mus musculus
ccaggttggagaacgtagctgctgc

SEQ ID NO: 588609 - DNA, 25 bp, Mus musculus
ccaggttggagatcgtagctgctgc

SEQ ID NO: 588610 - DNA, 25 bp, Mus musculus
ccaggttggcttagatctccctaga

SEQ ID NO: 588611 - DNA, 25 bp, Mus musculus
ccaggttggctttgatctccctaga

SEQ ID NO: 588612 - DNA, 25 bp, Mus musculus
ccaggttggtggagcagatagataa

SEQ ID NO: 588613 - DNA, 25 bp, Mus musculus
ccaggttggtggtgcagatagataa

SEQ ID NO: 588614 - DNA, 25 bp, Mus musculus
ccaggttgtcagctctctggtacca

SEQ ID NO: 588615 - DNA, 25 bp, Mus musculus
ccaggttgtcaggtctctggtacca

SEQ ID NO: 588616 - DNA, 25 bp, Mus musculus
ccaggttgttgtatcagcatccact

SEQ ID NO: 588617 - DNA, 25 bp, Mus musculus
ccaggttgttgtttcagcatccact

SEQ ID NO: 588618 - DNA, 25 bp, Mus musculus
ccaggtttactcatctcagaggaaa

SEQ ID NO: 588619 - DNA, 25 bp, Mus musculus
ccaggtttactcttctcagaggaaa

SEQ ID NO: 588620 - DNA, 25 bp, Mus musculus
ccaggtttcctgcagaaggcgatcc

SEQ ID NO: 588621 - DNA, 25 bp, Mus musculus
ccaggtttcctggagaaggcgatcc

SEQ ID NO: 588622 - DNA, 25 bp, Mus musculus
ccaggtttctggcttaggtcagtag

SEQ ID NO: 588623 - DNA, 25 bp, Mus musculus
ccaggtttctgggttaggtcagtag

SEQ ID NO: 588624 - DNA, 25 bp, Mus musculus
ccaggtttgaaaccttgatgtagtc

SEQ ID NO: 588625 - DNA, 25 bp, Mus musculus
ccaggtttgaaagcttgatgtagtc

SEQ ID NO: 588626 - DNA, 25 bp, Mus musculus
ccagtaaaccctcgccagaaggtgc

SEQ ID NO: 588627 - DNA, 25 bp, Mus musculus
ccagtaaaccctggccagaaggtgc

SEQ ID NO: 588628 - DNA, 25 bp, Mus musculus
ccagtaaatcttaatatcaaggcag

SEQ ID NO: 588629 - DNA, 25 bp, Mus musculus
ccagtaaatctttatatcaaggcag

SEQ ID NO: 588630 - DNA, 25 bp, Mus musculus
ccagtaaatgggatggtgatgcctt

SEQ ID NO: 588631 - DNA, 25 bp, Mus musculus
ccagtaaatgggttggtgatgcctt

SEQ ID NO: 588632 - DNA, 25 bp, Mus musculus
ccagtaacaagactagatgaaaggc

SEQ ID NO: 588633 - DNA, 25 bp, Mus musculus
ccagtaacaagagtagatgaaaggc

SEQ ID NO: 588634 - DNA, 25 bp, Mus musculus
ccagtaagataaatgtgttctgtct

SEQ ID NO: 588635 - DNA, 25 bp, Mus musculus
ccagtaagataattgtgttctgtct

SEQ ID NO: 588636 - DNA, 25 bp, Mus musculus
ccagtaagtgctcccggaagccaga

SEQ ID NO: 588637 - DNA, 25 bp, Mus musculus
ccagtaagtgctgccggaagccaga

SEQ ID NO: 588638 - DNA, 25 bp, Mus musculus
ccagtaccacggctgagtcagggtc

SEQ ID NO: 588639 - DNA, 25 bp, Mus musculus
ccagtaccacgggtgagtcagggtc

SEQ ID NO: 588640 - DNA, 25 bp, Mus musculus
ccagtaccagagcttcaaggatcgc

SEQ ID NO: 588641 - DNA, 25 bp, Mus musculus
ccagtaccagaggttcaaggatcgc

SEQ ID NO: 588642 - DNA, 25 bp, Mus musculus
ccagtacgacaacggtctgtctttg

SEQ ID NO: 588643 - DNA, 25 bp, Mus musculus
ccagtacgacaagggtctgtctttg

SEQ ID NO: 588644 - DNA, 25 bp, Mus musculus
ccagtacgagttattggagtcgatc

SEQ ID NO: 588645 - DNA, 25 bp, Mus musculus
ccagtacgagtttttggagtcgatc

SEQ ID NO: 588646 - DNA, 25 bp, Mus musculus
ccagtactcggaacttggagaatga

SEQ ID NO: 588647 - DNA, 25 bp, Mus musculus
ccagtactcggatcttggagaatga

SEQ ID NO: 588648 - DNA, 25 bp, Mus musculus
ccagtactggagatctactctgcat

SEQ ID NO: 588649 - DNA, 25 bp, Mus musculus
ccagtactggagttctactctgcat

SEQ ID NO: 588650 - DNA, 25 bp, Mus musculus
ccagtactggttctttgcgcgcgcg

SEQ ID NO: 588651 - DNA, 25 bp, Mus musculus
ccagtactggttgtttgcgcgcgcg

SEQ ID NO: 588652 - DNA, 25 bp, Mus musculus
ccagtactgtatcatggcaaacttc

SEQ ID NO: 588653 - DNA, 25 bp, Mus musculus
ccagtactgtatgatggcaaacttc

SEQ ID NO: 588654 - DNA, 25 bp, Mus musculus
ccagtacttggccatggacaccgaa

SEQ ID NO: 588655 - DNA, 25 bp, Mus musculus
ccagtacttggcgatggacaccgaa

SEQ ID NO: 588656 - DNA, 25 bp, Mus musculus
ccagtagaacaacgtaaatcaagat

SEQ ID NO: 588657 - DNA, 25 bp, Mus musculus
ccagtagaacaaggtaaatcaagat

SEQ ID NO: 588658 - DNA, 25 bp, Mus musculus
ccagtaggttctcctgccgcaagag

SEQ ID NO: 588659 - DNA, 25 bp, Mus musculus
ccagtaggttctgctgccgcaagag

SEQ ID NO: 588660 - DNA, 25 bp, Mus musculus
ccagtagttaccatgcaagattgtc

SEQ ID NO: 588661 - DNA, 25 bp, Mus musculus
ccagtagttaccttgcaagattgtc

SEQ ID NO: 588662 - DNA, 25 bp, Mus musculus
ccagtataaataagctgcgggagtc

SEQ ID NO: 588663 - DNA, 25 bp, Mus musculus
ccagtataaatatgctgcgggagtc

SEQ ID NO: 588664 - DNA, 25 bp, Mus musculus
ccagtatacattcgagccttcagaa

SEQ ID NO: 588665 - DNA, 25 bp, Mus musculus
ccagtatacattggagccttcagaa

SEQ ID NO: 588666 - DNA, 25 bp, Mus musculus
ccagtatccgctaggcgagccgatc

SEQ ID NO: 588667 - DNA, 25 bp, Mus musculus
ccagtatccgcttggcgagccgatc

SEQ ID NO: 588668 - DNA, 25 bp, Mus musculus
ccagtatcgtggacaccccaagtga

SEQ ID NO: 588669 - DNA, 25 bp, Mus musculus
ccagtatcgtggtcaccccaagtga

SEQ ID NO: 588670 - DNA, 25 bp, Mus musculus
ccagtatgcaggacaaagatgccag

SEQ ID NO: 588671 - DNA, 25 bp, Mus musculus
ccagtatgcaggtcaaagatgccag

SEQ ID NO: 588672 - DNA, 25 bp, Mus musculus
ccagtatggagaattcctcagggct

SEQ ID NO: 588673 - DNA, 25 bp, Mus musculus
ccagtatggagatttcctcagggct

SEQ ID NO: 588674 - DNA, 25 bp, Mus musculus
ccagtatggattctgcgaggctgac

SEQ ID NO: 588675 - DNA, 25 bp, Mus musculus
ccagtatggattgtgcgaggctgac

SEQ ID NO: 588676 - DNA, 25 bp, Mus musculus
ccagtatggcacaatgaccaggcag

SEQ ID NO: 588677 - DNA, 25 bp, Mus musculus
ccagtatggcactatgaccaggcag

SEQ ID NO: 588678 - DNA, 25 bp, Mus musculus
ccagtatggctgacggagccatggc

SEQ ID NO: 588679 - DNA, 25 bp, Mus musculus
ccagtatggctgtcggagccatggc

SEQ ID NO: 588680 - DNA, 25 bp, Mus musculus
ccagtatgtccccagaattgtgttt

SEQ ID NO: 588681 - DNA, 25 bp, Mus musculus
ccagtatgtcccgagaattgtgttt

SEQ ID NO: 588682 - DNA, 25 bp, Mus musculus
ccagtatgtgccaaacggttggcaa

SEQ ID NO: 588683 - DNA, 25 bp, Mus musculus
ccagtatgtgcctaacggttggcaa

SEQ ID NO: 588684 - DNA, 25 bp, Mus musculus
ccagtatgttccaggcaatggcttc

SEQ ID NO: 588685 - DNA, 25 bp, Mus musculus
ccagtatgttcctggcaatggcttc

SEQ ID NO: 588686 - DNA, 25 bp, Mus musculus
ccagtattacagcagtgacccagat

SEQ ID NO: 588687 - DNA, 25 bp, Mus musculus
ccagtattacaggagtgacccagat

SEQ ID NO: 588688 - DNA, 25 bp, Mus musculus
ccagtattatcacaggcccattggg

SEQ ID NO: 588689 - DNA, 25 bp, Mus musculus
ccagtattatcagaggcccattggg

SEQ ID NO: 588690 - DNA, 25 bp, Mus musculus
ccagtattggagacctgacaggcct

SEQ ID NO: 588691 - DNA, 25 bp, Mus musculus
ccagtattggagtcctgacaggcct

SEQ ID NO: 588692 - DNA, 25 bp, Mus musculus
ccagtcaaaagaagctctacagaga

SEQ ID NO: 588693 - DNA, 25 bp, Mus musculus
ccagtcaaaagatgctctacagaga

SEQ ID NO: 588694 - DNA, 25 bp, Mus musculus
ccagtcaaaggcaagaggtatcaag

SEQ ID NO: 588695 - DNA, 25 bp, Mus musculus
ccagtcaaaggctagaggtatcaag

SEQ ID NO: 588696 - DNA, 25 bp, Mus musculus
ccagtcaaagtccatctggatggca

SEQ ID NO: 588697 - DNA, 25 bp, Mus musculus
ccagtcaaagtcgatctggatggca

SEQ ID NO: 588698 - DNA, 25 bp, Mus musculus
ccagtcaaccataaaagactgtgcg

SEQ ID NO: 588699 - DNA, 25 bp, Mus musculus
ccagtcaaccattaaagactgtgcg

SEQ ID NO: 588700 - DNA, 25 bp, Mus musculus
ccagtcacaaggctcttctgcgtct

SEQ ID NO: 588701 - DNA, 25 bp, Mus musculus
ccagtcacaagggtcttctgcgtct

SEQ ID NO: 588702 - DNA, 25 bp, Mus musculus
ccagtcagacttcagggcctttgct

SEQ ID NO: 588703 - DNA, 25 bp, Mus musculus
ccagtcagacttgagggcctttgct

SEQ ID NO: 588704 - DNA, 25 bp, Mus musculus
ccagtcagtgtcactcgggttgtct

SEQ ID NO: 588705 - DNA, 25 bp, Mus musculus
ccagtcagtgtctctcgggttgtct

SEQ ID NO: 588706 - DNA, 25 bp, Mus musculus
ccagtcatcattagctcctcagctg

SEQ ID NO: 588707 - DNA, 25 bp, Mus musculus
ccagtcatcatttgctcctcagctg

SEQ ID NO: 588708 - DNA, 25 bp, Mus musculus
ccagtcatgacaaataattacgaag

SEQ ID NO: 588709 - DNA, 25 bp, Mus musculus
ccagtcatgacatataattacgaag

SEQ ID NO: 588710 - DNA, 25 bp, Mus musculus
ccagtcatggataatcaattatgca

SEQ ID NO: 588711 - DNA, 25 bp, Mus musculus
ccagtcatggattatcaattatgca

SEQ ID NO: 588712 - DNA, 25 bp, Mus musculus
ccagtcatgtacagattctcgtaga

SEQ ID NO: 588713 - DNA, 25 bp, Mus musculus
ccagtcatgtactgattctcgtaga

SEQ ID NO: 588714 - DNA, 25 bp, Mus musculus
ccagtcatgtggctgtctctgtcgt

SEQ ID NO: 588715 - DNA, 25 bp, Mus musculus
ccagtcatgtgggtgtctctgtcgt

SEQ ID NO: 588716 - DNA, 25 bp, Mus musculus
ccagtcattccacgaggctgccaag

SEQ ID NO: 588717 - DNA, 25 bp, Mus musculus
ccagtcattccaggaggctgccaag

SEQ ID NO: 588718 - DNA, 25 bp, Mus musculus
ccagtcattgagactgaaactctga

SEQ ID NO: 588719 - DNA, 25 bp, Mus musculus
ccagtcattgagtctgaaactctga

SEQ ID NO: 588720 - DNA, 25 bp, Mus musculus
ccagtccacaagatggtgatgccta

SEQ ID NO: 588721 - DNA, 25 bp, Mus musculus
ccagtccacaagttggtgatgccta

SEQ ID NO: 588722 - DNA, 25 bp, Mus musculus
ccagtccagactactgtgagaacct

SEQ ID NO: 588723 - DNA, 25 bp, Mus musculus
ccagtccagacttctgtgagaacct

SEQ ID NO: 588724 - DNA, 25 bp, Mus musculus
ccagtccaggtgcaaatgggagaat

SEQ ID NO: 588725 - DNA, 25 bp, Mus musculus
ccagtccaggtggaaatgggagaat

SEQ ID NO: 588726 - DNA, 25 bp, Mus musculus
ccagtccagtggatggcatgaagta

SEQ ID NO: 588727 - DNA, 25 bp, Mus musculus
ccagtccagtggttggcatgaagta

SEQ ID NO: 588728 - DNA, 25 bp, Mus musculus
ccagtccatcacctatgaattggct

SEQ ID NO: 588729 - DNA, 25 bp, Mus musculus
ccagtccatcacgtatgaattggct

SEQ ID NO: 588730 - DNA, 25 bp, Mus musculus
ccagtcccgaccagcaggaggaagg

SEQ ID NO: 588731 - DNA, 25 bp, Mus musculus
ccagtcccgacctgcaggaggaagg

SEQ ID NO: 588732 - DNA, 25 bp, Mus musculus
ccagtcctctttagacaacatcagg

SEQ ID NO: 588733 - DNA, 25 bp, Mus musculus
ccagtcctcttttgacaacatcagg

SEQ ID NO: 588734 - DNA, 25 bp, Mus musculus
ccagtcctggccatagggtggagaa

SEQ ID NO: 588735 - DNA, 25 bp, Mus musculus
ccagtcctggccttagggtggagaa

SEQ ID NO: 588736 - DNA, 25 bp, Mus musculus
ccagtcgccaagcagcttaattata

SEQ ID NO: 588737 - DNA, 25 bp, Mus musculus
ccagtcgccaaggagcttaattata

SEQ ID NO: 588738 - DNA, 25 bp, Mus musculus
ccagtcgcttgacttgggccaaccg

SEQ ID NO: 588739 - DNA, 25 bp, Mus musculus
ccagtcgcttgagttgggccaaccg

SEQ ID NO: 588740 - DNA, 25 bp, Mus musculus
ccagtcgggataacagtcggtgaca

SEQ ID NO: 588741 - DNA, 25 bp, Mus musculus
ccagtcgggatatcagtcggtgaca

SEQ ID NO: 588742 - DNA, 25 bp, Mus musculus
ccagtctaatgaagtctgttgcaag

SEQ ID NO: 588743 - DNA, 25 bp, Mus musculus
ccagtctaatgatgtctgttgcaag

SEQ ID NO: 588744 - DNA, 25 bp, Mus musculus
ccagtctaattgaagccaacggaga

SEQ ID NO: 588745 - DNA, 25 bp, Mus musculus
ccagtctaattgtagccaacggaga

SEQ ID NO: 588746 - DNA, 25 bp, Mus musculus
ccagtctaccagaagaccacagagg

SEQ ID NO: 588747 - DNA, 25 bp, Mus musculus
ccagtctaccagtagaccacagagg

SEQ ID NO: 588748 - DNA, 25 bp, Mus musculus
ccagtctacccacgatgaggttgct

SEQ ID NO: 588749 - DNA, 25 bp, Mus musculus
ccagtctacccaggatgaggttgct

SEQ ID NO: 588750 - DNA, 25 bp, Mus musculus
ccagtctatcaaagccatacttaag

SEQ ID NO: 588751 - DNA, 25 bp, Mus musculus
ccagtctatcaatgccatacttaag

SEQ ID NO: 588752 - DNA, 25 bp, Mus musculus
ccagtctcgctcagtctactgcata

SEQ ID NO: 588753 - DNA, 25 bp, Mus musculus
ccagtctcgctctgtctactgcata

SEQ ID NO: 588754 - DNA, 25 bp, Mus musculus
ccagtctgaggtaaggcctgagtgt

SEQ ID NO: 588755 - DNA, 25 bp, Mus musculus
ccagtctgaggttaggcctgagtgt

SEQ ID NO: 588756 - DNA, 25 bp, Mus musculus
ccagtctgagtgattgtccctttca

SEQ ID NO: 588757 - DNA, 25 bp, Mus musculus
ccagtctgagtgtttgtccctttca

SEQ ID NO: 588758 - DNA, 25 bp, Mus musculus
ccagtctgcaagcccagccaaggag

SEQ ID NO: 588759 - DNA, 25 bp, Mus musculus
ccagtctgcaaggccagccaaggag

SEQ ID NO: 588760 - DNA, 25 bp, Mus musculus
ccagtctgcggaagcagcacctgtt

SEQ ID NO: 588761 - DNA, 25 bp, Mus musculus
ccagtctgcggatgcagcacctgtt

SEQ ID NO: 588762 - DNA, 25 bp, Mus musculus
ccagtcttcagaccttccagcaaga

SEQ ID NO: 588763 - DNA, 25 bp, Mus musculus
ccagtcttcagagcttccagcaaga

SEQ ID NO: 588764 - DNA, 25 bp, Mus musculus
ccagtcttcagtcccatgtttgaac

SEQ ID NO: 588765 - DNA, 25 bp, Mus musculus
ccagtcttcagtgccatgtttgaac

SEQ ID NO: 588766 - DNA, 25 bp, Mus musculus
ccagtcttctctagaggaggttcca

SEQ ID NO: 588767 - DNA, 25 bp, Mus musculus
ccagtcttctcttgaggaggttcca

SEQ ID NO: 588768 - DNA, 25 bp, Mus musculus
ccagtcttgcatcgatgaccctcat

SEQ ID NO: 588769 - DNA, 25 bp, Mus musculus
ccagtcttgcatcttcttggtgaag

SEQ ID NO: 588770 - DNA, 25 bp, Mus musculus
ccagtcttgcatggatgaccctcat

SEQ ID NO: 588771 - DNA, 25 bp, Mus musculus
ccagtcttgcatgttcttggtgaag

SEQ ID NO: 588772 - DNA, 25 bp, Mus musculus
ccagtcttgctgctatggctgctgc

SEQ ID NO: 588773 - DNA, 25 bp, Mus musculus
ccagtcttgctggtatggctgctgc

SEQ ID NO: 588774 - DNA, 25 bp, Mus musculus
ccagtgaaaagcctctatcccctga

SEQ ID NO: 588775 - DNA, 25 bp, Mus musculus
ccagtgaaaagcgtctatcccctga

SEQ ID NO: 588776 - DNA, 25 bp, Mus musculus
ccagtgaaccataggatggtcttgc

SEQ ID NO: 588777 - DNA, 25 bp, Mus musculus
ccagtgaaccattggatggtcttgc

SEQ ID NO: 588778 - DNA, 25 bp, Mus musculus
ccagtgaaccggatccccatcatgg

SEQ ID NO: 588779 - DNA, 25 bp, Mus musculus
ccagtgaaccggttccccatcatgg

SEQ ID NO: 588780 - DNA, 25 bp, Mus musculus
ccagtgaagaggacattattcgaga

SEQ ID NO: 588781 - DNA, 25 bp, Mus musculus
ccagtgaagaggtcattattcgaga

SEQ ID NO: 588782 - DNA, 25 bp, Mus musculus
ccagtgaagccaccgagatcattga

SEQ ID NO: 588783 - DNA, 25 bp, Mus musculus
ccagtgaagccagcgagatcattga

SEQ ID NO: 588784 - DNA, 25 bp, Mus musculus
ccagtgaagcctagacatggtccag

SEQ ID NO: 588785 - DNA, 25 bp, Mus musculus
ccagtgaagccttgacatggtccag

SEQ ID NO: 588786 - DNA, 25 bp, Mus musculus
ccagtgaaggccacagcttgatgct

SEQ ID NO: 588787 - DNA, 25 bp, Mus musculus
ccagtgaaggcctcagcttgatgct

SEQ ID NO: 588788 - DNA, 25 bp, Mus musculus
ccagtgaagttaagcagaccagtac

SEQ ID NO: 588789 - DNA, 25 bp, Mus musculus
ccagtgaagttatgcagaccagtac

SEQ ID NO: 588790 - DNA, 25 bp, Mus musculus
ccagtgaatcacagacaggcttttt

SEQ ID NO: 588791 - DNA, 25 bp, Mus musculus
ccagtgaatcactgacaggcttttt

SEQ ID NO: 588792 - DNA, 25 bp, Mus musculus
ccagtgacataccttctccaggaag

SEQ ID NO: 588793 - DNA, 25 bp, Mus musculus
ccagtgacatacgttctccaggaag

SEQ ID NO: 588794 - DNA, 25 bp, Mus musculus
ccagtgacatcaagacgagtgacca

SEQ ID NO: 588795 - DNA, 25 bp, Mus musculus
ccagtgacatcatgacgagtgacca

SEQ ID NO: 588796 - DNA, 25 bp, Mus musculus
ccagtgacatttctctacgaggcat

SEQ ID NO: 588797 - DNA, 25 bp, Mus musculus
ccagtgacatttgtctacgaggcat

SEQ ID NO: 588798 - DNA, 25 bp, Mus musculus
ccagtgaccaccagatgaaccacag

SEQ ID NO: 588799 - DNA, 25 bp, Mus musculus
ccagtgaccacctgatgaaccacag

SEQ ID NO: 588800 - DNA, 25 bp, Mus musculus
ccagtgacctccctcagaagggcgt

SEQ ID NO: 588801 - DNA, 25 bp, Mus musculus
ccagtgacctccgtcagaagggcgt

SEQ ID NO: 588802 - DNA, 25 bp, Mus musculus
ccagtgacctgacgactatagagca

SEQ ID NO: 588803 - DNA, 25 bp, Mus musculus
ccagtgacctgaggactatagagca

SEQ ID NO: 588804 - DNA, 25 bp, Mus musculus
ccagtgagaacacccgtgagaacct

SEQ ID NO: 588805 - DNA, 25 bp, Mus musculus
ccagtgagaacagccgtgagaacct

SEQ ID NO: 588806 - DNA, 25 bp, Mus musculus
ccagtgagaagtagggacacggtcc

SEQ ID NO: 588807 - DNA, 25 bp, Mus musculus
ccagtgagaagtcaggtcctgccta

SEQ ID NO: 588808 - DNA, 25 bp, Mus musculus
ccagtgagaagtgaggtcctgccta

SEQ ID NO: 588809 - DNA, 25 bp, Mus musculus
ccagtgagaagttgggacacggtcc

SEQ ID NO: 588810 - DNA, 25 bp, Mus musculus
ccagtgagctcaaggaggctatgga

SEQ ID NO: 588811 - DNA, 25 bp, Mus musculus
ccagtgagctcatggaggctatgga

SEQ ID NO: 588812 - DNA, 25 bp, Mus musculus
ccagtgaggaacactccagggatct

SEQ ID NO: 588813 - DNA, 25 bp, Mus musculus
ccagtgaggaactctccagggatct

SEQ ID NO: 588814 - DNA, 25 bp, Mus musculus
ccagtgaggtccagagatccactca

SEQ ID NO: 588815 - DNA, 25 bp, Mus musculus
ccagtgaggtcctgagatccactca

SEQ ID NO: 588816 - DNA, 25 bp, Mus musculus
ccagtgaggtggagaaagccaaaga

SEQ ID NO: 588817 - DNA, 25 bp, Mus musculus
ccagtgaggtggtgaaagccaaaga

SEQ ID NO: 588818 - DNA, 25 bp, Mus musculus
ccagtgagtaagaaagttccttcac

SEQ ID NO: 588819 - DNA, 25 bp, Mus musculus
ccagtgagtaagtaagttccttcac

SEQ ID NO: 588820 - DNA, 25 bp, Mus musculus
ccagtgatcatgaggcgaaccttcc

SEQ ID NO: 588821 - DNA, 25 bp, Mus musculus
ccagtgatcatgtggcgaaccttcc

SEQ ID NO: 588822 - DNA, 25 bp, Mus musculus
ccagtgatgagaacgcccagcatgc

SEQ ID NO: 588823 - DNA, 25 bp, Mus musculus
ccagtgatgagatcgcccagcatgc

SEQ ID NO: 588824 - DNA, 25 bp, Mus musculus
ccagtgatgaggagcggatggtcat

SEQ ID NO: 588825 - DNA, 25 bp, Mus musculus
ccagtgatgaggtgcggatggtcat

SEQ ID NO: 588826 - DNA, 25 bp, Mus musculus
ccagtgatgttaaaagtatattgcc

SEQ ID NO: 588827 - DNA, 25 bp, Mus musculus
ccagtgatgttataagtatattgcc

SEQ ID NO: 588828 - DNA, 25 bp, Mus musculus
ccagtgattcaaccaccagttctac

SEQ ID NO: 588829 - DNA, 25 bp, Mus musculus
ccagtgattcaagcaccagttctac

SEQ ID NO: 588830 - DNA, 25 bp, Mus musculus
ccagtgcaagttcgtaaataaactt

SEQ ID NO: 588831 - DNA, 25 bp, Mus musculus
ccagtgcaagttggtaaataaactt

SEQ ID NO: 588832 - DNA, 25 bp, Mus musculus
ccagtgcaatggcaggagtttccac

SEQ ID NO: 588833 - DNA, 25 bp, Mus musculus
ccagtgcaatgggaggagtttccac

SEQ ID NO: 588834 - DNA, 25 bp, Mus musculus
ccagtgcaccgcatgctgtggagaa

SEQ ID NO: 588835 - DNA, 25 bp, Mus musculus
ccagtgcaccgcttgctgtggagaa

SEQ ID NO: 588836 - DNA, 25 bp, Mus musculus
ccagtgcaccttaggtgtgctccag

SEQ ID NO: 588837 - DNA, 25 bp, Mus musculus
ccagtgcacctttggtgtgctccag

SEQ ID NO: 588838 - DNA, 25 bp, Mus musculus
ccagtgcacgctctgtttgtgtcag

SEQ ID NO: 588839 - DNA, 25 bp, Mus musculus
ccagtgcacgctgtgtttgtgtcag

SEQ ID NO: 588840 - DNA, 25 bp, Mus musculus
ccagtgcccaagaacttgtctccag

SEQ ID NO: 588841 - DNA, 25 bp, Mus musculus
ccagtgcccaagtacttgtctccag

SEQ ID NO: 588842 - DNA, 25 bp, Mus musculus
ccagtgcccgacatcacagagtgag

SEQ ID NO: 588843 - DNA, 25 bp, Mus musculus
ccagtgcccgacttcacagagtgag

SEQ ID NO: 588844 - DNA, 25 bp, Mus musculus
ccagtgccctgacagaggaagcaga

SEQ ID NO: 588845 - DNA, 25 bp, Mus musculus
ccagtgccctgagagaggaagcaga

SEQ ID NO: 588846 - DNA, 25 bp, Mus musculus
ccagtgccgagacccgagaaaagct

SEQ ID NO: 588847 - DNA, 25 bp, Mus musculus
ccagtgccgagagccgagaaaagct

SEQ ID NO: 588848 - DNA, 25 bp, Mus musculus
ccagtgctaccaagggccagctgta

SEQ ID NO: 588849 - DNA, 25 bp, Mus musculus
ccagtgctaccatgggccagctgta

SEQ ID NO: 588850 - DNA, 25 bp, Mus musculus
ccagtgctatgacgacattcgagtg

SEQ ID NO: 588851 - DNA, 25 bp, Mus musculus
ccagtgctatgacgatgtgcgcgtc

SEQ ID NO: 588852 - DNA, 25 bp, Mus musculus
ccagtgctatgaggacattcgagtg

SEQ ID NO: 588853 - DNA, 25 bp, Mus musculus
ccagtgctatgaggatgtgcgcgtc

SEQ ID NO: 588854 - DNA, 25 bp, Mus musculus
ccagtgctcgctactgtatatatgc

SEQ ID NO: 588855 - DNA, 25 bp, Mus musculus
ccagtgctcgcttctgtatatatgc

SEQ ID NO: 588856 - DNA, 25 bp, Mus musculus
ccagtgctgacgattgaggaggccc

SEQ ID NO: 588857 - DNA, 25 bp, Mus musculus
ccagtgctgacgtttgaggaggccc

SEQ ID NO: 588858 - DNA, 25 bp, Mus musculus
ccagtgctgtgccagaagccagaaa

SEQ ID NO: 588859 - DNA, 25 bp, Mus musculus
ccagtgctgtgcctgtgacaggaga

SEQ ID NO: 588860 - DNA, 25 bp, Mus musculus
ccagtgctgtgcgagaagccagaaa

SEQ ID NO: 588861 - DNA, 25 bp, Mus musculus
ccagtgctgtgcgtgtgacaggaga

SEQ ID NO: 588862 - DNA, 25 bp, Mus musculus
ccagtgcttgaacctgaaggtgact

SEQ ID NO: 588863 - DNA, 25 bp, Mus musculus
ccagtgcttgaagctgaaggtgact

SEQ ID NO: 588864 - DNA, 25 bp, Mus musculus
ccagtgcttgtccacactagtccgt

SEQ ID NO: 588865 - DNA, 25 bp, Mus musculus
ccagtgcttgtcgacactagtccgt

SEQ ID NO: 588866 - DNA, 25 bp, Mus musculus
ccagtgctttttcgcgggaggccca

SEQ ID NO: 588867 - DNA, 25 bp, Mus musculus
ccagtgctttttggcgggaggccca

SEQ ID NO: 588868 - DNA, 25 bp, Mus musculus
ccagtggaagatcccattagtggtg

SEQ ID NO: 588869 - DNA, 25 bp, Mus musculus
ccagtggaagatgccattagtggtg

SEQ ID NO: 588870 - DNA, 25 bp, Mus musculus
ccagtggacaggatcaggcagaatc

SEQ ID NO: 588871 - DNA, 25 bp, Mus musculus
ccagtggacaggttcaggcagaatc

SEQ ID NO: 588872 - DNA, 25 bp, Mus musculus
ccagtggacttacatgacgccagcc

SEQ ID NO: 588873 - DNA, 25 bp, Mus musculus
ccagtggacttagatgacgccagcc

SEQ ID NO: 588874 - DNA, 25 bp, Mus musculus
ccagtggacttccagggtgttacat

SEQ ID NO: 588875 - DNA, 25 bp, Mus musculus
ccagtggacttcgagggtgttacat

SEQ ID NO: 588876 - DNA, 25 bp, Mus musculus
ccagtggagagacggtgaacttaac

SEQ ID NO: 588877 - DNA, 25 bp, Mus musculus
ccagtggagagagggtgaacttaac

SEQ ID NO: 588878 - DNA, 25 bp, Mus musculus
ccagtggcaaaactctggaagggcc

SEQ ID NO: 588879 - DNA, 25 bp, Mus musculus
ccagtggcaaaagtctggaagggcc

SEQ ID NO: 588880 - DNA, 25 bp, Mus musculus
ccagtggcacctatggtagtgacag

SEQ ID NO: 588881 - DNA, 25 bp, Mus musculus
ccagtggcacctttggtagtgacag

SEQ ID NO: 588882 - DNA, 25 bp, Mus musculus
ccagtggcatggcttcttctacggg

SEQ ID NO: 588883 - DNA, 25 bp, Mus musculus
ccagtggcatgggttcttctacggg

SEQ ID NO: 588884 - DNA, 25 bp, Mus musculus
ccagtggccaaaaggcatcacacta

SEQ ID NO: 588885 - DNA, 25 bp, Mus musculus
ccagtggccaaatggcatcacacta

SEQ ID NO: 588886 - DNA, 25 bp, Mus musculus
ccagtggccagaacaaggcagggta

SEQ ID NO: 588887 - DNA, 25 bp, Mus musculus
ccagtggccagatcaaggcagggta

SEQ ID NO: 588888 - DNA, 25 bp, Mus musculus
ccagtggccctgagactggctacaa

SEQ ID NO: 588889 - DNA, 25 bp, Mus musculus
ccagtggccctgtgactggctacaa

SEQ ID NO: 588890 - DNA, 25 bp, Mus musculus
ccagtggccgtcactattgggttga

SEQ ID NO: 588891 - DNA, 25 bp, Mus musculus
ccagtggccgtctctattgggttga

SEQ ID NO: 588892 - DNA, 25 bp, Mus musculus
ccagtggctggccagcagacatgaa

SEQ ID NO: 588893 - DNA, 25 bp, Mus musculus
ccagtggctggcgagcagacatgaa

SEQ ID NO: 588894 - DNA, 25 bp, Mus musculus
ccagtggcttggaaagatgagttct

SEQ ID NO: 588895 - DNA, 25 bp, Mus musculus
ccagtggcttggaggaagacaaatc

SEQ ID NO: 588896 - DNA, 25 bp, Mus musculus
ccagtggcttggtaagatgagttct

SEQ ID NO: 588897 - DNA, 25 bp, Mus musculus
ccagtggcttggtggaagacaaatc

SEQ ID NO: 588898 - DNA, 25 bp, Mus musculus
ccagtgggagagacggtgtcacctc

SEQ ID NO: 588899 - DNA, 25 bp, Mus musculus
ccagtgggagagtcggtgtcacctc

SEQ ID NO: 588900 - DNA, 25 bp, Mus musculus
ccagtgggccacagcctagaagctg

SEQ ID NO: 588901 - DNA, 25 bp, Mus musculus
ccagtgggccactgcctagaagctg

SEQ ID NO: 588902 - DNA, 25 bp, Mus musculus
ccagtgggtaggctttatcactcga

SEQ ID NO: 588903 - DNA, 25 bp, Mus musculus
ccagtgggtagggtttatcactcga

SEQ ID NO: 588904 - DNA, 25 bp, Mus musculus
ccagtgggtggacaaaataagagat

SEQ ID NO: 588905 - DNA, 25 bp, Mus musculus
ccagtgggtggagaaaataagagat

SEQ ID NO: 588906 - DNA, 25 bp, Mus musculus
ccagtggtagacatttaggcgcttc

SEQ ID NO: 588907 - DNA, 25 bp, Mus musculus
ccagtggtagacttttaggcgcttc

SEQ ID NO: 588908 - DNA, 25 bp, Mus musculus
ccagtggtatcactacaagaggcag

SEQ ID NO: 588909 - DNA, 25 bp, Mus musculus
ccagtggtatcagtacaagaggcag

SEQ ID NO: 588910 - DNA, 25 bp, Mus musculus
ccagtggtctctcggtgataataag

SEQ ID NO: 588911 - DNA, 25 bp, Mus musculus
ccagtggtctctgggtgataataag

SEQ ID NO: 588912 - DNA, 25 bp, Mus musculus
ccagtggtctgtctcgcagcgctga

SEQ ID NO: 588913 - DNA, 25 bp, Mus musculus
ccagtggtctgtgtcgcagcgctga

SEQ ID NO: 588914 - DNA, 25 bp, Mus musculus
ccagtggtgccaatctgaaagaagc

SEQ ID NO: 588915 - DNA, 25 bp, Mus musculus
ccagtggtgccattctgaaagaagc

SEQ ID NO: 588916 - DNA, 25 bp, Mus musculus
ccagtggtgcctccagcggtaactc

SEQ ID NO: 588917 - DNA, 25 bp, Mus musculus
ccagtggtgcctgcagcggtaactc

SEQ ID NO: 588918 - DNA, 25 bp, Mus musculus
ccagtggtggagacaccggcaatga

SEQ ID NO: 588919 - DNA, 25 bp, Mus musculus
ccagtggtggagtcaccggcaatga

SEQ ID NO: 588920 - DNA, 25 bp, Mus musculus
ccagtggtgtgaagaagctacagta

SEQ ID NO: 588921 - DNA, 25 bp, Mus musculus
ccagtggtgtgatgaagctacagta

SEQ ID NO: 588922 - DNA, 25 bp, Mus musculus
ccagtggttcatcccagctgtgaga

SEQ ID NO: 588923 - DNA, 25 bp, Mus musculus
ccagtggttcatgccagctgtgaga

SEQ ID NO: 588924 - DNA, 25 bp, Mus musculus
ccagtggttccacaatgggaggtcc

SEQ ID NO: 588925 - DNA, 25 bp, Mus musculus
ccagtggttccagaatgggaggtcc

SEQ ID NO: 588926 - DNA, 25 bp, Mus musculus
ccagtggttgaacgacaagatcctg

SEQ ID NO: 588927 - DNA, 25 bp, Mus musculus
ccagtggttgaaggacaagatcctg

SEQ ID NO: 588928 - DNA, 25 bp, Mus musculus
ccagtgtaatggagacacactattt

SEQ ID NO: 588929 - DNA, 25 bp, Mus musculus
ccagtgtaatggtgacacactattt

SEQ ID NO: 588930 - DNA, 25 bp, Mus musculus
ccagtgtaccagcaacgatgggaca

SEQ ID NO: 588931 - DNA, 25 bp, Mus musculus
ccagtgtaccaggaacgatgggaca

SEQ ID NO: 588932 - DNA, 25 bp, Mus musculus
ccagtgtacggtcagcttctagctt

SEQ ID NO: 588933 - DNA, 25 bp, Mus musculus
ccagtgtacggtgagcttctagctt

SEQ ID NO: 588934 - DNA, 25 bp, Mus musculus
ccagtgtagtaacccacctgtgggc

SEQ ID NO: 588935 - DNA, 25 bp, Mus musculus
ccagtgtagtaagccacctgtgggc

SEQ ID NO: 588936 - DNA, 25 bp, Mus musculus
ccagtgtcatcgcagagaagagccg

SEQ ID NO: 588937 - DNA, 25 bp, Mus musculus
ccagtgtcatcggagagaagagccg

SEQ ID NO: 588938 - DNA, 25 bp, Mus musculus
ccagtgtcgttactgcaggcttaag

SEQ ID NO: 588939 - DNA, 25 bp, Mus musculus
ccagtgtcgttagtgcaggcttaag

SEQ ID NO: 588940 - DNA, 25 bp, Mus musculus
ccagtgtctacacggctacacggga

SEQ ID NO: 588941 - DNA, 25 bp, Mus musculus
ccagtgtctacagggctacacggga

SEQ ID NO: 588942 - DNA, 25 bp, Mus musculus
ccagtgtctccaagatttgcttcca

SEQ ID NO: 588943 - DNA, 25 bp, Mus musculus
ccagtgtctccatgatttgcttcca

SEQ ID NO: 588944 - DNA, 25 bp, Mus musculus
ccagtgtgagccattggaggcccct

SEQ ID NO: 588945 - DNA, 25 bp, Mus musculus
ccagtgtgagcctttggaggcccct

SEQ ID NO: 588946 - DNA, 25 bp, Mus musculus
ccagtgtgaggcatacggaggcttc

SEQ ID NO: 588947 - DNA, 25 bp, Mus musculus
ccagtgtgaggcttacggaggcttc

SEQ ID NO: 588948 - DNA, 25 bp, Mus musculus
ccagtgtgcaaaagactgaggaaaa

SEQ ID NO: 588949 - DNA, 25 bp, Mus musculus
ccagtgtgcaaatgactgaggaaaa

SEQ ID NO: 588950 - DNA, 25 bp, Mus musculus
ccagtgtgctggcaaagtgctgcct

SEQ ID NO: 588951 - DNA, 25 bp, Mus musculus
ccagtgtgctgggaaagtgctgcct

SEQ ID NO: 588952 - DNA, 25 bp, Mus musculus
ccagtgtgtccacgaatgcatgaca

SEQ ID NO: 588953 - DNA, 25 bp, Mus musculus
ccagtgtgtccaggaatgcatgaca

SEQ ID NO: 588954 - DNA, 25 bp, Mus musculus
ccagtgtgtctacatccgtcctaga

SEQ ID NO: 588955 - DNA, 25 bp, Mus musculus
ccagtgtgtctagatccgtcctaga

SEQ ID NO: 588956 - DNA, 25 bp, Mus musculus
ccagtgtgttccaaacagatggcag

SEQ ID NO: 588957 - DNA, 25 bp, Mus musculus
ccagtgtgttcctaacagatggcag

SEQ ID NO: 588958 - DNA, 25 bp, Mus musculus
ccagtgttacctagaagttaatgga

SEQ ID NO: 588959 - DNA, 25 bp, Mus musculus
ccagtgttaccttgaagttaatgga

SEQ ID NO: 588960 - DNA, 25 bp, Mus musculus
ccagtgttagtcaggcggctgtgac

SEQ ID NO: 588961 - DNA, 25 bp, Mus musculus
ccagtgttagtctggcggctgtgac

SEQ ID NO: 588962 - DNA, 25 bp, Mus musculus
ccagtgttcagacggagaacgatcc

SEQ ID NO: 588963 - DNA, 25 bp, Mus musculus
ccagtgttcagagggagaacgatcc

SEQ ID NO: 588964 - DNA, 25 bp, Mus musculus
ccagtgttccatcaacagggatggc

SEQ ID NO: 588965 - DNA, 25 bp, Mus musculus
ccagtgttccatgaacagggatggc

SEQ ID NO: 588966 - DNA, 25 bp, Mus musculus
ccagtgttccttcgcacagggacag

SEQ ID NO: 588967 - DNA, 25 bp, Mus musculus
ccagtgttccttggcacagggacag

SEQ ID NO: 588968 - DNA, 25 bp, Mus musculus
ccagtgttcttacgagaaataataa

SEQ ID NO: 588969 - DNA, 25 bp, Mus musculus
ccagtgttcttaggagaaataataa

SEQ ID NO: 588970 - DNA, 25 bp, Mus musculus
ccagtgttgccacccacagaggagg

SEQ ID NO: 588971 - DNA, 25 bp, Mus musculus
ccagtgttgccagccacagaggagg

SEQ ID NO: 588972 - DNA, 25 bp, Mus musculus
ccagtgttgtggactccttcttcct

SEQ ID NO: 588973 - DNA, 25 bp, Mus musculus
ccagtgttgtggtctccttcttcct

SEQ ID NO: 588974 - DNA, 25 bp, Mus musculus
ccagtgtttgacagacatcaagaac

SEQ ID NO: 588975 - DNA, 25 bp, Mus musculus
ccagtgtttgactgacatcaagaac

SEQ ID NO: 588976 - DNA, 25 bp, Mus musculus
ccagtgtttgcaccgggaacatttc

SEQ ID NO: 588977 - DNA, 25 bp, Mus musculus
ccagtgtttgcagcgggaacatttc

SEQ ID NO: 588978 - DNA, 25 bp, Mus musculus
ccagtgttttgacttctagcggcac

SEQ ID NO: 588979 - DNA, 25 bp, Mus musculus
ccagtgttttgagttctagcggcac

SEQ ID NO: 588980 - DNA, 25 bp, Mus musculus
ccagttaaaatcagagagtgaagac

SEQ ID NO: 588981 - DNA, 25 bp, Mus musculus
ccagttaaaatctgagagtgaagac

SEQ ID NO: 588982 - DNA, 25 bp, Mus musculus
ccagttaactgaagatgtgctagtc

SEQ ID NO: 588983 - DNA, 25 bp, Mus musculus
ccagttaactgatgatgtgctagtc

SEQ ID NO: 588984 - DNA, 25 bp, Mus musculus
ccagttaattacactggctgaggca

SEQ ID NO: 588985 - DNA, 25 bp, Mus musculus
ccagttaattactctggctgaggca

SEQ ID NO: 588986 - DNA, 25 bp, Mus musculus
ccagttacaagcagccagtctgggt

SEQ ID NO: 588987 - DNA, 25 bp, Mus musculus
ccagttacaagctgccagtctgggt

SEQ ID NO: 588988 - DNA, 25 bp, Mus musculus
ccagttagcaatcagctagaaagca

SEQ ID NO: 588989 - DNA, 25 bp, Mus musculus
ccagttagcaatgagctagaaagca

SEQ ID NO: 588990 - DNA, 25 bp, Mus musculus
ccagttagcagaagaaattgaatcc

SEQ ID NO: 588991 - DNA, 25 bp, Mus musculus
ccagttagcagatgaaattgaatcc

SEQ ID NO: 588992 - DNA, 25 bp, Mus musculus
ccagttaggcagaagtgctggctgt

SEQ ID NO: 588993 - DNA, 25 bp, Mus musculus
ccagttaggcagtagtgctggctgt

SEQ ID NO: 588994 - DNA, 25 bp, Mus musculus
ccagttatggctataggtgctacaa

SEQ ID NO: 588995 - DNA, 25 bp, Mus musculus
ccagttatggctttaggtgctacaa

SEQ ID NO: 588996 - DNA, 25 bp, Mus musculus
ccagttcaagcaactcggccgcttg

SEQ ID NO: 588997 - DNA, 25 bp, Mus musculus
ccagttcaagcatctcggccgcttg

SEQ ID NO: 588998 - DNA, 25 bp, Mus musculus
ccagttcaagcgatgggaagtggca

SEQ ID NO: 588999 - DNA, 25 bp, Mus musculus
ccagttcaagcgttgggaagtggca

SEQ ID NO: 589000 - DNA, 25 bp, Mus musculus
ccagttcacctacgcctgtgggaca

SEQ ID NO: 589001 - DNA, 25 bp, Mus musculus
ccagttcacctaggcctgtgggaca

SEQ ID NO: 589002 - DNA, 25 bp, Mus musculus
ccagttcacgaaccatcagcaaggc

SEQ ID NO: 589003 - DNA, 25 bp, Mus musculus
ccagttcacgaagcatcagcaaggc

SEQ ID NO: 589004 - DNA, 25 bp, Mus musculus
ccagttcactgcagactatgcagca

SEQ ID NO: 589005 - DNA, 25 bp, Mus musculus
ccagttcactgctgactatgcagca

SEQ ID NO: 589006 - DNA, 25 bp, Mus musculus
ccagttccacagatccgaccagtta

SEQ ID NO: 589007 - DNA, 25 bp, Mus musculus
ccagttccacagttccgaccagtta

SEQ ID NO: 589008 - DNA, 25 bp, Mus musculus
ccagttcctactaagcatcgttgag

SEQ ID NO: 589009 - DNA, 25 bp, Mus musculus
ccagttcctacttagcatcgttgag

SEQ ID NO: 589010 - DNA, 25 bp, Mus musculus
ccagttcctgaccaagcctcgttag

SEQ ID NO: 589011 - DNA, 25 bp, Mus musculus
ccagttcctgacgaagcctcgttag

SEQ ID NO: 589012 - DNA, 25 bp, Mus musculus
ccagttcgaccccaataagctggca

SEQ ID NO: 589013 - DNA, 25 bp, Mus musculus
ccagttcgacccgaataagctggca

SEQ ID NO: 589014 - DNA, 25 bp, Mus musculus
ccagttcggacacagaatggtcccc

SEQ ID NO: 589015 - DNA, 25 bp, Mus musculus
ccagttcggacagagaatggtcccc

SEQ ID NO: 589016 - DNA, 25 bp, Mus musculus
ccagttctacacaaccaaagcaaaa

SEQ ID NO: 589017 - DNA, 25 bp, Mus musculus
ccagttctacactaccaaagcaaaa

SEQ ID NO: 589018 - DNA, 25 bp, Mus musculus
ccagttctctggcttcgtgatacac

SEQ ID NO: 589019 - DNA, 25 bp, Mus musculus
ccagttctctgggttcgtgatacac

SEQ ID NO: 589020 - DNA, 25 bp, Mus musculus
ccagttctgttgatttgtcctcggg

SEQ ID NO: 589021 - DNA, 25 bp, Mus musculus
ccagttctgttgttttgtcctcggg

SEQ ID NO: 589022 - DNA, 25 bp, Mus musculus
ccagttgaccagagaaatcctttct

SEQ ID NO: 589023 - DNA, 25 bp, Mus musculus
ccagttgaccagtgaaatcctttct

SEQ ID NO: 589024 - DNA, 25 bp, Mus musculus
ccagttgctatcatagtacagctaa

SEQ ID NO: 589025 - DNA, 25 bp, Mus musculus
ccagttgctatcttagtacagctaa

SEQ ID NO: 589026 - DNA, 25 bp, Mus musculus
ccagttgctcatcgcgttcctatta

SEQ ID NO: 589027 - DNA, 25 bp, Mus musculus
ccagttgctcatggcgttcctatta

SEQ ID NO: 589028 - DNA, 25 bp, Mus musculus
ccagttggaggaaagtagttgtgac

SEQ ID NO: 589029 - DNA, 25 bp, Mus musculus
ccagttggaggatagtagttgtgac

SEQ ID NO: 589030 - DNA, 25 bp, Mus musculus
ccagttggcatgcaataatgaggct

SEQ ID NO: 589031 - DNA, 25 bp, Mus musculus
ccagttggcatggaataatgaggct

SEQ ID NO: 589032 - DNA, 25 bp, Mus musculus
ccagttggcctcactgtggataagg

SEQ ID NO: 589033 - DNA, 25 bp, Mus musculus
ccagttggcctctctgtggataagg

SEQ ID NO: 589034 - DNA, 25 bp, Mus musculus
ccagttggcttactagggatgcttc

SEQ ID NO: 589035 - DNA, 25 bp, Mus musculus
ccagttggcttagtagggatgcttc

SEQ ID NO: 589036 - DNA, 25 bp, Mus musculus
ccagttgggcacaggcaataaaagt

SEQ ID NO: 589037 - DNA, 25 bp, Mus musculus
ccagttgggcactggcaataaaagt

SEQ ID NO: 589038 - DNA, 25 bp, Mus musculus
ccagttgtacttcacgcagccttca

SEQ ID NO: 589039 - DNA, 25 bp, Mus musculus
ccagttgtacttgacgcagccttca

SEQ ID NO: 589040 - DNA, 25 bp, Mus musculus
ccagttgtatgaccgggcactcaaa

SEQ ID NO: 589041 - DNA, 25 bp, Mus musculus
ccagttgtatgagcgggcactcaaa

SEQ ID NO: 589042 - DNA, 25 bp, Mus musculus
ccagttgtcattccagactcttata

SEQ ID NO: 589043 - DNA, 25 bp, Mus musculus
ccagttgtcattgcagactcttata

SEQ ID NO: 589044 - DNA, 25 bp, Mus musculus
ccagttgtgactactccatccgtgt

SEQ ID NO: 589045 - DNA, 25 bp, Mus musculus
ccagttgtgacttctccatccgtgt

SEQ ID NO: 589046 - DNA, 25 bp, Mus musculus
ccagttgttcgaagcctcctgaggg

SEQ ID NO: 589047 - DNA, 25 bp, Mus musculus
ccagttgttcgatgcctcctgaggg

SEQ ID NO: 589048 - DNA, 25 bp, Mus musculus
ccagttgttgatcacccggactcag

SEQ ID NO: 589049 - DNA, 25 bp, Mus musculus
ccagttgttgatgacccggactcag

SEQ ID NO: 589050 - DNA, 25 bp, Mus musculus
ccagtttaagagcattatcgaacac

SEQ ID NO: 589051 - DNA, 25 bp, Mus musculus
ccagtttaagaggattatcgaacac

SEQ ID NO: 589052 - DNA, 25 bp, Mus musculus
ccagtttacaccaggtgaagaggac

SEQ ID NO: 589053 - DNA, 25 bp, Mus musculus
ccagtttacacctggtgaagaggac

SEQ ID NO: 589054 - DNA, 25 bp, Mus musculus
ccagtttacggtcccgctgctggag

SEQ ID NO: 589055 - DNA, 25 bp, Mus musculus
ccagtttacggtgccgctgctggag

SEQ ID NO: 589056 - DNA, 25 bp, Mus musculus
ccagtttacttcactgcgggacctg

SEQ ID NO: 589057 - DNA, 25 bp, Mus musculus
ccagtttacttctctgcgggacctg

SEQ ID NO: 589058 - DNA, 25 bp, Mus musculus
ccagtttagggaagacagtgacagc

SEQ ID NO: 589059 - DNA, 25 bp, Mus musculus
ccagtttagggatgacagtgacagc

SEQ ID NO: 589060 - DNA, 25 bp, Mus musculus
ccagtttatttgagtattccataga

SEQ ID NO: 589061 - DNA, 25 bp, Mus musculus
ccagtttatttgtgtattccataga

SEQ ID NO: 589062 - DNA, 25 bp, Mus musculus
ccagtttccagcctgaacaattcca

SEQ ID NO: 589063 - DNA, 25 bp, Mus musculus
ccagtttccagcgtgaacaattcca

SEQ ID NO: 589064 - DNA, 25 bp, Mus musculus
ccagtttcccttctgggaatccttg

SEQ ID NO: 589065 - DNA, 25 bp, Mus musculus
ccagtttcccttgtgggaatccttg

SEQ ID NO: 589066 - DNA, 25 bp, Mus musculus
ccagtttctcagagagatgcaagag

SEQ ID NO: 589067 - DNA, 25 bp, Mus musculus
ccagtttctcagtgagatgcaagag

SEQ ID NO: 589068 - DNA, 25 bp, Mus musculus
ccagtttgccaacctggtgcgggaa

SEQ ID NO: 589069 - DNA, 25 bp, Mus musculus
ccagtttgccaagctggtgcgggaa

SEQ ID NO: 589070 - DNA, 25 bp, Mus musculus
ccagtttgcccaagtctccaaggct

SEQ ID NO: 589071 - DNA, 25 bp, Mus musculus
ccagtttgcccatgtctccaaggct

SEQ ID NO: 589072 - DNA, 25 bp, Mus musculus
ccagtttggagaacgagcctctgag

SEQ ID NO: 589073 - DNA, 25 bp, Mus musculus
ccagtttggagatcgagcctctgag

SEQ ID NO: 589074 - DNA, 25 bp, Mus musculus
ccagtttgtggcctgttaccatgaa

SEQ ID NO: 589075 - DNA, 25 bp, Mus musculus
ccagtttgtggcgtgttaccatgaa

SEQ ID NO: 589076 - DNA, 25 bp, Mus musculus
ccagttttactgaggcacggatgaa

SEQ ID NO: 589077 - DNA, 25 bp, Mus musculus
ccagttttactgtggcacggatgaa

SEQ ID NO: 589078 - DNA, 25 bp, Mus musculus
ccagttttgttgctcctgttggaca

SEQ ID NO: 589079 - DNA, 25 bp, Mus musculus
ccagttttgttggtcctgttggaca

SEQ ID NO: 589080 - DNA, 25 bp, Mus musculus
ccataaaaaactctgatggtgttcc

SEQ ID NO: 589081 - DNA, 25 bp, Mus musculus
ccataaaaaactgtgatggtgttcc

SEQ ID NO: 589082 - DNA, 25 bp, Mus musculus
ccataaacgctgcagaagagctgac

SEQ ID NO: 589083 - DNA, 25 bp, Mus musculus
ccataaacgctggagaagagctgac

SEQ ID NO: 589084 - DNA, 25 bp, Mus musculus
ccataaagattcaggttaaggagtc

SEQ ID NO: 589085 - DNA, 25 bp, Mus musculus
ccataaagattctggttaaggagtc

SEQ ID NO: 589086 - DNA, 25 bp, Mus musculus
ccataaaggtagacaggaagtgctc

SEQ ID NO: 589087 - DNA, 25 bp, Mus musculus
ccataaaggtagtcaggaagtgctc

SEQ ID NO: 589088 - DNA, 25 bp, Mus musculus
ccataaatatgcagagcggaggctc

SEQ ID NO: 589089 - DNA, 25 bp, Mus musculus
ccataaatatgctgagcggaggctc

SEQ ID NO: 589090 - DNA, 25 bp, Mus musculus
ccataaatatggctgaatttgatgc

SEQ ID NO: 589091 - DNA, 25 bp, Mus musculus
ccataaatatgggtgaatttgatgc

SEQ ID NO: 589092 - DNA, 25 bp, Mus musculus
ccataacaagtgcacaaaggaagct

SEQ ID NO: 589093 - DNA, 25 bp, Mus musculus
ccataacaagtggacaaaggaagct

SEQ ID NO: 589094 - DNA, 25 bp, Mus musculus
ccataaccctttctggtggcttgca

SEQ ID NO: 589095 - DNA, 25 bp, Mus musculus
ccataaccctttgtggtggcttgca

SEQ ID NO: 589096 - DNA, 25 bp, Mus musculus
ccataaccgttgaggagattcttca

SEQ ID NO: 589097 - DNA, 25 bp, Mus musculus
ccataaccgttgtggagattcttca

SEQ ID NO: 589098 - DNA, 25 bp, Mus musculus
ccataacgctgacttttaatgacca

SEQ ID NO: 589099 - DNA, 25 bp, Mus musculus
ccataacgctgagttttaatgacca

SEQ ID NO: 589100 - DNA, 25 bp, Mus musculus
ccataagaaagcaattgagaagtac

SEQ ID NO: 589101 - DNA, 25 bp, Mus musculus
ccataagaaagctattgagaagtac

SEQ ID NO: 589102 - DNA, 25 bp, Mus musculus
ccataagaaattaggcttgcataat

SEQ ID NO: 589103 - DNA, 25 bp, Mus musculus
ccataagaaatttggcttgcataat

SEQ ID NO: 589104 - DNA, 25 bp, Mus musculus
ccataagagatgcaaaagaacctac

SEQ ID NO: 589105 - DNA, 25 bp, Mus musculus
ccataagagatggaaaagaacctac

SEQ ID NO: 589106 - DNA, 25 bp, Mus musculus
ccataagttataaacatcggtacag

SEQ ID NO: 589107 - DNA, 25 bp, Mus musculus
ccataagttatatacatcggtacag

SEQ ID NO: 589108 - DNA, 25 bp, Mus musculus
ccataatcggagagtatgctggaga

SEQ ID NO: 589109 - DNA, 25 bp, Mus musculus
ccataatcggagtgtatgctggaga

SEQ ID NO: 589110 - DNA, 25 bp, Mus musculus
ccataatgctctaggaggagagctc

SEQ ID NO: 589111 - DNA, 25 bp, Mus musculus
ccataatgctcttggaggagagctc

SEQ ID NO: 589112 - DNA, 25 bp, Mus musculus
ccataatgggagatcctggtcctca

SEQ ID NO: 589113 - DNA, 25 bp, Mus musculus
ccataatgggagttcctggtcctca

SEQ ID NO: 589114 - DNA, 25 bp, Mus musculus
ccataattcctaaaatgaacactgg

SEQ ID NO: 589115 - DNA, 25 bp, Mus musculus
ccataattcctataatgaacactgg

SEQ ID NO: 589116 - DNA, 25 bp, Mus musculus
ccatacaaggtgagtcgaagtcgaa

SEQ ID NO: 589117 - DNA, 25 bp, Mus musculus
ccatacaaggtgtgtcgaagtcgaa

SEQ ID NO: 589118 - DNA, 25 bp, Mus musculus
ccatacactgggataggacacttgt

SEQ ID NO: 589119 - DNA, 25 bp, Mus musculus
ccatacactgggttaggacacttgt

SEQ ID NO: 589120 - DNA, 25 bp, Mus musculus
ccatacagagaaactgaggtgaaaa

SEQ ID NO: 589121 - DNA, 25 bp, Mus musculus
ccatacagagaatctgaggtgaaaa

SEQ ID NO: 589122 - DNA, 25 bp, Mus musculus
ccatacagcttacttgataatacag

SEQ ID NO: 589123 - DNA, 25 bp, Mus musculus
ccatacagcttagttgataatacag

SEQ ID NO: 589124 - DNA, 25 bp, Mus musculus
ccatacatacctacagctgggaagt

SEQ ID NO: 589125 - DNA, 25 bp, Mus musculus
ccatacataccttcagctgggaagt

SEQ ID NO: 589126 - DNA, 25 bp, Mus musculus
ccatacatgaggagcatgctgcagt

SEQ ID NO: 589127 - DNA, 25 bp, Mus musculus
ccatacatgaggtgcatgctgcagt

SEQ ID NO: 589128 - DNA, 25 bp, Mus musculus
ccataccattctcctgaagttctct

SEQ ID NO: 589129 - DNA, 25 bp, Mus musculus
ccataccattctgctgaagttctct

SEQ ID NO: 589130 - DNA, 25 bp, Mus musculus
ccatacccgggcagagaggaacatt

SEQ ID NO: 589131 - DNA, 25 bp, Mus musculus
ccatacccgggctgagaggaacatt

SEQ ID NO: 589132 - DNA, 25 bp, Mus musculus
ccatacctgtggaccccatttgttt

SEQ ID NO: 589133 - DNA, 25 bp, Mus musculus
ccatacctgtggtccccatttgttt

SEQ ID NO: 589134 - DNA, 25 bp, Mus musculus
ccatacgcatgaaaacggcacactg

SEQ ID NO: 589135 - DNA, 25 bp, Mus musculus
ccatacgcatgataacggcacactg

SEQ ID NO: 589136 - DNA, 25 bp, Mus musculus
ccatactacatgacacccgagagaa

SEQ ID NO: 589137 - DNA, 25 bp, Mus musculus
ccatactacatgtcacccgagagaa

SEQ ID NO: 589138 - DNA, 25 bp, Mus musculus
ccatactatgtgaaacctgttgcca

SEQ ID NO: 589139 - DNA, 25 bp, Mus musculus
ccatactatgtgtaacctgttgcca

SEQ ID NO: 589140 - DNA, 25 bp, Mus musculus
ccatactcaaggacaatgtgagaag

SEQ ID NO: 589141 - DNA, 25 bp, Mus musculus
ccatactcaaggtcaatgtgagaag

SEQ ID NO: 589142 - DNA, 25 bp, Mus musculus
ccatactgagacctatagtttctca

SEQ ID NO: 589143 - DNA, 25 bp, Mus musculus
ccatactgagacgtatagtttctca

SEQ ID NO: 589144 - DNA, 25 bp, Mus musculus
ccatactgttttctggagttccatg

SEQ ID NO: 589145 - DNA, 25 bp, Mus musculus
ccatactgttttgtggagttccatg

SEQ ID NO: 589146 - DNA, 25 bp, Mus musculus
ccatacttacagatgttgatcctaa

SEQ ID NO: 589147 - DNA, 25 bp, Mus musculus
ccatacttacagttgttgatcctaa

SEQ ID NO: 589148 - DNA, 25 bp, Mus musculus
ccatacttcatccaggaggctgcct

SEQ ID NO: 589149 - DNA, 25 bp, Mus musculus
ccatacttcatcgaggaggctgcct

SEQ ID NO: 589150 - DNA, 25 bp, Mus musculus
ccatactttttgcatagacgccaag

SEQ ID NO: 589151 - DNA, 25 bp, Mus musculus
ccatactttttggatagacgccaag

SEQ ID NO: 589152 - DNA, 25 bp, Mus musculus
ccatagaacaaacaagaggccctcc

SEQ ID NO: 589153 - DNA, 25 bp, Mus musculus
ccatagaacaaagaagaggccctcc

SEQ ID NO: 589154 - DNA, 25 bp, Mus musculus
ccatagaagagtcaaccgtgcctca

SEQ ID NO: 589155 - DNA, 25 bp, Mus musculus
ccatagaagagtgaaccgtgcctca

SEQ ID NO: 589156 - DNA, 25 bp, Mus musculus
ccatagaagtgaagtgtccacctgg

SEQ ID NO: 589157 - DNA, 25 bp, Mus musculus
ccatagaagtgatgtgtccacctgg

SEQ ID NO: 589158 - DNA, 25 bp, Mus musculus
ccatagaataatctcatttcctgag

SEQ ID NO: 589159 - DNA, 25 bp, Mus musculus
ccatagaataatgtcatttcctgag

SEQ ID NO: 589160 - DNA, 25 bp, Mus musculus
ccatagacaatcaggcaaagcctgt

SEQ ID NO: 589161 - DNA, 25 bp, Mus musculus
ccatagacaatctggcaaagcctgt

SEQ ID NO: 589162 - DNA, 25 bp, Mus musculus
ccatagagctagacgggagaaagaa

SEQ ID NO: 589163 - DNA, 25 bp, Mus musculus
ccatagagctagtcgggagaaagaa

SEQ ID NO: 589164 - DNA, 25 bp, Mus musculus
ccatagaggaatagctaaaggaggc

SEQ ID NO: 589165 - DNA, 25 bp, Mus musculus
ccatagaggaattgctaaaggaggc

SEQ ID NO: 589166 - DNA, 25 bp, Mus musculus
ccatagcagtcaaaagaaggatacg

SEQ ID NO: 589167 - DNA, 25 bp, Mus musculus
ccatagcagtcataagaaggatacg

SEQ ID NO: 589168 - DNA, 25 bp, Mus musculus
ccatagccactgagagggaggccca

SEQ ID NO: 589169 - DNA, 25 bp, Mus musculus
ccatagccactgtgagggaggccca

SEQ ID NO: 589170 - DNA, 25 bp, Mus musculus
ccatagccatagatgcggtccttct

SEQ ID NO: 589171 - DNA, 25 bp, Mus musculus
ccatagccatagttgcggtccttct

SEQ ID NO: 589172 - DNA, 25 bp, Mus musculus
ccatagccattcatcagctgcagga

SEQ ID NO: 589173 - DNA, 25 bp, Mus musculus
ccatagccattcatgccaaacctgg

SEQ ID NO: 589174 - DNA, 25 bp, Mus musculus
ccatagccattcttcagctgcagga

SEQ ID NO: 589175 - DNA, 25 bp, Mus musculus
ccatagccattcttgccaaacctgg

SEQ ID NO: 589176 - DNA, 25 bp, Mus musculus
ccatagcctaaaactgtcccttcta

SEQ ID NO: 589177 - DNA, 25 bp, Mus musculus
ccatagcctaaatctgtcccttcta

SEQ ID NO: 589178 - DNA, 25 bp, Mus musculus
ccatagctgagcaccttacgagtga

SEQ ID NO: 589179 - DNA, 25 bp, Mus musculus
ccatagctgagctccttacgagtga

SEQ ID NO: 589180 - DNA, 25 bp, Mus musculus
ccatagctgtggatccgttgtcggg

SEQ ID NO: 589181 - DNA, 25 bp, Mus musculus
ccatagctgtggttccgttgtcggg

SEQ ID NO: 589182 - DNA, 25 bp, Mus musculus
ccataggactccagcgttgtatgac

SEQ ID NO: 589183 - DNA, 25 bp, Mus musculus
ccataggactcctgcgttgtatgac

SEQ ID NO: 589184 - DNA, 25 bp, Mus musculus
ccataggagtggaatttggctcaaa

SEQ ID NO: 589185 - DNA, 25 bp, Mus musculus
ccataggagtggtatttggctcaaa

SEQ ID NO: 589186 - DNA, 25 bp, Mus musculus
ccatagggagcaaccagcgagtgca

SEQ ID NO: 589187 - DNA, 25 bp, Mus musculus
ccatagggagcatccagcgagtgca

SEQ ID NO: 589188 - DNA, 25 bp, Mus musculus
ccatagtgagttcttctggcatgaa

SEQ ID NO: 589189 - DNA, 25 bp, Mus musculus
ccatagtgagttgttctggcatgaa

SEQ ID NO: 589190 - DNA, 25 bp, Mus musculus
ccatagtggacacaccctctatgaa

SEQ ID NO: 589191 - DNA, 25 bp, Mus musculus
ccatagtggacagaccctctatgaa

SEQ ID NO: 589192 - DNA, 25 bp, Mus musculus
ccatataagtgaaaatcgtgaagaa

SEQ ID NO: 589193 - DNA, 25 bp, Mus musculus
ccatataagtgataatcgtgaagaa

SEQ ID NO: 589194 - DNA, 25 bp, Mus musculus
ccatatactgacaatgtgtctacca

SEQ ID NO: 589195 - DNA, 25 bp, Mus musculus
ccatatactgactatgtgtctacca

SEQ ID NO: 589196 - DNA, 25 bp, Mus musculus
ccatatagaggccaatgattcatct

SEQ ID NO: 589197 - DNA, 25 bp, Mus musculus
ccatatagaggcgaatgattcatct

SEQ ID NO: 589198 - DNA, 25 bp, Mus musculus
ccatataggactcaggacatccagc

SEQ ID NO: 589199 - DNA, 25 bp, Mus musculus
ccatataggactgaggacatccagc

SEQ ID NO: 589200 - DNA, 25 bp, Mus musculus
ccatatatggatcggtttaaaatgc

SEQ ID NO: 589201 - DNA, 25 bp, Mus musculus
ccatatatggatgggtttaaaatgc

SEQ ID NO: 589202 - DNA, 25 bp, Mus musculus
ccatatcagggcattgttgagcacc

SEQ ID NO: 589203 - DNA, 25 bp, Mus musculus
ccatatcagggctttgttgagcacc

SEQ ID NO: 589204 - DNA, 25 bp, Mus musculus
ccatatccatgcatcccttgtataa

SEQ ID NO: 589205 - DNA, 25 bp, Mus musculus
ccatatccatgcttcccttgtataa

SEQ ID NO: 589206 - DNA, 25 bp, Mus musculus
ccatatcctggactgtcctgaaggg

SEQ ID NO: 589207 - DNA, 25 bp, Mus musculus
ccatatcctggagtgtcctgaaggg

SEQ ID NO: 589208 - DNA, 25 bp, Mus musculus
ccatatctgggaacgggtatgagtg

SEQ ID NO: 589209 - DNA, 25 bp, Mus musculus
ccatatctgggatcgggtatgagtg

SEQ ID NO: 589210 - DNA, 25 bp, Mus musculus
ccatatcttaatcaaaagaagctga

SEQ ID NO: 589211 - DNA, 25 bp, Mus musculus
ccatatcttaatgaaaagaagctga

SEQ ID NO: 589212 - DNA, 25 bp, Mus musculus
ccatatctttaaaagcgaggccctg

SEQ ID NO: 589213 - DNA, 25 bp, Mus musculus
ccatatctttaatagcgaggccctg

SEQ ID NO: 589214 - DNA, 25 bp, Mus musculus
ccatatgacttgagatagcagtgct

SEQ ID NO: 589215 - DNA, 25 bp, Mus musculus
ccatatgacttgtgatagcagtgct

SEQ ID NO: 589216 - DNA, 25 bp, Mus musculus
ccatatgagaaaatcaggacgatga

SEQ ID NO: 589217 - DNA, 25 bp, Mus musculus
ccatatgagaaattcaggacgatga

SEQ ID NO: 589218 - DNA, 25 bp, Mus musculus
ccatatgcaaaacaattggaaactg

SEQ ID NO: 589219 - DNA, 25 bp, Mus musculus
ccatatgcaaaagaattggaaactg

SEQ ID NO: 589220 - DNA, 25 bp, Mus musculus
ccatatgcagacataagggacttca

SEQ ID NO: 589221 - DNA, 25 bp, Mus musculus
ccatatgcagacttaagggacttca

SEQ ID NO: 589222 - DNA, 25 bp, Mus musculus
ccatatggacctcaggtggcggcaa

SEQ ID NO: 589223 - DNA, 25 bp, Mus musculus
ccatatggacctgaggtggcggcaa

SEQ ID NO: 589224 - DNA, 25 bp, Mus musculus
ccatatggcgacagtagaatgctag

SEQ ID NO: 589225 - DNA, 25 bp, Mus musculus
ccatatggcgactgtagaatgctag

SEQ ID NO: 589226 - DNA, 25 bp, Mus musculus
ccatatgttcacatacttgatgcaa

SEQ ID NO: 589227 - DNA, 25 bp, Mus musculus
ccatatgttcacttacttgatgcaa

SEQ ID NO: 589228 - DNA, 25 bp, Mus musculus
ccatatgtttgtcccggtacattca

SEQ ID NO: 589229 - DNA, 25 bp, Mus musculus
ccatatgtttgtgccggtacattca

SEQ ID NO: 589230 - DNA, 25 bp, Mus musculus
ccatattactagagttgtaactgaa

SEQ ID NO: 589231 - DNA, 25 bp, Mus musculus
ccatattactagtgttgtaactgaa

SEQ ID NO: 589232 - DNA, 25 bp, Mus musculus
ccatattagtcaattggcagaagca

SEQ ID NO: 589233 - DNA, 25 bp, Mus musculus
ccatattagtcatttggcagaagca

SEQ ID NO: 589234 - DNA, 25 bp, Mus musculus
ccatattatgaaagctctttggcca

SEQ ID NO: 589235 - DNA, 25 bp, Mus musculus
ccatattatgaatgctctttggcca

SEQ ID NO: 589236 - DNA, 25 bp, Mus musculus
ccatattgatcactcaagtgctggg

SEQ ID NO: 589237 - DNA, 25 bp, Mus musculus
ccatattgatcagtcaagtgctggg

SEQ ID NO: 589238 - DNA, 25 bp, Mus musculus
ccatattggatgcaaatttacagcc

SEQ ID NO: 589239 - DNA, 25 bp, Mus musculus
ccatattggatggaaatttacagcc

SEQ ID NO: 589240 - DNA, 25 bp, Mus musculus
ccatattgtctgaacgcctggagca

SEQ ID NO: 589241 - DNA, 25 bp, Mus musculus
ccatattgtctgtacgcctggagca

SEQ ID NO: 589242 - DNA, 25 bp, Mus musculus
ccatatttacctcagtgtgtgaaga

SEQ ID NO: 589243 - DNA, 25 bp, Mus musculus
ccatatttacctgagtgtgtgaaga

SEQ ID NO: 589244 - DNA, 25 bp, Mus musculus
ccatatttgctgagtccacacgggt

SEQ ID NO: 589245 - DNA, 25 bp, Mus musculus
ccatatttgctgtgtccacacgggt

SEQ ID NO: 589246 - DNA, 25 bp, Mus musculus
ccatcaaaagccagaagtatatgct

SEQ ID NO: 589247 - DNA, 25 bp, Mus musculus
ccatcaaaagcctgaagtatatgct

SEQ ID NO: 589248 - DNA, 25 bp, Mus musculus
ccatcaaaccacaagatgactgcca

SEQ ID NO: 589249 - DNA, 25 bp, Mus musculus
ccatcaaaccactagatgactgcca

SEQ ID NO: 589250 - DNA, 25 bp, Mus musculus
ccatcaaaccagcaactacagttga

SEQ ID NO: 589251 - DNA, 25 bp, Mus musculus
ccatcaaaccaggaactacagttga

SEQ ID NO: 589252 - DNA, 25 bp, Mus musculus
ccatcaaacctcactgtagaggagc

SEQ ID NO: 589253 - DNA, 25 bp, Mus musculus
ccatcaaacctctctgtagaggagc

SEQ ID NO: 589254 - DNA, 25 bp, Mus musculus
ccatcaaagaagcactggcgaggtg

SEQ ID NO: 589255 - DNA, 25 bp, Mus musculus
ccatcaaagaaggactggcgaggtg

SEQ ID NO: 589256 - DNA, 25 bp, Mus musculus
ccatcaacagggatggcagcaataa

SEQ ID NO: 589257 - DNA, 25 bp, Mus musculus
ccatcaacagggttggcagcaataa

SEQ ID NO: 589258 - DNA, 25 bp, Mus musculus
ccatcaagaagcagaccaggaagcc

SEQ ID NO: 589259 - DNA, 25 bp, Mus musculus
ccatcaagaagctgaccaggaagcc

SEQ ID NO: 589260 - DNA, 25 bp, Mus musculus
ccatcaagatgacaagccttccgag

SEQ ID NO: 589261 - DNA, 25 bp, Mus musculus
ccatcaagatgagaagccttccgag

SEQ ID NO: 589262 - DNA, 25 bp, Mus musculus
ccatcaaggaagcaagtcggcaaaa

SEQ ID NO: 589263 - DNA, 25 bp, Mus musculus
ccatcaaggaaggaagtcggcaaaa

SEQ ID NO: 589264 - DNA, 25 bp, Mus musculus
ccatcaaggcataggaggattctct

SEQ ID NO: 589265 - DNA, 25 bp, Mus musculus
ccatcaaggcattggaggattctct

SEQ ID NO: 589266 - DNA, 25 bp, Mus musculus
ccatcaaggtgacagataggagcgg

SEQ ID NO: 589267 - DNA, 25 bp, Mus musculus
ccatcaaggtgagagataggagcgg

SEQ ID NO: 589268 - DNA, 25 bp, Mus musculus
ccatcaatggaacggtggacaccac

SEQ ID NO: 589269 - DNA, 25 bp, Mus musculus
ccatcaatggaagggtggacaccac

SEQ ID NO: 589270 - DNA, 25 bp, Mus musculus
ccatcacacaggcaaacccaggaag

SEQ ID NO: 589271 - DNA, 25 bp, Mus musculus
ccatcacacagggaaacccaggaag

SEQ ID NO: 589272 - DNA, 25 bp, Mus musculus
ccatcacacatgaacttctgcctag

SEQ ID NO: 589273 - DNA, 25 bp, Mus musculus
ccatcacacatgtacttctgcctag

SEQ ID NO: 589274 - DNA, 25 bp, Mus musculus
ccatcacaccaaacatgacatttac

SEQ ID NO: 589275 - DNA, 25 bp, Mus musculus
ccatcacaccaatcatgacatttac

SEQ ID NO: 589276 - DNA, 25 bp, Mus musculus
ccatcacagaccatgtgaagaacac

SEQ ID NO: 589277 - DNA, 25 bp, Mus musculus
ccatcacagaccttgtgaagaacac

SEQ ID NO: 589278 - DNA, 25 bp, Mus musculus
ccatcacagcctagagggaaatcaa

SEQ ID NO: 589279 - DNA, 25 bp, Mus musculus
ccatcacagccttgagggaaatcaa

SEQ ID NO: 589280 - DNA, 25 bp, Mus musculus
ccatcacagtcgataggcagggctt

SEQ ID NO: 589281 - DNA, 25 bp, Mus musculus
ccatcacagtcgttaggcagggctt

SEQ ID NO: 589282 - DNA, 25 bp, Mus musculus
ccatcacagtgaagtttgcagccaa

SEQ ID NO: 589283 - DNA, 25 bp, Mus musculus
ccatcacagtgatgtttgcagccaa

SEQ ID NO: 589284 - DNA, 25 bp, Mus musculus
ccatcaccaccgagtgagtggcagc

SEQ ID NO: 589285 - DNA, 25 bp, Mus musculus
ccatcaccaccgtgtgagtggcagc

SEQ ID NO: 589286 - DNA, 25 bp, Mus musculus
ccatcaccatagagatgggcttcct

SEQ ID NO: 589287 - DNA, 25 bp, Mus musculus
ccatcaccatagtgatgggcttcct

SEQ ID NO: 589288 - DNA, 25 bp, Mus musculus
ccatcaccggaaagaaaccttgtct

SEQ ID NO: 589289 - DNA, 25 bp, Mus musculus
ccatcaccggaatgaaaccttgtct

SEQ ID NO: 589290 - DNA, 25 bp, Mus musculus
ccatcaccgtgcaggagctcatggg

SEQ ID NO: 589291 - DNA, 25 bp, Mus musculus
ccatcaccgtgctggagctcatggg

SEQ ID NO: 589292 - DNA, 25 bp, Mus musculus
ccatcacctatgatctccagaaacg

SEQ ID NO: 589293 - DNA, 25 bp, Mus musculus
ccatcacctatgttctccagaaacg

SEQ ID NO: 589294 - DNA, 25 bp, Mus musculus
ccatcacctggtcgaagccataaga

SEQ ID NO: 589295 - DNA, 25 bp, Mus musculus
ccatcacctggtggaagccataaga

SEQ ID NO: 589296 - DNA, 25 bp, Mus musculus
ccatcaccttataaggtcacagcag

SEQ ID NO: 589297 - DNA, 25 bp, Mus musculus
ccatcaccttattaggtcacagcag

SEQ ID NO: 589298 - DNA, 25 bp, Mus musculus
ccatcaccttgtagagactctcaag

SEQ ID NO: 589299 - DNA, 25 bp, Mus musculus
ccatcaccttgttgagactctcaag

SEQ ID NO: 589300 - DNA, 25 bp, Mus musculus
ccatcacggactacctgtgggacaa

SEQ ID NO: 589301 - DNA, 25 bp, Mus musculus
ccatcacggacttcctgtgggacaa

SEQ ID NO: 589302 - DNA, 25 bp, Mus musculus
ccatcactgcccattgggagaagga

SEQ ID NO: 589303 - DNA, 25 bp, Mus musculus
ccatcactgccctttgggagaagga

SEQ ID NO: 589304 - DNA, 25 bp, Mus musculus
ccatcactgtgtctcaggatgaggg

SEQ ID NO: 589305 - DNA, 25 bp, Mus musculus
ccatcactgtgtgtcaggatgaggg

SEQ ID NO: 589306 - DNA, 25 bp, Mus musculus
ccatcacttctaagaagaatctaaa

SEQ ID NO: 589307 - DNA, 25 bp, Mus musculus
ccatcacttctatgaagaatctaaa

SEQ ID NO: 589308 - DNA, 25 bp, Mus musculus
ccatcagagttcagaggtcagctac

SEQ ID NO: 589309 - DNA, 25 bp, Mus musculus
ccatcagagttctgaggtcagctac

SEQ ID NO: 589310 - DNA, 25 bp, Mus musculus
ccatcagagttgagagcaggagaca

SEQ ID NO: 589311 - DNA, 25 bp, Mus musculus
ccatcagagttgtgagcaggagaca

SEQ ID NO: 589312 - DNA, 25 bp, Mus musculus
ccatcagccacgagcctttgggttg

SEQ ID NO: 589313 - DNA, 25 bp, Mus musculus
ccatcagccacgtgcctttgggttg

SEQ ID NO: 589314 - DNA, 25 bp, Mus musculus
ccatcagccagaactttggtacctg

SEQ ID NO: 589315 - DNA, 25 bp, Mus musculus
ccatcagccagatctttggtacctg

SEQ ID NO: 589316 - DNA, 25 bp, Mus musculus
ccatcagccaggctgtgctggagct

SEQ ID NO: 589317 - DNA, 25 bp, Mus musculus
ccatcagccagggtgtgctggagct

SEQ ID NO: 589318 - DNA, 25 bp, Mus musculus
ccatcagccgagaggaaggaagacg

SEQ ID NO: 589319 - DNA, 25 bp, Mus musculus
ccatcagccgagtggaaggaagacg

SEQ ID NO: 589320 - DNA, 25 bp, Mus musculus
ccatcagggagcatcagatggccaa

SEQ ID NO: 589321 - DNA, 25 bp, Mus musculus
ccatcagggagcttcagatggccaa

SEQ ID NO: 589322 - DNA, 25 bp, Mus musculus
ccatcaggtgccagctgtctcttct

SEQ ID NO: 589323 - DNA, 25 bp, Mus musculus
ccatcaggtgcctgctgtctcttct

SEQ ID NO: 589324 - DNA, 25 bp, Mus musculus
ccatcaggtggtacaaagggaacaa

SEQ ID NO: 589325 - DNA, 25 bp, Mus musculus
ccatcaggtggttcaaagggaacaa

SEQ ID NO: 589326 - DNA, 25 bp, Mus musculus
ccatcagtactacaatgactttcca

SEQ ID NO: 589327 - DNA, 25 bp, Mus musculus
ccatcagtactagaatgactttcca

SEQ ID NO: 589328 - DNA, 25 bp, Mus musculus
ccatcagtcagaccaaggtggcaga

SEQ ID NO: 589329 - DNA, 25 bp, Mus musculus
ccatcagtcagagcaaggtggcaga

SEQ ID NO: 589330 - DNA, 25 bp, Mus musculus
ccatcagtcctcaggtattggctgg

SEQ ID NO: 589331 - DNA, 25 bp, Mus musculus
ccatcagtcctctggtattggctgg

SEQ ID NO: 589332 - DNA, 25 bp, Mus musculus
ccatcagtctcacagtggccaagtg

SEQ ID NO: 589333 - DNA, 25 bp, Mus musculus
ccatcagtctcagagtggccaagtg

SEQ ID NO: 589334 - DNA, 25 bp, Mus musculus
ccatcagtcttgaatgccctgtgcc

SEQ ID NO: 589335 - DNA, 25 bp, Mus musculus
ccatcagtcttgtatgccctgtgcc

SEQ ID NO: 589336 - DNA, 25 bp, Mus musculus
ccatcagtgaagaccatgagctcca

SEQ ID NO: 589337 - DNA, 25 bp, Mus musculus
ccatcagtgaagtccatgagctcca

SEQ ID NO: 589338 - DNA, 25 bp, Mus musculus
ccatcagtgctgacattgctgatca

SEQ ID NO: 589339 - DNA, 25 bp, Mus musculus
ccatcagtgctgtcattgctgatca

SEQ ID NO: 589340 - DNA, 25 bp, Mus musculus
ccatcagttcctaccaatgagtctg

SEQ ID NO: 589341 - DNA, 25 bp, Mus musculus
ccatcagttccttccaatgagtctg

SEQ ID NO: 589342 - DNA, 25 bp, Mus musculus
ccatcagtttggagtgtgaagctgt

SEQ ID NO: 589343 - DNA, 25 bp, Mus musculus
ccatcagtttggtgtgtgaagctgt

SEQ ID NO: 589344 - DNA, 25 bp, Mus musculus
ccatcatcaatgcaaatcctgggca

SEQ ID NO: 589345 - DNA, 25 bp, Mus musculus
ccatcatcaatggaaatcctgggca

SEQ ID NO: 589346 - DNA, 25 bp, Mus musculus
ccatcatcggtcaagttccagtgag

SEQ ID NO: 589347 - DNA, 25 bp, Mus musculus
ccatcatcggtctagttccagtgag

SEQ ID NO: 589348 - DNA, 25 bp, Mus musculus
ccatcatcttctccagggcagatac

SEQ ID NO: 589349 - DNA, 25 bp, Mus musculus
ccatcatcttctgcagggcagatac

SEQ ID NO: 589350 - DNA, 25 bp, Mus musculus
ccatcatgattgagaggagggccat

SEQ ID NO: 589351 - DNA, 25 bp, Mus musculus
ccatcatgattgtgaggagggccat

SEQ ID NO: 589352 - DNA, 25 bp, Mus musculus
ccatcatgcagtcgttgtactttga

SEQ ID NO: 589353 - DNA, 25 bp, Mus musculus
ccatcatgcagtggttgtactttga

SEQ ID NO: 589354 - DNA, 25 bp, Mus musculus
ccatcatggatcattagtctaaaga

SEQ ID NO: 589355 - DNA, 25 bp, Mus musculus
ccatcatggatctttagtctaaaga

SEQ ID NO: 589356 - DNA, 25 bp, Mus musculus
ccatcatggcagaggagtttgacgg

SEQ ID NO: 589357 - DNA, 25 bp, Mus musculus
ccatcatggcagtggagtttgacgg

SEQ ID NO: 589358 - DNA, 25 bp, Mus musculus
ccatcatgggttcctgatgcggcag

SEQ ID NO: 589359 - DNA, 25 bp, Mus musculus
ccatcatgggttgctgatgcggcag

SEQ ID NO: 589360 - DNA, 25 bp, Mus musculus
ccatcatgtgggacaggatggccag

SEQ ID NO: 589361 - DNA, 25 bp, Mus musculus
ccatcatgtgggtcaggatggccag

SEQ ID NO: 589362 - DNA, 25 bp, Mus musculus
ccatcatgtgttacgggcagacagg

SEQ ID NO: 589363 - DNA, 25 bp, Mus musculus
ccatcatgtgtttcgggcagacagg

SEQ ID NO: 589364 - DNA, 25 bp, Mus musculus
ccatcattacttcggaaaaggacca

SEQ ID NO: 589365 - DNA, 25 bp, Mus musculus
ccatcattacttgggaaaaggacca

SEQ ID NO: 589366 - DNA, 25 bp, Mus musculus
ccatcattctcgagggcaacaagag

SEQ ID NO: 589367 - DNA, 25 bp, Mus musculus
ccatcattctcgtgggcaacaagag

SEQ ID NO: 589368 - DNA, 25 bp, Mus musculus
ccatcattgaagaggatcaggacaa

SEQ ID NO: 589369 - DNA, 25 bp, Mus musculus
ccatcattgaagtggatcaggacaa

SEQ ID NO: 589370 - DNA, 25 bp, Mus musculus
ccatcattgctgctgtcaaggacgg

SEQ ID NO: 589371 - DNA, 25 bp, Mus musculus
ccatcattgctggtgtcaaggacgg

SEQ ID NO: 589372 - DNA, 25 bp, Mus musculus
ccatcattggtgactgggtggataa

SEQ ID NO: 589373 - DNA, 25 bp, Mus musculus
ccatcattggtgtctgggtggataa

SEQ ID NO: 589374 - DNA, 25 bp, Mus musculus
ccatccaaggatccggttgaggctc

SEQ ID NO: 589375 - DNA, 25 bp, Mus musculus
ccatccaaggatgcggttgaggctc

SEQ ID NO: 589376 - DNA, 25 bp, Mus musculus
ccatccaaggtgagtctgcaattaa

SEQ ID NO: 589377 - DNA, 25 bp, Mus musculus
ccatccaaggtgtgtctgcaattaa

SEQ ID NO: 589378 - DNA, 25 bp, Mus musculus
ccatccaattggacgggctggtttg

SEQ ID NO: 589379 - DNA, 25 bp, Mus musculus
ccatccaattggtcgggctggtttg

SEQ ID NO: 589380 - DNA, 25 bp, Mus musculus
ccatccacggagaaacgccagaggg

SEQ ID NO: 589381 - DNA, 25 bp, Mus musculus
ccatccacggagtaacgccagaggg

SEQ ID NO: 589382 - DNA, 25 bp, Mus musculus
ccatccagactaaaatcctgatgac

SEQ ID NO: 589383 - DNA, 25 bp, Mus musculus
ccatccagactataatcctgatgac

SEQ ID NO: 589384 - DNA, 25 bp, Mus musculus
ccatccaggacgcagtatcaccaag

SEQ ID NO: 589385 - DNA, 25 bp, Mus musculus
ccatccaggacggagtatcaccaag

SEQ ID NO: 589386 - DNA, 25 bp, Mus musculus
ccatccaggagtcccagtgtctgct

SEQ ID NO: 589387 - DNA, 25 bp, Mus musculus
ccatccaggagtgccagtgtctgct

SEQ ID NO: 589388 - DNA, 25 bp, Mus musculus
ccatccaggccaccaaagtttggct

SEQ ID NO: 589389 - DNA, 25 bp, Mus musculus
ccatccaggccagcaaagtttggct

SEQ ID NO: 589390 - DNA, 25 bp, Mus musculus
ccatccaggctacggttttctttcg

SEQ ID NO: 589391 - DNA, 25 bp, Mus musculus
ccatccaggctagggttttctttcg

SEQ ID NO: 589392 - DNA, 25 bp, Mus musculus
ccatccagggagagaagacagggtt

SEQ ID NO: 589393 - DNA, 25 bp, Mus musculus
ccatccagggagtgaagacagggtt

SEQ ID NO: 589394 - DNA, 25 bp, Mus musculus
ccatccagggtcaccggataatgtg

SEQ ID NO: 589395 - DNA, 25 bp, Mus musculus
ccatccagggtctccggataatgtg

SEQ ID NO: 589396 - DNA, 25 bp, Mus musculus
ccatccagtggaaagggtgttgccg

SEQ ID NO: 589397 - DNA, 25 bp, Mus musculus
ccatccagtggatagggtgttgccg

SEQ ID NO: 589398 - DNA, 25 bp, Mus musculus
ccatccagtttgactttcagatcct

SEQ ID NO: 589399 - DNA, 25 bp, Mus musculus
ccatccagtttgtctttcagatcct

SEQ ID NO: 589400 - DNA, 25 bp, Mus musculus
ccatccatctgcagcgaaatatcaa

SEQ ID NO: 589401 - DNA, 25 bp, Mus musculus
ccatccatctgctgcgaaatatcaa

SEQ ID NO: 589402 - DNA, 25 bp, Mus musculus
ccatccatcttgagggtcagctggt

SEQ ID NO: 589403 - DNA, 25 bp, Mus musculus
ccatccatcttgtgggtcagctggt

SEQ ID NO: 589404 - DNA, 25 bp, Mus musculus
ccatccatgtgtccgagagctcaga

SEQ ID NO: 589405 - DNA, 25 bp, Mus musculus
ccatccatgtgtgcgagagctcaga

SEQ ID NO: 589406 - DNA, 25 bp, Mus musculus
ccatcccaacttaaaggtgtacttg

SEQ ID NO: 589407 - DNA, 25 bp, Mus musculus
ccatcccaactttaaggtgtacttg

SEQ ID NO: 589408 - DNA, 25 bp, Mus musculus
ccatcccaggagacttgcttcgaga

SEQ ID NO: 589409 - DNA, 25 bp, Mus musculus
ccatcccaggagtcttgcttcgaga

SEQ ID NO: 589410 - DNA, 25 bp, Mus musculus
ccatcccagtccatgatggctatgt

SEQ ID NO: 589411 - DNA, 25 bp, Mus musculus
ccatcccagtccttgatggctatgt

SEQ ID NO: 589412 - DNA, 25 bp, Mus musculus
ccatcccatattccacttgtcagga

SEQ ID NO: 589413 - DNA, 25 bp, Mus musculus
ccatcccatattgcacttgtcagga

SEQ ID NO: 589414 - DNA, 25 bp, Mus musculus
ccatcccatgaaatacaaagacaga

SEQ ID NO: 589415 - DNA, 25 bp, Mus musculus
ccatcccatgaattacaaagacaga

SEQ ID NO: 589416 - DNA, 25 bp, Mus musculus
ccatcccctcagctagcaggtgtga

SEQ ID NO: 589417 - DNA, 25 bp, Mus musculus
ccatcccctcaggtagcaggtgtga

SEQ ID NO: 589418 - DNA, 25 bp, Mus musculus
ccatcccctggcaggaggaccgggt

SEQ ID NO: 589419 - DNA, 25 bp, Mus musculus
ccatcccctggctggaggaccgggt

SEQ ID NO: 589420 - DNA, 25 bp, Mus musculus
ccatcccgaagtccagtggagatcg

SEQ ID NO: 589421 - DNA, 25 bp, Mus musculus
ccatcccgaagtgcagtggagatcg

SEQ ID NO: 589422 - DNA, 25 bp, Mus musculus
ccatcccgaggcaggaggagctata

SEQ ID NO: 589423 - DNA, 25 bp, Mus musculus
ccatcccgaggctggaggagctata

SEQ ID NO: 589424 - DNA, 25 bp, Mus musculus
ccatcccgggcacggcaaagggaca

SEQ ID NO: 589425 - DNA, 25 bp, Mus musculus
ccatcccgggcagggcaaagggaca

SEQ ID NO: 589426 - DNA, 25 bp, Mus musculus
ccatccctcattacggtctcgcaaa

SEQ ID NO: 589427 - DNA, 25 bp, Mus musculus
ccatccctcatttcggtctcgcaaa

SEQ ID NO: 589428 - DNA, 25 bp, Mus musculus
ccatccctctgtctcactgtgaagt

SEQ ID NO: 589429 - DNA, 25 bp, Mus musculus
ccatccctctgtgtcactgtgaagt

SEQ ID NO: 589430 - DNA, 25 bp, Mus musculus
ccatccctgttcagcagactctgaa

SEQ ID NO: 589431 - DNA, 25 bp, Mus musculus
ccatccctgttctgcagactctgaa

SEQ ID NO: 589432 - DNA, 25 bp, Mus musculus
ccatccgagggaaaggtgctagctg

SEQ ID NO: 589433 - DNA, 25 bp, Mus musculus
ccatccgagggataggtgctagctg

SEQ ID NO: 589434 - DNA, 25 bp, Mus musculus
ccatccgcacggagatgaccgtgcg

SEQ ID NO: 589435 - DNA, 25 bp, Mus musculus
ccatccgcacggtgatgaccgtgcg

SEQ ID NO: 589436 - DNA, 25 bp, Mus musculus
ccatccgcatgactccaagcaaaat

SEQ ID NO: 589437 - DNA, 25 bp, Mus musculus
ccatccgcatgagtccaagcaaaat

SEQ ID NO: 589438 - DNA, 25 bp, Mus musculus
ccatccgggaatcgtactgtcggga

SEQ ID NO: 589439 - DNA, 25 bp, Mus musculus
ccatccgggaatggtactgtcggga

SEQ ID NO: 589440 - DNA, 25 bp, Mus musculus
ccatccgggcccctgaaggcttttg

SEQ ID NO: 589441 - DNA, 25 bp, Mus musculus
ccatccgggcccgtgaaggcttttg

SEQ ID NO: 589442 - DNA, 25 bp, Mus musculus
ccatccgtgcagacaagaagtccaa

SEQ ID NO: 589443 - DNA, 25 bp, Mus musculus
ccatccgtgcagtcaagaagtccaa

SEQ ID NO: 589444 - DNA, 25 bp, Mus musculus
ccatccgtgtctatacctatgctga

SEQ ID NO: 589445 - DNA, 25 bp, Mus musculus
ccatccgtgtctttacctatgctga

SEQ ID NO: 589446 - DNA, 25 bp, Mus musculus
ccatcctacggcatctgggtgcctt

SEQ ID NO: 589447 - DNA, 25 bp, Mus musculus
ccatcctacggcttctgggtgcctt

SEQ ID NO: 589448 - DNA, 25 bp, Mus musculus
ccatcctcaggcaattcatgttggg

SEQ ID NO: 589449 - DNA, 25 bp, Mus musculus
ccatcctcaggctattcatgttggg

SEQ ID NO: 589450 - DNA, 25 bp, Mus musculus
ccatcctcaggtagtgtgtgccaag

SEQ ID NO: 589451 - DNA, 25 bp, Mus musculus
ccatcctcaggttgtgtgtgccaag

SEQ ID NO: 589452 - DNA, 25 bp, Mus musculus
ccatcctccctgaagaggattgctg

SEQ ID NO: 589453 - DNA, 25 bp, Mus musculus
ccatcctccctgtagaggattgctg

SEQ ID NO: 589454 - DNA, 25 bp, Mus musculus
ccatcctccgagaacatttttgaac

SEQ ID NO: 589455 - DNA, 25 bp, Mus musculus
ccatcctccgagtacatttttgaac

SEQ ID NO: 589456 - DNA, 25 bp, Mus musculus
ccatcctgcgtgagaaagtttgtca

SEQ ID NO: 589457 - DNA, 25 bp, Mus musculus
ccatcctgcgtgtgaaagtttgtca

SEQ ID NO: 589458 - DNA, 25 bp, Mus musculus
ccatcctgctggcaattgtgaactt

SEQ ID NO: 589459 - DNA, 25 bp, Mus musculus
ccatcctgctgggaattgtgaactt

SEQ ID NO: 589460 - DNA, 25 bp, Mus musculus
ccatcctggcacaatttgatgctgt

SEQ ID NO: 589461 - DNA, 25 bp, Mus musculus
ccatcctggcactatttgatgctgt

SEQ ID NO: 589462 - DNA, 25 bp, Mus musculus
ccatcctggtgcatacatggactgt

SEQ ID NO: 589463 - DNA, 25 bp, Mus musculus
ccatcctggtgcttacatggactgt

SEQ ID NO: 589464 - DNA, 25 bp, Mus musculus
ccatcctgtaccatggcaatgtcac

SEQ ID NO: 589465 - DNA, 25 bp, Mus musculus
ccatcctgtaccttggcaatgtcac

SEQ ID NO: 589466 - DNA, 25 bp, Mus musculus
ccatccttgagtcgcaacatcacgg

SEQ ID NO: 589467 - DNA, 25 bp, Mus musculus
ccatccttgagtggcaacatcacgg

SEQ ID NO: 589468 - DNA, 25 bp, Mus musculus
ccatccttgatgctgggatctggtg

SEQ ID NO: 589469 - DNA, 25 bp, Mus musculus
ccatccttgatggtgggatctggtg

SEQ ID NO: 589470 - DNA, 25 bp, Mus musculus
ccatccttgcatagttttacgccgc

SEQ ID NO: 589471 - DNA, 25 bp, Mus musculus
ccatccttgcattgttttacgccgc

SEQ ID NO: 589472 - DNA, 25 bp, Mus musculus
ccatccttttcactggcaagacaca

SEQ ID NO: 589473 - DNA, 25 bp, Mus musculus
ccatccttttcagtggcaagacaca

SEQ ID NO: 589474 - DNA, 25 bp, Mus musculus
ccatcgaaaacgcatgggtctcaag

SEQ ID NO: 589475 - DNA, 25 bp, Mus musculus
ccatcgaaaacggatgggtctcaag

SEQ ID NO: 589476 - DNA, 25 bp, Mus musculus
ccatcgacaataatggtgctggtgt

SEQ ID NO: 589477 - DNA, 25 bp, Mus musculus
ccatcgacaatattggtgctggtgt

SEQ ID NO: 589478 - DNA, 25 bp, Mus musculus
ccatcgaccagcaacatttggagta

SEQ ID NO: 589479 - DNA, 25 bp, Mus musculus
ccatcgaccagctacatttggagta

SEQ ID NO: 589480 - DNA, 25 bp, Mus musculus
ccatcgactggtcactcaagtataa

SEQ ID NO: 589481 - DNA, 25 bp, Mus musculus
ccatcgactggtgactcaagtataa

SEQ ID NO: 589482 - DNA, 25 bp, Mus musculus
ccatcgacttcaatgatgagggcag

SEQ ID NO: 589483 - DNA, 25 bp, Mus musculus
ccatcgacttcattgatgagggcag

SEQ ID NO: 589484 - DNA, 25 bp, Mus musculus
ccatcgagatgtcggacccggcagc

SEQ ID NO: 589485 - DNA, 25 bp, Mus musculus
ccatcgagatgtgggacccggcagc

SEQ ID NO: 589486 - DNA, 25 bp, Mus musculus
ccatcgaggagtacatggtacacgt

SEQ ID NO: 589487 - DNA, 25 bp, Mus musculus
ccatcgaggagttcatggtacacgt

SEQ ID NO: 589488 - DNA, 25 bp, Mus musculus
ccatcgagtggcaaagagatgggca

SEQ ID NO: 589489 - DNA, 25 bp, Mus musculus
ccatcgagtggctaagagatgggca

SEQ ID NO: 589490 - DNA, 25 bp, Mus musculus
ccatcgagtgggaacagcagaatca

SEQ ID NO: 589491 - DNA, 25 bp, Mus musculus
ccatcgagtgggtacagcagaatca

SEQ ID NO: 589492 - DNA, 25 bp, Mus musculus
ccatcgagtggtcttccagttgaac

SEQ ID NO: 589493 - DNA, 25 bp, Mus musculus
ccatcgagtggtgttccagttgaac

SEQ ID NO: 589494 - DNA, 25 bp, Mus musculus
ccatcgagttgtcgaaattttgcac

SEQ ID NO: 589495 - DNA, 25 bp, Mus musculus
ccatcgagttgtggaaattttgcac

SEQ ID NO: 589496 - DNA, 25 bp, Mus musculus
ccatcgatctggagacaaaagccac

SEQ ID NO: 589497 - DNA, 25 bp, Mus musculus
ccatcgatctggtgacaaaagccac

SEQ ID NO: 589498 - DNA, 25 bp, Mus musculus
ccatcgattgtgaaaggcagcgtga

SEQ ID NO: 589499 - DNA, 25 bp, Mus musculus
ccatcgattgtgtaaggcagcgtga

SEQ ID NO: 589500 - DNA, 25 bp, Mus musculus
ccatcgcacggacgagaattcgcct

SEQ ID NO: 589501 - DNA, 25 bp, Mus musculus
ccatcgcacggaggagaattcgcct

SEQ ID NO: 589502 - DNA, 25 bp, Mus musculus
ccatcgccactaacggagtggtgcc

SEQ ID NO: 589503 - DNA, 25 bp, Mus musculus
ccatcgccactatcggagtggtgcc

SEQ ID NO: 589504 - DNA, 25 bp, Mus musculus
ccatcgccagcaccgaggtaaagct

SEQ ID NO: 589505 - DNA, 25 bp, Mus musculus
ccatcgccagcagcgaggtaaagct

SEQ ID NO: 589506 - DNA, 25 bp, Mus musculus
ccatcgcctgcacacagttctgggc

SEQ ID NO: 589507 - DNA, 25 bp, Mus musculus
ccatcgcctgcagacagttctgggc

SEQ ID NO: 589508 - DNA, 25 bp, Mus musculus
ccatcgctcgtcacattgagttcta

SEQ ID NO: 589509 - DNA, 25 bp, Mus musculus
ccatcgctcgtctcattgagttcta

SEQ ID NO: 589510 - DNA, 25 bp, Mus musculus
ccatcgcttctcagtccaggctaag

SEQ ID NO: 589511 - DNA, 25 bp, Mus musculus
ccatcgcttctctgtccaggctaag

SEQ ID NO: 589512 - DNA, 25 bp, Mus musculus
ccatcgcttgttcatcgtgcatgag

SEQ ID NO: 589513 - DNA, 25 bp, Mus musculus
ccatcgcttgttgatcgtgcatgag

SEQ ID NO: 589514 - DNA, 25 bp, Mus musculus
ccatcggatgaactgctggcagaaa

SEQ ID NO: 589515 - DNA, 25 bp, Mus musculus
ccatcggatgaagtgctggcagaaa

SEQ ID NO: 589516 - DNA, 25 bp, Mus musculus
ccatcggattggaggcagctggtat

SEQ ID NO: 589517 - DNA, 25 bp, Mus musculus
ccatcggattggtggcagctggtat

SEQ ID NO: 589518 - DNA, 25 bp, Mus musculus
ccatcggcttcgagggctgcattgg

SEQ ID NO: 589519 - DNA, 25 bp, Mus musculus
ccatcggcttcgtgggctgcattgg

SEQ ID NO: 589520 - DNA, 25 bp, Mus musculus
ccatcgggcaggatctggtggccat

SEQ ID NO: 589521 - DNA, 25 bp, Mus musculus
ccatcgggcaggttctggtggccat

SEQ ID NO: 589522 - DNA, 25 bp, Mus musculus
ccatcgggctataaagatgtcactc

SEQ ID NO: 589523 - DNA, 25 bp, Mus musculus
ccatcgggctattaagatgtcactc

SEQ ID NO: 589524 - DNA, 25 bp, Mus musculus
ccatcgtacctaatactaaactgaa

SEQ ID NO: 589525 - DNA, 25 bp, Mus musculus
ccatcgtacctattactaaactgaa

SEQ ID NO: 589526 - DNA, 25 bp, Mus musculus
ccatcgtaccttctgcagttgaaca

SEQ ID NO: 589527 - DNA, 25 bp, Mus musculus
ccatcgtaccttgtgcagttgaaca

SEQ ID NO: 589528 - DNA, 25 bp, Mus musculus
ccatcgtcatgtcctcctatcaaga

SEQ ID NO: 589529 - DNA, 25 bp, Mus musculus
ccatcgtcatgtgctcctatcaaga

SEQ ID NO: 589530 - DNA, 25 bp, Mus musculus
ccatcgtccatgagggagacaagaa

SEQ ID NO: 589531 - DNA, 25 bp, Mus musculus
ccatcgtccatgtgggagacaagaa

SEQ ID NO: 589532 - DNA, 25 bp, Mus musculus
ccatcgtcgttcatgtttttcaggt

SEQ ID NO: 589533 - DNA, 25 bp, Mus musculus
ccatcgtcgttcttgtttttcaggt

SEQ ID NO: 589534 - DNA, 25 bp, Mus musculus
ccatcgtgaaagagaagggaactgt

SEQ ID NO: 589535 - DNA, 25 bp, Mus musculus
ccatcgtgaaagtgaagggaactgt

SEQ ID NO: 589536 - DNA, 25 bp, Mus musculus
ccatcgtgacgaagctggtgcagca

SEQ ID NO: 589537 - DNA, 25 bp, Mus musculus
ccatcgtgacgatgctggtgcagca

SEQ ID NO: 589538 - DNA, 25 bp, Mus musculus
ccatcgtgggacacagcagccttgg

SEQ ID NO: 589539 - DNA, 25 bp, Mus musculus
ccatcgtgggactcagcagccttgg

SEQ ID NO: 589540 - DNA, 25 bp, Mus musculus
ccatcgtggtgaaagtgcctggtca

SEQ ID NO: 589541 - DNA, 25 bp, Mus musculus
ccatcgtggtgatagtgcctggtca

SEQ ID NO: 589542 - DNA, 25 bp, Mus musculus
ccatcgtggtggagaccagcgcgaa

SEQ ID NO: 589543 - DNA, 25 bp, Mus musculus
ccatcgtggtggtgaccagcgcgaa

SEQ ID NO: 589544 - DNA, 25 bp, Mus musculus
ccatcgtgtggtatttgttcagcgc

SEQ ID NO: 589545 - DNA, 25 bp, Mus musculus
ccatcgtgtggtttttgttcagcgc

SEQ ID NO: 589546 - DNA, 25 bp, Mus musculus
ccatcgtttcttcagaaagctgata

SEQ ID NO: 589547 - DNA, 25 bp, Mus musculus
ccatcgtttcttgagaaagctgata

SEQ ID NO: 589548 - DNA, 25 bp, Mus musculus
ccatctaaagttctctctgttggcg

SEQ ID NO: 589549 - DNA, 25 bp, Mus musculus
ccatctaaagttgtctctgttggcg

SEQ ID NO: 589550 - DNA, 25 bp, Mus musculus
ccatctacaacaacatgaagcagtt

SEQ ID NO: 589551 - DNA, 25 bp, Mus musculus
ccatctacaacatcatgaagcagtt

SEQ ID NO: 589552 - DNA, 25 bp, Mus musculus
ccatctaccaatcctttcctggaag

SEQ ID NO: 589553 - DNA, 25 bp, Mus musculus
ccatctaccaatgctttcctggaag

SEQ ID NO: 589554 - DNA, 25 bp, Mus musculus
ccatctacgggcagtttgtggccgg

SEQ ID NO: 589555 - DNA, 25 bp, Mus musculus
ccatctacgggctgtttgtggccgg

SEQ ID NO: 589556 - DNA, 25 bp, Mus musculus
ccatctaggattccagagagaaaat

SEQ ID NO: 589557 - DNA, 25 bp, Mus musculus
ccatctaggattgcagagagaaaat

SEQ ID NO: 589558 - DNA, 25 bp, Mus musculus
ccatctatactgcactcatctacaa

SEQ ID NO: 589559 - DNA, 25 bp, Mus musculus
ccatctatactggactcatctacaa

SEQ ID NO: 589560 - DNA, 25 bp, Mus musculus
ccatctatgatgacctatcaacaaa

SEQ ID NO: 589561 - DNA, 25 bp, Mus musculus
ccatctatgatgtcctatcaacaaa

SEQ ID NO: 589562 - DNA, 25 bp, Mus musculus
ccatctatgcctatgacagagagat

SEQ ID NO: 589563 - DNA, 25 bp, Mus musculus
ccatctatgcctttgacagagagat

SEQ ID NO: 589564 - DNA, 25 bp, Mus musculus
ccatctatgtgtatggtggagacaa

SEQ ID NO: 589565 - DNA, 25 bp, Mus musculus
ccatctatgtgtttggtggagacaa

SEQ ID NO: 589566 - DNA, 25 bp, Mus musculus
ccatctcaacataaagaagtgacac

SEQ ID NO: 589567 - DNA, 25 bp, Mus musculus
ccatctcaacattaagaagtgacac

SEQ ID NO: 589568 - DNA, 25 bp, Mus musculus
ccatctcaggtaactagaagtagtc

SEQ ID NO: 589569 - DNA, 25 bp, Mus musculus
ccatctcaggtatctagaagtagtc

SEQ ID NO: 589570 - DNA, 25 bp, Mus musculus
ccatctcataagacaagaagaaaag

SEQ ID NO: 589571 - DNA, 25 bp, Mus musculus
ccatctcataagtcaagaagaaaag

SEQ ID NO: 589572 - DNA, 25 bp, Mus musculus
ccatctccgaggcagcttcttgttt

SEQ ID NO: 589573 - DNA, 25 bp, Mus musculus
ccatctccgagggagcttcttgttt

SEQ ID NO: 589574 - DNA, 25 bp, Mus musculus
ccatctcctatgagtacactgctga

SEQ ID NO: 589575 - DNA, 25 bp, Mus musculus
ccatctcctatgtgtacactgctga

SEQ ID NO: 589576 - DNA, 25 bp, Mus musculus
ccatctcctcaaacgtattggaagg

SEQ ID NO: 589577 - DNA, 25 bp, Mus musculus
ccatctcctcaatcgtattggaagg

SEQ ID NO: 589578 - DNA, 25 bp, Mus musculus
ccatctcgggccacagtaaactgaa

SEQ ID NO: 589579 - DNA, 25 bp, Mus musculus
ccatctcgggcctcagtaaactgaa

SEQ ID NO: 589580 - DNA, 25 bp, Mus musculus
ccatctctgagccatgaagagaact

SEQ ID NO: 589581 - DNA, 25 bp, Mus musculus
ccatctctgagcgatgaagagaact

SEQ ID NO: 589582 - DNA, 25 bp, Mus musculus
ccatctctgaggatgtgatcattgt

SEQ ID NO: 589583 - DNA, 25 bp, Mus musculus
ccatctctgaggttgtgatcattgt

SEQ ID NO: 589584 - DNA, 25 bp, Mus musculus
ccatctctggtgatcgccgtgactg

SEQ ID NO: 589585 - DNA, 25 bp, Mus musculus
ccatctctggtgttcgccgtgactg

SEQ ID NO: 589586 - DNA, 25 bp, Mus musculus
ccatctcttgaacatttgaaggtag

SEQ ID NO: 589587 - DNA, 25 bp, Mus musculus
ccatctcttgaagatttgaaggtag

SEQ ID NO: 589588 - DNA, 25 bp, Mus musculus
ccatctcttgtcacttacagctagc

SEQ ID NO: 589589 - DNA, 25 bp, Mus musculus
ccatctcttgtctcttacagctagc

SEQ ID NO: 589590 - DNA, 25 bp, Mus musculus
ccatctgaaggacgaacattaaatg

SEQ ID NO: 589591 - DNA, 25 bp, Mus musculus
ccatctgaaggaggaacattaaatg

SEQ ID NO: 589592 - DNA, 25 bp, Mus musculus
ccatctgaccttacagaagaaaata

SEQ ID NO: 589593 - DNA, 25 bp, Mus musculus
ccatctgacctttcagaagaaaata

SEQ ID NO: 589594 - DNA, 25 bp, Mus musculus
ccatctgagttgctggtatggtgta

SEQ ID NO: 589595 - DNA, 25 bp, Mus musculus
ccatctgagttggtggtatggtgta

SEQ ID NO: 589596 - DNA, 25 bp, Mus musculus
ccatctgatgggagacacaagccaa

SEQ ID NO: 589597 - DNA, 25 bp, Mus musculus
ccatctgatgggtgacacaagccaa

SEQ ID NO: 589598 - DNA, 25 bp, Mus musculus
ccatctgattgcatgcagatcaaca

SEQ ID NO: 589599 - DNA, 25 bp, Mus musculus
ccatctgattgcttgcagatcaaca

SEQ ID NO: 589600 - DNA, 25 bp, Mus musculus
ccatctgcgaagaggtggattccag

SEQ ID NO: 589601 - DNA, 25 bp, Mus musculus
ccatctgcgaagtggtggattccag

SEQ ID NO: 589602 - DNA, 25 bp, Mus musculus
ccatctggacagcaatggtgtctac

SEQ ID NO: 589603 - DNA, 25 bp, Mus musculus
ccatctggacaggaatggtgtctac

SEQ ID NO: 589604 - DNA, 25 bp, Mus musculus
ccatctgggcatccggtatctgacc

SEQ ID NO: 589605 - DNA, 25 bp, Mus musculus
ccatctgggcatgcggtatctgacc

SEQ ID NO: 589606 - DNA, 25 bp, Mus musculus
ccatctgtacacaagggctgccact

SEQ ID NO: 589607 - DNA, 25 bp, Mus musculus
ccatctgtacactagggctgccact

SEQ ID NO: 589608 - DNA, 25 bp, Mus musculus
ccatctgtcaggagcgcagccggcg

SEQ ID NO: 589609 - DNA, 25 bp, Mus musculus
ccatctgtcaggtgcgcagccggcg

SEQ ID NO: 589610 - DNA, 25 bp, Mus musculus
ccatctgtcgtgcaggtgcgtaagc

SEQ ID NO: 589611 - DNA, 25 bp, Mus musculus
ccatctgtcgtggaggtgcgtaagc

SEQ ID NO: 589612 - DNA, 25 bp, Mus musculus
ccatctgtgggaagagcctggagtc

SEQ ID NO: 589613 - DNA, 25 bp, Mus musculus
ccatctgtgggatgagcctggagtc

SEQ ID NO: 589614 - DNA, 25 bp, Mus musculus
ccatctgttacacacactgcaggct

SEQ ID NO: 589615 - DNA, 25 bp, Mus musculus
ccatctgttacagacactgcaggct

SEQ ID NO: 589616 - DNA, 25 bp, Mus musculus
ccatcttagaacaggatgagcacct

SEQ ID NO: 589617 - DNA, 25 bp, Mus musculus
ccatcttagaactggatgagcacct

SEQ ID NO: 589618 - DNA, 25 bp, Mus musculus
ccatcttagggtcgccgtttagtgc

SEQ ID NO: 589619 - DNA, 25 bp, Mus musculus
ccatcttagggtggccgtttagtgc

SEQ ID NO: 589620 - DNA, 25 bp, Mus musculus
ccatcttcagacagggctcttgtga

SEQ ID NO: 589621 - DNA, 25 bp, Mus musculus
ccatcttcagactgggctcttgtga

SEQ ID NO: 589622 - DNA, 25 bp, Mus musculus
ccatcttcctggaggctgttccact

SEQ ID NO: 589623 - DNA, 25 bp, Mus musculus
ccatcttcctggtggctgttccact

SEQ ID NO: 589624 - DNA, 25 bp, Mus musculus
ccatcttctttgctgcccggcagat

SEQ ID NO: 589625 - DNA, 25 bp, Mus musculus
ccatcttctttggtgcccggcagat

SEQ ID NO: 589626 - DNA, 25 bp, Mus musculus
ccatcttgagggatgccttgaacca

SEQ ID NO: 589627 - DNA, 25 bp, Mus musculus
ccatcttgagggttgccttgaacca

SEQ ID NO: 589628 - DNA, 25 bp, Mus musculus
ccatcttgcaccctgttttagttaa

SEQ ID NO: 589629 - DNA, 25 bp, Mus musculus
ccatcttgcaccgtgttttagttaa

SEQ ID NO: 589630 - DNA, 25 bp, Mus musculus
ccatcttggattccgcggtagcggt

SEQ ID NO: 589631 - DNA, 25 bp, Mus musculus
ccatcttggattgcgcggtagcggt

SEQ ID NO: 589632 - DNA, 25 bp, Mus musculus
ccatctttcgaacccttggtcagaa

SEQ ID NO: 589633 - DNA, 25 bp, Mus musculus
ccatctttcgaagccttggtcagaa

SEQ ID NO: 589634 - DNA, 25 bp, Mus musculus
ccatctttgaagatgtgatgatgtc

SEQ ID NO: 589635 - DNA, 25 bp, Mus musculus
ccatctttgaagttgtgatgatgtc

SEQ ID NO: 589636 - DNA, 25 bp, Mus musculus
ccatctttgcttcggaaatccgaga

SEQ ID NO: 589637 - DNA, 25 bp, Mus musculus
ccatctttgcttgggaaatccgaga

SEQ ID NO: 589638 - DNA, 25 bp, Mus musculus
ccatgaaactaaacgacagaattgt

SEQ ID NO: 589639 - DNA, 25 bp, Mus musculus
ccatgaaactaatcgacagaattgt

SEQ ID NO: 589640 - DNA, 25 bp, Mus musculus
ccatgaaagaaaagcagggattaac

SEQ ID NO: 589641 - DNA, 25 bp, Mus musculus
ccatgaaagaaatgcagggattaac

SEQ ID NO: 589642 - DNA, 25 bp, Mus musculus
ccatgaaagtggctgtcaagatgct

SEQ ID NO: 589643 - DNA, 25 bp, Mus musculus
ccatgaaagtgggtgtcaagatgct

SEQ ID NO: 589644 - DNA, 25 bp, Mus musculus
ccatgaacatttcttccacagaagt

SEQ ID NO: 589645 - DNA, 25 bp, Mus musculus
ccatgaacatttgttccacagaagt

SEQ ID NO: 589646 - DNA, 25 bp, Mus musculus
ccatgaaccgtcctggagccattaa

SEQ ID NO: 589647 - DNA, 25 bp, Mus musculus
ccatgaaccgtcgtggagccattaa

SEQ ID NO: 589648 - DNA, 25 bp, Mus musculus
ccatgaacctggactccagcagcaa

SEQ ID NO: 589649 - DNA, 25 bp, Mus musculus
ccatgaacctggtctccagcagcaa

SEQ ID NO: 589650 - DNA, 25 bp, Mus musculus
ccatgaacgagtatgagtacctgaa

SEQ ID NO: 589651 - DNA, 25 bp, Mus musculus
ccatgaacgagtttgagtacctgaa

SEQ ID NO: 589652 - DNA, 25 bp, Mus musculus
ccatgaacgggaaggaaggagtcgt

SEQ ID NO: 589653 - DNA, 25 bp, Mus musculus
ccatgaacgggatggaaggagtcgt

SEQ ID NO: 589654 - DNA, 25 bp, Mus musculus
ccatgaactggtcttggagtgcacc

SEQ ID NO: 589655 - DNA, 25 bp, Mus musculus
ccatgaactggtgttggagtgcacc

SEQ ID NO: 589656 - DNA, 25 bp, Mus musculus
ccatgaagactaacagttgccttat

SEQ ID NO: 589657 - DNA, 25 bp, Mus musculus
ccatgaagactatcagttgccttat

SEQ ID NO: 589658 - DNA, 25 bp, Mus musculus
ccatgaagagggaggccagctgacc

SEQ ID NO: 589659 - DNA, 25 bp, Mus musculus
ccatgaagagggtggccagctgacc

SEQ ID NO: 589660 - DNA, 25 bp, Mus musculus
ccatgaagaggtagactatactgaa

SEQ ID NO: 589661 - DNA, 25 bp, Mus musculus
ccatgaagaggtcgcccctaagtcc

SEQ ID NO: 589662 - DNA, 25 bp, Mus musculus
ccatgaagaggtggcccctaagtcc

SEQ ID NO: 589663 - DNA, 25 bp, Mus musculus
ccatgaagaggttgactatactgaa

SEQ ID NO: 589664 - DNA, 25 bp, Mus musculus
ccatgaagatccacatgaaagttgg

SEQ ID NO: 589665 - DNA, 25 bp, Mus musculus
ccatgaagatcctcatgaaagttgg

SEQ ID NO: 589666 - DNA, 25 bp, Mus musculus
ccatgaagatggaagtcactgaccc

SEQ ID NO: 589667 - DNA, 25 bp, Mus musculus
ccatgaagatggctactcagaagag

SEQ ID NO: 589668 - DNA, 25 bp, Mus musculus
ccatgaagatgggtactcagaagag

SEQ ID NO: 589669 - DNA, 25 bp, Mus musculus
ccatgaagatggtagtcactgaccc

SEQ ID NO: 589670 - DNA, 25 bp, Mus musculus
ccatgaagcccgagacgggcaactc

SEQ ID NO: 589671 - DNA, 25 bp, Mus musculus
ccatgaagcccgtgacgggcaactc

SEQ ID NO: 589672 - DNA, 25 bp, Mus musculus
ccatgaagctaaaagcagaaaagaa

SEQ ID NO: 589673 - DNA, 25 bp, Mus musculus
ccatgaagctaatagcagaaaagaa

SEQ ID NO: 589674 - DNA, 25 bp, Mus musculus
ccatgaaggaatatgcctatatgaa

SEQ ID NO: 589675 - DNA, 25 bp, Mus musculus
ccatgaaggaatttgcctatatgaa

SEQ ID NO: 589676 - DNA, 25 bp, Mus musculus
ccatgaagtttgaggatggtctgat

SEQ ID NO: 589677 - DNA, 25 bp, Mus musculus
ccatgaagtttgtggatggtctgat

SEQ ID NO: 589678 - DNA, 25 bp, Mus musculus
ccatgaatagacagacccagctgga

SEQ ID NO: 589679 - DNA, 25 bp, Mus musculus
ccatgaatagactgacccagctgga

SEQ ID NO: 589680 - DNA, 25 bp, Mus musculus
ccatgaatatgtacttgctgatatc

SEQ ID NO: 589681 - DNA, 25 bp, Mus musculus
ccatgaatatgttcttgctgatatc

SEQ ID NO: 589682 - DNA, 25 bp, Mus musculus
ccatgaatgatgacgaggagttgac

SEQ ID NO: 589683 - DNA, 25 bp, Mus musculus
ccatgaatgatgtcgaggagttgac

SEQ ID NO: 589684 - DNA, 25 bp, Mus musculus
ccatgacaacccaggatgataagtt

SEQ ID NO: 589685 - DNA, 25 bp, Mus musculus
ccatgacaaccctggatgataagtt

SEQ ID NO: 589686 - DNA, 25 bp, Mus musculus
ccatgacaatgcagttcatcagcca

SEQ ID NO: 589687 - DNA, 25 bp, Mus musculus
ccatgacaatgctgttcatcagcca

SEQ ID NO: 589688 - DNA, 25 bp, Mus musculus
ccatgacaatggcatgtttgcgcca

SEQ ID NO: 589689 - DNA, 25 bp, Mus musculus
ccatgacaatgggatgtttgcgcca

SEQ ID NO: 589690 - DNA, 25 bp, Mus musculus
ccatgacacagcactagtagtgtgg

SEQ ID NO: 589691 - DNA, 25 bp, Mus musculus
ccatgacacagctctagtagtgtgg

SEQ ID NO: 589692 - DNA, 25 bp, Mus musculus
ccatgacagagaagctgtaccctgg

SEQ ID NO: 589693 - DNA, 25 bp, Mus musculus
ccatgacagagatgctgtaccctgg

SEQ ID NO: 589694 - DNA, 25 bp, Mus musculus
ccatgacagtgtcgtggttccagat

SEQ ID NO: 589695 - DNA, 25 bp, Mus musculus
ccatgacagtgtggtggttccagat

SEQ ID NO: 589696 - DNA, 25 bp, Mus musculus
ccatgacatgttagttcgagagaca

SEQ ID NO: 589697 - DNA, 25 bp, Mus musculus
ccatgacatgtttgttcgagagaca

SEQ ID NO: 589698 - DNA, 25 bp, Mus musculus
ccatgaccaacaagagctggagctt

SEQ ID NO: 589699 - DNA, 25 bp, Mus musculus
ccatgaccaacatgagctggagctt

SEQ ID NO: 589700 - DNA, 25 bp, Mus musculus
ccatgacccacgagttggcaggagg

SEQ ID NO: 589701 - DNA, 25 bp, Mus musculus
ccatgacccacgtgttggcaggagg

SEQ ID NO: 589702 - DNA, 25 bp, Mus musculus
ccatgaccgtcaccagtctggcaat

SEQ ID NO: 589703 - DNA, 25 bp, Mus musculus
ccatgaccgtcagcagtctggcaat

SEQ ID NO: 589704 - DNA, 25 bp, Mus musculus
ccatgacggagtaagtatgcagcag

SEQ ID NO: 589705 - DNA, 25 bp, Mus musculus
ccatgacggagttagtatgcagcag

SEQ ID NO: 589706 - DNA, 25 bp, Mus musculus
ccatgacgggatcgtatatggacaa

SEQ ID NO: 589707 - DNA, 25 bp, Mus musculus
ccatgacgggatggtatatggacaa

SEQ ID NO: 589708 - DNA, 25 bp, Mus musculus
ccatgactgaccaggacatgctgtc

SEQ ID NO: 589709 - DNA, 25 bp, Mus musculus
ccatgactgacctggacatgctgtc

SEQ ID NO: 589710 - DNA, 25 bp, Mus musculus
ccatgactggatcgtcttcgtgcgt

SEQ ID NO: 589711 - DNA, 25 bp, Mus musculus
ccatgactggatggtcttcgtgcgt

SEQ ID NO: 589712 - DNA, 25 bp, Mus musculus
ccatgactgggtcggtccatgatgt

SEQ ID NO: 589713 - DNA, 25 bp, Mus musculus
ccatgactgggtgggtccatgatgt

SEQ ID NO: 589714 - DNA, 25 bp, Mus musculus
ccatgactttgcaatcaactttgac

SEQ ID NO: 589715 - DNA, 25 bp, Mus musculus
ccatgactttgctatcaactttgac

SEQ ID NO: 589716 - DNA, 25 bp, Mus musculus
ccatgagaaaacctccaagttgaaa

SEQ ID NO: 589717 - DNA, 25 bp, Mus musculus
ccatgagaaaacgtccaagttgaaa

SEQ ID NO: 589718 - DNA, 25 bp, Mus musculus
ccatgagaacgtcgtggtagtaacc

SEQ ID NO: 589719 - DNA, 25 bp, Mus musculus
ccatgagaacgtggtggtagtaacc

SEQ ID NO: 589720 - DNA, 25 bp, Mus musculus
ccatgagaattacaccaaggccctg

SEQ ID NO: 589721 - DNA, 25 bp, Mus musculus
ccatgagaattagaccaaggccctg

SEQ ID NO: 589722 - DNA, 25 bp, Mus musculus
ccatgagaggtactactagatcttc

SEQ ID NO: 589723 - DNA, 25 bp, Mus musculus
ccatgagaggtagtactagatcttc

SEQ ID NO: 589724 - DNA, 25 bp, Mus musculus
ccatgagatcttaggccatgtcgag

SEQ ID NO: 589725 - DNA, 25 bp, Mus musculus
ccatgagatctttggccatgtcgag

SEQ ID NO: 589726 - DNA, 25 bp, Mus musculus
ccatgagatgttcaccgaaagggat

SEQ ID NO: 589727 - DNA, 25 bp, Mus musculus
ccatgagatgttgaccgaaagggat

SEQ ID NO: 589728 - DNA, 25 bp, Mus musculus
ccatgagcgaggacacggttcccga

SEQ ID NO: 589729 - DNA, 25 bp, Mus musculus
ccatgagcgaggtcacggttcccga

SEQ ID NO: 589730 - DNA, 25 bp, Mus musculus
ccatgagctatgacgcagatgggag

SEQ ID NO: 589731 - DNA, 25 bp, Mus musculus
ccatgagctatgtcgcagatgggag

SEQ ID NO: 589732 - DNA, 25 bp, Mus musculus
ccatgagctgttccttgcgctgaaa

SEQ ID NO: 589733 - DNA, 25 bp, Mus musculus
ccatgagctgttgcttgcgctgaaa

SEQ ID NO: 589734 - DNA, 25 bp, Mus musculus
ccatgagctttgactgtattgtggc

SEQ ID NO: 589735 - DNA, 25 bp, Mus musculus
ccatgagctttgtctgtattgtggc

SEQ ID NO: 589736 - DNA, 25 bp, Mus musculus
ccatgaggacttctggacccaggaa

SEQ ID NO: 589737 - DNA, 25 bp, Mus musculus
ccatgaggacttgtggacccaggaa

SEQ ID NO: 589738 - DNA, 25 bp, Mus musculus
ccatgaggcatcaccgtagtgcgct

SEQ ID NO: 589739 - DNA, 25 bp, Mus musculus
ccatgaggcatctccgtagtgcgct

SEQ ID NO: 589740 - DNA, 25 bp, Mus musculus
ccatgaggcgtaacattttatcgac

SEQ ID NO: 589741 - DNA, 25 bp, Mus musculus
ccatgaggcgtatcattttatcgac

SEQ ID NO: 589742 - DNA, 25 bp, Mus musculus
ccatgagggctacgacttgaattcc

SEQ ID NO: 589743 - DNA, 25 bp, Mus musculus
ccatgagggctaggacttgaattcc

SEQ ID NO: 589744 - DNA, 25 bp, Mus musculus
ccatgaggtaaaacgcaagcccttg

SEQ ID NO: 589745 - DNA, 25 bp, Mus musculus
ccatgaggtaaatcgcaagcccttg

SEQ ID NO: 589746 - DNA, 25 bp, Mus musculus
ccatgaggtcatcctggcccttacg

SEQ ID NO: 589747 - DNA, 25 bp, Mus musculus
ccatgaggtcatgctggcccttacg

SEQ ID NO: 589748 - DNA, 25 bp, Mus musculus
ccatgaggttggatgcctcatcttg

SEQ ID NO: 589749 - DNA, 25 bp, Mus musculus
ccatgaggttggttgcctcatcttg

SEQ ID NO: 589750 - DNA, 25 bp, Mus musculus
ccatgagtaagcagtggttcaaaca

SEQ ID NO: 589751 - DNA, 25 bp, Mus musculus
ccatgagtaagctgtggttcaaaca

SEQ ID NO: 589752 - DNA, 25 bp, Mus musculus
ccatgagtgaatccaacggcacttg

SEQ ID NO: 589753 - DNA, 25 bp, Mus musculus
ccatgagtgaatgcaacggcacttg

SEQ ID NO: 589754 - DNA, 25 bp, Mus musculus
ccatgagtgagaagacaggcaatac

SEQ ID NO: 589755 - DNA, 25 bp, Mus musculus
ccatgagtgagatgacaggcaatac

SEQ ID NO: 589756 - DNA, 25 bp, Mus musculus
ccatgagtgcggaggtgaaggtgac

SEQ ID NO: 589757 - DNA, 25 bp, Mus musculus
ccatgagtgcggtggtgaaggtgac

SEQ ID NO: 589758 - DNA, 25 bp, Mus musculus
ccatgagtttataagcagggcaggc

SEQ ID NO: 589759 - DNA, 25 bp, Mus musculus
ccatgagtttattagcagggcaggc

SEQ ID NO: 589760 - DNA, 25 bp, Mus musculus
ccatgatcctgaccaatttgactgc

SEQ ID NO: 589761 - DNA, 25 bp, Mus musculus
ccatgatcctgagcaatttgactgc

SEQ ID NO: 589762 - DNA, 25 bp, Mus musculus
ccatgatctgatccggaagatgtca

SEQ ID NO: 589763 - DNA, 25 bp, Mus musculus
ccatgatctgatgcggaagatgtca

SEQ ID NO: 589764 - DNA, 25 bp, Mus musculus
ccatgatgattaaagcggtggtgcc

SEQ ID NO: 589765 - DNA, 25 bp, Mus musculus
ccatgatgattatagcggtggtgcc

SEQ ID NO: 589766 - DNA, 25 bp, Mus musculus
ccatgatggcatcgatatcaacaac

SEQ ID NO: 589767 - DNA, 25 bp, Mus musculus
ccatgatggcatggatatcaacaac

SEQ ID NO: 589768 - DNA, 25 bp, Mus musculus
ccatgatgtgcacagcctgtcggca

SEQ ID NO: 589769 - DNA, 25 bp, Mus musculus
ccatgatgtgcagagcctgtcggca

SEQ ID NO: 589770 - DNA, 25 bp, Mus musculus
ccatgattagaactcccagacccag

SEQ ID NO: 589771 - DNA, 25 bp, Mus musculus
ccatgattagaagtcccagacccag

SEQ ID NO: 589772 - DNA, 25 bp, Mus musculus
ccatgattaggccagaacctgctca

SEQ ID NO: 589773 - DNA, 25 bp, Mus musculus
ccatgattaggcgagaacctgctca

SEQ ID NO: 589774 - DNA, 25 bp, Mus musculus
ccatgattcaatcaaaatggagatt

SEQ ID NO: 589775 - DNA, 25 bp, Mus musculus
ccatgattcaatgaaaatggagatt

SEQ ID NO: 589776 - DNA, 25 bp, Mus musculus
ccatgattgagaaggtgaccaggaa

SEQ ID NO: 589777 - DNA, 25 bp, Mus musculus
ccatgattgagatggtgaccaggaa

SEQ ID NO: 589778 - DNA, 25 bp, Mus musculus
ccatgcaaaactcggtcagatctaa

SEQ ID NO: 589779 - DNA, 25 bp, Mus musculus
ccatgcaaaactgggtcagatctaa

SEQ ID NO: 589780 - DNA, 25 bp, Mus musculus
ccatgcaatcgtccgtgatgctcat

SEQ ID NO: 589781 - DNA, 25 bp, Mus musculus
ccatgcaatcgtgcgtgatgctcat

SEQ ID NO: 589782 - DNA, 25 bp, Mus musculus
ccatgcacaaggcagagcgggcttt

SEQ ID NO: 589783 - DNA, 25 bp, Mus musculus
ccatgcacaagggagagcgggcttt

SEQ ID NO: 589784 - DNA, 25 bp, Mus musculus
ccatgcacagaaaagatccgcttca

SEQ ID NO: 589785 - DNA, 25 bp, Mus musculus
ccatgcacagaatagatccgcttca

SEQ ID NO: 589786 - DNA, 25 bp, Mus musculus
ccatgcactgcgcagtctggaccag

SEQ ID NO: 589787 - DNA, 25 bp, Mus musculus
ccatgcactgcggagtctggaccag

SEQ ID NO: 589788 - DNA, 25 bp, Mus musculus
ccatgcactgctcaagatgatctac

SEQ ID NO: 589789 - DNA, 25 bp, Mus musculus
ccatgcactgctgaagatgatctac

SEQ ID NO: 589790 - DNA, 25 bp, Mus musculus
ccatgcactgggcatatgattccag

SEQ ID NO: 589791 - DNA, 25 bp, Mus musculus
ccatgcactggggatatgattccag

SEQ ID NO: 589792 - DNA, 25 bp, Mus musculus
ccatgcactgtgaaggaccctcgtt

SEQ ID NO: 589793 - DNA, 25 bp, Mus musculus
ccatgcactgtgtaggaccctcgtt

SEQ ID NO: 589794 - DNA, 25 bp, Mus musculus
ccatgcagatgcaaaagtccaggtg

SEQ ID NO: 589795 - DNA, 25 bp, Mus musculus
ccatgcagatgctaaagtccaggtg

SEQ ID NO: 589796 - DNA, 25 bp, Mus musculus
ccatgcaggaaaatgaacccgggtt

SEQ ID NO: 589797 - DNA, 25 bp, Mus musculus
ccatgcaggaaattgaacccgggtt

SEQ ID NO: 589798 - DNA, 25 bp, Mus musculus
ccatgcaggagcaaattggcttcta

SEQ ID NO: 589799 - DNA, 25 bp, Mus musculus
ccatgcaggagctaattggcttcta

SEQ ID NO: 589800 - DNA, 25 bp, Mus musculus
ccatgcaggaggaccgtagcatggt

SEQ ID NO: 589801 - DNA, 25 bp, Mus musculus
ccatgcaggaggtccgtagcatggt

SEQ ID NO: 589802 - DNA, 25 bp, Mus musculus
ccatgcagggttctttctgagagaa

SEQ ID NO: 589803 - DNA, 25 bp, Mus musculus
ccatgcagggttgtttctgagagaa

SEQ ID NO: 589804 - DNA, 25 bp, Mus musculus
ccatgcaggtgaccttcgtgtgcca

SEQ ID NO: 589805 - DNA, 25 bp, Mus musculus
ccatgcaggtgagcttcgtgtgcca

SEQ ID NO: 589806 - DNA, 25 bp, Mus musculus
ccatgcagtttgacgatgacgatca

SEQ ID NO: 589807 - DNA, 25 bp, Mus musculus
ccatgcagtttgtcgatgacgatca

SEQ ID NO: 589808 - DNA, 25 bp, Mus musculus
ccatgcataggtacacttccttcag

SEQ ID NO: 589809 - DNA, 25 bp, Mus musculus
ccatgcataggttcacttccttcag

SEQ ID NO: 589810 - DNA, 25 bp, Mus musculus
ccatgcatatctaaaggaatggttg

SEQ ID NO: 589811 - DNA, 25 bp, Mus musculus
ccatgcatatcttaaggaatggttg

SEQ ID NO: 589812 - DNA, 25 bp, Mus musculus
ccatgcatcattccccaagctggag

SEQ ID NO: 589813 - DNA, 25 bp, Mus musculus
ccatgcatcattgcccaagctggag

SEQ ID NO: 589814 - DNA, 25 bp, Mus musculus
ccatgcatccctagtataaataaag

SEQ ID NO: 589815 - DNA, 25 bp, Mus musculus
ccatgcatcccttgtataaataaag

SEQ ID NO: 589816 - DNA, 25 bp, Mus musculus
ccatgcatttgtacgctgggtaaca

SEQ ID NO: 589817 - DNA, 25 bp, Mus musculus
ccatgcatttgttcgctgggtaaca

SEQ ID NO: 589818 - DNA, 25 bp, Mus musculus
ccatgccatcagagagcaactgatc

SEQ ID NO: 589819 - DNA, 25 bp, Mus musculus
ccatgccatcagtgagcaactgatc

SEQ ID NO: 589820 - DNA, 25 bp, Mus musculus
ccatgccctgcacaaaataaagtca

SEQ ID NO: 589821 - DNA, 25 bp, Mus musculus
ccatgccctgcagaaaataaagtca

SEQ ID NO: 589822 - DNA, 25 bp, Mus musculus
ccatgccgctggatctgctaactca

SEQ ID NO: 589823 - DNA, 25 bp, Mus musculus
ccatgccgctggttctgctaactca

SEQ ID NO: 589824 - DNA, 25 bp, Mus musculus
ccatgcctcagtagactccacagat

SEQ ID NO: 589825 - DNA, 25 bp, Mus musculus
ccatgcctcagttgactccacagat

SEQ ID NO: 589826 - DNA, 25 bp, Mus musculus
ccatgcctggagcagcatcaatggc

SEQ ID NO: 589827 - DNA, 25 bp, Mus musculus
ccatgcctggaggagcatcaatggc

SEQ ID NO: 589828 - DNA, 25 bp, Mus musculus
ccatgccttggactttgggagagat

SEQ ID NO: 589829 - DNA, 25 bp, Mus musculus
ccatgccttggagtttgggagagat

SEQ ID NO: 589830 - DNA, 25 bp, Mus musculus
ccatgccttttcaggagcgcagaag

SEQ ID NO: 589831 - DNA, 25 bp, Mus musculus
ccatgccttttctggagcgcagaag

SEQ ID NO: 589832 - DNA, 25 bp, Mus musculus
ccatgcgagaggagaagcgagctct

SEQ ID NO: 589833 - DNA, 25 bp, Mus musculus
ccatgcgagaggtgaagcgagctct

SEQ ID NO: 589834 - DNA, 25 bp, Mus musculus
ccatgcgatgtaaggagcataggct

SEQ ID NO: 589835 - DNA, 25 bp, Mus musculus
ccatgcgatgtatggagcataggct

SEQ ID NO: 589836 - DNA, 25 bp, Mus musculus
ccatgcgcaagcaggtgcgctcact

SEQ ID NO: 589837 - DNA, 25 bp, Mus musculus
ccatgcgcaagctggtgcgctcact

SEQ ID NO: 589838 - DNA, 25 bp, Mus musculus
ccatgcggcagtctggatgtcttcc

SEQ ID NO: 589839 - DNA, 25 bp, Mus musculus
ccatgcggcagtgtggatgtcttcc

SEQ ID NO: 589840 - DNA, 25 bp, Mus musculus
ccatgcgttacaaggccctggatcc

SEQ ID NO: 589841 - DNA, 25 bp, Mus musculus
ccatgcgttacatggccctggatcc

SEQ ID NO: 589842 - DNA, 25 bp, Mus musculus
ccatgctaagtacctgaatgcatga

SEQ ID NO: 589843 - DNA, 25 bp, Mus musculus
ccatgctaagtagctgaatgcatga

SEQ ID NO: 589844 - DNA, 25 bp, Mus musculus
ccatgctaatcaagacggagtcgga

SEQ ID NO: 589845 - DNA, 25 bp, Mus musculus
ccatgctaatcatgacggagtcgga

SEQ ID NO: 589846 - DNA, 25 bp, Mus musculus
ccatgctacgaacacagcagatcaa

SEQ ID NO: 589847 - DNA, 25 bp, Mus musculus
ccatgctacgaagacagcagatcaa

SEQ ID NO: 589848 - DNA, 25 bp, Mus musculus
ccatgctaggtaattctgaggacca

SEQ ID NO: 589849 - DNA, 25 bp, Mus musculus
ccatgctaggtatttctgaggacca

SEQ ID NO: 589850 - DNA, 25 bp, Mus musculus
ccatgctccataaggtgccggccgt

SEQ ID NO: 589851 - DNA, 25 bp, Mus musculus
ccatgctccatatggtgccggccgt

SEQ ID NO: 589852 - DNA, 25 bp, Mus musculus
ccatgctctgttcaactgtataaaa

SEQ ID NO: 589853 - DNA, 25 bp, Mus musculus
ccatgctctgttgaactgtataaaa

SEQ ID NO: 589854 - DNA, 25 bp, Mus musculus
ccatgctggccccgcttggctatga

SEQ ID NO: 589855 - DNA, 25 bp, Mus musculus
ccatgctggcccggcttggctatga

SEQ ID NO: 589856 - DNA, 25 bp, Mus musculus
ccatgctgggttcccaaagcatcag

SEQ ID NO: 589857 - DNA, 25 bp, Mus musculus
ccatgctgggttgccaaagcatcag

SEQ ID NO: 589858 - DNA, 25 bp, Mus musculus
ccatgctgtcctcaatgccggaaga

SEQ ID NO: 589859 - DNA, 25 bp, Mus musculus
ccatgctgtcctgaatgccggaaga

SEQ ID NO: 589860 - DNA, 25 bp, Mus musculus
ccatgctgttgaagtggattcaggc

SEQ ID NO: 589861 - DNA, 25 bp, Mus musculus
ccatgctgttgatgtggattcaggc

SEQ ID NO: 589862 - DNA, 25 bp, Mus musculus
ccatgctgttggattgacgacttcc

SEQ ID NO: 589863 - DNA, 25 bp, Mus musculus
ccatgctgttggtttgacgacttcc

SEQ ID NO: 589864 - DNA, 25 bp, Mus musculus
ccatgcttacagctgctgtgcagca

SEQ ID NO: 589865 - DNA, 25 bp, Mus musculus
ccatgcttacaggtgctgtgcagca

SEQ ID NO: 589866 - DNA, 25 bp, Mus musculus
ccatgcttattaccgagatgctcag

SEQ ID NO: 589867 - DNA, 25 bp, Mus musculus
ccatgcttattagcgagatgctcag

SEQ ID NO: 589868 - DNA, 25 bp, Mus musculus
ccatgcttgtacacagaggccagag

SEQ ID NO: 589869 - DNA, 25 bp, Mus musculus
ccatgcttgtactcagaggccagag

SEQ ID NO: 589870 - DNA, 25 bp, Mus musculus
ccatgctttgagaggtactgttgta

SEQ ID NO: 589871 - DNA, 25 bp, Mus musculus
ccatgctttgagtggtactgttgta

SEQ ID NO: 589872 - DNA, 25 bp, Mus musculus
ccatggaaaaagcttgatggacagt

SEQ ID NO: 589873 - DNA, 25 bp, Mus musculus
ccatggaaaaaggttgatggacagt

SEQ ID NO: 589874 - DNA, 25 bp, Mus musculus
ccatggaaaacaaccctacagtggg

SEQ ID NO: 589875 - DNA, 25 bp, Mus musculus
ccatggaaaacatccctacagtggg

SEQ ID NO: 589876 - DNA, 25 bp, Mus musculus
ccatggaaagacaccaagaaattta

SEQ ID NO: 589877 - DNA, 25 bp, Mus musculus
ccatggaaagactccaagaaattta

SEQ ID NO: 589878 - DNA, 25 bp, Mus musculus
ccatggaaatggagggtgtcagcac

SEQ ID NO: 589879 - DNA, 25 bp, Mus musculus
ccatggaaatggtgggtgtcagcac

SEQ ID NO: 589880 - DNA, 25 bp, Mus musculus
ccatggaagaagagcctgtttgccc

SEQ ID NO: 589881 - DNA, 25 bp, Mus musculus
ccatggaagaagtgcctgtttgccc

SEQ ID NO: 589882 - DNA, 25 bp, Mus musculus
ccatggaagacaaccccgtcatctc

SEQ ID NO: 589883 - DNA, 25 bp, Mus musculus
ccatggaagacatccccgtcatctc

SEQ ID NO: 589884 - DNA, 25 bp, Mus musculus
ccatggaagaggctggaggcgaggg

SEQ ID NO: 589885 - DNA, 25 bp, Mus musculus
ccatggaagagggtggaggcgaggg

SEQ ID NO: 589886 - DNA, 25 bp, Mus musculus
ccatggaagtacaagagggatatgg

SEQ ID NO: 589887 - DNA, 25 bp, Mus musculus
ccatggaagtactagagggatatgg

SEQ ID NO: 589888 - DNA, 25 bp, Mus musculus
ccatggaatcaaagacacagcaagt

SEQ ID NO: 589889 - DNA, 25 bp, Mus musculus
ccatggaatcaatgacacagcaagt

SEQ ID NO: 589890 - DNA, 25 bp, Mus musculus
ccatggacaattctatgacctcaag

SEQ ID NO: 589891 - DNA, 25 bp, Mus musculus
ccatggacaattgtatgacctcaag

SEQ ID NO: 589892 - DNA, 25 bp, Mus musculus
ccatggacacacaacgctgcaaaat

SEQ ID NO: 589893 - DNA, 25 bp, Mus musculus
ccatggacacactacgctgcaaaat

SEQ ID NO: 589894 - DNA, 25 bp, Mus musculus
ccatggacacctccgttcaagactt

SEQ ID NO: 589895 - DNA, 25 bp, Mus musculus
ccatggacacctgcgttcaagactt

SEQ ID NO: 589896 - DNA, 25 bp, Mus musculus
ccatggacacttagggcgtggagta

SEQ ID NO: 589897 - DNA, 25 bp, Mus musculus
ccatggacactttgggcgtggagta

SEQ ID NO: 589898 - DNA, 25 bp, Mus musculus
ccatggacagtgagttaagcaacgc

SEQ ID NO: 589899 - DNA, 25 bp, Mus musculus
ccatggacagtgtgttaagcaacgc

SEQ ID NO: 589900 - DNA, 25 bp, Mus musculus
ccatggacagttcccctgtggagtc

SEQ ID NO: 589901 - DNA, 25 bp, Mus musculus
ccatggacagttgccctgtggagtc

SEQ ID NO: 589902 - DNA, 25 bp, Mus musculus
ccatggacatcgcacggactatgct

SEQ ID NO: 589903 - DNA, 25 bp, Mus musculus
ccatggacatcggacggactatgct

SEQ ID NO: 589904 - DNA, 25 bp, Mus musculus
ccatggacgactatgcggttttgtc

SEQ ID NO: 589905 - DNA, 25 bp, Mus musculus
ccatggacgactttgcggttttgtc

SEQ ID NO: 589906 - DNA, 25 bp, Mus musculus
ccatggacggccaggaccgcgagca

SEQ ID NO: 589907 - DNA, 25 bp, Mus musculus
ccatggacggcctggaccgcgagca

SEQ ID NO: 589908 - DNA, 25 bp, Mus musculus
ccatggacgtatctttggaggtgca

SEQ ID NO: 589909 - DNA, 25 bp, Mus musculus
ccatggacgtatgtttggaggtgca

SEQ ID NO: 589910 - DNA, 25 bp, Mus musculus
ccatggactactcggagggcttgtc

SEQ ID NO: 589911 - DNA, 25 bp, Mus musculus
ccatggactactgggagggcttgtc

SEQ ID NO: 589912 - DNA, 25 bp, Mus musculus
ccatggactctgcttcccagataac

SEQ ID NO: 589913 - DNA, 25 bp, Mus musculus
ccatggactctggttcccagataac

SEQ ID NO: 589914 - DNA, 25 bp, Mus musculus
ccatggactgtcaccctttgggaag

SEQ ID NO: 589915 - DNA, 25 bp, Mus musculus
ccatggactgtctccctttgggaag

SEQ ID NO: 589916 - DNA, 25 bp, Mus musculus
ccatggagaaccacagccggagact

SEQ ID NO: 589917 - DNA, 25 bp, Mus musculus
ccatggagaacctcagccggagact

SEQ ID NO: 589918 - DNA, 25 bp, Mus musculus
ccatggagaatgattatttgggccc

SEQ ID NO: 589919 - DNA, 25 bp, Mus musculus
ccatggagaatgtttatttgggccc

SEQ ID NO: 589920 - DNA, 25 bp, Mus musculus
ccatggagacaacaggacacgagtt

SEQ ID NO: 589921 - DNA, 25 bp, Mus musculus
ccatggagacaagaggacacgagtt

SEQ ID NO: 589922 - DNA, 25 bp, Mus musculus
ccatggagagctagctgtaagcagt

SEQ ID NO: 589923 - DNA, 25 bp, Mus musculus
ccatggagagcttgctgtaagcagt

SEQ ID NO: 589924 - DNA, 25 bp, Mus musculus
ccatggagatcgagcgcagcaaggc

SEQ ID NO: 589925 - DNA, 25 bp, Mus musculus
ccatggagatcgtgcgcagcaaggc

SEQ ID NO: 589926 - DNA, 25 bp, Mus musculus
ccatggagatgtcagggtacttact

SEQ ID NO: 589927 - DNA, 25 bp, Mus musculus
ccatggagatgtgagggtacttact

SEQ ID NO: 589928 - DNA, 25 bp, Mus musculus
ccatggagccggacagaaaagctgc

SEQ ID NO: 589929 - DNA, 25 bp, Mus musculus
ccatggagccggtcagaaaagctgc

SEQ ID NO: 589930 - DNA, 25 bp, Mus musculus
ccatggagctttagtggtaaaagcg

SEQ ID NO: 589931 - DNA, 25 bp, Mus musculus
ccatggagcttttgtggtaaaagcg

SEQ ID NO: 589932 - DNA, 25 bp, Mus musculus
ccatggaggacacttttctggaatc

SEQ ID NO: 589933 - DNA, 25 bp, Mus musculus
ccatggaggacagttttctggaatc

SEQ ID NO: 589934 - DNA, 25 bp, Mus musculus
ccatggaggattatcagacagatct

SEQ ID NO: 589935 - DNA, 25 bp, Mus musculus
ccatggaggattttcagacagatct

SEQ ID NO: 589936 - DNA, 25 bp, Mus musculus
ccatggaggcacaggccttagctga

SEQ ID NO: 589937 - DNA, 25 bp, Mus musculus
ccatggaggcactggccttagctga

SEQ ID NO: 589938 - DNA, 25 bp, Mus musculus
ccatggataagactgagctggtaca

SEQ ID NO: 589939 - DNA, 25 bp, Mus musculus
ccatggataagagtgagctggtaca

SEQ ID NO: 589940 - DNA, 25 bp, Mus musculus
ccatggatatcacagaaagaaatcc

SEQ ID NO: 589941 - DNA, 25 bp, Mus musculus
ccatggatatcagagaaagaaatcc

SEQ ID NO: 589942 - DNA, 25 bp, Mus musculus
ccatggatcccaccatcctgaaggg

SEQ ID NO: 589943 - DNA, 25 bp, Mus musculus
ccatggatcccagcatcctgaaggg

SEQ ID NO: 589944 - DNA, 25 bp, Mus musculus
ccatggatcgacaaagttacacggg

SEQ ID NO: 589945 - DNA, 25 bp, Mus musculus
ccatggatcgactaagttacacggg

SEQ ID NO: 589946 - DNA, 25 bp, Mus musculus
ccatggatgtgaaactgaagcgcca

SEQ ID NO: 589947 - DNA, 25 bp, Mus musculus
ccatggatgtgatactgaagcgcca

SEQ ID NO: 589948 - DNA, 25 bp, Mus musculus
ccatggattccaatggcttggcaga

SEQ ID NO: 589949 - DNA, 25 bp, Mus musculus
ccatggattccattggcttggcaga

SEQ ID NO: 589950 - DNA, 25 bp, Mus musculus
ccatggatttagacacaaagttgcc

SEQ ID NO: 589951 - DNA, 25 bp, Mus musculus
ccatggatttagtcacaaagttgcc

SEQ ID NO: 589952 - DNA, 25 bp, Mus musculus
ccatggcaaactctcagtatggctg

SEQ ID NO: 589953 - DNA, 25 bp, Mus musculus
ccatggcaaactgtcagtatggctg

SEQ ID NO: 589954 - DNA, 25 bp, Mus musculus
ccatggcacagaaatgaggaagatg

SEQ ID NO: 589955 - DNA, 25 bp, Mus musculus
ccatggcacagatatgaggaagatg

SEQ ID NO: 589956 - DNA, 25 bp, Mus musculus
ccatggcagacgaggtgactgagaa

SEQ ID NO: 589957 - DNA, 25 bp, Mus musculus
ccatggcagacgtggtgactgagaa

SEQ ID NO: 589958 - DNA, 25 bp, Mus musculus
ccatggcagccccagttcttgtcat

SEQ ID NO: 589959 - DNA, 25 bp, Mus musculus
ccatggcagcccgagttcttgtcat

SEQ ID NO: 589960 - DNA, 25 bp, Mus musculus
ccatggcagccgagggctttgaaga

SEQ ID NO: 589961 - DNA, 25 bp, Mus musculus
ccatggcagccgtgggctttgaaga

SEQ ID NO: 589962 - DNA, 25 bp, Mus musculus
ccatggcagcggcaagctctttgta

SEQ ID NO: 589963 - DNA, 25 bp, Mus musculus
ccatggcagcgggaagctctttgta

SEQ ID NO: 589964 - DNA, 25 bp, Mus musculus
ccatggcagttgaggagctgcgtga

SEQ ID NO: 589965 - DNA, 25 bp, Mus musculus
ccatggcagttgtggagctgcgtga

SEQ ID NO: 589966 - DNA, 25 bp, Mus musculus
ccatggcatcatcggcctgggtgcc

SEQ ID NO: 589967 - DNA, 25 bp, Mus musculus
ccatggcatcatgggcctgggtgcc

SEQ ID NO: 589968 - DNA, 25 bp, Mus musculus
ccatggccatcgagaacactcaaga

SEQ ID NO: 589969 - DNA, 25 bp, Mus musculus
ccatggccatcgtgaacactcaaga

SEQ ID NO: 589970 - DNA, 25 bp, Mus musculus
ccatggccatctcagcaaggatcaa

SEQ ID NO: 589971 - DNA, 25 bp, Mus musculus
ccatggccatctgagcaaggatcaa

SEQ ID NO: 589972 - DNA, 25 bp, Mus musculus
ccatggccatggactgacgagacca

SEQ ID NO: 589973 - DNA, 25 bp, Mus musculus
ccatggccatggtctgacgagacca

SEQ ID NO: 589974 - DNA, 25 bp, Mus musculus
ccatggcccgaaagatccgaatgaa

SEQ ID NO: 589975 - DNA, 25 bp, Mus musculus
ccatggcccgaatgatccgaatgaa

SEQ ID NO: 589976 - DNA, 25 bp, Mus musculus
ccatggccctttctgtggagacgga

SEQ ID NO: 589977 - DNA, 25 bp, Mus musculus
ccatggccctttgtgtggagacgga

SEQ ID NO: 589978 - DNA, 25 bp, Mus musculus
ccatggccgcgcaggaatcgctgcg

SEQ ID NO: 589979 - DNA, 25 bp, Mus musculus
ccatggccgcgctggaatcgctgcg

SEQ ID NO: 589980 - DNA, 25 bp, Mus musculus
ccatggcggaacagaagagcctctc

SEQ ID NO: 589981 - DNA, 25 bp, Mus musculus
ccatggcggaactgaagagcctctc

SEQ ID NO: 589982 - DNA, 25 bp, Mus musculus
ccatggcggacgctccactttaggg

SEQ ID NO: 589983 - DNA, 25 bp, Mus musculus
ccatggcggacggtccactttaggg

SEQ ID NO: 589984 - DNA, 25 bp, Mus musculus
ccatggcggcgcctttgaagacttc

SEQ ID NO: 589985 - DNA, 25 bp, Mus musculus
ccatggcggcgcgtttgaagacttc

SEQ ID NO: 589986 - DNA, 25 bp, Mus musculus
ccatggcggtgaacctgagccggaa

SEQ ID NO: 589987 - DNA, 25 bp, Mus musculus
ccatggcggtgatcctgagccggaa

SEQ ID NO: 589988 - DNA, 25 bp, Mus musculus
ccatggctatcgagacagtgcgaga

SEQ ID NO: 589989 - DNA, 25 bp, Mus musculus
ccatggctatcgtgacagtgcgaga

SEQ ID NO: 589990 - DNA, 25 bp, Mus musculus
ccatggctgggcaggctaaaagctt

SEQ ID NO: 589991 - DNA, 25 bp, Mus musculus
ccatggctgggctggctaaaagctt

SEQ ID NO: 589992 - DNA, 25 bp, Mus musculus
ccatggctgtcgctggtttctccaa

SEQ ID NO: 589993 - DNA, 25 bp, Mus musculus
ccatggctgtcggtggtttctccaa

SEQ ID NO: 589994 - DNA, 25 bp, Mus musculus
ccatggctgtgacttccagtgtgtg

SEQ ID NO: 589995 - DNA, 25 bp, Mus musculus
ccatggctgtgagttccagtgtgtg

SEQ ID NO: 589996 - DNA, 25 bp, Mus musculus
ccatggcttcagaagaagtaaagca

SEQ ID NO: 589997 - DNA, 25 bp, Mus musculus
ccatggcttcagtagaagtaaagca

SEQ ID NO: 589998 - DNA, 25 bp, Mus musculus
ccatggcttggaaagaaaaggcaga

SEQ ID NO: 589999 - DNA, 25 bp, Mus musculus
ccatggcttggatagaaaaggcaga

SEQ ID NO: 590000 - DNA, 25 bp, Mus musculus
ccatgggagggacagtcagtgccgt

SEQ ID NO: 590001 - DNA, 25 bp, Mus musculus
ccatgggagggagagtcagtgccgt

SEQ ID NO: 590002 - DNA, 25 bp, Mus musculus
ccatgggattcactggacctttgaa

SEQ ID NO: 590003 - DNA, 25 bp, Mus musculus
ccatgggattcagtggacctttgaa

SEQ ID NO: 590004 - DNA, 25 bp, Mus musculus
ccatgggcaactcccacacggtggg

SEQ ID NO: 590005 - DNA, 25 bp, Mus musculus
ccatgggcaactgccacacggtggg

SEQ ID NO: 590006 - DNA, 25 bp, Mus musculus
ccatgggcatgtccgacgtgtacct

SEQ ID NO: 590007 - DNA, 25 bp, Mus musculus
ccatgggcatgtgcgacgtgtacct

SEQ ID NO: 590008 - DNA, 25 bp, Mus musculus
ccatgggccagtcccagcggtaact

SEQ ID NO: 590009 - DNA, 25 bp, Mus musculus
ccatgggccagtgccagcggtaact

SEQ ID NO: 590010 - DNA, 25 bp, Mus musculus
ccatgggccccgagcgggaacgtct

SEQ ID NO: 590011 - DNA, 25 bp, Mus musculus
ccatgggccccgtgcgggaacgtct

SEQ ID NO: 590012 - DNA, 25 bp, Mus musculus
ccatgggcttcacggtcactaacgg

SEQ ID NO: 590013 - DNA, 25 bp, Mus musculus
ccatgggcttcagggtcactaacgg

SEQ ID NO: 590014 - DNA, 25 bp, Mus musculus
ccatgggcttggcaatccttatctt

SEQ ID NO: 590015 - DNA, 25 bp, Mus musculus
ccatgggcttgggaatccttatctt

SEQ ID NO: 590016 - DNA, 25 bp, Mus musculus
ccatgggtcgagatccgggcttctt

SEQ ID NO: 590017 - DNA, 25 bp, Mus musculus
ccatgggtcgagttccgggcttctt

SEQ ID NO: 590018 - DNA, 25 bp, Mus musculus
ccatgggtcgggaggatcagttcca

SEQ ID NO: 590019 - DNA, 25 bp, Mus musculus
ccatgggtcgggtggatcagttcca

SEQ ID NO: 590020 - DNA, 25 bp, Mus musculus
ccatgggttatgagagcagtgccga

SEQ ID NO: 590021 - DNA, 25 bp, Mus musculus
ccatgggttatgtgagcagtgccga

SEQ ID NO: 590022 - DNA, 25 bp, Mus musculus
ccatggtaaaaacctgaaactgggc

SEQ ID NO: 590023 - DNA, 25 bp, Mus musculus
ccatggtaaaaagctgaaactgggc

SEQ ID NO: 590024 - DNA, 25 bp, Mus musculus
ccatggtaaggtctcccgctctggg

SEQ ID NO: 590025 - DNA, 25 bp, Mus musculus
ccatggtaaggtgtcccgctctggg

SEQ ID NO: 590026 - DNA, 25 bp, Mus musculus
ccatggtagagaacgacgggatgaa

SEQ ID NO: 590027 - DNA, 25 bp, Mus musculus
ccatggtagagatcgacgggatgaa

SEQ ID NO: 590028 - DNA, 25 bp, Mus musculus
ccatggtagggcatcccgctctgct

SEQ ID NO: 590029 - DNA, 25 bp, Mus musculus
ccatggtagggcttcccgctctgct

SEQ ID NO: 590030 - DNA, 25 bp, Mus musculus
ccatggtcaagtaaatggcatactc

SEQ ID NO: 590031 - DNA, 25 bp, Mus musculus
ccatggtcaagttaatggcatactc

SEQ ID NO: 590032 - DNA, 25 bp, Mus musculus
ccatggtgacgcacgccgagctgct

SEQ ID NO: 590033 - DNA, 25 bp, Mus musculus
ccatggtgacgctcgccgagctgct

SEQ ID NO: 590034 - DNA, 25 bp, Mus musculus
ccatggtgaggaaccaagactgcct

SEQ ID NO: 590035 - DNA, 25 bp, Mus musculus
ccatggtgaggatccaagactgcct

SEQ ID NO: 590036 - DNA, 25 bp, Mus musculus
ccatggtgcactatatcaagcagaa

SEQ ID NO: 590037 - DNA, 25 bp, Mus musculus
ccatggtgcactttatcaagcagaa

SEQ ID NO: 590038 - DNA, 25 bp, Mus musculus
ccatggtggcctaggtgagagtctc

SEQ ID NO: 590039 - DNA, 25 bp, Mus musculus
ccatggtggccttggtgagagtctc

SEQ ID NO: 590040 - DNA, 25 bp, Mus musculus
ccatggtggcgtcttatccaggcaa

SEQ ID NO: 590041 - DNA, 25 bp, Mus musculus
ccatggtggcgtgttatccaggcaa

SEQ ID NO: 590042 - DNA, 25 bp, Mus musculus
ccatggtgtaatcggcaaagatgag

SEQ ID NO: 590043 - DNA, 25 bp, Mus musculus
ccatggtgtaatgggcaaagatgag

SEQ ID NO: 590044 - DNA, 25 bp, Mus musculus
ccatggtgtcctctatctatatagt

SEQ ID NO: 590045 - DNA, 25 bp, Mus musculus
ccatggtgtcctgtatctatatagt

SEQ ID NO: 590046 - DNA, 25 bp, Mus musculus
ccatggtgtgttctggaccctgctg

SEQ ID NO: 590047 - DNA, 25 bp, Mus musculus
ccatggtgtgttgtggaccctgctg

SEQ ID NO: 590048 - DNA, 25 bp, Mus musculus
ccatggttagtcaggaaatggagaa

SEQ ID NO: 590049 - DNA, 25 bp, Mus musculus
ccatggttagtctggaaatggagaa

SEQ ID NO: 590050 - DNA, 25 bp, Mus musculus
ccatggttatggatcctgctactgt

SEQ ID NO: 590051 - DNA, 25 bp, Mus musculus
ccatggttatggttcctgctactgt

SEQ ID NO: 590052 - DNA, 25 bp, Mus musculus
ccatgtaaccatcagagagccagag

SEQ ID NO: 590053 - DNA, 25 bp, Mus musculus
ccatgtaaccatgagagagccagag

SEQ ID NO: 590054 - DNA, 25 bp, Mus musculus
ccatgtaatttaaagctgaacggca

SEQ ID NO: 590055 - DNA, 25 bp, Mus musculus
ccatgtaatttatagctgaacggca

SEQ ID NO: 590056 - DNA, 25 bp, Mus musculus
ccatgtacatccagggtaccatcga

SEQ ID NO: 590057 - DNA, 25 bp, Mus musculus
ccatgtacatcctgggtaccatcga

SEQ ID NO: 590058 - DNA, 25 bp, Mus musculus
ccatgtactcggaggagatcacggt

SEQ ID NO: 590059 - DNA, 25 bp, Mus musculus
ccatgtactcggtggagatcacggt

SEQ ID NO: 590060 - DNA, 25 bp, Mus musculus
ccatgtaggagtagcttggcccaaa

SEQ ID NO: 590061 - DNA, 25 bp, Mus musculus
ccatgtaggagttgcttggcccaaa

SEQ ID NO: 590062 - DNA, 25 bp, Mus musculus
ccatgtaggtggactctggaagata

SEQ ID NO: 590063 - DNA, 25 bp, Mus musculus
ccatgtaggtggtctctggaagata

SEQ ID NO: 590064 - DNA, 25 bp, Mus musculus
ccatgtatattcatggtgccattga

SEQ ID NO: 590065 - DNA, 25 bp, Mus musculus
ccatgtatattcttggtgccattga

SEQ ID NO: 590066 - DNA, 25 bp, Mus musculus
ccatgtatccggaatcaaccacggg

SEQ ID NO: 590067 - DNA, 25 bp, Mus musculus
ccatgtatccggtatcaaccacggg

SEQ ID NO: 590068 - DNA, 25 bp, Mus musculus
ccatgtatggccacttgaaggaatg

SEQ ID NO: 590069 - DNA, 25 bp, Mus musculus
ccatgtatggcctcttgaaggaatg

SEQ ID NO: 590070 - DNA, 25 bp, Mus musculus
ccatgtcaatgaaaagccgtccagc

SEQ ID NO: 590071 - DNA, 25 bp, Mus musculus
ccatgtcaatgataagccgtccagc

SEQ ID NO: 590072 - DNA, 25 bp, Mus musculus
ccatgtcagaatcatgccacttgcc

SEQ ID NO: 590073 - DNA, 25 bp, Mus musculus
ccatgtcagaatgatgccacttgcc

SEQ ID NO: 590074 - DNA, 25 bp, Mus musculus
ccatgtcagcgtcactggcatcttc

SEQ ID NO: 590075 - DNA, 25 bp, Mus musculus
ccatgtcagcgtgactggcatcttc

SEQ ID NO: 590076 - DNA, 25 bp, Mus musculus
ccatgtccagatcatagtgctagat

SEQ ID NO: 590077 - DNA, 25 bp, Mus musculus
ccatgtccagatgatagtgctagat

SEQ ID NO: 590078 - DNA, 25 bp, Mus musculus
ccatgtcgagacctgacgtggtcct

SEQ ID NO: 590079 - DNA, 25 bp, Mus musculus
ccatgtcgagacgtgacgtggtcct

SEQ ID NO: 590080 - DNA, 25 bp, Mus musculus
ccatgtcggtgccagagttgaacca

SEQ ID NO: 590081 - DNA, 25 bp, Mus musculus
ccatgtcggtgcgagagttgaacca

SEQ ID NO: 590082 - DNA, 25 bp, Mus musculus
ccatgtcgtgctcggcagtgtctgc

SEQ ID NO: 590083 - DNA, 25 bp, Mus musculus
ccatgtcgtgctgggcagtgtctgc

SEQ ID NO: 590084 - DNA, 25 bp, Mus musculus
ccatgtctccaacgcttctacaggg

SEQ ID NO: 590085 - DNA, 25 bp, Mus musculus
ccatgtctccaaggcttctacaggg

SEQ ID NO: 590086 - DNA, 25 bp, Mus musculus
ccatgtctcctgagatatgcagaaa

SEQ ID NO: 590087 - DNA, 25 bp, Mus musculus
ccatgtctcctgtgatatgcagaaa

SEQ ID NO: 590088 - DNA, 25 bp, Mus musculus
ccatgtctgagtaagtggtgcacac

SEQ ID NO: 590089 - DNA, 25 bp, Mus musculus
ccatgtctgagttagtggtgcacac

SEQ ID NO: 590090 - DNA, 25 bp, Mus musculus
ccatgtgaacagagaggtcaattct

SEQ ID NO: 590091 - DNA, 25 bp, Mus musculus
ccatgtgaacagtgaggtcaattct

SEQ ID NO: 590092 - DNA, 25 bp, Mus musculus
ccatgtgactgacactgggcagcat

SEQ ID NO: 590093 - DNA, 25 bp, Mus musculus
ccatgtgactgagactgggcagcat

SEQ ID NO: 590094 - DNA, 25 bp, Mus musculus
ccatgtgagatgagacaaagatgaa

SEQ ID NO: 590095 - DNA, 25 bp, Mus musculus
ccatgtgagatgtgacaaagatgaa

SEQ ID NO: 590096 - DNA, 25 bp, Mus musculus
ccatgtgaggctctgcgtccgagat

SEQ ID NO: 590097 - DNA, 25 bp, Mus musculus
ccatgtgaggctgtgcgtccgagat

SEQ ID NO: 590098 - DNA, 25 bp, Mus musculus
ccatgtgcaccacgaagttcacaag

SEQ ID NO: 590099 - DNA, 25 bp, Mus musculus
ccatgtgcaccaggaagttcacaag

SEQ ID NO: 590100 - DNA, 25 bp, Mus musculus
ccatgtgcagcaacacgcaaagcct

SEQ ID NO: 590101 - DNA, 25 bp, Mus musculus
ccatgtgcagcatcacgcaaagcct

SEQ ID NO: 590102 - DNA, 25 bp, Mus musculus
ccatgtgcattaaggagagcctacg

SEQ ID NO: 590103 - DNA, 25 bp, Mus musculus
ccatgtgcattatggagagcctacg

SEQ ID NO: 590104 - DNA, 25 bp, Mus musculus
ccatgtgcccgacaagcggcctgtg

SEQ ID NO: 590105 - DNA, 25 bp, Mus musculus
ccatgtgcccgagaagcggcctgtg

SEQ ID NO: 590106 - DNA, 25 bp, Mus musculus
ccatgtgccggcactgagcagcagg

SEQ ID NO: 590107 - DNA, 25 bp, Mus musculus
ccatgtgccggctctgagcagcagg

SEQ ID NO: 590108 - DNA, 25 bp, Mus musculus
ccatgtgctacaagaccagaccgca

SEQ ID NO: 590109 - DNA, 25 bp, Mus musculus
ccatgtgctacatgaccagaccgca

SEQ ID NO: 590110 - DNA, 25 bp, Mus musculus
ccatgtgctgtgacttcctaattat

SEQ ID NO: 590111 - DNA, 25 bp, Mus musculus
ccatgtgctgtgtcttcctaattat

SEQ ID NO: 590112 - DNA, 25 bp, Mus musculus
ccatgtggtcttattggcaaggaat

SEQ ID NO: 590113 - DNA, 25 bp, Mus musculus
ccatgtggtctttttggcaaggaat

SEQ ID NO: 590114 - DNA, 25 bp, Mus musculus
ccatgtgtaaacctgaatgctgtac

SEQ ID NO: 590115 - DNA, 25 bp, Mus musculus
ccatgtgtaaacgtgaatgctgtac

SEQ ID NO: 590116 - DNA, 25 bp, Mus musculus
ccatgtgtacatcaatcataactga

SEQ ID NO: 590117 - DNA, 25 bp, Mus musculus
ccatgtgtacatgaatcataactga

SEQ ID NO: 590118 - DNA, 25 bp, Mus musculus
ccatgtgtggacctgcctatgacat

SEQ ID NO: 590119 - DNA, 25 bp, Mus musculus
ccatgtgtggacgtgcctatgacat

SEQ ID NO: 590120 - DNA, 25 bp, Mus musculus
ccatgtgtgggtacaagtcttgtca

SEQ ID NO: 590121 - DNA, 25 bp, Mus musculus
ccatgtgtgggttcaagtcttgtca

SEQ ID NO: 590122 - DNA, 25 bp, Mus musculus
ccatgtgtgtgtaagccagaggacc

SEQ ID NO: 590123 - DNA, 25 bp, Mus musculus
ccatgtgtgtgttagccagaggacc

SEQ ID NO: 590124 - DNA, 25 bp, Mus musculus
ccatgtgtttgtaggtgacctcagt

SEQ ID NO: 590125 - DNA, 25 bp, Mus musculus
ccatgtgtttgttggtgacctcagt

SEQ ID NO: 590126 - DNA, 25 bp, Mus musculus
ccatgtgttttaatatctgctgctg

SEQ ID NO: 590127 - DNA, 25 bp, Mus musculus
ccatgtgttttattatctgctgctg

SEQ ID NO: 590128 - DNA, 25 bp, Mus musculus
ccatgttagggtagcctggtgctct

SEQ ID NO: 590129 - DNA, 25 bp, Mus musculus
ccatgttagggttgcctggtgctct

SEQ ID NO: 590130 - DNA, 25 bp, Mus musculus
ccatgttcactaagctgtatctggt

SEQ ID NO: 590131 - DNA, 25 bp, Mus musculus
ccatgttcactatgctgtatctggt

SEQ ID NO: 590132 - DNA, 25 bp, Mus musculus
ccatgttcttgccagggaaatggat

SEQ ID NO: 590133 - DNA, 25 bp, Mus musculus
ccatgttcttgcgagggaaatggat

SEQ ID NO: 590134 - DNA, 25 bp, Mus musculus
ccatgttgaatgcaactgagaagac

SEQ ID NO: 590135 - DNA, 25 bp, Mus musculus
ccatgttgaatggaactgagaagac

SEQ ID NO: 590136 - DNA, 25 bp, Mus musculus
ccatgttgatcgaggctagcacagg

SEQ ID NO: 590137 - DNA, 25 bp, Mus musculus
ccatgttgatcgtggctagcacagg

SEQ ID NO: 590138 - DNA, 25 bp, Mus musculus
ccatgttgggtaagtgtgtgtgcct

SEQ ID NO: 590139 - DNA, 25 bp, Mus musculus
ccatgttgggtatgtgtgtgtgcct

SEQ ID NO: 590140 - DNA, 25 bp, Mus musculus
ccatgttgtggcacggagcccaggc

SEQ ID NO: 590141 - DNA, 25 bp, Mus musculus
ccatgttgtggctcggagcccaggc

SEQ ID NO: 590142 - DNA, 25 bp, Mus musculus
ccatgttgtgggagtctgagaagct

SEQ ID NO: 590143 - DNA, 25 bp, Mus musculus
ccatgttgtgggtgtctgagaagct

SEQ ID NO: 590144 - DNA, 25 bp, Mus musculus
ccatgtttacacagtacagcatctg

SEQ ID NO: 590145 - DNA, 25 bp, Mus musculus
ccatgtttacactgtacagcatctg

SEQ ID NO: 590146 - DNA, 25 bp, Mus musculus
ccatgtttcccaagccccgagttat

SEQ ID NO: 590147 - DNA, 25 bp, Mus musculus
ccatgtttcccatgccccgagttat

SEQ ID NO: 590148 - DNA, 25 bp, Mus musculus
ccatgtttcttccttcggcggagat

SEQ ID NO: 590149 - DNA, 25 bp, Mus musculus
ccatgtttcttcgttcggcggagat

SEQ ID NO: 590150 - DNA, 25 bp, Mus musculus
ccatgttttcacaggaagagttaca

SEQ ID NO: 590151 - DNA, 25 bp, Mus musculus
ccatgttttcactggaagagttaca

SEQ ID NO: 590152 - DNA, 25 bp, Mus musculus
ccatgtttttcacttgtggcccaaa

SEQ ID NO: 590153 - DNA, 25 bp, Mus musculus
ccatgtttttcagttgtggcccaaa

SEQ ID NO: 590154 - DNA, 25 bp, Mus musculus
ccattaaagacaaagatggctatca

SEQ ID NO: 590155 - DNA, 25 bp, Mus musculus
ccattaaagacatagatggctatca

SEQ ID NO: 590156 - DNA, 25 bp, Mus musculus
ccattaaagtgtcgagtatgttccg

SEQ ID NO: 590157 - DNA, 25 bp, Mus musculus
ccattaaagtgtggagtatgttccg

SEQ ID NO: 590158 - DNA, 25 bp, Mus musculus
ccattaaagttacgacagcagctgc

SEQ ID NO: 590159 - DNA, 25 bp, Mus musculus
ccattaaagttaggacagcagctgc

SEQ ID NO: 590160 - DNA, 25 bp, Mus musculus
ccattaaatagcagtaggcctccct

SEQ ID NO: 590161 - DNA, 25 bp, Mus musculus
ccattaaatagctgtaggcctccct

SEQ ID NO: 590162 - DNA, 25 bp, Mus musculus
ccattaagaatgcttctcgactcag

SEQ ID NO: 590163 - DNA, 25 bp, Mus musculus
ccattaagaatggttctcgactcag

SEQ ID NO: 590164 - DNA, 25 bp, Mus musculus
ccattaagagtgcaaagtataaaca

SEQ ID NO: 590165 - DNA, 25 bp, Mus musculus
ccattaagagtggaaagtataaaca

SEQ ID NO: 590166 - DNA, 25 bp, Mus musculus
ccattacagacaataggcagaaaac

SEQ ID NO: 590167 - DNA, 25 bp, Mus musculus
ccattacagacattaggcagaaaac

SEQ ID NO: 590168 - DNA, 25 bp, Mus musculus
ccattaccatgacaactacggaaag

SEQ ID NO: 590169 - DNA, 25 bp, Mus musculus
ccattaccatgagaactacggaaag

SEQ ID NO: 590170 - DNA, 25 bp, Mus musculus
ccattactacggatcctaagctgag

SEQ ID NO: 590171 - DNA, 25 bp, Mus musculus
ccattactacggttcctaagctgag

SEQ ID NO: 590172 - DNA, 25 bp, Mus musculus
ccattactatccagtgccattgcca

SEQ ID NO: 590173 - DNA, 25 bp, Mus musculus
ccattactatcctgtgccattgcca

SEQ ID NO: 590174 - DNA, 25 bp, Mus musculus
ccattactggtgcatctcactgtgg

SEQ ID NO: 590175 - DNA, 25 bp, Mus musculus
ccattactggtggatctcactgtgg

SEQ ID NO: 590176 - DNA, 25 bp, Mus musculus
ccattagagagaagtttaatactcc

SEQ ID NO: 590177 - DNA, 25 bp, Mus musculus
ccattagagagatgtttaatactcc

SEQ ID NO: 590178 - DNA, 25 bp, Mus musculus
ccattagtgaggaacttccctatag

SEQ ID NO: 590179 - DNA, 25 bp, Mus musculus
ccattagtgaggtacttccctatag

SEQ ID NO: 590180 - DNA, 25 bp, Mus musculus
ccattagtgatgatgagctagcaga

SEQ ID NO: 590181 - DNA, 25 bp, Mus musculus
ccattagtgatgttgagctagcaga

SEQ ID NO: 590182 - DNA, 25 bp, Mus musculus
ccattatctgtaccagcgcagccag

SEQ ID NO: 590183 - DNA, 25 bp, Mus musculus
ccattatctgtagcagcgcagccag

SEQ ID NO: 590184 - DNA, 25 bp, Mus musculus
ccattatgagccagggagcagcttt

SEQ ID NO: 590185 - DNA, 25 bp, Mus musculus
ccattatgagcctgggagcagcttt

SEQ ID NO: 590186 - DNA, 25 bp, Mus musculus
ccattatggactatcagacttctga

SEQ ID NO: 590187 - DNA, 25 bp, Mus musculus
ccattatggactttcagacttctga

SEQ ID NO: 590188 - DNA, 25 bp, Mus musculus
ccattattatggacctgctttggaa

SEQ ID NO: 590189 - DNA, 25 bp, Mus musculus
ccattattatggcaggacttcaggg

SEQ ID NO: 590190 - DNA, 25 bp, Mus musculus
ccattattatgggaggacttcaggg

SEQ ID NO: 590191 - DNA, 25 bp, Mus musculus
ccattattatggtcctgctttggaa

SEQ ID NO: 590192 - DNA, 25 bp, Mus musculus
ccattattggcactgcccgctgtaa

SEQ ID NO: 590193 - DNA, 25 bp, Mus musculus
ccattattggcagtgcccgctgtaa

SEQ ID NO: 590194 - DNA, 25 bp, Mus musculus
ccattattggtgagcacttggacac

SEQ ID NO: 590195 - DNA, 25 bp, Mus musculus
ccattattggtgcagataggcctga

SEQ ID NO: 590196 - DNA, 25 bp, Mus musculus
ccattattggtggagataggcctga

SEQ ID NO: 590197 - DNA, 25 bp, Mus musculus
ccattattggtgtgcacttggacac

SEQ ID NO: 590198 - DNA, 25 bp, Mus musculus
ccattcaaaatgcttaccgcagcac

SEQ ID NO: 590199 - DNA, 25 bp, Mus musculus
ccattcaaaatggttaccgcagcac

SEQ ID NO: 590200 - DNA, 25 bp, Mus musculus
ccattcaaagagctctgtactccat

SEQ ID NO: 590201 - DNA, 25 bp, Mus musculus
ccattcaaagaggtctgtactccat

SEQ ID NO: 590202 - DNA, 25 bp, Mus musculus
ccattcaatatcaagatgtccatac

SEQ ID NO: 590203 - DNA, 25 bp, Mus musculus
ccattcaatatctagatgtccatac

SEQ ID NO: 590204 - DNA, 25 bp, Mus musculus
ccattcacacacaggcactttcatg

SEQ ID NO: 590205 - DNA, 25 bp, Mus musculus
ccattcacacactggcactttcatg

SEQ ID NO: 590206 - DNA, 25 bp, Mus musculus
ccattcacgttgcagaaggctttgt

SEQ ID NO: 590207 - DNA, 25 bp, Mus musculus
ccattcacgttggagaaggctttgt

SEQ ID NO: 590208 - DNA, 25 bp, Mus musculus
ccattcagaaaacggagacgcgctt

SEQ ID NO: 590209 - DNA, 25 bp, Mus musculus
ccattcagaaaagggagacgcgctt

SEQ ID NO: 590210 - DNA, 25 bp, Mus musculus
ccattcagaatccagttgatattgc

SEQ ID NO: 590211 - DNA, 25 bp, Mus musculus
ccattcagaatcgagttgatattgc

SEQ ID NO: 590212 - DNA, 25 bp, Mus musculus
ccattcaggaatacatacgacagct

SEQ ID NO: 590213 - DNA, 25 bp, Mus musculus
ccattcaggaattcatacgacagct

SEQ ID NO: 590214 - DNA, 25 bp, Mus musculus
ccattcagggtgacgaggaggacct

SEQ ID NO: 590215 - DNA, 25 bp, Mus musculus
ccattcagggtgtcgaggaggacct

SEQ ID NO: 590216 - DNA, 25 bp, Mus musculus
ccattcattgacagccagcatgtca

SEQ ID NO: 590217 - DNA, 25 bp, Mus musculus
ccattcattgactgccagcatgtca

SEQ ID NO: 590218 - DNA, 25 bp, Mus musculus
ccattcattgagaagtccaggagat

SEQ ID NO: 590219 - DNA, 25 bp, Mus musculus
ccattcattgagtagtccaggagat

SEQ ID NO: 590220 - DNA, 25 bp, Mus musculus
ccattcattgcacagagaatcttct

SEQ ID NO: 590221 - DNA, 25 bp, Mus musculus
ccattcattgcagagagaatcttct

SEQ ID NO: 590222 - DNA, 25 bp, Mus musculus
ccattccaagttctaaatgctagtc

SEQ ID NO: 590223 - DNA, 25 bp, Mus musculus
ccattccaagttgtaaatgctagtc

SEQ ID NO: 590224 - DNA, 25 bp, Mus musculus
ccattccataagaatgcctgccatg

SEQ ID NO: 590225 - DNA, 25 bp, Mus musculus
ccattccataagtatgcctgccatg

SEQ ID NO: 590226 - DNA, 25 bp, Mus musculus
ccattcccactgactgggccaaggg

SEQ ID NO: 590227 - DNA, 25 bp, Mus musculus
ccattcccactgtctgggccaaggg

SEQ ID NO: 590228 - DNA, 25 bp, Mus musculus
ccattccgagacctgcagtgttctc

SEQ ID NO: 590229 - DNA, 25 bp, Mus musculus
ccattccgagacgtgcagtgttctc

SEQ ID NO: 590230 - DNA, 25 bp, Mus musculus
ccattccgatggctctgtcagccag

SEQ ID NO: 590231 - DNA, 25 bp, Mus musculus
ccattccgatgggtctgtcagccag

SEQ ID NO: 590232 - DNA, 25 bp, Mus musculus
ccattccgctgtacagacactgttt

SEQ ID NO: 590233 - DNA, 25 bp, Mus musculus
ccattccgctgttcagacactgttt

SEQ ID NO: 590234 - DNA, 25 bp, Mus musculus
ccattccggacaagattcttggaca

SEQ ID NO: 590235 - DNA, 25 bp, Mus musculus
ccattccggacatgattcttggaca

SEQ ID NO: 590236 - DNA, 25 bp, Mus musculus
ccattccggttaagatttgctagtc

SEQ ID NO: 590237 - DNA, 25 bp, Mus musculus
ccattccggttatgatttgctagtc

SEQ ID NO: 590238 - DNA, 25 bp, Mus musculus
ccattccgtttgcatccagaacaga

SEQ ID NO: 590239 - DNA, 25 bp, Mus musculus
ccattccgtttggatccagaacaga

SEQ ID NO: 590240 - DNA, 25 bp, Mus musculus
ccattcctcagaccgaggtagccgg

SEQ ID NO: 590241 - DNA, 25 bp, Mus musculus
ccattcctcagagcgaggtagccgg

SEQ ID NO: 590242 - DNA, 25 bp, Mus musculus
ccattcctcgggaggaatacacaga

SEQ ID NO: 590243 - DNA, 25 bp, Mus musculus
ccattcctcgggtggaatacacaga

SEQ ID NO: 590244 - DNA, 25 bp, Mus musculus
ccattcctgaagactcaaaggagaa

SEQ ID NO: 590245 - DNA, 25 bp, Mus musculus
ccattcctgaagtctcaaaggagaa

SEQ ID NO: 590246 - DNA, 25 bp, Mus musculus
ccattcctgggccagaccaagcagg

SEQ ID NO: 590247 - DNA, 25 bp, Mus musculus
ccattcctgggcgagaccaagcagg

SEQ ID NO: 590248 - DNA, 25 bp, Mus musculus
ccattcctgtggaggactgcgggtc

SEQ ID NO: 590249 - DNA, 25 bp, Mus musculus
ccattcctgtggtggactgcgggtc

SEQ ID NO: 590250 - DNA, 25 bp, Mus musculus
ccattcgaacttcggaaagtgacct

SEQ ID NO: 590251 - DNA, 25 bp, Mus musculus
ccattcgaacttgggaaagtgacct

SEQ ID NO: 590252 - DNA, 25 bp, Mus musculus
ccattcgaatcaccctttatgcggt

SEQ ID NO: 590253 - DNA, 25 bp, Mus musculus
ccattcgaatcagcctttatgcggt

SEQ ID NO: 590254 - DNA, 25 bp, Mus musculus
ccattcgataggaactttggaacca

SEQ ID NO: 590255 - DNA, 25 bp, Mus musculus
ccattcgataggtactttggaacca

SEQ ID NO: 590256 - DNA, 25 bp, Mus musculus
ccattcgcaaatcaagacgagtata

SEQ ID NO: 590257 - DNA, 25 bp, Mus musculus
ccattcgcaaatgaagacgagtata

SEQ ID NO: 590258 - DNA, 25 bp, Mus musculus
ccattcgcaactaggctatggagaa

SEQ ID NO: 590259 - DNA, 25 bp, Mus musculus
ccattcgcaacttggctatggagaa

SEQ ID NO: 590260 - DNA, 25 bp, Mus musculus
ccattcggcgaaagaggcaaagcca

SEQ ID NO: 590261 - DNA, 25 bp, Mus musculus
ccattcggcgaatgaggcaaagcca

SEQ ID NO: 590262 - DNA, 25 bp, Mus musculus
ccattcgggaagacacctggccaac

SEQ ID NO: 590263 - DNA, 25 bp, Mus musculus
ccattcgggaagtcacctggccaac

SEQ ID NO: 590264 - DNA, 25 bp, Mus musculus
ccattcgggagtacctggatcagta

SEQ ID NO: 590265 - DNA, 25 bp, Mus musculus
ccattcgggagttcctggatcagta

SEQ ID NO: 590266 - DNA, 25 bp, Mus musculus
ccattcgtgaatctattgagagtga

SEQ ID NO: 590267 - DNA, 25 bp, Mus musculus
ccattcgtgaatgtattgagagtga

SEQ ID NO: 590268 - DNA, 25 bp, Mus musculus
ccattctaattaatgtgatgtgtgc

SEQ ID NO: 590269 - DNA, 25 bp, Mus musculus
ccattctaattattgtgatgtgtgc

SEQ ID NO: 590270 - DNA, 25 bp, Mus musculus
ccattctaccttctttagaccatga

SEQ ID NO: 590271 - DNA, 25 bp, Mus musculus
ccattctaccttgtttagaccatga

SEQ ID NO: 590272 - DNA, 25 bp, Mus musculus
ccattctatgttcaccagtggttgg

SEQ ID NO: 590273 - DNA, 25 bp, Mus musculus
ccattctatgttgaccagtggttgg

SEQ ID NO: 590274 - DNA, 25 bp, Mus musculus
ccattctcttccagtcacgggagct

SEQ ID NO: 590275 - DNA, 25 bp, Mus musculus
ccattctcttcctgtcacgggagct

SEQ ID NO: 590276 - DNA, 25 bp, Mus musculus
ccattctgaggactacatcgacttc

SEQ ID NO: 590277 - DNA, 25 bp, Mus musculus
ccattctgaggagtacatcgacttc

SEQ ID NO: 590278 - DNA, 25 bp, Mus musculus
ccattctgcatacggtagctgctcc

SEQ ID NO: 590279 - DNA, 25 bp, Mus musculus
ccattctgcatagggtagctgctcc

SEQ ID NO: 590280 - DNA, 25 bp, Mus musculus
ccattctgcttaaaatttgaaggga

SEQ ID NO: 590281 - DNA, 25 bp, Mus musculus
ccattctgcttataatttgaaggga

SEQ ID NO: 590282 - DNA, 25 bp, Mus musculus
ccattctggagacgctgctccaagc

SEQ ID NO: 590283 - DNA, 25 bp, Mus musculus
ccattctggagaggctgctccaagc

SEQ ID NO: 590284 - DNA, 25 bp, Mus musculus
ccattcttcaaaagaatgtgagtga

SEQ ID NO: 590285 - DNA, 25 bp, Mus musculus
ccattcttcaaatgaatgtgagtga

SEQ ID NO: 590286 - DNA, 25 bp, Mus musculus
ccattcttcgtcagcaaacaacaga

SEQ ID NO: 590287 - DNA, 25 bp, Mus musculus
ccattcttcgtctgcaaacaacaga

SEQ ID NO: 590288 - DNA, 25 bp, Mus musculus
ccattcttctgcagcgtgacaaccg

SEQ ID NO: 590289 - DNA, 25 bp, Mus musculus
ccattcttctgctgcgtgacaaccg

SEQ ID NO: 590290 - DNA, 25 bp, Mus musculus
ccattcttcttcagtccctcaggga

SEQ ID NO: 590291 - DNA, 25 bp, Mus musculus
ccattcttcttctgtccctcaggga

SEQ ID NO: 590292 - DNA, 25 bp, Mus musculus
ccattcttggtgctatcgaagaaga

SEQ ID NO: 590293 - DNA, 25 bp, Mus musculus
ccattcttggtggtatcgaagaaga

SEQ ID NO: 590294 - DNA, 25 bp, Mus musculus
ccattgaaaaataggcttgaacacc

SEQ ID NO: 590295 - DNA, 25 bp, Mus musculus
ccattgaaaaattggcttgaacacc

SEQ ID NO: 590296 - DNA, 25 bp, Mus musculus
ccattgaaagtaagatggtcactct

SEQ ID NO: 590297 - DNA, 25 bp, Mus musculus
ccattgaaagtatgatggtcactct

SEQ ID NO: 590298 - DNA, 25 bp, Mus musculus
ccattgaagagaaaaagcagcggct

SEQ ID NO: 590299 - DNA, 25 bp, Mus musculus
ccattgaagagataaagcagcggct

SEQ ID NO: 590300 - DNA, 25 bp, Mus musculus
ccattgaatctgagtatgaatatac

SEQ ID NO: 590301 - DNA, 25 bp, Mus musculus
ccattgaatctgtgtatgaatatac

SEQ ID NO: 590302 - DNA, 25 bp, Mus musculus
ccattgacaactcgcgcgttgtcct

SEQ ID NO: 590303 - DNA, 25 bp, Mus musculus
ccattgacaactggcgcgttgtcct

SEQ ID NO: 590304 - DNA, 25 bp, Mus musculus
ccattgaccccaccaggaagcagaa

SEQ ID NO: 590305 - DNA, 25 bp, Mus musculus
ccattgaccccagcaggaagcagaa

SEQ ID NO: 590306 - DNA, 25 bp, Mus musculus
ccattgacctatatgagctggagga

SEQ ID NO: 590307 - DNA, 25 bp, Mus musculus
ccattgacctatttgagctggagga

SEQ ID NO: 590308 - DNA, 25 bp, Mus musculus
ccattgacgtgtacagagaactaac

SEQ ID NO: 590309 - DNA, 25 bp, Mus musculus
ccattgacgtgttcagagaactaac

SEQ ID NO: 590310 - DNA, 25 bp, Mus musculus
ccattgactacaaccagtttttaca

SEQ ID NO: 590311 - DNA, 25 bp, Mus musculus
ccattgactacatccagtttttaca

SEQ ID NO: 590312 - DNA, 25 bp, Mus musculus
ccattgactgtcaattattctggcg

SEQ ID NO: 590313 - DNA, 25 bp, Mus musculus
ccattgactgtctattattctggcg

SEQ ID NO: 590314 - DNA, 25 bp, Mus musculus
ccattgacttgaaagcatgttggtt

SEQ ID NO: 590315 - DNA, 25 bp, Mus musculus
ccattgacttgatagcatgttggtt

SEQ ID NO: 590316 - DNA, 25 bp, Mus musculus
ccattgagatggaaaaaggagggca

SEQ ID NO: 590317 - DNA, 25 bp, Mus musculus
ccattgagatggtaaaaggagggca

SEQ ID NO: 590318 - DNA, 25 bp, Mus musculus
ccattgagtatgattgcaaggagga

SEQ ID NO: 590319 - DNA, 25 bp, Mus musculus
ccattgagtatgtttgcaaggagga

SEQ ID NO: 590320 - DNA, 25 bp, Mus musculus
ccattgagtgctccaagcacttttt

SEQ ID NO: 590321 - DNA, 25 bp, Mus musculus
ccattgagtgctgcaagcacttttt

SEQ ID NO: 590322 - DNA, 25 bp, Mus musculus
ccattgagttagatgaagacaccgg

SEQ ID NO: 590323 - DNA, 25 bp, Mus musculus
ccattgagttagttgaagacaccgg

SEQ ID NO: 590324 - DNA, 25 bp, Mus musculus
ccattgataagtccctgacgccgat

SEQ ID NO: 590325 - DNA, 25 bp, Mus musculus
ccattgataagtgcctgacgccgat

SEQ ID NO: 590326 - DNA, 25 bp, Mus musculus
ccattgatccgacggaactgtggcg

SEQ ID NO: 590327 - DNA, 25 bp, Mus musculus
ccattgatccgagggaactgtggcg

SEQ ID NO: 590328 - DNA, 25 bp, Mus musculus
ccattgattgaacgctgaagctgag

SEQ ID NO: 590329 - DNA, 25 bp, Mus musculus
ccattgattgaaggctgaagctgag

SEQ ID NO: 590330 - DNA, 25 bp, Mus musculus
ccattgcaggcaaccctctgggtgt

SEQ ID NO: 590331 - DNA, 25 bp, Mus musculus
ccattgcaggcatccctctgggtgt

SEQ ID NO: 590332 - DNA, 25 bp, Mus musculus
ccattgcagtagagggacctggctg

SEQ ID NO: 590333 - DNA, 25 bp, Mus musculus
ccattgcagtagtgggacctggctg

SEQ ID NO: 590334 - DNA, 25 bp, Mus musculus
ccattgcccaccatctcttaaatag

SEQ ID NO: 590335 - DNA, 25 bp, Mus musculus
ccattgcccaccttctcttaaatag

SEQ ID NO: 590336 - DNA, 25 bp, Mus musculus
ccattgccttctcgctcggtgagcg

SEQ ID NO: 590337 - DNA, 25 bp, Mus musculus
ccattgccttctggctcggtgagcg

SEQ ID NO: 590338 - DNA, 25 bp, Mus musculus
ccattgcgcgtgacggaatcatccc

SEQ ID NO: 590339 - DNA, 25 bp, Mus musculus
ccattgcgcgtgtcggaatcatccc

SEQ ID NO: 590340 - DNA, 25 bp, Mus musculus
ccattgctgcatccagctctctaga

SEQ ID NO: 590341 - DNA, 25 bp, Mus musculus
ccattgctgcatgcagctctctaga

SEQ ID NO: 590342 - DNA, 25 bp, Mus musculus
ccattgctgtggcaacctccttata

SEQ ID NO: 590343 - DNA, 25 bp, Mus musculus
ccattgctgtgggaacctccttata

SEQ ID NO: 590344 - DNA, 25 bp, Mus musculus
ccattggaatataaagcccgggagt

SEQ ID NO: 590345 - DNA, 25 bp, Mus musculus
ccattggaatattaagcccgggagt

SEQ ID NO: 590346 - DNA, 25 bp, Mus musculus
ccattggacaaacggccctgacatt

SEQ ID NO: 590347 - DNA, 25 bp, Mus musculus
ccattggacaaagggccctgacatt

SEQ ID NO: 590348 - DNA, 25 bp, Mus musculus
ccattggagccaatgcagggagaat

SEQ ID NO: 590349 - DNA, 25 bp, Mus musculus
ccattggagccattgcagggagaat

SEQ ID NO: 590350 - DNA, 25 bp, Mus musculus
ccattggatgtcatctttaagtgca

SEQ ID NO: 590351 - DNA, 25 bp, Mus musculus
ccattggatgtcttctttaagtgca

SEQ ID NO: 590352 - DNA, 25 bp, Mus musculus
ccattggatgtgacagggaagacca

SEQ ID NO: 590353 - DNA, 25 bp, Mus musculus
ccattggatgtgtcagggaagacca

SEQ ID NO: 590354 - DNA, 25 bp, Mus musculus
ccattggccagaaccctggaggcac

SEQ ID NO: 590355 - DNA, 25 bp, Mus musculus
ccattggccagatccctggaggcac

SEQ ID NO: 590356 - DNA, 25 bp, Mus musculus
ccattggccagcatgaggtggtgaa

SEQ ID NO: 590357 - DNA, 25 bp, Mus musculus
ccattggccagcttgaggtggtgaa

SEQ ID NO: 590358 - DNA, 25 bp, Mus musculus
ccattggccgcaccaactttcgaga

SEQ ID NO: 590359 - DNA, 25 bp, Mus musculus
ccattggccgcagcaactttcgaga

SEQ ID NO: 590360 - DNA, 25 bp, Mus musculus
ccattggcgtgtcgaaaatgccacc

SEQ ID NO: 590361 - DNA, 25 bp, Mus musculus
ccattggcgtgtggaaaatgccacc

SEQ ID NO: 590362 - DNA, 25 bp, Mus musculus
ccattggctcccaggtggtgaggaa

SEQ ID NO: 590363 - DNA, 25 bp, Mus musculus
ccattggctccctggtggtgaggaa

SEQ ID NO: 590364 - DNA, 25 bp, Mus musculus
ccattggctctcagatggacgacta

SEQ ID NO: 590365 - DNA, 25 bp, Mus musculus
ccattggctctctgatggacgacta

SEQ ID NO: 590366 - DNA, 25 bp, Mus musculus
ccattgggtggaagagcagtcatac

SEQ ID NO: 590367 - DNA, 25 bp, Mus musculus
ccattgggtggatgagcagtcatac

SEQ ID NO: 590368 - DNA, 25 bp, Mus musculus
ccattggtggtgaggtgtaccatgc

SEQ ID NO: 590369 - DNA, 25 bp, Mus musculus
ccattggtggtgtggtgtaccatgc

SEQ ID NO: 590370 - DNA, 25 bp, Mus musculus
ccattgtcaatgcatattatactag

SEQ ID NO: 590371 - DNA, 25 bp, Mus musculus
ccattgtcaatggatattatactag

SEQ ID NO: 590372 - DNA, 25 bp, Mus musculus
ccattgtccgccaggtagtggagaa

SEQ ID NO: 590373 - DNA, 25 bp, Mus musculus
ccattgtccgcctggtagtggagaa

SEQ ID NO: 590374 - DNA, 25 bp, Mus musculus
ccattgtcgaccaatcccatgataa

SEQ ID NO: 590375 - DNA, 25 bp, Mus musculus
ccattgtcgacctatcccatgataa

SEQ ID NO: 590376 - DNA, 25 bp, Mus musculus
ccattgtctccaaggatactgaaaa

SEQ ID NO: 590377 - DNA, 25 bp, Mus musculus
ccattgtctccatggatactgaaaa

SEQ ID NO: 590378 - DNA, 25 bp, Mus musculus
ccattgtctgtaaaggtgagtccac

SEQ ID NO: 590379 - DNA, 25 bp, Mus musculus
ccattgtctgtataggtgagtccac

SEQ ID NO: 590380 - DNA, 25 bp, Mus musculus
ccattgtgccctcctcagggaagca

SEQ ID NO: 590381 - DNA, 25 bp, Mus musculus
ccattgtgccctgctcagggaagca

SEQ ID NO: 590382 - DNA, 25 bp, Mus musculus
ccattgtggagaatctccgcaccta

SEQ ID NO: 590383 - DNA, 25 bp, Mus musculus
ccattgtggagattctccgcaccta

SEQ ID NO: 590384 - DNA, 25 bp, Mus musculus
ccattgtggtatctggaaccccgat

SEQ ID NO: 590385 - DNA, 25 bp, Mus musculus
ccattgtggtatgtggaaccccgat

SEQ ID NO: 590386 - DNA, 25 bp, Mus musculus
ccattgttgacaatctactctgcaa

SEQ ID NO: 590387 - DNA, 25 bp, Mus musculus
ccattgttgacattctactctgcaa

SEQ ID NO: 590388 - DNA, 25 bp, Mus musculus
ccattgttttgaagaacacctggcc

SEQ ID NO: 590389 - DNA, 25 bp, Mus musculus
ccattgttttgatgaacacctggcc

SEQ ID NO: 590390 - DNA, 25 bp, Mus musculus
ccatttaaagtgaagtttgaggtgc

SEQ ID NO: 590391 - DNA, 25 bp, Mus musculus
ccatttaaagtgtagtttgaggtgc

SEQ ID NO: 590392 - DNA, 25 bp, Mus musculus
ccatttaaggccatgtctgtgggaa

SEQ ID NO: 590393 - DNA, 25 bp, Mus musculus
ccatttaaggccttgtctgtgggaa

SEQ ID NO: 590394 - DNA, 25 bp, Mus musculus
ccatttaccaagaacgagtttgcgg

SEQ ID NO: 590395 - DNA, 25 bp, Mus musculus
ccatttaccaagtacgagtttgcgg

SEQ ID NO: 590396 - DNA, 25 bp, Mus musculus
ccatttagtttgatgctggttgctg

SEQ ID NO: 590397 - DNA, 25 bp, Mus musculus
ccatttagtttgttgctggttgctg

SEQ ID NO: 590398 - DNA, 25 bp, Mus musculus
ccatttataagcaagactgatgctc

SEQ ID NO: 590399 - DNA, 25 bp, Mus musculus
ccatttataagctagactgatgctc

SEQ ID NO: 590400 - DNA, 25 bp, Mus musculus
ccatttatgccacggttatccagaa

SEQ ID NO: 590401 - DNA, 25 bp, Mus musculus
ccatttatgccagggttatccagaa

SEQ ID NO: 590402 - DNA, 25 bp, Mus musculus
ccatttattcccacaacatggaaca

SEQ ID NO: 590403 - DNA, 25 bp, Mus musculus
ccatttattccctcaacatggaaca

SEQ ID NO: 590404 - DNA, 25 bp, Mus musculus
ccatttcagacacagcgcagggaga

SEQ ID NO: 590405 - DNA, 25 bp, Mus musculus
ccatttcagacagagcgcagggaga

SEQ ID NO: 590406 - DNA, 25 bp, Mus musculus
ccatttcagttcagttcgggtcagt

SEQ ID NO: 590407 - DNA, 25 bp, Mus musculus
ccatttcagttctgttcgggtcagt

SEQ ID NO: 590408 - DNA, 25 bp, Mus musculus
ccatttcccattcattgaaggctga

SEQ ID NO: 590409 - DNA, 25 bp, Mus musculus
ccatttcccattgattgaaggctga

SEQ ID NO: 590410 - DNA, 25 bp, Mus musculus
ccatttcctggtagatgtatgtgaa

SEQ ID NO: 590411 - DNA, 25 bp, Mus musculus
ccatttcctggtcctagggtcagca

SEQ ID NO: 590412 - DNA, 25 bp, Mus musculus
ccatttcctggtgctagggtcagca

SEQ ID NO: 590413 - DNA, 25 bp, Mus musculus
ccatttcctggttgatgtatgtgaa

SEQ ID NO: 590414 - DNA, 25 bp, Mus musculus
ccatttcgagacagtgcagatgtat

SEQ ID NO: 590415 - DNA, 25 bp, Mus musculus
ccatttcgagactgtgcagatgtat

SEQ ID NO: 590416 - DNA, 25 bp, Mus musculus
ccatttcgggcgctgctgggaggct

SEQ ID NO: 590417 - DNA, 25 bp, Mus musculus
ccatttcgggcggtgctgggaggct

SEQ ID NO: 590418 - DNA, 25 bp, Mus musculus
ccatttcgtagactgacgttttctg

SEQ ID NO: 590419 - DNA, 25 bp, Mus musculus
ccatttcgtagagtgacgttttctg

SEQ ID NO: 590420 - DNA, 25 bp, Mus musculus
ccatttctaagactgagctggcaaa

SEQ ID NO: 590421 - DNA, 25 bp, Mus musculus
ccatttctaagagtgagctggcaaa

SEQ ID NO: 590422 - DNA, 25 bp, Mus musculus
ccatttctaagcaattggcaaaagg

SEQ ID NO: 590423 - DNA, 25 bp, Mus musculus
ccatttctaagctattggcaaaagg

SEQ ID NO: 590424 - DNA, 25 bp, Mus musculus
ccatttctaatgctggaagtgaact

SEQ ID NO: 590425 - DNA, 25 bp, Mus musculus
ccatttctaatggtggaagtgaact

SEQ ID NO: 590426 - DNA, 25 bp, Mus musculus
ccatttctacttcggtgtgccttcg

SEQ ID NO: 590427 - DNA, 25 bp, Mus musculus
ccatttctacttgggtgtgccttcg

SEQ ID NO: 590428 - DNA, 25 bp, Mus musculus
ccatttctaggaagtaccagcccca

SEQ ID NO: 590429 - DNA, 25 bp, Mus musculus
ccatttctaggatgtaccagcccca

SEQ ID NO: 590430 - DNA, 25 bp, Mus musculus
ccatttctcaagctttccggctgta

SEQ ID NO: 590431 - DNA, 25 bp, Mus musculus
ccatttctcaaggtttccggctgta

SEQ ID NO: 590432 - DNA, 25 bp, Mus musculus
ccatttctcccgaagatctttgtca

SEQ ID NO: 590433 - DNA, 25 bp, Mus musculus
ccatttctcccgtagatctttgtca

SEQ ID NO: 590434 - DNA, 25 bp, Mus musculus
ccatttctgtgactccagagggagg

SEQ ID NO: 590435 - DNA, 25 bp, Mus musculus
ccatttctgtgagtccagagggagg

SEQ ID NO: 590436 - DNA, 25 bp, Mus musculus
ccatttcttatgaggcaagcattca

SEQ ID NO: 590437 - DNA, 25 bp, Mus musculus
ccatttcttatgtggcaagcattca

SEQ ID NO: 590438 - DNA, 25 bp, Mus musculus
ccatttcttcggagacaagtggagc

SEQ ID NO: 590439 - DNA, 25 bp, Mus musculus
ccatttcttcggtgacaagtggagc

SEQ ID NO: 590440 - DNA, 25 bp, Mus musculus
ccatttgaacttaaggaagattgct

SEQ ID NO: 590441 - DNA, 25 bp, Mus musculus
ccatttgaactttaggaagattgct

SEQ ID NO: 590442 - DNA, 25 bp, Mus musculus
ccatttgagattccaaaagcgtctg

SEQ ID NO: 590443 - DNA, 25 bp, Mus musculus
ccatttgagattgcaaaagcgtctg

SEQ ID NO: 590444 - DNA, 25 bp, Mus musculus
ccatttgatggaagaaggagattta

SEQ ID NO: 590445 - DNA, 25 bp, Mus musculus
ccatttgatggatgaaggagattta

SEQ ID NO: 590446 - DNA, 25 bp, Mus musculus
ccatttgccaaactggaccgcggag

SEQ ID NO: 590447 - DNA, 25 bp, Mus musculus
ccatttgccaaagtggaccgcggag

SEQ ID NO: 590448 - DNA, 25 bp, Mus musculus
ccatttgcctttagccttggccaag

SEQ ID NO: 590449 - DNA, 25 bp, Mus musculus
ccatttgccttttgccttggccaag

SEQ ID NO: 590450 - DNA, 25 bp, Mus musculus
ccatttgcgcggctgcctatgctct

SEQ ID NO: 590451 - DNA, 25 bp, Mus musculus
ccatttgcgcgggtgcctatgctct

SEQ ID NO: 590452 - DNA, 25 bp, Mus musculus
ccatttgggaatccactgtgcaaga

SEQ ID NO: 590453 - DNA, 25 bp, Mus musculus
ccatttgggaatgcactgtgcaaga

SEQ ID NO: 590454 - DNA, 25 bp, Mus musculus
ccatttgggagactgaatctctgga

SEQ ID NO: 590455 - DNA, 25 bp, Mus musculus
ccatttgggagagtgaatctctgga

SEQ ID NO: 590456 - DNA, 25 bp, Mus musculus
ccatttgggagcagtgtggaagccc

SEQ ID NO: 590457 - DNA, 25 bp, Mus musculus
ccatttgggagctgtgtggaagccc

SEQ ID NO: 590458 - DNA, 25 bp, Mus musculus
ccatttgtaaacagttggccacaga

SEQ ID NO: 590459 - DNA, 25 bp, Mus musculus
ccatttgtaaactgttggccacaga

SEQ ID NO: 590460 - DNA, 25 bp, Mus musculus
ccatttgtatttcttggcactaaag

SEQ ID NO: 590461 - DNA, 25 bp, Mus musculus
ccatttgtatttgttggcactaaag

SEQ ID NO: 590462 - DNA, 25 bp, Mus musculus
ccatttgtgctgctcagtggatcca

SEQ ID NO: 590463 - DNA, 25 bp, Mus musculus
ccatttgtgctggtcagtggatcca

SEQ ID NO: 590464 - DNA, 25 bp, Mus musculus
ccattttacacacgccaagggcgct

SEQ ID NO: 590465 - DNA, 25 bp, Mus musculus
ccattttacacaggccaagggcgct

SEQ ID NO: 590466 - DNA, 25 bp, Mus musculus
ccattttaggtgatggatctgaggg

SEQ ID NO: 590467 - DNA, 25 bp, Mus musculus
ccattttaggtgttggatctgaggg

SEQ ID NO: 590468 - DNA, 25 bp, Mus musculus
ccattttatatgcagtctgggctga

SEQ ID NO: 590469 - DNA, 25 bp, Mus musculus
ccattttatatggagtctgggctga

SEQ ID NO: 590470 - DNA, 25 bp, Mus musculus
ccattttcaccgagctgactgccaa

SEQ ID NO: 590471 - DNA, 25 bp, Mus musculus
ccattttcaccgtgctgactgccaa

SEQ ID NO: 590472 - DNA, 25 bp, Mus musculus
ccattttctgcacgttctaacgtac

SEQ ID NO: 590473 - DNA, 25 bp, Mus musculus
ccattttctgcaggttctaacgtac

SEQ ID NO: 590474 - DNA, 25 bp, Mus musculus
ccattttctggtatcaggctgtaaa

SEQ ID NO: 590475 - DNA, 25 bp, Mus musculus
ccattttctggtttcaggctgtaaa

SEQ ID NO: 590476 - DNA, 25 bp, Mus musculus
ccattttgaccactgcttaagcttc

SEQ ID NO: 590477 - DNA, 25 bp, Mus musculus
ccattttgaccagtgcttaagcttc

SEQ ID NO: 590478 - DNA, 25 bp, Mus musculus
ccattttgcttccagggacagtaca

SEQ ID NO: 590479 - DNA, 25 bp, Mus musculus
ccattttgcttcgagggacagtaca

SEQ ID NO: 590480 - DNA, 25 bp, Mus musculus
ccattttgtgggaagacgctgcctc

SEQ ID NO: 590481 - DNA, 25 bp, Mus musculus
ccattttgtgggtagacgctgcctc

SEQ ID NO: 590482 - DNA, 25 bp, Mus musculus
ccatttttagctcccagggccgtga

SEQ ID NO: 590483 - DNA, 25 bp, Mus musculus
ccatttttagctgccagggccgtga

SEQ ID NO: 590484 - DNA, 25 bp, Mus musculus
ccatttttctagaagagagcgggag

SEQ ID NO: 590485 - DNA, 25 bp, Mus musculus
ccatttttctagtagagagcgggag

SEQ ID NO: 590486 - DNA, 25 bp, Mus musculus
cccaaaaagctcaaggtggaagcgc

SEQ ID NO: 590487 - DNA, 25 bp, Mus musculus
cccaaaaagctctaggtggaagcgc

SEQ ID NO: 590488 - DNA, 25 bp, Mus musculus
cccaaaacaaagatgccgtgaagag

SEQ ID NO: 590489 - DNA, 25 bp, Mus musculus
cccaaaacaaagttgccgtgaagag

SEQ ID NO: 590490 - DNA, 25 bp, Mus musculus
cccaaaacagaacctctggagatgg

SEQ ID NO: 590491 - DNA, 25 bp, Mus musculus
cccaaaacagaagctctggagatgg

SEQ ID NO: 590492 - DNA, 25 bp, Mus musculus
cccaaaacagatctgctaggtgttc

SEQ ID NO: 590493 - DNA, 25 bp, Mus musculus
cccaaaacagatgtgctaggtgttc

SEQ ID NO: 590494 - DNA, 25 bp, Mus musculus
cccaaaacattgaggaggacatgga

SEQ ID NO: 590495 - DNA, 25 bp, Mus musculus
cccaaaacattgtggaggacatgga

SEQ ID NO: 590496 - DNA, 25 bp, Mus musculus
cccaaaagctgtaaccatgatgccg

SEQ ID NO: 590497 - DNA, 25 bp, Mus musculus
cccaaaagctgttaccatgatgccg

SEQ ID NO: 590498 - DNA, 25 bp, Mus musculus
cccaaaagtagtctgcggcaggctc

SEQ ID NO: 590499 - DNA, 25 bp, Mus musculus
cccaaaagtagtgtgcggcaggctc

SEQ ID NO: 590500 - DNA, 25 bp, Mus musculus
cccaaaatgacacagctctaccagt

SEQ ID NO: 590501 - DNA, 25 bp, Mus musculus
cccaaaatgacagagctctaccagt

SEQ ID NO: 590502 - DNA, 25 bp, Mus musculus
cccaaaatggccacggttctgtggg

SEQ ID NO: 590503 - DNA, 25 bp, Mus musculus
cccaaaatggcctcggttctgtggg

SEQ ID NO: 590504 - DNA, 25 bp, Mus musculus
cccaaacagaggcagagtgtacagc

SEQ ID NO: 590505 - DNA, 25 bp, Mus musculus
cccaaacagagggagagtgtacagc

SEQ ID NO: 590506 - DNA, 25 bp, Mus musculus
cccaaacaggagacattcacctttg

SEQ ID NO: 590507 - DNA, 25 bp, Mus musculus
cccaaacaggagtcattcacctttg

SEQ ID NO: 590508 - DNA, 25 bp, Mus musculus
cccaaaccaagtccaaagtctatct

SEQ ID NO: 590509 - DNA, 25 bp, Mus musculus
cccaaaccaagtgcaaagtctatct

SEQ ID NO: 590510 - DNA, 25 bp, Mus musculus
cccaaaccacagatggcctggctgg

SEQ ID NO: 590511 - DNA, 25 bp, Mus musculus
cccaaaccacagttggcctggctgg

SEQ ID NO: 590512 - DNA, 25 bp, Mus musculus
cccaaaccacgaaggctgggtggca

SEQ ID NO: 590513 - DNA, 25 bp, Mus musculus
cccaaaccacgatggctgggtggca

SEQ ID NO: 590514 - DNA, 25 bp, Mus musculus
cccaaacgagcaccgcgttacagtt

SEQ ID NO: 590515 - DNA, 25 bp, Mus musculus
cccaaacgagcagcgcgttacagtt

SEQ ID NO: 590516 - DNA, 25 bp, Mus musculus
cccaaacgagtgagacttctgcgtg

SEQ ID NO: 590517 - DNA, 25 bp, Mus musculus
cccaaacgagtgtgacttctgcgtg

SEQ ID NO: 590518 - DNA, 25 bp, Mus musculus
cccaaacgatgcaatggcagcaggc

SEQ ID NO: 590519 - DNA, 25 bp, Mus musculus
cccaaacgatgctatggcagcaggc

SEQ ID NO: 590520 - DNA, 25 bp, Mus musculus
cccaaacgtggcctggaagtgaata

SEQ ID NO: 590521 - DNA, 25 bp, Mus musculus
cccaaacgtggcgtggaagtgaata

SEQ ID NO: 590522 - DNA, 25 bp, Mus musculus
cccaaactgtgaagtggtagcagta

SEQ ID NO: 590523 - DNA, 25 bp, Mus musculus
cccaaactgtgatgtggtagcagta

SEQ ID NO: 590524 - DNA, 25 bp, Mus musculus
cccaaacttcacagtaagagacaac

SEQ ID NO: 590525 - DNA, 25 bp, Mus musculus
cccaaacttcactgtaagagacaac

SEQ ID NO: 590526 - DNA, 25 bp, Mus musculus
cccaaagaagacctaaggctacagg

SEQ ID NO: 590527 - DNA, 25 bp, Mus musculus
cccaaagaagacgtaaggctacagg

SEQ ID NO: 590528 - DNA, 25 bp, Mus musculus
cccaaagaagtgcagagtgtacagg

SEQ ID NO: 590529 - DNA, 25 bp, Mus musculus
cccaaagaagtggagagtgtacagg

SEQ ID NO: 590530 - DNA, 25 bp, Mus musculus
cccaaagacagtattggcatctatg

SEQ ID NO: 590531 - DNA, 25 bp, Mus musculus
cccaaagacagttttggcatctatg

SEQ ID NO: 590532 - DNA, 25 bp, Mus musculus
cccaaagacatcaggtgactccagt

SEQ ID NO: 590533 - DNA, 25 bp, Mus musculus
cccaaagacatctggtgactccagt

SEQ ID NO: 590534 - DNA, 25 bp, Mus musculus
cccaaagacccaagaatgtagtagg

SEQ ID NO: 590535 - DNA, 25 bp, Mus musculus
cccaaagacccatgaatgtagtagg

SEQ ID NO: 590536 - DNA, 25 bp, Mus musculus
cccaaagagaagcagaaataccacg

SEQ ID NO: 590537 - DNA, 25 bp, Mus musculus
cccaaagagaaggagaaataccacg

SEQ ID NO: 590538 - DNA, 25 bp, Mus musculus
cccaaagagcctcccatgaaatcag

SEQ ID NO: 590539 - DNA, 25 bp, Mus musculus
cccaaagagcctgccatgaaatcag

SEQ ID NO: 590540 - DNA, 25 bp, Mus musculus
cccaaagaggaaaagccaccagtgt

SEQ ID NO: 590541 - DNA, 25 bp, Mus musculus
cccaaagaggaatagccaccagtgt

SEQ ID NO: 590542 - DNA, 25 bp, Mus musculus
cccaaagaggtgaacaggcagcagc

SEQ ID NO: 590543 - DNA, 25 bp, Mus musculus
cccaaagaggtgtacaggcagcagc

SEQ ID NO: 590544 - DNA, 25 bp, Mus musculus
cccaaagatgctctggctattacca

SEQ ID NO: 590545 - DNA, 25 bp, Mus musculus
cccaaagatgctgtggctattacca

SEQ ID NO: 590546 - DNA, 25 bp, Mus musculus
cccaaagattcccacttggtggaag

SEQ ID NO: 590547 - DNA, 25 bp, Mus musculus
cccaaagattccgacttggtggaag

SEQ ID NO: 590548 - DNA, 25 bp, Mus musculus
cccaaagcgcagcatcctaatcgta

SEQ ID NO: 590549 - DNA, 25 bp, Mus musculus
cccaaagcgcaggatcctaatcgta

SEQ ID NO: 590550 - DNA, 25 bp, Mus musculus
cccaaaggatcacgaagagtggcta

SEQ ID NO: 590551 - DNA, 25 bp, Mus musculus
cccaaaggatcaggaagagtggcta

SEQ ID NO: 590552 - DNA, 25 bp, Mus musculus
cccaaaggcgctcccagagagtgaa

SEQ ID NO: 590553 - DNA, 25 bp, Mus musculus
cccaaaggcgctgccagagagtgaa

SEQ ID NO: 590554 - DNA, 25 bp, Mus musculus
cccaaaggctccaggctacgaacta

SEQ ID NO: 590555 - DNA, 25 bp, Mus musculus
cccaaaggctcctggctacgaacta

SEQ ID NO: 590556 - DNA, 25 bp, Mus musculus
cccaaagtacttacgaaagaagcag

SEQ ID NO: 590557 - DNA, 25 bp, Mus musculus
cccaaagtactttcgaaagaagcag

SEQ ID NO: 590558 - DNA, 25 bp, Mus musculus
cccaaagtgttcatcaagaccagcc

SEQ ID NO: 590559 - DNA, 25 bp, Mus musculus
cccaaagtgttcttcaagaccagcc

SEQ ID NO: 590560 - DNA, 25 bp, Mus musculus
cccaaagtttgtcgatgtgtctcag

SEQ ID NO: 590561 - DNA, 25 bp, Mus musculus
cccaaagtttgtggatgtgtctcag

SEQ ID NO: 590562 - DNA, 25 bp, Mus musculus
cccaaatactgtcaacctgtagtta

SEQ ID NO: 590563 - DNA, 25 bp, Mus musculus
cccaaatactgtgaacctgtagtta

SEQ ID NO: 590564 - DNA, 25 bp, Mus musculus
cccaaatctgccatcgttggattaa

SEQ ID NO: 590565 - DNA, 25 bp, Mus musculus
cccaaatctgccttcgttggattaa

SEQ ID NO: 590566 - DNA, 25 bp, Mus musculus
cccaaatctgtgaaggtggtgcatg

SEQ ID NO: 590567 - DNA, 25 bp, Mus musculus
cccaaatctgtgtaggtggtgcatg

SEQ ID NO: 590568 - DNA, 25 bp, Mus musculus
cccaaatgtccgaaggcccagacag

SEQ ID NO: 590569 - DNA, 25 bp, Mus musculus
cccaaatgtccgtaggcccagacag

SEQ ID NO: 590570 - DNA, 25 bp, Mus musculus
cccaaatgtgttctgtctggaccac

SEQ ID NO: 590571 - DNA, 25 bp, Mus musculus
cccaaatgtgttgtgtctggaccac

SEQ ID NO: 590572 - DNA, 25 bp, Mus musculus
cccaaattcccgaggaggcgtggcg

SEQ ID NO: 590573 - DNA, 25 bp, Mus musculus
cccaaattcccgtggaggcgtggcg

SEQ ID NO: 590574 - DNA, 25 bp, Mus musculus
cccaaattgtacagagaagcgagtc

SEQ ID NO: 590575 - DNA, 25 bp, Mus musculus
cccaaattgtactgagaagcgagtc

SEQ ID NO: 590576 - DNA, 25 bp, Mus musculus
cccaaattttgacgtagcagaaagt

SEQ ID NO: 590577 - DNA, 25 bp, Mus musculus
cccaaattttgaggtagcagaaagt

SEQ ID NO: 590578 - DNA, 25 bp, Mus musculus
cccaacaacaagaagtccaaggagg

SEQ ID NO: 590579 - DNA, 25 bp, Mus musculus
cccaacaacaagtagtccaaggagg

SEQ ID NO: 590580 - DNA, 25 bp, Mus musculus
cccaacaatgtgcacgctaacaatg

SEQ ID NO: 590581 - DNA, 25 bp, Mus musculus
cccaacaatgtggacgctaacaatg

SEQ ID NO: 590582 - DNA, 25 bp, Mus musculus
cccaacacgcatattgtgtcacaga

SEQ ID NO: 590583 - DNA, 25 bp, Mus musculus
cccaacacgcattttgtgtcacaga

SEQ ID NO: 590584 - DNA, 25 bp, Mus musculus
cccaacacggataatgagttctacg

SEQ ID NO: 590585 - DNA, 25 bp, Mus musculus
cccaacacggatcggatggagctgc

SEQ ID NO: 590586 - DNA, 25 bp, Mus musculus
cccaacacggatgggatggagctgc

SEQ ID NO: 590587 - DNA, 25 bp, Mus musculus
cccaacacggattatgagttctacg

SEQ ID NO: 590588 - DNA, 25 bp, Mus musculus
cccaacagcagaccacctgagtatg

SEQ ID NO: 590589 - DNA, 25 bp, Mus musculus
cccaacagcagagcacctgagtatg

SEQ ID NO: 590590 - DNA, 25 bp, Mus musculus
cccaacagctggcagaaattgtgac

SEQ ID NO: 590591 - DNA, 25 bp, Mus musculus
cccaacagctgggagaaattgtgac

SEQ ID NO: 590592 - DNA, 25 bp, Mus musculus
cccaacagtactctgatcatcagca

SEQ ID NO: 590593 - DNA, 25 bp, Mus musculus
cccaacagtactgtgatcatcagca

SEQ ID NO: 590594 - DNA, 25 bp, Mus musculus
cccaacagtagtaattggctcaggt

SEQ ID NO: 590595 - DNA, 25 bp, Mus musculus
cccaacagtagttattggctcaggt

SEQ ID NO: 590596 - DNA, 25 bp, Mus musculus
cccaacagtggaacgggcagggcat

SEQ ID NO: 590597 - DNA, 25 bp, Mus musculus
cccaacagtggatcgggcagggcat

SEQ ID NO: 590598 - DNA, 25 bp, Mus musculus
cccaacatatgacctggcattacaa

SEQ ID NO: 590599 - DNA, 25 bp, Mus musculus
cccaacatatgagctggcattacaa

SEQ ID NO: 590600 - DNA, 25 bp, Mus musculus
cccaacccagagctggtggtcgcag

SEQ ID NO: 590601 - DNA, 25 bp, Mus musculus
cccaacccagaggtggtggtcgcag

SEQ ID NO: 590602 - DNA, 25 bp, Mus musculus
cccaaccgaattagtcacggagaag

SEQ ID NO: 590603 - DNA, 25 bp, Mus musculus
cccaaccgaatttgtcacggagaag

SEQ ID NO: 590604 - DNA, 25 bp, Mus musculus
cccaacctgtgcctttgtggaggtg

SEQ ID NO: 590605 - DNA, 25 bp, Mus musculus
cccaacctgtgcgtttgtggaggtg

SEQ ID NO: 590606 - DNA, 25 bp, Mus musculus
cccaacgaggaactggcgaggttct

SEQ ID NO: 590607 - DNA, 25 bp, Mus musculus
cccaacgaggaagtggcgaggttct

SEQ ID NO: 590608 - DNA, 25 bp, Mus musculus
cccaacgcctggaaagctaacagaa

SEQ ID NO: 590609 - DNA, 25 bp, Mus musculus
cccaacgcctggtaagctaacagaa

SEQ ID NO: 590610 - DNA, 25 bp, Mus musculus
cccaacggtgagctttctgtgacac

SEQ ID NO: 590611 - DNA, 25 bp, Mus musculus
cccaacggtgaggtttctgtgacac

SEQ ID NO: 590612 - DNA, 25 bp, Mus musculus
cccaacgttgagaggctggagagaa

SEQ ID NO: 590613 - DNA, 25 bp, Mus musculus
cccaacgttgagtggctggagagaa

SEQ ID NO: 590614 - DNA, 25 bp, Mus musculus
cccaactcgttgaaacatccagcaa

SEQ ID NO: 590615 - DNA, 25 bp, Mus musculus
cccaactcgttgtaacatccagcaa

SEQ ID NO: 590616 - DNA, 25 bp, Mus musculus
cccaactggcagagatgatgtatct

SEQ ID NO: 590617 - DNA, 25 bp, Mus musculus
cccaactggcagtgatgatgtatct

SEQ ID NO: 590618 - DNA, 25 bp, Mus musculus
cccaactggtcaacatagagactga

SEQ ID NO: 590619 - DNA, 25 bp, Mus musculus
cccaactggtcatcatagagactga

SEQ ID NO: 590620 - DNA, 25 bp, Mus musculus
cccaactgtttgattatcgttcact

SEQ ID NO: 590621 - DNA, 25 bp, Mus musculus
cccaactgtttgtttatcgttcact

SEQ ID NO: 590622 - DNA, 25 bp, Mus musculus
cccaacttcattagtgtatggatct

SEQ ID NO: 590623 - DNA, 25 bp, Mus musculus
cccaacttcatttgtgtatggatct

SEQ ID NO: 590624 - DNA, 25 bp, Mus musculus
cccaacttccttctaggagtggaat

SEQ ID NO: 590625 - DNA, 25 bp, Mus musculus
cccaacttccttgtaggagtggaat

SEQ ID NO: 590626 - DNA, 25 bp, Mus musculus
cccaagaaaccacacatactatgat

SEQ ID NO: 590627 - DNA, 25 bp, Mus musculus
cccaagaaaccagacatactatgat

SEQ ID NO: 590628 - DNA, 25 bp, Mus musculus
cccaagaaagaacctcttggtgccc

SEQ ID NO: 590629 - DNA, 25 bp, Mus musculus
cccaagaaagaagctcttggtgccc

SEQ ID NO: 590630 - DNA, 25 bp, Mus musculus
cccaagaagcccaaaaaagtagcat

SEQ ID NO: 590631 - DNA, 25 bp, Mus musculus
cccaagaagccctaaaaagtagcat

SEQ ID NO: 590632 - DNA, 25 bp, Mus musculus
cccaagaaggtacggcagagcagct

SEQ ID NO: 590633 - DNA, 25 bp, Mus musculus
cccaagaaggtagggcagagcagct

SEQ ID NO: 590634 - DNA, 25 bp, Mus musculus
cccaagacagttcggtgaagttgct

SEQ ID NO: 590635 - DNA, 25 bp, Mus musculus
cccaagacagttgggtgaagttgct

SEQ ID NO: 590636 - DNA, 25 bp, Mus musculus
cccaagagaaaactgacgtgctgct

SEQ ID NO: 590637 - DNA, 25 bp, Mus musculus
cccaagagaaaagtgacgtgctgct

SEQ ID NO: 590638 - DNA, 25 bp, Mus musculus
cccaagagatgaagggtctcctcac

SEQ ID NO: 590639 - DNA, 25 bp, Mus musculus
cccaagagatgacacttacaagccc

SEQ ID NO: 590640 - DNA, 25 bp, Mus musculus
cccaagagatgagacttacaagccc

SEQ ID NO: 590641 - DNA, 25 bp, Mus musculus
cccaagagatgatgggtctcctcac

SEQ ID NO: 590642 - DNA, 25 bp, Mus musculus
cccaagagatggaagtcggacttca

SEQ ID NO: 590643 - DNA, 25 bp, Mus musculus
cccaagagatggtagtcggacttca

SEQ ID NO: 590644 - DNA, 25 bp, Mus musculus
cccaagagctcacactggatgctct

SEQ ID NO: 590645 - DNA, 25 bp, Mus musculus
cccaagagctcagactggatgctct

SEQ ID NO: 590646 - DNA, 25 bp, Mus musculus
cccaagaggaacaacgaagtctgtt

SEQ ID NO: 590647 - DNA, 25 bp, Mus musculus
cccaagaggaactacgaagtctgtt

SEQ ID NO: 590648 - DNA, 25 bp, Mus musculus
cccaagaggattcctcaggctgtgg

SEQ ID NO: 590649 - DNA, 25 bp, Mus musculus
cccaagaggattgctcaggctgtgg

SEQ ID NO: 590650 - DNA, 25 bp, Mus musculus
cccaagaggcatactagagcagcga

SEQ ID NO: 590651 - DNA, 25 bp, Mus musculus
cccaagaggcattctagagcagcga

SEQ ID NO: 590652 - DNA, 25 bp, Mus musculus
cccaagaggcctccgtgagtatgag

SEQ ID NO: 590653 - DNA, 25 bp, Mus musculus
cccaagaggcctgcgtgagtatgag

SEQ ID NO: 590654 - DNA, 25 bp, Mus musculus
cccaagagggtcattggactccctg

SEQ ID NO: 590655 - DNA, 25 bp, Mus musculus
cccaagagggtctttggactccctg

SEQ ID NO: 590656 - DNA, 25 bp, Mus musculus
cccaagagtcctatgaggcagatga

SEQ ID NO: 590657 - DNA, 25 bp, Mus musculus
cccaagagtcctttgaggcagatga

SEQ ID NO: 590658 - DNA, 25 bp, Mus musculus
cccaagataacgagcagtgccggaa

SEQ ID NO: 590659 - DNA, 25 bp, Mus musculus
cccaagataacgtgcagtgccggaa

SEQ ID NO: 590660 - DNA, 25 bp, Mus musculus
cccaagatcatgaaggtcacggtga

SEQ ID NO: 590661 - DNA, 25 bp, Mus musculus
cccaagatcatgtaggtcacggtga

SEQ ID NO: 590662 - DNA, 25 bp, Mus musculus
cccaagatccttatgttggacgagg

SEQ ID NO: 590663 - DNA, 25 bp, Mus musculus
cccaagatccttttgttggacgagg

SEQ ID NO: 590664 - DNA, 25 bp, Mus musculus
cccaagatgatcagaaagatgaatt

SEQ ID NO: 590665 - DNA, 25 bp, Mus musculus
cccaagatgatctgaaagatgaatt

SEQ ID NO: 590666 - DNA, 25 bp, Mus musculus
cccaagatggatcaactgcagttgt

SEQ ID NO: 590667 - DNA, 25 bp, Mus musculus
cccaagatggatgaactgcagttgt

SEQ ID NO: 590668 - DNA, 25 bp, Mus musculus
cccaagatttagaggacacagctgc

SEQ ID NO: 590669 - DNA, 25 bp, Mus musculus
cccaagatttagtggacacagctgc

SEQ ID NO: 590670 - DNA, 25 bp, Mus musculus
cccaagcaactgctgccatggcggg

SEQ ID NO: 590671 - DNA, 25 bp, Mus musculus
cccaagcaactggtgccatggcggg

SEQ ID NO: 590672 - DNA, 25 bp, Mus musculus
cccaagcaccgtatgcaatgatgag

SEQ ID NO: 590673 - DNA, 25 bp, Mus musculus
cccaagcaccgtttgcaatgatgag

SEQ ID NO: 590674 - DNA, 25 bp, Mus musculus
cccaagcagacactggtgatatgca

SEQ ID NO: 590675 - DNA, 25 bp, Mus musculus
cccaagcagacagtggtgatatgca

SEQ ID NO: 590676 - DNA, 25 bp, Mus musculus
cccaagcagaggaactggctttgca

SEQ ID NO: 590677 - DNA, 25 bp, Mus musculus
cccaagcagaggtactggctttgca

SEQ ID NO: 590678 - DNA, 25 bp, Mus musculus
cccaagcatattctggagtggcatg

SEQ ID NO: 590679 - DNA, 25 bp, Mus musculus
cccaagcatattgtggagtggcatg

SEQ ID NO: 590680 - DNA, 25 bp, Mus musculus
cccaagccaaggactctacgctttt

SEQ ID NO: 590681 - DNA, 25 bp, Mus musculus
cccaagccaaggtctctacgctttt

SEQ ID NO: 590682 - DNA, 25 bp, Mus musculus
cccaagccagtgattgctgccattc

SEQ ID NO: 590683 - DNA, 25 bp, Mus musculus
cccaagccagtgtttgctgccattc

SEQ ID NO: 590684 - DNA, 25 bp, Mus musculus
cccaagcctagaaaagtggagctgt

SEQ ID NO: 590685 - DNA, 25 bp, Mus musculus
cccaagcctagataagtggagctgt

SEQ ID NO: 590686 - DNA, 25 bp, Mus musculus
cccaagcgatggagttgcaacagag

SEQ ID NO: 590687 - DNA, 25 bp, Mus musculus
cccaagcgatggtgttgcaacagag

SEQ ID NO: 590688 - DNA, 25 bp, Mus musculus
cccaagcgcaagatgaggagacgtt

SEQ ID NO: 590689 - DNA, 25 bp, Mus musculus
cccaagcgcaagttgaggagacgtt

SEQ ID NO: 590690 - DNA, 25 bp, Mus musculus
cccaagcgcctactactagtcggtg

SEQ ID NO: 590691 - DNA, 25 bp, Mus musculus
cccaagcgcctagtactagtcggtg

SEQ ID NO: 590692 - DNA, 25 bp, Mus musculus
cccaagctgcggatgtgcatgagaa

SEQ ID NO: 590693 - DNA, 25 bp, Mus musculus
cccaagctgcggttgtgcatgagaa

SEQ ID NO: 590694 - DNA, 25 bp, Mus musculus
cccaagcttcgtctctgacaagaga

SEQ ID NO: 590695 - DNA, 25 bp, Mus musculus
cccaagcttcgtgtctgacaagaga

SEQ ID NO: 590696 - DNA, 25 bp, Mus musculus
cccaagcttggtccctggcgcagga

SEQ ID NO: 590697 - DNA, 25 bp, Mus musculus
cccaagcttggtgcctggcgcagga

SEQ ID NO: 590698 - DNA, 25 bp, Mus musculus
cccaaggaccatcacacagaaggat

SEQ ID NO: 590699 - DNA, 25 bp, Mus musculus
cccaaggaccatgacacagaaggat

SEQ ID NO: 590700 - DNA, 25 bp, Mus musculus
cccaaggagatgaccaagtggaatt

SEQ ID NO: 590701 - DNA, 25 bp, Mus musculus
cccaaggagatgtccaagtggaatt

SEQ ID NO: 590702 - DNA, 25 bp, Mus musculus
cccaaggatttcaggagaagacaga

SEQ ID NO: 590703 - DNA, 25 bp, Mus musculus
cccaaggatttctggagaagacaga

SEQ ID NO: 590704 - DNA, 25 bp, Mus musculus
cccaaggcacttagtggactcacac

SEQ ID NO: 590705 - DNA, 25 bp, Mus musculus
cccaaggcactttgtggactcacac

SEQ ID NO: 590706 - DNA, 25 bp, Mus musculus
cccaaggcccagaaatatgacgact

SEQ ID NO: 590707 - DNA, 25 bp, Mus musculus
cccaaggcccagtaatatgacgact

SEQ ID NO: 590708 - DNA, 25 bp, Mus musculus
cccaaggctgctaggtgccagggct

SEQ ID NO: 590709 - DNA, 25 bp, Mus musculus
cccaaggctgcttggtgccagggct

SEQ ID NO: 590710 - DNA, 25 bp, Mus musculus
cccaagggccatagtggagtatcgg

SEQ ID NO: 590711 - DNA, 25 bp, Mus musculus
cccaagggccattgtggagtatcgg

SEQ ID NO: 590712 - DNA, 25 bp, Mus musculus
cccaagggcctccaatggctgtgga

SEQ ID NO: 590713 - DNA, 25 bp, Mus musculus
cccaagggcctcgaatggctgtgga

SEQ ID NO: 590714 - DNA, 25 bp, Mus musculus
cccaagggcgatcatttcctctaca

SEQ ID NO: 590715 - DNA, 25 bp, Mus musculus
cccaagggcgatgatttcctctaca

SEQ ID NO: 590716 - DNA, 25 bp, Mus musculus
cccaaggtgatcattattcaggcat

SEQ ID NO: 590717 - DNA, 25 bp, Mus musculus
cccaaggtgatctttattcaggcat

SEQ ID NO: 590718 - DNA, 25 bp, Mus musculus
cccaagtaccgacacaagaagaaga

SEQ ID NO: 590719 - DNA, 25 bp, Mus musculus
cccaagtaccgagacaagaagaaga

SEQ ID NO: 590720 - DNA, 25 bp, Mus musculus
cccaagtactaacggcttcgagcca

SEQ ID NO: 590721 - DNA, 25 bp, Mus musculus
cccaagtactaagggcttcgagcca

SEQ ID NO: 590722 - DNA, 25 bp, Mus musculus
cccaagtagcagagactactcagcc

SEQ ID NO: 590723 - DNA, 25 bp, Mus musculus
cccaagtagcagtgactactcagcc

SEQ ID NO: 590724 - DNA, 25 bp, Mus musculus
cccaagtcattcaagaggaaaatct

SEQ ID NO: 590725 - DNA, 25 bp, Mus musculus
cccaagtcattctagaggaaaatct

SEQ ID NO: 590726 - DNA, 25 bp, Mus musculus
cccaagtcggataagagagaatatc

SEQ ID NO: 590727 - DNA, 25 bp, Mus musculus
cccaagtcggattagagagaatatc

SEQ ID NO: 590728 - DNA, 25 bp, Mus musculus
cccaagtctccgaggtaggtgacaa

SEQ ID NO: 590729 - DNA, 25 bp, Mus musculus
cccaagtctccgtggtaggtgacaa

SEQ ID NO: 590730 - DNA, 25 bp, Mus musculus
cccaagtgaagactcccatgtgaca

SEQ ID NO: 590731 - DNA, 25 bp, Mus musculus
cccaagtgaagagtcccatgtgaca

SEQ ID NO: 590732 - DNA, 25 bp, Mus musculus
cccaagtgaggcagaataaggacac

SEQ ID NO: 590733 - DNA, 25 bp, Mus musculus
cccaagtgaggctgaataaggacac

SEQ ID NO: 590734 - DNA, 25 bp, Mus musculus
cccaagtgccgcaggttctcttaca

SEQ ID NO: 590735 - DNA, 25 bp, Mus musculus
cccaagtgccgctggttctcttaca

SEQ ID NO: 590736 - DNA, 25 bp, Mus musculus
cccaagtggaatactaactgccagt

SEQ ID NO: 590737 - DNA, 25 bp, Mus musculus
cccaagtggaattctaactgccagt

SEQ ID NO: 590738 - DNA, 25 bp, Mus musculus
cccaagtgggtgctgaataagtcat

SEQ ID NO: 590739 - DNA, 25 bp, Mus musculus
cccaagtgggtggtgaataagtcat

SEQ ID NO: 590740 - DNA, 25 bp, Mus musculus
cccaagtggtaacattggtcccaag

SEQ ID NO: 590741 - DNA, 25 bp, Mus musculus
cccaagtggtaagattggtcccaag

SEQ ID NO: 590742 - DNA, 25 bp, Mus musculus
cccaagttcttcagggcagctgtga

SEQ ID NO: 590743 - DNA, 25 bp, Mus musculus
cccaagttcttctgggcagctgtga

SEQ ID NO: 590744 - DNA, 25 bp, Mus musculus
cccaagtttggcctgattggtgttc

SEQ ID NO: 590745 - DNA, 25 bp, Mus musculus
cccaagtttggcgtgattggtgttc

SEQ ID NO: 590746 - DNA, 25 bp, Mus musculus
cccaatagaaaacacagaggacggt

SEQ ID NO: 590747 - DNA, 25 bp, Mus musculus
cccaatagaaaagacagaggacggt

SEQ ID NO: 590748 - DNA, 25 bp, Mus musculus
cccaatagaatcctgccagaatttc

SEQ ID NO: 590749 - DNA, 25 bp, Mus musculus
cccaatagaatcgtgccagaatttc

SEQ ID NO: 590750 - DNA, 25 bp, Mus musculus
cccaatagaggaatatgacctttaa

SEQ ID NO: 590751 - DNA, 25 bp, Mus musculus
cccaatagaggattatgacctttaa

SEQ ID NO: 590752 - DNA, 25 bp, Mus musculus
cccaataggattctacaaaaaggca

SEQ ID NO: 590753 - DNA, 25 bp, Mus musculus
cccaataggattgtacaaaaaggca

SEQ ID NO: 590754 - DNA, 25 bp, Mus musculus
cccaataggtgtattactggtgatc

SEQ ID NO: 590755 - DNA, 25 bp, Mus musculus
cccaataggtgttttactggtgatc

SEQ ID NO: 590756 - DNA, 25 bp, Mus musculus
cccaatatgggcagtggcaccctga

SEQ ID NO: 590757 - DNA, 25 bp, Mus musculus
cccaatatgggctgtggcaccctga

SEQ ID NO: 590758 - DNA, 25 bp, Mus musculus
cccaatattccgcagaggagagaaa

SEQ ID NO: 590759 - DNA, 25 bp, Mus musculus
cccaatattccggagaggagagaaa

SEQ ID NO: 590760 - DNA, 25 bp, Mus musculus
cccaatcatggaagcatttggcaat

SEQ ID NO: 590761 - DNA, 25 bp, Mus musculus
cccaatcatggatgcatttggcaat

SEQ ID NO: 590762 - DNA, 25 bp, Mus musculus
cccaatcctgggaatgggacccagg

SEQ ID NO: 590763 - DNA, 25 bp, Mus musculus
cccaatcctgggtatgggacccagg

SEQ ID NO: 590764 - DNA, 25 bp, Mus musculus
cccaatcgctgtcagagctgctacg

SEQ ID NO: 590765 - DNA, 25 bp, Mus musculus
cccaatcgctgtgagagctgctacg

SEQ ID NO: 590766 - DNA, 25 bp, Mus musculus
cccaatcttctgagacgctttttac

SEQ ID NO: 590767 - DNA, 25 bp, Mus musculus
cccaatcttctgtgacgctttttac

SEQ ID NO: 590768 - DNA, 25 bp, Mus musculus
cccaatgagcctctttctgattaca

SEQ ID NO: 590769 - DNA, 25 bp, Mus musculus
cccaatgagcctgtttctgattaca

SEQ ID NO: 590770 - DNA, 25 bp, Mus musculus
cccaatgcgtcgcatgcgagaatct

SEQ ID NO: 590771 - DNA, 25 bp, Mus musculus
cccaatgcgtcggatgcgagaatct

SEQ ID NO: 590772 - DNA, 25 bp, Mus musculus
cccaatggacatagcagtgcaggag

SEQ ID NO: 590773 - DNA, 25 bp, Mus musculus
cccaatggacattgcagtgcaggag

SEQ ID NO: 590774 - DNA, 25 bp, Mus musculus
cccaatggagacaggacataccaga

SEQ ID NO: 590775 - DNA, 25 bp, Mus musculus
cccaatggagactggacataccaga

SEQ ID NO: 590776 - DNA, 25 bp, Mus musculus
cccaatggaggaagcttgaaccaga

SEQ ID NO: 590777 - DNA, 25 bp, Mus musculus
cccaatggaggatgcttgaaccaga

SEQ ID NO: 590778 - DNA, 25 bp, Mus musculus
cccaatggatctcgcagtggccctg

SEQ ID NO: 590779 - DNA, 25 bp, Mus musculus
cccaatggatctggcagtggccctg

SEQ ID NO: 590780 - DNA, 25 bp, Mus musculus
cccaatggtgagattgtggagtatc

SEQ ID NO: 590781 - DNA, 25 bp, Mus musculus
cccaatggtgagtttgtggagtatc

SEQ ID NO: 590782 - DNA, 25 bp, Mus musculus
cccaatgtaaatctggagccgagac

SEQ ID NO: 590783 - DNA, 25 bp, Mus musculus
cccaatgtaaatgtggagccgagac

SEQ ID NO: 590784 - DNA, 25 bp, Mus musculus
cccaatgtggagacggagcctccgg

SEQ ID NO: 590785 - DNA, 25 bp, Mus musculus
cccaatgtggagtcggagcctccgg

SEQ ID NO: 590786 - DNA, 25 bp, Mus musculus
cccaatgtttggagacaaagtttat

SEQ ID NO: 590787 - DNA, 25 bp, Mus musculus
cccaatgtttggtgacaaagtttat

SEQ ID NO: 590788 - DNA, 25 bp, Mus musculus
cccaattatggcagagaacgatgtg

SEQ ID NO: 590789 - DNA, 25 bp, Mus musculus
cccaattatggctgagaacgatgtg

SEQ ID NO: 590790 - DNA, 25 bp, Mus musculus
cccaattgaggtacccaccgctgtg

SEQ ID NO: 590791 - DNA, 25 bp, Mus musculus
cccaattgaggttcccaccgctgtg

SEQ ID NO: 590792 - DNA, 25 bp, Mus musculus
cccaattgtctaagagaagtataag

SEQ ID NO: 590793 - DNA, 25 bp, Mus musculus
cccaattgtctatgagaagtataag

SEQ ID NO: 590794 - DNA, 25 bp, Mus musculus
cccacaaagcgaacactctggtgta

SEQ ID NO: 590795 - DNA, 25 bp, Mus musculus
cccacaaagcgatcactctggtgta

SEQ ID NO: 590796 - DNA, 25 bp, Mus musculus
cccacaacagctcatctcgatttga

SEQ ID NO: 590797 - DNA, 25 bp, Mus musculus
cccacaacagctgatctcgatttga

SEQ ID NO: 590798 - DNA, 25 bp, Mus musculus
cccacaactggcaagcacaagggct

SEQ ID NO: 590799 - DNA, 25 bp, Mus musculus
cccacaactggctagcacaagggct

SEQ ID NO: 590800 - DNA, 25 bp, Mus musculus
cccacaagcagacgaagcgttagcg

SEQ ID NO: 590801 - DNA, 25 bp, Mus musculus
cccacaagcagaggaagcgttagcg

SEQ ID NO: 590802 - DNA, 25 bp, Mus musculus
cccacaagcgggaatggaatctttt

SEQ ID NO: 590803 - DNA, 25 bp, Mus musculus
cccacaagcgggtatggaatctttt

SEQ ID NO: 590804 - DNA, 25 bp, Mus musculus
cccacaaggcgtactgaaggagatt

SEQ ID NO: 590805 - DNA, 25 bp, Mus musculus
cccacaaggcgttctgaaggagatt

SEQ ID NO: 590806 - DNA, 25 bp, Mus musculus
cccacaagggaaagaggacatgtcc

SEQ ID NO: 590807 - DNA, 25 bp, Mus musculus
cccacaagggaatgaggacatgtcc

SEQ ID NO: 590808 - DNA, 25 bp, Mus musculus
cccacaatgatgaagtcattgccag

SEQ ID NO: 590809 - DNA, 25 bp, Mus musculus
cccacaatgatgtagtcattgccag

SEQ ID NO: 590810 - DNA, 25 bp, Mus musculus
cccacaatgggaagtttgaggcgaa

SEQ ID NO: 590811 - DNA, 25 bp, Mus musculus
cccacaatgggacgaggctgaatat

SEQ ID NO: 590812 - DNA, 25 bp, Mus musculus
cccacaatgggaggaggctgaatat

SEQ ID NO: 590813 - DNA, 25 bp, Mus musculus
cccacaatgggatgtttgaggcgaa

SEQ ID NO: 590814 - DNA, 25 bp, Mus musculus
cccacacccacgagagattttcaag

SEQ ID NO: 590815 - DNA, 25 bp, Mus musculus
cccacacccacgtgagattttcaag

SEQ ID NO: 590816 - DNA, 25 bp, Mus musculus
cccacacctaggaagttcgtgattt

SEQ ID NO: 590817 - DNA, 25 bp, Mus musculus
cccacacctaggtagttcgtgattt

SEQ ID NO: 590818 - DNA, 25 bp, Mus musculus
cccacacggaagagtttccttatat

SEQ ID NO: 590819 - DNA, 25 bp, Mus musculus
cccacacggaagtgtttccttatat

SEQ ID NO: 590820 - DNA, 25 bp, Mus musculus
cccacacggtggaattattgccaca

SEQ ID NO: 590821 - DNA, 25 bp, Mus musculus
cccacacggtggtattattgccaca

SEQ ID NO: 590822 - DNA, 25 bp, Mus musculus
cccacacgtggcattgtatgctctg

SEQ ID NO: 590823 - DNA, 25 bp, Mus musculus
cccacacgtggctttgtatgctctg

SEQ ID NO: 590824 - DNA, 25 bp, Mus musculus
cccacactgagcagtgagagagaca

SEQ ID NO: 590825 - DNA, 25 bp, Mus musculus
cccacactgagctgtgagagagaca

SEQ ID NO: 590826 - DNA, 25 bp, Mus musculus
cccacactgtgccgccaaggagtag

SEQ ID NO: 590827 - DNA, 25 bp, Mus musculus
cccacactgtgcggccaaggagtag

SEQ ID NO: 590828 - DNA, 25 bp, Mus musculus
cccacagaaacaactgcaatgacgg

SEQ ID NO: 590829 - DNA, 25 bp, Mus musculus
cccacagaaacatctgcaatgacgg

SEQ ID NO: 590830 - DNA, 25 bp, Mus musculus
cccacagaagctcggccctgatgga

SEQ ID NO: 590831 - DNA, 25 bp, Mus musculus
cccacagaagctgggccctgatgga

SEQ ID NO: 590832 - DNA, 25 bp, Mus musculus
cccacagactttcatttcctcaaag

SEQ ID NO: 590833 - DNA, 25 bp, Mus musculus
cccacagactttgatttcctcaaag

SEQ ID NO: 590834 - DNA, 25 bp, Mus musculus
cccacagaggctcatggtgctggct

SEQ ID NO: 590835 - DNA, 25 bp, Mus musculus
cccacagaggctgatggtgctggct

SEQ ID NO: 590836 - DNA, 25 bp, Mus musculus
cccacagagtctcaagcaagagcat

SEQ ID NO: 590837 - DNA, 25 bp, Mus musculus
cccacagagtctgaagcaagagcat

SEQ ID NO: 590838 - DNA, 25 bp, Mus musculus
cccacagctaagctggtgctggatc

SEQ ID NO: 590839 - DNA, 25 bp, Mus musculus
cccacagctaaggtggtgctggatc

SEQ ID NO: 590840 - DNA, 25 bp, Mus musculus
cccacagctcttccctggatgatgt

SEQ ID NO: 590841 - DNA, 25 bp, Mus musculus
cccacagctcttgcctggatgatgt

SEQ ID NO: 590842 - DNA, 25 bp, Mus musculus
cccacaggagaacagactccaagca

SEQ ID NO: 590843 - DNA, 25 bp, Mus musculus
cccacaggagaagagactccaagca

SEQ ID NO: 590844 - DNA, 25 bp, Mus musculus
cccacaggaggtcgttcaagtcctc

SEQ ID NO: 590845 - DNA, 25 bp, Mus musculus
cccacaggaggtggttcaagtcctc

SEQ ID NO: 590846 - DNA, 25 bp, Mus musculus
cccacaggccttaatttcattaaga

SEQ ID NO: 590847 - DNA, 25 bp, Mus musculus
cccacaggcctttatttcattaaga

SEQ ID NO: 590848 - DNA, 25 bp, Mus musculus
cccacagggaagagagctgagtgct

SEQ ID NO: 590849 - DNA, 25 bp, Mus musculus
cccacagggaagtgagctgagtgct

SEQ ID NO: 590850 - DNA, 25 bp, Mus musculus
cccacagtacttagagttcgagttt

SEQ ID NO: 590851 - DNA, 25 bp, Mus musculus
cccacagtactttgagttcgagttt

SEQ ID NO: 590852 - DNA, 25 bp, Mus musculus
cccacagtgagaatccagtagctat

SEQ ID NO: 590853 - DNA, 25 bp, Mus musculus
cccacagtgagattccagtagctat

SEQ ID NO: 590854 - DNA, 25 bp, Mus musculus
cccacagtggggagcacagtcttga

SEQ ID NO: 590855 - DNA, 25 bp, Mus musculus
cccacagtggggtgcacagtcttga

SEQ ID NO: 590856 - DNA, 25 bp, Mus musculus
cccacagtgtacatgaaggtggacg

SEQ ID NO: 590857 - DNA, 25 bp, Mus musculus
cccacagtgtacttgaaggtggacg

SEQ ID NO: 590858 - DNA, 25 bp, Mus musculus
cccacagtgtggaaaagggaatgta

SEQ ID NO: 590859 - DNA, 25 bp, Mus musculus
cccacagtgtggtaaagggaatgta

SEQ ID NO: 590860 - DNA, 25 bp, Mus musculus
cccacagttgccagaatcagagcta

SEQ ID NO: 590861 - DNA, 25 bp, Mus musculus
cccacagttgcctgaatcagagcta

SEQ ID NO: 590862 - DNA, 25 bp, Mus musculus
cccacatacagtcgctgaaacacgt

SEQ ID NO: 590863 - DNA, 25 bp, Mus musculus
cccacatacagtggctgaaacacgt

SEQ ID NO: 590864 - DNA, 25 bp, Mus musculus
cccacatcatcgaggtcatcttggg

SEQ ID NO: 590865 - DNA, 25 bp, Mus musculus
cccacatcatcgtggtcatcttggg

SEQ ID NO: 590866 - DNA, 25 bp, Mus musculus
cccacatgataacaaagcggatcct

SEQ ID NO: 590867 - DNA, 25 bp, Mus musculus
cccacatgataagaaagcggatcct

SEQ ID NO: 590868 - DNA, 25 bp, Mus musculus
cccacatgctggcttctggaatgca

SEQ ID NO: 590869 - DNA, 25 bp, Mus musculus
cccacatgctgggttctggaatgca

SEQ ID NO: 590870 - DNA, 25 bp, Mus musculus
cccacattcaagcagttggtcgaag

SEQ ID NO: 590871 - DNA, 25 bp, Mus musculus
cccacattcaaggagttggtcgaag

SEQ ID NO: 590872 - DNA, 25 bp, Mus musculus
cccacattctctctttgttagcctg

SEQ ID NO: 590873 - DNA, 25 bp, Mus musculus
cccacattctctgtttgttagcctg

SEQ ID NO: 590874 - DNA, 25 bp, Mus musculus
cccacattctgtagttcgtcatgcg

SEQ ID NO: 590875 - DNA, 25 bp, Mus musculus
cccacattctgttgttcgtcatgcg

SEQ ID NO: 590876 - DNA, 25 bp, Mus musculus
cccacattgatgacattcattatcg

SEQ ID NO: 590877 - DNA, 25 bp, Mus musculus
cccacattgatgtcattcattatcg

SEQ ID NO: 590878 - DNA, 25 bp, Mus musculus
cccacattgggcatcgggactggta

SEQ ID NO: 590879 - DNA, 25 bp, Mus musculus
cccacattgggcttcgggactggta

SEQ ID NO: 590880 - DNA, 25 bp, Mus musculus
cccaccaaagaaccggataacgtca

SEQ ID NO: 590881 - DNA, 25 bp, Mus musculus
cccaccaaagaagcggataacgtca

SEQ ID NO: 590882 - DNA, 25 bp, Mus musculus
cccaccaagaccctaagatacagtt

SEQ ID NO: 590883 - DNA, 25 bp, Mus musculus
cccaccaagaccgtaagatacagtt

SEQ ID NO: 590884 - DNA, 25 bp, Mus musculus
cccaccaagtgtctttctgcaacag

SEQ ID NO: 590885 - DNA, 25 bp, Mus musculus
cccaccaagtgtgtttctgcaacag

SEQ ID NO: 590886 - DNA, 25 bp, Mus musculus
cccaccacgaggagcgcacgtggta

SEQ ID NO: 590887 - DNA, 25 bp, Mus musculus
cccaccacgaggtgcgcacgtggta

SEQ ID NO: 590888 - DNA, 25 bp, Mus musculus
cccaccagaaatatccatgacatgg

SEQ ID NO: 590889 - DNA, 25 bp, Mus musculus
cccaccagaaatttccatgacatgg

SEQ ID NO: 590890 - DNA, 25 bp, Mus musculus
cccaccaggaggatgacggagagaa

SEQ ID NO: 590891 - DNA, 25 bp, Mus musculus
cccaccaggaggttgacggagagaa

SEQ ID NO: 590892 - DNA, 25 bp, Mus musculus
cccaccaggataaaagggtctcaga

SEQ ID NO: 590893 - DNA, 25 bp, Mus musculus
cccaccaggatataagggtctcaga

SEQ ID NO: 590894 - DNA, 25 bp, Mus musculus
cccaccatctcgagtatcctgagag

SEQ ID NO: 590895 - DNA, 25 bp, Mus musculus
cccaccatctcgtgtatcctgagag

SEQ ID NO: 590896 - DNA, 25 bp, Mus musculus
cccaccatgatgcaagacgacggac

SEQ ID NO: 590897 - DNA, 25 bp, Mus musculus
cccaccatgatggaagacgacggac

SEQ ID NO: 590898 - DNA, 25 bp, Mus musculus
cccaccatgtatcctgagtggaaga

SEQ ID NO: 590899 - DNA, 25 bp, Mus musculus
cccaccatgtatgctgagtggaaga

SEQ ID NO: 590900 - DNA, 25 bp, Mus musculus
cccaccatgttccttgccatgatga

SEQ ID NO: 590901 - DNA, 25 bp, Mus musculus
cccaccatgttcgttgccatgatga

SEQ ID NO: 590902 - DNA, 25 bp, Mus musculus
cccacccagcttatgatgataagga

SEQ ID NO: 590903 - DNA, 25 bp, Mus musculus
cccacccagcttttgatgataagga

SEQ ID NO: 590904 - DNA, 25 bp, Mus musculus
cccaccctgtttcagagtctgtctg

SEQ ID NO: 590905 - DNA, 25 bp, Mus musculus
cccaccctgtttgagagtctgtctg

SEQ ID NO: 590906 - DNA, 25 bp, Mus musculus
cccacccttgaacttaacatgtagg

SEQ ID NO: 590907 - DNA, 25 bp, Mus musculus
cccacccttgaagttaacatgtagg

SEQ ID NO: 590908 - DNA, 25 bp, Mus musculus
cccaccggtgacaaatgaggagctc

SEQ ID NO: 590909 - DNA, 25 bp, Mus musculus
cccaccggtgactaatgaggagctc

SEQ ID NO: 590910 - DNA, 25 bp, Mus musculus
cccaccgtcagaacttcataaagct

SEQ ID NO: 590911 - DNA, 25 bp, Mus musculus
cccaccgtcagatcttcataaagct

SEQ ID NO: 590912 - DNA, 25 bp, Mus musculus
cccacctcgggtagtctgtgctgtc

SEQ ID NO: 590913 - DNA, 25 bp, Mus musculus
cccacctcgggttgtctgtgctgtc

SEQ ID NO: 590914 - DNA, 25 bp, Mus musculus
cccacctgaagtaaatcggattttg

SEQ ID NO: 590915 - DNA, 25 bp, Mus musculus
cccacctgaagttaatcggattttg

SEQ ID NO: 590916 - DNA, 25 bp, Mus musculus
cccacctgcaatcgattttgttaca

SEQ ID NO: 590917 - DNA, 25 bp, Mus musculus
cccacctgcaatggattttgttaca

SEQ ID NO: 590918 - DNA, 25 bp, Mus musculus
cccacctgcagaatgacgacagtgt

SEQ ID NO: 590919 - DNA, 25 bp, Mus musculus
cccacctgcagattgacgacagtgt

SEQ ID NO: 590920 - DNA, 25 bp, Mus musculus
cccacctgctcacagtatatgactt

SEQ ID NO: 590921 - DNA, 25 bp, Mus musculus
cccacctgctcagagtatatgactt

SEQ ID NO: 590922 - DNA, 25 bp, Mus musculus
cccacctgttgtctgcataacatca

SEQ ID NO: 590923 - DNA, 25 bp, Mus musculus
cccacctgttgtgtgcataacatca

SEQ ID NO: 590924 - DNA, 25 bp, Mus musculus
cccaccttatagagctgaggaaaca

SEQ ID NO: 590925 - DNA, 25 bp, Mus musculus
cccaccttatagtgctgaggaaaca

SEQ ID NO: 590926 - DNA, 25 bp, Mus musculus
cccaccttggccatgagcgctggga

SEQ ID NO: 590927 - DNA, 25 bp, Mus musculus
cccaccttggccttgagcgctggga

SEQ ID NO: 590928 - DNA, 25 bp, Mus musculus
cccaccttgtacactgttcaggagg

SEQ ID NO: 590929 - DNA, 25 bp, Mus musculus
cccaccttgtactctgttcaggagg

SEQ ID NO: 590930 - DNA, 25 bp, Mus musculus
cccaccttgtggaccagggggcaat

SEQ ID NO: 590931 - DNA, 25 bp, Mus musculus
cccaccttgtggtccagggggcaat

SEQ ID NO: 590932 - DNA, 25 bp, Mus musculus
cccacgagagatattcaagcagaag

SEQ ID NO: 590933 - DNA, 25 bp, Mus musculus
cccacgagagattttcaagcagaag

SEQ ID NO: 590934 - DNA, 25 bp, Mus musculus
cccacgagatcaccaaggagcacat

SEQ ID NO: 590935 - DNA, 25 bp, Mus musculus
cccacgagatcagcaaggagcacat

SEQ ID NO: 590936 - DNA, 25 bp, Mus musculus
cccacgaggcaaccaaaagttaagt

SEQ ID NO: 590937 - DNA, 25 bp, Mus musculus
cccacgaggcaagcaaaagttaagt

SEQ ID NO: 590938 - DNA, 25 bp, Mus musculus
cccacgagttatccttgcttcagaa

SEQ ID NO: 590939 - DNA, 25 bp, Mus musculus
cccacgagttatgcttgcttcagaa

SEQ ID NO: 590940 - DNA, 25 bp, Mus musculus
cccacgatgtctatagtaacctcag

SEQ ID NO: 590941 - DNA, 25 bp, Mus musculus
cccacgatgtctttagtaacctcag

SEQ ID NO: 590942 - DNA, 25 bp, Mus musculus
cccacgattatcagaacctgtttca

SEQ ID NO: 590943 - DNA, 25 bp, Mus musculus
cccacgattatctgaacctgtttca

SEQ ID NO: 590944 - DNA, 25 bp, Mus musculus
cccacgcatcagacttctgtagggc

SEQ ID NO: 590945 - DNA, 25 bp, Mus musculus
cccacgcatcagtcttctgtagggc

SEQ ID NO: 590946 - DNA, 25 bp, Mus musculus
cccacgcccggcactatgaattgta

SEQ ID NO: 590947 - DNA, 25 bp, Mus musculus
cccacgcccggctctatgaattgta

SEQ ID NO: 590948 - DNA, 25 bp, Mus musculus
cccacgctgaaccaaagggacacgg

SEQ ID NO: 590949 - DNA, 25 bp, Mus musculus
cccacgctgaacgaaagggacacgg

SEQ ID NO: 590950 - DNA, 25 bp, Mus musculus
cccacggagccaaagtcacagtttt

SEQ ID NO: 590951 - DNA, 25 bp, Mus musculus
cccacggagccatagtcacagtttt

SEQ ID NO: 590952 - DNA, 25 bp, Mus musculus
cccacggatgagaatgtaaatgaaa

SEQ ID NO: 590953 - DNA, 25 bp, Mus musculus
cccacggatgagtatgtaaatgaaa

SEQ ID NO: 590954 - DNA, 25 bp, Mus musculus
cccacggtagaaccgatgcaggtcc

SEQ ID NO: 590955 - DNA, 25 bp, Mus musculus
cccacggtagaagcgatgcaggtcc

SEQ ID NO: 590956 - DNA, 25 bp, Mus musculus
cccacgtgggagaccccatgcggtt

SEQ ID NO: 590957 - DNA, 25 bp, Mus musculus
cccacgtgggagtccccatgcggtt

SEQ ID NO: 590958 - DNA, 25 bp, Mus musculus
cccactactgctccggaaattgcag

SEQ ID NO: 590959 - DNA, 25 bp, Mus musculus
cccactactgctgcggaaattgcag

SEQ ID NO: 590960 - DNA, 25 bp, Mus musculus
cccactagcatgacaccgcgtgtgt

SEQ ID NO: 590961 - DNA, 25 bp, Mus musculus
cccactagcatgtcaccgcgtgtgt

SEQ ID NO: 590962 - DNA, 25 bp, Mus musculus
cccactatgaggagcggcctgtgga

SEQ ID NO: 590963 - DNA, 25 bp, Mus musculus
cccactatgaggtgcggcctgtgga

SEQ ID NO: 590964 - DNA, 25 bp, Mus musculus
cccactcaggacacggctttgacag

SEQ ID NO: 590965 - DNA, 25 bp, Mus musculus
cccactcaggactcggctttgacag

SEQ ID NO: 590966 - DNA, 25 bp, Mus musculus
cccactccacacaagagatggttgg

SEQ ID NO: 590967 - DNA, 25 bp, Mus musculus
cccactccacactagagatggttgg

SEQ ID NO: 590968 - DNA, 25 bp, Mus musculus
cccactccactcagctgtccaagaa

SEQ ID NO: 590969 - DNA, 25 bp, Mus musculus
cccactccactctgctgtccaagaa

SEQ ID NO: 590970 - DNA, 25 bp, Mus musculus
cccactcggatgagaagagatacca

SEQ ID NO: 590971 - DNA, 25 bp, Mus musculus
cccactcggatgtgaagagatacca

SEQ ID NO: 590972 - DNA, 25 bp, Mus musculus
cccactgaaggaccgtgtatccctg

SEQ ID NO: 590973 - DNA, 25 bp, Mus musculus
cccactgaaggagcgtgtatccctg

SEQ ID NO: 590974 - DNA, 25 bp, Mus musculus
cccactgataaaaactaagaatgaa

SEQ ID NO: 590975 - DNA, 25 bp, Mus musculus
cccactgataaatactaagaatgaa

SEQ ID NO: 590976 - DNA, 25 bp, Mus musculus
cccactgcacagaaaacgagtagaa

SEQ ID NO: 590977 - DNA, 25 bp, Mus musculus
cccactgcacagtaaacgagtagaa

SEQ ID NO: 590978 - DNA, 25 bp, Mus musculus
cccactgcggcacgtccttagggat

SEQ ID NO: 590979 - DNA, 25 bp, Mus musculus
cccactgcggcaggtccttagggat

SEQ ID NO: 590980 - DNA, 25 bp, Mus musculus
cccactggacacagttgaggtccct

SEQ ID NO: 590981 - DNA, 25 bp, Mus musculus
cccactggacactgttgaggtccct

SEQ ID NO: 590982 - DNA, 25 bp, Mus musculus
cccactggatgtaattacctccttt

SEQ ID NO: 590983 - DNA, 25 bp, Mus musculus
cccactggatgttattacctccttt

SEQ ID NO: 590984 - DNA, 25 bp, Mus musculus
cccactgggaaaatgaagaacttct

SEQ ID NO: 590985 - DNA, 25 bp, Mus musculus
cccactgggaaattgaagaacttct

SEQ ID NO: 590986 - DNA, 25 bp, Mus musculus
cccactgggcgacgacaacattggt

SEQ ID NO: 590987 - DNA, 25 bp, Mus musculus
cccactgggcgaggacaacattggt

SEQ ID NO: 590988 - DNA, 25 bp, Mus musculus
cccactgggttgaggccaatctgta

SEQ ID NO: 590989 - DNA, 25 bp, Mus musculus
cccactgggttgtggccaatctgta

SEQ ID NO: 590990 - DNA, 25 bp, Mus musculus
cccactggtctgcttgctgggcaga

SEQ ID NO: 590991 - DNA, 25 bp, Mus musculus
cccactggtctggttgctgggcaga

SEQ ID NO: 590992 - DNA, 25 bp, Mus musculus
cccactgtaggacaacgatttcgat

SEQ ID NO: 590993 - DNA, 25 bp, Mus musculus
cccactgtaggagaacgatttcgat

SEQ ID NO: 590994 - DNA, 25 bp, Mus musculus
cccactgtcagcacgcagttcaagg

SEQ ID NO: 590995 - DNA, 25 bp, Mus musculus
cccactgtcagctcgcagttcaagg

SEQ ID NO: 590996 - DNA, 25 bp, Mus musculus
cccacttcatcgaggagcagcaggc

SEQ ID NO: 590997 - DNA, 25 bp, Mus musculus
cccacttcatcgtggagcagcaggc

SEQ ID NO: 590998 - DNA, 25 bp, Mus musculus
cccacttcgaggagccagggccgat

SEQ ID NO: 590999 - DNA, 25 bp, Mus musculus
cccacttcgaggtgccagggccgat

SEQ ID NO: 591000 - DNA, 25 bp, Mus musculus
cccacttcgggtactcaaatgtgta

SEQ ID NO: 591001 - DNA, 25 bp, Mus musculus
cccacttcgggttctcaaatgtgta

SEQ ID NO: 591002 - DNA, 25 bp, Mus musculus
cccacttctgaacacttggcttggg

SEQ ID NO: 591003 - DNA, 25 bp, Mus musculus
cccacttctgaagacttggcttggg

SEQ ID NO: 591004 - DNA, 25 bp, Mus musculus
cccacttgcgaccaggagagcattt

SEQ ID NO: 591005 - DNA, 25 bp, Mus musculus
cccacttgcgacgaggagagcattt

SEQ ID NO: 591006 - DNA, 25 bp, Mus musculus
cccacttgtgatagtgtatggaata

SEQ ID NO: 591007 - DNA, 25 bp, Mus musculus
cccacttgtgattgtgtatggaata

SEQ ID NO: 591008 - DNA, 25 bp, Mus musculus
cccacttgtttcaagagagggctgc

SEQ ID NO: 591009 - DNA, 25 bp, Mus musculus
cccacttgtttctagagagggctgc

SEQ ID NO: 591010 - DNA, 25 bp, Mus musculus
cccactttgtaaataatgctgccag

SEQ ID NO: 591011 - DNA, 25 bp, Mus musculus
cccactttgtaattaatgctgccag

SEQ ID NO: 591012 - DNA, 25 bp, Mus musculus
cccacttttggacagggccagcctt

SEQ ID NO: 591013 - DNA, 25 bp, Mus musculus
cccacttttggagagggccagcctt

SEQ ID NO: 591014 - DNA, 25 bp, Mus musculus
cccagaaaaggccatgtcaggcggc

SEQ ID NO: 591015 - DNA, 25 bp, Mus musculus
cccagaaaaggcgatgtcaggcggc

SEQ ID NO: 591016 - DNA, 25 bp, Mus musculus
cccagaaactggcattttcaccaag

SEQ ID NO: 591017 - DNA, 25 bp, Mus musculus
cccagaaactgggattttcaccaag

SEQ ID NO: 591018 - DNA, 25 bp, Mus musculus
cccagaaagctgagcaaggaatact

SEQ ID NO: 591019 - DNA, 25 bp, Mus musculus
cccagaaagctgtgcaaggaatact

SEQ ID NO: 591020 - DNA, 25 bp, Mus musculus
cccagaaatcctcgatagagagcac

SEQ ID NO: 591021 - DNA, 25 bp, Mus musculus
cccagaaatcctggatagagagcac

SEQ ID NO: 591022 - DNA, 25 bp, Mus musculus
cccagaagacctcgttgaagtgaac

SEQ ID NO: 591023 - DNA, 25 bp, Mus musculus
cccagaagacctctttaacatgttc

SEQ ID NO: 591024 - DNA, 25 bp, Mus musculus
cccagaagacctggttgaagtgaac

SEQ ID NO: 591025 - DNA, 25 bp, Mus musculus
cccagaagacctgtttaacatgttc

SEQ ID NO: 591026 - DNA, 25 bp, Mus musculus
cccagaagacgaactctaccaggag

SEQ ID NO: 591027 - DNA, 25 bp, Mus musculus
cccagaagacgatctctaccaggag

SEQ ID NO: 591028 - DNA, 25 bp, Mus musculus
cccagaagatgacaatgcagacgca

SEQ ID NO: 591029 - DNA, 25 bp, Mus musculus
cccagaagatgagaatgcagacgca

SEQ ID NO: 591030 - DNA, 25 bp, Mus musculus
cccagaagcgcaagcggagagactg

SEQ ID NO: 591031 - DNA, 25 bp, Mus musculus
cccagaagcgcatgcggagagactg

SEQ ID NO: 591032 - DNA, 25 bp, Mus musculus
cccagaagcttgcaagccgcggctg

SEQ ID NO: 591033 - DNA, 25 bp, Mus musculus
cccagaagcttggaagccgcggctg

SEQ ID NO: 591034 - DNA, 25 bp, Mus musculus
cccagaaggaaaaggagtgccacct

SEQ ID NO: 591035 - DNA, 25 bp, Mus musculus
cccagaaggaaatggagtgccacct

SEQ ID NO: 591036 - DNA, 25 bp, Mus musculus
cccagaaggagcacacattcgacag

SEQ ID NO: 591037 - DNA, 25 bp, Mus musculus
cccagaaggagctcacattcgacag

SEQ ID NO: 591038 - DNA, 25 bp, Mus musculus
cccagaaggagtcatagctcgaagg

SEQ ID NO: 591039 - DNA, 25 bp, Mus musculus
cccagaaggagtgatagctcgaagg

SEQ ID NO: 591040 - DNA, 25 bp, Mus musculus
cccagaaggatgagcactgctgggt

SEQ ID NO: 591041 - DNA, 25 bp, Mus musculus
cccagaaggatgtgcactgctgggt

SEQ ID NO: 591042 - DNA, 25 bp, Mus musculus
cccagaagtactatctcaagttgaa

SEQ ID NO: 591043 - DNA, 25 bp, Mus musculus
cccagaagtactttctcaagttgaa

SEQ ID NO: 591044 - DNA, 25 bp, Mus musculus
cccagaagtatgaggatcggattca

SEQ ID NO: 591045 - DNA, 25 bp, Mus musculus
cccagaagtatgtggatcggattca

SEQ ID NO: 591046 - DNA, 25 bp, Mus musculus
cccagaagtggaaacaaggcatctt

SEQ ID NO: 591047 - DNA, 25 bp, Mus musculus
cccagaagtggatacaaggcatctt

SEQ ID NO: 591048 - DNA, 25 bp, Mus musculus
cccagaagtttcatagtagcagaga

SEQ ID NO: 591049 - DNA, 25 bp, Mus musculus
cccagaagtttcttagtagcagaga

SEQ ID NO: 591050 - DNA, 25 bp, Mus musculus
cccagaataaggatggagaaccaga

SEQ ID NO: 591051 - DNA, 25 bp, Mus musculus
cccagaataaggttggagaaccaga

SEQ ID NO: 591052 - DNA, 25 bp, Mus musculus
cccagaatattaatgagctcaagtc

SEQ ID NO: 591053 - DNA, 25 bp, Mus musculus
cccagaatattattgagctcaagtc

SEQ ID NO: 591054 - DNA, 25 bp, Mus musculus
cccagaatgcgccagatatatggac

SEQ ID NO: 591055 - DNA, 25 bp, Mus musculus
cccagaatgcgcgagatatatggac

SEQ ID NO: 591056 - DNA, 25 bp, Mus musculus
cccagacacaagctccttgagagtt

SEQ ID NO: 591057 - DNA, 25 bp, Mus musculus
cccagacacaaggtccttgagagtt

SEQ ID NO: 591058 - DNA, 25 bp, Mus musculus
cccagacatggacgtggatgagaat

SEQ ID NO: 591059 - DNA, 25 bp, Mus musculus
cccagacatggaggtggatgagaat

SEQ ID NO: 591060 - DNA, 25 bp, Mus musculus
cccagacatgggaataggcggagcc

SEQ ID NO: 591061 - DNA, 25 bp, Mus musculus
cccagacatgggtataggcggagcc

SEQ ID NO: 591062 - DNA, 25 bp, Mus musculus
cccagaccaatgcattgtcccagga

SEQ ID NO: 591063 - DNA, 25 bp, Mus musculus
cccagaccaatggattgtcccagga

SEQ ID NO: 591064 - DNA, 25 bp, Mus musculus
cccagaccatttatgtgtcaatgag

SEQ ID NO: 591065 - DNA, 25 bp, Mus musculus
cccagaccatttttgtgtcaatgag

SEQ ID NO: 591066 - DNA, 25 bp, Mus musculus
cccagacctgcaacaaagtgcgatg

SEQ ID NO: 591067 - DNA, 25 bp, Mus musculus
cccagacctgcatcaaagtgcgatg

SEQ ID NO: 591068 - DNA, 25 bp, Mus musculus
cccagaccttgacttggagtgacag

SEQ ID NO: 591069 - DNA, 25 bp, Mus musculus
cccagaccttgagttggagtgacag

SEQ ID NO: 591070 - DNA, 25 bp, Mus musculus
cccagacgccacatacgactacaga

SEQ ID NO: 591071 - DNA, 25 bp, Mus musculus
cccagacgccacttacgactacaga

SEQ ID NO: 591072 - DNA, 25 bp, Mus musculus
cccagacgggacaagagaagttgct

SEQ ID NO: 591073 - DNA, 25 bp, Mus musculus
cccagacgggactagagaagttgct

SEQ ID NO: 591074 - DNA, 25 bp, Mus musculus
cccagacgggttagcagctgagcct

SEQ ID NO: 591075 - DNA, 25 bp, Mus musculus
cccagacgggtttgcagctgagcct

SEQ ID NO: 591076 - DNA, 25 bp, Mus musculus
cccagactacagaaatactcaacaa

SEQ ID NO: 591077 - DNA, 25 bp, Mus musculus
cccagactacagtaatactcaacaa

SEQ ID NO: 591078 - DNA, 25 bp, Mus musculus
cccagactataaagtggagtttttt

SEQ ID NO: 591079 - DNA, 25 bp, Mus musculus
cccagactataatgtggagtttttt

SEQ ID NO: 591080 - DNA, 25 bp, Mus musculus
cccagactctggcactatggtcatg

SEQ ID NO: 591081 - DNA, 25 bp, Mus musculus
cccagactctgggactatggtcatg

SEQ ID NO: 591082 - DNA, 25 bp, Mus musculus
cccagactcttgactgaggtgggct

SEQ ID NO: 591083 - DNA, 25 bp, Mus musculus
cccagactcttgtctgaggtgggct

SEQ ID NO: 591084 - DNA, 25 bp, Mus musculus
cccagactggtgagctggacagcca

SEQ ID NO: 591085 - DNA, 25 bp, Mus musculus
cccagactggtgtgctggacagcca

SEQ ID NO: 591086 - DNA, 25 bp, Mus musculus
cccagacttacgacatgatcttcat

SEQ ID NO: 591087 - DNA, 25 bp, Mus musculus
cccagacttacgtcatgatcttcat

SEQ ID NO: 591088 - DNA, 25 bp, Mus musculus
cccagacttggtccaatggactcga

SEQ ID NO: 591089 - DNA, 25 bp, Mus musculus
cccagacttggtgcaatggactcga

SEQ ID NO: 591090 - DNA, 25 bp, Mus musculus
cccagagaacaccacggtagtgtct

SEQ ID NO: 591091 - DNA, 25 bp, Mus musculus
cccagagaacacgacggtagtgtct

SEQ ID NO: 591092 - DNA, 25 bp, Mus musculus
cccagagaagaaacctgacgatttc

SEQ ID NO: 591093 - DNA, 25 bp, Mus musculus
cccagagaagaatcctgacgatttc

SEQ ID NO: 591094 - DNA, 25 bp, Mus musculus
cccagagaagatcgacttgaggcat

SEQ ID NO: 591095 - DNA, 25 bp, Mus musculus
cccagagaagatggacttgaggcat

SEQ ID NO: 591096 - DNA, 25 bp, Mus musculus
cccagagactgtacctttgtctacg

SEQ ID NO: 591097 - DNA, 25 bp, Mus musculus
cccagagactgttcctttgtctacg

SEQ ID NO: 591098 - DNA, 25 bp, Mus musculus
cccagagagacgaggtgattatgct

SEQ ID NO: 591099 - DNA, 25 bp, Mus musculus
cccagagagacgtggtgattatgct

SEQ ID NO: 591100 - DNA, 25 bp, Mus musculus
cccagagagatgaagtaattcaatg

SEQ ID NO: 591101 - DNA, 25 bp, Mus musculus
cccagagagatgtagtaattcaatg

SEQ ID NO: 591102 - DNA, 25 bp, Mus musculus
cccagagagggccagttgctaagtc

SEQ ID NO: 591103 - DNA, 25 bp, Mus musculus
cccagagagggcgagttgctaagtc

SEQ ID NO: 591104 - DNA, 25 bp, Mus musculus
cccagagaggtgagaaaggactact

SEQ ID NO: 591105 - DNA, 25 bp, Mus musculus
cccagagaggtgtgaaaggactact

SEQ ID NO: 591106 - DNA, 25 bp, Mus musculus
cccagagagttgagcacaggatgtc

SEQ ID NO: 591107 - DNA, 25 bp, Mus musculus
cccagagagttgtgcacaggatgtc

SEQ ID NO: 591108 - DNA, 25 bp, Mus musculus
cccagagatcatcctgaattggatg

SEQ ID NO: 591109 - DNA, 25 bp, Mus musculus
cccagagatcatgctgaattggatg

SEQ ID NO: 591110 - DNA, 25 bp, Mus musculus
cccagagcaatccaggaaaccttta

SEQ ID NO: 591111 - DNA, 25 bp, Mus musculus
cccagagcaatcgaggaaaccttta

SEQ ID NO: 591112 - DNA, 25 bp, Mus musculus
cccagagcaggactggtacagagct

SEQ ID NO: 591113 - DNA, 25 bp, Mus musculus
cccagagcaggagtggtacagagct

SEQ ID NO: 591114 - DNA, 25 bp, Mus musculus
cccagagcaggtcataacctcttct

SEQ ID NO: 591115 - DNA, 25 bp, Mus musculus
cccagagcaggtgataacctcttct

SEQ ID NO: 591116 - DNA, 25 bp, Mus musculus
cccagagcccaacagcgttgtgcaa

SEQ ID NO: 591117 - DNA, 25 bp, Mus musculus
cccagagcccaagagcgttgtgcaa

SEQ ID NO: 591118 - DNA, 25 bp, Mus musculus
cccagagctcgcagcccagattatt

SEQ ID NO: 591119 - DNA, 25 bp, Mus musculus
cccagagctcgctgcccagattatt

SEQ ID NO: 591120 - DNA, 25 bp, Mus musculus
cccagagctgagattatctagtcag

SEQ ID NO: 591121 - DNA, 25 bp, Mus musculus
cccagagctgagtttatctagtcag

SEQ ID NO: 591122 - DNA, 25 bp, Mus musculus
cccagagcttcacggacaatgatgt

SEQ ID NO: 591123 - DNA, 25 bp, Mus musculus
cccagagcttcagggacaatgatgt

SEQ ID NO: 591124 - DNA, 25 bp, Mus musculus
cccagaggaaaccatggctctagtg

SEQ ID NO: 591125 - DNA, 25 bp, Mus musculus
cccagaggaaacgatggctctagtg

SEQ ID NO: 591126 - DNA, 25 bp, Mus musculus
cccagaggacatataagctcgacta

SEQ ID NO: 591127 - DNA, 25 bp, Mus musculus
cccagaggacatttaagctcgacta

SEQ ID NO: 591128 - DNA, 25 bp, Mus musculus
cccagaggagctactggaagcaaag

SEQ ID NO: 591129 - DNA, 25 bp, Mus musculus
cccagaggagcttctggaagcaaag

SEQ ID NO: 591130 - DNA, 25 bp, Mus musculus
cccagaggatcgctgagagcaatca

SEQ ID NO: 591131 - DNA, 25 bp, Mus musculus
cccagaggatcggtgagagcaatca

SEQ ID NO: 591132 - DNA, 25 bp, Mus musculus
cccagaggcgggagctaatcttggc

SEQ ID NO: 591133 - DNA, 25 bp, Mus musculus
cccagaggcgggtgctaatcttggc

SEQ ID NO: 591134 - DNA, 25 bp, Mus musculus
cccagaggtgctctttggagttagc

SEQ ID NO: 591135 - DNA, 25 bp, Mus musculus
cccagaggtgctgtttggagttagc

SEQ ID NO: 591136 - DNA, 25 bp, Mus musculus
cccagagtcctcatcagcaggtgca

SEQ ID NO: 591137 - DNA, 25 bp, Mus musculus
cccagagtcctcttcagcaggtgca

SEQ ID NO: 591138 - DNA, 25 bp, Mus musculus
cccagagtgaggcttttgacagtgt

SEQ ID NO: 591139 - DNA, 25 bp, Mus musculus
cccagagtgagggttttgacagtgt

SEQ ID NO: 591140 - DNA, 25 bp, Mus musculus
cccagagtggatatggcgcaagaag

SEQ ID NO: 591141 - DNA, 25 bp, Mus musculus
cccagagtggatttggcgcaagaag

SEQ ID NO: 591142 - DNA, 25 bp, Mus musculus
cccagagtgtcaccctggagggctc

SEQ ID NO: 591143 - DNA, 25 bp, Mus musculus
cccagagtgtcagcctggagggctc

SEQ ID NO: 591144 - DNA, 25 bp, Mus musculus
cccagagtgtccaggcaggctccaa

SEQ ID NO: 591145 - DNA, 25 bp, Mus musculus
cccagagtgtcctggcaggctccaa

SEQ ID NO: 591146 - DNA, 25 bp, Mus musculus
cccagagtgtggagagctacctgga

SEQ ID NO: 591147 - DNA, 25 bp, Mus musculus
cccagagtgtggtgagctacctgga

SEQ ID NO: 591148 - DNA, 25 bp, Mus musculus
cccagagttcccagtgtggcagctg

SEQ ID NO: 591149 - DNA, 25 bp, Mus musculus
cccagagttccctgtgtggcagctg

SEQ ID NO: 591150 - DNA, 25 bp, Mus musculus
cccagataacatctggtccagccag

SEQ ID NO: 591151 - DNA, 25 bp, Mus musculus
cccagataacatgtggtccagccag

SEQ ID NO: 591152 - DNA, 25 bp, Mus musculus
cccagataattaaggacgtcccact

SEQ ID NO: 591153 - DNA, 25 bp, Mus musculus
cccagataattatggacgtcccact

SEQ ID NO: 591154 - DNA, 25 bp, Mus musculus
cccagataattcaggccaagaagag

SEQ ID NO: 591155 - DNA, 25 bp, Mus musculus
cccagataattctggccaagaagag

SEQ ID NO: 591156 - DNA, 25 bp, Mus musculus
cccagatagtctcatttttcaagag

SEQ ID NO: 591157 - DNA, 25 bp, Mus musculus
cccagatagtctgatttttcaagag

SEQ ID NO: 591158 - DNA, 25 bp, Mus musculus
cccagatccgctcagagctggatgt

SEQ ID NO: 591159 - DNA, 25 bp, Mus musculus
cccagatccgctgagagctggatgt

SEQ ID NO: 591160 - DNA, 25 bp, Mus musculus
cccagatcctggcaaggtggcaaca

SEQ ID NO: 591161 - DNA, 25 bp, Mus musculus
cccagatcctgggaaggtggcaaca

SEQ ID NO: 591162 - DNA, 25 bp, Mus musculus
cccagatgaaatcttttggaaccac

SEQ ID NO: 591163 - DNA, 25 bp, Mus musculus
cccagatgaaatgttttggaaccac

SEQ ID NO: 591164 - DNA, 25 bp, Mus musculus
cccagatgagctaaagaatatggtc

SEQ ID NO: 591165 - DNA, 25 bp, Mus musculus
cccagatgagcttaagaatatggtc

SEQ ID NO: 591166 - DNA, 25 bp, Mus musculus
cccagatgatggcagagaagcagtc

SEQ ID NO: 591167 - DNA, 25 bp, Mus musculus
cccagatgatgggagagaagcagtc

SEQ ID NO: 591168 - DNA, 25 bp, Mus musculus
cccagatgccatatctagattcagt

SEQ ID NO: 591169 - DNA, 25 bp, Mus musculus
cccagatgccatttctagattcagt

SEQ ID NO: 591170 - DNA, 25 bp, Mus musculus
cccagatgctgcctgacatttgctc

SEQ ID NO: 591171 - DNA, 25 bp, Mus musculus
cccagatgctgcgtgacatttgctc

SEQ ID NO: 591172 - DNA, 25 bp, Mus musculus
cccagatgctttctgtcaatgagga

SEQ ID NO: 591173 - DNA, 25 bp, Mus musculus
cccagatgctttgtgtcaatgagga

SEQ ID NO: 591174 - DNA, 25 bp, Mus musculus
cccagatggatcagaaaagaaagat

SEQ ID NO: 591175 - DNA, 25 bp, Mus musculus
cccagatggatctgaaaagaaagat

SEQ ID NO: 591176 - DNA, 25 bp, Mus musculus
cccagatgggaacggaatgaatcca

SEQ ID NO: 591177 - DNA, 25 bp, Mus musculus
cccagatgggaagggaatgaatcca

SEQ ID NO: 591178 - DNA, 25 bp, Mus musculus
cccagatgttgaccagtgagaaact

SEQ ID NO: 591179 - DNA, 25 bp, Mus musculus
cccagatgttgagcagtgagaaact

SEQ ID NO: 591180 - DNA, 25 bp, Mus musculus
cccagattggaaatggtgcaacaag

SEQ ID NO: 591181 - DNA, 25 bp, Mus musculus
cccagattggaattggtgcaacaag

SEQ ID NO: 591182 - DNA, 25 bp, Mus musculus
cccagcaaactccagcttatggaaa

SEQ ID NO: 591183 - DNA, 25 bp, Mus musculus
cccagcaaactcgagcttatggaaa

SEQ ID NO: 591184 - DNA, 25 bp, Mus musculus
cccagcaacctacctgtgaacgaag

SEQ ID NO: 591185 - DNA, 25 bp, Mus musculus
cccagcaacctagctgtgaacgaag

SEQ ID NO: 591186 - DNA, 25 bp, Mus musculus
cccagcaacctgatttcaacctatg

SEQ ID NO: 591187 - DNA, 25 bp, Mus musculus
cccagcaacctgttttcaacctatg

SEQ ID NO: 591188 - DNA, 25 bp, Mus musculus
cccagcaactgacaaaaatggccac

SEQ ID NO: 591189 - DNA, 25 bp, Mus musculus
cccagcaactgagaaaaatggccac

SEQ ID NO: 591190 - DNA, 25 bp, Mus musculus
cccagcaatggcagccgtgaggccg

SEQ ID NO: 591191 - DNA, 25 bp, Mus musculus
cccagcaatggctgccgtgaggccg

SEQ ID NO: 591192 - DNA, 25 bp, Mus musculus
cccagcacacggaggatgatgctga

SEQ ID NO: 591193 - DNA, 25 bp, Mus musculus
cccagcacacggtggatgatgctga

SEQ ID NO: 591194 - DNA, 25 bp, Mus musculus
cccagcaccaccagcgaggttgtta

SEQ ID NO: 591195 - DNA, 25 bp, Mus musculus
cccagcaccacctgcgaggttgtta

SEQ ID NO: 591196 - DNA, 25 bp, Mus musculus
cccagcaccgagaccttgacgtggg

SEQ ID NO: 591197 - DNA, 25 bp, Mus musculus
cccagcaccgagtccttgacgtggg

SEQ ID NO: 591198 - DNA, 25 bp, Mus musculus
cccagcagaaaacttaatcgaatac

SEQ ID NO: 591199 - DNA, 25 bp, Mus musculus
cccagcagaaaagttaatcgaatac

SEQ ID NO: 591200 - DNA, 25 bp, Mus musculus
cccagcagccttccattataaataa

SEQ ID NO: 591201 - DNA, 25 bp, Mus musculus
cccagcagccttgcattataaataa

SEQ ID NO: 591202 - DNA, 25 bp, Mus musculus
cccagcaggagacgtgtttcagaac

SEQ ID NO: 591203 - DNA, 25 bp, Mus musculus
cccagcaggagaggtgtttcagaac

SEQ ID NO: 591204 - DNA, 25 bp, Mus musculus
cccagcaggtcgataattaagggct

SEQ ID NO: 591205 - DNA, 25 bp, Mus musculus
cccagcaggtcgttaattaagggct

SEQ ID NO: 591206 - DNA, 25 bp, Mus musculus
cccagcagtacacgagccaagagaa

SEQ ID NO: 591207 - DNA, 25 bp, Mus musculus
cccagcagtacaggagccaagagaa

SEQ ID NO: 591208 - DNA, 25 bp, Mus musculus
cccagcagtggcaggaagacctgga

SEQ ID NO: 591209 - DNA, 25 bp, Mus musculus
cccagcagtggctggaagacctgga

SEQ ID NO: 591210 - DNA, 25 bp, Mus musculus
cccagcatactgacacgtgaacgaa

SEQ ID NO: 591211 - DNA, 25 bp, Mus musculus
cccagcatactgtcacgtgaacgaa

SEQ ID NO: 591212 - DNA, 25 bp, Mus musculus
cccagcatcagccaggaacagatta

SEQ ID NO: 591213 - DNA, 25 bp, Mus musculus
cccagcatcagcgaggaacagatta

SEQ ID NO: 591214 - DNA, 25 bp, Mus musculus
cccagcatcaggaggaactatgtgg

SEQ ID NO: 591215 - DNA, 25 bp, Mus musculus
cccagcatcaggtggaactatgtgg

SEQ ID NO: 591216 - DNA, 25 bp, Mus musculus
cccagcatcatgagggcctggatct

SEQ ID NO: 591217 - DNA, 25 bp, Mus musculus
cccagcatcatgtgggcctggatct

SEQ ID NO: 591218 - DNA, 25 bp, Mus musculus
cccagcatggctcaatgagcaggca

SEQ ID NO: 591219 - DNA, 25 bp, Mus musculus
cccagcatggctgaatgagcaggca

SEQ ID NO: 591220 - DNA, 25 bp, Mus musculus
cccagcatgggtacaagggtcctag

SEQ ID NO: 591221 - DNA, 25 bp, Mus musculus
cccagcatgggttcaagggtcctag

SEQ ID NO: 591222 - DNA, 25 bp, Mus musculus
cccagccaagaaagctatctccgag

SEQ ID NO: 591223 - DNA, 25 bp, Mus musculus
cccagccaagaatgctatctccgag

SEQ ID NO: 591224 - DNA, 25 bp, Mus musculus
cccagccaaggacaggatatcgtga

SEQ ID NO: 591225 - DNA, 25 bp, Mus musculus
cccagccaaggagaggatatcgtga

SEQ ID NO: 591226 - DNA, 25 bp, Mus musculus
cccagccagccaagtgaagctgaca

SEQ ID NO: 591227 - DNA, 25 bp, Mus musculus
cccagccagccatgtgaagctgaca

SEQ ID NO: 591228 - DNA, 25 bp, Mus musculus
cccagccagcgtagacagttcagac

SEQ ID NO: 591229 - DNA, 25 bp, Mus musculus
cccagccagcgttgacagttcagac

SEQ ID NO: 591230 - DNA, 25 bp, Mus musculus
cccagccagggcctggtttgtcagc

SEQ ID NO: 591231 - DNA, 25 bp, Mus musculus
cccagccagggcgtggtttgtcagc

SEQ ID NO: 591232 - DNA, 25 bp, Mus musculus
cccagccagtgacaggttccattca

SEQ ID NO: 591233 - DNA, 25 bp, Mus musculus
cccagccagtgagaggttccattca

SEQ ID NO: 591234 - DNA, 25 bp, Mus musculus
cccagcccaaatcgtatttcaaaag

SEQ ID NO: 591235 - DNA, 25 bp, Mus musculus
cccagcccaaatggtatttcaaaag

SEQ ID NO: 591236 - DNA, 25 bp, Mus musculus
cccagcccactgagagtggtactac

SEQ ID NO: 591237 - DNA, 25 bp, Mus musculus
cccagcccactgtgagtggtactac

SEQ ID NO: 591238 - DNA, 25 bp, Mus musculus
cccagcccgagtacaactagtacga

SEQ ID NO: 591239 - DNA, 25 bp, Mus musculus
cccagcccgagttcaactagtacga

SEQ ID NO: 591240 - DNA, 25 bp, Mus musculus
cccagccctgggaacagaagtgaca

SEQ ID NO: 591241 - DNA, 25 bp, Mus musculus
cccagccctgggtacagaagtgaca

SEQ ID NO: 591242 - DNA, 25 bp, Mus musculus
cccagccgttctctctggaggaaca

SEQ ID NO: 591243 - DNA, 25 bp, Mus musculus
cccagccgttctgtctggaggaaca

SEQ ID NO: 591244 - DNA, 25 bp, Mus musculus
cccagcctatggatacaagcagtaa

SEQ ID NO: 591245 - DNA, 25 bp, Mus musculus
cccagcctatggttacaagcagtaa

SEQ ID NO: 591246 - DNA, 25 bp, Mus musculus
cccagcctgaaacgactgattaatt

SEQ ID NO: 591247 - DNA, 25 bp, Mus musculus
cccagcctgaaaggactgattaatt

SEQ ID NO: 591248 - DNA, 25 bp, Mus musculus
cccagcctggatcgcgagattgtca

SEQ ID NO: 591249 - DNA, 25 bp, Mus musculus
cccagcctggatggcgagattgtca

SEQ ID NO: 591250 - DNA, 25 bp, Mus musculus
cccagcctggcgagtcgtacgcagt

SEQ ID NO: 591251 - DNA, 25 bp, Mus musculus
cccagcctggcgtgtcgtacgcagt

SEQ ID NO: 591252 - DNA, 25 bp, Mus musculus
cccagccttccactagggattcagg

SEQ ID NO: 591253 - DNA, 25 bp, Mus musculus
cccagccttccagtagggattcagg

SEQ ID NO: 591254 - DNA, 25 bp, Mus musculus
cccagccttgctcggtgaatttggg

SEQ ID NO: 591255 - DNA, 25 bp, Mus musculus
cccagccttgctgggtgaatttggg

SEQ ID NO: 591256 - DNA, 25 bp, Mus musculus
cccagcgagaacagataagaggttc

SEQ ID NO: 591257 - DNA, 25 bp, Mus musculus
cccagcgagaactgataagaggttc

SEQ ID NO: 591258 - DNA, 25 bp, Mus musculus
cccagcggaagtcccaaaggtactg

SEQ ID NO: 591259 - DNA, 25 bp, Mus musculus
cccagcggaagtgccaaaggtactg

SEQ ID NO: 591260 - DNA, 25 bp, Mus musculus
cccagcggcagtatgattttggtct

SEQ ID NO: 591261 - DNA, 25 bp, Mus musculus
cccagcggcagtttgattttggtct

SEQ ID NO: 591262 - DNA, 25 bp, Mus musculus
cccagcggcctcagtggaagagcag

SEQ ID NO: 591263 - DNA, 25 bp, Mus musculus
cccagcggcctctgtggaagagcag

SEQ ID NO: 591264 - DNA, 25 bp, Mus musculus
cccagcggtactctcagtgcaatac

SEQ ID NO: 591265 - DNA, 25 bp, Mus musculus
cccagcggtactgtcagtgcaatac

SEQ ID NO: 591266 - DNA, 25 bp, Mus musculus
cccagcgtcggaagctgctttcggg

SEQ ID NO: 591267 - DNA, 25 bp, Mus musculus
cccagcgtcggatgctgctttcggg

SEQ ID NO: 591268 - DNA, 25 bp, Mus musculus
cccagcgtggtgagaagtcttcaga

SEQ ID NO: 591269 - DNA, 25 bp, Mus musculus
cccagcgtggtgtgaagtcttcaga

SEQ ID NO: 591270 - DNA, 25 bp, Mus musculus
cccagcgttgccataccatcgagat

SEQ ID NO: 591271 - DNA, 25 bp, Mus musculus
cccagcgttgccttaccatcgagat

SEQ ID NO: 591272 - DNA, 25 bp, Mus musculus
cccagctaagaaaatccacaccgga

SEQ ID NO: 591273 - DNA, 25 bp, Mus musculus
cccagctaagaatatccacaccgga

SEQ ID NO: 591274 - DNA, 25 bp, Mus musculus
cccagctacaggatcagtgtatcag

SEQ ID NO: 591275 - DNA, 25 bp, Mus musculus
cccagctacaggttcagtgtatcag

SEQ ID NO: 591276 - DNA, 25 bp, Mus musculus
cccagctatgctcggcttgtgagtc

SEQ ID NO: 591277 - DNA, 25 bp, Mus musculus
cccagctatgctgggcttgtgagtc

SEQ ID NO: 591278 - DNA, 25 bp, Mus musculus
cccagctccagaatggtacaaagat

SEQ ID NO: 591279 - DNA, 25 bp, Mus musculus
cccagctccagattggtacaaagat

SEQ ID NO: 591280 - DNA, 25 bp, Mus musculus
cccagctcgtagaatcttggaagaa

SEQ ID NO: 591281 - DNA, 25 bp, Mus musculus
cccagctcgtagtatcttggaagaa

SEQ ID NO: 591282 - DNA, 25 bp, Mus musculus
cccagctgatcaagcaggcagaagc

SEQ ID NO: 591283 - DNA, 25 bp, Mus musculus
cccagctgatcatgcaggcagaagc

SEQ ID NO: 591284 - DNA, 25 bp, Mus musculus
cccagctgatcgaggaagagtgtcc

SEQ ID NO: 591285 - DNA, 25 bp, Mus musculus
cccagctgatcgtggaagagtgtcc

SEQ ID NO: 591286 - DNA, 25 bp, Mus musculus
cccagctgctgcctaataaactgtg

SEQ ID NO: 591287 - DNA, 25 bp, Mus musculus
cccagctgctgcgtaataaactgtg

SEQ ID NO: 591288 - DNA, 25 bp, Mus musculus
cccagctggaggagacgctacatga

SEQ ID NO: 591289 - DNA, 25 bp, Mus musculus
cccagctggaggtgacgctacatga

SEQ ID NO: 591290 - DNA, 25 bp, Mus musculus
cccagctgggaaaccgaatcgacga

SEQ ID NO: 591291 - DNA, 25 bp, Mus musculus
cccagctgggaatccgaatcgacga

SEQ ID NO: 591292 - DNA, 25 bp, Mus musculus
cccagctgtatgaggaggagcctcg

SEQ ID NO: 591293 - DNA, 25 bp, Mus musculus
cccagctgtatgtggaggagcctcg

SEQ ID NO: 591294 - DNA, 25 bp, Mus musculus
cccagctgtgagaggggatatccct

SEQ ID NO: 591295 - DNA, 25 bp, Mus musculus
cccagctgtgagtggggatatccct

SEQ ID NO: 591296 - DNA, 25 bp, Mus musculus
cccagctgtgccatcttccagtgtt

SEQ ID NO: 591297 - DNA, 25 bp, Mus musculus
cccagctgtgccttcttccagtgtt

SEQ ID NO: 591298 - DNA, 25 bp, Mus musculus
cccagcttatagatcaccacttcaa

SEQ ID NO: 591299 - DNA, 25 bp, Mus musculus
cccagcttatagttcaccacttcaa

SEQ ID NO: 591300 - DNA, 25 bp, Mus musculus
cccagcttatgaagataaggacaac

SEQ ID NO: 591301 - DNA, 25 bp, Mus musculus
cccagcttatgatgataaggacaac

SEQ ID NO: 591302 - DNA, 25 bp, Mus musculus
cccagcttcggacgagagaagggct

SEQ ID NO: 591303 - DNA, 25 bp, Mus musculus
cccagcttcggaggagagaagggct

SEQ ID NO: 591304 - DNA, 25 bp, Mus musculus
cccagcttcgggatgaattttgatc

SEQ ID NO: 591305 - DNA, 25 bp, Mus musculus
cccagcttcgggttgaattttgatc

SEQ ID NO: 591306 - DNA, 25 bp, Mus musculus
cccagcttctagcaaaaggtcgaga

SEQ ID NO: 591307 - DNA, 25 bp, Mus musculus
cccagcttctaggaaaaggtcgaga

SEQ ID NO: 591308 - DNA, 25 bp, Mus musculus
cccagctttcacacgatgatactca

SEQ ID NO: 591309 - DNA, 25 bp, Mus musculus
cccagctttcactcgatgatactca

SEQ ID NO: 591310 - DNA, 25 bp, Mus musculus
cccagcttttggcttcggagctcga

SEQ ID NO: 591311 - DNA, 25 bp, Mus musculus
cccagcttttgggttcggagctcga

SEQ ID NO: 591312 - DNA, 25 bp, Mus musculus
cccaggaaaaatcaagcggatcaga

SEQ ID NO: 591313 - DNA, 25 bp, Mus musculus
cccaggaaaaatgaagcggatcaga

SEQ ID NO: 591314 - DNA, 25 bp, Mus musculus
cccaggaaaagtcgcaggtagctgt

SEQ ID NO: 591315 - DNA, 25 bp, Mus musculus
cccaggaaaagtggcaggtagctgt

SEQ ID NO: 591316 - DNA, 25 bp, Mus musculus
cccaggaaacaacgatgaacggctg

SEQ ID NO: 591317 - DNA, 25 bp, Mus musculus
cccaggaaacaaggatgaacggctg

SEQ ID NO: 591318 - DNA, 25 bp, Mus musculus
cccaggaagaggagatgtcatccct

SEQ ID NO: 591319 - DNA, 25 bp, Mus musculus
cccaggaagaggtgatgtcatccct

SEQ ID NO: 591320 - DNA, 25 bp, Mus musculus
cccaggaagatgaatctggaattaa

SEQ ID NO: 591321 - DNA, 25 bp, Mus musculus
cccaggaagatgtatctggaattaa

SEQ ID NO: 591322 - DNA, 25 bp, Mus musculus
cccaggaagcccacatcacagtgaa

SEQ ID NO: 591323 - DNA, 25 bp, Mus musculus
cccaggaagccctcatcacagtgaa

SEQ ID NO: 591324 - DNA, 25 bp, Mus musculus
cccaggaagcctatgatcttataag

SEQ ID NO: 591325 - DNA, 25 bp, Mus musculus
cccaggaagcctttgatcttataag

SEQ ID NO: 591326 - DNA, 25 bp, Mus musculus
cccaggaagtgcaagggatataatt

SEQ ID NO: 591327 - DNA, 25 bp, Mus musculus
cccaggaagtgctagggatataatt

SEQ ID NO: 591328 - DNA, 25 bp, Mus musculus
cccaggaattttaggcagcagtgtt

SEQ ID NO: 591329 - DNA, 25 bp, Mus musculus
cccaggaatttttggcagcagtgtt

SEQ ID NO: 591330 - DNA, 25 bp, Mus musculus
cccaggacaactcgagatgagaaac

SEQ ID NO: 591331 - DNA, 25 bp, Mus musculus
cccaggacaactggagatgagaaac

SEQ ID NO: 591332 - DNA, 25 bp, Mus musculus
cccaggacaattcggccaaactgaa

SEQ ID NO: 591333 - DNA, 25 bp, Mus musculus
cccaggacaattgggccaaactgaa

SEQ ID NO: 591334 - DNA, 25 bp, Mus musculus
cccaggacatggactttaagcctga

SEQ ID NO: 591335 - DNA, 25 bp, Mus musculus
cccaggacatggaggacagggtcaa

SEQ ID NO: 591336 - DNA, 25 bp, Mus musculus
cccaggacatggtctttaagcctga

SEQ ID NO: 591337 - DNA, 25 bp, Mus musculus
cccaggacatggtggacagggtcaa

SEQ ID NO: 591338 - DNA, 25 bp, Mus musculus
cccaggaccataagaactttattgc

SEQ ID NO: 591339 - DNA, 25 bp, Mus musculus
cccaggaccatatgaactttattgc

SEQ ID NO: 591340 - DNA, 25 bp, Mus musculus
cccaggaccgaacgctcaggatttg

SEQ ID NO: 591341 - DNA, 25 bp, Mus musculus
cccaggaccgaaggctcaggatttg

SEQ ID NO: 591342 - DNA, 25 bp, Mus musculus
cccaggactggaattacagctagtt

SEQ ID NO: 591343 - DNA, 25 bp, Mus musculus
cccaggactggacgtcactcgaagg

SEQ ID NO: 591344 - DNA, 25 bp, Mus musculus
cccaggactggaggtcactcgaagg

SEQ ID NO: 591345 - DNA, 25 bp, Mus musculus
cccaggactggatttacagctagtt

SEQ ID NO: 591346 - DNA, 25 bp, Mus musculus
cccaggagaacacgagtgtgctgca

SEQ ID NO: 591347 - DNA, 25 bp, Mus musculus
cccaggagaacaggagtgtgctgca

SEQ ID NO: 591348 - DNA, 25 bp, Mus musculus
cccaggagacatctactgccctttt

SEQ ID NO: 591349 - DNA, 25 bp, Mus musculus
cccaggagacatgtactgccctttt

SEQ ID NO: 591350 - DNA, 25 bp, Mus musculus
cccaggagatggaagcttgccgctg

SEQ ID NO: 591351 - DNA, 25 bp, Mus musculus
cccaggagatggtagcttgccgctg

SEQ ID NO: 591352 - DNA, 25 bp, Mus musculus
cccaggagcaggctgggcatccagg

SEQ ID NO: 591353 - DNA, 25 bp, Mus musculus
cccaggagcagggtgggcatccagg

SEQ ID NO: 591354 - DNA, 25 bp, Mus musculus
cccaggaggactcagcactaaacct

SEQ ID NO: 591355 - DNA, 25 bp, Mus musculus
cccaggaggactgagcactaaacct

SEQ ID NO: 591356 - DNA, 25 bp, Mus musculus
cccaggaggagcaccgaactgtgga

SEQ ID NO: 591357 - DNA, 25 bp, Mus musculus
cccaggaggagctccgaactgtgga

SEQ ID NO: 591358 - DNA, 25 bp, Mus musculus
cccaggaggtacctattgagatcaa

SEQ ID NO: 591359 - DNA, 25 bp, Mus musculus
cccaggaggtacgtattgagatcaa

SEQ ID NO: 591360 - DNA, 25 bp, Mus musculus
cccaggagtctgcacatggctattg

SEQ ID NO: 591361 - DNA, 25 bp, Mus musculus
cccaggagtctggacatggctattg

SEQ ID NO: 591362 - DNA, 25 bp, Mus musculus
cccaggagttctaggagtcgctcaa

SEQ ID NO: 591363 - DNA, 25 bp, Mus musculus
cccaggagttcttggagtcgctcaa

SEQ ID NO: 591364 - DNA, 25 bp, Mus musculus
cccaggatatgaaatgacaacgtca

SEQ ID NO: 591365 - DNA, 25 bp, Mus musculus
cccaggatatgaacttgaggaagat

SEQ ID NO: 591366 - DNA, 25 bp, Mus musculus
cccaggatatgatatgacaacgtca

SEQ ID NO: 591367 - DNA, 25 bp, Mus musculus
cccaggatatgatcttgaggaagat

SEQ ID NO: 591368 - DNA, 25 bp, Mus musculus
cccaggatcagaccaaacttcaaag

SEQ ID NO: 591369 - DNA, 25 bp, Mus musculus
cccaggatcagagcaaacttcaaag

SEQ ID NO: 591370 - DNA, 25 bp, Mus musculus
cccaggatcattactggcaagagaa

SEQ ID NO: 591371 - DNA, 25 bp, Mus musculus
cccaggatcatttctggcaagagaa

SEQ ID NO: 591372 - DNA, 25 bp, Mus musculus
cccaggatcctcacaataaacttat

SEQ ID NO: 591373 - DNA, 25 bp, Mus musculus
cccaggatcctctcaataaacttat

SEQ ID NO: 591374 - DNA, 25 bp, Mus musculus
cccaggatggcgacggtaaagatca

SEQ ID NO: 591375 - DNA, 25 bp, Mus musculus
cccaggatggcgtcggtaaagatca

SEQ ID NO: 591376 - DNA, 25 bp, Mus musculus
cccaggatgggaacttcgatgaatt

SEQ ID NO: 591377 - DNA, 25 bp, Mus musculus
cccaggatgggatcttcgatgaatt

SEQ ID NO: 591378 - DNA, 25 bp, Mus musculus
cccaggatgggtataaactctcaga

SEQ ID NO: 591379 - DNA, 25 bp, Mus musculus
cccaggatgggtttaaactctcaga

SEQ ID NO: 591380 - DNA, 25 bp, Mus musculus
cccaggatgtccagatgtaaataaa

SEQ ID NO: 591381 - DNA, 25 bp, Mus musculus
cccaggatgtcctgatgtaaataaa

SEQ ID NO: 591382 - DNA, 25 bp, Mus musculus
cccaggattcatagacttcatagct

SEQ ID NO: 591383 - DNA, 25 bp, Mus musculus
cccaggattcattgacttcatagct

SEQ ID NO: 591384 - DNA, 25 bp, Mus musculus
cccaggattgaaactgacagccaca

SEQ ID NO: 591385 - DNA, 25 bp, Mus musculus
cccaggattgaatctgacagccaca

SEQ ID NO: 591386 - DNA, 25 bp, Mus musculus
cccaggattgaccaaggaaggaact

SEQ ID NO: 591387 - DNA, 25 bp, Mus musculus
cccaggattgacgaaggaaggaact

SEQ ID NO: 591388 - DNA, 25 bp, Mus musculus
cccaggcaagaactattctcatgca

SEQ ID NO: 591389 - DNA, 25 bp, Mus musculus
cccaggcaagaagtattctcatgca

SEQ ID NO: 591390 - DNA, 25 bp, Mus musculus
cccaggcaaggaattgaagcccaga

SEQ ID NO: 591391 - DNA, 25 bp, Mus musculus
cccaggcaaggatttgaagcccaga

SEQ ID NO: 591392 - DNA, 25 bp, Mus musculus
cccaggcaccatagcagcagtcata

SEQ ID NO: 591393 - DNA, 25 bp, Mus musculus
cccaggcaccattgcagcagtcata

SEQ ID NO: 591394 - DNA, 25 bp, Mus musculus
cccaggcagagtatgtggagaagtt

SEQ ID NO: 591395 - DNA, 25 bp, Mus musculus
cccaggcagagtttgtggagaagtt

SEQ ID NO: 591396 - DNA, 25 bp, Mus musculus
cccaggcaggaccacgaactgaaat

SEQ ID NO: 591397 - DNA, 25 bp, Mus musculus
cccaggcaggacgacgaactgaaat

SEQ ID NO: 591398 - DNA, 25 bp, Mus musculus
cccaggcaggagaggccttagccaa

SEQ ID NO: 591399 - DNA, 25 bp, Mus musculus
cccaggcaggagtggccttagccaa

SEQ ID NO: 591400 - DNA, 25 bp, Mus musculus
cccaggccctctaagcaagcaaggt

SEQ ID NO: 591401 - DNA, 25 bp, Mus musculus
cccaggccctcttagcaagcaaggt

SEQ ID NO: 591402 - DNA, 25 bp, Mus musculus
cccaggccttgtcatgttccagtaa

SEQ ID NO: 591403 - DNA, 25 bp, Mus musculus
cccaggccttgtgatgttccagtaa

SEQ ID NO: 591404 - DNA, 25 bp, Mus musculus
cccaggcgaaaccaggagagaccca

SEQ ID NO: 591405 - DNA, 25 bp, Mus musculus
cccaggcgaaacgaggagagaccca

SEQ ID NO: 591406 - DNA, 25 bp, Mus musculus
cccaggctattgctgacctcagatt

SEQ ID NO: 591407 - DNA, 25 bp, Mus musculus
cccaggctattggtgacctcagatt

SEQ ID NO: 591408 - DNA, 25 bp, Mus musculus
cccaggctgctcatattggtcaatc

SEQ ID NO: 591409 - DNA, 25 bp, Mus musculus
cccaggctgctcttattggtcaatc

SEQ ID NO: 591410 - DNA, 25 bp, Mus musculus
cccaggctggcaatacggttactac

SEQ ID NO: 591411 - DNA, 25 bp, Mus musculus
cccaggctggcattacggttactac

SEQ ID NO: 591412 - DNA, 25 bp, Mus musculus
cccaggctgtgaccatgcaggcatt

SEQ ID NO: 591413 - DNA, 25 bp, Mus musculus
cccaggctgtgagcatgcaggcatt

SEQ ID NO: 591414 - DNA, 25 bp, Mus musculus
cccaggcttgcgattctcattgaaa

SEQ ID NO: 591415 - DNA, 25 bp, Mus musculus
cccaggcttgcgtttctcattgaaa

SEQ ID NO: 591416 - DNA, 25 bp, Mus musculus
cccaggcttggcacactgtgaagac

SEQ ID NO: 591417 - DNA, 25 bp, Mus musculus
cccaggcttggctcactgtgaagac

SEQ ID NO: 591418 - DNA, 25 bp, Mus musculus
cccaggctttatccgagtggcactg

SEQ ID NO: 591419 - DNA, 25 bp, Mus musculus
cccaggctttatgcgagtggcactg

SEQ ID NO: 591420 - DNA, 25 bp, Mus musculus
cccaggcttttacgatcctctgaaa

SEQ ID NO: 591421 - DNA, 25 bp, Mus musculus
cccaggcttttaggatcctctgaaa

SEQ ID NO: 591422 - DNA, 25 bp, Mus musculus
cccagggaaaggaactgtggctagc

SEQ ID NO: 591423 - DNA, 25 bp, Mus musculus
cccagggaaaggtactgtggctagc

SEQ ID NO: 591424 - DNA, 25 bp, Mus musculus
cccagggacaagagaagttgatgag

SEQ ID NO: 591425 - DNA, 25 bp, Mus musculus
cccagggacaagtgaagttgatgag

SEQ ID NO: 591426 - DNA, 25 bp, Mus musculus
cccagggagagaagctctacctggc

SEQ ID NO: 591427 - DNA, 25 bp, Mus musculus
cccagggagagacttatgcccaggt

SEQ ID NO: 591428 - DNA, 25 bp, Mus musculus
cccagggagagagttatgcccaggt

SEQ ID NO: 591429 - DNA, 25 bp, Mus musculus
cccagggagagatgctctacctggc

SEQ ID NO: 591430 - DNA, 25 bp, Mus musculus
cccagggaggatcagacacttcaaa

SEQ ID NO: 591431 - DNA, 25 bp, Mus musculus
cccagggaggatgagacacttcaaa

SEQ ID NO: 591432 - DNA, 25 bp, Mus musculus
cccagggaggtcctcacaggtaacg

SEQ ID NO: 591433 - DNA, 25 bp, Mus musculus
cccagggaggtcgtcacaggtaacg

SEQ ID NO: 591434 - DNA, 25 bp, Mus musculus
cccagggagtggcagccagtccagt

SEQ ID NO: 591435 - DNA, 25 bp, Mus musculus
cccagggagtgggagccagtccagt

SEQ ID NO: 591436 - DNA, 25 bp, Mus musculus
cccagggatcgaatggttcaggttg

SEQ ID NO: 591437 - DNA, 25 bp, Mus musculus
cccagggatcgattggttcaggttg

SEQ ID NO: 591438 - DNA, 25 bp, Mus musculus
cccagggattgtagtggcgtcagac

SEQ ID NO: 591439 - DNA, 25 bp, Mus musculus
cccagggattgtcgttgtaagcctt

SEQ ID NO: 591440 - DNA, 25 bp, Mus musculus
cccagggattgtggttgtaagcctt

SEQ ID NO: 591441 - DNA, 25 bp, Mus musculus
cccagggattgttgtggcgtcagac

SEQ ID NO: 591442 - DNA, 25 bp, Mus musculus
cccagggcccaaagggatggccaca

SEQ ID NO: 591443 - DNA, 25 bp, Mus musculus
cccagggcccaatgggatggccaca

SEQ ID NO: 591444 - DNA, 25 bp, Mus musculus
cccagggccgctagagtttggttga

SEQ ID NO: 591445 - DNA, 25 bp, Mus musculus
cccagggccgcttgagtttggttga

SEQ ID NO: 591446 - DNA, 25 bp, Mus musculus
cccagggcgtgcaccagacgatttt

SEQ ID NO: 591447 - DNA, 25 bp, Mus musculus
cccagggcgtgctccagacgatttt

SEQ ID NO: 591448 - DNA, 25 bp, Mus musculus
cccagggctctccatgtgtgcagca

SEQ ID NO: 591449 - DNA, 25 bp, Mus musculus
cccagggctctcgatgtgtgcagca

SEQ ID NO: 591450 - DNA, 25 bp, Mus musculus
cccagggctgatctggatcaataaa

SEQ ID NO: 591451 - DNA, 25 bp, Mus musculus
cccagggctgatgtggatcaataaa

SEQ ID NO: 591452 - DNA, 25 bp, Mus musculus
cccagggctgggagatgtttgtgtc

SEQ ID NO: 591453 - DNA, 25 bp, Mus musculus
cccagggctgggtgatgtttgtgtc

SEQ ID NO: 591454 - DNA, 25 bp, Mus musculus
cccagggttgttcgtggctattgac

SEQ ID NO: 591455 - DNA, 25 bp, Mus musculus
cccagggttgttggtggctattgac

SEQ ID NO: 591456 - DNA, 25 bp, Mus musculus
cccaggtaatcacggaaggcttcca

SEQ ID NO: 591457 - DNA, 25 bp, Mus musculus
cccaggtaatcagggaaggcttcca

SEQ ID NO: 591458 - DNA, 25 bp, Mus musculus
cccaggtagaagaggagtagcaaca

SEQ ID NO: 591459 - DNA, 25 bp, Mus musculus
cccaggtagaagtggagtagcaaca

SEQ ID NO: 591460 - DNA, 25 bp, Mus musculus
cccaggtcacacaggtggctgttat

SEQ ID NO: 591461 - DNA, 25 bp, Mus musculus
cccaggtcacactggtggctgttat

SEQ ID NO: 591462 - DNA, 25 bp, Mus musculus
cccaggtccaatcgacaacactaaa

SEQ ID NO: 591463 - DNA, 25 bp, Mus musculus
cccaggtccaatggacaacactaaa

SEQ ID NO: 591464 - DNA, 25 bp, Mus musculus
cccaggtcccttaagtgtacagaga

SEQ ID NO: 591465 - DNA, 25 bp, Mus musculus
cccaggtccctttagtgtacagaga

SEQ ID NO: 591466 - DNA, 25 bp, Mus musculus
cccaggtcttcacgaacctgagaga

SEQ ID NO: 591467 - DNA, 25 bp, Mus musculus
cccaggtcttcaggaacctgagaga

SEQ ID NO: 591468 - DNA, 25 bp, Mus musculus
cccaggtcttggagccgaacataca

SEQ ID NO: 591469 - DNA, 25 bp, Mus musculus
cccaggtcttggtgccgaacataca

SEQ ID NO: 591470 - DNA, 25 bp, Mus musculus
cccaggtgaactccttaaacaaagt

SEQ ID NO: 591471 - DNA, 25 bp, Mus musculus
cccaggtgaactgcttaaacaaagt

SEQ ID NO: 591472 - DNA, 25 bp, Mus musculus
cccaggtgaccacatggtggcctca

SEQ ID NO: 591473 - DNA, 25 bp, Mus musculus
cccaggtgaccagatggtggcctca

SEQ ID NO: 591474 - DNA, 25 bp, Mus musculus
cccaggtgaggaatgataatgagcc

SEQ ID NO: 591475 - DNA, 25 bp, Mus musculus
cccaggtgaggattgataatgagcc

SEQ ID NO: 591476 - DNA, 25 bp, Mus musculus
cccaggtgatggcttactaaggatc

SEQ ID NO: 591477 - DNA, 25 bp, Mus musculus
cccaggtgatgggttactaaggatc

SEQ ID NO: 591478 - DNA, 25 bp, Mus musculus
cccaggtgctggatgtcatgtttaa

SEQ ID NO: 591479 - DNA, 25 bp, Mus musculus
cccaggtgctggttgtcatgtttaa

SEQ ID NO: 591480 - DNA, 25 bp, Mus musculus
cccaggtgctgtccacatatatgaa

SEQ ID NO: 591481 - DNA, 25 bp, Mus musculus
cccaggtgctgtgcacatatatgaa

SEQ ID NO: 591482 - DNA, 25 bp, Mus musculus
cccaggtgggaaacatgtggcctaa

SEQ ID NO: 591483 - DNA, 25 bp, Mus musculus
cccaggtgggaatcatgtggcctaa

SEQ ID NO: 591484 - DNA, 25 bp, Mus musculus
cccaggtgtcagaggaggttgcctt

SEQ ID NO: 591485 - DNA, 25 bp, Mus musculus
cccaggtgtcagtggaggttgcctt

SEQ ID NO: 591486 - DNA, 25 bp, Mus musculus
cccaggtgttggagatgctgaacct

SEQ ID NO: 591487 - DNA, 25 bp, Mus musculus
cccaggtgttggtgatgctgaacct

SEQ ID NO: 591488 - DNA, 25 bp, Mus musculus
cccaggttatccaggctggaaacaa

SEQ ID NO: 591489 - DNA, 25 bp, Mus musculus
cccaggttatcctggctggaaacaa

SEQ ID NO: 591490 - DNA, 25 bp, Mus musculus
cccaggttcaggctccaagttagaa

SEQ ID NO: 591491 - DNA, 25 bp, Mus musculus
cccaggttcagggtccaagttagaa

SEQ ID NO: 591492 - DNA, 25 bp, Mus musculus
cccaggttggcacgaagctcctgaa

SEQ ID NO: 591493 - DNA, 25 bp, Mus musculus
cccaggttggcaggaagctcctgaa

SEQ ID NO: 591494 - DNA, 25 bp, Mus musculus
cccaggtttctgagaagctggtttt

SEQ ID NO: 591495 - DNA, 25 bp, Mus musculus
cccaggtttctgtgaagctggtttt

SEQ ID NO: 591496 - DNA, 25 bp, Mus musculus
cccagtaatcgtctaagggaccatt

SEQ ID NO: 591497 - DNA, 25 bp, Mus musculus
cccagtaatcgtgtaagggaccatt

SEQ ID NO: 591498 - DNA, 25 bp, Mus musculus
cccagtacatgtaggaaatgtttca

SEQ ID NO: 591499 - DNA, 25 bp, Mus musculus
cccagtacatgttggaaatgtttca

SEQ ID NO: 591500 - DNA, 25 bp, Mus musculus
cccagtaccctacccggatgattgt

SEQ ID NO: 591501 - DNA, 25 bp, Mus musculus
cccagtaccctagccggatgattgt

SEQ ID NO: 591502 - DNA, 25 bp, Mus musculus
cccagtagaggtccaaagttaccag

SEQ ID NO: 591503 - DNA, 25 bp, Mus musculus
cccagtagaggtgcaaagttaccag

SEQ ID NO: 591504 - DNA, 25 bp, Mus musculus
cccagtagctttagcaggattcaac

SEQ ID NO: 591505 - DNA, 25 bp, Mus musculus
cccagtagcttttgcaggattcaac

SEQ ID NO: 591506 - DNA, 25 bp, Mus musculus
cccagtatcttgagagccaggcaga

SEQ ID NO: 591507 - DNA, 25 bp, Mus musculus
cccagtatcttgtgagccaggcaga

SEQ ID NO: 591508 - DNA, 25 bp, Mus musculus
cccagtatgcagcacaaagatgcca

SEQ ID NO: 591509 - DNA, 25 bp, Mus musculus
cccagtatgcaggacaaagatgcca

SEQ ID NO: 591510 - DNA, 25 bp, Mus musculus
cccagtcaagtaatgctgtagctga

SEQ ID NO: 591511 - DNA, 25 bp, Mus musculus
cccagtcaagtattgctgtagctga

SEQ ID NO: 591512 - DNA, 25 bp, Mus musculus
cccagtcaggagagtttgtcattag

SEQ ID NO: 591513 - DNA, 25 bp, Mus musculus
cccagtcaggagtgtttgtcattag

SEQ ID NO: 591514 - DNA, 25 bp, Mus musculus
cccagtcatctgattcgagtagaag

SEQ ID NO: 591515 - DNA, 25 bp, Mus musculus
cccagtcatctgtttcgagtagaag

SEQ ID NO: 591516 - DNA, 25 bp, Mus musculus
cccagtctgtgccagaagtatttgc

SEQ ID NO: 591517 - DNA, 25 bp, Mus musculus
cccagtctgtgcgagaagtatttgc

SEQ ID NO: 591518 - DNA, 25 bp, Mus musculus
cccagtgaaaaacccctgagctttg

SEQ ID NO: 591519 - DNA, 25 bp, Mus musculus
cccagtgaaaaagccctgagctttg

SEQ ID NO: 591520 - DNA, 25 bp, Mus musculus
cccagtgaggagagtccacttgact

SEQ ID NO: 591521 - DNA, 25 bp, Mus musculus
cccagtgaggagtgtccacttgact

SEQ ID NO: 591522 - DNA, 25 bp, Mus musculus
cccagtgaggtgcagaaagccaaag

SEQ ID NO: 591523 - DNA, 25 bp, Mus musculus
cccagtgaggtggagaaagccaaag

SEQ ID NO: 591524 - DNA, 25 bp, Mus musculus
cccagtgagtgtcgaagctctaggt

SEQ ID NO: 591525 - DNA, 25 bp, Mus musculus
cccagtgagtgtggaagctctaggt

SEQ ID NO: 591526 - DNA, 25 bp, Mus musculus
cccagtgatgaccagctaagcctca

SEQ ID NO: 591527 - DNA, 25 bp, Mus musculus
cccagtgatgacgagctaagcctca

SEQ ID NO: 591528 - DNA, 25 bp, Mus musculus
cccagtgatgttcctgccagatgac

SEQ ID NO: 591529 - DNA, 25 bp, Mus musculus
cccagtgatgttgctgccagatgac

SEQ ID NO: 591530 - DNA, 25 bp, Mus musculus
cccagtgattatcgcatctatacaa

SEQ ID NO: 591531 - DNA, 25 bp, Mus musculus
cccagtgattatggcatctatacaa

SEQ ID NO: 591532 - DNA, 25 bp, Mus musculus
cccagtgcacggcatgttacgccag

SEQ ID NO: 591533 - DNA, 25 bp, Mus musculus
cccagtgcacgggatgttacgccag

SEQ ID NO: 591534 - DNA, 25 bp, Mus musculus
cccagtgcagagaccggagatgttc

SEQ ID NO: 591535 - DNA, 25 bp, Mus musculus
cccagtgcagagagtggagaagatc

SEQ ID NO: 591536 - DNA, 25 bp, Mus musculus
cccagtgcagagtccggagatgttc

SEQ ID NO: 591537 - DNA, 25 bp, Mus musculus
cccagtgcagagtgtggagaagatc

SEQ ID NO: 591538 - DNA, 25 bp, Mus musculus
cccagtgcagggatttgatatagca

SEQ ID NO: 591539 - DNA, 25 bp, Mus musculus
cccagtgcagggttttgatatagca

SEQ ID NO: 591540 - DNA, 25 bp, Mus musculus
cccagtgcccgacttcacagagtga

SEQ ID NO: 591541 - DNA, 25 bp, Mus musculus
cccagtgcccgagttcacagagtga

SEQ ID NO: 591542 - DNA, 25 bp, Mus musculus
cccagtgctggaccggatccgcaag

SEQ ID NO: 591543 - DNA, 25 bp, Mus musculus
cccagtgctggagcggatccgcaag

SEQ ID NO: 591544 - DNA, 25 bp, Mus musculus
cccagtgcttaaagtggagatgccc

SEQ ID NO: 591545 - DNA, 25 bp, Mus musculus
cccagtgcttaatgtggagatgccc

SEQ ID NO: 591546 - DNA, 25 bp, Mus musculus
cccagtgcttgaagctgaaggtgac

SEQ ID NO: 591547 - DNA, 25 bp, Mus musculus
cccagtgcttgatgctgaaggtgac

SEQ ID NO: 591548 - DNA, 25 bp, Mus musculus
cccagtggacgcaccggagtttgtg

SEQ ID NO: 591549 - DNA, 25 bp, Mus musculus
cccagtggacgctccggagtttgtg

SEQ ID NO: 591550 - DNA, 25 bp, Mus musculus
cccagtggtcaacgttacatcccag

SEQ ID NO: 591551 - DNA, 25 bp, Mus musculus
cccagtggtcaaggttacatcccag

SEQ ID NO: 591552 - DNA, 25 bp, Mus musculus
cccagtgtatgaccctgtgaattac

SEQ ID NO: 591553 - DNA, 25 bp, Mus musculus
cccagtgtatgagcctgtgaattac

SEQ ID NO: 591554 - DNA, 25 bp, Mus musculus
cccagtgtctacactggtggagttt

SEQ ID NO: 591555 - DNA, 25 bp, Mus musculus
cccagtgtctactctggtggagttt

SEQ ID NO: 591556 - DNA, 25 bp, Mus musculus
cccagtgttagactgcttgttcagc

SEQ ID NO: 591557 - DNA, 25 bp, Mus musculus
cccagtgttagagtgcttgttcagc

SEQ ID NO: 591558 - DNA, 25 bp, Mus musculus
cccagtgtttccaggacttttcgag

SEQ ID NO: 591559 - DNA, 25 bp, Mus musculus
cccagtgtttcctggacttttcgag

SEQ ID NO: 591560 - DNA, 25 bp, Mus musculus
cccagttaaaatcggatctgtttat

SEQ ID NO: 591561 - DNA, 25 bp, Mus musculus
cccagttaaaatgggatctgtttat

SEQ ID NO: 591562 - DNA, 25 bp, Mus musculus
cccagttatttacgagtgcaaagca

SEQ ID NO: 591563 - DNA, 25 bp, Mus musculus
cccagttatttaggagtgcaaagca

SEQ ID NO: 591564 - DNA, 25 bp, Mus musculus
cccagttccaggagcggactcgcat

SEQ ID NO: 591565 - DNA, 25 bp, Mus musculus
cccagttccaggcagctctggatga

SEQ ID NO: 591566 - DNA, 25 bp, Mus musculus
cccagttccagggagctctggatga

SEQ ID NO: 591567 - DNA, 25 bp, Mus musculus
cccagttccaggtgcggactcgcat

SEQ ID NO: 591568 - DNA, 25 bp, Mus musculus
cccagttccattcttgacaatctac

SEQ ID NO: 591569 - DNA, 25 bp, Mus musculus
cccagttccattgttgacaatctac

SEQ ID NO: 591570 - DNA, 25 bp, Mus musculus
cccagttcggcgctgttgatcagag

SEQ ID NO: 591571 - DNA, 25 bp, Mus musculus
cccagttcggcggtgttgatcagag

SEQ ID NO: 591572 - DNA, 25 bp, Mus musculus
cccagttgcctgactttcgtgaatg

SEQ ID NO: 591573 - DNA, 25 bp, Mus musculus
cccagttgcctgtctttcgtgaatg

SEQ ID NO: 591574 - DNA, 25 bp, Mus musculus
cccagttggactagagaggctgcat

SEQ ID NO: 591575 - DNA, 25 bp, Mus musculus
cccagttggacttgagaggctgcat

SEQ ID NO: 591576 - DNA, 25 bp, Mus musculus
cccagttggaggatgagtagatgcc

SEQ ID NO: 591577 - DNA, 25 bp, Mus musculus
cccagttggaggttgagtagatgcc

SEQ ID NO: 591578 - DNA, 25 bp, Mus musculus
cccagttggagtacctagcccacag

SEQ ID NO: 591579 - DNA, 25 bp, Mus musculus
cccagttggagttcctagcccacag

SEQ ID NO: 591580 - DNA, 25 bp, Mus musculus
cccagttgggttagaaagaccagca

SEQ ID NO: 591581 - DNA, 25 bp, Mus musculus
cccagttgggtttgaaagaccagca

SEQ ID NO: 591582 - DNA, 25 bp, Mus musculus
cccagtttaactcggaggagcagtg

SEQ ID NO: 591583 - DNA, 25 bp, Mus musculus
cccagtttaactgggaggagcagtg

SEQ ID NO: 591584 - DNA, 25 bp, Mus musculus
cccagtttagaactgactataacag

SEQ ID NO: 591585 - DNA, 25 bp, Mus musculus
cccagtttagaagtgactataacag

SEQ ID NO: 591586 - DNA, 25 bp, Mus musculus
cccataaaattgaggctgagtatcc

SEQ ID NO: 591587 - DNA, 25 bp, Mus musculus
cccataaaattgtggctgagtatcc

SEQ ID NO: 591588 - DNA, 25 bp, Mus musculus
cccataaactggcatgatctgtacc

SEQ ID NO: 591589 - DNA, 25 bp, Mus musculus
cccataaactgggatgatctgtacc

SEQ ID NO: 591590 - DNA, 25 bp, Mus musculus
cccataagggtgaaattcgtggagc

SEQ ID NO: 591591 - DNA, 25 bp, Mus musculus
cccataagggtgtaattcgtggagc

SEQ ID NO: 591592 - DNA, 25 bp, Mus musculus
cccataccagccattggagtgcata

SEQ ID NO: 591593 - DNA, 25 bp, Mus musculus
cccataccagcctttggagtgcata

SEQ ID NO: 591594 - DNA, 25 bp, Mus musculus
cccataccctggcattccggtggag

SEQ ID NO: 591595 - DNA, 25 bp, Mus musculus
cccataccctgggattccggtggag

SEQ ID NO: 591596 - DNA, 25 bp, Mus musculus
cccatacctttgagtcctggcacag

SEQ ID NO: 591597 - DNA, 25 bp, Mus musculus
cccatacctttgtgtcctggcacag

SEQ ID NO: 591598 - DNA, 25 bp, Mus musculus
cccatacggtaacctggccagtgaa

SEQ ID NO: 591599 - DNA, 25 bp, Mus musculus
cccatacggtaagctggccagtgaa

SEQ ID NO: 591600 - DNA, 25 bp, Mus musculus
cccatagagaggattacaacagtac

SEQ ID NO: 591601 - DNA, 25 bp, Mus musculus
cccatagagaggtttacaacagtac

SEQ ID NO: 591602 - DNA, 25 bp, Mus musculus
cccatagagcttacgacaatgatgt

SEQ ID NO: 591603 - DNA, 25 bp, Mus musculus
cccatagagctttcgacaatgatgt

SEQ ID NO: 591604 - DNA, 25 bp, Mus musculus
cccatagaggatcactgcggtgact

SEQ ID NO: 591605 - DNA, 25 bp, Mus musculus
cccatagaggatgactgcggtgact

SEQ ID NO: 591606 - DNA, 25 bp, Mus musculus
cccatatatagacaccagtgccaag

SEQ ID NO: 591607 - DNA, 25 bp, Mus musculus
cccatatatagagaccagtgccaag

SEQ ID NO: 591608 - DNA, 25 bp, Mus musculus
cccatatatgcgagtgcgacgctaa

SEQ ID NO: 591609 - DNA, 25 bp, Mus musculus
cccatatatgcgtgtgcgacgctaa

SEQ ID NO: 591610 - DNA, 25 bp, Mus musculus
cccatatccatgcatcccttgtata

SEQ ID NO: 591611 - DNA, 25 bp, Mus musculus
cccatatccatggatcccttgtata

SEQ ID NO: 591612 - DNA, 25 bp, Mus musculus
cccatatctggtctggttttactat

SEQ ID NO: 591613 - DNA, 25 bp, Mus musculus
cccatatctggtgtggttttactat

SEQ ID NO: 591614 - DNA, 25 bp, Mus musculus
cccatatgaggcagtccacagccat

SEQ ID NO: 591615 - DNA, 25 bp, Mus musculus
cccatatgaggctgtccacagccat

SEQ ID NO: 591616 - DNA, 25 bp, Mus musculus
cccatcagccagaagatgtacgcca

SEQ ID NO: 591617 - DNA, 25 bp, Mus musculus
cccatcagccagtagatgtacgcca

SEQ ID NO: 591618 - DNA, 25 bp, Mus musculus
cccatcaggaaacaggcaagattgc

SEQ ID NO: 591619 - DNA, 25 bp, Mus musculus
cccatcaggaaagaggcaagattgc

SEQ ID NO: 591620 - DNA, 25 bp, Mus musculus
cccatcagtaacatctttgcgtgca

SEQ ID NO: 591621 - DNA, 25 bp, Mus musculus
cccatcagtaacttctttgcgtgca

SEQ ID NO: 591622 - DNA, 25 bp, Mus musculus
cccatcagtagtctgttggtgaata

SEQ ID NO: 591623 - DNA, 25 bp, Mus musculus
cccatcagtagtgtgttggtgaata

SEQ ID NO: 591624 - DNA, 25 bp, Mus musculus
cccatcagtattagctgttgttctc

SEQ ID NO: 591625 - DNA, 25 bp, Mus musculus
cccatcagtatttgctgttgttctc

SEQ ID NO: 591626 - DNA, 25 bp, Mus musculus
cccatcagtctcacagtggccaagt

SEQ ID NO: 591627 - DNA, 25 bp, Mus musculus
cccatcagtctctcagtggccaagt

SEQ ID NO: 591628 - DNA, 25 bp, Mus musculus
cccatcatcacgaccctgagggagg

SEQ ID NO: 591629 - DNA, 25 bp, Mus musculus
cccatcatcacgtccctgagggagg

SEQ ID NO: 591630 - DNA, 25 bp, Mus musculus
cccatcatgaacctgcacgagcgga

SEQ ID NO: 591631 - DNA, 25 bp, Mus musculus
cccatcatgaacgtgcacgagcgga

SEQ ID NO: 591632 - DNA, 25 bp, Mus musculus
cccatcatggaaaaggcccctgaag

SEQ ID NO: 591633 - DNA, 25 bp, Mus musculus
cccatcatggaataggcccctgaag

SEQ ID NO: 591634 - DNA, 25 bp, Mus musculus
cccatcattccgacagatcttgctg

SEQ ID NO: 591635 - DNA, 25 bp, Mus musculus
cccatcattccgtcagatcttgctg

SEQ ID NO: 591636 - DNA, 25 bp, Mus musculus
cccatccagactataatcctgatga

SEQ ID NO: 591637 - DNA, 25 bp, Mus musculus
cccatccagactttaatcctgatga

SEQ ID NO: 591638 - DNA, 25 bp, Mus musculus
cccatcccgaagagcagtggagatc

SEQ ID NO: 591639 - DNA, 25 bp, Mus musculus
cccatcccgaagtgcagtggagatc

SEQ ID NO: 591640 - DNA, 25 bp, Mus musculus
cccatcctcaggaagtgtgtgccaa

SEQ ID NO: 591641 - DNA, 25 bp, Mus musculus
cccatcctcaggtagtgtgtgccaa

SEQ ID NO: 591642 - DNA, 25 bp, Mus musculus
cccatcgcttgtacatcgtgcatga

SEQ ID NO: 591643 - DNA, 25 bp, Mus musculus
cccatcgcttgttcatcgtgcatga

SEQ ID NO: 591644 - DNA, 25 bp, Mus musculus
cccatcgtacctactgcagttgaac

SEQ ID NO: 591645 - DNA, 25 bp, Mus musculus
cccatcgtaccttctgcagttgaac

SEQ ID NO: 591646 - DNA, 25 bp, Mus musculus
cccatcgtgacgaagctggtgcagc

SEQ ID NO: 591647 - DNA, 25 bp, Mus musculus
cccatcgtgacgtagctggtgcagc

SEQ ID NO: 591648 - DNA, 25 bp, Mus musculus
cccatctaggataccagagagaaaa

SEQ ID NO: 591649 - DNA, 25 bp, Mus musculus
cccatctaggattccagagagaaaa

SEQ ID NO: 591650 - DNA, 25 bp, Mus musculus
cccatctcggtacaggacagtgtct

SEQ ID NO: 591651 - DNA, 25 bp, Mus musculus
cccatctcggtagaggacagtgtct

SEQ ID NO: 591652 - DNA, 25 bp, Mus musculus
cccatctgcacgaggtgtgttggac

SEQ ID NO: 591653 - DNA, 25 bp, Mus musculus
cccatctgcacgtggtgtgttggac

SEQ ID NO: 591654 - DNA, 25 bp, Mus musculus
cccatctgtcaaactatggaaatga

SEQ ID NO: 591655 - DNA, 25 bp, Mus musculus
cccatctgtcaatctatggaaatga

SEQ ID NO: 591656 - DNA, 25 bp, Mus musculus
cccatcttggatccaataccagttg

SEQ ID NO: 591657 - DNA, 25 bp, Mus musculus
cccatcttggatgcaataccagttg

SEQ ID NO: 591658 - DNA, 25 bp, Mus musculus
cccatcttggctcgcgtaatgctgg

SEQ ID NO: 591659 - DNA, 25 bp, Mus musculus
cccatcttggctggcgtaatgctgg

SEQ ID NO: 591660 - DNA, 25 bp, Mus musculus
cccatcttgggaagacaatgttgtc

SEQ ID NO: 591661 - DNA, 25 bp, Mus musculus
cccatcttgggatgacaatgttgtc

SEQ ID NO: 591662 - DNA, 25 bp, Mus musculus
cccatgaaatcacaacagacattcc

SEQ ID NO: 591663 - DNA, 25 bp, Mus musculus
cccatgaaatcagaacagacattcc

SEQ ID NO: 591664 - DNA, 25 bp, Mus musculus
cccatgaacattacttccacagaag

SEQ ID NO: 591665 - DNA, 25 bp, Mus musculus
cccatgaacatttcttccacagaag

SEQ ID NO: 591666 - DNA, 25 bp, Mus musculus
cccatgaactggcaaaatgctagaa

SEQ ID NO: 591667 - DNA, 25 bp, Mus musculus
cccatgaactgggaaaatgctagaa

SEQ ID NO: 591668 - DNA, 25 bp, Mus musculus
cccatgaagaggctaccagccatga

SEQ ID NO: 591669 - DNA, 25 bp, Mus musculus
cccatgaagagggtaccagccatga

SEQ ID NO: 591670 - DNA, 25 bp, Mus musculus
cccatgaaggatcatgacatgaagt

SEQ ID NO: 591671 - DNA, 25 bp, Mus musculus
cccatgaaggatgatgacatgaagt

SEQ ID NO: 591672 - DNA, 25 bp, Mus musculus
cccatgaaggcgagcccagtgagtg

SEQ ID NO: 591673 - DNA, 25 bp, Mus musculus
cccatgaaggcgtgcccagtgagtg

SEQ ID NO: 591674 - DNA, 25 bp, Mus musculus
cccatgaagtatacctcttgtcctg

SEQ ID NO: 591675 - DNA, 25 bp, Mus musculus
cccatgaagtattcctcttgtcctg

SEQ ID NO: 591676 - DNA, 25 bp, Mus musculus
cccatgacaaatcgagaaagcaagt

SEQ ID NO: 591677 - DNA, 25 bp, Mus musculus
cccatgacaaatggagaaagcaagt

SEQ ID NO: 591678 - DNA, 25 bp, Mus musculus
cccatgaccaacatgagctggagct

SEQ ID NO: 591679 - DNA, 25 bp, Mus musculus
cccatgaccaacttgagctggagct

SEQ ID NO: 591680 - DNA, 25 bp, Mus musculus
cccatgactttgctatcaactttga

SEQ ID NO: 591681 - DNA, 25 bp, Mus musculus
cccatgactttggtatcaactttga

SEQ ID NO: 591682 - DNA, 25 bp, Mus musculus
cccatgagaggtactactagatctt

SEQ ID NO: 591683 - DNA, 25 bp, Mus musculus
cccatgagaggttctactagatctt

SEQ ID NO: 591684 - DNA, 25 bp, Mus musculus
cccatgagattgcttaacttcccta

SEQ ID NO: 591685 - DNA, 25 bp, Mus musculus
cccatgagattggttaacttcccta

SEQ ID NO: 591686 - DNA, 25 bp, Mus musculus
cccatgagcaggctatcaagtctcc

SEQ ID NO: 591687 - DNA, 25 bp, Mus musculus
cccatgagcagggtatcaagtctcc

SEQ ID NO: 591688 - DNA, 25 bp, Mus musculus
cccatgagcctgcacgagtatcaag

SEQ ID NO: 591689 - DNA, 25 bp, Mus musculus
cccatgagcctggacgagtatcaag

SEQ ID NO: 591690 - DNA, 25 bp, Mus musculus
cccatgaggtggaggtgcagtacta

SEQ ID NO: 591691 - DNA, 25 bp, Mus musculus
cccatgaggtggtggtgcagtacta

SEQ ID NO: 591692 - DNA, 25 bp, Mus musculus
cccatgagtgctctttacattgaga

SEQ ID NO: 591693 - DNA, 25 bp, Mus musculus
cccatgagtgctgtttacattgaga

SEQ ID NO: 591694 - DNA, 25 bp, Mus musculus
cccatgagttatcatgagaagagac

SEQ ID NO: 591695 - DNA, 25 bp, Mus musculus
cccatgagttatgatgagaagagac

SEQ ID NO: 591696 - DNA, 25 bp, Mus musculus
cccatgatggatcgcagactctgta

SEQ ID NO: 591697 - DNA, 25 bp, Mus musculus
cccatgatggatggcagactctgta

SEQ ID NO: 591698 - DNA, 25 bp, Mus musculus
cccatgatgggaagcgcttccggaa

SEQ ID NO: 591699 - DNA, 25 bp, Mus musculus
cccatgatgggatgcgcttccggaa

SEQ ID NO: 591700 - DNA, 25 bp, Mus musculus
cccatgatgtctagaagaaagcgcg

SEQ ID NO: 591701 - DNA, 25 bp, Mus musculus
cccatgatgtcttgaagaaagcgcg

SEQ ID NO: 591702 - DNA, 25 bp, Mus musculus
cccatgcagatgcaaaagtccaggt

SEQ ID NO: 591703 - DNA, 25 bp, Mus musculus
cccatgcagatggaaaagtccaggt

SEQ ID NO: 591704 - DNA, 25 bp, Mus musculus
cccatgccgcggctgtccgaaatat

SEQ ID NO: 591705 - DNA, 25 bp, Mus musculus
cccatgccgcgggtgtccgaaatat

SEQ ID NO: 591706 - DNA, 25 bp, Mus musculus
cccatgccggagactgtacttcaga

SEQ ID NO: 591707 - DNA, 25 bp, Mus musculus
cccatgccggagtctgtacttcaga

SEQ ID NO: 591708 - DNA, 25 bp, Mus musculus
cccatgcctctgcaacgggtgcaga

SEQ ID NO: 591709 - DNA, 25 bp, Mus musculus
cccatgcctctggaacgggtgcaga

SEQ ID NO: 591710 - DNA, 25 bp, Mus musculus
cccatgctaatgaggtgatctgcta

SEQ ID NO: 591711 - DNA, 25 bp, Mus musculus
cccatgctaatgtggtgatctgcta

SEQ ID NO: 591712 - DNA, 25 bp, Mus musculus
cccatgctgagtagcagcggcagcg

SEQ ID NO: 591713 - DNA, 25 bp, Mus musculus
cccatgctgagttgcagcggcagcg

SEQ ID NO: 591714 - DNA, 25 bp, Mus musculus
cccatgctggctcgagtctccgaat

SEQ ID NO: 591715 - DNA, 25 bp, Mus musculus
cccatgctggctggagtctccgaat

SEQ ID NO: 591716 - DNA, 25 bp, Mus musculus
cccatgcttcaactggaccggagga

SEQ ID NO: 591717 - DNA, 25 bp, Mus musculus
cccatgcttcaagtggaccggagga

SEQ ID NO: 591718 - DNA, 25 bp, Mus musculus
cccatgcttctgactccggtggaag

SEQ ID NO: 591719 - DNA, 25 bp, Mus musculus
cccatgcttctgtctccggtggaag

SEQ ID NO: 591720 - DNA, 25 bp, Mus musculus
cccatgcttgggaatgcaggcaatc

SEQ ID NO: 591721 - DNA, 25 bp, Mus musculus
cccatgcttgggtatgcaggcaatc

SEQ ID NO: 591722 - DNA, 25 bp, Mus musculus
cccatggaacatagcaccacacgtt

SEQ ID NO: 591723 - DNA, 25 bp, Mus musculus
cccatggaacattgcaccacacgtt

SEQ ID NO: 591724 - DNA, 25 bp, Mus musculus
cccatggaagatagacacaatatcc

SEQ ID NO: 591725 - DNA, 25 bp, Mus musculus
cccatggaagattgacacaatatcc

SEQ ID NO: 591726 - DNA, 25 bp, Mus musculus
cccatggaagtacaagagggatatg

SEQ ID NO: 591727 - DNA, 25 bp, Mus musculus
cccatggaagtagaagagggatatg

SEQ ID NO: 591728 - DNA, 25 bp, Mus musculus
cccatggacagcagtgcatattcct

SEQ ID NO: 591729 - DNA, 25 bp, Mus musculus
cccatggacagctgtgcatattcct

SEQ ID NO: 591730 - DNA, 25 bp, Mus musculus
cccatggagctgcttcgctgtatcc

SEQ ID NO: 591731 - DNA, 25 bp, Mus musculus
cccatggagctggttcgctgtatcc

SEQ ID NO: 591732 - DNA, 25 bp, Mus musculus
cccatggattctacagtggaggatg

SEQ ID NO: 591733 - DNA, 25 bp, Mus musculus
cccatggattcttcagtggaggatg

SEQ ID NO: 591734 - DNA, 25 bp, Mus musculus
cccatggcatcaaagttgtgtatga

SEQ ID NO: 591735 - DNA, 25 bp, Mus musculus
cccatggcatcatagttgtgtatga

SEQ ID NO: 591736 - DNA, 25 bp, Mus musculus
cccatgggcgctcattacatcatta

SEQ ID NO: 591737 - DNA, 25 bp, Mus musculus
cccatgggcgctgattacatcatta

SEQ ID NO: 591738 - DNA, 25 bp, Mus musculus
cccatggtagagatcgacgggatga

SEQ ID NO: 591739 - DNA, 25 bp, Mus musculus
cccatggtagagttcgacgggatga

SEQ ID NO: 591740 - DNA, 25 bp, Mus musculus
cccatggtggctcctagtccggaga

SEQ ID NO: 591741 - DNA, 25 bp, Mus musculus
cccatggtggctgctagtccggaga

SEQ ID NO: 591742 - DNA, 25 bp, Mus musculus
cccatggtgttgactccttctgtga

SEQ ID NO: 591743 - DNA, 25 bp, Mus musculus
cccatggtgttgtctccttctgtga

SEQ ID NO: 591744 - DNA, 25 bp, Mus musculus
cccatgtaaagaacggtgaggtagg

SEQ ID NO: 591745 - DNA, 25 bp, Mus musculus
cccatgtaaagatcggtgaggtagg

SEQ ID NO: 591746 - DNA, 25 bp, Mus musculus
cccatgtctgaacggaggcacctgc

SEQ ID NO: 591747 - DNA, 25 bp, Mus musculus
cccatgtctgaagggaggcacctgc

SEQ ID NO: 591748 - DNA, 25 bp, Mus musculus
cccatgtgcagaatctatgaatttg

SEQ ID NO: 591749 - DNA, 25 bp, Mus musculus
cccatgtgcagattctatgaatttg

SEQ ID NO: 591750 - DNA, 25 bp, Mus musculus
cccatgtgcatgcatgacaaccagg

SEQ ID NO: 591751 - DNA, 25 bp, Mus musculus
cccatgtgcatggatgacaaccagg

SEQ ID NO: 591752 - DNA, 25 bp, Mus musculus
cccatgtgtatgcatcctgagccca

SEQ ID NO: 591753 - DNA, 25 bp, Mus musculus
cccatgtgtatggatcctgagccca

SEQ ID NO: 591754 - DNA, 25 bp, Mus musculus
cccatgtttgaacagacatgctgct

SEQ ID NO: 591755 - DNA, 25 bp, Mus musculus
cccatgtttgaagagacatgctgct

SEQ ID NO: 591756 - DNA, 25 bp, Mus musculus
cccattaagacacggttccaggaat

SEQ ID NO: 591757 - DNA, 25 bp, Mus musculus
cccattaagacagggttccaggaat

SEQ ID NO: 591758 - DNA, 25 bp, Mus musculus
cccattagaaggcacttggcctgcc

SEQ ID NO: 591759 - DNA, 25 bp, Mus musculus
cccattagaagggacttggcctgcc

SEQ ID NO: 591760 - DNA, 25 bp, Mus musculus
cccattagtccaagccaggtataga

SEQ ID NO: 591761 - DNA, 25 bp, Mus musculus
cccattagtccatgccaggtataga

SEQ ID NO: 591762 - DNA, 25 bp, Mus musculus
cccattatttttcatggagcagcag

SEQ ID NO: 591763 - DNA, 25 bp, Mus musculus
cccattatttttgatggagcagcag

SEQ ID NO: 591764 - DNA, 25 bp, Mus musculus
cccattcaccttaaccatgacaata

SEQ ID NO: 591765 - DNA, 25 bp, Mus musculus
cccattcacctttaccatgacaata

SEQ ID NO: 591766 - DNA, 25 bp, Mus musculus
cccattcattgaaccagaatacatg

SEQ ID NO: 591767 - DNA, 25 bp, Mus musculus
cccattcattgatccagaatacatg

SEQ ID NO: 591768 - DNA, 25 bp, Mus musculus
cccattcgagtcacttcctggaaga

SEQ ID NO: 591769 - DNA, 25 bp, Mus musculus
cccattcgagtctcttcctggaaga

SEQ ID NO: 591770 - DNA, 25 bp, Mus musculus
cccattcgcctcataggcgagtttg

SEQ ID NO: 591771 - DNA, 25 bp, Mus musculus
cccattcgcctcttaggcgagtttg

SEQ ID NO: 591772 - DNA, 25 bp, Mus musculus
cccattctatgtacaccagtggttg

SEQ ID NO: 591773 - DNA, 25 bp, Mus musculus
cccattctatgttcaccagtggttg

SEQ ID NO: 591774 - DNA, 25 bp, Mus musculus
cccattctgatgagagaagactgtg

SEQ ID NO: 591775 - DNA, 25 bp, Mus musculus
cccattctgatgtgagaagactgtg

SEQ ID NO: 591776 - DNA, 25 bp, Mus musculus
cccattgaagtaccaggtgggtaca

SEQ ID NO: 591777 - DNA, 25 bp, Mus musculus
cccattgaagtagcaggtgggtaca

SEQ ID NO: 591778 - DNA, 25 bp, Mus musculus
cccattgaagtgagcggcgttctga

SEQ ID NO: 591779 - DNA, 25 bp, Mus musculus
cccattgaagtgtgcggcgttctga

SEQ ID NO: 591780 - DNA, 25 bp, Mus musculus
cccattgagcaacagggcaccggat

SEQ ID NO: 591781 - DNA, 25 bp, Mus musculus
cccattgagcaagagggcaccggat

SEQ ID NO: 591782 - DNA, 25 bp, Mus musculus
cccattgagtacagcaagcctctca

SEQ ID NO: 591783 - DNA, 25 bp, Mus musculus
cccattgagtactgcaagcctctca

SEQ ID NO: 591784 - DNA, 25 bp, Mus musculus
cccattgagtgcaccaagcactttt

SEQ ID NO: 591785 - DNA, 25 bp, Mus musculus
cccattgagtgctccaagcactttt

SEQ ID NO: 591786 - DNA, 25 bp, Mus musculus
cccattgattgtatgtcggaagtct

SEQ ID NO: 591787 - DNA, 25 bp, Mus musculus
cccattgattgtttgtcggaagtct

SEQ ID NO: 591788 - DNA, 25 bp, Mus musculus
cccattgcaggtctgacggctgtga

SEQ ID NO: 591789 - DNA, 25 bp, Mus musculus
cccattgcaggtgtgacggctgtga

SEQ ID NO: 591790 - DNA, 25 bp, Mus musculus
cccattgctgtgcacttttggagcc

SEQ ID NO: 591791 - DNA, 25 bp, Mus musculus
cccattgctgtggacttttggagcc

SEQ ID NO: 591792 - DNA, 25 bp, Mus musculus
cccatttacaggctacggacgagtt

SEQ ID NO: 591793 - DNA, 25 bp, Mus musculus
cccatttacagggtacggacgagtt

SEQ ID NO: 591794 - DNA, 25 bp, Mus musculus
cccatttagtgacacaggcctgaga

SEQ ID NO: 591795 - DNA, 25 bp, Mus musculus
cccatttagtgagacaggcctgaga

SEQ ID NO: 591796 - DNA, 25 bp, Mus musculus
cccatttcaaagaagagattagcaa

SEQ ID NO: 591797 - DNA, 25 bp, Mus musculus
cccatttcaaagtagagattagcaa

SEQ ID NO: 591798 - DNA, 25 bp, Mus musculus
cccatttcctgcagacacatggata

SEQ ID NO: 591799 - DNA, 25 bp, Mus musculus
cccatttcctgctgacacatggata

SEQ ID NO: 591800 - DNA, 25 bp, Mus musculus
cccatttgacttcgctagtcggtga

SEQ ID NO: 591801 - DNA, 25 bp, Mus musculus
cccatttgacttggctagtcggtga

SEQ ID NO: 591802 - DNA, 25 bp, Mus musculus
cccatttgagacatcttgcccatca

SEQ ID NO: 591803 - DNA, 25 bp, Mus musculus
cccatttgagacttcttgcccatca

SEQ ID NO: 591804 - DNA, 25 bp, Mus musculus
cccatttgatggcagtatgccccat

SEQ ID NO: 591805 - DNA, 25 bp, Mus musculus
cccatttgatgggagtatgccccat

SEQ ID NO: 591806 - DNA, 25 bp, Mus musculus
cccatttggagaacttagtgatcgc

SEQ ID NO: 591807 - DNA, 25 bp, Mus musculus
cccatttggagatcttagtgatcgc

SEQ ID NO: 591808 - DNA, 25 bp, Mus musculus
cccatttgtgataagggatgtgcta

SEQ ID NO: 591809 - DNA, 25 bp, Mus musculus
cccatttgtgattagggatgtgcta

SEQ ID NO: 591810 - DNA, 25 bp, Mus musculus
cccatttgtggacgacgacatggat

SEQ ID NO: 591811 - DNA, 25 bp, Mus musculus
cccatttgtggaggacgacatggat

SEQ ID NO: 591812 - DNA, 25 bp, Mus musculus
cccattttcttaaatgaggttctag

SEQ ID NO: 591813 - DNA, 25 bp, Mus musculus
cccattttcttatatgaggttctag

SEQ ID NO: 591814 - DNA, 25 bp, Mus musculus
cccatttttaatcgccacactgagg

SEQ ID NO: 591815 - DNA, 25 bp, Mus musculus
cccatttttaatggccacactgagg

SEQ ID NO: 591816 - DNA, 25 bp, Mus musculus
ccccaaaaggagagctgatgtatgg

SEQ ID NO: 591817 - DNA, 25 bp, Mus musculus
ccccaaaaggagtgctgatgtatgg

SEQ ID NO: 591818 - DNA, 25 bp, Mus musculus
ccccaaaatggcctcggttctgtgg

SEQ ID NO: 591819 - DNA, 25 bp, Mus musculus
ccccaaaatggcgtcggttctgtgg

SEQ ID NO: 591820 - DNA, 25 bp, Mus musculus
ccccaaagacaacacatggaggctt

SEQ ID NO: 591821 - DNA, 25 bp, Mus musculus
ccccaaagacaagacatggaggctt

SEQ ID NO: 591822 - DNA, 25 bp, Mus musculus
ccccaaagacaccagttgaggtgct

SEQ ID NO: 591823 - DNA, 25 bp, Mus musculus
ccccaaagacacgagttgaggtgct

SEQ ID NO: 591824 - DNA, 25 bp, Mus musculus
ccccaaagataacgacaaggatgag

SEQ ID NO: 591825 - DNA, 25 bp, Mus musculus
ccccaaagataaggacaaggatgag

SEQ ID NO: 591826 - DNA, 25 bp, Mus musculus
ccccaaagatgaagagttctatcag

SEQ ID NO: 591827 - DNA, 25 bp, Mus musculus
ccccaaagatgatgagttctatcag

SEQ ID NO: 591828 - DNA, 25 bp, Mus musculus
ccccaaagatgcctgtacaagcttc

SEQ ID NO: 591829 - DNA, 25 bp, Mus musculus
ccccaaagatgccttccgagcagtg

SEQ ID NO: 591830 - DNA, 25 bp, Mus musculus
ccccaaagatgcgtgtacaagcttc

SEQ ID NO: 591831 - DNA, 25 bp, Mus musculus
ccccaaagatgcgttccgagcagtg

SEQ ID NO: 591832 - DNA, 25 bp, Mus musculus
ccccaaaggacaagacatttttacg

SEQ ID NO: 591833 - DNA, 25 bp, Mus musculus
ccccaaaggacatgacatttttacg

SEQ ID NO: 591834 - DNA, 25 bp, Mus musculus
ccccaaaggaggatgctgagatcaa

SEQ ID NO: 591835 - DNA, 25 bp, Mus musculus
ccccaaaggaggttgctgagatcaa

SEQ ID NO: 591836 - DNA, 25 bp, Mus musculus
ccccaaagggtacgatcctggctgg

SEQ ID NO: 591837 - DNA, 25 bp, Mus musculus
ccccaaagggtaggatcctggctgg

SEQ ID NO: 591838 - DNA, 25 bp, Mus musculus
ccccaaagtcgacgaatgtatagca

SEQ ID NO: 591839 - DNA, 25 bp, Mus musculus
ccccaaagtcgaggaatgtatagca

SEQ ID NO: 591840 - DNA, 25 bp, Mus musculus
ccccaaagtcggctgtctgaggcgc

SEQ ID NO: 591841 - DNA, 25 bp, Mus musculus
ccccaaagtcgggtgtctgaggcgc

SEQ ID NO: 591842 - DNA, 25 bp, Mus musculus
ccccaaagtgatctgcagaaatgag

SEQ ID NO: 591843 - DNA, 25 bp, Mus musculus
ccccaaagtgatgtgcagaaatgag

SEQ ID NO: 591844 - DNA, 25 bp, Mus musculus
ccccaaatactgagaacctgtagtt

SEQ ID NO: 591845 - DNA, 25 bp, Mus musculus
ccccaaatactgtgaacctgtagtt

SEQ ID NO: 591846 - DNA, 25 bp, Mus musculus
ccccaaatggacactttgtttacag

SEQ ID NO: 591847 - DNA, 25 bp, Mus musculus
ccccaaatggactctttgtttacag

SEQ ID NO: 591848 - DNA, 25 bp, Mus musculus
ccccaacatatgagctggcattaca

SEQ ID NO: 591849 - DNA, 25 bp, Mus musculus
ccccaacatatgtgctggcattaca

SEQ ID NO: 591850 - DNA, 25 bp, Mus musculus
ccccaaccatacatacagatgttga

SEQ ID NO: 591851 - DNA, 25 bp, Mus musculus
ccccaaccatacttacagatgttga

SEQ ID NO: 591852 - DNA, 25 bp, Mus musculus
ccccaaccctgtcaggtgtcattgt

SEQ ID NO: 591853 - DNA, 25 bp, Mus musculus
ccccaaccctgtgaggtgtcattgt

SEQ ID NO: 591854 - DNA, 25 bp, Mus musculus
ccccaaccgtgaatgtgatggtggg

SEQ ID NO: 591855 - DNA, 25 bp, Mus musculus
ccccaaccgtgattgtgatggtggg

SEQ ID NO: 591856 - DNA, 25 bp, Mus musculus
ccccaacggtggacgcatatattac

SEQ ID NO: 591857 - DNA, 25 bp, Mus musculus
ccccaacggtggtcgcatatattac

SEQ ID NO: 591858 - DNA, 25 bp, Mus musculus
ccccaacgtggtcaatctgcatgag

SEQ ID NO: 591859 - DNA, 25 bp, Mus musculus
ccccaacgtggtgaatctgcatgag

SEQ ID NO: 591860 - DNA, 25 bp, Mus musculus
ccccaactggtcagtcaacgtaaag

SEQ ID NO: 591861 - DNA, 25 bp, Mus musculus
ccccaactggtctgtcaacgtaaag

SEQ ID NO: 591862 - DNA, 25 bp, Mus musculus
ccccaactggtgaagaggatacatc

SEQ ID NO: 591863 - DNA, 25 bp, Mus musculus
ccccaactggtgtagaggatacatc

SEQ ID NO: 591864 - DNA, 25 bp, Mus musculus
ccccaacttgaaaaagactggatac

SEQ ID NO: 591865 - DNA, 25 bp, Mus musculus
ccccaacttgaataagactggatac

SEQ ID NO: 591866 - DNA, 25 bp, Mus musculus
ccccaagaagctccgtgtgaagaac

SEQ ID NO: 591867 - DNA, 25 bp, Mus musculus
ccccaagaagctgcgtgtgaagaac

SEQ ID NO: 591868 - DNA, 25 bp, Mus musculus
ccccaagaagttctctgattttgga

SEQ ID NO: 591869 - DNA, 25 bp, Mus musculus
ccccaagaagttgtctgattttgga

SEQ ID NO: 591870 - DNA, 25 bp, Mus musculus
ccccaagagcagagaggatgtcatg

SEQ ID NO: 591871 - DNA, 25 bp, Mus musculus
ccccaagagcagtgaggatgtcatg

SEQ ID NO: 591872 - DNA, 25 bp, Mus musculus
ccccaagagcggacgctggttgctg

SEQ ID NO: 591873 - DNA, 25 bp, Mus musculus
ccccaagagcggtcgctggttgctg

SEQ ID NO: 591874 - DNA, 25 bp, Mus musculus
ccccaagagggtagcacagactcag

SEQ ID NO: 591875 - DNA, 25 bp, Mus musculus
ccccaagagggttgcacagactcag

SEQ ID NO: 591876 - DNA, 25 bp, Mus musculus
ccccaagatgatctgaaagatgaat

SEQ ID NO: 591877 - DNA, 25 bp, Mus musculus
ccccaagatgatgtgaaagatgaat

SEQ ID NO: 591878 - DNA, 25 bp, Mus musculus
ccccaagcgaaactgaaggcagtga

SEQ ID NO: 591879 - DNA, 25 bp, Mus musculus
ccccaagcgaaagtgaaggcagtga

SEQ ID NO: 591880 - DNA, 25 bp, Mus musculus
ccccaagctgcgaaggcagggtagc

SEQ ID NO: 591881 - DNA, 25 bp, Mus musculus
ccccaagctgcgtaggcagggtagc

SEQ ID NO: 591882 - DNA, 25 bp, Mus musculus
ccccaaggaaagaatatgacacacg

SEQ ID NO: 591883 - DNA, 25 bp, Mus musculus
ccccaaggaaagtatatgacacacg

SEQ ID NO: 591884 - DNA, 25 bp, Mus musculus
ccccaaggagaaaagtcacagctag

SEQ ID NO: 591885 - DNA, 25 bp, Mus musculus
ccccaaggagaatagtcacagctag

SEQ ID NO: 591886 - DNA, 25 bp, Mus musculus
ccccaaggaggcaatctgagaggag

SEQ ID NO: 591887 - DNA, 25 bp, Mus musculus
ccccaaggaggctatctgagaggag

SEQ ID NO: 591888 - DNA, 25 bp, Mus musculus
ccccaaggatttagactgtatcatt

SEQ ID NO: 591889 - DNA, 25 bp, Mus musculus
ccccaaggatttcaggagaagacag

SEQ ID NO: 591890 - DNA, 25 bp, Mus musculus
ccccaaggatttgaggagaagacag

SEQ ID NO: 591891 - DNA, 25 bp, Mus musculus
ccccaaggattttgactgtatcatt

SEQ ID NO: 591892 - DNA, 25 bp, Mus musculus
ccccaaggcccaagagattgatcaa

SEQ ID NO: 591893 - DNA, 25 bp, Mus musculus
ccccaaggcccatgagattgatcaa

SEQ ID NO: 591894 - DNA, 25 bp, Mus musculus
ccccaaggccggagatttcgcttcg

SEQ ID NO: 591895 - DNA, 25 bp, Mus musculus
ccccaaggccggtgatttcgcttcg

SEQ ID NO: 591896 - DNA, 25 bp, Mus musculus
ccccaagggacacgaataactagca

SEQ ID NO: 591897 - DNA, 25 bp, Mus musculus
ccccaagggacaggaataactagca

SEQ ID NO: 591898 - DNA, 25 bp, Mus musculus
ccccaagggtgaacgtggagctcct

SEQ ID NO: 591899 - DNA, 25 bp, Mus musculus
ccccaagggtgatcgtggagctcct

SEQ ID NO: 591900 - DNA, 25 bp, Mus musculus
ccccaaggtcttctcgtggctacag

SEQ ID NO: 591901 - DNA, 25 bp, Mus musculus
ccccaaggtcttgtcgtggctacag

SEQ ID NO: 591902 - DNA, 25 bp, Mus musculus
ccccaagtaccgagacaagaagaag

SEQ ID NO: 591903 - DNA, 25 bp, Mus musculus
ccccaagtaccgtgacaagaagaag

SEQ ID NO: 591904 - DNA, 25 bp, Mus musculus
ccccaagtgaagactcccatgtgac

SEQ ID NO: 591905 - DNA, 25 bp, Mus musculus
ccccaagtgaagtctcccatgtgac

SEQ ID NO: 591906 - DNA, 25 bp, Mus musculus
ccccaataaagtcgagccctgaaga

SEQ ID NO: 591907 - DNA, 25 bp, Mus musculus
ccccaataaagtggagccctgaaga

SEQ ID NO: 591908 - DNA, 25 bp, Mus musculus
ccccaatatcctcaacttgagcggg

SEQ ID NO: 591909 - DNA, 25 bp, Mus musculus
ccccaatatcctgaacttgagcggg

SEQ ID NO: 591910 - DNA, 25 bp, Mus musculus
ccccaatatctaagagctgaggaca

SEQ ID NO: 591911 - DNA, 25 bp, Mus musculus
ccccaatatctatgagctgaggaca

SEQ ID NO: 591912 - DNA, 25 bp, Mus musculus
ccccaatgacatctttcgatataat

SEQ ID NO: 591913 - DNA, 25 bp, Mus musculus
ccccaatgacatgtttcgatataat

SEQ ID NO: 591914 - DNA, 25 bp, Mus musculus
ccccaatgccatacagatctgtact

SEQ ID NO: 591915 - DNA, 25 bp, Mus musculus
ccccaatgccattcagatctgtact

SEQ ID NO: 591916 - DNA, 25 bp, Mus musculus
ccccaatggactcggaggcattgga

SEQ ID NO: 591917 - DNA, 25 bp, Mus musculus
ccccaatggactgggaggcattgga

SEQ ID NO: 591918 - DNA, 25 bp, Mus musculus
ccccaatggagtataagggtgaact

SEQ ID NO: 591919 - DNA, 25 bp, Mus musculus
ccccaatggagtttaagggtgaact

SEQ ID NO: 591920 - DNA, 25 bp, Mus musculus
ccccaatgggtgacagtttagtgta

SEQ ID NO: 591921 - DNA, 25 bp, Mus musculus
ccccaatgggtgtcagtttagtgta

SEQ ID NO: 591922 - DNA, 25 bp, Mus musculus
ccccaattggaacaactcattactg

SEQ ID NO: 591923 - DNA, 25 bp, Mus musculus
ccccaattggaagaactcattactg

SEQ ID NO: 591924 - DNA, 25 bp, Mus musculus
ccccacaatacacggttctgcagga

SEQ ID NO: 591925 - DNA, 25 bp, Mus musculus
ccccacaatacagggttctgcagga

SEQ ID NO: 591926 - DNA, 25 bp, Mus musculus
ccccacacctagcaagttcgtgatt

SEQ ID NO: 591927 - DNA, 25 bp, Mus musculus
ccccacacctaggaagttcgtgatt

SEQ ID NO: 591928 - DNA, 25 bp, Mus musculus
ccccacactgtaactagagaaatat

SEQ ID NO: 591929 - DNA, 25 bp, Mus musculus
ccccacactgtatctagagaaatat

SEQ ID NO: 591930 - DNA, 25 bp, Mus musculus
ccccacagatggagatcgaaggctt

SEQ ID NO: 591931 - DNA, 25 bp, Mus musculus
ccccacagatggtgatcgaaggctt

SEQ ID NO: 591932 - DNA, 25 bp, Mus musculus
ccccacagctaacctggtgctggat

SEQ ID NO: 591933 - DNA, 25 bp, Mus musculus
ccccacagctaagctggtgctggat

SEQ ID NO: 591934 - DNA, 25 bp, Mus musculus
ccccacagtgaacactactctgaaa

SEQ ID NO: 591935 - DNA, 25 bp, Mus musculus
ccccacagtgaagactactctgaaa

SEQ ID NO: 591936 - DNA, 25 bp, Mus musculus
ccccacattgaaacatcagggctgg

SEQ ID NO: 591937 - DNA, 25 bp, Mus musculus
ccccacattgaatcatcagggctgg

SEQ ID NO: 591938 - DNA, 25 bp, Mus musculus
ccccaccaggagatccagggagaca

SEQ ID NO: 591939 - DNA, 25 bp, Mus musculus
ccccaccaggagttccagggagaca

SEQ ID NO: 591940 - DNA, 25 bp, Mus musculus
ccccaccatggaagagctagctgag

SEQ ID NO: 591941 - DNA, 25 bp, Mus musculus
ccccaccatggatgagctagctgag

SEQ ID NO: 591942 - DNA, 25 bp, Mus musculus
ccccacctatcgatttgaaagactg

SEQ ID NO: 591943 - DNA, 25 bp, Mus musculus
ccccacctatcgttttgaaagactg

SEQ ID NO: 591944 - DNA, 25 bp, Mus musculus
ccccaccttggcagtactggtcatg

SEQ ID NO: 591945 - DNA, 25 bp, Mus musculus
ccccaccttggctgtactggtcatg

SEQ ID NO: 591946 - DNA, 25 bp, Mus musculus
ccccacggagagaaactgtgaggtg

SEQ ID NO: 591947 - DNA, 25 bp, Mus musculus
ccccacggagagtaactgtgaggtg

SEQ ID NO: 591948 - DNA, 25 bp, Mus musculus
ccccacggagcccaatggtgagatt

SEQ ID NO: 591949 - DNA, 25 bp, Mus musculus
ccccacggagccgaatggtgagatt

SEQ ID NO: 591950 - DNA, 25 bp, Mus musculus
ccccacggaggtagagccgggcaca

SEQ ID NO: 591951 - DNA, 25 bp, Mus musculus
ccccacggaggttgagccgggcaca

SEQ ID NO: 591952 - DNA, 25 bp, Mus musculus
ccccacggagtcaatgcgcaggagt

SEQ ID NO: 591953 - DNA, 25 bp, Mus musculus
ccccacggagtctatgcgcaggagt

SEQ ID NO: 591954 - DNA, 25 bp, Mus musculus
ccccacgtgggcatgcgcttttaga

SEQ ID NO: 591955 - DNA, 25 bp, Mus musculus
ccccacgtgggcttgcgcttttaga

SEQ ID NO: 591956 - DNA, 25 bp, Mus musculus
ccccactaatagacggttacaaatg

SEQ ID NO: 591957 - DNA, 25 bp, Mus musculus
ccccactaatagtcggttacaaatg

SEQ ID NO: 591958 - DNA, 25 bp, Mus musculus
ccccactctctgataggttctgagc

SEQ ID NO: 591959 - DNA, 25 bp, Mus musculus
ccccactctctgttaggttctgagc

SEQ ID NO: 591960 - DNA, 25 bp, Mus musculus
ccccactctggacgcgagatgggac

SEQ ID NO: 591961 - DNA, 25 bp, Mus musculus
ccccactctggaggcgagatgggac

SEQ ID NO: 591962 - DNA, 25 bp, Mus musculus
ccccactcttaactataggatcacg

SEQ ID NO: 591963 - DNA, 25 bp, Mus musculus
ccccactcttaagtataggatcacg

SEQ ID NO: 591964 - DNA, 25 bp, Mus musculus
ccccactgaaggagcgtgtatccct

SEQ ID NO: 591965 - DNA, 25 bp, Mus musculus
ccccactgaaggtgcgtgtatccct

SEQ ID NO: 591966 - DNA, 25 bp, Mus musculus
ccccactgactgacgcacagaagaa

SEQ ID NO: 591967 - DNA, 25 bp, Mus musculus
ccccactgactgtcgcacagaagaa

SEQ ID NO: 591968 - DNA, 25 bp, Mus musculus
ccccactggcatatgctacgtcatg

SEQ ID NO: 591969 - DNA, 25 bp, Mus musculus
ccccactggcatttgctacgtcatg

SEQ ID NO: 591970 - DNA, 25 bp, Mus musculus
ccccactggtctcgttgctgggcag

SEQ ID NO: 591971 - DNA, 25 bp, Mus musculus
ccccactggtctggttgctgggcag

SEQ ID NO: 591972 - DNA, 25 bp, Mus musculus
ccccactttgggagtcatgtcggtg

SEQ ID NO: 591973 - DNA, 25 bp, Mus musculus
ccccactttgggtgtcatgtcggtg

SEQ ID NO: 591974 - DNA, 25 bp, Mus musculus
ccccagaacatgcacaattccaagg

SEQ ID NO: 591975 - DNA, 25 bp, Mus musculus
ccccagaacatggacaattccaagg

SEQ ID NO: 591976 - DNA, 25 bp, Mus musculus
ccccagaagatgagaatgcagacgc

SEQ ID NO: 591977 - DNA, 25 bp, Mus musculus
ccccagaagatgtgaatgcagacgc

SEQ ID NO: 591978 - DNA, 25 bp, Mus musculus
ccccagaagcatcggctagagctag

SEQ ID NO: 591979 - DNA, 25 bp, Mus musculus
ccccagaagcatgggctagagctag

SEQ ID NO: 591980 - DNA, 25 bp, Mus musculus
ccccagaagcgcatgcggagagact

SEQ ID NO: 591981 - DNA, 25 bp, Mus musculus
ccccagaagcgcttgcggagagact

SEQ ID NO: 591982 - DNA, 25 bp, Mus musculus
ccccagaagcttagctgaactgcta

SEQ ID NO: 591983 - DNA, 25 bp, Mus musculus
ccccagaagctttgctgaactgcta

SEQ ID NO: 591984 - DNA, 25 bp, Mus musculus
ccccagaaggagctgtatttcatgg

SEQ ID NO: 591985 - DNA, 25 bp, Mus musculus
ccccagaaggaggtgtatttcatgg

SEQ ID NO: 591986 - DNA, 25 bp, Mus musculus
ccccagaaggataagccagaagcag

SEQ ID NO: 591987 - DNA, 25 bp, Mus musculus
ccccagaaggattagccagaagcag

SEQ ID NO: 591988 - DNA, 25 bp, Mus musculus
ccccagaaggcgcaacaggactggt

SEQ ID NO: 591989 - DNA, 25 bp, Mus musculus
ccccagaaggcggaacaggactggt

SEQ ID NO: 591990 - DNA, 25 bp, Mus musculus
ccccagaatctcacaagcgtgaata

SEQ ID NO: 591991 - DNA, 25 bp, Mus musculus
ccccagaatctctcaagcgtgaata

SEQ ID NO: 591992 - DNA, 25 bp, Mus musculus
ccccagacagcgctagcaccatggt

SEQ ID NO: 591993 - DNA, 25 bp, Mus musculus
ccccagacagcggtagcaccatggt

SEQ ID NO: 591994 - DNA, 25 bp, Mus musculus
ccccagacgagaagatattcaaaga

SEQ ID NO: 591995 - DNA, 25 bp, Mus musculus
ccccagacgagatgatattcaaaga

SEQ ID NO: 591996 - DNA, 25 bp, Mus musculus
ccccagagagacctgaagtgtgctg

SEQ ID NO: 591997 - DNA, 25 bp, Mus musculus
ccccagagagacgtgaagtgtgctg

SEQ ID NO: 591998 - DNA, 25 bp, Mus musculus
ccccagagagcgacacgggagatga

SEQ ID NO: 591999 - DNA, 25 bp, Mus musculus
ccccagagagcgtcacgggagatga

SEQ ID NO: 592000 - DNA, 25 bp, Mus musculus
ccccagagagtaacaggtgtctgaa

SEQ ID NO: 592001 - DNA, 25 bp, Mus musculus
ccccagagagtatcaggtgtctgaa

SEQ ID NO: 592002 - DNA, 25 bp, Mus musculus
ccccagagcgtcattcgcgtggata

SEQ ID NO: 592003 - DNA, 25 bp, Mus musculus
ccccagagcgtctttcgcgtggata

SEQ ID NO: 592004 - DNA, 25 bp, Mus musculus
ccccagaggagtacccagagcctgg

SEQ ID NO: 592005 - DNA, 25 bp, Mus musculus
ccccagaggagttcccagagcctgg

SEQ ID NO: 592006 - DNA, 25 bp, Mus musculus
ccccagagtatcagcacatagacca

SEQ ID NO: 592007 - DNA, 25 bp, Mus musculus
ccccagagtatctgcacatagacca

SEQ ID NO: 592008 - DNA, 25 bp, Mus musculus
ccccagagtgaaaactcggttgtga

SEQ ID NO: 592009 - DNA, 25 bp, Mus musculus
ccccagagtgaatactcggttgtga

SEQ ID NO: 592010 - DNA, 25 bp, Mus musculus
ccccagatgccaagggaactatggg

SEQ ID NO: 592011 - DNA, 25 bp, Mus musculus
ccccagatgccatgggaactatggg

SEQ ID NO: 592012 - DNA, 25 bp, Mus musculus
ccccagcaatagcaaggacagtagt

SEQ ID NO: 592013 - DNA, 25 bp, Mus musculus
ccccagcaataggaaggacagtagt

SEQ ID NO: 592014 - DNA, 25 bp, Mus musculus
ccccagcacaagaccataagcgatt

SEQ ID NO: 592015 - DNA, 25 bp, Mus musculus
ccccagcacaagtccataagcgatt

SEQ ID NO: 592016 - DNA, 25 bp, Mus musculus
ccccagcacacgcaggatgatgctg

SEQ ID NO: 592017 - DNA, 25 bp, Mus musculus
ccccagcacacggaggatgatgctg

SEQ ID NO: 592018 - DNA, 25 bp, Mus musculus
ccccagcatggccattggagccatt

SEQ ID NO: 592019 - DNA, 25 bp, Mus musculus
ccccagcatggcgattggagccatt

SEQ ID NO: 592020 - DNA, 25 bp, Mus musculus
ccccagcccaaaatcctttgaggag

SEQ ID NO: 592021 - DNA, 25 bp, Mus musculus
ccccagcccaaattcctttgaggag

SEQ ID NO: 592022 - DNA, 25 bp, Mus musculus
ccccagctaatgagactggacaata

SEQ ID NO: 592023 - DNA, 25 bp, Mus musculus
ccccagctaatgtgactggacaata

SEQ ID NO: 592024 - DNA, 25 bp, Mus musculus
ccccagctcgggaagaatgtgccac

SEQ ID NO: 592025 - DNA, 25 bp, Mus musculus
ccccagctcgggtagaatgtgccac

SEQ ID NO: 592026 - DNA, 25 bp, Mus musculus
ccccagctctgacggctgtatcaag

SEQ ID NO: 592027 - DNA, 25 bp, Mus musculus
ccccagctctgagggctgtatcaag

SEQ ID NO: 592028 - DNA, 25 bp, Mus musculus
ccccagctgaggagctggtcaacat

SEQ ID NO: 592029 - DNA, 25 bp, Mus musculus
ccccagctgaggatctctagaagag

SEQ ID NO: 592030 - DNA, 25 bp, Mus musculus
ccccagctgaggtgctggtcaacat

SEQ ID NO: 592031 - DNA, 25 bp, Mus musculus
ccccagctgaggttctctagaagag

SEQ ID NO: 592032 - DNA, 25 bp, Mus musculus
ccccagctgccaaggctgcaccctg

SEQ ID NO: 592033 - DNA, 25 bp, Mus musculus
ccccagctgccatggctgcaccctg

SEQ ID NO: 592034 - DNA, 25 bp, Mus musculus
ccccagctgcgtagtttcctggtgc

SEQ ID NO: 592035 - DNA, 25 bp, Mus musculus
ccccagctgcgttgtttcctggtgc

SEQ ID NO: 592036 - DNA, 25 bp, Mus musculus
ccccagctgtgccttaaggactaat

SEQ ID NO: 592037 - DNA, 25 bp, Mus musculus
ccccagctgtgcgttaaggactaat

SEQ ID NO: 592038 - DNA, 25 bp, Mus musculus
ccccaggaaagacgcacttgtatat

SEQ ID NO: 592039 - DNA, 25 bp, Mus musculus
ccccaggaaagaggcacttgtatat

SEQ ID NO: 592040 - DNA, 25 bp, Mus musculus
ccccaggaaggtctgctataagtaa

SEQ ID NO: 592041 - DNA, 25 bp, Mus musculus
ccccaggaaggtgtgctataagtaa

SEQ ID NO: 592042 - DNA, 25 bp, Mus musculus
ccccaggaagttctggacatgagga

SEQ ID NO: 592043 - DNA, 25 bp, Mus musculus
ccccaggaagttgtggacatgagga

SEQ ID NO: 592044 - DNA, 25 bp, Mus musculus
ccccaggaatgacacggaatctgct

SEQ ID NO: 592045 - DNA, 25 bp, Mus musculus
ccccaggaatgagacggaatctgct

SEQ ID NO: 592046 - DNA, 25 bp, Mus musculus
ccccaggagaatacaaagcggaaga

SEQ ID NO: 592047 - DNA, 25 bp, Mus musculus
ccccaggagaattcaaagcggaaga

SEQ ID NO: 592048 - DNA, 25 bp, Mus musculus
ccccaggagagtaagtgactgcaga

SEQ ID NO: 592049 - DNA, 25 bp, Mus musculus
ccccaggagagttagtgactgcaga

SEQ ID NO: 592050 - DNA, 25 bp, Mus musculus
ccccaggatccgcttcttggtgata

SEQ ID NO: 592051 - DNA, 25 bp, Mus musculus
ccccaggatccggttcttggtgata

SEQ ID NO: 592052 - DNA, 25 bp, Mus musculus
ccccaggatcggagctctgtatgta

SEQ ID NO: 592053 - DNA, 25 bp, Mus musculus
ccccaggatcggtgctctgtatgta

SEQ ID NO: 592054 - DNA, 25 bp, Mus musculus
ccccaggcctatatggaactgcagg

SEQ ID NO: 592055 - DNA, 25 bp, Mus musculus
ccccaggcctatttggaactgcagg

SEQ ID NO: 592056 - DNA, 25 bp, Mus musculus
ccccaggcttcgcaatcaagaagga

SEQ ID NO: 592057 - DNA, 25 bp, Mus musculus
ccccaggcttcggaatcaagaagga

SEQ ID NO: 592058 - DNA, 25 bp, Mus musculus
ccccaggcttggctcactgtgaaga

SEQ ID NO: 592059 - DNA, 25 bp, Mus musculus
ccccaggcttgggtcactgtgaaga

SEQ ID NO: 592060 - DNA, 25 bp, Mus musculus
ccccagggaaggctcttgcatcctg

SEQ ID NO: 592061 - DNA, 25 bp, Mus musculus
ccccagggaagggtcttgcatcctg

SEQ ID NO: 592062 - DNA, 25 bp, Mus musculus
ccccagggaagtcgatcgtgttctg

SEQ ID NO: 592063 - DNA, 25 bp, Mus musculus
ccccagggaagtggatcgtgttctg

SEQ ID NO: 592064 - DNA, 25 bp, Mus musculus
ccccagggctacaagaggctcaaca

SEQ ID NO: 592065 - DNA, 25 bp, Mus musculus
ccccagggctactagaggctcaaca

SEQ ID NO: 592066 - DNA, 25 bp, Mus musculus
ccccagggtaaacagtgtcacctag

SEQ ID NO: 592067 - DNA, 25 bp, Mus musculus
ccccagggtaaagagtgtcacctag

SEQ ID NO: 592068 - DNA, 25 bp, Mus musculus
ccccagggtacaattgctttgtgga

SEQ ID NO: 592069 - DNA, 25 bp, Mus musculus
ccccagggtacatttgctttgtgga

SEQ ID NO: 592070 - DNA, 25 bp, Mus musculus
ccccaggtaagcacggcaggagaca

SEQ ID NO: 592071 - DNA, 25 bp, Mus musculus
ccccaggtaagctcggcaggagaca

SEQ ID NO: 592072 - DNA, 25 bp, Mus musculus
ccccaggtacagcagacggcatggt

SEQ ID NO: 592073 - DNA, 25 bp, Mus musculus
ccccaggtacaggagacggcatggt

SEQ ID NO: 592074 - DNA, 25 bp, Mus musculus
ccccaggtactgagggaaaatcgtg

SEQ ID NO: 592075 - DNA, 25 bp, Mus musculus
ccccaggtactgtgggaaaatcgtg

SEQ ID NO: 592076 - DNA, 25 bp, Mus musculus
ccccaggtcagacagcattcgagaa

SEQ ID NO: 592077 - DNA, 25 bp, Mus musculus
ccccaggtcagagagcattcgagaa

SEQ ID NO: 592078 - DNA, 25 bp, Mus musculus
ccccaggtgtcactggaggttgcct

SEQ ID NO: 592079 - DNA, 25 bp, Mus musculus
ccccaggtgtcagtggaggttgcct

SEQ ID NO: 592080 - DNA, 25 bp, Mus musculus
ccccaggtgtccaccagtgcagaag

SEQ ID NO: 592081 - DNA, 25 bp, Mus musculus
ccccaggtgtcctccagtgcagaag

SEQ ID NO: 592082 - DNA, 25 bp, Mus musculus
ccccaggtgttgctgatgctgaacc

SEQ ID NO: 592083 - DNA, 25 bp, Mus musculus
ccccaggtgttggtgatgctgaacc

SEQ ID NO: 592084 - DNA, 25 bp, Mus musculus
ccccaggttcagcatgtattcttgc

SEQ ID NO: 592085 - DNA, 25 bp, Mus musculus
ccccaggttcaggatgtattcttgc

SEQ ID NO: 592086 - DNA, 25 bp, Mus musculus
ccccaggttcgactaggtggaagca

SEQ ID NO: 592087 - DNA, 25 bp, Mus musculus
ccccaggttcgagtaggtggaagca

SEQ ID NO: 592088 - DNA, 25 bp, Mus musculus
ccccagtacaaaatggaggtgcagt

SEQ ID NO: 592089 - DNA, 25 bp, Mus musculus
ccccagtacaaattggaggtgcagt

SEQ ID NO: 592090 - DNA, 25 bp, Mus musculus
ccccagtactttcgcggagtttcag

SEQ ID NO: 592091 - DNA, 25 bp, Mus musculus
ccccagtactttggcggagtttcag

SEQ ID NO: 592092 - DNA, 25 bp, Mus musculus
ccccagtataaaaatgctgcgggag

SEQ ID NO: 592093 - DNA, 25 bp, Mus musculus
ccccagtataaatatgctgcgggag

SEQ ID NO: 592094 - DNA, 25 bp, Mus musculus
ccccagtatggtcctccaggatctt

SEQ ID NO: 592095 - DNA, 25 bp, Mus musculus
ccccagtatggtgctccaggatctt

SEQ ID NO: 592096 - DNA, 25 bp, Mus musculus
ccccagtcacgtcctgttataatgt

SEQ ID NO: 592097 - DNA, 25 bp, Mus musculus
ccccagtcacgtgctgttataatgt

SEQ ID NO: 592098 - DNA, 25 bp, Mus musculus
ccccagtcagtaatatggagtcttg

SEQ ID NO: 592099 - DNA, 25 bp, Mus musculus
ccccagtcagtattatggagtcttg

SEQ ID NO: 592100 - DNA, 25 bp, Mus musculus
ccccagtgacttcagcatgctatag

SEQ ID NO: 592101 - DNA, 25 bp, Mus musculus
ccccagtgacttgagcatgctatag

SEQ ID NO: 592102 - DNA, 25 bp, Mus musculus
ccccagtgagatcatctagaaacca

SEQ ID NO: 592103 - DNA, 25 bp, Mus musculus
ccccagtgagatgatctagaaacca

SEQ ID NO: 592104 - DNA, 25 bp, Mus musculus
ccccagtgccagatgctgtttgttg

SEQ ID NO: 592105 - DNA, 25 bp, Mus musculus
ccccagtgccagttgctgtttgttg

SEQ ID NO: 592106 - DNA, 25 bp, Mus musculus
ccccagtgggacagttgcgacagtc

SEQ ID NO: 592107 - DNA, 25 bp, Mus musculus
ccccagtgggactgttgcgacagtc

SEQ ID NO: 592108 - DNA, 25 bp, Mus musculus
ccccagtggtcacctatgtgtgtga

SEQ ID NO: 592109 - DNA, 25 bp, Mus musculus
ccccagtggtcagctatgtgtgtga

SEQ ID NO: 592110 - DNA, 25 bp, Mus musculus
ccccagtgttccatcaacagggatg

SEQ ID NO: 592111 - DNA, 25 bp, Mus musculus
ccccagtgttccttcaacagggatg

SEQ ID NO: 592112 - DNA, 25 bp, Mus musculus
ccccagttccctcgagggcagtgaa

SEQ ID NO: 592113 - DNA, 25 bp, Mus musculus
ccccagttccctggagggcagtgaa

SEQ ID NO: 592114 - DNA, 25 bp, Mus musculus
ccccagttgctgcatgaacgaaact

SEQ ID NO: 592115 - DNA, 25 bp, Mus musculus
ccccagttgctggatgaacgaaact

SEQ ID NO: 592116 - DNA, 25 bp, Mus musculus
ccccagtttggacgcaaagactgtg

SEQ ID NO: 592117 - DNA, 25 bp, Mus musculus
ccccagtttggaggcaaagactgtg

SEQ ID NO: 592118 - DNA, 25 bp, Mus musculus
ccccataactgacgcggaagcatag

SEQ ID NO: 592119 - DNA, 25 bp, Mus musculus
ccccataactgaggcggaagcatag

SEQ ID NO: 592120 - DNA, 25 bp, Mus musculus
ccccataatcggagagtatgctgga

SEQ ID NO: 592121 - DNA, 25 bp, Mus musculus
ccccataatcggtgagtatgctgga

SEQ ID NO: 592122 - DNA, 25 bp, Mus musculus
ccccatactcaacgacaatgtgaga

SEQ ID NO: 592123 - DNA, 25 bp, Mus musculus
ccccatactcaaggacaatgtgaga

SEQ ID NO: 592124 - DNA, 25 bp, Mus musculus
ccccatagatatcgcaatggtagtc

SEQ ID NO: 592125 - DNA, 25 bp, Mus musculus
ccccatagatatggcaatggtagtc

SEQ ID NO: 592126 - DNA, 25 bp, Mus musculus
ccccatcaagaaatcgccgagagag

SEQ ID NO: 592127 - DNA, 25 bp, Mus musculus
ccccatcaagaattcgccgagagag

SEQ ID NO: 592128 - DNA, 25 bp, Mus musculus
ccccatcaatgaacaggatgtggag

SEQ ID NO: 592129 - DNA, 25 bp, Mus musculus
ccccatcaatgatcaggatgtggag

SEQ ID NO: 592130 - DNA, 25 bp, Mus musculus
ccccatcactgtccggtgagcaagt

SEQ ID NO: 592131 - DNA, 25 bp, Mus musculus
ccccatcactgtgcggtgagcaagt

SEQ ID NO: 592132 - DNA, 25 bp, Mus musculus
ccccatctttaaccgcgtttggctg

SEQ ID NO: 592133 - DNA, 25 bp, Mus musculus
ccccatctttaagcgcgtttggctg

SEQ ID NO: 592134 - DNA, 25 bp, Mus musculus
ccccatgaccagcacaggatgatct

SEQ ID NO: 592135 - DNA, 25 bp, Mus musculus
ccccatgaccaggacaggatgatct

SEQ ID NO: 592136 - DNA, 25 bp, Mus musculus
ccccatgaccatatacagagtgatg

SEQ ID NO: 592137 - DNA, 25 bp, Mus musculus
ccccatgaccatttacagagtgatg

SEQ ID NO: 592138 - DNA, 25 bp, Mus musculus
ccccatgagaagcaggtcatgatgt

SEQ ID NO: 592139 - DNA, 25 bp, Mus musculus
ccccatgagaaggaggtcatgatgt

SEQ ID NO: 592140 - DNA, 25 bp, Mus musculus
ccccatgagcatcggtgtcattaaa

SEQ ID NO: 592141 - DNA, 25 bp, Mus musculus
ccccatgagcatgggtgtcattaaa

SEQ ID NO: 592142 - DNA, 25 bp, Mus musculus
ccccatgatgggagttctggacggt

SEQ ID NO: 592143 - DNA, 25 bp, Mus musculus
ccccatgatgggtgttctggacggt

SEQ ID NO: 592144 - DNA, 25 bp, Mus musculus
ccccatgcctggaggagcatcaatg

SEQ ID NO: 592145 - DNA, 25 bp, Mus musculus
ccccatgcctggtggagcatcaatg

SEQ ID NO: 592146 - DNA, 25 bp, Mus musculus
ccccatgccttgcaattatgtaaag

SEQ ID NO: 592147 - DNA, 25 bp, Mus musculus
ccccatgccttggaattatgtaaag

SEQ ID NO: 592148 - DNA, 25 bp, Mus musculus
ccccatggacggacagcttgcggaa

SEQ ID NO: 592149 - DNA, 25 bp, Mus musculus
ccccatggacggtcagcttgcggaa

SEQ ID NO: 592150 - DNA, 25 bp, Mus musculus
ccccatggagacatcacctgtgatt

SEQ ID NO: 592151 - DNA, 25 bp, Mus musculus
ccccatggagacttcacctgtgatt

SEQ ID NO: 592152 - DNA, 25 bp, Mus musculus
ccccatggatggcattaaaggagag

SEQ ID NO: 592153 - DNA, 25 bp, Mus musculus
ccccatggatgggattaaaggagag

SEQ ID NO: 592154 - DNA, 25 bp, Mus musculus
ccccatgggagacaaagttctgcct

SEQ ID NO: 592155 - DNA, 25 bp, Mus musculus
ccccatgggagagaaagttctgcct

SEQ ID NO: 592156 - DNA, 25 bp, Mus musculus
ccccatgtacatagaaaccgtggta

SEQ ID NO: 592157 - DNA, 25 bp, Mus musculus
ccccatgtacattgaaaccgtggta

SEQ ID NO: 592158 - DNA, 25 bp, Mus musculus
ccccatgtcactctgcagtttgcag

SEQ ID NO: 592159 - DNA, 25 bp, Mus musculus
ccccatgtcactgtgcagtttgcag

SEQ ID NO: 592160 - DNA, 25 bp, Mus musculus
ccccatgtcgtcaccaatgtgtctg

SEQ ID NO: 592161 - DNA, 25 bp, Mus musculus
ccccatgtcgtctccaatgtgtctg

SEQ ID NO: 592162 - DNA, 25 bp, Mus musculus
ccccatgtgtggaggtgaagcgctg

SEQ ID NO: 592163 - DNA, 25 bp, Mus musculus
ccccatgtgtggtggtgaagcgctg

SEQ ID NO: 592164 - DNA, 25 bp, Mus musculus
ccccattacttccatgcttgtgggt

SEQ ID NO: 592165 - DNA, 25 bp, Mus musculus
ccccattacttcgatgcttgtgggt

SEQ ID NO: 592166 - DNA, 25 bp, Mus musculus
ccccattcatgtagaggccacatac

SEQ ID NO: 592167 - DNA, 25 bp, Mus musculus
ccccattcatgttgaggccacatac

SEQ ID NO: 592168 - DNA, 25 bp, Mus musculus
ccccattctagacccaaagaggaca

SEQ ID NO: 592169 - DNA, 25 bp, Mus musculus
ccccattctagagccaaagaggaca

SEQ ID NO: 592170 - DNA, 25 bp, Mus musculus
ccccattgagtgctccaagcacttt

SEQ ID NO: 592171 - DNA, 25 bp, Mus musculus
ccccattgagtggtccaagcacttt

SEQ ID NO: 592172 - DNA, 25 bp, Mus musculus
ccccattggacaaagggccctgaca

SEQ ID NO: 592173 - DNA, 25 bp, Mus musculus
ccccattggacatagggccctgaca

SEQ ID NO: 592174 - DNA, 25 bp, Mus musculus
ccccattgtggaacatctaggcagt

SEQ ID NO: 592175 - DNA, 25 bp, Mus musculus
ccccattgtggatcatctaggcagt

SEQ ID NO: 592176 - DNA, 25 bp, Mus musculus
cccccaaattatacttaatcatgga

SEQ ID NO: 592177 - DNA, 25 bp, Mus musculus
cccccaaattattcttaatcatgga

SEQ ID NO: 592178 - DNA, 25 bp, Mus musculus
ccccctaggaagctgactgcataca

SEQ ID NO: 592179 - DNA, 25 bp, Mus musculus
ccccctaggaaggtgactgcataca

SEQ ID NO: 592180 - DNA, 25 bp, Mus musculus
ccccctgtgggaagatcctgaggaa

SEQ ID NO: 592181 - DNA, 25 bp, Mus musculus
ccccctgtgggatgatcctgaggaa

SEQ ID NO: 592182 - DNA, 25 bp, Mus musculus
ccccgaatgcctccaagtggattta

SEQ ID NO: 592183 - DNA, 25 bp, Mus musculus
ccccgaatgcctgcaagtggattta

SEQ ID NO: 592184 - DNA, 25 bp, Mus musculus
ccccgaattcctcaaggcagggaag

SEQ ID NO: 592185 - DNA, 25 bp, Mus musculus
ccccgaattcctgaaggcagggaag

SEQ ID NO: 592186 - DNA, 25 bp, Mus musculus
ccccgacagacaatgagagcggcgg

SEQ ID NO: 592187 - DNA, 25 bp, Mus musculus
ccccgacagacattgagagcggcgg

SEQ ID NO: 592188 - DNA, 25 bp, Mus musculus
ccccgacgaaatcgacgagaacagc

SEQ ID NO: 592189 - DNA, 25 bp, Mus musculus
ccccgacgaaatggacgagaacagc

SEQ ID NO: 592190 - DNA, 25 bp, Mus musculus
ccccgacgggaacgcacttctgtga

SEQ ID NO: 592191 - DNA, 25 bp, Mus musculus
ccccgacgggaaggcacttctgtga

SEQ ID NO: 592192 - DNA, 25 bp, Mus musculus
ccccgactcgtaagagtgaatttgt

SEQ ID NO: 592193 - DNA, 25 bp, Mus musculus
ccccgactcgtatgagtgaatttgt

SEQ ID NO: 592194 - DNA, 25 bp, Mus musculus
ccccgagaagacacaacacgcattg

SEQ ID NO: 592195 - DNA, 25 bp, Mus musculus
ccccgagaagactcaacacgcattg

SEQ ID NO: 592196 - DNA, 25 bp, Mus musculus
ccccgagaggatcggctctggcatc

SEQ ID NO: 592197 - DNA, 25 bp, Mus musculus
ccccgagaggatgggctctggcatc

SEQ ID NO: 592198 - DNA, 25 bp, Mus musculus
ccccgagatcgtacgagaaatgatc

SEQ ID NO: 592199 - DNA, 25 bp, Mus musculus
ccccgagatcgttcgagaaatgatc

SEQ ID NO: 592200 - DNA, 25 bp, Mus musculus
ccccgagattcgaaaatacaagaag

SEQ ID NO: 592201 - DNA, 25 bp, Mus musculus
ccccgagattcgtaaatacaagaag

SEQ ID NO: 592202 - DNA, 25 bp, Mus musculus
ccccgagcgggaacgtctgatacgg

SEQ ID NO: 592203 - DNA, 25 bp, Mus musculus
ccccgagcgggatcgtctgatacgg

SEQ ID NO: 592204 - DNA, 25 bp, Mus musculus
ccccgagctgttaatcaagacaaaa

SEQ ID NO: 592205 - DNA, 25 bp, Mus musculus
ccccgagctgtttatcaagacaaaa

SEQ ID NO: 592206 - DNA, 25 bp, Mus musculus
ccccgaggcaagctgaaaagctcga

SEQ ID NO: 592207 - DNA, 25 bp, Mus musculus
ccccgaggcaaggtgaaaagctcga

SEQ ID NO: 592208 - DNA, 25 bp, Mus musculus
ccccgagggccaccttgtgctttgg

SEQ ID NO: 592209 - DNA, 25 bp, Mus musculus
ccccgagggccagcttgtgctttgg

SEQ ID NO: 592210 - DNA, 25 bp, Mus musculus
ccccgagggtgaagcgcagatcgat

SEQ ID NO: 592211 - DNA, 25 bp, Mus musculus
ccccgagggtgatgcgcagatcgat

SEQ ID NO: 592212 - DNA, 25 bp, Mus musculus
ccccgagtcccacattgtggaggag

SEQ ID NO: 592213 - DNA, 25 bp, Mus musculus
ccccgagtcccagattgtggaggag

SEQ ID NO: 592214 - DNA, 25 bp, Mus musculus
ccccgagtctaaagagaacaaggat

SEQ ID NO: 592215 - DNA, 25 bp, Mus musculus
ccccgagtctaatgagaacaaggat

SEQ ID NO: 592216 - DNA, 25 bp, Mus musculus
ccccgagtggatagtgacggccgcc

SEQ ID NO: 592217 - DNA, 25 bp, Mus musculus
ccccgagtggatccgattgtccttg

SEQ ID NO: 592218 - DNA, 25 bp, Mus musculus
ccccgagtggatgcgattgtccttg

SEQ ID NO: 592219 - DNA, 25 bp, Mus musculus
ccccgagtggattgtgacggccgcc

SEQ ID NO: 592220 - DNA, 25 bp, Mus musculus
ccccgagtggctcacagaaggctat

SEQ ID NO: 592221 - DNA, 25 bp, Mus musculus
ccccgagtggctgacagaaggctat

SEQ ID NO: 592222 - DNA, 25 bp, Mus musculus
ccccgagtgtggctgagggctctag

SEQ ID NO: 592223 - DNA, 25 bp, Mus musculus
ccccgagtgtgggtgagggctctag

SEQ ID NO: 592224 - DNA, 25 bp, Mus musculus
ccccgagttgatccagtatcaccag

SEQ ID NO: 592225 - DNA, 25 bp, Mus musculus
ccccgagttgatgcagtatcaccag

SEQ ID NO: 592226 - DNA, 25 bp, Mus musculus
ccccgatgcacccatgtttgtcatg

SEQ ID NO: 592227 - DNA, 25 bp, Mus musculus
ccccgatgcaccgatgtttgtcatg

SEQ ID NO: 592228 - DNA, 25 bp, Mus musculus
ccccgattatgaccacatggagtac

SEQ ID NO: 592229 - DNA, 25 bp, Mus musculus
ccccgattatgagcacatggagtac

SEQ ID NO: 592230 - DNA, 25 bp, Mus musculus
ccccgcagaaacaaatgtgcaaaga

SEQ ID NO: 592231 - DNA, 25 bp, Mus musculus
ccccgcagaaactaatgtgcaaaga

SEQ ID NO: 592232 - DNA, 25 bp, Mus musculus
ccccgcctgggaagccatgtaggca

SEQ ID NO: 592233 - DNA, 25 bp, Mus musculus
ccccgcctgggatgccatgtaggca

SEQ ID NO: 592234 - DNA, 25 bp, Mus musculus
ccccggacagatcggcttgtttctc

SEQ ID NO: 592235 - DNA, 25 bp, Mus musculus
ccccggacagatgggcttgtttctc

SEQ ID NO: 592236 - DNA, 25 bp, Mus musculus
ccccggacgtctaacaagacatggc

SEQ ID NO: 592237 - DNA, 25 bp, Mus musculus
ccccggacgtcttacaagacatggc

SEQ ID NO: 592238 - DNA, 25 bp, Mus musculus
ccccggaggaagactggacgaagat

SEQ ID NO: 592239 - DNA, 25 bp, Mus musculus
ccccggaggaagtctggacgaagat

SEQ ID NO: 592240 - DNA, 25 bp, Mus musculus
ccccggatcatcaagccacaaatgt

SEQ ID NO: 592241 - DNA, 25 bp, Mus musculus
ccccggatcatcacatggagaattg

SEQ ID NO: 592242 - DNA, 25 bp, Mus musculus
ccccggatcatctagccacaaatgt

SEQ ID NO: 592243 - DNA, 25 bp, Mus musculus
ccccggatcatctcatggagaattg

SEQ ID NO: 592244 - DNA, 25 bp, Mus musculus
ccccggatgaccagtgtgagaagat

SEQ ID NO: 592245 - DNA, 25 bp, Mus musculus
ccccggatgacctgtgtgagaagat

SEQ ID NO: 592246 - DNA, 25 bp, Mus musculus
ccccggcaaacaagtggcctcttca

SEQ ID NO: 592247 - DNA, 25 bp, Mus musculus
ccccggcaaacatgtggcctcttca

SEQ ID NO: 592248 - DNA, 25 bp, Mus musculus
ccccggcgataacgcagtactataa

SEQ ID NO: 592249 - DNA, 25 bp, Mus musculus
ccccggcgataaggcagtactataa

SEQ ID NO: 592250 - DNA, 25 bp, Mus musculus
ccccggctacggatatgattatgac

SEQ ID NO: 592251 - DNA, 25 bp, Mus musculus
ccccggctacggttatgattatgac

SEQ ID NO: 592252 - DNA, 25 bp, Mus musculus
ccccggcttgaacagcaacttgtct

SEQ ID NO: 592253 - DNA, 25 bp, Mus musculus
ccccggcttgaagagcaacttgtct

SEQ ID NO: 592254 - DNA, 25 bp, Mus musculus
ccccgggaagacctgattggcttga

SEQ ID NO: 592255 - DNA, 25 bp, Mus musculus
ccccgggaagacgtgattggcttga

SEQ ID NO: 592256 - DNA, 25 bp, Mus musculus
ccccgggacgccattcttggagtca

SEQ ID NO: 592257 - DNA, 25 bp, Mus musculus
ccccgggacgcctttcttggagtca

SEQ ID NO: 592258 - DNA, 25 bp, Mus musculus
ccccgggatcctaatctgtgaactt

SEQ ID NO: 592259 - DNA, 25 bp, Mus musculus
ccccgggatccttatctgtgaactt

SEQ ID NO: 592260 - DNA, 25 bp, Mus musculus
ccccgggctggccagatattgaacc

SEQ ID NO: 592261 - DNA, 25 bp, Mus musculus
ccccgggctggcgagatattgaacc

SEQ ID NO: 592262 - DNA, 25 bp, Mus musculus
ccccgggtgctcctcagtggagttt

SEQ ID NO: 592263 - DNA, 25 bp, Mus musculus
ccccgggtgctcgtcagtggagttt

SEQ ID NO: 592264 - DNA, 25 bp, Mus musculus
ccccggtcacagaaatttctcttct

SEQ ID NO: 592265 - DNA, 25 bp, Mus musculus
ccccggtcacagtaatttctcttct

SEQ ID NO: 592266 - DNA, 25 bp, Mus musculus
ccccggtgtggtaacctgccttgat

SEQ ID NO: 592267 - DNA, 25 bp, Mus musculus
ccccggtgtggttacctgccttgat

SEQ ID NO: 592268 - DNA, 25 bp, Mus musculus
ccccggtgtgtcctctcagggacga

SEQ ID NO: 592269 - DNA, 25 bp, Mus musculus
ccccggtgtgtcgtctcagggacga

SEQ ID NO: 592270 - DNA, 25 bp, Mus musculus
ccccggtttggcactcagtaacctg

SEQ ID NO: 592271 - DNA, 25 bp, Mus musculus
ccccggtttggctctcagtaacctg

SEQ ID NO: 592272 - DNA, 25 bp, Mus musculus
ccccgtctaagaagaggaataaatt

SEQ ID NO: 592273 - DNA, 25 bp, Mus musculus
ccccgtctaagatgaggaataaatt

SEQ ID NO: 592274 - DNA, 25 bp, Mus musculus
ccccgtcttgtaaaggtgacaggag

SEQ ID NO: 592275 - DNA, 25 bp, Mus musculus
ccccgtcttgtataggtgacaggag

SEQ ID NO: 592276 - DNA, 25 bp, Mus musculus
ccccgtgatcctctatgaagtatga

SEQ ID NO: 592277 - DNA, 25 bp, Mus musculus
ccccgtgatcctgtatgaagtatga

SEQ ID NO: 592278 - DNA, 25 bp, Mus musculus
ccccgtgcgtctagtctatttattg

SEQ ID NO: 592279 - DNA, 25 bp, Mus musculus
ccccgtgcgtcttgtctatttattg

SEQ ID NO: 592280 - DNA, 25 bp, Mus musculus
ccccgtggcctcaggagagctgtgt

SEQ ID NO: 592281 - DNA, 25 bp, Mus musculus
ccccgtggcctctggagagctgtgt

SEQ ID NO: 592282 - DNA, 25 bp, Mus musculus
ccccgtggtgaacgtgcgtgtccat

SEQ ID NO: 592283 - DNA, 25 bp, Mus musculus
ccccgtggtgaaggtgcgtgtccat

SEQ ID NO: 592284 - DNA, 25 bp, Mus musculus
ccccgtgttcttacagctgggttgc

SEQ ID NO: 592285 - DNA, 25 bp, Mus musculus
ccccgtgttctttcagctgggttgc

SEQ ID NO: 592286 - DNA, 25 bp, Mus musculus
ccccgtttcaatcagaatgctgttg

SEQ ID NO: 592287 - DNA, 25 bp, Mus musculus
ccccgtttcaatgagaatgctgttg

SEQ ID NO: 592288 - DNA, 25 bp, Mus musculus
cccctaaaagccaggaggaagctgt

SEQ ID NO: 592289 - DNA, 25 bp, Mus musculus
cccctaaaagcctggaggaagctgt

SEQ ID NO: 592290 - DNA, 25 bp, Mus musculus
cccctaagggtgagctcatgtacag

SEQ ID NO: 592291 - DNA, 25 bp, Mus musculus
cccctaagggtgaggcaaaggctca

SEQ ID NO: 592292 - DNA, 25 bp, Mus musculus
cccctaagggtgtgctcatgtacag

SEQ ID NO: 592293 - DNA, 25 bp, Mus musculus
cccctaagggtgtggcaaaggctca

SEQ ID NO: 592294 - DNA, 25 bp, Mus musculus
cccctaatgccactgtgaaaaagaa

SEQ ID NO: 592295 - DNA, 25 bp, Mus musculus
cccctaatgccagtgtgaaaaagaa

SEQ ID NO: 592296 - DNA, 25 bp, Mus musculus
cccctaatgctcatcaagcaagcag

SEQ ID NO: 592297 - DNA, 25 bp, Mus musculus
cccctaatgctcttcaagcaagcag

SEQ ID NO: 592298 - DNA, 25 bp, Mus musculus
cccctaatgtttcgttctcttactg

SEQ ID NO: 592299 - DNA, 25 bp, Mus musculus
cccctaatgtttggttctcttactg

SEQ ID NO: 592300 - DNA, 25 bp, Mus musculus
cccctacaacagacttggtactgct

SEQ ID NO: 592301 - DNA, 25 bp, Mus musculus
cccctacaacagtcttggtactgct

SEQ ID NO: 592302 - DNA, 25 bp, Mus musculus
cccctacaagggagaagtcaccaca

SEQ ID NO: 592303 - DNA, 25 bp, Mus musculus
cccctacaagggtgaagtcaccaca

SEQ ID NO: 592304 - DNA, 25 bp, Mus musculus
cccctacattgaaacatcagccaag

SEQ ID NO: 592305 - DNA, 25 bp, Mus musculus
cccctacattgatacatcagccaag

SEQ ID NO: 592306 - DNA, 25 bp, Mus musculus
cccctactggaaagagcgtctttga

SEQ ID NO: 592307 - DNA, 25 bp, Mus musculus
cccctactggaatgagcgtctttga

SEQ ID NO: 592308 - DNA, 25 bp, Mus musculus
cccctagacctaccctgtgaatttg

SEQ ID NO: 592309 - DNA, 25 bp, Mus musculus
cccctagacctagcctgtgaatttg

SEQ ID NO: 592310 - DNA, 25 bp, Mus musculus
cccctaggaagaaaataccagagaa

SEQ ID NO: 592311 - DNA, 25 bp, Mus musculus
cccctaggaagataataccagagaa

SEQ ID NO: 592312 - DNA, 25 bp, Mus musculus
cccctagtgtggagaaaggcctgct

SEQ ID NO: 592313 - DNA, 25 bp, Mus musculus
cccctagtgtggtgaaaggcctgct

SEQ ID NO: 592314 - DNA, 25 bp, Mus musculus
cccctatattccagccgtcggatgg

SEQ ID NO: 592315 - DNA, 25 bp, Mus musculus
cccctatattcctgccgtcggatgg

SEQ ID NO: 592316 - DNA, 25 bp, Mus musculus
cccctatattgaccccgattacgtg

SEQ ID NO: 592317 - DNA, 25 bp, Mus musculus
cccctatattgagcccgattacgtg

SEQ ID NO: 592318 - DNA, 25 bp, Mus musculus
cccctatgctgcagtgggagagtgt

SEQ ID NO: 592319 - DNA, 25 bp, Mus musculus
cccctatgctgctgtgggagagtgt

SEQ ID NO: 592320 - DNA, 25 bp, Mus musculus
cccctatgtgaacgtgtggctgatg

SEQ ID NO: 592321 - DNA, 25 bp, Mus musculus
cccctatgtgaaggtgtggctgatg

SEQ ID NO: 592322 - DNA, 25 bp, Mus musculus
cccctattgtgtcgctgcgagagca

SEQ ID NO: 592323 - DNA, 25 bp, Mus musculus
cccctattgtgtggctgcgagagca

SEQ ID NO: 592324 - DNA, 25 bp, Mus musculus
cccctcaccatgcattgcctgtgga

SEQ ID NO: 592325 - DNA, 25 bp, Mus musculus
cccctcaccatggattgcctgtgga

SEQ ID NO: 592326 - DNA, 25 bp, Mus musculus
cccctcagttgccaaagagtcatga

SEQ ID NO: 592327 - DNA, 25 bp, Mus musculus
cccctcagttgcgaaagagtcatga

SEQ ID NO: 592328 - DNA, 25 bp, Mus musculus
cccctcatattgaagatctggtgat

SEQ ID NO: 592329 - DNA, 25 bp, Mus musculus
cccctcatattgtagatctggtgat

SEQ ID NO: 592330 - DNA, 25 bp, Mus musculus
cccctcattttgataaatccaagaa

SEQ ID NO: 592331 - DNA, 25 bp, Mus musculus
cccctcattttgttaaatccaagaa

SEQ ID NO: 592332 - DNA, 25 bp, Mus musculus
cccctccgggagagtctgggtctga

SEQ ID NO: 592333 - DNA, 25 bp, Mus musculus
cccctccgggagtgtctgggtctga

SEQ ID NO: 592334 - DNA, 25 bp, Mus musculus
cccctcctaagtaaagctgtgagca

SEQ ID NO: 592335 - DNA, 25 bp, Mus musculus
cccctcctaagttaagctgtgagca

SEQ ID NO: 592336 - DNA, 25 bp, Mus musculus
cccctcctagagctttggtggcagt

SEQ ID NO: 592337 - DNA, 25 bp, Mus musculus
cccctcctagaggtttggtggcagt

SEQ ID NO: 592338 - DNA, 25 bp, Mus musculus
cccctcctgaggacttgcatgacaa

SEQ ID NO: 592339 - DNA, 25 bp, Mus musculus
cccctcctgaggtcttgcatgacaa

SEQ ID NO: 592340 - DNA, 25 bp, Mus musculus
cccctcctgagtatgttcagaagct

SEQ ID NO: 592341 - DNA, 25 bp, Mus musculus
cccctcctgagtttgttcagaagct

SEQ ID NO: 592342 - DNA, 25 bp, Mus musculus
cccctcgcggataaggagctagcgt

SEQ ID NO: 592343 - DNA, 25 bp, Mus musculus
cccctcgcggattaggagctagcgt

SEQ ID NO: 592344 - DNA, 25 bp, Mus musculus
cccctcgggtcccaacgagtggatg

SEQ ID NO: 592345 - DNA, 25 bp, Mus musculus
cccctcgggtccgaacgagtggatg

SEQ ID NO: 592346 - DNA, 25 bp, Mus musculus
cccctcggttggatagtcggagtgt

SEQ ID NO: 592347 - DNA, 25 bp, Mus musculus
cccctcggttggttagtcggagtgt

SEQ ID NO: 592348 - DNA, 25 bp, Mus musculus
cccctctcagaaagatataaacttg

SEQ ID NO: 592349 - DNA, 25 bp, Mus musculus
cccctctcagaatgatataaacttg

SEQ ID NO: 592350 - DNA, 25 bp, Mus musculus
cccctctgcactagctaagtgtgtc

SEQ ID NO: 592351 - DNA, 25 bp, Mus musculus
cccctctgcacttgctaagtgtgtc

SEQ ID NO: 592352 - DNA, 25 bp, Mus musculus
cccctctgtgaaaaggcacgctgat

SEQ ID NO: 592353 - DNA, 25 bp, Mus musculus
cccctctgtgaataggcacgctgat

SEQ ID NO: 592354 - DNA, 25 bp, Mus musculus
cccctctttctaccacagtgtagag

SEQ ID NO: 592355 - DNA, 25 bp, Mus musculus
cccctctttctagcacagtgtagag

SEQ ID NO: 592356 - DNA, 25 bp, Mus musculus
cccctgaacagaaggcactgacgta

SEQ ID NO: 592357 - DNA, 25 bp, Mus musculus
cccctgaacagatggcactgacgta

SEQ ID NO: 592358 - DNA, 25 bp, Mus musculus
cccctgaacatcaactttggcttta

SEQ ID NO: 592359 - DNA, 25 bp, Mus musculus
cccctgaacatctactttggcttta

SEQ ID NO: 592360 - DNA, 25 bp, Mus musculus
cccctgaactgtcagcttgttagag

SEQ ID NO: 592361 - DNA, 25 bp, Mus musculus
cccctgaactgtgagcttgttagag

SEQ ID NO: 592362 - DNA, 25 bp, Mus musculus
cccctgaaggagagcacctcatctg

SEQ ID NO: 592363 - DNA, 25 bp, Mus musculus
cccctgaaggagatctaccctgact

SEQ ID NO: 592364 - DNA, 25 bp, Mus musculus
cccctgaaggagtgcacctcatctg

SEQ ID NO: 592365 - DNA, 25 bp, Mus musculus
cccctgaaggagttctaccctgact

SEQ ID NO: 592366 - DNA, 25 bp, Mus musculus
cccctgaataaacgcggcggtgtgt

SEQ ID NO: 592367 - DNA, 25 bp, Mus musculus
cccctgaataaaggcggcggtgtgt

SEQ ID NO: 592368 - DNA, 25 bp, Mus musculus
cccctgaattttctggagcttgttg

SEQ ID NO: 592369 - DNA, 25 bp, Mus musculus
cccctgaattttgtggagcttgttg

SEQ ID NO: 592370 - DNA, 25 bp, Mus musculus
cccctgactttgcagactcagttta

SEQ ID NO: 592371 - DNA, 25 bp, Mus musculus
cccctgactttggagactcagttta

SEQ ID NO: 592372 - DNA, 25 bp, Mus musculus
cccctgagaaggacagaatgaattc

SEQ ID NO: 592373 - DNA, 25 bp, Mus musculus
cccctgagaaggtcagaatgaattc

SEQ ID NO: 592374 - DNA, 25 bp, Mus musculus
cccctgagatagaagagatggctct

SEQ ID NO: 592375 - DNA, 25 bp, Mus musculus
cccctgagatagtagagatggctct

SEQ ID NO: 592376 - DNA, 25 bp, Mus musculus
cccctgagatgtagcaggcgcacct

SEQ ID NO: 592377 - DNA, 25 bp, Mus musculus
cccctgagatgttgcaggcgcacct

SEQ ID NO: 592378 - DNA, 25 bp, Mus musculus
cccctgagcagcacaaggagtgtgc

SEQ ID NO: 592379 - DNA, 25 bp, Mus musculus
cccctgagcagctcaaggagtgtgc

SEQ ID NO: 592380 - DNA, 25 bp, Mus musculus
cccctgagctgtatggagaagtgcc

SEQ ID NO: 592381 - DNA, 25 bp, Mus musculus
cccctgagctgtttggagaagtgcc

SEQ ID NO: 592382 - DNA, 25 bp, Mus musculus
cccctgaggaagagacaacaggagt

SEQ ID NO: 592383 - DNA, 25 bp, Mus musculus
cccctgaggaagtgacaacaggagt

SEQ ID NO: 592384 - DNA, 25 bp, Mus musculus
cccctgaggagtcagggctcagacc

SEQ ID NO: 592385 - DNA, 25 bp, Mus musculus
cccctgaggagtgagggctcagacc

SEQ ID NO: 592386 - DNA, 25 bp, Mus musculus
cccctgaggcgtagtttgaccggat

SEQ ID NO: 592387 - DNA, 25 bp, Mus musculus
cccctgaggcgttgtttgaccggat

SEQ ID NO: 592388 - DNA, 25 bp, Mus musculus
cccctgagggacctgaacagctaaa

SEQ ID NO: 592389 - DNA, 25 bp, Mus musculus
cccctgagggacgtgaacagctaaa

SEQ ID NO: 592390 - DNA, 25 bp, Mus musculus
cccctgagtcccattgaggatgtgg

SEQ ID NO: 592391 - DNA, 25 bp, Mus musculus
cccctgagtccctttgaggatgtgg

SEQ ID NO: 592392 - DNA, 25 bp, Mus musculus
cccctgagtcttcgtgggtggacat

SEQ ID NO: 592393 - DNA, 25 bp, Mus musculus
cccctgagtcttggtgggtggacat

SEQ ID NO: 592394 - DNA, 25 bp, Mus musculus
cccctgatccaactttggataatga

SEQ ID NO: 592395 - DNA, 25 bp, Mus musculus
cccctgatccaagtttggataatga

SEQ ID NO: 592396 - DNA, 25 bp, Mus musculus
cccctgatgagcagaaggtatttgc

SEQ ID NO: 592397 - DNA, 25 bp, Mus musculus
cccctgatgagctgaaggtatttgc

SEQ ID NO: 592398 - DNA, 25 bp, Mus musculus
cccctgatgatgatagtgtgaccac

SEQ ID NO: 592399 - DNA, 25 bp, Mus musculus
cccctgatgatgttagtgtgaccac

SEQ ID NO: 592400 - DNA, 25 bp, Mus musculus
cccctgcagcggctggataacgaga

SEQ ID NO: 592401 - DNA, 25 bp, Mus musculus
cccctgcagcgggtggataacgaga

SEQ ID NO: 592402 - DNA, 25 bp, Mus musculus
cccctgcatcatcaaactcagagat

SEQ ID NO: 592403 - DNA, 25 bp, Mus musculus
cccctgcatcatgaaactcagagat

SEQ ID NO: 592404 - DNA, 25 bp, Mus musculus
cccctgcatgggaaatcaaccctgt

SEQ ID NO: 592405 - DNA, 25 bp, Mus musculus
cccctgcatgggtaatcaaccctgt

SEQ ID NO: 592406 - DNA, 25 bp, Mus musculus
cccctgccgtggaatctacctgttt

SEQ ID NO: 592407 - DNA, 25 bp, Mus musculus
cccctgccgtggtatctacctgttt

SEQ ID NO: 592408 - DNA, 25 bp, Mus musculus
cccctgcctaatcaaaattgtgcca

SEQ ID NO: 592409 - DNA, 25 bp, Mus musculus
cccctgcctaatgaaaattgtgcca

SEQ ID NO: 592410 - DNA, 25 bp, Mus musculus
cccctgctactgcatccttatggaa

SEQ ID NO: 592411 - DNA, 25 bp, Mus musculus
cccctgctactggatccttatggaa

SEQ ID NO: 592412 - DNA, 25 bp, Mus musculus
cccctgctcagaagagactcggctg

SEQ ID NO: 592413 - DNA, 25 bp, Mus musculus
cccctgctcagatgagactcggctg

SEQ ID NO: 592414 - DNA, 25 bp, Mus musculus
cccctgctcccaaggtatgagtact

SEQ ID NO: 592415 - DNA, 25 bp, Mus musculus
cccctgctcccatggtatgagtact

SEQ ID NO: 592416 - DNA, 25 bp, Mus musculus
cccctgctgaccatggagttcgact

SEQ ID NO: 592417 - DNA, 25 bp, Mus musculus
cccctgctgaccttggagttcgact

SEQ ID NO: 592418 - DNA, 25 bp, Mus musculus
cccctggactacatctactgatgct

SEQ ID NO: 592419 - DNA, 25 bp, Mus musculus
cccctggactacttctactgatgct

SEQ ID NO: 592420 - DNA, 25 bp, Mus musculus
cccctggagaacagcgatctcggtt

SEQ ID NO: 592421 - DNA, 25 bp, Mus musculus
cccctggagaactgcgatctcggtt

SEQ ID NO: 592422 - DNA, 25 bp, Mus musculus
cccctggatgcaatgatgcagtgca

SEQ ID NO: 592423 - DNA, 25 bp, Mus musculus
cccctggatgcattgatgcagtgca

SEQ ID NO: 592424 - DNA, 25 bp, Mus musculus
cccctggcaacacaaggtcaggttt

SEQ ID NO: 592425 - DNA, 25 bp, Mus musculus
cccctggcaacagaaggtcaggttt

SEQ ID NO: 592426 - DNA, 25 bp, Mus musculus
cccctggcctgaactatgcagaaag

SEQ ID NO: 592427 - DNA, 25 bp, Mus musculus
cccctggcctgatctatgcagaaag

SEQ ID NO: 592428 - DNA, 25 bp, Mus musculus
cccctggcctggagggtgatctgaa

SEQ ID NO: 592429 - DNA, 25 bp, Mus musculus
cccctggcctggtgggtgatctgaa

SEQ ID NO: 592430 - DNA, 25 bp, Mus musculus
cccctggcggacaaaagcattcgaa

SEQ ID NO: 592431 - DNA, 25 bp, Mus musculus
cccctggcggactaaagcattcgaa

SEQ ID NO: 592432 - DNA, 25 bp, Mus musculus
cccctggcggagagtgtggtgaagc

SEQ ID NO: 592433 - DNA, 25 bp, Mus musculus
cccctggcggagtgtgtggtgaagc

SEQ ID NO: 592434 - DNA, 25 bp, Mus musculus
cccctggcgtggacaatatcgttcc

SEQ ID NO: 592435 - DNA, 25 bp, Mus musculus
cccctggcgtggtcaatatcgttcc

SEQ ID NO: 592436 - DNA, 25 bp, Mus musculus
cccctggctgtgacggttctggaca

SEQ ID NO: 592437 - DNA, 25 bp, Mus musculus
cccctggctgtgtcggttctggaca

SEQ ID NO: 592438 - DNA, 25 bp, Mus musculus
cccctggctgttaggtctctgtgga

SEQ ID NO: 592439 - DNA, 25 bp, Mus musculus
cccctggctgtttggtctctgtgga

SEQ ID NO: 592440 - DNA, 25 bp, Mus musculus
cccctgggaacaagccggagctgta

SEQ ID NO: 592441 - DNA, 25 bp, Mus musculus
cccctgggaacatgccggagctgta

SEQ ID NO: 592442 - DNA, 25 bp, Mus musculus
cccctgggacacctctgaagaggat

SEQ ID NO: 592443 - DNA, 25 bp, Mus musculus
cccctgggacacgtctgaagaggat

SEQ ID NO: 592444 - DNA, 25 bp, Mus musculus
cccctgggcaagcagacagagtctc

SEQ ID NO: 592445 - DNA, 25 bp, Mus musculus
cccctgggcaaggagacagagtctc

SEQ ID NO: 592446 - DNA, 25 bp, Mus musculus
cccctgggtgccagacgtaacaagg

SEQ ID NO: 592447 - DNA, 25 bp, Mus musculus
cccctgggtgcctgacgtaacaagg

SEQ ID NO: 592448 - DNA, 25 bp, Mus musculus
cccctgggttagagtcttgtggatc

SEQ ID NO: 592449 - DNA, 25 bp, Mus musculus
cccctgggttagtgtcttgtggatc

SEQ ID NO: 592450 - DNA, 25 bp, Mus musculus
cccctgggttctatggctgctctga

SEQ ID NO: 592451 - DNA, 25 bp, Mus musculus
cccctgggttctttggctgctctga

SEQ ID NO: 592452 - DNA, 25 bp, Mus musculus
cccctggtgaccattaatcgttctg

SEQ ID NO: 592453 - DNA, 25 bp, Mus musculus
cccctggtgacctttaatcgttctg

SEQ ID NO: 592454 - DNA, 25 bp, Mus musculus
cccctggtgggcagttcatgaaatg

SEQ ID NO: 592455 - DNA, 25 bp, Mus musculus
cccctggtgggctgttcatgaaatg

SEQ ID NO: 592456 - DNA, 25 bp, Mus musculus
cccctggtgggtcattcggatgccc

SEQ ID NO: 592457 - DNA, 25 bp, Mus musculus
cccctggtgggtgattcggatgccc

SEQ ID NO: 592458 - DNA, 25 bp, Mus musculus
cccctggtggtacgtttgctcctgc

SEQ ID NO: 592459 - DNA, 25 bp, Mus musculus
cccctggtggtaggtttgctcctgc

SEQ ID NO: 592460 - DNA, 25 bp, Mus musculus
cccctggtggtcagggtctacagca

SEQ ID NO: 592461 - DNA, 25 bp, Mus musculus
cccctggtggtctgggtctacagca

SEQ ID NO: 592462 - DNA, 25 bp, Mus musculus
cccctggtttcaatcgaaggcctca

SEQ ID NO: 592463 - DNA, 25 bp, Mus musculus
cccctggtttcattcgaaggcctca

SEQ ID NO: 592464 - DNA, 25 bp, Mus musculus
cccctgtaccatctcaatgaaaagc

SEQ ID NO: 592465 - DNA, 25 bp, Mus musculus
cccctgtaccatgtcaatgaaaagc

SEQ ID NO: 592466 - DNA, 25 bp, Mus musculus
cccctgtatatgaagaacgaattcc

SEQ ID NO: 592467 - DNA, 25 bp, Mus musculus
cccctgtatatgtagaacgaattcc

SEQ ID NO: 592468 - DNA, 25 bp, Mus musculus
cccctgtcaaggaggccttgaagtc

SEQ ID NO: 592469 - DNA, 25 bp, Mus musculus
cccctgtcaaggtggccttgaagtc

SEQ ID NO: 592470 - DNA, 25 bp, Mus musculus
cccctgtcaagtctctggagtctgg

SEQ ID NO: 592471 - DNA, 25 bp, Mus musculus
cccctgtcaagtgtctggagtctgg

SEQ ID NO: 592472 - DNA, 25 bp, Mus musculus
cccctgtgcaggaccgggttagcat

SEQ ID NO: 592473 - DNA, 25 bp, Mus musculus
cccctgtgcaggtccgggttagcat

SEQ ID NO: 592474 - DNA, 25 bp, Mus musculus
cccctgtgcctgacgtagaaagtct

SEQ ID NO: 592475 - DNA, 25 bp, Mus musculus
cccctgtgcctgtcgtagaaagtct

SEQ ID NO: 592476 - DNA, 25 bp, Mus musculus
cccctgtgctagacatcgcctggtg

SEQ ID NO: 592477 - DNA, 25 bp, Mus musculus
cccctgtgctagtcatcgcctggtg

SEQ ID NO: 592478 - DNA, 25 bp, Mus musculus
cccctgtggtatctgaccaaggaga

SEQ ID NO: 592479 - DNA, 25 bp, Mus musculus
cccctgtggtatgtgaccaaggaga

SEQ ID NO: 592480 - DNA, 25 bp, Mus musculus
cccctgtgtcgaccgatgatgacaa

SEQ ID NO: 592481 - DNA, 25 bp, Mus musculus
cccctgtgtcgagcgatgatgacaa

SEQ ID NO: 592482 - DNA, 25 bp, Mus musculus
cccctgtttacacataacgctaact

SEQ ID NO: 592483 - DNA, 25 bp, Mus musculus
cccctgtttacagataacgctaact

SEQ ID NO: 592484 - DNA, 25 bp, Mus musculus
cccctgtttgtgcttagcaaagttg

SEQ ID NO: 592485 - DNA, 25 bp, Mus musculus
cccctgtttgtggttagcaaagttg

SEQ ID NO: 592486 - DNA, 25 bp, Mus musculus
ccccttaacatgcatgtgttccctg

SEQ ID NO: 592487 - DNA, 25 bp, Mus musculus
ccccttaacatggatgtgttccctg

SEQ ID NO: 592488 - DNA, 25 bp, Mus musculus
ccccttacacagaagaagatatacc

SEQ ID NO: 592489 - DNA, 25 bp, Mus musculus
ccccttacacagtagaagatatacc

SEQ ID NO: 592490 - DNA, 25 bp, Mus musculus
ccccttatcctgctgctggtctata

SEQ ID NO: 592491 - DNA, 25 bp, Mus musculus
ccccttatcctggtgctggtctata

SEQ ID NO: 592492 - DNA, 25 bp, Mus musculus
ccccttatcgcaaagaaaaccagac

SEQ ID NO: 592493 - DNA, 25 bp, Mus musculus
ccccttatcgcatagaaaaccagac

SEQ ID NO: 592494 - DNA, 25 bp, Mus musculus
ccccttccgtcacagtgatgcagag

SEQ ID NO: 592495 - DNA, 25 bp, Mus musculus
ccccttccgtcagagtgatgcagag

SEQ ID NO: 592496 - DNA, 25 bp, Mus musculus
ccccttcctctgctagggaagacaa

SEQ ID NO: 592497 - DNA, 25 bp, Mus musculus
ccccttcctctggtagggaagacaa

SEQ ID NO: 592498 - DNA, 25 bp, Mus musculus
ccccttctctgtaattggaaacaca

SEQ ID NO: 592499 - DNA, 25 bp, Mus musculus
ccccttctctgttattggaaacaca

SEQ ID NO: 592500 - DNA, 25 bp, Mus musculus
ccccttcttgaaatccatgccgaat

SEQ ID NO: 592501 - DNA, 25 bp, Mus musculus
ccccttcttgaattccatgccgaat

SEQ ID NO: 592502 - DNA, 25 bp, Mus musculus
ccccttcttgggatttcactctgtc

SEQ ID NO: 592503 - DNA, 25 bp, Mus musculus
ccccttcttgggttttcactctgtc

SEQ ID NO: 592504 - DNA, 25 bp, Mus musculus
ccccttgaccggagagacggcctgg

SEQ ID NO: 592505 - DNA, 25 bp, Mus musculus
ccccttgaccggtgagacggcctgg

SEQ ID NO: 592506 - DNA, 25 bp, Mus musculus
ccccttgagtctcggtaataaactg

SEQ ID NO: 592507 - DNA, 25 bp, Mus musculus
ccccttgagtctgggtaataaactg

SEQ ID NO: 592508 - DNA, 25 bp, Mus musculus
ccccttgatggaagaaatgttccag

SEQ ID NO: 592509 - DNA, 25 bp, Mus musculus
ccccttgatggatgaaatgttccag

SEQ ID NO: 592510 - DNA, 25 bp, Mus musculus
ccccttgcacacagcggtgatttgg

SEQ ID NO: 592511 - DNA, 25 bp, Mus musculus
ccccttgcacactgcggtgatttgg

SEQ ID NO: 592512 - DNA, 25 bp, Mus musculus
ccccttgctataagaccatggacga

SEQ ID NO: 592513 - DNA, 25 bp, Mus musculus
ccccttgctatatgaccatggacga

SEQ ID NO: 592514 - DNA, 25 bp, Mus musculus
ccccttggcgaaataagggctgctg

SEQ ID NO: 592515 - DNA, 25 bp, Mus musculus
ccccttggcgaattaagggctgctg

SEQ ID NO: 592516 - DNA, 25 bp, Mus musculus
ccccttggtgcacgaaagccttcta

SEQ ID NO: 592517 - DNA, 25 bp, Mus musculus
ccccttggtgcaggaaagccttcta

SEQ ID NO: 592518 - DNA, 25 bp, Mus musculus
ccccttggtggacctcagcttgtca

SEQ ID NO: 592519 - DNA, 25 bp, Mus musculus
ccccttggtggagctcagcttgtca

SEQ ID NO: 592520 - DNA, 25 bp, Mus musculus
ccccttggtgtgctgacagtgagca

SEQ ID NO: 592521 - DNA, 25 bp, Mus musculus
ccccttggtgtggtgacagtgagca

SEQ ID NO: 592522 - DNA, 25 bp, Mus musculus
ccccttgtgctaaagaagcgagata

SEQ ID NO: 592523 - DNA, 25 bp, Mus musculus
ccccttgtgctatagaagcgagata

SEQ ID NO: 592524 - DNA, 25 bp, Mus musculus
cccctttacagtatgcagcctgcaa

SEQ ID NO: 592525 - DNA, 25 bp, Mus musculus
cccctttacagtttgcagcctgcaa

SEQ ID NO: 592526 - DNA, 25 bp, Mus musculus
cccctttgatgtcagtcatggtagc

SEQ ID NO: 592527 - DNA, 25 bp, Mus musculus
cccctttgatgtgagtcatggtagc

SEQ ID NO: 592528 - DNA, 25 bp, Mus musculus
cccctttgctgaagctctggacctg

SEQ ID NO: 592529 - DNA, 25 bp, Mus musculus
cccctttgctgatgctctggacctg

SEQ ID NO: 592530 - DNA, 25 bp, Mus musculus
ccccttttgagtacgcgggcaaatg

SEQ ID NO: 592531 - DNA, 25 bp, Mus musculus
ccccttttgagttcgcgggcaaatg

SEQ ID NO: 592532 - DNA, 25 bp, Mus musculus
cccgaaaaaagacgctgaatatcat

SEQ ID NO: 592533 - DNA, 25 bp, Mus musculus
cccgaaaaaagaggctgaatatcat

SEQ ID NO: 592534 - DNA, 25 bp, Mus musculus
cccgaaaccggaagatgtctagcaa

SEQ ID NO: 592535 - DNA, 25 bp, Mus musculus
cccgaaaccggatgatgtctagcaa

SEQ ID NO: 592536 - DNA, 25 bp, Mus musculus
cccgaaccactgcatatgtgatcca

SEQ ID NO: 592537 - DNA, 25 bp, Mus musculus
cccgaaccactggatatgtgatcca

SEQ ID NO: 592538 - DNA, 25 bp, Mus musculus
cccgaactcaatcttatgggaagtt

SEQ ID NO: 592539 - DNA, 25 bp, Mus musculus
cccgaactcaatgttatgggaagtt

SEQ ID NO: 592540 - DNA, 25 bp, Mus musculus
cccgaacttgggaccctggatccag

SEQ ID NO: 592541 - DNA, 25 bp, Mus musculus
cccgaacttgggtccctggatccag

SEQ ID NO: 592542 - DNA, 25 bp, Mus musculus
cccgaagagtgcctagagttcaagt

SEQ ID NO: 592543 - DNA, 25 bp, Mus musculus
cccgaagagtgcgtagagttcaagt

SEQ ID NO: 592544 - DNA, 25 bp, Mus musculus
cccgaagatcttccgataatttgtt

SEQ ID NO: 592545 - DNA, 25 bp, Mus musculus
cccgaagatcttgcgataatttgtt

SEQ ID NO: 592546 - DNA, 25 bp, Mus musculus
cccgaagatgatcggaatgacctca

SEQ ID NO: 592547 - DNA, 25 bp, Mus musculus
cccgaagatgatgggaatgacctca

SEQ ID NO: 592548 - DNA, 25 bp, Mus musculus
cccgaaggagcgcacacggtgtcca

SEQ ID NO: 592549 - DNA, 25 bp, Mus musculus
cccgaaggagcggacacggtgtcca

SEQ ID NO: 592550 - DNA, 25 bp, Mus musculus
cccgaaggctgcatatgtgtatgac

SEQ ID NO: 592551 - DNA, 25 bp, Mus musculus
cccgaaggctgcttatgtgtatgac

SEQ ID NO: 592552 - DNA, 25 bp, Mus musculus
cccgaagggagcctaagctgcattc

SEQ ID NO: 592553 - DNA, 25 bp, Mus musculus
cccgaagggagcgtaagctgcattc

SEQ ID NO: 592554 - DNA, 25 bp, Mus musculus
cccgaagtgcagaggagatcgcccc

SEQ ID NO: 592555 - DNA, 25 bp, Mus musculus
cccgaagtgcagtggagatcgcccc

SEQ ID NO: 592556 - DNA, 25 bp, Mus musculus
cccgaagtgccaaaactgttgatta

SEQ ID NO: 592557 - DNA, 25 bp, Mus musculus
cccgaagtgccataactgttgatta

SEQ ID NO: 592558 - DNA, 25 bp, Mus musculus
cccgaatagctaaggctgagcaagc

SEQ ID NO: 592559 - DNA, 25 bp, Mus musculus
cccgaatagctatggctgagcaagc

SEQ ID NO: 592560 - DNA, 25 bp, Mus musculus
cccgaatccttaagggccagctaca

SEQ ID NO: 592561 - DNA, 25 bp, Mus musculus
cccgaatccttatgggccagctaca

SEQ ID NO: 592562 - DNA, 25 bp, Mus musculus
cccgaatgccggatcacatctaact

SEQ ID NO: 592563 - DNA, 25 bp, Mus musculus
cccgaatgccggttcacatctaact

SEQ ID NO: 592564 - DNA, 25 bp, Mus musculus
cccgaatggtcaccgagggctacag

SEQ ID NO: 592565 - DNA, 25 bp, Mus musculus
cccgaatggtcagcgagggctacag

SEQ ID NO: 592566 - DNA, 25 bp, Mus musculus
cccgacagatttctctcgtgaaggg

SEQ ID NO: 592567 - DNA, 25 bp, Mus musculus
cccgacagatttgtctcgtgaaggg

SEQ ID NO: 592568 - DNA, 25 bp, Mus musculus
cccgacagtgagaagtcttcccggg

SEQ ID NO: 592569 - DNA, 25 bp, Mus musculus
cccgacagtgagtagtcttcccggg

SEQ ID NO: 592570 - DNA, 25 bp, Mus musculus
cccgacatgaaaatggagctccttg

SEQ ID NO: 592571 - DNA, 25 bp, Mus musculus
cccgacatgaaattggagctccttg

SEQ ID NO: 592572 - DNA, 25 bp, Mus musculus
cccgacatgggtaggaatccgtgac

SEQ ID NO: 592573 - DNA, 25 bp, Mus musculus
cccgacatgggttggaatccgtgac

SEQ ID NO: 592574 - DNA, 25 bp, Mus musculus
cccgaccagtacctgaagatgaacg

SEQ ID NO: 592575 - DNA, 25 bp, Mus musculus
cccgaccagtacgtgaagatgaacg

SEQ ID NO: 592576 - DNA, 25 bp, Mus musculus
cccgaccctgtgattgagagtatct

SEQ ID NO: 592577 - DNA, 25 bp, Mus musculus
cccgaccctgtgtttgagagtatct

SEQ ID NO: 592578 - DNA, 25 bp, Mus musculus
cccgacgaaatccacgagaacagca

SEQ ID NO: 592579 - DNA, 25 bp, Mus musculus
cccgacgaaatcgacgagaacagca

SEQ ID NO: 592580 - DNA, 25 bp, Mus musculus
cccgacgacttaaaatggatgctgt

SEQ ID NO: 592581 - DNA, 25 bp, Mus musculus
cccgacgacttataatggatgctgt

SEQ ID NO: 592582 - DNA, 25 bp, Mus musculus
cccgacgagcttctgtcggccgtgt

SEQ ID NO: 592583 - DNA, 25 bp, Mus musculus
cccgacgagcttgtgtcggccgtgt

SEQ ID NO: 592584 - DNA, 25 bp, Mus musculus
cccgacggaggtcctagaaaagaga

SEQ ID NO: 592585 - DNA, 25 bp, Mus musculus
cccgacggaggtgctagaaaagaga

SEQ ID NO: 592586 - DNA, 25 bp, Mus musculus
cccgacgttctgacagcgataatga

SEQ ID NO: 592587 - DNA, 25 bp, Mus musculus
cccgacgttctgtcagcgataatga

SEQ ID NO: 592588 - DNA, 25 bp, Mus musculus
cccgactcgctaaagagtccattaa

SEQ ID NO: 592589 - DNA, 25 bp, Mus musculus
cccgactcgctatagagtccattaa

SEQ ID NO: 592590 - DNA, 25 bp, Mus musculus
cccgactctacgagagacgtacagc

SEQ ID NO: 592591 - DNA, 25 bp, Mus musculus
cccgactctacgtgagacgtacagc

SEQ ID NO: 592592 - DNA, 25 bp, Mus musculus
cccgactcttctctgatgtctacaa

SEQ ID NO: 592593 - DNA, 25 bp, Mus musculus
cccgactcttctgtgatgtctacaa

SEQ ID NO: 592594 - DNA, 25 bp, Mus musculus
cccgactgaaacatctgttgcagag

SEQ ID NO: 592595 - DNA, 25 bp, Mus musculus
cccgactgaaacttctgttgcagag

SEQ ID NO: 592596 - DNA, 25 bp, Mus musculus
cccgactgtggcaggtgcaagaaga

SEQ ID NO: 592597 - DNA, 25 bp, Mus musculus
cccgactgtggctggtgcaagaaga

SEQ ID NO: 592598 - DNA, 25 bp, Mus musculus
cccgagaagagtcggcggcacaaaa

SEQ ID NO: 592599 - DNA, 25 bp, Mus musculus
cccgagaagagtgggcggcacaaaa

SEQ ID NO: 592600 - DNA, 25 bp, Mus musculus
cccgagacagggatgagatggttaa

SEQ ID NO: 592601 - DNA, 25 bp, Mus musculus
cccgagacagggttgagatggttaa

SEQ ID NO: 592602 - DNA, 25 bp, Mus musculus
cccgagacatgtacgctgaggagcg

SEQ ID NO: 592603 - DNA, 25 bp, Mus musculus
cccgagacatgttcgctgaggagcg

SEQ ID NO: 592604 - DNA, 25 bp, Mus musculus
cccgagaccatcaaacagcactttg

SEQ ID NO: 592605 - DNA, 25 bp, Mus musculus
cccgagaccatctaacagcactttg

SEQ ID NO: 592606 - DNA, 25 bp, Mus musculus
cccgagactgagctaaaaatggaag

SEQ ID NO: 592607 - DNA, 25 bp, Mus musculus
cccgagactgaggtaaaaatggaag

SEQ ID NO: 592608 - DNA, 25 bp, Mus musculus
cccgagagacggacggtctacgagc

SEQ ID NO: 592609 - DNA, 25 bp, Mus musculus
cccgagagacggtcggtctacgagc

SEQ ID NO: 592610 - DNA, 25 bp, Mus musculus
cccgagagagaacttatcagtgccc

SEQ ID NO: 592611 - DNA, 25 bp, Mus musculus
cccgagagagaagttatcagtgccc

SEQ ID NO: 592612 - DNA, 25 bp, Mus musculus
cccgagagagttagttgatttctcc

SEQ ID NO: 592613 - DNA, 25 bp, Mus musculus
cccgagagagtttgttgatttctcc

SEQ ID NO: 592614 - DNA, 25 bp, Mus musculus
cccgagagcaaacaagagtggcatc

SEQ ID NO: 592615 - DNA, 25 bp, Mus musculus
cccgagagcaaagaagagtggcatc

SEQ ID NO: 592616 - DNA, 25 bp, Mus musculus
cccgagaggagcctgttgacactga

SEQ ID NO: 592617 - DNA, 25 bp, Mus musculus
cccgagaggagcgtgttgacactga

SEQ ID NO: 592618 - DNA, 25 bp, Mus musculus
cccgagataatcaggagcaggaaat

SEQ ID NO: 592619 - DNA, 25 bp, Mus musculus
cccgagataatctggagcaggaaat

SEQ ID NO: 592620 - DNA, 25 bp, Mus musculus
cccgagatattaagcagttagatca

SEQ ID NO: 592621 - DNA, 25 bp, Mus musculus
cccgagatattatgcagttagatca

SEQ ID NO: 592622 - DNA, 25 bp, Mus musculus
cccgagatgaaaaggtttcctggat

SEQ ID NO: 592623 - DNA, 25 bp, Mus musculus
cccgagatgaaatggtttcctggat

SEQ ID NO: 592624 - DNA, 25 bp, Mus musculus
cccgagccgctgacatggatggata

SEQ ID NO: 592625 - DNA, 25 bp, Mus musculus
cccgagccgctgtcatggatggata

SEQ ID NO: 592626 - DNA, 25 bp, Mus musculus
cccgagccggtcacgctgctggtga

SEQ ID NO: 592627 - DNA, 25 bp, Mus musculus
cccgagccggtctcgctgctggtga

SEQ ID NO: 592628 - DNA, 25 bp, Mus musculus
cccgagcctgctaccggcagttttt

SEQ ID NO: 592629 - DNA, 25 bp, Mus musculus
cccgagcctgcttccggcagttttt

SEQ ID NO: 592630 - DNA, 25 bp, Mus musculus
cccgagctctgcacctgtgaaggag

SEQ ID NO: 592631 - DNA, 25 bp, Mus musculus
cccgagctctgctcctgtgaaggag

SEQ ID NO: 592632 - DNA, 25 bp, Mus musculus
cccgagctgttaatcaagacaaaaa

SEQ ID NO: 592633 - DNA, 25 bp, Mus musculus
cccgagctgttattcaagacaaaaa

SEQ ID NO: 592634 - DNA, 25 bp, Mus musculus
cccgagctttcgaggcgtaatgcct

SEQ ID NO: 592635 - DNA, 25 bp, Mus musculus
cccgagctttcgtggcgtaatgcct

SEQ ID NO: 592636 - DNA, 25 bp, Mus musculus
cccgaggaattcctggatccccagg

SEQ ID NO: 592637 - DNA, 25 bp, Mus musculus
cccgaggaattcgtggatccccagg

SEQ ID NO: 592638 - DNA, 25 bp, Mus musculus
cccgaggacgtcactgacgcgcggt

SEQ ID NO: 592639 - DNA, 25 bp, Mus musculus
cccgaggacgtctctgacgcgcggt

SEQ ID NO: 592640 - DNA, 25 bp, Mus musculus
cccgaggcaagcagaaaagctcgaa

SEQ ID NO: 592641 - DNA, 25 bp, Mus musculus
cccgaggcaagctgaaaagctcgaa

SEQ ID NO: 592642 - DNA, 25 bp, Mus musculus
cccgaggcactcagagagctgccat

SEQ ID NO: 592643 - DNA, 25 bp, Mus musculus
cccgaggcactctgagagctgccat

SEQ ID NO: 592644 - DNA, 25 bp, Mus musculus
cccgaggcaggcatagccaatgacg

SEQ ID NO: 592645 - DNA, 25 bp, Mus musculus
cccgaggcaggcttagccaatgacg

SEQ ID NO: 592646 - DNA, 25 bp, Mus musculus
cccgaggtattgatatacaagctgt

SEQ ID NO: 592647 - DNA, 25 bp, Mus musculus
cccgaggtattgttatacaagctgt

SEQ ID NO: 592648 - DNA, 25 bp, Mus musculus
cccgaggtcatgatggtatgagcca

SEQ ID NO: 592649 - DNA, 25 bp, Mus musculus
cccgaggtcatgttggtatgagcca

SEQ ID NO: 592650 - DNA, 25 bp, Mus musculus
cccgaggttgacaacgcgattctgt

SEQ ID NO: 592651 - DNA, 25 bp, Mus musculus
cccgaggttgactacgcgattctgt

SEQ ID NO: 592652 - DNA, 25 bp, Mus musculus
cccgagtacttactggaccagcata

SEQ ID NO: 592653 - DNA, 25 bp, Mus musculus
cccgagtacttagtggaccagcata

SEQ ID NO: 592654 - DNA, 25 bp, Mus musculus
cccgagtatccactgccgtgaaggc

SEQ ID NO: 592655 - DNA, 25 bp, Mus musculus
cccgagtatccagtgccgtgaaggc

SEQ ID NO: 592656 - DNA, 25 bp, Mus musculus
cccgagtatcgtatgagcagatcct

SEQ ID NO: 592657 - DNA, 25 bp, Mus musculus
cccgagtatcgtttgagcagatcct

SEQ ID NO: 592658 - DNA, 25 bp, Mus musculus
cccgagtcagaactccatcacaggg

SEQ ID NO: 592659 - DNA, 25 bp, Mus musculus
cccgagtcagaagtccatcacaggg

SEQ ID NO: 592660 - DNA, 25 bp, Mus musculus
cccgagtccatgcaagaagttccca

SEQ ID NO: 592661 - DNA, 25 bp, Mus musculus
cccgagtccatggaagaagttccca

SEQ ID NO: 592662 - DNA, 25 bp, Mus musculus
cccgagtcccagattgtggaggaga

SEQ ID NO: 592663 - DNA, 25 bp, Mus musculus
cccgagtcccagtttgtggaggaga

SEQ ID NO: 592664 - DNA, 25 bp, Mus musculus
cccgagtcctagatgacggagagct

SEQ ID NO: 592665 - DNA, 25 bp, Mus musculus
cccgagtcctagttgacggagagct

SEQ ID NO: 592666 - DNA, 25 bp, Mus musculus
cccgagtcgccactgtgctagggct

SEQ ID NO: 592667 - DNA, 25 bp, Mus musculus
cccgagtcgccagtgtgctagggct

SEQ ID NO: 592668 - DNA, 25 bp, Mus musculus
cccgagttatctatgccatggctga

SEQ ID NO: 592669 - DNA, 25 bp, Mus musculus
cccgagttatctttgccatggctga

SEQ ID NO: 592670 - DNA, 25 bp, Mus musculus
cccgagttcatgctgtcagtcagct

SEQ ID NO: 592671 - DNA, 25 bp, Mus musculus
cccgagttcatggtgtcagtcagct

SEQ ID NO: 592672 - DNA, 25 bp, Mus musculus
cccgagttcttgacatcggtagcgg

SEQ ID NO: 592673 - DNA, 25 bp, Mus musculus
cccgagttcttgtcatcggtagcgg

SEQ ID NO: 592674 - DNA, 25 bp, Mus musculus
cccgagttgcaaacggctgtcagag

SEQ ID NO: 592675 - DNA, 25 bp, Mus musculus
cccgagttgcaatcggctgtcagag

SEQ ID NO: 592676 - DNA, 25 bp, Mus musculus
cccgagttttgtcgaccgcatcttt

SEQ ID NO: 592677 - DNA, 25 bp, Mus musculus
cccgagttttgtggaccgcatcttt

SEQ ID NO: 592678 - DNA, 25 bp, Mus musculus
cccgatagaggtcagagaggccact

SEQ ID NO: 592679 - DNA, 25 bp, Mus musculus
cccgatagaggtgagagaggccact

SEQ ID NO: 592680 - DNA, 25 bp, Mus musculus
cccgatagcagaagggtcaactctt

SEQ ID NO: 592681 - DNA, 25 bp, Mus musculus
cccgatagcagatgggtcaactctt

SEQ ID NO: 592682 - DNA, 25 bp, Mus musculus
cccgatgactgaagaaatacagcaa

SEQ ID NO: 592683 - DNA, 25 bp, Mus musculus
cccgatgactgatgaaatacagcaa

SEQ ID NO: 592684 - DNA, 25 bp, Mus musculus
cccgatggctgaatacttgaaactg

SEQ ID NO: 592685 - DNA, 25 bp, Mus musculus
cccgatggctgattacttgaaactg

SEQ ID NO: 592686 - DNA, 25 bp, Mus musculus
cccgatggtgaaaaccagtctaatg

SEQ ID NO: 592687 - DNA, 25 bp, Mus musculus
cccgatggtgaataccagtctaatg

SEQ ID NO: 592688 - DNA, 25 bp, Mus musculus
cccgatgtggagaatgatatacttt

SEQ ID NO: 592689 - DNA, 25 bp, Mus musculus
cccgatgtggagtatgatatacttt

SEQ ID NO: 592690 - DNA, 25 bp, Mus musculus
cccgatgtgggcaacttccactatg

SEQ ID NO: 592691 - DNA, 25 bp, Mus musculus
cccgatgtgggctacttccactatg

SEQ ID NO: 592692 - DNA, 25 bp, Mus musculus
cccgattcggagacgcgcgactgag

SEQ ID NO: 592693 - DNA, 25 bp, Mus musculus
cccgattcggagtcgcgcgactgag

SEQ ID NO: 592694 - DNA, 25 bp, Mus musculus
cccgattctgggactgctcacaaga

SEQ ID NO: 592695 - DNA, 25 bp, Mus musculus
cccgattctgggtctgctcacaaga

SEQ ID NO: 592696 - DNA, 25 bp, Mus musculus
cccgatttggctatggatttggcaa

SEQ ID NO: 592697 - DNA, 25 bp, Mus musculus
cccgatttggctttggatttggcaa

SEQ ID NO: 592698 - DNA, 25 bp, Mus musculus
cccgatttgggaactggatgctgat

SEQ ID NO: 592699 - DNA, 25 bp, Mus musculus
cccgatttgggatctggatgctgat

SEQ ID NO: 592700 - DNA, 25 bp, Mus musculus
cccgcaaaacttcaatgaatctgat

SEQ ID NO: 592701 - DNA, 25 bp, Mus musculus
cccgcaaaacttgaatgaatctgat

SEQ ID NO: 592702 - DNA, 25 bp, Mus musculus
cccgcaagaacacgtccaagtcgga

SEQ ID NO: 592703 - DNA, 25 bp, Mus musculus
cccgcaagaacaggtccaagtcgga

SEQ ID NO: 592704 - DNA, 25 bp, Mus musculus
cccgcaagatgaaggctgacgaggc

SEQ ID NO: 592705 - DNA, 25 bp, Mus musculus
cccgcaagatgatggctgacgaggc

SEQ ID NO: 592706 - DNA, 25 bp, Mus musculus
cccgcaaggtcactggaggaattca

SEQ ID NO: 592707 - DNA, 25 bp, Mus musculus
cccgcaaggtcagtggaggaattca

SEQ ID NO: 592708 - DNA, 25 bp, Mus musculus
cccgcaatgagaactacatcctctt

SEQ ID NO: 592709 - DNA, 25 bp, Mus musculus
cccgcaatgagatctacatcctctt

SEQ ID NO: 592710 - DNA, 25 bp, Mus musculus
cccgcacaaggcagctctaacgtat

SEQ ID NO: 592711 - DNA, 25 bp, Mus musculus
cccgcacaaggctgctctaacgtat

SEQ ID NO: 592712 - DNA, 25 bp, Mus musculus
cccgcacactgaagcggcagcagag

SEQ ID NO: 592713 - DNA, 25 bp, Mus musculus
cccgcacactgatgcggcagcagag

SEQ ID NO: 592714 - DNA, 25 bp, Mus musculus
cccgcaccagctaccgggaggagga

SEQ ID NO: 592715 - DNA, 25 bp, Mus musculus
cccgcaccagcttccgggaggagga

SEQ ID NO: 592716 - DNA, 25 bp, Mus musculus
cccgcagagtggagagctaccctct

SEQ ID NO: 592717 - DNA, 25 bp, Mus musculus
cccgcagagtggtgagctaccctct

SEQ ID NO: 592718 - DNA, 25 bp, Mus musculus
cccgcagcgcatagaggagtgcata

SEQ ID NO: 592719 - DNA, 25 bp, Mus musculus
cccgcagcgcattgaggagtgcata

SEQ ID NO: 592720 - DNA, 25 bp, Mus musculus
cccgcagctgttaccaggatgtcta

SEQ ID NO: 592721 - DNA, 25 bp, Mus musculus
cccgcagctgtttccaggatgtcta

SEQ ID NO: 592722 - DNA, 25 bp, Mus musculus
cccgcaggccagaagtggctgccag

SEQ ID NO: 592723 - DNA, 25 bp, Mus musculus
cccgcaggccagtagtggctgccag

SEQ ID NO: 592724 - DNA, 25 bp, Mus musculus
cccgcaggggtgcatagctttcttc

SEQ ID NO: 592725 - DNA, 25 bp, Mus musculus
cccgcaggggtggatagctttcttc

SEQ ID NO: 592726 - DNA, 25 bp, Mus musculus
cccgcaggttccagtgcggtgtcgt

SEQ ID NO: 592727 - DNA, 25 bp, Mus musculus
cccgcaggttcctgtgcggtgtcgt

SEQ ID NO: 592728 - DNA, 25 bp, Mus musculus
cccgcatgggtgctcatctagtggt

SEQ ID NO: 592729 - DNA, 25 bp, Mus musculus
cccgcatgggtggtcatctagtggt

SEQ ID NO: 592730 - DNA, 25 bp, Mus musculus
cccgcattaagcacatcgactttgg

SEQ ID NO: 592731 - DNA, 25 bp, Mus musculus
cccgcattaagctcatcgactttgg

SEQ ID NO: 592732 - DNA, 25 bp, Mus musculus
cccgccacgttgctgttgccatgaa

SEQ ID NO: 592733 - DNA, 25 bp, Mus musculus
cccgccacgttggtgttgccatgaa

SEQ ID NO: 592734 - DNA, 25 bp, Mus musculus
cccgccagcgtcaagaaactcttga

SEQ ID NO: 592735 - DNA, 25 bp, Mus musculus
cccgccagcgtctagaaactcttga

SEQ ID NO: 592736 - DNA, 25 bp, Mus musculus
cccgccaggcgtctgaggacagaca

SEQ ID NO: 592737 - DNA, 25 bp, Mus musculus
cccgccaggcgtgtgaggacagaca

SEQ ID NO: 592738 - DNA, 25 bp, Mus musculus
cccgcccgtgtaacaggatgtcctt

SEQ ID NO: 592739 - DNA, 25 bp, Mus musculus
cccgcccgtgtatcaggatgtcctt

SEQ ID NO: 592740 - DNA, 25 bp, Mus musculus
cccgccgcccagcagagttgtgttt

SEQ ID NO: 592741 - DNA, 25 bp, Mus musculus
cccgccgcccaggagagttgtgttt

SEQ ID NO: 592742 - DNA, 25 bp, Mus musculus
cccgccgtgcgtactcactggaggg

SEQ ID NO: 592743 - DNA, 25 bp, Mus musculus
cccgccgtgcgttctcactggaggg

SEQ ID NO: 592744 - DNA, 25 bp, Mus musculus
cccgcctagcagcacctgggagaag

SEQ ID NO: 592745 - DNA, 25 bp, Mus musculus
cccgcctagcaggacctgggagaag

SEQ ID NO: 592746 - DNA, 25 bp, Mus musculus
cccgcctcagggaggagagtcctga

SEQ ID NO: 592747 - DNA, 25 bp, Mus musculus
cccgcctcagggtggagagtcctga

SEQ ID NO: 592748 - DNA, 25 bp, Mus musculus
cccgcctgacagcatgagcagttca

SEQ ID NO: 592749 - DNA, 25 bp, Mus musculus
cccgcctgacaggatgagcagttca

SEQ ID NO: 592750 - DNA, 25 bp, Mus musculus
cccgcctgtattaccactggaagag

SEQ ID NO: 592751 - DNA, 25 bp, Mus musculus
cccgcctgtatttccactggaagag

SEQ ID NO: 592752 - DNA, 25 bp, Mus musculus
cccgcgaggcgcaggtagacctctg

SEQ ID NO: 592753 - DNA, 25 bp, Mus musculus
cccgcgaggcgctggtagacctctg

SEQ ID NO: 592754 - DNA, 25 bp, Mus musculus
cccgcgcagcggattgacagtgacg

SEQ ID NO: 592755 - DNA, 25 bp, Mus musculus
cccgcgcagcggtttgacagtgacg

SEQ ID NO: 592756 - DNA, 25 bp, Mus musculus
cccgcgcatcttcgatatgccagga

SEQ ID NO: 592757 - DNA, 25 bp, Mus musculus
cccgcgcatcttggatatgccagga

SEQ ID NO: 592758 - DNA, 25 bp, Mus musculus
cccgcgccctatatctagtgacgtt

SEQ ID NO: 592759 - DNA, 25 bp, Mus musculus
cccgcgccctatttctagtgacgtt

SEQ ID NO: 592760 - DNA, 25 bp, Mus musculus
cccgcggcgcttagttaggactgga

SEQ ID NO: 592761 - DNA, 25 bp, Mus musculus
cccgcggcgctttgttaggactgga

SEQ ID NO: 592762 - DNA, 25 bp, Mus musculus
cccgcgttgcagacaacaattttgg

SEQ ID NO: 592763 - DNA, 25 bp, Mus musculus
cccgcgttgcagtcaacaattttgg

SEQ ID NO: 592764 - DNA, 25 bp, Mus musculus
cccgctacaccgactacgattaaag

SEQ ID NO: 592765 - DNA, 25 bp, Mus musculus
cccgctacaccgtctacgattaaag

SEQ ID NO: 592766 - DNA, 25 bp, Mus musculus
cccgctacgagtaggctttgattct

SEQ ID NO: 592767 - DNA, 25 bp, Mus musculus
cccgctacgagttggctttgattct

SEQ ID NO: 592768 - DNA, 25 bp, Mus musculus
cccgctatccctcgagtttttggtg

SEQ ID NO: 592769 - DNA, 25 bp, Mus musculus
cccgctatccctggagtttttggtg

SEQ ID NO: 592770 - DNA, 25 bp, Mus musculus
cccgctcagaggactacgtggacat

SEQ ID NO: 592771 - DNA, 25 bp, Mus musculus
cccgctcagaggtctacgtggacat

SEQ ID NO: 592772 - DNA, 25 bp, Mus musculus
cccgctcagatcatggttctgcaat

SEQ ID NO: 592773 - DNA, 25 bp, Mus musculus
cccgctcagatcttggttctgcaat

SEQ ID NO: 592774 - DNA, 25 bp, Mus musculus
cccgctccagaaaagagtatagtag

SEQ ID NO: 592775 - DNA, 25 bp, Mus musculus
cccgctccagaatagagtatagtag

SEQ ID NO: 592776 - DNA, 25 bp, Mus musculus
cccgctgaacttagacccttgtgag

SEQ ID NO: 592777 - DNA, 25 bp, Mus musculus
cccgctgaactttgacccttgtgag

SEQ ID NO: 592778 - DNA, 25 bp, Mus musculus
cccgctgcaaagatgagtctcctat

SEQ ID NO: 592779 - DNA, 25 bp, Mus musculus
cccgctgcaaagttgagtctcctat

SEQ ID NO: 592780 - DNA, 25 bp, Mus musculus
cccgctgcacaaaggtttccaggca

SEQ ID NO: 592781 - DNA, 25 bp, Mus musculus
cccgctgcacaatggtttccaggca

SEQ ID NO: 592782 - DNA, 25 bp, Mus musculus
cccgctgcctagcaaggtcctgttt

SEQ ID NO: 592783 - DNA, 25 bp, Mus musculus
cccgctgcctaggaaggtcctgttt

SEQ ID NO: 592784 - DNA, 25 bp, Mus musculus
cccgctggaattccctgaagaggct

SEQ ID NO: 592785 - DNA, 25 bp, Mus musculus
cccgctggaattgcctgaagaggct

SEQ ID NO: 592786 - DNA, 25 bp, Mus musculus
cccgctggagagagacggtgcttta

SEQ ID NO: 592787 - DNA, 25 bp, Mus musculus
cccgctggagagtgacggtgcttta

SEQ ID NO: 592788 - DNA, 25 bp, Mus musculus
cccgctggatgaagattcctcctta

SEQ ID NO: 592789 - DNA, 25 bp, Mus musculus
cccgctggatgatgattcctcctta

SEQ ID NO: 592790 - DNA, 25 bp, Mus musculus
cccgctggtgaaaactggtctaaag

SEQ ID NO: 592791 - DNA, 25 bp, Mus musculus
cccgctggtgaatactggtctaaag

SEQ ID NO: 592792 - DNA, 25 bp, Mus musculus
cccgctgtgagaatgatgttaatga

SEQ ID NO: 592793 - DNA, 25 bp, Mus musculus
cccgctgtgagattgatgttaatga

SEQ ID NO: 592794 - DNA, 25 bp, Mus musculus
cccgcttctgggagagacttatgaa

SEQ ID NO: 592795 - DNA, 25 bp, Mus musculus
cccgcttctgggtgagacttatgaa

SEQ ID NO: 592796 - DNA, 25 bp, Mus musculus
cccgcttgcaggatgtgattactct

SEQ ID NO: 592797 - DNA, 25 bp, Mus musculus
cccgcttgcaggttgtgattactct

SEQ ID NO: 592798 - DNA, 25 bp, Mus musculus
cccgcttgcatgacactggtagaga

SEQ ID NO: 592799 - DNA, 25 bp, Mus musculus
cccgcttgcatgtcactggtagaga

SEQ ID NO: 592800 - DNA, 25 bp, Mus musculus
cccgcttggctcaggctggtaatga

SEQ ID NO: 592801 - DNA, 25 bp, Mus musculus
cccgcttggctctggctggtaatga

SEQ ID NO: 592802 - DNA, 25 bp, Mus musculus
cccgcttgttccagacataaggaca

SEQ ID NO: 592803 - DNA, 25 bp, Mus musculus
cccgcttgttcctgacataaggaca

SEQ ID NO: 592804 - DNA, 25 bp, Mus musculus
cccgctttgagcatccagctttcga

SEQ ID NO: 592805 - DNA, 25 bp, Mus musculus
cccgctttgagcttccagctttcga

SEQ ID NO: 592806 - DNA, 25 bp, Mus musculus
cccggaaccagtctatgccaatgta

SEQ ID NO: 592807 - DNA, 25 bp, Mus musculus
cccggaaccagtgtatgccaatgta

SEQ ID NO: 592808 - DNA, 25 bp, Mus musculus
cccggaacgttgatgctgctggaca

SEQ ID NO: 592809 - DNA, 25 bp, Mus musculus
cccggaacgttgttgctgctggaca

SEQ ID NO: 592810 - DNA, 25 bp, Mus musculus
cccggaagaaggctctccatacagt

SEQ ID NO: 592811 - DNA, 25 bp, Mus musculus
cccggaagaagggtctccatacagt

SEQ ID NO: 592812 - DNA, 25 bp, Mus musculus
cccggaagctcaacggctgctgctg

SEQ ID NO: 592813 - DNA, 25 bp, Mus musculus
cccggaagctcatcggctgctgctg

SEQ ID NO: 592814 - DNA, 25 bp, Mus musculus
cccggaagctggacacaacagagtc

SEQ ID NO: 592815 - DNA, 25 bp, Mus musculus
cccggaagctggtcacaacagagtc

SEQ ID NO: 592816 - DNA, 25 bp, Mus musculus
cccggaagcttgagctgctcaactg

SEQ ID NO: 592817 - DNA, 25 bp, Mus musculus
cccggaagcttgtgctgctcaactg

SEQ ID NO: 592818 - DNA, 25 bp, Mus musculus
cccggaaggagccagctgaagccac

SEQ ID NO: 592819 - DNA, 25 bp, Mus musculus
cccggaaggagcgagctgaagccac

SEQ ID NO: 592820 - DNA, 25 bp, Mus musculus
cccggaagtgcaccgagtaacgtac

SEQ ID NO: 592821 - DNA, 25 bp, Mus musculus
cccggaagtgcagcgagtaacgtac

SEQ ID NO: 592822 - DNA, 25 bp, Mus musculus
cccggaatctgcagagtgtggacat

SEQ ID NO: 592823 - DNA, 25 bp, Mus musculus
cccggaatctgctgagtgtggacat

SEQ ID NO: 592824 - DNA, 25 bp, Mus musculus
cccggaatgtgcaggtgtctgaaga

SEQ ID NO: 592825 - DNA, 25 bp, Mus musculus
cccggaatgtgctggtgtctgaaga

SEQ ID NO: 592826 - DNA, 25 bp, Mus musculus
cccggacaagcaaaagggaagcttt

SEQ ID NO: 592827 - DNA, 25 bp, Mus musculus
cccggacaagcacttagatgagagg

SEQ ID NO: 592828 - DNA, 25 bp, Mus musculus
cccggacaagcagttagatgagagg

SEQ ID NO: 592829 - DNA, 25 bp, Mus musculus
cccggacaagcataagggaagcttt

SEQ ID NO: 592830 - DNA, 25 bp, Mus musculus
cccggacaagggagtgcccctacag

SEQ ID NO: 592831 - DNA, 25 bp, Mus musculus
cccggacaagggtgtgcccctacag

SEQ ID NO: 592832 - DNA, 25 bp, Mus musculus
cccggacacagtagaaggtcttgtt

SEQ ID NO: 592833 - DNA, 25 bp, Mus musculus
cccggacacagttgaaggtcttgtt

SEQ ID NO: 592834 - DNA, 25 bp, Mus musculus
cccggaccatccaaggactcattga

SEQ ID NO: 592835 - DNA, 25 bp, Mus musculus
cccggaccatcctaggactcattga

SEQ ID NO: 592836 - DNA, 25 bp, Mus musculus
cccggacctgcgacgatttatcgat

SEQ ID NO: 592837 - DNA, 25 bp, Mus musculus
cccggacctgcgtcgatttatcgat

SEQ ID NO: 592838 - DNA, 25 bp, Mus musculus
cccggactgaagatggtgcagaaga

SEQ ID NO: 592839 - DNA, 25 bp, Mus musculus
cccggactgaagttggtgcagaaga

SEQ ID NO: 592840 - DNA, 25 bp, Mus musculus
cccggagacttaatgcagaaataga

SEQ ID NO: 592841 - DNA, 25 bp, Mus musculus
cccggagacttattgcagaaataga

SEQ ID NO: 592842 - DNA, 25 bp, Mus musculus
cccggagatagtctggtcactggac

SEQ ID NO: 592843 - DNA, 25 bp, Mus musculus
cccggagatagtgtggtcactggac

SEQ ID NO: 592844 - DNA, 25 bp, Mus musculus
cccggaggcagaatccgagtgcagt

SEQ ID NO: 592845 - DNA, 25 bp, Mus musculus
cccggaggcagattccgagtgcagt

SEQ ID NO: 592846 - DNA, 25 bp, Mus musculus
cccggaggcctgcaaagcgacttga

SEQ ID NO: 592847 - DNA, 25 bp, Mus musculus
cccggaggcctggaaagcgacttga

SEQ ID NO: 592848 - DNA, 25 bp, Mus musculus
cccggaggctacagcgtatccgtgc

SEQ ID NO: 592849 - DNA, 25 bp, Mus musculus
cccggaggctactgcgtatccgtgc

SEQ ID NO: 592850 - DNA, 25 bp, Mus musculus
cccggagtccgtagacctggagtgt

SEQ ID NO: 592851 - DNA, 25 bp, Mus musculus
cccggagtccgttgacctggagtgt

SEQ ID NO: 592852 - DNA, 25 bp, Mus musculus
cccggagtgcaacagcacgcaggat

SEQ ID NO: 592853 - DNA, 25 bp, Mus musculus
cccggagtgcaagagcacgcaggat

SEQ ID NO: 592854 - DNA, 25 bp, Mus musculus
cccggagttcccacgctggtagtgt

SEQ ID NO: 592855 - DNA, 25 bp, Mus musculus
cccggagttccctcgctggtagtgt

SEQ ID NO: 592856 - DNA, 25 bp, Mus musculus
cccggatcggccagtccctggtgaa

SEQ ID NO: 592857 - DNA, 25 bp, Mus musculus
cccggatcggcctgtccctggtgaa

SEQ ID NO: 592858 - DNA, 25 bp, Mus musculus
cccggatctgaactatatcagccca

SEQ ID NO: 592859 - DNA, 25 bp, Mus musculus
cccggatctgaagtatatcagccca

SEQ ID NO: 592860 - DNA, 25 bp, Mus musculus
cccggatctgtgaccagtctggtat

SEQ ID NO: 592861 - DNA, 25 bp, Mus musculus
cccggatctgtgtccagtctggtat

SEQ ID NO: 592862 - DNA, 25 bp, Mus musculus
cccggatggaccagagccctggata

SEQ ID NO: 592863 - DNA, 25 bp, Mus musculus
cccggatggacctgagccctggata

SEQ ID NO: 592864 - DNA, 25 bp, Mus musculus
cccggatggtcaagctcggcctgaa

SEQ ID NO: 592865 - DNA, 25 bp, Mus musculus
cccggatggtcatgctcggcctgaa

SEQ ID NO: 592866 - DNA, 25 bp, Mus musculus
cccggatgttgaactgaaggccgaa

SEQ ID NO: 592867 - DNA, 25 bp, Mus musculus
cccggatgttgatctgaaggccgaa

SEQ ID NO: 592868 - DNA, 25 bp, Mus musculus
cccggattcccgcacggatgagcga

SEQ ID NO: 592869 - DNA, 25 bp, Mus musculus
cccggattcccggacggatgagcga

SEQ ID NO: 592870 - DNA, 25 bp, Mus musculus
cccggattccgccatgttgagtctt

SEQ ID NO: 592871 - DNA, 25 bp, Mus musculus
cccggattccgcgatgttgagtctt

SEQ ID NO: 592872 - DNA, 25 bp, Mus musculus
cccggattctggagtcctcactgta

SEQ ID NO: 592873 - DNA, 25 bp, Mus musculus
cccggattctggtgtcctcactgta

SEQ ID NO: 592874 - DNA, 25 bp, Mus musculus
cccggatttttcacactgagtttgg

SEQ ID NO: 592875 - DNA, 25 bp, Mus musculus
cccggatttttctcactgagtttgg

SEQ ID NO: 592876 - DNA, 25 bp, Mus musculus
cccggcaagctgacagaggctttca

SEQ ID NO: 592877 - DNA, 25 bp, Mus musculus
cccggcaagctgatattgtggctgc

SEQ ID NO: 592878 - DNA, 25 bp, Mus musculus
cccggcaagctgtcagaggctttca

SEQ ID NO: 592879 - DNA, 25 bp, Mus musculus
cccggcaagctgttattgtggctgc

SEQ ID NO: 592880 - DNA, 25 bp, Mus musculus
cccggcaatgctacctgccagatag

SEQ ID NO: 592881 - DNA, 25 bp, Mus musculus
cccggcaatgcttcctgccagatag

SEQ ID NO: 592882 - DNA, 25 bp, Mus musculus
cccggcagtacgagagccaggatga

SEQ ID NO: 592883 - DNA, 25 bp, Mus musculus
cccggcagtacgtgagccaggatga

SEQ ID NO: 592884 - DNA, 25 bp, Mus musculus
cccggccaacctagagcaggagaag

SEQ ID NO: 592885 - DNA, 25 bp, Mus musculus
cccggccaaccttgagcaggagaag

SEQ ID NO: 592886 - DNA, 25 bp, Mus musculus
cccggccagctgcagatgagctgct

SEQ ID NO: 592887 - DNA, 25 bp, Mus musculus
cccggccagctggagatgagctgct

SEQ ID NO: 592888 - DNA, 25 bp, Mus musculus
cccggccatttgaggtgctcatgca

SEQ ID NO: 592889 - DNA, 25 bp, Mus musculus
cccggccatttgtggtgctcatgca

SEQ ID NO: 592890 - DNA, 25 bp, Mus musculus
cccggcccgacgagaaggccataat

SEQ ID NO: 592891 - DNA, 25 bp, Mus musculus
cccggcccgacgtgaaggccataat

SEQ ID NO: 592892 - DNA, 25 bp, Mus musculus
cccggcctcaaacctggtttcagag

SEQ ID NO: 592893 - DNA, 25 bp, Mus musculus
cccggcctcaaagctggtttcagag

SEQ ID NO: 592894 - DNA, 25 bp, Mus musculus
cccggcctctacaggcaggtgacat

SEQ ID NO: 592895 - DNA, 25 bp, Mus musculus
cccggcctctactggcaggtgacat

SEQ ID NO: 592896 - DNA, 25 bp, Mus musculus
cccggcgacagccaagagagttccg

SEQ ID NO: 592897 - DNA, 25 bp, Mus musculus
cccggcgacagcgaagagagttccg

SEQ ID NO: 592898 - DNA, 25 bp, Mus musculus
cccggcgcagcaaggtgtttgcaaa

SEQ ID NO: 592899 - DNA, 25 bp, Mus musculus
cccggcgcagcatggtgtttgcaaa

SEQ ID NO: 592900 - DNA, 25 bp, Mus musculus
cccggcgccccaagttggagcgaat

SEQ ID NO: 592901 - DNA, 25 bp, Mus musculus
cccggcgccccatgttggagcgaat

SEQ ID NO: 592902 - DNA, 25 bp, Mus musculus
cccggcgcgacgaaagcctgagtga

SEQ ID NO: 592903 - DNA, 25 bp, Mus musculus
cccggcgcgacgtaagcctgagtga

SEQ ID NO: 592904 - DNA, 25 bp, Mus musculus
cccggcgctatgatgcagatcgaag

SEQ ID NO: 592905 - DNA, 25 bp, Mus musculus
cccggcgctatgttgcagatcgaag

SEQ ID NO: 592906 - DNA, 25 bp, Mus musculus
cccggcggttgtcattgacatgtca

SEQ ID NO: 592907 - DNA, 25 bp, Mus musculus
cccggcggttgtgattgacatgtca

SEQ ID NO: 592908 - DNA, 25 bp, Mus musculus
cccggcgtccgactacatggagaag

SEQ ID NO: 592909 - DNA, 25 bp, Mus musculus
cccggcgtccgagtacatggagaag

SEQ ID NO: 592910 - DNA, 25 bp, Mus musculus
cccggctaagagctgcatcatggag

SEQ ID NO: 592911 - DNA, 25 bp, Mus musculus
cccggctaagaggtgcatcatggag

SEQ ID NO: 592912 - DNA, 25 bp, Mus musculus
cccggctcagaaacaagcatgaact

SEQ ID NO: 592913 - DNA, 25 bp, Mus musculus
cccggctcagaatcaagcatgaact

SEQ ID NO: 592914 - DNA, 25 bp, Mus musculus
cccggctcctgaaggtgaatatagc

SEQ ID NO: 592915 - DNA, 25 bp, Mus musculus
cccggctcctgatggtgaatatagc

SEQ ID NO: 592916 - DNA, 25 bp, Mus musculus
cccggctgcagcctgaaggctttga

SEQ ID NO: 592917 - DNA, 25 bp, Mus musculus
cccggctgcagcgtgaaggctttga

SEQ ID NO: 592918 - DNA, 25 bp, Mus musculus
cccggctgtgccagtacgaagatgg

SEQ ID NO: 592919 - DNA, 25 bp, Mus musculus
cccggctgtgcctgtacgaagatgg

SEQ ID NO: 592920 - DNA, 25 bp, Mus musculus
cccgggaaagacaagcagccaaaat

SEQ ID NO: 592921 - DNA, 25 bp, Mus musculus
cccgggaaagactagcagccaaaat

SEQ ID NO: 592922 - DNA, 25 bp, Mus musculus
cccgggaagaatagaccagaatgct

SEQ ID NO: 592923 - DNA, 25 bp, Mus musculus
cccgggaagaattgaccagaatgct

SEQ ID NO: 592924 - DNA, 25 bp, Mus musculus
cccgggaccgtcatggactggtgct

SEQ ID NO: 592925 - DNA, 25 bp, Mus musculus
cccgggaccgtcttggactggtgct

SEQ ID NO: 592926 - DNA, 25 bp, Mus musculus
cccgggactgcaaaatgggacgaaa

SEQ ID NO: 592927 - DNA, 25 bp, Mus musculus
cccgggactgcataatgggacgaaa

SEQ ID NO: 592928 - DNA, 25 bp, Mus musculus
cccgggagagcacaagaacgtctta

SEQ ID NO: 592929 - DNA, 25 bp, Mus musculus
cccgggagagcactactctgagaag

SEQ ID NO: 592930 - DNA, 25 bp, Mus musculus
cccgggagagcagaagaacgtctta

SEQ ID NO: 592931 - DNA, 25 bp, Mus musculus
cccgggagagcagtactctgagaag

SEQ ID NO: 592932 - DNA, 25 bp, Mus musculus
cccgggagctatctgagcttgaccc

SEQ ID NO: 592933 - DNA, 25 bp, Mus musculus
cccgggagctatgtgagcttgaccc

SEQ ID NO: 592934 - DNA, 25 bp, Mus musculus
cccgggaggtcaacgacagcatcat

SEQ ID NO: 592935 - DNA, 25 bp, Mus musculus
cccgggaggtcatcgacagcatcat

SEQ ID NO: 592936 - DNA, 25 bp, Mus musculus
cccgggataatcacaggaagcagtg

SEQ ID NO: 592937 - DNA, 25 bp, Mus musculus
cccgggataatctcaggaagcagtg

SEQ ID NO: 592938 - DNA, 25 bp, Mus musculus
cccgggatcagaccaagtcaattgt

SEQ ID NO: 592939 - DNA, 25 bp, Mus musculus
cccgggatcagagcaagtcaattgt

SEQ ID NO: 592940 - DNA, 25 bp, Mus musculus
cccgggatgagaacaagaggaccca

SEQ ID NO: 592941 - DNA, 25 bp, Mus musculus
cccgggatgagatcaagaggaccca

SEQ ID NO: 592942 - DNA, 25 bp, Mus musculus
cccgggcacagcaactgcagaattt

SEQ ID NO: 592943 - DNA, 25 bp, Mus musculus
cccgggcacagctactgcagaattt

SEQ ID NO: 592944 - DNA, 25 bp, Mus musculus
cccgggcagtacatgacctagttga

SEQ ID NO: 592945 - DNA, 25 bp, Mus musculus
cccgggcagtacttgacctagttga

SEQ ID NO: 592946 - DNA, 25 bp, Mus musculus
cccgggccatgcagggcatgaagct

SEQ ID NO: 592947 - DNA, 25 bp, Mus musculus
cccgggccatgctgggcatgaagct

SEQ ID NO: 592948 - DNA, 25 bp, Mus musculus
cccgggcgaggcagagatccacttc

SEQ ID NO: 592949 - DNA, 25 bp, Mus musculus
cccgggcgaggctgagatccacttc

SEQ ID NO: 592950 - DNA, 25 bp, Mus musculus
cccgggctcgctatggagaccgaat

SEQ ID NO: 592951 - DNA, 25 bp, Mus musculus
cccgggctcgctattctgaaggctt

SEQ ID NO: 592952 - DNA, 25 bp, Mus musculus
cccgggctcgctttggagaccgaat

SEQ ID NO: 592953 - DNA, 25 bp, Mus musculus
cccgggctcgcttttctgaaggctt

SEQ ID NO: 592954 - DNA, 25 bp, Mus musculus
cccgggctctgaagcaagcaaagaa

SEQ ID NO: 592955 - DNA, 25 bp, Mus musculus
cccgggctctgatgcaagcaaagaa

SEQ ID NO: 592956 - DNA, 25 bp, Mus musculus
cccgggctctggagttgcagctctg

SEQ ID NO: 592957 - DNA, 25 bp, Mus musculus
cccgggctctggtgttgcagctctg

SEQ ID NO: 592958 - DNA, 25 bp, Mus musculus
cccgggtcaccaaccttgggcatgt

SEQ ID NO: 592959 - DNA, 25 bp, Mus musculus
cccgggtcaccatccttgggcatgt

SEQ ID NO: 592960 - DNA, 25 bp, Mus musculus
cccgggtgaagcctcaaggactgtt

SEQ ID NO: 592961 - DNA, 25 bp, Mus musculus
cccgggtgaagcgtcaaggactgtt

SEQ ID NO: 592962 - DNA, 25 bp, Mus musculus
cccgggtgcccaactttgaccagag

SEQ ID NO: 592963 - DNA, 25 bp, Mus musculus
cccgggtgcccatctttgaccagag

SEQ ID NO: 592964 - DNA, 25 bp, Mus musculus
cccgggttctctaaaagagcagaca

SEQ ID NO: 592965 - DNA, 25 bp, Mus musculus
cccgggttctcttaaagagcagaca

SEQ ID NO: 592966 - DNA, 25 bp, Mus musculus
cccgggttgcagcatcagatttgga

SEQ ID NO: 592967 - DNA, 25 bp, Mus musculus
cccgggttgcaggatcagatttgga

SEQ ID NO: 592968 - DNA, 25 bp, Mus musculus
cccggtcaagtccaagtcatgcgag

SEQ ID NO: 592969 - DNA, 25 bp, Mus musculus
cccggtcaagtcgaagtcatgcgag

SEQ ID NO: 592970 - DNA, 25 bp, Mus musculus
cccggtcctcccagagagtcttaag

SEQ ID NO: 592971 - DNA, 25 bp, Mus musculus
cccggtcctccctgagagtcttaag

SEQ ID NO: 592972 - DNA, 25 bp, Mus musculus
cccggtgagggactagagaacaaca

SEQ ID NO: 592973 - DNA, 25 bp, Mus musculus
cccggtgagggagtagagaacaaca

SEQ ID NO: 592974 - DNA, 25 bp, Mus musculus
cccggtgatgaaattacaagccata

SEQ ID NO: 592975 - DNA, 25 bp, Mus musculus
cccggtgatgaatttacaagccata

SEQ ID NO: 592976 - DNA, 25 bp, Mus musculus
cccggtggttccacatcctgggcat

SEQ ID NO: 592977 - DNA, 25 bp, Mus musculus
cccggtggttcctcatcctgggcat

SEQ ID NO: 592978 - DNA, 25 bp, Mus musculus
cccggtgtgatcaactcagaagcta

SEQ ID NO: 592979 - DNA, 25 bp, Mus musculus
cccggtgtgatctactcagaagcta

SEQ ID NO: 592980 - DNA, 25 bp, Mus musculus
cccggtgtgcctctggaggaacttt

SEQ ID NO: 592981 - DNA, 25 bp, Mus musculus
cccggtgtgcctgtggaggaacttt

SEQ ID NO: 592982 - DNA, 25 bp, Mus musculus
cccggtgtgggcagtccaattccac

SEQ ID NO: 592983 - DNA, 25 bp, Mus musculus
cccggtgtgggctgtccaattccac

SEQ ID NO: 592984 - DNA, 25 bp, Mus musculus
cccggttaaacccagcgagtgagct

SEQ ID NO: 592985 - DNA, 25 bp, Mus musculus
cccggttaaaccgagcgagtgagct

SEQ ID NO: 592986 - DNA, 25 bp, Mus musculus
cccggttcccgcagtgctgtggaga

SEQ ID NO: 592987 - DNA, 25 bp, Mus musculus
cccggttcccgctgtgctgtggaga

SEQ ID NO: 592988 - DNA, 25 bp, Mus musculus
cccggttgtcatcgtaactactgtg

SEQ ID NO: 592989 - DNA, 25 bp, Mus musculus
cccggttgtcatggtaactactgtg

SEQ ID NO: 592990 - DNA, 25 bp, Mus musculus
cccggttgttgcagaaacgactata

SEQ ID NO: 592991 - DNA, 25 bp, Mus musculus
cccggttgttgctgaaacgactata

SEQ ID NO: 592992 - DNA, 25 bp, Mus musculus
cccggttttctccagcgcgttgagc

SEQ ID NO: 592993 - DNA, 25 bp, Mus musculus
cccggttttctcgagcgcgttgagc

SEQ ID NO: 592994 - DNA, 25 bp, Mus musculus
cccgtaagagagaaatctaagtgtc

SEQ ID NO: 592995 - DNA, 25 bp, Mus musculus
cccgtaagagagtaatctaagtgtc

SEQ ID NO: 592996 - DNA, 25 bp, Mus musculus
cccgtaatgtacagctgttcctaca

SEQ ID NO: 592997 - DNA, 25 bp, Mus musculus
cccgtaatgtactgctgttcctaca

SEQ ID NO: 592998 - DNA, 25 bp, Mus musculus
cccgtacccgttaggcattgatccg

SEQ ID NO: 592999 - DNA, 25 bp, Mus musculus
cccgtacccgtttggcattgatccg

SEQ ID NO: 593000 - DNA, 25 bp, Mus musculus
cccgtactgtgtctcttctgtgtat

SEQ ID NO: 593001 - DNA, 25 bp, Mus musculus
cccgtactgtgtgtcttctgtgtat

SEQ ID NO: 593002 - DNA, 25 bp, Mus musculus
cccgtatacagcctttggagatctg

SEQ ID NO: 593003 - DNA, 25 bp, Mus musculus
cccgtatacagcgtttggagatctg

SEQ ID NO: 593004 - DNA, 25 bp, Mus musculus
cccgtatccggtcgattacagacta

SEQ ID NO: 593005 - DNA, 25 bp, Mus musculus
cccgtatccggtggattacagacta

SEQ ID NO: 593006 - DNA, 25 bp, Mus musculus
cccgtatgaagtatggccagagagc

SEQ ID NO: 593007 - DNA, 25 bp, Mus musculus
cccgtatgaagtttggccagagagc

SEQ ID NO: 593008 - DNA, 25 bp, Mus musculus
cccgtatgcagtcctgtgtccttgg

SEQ ID NO: 593009 - DNA, 25 bp, Mus musculus
cccgtatgcagtgctgtgtccttgg

SEQ ID NO: 593010 - DNA, 25 bp, Mus musculus
cccgtcaattttcctgagttctcca

SEQ ID NO: 593011 - DNA, 25 bp, Mus musculus
cccgtcaattttgctgagttctcca

SEQ ID NO: 593012 - DNA, 25 bp, Mus musculus
cccgtcaggtgcaatgagctgctca

SEQ ID NO: 593013 - DNA, 25 bp, Mus musculus
cccgtcaggtgctatgagctgctca

SEQ ID NO: 593014 - DNA, 25 bp, Mus musculus
cccgtcagtgaaagggcggagttat

SEQ ID NO: 593015 - DNA, 25 bp, Mus musculus
cccgtcagtgaatgggcggagttat

SEQ ID NO: 593016 - DNA, 25 bp, Mus musculus
cccgtccggatcagacttgtgccta

SEQ ID NO: 593017 - DNA, 25 bp, Mus musculus
cccgtccggatctgacttgtgccta

SEQ ID NO: 593018 - DNA, 25 bp, Mus musculus
cccgtcgacagtaatgatgccttct

SEQ ID NO: 593019 - DNA, 25 bp, Mus musculus
cccgtcgacagttatgatgccttct

SEQ ID NO: 593020 - DNA, 25 bp, Mus musculus
cccgtcgagcatacggattctgaag

SEQ ID NO: 593021 - DNA, 25 bp, Mus musculus
cccgtcgagcattcggattctgaag

SEQ ID NO: 593022 - DNA, 25 bp, Mus musculus
cccgtcggcagcaggcttgtcctgg

SEQ ID NO: 593023 - DNA, 25 bp, Mus musculus
cccgtcggcagctggcttgtcctgg

SEQ ID NO: 593024 - DNA, 25 bp, Mus musculus
cccgtcggtgctattctgttgcttg

SEQ ID NO: 593025 - DNA, 25 bp, Mus musculus
cccgtcggtgcttttctgttgcttg

SEQ ID NO: 593026 - DNA, 25 bp, Mus musculus
cccgtctaactgagcgtgctctgca

SEQ ID NO: 593027 - DNA, 25 bp, Mus musculus
cccgtctaactgtgcgtgctctgca

SEQ ID NO: 593028 - DNA, 25 bp, Mus musculus
cccgtctacaaacgagtctgtaaat

SEQ ID NO: 593029 - DNA, 25 bp, Mus musculus
cccgtctacaaaggagtctgtaaat

SEQ ID NO: 593030 - DNA, 25 bp, Mus musculus
cccgtctcctgcacagggcaagaag

SEQ ID NO: 593031 - DNA, 25 bp, Mus musculus
cccgtctcctgctcagggcaagaag

SEQ ID NO: 593032 - DNA, 25 bp, Mus musculus
cccgtctcttcgaaagcggcttcag

SEQ ID NO: 593033 - DNA, 25 bp, Mus musculus
cccgtctcttcgtaagcggcttcag

SEQ ID NO: 593034 - DNA, 25 bp, Mus musculus
cccgtctggcaacagggcgctgata

SEQ ID NO: 593035 - DNA, 25 bp, Mus musculus
cccgtctggcaagagggcgctgata

SEQ ID NO: 593036 - DNA, 25 bp, Mus musculus
cccgtgacaagcaacgtggagcccg

SEQ ID NO: 593037 - DNA, 25 bp, Mus musculus
cccgtgacaagctacgtggagcccg

SEQ ID NO: 593038 - DNA, 25 bp, Mus musculus
cccgtgagcctgacattggagccag

SEQ ID NO: 593039 - DNA, 25 bp, Mus musculus
cccgtgagcctgtcattggagccag

SEQ ID NO: 593040 - DNA, 25 bp, Mus musculus
cccgtgagtgtcaaggtgtatgaaa

SEQ ID NO: 593041 - DNA, 25 bp, Mus musculus
cccgtgagtgtctaggtgtatgaaa

SEQ ID NO: 593042 - DNA, 25 bp, Mus musculus
cccgtgatgcccaggctaaaaacct

SEQ ID NO: 593043 - DNA, 25 bp, Mus musculus
cccgtgatgccctggctaaaaacct

SEQ ID NO: 593044 - DNA, 25 bp, Mus musculus
cccgtgattgtgaaaatagtgtagc

SEQ ID NO: 593045 - DNA, 25 bp, Mus musculus
cccgtgattgtgtaaatagtgtagc

SEQ ID NO: 593046 - DNA, 25 bp, Mus musculus
cccgtgcagactattttacttatga

SEQ ID NO: 593047 - DNA, 25 bp, Mus musculus
cccgtgcagacttttttacttatga

SEQ ID NO: 593048 - DNA, 25 bp, Mus musculus
cccgtgccagagactggtcagctct

SEQ ID NO: 593049 - DNA, 25 bp, Mus musculus
cccgtgccagagtctggtcagctct

SEQ ID NO: 593050 - DNA, 25 bp, Mus musculus
cccgtgcccgttcgaggagcgatct

SEQ ID NO: 593051 - DNA, 25 bp, Mus musculus
cccgtgcccgttggaggagcgatct

SEQ ID NO: 593052 - DNA, 25 bp, Mus musculus
cccgtgcgggtaactgtgcgtttca

SEQ ID NO: 593053 - DNA, 25 bp, Mus musculus
cccgtgcgggtatctgtgcgtttca

SEQ ID NO: 593054 - DNA, 25 bp, Mus musculus
cccgtgcggttgacgcatttggcgc

SEQ ID NO: 593055 - DNA, 25 bp, Mus musculus
cccgtgcggttgtcgcatttggcgc

SEQ ID NO: 593056 - DNA, 25 bp, Mus musculus
cccgtgctgacactgacggagatct

SEQ ID NO: 593057 - DNA, 25 bp, Mus musculus
cccgtgctgacagtgacggagatct

SEQ ID NO: 593058 - DNA, 25 bp, Mus musculus
cccgtggaaaggcactggtgttctt

SEQ ID NO: 593059 - DNA, 25 bp, Mus musculus
cccgtggaaagggactggtgttctt

SEQ ID NO: 593060 - DNA, 25 bp, Mus musculus
cccgtggaataccagacggtgcaga

SEQ ID NO: 593061 - DNA, 25 bp, Mus musculus
cccgtggaataccagtggcatggct

SEQ ID NO: 593062 - DNA, 25 bp, Mus musculus
cccgtggaatacgagacggtgcaga

SEQ ID NO: 593063 - DNA, 25 bp, Mus musculus
cccgtggaatacgagtggcatggct

SEQ ID NO: 593064 - DNA, 25 bp, Mus musculus
cccgtggacctaaattaccttatgg

SEQ ID NO: 593065 - DNA, 25 bp, Mus musculus
cccgtggacctatattaccttatgg

SEQ ID NO: 593066 - DNA, 25 bp, Mus musculus
cccgtggattcaactgtaggtgccc

SEQ ID NO: 593067 - DNA, 25 bp, Mus musculus
cccgtggattcatctgtaggtgccc

SEQ ID NO: 593068 - DNA, 25 bp, Mus musculus
cccgtggcatggctctctatgagga

SEQ ID NO: 593069 - DNA, 25 bp, Mus musculus
cccgtggcatgggtctctatgagga

SEQ ID NO: 593070 - DNA, 25 bp, Mus musculus
cccgtggccttaaggagcaaggaca

SEQ ID NO: 593071 - DNA, 25 bp, Mus musculus
cccgtggccttatggagcaaggaca

SEQ ID NO: 593072 - DNA, 25 bp, Mus musculus
cccgtggctcttcgctataacctgt

SEQ ID NO: 593073 - DNA, 25 bp, Mus musculus
cccgtggctcttggctataacctgt

SEQ ID NO: 593074 - DNA, 25 bp, Mus musculus
cccgtgggaggcctcctcagactcg

SEQ ID NO: 593075 - DNA, 25 bp, Mus musculus
cccgtgggaggcgtcctcagactcg

SEQ ID NO: 593076 - DNA, 25 bp, Mus musculus
cccgtggttcacaatgatatctgag

SEQ ID NO: 593077 - DNA, 25 bp, Mus musculus
cccgtggttcactatgatatctgag

SEQ ID NO: 593078 - DNA, 25 bp, Mus musculus
cccgtgtactatcagcagttggtgc

SEQ ID NO: 593079 - DNA, 25 bp, Mus musculus
cccgtgtactatgagcagttggtgc

SEQ ID NO: 593080 - DNA, 25 bp, Mus musculus
cccgtgtatgccatccgctcatatg

SEQ ID NO: 593081 - DNA, 25 bp, Mus musculus
cccgtgtatgccttccgctcatatg

SEQ ID NO: 593082 - DNA, 25 bp, Mus musculus
cccgtgtgaagaccacgggcatcgt

SEQ ID NO: 593083 - DNA, 25 bp, Mus musculus
cccgtgtgaagagcacgggcatcgt

SEQ ID NO: 593084 - DNA, 25 bp, Mus musculus
cccgtgtgatgtcttggagtataga

SEQ ID NO: 593085 - DNA, 25 bp, Mus musculus
cccgtgtgatgtgttggagtataga

SEQ ID NO: 593086 - DNA, 25 bp, Mus musculus
cccgtgtgcccaagaaaatcctcaa

SEQ ID NO: 593087 - DNA, 25 bp, Mus musculus
cccgtgtgcccatgaaaatcctcaa

SEQ ID NO: 593088 - DNA, 25 bp, Mus musculus
cccgtgtggtaaaagacatggctac

SEQ ID NO: 593089 - DNA, 25 bp, Mus musculus
cccgtgtggtaatagacatggctac

SEQ ID NO: 593090 - DNA, 25 bp, Mus musculus
cccgtgtggtggacaagctctctct

SEQ ID NO: 593091 - DNA, 25 bp, Mus musculus
cccgtgtggtggtcaagctctctct

SEQ ID NO: 593092 - DNA, 25 bp, Mus musculus
cccgtgttcttgcagaaggctgtgc

SEQ ID NO: 593093 - DNA, 25 bp, Mus musculus
cccgtgttcttggagaaggctgtgc

SEQ ID NO: 593094 - DNA, 25 bp, Mus musculus
cccgtgttctttcagctgggttgca

SEQ ID NO: 593095 - DNA, 25 bp, Mus musculus
cccgtgttctttgagctgggttgca

SEQ ID NO: 593096 - DNA, 25 bp, Mus musculus
cccgtgttggtcagcaatggcacat

SEQ ID NO: 593097 - DNA, 25 bp, Mus musculus
cccgtgttggtctgcaatggcacat

SEQ ID NO: 593098 - DNA, 25 bp, Mus musculus
cccgtgtttgagatccctctgcaga

SEQ ID NO: 593099 - DNA, 25 bp, Mus musculus
cccgtgtttgagttccctctgcaga

SEQ ID NO: 593100 - DNA, 25 bp, Mus musculus
cccgttactctgatcaacttctggc

SEQ ID NO: 593101 - DNA, 25 bp, Mus musculus
cccgttactctgttcaacttctggc

SEQ ID NO: 593102 - DNA, 25 bp, Mus musculus
cccgttcctggaacctgcactgagg

SEQ ID NO: 593103 - DNA, 25 bp, Mus musculus
cccgttcctggatcctgcactgagg

SEQ ID NO: 593104 - DNA, 25 bp, Mus musculus
cccgttctcttcagcagatcatttc

SEQ ID NO: 593105 - DNA, 25 bp, Mus musculus
cccgttctcttctgcagatcatttc

SEQ ID NO: 593106 - DNA, 25 bp, Mus musculus
cccgttgggagcaagagattgactg

SEQ ID NO: 593107 - DNA, 25 bp, Mus musculus
cccgttgggagctagagattgactg

SEQ ID NO: 593108 - DNA, 25 bp, Mus musculus
cccgttgtagttcttgctgaggata

SEQ ID NO: 593109 - DNA, 25 bp, Mus musculus
cccgttgtagttgttgctgaggata

SEQ ID NO: 593110 - DNA, 25 bp, Mus musculus
cccgttgtcaggacggtgaagtctg

SEQ ID NO: 593111 - DNA, 25 bp, Mus musculus
cccgttgtcaggtcggtgaagtctg

SEQ ID NO: 593112 - DNA, 25 bp, Mus musculus
cccgttgtgtccaggaggcggcaaa

SEQ ID NO: 593113 - DNA, 25 bp, Mus musculus
cccgttgtgtcctggaggcggcaaa

SEQ ID NO: 593114 - DNA, 25 bp, Mus musculus
cccgttgttcccaggcggtggcgct

SEQ ID NO: 593115 - DNA, 25 bp, Mus musculus
cccgttgttccctggcggtggcgct

SEQ ID NO: 593116 - DNA, 25 bp, Mus musculus
cccgtttccatgaccctggtgggtg

SEQ ID NO: 593117 - DNA, 25 bp, Mus musculus
cccgtttccatgtccctggtgggtg

SEQ ID NO: 593118 - DNA, 25 bp, Mus musculus
cccgtttgcttaagtggaccccttg

SEQ ID NO: 593119 - DNA, 25 bp, Mus musculus
cccgtttgcttatgtggaccccttg

SEQ ID NO: 593120 - DNA, 25 bp, Mus musculus
cccgtttgctttcttcgtgtcactt

SEQ ID NO: 593121 - DNA, 25 bp, Mus musculus
cccgtttgctttgttcgtgtcactt

SEQ ID NO: 593122 - DNA, 25 bp, Mus musculus
cccgtttgtgctcggaggcaaccta

SEQ ID NO: 593123 - DNA, 25 bp, Mus musculus
cccgtttgtgctgggaggcaaccta

SEQ ID NO: 593124 - DNA, 25 bp, Mus musculus
cccgttttctttaaggcagtgcctg

SEQ ID NO: 593125 - DNA, 25 bp, Mus musculus
cccgttttcttttaggcagtgcctg

SEQ ID NO: 593126 - DNA, 25 bp, Mus musculus
ccctaaaatcaaccgctctatgcag

SEQ ID NO: 593127 - DNA, 25 bp, Mus musculus
ccctaaaatcaactttgaaaccatg

SEQ ID NO: 593128 - DNA, 25 bp, Mus musculus
ccctaaaatcaagcgctctatgcag

SEQ ID NO: 593129 - DNA, 25 bp, Mus musculus
ccctaaaatcaagtttgaaaccatg

SEQ ID NO: 593130 - DNA, 25 bp, Mus musculus
ccctaaaattcgctgtggccctcgg

SEQ ID NO: 593131 - DNA, 25 bp, Mus musculus
ccctaaaattcggtgtggccctcgg

SEQ ID NO: 593132 - DNA, 25 bp, Mus musculus
ccctaaacttgaagacaccatgaag

SEQ ID NO: 593133 - DNA, 25 bp, Mus musculus
ccctaaacttgatgacaccatgaag

SEQ ID NO: 593134 - DNA, 25 bp, Mus musculus
ccctaaaggaccagtctcactgcat

SEQ ID NO: 593135 - DNA, 25 bp, Mus musculus
ccctaaaggacctgtctcactgcat

SEQ ID NO: 593136 - DNA, 25 bp, Mus musculus
ccctaaagttccaaggagggcatga

SEQ ID NO: 593137 - DNA, 25 bp, Mus musculus
ccctaaagttcctaggagggcatga

SEQ ID NO: 593138 - DNA, 25 bp, Mus musculus
ccctaaatggagagctcacagctga

SEQ ID NO: 593139 - DNA, 25 bp, Mus musculus
ccctaaatggagtgctcacagctga

SEQ ID NO: 593140 - DNA, 25 bp, Mus musculus
ccctaacaggatattgctttgtatt

SEQ ID NO: 593141 - DNA, 25 bp, Mus musculus
ccctaacaggattttgctttgtatt

SEQ ID NO: 593142 - DNA, 25 bp, Mus musculus
ccctaaccagagctatgagggcagc

SEQ ID NO: 593143 - DNA, 25 bp, Mus musculus
ccctaaccagaggtatgagggcagc

SEQ ID NO: 593144 - DNA, 25 bp, Mus musculus
ccctaagaaggtagaccttatcatc

SEQ ID NO: 593145 - DNA, 25 bp, Mus musculus
ccctaagaaggttgaccttatcatc

SEQ ID NO: 593146 - DNA, 25 bp, Mus musculus
ccctaagatggcagacgtctcagca

SEQ ID NO: 593147 - DNA, 25 bp, Mus musculus
ccctaagatggctgacgtctcagca

SEQ ID NO: 593148 - DNA, 25 bp, Mus musculus
ccctaaggaggaagtgtcatactac

SEQ ID NO: 593149 - DNA, 25 bp, Mus musculus
ccctaaggaggatgtgtcatactac

SEQ ID NO: 593150 - DNA, 25 bp, Mus musculus
ccctaagtgtcaaggtgatgagaga

SEQ ID NO: 593151 - DNA, 25 bp, Mus musculus
ccctaagtgtcatggtgatgagaga

SEQ ID NO: 593152 - DNA, 25 bp, Mus musculus
ccctaatattagatccgtcacaggg

SEQ ID NO: 593153 - DNA, 25 bp, Mus musculus
ccctaatattagttccgtcacaggg

SEQ ID NO: 593154 - DNA, 25 bp, Mus musculus
ccctaatctctaagccaactggctg

SEQ ID NO: 593155 - DNA, 25 bp, Mus musculus
ccctaatctctatgccaactggctg

SEQ ID NO: 593156 - DNA, 25 bp, Mus musculus
ccctaatgtttgcttctcttactgt

SEQ ID NO: 593157 - DNA, 25 bp, Mus musculus
ccctaatgtttggttctcttactgt

SEQ ID NO: 593158 - DNA, 25 bp, Mus musculus
ccctacaaagtgcaggagtcgggct

SEQ ID NO: 593159 - DNA, 25 bp, Mus musculus
ccctacaaagtggaggagtcgggct

SEQ ID NO: 593160 - DNA, 25 bp, Mus musculus
ccctacaatgctacttgtgaaattg

SEQ ID NO: 593161 - DNA, 25 bp, Mus musculus
ccctacaatgcttcttgtgaaattg

SEQ ID NO: 593162 - DNA, 25 bp, Mus musculus
ccctacacagatcggcctggaggca

SEQ ID NO: 593163 - DNA, 25 bp, Mus musculus
ccctacacagatgggcctggaggca

SEQ ID NO: 593164 - DNA, 25 bp, Mus musculus
ccctacactatgcagcctggcaggg

SEQ ID NO: 593165 - DNA, 25 bp, Mus musculus
ccctacactatggagcctggcaggg

SEQ ID NO: 593166 - DNA, 25 bp, Mus musculus
ccctacagtgcgaggcagcacatgg

SEQ ID NO: 593167 - DNA, 25 bp, Mus musculus
ccctacagtgcgtggcagcacatgg

SEQ ID NO: 593168 - DNA, 25 bp, Mus musculus
ccctacatcctgctttactaggtca

SEQ ID NO: 593169 - DNA, 25 bp, Mus musculus
ccctacatcctggtttactaggtca

SEQ ID NO: 593170 - DNA, 25 bp, Mus musculus
ccctacatgtttcaggcccgcgaat

SEQ ID NO: 593171 - DNA, 25 bp, Mus musculus
ccctacatgtttgaggcccgcgaat

SEQ ID NO: 593172 - DNA, 25 bp, Mus musculus
ccctaccgtggtagactataaagag

SEQ ID NO: 593173 - DNA, 25 bp, Mus musculus
ccctaccgtggttgactataaagag

SEQ ID NO: 593174 - DNA, 25 bp, Mus musculus
ccctacctacaaatggaagcggcag

SEQ ID NO: 593175 - DNA, 25 bp, Mus musculus
ccctacctacaattggaagcggcag

SEQ ID NO: 593176 - DNA, 25 bp, Mus musculus
ccctacgagataaacctgatggagg

SEQ ID NO: 593177 - DNA, 25 bp, Mus musculus
ccctacgagatatacctgatggagg

SEQ ID NO: 593178 - DNA, 25 bp, Mus musculus
ccctacgctgggacatcattggcaa

SEQ ID NO: 593179 - DNA, 25 bp, Mus musculus
ccctacgctgggtcatcattggcaa

SEQ ID NO: 593180 - DNA, 25 bp, Mus musculus
ccctactccacgatgcagtaatgaa

SEQ ID NO: 593181 - DNA, 25 bp, Mus musculus
ccctactccacgttgcagtaatgaa

SEQ ID NO: 593182 - DNA, 25 bp, Mus musculus
ccctactcgcacagaatacagactt

SEQ ID NO: 593183 - DNA, 25 bp, Mus musculus
ccctactcgcactgaatacagactt

SEQ ID NO: 593184 - DNA, 25 bp, Mus musculus
ccctactctggaagcctttgacctg

SEQ ID NO: 593185 - DNA, 25 bp, Mus musculus
ccctactctggatgcctttgacctg

SEQ ID NO: 593186 - DNA, 25 bp, Mus musculus
ccctactgcaagagcctctggatca

SEQ ID NO: 593187 - DNA, 25 bp, Mus musculus
ccctactgcaagtgcctctggatca

SEQ ID NO: 593188 - DNA, 25 bp, Mus musculus
ccctactgccggcaagctgactgtt

SEQ ID NO: 593189 - DNA, 25 bp, Mus musculus
ccctactgccgggaagctgactgtt

SEQ ID NO: 593190 - DNA, 25 bp, Mus musculus
ccctagaagaagagcaagatggatt

SEQ ID NO: 593191 - DNA, 25 bp, Mus musculus
ccctagaagaagtgcaagatggatt

SEQ ID NO: 593192 - DNA, 25 bp, Mus musculus
ccctagaagcagctagctactccag

SEQ ID NO: 593193 - DNA, 25 bp, Mus musculus
ccctagaagcaggtagctactccag

SEQ ID NO: 593194 - DNA, 25 bp, Mus musculus
ccctagaaggcgaggctgaaaggat

SEQ ID NO: 593195 - DNA, 25 bp, Mus musculus
ccctagaaggcgtggctgaaaggat

SEQ ID NO: 593196 - DNA, 25 bp, Mus musculus
ccctagaaggctctgtatagtccat

SEQ ID NO: 593197 - DNA, 25 bp, Mus musculus
ccctagaaggctgtgtatagtccat

SEQ ID NO: 593198 - DNA, 25 bp, Mus musculus
ccctagaagtcacgaggcatgaaac

SEQ ID NO: 593199 - DNA, 25 bp, Mus musculus
ccctagaagtcaggaggcatgaaac

SEQ ID NO: 593200 - DNA, 25 bp, Mus musculus
ccctagaataccaaaatgtgctgta

SEQ ID NO: 593201 - DNA, 25 bp, Mus musculus
ccctagaatacctaaatgtgctgta

SEQ ID NO: 593202 - DNA, 25 bp, Mus musculus
ccctagacctttattgtgagcactg

SEQ ID NO: 593203 - DNA, 25 bp, Mus musculus
ccctagaccttttttgtgagcactg

SEQ ID NO: 593204 - DNA, 25 bp, Mus musculus
ccctagagccggcaagacatgggct

SEQ ID NO: 593205 - DNA, 25 bp, Mus musculus
ccctagagccgggaagacatgggct

SEQ ID NO: 593206 - DNA, 25 bp, Mus musculus
ccctagataggaagaggtgcctctg

SEQ ID NO: 593207 - DNA, 25 bp, Mus musculus
ccctagataggatgaggtgcctctg

SEQ ID NO: 593208 - DNA, 25 bp, Mus musculus
ccctagatgaggcagccaagctgcc

SEQ ID NO: 593209 - DNA, 25 bp, Mus musculus
ccctagatgagggagccaagctgcc

SEQ ID NO: 593210 - DNA, 25 bp, Mus musculus
ccctagcagtgtctgtcatggaaat

SEQ ID NO: 593211 - DNA, 25 bp, Mus musculus
ccctagcagtgtgtgtcatggaaat

SEQ ID NO: 593212 - DNA, 25 bp, Mus musculus
ccctagcgttatcattgatgatctt

SEQ ID NO: 593213 - DNA, 25 bp, Mus musculus
ccctagcgttatgattgatgatctt

SEQ ID NO: 593214 - DNA, 25 bp, Mus musculus
ccctagctctgtaaataggaataaa

SEQ ID NO: 593215 - DNA, 25 bp, Mus musculus
ccctagctctgttaataggaataaa

SEQ ID NO: 593216 - DNA, 25 bp, Mus musculus
ccctagctttggacttgttgatatc

SEQ ID NO: 593217 - DNA, 25 bp, Mus musculus
ccctagctttggtcttgttgatatc

SEQ ID NO: 593218 - DNA, 25 bp, Mus musculus
ccctaggcaagcaggaatagattct

SEQ ID NO: 593219 - DNA, 25 bp, Mus musculus
ccctaggcaagctggaatagattct

SEQ ID NO: 593220 - DNA, 25 bp, Mus musculus
ccctaggcttagagaggttgctttc

SEQ ID NO: 593221 - DNA, 25 bp, Mus musculus
ccctaggcttagtgaggttgctttc

SEQ ID NO: 593222 - DNA, 25 bp, Mus musculus
ccctagggaggtacgcgctcccgtg

SEQ ID NO: 593223 - DNA, 25 bp, Mus musculus
ccctagggaggttcgcgctcccgtg

SEQ ID NO: 593224 - DNA, 25 bp, Mus musculus
ccctagggcctactttatcagaaag

SEQ ID NO: 593225 - DNA, 25 bp, Mus musculus
ccctagggcctagtttatcagaaag

SEQ ID NO: 593226 - DNA, 25 bp, Mus musculus
ccctagggcttccttagcattaaat

SEQ ID NO: 593227 - DNA, 25 bp, Mus musculus
ccctagggcttcgttagcattaaat

SEQ ID NO: 593228 - DNA, 25 bp, Mus musculus
ccctagggtatgcagcaattccact

SEQ ID NO: 593229 - DNA, 25 bp, Mus musculus
ccctagggtatggagcaattccact

SEQ ID NO: 593230 - DNA, 25 bp, Mus musculus
ccctagggtttccatgtcagatgca

SEQ ID NO: 593231 - DNA, 25 bp, Mus musculus
ccctagggtttcgatgtcagatgca

SEQ ID NO: 593232 - DNA, 25 bp, Mus musculus
ccctagtatggccaatgaagaagat

SEQ ID NO: 593233 - DNA, 25 bp, Mus musculus
ccctagtatggcgaatgaagaagat

SEQ ID NO: 593234 - DNA, 25 bp, Mus musculus
ccctagtcagggaccaggacattca

SEQ ID NO: 593235 - DNA, 25 bp, Mus musculus
ccctagtcagggtccaggacattca

SEQ ID NO: 593236 - DNA, 25 bp, Mus musculus
ccctagtgaaggagcagtgggtact

SEQ ID NO: 593237 - DNA, 25 bp, Mus musculus
ccctagtgaaggtgcagtgggtact

SEQ ID NO: 593238 - DNA, 25 bp, Mus musculus
ccctagtgcatgctatgattatgta

SEQ ID NO: 593239 - DNA, 25 bp, Mus musculus
ccctagtgcatggtatgattatgta

SEQ ID NO: 593240 - DNA, 25 bp, Mus musculus
ccctagtggatgagagagctcccga

SEQ ID NO: 593241 - DNA, 25 bp, Mus musculus
ccctagtggatgtgagagctcccga

SEQ ID NO: 593242 - DNA, 25 bp, Mus musculus
ccctagttcaagctcccttcggagt

SEQ ID NO: 593243 - DNA, 25 bp, Mus musculus
ccctagttcaaggtcccttcggagt

SEQ ID NO: 593244 - DNA, 25 bp, Mus musculus
ccctataaaggacgccagggccaag

SEQ ID NO: 593245 - DNA, 25 bp, Mus musculus
ccctataaaggaggccagggccaag

SEQ ID NO: 593246 - DNA, 25 bp, Mus musculus
ccctataagaacagcaagacggact

SEQ ID NO: 593247 - DNA, 25 bp, Mus musculus
ccctataagaactgcaagacggact

SEQ ID NO: 593248 - DNA, 25 bp, Mus musculus
ccctatatatccagcagtgggaggt

SEQ ID NO: 593249 - DNA, 25 bp, Mus musculus
ccctatatatcctgcagtgggaggt

SEQ ID NO: 593250 - DNA, 25 bp, Mus musculus
ccctatcacagtcagaggctgagga

SEQ ID NO: 593251 - DNA, 25 bp, Mus musculus
ccctatcacagtgagaggctgagga

SEQ ID NO: 593252 - DNA, 25 bp, Mus musculus
ccctatcatgcacggtaacacagag

SEQ ID NO: 593253 - DNA, 25 bp, Mus musculus
ccctatcatgcagggtaacacagag

SEQ ID NO: 593254 - DNA, 25 bp, Mus musculus
ccctatcggtgtctggagattgcca

SEQ ID NO: 593255 - DNA, 25 bp, Mus musculus
ccctatcggtgtgtggagattgcca

SEQ ID NO: 593256 - DNA, 25 bp, Mus musculus
ccctatgacaaacgtgaatactcac

SEQ ID NO: 593257 - DNA, 25 bp, Mus musculus
ccctatgacaaaggtgaatactcac

SEQ ID NO: 593258 - DNA, 25 bp, Mus musculus
ccctatgagcgacggcttctcatca

SEQ ID NO: 593259 - DNA, 25 bp, Mus musculus
ccctatgagcgagggcttctcatca

SEQ ID NO: 593260 - DNA, 25 bp, Mus musculus
ccctatgaggaacaaatcatgagga

SEQ ID NO: 593261 - DNA, 25 bp, Mus musculus
ccctatgaggaagaaatcatgagga

SEQ ID NO: 593262 - DNA, 25 bp, Mus musculus
ccctatgaggcaatgggagccttct

SEQ ID NO: 593263 - DNA, 25 bp, Mus musculus
ccctatgaggcattgggagccttct

SEQ ID NO: 593264 - DNA, 25 bp, Mus musculus
ccctatgagtctcggcccctggagg

SEQ ID NO: 593265 - DNA, 25 bp, Mus musculus
ccctatgagtctgggcccctggagg

SEQ ID NO: 593266 - DNA, 25 bp, Mus musculus
ccctatgagtggaataatccacacc

SEQ ID NO: 593267 - DNA, 25 bp, Mus musculus
ccctatgagtggtataatccacacc

SEQ ID NO: 593268 - DNA, 25 bp, Mus musculus
ccctatggccacagaggccacatgg

SEQ ID NO: 593269 - DNA, 25 bp, Mus musculus
ccctatggccactgaggccacatgg

SEQ ID NO: 593270 - DNA, 25 bp, Mus musculus
ccctatggctggcagaaaatagagg

SEQ ID NO: 593271 - DNA, 25 bp, Mus musculus
ccctatggctgggagaaaatagagg

SEQ ID NO: 593272 - DNA, 25 bp, Mus musculus
ccctatgtcaggctgactatggaag

SEQ ID NO: 593273 - DNA, 25 bp, Mus musculus
ccctatgtcagggtgactatggaag

SEQ ID NO: 593274 - DNA, 25 bp, Mus musculus
ccctatgtctatacccagagccgaa

SEQ ID NO: 593275 - DNA, 25 bp, Mus musculus
ccctatgtctattcccagagccgaa

SEQ ID NO: 593276 - DNA, 25 bp, Mus musculus
ccctatgtgcgcacccagaagctaa

SEQ ID NO: 593277 - DNA, 25 bp, Mus musculus
ccctatgtgcgctcccagaagctaa

SEQ ID NO: 593278 - DNA, 25 bp, Mus musculus
ccctatgttcggaaggctctccaca

SEQ ID NO: 593279 - DNA, 25 bp, Mus musculus
ccctatgttcggtaggctctccaca

SEQ ID NO: 593280 - DNA, 25 bp, Mus musculus
ccctattaaggtcgctttggatgtg

SEQ ID NO: 593281 - DNA, 25 bp, Mus musculus
ccctattaaggtggctttggatgtg

SEQ ID NO: 593282 - DNA, 25 bp, Mus musculus
ccctattcgataaagatggtgacgg

SEQ ID NO: 593283 - DNA, 25 bp, Mus musculus
ccctattcgatatagatggtgacgg

SEQ ID NO: 593284 - DNA, 25 bp, Mus musculus
ccctatttgctgcaaatcctcagct

SEQ ID NO: 593285 - DNA, 25 bp, Mus musculus
ccctatttgctggaaatcctcagct

SEQ ID NO: 593286 - DNA, 25 bp, Mus musculus
ccctcaaaagcgatttgagtgcctt

SEQ ID NO: 593287 - DNA, 25 bp, Mus musculus
ccctcaaaagcgttttgagtgcctt

SEQ ID NO: 593288 - DNA, 25 bp, Mus musculus
ccctcaaagatgctagtcatcaaaa

SEQ ID NO: 593289 - DNA, 25 bp, Mus musculus
ccctcaaagatggtagtcatcaaaa

SEQ ID NO: 593290 - DNA, 25 bp, Mus musculus
ccctcaaatgacctggattccacaa

SEQ ID NO: 593291 - DNA, 25 bp, Mus musculus
ccctcaaatgacgtggattccacaa

SEQ ID NO: 593292 - DNA, 25 bp, Mus musculus
ccctcaactttgcattatatggtta

SEQ ID NO: 593293 - DNA, 25 bp, Mus musculus
ccctcaactttggattatatggtta

SEQ ID NO: 593294 - DNA, 25 bp, Mus musculus
ccctcaagaagtatgtgatggtgaa

SEQ ID NO: 593295 - DNA, 25 bp, Mus musculus
ccctcaagaagtttgtgatggtgaa

SEQ ID NO: 593296 - DNA, 25 bp, Mus musculus
ccctcaagagagcagaagttctacc

SEQ ID NO: 593297 - DNA, 25 bp, Mus musculus
ccctcaagagaggagaagttctacc

SEQ ID NO: 593298 - DNA, 25 bp, Mus musculus
ccctcaagtcttcagaggctgcagg

SEQ ID NO: 593299 - DNA, 25 bp, Mus musculus
ccctcaagtcttgagaggctgcagg

SEQ ID NO: 593300 - DNA, 25 bp, Mus musculus
ccctcaatgtcaagagtgaaaaggt

SEQ ID NO: 593301 - DNA, 25 bp, Mus musculus
ccctcaatgtcatgagtgaaaaggt

SEQ ID NO: 593302 - DNA, 25 bp, Mus musculus
ccctcaatgtctatgttgtctctcc

SEQ ID NO: 593303 - DNA, 25 bp, Mus musculus
ccctcaatgtctttgttgtctctcc

SEQ ID NO: 593304 - DNA, 25 bp, Mus musculus
ccctcacctgttaggagcgattcaa

SEQ ID NO: 593305 - DNA, 25 bp, Mus musculus
ccctcacctgtttggagcgattcaa

SEQ ID NO: 593306 - DNA, 25 bp, Mus musculus
ccctcacgggtcagcaattatttga

SEQ ID NO: 593307 - DNA, 25 bp, Mus musculus
ccctcacgggtctgcaattatttga

SEQ ID NO: 593308 - DNA, 25 bp, Mus musculus
ccctcacgtagtcaagtattatggc

SEQ ID NO: 593309 - DNA, 25 bp, Mus musculus
ccctcacgtagtgaagtattatggc

SEQ ID NO: 593310 - DNA, 25 bp, Mus musculus
ccctcactatggacatctactttga

SEQ ID NO: 593311 - DNA, 25 bp, Mus musculus
ccctcactatggtcatctactttga

SEQ ID NO: 593312 - DNA, 25 bp, Mus musculus
ccctcactggagcaggtcctgcagt

SEQ ID NO: 593313 - DNA, 25 bp, Mus musculus
ccctcactggaggaggtcctgcagt

SEQ ID NO: 593314 - DNA, 25 bp, Mus musculus
ccctcactgtgactgtaatacttaa

SEQ ID NO: 593315 - DNA, 25 bp, Mus musculus
ccctcactgtgagtgtaatacttaa

SEQ ID NO: 593316 - DNA, 25 bp, Mus musculus
ccctcagaacgtccactgggcattg

SEQ ID NO: 593317 - DNA, 25 bp, Mus musculus
ccctcagaacgtgcactgggcattg

SEQ ID NO: 593318 - DNA, 25 bp, Mus musculus
ccctcagaagagattaatgggtatc

SEQ ID NO: 593319 - DNA, 25 bp, Mus musculus
ccctcagaagagtttaatgggtatc

SEQ ID NO: 593320 - DNA, 25 bp, Mus musculus
ccctcagaaggtagtatatagattt

SEQ ID NO: 593321 - DNA, 25 bp, Mus musculus
ccctcagaaggttgtatatagattt

SEQ ID NO: 593322 - DNA, 25 bp, Mus musculus
ccctcagacaggcacaaagagagta

SEQ ID NO: 593323 - DNA, 25 bp, Mus musculus
ccctcagacagggacaaagagagta

SEQ ID NO: 593324 - DNA, 25 bp, Mus musculus
ccctcagagacacacaggagtgcca

SEQ ID NO: 593325 - DNA, 25 bp, Mus musculus
ccctcagagacagacaggagtgcca

SEQ ID NO: 593326 - DNA, 25 bp, Mus musculus
ccctcagatgctccgttggagtgct

SEQ ID NO: 593327 - DNA, 25 bp, Mus musculus
ccctcagatgctgcgttggagtgct

SEQ ID NO: 593328 - DNA, 25 bp, Mus musculus
ccctcagcacgcacgcttcgggact

SEQ ID NO: 593329 - DNA, 25 bp, Mus musculus
ccctcagcacgctcgcttcgggact

SEQ ID NO: 593330 - DNA, 25 bp, Mus musculus
ccctcagcagggaacagtttctcaa

SEQ ID NO: 593331 - DNA, 25 bp, Mus musculus
ccctcagcagggtacagtttctcaa

SEQ ID NO: 593332 - DNA, 25 bp, Mus musculus
ccctcagcaggtagggtgcaagcca

SEQ ID NO: 593333 - DNA, 25 bp, Mus musculus
ccctcagcaggttgggtgcaagcca

SEQ ID NO: 593334 - DNA, 25 bp, Mus musculus
ccctcagcctggattactgcttcgt

SEQ ID NO: 593335 - DNA, 25 bp, Mus musculus
ccctcagcctggtttactgcttcgt

SEQ ID NO: 593336 - DNA, 25 bp, Mus musculus
ccctcagcgaaaagtcccagagaag

SEQ ID NO: 593337 - DNA, 25 bp, Mus musculus
ccctcagcgaaatgtcccagagaag

SEQ ID NO: 593338 - DNA, 25 bp, Mus musculus
ccctcagcttgcagacgttccaggg

SEQ ID NO: 593339 - DNA, 25 bp, Mus musculus
ccctcagcttgctgacgttccaggg

SEQ ID NO: 593340 - DNA, 25 bp, Mus musculus
ccctcaggaaaacgatgtctgggaa

SEQ ID NO: 593341 - DNA, 25 bp, Mus musculus
ccctcaggaaaaggatgtctgggaa

SEQ ID NO: 593342 - DNA, 25 bp, Mus musculus
ccctcaggaaggagtctcgatgcct

SEQ ID NO: 593343 - DNA, 25 bp, Mus musculus
ccctcaggaaggtgtctcgatgcct

SEQ ID NO: 593344 - DNA, 25 bp, Mus musculus
ccctcaggatggagactatgagttt

SEQ ID NO: 593345 - DNA, 25 bp, Mus musculus
ccctcaggatggtgactatgagttt

SEQ ID NO: 593346 - DNA, 25 bp, Mus musculus
ccctcaggcgttaggtcatagcaac

SEQ ID NO: 593347 - DNA, 25 bp, Mus musculus
ccctcaggcgtttggtcatagcaac

SEQ ID NO: 593348 - DNA, 25 bp, Mus musculus
ccctcagggtgtacgtgaatgccgg

SEQ ID NO: 593349 - DNA, 25 bp, Mus musculus
ccctcagggtgtctgccagcgtgca

SEQ ID NO: 593350 - DNA, 25 bp, Mus musculus
ccctcagggtgtgtgccagcgtgca

SEQ ID NO: 593351 - DNA, 25 bp, Mus musculus
ccctcagggtgttcgtgaatgccgg

SEQ ID NO: 593352 - DNA, 25 bp, Mus musculus
ccctcagtagcgacaccaacttgtt

SEQ ID NO: 593353 - DNA, 25 bp, Mus musculus
ccctcagtagcgtcaccaacttgtt

SEQ ID NO: 593354 - DNA, 25 bp, Mus musculus
ccctcagtatgtcgaggctgcctgg

SEQ ID NO: 593355 - DNA, 25 bp, Mus musculus
ccctcagtatgtggaggctgcctgg

SEQ ID NO: 593356 - DNA, 25 bp, Mus musculus
ccctcagtcgacatctgcaggcaat

SEQ ID NO: 593357 - DNA, 25 bp, Mus musculus
ccctcagtcgacttctgcaggcaat

SEQ ID NO: 593358 - DNA, 25 bp, Mus musculus
ccctcagtgcctacgacatggtgct

SEQ ID NO: 593359 - DNA, 25 bp, Mus musculus
ccctcagtgccttcgacatggtgct

SEQ ID NO: 593360 - DNA, 25 bp, Mus musculus
ccctcagttgccacaagcatggcta

SEQ ID NO: 593361 - DNA, 25 bp, Mus musculus
ccctcagttgcctcaagcatggcta

SEQ ID NO: 593362 - DNA, 25 bp, Mus musculus
ccctcatcagagagatggtctcaag

SEQ ID NO: 593363 - DNA, 25 bp, Mus musculus
ccctcatcagagtgatggtctcaag

SEQ ID NO: 593364 - DNA, 25 bp, Mus musculus
ccctcatcctggcaggccgagagga

SEQ ID NO: 593365 - DNA, 25 bp, Mus musculus
ccctcatcctgggaggccgagagga

SEQ ID NO: 593366 - DNA, 25 bp, Mus musculus
ccctcatctgagaaggcagagttcc

SEQ ID NO: 593367 - DNA, 25 bp, Mus musculus
ccctcatctgagtaggcagagttcc

SEQ ID NO: 593368 - DNA, 25 bp, Mus musculus
ccctcatgagttctgcctggaattc

SEQ ID NO: 593369 - DNA, 25 bp, Mus musculus
ccctcatgagttgtgcctggaattc

SEQ ID NO: 593370 - DNA, 25 bp, Mus musculus
ccctcatggagactggctggtttga

SEQ ID NO: 593371 - DNA, 25 bp, Mus musculus
ccctcatggagagtggctggtttga

SEQ ID NO: 593372 - DNA, 25 bp, Mus musculus
ccctcatggttcaggccaatcctga

SEQ ID NO: 593373 - DNA, 25 bp, Mus musculus
ccctcatggttctggccaatcctga

SEQ ID NO: 593374 - DNA, 25 bp, Mus musculus
ccctcatgtggaccagtatgaaacc

SEQ ID NO: 593375 - DNA, 25 bp, Mus musculus
ccctcatgtggagcagtatgaaacc

SEQ ID NO: 593376 - DNA, 25 bp, Mus musculus
ccctcattatgaagcaaattagcaa

SEQ ID NO: 593377 - DNA, 25 bp, Mus musculus
ccctcattatgatgcaaattagcaa

SEQ ID NO: 593378 - DNA, 25 bp, Mus musculus
ccctcattgacccttttgacctgga

SEQ ID NO: 593379 - DNA, 25 bp, Mus musculus
ccctcattgaccgttttgacctgga

SEQ ID NO: 593380 - DNA, 25 bp, Mus musculus
ccctcattgtgtctgtcatcaatag

SEQ ID NO: 593381 - DNA, 25 bp, Mus musculus
ccctcattgtgtgtgtcatcaatag

SEQ ID NO: 593382 - DNA, 25 bp, Mus musculus
ccctcatttatgctcgtcgatttga

SEQ ID NO: 593383 - DNA, 25 bp, Mus musculus
ccctcatttatggtcgtcgatttga

SEQ ID NO: 593384 - DNA, 25 bp, Mus musculus
ccctcatttgagaaaccttcggcag

SEQ ID NO: 593385 - DNA, 25 bp, Mus musculus
ccctcatttgagtaaccttcggcag

SEQ ID NO: 593386 - DNA, 25 bp, Mus musculus
ccctccaaaggaactaagaatcaaa

SEQ ID NO: 593387 - DNA, 25 bp, Mus musculus
ccctccaaaggatctaagaatcaaa

SEQ ID NO: 593388 - DNA, 25 bp, Mus musculus
ccctccaaaggcacatgaagttcgg

SEQ ID NO: 593389 - DNA, 25 bp, Mus musculus
ccctccaaaggctcatgaagttcgg

SEQ ID NO: 593390 - DNA, 25 bp, Mus musculus
ccctccaagttgcagttgctgaagg

SEQ ID NO: 593391 - DNA, 25 bp, Mus musculus
ccctccaagttggagttgctgaagg

SEQ ID NO: 593392 - DNA, 25 bp, Mus musculus
ccctccagcagcagaatgggctgtg

SEQ ID NO: 593393 - DNA, 25 bp, Mus musculus
ccctccagcagctgaatgggctgtg

SEQ ID NO: 593394 - DNA, 25 bp, Mus musculus
ccctccatcggaacagtgctgtgtg

SEQ ID NO: 593395 - DNA, 25 bp, Mus musculus
ccctccatcggatcagtgctgtgtg

SEQ ID NO: 593396 - DNA, 25 bp, Mus musculus
ccctccattcatagcaagatacttg

SEQ ID NO: 593397 - DNA, 25 bp, Mus musculus
ccctccattcattgcaagatacttg

SEQ ID NO: 593398 - DNA, 25 bp, Mus musculus
ccctcccaaatgaccagtgtgtaaa

SEQ ID NO: 593399 - DNA, 25 bp, Mus musculus
ccctcccaaatgtccagtgtgtaaa

SEQ ID NO: 593400 - DNA, 25 bp, Mus musculus
ccctcccaagatcttgtttacacga

SEQ ID NO: 593401 - DNA, 25 bp, Mus musculus
ccctcccaagatgttgtttacacga

SEQ ID NO: 593402 - DNA, 25 bp, Mus musculus
ccctcccagaagacctggttgaagt

SEQ ID NO: 593403 - DNA, 25 bp, Mus musculus
ccctcccagaagtcctggttgaagt

SEQ ID NO: 593404 - DNA, 25 bp, Mus musculus
ccctcccagtgtcaggaatctggct

SEQ ID NO: 593405 - DNA, 25 bp, Mus musculus
ccctcccagtgtgaggaatctggct

SEQ ID NO: 593406 - DNA, 25 bp, Mus musculus
ccctccgagcagagagcataaatga

SEQ ID NO: 593407 - DNA, 25 bp, Mus musculus
ccctccgagcagtgagcataaatga

SEQ ID NO: 593408 - DNA, 25 bp, Mus musculus
ccctccgatcagcctgtggacattg

SEQ ID NO: 593409 - DNA, 25 bp, Mus musculus
ccctccgatcaggctgtggacattg

SEQ ID NO: 593410 - DNA, 25 bp, Mus musculus
ccctccggatggcagaacatctcta

SEQ ID NO: 593411 - DNA, 25 bp, Mus musculus
ccctccggatgggagaacatctcta

SEQ ID NO: 593412 - DNA, 25 bp, Mus musculus
ccctccgtaggcaccgggttgtgct

SEQ ID NO: 593413 - DNA, 25 bp, Mus musculus
ccctccgtaggctccgggttgtgct

SEQ ID NO: 593414 - DNA, 25 bp, Mus musculus
ccctccgtgaaacaaagtgctctcg

SEQ ID NO: 593415 - DNA, 25 bp, Mus musculus
ccctccgtgaaagaaagtgctctcg

SEQ ID NO: 593416 - DNA, 25 bp, Mus musculus
ccctccgttaccaggactcattttg

SEQ ID NO: 593417 - DNA, 25 bp, Mus musculus
ccctccgttacctggactcattttg

SEQ ID NO: 593418 - DNA, 25 bp, Mus musculus
ccctcctcagctatgctgacgtttt

SEQ ID NO: 593419 - DNA, 25 bp, Mus musculus
ccctcctcagctttgctgacgtttt

SEQ ID NO: 593420 - DNA, 25 bp, Mus musculus
ccctcctctaggaagatcatgatcc

SEQ ID NO: 593421 - DNA, 25 bp, Mus musculus
ccctcctctaggtagatcatgatcc

SEQ ID NO: 593422 - DNA, 25 bp, Mus musculus
ccctcctgccagaaggcgaaggtct

SEQ ID NO: 593423 - DNA, 25 bp, Mus musculus
ccctcctgccagtaggcgaaggtct

SEQ ID NO: 593424 - DNA, 25 bp, Mus musculus
ccctcctggtgaatgctgggaagag

SEQ ID NO: 593425 - DNA, 25 bp, Mus musculus
ccctcctggtgattgctgggaagag

SEQ ID NO: 593426 - DNA, 25 bp, Mus musculus
ccctccttagtgctagcttttgtct

SEQ ID NO: 593427 - DNA, 25 bp, Mus musculus
ccctccttagtggtagcttttgtct

SEQ ID NO: 593428 - DNA, 25 bp, Mus musculus
ccctcgaccggtacgtgcaagagaa

SEQ ID NO: 593429 - DNA, 25 bp, Mus musculus
ccctcgaccggttcgtgcaagagaa

SEQ ID NO: 593430 - DNA, 25 bp, Mus musculus
ccctcgaggaggattactctgtgca

SEQ ID NO: 593431 - DNA, 25 bp, Mus musculus
ccctcgaggaggtttactctgtgca

SEQ ID NO: 593432 - DNA, 25 bp, Mus musculus
ccctcgcagtataccaggtgtctgg

SEQ ID NO: 593433 - DNA, 25 bp, Mus musculus
ccctcgcagtattccaggtgtctgg

SEQ ID NO: 593434 - DNA, 25 bp, Mus musculus
ccctcggaagcacagcgtcatgatg

SEQ ID NO: 593435 - DNA, 25 bp, Mus musculus
ccctcggaagcagagcgtcatgatg

SEQ ID NO: 593436 - DNA, 25 bp, Mus musculus
ccctcggaatctcgagctcttaggg

SEQ ID NO: 593437 - DNA, 25 bp, Mus musculus
ccctcggaatctggagctcttaggg

SEQ ID NO: 593438 - DNA, 25 bp, Mus musculus
ccctcgggacatcatcgacttagag

SEQ ID NO: 593439 - DNA, 25 bp, Mus musculus
ccctcgggacatgatcgacttagag

SEQ ID NO: 593440 - DNA, 25 bp, Mus musculus
ccctcgggacgcaggacttttacat

SEQ ID NO: 593441 - DNA, 25 bp, Mus musculus
ccctcgggacgctggacttttacat

SEQ ID NO: 593442 - DNA, 25 bp, Mus musculus
ccctcgggatgtcgaaagaccagca

SEQ ID NO: 593443 - DNA, 25 bp, Mus musculus
ccctcgggatgtggaaagaccagca

SEQ ID NO: 593444 - DNA, 25 bp, Mus musculus
ccctcgggtcccaacgagtggatga

SEQ ID NO: 593445 - DNA, 25 bp, Mus musculus
ccctcgggtccctacgagtggatga

SEQ ID NO: 593446 - DNA, 25 bp, Mus musculus
ccctcggtagcactctcgttctgaa

SEQ ID NO: 593447 - DNA, 25 bp, Mus musculus
ccctcggtagcagtctcgttctgaa

SEQ ID NO: 593448 - DNA, 25 bp, Mus musculus
ccctcggtgaagactctgaagtcat

SEQ ID NO: 593449 - DNA, 25 bp, Mus musculus
ccctcggtgaagtctctgaagtcat

SEQ ID NO: 593450 - DNA, 25 bp, Mus musculus
ccctcggtgtttcaggctggcagga

SEQ ID NO: 593451 - DNA, 25 bp, Mus musculus
ccctcggtgtttgaggctggcagga

SEQ ID NO: 593452 - DNA, 25 bp, Mus musculus
ccctcgtgcgggattccacgcggag

SEQ ID NO: 593453 - DNA, 25 bp, Mus musculus
ccctcgtgcgggtttccacgcggag

SEQ ID NO: 593454 - DNA, 25 bp, Mus musculus
ccctcgtgtgcgctgttgtctgtga

SEQ ID NO: 593455 - DNA, 25 bp, Mus musculus
ccctcgtgtgcggtgttgtctgtga

SEQ ID NO: 593456 - DNA, 25 bp, Mus musculus
ccctcgttctggctgctgcaaacgt

SEQ ID NO: 593457 - DNA, 25 bp, Mus musculus
ccctcgttctgggtgctgcaaacgt

SEQ ID NO: 593458 - DNA, 25 bp, Mus musculus
ccctctaaaggtctgctgctgtttg

SEQ ID NO: 593459 - DNA, 25 bp, Mus musculus
ccctctaaaggtgtgctgctgtttg

SEQ ID NO: 593460 - DNA, 25 bp, Mus musculus
ccctctactgaaacagtttgggatc

SEQ ID NO: 593461 - DNA, 25 bp, Mus musculus
ccctctactgaatcagtttgggatc

SEQ ID NO: 593462 - DNA, 25 bp, Mus musculus
ccctctatggctcctggcagcgtgg

SEQ ID NO: 593463 - DNA, 25 bp, Mus musculus
ccctctatggctgctggcagcgtgg

SEQ ID NO: 593464 - DNA, 25 bp, Mus musculus
ccctctattgtgctggtggtgctga

SEQ ID NO: 593465 - DNA, 25 bp, Mus musculus
ccctctattgtggtggtggtgctga

SEQ ID NO: 593466 - DNA, 25 bp, Mus musculus
ccctctcccaggaatttgcacaata

SEQ ID NO: 593467 - DNA, 25 bp, Mus musculus
ccctctcccaggtatttgcacaata

SEQ ID NO: 593468 - DNA, 25 bp, Mus musculus
ccctctcgctgtatttgatagtctg

SEQ ID NO: 593469 - DNA, 25 bp, Mus musculus
ccctctcgctgtttttgatagtctg

SEQ ID NO: 593470 - DNA, 25 bp, Mus musculus
ccctctcgggtgcattagcagttgg

SEQ ID NO: 593471 - DNA, 25 bp, Mus musculus
ccctctcgggtggattagcagttgg

SEQ ID NO: 593472 - DNA, 25 bp, Mus musculus
ccctctgaacgaagggacggacgca

SEQ ID NO: 593473 - DNA, 25 bp, Mus musculus
ccctctgaacgatgggacggacgca

SEQ ID NO: 593474 - DNA, 25 bp, Mus musculus
ccctctgaactacctgccgagaaat

SEQ ID NO: 593475 - DNA, 25 bp, Mus musculus
ccctctgaactagctgccgagaaat

SEQ ID NO: 593476 - DNA, 25 bp, Mus musculus
ccctctgacagacccagtagtggtg

SEQ ID NO: 593477 - DNA, 25 bp, Mus musculus
ccctctgacagagccagtagtggtg

SEQ ID NO: 593478 - DNA, 25 bp, Mus musculus
ccctctgacccgcagcagattggga

SEQ ID NO: 593479 - DNA, 25 bp, Mus musculus
ccctctgacccggagcagattggga

SEQ ID NO: 593480 - DNA, 25 bp, Mus musculus
ccctctgagaggagtcttaagagag

SEQ ID NO: 593481 - DNA, 25 bp, Mus musculus
ccctctgagaggtgtcttaagagag

SEQ ID NO: 593482 - DNA, 25 bp, Mus musculus
ccctctgaggctcatcgacaaggag

SEQ ID NO: 593483 - DNA, 25 bp, Mus musculus
ccctctgaggctgatcgacaaggag

SEQ ID NO: 593484 - DNA, 25 bp, Mus musculus
ccctctgagtccatgaaggtggtgg

SEQ ID NO: 593485 - DNA, 25 bp, Mus musculus
ccctctgagtccttgaaggtggtgg

SEQ ID NO: 593486 - DNA, 25 bp, Mus musculus
ccctctgatgtaatggaactccgta

SEQ ID NO: 593487 - DNA, 25 bp, Mus musculus
ccctctgatgtattggaactccgta

SEQ ID NO: 593488 - DNA, 25 bp, Mus musculus
ccctctgcagagcagttccgacgta

SEQ ID NO: 593489 - DNA, 25 bp, Mus musculus
ccctctgcagaggagttccgacgta

SEQ ID NO: 593490 - DNA, 25 bp, Mus musculus
ccctctgcccagacggaggctgggt

SEQ ID NO: 593491 - DNA, 25 bp, Mus musculus
ccctctgcccagtcggaggctgggt

SEQ ID NO: 593492 - DNA, 25 bp, Mus musculus
ccctctgctcatccatggatctggt

SEQ ID NO: 593493 - DNA, 25 bp, Mus musculus
ccctctgctcatgcatggatctggt

SEQ ID NO: 593494 - DNA, 25 bp, Mus musculus
ccctctgcttgactggttggaataa

SEQ ID NO: 593495 - DNA, 25 bp, Mus musculus
ccctctgcttgagtggttggaataa

SEQ ID NO: 593496 - DNA, 25 bp, Mus musculus
ccctctgctttcaagtgatgccggg

SEQ ID NO: 593497 - DNA, 25 bp, Mus musculus
ccctctgctttctagtgatgccggg

SEQ ID NO: 593498 - DNA, 25 bp, Mus musculus
ccctctggaaagagcgccaaacgga

SEQ ID NO: 593499 - DNA, 25 bp, Mus musculus
ccctctggaaagtgcgccaaacgga

SEQ ID NO: 593500 - DNA, 25 bp, Mus musculus
ccctctggagacactacttccagaa

SEQ ID NO: 593501 - DNA, 25 bp, Mus musculus
ccctctggagactctacttccagaa

SEQ ID NO: 593502 - DNA, 25 bp, Mus musculus
ccctctggcaagattgtggctcttg

SEQ ID NO: 593503 - DNA, 25 bp, Mus musculus
ccctctggcaagtttgtggctcttg

SEQ ID NO: 593504 - DNA, 25 bp, Mus musculus
ccctctggtgtgagaggaaggaact

SEQ ID NO: 593505 - DNA, 25 bp, Mus musculus
ccctctggtgtgtgaggaaggaact

SEQ ID NO: 593506 - DNA, 25 bp, Mus musculus
ccctctgtcttaagagaccctggaa

SEQ ID NO: 593507 - DNA, 25 bp, Mus musculus
ccctctgtcttatgagaccctggaa

SEQ ID NO: 593508 - DNA, 25 bp, Mus musculus
ccctctgtgcagagggaccaaggct

SEQ ID NO: 593509 - DNA, 25 bp, Mus musculus
ccctctgtgcagtgggaccaaggct

SEQ ID NO: 593510 - DNA, 25 bp, Mus musculus
ccctctgtgcggagcatcctgaggc

SEQ ID NO: 593511 - DNA, 25 bp, Mus musculus
ccctctgtgcggtgcatcctgaggc

SEQ ID NO: 593512 - DNA, 25 bp, Mus musculus
ccctctgtgggtcaagtagcccagg

SEQ ID NO: 593513 - DNA, 25 bp, Mus musculus
ccctctgtgggtgaagtagcccagg

SEQ ID NO: 593514 - DNA, 25 bp, Mus musculus
ccctcttattggattgtcatctgct

SEQ ID NO: 593515 - DNA, 25 bp, Mus musculus
ccctcttattggtttgtcatctgct

SEQ ID NO: 593516 - DNA, 25 bp, Mus musculus
ccctcttcaggacaactgatttcaa

SEQ ID NO: 593517 - DNA, 25 bp, Mus musculus
ccctcttcaggagaactgatttcaa

SEQ ID NO: 593518 - DNA, 25 bp, Mus musculus
ccctcttcgacaaggatggagatgg

SEQ ID NO: 593519 - DNA, 25 bp, Mus musculus
ccctcttcgacatggatggagatgg

SEQ ID NO: 593520 - DNA, 25 bp, Mus musculus
ccctcttcgttaccgggttggagct

SEQ ID NO: 593521 - DNA, 25 bp, Mus musculus
ccctcttcgttagcgggttggagct

SEQ ID NO: 593522 - DNA, 25 bp, Mus musculus
ccctcttcttagagcctgtgctgtg

SEQ ID NO: 593523 - DNA, 25 bp, Mus musculus
ccctcttcttagtgcctgtgctgtg

SEQ ID NO: 593524 - DNA, 25 bp, Mus musculus
ccctcttgatgcaggtgtttggaaa

SEQ ID NO: 593525 - DNA, 25 bp, Mus musculus
ccctcttgatgctggtgtttggaaa

SEQ ID NO: 593526 - DNA, 25 bp, Mus musculus
ccctcttggaagaggagactgagga

SEQ ID NO: 593527 - DNA, 25 bp, Mus musculus
ccctcttggaagtggagactgagga

SEQ ID NO: 593528 - DNA, 25 bp, Mus musculus
ccctcttggaggagtgttcaataat

SEQ ID NO: 593529 - DNA, 25 bp, Mus musculus
ccctcttggaggtgtgttcaataat

SEQ ID NO: 593530 - DNA, 25 bp, Mus musculus
ccctctttggcacacttggaaactg

SEQ ID NO: 593531 - DNA, 25 bp, Mus musculus
ccctctttggcagacttggaaactg

SEQ ID NO: 593532 - DNA, 25 bp, Mus musculus
ccctgaaaacaaaagccgccaagca

SEQ ID NO: 593533 - DNA, 25 bp, Mus musculus
ccctgaaaacaatagccgccaagca

SEQ ID NO: 593534 - DNA, 25 bp, Mus musculus
ccctgaaaaccaaggcacagatatg

SEQ ID NO: 593535 - DNA, 25 bp, Mus musculus
ccctgaaaaccatggcacagatatg

SEQ ID NO: 593536 - DNA, 25 bp, Mus musculus
ccctgaaaagtgcagtcgctctgaa

SEQ ID NO: 593537 - DNA, 25 bp, Mus musculus
ccctgaaaagtggagtcgctctgaa

SEQ ID NO: 593538 - DNA, 25 bp, Mus musculus
ccctgaaactagactgggtttgtct

SEQ ID NO: 593539 - DNA, 25 bp, Mus musculus
ccctgaaactagtctgggtttgtct

SEQ ID NO: 593540 - DNA, 25 bp, Mus musculus
ccctgaaagacgacagctggctgaa

SEQ ID NO: 593541 - DNA, 25 bp, Mus musculus
ccctgaaagacgtcagctggctgaa

SEQ ID NO: 593542 - DNA, 25 bp, Mus musculus
ccctgaaagccgcacagtggcagtg

SEQ ID NO: 593543 - DNA, 25 bp, Mus musculus
ccctgaaagccggacagtggcagtg

SEQ ID NO: 593544 - DNA, 25 bp, Mus musculus
ccctgaaagcctaggaaccgactct

SEQ ID NO: 593545 - DNA, 25 bp, Mus musculus
ccctgaaagccttggaaccgactct

SEQ ID NO: 593546 - DNA, 25 bp, Mus musculus
ccctgaaaggctactggagcaagtt

SEQ ID NO: 593547 - DNA, 25 bp, Mus musculus
ccctgaaaggcttctggagcaagtt

SEQ ID NO: 593548 - DNA, 25 bp, Mus musculus
ccctgaacagagagtcaaatgtgtt

SEQ ID NO: 593549 - DNA, 25 bp, Mus musculus
ccctgaacagagtgtcaaatgtgtt

SEQ ID NO: 593550 - DNA, 25 bp, Mus musculus
ccctgaactcacagtctctttgcag

SEQ ID NO: 593551 - DNA, 25 bp, Mus musculus
ccctgaactcactgtctctttgcag

SEQ ID NO: 593552 - DNA, 25 bp, Mus musculus
ccctgaagagatccacagttggatt

SEQ ID NO: 593553 - DNA, 25 bp, Mus musculus
ccctgaagagatgcacagttggatt

SEQ ID NO: 593554 - DNA, 25 bp, Mus musculus
ccctgaagagcacggaactgagatc

SEQ ID NO: 593555 - DNA, 25 bp, Mus musculus
ccctgaagagcagggaactgagatc

SEQ ID NO: 593556 - DNA, 25 bp, Mus musculus
ccctgaagcacccagacctagttag

SEQ ID NO: 593557 - DNA, 25 bp, Mus musculus
ccctgaagcaccgagacctagttag

SEQ ID NO: 593558 - DNA, 25 bp, Mus musculus
ccctgaagcacgcttttaatgcaaa

SEQ ID NO: 593559 - DNA, 25 bp, Mus musculus
ccctgaagcacggttttaatgcaaa

SEQ ID NO: 593560 - DNA, 25 bp, Mus musculus
ccctgaatacttaggttgcaatcac

SEQ ID NO: 593561 - DNA, 25 bp, Mus musculus
ccctgaatactttggttgcaatcac

SEQ ID NO: 593562 - DNA, 25 bp, Mus musculus
ccctgaatgcaacataaagcctatg

SEQ ID NO: 593563 - DNA, 25 bp, Mus musculus
ccctgaatgcaagataaagcctatg

SEQ ID NO: 593564 - DNA, 25 bp, Mus musculus
ccctgacaatgacgaagccatgaga

SEQ ID NO: 593565 - DNA, 25 bp, Mus musculus
ccctgacaatgaggaagccatgaga

SEQ ID NO: 593566 - DNA, 25 bp, Mus musculus
ccctgacacatgcacagctgatttt

SEQ ID NO: 593567 - DNA, 25 bp, Mus musculus
ccctgacacatggacagctgatttt

SEQ ID NO: 593568 - DNA, 25 bp, Mus musculus
ccctgacagtttcggtaaggctttg

SEQ ID NO: 593569 - DNA, 25 bp, Mus musculus
ccctgacagtttgggtaaggctttg

SEQ ID NO: 593570 - DNA, 25 bp, Mus musculus
ccctgaccttggcacctgagtctaa

SEQ ID NO: 593571 - DNA, 25 bp, Mus musculus
ccctgaccttgggacctgagtctaa

SEQ ID NO: 593572 - DNA, 25 bp, Mus musculus
ccctgacggtgacggcagacatcac

SEQ ID NO: 593573 - DNA, 25 bp, Mus musculus
ccctgacggtgagggcagacatcac

SEQ ID NO: 593574 - DNA, 25 bp, Mus musculus
ccctgactaacgatgaataccccat

SEQ ID NO: 593575 - DNA, 25 bp, Mus musculus
ccctgactaacgttgaataccccat

SEQ ID NO: 593576 - DNA, 25 bp, Mus musculus
ccctgactacagcatgatgggcatg

SEQ ID NO: 593577 - DNA, 25 bp, Mus musculus
ccctgactacaggatgatgggcatg

SEQ ID NO: 593578 - DNA, 25 bp, Mus musculus
ccctgactatggcacggaaatcagt

SEQ ID NO: 593579 - DNA, 25 bp, Mus musculus
ccctgactatgggacggaaatcagt

SEQ ID NO: 593580 - DNA, 25 bp, Mus musculus
ccctgactcagacgtggtggaaaac

SEQ ID NO: 593581 - DNA, 25 bp, Mus musculus
ccctgactcagaggtggtggaaaac

SEQ ID NO: 593582 - DNA, 25 bp, Mus musculus
ccctgactgcaacgacggcagcgat

SEQ ID NO: 593583 - DNA, 25 bp, Mus musculus
ccctgactgcaaggacggcagcgat

SEQ ID NO: 593584 - DNA, 25 bp, Mus musculus
ccctgactggacatagaaactgttg

SEQ ID NO: 593585 - DNA, 25 bp, Mus musculus
ccctgactggacttagaaactgttg

SEQ ID NO: 593586 - DNA, 25 bp, Mus musculus
ccctgactggttagtgggcatcgac

SEQ ID NO: 593587 - DNA, 25 bp, Mus musculus
ccctgactggtttgtgggcatcgac

SEQ ID NO: 593588 - DNA, 25 bp, Mus musculus
ccctgacttgctcttcgtttgtgag

SEQ ID NO: 593589 - DNA, 25 bp, Mus musculus
ccctgacttgctgttcgtttgtgag

SEQ ID NO: 593590 - DNA, 25 bp, Mus musculus
ccctgagaacagactgagaaactct

SEQ ID NO: 593591 - DNA, 25 bp, Mus musculus
ccctgagaacagtctgagaaactct

SEQ ID NO: 593592 - DNA, 25 bp, Mus musculus
ccctgagaagcgagtggcatactgc

SEQ ID NO: 593593 - DNA, 25 bp, Mus musculus
ccctgagaagcgtgtggcatactgc

SEQ ID NO: 593594 - DNA, 25 bp, Mus musculus
ccctgagaaggtcgacggacgcttt

SEQ ID NO: 593595 - DNA, 25 bp, Mus musculus
ccctgagaaggtggacggacgcttt

SEQ ID NO: 593596 - DNA, 25 bp, Mus musculus
ccctgagaatggaagtagacgcatt

SEQ ID NO: 593597 - DNA, 25 bp, Mus musculus
ccctgagaatggtagtagacgcatt

SEQ ID NO: 593598 - DNA, 25 bp, Mus musculus
ccctgagaccctcgataagtttgac

SEQ ID NO: 593599 - DNA, 25 bp, Mus musculus
ccctgagaccctggataagtttgac

SEQ ID NO: 593600 - DNA, 25 bp, Mus musculus
ccctgagacgggctgactggtacaa

SEQ ID NO: 593601 - DNA, 25 bp, Mus musculus
ccctgagacggggtgactggtacaa

SEQ ID NO: 593602 - DNA, 25 bp, Mus musculus
ccctgagagaggcttcaagcaggaa

SEQ ID NO: 593603 - DNA, 25 bp, Mus musculus
ccctgagagagggttcaagcaggaa

SEQ ID NO: 593604 - DNA, 25 bp, Mus musculus
ccctgagagatgacaaaagctacct

SEQ ID NO: 593605 - DNA, 25 bp, Mus musculus
ccctgagagatgtcaaaagctacct

SEQ ID NO: 593606 - DNA, 25 bp, Mus musculus
ccctgagagcccctggtcacagatt

SEQ ID NO: 593607 - DNA, 25 bp, Mus musculus
ccctgagagcccgtggtcacagatt

SEQ ID NO: 593608 - DNA, 25 bp, Mus musculus
ccctgagagtaaagaagctggtcta

SEQ ID NO: 593609 - DNA, 25 bp, Mus musculus
ccctgagagtaatgaagctggtcta

SEQ ID NO: 593610 - DNA, 25 bp, Mus musculus
ccctgagcagcacaaggagtgtgca

SEQ ID NO: 593611 - DNA, 25 bp, Mus musculus
ccctgagcagcagaaggagtgtgca

SEQ ID NO: 593612 - DNA, 25 bp, Mus musculus
ccctgagcctcaatttggaggcagt

SEQ ID NO: 593613 - DNA, 25 bp, Mus musculus
ccctgagcctcattttggaggcagt

SEQ ID NO: 593614 - DNA, 25 bp, Mus musculus
ccctgagcctgaacatggttctgtc

SEQ ID NO: 593615 - DNA, 25 bp, Mus musculus
ccctgagcctgatcatggttctgtc

SEQ ID NO: 593616 - DNA, 25 bp, Mus musculus
ccctgagcggagatactgggttcca

SEQ ID NO: 593617 - DNA, 25 bp, Mus musculus
ccctgagcggagttactgggttcca

SEQ ID NO: 593618 - DNA, 25 bp, Mus musculus
ccctgagctgctcagagtctcgggc

SEQ ID NO: 593619 - DNA, 25 bp, Mus musculus
ccctgagctgctgagagtctcgggc

SEQ ID NO: 593620 - DNA, 25 bp, Mus musculus
ccctgagctgtacctgtcctgttca

SEQ ID NO: 593621 - DNA, 25 bp, Mus musculus
ccctgagctgtagctgtcctgttca

SEQ ID NO: 593622 - DNA, 25 bp, Mus musculus
ccctgagctgttaggagaagtgcct

SEQ ID NO: 593623 - DNA, 25 bp, Mus musculus
ccctgagctgtttggagaagtgcct

SEQ ID NO: 593624 - DNA, 25 bp, Mus musculus
ccctgagcttggagaactatgagaa

SEQ ID NO: 593625 - DNA, 25 bp, Mus musculus
ccctgagcttggtgaactatgagaa

SEQ ID NO: 593626 - DNA, 25 bp, Mus musculus
ccctgaggaagaagatgttgacacc

SEQ ID NO: 593627 - DNA, 25 bp, Mus musculus
ccctgaggaagatgatgttgacacc

SEQ ID NO: 593628 - DNA, 25 bp, Mus musculus
ccctgaggaggacctctctaaactc

SEQ ID NO: 593629 - DNA, 25 bp, Mus musculus
ccctgaggaggagctctctaaactc

SEQ ID NO: 593630 - DNA, 25 bp, Mus musculus
ccctgaggagggaccagcgggatgc

SEQ ID NO: 593631 - DNA, 25 bp, Mus musculus
ccctgaggagggtccagcgggatgc

SEQ ID NO: 593632 - DNA, 25 bp, Mus musculus
ccctgaggatttccttggagctgga

SEQ ID NO: 593633 - DNA, 25 bp, Mus musculus
ccctgaggatttgcttggagctgga

SEQ ID NO: 593634 - DNA, 25 bp, Mus musculus
ccctgaggccctatttcatactagc

SEQ ID NO: 593635 - DNA, 25 bp, Mus musculus
ccctgaggccctttttcatactagc

SEQ ID NO: 593636 - DNA, 25 bp, Mus musculus
ccctgaggccgacgagaaactatct

SEQ ID NO: 593637 - DNA, 25 bp, Mus musculus
ccctgaggccgaggagaaactatct

SEQ ID NO: 593638 - DNA, 25 bp, Mus musculus
ccctgagggaacatcacttggacaa

SEQ ID NO: 593639 - DNA, 25 bp, Mus musculus
ccctgagggaacttcacttggacaa

SEQ ID NO: 593640 - DNA, 25 bp, Mus musculus
ccctgagtatgaacggagatttgtg

SEQ ID NO: 593641 - DNA, 25 bp, Mus musculus
ccctgagtatgatcggagatttgtg

SEQ ID NO: 593642 - DNA, 25 bp, Mus musculus
ccctgagtcaacacaaatttgccag

SEQ ID NO: 593643 - DNA, 25 bp, Mus musculus
ccctgagtcaactcaaatttgccag

SEQ ID NO: 593644 - DNA, 25 bp, Mus musculus
ccctgagttcgccaagagtgtgcga

SEQ ID NO: 593645 - DNA, 25 bp, Mus musculus
ccctgagttcgcgaagagtgtgcga

SEQ ID NO: 593646 - DNA, 25 bp, Mus musculus
ccctgataaactattgtatgtgagg

SEQ ID NO: 593647 - DNA, 25 bp, Mus musculus
ccctgataaacttttgtatgtgagg

SEQ ID NO: 593648 - DNA, 25 bp, Mus musculus
ccctgatagaacaacaagtttcaat

SEQ ID NO: 593649 - DNA, 25 bp, Mus musculus
ccctgatagaactacaagtttcaat

SEQ ID NO: 593650 - DNA, 25 bp, Mus musculus
ccctgatagggtagttatgaagatt

SEQ ID NO: 593651 - DNA, 25 bp, Mus musculus
ccctgatagggttgttatgaagatt

SEQ ID NO: 593652 - DNA, 25 bp, Mus musculus
ccctgatcaaatatcttcaagtaga

SEQ ID NO: 593653 - DNA, 25 bp, Mus musculus
ccctgatcaaatttcttcaagtaga

SEQ ID NO: 593654 - DNA, 25 bp, Mus musculus
ccctgatcaaccagcccctgctttt

SEQ ID NO: 593655 - DNA, 25 bp, Mus musculus
ccctgatcaacctgcccctgctttt

SEQ ID NO: 593656 - DNA, 25 bp, Mus musculus
ccctgatcaaggagtggcctggtta

SEQ ID NO: 593657 - DNA, 25 bp, Mus musculus
ccctgatcaaggtgtggcctggtta

SEQ ID NO: 593658 - DNA, 25 bp, Mus musculus
ccctgatccaagattggataatgag

SEQ ID NO: 593659 - DNA, 25 bp, Mus musculus
ccctgatccaagtttggataatgag

SEQ ID NO: 593660 - DNA, 25 bp, Mus musculus
ccctgatccgagcagcaaatgaccg

SEQ ID NO: 593661 - DNA, 25 bp, Mus musculus
ccctgatccgaggagcaaatgaccg

SEQ ID NO: 593662 - DNA, 25 bp, Mus musculus
ccctgatctcagatggaggacaaca

SEQ ID NO: 593663 - DNA, 25 bp, Mus musculus
ccctgatctcagttggaggacaaca

SEQ ID NO: 593664 - DNA, 25 bp, Mus musculus
ccctgatgacagagcttagcatcaa

SEQ ID NO: 593665 - DNA, 25 bp, Mus musculus
ccctgatgacagtgcttagcatcaa

SEQ ID NO: 593666 - DNA, 25 bp, Mus musculus
ccctgatgcagactgtttgaggatc

SEQ ID NO: 593667 - DNA, 25 bp, Mus musculus
ccctgatgcagagtgtttgaggatc

SEQ ID NO: 593668 - DNA, 25 bp, Mus musculus
ccctgatgctaacaagcctgaggac

SEQ ID NO: 593669 - DNA, 25 bp, Mus musculus
ccctgatgctaagaagcctgaggac

SEQ ID NO: 593670 - DNA, 25 bp, Mus musculus
ccctgatggacccaggagccatagt

SEQ ID NO: 593671 - DNA, 25 bp, Mus musculus
ccctgatggaccgaggagccatagt

SEQ ID NO: 593672 - DNA, 25 bp, Mus musculus
ccctgatggcaaaacagtgacatgc

SEQ ID NO: 593673 - DNA, 25 bp, Mus musculus
ccctgatggcaatacagtgacatgc

SEQ ID NO: 593674 - DNA, 25 bp, Mus musculus
ccctgatggccccaagggtgaacgt

SEQ ID NO: 593675 - DNA, 25 bp, Mus musculus
ccctgatggcccgaagggtgaacgt

SEQ ID NO: 593676 - DNA, 25 bp, Mus musculus
ccctgatgtggcacccagagttctg

SEQ ID NO: 593677 - DNA, 25 bp, Mus musculus
ccctgatgtggctcccagagttctg

SEQ ID NO: 593678 - DNA, 25 bp, Mus musculus
ccctgattatttcatgtactcgaca

SEQ ID NO: 593679 - DNA, 25 bp, Mus musculus
ccctgattatttgatgtactcgaca

SEQ ID NO: 593680 - DNA, 25 bp, Mus musculus
ccctgattggagctggatgtcacac

SEQ ID NO: 593681 - DNA, 25 bp, Mus musculus
ccctgattggaggtggatgtcacac

SEQ ID NO: 593682 - DNA, 25 bp, Mus musculus
ccctgatttgtcaccagggtacctg

SEQ ID NO: 593683 - DNA, 25 bp, Mus musculus
ccctgatttgtctccagggtacctg

SEQ ID NO: 593684 - DNA, 25 bp, Mus musculus
ccctgatttgttcaagacctccaga

SEQ ID NO: 593685 - DNA, 25 bp, Mus musculus
ccctgatttgttgaagacctccaga

SEQ ID NO: 593686 - DNA, 25 bp, Mus musculus
ccctgcaaaagtctgagattgcgct

SEQ ID NO: 593687 - DNA, 25 bp, Mus musculus
ccctgcaaaagtgtgagattgcgct

SEQ ID NO: 593688 - DNA, 25 bp, Mus musculus
ccctgcaccaggataatatctcagt

SEQ ID NO: 593689 - DNA, 25 bp, Mus musculus
ccctgcaccaggttaatatctcagt

SEQ ID NO: 593690 - DNA, 25 bp, Mus musculus
ccctgcagagagaggcccgcatcaa

SEQ ID NO: 593691 - DNA, 25 bp, Mus musculus
ccctgcagagagtggcccgcatcaa

SEQ ID NO: 593692 - DNA, 25 bp, Mus musculus
ccctgcaggaggagtgtgaccgcaa

SEQ ID NO: 593693 - DNA, 25 bp, Mus musculus
ccctgcaggaggtgtgtgaccgcaa

SEQ ID NO: 593694 - DNA, 25 bp, Mus musculus
ccctgcagtgcgagcagtgcaaaaa

SEQ ID NO: 593695 - DNA, 25 bp, Mus musculus
ccctgcagtgcgtgcagtgcaaaaa

SEQ ID NO: 593696 - DNA, 25 bp, Mus musculus
ccctgcatggatagttctgggccag

SEQ ID NO: 593697 - DNA, 25 bp, Mus musculus
ccctgcatggattgttctgggccag

SEQ ID NO: 593698 - DNA, 25 bp, Mus musculus
ccctgccaaaaacagtgagcttatc

SEQ ID NO: 593699 - DNA, 25 bp, Mus musculus
ccctgccaaaaagagtgagcttatc

SEQ ID NO: 593700 - DNA, 25 bp, Mus musculus
ccctgccaagccaggagtcgcaggt

SEQ ID NO: 593701 - DNA, 25 bp, Mus musculus
ccctgccaagcctggagtcgcaggt

SEQ ID NO: 593702 - DNA, 25 bp, Mus musculus
ccctgccacgggatgccgtagagaa

SEQ ID NO: 593703 - DNA, 25 bp, Mus musculus
ccctgccacgggttgccgtagagaa

SEQ ID NO: 593704 - DNA, 25 bp, Mus musculus
ccctgccattccaaggagcagaagt

SEQ ID NO: 593705 - DNA, 25 bp, Mus musculus
ccctgccattcctaggagcagaagt

SEQ ID NO: 593706 - DNA, 25 bp, Mus musculus
ccctgcccagagcagcttatacagg

SEQ ID NO: 593707 - DNA, 25 bp, Mus musculus
ccctgcccagaggagcttatacagg

SEQ ID NO: 593708 - DNA, 25 bp, Mus musculus
ccctgcccatggagagaaatgcaga

SEQ ID NO: 593709 - DNA, 25 bp, Mus musculus
ccctgcccatggtgagaaatgcaga

SEQ ID NO: 593710 - DNA, 25 bp, Mus musculus
ccctgccgagggagctagtgtaaaa

SEQ ID NO: 593711 - DNA, 25 bp, Mus musculus
ccctgccgagggtgctagtgtaaaa

SEQ ID NO: 593712 - DNA, 25 bp, Mus musculus
ccctgccggcccaattatggcagag

SEQ ID NO: 593713 - DNA, 25 bp, Mus musculus
ccctgccggccctattatggcagag

SEQ ID NO: 593714 - DNA, 25 bp, Mus musculus
ccctgccggtgtcgagttgaacagc

SEQ ID NO: 593715 - DNA, 25 bp, Mus musculus
ccctgccggtgtggagttgaacagc

SEQ ID NO: 593716 - DNA, 25 bp, Mus musculus
ccctgcctaccgcaaatgtactttt

SEQ ID NO: 593717 - DNA, 25 bp, Mus musculus
ccctgcctaccggaaatgtactttt

SEQ ID NO: 593718 - DNA, 25 bp, Mus musculus
ccctgccttcggatctcctagagaa

SEQ ID NO: 593719 - DNA, 25 bp, Mus musculus
ccctgccttcggttctcctagagaa

SEQ ID NO: 593720 - DNA, 25 bp, Mus musculus
ccctgccttgctattccgtgggaca

SEQ ID NO: 593721 - DNA, 25 bp, Mus musculus
ccctgccttgcttttccgtgggaca

SEQ ID NO: 593722 - DNA, 25 bp, Mus musculus
ccctgcctttgtcgatacagtcata

SEQ ID NO: 593723 - DNA, 25 bp, Mus musculus
ccctgcctttgtggatacagtcata

SEQ ID NO: 593724 - DNA, 25 bp, Mus musculus
ccctgcgaagggatgtgtggatctt

SEQ ID NO: 593725 - DNA, 25 bp, Mus musculus
ccctgcgaagggttgtgtggatctt

SEQ ID NO: 593726 - DNA, 25 bp, Mus musculus
ccctgcgacgcaagatcaacaagat

SEQ ID NO: 593727 - DNA, 25 bp, Mus musculus
ccctgcgacgcatgatcaacaagat

SEQ ID NO: 593728 - DNA, 25 bp, Mus musculus
ccctgcgagagaagatcgaggagat

SEQ ID NO: 593729 - DNA, 25 bp, Mus musculus
ccctgcgagagatgatcgaggagat

SEQ ID NO: 593730 - DNA, 25 bp, Mus musculus
ccctgcgagcttaggctgatgatga

SEQ ID NO: 593731 - DNA, 25 bp, Mus musculus
ccctgcgagctttggctgatgatga

SEQ ID NO: 593732 - DNA, 25 bp, Mus musculus
ccctgcgcttcacctggagcatgaa

SEQ ID NO: 593733 - DNA, 25 bp, Mus musculus
ccctgcgcttcagctggagcatgaa

SEQ ID NO: 593734 - DNA, 25 bp, Mus musculus
ccctgcggaaagactgacatgcggg

SEQ ID NO: 593735 - DNA, 25 bp, Mus musculus
ccctgcggaaagtctgacatgcggg

SEQ ID NO: 593736 - DNA, 25 bp, Mus musculus
ccctgcggatgcagatgcacgggaa

SEQ ID NO: 593737 - DNA, 25 bp, Mus musculus
ccctgcggatgctgatgcacgggaa

SEQ ID NO: 593738 - DNA, 25 bp, Mus musculus
ccctgcgggaagctagccttctgct

SEQ ID NO: 593739 - DNA, 25 bp, Mus musculus
ccctgcgggaaggtagccttctgct

SEQ ID NO: 593740 - DNA, 25 bp, Mus musculus
ccctgcggttcccatcgaggtggca

SEQ ID NO: 593741 - DNA, 25 bp, Mus musculus
ccctgcggttccgatcgaggtggca

SEQ ID NO: 593742 - DNA, 25 bp, Mus musculus
ccctgcgtgaaacggctgccactag

SEQ ID NO: 593743 - DNA, 25 bp, Mus musculus
ccctgcgtgaaagggctgccactag

SEQ ID NO: 593744 - DNA, 25 bp, Mus musculus
ccctgcgtgctgacgtcaggcgcgt

SEQ ID NO: 593745 - DNA, 25 bp, Mus musculus
ccctgcgtgctgtcgtcaggcgcgt

SEQ ID NO: 593746 - DNA, 25 bp, Mus musculus
ccctgcgtggatcaactcagtgaca

SEQ ID NO: 593747 - DNA, 25 bp, Mus musculus
ccctgcgtggatgaactcagtgaca

SEQ ID NO: 593748 - DNA, 25 bp, Mus musculus
ccctgctactcccatagaactaaga

SEQ ID NO: 593749 - DNA, 25 bp, Mus musculus
ccctgctactccgatagaactaaga

SEQ ID NO: 593750 - DNA, 25 bp, Mus musculus
ccctgctatgttaggagacgtgaag

SEQ ID NO: 593751 - DNA, 25 bp, Mus musculus
ccctgctatgtttggagacgtgaag

SEQ ID NO: 593752 - DNA, 25 bp, Mus musculus
ccctgctcaagaagagtgtgggcct

SEQ ID NO: 593753 - DNA, 25 bp, Mus musculus
ccctgctcaagatgagtgtgggcct

SEQ ID NO: 593754 - DNA, 25 bp, Mus musculus
ccctgctcagaactgtggtgtccag

SEQ ID NO: 593755 - DNA, 25 bp, Mus musculus
ccctgctcagaagtgtggtgtccag

SEQ ID NO: 593756 - DNA, 25 bp, Mus musculus
ccctgctcagtgatctgcgggacct

SEQ ID NO: 593757 - DNA, 25 bp, Mus musculus
ccctgctcagtgttctgcgggacct

SEQ ID NO: 593758 - DNA, 25 bp, Mus musculus
ccctgctcgcttctgggcaactgga

SEQ ID NO: 593759 - DNA, 25 bp, Mus musculus
ccctgctcgcttgtgggcaactgga

SEQ ID NO: 593760 - DNA, 25 bp, Mus musculus
ccctgctctcaacggagaaattcca

SEQ ID NO: 593761 - DNA, 25 bp, Mus musculus
ccctgctctcaagggagaaattcca

SEQ ID NO: 593762 - DNA, 25 bp, Mus musculus
ccctgctcttcacggaggtcagttt

SEQ ID NO: 593763 - DNA, 25 bp, Mus musculus
ccctgctcttcagggaggtcagttt

SEQ ID NO: 593764 - DNA, 25 bp, Mus musculus
ccctgctgaaatcggatgcggacat

SEQ ID NO: 593765 - DNA, 25 bp, Mus musculus
ccctgctgaaatgggatgcggacat

SEQ ID NO: 593766 - DNA, 25 bp, Mus musculus
ccctgctgacgcacactgtgttctt

SEQ ID NO: 593767 - DNA, 25 bp, Mus musculus
ccctgctgacgctcactgtgttctt

SEQ ID NO: 593768 - DNA, 25 bp, Mus musculus
ccctgctgatatagatgcttctgag

SEQ ID NO: 593769 - DNA, 25 bp, Mus musculus
ccctgctgatattgatgcttctgag

SEQ ID NO: 593770 - DNA, 25 bp, Mus musculus
ccctgctgatctcggagaagtgcgc

SEQ ID NO: 593771 - DNA, 25 bp, Mus musculus
ccctgctgatctgggagaagtgcgc

SEQ ID NO: 593772 - DNA, 25 bp, Mus musculus
ccctgctgcagtctttggaaaggct

SEQ ID NO: 593773 - DNA, 25 bp, Mus musculus
ccctgctgcagtgtttggaaaggct

SEQ ID NO: 593774 - DNA, 25 bp, Mus musculus
ccctgctgcgtgaggaacatgggcc

SEQ ID NO: 593775 - DNA, 25 bp, Mus musculus
ccctgctgcgtgtggaacatgggcc

SEQ ID NO: 593776 - DNA, 25 bp, Mus musculus
ccctgctggcaacattacgagcttt

SEQ ID NO: 593777 - DNA, 25 bp, Mus musculus
ccctgctggcaagattacgagcttt

SEQ ID NO: 593778 - DNA, 25 bp, Mus musculus
ccctgctggtgtcccgctggttcat

SEQ ID NO: 593779 - DNA, 25 bp, Mus musculus
ccctgctggtgtgccgctggttcat

SEQ ID NO: 593780 - DNA, 25 bp, Mus musculus
ccctgctgtaggaaaactgctgcta

SEQ ID NO: 593781 - DNA, 25 bp, Mus musculus
ccctgctgtaggtaaactgctgcta

SEQ ID NO: 593782 - DNA, 25 bp, Mus musculus
ccctgctgtgtaagcccgcatcggg

SEQ ID NO: 593783 - DNA, 25 bp, Mus musculus
ccctgctgtgtatgcccgcatcggg

SEQ ID NO: 593784 - DNA, 25 bp, Mus musculus
ccctgcttactaagtggaatatttg

SEQ ID NO: 593785 - DNA, 25 bp, Mus musculus
ccctgcttactatgtggaatatttg

SEQ ID NO: 593786 - DNA, 25 bp, Mus musculus
ccctgcttagctccgaactagtgta

SEQ ID NO: 593787 - DNA, 25 bp, Mus musculus
ccctgcttagctgcgaactagtgta

SEQ ID NO: 593788 - DNA, 25 bp, Mus musculus
ccctgcttctatatccagaaggctg

SEQ ID NO: 593789 - DNA, 25 bp, Mus musculus
ccctgcttctatttccagaaggctg

SEQ ID NO: 593790 - DNA, 25 bp, Mus musculus
ccctgcttctggagaacggccaaga

SEQ ID NO: 593791 - DNA, 25 bp, Mus musculus
ccctgcttctggtgaacggccaaga

SEQ ID NO: 593792 - DNA, 25 bp, Mus musculus
ccctgcttgatgctgtgcatttagg

SEQ ID NO: 593793 - DNA, 25 bp, Mus musculus
ccctgcttgatggtgtgcatttagg

SEQ ID NO: 593794 - DNA, 25 bp, Mus musculus
ccctggaaatgtactaaatacagaa

SEQ ID NO: 593795 - DNA, 25 bp, Mus musculus
ccctggaaatgttctaaatacagaa

SEQ ID NO: 593796 - DNA, 25 bp, Mus musculus
ccctggaactgcagacggatgagct

SEQ ID NO: 593797 - DNA, 25 bp, Mus musculus
ccctggaactgctgacggatgagct

SEQ ID NO: 593798 - DNA, 25 bp, Mus musculus
ccctggaagatcagcatgcatttat

SEQ ID NO: 593799 - DNA, 25 bp, Mus musculus
ccctggaagatctgcatgcatttat

SEQ ID NO: 593800 - DNA, 25 bp, Mus musculus
ccctggaaggatatcctcgttggag

SEQ ID NO: 593801 - DNA, 25 bp, Mus musculus
ccctggaaggatttcctcgttggag

SEQ ID NO: 593802 - DNA, 25 bp, Mus musculus
ccctggaaggtgacagaggtgccaa

SEQ ID NO: 593803 - DNA, 25 bp, Mus musculus
ccctggaaggtgtcagaggtgccaa

SEQ ID NO: 593804 - DNA, 25 bp, Mus musculus
ccctggaaggttcggatgaagcacc

SEQ ID NO: 593805 - DNA, 25 bp, Mus musculus
ccctggaaggttgggatgaagcacc

SEQ ID NO: 593806 - DNA, 25 bp, Mus musculus
ccctggaagttcaactggagcagct

SEQ ID NO: 593807 - DNA, 25 bp, Mus musculus
ccctggaagttctactggagcagct

SEQ ID NO: 593808 - DNA, 25 bp, Mus musculus
ccctggaatgtgattgatggcaagc

SEQ ID NO: 593809 - DNA, 25 bp, Mus musculus
ccctggaatgtgtttgatggcaagc

SEQ ID NO: 593810 - DNA, 25 bp, Mus musculus
ccctggacacagagctgtttgggcc

SEQ ID NO: 593811 - DNA, 25 bp, Mus musculus
ccctggacacagtgctgtttgggcc

SEQ ID NO: 593812 - DNA, 25 bp, Mus musculus
ccctggacatcaatgttgtggtatc

SEQ ID NO: 593813 - DNA, 25 bp, Mus musculus
ccctggacatcattgttgtggtatc

SEQ ID NO: 593814 - DNA, 25 bp, Mus musculus
ccctggaccaggagaccaagctagc

SEQ ID NO: 593815 - DNA, 25 bp, Mus musculus
ccctggaccaggtgaccaagctagc

SEQ ID NO: 593816 - DNA, 25 bp, Mus musculus
ccctggaccatgacattgatgtgca

SEQ ID NO: 593817 - DNA, 25 bp, Mus musculus
ccctggaccatgtcattgatgtgca

SEQ ID NO: 593818 - DNA, 25 bp, Mus musculus
ccctggacctgacgagacactaaca

SEQ ID NO: 593819 - DNA, 25 bp, Mus musculus
ccctggacctgaggagacactaaca

SEQ ID NO: 593820 - DNA, 25 bp, Mus musculus
ccctggacgtcgagcccagtgttac

SEQ ID NO: 593821 - DNA, 25 bp, Mus musculus
ccctggacgtcgtgcccagtgttac

SEQ ID NO: 593822 - DNA, 25 bp, Mus musculus
ccctggactgggaggcacaaatggt

SEQ ID NO: 593823 - DNA, 25 bp, Mus musculus
ccctggactgggtggcacaaatggt

SEQ ID NO: 593824 - DNA, 25 bp, Mus musculus
ccctggacttggatggtatcattgc

SEQ ID NO: 593825 - DNA, 25 bp, Mus musculus
ccctggacttggttggtatcattgc

SEQ ID NO: 593826 - DNA, 25 bp, Mus musculus
ccctggagaaagatcggaagatgtc

SEQ ID NO: 593827 - DNA, 25 bp, Mus musculus
ccctggagaaagttcggaagatgtc

SEQ ID NO: 593828 - DNA, 25 bp, Mus musculus
ccctggagaacactggctttgaacc

SEQ ID NO: 593829 - DNA, 25 bp, Mus musculus
ccctggagaacagtggctttgaacc

SEQ ID NO: 593830 - DNA, 25 bp, Mus musculus
ccctggagaaccagagtatccgaga

SEQ ID NO: 593831 - DNA, 25 bp, Mus musculus
ccctggagaacctgagtatccgaga

SEQ ID NO: 593832 - DNA, 25 bp, Mus musculus
ccctggagaagtacggaccgctgaa

SEQ ID NO: 593833 - DNA, 25 bp, Mus musculus
ccctggagaagttcggaccgctgaa

SEQ ID NO: 593834 - DNA, 25 bp, Mus musculus
ccctggagagaaaggtttccctggt

SEQ ID NO: 593835 - DNA, 25 bp, Mus musculus
ccctggagagaatggtttccctggt

SEQ ID NO: 593836 - DNA, 25 bp, Mus musculus
ccctggagatacataaggccccagg

SEQ ID NO: 593837 - DNA, 25 bp, Mus musculus
ccctggagatacttaaggccccagg

SEQ ID NO: 593838 - DNA, 25 bp, Mus musculus
ccctggagcaacaccgggagaagct

SEQ ID NO: 593839 - DNA, 25 bp, Mus musculus
ccctggagcaactccgggagaagct

SEQ ID NO: 593840 - DNA, 25 bp, Mus musculus
ccctggagcctcatgtacagtgtgg

SEQ ID NO: 593841 - DNA, 25 bp, Mus musculus
ccctggagcctcttgtacagtgtgg

SEQ ID NO: 593842 - DNA, 25 bp, Mus musculus
ccctggagctgcaaaagacagccat

SEQ ID NO: 593843 - DNA, 25 bp, Mus musculus
ccctggagctgctaaagacagccat

SEQ ID NO: 593844 - DNA, 25 bp, Mus musculus
ccctggagctggctccccgtaatgt

SEQ ID NO: 593845 - DNA, 25 bp, Mus musculus
ccctggagctgggtccccgtaatgt

SEQ ID NO: 593846 - DNA, 25 bp, Mus musculus
ccctggaggaatctgctctgcgctc

SEQ ID NO: 593847 - DNA, 25 bp, Mus musculus
ccctggaggaatgtgctctgcgctc

SEQ ID NO: 593848 - DNA, 25 bp, Mus musculus
ccctggaggctaaggacttgtttcg

SEQ ID NO: 593849 - DNA, 25 bp, Mus musculus
ccctggaggctatggacttgtttcg

SEQ ID NO: 593850 - DNA, 25 bp, Mus musculus
ccctggagtacaacccctatgcttg

SEQ ID NO: 593851 - DNA, 25 bp, Mus musculus
ccctggagtacatcccctatgcttg

SEQ ID NO: 593852 - DNA, 25 bp, Mus musculus
ccctggagtactacgacaaagcctt

SEQ ID NO: 593853 - DNA, 25 bp, Mus musculus
ccctggagtacttcgacaaagcctt

SEQ ID NO: 593854 - DNA, 25 bp, Mus musculus
ccctggagtcgtcaggaaaagaaga

SEQ ID NO: 593855 - DNA, 25 bp, Mus musculus
ccctggagtcgtgaggaaaagaaga

SEQ ID NO: 593856 - DNA, 25 bp, Mus musculus
ccctggagtctccagagatagcaac

SEQ ID NO: 593857 - DNA, 25 bp, Mus musculus
ccctggagtctcgagagatagcaac

SEQ ID NO: 593858 - DNA, 25 bp, Mus musculus
ccctggagttgcactggctcagtta

SEQ ID NO: 593859 - DNA, 25 bp, Mus musculus
ccctggagttgctctggctcagtta

SEQ ID NO: 593860 - DNA, 25 bp, Mus musculus
ccctggagttgtcgtaaaatgtagc

SEQ ID NO: 593861 - DNA, 25 bp, Mus musculus
ccctggagttgtggtaaaatgtagc

SEQ ID NO: 593862 - DNA, 25 bp, Mus musculus
ccctggataagtatgacaagttcaa

SEQ ID NO: 593863 - DNA, 25 bp, Mus musculus
ccctggataagtttgacaagttcaa

SEQ ID NO: 593864 - DNA, 25 bp, Mus musculus
ccctggatatctcggtgtgggacta

SEQ ID NO: 593865 - DNA, 25 bp, Mus musculus
ccctggatatctctgtgcattctca

SEQ ID NO: 593866 - DNA, 25 bp, Mus musculus
ccctggatatctgggtgtgggacta

SEQ ID NO: 593867 - DNA, 25 bp, Mus musculus
ccctggatatctgtgtgcattctca

SEQ ID NO: 593868 - DNA, 25 bp, Mus musculus
ccctggatcatcacatcaaaggaag

SEQ ID NO: 593869 - DNA, 25 bp, Mus musculus
ccctggatcatcaggacccaagggt

SEQ ID NO: 593870 - DNA, 25 bp, Mus musculus
ccctggatcatctcatcaaaggaag

SEQ ID NO: 593871 - DNA, 25 bp, Mus musculus
ccctggatcatctggacccaagggt

SEQ ID NO: 593872 - DNA, 25 bp, Mus musculus
ccctggatctgcacaaggatgaagg

SEQ ID NO: 593873 - DNA, 25 bp, Mus musculus
ccctggatctgctcaaggatgaagg

SEQ ID NO: 593874 - DNA, 25 bp, Mus musculus
ccctggatcttaaatcatgaactac

SEQ ID NO: 593875 - DNA, 25 bp, Mus musculus
ccctggatcttatatcatgaactac

SEQ ID NO: 593876 - DNA, 25 bp, Mus musculus
ccctggatgacaatggagttctgat

SEQ ID NO: 593877 - DNA, 25 bp, Mus musculus
ccctggatgacattggagttctgat

SEQ ID NO: 593878 - DNA, 25 bp, Mus musculus
ccctggatgaccactgtgctgcgga

SEQ ID NO: 593879 - DNA, 25 bp, Mus musculus
ccctggatgacctctgtgctgcgga

SEQ ID NO: 593880 - DNA, 25 bp, Mus musculus
ccctggatgagccatgcagaagagt

SEQ ID NO: 593881 - DNA, 25 bp, Mus musculus
ccctggatgagcgatgcagaagagt

SEQ ID NO: 593882 - DNA, 25 bp, Mus musculus
ccctggatgcctacaaggacttgaa

SEQ ID NO: 593883 - DNA, 25 bp, Mus musculus
ccctggatgccttcaaggacttgaa

SEQ ID NO: 593884 - DNA, 25 bp, Mus musculus
ccctggatggcaccttcgccatggt

SEQ ID NO: 593885 - DNA, 25 bp, Mus musculus
ccctggatggcagcttcgccatggt

SEQ ID NO: 593886 - DNA, 25 bp, Mus musculus
ccctggatgtctccttgaacaggtt

SEQ ID NO: 593887 - DNA, 25 bp, Mus musculus
ccctggatgtctgcttgaacaggtt

SEQ ID NO: 593888 - DNA, 25 bp, Mus musculus
ccctggatgtgcatcaatgtacctc

SEQ ID NO: 593889 - DNA, 25 bp, Mus musculus
ccctggatgtgcttcaatgtacctc

SEQ ID NO: 593890 - DNA, 25 bp, Mus musculus
ccctggattccaccggaaagtgtta

SEQ ID NO: 593891 - DNA, 25 bp, Mus musculus
ccctggattccagcggaaagtgtta

SEQ ID NO: 593892 - DNA, 25 bp, Mus musculus
ccctggattgcgcaagttagaggca

SEQ ID NO: 593893 - DNA, 25 bp, Mus musculus
ccctggattgcggaagttagaggca

SEQ ID NO: 593894 - DNA, 25 bp, Mus musculus
ccctggatttctcggtgagacttgc

SEQ ID NO: 593895 - DNA, 25 bp, Mus musculus
ccctggatttctgggtgagacttgc

SEQ ID NO: 593896 - DNA, 25 bp, Mus musculus
ccctggcaaggtacagaacggaagt

SEQ ID NO: 593897 - DNA, 25 bp, Mus musculus
ccctggcaaggttcagaacggaagt

SEQ ID NO: 593898 - DNA, 25 bp, Mus musculus
ccctggcacttgaggcggtggccct

SEQ ID NO: 593899 - DNA, 25 bp, Mus musculus
ccctggcacttgtggcggtggccct

SEQ ID NO: 593900 - DNA, 25 bp, Mus musculus
ccctggccaccaactcaatgtttga

SEQ ID NO: 593901 - DNA, 25 bp, Mus musculus
ccctggccaccatctcaatgtttga

SEQ ID NO: 593902 - DNA, 25 bp, Mus musculus
ccctggccacggctaccttggtgag

SEQ ID NO: 593903 - DNA, 25 bp, Mus musculus
ccctggccacgggtaccttggtgag

SEQ ID NO: 593904 - DNA, 25 bp, Mus musculus
ccctggccaggaaggacctcgtgga

SEQ ID NO: 593905 - DNA, 25 bp, Mus musculus
ccctggccaggatggacctcgtgga

SEQ ID NO: 593906 - DNA, 25 bp, Mus musculus
ccctggcctgacaggaagcagaaaa

SEQ ID NO: 593907 - DNA, 25 bp, Mus musculus
ccctggcctgactggaagcagaaaa

SEQ ID NO: 593908 - DNA, 25 bp, Mus musculus
ccctggccttgaatgagtgtgggct

SEQ ID NO: 593909 - DNA, 25 bp, Mus musculus
ccctggccttgattgagtgtgggct

SEQ ID NO: 593910 - DNA, 25 bp, Mus musculus
ccctggcgagttagaagctgcccct

SEQ ID NO: 593911 - DNA, 25 bp, Mus musculus
ccctggcgagtttgaagctgcccct

SEQ ID NO: 593912 - DNA, 25 bp, Mus musculus
ccctggcggagcatgactggtacca

SEQ ID NO: 593913 - DNA, 25 bp, Mus musculus
ccctggcggagcttgactggtacca

SEQ ID NO: 593914 - DNA, 25 bp, Mus musculus
ccctggctacaaccacaaatatgag

SEQ ID NO: 593915 - DNA, 25 bp, Mus musculus
ccctggctacaagcacaaatatgag

SEQ ID NO: 593916 - DNA, 25 bp, Mus musculus
ccctggctacgccatcatggcagat

SEQ ID NO: 593917 - DNA, 25 bp, Mus musculus
ccctggctacgcgatcatggcagat

SEQ ID NO: 593918 - DNA, 25 bp, Mus musculus
ccctggctagagatgcagattaatt

SEQ ID NO: 593919 - DNA, 25 bp, Mus musculus
ccctggctagagttgcagattaatt

SEQ ID NO: 593920 - DNA, 25 bp, Mus musculus
ccctggctatccagcgggcgacagg

SEQ ID NO: 593921 - DNA, 25 bp, Mus musculus
ccctggctatcctgcgggcgacagg

SEQ ID NO: 593922 - DNA, 25 bp, Mus musculus
ccctggctcctccagtgatagcaat

SEQ ID NO: 593923 - DNA, 25 bp, Mus musculus
ccctggctcctcgagtgatagcaat

SEQ ID NO: 593924 - DNA, 25 bp, Mus musculus
ccctggctgccaagaatgggcggaa

SEQ ID NO: 593925 - DNA, 25 bp, Mus musculus
ccctggctgccatgaatgggcggaa

SEQ ID NO: 593926 - DNA, 25 bp, Mus musculus
ccctggctgctaactgctgcaaact

SEQ ID NO: 593927 - DNA, 25 bp, Mus musculus
ccctggctgctatctgctgcaaact

SEQ ID NO: 593928 - DNA, 25 bp, Mus musculus
ccctggctgtgacggttctggacac

SEQ ID NO: 593929 - DNA, 25 bp, Mus musculus
ccctggctgtgagggttctggacac

SEQ ID NO: 593930 - DNA, 25 bp, Mus musculus
ccctggcttgcccagaggtagaatg

SEQ ID NO: 593931 - DNA, 25 bp, Mus musculus
ccctggcttgccgagaggtagaatg

SEQ ID NO: 593932 - DNA, 25 bp, Mus musculus
ccctggctttcactgcgaagcctgt

SEQ ID NO: 593933 - DNA, 25 bp, Mus musculus
ccctggctttcagtgcgaagcctgt

SEQ ID NO: 593934 - DNA, 25 bp, Mus musculus
ccctggctttggcaagaccgaatct

SEQ ID NO: 593935 - DNA, 25 bp, Mus musculus
ccctggctttgggaagaccgaatct

SEQ ID NO: 593936 - DNA, 25 bp, Mus musculus
ccctggctttgtcgaacggctttgc

SEQ ID NO: 593937 - DNA, 25 bp, Mus musculus
ccctggctttgtggaacggctttgc

SEQ ID NO: 593938 - DNA, 25 bp, Mus musculus
ccctgggaacaacccggagctgtat

SEQ ID NO: 593939 - DNA, 25 bp, Mus musculus
ccctgggaacaagccggagctgtat

SEQ ID NO: 593940 - DNA, 25 bp, Mus musculus
ccctgggaagagcttccaacagtct

SEQ ID NO: 593941 - DNA, 25 bp, Mus musculus
ccctgggaagaggttccaacagtct

SEQ ID NO: 593942 - DNA, 25 bp, Mus musculus
ccctgggacccgatgtatgtgttct

SEQ ID NO: 593943 - DNA, 25 bp, Mus musculus
ccctgggacccgttgtatgtgttct

SEQ ID NO: 593944 - DNA, 25 bp, Mus musculus
ccctgggacctgagtggcgcctgaa

SEQ ID NO: 593945 - DNA, 25 bp, Mus musculus
ccctgggacctgtgtggcgcctgaa

SEQ ID NO: 593946 - DNA, 25 bp, Mus musculus
ccctgggacttccaggtcctggtca

SEQ ID NO: 593947 - DNA, 25 bp, Mus musculus
ccctgggacttcgaggtcctggtca

SEQ ID NO: 593948 - DNA, 25 bp, Mus musculus
ccctgggatggcagagcaacctatt

SEQ ID NO: 593949 - DNA, 25 bp, Mus musculus
ccctgggatggctgagcaacctatt

SEQ ID NO: 593950 - DNA, 25 bp, Mus musculus
ccctgggcatttcctgcccgagagt

SEQ ID NO: 593951 - DNA, 25 bp, Mus musculus
ccctgggcatttgctgcccgagagt

SEQ ID NO: 593952 - DNA, 25 bp, Mus musculus
ccctgggccaagacagttggaggct

SEQ ID NO: 593953 - DNA, 25 bp, Mus musculus
ccctgggccaagtcagttggaggct

SEQ ID NO: 593954 - DNA, 25 bp, Mus musculus
ccctgggccccgcattactgtggtg

SEQ ID NO: 593955 - DNA, 25 bp, Mus musculus
ccctgggccccggattactgtggtg

SEQ ID NO: 593956 - DNA, 25 bp, Mus musculus
ccctgggccctaatgacttaaagca

SEQ ID NO: 593957 - DNA, 25 bp, Mus musculus
ccctgggccctattgacttaaagca

SEQ ID NO: 593958 - DNA, 25 bp, Mus musculus
ccctgggcctttcggagatgtcctg

SEQ ID NO: 593959 - DNA, 25 bp, Mus musculus
ccctgggcctttgggagatgtcctg

SEQ ID NO: 593960 - DNA, 25 bp, Mus musculus
ccctgggtgttaaagcaatatgttc

SEQ ID NO: 593961 - DNA, 25 bp, Mus musculus
ccctgggtgttatagcaatatgttc

SEQ ID NO: 593962 - DNA, 25 bp, Mus musculus
ccctgggttctaaggctgctctgag

SEQ ID NO: 593963 - DNA, 25 bp, Mus musculus
ccctgggttctatggctgctctgag

SEQ ID NO: 593964 - DNA, 25 bp, Mus musculus
ccctggtacgtgagttcgcaccgta

SEQ ID NO: 593965 - DNA, 25 bp, Mus musculus
ccctggtacgtgtgttcgcaccgta

SEQ ID NO: 593966 - DNA, 25 bp, Mus musculus
ccctggtagatgagaccaaggtttc

SEQ ID NO: 593967 - DNA, 25 bp, Mus musculus
ccctggtagatgtgaccaaggtttc

SEQ ID NO: 593968 - DNA, 25 bp, Mus musculus
ccctggtcaacaagaagaatgcgct

SEQ ID NO: 593969 - DNA, 25 bp, Mus musculus
ccctggtcaacatgaagaatgcgct

SEQ ID NO: 593970 - DNA, 25 bp, Mus musculus
ccctggtcaccaagggacatctgct

SEQ ID NO: 593971 - DNA, 25 bp, Mus musculus
ccctggtcaccatgggacatctgct

SEQ ID NO: 593972 - DNA, 25 bp, Mus musculus
ccctggtcacttctgaggagatgag

SEQ ID NO: 593973 - DNA, 25 bp, Mus musculus
ccctggtcacttgtgaggagatgag

SEQ ID NO: 593974 - DNA, 25 bp, Mus musculus
ccctggtcagacaggacctcgagga

SEQ ID NO: 593975 - DNA, 25 bp, Mus musculus
ccctggtcagactggacctcgagga

SEQ ID NO: 593976 - DNA, 25 bp, Mus musculus
ccctggtcagggatgttaggaaata

SEQ ID NO: 593977 - DNA, 25 bp, Mus musculus
ccctggtcagggttgttaggaaata

SEQ ID NO: 593978 - DNA, 25 bp, Mus musculus
ccctggtctccaagcaggcatcaag

SEQ ID NO: 593979 - DNA, 25 bp, Mus musculus
ccctggtctccatgcaggcatcaag

SEQ ID NO: 593980 - DNA, 25 bp, Mus musculus
ccctggtctgagaggacctcctgct

SEQ ID NO: 593981 - DNA, 25 bp, Mus musculus
ccctggtctgagtggacctcctgct

SEQ ID NO: 593982 - DNA, 25 bp, Mus musculus
ccctggtgaaacagaacagtgtctt

SEQ ID NO: 593983 - DNA, 25 bp, Mus musculus
ccctggtgaaactgaacagtgtctt

SEQ ID NO: 593984 - DNA, 25 bp, Mus musculus
ccctggtgaaagatatcaataatcc

SEQ ID NO: 593985 - DNA, 25 bp, Mus musculus
ccctggtgaaagttatcaataatcc

SEQ ID NO: 593986 - DNA, 25 bp, Mus musculus
ccctggtgaatgcaccatataagcg

SEQ ID NO: 593987 - DNA, 25 bp, Mus musculus
ccctggtgaatggaccatataagcg

SEQ ID NO: 593988 - DNA, 25 bp, Mus musculus
ccctggtgaccaataatcgttctgc

SEQ ID NO: 593989 - DNA, 25 bp, Mus musculus
ccctggtgaccattaatcgttctgc

SEQ ID NO: 593990 - DNA, 25 bp, Mus musculus
ccctggtgaggcagtttggacagca

SEQ ID NO: 593991 - DNA, 25 bp, Mus musculus
ccctggtgaggctgtttggacagca

SEQ ID NO: 593992 - DNA, 25 bp, Mus musculus
ccctggtgaggtatgctatagatcc

SEQ ID NO: 593993 - DNA, 25 bp, Mus musculus
ccctggtgaggtttgctatagatcc

SEQ ID NO: 593994 - DNA, 25 bp, Mus musculus
ccctggtgcaaaaggtgttgccggt

SEQ ID NO: 593995 - DNA, 25 bp, Mus musculus
ccctggtgcaaatggtgttgccggt

SEQ ID NO: 593996 - DNA, 25 bp, Mus musculus
ccctggtgcacaatttcttccctga

SEQ ID NO: 593997 - DNA, 25 bp, Mus musculus
ccctggtgcacattttcttccctga

SEQ ID NO: 593998 - DNA, 25 bp, Mus musculus
ccctggtgcattcgatgggacctca

SEQ ID NO: 593999 - DNA, 25 bp, Mus musculus
ccctggtgcattggatgggacctca

SEQ ID NO: 594000 - DNA, 25 bp, Mus musculus
ccctggtgccctacgggaatgcaca

SEQ ID NO: 594001 - DNA, 25 bp, Mus musculus
ccctggtgcccttcgggaatgcaca

SEQ ID NO: 594002 - DNA, 25 bp, Mus musculus
ccctggtggaagaaatcaggaaaag

SEQ ID NO: 594003 - DNA, 25 bp, Mus musculus
ccctggtggaagtaatcaggaaaag

SEQ ID NO: 594004 - DNA, 25 bp, Mus musculus
ccctggtggaggacttaaccaagag

SEQ ID NO: 594005 - DNA, 25 bp, Mus musculus
ccctggtggaggtcttaaccaagag

SEQ ID NO: 594006 - DNA, 25 bp, Mus musculus
ccctggtggcatcggtttctctggc

SEQ ID NO: 594007 - DNA, 25 bp, Mus musculus
ccctggtggcatgggtttctctggc

SEQ ID NO: 594008 - DNA, 25 bp, Mus musculus
ccctggtgggctcctatggtacctc

SEQ ID NO: 594009 - DNA, 25 bp, Mus musculus
ccctggtgggctgctatggtacctc

SEQ ID NO: 594010 - DNA, 25 bp, Mus musculus
ccctggtgtggccaaatctcagctc

SEQ ID NO: 594011 - DNA, 25 bp, Mus musculus
ccctggtgtggcgaaatctcagctc

SEQ ID NO: 594012 - DNA, 25 bp, Mus musculus
ccctggttaagcagtacagccccaa

SEQ ID NO: 594013 - DNA, 25 bp, Mus musculus
ccctggttaagctgtacagccccaa

SEQ ID NO: 594014 - DNA, 25 bp, Mus musculus
ccctggttgaggacttgttcaagga

SEQ ID NO: 594015 - DNA, 25 bp, Mus musculus
ccctggttgaggtcttgttcaagga

SEQ ID NO: 594016 - DNA, 25 bp, Mus musculus
ccctggttgcctacagcgggactga

SEQ ID NO: 594017 - DNA, 25 bp, Mus musculus
ccctggttgccttcagcgggactga

SEQ ID NO: 594018 - DNA, 25 bp, Mus musculus
ccctggttgctgctatgagacagct

SEQ ID NO: 594019 - DNA, 25 bp, Mus musculus
ccctggttgctggtatgagacagct

SEQ ID NO: 594020 - DNA, 25 bp, Mus musculus
ccctgtaattgtagcgaccatcagt

SEQ ID NO: 594021 - DNA, 25 bp, Mus musculus
ccctgtaattgttgcgaccatcagt

SEQ ID NO: 594022 - DNA, 25 bp, Mus musculus
ccctgtaccagtagtactgcagcca

SEQ ID NO: 594023 - DNA, 25 bp, Mus musculus
ccctgtaccagttgtactgcagcca

SEQ ID NO: 594024 - DNA, 25 bp, Mus musculus
ccctgtagaagtaagatagcctgtc

SEQ ID NO: 594025 - DNA, 25 bp, Mus musculus
ccctgtagaagttagatagcctgtc

SEQ ID NO: 594026 - DNA, 25 bp, Mus musculus
ccctgtagccctccaaactttatgg

SEQ ID NO: 594027 - DNA, 25 bp, Mus musculus
ccctgtagccctgcaaactttatgg

SEQ ID NO: 594028 - DNA, 25 bp, Mus musculus
ccctgtatatgaagaacgaattcct

SEQ ID NO: 594029 - DNA, 25 bp, Mus musculus
ccctgtatatgatgaacgaattcct

SEQ ID NO: 594030 - DNA, 25 bp, Mus musculus
ccctgtatctgcaatgtctatgact

SEQ ID NO: 594031 - DNA, 25 bp, Mus musculus
ccctgtatctgctatgtctatgact

SEQ ID NO: 594032 - DNA, 25 bp, Mus musculus
ccctgtattgtaacattctctgcga

SEQ ID NO: 594033 - DNA, 25 bp, Mus musculus
ccctgtattgtatcattctctgcga

SEQ ID NO: 594034 - DNA, 25 bp, Mus musculus
ccctgtcaatatagctgctcagatg

SEQ ID NO: 594035 - DNA, 25 bp, Mus musculus
ccctgtcaatattgctgctcagatg

SEQ ID NO: 594036 - DNA, 25 bp, Mus musculus
ccctgtcaccatcgccattgccaga

SEQ ID NO: 594037 - DNA, 25 bp, Mus musculus
ccctgtcaccatggccattgccaga

SEQ ID NO: 594038 - DNA, 25 bp, Mus musculus
ccctgtcagcctcaaggcattacgt

SEQ ID NO: 594039 - DNA, 25 bp, Mus musculus
ccctgtcagcctgaaggcattacgt

SEQ ID NO: 594040 - DNA, 25 bp, Mus musculus
ccctgtcatcgtagaagatgttaga

SEQ ID NO: 594041 - DNA, 25 bp, Mus musculus
ccctgtcatcgttgaagatgttaga

SEQ ID NO: 594042 - DNA, 25 bp, Mus musculus
ccctgtcatgtcagtgtgattaaca

SEQ ID NO: 594043 - DNA, 25 bp, Mus musculus
ccctgtcatgtctgtgtgattaaca

SEQ ID NO: 594044 - DNA, 25 bp, Mus musculus
ccctgtccaccaagattgacgggag

SEQ ID NO: 594045 - DNA, 25 bp, Mus musculus
ccctgtccaccatgattgacgggag

SEQ ID NO: 594046 - DNA, 25 bp, Mus musculus
ccctgtccgtggaatcccttattga

SEQ ID NO: 594047 - DNA, 25 bp, Mus musculus
ccctgtccgtggtatcccttattga

SEQ ID NO: 594048 - DNA, 25 bp, Mus musculus
ccctgtcctggtcgaagatacctgt

SEQ ID NO: 594049 - DNA, 25 bp, Mus musculus
ccctgtcctggtggaagatacctgt

SEQ ID NO: 594050 - DNA, 25 bp, Mus musculus
ccctgtcgaagcagaggtactgcct

SEQ ID NO: 594051 - DNA, 25 bp, Mus musculus
ccctgtcgaagctgaggtactgcct

SEQ ID NO: 594052 - DNA, 25 bp, Mus musculus
ccctgtcggaaaatgtgtgagaaaa

SEQ ID NO: 594053 - DNA, 25 bp, Mus musculus
ccctgtcggaaattgtgtgagaaaa

SEQ ID NO: 594054 - DNA, 25 bp, Mus musculus
ccctgtcggagaacatgctaagcca

SEQ ID NO: 594055 - DNA, 25 bp, Mus musculus
ccctgtcggagatcatgctaagcca

SEQ ID NO: 594056 - DNA, 25 bp, Mus musculus
ccctgtcgtcggaggctggtacaaa

SEQ ID NO: 594057 - DNA, 25 bp, Mus musculus
ccctgtcgtcggtggctggtacaaa

SEQ ID NO: 594058 - DNA, 25 bp, Mus musculus
ccctgtctcctcctatggatcatag

SEQ ID NO: 594059 - DNA, 25 bp, Mus musculus
ccctgtctcctcgtatggatcatag

SEQ ID NO: 594060 - DNA, 25 bp, Mus musculus
ccctgtctctgcacagagaagtaga

SEQ ID NO: 594061 - DNA, 25 bp, Mus musculus
ccctgtctctgctcagagaagtaga

SEQ ID NO: 594062 - DNA, 25 bp, Mus musculus
ccctgtctctggagggacgaggctt

SEQ ID NO: 594063 - DNA, 25 bp, Mus musculus
ccctgtctctggtgggacgaggctt

SEQ ID NO: 594064 - DNA, 25 bp, Mus musculus
ccctgtcttctgctgaagccatgca

SEQ ID NO: 594065 - DNA, 25 bp, Mus musculus
ccctgtcttctggtgaagccatgca

SEQ ID NO: 594066 - DNA, 25 bp, Mus musculus
ccctgtgaactgacgtttgtggctg

SEQ ID NO: 594067 - DNA, 25 bp, Mus musculus
ccctgtgaactgtcgtttgtggctg

SEQ ID NO: 594068 - DNA, 25 bp, Mus musculus
ccctgtgacgggattctgttcagta

SEQ ID NO: 594069 - DNA, 25 bp, Mus musculus
ccctgtgacgggtttctgttcagta

SEQ ID NO: 594070 - DNA, 25 bp, Mus musculus
ccctgtgactctacgcctgcgtggg

SEQ ID NO: 594071 - DNA, 25 bp, Mus musculus
ccctgtgactcttcgcctgcgtggg

SEQ ID NO: 594072 - DNA, 25 bp, Mus musculus
ccctgtgactggaagggtggaggag

SEQ ID NO: 594073 - DNA, 25 bp, Mus musculus
ccctgtgactggctacaaggttcag

SEQ ID NO: 594074 - DNA, 25 bp, Mus musculus
ccctgtgactgggtacaaggttcag

SEQ ID NO: 594075 - DNA, 25 bp, Mus musculus
ccctgtgactggtagggtggaggag

SEQ ID NO: 594076 - DNA, 25 bp, Mus musculus
ccctgtgagtgaacaagaacccaag

SEQ ID NO: 594077 - DNA, 25 bp, Mus musculus
ccctgtgagtgatcaagaacccaag

SEQ ID NO: 594078 - DNA, 25 bp, Mus musculus
ccctgtgagtggcaaggactttgat

SEQ ID NO: 594079 - DNA, 25 bp, Mus musculus
ccctgtgagtgggaaggactttgat

SEQ ID NO: 594080 - DNA, 25 bp, Mus musculus
ccctgtgccctcaacagatgcgagg

SEQ ID NO: 594081 - DNA, 25 bp, Mus musculus
ccctgtgccctctacagatgcgagg

SEQ ID NO: 594082 - DNA, 25 bp, Mus musculus
ccctgtgccgagctgttgaactcta

SEQ ID NO: 594083 - DNA, 25 bp, Mus musculus
ccctgtgccgaggtgttgaactcta

SEQ ID NO: 594084 - DNA, 25 bp, Mus musculus
ccctgtgcgtttattggaataggaa

SEQ ID NO: 594085 - DNA, 25 bp, Mus musculus
ccctgtgcgttttttggaataggaa

SEQ ID NO: 594086 - DNA, 25 bp, Mus musculus
ccctgtgctgagcattgttgaccct

SEQ ID NO: 594087 - DNA, 25 bp, Mus musculus
ccctgtgctgaggattgttgaccct

SEQ ID NO: 594088 - DNA, 25 bp, Mus musculus
ccctgtgctgctcctagagaggctg

SEQ ID NO: 594089 - DNA, 25 bp, Mus musculus
ccctgtgctgctgctagagaggctg

SEQ ID NO: 594090 - DNA, 25 bp, Mus musculus
ccctgtggaacacaaaaagcgcaag

SEQ ID NO: 594091 - DNA, 25 bp, Mus musculus
ccctgtggaacagaaaaagcgcaag

SEQ ID NO: 594092 - DNA, 25 bp, Mus musculus
ccctgtggagctcgtctgagaaaaa

SEQ ID NO: 594093 - DNA, 25 bp, Mus musculus
ccctgtggagctggtctgagaaaaa

SEQ ID NO: 594094 - DNA, 25 bp, Mus musculus
ccctgtggctcaagaggatgtcaga

SEQ ID NO: 594095 - DNA, 25 bp, Mus musculus
ccctgtggctcatgaggatgtcaga

SEQ ID NO: 594096 - DNA, 25 bp, Mus musculus
ccctgtgggcaacggtttggcaata

SEQ ID NO: 594097 - DNA, 25 bp, Mus musculus
ccctgtgggcaagggtttggcaata

SEQ ID NO: 594098 - DNA, 25 bp, Mus musculus
ccctgtgggtcactggcgagtctct

SEQ ID NO: 594099 - DNA, 25 bp, Mus musculus
ccctgtgggtcagtggcgagtctct

SEQ ID NO: 594100 - DNA, 25 bp, Mus musculus
ccctgtggtgggcatgtcccgctca

SEQ ID NO: 594101 - DNA, 25 bp, Mus musculus
ccctgtggtggggatgtcccgctca

SEQ ID NO: 594102 - DNA, 25 bp, Mus musculus
ccctgtgtaccgcatggtggattag

SEQ ID NO: 594103 - DNA, 25 bp, Mus musculus
ccctgtgtaccggatggtggattag

SEQ ID NO: 594104 - DNA, 25 bp, Mus musculus
ccctgtgtcatcaagtacggaaaca

SEQ ID NO: 594105 - DNA, 25 bp, Mus musculus
ccctgtgtcatctagtacggaaaca

SEQ ID NO: 594106 - DNA, 25 bp, Mus musculus
ccctgtgtcattcggatttgtactt

SEQ ID NO: 594107 - DNA, 25 bp, Mus musculus
ccctgtgtcattgggatttgtactt

SEQ ID NO: 594108 - DNA, 25 bp, Mus musculus
ccctgtgtgttgcttgcggcaatca

SEQ ID NO: 594109 - DNA, 25 bp, Mus musculus
ccctgtgtgttggttgcggcaatca

SEQ ID NO: 594110 - DNA, 25 bp, Mus musculus
ccctgtgttccgaggccaggcctgg

SEQ ID NO: 594111 - DNA, 25 bp, Mus musculus
ccctgtgttccgtggccaggcctgg

SEQ ID NO: 594112 - DNA, 25 bp, Mus musculus
ccctgtgttgctctagagaggaaga

SEQ ID NO: 594113 - DNA, 25 bp, Mus musculus
ccctgtgttgctgtagagaggaaga

SEQ ID NO: 594114 - DNA, 25 bp, Mus musculus
ccctgttacgaaacagaaagccagc

SEQ ID NO: 594115 - DNA, 25 bp, Mus musculus
ccctgttacgaatcagaaagccagc

SEQ ID NO: 594116 - DNA, 25 bp, Mus musculus
ccctgttacgtgaggccatccgtga

SEQ ID NO: 594117 - DNA, 25 bp, Mus musculus
ccctgttacgtgtggccatccgtga

SEQ ID NO: 594118 - DNA, 25 bp, Mus musculus
ccctgttactagattgtggagagca

SEQ ID NO: 594119 - DNA, 25 bp, Mus musculus
ccctgttactagtttgtggagagca

SEQ ID NO: 594120 - DNA, 25 bp, Mus musculus
ccctgttcagacagcatgagaagac

SEQ ID NO: 594121 - DNA, 25 bp, Mus musculus
ccctgttcagactgcatgagaagac

SEQ ID NO: 594122 - DNA, 25 bp, Mus musculus
ccctgttccctacgagcagatgcta

SEQ ID NO: 594123 - DNA, 25 bp, Mus musculus
ccctgttccctaggagcagatgcta

SEQ ID NO: 594124 - DNA, 25 bp, Mus musculus
ccctgttcgggcaacagagacagag

SEQ ID NO: 594125 - DNA, 25 bp, Mus musculus
ccctgttcgggctacagagacagag

SEQ ID NO: 594126 - DNA, 25 bp, Mus musculus
ccctgttctcctactcgggctggga

SEQ ID NO: 594127 - DNA, 25 bp, Mus musculus
ccctgttctccttctcgggctggga

SEQ ID NO: 594128 - DNA, 25 bp, Mus musculus
ccctgttgaagacctcttagattcc

SEQ ID NO: 594129 - DNA, 25 bp, Mus musculus
ccctgttgaagagctcttagattcc

SEQ ID NO: 594130 - DNA, 25 bp, Mus musculus
ccctgttgctgcaggttggcttcct

SEQ ID NO: 594131 - DNA, 25 bp, Mus musculus
ccctgttgctgctggttggcttcct

SEQ ID NO: 594132 - DNA, 25 bp, Mus musculus
ccctgttgtttaattgctgtgtgac

SEQ ID NO: 594133 - DNA, 25 bp, Mus musculus
ccctgttgtttatttgctgtgtgac

SEQ ID NO: 594134 - DNA, 25 bp, Mus musculus
ccctgtttcaccattatagcccctg

SEQ ID NO: 594135 - DNA, 25 bp, Mus musculus
ccctgtttcacctttatagcccctg

SEQ ID NO: 594136 - DNA, 25 bp, Mus musculus
ccctgtttcagactctgtctgcctg

SEQ ID NO: 594137 - DNA, 25 bp, Mus musculus
ccctgtttcagagtctgtctgcctg

SEQ ID NO: 594138 - DNA, 25 bp, Mus musculus
ccctgtttccatcaatagactgagc

SEQ ID NO: 594139 - DNA, 25 bp, Mus musculus
ccctgtttccatgaatagactgagc

SEQ ID NO: 594140 - DNA, 25 bp, Mus musculus
ccctgtttgaacaagattacttctt

SEQ ID NO: 594141 - DNA, 25 bp, Mus musculus
ccctgtttgaactagattacttctt

SEQ ID NO: 594142 - DNA, 25 bp, Mus musculus
ccctgtttggcaacatgtcttcaga

SEQ ID NO: 594143 - DNA, 25 bp, Mus musculus
ccctgtttggcatcatgtcttcaga

SEQ ID NO: 594144 - DNA, 25 bp, Mus musculus
ccctgtttgtccatgcgaggactcc

SEQ ID NO: 594145 - DNA, 25 bp, Mus musculus
ccctgtttgtccttgcgaggactcc

SEQ ID NO: 594146 - DNA, 25 bp, Mus musculus
cccttaaaattgaggacttcggcag

SEQ ID NO: 594147 - DNA, 25 bp, Mus musculus
cccttaaaattgtggacttcggcag

SEQ ID NO: 594148 - DNA, 25 bp, Mus musculus
cccttacaggtgcagatttctgatg

SEQ ID NO: 594149 - DNA, 25 bp, Mus musculus
cccttacaggtggagatttctgatg

SEQ ID NO: 594150 - DNA, 25 bp, Mus musculus
cccttaccgggacaaaatctacatg

SEQ ID NO: 594151 - DNA, 25 bp, Mus musculus
cccttaccgggagaaaatctacatg

SEQ ID NO: 594152 - DNA, 25 bp, Mus musculus
cccttacgagatcgcattgatgacc

SEQ ID NO: 594153 - DNA, 25 bp, Mus musculus
cccttacgagatggcattgatgacc

SEQ ID NO: 594154 - DNA, 25 bp, Mus musculus
cccttacgtggacaagtatagacct

SEQ ID NO: 594155 - DNA, 25 bp, Mus musculus
cccttacgtggagaagtatagacct

SEQ ID NO: 594156 - DNA, 25 bp, Mus musculus
cccttactattgcaatgtggagaca

SEQ ID NO: 594157 - DNA, 25 bp, Mus musculus
cccttactattggaatgtggagaca

SEQ ID NO: 594158 - DNA, 25 bp, Mus musculus
cccttactcagtagagccggcagag

SEQ ID NO: 594159 - DNA, 25 bp, Mus musculus
cccttactcagttgagccggcagag

SEQ ID NO: 594160 - DNA, 25 bp, Mus musculus
cccttaggaatgacagcagtagcag

SEQ ID NO: 594161 - DNA, 25 bp, Mus musculus
cccttaggaatgtcagcagtagcag

SEQ ID NO: 594162 - DNA, 25 bp, Mus musculus
cccttagtgaggaccagagattcag

SEQ ID NO: 594163 - DNA, 25 bp, Mus musculus
cccttagtgaggtccagagattcag

SEQ ID NO: 594164 - DNA, 25 bp, Mus musculus
cccttatgccgaagacaagcggaag

SEQ ID NO: 594165 - DNA, 25 bp, Mus musculus
cccttatgccgatgacaagcggaag

SEQ ID NO: 594166 - DNA, 25 bp, Mus musculus
cccttattcagaagaaattgagtat

SEQ ID NO: 594167 - DNA, 25 bp, Mus musculus
cccttattcagatgaaattgagtat

SEQ ID NO: 594168 - DNA, 25 bp, Mus musculus
cccttcaatgaaaaccgaaagaggt

SEQ ID NO: 594169 - DNA, 25 bp, Mus musculus
cccttcaatgaataccgaaagaggt

SEQ ID NO: 594170 - DNA, 25 bp, Mus musculus
cccttcaccaccagtcagagtcagc

SEQ ID NO: 594171 - DNA, 25 bp, Mus musculus
cccttcaccacctgtcagagtcagc

SEQ ID NO: 594172 - DNA, 25 bp, Mus musculus
cccttcagcagacgccggagagaga

SEQ ID NO: 594173 - DNA, 25 bp, Mus musculus
cccttcagcagaggccggagagaga

SEQ ID NO: 594174 - DNA, 25 bp, Mus musculus
cccttcataggcagcactgtggtga

SEQ ID NO: 594175 - DNA, 25 bp, Mus musculus
cccttcataggctgcactgtggtga

SEQ ID NO: 594176 - DNA, 25 bp, Mus musculus
cccttcatctgcaggtgcgggatgt

SEQ ID NO: 594177 - DNA, 25 bp, Mus musculus
cccttcatctgctggtgcgggatgt

SEQ ID NO: 594178 - DNA, 25 bp, Mus musculus
cccttcatgtggacgaatctgggca

SEQ ID NO: 594179 - DNA, 25 bp, Mus musculus
cccttcatgtggtcgaatctgggca

SEQ ID NO: 594180 - DNA, 25 bp, Mus musculus
cccttccagctgagaggcccaaggt

SEQ ID NO: 594181 - DNA, 25 bp, Mus musculus
cccttccagctgtgaggcccaaggt

SEQ ID NO: 594182 - DNA, 25 bp, Mus musculus
cccttcctgaacagcttcgtggagg

SEQ ID NO: 594183 - DNA, 25 bp, Mus musculus
cccttcctgaactgcttcgtggagg

SEQ ID NO: 594184 - DNA, 25 bp, Mus musculus
cccttcctgcggatatagacagcac

SEQ ID NO: 594185 - DNA, 25 bp, Mus musculus
cccttcctgcggttatagacagcac

SEQ ID NO: 594186 - DNA, 25 bp, Mus musculus
cccttcctggacaggtaccacttgt

SEQ ID NO: 594187 - DNA, 25 bp, Mus musculus
cccttcctggactggtaccacttgt

SEQ ID NO: 594188 - DNA, 25 bp, Mus musculus
cccttcctggatagtggccatcatc

SEQ ID NO: 594189 - DNA, 25 bp, Mus musculus
cccttcctggattgtggccatcatc

SEQ ID NO: 594190 - DNA, 25 bp, Mus musculus
cccttcgactgacggctttgaggca

SEQ ID NO: 594191 - DNA, 25 bp, Mus musculus
cccttcgactgagggctttgaggca

SEQ ID NO: 594192 - DNA, 25 bp, Mus musculus
cccttcgagataatcggattcagct

SEQ ID NO: 594193 - DNA, 25 bp, Mus musculus
cccttcgagatattcggattcagct

SEQ ID NO: 594194 - DNA, 25 bp, Mus musculus
cccttcgaggagcacgagatctgga

SEQ ID NO: 594195 - DNA, 25 bp, Mus musculus
cccttcgaggaggacgagatctgga

SEQ ID NO: 594196 - DNA, 25 bp, Mus musculus
cccttcgagtgtcccaaatgtggga

SEQ ID NO: 594197 - DNA, 25 bp, Mus musculus
cccttcgagtgtgccaaatgtggga

SEQ ID NO: 594198 - DNA, 25 bp, Mus musculus
cccttcgatgacctgaaaatctccg

SEQ ID NO: 594199 - DNA, 25 bp, Mus musculus
cccttcgatgacgtgaaaatctccg

SEQ ID NO: 594200 - DNA, 25 bp, Mus musculus
cccttcgctgacctgattggttatg

SEQ ID NO: 594201 - DNA, 25 bp, Mus musculus
cccttcgctgacgtgattggttatg

SEQ ID NO: 594202 - DNA, 25 bp, Mus musculus
cccttcggacttagatgtgatcgta

SEQ ID NO: 594203 - DNA, 25 bp, Mus musculus
cccttcggactttgatgtgatcgta

SEQ ID NO: 594204 - DNA, 25 bp, Mus musculus
cccttcggagatcggtgctggaatc

SEQ ID NO: 594205 - DNA, 25 bp, Mus musculus
cccttcggagatgggtgctggaatc

SEQ ID NO: 594206 - DNA, 25 bp, Mus musculus
cccttcgggcatagcatggtcttcc

SEQ ID NO: 594207 - DNA, 25 bp, Mus musculus
cccttcgggcattgcatggtcttcc

SEQ ID NO: 594208 - DNA, 25 bp, Mus musculus
cccttctcaatgagctgagccctgt

SEQ ID NO: 594209 - DNA, 25 bp, Mus musculus
cccttctcaatgtgctgagccctgt

SEQ ID NO: 594210 - DNA, 25 bp, Mus musculus
cccttctcaggtcgacaatgccaag

SEQ ID NO: 594211 - DNA, 25 bp, Mus musculus
cccttctcaggtggacaatgccaag

SEQ ID NO: 594212 - DNA, 25 bp, Mus musculus
cccttctctaggcacttcggaggag

SEQ ID NO: 594213 - DNA, 25 bp, Mus musculus
cccttctctagggacttcggaggag

SEQ ID NO: 594214 - DNA, 25 bp, Mus musculus
cccttctctgggaagcagggctagg

SEQ ID NO: 594215 - DNA, 25 bp, Mus musculus
cccttctctgggtagcagggctagg

SEQ ID NO: 594216 - DNA, 25 bp, Mus musculus
cccttctctgttcccatgtggtgaa

SEQ ID NO: 594217 - DNA, 25 bp, Mus musculus
cccttctctgttgccatgtggtgaa

SEQ ID NO: 594218 - DNA, 25 bp, Mus musculus
cccttctgaaaactgggccatggag

SEQ ID NO: 594219 - DNA, 25 bp, Mus musculus
cccttctgaaaagtgggccatggag

SEQ ID NO: 594220 - DNA, 25 bp, Mus musculus
cccttctgccgtagtgagatcaaag

SEQ ID NO: 594221 - DNA, 25 bp, Mus musculus
cccttctgccgttgtgagatcaaag

SEQ ID NO: 594222 - DNA, 25 bp, Mus musculus
cccttctggacaaagtcttccacgt

SEQ ID NO: 594223 - DNA, 25 bp, Mus musculus
cccttctggacatagtcttccacgt

SEQ ID NO: 594224 - DNA, 25 bp, Mus musculus
cccttctggtcacctctgagtgaaa

SEQ ID NO: 594225 - DNA, 25 bp, Mus musculus
cccttctggtcagctctgagtgaaa

SEQ ID NO: 594226 - DNA, 25 bp, Mus musculus
cccttctggtgaaaggtgcacatgt

SEQ ID NO: 594227 - DNA, 25 bp, Mus musculus
cccttctggtgataggtgcacatgt

SEQ ID NO: 594228 - DNA, 25 bp, Mus musculus
cccttcttcttcagcacaggctggg

SEQ ID NO: 594229 - DNA, 25 bp, Mus musculus
cccttcttcttctgcacaggctggg

SEQ ID NO: 594230 - DNA, 25 bp, Mus musculus
cccttgaatagaagacagaatgcca

SEQ ID NO: 594231 - DNA, 25 bp, Mus musculus
cccttgaatagatgacagaatgcca

SEQ ID NO: 594232 - DNA, 25 bp, Mus musculus
cccttgagagaaatacataaaagag

SEQ ID NO: 594233 - DNA, 25 bp, Mus musculus
cccttgagagaattacataaaagag

SEQ ID NO: 594234 - DNA, 25 bp, Mus musculus
cccttgagcaaaatgaatgttctga

SEQ ID NO: 594235 - DNA, 25 bp, Mus musculus
cccttgagcaaattgaatgttctga

SEQ ID NO: 594236 - DNA, 25 bp, Mus musculus
cccttgagcactcggcatgggaaaa

SEQ ID NO: 594237 - DNA, 25 bp, Mus musculus
cccttgagcactgggcatgggaaaa

SEQ ID NO: 594238 - DNA, 25 bp, Mus musculus
cccttgagttttaataagtgacact

SEQ ID NO: 594239 - DNA, 25 bp, Mus musculus
cccttgagtttttataagtgacact

SEQ ID NO: 594240 - DNA, 25 bp, Mus musculus
cccttgataatgaaccagaaactga

SEQ ID NO: 594241 - DNA, 25 bp, Mus musculus
cccttgataatgtaccagaaactga

SEQ ID NO: 594242 - DNA, 25 bp, Mus musculus
cccttgatgacgcagtgtgtgtttg

SEQ ID NO: 594243 - DNA, 25 bp, Mus musculus
cccttgatgacggagtgtgtgtttg

SEQ ID NO: 594244 - DNA, 25 bp, Mus musculus
cccttgatgataaaaaagaatggct

SEQ ID NO: 594245 - DNA, 25 bp, Mus musculus
cccttgatgatataaaagaatggct

SEQ ID NO: 594246 - DNA, 25 bp, Mus musculus
cccttgatggcactttgagggaaag

SEQ ID NO: 594247 - DNA, 25 bp, Mus musculus
cccttgatggcagtttgagggaaag

SEQ ID NO: 594248 - DNA, 25 bp, Mus musculus
cccttgatgtatcaaagcctttgat

SEQ ID NO: 594249 - DNA, 25 bp, Mus musculus
cccttgatgtatgaaagcctttgat

SEQ ID NO: 594250 - DNA, 25 bp, Mus musculus
cccttgcactatccagctcagagta

SEQ ID NO: 594251 - DNA, 25 bp, Mus musculus
cccttgcactatgcagctcagagta

SEQ ID NO: 594252 - DNA, 25 bp, Mus musculus
cccttgcataagacttgctctctct

SEQ ID NO: 594253 - DNA, 25 bp, Mus musculus
cccttgcataagtcttgctctctct

SEQ ID NO: 594254 - DNA, 25 bp, Mus musculus
cccttgcatgtgcatctagctacct

SEQ ID NO: 594255 - DNA, 25 bp, Mus musculus
cccttgcatgtggatctagctacct

SEQ ID NO: 594256 - DNA, 25 bp, Mus musculus
cccttgcggctcacacaaagcagga

SEQ ID NO: 594257 - DNA, 25 bp, Mus musculus
cccttgcggctctcacaaagcagga

SEQ ID NO: 594258 - DNA, 25 bp, Mus musculus
cccttgctataacaccatggacgag

SEQ ID NO: 594259 - DNA, 25 bp, Mus musculus
cccttgctataagaccatggacgag

SEQ ID NO: 594260 - DNA, 25 bp, Mus musculus
cccttgctcctcatcacagaatatt

SEQ ID NO: 594261 - DNA, 25 bp, Mus musculus
cccttgctcctcttcacagaatatt

SEQ ID NO: 594262 - DNA, 25 bp, Mus musculus
cccttgctgactagtggacacggaa

SEQ ID NO: 594263 - DNA, 25 bp, Mus musculus
cccttgctgacttgtggacacggaa

SEQ ID NO: 594264 - DNA, 25 bp, Mus musculus
cccttgctgctcagacctctaataa

SEQ ID NO: 594265 - DNA, 25 bp, Mus musculus
cccttgctgctctgacctctaataa

SEQ ID NO: 594266 - DNA, 25 bp, Mus musculus
cccttgcttggaactggagacctta

SEQ ID NO: 594267 - DNA, 25 bp, Mus musculus
cccttgcttggatctggagacctta

SEQ ID NO: 594268 - DNA, 25 bp, Mus musculus
cccttggactctcacagcggtagct

SEQ ID NO: 594269 - DNA, 25 bp, Mus musculus
cccttggactctgacagcggtagct

SEQ ID NO: 594270 - DNA, 25 bp, Mus musculus
cccttggagactatgcacctcaatg

SEQ ID NO: 594271 - DNA, 25 bp, Mus musculus
cccttggagactttgcacctcaatg

SEQ ID NO: 594272 - DNA, 25 bp, Mus musculus
cccttggagccaattacgctggaaa

SEQ ID NO: 594273 - DNA, 25 bp, Mus musculus
cccttggagccatttacgctggaaa

SEQ ID NO: 594274 - DNA, 25 bp, Mus musculus
cccttggagtgacatcaggaacatc

SEQ ID NO: 594275 - DNA, 25 bp, Mus musculus
cccttggagtgagatcaggaacatc

SEQ ID NO: 594276 - DNA, 25 bp, Mus musculus
cccttggattcaagagtttcctttg

SEQ ID NO: 594277 - DNA, 25 bp, Mus musculus
cccttggattcatgagtttcctttg

SEQ ID NO: 594278 - DNA, 25 bp, Mus musculus
cccttggcataacggctaggagtca

SEQ ID NO: 594279 - DNA, 25 bp, Mus musculus
cccttggcataagggctaggagtca

SEQ ID NO: 594280 - DNA, 25 bp, Mus musculus
cccttggcggagagaacaagagcct

SEQ ID NO: 594281 - DNA, 25 bp, Mus musculus
cccttggcggagtgaacaagagcct

SEQ ID NO: 594282 - DNA, 25 bp, Mus musculus
cccttgggatatcagtgctgaagcc

SEQ ID NO: 594283 - DNA, 25 bp, Mus musculus
cccttgggatatgagtgctgaagcc

SEQ ID NO: 594284 - DNA, 25 bp, Mus musculus
cccttgggcaggatgaagaaccact

SEQ ID NO: 594285 - DNA, 25 bp, Mus musculus
cccttgggcaggttgaagaaccact

SEQ ID NO: 594286 - DNA, 25 bp, Mus musculus
cccttgggcttaagaggcactcccg

SEQ ID NO: 594287 - DNA, 25 bp, Mus musculus
cccttgggcttatgaggcactcccg

SEQ ID NO: 594288 - DNA, 25 bp, Mus musculus
cccttgggtcaacgcaagcttcgcg

SEQ ID NO: 594289 - DNA, 25 bp, Mus musculus
cccttgggtcaaggcaagcttcgcg

SEQ ID NO: 594290 - DNA, 25 bp, Mus musculus
cccttggtgattagctgtgtcagct

SEQ ID NO: 594291 - DNA, 25 bp, Mus musculus
cccttggtgatttgctgtgtcagct

SEQ ID NO: 594292 - DNA, 25 bp, Mus musculus
cccttgtagacccattcctgtgaaa

SEQ ID NO: 594293 - DNA, 25 bp, Mus musculus
cccttgtagaccgattcctgtgaaa

SEQ ID NO: 594294 - DNA, 25 bp, Mus musculus
cccttgtagactcttcttggaatga

SEQ ID NO: 594295 - DNA, 25 bp, Mus musculus
cccttgtagactgttcttggaatga

SEQ ID NO: 594296 - DNA, 25 bp, Mus musculus
cccttgtattcacttacccaatggg

SEQ ID NO: 594297 - DNA, 25 bp, Mus musculus
cccttgtattcagttacccaatggg

SEQ ID NO: 594298 - DNA, 25 bp, Mus musculus
cccttgtctatgaagccctcagctg

SEQ ID NO: 594299 - DNA, 25 bp, Mus musculus
cccttgtctatgtagccctcagctg

SEQ ID NO: 594300 - DNA, 25 bp, Mus musculus
cccttgtgaagaataaaagaatgag

SEQ ID NO: 594301 - DNA, 25 bp, Mus musculus
cccttgtgaagattaaaagaatgag

SEQ ID NO: 594302 - DNA, 25 bp, Mus musculus
cccttgtgaattatgaccccatgga

SEQ ID NO: 594303 - DNA, 25 bp, Mus musculus
cccttgtgaattttgaccccatgga

SEQ ID NO: 594304 - DNA, 25 bp, Mus musculus
cccttgtgagtcaggattatgtcaa

SEQ ID NO: 594305 - DNA, 25 bp, Mus musculus
cccttgtgagtctggattatgtcaa

SEQ ID NO: 594306 - DNA, 25 bp, Mus musculus
cccttgtgctagagggtaacaaaat

SEQ ID NO: 594307 - DNA, 25 bp, Mus musculus
cccttgtgctagtgggtaacaaaat

SEQ ID NO: 594308 - DNA, 25 bp, Mus musculus
cccttgttcaacagagagcttttgc

SEQ ID NO: 594309 - DNA, 25 bp, Mus musculus
cccttgttcaactgagagcttttgc

SEQ ID NO: 594310 - DNA, 25 bp, Mus musculus
cccttgttgcaaaagcgtggacagt

SEQ ID NO: 594311 - DNA, 25 bp, Mus musculus
cccttgttgcaatagcgtggacagt

SEQ ID NO: 594312 - DNA, 25 bp, Mus musculus
cccttgttggccaggttctcctgct

SEQ ID NO: 594313 - DNA, 25 bp, Mus musculus
cccttgttggcctggttctcctgct

SEQ ID NO: 594314 - DNA, 25 bp, Mus musculus
ccctttaaaggccatgtggaacata

SEQ ID NO: 594315 - DNA, 25 bp, Mus musculus
ccctttaaaggcgatgtggaacata

SEQ ID NO: 594316 - DNA, 25 bp, Mus musculus
ccctttacagaactaatgtttacat

SEQ ID NO: 594317 - DNA, 25 bp, Mus musculus
ccctttacagaagtaatgtttacat

SEQ ID NO: 594318 - DNA, 25 bp, Mus musculus
ccctttaccaagatgagacactaag

SEQ ID NO: 594319 - DNA, 25 bp, Mus musculus
ccctttaccaagttgagacactaag

SEQ ID NO: 594320 - DNA, 25 bp, Mus musculus
ccctttactggaccaatccaaggag

SEQ ID NO: 594321 - DNA, 25 bp, Mus musculus
ccctttactggagcaatccaaggag

SEQ ID NO: 594322 - DNA, 25 bp, Mus musculus
ccctttccaggtcttctattactca

SEQ ID NO: 594323 - DNA, 25 bp, Mus musculus
ccctttccaggtgttctattactca

SEQ ID NO: 594324 - DNA, 25 bp, Mus musculus
ccctttcctgttcggcgcgtgcggt

SEQ ID NO: 594325 - DNA, 25 bp, Mus musculus
ccctttcctgttgggcgcgtgcggt

SEQ ID NO: 594326 - DNA, 25 bp, Mus musculus
ccctttcgctgaagcaagagcctag

SEQ ID NO: 594327 - DNA, 25 bp, Mus musculus
ccctttcgctgatgcaagagcctag

SEQ ID NO: 594328 - DNA, 25 bp, Mus musculus
ccctttcgtcatcaccttgaagatc

SEQ ID NO: 594329 - DNA, 25 bp, Mus musculus
ccctttcgtcatgaccttgaagatc

SEQ ID NO: 594330 - DNA, 25 bp, Mus musculus
ccctttctacagaggaggtggacca

SEQ ID NO: 594331 - DNA, 25 bp, Mus musculus
ccctttctacagtggaggtggacca

SEQ ID NO: 594332 - DNA, 25 bp, Mus musculus
ccctttctgtggagacggagtcgca

SEQ ID NO: 594333 - DNA, 25 bp, Mus musculus
ccctttctgtggtgacggagtcgca

SEQ ID NO: 594334 - DNA, 25 bp, Mus musculus
ccctttcttgcacggagactctgat

SEQ ID NO: 594335 - DNA, 25 bp, Mus musculus
ccctttcttgcagggagactctgat

SEQ ID NO: 594336 - DNA, 25 bp, Mus musculus
ccctttgcacgtccgcactgggtgt

SEQ ID NO: 594337 - DNA, 25 bp, Mus musculus
ccctttgcacgtgcgcactgggtgt

SEQ ID NO: 594338 - DNA, 25 bp, Mus musculus
ccctttgcatcacccagtgtggtgc

SEQ ID NO: 594339 - DNA, 25 bp, Mus musculus
ccctttgcatcagccagtgtggtgc

SEQ ID NO: 594340 - DNA, 25 bp, Mus musculus
ccctttgcatctctggcatctggca

SEQ ID NO: 594341 - DNA, 25 bp, Mus musculus
ccctttgcatctgtggcatctggca

SEQ ID NO: 594342 - DNA, 25 bp, Mus musculus
ccctttgccggccttagtgaccaga

SEQ ID NO: 594343 - DNA, 25 bp, Mus musculus
ccctttgccggcgttagtgaccaga

SEQ ID NO: 594344 - DNA, 25 bp, Mus musculus
ccctttgctgagaggtctgctgtac

SEQ ID NO: 594345 - DNA, 25 bp, Mus musculus
ccctttgctgagtggtctgctgtac

SEQ ID NO: 594346 - DNA, 25 bp, Mus musculus
ccctttgctgggaacatgatgactt

SEQ ID NO: 594347 - DNA, 25 bp, Mus musculus
ccctttgctgggtacatgatgactt

SEQ ID NO: 594348 - DNA, 25 bp, Mus musculus
ccctttgctgtaaacaatgtcaaga

SEQ ID NO: 594349 - DNA, 25 bp, Mus musculus
ccctttgctgtatacaatgtcaaga

SEQ ID NO: 594350 - DNA, 25 bp, Mus musculus
ccctttgctttgcaaatttgctgac

SEQ ID NO: 594351 - DNA, 25 bp, Mus musculus
ccctttgctttggaaatttgctgac

SEQ ID NO: 594352 - DNA, 25 bp, Mus musculus
ccctttggcggccttggagtataat

SEQ ID NO: 594353 - DNA, 25 bp, Mus musculus
ccctttggcggcgttggagtataat

SEQ ID NO: 594354 - DNA, 25 bp, Mus musculus
ccctttgggagcaggcctgtgtatc

SEQ ID NO: 594355 - DNA, 25 bp, Mus musculus
ccctttgggagctggcctgtgtatc

SEQ ID NO: 594356 - DNA, 25 bp, Mus musculus
ccctttgggcctcatgacagatttt

SEQ ID NO: 594357 - DNA, 25 bp, Mus musculus
ccctttgggcctgatgacagatttt

SEQ ID NO: 594358 - DNA, 25 bp, Mus musculus
ccctttggtcacacatggactagcg

SEQ ID NO: 594359 - DNA, 25 bp, Mus musculus
ccctttggtcactcatggactagcg

SEQ ID NO: 594360 - DNA, 25 bp, Mus musculus
ccctttgtaaccagaatgctgatct

SEQ ID NO: 594361 - DNA, 25 bp, Mus musculus
ccctttgtaacctgaatgctgatct

SEQ ID NO: 594362 - DNA, 25 bp, Mus musculus
ccctttgtagagatctgcatgaaac

SEQ ID NO: 594363 - DNA, 25 bp, Mus musculus
ccctttgtagagttctgcatgaaac

SEQ ID NO: 594364 - DNA, 25 bp, Mus musculus
ccctttgtctatcgtggctgcggag

SEQ ID NO: 594365 - DNA, 25 bp, Mus musculus
ccctttgtctatggtggctgcggag

SEQ ID NO: 594366 - DNA, 25 bp, Mus musculus
ccctttgtgactacttccaactgca

SEQ ID NO: 594367 - DNA, 25 bp, Mus musculus
ccctttgtgacttcttccaactgca

SEQ ID NO: 594368 - DNA, 25 bp, Mus musculus
cccttttcagacaatggatcggatg

SEQ ID NO: 594369 - DNA, 25 bp, Mus musculus
cccttttcagactatggatcggatg

SEQ ID NO: 594370 - DNA, 25 bp, Mus musculus
cccttttcccgcatgcaggatgtga

SEQ ID NO: 594371 - DNA, 25 bp, Mus musculus
cccttttcccgcttgcaggatgtga

SEQ ID NO: 594372 - DNA, 25 bp, Mus musculus
cccttttgacctcgatgtcttcaca

SEQ ID NO: 594373 - DNA, 25 bp, Mus musculus
cccttttgacctggatgtcttcaca

SEQ ID NO: 594374 - DNA, 25 bp, Mus musculus
cccttttgctttagcacggtgagag

SEQ ID NO: 594375 - DNA, 25 bp, Mus musculus
cccttttgcttttgcacggtgagag

SEQ ID NO: 594376 - DNA, 25 bp, Mus musculus
cccttttgtgttcttgtctactcta

SEQ ID NO: 594377 - DNA, 25 bp, Mus musculus
cccttttgtgttgttgtctactcta

SEQ ID NO: 594378 - DNA, 25 bp, Mus musculus
ccctttttcaagactatcaactggt

SEQ ID NO: 594379 - DNA, 25 bp, Mus musculus
ccctttttcaagtctatcaactggt

SEQ ID NO: 594380 - DNA, 25 bp, Mus musculus
ccctttttcactcggtacggagcat

SEQ ID NO: 594381 - DNA, 25 bp, Mus musculus
ccctttttcactgggtacggagcat

SEQ ID NO: 594382 - DNA, 25 bp, Mus musculus
ccctttttggatcaggatcgtctgg

SEQ ID NO: 594383 - DNA, 25 bp, Mus musculus
ccctttttggatgaggatcgtctgg

SEQ ID NO: 594384 - DNA, 25 bp, Mus musculus
ccctttttgtagcagtgttggtgat

SEQ ID NO: 594385 - DNA, 25 bp, Mus musculus
ccctttttgtaggagtgttggtgat

SEQ ID NO: 594386 - DNA, 25 bp, Mus musculus
ccgaaacaagcacggcatggacaag

SEQ ID NO: 594387 - DNA, 25 bp, Mus musculus
ccgaaacaagcagggcatggacaag

SEQ ID NO: 594388 - DNA, 25 bp, Mus musculus
ccgaaacaccgtcggcagctttgaa

SEQ ID NO: 594389 - DNA, 25 bp, Mus musculus
ccgaaacaccgtgggcagctttgaa

SEQ ID NO: 594390 - DNA, 25 bp, Mus musculus
ccgaaacactgacttacgctgggca

SEQ ID NO: 594391 - DNA, 25 bp, Mus musculus
ccgaaacactgagttacgctgggca

SEQ ID NO: 594392 - DNA, 25 bp, Mus musculus
ccgaaacgcggacccgcgaacagga

SEQ ID NO: 594393 - DNA, 25 bp, Mus musculus
ccgaaacgcggagccgcgaacagga

SEQ ID NO: 594394 - DNA, 25 bp, Mus musculus
ccgaaagacggaacaggatgggcaa

SEQ ID NO: 594395 - DNA, 25 bp, Mus musculus
ccgaaagacggatcaggatgggcaa

SEQ ID NO: 594396 - DNA, 25 bp, Mus musculus
ccgaaagagttaccagcctggctcc

SEQ ID NO: 594397 - DNA, 25 bp, Mus musculus
ccgaaagagttagcagcctggctcc

SEQ ID NO: 594398 - DNA, 25 bp, Mus musculus
ccgaaagctgagcagcaaccttggg

SEQ ID NO: 594399 - DNA, 25 bp, Mus musculus
ccgaaagctgaggagcaaccttggg

SEQ ID NO: 594400 - DNA, 25 bp, Mus musculus
ccgaaaggctcgagatatggacctg

SEQ ID NO: 594401 - DNA, 25 bp, Mus musculus
ccgaaaggctcgtgatatggacctg

SEQ ID NO: 594402 - DNA, 25 bp, Mus musculus
ccgaaagtccagaaatgagtggcaa

SEQ ID NO: 594403 - DNA, 25 bp, Mus musculus
ccgaaagtccagtaatgagtggcaa

SEQ ID NO: 594404 - DNA, 25 bp, Mus musculus
ccgaaagttccacattccccaggag

SEQ ID NO: 594405 - DNA, 25 bp, Mus musculus
ccgaaagttccagattccccaggag

SEQ ID NO: 594406 - DNA, 25 bp, Mus musculus
ccgaaatcagagcaaaggtcttagc

SEQ ID NO: 594407 - DNA, 25 bp, Mus musculus
ccgaaatcagaggaaaggtcttagc

SEQ ID NO: 594408 - DNA, 25 bp, Mus musculus
ccgaaatcgaatcgctgaaaacctt

SEQ ID NO: 594409 - DNA, 25 bp, Mus musculus
ccgaaatcgaatggctgaaaacctt

SEQ ID NO: 594410 - DNA, 25 bp, Mus musculus
ccgaaattgaataggctaaacaaat

SEQ ID NO: 594411 - DNA, 25 bp, Mus musculus
ccgaaattgaattggctaaacaaat

SEQ ID NO: 594412 - DNA, 25 bp, Mus musculus
ccgaacaagctcagaatgaaaatga

SEQ ID NO: 594413 - DNA, 25 bp, Mus musculus
ccgaacaagctctgaatgaaaatga

SEQ ID NO: 594414 - DNA, 25 bp, Mus musculus
ccgaacagccacaggaaacagagtg

SEQ ID NO: 594415 - DNA, 25 bp, Mus musculus
ccgaacagccactggaaacagagtg

SEQ ID NO: 594416 - DNA, 25 bp, Mus musculus
ccgaacatgcgtcagtcactatcta

SEQ ID NO: 594417 - DNA, 25 bp, Mus musculus
ccgaacatgcgtgagtcactatcta

SEQ ID NO: 594418 - DNA, 25 bp, Mus musculus
ccgaacccggctaggttaggagcag

SEQ ID NO: 594419 - DNA, 25 bp, Mus musculus
ccgaacccggcttggttaggagcag

SEQ ID NO: 594420 - DNA, 25 bp, Mus musculus
ccgaaccgatcgctggcgattgcct

SEQ ID NO: 594421 - DNA, 25 bp, Mus musculus
ccgaaccgatcggtggcgattgcct

SEQ ID NO: 594422 - DNA, 25 bp, Mus musculus
ccgaacctcgacaagatggctgacg

SEQ ID NO: 594423 - DNA, 25 bp, Mus musculus
ccgaacctcgactagatggctgacg

SEQ ID NO: 594424 - DNA, 25 bp, Mus musculus
ccgaactagtgtagcagcgccctga

SEQ ID NO: 594425 - DNA, 25 bp, Mus musculus
ccgaactagtgttgcagcgccctga

SEQ ID NO: 594426 - DNA, 25 bp, Mus musculus
ccgaactgggagaccacgacccata

SEQ ID NO: 594427 - DNA, 25 bp, Mus musculus
ccgaactgggagtccacgacccata

SEQ ID NO: 594428 - DNA, 25 bp, Mus musculus
ccgaagaatcgcatctgttcctcag

SEQ ID NO: 594429 - DNA, 25 bp, Mus musculus
ccgaagaatcgcttctgttcctcag

SEQ ID NO: 594430 - DNA, 25 bp, Mus musculus
ccgaagacccaactacagcatatat

SEQ ID NO: 594431 - DNA, 25 bp, Mus musculus
ccgaagacccaagtacagcatatat

SEQ ID NO: 594432 - DNA, 25 bp, Mus musculus
ccgaagacgagcacttgggcatcct

SEQ ID NO: 594433 - DNA, 25 bp, Mus musculus
ccgaagacgagctcttgggcatcct

SEQ ID NO: 594434 - DNA, 25 bp, Mus musculus
ccgaagactgtactatggaagttac

SEQ ID NO: 594435 - DNA, 25 bp, Mus musculus
ccgaagactgtagtatggaagttac

SEQ ID NO: 594436 - DNA, 25 bp, Mus musculus
ccgaagactttgactatgcggctta

SEQ ID NO: 594437 - DNA, 25 bp, Mus musculus
ccgaagactttgtctatgcggctta

SEQ ID NO: 594438 - DNA, 25 bp, Mus musculus
ccgaagagatcacgaaccccgagag

SEQ ID NO: 594439 - DNA, 25 bp, Mus musculus
ccgaagagatcaggaaccccgagag

SEQ ID NO: 594440 - DNA, 25 bp, Mus musculus
ccgaagaggattcgcttatggacac

SEQ ID NO: 594441 - DNA, 25 bp, Mus musculus
ccgaagaggattggcttatggacac

SEQ ID NO: 594442 - DNA, 25 bp, Mus musculus
ccgaagagtcgtccagtacggtgca

SEQ ID NO: 594443 - DNA, 25 bp, Mus musculus
ccgaagagtcgtgcagtacggtgca

SEQ ID NO: 594444 - DNA, 25 bp, Mus musculus
ccgaagcaaggcaggacatggcaag

SEQ ID NO: 594445 - DNA, 25 bp, Mus musculus
ccgaagcaaggctggacatggcaag

SEQ ID NO: 594446 - DNA, 25 bp, Mus musculus
ccgaagccatccatcttgcagcagg

SEQ ID NO: 594447 - DNA, 25 bp, Mus musculus
ccgaagccatccttcttgcagcagg

SEQ ID NO: 594448 - DNA, 25 bp, Mus musculus
ccgaagccgcagagtgacccggagc

SEQ ID NO: 594449 - DNA, 25 bp, Mus musculus
ccgaagccgcagtgtgacccggagc

SEQ ID NO: 594450 - DNA, 25 bp, Mus musculus
ccgaagccgggcctgaagcgggcga

SEQ ID NO: 594451 - DNA, 25 bp, Mus musculus
ccgaagccgggcgtgaagcgggcga

SEQ ID NO: 594452 - DNA, 25 bp, Mus musculus
ccgaagcggagcatcctacgccaga

SEQ ID NO: 594453 - DNA, 25 bp, Mus musculus
ccgaagcggagcttcctacgccaga

SEQ ID NO: 594454 - DNA, 25 bp, Mus musculus
ccgaagcggcccagtatggaaggtt

SEQ ID NO: 594455 - DNA, 25 bp, Mus musculus
ccgaagcggccctgtatggaaggtt

SEQ ID NO: 594456 - DNA, 25 bp, Mus musculus
ccgaagctgctgcagttcgggtcct

SEQ ID NO: 594457 - DNA, 25 bp, Mus musculus
ccgaagctgctggagttcgggtcct

SEQ ID NO: 594458 - DNA, 25 bp, Mus musculus
ccgaagctggatagagggactcacg

SEQ ID NO: 594459 - DNA, 25 bp, Mus musculus
ccgaagctggattgagggactcacg

SEQ ID NO: 594460 - DNA, 25 bp, Mus musculus
ccgaagctttgcagggtctgtcagc

SEQ ID NO: 594461 - DNA, 25 bp, Mus musculus
ccgaagctttgctgggtctgtcagc

SEQ ID NO: 594462 - DNA, 25 bp, Mus musculus
ccgaaggcatggctttcaccgagtt

SEQ ID NO: 594463 - DNA, 25 bp, Mus musculus
ccgaaggcatgggtttcaccgagtt

SEQ ID NO: 594464 - DNA, 25 bp, Mus musculus
ccgaaggccaacagattaagaaact

SEQ ID NO: 594465 - DNA, 25 bp, Mus musculus
ccgaaggccaactgattaagaaact

SEQ ID NO: 594466 - DNA, 25 bp, Mus musculus
ccgaaggctgcaaatgtgtatgact

SEQ ID NO: 594467 - DNA, 25 bp, Mus musculus
ccgaaggctgcatatgtgtatgact

SEQ ID NO: 594468 - DNA, 25 bp, Mus musculus
ccgaaggctggccaagctctacaag

SEQ ID NO: 594469 - DNA, 25 bp, Mus musculus
ccgaaggctggcgaagctctacaag

SEQ ID NO: 594470 - DNA, 25 bp, Mus musculus
ccgaaggtgaggacctgcacacttg

SEQ ID NO: 594471 - DNA, 25 bp, Mus musculus
ccgaaggtgaggtcctgcacacttg

SEQ ID NO: 594472 - DNA, 25 bp, Mus musculus
ccgaagtatagacggctgctgtata

SEQ ID NO: 594473 - DNA, 25 bp, Mus musculus
ccgaagtatagagggctgctgtata

SEQ ID NO: 594474 - DNA, 25 bp, Mus musculus
ccgaagtcatgcctcagagtgggac

SEQ ID NO: 594475 - DNA, 25 bp, Mus musculus
ccgaagtcatgcgtcagagtgggac

SEQ ID NO: 594476 - DNA, 25 bp, Mus musculus
ccgaagtggcctaggaatacaataa

SEQ ID NO: 594477 - DNA, 25 bp, Mus musculus
ccgaagtggccttggaatacaataa

SEQ ID NO: 594478 - DNA, 25 bp, Mus musculus
ccgaagtgggttagaaaagactgag

SEQ ID NO: 594479 - DNA, 25 bp, Mus musculus
ccgaagtgggtttgaaaagactgag

SEQ ID NO: 594480 - DNA, 25 bp, Mus musculus
ccgaagtgtccgcaaatccagccag

SEQ ID NO: 594481 - DNA, 25 bp, Mus musculus
ccgaagtgtccggaaatccagccag

SEQ ID NO: 594482 - DNA, 25 bp, Mus musculus
ccgaagtgttttaccagcatgggta

SEQ ID NO: 594483 - DNA, 25 bp, Mus musculus
ccgaagtgtttttccagcatgggta

SEQ ID NO: 594484 - DNA, 25 bp, Mus musculus
ccgaatcacttcctgtttggagcag

SEQ ID NO: 594485 - DNA, 25 bp, Mus musculus
ccgaatcacttcgtgtttggagcag

SEQ ID NO: 594486 - DNA, 25 bp, Mus musculus
ccgaatcagtgtcgcccaaaacaga

SEQ ID NO: 594487 - DNA, 25 bp, Mus musculus
ccgaatcagtgtggcccaaaacaga

SEQ ID NO: 594488 - DNA, 25 bp, Mus musculus
ccgaatccagttcagtgttggctac

SEQ ID NO: 594489 - DNA, 25 bp, Mus musculus
ccgaatccagttgagtgttggctac

SEQ ID NO: 594490 - DNA, 25 bp, Mus musculus
ccgaatctgtttccagatggacaga

SEQ ID NO: 594491 - DNA, 25 bp, Mus musculus
ccgaatctgtttgcagatggacaga

SEQ ID NO: 594492 - DNA, 25 bp, Mus musculus
ccgaatctttgacgtgagcttcttg

SEQ ID NO: 594493 - DNA, 25 bp, Mus musculus
ccgaatctttgaggtgagcttcttg

SEQ ID NO: 594494 - DNA, 25 bp, Mus musculus
ccgaatgaagaccacgaccaagaag

SEQ ID NO: 594495 - DNA, 25 bp, Mus musculus
ccgaatgaagacgacgaccaagaag

SEQ ID NO: 594496 - DNA, 25 bp, Mus musculus
ccgaatgcatgaaggcacaactcca

SEQ ID NO: 594497 - DNA, 25 bp, Mus musculus
ccgaatgcatgatggcacaactcca

SEQ ID NO: 594498 - DNA, 25 bp, Mus musculus
ccgaatgccggaacacatctaactt

SEQ ID NO: 594499 - DNA, 25 bp, Mus musculus
ccgaatgccggatcacatctaactt

SEQ ID NO: 594500 - DNA, 25 bp, Mus musculus
ccgaatggctttattgcgaactgca

SEQ ID NO: 594501 - DNA, 25 bp, Mus musculus
ccgaatggcttttttgcgaactgca

SEQ ID NO: 594502 - DNA, 25 bp, Mus musculus
ccgaatggtgccagaggacattaag

SEQ ID NO: 594503 - DNA, 25 bp, Mus musculus
ccgaatggtgcctgaggacattaag

SEQ ID NO: 594504 - DNA, 25 bp, Mus musculus
ccgaatgtctggatgcctacaacag

SEQ ID NO: 594505 - DNA, 25 bp, Mus musculus
ccgaatgtctggttgcctacaacag

SEQ ID NO: 594506 - DNA, 25 bp, Mus musculus
ccgaattgccatagcggctcttgag

SEQ ID NO: 594507 - DNA, 25 bp, Mus musculus
ccgaattgccattgcggctcttgag

SEQ ID NO: 594508 - DNA, 25 bp, Mus musculus
ccgaattgggatcgatgaagatgat

SEQ ID NO: 594509 - DNA, 25 bp, Mus musculus
ccgaattgggatggatgaagatgat

SEQ ID NO: 594510 - DNA, 25 bp, Mus musculus
ccgacaaccacaagtttaagcagtt

SEQ ID NO: 594511 - DNA, 25 bp, Mus musculus
ccgacaaccacatgtttaagcagtt

SEQ ID NO: 594512 - DNA, 25 bp, Mus musculus
ccgacaacgtcaagggcaggtcacc

SEQ ID NO: 594513 - DNA, 25 bp, Mus musculus
ccgacaacgtcatgggcaggtcacc

SEQ ID NO: 594514 - DNA, 25 bp, Mus musculus
ccgacaaggaaaaggaggtgcttca

SEQ ID NO: 594515 - DNA, 25 bp, Mus musculus
ccgacaaggaaatggaggtgcttca

SEQ ID NO: 594516 - DNA, 25 bp, Mus musculus
ccgacaatctgtcgtcctggaactt

SEQ ID NO: 594517 - DNA, 25 bp, Mus musculus
ccgacaatctgtggtcctggaactt

SEQ ID NO: 594518 - DNA, 25 bp, Mus musculus
ccgacaccaagaacgtgcagtttgt

SEQ ID NO: 594519 - DNA, 25 bp, Mus musculus
ccgacaccaagatcgtgcagtttgt

SEQ ID NO: 594520 - DNA, 25 bp, Mus musculus
ccgacacccactcatccttgctgcg

SEQ ID NO: 594521 - DNA, 25 bp, Mus musculus
ccgacacccactgatccttgctgcg

SEQ ID NO: 594522 - DNA, 25 bp, Mus musculus
ccgacacgggcgagaccacctggga

SEQ ID NO: 594523 - DNA, 25 bp, Mus musculus
ccgacacgggcgtgaccacctggga

SEQ ID NO: 594524 - DNA, 25 bp, Mus musculus
ccgacactcgctcgaaattcaacgt

SEQ ID NO: 594525 - DNA, 25 bp, Mus musculus
ccgacactcgctggaaattcaacgt

SEQ ID NO: 594526 - DNA, 25 bp, Mus musculus
ccgacactggcaagatgcaggccct

SEQ ID NO: 594527 - DNA, 25 bp, Mus musculus
ccgacactggcatgatgcaggccct

SEQ ID NO: 594528 - DNA, 25 bp, Mus musculus
ccgacacttgtcctgagaaggaaga

SEQ ID NO: 594529 - DNA, 25 bp, Mus musculus
ccgacacttgtcgtgagaaggaaga

SEQ ID NO: 594530 - DNA, 25 bp, Mus musculus
ccgacagaagctcagcttgtcaact

SEQ ID NO: 594531 - DNA, 25 bp, Mus musculus
ccgacagaagctgagcttgtcaact

SEQ ID NO: 594532 - DNA, 25 bp, Mus musculus
ccgacagaggctatccacaaagatg

SEQ ID NO: 594533 - DNA, 25 bp, Mus musculus
ccgacagaggctttccacaaagatg

SEQ ID NO: 594534 - DNA, 25 bp, Mus musculus
ccgacagcatgtcgagacgttcttc

SEQ ID NO: 594535 - DNA, 25 bp, Mus musculus
ccgacagcatgtggagacgttcttc

SEQ ID NO: 594536 - DNA, 25 bp, Mus musculus
ccgacagccttgactaccagatctt

SEQ ID NO: 594537 - DNA, 25 bp, Mus musculus
ccgacagccttgtctaccagatctt

SEQ ID NO: 594538 - DNA, 25 bp, Mus musculus
ccgacagctaggatctcctttctgg

SEQ ID NO: 594539 - DNA, 25 bp, Mus musculus
ccgacagctaggttctcctttctgg

SEQ ID NO: 594540 - DNA, 25 bp, Mus musculus
ccgacaggattccttggctaccgtc

SEQ ID NO: 594541 - DNA, 25 bp, Mus musculus
ccgacaggattcgttggctaccgtc

SEQ ID NO: 594542 - DNA, 25 bp, Mus musculus
ccgacaggtccaaggctcagagatc

SEQ ID NO: 594543 - DNA, 25 bp, Mus musculus
ccgacaggtccatggctcagagatc

SEQ ID NO: 594544 - DNA, 25 bp, Mus musculus
ccgacaggtgcgctcccttcaagga

SEQ ID NO: 594545 - DNA, 25 bp, Mus musculus
ccgacaggtgcggtcccttcaagga

SEQ ID NO: 594546 - DNA, 25 bp, Mus musculus
ccgacagtcttcagactctggcgta

SEQ ID NO: 594547 - DNA, 25 bp, Mus musculus
ccgacagtcttctgactctggcgta

SEQ ID NO: 594548 - DNA, 25 bp, Mus musculus
ccgacatcaagtaccctctgaggct

SEQ ID NO: 594549 - DNA, 25 bp, Mus musculus
ccgacatcaagttccctctgaggct

SEQ ID NO: 594550 - DNA, 25 bp, Mus musculus
ccgacatctgcactagtgagagtgt

SEQ ID NO: 594551 - DNA, 25 bp, Mus musculus
ccgacatctgcagtagtgagagtgt

SEQ ID NO: 594552 - DNA, 25 bp, Mus musculus
ccgacatcttgcaacagtggtgaca

SEQ ID NO: 594553 - DNA, 25 bp, Mus musculus
ccgacatcttgctacagtggtgaca

SEQ ID NO: 594554 - DNA, 25 bp, Mus musculus
ccgaccaaggaaacacagagaactg

SEQ ID NO: 594555 - DNA, 25 bp, Mus musculus
ccgaccaaggaatcacagagaactg

SEQ ID NO: 594556 - DNA, 25 bp, Mus musculus
ccgaccagcacaacaagcaggtttg

SEQ ID NO: 594557 - DNA, 25 bp, Mus musculus
ccgaccagcacatcaagcaggtttg

SEQ ID NO: 594558 - DNA, 25 bp, Mus musculus
ccgaccagtcaacggtcagtgacta

SEQ ID NO: 594559 - DNA, 25 bp, Mus musculus
ccgaccagtcaagggtcagtgacta

SEQ ID NO: 594560 - DNA, 25 bp, Mus musculus
ccgacccaatcgcttaattgttgat

SEQ ID NO: 594561 - DNA, 25 bp, Mus musculus
ccgacccaatcggttaattgttgat

SEQ ID NO: 594562 - DNA, 25 bp, Mus musculus
ccgacccatcctacaggcagggctg

SEQ ID NO: 594563 - DNA, 25 bp, Mus musculus
ccgacccatccttcaggcagggctg

SEQ ID NO: 594564 - DNA, 25 bp, Mus musculus
ccgaccctgacaccaaaccattcag

SEQ ID NO: 594565 - DNA, 25 bp, Mus musculus
ccgaccctgacagcaaaccattcag

SEQ ID NO: 594566 - DNA, 25 bp, Mus musculus
ccgaccctgttgatgcagagcagta

SEQ ID NO: 594567 - DNA, 25 bp, Mus musculus
ccgaccctgttgttgcagagcagta

SEQ ID NO: 594568 - DNA, 25 bp, Mus musculus
ccgacctcttcacgatggagatatt

SEQ ID NO: 594569 - DNA, 25 bp, Mus musculus
ccgacctcttcaggatggagatatt

SEQ ID NO: 594570 - DNA, 25 bp, Mus musculus
ccgacgaaatcgacgagaacagcat

SEQ ID NO: 594571 - DNA, 25 bp, Mus musculus
ccgacgaaatcgtcgagaacagcat

SEQ ID NO: 594572 - DNA, 25 bp, Mus musculus
ccgacgagagctaccgcatgtacag

SEQ ID NO: 594573 - DNA, 25 bp, Mus musculus
ccgacgagagcttccgcatgtacag

SEQ ID NO: 594574 - DNA, 25 bp, Mus musculus
ccgacgcaacggagaaggacctgtc

SEQ ID NO: 594575 - DNA, 25 bp, Mus musculus
ccgacgcaacggtgaaggacctgtc

SEQ ID NO: 594576 - DNA, 25 bp, Mus musculus
ccgacgcacggcagctgagaatgag

SEQ ID NO: 594577 - DNA, 25 bp, Mus musculus
ccgacgcacggctgctgagaatgag

SEQ ID NO: 594578 - DNA, 25 bp, Mus musculus
ccgacgcagggcaggagcagtctcc

SEQ ID NO: 594579 - DNA, 25 bp, Mus musculus
ccgacgcagggctggagcagtctcc

SEQ ID NO: 594580 - DNA, 25 bp, Mus musculus
ccgacgcaggtgctcacgtgcttga

SEQ ID NO: 594581 - DNA, 25 bp, Mus musculus
ccgacgcaggtggtcacgtgcttga

SEQ ID NO: 594582 - DNA, 25 bp, Mus musculus
ccgacgcattccacaaagcatttct

SEQ ID NO: 594583 - DNA, 25 bp, Mus musculus
ccgacgcattcctcaaagcatttct

SEQ ID NO: 594584 - DNA, 25 bp, Mus musculus
ccgacgccgggcagtcattctgaaa

SEQ ID NO: 594585 - DNA, 25 bp, Mus musculus
ccgacgccgggctgtcattctgaaa

SEQ ID NO: 594586 - DNA, 25 bp, Mus musculus
ccgacgggttggctttgaatgctct

SEQ ID NO: 594587 - DNA, 25 bp, Mus musculus
ccgacgggttgggtttgaatgctct

SEQ ID NO: 594588 - DNA, 25 bp, Mus musculus
ccgacggtcacgatgttgctgagtg

SEQ ID NO: 594589 - DNA, 25 bp, Mus musculus
ccgacggtcacgttgttgctgagtg

SEQ ID NO: 594590 - DNA, 25 bp, Mus musculus
ccgacggtgcttagaggcccggatc

SEQ ID NO: 594591 - DNA, 25 bp, Mus musculus
ccgacggtgctttgaggcccggatc

SEQ ID NO: 594592 - DNA, 25 bp, Mus musculus
ccgacgtgcgcgagaaggacctcga

SEQ ID NO: 594593 - DNA, 25 bp, Mus musculus
ccgacgtgcgcgtgaaggacctcga

SEQ ID NO: 594594 - DNA, 25 bp, Mus musculus
ccgactacatggagcagtgcaagcc

SEQ ID NO: 594595 - DNA, 25 bp, Mus musculus
ccgactacatggtgcagtgcaagcc

SEQ ID NO: 594596 - DNA, 25 bp, Mus musculus
ccgactcattatccatttccgagat

SEQ ID NO: 594597 - DNA, 25 bp, Mus musculus
ccgactcattatgcatttccgagat

SEQ ID NO: 594598 - DNA, 25 bp, Mus musculus
ccgactccctgaacctggccaaggg

SEQ ID NO: 594599 - DNA, 25 bp, Mus musculus
ccgactccctgatcctggccaaggg

SEQ ID NO: 594600 - DNA, 25 bp, Mus musculus
ccgactcctgtgaccgcatcaaaga

SEQ ID NO: 594601 - DNA, 25 bp, Mus musculus
ccgactcctgtgtccgcatcaaaga

SEQ ID NO: 594602 - DNA, 25 bp, Mus musculus
ccgactcgtaagagtgaatttgtag

SEQ ID NO: 594603 - DNA, 25 bp, Mus musculus
ccgactcgtaagtgtgaatttgtag

SEQ ID NO: 594604 - DNA, 25 bp, Mus musculus
ccgactgagagcaagcgaacaggca

SEQ ID NO: 594605 - DNA, 25 bp, Mus musculus
ccgactgagagctagcgaacaggca

SEQ ID NO: 594606 - DNA, 25 bp, Mus musculus
ccgactgcaaacaggtaggtagggc

SEQ ID NO: 594607 - DNA, 25 bp, Mus musculus
ccgactgcaaactggtaggtagggc

SEQ ID NO: 594608 - DNA, 25 bp, Mus musculus
ccgactgctgcaccgctgtgaacta

SEQ ID NO: 594609 - DNA, 25 bp, Mus musculus
ccgactgctgcagcgctgtgaacta

SEQ ID NO: 594610 - DNA, 25 bp, Mus musculus
ccgactgggtccaggcagagatcag

SEQ ID NO: 594611 - DNA, 25 bp, Mus musculus
ccgactgggtcctggcagagatcag

SEQ ID NO: 594612 - DNA, 25 bp, Mus musculus
ccgactgtctggacgcaggagacct

SEQ ID NO: 594613 - DNA, 25 bp, Mus musculus
ccgactgtctggtcgcaggagacct

SEQ ID NO: 594614 - DNA, 25 bp, Mus musculus
ccgactgtgagcagaagtgtaggtc

SEQ ID NO: 594615 - DNA, 25 bp, Mus musculus
ccgactgtgagctgaagtgtaggtc

SEQ ID NO: 594616 - DNA, 25 bp, Mus musculus
ccgacttccctgagctgctgctaga

SEQ ID NO: 594617 - DNA, 25 bp, Mus musculus
ccgacttccctgtgctgctgctaga

SEQ ID NO: 594618 - DNA, 25 bp, Mus musculus
ccgacttcggaaaggctgctgataa

SEQ ID NO: 594619 - DNA, 25 bp, Mus musculus
ccgacttcggaatggctgctgataa

SEQ ID NO: 594620 - DNA, 25 bp, Mus musculus
ccgacttctgtaaggccagggcaaa

SEQ ID NO: 594621 - DNA, 25 bp, Mus musculus
ccgacttctgtatggccagggcaaa

SEQ ID NO: 594622 - DNA, 25 bp, Mus musculus
ccgacttgatagacatggttcttga

SEQ ID NO: 594623 - DNA, 25 bp, Mus musculus
ccgacttgatagtcatggttcttga

SEQ ID NO: 594624 - DNA, 25 bp, Mus musculus
ccgacttgttccctatggaaatcat

SEQ ID NO: 594625 - DNA, 25 bp, Mus musculus
ccgacttgttccgtatggaaatcat

SEQ ID NO: 594626 - DNA, 25 bp, Mus musculus
ccgacttgttgaactcgcgcaggca

SEQ ID NO: 594627 - DNA, 25 bp, Mus musculus
ccgacttgttgatctcgcgcaggca

SEQ ID NO: 594628 - DNA, 25 bp, Mus musculus
ccgagaacaagtcaataaggcctat

SEQ ID NO: 594629 - DNA, 25 bp, Mus musculus
ccgagaacaagtgaataaggcctat

SEQ ID NO: 594630 - DNA, 25 bp, Mus musculus
ccgagaagacgcatgtggccaagat

SEQ ID NO: 594631 - DNA, 25 bp, Mus musculus
ccgagaagacgcttgtggccaagat

SEQ ID NO: 594632 - DNA, 25 bp, Mus musculus
ccgagaagccgcaatgaccgagatt

SEQ ID NO: 594633 - DNA, 25 bp, Mus musculus
ccgagaagccgctatgaccgagatt

SEQ ID NO: 594634 - DNA, 25 bp, Mus musculus
ccgagaagccggaacctgcggccgt

SEQ ID NO: 594635 - DNA, 25 bp, Mus musculus
ccgagaagccggtacctgcggccgt

SEQ ID NO: 594636 - DNA, 25 bp, Mus musculus
ccgagaagctgaacctcactttcca

SEQ ID NO: 594637 - DNA, 25 bp, Mus musculus
ccgagaagctgatcctcactttcca

SEQ ID NO: 594638 - DNA, 25 bp, Mus musculus
ccgagaagttgtcatcggaagagtt

SEQ ID NO: 594639 - DNA, 25 bp, Mus musculus
ccgagaagttgtgatcggaagagtt

SEQ ID NO: 594640 - DNA, 25 bp, Mus musculus
ccgagaatggagatttgattgcaga

SEQ ID NO: 594641 - DNA, 25 bp, Mus musculus
ccgagaatggagttttgattgcaga

SEQ ID NO: 594642 - DNA, 25 bp, Mus musculus
ccgagacagccaagtgtcaggccat

SEQ ID NO: 594643 - DNA, 25 bp, Mus musculus
ccgagacagccatgtgtcaggccat

SEQ ID NO: 594644 - DNA, 25 bp, Mus musculus
ccgagaccagttcccgatacagtaa

SEQ ID NO: 594645 - DNA, 25 bp, Mus musculus
ccgagaccagttgccgatacagtaa

SEQ ID NO: 594646 - DNA, 25 bp, Mus musculus
ccgagaccattcagtggacgagagc

SEQ ID NO: 594647 - DNA, 25 bp, Mus musculus
ccgagaccattctgtggacgagagc

SEQ ID NO: 594648 - DNA, 25 bp, Mus musculus
ccgagaccctggaggaatgtgctct

SEQ ID NO: 594649 - DNA, 25 bp, Mus musculus
ccgagaccctggtggaatgtgctct

SEQ ID NO: 594650 - DNA, 25 bp, Mus musculus
ccgagaccgtgacgccctggtgatc

SEQ ID NO: 594651 - DNA, 25 bp, Mus musculus
ccgagaccgtgaggccctggtgatc

SEQ ID NO: 594652 - DNA, 25 bp, Mus musculus
ccgagacctgaactttgagcgaggt

SEQ ID NO: 594653 - DNA, 25 bp, Mus musculus
ccgagacctgaagtttgagcgaggt

SEQ ID NO: 594654 - DNA, 25 bp, Mus musculus
ccgagacgacccagagcaaaggaag

SEQ ID NO: 594655 - DNA, 25 bp, Mus musculus
ccgagacgaccctgagcaaaggaag

SEQ ID NO: 594656 - DNA, 25 bp, Mus musculus
ccgagactgcttatacctctgtcct

SEQ ID NO: 594657 - DNA, 25 bp, Mus musculus
ccgagactgcttttacctctgtcct

SEQ ID NO: 594658 - DNA, 25 bp, Mus musculus
ccgagaggacaacgcctactgtgaa

SEQ ID NO: 594659 - DNA, 25 bp, Mus musculus
ccgagaggacaaggcctactgtgaa

SEQ ID NO: 594660 - DNA, 25 bp, Mus musculus
ccgagaggcactccatgagctggcc

SEQ ID NO: 594661 - DNA, 25 bp, Mus musculus
ccgagaggcactgcatgagctggcc

SEQ ID NO: 594662 - DNA, 25 bp, Mus musculus
ccgagaggcattctggaaaatgaag

SEQ ID NO: 594663 - DNA, 25 bp, Mus musculus
ccgagaggcattgtggaaaatgaag

SEQ ID NO: 594664 - DNA, 25 bp, Mus musculus
ccgagagggtgcaccggtgtccatt

SEQ ID NO: 594665 - DNA, 25 bp, Mus musculus
ccgagagggtgctccggtgtccatt

SEQ ID NO: 594666 - DNA, 25 bp, Mus musculus
ccgagaggttgccagctgccaagtt

SEQ ID NO: 594667 - DNA, 25 bp, Mus musculus
ccgagaggttgcgagctgccaagtt

SEQ ID NO: 594668 - DNA, 25 bp, Mus musculus
ccgagagtgcccatgctgcattcga

SEQ ID NO: 594669 - DNA, 25 bp, Mus musculus
ccgagagtgcccttgctgcattcga

SEQ ID NO: 594670 - DNA, 25 bp, Mus musculus
ccgagagttcataggaagtttcctg

SEQ ID NO: 594671 - DNA, 25 bp, Mus musculus
ccgagagttcattggaagtttcctg

SEQ ID NO: 594672 - DNA, 25 bp, Mus musculus
ccgagataagtgctttcacgtttct

SEQ ID NO: 594673 - DNA, 25 bp, Mus musculus
ccgagataagtggtttcacgtttct

SEQ ID NO: 594674 - DNA, 25 bp, Mus musculus
ccgagatacagaagcccgggctgtg

SEQ ID NO: 594675 - DNA, 25 bp, Mus musculus
ccgagatacagatgcccgggctgtg

SEQ ID NO: 594676 - DNA, 25 bp, Mus musculus
ccgagatcaacgaggagagagatga

SEQ ID NO: 594677 - DNA, 25 bp, Mus musculus
ccgagatcaacgtggagagagatga

SEQ ID NO: 594678 - DNA, 25 bp, Mus musculus
ccgagatccacgagacacagacagt

SEQ ID NO: 594679 - DNA, 25 bp, Mus musculus
ccgagatccacgtgacacagacagt

SEQ ID NO: 594680 - DNA, 25 bp, Mus musculus
ccgagatctgctcagaacaccctta

SEQ ID NO: 594681 - DNA, 25 bp, Mus musculus
ccgagatctgctgagaacaccctta

SEQ ID NO: 594682 - DNA, 25 bp, Mus musculus
ccgagatcttagaaagccagtggga

SEQ ID NO: 594683 - DNA, 25 bp, Mus musculus
ccgagatcttagtaagccagtggga

SEQ ID NO: 594684 - DNA, 25 bp, Mus musculus
ccgagatgaaatcgtttcctggatg

SEQ ID NO: 594685 - DNA, 25 bp, Mus musculus
ccgagatgaaatggtttcctggatg

SEQ ID NO: 594686 - DNA, 25 bp, Mus musculus
ccgagatgaacacgggcaccaatga

SEQ ID NO: 594687 - DNA, 25 bp, Mus musculus
ccgagatgaacaggggcaccaatga

SEQ ID NO: 594688 - DNA, 25 bp, Mus musculus
ccgagatgaggccaagaagctagaa

SEQ ID NO: 594689 - DNA, 25 bp, Mus musculus
ccgagatgaggcgaagaagctagaa

SEQ ID NO: 594690 - DNA, 25 bp, Mus musculus
ccgagatgatctaccccagcggcag

SEQ ID NO: 594691 - DNA, 25 bp, Mus musculus
ccgagatgatcttccccagcggcag

SEQ ID NO: 594692 - DNA, 25 bp, Mus musculus
ccgagatgcaggaataggcttcact

SEQ ID NO: 594693 - DNA, 25 bp, Mus musculus
ccgagatgcaggtataggcttcact

SEQ ID NO: 594694 - DNA, 25 bp, Mus musculus
ccgagatgctgaaaccaatgatagg

SEQ ID NO: 594695 - DNA, 25 bp, Mus musculus
ccgagatgctgataccaatgatagg

SEQ ID NO: 594696 - DNA, 25 bp, Mus musculus
ccgagatggagtactgagtcccagc

SEQ ID NO: 594697 - DNA, 25 bp, Mus musculus
ccgagatggagttctgagtcccagc

SEQ ID NO: 594698 - DNA, 25 bp, Mus musculus
ccgagatgtggccattttgcaggaa

SEQ ID NO: 594699 - DNA, 25 bp, Mus musculus
ccgagatgtggcgattttgcaggaa

SEQ ID NO: 594700 - DNA, 25 bp, Mus musculus
ccgagatttgggagttgatgaaaca

SEQ ID NO: 594701 - DNA, 25 bp, Mus musculus
ccgagatttgggtgttgatgaaaca

SEQ ID NO: 594702 - DNA, 25 bp, Mus musculus
ccgagcaatcggcaccatcggattg

SEQ ID NO: 594703 - DNA, 25 bp, Mus musculus
ccgagcaatcgggaccatcggattg

SEQ ID NO: 594704 - DNA, 25 bp, Mus musculus
ccgagcacattcagagtctctgtga

SEQ ID NO: 594705 - DNA, 25 bp, Mus musculus
ccgagcacattctgagtctctgtga

SEQ ID NO: 594706 - DNA, 25 bp, Mus musculus
ccgagcagaaatcgcaaagacggaa

SEQ ID NO: 594707 - DNA, 25 bp, Mus musculus
ccgagcagaaatggcaaagacggaa

SEQ ID NO: 594708 - DNA, 25 bp, Mus musculus
ccgagcagcagtcgagcctccatgt

SEQ ID NO: 594709 - DNA, 25 bp, Mus musculus
ccgagcagcagtggagcctccatgt

SEQ ID NO: 594710 - DNA, 25 bp, Mus musculus
ccgagccacgagagaggagactttc

SEQ ID NO: 594711 - DNA, 25 bp, Mus musculus
ccgagccacgagtgaggagactttc

SEQ ID NO: 594712 - DNA, 25 bp, Mus musculus
ccgagccagggaaagcgtggagctg

SEQ ID NO: 594713 - DNA, 25 bp, Mus musculus
ccgagccagggatagcgtggagctg

SEQ ID NO: 594714 - DNA, 25 bp, Mus musculus
ccgagccatctcacttaggcgcttg

SEQ ID NO: 594715 - DNA, 25 bp, Mus musculus
ccgagccatctctcttaggcgcttg

SEQ ID NO: 594716 - DNA, 25 bp, Mus musculus
ccgagcccgaaaaaagaggctgaat

SEQ ID NO: 594717 - DNA, 25 bp, Mus musculus
ccgagcccgaaataagaggctgaat

SEQ ID NO: 594718 - DNA, 25 bp, Mus musculus
ccgagcccgcagctgtttccaggat

SEQ ID NO: 594719 - DNA, 25 bp, Mus musculus
ccgagcccgcaggtgtttccaggat

SEQ ID NO: 594720 - DNA, 25 bp, Mus musculus
ccgagccggagcaggtgatcagaaa

SEQ ID NO: 594721 - DNA, 25 bp, Mus musculus
ccgagccggagctggtgatcagaaa

SEQ ID NO: 594722 - DNA, 25 bp, Mus musculus
ccgagccgtgagcacatgtgcgcat

SEQ ID NO: 594723 - DNA, 25 bp, Mus musculus
ccgagccgtgaggacatgtgcgcat

SEQ ID NO: 594724 - DNA, 25 bp, Mus musculus
ccgagcctgccgctggtaaagagac

SEQ ID NO: 594725 - DNA, 25 bp, Mus musculus
ccgagcctgccggtggtaaagagac

SEQ ID NO: 594726 - DNA, 25 bp, Mus musculus
ccgagcctgctcagactccttggaa

SEQ ID NO: 594727 - DNA, 25 bp, Mus musculus
ccgagcctgctctgactccttggaa

SEQ ID NO: 594728 - DNA, 25 bp, Mus musculus
ccgagcgaaagcctaagcgcctgcg

SEQ ID NO: 594729 - DNA, 25 bp, Mus musculus
ccgagcgaaagcgtaagcgcctgcg

SEQ ID NO: 594730 - DNA, 25 bp, Mus musculus
ccgagcgcgcagactttcgaggagc

SEQ ID NO: 594731 - DNA, 25 bp, Mus musculus
ccgagcgcgcagtctttcgaggagc

SEQ ID NO: 594732 - DNA, 25 bp, Mus musculus
ccgagcgctaaaacaggagtctgga

SEQ ID NO: 594733 - DNA, 25 bp, Mus musculus
ccgagcgctaaatcaggagtctgga

SEQ ID NO: 594734 - DNA, 25 bp, Mus musculus
ccgagcgtcaaacgcctgaaggagc

SEQ ID NO: 594735 - DNA, 25 bp, Mus musculus
ccgagcgtcaaaggcctgaaggagc

SEQ ID NO: 594736 - DNA, 25 bp, Mus musculus
ccgagcgtccttacttcagaacgaa

SEQ ID NO: 594737 - DNA, 25 bp, Mus musculus
ccgagcgtcctttcttcagaacgaa

SEQ ID NO: 594738 - DNA, 25 bp, Mus musculus
ccgagctaccttccggatagaggat

SEQ ID NO: 594739 - DNA, 25 bp, Mus musculus
ccgagctaccttgcggatagaggat

SEQ ID NO: 594740 - DNA, 25 bp, Mus musculus
ccgagctccaggacaccagtttgac

SEQ ID NO: 594741 - DNA, 25 bp, Mus musculus
ccgagctccaggtcaccagtttgac

SEQ ID NO: 594742 - DNA, 25 bp, Mus musculus
ccgagctccccgccgtgtttgatgg

SEQ ID NO: 594743 - DNA, 25 bp, Mus musculus
ccgagctccccggcgtgtttgatgg

SEQ ID NO: 594744 - DNA, 25 bp, Mus musculus
ccgagctgaaggagagacgcattca

SEQ ID NO: 594745 - DNA, 25 bp, Mus musculus
ccgagctgaaggtgagacgcattca

SEQ ID NO: 594746 - DNA, 25 bp, Mus musculus
ccgagctgagtactttgatggttca

SEQ ID NO: 594747 - DNA, 25 bp, Mus musculus
ccgagctgagtagtttgatggttca

SEQ ID NO: 594748 - DNA, 25 bp, Mus musculus
ccgagctgcggtcaatgttgtagac

SEQ ID NO: 594749 - DNA, 25 bp, Mus musculus
ccgagctgcggtgaatgttgtagac

SEQ ID NO: 594750 - DNA, 25 bp, Mus musculus
ccgagctggtacaaggtgtttgacc

SEQ ID NO: 594751 - DNA, 25 bp, Mus musculus
ccgagctggtactaggtgtttgacc

SEQ ID NO: 594752 - DNA, 25 bp, Mus musculus
ccgagctgtgcgcagcaaacacagc

SEQ ID NO: 594753 - DNA, 25 bp, Mus musculus
ccgagctgtgcggagcaaacacagc

SEQ ID NO: 594754 - DNA, 25 bp, Mus musculus
ccgagctgttaaacaagacaaaaag

SEQ ID NO: 594755 - DNA, 25 bp, Mus musculus
ccgagctgttaatcaagacaaaaag

SEQ ID NO: 594756 - DNA, 25 bp, Mus musculus
ccgagcttggacagaacttacagac

SEQ ID NO: 594757 - DNA, 25 bp, Mus musculus
ccgagcttggactgaacttacagac

SEQ ID NO: 594758 - DNA, 25 bp, Mus musculus
ccgaggaaataaatacttggccaag

SEQ ID NO: 594759 - DNA, 25 bp, Mus musculus
ccgaggaaataattacttggccaag

SEQ ID NO: 594760 - DNA, 25 bp, Mus musculus
ccgaggaacacgagggcaactatgt

SEQ ID NO: 594761 - DNA, 25 bp, Mus musculus
ccgaggaacacgtgggcaactatgt

SEQ ID NO: 594762 - DNA, 25 bp, Mus musculus
ccgaggaattccaggatccccaggg

SEQ ID NO: 594763 - DNA, 25 bp, Mus musculus
ccgaggaattcctggatccccaggg

SEQ ID NO: 594764 - DNA, 25 bp, Mus musculus
ccgaggacagttcagtgaggtttac

SEQ ID NO: 594765 - DNA, 25 bp, Mus musculus
ccgaggacagttgagtgaggtttac

SEQ ID NO: 594766 - DNA, 25 bp, Mus musculus
ccgaggaccggcagctactggtagt

SEQ ID NO: 594767 - DNA, 25 bp, Mus musculus
ccgaggaccggctgctactggtagt

SEQ ID NO: 594768 - DNA, 25 bp, Mus musculus
ccgaggagacgtacagctactctga

SEQ ID NO: 594769 - DNA, 25 bp, Mus musculus
ccgaggagacgttcagctactctga

SEQ ID NO: 594770 - DNA, 25 bp, Mus musculus
ccgaggagcgcacaacggtacccaa

SEQ ID NO: 594771 - DNA, 25 bp, Mus musculus
ccgaggagcgcagaacggtacccaa

SEQ ID NO: 594772 - DNA, 25 bp, Mus musculus
ccgaggagctagatcgagtagatca

SEQ ID NO: 594773 - DNA, 25 bp, Mus musculus
ccgaggagctagttcgagtagatca

SEQ ID NO: 594774 - DNA, 25 bp, Mus musculus
ccgaggagctgaaagtggcccctga

SEQ ID NO: 594775 - DNA, 25 bp, Mus musculus
ccgaggagctgatagtggcccctga

SEQ ID NO: 594776 - DNA, 25 bp, Mus musculus
ccgaggataacgaaatgaagatcgc

SEQ ID NO: 594777 - DNA, 25 bp, Mus musculus
ccgaggataacgtaatgaagatcgc

SEQ ID NO: 594778 - DNA, 25 bp, Mus musculus
ccgaggatgacaacagcgatgtgcc

SEQ ID NO: 594779 - DNA, 25 bp, Mus musculus
ccgaggatgacatcagcgatgtgcc

SEQ ID NO: 594780 - DNA, 25 bp, Mus musculus
ccgaggcaaaaacgacgtgaaccag

SEQ ID NO: 594781 - DNA, 25 bp, Mus musculus
ccgaggcaaaaaggacgtgaaccag

SEQ ID NO: 594782 - DNA, 25 bp, Mus musculus
ccgaggcaatggagggagtgccgaa

SEQ ID NO: 594783 - DNA, 25 bp, Mus musculus
ccgaggcaatggtgggagtgccgaa

SEQ ID NO: 594784 - DNA, 25 bp, Mus musculus
ccgaggcatgcaccaagcagaggca

SEQ ID NO: 594785 - DNA, 25 bp, Mus musculus
ccgaggcatgcagcaagcagaggca

SEQ ID NO: 594786 - DNA, 25 bp, Mus musculus
ccgaggcctacgaccttttctacag

SEQ ID NO: 594787 - DNA, 25 bp, Mus musculus
ccgaggcctacgtccttttctacag

SEQ ID NO: 594788 - DNA, 25 bp, Mus musculus
ccgaggcggacaactgacgagttgc

SEQ ID NO: 594789 - DNA, 25 bp, Mus musculus
ccgaggcggacatctgacgagttgc

SEQ ID NO: 594790 - DNA, 25 bp, Mus musculus
ccgaggctccgtcttgctaagcaga

SEQ ID NO: 594791 - DNA, 25 bp, Mus musculus
ccgaggctccgtgttgctaagcaga

SEQ ID NO: 594792 - DNA, 25 bp, Mus musculus
ccgaggctgtgaaaccatggtgctg

SEQ ID NO: 594793 - DNA, 25 bp, Mus musculus
ccgaggctgtgataccatggtgctg

SEQ ID NO: 594794 - DNA, 25 bp, Mus musculus
ccgaggctttggctatggcctgact

SEQ ID NO: 594795 - DNA, 25 bp, Mus musculus
ccgaggctttgggtatggcctgact

SEQ ID NO: 594796 - DNA, 25 bp, Mus musculus
ccgagggagcagcaacatcaaggaa

SEQ ID NO: 594797 - DNA, 25 bp, Mus musculus
ccgagggagcaggaacatcaaggaa

SEQ ID NO: 594798 - DNA, 25 bp, Mus musculus
ccgagggccagtactcagaggacga

SEQ ID NO: 594799 - DNA, 25 bp, Mus musculus
ccgagggccagttctcagaggacga

SEQ ID NO: 594800 - DNA, 25 bp, Mus musculus
ccgagggcttccagtacagggctgt

SEQ ID NO: 594801 - DNA, 25 bp, Mus musculus
ccgagggcttcctgtacagggctgt

SEQ ID NO: 594802 - DNA, 25 bp, Mus musculus
ccgagggtcagcaagatgtcgagat

SEQ ID NO: 594803 - DNA, 25 bp, Mus musculus
ccgagggtcagctagatgtcgagat

SEQ ID NO: 594804 - DNA, 25 bp, Mus musculus
ccgagggttggacctcaagttgacc

SEQ ID NO: 594805 - DNA, 25 bp, Mus musculus
ccgagggttggagctcaagttgacc

SEQ ID NO: 594806 - DNA, 25 bp, Mus musculus
ccgaggtaaagcagaggctccagga

SEQ ID NO: 594807 - DNA, 25 bp, Mus musculus
ccgaggtaaagctgaggctccagga

SEQ ID NO: 594808 - DNA, 25 bp, Mus musculus
ccgaggtagcatcgtggccacctat

SEQ ID NO: 594809 - DNA, 25 bp, Mus musculus
ccgaggtagcatggtggccacctat

SEQ ID NO: 594810 - DNA, 25 bp, Mus musculus
ccgaggtattgaaatacaagctgtg

SEQ ID NO: 594811 - DNA, 25 bp, Mus musculus
ccgaggtattgatatacaagctgtg

SEQ ID NO: 594812 - DNA, 25 bp, Mus musculus
ccgaggtcatgtcattaggaagtca

SEQ ID NO: 594813 - DNA, 25 bp, Mus musculus
ccgaggtcatgtgattaggaagtca

SEQ ID NO: 594814 - DNA, 25 bp, Mus musculus
ccgaggtccggaagggtctcctgga

SEQ ID NO: 594815 - DNA, 25 bp, Mus musculus
ccgaggtccggatgggtctcctgga

SEQ ID NO: 594816 - DNA, 25 bp, Mus musculus
ccgaggtcggctcgatgacatctgt

SEQ ID NO: 594817 - DNA, 25 bp, Mus musculus
ccgaggtcggctggatgacatctgt

SEQ ID NO: 594818 - DNA, 25 bp, Mus musculus
ccgaggtctaacatcagcagaggct

SEQ ID NO: 594819 - DNA, 25 bp, Mus musculus
ccgaggtctaacttcagcagaggct

SEQ ID NO: 594820 - DNA, 25 bp, Mus musculus
ccgaggtctgagactgcccaggtat

SEQ ID NO: 594821 - DNA, 25 bp, Mus musculus
ccgaggtctgagtctgcccaggtat

SEQ ID NO: 594822 - DNA, 25 bp, Mus musculus
ccgaggtggagacctctttctgaca

SEQ ID NO: 594823 - DNA, 25 bp, Mus musculus
ccgaggtggagagctctttctgaca

SEQ ID NO: 594824 - DNA, 25 bp, Mus musculus
ccgaggtgtcgaccatcaaccagga

SEQ ID NO: 594825 - DNA, 25 bp, Mus musculus
ccgaggtgtcgagcatcaaccagga

SEQ ID NO: 594826 - DNA, 25 bp, Mus musculus
ccgaggttgtgaaacgatgccctaa

SEQ ID NO: 594827 - DNA, 25 bp, Mus musculus
ccgaggttgtgatacgatgccctaa

SEQ ID NO: 594828 - DNA, 25 bp, Mus musculus
ccgagtaaggaacagctagtggcat

SEQ ID NO: 594829 - DNA, 25 bp, Mus musculus
ccgagtaaggaagagctagtggcat

SEQ ID NO: 594830 - DNA, 25 bp, Mus musculus
ccgagtacacagaccccaaggtggt

SEQ ID NO: 594831 - DNA, 25 bp, Mus musculus
ccgagtacacagtccccaaggtggt

SEQ ID NO: 594832 - DNA, 25 bp, Mus musculus
ccgagtagcgttatcgtgagtggct

SEQ ID NO: 594833 - DNA, 25 bp, Mus musculus
ccgagtagcgttttcgtgagtggct

SEQ ID NO: 594834 - DNA, 25 bp, Mus musculus
ccgagtagctggcactcttattggg

SEQ ID NO: 594835 - DNA, 25 bp, Mus musculus
ccgagtagctgggactcttattggg

SEQ ID NO: 594836 - DNA, 25 bp, Mus musculus
ccgagtatgctcatgggtggaaacg

SEQ ID NO: 594837 - DNA, 25 bp, Mus musculus
ccgagtatgctcttgggtggaaacg

SEQ ID NO: 594838 - DNA, 25 bp, Mus musculus
ccgagtcaagagaaggattgtagga

SEQ ID NO: 594839 - DNA, 25 bp, Mus musculus
ccgagtcaagagtaggattgtagga

SEQ ID NO: 594840 - DNA, 25 bp, Mus musculus
ccgagtcatgttaattggtgaaaag

SEQ ID NO: 594841 - DNA, 25 bp, Mus musculus
ccgagtcatgtttattggtgaaaag

SEQ ID NO: 594842 - DNA, 25 bp, Mus musculus
ccgagtccgcgaatggtacggcccg

SEQ ID NO: 594843 - DNA, 25 bp, Mus musculus
ccgagtccgcgattggtacggcccg

SEQ ID NO: 594844 - DNA, 25 bp, Mus musculus
ccgagtctactcagtgtccatctct

SEQ ID NO: 594845 - DNA, 25 bp, Mus musculus
ccgagtctactctgtgtccatctct

SEQ ID NO: 594846 - DNA, 25 bp, Mus musculus
ccgagtctatgacaacgtgggcctc

SEQ ID NO: 594847 - DNA, 25 bp, Mus musculus
ccgagtctatgagaacgtgggcctc

SEQ ID NO: 594848 - DNA, 25 bp, Mus musculus
ccgagtgagccaaacatagtccaga

SEQ ID NO: 594849 - DNA, 25 bp, Mus musculus
ccgagtgagccatacatagtccaga

SEQ ID NO: 594850 - DNA, 25 bp, Mus musculus
ccgagtgcccggatggctccgatga

SEQ ID NO: 594851 - DNA, 25 bp, Mus musculus
ccgagtgcccggttggctccgatga

SEQ ID NO: 594852 - DNA, 25 bp, Mus musculus
ccgagtgcgagcacaggagattaag

SEQ ID NO: 594853 - DNA, 25 bp, Mus musculus
ccgagtgcgagctcaggagattaag

SEQ ID NO: 594854 - DNA, 25 bp, Mus musculus
ccgagtgctgcaagagtcctgtgag

SEQ ID NO: 594855 - DNA, 25 bp, Mus musculus
ccgagtgctgcatgagtcctgtgag

SEQ ID NO: 594856 - DNA, 25 bp, Mus musculus
ccgagtgctggtagcttcccgtaat

SEQ ID NO: 594857 - DNA, 25 bp, Mus musculus
ccgagtgctggttgcttcccgtaat

SEQ ID NO: 594858 - DNA, 25 bp, Mus musculus
ccgagtggtttgcaccagaaggaca

SEQ ID NO: 594859 - DNA, 25 bp, Mus musculus
ccgagtggtttggaccagaaggaca

SEQ ID NO: 594860 - DNA, 25 bp, Mus musculus
ccgagtgtatggcacaggttctttg

SEQ ID NO: 594861 - DNA, 25 bp, Mus musculus
ccgagtgtatgggacaggttctttg

SEQ ID NO: 594862 - DNA, 25 bp, Mus musculus
ccgagtgtggccagcacctagacga

SEQ ID NO: 594863 - DNA, 25 bp, Mus musculus
ccgagtgtggcctgcacctagacga

SEQ ID NO: 594864 - DNA, 25 bp, Mus musculus
ccgagtgttgccaaaagcatgatgg

SEQ ID NO: 594865 - DNA, 25 bp, Mus musculus
ccgagtgttgcctaaagcatgatgg

SEQ ID NO: 594866 - DNA, 25 bp, Mus musculus
ccgagttacaccaaccaggacagaa

SEQ ID NO: 594867 - DNA, 25 bp, Mus musculus
ccgagttacacctaccaggacagaa

SEQ ID NO: 594868 - DNA, 25 bp, Mus musculus
ccgagttatatacatttaggccgct

SEQ ID NO: 594869 - DNA, 25 bp, Mus musculus
ccgagttatatagatttaggccgct

SEQ ID NO: 594870 - DNA, 25 bp, Mus musculus
ccgagttgcaaacggccataaaatg

SEQ ID NO: 594871 - DNA, 25 bp, Mus musculus
ccgagttgcaaagggccataaaatg

SEQ ID NO: 594872 - DNA, 25 bp, Mus musculus
ccgagttgctatcggcacgcccttg

SEQ ID NO: 594873 - DNA, 25 bp, Mus musculus
ccgagttgctatgggcacgcccttg

SEQ ID NO: 594874 - DNA, 25 bp, Mus musculus
ccgagttggaaaagtgaacgcaaga

SEQ ID NO: 594875 - DNA, 25 bp, Mus musculus
ccgagttggaaatgtgaacgcaaga

SEQ ID NO: 594876 - DNA, 25 bp, Mus musculus
ccgagttggtcactgtggtcttgtc

SEQ ID NO: 594877 - DNA, 25 bp, Mus musculus
ccgagttggtcagtgtggtcttgtc

SEQ ID NO: 594878 - DNA, 25 bp, Mus musculus
ccgagttgtgcactgtgtggaccat

SEQ ID NO: 594879 - DNA, 25 bp, Mus musculus
ccgagttgtgcagtgtgtggaccat

SEQ ID NO: 594880 - DNA, 25 bp, Mus musculus
ccgagttgtgcccaaaacctagagg

SEQ ID NO: 594881 - DNA, 25 bp, Mus musculus
ccgagttgtgccgaaaacctagagg

SEQ ID NO: 594882 - DNA, 25 bp, Mus musculus
ccgagtttgtgcacagcggcgcgtt

SEQ ID NO: 594883 - DNA, 25 bp, Mus musculus
ccgagtttgtgctcagcggcgcgtt

SEQ ID NO: 594884 - DNA, 25 bp, Mus musculus
ccgatacaagggaggaagacattcc

SEQ ID NO: 594885 - DNA, 25 bp, Mus musculus
ccgatacaagggtggaagacattcc

SEQ ID NO: 594886 - DNA, 25 bp, Mus musculus
ccgatacttgtcacagctgaaggat

SEQ ID NO: 594887 - DNA, 25 bp, Mus musculus
ccgatacttgtctcagctgaaggat

SEQ ID NO: 594888 - DNA, 25 bp, Mus musculus
ccgatagcagaacggtcaactcttc

SEQ ID NO: 594889 - DNA, 25 bp, Mus musculus
ccgatagcagaagggtcaactcttc

SEQ ID NO: 594890 - DNA, 25 bp, Mus musculus
ccgataggaggtctgctcttcagtc

SEQ ID NO: 594891 - DNA, 25 bp, Mus musculus
ccgataggaggtgtgctcttcagtc

SEQ ID NO: 594892 - DNA, 25 bp, Mus musculus
ccgatagtatagacatggccgactg

SEQ ID NO: 594893 - DNA, 25 bp, Mus musculus
ccgatagtatagtcatggccgactg

SEQ ID NO: 594894 - DNA, 25 bp, Mus musculus
ccgatatgatgacccgttaggaaaa

SEQ ID NO: 594895 - DNA, 25 bp, Mus musculus
ccgatatgatgagccgttaggaaaa

SEQ ID NO: 594896 - DNA, 25 bp, Mus musculus
ccgatcatggaaccttgacaacctg

SEQ ID NO: 594897 - DNA, 25 bp, Mus musculus
ccgatcatggaagcttgacaacctg

SEQ ID NO: 594898 - DNA, 25 bp, Mus musculus
ccgatccacgaaccagtgaagcgag

SEQ ID NO: 594899 - DNA, 25 bp, Mus musculus
ccgatccacgaagcagtgaagcgag

SEQ ID NO: 594900 - DNA, 25 bp, Mus musculus
ccgatcctaaggagctgtcgcctca

SEQ ID NO: 594901 - DNA, 25 bp, Mus musculus
ccgatcctaaggtgctgtcgcctca

SEQ ID NO: 594902 - DNA, 25 bp, Mus musculus
ccgatctctgtaacatatgtatgaa

SEQ ID NO: 594903 - DNA, 25 bp, Mus musculus
ccgatctctgtatcatatgtatgaa

SEQ ID NO: 594904 - DNA, 25 bp, Mus musculus
ccgatctgccccagtgaaaatgtca

SEQ ID NO: 594905 - DNA, 25 bp, Mus musculus
ccgatctgcccctgtgaaaatgtca

SEQ ID NO: 594906 - DNA, 25 bp, Mus musculus
ccgatctgtctgacaaaaccaaaga

SEQ ID NO: 594907 - DNA, 25 bp, Mus musculus
ccgatctgtctgtcaaaaccaaaga

SEQ ID NO: 594908 - DNA, 25 bp, Mus musculus
ccgatgaacgacatcagcctctgct

SEQ ID NO: 594909 - DNA, 25 bp, Mus musculus
ccgatgaacgacttcagcctctgct

SEQ ID NO: 594910 - DNA, 25 bp, Mus musculus
ccgatgaatgtgaactgtttgggcc

SEQ ID NO: 594911 - DNA, 25 bp, Mus musculus
ccgatgaatgtgtactgtttgggcc

SEQ ID NO: 594912 - DNA, 25 bp, Mus musculus
ccgatgactgcgctggagatccagc

SEQ ID NO: 594913 - DNA, 25 bp, Mus musculus
ccgatgactgcggtggagatccagc

SEQ ID NO: 594914 - DNA, 25 bp, Mus musculus
ccgatgactgtaatgtggaaggagc

SEQ ID NO: 594915 - DNA, 25 bp, Mus musculus
ccgatgactgtattgtggaaggagc

SEQ ID NO: 594916 - DNA, 25 bp, Mus musculus
ccgatgcactgtactaaggaagcaa

SEQ ID NO: 594917 - DNA, 25 bp, Mus musculus
ccgatgcactgttctaaggaagcaa

SEQ ID NO: 594918 - DNA, 25 bp, Mus musculus
ccgatgcagttcagggcgttctcca

SEQ ID NO: 594919 - DNA, 25 bp, Mus musculus
ccgatgcagttctgggcgttctcca

SEQ ID NO: 594920 - DNA, 25 bp, Mus musculus
ccgatgcagttgagtcccatcctgc

SEQ ID NO: 594921 - DNA, 25 bp, Mus musculus
ccgatgcagttgtgtcccatcctgc

SEQ ID NO: 594922 - DNA, 25 bp, Mus musculus
ccgatgcatggtctgtatatgagcc

SEQ ID NO: 594923 - DNA, 25 bp, Mus musculus
ccgatgcatggtgtgtatatgagcc

SEQ ID NO: 594924 - DNA, 25 bp, Mus musculus
ccgatgcccagtatctaaaagccag

SEQ ID NO: 594925 - DNA, 25 bp, Mus musculus
ccgatgcccagtttctaaaagccag

SEQ ID NO: 594926 - DNA, 25 bp, Mus musculus
ccgatgctagcacgggtctccgagt

SEQ ID NO: 594927 - DNA, 25 bp, Mus musculus
ccgatgctagcaggggtctccgagt

SEQ ID NO: 594928 - DNA, 25 bp, Mus musculus
ccgatgctcagtaggctgggatgcc

SEQ ID NO: 594929 - DNA, 25 bp, Mus musculus
ccgatgctcagttggctgggatgcc

SEQ ID NO: 594930 - DNA, 25 bp, Mus musculus
ccgatggaccggattgcaagaggcc

SEQ ID NO: 594931 - DNA, 25 bp, Mus musculus
ccgatggaccggtttgcaagaggcc

SEQ ID NO: 594932 - DNA, 25 bp, Mus musculus
ccgatggagagtccatcgtggttat

SEQ ID NO: 594933 - DNA, 25 bp, Mus musculus
ccgatggagagtgcatcgtggttat

SEQ ID NO: 594934 - DNA, 25 bp, Mus musculus
ccgatggagccacattttgcaggat

SEQ ID NO: 594935 - DNA, 25 bp, Mus musculus
ccgatggagccagattttgcaggat

SEQ ID NO: 594936 - DNA, 25 bp, Mus musculus
ccgatggagcccaggtgctgagctt

SEQ ID NO: 594937 - DNA, 25 bp, Mus musculus
ccgatggagccctggtgctgagctt

SEQ ID NO: 594938 - DNA, 25 bp, Mus musculus
ccgatggcatcaacacagccttctg

SEQ ID NO: 594939 - DNA, 25 bp, Mus musculus
ccgatggcatcatcacagccttctg

SEQ ID NO: 594940 - DNA, 25 bp, Mus musculus
ccgatggcgagaatatggtgccttg

SEQ ID NO: 594941 - DNA, 25 bp, Mus musculus
ccgatggcgagattatggtgccttg

SEQ ID NO: 594942 - DNA, 25 bp, Mus musculus
ccgatggctgcacaggacaacccgg

SEQ ID NO: 594943 - DNA, 25 bp, Mus musculus
ccgatggctgcagaggacaacccgg

SEQ ID NO: 594944 - DNA, 25 bp, Mus musculus
ccgatgggacccagacaagactgga

SEQ ID NO: 594945 - DNA, 25 bp, Mus musculus
ccgatgggaccctgacaagactgga

SEQ ID NO: 594946 - DNA, 25 bp, Mus musculus
ccgatgggcacacaactgggcgact

SEQ ID NO: 594947 - DNA, 25 bp, Mus musculus
ccgatgggcacagaactgggcgact

SEQ ID NO: 594948 - DNA, 25 bp, Mus musculus
ccgatgtaagcaccgaaagggtgat

SEQ ID NO: 594949 - DNA, 25 bp, Mus musculus
ccgatgtaagcagcgaaagggtgat

SEQ ID NO: 594950 - DNA, 25 bp, Mus musculus
ccgatgtcagttctaaggattctca

SEQ ID NO: 594951 - DNA, 25 bp, Mus musculus
ccgatgtcagttgtaaggattctca

SEQ ID NO: 594952 - DNA, 25 bp, Mus musculus
ccgatgtggaaaccttcgatttaag

SEQ ID NO: 594953 - DNA, 25 bp, Mus musculus
ccgatgtggaaagcttcgatttaag

SEQ ID NO: 594954 - DNA, 25 bp, Mus musculus
ccgatgtggacccagagatggccaa

SEQ ID NO: 594955 - DNA, 25 bp, Mus musculus
ccgatgtggaccgagagatggccaa

SEQ ID NO: 594956 - DNA, 25 bp, Mus musculus
ccgatgttatgtccgtgacaaggag

SEQ ID NO: 594957 - DNA, 25 bp, Mus musculus
ccgatgttatgtgcgtgacaaggag

SEQ ID NO: 594958 - DNA, 25 bp, Mus musculus
ccgatgttgtcgacagtaggctcat

SEQ ID NO: 594959 - DNA, 25 bp, Mus musculus
ccgatgttgtcgtcagtaggctcat

SEQ ID NO: 594960 - DNA, 25 bp, Mus musculus
ccgattatttaccagggcctgccca

SEQ ID NO: 594961 - DNA, 25 bp, Mus musculus
ccgattatttacgagggcctgccca

SEQ ID NO: 594962 - DNA, 25 bp, Mus musculus
ccgattcagacgaggaggaagtgac

SEQ ID NO: 594963 - DNA, 25 bp, Mus musculus
ccgattcagacgtggaggaagtgac

SEQ ID NO: 594964 - DNA, 25 bp, Mus musculus
ccgattcctatgaagtgctgtgctg

SEQ ID NO: 594965 - DNA, 25 bp, Mus musculus
ccgattcctatgtagtgctgtgctg

SEQ ID NO: 594966 - DNA, 25 bp, Mus musculus
ccgattctgtagatgggtggaccag

SEQ ID NO: 594967 - DNA, 25 bp, Mus musculus
ccgattctgtagttgggtggaccag

SEQ ID NO: 594968 - DNA, 25 bp, Mus musculus
ccgattcttagaagatggacaaatc

SEQ ID NO: 594969 - DNA, 25 bp, Mus musculus
ccgattcttagatgatggacaaatc

SEQ ID NO: 594970 - DNA, 25 bp, Mus musculus
ccgattgcaagtacgtgaaggcgca

SEQ ID NO: 594971 - DNA, 25 bp, Mus musculus
ccgattgcaagttcgtgaaggcgca

SEQ ID NO: 594972 - DNA, 25 bp, Mus musculus
ccgattggacatcagcgtgagcgcc

SEQ ID NO: 594973 - DNA, 25 bp, Mus musculus
ccgattggacatgagcgtgagcgcc

SEQ ID NO: 594974 - DNA, 25 bp, Mus musculus
ccgattgggccaagtggttgattat

SEQ ID NO: 594975 - DNA, 25 bp, Mus musculus
ccgattgggccatgtggttgattat

SEQ ID NO: 594976 - DNA, 25 bp, Mus musculus
ccgattggtggtctgagcccatgac

SEQ ID NO: 594977 - DNA, 25 bp, Mus musculus
ccgattggtggtgtgagcccatgac

SEQ ID NO: 594978 - DNA, 25 bp, Mus musculus
ccgattgtgaggcaatcatttctaa

SEQ ID NO: 594979 - DNA, 25 bp, Mus musculus
ccgattgtgagggaatcatttctaa

SEQ ID NO: 594980 - DNA, 25 bp, Mus musculus
ccgatttcagatccaaaggaactta

SEQ ID NO: 594981 - DNA, 25 bp, Mus musculus
ccgatttcagatgcaaaggaactta

SEQ ID NO: 594982 - DNA, 25 bp, Mus musculus
ccgatttccatgaatggaggcacca

SEQ ID NO: 594983 - DNA, 25 bp, Mus musculus
ccgatttccatgtatggaggcacca

SEQ ID NO: 594984 - DNA, 25 bp, Mus musculus
ccgatttccgacaattccagatgat

SEQ ID NO: 594985 - DNA, 25 bp, Mus musculus
ccgatttccgactattccagatgat

SEQ ID NO: 594986 - DNA, 25 bp, Mus musculus
ccgcaaacagcacaatgtggaccgt

SEQ ID NO: 594987 - DNA, 25 bp, Mus musculus
ccgcaaacagcagaatgtggaccgt

SEQ ID NO: 594988 - DNA, 25 bp, Mus musculus
ccgcaaactggacaaactgattaaa

SEQ ID NO: 594989 - DNA, 25 bp, Mus musculus
ccgcaaactggagaaactgattaaa

SEQ ID NO: 594990 - DNA, 25 bp, Mus musculus
ccgcaaagatgaagaattagacccc

SEQ ID NO: 594991 - DNA, 25 bp, Mus musculus
ccgcaaagatgatgaattagacccc

SEQ ID NO: 594992 - DNA, 25 bp, Mus musculus
ccgcaaagcgggagaagctcacgtt

SEQ ID NO: 594993 - DNA, 25 bp, Mus musculus
ccgcaaagcgggtgaagctcacgtt

SEQ ID NO: 594994 - DNA, 25 bp, Mus musculus
ccgcaacccattagacttcgctagt

SEQ ID NO: 594995 - DNA, 25 bp, Mus musculus
ccgcaacccatttgacttcgctagt

SEQ ID NO: 594996 - DNA, 25 bp, Mus musculus
ccgcaacggcaactatgatctggac

SEQ ID NO: 594997 - DNA, 25 bp, Mus musculus
ccgcaacggcaagtatgatctggac

SEQ ID NO: 594998 - DNA, 25 bp, Mus musculus
ccgcaagaaacccagataattcagg

SEQ ID NO: 594999 - DNA, 25 bp, Mus musculus
ccgcaagaaaccgagataattcagg

SEQ ID NO: 595000 - DNA, 25 bp, Mus musculus
ccgcaagatgatcgctgacgaggcc

SEQ ID NO: 595001 - DNA, 25 bp, Mus musculus
ccgcaagatgatggctgacgaggcc

SEQ ID NO: 595002 - DNA, 25 bp, Mus musculus
ccgcaaggaagacgtgtcaactctg

SEQ ID NO: 595003 - DNA, 25 bp, Mus musculus
ccgcaaggaagaggtgtcaactctg

SEQ ID NO: 595004 - DNA, 25 bp, Mus musculus
ccgcaagtctatccgtcagtctaca

SEQ ID NO: 595005 - DNA, 25 bp, Mus musculus
ccgcaagtctatgcgtcagtctaca

SEQ ID NO: 595006 - DNA, 25 bp, Mus musculus
ccgcaagtgctaccgcatggttgga

SEQ ID NO: 595007 - DNA, 25 bp, Mus musculus
ccgcaagtgctagcgcatggttgga

SEQ ID NO: 595008 - DNA, 25 bp, Mus musculus
ccgcacaaagatagggtccctccag

SEQ ID NO: 595009 - DNA, 25 bp, Mus musculus
ccgcacaaagattgggtccctccag

SEQ ID NO: 595010 - DNA, 25 bp, Mus musculus
ccgcacattcgcatggtggaccagc

SEQ ID NO: 595011 - DNA, 25 bp, Mus musculus
ccgcacattcgcttggtggaccagc

SEQ ID NO: 595012 - DNA, 25 bp, Mus musculus
ccgcaccatgcgagaggccaagtat

SEQ ID NO: 595013 - DNA, 25 bp, Mus musculus
ccgcaccatgcgtgaggccaagtat

SEQ ID NO: 595014 - DNA, 25 bp, Mus musculus
ccgcacctggtgaagaagtatattg

SEQ ID NO: 595015 - DNA, 25 bp, Mus musculus
ccgcacctggtgtagaagtatattg

SEQ ID NO: 595016 - DNA, 25 bp, Mus musculus
ccgcacgcggtcagcggagcgtctt

SEQ ID NO: 595017 - DNA, 25 bp, Mus musculus
ccgcacgcggtctgcggagcgtctt

SEQ ID NO: 595018 - DNA, 25 bp, Mus musculus
ccgcactgtgaaactgctgcttctg

SEQ ID NO: 595019 - DNA, 25 bp, Mus musculus
ccgcactgtgaatctgctgcttctg

SEQ ID NO: 595020 - DNA, 25 bp, Mus musculus
ccgcacttcagaaactccgtggaca

SEQ ID NO: 595021 - DNA, 25 bp, Mus musculus
ccgcacttcagatactccgtggaca

SEQ ID NO: 595022 - DNA, 25 bp, Mus musculus
ccgcagccaggaccgagccaaggat

SEQ ID NO: 595023 - DNA, 25 bp, Mus musculus
ccgcagccaggagcgagccaaggat

SEQ ID NO: 595024 - DNA, 25 bp, Mus musculus
ccgcagccgagcaagcaagattcga

SEQ ID NO: 595025 - DNA, 25 bp, Mus musculus
ccgcagccgagctagcaagattcga

SEQ ID NO: 595026 - DNA, 25 bp, Mus musculus
ccgcagctcagtagggtagcacagc

SEQ ID NO: 595027 - DNA, 25 bp, Mus musculus
ccgcagctcagttgggtagcacagc

SEQ ID NO: 595028 - DNA, 25 bp, Mus musculus
ccgcagctctggcagatgagaccat

SEQ ID NO: 595029 - DNA, 25 bp, Mus musculus
ccgcagctctgggagatgagaccat

SEQ ID NO: 595030 - DNA, 25 bp, Mus musculus
ccgcaggattgccaagttctctgac

SEQ ID NO: 595031 - DNA, 25 bp, Mus musculus
ccgcaggattgcgaagttctctgac

SEQ ID NO: 595032 - DNA, 25 bp, Mus musculus
ccgcaggattggaggtcccgccgct

SEQ ID NO: 595033 - DNA, 25 bp, Mus musculus
ccgcaggattggtggtcccgccgct

SEQ ID NO: 595034 - DNA, 25 bp, Mus musculus
ccgcagggtcagagccaagacatct

SEQ ID NO: 595035 - DNA, 25 bp, Mus musculus
ccgcagggtcagtgccaagacatct

SEQ ID NO: 595036 - DNA, 25 bp, Mus musculus
ccgcaggtcgtccttgagagctcgt

SEQ ID NO: 595037 - DNA, 25 bp, Mus musculus
ccgcaggtcgtcgttgagagctcgt

SEQ ID NO: 595038 - DNA, 25 bp, Mus musculus
ccgcaggtggctaaggctggatttt

SEQ ID NO: 595039 - DNA, 25 bp, Mus musculus
ccgcaggtggcttaggctggatttt

SEQ ID NO: 595040 - DNA, 25 bp, Mus musculus
ccgcagtgctttcggctgcgagcct

SEQ ID NO: 595041 - DNA, 25 bp, Mus musculus
ccgcagtgctttgggctgcgagcct

SEQ ID NO: 595042 - DNA, 25 bp, Mus musculus
ccgcagtgtgacctgtttggatact

SEQ ID NO: 595043 - DNA, 25 bp, Mus musculus
ccgcagtgtgacgtgtttggatact

SEQ ID NO: 595044 - DNA, 25 bp, Mus musculus
ccgcagttgtccagaagcgctttgg

SEQ ID NO: 595045 - DNA, 25 bp, Mus musculus
ccgcagttgtcctgaagcgctttgg

SEQ ID NO: 595046 - DNA, 25 bp, Mus musculus
ccgcagtttccgctcagagtgtgag

SEQ ID NO: 595047 - DNA, 25 bp, Mus musculus
ccgcagtttccggtcagagtgtgag

SEQ ID NO: 595048 - DNA, 25 bp, Mus musculus
ccgcataactcaacagaatggtttg

SEQ ID NO: 595049 - DNA, 25 bp, Mus musculus
ccgcataactcatcagaatggtttg

SEQ ID NO: 595050 - DNA, 25 bp, Mus musculus
ccgcatattttgcatctgggtcttc

SEQ ID NO: 595051 - DNA, 25 bp, Mus musculus
ccgcatattttggatctgggtcttc

SEQ ID NO: 595052 - DNA, 25 bp, Mus musculus
ccgcatcaacggcaaacaagaagag

SEQ ID NO: 595053 - DNA, 25 bp, Mus musculus
ccgcatcaacgggaaacaagaagag

SEQ ID NO: 595054 - DNA, 25 bp, Mus musculus
ccgcatcaccgcagtctgtctggat

SEQ ID NO: 595055 - DNA, 25 bp, Mus musculus
ccgcatcaccgctgtctgtctggat

SEQ ID NO: 595056 - DNA, 25 bp, Mus musculus
ccgcatcactgcagaatccgtttgg

SEQ ID NO: 595057 - DNA, 25 bp, Mus musculus
ccgcatcactgctgaatccgtttgg

SEQ ID NO: 595058 - DNA, 25 bp, Mus musculus
ccgcatcagtcgcttggccagcttt

SEQ ID NO: 595059 - DNA, 25 bp, Mus musculus
ccgcatcagtcggttggccagcttt

SEQ ID NO: 595060 - DNA, 25 bp, Mus musculus
ccgcatcgcacacgctgtgaagact

SEQ ID NO: 595061 - DNA, 25 bp, Mus musculus
ccgcatcgcacaggctgtgaagact

SEQ ID NO: 595062 - DNA, 25 bp, Mus musculus
ccgcatctgtgaccttctctcggat

SEQ ID NO: 595063 - DNA, 25 bp, Mus musculus
ccgcatctgtgagcttctctcggat

SEQ ID NO: 595064 - DNA, 25 bp, Mus musculus
ccgcatgcgtcccaagctggaaatg

SEQ ID NO: 595065 - DNA, 25 bp, Mus musculus
ccgcatgcgtccgaagctggaaatg

SEQ ID NO: 595066 - DNA, 25 bp, Mus musculus
ccgcatggacgaccagcgtgtaaca

SEQ ID NO: 595067 - DNA, 25 bp, Mus musculus
ccgcatggacgagcagcgtgtaaca

SEQ ID NO: 595068 - DNA, 25 bp, Mus musculus
ccgcatgggctaccagtgcaccttt

SEQ ID NO: 595069 - DNA, 25 bp, Mus musculus
ccgcatgggctagcagtgcaccttt

SEQ ID NO: 595070 - DNA, 25 bp, Mus musculus
ccgcattggcaaaggctcatttggg

SEQ ID NO: 595071 - DNA, 25 bp, Mus musculus
ccgcattggcaatggctcatttggg

SEQ ID NO: 595072 - DNA, 25 bp, Mus musculus
ccgcattggcatctttgggcaggat

SEQ ID NO: 595073 - DNA, 25 bp, Mus musculus
ccgcattggcatgtttgggcaggat

SEQ ID NO: 595074 - DNA, 25 bp, Mus musculus
ccgcatttgacgatggaggctgtga

SEQ ID NO: 595075 - DNA, 25 bp, Mus musculus
ccgcatttgacgttggaggctgtga

SEQ ID NO: 595076 - DNA, 25 bp, Mus musculus
ccgcatttgtgaattggatgtgcac

SEQ ID NO: 595077 - DNA, 25 bp, Mus musculus
ccgcatttgtgatttggatgtgcac

SEQ ID NO: 595078 - DNA, 25 bp, Mus musculus
ccgccaagaatgcacattcacattg

SEQ ID NO: 595079 - DNA, 25 bp, Mus musculus
ccgccaagaatggacattcacattg

SEQ ID NO: 595080 - DNA, 25 bp, Mus musculus
ccgccacaaaaactgccgggagagg

SEQ ID NO: 595081 - DNA, 25 bp, Mus musculus
ccgccacaaaaagtgccgggagagg

SEQ ID NO: 595082 - DNA, 25 bp, Mus musculus
ccgccacaagccagggaagtttgaa

SEQ ID NO: 595083 - DNA, 25 bp, Mus musculus
ccgccacaagcctgggaagtttgaa

SEQ ID NO: 595084 - DNA, 25 bp, Mus musculus
ccgccacctggtcggagtgtgctac

SEQ ID NO: 595085 - DNA, 25 bp, Mus musculus
ccgccacctggtgggagtgtgctac

SEQ ID NO: 595086 - DNA, 25 bp, Mus musculus
ccgccactcgataagtatgcctgtc

SEQ ID NO: 595087 - DNA, 25 bp, Mus musculus
ccgccactcgattagtatgcctgtc

SEQ ID NO: 595088 - DNA, 25 bp, Mus musculus
ccgccagaagtacaagcgacggctg

SEQ ID NO: 595089 - DNA, 25 bp, Mus musculus
ccgccagaagtagaagcgacggctg

SEQ ID NO: 595090 - DNA, 25 bp, Mus musculus
ccgccagcaaaacaccgctgaagat

SEQ ID NO: 595091 - DNA, 25 bp, Mus musculus
ccgccagcaaaagaccgctgaagat

SEQ ID NO: 595092 - DNA, 25 bp, Mus musculus
ccgccagcaggccaagctgaaggaa

SEQ ID NO: 595093 - DNA, 25 bp, Mus musculus
ccgccagcaggcgaagctgaaggaa

SEQ ID NO: 595094 - DNA, 25 bp, Mus musculus
ccgccaggaaaccttcacttgtcag

SEQ ID NO: 595095 - DNA, 25 bp, Mus musculus
ccgccaggaaacgttcacttgtcag

SEQ ID NO: 595096 - DNA, 25 bp, Mus musculus
ccgccaggatcacgtctagaggaga

SEQ ID NO: 595097 - DNA, 25 bp, Mus musculus
ccgccaggatcaggtctagaggaga

SEQ ID NO: 595098 - DNA, 25 bp, Mus musculus
ccgccatcacggacttcctgtggga

SEQ ID NO: 595099 - DNA, 25 bp, Mus musculus
ccgccatcacggtcttcctgtggga

SEQ ID NO: 595100 - DNA, 25 bp, Mus musculus
ccgccatcttggatggcgggagtta

SEQ ID NO: 595101 - DNA, 25 bp, Mus musculus
ccgccatcttggttggcgggagtta

SEQ ID NO: 595102 - DNA, 25 bp, Mus musculus
ccgccatcttgtcggagcgaaacca

SEQ ID NO: 595103 - DNA, 25 bp, Mus musculus
ccgccatcttgtctcggctgctggg

SEQ ID NO: 595104 - DNA, 25 bp, Mus musculus
ccgccatcttgtgggagcgaaacca

SEQ ID NO: 595105 - DNA, 25 bp, Mus musculus
ccgccatcttgtgtcggctgctggg

SEQ ID NO: 595106 - DNA, 25 bp, Mus musculus
ccgccatgctgtatgagaagcagca

SEQ ID NO: 595107 - DNA, 25 bp, Mus musculus
ccgccatgctgtttgagaagcagca

SEQ ID NO: 595108 - DNA, 25 bp, Mus musculus
ccgccatgggacagaacgacctgat

SEQ ID NO: 595109 - DNA, 25 bp, Mus musculus
ccgccatgggactgaacgacctgat

SEQ ID NO: 595110 - DNA, 25 bp, Mus musculus
ccgcccaggcagagtatgtggagaa

SEQ ID NO: 595111 - DNA, 25 bp, Mus musculus
ccgcccaggcagtgtatgtggagaa

SEQ ID NO: 595112 - DNA, 25 bp, Mus musculus
ccgcccaggcttaccgtggagacgg

SEQ ID NO: 595113 - DNA, 25 bp, Mus musculus
ccgcccaggctttccgtggagacgg

SEQ ID NO: 595114 - DNA, 25 bp, Mus musculus
ccgcccagtggcatcacaagctgta

SEQ ID NO: 595115 - DNA, 25 bp, Mus musculus
ccgcccagtggcttcacaagctgta

SEQ ID NO: 595116 - DNA, 25 bp, Mus musculus
ccgccccgaaggatggccttggatg

SEQ ID NO: 595117 - DNA, 25 bp, Mus musculus
ccgccccgaaggttggccttggatg

SEQ ID NO: 595118 - DNA, 25 bp, Mus musculus
ccgcccgagcaaagtttgatgcgaa

SEQ ID NO: 595119 - DNA, 25 bp, Mus musculus
ccgcccgagcaatgtttgatgcgaa

SEQ ID NO: 595120 - DNA, 25 bp, Mus musculus
ccgcccggatgtattgacagtgacc

SEQ ID NO: 595121 - DNA, 25 bp, Mus musculus
ccgcccggatgttttgacagtgacc

SEQ ID NO: 595122 - DNA, 25 bp, Mus musculus
ccgcccgtggatacatctgtaggtg

SEQ ID NO: 595123 - DNA, 25 bp, Mus musculus
ccgcccgtggattcatctgtaggtg

SEQ ID NO: 595124 - DNA, 25 bp, Mus musculus
ccgccctagagacgtgtttcattca

SEQ ID NO: 595125 - DNA, 25 bp, Mus musculus
ccgccctagagaggtgtttcattca

SEQ ID NO: 595126 - DNA, 25 bp, Mus musculus
ccgcccttacatcgcacgtgtgagg

SEQ ID NO: 595127 - DNA, 25 bp, Mus musculus
ccgcccttacatggcacgtgtgagg

SEQ ID NO: 595128 - DNA, 25 bp, Mus musculus
ccgccgaaagaccaggtatgatcgc

SEQ ID NO: 595129 - DNA, 25 bp, Mus musculus
ccgccgaaagacgaggtatgatcgc

SEQ ID NO: 595130 - DNA, 25 bp, Mus musculus
ccgccgaattgtagtggtgttgcag

SEQ ID NO: 595131 - DNA, 25 bp, Mus musculus
ccgccgaattgttgtggtgttgcag

SEQ ID NO: 595132 - DNA, 25 bp, Mus musculus
ccgccgactctcagaagttctggga

SEQ ID NO: 595133 - DNA, 25 bp, Mus musculus
ccgccgactctctgaagttctggga

SEQ ID NO: 595134 - DNA, 25 bp, Mus musculus
ccgccgagacctcaactttgagcga

SEQ ID NO: 595135 - DNA, 25 bp, Mus musculus
ccgccgagacctgaactttgagcga

SEQ ID NO: 595136 - DNA, 25 bp, Mus musculus
ccgccgagtatcagcagcacagcat

SEQ ID NO: 595137 - DNA, 25 bp, Mus musculus
ccgccgagtatctgcagcacagcat

SEQ ID NO: 595138 - DNA, 25 bp, Mus musculus
ccgccgcaaagaaggaggagccgtc

SEQ ID NO: 595139 - DNA, 25 bp, Mus musculus
ccgccgcaaagatggaggagccgtc

SEQ ID NO: 595140 - DNA, 25 bp, Mus musculus
ccgccgcccggcagttatgtattct

SEQ ID NO: 595141 - DNA, 25 bp, Mus musculus
ccgccgcccggctgttatgtattct

SEQ ID NO: 595142 - DNA, 25 bp, Mus musculus
ccgccgcctggcatactggcggaag

SEQ ID NO: 595143 - DNA, 25 bp, Mus musculus
ccgccgcctggcttactggcggaag

SEQ ID NO: 595144 - DNA, 25 bp, Mus musculus
ccgccgcttagacagactcctttga

SEQ ID NO: 595145 - DNA, 25 bp, Mus musculus
ccgccgcttagagagactcctttga

SEQ ID NO: 595146 - DNA, 25 bp, Mus musculus
ccgccgctttgtctctgggagataa

SEQ ID NO: 595147 - DNA, 25 bp, Mus musculus
ccgccgctttgtgtctgggagataa

SEQ ID NO: 595148 - DNA, 25 bp, Mus musculus
ccgccggaaagaccgagcaaaatct

SEQ ID NO: 595149 - DNA, 25 bp, Mus musculus
ccgccggaaagagcgagcaaaatct

SEQ ID NO: 595150 - DNA, 25 bp, Mus musculus
ccgccggaagcccaactatagcgag

SEQ ID NO: 595151 - DNA, 25 bp, Mus musculus
ccgccggaagccgaactatagcgag

SEQ ID NO: 595152 - DNA, 25 bp, Mus musculus
ccgccggacgggactctaagatgaa

SEQ ID NO: 595153 - DNA, 25 bp, Mus musculus
ccgccggacgggtctctaagatgaa

SEQ ID NO: 595154 - DNA, 25 bp, Mus musculus
ccgccggagctgagtagtatggcat

SEQ ID NO: 595155 - DNA, 25 bp, Mus musculus
ccgccggagctgtgtagtatggcat

SEQ ID NO: 595156 - DNA, 25 bp, Mus musculus
ccgccgggtgctagctctatggcga

SEQ ID NO: 595157 - DNA, 25 bp, Mus musculus
ccgccgggtgcttgctctatggcga

SEQ ID NO: 595158 - DNA, 25 bp, Mus musculus
ccgccgggtgtcagtggctcgattc

SEQ ID NO: 595159 - DNA, 25 bp, Mus musculus
ccgccgggtgtctgtggctcgattc

SEQ ID NO: 595160 - DNA, 25 bp, Mus musculus
ccgccggtaagacgcttctcgaagc

SEQ ID NO: 595161 - DNA, 25 bp, Mus musculus
ccgccggtaagaggcttctcgaagc

SEQ ID NO: 595162 - DNA, 25 bp, Mus musculus
ccgccggttataatgttgaacagga

SEQ ID NO: 595163 - DNA, 25 bp, Mus musculus
ccgccggttatattgttgaacagga

SEQ ID NO: 595164 - DNA, 25 bp, Mus musculus
ccgccgtccagtagaaaacagcagg

SEQ ID NO: 595165 - DNA, 25 bp, Mus musculus
ccgccgtccagttgaaaacagcagg

SEQ ID NO: 595166 - DNA, 25 bp, Mus musculus
ccgccgtgatcacttggactaagga

SEQ ID NO: 595167 - DNA, 25 bp, Mus musculus
ccgccgtgatcagttggactaagga

SEQ ID NO: 595168 - DNA, 25 bp, Mus musculus
ccgcctaagagtcgcgctgtaagaa

SEQ ID NO: 595169 - DNA, 25 bp, Mus musculus
ccgcctaagagtggcgctgtaagaa

SEQ ID NO: 595170 - DNA, 25 bp, Mus musculus
ccgcctacgcagcaggtcgtgtgac

SEQ ID NO: 595171 - DNA, 25 bp, Mus musculus
ccgcctacgcaggaggtcgtgtgac

SEQ ID NO: 595172 - DNA, 25 bp, Mus musculus
ccgcctagaagacgaactggtgatg

SEQ ID NO: 595173 - DNA, 25 bp, Mus musculus
ccgcctagaagaggaactggtgatg

SEQ ID NO: 595174 - DNA, 25 bp, Mus musculus
ccgcctagaaggcttgtagcattat

SEQ ID NO: 595175 - DNA, 25 bp, Mus musculus
ccgcctagaagggttgtagcattat

SEQ ID NO: 595176 - DNA, 25 bp, Mus musculus
ccgcctagcagcacctgggagaaga

SEQ ID NO: 595177 - DNA, 25 bp, Mus musculus
ccgcctagcagctcctgggagaaga

SEQ ID NO: 595178 - DNA, 25 bp, Mus musculus
ccgcctccgaggagttgagaccgag

SEQ ID NO: 595179 - DNA, 25 bp, Mus musculus
ccgcctccgaggtgttgagaccgag

SEQ ID NO: 595180 - DNA, 25 bp, Mus musculus
ccgcctcgggccacagttgagtagt

SEQ ID NO: 595181 - DNA, 25 bp, Mus musculus
ccgcctcgggcctcagttgagtagt

SEQ ID NO: 595182 - DNA, 25 bp, Mus musculus
ccgcctctgggcaggcatcgtgttc

SEQ ID NO: 595183 - DNA, 25 bp, Mus musculus
ccgcctctgggctggcatcgtgttc

SEQ ID NO: 595184 - DNA, 25 bp, Mus musculus
ccgcctgaagaacattctcattgag

SEQ ID NO: 595185 - DNA, 25 bp, Mus musculus
ccgcctgaagaagattctcattgag

SEQ ID NO: 595186 - DNA, 25 bp, Mus musculus
ccgcctgaggtcaggcagtcagtga

SEQ ID NO: 595187 - DNA, 25 bp, Mus musculus
ccgcctgaggtctggcagtcagtga

SEQ ID NO: 595188 - DNA, 25 bp, Mus musculus
ccgcctgcaggacatttacaaccga

SEQ ID NO: 595189 - DNA, 25 bp, Mus musculus
ccgcctgcaggagatttacaaccga

SEQ ID NO: 595190 - DNA, 25 bp, Mus musculus
ccgcctgccacgaaaagaatttcta

SEQ ID NO: 595191 - DNA, 25 bp, Mus musculus
ccgcctgccacgtaaagaatttcta

SEQ ID NO: 595192 - DNA, 25 bp, Mus musculus
ccgcctgcgccaaaggctgtgacta

SEQ ID NO: 595193 - DNA, 25 bp, Mus musculus
ccgcctgcgccataggctgtgacta

SEQ ID NO: 595194 - DNA, 25 bp, Mus musculus
ccgcctggaacacggaagactctgc

SEQ ID NO: 595195 - DNA, 25 bp, Mus musculus
ccgcctggaacagggaagactctgc

SEQ ID NO: 595196 - DNA, 25 bp, Mus musculus
ccgcctggcctcctatatggagaag

SEQ ID NO: 595197 - DNA, 25 bp, Mus musculus
ccgcctggcctcgtatatggagaag

SEQ ID NO: 595198 - DNA, 25 bp, Mus musculus
ccgcctgggccaagatatcatcgat

SEQ ID NO: 595199 - DNA, 25 bp, Mus musculus
ccgcctgggccatgatatcatcgat

SEQ ID NO: 595200 - DNA, 25 bp, Mus musculus
ccgcctgtgctactttaagaagtct

SEQ ID NO: 595201 - DNA, 25 bp, Mus musculus
ccgcctgtgctagtttaagaagtct

SEQ ID NO: 595202 - DNA, 25 bp, Mus musculus
ccgccttcacagacctaatcaagaa

SEQ ID NO: 595203 - DNA, 25 bp, Mus musculus
ccgccttcacagtcctaatcaagaa

SEQ ID NO: 595204 - DNA, 25 bp, Mus musculus
ccgccttgatacaggcatggacagc

SEQ ID NO: 595205 - DNA, 25 bp, Mus musculus
ccgccttgatactggcatggacagc

SEQ ID NO: 595206 - DNA, 25 bp, Mus musculus
ccgccttggacccagatacagaggg

SEQ ID NO: 595207 - DNA, 25 bp, Mus musculus
ccgccttggaccgagatacagaggg

SEQ ID NO: 595208 - DNA, 25 bp, Mus musculus
ccgccttgggccctgaaagtgtcca

SEQ ID NO: 595209 - DNA, 25 bp, Mus musculus
ccgccttgggccgtgaaagtgtcca

SEQ ID NO: 595210 - DNA, 25 bp, Mus musculus
ccgccttgtggcacagaccgagaat

SEQ ID NO: 595211 - DNA, 25 bp, Mus musculus
ccgccttgtggctcagaccgagaat

SEQ ID NO: 595212 - DNA, 25 bp, Mus musculus
ccgcgaacaggaatgagtagcggcc

SEQ ID NO: 595213 - DNA, 25 bp, Mus musculus
ccgcgaacaggattgagtagcggcc

SEQ ID NO: 595214 - DNA, 25 bp, Mus musculus
ccgcgacgtgagcagcatcttcgag

SEQ ID NO: 595215 - DNA, 25 bp, Mus musculus
ccgcgacgtgaggagcatcttcgag

SEQ ID NO: 595216 - DNA, 25 bp, Mus musculus
ccgcgactgccacgactggtcggat

SEQ ID NO: 595217 - DNA, 25 bp, Mus musculus
ccgcgactgccaggactggtcggat

SEQ ID NO: 595218 - DNA, 25 bp, Mus musculus
ccgcgagcaggacaataagtacata

SEQ ID NO: 595219 - DNA, 25 bp, Mus musculus
ccgcgagcaggagaataagtacata

SEQ ID NO: 595220 - DNA, 25 bp, Mus musculus
ccgcgaggccttacttgaggaggtc

SEQ ID NO: 595221 - DNA, 25 bp, Mus musculus
ccgcgaggcctttcttgaggaggtc

SEQ ID NO: 595222 - DNA, 25 bp, Mus musculus
ccgcgatagagcagccatcccaatt

SEQ ID NO: 595223 - DNA, 25 bp, Mus musculus
ccgcgatagagctgccatcccaatt

SEQ ID NO: 595224 - DNA, 25 bp, Mus musculus
ccgcgatccctactgtgcctgggat

SEQ ID NO: 595225 - DNA, 25 bp, Mus musculus
ccgcgatccctagtgtgcctgggat

SEQ ID NO: 595226 - DNA, 25 bp, Mus musculus
ccgcgatgggtcatatgatatgcag

SEQ ID NO: 595227 - DNA, 25 bp, Mus musculus
ccgcgatgggtcttatgatatgcag

SEQ ID NO: 595228 - DNA, 25 bp, Mus musculus
ccgcgcaatggcactgtagccgcga

SEQ ID NO: 595229 - DNA, 25 bp, Mus musculus
ccgcgcaatggctctgtagccgcga

SEQ ID NO: 595230 - DNA, 25 bp, Mus musculus
ccgcgcactattagacacgctgcga

SEQ ID NO: 595231 - DNA, 25 bp, Mus musculus
ccgcgcactatttgacacgctgcga

SEQ ID NO: 595232 - DNA, 25 bp, Mus musculus
ccgcgccctattactagtgacgttc

SEQ ID NO: 595233 - DNA, 25 bp, Mus musculus
ccgcgccctatttctagtgacgttc

SEQ ID NO: 595234 - DNA, 25 bp, Mus musculus
ccgcgccgctgactagcagcaagga

SEQ ID NO: 595235 - DNA, 25 bp, Mus musculus
ccgcgccgctgagtagcagcaagga

SEQ ID NO: 595236 - DNA, 25 bp, Mus musculus
ccgcgctcccggctgtcgttgatgt

SEQ ID NO: 595237 - DNA, 25 bp, Mus musculus
ccgcgctcccgggtgtcgttgatgt

SEQ ID NO: 595238 - DNA, 25 bp, Mus musculus
ccgcgctctacgaggccaacttgat

SEQ ID NO: 595239 - DNA, 25 bp, Mus musculus
ccgcgctctacgtggccaacttgat

SEQ ID NO: 595240 - DNA, 25 bp, Mus musculus
ccgcgctgcggaaccgttttgcggc

SEQ ID NO: 595241 - DNA, 25 bp, Mus musculus
ccgcgctgcggatccgttttgcggc

SEQ ID NO: 595242 - DNA, 25 bp, Mus musculus
ccgcggacccgcaggtgggcgtgtt

SEQ ID NO: 595243 - DNA, 25 bp, Mus musculus
ccgcggacccgctggtgggcgtgtt

SEQ ID NO: 595244 - DNA, 25 bp, Mus musculus
ccgcggagccgaacgccatggcgtt

SEQ ID NO: 595245 - DNA, 25 bp, Mus musculus
ccgcggagccgatcgccatggcgtt

SEQ ID NO: 595246 - DNA, 25 bp, Mus musculus
ccgcggagctggattccgctgacaa

SEQ ID NO: 595247 - DNA, 25 bp, Mus musculus
ccgcggagctggtttccgctgacaa

SEQ ID NO: 595248 - DNA, 25 bp, Mus musculus
ccgcggagggcaaccggaaagccca

SEQ ID NO: 595249 - DNA, 25 bp, Mus musculus
ccgcggagggcatccggaaagccca

SEQ ID NO: 595250 - DNA, 25 bp, Mus musculus
ccgcggccgagtagcgttttcgtga

SEQ ID NO: 595251 - DNA, 25 bp, Mus musculus
ccgcggccgagttgcgttttcgtga

SEQ ID NO: 595252 - DNA, 25 bp, Mus musculus
ccgcggccggaacaatgagcctgtc

SEQ ID NO: 595253 - DNA, 25 bp, Mus musculus
ccgcggccggaagaatgagcctgtc

SEQ ID NO: 595254 - DNA, 25 bp, Mus musculus
ccgcggctctgcaaaggacggagcg

SEQ ID NO: 595255 - DNA, 25 bp, Mus musculus
ccgcggctctgctaaggacggagcg

SEQ ID NO: 595256 - DNA, 25 bp, Mus musculus
ccgcgggtacctacagcggaggcaa

SEQ ID NO: 595257 - DNA, 25 bp, Mus musculus
ccgcgggtaccttcagcggaggcaa

SEQ ID NO: 595258 - DNA, 25 bp, Mus musculus
ccgcgggtctccacgcgggtatctg

SEQ ID NO: 595259 - DNA, 25 bp, Mus musculus
ccgcgggtctcctcgcgggtatctg

SEQ ID NO: 595260 - DNA, 25 bp, Mus musculus
ccgcgggtgtcccaaatatcgagat

SEQ ID NO: 595261 - DNA, 25 bp, Mus musculus
ccgcgggtgtccgaaatatcgagat

SEQ ID NO: 595262 - DNA, 25 bp, Mus musculus
ccgcggtgaacaatgtggatgctgc

SEQ ID NO: 595263 - DNA, 25 bp, Mus musculus
ccgcggtgaacattgtggatgctgc

SEQ ID NO: 595264 - DNA, 25 bp, Mus musculus
ccgcggttcttgataagtgagcgag

SEQ ID NO: 595265 - DNA, 25 bp, Mus musculus
ccgcggttcttgttaagtgagcgag

SEQ ID NO: 595266 - DNA, 25 bp, Mus musculus
ccgcgtacaacaaagtgactctggg

SEQ ID NO: 595267 - DNA, 25 bp, Mus musculus
ccgcgtacaacatagtgactctggg

SEQ ID NO: 595268 - DNA, 25 bp, Mus musculus
ccgcgtccgtggaagccgctttgac

SEQ ID NO: 595269 - DNA, 25 bp, Mus musculus
ccgcgtccgtggtagccgctttgac

SEQ ID NO: 595270 - DNA, 25 bp, Mus musculus
ccgcgtcctgggagatctgcatctg

SEQ ID NO: 595271 - DNA, 25 bp, Mus musculus
ccgcgtcctgggtgatctgcatctg

SEQ ID NO: 595272 - DNA, 25 bp, Mus musculus
ccgcgtcttgggagcactgtcccgg

SEQ ID NO: 595273 - DNA, 25 bp, Mus musculus
ccgcgtcttgggtgcactgtcccgg

SEQ ID NO: 595274 - DNA, 25 bp, Mus musculus
ccgcgtgttccaagataaggacgcc

SEQ ID NO: 595275 - DNA, 25 bp, Mus musculus
ccgcgtgttccatgataaggacgcc

SEQ ID NO: 595276 - DNA, 25 bp, Mus musculus
ccgctaacgcagctgtacagccagg

SEQ ID NO: 595277 - DNA, 25 bp, Mus musculus
ccgctaacgcaggtgtacagccagg

SEQ ID NO: 595278 - DNA, 25 bp, Mus musculus
ccgctaacgtccagagccaggagag

SEQ ID NO: 595279 - DNA, 25 bp, Mus musculus
ccgctaacgtcctgagccaggagag

SEQ ID NO: 595280 - DNA, 25 bp, Mus musculus
ccgctaaggttcacaagccctgctt

SEQ ID NO: 595281 - DNA, 25 bp, Mus musculus
ccgctaaggttctcaagccctgctt

SEQ ID NO: 595282 - DNA, 25 bp, Mus musculus
ccgctacagcatccgggagaatggt

SEQ ID NO: 595283 - DNA, 25 bp, Mus musculus
ccgctacagcatgcgggagaatggt

SEQ ID NO: 595284 - DNA, 25 bp, Mus musculus
ccgctacagttgcagtttttcatga

SEQ ID NO: 595285 - DNA, 25 bp, Mus musculus
ccgctacagttggagtttttcatga

SEQ ID NO: 595286 - DNA, 25 bp, Mus musculus
ccgctacatcatcatgcggagtggg

SEQ ID NO: 595287 - DNA, 25 bp, Mus musculus
ccgctacatcatgatgcggagtggg

SEQ ID NO: 595288 - DNA, 25 bp, Mus musculus
ccgctactcacaagggccaaagatt

SEQ ID NO: 595289 - DNA, 25 bp, Mus musculus
ccgctactcacatgggccaaagatt

SEQ ID NO: 595290 - DNA, 25 bp, Mus musculus
ccgctactctgacgcggtgttttac

SEQ ID NO: 595291 - DNA, 25 bp, Mus musculus
ccgctactctgaggcggtgttttac

SEQ ID NO: 595292 - DNA, 25 bp, Mus musculus
ccgctactttccctcttagtgtaca

SEQ ID NO: 595293 - DNA, 25 bp, Mus musculus
ccgctactttccgtcttagtgtaca

SEQ ID NO: 595294 - DNA, 25 bp, Mus musculus
ccgctactttgtcatcaggatccag

SEQ ID NO: 595295 - DNA, 25 bp, Mus musculus
ccgctactttgtgatcaggatccag

SEQ ID NO: 595296 - DNA, 25 bp, Mus musculus
ccgctaggatttcgtgtactgagcc

SEQ ID NO: 595297 - DNA, 25 bp, Mus musculus
ccgctaggatttggtgtactgagcc

SEQ ID NO: 595298 - DNA, 25 bp, Mus musculus
ccgctcaagaatccagacagtcaga

SEQ ID NO: 595299 - DNA, 25 bp, Mus musculus
ccgctcaagaatgcagacagtcaga

SEQ ID NO: 595300 - DNA, 25 bp, Mus musculus
ccgctcacctctatggcatcaggag

SEQ ID NO: 595301 - DNA, 25 bp, Mus musculus
ccgctcacctctttggcatcaggag

SEQ ID NO: 595302 - DNA, 25 bp, Mus musculus
ccgctcagacggagcaggatgagta

SEQ ID NO: 595303 - DNA, 25 bp, Mus musculus
ccgctcagacggtgcaggatgagta

SEQ ID NO: 595304 - DNA, 25 bp, Mus musculus
ccgctcagatagagtttggaaagga

SEQ ID NO: 595305 - DNA, 25 bp, Mus musculus
ccgctcagatagtgtttggaaagga

SEQ ID NO: 595306 - DNA, 25 bp, Mus musculus
ccgctcaggaacatcccaagaggag

SEQ ID NO: 595307 - DNA, 25 bp, Mus musculus
ccgctcaggaacttcccaagaggag

SEQ ID NO: 595308 - DNA, 25 bp, Mus musculus
ccgctcagggcgataggagaataga

SEQ ID NO: 595309 - DNA, 25 bp, Mus musculus
ccgctcagggcgttaggagaataga

SEQ ID NO: 595310 - DNA, 25 bp, Mus musculus
ccgctcagttacagtttaccatgga

SEQ ID NO: 595311 - DNA, 25 bp, Mus musculus
ccgctcagttactgtttaccatgga

SEQ ID NO: 595312 - DNA, 25 bp, Mus musculus
ccgctcatcttcagtgagtgccagc

SEQ ID NO: 595313 - DNA, 25 bp, Mus musculus
ccgctcatcttctgtgagtgccagc

SEQ ID NO: 595314 - DNA, 25 bp, Mus musculus
ccgctcatgctgaatatgagaaaag

SEQ ID NO: 595315 - DNA, 25 bp, Mus musculus
ccgctcatgctgtatatgagaaaag

SEQ ID NO: 595316 - DNA, 25 bp, Mus musculus
ccgctccaacttacaatcagacttg

SEQ ID NO: 595317 - DNA, 25 bp, Mus musculus
ccgctccaactttcaatcagacttg

SEQ ID NO: 595318 - DNA, 25 bp, Mus musculus
ccgctcctagcgacaactcttgagg

SEQ ID NO: 595319 - DNA, 25 bp, Mus musculus
ccgctcctagcgtcaactcttgagg

SEQ ID NO: 595320 - DNA, 25 bp, Mus musculus
ccgctctgaaggaaccagagcatgg

SEQ ID NO: 595321 - DNA, 25 bp, Mus musculus
ccgctctgaaggtaccagagcatgg

SEQ ID NO: 595322 - DNA, 25 bp, Mus musculus
ccgctctgctggatgggcctctggt

SEQ ID NO: 595323 - DNA, 25 bp, Mus musculus
ccgctctgctggttgggcctctggt

SEQ ID NO: 595324 - DNA, 25 bp, Mus musculus
ccgctgaaatggctgtgttgtactc

SEQ ID NO: 595325 - DNA, 25 bp, Mus musculus
ccgctgaaatgggtgtgttgtactc

SEQ ID NO: 595326 - DNA, 25 bp, Mus musculus
ccgctgacagcactttgggcactgg

SEQ ID NO: 595327 - DNA, 25 bp, Mus musculus
ccgctgacagcagtttgggcactgg

SEQ ID NO: 595328 - DNA, 25 bp, Mus musculus
ccgctgaggaaactgtaaaagctat

SEQ ID NO: 595329 - DNA, 25 bp, Mus musculus
ccgctgaggaaagtgtaaaagctat

SEQ ID NO: 595330 - DNA, 25 bp, Mus musculus
ccgctgataagaaggccccggagga

SEQ ID NO: 595331 - DNA, 25 bp, Mus musculus
ccgctgataagatggccccggagga

SEQ ID NO: 595332 - DNA, 25 bp, Mus musculus
ccgctgatactgatgtgtggacccc

SEQ ID NO: 595333 - DNA, 25 bp, Mus musculus
ccgctgatactgttgtgtggacccc

SEQ ID NO: 595334 - DNA, 25 bp, Mus musculus
ccgctgccgaggagagctctgctcg

SEQ ID NO: 595335 - DNA, 25 bp, Mus musculus
ccgctgccgaggtgagctctgctcg

SEQ ID NO: 595336 - DNA, 25 bp, Mus musculus
ccgctgcctgcgctttgattgtcca

SEQ ID NO: 595337 - DNA, 25 bp, Mus musculus
ccgctgcctgcggtttgattgtcca

SEQ ID NO: 595338 - DNA, 25 bp, Mus musculus
ccgctgctgatgaccagaggagtag

SEQ ID NO: 595339 - DNA, 25 bp, Mus musculus
ccgctgctgatgtccagaggagtag

SEQ ID NO: 595340 - DNA, 25 bp, Mus musculus
ccgctgctgcttagaaacgtacaat

SEQ ID NO: 595341 - DNA, 25 bp, Mus musculus
ccgctgctgctttgaaacgtacaat

SEQ ID NO: 595342 - DNA, 25 bp, Mus musculus
ccgctggaggtcaggacatgaacag

SEQ ID NO: 595343 - DNA, 25 bp, Mus musculus
ccgctggaggtctggacatgaacag

SEQ ID NO: 595344 - DNA, 25 bp, Mus musculus
ccgctggctagaacctgggtggacc

SEQ ID NO: 595345 - DNA, 25 bp, Mus musculus
ccgctggctagatcctgggtggacc

SEQ ID NO: 595346 - DNA, 25 bp, Mus musculus
ccgctggctggcagtcgcacggttc

SEQ ID NO: 595347 - DNA, 25 bp, Mus musculus
ccgctggctggctgtcgcacggttc

SEQ ID NO: 595348 - DNA, 25 bp, Mus musculus
ccgctgggaggactgataagtaact

SEQ ID NO: 595349 - DNA, 25 bp, Mus musculus
ccgctgggaggagtgataagtaact

SEQ ID NO: 595350 - DNA, 25 bp, Mus musculus
ccgctgggtcgaatccaaacataag

SEQ ID NO: 595351 - DNA, 25 bp, Mus musculus
ccgctgggtcgattccaaacataag

SEQ ID NO: 595352 - DNA, 25 bp, Mus musculus
ccgctggtactcctcctctggaagg

SEQ ID NO: 595353 - DNA, 25 bp, Mus musculus
ccgctggtactcgtcctctggaagg

SEQ ID NO: 595354 - DNA, 25 bp, Mus musculus
ccgctggtgttcaagtgtgcgcctg

SEQ ID NO: 595355 - DNA, 25 bp, Mus musculus
ccgctggtgttctagtgtgcgcctg

SEQ ID NO: 595356 - DNA, 25 bp, Mus musculus
ccgctggttactatgaagaatggga

SEQ ID NO: 595357 - DNA, 25 bp, Mus musculus
ccgctggttactttgaagaatggga

SEQ ID NO: 595358 - DNA, 25 bp, Mus musculus
ccgctggtttcgaagacatgtggtg

SEQ ID NO: 595359 - DNA, 25 bp, Mus musculus
ccgctggtttcgtagacatgtggtg

SEQ ID NO: 595360 - DNA, 25 bp, Mus musculus
ccgctgtcgcctctctagaagggaa

SEQ ID NO: 595361 - DNA, 25 bp, Mus musculus
ccgctgtcgcctgtctagaagggaa

SEQ ID NO: 595362 - DNA, 25 bp, Mus musculus
ccgctgtctcccctagtgaacttga

SEQ ID NO: 595363 - DNA, 25 bp, Mus musculus
ccgctgtctcccgtagtgaacttga

SEQ ID NO: 595364 - DNA, 25 bp, Mus musculus
ccgctgtgccttcatgggctctttg

SEQ ID NO: 595365 - DNA, 25 bp, Mus musculus
ccgctgtgccttgatgggctctttg

SEQ ID NO: 595366 - DNA, 25 bp, Mus musculus
ccgctgtgtggccaaaaacagcctg

SEQ ID NO: 595367 - DNA, 25 bp, Mus musculus
ccgctgtgtggcgaaaaacagcctg

SEQ ID NO: 595368 - DNA, 25 bp, Mus musculus
ccgctgttctccatgcttaaccaga

SEQ ID NO: 595369 - DNA, 25 bp, Mus musculus
ccgctgttctccttgcttaaccaga

SEQ ID NO: 595370 - DNA, 25 bp, Mus musculus
ccgcttaacagcacccagtggatga

SEQ ID NO: 595371 - DNA, 25 bp, Mus musculus
ccgcttaacagctcccagtggatga

SEQ ID NO: 595372 - DNA, 25 bp, Mus musculus
ccgcttattcaaaataagagccatg

SEQ ID NO: 595373 - DNA, 25 bp, Mus musculus
ccgcttattcaatataagagccatg

SEQ ID NO: 595374 - DNA, 25 bp, Mus musculus
ccgcttctggatacaggacaaaggc

SEQ ID NO: 595375 - DNA, 25 bp, Mus musculus
ccgcttctggattcaggacaaaggc

SEQ ID NO: 595376 - DNA, 25 bp, Mus musculus
ccgcttctgggaagactgtgtcaag

SEQ ID NO: 595377 - DNA, 25 bp, Mus musculus
ccgcttctgggatgactgtgtcaag

SEQ ID NO: 595378 - DNA, 25 bp, Mus musculus
ccgcttctgggcaaagtggctaagt

SEQ ID NO: 595379 - DNA, 25 bp, Mus musculus
ccgcttctgggctaagtggctaagt

SEQ ID NO: 595380 - DNA, 25 bp, Mus musculus
ccgcttcttccgatcttgctgtgga

SEQ ID NO: 595381 - DNA, 25 bp, Mus musculus
ccgcttcttccgttcttgctgtgga

SEQ ID NO: 595382 - DNA, 25 bp, Mus musculus
ccgcttgaaccaaaaatggtgagtg

SEQ ID NO: 595383 - DNA, 25 bp, Mus musculus
ccgcttgaaccataaatggtgagtg

SEQ ID NO: 595384 - DNA, 25 bp, Mus musculus
ccgcttggaaaaatgaagagagcca

SEQ ID NO: 595385 - DNA, 25 bp, Mus musculus
ccgcttggaaaattgaagagagcca

SEQ ID NO: 595386 - DNA, 25 bp, Mus musculus
ccgctttcatctcgagtctgtcatg

SEQ ID NO: 595387 - DNA, 25 bp, Mus musculus
ccgctttcatctggagtctgtcatg

SEQ ID NO: 595388 - DNA, 25 bp, Mus musculus
ccgctttgaacgagtcctcatgaga

SEQ ID NO: 595389 - DNA, 25 bp, Mus musculus
ccgctttgaacgtgtcctcatgaga

SEQ ID NO: 595390 - DNA, 25 bp, Mus musculus
ccgctttggtgaaccggaatgccag

SEQ ID NO: 595391 - DNA, 25 bp, Mus musculus
ccgctttggtgatccggaatgccag

SEQ ID NO: 595392 - DNA, 25 bp, Mus musculus
ccgctttgttgaagaatgatgagac

SEQ ID NO: 595393 - DNA, 25 bp, Mus musculus
ccgctttgttgatgaatgatgagac

SEQ ID NO: 595394 - DNA, 25 bp, Mus musculus
ccgcttttcctacgacacttttgtg

SEQ ID NO: 595395 - DNA, 25 bp, Mus musculus
ccgcttttcctaggacacttttgtg

SEQ ID NO: 595396 - DNA, 25 bp, Mus musculus
ccggaaaaagaaccgctgtcgggct

SEQ ID NO: 595397 - DNA, 25 bp, Mus musculus
ccggaaaaagaagcgctgtcgggct

SEQ ID NO: 595398 - DNA, 25 bp, Mus musculus
ccggaaaaggacagagtttgctgga

SEQ ID NO: 595399 - DNA, 25 bp, Mus musculus
ccggaaaaggactgagtttgctgga

SEQ ID NO: 595400 - DNA, 25 bp, Mus musculus
ccggaaactcacatggacgaggacg

SEQ ID NO: 595401 - DNA, 25 bp, Mus musculus
ccggaaactcacttggacgaggacg

SEQ ID NO: 595402 - DNA, 25 bp, Mus musculus
ccggaaatgccactgccgaacaggt

SEQ ID NO: 595403 - DNA, 25 bp, Mus musculus
ccggaaatgccagtgccgaacaggt

SEQ ID NO: 595404 - DNA, 25 bp, Mus musculus
ccggaaatggtgaggtttgagccca

SEQ ID NO: 595405 - DNA, 25 bp, Mus musculus
ccggaaatggtgtggtttgagccca

SEQ ID NO: 595406 - DNA, 25 bp, Mus musculus
ccggaacaaggcagcgtgaacacag

SEQ ID NO: 595407 - DNA, 25 bp, Mus musculus
ccggaacaaggctgcgtgaacacag

SEQ ID NO: 595408 - DNA, 25 bp, Mus musculus
ccggaacaagtgacattctgtacca

SEQ ID NO: 595409 - DNA, 25 bp, Mus musculus
ccggaacaagtgtcattctgtacca

SEQ ID NO: 595410 - DNA, 25 bp, Mus musculus
ccggaacctgggaacgagtgccaga

SEQ ID NO: 595411 - DNA, 25 bp, Mus musculus
ccggaacctgggtacgagtgccaga

SEQ ID NO: 595412 - DNA, 25 bp, Mus musculus
ccggaacgaagtcgccattttacag

SEQ ID NO: 595413 - DNA, 25 bp, Mus musculus
ccggaacgaagtggccattttacag

SEQ ID NO: 595414 - DNA, 25 bp, Mus musculus
ccggaactcctgagggcgcaaggcc

SEQ ID NO: 595415 - DNA, 25 bp, Mus musculus
ccggaactcctgtgggcgcaaggcc

SEQ ID NO: 595416 - DNA, 25 bp, Mus musculus
ccggaagaccaactgccatgttact

SEQ ID NO: 595417 - DNA, 25 bp, Mus musculus
ccggaagaccaagtgccatgttact

SEQ ID NO: 595418 - DNA, 25 bp, Mus musculus
ccggaagactccagataaaatgaat

SEQ ID NO: 595419 - DNA, 25 bp, Mus musculus
ccggaagactcctgataaaatgaat

SEQ ID NO: 595420 - DNA, 25 bp, Mus musculus
ccggaagaggcaatagatgccctga

SEQ ID NO: 595421 - DNA, 25 bp, Mus musculus
ccggaagaggcattagatgccctga

SEQ ID NO: 595422 - DNA, 25 bp, Mus musculus
ccggaagcatgcaccacatacatgt

SEQ ID NO: 595423 - DNA, 25 bp, Mus musculus
ccggaagcatgctccacatacatgt

SEQ ID NO: 595424 - DNA, 25 bp, Mus musculus
ccggaagccagaaactttccctcag

SEQ ID NO: 595425 - DNA, 25 bp, Mus musculus
ccggaagccagatactttccctcag

SEQ ID NO: 595426 - DNA, 25 bp, Mus musculus
ccggaagccggaaccgctagcttgt

SEQ ID NO: 595427 - DNA, 25 bp, Mus musculus
ccggaagccggatccgctagcttgt

SEQ ID NO: 595428 - DNA, 25 bp, Mus musculus
ccggaagcttgacctgctcaactgg

SEQ ID NO: 595429 - DNA, 25 bp, Mus musculus
ccggaagcttgagctgctcaactgg

SEQ ID NO: 595430 - DNA, 25 bp, Mus musculus
ccggaagggctgactagtgactgac

SEQ ID NO: 595431 - DNA, 25 bp, Mus musculus
ccggaagggctgtctagtgactgac

SEQ ID NO: 595432 - DNA, 25 bp, Mus musculus
ccggaagtaagaagcaaccctcaag

SEQ ID NO: 595433 - DNA, 25 bp, Mus musculus
ccggaagtaagatgcaaccctcaag

SEQ ID NO: 595434 - DNA, 25 bp, Mus musculus
ccggaagtacagcttttgcacagca

SEQ ID NO: 595435 - DNA, 25 bp, Mus musculus
ccggaagtacaggttttgcacagca

SEQ ID NO: 595436 - DNA, 25 bp, Mus musculus
ccggaagtgagactccaattgtagt

SEQ ID NO: 595437 - DNA, 25 bp, Mus musculus
ccggaagtgagagtccaattgtagt

SEQ ID NO: 595438 - DNA, 25 bp, Mus musculus
ccggaagtgccacgctagccgagta

SEQ ID NO: 595439 - DNA, 25 bp, Mus musculus
ccggaagtgccaggctagccgagta

SEQ ID NO: 595440 - DNA, 25 bp, Mus musculus
ccggaatcctgaaggctccgaggcg

SEQ ID NO: 595441 - DNA, 25 bp, Mus musculus
ccggaatcctgatggctccgaggcg

SEQ ID NO: 595442 - DNA, 25 bp, Mus musculus
ccggaatcgcctcgtcccgggagat

SEQ ID NO: 595443 - DNA, 25 bp, Mus musculus
ccggaatcgcctggtcccgggagat

SEQ ID NO: 595444 - DNA, 25 bp, Mus musculus
ccggaatcttgaaaaggtggacaga

SEQ ID NO: 595445 - DNA, 25 bp, Mus musculus
ccggaatcttgataaggtggacaga

SEQ ID NO: 595446 - DNA, 25 bp, Mus musculus
ccggaatggcaacgaggagaaaaca

SEQ ID NO: 595447 - DNA, 25 bp, Mus musculus
ccggaatggcaaggaggagaaaaca

SEQ ID NO: 595448 - DNA, 25 bp, Mus musculus
ccggaattggcaagtaaagtagaca

SEQ ID NO: 595449 - DNA, 25 bp, Mus musculus
ccggaattggcatgtaaagtagaca

SEQ ID NO: 595450 - DNA, 25 bp, Mus musculus
ccggaccttcgtccaggagaatgtg

SEQ ID NO: 595451 - DNA, 25 bp, Mus musculus
ccggaccttcgtgcaggagaatgtg

SEQ ID NO: 595452 - DNA, 25 bp, Mus musculus
ccggacgggactctaagatgaagtt

SEQ ID NO: 595453 - DNA, 25 bp, Mus musculus
ccggacgggactgtaagatgaagtt

SEQ ID NO: 595454 - DNA, 25 bp, Mus musculus
ccggacgtgtaacgacactgccact

SEQ ID NO: 595455 - DNA, 25 bp, Mus musculus
ccggacgtgtaaggacactgccact

SEQ ID NO: 595456 - DNA, 25 bp, Mus musculus
ccggacgttggtcagcaccaagcag

SEQ ID NO: 595457 - DNA, 25 bp, Mus musculus
ccggacgttggtgagcaccaagcag

SEQ ID NO: 595458 - DNA, 25 bp, Mus musculus
ccggactttgtcaataagaggataa

SEQ ID NO: 595459 - DNA, 25 bp, Mus musculus
ccggactttgtctataagaggataa

SEQ ID NO: 595460 - DNA, 25 bp, Mus musculus
ccggagaagataacccatcgggagc

SEQ ID NO: 595461 - DNA, 25 bp, Mus musculus
ccggagaagatatcccatcgggagc

SEQ ID NO: 595462 - DNA, 25 bp, Mus musculus
ccggagaccaagcttgtacagattc

SEQ ID NO: 595463 - DNA, 25 bp, Mus musculus
ccggagaccaaggttgtacagattc

SEQ ID NO: 595464 - DNA, 25 bp, Mus musculus
ccggagacgggacgaacatgacatc

SEQ ID NO: 595465 - DNA, 25 bp, Mus musculus
ccggagacgggaggaacatgacatc

SEQ ID NO: 595466 - DNA, 25 bp, Mus musculus
ccggagacggtgaatccctttgact

SEQ ID NO: 595467 - DNA, 25 bp, Mus musculus
ccggagacggtgtatccctttgact

SEQ ID NO: 595468 - DNA, 25 bp, Mus musculus
ccggagagcaggcagcgttcccatt

SEQ ID NO: 595469 - DNA, 25 bp, Mus musculus
ccggagagcagggagcgttcccatt

SEQ ID NO: 595470 - DNA, 25 bp, Mus musculus
ccggagaggtggaggtagatgcgct

SEQ ID NO: 595471 - DNA, 25 bp, Mus musculus
ccggagaggtggtggtagatgcgct

SEQ ID NO: 595472 - DNA, 25 bp, Mus musculus
ccggagatcaacaaagcagttctgc

SEQ ID NO: 595473 - DNA, 25 bp, Mus musculus
ccggagatcaactaagcagttctgc

SEQ ID NO: 595474 - DNA, 25 bp, Mus musculus
ccggagatctagactccggccaggg

SEQ ID NO: 595475 - DNA, 25 bp, Mus musculus
ccggagatctagtctccggccaggg

SEQ ID NO: 595476 - DNA, 25 bp, Mus musculus
ccggagattgcacgcagcaggaatt

SEQ ID NO: 595477 - DNA, 25 bp, Mus musculus
ccggagattgcaggcagcaggaatt

SEQ ID NO: 595478 - DNA, 25 bp, Mus musculus
ccggagatttaaccgagaactggag

SEQ ID NO: 595479 - DNA, 25 bp, Mus musculus
ccggagatttaagcgagaactggag

SEQ ID NO: 595480 - DNA, 25 bp, Mus musculus
ccggagcacgaaactctggtattta

SEQ ID NO: 595481 - DNA, 25 bp, Mus musculus
ccggagcacgaatctctggtattta

SEQ ID NO: 595482 - DNA, 25 bp, Mus musculus
ccggagcagcacattcaactcccag

SEQ ID NO: 595483 - DNA, 25 bp, Mus musculus
ccggagcagcactttcaactcccag

SEQ ID NO: 595484 - DNA, 25 bp, Mus musculus
ccggagcagcttctcgcagcatgct

SEQ ID NO: 595485 - DNA, 25 bp, Mus musculus
ccggagcagcttgtcgcagcatgct

SEQ ID NO: 595486 - DNA, 25 bp, Mus musculus
ccggagcaggcactttcttcagttc

SEQ ID NO: 595487 - DNA, 25 bp, Mus musculus
ccggagcaggcagtttcttcagttc

SEQ ID NO: 595488 - DNA, 25 bp, Mus musculus
ccggagcaggtgatcagaaagtaca

SEQ ID NO: 595489 - DNA, 25 bp, Mus musculus
ccggagcaggtgttcagaaagtaca

SEQ ID NO: 595490 - DNA, 25 bp, Mus musculus
ccggagcagttcacctacatgctgg

SEQ ID NO: 595491 - DNA, 25 bp, Mus musculus
ccggagcagttctcctacatgctgg

SEQ ID NO: 595492 - DNA, 25 bp, Mus musculus
ccggagcccgtgacagacgggccaa

SEQ ID NO: 595493 - DNA, 25 bp, Mus musculus
ccggagcccgtgtcagacgggccaa

SEQ ID NO: 595494 - DNA, 25 bp, Mus musculus
ccggagcctacaatctgtcgcgata

SEQ ID NO: 595495 - DNA, 25 bp, Mus musculus
ccggagcctacattctgtcgcgata

SEQ ID NO: 595496 - DNA, 25 bp, Mus musculus
ccggagcgaatgcataagaaactgc

SEQ ID NO: 595497 - DNA, 25 bp, Mus musculus
ccggagcgaatggataagaaactgc

SEQ ID NO: 595498 - DNA, 25 bp, Mus musculus
ccggagctatccagaacttgtgtgc

SEQ ID NO: 595499 - DNA, 25 bp, Mus musculus
ccggagctatcctgaacttgtgtgc

SEQ ID NO: 595500 - DNA, 25 bp, Mus musculus
ccggagctgagtagtatggcatcga

SEQ ID NO: 595501 - DNA, 25 bp, Mus musculus
ccggagctgagttgtatggcatcga

SEQ ID NO: 595502 - DNA, 25 bp, Mus musculus
ccggaggaactgacccgaagctgtg

SEQ ID NO: 595503 - DNA, 25 bp, Mus musculus
ccggaggaactgtcccgaagctgtg

SEQ ID NO: 595504 - DNA, 25 bp, Mus musculus
ccggaggaccatacgctgctggtga

SEQ ID NO: 595505 - DNA, 25 bp, Mus musculus
ccggaggaccattcgctgctggtga

SEQ ID NO: 595506 - DNA, 25 bp, Mus musculus
ccggaggatcaacgttcagtttcca

SEQ ID NO: 595507 - DNA, 25 bp, Mus musculus
ccggaggatcaaggttcagtttcca

SEQ ID NO: 595508 - DNA, 25 bp, Mus musculus
ccggaggatctgaaggaagcactgt

SEQ ID NO: 595509 - DNA, 25 bp, Mus musculus
ccggaggatctgtaggaagcactgt

SEQ ID NO: 595510 - DNA, 25 bp, Mus musculus
ccggaggatggtcctgcccaagacc

SEQ ID NO: 595511 - DNA, 25 bp, Mus musculus
ccggaggatggtgctgcccaagacc

SEQ ID NO: 595512 - DNA, 25 bp, Mus musculus
ccggaggcacttcagcatgggcaat

SEQ ID NO: 595513 - DNA, 25 bp, Mus musculus
ccggaggcacttgagcatgggcaat

SEQ ID NO: 595514 - DNA, 25 bp, Mus musculus
ccggaggccgcgacctatgcgaagc

SEQ ID NO: 595515 - DNA, 25 bp, Mus musculus
ccggaggccgcgtcctatgcgaagc

SEQ ID NO: 595516 - DNA, 25 bp, Mus musculus
ccggagggagaccacagtgacccat

SEQ ID NO: 595517 - DNA, 25 bp, Mus musculus
ccggagggagacgacagtgacccat

SEQ ID NO: 595518 - DNA, 25 bp, Mus musculus
ccggagggcccaatggcctcaatga

SEQ ID NO: 595519 - DNA, 25 bp, Mus musculus
ccggagggcccattggcctcaatga

SEQ ID NO: 595520 - DNA, 25 bp, Mus musculus
ccggaggtgacacatcagctcgagt

SEQ ID NO: 595521 - DNA, 25 bp, Mus musculus
ccggaggtgacagatcagctcgagt

SEQ ID NO: 595522 - DNA, 25 bp, Mus musculus
ccggaggttcatcgagaagaatctt

SEQ ID NO: 595523 - DNA, 25 bp, Mus musculus
ccggaggttcatggagaagaatctt

SEQ ID NO: 595524 - DNA, 25 bp, Mus musculus
ccggaggttcctcgctgttgcagat

SEQ ID NO: 595525 - DNA, 25 bp, Mus musculus
ccggaggttcctggctgttgcagat

SEQ ID NO: 595526 - DNA, 25 bp, Mus musculus
ccggaggttttaccgagagcatgaa

SEQ ID NO: 595527 - DNA, 25 bp, Mus musculus
ccggaggttttagcgagagcatgaa

SEQ ID NO: 595528 - DNA, 25 bp, Mus musculus
ccggagtagacaacgcagctggaaa

SEQ ID NO: 595529 - DNA, 25 bp, Mus musculus
ccggagtagacatcgcagctggaaa

SEQ ID NO: 595530 - DNA, 25 bp, Mus musculus
ccggagtctacacagacgtggccaa

SEQ ID NO: 595531 - DNA, 25 bp, Mus musculus
ccggagtctacagagacgtggccaa

SEQ ID NO: 595532 - DNA, 25 bp, Mus musculus
ccggagtctctgcaatcatgctttt

SEQ ID NO: 595533 - DNA, 25 bp, Mus musculus
ccggagtctctggaatcatgctttt

SEQ ID NO: 595534 - DNA, 25 bp, Mus musculus
ccggagtcttcgacctgtttgatga

SEQ ID NO: 595535 - DNA, 25 bp, Mus musculus
ccggagtcttcgtcctgtttgatga

SEQ ID NO: 595536 - DNA, 25 bp, Mus musculus
ccggagtggcctcctgttacctctg

SEQ ID NO: 595537 - DNA, 25 bp, Mus musculus
ccggagtggcctgctgttacctctg

SEQ ID NO: 595538 - DNA, 25 bp, Mus musculus
ccggataccccgcttctactgggag

SEQ ID NO: 595539 - DNA, 25 bp, Mus musculus
ccggataccccggttctactgggag

SEQ ID NO: 595540 - DNA, 25 bp, Mus musculus
ccggatactcccaggaaacaaagag

SEQ ID NO: 595541 - DNA, 25 bp, Mus musculus
ccggatactccctggaaacaaagag

SEQ ID NO: 595542 - DNA, 25 bp, Mus musculus
ccggatagaggaaaaacagctgaag

SEQ ID NO: 595543 - DNA, 25 bp, Mus musculus
ccggatagaggataaacagctgaag

SEQ ID NO: 595544 - DNA, 25 bp, Mus musculus
ccggatagcacacagcaaagaggac

SEQ ID NO: 595545 - DNA, 25 bp, Mus musculus
ccggatagcacagagcaaagaggac

SEQ ID NO: 595546 - DNA, 25 bp, Mus musculus
ccggatataccacgatgagagggaa

SEQ ID NO: 595547 - DNA, 25 bp, Mus musculus
ccggatataccaggatgagagggaa

SEQ ID NO: 595548 - DNA, 25 bp, Mus musculus
ccggatattaacaccagagaactgg

SEQ ID NO: 595549 - DNA, 25 bp, Mus musculus
ccggatattaactccagagaactgg

SEQ ID NO: 595550 - DNA, 25 bp, Mus musculus
ccggatcacatcaaactttgtcatt

SEQ ID NO: 595551 - DNA, 25 bp, Mus musculus
ccggatcacatctaactttgtcatt

SEQ ID NO: 595552 - DNA, 25 bp, Mus musculus
ccggatcatcacatggagaattgag

SEQ ID NO: 595553 - DNA, 25 bp, Mus musculus
ccggatcatcacttggagaattgag

SEQ ID NO: 595554 - DNA, 25 bp, Mus musculus
ccggatcccactcatgtggaaggat

SEQ ID NO: 595555 - DNA, 25 bp, Mus musculus
ccggatcccactgatgtggaaggat

SEQ ID NO: 595556 - DNA, 25 bp, Mus musculus
ccggatcctcttcagtacctggaac

SEQ ID NO: 595557 - DNA, 25 bp, Mus musculus
ccggatcctcttgagtacctggaac

SEQ ID NO: 595558 - DNA, 25 bp, Mus musculus
ccggatctcaaacaccacatggtag

SEQ ID NO: 595559 - DNA, 25 bp, Mus musculus
ccggatctcaaagaccacatggtag

SEQ ID NO: 595560 - DNA, 25 bp, Mus musculus
ccggatctcaggaggctgcacaagt

SEQ ID NO: 595561 - DNA, 25 bp, Mus musculus
ccggatctcaggtggctgcacaagt

SEQ ID NO: 595562 - DNA, 25 bp, Mus musculus
ccggatgcagtacggcctgttcctc

SEQ ID NO: 595563 - DNA, 25 bp, Mus musculus
ccggatgcagtagggcctgttcctc

SEQ ID NO: 595564 - DNA, 25 bp, Mus musculus
ccggatgcgctcctttggcatgatc

SEQ ID NO: 595565 - DNA, 25 bp, Mus musculus
ccggatgcgctcgtttggcatgatc

SEQ ID NO: 595566 - DNA, 25 bp, Mus musculus
ccggatggactcaggaacgcgttag

SEQ ID NO: 595567 - DNA, 25 bp, Mus musculus
ccggatggactctggaacgcgttag

SEQ ID NO: 595568 - DNA, 25 bp, Mus musculus
ccggatggagctaaaggcggatcag

SEQ ID NO: 595569 - DNA, 25 bp, Mus musculus
ccggatggagcttaaggcggatcag

SEQ ID NO: 595570 - DNA, 25 bp, Mus musculus
ccggatggtcatcctcggcctgaag

SEQ ID NO: 595571 - DNA, 25 bp, Mus musculus
ccggatggtcatgctcggcctgaag

SEQ ID NO: 595572 - DNA, 25 bp, Mus musculus
ccggatgtgttcaggtacagagatg

SEQ ID NO: 595573 - DNA, 25 bp, Mus musculus
ccggatgtgttctggtacagagatg

SEQ ID NO: 595574 - DNA, 25 bp, Mus musculus
ccggattatggcacgggtgtccgtc

SEQ ID NO: 595575 - DNA, 25 bp, Mus musculus
ccggattatggctcgggtgtccgtc

SEQ ID NO: 595576 - DNA, 25 bp, Mus musculus
ccggattccgccatgttgagtcttg

SEQ ID NO: 595577 - DNA, 25 bp, Mus musculus
ccggattccgccttgttgagtcttg

SEQ ID NO: 595578 - DNA, 25 bp, Mus musculus
ccggatttaagaagtaccccattga

SEQ ID NO: 595579 - DNA, 25 bp, Mus musculus
ccggatttaagatgtaccccattga

SEQ ID NO: 595580 - DNA, 25 bp, Mus musculus
ccggatttcagcaggcactggcgct

SEQ ID NO: 595581 - DNA, 25 bp, Mus musculus
ccggatttcagctggcactggcgct

SEQ ID NO: 595582 - DNA, 25 bp, Mus musculus
ccggcaaagggtaactgggcattct

SEQ ID NO: 595583 - DNA, 25 bp, Mus musculus
ccggcaaagggttactgggcattct

SEQ ID NO: 595584 - DNA, 25 bp, Mus musculus
ccggcaacgtggcaatgaggtctca

SEQ ID NO: 595585 - DNA, 25 bp, Mus musculus
ccggcaacgtgggaatgaggtctca

SEQ ID NO: 595586 - DNA, 25 bp, Mus musculus
ccggcaagctgacagaggctttcaa

SEQ ID NO: 595587 - DNA, 25 bp, Mus musculus
ccggcaagctgagagaggctttcaa

SEQ ID NO: 595588 - DNA, 25 bp, Mus musculus
ccggcaagtccactttcatccagga

SEQ ID NO: 595589 - DNA, 25 bp, Mus musculus
ccggcaagtccagtttcatccagga

SEQ ID NO: 595590 - DNA, 25 bp, Mus musculus
ccggcaatgctacctgccagatagc

SEQ ID NO: 595591 - DNA, 25 bp, Mus musculus
ccggcaatgctagctgccagatagc

SEQ ID NO: 595592 - DNA, 25 bp, Mus musculus
ccggcacaggccagagctgattgag

SEQ ID NO: 595593 - DNA, 25 bp, Mus musculus
ccggcacaggcctgagctgattgag

SEQ ID NO: 595594 - DNA, 25 bp, Mus musculus
ccggcactacgtcggatcagcagct

SEQ ID NO: 595595 - DNA, 25 bp, Mus musculus
ccggcactacgtgggatcagcagct

SEQ ID NO: 595596 - DNA, 25 bp, Mus musculus
ccggcagaacaaccgcctggatgct

SEQ ID NO: 595597 - DNA, 25 bp, Mus musculus
ccggcagaacaagcgcctggatgct

SEQ ID NO: 595598 - DNA, 25 bp, Mus musculus
ccggcagaagatcgtagagctagct

SEQ ID NO: 595599 - DNA, 25 bp, Mus musculus
ccggcagaagatggtagagctagct

SEQ ID NO: 595600 - DNA, 25 bp, Mus musculus
ccggcagatattctgaagaacttga

SEQ ID NO: 595601 - DNA, 25 bp, Mus musculus
ccggcagatattgtgaagaacttga

SEQ ID NO: 595602 - DNA, 25 bp, Mus musculus
ccggcagatggcactcagcctggag

SEQ ID NO: 595603 - DNA, 25 bp, Mus musculus
ccggcagatggctctcagcctggag

SEQ ID NO: 595604 - DNA, 25 bp, Mus musculus
ccggcaggcattaatctccaaagct

SEQ ID NO: 595605 - DNA, 25 bp, Mus musculus
ccggcaggcatttatctccaaagct

SEQ ID NO: 595606 - DNA, 25 bp, Mus musculus
ccggcagggactacgaggtattcga

SEQ ID NO: 595607 - DNA, 25 bp, Mus musculus
ccggcagggacttcgaggtattcga

SEQ ID NO: 595608 - DNA, 25 bp, Mus musculus
ccggcagggctacgatgtcagcatt

SEQ ID NO: 595609 - DNA, 25 bp, Mus musculus
ccggcagggctaggatgtcagcatt

SEQ ID NO: 595610 - DNA, 25 bp, Mus musculus
ccggcagggcttctttactatggct

SEQ ID NO: 595611 - DNA, 25 bp, Mus musculus
ccggcagggcttgtttactatggct

SEQ ID NO: 595612 - DNA, 25 bp, Mus musculus
ccggcagttccccatcgcgaattaa

SEQ ID NO: 595613 - DNA, 25 bp, Mus musculus
ccggcagttcccgatcgcgaattaa

SEQ ID NO: 595614 - DNA, 25 bp, Mus musculus
ccggcagtttttcaccaagatcaag

SEQ ID NO: 595615 - DNA, 25 bp, Mus musculus
ccggcagtttttgaccaagatcaag

SEQ ID NO: 595616 - DNA, 25 bp, Mus musculus
ccggcatggagcacatcattgagga

SEQ ID NO: 595617 - DNA, 25 bp, Mus musculus
ccggcatggagctcatcattgagga

SEQ ID NO: 595618 - DNA, 25 bp, Mus musculus
ccggcattatataaccctgagctat

SEQ ID NO: 595619 - DNA, 25 bp, Mus musculus
ccggcattatattaccctgagctat

SEQ ID NO: 595620 - DNA, 25 bp, Mus musculus
ccggcattggtgacactggtatcaa

SEQ ID NO: 595621 - DNA, 25 bp, Mus musculus
ccggcattggtgtcactggtatcaa

SEQ ID NO: 595622 - DNA, 25 bp, Mus musculus
ccggccacgtacacgcagtgtacag

SEQ ID NO: 595623 - DNA, 25 bp, Mus musculus
ccggccacgtactcgcagtgtacag

SEQ ID NO: 595624 - DNA, 25 bp, Mus musculus
ccggccagaggtacgagagttttct

SEQ ID NO: 595625 - DNA, 25 bp, Mus musculus
ccggccagaggttcgagagttttct

SEQ ID NO: 595626 - DNA, 25 bp, Mus musculus
ccggccagatctagacccaaagcta

SEQ ID NO: 595627 - DNA, 25 bp, Mus musculus
ccggccagatcttgacccaaagcta

SEQ ID NO: 595628 - DNA, 25 bp, Mus musculus
ccggccagcgcaaaaatctccggtg

SEQ ID NO: 595629 - DNA, 25 bp, Mus musculus
ccggccagcgcataaatctccggtg

SEQ ID NO: 595630 - DNA, 25 bp, Mus musculus
ccggccaggagaagtaccaaagcgt

SEQ ID NO: 595631 - DNA, 25 bp, Mus musculus
ccggccaggagatgtaccaaagcgt

SEQ ID NO: 595632 - DNA, 25 bp, Mus musculus
ccggccaggtggatcagatccctgt

SEQ ID NO: 595633 - DNA, 25 bp, Mus musculus
ccggccaggtggttcagatccctgt

SEQ ID NO: 595634 - DNA, 25 bp, Mus musculus
ccggcccaattaaggcagagaacga

SEQ ID NO: 595635 - DNA, 25 bp, Mus musculus
ccggcccaattatggcagagaacga

SEQ ID NO: 595636 - DNA, 25 bp, Mus musculus
ccggcccaggtgcattgccaagctt

SEQ ID NO: 595637 - DNA, 25 bp, Mus musculus
ccggcccaggtggattgccaagctt

SEQ ID NO: 595638 - DNA, 25 bp, Mus musculus
ccggccccgagaaggtctagtctct

SEQ ID NO: 595639 - DNA, 25 bp, Mus musculus
ccggccccgagatggtctagtctct

SEQ ID NO: 595640 - DNA, 25 bp, Mus musculus
ccggcccctcggatgacagtatata

SEQ ID NO: 595641 - DNA, 25 bp, Mus musculus
ccggcccctcggttgacagtatata

SEQ ID NO: 595642 - DNA, 25 bp, Mus musculus
ccggcccctgatatgttcaagacct

SEQ ID NO: 595643 - DNA, 25 bp, Mus musculus
ccggcccctgatttgttcaagacct

SEQ ID NO: 595644 - DNA, 25 bp, Mus musculus
ccggccctgtgcagctgcggttttc

SEQ ID NO: 595645 - DNA, 25 bp, Mus musculus
ccggccctgtgctgctgcggttttc

SEQ ID NO: 595646 - DNA, 25 bp, Mus musculus
ccggccgtgcgacatttcccgaatt

SEQ ID NO: 595647 - DNA, 25 bp, Mus musculus
ccggccgtgcgagatttcccgaatt

SEQ ID NO: 595648 - DNA, 25 bp, Mus musculus
ccggccgtttgtcttgcttcagaca

SEQ ID NO: 595649 - DNA, 25 bp, Mus musculus
ccggccgtttgtgttgcttcagaca

SEQ ID NO: 595650 - DNA, 25 bp, Mus musculus
ccggcctcagtgagggcctctcgga

SEQ ID NO: 595651 - DNA, 25 bp, Mus musculus
ccggcctcagtgtgggcctctcgga

SEQ ID NO: 595652 - DNA, 25 bp, Mus musculus
ccggcctcgtgtctgcgactctgag

SEQ ID NO: 595653 - DNA, 25 bp, Mus musculus
ccggcctcgtgtgtgcgactctgag

SEQ ID NO: 595654 - DNA, 25 bp, Mus musculus
ccggcctctcagaaggtacttgact

SEQ ID NO: 595655 - DNA, 25 bp, Mus musculus
ccggcctctcagtaggtacttgact

SEQ ID NO: 595656 - DNA, 25 bp, Mus musculus
ccggcctcttcaagggcacctatgg

SEQ ID NO: 595657 - DNA, 25 bp, Mus musculus
ccggcctcttcatgggcacctatgg

SEQ ID NO: 595658 - DNA, 25 bp, Mus musculus
ccggcgatattcacctaccatgatg

SEQ ID NO: 595659 - DNA, 25 bp, Mus musculus
ccggcgatattctcctaccatgatg

SEQ ID NO: 595660 - DNA, 25 bp, Mus musculus
ccggcgcactggacatggagctccg

SEQ ID NO: 595661 - DNA, 25 bp, Mus musculus
ccggcgcactggtcatggagctccg

SEQ ID NO: 595662 - DNA, 25 bp, Mus musculus
ccggcgcatcgtaggcagaacgcat

SEQ ID NO: 595663 - DNA, 25 bp, Mus musculus
ccggcgcatcgttggcagaacgcat

SEQ ID NO: 595664 - DNA, 25 bp, Mus musculus
ccggcgcatttacaaaaggaggcac

SEQ ID NO: 595665 - DNA, 25 bp, Mus musculus
ccggcgcatttagaaaaggaggcac

SEQ ID NO: 595666 - DNA, 25 bp, Mus musculus
ccggcgcctgaccaagttcacaggg

SEQ ID NO: 595667 - DNA, 25 bp, Mus musculus
ccggcgcctgacgaagttcacaggg

SEQ ID NO: 595668 - DNA, 25 bp, Mus musculus
ccggcgcctgcaacgtgggaatcct

SEQ ID NO: 595669 - DNA, 25 bp, Mus musculus
ccggcgcctgcatcgtgggaatcct

SEQ ID NO: 595670 - DNA, 25 bp, Mus musculus
ccggcgcgaagaatgcgaagccttc

SEQ ID NO: 595671 - DNA, 25 bp, Mus musculus
ccggcgcgaagattgcgaagccttc

SEQ ID NO: 595672 - DNA, 25 bp, Mus musculus
ccggcgcgttgcactctgctggagc

SEQ ID NO: 595673 - DNA, 25 bp, Mus musculus
ccggcgcgttgctctctgctggagc

SEQ ID NO: 595674 - DNA, 25 bp, Mus musculus
ccggcgctacctcgctgtaaatact

SEQ ID NO: 595675 - DNA, 25 bp, Mus musculus
ccggcgctacctggctgtaaatact

SEQ ID NO: 595676 - DNA, 25 bp, Mus musculus
ccggcgctatgtagcagatcgaagc

SEQ ID NO: 595677 - DNA, 25 bp, Mus musculus
ccggcgctatgttgcagatcgaagc

SEQ ID NO: 595678 - DNA, 25 bp, Mus musculus
ccggcgctggcgagttagttttgtc

SEQ ID NO: 595679 - DNA, 25 bp, Mus musculus
ccggcgctggcgtgttagttttgtc

SEQ ID NO: 595680 - DNA, 25 bp, Mus musculus
ccggcggcgtgtcaatggcggcctc

SEQ ID NO: 595681 - DNA, 25 bp, Mus musculus
ccggcggcgtgtctacgatgcctta

SEQ ID NO: 595682 - DNA, 25 bp, Mus musculus
ccggcggcgtgtgaatggcggcctc

SEQ ID NO: 595683 - DNA, 25 bp, Mus musculus
ccggcggcgtgtgtacgatgcctta

SEQ ID NO: 595684 - DNA, 25 bp, Mus musculus
ccggcggtcgctcgatgtgctcact

SEQ ID NO: 595685 - DNA, 25 bp, Mus musculus
ccggcggtcgctggatgtgctcact

SEQ ID NO: 595686 - DNA, 25 bp, Mus musculus
ccggcggttgctctcacctgattct

SEQ ID NO: 595687 - DNA, 25 bp, Mus musculus
ccggcggttgctgtcacctgattct

SEQ ID NO: 595688 - DNA, 25 bp, Mus musculus
ccggcgtccgagaacatggagaagc

SEQ ID NO: 595689 - DNA, 25 bp, Mus musculus
ccggcgtccgagtacatggagaagc

SEQ ID NO: 595690 - DNA, 25 bp, Mus musculus
ccggctaaggaactgcaaagagatg

SEQ ID NO: 595691 - DNA, 25 bp, Mus musculus
ccggctaaggaagtgcaaagagatg

SEQ ID NO: 595692 - DNA, 25 bp, Mus musculus
ccggctacacagaacaactgcaaca

SEQ ID NO: 595693 - DNA, 25 bp, Mus musculus
ccggctacacagtacaactgcaaca

SEQ ID NO: 595694 - DNA, 25 bp, Mus musculus
ccggctaccatgctttgttctcaga

SEQ ID NO: 595695 - DNA, 25 bp, Mus musculus
ccggctaccatggtttgttctcaga

SEQ ID NO: 595696 - DNA, 25 bp, Mus musculus
ccggctacttcaagtctggacttaa

SEQ ID NO: 595697 - DNA, 25 bp, Mus musculus
ccggctacttcatgtctggacttaa

SEQ ID NO: 595698 - DNA, 25 bp, Mus musculus
ccggctagagtaactgcgggaccag

SEQ ID NO: 595699 - DNA, 25 bp, Mus musculus
ccggctagagtatctgcgggaccag

SEQ ID NO: 595700 - DNA, 25 bp, Mus musculus
ccggctaggccccactgagagcaag

SEQ ID NO: 595701 - DNA, 25 bp, Mus musculus
ccggctaggcccgactgagagcaag

SEQ ID NO: 595702 - DNA, 25 bp, Mus musculus
ccggctagtgagaacacatgtagat

SEQ ID NO: 595703 - DNA, 25 bp, Mus musculus
ccggctagtgagtacacatgtagat

SEQ ID NO: 595704 - DNA, 25 bp, Mus musculus
ccggctagtggcctttccagctttg

SEQ ID NO: 595705 - DNA, 25 bp, Mus musculus
ccggctagtggcgtttccagctttg

SEQ ID NO: 595706 - DNA, 25 bp, Mus musculus
ccggctatgataacgccctggtgca

SEQ ID NO: 595707 - DNA, 25 bp, Mus musculus
ccggctatgatatcgccctggtgca

SEQ ID NO: 595708 - DNA, 25 bp, Mus musculus
ccggctcaaacacgctggaatctct

SEQ ID NO: 595709 - DNA, 25 bp, Mus musculus
ccggctcaaacaggctggaatctct

SEQ ID NO: 595710 - DNA, 25 bp, Mus musculus
ccggctcatgaccaggatccttcta

SEQ ID NO: 595711 - DNA, 25 bp, Mus musculus
ccggctcatgacgaggatccttcta

SEQ ID NO: 595712 - DNA, 25 bp, Mus musculus
ccggctccaagtaccgggcagctgg

SEQ ID NO: 595713 - DNA, 25 bp, Mus musculus
ccggctccaagttccgggcagctgg

SEQ ID NO: 595714 - DNA, 25 bp, Mus musculus
ccggctcgacatctctgagttccag

SEQ ID NO: 595715 - DNA, 25 bp, Mus musculus
ccggctcgacatgtctgagttccag

SEQ ID NO: 595716 - DNA, 25 bp, Mus musculus
ccggctcggatgatcagtccctctg

SEQ ID NO: 595717 - DNA, 25 bp, Mus musculus
ccggctcggatgttcagtccctctg

SEQ ID NO: 595718 - DNA, 25 bp, Mus musculus
ccggctcggtgcaaggcgactctgc

SEQ ID NO: 595719 - DNA, 25 bp, Mus musculus
ccggctcggtgctaggcgactctgc

SEQ ID NO: 595720 - DNA, 25 bp, Mus musculus
ccggctctaggccaaaaggctcggt

SEQ ID NO: 595721 - DNA, 25 bp, Mus musculus
ccggctctaggcgaaaaggctcggt

SEQ ID NO: 595722 - DNA, 25 bp, Mus musculus
ccggctctcgttattggtcatccaa

SEQ ID NO: 595723 - DNA, 25 bp, Mus musculus
ccggctctcgtttttggtcatccaa

SEQ ID NO: 595724 - DNA, 25 bp, Mus musculus
ccggctctggctaaacggtgtgcag

SEQ ID NO: 595725 - DNA, 25 bp, Mus musculus
ccggctctggcttaacggtgtgcag

SEQ ID NO: 595726 - DNA, 25 bp, Mus musculus
ccggctgagctcactagagaagagt

SEQ ID NO: 595727 - DNA, 25 bp, Mus musculus
ccggctgagctctctagagaagagt

SEQ ID NO: 595728 - DNA, 25 bp, Mus musculus
ccggctgcagagagtctagggacca

SEQ ID NO: 595729 - DNA, 25 bp, Mus musculus
ccggctgcagagtgtctagggacca

SEQ ID NO: 595730 - DNA, 25 bp, Mus musculus
ccggctgcccttactccggtgtggg

SEQ ID NO: 595731 - DNA, 25 bp, Mus musculus
ccggctgccctttctccggtgtggg

SEQ ID NO: 595732 - DNA, 25 bp, Mus musculus
ccggctgccgagcaaatttcaggaa

SEQ ID NO: 595733 - DNA, 25 bp, Mus musculus
ccggctgccgaggaaatttcaggaa

SEQ ID NO: 595734 - DNA, 25 bp, Mus musculus
ccggctgcgcgaactctaaggacgg

SEQ ID NO: 595735 - DNA, 25 bp, Mus musculus
ccggctgcgcgatctctaaggacgg

SEQ ID NO: 595736 - DNA, 25 bp, Mus musculus
ccggctgctggaaaataagattggt

SEQ ID NO: 595737 - DNA, 25 bp, Mus musculus
ccggctgctggataataagattggt

SEQ ID NO: 595738 - DNA, 25 bp, Mus musculus
ccggctggagcgagccaacgctctg

SEQ ID NO: 595739 - DNA, 25 bp, Mus musculus
ccggctggagcgtgccaacgctctg

SEQ ID NO: 595740 - DNA, 25 bp, Mus musculus
ccggctggcaccagagagtgacttt

SEQ ID NO: 595741 - DNA, 25 bp, Mus musculus
ccggctggcacctgagagtgacttt

SEQ ID NO: 595742 - DNA, 25 bp, Mus musculus
ccggctggccgtcgagatgaaaacc

SEQ ID NO: 595743 - DNA, 25 bp, Mus musculus
ccggctggccgtggagatgaaaacc

SEQ ID NO: 595744 - DNA, 25 bp, Mus musculus
ccggctgggcctctacacctttgag

SEQ ID NO: 595745 - DNA, 25 bp, Mus musculus
ccggctgggcctgtacacctttgag

SEQ ID NO: 595746 - DNA, 25 bp, Mus musculus
ccggctgtcattagcttgaaggcat

SEQ ID NO: 595747 - DNA, 25 bp, Mus musculus
ccggctgtcatttgcttgaaggcat

SEQ ID NO: 595748 - DNA, 25 bp, Mus musculus
ccggctgtcctcaggagaaggtcct

SEQ ID NO: 595749 - DNA, 25 bp, Mus musculus
ccggctgtcctctggagaaggtcct

SEQ ID NO: 595750 - DNA, 25 bp, Mus musculus
ccggcttccaggctgccttctgtga

SEQ ID NO: 595751 - DNA, 25 bp, Mus musculus
ccggcttccagggtgccttctgtga

SEQ ID NO: 595752 - DNA, 25 bp, Mus musculus
ccggcttctgctcagccaacagtgt

SEQ ID NO: 595753 - DNA, 25 bp, Mus musculus
ccggcttctgctgagccaacagtgt

SEQ ID NO: 595754 - DNA, 25 bp, Mus musculus
ccggcttgatagagttggaaggatt

SEQ ID NO: 595755 - DNA, 25 bp, Mus musculus
ccggcttgatagtgttggaaggatt

SEQ ID NO: 595756 - DNA, 25 bp, Mus musculus
ccggctttcagaatgcgaggaacaa

SEQ ID NO: 595757 - DNA, 25 bp, Mus musculus
ccggctttcagattgcgaggaacaa

SEQ ID NO: 595758 - DNA, 25 bp, Mus musculus
ccggctttctgacagacctcagctg

SEQ ID NO: 595759 - DNA, 25 bp, Mus musculus
ccggctttctgagagacctcagctg

SEQ ID NO: 595760 - DNA, 25 bp, Mus musculus
ccggctttgtagcaatgctgataca

SEQ ID NO: 595761 - DNA, 25 bp, Mus musculus
ccggctttgtaggaatgctgataca

SEQ ID NO: 595762 - DNA, 25 bp, Mus musculus
ccgggaaaaaatcaacactgccatc

SEQ ID NO: 595763 - DNA, 25 bp, Mus musculus
ccgggaaaaaatgaacactgccatc

SEQ ID NO: 595764 - DNA, 25 bp, Mus musculus
ccgggaaaggcaactgtatgaacac

SEQ ID NO: 595765 - DNA, 25 bp, Mus musculus
ccgggaaaggcatctgtatgaacac

SEQ ID NO: 595766 - DNA, 25 bp, Mus musculus
ccgggaaagtttcccgagatcggct

SEQ ID NO: 595767 - DNA, 25 bp, Mus musculus
ccgggaaagtttgccgagatcggct

SEQ ID NO: 595768 - DNA, 25 bp, Mus musculus
ccgggaagatgccagtggcggtgat

SEQ ID NO: 595769 - DNA, 25 bp, Mus musculus
ccgggaagatgcgagtggcggtgat

SEQ ID NO: 595770 - DNA, 25 bp, Mus musculus
ccgggaagcactatgttcagtggtg

SEQ ID NO: 595771 - DNA, 25 bp, Mus musculus
ccgggaagcactttgttcagtggtg

SEQ ID NO: 595772 - DNA, 25 bp, Mus musculus
ccgggaagtacgagctgactctgtg

SEQ ID NO: 595773 - DNA, 25 bp, Mus musculus
ccgggaagtacgtgctgactctgtg

SEQ ID NO: 595774 - DNA, 25 bp, Mus musculus
ccgggaatatgcagacagttttgga

SEQ ID NO: 595775 - DNA, 25 bp, Mus musculus
ccgggaatatgctgacagttttgga

SEQ ID NO: 595776 - DNA, 25 bp, Mus musculus
ccgggaatcagacacaggaaaggca

SEQ ID NO: 595777 - DNA, 25 bp, Mus musculus
ccgggaatcagagacaggaaaggca

SEQ ID NO: 595778 - DNA, 25 bp, Mus musculus
ccgggaatcagtcacacaaatcatg

SEQ ID NO: 595779 - DNA, 25 bp, Mus musculus
ccgggaatcagtgacacaaatcatg

SEQ ID NO: 595780 - DNA, 25 bp, Mus musculus
ccgggacaatcacgggcgacttcag

SEQ ID NO: 595781 - DNA, 25 bp, Mus musculus
ccgggacaatcaggggcgacttcag

SEQ ID NO: 595782 - DNA, 25 bp, Mus musculus
ccgggacagaccaagcagtaggatt

SEQ ID NO: 595783 - DNA, 25 bp, Mus musculus
ccgggacagacctagcagtaggatt

SEQ ID NO: 595784 - DNA, 25 bp, Mus musculus
ccgggacagttccaggagtattata

SEQ ID NO: 595785 - DNA, 25 bp, Mus musculus
ccgggacagttcgaggagtattata

SEQ ID NO: 595786 - DNA, 25 bp, Mus musculus
ccgggacatggcaaacaggatcagt

SEQ ID NO: 595787 - DNA, 25 bp, Mus musculus
ccgggacatggctaacaggatcagt

SEQ ID NO: 595788 - DNA, 25 bp, Mus musculus
ccgggacattgtcctacctgatggc

SEQ ID NO: 595789 - DNA, 25 bp, Mus musculus
ccgggacattgtgctacctgatggc

SEQ ID NO: 595790 - DNA, 25 bp, Mus musculus
ccgggaccccagagagtaacaggtg

SEQ ID NO: 595791 - DNA, 25 bp, Mus musculus
ccgggaccccagtgagtaacaggtg

SEQ ID NO: 595792 - DNA, 25 bp, Mus musculus
ccgggacgcaagagctacttcgcac

SEQ ID NO: 595793 - DNA, 25 bp, Mus musculus
ccgggacgcaagtgctacttcgcac

SEQ ID NO: 595794 - DNA, 25 bp, Mus musculus
ccgggacgccatacttggagtcagg

SEQ ID NO: 595795 - DNA, 25 bp, Mus musculus
ccgggacgccattcttggagtcagg

SEQ ID NO: 595796 - DNA, 25 bp, Mus musculus
ccgggacggaatcgacaatgagaca

SEQ ID NO: 595797 - DNA, 25 bp, Mus musculus
ccgggacggaatggacaatgagaca

SEQ ID NO: 595798 - DNA, 25 bp, Mus musculus
ccgggactcactcacattactggat

SEQ ID NO: 595799 - DNA, 25 bp, Mus musculus
ccgggactcactgacattactggat

SEQ ID NO: 595800 - DNA, 25 bp, Mus musculus
ccgggactcggactatgacatggac

SEQ ID NO: 595801 - DNA, 25 bp, Mus musculus
ccgggactcggagtatgacatggac

SEQ ID NO: 595802 - DNA, 25 bp, Mus musculus
ccgggagacggaaagctgcccacgt

SEQ ID NO: 595803 - DNA, 25 bp, Mus musculus
ccgggagacggatagctgcccacgt

SEQ ID NO: 595804 - DNA, 25 bp, Mus musculus
ccgggagatcggattcactacatca

SEQ ID NO: 595805 - DNA, 25 bp, Mus musculus
ccgggagatcggtttcactacatca

SEQ ID NO: 595806 - DNA, 25 bp, Mus musculus
ccgggagcagcaacctcaagagagt

SEQ ID NO: 595807 - DNA, 25 bp, Mus musculus
ccgggagcagcatcctcaagagagt

SEQ ID NO: 595808 - DNA, 25 bp, Mus musculus
ccgggagctatgagagcttgaccct

SEQ ID NO: 595809 - DNA, 25 bp, Mus musculus
ccgggagctatgtgagcttgaccct

SEQ ID NO: 595810 - DNA, 25 bp, Mus musculus
ccgggaggacccagcaatgtcctga

SEQ ID NO: 595811 - DNA, 25 bp, Mus musculus
ccgggaggaccctgcaatgtcctga

SEQ ID NO: 595812 - DNA, 25 bp, Mus musculus
ccgggaggtcacagccttaggcaaa

SEQ ID NO: 595813 - DNA, 25 bp, Mus musculus
ccgggaggtcactgccttaggcaaa

SEQ ID NO: 595814 - DNA, 25 bp, Mus musculus
ccgggaggtcagattcacttctggg

SEQ ID NO: 595815 - DNA, 25 bp, Mus musculus
ccgggaggtcagtttcacttctggg

SEQ ID NO: 595816 - DNA, 25 bp, Mus musculus
ccgggaggttctcatctcagaggct

SEQ ID NO: 595817 - DNA, 25 bp, Mus musculus
ccgggaggttctgatctcagaggct

SEQ ID NO: 595818 - DNA, 25 bp, Mus musculus
ccgggataccgacagacataggaag

SEQ ID NO: 595819 - DNA, 25 bp, Mus musculus
ccgggataccgagagacataggaag

SEQ ID NO: 595820 - DNA, 25 bp, Mus musculus
ccgggatgagtgaataagctgtcga

SEQ ID NO: 595821 - DNA, 25 bp, Mus musculus
ccgggatgagtgcagaatatgcccc

SEQ ID NO: 595822 - DNA, 25 bp, Mus musculus
ccgggatgagtggagaatatgcccc

SEQ ID NO: 595823 - DNA, 25 bp, Mus musculus
ccgggatgagtgtataagctgtcga

SEQ ID NO: 595824 - DNA, 25 bp, Mus musculus
ccgggatgtgtgagaaccttgacca

SEQ ID NO: 595825 - DNA, 25 bp, Mus musculus
ccgggatgtgtgtgaaccttgacca

SEQ ID NO: 595826 - DNA, 25 bp, Mus musculus
ccgggatttgctactgcctccatca

SEQ ID NO: 595827 - DNA, 25 bp, Mus musculus
ccgggatttgcttctgcctccatca

SEQ ID NO: 595828 - DNA, 25 bp, Mus musculus
ccgggcaaactcagcctaggtctaa

SEQ ID NO: 595829 - DNA, 25 bp, Mus musculus
ccgggcaaactctgcctaggtctaa

SEQ ID NO: 595830 - DNA, 25 bp, Mus musculus
ccgggcagacacagctgctgcaagc

SEQ ID NO: 595831 - DNA, 25 bp, Mus musculus
ccgggcagacactgctgctgcaagc

SEQ ID NO: 595832 - DNA, 25 bp, Mus musculus
ccgggcaggtccaaacagtactgaa

SEQ ID NO: 595833 - DNA, 25 bp, Mus musculus
ccgggcaggtcctaacagtactgaa

SEQ ID NO: 595834 - DNA, 25 bp, Mus musculus
ccgggccacagcaagcttccagtaa

SEQ ID NO: 595835 - DNA, 25 bp, Mus musculus
ccgggccacagctagcttccagtaa

SEQ ID NO: 595836 - DNA, 25 bp, Mus musculus
ccgggccagattaagtaacttagca

SEQ ID NO: 595837 - DNA, 25 bp, Mus musculus
ccgggccagatttagtaacttagca

SEQ ID NO: 595838 - DNA, 25 bp, Mus musculus
ccgggcccggatattaactccagag

SEQ ID NO: 595839 - DNA, 25 bp, Mus musculus
ccgggcccggattttaactccagag

SEQ ID NO: 595840 - DNA, 25 bp, Mus musculus
ccgggccgatgtcgttgcaaatgat

SEQ ID NO: 595841 - DNA, 25 bp, Mus musculus
ccgggccgatgtggttgcaaatgat

SEQ ID NO: 595842 - DNA, 25 bp, Mus musculus
ccgggcctgccgcttgagaccatta

SEQ ID NO: 595843 - DNA, 25 bp, Mus musculus
ccgggcctgccggttgagaccatta

SEQ ID NO: 595844 - DNA, 25 bp, Mus musculus
ccgggcgggaatagtttccacattg

SEQ ID NO: 595845 - DNA, 25 bp, Mus musculus
ccgggcgggaattgtttccacattg

SEQ ID NO: 595846 - DNA, 25 bp, Mus musculus
ccgggcgggcctacctgactttgct

SEQ ID NO: 595847 - DNA, 25 bp, Mus musculus
ccgggcgggccttcctgactttgct

SEQ ID NO: 595848 - DNA, 25 bp, Mus musculus
ccgggctccgagagtggaattcaaa

SEQ ID NO: 595849 - DNA, 25 bp, Mus musculus
ccgggctccgagtgtggaattcaaa

SEQ ID NO: 595850 - DNA, 25 bp, Mus musculus
ccgggctcggaacacacatttatta

SEQ ID NO: 595851 - DNA, 25 bp, Mus musculus
ccgggctcggaagacacatttatta

SEQ ID NO: 595852 - DNA, 25 bp, Mus musculus
ccgggctctcaacttgagtttggca

SEQ ID NO: 595853 - DNA, 25 bp, Mus musculus
ccgggctctcaagttgagtttggca

SEQ ID NO: 595854 - DNA, 25 bp, Mus musculus
ccgggctgaagtcgacacattcatg

SEQ ID NO: 595855 - DNA, 25 bp, Mus musculus
ccgggctgaagtggacacattcatg

SEQ ID NO: 595856 - DNA, 25 bp, Mus musculus
ccgggctgcccgaggatggatttta

SEQ ID NO: 595857 - DNA, 25 bp, Mus musculus
ccgggctgcccgtggatggatttta

SEQ ID NO: 595858 - DNA, 25 bp, Mus musculus
ccgggctgcggtagcttctgtaact

SEQ ID NO: 595859 - DNA, 25 bp, Mus musculus
ccgggctgcggttgcttctgtaact

SEQ ID NO: 595860 - DNA, 25 bp, Mus musculus
ccgggctgctgaagaggcgttttca

SEQ ID NO: 595861 - DNA, 25 bp, Mus musculus
ccgggctgctgatgaggcgttttca

SEQ ID NO: 595862 - DNA, 25 bp, Mus musculus
ccgggctgtcatactgaaattcagt

SEQ ID NO: 595863 - DNA, 25 bp, Mus musculus
ccgggctgtcattctgaaattcagt

SEQ ID NO: 595864 - DNA, 25 bp, Mus musculus
ccgggctgtttgctacagttgtcca

SEQ ID NO: 595865 - DNA, 25 bp, Mus musculus
ccgggctgtttggtacagttgtcca

SEQ ID NO: 595866 - DNA, 25 bp, Mus musculus
ccgggcttctacaggaacgtggtga

SEQ ID NO: 595867 - DNA, 25 bp, Mus musculus
ccgggcttctactggaacgtggtga

SEQ ID NO: 595868 - DNA, 25 bp, Mus musculus
ccggggaaggccacactgtcactgt

SEQ ID NO: 595869 - DNA, 25 bp, Mus musculus
ccggggaaggcctcactgtcactgt

SEQ ID NO: 595870 - DNA, 25 bp, Mus musculus
ccgggtaacatcctgctgcagctgc

SEQ ID NO: 595871 - DNA, 25 bp, Mus musculus
ccgggtaacatcgtgctgcagctgc

SEQ ID NO: 595872 - DNA, 25 bp, Mus musculus
ccgggtaggccaagacctgaaggat

SEQ ID NO: 595873 - DNA, 25 bp, Mus musculus
ccgggtaggccatgacctgaaggat

SEQ ID NO: 595874 - DNA, 25 bp, Mus musculus
ccgggtagttaaagacatggcaact

SEQ ID NO: 595875 - DNA, 25 bp, Mus musculus
ccgggtagttaatgacatggcaact

SEQ ID NO: 595876 - DNA, 25 bp, Mus musculus
ccgggtatacttagtggaagaacat

SEQ ID NO: 595877 - DNA, 25 bp, Mus musculus
ccgggtatactttgtggaagaacat

SEQ ID NO: 595878 - DNA, 25 bp, Mus musculus
ccgggtcactgcactataggagtca

SEQ ID NO: 595879 - DNA, 25 bp, Mus musculus
ccgggtcactgctctataggagtca

SEQ ID NO: 595880 - DNA, 25 bp, Mus musculus
ccgggtcagcggaagattgtcatgc

SEQ ID NO: 595881 - DNA, 25 bp, Mus musculus
ccgggtcagcggtagattgtcatgc

SEQ ID NO: 595882 - DNA, 25 bp, Mus musculus
ccgggtcatagacggaagtccagct

SEQ ID NO: 595883 - DNA, 25 bp, Mus musculus
ccgggtcatagagggaagtccagct

SEQ ID NO: 595884 - DNA, 25 bp, Mus musculus
ccgggtcatctcaacttggatcctt

SEQ ID NO: 595885 - DNA, 25 bp, Mus musculus
ccgggtcatctctacttggatcctt

SEQ ID NO: 595886 - DNA, 25 bp, Mus musculus
ccgggtcatgctcaggtctcctaag

SEQ ID NO: 595887 - DNA, 25 bp, Mus musculus
ccgggtcatgctgaggtctcctaag

SEQ ID NO: 595888 - DNA, 25 bp, Mus musculus
ccgggtccacctagtgatggaaaag

SEQ ID NO: 595889 - DNA, 25 bp, Mus musculus
ccgggtccaccttgtgatggaaaag

SEQ ID NO: 595890 - DNA, 25 bp, Mus musculus
ccgggtctctcaagttgaggaggaa

SEQ ID NO: 595891 - DNA, 25 bp, Mus musculus
ccgggtctctcatgttgaggaggaa

SEQ ID NO: 595892 - DNA, 25 bp, Mus musculus
ccgggtgaaaggagtgaccagcatt

SEQ ID NO: 595893 - DNA, 25 bp, Mus musculus
ccgggtgaaaggtgtgaccagcatt

SEQ ID NO: 595894 - DNA, 25 bp, Mus musculus
ccgggtgacaccagcaggagataac

SEQ ID NO: 595895 - DNA, 25 bp, Mus musculus
ccgggtgacacctgcaggagataac

SEQ ID NO: 595896 - DNA, 25 bp, Mus musculus
ccgggtgccaaacatcgctgaattt

SEQ ID NO: 595897 - DNA, 25 bp, Mus musculus
ccgggtgccaaagatcgctgaattt

SEQ ID NO: 595898 - DNA, 25 bp, Mus musculus
ccgggtgctggccattgaatacttt

SEQ ID NO: 595899 - DNA, 25 bp, Mus musculus
ccgggtgctggcgattgaatacttt

SEQ ID NO: 595900 - DNA, 25 bp, Mus musculus
ccgggtgctgtaaggaaaacctaag

SEQ ID NO: 595901 - DNA, 25 bp, Mus musculus
ccgggtgctgtatggaaaacctaag

SEQ ID NO: 595902 - DNA, 25 bp, Mus musculus
ccgggtgtgaatatcgactttctcg

SEQ ID NO: 595903 - DNA, 25 bp, Mus musculus
ccgggtgtgaatttcgactttctcg

SEQ ID NO: 595904 - DNA, 25 bp, Mus musculus
ccgggttcagaaccagcaggacttt

SEQ ID NO: 595905 - DNA, 25 bp, Mus musculus
ccgggttcagaagcagcaggacttt

SEQ ID NO: 595906 - DNA, 25 bp, Mus musculus
ccgggttctcttaaagagcagacaa

SEQ ID NO: 595907 - DNA, 25 bp, Mus musculus
ccgggttctctttaagagcagacaa

SEQ ID NO: 595908 - DNA, 25 bp, Mus musculus
ccgggtttcccaagagggcagtcat

SEQ ID NO: 595909 - DNA, 25 bp, Mus musculus
ccgggtttcccatgagggcagtcat

SEQ ID NO: 595910 - DNA, 25 bp, Mus musculus
ccggtaagaggcatctcgaagcgcc

SEQ ID NO: 595911 - DNA, 25 bp, Mus musculus
ccggtaagaggcttctcgaagcgcc

SEQ ID NO: 595912 - DNA, 25 bp, Mus musculus
ccggtaagatcaagtgcctattgaa

SEQ ID NO: 595913 - DNA, 25 bp, Mus musculus
ccggtaagatcatgtgcctattgaa

SEQ ID NO: 595914 - DNA, 25 bp, Mus musculus
ccggtaatagcgcatggtggcatcc

SEQ ID NO: 595915 - DNA, 25 bp, Mus musculus
ccggtaatagcggatggtggcatcc

SEQ ID NO: 595916 - DNA, 25 bp, Mus musculus
ccggtacaattcctgtgatgtatca

SEQ ID NO: 595917 - DNA, 25 bp, Mus musculus
ccggtacaattcgtgtgatgtatca

SEQ ID NO: 595918 - DNA, 25 bp, Mus musculus
ccggtacagtgacacgacaggctgt

SEQ ID NO: 595919 - DNA, 25 bp, Mus musculus
ccggtacagtgagacgacaggctgt

SEQ ID NO: 595920 - DNA, 25 bp, Mus musculus
ccggtacatgaaccaggacttcagc

SEQ ID NO: 595921 - DNA, 25 bp, Mus musculus
ccggtacatgaagcaggacttcagc

SEQ ID NO: 595922 - DNA, 25 bp, Mus musculus
ccggtacgatgcagtgacaattaag

SEQ ID NO: 595923 - DNA, 25 bp, Mus musculus
ccggtacgatgctgtgacaattaag

SEQ ID NO: 595924 - DNA, 25 bp, Mus musculus
ccggtaggaccacaagggtctccag

SEQ ID NO: 595925 - DNA, 25 bp, Mus musculus
ccggtaggaccagaagggtctccag

SEQ ID NO: 595926 - DNA, 25 bp, Mus musculus
ccggtatctatcagtgtgttataag

SEQ ID NO: 595927 - DNA, 25 bp, Mus musculus
ccggtatctatctgtgtgttataag

SEQ ID NO: 595928 - DNA, 25 bp, Mus musculus
ccggtattcaatccctcagtacagt

SEQ ID NO: 595929 - DNA, 25 bp, Mus musculus
ccggtattcaatgcctcagtacagt

SEQ ID NO: 595930 - DNA, 25 bp, Mus musculus
ccggtcagtgaacccggcgagccat

SEQ ID NO: 595931 - DNA, 25 bp, Mus musculus
ccggtcagtgaagccggcgagccat

SEQ ID NO: 595932 - DNA, 25 bp, Mus musculus
ccggtcatagctagggtccctcgcg

SEQ ID NO: 595933 - DNA, 25 bp, Mus musculus
ccggtcatagcttgggtccctcgcg

SEQ ID NO: 595934 - DNA, 25 bp, Mus musculus
ccggtccccaagcaagggatgctca

SEQ ID NO: 595935 - DNA, 25 bp, Mus musculus
ccggtccccaaggaagggatgctca

SEQ ID NO: 595936 - DNA, 25 bp, Mus musculus
ccggtccccagcacgaggatggcgt

SEQ ID NO: 595937 - DNA, 25 bp, Mus musculus
ccggtccccagctcgaggatggcgt

SEQ ID NO: 595938 - DNA, 25 bp, Mus musculus
ccggtcctatgacgcagtggcagct

SEQ ID NO: 595939 - DNA, 25 bp, Mus musculus
ccggtcctatgaggcagtggcagct

SEQ ID NO: 595940 - DNA, 25 bp, Mus musculus
ccggtcgaatcacacaatgggctgg

SEQ ID NO: 595941 - DNA, 25 bp, Mus musculus
ccggtcgaatcagacaatgggctgg

SEQ ID NO: 595942 - DNA, 25 bp, Mus musculus
ccggtcgctcttcgaattggaatta

SEQ ID NO: 595943 - DNA, 25 bp, Mus musculus
ccggtcgctcttggaattggaatta

SEQ ID NO: 595944 - DNA, 25 bp, Mus musculus
ccggtctcaagtctcatggctgcct

SEQ ID NO: 595945 - DNA, 25 bp, Mus musculus
ccggtctcaagtgtcatggctgcct

SEQ ID NO: 595946 - DNA, 25 bp, Mus musculus
ccggtctcggctacaggagaagaat

SEQ ID NO: 595947 - DNA, 25 bp, Mus musculus
ccggtctcggcttcaggagaagaat

SEQ ID NO: 595948 - DNA, 25 bp, Mus musculus
ccggtctctagacggaggtttacag

SEQ ID NO: 595949 - DNA, 25 bp, Mus musculus
ccggtctctagagggaggtttacag

SEQ ID NO: 595950 - DNA, 25 bp, Mus musculus
ccggtgaatatgaggagcgcaagct

SEQ ID NO: 595951 - DNA, 25 bp, Mus musculus
ccggtgaatatgtggagcgcaagct

SEQ ID NO: 595952 - DNA, 25 bp, Mus musculus
ccggtgactcacaaacgcccatttt

SEQ ID NO: 595953 - DNA, 25 bp, Mus musculus
ccggtgactcactaacgcccatttt

SEQ ID NO: 595954 - DNA, 25 bp, Mus musculus
ccggtgagcgtccaacgactgaagc

SEQ ID NO: 595955 - DNA, 25 bp, Mus musculus
ccggtgagcgtcgaacgactgaagc

SEQ ID NO: 595956 - DNA, 25 bp, Mus musculus
ccggtgatttaaagataggtggaca

SEQ ID NO: 595957 - DNA, 25 bp, Mus musculus
ccggtgatttaatgataggtggaca

SEQ ID NO: 595958 - DNA, 25 bp, Mus musculus
ccggtgcacatgaggcactagccaa

SEQ ID NO: 595959 - DNA, 25 bp, Mus musculus
ccggtgcacatgtggcactagccaa

SEQ ID NO: 595960 - DNA, 25 bp, Mus musculus
ccggtgccatgaaccggaacgggca

SEQ ID NO: 595961 - DNA, 25 bp, Mus musculus
ccggtgccatgatccggaacgggca

SEQ ID NO: 595962 - DNA, 25 bp, Mus musculus
ccggtgcggccgatcaagccagcga

SEQ ID NO: 595963 - DNA, 25 bp, Mus musculus
ccggtgcggccgttcaagccagcga

SEQ ID NO: 595964 - DNA, 25 bp, Mus musculus
ccggtgctgaagaccaacgccggac

SEQ ID NO: 595965 - DNA, 25 bp, Mus musculus
ccggtgctgaagtccaacgccggac

SEQ ID NO: 595966 - DNA, 25 bp, Mus musculus
ccggtgctgtttacctatgacaatg

SEQ ID NO: 595967 - DNA, 25 bp, Mus musculus
ccggtgctgttttcctatgacaatg

SEQ ID NO: 595968 - DNA, 25 bp, Mus musculus
ccggtggaacaaaggagtgagattc

SEQ ID NO: 595969 - DNA, 25 bp, Mus musculus
ccggtggaacaatggagtgagattc

SEQ ID NO: 595970 - DNA, 25 bp, Mus musculus
ccggtggaattcagttcaggtcaac

SEQ ID NO: 595971 - DNA, 25 bp, Mus musculus
ccggtggaattctgttcaggtcaac

SEQ ID NO: 595972 - DNA, 25 bp, Mus musculus
ccggtggattgtatcaaatctagaa

SEQ ID NO: 595973 - DNA, 25 bp, Mus musculus
ccggtggattgtttcaaatctagaa

SEQ ID NO: 595974 - DNA, 25 bp, Mus musculus
ccggtggcttcgaaggaagatcgta

SEQ ID NO: 595975 - DNA, 25 bp, Mus musculus
ccggtggcttcgtaggaagatcgta

SEQ ID NO: 595976 - DNA, 25 bp, Mus musculus
ccggtggtgcccatgcagaggcaaa

SEQ ID NO: 595977 - DNA, 25 bp, Mus musculus
ccggtggtgcccttgcagaggcaaa

SEQ ID NO: 595978 - DNA, 25 bp, Mus musculus
ccggtggttatgacgataggatccc

SEQ ID NO: 595979 - DNA, 25 bp, Mus musculus
ccggtggttatgtcgataggatccc

SEQ ID NO: 595980 - DNA, 25 bp, Mus musculus
ccggtgtccgccaatttcagtacaa

SEQ ID NO: 595981 - DNA, 25 bp, Mus musculus
ccggtgtccgcctatttcagtacaa

SEQ ID NO: 595982 - DNA, 25 bp, Mus musculus
ccggtgtgacaccaggcagcagtac

SEQ ID NO: 595983 - DNA, 25 bp, Mus musculus
ccggtgtgacacgaggcagcagtac

SEQ ID NO: 595984 - DNA, 25 bp, Mus musculus
ccggtgtgaccactagtgccagatt

SEQ ID NO: 595985 - DNA, 25 bp, Mus musculus
ccggtgtgaccagtagtgccagatt

SEQ ID NO: 595986 - DNA, 25 bp, Mus musculus
ccggtgtggttgactctcactcttt

SEQ ID NO: 595987 - DNA, 25 bp, Mus musculus
ccggtgtggttgtctctcactcttt

SEQ ID NO: 595988 - DNA, 25 bp, Mus musculus
ccggttactagcaacgttgagctcc

SEQ ID NO: 595989 - DNA, 25 bp, Mus musculus
ccggttactagctacgttgagctcc

SEQ ID NO: 595990 - DNA, 25 bp, Mus musculus
ccggttataccaaagctgtgctgac

SEQ ID NO: 595991 - DNA, 25 bp, Mus musculus
ccggttataccatagctgtgctgac

SEQ ID NO: 595992 - DNA, 25 bp, Mus musculus
ccggttcaagtgcatccacattgag

SEQ ID NO: 595993 - DNA, 25 bp, Mus musculus
ccggttcaagtggatccacattgag

SEQ ID NO: 595994 - DNA, 25 bp, Mus musculus
ccggttctagcaaacagcaattgat

SEQ ID NO: 595995 - DNA, 25 bp, Mus musculus
ccggttctagcatacagcaattgat

SEQ ID NO: 595996 - DNA, 25 bp, Mus musculus
ccggttctgagaacgtattgctgac

SEQ ID NO: 595997 - DNA, 25 bp, Mus musculus
ccggttctgagatcgtattgctgac

SEQ ID NO: 595998 - DNA, 25 bp, Mus musculus
ccggttgatgcaaatgggacgcaca

SEQ ID NO: 595999 - DNA, 25 bp, Mus musculus
ccggttgatgcatatgggacgcaca

SEQ ID NO: 596000 - DNA, 25 bp, Mus musculus
ccggttgcgaggcaacatcgccaac

SEQ ID NO: 596001 - DNA, 25 bp, Mus musculus
ccggttgcgagggaacatcgccaac

SEQ ID NO: 596002 - DNA, 25 bp, Mus musculus
ccggttgctaggacttggataagcg

SEQ ID NO: 596003 - DNA, 25 bp, Mus musculus
ccggttgctaggtcttggataagcg

SEQ ID NO: 596004 - DNA, 25 bp, Mus musculus
ccggttgctcggaagcttcagtcga

SEQ ID NO: 596005 - DNA, 25 bp, Mus musculus
ccggttgctcggtagcttcagtcga

SEQ ID NO: 596006 - DNA, 25 bp, Mus musculus
ccggttgtcagtctccggacgcgca

SEQ ID NO: 596007 - DNA, 25 bp, Mus musculus
ccggttgtcagtgtccggacgcgca

SEQ ID NO: 596008 - DNA, 25 bp, Mus musculus
ccggtttgaggacgatgagcggcag

SEQ ID NO: 596009 - DNA, 25 bp, Mus musculus
ccggtttgaggaggatgagcggcag

SEQ ID NO: 596010 - DNA, 25 bp, Mus musculus
ccggtttgcagaaagtaggatctgc

SEQ ID NO: 596011 - DNA, 25 bp, Mus musculus
ccggtttgcagatagtaggatctgc

SEQ ID NO: 596012 - DNA, 25 bp, Mus musculus
ccggtttggctcacagtaacctgtt

SEQ ID NO: 596013 - DNA, 25 bp, Mus musculus
ccggtttggctctcagtaacctgtt

SEQ ID NO: 596014 - DNA, 25 bp, Mus musculus
ccggtttgggcacatcatgattgaa

SEQ ID NO: 596015 - DNA, 25 bp, Mus musculus
ccggtttgggcagatcatgattgaa

SEQ ID NO: 596016 - DNA, 25 bp, Mus musculus
ccggtttgttgaatcagttgcaaga

SEQ ID NO: 596017 - DNA, 25 bp, Mus musculus
ccggtttgttgattcagttgcaaga

SEQ ID NO: 596018 - DNA, 25 bp, Mus musculus
ccgtaacctagaaattgagcgtcca

SEQ ID NO: 596019 - DNA, 25 bp, Mus musculus
ccgtaacctagatattgagcgtcca

SEQ ID NO: 596020 - DNA, 25 bp, Mus musculus
ccgtaagaatgccagcaacatggag

SEQ ID NO: 596021 - DNA, 25 bp, Mus musculus
ccgtaagaatgcgagcaacatggag

SEQ ID NO: 596022 - DNA, 25 bp, Mus musculus
ccgtaagaggctcaggccgctgctt

SEQ ID NO: 596023 - DNA, 25 bp, Mus musculus
ccgtaagaggctgaggccgctgctt

SEQ ID NO: 596024 - DNA, 25 bp, Mus musculus
ccgtaagctggtcatcatcgagagc

SEQ ID NO: 596025 - DNA, 25 bp, Mus musculus
ccgtaagctggtgatcatcgagagc

SEQ ID NO: 596026 - DNA, 25 bp, Mus musculus
ccgtaatccaaacgccaaatgagga

SEQ ID NO: 596027 - DNA, 25 bp, Mus musculus
ccgtaatccaaaggccaaatgagga

SEQ ID NO: 596028 - DNA, 25 bp, Mus musculus
ccgtaatcgtcccatgtcgtgctgg

SEQ ID NO: 596029 - DNA, 25 bp, Mus musculus
ccgtaatcgtccgatgtcgtgctgg

SEQ ID NO: 596030 - DNA, 25 bp, Mus musculus
ccgtacagccgaatagccgaggacc

SEQ ID NO: 596031 - DNA, 25 bp, Mus musculus
ccgtacagccgattagccgaggacc

SEQ ID NO: 596032 - DNA, 25 bp, Mus musculus
ccgtacaggttcagcgagacggcgc

SEQ ID NO: 596033 - DNA, 25 bp, Mus musculus
ccgtacaggttctgcgagacggcgc

SEQ ID NO: 596034 - DNA, 25 bp, Mus musculus
ccgtaccctgagctcttctatggca

SEQ ID NO: 596035 - DNA, 25 bp, Mus musculus
ccgtaccctgaggtcttctatggca

SEQ ID NO: 596036 - DNA, 25 bp, Mus musculus
ccgtaccttgtcaccaatgtcatcg

SEQ ID NO: 596037 - DNA, 25 bp, Mus musculus
ccgtaccttgtctccaatgtcatcg

SEQ ID NO: 596038 - DNA, 25 bp, Mus musculus
ccgtacggctgtagggtgatccaga

SEQ ID NO: 596039 - DNA, 25 bp, Mus musculus
ccgtacggctgttgggtgatccaga

SEQ ID NO: 596040 - DNA, 25 bp, Mus musculus
ccgtactggaccaacaccgagaaga

SEQ ID NO: 596041 - DNA, 25 bp, Mus musculus
ccgtactggacctacaccgagaaga

SEQ ID NO: 596042 - DNA, 25 bp, Mus musculus
ccgtagaaatcgacacggctccggg

SEQ ID NO: 596043 - DNA, 25 bp, Mus musculus
ccgtagaaatcgtcacggctccggg

SEQ ID NO: 596044 - DNA, 25 bp, Mus musculus
ccgtagagaacgagctgctagacag

SEQ ID NO: 596045 - DNA, 25 bp, Mus musculus
ccgtagagaacgtgctgctagacag

SEQ ID NO: 596046 - DNA, 25 bp, Mus musculus
ccgtagaggtggaatgggattactc

SEQ ID NO: 596047 - DNA, 25 bp, Mus musculus
ccgtagaggtggtatgggattactc

SEQ ID NO: 596048 - DNA, 25 bp, Mus musculus
ccgtagagtctgagcagtacggagt

SEQ ID NO: 596049 - DNA, 25 bp, Mus musculus
ccgtagagtctgtgcagtacggagt

SEQ ID NO: 596050 - DNA, 25 bp, Mus musculus
ccgtagatggagaccattgcagaaa

SEQ ID NO: 596051 - DNA, 25 bp, Mus musculus
ccgtagatggagtccattgcagaaa

SEQ ID NO: 596052 - DNA, 25 bp, Mus musculus
ccgtagcactacataaagtctgaaa

SEQ ID NO: 596053 - DNA, 25 bp, Mus musculus
ccgtagcactacttaaagtctgaaa

SEQ ID NO: 596054 - DNA, 25 bp, Mus musculus
ccgtagccggctaagaccgagctga

SEQ ID NO: 596055 - DNA, 25 bp, Mus musculus
ccgtagccggcttagaccgagctga

SEQ ID NO: 596056 - DNA, 25 bp, Mus musculus
ccgtagggacctcatctggttctgc

SEQ ID NO: 596057 - DNA, 25 bp, Mus musculus
ccgtagggacctgatctggttctgc

SEQ ID NO: 596058 - DNA, 25 bp, Mus musculus
ccgtaggtgacactccgagccgcga

SEQ ID NO: 596059 - DNA, 25 bp, Mus musculus
ccgtaggtgacagtccgagccgcga

SEQ ID NO: 596060 - DNA, 25 bp, Mus musculus
ccgtagtgattcaaggcagggtacc

SEQ ID NO: 596061 - DNA, 25 bp, Mus musculus
ccgtagtgattctaggcagggtacc

SEQ ID NO: 596062 - DNA, 25 bp, Mus musculus
ccgtatactgcaccaggattggctg

SEQ ID NO: 596063 - DNA, 25 bp, Mus musculus
ccgtatactgcagcaggattggctg

SEQ ID NO: 596064 - DNA, 25 bp, Mus musculus
ccgtatactgtgcttccctgggact

SEQ ID NO: 596065 - DNA, 25 bp, Mus musculus
ccgtatactgtggttccctgggact

SEQ ID NO: 596066 - DNA, 25 bp, Mus musculus
ccgtatgactgtccagaatgtggcc

SEQ ID NO: 596067 - DNA, 25 bp, Mus musculus
ccgtatgactgtgcagaatgtggcc

SEQ ID NO: 596068 - DNA, 25 bp, Mus musculus
ccgtatggatttcacacagccagct

SEQ ID NO: 596069 - DNA, 25 bp, Mus musculus
ccgtatggatttgacacagccagct

SEQ ID NO: 596070 - DNA, 25 bp, Mus musculus
ccgtatttgaggatggctccaggga

SEQ ID NO: 596071 - DNA, 25 bp, Mus musculus
ccgtatttgaggttggctccaggga

SEQ ID NO: 596072 - DNA, 25 bp, Mus musculus
ccgtcaattttgctgagttctccaa

SEQ ID NO: 596073 - DNA, 25 bp, Mus musculus
ccgtcaattttggtgagttctccaa

SEQ ID NO: 596074 - DNA, 25 bp, Mus musculus
ccgtcacgggcaacatcgtgggtgt

SEQ ID NO: 596075 - DNA, 25 bp, Mus musculus
ccgtcacgggcatcatcgtgggtgt

SEQ ID NO: 596076 - DNA, 25 bp, Mus musculus
ccgtcactagcgcagattgtggagc

SEQ ID NO: 596077 - DNA, 25 bp, Mus musculus
ccgtcactagcggagattgtggagc

SEQ ID NO: 596078 - DNA, 25 bp, Mus musculus
ccgtcagaggctcgcagatgtagct

SEQ ID NO: 596079 - DNA, 25 bp, Mus musculus
ccgtcagaggctggcagatgtagct

SEQ ID NO: 596080 - DNA, 25 bp, Mus musculus
ccgtcagatcttcataaagctttgc

SEQ ID NO: 596081 - DNA, 25 bp, Mus musculus
ccgtcagatcttgataaagctttgc

SEQ ID NO: 596082 - DNA, 25 bp, Mus musculus
ccgtcagcacctagacgaatatcca

SEQ ID NO: 596083 - DNA, 25 bp, Mus musculus
ccgtcagcaccttgacgaatatcca

SEQ ID NO: 596084 - DNA, 25 bp, Mus musculus
ccgtcagcctgacagagttagatat

SEQ ID NO: 596085 - DNA, 25 bp, Mus musculus
ccgtcagcctgagagagttagatat

SEQ ID NO: 596086 - DNA, 25 bp, Mus musculus
ccgtcagcttgtcctacatggtggg

SEQ ID NO: 596087 - DNA, 25 bp, Mus musculus
ccgtcagcttgtgctacatggtggg

SEQ ID NO: 596088 - DNA, 25 bp, Mus musculus
ccgtcaggagcgagagcgaacacct

SEQ ID NO: 596089 - DNA, 25 bp, Mus musculus
ccgtcaggagcgtgagcgaacacct

SEQ ID NO: 596090 - DNA, 25 bp, Mus musculus
ccgtcaggcacccatcggtggtgat

SEQ ID NO: 596091 - DNA, 25 bp, Mus musculus
ccgtcaggcaccgatcggtggtgat

SEQ ID NO: 596092 - DNA, 25 bp, Mus musculus
ccgtcatggtcaccgcattctcggg

SEQ ID NO: 596093 - DNA, 25 bp, Mus musculus
ccgtcatggtcagcgcattctcggg

SEQ ID NO: 596094 - DNA, 25 bp, Mus musculus
ccgtcattcagtctgatatcagcat

SEQ ID NO: 596095 - DNA, 25 bp, Mus musculus
ccgtcattcagtgtgatatcagcat

SEQ ID NO: 596096 - DNA, 25 bp, Mus musculus
ccgtcattgaggatattggaaaagc

SEQ ID NO: 596097 - DNA, 25 bp, Mus musculus
ccgtcattgaggttattggaaaagc

SEQ ID NO: 596098 - DNA, 25 bp, Mus musculus
ccgtccaaacttcaagccttcaagg

SEQ ID NO: 596099 - DNA, 25 bp, Mus musculus
ccgtccaaacttgaagccttcaagg

SEQ ID NO: 596100 - DNA, 25 bp, Mus musculus
ccgtccacagtcaacacacttggga

SEQ ID NO: 596101 - DNA, 25 bp, Mus musculus
ccgtccacagtctacacacttggga

SEQ ID NO: 596102 - DNA, 25 bp, Mus musculus
ccgtccagagcactgtgaaggcgca

SEQ ID NO: 596103 - DNA, 25 bp, Mus musculus
ccgtccagagcagtgtgaaggcgca

SEQ ID NO: 596104 - DNA, 25 bp, Mus musculus
ccgtccaggccgaggcttacataaa

SEQ ID NO: 596105 - DNA, 25 bp, Mus musculus
ccgtccaggccgtggcttacataaa

SEQ ID NO: 596106 - DNA, 25 bp, Mus musculus
ccgtcccacgatcgaagcatgtgaa

SEQ ID NO: 596107 - DNA, 25 bp, Mus musculus
ccgtcccacgatggaagcatgtgaa

SEQ ID NO: 596108 - DNA, 25 bp, Mus musculus
ccgtcccggaaaagcgatggctgtg

SEQ ID NO: 596109 - DNA, 25 bp, Mus musculus
ccgtcccggaaatgcgatggctgtg

SEQ ID NO: 596110 - DNA, 25 bp, Mus musculus
ccgtccctacatcgcatattatgag

SEQ ID NO: 596111 - DNA, 25 bp, Mus musculus
ccgtccctacatggcatattatgag

SEQ ID NO: 596112 - DNA, 25 bp, Mus musculus
ccgtccgcagtgaattccaaggctg

SEQ ID NO: 596113 - DNA, 25 bp, Mus musculus
ccgtccgcagtgtattccaaggctg

SEQ ID NO: 596114 - DNA, 25 bp, Mus musculus
ccgtccgggaacaacgttgcctgtg

SEQ ID NO: 596115 - DNA, 25 bp, Mus musculus
ccgtccgggaactacgttgcctgtg

SEQ ID NO: 596116 - DNA, 25 bp, Mus musculus
ccgtcctagagcaccgcggagccgg

SEQ ID NO: 596117 - DNA, 25 bp, Mus musculus
ccgtcctagagctccgcggagccgg

SEQ ID NO: 596118 - DNA, 25 bp, Mus musculus
ccgtcctgctgtcgaggaactggcg

SEQ ID NO: 596119 - DNA, 25 bp, Mus musculus
ccgtcctgctgtggaggaactggcg

SEQ ID NO: 596120 - DNA, 25 bp, Mus musculus
ccgtcctggactaaggcagagtgca

SEQ ID NO: 596121 - DNA, 25 bp, Mus musculus
ccgtcctggacttaggcagagtgca

SEQ ID NO: 596122 - DNA, 25 bp, Mus musculus
ccgtcgaagcagcacaacaggtcaa

SEQ ID NO: 596123 - DNA, 25 bp, Mus musculus
ccgtcgaagcaggacaacaggtcaa

SEQ ID NO: 596124 - DNA, 25 bp, Mus musculus
ccgtcgcacccaccatgatggaaga

SEQ ID NO: 596125 - DNA, 25 bp, Mus musculus
ccgtcgcacccagcatgatggaaga

SEQ ID NO: 596126 - DNA, 25 bp, Mus musculus
ccgtcgcctctgactccggaaaggg

SEQ ID NO: 596127 - DNA, 25 bp, Mus musculus
ccgtcgcctctgtctccggaaaggg

SEQ ID NO: 596128 - DNA, 25 bp, Mus musculus
ccgtcgggaaatcacggatgtgatt

SEQ ID NO: 596129 - DNA, 25 bp, Mus musculus
ccgtcgggaaatgacggatgtgatt

SEQ ID NO: 596130 - DNA, 25 bp, Mus musculus
ccgtcggttttcagagggaacatca

SEQ ID NO: 596131 - DNA, 25 bp, Mus musculus
ccgtcggttttctgagggaacatca

SEQ ID NO: 596132 - DNA, 25 bp, Mus musculus
ccgtcgtgagcaccaaccttcagtt

SEQ ID NO: 596133 - DNA, 25 bp, Mus musculus
ccgtcgtgagcagcaaccttcagtt

SEQ ID NO: 596134 - DNA, 25 bp, Mus musculus
ccgtcgtggagtcgtcgtccgatct

SEQ ID NO: 596135 - DNA, 25 bp, Mus musculus
ccgtcgtggagtggtcgtccgatct

SEQ ID NO: 596136 - DNA, 25 bp, Mus musculus
ccgtcgtttgataagtcgctgcccc

SEQ ID NO: 596137 - DNA, 25 bp, Mus musculus
ccgtcgtttgattagtcgctgcccc

SEQ ID NO: 596138 - DNA, 25 bp, Mus musculus
ccgtctaactgaccgtgctctgcaa

SEQ ID NO: 596139 - DNA, 25 bp, Mus musculus
ccgtctaactgagcgtgctctgcaa

SEQ ID NO: 596140 - DNA, 25 bp, Mus musculus
ccgtctacacccaaatttgcatatg

SEQ ID NO: 596141 - DNA, 25 bp, Mus musculus
ccgtctacaccctaatttgcatatg

SEQ ID NO: 596142 - DNA, 25 bp, Mus musculus
ccgtctacctaaacagaatgggcct

SEQ ID NO: 596143 - DNA, 25 bp, Mus musculus
ccgtctacctaatcagaatgggcct

SEQ ID NO: 596144 - DNA, 25 bp, Mus musculus
ccgtctcatttgaactggtttatca

SEQ ID NO: 596145 - DNA, 25 bp, Mus musculus
ccgtctcatttgtactggtttatca

SEQ ID NO: 596146 - DNA, 25 bp, Mus musculus
ccgtctcctgctcagggcaagaaga

SEQ ID NO: 596147 - DNA, 25 bp, Mus musculus
ccgtctcctgctgagggcaagaaga

SEQ ID NO: 596148 - DNA, 25 bp, Mus musculus
ccgtctctccagatctatagttcag

SEQ ID NO: 596149 - DNA, 25 bp, Mus musculus
ccgtctctccagttctatagttcag

SEQ ID NO: 596150 - DNA, 25 bp, Mus musculus
ccgtctctggaaacttgatcgacct

SEQ ID NO: 596151 - DNA, 25 bp, Mus musculus
ccgtctctggaatcttgatcgacct

SEQ ID NO: 596152 - DNA, 25 bp, Mus musculus
ccgtctcttcgtaagcggcttcagc

SEQ ID NO: 596153 - DNA, 25 bp, Mus musculus
ccgtctcttcgttagcggcttcagc

SEQ ID NO: 596154 - DNA, 25 bp, Mus musculus
ccgtctgaaacgaaatcctgccaac

SEQ ID NO: 596155 - DNA, 25 bp, Mus musculus
ccgtctgaaacgtaatcctgccaac

SEQ ID NO: 596156 - DNA, 25 bp, Mus musculus
ccgtctgaagacaatcctgaaacag

SEQ ID NO: 596157 - DNA, 25 bp, Mus musculus
ccgtctgaagactatcctgaaacag

SEQ ID NO: 596158 - DNA, 25 bp, Mus musculus
ccgtctgcaaggagaccagatcaac

SEQ ID NO: 596159 - DNA, 25 bp, Mus musculus
ccgtctgcaaggtgaccagatcaac

SEQ ID NO: 596160 - DNA, 25 bp, Mus musculus
ccgtctgcgtctcggctatgctgtt

SEQ ID NO: 596161 - DNA, 25 bp, Mus musculus
ccgtctgcgtctgggctatgctgtt

SEQ ID NO: 596162 - DNA, 25 bp, Mus musculus
ccgtctgggaggacaggcacaagta

SEQ ID NO: 596163 - DNA, 25 bp, Mus musculus
ccgtctgggaggtcaggcacaagta

SEQ ID NO: 596164 - DNA, 25 bp, Mus musculus
ccgtctggttccagagctggacaca

SEQ ID NO: 596165 - DNA, 25 bp, Mus musculus
ccgtctggttcctgagctggacaca

SEQ ID NO: 596166 - DNA, 25 bp, Mus musculus
ccgtctgtccgcctggtgatcaaca

SEQ ID NO: 596167 - DNA, 25 bp, Mus musculus
ccgtctgtccgcgtggtgatcaaca

SEQ ID NO: 596168 - DNA, 25 bp, Mus musculus
ccgtcttaaggaccgtgagtgagcc

SEQ ID NO: 596169 - DNA, 25 bp, Mus musculus
ccgtcttaaggagcgtgagtgagcc

SEQ ID NO: 596170 - DNA, 25 bp, Mus musculus
ccgtcttacaacatgcttttcagtg

SEQ ID NO: 596171 - DNA, 25 bp, Mus musculus
ccgtcttacaacttgcttttcagtg

SEQ ID NO: 596172 - DNA, 25 bp, Mus musculus
ccgtcttagggtcagagcatgctca

SEQ ID NO: 596173 - DNA, 25 bp, Mus musculus
ccgtcttagggtgagagcatgctca

SEQ ID NO: 596174 - DNA, 25 bp, Mus musculus
ccgtcttcaaagaggtcaccagctc

SEQ ID NO: 596175 - DNA, 25 bp, Mus musculus
ccgtcttcaaagtggtcaccagctc

SEQ ID NO: 596176 - DNA, 25 bp, Mus musculus
ccgtcttcacaaccggaagtgggcg

SEQ ID NO: 596177 - DNA, 25 bp, Mus musculus
ccgtcttcacaagcggaagtgggcg

SEQ ID NO: 596178 - DNA, 25 bp, Mus musculus
ccgtcttcggaacaccctagtcatt

SEQ ID NO: 596179 - DNA, 25 bp, Mus musculus
ccgtcttcggaagaccctagtcatt

SEQ ID NO: 596180 - DNA, 25 bp, Mus musculus
ccgtcttggcagatagattgggagc

SEQ ID NO: 596181 - DNA, 25 bp, Mus musculus
ccgtcttggcagttagattgggagc

SEQ ID NO: 596182 - DNA, 25 bp, Mus musculus
ccgtgaaacaaactgctctcgacag

SEQ ID NO: 596183 - DNA, 25 bp, Mus musculus
ccgtgaaacaaagtgctctcgacag

SEQ ID NO: 596184 - DNA, 25 bp, Mus musculus
ccgtgaaacagactcccgtggatag

SEQ ID NO: 596185 - DNA, 25 bp, Mus musculus
ccgtgaaacagagtcccgtggatag

SEQ ID NO: 596186 - DNA, 25 bp, Mus musculus
ccgtgaaagctgcttcaggattcaa

SEQ ID NO: 596187 - DNA, 25 bp, Mus musculus
ccgtgaaagctggttcaggattcaa

SEQ ID NO: 596188 - DNA, 25 bp, Mus musculus
ccgtgaacaaggcaaacagagcgtt

SEQ ID NO: 596189 - DNA, 25 bp, Mus musculus
ccgtgaacaagggaaacagagcgtt

SEQ ID NO: 596190 - DNA, 25 bp, Mus musculus
ccgtgaacatcaagcacagcagcct

SEQ ID NO: 596191 - DNA, 25 bp, Mus musculus
ccgtgaacatcatgcacagcagcct

SEQ ID NO: 596192 - DNA, 25 bp, Mus musculus
ccgtgaaccagaaagcgtttgtgga

SEQ ID NO: 596193 - DNA, 25 bp, Mus musculus
ccgtgaaccagatagcgtttgtgga

SEQ ID NO: 596194 - DNA, 25 bp, Mus musculus
ccgtgaacctggagggctgtctcgc

SEQ ID NO: 596195 - DNA, 25 bp, Mus musculus
ccgtgaacctggtgggctgtctcgc

SEQ ID NO: 596196 - DNA, 25 bp, Mus musculus
ccgtgaactcaacgaaacagagggc

SEQ ID NO: 596197 - DNA, 25 bp, Mus musculus
ccgtgaactcaaggaaacagagggc

SEQ ID NO: 596198 - DNA, 25 bp, Mus musculus
ccgtgaagacttacttttgtatctg

SEQ ID NO: 596199 - DNA, 25 bp, Mus musculus
ccgtgaagactttcttttgtatctg

SEQ ID NO: 596200 - DNA, 25 bp, Mus musculus
ccgtgaagcagacgttcgaggataa

SEQ ID NO: 596201 - DNA, 25 bp, Mus musculus
ccgtgaagcagaggttcgaggataa

SEQ ID NO: 596202 - DNA, 25 bp, Mus musculus
ccgtgaagcgaaagcgcagcgagaa

SEQ ID NO: 596203 - DNA, 25 bp, Mus musculus
ccgtgaagcgaatgcgcagcgagaa

SEQ ID NO: 596204 - DNA, 25 bp, Mus musculus
ccgtgaaggctgagcagcatggcaa

SEQ ID NO: 596205 - DNA, 25 bp, Mus musculus
ccgtgaaggctgtgcagcatggcaa

SEQ ID NO: 596206 - DNA, 25 bp, Mus musculus
ccgtgaaggtgaagagttcaaacat

SEQ ID NO: 596207 - DNA, 25 bp, Mus musculus
ccgtgaaggtgatgagttcaaacat

SEQ ID NO: 596208 - DNA, 25 bp, Mus musculus
ccgtgaatgccgaagagtgcgctgc

SEQ ID NO: 596209 - DNA, 25 bp, Mus musculus
ccgtgaatgccgtagagtgcgctgc

SEQ ID NO: 596210 - DNA, 25 bp, Mus musculus
ccgtgaatgtgcagtccggtgacaa

SEQ ID NO: 596211 - DNA, 25 bp, Mus musculus
ccgtgaatgtgctgtccggtgacaa

SEQ ID NO: 596212 - DNA, 25 bp, Mus musculus
ccgtgacaagctacgtggagcccgg

SEQ ID NO: 596213 - DNA, 25 bp, Mus musculus
ccgtgacaagcttcgtggagcccgg

SEQ ID NO: 596214 - DNA, 25 bp, Mus musculus
ccgtgacagcagagcgccctatgca

SEQ ID NO: 596215 - DNA, 25 bp, Mus musculus
ccgtgacagcagtgcgccctatgca

SEQ ID NO: 596216 - DNA, 25 bp, Mus musculus
ccgtgacagcggagctcctgaatca

SEQ ID NO: 596217 - DNA, 25 bp, Mus musculus
ccgtgacagcggtgctcctgaatca

SEQ ID NO: 596218 - DNA, 25 bp, Mus musculus
ccgtgacattgtccagtttgtgccc

SEQ ID NO: 596219 - DNA, 25 bp, Mus musculus
ccgtgacattgtgcagtttgtgccc

SEQ ID NO: 596220 - DNA, 25 bp, Mus musculus
ccgtgaccagaaaagacaacactgt

SEQ ID NO: 596221 - DNA, 25 bp, Mus musculus
ccgtgaccagaatagacaacactgt

SEQ ID NO: 596222 - DNA, 25 bp, Mus musculus
ccgtgaccaggcacgagaaggttgc

SEQ ID NO: 596223 - DNA, 25 bp, Mus musculus
ccgtgaccaggctcgagaaggttgc

SEQ ID NO: 596224 - DNA, 25 bp, Mus musculus
ccgtgactatgaagtgtatgcaaga

SEQ ID NO: 596225 - DNA, 25 bp, Mus musculus
ccgtgactatgatgtgtatgcaaga

SEQ ID NO: 596226 - DNA, 25 bp, Mus musculus
ccgtgactcagaaggaatggatgaa

SEQ ID NO: 596227 - DNA, 25 bp, Mus musculus
ccgtgactcagatggaatggatgaa

SEQ ID NO: 596228 - DNA, 25 bp, Mus musculus
ccgtgactgaaaatctagtgctgcc

SEQ ID NO: 596229 - DNA, 25 bp, Mus musculus
ccgtgactgaaattctagtgctgcc

SEQ ID NO: 596230 - DNA, 25 bp, Mus musculus
ccgtgactggtgcatgtgcatgatc

SEQ ID NO: 596231 - DNA, 25 bp, Mus musculus
ccgtgactggtggatgtgcatgatc

SEQ ID NO: 596232 - DNA, 25 bp, Mus musculus
ccgtgactgtagctggagaagaaat

SEQ ID NO: 596233 - DNA, 25 bp, Mus musculus
ccgtgactgtaggtggagaagaaat

SEQ ID NO: 596234 - DNA, 25 bp, Mus musculus
ccgtgagaaaagacagaaataagac

SEQ ID NO: 596235 - DNA, 25 bp, Mus musculus
ccgtgagaaaagtcagaaataagac

SEQ ID NO: 596236 - DNA, 25 bp, Mus musculus
ccgtgaggctcaccaatgaaggctt

SEQ ID NO: 596237 - DNA, 25 bp, Mus musculus
ccgtgaggctcagcaatgaaggctt

SEQ ID NO: 596238 - DNA, 25 bp, Mus musculus
ccgtgagggtccactgagacttagc

SEQ ID NO: 596239 - DNA, 25 bp, Mus musculus
ccgtgagggtcctctgagacttagc

SEQ ID NO: 596240 - DNA, 25 bp, Mus musculus
ccgtgagtgtcaaggtgtatgaaag

SEQ ID NO: 596241 - DNA, 25 bp, Mus musculus
ccgtgagtgtcatggtgtatgaaag

SEQ ID NO: 596242 - DNA, 25 bp, Mus musculus
ccgtgagtttatcacaatggttgtg

SEQ ID NO: 596243 - DNA, 25 bp, Mus musculus
ccgtgagtttatgacaatggttgtg

SEQ ID NO: 596244 - DNA, 25 bp, Mus musculus
ccgtgataccccagagaaaagaatt

SEQ ID NO: 596245 - DNA, 25 bp, Mus musculus
ccgtgatacccctgagaaaagaatt

SEQ ID NO: 596246 - DNA, 25 bp, Mus musculus
ccgtgatcttcacacaagggcgaga

SEQ ID NO: 596247 - DNA, 25 bp, Mus musculus
ccgtgatcttcagacaagggcgaga

SEQ ID NO: 596248 - DNA, 25 bp, Mus musculus
ccgtgatgatgcatgacgagctgct

SEQ ID NO: 596249 - DNA, 25 bp, Mus musculus
ccgtgatgatgcttgacgagctgct

SEQ ID NO: 596250 - DNA, 25 bp, Mus musculus
ccgtgatgctttagccctggccaag

SEQ ID NO: 596251 - DNA, 25 bp, Mus musculus
ccgtgatgcttttgccctggccaag

SEQ ID NO: 596252 - DNA, 25 bp, Mus musculus
ccgtgatggaatcgaccatgacatc

SEQ ID NO: 596253 - DNA, 25 bp, Mus musculus
ccgtgatggaatggaccatgacatc

SEQ ID NO: 596254 - DNA, 25 bp, Mus musculus
ccgtgatggaccagacggagctgcc

SEQ ID NO: 596255 - DNA, 25 bp, Mus musculus
ccgtgatggacctgacggagctgcc

SEQ ID NO: 596256 - DNA, 25 bp, Mus musculus
ccgtgatggcgcagctagaggccac

SEQ ID NO: 596257 - DNA, 25 bp, Mus musculus
ccgtgatggcgctgctagaggccac

SEQ ID NO: 596258 - DNA, 25 bp, Mus musculus
ccgtgatggctaactgtgactatga

SEQ ID NO: 596259 - DNA, 25 bp, Mus musculus
ccgtgatggctatctgtgactatga

SEQ ID NO: 596260 - DNA, 25 bp, Mus musculus
ccgtgcaaaagccatcggatcaatg

SEQ ID NO: 596261 - DNA, 25 bp, Mus musculus
ccgtgcaaaagcgatcggatcaatg

SEQ ID NO: 596262 - DNA, 25 bp, Mus musculus
ccgtgcacaacaaggaagtgctgta

SEQ ID NO: 596263 - DNA, 25 bp, Mus musculus
ccgtgcacaacatggaagtgctgta

SEQ ID NO: 596264 - DNA, 25 bp, Mus musculus
ccgtgcacctacaacacctatgttt

SEQ ID NO: 596265 - DNA, 25 bp, Mus musculus
ccgtgcacctactacacctatgttt

SEQ ID NO: 596266 - DNA, 25 bp, Mus musculus
ccgtgcagcccgacgtggagagtaa

SEQ ID NO: 596267 - DNA, 25 bp, Mus musculus
ccgtgcagcccgtcgtggagagtaa

SEQ ID NO: 596268 - DNA, 25 bp, Mus musculus
ccgtgcagcctccagcttaggagaa

SEQ ID NO: 596269 - DNA, 25 bp, Mus musculus
ccgtgcagcctcgagcttaggagaa

SEQ ID NO: 596270 - DNA, 25 bp, Mus musculus
ccgtgcaggccaccgatcaatactg

SEQ ID NO: 596271 - DNA, 25 bp, Mus musculus
ccgtgcaggccagcgatcaatactg

SEQ ID NO: 596272 - DNA, 25 bp, Mus musculus
ccgtgcaggtggaccttccctaaag

SEQ ID NO: 596273 - DNA, 25 bp, Mus musculus
ccgtgcaggtggtccttccctaaag

SEQ ID NO: 596274 - DNA, 25 bp, Mus musculus
ccgtgcagtcaaaggaggcatgctc

SEQ ID NO: 596275 - DNA, 25 bp, Mus musculus
ccgtgcagtcaatggaggcatgctc

SEQ ID NO: 596276 - DNA, 25 bp, Mus musculus
ccgtgcagtggccacactacaggga

SEQ ID NO: 596277 - DNA, 25 bp, Mus musculus
ccgtgcagtggcgacactacaggga

SEQ ID NO: 596278 - DNA, 25 bp, Mus musculus
ccgtgccaaggactagaacaagccc

SEQ ID NO: 596279 - DNA, 25 bp, Mus musculus
ccgtgccaaggagtagaacaagccc

SEQ ID NO: 596280 - DNA, 25 bp, Mus musculus
ccgtgccacaaacgagggacatgta

SEQ ID NO: 596281 - DNA, 25 bp, Mus musculus
ccgtgccacaaaggagggacatgta

SEQ ID NO: 596282 - DNA, 25 bp, Mus musculus
ccgtgcccaaatctttcggttacat

SEQ ID NO: 596283 - DNA, 25 bp, Mus musculus
ccgtgcccaaatgtttcggttacat

SEQ ID NO: 596284 - DNA, 25 bp, Mus musculus
ccgtgcctctggagcttgatcaaga

SEQ ID NO: 596285 - DNA, 25 bp, Mus musculus
ccgtgcctctggtgcttgatcaaga

SEQ ID NO: 596286 - DNA, 25 bp, Mus musculus
ccgtgcctgccacctgagcgttgtg

SEQ ID NO: 596287 - DNA, 25 bp, Mus musculus
ccgtgcctgccagctgagcgttgtg

SEQ ID NO: 596288 - DNA, 25 bp, Mus musculus
ccgtgccttgtgcaaatgaacttca

SEQ ID NO: 596289 - DNA, 25 bp, Mus musculus
ccgtgccttgtggaaatgaacttca

SEQ ID NO: 596290 - DNA, 25 bp, Mus musculus
ccgtgctgcccgcttggattgcaag

SEQ ID NO: 596291 - DNA, 25 bp, Mus musculus
ccgtgctgcccggttggattgcaag

SEQ ID NO: 596292 - DNA, 25 bp, Mus musculus
ccgtgctggaccagccctgggagaa

SEQ ID NO: 596293 - DNA, 25 bp, Mus musculus
ccgtgctggacctgccctgggagaa

SEQ ID NO: 596294 - DNA, 25 bp, Mus musculus
ccgtgctttgtcctcgggccgctga

SEQ ID NO: 596295 - DNA, 25 bp, Mus musculus
ccgtgctttgtcgtcgggccgctga

SEQ ID NO: 596296 - DNA, 25 bp, Mus musculus
ccgtggaacgcaaggagtcgcctat

SEQ ID NO: 596297 - DNA, 25 bp, Mus musculus
ccgtggaacgcatggagtcgcctat

SEQ ID NO: 596298 - DNA, 25 bp, Mus musculus
ccgtggaagagaagttcccttacat

SEQ ID NO: 596299 - DNA, 25 bp, Mus musculus
ccgtggaagagatgttcccttacat

SEQ ID NO: 596300 - DNA, 25 bp, Mus musculus
ccgtggaatgagaccagcatctttc

SEQ ID NO: 596301 - DNA, 25 bp, Mus musculus
ccgtggaatgagtccagcatctttc

SEQ ID NO: 596302 - DNA, 25 bp, Mus musculus
ccgtggaatggcctgaagaatgcaa

SEQ ID NO: 596303 - DNA, 25 bp, Mus musculus
ccgtggaatggcgtgaagaatgcaa

SEQ ID NO: 596304 - DNA, 25 bp, Mus musculus
ccgtggacaacaaaatgatggtttc

SEQ ID NO: 596305 - DNA, 25 bp, Mus musculus
ccgtggacaacataatgatggtttc

SEQ ID NO: 596306 - DNA, 25 bp, Mus musculus
ccgtggaccactatgggaaggagca

SEQ ID NO: 596307 - DNA, 25 bp, Mus musculus
ccgtggaccactttgggaaggagca

SEQ ID NO: 596308 - DNA, 25 bp, Mus musculus
ccgtggaccatgaatatcctcatta

SEQ ID NO: 596309 - DNA, 25 bp, Mus musculus
ccgtggaccatgtatatcctcatta

SEQ ID NO: 596310 - DNA, 25 bp, Mus musculus
ccgtggacgtccacagattgagttg

SEQ ID NO: 596311 - DNA, 25 bp, Mus musculus
ccgtggacgtcctcagattgagttg

SEQ ID NO: 596312 - DNA, 25 bp, Mus musculus
ccgtggacgtggatgaatgctcaga

SEQ ID NO: 596313 - DNA, 25 bp, Mus musculus
ccgtggacgtggttgaatgctcaga

SEQ ID NO: 596314 - DNA, 25 bp, Mus musculus
ccgtggactcctattggaaaagtgc

SEQ ID NO: 596315 - DNA, 25 bp, Mus musculus
ccgtggactccttttggaaaagtgc

SEQ ID NO: 596316 - DNA, 25 bp, Mus musculus
ccgtggacttcaaccacaagaggga

SEQ ID NO: 596317 - DNA, 25 bp, Mus musculus
ccgtggacttcatccacaagaggga

SEQ ID NO: 596318 - DNA, 25 bp, Mus musculus
ccgtggagacccagcgtcgcaagca

SEQ ID NO: 596319 - DNA, 25 bp, Mus musculus
ccgtggagaccctgcgtcgcaagca

SEQ ID NO: 596320 - DNA, 25 bp, Mus musculus
ccgtggagattgactatgattcgct

SEQ ID NO: 596321 - DNA, 25 bp, Mus musculus
ccgtggagattgtctatgattcgct

SEQ ID NO: 596322 - DNA, 25 bp, Mus musculus
ccgtggagccaaaccgactccaagt

SEQ ID NO: 596323 - DNA, 25 bp, Mus musculus
ccgtggagccaatccgactccaagt

SEQ ID NO: 596324 - DNA, 25 bp, Mus musculus
ccgtggagccttctttggtgcaaat

SEQ ID NO: 596325 - DNA, 25 bp, Mus musculus
ccgtggagccttgtttggtgcaaat

SEQ ID NO: 596326 - DNA, 25 bp, Mus musculus
ccgtggagctgcagggtaaaaccaa

SEQ ID NO: 596327 - DNA, 25 bp, Mus musculus
ccgtggagctgctgggtaaaaccaa

SEQ ID NO: 596328 - DNA, 25 bp, Mus musculus
ccgtggaggaccaggttgaagaatt

SEQ ID NO: 596329 - DNA, 25 bp, Mus musculus
ccgtggaggacctggttgaagaatt

SEQ ID NO: 596330 - DNA, 25 bp, Mus musculus
ccgtggaggccacctaccggaacat

SEQ ID NO: 596331 - DNA, 25 bp, Mus musculus
ccgtggaggccagctaccggaacat

SEQ ID NO: 596332 - DNA, 25 bp, Mus musculus
ccgtggagggctcccaaaatgatca

SEQ ID NO: 596333 - DNA, 25 bp, Mus musculus
ccgtggagggctgccaaaatgatca

SEQ ID NO: 596334 - DNA, 25 bp, Mus musculus
ccgtggagtattcgctgatggcact

SEQ ID NO: 596335 - DNA, 25 bp, Mus musculus
ccgtggagtattggctgatggcact

SEQ ID NO: 596336 - DNA, 25 bp, Mus musculus
ccgtggagtctcatacagcagtgca

SEQ ID NO: 596337 - DNA, 25 bp, Mus musculus
ccgtggagtctcttacagcagtgca

SEQ ID NO: 596338 - DNA, 25 bp, Mus musculus
ccgtggatagtaactccaaagtcag

SEQ ID NO: 596339 - DNA, 25 bp, Mus musculus
ccgtggatagtatctccaaagtcag

SEQ ID NO: 596340 - DNA, 25 bp, Mus musculus
ccgtggatggatattacacacaaga

SEQ ID NO: 596341 - DNA, 25 bp, Mus musculus
ccgtggatggattttacacacaaga

SEQ ID NO: 596342 - DNA, 25 bp, Mus musculus
ccgtggattactacgggccctgcca

SEQ ID NO: 596343 - DNA, 25 bp, Mus musculus
ccgtggattacttcgggccctgcca

SEQ ID NO: 596344 - DNA, 25 bp, Mus musculus
ccgtggcatggcactctatgaggag

SEQ ID NO: 596345 - DNA, 25 bp, Mus musculus
ccgtggcatggctctctatgaggag

SEQ ID NO: 596346 - DNA, 25 bp, Mus musculus
ccgtggcattggctattacctggaa

SEQ ID NO: 596347 - DNA, 25 bp, Mus musculus
ccgtggcattgggtattacctggaa

SEQ ID NO: 596348 - DNA, 25 bp, Mus musculus
ccgtggccttatcgagcaaggacac

SEQ ID NO: 596349 - DNA, 25 bp, Mus musculus
ccgtggccttatggagcaaggacac

SEQ ID NO: 596350 - DNA, 25 bp, Mus musculus
ccgtggcgactcagctaagcagctg

SEQ ID NO: 596351 - DNA, 25 bp, Mus musculus
ccgtggcgactctgctaagcagctg

SEQ ID NO: 596352 - DNA, 25 bp, Mus musculus
ccgtggcggcccaggatgagttcta

SEQ ID NO: 596353 - DNA, 25 bp, Mus musculus
ccgtggcggccctggatgagttcta

SEQ ID NO: 596354 - DNA, 25 bp, Mus musculus
ccgtggctcacaaggttttaggaga

SEQ ID NO: 596355 - DNA, 25 bp, Mus musculus
ccgtggctcacatggttttaggaga

SEQ ID NO: 596356 - DNA, 25 bp, Mus musculus
ccgtggctccccatctcggtaggag

SEQ ID NO: 596357 - DNA, 25 bp, Mus musculus
ccgtggctccccttctcggtaggag

SEQ ID NO: 596358 - DNA, 25 bp, Mus musculus
ccgtggctgctgatggccgcattga

SEQ ID NO: 596359 - DNA, 25 bp, Mus musculus
ccgtggctgctgttggccgcattga

SEQ ID NO: 596360 - DNA, 25 bp, Mus musculus
ccgtggctgcttcactctggcttag

SEQ ID NO: 596361 - DNA, 25 bp, Mus musculus
ccgtggctgcttgactctggcttag

SEQ ID NO: 596362 - DNA, 25 bp, Mus musculus
ccgtggctgtcaacccgcgttctgg

SEQ ID NO: 596363 - DNA, 25 bp, Mus musculus
ccgtggctgtcatcccgcgttctgg

SEQ ID NO: 596364 - DNA, 25 bp, Mus musculus
ccgtggctgtggagcaggccatcct

SEQ ID NO: 596365 - DNA, 25 bp, Mus musculus
ccgtggctgtggtgcaggccatcct

SEQ ID NO: 596366 - DNA, 25 bp, Mus musculus
ccgtgggaagtaaaatggccgagtt

SEQ ID NO: 596367 - DNA, 25 bp, Mus musculus
ccgtgggaagtataatggccgagtt

SEQ ID NO: 596368 - DNA, 25 bp, Mus musculus
ccgtgggaccggctacacagaacaa

SEQ ID NO: 596369 - DNA, 25 bp, Mus musculus
ccgtgggaccgggtacacagaacaa

SEQ ID NO: 596370 - DNA, 25 bp, Mus musculus
ccgtgggatattccatgtctcttgc

SEQ ID NO: 596371 - DNA, 25 bp, Mus musculus
ccgtgggatattgcatgtctcttgc

SEQ ID NO: 596372 - DNA, 25 bp, Mus musculus
ccgtgggcacctatcagcccgagtt

SEQ ID NO: 596373 - DNA, 25 bp, Mus musculus
ccgtgggcacctttcagcccgagtt

SEQ ID NO: 596374 - DNA, 25 bp, Mus musculus
ccgtgggccggtactctgctttcct

SEQ ID NO: 596375 - DNA, 25 bp, Mus musculus
ccgtgggccggttctctgctttcct

SEQ ID NO: 596376 - DNA, 25 bp, Mus musculus
ccgtgggcgtcgatgcctttctctg

SEQ ID NO: 596377 - DNA, 25 bp, Mus musculus
ccgtgggcgtcgttgcctttctctg

SEQ ID NO: 596378 - DNA, 25 bp, Mus musculus
ccgtgggcgtggctaaggctgtgga

SEQ ID NO: 596379 - DNA, 25 bp, Mus musculus
ccgtgggcgtgggtaaggctgtgga

SEQ ID NO: 596380 - DNA, 25 bp, Mus musculus
ccgtgggtgatccttattggctcct

SEQ ID NO: 596381 - DNA, 25 bp, Mus musculus
ccgtgggtgatcgttattggctcct

SEQ ID NO: 596382 - DNA, 25 bp, Mus musculus
ccgtgggttctccaagctcagggaa

SEQ ID NO: 596383 - DNA, 25 bp, Mus musculus
ccgtgggttctcgaagctcagggaa

SEQ ID NO: 596384 - DNA, 25 bp, Mus musculus
ccgtggtaatgaccaggtagcaatc

SEQ ID NO: 596385 - DNA, 25 bp, Mus musculus
ccgtggtaatgagcaggtagcaatc

SEQ ID NO: 596386 - DNA, 25 bp, Mus musculus
ccgtggtagtccatggatgctgaaa

SEQ ID NO: 596387 - DNA, 25 bp, Mus musculus
ccgtggtagtccttggatgctgaaa

SEQ ID NO: 596388 - DNA, 25 bp, Mus musculus
ccgtggtatcaacctagtggtggca

SEQ ID NO: 596389 - DNA, 25 bp, Mus musculus
ccgtggtatcaagctagtggtggca

SEQ ID NO: 596390 - DNA, 25 bp, Mus musculus
ccgtggtctaccagagagcatcaag

SEQ ID NO: 596391 - DNA, 25 bp, Mus musculus
ccgtggtctacctgagagcatcaag

SEQ ID NO: 596392 - DNA, 25 bp, Mus musculus
ccgtggtctcccaagacaaccaaag

SEQ ID NO: 596393 - DNA, 25 bp, Mus musculus
ccgtggtctccctagacaaccaaag

SEQ ID NO: 596394 - DNA, 25 bp, Mus musculus
ccgtggtgaagcaccgcttcccgaa

SEQ ID NO: 596395 - DNA, 25 bp, Mus musculus
ccgtggtgaagctccgcttcccgaa

SEQ ID NO: 596396 - DNA, 25 bp, Mus musculus
ccgtggtggaacagagggcatcatt

SEQ ID NO: 596397 - DNA, 25 bp, Mus musculus
ccgtggtggaactgagggcatcatt

SEQ ID NO: 596398 - DNA, 25 bp, Mus musculus
ccgtggtggatgactggattgaatt

SEQ ID NO: 596399 - DNA, 25 bp, Mus musculus
ccgtggtggatgtctggattgaatt

SEQ ID NO: 596400 - DNA, 25 bp, Mus musculus
ccgtggtggtgtatgccatgctatg

SEQ ID NO: 596401 - DNA, 25 bp, Mus musculus
ccgtggtggtgtttgccatgctatg

SEQ ID NO: 596402 - DNA, 25 bp, Mus musculus
ccgtggtgtgcaccatccgctaagg

SEQ ID NO: 596403 - DNA, 25 bp, Mus musculus
ccgtggtgtgcagcatccgctaagg

SEQ ID NO: 596404 - DNA, 25 bp, Mus musculus
ccgtggtgtgtgattcaagccagga

SEQ ID NO: 596405 - DNA, 25 bp, Mus musculus
ccgtggtgtgtgtttcaagccagga

SEQ ID NO: 596406 - DNA, 25 bp, Mus musculus
ccgtggttatggctgacgtgtccca

SEQ ID NO: 596407 - DNA, 25 bp, Mus musculus
ccgtggttatgggtgacgtgtccca

SEQ ID NO: 596408 - DNA, 25 bp, Mus musculus
ccgtggttcactatgatatctgagg

SEQ ID NO: 596409 - DNA, 25 bp, Mus musculus
ccgtggttcactttgatatctgagg

SEQ ID NO: 596410 - DNA, 25 bp, Mus musculus
ccgtggttcgccaaactgatgggca

SEQ ID NO: 596411 - DNA, 25 bp, Mus musculus
ccgtggttcgcctaactgatgggca

SEQ ID NO: 596412 - DNA, 25 bp, Mus musculus
ccgtggttgactataaagaggtcct

SEQ ID NO: 596413 - DNA, 25 bp, Mus musculus
ccgtggttgactttaaagaggtcct

SEQ ID NO: 596414 - DNA, 25 bp, Mus musculus
ccgtgtacagctctaaaagccttag

SEQ ID NO: 596415 - DNA, 25 bp, Mus musculus
ccgtgtacagctgtaaaagccttag

SEQ ID NO: 596416 - DNA, 25 bp, Mus musculus
ccgtgtacttcgaggctctggtgat

SEQ ID NO: 596417 - DNA, 25 bp, Mus musculus
ccgtgtacttcgtggctctggtgat

SEQ ID NO: 596418 - DNA, 25 bp, Mus musculus
ccgtgtagccataacgagggtggcc

SEQ ID NO: 596419 - DNA, 25 bp, Mus musculus
ccgtgtagccattacgagggtggcc

SEQ ID NO: 596420 - DNA, 25 bp, Mus musculus
ccgtgtaggcaaccatggatatcct

SEQ ID NO: 596421 - DNA, 25 bp, Mus musculus
ccgtgtaggcaagcatggatatcct

SEQ ID NO: 596422 - DNA, 25 bp, Mus musculus
ccgtgtccagcgagctcatctgagg

SEQ ID NO: 596423 - DNA, 25 bp, Mus musculus
ccgtgtccagcgtgctcatctgagg

SEQ ID NO: 596424 - DNA, 25 bp, Mus musculus
ccgtgtccatttagcaccggcgcag

SEQ ID NO: 596425 - DNA, 25 bp, Mus musculus
ccgtgtccattttgcaccggcgcag

SEQ ID NO: 596426 - DNA, 25 bp, Mus musculus
ccgtgtcctgcacaactctaggcat

SEQ ID NO: 596427 - DNA, 25 bp, Mus musculus
ccgtgtcctgcagaactctaggcat

SEQ ID NO: 596428 - DNA, 25 bp, Mus musculus
ccgtgtcgaccacctaaagtatgat

SEQ ID NO: 596429 - DNA, 25 bp, Mus musculus
ccgtgtcgaccagctaaagtatgat

SEQ ID NO: 596430 - DNA, 25 bp, Mus musculus
ccgtgtcgggccatggtggaacatc

SEQ ID NO: 596431 - DNA, 25 bp, Mus musculus
ccgtgtcgggccttggtggaacatc

SEQ ID NO: 596432 - DNA, 25 bp, Mus musculus
ccgtgtctgtctacaagcgtggaga

SEQ ID NO: 596433 - DNA, 25 bp, Mus musculus
ccgtgtctgtcttcaagcgtggaga

SEQ ID NO: 596434 - DNA, 25 bp, Mus musculus
ccgtgtcttaggagatcactaagaa

SEQ ID NO: 596435 - DNA, 25 bp, Mus musculus
ccgtgtcttaggtgatcactaagaa

SEQ ID NO: 596436 - DNA, 25 bp, Mus musculus
ccgtgtgaagtgactactgtaagcc

SEQ ID NO: 596437 - DNA, 25 bp, Mus musculus
ccgtgtgaagtgtctactgtaagcc

SEQ ID NO: 596438 - DNA, 25 bp, Mus musculus
ccgtgtgaggaaattcttggccctc

SEQ ID NO: 596439 - DNA, 25 bp, Mus musculus
ccgtgtgaggaatttcttggccctc

SEQ ID NO: 596440 - DNA, 25 bp, Mus musculus
ccgtgtgagtagagagatgccctga

SEQ ID NO: 596441 - DNA, 25 bp, Mus musculus
ccgtgtgagtagtgagatgccctga

SEQ ID NO: 596442 - DNA, 25 bp, Mus musculus
ccgtgtgattggaccgcagagtcca

SEQ ID NO: 596443 - DNA, 25 bp, Mus musculus
ccgtgtgattggtccgcagagtcca

SEQ ID NO: 596444 - DNA, 25 bp, Mus musculus
ccgtgtgccaaaagaagaggatcca

SEQ ID NO: 596445 - DNA, 25 bp, Mus musculus
ccgtgtgccaaatgaagaggatcca

SEQ ID NO: 596446 - DNA, 25 bp, Mus musculus
ccgtgtgctatacaggccttacctg

SEQ ID NO: 596447 - DNA, 25 bp, Mus musculus
ccgtgtgctatagaggccttacctg

SEQ ID NO: 596448 - DNA, 25 bp, Mus musculus
ccgtgtgctcgcatggagtgcctga

SEQ ID NO: 596449 - DNA, 25 bp, Mus musculus
ccgtgtgctcgcttggagtgcctga

SEQ ID NO: 596450 - DNA, 25 bp, Mus musculus
ccgtgtggcggtccaggccatctca

SEQ ID NO: 596451 - DNA, 25 bp, Mus musculus
ccgtgtggcggtgcaggccatctca

SEQ ID NO: 596452 - DNA, 25 bp, Mus musculus
ccgtgtgtggacctaaaacttctgc

SEQ ID NO: 596453 - DNA, 25 bp, Mus musculus
ccgtgtgtggacgtaaaacttctgc

SEQ ID NO: 596454 - DNA, 25 bp, Mus musculus
ccgtgttcgaaaagctgagattggt

SEQ ID NO: 596455 - DNA, 25 bp, Mus musculus
ccgtgttcgaaatgctgagattggt

SEQ ID NO: 596456 - DNA, 25 bp, Mus musculus
ccgtgttctttcagctgggttgcag

SEQ ID NO: 596457 - DNA, 25 bp, Mus musculus
ccgtgttctttctgctgggttgcag

SEQ ID NO: 596458 - DNA, 25 bp, Mus musculus
ccgtgttgcaatccatgaggctatg

SEQ ID NO: 596459 - DNA, 25 bp, Mus musculus
ccgtgttgcaatgcatgaggctatg

SEQ ID NO: 596460 - DNA, 25 bp, Mus musculus
ccgtgtttacgacgaaccctatgca

SEQ ID NO: 596461 - DNA, 25 bp, Mus musculus
ccgtgtttacgaggaaccctatgca

SEQ ID NO: 596462 - DNA, 25 bp, Mus musculus
ccgtgtttatccagagccgctctgt

SEQ ID NO: 596463 - DNA, 25 bp, Mus musculus
ccgtgtttatcctgagccgctctgt

SEQ ID NO: 596464 - DNA, 25 bp, Mus musculus
ccgtgtttgacaatagcatcaagac

SEQ ID NO: 596465 - DNA, 25 bp, Mus musculus
ccgtgtttgacattagcatcaagac

SEQ ID NO: 596466 - DNA, 25 bp, Mus musculus
ccgttacactgtccgggccaagcgg

SEQ ID NO: 596467 - DNA, 25 bp, Mus musculus
ccgttacactgtgcgggccaagcgg

SEQ ID NO: 596468 - DNA, 25 bp, Mus musculus
ccgttactctgaacaacttctggcc

SEQ ID NO: 596469 - DNA, 25 bp, Mus musculus
ccgttactctgatcaacttctggcc

SEQ ID NO: 596470 - DNA, 25 bp, Mus musculus
ccgttagtgcagcttcatagaaaca

SEQ ID NO: 596471 - DNA, 25 bp, Mus musculus
ccgttagtgcaggttcatagaaaca

SEQ ID NO: 596472 - DNA, 25 bp, Mus musculus
ccgttatgactgagaacaatgaaat

SEQ ID NO: 596473 - DNA, 25 bp, Mus musculus
ccgttatgactgtgaacaatgaaat

SEQ ID NO: 596474 - DNA, 25 bp, Mus musculus
ccgttattgtcgaatgctagaagaa

SEQ ID NO: 596475 - DNA, 25 bp, Mus musculus
ccgttattgtcgtatgctagaagaa

SEQ ID NO: 596476 - DNA, 25 bp, Mus musculus
ccgttcaagaatcccctggagaagt

SEQ ID NO: 596477 - DNA, 25 bp, Mus musculus
ccgttcaagaatgccctggagaagt

SEQ ID NO: 596478 - DNA, 25 bp, Mus musculus
ccgttcaggtgaccgctataagcgg

SEQ ID NO: 596479 - DNA, 25 bp, Mus musculus
ccgttcaggtgagcgctataagcgg

SEQ ID NO: 596480 - DNA, 25 bp, Mus musculus
ccgttcaggtgcaccgcatcgaggg

SEQ ID NO: 596481 - DNA, 25 bp, Mus musculus
ccgttcaggtgctccgcatcgaggg

SEQ ID NO: 596482 - DNA, 25 bp, Mus musculus
ccgttcatgggtcccacgtgcgcga

SEQ ID NO: 596483 - DNA, 25 bp, Mus musculus
ccgttcatgggtgccacgtgcgcga

SEQ ID NO: 596484 - DNA, 25 bp, Mus musculus
ccgttccgtggccagcagagaagaa

SEQ ID NO: 596485 - DNA, 25 bp, Mus musculus
ccgttccgtggcgagcagagaagaa

SEQ ID NO: 596486 - DNA, 25 bp, Mus musculus
ccgttctactggatgcgagtgattc

SEQ ID NO: 596487 - DNA, 25 bp, Mus musculus
ccgttctactggttgcgagtgattc

SEQ ID NO: 596488 - DNA, 25 bp, Mus musculus
ccgttctcgtgcagctgagataagt

SEQ ID NO: 596489 - DNA, 25 bp, Mus musculus
ccgttctcgtgctgctgagataagt

SEQ ID NO: 596490 - DNA, 25 bp, Mus musculus
ccgttctctgcacaacttctttctg

SEQ ID NO: 596491 - DNA, 25 bp, Mus musculus
ccgttctctgcagaacttctttctg

SEQ ID NO: 596492 - DNA, 25 bp, Mus musculus
ccgttctgaggcagtggtggagtat

SEQ ID NO: 596493 - DNA, 25 bp, Mus musculus
ccgttctgaggctgtggtggagtat

SEQ ID NO: 596494 - DNA, 25 bp, Mus musculus
ccgttctggctactaaaattctcca

SEQ ID NO: 596495 - DNA, 25 bp, Mus musculus
ccgttctggctagtaaaattctcca

SEQ ID NO: 596496 - DNA, 25 bp, Mus musculus
ccgttcttaggactggctctgagct

SEQ ID NO: 596497 - DNA, 25 bp, Mus musculus
ccgttcttaggagtggctctgagct

SEQ ID NO: 596498 - DNA, 25 bp, Mus musculus
ccgttgaagagaagaacgagacatt

SEQ ID NO: 596499 - DNA, 25 bp, Mus musculus
ccgttgaagagatgaacgagacatt

SEQ ID NO: 596500 - DNA, 25 bp, Mus musculus
ccgttgcagggtatgcagacactgc

SEQ ID NO: 596501 - DNA, 25 bp, Mus musculus
ccgttgcagggtttgcagacactgc

SEQ ID NO: 596502 - DNA, 25 bp, Mus musculus
ccgttgctgtaaccaagagttgact

SEQ ID NO: 596503 - DNA, 25 bp, Mus musculus
ccgttgctgtaagcaagagttgact

SEQ ID NO: 596504 - DNA, 25 bp, Mus musculus
ccgttggaagcgcatgattgaaccc

SEQ ID NO: 596505 - DNA, 25 bp, Mus musculus
ccgttggaagcggatgattgaaccc

SEQ ID NO: 596506 - DNA, 25 bp, Mus musculus
ccgttggtgcatatcaatctgattc

SEQ ID NO: 596507 - DNA, 25 bp, Mus musculus
ccgttggtgcatttcaatctgattc

SEQ ID NO: 596508 - DNA, 25 bp, Mus musculus
ccgttgtcagcacacagcgttcaca

SEQ ID NO: 596509 - DNA, 25 bp, Mus musculus
ccgttgtcagcagacagcgttcaca

SEQ ID NO: 596510 - DNA, 25 bp, Mus musculus
ccgttgttatgacgacatggtcgta

SEQ ID NO: 596511 - DNA, 25 bp, Mus musculus
ccgttgttatgaggacatggtcgta

SEQ ID NO: 596512 - DNA, 25 bp, Mus musculus
ccgttgttggataagtccgtccaga

SEQ ID NO: 596513 - DNA, 25 bp, Mus musculus
ccgttgttggattagtccgtccaga

SEQ ID NO: 596514 - DNA, 25 bp, Mus musculus
ccgtttacaagcaaagcaacatgcc

SEQ ID NO: 596515 - DNA, 25 bp, Mus musculus
ccgtttacaagctaagcaacatgcc

SEQ ID NO: 596516 - DNA, 25 bp, Mus musculus
ccgtttctacctcgtgtttgagaag

SEQ ID NO: 596517 - DNA, 25 bp, Mus musculus
ccgtttctacctggtgtttgagaag

SEQ ID NO: 596518 - DNA, 25 bp, Mus musculus
ccgtttctgtatcacctggttatga

SEQ ID NO: 596519 - DNA, 25 bp, Mus musculus
ccgtttctgtatgacctggttatga

SEQ ID NO: 596520 - DNA, 25 bp, Mus musculus
cctaaaaaacttcattaatgacgct

SEQ ID NO: 596521 - DNA, 25 bp, Mus musculus
cctaaaaaacttgattaatgacgct

SEQ ID NO: 596522 - DNA, 25 bp, Mus musculus
cctaaaacatgacaatgtggtgaac

SEQ ID NO: 596523 - DNA, 25 bp, Mus musculus
cctaaaacatgagaatgtggtgaac

SEQ ID NO: 596524 - DNA, 25 bp, Mus musculus
cctaaaacgagacacctgctgcgct

SEQ ID NO: 596525 - DNA, 25 bp, Mus musculus
cctaaaacgagagacctgctgcgct

SEQ ID NO: 596526 - DNA, 25 bp, Mus musculus
cctaaaagaactagtcctgctcgag

SEQ ID NO: 596527 - DNA, 25 bp, Mus musculus
cctaaaagaacttgtcctgctcgag

SEQ ID NO: 596528 - DNA, 25 bp, Mus musculus
cctaaaagagctcacgggtgaggac

SEQ ID NO: 596529 - DNA, 25 bp, Mus musculus
cctaaaagagctgacgggtgaggac

SEQ ID NO: 596530 - DNA, 25 bp, Mus musculus
cctaaaagccaacggcgtggagctg

SEQ ID NO: 596531 - DNA, 25 bp, Mus musculus
cctaaaagccaagggcgtggagctg

SEQ ID NO: 596532 - DNA, 25 bp, Mus musculus
cctaaaagtggaatgtctgcgacct

SEQ ID NO: 596533 - DNA, 25 bp, Mus musculus
cctaaaagtggattgtctgcgacct

SEQ ID NO: 596534 - DNA, 25 bp, Mus musculus
cctaaacaatgcatttgaagtggct

SEQ ID NO: 596535 - DNA, 25 bp, Mus musculus
cctaaacaatgcttttgaagtggct

SEQ ID NO: 596536 - DNA, 25 bp, Mus musculus
cctaaacagagcagcagtgcagtgc

SEQ ID NO: 596537 - DNA, 25 bp, Mus musculus
cctaaacagagctgcagtgcagtgc

SEQ ID NO: 596538 - DNA, 25 bp, Mus musculus
cctaaactcggtctaaagtggcaag

SEQ ID NO: 596539 - DNA, 25 bp, Mus musculus
cctaaactcggtgtaaagtggcaag

SEQ ID NO: 596540 - DNA, 25 bp, Mus musculus
cctaaactgactacggctggtggtg

SEQ ID NO: 596541 - DNA, 25 bp, Mus musculus
cctaaactgacttcggctggtggtg

SEQ ID NO: 596542 - DNA, 25 bp, Mus musculus
cctaaagaagcacaacggcattggc

SEQ ID NO: 596543 - DNA, 25 bp, Mus musculus
cctaaagaagcagaacggcattggc

SEQ ID NO: 596544 - DNA, 25 bp, Mus musculus
cctaaagaatgtcaggtcgaagatt

SEQ ID NO: 596545 - DNA, 25 bp, Mus musculus
cctaaagaatgtgaggtcgaagatt

SEQ ID NO: 596546 - DNA, 25 bp, Mus musculus
cctaaagaccaacaagtgggtggat

SEQ ID NO: 596547 - DNA, 25 bp, Mus musculus
cctaaagaccaagaagtgggtggat

SEQ ID NO: 596548 - DNA, 25 bp, Mus musculus
cctaaagagaacatgaggtgggacc

SEQ ID NO: 596549 - DNA, 25 bp, Mus musculus
cctaaagagaacttgaggtgggacc

SEQ ID NO: 596550 - DNA, 25 bp, Mus musculus
cctaaagatgctacttcaattcacc

SEQ ID NO: 596551 - DNA, 25 bp, Mus musculus
cctaaagatgcttcttcaattcacc

SEQ ID NO: 596552 - DNA, 25 bp, Mus musculus
cctaaagcagtgaaaatggccagag

SEQ ID NO: 596553 - DNA, 25 bp, Mus musculus
cctaaagcagtgagttgtgggacag

SEQ ID NO: 596554 - DNA, 25 bp, Mus musculus
cctaaagcagtgtaaatggccagag

SEQ ID NO: 596555 - DNA, 25 bp, Mus musculus
cctaaagcagtgtgttgtgggacag

SEQ ID NO: 596556 - DNA, 25 bp, Mus musculus
cctaaagcccagcaacctagctgtg

SEQ ID NO: 596557 - DNA, 25 bp, Mus musculus
cctaaagcccaggaacctagctgtg

SEQ ID NO: 596558 - DNA, 25 bp, Mus musculus
cctaaagcgcatcaggtgctgactc

SEQ ID NO: 596559 - DNA, 25 bp, Mus musculus
cctaaagcgcatgaggtgctgactc

SEQ ID NO: 596560 - DNA, 25 bp, Mus musculus
cctaaaggtggacaaggattatgtg

SEQ ID NO: 596561 - DNA, 25 bp, Mus musculus
cctaaaggtggagaaggattatgtg

SEQ ID NO: 596562 - DNA, 25 bp, Mus musculus
cctaaagtggtgaacacaagtgatc

SEQ ID NO: 596563 - DNA, 25 bp, Mus musculus
cctaaagtggtgtacacaagtgatc

SEQ ID NO: 596564 - DNA, 25 bp, Mus musculus
cctaaagtgtctaatgtgaaggcgc

SEQ ID NO: 596565 - DNA, 25 bp, Mus musculus
cctaaagtgtcttatgtgaaggcgc

SEQ ID NO: 596566 - DNA, 25 bp, Mus musculus
cctaaataatgaccctacgcgggaa

SEQ ID NO: 596567 - DNA, 25 bp, Mus musculus
cctaaataatgagcctacgcgggaa

SEQ ID NO: 596568 - DNA, 25 bp, Mus musculus
cctaaatgaaggaagggccagctgt

SEQ ID NO: 596569 - DNA, 25 bp, Mus musculus
cctaaatgaaggtagggccagctgt

SEQ ID NO: 596570 - DNA, 25 bp, Mus musculus
cctaaattttggaatgattgtctcc

SEQ ID NO: 596571 - DNA, 25 bp, Mus musculus
cctaaattttggtatgattgtctcc

SEQ ID NO: 596572 - DNA, 25 bp, Mus musculus
cctaacaaaggtctgctgtctgact

SEQ ID NO: 596573 - DNA, 25 bp, Mus musculus
cctaacaaaggtgtgctgtctgact

SEQ ID NO: 596574 - DNA, 25 bp, Mus musculus
cctaacaaccggagatccagacaca

SEQ ID NO: 596575 - DNA, 25 bp, Mus musculus
cctaacaaccggtgatccagacaca

SEQ ID NO: 596576 - DNA, 25 bp, Mus musculus
cctaacaccaaccatgaggtggatg

SEQ ID NO: 596577 - DNA, 25 bp, Mus musculus
cctaacaccaacgatgaggtggatg

SEQ ID NO: 596578 - DNA, 25 bp, Mus musculus
cctaacagacttcacattcatggtg

SEQ ID NO: 596579 - DNA, 25 bp, Mus musculus
cctaacagacttgacattcatggtg

SEQ ID NO: 596580 - DNA, 25 bp, Mus musculus
cctaacatacatcgtggccatgcct

SEQ ID NO: 596581 - DNA, 25 bp, Mus musculus
cctaacatacatggtggccatgcct

SEQ ID NO: 596582 - DNA, 25 bp, Mus musculus
cctaaccaaagcaggcacggaggaa

SEQ ID NO: 596583 - DNA, 25 bp, Mus musculus
cctaaccaaagctggcacggaggaa

SEQ ID NO: 596584 - DNA, 25 bp, Mus musculus
cctaaccagagcaatgagggcagca

SEQ ID NO: 596585 - DNA, 25 bp, Mus musculus
cctaaccagagctatgagggcagca

SEQ ID NO: 596586 - DNA, 25 bp, Mus musculus
cctaaccagtcactgtttctcttca

SEQ ID NO: 596587 - DNA, 25 bp, Mus musculus
cctaaccagtcagtgtttctcttca

SEQ ID NO: 596588 - DNA, 25 bp, Mus musculus
cctaaccatcgtctgtatggaggag

SEQ ID NO: 596589 - DNA, 25 bp, Mus musculus
cctaaccatcgtgtgtatggaggag

SEQ ID NO: 596590 - DNA, 25 bp, Mus musculus
cctaacccatgccagaacgatggcg

SEQ ID NO: 596591 - DNA, 25 bp, Mus musculus
cctaacccatgcgagaacgatggcg

SEQ ID NO: 596592 - DNA, 25 bp, Mus musculus
cctaacctccagaatgggcccattt

SEQ ID NO: 596593 - DNA, 25 bp, Mus musculus
cctaacctccagtatgggcccattt

SEQ ID NO: 596594 - DNA, 25 bp, Mus musculus
cctaaccttgagcttgaggctctgt

SEQ ID NO: 596595 - DNA, 25 bp, Mus musculus
cctaaccttgaggttgaggctctgt

SEQ ID NO: 596596 - DNA, 25 bp, Mus musculus
cctaacgcagagcaagggacctggc

SEQ ID NO: 596597 - DNA, 25 bp, Mus musculus
cctaacgcagaggaagggacctggc

SEQ ID NO: 596598 - DNA, 25 bp, Mus musculus
cctaacggcgtcctatgtgcgggca

SEQ ID NO: 596599 - DNA, 25 bp, Mus musculus
cctaacggcgtcgtatgtgcgggca

SEQ ID NO: 596600 - DNA, 25 bp, Mus musculus
cctaacgggccacatagggagccgt

SEQ ID NO: 596601 - DNA, 25 bp, Mus musculus
cctaacgggccagatagggagccgt

SEQ ID NO: 596602 - DNA, 25 bp, Mus musculus
cctaacggtggtcgatgtcttgacc

SEQ ID NO: 596603 - DNA, 25 bp, Mus musculus
cctaacggtggtggatgtcttgacc

SEQ ID NO: 596604 - DNA, 25 bp, Mus musculus
cctaactaagacacaaggttgtata

SEQ ID NO: 596605 - DNA, 25 bp, Mus musculus
cctaactaagactcaaggttgtata

SEQ ID NO: 596606 - DNA, 25 bp, Mus musculus
cctaactagggaagacagctgccac

SEQ ID NO: 596607 - DNA, 25 bp, Mus musculus
cctaactagggatgacagctgccac

SEQ ID NO: 596608 - DNA, 25 bp, Mus musculus
cctaactatgatacagagggaagca

SEQ ID NO: 596609 - DNA, 25 bp, Mus musculus
cctaactatgattcagagggaagca

SEQ ID NO: 596610 - DNA, 25 bp, Mus musculus
cctaactcacacaactgctgtcagg

SEQ ID NO: 596611 - DNA, 25 bp, Mus musculus
cctaactcacactactgctgtcagg

SEQ ID NO: 596612 - DNA, 25 bp, Mus musculus
cctaactgggtgagctttatagctc

SEQ ID NO: 596613 - DNA, 25 bp, Mus musculus
cctaactgggtgtgctttatagctc

SEQ ID NO: 596614 - DNA, 25 bp, Mus musculus
cctaacttggatcatggctggtgca

SEQ ID NO: 596615 - DNA, 25 bp, Mus musculus
cctaacttggatgatggctggtgca

SEQ ID NO: 596616 - DNA, 25 bp, Mus musculus
cctaactttgcaactatcccacaag

SEQ ID NO: 596617 - DNA, 25 bp, Mus musculus
cctaactttgcatctatcccacaag

SEQ ID NO: 596618 - DNA, 25 bp, Mus musculus
cctaagaaaaatagtagcagtgcta

SEQ ID NO: 596619 - DNA, 25 bp, Mus musculus
cctaagaaaaattgtagcagtgcta

SEQ ID NO: 596620 - DNA, 25 bp, Mus musculus
cctaagaatcgtacaattggagcag

SEQ ID NO: 596621 - DNA, 25 bp, Mus musculus
cctaagaatcgttcaattggagcag

SEQ ID NO: 596622 - DNA, 25 bp, Mus musculus
cctaagaccacgagagaaaaagctg

SEQ ID NO: 596623 - DNA, 25 bp, Mus musculus
cctaagaccacgcagccagtgtcag

SEQ ID NO: 596624 - DNA, 25 bp, Mus musculus
cctaagaccacggagccagtgtcag

SEQ ID NO: 596625 - DNA, 25 bp, Mus musculus
cctaagaccacgtgagaaaaagctg

SEQ ID NO: 596626 - DNA, 25 bp, Mus musculus
cctaagagcagaaggcgagttacag

SEQ ID NO: 596627 - DNA, 25 bp, Mus musculus
cctaagagcagatggcgagttacag

SEQ ID NO: 596628 - DNA, 25 bp, Mus musculus
cctaagagcttcatgctggtcagga

SEQ ID NO: 596629 - DNA, 25 bp, Mus musculus
cctaagagcttcttgctggtcagga

SEQ ID NO: 596630 - DNA, 25 bp, Mus musculus
cctaagataaagaagaaccagagcg

SEQ ID NO: 596631 - DNA, 25 bp, Mus musculus
cctaagataaagtagaaccagagcg

SEQ ID NO: 596632 - DNA, 25 bp, Mus musculus
cctaagatcatcattgtagagcgaa

SEQ ID NO: 596633 - DNA, 25 bp, Mus musculus
cctaagatcatctttgtagagcgaa

SEQ ID NO: 596634 - DNA, 25 bp, Mus musculus
cctaagatggctcacgtctcagcag

SEQ ID NO: 596635 - DNA, 25 bp, Mus musculus
cctaagatggctgacgtctcagcag

SEQ ID NO: 596636 - DNA, 25 bp, Mus musculus
cctaagcatagtcccgttagccaac

SEQ ID NO: 596637 - DNA, 25 bp, Mus musculus
cctaagcatagtgccgttagccaac

SEQ ID NO: 596638 - DNA, 25 bp, Mus musculus
cctaagcatggcactgcacatgatt

SEQ ID NO: 596639 - DNA, 25 bp, Mus musculus
cctaagcatggctctgcacatgatt

SEQ ID NO: 596640 - DNA, 25 bp, Mus musculus
cctaagccatgcacagcagtaccga

SEQ ID NO: 596641 - DNA, 25 bp, Mus musculus
cctaagccatgctcagcagtaccga

SEQ ID NO: 596642 - DNA, 25 bp, Mus musculus
cctaagccctctaaggcaaagccgg

SEQ ID NO: 596643 - DNA, 25 bp, Mus musculus
cctaagccctcttaggcaaagccgg

SEQ ID NO: 596644 - DNA, 25 bp, Mus musculus
cctaagccttgcaaagatggtccct

SEQ ID NO: 596645 - DNA, 25 bp, Mus musculus
cctaagccttgctaagatggtccct

SEQ ID NO: 596646 - DNA, 25 bp, Mus musculus
cctaagcgactgagtgggtcaaatc

SEQ ID NO: 596647 - DNA, 25 bp, Mus musculus
cctaagcgactgtgtgggtcaaatc

SEQ ID NO: 596648 - DNA, 25 bp, Mus musculus
cctaagctgagtcaaaatgtaaagc

SEQ ID NO: 596649 - DNA, 25 bp, Mus musculus
cctaagctgagtgaaaatgtaaagc

SEQ ID NO: 596650 - DNA, 25 bp, Mus musculus
cctaagctggaccaagccttggtgg

SEQ ID NO: 596651 - DNA, 25 bp, Mus musculus
cctaagctggacgaagccttggtgg

SEQ ID NO: 596652 - DNA, 25 bp, Mus musculus
cctaagcttgttagtgtatgtaatt

SEQ ID NO: 596653 - DNA, 25 bp, Mus musculus
cctaagcttgtttgtgtatgtaatt

SEQ ID NO: 596654 - DNA, 25 bp, Mus musculus
cctaaggaacgcagccgccacagag

SEQ ID NO: 596655 - DNA, 25 bp, Mus musculus
cctaaggaacgctgccgccacagag

SEQ ID NO: 596656 - DNA, 25 bp, Mus musculus
cctaaggaacggaaatttgcacatc

SEQ ID NO: 596657 - DNA, 25 bp, Mus musculus
cctaaggaacggtaatttgcacatc

SEQ ID NO: 596658 - DNA, 25 bp, Mus musculus
cctaaggaccagatccatccctggg

SEQ ID NO: 596659 - DNA, 25 bp, Mus musculus
cctaaggaccagttccatccctggg

SEQ ID NO: 596660 - DNA, 25 bp, Mus musculus
cctaaggagaatacagaacaaccag

SEQ ID NO: 596661 - DNA, 25 bp, Mus musculus
cctaaggagaattcagaacaaccag

SEQ ID NO: 596662 - DNA, 25 bp, Mus musculus
cctaaggcgcagaaggcacgggctt

SEQ ID NO: 596663 - DNA, 25 bp, Mus musculus
cctaaggcgcagtaggcacgggctt

SEQ ID NO: 596664 - DNA, 25 bp, Mus musculus
cctaaggctcctcattgaacaaaac

SEQ ID NO: 596665 - DNA, 25 bp, Mus musculus
cctaaggctcctgattgaacaaaac

SEQ ID NO: 596666 - DNA, 25 bp, Mus musculus
cctaaggtcagtagctgctctctgc

SEQ ID NO: 596667 - DNA, 25 bp, Mus musculus
cctaaggtcagttgctgctctctgc

SEQ ID NO: 596668 - DNA, 25 bp, Mus musculus
cctaaggttctgctcttggaagcca

SEQ ID NO: 596669 - DNA, 25 bp, Mus musculus
cctaaggttctggtcttggaagcca

SEQ ID NO: 596670 - DNA, 25 bp, Mus musculus
cctaagtacagcatatgtaataaac

SEQ ID NO: 596671 - DNA, 25 bp, Mus musculus
cctaagtacagcttatgtaataaac

SEQ ID NO: 596672 - DNA, 25 bp, Mus musculus
cctaagtcaggaatcagcgtggtca

SEQ ID NO: 596673 - DNA, 25 bp, Mus musculus
cctaagtcaggattcagcgtggtca

SEQ ID NO: 596674 - DNA, 25 bp, Mus musculus
cctaagtgcgagaaggtttgaaact

SEQ ID NO: 596675 - DNA, 25 bp, Mus musculus
cctaagtgcgagtaggtttgaaact

SEQ ID NO: 596676 - DNA, 25 bp, Mus musculus
cctaagtgctcaaaacagaggcctt

SEQ ID NO: 596677 - DNA, 25 bp, Mus musculus
cctaagtgctcataacagaggcctt

SEQ ID NO: 596678 - DNA, 25 bp, Mus musculus
cctaagtgtcaacgtgatgagagac

SEQ ID NO: 596679 - DNA, 25 bp, Mus musculus
cctaagtgtcaaggtgatgagagac

SEQ ID NO: 596680 - DNA, 25 bp, Mus musculus
cctaagtgtttcagatgcgtgacaa

SEQ ID NO: 596681 - DNA, 25 bp, Mus musculus
cctaagtgtttctgatgcgtgacaa

SEQ ID NO: 596682 - DNA, 25 bp, Mus musculus
cctaagttaccacagataaaggcaa

SEQ ID NO: 596683 - DNA, 25 bp, Mus musculus
cctaagttaccagagataaaggcaa

SEQ ID NO: 596684 - DNA, 25 bp, Mus musculus
cctaagttagatctctgggacccac

SEQ ID NO: 596685 - DNA, 25 bp, Mus musculus
cctaagttagatgtctgggacccac

SEQ ID NO: 596686 - DNA, 25 bp, Mus musculus
cctaagttctctatcagggtgatgc

SEQ ID NO: 596687 - DNA, 25 bp, Mus musculus
cctaagttctctttcagggtgatgc

SEQ ID NO: 596688 - DNA, 25 bp, Mus musculus
cctaagttgtatcggccggatggcc

SEQ ID NO: 596689 - DNA, 25 bp, Mus musculus
cctaagttgtatgggccggatggcc

SEQ ID NO: 596690 - DNA, 25 bp, Mus musculus
cctaataccacaacggtagagaaag

SEQ ID NO: 596691 - DNA, 25 bp, Mus musculus
cctaataccacatcggtagagaaag

SEQ ID NO: 596692 - DNA, 25 bp, Mus musculus
cctaatagctgcagtgtatataaca

SEQ ID NO: 596693 - DNA, 25 bp, Mus musculus
cctaatagctgctgtgtatataaca

SEQ ID NO: 596694 - DNA, 25 bp, Mus musculus
cctaataggatgcttcttggaagaa

SEQ ID NO: 596695 - DNA, 25 bp, Mus musculus
cctaataggatggttcttggaagaa

SEQ ID NO: 596696 - DNA, 25 bp, Mus musculus
cctaatatagtcaagctagcagagc

SEQ ID NO: 596697 - DNA, 25 bp, Mus musculus
cctaatatagtctagctagcagagc

SEQ ID NO: 596698 - DNA, 25 bp, Mus musculus
cctaatatcaacagcaatggcagca

SEQ ID NO: 596699 - DNA, 25 bp, Mus musculus
cctaatatcaactgcaatggcagca

SEQ ID NO: 596700 - DNA, 25 bp, Mus musculus
cctaatatggtacccctggtgtcac

SEQ ID NO: 596701 - DNA, 25 bp, Mus musculus
cctaatatggtagccctggtgtcac

SEQ ID NO: 596702 - DNA, 25 bp, Mus musculus
cctaatattaccaaccaatgcatgg

SEQ ID NO: 596703 - DNA, 25 bp, Mus musculus
cctaatattacctaccaatgcatgg

SEQ ID NO: 596704 - DNA, 25 bp, Mus musculus
cctaatcacagacgagaggctgcag

SEQ ID NO: 596705 - DNA, 25 bp, Mus musculus
cctaatcacagaggagaggctgcag

SEQ ID NO: 596706 - DNA, 25 bp, Mus musculus
cctaatcagtttcataagctcagtg

SEQ ID NO: 596707 - DNA, 25 bp, Mus musculus
cctaatcagtttgataagctcagtg

SEQ ID NO: 596708 - DNA, 25 bp, Mus musculus
cctaatcatggacttcctgcctgga

SEQ ID NO: 596709 - DNA, 25 bp, Mus musculus
cctaatcatggagttcctgcctgga

SEQ ID NO: 596710 - DNA, 25 bp, Mus musculus
cctaatcattatcccgaggatttgg

SEQ ID NO: 596711 - DNA, 25 bp, Mus musculus
cctaatcattatgccgaggatttgg

SEQ ID NO: 596712 - DNA, 25 bp, Mus musculus
cctaatccaagcatctgagcaattc

SEQ ID NO: 596713 - DNA, 25 bp, Mus musculus
cctaatccaagcttctgagcaattc

SEQ ID NO: 596714 - DNA, 25 bp, Mus musculus
cctaatcctatgcaaggcatgacag

SEQ ID NO: 596715 - DNA, 25 bp, Mus musculus
cctaatcctatggaaggcatgacag

SEQ ID NO: 596716 - DNA, 25 bp, Mus musculus
cctaatcggcaacaaggagatgcgc

SEQ ID NO: 596717 - DNA, 25 bp, Mus musculus
cctaatcggcaagaaggagatgcgc

SEQ ID NO: 596718 - DNA, 25 bp, Mus musculus
cctaatctacatacaggagaccgaa

SEQ ID NO: 596719 - DNA, 25 bp, Mus musculus
cctaatctacattcaggagaccgaa

SEQ ID NO: 596720 - DNA, 25 bp, Mus musculus
cctaatctggctattctagaagtac

SEQ ID NO: 596721 - DNA, 25 bp, Mus musculus
cctaatctggcttttctagaagtac

SEQ ID NO: 596722 - DNA, 25 bp, Mus musculus
cctaatgaagaccagatgcccaacc

SEQ ID NO: 596723 - DNA, 25 bp, Mus musculus
cctaatgaagacgagatgcccaacc

SEQ ID NO: 596724 - DNA, 25 bp, Mus musculus
cctaatgagatgatgcagtagataa

SEQ ID NO: 596725 - DNA, 25 bp, Mus musculus
cctaatgagatgttgcagtagataa

SEQ ID NO: 596726 - DNA, 25 bp, Mus musculus
cctaatgaggttccccagcagctga

SEQ ID NO: 596727 - DNA, 25 bp, Mus musculus
cctaatgaggttgcccagcagctga

SEQ ID NO: 596728 - DNA, 25 bp, Mus musculus
cctaatgcttttcatgtggtgacca

SEQ ID NO: 596729 - DNA, 25 bp, Mus musculus
cctaatgcttttgatgtggtgacca

SEQ ID NO: 596730 - DNA, 25 bp, Mus musculus
cctaatggacagaaagagagcgtgc

SEQ ID NO: 596731 - DNA, 25 bp, Mus musculus
cctaatggacagtaagagagcgtgc

SEQ ID NO: 596732 - DNA, 25 bp, Mus musculus
cctaatgggcatctttggaggttgt

SEQ ID NO: 596733 - DNA, 25 bp, Mus musculus
cctaatgggcatgtttggaggttgt

SEQ ID NO: 596734 - DNA, 25 bp, Mus musculus
cctaatggtgagcagatgaccctca

SEQ ID NO: 596735 - DNA, 25 bp, Mus musculus
cctaatggtgaggagatgaccctca

SEQ ID NO: 596736 - DNA, 25 bp, Mus musculus
cctaatggtgtgagaggcccttaaa

SEQ ID NO: 596737 - DNA, 25 bp, Mus musculus
cctaatggtgtgtgaggcccttaaa

SEQ ID NO: 596738 - DNA, 25 bp, Mus musculus
cctaatgttagacaggtgtgttgct

SEQ ID NO: 596739 - DNA, 25 bp, Mus musculus
cctaatgttagagaggtgtgttgct

SEQ ID NO: 596740 - DNA, 25 bp, Mus musculus
cctaattccaacatcagggatccct

SEQ ID NO: 596741 - DNA, 25 bp, Mus musculus
cctaattccaacttcagggatccct

SEQ ID NO: 596742 - DNA, 25 bp, Mus musculus
cctaattggagacctaattacacca

SEQ ID NO: 596743 - DNA, 25 bp, Mus musculus
cctaattggagagctaattacacca

SEQ ID NO: 596744 - DNA, 25 bp, Mus musculus
cctaattgtttgagcttggacagcc

SEQ ID NO: 596745 - DNA, 25 bp, Mus musculus
cctaattgtttgtgcttggacagcc

SEQ ID NO: 596746 - DNA, 25 bp, Mus musculus
cctaatttgagacgcggactttccg

SEQ ID NO: 596747 - DNA, 25 bp, Mus musculus
cctaatttgagaggcggactttccg

SEQ ID NO: 596748 - DNA, 25 bp, Mus musculus
cctacaaaatgcctggagacatcaa

SEQ ID NO: 596749 - DNA, 25 bp, Mus musculus
cctacaaaatgcgtggagacatcaa

SEQ ID NO: 596750 - DNA, 25 bp, Mus musculus
cctacaaagaacaatggacccagag

SEQ ID NO: 596751 - DNA, 25 bp, Mus musculus
cctacaaagaactatggacccagag

SEQ ID NO: 596752 - DNA, 25 bp, Mus musculus
cctacaaaggtcagtacatggtgca

SEQ ID NO: 596753 - DNA, 25 bp, Mus musculus
cctacaaaggtctgtacatggtgca

SEQ ID NO: 596754 - DNA, 25 bp, Mus musculus
cctacaacaagcacattaacatcag

SEQ ID NO: 596755 - DNA, 25 bp, Mus musculus
cctacaacaagctcattaacatcag

SEQ ID NO: 596756 - DNA, 25 bp, Mus musculus
cctacaacagtcatggtactgctgg

SEQ ID NO: 596757 - DNA, 25 bp, Mus musculus
cctacaacagtcttggtactgctgg

SEQ ID NO: 596758 - DNA, 25 bp, Mus musculus
cctacaacttgaaaagaaagcaaac

SEQ ID NO: 596759 - DNA, 25 bp, Mus musculus
cctacaacttgataagaaagcaaac

SEQ ID NO: 596760 - DNA, 25 bp, Mus musculus
cctacaagaactatggtgaccagcc

SEQ ID NO: 596761 - DNA, 25 bp, Mus musculus
cctacaagaactttggtgaccagcc

SEQ ID NO: 596762 - DNA, 25 bp, Mus musculus
cctacaagaagacagccacaggccg

SEQ ID NO: 596763 - DNA, 25 bp, Mus musculus
cctacaagaagagagccacaggccg

SEQ ID NO: 596764 - DNA, 25 bp, Mus musculus
cctacaagtgagacagaaagattac

SEQ ID NO: 596765 - DNA, 25 bp, Mus musculus
cctacaagtgagtcagaaagattac

SEQ ID NO: 596766 - DNA, 25 bp, Mus musculus
cctacaagtgggaggaagatctaca

SEQ ID NO: 596767 - DNA, 25 bp, Mus musculus
cctacaagtgggtggaagatctaca

SEQ ID NO: 596768 - DNA, 25 bp, Mus musculus
cctacaatagaaagtgatatctctt

SEQ ID NO: 596769 - DNA, 25 bp, Mus musculus
cctacaatagaatgtgatatctctt

SEQ ID NO: 596770 - DNA, 25 bp, Mus musculus
cctacacatcccaaggtatggtctc

SEQ ID NO: 596771 - DNA, 25 bp, Mus musculus
cctacacatccctaggtatggtctc

SEQ ID NO: 596772 - DNA, 25 bp, Mus musculus
cctacacatttgatatcaacctgtc

SEQ ID NO: 596773 - DNA, 25 bp, Mus musculus
cctacacatttgttatcaacctgtc

SEQ ID NO: 596774 - DNA, 25 bp, Mus musculus
cctacacccttcagtatggacagtg

SEQ ID NO: 596775 - DNA, 25 bp, Mus musculus
cctacacccttctgtatggacagtg

SEQ ID NO: 596776 - DNA, 25 bp, Mus musculus
cctacaccgaggaggaccctgaagg

SEQ ID NO: 596777 - DNA, 25 bp, Mus musculus
cctacaccgaggtggaccctgaagg

SEQ ID NO: 596778 - DNA, 25 bp, Mus musculus
cctacaccgagtacccggagttcag

SEQ ID NO: 596779 - DNA, 25 bp, Mus musculus
cctacaccgagttcccggagttcag

SEQ ID NO: 596780 - DNA, 25 bp, Mus musculus
cctacaccgtttacctagagctgga

SEQ ID NO: 596781 - DNA, 25 bp, Mus musculus
cctacaccgttttcctagagctgga

SEQ ID NO: 596782 - DNA, 25 bp, Mus musculus
cctacacgaaagcattacggatcca

SEQ ID NO: 596783 - DNA, 25 bp, Mus musculus
cctacacgaaaggattacggatcca

SEQ ID NO: 596784 - DNA, 25 bp, Mus musculus
cctacacgtttcattcgacttgggt

SEQ ID NO: 596785 - DNA, 25 bp, Mus musculus
cctacacgtttctttcgacttgggt

SEQ ID NO: 596786 - DNA, 25 bp, Mus musculus
cctacactcaaacggttgaggtcct

SEQ ID NO: 596787 - DNA, 25 bp, Mus musculus
cctacactcaaagggttgaggtcct

SEQ ID NO: 596788 - DNA, 25 bp, Mus musculus
cctacactgacacaggaatgatcta

SEQ ID NO: 596789 - DNA, 25 bp, Mus musculus
cctacactgacagaggaatgatcta

SEQ ID NO: 596790 - DNA, 25 bp, Mus musculus
cctacactgagacaaggtgggcctt

SEQ ID NO: 596791 - DNA, 25 bp, Mus musculus
cctacactgagagaaggtgggcctt

SEQ ID NO: 596792 - DNA, 25 bp, Mus musculus
cctacactgggaagctattaaaacg

SEQ ID NO: 596793 - DNA, 25 bp, Mus musculus
cctacactgggatgctattaaaacg

SEQ ID NO: 596794 - DNA, 25 bp, Mus musculus
cctacactgtttatgggtcacccga

SEQ ID NO: 596795 - DNA, 25 bp, Mus musculus
cctacactgtttttgggtcacccga

SEQ ID NO: 596796 - DNA, 25 bp, Mus musculus
cctacagaattcacgggtccggcag

SEQ ID NO: 596797 - DNA, 25 bp, Mus musculus
cctacagaattctcgggtccggcag

SEQ ID NO: 596798 - DNA, 25 bp, Mus musculus
cctacagagatgatataatgtccgt

SEQ ID NO: 596799 - DNA, 25 bp, Mus musculus
cctacagagatgttataatgtccgt

SEQ ID NO: 596800 - DNA, 25 bp, Mus musculus
cctacagattgaaccagtttcactt

SEQ ID NO: 596801 - DNA, 25 bp, Mus musculus
cctacagattgatccagtttcactt

SEQ ID NO: 596802 - DNA, 25 bp, Mus musculus
cctacagcagagacgggcagttgat

SEQ ID NO: 596803 - DNA, 25 bp, Mus musculus
cctacagcagagtcgggcagttgat

SEQ ID NO: 596804 - DNA, 25 bp, Mus musculus
cctacagcagctacagaacgtggta

SEQ ID NO: 596805 - DNA, 25 bp, Mus musculus
cctacagcagcttcagaacgtggta

SEQ ID NO: 596806 - DNA, 25 bp, Mus musculus
cctacagccaggatcctagagagtg

SEQ ID NO: 596807 - DNA, 25 bp, Mus musculus
cctacagccaggttcctagagagtg

SEQ ID NO: 596808 - DNA, 25 bp, Mus musculus
cctacagcctagcttgtccttagac

SEQ ID NO: 596809 - DNA, 25 bp, Mus musculus
cctacagcctaggttgtccttagac

SEQ ID NO: 596810 - DNA, 25 bp, Mus musculus
cctacagcgactcgagaaggaccga

SEQ ID NO: 596811 - DNA, 25 bp, Mus musculus
cctacagcgactggagaaggaccga

SEQ ID NO: 596812 - DNA, 25 bp, Mus musculus
cctacagctatgacagctctgaggt

SEQ ID NO: 596813 - DNA, 25 bp, Mus musculus
cctacagctatgtcagctctgaggt

SEQ ID NO: 596814 - DNA, 25 bp, Mus musculus
cctacagctgcgagcagtgcggcaa

SEQ ID NO: 596815 - DNA, 25 bp, Mus musculus
cctacagctgcgtgcagtgcggcaa

SEQ ID NO: 596816 - DNA, 25 bp, Mus musculus
cctacaggagctccgtaagattgag

SEQ ID NO: 596817 - DNA, 25 bp, Mus musculus
cctacaggagctgcgtaagattgag

SEQ ID NO: 596818 - DNA, 25 bp, Mus musculus
cctacaggtgacaagcggatctttc

SEQ ID NO: 596819 - DNA, 25 bp, Mus musculus
cctacaggtgactagcggatctttc

SEQ ID NO: 596820 - DNA, 25 bp, Mus musculus
cctacaggttggatcagtttgatac

SEQ ID NO: 596821 - DNA, 25 bp, Mus musculus
cctacaggttggttcagtttgatac

SEQ ID NO: 596822 - DNA, 25 bp, Mus musculus
cctacagtgacaacagcctggatcc

SEQ ID NO: 596823 - DNA, 25 bp, Mus musculus
cctacagtgacatcagcctggatcc

SEQ ID NO: 596824 - DNA, 25 bp, Mus musculus
cctacagtgacgaagtacggaatga

SEQ ID NO: 596825 - DNA, 25 bp, Mus musculus
cctacagtgacgtagtacggaatga

SEQ ID NO: 596826 - DNA, 25 bp, Mus musculus
cctacagtgggaagctggatgagtt

SEQ ID NO: 596827 - DNA, 25 bp, Mus musculus
cctacagtgggatgctggatgagtt

SEQ ID NO: 596828 - DNA, 25 bp, Mus musculus
cctacatacctgcagcctgggatcg

SEQ ID NO: 596829 - DNA, 25 bp, Mus musculus
cctacatacctggagcctgggatcg

SEQ ID NO: 596830 - DNA, 25 bp, Mus musculus
cctacataggagctttgggaattat

SEQ ID NO: 596831 - DNA, 25 bp, Mus musculus
cctacataggaggtttgggaattat

SEQ ID NO: 596832 - DNA, 25 bp, Mus musculus
cctacataggtgatgctatttgcgt

SEQ ID NO: 596833 - DNA, 25 bp, Mus musculus
cctacataggtgttgctatttgcgt

SEQ ID NO: 596834 - DNA, 25 bp, Mus musculus
cctacatcatcaagctcattgtgga

SEQ ID NO: 596835 - DNA, 25 bp, Mus musculus
cctacatcatcatgctcattgtgga

SEQ ID NO: 596836 - DNA, 25 bp, Mus musculus
cctacatcatctatgggcctccagg

SEQ ID NO: 596837 - DNA, 25 bp, Mus musculus
cctacatcatctttgggcctccagg

SEQ ID NO: 596838 - DNA, 25 bp, Mus musculus
cctacatcattgagtctttcgtgaa

SEQ ID NO: 596839 - DNA, 25 bp, Mus musculus
cctacatcattgtgtctttcgtgaa

SEQ ID NO: 596840 - DNA, 25 bp, Mus musculus
cctacatccgtaaggtgaagcacat

SEQ ID NO: 596841 - DNA, 25 bp, Mus musculus
cctacatccgtatggtgaagcacat

SEQ ID NO: 596842 - DNA, 25 bp, Mus musculus
cctacatctgtgcagagtgggacat

SEQ ID NO: 596843 - DNA, 25 bp, Mus musculus
cctacatctgtggagagtgggacat

SEQ ID NO: 596844 - DNA, 25 bp, Mus musculus
cctacatcttccagcctgatatgct

SEQ ID NO: 596845 - DNA, 25 bp, Mus musculus
cctacatcttcctgcctgatatgct

SEQ ID NO: 596846 - DNA, 25 bp, Mus musculus
cctacatggcttccgtgcaagtgaa

SEQ ID NO: 596847 - DNA, 25 bp, Mus musculus
cctacatggcttgcgtgcaagtgaa

SEQ ID NO: 596848 - DNA, 25 bp, Mus musculus
cctacatggtaccagagaactaact

SEQ ID NO: 596849 - DNA, 25 bp, Mus musculus
cctacatggtacgagagaactaact

SEQ ID NO: 596850 - DNA, 25 bp, Mus musculus
cctacatgtagtcccctggctcgaa

SEQ ID NO: 596851 - DNA, 25 bp, Mus musculus
cctacatgtagtgccctggctcgaa

SEQ ID NO: 596852 - DNA, 25 bp, Mus musculus
cctacattcgtgatgtggccaagcg

SEQ ID NO: 596853 - DNA, 25 bp, Mus musculus
cctacattcgtgttgtggccaagcg

SEQ ID NO: 596854 - DNA, 25 bp, Mus musculus
cctacattgtctcgactgccaatca

SEQ ID NO: 596855 - DNA, 25 bp, Mus musculus
cctacattgtctggactgccaatca

SEQ ID NO: 596856 - DNA, 25 bp, Mus musculus
cctaccaacgcaaccaagtgtcaga

SEQ ID NO: 596857 - DNA, 25 bp, Mus musculus
cctaccaacgcatccaagtgtcaga

SEQ ID NO: 596858 - DNA, 25 bp, Mus musculus
cctaccacgtggaaagcagaagcag

SEQ ID NO: 596859 - DNA, 25 bp, Mus musculus
cctaccacgtggtaagcagaagcag

SEQ ID NO: 596860 - DNA, 25 bp, Mus musculus
cctaccagcaggctcaagttcctga

SEQ ID NO: 596861 - DNA, 25 bp, Mus musculus
cctaccagcagggtcaagttcctga

SEQ ID NO: 596862 - DNA, 25 bp, Mus musculus
cctaccaggatacaggaaattatcg

SEQ ID NO: 596863 - DNA, 25 bp, Mus musculus
cctaccaggatagaggaaattatcg

SEQ ID NO: 596864 - DNA, 25 bp, Mus musculus
cctacccatcgacgacgagtgtggt

SEQ ID NO: 596865 - DNA, 25 bp, Mus musculus
cctacccatcgaggacgagtgtggt

SEQ ID NO: 596866 - DNA, 25 bp, Mus musculus
cctaccctgagccttgggaagctgc

SEQ ID NO: 596867 - DNA, 25 bp, Mus musculus
cctaccctgagcgttgggaagctgc

SEQ ID NO: 596868 - DNA, 25 bp, Mus musculus
cctaccgacgacagcatggatcgct

SEQ ID NO: 596869 - DNA, 25 bp, Mus musculus
cctaccgacgactgcatggatcgct

SEQ ID NO: 596870 - DNA, 25 bp, Mus musculus
cctaccgcctagaggtcagtcttct

SEQ ID NO: 596871 - DNA, 25 bp, Mus musculus
cctaccgcctagtggtcagtcttct

SEQ ID NO: 596872 - DNA, 25 bp, Mus musculus
cctaccgctatgaagtcagtgagcc

SEQ ID NO: 596873 - DNA, 25 bp, Mus musculus
cctaccgctatgtagtcagtgagcc

SEQ ID NO: 596874 - DNA, 25 bp, Mus musculus
cctaccggccagagtatgcagtcaa

SEQ ID NO: 596875 - DNA, 25 bp, Mus musculus
cctaccggccagtgtatgcagtcaa

SEQ ID NO: 596876 - DNA, 25 bp, Mus musculus
cctaccgtgagaatataaagaacag

SEQ ID NO: 596877 - DNA, 25 bp, Mus musculus
cctaccgtgagattataaagaacag

SEQ ID NO: 596878 - DNA, 25 bp, Mus musculus
cctacctcatctcccttaagtgaaa

SEQ ID NO: 596879 - DNA, 25 bp, Mus musculus
cctacctcatctgccttaagtgaaa

SEQ ID NO: 596880 - DNA, 25 bp, Mus musculus
cctacctgaacccagagatgaaaga

SEQ ID NO: 596881 - DNA, 25 bp, Mus musculus
cctacctgaaccgagagatgaaaga

SEQ ID NO: 596882 - DNA, 25 bp, Mus musculus
cctacctggcgacaaacatgagcga

SEQ ID NO: 596883 - DNA, 25 bp, Mus musculus
cctacctggcgagaaacatgagcga

SEQ ID NO: 596884 - DNA, 25 bp, Mus musculus
cctacctggctgaaacttgataaaa

SEQ ID NO: 596885 - DNA, 25 bp, Mus musculus
cctacctggctgtaacttgataaaa

SEQ ID NO: 596886 - DNA, 25 bp, Mus musculus
cctacctgggctatacttctaactg

SEQ ID NO: 596887 - DNA, 25 bp, Mus musculus
cctacctgggctttacttctaactg

SEQ ID NO: 596888 - DNA, 25 bp, Mus musculus
cctacctgtgaaagtaagtcacaca

SEQ ID NO: 596889 - DNA, 25 bp, Mus musculus
cctacctgtgaatgtaagtcacaca

SEQ ID NO: 596890 - DNA, 25 bp, Mus musculus
cctaccttgctgctatgagtacaag

SEQ ID NO: 596891 - DNA, 25 bp, Mus musculus
cctaccttgctggtatgagtacaag

SEQ ID NO: 596892 - DNA, 25 bp, Mus musculus
cctacctttggactcataaactgaa

SEQ ID NO: 596893 - DNA, 25 bp, Mus musculus
cctacctttggagtcataaactgaa

SEQ ID NO: 596894 - DNA, 25 bp, Mus musculus
cctacgaaccacactgtgagtgatg

SEQ ID NO: 596895 - DNA, 25 bp, Mus musculus
cctacgaaccactctgtgagtgatg

SEQ ID NO: 596896 - DNA, 25 bp, Mus musculus
cctacgaagtaccaacttctcctgt

SEQ ID NO: 596897 - DNA, 25 bp, Mus musculus
cctacgaagtacgaacttctcctgt

SEQ ID NO: 596898 - DNA, 25 bp, Mus musculus
cctacgacagggacaactctgggat

SEQ ID NO: 596899 - DNA, 25 bp, Mus musculus
cctacgacagggtcaactctgggat

SEQ ID NO: 596900 - DNA, 25 bp, Mus musculus
cctacgagacaaccggattgagcag

SEQ ID NO: 596901 - DNA, 25 bp, Mus musculus
cctacgagacaagcggattgagcag

SEQ ID NO: 596902 - DNA, 25 bp, Mus musculus
cctacgaggacgcagctgaagagtt

SEQ ID NO: 596903 - DNA, 25 bp, Mus musculus
cctacgaggacggagctgaagagtt

SEQ ID NO: 596904 - DNA, 25 bp, Mus musculus
cctacgcagataactttagttgatg

SEQ ID NO: 596905 - DNA, 25 bp, Mus musculus
cctacgcagatatctttagttgatg

SEQ ID NO: 596906 - DNA, 25 bp, Mus musculus
cctacgccaccaaaggagctggtgt

SEQ ID NO: 596907 - DNA, 25 bp, Mus musculus
cctacgccaccataggagctggtgt

SEQ ID NO: 596908 - DNA, 25 bp, Mus musculus
cctacggaggcacctggaagttcct

SEQ ID NO: 596909 - DNA, 25 bp, Mus musculus
cctacggaggcagctggaagttcct

SEQ ID NO: 596910 - DNA, 25 bp, Mus musculus
cctacgggctctcggccgaggtcaa

SEQ ID NO: 596911 - DNA, 25 bp, Mus musculus
cctacgggctctgggccgaggtcaa

SEQ ID NO: 596912 - DNA, 25 bp, Mus musculus
cctacgtgagcaagctggattagct

SEQ ID NO: 596913 - DNA, 25 bp, Mus musculus
cctacgtgagcatgctggattagct

SEQ ID NO: 596914 - DNA, 25 bp, Mus musculus
cctacgtgcagccagagaacctcta

SEQ ID NO: 596915 - DNA, 25 bp, Mus musculus
cctacgtgcagcgagagaacctcta

SEQ ID NO: 596916 - DNA, 25 bp, Mus musculus
cctacgtggtctacgagaacatgaa

SEQ ID NO: 596917 - DNA, 25 bp, Mus musculus
cctacgtggtcttcgagaacatgaa

SEQ ID NO: 596918 - DNA, 25 bp, Mus musculus
cctacgttgggcatgggactgatgc

SEQ ID NO: 596919 - DNA, 25 bp, Mus musculus
cctacgttgggcttgggactgatgc

SEQ ID NO: 596920 - DNA, 25 bp, Mus musculus
cctactaagcctaaagagcataaag

SEQ ID NO: 596921 - DNA, 25 bp, Mus musculus
cctactaagccttaagagcataaag

SEQ ID NO: 596922 - DNA, 25 bp, Mus musculus
cctactaagtgtccaataacaacca

SEQ ID NO: 596923 - DNA, 25 bp, Mus musculus
cctactaagtgtgcaataacaacca

SEQ ID NO: 596924 - DNA, 25 bp, Mus musculus
cctactacagttaggctatgggagt

SEQ ID NO: 596925 - DNA, 25 bp, Mus musculus
cctactacagtttggctatgggagt

SEQ ID NO: 596926 - DNA, 25 bp, Mus musculus
cctactacggtcacgtgcggctgtg

SEQ ID NO: 596927 - DNA, 25 bp, Mus musculus
cctactacggtctcgtgcggctgtg

SEQ ID NO: 596928 - DNA, 25 bp, Mus musculus
cctactatatgcacctggaacggga

SEQ ID NO: 596929 - DNA, 25 bp, Mus musculus
cctactatatgctcctggaacggga

SEQ ID NO: 596930 - DNA, 25 bp, Mus musculus
cctactatcgcgcagctatgggttt

SEQ ID NO: 596931 - DNA, 25 bp, Mus musculus
cctactatcgcggagctatgggttt

SEQ ID NO: 596932 - DNA, 25 bp, Mus musculus
cctactattacaccgggattggtgc

SEQ ID NO: 596933 - DNA, 25 bp, Mus musculus
cctactattacagcgggattggtgc

SEQ ID NO: 596934 - DNA, 25 bp, Mus musculus
cctactattgcacataaggccatga

SEQ ID NO: 596935 - DNA, 25 bp, Mus musculus
cctactattgcagataaggccatga

SEQ ID NO: 596936 - DNA, 25 bp, Mus musculus
cctactcactgtacagaagggagct

SEQ ID NO: 596937 - DNA, 25 bp, Mus musculus
cctactcactgttcagaagggagct

SEQ ID NO: 596938 - DNA, 25 bp, Mus musculus
cctactcagatcctgtggccgtgga

SEQ ID NO: 596939 - DNA, 25 bp, Mus musculus
cctactcagatcgtgtggccgtgga

SEQ ID NO: 596940 - DNA, 25 bp, Mus musculus
cctactcatgtccaacgatctgcga

SEQ ID NO: 596941 - DNA, 25 bp, Mus musculus
cctactcatgtcgaacgatctgcga

SEQ ID NO: 596942 - DNA, 25 bp, Mus musculus
cctactccagggacttcaaagtcag

SEQ ID NO: 596943 - DNA, 25 bp, Mus musculus
cctactccagggtcttcaaagtcag

SEQ ID NO: 596944 - DNA, 25 bp, Mus musculus
cctactcggataccatctgtaaaaa

SEQ ID NO: 596945 - DNA, 25 bp, Mus musculus
cctactcggatagcatctgtaaaaa

SEQ ID NO: 596946 - DNA, 25 bp, Mus musculus
cctactcggcttctagtcaggcatt

SEQ ID NO: 596947 - DNA, 25 bp, Mus musculus
cctactcggcttgtagtcaggcatt

SEQ ID NO: 596948 - DNA, 25 bp, Mus musculus
cctactctaacgaggcagacatcct

SEQ ID NO: 596949 - DNA, 25 bp, Mus musculus
cctactctaacgtggcagacatcct

SEQ ID NO: 596950 - DNA, 25 bp, Mus musculus
cctactctacagaggcaagctcttg

SEQ ID NO: 596951 - DNA, 25 bp, Mus musculus
cctactctacagtggcaagctcttg

SEQ ID NO: 596952 - DNA, 25 bp, Mus musculus
cctactctcaggcagcgctatggtt

SEQ ID NO: 596953 - DNA, 25 bp, Mus musculus
cctactctcagggagcgctatggtt

SEQ ID NO: 596954 - DNA, 25 bp, Mus musculus
cctactctggatccctttgacctgg

SEQ ID NO: 596955 - DNA, 25 bp, Mus musculus
cctactctggatgcctttgacctgg

SEQ ID NO: 596956 - DNA, 25 bp, Mus musculus
cctactctgtccaggctgaaaggtg

SEQ ID NO: 596957 - DNA, 25 bp, Mus musculus
cctactctgtcctggctgaaaggtg

SEQ ID NO: 596958 - DNA, 25 bp, Mus musculus
cctactgaccaacgattaagcctga

SEQ ID NO: 596959 - DNA, 25 bp, Mus musculus
cctactgaccaaggattaagcctga

SEQ ID NO: 596960 - DNA, 25 bp, Mus musculus
cctactgagcttcaagggaacatca

SEQ ID NO: 596961 - DNA, 25 bp, Mus musculus
cctactgagcttgaagggaacatca

SEQ ID NO: 596962 - DNA, 25 bp, Mus musculus
cctactgatgacattgctcatgaaa

SEQ ID NO: 596963 - DNA, 25 bp, Mus musculus
cctactgatgactttgctcatgaaa

SEQ ID NO: 596964 - DNA, 25 bp, Mus musculus
cctactgattctatggtggactatc

SEQ ID NO: 596965 - DNA, 25 bp, Mus musculus
cctactgattctttggtggactatc

SEQ ID NO: 596966 - DNA, 25 bp, Mus musculus
cctactgcaagtccctctggatcag

SEQ ID NO: 596967 - DNA, 25 bp, Mus musculus
cctactgcaagtgcctctggatcag

SEQ ID NO: 596968 - DNA, 25 bp, Mus musculus
cctactgcagaacagacattggaac

SEQ ID NO: 596969 - DNA, 25 bp, Mus musculus
cctactgcagaagagacattggaac

SEQ ID NO: 596970 - DNA, 25 bp, Mus musculus
cctactgctattatggctttcctgg

SEQ ID NO: 596971 - DNA, 25 bp, Mus musculus
cctactgctattttggctttcctgg

SEQ ID NO: 596972 - DNA, 25 bp, Mus musculus
cctactgctcatcagggaggttgac

SEQ ID NO: 596973 - DNA, 25 bp, Mus musculus
cctactgctcatgagggaggttgac

SEQ ID NO: 596974 - DNA, 25 bp, Mus musculus
cctactgctgcgacaactgtgggaa

SEQ ID NO: 596975 - DNA, 25 bp, Mus musculus
cctactgctgcgtcaactgtgggaa

SEQ ID NO: 596976 - DNA, 25 bp, Mus musculus
cctactgggacaagaacgagcagga

SEQ ID NO: 596977 - DNA, 25 bp, Mus musculus
cctactgggacatgaacgagcagga

SEQ ID NO: 596978 - DNA, 25 bp, Mus musculus
cctactgggccacacggacgtggct

SEQ ID NO: 596979 - DNA, 25 bp, Mus musculus
cctactgggccagacggacgtggct

SEQ ID NO: 596980 - DNA, 25 bp, Mus musculus
cctactggtttaatagctgctgaga

SEQ ID NO: 596981 - DNA, 25 bp, Mus musculus
cctactggtttattagctgctgaga

SEQ ID NO: 596982 - DNA, 25 bp, Mus musculus
cctactgtcaacacattagattggg

SEQ ID NO: 596983 - DNA, 25 bp, Mus musculus
cctactgtcaactcattagattggg

SEQ ID NO: 596984 - DNA, 25 bp, Mus musculus
cctactgtgcccaatggagaattca

SEQ ID NO: 596985 - DNA, 25 bp, Mus musculus
cctactgtgccctatggagaattca

SEQ ID NO: 596986 - DNA, 25 bp, Mus musculus
cctactgtgcgcagagaggaatgca

SEQ ID NO: 596987 - DNA, 25 bp, Mus musculus
cctactgtgcgctgagaggaatgca

SEQ ID NO: 596988 - DNA, 25 bp, Mus musculus
cctacttcaacgaggccttcgtctt

SEQ ID NO: 596989 - DNA, 25 bp, Mus musculus
cctacttcaacgtggccttcgtctt

SEQ ID NO: 596990 - DNA, 25 bp, Mus musculus
cctacttgaaagagaagagctgtgt

SEQ ID NO: 596991 - DNA, 25 bp, Mus musculus
cctacttgaaagtgaagagctgtgt

SEQ ID NO: 596992 - DNA, 25 bp, Mus musculus
cctacttgcatgagagggaggcctt

SEQ ID NO: 596993 - DNA, 25 bp, Mus musculus
cctacttgcatgtgagggaggcctt

SEQ ID NO: 596994 - DNA, 25 bp, Mus musculus
cctacttgcattatctataaggact

SEQ ID NO: 596995 - DNA, 25 bp, Mus musculus
cctacttgcattttctataaggact

SEQ ID NO: 596996 - DNA, 25 bp, Mus musculus
cctacttgggcaacacagatgtgag

SEQ ID NO: 596997 - DNA, 25 bp, Mus musculus
cctacttgggcatcacagatgtgag

SEQ ID NO: 596998 - DNA, 25 bp, Mus musculus
cctacttggtggacagcttgtggga

SEQ ID NO: 596999 - DNA, 25 bp, Mus musculus
cctacttggtggtcagcttgtggga

SEQ ID NO: 597000 - DNA, 25 bp, Mus musculus
cctactttggatcccaatgaccctg

SEQ ID NO: 597001 - DNA, 25 bp, Mus musculus
cctactttggatgccaatgaccctg

SEQ ID NO: 597002 - DNA, 25 bp, Mus musculus
cctactttggtgaaagtgactcgcc

SEQ ID NO: 597003 - DNA, 25 bp, Mus musculus
cctactttggtgtaagtgactcgcc

SEQ ID NO: 597004 - DNA, 25 bp, Mus musculus
cctagaaaagtgcagctgtctgagt

SEQ ID NO: 597005 - DNA, 25 bp, Mus musculus
cctagaaaagtggagctgtctgagt

SEQ ID NO: 597006 - DNA, 25 bp, Mus musculus
cctagaaacgccatatcgggcgagg

SEQ ID NO: 597007 - DNA, 25 bp, Mus musculus
cctagaaacgccttatcgggcgagg

SEQ ID NO: 597008 - DNA, 25 bp, Mus musculus
cctagaaaggatccaagagaagatc

SEQ ID NO: 597009 - DNA, 25 bp, Mus musculus
cctagaaaggatgcaagagaagatc

SEQ ID NO: 597010 - DNA, 25 bp, Mus musculus
cctagaaatttcacaccagtggtat

SEQ ID NO: 597011 - DNA, 25 bp, Mus musculus
cctagaaatttctcaccagtggtat

SEQ ID NO: 597012 - DNA, 25 bp, Mus musculus
cctagaacatgtcttggtaatggaa

SEQ ID NO: 597013 - DNA, 25 bp, Mus musculus
cctagaacatgtgttggtaatggaa

SEQ ID NO: 597014 - DNA, 25 bp, Mus musculus
cctagaactgcgcttcagccgagcg

SEQ ID NO: 597015 - DNA, 25 bp, Mus musculus
cctagaactgcggttcagccgagcg

SEQ ID NO: 597016 - DNA, 25 bp, Mus musculus
cctagaaggcttctagcattatttg

SEQ ID NO: 597017 - DNA, 25 bp, Mus musculus
cctagaaggcttgtagcattatttg

SEQ ID NO: 597018 - DNA, 25 bp, Mus musculus
cctagaaggtgaaattgggagagat

SEQ ID NO: 597019 - DNA, 25 bp, Mus musculus
cctagaaggtgatattgggagagat

SEQ ID NO: 597020 - DNA, 25 bp, Mus musculus
cctagaatcataactgaaggatttg

SEQ ID NO: 597021 - DNA, 25 bp, Mus musculus
cctagaatcatatctgaaggatttg

SEQ ID NO: 597022 - DNA, 25 bp, Mus musculus
cctagaatggatcttcggaaggaaa

SEQ ID NO: 597023 - DNA, 25 bp, Mus musculus
cctagaatggatgttcggaaggaaa

SEQ ID NO: 597024 - DNA, 25 bp, Mus musculus
cctagaatgtgaagggaccatctgt

SEQ ID NO: 597025 - DNA, 25 bp, Mus musculus
cctagaatgtgatgggaccatctgt

SEQ ID NO: 597026 - DNA, 25 bp, Mus musculus
cctagacaacaacattgagcaggcc

SEQ ID NO: 597027 - DNA, 25 bp, Mus musculus
cctagacaacaagattgagcaggcc

SEQ ID NO: 597028 - DNA, 25 bp, Mus musculus
cctagacagaagacaggaaggacag

SEQ ID NO: 597029 - DNA, 25 bp, Mus musculus
cctagacagaagtcaggaaggacag

SEQ ID NO: 597030 - DNA, 25 bp, Mus musculus
cctagacagatgcagaggcgtatcc

SEQ ID NO: 597031 - DNA, 25 bp, Mus musculus
cctagacagatggagaggcgtatcc

SEQ ID NO: 597032 - DNA, 25 bp, Mus musculus
cctagacctagcctgtgaatttggg

SEQ ID NO: 597033 - DNA, 25 bp, Mus musculus
cctagacctagcgtgtgaatttggg

SEQ ID NO: 597034 - DNA, 25 bp, Mus musculus
cctagacgatgacagagaagatctt

SEQ ID NO: 597035 - DNA, 25 bp, Mus musculus
cctagacgatgagagagaagatctt

SEQ ID NO: 597036 - DNA, 25 bp, Mus musculus
cctagacggtgtcattacacggagt

SEQ ID NO: 597037 - DNA, 25 bp, Mus musculus
cctagacggtgtgattacacggagt

SEQ ID NO: 597038 - DNA, 25 bp, Mus musculus
cctagactggctaaaaaatgcaata

SEQ ID NO: 597039 - DNA, 25 bp, Mus musculus
cctagactggcttaaaaatgcaata

SEQ ID NO: 597040 - DNA, 25 bp, Mus musculus
cctagagaaactctctggtgttggg

SEQ ID NO: 597041 - DNA, 25 bp, Mus musculus
cctagagaaactgtctggtgttggg

SEQ ID NO: 597042 - DNA, 25 bp, Mus musculus
cctagagaacgtagccacaaggctc

SEQ ID NO: 597043 - DNA, 25 bp, Mus musculus
cctagagaacgttgccacaaggctc

SEQ ID NO: 597044 - DNA, 25 bp, Mus musculus
cctagagaagttaagactgaaagaa

SEQ ID NO: 597045 - DNA, 25 bp, Mus musculus
cctagagaagtttagactgaaagaa

SEQ ID NO: 597046 - DNA, 25 bp, Mus musculus
cctagagacagtcttcttccacaag

SEQ ID NO: 597047 - DNA, 25 bp, Mus musculus
cctagagacagtgttcttccacaag

SEQ ID NO: 597048 - DNA, 25 bp, Mus musculus
cctagagaggtgattcattcaagaa

SEQ ID NO: 597049 - DNA, 25 bp, Mus musculus
cctagagaggtgtttcattcaagaa

SEQ ID NO: 597050 - DNA, 25 bp, Mus musculus
cctagagcagatcaatgaggatgac

SEQ ID NO: 597051 - DNA, 25 bp, Mus musculus
cctagagcagatgaatgaggatgac

SEQ ID NO: 597052 - DNA, 25 bp, Mus musculus
cctagaggagacactccactcaaag

SEQ ID NO: 597053 - DNA, 25 bp, Mus musculus
cctagaggagactctccactcaaag

SEQ ID NO: 597054 - DNA, 25 bp, Mus musculus
cctagaggagctaaagaaactgttc

SEQ ID NO: 597055 - DNA, 25 bp, Mus musculus
cctagaggagcttaagaaactgttc

SEQ ID NO: 597056 - DNA, 25 bp, Mus musculus
cctagaggaggcagtaagcatgcat

SEQ ID NO: 597057 - DNA, 25 bp, Mus musculus
cctagaggaggctgtaagcatgcat

SEQ ID NO: 597058 - DNA, 25 bp, Mus musculus
cctagaggcactcaaggaggatgct

SEQ ID NO: 597059 - DNA, 25 bp, Mus musculus
cctagaggcactgaaggaggatgct

SEQ ID NO: 597060 - DNA, 25 bp, Mus musculus
cctagaggccacctatggagagtac

SEQ ID NO: 597061 - DNA, 25 bp, Mus musculus
cctagaggccacgtatggagagtac

SEQ ID NO: 597062 - DNA, 25 bp, Mus musculus
cctagaggccccatgcaagagaagg

SEQ ID NO: 597063 - DNA, 25 bp, Mus musculus
cctagaggccccttgcaagagaagg

SEQ ID NO: 597064 - DNA, 25 bp, Mus musculus
cctagaggccttcggacttcacatc

SEQ ID NO: 597065 - DNA, 25 bp, Mus musculus
cctagaggccttgggacttcacatc

SEQ ID NO: 597066 - DNA, 25 bp, Mus musculus
cctagaggtgcgagccgcgccataa

SEQ ID NO: 597067 - DNA, 25 bp, Mus musculus
cctagaggtgcgtgccgcgccataa

SEQ ID NO: 597068 - DNA, 25 bp, Mus musculus
cctagagtgtgaaatcagagaagcg

SEQ ID NO: 597069 - DNA, 25 bp, Mus musculus
cctagagtgtgatatcagagaagcg

SEQ ID NO: 597070 - DNA, 25 bp, Mus musculus
cctagatcctgtattgcgcaagtgt

SEQ ID NO: 597071 - DNA, 25 bp, Mus musculus
cctagatcctgttttgcgcaagtgt

SEQ ID NO: 597072 - DNA, 25 bp, Mus musculus
cctagatcgggtcgactttgtaaag

SEQ ID NO: 597073 - DNA, 25 bp, Mus musculus
cctagatcgggtggactttgtaaag

SEQ ID NO: 597074 - DNA, 25 bp, Mus musculus
cctagatgctagaggattgaggcag

SEQ ID NO: 597075 - DNA, 25 bp, Mus musculus
cctagatgctagtggattgaggcag

SEQ ID NO: 597076 - DNA, 25 bp, Mus musculus
cctagatgggatacatgctttgatg

SEQ ID NO: 597077 - DNA, 25 bp, Mus musculus
cctagatgggattcatgctttgatg

SEQ ID NO: 597078 - DNA, 25 bp, Mus musculus
cctagatgtccacgacagtgatgca

SEQ ID NO: 597079 - DNA, 25 bp, Mus musculus
cctagatgtccaggacagtgatgca

SEQ ID NO: 597080 - DNA, 25 bp, Mus musculus
cctagattaagcagttcccctgcct

SEQ ID NO: 597081 - DNA, 25 bp, Mus musculus
cctagattaagctgttcccctgcct

SEQ ID NO: 597082 - DNA, 25 bp, Mus musculus
cctagattgggcagtaaacctgata

SEQ ID NO: 597083 - DNA, 25 bp, Mus musculus
cctagattgggctgtaaacctgata

SEQ ID NO: 597084 - DNA, 25 bp, Mus musculus
cctagcaaactcagtgagaaacttg

SEQ ID NO: 597085 - DNA, 25 bp, Mus musculus
cctagcaaactctgtgagaaacttg

SEQ ID NO: 597086 - DNA, 25 bp, Mus musculus
cctagcaagcacacccgtgattgtg

SEQ ID NO: 597087 - DNA, 25 bp, Mus musculus
cctagcaagcactcccgtgattgtg

SEQ ID NO: 597088 - DNA, 25 bp, Mus musculus
cctagcaagtgaaggccaactccct

SEQ ID NO: 597089 - DNA, 25 bp, Mus musculus
cctagcaagtgatggccaactccct

SEQ ID NO: 597090 - DNA, 25 bp, Mus musculus
cctagcacgttcacacagtattgtc

SEQ ID NO: 597091 - DNA, 25 bp, Mus musculus
cctagcacgttctcacagtattgtc

SEQ ID NO: 597092 - DNA, 25 bp, Mus musculus
cctagcactcaccaagtggaaacag

SEQ ID NO: 597093 - DNA, 25 bp, Mus musculus
cctagcactcacgaagtggaaacag

SEQ ID NO: 597094 - DNA, 25 bp, Mus musculus
cctagcagagtacggagacaccaat

SEQ ID NO: 597095 - DNA, 25 bp, Mus musculus
cctagcagagtagggagacaccaat

SEQ ID NO: 597096 - DNA, 25 bp, Mus musculus
cctagcagcaccagggagaagagcg

SEQ ID NO: 597097 - DNA, 25 bp, Mus musculus
cctagcagcacctgggagaagagcg

SEQ ID NO: 597098 - DNA, 25 bp, Mus musculus
cctagcaggagaacaagaagattgt

SEQ ID NO: 597099 - DNA, 25 bp, Mus musculus
cctagcaggagatcaagaagattgt

SEQ ID NO: 597100 - DNA, 25 bp, Mus musculus
cctagcatctgcagggcgagtacgg

SEQ ID NO: 597101 - DNA, 25 bp, Mus musculus
cctagcatctgctgggcgagtacgg

SEQ ID NO: 597102 - DNA, 25 bp, Mus musculus
cctagcatgtcacttcgaggtggag

SEQ ID NO: 597103 - DNA, 25 bp, Mus musculus
cctagcatgtcagttcgaggtggag

SEQ ID NO: 597104 - DNA, 25 bp, Mus musculus
cctagccagatacagcctcagagct

SEQ ID NO: 597105 - DNA, 25 bp, Mus musculus
cctagccagatagagcctcagagct

SEQ ID NO: 597106 - DNA, 25 bp, Mus musculus
cctagcccgggaagagaaattgcaa

SEQ ID NO: 597107 - DNA, 25 bp, Mus musculus
cctagcccgggatgagaaattgcaa

SEQ ID NO: 597108 - DNA, 25 bp, Mus musculus
cctagccctggaactgctcaaggat

SEQ ID NO: 597109 - DNA, 25 bp, Mus musculus
cctagccctggatctgctcaaggat

SEQ ID NO: 597110 - DNA, 25 bp, Mus musculus
cctagccgccttactgaccgtggaa

SEQ ID NO: 597111 - DNA, 25 bp, Mus musculus
cctagccgcctttctgaccgtggaa

SEQ ID NO: 597112 - DNA, 25 bp, Mus musculus
cctagccggcggcttctcattactg

SEQ ID NO: 597113 - DNA, 25 bp, Mus musculus
cctagccggcgggttctcattactg

SEQ ID NO: 597114 - DNA, 25 bp, Mus musculus
cctagcctagctaggagagtgacct

SEQ ID NO: 597115 - DNA, 25 bp, Mus musculus
cctagcctagcttggagagtgacct

SEQ ID NO: 597116 - DNA, 25 bp, Mus musculus
cctagcctgggaccatgatcgtgga

SEQ ID NO: 597117 - DNA, 25 bp, Mus musculus
cctagcctgggagcatgatcgtgga

SEQ ID NO: 597118 - DNA, 25 bp, Mus musculus
cctagcctgtgaatttgggcggctc

SEQ ID NO: 597119 - DNA, 25 bp, Mus musculus
cctagcctgtgattttgggcggctc

SEQ ID NO: 597120 - DNA, 25 bp, Mus musculus
cctagccttggtcgcctattaccaa

SEQ ID NO: 597121 - DNA, 25 bp, Mus musculus
cctagccttggtggcctattaccaa

SEQ ID NO: 597122 - DNA, 25 bp, Mus musculus
cctagcgaaggtagcggtagactcg

SEQ ID NO: 597123 - DNA, 25 bp, Mus musculus
cctagcgaaggttgcggtagactcg

SEQ ID NO: 597124 - DNA, 25 bp, Mus musculus
cctagcgaggaacgtgcaatgcttg

SEQ ID NO: 597125 - DNA, 25 bp, Mus musculus
cctagcgaggaaggtgcaatgcttg

SEQ ID NO: 597126 - DNA, 25 bp, Mus musculus
cctagcggacggacgtccggcttcg

SEQ ID NO: 597127 - DNA, 25 bp, Mus musculus
cctagcggacggtcgtccggcttcg

SEQ ID NO: 597128 - DNA, 25 bp, Mus musculus
cctagcggcgacatggatgctgccg

SEQ ID NO: 597129 - DNA, 25 bp, Mus musculus
cctagcggcgacttggatgctgccg

SEQ ID NO: 597130 - DNA, 25 bp, Mus musculus
cctagcgggcggctcttagctttgt

SEQ ID NO: 597131 - DNA, 25 bp, Mus musculus
cctagcgggcgggtcttagctttgt

SEQ ID NO: 597132 - DNA, 25 bp, Mus musculus
cctagctacattcgagactccactg

SEQ ID NO: 597133 - DNA, 25 bp, Mus musculus
cctagctacattggagactccactg

SEQ ID NO: 597134 - DNA, 25 bp, Mus musculus
cctagctacctgcaacagtaattca

SEQ ID NO: 597135 - DNA, 25 bp, Mus musculus
cctagctacctggaacagtaattca

SEQ ID NO: 597136 - DNA, 25 bp, Mus musculus
cctagctctacactaaagggcaggt

SEQ ID NO: 597137 - DNA, 25 bp, Mus musculus
cctagctctacagtaaagggcaggt

SEQ ID NO: 597138 - DNA, 25 bp, Mus musculus
cctagctctgcaatcttgaccacgt

SEQ ID NO: 597139 - DNA, 25 bp, Mus musculus
cctagctctgcattcttgaccacgt

SEQ ID NO: 597140 - DNA, 25 bp, Mus musculus
cctagctctttgaggcgtcggaaag

SEQ ID NO: 597141 - DNA, 25 bp, Mus musculus
cctagctctttgtggcgtcggaaag

SEQ ID NO: 597142 - DNA, 25 bp, Mus musculus
cctagctgccgcatttgtgccgcag

SEQ ID NO: 597143 - DNA, 25 bp, Mus musculus
cctagctgccgcttttgtgccgcag

SEQ ID NO: 597144 - DNA, 25 bp, Mus musculus
cctagctgcgtaagaggctggaagc

SEQ ID NO: 597145 - DNA, 25 bp, Mus musculus
cctagctgcgtatgaggctggaagc

SEQ ID NO: 597146 - DNA, 25 bp, Mus musculus
cctagcttcaggatcccatggatgc

SEQ ID NO: 597147 - DNA, 25 bp, Mus musculus
cctagcttcaggttcccatggatgc

SEQ ID NO: 597148 - DNA, 25 bp, Mus musculus
cctagcttgtttagcagaaacagga

SEQ ID NO: 597149 - DNA, 25 bp, Mus musculus
cctagcttgttttgcagaaacagga

SEQ ID NO: 597150 - DNA, 25 bp, Mus musculus
cctagctttgatcgacgactgaaag

SEQ ID NO: 597151 - DNA, 25 bp, Mus musculus
cctagctttgatggacgactgaaag

SEQ ID NO: 597152 - DNA, 25 bp, Mus musculus
cctaggaaccagaggttgtgtcggc

SEQ ID NO: 597153 - DNA, 25 bp, Mus musculus
cctaggaaccagtggttgtgtcggc

SEQ ID NO: 597154 - DNA, 25 bp, Mus musculus
cctaggactcctagagctggcagct

SEQ ID NO: 597155 - DNA, 25 bp, Mus musculus
cctaggactccttgagctggcagct

SEQ ID NO: 597156 - DNA, 25 bp, Mus musculus
cctaggactgagagatctacaagac

SEQ ID NO: 597157 - DNA, 25 bp, Mus musculus
cctaggactgagtgatctacaagac

SEQ ID NO: 597158 - DNA, 25 bp, Mus musculus
cctaggacttcgcacatcggagcgg

SEQ ID NO: 597159 - DNA, 25 bp, Mus musculus
cctaggacttcggacatcggagcgg

SEQ ID NO: 597160 - DNA, 25 bp, Mus musculus
cctaggagggcaagataactggacg

SEQ ID NO: 597161 - DNA, 25 bp, Mus musculus
cctaggagggcatgataactggacg

SEQ ID NO: 597162 - DNA, 25 bp, Mus musculus
cctaggagtgtcattgagtactgcc

SEQ ID NO: 597163 - DNA, 25 bp, Mus musculus
cctaggagtgtctttgagtactgcc

SEQ ID NO: 597164 - DNA, 25 bp, Mus musculus
cctaggatagcaatcctgccttacg

SEQ ID NO: 597165 - DNA, 25 bp, Mus musculus
cctaggatagcattcctgccttacg

SEQ ID NO: 597166 - DNA, 25 bp, Mus musculus
cctaggatgcagagagacgggaaca

SEQ ID NO: 597167 - DNA, 25 bp, Mus musculus
cctaggatgcagtgagacgggaaca

SEQ ID NO: 597168 - DNA, 25 bp, Mus musculus
cctaggcacaagagtgacgtggaga

SEQ ID NO: 597169 - DNA, 25 bp, Mus musculus
cctaggcacaagtgtgacgtggaga

SEQ ID NO: 597170 - DNA, 25 bp, Mus musculus
cctaggcagctacgagccagagttc

SEQ ID NO: 597171 - DNA, 25 bp, Mus musculus
cctaggcagctaggagccagagttc

SEQ ID NO: 597172 - DNA, 25 bp, Mus musculus
cctaggcctagcagccgcttttgtg

SEQ ID NO: 597173 - DNA, 25 bp, Mus musculus
cctaggcctagctgccgcttttgtg

SEQ ID NO: 597174 - DNA, 25 bp, Mus musculus
cctaggcgataaagtctctcaagat

SEQ ID NO: 597175 - DNA, 25 bp, Mus musculus
cctaggcgataatgtctctcaagat

SEQ ID NO: 597176 - DNA, 25 bp, Mus musculus
cctaggctgcaactcaccatgtgag

SEQ ID NO: 597177 - DNA, 25 bp, Mus musculus
cctaggctgcaagtcaccatgtgag

SEQ ID NO: 597178 - DNA, 25 bp, Mus musculus
cctaggctggctcactagagtcacc

SEQ ID NO: 597179 - DNA, 25 bp, Mus musculus
cctaggctggctgactagagtcacc

SEQ ID NO: 597180 - DNA, 25 bp, Mus musculus
cctaggctgtgacgtgcatgaagac

SEQ ID NO: 597181 - DNA, 25 bp, Mus musculus
cctaggctgtgaggtgcatgaagac

SEQ ID NO: 597182 - DNA, 25 bp, Mus musculus
cctaggctgtgtcctgcccagtctt

SEQ ID NO: 597183 - DNA, 25 bp, Mus musculus
cctaggctgtgtcctttatgccatg

SEQ ID NO: 597184 - DNA, 25 bp, Mus musculus
cctaggctgtgtgctgcccagtctt

SEQ ID NO: 597185 - DNA, 25 bp, Mus musculus
cctaggctgtgtgctttatgccatg

SEQ ID NO: 597186 - DNA, 25 bp, Mus musculus
cctagggagtctagaatggaggcca

SEQ ID NO: 597187 - DNA, 25 bp, Mus musculus
cctagggagtcttgaatggaggcca

SEQ ID NO: 597188 - DNA, 25 bp, Mus musculus
cctagggatgtgctcagtgccttgc

SEQ ID NO: 597189 - DNA, 25 bp, Mus musculus
cctagggatgtggtcagtgccttgc

SEQ ID NO: 597190 - DNA, 25 bp, Mus musculus
cctagggctccgctttgatggtgat

SEQ ID NO: 597191 - DNA, 25 bp, Mus musculus
cctagggctccggtttgatggtgat

SEQ ID NO: 597192 - DNA, 25 bp, Mus musculus
cctagggtagcaatttcagctgccc

SEQ ID NO: 597193 - DNA, 25 bp, Mus musculus
cctagggtagcattttcagctgccc

SEQ ID NO: 597194 - DNA, 25 bp, Mus musculus
cctagggtcctacagaacactcttc

SEQ ID NO: 597195 - DNA, 25 bp, Mus musculus
cctagggtcctagagaacactcttc

SEQ ID NO: 597196 - DNA, 25 bp, Mus musculus
cctagggtttctaccatgaggcctc

SEQ ID NO: 597197 - DNA, 25 bp, Mus musculus
cctagggtttctcaaatgcaagcac

SEQ ID NO: 597198 - DNA, 25 bp, Mus musculus
cctagggtttctgaaatgcaagcac

SEQ ID NO: 597199 - DNA, 25 bp, Mus musculus
cctagggtttcttccatgaggcctc

SEQ ID NO: 597200 - DNA, 25 bp, Mus musculus
cctagggtttgtctctgtctgggac

SEQ ID NO: 597201 - DNA, 25 bp, Mus musculus
cctagggtttgtgtctgtctgggac

SEQ ID NO: 597202 - DNA, 25 bp, Mus musculus
cctaggtaatatcgcatggtcgcag

SEQ ID NO: 597203 - DNA, 25 bp, Mus musculus
cctaggtaatatggcatggtcgcag

SEQ ID NO: 597204 - DNA, 25 bp, Mus musculus
cctaggtatgagacagggaaagacc

SEQ ID NO: 597205 - DNA, 25 bp, Mus musculus
cctaggtatgagtcagggaaagacc

SEQ ID NO: 597206 - DNA, 25 bp, Mus musculus
cctaggtctagacgagctgccaaaa

SEQ ID NO: 597207 - DNA, 25 bp, Mus musculus
cctaggtctagaggagctgccaaaa

SEQ ID NO: 597208 - DNA, 25 bp, Mus musculus
cctaggtctaggaattgctctggag

SEQ ID NO: 597209 - DNA, 25 bp, Mus musculus
cctaggtctaggtattgctctggag

SEQ ID NO: 597210 - DNA, 25 bp, Mus musculus
cctaggtcttacaagggtctagtat

SEQ ID NO: 597211 - DNA, 25 bp, Mus musculus
cctaggtcttactagggtctagtat

SEQ ID NO: 597212 - DNA, 25 bp, Mus musculus
cctaggtgccggacctaagaagtca

SEQ ID NO: 597213 - DNA, 25 bp, Mus musculus
cctaggtgccggtcctaagaagtca

SEQ ID NO: 597214 - DNA, 25 bp, Mus musculus
cctaggtgggcgacaggatgaaggc

SEQ ID NO: 597215 - DNA, 25 bp, Mus musculus
cctaggtgggcgtcaggatgaaggc

SEQ ID NO: 597216 - DNA, 25 bp, Mus musculus
cctaggttacatatatgtggatcgc

SEQ ID NO: 597217 - DNA, 25 bp, Mus musculus
cctaggttacatttatgtggatcgc

SEQ ID NO: 597218 - DNA, 25 bp, Mus musculus
cctagtaggaaacgattgtcactga

SEQ ID NO: 597219 - DNA, 25 bp, Mus musculus
cctagtaggaaaggattgtcactga

SEQ ID NO: 597220 - DNA, 25 bp, Mus musculus
cctagtaggtgaccccgatggacaa

SEQ ID NO: 597221 - DNA, 25 bp, Mus musculus
cctagtaggtgagcccgatggacaa

SEQ ID NO: 597222 - DNA, 25 bp, Mus musculus
cctagtatccttcgtctatctcaag

SEQ ID NO: 597223 - DNA, 25 bp, Mus musculus
cctagtatccttggtctatctcaag

SEQ ID NO: 597224 - DNA, 25 bp, Mus musculus
cctagtatggccaatgaagaagatg

SEQ ID NO: 597225 - DNA, 25 bp, Mus musculus
cctagtatggcctatgaagaagatg

SEQ ID NO: 597226 - DNA, 25 bp, Mus musculus
cctagtcaccatcattgtggctgca

SEQ ID NO: 597227 - DNA, 25 bp, Mus musculus
cctagtcaccatgattgtggctgca

SEQ ID NO: 597228 - DNA, 25 bp, Mus musculus
cctagtcaggaaacgagttggagac

SEQ ID NO: 597229 - DNA, 25 bp, Mus musculus
cctagtcaggaatcgagttggagac

SEQ ID NO: 597230 - DNA, 25 bp, Mus musculus
cctagtctctggcttactggaatta

SEQ ID NO: 597231 - DNA, 25 bp, Mus musculus
cctagtctctgggttactggaatta

SEQ ID NO: 597232 - DNA, 25 bp, Mus musculus
cctagtctggaacttcatcaacaga

SEQ ID NO: 597233 - DNA, 25 bp, Mus musculus
cctagtctggaagttcatcaacaga

SEQ ID NO: 597234 - DNA, 25 bp, Mus musculus
cctagtgactctacagctgttaacc

SEQ ID NO: 597235 - DNA, 25 bp, Mus musculus
cctagtgactcttcagctgttaacc

SEQ ID NO: 597236 - DNA, 25 bp, Mus musculus
cctagtgccctcaggcggtcatgta

SEQ ID NO: 597237 - DNA, 25 bp, Mus musculus
cctagtgccctctggcggtcatgta

SEQ ID NO: 597238 - DNA, 25 bp, Mus musculus
cctagtgcctatcagacccgtagct

SEQ ID NO: 597239 - DNA, 25 bp, Mus musculus
cctagtgcctatgagacccgtagct

SEQ ID NO: 597240 - DNA, 25 bp, Mus musculus
cctagtgcgatgacctccgaaagga

SEQ ID NO: 597241 - DNA, 25 bp, Mus musculus
cctagtgcgatgtcctccgaaagga

SEQ ID NO: 597242 - DNA, 25 bp, Mus musculus
cctagtgcgggacgcagcaaagcaa

SEQ ID NO: 597243 - DNA, 25 bp, Mus musculus
cctagtgcgggaggcagcaaagcaa

SEQ ID NO: 597244 - DNA, 25 bp, Mus musculus
cctagtgctggccagttacggcaga

SEQ ID NO: 597245 - DNA, 25 bp, Mus musculus
cctagtgctggcgagttacggcaga

SEQ ID NO: 597246 - DNA, 25 bp, Mus musculus
cctagtgcttggaaacaagagctga

SEQ ID NO: 597247 - DNA, 25 bp, Mus musculus
cctagtgcttggtaacaagagctga

SEQ ID NO: 597248 - DNA, 25 bp, Mus musculus
cctagtggagctcgtgcctcagtat

SEQ ID NO: 597249 - DNA, 25 bp, Mus musculus
cctagtggagctggtgcctcagtat

SEQ ID NO: 597250 - DNA, 25 bp, Mus musculus
cctagtggagggaatgtgcattgca

SEQ ID NO: 597251 - DNA, 25 bp, Mus musculus
cctagtggagggtatgtgcattgca

SEQ ID NO: 597252 - DNA, 25 bp, Mus musculus
cctagtgggtctagtcaatccagga

SEQ ID NO: 597253 - DNA, 25 bp, Mus musculus
cctagtgggtcttgtcaatccagga

SEQ ID NO: 597254 - DNA, 25 bp, Mus musculus
cctagtgtggagaaaggcctgctct

SEQ ID NO: 597255 - DNA, 25 bp, Mus musculus
cctagtgtggagtaaggcctgctct

SEQ ID NO: 597256 - DNA, 25 bp, Mus musculus
cctagtgtttgaccatatagaccag

SEQ ID NO: 597257 - DNA, 25 bp, Mus musculus
cctagtgtttgagcatatagaccag

SEQ ID NO: 597258 - DNA, 25 bp, Mus musculus
cctagttataggatatgagtgtgat

SEQ ID NO: 597259 - DNA, 25 bp, Mus musculus
cctagttataggttatgagtgtgat

SEQ ID NO: 597260 - DNA, 25 bp, Mus musculus
cctagttgaccactgcccaaaggag

SEQ ID NO: 597261 - DNA, 25 bp, Mus musculus
cctagttgaccagtgcccaaaggag

SEQ ID NO: 597262 - DNA, 25 bp, Mus musculus
cctagttgatcaactcaaagggaaa

SEQ ID NO: 597263 - DNA, 25 bp, Mus musculus
cctagttgatcatctcaaagggaaa

SEQ ID NO: 597264 - DNA, 25 bp, Mus musculus
cctataaaactcagtgcccaacttg

SEQ ID NO: 597265 - DNA, 25 bp, Mus musculus
cctataaaactctgtgcccaacttg

SEQ ID NO: 597266 - DNA, 25 bp, Mus musculus
cctataaatgaccaaaatcaagatg

SEQ ID NO: 597267 - DNA, 25 bp, Mus musculus
cctataaatgacgaaaatcaagatg

SEQ ID NO: 597268 - DNA, 25 bp, Mus musculus
cctataaggcccaggctgggaatgt

SEQ ID NO: 597269 - DNA, 25 bp, Mus musculus
cctataaggccctggctgggaatgt

SEQ ID NO: 597270 - DNA, 25 bp, Mus musculus
cctataagtattaatagaagccttc

SEQ ID NO: 597271 - DNA, 25 bp, Mus musculus
cctataagtatttatagaagccttc

SEQ ID NO: 597272 - DNA, 25 bp, Mus musculus
cctataattggaccggtctgggatc

SEQ ID NO: 597273 - DNA, 25 bp, Mus musculus
cctataattggagcggtctgggatc

SEQ ID NO: 597274 - DNA, 25 bp, Mus musculus
cctatacacacaatgccatggcaat

SEQ ID NO: 597275 - DNA, 25 bp, Mus musculus
cctatacacacattgccatggcaat

SEQ ID NO: 597276 - DNA, 25 bp, Mus musculus
cctatacagagcatacctcgcacag

SEQ ID NO: 597277 - DNA, 25 bp, Mus musculus
cctatacagagcttacctcgcacag

SEQ ID NO: 597278 - DNA, 25 bp, Mus musculus
cctataccagatcatgaagttcaac

SEQ ID NO: 597279 - DNA, 25 bp, Mus musculus
cctataccagatgatgaagttcaac

SEQ ID NO: 597280 - DNA, 25 bp, Mus musculus
cctatactgagcagctgcacaatga

SEQ ID NO: 597281 - DNA, 25 bp, Mus musculus
cctatactgagctgctgcacaatga

SEQ ID NO: 597282 - DNA, 25 bp, Mus musculus
cctatacttgcaacgtgtcagtgag

SEQ ID NO: 597283 - DNA, 25 bp, Mus musculus
cctatacttgcatcgtgtcagtgag

SEQ ID NO: 597284 - DNA, 25 bp, Mus musculus
cctatagagatcacatatcgagcga

SEQ ID NO: 597285 - DNA, 25 bp, Mus musculus
cctatagagatctcatatcgagcga

SEQ ID NO: 597286 - DNA, 25 bp, Mus musculus
cctatagcagatcaacagtggcagc

SEQ ID NO: 597287 - DNA, 25 bp, Mus musculus
cctatagcagatgaacagtggcagc

SEQ ID NO: 597288 - DNA, 25 bp, Mus musculus
cctatagcatttagtgggacttgaa

SEQ ID NO: 597289 - DNA, 25 bp, Mus musculus
cctatagcattttgtgggacttgaa

SEQ ID NO: 597290 - DNA, 25 bp, Mus musculus
cctatagcgcggatagtggaagaaa

SEQ ID NO: 597291 - DNA, 25 bp, Mus musculus
cctatagcgcggttagtggaagaaa

SEQ ID NO: 597292 - DNA, 25 bp, Mus musculus
cctatagtggtaagatccacttcat

SEQ ID NO: 597293 - DNA, 25 bp, Mus musculus
cctatagtggtatgatccacttcat

SEQ ID NO: 597294 - DNA, 25 bp, Mus musculus
cctatatccgtgaactctcgtgtct

SEQ ID NO: 597295 - DNA, 25 bp, Mus musculus
cctatatccgtgtactctcgtgtct

SEQ ID NO: 597296 - DNA, 25 bp, Mus musculus
cctatatgcgtcaagtgctagaggg

SEQ ID NO: 597297 - DNA, 25 bp, Mus musculus
cctatatgcgtctagtgctagaggg

SEQ ID NO: 597298 - DNA, 25 bp, Mus musculus
cctatatgcgtgctgtgtacttccg

SEQ ID NO: 597299 - DNA, 25 bp, Mus musculus
cctatatgcgtggtgtgtacttccg

SEQ ID NO: 597300 - DNA, 25 bp, Mus musculus
cctatatggacactggtgcagtgcc

SEQ ID NO: 597301 - DNA, 25 bp, Mus musculus
cctatatggacagtggtgcagtgcc

SEQ ID NO: 597302 - DNA, 25 bp, Mus musculus
cctatattcgtgacctcttctgcta

SEQ ID NO: 597303 - DNA, 25 bp, Mus musculus
cctatattcgtgtcctcttctgcta

SEQ ID NO: 597304 - DNA, 25 bp, Mus musculus
cctatcaccacacgaggtgttactt

SEQ ID NO: 597305 - DNA, 25 bp, Mus musculus
cctatcaccacaggaggtgttactt

SEQ ID NO: 597306 - DNA, 25 bp, Mus musculus
cctatcagaagtcggtccgggagca

SEQ ID NO: 597307 - DNA, 25 bp, Mus musculus
cctatcagaagtgggtccgggagca

SEQ ID NO: 597308 - DNA, 25 bp, Mus musculus
cctatcagacagaaggcccgcttca

SEQ ID NO: 597309 - DNA, 25 bp, Mus musculus
cctatcagacagagccgtggtttca

SEQ ID NO: 597310 - DNA, 25 bp, Mus musculus
cctatcagacagtaggcccgcttca

SEQ ID NO: 597311 - DNA, 25 bp, Mus musculus
cctatcagacagtgccgtggtttca

SEQ ID NO: 597312 - DNA, 25 bp, Mus musculus
cctatcagagccaagggtagctgct

SEQ ID NO: 597313 - DNA, 25 bp, Mus musculus
cctatcagagcctagggtagctgct

SEQ ID NO: 597314 - DNA, 25 bp, Mus musculus
cctatcatcgatcgtcgcaaggcca

SEQ ID NO: 597315 - DNA, 25 bp, Mus musculus
cctatcatcgatggtcgcaaggcca

SEQ ID NO: 597316 - DNA, 25 bp, Mus musculus
cctatccaacccagtggcagggctg

SEQ ID NO: 597317 - DNA, 25 bp, Mus musculus
cctatccaaccctgtggcagggctg

SEQ ID NO: 597318 - DNA, 25 bp, Mus musculus
cctatccagataacgcagttgccat

SEQ ID NO: 597319 - DNA, 25 bp, Mus musculus
cctatccagatatcgcagttgccat

SEQ ID NO: 597320 - DNA, 25 bp, Mus musculus
cctatcccatagatcctaaagagaa

SEQ ID NO: 597321 - DNA, 25 bp, Mus musculus
cctatcccatagttcctaaagagaa

SEQ ID NO: 597322 - DNA, 25 bp, Mus musculus
cctatccgtgatctaagaaagcctg

SEQ ID NO: 597323 - DNA, 25 bp, Mus musculus
cctatccgtgatgtaagaaagcctg

SEQ ID NO: 597324 - DNA, 25 bp, Mus musculus
cctatccgtgggacttcagagagag

SEQ ID NO: 597325 - DNA, 25 bp, Mus musculus
cctatccgtgggtcttcagagagag

SEQ ID NO: 597326 - DNA, 25 bp, Mus musculus
cctatcgctgcaatctctgtgggag

SEQ ID NO: 597327 - DNA, 25 bp, Mus musculus
cctatcgctgcattctctgtgggag

SEQ ID NO: 597328 - DNA, 25 bp, Mus musculus
cctatcgtgttccatggcaaactgt

SEQ ID NO: 597329 - DNA, 25 bp, Mus musculus
cctatcgtgttcgatggcaaactgt

SEQ ID NO: 597330 - DNA, 25 bp, Mus musculus
cctatcgttgtgacctaggccctca

SEQ ID NO: 597331 - DNA, 25 bp, Mus musculus
cctatcgttgtgtcctaggccctca

SEQ ID NO: 597332 - DNA, 25 bp, Mus musculus
cctatctaagatccgggcccatgtg

SEQ ID NO: 597333 - DNA, 25 bp, Mus musculus
cctatctaagatgcgggcccatgtg

SEQ ID NO: 597334 - DNA, 25 bp, Mus musculus
cctatgaaatcaagagggagcttga

SEQ ID NO: 597335 - DNA, 25 bp, Mus musculus
cctatgaaatcatgagggagcttga

SEQ ID NO: 597336 - DNA, 25 bp, Mus musculus
cctatgaacttcagcgcttggagga

SEQ ID NO: 597337 - DNA, 25 bp, Mus musculus
cctatgaacttctgcgcttggagga

SEQ ID NO: 597338 - DNA, 25 bp, Mus musculus
cctatgaagatactactgtggccga

SEQ ID NO: 597339 - DNA, 25 bp, Mus musculus
cctatgaagatagtactgtggccga

SEQ ID NO: 597340 - DNA, 25 bp, Mus musculus
cctatgaaggtgctgtagacttgaa

SEQ ID NO: 597341 - DNA, 25 bp, Mus musculus
cctatgaaggtggtgtagacttgaa

SEQ ID NO: 597342 - DNA, 25 bp, Mus musculus
cctatgacatggagcggtccctgtg

SEQ ID NO: 597343 - DNA, 25 bp, Mus musculus
cctatgacatggtgcggtccctgtg

SEQ ID NO: 597344 - DNA, 25 bp, Mus musculus
cctatgaccggcatctgtggaatgt

SEQ ID NO: 597345 - DNA, 25 bp, Mus musculus
cctatgaccggcttctgtggaatgt

SEQ ID NO: 597346 - DNA, 25 bp, Mus musculus
cctatgagccacactttggtgcaac

SEQ ID NO: 597347 - DNA, 25 bp, Mus musculus
cctatgagccactctttggtgcaac

SEQ ID NO: 597348 - DNA, 25 bp, Mus musculus
cctatgagggccaatatgatgccta

SEQ ID NO: 597349 - DNA, 25 bp, Mus musculus
cctatgagggcctatatgatgccta

SEQ ID NO: 597350 - DNA, 25 bp, Mus musculus
cctatgagtggtataatccacaccc

SEQ ID NO: 597351 - DNA, 25 bp, Mus musculus
cctatgagtggtttaatccacaccc

SEQ ID NO: 597352 - DNA, 25 bp, Mus musculus
cctatgatgcaaaacactttctgtg

SEQ ID NO: 597353 - DNA, 25 bp, Mus musculus
cctatgatgcaatacactttctgtg

SEQ ID NO: 597354 - DNA, 25 bp, Mus musculus
cctatgcagcggcaagggtcgatgc

SEQ ID NO: 597355 - DNA, 25 bp, Mus musculus
cctatgcagcgggaagggtcgatgc

SEQ ID NO: 597356 - DNA, 25 bp, Mus musculus
cctatgcagtagagggtgggccacc

SEQ ID NO: 597357 - DNA, 25 bp, Mus musculus
cctatgcagtagtgggtgggccacc

SEQ ID NO: 597358 - DNA, 25 bp, Mus musculus
cctatgccagacacagggctgcgag

SEQ ID NO: 597359 - DNA, 25 bp, Mus musculus
cctatgccagactcagggctgcgag

SEQ ID NO: 597360 - DNA, 25 bp, Mus musculus
cctatgccgcaaagcgggagaagct

SEQ ID NO: 597361 - DNA, 25 bp, Mus musculus
cctatgccgcaatgcgggagaagct

SEQ ID NO: 597362 - DNA, 25 bp, Mus musculus
cctatgctaaggagttggcgctgat

SEQ ID NO: 597363 - DNA, 25 bp, Mus musculus
cctatgctaaggtgttggcgctgat

SEQ ID NO: 597364 - DNA, 25 bp, Mus musculus
cctatggaaaggcatgggaagcaca

SEQ ID NO: 597365 - DNA, 25 bp, Mus musculus
cctatggaaagggatgggaagcaca

SEQ ID NO: 597366 - DNA, 25 bp, Mus musculus
cctatggaaatcattcctatctgga

SEQ ID NO: 597367 - DNA, 25 bp, Mus musculus
cctatggaaatctttcctatctgga

SEQ ID NO: 597368 - DNA, 25 bp, Mus musculus
cctatggagagtacccactgacagc

SEQ ID NO: 597369 - DNA, 25 bp, Mus musculus
cctatggagagttcccactgacagc

SEQ ID NO: 597370 - DNA, 25 bp, Mus musculus
cctatggagatcatcgtggatgacg

SEQ ID NO: 597371 - DNA, 25 bp, Mus musculus
cctatggagatcttcgtggatgacg

SEQ ID NO: 597372 - DNA, 25 bp, Mus musculus
cctatggatgttagagtaatgagta

SEQ ID NO: 597373 - DNA, 25 bp, Mus musculus
cctatggatgtttgagtaatgagta

SEQ ID NO: 597374 - DNA, 25 bp, Mus musculus
cctatggcagccacgggctggagat

SEQ ID NO: 597375 - DNA, 25 bp, Mus musculus
cctatggcagcctcgggctggagat

SEQ ID NO: 597376 - DNA, 25 bp, Mus musculus
cctatggccactcaggccacatgga

SEQ ID NO: 597377 - DNA, 25 bp, Mus musculus
cctatggccactgaggccacatgga

SEQ ID NO: 597378 - DNA, 25 bp, Mus musculus
cctatggcccagactgtggctgttg

SEQ ID NO: 597379 - DNA, 25 bp, Mus musculus
cctatggcccagtctgtggctgttg

SEQ ID NO: 597380 - DNA, 25 bp, Mus musculus
cctatggcctagaacaacttgaatc

SEQ ID NO: 597381 - DNA, 25 bp, Mus musculus
cctatggcctagtacaacttgaatc

SEQ ID NO: 597382 - DNA, 25 bp, Mus musculus
cctatggcggcgagcgtgagatccc

SEQ ID NO: 597383 - DNA, 25 bp, Mus musculus
cctatggcggcgtgcgtgagatccc

SEQ ID NO: 597384 - DNA, 25 bp, Mus musculus
cctatggcggttctcaggtggctac

SEQ ID NO: 597385 - DNA, 25 bp, Mus musculus
cctatggcggttgtcaggtggctac

SEQ ID NO: 597386 - DNA, 25 bp, Mus musculus
cctatgggaagcagaaaaacggaat

SEQ ID NO: 597387 - DNA, 25 bp, Mus musculus
cctatgggaagctgaaaaacggaat

SEQ ID NO: 597388 - DNA, 25 bp, Mus musculus
cctatgggaaggagttcctggtgcg

SEQ ID NO: 597389 - DNA, 25 bp, Mus musculus
cctatgggaaggtgttcctggtgcg

SEQ ID NO: 597390 - DNA, 25 bp, Mus musculus
cctatgggacctatgcggactactt

SEQ ID NO: 597391 - DNA, 25 bp, Mus musculus
cctatgggacctttgcggactactt

SEQ ID NO: 597392 - DNA, 25 bp, Mus musculus
cctatgggactgcactaagatgtta

SEQ ID NO: 597393 - DNA, 25 bp, Mus musculus
cctatgggactggactaagatgtta

SEQ ID NO: 597394 - DNA, 25 bp, Mus musculus
cctatgggaggcaggaatttaaacg

SEQ ID NO: 597395 - DNA, 25 bp, Mus musculus
cctatgggaggctggaatttaaacg

SEQ ID NO: 597396 - DNA, 25 bp, Mus musculus
cctatgggtttcaagtgggttagtg

SEQ ID NO: 597397 - DNA, 25 bp, Mus musculus
cctatgggtttctagtgggttagtg

SEQ ID NO: 597398 - DNA, 25 bp, Mus musculus
cctatggtcacaagcggtaccggca

SEQ ID NO: 597399 - DNA, 25 bp, Mus musculus
cctatggtcacatgcggtaccggca

SEQ ID NO: 597400 - DNA, 25 bp, Mus musculus
cctatggtgttgcatgctttaatca

SEQ ID NO: 597401 - DNA, 25 bp, Mus musculus
cctatggtgttggatgctttaatca

SEQ ID NO: 597402 - DNA, 25 bp, Mus musculus
cctatgtacataccccagggtgacc

SEQ ID NO: 597403 - DNA, 25 bp, Mus musculus
cctatgtacatagcccagggtgacc

SEQ ID NO: 597404 - DNA, 25 bp, Mus musculus
cctatgtaggctaccctgtggagct

SEQ ID NO: 597405 - DNA, 25 bp, Mus musculus
cctatgtaggcttccctgtggagct

SEQ ID NO: 597406 - DNA, 25 bp, Mus musculus
cctatgtcaacaaccagaatctaga

SEQ ID NO: 597407 - DNA, 25 bp, Mus musculus
cctatgtcaacatccagaatctaga

SEQ ID NO: 597408 - DNA, 25 bp, Mus musculus
cctatgtccagaagcttggcctgaa

SEQ ID NO: 597409 - DNA, 25 bp, Mus musculus
cctatgtccagatgcttggcctgaa

SEQ ID NO: 597410 - DNA, 25 bp, Mus musculus
cctatgtccgggctgaggagaacct

SEQ ID NO: 597411 - DNA, 25 bp, Mus musculus
cctatgtccggggtgaggagaacct

SEQ ID NO: 597412 - DNA, 25 bp, Mus musculus
cctatgtcgctaaggaggcaggatt

SEQ ID NO: 597413 - DNA, 25 bp, Mus musculus
cctatgtcgctatggaggcaggatt

SEQ ID NO: 597414 - DNA, 25 bp, Mus musculus
cctatgtctgcgaagctgagttccc

SEQ ID NO: 597415 - DNA, 25 bp, Mus musculus
cctatgtctgcgtagctgagttccc

SEQ ID NO: 597416 - DNA, 25 bp, Mus musculus
cctatgtcttgcatcatctctcgac

SEQ ID NO: 597417 - DNA, 25 bp, Mus musculus
cctatgtcttgcttcatctctcgac

SEQ ID NO: 597418 - DNA, 25 bp, Mus musculus
cctatgtgtgggacatcaagagtat

SEQ ID NO: 597419 - DNA, 25 bp, Mus musculus
cctatgtgtgggtcatcaagagtat

SEQ ID NO: 597420 - DNA, 25 bp, Mus musculus
cctatgttcagacgctgctctgcag

SEQ ID NO: 597421 - DNA, 25 bp, Mus musculus
cctatgttcagaggctgctctgcag

SEQ ID NO: 597422 - DNA, 25 bp, Mus musculus
cctatgttctccagaaacgatttca

SEQ ID NO: 597423 - DNA, 25 bp, Mus musculus
cctatgttctcctgaaacgatttca

SEQ ID NO: 597424 - DNA, 25 bp, Mus musculus
cctatgtttcctaccgtgtgccaga

SEQ ID NO: 597425 - DNA, 25 bp, Mus musculus
cctatgtttccttccgtgtgccaga

SEQ ID NO: 597426 - DNA, 25 bp, Mus musculus
cctatgtttgctatgcagcaaatga

SEQ ID NO: 597427 - DNA, 25 bp, Mus musculus
cctatgtttgctttgcagcaaatga

SEQ ID NO: 597428 - DNA, 25 bp, Mus musculus
cctattaaactcaacactggtgcag

SEQ ID NO: 597429 - DNA, 25 bp, Mus musculus
cctattaaactctacactggtgcag

SEQ ID NO: 597430 - DNA, 25 bp, Mus musculus
cctattaaacttatttgtaaatgca

SEQ ID NO: 597431 - DNA, 25 bp, Mus musculus
cctattaaacttttttgtaaatgca

SEQ ID NO: 597432 - DNA, 25 bp, Mus musculus
cctattacaaagcatggtgaaatag

SEQ ID NO: 597433 - DNA, 25 bp, Mus musculus
cctattacaaaggatggtgaaatag

SEQ ID NO: 597434 - DNA, 25 bp, Mus musculus
cctattcaagtgcagagccgcatgt

SEQ ID NO: 597435 - DNA, 25 bp, Mus musculus
cctattcaagtggagagccgcatgt

SEQ ID NO: 597436 - DNA, 25 bp, Mus musculus
cctattcactgacggcaaagaagag

SEQ ID NO: 597437 - DNA, 25 bp, Mus musculus
cctattcactgagggcaaagaagag

SEQ ID NO: 597438 - DNA, 25 bp, Mus musculus
cctattctgtggctggatctggctg

SEQ ID NO: 597439 - DNA, 25 bp, Mus musculus
cctattctgtgggtggatctggctg

SEQ ID NO: 597440 - DNA, 25 bp, Mus musculus
cctattcttctgcagggagcgatga

SEQ ID NO: 597441 - DNA, 25 bp, Mus musculus
cctattcttctggagggagcgatga

SEQ ID NO: 597442 - DNA, 25 bp, Mus musculus
cctattcttgccacagcagttcagg

SEQ ID NO: 597443 - DNA, 25 bp, Mus musculus
cctattcttgcctcagcagttcagg

SEQ ID NO: 597444 - DNA, 25 bp, Mus musculus
cctattgaggcaagaggaacattca

SEQ ID NO: 597445 - DNA, 25 bp, Mus musculus
cctattgaggcatgaggaacattca

SEQ ID NO: 597446 - DNA, 25 bp, Mus musculus
cctattgatctcatcatggtggaaa

SEQ ID NO: 597447 - DNA, 25 bp, Mus musculus
cctattgatctcttcatggtggaaa

SEQ ID NO: 597448 - DNA, 25 bp, Mus musculus
cctattgccctgctttatggattca

SEQ ID NO: 597449 - DNA, 25 bp, Mus musculus
cctattgccctggtttatggattca

SEQ ID NO: 597450 - DNA, 25 bp, Mus musculus
cctattgccgttcgattctccacag

SEQ ID NO: 597451 - DNA, 25 bp, Mus musculus
cctattgccgttggattctccacag

SEQ ID NO: 597452 - DNA, 25 bp, Mus musculus
cctattgcggtgctcatagatgaac

SEQ ID NO: 597453 - DNA, 25 bp, Mus musculus
cctattgcggtggtcatagatgaac

SEQ ID NO: 597454 - DNA, 25 bp, Mus musculus
cctattggacataacaggcaataca

SEQ ID NO: 597455 - DNA, 25 bp, Mus musculus
cctattggacattacaggcaataca

SEQ ID NO: 597456 - DNA, 25 bp, Mus musculus
cctattggccctcattgtggcctat

SEQ ID NO: 597457 - DNA, 25 bp, Mus musculus
cctattggccctgattgtggcctat

SEQ ID NO: 597458 - DNA, 25 bp, Mus musculus
cctatttaagagaggcatcagctgg

SEQ ID NO: 597459 - DNA, 25 bp, Mus musculus
cctatttaagagtggcatcagctgg

SEQ ID NO: 597460 - DNA, 25 bp, Mus musculus
cctatttctagtcacgttcccttca

SEQ ID NO: 597461 - DNA, 25 bp, Mus musculus
cctatttctagtgacgttcccttca

SEQ ID NO: 597462 - DNA, 25 bp, Mus musculus
cctatttcttgtccccttgtagtgg

SEQ ID NO: 597463 - DNA, 25 bp, Mus musculus
cctatttcttgtgcccttgtagtgg

SEQ ID NO: 597464 - DNA, 25 bp, Mus musculus
cctattttcttcatcagggatgcca

SEQ ID NO: 597465 - DNA, 25 bp, Mus musculus
cctattttcttcttcagggatgcca

SEQ ID NO: 597466 - DNA, 25 bp, Mus musculus
cctcaaaacaagctatgaagcaaag

SEQ ID NO: 597467 - DNA, 25 bp, Mus musculus
cctcaaaacaaggtatgaagcaaag

SEQ ID NO: 597468 - DNA, 25 bp, Mus musculus
cctcaaaagcgtattgagtgcctta

SEQ ID NO: 597469 - DNA, 25 bp, Mus musculus
cctcaaaagcgttttgagtgcctta

SEQ ID NO: 597470 - DNA, 25 bp, Mus musculus
cctcaaaattgaagaaagctcactc

SEQ ID NO: 597471 - DNA, 25 bp, Mus musculus
cctcaaaattgatgaaagctcactc

SEQ ID NO: 597472 - DNA, 25 bp, Mus musculus
cctcaaagaagtcggcctttgcaca

SEQ ID NO: 597473 - DNA, 25 bp, Mus musculus
cctcaaagaagtgggcctttgcaca

SEQ ID NO: 597474 - DNA, 25 bp, Mus musculus
cctcaaagatgcaagtcatcaaaaa

SEQ ID NO: 597475 - DNA, 25 bp, Mus musculus
cctcaaagatgctagtcatcaaaaa

SEQ ID NO: 597476 - DNA, 25 bp, Mus musculus
cctcaaagctggaaatgcaccaaaa

SEQ ID NO: 597477 - DNA, 25 bp, Mus musculus
cctcaaagctggtaatgcaccaaaa

SEQ ID NO: 597478 - DNA, 25 bp, Mus musculus
cctcaaaggagaattcagcagcccc

SEQ ID NO: 597479 - DNA, 25 bp, Mus musculus
cctcaaaggagatttcagcagcccc

SEQ ID NO: 597480 - DNA, 25 bp, Mus musculus
cctcaaaggttgagatgtggtggtc

SEQ ID NO: 597481 - DNA, 25 bp, Mus musculus
cctcaaaggttgtgatgtggtggtc

SEQ ID NO: 597482 - DNA, 25 bp, Mus musculus
cctcaaatactaagagtacgagttc

SEQ ID NO: 597483 - DNA, 25 bp, Mus musculus
cctcaaatactatgagtacgagttc

SEQ ID NO: 597484 - DNA, 25 bp, Mus musculus
cctcaaatatgacttcgacatcgag

SEQ ID NO: 597485 - DNA, 25 bp, Mus musculus
cctcaaatatgagttcgacatcgag

SEQ ID NO: 597486 - DNA, 25 bp, Mus musculus
cctcaacaagcaaggctacaaatgc

SEQ ID NO: 597487 - DNA, 25 bp, Mus musculus
cctcaacaagcatggctacaaatgc

SEQ ID NO: 597488 - DNA, 25 bp, Mus musculus
cctcaacaccatccgggataggcgg

SEQ ID NO: 597489 - DNA, 25 bp, Mus musculus
cctcaacaccatgcgggataggcgg

SEQ ID NO: 597490 - DNA, 25 bp, Mus musculus
cctcaacagggaacaaaacatactg

SEQ ID NO: 597491 - DNA, 25 bp, Mus musculus
cctcaacagggacaaaatggctttg

SEQ ID NO: 597492 - DNA, 25 bp, Mus musculus
cctcaacagggagaaaatggctttg

SEQ ID NO: 597493 - DNA, 25 bp, Mus musculus
cctcaacagggatcaaaacatactg

SEQ ID NO: 597494 - DNA, 25 bp, Mus musculus
cctcaacagtgaagggtatgctgca

SEQ ID NO: 597495 - DNA, 25 bp, Mus musculus
cctcaacagtgatgggtatgctgca

SEQ ID NO: 597496 - DNA, 25 bp, Mus musculus
cctcaacatcaaacagaacaacaag

SEQ ID NO: 597497 - DNA, 25 bp, Mus musculus
cctcaacatcaatcagaacaacaag

SEQ ID NO: 597498 - DNA, 25 bp, Mus musculus
cctcaaccagaaaactcagtttgaa

SEQ ID NO: 597499 - DNA, 25 bp, Mus musculus
cctcaaccagaatactcagtttgaa

SEQ ID NO: 597500 - DNA, 25 bp, Mus musculus
cctcaacgtgctccgggacgacatt

SEQ ID NO: 597501 - DNA, 25 bp, Mus musculus
cctcaacgtgctgcgggacgacatt

SEQ ID NO: 597502 - DNA, 25 bp, Mus musculus
cctcaactgcatcagagaagaatga

SEQ ID NO: 597503 - DNA, 25 bp, Mus musculus
cctcaactgcatgagagaagaatga

SEQ ID NO: 597504 - DNA, 25 bp, Mus musculus
cctcaactggtcatggtggccgctg

SEQ ID NO: 597505 - DNA, 25 bp, Mus musculus
cctcaactggtcttggtggccgctg

SEQ ID NO: 597506 - DNA, 25 bp, Mus musculus
cctcaactgtgccattggcatggtg

SEQ ID NO: 597507 - DNA, 25 bp, Mus musculus
cctcaactgtgcgattggcatggtg

SEQ ID NO: 597508 - DNA, 25 bp, Mus musculus
cctcaacttctgagaggctaagaat

SEQ ID NO: 597509 - DNA, 25 bp, Mus musculus
cctcaacttctgtgaggctaagaat

SEQ ID NO: 597510 - DNA, 25 bp, Mus musculus
cctcaagaacaacttatcgagtggg

SEQ ID NO: 597511 - DNA, 25 bp, Mus musculus
cctcaagaacaagttatcgagtggg

SEQ ID NO: 597512 - DNA, 25 bp, Mus musculus
cctcaagcaagtctttgcacttctc

SEQ ID NO: 597513 - DNA, 25 bp, Mus musculus
cctcaagcaagtgtttgcacttctc

SEQ ID NO: 597514 - DNA, 25 bp, Mus musculus
cctcaagcacgtcatggaaggctca

SEQ ID NO: 597515 - DNA, 25 bp, Mus musculus
cctcaagcacgtgatggaaggctca

SEQ ID NO: 597516 - DNA, 25 bp, Mus musculus
cctcaagctccaacttggctcagga

SEQ ID NO: 597517 - DNA, 25 bp, Mus musculus
cctcaagctccatcttggctcagga

SEQ ID NO: 597518 - DNA, 25 bp, Mus musculus
cctcaaggaaagaacaaagtgttgc

SEQ ID NO: 597519 - DNA, 25 bp, Mus musculus
cctcaaggaaagtacaaagtgttgc

SEQ ID NO: 597520 - DNA, 25 bp, Mus musculus
cctcaaggatctagtggctctgcag

SEQ ID NO: 597521 - DNA, 25 bp, Mus musculus
cctcaaggatcttgtggctctgcag

SEQ ID NO: 597522 - DNA, 25 bp, Mus musculus
cctcaaggccctctttgaacacgga

SEQ ID NO: 597523 - DNA, 25 bp, Mus musculus
cctcaaggccctgtttgaacacgga

SEQ ID NO: 597524 - DNA, 25 bp, Mus musculus
cctcaagggattccagctgcccgta

SEQ ID NO: 597525 - DNA, 25 bp, Mus musculus
cctcaagggattgcagctgcccgta

SEQ ID NO: 597526 - DNA, 25 bp, Mus musculus
cctcaagggctgcttcgagccaata

SEQ ID NO: 597527 - DNA, 25 bp, Mus musculus
cctcaagggctggttcgagccaata

SEQ ID NO: 597528 - DNA, 25 bp, Mus musculus
cctcaaggtgaacctacttttggaa

SEQ ID NO: 597529 - DNA, 25 bp, Mus musculus
cctcaaggtgaagctacttttggaa

SEQ ID NO: 597530 - DNA, 25 bp, Mus musculus
cctcaagtcctaaggtacaagaaca

SEQ ID NO: 597531 - DNA, 25 bp, Mus musculus
cctcaagtcctatggtacaagaaca

SEQ ID NO: 597532 - DNA, 25 bp, Mus musculus
cctcaagtgatgctttacggcaaag

SEQ ID NO: 597533 - DNA, 25 bp, Mus musculus
cctcaagtgatggtttacggcaaag

SEQ ID NO: 597534 - DNA, 25 bp, Mus musculus
cctcaagttgagagggtacaggccg

SEQ ID NO: 597535 - DNA, 25 bp, Mus musculus
cctcaagttgagtgggtacaggccg

SEQ ID NO: 597536 - DNA, 25 bp, Mus musculus
cctcaagtttctcgttgatggaaaa

SEQ ID NO: 597537 - DNA, 25 bp, Mus musculus
cctcaagtttctggttgatggaaaa

SEQ ID NO: 597538 - DNA, 25 bp, Mus musculus
cctcaatgagatcatcaatccaaac

SEQ ID NO: 597539 - DNA, 25 bp, Mus musculus
cctcaatgagatgatcaatccaaac

SEQ ID NO: 597540 - DNA, 25 bp, Mus musculus
cctcaatgcgttcatgctttacatg

SEQ ID NO: 597541 - DNA, 25 bp, Mus musculus
cctcaatgcgttgatgctttacatg

SEQ ID NO: 597542 - DNA, 25 bp, Mus musculus
cctcaatggagaaggacgagtggac

SEQ ID NO: 597543 - DNA, 25 bp, Mus musculus
cctcaatggagatggacgagtggac

SEQ ID NO: 597544 - DNA, 25 bp, Mus musculus
cctcaattggccagctcacaaacat

SEQ ID NO: 597545 - DNA, 25 bp, Mus musculus
cctcaattggcctgctcacaaacat

SEQ ID NO: 597546 - DNA, 25 bp, Mus musculus
cctcacaaactgacccttagggtgg

SEQ ID NO: 597547 - DNA, 25 bp, Mus musculus
cctcacaaactgtcccttagggtgg

SEQ ID NO: 597548 - DNA, 25 bp, Mus musculus
cctcacaagagaccgtaggccgcgt

SEQ ID NO: 597549 - DNA, 25 bp, Mus musculus
cctcacaagagagcgtaggccgcgt

SEQ ID NO: 597550 - DNA, 25 bp, Mus musculus
cctcacaatgatcgatttgtgctct

SEQ ID NO: 597551 - DNA, 25 bp, Mus musculus
cctcacaatgatggatttgtgctct

SEQ ID NO: 597552 - DNA, 25 bp, Mus musculus
cctcacagcccacattgtgaaagac

SEQ ID NO: 597553 - DNA, 25 bp, Mus musculus
cctcacagcccagattgtgaaagac

SEQ ID NO: 597554 - DNA, 25 bp, Mus musculus
cctcacagcgatatgaaagagcttt

SEQ ID NO: 597555 - DNA, 25 bp, Mus musculus
cctcacagcgatttgaaagagcttt

SEQ ID NO: 597556 - DNA, 25 bp, Mus musculus
cctcacaggattatacacaaaagtg

SEQ ID NO: 597557 - DNA, 25 bp, Mus musculus
cctcacaggattttacacaaaagtg

SEQ ID NO: 597558 - DNA, 25 bp, Mus musculus
cctcacaggttccacgagtcatgtc

SEQ ID NO: 597559 - DNA, 25 bp, Mus musculus
cctcacaggttcgacgagtcatgtc

SEQ ID NO: 597560 - DNA, 25 bp, Mus musculus
cctcacagttgcagccaaagagtta

SEQ ID NO: 597561 - DNA, 25 bp, Mus musculus
cctcacagttgctgccaaagagtta

SEQ ID NO: 597562 - DNA, 25 bp, Mus musculus
cctcacataagccaatgtttgatga

SEQ ID NO: 597563 - DNA, 25 bp, Mus musculus
cctcacataagcgaatgtttgatga

SEQ ID NO: 597564 - DNA, 25 bp, Mus musculus
cctcacatgctgacatggaggtgac

SEQ ID NO: 597565 - DNA, 25 bp, Mus musculus
cctcacatgctgtcatggaggtgac

SEQ ID NO: 597566 - DNA, 25 bp, Mus musculus
cctcacatgtaactacagctagcaa

SEQ ID NO: 597567 - DNA, 25 bp, Mus musculus
cctcacatgtaagtacagctagcaa

SEQ ID NO: 597568 - DNA, 25 bp, Mus musculus
cctcaccatgtgcattaaggagagc

SEQ ID NO: 597569 - DNA, 25 bp, Mus musculus
cctcaccatgtggattaaggagagc

SEQ ID NO: 597570 - DNA, 25 bp, Mus musculus
cctcaccctcacagggcaagatgag

SEQ ID NO: 597571 - DNA, 25 bp, Mus musculus
cctcaccctcactgggcaagatgag

SEQ ID NO: 597572 - DNA, 25 bp, Mus musculus
cctcaccctggaccgcaccattaat

SEQ ID NO: 597573 - DNA, 25 bp, Mus musculus
cctcaccctggagcgcaccattaat

SEQ ID NO: 597574 - DNA, 25 bp, Mus musculus
cctcaccggtgtcgacctttcaaag

SEQ ID NO: 597575 - DNA, 25 bp, Mus musculus
cctcaccggtgtggacctttcaaag

SEQ ID NO: 597576 - DNA, 25 bp, Mus musculus
cctcacctgatgcaagaacacatgg

SEQ ID NO: 597577 - DNA, 25 bp, Mus musculus
cctcacctgatggaagaacacatgg

SEQ ID NO: 597578 - DNA, 25 bp, Mus musculus
cctcaccttcagagacttcaatgca

SEQ ID NO: 597579 - DNA, 25 bp, Mus musculus
cctcaccttcagtgacttcaatgca

SEQ ID NO: 597580 - DNA, 25 bp, Mus musculus
cctcacgaaccgagttgaagatcct

SEQ ID NO: 597581 - DNA, 25 bp, Mus musculus
cctcacgaaccgtgttgaagatcct

SEQ ID NO: 597582 - DNA, 25 bp, Mus musculus
cctcactattgtcgccctgattctg

SEQ ID NO: 597583 - DNA, 25 bp, Mus musculus
cctcactattgtggccctgattctg

SEQ ID NO: 597584 - DNA, 25 bp, Mus musculus
cctcactgatatctaggaagctaat

SEQ ID NO: 597585 - DNA, 25 bp, Mus musculus
cctcactgatatgtaggaagctaat

SEQ ID NO: 597586 - DNA, 25 bp, Mus musculus
cctcactgcagacttgctacaatct

SEQ ID NO: 597587 - DNA, 25 bp, Mus musculus
cctcactgcagagttgctacaatct

SEQ ID NO: 597588 - DNA, 25 bp, Mus musculus
cctcactggaggaggtcctgcagtg

SEQ ID NO: 597589 - DNA, 25 bp, Mus musculus
cctcactggaggtggtcctgcagtg

SEQ ID NO: 597590 - DNA, 25 bp, Mus musculus
cctcactggccgaaatgtgtctgac

SEQ ID NO: 597591 - DNA, 25 bp, Mus musculus
cctcactggccgtaatgtgtctgac

SEQ ID NO: 597592 - DNA, 25 bp, Mus musculus
cctcactggcgcagctttggtttct

SEQ ID NO: 597593 - DNA, 25 bp, Mus musculus
cctcactggcgctgctttggtttct

SEQ ID NO: 597594 - DNA, 25 bp, Mus musculus
cctcacttatggacattgacacgct

SEQ ID NO: 597595 - DNA, 25 bp, Mus musculus
cctcacttatggtcattgacacgct

SEQ ID NO: 597596 - DNA, 25 bp, Mus musculus
cctcacttcaggatcaacgggcaga

SEQ ID NO: 597597 - DNA, 25 bp, Mus musculus
cctcacttcaggttcaacgggcaga

SEQ ID NO: 597598 - DNA, 25 bp, Mus musculus
cctcacttgattcagttgaaagtgg

SEQ ID NO: 597599 - DNA, 25 bp, Mus musculus
cctcacttgattgagttgaaagtgg

SEQ ID NO: 597600 - DNA, 25 bp, Mus musculus
cctcacttgcttcaggtgtgaaaca

SEQ ID NO: 597601 - DNA, 25 bp, Mus musculus
cctcacttgcttgaggtgtgaaaca

SEQ ID NO: 597602 - DNA, 25 bp, Mus musculus
cctcactttgtgctagtccactgca

SEQ ID NO: 597603 - DNA, 25 bp, Mus musculus
cctcactttgtggtagtccactgca

SEQ ID NO: 597604 - DNA, 25 bp, Mus musculus
cctcagaaaatgcatctcaaagtgg

SEQ ID NO: 597605 - DNA, 25 bp, Mus musculus
cctcagaaaatggatctcaaagtgg

SEQ ID NO: 597606 - DNA, 25 bp, Mus musculus
cctcagaaacagatgcggctcttca

SEQ ID NO: 597607 - DNA, 25 bp, Mus musculus
cctcagaaacagttgcggctcttca

SEQ ID NO: 597608 - DNA, 25 bp, Mus musculus
cctcagaaacttagagagactttgt

SEQ ID NO: 597609 - DNA, 25 bp, Mus musculus
cctcagaaactttgagagactttgt

SEQ ID NO: 597610 - DNA, 25 bp, Mus musculus
cctcagaaccggcagaaaactgtgt

SEQ ID NO: 597611 - DNA, 25 bp, Mus musculus
cctcagaaccgggagaaaactgtgt

SEQ ID NO: 597612 - DNA, 25 bp, Mus musculus
cctcagaagagtataatgggtatct

SEQ ID NO: 597613 - DNA, 25 bp, Mus musculus
cctcagaagagtttaatgggtatct

SEQ ID NO: 597614 - DNA, 25 bp, Mus musculus
cctcagaagattcccaagaagttca

SEQ ID NO: 597615 - DNA, 25 bp, Mus musculus
cctcagaagattgccaagaagttca

SEQ ID NO: 597616 - DNA, 25 bp, Mus musculus
cctcagaaggagcaagacttgggcc

SEQ ID NO: 597617 - DNA, 25 bp, Mus musculus
cctcagaaggaggaagacttgggcc

SEQ ID NO: 597618 - DNA, 25 bp, Mus musculus
cctcagaaggtcatctgtagactct

SEQ ID NO: 597619 - DNA, 25 bp, Mus musculus
cctcagaaggtcttctgtagactct

SEQ ID NO: 597620 - DNA, 25 bp, Mus musculus
cctcagaatagtcctgcctaaggac

SEQ ID NO: 597621 - DNA, 25 bp, Mus musculus
cctcagaatagtgctgcctaaggac

SEQ ID NO: 597622 - DNA, 25 bp, Mus musculus
cctcagaatttgatgagtgggagcc

SEQ ID NO: 597623 - DNA, 25 bp, Mus musculus
cctcagaatttgttgagtgggagcc

SEQ ID NO: 597624 - DNA, 25 bp, Mus musculus
cctcagacaagaacccaaagggaca

SEQ ID NO: 597625 - DNA, 25 bp, Mus musculus
cctcagacaagatcccaaagggaca

SEQ ID NO: 597626 - DNA, 25 bp, Mus musculus
cctcagacacatcacatggaagcag

SEQ ID NO: 597627 - DNA, 25 bp, Mus musculus
cctcagacacatgacatggaagcag

SEQ ID NO: 597628 - DNA, 25 bp, Mus musculus
cctcagacatatctacacggacggg

SEQ ID NO: 597629 - DNA, 25 bp, Mus musculus
cctcagacatatgtacacggacggg

SEQ ID NO: 597630 - DNA, 25 bp, Mus musculus
cctcagaccagtagctagggatgct

SEQ ID NO: 597631 - DNA, 25 bp, Mus musculus
cctcagaccagtcgcagaaagctgt

SEQ ID NO: 597632 - DNA, 25 bp, Mus musculus
cctcagaccagtggcagaaagctgt

SEQ ID NO: 597633 - DNA, 25 bp, Mus musculus
cctcagaccagttgctagggatgct

SEQ ID NO: 597634 - DNA, 25 bp, Mus musculus
cctcagactttcactacgataaatt

SEQ ID NO: 597635 - DNA, 25 bp, Mus musculus
cctcagactttctctacgataaatt

SEQ ID NO: 597636 - DNA, 25 bp, Mus musculus
cctcagagagagaagactgtaataa

SEQ ID NO: 597637 - DNA, 25 bp, Mus musculus
cctcagagagagagattaaggccta

SEQ ID NO: 597638 - DNA, 25 bp, Mus musculus
cctcagagagagtagactgtaataa

SEQ ID NO: 597639 - DNA, 25 bp, Mus musculus
cctcagagagagtgattaaggccta

SEQ ID NO: 597640 - DNA, 25 bp, Mus musculus
cctcagagaggtagatgaagacact

SEQ ID NO: 597641 - DNA, 25 bp, Mus musculus
cctcagagaggttgatgaagacact

SEQ ID NO: 597642 - DNA, 25 bp, Mus musculus
cctcagaggcatcaggctgactcct

SEQ ID NO: 597643 - DNA, 25 bp, Mus musculus
cctcagaggcatgaggctgactcct

SEQ ID NO: 597644 - DNA, 25 bp, Mus musculus
cctcagagggggctatgaatgcttc

SEQ ID NO: 597645 - DNA, 25 bp, Mus musculus
cctcagaggggggtatgaatgcttc

SEQ ID NO: 597646 - DNA, 25 bp, Mus musculus
cctcagaggtgccagtggaggagca

SEQ ID NO: 597647 - DNA, 25 bp, Mus musculus
cctcagaggtgcgagtggaggagca

SEQ ID NO: 597648 - DNA, 25 bp, Mus musculus
cctcagatatggctggttatgccac

SEQ ID NO: 597649 - DNA, 25 bp, Mus musculus
cctcagatatgggtggttatgccac

SEQ ID NO: 597650 - DNA, 25 bp, Mus musculus
cctcagatgacccttgggatgataa

SEQ ID NO: 597651 - DNA, 25 bp, Mus musculus
cctcagatgaccgttgggatgataa

SEQ ID NO: 597652 - DNA, 25 bp, Mus musculus
cctcagatgtcgctctggcattcac

SEQ ID NO: 597653 - DNA, 25 bp, Mus musculus
cctcagatgtcggtctggcattcac

SEQ ID NO: 597654 - DNA, 25 bp, Mus musculus
cctcagcaaactcgtggccgagtgg

SEQ ID NO: 597655 - DNA, 25 bp, Mus musculus
cctcagcaaactggtggccgagtgg

SEQ ID NO: 597656 - DNA, 25 bp, Mus musculus
cctcagcaaattcggagaacttggg

SEQ ID NO: 597657 - DNA, 25 bp, Mus musculus
cctcagcaaattgggagaacttggg

SEQ ID NO: 597658 - DNA, 25 bp, Mus musculus
cctcagcaacctcaggagaaacaaa

SEQ ID NO: 597659 - DNA, 25 bp, Mus musculus
cctcagcaacctgaggagaaacaaa

SEQ ID NO: 597660 - DNA, 25 bp, Mus musculus
cctcagcaagcgcataaaggtcatc

SEQ ID NO: 597661 - DNA, 25 bp, Mus musculus
cctcagcaagcggataaaggtcatc

SEQ ID NO: 597662 - DNA, 25 bp, Mus musculus
cctcagcaatggctacagggtgact

SEQ ID NO: 597663 - DNA, 25 bp, Mus musculus
cctcagcaatgggtacagggtgact

SEQ ID NO: 597664 - DNA, 25 bp, Mus musculus
cctcagcagccacggactgaagacg

SEQ ID NO: 597665 - DNA, 25 bp, Mus musculus
cctcagcagccagggactgaagacg

SEQ ID NO: 597666 - DNA, 25 bp, Mus musculus
cctcagcagggaacagtttctcaag

SEQ ID NO: 597667 - DNA, 25 bp, Mus musculus
cctcagcagggatcagtttctcaag

SEQ ID NO: 597668 - DNA, 25 bp, Mus musculus
cctcagccaacactgtgggcaatgc

SEQ ID NO: 597669 - DNA, 25 bp, Mus musculus
cctcagccaacagtgtgggcaatgc

SEQ ID NO: 597670 - DNA, 25 bp, Mus musculus
cctcagccggccagaaccaggtaaa

SEQ ID NO: 597671 - DNA, 25 bp, Mus musculus
cctcagccggcctgaaccaggtaaa

SEQ ID NO: 597672 - DNA, 25 bp, Mus musculus
cctcagcctgctctttcggaggcag

SEQ ID NO: 597673 - DNA, 25 bp, Mus musculus
cctcagcctgctgtttcggaggcag

SEQ ID NO: 597674 - DNA, 25 bp, Mus musculus
cctcagcgagaccttgtatgaattg

SEQ ID NO: 597675 - DNA, 25 bp, Mus musculus
cctcagcgagacgttgtatgaattg

SEQ ID NO: 597676 - DNA, 25 bp, Mus musculus
cctcagcgcagaagagggcactcag

SEQ ID NO: 597677 - DNA, 25 bp, Mus musculus
cctcagcgcagatgagggcactcag

SEQ ID NO: 597678 - DNA, 25 bp, Mus musculus
cctcagctaggtcgtggccaagact

SEQ ID NO: 597679 - DNA, 25 bp, Mus musculus
cctcagctaggtggtggccaagact

SEQ ID NO: 597680 - DNA, 25 bp, Mus musculus
cctcagctatggcactggttcaatc

SEQ ID NO: 597681 - DNA, 25 bp, Mus musculus
cctcagctatggcagtggccctcat

SEQ ID NO: 597682 - DNA, 25 bp, Mus musculus
cctcagctatgggactggttcaatc

SEQ ID NO: 597683 - DNA, 25 bp, Mus musculus
cctcagctatgggagtggccctcat

SEQ ID NO: 597684 - DNA, 25 bp, Mus musculus
cctcagctcaggattcgagagaaga

SEQ ID NO: 597685 - DNA, 25 bp, Mus musculus
cctcagctcaggtttcgagagaaga

SEQ ID NO: 597686 - DNA, 25 bp, Mus musculus
cctcagctggcaaattcagtgcaga

SEQ ID NO: 597687 - DNA, 25 bp, Mus musculus
cctcagctggcatattcagtgcaga

SEQ ID NO: 597688 - DNA, 25 bp, Mus musculus
cctcagctggccagctagcagcaaa

SEQ ID NO: 597689 - DNA, 25 bp, Mus musculus
cctcagctggcctgctagcagcaaa

SEQ ID NO: 597690 - DNA, 25 bp, Mus musculus
cctcagctggtactggaaggtcatg

SEQ ID NO: 597691 - DNA, 25 bp, Mus musculus
cctcagctggtagtggaaggtcatg

SEQ ID NO: 597692 - DNA, 25 bp, Mus musculus
cctcagctggtcaaagatgggcaaa

SEQ ID NO: 597693 - DNA, 25 bp, Mus musculus
cctcagctggtctaagatgggcaaa

SEQ ID NO: 597694 - DNA, 25 bp, Mus musculus
cctcagctggttccgggatgggcag

SEQ ID NO: 597695 - DNA, 25 bp, Mus musculus
cctcagctggttgcgggatgggcag

SEQ ID NO: 597696 - DNA, 25 bp, Mus musculus
cctcagctttaacaacatgtgcaag

SEQ ID NO: 597697 - DNA, 25 bp, Mus musculus
cctcagctttaagaacatgtgcaag

SEQ ID NO: 597698 - DNA, 25 bp, Mus musculus
cctcaggaacccaggatgtctcctt

SEQ ID NO: 597699 - DNA, 25 bp, Mus musculus
cctcaggaaccctggatgtctcctt

SEQ ID NO: 597700 - DNA, 25 bp, Mus musculus
cctcaggaagagagacgtggttctg

SEQ ID NO: 597701 - DNA, 25 bp, Mus musculus
cctcaggaagagtgacgtggttctg

SEQ ID NO: 597702 - DNA, 25 bp, Mus musculus
cctcaggactctagagaagatggaa

SEQ ID NO: 597703 - DNA, 25 bp, Mus musculus
cctcaggactcttgagaagatggaa

SEQ ID NO: 597704 - DNA, 25 bp, Mus musculus
cctcaggagagaaggcttcctacaa

SEQ ID NO: 597705 - DNA, 25 bp, Mus musculus
cctcaggagagaagttatatgctac

SEQ ID NO: 597706 - DNA, 25 bp, Mus musculus
cctcaggagagatggcttcctacaa

SEQ ID NO: 597707 - DNA, 25 bp, Mus musculus
cctcaggagagatgttatatgctac

SEQ ID NO: 597708 - DNA, 25 bp, Mus musculus
cctcaggagccgaacaggttcagcg

SEQ ID NO: 597709 - DNA, 25 bp, Mus musculus
cctcaggagccgtacaggttcagcg

SEQ ID NO: 597710 - DNA, 25 bp, Mus musculus
cctcaggagtaaaggtgttgctgag

SEQ ID NO: 597711 - DNA, 25 bp, Mus musculus
cctcaggagtaatggtgttgctgag

SEQ ID NO: 597712 - DNA, 25 bp, Mus musculus
cctcaggatggacaatggtctctgc

SEQ ID NO: 597713 - DNA, 25 bp, Mus musculus
cctcaggatggagaatggtctctgc

SEQ ID NO: 597714 - DNA, 25 bp, Mus musculus
cctcaggcagtgagagctgctccta

SEQ ID NO: 597715 - DNA, 25 bp, Mus musculus
cctcaggcagtgtgagctgctccta

SEQ ID NO: 597716 - DNA, 25 bp, Mus musculus
cctcagggacaaagcggcgtgtgtt

SEQ ID NO: 597717 - DNA, 25 bp, Mus musculus
cctcagggacaatgcggcgtgtgtt

SEQ ID NO: 597718 - DNA, 25 bp, Mus musculus
cctcagggaccccaagacaaaggct

SEQ ID NO: 597719 - DNA, 25 bp, Mus musculus
cctcagggacccgaagacaaaggct

SEQ ID NO: 597720 - DNA, 25 bp, Mus musculus
cctcagggtaggcagagcactgttt

SEQ ID NO: 597721 - DNA, 25 bp, Mus musculus
cctcagggtagggagagcactgttt

SEQ ID NO: 597722 - DNA, 25 bp, Mus musculus
cctcagggtctgagaggcatcactg

SEQ ID NO: 597723 - DNA, 25 bp, Mus musculus
cctcagggtctgtgaggcatcactg

SEQ ID NO: 597724 - DNA, 25 bp, Mus musculus
cctcagggtcttaggcaaaggtgat

SEQ ID NO: 597725 - DNA, 25 bp, Mus musculus
cctcagggtctttggcaaaggtgat

SEQ ID NO: 597726 - DNA, 25 bp, Mus musculus
cctcagggtggtagtgactgggacc

SEQ ID NO: 597727 - DNA, 25 bp, Mus musculus
cctcagggtggttgtgactgggacc

SEQ ID NO: 597728 - DNA, 25 bp, Mus musculus
cctcagggtgttaaagcagggctgc

SEQ ID NO: 597729 - DNA, 25 bp, Mus musculus
cctcagggtgtttaagcagggctgc

SEQ ID NO: 597730 - DNA, 25 bp, Mus musculus
cctcaggtgtcacagagtaagctat

SEQ ID NO: 597731 - DNA, 25 bp, Mus musculus
cctcaggtgtcagagagtaagctat

SEQ ID NO: 597732 - DNA, 25 bp, Mus musculus
cctcagtaccgcctggagaagcaga

SEQ ID NO: 597733 - DNA, 25 bp, Mus musculus
cctcagtaccgcgtggagaagcaga

SEQ ID NO: 597734 - DNA, 25 bp, Mus musculus
cctcagtagtgtacaacaagctggg

SEQ ID NO: 597735 - DNA, 25 bp, Mus musculus
cctcagtagtgttcaacaagctggg

SEQ ID NO: 597736 - DNA, 25 bp, Mus musculus
cctcagtatgccattgctggaagca

SEQ ID NO: 597737 - DNA, 25 bp, Mus musculus
cctcagtatgcctttgctggaagca

SEQ ID NO: 597738 - DNA, 25 bp, Mus musculus
cctcagtcagtgagaatcacgatgc

SEQ ID NO: 597739 - DNA, 25 bp, Mus musculus
cctcagtcagtgtgaatcacgatgc

SEQ ID NO: 597740 - DNA, 25 bp, Mus musculus
cctcagtccccaaggtgtgggagcc

SEQ ID NO: 597741 - DNA, 25 bp, Mus musculus
cctcagtccccatggtgtgggagcc

SEQ ID NO: 597742 - DNA, 25 bp, Mus musculus
cctcagtccccgagttgatccagta

SEQ ID NO: 597743 - DNA, 25 bp, Mus musculus
cctcagtccccgtgttgatccagta

SEQ ID NO: 597744 - DNA, 25 bp, Mus musculus
cctcagtcgactactgcaggcaatc

SEQ ID NO: 597745 - DNA, 25 bp, Mus musculus
cctcagtcgacttctgcaggcaatc

SEQ ID NO: 597746 - DNA, 25 bp, Mus musculus
cctcagtcgggaaatcttggttctc

SEQ ID NO: 597747 - DNA, 25 bp, Mus musculus
cctcagtcgggatatcttggttctc

SEQ ID NO: 597748 - DNA, 25 bp, Mus musculus
cctcagtctggactgaatctcactg

SEQ ID NO: 597749 - DNA, 25 bp, Mus musculus
cctcagtctggagtgaatctcactg

SEQ ID NO: 597750 - DNA, 25 bp, Mus musculus
cctcagtctggcagatgactcttca

SEQ ID NO: 597751 - DNA, 25 bp, Mus musculus
cctcagtctggctgatgactcttca

SEQ ID NO: 597752 - DNA, 25 bp, Mus musculus
cctcagtgacatcgagtggcacatc

SEQ ID NO: 597753 - DNA, 25 bp, Mus musculus
cctcagtgacatggagtggcacatc

SEQ ID NO: 597754 - DNA, 25 bp, Mus musculus
cctcagtgagttaacatataagacc

SEQ ID NO: 597755 - DNA, 25 bp, Mus musculus
cctcagtgagtttacatataagacc

SEQ ID NO: 597756 - DNA, 25 bp, Mus musculus
cctcagtggcatcgacgacttgctc

SEQ ID NO: 597757 - DNA, 25 bp, Mus musculus
cctcagtggcatggacgacttgctc

SEQ ID NO: 597758 - DNA, 25 bp, Mus musculus
cctcagtggcttcctctgcggcggt

SEQ ID NO: 597759 - DNA, 25 bp, Mus musculus
cctcagtggcttgctctgcggcggt

SEQ ID NO: 597760 - DNA, 25 bp, Mus musculus
cctcagtgggaacccgtgttaagga

SEQ ID NO: 597761 - DNA, 25 bp, Mus musculus
cctcagtgggaagccgtgttaagga

SEQ ID NO: 597762 - DNA, 25 bp, Mus musculus
cctcagtgggcaccgctgtgtgaac

SEQ ID NO: 597763 - DNA, 25 bp, Mus musculus
cctcagtgggcagcgctgtgtgaac

SEQ ID NO: 597764 - DNA, 25 bp, Mus musculus
cctcagtgggctctctcagcgggct

SEQ ID NO: 597765 - DNA, 25 bp, Mus musculus
cctcagtgggctgtctcagcgggct

SEQ ID NO: 597766 - DNA, 25 bp, Mus musculus
cctcagtgtcctcatgatggagaag

SEQ ID NO: 597767 - DNA, 25 bp, Mus musculus
cctcagtgtcctgatgatggagaag

SEQ ID NO: 597768 - DNA, 25 bp, Mus musculus
cctcagtgttggaatcctggtcaaa

SEQ ID NO: 597769 - DNA, 25 bp, Mus musculus
cctcagtgttggtatcctggtcaaa

SEQ ID NO: 597770 - DNA, 25 bp, Mus musculus
cctcagttctggcaaattttacggg

SEQ ID NO: 597771 - DNA, 25 bp, Mus musculus
cctcagttctgggaaattttacggg

SEQ ID NO: 597772 - DNA, 25 bp, Mus musculus
cctcagttgagtaggtttctgctga

SEQ ID NO: 597773 - DNA, 25 bp, Mus musculus
cctcagttgagttggtttctgctga

SEQ ID NO: 597774 - DNA, 25 bp, Mus musculus
cctcagttggccaggcaacttgtaa

SEQ ID NO: 597775 - DNA, 25 bp, Mus musculus
cctcagttggcctggcaacttgtaa

SEQ ID NO: 597776 - DNA, 25 bp, Mus musculus
cctcatacagctacaagtttcttcc

SEQ ID NO: 597777 - DNA, 25 bp, Mus musculus
cctcatacagcttcaagtttcttcc

SEQ ID NO: 597778 - DNA, 25 bp, Mus musculus
cctcataccgtaatttattttcctg

SEQ ID NO: 597779 - DNA, 25 bp, Mus musculus
cctcataccgtattttattttcctg

SEQ ID NO: 597780 - DNA, 25 bp, Mus musculus
cctcatatcgtccttgcgacaacag

SEQ ID NO: 597781 - DNA, 25 bp, Mus musculus
cctcatatcgtcgttgcgacaacag

SEQ ID NO: 597782 - DNA, 25 bp, Mus musculus
cctcatatctttagccagggcagaa

SEQ ID NO: 597783 - DNA, 25 bp, Mus musculus
cctcatatcttttgccagggcagaa

SEQ ID NO: 597784 - DNA, 25 bp, Mus musculus
cctcatcatcatcggtgtcattgtc

SEQ ID NO: 597785 - DNA, 25 bp, Mus musculus
cctcatcatcatgggtgtcattgtc

SEQ ID NO: 597786 - DNA, 25 bp, Mus musculus
cctcatccagccatatggcgaatgg

SEQ ID NO: 597787 - DNA, 25 bp, Mus musculus
cctcatccagccttatggcgaatgg

SEQ ID NO: 597788 - DNA, 25 bp, Mus musculus
cctcatccatagcagtggctggagc

SEQ ID NO: 597789 - DNA, 25 bp, Mus musculus
cctcatccataggagtggctggagc

SEQ ID NO: 597790 - DNA, 25 bp, Mus musculus
cctcatcccagcagttgggagggag

SEQ ID NO: 597791 - DNA, 25 bp, Mus musculus
cctcatcccagctgttgggagggag

SEQ ID NO: 597792 - DNA, 25 bp, Mus musculus
cctcatcctaggcaggaatggagtt

SEQ ID NO: 597793 - DNA, 25 bp, Mus musculus
cctcatcctagggaggaatggagtt

SEQ ID NO: 597794 - DNA, 25 bp, Mus musculus
cctcatccttgtatactcggagaaa

SEQ ID NO: 597795 - DNA, 25 bp, Mus musculus
cctcatccttgtttactcggagaaa

SEQ ID NO: 597796 - DNA, 25 bp, Mus musculus
cctcatcgcacacgtgaccgtaggg

SEQ ID NO: 597797 - DNA, 25 bp, Mus musculus
cctcatcgcacaggtgaccgtaggg

SEQ ID NO: 597798 - DNA, 25 bp, Mus musculus
cctcatcgggtacccgagttgggat

SEQ ID NO: 597799 - DNA, 25 bp, Mus musculus
cctcatcgggtagccgagttgggat

SEQ ID NO: 597800 - DNA, 25 bp, Mus musculus
cctcatcgtggccatctcaatggca

SEQ ID NO: 597801 - DNA, 25 bp, Mus musculus
cctcatcgtggcgatctcaatggca

SEQ ID NO: 597802 - DNA, 25 bp, Mus musculus
cctcatctactactccctgaaggag

SEQ ID NO: 597803 - DNA, 25 bp, Mus musculus
cctcatctactagtccctgaaggag

SEQ ID NO: 597804 - DNA, 25 bp, Mus musculus
cctcatctgaggcaactccacttgg

SEQ ID NO: 597805 - DNA, 25 bp, Mus musculus
cctcatctgagggaactccacttgg

SEQ ID NO: 597806 - DNA, 25 bp, Mus musculus
cctcatctgggcctcagcctttgga

SEQ ID NO: 597807 - DNA, 25 bp, Mus musculus
cctcatctgggcgtcagcctttgga

SEQ ID NO: 597808 - DNA, 25 bp, Mus musculus
cctcatctgtcaatgggaactgctg

SEQ ID NO: 597809 - DNA, 25 bp, Mus musculus
cctcatctgtcattgggaactgctg

SEQ ID NO: 597810 - DNA, 25 bp, Mus musculus
cctcatctttttcagctctaggaat

SEQ ID NO: 597811 - DNA, 25 bp, Mus musculus
cctcatctttttgagctctaggaat

SEQ ID NO: 597812 - DNA, 25 bp, Mus musculus
cctcatgaagtgagtgaaccataaa

SEQ ID NO: 597813 - DNA, 25 bp, Mus musculus
cctcatgaagtgcacctttggcaaa

SEQ ID NO: 597814 - DNA, 25 bp, Mus musculus
cctcatgaagtggacctttggcaaa

SEQ ID NO: 597815 - DNA, 25 bp, Mus musculus
cctcatgaagtgtgtgaaccataaa

SEQ ID NO: 597816 - DNA, 25 bp, Mus musculus
cctcatgacataagactattccacg

SEQ ID NO: 597817 - DNA, 25 bp, Mus musculus
cctcatgacatatgactattccacg

SEQ ID NO: 597818 - DNA, 25 bp, Mus musculus
cctcatgacgaacaatttctatgca

SEQ ID NO: 597819 - DNA, 25 bp, Mus musculus
cctcatgacgaagaatttctatgca

SEQ ID NO: 597820 - DNA, 25 bp, Mus musculus
cctcatgagagtaggatatcaagca

SEQ ID NO: 597821 - DNA, 25 bp, Mus musculus
cctcatgagagttggatatcaagca

SEQ ID NO: 597822 - DNA, 25 bp, Mus musculus
cctcatgagggtcctggactcctac

SEQ ID NO: 597823 - DNA, 25 bp, Mus musculus
cctcatgagggtgctggactcctac

SEQ ID NO: 597824 - DNA, 25 bp, Mus musculus
cctcatgatcctcatatgtgccatg

SEQ ID NO: 597825 - DNA, 25 bp, Mus musculus
cctcatgatcctgatatgtgccatg

SEQ ID NO: 597826 - DNA, 25 bp, Mus musculus
cctcatgattgcctcctgcagtgga

SEQ ID NO: 597827 - DNA, 25 bp, Mus musculus
cctcatgattgcgtcctgcagtgga

SEQ ID NO: 597828 - DNA, 25 bp, Mus musculus
cctcatgcagcccatggatagccat

SEQ ID NO: 597829 - DNA, 25 bp, Mus musculus
cctcatgcagccgatggatagccat

SEQ ID NO: 597830 - DNA, 25 bp, Mus musculus
cctcatggactgcatgaacaagcta

SEQ ID NO: 597831 - DNA, 25 bp, Mus musculus
cctcatggactggatgaacaagcta

SEQ ID NO: 597832 - DNA, 25 bp, Mus musculus
cctcatggatatctgaagccttgtg

SEQ ID NO: 597833 - DNA, 25 bp, Mus musculus
cctcatggatatgtgaagccttgtg

SEQ ID NO: 597834 - DNA, 25 bp, Mus musculus
cctcatggatgcacaggtgaaggcc

SEQ ID NO: 597835 - DNA, 25 bp, Mus musculus
cctcatggatgctcaggtgaaggcc

SEQ ID NO: 597836 - DNA, 25 bp, Mus musculus
cctcatgggagtcggcaccctgatg

SEQ ID NO: 597837 - DNA, 25 bp, Mus musculus
cctcatgggagtgggcaccctgatg

SEQ ID NO: 597838 - DNA, 25 bp, Mus musculus
cctcatggtgtgatggatcctgtcc

SEQ ID NO: 597839 - DNA, 25 bp, Mus musculus
cctcatggtgtgttggatcctgtcc

SEQ ID NO: 597840 - DNA, 25 bp, Mus musculus
cctcatgtcatactgcattgtgctg

SEQ ID NO: 597841 - DNA, 25 bp, Mus musculus
cctcatgtcatagtgcattgtgctg

SEQ ID NO: 597842 - DNA, 25 bp, Mus musculus
cctcatgtgcacactgggcattgtg

SEQ ID NO: 597843 - DNA, 25 bp, Mus musculus
cctcatgtgcactctgggcattgtg

SEQ ID NO: 597844 - DNA, 25 bp, Mus musculus
cctcatgtggaccagtatgaaacca

SEQ ID NO: 597845 - DNA, 25 bp, Mus musculus
cctcatgtggacgagtatgaaacca

SEQ ID NO: 597846 - DNA, 25 bp, Mus musculus
cctcatgttggaccacactgtgcca

SEQ ID NO: 597847 - DNA, 25 bp, Mus musculus
cctcatgttggagcacactgtgcca

SEQ ID NO: 597848 - DNA, 25 bp, Mus musculus
cctcatgtttggcatatttggtgcc

SEQ ID NO: 597849 - DNA, 25 bp, Mus musculus
cctcatgtttgggatatttggtgcc

SEQ ID NO: 597850 - DNA, 25 bp, Mus musculus
cctcattagagcaactccattcaaa

SEQ ID NO: 597851 - DNA, 25 bp, Mus musculus
cctcattagagctactccattcaaa

SEQ ID NO: 597852 - DNA, 25 bp, Mus musculus
cctcattaggatccttgttcttttc

SEQ ID NO: 597853 - DNA, 25 bp, Mus musculus
cctcattaggatgcttgttcttttc

SEQ ID NO: 597854 - DNA, 25 bp, Mus musculus
cctcattatggtctggatcaatgct

SEQ ID NO: 597855 - DNA, 25 bp, Mus musculus
cctcattatggtgtggatcaatgct

SEQ ID NO: 597856 - DNA, 25 bp, Mus musculus
cctcattcgagtcgttgcgtcggcc

SEQ ID NO: 597857 - DNA, 25 bp, Mus musculus
cctcattcgagtggttgcgtcggcc

SEQ ID NO: 597858 - DNA, 25 bp, Mus musculus
cctcattcgtgactgggtagcagca

SEQ ID NO: 597859 - DNA, 25 bp, Mus musculus
cctcattcgtgagtgggtagcagca

SEQ ID NO: 597860 - DNA, 25 bp, Mus musculus
cctcattctagtctgtgcttggcac

SEQ ID NO: 597861 - DNA, 25 bp, Mus musculus
cctcattctagtgtgtgcttggcac

SEQ ID NO: 597862 - DNA, 25 bp, Mus musculus
cctcattgagaaaatcttgaagcag

SEQ ID NO: 597863 - DNA, 25 bp, Mus musculus
cctcattgagaatatcttgaagcag

SEQ ID NO: 597864 - DNA, 25 bp, Mus musculus
cctcattgattaatacctggcagca

SEQ ID NO: 597865 - DNA, 25 bp, Mus musculus
cctcattgattattacctggcagca

SEQ ID NO: 597866 - DNA, 25 bp, Mus musculus
cctcattggaatagcagccattgtg

SEQ ID NO: 597867 - DNA, 25 bp, Mus musculus
cctcattggaattgcagccattgtg

SEQ ID NO: 597868 - DNA, 25 bp, Mus musculus
cctcattgtggccatgtgctgcacc

SEQ ID NO: 597869 - DNA, 25 bp, Mus musculus
cctcattgtggcgatgtgctgcacc

SEQ ID NO: 597870 - DNA, 25 bp, Mus musculus
cctcattgttctcagctgttgtggg

SEQ ID NO: 597871 - DNA, 25 bp, Mus musculus
cctcattgttctgagctgttgtggg

SEQ ID NO: 597872 - DNA, 25 bp, Mus musculus
cctcatttacaaccaaggcttcgag

SEQ ID NO: 597873 - DNA, 25 bp, Mus musculus
cctcatttacaagcaaggcttcgag

SEQ ID NO: 597874 - DNA, 25 bp, Mus musculus
cctcatttctgtctgtacgattgtc

SEQ ID NO: 597875 - DNA, 25 bp, Mus musculus
cctcatttctgtgtgtacgattgtc

SEQ ID NO: 597876 - DNA, 25 bp, Mus musculus
cctcattttcatcgttcaggcagaa

SEQ ID NO: 597877 - DNA, 25 bp, Mus musculus
cctcattttcatggttcaggcagaa

SEQ ID NO: 597878 - DNA, 25 bp, Mus musculus
cctccaaaccaacctgggtatggaa

SEQ ID NO: 597879 - DNA, 25 bp, Mus musculus
cctccaaaccaagctgggtatggaa

SEQ ID NO: 597880 - DNA, 25 bp, Mus musculus
cctccaaagacgcaaaggatgggct

SEQ ID NO: 597881 - DNA, 25 bp, Mus musculus
cctccaaagacggaaaggatgggct

SEQ ID NO: 597882 - DNA, 25 bp, Mus musculus
cctccaaaggatctaagaatcaaaa

SEQ ID NO: 597883 - DNA, 25 bp, Mus musculus
cctccaaaggatgtaagaatcaaaa

SEQ ID NO: 597884 - DNA, 25 bp, Mus musculus
cctccaaagtttatactatcagacc

SEQ ID NO: 597885 - DNA, 25 bp, Mus musculus
cctccaaagtttttactatcagacc

SEQ ID NO: 597886 - DNA, 25 bp, Mus musculus
cctccaagattgaaggtgggcacga

SEQ ID NO: 597887 - DNA, 25 bp, Mus musculus
cctccaagattgtaggtgggcacga

SEQ ID NO: 597888 - DNA, 25 bp, Mus musculus
cctccaaggaaacgagtcaagggca

SEQ ID NO: 597889 - DNA, 25 bp, Mus musculus
cctccaaggaaaggagtcaagggca

SEQ ID NO: 597890 - DNA, 25 bp, Mus musculus
cctccaaggacacttatctaagtca

SEQ ID NO: 597891 - DNA, 25 bp, Mus musculus
cctccaaggacagttatctaagtca

SEQ ID NO: 597892 - DNA, 25 bp, Mus musculus
cctccaagggcactgcctatttgaa

SEQ ID NO: 597893 - DNA, 25 bp, Mus musculus
cctccaagggcagtgcctatttgaa

SEQ ID NO: 597894 - DNA, 25 bp, Mus musculus
cctccaaggtgacgatcttgtcggt

SEQ ID NO: 597895 - DNA, 25 bp, Mus musculus
cctccaaggtgaggatcttgtcggt

SEQ ID NO: 597896 - DNA, 25 bp, Mus musculus
cctccaagtggacagagcacctcat

SEQ ID NO: 597897 - DNA, 25 bp, Mus musculus
cctccaagtggagagagcacctcat

SEQ ID NO: 597898 - DNA, 25 bp, Mus musculus
cctccaagtgggagcccagttccag

SEQ ID NO: 597899 - DNA, 25 bp, Mus musculus
cctccaagtgggtgcccagttccag

SEQ ID NO: 597900 - DNA, 25 bp, Mus musculus
cctccaattcctatgccatcaagaa

SEQ ID NO: 597901 - DNA, 25 bp, Mus musculus
cctccaattcctttgccatcaagaa

SEQ ID NO: 597902 - DNA, 25 bp, Mus musculus
cctccacaaggcatcaagagggtgg

SEQ ID NO: 597903 - DNA, 25 bp, Mus musculus
cctccacaaggcttcaagagggtgg

SEQ ID NO: 597904 - DNA, 25 bp, Mus musculus
cctccacctattcacaatggagaca

SEQ ID NO: 597905 - DNA, 25 bp, Mus musculus
cctccacctattgacaatggagaca

SEQ ID NO: 597906 - DNA, 25 bp, Mus musculus
cctccacggatgatgctgaccaaag

SEQ ID NO: 597907 - DNA, 25 bp, Mus musculus
cctccacggatgttgctgaccaaag

SEQ ID NO: 597908 - DNA, 25 bp, Mus musculus
cctccacgtcagaggatctgcaggg

SEQ ID NO: 597909 - DNA, 25 bp, Mus musculus
cctccacgtcagtggatctgcaggg

SEQ ID NO: 597910 - DNA, 25 bp, Mus musculus
cctccactagccaggcctggttggg

SEQ ID NO: 597911 - DNA, 25 bp, Mus musculus
cctccactagcctggcctggttggg

SEQ ID NO: 597912 - DNA, 25 bp, Mus musculus
cctccactgacaagaggagaatggc

SEQ ID NO: 597913 - DNA, 25 bp, Mus musculus
cctccactgacatgaggagaatggc

SEQ ID NO: 597914 - DNA, 25 bp, Mus musculus
cctccagaatcaaatcgtacagaag

SEQ ID NO: 597915 - DNA, 25 bp, Mus musculus
cctccagaatcatatcgtacagaag

SEQ ID NO: 597916 - DNA, 25 bp, Mus musculus
cctccagaatgacccagggagccag

SEQ ID NO: 597917 - DNA, 25 bp, Mus musculus
cctccagaatgagccagggagccag

SEQ ID NO: 597918 - DNA, 25 bp, Mus musculus
cctccagagctgagggaacctcggg

SEQ ID NO: 597919 - DNA, 25 bp, Mus musculus
cctccagagctgtgggaacctcggg

SEQ ID NO: 597920 - DNA, 25 bp, Mus musculus
cctccagatgttcgtaaaggaatct

SEQ ID NO: 597921 - DNA, 25 bp, Mus musculus
cctccagatgttggtaaaggaatct

SEQ ID NO: 597922 - DNA, 25 bp, Mus musculus
cctccagcaagaaggaatgtcctct

SEQ ID NO: 597923 - DNA, 25 bp, Mus musculus
cctccagcaagatggaatgtcctct

SEQ ID NO: 597924 - DNA, 25 bp, Mus musculus
cctccagcagtacttccagaacggg

SEQ ID NO: 597925 - DNA, 25 bp, Mus musculus
cctccagcagtagttccagaacggg

SEQ ID NO: 597926 - DNA, 25 bp, Mus musculus
cctccagcccagatggagttcctag

SEQ ID NO: 597927 - DNA, 25 bp, Mus musculus
cctccagcccagttggagttcctag

SEQ ID NO: 597928 - DNA, 25 bp, Mus musculus
cctccagctgcccagatggttttaa

SEQ ID NO: 597929 - DNA, 25 bp, Mus musculus
cctccagctgccgagatggttttaa

SEQ ID NO: 597930 - DNA, 25 bp, Mus musculus
cctccaggagaaaatcagtgggaag

SEQ ID NO: 597931 - DNA, 25 bp, Mus musculus
cctccaggagaatatcagtgggaag

SEQ ID NO: 597932 - DNA, 25 bp, Mus musculus
cctccaggccgtcacggtagcagtg

SEQ ID NO: 597933 - DNA, 25 bp, Mus musculus
cctccaggccgtgacggtagcagtg

SEQ ID NO: 597934 - DNA, 25 bp, Mus musculus
cctccaggcgagattaaggaagtct

SEQ ID NO: 597935 - DNA, 25 bp, Mus musculus
cctccaggcgagtttaaggaagtct

SEQ ID NO: 597936 - DNA, 25 bp, Mus musculus
cctccaggctttagtgggtcgccgg

SEQ ID NO: 597937 - DNA, 25 bp, Mus musculus
cctccaggcttttgtgggtcgccgg

SEQ ID NO: 597938 - DNA, 25 bp, Mus musculus
cctccagggaagcatcaggcaacct

SEQ ID NO: 597939 - DNA, 25 bp, Mus musculus
cctccagggaaggatcaggcaacct

SEQ ID NO: 597940 - DNA, 25 bp, Mus musculus
cctccagggacaaagacaattacgt

SEQ ID NO: 597941 - DNA, 25 bp, Mus musculus
cctccagggacatagacaattacgt

SEQ ID NO: 597942 - DNA, 25 bp, Mus musculus
cctccagggaggatgctcatgacca

SEQ ID NO: 597943 - DNA, 25 bp, Mus musculus
cctccagggaggttgctcatgacca

SEQ ID NO: 597944 - DNA, 25 bp, Mus musculus
cctccagggctgaccggagcagctg

SEQ ID NO: 597945 - DNA, 25 bp, Mus musculus
cctccagggctgtccggagcagctg

SEQ ID NO: 597946 - DNA, 25 bp, Mus musculus
cctccagggtgtacgtggaagagca

SEQ ID NO: 597947 - DNA, 25 bp, Mus musculus
cctccagggtgttcgtggaagagca

SEQ ID NO: 597948 - DNA, 25 bp, Mus musculus
cctccagtatgaattgattgggcaa

SEQ ID NO: 597949 - DNA, 25 bp, Mus musculus
cctccagtatgatttgattgggcaa

SEQ ID NO: 597950 - DNA, 25 bp, Mus musculus
cctccagtgaggaaagtagcagtga

SEQ ID NO: 597951 - DNA, 25 bp, Mus musculus
cctccagtgaggtaagtagcagtga

SEQ ID NO: 597952 - DNA, 25 bp, Mus musculus
cctccagtgcggcacgttggcttga

SEQ ID NO: 597953 - DNA, 25 bp, Mus musculus
cctccagtgcgggacgttggcttga

SEQ ID NO: 597954 - DNA, 25 bp, Mus musculus
cctccataatatcaagttgtaggga

SEQ ID NO: 597955 - DNA, 25 bp, Mus musculus
cctccataatatgaagttgtaggga

SEQ ID NO: 597956 - DNA, 25 bp, Mus musculus
cctccataatgtacatgcaaaacct

SEQ ID NO: 597957 - DNA, 25 bp, Mus musculus
cctccataatgttcatgcaaaacct

SEQ ID NO: 597958 - DNA, 25 bp, Mus musculus
cctccataccggactgagctgtatc

SEQ ID NO: 597959 - DNA, 25 bp, Mus musculus
cctccataccggtctgagctgtatc

SEQ ID NO: 597960 - DNA, 25 bp, Mus musculus
cctccatcatcgagaagtggtcgat

SEQ ID NO: 597961 - DNA, 25 bp, Mus musculus
cctccatcatcgtgaagtggtcgat

SEQ ID NO: 597962 - DNA, 25 bp, Mus musculus
cctccatcatgaagatacatacatt

SEQ ID NO: 597963 - DNA, 25 bp, Mus musculus
cctccatcatgatgatacatacatt

SEQ ID NO: 597964 - DNA, 25 bp, Mus musculus
cctccatgaaagaaatgcagggatt

SEQ ID NO: 597965 - DNA, 25 bp, Mus musculus
cctccatgaaagtaatgcagggatt

SEQ ID NO: 597966 - DNA, 25 bp, Mus musculus
cctccatgaacaatgcgctgtatgc

SEQ ID NO: 597967 - DNA, 25 bp, Mus musculus
cctccatgaacattgcgctgtatgc

SEQ ID NO: 597968 - DNA, 25 bp, Mus musculus
cctccatgaggactataagagcaag

SEQ ID NO: 597969 - DNA, 25 bp, Mus musculus
cctccatgaggagtataagagcaag

SEQ ID NO: 597970 - DNA, 25 bp, Mus musculus
cctccatggtgcatgagctcaaccg

SEQ ID NO: 597971 - DNA, 25 bp, Mus musculus
cctccatggtgcttgagctcaaccg

SEQ ID NO: 597972 - DNA, 25 bp, Mus musculus
cctccattgaggctggcccgcaggt

SEQ ID NO: 597973 - DNA, 25 bp, Mus musculus
cctccattgagggtggcccgcaggt

SEQ ID NO: 597974 - DNA, 25 bp, Mus musculus
cctcccaagatgatgtttacacgag

SEQ ID NO: 597975 - DNA, 25 bp, Mus musculus
cctcccaagatgttgtttacacgag

SEQ ID NO: 597976 - DNA, 25 bp, Mus musculus
cctcccaaggtgctaggctgaggcc

SEQ ID NO: 597977 - DNA, 25 bp, Mus musculus
cctcccaaggtggtaggctgaggcc

SEQ ID NO: 597978 - DNA, 25 bp, Mus musculus
cctcccaatgagatgtaaagtttca

SEQ ID NO: 597979 - DNA, 25 bp, Mus musculus
cctcccaatgagttgtaaagtttca

SEQ ID NO: 597980 - DNA, 25 bp, Mus musculus
cctcccaccgtgaagctggaaaatg

SEQ ID NO: 597981 - DNA, 25 bp, Mus musculus
cctcccaccgtgtagctggaaaatg

SEQ ID NO: 597982 - DNA, 25 bp, Mus musculus
cctcccagaagaagacaccaagctc

SEQ ID NO: 597983 - DNA, 25 bp, Mus musculus
cctcccagaagacctggttgaagtg

SEQ ID NO: 597984 - DNA, 25 bp, Mus musculus
cctcccagaagagctggttgaagtg

SEQ ID NO: 597985 - DNA, 25 bp, Mus musculus
cctcccagaagatgacaccaagctc

SEQ ID NO: 597986 - DNA, 25 bp, Mus musculus
cctcccagacaacgtccaggtggaa

SEQ ID NO: 597987 - DNA, 25 bp, Mus musculus
cctcccagacaaggtccaggtggaa

SEQ ID NO: 597988 - DNA, 25 bp, Mus musculus
cctcccagatgcaggcttatctctt

SEQ ID NO: 597989 - DNA, 25 bp, Mus musculus
cctcccagatgctggcttatctctt

SEQ ID NO: 597990 - DNA, 25 bp, Mus musculus
cctcccaggattcatagacttcata

SEQ ID NO: 597991 - DNA, 25 bp, Mus musculus
cctcccaggattgatagacttcata

SEQ ID NO: 597992 - DNA, 25 bp, Mus musculus
cctcccagggcaagatgagggagaa

SEQ ID NO: 597993 - DNA, 25 bp, Mus musculus
cctcccagggcatgatgagggagaa

SEQ ID NO: 597994 - DNA, 25 bp, Mus musculus
cctcccaggtgaccagatggtggcc

SEQ ID NO: 597995 - DNA, 25 bp, Mus musculus
cctcccaggtgagcagatggtggcc

SEQ ID NO: 597996 - DNA, 25 bp, Mus musculus
cctcccagttggaggaaagctgcca

SEQ ID NO: 597997 - DNA, 25 bp, Mus musculus
cctcccagttggtggaaagctgcca

SEQ ID NO: 597998 - DNA, 25 bp, Mus musculus
cctcccataggcatacctgatgaag

SEQ ID NO: 597999 - DNA, 25 bp, Mus musculus
cctcccataggcttacctgatgaag

SEQ ID NO: 598000 - DNA, 25 bp, Mus musculus
cctcccatctacacagaagtcttgg

SEQ ID NO: 598001 - DNA, 25 bp, Mus musculus
cctcccatctactcagaagtcttgg

SEQ ID NO: 598002 - DNA, 25 bp, Mus musculus
cctcccatgaaaacagaacagacat

SEQ ID NO: 598003 - DNA, 25 bp, Mus musculus
cctcccatgaaatcagaacagacat

SEQ ID NO: 598004 - DNA, 25 bp, Mus musculus
cctccccagacaccggagaatgttt

SEQ ID NO: 598005 - DNA, 25 bp, Mus musculus
cctccccagacagcggagaatgttt

SEQ ID NO: 598006 - DNA, 25 bp, Mus musculus
cctccccatcttatttctggtaaag

SEQ ID NO: 598007 - DNA, 25 bp, Mus musculus
cctccccatcttttttctggtaaag

SEQ ID NO: 598008 - DNA, 25 bp, Mus musculus
cctccccggttaagctgcggataca

SEQ ID NO: 598009 - DNA, 25 bp, Mus musculus
cctccccggttatgctgcggataca

SEQ ID NO: 598010 - DNA, 25 bp, Mus musculus
cctccccttagacttgagcatctgt

SEQ ID NO: 598011 - DNA, 25 bp, Mus musculus
cctccccttagagttgagcatctgt

SEQ ID NO: 598012 - DNA, 25 bp, Mus musculus
cctcccgcagggagcggacatggac

SEQ ID NO: 598013 - DNA, 25 bp, Mus musculus
cctcccgcagggtgcggacatggac

SEQ ID NO: 598014 - DNA, 25 bp, Mus musculus
cctccctatgaaatattacacagtg

SEQ ID NO: 598015 - DNA, 25 bp, Mus musculus
cctccctatgaattattacacagtg

SEQ ID NO: 598016 - DNA, 25 bp, Mus musculus
cctccctcatctcagaaggcagagt

SEQ ID NO: 598017 - DNA, 25 bp, Mus musculus
cctccctcatctgagaaggcagagt

SEQ ID NO: 598018 - DNA, 25 bp, Mus musculus
cctccctgacgccatctgtatggtt

SEQ ID NO: 598019 - DNA, 25 bp, Mus musculus
cctccctgacgcgatctgtatggtt

SEQ ID NO: 598020 - DNA, 25 bp, Mus musculus
cctccctgaggaaggtggagtctga

SEQ ID NO: 598021 - DNA, 25 bp, Mus musculus
cctccctgaggatggtggagtctga

SEQ ID NO: 598022 - DNA, 25 bp, Mus musculus
cctccctgaggtcaaggaccgatgc

SEQ ID NO: 598023 - DNA, 25 bp, Mus musculus
cctccctgaggtgaaggaccgatgc

SEQ ID NO: 598024 - DNA, 25 bp, Mus musculus
cctccctgagttagctgggccttgg

SEQ ID NO: 598025 - DNA, 25 bp, Mus musculus
cctccctgagtttgctgggccttgg

SEQ ID NO: 598026 - DNA, 25 bp, Mus musculus
cctccctgcagacggttctatgact

SEQ ID NO: 598027 - DNA, 25 bp, Mus musculus
cctccctgcagagggttctatgact

SEQ ID NO: 598028 - DNA, 25 bp, Mus musculus
cctccctgcatgcatagttctgggc

SEQ ID NO: 598029 - DNA, 25 bp, Mus musculus
cctccctgcatggatagttctgggc

SEQ ID NO: 598030 - DNA, 25 bp, Mus musculus
cctccctgggaaataaacaagtgct

SEQ ID NO: 598031 - DNA, 25 bp, Mus musculus
cctccctgggaattaaacaagtgct

SEQ ID NO: 598032 - DNA, 25 bp, Mus musculus
cctccctgggttcagtatgaatgga

SEQ ID NO: 598033 - DNA, 25 bp, Mus musculus
cctccctgggttgagtatgaatgga

SEQ ID NO: 598034 - DNA, 25 bp, Mus musculus
cctccctttaaccagtgctgctgtg

SEQ ID NO: 598035 - DNA, 25 bp, Mus musculus
cctccctttaacgagtgctgctgtg

SEQ ID NO: 598036 - DNA, 25 bp, Mus musculus
cctccgaagatgagattcacctgtg

SEQ ID NO: 598037 - DNA, 25 bp, Mus musculus
cctccgaagatgtgattcacctgtg

SEQ ID NO: 598038 - DNA, 25 bp, Mus musculus
cctccgaagcaaagcatctgggtca

SEQ ID NO: 598039 - DNA, 25 bp, Mus musculus
cctccgaagcaatgcatctgggtca

SEQ ID NO: 598040 - DNA, 25 bp, Mus musculus
cctccgaagcgaagatggtggacta

SEQ ID NO: 598041 - DNA, 25 bp, Mus musculus
cctccgaagcgatgatggtggacta

SEQ ID NO: 598042 - DNA, 25 bp, Mus musculus
cctccgaagtagctgggatcaccgt

SEQ ID NO: 598043 - DNA, 25 bp, Mus musculus
cctccgaagtaggtgggatcaccgt

SEQ ID NO: 598044 - DNA, 25 bp, Mus musculus
cctccgagcggaagctgaaaaggct

SEQ ID NO: 598045 - DNA, 25 bp, Mus musculus
cctccgagcggatgctgaaaaggct

SEQ ID NO: 598046 - DNA, 25 bp, Mus musculus
cctccgagtgctcttttgaatatct

SEQ ID NO: 598047 - DNA, 25 bp, Mus musculus
cctccgagtgctgttttgaatatct

SEQ ID NO: 598048 - DNA, 25 bp, Mus musculus
cctccgatagatagagttaatccgt

SEQ ID NO: 598049 - DNA, 25 bp, Mus musculus
cctccgatagattgagttaatccgt

SEQ ID NO: 598050 - DNA, 25 bp, Mus musculus
cctccgcagagacaaagatcggagg

SEQ ID NO: 598051 - DNA, 25 bp, Mus musculus
cctccgcagagagaaagatcggagg

SEQ ID NO: 598052 - DNA, 25 bp, Mus musculus
cctccgccttttcgatcagggtggg

SEQ ID NO: 598053 - DNA, 25 bp, Mus musculus
cctccgccttttggatcagggtggg

SEQ ID NO: 598054 - DNA, 25 bp, Mus musculus
cctccgctgcctacctgtgggtggg

SEQ ID NO: 598055 - DNA, 25 bp, Mus musculus
cctccgctgccttcctgtgggtggg

SEQ ID NO: 598056 - DNA, 25 bp, Mus musculus
cctccggatcccactcatgtggaag

SEQ ID NO: 598057 - DNA, 25 bp, Mus musculus
cctccggatccctctcatgtggaag

SEQ ID NO: 598058 - DNA, 25 bp, Mus musculus
cctccggatgtacagcagcagtatt

SEQ ID NO: 598059 - DNA, 25 bp, Mus musculus
cctccggatgtagagcagcagtatt

SEQ ID NO: 598060 - DNA, 25 bp, Mus musculus
cctccggccaggctggacagagtca

SEQ ID NO: 598061 - DNA, 25 bp, Mus musculus
cctccggccagggtggacagagtca

SEQ ID NO: 598062 - DNA, 25 bp, Mus musculus
cctccggccgcactaggttattgga

SEQ ID NO: 598063 - DNA, 25 bp, Mus musculus
cctccggccgcagtaggttattgga

SEQ ID NO: 598064 - DNA, 25 bp, Mus musculus
cctccggccttacgagagtcgcaga

SEQ ID NO: 598065 - DNA, 25 bp, Mus musculus
cctccggccttaggagagtcgcaga

SEQ ID NO: 598066 - DNA, 25 bp, Mus musculus
cctccgggaggaaagatcaatcgtc

SEQ ID NO: 598067 - DNA, 25 bp, Mus musculus
cctccgggaggatagatcaatcgtc

SEQ ID NO: 598068 - DNA, 25 bp, Mus musculus
cctccgggtggcacggagctttcag

SEQ ID NO: 598069 - DNA, 25 bp, Mus musculus
cctccgggtggctcggagctttcag

SEQ ID NO: 598070 - DNA, 25 bp, Mus musculus
cctccggtacatcaagcaggacttc

SEQ ID NO: 598071 - DNA, 25 bp, Mus musculus
cctccggtacatgaagcaggacttc

SEQ ID NO: 598072 - DNA, 25 bp, Mus musculus
cctccggtgtgaacaagcatcagca

SEQ ID NO: 598073 - DNA, 25 bp, Mus musculus
cctccggtgtgatcaagcatcagca

SEQ ID NO: 598074 - DNA, 25 bp, Mus musculus
cctccgtcctgtagctggcttactg

SEQ ID NO: 598075 - DNA, 25 bp, Mus musculus
cctccgtcctgttgctggcttactg

SEQ ID NO: 598076 - DNA, 25 bp, Mus musculus
cctccgtcggttctcaatgaaaaag

SEQ ID NO: 598077 - DNA, 25 bp, Mus musculus
cctccgtcggttgtcaatgaaaaag

SEQ ID NO: 598078 - DNA, 25 bp, Mus musculus
cctccgtggtgacttggcatcgctt

SEQ ID NO: 598079 - DNA, 25 bp, Mus musculus
cctccgtggtgagttggcatcgctt

SEQ ID NO: 598080 - DNA, 25 bp, Mus musculus
cctccgttgtggacagaggaactct

SEQ ID NO: 598081 - DNA, 25 bp, Mus musculus
cctccgttgtggtcagaggaactct

SEQ ID NO: 598082 - DNA, 25 bp, Mus musculus
cctcctaaccgtcagagtgagtttg

SEQ ID NO: 598083 - DNA, 25 bp, Mus musculus
cctcctaaccgtgagagtgagtttg

SEQ ID NO: 598084 - DNA, 25 bp, Mus musculus
cctcctaaggaacgtgagtatcatc

SEQ ID NO: 598085 - DNA, 25 bp, Mus musculus
cctcctaaggaaggtgagtatcatc

SEQ ID NO: 598086 - DNA, 25 bp, Mus musculus
cctcctacatgccaattctccagcg

SEQ ID NO: 598087 - DNA, 25 bp, Mus musculus
cctcctacatgcgaattctccagcg

SEQ ID NO: 598088 - DNA, 25 bp, Mus musculus
cctcctaccagaagcgtagctttgg

SEQ ID NO: 598089 - DNA, 25 bp, Mus musculus
cctcctaccagatgcgtagctttgg

SEQ ID NO: 598090 - DNA, 25 bp, Mus musculus
cctcctactcggataccatctgtaa

SEQ ID NO: 598091 - DNA, 25 bp, Mus musculus
cctcctactcggttaccatctgtaa

SEQ ID NO: 598092 - DNA, 25 bp, Mus musculus
cctcctagagaacgacattatcact

SEQ ID NO: 598093 - DNA, 25 bp, Mus musculus
cctcctagagaaggacattatcact

SEQ ID NO: 598094 - DNA, 25 bp, Mus musculus
cctcctaggagtaacaggaatatga

SEQ ID NO: 598095 - DNA, 25 bp, Mus musculus
cctcctaggagttacaggaatatga

SEQ ID NO: 598096 - DNA, 25 bp, Mus musculus
cctcctatgcagaccagatgttcct

SEQ ID NO: 598097 - DNA, 25 bp, Mus musculus
cctcctatgcagtccagatgttcct

SEQ ID NO: 598098 - DNA, 25 bp, Mus musculus
cctcctatgtcaaaaccagggcaag

SEQ ID NO: 598099 - DNA, 25 bp, Mus musculus
cctcctatgtcataaccagggcaag

SEQ ID NO: 598100 - DNA, 25 bp, Mus musculus
cctcctcactggagcttcctgctgt

SEQ ID NO: 598101 - DNA, 25 bp, Mus musculus
cctcctcactggtgcttcctgctgt

SEQ ID NO: 598102 - DNA, 25 bp, Mus musculus
cctcctcacttgattcagttgaaag

SEQ ID NO: 598103 - DNA, 25 bp, Mus musculus
cctcctcacttgtttcagttgaaag

SEQ ID NO: 598104 - DNA, 25 bp, Mus musculus
cctcctcagagccttcatagggaat

SEQ ID NO: 598105 - DNA, 25 bp, Mus musculus
cctcctcagagcgttcatagggaat

SEQ ID NO: 598106 - DNA, 25 bp, Mus musculus
cctcctcagattcttggaatgtggg

SEQ ID NO: 598107 - DNA, 25 bp, Mus musculus
cctcctcagattgttggaatgtggg

SEQ ID NO: 598108 - DNA, 25 bp, Mus musculus
cctcctcagcagaggctgtataggg

SEQ ID NO: 598109 - DNA, 25 bp, Mus musculus
cctcctcagcagtggctgtataggg

SEQ ID NO: 598110 - DNA, 25 bp, Mus musculus
cctcctcatcttattcagctctagg

SEQ ID NO: 598111 - DNA, 25 bp, Mus musculus
cctcctcatctttttcagctctagg

SEQ ID NO: 598112 - DNA, 25 bp, Mus musculus
cctcctcatgaaccttgacatttgg

SEQ ID NO: 598113 - DNA, 25 bp, Mus musculus
cctcctcatgaagcttgacatttgg

SEQ ID NO: 598114 - DNA, 25 bp, Mus musculus
cctcctcatttgcttcatagcgtac

SEQ ID NO: 598115 - DNA, 25 bp, Mus musculus
cctcctcatttggttcatagcgtac

SEQ ID NO: 598116 - DNA, 25 bp, Mus musculus
cctcctccaaaccaagctgggtatg

SEQ ID NO: 598117 - DNA, 25 bp, Mus musculus
cctcctccaaacgaagctgggtatg

SEQ ID NO: 598118 - DNA, 25 bp, Mus musculus
cctcctccgaagcaatgcatctggg

SEQ ID NO: 598119 - DNA, 25 bp, Mus musculus
cctcctccgaaggaatgcatctggg

SEQ ID NO: 598120 - DNA, 25 bp, Mus musculus
cctcctcctcacatgattcagttga

SEQ ID NO: 598121 - DNA, 25 bp, Mus musculus
cctcctcctcacttgattcagttga

SEQ ID NO: 598122 - DNA, 25 bp, Mus musculus
cctcctcctctacatattggcttga

SEQ ID NO: 598123 - DNA, 25 bp, Mus musculus
cctcctcctctagatattggcttga

SEQ ID NO: 598124 - DNA, 25 bp, Mus musculus
cctcctcctggtagcatggttcaag

SEQ ID NO: 598125 - DNA, 25 bp, Mus musculus
cctcctcctggttgcatggttcaag

SEQ ID NO: 598126 - DNA, 25 bp, Mus musculus
cctcctccttgcaggtgggaatcct

SEQ ID NO: 598127 - DNA, 25 bp, Mus musculus
cctcctccttgctggtgggaatcct

SEQ ID NO: 598128 - DNA, 25 bp, Mus musculus
cctcctcgcaggacaatggagacga

SEQ ID NO: 598129 - DNA, 25 bp, Mus musculus
cctcctcgcaggtcaatggagacga

SEQ ID NO: 598130 - DNA, 25 bp, Mus musculus
cctcctcgcattaggctgtaagaag

SEQ ID NO: 598131 - DNA, 25 bp, Mus musculus
cctcctcgcatttggctgtaagaag

SEQ ID NO: 598132 - DNA, 25 bp, Mus musculus
cctcctctaggtagatcatgatcca

SEQ ID NO: 598133 - DNA, 25 bp, Mus musculus
cctcctctaggttgatcatgatcca

SEQ ID NO: 598134 - DNA, 25 bp, Mus musculus
cctcctctatggacacaaagtcgcg

SEQ ID NO: 598135 - DNA, 25 bp, Mus musculus
cctcctctatggtcacaaagtcgcg

SEQ ID NO: 598136 - DNA, 25 bp, Mus musculus
cctcctctgctcaagtgggaagtgg

SEQ ID NO: 598137 - DNA, 25 bp, Mus musculus
cctcctctgctctagtgggaagtgg

SEQ ID NO: 598138 - DNA, 25 bp, Mus musculus
cctcctctttgcctgcactattgtg

SEQ ID NO: 598139 - DNA, 25 bp, Mus musculus
cctcctctttgcgtgcactattgtg

SEQ ID NO: 598140 - DNA, 25 bp, Mus musculus
cctcctgagccgatttgtggatggg

SEQ ID NO: 598141 - DNA, 25 bp, Mus musculus
cctcctgagccgttttgtggatggg

SEQ ID NO: 598142 - DNA, 25 bp, Mus musculus
cctcctgagctcagtcgatttggaa

SEQ ID NO: 598143 - DNA, 25 bp, Mus musculus
cctcctgagctctgtcgatttggaa

SEQ ID NO: 598144 - DNA, 25 bp, Mus musculus
cctcctgaggacatgcatgacaagt

SEQ ID NO: 598145 - DNA, 25 bp, Mus musculus
cctcctgaggacttgcatgacaagt

SEQ ID NO: 598146 - DNA, 25 bp, Mus musculus
cctcctgagtgccagctcagagcag

SEQ ID NO: 598147 - DNA, 25 bp, Mus musculus
cctcctgagtgcgagctcagagcag

SEQ ID NO: 598148 - DNA, 25 bp, Mus musculus
cctcctgagttgctggacgtcatca

SEQ ID NO: 598149 - DNA, 25 bp, Mus musculus
cctcctgagttggtggacgtcatca

SEQ ID NO: 598150 - DNA, 25 bp, Mus musculus
cctcctgagtttcttcagaagctac

SEQ ID NO: 598151 - DNA, 25 bp, Mus musculus
cctcctgagtttgttcagaagctac

SEQ ID NO: 598152 - DNA, 25 bp, Mus musculus
cctcctgatgagaccatggactttg

SEQ ID NO: 598153 - DNA, 25 bp, Mus musculus
cctcctgatgagtccatggactttg

SEQ ID NO: 598154 - DNA, 25 bp, Mus musculus
cctcctgattgcagagactgtgcca

SEQ ID NO: 598155 - DNA, 25 bp, Mus musculus
cctcctgattgctgagactgtgcca

SEQ ID NO: 598156 - DNA, 25 bp, Mus musculus
cctcctgcaagaaaaacagcggaaa

SEQ ID NO: 598157 - DNA, 25 bp, Mus musculus
cctcctgcaagataaacagcggaaa

SEQ ID NO: 598158 - DNA, 25 bp, Mus musculus
cctcctgcacacaggacagaagatg

SEQ ID NO: 598159 - DNA, 25 bp, Mus musculus
cctcctgcacactggacagaagatg

SEQ ID NO: 598160 - DNA, 25 bp, Mus musculus
cctcctgcagatacggtcctatgtg

SEQ ID NO: 598161 - DNA, 25 bp, Mus musculus
cctcctgcagattcggtcctatgtg

SEQ ID NO: 598162 - DNA, 25 bp, Mus musculus
cctcctgcagttcactttgctcatg

SEQ ID NO: 598163 - DNA, 25 bp, Mus musculus
cctcctgcagttgactttgctcatg

SEQ ID NO: 598164 - DNA, 25 bp, Mus musculus
cctcctgccagaaggcgaaggtctc

SEQ ID NO: 598165 - DNA, 25 bp, Mus musculus
cctcctgccagatggcgaaggtctc

SEQ ID NO: 598166 - DNA, 25 bp, Mus musculus
cctcctgctgtgaccgtggcagagg

SEQ ID NO: 598167 - DNA, 25 bp, Mus musculus
cctcctgctgtgtccgtggcagagg

SEQ ID NO: 598168 - DNA, 25 bp, Mus musculus
cctcctggaagtacccaggcaaaag

SEQ ID NO: 598169 - DNA, 25 bp, Mus musculus
cctcctggaagttcccaggcaaaag

SEQ ID NO: 598170 - DNA, 25 bp, Mus musculus
cctcctggagcacgatagtgcccga

SEQ ID NO: 598171 - DNA, 25 bp, Mus musculus
cctcctggagcaggatagtgcccga

SEQ ID NO: 598172 - DNA, 25 bp, Mus musculus
cctcctggagcgagaatataagcat

SEQ ID NO: 598173 - DNA, 25 bp, Mus musculus
cctcctggagcgtgaatataagcat

SEQ ID NO: 598174 - DNA, 25 bp, Mus musculus
cctcctggcatgaggtgatcggcga

SEQ ID NO: 598175 - DNA, 25 bp, Mus musculus
cctcctggcatgtggtgatcggcga

SEQ ID NO: 598176 - DNA, 25 bp, Mus musculus
cctcctggcggaagctggctttgat

SEQ ID NO: 598177 - DNA, 25 bp, Mus musculus
cctcctggcggatgctggctttgat

SEQ ID NO: 598178 - DNA, 25 bp, Mus musculus
cctcctggttcgcaatgtcagctat

SEQ ID NO: 598179 - DNA, 25 bp, Mus musculus
cctcctggttcggaatgtcagctat

SEQ ID NO: 598180 - DNA, 25 bp, Mus musculus
cctcctgtaggtcaaaattctgttc

SEQ ID NO: 598181 - DNA, 25 bp, Mus musculus
cctcctgtaggtgaaaattctgttc

SEQ ID NO: 598182 - DNA, 25 bp, Mus musculus
cctcctgtgcaacagaattttgacg

SEQ ID NO: 598183 - DNA, 25 bp, Mus musculus
cctcctgtgcaagagaattttgacg

SEQ ID NO: 598184 - DNA, 25 bp, Mus musculus
cctcctgtgcataatgatggagacc

SEQ ID NO: 598185 - DNA, 25 bp, Mus musculus
cctcctgtgcattatgatggagacc

SEQ ID NO: 598186 - DNA, 25 bp, Mus musculus
cctcctgtggagcttctcactggag

SEQ ID NO: 598187 - DNA, 25 bp, Mus musculus
cctcctgtggaggttctcactggag

SEQ ID NO: 598188 - DNA, 25 bp, Mus musculus
cctcctgttacaagtcggatatcga

SEQ ID NO: 598189 - DNA, 25 bp, Mus musculus
cctcctgttacatgtcggatatcga

SEQ ID NO: 598190 - DNA, 25 bp, Mus musculus
cctcctgttccgagtccttgctaag

SEQ ID NO: 598191 - DNA, 25 bp, Mus musculus
cctcctgttccgtgtccttgctaag

SEQ ID NO: 598192 - DNA, 25 bp, Mus musculus
cctccttaggagcaacgacattgac

SEQ ID NO: 598193 - DNA, 25 bp, Mus musculus
cctccttaggaggaacgacattgac

SEQ ID NO: 598194 - DNA, 25 bp, Mus musculus
cctccttagtggaagcttttgtctg

SEQ ID NO: 598195 - DNA, 25 bp, Mus musculus
cctccttagtggtagcttttgtctg

SEQ ID NO: 598196 - DNA, 25 bp, Mus musculus
cctccttatcttaggccaaaagtgt

SEQ ID NO: 598197 - DNA, 25 bp, Mus musculus
cctccttatctttggccaaaagtgt

SEQ ID NO: 598198 - DNA, 25 bp, Mus musculus
cctccttattcaaggaacggcagat

SEQ ID NO: 598199 - DNA, 25 bp, Mus musculus
cctccttattcatggaacggcagat

SEQ ID NO: 598200 - DNA, 25 bp, Mus musculus
cctccttcagaaccatgatgacttt

SEQ ID NO: 598201 - DNA, 25 bp, Mus musculus
cctccttcagaagcatgatgacttt

SEQ ID NO: 598202 - DNA, 25 bp, Mus musculus
cctccttcagacctcaaattcaaag

SEQ ID NO: 598203 - DNA, 25 bp, Mus musculus
cctccttcagacgtcaaattcaaag

SEQ ID NO: 598204 - DNA, 25 bp, Mus musculus
cctccttcctcacgcgtagaggaga

SEQ ID NO: 598205 - DNA, 25 bp, Mus musculus
cctccttcctcaggcgtagaggaga

SEQ ID NO: 598206 - DNA, 25 bp, Mus musculus
cctccttctctaactgggtgcttaa

SEQ ID NO: 598207 - DNA, 25 bp, Mus musculus
cctccttctctatctgggtgcttaa

SEQ ID NO: 598208 - DNA, 25 bp, Mus musculus
cctccttctgtactctgtttgagta

SEQ ID NO: 598209 - DNA, 25 bp, Mus musculus
cctccttctgtagtctgtttgagta

SEQ ID NO: 598210 - DNA, 25 bp, Mus musculus
cctccttcttttagtctgcagagcc

SEQ ID NO: 598211 - DNA, 25 bp, Mus musculus
cctccttctttttgtctgcagagcc

SEQ ID NO: 598212 - DNA, 25 bp, Mus musculus
cctccttgcaggagggaatcctaga

SEQ ID NO: 598213 - DNA, 25 bp, Mus musculus
cctccttgcaggtgggaatcctaga

SEQ ID NO: 598214 - DNA, 25 bp, Mus musculus
cctccttgctggatgactggtccat

SEQ ID NO: 598215 - DNA, 25 bp, Mus musculus
cctccttgctggttgactggtccat

SEQ ID NO: 598216 - DNA, 25 bp, Mus musculus
cctccttggagcagttctcgcgaga

SEQ ID NO: 598217 - DNA, 25 bp, Mus musculus
cctccttggagctgttctcgcgaga

SEQ ID NO: 598218 - DNA, 25 bp, Mus musculus
cctccttggtggatgagatcgctct

SEQ ID NO: 598219 - DNA, 25 bp, Mus musculus
cctccttggtggttgagatcgctct

SEQ ID NO: 598220 - DNA, 25 bp, Mus musculus
cctccttgtgtgaatcttatgggca

SEQ ID NO: 598221 - DNA, 25 bp, Mus musculus
cctccttgtgtgtatcttatgggca

SEQ ID NO: 598222 - DNA, 25 bp, Mus musculus
cctcctttgaggaactgaattcatt

SEQ ID NO: 598223 - DNA, 25 bp, Mus musculus
cctcctttgaggtactgaattcatt

SEQ ID NO: 598224 - DNA, 25 bp, Mus musculus
cctcctttggcaagtattgcatgtt

SEQ ID NO: 598225 - DNA, 25 bp, Mus musculus
cctcctttggcatgtattgcatgtt

SEQ ID NO: 598226 - DNA, 25 bp, Mus musculus
cctcctttgggaaagcgacagaaag

SEQ ID NO: 598227 - DNA, 25 bp, Mus musculus
cctcctttgggatagcgacagaaag

SEQ ID NO: 598228 - DNA, 25 bp, Mus musculus
cctccttttgttaggcagctctttt

SEQ ID NO: 598229 - DNA, 25 bp, Mus musculus
cctccttttgtttggcagctctttt

SEQ ID NO: 598230 - DNA, 25 bp, Mus musculus
cctcgaaaacagatgaaagctctgc

SEQ ID NO: 598231 - DNA, 25 bp, Mus musculus
cctcgaaaacagttgaaagctctgc

SEQ ID NO: 598232 - DNA, 25 bp, Mus musculus
cctcgaagggagactgcgaccggac

SEQ ID NO: 598233 - DNA, 25 bp, Mus musculus
cctcgaagggagtctgcgaccggac

SEQ ID NO: 598234 - DNA, 25 bp, Mus musculus
cctcgaagtgggatacagcaagcac

SEQ ID NO: 598235 - DNA, 25 bp, Mus musculus
cctcgaagtgggttacagcaagcac

SEQ ID NO: 598236 - DNA, 25 bp, Mus musculus
cctcgaatgatcaaggtggcggatt

SEQ ID NO: 598237 - DNA, 25 bp, Mus musculus
cctcgaatgatcctgcgttgcagaa

SEQ ID NO: 598238 - DNA, 25 bp, Mus musculus
cctcgaatgatcgtgcgttgcagaa

SEQ ID NO: 598239 - DNA, 25 bp, Mus musculus
cctcgaatgatctaggtggcggatt

SEQ ID NO: 598240 - DNA, 25 bp, Mus musculus
cctcgacagctacagtcattaattc

SEQ ID NO: 598241 - DNA, 25 bp, Mus musculus
cctcgacagctagagtcattaattc

SEQ ID NO: 598242 - DNA, 25 bp, Mus musculus
cctcgagaaatgctcagatttcact

SEQ ID NO: 598243 - DNA, 25 bp, Mus musculus
cctcgagaaatggtcagatttcact

SEQ ID NO: 598244 - DNA, 25 bp, Mus musculus
cctcgagaccccatcaggatctgaa

SEQ ID NO: 598245 - DNA, 25 bp, Mus musculus
cctcgagaccccttcaggatctgaa

SEQ ID NO: 598246 - DNA, 25 bp, Mus musculus
cctcgagccgctagatgaagatctc

SEQ ID NO: 598247 - DNA, 25 bp, Mus musculus
cctcgagccgcttgatgaagatctc

SEQ ID NO: 598248 - DNA, 25 bp, Mus musculus
cctcgagcttcgcagtgacatgtac

SEQ ID NO: 598249 - DNA, 25 bp, Mus musculus
cctcgagcttcggagtgacatgtac

SEQ ID NO: 598250 - DNA, 25 bp, Mus musculus
cctcgagggttcaatggcacatttg

SEQ ID NO: 598251 - DNA, 25 bp, Mus musculus
cctcgagggttctatggcacatttg

SEQ ID NO: 598252 - DNA, 25 bp, Mus musculus
cctcgagtggtcatgtctacccaca

SEQ ID NO: 598253 - DNA, 25 bp, Mus musculus
cctcgagtggtcttgtctacccaca

SEQ ID NO: 598254 - DNA, 25 bp, Mus musculus
cctcgatccagaagctgaacgttga

SEQ ID NO: 598255 - DNA, 25 bp, Mus musculus
cctcgatccagatgctgaacgttga

SEQ ID NO: 598256 - DNA, 25 bp, Mus musculus
cctcgatccggaagaccaaaggaga

SEQ ID NO: 598257 - DNA, 25 bp, Mus musculus
cctcgatccggatgaccaaaggaga

SEQ ID NO: 598258 - DNA, 25 bp, Mus musculus
cctcgatgtgacagtggagggactc

SEQ ID NO: 598259 - DNA, 25 bp, Mus musculus
cctcgatgtgactgtggagggactc

SEQ ID NO: 598260 - DNA, 25 bp, Mus musculus
cctcgattaatcagcccaaagttgt

SEQ ID NO: 598261 - DNA, 25 bp, Mus musculus
cctcgattaatctgcccaaagttgt

SEQ ID NO: 598262 - DNA, 25 bp, Mus musculus
cctcgatttaggcagtgtgtcaaca

SEQ ID NO: 598263 - DNA, 25 bp, Mus musculus
cctcgatttagggagtgtgtcaaca

SEQ ID NO: 598264 - DNA, 25 bp, Mus musculus
cctcgcacgattcgcagggagactg

SEQ ID NO: 598265 - DNA, 25 bp, Mus musculus
cctcgcacgattggcagggagactg

SEQ ID NO: 598266 - DNA, 25 bp, Mus musculus
cctcgccaggagattgacacaatgg

SEQ ID NO: 598267 - DNA, 25 bp, Mus musculus
cctcgccaggagtttgacacaatgg

SEQ ID NO: 598268 - DNA, 25 bp, Mus musculus
cctcgcgacgctagcgcactaggga

SEQ ID NO: 598269 - DNA, 25 bp, Mus musculus
cctcgcgacgcttgcgcactaggga

SEQ ID NO: 598270 - DNA, 25 bp, Mus musculus
cctcgcgagcggagttgactaccga

SEQ ID NO: 598271 - DNA, 25 bp, Mus musculus
cctcgcgagcggtgttgactaccga

SEQ ID NO: 598272 - DNA, 25 bp, Mus musculus
cctcgcgtagaacccggttgtcaga

SEQ ID NO: 598273 - DNA, 25 bp, Mus musculus
cctcgcgtagaagccggttgtcaga

SEQ ID NO: 598274 - DNA, 25 bp, Mus musculus
cctcgctaggttacacagtggtgaa

SEQ ID NO: 598275 - DNA, 25 bp, Mus musculus
cctcgctaggtttcacagtggtgaa

SEQ ID NO: 598276 - DNA, 25 bp, Mus musculus
cctcgctatcggctggcttacaaga

SEQ ID NO: 598277 - DNA, 25 bp, Mus musculus
cctcgctatcgggtggcttacaaga

SEQ ID NO: 598278 - DNA, 25 bp, Mus musculus
cctcgctatttgcaggtcagtaaaa

SEQ ID NO: 598279 - DNA, 25 bp, Mus musculus
cctcgctatttggaggtcagtaaaa

SEQ ID NO: 598280 - DNA, 25 bp, Mus musculus
cctcgctcgagacagcagcgagctg

SEQ ID NO: 598281 - DNA, 25 bp, Mus musculus
cctcgctcgagacggcaggatcaag

SEQ ID NO: 598282 - DNA, 25 bp, Mus musculus
cctcgctcgagagagcagcgagctg

SEQ ID NO: 598283 - DNA, 25 bp, Mus musculus
cctcgctcgagagggcaggatcaag

SEQ ID NO: 598284 - DNA, 25 bp, Mus musculus
cctcgctcgggacttcgcagagcgt

SEQ ID NO: 598285 - DNA, 25 bp, Mus musculus
cctcgctcgggagttcgcagagcgt

SEQ ID NO: 598286 - DNA, 25 bp, Mus musculus
cctcgcttaataagacgtttgtcct

SEQ ID NO: 598287 - DNA, 25 bp, Mus musculus
cctcgcttaatatgacgtttgtcct

SEQ ID NO: 598288 - DNA, 25 bp, Mus musculus
cctcgcttgaaccaggaagcagcgg

SEQ ID NO: 598289 - DNA, 25 bp, Mus musculus
cctcgcttgaacgaggaagcagcgg

SEQ ID NO: 598290 - DNA, 25 bp, Mus musculus
cctcggaacagtaggtatgatgaca

SEQ ID NO: 598291 - DNA, 25 bp, Mus musculus
cctcggaacagttggtatgatgaca

SEQ ID NO: 598292 - DNA, 25 bp, Mus musculus
cctcggaagcagaggttgagccttg

SEQ ID NO: 598293 - DNA, 25 bp, Mus musculus
cctcggaagcagtggttgagccttg

SEQ ID NO: 598294 - DNA, 25 bp, Mus musculus
cctcggaagtctcgaagtccaagat

SEQ ID NO: 598295 - DNA, 25 bp, Mus musculus
cctcggaagtctggaagtccaagat

SEQ ID NO: 598296 - DNA, 25 bp, Mus musculus
cctcggaatcggagtggctgagtca

SEQ ID NO: 598297 - DNA, 25 bp, Mus musculus
cctcggaatcggtgtggctgagtca

SEQ ID NO: 598298 - DNA, 25 bp, Mus musculus
cctcggaattccaggcagggtggca

SEQ ID NO: 598299 - DNA, 25 bp, Mus musculus
cctcggaattcctggcagggtggca

SEQ ID NO: 598300 - DNA, 25 bp, Mus musculus
cctcggacacaacgaaggctcgtga

SEQ ID NO: 598301 - DNA, 25 bp, Mus musculus
cctcggacacaaggaaggctcgtga

SEQ ID NO: 598302 - DNA, 25 bp, Mus musculus
cctcggacatcacggtggcatggct

SEQ ID NO: 598303 - DNA, 25 bp, Mus musculus
cctcggacatcagggtggcatggct

SEQ ID NO: 598304 - DNA, 25 bp, Mus musculus
cctcggacgtggaccaggagatcca

SEQ ID NO: 598305 - DNA, 25 bp, Mus musculus
cctcggacgtggtccaggagatcca

SEQ ID NO: 598306 - DNA, 25 bp, Mus musculus
cctcggataataaagacacatcttc

SEQ ID NO: 598307 - DNA, 25 bp, Mus musculus
cctcggataatatagacacatcttc

SEQ ID NO: 598308 - DNA, 25 bp, Mus musculus
cctcggatgagcacaggagcgaaag

SEQ ID NO: 598309 - DNA, 25 bp, Mus musculus
cctcggatgagctcaggagcgaaag

SEQ ID NO: 598310 - DNA, 25 bp, Mus musculus
cctcggattaaaatgtggaaagatg

SEQ ID NO: 598311 - DNA, 25 bp, Mus musculus
cctcggattaaattgtggaaagatg

SEQ ID NO: 598312 - DNA, 25 bp, Mus musculus
cctcggcaagctatgggcgctggta

SEQ ID NO: 598313 - DNA, 25 bp, Mus musculus
cctcggcaagctttgggcgctggta

SEQ ID NO: 598314 - DNA, 25 bp, Mus musculus
cctcggcactaaagatctggaaggg

SEQ ID NO: 598315 - DNA, 25 bp, Mus musculus
cctcggcactaatgatctggaaggg

SEQ ID NO: 598316 - DNA, 25 bp, Mus musculus
cctcggcagcgactgactggaacac

SEQ ID NO: 598317 - DNA, 25 bp, Mus musculus
cctcggcagcgagtgactggaacac

SEQ ID NO: 598318 - DNA, 25 bp, Mus musculus
cctcggcaggaactgtgcaaagctg

SEQ ID NO: 598319 - DNA, 25 bp, Mus musculus
cctcggcaggaagtgtgcaaagctg

SEQ ID NO: 598320 - DNA, 25 bp, Mus musculus
cctcggcatcatccacatgctgttt

SEQ ID NO: 598321 - DNA, 25 bp, Mus musculus
cctcggcatcatgcacatgctgttt

SEQ ID NO: 598322 - DNA, 25 bp, Mus musculus
cctcggccagatccgctcatgaagg

SEQ ID NO: 598323 - DNA, 25 bp, Mus musculus
cctcggccagatgcgctcatgaagg

SEQ ID NO: 598324 - DNA, 25 bp, Mus musculus
cctcggccagtgctgccttctggaa

SEQ ID NO: 598325 - DNA, 25 bp, Mus musculus
cctcggccagtggtgccttctggaa

SEQ ID NO: 598326 - DNA, 25 bp, Mus musculus
cctcggcccaacaaaatggcgtcgg

SEQ ID NO: 598327 - DNA, 25 bp, Mus musculus
cctcggcccaactaaatggcgtcgg

SEQ ID NO: 598328 - DNA, 25 bp, Mus musculus
cctcggcggcttacgtccggatgga

SEQ ID NO: 598329 - DNA, 25 bp, Mus musculus
cctcggcggctttcgtccggatgga

SEQ ID NO: 598330 - DNA, 25 bp, Mus musculus
cctcggctaaagcacatcaacaaag

SEQ ID NO: 598331 - DNA, 25 bp, Mus musculus
cctcggctaaaggacatcaacaaag

SEQ ID NO: 598332 - DNA, 25 bp, Mus musculus
cctcggctcaccagaaactctgtgt

SEQ ID NO: 598333 - DNA, 25 bp, Mus musculus
cctcggctcacctgaaactctgtgt

SEQ ID NO: 598334 - DNA, 25 bp, Mus musculus
cctcggctggcgcaataccaagctt

SEQ ID NO: 598335 - DNA, 25 bp, Mus musculus
cctcggctggcggaataccaagctt

SEQ ID NO: 598336 - DNA, 25 bp, Mus musculus
cctcggcttcatacaaggcgggagg

SEQ ID NO: 598337 - DNA, 25 bp, Mus musculus
cctcggcttcattcaaggcgggagg

SEQ ID NO: 598338 - DNA, 25 bp, Mus musculus
cctcgggaaggcctaagcaagttgc

SEQ ID NO: 598339 - DNA, 25 bp, Mus musculus
cctcgggaaggcgtaagcaagttgc

SEQ ID NO: 598340 - DNA, 25 bp, Mus musculus
cctcgggagcctcgtaatttggcac

SEQ ID NO: 598341 - DNA, 25 bp, Mus musculus
cctcgggagcctggtaatttggcac

SEQ ID NO: 598342 - DNA, 25 bp, Mus musculus
cctcgggcaggtcgaaatgacctag

SEQ ID NO: 598343 - DNA, 25 bp, Mus musculus
cctcgggcaggtggaaatgacctag

SEQ ID NO: 598344 - DNA, 25 bp, Mus musculus
cctcgggcagtcattgtggacctgg

SEQ ID NO: 598345 - DNA, 25 bp, Mus musculus
cctcgggcagtctttgtggacctgg

SEQ ID NO: 598346 - DNA, 25 bp, Mus musculus
cctcgggccaatcaatcagtggtgg

SEQ ID NO: 598347 - DNA, 25 bp, Mus musculus
cctcgggccaatgaatcagtggtgg

SEQ ID NO: 598348 - DNA, 25 bp, Mus musculus
cctcgggccacgaagatgcaatttt

SEQ ID NO: 598349 - DNA, 25 bp, Mus musculus
cctcgggccacgtagatgcaatttt

SEQ ID NO: 598350 - DNA, 25 bp, Mus musculus
cctcgggcctgacctgcctggcctg

SEQ ID NO: 598351 - DNA, 25 bp, Mus musculus
cctcgggcctgagctgcctggcctg

SEQ ID NO: 598352 - DNA, 25 bp, Mus musculus
cctcgggcctgcagactgaaaggaa

SEQ ID NO: 598353 - DNA, 25 bp, Mus musculus
cctcgggcctgctgactgaaaggaa

SEQ ID NO: 598354 - DNA, 25 bp, Mus musculus
cctcgggtagtcagtgctgtccctg

SEQ ID NO: 598355 - DNA, 25 bp, Mus musculus
cctcgggtagtctgtgctgtccctg

SEQ ID NO: 598356 - DNA, 25 bp, Mus musculus
cctcgggtcccaacgagtggatgaa

SEQ ID NO: 598357 - DNA, 25 bp, Mus musculus
cctcgggtcccatcgagtggatgaa

SEQ ID NO: 598358 - DNA, 25 bp, Mus musculus
cctcgggtgaaaagacctgaagata

SEQ ID NO: 598359 - DNA, 25 bp, Mus musculus
cctcgggtgaaatgacctgaagata

SEQ ID NO: 598360 - DNA, 25 bp, Mus musculus
cctcgggtgatgaattcaatggcag

SEQ ID NO: 598361 - DNA, 25 bp, Mus musculus
cctcgggtgatgtattcaatggcag

SEQ ID NO: 598362 - DNA, 25 bp, Mus musculus
cctcgggtgctcaacattgatatcg

SEQ ID NO: 598363 - DNA, 25 bp, Mus musculus
cctcgggtgctctacattgatatcg

SEQ ID NO: 598364 - DNA, 25 bp, Mus musculus
cctcggtcggtgctctctcgtgctt

SEQ ID NO: 598365 - DNA, 25 bp, Mus musculus
cctcggtcggtggtctctcgtgctt

SEQ ID NO: 598366 - DNA, 25 bp, Mus musculus
cctcggtgacagatccgacgacgca

SEQ ID NO: 598367 - DNA, 25 bp, Mus musculus
cctcggtgacagttccgacgacgca

SEQ ID NO: 598368 - DNA, 25 bp, Mus musculus
cctcggtgcccacagtctggaagaa

SEQ ID NO: 598369 - DNA, 25 bp, Mus musculus
cctcggtgcccagagtctggaagaa

SEQ ID NO: 598370 - DNA, 25 bp, Mus musculus
cctcggtggaaacttttatttgatg

SEQ ID NO: 598371 - DNA, 25 bp, Mus musculus
cctcggtggaaagttttatttgatg

SEQ ID NO: 598372 - DNA, 25 bp, Mus musculus
cctcggtggccgatggctgatgtct

SEQ ID NO: 598373 - DNA, 25 bp, Mus musculus
cctcggtggccgttggctgatgtct

SEQ ID NO: 598374 - DNA, 25 bp, Mus musculus
cctcggttggatagtcggagtgtcc

SEQ ID NO: 598375 - DNA, 25 bp, Mus musculus
cctcggttggattgtcggagtgtcc

SEQ ID NO: 598376 - DNA, 25 bp, Mus musculus
cctcggtttgagactatcatggaag

SEQ ID NO: 598377 - DNA, 25 bp, Mus musculus
cctcggtttgagtctatcatggaag

SEQ ID NO: 598378 - DNA, 25 bp, Mus musculus
cctcgtagtgaactcgtagctctcc

SEQ ID NO: 598379 - DNA, 25 bp, Mus musculus
cctcgtagtgaagtcgtagctctcc

SEQ ID NO: 598380 - DNA, 25 bp, Mus musculus
cctcgtcctcgtccaaaaagatggg

SEQ ID NO: 598381 - DNA, 25 bp, Mus musculus
cctcgtcctcgtgcaaaaagatggg

SEQ ID NO: 598382 - DNA, 25 bp, Mus musculus
cctcgtcgggagagcgtctcctcgg

SEQ ID NO: 598383 - DNA, 25 bp, Mus musculus
cctcgtcgggagtgcgtctcctcgg

SEQ ID NO: 598384 - DNA, 25 bp, Mus musculus
cctcgtgagcaacaagcctgacttt

SEQ ID NO: 598385 - DNA, 25 bp, Mus musculus
cctcgtgagcaagaagcctgacttt

SEQ ID NO: 598386 - DNA, 25 bp, Mus musculus
cctcgtggccaacaaggtggatctg

SEQ ID NO: 598387 - DNA, 25 bp, Mus musculus
cctcgtggccaagaaggtggatctg

SEQ ID NO: 598388 - DNA, 25 bp, Mus musculus
cctcgtggctccctatgaagctgat

SEQ ID NO: 598389 - DNA, 25 bp, Mus musculus
cctcgtggctccgtatgaagctgat

SEQ ID NO: 598390 - DNA, 25 bp, Mus musculus
cctcgtggctgcagcttttgctatg

SEQ ID NO: 598391 - DNA, 25 bp, Mus musculus
cctcgtggctgctgcttttgctatg

SEQ ID NO: 598392 - DNA, 25 bp, Mus musculus
cctcgtgggcagagagactcgagtt

SEQ ID NO: 598393 - DNA, 25 bp, Mus musculus
cctcgtgggcagtgagactcgagtt

SEQ ID NO: 598394 - DNA, 25 bp, Mus musculus
cctcgtgggcggaagaaccattttg

SEQ ID NO: 598395 - DNA, 25 bp, Mus musculus
cctcgtgggcggtagaaccattttg

SEQ ID NO: 598396 - DNA, 25 bp, Mus musculus
cctcgtggtagcaggctctttgttc

SEQ ID NO: 598397 - DNA, 25 bp, Mus musculus
cctcgtggtagctggctctttgttc

SEQ ID NO: 598398 - DNA, 25 bp, Mus musculus
cctcgtgtgcggagttgtctgtgaa

SEQ ID NO: 598399 - DNA, 25 bp, Mus musculus
cctcgtgtgcggtgttgtctgtgaa

SEQ ID NO: 598400 - DNA, 25 bp, Mus musculus
cctcgttagaaaccggccgtgagcc

SEQ ID NO: 598401 - DNA, 25 bp, Mus musculus
cctcgttagaaagcggccgtgagcc

SEQ ID NO: 598402 - DNA, 25 bp, Mus musculus
cctcgttcctagaggcttaaccata

SEQ ID NO: 598403 - DNA, 25 bp, Mus musculus
cctcgttcctagtggcttaaccata

SEQ ID NO: 598404 - DNA, 25 bp, Mus musculus
cctcgttgactgctggacgcagcag

SEQ ID NO: 598405 - DNA, 25 bp, Mus musculus
cctcgttgactggtggacgcagcag

SEQ ID NO: 598406 - DNA, 25 bp, Mus musculus
cctcgttggatgaacgcacgcgaca

SEQ ID NO: 598407 - DNA, 25 bp, Mus musculus
cctcgttggatgtacgcacgcgaca

SEQ ID NO: 598408 - DNA, 25 bp, Mus musculus
cctcgtttcgagctccagttgcact

SEQ ID NO: 598409 - DNA, 25 bp, Mus musculus
cctcgtttcgaggtccagttgcact

SEQ ID NO: 598410 - DNA, 25 bp, Mus musculus
cctcgtttctgcctgtgacattcgc

SEQ ID NO: 598411 - DNA, 25 bp, Mus musculus
cctcgtttctgcgtgtgacattcgc

SEQ ID NO: 598412 - DNA, 25 bp, Mus musculus
cctcgtttgaagatgtagatgcgtt

SEQ ID NO: 598413 - DNA, 25 bp, Mus musculus
cctcgtttgaagttgtagatgcgtt

SEQ ID NO: 598414 - DNA, 25 bp, Mus musculus
cctctaaagagcatgaggcctcgca

SEQ ID NO: 598415 - DNA, 25 bp, Mus musculus
cctctaaagagcttgaggcctcgca

SEQ ID NO: 598416 - DNA, 25 bp, Mus musculus
cctctaaaggtcagctgctgtttgt

SEQ ID NO: 598417 - DNA, 25 bp, Mus musculus
cctctaaaggtctgctgctgtttgt

SEQ ID NO: 598418 - DNA, 25 bp, Mus musculus
cctctaaagtcactagtgggacacc

SEQ ID NO: 598419 - DNA, 25 bp, Mus musculus
cctctaaagtcagtagtgggacacc

SEQ ID NO: 598420 - DNA, 25 bp, Mus musculus
cctctaaccgcacaactgggatgtg

SEQ ID NO: 598421 - DNA, 25 bp, Mus musculus
cctctaaccgcagaactgggatgtg

SEQ ID NO: 598422 - DNA, 25 bp, Mus musculus
cctctaagagttaaagctcagatga

SEQ ID NO: 598423 - DNA, 25 bp, Mus musculus
cctctaagagtttaagctcagatga

SEQ ID NO: 598424 - DNA, 25 bp, Mus musculus
cctctaagatttcggatgtcaatgt

SEQ ID NO: 598425 - DNA, 25 bp, Mus musculus
cctctaagatttgggatgtcaatgt

SEQ ID NO: 598426 - DNA, 25 bp, Mus musculus
cctctaaggtggagcaggtggtcta

SEQ ID NO: 598427 - DNA, 25 bp, Mus musculus
cctctaaggtggtgcaggtggtcta

SEQ ID NO: 598428 - DNA, 25 bp, Mus musculus
cctctaagttagagcgggatagtaa

SEQ ID NO: 598429 - DNA, 25 bp, Mus musculus
cctctaagttagtgcgggatagtaa

SEQ ID NO: 598430 - DNA, 25 bp, Mus musculus
cctctaatcgcacgcaggaggattt

SEQ ID NO: 598431 - DNA, 25 bp, Mus musculus
cctctaatcgcaggcaggaggattt

SEQ ID NO: 598432 - DNA, 25 bp, Mus musculus
cctctaatctacataggatgggtgc

SEQ ID NO: 598433 - DNA, 25 bp, Mus musculus
cctctaatctacttaggatgggtgc

SEQ ID NO: 598434 - DNA, 25 bp, Mus musculus
cctctacagccgcttgttttcatgg

SEQ ID NO: 598435 - DNA, 25 bp, Mus musculus
cctctacagccggttgttttcatgg

SEQ ID NO: 598436 - DNA, 25 bp, Mus musculus
cctctacatcatccggaacctggag

SEQ ID NO: 598437 - DNA, 25 bp, Mus musculus
cctctacatcatgcggaacctggag

SEQ ID NO: 598438 - DNA, 25 bp, Mus musculus
cctctacatgagacagcaccgagtt

SEQ ID NO: 598439 - DNA, 25 bp, Mus musculus
cctctacatgagtcagcaccgagtt

SEQ ID NO: 598440 - DNA, 25 bp, Mus musculus
cctctacctggaaagcccgagtgtc

SEQ ID NO: 598441 - DNA, 25 bp, Mus musculus
cctctacctggatagcccgagtgtc

SEQ ID NO: 598442 - DNA, 25 bp, Mus musculus
cctctacgagatcctacatggcctg

SEQ ID NO: 598443 - DNA, 25 bp, Mus musculus
cctctacgagatgctacatggcctg

SEQ ID NO: 598444 - DNA, 25 bp, Mus musculus
cctctacgtgagacgtggcagggat

SEQ ID NO: 598445 - DNA, 25 bp, Mus musculus
cctctacgtgagtcgtggcagggat

SEQ ID NO: 598446 - DNA, 25 bp, Mus musculus
cctctactgctgactagtgatagaa

SEQ ID NO: 598447 - DNA, 25 bp, Mus musculus
cctctactgctgtctagtgatagaa

SEQ ID NO: 598448 - DNA, 25 bp, Mus musculus
cctctactgtgcatgggagaatgcg

SEQ ID NO: 598449 - DNA, 25 bp, Mus musculus
cctctactgtgcttgggagaatgcg

SEQ ID NO: 598450 - DNA, 25 bp, Mus musculus
cctctactttgtagtcccaggaaag

SEQ ID NO: 598451 - DNA, 25 bp, Mus musculus
cctctactttgttgtcccaggaaag

SEQ ID NO: 598452 - DNA, 25 bp, Mus musculus
cctctagacagacgagggctcccag

SEQ ID NO: 598453 - DNA, 25 bp, Mus musculus
cctctagacagaggagggctcccag

SEQ ID NO: 598454 - DNA, 25 bp, Mus musculus
cctctagagggacctggtcattgcc

SEQ ID NO: 598455 - DNA, 25 bp, Mus musculus
cctctagagggagctggtcattgcc

SEQ ID NO: 598456 - DNA, 25 bp, Mus musculus
cctctagatacactacttgtggatg

SEQ ID NO: 598457 - DNA, 25 bp, Mus musculus
cctctagatacagtacttgtggatg

SEQ ID NO: 598458 - DNA, 25 bp, Mus musculus
cctctagataggcaagaaactgcct

SEQ ID NO: 598459 - DNA, 25 bp, Mus musculus
cctctagatagggaagaaactgcct

SEQ ID NO: 598460 - DNA, 25 bp, Mus musculus
cctctagctttgagttcctgctctg

SEQ ID NO: 598461 - DNA, 25 bp, Mus musculus
cctctagctttgtgttcctgctctg

SEQ ID NO: 598462 - DNA, 25 bp, Mus musculus
cctctaggactgaggcctttgaaga

SEQ ID NO: 598463 - DNA, 25 bp, Mus musculus
cctctaggactgtggcctttgaaga

SEQ ID NO: 598464 - DNA, 25 bp, Mus musculus
cctctaggccagaagattaatgctt

SEQ ID NO: 598465 - DNA, 25 bp, Mus musculus
cctctaggccagtagattaatgctt

SEQ ID NO: 598466 - DNA, 25 bp, Mus musculus
cctctaggtgagacagaagccaaac

SEQ ID NO: 598467 - DNA, 25 bp, Mus musculus
cctctaggtgagtcagaagccaaac

SEQ ID NO: 598468 - DNA, 25 bp, Mus musculus
cctctaggtggaattcaaggatgca

SEQ ID NO: 598469 - DNA, 25 bp, Mus musculus
cctctaggtggatttcaaggatgca

SEQ ID NO: 598470 - DNA, 25 bp, Mus musculus
cctctataaagaaggaaagctatat

SEQ ID NO: 598471 - DNA, 25 bp, Mus musculus
cctctataaagatggaaagctatat

SEQ ID NO: 598472 - DNA, 25 bp, Mus musculus
cctctatgagacatgaaaatacccg

SEQ ID NO: 598473 - DNA, 25 bp, Mus musculus
cctctatgagacttgaaaatacccg

SEQ ID NO: 598474 - DNA, 25 bp, Mus musculus
cctctatgccagaaatgtctcccag

SEQ ID NO: 598475 - DNA, 25 bp, Mus musculus
cctctatgccagtaatgtctcccag

SEQ ID NO: 598476 - DNA, 25 bp, Mus musculus
cctctatggtgaaaaagtacctttg

SEQ ID NO: 598477 - DNA, 25 bp, Mus musculus
cctctatggtgataaagtacctttg

SEQ ID NO: 598478 - DNA, 25 bp, Mus musculus
cctctatggtggatgaagcagctca

SEQ ID NO: 598479 - DNA, 25 bp, Mus musculus
cctctatggtggttgaagcagctca

SEQ ID NO: 598480 - DNA, 25 bp, Mus musculus
cctctattactgctttagcaacctg

SEQ ID NO: 598481 - DNA, 25 bp, Mus musculus
cctctattactggtttagcaacctg

SEQ ID NO: 598482 - DNA, 25 bp, Mus musculus
cctctcaaactccaggtgctgtgat

SEQ ID NO: 598483 - DNA, 25 bp, Mus musculus
cctctcaaactcgaggtgctgtgat

SEQ ID NO: 598484 - DNA, 25 bp, Mus musculus
cctctcaaatagagggtagatttat

SEQ ID NO: 598485 - DNA, 25 bp, Mus musculus
cctctcaaatagtgggtagatttat

SEQ ID NO: 598486 - DNA, 25 bp, Mus musculus
cctctcaagggtcgagcggaataga

SEQ ID NO: 598487 - DNA, 25 bp, Mus musculus
cctctcaagggtggagcggaataga

SEQ ID NO: 598488 - DNA, 25 bp, Mus musculus
cctctcaagtggaaaagactctgta

SEQ ID NO: 598489 - DNA, 25 bp, Mus musculus
cctctcaagtggtaaagactctgta

SEQ ID NO: 598490 - DNA, 25 bp, Mus musculus
cctctcagaagccttcagtgtggcc

SEQ ID NO: 598491 - DNA, 25 bp, Mus musculus
cctctcagaagcgttcagtgtggcc

SEQ ID NO: 598492 - DNA, 25 bp, Mus musculus
cctctcagaaggaacttgactttag

SEQ ID NO: 598493 - DNA, 25 bp, Mus musculus
cctctcagaaggtacttgactttag

SEQ ID NO: 598494 - DNA, 25 bp, Mus musculus
cctctcagaagtaggagatacacaa

SEQ ID NO: 598495 - DNA, 25 bp, Mus musculus
cctctcagaagttggagatacacaa

SEQ ID NO: 598496 - DNA, 25 bp, Mus musculus
cctctcagctggcttcgaaactgct

SEQ ID NO: 598497 - DNA, 25 bp, Mus musculus
cctctcagctgggttcgaaactgct

SEQ ID NO: 598498 - DNA, 25 bp, Mus musculus
cctctcaggctcactgtacaggaaa

SEQ ID NO: 598499 - DNA, 25 bp, Mus musculus
cctctcaggctctctgtacaggaaa

SEQ ID NO: 598500 - DNA, 25 bp, Mus musculus
cctctcagtgtgcttcagaatgggc

SEQ ID NO: 598501 - DNA, 25 bp, Mus musculus
cctctcagtgtggttcagaatgggc

SEQ ID NO: 598502 - DNA, 25 bp, Mus musculus
cctctcatcatcagggcgacttctg

SEQ ID NO: 598503 - DNA, 25 bp, Mus musculus
cctctcatcatctgggcgacttctg

SEQ ID NO: 598504 - DNA, 25 bp, Mus musculus
cctctcatgtggagttagtgacgga

SEQ ID NO: 598505 - DNA, 25 bp, Mus musculus
cctctcatgtggtgttagtgacgga

SEQ ID NO: 598506 - DNA, 25 bp, Mus musculus
cctctcatttgtcgtgagacctatg

SEQ ID NO: 598507 - DNA, 25 bp, Mus musculus
cctctcatttgtggtgagacctatg

SEQ ID NO: 598508 - DNA, 25 bp, Mus musculus
cctctccaggagatccggcttgata

SEQ ID NO: 598509 - DNA, 25 bp, Mus musculus
cctctccaggagttccggcttgata

SEQ ID NO: 598510 - DNA, 25 bp, Mus musculus
cctctccatccacggagtcaaggag

SEQ ID NO: 598511 - DNA, 25 bp, Mus musculus
cctctccatccagggagtcaaggag

SEQ ID NO: 598512 - DNA, 25 bp, Mus musculus
cctctcccagaaccacgagaatgag

SEQ ID NO: 598513 - DNA, 25 bp, Mus musculus
cctctcccagaagcacgagaatgag

SEQ ID NO: 598514 - DNA, 25 bp, Mus musculus
cctctccggctgaggccgggatttg

SEQ ID NO: 598515 - DNA, 25 bp, Mus musculus
cctctccggctgtggccgggatttg

SEQ ID NO: 598516 - DNA, 25 bp, Mus musculus
cctctcctctctatgacagaggaca

SEQ ID NO: 598517 - DNA, 25 bp, Mus musculus
cctctcctctctttgacagaggaca

SEQ ID NO: 598518 - DNA, 25 bp, Mus musculus
cctctcctgcggcagtgacaatgac

SEQ ID NO: 598519 - DNA, 25 bp, Mus musculus
cctctcctgcgggagtgacaatgac

SEQ ID NO: 598520 - DNA, 25 bp, Mus musculus
cctctcctggatagtaggagaagcg

SEQ ID NO: 598521 - DNA, 25 bp, Mus musculus
cctctcctggattgtaggagaagcg

SEQ ID NO: 598522 - DNA, 25 bp, Mus musculus
cctctccttcgcctatgtggaagga

SEQ ID NO: 598523 - DNA, 25 bp, Mus musculus
cctctccttcgcgtatgtggaagga

SEQ ID NO: 598524 - DNA, 25 bp, Mus musculus
cctctcgaagtgatggatacaggcc

SEQ ID NO: 598525 - DNA, 25 bp, Mus musculus
cctctcgaagtgttggatacaggcc

SEQ ID NO: 598526 - DNA, 25 bp, Mus musculus
cctctcgacggcacaggagtacctg

SEQ ID NO: 598527 - DNA, 25 bp, Mus musculus
cctctcgacggctcaggagtacctg

SEQ ID NO: 598528 - DNA, 25 bp, Mus musculus
cctctcgcagtgatgcaatataggg

SEQ ID NO: 598529 - DNA, 25 bp, Mus musculus
cctctcgcagtgttgcaatataggg

SEQ ID NO: 598530 - DNA, 25 bp, Mus musculus
cctctcggctctcccatggaggagg

SEQ ID NO: 598531 - DNA, 25 bp, Mus musculus
cctctcggctctgccatggaggagg

SEQ ID NO: 598532 - DNA, 25 bp, Mus musculus
cctctcggctgccaaggtacagaga

SEQ ID NO: 598533 - DNA, 25 bp, Mus musculus
cctctcggctgcgaaggtacagaga

SEQ ID NO: 598534 - DNA, 25 bp, Mus musculus
cctctcgggaggcttcgctgttgat

SEQ ID NO: 598535 - DNA, 25 bp, Mus musculus
cctctcgggagggttcgctgttgat

SEQ ID NO: 598536 - DNA, 25 bp, Mus musculus
cctctcggtgagaaatggcttcggc

SEQ ID NO: 598537 - DNA, 25 bp, Mus musculus
cctctcggtgagtaatggcttcggc

SEQ ID NO: 598538 - DNA, 25 bp, Mus musculus
cctctctcaggtcggtgtgtcagga

SEQ ID NO: 598539 - DNA, 25 bp, Mus musculus
cctctctcaggtgggtgtgtcagga

SEQ ID NO: 598540 - DNA, 25 bp, Mus musculus
cctctctgaagcactggacttgatt

SEQ ID NO: 598541 - DNA, 25 bp, Mus musculus
cctctctgaagctctggacttgatt

SEQ ID NO: 598542 - DNA, 25 bp, Mus musculus
cctctctgacagctaaaaattcacg

SEQ ID NO: 598543 - DNA, 25 bp, Mus musculus
cctctctgacaggtaaaaattcacg

SEQ ID NO: 598544 - DNA, 25 bp, Mus musculus
cctctctgattgcagaagaactgca

SEQ ID NO: 598545 - DNA, 25 bp, Mus musculus
cctctctgattggagaagaactgca

SEQ ID NO: 598546 - DNA, 25 bp, Mus musculus
cctctctgcctgcactgagtggctg

SEQ ID NO: 598547 - DNA, 25 bp, Mus musculus
cctctctgcctggactgagtggctg

SEQ ID NO: 598548 - DNA, 25 bp, Mus musculus
cctctctgtgtgcatatgtgtctca

SEQ ID NO: 598549 - DNA, 25 bp, Mus musculus
cctctctgtgtggatatgtgtctca

SEQ ID NO: 598550 - DNA, 25 bp, Mus musculus
cctctcttgccacagtgccatggag

SEQ ID NO: 598551 - DNA, 25 bp, Mus musculus
cctctcttgccagagtgccatggag

SEQ ID NO: 598552 - DNA, 25 bp, Mus musculus
cctctctttgacagaggacaaaggt

SEQ ID NO: 598553 - DNA, 25 bp, Mus musculus
cctctctttgactgaggacaaaggt

SEQ ID NO: 598554 - DNA, 25 bp, Mus musculus
cctctgaaaaggctgggtaatgacg

SEQ ID NO: 598555 - DNA, 25 bp, Mus musculus
cctctgaaaagggtgggtaatgacg

SEQ ID NO: 598556 - DNA, 25 bp, Mus musculus
cctctgaaaggtctctgagcgagtg

SEQ ID NO: 598557 - DNA, 25 bp, Mus musculus
cctctgaaaggtgtctgagcgagtg

SEQ ID NO: 598558 - DNA, 25 bp, Mus musculus
cctctgaagaaaatgttgggataaa

SEQ ID NO: 598559 - DNA, 25 bp, Mus musculus
cctctgaagaaattgttgggataaa

SEQ ID NO: 598560 - DNA, 25 bp, Mus musculus
cctctgaagagcagcgagctgacag

SEQ ID NO: 598561 - DNA, 25 bp, Mus musculus
cctctgaagagctgcgagctgacag

SEQ ID NO: 598562 - DNA, 25 bp, Mus musculus
cctctgaatgccaacggagatgacg

SEQ ID NO: 598563 - DNA, 25 bp, Mus musculus
cctctgaatgcctacggagatgacg

SEQ ID NO: 598564 - DNA, 25 bp, Mus musculus
cctctgacccggagcagattgggag

SEQ ID NO: 598565 - DNA, 25 bp, Mus musculus
cctctgacccggtgcagattgggag

SEQ ID NO: 598566 - DNA, 25 bp, Mus musculus
cctctgagaatcagggacctcaaca

SEQ ID NO: 598567 - DNA, 25 bp, Mus musculus
cctctgagaatctgggacctcaaca

SEQ ID NO: 598568 - DNA, 25 bp, Mus musculus
cctctgagaattcggacagtctgct

SEQ ID NO: 598569 - DNA, 25 bp, Mus musculus
cctctgagaattgggacagtctgct

SEQ ID NO: 598570 - DNA, 25 bp, Mus musculus
cctctgagaccaccaaactcttggg

SEQ ID NO: 598571 - DNA, 25 bp, Mus musculus
cctctgagaccagcaaactcttggg

SEQ ID NO: 598572 - DNA, 25 bp, Mus musculus
cctctgagactgacaccaggtattt

SEQ ID NO: 598573 - DNA, 25 bp, Mus musculus
cctctgagactgtcaccaggtattt

SEQ ID NO: 598574 - DNA, 25 bp, Mus musculus
cctctgaggattatgggaaaggtct

SEQ ID NO: 598575 - DNA, 25 bp, Mus musculus
cctctgaggattttgggaaaggtct

SEQ ID NO: 598576 - DNA, 25 bp, Mus musculus
cctctgagggtaagtgactaagact

SEQ ID NO: 598577 - DNA, 25 bp, Mus musculus
cctctgagggtatgtgactaagact

SEQ ID NO: 598578 - DNA, 25 bp, Mus musculus
cctctgatagagcagtaacagccga

SEQ ID NO: 598579 - DNA, 25 bp, Mus musculus
cctctgatagaggagtaacagccga

SEQ ID NO: 598580 - DNA, 25 bp, Mus musculus
cctctgatcttcactccacgtggga

SEQ ID NO: 598581 - DNA, 25 bp, Mus musculus
cctctgatcttctctccacgtggga

SEQ ID NO: 598582 - DNA, 25 bp, Mus musculus
cctctgatggctcccttaggtgaag

SEQ ID NO: 598583 - DNA, 25 bp, Mus musculus
cctctgatggctgccttaggtgaag

SEQ ID NO: 598584 - DNA, 25 bp, Mus musculus
cctctgatggtcattattggtgagc

SEQ ID NO: 598585 - DNA, 25 bp, Mus musculus
cctctgatggtctttattggtgagc

SEQ ID NO: 598586 - DNA, 25 bp, Mus musculus
cctctgatgtgtcgatgtttggcgt

SEQ ID NO: 598587 - DNA, 25 bp, Mus musculus
cctctgatgtgtggatgtttggcgt

SEQ ID NO: 598588 - DNA, 25 bp, Mus musculus
cctctgattcagctatggagtgtgg

SEQ ID NO: 598589 - DNA, 25 bp, Mus musculus
cctctgattcaggtatggagtgtgg

SEQ ID NO: 598590 - DNA, 25 bp, Mus musculus
cctctgcaccagcacatcttctgtg

SEQ ID NO: 598591 - DNA, 25 bp, Mus musculus
cctctgcaccaggacatcttctgtg

SEQ ID NO: 598592 - DNA, 25 bp, Mus musculus
cctctgcactttcgagacggaggag

SEQ ID NO: 598593 - DNA, 25 bp, Mus musculus
cctctgcactttggagacggaggag

SEQ ID NO: 598594 - DNA, 25 bp, Mus musculus
cctctgcagggaccaaaaggtttgc

SEQ ID NO: 598595 - DNA, 25 bp, Mus musculus
cctctgcagggagcaaaaggtttgc

SEQ ID NO: 598596 - DNA, 25 bp, Mus musculus
cctctgcatgtcatcgagtggctgc

SEQ ID NO: 598597 - DNA, 25 bp, Mus musculus
cctctgcatgtcttcgagtggctgc

SEQ ID NO: 598598 - DNA, 25 bp, Mus musculus
cctctgccaccaagagaaacatctt

SEQ ID NO: 598599 - DNA, 25 bp, Mus musculus
cctctgccaccatgagaaacatctt

SEQ ID NO: 598600 - DNA, 25 bp, Mus musculus
cctctgccagtgaggaccagggact

SEQ ID NO: 598601 - DNA, 25 bp, Mus musculus
cctctgccagtgtggaccagggact

SEQ ID NO: 598602 - DNA, 25 bp, Mus musculus
cctctgcgcactcaggctacagagt

SEQ ID NO: 598603 - DNA, 25 bp, Mus musculus
cctctgcgcactgaggctacagagt

SEQ ID NO: 598604 - DNA, 25 bp, Mus musculus
cctctgcggcgtatcgatggttatg

SEQ ID NO: 598605 - DNA, 25 bp, Mus musculus
cctctgcggcgtttcgatggttatg

SEQ ID NO: 598606 - DNA, 25 bp, Mus musculus
cctctgcgggtgataccacttaaag

SEQ ID NO: 598607 - DNA, 25 bp, Mus musculus
cctctgcgggtgttaccacttaaag

SEQ ID NO: 598608 - DNA, 25 bp, Mus musculus
cctctgcggtggatcttcggtgcga

SEQ ID NO: 598609 - DNA, 25 bp, Mus musculus
cctctgcggtggttcttcggtgcga

SEQ ID NO: 598610 - DNA, 25 bp, Mus musculus
cctctgcgtggcattctctacgttt

SEQ ID NO: 598611 - DNA, 25 bp, Mus musculus
cctctgcgtggctttctctacgttt

SEQ ID NO: 598612 - DNA, 25 bp, Mus musculus
cctctgctaaggaaggactcctcct

SEQ ID NO: 598613 - DNA, 25 bp, Mus musculus
cctctgctaaggtaggactcctcct

SEQ ID NO: 598614 - DNA, 25 bp, Mus musculus
cctctgctggaaagtgtgacctgga

SEQ ID NO: 598615 - DNA, 25 bp, Mus musculus
cctctgctggaactgtcctgatggt

SEQ ID NO: 598616 - DNA, 25 bp, Mus musculus
cctctgctggaagtgtcctgatggt

SEQ ID NO: 598617 - DNA, 25 bp, Mus musculus
cctctgctggaatgtgtgacctgga

SEQ ID NO: 598618 - DNA, 25 bp, Mus musculus
cctctgctggttcctggacgaggca

SEQ ID NO: 598619 - DNA, 25 bp, Mus musculus
cctctgctggttgctggacgaggca

SEQ ID NO: 598620 - DNA, 25 bp, Mus musculus
cctctgcttctacttgggcacgaca

SEQ ID NO: 598621 - DNA, 25 bp, Mus musculus
cctctgcttctagttgggcacgaca

SEQ ID NO: 598622 - DNA, 25 bp, Mus musculus
cctctgctttcacaatggagtccag

SEQ ID NO: 598623 - DNA, 25 bp, Mus musculus
cctctgctttcagaatggagtccag

SEQ ID NO: 598624 - DNA, 25 bp, Mus musculus
cctctggaaaccctggctgggtgaa

SEQ ID NO: 598625 - DNA, 25 bp, Mus musculus
cctctggaaaccgtggctgggtgaa

SEQ ID NO: 598626 - DNA, 25 bp, Mus musculus
cctctggaaagaagggtcctggctt

SEQ ID NO: 598627 - DNA, 25 bp, Mus musculus
cctctggaaagaccgccaaacggaa

SEQ ID NO: 598628 - DNA, 25 bp, Mus musculus
cctctggaaagagcgccaaacggaa

SEQ ID NO: 598629 - DNA, 25 bp, Mus musculus
cctctggaaagatgggtcctggctt

SEQ ID NO: 598630 - DNA, 25 bp, Mus musculus
cctctggaatgaccacaggatctga

SEQ ID NO: 598631 - DNA, 25 bp, Mus musculus
cctctggaatgagcacaggatctga

SEQ ID NO: 598632 - DNA, 25 bp, Mus musculus
cctctggacccacggatttggagaa

SEQ ID NO: 598633 - DNA, 25 bp, Mus musculus
cctctggacccagggatttggagaa

SEQ ID NO: 598634 - DNA, 25 bp, Mus musculus
cctctggacggacagaagacaggca

SEQ ID NO: 598635 - DNA, 25 bp, Mus musculus
cctctggacggagagaagacaggca

SEQ ID NO: 598636 - DNA, 25 bp, Mus musculus
cctctggaggctcccaacgagaggc

SEQ ID NO: 598637 - DNA, 25 bp, Mus musculus
cctctggaggctgccaacgagaggc

SEQ ID NO: 598638 - DNA, 25 bp, Mus musculus
cctctggagttgagcctagtcgaag

SEQ ID NO: 598639 - DNA, 25 bp, Mus musculus
cctctggagttgtgcctagtcgaag

SEQ ID NO: 598640 - DNA, 25 bp, Mus musculus
cctctggatagacagttaactggca

SEQ ID NO: 598641 - DNA, 25 bp, Mus musculus
cctctggatagagagttaactggca

SEQ ID NO: 598642 - DNA, 25 bp, Mus musculus
cctctggatagtcactggcatcctc

SEQ ID NO: 598643 - DNA, 25 bp, Mus musculus
cctctggatagtgactggcatcctc

SEQ ID NO: 598644 - DNA, 25 bp, Mus musculus
cctctggatcgacagctgatagccc

SEQ ID NO: 598645 - DNA, 25 bp, Mus musculus
cctctggatcgagagctgatagccc

SEQ ID NO: 598646 - DNA, 25 bp, Mus musculus
cctctggcaagaatgtggctcttgt

SEQ ID NO: 598647 - DNA, 25 bp, Mus musculus
cctctggcaagattgtggctcttgt

SEQ ID NO: 598648 - DNA, 25 bp, Mus musculus
cctctggcacctaccgatgtgtggc

SEQ ID NO: 598649 - DNA, 25 bp, Mus musculus
cctctggcaccttccgatgtgtggc

SEQ ID NO: 598650 - DNA, 25 bp, Mus musculus
cctctggccatgagataattgtgca

SEQ ID NO: 598651 - DNA, 25 bp, Mus musculus
cctctggccatgtgataattgtgca

SEQ ID NO: 598652 - DNA, 25 bp, Mus musculus
cctctggccggtaaccgctctggag

SEQ ID NO: 598653 - DNA, 25 bp, Mus musculus
cctctggccggttaccgctctggag

SEQ ID NO: 598654 - DNA, 25 bp, Mus musculus
cctctggcggcaaggatatgatggt

SEQ ID NO: 598655 - DNA, 25 bp, Mus musculus
cctctggcggcatggatatgatggt

SEQ ID NO: 598656 - DNA, 25 bp, Mus musculus
cctctggcggtgctttgatgaaatc

SEQ ID NO: 598657 - DNA, 25 bp, Mus musculus
cctctggcggtggtttgatgaaatc

SEQ ID NO: 598658 - DNA, 25 bp, Mus musculus
cctctggctcaacgttcgggtcctg

SEQ ID NO: 598659 - DNA, 25 bp, Mus musculus
cctctggctcaaggttcgggtcctg

SEQ ID NO: 598660 - DNA, 25 bp, Mus musculus
cctctggctgtgaactggagcgtgt

SEQ ID NO: 598661 - DNA, 25 bp, Mus musculus
cctctggctgtgtactggagcgtgt

SEQ ID NO: 598662 - DNA, 25 bp, Mus musculus
cctctgggaagactggaccaacttg

SEQ ID NO: 598663 - DNA, 25 bp, Mus musculus
cctctgggaagagtggaccaacttg

SEQ ID NO: 598664 - DNA, 25 bp, Mus musculus
cctctgggaagtacttatatgtgca

SEQ ID NO: 598665 - DNA, 25 bp, Mus musculus
cctctgggaagttcttatatgtgca

SEQ ID NO: 598666 - DNA, 25 bp, Mus musculus
cctctgggagtcaggagacatgagt

SEQ ID NO: 598667 - DNA, 25 bp, Mus musculus
cctctgggagtctggagacatgagt

SEQ ID NO: 598668 - DNA, 25 bp, Mus musculus
cctctgggagtgctagctcactgaa

SEQ ID NO: 598669 - DNA, 25 bp, Mus musculus
cctctgggagtggtagctcactgaa

SEQ ID NO: 598670 - DNA, 25 bp, Mus musculus
cctctgggctgcagtagatgactac

SEQ ID NO: 598671 - DNA, 25 bp, Mus musculus
cctctgggctgctgtagatgactac

SEQ ID NO: 598672 - DNA, 25 bp, Mus musculus
cctctgggctgtcctgcagaatcgt

SEQ ID NO: 598673 - DNA, 25 bp, Mus musculus
cctctgggctgtgctgcagaatcgt

SEQ ID NO: 598674 - DNA, 25 bp, Mus musculus
cctctggtgccacagaaagacagcc

SEQ ID NO: 598675 - DNA, 25 bp, Mus musculus
cctctggtgccagagaaagacagcc

SEQ ID NO: 598676 - DNA, 25 bp, Mus musculus
cctctggtgctgctctactttgcag

SEQ ID NO: 598677 - DNA, 25 bp, Mus musculus
cctctggtgctggtctactttgcag

SEQ ID NO: 598678 - DNA, 25 bp, Mus musculus
cctctggtgcttcatcaagagtatg

SEQ ID NO: 598679 - DNA, 25 bp, Mus musculus
cctctggtgcttgatcaagagtatg

SEQ ID NO: 598680 - DNA, 25 bp, Mus musculus
cctctgtatgtcagttgctgcagaa

SEQ ID NO: 598681 - DNA, 25 bp, Mus musculus
cctctgtatgtctgttgctgcagaa

SEQ ID NO: 598682 - DNA, 25 bp, Mus musculus
cctctgtgaaatcagacaactcgac

SEQ ID NO: 598683 - DNA, 25 bp, Mus musculus
cctctgtgaaatgagacaactcgac

SEQ ID NO: 598684 - DNA, 25 bp, Mus musculus
cctctgtgaattaggccagaatccc

SEQ ID NO: 598685 - DNA, 25 bp, Mus musculus
cctctgtgaatttggccagaatccc

SEQ ID NO: 598686 - DNA, 25 bp, Mus musculus
cctctgtgagatcgcgcacctgggt

SEQ ID NO: 598687 - DNA, 25 bp, Mus musculus
cctctgtgagatggcgcacctgggt

SEQ ID NO: 598688 - DNA, 25 bp, Mus musculus
cctctgtgcagcctagtgaggccca

SEQ ID NO: 598689 - DNA, 25 bp, Mus musculus
cctctgtgcagcgtagtgaggccca

SEQ ID NO: 598690 - DNA, 25 bp, Mus musculus
cctctgtgctatcggttttgatagg

SEQ ID NO: 598691 - DNA, 25 bp, Mus musculus
cctctgtgctatgggttttgatagg

SEQ ID NO: 598692 - DNA, 25 bp, Mus musculus
cctctgtgctcgaaaacgatgtcca

SEQ ID NO: 598693 - DNA, 25 bp, Mus musculus
cctctgtgctcgtaaacgatgtcca

SEQ ID NO: 598694 - DNA, 25 bp, Mus musculus
cctctgtgctgaagcaagaccggga

SEQ ID NO: 598695 - DNA, 25 bp, Mus musculus
cctctgtgctgatgcaagaccggga

SEQ ID NO: 598696 - DNA, 25 bp, Mus musculus
cctctgtggactctgtggctgttct

SEQ ID NO: 598697 - DNA, 25 bp, Mus musculus
cctctgtggactgtgtggctgttct

SEQ ID NO: 598698 - DNA, 25 bp, Mus musculus
cctctgtggtggagcgaccacagct

SEQ ID NO: 598699 - DNA, 25 bp, Mus musculus
cctctgtggtggtgcgaccacagct

SEQ ID NO: 598700 - DNA, 25 bp, Mus musculus
cctctgtgtcttacatgataagcat

SEQ ID NO: 598701 - DNA, 25 bp, Mus musculus
cctctgtgtctttcatgataagcat

SEQ ID NO: 598702 - DNA, 25 bp, Mus musculus
cctctgtgttggctggactgtgtta

SEQ ID NO: 598703 - DNA, 25 bp, Mus musculus
cctctgtgttgggtggactgtgtta

SEQ ID NO: 598704 - DNA, 25 bp, Mus musculus
cctctgttaccaactgtgggcctta

SEQ ID NO: 598705 - DNA, 25 bp, Mus musculus
cctctgttaccatctgtgggcctta

SEQ ID NO: 598706 - DNA, 25 bp, Mus musculus
cctctgttagggacactttctcatt

SEQ ID NO: 598707 - DNA, 25 bp, Mus musculus
cctctgttagggtcactttctcatt

SEQ ID NO: 598708 - DNA, 25 bp, Mus musculus
cctctgttgggcagtagaagttaag

SEQ ID NO: 598709 - DNA, 25 bp, Mus musculus
cctctgttgggctgtagaagttaag

SEQ ID NO: 598710 - DNA, 25 bp, Mus musculus
cctcttaaggaacgtgccacgtgtg

SEQ ID NO: 598711 - DNA, 25 bp, Mus musculus
cctcttaaggaaggtgccacgtgtg

SEQ ID NO: 598712 - DNA, 25 bp, Mus musculus
cctcttaaggtgatgaagatttcaa

SEQ ID NO: 598713 - DNA, 25 bp, Mus musculus
cctcttaaggtgttgaagatttcaa

SEQ ID NO: 598714 - DNA, 25 bp, Mus musculus
cctcttacaattaggtggctgacga

SEQ ID NO: 598715 - DNA, 25 bp, Mus musculus
cctcttacaatttggtggctgacga

SEQ ID NO: 598716 - DNA, 25 bp, Mus musculus
cctcttacaggaccggggccattct

SEQ ID NO: 598717 - DNA, 25 bp, Mus musculus
cctcttacaggagcggggccattct

SEQ ID NO: 598718 - DNA, 25 bp, Mus musculus
cctcttacatatcgcagggatcgta

SEQ ID NO: 598719 - DNA, 25 bp, Mus musculus
cctcttacatatggcagggatcgta

SEQ ID NO: 598720 - DNA, 25 bp, Mus musculus
cctcttagagccatggacatctctg

SEQ ID NO: 598721 - DNA, 25 bp, Mus musculus
cctcttagagccttggacatctctg

SEQ ID NO: 598722 - DNA, 25 bp, Mus musculus
cctcttagggttcgctttgtgtgca

SEQ ID NO: 598723 - DNA, 25 bp, Mus musculus
cctcttagggttggctttgtgtgca

SEQ ID NO: 598724 - DNA, 25 bp, Mus musculus
cctcttatcaagacgctgtctcagc

SEQ ID NO: 598725 - DNA, 25 bp, Mus musculus
cctcttatcaagtcgctgtctcagc

SEQ ID NO: 598726 - DNA, 25 bp, Mus musculus
cctcttatgtccacagagcaattgg

SEQ ID NO: 598727 - DNA, 25 bp, Mus musculus
cctcttatgtcctcagagcaattgg

SEQ ID NO: 598728 - DNA, 25 bp, Mus musculus
cctcttcaatgcatgctgcagtggc

SEQ ID NO: 598729 - DNA, 25 bp, Mus musculus
cctcttcaatgcttgctgcagtggc

SEQ ID NO: 598730 - DNA, 25 bp, Mus musculus
cctcttcaatgtcgtgaccaaggac

SEQ ID NO: 598731 - DNA, 25 bp, Mus musculus
cctcttcaatgtggtgaccaaggac

SEQ ID NO: 598732 - DNA, 25 bp, Mus musculus
cctcttcagcttcgtcctgggtgtc

SEQ ID NO: 598733 - DNA, 25 bp, Mus musculus
cctcttcagcttggtcctgggtgtc

SEQ ID NO: 598734 - DNA, 25 bp, Mus musculus
cctcttcagtgcctactacgttgca

SEQ ID NO: 598735 - DNA, 25 bp, Mus musculus
cctcttcagtgcgtactacgttgca

SEQ ID NO: 598736 - DNA, 25 bp, Mus musculus
cctcttcatgggacatctgggcaga

SEQ ID NO: 598737 - DNA, 25 bp, Mus musculus
cctcttcatgggtcatctgggcaga

SEQ ID NO: 598738 - DNA, 25 bp, Mus musculus
cctcttcattccagtagccgtcatg

SEQ ID NO: 598739 - DNA, 25 bp, Mus musculus
cctcttcattcctgtagccgtcatg

SEQ ID NO: 598740 - DNA, 25 bp, Mus musculus
cctcttccacaaagagtcgtcttta

SEQ ID NO: 598741 - DNA, 25 bp, Mus musculus
cctcttccacaatgagtcgtcttta

SEQ ID NO: 598742 - DNA, 25 bp, Mus musculus
cctcttccaggaaataaacttcatt

SEQ ID NO: 598743 - DNA, 25 bp, Mus musculus
cctcttccaggatataaacttcatt

SEQ ID NO: 598744 - DNA, 25 bp, Mus musculus
cctcttccataactcaggtgctttg

SEQ ID NO: 598745 - DNA, 25 bp, Mus musculus
cctcttccataagtcaggtgctttg

SEQ ID NO: 598746 - DNA, 25 bp, Mus musculus
cctcttccgtaaagcgggatgtgct

SEQ ID NO: 598747 - DNA, 25 bp, Mus musculus
cctcttccgtaatgcgggatgtgct

SEQ ID NO: 598748 - DNA, 25 bp, Mus musculus
cctcttcctgatagtggctagtgca

SEQ ID NO: 598749 - DNA, 25 bp, Mus musculus
cctcttcctgattgtggctagtgca

SEQ ID NO: 598750 - DNA, 25 bp, Mus musculus
cctcttcgctctacaggtttcttgg

SEQ ID NO: 598751 - DNA, 25 bp, Mus musculus
cctcttcgctcttcaggtttcttgg

SEQ ID NO: 598752 - DNA, 25 bp, Mus musculus
cctcttctacttcaacgctgacaag

SEQ ID NO: 598753 - DNA, 25 bp, Mus musculus
cctcttctacttcgcaggacagtgg

SEQ ID NO: 598754 - DNA, 25 bp, Mus musculus
cctcttctacttgaacgctgacaag

SEQ ID NO: 598755 - DNA, 25 bp, Mus musculus
cctcttctacttggcaggacagtgg

SEQ ID NO: 598756 - DNA, 25 bp, Mus musculus
cctcttctccggaactcaggacaga

SEQ ID NO: 598757 - DNA, 25 bp, Mus musculus
cctcttctccggtactcaggacaga

SEQ ID NO: 598758 - DNA, 25 bp, Mus musculus
cctcttctgcaaaggctccagcttg

SEQ ID NO: 598759 - DNA, 25 bp, Mus musculus
cctcttctgcaatggctccagcttg

SEQ ID NO: 598760 - DNA, 25 bp, Mus musculus
cctcttcttagaccctgtgctgtgg

SEQ ID NO: 598761 - DNA, 25 bp, Mus musculus
cctcttcttagagcctgtgctgtgg

SEQ ID NO: 598762 - DNA, 25 bp, Mus musculus
cctcttcttcatcctagtggctgtc

SEQ ID NO: 598763 - DNA, 25 bp, Mus musculus
cctcttcttcatgctagtggctgtc

SEQ ID NO: 598764 - DNA, 25 bp, Mus musculus
cctcttcttgggatccaacatcggc

SEQ ID NO: 598765 - DNA, 25 bp, Mus musculus
cctcttcttgggttccaacatcggc

SEQ ID NO: 598766 - DNA, 25 bp, Mus musculus
cctcttgaaactctagatgccttgg

SEQ ID NO: 598767 - DNA, 25 bp, Mus musculus
cctcttgaaactgtagatgccttgg

SEQ ID NO: 598768 - DNA, 25 bp, Mus musculus
cctcttgaacgcagggactgcaggt

SEQ ID NO: 598769 - DNA, 25 bp, Mus musculus
cctcttgaacgctgggactgcaggt

SEQ ID NO: 598770 - DNA, 25 bp, Mus musculus
cctcttgaagagaagcatcagcgat

SEQ ID NO: 598771 - DNA, 25 bp, Mus musculus
cctcttgaagagtagcatcagcgat

SEQ ID NO: 598772 - DNA, 25 bp, Mus musculus
cctcttgatgagaactggtgacaag

SEQ ID NO: 598773 - DNA, 25 bp, Mus musculus
cctcttgatgagtactggtgacaag

SEQ ID NO: 598774 - DNA, 25 bp, Mus musculus
cctcttgccagccagggtcttgcaa

SEQ ID NO: 598775 - DNA, 25 bp, Mus musculus
cctcttgccagcgagggtcttgcaa

SEQ ID NO: 598776 - DNA, 25 bp, Mus musculus
cctcttggcaggctgagaaaataaa

SEQ ID NO: 598777 - DNA, 25 bp, Mus musculus
cctcttggcagggtgagaaaataaa

SEQ ID NO: 598778 - DNA, 25 bp, Mus musculus
cctcttgggcgccaactagttgtga

SEQ ID NO: 598779 - DNA, 25 bp, Mus musculus
cctcttgggcgcgaactagttgtga

SEQ ID NO: 598780 - DNA, 25 bp, Mus musculus
cctcttgtaaacatggaatagctaa

SEQ ID NO: 598781 - DNA, 25 bp, Mus musculus
cctcttgtaaacttggaatagctaa

SEQ ID NO: 598782 - DNA, 25 bp, Mus musculus
cctcttgtccggcagcagatcaatg

SEQ ID NO: 598783 - DNA, 25 bp, Mus musculus
cctcttgtccgggagcagatcaatg

SEQ ID NO: 598784 - DNA, 25 bp, Mus musculus
cctcttgtcctcaatgacggataca

SEQ ID NO: 598785 - DNA, 25 bp, Mus musculus
cctcttgtcctctatgacggataca

SEQ ID NO: 598786 - DNA, 25 bp, Mus musculus
cctcttgttggacctacaactcctg

SEQ ID NO: 598787 - DNA, 25 bp, Mus musculus
cctcttgttggagctacaactcctg

SEQ ID NO: 598788 - DNA, 25 bp, Mus musculus
cctcttgtttacagttgccgggaga

SEQ ID NO: 598789 - DNA, 25 bp, Mus musculus
cctcttgtttactgttgccgggaga

SEQ ID NO: 598790 - DNA, 25 bp, Mus musculus
cctcttgtttgaaggccagccctta

SEQ ID NO: 598791 - DNA, 25 bp, Mus musculus
cctcttgtttgatggccagccctta

SEQ ID NO: 598792 - DNA, 25 bp, Mus musculus
cctctttatgtcattgtggagtacg

SEQ ID NO: 598793 - DNA, 25 bp, Mus musculus
cctctttatgtctttgtggagtacg

SEQ ID NO: 598794 - DNA, 25 bp, Mus musculus
cctctttcgcacagggatgctggaa

SEQ ID NO: 598795 - DNA, 25 bp, Mus musculus
cctctttcgcactgggatgctggaa

SEQ ID NO: 598796 - DNA, 25 bp, Mus musculus
cctctttctaccacagtgtagagaa

SEQ ID NO: 598797 - DNA, 25 bp, Mus musculus
cctctttctacctcagtgtagagaa

SEQ ID NO: 598798 - DNA, 25 bp, Mus musculus
cctctttgctgaagccatgcagctg

SEQ ID NO: 598799 - DNA, 25 bp, Mus musculus
cctctttgctgatgccatgcagctg

SEQ ID NO: 598800 - DNA, 25 bp, Mus musculus
cctctttgcttcctgtgccccatct

SEQ ID NO: 598801 - DNA, 25 bp, Mus musculus
cctctttgcttcgtgtgccccatct

SEQ ID NO: 598802 - DNA, 25 bp, Mus musculus
cctctttggaaacaggattagttag

SEQ ID NO: 598803 - DNA, 25 bp, Mus musculus
cctctttggaaagaggattagttag

SEQ ID NO: 598804 - DNA, 25 bp, Mus musculus
cctctttgggtgatggctatcggac

SEQ ID NO: 598805 - DNA, 25 bp, Mus musculus
cctctttgggtgttggctatcggac

SEQ ID NO: 598806 - DNA, 25 bp, Mus musculus
cctctttggtctctaaagattccat

SEQ ID NO: 598807 - DNA, 25 bp, Mus musculus
cctctttggtctgtaaagattccat

SEQ ID NO: 598808 - DNA, 25 bp, Mus musculus
cctctttgtaaaaattctcatcgtg

SEQ ID NO: 598809 - DNA, 25 bp, Mus musculus
cctctttgtaaatattctcatcgtg

SEQ ID NO: 598810 - DNA, 25 bp, Mus musculus
cctctttgtcccaaggactcagaca

SEQ ID NO: 598811 - DNA, 25 bp, Mus musculus
cctctttgtccctaggactcagaca

SEQ ID NO: 598812 - DNA, 25 bp, Mus musculus
cctctttgtggacagcggtgctgac

SEQ ID NO: 598813 - DNA, 25 bp, Mus musculus
cctctttgtggagagcggtgctgac

SEQ ID NO: 598814 - DNA, 25 bp, Mus musculus
cctcttttagtgcaagaggctctgg

SEQ ID NO: 598815 - DNA, 25 bp, Mus musculus
cctcttttagtggaagaggctctgg

SEQ ID NO: 598816 - DNA, 25 bp, Mus musculus
cctgaaaaatggcatctggacaagg

SEQ ID NO: 598817 - DNA, 25 bp, Mus musculus
cctgaaaaatgggatctggacaagg

SEQ ID NO: 598818 - DNA, 25 bp, Mus musculus
cctgaaaacaaccactccgctggag

SEQ ID NO: 598819 - DNA, 25 bp, Mus musculus
cctgaaaacaacgactccgctggag

SEQ ID NO: 598820 - DNA, 25 bp, Mus musculus
cctgaaaacaggatttaccagagga

SEQ ID NO: 598821 - DNA, 25 bp, Mus musculus
cctgaaaacaggttttaccagagga

SEQ ID NO: 598822 - DNA, 25 bp, Mus musculus
cctgaaaactggcaacatgctaaat

SEQ ID NO: 598823 - DNA, 25 bp, Mus musculus
cctgaaaactgggaacatgctaaat

SEQ ID NO: 598824 - DNA, 25 bp, Mus musculus
cctgaaaagcgaccgcgctgtcaag

SEQ ID NO: 598825 - DNA, 25 bp, Mus musculus
cctgaaaagcgagcgcgctgtcaag

SEQ ID NO: 598826 - DNA, 25 bp, Mus musculus
cctgaaaatgctccagtgccggagc

SEQ ID NO: 598827 - DNA, 25 bp, Mus musculus
cctgaaaatgctgcagtgccggagc

SEQ ID NO: 598828 - DNA, 25 bp, Mus musculus
cctgaaacagatcgagatcaacact

SEQ ID NO: 598829 - DNA, 25 bp, Mus musculus
cctgaaacagatggagatcaacact

SEQ ID NO: 598830 - DNA, 25 bp, Mus musculus
cctgaaacaggcaatttgatctctg

SEQ ID NO: 598831 - DNA, 25 bp, Mus musculus
cctgaaacaggctatttgatctctg

SEQ ID NO: 598832 - DNA, 25 bp, Mus musculus
cctgaaacgaggcatgagatgttct

SEQ ID NO: 598833 - DNA, 25 bp, Mus musculus
cctgaaacgagggatgagatgttct

SEQ ID NO: 598834 - DNA, 25 bp, Mus musculus
cctgaaacttaaagcaaggagcctg

SEQ ID NO: 598835 - DNA, 25 bp, Mus musculus
cctgaaacttaatgcaaggagcctg

SEQ ID NO: 598836 - DNA, 25 bp, Mus musculus
cctgaaagatgaattcacatatgaa

SEQ ID NO: 598837 - DNA, 25 bp, Mus musculus
cctgaaagatgatttcacatatgaa

SEQ ID NO: 598838 - DNA, 25 bp, Mus musculus
cctgaaagccgacaacaaaggcaat

SEQ ID NO: 598839 - DNA, 25 bp, Mus musculus
cctgaaagccgacaagctggtgatg

SEQ ID NO: 598840 - DNA, 25 bp, Mus musculus
cctgaaagccgagaacaaaggcaat

SEQ ID NO: 598841 - DNA, 25 bp, Mus musculus
cctgaaagccgagaagctggtgatg

SEQ ID NO: 598842 - DNA, 25 bp, Mus musculus
cctgaaagccggacagtggcagtga

SEQ ID NO: 598843 - DNA, 25 bp, Mus musculus
cctgaaagccggtcagtggcagtga

SEQ ID NO: 598844 - DNA, 25 bp, Mus musculus
cctgaaagctttcgctccatgctgg

SEQ ID NO: 598845 - DNA, 25 bp, Mus musculus
cctgaaagctttggctccatgctgg

SEQ ID NO: 598846 - DNA, 25 bp, Mus musculus
cctgaaaggactcattaatttgtct

SEQ ID NO: 598847 - DNA, 25 bp, Mus musculus
cctgaaaggactgattaatttgtct

SEQ ID NO: 598848 - DNA, 25 bp, Mus musculus
cctgaaaggcctcgattatctgcac

SEQ ID NO: 598849 - DNA, 25 bp, Mus musculus
cctgaaaggcctggattatctgcac

SEQ ID NO: 598850 - DNA, 25 bp, Mus musculus
cctgaaaggtcaatgaagtcacatc

SEQ ID NO: 598851 - DNA, 25 bp, Mus musculus
cctgaaaggtcattgaagtcacatc

SEQ ID NO: 598852 - DNA, 25 bp, Mus musculus
cctgaaaggtggaccgaaggatcaa

SEQ ID NO: 598853 - DNA, 25 bp, Mus musculus
cctgaaaggtggtccgaaggatcaa

SEQ ID NO: 598854 - DNA, 25 bp, Mus musculus
cctgaaagtgggaacaacctgtgcc

SEQ ID NO: 598855 - DNA, 25 bp, Mus musculus
cctgaaagtgggtacaacctgtgcc

SEQ ID NO: 598856 - DNA, 25 bp, Mus musculus
cctgaaataacgagggagatgctct

SEQ ID NO: 598857 - DNA, 25 bp, Mus musculus
cctgaaataacgtgggagatgctct

SEQ ID NO: 598858 - DNA, 25 bp, Mus musculus
cctgaaatcattcactgctgtctgt

SEQ ID NO: 598859 - DNA, 25 bp, Mus musculus
cctgaaatcattgactgctgtctgt

SEQ ID NO: 598860 - DNA, 25 bp, Mus musculus
cctgaaattgtaagcggtagagatc

SEQ ID NO: 598861 - DNA, 25 bp, Mus musculus
cctgaaattgtatgcggtagagatc

SEQ ID NO: 598862 - DNA, 25 bp, Mus musculus
cctgaacaagggatggctggctccg

SEQ ID NO: 598863 - DNA, 25 bp, Mus musculus
cctgaacaagggttggctggctccg

SEQ ID NO: 598864 - DNA, 25 bp, Mus musculus
cctgaacacctaaaagcgtcttgcc

SEQ ID NO: 598865 - DNA, 25 bp, Mus musculus
cctgaacacctataagcgtcttgcc

SEQ ID NO: 598866 - DNA, 25 bp, Mus musculus
cctgaacacctcactgggaaacatt

SEQ ID NO: 598867 - DNA, 25 bp, Mus musculus
cctgaacacctctctgggaaacatt

SEQ ID NO: 598868 - DNA, 25 bp, Mus musculus
cctgaacagatgcaagacagcgtcc

SEQ ID NO: 598869 - DNA, 25 bp, Mus musculus
cctgaacagatggaagacagcgtcc

SEQ ID NO: 598870 - DNA, 25 bp, Mus musculus
cctgaacaggatcctcgatactgct

SEQ ID NO: 598871 - DNA, 25 bp, Mus musculus
cctgaacaggatgctcgatactgct

SEQ ID NO: 598872 - DNA, 25 bp, Mus musculus
cctgaacaggtgcttctgggttgtt

SEQ ID NO: 598873 - DNA, 25 bp, Mus musculus
cctgaacaggtggttctgggttgtt

SEQ ID NO: 598874 - DNA, 25 bp, Mus musculus
cctgaacagtatctggtacctccag

SEQ ID NO: 598875 - DNA, 25 bp, Mus musculus
cctgaacagtatgtggtacctccag

SEQ ID NO: 598876 - DNA, 25 bp, Mus musculus
cctgaacagtggaaccagttttgtg

SEQ ID NO: 598877 - DNA, 25 bp, Mus musculus
cctgaacagtggtaccagttttgtg

SEQ ID NO: 598878 - DNA, 25 bp, Mus musculus
cctgaacatccgaatgggcatcctc

SEQ ID NO: 598879 - DNA, 25 bp, Mus musculus
cctgaacatccgtatgggcatcctc

SEQ ID NO: 598880 - DNA, 25 bp, Mus musculus
cctgaacatctaagagcctgactat

SEQ ID NO: 598881 - DNA, 25 bp, Mus musculus
cctgaacatctatgagcctgactat

SEQ ID NO: 598882 - DNA, 25 bp, Mus musculus
cctgaacatggtactgtccaggaaa

SEQ ID NO: 598883 - DNA, 25 bp, Mus musculus
cctgaacatggttctgtccaggaaa

SEQ ID NO: 598884 - DNA, 25 bp, Mus musculus
cctgaacattttctggacgacaatc

SEQ ID NO: 598885 - DNA, 25 bp, Mus musculus
cctgaacattttgtggacgacaatc

SEQ ID NO: 598886 - DNA, 25 bp, Mus musculus
cctgaaccacaccaagtgccggtta

SEQ ID NO: 598887 - DNA, 25 bp, Mus musculus
cctgaaccacacgaagtgccggtta

SEQ ID NO: 598888 - DNA, 25 bp, Mus musculus
cctgaaccaggtcgaagtgaagact

SEQ ID NO: 598889 - DNA, 25 bp, Mus musculus
cctgaaccaggtggaagtgaagact

SEQ ID NO: 598890 - DNA, 25 bp, Mus musculus
cctgaacccagacatgaaagaaaat

SEQ ID NO: 598891 - DNA, 25 bp, Mus musculus
cctgaacccagagatgaaagaaaat

SEQ ID NO: 598892 - DNA, 25 bp, Mus musculus
cctgaaccctccagcaagaaggaat

SEQ ID NO: 598893 - DNA, 25 bp, Mus musculus
cctgaaccctcctgcaagaaggaat

SEQ ID NO: 598894 - DNA, 25 bp, Mus musculus
cctgaaccctgacaatgtgctgaaa

SEQ ID NO: 598895 - DNA, 25 bp, Mus musculus
cctgaaccctgagaatgtgctgaaa

SEQ ID NO: 598896 - DNA, 25 bp, Mus musculus
cctgaaccgggacagtgactgcttt

SEQ ID NO: 598897 - DNA, 25 bp, Mus musculus
cctgaaccgggagagtgactgcttt

SEQ ID NO: 598898 - DNA, 25 bp, Mus musculus
cctgaacctgtgcaatatagacgtg

SEQ ID NO: 598899 - DNA, 25 bp, Mus musculus
cctgaacctgtggaatatagacgtg

SEQ ID NO: 598900 - DNA, 25 bp, Mus musculus
cctgaacgaggaatgatttttgttt

SEQ ID NO: 598901 - DNA, 25 bp, Mus musculus
cctgaacgaggattgatttttgttt

SEQ ID NO: 598902 - DNA, 25 bp, Mus musculus
cctgaacggtggatgagaacgctct

SEQ ID NO: 598903 - DNA, 25 bp, Mus musculus
cctgaacggtggttgagaacgctct

SEQ ID NO: 598904 - DNA, 25 bp, Mus musculus
cctgaacgtctgcagtctatttcac

SEQ ID NO: 598905 - DNA, 25 bp, Mus musculus
cctgaacgtctggagtctatttcac

SEQ ID NO: 598906 - DNA, 25 bp, Mus musculus
cctgaacgtgatcatgatgggtgca

SEQ ID NO: 598907 - DNA, 25 bp, Mus musculus
cctgaacgtgatgatgatgggtgca

SEQ ID NO: 598908 - DNA, 25 bp, Mus musculus
cctgaactactgaaaagatcaattt

SEQ ID NO: 598909 - DNA, 25 bp, Mus musculus
cctgaactactgtaaagatcaattt

SEQ ID NO: 598910 - DNA, 25 bp, Mus musculus
cctgaactgccccttcctctaagga

SEQ ID NO: 598911 - DNA, 25 bp, Mus musculus
cctgaactgcccgttcctctaagga

SEQ ID NO: 598912 - DNA, 25 bp, Mus musculus
cctgaactgtacagcccagaaggag

SEQ ID NO: 598913 - DNA, 25 bp, Mus musculus
cctgaactgtactgcccagaaggag

SEQ ID NO: 598914 - DNA, 25 bp, Mus musculus
cctgaacttcagagggaacaagaac

SEQ ID NO: 598915 - DNA, 25 bp, Mus musculus
cctgaacttcagtgggaacaagaac

SEQ ID NO: 598916 - DNA, 25 bp, Mus musculus
cctgaacttcatagtgaaggaatcc

SEQ ID NO: 598917 - DNA, 25 bp, Mus musculus
cctgaacttcattgtgaaggaatcc

SEQ ID NO: 598918 - DNA, 25 bp, Mus musculus
cctgaagaagatactcattgaggag

SEQ ID NO: 598919 - DNA, 25 bp, Mus musculus
cctgaagaagattctcattgaggag

SEQ ID NO: 598920 - DNA, 25 bp, Mus musculus
cctgaagaagctcaagagtaaacgc

SEQ ID NO: 598921 - DNA, 25 bp, Mus musculus
cctgaagaagctgaagagtaaacgc

SEQ ID NO: 598922 - DNA, 25 bp, Mus musculus
cctgaagaaggcaatgcagactgtg

SEQ ID NO: 598923 - DNA, 25 bp, Mus musculus
cctgaagaaggctatgcagactgtg

SEQ ID NO: 598924 - DNA, 25 bp, Mus musculus
cctgaagaagttctgccggaaggac

SEQ ID NO: 598925 - DNA, 25 bp, Mus musculus
cctgaagaagttgtgccggaaggac

SEQ ID NO: 598926 - DNA, 25 bp, Mus musculus
cctgaagaatgcctcagatggtgct

SEQ ID NO: 598927 - DNA, 25 bp, Mus musculus
cctgaagaatgcgtcagatggtgct

SEQ ID NO: 598928 - DNA, 25 bp, Mus musculus
cctgaagaatgtcgtggctctcgac

SEQ ID NO: 598929 - DNA, 25 bp, Mus musculus
cctgaagaatgtggtggctctcgac

SEQ ID NO: 598930 - DNA, 25 bp, Mus musculus
cctgaagaccaacagcaacggtgca

SEQ ID NO: 598931 - DNA, 25 bp, Mus musculus
cctgaagaccaagagcaacggtgca

SEQ ID NO: 598932 - DNA, 25 bp, Mus musculus
cctgaagacccacttcgtggtgcac

SEQ ID NO: 598933 - DNA, 25 bp, Mus musculus
cctgaagacccagttcgtggtgcac

SEQ ID NO: 598934 - DNA, 25 bp, Mus musculus
cctgaagactataacacgcggccag

SEQ ID NO: 598935 - DNA, 25 bp, Mus musculus
cctgaagactattacacgcggccag

SEQ ID NO: 598936 - DNA, 25 bp, Mus musculus
cctgaagagatgacatcactgacaa

SEQ ID NO: 598937 - DNA, 25 bp, Mus musculus
cctgaagagatgtcatcactgacaa

SEQ ID NO: 598938 - DNA, 25 bp, Mus musculus
cctgaagagcatcatcaaggaggtg

SEQ ID NO: 598939 - DNA, 25 bp, Mus musculus
cctgaagagcatgatcaaggaggtg

SEQ ID NO: 598940 - DNA, 25 bp, Mus musculus
cctgaagagtgcagtgtccgcagtg

SEQ ID NO: 598941 - DNA, 25 bp, Mus musculus
cctgaagagtgctgtgtccgcagtg

SEQ ID NO: 598942 - DNA, 25 bp, Mus musculus
cctgaagataggaagtcagtgcttt

SEQ ID NO: 598943 - DNA, 25 bp, Mus musculus
cctgaagataggtagtcagtgcttt

SEQ ID NO: 598944 - DNA, 25 bp, Mus musculus
cctgaagatgttaacagcgcagtct

SEQ ID NO: 598945 - DNA, 25 bp, Mus musculus
cctgaagatgtttacagcgcagtct

SEQ ID NO: 598946 - DNA, 25 bp, Mus musculus
cctgaagcaaaacatgtcatctgca

SEQ ID NO: 598947 - DNA, 25 bp, Mus musculus
cctgaagcaaaagatgtcatctgca

SEQ ID NO: 598948 - DNA, 25 bp, Mus musculus
cctgaagcacagaaggtgtgcaact

SEQ ID NO: 598949 - DNA, 25 bp, Mus musculus
cctgaagcacagtaggtgtgcaact

SEQ ID NO: 598950 - DNA, 25 bp, Mus musculus
cctgaagcagcacatcgaaagtgag

SEQ ID NO: 598951 - DNA, 25 bp, Mus musculus
cctgaagcagcagatcgaaagtgag

SEQ ID NO: 598952 - DNA, 25 bp, Mus musculus
cctgaagcaggaagtctcggttaga

SEQ ID NO: 598953 - DNA, 25 bp, Mus musculus
cctgaagcaggatgtctcggttaga
